United States Patent 7,618,814 (MICRORNA-RELATED NUCLEIC ACIDS AND USES THEREOF) - sequence listing, part 5

SEQ ID NO: 155839 - RNA, 32 nt, Human
gacugugccacugcacuccagccugggcaaca

SEQ ID NO: 155840 - RNA, 32 nt, Human
gacugugccacugcacuccagccugggugaca

SEQ ID NO: 155841 - RNA, 32 nt, Human
gacugugccacugcacuccagccuggucaaca

SEQ ID NO: 155842 - RNA, 32 nt, Human
gacugugccacugcaguccagccugggugaca

SEQ ID NO: 155843 - RNA, 32 nt, Human
gacugugccauugcacuccagucggguuaaca

SEQ ID NO: 155844 - RNA, 32 nt, Human
gacugugcccagggcccugccucuugugcaga

SEQ ID NO: 155845 - RNA, 32 nt, Human
gacugugcuacugcacuccagccugggcaaca

SEQ ID NO: 155846 - RNA, 32 nt, Human
gacugugcucuaccuguuccuucucugaagcu

SEQ ID NO: 155847 - RNA, 32 nt, Human
gacugugcuggguuggaaugugaacaauaaag

SEQ ID NO: 155848 - RNA, 32 nt, Human
gacugugcugugaaagagaucugugaccuugc

SEQ ID NO: 155849 - RNA, 32 nt, Human
gacugugcugugcagcucucuaaaugggaauu

SEQ ID NO: 155850 - RNA, 32 nt, Human
gacugugcuguuccucucuguccuggggcucc

SEQ ID NO: 155851 - RNA, 21 nt, Human
gacugugcuucucgugcuuca

SEQ ID NO: 155852 - RNA, 32 nt, Human
gacugugcuucucgugcuucauguagaacccu

SEQ ID NO: 155853 - RNA, 21 nt, Human
gacuguggaagagauuacaaa

SEQ ID NO: 155854 - RNA, 32 nt, Human
gacuguggacuggugggcuccccucugggcca

SEQ ID NO: 155855 - RNA, 32 nt, Human
gacuguggacuucacucaggaggaguggcagc

SEQ ID NO: 155856 - RNA, 32 nt, Human
gacuguggagggacuuuccggagcagcucgag

SEQ ID NO: 155857 - RNA, 32 nt, Human
gacuguggcaccugacccagugcccugcgaca

SEQ ID NO: 155858 - RNA, 32 nt, Human
gacuguggccaggguaguucucagguugugcu

SEQ ID NO: 155859 - RNA, 32 nt, Human
gacuguggccauggcucugacugacauagacc

SEQ ID NO: 155860 - RNA, 32 nt, Human
gacuguggcccaggaugcugccgaacagugag

SEQ ID NO: 155861 - RNA, 32 nt, Human
gacuguggccugaguuccccagccccucuccu

SEQ ID NO: 155862 - RNA, 32 nt, Human
gacuguggccuucuucucacagcuccacuagg

SEQ ID NO: 155863 - RNA, 32 nt, Human
gacuguggcgauggcucugaugaggaggguug

SEQ ID NO: 155864 - RNA, 32 nt, Human
gacuguggcugcagagaccuugcgaccaugug

SEQ ID NO: 155865 - RNA, 32 nt, Human
gacuguggcugguauaucuggcugccauuuuu

SEQ ID NO: 155866 - RNA, 32 nt, Human
gacugugggaaaggaagagaaggagcaaguaa

SEQ ID NO: 155867 - RNA, 32 nt, Human
gacugugggaggaaagagcugcguggauagau

SEQ ID NO: 155868 - RNA, 32 nt, Human
gacugugggcugggaaacuguaccuaccucuc

SEQ ID NO: 155869 - RNA, 20 nt, Human
gacuguggguuccaaauuac

SEQ ID NO: 155870 - RNA, 32 nt, Human
gacuguggugggauucccgccucggcagcguc

SEQ ID NO: 155871 - RNA, 32 nt, Human
gacuguguaaaugagagaaagacuugauucag

SEQ ID NO: 155872 - RNA, 32 nt, Human
gacuguguaggugacagggagggaaagaugau

SEQ ID NO: 155873 - RNA, 32 nt, Human
gacugugucauugcacuccagccugggcgaca

SEQ ID NO: 155874 - RNA, 32 nt, Human
gacuguguccaggccacaugcaacuuaaagga

SEQ ID NO: 155875 - RNA, 32 nt, Human
gacugugucugaagauuuuaaauuccaaguca

SEQ ID NO: 155876 - RNA, 19 nt, Human
gacugugucuuucaugaca

SEQ ID NO: 155877 - RNA, 32 nt, Human
gacugugugugcccucugggcucugaguaccc

SEQ ID NO: 155878 - RNA, 32 nt, Human
gacuguguuacccaggcuggucuucaacucuu

SEQ ID NO: 155879 - RNA, 32 nt, Human
gacuguguugacugacgagccgagggguggcc

SEQ ID NO: 155880 - RNA, 32 nt, Human
gacuguguuuccauccuggccuagaggagcag

SEQ ID NO: 155881 - RNA, 32 nt, Human
gacuguguuugauguccuuuauugauacaaag

SEQ ID NO: 155882 - RNA, 32 nt, Human
gacuguuaacgccuccacaguggaccaagaaa

SEQ ID NO: 155883 - RNA, 32 nt, Human
gacuguuauuucuuuucuuccugcuuuccuac

SEQ ID NO: 155884 - RNA, 32 nt, Human
gacuguucaucuccuaugugaugcugaagacc

SEQ ID NO: 155885 - RNA, 32 nt, Human
gacuguuccagccuuagucugugcuuaaaaag

SEQ ID NO: 155886 - RNA, 18 nt, Human
gacuguuccauuuuaaca

SEQ ID NO: 155887 - RNA, 15 nt, Human
gacuguucccaucac

SEQ ID NO: 155888 - RNA, 17 nt, Human
gacuguucccuucgcau

SEQ ID NO: 155889 - RNA, 16 nt, Human
gacuguuccguuccac

SEQ ID NO: 155890 - RNA, 19 nt, Human
gacuguuccugucucagca

SEQ ID NO: 155891 - RNA, 32 nt, Human
gacuguucucauaguuaguugacucauauggu

SEQ ID NO: 155892 - RNA, 32 nt, Human
gacuguucucucuugacaggcaagcaagcaaa

SEQ ID NO: 155893 - RNA, 18 nt, Human
gacuguucugugucagca

SEQ ID NO: 155894 - RNA, 16 nt, Human
gacuguucuuuauaca

SEQ ID NO: 155895 - RNA, 32 nt, Human
gacuguugagcagucugcugucaggagagaug

SEQ ID NO: 155896 - RNA, 32 nt, Human
gacuguugcaccaggcugagaaagcagcaaua

SEQ ID NO: 155897 - RNA, 32 nt, Human
gacuguugcccaggcuggaguguaauggcgcc

SEQ ID NO: 155898 - RNA, 32 nt, Human
gacuguugcccuuuauuuaugcaaaaccaccu

SEQ ID NO: 155899 - RNA, 32 nt, Human
gacuguugcugcacuccagccugagugacaga

SEQ ID NO: 155900 - RNA, 32 nt, Human
gacuguugcuuccucuaacacauggggaggcu

SEQ ID NO: 155901 - RNA, 32 nt, Human
gacuguugggauuacaggcaugagccaccacg

SEQ ID NO: 155902 - RNA, 32 nt, Human
gacuguuggggaccaggaugcuggcaggucaa

SEQ ID NO: 155903 - RNA, 32 nt, Human
gacuguuuaaggccuuaacaggugaaucuaga

SEQ ID NO: 155904 - RNA, 16 nt, Human
gacuguuucacacaca

SEQ ID NO: 155905 - RNA, 32 nt, Human
gacuguuucagaaaggagaaagcagaggccuc

SEQ ID NO: 155906 - RNA, 32 nt, Human
gacuguuuccaucaaggguacacugccuucuc

SEQ ID NO: 155907 - RNA, 32 nt, Human
gacuguuucccaaccagcacccaaagacgggc

SEQ ID NO: 155908 - RNA, 32 nt, Human
gacuguuuccccuacaucuuuugagccacagu

SEQ ID NO: 155909 - RNA, 32 nt, Human
gacuguuucccuuuccuucaaggccuagagua

SEQ ID NO: 155910 - RNA, 32 nt, Human
gacuguuucucuuccucucuuucuuccuuuug

SEQ ID NO: 155911 - RNA, 32 nt, Human
gacuguuuggcacuugagacaaaccugccuuu

SEQ ID NO: 155912 - RNA, 16 nt, Human
gacuguuuucauccca

SEQ ID NO: 155913 - RNA, 32 nt, Human
gacuguuuucccaccauaagggacuaugauuu

SEQ ID NO: 155914 - RNA, 32 nt, Human
gacuguuuugagagugggacucacucugaagu

SEQ ID NO: 155915 - RNA, 32 nt, Human
gacuguuuuuauaaauaaacuguuucauaaau

SEQ ID NO: 155916 - RNA, 32 nt, Human
gacuuaaacaucuucugaaacagcacuguuuu

SEQ ID NO: 155917 - RNA, 32 nt, Human
gacuuaaagaauagucuggugaaguuacucga

SEQ ID NO: 155918 - RNA, 32 nt, Human
gacuuaaaggcaguuuucugaagaacucuuga

SEQ ID NO: 155919 - RNA, 32 nt, Human
gacuuaaaugucccugucugacagcuuugaag

SEQ ID NO: 155920 - RNA, 32 nt, Human
gacuuaacaaguguacugcagaauaaacuacc

SEQ ID NO: 155921 - RNA, 32 nt, Human
gacuuaaccaaacaucacagagcuguaaacca

SEQ ID NO: 155922 - RNA, 32 nt, Human
gacuuaaccaguaucaauuugaaaugcugauu

SEQ ID NO: 155923 - RNA, 32 nt, Human
gacuuaacguugaaauuuucuucaggaauuuu

SEQ ID NO: 155924 - RNA, 32 nt, Human
gacuuaacuaugcuuuuuaacucuuuuuccac

SEQ ID NO: 155925 - RNA, 32 nt, Human
gacuuaagacuacccuacaggaacccuguacu

SEQ ID NO: 155926 - RNA, 32 nt, Human
gacuuaagaucccacaccucacaaaccuacag

SEQ ID NO: 155927 - RNA, 32 nt, Human
gacuuaaggaagagacccugugagucugacaa

SEQ ID NO: 155928 - RNA, 32 nt, Human
gacuuaaggccuugccugucugacugacagcc

SEQ ID NO: 155929 - RNA, 31 nt, Human
gacuuaagugagaaagaacaagagaagcugc

SEQ ID NO: 155930 - RNA, 32 nt, Human
gacuuaauauacuacccguuccuuccacccag

SEQ ID NO: 155931 - RNA, 32 nt, Human
gacuuaaucagcagugaauacucuccaccaag

SEQ ID NO: 155932 - RNA, 32 nt, Human
gacuuaaucccagcuacgugggaggcagaggc

SEQ ID NO: 155933 - RNA, 32 nt, Human
gacuuacaaggaaagcacgaggcccuugagga

SEQ ID NO: 155934 - RNA, 32 nt, Human
gacuuacagggagagacacuagguaugugagc

SEQ ID NO: 155935 - RNA, 32 nt, Human
gacuuacagucagagaugaccuuaaauaugau

SEQ ID NO: 155936 - RNA, 32 nt, Human
gacuuacauaugcagccaagguugagagucac

SEQ ID NO: 155937 - RNA, 32 nt, Human
gacuuacauauguacaagugguaugugauaua

SEQ ID NO: 155938 - RNA, 32 nt, Human
gacuuaccacacacccuuccugcugcuccucu

SEQ ID NO: 155939 - RNA, 32 nt, Human
gacuuacgccuguaaucucagcacuuugggag

SEQ ID NO: 155940 - RNA, 32 nt, Human
gacuuacucaggugggacugggcacagggcag

SEQ ID NO: 155941 - RNA, 32 nt, Human
gacuuacucucuccucuccuuugagagguccc

SEQ ID NO: 155942 - RNA, 32 nt, Human
gacuuacugcagccuugaucucuugggcucaa

SEQ ID NO: 155943 - RNA, 32 nt, Human
gacuuacugccucugagccuuggcuuucugug

SEQ ID NO: 155944 - RNA, 32 nt, Human
gacuuacuuaaauuugggauucugcuuaaacu

SEQ ID NO: 155945 - RNA, 32 nt, Human
gacuuacuucucugcuaucuagaucugaacuc

SEQ ID NO: 155946 - RNA, 32 nt, Human
gacuuacuuguccuuaagcagaagccaggcug

SEQ ID NO: 155947 - RNA, 32 nt, Human
gacuuagagaagaaggagggaagaauagauga

SEQ ID NO: 155948 - RNA, 32 nt, Human
gacuuagagauggaauguaacuuugcuuacaa

SEQ ID NO: 155949 - RNA, 32 nt, Human
gacuuagaucuuccaccucacucccucagcca

SEQ ID NO: 155950 - RNA, 32 nt, Human
gacuuagcaaagcagagauuaucagugacuuu

SEQ ID NO: 155951 - RNA, 32 nt, Human
gacuuagccuccagaauugagagaaguaaaug

SEQ ID NO: 155952 - RNA, 32 nt, Human
gacuuagcuggguuuauucaaagugggcgggu

SEQ ID NO: 155953 - RNA, 32 nt, Human
gacuuagcugugauacugacagguaagcaaca

SEQ ID NO: 155954 - RNA, 32 nt, Human
gacuuaggaauagagacagccagagagaaaug

SEQ ID NO: 155955 - RNA, 32 nt, Human
gacuuagggaggcagaguggaggaagugagag

SEQ ID NO: 155956 - RNA, 32 nt, Human
gacuuaguccaguucccugugaucucaaaaca

SEQ ID NO: 155957 - RNA, 32 nt, Human
gacuuagucccacccagcaccauaaagaaagg

SEQ ID NO: 155958 - RNA, 32 nt, Human
gacuuagugauggggaacacccagggacaugc

SEQ ID NO: 155959 - RNA, 32 nt, Human
gacuuauacaguaagggcuucaacugaccuua

SEQ ID NO: 155960 - RNA, 32 nt, Human
gacuuauacaguaagggcuucaacugaucuua

SEQ ID NO: 155961 - RNA, 32 nt, Human
gacuuaucuccucacuccuuuuucucuccuua

SEQ ID NO: 155962 - RNA, 32 nt, Human
gacuuaucuguggagccuggugcuccaggaug

SEQ ID NO: 155963 - RNA, 32 nt, Human
gacuuauucaaugaaagugaaaaagaagcucu

SEQ ID NO: 155964 - RNA, 32 nt, Human
gacuuauuuauuugcaggaacaaauggugccu

SEQ ID NO: 155965 - RNA, 32 nt, Human
gacuucaaaaauuaauaaaaagaaaagaaaaa

SEQ ID NO: 155966 - RNA, 32 nt, Human
gacuucaaagagaccaugguuccguuggaggc

SEQ ID NO: 155967 - RNA, 19 nt, Human
gacuucaaagugcucagua

SEQ ID NO: 155968 - RNA, 32 nt, Human
gacuucaaauugcaggaccaagcccuaaagga

SEQ ID NO: 155969 - RNA, 24 nt, Human
gacuucaaauugcaucuagaauua

SEQ ID NO: 155970 - RNA, 32 nt, Human
gacuucaagauccucuugccacaucuugaaaa

SEQ ID NO: 155971 - RNA, 17 nt, Human
gacuucacacgacagca

SEQ ID NO: 155972 - RNA, 32 nt, Human
gacuucacagaaucgucugagaaaggagagcu

SEQ ID NO: 155973 - RNA, 32 nt, Human
gacuucaccguguuggccaggcuggucuugaa

SEQ ID NO: 155974 - RNA, 22 nt, Human
gacuucacuacguugauugcua

SEQ ID NO: 155975 - RNA, 32 nt, Human
gacuucacugugcuucccagccccaggguuuc

SEQ ID NO: 155976 - RNA, 32 nt, Human
gacuucagacacacaccacaccucaaauauau

SEQ ID NO: 155977 - RNA, 22 nt, Human
gacuucagagaaagcccugcag

SEQ ID NO: 155978 - RNA, 32 nt, Human
gacuucagagauccgccucccuugcccuuccc

SEQ ID NO: 155979 - RNA, 32 nt, Human
gacuucagauccacccauggcuguaauggaug

SEQ ID NO: 155980 - RNA, 32 nt, Human
gacuucagauuccauacugagaucguucccag

SEQ ID NO: 155981 - RNA, 22 nt, Human
gacuucagcucucugaaggcug

SEQ ID NO: 155982 - RNA, 32 nt, Human
gacuucaggauagaauucuccaucaaauauac

SEQ ID NO: 155983 - RNA, 32 nt, Human
gacuucaggcagcaggaggcugugugucccug

SEQ ID NO: 155984 - RNA, 32 nt, Human
gacuucagggagaccuggcuugggcuaaaauc

SEQ ID NO: 155985 - RNA, 32 nt, Human
gacuucaguagcaaaccacuacagucaguacc

SEQ ID NO: 155986 - RNA, 21 nt, Human
gacuucaguccuagcccccag

SEQ ID NO: 155987 - RNA, 19 nt, Human
gacuucaguccuggucugc

SEQ ID NO: 155988 - RNA, 32 nt, Human
gacuucagugcccugaggaaaaggcuuuggga

SEQ ID NO: 155989 - RNA, 32 nt, Human
gacuucagugccuuugguguuccagaagcacu

SEQ ID NO: 155990 - RNA, 32 nt, Human
gacuucauaaaagccaucucagagccauugau

SEQ ID NO: 155991 - RNA, 32 nt, Human
gacuucauccucccuucucuguccacaccacg

SEQ ID NO: 155992 - RNA, 32 nt, Human
gacuucauccugucauuccagccuggggucug

SEQ ID NO: 155993 - RNA, 32 nt, Human
gacuucauggugcuggaugggagacgcuagcg

SEQ ID NO: 155994 - RNA, 32 nt, Human
gacuucauguagagaagaaagcacuggacuga

SEQ ID NO: 155995 - RNA, 32 nt, Human
gacuucauguaucugugucugugguucauuuu

SEQ ID NO: 155996 - RNA, 32 nt, Human
gacuuccacagcuuucuuuucuacagcugcua

SEQ ID NO: 155997 - RNA, 32 nt, Human
gacuuccagaacucuuaacgugaacauuuugu

SEQ ID NO: 155998 - RNA, 32 nt, Human
gacuuccagcagaaugggaaugggggaaacac

SEQ ID NO: 155999 - RNA, 32 nt, Human
gacuuccaguacuguccucgaccaugggcaga

SEQ ID NO: 156000 - RNA, 19 nt, Human
gacuuccauguccugguua

SEQ ID NO: 156001 - RNA, 32 nt, Human
gacuucccaaagugcugggauuacagcgugag

SEQ ID NO: 156002 - RNA, 32 nt, Human
gacuucccaaagugcugggauuacaggcggga

SEQ ID NO: 156003 - RNA, 32 nt, Human
gacuucccaaagugcugggauuacagguguga

SEQ ID NO: 156004 - RNA, 32 nt, Human
gacuucccaaagugcugggauuaugggcgggu

SEQ ID NO: 156005 - RNA, 32 nt, Human
gacuucccagagugcugggauuacaggcguga

SEQ ID NO: 156006 - RNA, 32 nt, Human
gacuucccagcccccagaacugugagaaauaa

SEQ ID NO: 156007 - RNA, 32 nt, Human
gacuucccagccuccagaacugugagaaauaa

SEQ ID NO: 156008 - RNA, 32 nt, Human
gacuucccagccucuagaacugugagaaauaa

SEQ ID NO: 156009 - RNA, 32 nt, Human
gacuucccagccuucagaacugugaguuggga

SEQ ID NO: 156010 - RNA, 32 nt, Human
gacuucccagggagggaggcagcuggcugggg

SEQ ID NO: 156011 - RNA, 32 nt, Human
gacuuccccaacaaaagaucuugaacuucugg

SEQ ID NO: 156012 - RNA, 32 nt, Human
gacuuccccacauugacauuugugcgccaccu

SEQ ID NO: 156013 - RNA, 32 nt, Human
gacuuccccagccuggacgggcguggguucug

SEQ ID NO: 156014 - RNA, 32 nt, Human
gacuuccccugccuccuacuccaguaugacag

SEQ ID NO: 156015 - RNA, 32 nt, Human
gacuucccuaggcagguauuuucuccaugccu

SEQ ID NO: 156016 - RNA, 32 nt, Human
gacuucccucccccucuuuuccauuucucccu

SEQ ID NO: 156017 - RNA, 32 nt, Human
gacuuccggcuguugcucaucuuuggauugcc

SEQ ID NO: 156018 - RNA, 32 nt, Human
gacuuccuacagccaaauccccagaggccaac

SEQ ID NO: 156019 - RNA, 32 nt, Human
gacuuccuccaaggagcuuuggcuauacucuc

SEQ ID NO: 156020 - RNA, 32 nt, Human
gacuuccuccaauccccacuccuccgagaccc

SEQ ID NO: 156021 - RNA, 32 nt, Human
gacuuccuccuaacugucaggguggggagcug

SEQ ID NO: 156022 - RNA, 22 nt, Human
gacuuccuccucuggguccucu

SEQ ID NO: 156023 - RNA, 21 nt, Human
gacuuccucgugcaauguguu

SEQ ID NO: 156024 - RNA, 32 nt, Human
gacuuccucuacuugcgcugcucggcccagcc

SEQ ID NO: 156025 - RNA, 32 nt, Human
gacuuccucuggcugcuuuccugaugcucugg

SEQ ID NO: 156026 - RNA, 32 nt, Human
gacuuccucuuccuucugauucugccugaaua

SEQ ID NO: 156027 - RNA, 32 nt, Human
gacuuccugcucaucggcagaucccccuuucc

SEQ ID NO: 156028 - RNA, 32 nt, Human
gacuuccugcucaucugccgcucccuuugccg

SEQ ID NO: 156029 - RNA, 32 nt, Human
gacuuccuguaagauggagguggacaccgagg

SEQ ID NO: 156030 - RNA, 22 nt, Human
gacuuccugugucaguacugug

SEQ ID NO: 156031 - RNA, 20 nt, Human
gacuuccuucuaacaugugu

SEQ ID NO: 156032 - RNA, 32 nt, Human
gacuuccuuugcuucucuuuuccuuguaucuu

SEQ ID NO: 156033 - RNA, 32 nt, Human
gacuucgagaucagccagagaggcagagaacu

SEQ ID NO: 156034 - RNA, 32 nt, Human
gacuucgauuuucagaauuccuccugggaaug

SEQ ID NO: 156035 - RNA, 32 nt, Human
gacuucgccauucaagacaaggaagagacaca

SEQ ID NO: 156036 - RNA, 32 nt, Human
gacuucggauggcucccucuccccaaccgcga

SEQ ID NO: 156037 - RNA, 32 nt, Human
gacuucggcgagguggaaguggagcccaguga

SEQ ID NO: 156038 - RNA, 32 nt, Human
gacuucggcgauuugggcugggcgcggugauu

SEQ ID NO: 156039 - RNA, 32 nt, Human
gacuucggggcuguggagaccagcacaggaca

SEQ ID NO: 156040 - RNA, 32 nt, Human
gacuucgucacacuaaaacggauuuugugagg

SEQ ID NO: 156041 - RNA, 32 nt, Human
gacuucuaaucuccagaauagugagaaauaaa

SEQ ID NO: 156042 - RNA, 32 nt, Human
gacuucuagccaggcugggcugccagugccau

SEQ ID NO: 156043 - RNA, 32 nt, Human
gacuucuaugugagaagugcuggaaaaugauu

SEQ ID NO: 156044 - RNA, 32 nt, Human
gacuucucaaagcugcaaacuagccaguugug

SEQ ID NO: 156045 - RNA, 32 nt, Human
gacuucucaguaggaaggggugaggcagcugu

SEQ ID NO: 156046 - RNA, 32 nt, Human
gacuucuccgcugcaggagguggggugaggac

SEQ ID NO: 156047 - RNA, 32 nt, Human
gacuucuccuucaauccucuggcugacaagaa

SEQ ID NO: 156048 - RNA, 32 nt, Human
gacuucucucaaacuugugugcugaggagacu

SEQ ID NO: 156049 - RNA, 32 nt, Human
gacuucucugauggcgagaggcugcggcugua

SEQ ID NO: 156050 - RNA, 32 nt, Human
gacuucucuggagaggccuggagaccuagcuc

SEQ ID NO: 156051 - RNA, 17 nt, Human
gacuucucugggccugg

SEQ ID NO: 156052 - RNA, 16 nt, Human
gacuucucugggcuga

SEQ ID NO: 156053 - RNA, 32 nt, Human
gacuucucuggugcaagaccucagguccgugg

SEQ ID NO: 156054 - RNA, 32 nt, Human
gacuucucuguaaauaaacaaaucucuucugc

SEQ ID NO: 156055 - RNA, 32 nt, Human
gacuucucuuauucuuuacaaaaugaaugcau

SEQ ID NO: 156056 - RNA, 32 nt, Human
gacuucucuugccuggagggugcagugauagc

SEQ ID NO: 156057 - RNA, 32 nt, Human
gacuucucuuucccucucccuccuccaacauu

SEQ ID NO: 156058 - RNA, 17 nt, Human
gacuucugaauacagca

SEQ ID NO: 156059 - RNA, 32 nt, Human
gacuucugaaugucuaguuugagaaacuguuc

SEQ ID NO: 156060 - RNA, 32 nt, Human
gacuucugcaggaaauaggguagagaacaggc

SEQ ID NO: 156061 - RNA, 32 nt, Human
gacuucugcaugcaguuugucuuucuguucug

SEQ ID NO: 156062 - RNA, 32 nt, Human
gacuucugccuccccuccuacccucuggccuc

SEQ ID NO: 156063 - RNA, 32 nt, Human
gacuucugcuuaauaaauaugcugacuucauu

SEQ ID NO: 156064 - RNA, 32 nt, Human
gacuucugucuucucauuuccaagccauuguu

SEQ ID NO: 156065 - RNA, 32 nt, Human
gacuucugugaaaucuuuguuuuuaagugcca

SEQ ID NO: 156066 - RNA, 32 nt, Human
gacuucuuaccuuuaacaucccuguuaaagau

SEQ ID NO: 156067 - RNA, 32 nt, Human
gacuucuucccucgcuccuccuggucaugucc

SEQ ID NO: 156068 - RNA, 32 nt, Human
gacuucuuccuugagugacuucuuaugauucu

SEQ ID NO: 156069 - RNA, 32 nt, Human
gacuucuuggaaggcagacuugggacgcuuug

SEQ ID NO: 156070 - RNA, 32 nt, Human
gacuucuuggaauuaucagagguagggugguc

SEQ ID NO: 156071 - RNA, 32 nt, Human
gacuucuugggccuuccugccugccacccccu

SEQ ID NO: 156072 - RNA, 32 nt, Human
gacuucuugguuuggggagaaauaaauuuugu

SEQ ID NO: 156073 - RNA, 32 nt, Human
gacuucuuugagacagagggcaaugaugugug

SEQ ID NO: 156074 - RNA, 32 nt, Human
gacuugaaaugaggccuacucuaaagaauucu

SEQ ID NO: 156075 - RNA, 32 nt, Human
gacuugaagcagaguucaccagugagcucagg

SEQ ID NO: 156076 - RNA, 32 nt, Human
gacuugaaggcaccuccagcauuggcccagca

SEQ ID NO: 156077 - RNA, 32 nt, Human
gacuugaauguuaucaguacuaccacagaacu

SEQ ID NO: 156078 - RNA, 32 nt, Human
gacuugacaccaccaccuuccuccaggggaaa

SEQ ID NO: 156079 - RNA, 32 nt, Human
gacuugacugaggcuguauccuuauccuccau

SEQ ID NO: 156080 - RNA, 32 nt, Human
gacuugagaacagccucugcagggccugcucu

SEQ ID NO: 156081 - RNA, 32 nt, Human
gacuugagaguguugcucugguauucugagag

SEQ ID NO: 156082 - RNA, 32 nt, Human
gacuugagaguguugcucugguauucuggguu

SEQ ID NO: 156083 - RNA, 32 nt, Human
gacuugagccacuccuuccuucaggacucugc

SEQ ID NO: 156084 - RNA, 21 nt, Human
gacuugagcccaagaguucca

SEQ ID NO: 156085 - RNA, 32 nt, Human
gacuugagggacccagucccaccccaaacugc

SEQ ID NO: 156086 - RNA, 32 nt, Human
gacuugagggccugagcaggaaagacuggccc

SEQ ID NO: 156087 - RNA, 32 nt, Human
gacuugaggguuaagaagaaagaggaaugagg

SEQ ID NO: 156088 - RNA, 32 nt, Human
gacuugaguucgggacaguaagccagggguua

SEQ ID NO: 156089 - RNA, 32 nt, Human
gacuugaguuugaauugacuuaacauugaguu

SEQ ID NO: 156090 - RNA, 29 nt, Human
gacuugauaaacgguuucgccucuuuugg

SEQ ID NO: 156091 - RNA, 32 nt, Human
gacuugaugagguuugagguacaaggggaaaa

SEQ ID NO: 156092 - RNA, 32 nt, Human
gacuugauuugggaagccuuguugacucugau

SEQ ID NO: 156093 - RNA, 32 nt, Human
gacuugcaaagacauuccccuugagugucagu

SEQ ID NO: 156094 - RNA, 32 nt, Human
gacuugcaagcguggacccaggcucggugcac

SEQ ID NO: 156095 - RNA, 32 nt, Human
gacuugcaaucuauauguaauggcuacuuacu

SEQ ID NO: 156096 - RNA, 32 nt, Human
gacuugcacacagggaggcuguagccaggaaa

SEQ ID NO: 156097 - RNA, 32 nt, Human
gacuugcacauccugucaucugcuguguuaca

SEQ ID NO: 156098 - RNA, 32 nt, Human
gacuugcaccuauaaucccagcacuuugggag

SEQ ID NO: 156099 - RNA, 32 nt, Human
gacuugcagauaagcacaagccuacuggaauu

SEQ ID NO: 156100 - RNA, 32 nt, Human
gacuugcaggagaccgugugauuuguguagug

SEQ ID NO: 156101 - RNA, 32 nt, Human
gacuugccacauuccucugagucuggaguagc

SEQ ID NO: 156102 - RNA, 32 nt, Human
gacuugcccuggaccuugaguguggcccuccc

SEQ ID NO: 156103 - RNA, 32 nt, Human
gacuugccucagcugcucggcgaggcuggagc

SEQ ID NO: 156104 - RNA, 32 nt, Human
gacuugccuccaccgccaccugcaaguccgcc

SEQ ID NO: 156105 - RNA, 32 nt, Human
gacuugccuccagcacuggacacaccuguguu

SEQ ID NO: 156106 - RNA, 32 nt, Human
gacuugccucugcacacccuccagagacaaca

SEQ ID NO: 156107 - RNA, 21 nt, Human
gacuugcgaccuugaagccaa

SEQ ID NO: 156108 - RNA, 32 nt, Human
gacuugcgcagccgccugcagcgcggcccgug

SEQ ID NO: 156109 - RNA, 32 nt, Human
gacuugcggggcagaggagggcgugggcgugu

SEQ ID NO: 156110 - RNA, 32 nt, Human
gacuugcuccauccucuuaaacuuuuuguguc

SEQ ID NO: 156111 - RNA, 32 nt, Human
gacuugcucuacugaaggcuucuugguuauaa

SEQ ID NO: 156112 - RNA, 17 nt, Human
gacuugcucucaucaca

SEQ ID NO: 156113 - RNA, 32 nt, Human
gacuugcugugugcccuuaaaccagccacuac

SEQ ID NO: 156114 - RNA, 32 nt, Human
gacuugcuucagacgacacagagcaagaggaa

SEQ ID NO: 156115 - RNA, 32 nt, Human
gacuuggaacaucugcuuauuuucuaauccgc

SEQ ID NO: 156116 - RNA, 32 nt, Human
gacuuggaagaggaggaggaggaggagaagga

SEQ ID NO: 156117 - RNA, 32 nt, Human
gacuuggaccgcuucagccugggcugggagca

SEQ ID NO: 156118 - RNA, 32 nt, Human
gacuuggacuccucuguccagcuuuuaacaau

SEQ ID NO: 156119 - RNA, 32 nt, Human
gacuuggacuuggacuuggauuugagcuuggc

SEQ ID NO: 156120 - RNA, 32 nt, Human
gacuuggagguggaggggacgcggcgguacuc

SEQ ID NO: 156121 - RNA, 32 nt, Human
gacuuggagguggcaggaguccgagcccugcu

SEQ ID NO: 156122 - RNA, 32 nt, Human
gacuuggauggcagccaucagggaaggcuggg

SEQ ID NO: 156123 - RNA, 32 nt, Human
gacuuggcauccagagaugagccccagaaguu

SEQ ID NO: 156124 - RNA, 32 nt, Human
gacuuggccuggggcccaggaggcagguguaa

SEQ ID NO: 156125 - RNA, 32 nt, Human
gacuuggccuuggcugggcaugguggcucacg

SEQ ID NO: 156126 - RNA, 32 nt, Human
gacuugggagagauaaggagggagggcgggug

SEQ ID NO: 156127 - RNA, 32 nt, Human
gacuugggagauggaugggcugagggagugga

SEQ ID NO: 156128 - RNA, 32 nt, Human
gacuugggaggcgcggugaggagucaggcuua

SEQ ID NO: 156129 - RNA, 32 nt, Human
gacuugggaggcgguuguugcagugagcugug

SEQ ID NO: 156130 - RNA, 32 nt, Human
gacuugggaggcugaggcaggagaaucgcuug

SEQ ID NO: 156131 - RNA, 32 nt, Human
gacuugggagucaggaauaagggaaaggggau

SEQ ID NO: 156132 - RNA, 32 nt, Human
gacuugggccagagcagcagagcuggcccaac

SEQ ID NO: 156133 - RNA, 32 nt, Human
gacuugggccuccagcucaucuguuccuucug

SEQ ID NO: 156134 - RNA, 32 nt, Human
gacuuggggagggagaaauaggaggagacguc

SEQ ID NO: 156135 - RNA, 32 nt, Human
gacuuggggaucagggagaaguugccgaaacu

SEQ ID NO: 156136 - RNA, 32 nt, Human
gacuugggguuugcuuuuuaaaaugaaacuag

SEQ ID NO: 156137 - RNA, 32 nt, Human
gacuuggguugcuggucccccuucccuagugg

SEQ ID NO: 156138 - RNA, 32 nt, Human
gacuugguaggugguuaugaagggcuggccag

SEQ ID NO: 156139 - RNA, 32 nt, Human
gacuuggucuacaccugacagucacuggaaug

SEQ ID NO: 156140 - RNA, 32 nt, Human
gacuuggugcagcccaugcucucucucaugcu

SEQ ID NO: 156141 - RNA, 32 nt, Human
gacuugguggaaguucugccucaggugggcau

SEQ ID NO: 156142 - RNA, 32 nt, Human
gacuugguggcuuuuccuugaauccagaacac

SEQ ID NO: 156143 - RNA, 18 nt, Human
gacuuggugggcggggug

SEQ ID NO: 156144 - RNA, 32 nt, Human
gacuugguggggagagaaagaauacagugagu

SEQ ID NO: 156145 - RNA, 32 nt, Human
gacuugguggguggggugggugguuuuuguuu

SEQ ID NO: 156146 - RNA, 22 nt, Human
gacuuguaaaugaaacaaugca

SEQ ID NO: 156147 - RNA, 32 nt, Human
gacuuguagauuugccuucagacagcucuugg

SEQ ID NO: 156148 - RNA, 32 nt, Human
gacuugucaaauaccaguuuuguuucaaauaa

SEQ ID NO: 156149 - RNA, 32 nt, Human
gacuugucagaagucagagcaagguauuggug

SEQ ID NO: 156150 - RNA, 32 nt, Human
gacuugucauaguggaugaggucugggcugga

SEQ ID NO: 156151 - RNA, 32 nt, Human
gacuuguccaauaagauaagaucucaaaacaa

SEQ ID NO: 156152 - RNA, 32 nt, Human
gacuugucuacuauagcugcugccucagcguc

SEQ ID NO: 156153 - RNA, 32 nt, Human
gacuugugaaggcagaguagcgguugagguug

SEQ ID NO: 156154 - RNA, 32 nt, Human
gacuugugaauauauuugaauguauguuguuu

SEQ ID NO: 156155 - RNA, 32 nt, Human
gacuugugcuuccagggacccaggcaggauga

SEQ ID NO: 156156 - RNA, 32 nt, Human
gacuuguucauguccccucucucccuauaaau

SEQ ID NO: 156157 - RNA, 32 nt, Human
gacuuguucuucuucugcaguaucuggaaaau

SEQ ID NO: 156158 - RNA, 19 nt, Human
gacuuguucuuuccucaca

SEQ ID NO: 156159 - RNA, 22 nt, Human
gacuuguuuaaucguguucuca

SEQ ID NO: 156160 - RNA, 32 nt, Human
gacuuguuugcaaugcagaaucacagccccca

SEQ ID NO: 156161 - RNA, 32 nt, Human
gacuuguuuuacugcugucugccaucaauauu

SEQ ID NO: 156162 - RNA, 32 nt, Human
gacuuuaaaggacuguguucauucugauuugg

SEQ ID NO: 156163 - RNA, 32 nt, Human
gacuuuaaggaaaugaagacuggggaagaaua

SEQ ID NO: 156164 - RNA, 32 nt, Human
gacuuuaaucuuuauggcucuguggcuggagu

SEQ ID NO: 156165 - RNA, 32 nt, Human
gacuuuaccaccugaaacugcugcuucaaguu

SEQ ID NO: 156166 - RNA, 32 nt, Human
gacuuuacccuccugguugguucuuacuguuu

SEQ ID NO: 156167 - RNA, 32 nt, Human
gacuuuacuaccacaucuacagagccaucauu

SEQ ID NO: 156168 - RNA, 32 nt, Human
gacuuuagggaaugguauaggggaagauggga

SEQ ID NO: 156169 - RNA, 32 nt, Human
gacuuuauagaagcuauccaggagacuuaaua

SEQ ID NO: 156170 - RNA, 32 nt, Human
gacuuuauuauuccuacuucaagaccaucauu

SEQ ID NO: 156171 - RNA, 32 nt, Human
gacuuuauuuguguccuaaacauucuucagug

SEQ ID NO: 156172 - RNA, 32 nt, Human
gacuuucaaggagauacugcagugaguuucuc

SEQ ID NO: 156173 - RNA, 32 nt, Human
gacuuucagcacaaaagauacuuauaaacaaa

SEQ ID NO: 156174 - RNA, 32 nt, Human
gacuuucaguucuuacgauagucucaaggcug

SEQ ID NO: 156175 - RNA, 32 nt, Human
gacuuucccaugagccuccuggaacugccaaa

SEQ ID NO: 156176 - RNA, 32 nt, Human
gacuuucccaugagccuccuggaacugccagc

SEQ ID NO: 156177 - RNA, 32 nt, Human
gacuuucccuaagcagauaagcagaaacuugu

SEQ ID NO: 156178 - RNA, 32 nt, Human
gacuuucccugagaagaaucaucucugccagg

SEQ ID NO: 156179 - RNA, 32 nt, Human
gacuuucccuggggcaugucaguugccucaua

SEQ ID NO: 156180 - RNA, 21 nt, Human
gacuuucccuggugccugcgg

SEQ ID NO: 156181 - RNA, 32 nt, Human
gacuuuccuccaggggcuuccucacuggggaa

SEQ ID NO: 156182 - RNA, 32 nt, Human
gacuuuccuccuucccgccugccuguagcggc

SEQ ID NO: 156183 - RNA, 21 nt, Human
gacuuuccucugaaagcuaag

SEQ ID NO: 156184 - RNA, 32 nt, Human
gacuuucgggcucucuggaaggccggggagag

SEQ ID NO: 156185 - RNA, 32 nt, Human
gacuuucuaauuacuacaacuaaccuguugug

SEQ ID NO: 156186 - RNA, 32 nt, Human
gacuuucucacccugcggcaggcacaacagau

SEQ ID NO: 156187 - RNA, 32 nt, Human
gacuuucuccaauguggacucugugugucagu

SEQ ID NO: 156188 - RNA, 32 nt, Human
gacuuucuccccucagcuugagacugcaugua

SEQ ID NO: 156189 - RNA, 32 nt, Human
gacuuucuccuggccccugccugcuggagauc

SEQ ID NO: 156190 - RNA, 32 nt, Human
gacuuucucuaacccaguggcugugcggugca

SEQ ID NO: 156191 - RNA, 32 nt, Human
gacuuucugaaggaugggcaacaugucagauu

SEQ ID NO: 156192 - RNA, 20 nt, Human
gagaggcacuugugacuuug

SEQ ID NO: 156193 - RNA, 32 nt, Human
gagaggcagaaaaauuggguccugguucaggu

SEQ ID NO: 156194 - RNA, 32 nt, Human
gagaggcagaaaccaugugcagaggcugggag

SEQ ID NO: 156195 - RNA, 24 nt, Human
gagaggcagaggcagacaggcgcu

SEQ ID NO: 156196 - RNA, 32 nt, Human
gagaggcagagggaggcacagccccgacacag

SEQ ID NO: 156197 - RNA, 19 nt, Human
gagaggcagcauccaccag

SEQ ID NO: 156198 - RNA, 31 nt, Human
gagaggcagcgacaucggaggagggagaggc

SEQ ID NO: 156199 - RNA, 32 nt, Human
gagaggcaggauucaacagaucugucugucuu

SEQ ID NO: 156200 - RNA, 32 nt, Human
gagaggcaggcaagcaguuggguucgcccaca

SEQ ID NO: 156201 - RNA, 32 nt, Human
gagaggcagggugggauagggaacgucucgag

SEQ ID NO: 156202 - RNA, 32 nt, Human
gagaggcaggucaagaucugguuccagaaccg

SEQ ID NO: 156203 - RNA, 32 nt, Human
gagaggcaguagccucagugugcaguggguag

SEQ ID NO: 156204 - RNA, 21 nt, Human
gagaggcauaaaaaggcacuc

SEQ ID NO: 156205 - RNA, 32 nt, Human
gagaggcauccagcaacucugagauuaaauuc

SEQ ID NO: 156206 - RNA, 22 nt, Human
gagaggcaugaacacacaguca

SEQ ID NO: 156207 - RNA, 24 nt, Human
gagaggcaugugucggggggccug

SEQ ID NO: 156208 - RNA, 28 nt, Human
gagaggccaagggcugccuccuaucaga

SEQ ID NO: 156209 - RNA, 32 nt, Human
gagaggccaccguccaggucucuugccucuau

SEQ ID NO: 156210 - RNA, 32 nt, Human
gagaggccagaggcagaggggugcagaagaga

SEQ ID NO: 156211 - RNA, 32 nt, Human
gagaggccagcugcacuccugcacgggguucc

SEQ ID NO: 156212 - RNA, 32 nt, Human
gagaggccaggcaagcaaagucaugccacaaa

SEQ ID NO: 156213 - RNA, 32 nt, Human
gagaggccaggucacagagcaaggggcaggaa

SEQ ID NO: 156214 - RNA, 32 nt, Human
gagaggccaucuaucccagccugggugauccu

SEQ ID NO: 156215 - RNA, 32 nt, Human
gagaggcccagaggaaagcccaucucccucca

SEQ ID NO: 156216 - RNA, 32 nt, Human
gagaggcccaggacaccaagagccagcugugg

SEQ ID NO: 156217 - RNA, 32 nt, Human
gagaggccccaacacuggaugguucuguaggg

SEQ ID NO: 156218 - RNA, 32 nt, Human
gagaggcccccaaccuccucaggauuugcacg

SEQ ID NO: 156219 - RNA, 23 nt, Human
gagaggcccggagagggacucug

SEQ ID NO: 156220 - RNA, 32 nt, Human
gagaggcccuggaugguagaucggccaugcuc

SEQ ID NO: 156221 - RNA, 21 nt, Human
gagaggccgacccaggaggaa

SEQ ID NO: 156222 - RNA, 32 nt, Human
gagaggccgcugcaccaccacccgagccuggg

SEQ ID NO: 156223 - RNA, 31 nt, Human
gagaggccgggguuagggugaucuguguggc

SEQ ID NO: 156224 - RNA, 32 nt, Human
gagaggccucugauguccugaggucucagagg

SEQ ID NO: 156225 - RNA, 32 nt, Human
gagaggccuucucauccccaagcucuccaguc

SEQ ID NO: 156226 - RNA, 16 nt, Human
gagaggccuucuggga

SEQ ID NO: 156227 - RNA, 24 nt, Human
gagaggcgacggaggcggacucug

SEQ ID NO: 156228 - RNA, 18 nt, Human
gagaggcgagcaccggga

SEQ ID NO: 156229 - RNA, 32 nt, Human
gagaggcgaggcugagcgaaagaaggaaggac

SEQ ID NO: 156230 - RNA, 31 nt, Human
gagaggcgcagcucugucucacuggaaggca

SEQ ID NO: 156231 - RNA, 32 nt, Human
gagaggcgcgcugaggaugagagggcacaggg

SEQ ID NO: 156232 - RNA, 32 nt, Human
gagaggcgcggacgcugagcgagcccggugcc

SEQ ID NO: 156233 - RNA, 22 nt, Human
gagaggcgcuuggcugggcucu

SEQ ID NO: 156234 - RNA, 32 nt, Human
gagaggcggagaacuccuuccccaaaucuuuu

SEQ ID NO: 156235 - RNA, 32 nt, Human
gagaggcggagguugcagugagccaaaauugc

SEQ ID NO: 156236 - RNA, 32 nt, Human
gagaggcgugagcacccuaucucagcugcuau

SEQ ID NO: 156237 - RNA, 32 nt, Human
gagaggcguucugcagccgggagggagccgcc

SEQ ID NO: 156238 - RNA, 32 nt, Human
gagaggcucaggcagaggauugcuugaggcca

SEQ ID NO: 156239 - RNA, 32 nt, Human
gagaggcucugacguccguguuuccaugacgu

SEQ ID NO: 156240 - RNA, 32 nt, Human
gagaggcucuguuuccagccaguuauuuucuc

SEQ ID NO: 156241 - RNA, 32 nt, Human
gagaggcucuucugggggccaggcugggacug

SEQ ID NO: 156242 - RNA, 32 nt, Human
gagaggcucuugugguuaacugauaauauuga

SEQ ID NO: 156243 - RNA, 32 nt, Human
gagaggcugagaaaucauccccugaauaacuu

SEQ ID NO: 156244 - RNA, 32 nt, Human
gagaggcugagcgggguggaucauuugaggcc

SEQ ID NO: 156245 - RNA, 32 nt, Human
gagaggcugagggagggagguggagaaggacg

SEQ ID NO: 156246 - RNA, 32 nt, Human
gagaggcugagguugcgccacuacacuccagc

SEQ ID NO: 156247 - RNA, 32 nt, Human
gagaggcugagugucaccaagguccaaacucc

SEQ ID NO: 156248 - RNA, 32 nt, Human
gagaggcugcagccacagcacccuacugcccu

SEQ ID NO: 156249 - RNA, 32 nt, Human
gagaggcugcaggagaaaccagcucugcugac

SEQ ID NO: 156250 - RNA, 32 nt, Human
gagaggcugcaugcgugccugaggucacacag

SEQ ID NO: 156251 - RNA, 32 nt, Human
gagaggcugcucccuccccuuuuuccugccca

SEQ ID NO: 156252 - RNA, 32 nt, Human
gagaggcuggcauugguggagccacccacugc

SEQ ID NO: 156253 - RNA, 32 nt, Human
gagaggcuggcgacuggagcaggauccagggg

SEQ ID NO: 156254 - RNA, 32 nt, Human
gagaggcugggaauggaggggcagagccagga

SEQ ID NO: 156255 - RNA, 32 nt, Human
gagaggcugggcaggggcugauggggcugggu

SEQ ID NO: 156256 - RNA, 32 nt, Human
gagaggcugggcggcugccggugacagacugu

SEQ ID NO: 156257 - RNA, 32 nt, Human
gagaggcugucugagcagggagguugggaccc

SEQ ID NO: 156258 - RNA, 32 nt, Human
gagaggcuguggcagcaggagacucugcggga

SEQ ID NO: 156259 - RNA, 32 nt, Human
gagaggcuguggcagcaggagacucuguggga

SEQ ID NO: 156260 - RNA, 32 nt, Human
gagaggcuguggcagcaguagacucugcagga

SEQ ID NO: 156261 - RNA, 32 nt, Human
gagaggcuucauccaucccacccggucgucgc

SEQ ID NO: 156262 - RNA, 32 nt, Human
gagaggcuugcugcggacucaggcuggcgaau

SEQ ID NO: 156263 - RNA, 32 nt, Human
gagaggcuugggccucaguuucccucugugaa

SEQ ID NO: 156264 - RNA, 32 nt, Human
gagaggcuuucagaguggcuggaaaaggcucu

SEQ ID NO: 156265 - RNA, 32 nt, Human
gagagggaaaagcacaaugcaagaaccuaacu

SEQ ID NO: 156266 - RNA, 32 nt, Human
gagagggaaaauccuaagacagaggaacucca

SEQ ID NO: 156267 - RNA, 32 nt, Human
gagagggaaagacgaggccgagagggacccug

SEQ ID NO: 156268 - RNA, 32 nt, Human
gagagggaaagccagagugugaugggccugcc

SEQ ID NO: 156269 - RNA, 32 nt, Human
gagagggaacacaaguugaagaugguuuggga

SEQ ID NO: 156270 - RNA, 32 nt, Human
gagagggaacccaggaauugugagguuagcag

SEQ ID NO: 156271 - RNA, 22 nt, Human
gagagggaacggggacaggagc

SEQ ID NO: 156272 - RNA, 32 nt, Human
gagagggaagagaaagcacagagcagagaagc

SEQ ID NO: 156273 - RNA, 32 nt, Human
gagagggaagugcagacauaaagaggugaauu

SEQ ID NO: 156274 - RNA, 20 nt, Human
gagagggaaugugcaggaac

SEQ ID NO: 156275 - RNA, 32 nt, Human
gagagggacaaaccagugagugucuccgaguu

SEQ ID NO: 156276 - RNA, 32 nt, Human
gagagggacuucagagaguuaagcaguucagu

SEQ ID NO: 156277 - RNA, 32 nt, Human
gagagggagaaaccaccagacacuaucgguca

SEQ ID NO: 156278 - RNA, 32 nt, Human
gagagggagacagggccagacauguucuagca

SEQ ID NO: 156279 - RNA, 31 nt, Human
gagagggagagcuucuuuagguuccugguaa

SEQ ID NO: 156280 - RNA, 32 nt, Human
gagagggagagggauccuggcccagcugacuu

SEQ ID NO: 156281 - RNA, 32 nt, Human
gagagggagagggccuggguaggagcugggag

SEQ ID NO: 156282 - RNA, 32 nt, Human
gagagggagaggggacccgaggcugaggcaua

SEQ ID NO: 156283 - RNA, 32 nt, Human
gagagggagagggggcugaggagguagugcug

SEQ ID NO: 156284 - RNA, 32 nt, Human
gagagggagcaccuguaacagcagaacuacug

SEQ ID NO: 156285 - RNA, 32 nt, Human
gagagggagcagcagguaacugcgcaaccccu

SEQ ID NO: 156286 - RNA, 32 nt, Human
gagagggagccugucgucucccagggaauaaa

SEQ ID NO: 156287 - RNA, 19 nt, Human
gagagggagcgcccaccaa

SEQ ID NO: 156288 - RNA, 32 nt, Human
gagagggagcgcgagagagggagggaggaggg

SEQ ID NO: 156289 - RNA, 32 nt, Human
gagagggagcugcaccagccucucacaugagc

SEQ ID NO: 156290 - RNA, 32 nt, Human
gagagggagcuggggcgcauggggaagcaggu

SEQ ID NO: 156291 - RNA, 21 nt, Human
gagagggagcuuggagaacuc

SEQ ID NO: 156292 - RNA, 32 nt, Human
gagagggaggaagaggauggcagggccacgcc

SEQ ID NO: 156293 - RNA, 32 nt, Human
gagagggaggcagaagaggaagucagagcgau

SEQ ID NO: 156294 - RNA, 32 nt, Human
gagagggagggagcgagagggagagcaaaaga

SEQ ID NO: 156295 - RNA, 32 nt, Human
gagagggagggcaggaaggaaaagaaaggacu

SEQ ID NO: 156296 - RNA, 32 nt, Human
gagagggagggcggagggcggaggggcggcgg

SEQ ID NO: 156297 - RNA, 32 nt, Human
gagagggaggggcaacagagguccaggguuug

SEQ ID NO: 156298 - RNA, 32 nt, Human
gagagggaguuucacucuuguugcccaggcug

SEQ ID NO: 156299 - RNA, 32 nt, Human
gagagggaugguggggaagggguggagcuggg

SEQ ID NO: 156300 - RNA, 32 nt, Human
gagagggcacgaggcccugccugccccgggcg

SEQ ID NO: 156301 - RNA, 32 nt, Human
gagagggcacugaagaccugaaucuacacuag

SEQ ID NO: 156302 - RNA, 22 nt, Human
gagagggcaggaaggaggcaga

SEQ ID NO: 156303 - RNA, 32 nt, Human
gagagggcaggaagggacaggagcggagcagg

SEQ ID NO: 156304 - RNA, 32 nt, Human
gagagggcagugccauguuccucuccauccua

SEQ ID NO: 156305 - RNA, 32 nt, Human
gagagggcaguguggagggaaguugcuagaaa

SEQ ID NO: 156306 - RNA, 32 nt, Human
gagagggccccgggagccggggguggguacug

SEQ ID NO: 156307 - RNA, 18 nt, Human
gagagggcccugauucca

SEQ ID NO: 156308 - RNA, 32 nt, Human
gagagggccuauggcugcuuucacguuacaau

SEQ ID NO: 156309 - RNA, 21 nt, Human
gagagggccuggcccuggggu

SEQ ID NO: 156310 - RNA, 32 nt, Human
gagagggccugggagcacaaugcugagccccu

SEQ ID NO: 156311 - RNA, 32 nt, Human
gagagggccuggguaggagcugggaggaagau

SEQ ID NO: 156312 - RNA, 32 nt, Human
gagagggccugugcuccacacagccgugguuu

SEQ ID NO: 156313 - RNA, 32 nt, Human
gagagggccuuggcaccucuugcauccaggca

SEQ ID NO: 156314 - RNA, 32 nt, Human
gagagggcgagagagagcgggcgagagugggc

SEQ ID NO: 156315 - RNA, 32 nt, Human
gagagggcggcaaugacacugcaccucuccuu

SEQ ID NO: 156316 - RNA, 32 nt, Human
gagagggcugcagccagggcccugccagccuc

SEQ ID NO: 156317 - RNA, 32 nt, Human
gagagggcugggcggggaggagcugcuacugc

SEQ ID NO: 156318 - RNA, 32 nt, Human
gagagggcuuccuucucacccuucucuccaua

SEQ ID NO: 156319 - RNA, 32 nt, Human
gagaggggaaggaucagggggccaggccagca

SEQ ID NO: 156320 - RNA, 32 nt, Human
gagaggggacacaggcaugggccuggcacuau

SEQ ID NO: 156321 - RNA, 32 nt, Human
gagaggggaccaagccuggccugggggugggg

SEQ ID NO: 156322 - RNA, 32 nt, Human
gagaggggaccccagacugggcccagaggcug

SEQ ID NO: 156323 - RNA, 18 nt, Human
gagaggggacccggcaga

SEQ ID NO: 156324 - RNA, 32 nt, Human
gagaggggacucuggacgugccagggucagau

SEQ ID NO: 156325 - RNA, 32 nt, Human
gagaggggacuuccagagucaaugaacgucac

SEQ ID NO: 156326 - RNA, 32 nt, Human
gagaggggagagagacuggagcuggcaaggac

SEQ ID NO: 156327 - RNA, 32 nt, Human
gagaggggaggaacacaccucgcucucuccug

SEQ ID NO: 156328 - RNA, 32 nt, Human
gagaggggaggcaaagcugaagagagucaagg

SEQ ID NO: 156329 - RNA, 32 nt, Human
gagaggggagguggaguuggaaaugugggugu

SEQ ID NO: 156330 - RNA, 31 nt, Human
gagaggggaguggaaagaggaaggggugaag

SEQ ID NO: 156331 - RNA, 32 nt, Human
gagaggggauucacaaggugaagaacuggaac

SEQ ID NO: 156332 - RNA, 32 nt, Human
gagaggggcaggcaggaaagaguggggauccu

SEQ ID NO: 156333 - RNA, 21 nt, Human
gagaggggcgggaccuggaga

SEQ ID NO: 156334 - RNA, 19 nt, Human
gagaggggcgggcaggaac

SEQ ID NO: 156335 - RNA, 32 nt, Human
gagagggggaaagagcugcgggaaaagccggg

SEQ ID NO: 156336 - RNA, 32 nt, Human
gagagggggagagguuucuccaugcuacucuc

SEQ ID NO: 156337 - RNA, 32 nt, Human
gagagggggcuucaccuucccuuucguuucac

SEQ ID NO: 156338 - RNA, 32 nt, Human
gagaggggguagcuagccugagagggaacccu

SEQ ID NO: 156339 - RNA, 32 nt, Human
gagagggggugagagagggcaggcggggacug

SEQ ID NO: 156340 - RNA, 22 nt, Human
gagaggggguuucaccacguug

SEQ ID NO: 156341 - RNA, 23 nt, Human
gagaggggguuucaccacguugg

SEQ ID NO: 156342 - RNA, 22 nt, Human
gagaggggguuucaccauguug

SEQ ID NO: 156343 - RNA, 23 nt, Human
gagaggggguuucaccauguugg

SEQ ID NO: 156344 - RNA, 32 nt, Human
gagagggguaccagggacaaacccuagacaga

SEQ ID NO: 156345 - RNA, 32 nt, Human
gagagggguaggcagaguggugaggcuuuugc

SEQ ID NO: 156346 - RNA, 32 nt, Human
gagagggguauacacagggaggccaggcagcc

SEQ ID NO: 156347 - RNA, 32 nt, Human
gagaggggucacggcugcggaagaggagguuc

SEQ ID NO: 156348 - RNA, 32 nt, Human
gagaggggugaaagaggagaccaauggcaguu

SEQ ID NO: 156349 - RNA, 32 nt, Human
gagaggggugcugggccuuggaccuucucccu

SEQ ID NO: 156350 - RNA, 32 nt, Human
gagagggguggagguggcaggcagggguucuc

SEQ ID NO: 156351 - RNA, 32 nt, Human
gagagggguggcggaggguagagagagaaaga

SEQ ID NO: 156352 - RNA, 32 nt, Human
gagagggugaagcggagcagcccgaggcgggg

SEQ ID NO: 156353 - RNA, 32 nt, Human
gagagggugaggaagaaagagaggaauacuaa

SEQ ID NO: 156354 - RNA, 32 nt, Human
gagagggugcuaagaggaaggaugaagggcuu

SEQ ID NO: 156355 - RNA, 32 nt, Human
gagaggguggcgaccagcuguucuccauaugc

SEQ ID NO: 156356 - RNA, 32 nt, Human
gagaggguggguggcagaggggagcagagcca

SEQ ID NO: 156357 - RNA, 32 nt, Human
gagagguaaaaauacagauauucugggagagu

SEQ ID NO: 156358 - RNA, 32 nt, Human
gagagguacagguuggguucucugccuaccau

SEQ ID NO: 156359 - RNA, 32 nt, Human
gagagguagcaacuagguaaacuccuuauaaa

SEQ ID NO: 156360 - RNA, 32 nt, Human
gagagguaggaggcacguucuuggucacuguu

SEQ ID NO: 156361 - RNA, 32 nt, Human
gagagguaggguggaugacccaggaaggccgc

SEQ ID NO: 156362 - RNA, 32 nt, Human
gagagguauagagagagcagguuccauagcuc

SEQ ID NO: 156363 - RNA, 32 nt, Human
gagaggucacugggccuguuuucucccuccug

SEQ ID NO: 156364 - RNA, 17 nt, Human
gagaggucacuuuggga

SEQ ID NO: 156365 - RNA, 32 nt, Human
gagaggucagcgugagccccuugucucacacc

SEQ ID NO: 156366 - RNA, 32 nt, Human
gagaggucaggggucagcaggagugaggcugg

SEQ ID NO: 156367 - RNA, 32 nt, Human
gagaggucauucuuuuugguccaacucuugcu

SEQ ID NO: 156368 - RNA, 19 nt, Human
gagaggucccggcugggag

SEQ ID NO: 156369 - RNA, 32 nt, Human
gagaggucccggcugggagugacagggugcuu

SEQ ID NO: 156370 - RNA, 32 nt, Human
gagaggucgccaaagccugcagccuggccugg

SEQ ID NO: 156371 - RNA, 32 nt, Human
gagaggucugguguguuccuagaaucucaccu

SEQ ID NO: 156372 - RNA, 32 nt, Human
gagaggucuugggguucaaggcuguuucuugg

SEQ ID NO: 156373 - RNA, 32 nt, Human
gagaggugagcagcaggggagcgggcacaguc

SEQ ID NO: 156374 - RNA, 32 nt, Human
gagaggugagggugaccauauccuggacugug

SEQ ID NO: 156375 - RNA, 32 nt, Human
gagaggugcaucuucuggcucacuuucuucuu

SEQ ID NO: 156376 - RNA, 18 nt, Human
gagaggugcugccggagg

SEQ ID NO: 156377 - RNA, 32 nt, Human
gagagguggagguugcagugagccaaaauccc

SEQ ID NO: 156378 - RNA, 19 nt, Human
gagagguggcuccucggcc

SEQ ID NO: 156379 - RNA, 32 nt, Human
gagagguggcugaaaugugaugaaaagcaaua

SEQ ID NO: 156380 - RNA, 32 nt, Human
gagaggugggaggaaggacaaggguggugcau

SEQ ID NO: 156381 - RNA, 32 nt, Human
gagagguggggccccugcugggguagagcugg

SEQ ID NO: 156382 - RNA, 32 nt, Human
gagaggugggggaagggccaggagugccccag

SEQ ID NO: 156383 - RNA, 18 nt, Human
gagaggugggguggggug

SEQ ID NO: 156384 - RNA, 31 nt, Human
gagaggugggugggagggugggagggugggg

SEQ ID NO: 156385 - RNA, 32 nt, Human
gagagguguuuccuuggccuuccagaaggccc

SEQ ID NO: 156386 - RNA, 32 nt, Human
gagagguuaagcaauuugccuagguucacaca

SEQ ID NO: 156387 - RNA, 32 nt, Human
gagagguuaggggucggcagaggcggagcugg

SEQ ID NO: 156388 - RNA, 32 nt, Human
gagagguuauucacaaccucaccaaacuagua

SEQ ID NO: 156389 - RNA, 32 nt, Human
gagagguucaggagucaggucuucugccuucu

SEQ ID NO: 156390 - RNA, 32 nt, Human
gagagguugccugguggcccugagagagccau

SEQ ID NO: 156391 - RNA, 32 nt, Human
gagagguuucaguugaucguagagagggacgu

SEQ ID NO: 156392 - RNA, 32 nt, Human
gagaguaaaguuuugaagacucagggauagcu

SEQ ID NO: 156393 - RNA, 32 nt, Human
gagaguaagccuuguguuagucagaacucugu

SEQ ID NO: 156394 - RNA, 32 nt, Human
gagaguaauagaauugggagggcagagacuua

SEQ ID NO: 156395 - RNA, 32 nt, Human
gagaguaauuuuaccccucuacguaccuaaag

SEQ ID NO: 156396 - RNA, 18 nt, Human
gagaguacagacugcaga

SEQ ID NO: 156397 - RNA, 32 nt, Human
gagaguacagugagccaagaucgcgccacugc

SEQ ID NO: 156398 - RNA, 32 nt, Human
gagaguagaagagaagggagcaacuuauccuu

SEQ ID NO: 156399 - RNA, 23 nt, Human
gagaguagaggauacaagugaug

SEQ ID NO: 156400 - RNA, 32 nt, Human
gagaguagaugcuugcucuugggaaacggaau

SEQ ID NO: 156401 - RNA, 32 nt, Human
gagaguagcgugaacccgggaggcagagcuug

SEQ ID NO: 156402 - RNA, 32 nt, Human
gagaguaggaaagaguggggguacaugcugga

SEQ ID NO: 156403 - RNA, 22 nt, Human
gagaguaucccacccacuucac

SEQ ID NO: 156404 - RNA, 32 nt, Human
gagaguauugauuucaaauaggaaguugguag

SEQ ID NO: 156405 - RNA, 32 nt, Human
gagaguauuugagauuggccaagcagaacuau

SEQ ID NO: 156406 - RNA, 32 nt, Human
gagagucaagagagcauugguuugggagcuuu

SEQ ID NO: 156407 - RNA, 32 nt, Human
gagagucaaggcggaggucgcgguaagccgag

SEQ ID NO: 156408 - RNA, 32 nt, Human
gagagucacagaaaggccagagggucucagga

SEQ ID NO: 156409 - RNA, 20 nt, Human
gagagucacagacaagacag

SEQ ID NO: 156410 - RNA, 32 nt, Human
gagagucaccucaggcucaggauucugaacca

SEQ ID NO: 156411 - RNA, 22 nt, Human
gagagucagagacagagacaga

SEQ ID NO: 156412 - RNA, 32 nt, Human
gagagucagggaaagagaggagacugucccag

SEQ ID NO: 156413 - RNA, 32 nt, Human
gagaguccaagaccagccuggccaacauggug

SEQ ID NO: 156414 - RNA, 32 nt, Human
gagaguccagaagucccugaaccccaaacugu

SEQ ID NO: 156415 - RNA, 32 nt, Human
gagagucccacauuccagggcacaugggaacu

SEQ ID NO: 156416 - RNA, 32 nt, Human
gagaguccccagcuagggaccugcacguggac

SEQ ID NO: 156417 - RNA, 32 nt, Human
gagaguccuccaggcaggguggcuggugccca

SEQ ID NO: 156418 - RNA, 32 nt, Human
gagaguccugcugcccuccagccgggcuccuc

SEQ ID NO: 156419 - RNA, 32 nt, Human
gagaguccuuuaugggcuucagaaggaaggaa

SEQ ID NO: 156420 - RNA, 32 nt, Human
gagagucggggcuccagccaggagcgcuccag

SEQ ID NO: 156421 - RNA, 32 nt, Human
gagagucgggugggaaggaagcagggaagaga

SEQ ID NO: 156422 - RNA, 32 nt, Human
gagagucgugccgugcagaacccagcauguca

SEQ ID NO: 156423 - RNA, 21 nt, Human
gagagucuagucacugagaga

SEQ ID NO: 156424 - RNA, 32 nt, Human
gagagucugagucuugcccaaacauucuuucu

SEQ ID NO: 156425 - RNA, 32 nt, Human
gagagugaaagaaaggaggaaagucugccacu

SEQ ID NO: 156426 - RNA, 32 nt, Human
gagagugaaggaaguugaugcacagaauuuac

SEQ ID NO: 156427 - RNA, 19 nt, Human
gagagugaaggccugcagg

SEQ ID NO: 156428 - RNA, 32 nt, Human
gagagugaaggcugccaaugucagcuuuggag

SEQ ID NO: 156429 - RNA, 24 nt, Human
gagagugaagugaagagaggcaaa

SEQ ID NO: 156430 - RNA, 32 nt, Human
gagagugacagagaauccagaauagcuuaugg

SEQ ID NO: 156431 - RNA, 22 nt, Human
gagagugaccguccugcaggug

SEQ ID NO: 156432 - RNA, 32 nt, Human
gagagugacgugaacccgagagguagagcuug

SEQ ID NO: 156433 - RNA, 32 nt, Human
gagagugagagaaaggcuggaagacgagaccu

SEQ ID NO: 156434 - RNA, 32 nt, Human
gagagugagagagacauccaggcuuugccgca

SEQ ID NO: 156435 - RNA, 32 nt, Human
gagagugagcagcuccacgcgggacugugcac

SEQ ID NO: 156436 - RNA, 32 nt, Human
gagagugagcaugagcucacuccaucacucga

SEQ ID NO: 156437 - RNA, 20 nt, Human
gagagugagguaguggcgag

SEQ ID NO: 156438 - RNA, 32 nt, Human
gagagugagguguccagccugcaaagcuauuc

SEQ ID NO: 156439 - RNA, 32 nt, Human
gagagugaugauucugugaauauugcugagaa

SEQ ID NO: 156440 - RNA, 32 nt, Human
gagagugcaccauugcacuccagccugggcaa

SEQ ID NO: 156441 - RNA, 32 nt, Human
gagagugcacugcucccugggguucucuacag

SEQ ID NO: 156442 - RNA, 32 nt, Human
gagagugcagaggcuucccccacauuucaggc

SEQ ID NO: 156443 - RNA, 32 nt, Human
gagagugcagaugcaggaaggcccggccugcc

SEQ ID NO: 156444 - RNA, 32 nt, Human
gagagugcagcucaguucgcacacaacagcac

SEQ ID NO: 156445 - RNA, 32 nt, Human
gagagugcagggcgcuguguccagccggggga

SEQ ID NO: 156446 - RNA, 32 nt, Human
gagagugcagugaugggagcacagaccagggu

SEQ ID NO: 156447 - RNA, 32 nt, Human
gagagugccccacugcacuccagccuggguga

SEQ ID NO: 156448 - RNA, 32 nt, Human
gagagugccugggacaggacugugaccuggug

SEQ ID NO: 156449 - RNA, 32 nt, Human
gagagugcgagugcaccaugcucacuguugcu

SEQ ID NO: 156450 - RNA, 32 nt, Human
gagagugcgccacuucacuccagccugggcaa

SEQ ID NO: 156451 - RNA, 32 nt, Human
gagagugcuggcauacuaugugaagcuacuau

SEQ ID NO: 156452 - RNA, 32 nt, Human
gagaguggacugucuucucucccuucacaaaa

SEQ ID NO: 156453 - RNA, 32 nt, Human
gagaguggagcugcuuaguggaagauguaagu

SEQ ID NO: 156454 - RNA, 32 nt, Human
gagaguggaggccaggcugggguggggugugg

SEQ ID NO: 156455 - RNA, 32 nt, Human
gagaguggagugaggccagcaugcaggaagga

SEQ ID NO: 156456 - RNA, 32 nt, Human
gagaguggcaggaagcaagcauguuugcugug

SEQ ID NO: 156457 - RNA, 32 nt, Human
gagaguggcauuaucccuccuaggcagagugc

SEQ ID NO: 156458 - RNA, 32 nt, Human
gagaguggcuggcaauggcugcucucaauccc

SEQ ID NO: 156459 - RNA, 32 nt, Human
gagaguggcuucccauggaguuuggaggagga

SEQ ID NO: 156460 - RNA, 32 nt, Human
gagagugggaggcagagugugauggggaggag

SEQ ID NO: 156461 - RNA, 32 nt, Human
gagagugggcugggaugugcauccugcucccu

SEQ ID NO: 156462 - RNA, 32 nt, Human
gagagugggcugggaugugcauccugcuuccc

SEQ ID NO: 156463 - RNA, 32 nt, Human
gagaguggguuguggggucauguagggguggg

SEQ ID NO: 156464 - RNA, 23 nt, Human
gagaguggguuucacuauguugg

SEQ ID NO: 156465 - RNA, 32 nt, Human
gagaguggugacuaaggcugagcacuaccuau

SEQ ID NO: 156466 - RNA, 32 nt, Human
gagaguggugugaacccgggaggcagagcuug

SEQ ID NO: 156467 - RNA, 32 nt, Human
gagagugguuccugcuguuuauucucugguca

SEQ ID NO: 156468 - RNA, 32 nt, Human
gagaguguaaggaacauggcugugcuguagcc

SEQ ID NO: 156469 - RNA, 32 nt, Human
gagaguguagaagggaaggcuucucaggagga

SEQ ID NO: 156470 - RNA, 32 nt, Human
gagagugucuucaagcugaaugaagcccagcc

SEQ ID NO: 156471 - RNA, 32 nt, Human
gagagugucuucaugccaaccacagccuguuu

SEQ ID NO: 156472 - RNA, 32 nt, Human
gagagugugcuggagcagauggggcacacaga

SEQ ID NO: 156473 - RNA, 32 nt, Human
gagaguuagaccuccagacgucagccucccuc

SEQ ID NO: 156474 - RNA, 32 nt, Human
gagaguuagagagagacaaagagagagaguua

SEQ ID NO: 156475 - RNA, 32 nt, Human
gagaguucaagaccagccuggccaacauggag

SEQ ID NO: 156476 - RNA, 25 nt, Human
gagaguucaggcugcaauaagcugu

SEQ ID NO: 156477 - RNA, 32 nt, Human
gagaguucccauuccuccacauccuuaccaau

SEQ ID NO: 156478 - RNA, 32 nt, Human
gagaguuccuggcucuggaccuuggagggacc

SEQ ID NO: 156479 - RNA, 32 nt, Human
gagaguucuggcuaagauuuuguuugcuugug

SEQ ID NO: 156480 - RNA, 32 nt, Human
gagaguucuguauuuuguuguacaaagacaac

SEQ ID NO: 156481 - RNA, 32 nt, Human
gagaguucuuucacccccucuucuuucuccaa

SEQ ID NO: 156482 - RNA, 32 nt, Human
gagaguugccccacccuaccugccuuuuauag

SEQ ID NO: 156483 - RNA, 32 nt, Human
gagaguugcucugggaguugggguaccacccc

SEQ ID NO: 156484 - RNA, 32 nt, Human
gagaguugcuugaacccaggaggcggagauug

SEQ ID NO: 156485 - RNA, 32 nt, Human
gagaguuggcugccacagccucugccaagcuu

SEQ ID NO: 156486 - RNA, 32 nt, Human
gagaguuuacucaacuaccagaccauggugug

SEQ ID NO: 156487 - RNA, 32 nt, Human
gagaguuuauaucgugccuuuaggcagaaaag

SEQ ID NO: 156488 - RNA, 32 nt, Human
gagaguuuccaucccaacauaauggacuuugg

SEQ ID NO: 156489 - RNA, 21 nt, Human
gagaguuucccaguuuccuga

SEQ ID NO: 156490 - RNA, 32 nt, Human
gagaguuugagaccagccuggccaacaugaug

SEQ ID NO: 156491 - RNA, 32 nt, Human
gagaguuugagaccagcuugaccaacauggag

SEQ ID NO: 156492 - RNA, 32 nt, Human
gagaguuugccacuccccuaaacuccaggauu

SEQ ID NO: 156493 - RNA, 32 nt, Human
gagaguuugccgaccuaacucggguugaaacu

SEQ ID NO: 156494 - RNA, 32 nt, Human
gagaguuugcggccacacacaacacgcaagca

SEQ ID NO: 156495 - RNA, 32 nt, Human
gagaguuuguuuucucuuucucugcucuuugc

SEQ ID NO: 156496 - RNA, 32 nt, Human
gagaguuuucgcucuuaaauccuggggguuuc

SEQ ID NO: 156497 - RNA, 32 nt, Human
gagauaaaacagacuaaguacacagaggaguu

SEQ ID NO: 156498 - RNA, 32 nt, Human
gagauaaagagagagggcaaagaggcagcaag

SEQ ID NO: 156499 - RNA, 32 nt, Human
gagauaaaggucccucuccacccucuacuaac

SEQ ID NO: 156500 - RNA, 21 nt, Human
gagauaaauguacaugaugag

SEQ ID NO: 156501 - RNA, 32 nt, Human
gagauaacacuacugcauuccagccuggguga

SEQ ID NO: 156502 - RNA, 32 nt, Human
gagauaacagccagggaggacaagcagggcug

SEQ ID NO: 156503 - RNA, 32 nt, Human
gagauaaccuuaaacucugaccaacagugagc

SEQ ID NO: 156504 - RNA, 32 nt, Human
gagauaaggcauuuuccuugugcagccuuuac

SEQ ID NO: 156505 - RNA, 32 nt, Human
gagauaaggucaugggagaguggguggggaca

SEQ ID NO: 156506 - RNA, 32 nt, Human
gagauaaguauaucagaugacacugguggcuc

SEQ ID NO: 156507 - RNA, 32 nt, Human
gagauaauaaucaguucuuuacaaccgauggu

SEQ ID NO: 156508 - RNA, 32 nt, Human
gagauaauacagugacuuuaccucacaaauca

SEQ ID NO: 156509 - RNA, 32 nt, Human
gagauaaucuccaggaugccugugaagaaaga

SEQ ID NO: 156510 - RNA, 32 nt, Human
gagauaaugcagacugucauggguggggaaug

SEQ ID NO: 156511 - RNA, 32 nt, Human
gagauaaugccacugcacuccagccugccugg

SEQ ID NO: 156512 - RNA, 32 nt, Human
gagauaauuaguugcuuccuccuucacacugu

SEQ ID NO: 156513 - RNA, 32 nt, Human
gagauaauuauuuaucuugcuuuucauagugu

SEQ ID NO: 156514 - RNA, 32 nt, Human
gagauaauucugaucaaucauuuuggaggcuu

SEQ ID NO: 156515 - RNA, 32 nt, Human
gagauacagaauuggagaagacuugcaaaaca

SEQ ID NO: 156516 - RNA, 32 nt, Human
gagauacagucauaggggguugcagugagguu

SEQ ID NO: 156517 - RNA, 24 nt, Human
gagauacauacuaugaaaugaaga

SEQ ID NO: 156518 - RNA, 21 nt, Human
gagauacauaggaugugaaaa

SEQ ID NO: 156519 - RNA, 18 nt, Human
gagauaccaauguacugg

SEQ ID NO: 156520 - RNA, 32 nt, Human
gagauaccagagacucugaaacuauagaauaa

SEQ ID NO: 156521 - RNA, 32 nt, Human
gagauaccgggacgagcgggcccagggcugag

SEQ ID NO: 156522 - RNA, 32 nt, Human
gagauaccuaucuugaauucaaagaauguuuu

SEQ ID NO: 156523 - RNA, 32 nt, Human
gagauacgagaagcaucacuuccuucagacag

SEQ ID NO: 156524 - RNA, 32 nt, Human
gagauacuggaaggagccucagauugcucaca

SEQ ID NO: 156525 - RNA, 24 nt, Human
gagauacuggagcugaccauccug

SEQ ID NO: 156526 - RNA, 32 nt, Human
gagauacuguguauuucuacaacucuuuggca

SEQ ID NO: 156527 - RNA, 32 nt, Human
gagauagaaggaccagccacuuugaacgccuu

SEQ ID NO: 156528 - RNA, 32 nt, Human
gagauagagcacagcaaagaucugccagcccc

SEQ ID NO: 156529 - RNA, 20 nt, Human
gagauagaggaggaggccga

SEQ ID NO: 156530 - RNA, 32 nt, Human
gagauagaggaggcugugaaugcugagaccag

SEQ ID NO: 156531 - RNA, 19 nt, Human
gagauagaggcugaggcug

SEQ ID NO: 156532 - RNA, 21 nt, Human
gagauagagguugcaaugagc

SEQ ID NO: 156533 - RNA, 32 nt, Human
gagauagauguggaaugaccugagaggcaccu

SEQ ID NO: 156534 - RNA, 32 nt, Human
gagauagcaccacugcacuucuaguugacaga

SEQ ID NO: 156535 - RNA, 32 nt, Human
gagauagcaccacugcaugcaagccugggcaa

SEQ ID NO: 156536 - RNA, 32 nt, Human
gagauagcaccauugcacuccagccugggcga

SEQ ID NO: 156537 - RNA, 32 nt, Human
gagauagccuguggcccuguccugccaugcaa

SEQ ID NO: 156538 - RNA, 32 nt, Human
gagauagcgccacugcaguccggccuggguga

SEQ ID NO: 156539 - RNA, 32 nt, Human
gagauagcgccauugcacuccagccugagcga

SEQ ID NO: 156540 - RNA, 32 nt, Human
gagauagcgccauugcacuccagccugggcaa

SEQ ID NO: 156541 - RNA, 32 nt, Human
gagauagcgccauugcacuccagccugggcga

SEQ ID NO: 156542 - RNA, 32 nt, Human
gagauagcggcacugcacuccagccuggguga

SEQ ID NO: 156543 - RNA, 32 nt, Human
gagauagcggcauugcacuccagccugggcaa

SEQ ID NO: 156544 - RNA, 32 nt, Human
gagauagcuguucuccagccuuucuggaggga

SEQ ID NO: 156545 - RNA, 32 nt, Human
gagauaggcaccacuguauccuccagcuccuu

SEQ ID NO: 156546 - RNA, 23 nt, Human
gagauaggcaggcagcgcugcuc

SEQ ID NO: 156547 - RNA, 32 nt, Human
gagauaggcaucucgcuauguugccuaggcug

SEQ ID NO: 156548 - RNA, 23 nt, Human
gagauagggguuucaccguguua

SEQ ID NO: 156549 - RNA, 32 nt, Human
gagauagggugggggagcuggggaagggugca

SEQ ID NO: 156550 - RNA, 23 nt, Human
gagauaggguuucacaauguugg

SEQ ID NO: 156551 - RNA, 22 nt, Human
gagauaggguuucaccauguug

SEQ ID NO: 156552 - RNA, 23 nt, Human
gagauaggguuucaccauguugg

SEQ ID NO: 156553 - RNA, 32 nt, Human
gagauaguaccacugcacuccagccugggcga

SEQ ID NO: 156554 - RNA, 32 nt, Human
gagauagucugccuggucaaugcugagcugua

SEQ ID NO: 156555 - RNA, 32 nt, Human
gagauagugccacagcucuccagccugggcga

SEQ ID NO: 156556 - RNA, 32 nt, Human
gagauagugccacugcacuucagcuugggcaa

SEQ ID NO: 156557 - RNA, 32 nt, Human
gagauagugccacugcauuccggccugggcga

SEQ ID NO: 156558 - RNA, 32 nt, Human
gagauagugccacugugcuccagccuggauga

SEQ ID NO: 156559 - RNA, 32 nt, Human
gagauagugccauugcacuccggccugggcaa

SEQ ID NO: 156560 - RNA, 32 nt, Human
gagauagugccauuguacuccagcuugggcaa

SEQ ID NO: 156561 - RNA, 32 nt, Human
gagauagugccucugcacuccagccugcguga

SEQ ID NO: 156562 - RNA, 32 nt, Human
gagauaguuucaaagucuaaaccaccagccca

SEQ ID NO: 156563 - RNA, 32 nt, Human
gagauauaagggccugggaugcauuuauuuua

SEQ ID NO: 156564 - RNA, 32 nt, Human
gagauauauaaauggaauuaugcauucuucgu

SEQ ID NO: 156565 - RNA, 21 nt, Human
gagauauauugacacugagga

SEQ ID NO: 156566 - RNA, 32 nt, Human
gagauaucagccuggucauccaguagaacaga

SEQ ID NO: 156567 - RNA, 32 nt, Human
gagauaucauuuauguggagauccacaaccuu

SEQ ID NO: 156568 - RNA, 32 nt, Human
gagauauccugacccucugcuuccuagccuga

SEQ ID NO: 156569 - RNA, 32 nt, Human
gagauaucgccacugcacuccagccuggguga

SEQ ID NO: 156570 - RNA, 32 nt, Human
gagauaucuaagccauauuugugcacaugagc

SEQ ID NO: 156571 - RNA, 32 nt, Human
gagauaucuguaacucaaauuuuucuuaggug

SEQ ID NO: 156572 - RNA, 32 nt, Human
gagauaugaaguauuauccuuuuguucaguug

SEQ ID NO: 156573 - RNA, 32 nt, Human
gagauauggcaaagaauuguagcauccaaauu

SEQ ID NO: 156574 - RNA, 31 nt, Human
gagauauguacuucuugccuuuaaguuuuaa

SEQ ID NO: 156575 - RNA, 32 nt, Human
gagauauguucccaguuguaaauuacuguuua

SEQ ID NO: 156576 - RNA, 32 nt, Human
gagauauguuuagagaccucucagaaaaacuu

SEQ ID NO: 156577 - RNA, 32 nt, Human
gagauauuacucuuugaugaaugcauaaguuc

SEQ ID NO: 156578 - RNA, 32 nt, Human
gagauauuagguuggugcaagaguaauugcag

SEQ ID NO: 156579 - RNA, 25 nt, Human
gagauauuaugauuggaacugagag

SEQ ID NO: 156580 - RNA, 32 nt, Human
gagauauuuacaaugaaugaaaagcuaguuuu

SEQ ID NO: 156581 - RNA, 32 nt, Human
gagauauuuacuauguuaaaucuuuaaaauag

SEQ ID NO: 156582 - RNA, 32 nt, Human
gagauauuuauugccuacuauuuuaaagaugu

SEQ ID NO: 156583 - RNA, 19 nt, Human
gagauauuucaacauguua

SEQ ID NO: 156584 - RNA, 32 nt, Human
gagauauuugaggauguccagagcagaauugu

SEQ ID NO: 156585 - RNA, 32 nt, Human
gagauauuugggguggggacagugaguuugga

SEQ ID NO: 156586 - RNA, 32 nt, Human
gagaucaaagaagucagagagauuggaagcau

SEQ ID NO: 156587 - RNA, 32 nt, Human
gagaucaaagagaccucucucggggucuggau

SEQ ID NO: 156588 - RNA, 32 nt, Human
gagaucaaagagaccucucuuggggucuggau

SEQ ID NO: 156589 - RNA, 32 nt, Human
gagaucaacacacacucccacccuugggguag

SEQ ID NO: 156590 - RNA, 32 nt, Human
gagaucaagccauugcacuccagccugggcaa

SEQ ID NO: 156591 - RNA, 32 nt, Human
gagaucaagggaacaagaguguuugcaagaag

SEQ ID NO: 156592 - RNA, 32 nt, Human
gagaucaagugucugaucaagccucaguguau

SEQ ID NO: 156593 - RNA, 32 nt, Human
gagaucaaguugagacagagaagggaaguagg

SEQ ID NO: 156594 - RNA, 32 nt, Human
gagaucacacaauugcaguccagccugggcag

SEQ ID NO: 156595 - RNA, 32 nt, Human
gagaucacaccaccacuccagccugggcgaga

SEQ ID NO: 156596 - RNA, 32 nt, Human
gagaucacaccaccgcacuccacccugggaag

SEQ ID NO: 156597 - RNA, 32 nt, Human
gagaucacaccacuacacuccagccuaggcaa

SEQ ID NO: 156598 - RNA, 32 nt, Human
gagaucacaccacuacacuccagccugggcga

SEQ ID NO: 156599 - RNA, 32 nt, Human
gagaucacaccacugcaauccagccugggcga

SEQ ID NO: 156600 - RNA, 32 nt, Human
gagaucacaccacugcacuacagccucggcaa

SEQ ID NO: 156601 - RNA, 32 nt, Human
gagaucacaccacugcacucagccugggugac

SEQ ID NO: 156602 - RNA, 32 nt, Human
gagaucacaccacugcacuccaaccugggaaa

SEQ ID NO: 156603 - RNA, 32 nt, Human
gagaucacaccacugcacuccagcccagguga

SEQ ID NO: 156604 - RNA, 32 nt, Human
gagaucacaccacugcacuccagccuggcgac

SEQ ID NO: 156605 - RNA, 32 nt, Human
gagaucacaccacugcacuccagccugggaga

SEQ ID NO: 156606 - RNA, 32 nt, Human
gagaucacaccacugcacuccagccugggcaa

SEQ ID NO: 156607 - RNA, 32 nt, Human
gagaucacaccacugcacuccagccugggcga

SEQ ID NO: 156608 - RNA, 32 nt, Human
gagaucacaccacugcacuccagccugggcgg

SEQ ID NO: 156609 - RNA, 32 nt, Human
gagaucacaccacugcacuccagccuggggga

SEQ ID NO: 156610 - RNA, 32 nt, Human
gagaucacaccacugcacuccagccuggggug

SEQ ID NO: 156611 - RNA, 32 nt, Human
gagaucacaccacugcacuccagccuggguaa

SEQ ID NO: 156612 - RNA, 32 nt, Human
gagaucacaccacugcacuccagccuggguga

SEQ ID NO: 156613 - RNA, 32 nt, Human
gagaucacaccacugcacuccagccugggugg

SEQ ID NO: 156614 - RNA, 32 nt, Human
gagaucacaccacugcacuccagccuggucaa

SEQ ID NO: 156615 - RNA, 32 nt, Human
gagaucacaccacugcacuccagccuggugac

SEQ ID NO: 156616 - RNA, 32 nt, Human
gagaucacaccacugcacuccagccugugcga

SEQ ID NO: 156617 - RNA, 32 nt, Human
gagaucacaccacugcacuccagccuugguga

SEQ ID NO: 156618 - RNA, 32 nt, Human
gagaucacaccacugcacuccagucugggcac

SEQ ID NO: 156619 - RNA, 32 nt, Human
gagaucacaccacugcacuccagugugagcaa

SEQ ID NO: 156620 - RNA, 32 nt, Human
gagaucacaccacugcacuccauccagccugg

SEQ ID NO: 156621 - RNA, 32 nt, Human
gagaucacaccacugcacuccggccugggcga

SEQ ID NO: 156622 - RNA, 32 nt, Human
gagaucacaccacugcacucuagccuggguga

SEQ ID NO: 156623 - RNA, 32 nt, Human
gagaucacaccacugcauuccagccugggcac

SEQ ID NO: 156624 - RNA, 32 nt, Human
gagaucacaccacugcauuccagccuggguga

SEQ ID NO: 156625 - RNA, 32 nt, Human
gagaucacaccacugcauucccgccugggcag

SEQ ID NO: 156626 - RNA, 32 nt, Human
gagaucacaccacugcgcucuagccuggacaa

SEQ ID NO: 156627 - RNA, 32 nt, Human
gagaucacaccacuguacuccagccugaguga

SEQ ID NO: 156628 - RNA, 32 nt, Human
gagaucacaccacuguacuccagccuggauga

SEQ ID NO: 156629 - RNA, 32 nt, Human
gagaucacaccacuguacuccagccuggguga

SEQ ID NO: 156630 - RNA, 32 nt, Human
gagaucacaccacuguauuccagccuggguga

SEQ ID NO: 156631 - RNA, 32 nt, Human
gagaucacaccacugugcucuagccuggacaa

SEQ ID NO: 156632 - RNA, 32 nt, Human
gagaucacaccauugcacuccaaccugggcaa

SEQ ID NO: 156633 - RNA, 32 nt, Human
gagaucacaccauugcacuccagccugggcaa

SEQ ID NO: 156634 - RNA, 32 nt, Human
gagaucacaccauugcacuccagccugggcga

SEQ ID NO: 156635 - RNA, 32 nt, Human
gagaucacaccauugcccuccagccuggguga

SEQ ID NO: 156636 - RNA, 32 nt, Human
gagaucacacuacugcacuccagccugggcga

SEQ ID NO: 156637 - RNA, 32 nt, Human
gagaucacacuacugcacuccugcaugggcga

SEQ ID NO: 156638 - RNA, 32 nt, Human
gagaucacacuacugcauuccagccugagcaa

SEQ ID NO: 156639 - RNA, 32 nt, Human
gagaucacagaaguuuaaguacacacugucaa

SEQ ID NO: 156640 - RNA, 32 nt, Human
gagaucacaucacugcacuccauccuggguga

SEQ ID NO: 156641 - RNA, 32 nt, Human
gagaucaccccacugcauuccagccuggguga

SEQ ID NO: 156642 - RNA, 32 nt, Human
gagaucaccccacuguccuccagccugggcaa

SEQ ID NO: 156643 - RNA, 32 nt, Human
gagaucaccccauugcacuccagccuggacaa

SEQ ID NO: 156644 - RNA, 32 nt, Human
gagaucaccccauuucacuccagccugggcga

SEQ ID NO: 156645 - RNA, 32 nt, Human
gagaucaccugcugccccgcagaccccugucc

SEQ ID NO: 156646 - RNA, 32 nt, Human
gagaucacgccacagcacuccagccugggcga

SEQ ID NO: 156647 - RNA, 32 nt, Human
gagaucacgccacugcaacuccagcuugggug

SEQ ID NO: 156648 - RNA, 32 nt, Human
gagaucacgccacugcacucaagccugggcga

SEQ ID NO: 156649 - RNA, 32 nt, Human
gagaucacgccacugcacuccaaccuggguga

SEQ ID NO: 156650 - RNA, 32 nt, Human
gagaucacgccacugcacuccaacuugggcaa

SEQ ID NO: 156651 - RNA, 32 nt, Human
gagaucacgccacugcacuccagccuaggcga

SEQ ID NO: 156652 - RNA, 32 nt, Human
gagaucacgccacugcacuccagccuggauga

SEQ ID NO: 156653 - RNA, 32 nt, Human
gagaucacgccacugcacuccagccuggcgac

SEQ ID NO: 156654 - RNA, 32 nt, Human
gagaucacgccacugcacuccagccugggaga

SEQ ID NO: 156655 - RNA, 32 nt, Human
gagaucacgccacugcacuccagccugggcaa

SEQ ID NO: 156656 - RNA, 32 nt, Human
gagaucacgccacugcacuccagccugggcga

SEQ ID NO: 156657 - RNA, 32 nt, Human
gagaucacgccacugcacuccagccuggguaa

SEQ ID NO: 156658 - RNA, 32 nt, Human
gagaucacgccacugcacuccagccuggguga

SEQ ID NO: 156659 - RNA, 32 nt, Human
gagaucacgccacugcacuccagccuggucaa

SEQ ID NO: 156660 - RNA, 32 nt, Human
gagaucacgccacugcacuccagccuggugac

SEQ ID NO: 156661 - RNA, 32 nt, Human
gagaucacgccacugcacuccagccuguugac

SEQ ID NO: 156662 - RNA, 32 nt, Human
gagaucacgccacugcacuccagucuggguga

SEQ ID NO: 156663 - RNA, 32 nt, Human
gagaucacgccacugcacuccauccagccugg

SEQ ID NO: 156664 - RNA, 32 nt, Human
gagaucacgccacugcacucuagccuaggcga

SEQ ID NO: 156665 - RNA, 32 nt, Human
gagaucacgccacugcacucuagccugggaua

SEQ ID NO: 156666 - RNA, 32 nt, Human
gagaucacgccacugcacuugagccugggcga

SEQ ID NO: 156667 - RNA, 32 nt, Human
gagaucacgccacugcauuccagacugggcga

SEQ ID NO: 156668 - RNA, 32 nt, Human
gagaucacgccacugcauuccagccugggcga

SEQ ID NO: 156669 - RNA, 32 nt, Human
gagaucacgccacugcauuccagccugugcga

SEQ ID NO: 156670 - RNA, 32 nt, Human
gagaucacgccacugcccuccagccuggggag

SEQ ID NO: 156671 - RNA, 32 nt, Human
gagaucacgccacugcgcuccagccugggcga

SEQ ID NO: 156672 - RNA, 32 nt, Human
gagaucacgccacuguacuccagccugggaga

SEQ ID NO: 156673 - RNA, 32 nt, Human
gagaucacgccacuguacuucuagccuggguu

SEQ ID NO: 156674 - RNA, 32 nt, Human
gagaucacgccacugugcuccagccugggcaa

SEQ ID NO: 156675 - RNA, 32 nt, Human
gagaucacgccauuacacuccagccugggcaa

SEQ ID NO: 156676 - RNA, 32 nt, Human
gagaucacgccauugcacuccaaccuggguga

SEQ ID NO: 156677 - RNA, 32 nt, Human
gagaucacgccauugcacuccagccuaggcga

SEQ ID NO: 156678 - RNA, 32 nt, Human
gagaucacgccauugcacuccagccugggcaa

SEQ ID NO: 156679 - RNA, 32 nt, Human
gagaucacgccauugcacuccagccugggcga

SEQ ID NO: 156680 - RNA, 32 nt, Human
gagaucacgccauugcacuccagccuggguga

SEQ ID NO: 156681 - RNA, 32 nt, Human
gagaucacgccauugcacuccagccugugcga

SEQ ID NO: 156682 - RNA, 32 nt, Human
gagaucacgccauugcacuccagucugagcaa

SEQ ID NO: 156683 - RNA, 32 nt, Human
gagaucacgccauugcacuccagucugguuga

SEQ ID NO: 156684 - RNA, 32 nt, Human
gagaucacgccauuguacuccagccugggcaa

SEQ ID NO: 156685 - RNA, 32 nt, Human
gagaucacgccauuguacuccagccugggcga

SEQ ID NO: 156686 - RNA, 32 nt, Human
gagaucacgccgcugcacuccagccugagcac

SEQ ID NO: 156687 - RNA, 32 nt, Human
gagaucacgccguugcacuccagccugggcaa

SEQ ID NO: 156688 - RNA, 32 nt, Human
gagaucacgccucugcacuccagccugggcaa

SEQ ID NO: 156689 - RNA, 32 nt, Human
gagaucacgcuacugcgcuccagccugaguga

SEQ ID NO: 156690 - RNA, 32 nt, Human
gagaucacggaacgagagaugcagcuuaccag

SEQ ID NO: 156691 - RNA, 32 nt, Human
gagaucacgucacugcacuccagcuugggcaa

SEQ ID NO: 156692 - RNA, 32 nt, Human
gagaucacgucacugcacuccggccuggguga

SEQ ID NO: 156693 - RNA, 32 nt, Human
gagaucacgucauugcacuccauccugagcca

SEQ ID NO: 156694 - RNA, 32 nt, Human
gagaucacgucauugcucuccagccugggcaa

SEQ ID NO: 156695 - RNA, 32 nt, Human
gagaucacuccacugcacuccagccugggcaa

SEQ ID NO: 156696 - RNA, 32 nt, Human
gagaucagaccuuuacaagugaaggaaagcaa

SEQ ID NO: 156697 - RNA, 32 nt, Human
gagaucagccuccuggucucgaacauagcgaa

SEQ ID NO: 156698 - RNA, 32 nt, Human
gagaucagccuccugucucaucuggaagacca

SEQ ID NO: 156699 - RNA, 32 nt, Human
gagaucagccugaccaacaugaugaaaugcca

SEQ ID NO: 156700 - RNA, 32 nt, Human
gagaucagccuggacaauacggugagacccug

SEQ ID NO: 156701 - RNA, 32 nt, Human
gagaucagccuggagaacaaagugagaccccc

SEQ ID NO: 156702 - RNA, 32 nt, Human
gagaucagccuggccaacagacgugagccauu

SEQ ID NO: 156703 - RNA, 32 nt, Human
gagaucagccuggccaacagacgugagucacu

SEQ ID NO: 156704 - RNA, 32 nt, Human
gagaucagccugggaaacacagggaggccccc

SEQ ID NO: 156705 - RNA, 32 nt, Human
gagaucagccugggcaacacagggagacucau

SEQ ID NO: 156706 - RNA, 32 nt, Human
gagaucagccugggcaacauggccagaccucc

SEQ ID NO: 156707 - RNA, 32 nt, Human
gagaucagccugggcaacaugguggaacccug

SEQ ID NO: 156708 - RNA, 32 nt, Human
gagaucagccuggguaacauagcgagacccca

SEQ ID NO: 156709 - RNA, 32 nt, Human
gagaucagccuggucaacagagcgauauccua

SEQ ID NO: 156710 - RNA, 32 nt, Human
gagaucaggaaagacuuccuggccaacaugag

SEQ ID NO: 156711 - RNA, 32 nt, Human
gagaucaggaagagaaggagcagagcagagcu

SEQ ID NO: 156712 - RNA, 32 nt, Human
gagaucaggaguuggagaccagccuggccaac

SEQ ID NO: 156713 - RNA, 32 nt, Human
gagaucaggaguuugaaaccagccuggccaac

SEQ ID NO: 156714 - RNA, 32 nt, Human
gagaucaggaguuugagaacagccuggccaac

SEQ ID NO: 156715 - RNA, 32 nt, Human
gagaucaggaguuugagaccagccuggccaac

SEQ ID NO: 156716 - RNA, 32 nt, Human
gagaucaggaguuugagagcagccuggccaac

SEQ ID NO: 156717 - RNA, 32 nt, Human
gagaucaggccacugcacuccagccugaacaa

SEQ ID NO: 156718 - RNA, 32 nt, Human
gagaucaggccacugcacuccagccugggcaa

SEQ ID NO: 156719 - RNA, 32 nt, Human
gagaucaggccauugcacuccagccugggcaa

SEQ ID NO: 156720 - RNA, 32 nt, Human
gagaucagggauuggugaugacucuuaacgag

SEQ ID NO: 156721 - RNA, 32 nt, Human
gagaucaggugggcagaggcuggcagugcuga

SEQ ID NO: 156722 - RNA, 32 nt, Human
gagaucagucagaaaggcuuucugagaaaacu

SEQ ID NO: 156723 - RNA, 32 nt, Human
gagaucagugagcagaaaagcucacagaucaa

SEQ ID NO: 156724 - RNA, 32 nt, Human
gagaucauaccacugcacuccagccuggcgac

SEQ ID NO: 156725 - RNA, 32 nt, Human
gagaucauaccacuucauuccagccuggguga

SEQ ID NO: 156726 - RNA, 32 nt, Human
gagaucauaccauugcacuccagccuaggcaa

SEQ ID NO: 156727 - RNA, 32 nt, Human
gagaucauaccauugcacuccagccugggcaa

SEQ ID NO: 156728 - RNA, 32 nt, Human
gagaucaucuguccauuuuagaaccauuaauc

SEQ ID NO: 156729 - RNA, 32 nt, Human
gagaucaugacacugcacuccagccugggcaa

SEQ ID NO: 156730 - RNA, 32 nt, Human
gagaucaugccaccgcacuccagccugggcaa

SEQ ID NO: 156731 - RNA, 32 nt, Human
gagaucaugccacuacacuccagccuggcgac

SEQ ID NO: 156732 - RNA, 32 nt, Human
gagaucaugccacugaacuccagccugggcaa

SEQ ID NO: 156733 - RNA, 32 nt, Human
gagaucaugccacugcaaucuagccuggguga

SEQ ID NO: 156734 - RNA, 32 nt, Human
gagaucaugccacugcaccccagcaccuggcu

SEQ ID NO: 156735 - RNA, 32 nt, Human
gagaucaugccacugcaccccagccugggcaa

SEQ ID NO: 156736 - RNA, 32 nt, Human
gagaucaugccacugcacccuagcuugggugg

SEQ ID NO: 156737 - RNA, 32 nt, Human
gagaucaugccacugcacuagagccugggcaa

SEQ ID NO: 156738 - RNA, 32 nt, Human
gagaucaugccacugcacuccaaccugggcga

SEQ ID NO: 156739 - RNA, 32 nt, Human
gagaucaugccacugcacuccaaccuggguga

SEQ ID NO: 156740 - RNA, 32 nt, Human
gagaucaugccacugcacuccagccugaguga

SEQ ID NO: 156741 - RNA, 32 nt, Human
gagaucaugccacugcacuccagccuggacaa

SEQ ID NO: 156742 - RNA, 32 nt, Human
gagaucaugccacugcacuccagccuggauga

SEQ ID NO: 156743 - RNA, 32 nt, Human
gagaucaugccacugcacuccagccugggcaa

SEQ ID NO: 156744 - RNA, 32 nt, Human
gagaucaugccacugcacuccagccugggcag

SEQ ID NO: 156745 - RNA, 32 nt, Human
gagaucaugccacugcacuccagccugggcau

SEQ ID NO: 156746 - RNA, 32 nt, Human
gagaucaugccacugcacuccagccugggcca

SEQ ID NO: 156747 - RNA, 32 nt, Human
gagaucaugccacugcacuccagccugggcga

SEQ ID NO: 156748 - RNA, 32 nt, Human
gagaucaugccacugcacuccagccuggguga

SEQ ID NO: 156749 - RNA, 32 nt, Human
gagaucaugccacugcacuccauccugggcaa

SEQ ID NO: 156750 - RNA, 32 nt, Human
gagaucaugccacugcacuccugccuggguga

SEQ ID NO: 156751 - RNA, 32 nt, Human
gagaucaugccacugcacugcacuccagccug

SEQ ID NO: 156752 - RNA, 32 nt, Human
gagaucaugccacugcacuuuagccuggguga

SEQ ID NO: 156753 - RNA, 32 nt, Human
gagaucaugccacugcaugccagccugggcaa

SEQ ID NO: 156754 - RNA, 32 nt, Human
gagaucaugccacugcauucuagccugggcaa

SEQ ID NO: 156755 - RNA, 32 nt, Human
gagaucaugccagugcacuccagccugggcaa

SEQ ID NO: 156756 - RNA, 32 nt, Human
gagaucaugccauggcacuccauccuggguga

SEQ ID NO: 156757 - RNA, 32 nt, Human
gagaucaugccauuacacuccagccugggcga

SEQ ID NO: 156758 - RNA, 32 nt, Human
gagaucaugccauuacuccagccugggugaca

SEQ ID NO: 156759 - RNA, 32 nt, Human
gagaucaugccauugcacuccaaccuggguga

SEQ ID NO: 156760 - RNA, 32 nt, Human
gagaucaugccauugcacuccagccugaguga

SEQ ID NO: 156761 - RNA, 32 nt, Human
gagaucaugccauugcacuccagccuggacaa

SEQ ID NO: 156762 - RNA, 32 nt, Human
gagaucaugccauugcacuccagccugggcaa

SEQ ID NO: 156763 - RNA, 32 nt, Human
gagaucaugccauugcacuccagccugggcga

SEQ ID NO: 156764 - RNA, 32 nt, Human
gagaucaugccauugcacuccagccuggguga

SEQ ID NO: 156765 - RNA, 32 nt, Human
gagaucaugccauugcacuccagcuuggguga

SEQ ID NO: 156766 - RNA, 32 nt, Human
gagaucaugccauugcacuccagucugggcga

SEQ ID NO: 156767 - RNA, 32 nt, Human
gagaucaugccauugcacuccgacucugggca

SEQ ID NO: 156768 - RNA, 32 nt, Human
gagaucaugccccugcauuccagccuaggcga

SEQ ID NO: 156769 - RNA, 31 nt, Human
gagaucaugccgcugcauuccagccugggug

SEQ ID NO: 156770 - RNA, 32 nt, Human
gagaucaugccguuguacuccagcuugggcaa

SEQ ID NO: 156771 - RNA, 32 nt, Human
gagaucaugcuacugcacuccagccugggcga

SEQ ID NO: 156772 - RNA, 32 nt, Human
gagaucaugcuacugcacucuagccugagcga

SEQ ID NO: 156773 - RNA, 32 nt, Human
gagaucaugcuacugcaugccagccuggguga

SEQ ID NO: 156774 - RNA, 32 nt, Human
gagaucaugcuagugcgcuccagccugggcaa

SEQ ID NO: 156775 - RNA, 32 nt, Human
gagaucaugucacugcacuccagccuggguga

SEQ ID NO: 156776 - RNA, 32 nt, Human
gagaucaugucacugcacucuagcuugggaga

SEQ ID NO: 156777 - RNA, 32 nt, Human
gagaucaugucacuguacuccagccugggcaa

SEQ ID NO: 156778 - RNA, 32 nt, Human
gagaucauuaaaggcaaagccuguaugacgcu

SEQ ID NO: 156779 - RNA, 32 nt, Human
gagaucauuccauuacacuccagccugggcac

SEQ ID NO: 156780 - RNA, 32 nt, Human
gagaucauugcacuccagccugggcaauaaga

SEQ ID NO: 156781 - RNA, 21 nt, Human
gagauccaaaccaaggaggaa

SEQ ID NO: 156782 - RNA, 31 nt, Human
gagauccacagcuaagacgcccgggagcccc

SEQ ID NO: 156783 - RNA, 32 nt, Human
gagauccacgaggcagaggcagcaguagcgcu

SEQ ID NO: 156784 - RNA, 32 nt, Human
gagauccagccacagcacuccagccuggguga

SEQ ID NO: 156785 - RNA, 32 nt, Human
gagauccagcccuacuucuugcacugauaaug

SEQ ID NO: 156786 - RNA, 32 nt, Human
gagauccaggaaaccaaagcccugcugagcag

SEQ ID NO: 156787 - RNA, 32 nt, Human
gagauccagguuuaaaucuggcuuauuaacuc

SEQ ID NO: 156788 - RNA, 32 nt, Human
gagauccauccucccaccucagucuccugaaa

SEQ ID NO: 156789 - RNA, 32 nt, Human
gagauccauugaggcccucccagacugacgaa

SEQ ID NO: 156790 - RNA, 32 nt, Human
gagaucccaccacugcacuccagccugggcga

SEQ ID NO: 156791 - RNA, 32 nt, Human
gagaucccaccauugcacuccagccugggcaa

SEQ ID NO: 156792 - RNA, 32 nt, Human
gagaucccaggcccgagaggaugaaggcggga

SEQ ID NO: 156793 - RNA, 32 nt, Human
gagaucccaggcggugacagaguggagccaug

SEQ ID NO: 156794 - RNA, 32 nt, Human
gagaucccaguccggcuaagcuugguggagca

SEQ ID NO: 156795 - RNA, 32 nt, Human
gagaucccccgaccgcacuccagccugggcga

SEQ ID NO: 156796 - RNA, 32 nt, Human
gagauccccucauuaaaagaacagugaugaug

SEQ ID NO: 156797 - RNA, 32 nt, Human
gagaucccgccacucacuccagccuggauaaa

SEQ ID NO: 156798 - RNA, 32 nt, Human
gagaucccgccacugcacgccagccugggcga

SEQ ID NO: 156799 - RNA, 32 nt, Human
gagaucccgccacugcacuccagacugggcga

SEQ ID NO: 156800 - RNA, 32 nt, Human
gagaucccgccacugcacuccagccugggcga

SEQ ID NO: 156801 - RNA, 32 nt, Human
gagaucccggagagacagaugcugggacauca

SEQ ID NO: 156802 - RNA, 32 nt, Human
gagaucccugcccacucucuccccuucauugg

SEQ ID NO: 156803 - RNA, 32 nt, Human
gagaucccugggggcuccucuugccuggcagg

SEQ ID NO: 156804 - RNA, 32 nt, Human
gagauccgagagcucugcuucucugaaaagcg

SEQ ID NO: 156805 - RNA, 32 nt, Human
gagauccgccacugcacuccagccugggugac

SEQ ID NO: 156806 - RNA, 32 nt, Human
gagauccgugaauucucggaauggcaggggaa

SEQ ID NO: 156807 - RNA, 32 nt, Human
gagauccuacuucucugagucagcugaccccc

SEQ ID NO: 156808 - RNA, 32 nt, Human
gagauccucacaacacacuugggaaacagaca

SEQ ID NO: 156809 - RNA, 32 nt, Human
gagauccucagaguggaaggagggggaagcag

SEQ ID NO: 156810 - RNA, 32 nt, Human
gagauccuccagccuggacaugcugcccauac

SEQ ID NO: 156811 - RNA, 32 nt, Human
gagauccucccgccucagcauccugguagcug

SEQ ID NO: 156812 - RNA, 32 nt, Human
gagauccucuacccuucucugggccuugcuga

SEQ ID NO: 156813 - RNA, 32 nt, Human
gagauccugaaaccucugucauggaaaaguac

SEQ ID NO: 156814 - RNA, 32 nt, Human
gagauccugacccuacccuugugagagucaag

SEQ ID NO: 156815 - RNA, 32 nt, Human
gagauccugagccacagccgcccagcccugcu

SEQ ID NO: 156816 - RNA, 32 nt, Human
gagauccugagccuguggacuccgcucagcug

SEQ ID NO: 156817 - RNA, 32 nt, Human
gagauccugaggcugguaggggaagguaauuc

SEQ ID NO: 156818 - RNA, 32 nt, Human
gagauccugccacugcacuccagccugggcaa

SEQ ID NO: 156819 - RNA, 32 nt, Human
gagauccugccacugcacuccagccugugcca

SEQ ID NO: 156820 - RNA, 32 nt, Human
gagauccuggacugagggggccuggaugcccc

SEQ ID NO: 156821 - RNA, 22 nt, Human
gagauccuggagagauugaaaa

SEQ ID NO: 156822 - RNA, 32 nt, Human
gagauccuggagcuggagcaugagugucugac

SEQ ID NO: 156823 - RNA, 32 nt, Human
gagauccugggccagccccuccacacaucucc

SEQ ID NO: 156824 - RNA, 32 nt, Human
gagaucgagaccauccuaacacggugaaaucc

SEQ ID NO: 156825 - RNA, 31 nt, Human
gagaucgagacgauccuggccaacacgguga

SEQ ID NO: 156826 - RNA, 32 nt, Human
gagaucgagccacugcacuccagccugggcga

SEQ ID NO: 156827 - RNA, 32 nt, Human
gagaucgagccacugcacuccagccuggguga

SEQ ID NO: 156828 - RNA, 32 nt, Human
gagaucgagccacugcacuccugggcaacaga

SEQ ID NO: 156829 - RNA, 32 nt, Human
gagaucgagccauugcacuccagccuggacag

SEQ ID NO: 156830 - RNA, 24 nt, Human
gagaucgaggcuacagugagcuau

SEQ ID NO: 156831 - RNA, 32 nt, Human
gagaucgcaacacuacacuccagccugggcga

SEQ ID NO: 156832 - RNA, 32 nt, Human
gagaucgcaacacugcacuccagccugggcga

SEQ ID NO: 156833 - RNA, 32 nt, Human
gagaucgcaacacugcacuccagccuggguga

SEQ ID NO: 156834 - RNA, 32 nt, Human
gagaucgcaccacagcacuccagcccaggcgg

SEQ ID NO: 156835 - RNA, 32 nt, Human
gagaucgcaccaccacacuccagccuggguga

SEQ ID NO: 156836 - RNA, 32 nt, Human
gagaucgcaccacgccacugcacuccagcgug

SEQ ID NO: 156837 - RNA, 32 nt, Human
gagaucgcaccacggcacuccagccuggcgac

SEQ ID NO: 156838 - RNA, 32 nt, Human
gagaucgcaccacugcacucaagccugggcga

SEQ ID NO: 156839 - RNA, 32 nt, Human
gagaucgcaccacugcacuccaaccuggguga

SEQ ID NO: 156840 - RNA, 32 nt, Human
gagaucgcaccacugcacuccaaucugggcaa

SEQ ID NO: 156841 - RNA, 32 nt, Human
gagaucgcaccacugcacuccagcacuccagc

SEQ ID NO: 156842 - RNA, 32 nt, Human
gagaucgcaccacugcacuccagcaugaguga

SEQ ID NO: 156843 - RNA, 32 nt, Human
gagaucgcaccacugcacuccagccuggacaa

SEQ ID NO: 156844 - RNA, 32 nt, Human
gagaucgcaccacugcacuccagccugggaga

SEQ ID NO: 156845 - RNA, 32 nt, Human
gagaucgcaccacugcacuccagccugggcaa

SEQ ID NO: 156846 - RNA, 32 nt, Human
gagaucgcaccacugcacuccagccugggcga

SEQ ID NO: 156847 - RNA, 32 nt, Human
gagaucgcaccacugcacuccagccugggcgg

SEQ ID NO: 156848 - RNA, 32 nt, Human
gagaucgcaccacugcacuccagccuggguga

SEQ ID NO: 156849 - RNA, 32 nt, Human
gagaucgcaccacugcacuccagccuggugac

SEQ ID NO: 156850 - RNA, 32 nt, Human
gagaucgcaccacugcacuccagccugguuac

SEQ ID NO: 156851 - RNA, 32 nt, Human
gagaucgcaccacugcacuccagcuuggagga

SEQ ID NO: 156852 - RNA, 32 nt, Human
gagaucgcaccacugcacucccgcuuggcaau

SEQ ID NO: 156853 - RNA, 32 nt, Human
gagaucgcaccacugcacucuagccuggguga

SEQ ID NO: 156854 - RNA, 32 nt, Human
gagaucgcaccacugcacucuagccuuggcaa

SEQ ID NO: 156855 - RNA, 32 nt, Human
gagaucgcaccacugcacucuagcuugggcaa

SEQ ID NO: 156856 - RNA, 32 nt, Human
gagaucgcaccacugcacugcagccuggcaac

SEQ ID NO: 156857 - RNA, 32 nt, Human
gagaucgcaccacugcacuucagccuggguga

SEQ ID NO: 156858 - RNA, 32 nt, Human
gagaucgcaccacugcauuccagccugggcaa

SEQ ID NO: 156859 - RNA, 32 nt, Human
gagaucgcaccacugcauuccagccuggguga

SEQ ID NO: 156860 - RNA, 32 nt, Human
gagaucgcaccacugcauugcagccuggugac

SEQ ID NO: 156861 - RNA, 32 nt, Human
gagaucgcaccacugcccuccagccuagguga

SEQ ID NO: 156862 - RNA, 32 nt, Human
gagaucgcaccacuguacuccagccugggcga

SEQ ID NO: 156863 - RNA, 32 nt, Human
gagaucgcaccacuguacuccagccuggguga

SEQ ID NO: 156864 - RNA, 32 nt, Human
gagaucgcaccagugcacuccagccuugguga

SEQ ID NO: 156865 - RNA, 32 nt, Human
gagaucgcaccauuacacuccagccugggcaa

SEQ ID NO: 156866 - RNA, 32 nt, Human
gagaucgcaccauugcacuccagcccgggcaa

SEQ ID NO: 156867 - RNA, 32 nt, Human
gagaucgcaccauugcacuccagccuggcgac

SEQ ID NO: 156868 - RNA, 32 nt, Human
gagaucgcaccauugcacuccagccugggcaa

SEQ ID NO: 156869 - RNA, 32 nt, Human
gagaucgcaccauugcacuccugccugggcaa

SEQ ID NO: 156870 - RNA, 32 nt, Human
gagaucgcaccauugcauuccagccugggcaa

SEQ ID NO: 156871 - RNA, 32 nt, Human
gagaucgcaccauugcccuccagccugggcaa

SEQ ID NO: 156872 - RNA, 32 nt, Human
gagaucgcaccccugcacuccagccugggcaa

SEQ ID NO: 156873 - RNA, 32 nt, Human
gagaucgcaccgcugcacuccagccugggcaa

SEQ ID NO: 156874 - RNA, 32 nt, Human
gagaucgcaccgcugcccuccagccugggcaa

SEQ ID NO: 156875 - RNA, 32 nt, Human
gagaucgcacuccagccugggugacagaguga

SEQ ID NO: 156876 - RNA, 32 nt, Human
gagaucgcacugcuguacccagccugggccac

SEQ ID NO: 156877 - RNA, 32 nt, Human
gagaucgcagcacuguacuccagccugggcga

SEQ ID NO: 156878 - RNA, 32 nt, Human
gagaucgcagugagcugagaucacgccacugc

SEQ ID NO: 156879 - RNA, 32 nt, Human
gagaucgcagugaguugagauuguaccacugc

SEQ ID NO: 156880 - RNA, 32 nt, Human
gagaucgcaucacugcaguccagccuggauga

SEQ ID NO: 156881 - RNA, 32 nt, Human
gagaucgcauuacugcacuccagccuggguaa

SEQ ID NO: 156882 - RNA, 32 nt, Human
gagaucgccacugcacuccagccugggaaaua

SEQ ID NO: 156883 - RNA, 32 nt, Human
gagaucgccccacuacacuccagccuggucaa

SEQ ID NO: 156884 - RNA, 32 nt, Human
gagaucgccccacugcacuccagccuggugac

SEQ ID NO: 156885 - RNA, 32 nt, Human
gagaucgccccauuguacuccagccuggggaa

SEQ ID NO: 156886 - RNA, 32 nt, Human
gagaucgcccugcugcacuccagccuggguga

SEQ ID NO: 156887 - RNA, 32 nt, Human
gagaucgcgacacugcgcuccagccugggcaa

SEQ ID NO: 156888 - RNA, 32 nt, Human
gagaucgcgcaauugcgcuccagccugggcga

SEQ ID NO: 156889 - RNA, 32 nt, Human
gagaucgcgcagcugcacuccagccugggcaa

SEQ ID NO: 156890 - RNA, 32 nt, Human
gagaucgcgccaaugcacuccagccugggcga

SEQ ID NO: 156891 - RNA, 32 nt, Human
gagaucgcgccaccacacuccagccugagcga

SEQ ID NO: 156892 - RNA, 32 nt, Human
gagaucgcgccacccacuccagcccgggugac

SEQ ID NO: 156893 - RNA, 32 nt, Human
gagaucgcgccaccgcacuccagccucgccga

SEQ ID NO: 156894 - RNA, 32 nt, Human
gagaucgcgccaccgcauuccagccugggcga

SEQ ID NO: 156895 - RNA, 32 nt, Human
gagaucgcgccaccgcccuccagccugggcga

SEQ ID NO: 156896 - RNA, 32 nt, Human
gagaucgcgccacggcacuccagccugggaga

SEQ ID NO: 156897 - RNA, 32 nt, Human
gagaucgcgccacuacuccagccugggugaca

SEQ ID NO: 156898 - RNA, 32 nt, Human
gagaucgcgccacuauacuccagccugggcaa

SEQ ID NO: 156899 - RNA, 32 nt, Human
gagaucgcgccacugcaacccagccuggguga

SEQ ID NO: 156900 - RNA, 32 nt, Human
gagaucgcgccacugcacucaagccugggcaa

SEQ ID NO: 156901 - RNA, 32 nt, Human
gagaucgcgccacugcacuccaaccuggguga

SEQ ID NO: 156902 - RNA, 32 nt, Human
gagaucgcgccacugcacuccagcagucuggg

SEQ ID NO: 156903 - RNA, 32 nt, Human
gagaucgcgccacugcacuccagccuagacga

SEQ ID NO: 156904 - RNA, 32 nt, Human
gagaucgcgccacugcacuccagccuagggga

SEQ ID NO: 156905 - RNA, 32 nt, Human
gagaucgcgccacugcacuccagccuagguga

SEQ ID NO: 156906 - RNA, 32 nt, Human
gagaucgcgccacugcacuccagccucgguga

SEQ ID NO: 156907 - RNA, 32 nt, Human
gagaucgcgccacugcacuccagccuggacga

SEQ ID NO: 156908 - RNA, 32 nt, Human
gagaucgcgccacugcacuccagccuggcaac

SEQ ID NO: 156909 - RNA, 32 nt, Human
gagaucgcgccacugcacuccagccuggcgac

SEQ ID NO: 156910 - RNA, 32 nt, Human
gagaucgcgccacugcacuccagccugggcaa

SEQ ID NO: 156911 - RNA, 32 nt, Human
gagaucgcgccacugcacuccagccugggcga

SEQ ID NO: 156912 - RNA, 32 nt, Human
gagaucgcgccacugcacuccagccuggguaa

SEQ ID NO: 156913 - RNA, 32 nt, Human
gagaucgcgccacugcacuccagccuggguga

SEQ ID NO: 156914 - RNA, 32 nt, Human
gagaucgcgccacugcacuccagccuggugac

SEQ ID NO: 156915 - RNA, 32 nt, Human
gagaucgcgccacugcacuccagcuugggcaa

SEQ ID NO: 156916 - RNA, 32 nt, Human
gagaucgcgccacugcacuccaggccugggug

SEQ ID NO: 156917 - RNA, 32 nt, Human
gagaucgcgccacugcacuccaggcugggcga

SEQ ID NO: 156918 - RNA, 32 nt, Human
gagaucgcgccacugcacuccaguuugggcaa

SEQ ID NO: 156919 - RNA, 32 nt, Human
gagaucgcgccacugcacuccugccugggaca

SEQ ID NO: 156920 - RNA, 32 nt, Human
gagaucgcgccacugcacucuagccggaguga

SEQ ID NO: 156921 - RNA, 32 nt, Human
gagaucgcgccacugcacucuagccugaguga

SEQ ID NO: 156922 - RNA, 32 nt, Human
gagaucgcgccacugcacucuagccugggcca

SEQ ID NO: 156923 - RNA, 32 nt, Human
gagaucgcgccacugcacucuagccuggguga

SEQ ID NO: 156924 - RNA, 32 nt, Human
gagaucgcgccacugcccuccagccugggcga

SEQ ID NO: 156925 - RNA, 32 nt, Human
gagaucgcgccacugcucuccagccugggugg

SEQ ID NO: 156926 - RNA, 32 nt, Human
gagaucgcgccacuggacuccagccuggacaa

SEQ ID NO: 156927 - RNA, 32 nt, Human
gagaucgcgccacugggcuccagccugggcga

SEQ ID NO: 156928 - RNA, 32 nt, Human
gagaucgcgccacugugcuccagccugggcaa

SEQ ID NO: 156929 - RNA, 32 nt, Human
gagaucgcgccaguacacuccagccuggguaa

SEQ ID NO: 156930 - RNA, 32 nt, Human
gagaucgcgccagugcacuccagccugggcaa

SEQ ID NO: 156931 - RNA, 32 nt, Human
gagaucgcgccauagcacuccagccuuagccu

SEQ ID NO: 156932 - RNA, 32 nt, Human
gagaucgcgccaucacacuccagccuaggcga

SEQ ID NO: 156933 - RNA, 32 nt, Human
gagaucgcgccaucgcacuccagccuggguga

SEQ ID NO: 156934 - RNA, 32 nt, Human
gagaucgcgccauugcacuccaaccuagguga

SEQ ID NO: 156935 - RNA, 32 nt, Human
gagaucgcgccauugcacuccagccuggccua

SEQ ID NO: 156936 - RNA, 32 nt, Human
gagaucgcgccauugcacuccagccugggcaa

SEQ ID NO: 156937 - RNA, 32 nt, Human
gagaucgcgccauugcacuccagccugggcga

SEQ ID NO: 156938 - RNA, 32 nt, Human
gagaucgcgccauugcacuccagccuggguga

SEQ ID NO: 156939 - RNA, 32 nt, Human
gagaucgcgccauugcacuccauccuggacaa

SEQ ID NO: 156940 - RNA, 32 nt, Human
gagaucgcgccauugcacucccgccugggcga

SEQ ID NO: 156941 - RNA, 32 nt, Human
gagaucgcgccauugcacuccggccuggggac

SEQ ID NO: 156942 - RNA, 32 nt, Human
gagaucgcgccauuguacuccagccugggcga

SEQ ID NO: 156943 - RNA, 32 nt, Human
gagaucgcgccgcugcacuccagccugggcca

SEQ ID NO: 156944 - RNA, 32 nt, Human
gagaucgcgccgcugcacuccagccugggcga

SEQ ID NO: 156945 - RNA, 32 nt, Human
gagaucgcgccgcugcacuccagccuggguga

SEQ ID NO: 156946 - RNA, 32 nt, Human
gagaucgcgccgcugcauuccagccuggguga

SEQ ID NO: 156947 - RNA, 32 nt, Human
gagaucgcgccguugcacuccagccugggcaa

SEQ ID NO: 156948 - RNA, 32 nt, Human
gagaucgcgccuuugcacuccagccuggaaga

SEQ ID NO: 156949 - RNA, 32 nt, Human
gagaucgcgcuacugcacuccagccuggguga

SEQ ID NO: 156950 - RNA, 32 nt, Human
gagaucgcgcuacugcauuccagccugggcgc

SEQ ID NO: 156951 - RNA, 32 nt, Human
gagaucgcgcugcugcacuccagccuggguga

SEQ ID NO: 156952 - RNA, 32 nt, Human
gagaucgcgucacugcacuccagccuggacaa

SEQ ID NO: 156953 - RNA, 32 nt, Human
gagaucgcgucacugcacuccagcgugggcga

SEQ ID NO: 156954 - RNA, 32 nt, Human
gagaucgcgucacugcacuccagucuagcaac

SEQ ID NO: 156955 - RNA, 32 nt, Human
gagaucgcgucaguacacuccagccugggcaa

SEQ ID NO: 156956 - RNA, 32 nt, Human
gagaucgcgucauugcacuccagccugggcaa

SEQ ID NO: 156957 - RNA, 32 nt, Human
gagaucgcuccacugcacuccagcccagguga

SEQ ID NO: 156958 - RNA, 32 nt, Human
gagaucgcuccacugcacuccagccuggguga

SEQ ID NO: 156959 - RNA, 32 nt, Human
gagaucgcugcacuccagccugggcgacaaga

SEQ ID NO: 156960 - RNA, 32 nt, Human
gagaucgggccacggcacuccagccuggguga

SEQ ID NO: 156961 - RNA, 22 nt, Human
gagaucggggagcccacggugg

SEQ ID NO: 156962 - RNA, 32 nt, Human
gagaucggucaccaggagagcagccacaaagg

SEQ ID NO: 156963 - RNA, 32 nt, Human
gagaucguaccauugcacuccagccugggcaa

SEQ ID NO: 156964 - RNA, 32 nt, Human
gagaucguaccuauugcacuccauccuggaug

SEQ ID NO: 156965 - RNA, 32 nt, Human
gagaucguagcacugcaguccagccugggcga

SEQ ID NO: 156966 - RNA, 32 nt, Human
gagaucgucccacugcacuccagcccgggcaa

SEQ ID NO: 156967 - RNA, 32 nt, Human
gagaucgucccacugcacuccagccugggcaa

SEQ ID NO: 156968 - RNA, 32 nt, Human
gagaucgugacacugcacuucagccuggcuga

SEQ ID NO: 156969 - RNA, 32 nt, Human
gagaucgugcaacugcacuccaaccugggcaa

SEQ ID NO: 156970 - RNA, 32 nt, Human
gagaucgugccacugcaccacuccagccuggg

SEQ ID NO: 156971 - RNA, 32 nt, Human
gagaucgugccacugcaccccagccugggcaa

SEQ ID NO: 156972 - RNA, 32 nt, Human
gagaucgugccacugcacgccagccugggcaa

SEQ ID NO: 156973 - RNA, 32 nt, Human
gagaucgugccacugcacucaagccuggguga

SEQ ID NO: 156974 - RNA, 32 nt, Human
gagaucgugccacugcacucaagccuggugac

SEQ ID NO: 156975 - RNA, 32 nt, Human
gagaucgugccacugcacuccagacuugguga

SEQ ID NO: 156976 - RNA, 32 nt, Human
gagaucgugccacugcacuccagagccugggc

SEQ ID NO: 156977 - RNA, 32 nt, Human
gagaucgugccacugcacuccagccugaagac

SEQ ID NO: 156978 - RNA, 32 nt, Human
gagaucgugccacugcacuccagccugagcaa

SEQ ID NO: 156979 - RNA, 32 nt, Human
gagaucgugccacugcacuccagccugcggga

SEQ ID NO: 156980 - RNA, 32 nt, Human
gagaucgugccacugcacuccagccuggauua

SEQ ID NO: 156981 - RNA, 32 nt, Human
gagaucgugccacugcacuccagccugggaga

SEQ ID NO: 156982 - RNA, 32 nt, Human
gagaucgugccacugcacuccagccugggcaa

SEQ ID NO: 156983 - RNA, 32 nt, Human
gagaucgugccacugcacuccagccugggcac

SEQ ID NO: 156984 - RNA, 32 nt, Human
gagaucgugccacugcacuccagccugggcca

SEQ ID NO: 156985 - RNA, 32 nt, Human
gagaucgugccacugcacuccagccugggcga

SEQ ID NO: 156986 - RNA, 32 nt, Human
gagaucgugccacugcacuccagccuggguga

SEQ ID NO: 156987 - RNA, 32 nt, Human
gagaucgugccacugcacuccagccugggugg

SEQ ID NO: 156988 - RNA, 32 nt, Human
gagaucgugccacugcacuccagccuggucaa

SEQ ID NO: 156989 - RNA, 32 nt, Human
gagaucgugccacugcacuccagccuggugac

SEQ ID NO: 156990 - RNA, 32 nt, Human
gagaucgugccacugcacuccagccuggugag

SEQ ID NO: 156991 - RNA, 32 nt, Human
gagaucgugccacugcacuccagcuugggcaa

SEQ ID NO: 156992 - RNA, 32 nt, Human
gagaucgugccacugcacuccaggcugggcga

SEQ ID NO: 156993 - RNA, 32 nt, Human
gagaucgugccacugcacuccaggcuggguga

SEQ ID NO: 156994 - RNA, 32 nt, Human
gagaucgugccacugcacuccagucugggcaa

SEQ ID NO: 156995 - RNA, 32 nt, Human
gagaucgugccacugcacuccauccuggacga

SEQ ID NO: 156996 - RNA, 32 nt, Human
gagaucgugccacugcacucccagccugggca

SEQ ID NO: 156997 - RNA, 32 nt, Human
gagaucgugccacugcacucuagccugggcga

SEQ ID NO: 156998 - RNA, 32 nt, Human
gagaucgugccacugcgcuccagccuggguga

SEQ ID NO: 156999 - RNA, 32 nt, Human
gagaucgugccacugcgcuccagccugggugg

SEQ ID NO: 157000 - RNA, 32 nt, Human
gagaucgugccacugcucuccagccuggguga

SEQ ID NO: 157001 - RNA, 32 nt, Human
gagaucgugccauuacacuccagccugggcga

SEQ ID NO: 157002 - RNA, 32 nt, Human
gagaucgugccauugcacuccagccuaggcaa

SEQ ID NO: 157003 - RNA, 32 nt, Human
gagaucgugccauugcacuccagccuggauga

SEQ ID NO: 157004 - RNA, 32 nt, Human
gagaucgugccauugcacuccagccuggccac

SEQ ID NO: 157005 - RNA, 32 nt, Human
gagaucgugccauugcacuccagccuggcgac

SEQ ID NO: 157006 - RNA, 32 nt, Human
gagaucgugccauugcacuccagccugggcga

SEQ ID NO: 157007 - RNA, 32 nt, Human
gagaucgugccauugcacuccagccuggguga

SEQ ID NO: 157008 - RNA, 32 nt, Human
gagaucgugccauugcacuccagucuggguaa

SEQ ID NO: 157009 - RNA, 32 nt, Human
gagaucgugccauugcacuccggccugggcaa

SEQ ID NO: 157010 - RNA, 32 nt, Human
gagaucgugccauugcauuccagccugggaga

SEQ ID NO: 157011 - RNA, 32 nt, Human
gagaucgugccauugcgcuccagccuagguga

SEQ ID NO: 157012 - RNA, 32 nt, Human
gagaucgugccauugcgcuccagccugggcaa

SEQ ID NO: 157013 - RNA, 32 nt, Human
gagaucgugccauugugcuccagccugggcaa

SEQ ID NO: 157014 - RNA, 32 nt, Human
gagaucgugccguugcacuccagccugggcga

SEQ ID NO: 157015 - RNA, 32 nt, Human
gagaucgugccuuugcacuccagcguggaaga

SEQ ID NO: 157016 - RNA, 32 nt, Human
gagaucgugcuacugcacuccagccuggggga

SEQ ID NO: 157017 - RNA, 32 nt, Human
gagaucgugcuacugcacuccagucuggguga

SEQ ID NO: 157018 - RNA, 32 nt, Human
gagaucgugcuacugcaguccagccugggcua

SEQ ID NO: 157019 - RNA, 32 nt, Human
gagaucgugcuauugcacuccagccugggcga

SEQ ID NO: 157020 - RNA, 32 nt, Human
gagaucgugcugcugcacuccagccugggcaa

SEQ ID NO: 157021 - RNA, 32 nt, Human
gagaucguggccacugcaauccagccugggcg

SEQ ID NO: 157022 - RNA, 32 nt, Human
gagaucgugucacuacacuccaggcuggguga

SEQ ID NO: 157023 - RNA, 32 nt, Human
gagaucgugucacugcacuccagccuggcgac

SEQ ID NO: 157024 - RNA, 32 nt, Human
gagaucgugucacugcacuccagccugggcga

SEQ ID NO: 157025 - RNA, 32 nt, Human
gagaucgugucacugcacuccagccuggguga

SEQ ID NO: 157026 - RNA, 32 nt, Human
gagaucguucccaggcuggcgucucugggguu

SEQ ID NO: 157027 - RNA, 32 nt, Human
gagaucucaaaaaucagccccaaaaagguauu

SEQ ID NO: 157028 - RNA, 32 nt, Human
gagaucucaccacugcacuccagccugggcag

SEQ ID NO: 157029 - RNA, 32 nt, Human
gagaucucaccauuacacuccagccugggcga

SEQ ID NO: 157030 - RNA, 32 nt, Human
gagaucucgccacugcgcuccagccugggcaa

SEQ ID NO: 157031 - RNA, 32 nt, Human
gagaucucgccacugugcuccagccugggcaa

SEQ ID NO: 157032 - RNA, 32 nt, Human
gagaucucgccauugcacuccauucugggcaa

SEQ ID NO: 157033 - RNA, 32 nt, Human
gagaucugaaguuuauggcuucauugagaaac

SEQ ID NO: 157034 - RNA, 32 nt, Human
gagaucugagccugaagagagggaacaaguca

SEQ ID NO: 157035 - RNA, 32 nt, Human
gagaucugaugcuuccugagggccaaggcauu

SEQ ID NO: 157036 - RNA, 32 nt, Human
gagaucugcagcaagcucaacuacauuccagg

SEQ ID NO: 157037 - RNA, 32 nt, Human
gagaucugcaggcugccucuucugccccggag

SEQ ID NO: 157038 - RNA, 32 nt, Human
gagaucugccacugcacuccagccuggcgaca

SEQ ID NO: 157039 - RNA, 32 nt, Human
gagaucuggccauugcacuccagcgugggcaa

SEQ ID NO: 157040 - RNA, 32 nt, Human
gagaucuggcugggaucaagaaaccucuuuuc

SEQ ID NO: 157041 - RNA, 32 nt, Human
gagaucugggcaacauauugagacucugucuc

SEQ ID NO: 157042 - RNA, 32 nt, Human
gagaucugggcuggagcuagggggucaaugga

SEQ ID NO: 157043 - RNA, 25 nt, Human
gagaucuguaaaaccugcccaggaa

SEQ ID NO: 157044 - RNA, 32 nt, Human
gagaucugucagggguccagaggagcggaguc

SEQ ID NO: 157045 - RNA, 29 nt, Human
gagaucugucucccugugccuggagaguu

SEQ ID NO: 157046 - RNA, 32 nt, Human
gagaucugugugccuugccuuccuucagcagg

SEQ ID NO: 157047 - RNA, 32 nt, Human
gagaucuucccacugcacuccagccuggccaa

SEQ ID NO: 157048 - RNA, 32 nt, Human
gagaucuucuagggagugacccaucuauuuuu

SEQ ID NO: 157049 - RNA, 32 nt, Human
gagaucuugccacugcacaccagccugggcaa

SEQ ID NO: 157050 - RNA, 32 nt, Human
gagaucuugccacugcacuccagccugggcaa

SEQ ID NO: 157051 - RNA, 32 nt, Human
gagaucuuguggagcugggaucauguuugaac

SEQ ID NO: 157052 - RNA, 32 nt, Human
gagaucuuucuuuccaaaacauuucuggacag

SEQ ID NO: 157053 - RNA, 32 nt, Human
gagaugaaaacaacaagcaggccaggcacggu

SEQ ID NO: 157054 - RNA, 32 nt, Human
gagaugaaaacaacgagcaggccaggcacggu

SEQ ID NO: 157055 - RNA, 28 nt, Human
gagaugaaaggcugcugccgcccggucg

SEQ ID NO: 157056 - RNA, 32 nt, Human
gagaugaaaggcuuugcagaaagcuuugagcu

SEQ ID NO: 157057 - RNA, 28 nt, Human
gagaugaacggcuucagcacggaggagg

SEQ ID NO: 157058 - RNA, 32 nt, Human
gagaugaacucuuaaaggccuggaccugggag

SEQ ID NO: 157059 - RNA, 32 nt, Human
gagaugaaggaaaggagugaaagggaaguagg

SEQ ID NO: 157060 - RNA, 24 nt, Human
gagaugacaaauggagaagaaagg

SEQ ID NO: 157061 - RNA, 23 nt, Human
gagaugacacagacccaaagugg

SEQ ID NO: 157062 - RNA, 23 nt, Human
gagaugacacagcaagaagaagg

SEQ ID NO: 157063 - RNA, 23 nt, Human
gagaugacacggcaagaagaagg

SEQ ID NO: 157064 - RNA, 24 nt, Human
gagaugacaugcauagaaagaggg

SEQ ID NO: 157065 - RNA, 32 nt, Human
gagaugaccuggagaacugcauuuuaagauuu

SEQ ID NO: 157066 - RNA, 32 nt, Human
gagaugaccuuugccaagagcacagccaucuu

SEQ ID NO: 157067 - RNA, 32 nt, Human
gagaugaccuuugccaagagcacagccgucuu

SEQ ID NO: 157068 - RNA, 32 nt, Human
gagaugacgagaugucccggcuccaguggcga

SEQ ID NO: 157069 - RNA, 32 nt, Human
gagaugacgccauugcacuccagccuggguga

SEQ ID NO: 157070 - RNA, 32 nt, Human
gagaugacucacuuaacccgucuccuuuaagu

SEQ ID NO: 157071 - RNA, 32 nt, Human
gagaugacugaguauggagauuaccaggcaga

SEQ ID NO: 157072 - RNA, 32 nt, Human
gagaugacuucucagagguucuaggugaugcu

SEQ ID NO: 157073 - RNA, 32 nt, Human
gagaugacuucugcugauuuugcuuuagaaug

SEQ ID NO: 157074 - RNA, 32 nt, Human
gagaugacuuugaugacucugccccucagcag

SEQ ID NO: 157075 - RNA, 32 nt, Human
gagaugagaacaggaccagacaccuucauccu

SEQ ID NO: 157076 - RNA, 32 nt, Human
gagaugagaagaggcacaagaaacaaucucga

SEQ ID NO: 157077 - RNA, 32 nt, Human
gagaugagagaggugccuucucuguauuagac

SEQ ID NO: 157078 - RNA, 22 nt, Human
gagaugagauuucaccauguug

SEQ ID NO: 157079 - RNA, 32 nt, Human
gagaugagcccacccccacccuucccuggggg

SEQ ID NO: 157080 - RNA, 32 nt, Human
gagaugaggagggagagaacuaggggcccgca

SEQ ID NO: 157081 - RNA, 32 nt, Human
gagaugaggccucguccuccuggaagcugagg

SEQ ID NO: 157082 - RNA, 32 nt, Human
gagaugaggggacugaggggaccaggggacag

SEQ ID NO: 157083 - RNA, 32 nt, Human
gagaugagggucuugccauguuguccaggcug

SEQ ID NO: 157084 - RNA, 22 nt, Human
gagaugagguuucaccauguug

SEQ ID NO: 157085 - RNA, 23 nt, Human
gagaugagguuucaccauguugg

SEQ ID NO: 157086 - RNA, 32 nt, Human
gagaugaguagagagaacugaauuagaggauu

SEQ ID NO: 157087 - RNA, 32 nt, Human
gagaugagugugagagcugggaugggcaggaa

SEQ ID NO: 157088 - RNA, 21 nt, Human
gagaugaguuucaccauguug

SEQ ID NO: 157089 - RNA, 18 nt, Human
gagaugaucuugcccuuc

SEQ ID NO: 157090 - RNA, 32 nt, Human
gagaugauggauagaauuaaaaagggaguuca

SEQ ID NO: 157091 - RNA, 32 nt, Human
gagaugauggauuccuguagaacuagaggugg

SEQ ID NO: 157092 - RNA, 32 nt, Human
gagaugauguucaugugcuuccuugaaaccag

SEQ ID NO: 157093 - RNA, 32 nt, Human
gagaugcaaagccugaagacacugguagcuuu

SEQ ID NO: 157094 - RNA, 32 nt, Human
gagaugcaacccagcccccaaaccuacauucu

SEQ ID NO: 157095 - RNA, 32 nt, Human
gagaugcaaugauaguuaugugcuuaccuaac

SEQ ID NO: 157096 - RNA, 32 nt, Human
gagaugcacaccuucgcuucucucaccaggaa

SEQ ID NO: 157097 - RNA, 32 nt, Human
gagaugcacuauacuuaaaaccauucucuccc

SEQ ID NO: 157098 - RNA, 17 nt, Human
gagaugcagcucuggga

SEQ ID NO: 157099 - RNA, 32 nt, Human
gagaugcagugccaggaacccuuaaacaguug

SEQ ID NO: 157100 - RNA, 32 nt, Human
gagaugcaguguccagggaagcagaggcagca

SEQ ID NO: 157101 - RNA, 32 nt, Human
gagaugcauauuaggaaugugaagccagaaug

SEQ ID NO: 157102 - RNA, 32 nt, Human
gagaugcauuccagagaugcacuccgcucugg

SEQ ID NO: 157103 - RNA, 32 nt, Human
gagaugcauugugauuguaauuacugaguuga

SEQ ID NO: 157104 - RNA, 21 nt, Human
gagaugcauuugaggauuuua

SEQ ID NO: 157105 - RNA, 32 nt, Human
gagaugccaaguggggccagggccaagucuca

SEQ ID NO: 157106 - RNA, 32 nt, Human
gagaugccacauuucucucugggaaacuacca

SEQ ID NO: 157107 - RNA, 32 nt, Human
gagaugcccaggaggaggagcccuagggaaga

SEQ ID NO: 157108 - RNA, 32 nt, Human
gagaugcccaggauuugacucgggccuuagaa

SEQ ID NO: 157109 - RNA, 32 nt, Human
gagaugcccccauccaguccuggaggacccgc

SEQ ID NO: 157110 - RNA, 25 nt, Human
gagaugcccgcacaguaauguagaa

SEQ ID NO: 157111 - RNA, 32 nt, Human
gagaugccucauucuacuggaacaucacugug

SEQ ID NO: 157112 - RNA, 32 nt, Human
gagaugccuucagccagcaucccagacuccac

SEQ ID NO: 157113 - RNA, 32 nt, Human
gagaugcgaaggaagccagaacgaaaagagag

SEQ ID NO: 157114 - RNA, 32 nt, Human
gagaugcgcagccacggccccacccacagccu

SEQ ID NO: 157115 - RNA, 32 nt, Human
gagaugcgccacugcacuccagccugggcgac

SEQ ID NO: 157116 - RNA, 32 nt, Human
gagaugcgcggcuguucguguuuuggguuuuu

SEQ ID NO: 157117 - RNA, 32 nt, Human
gagaugcggaaagggucagagcagggcucggc

SEQ ID NO: 157118 - RNA, 21 nt, Human
gagaugcggccaagauaggac

SEQ ID NO: 157119 - RNA, 32 nt, Human
gagaugcuaaggaauugcccaaagucacacag

SEQ ID NO: 157120 - RNA, 32 nt, Human
gagaugcuacguccaagaccugcaggaugucu

SEQ ID NO: 157121 - RNA, 32 nt, Human
gagaugcuacugccuggagacuggggucuuaa

SEQ ID NO: 157122 - RNA, 31 nt, Human
gagaugcucaauagauguuuguugaaugaau

SEQ ID NO: 157123 - RNA, 32 nt, Human
gagaugcuccuugggcccuuugagugcagucc

SEQ ID NO: 157124 - RNA, 23 nt, Human
gagaugcugaggcagguggauca

SEQ ID NO: 157125 - RNA, 24 nt, Human
gagaugcugaggcagguggaucau

SEQ ID NO: 157126 - RNA, 32 nt, Human
gagaugcugcaguccaggucugaggucccgcu

SEQ ID NO: 157127 - RNA, 32 nt, Human
gagaugcugcuccaaaaggcccaggcuuccuu

SEQ ID NO: 157128 - RNA, 32 nt, Human
gagaugcuggaggugggggugcuguguucuag

SEQ ID NO: 157129 - RNA, 30 nt, Human
gagaugcuggccucugugcuccugcugucu

SEQ ID NO: 157130 - RNA, 32 nt, Human
gagaugcuggcgaucuccuucaucucggccgu

SEQ ID NO: 157131 - RNA, 32 nt, Human
gagaugcugggaacuuugggacucacuugauu

SEQ ID NO: 157132 - RNA, 18 nt, Human
gagaugcuggggaugcca

SEQ ID NO: 157133 - RNA, 32 nt, Human
gagaugcugguccuggcuugaggggaggggca

SEQ ID NO: 157134 - RNA, 32 nt, Human
gagaugcuguucaucagucccaacaagauggc

SEQ ID NO: 157135 - RNA, 24 nt, Human
gagaugcuuggaugggccugaaaa

SEQ ID NO: 157136 - RNA, 32 nt, Human
gagaugcuuguccuagguccaaaucucaucca

SEQ ID NO: 157137 - RNA, 17 nt, Human
gagaugcuugugaagua

SEQ ID NO: 157138 - RNA, 19 nt, Human
gagauggaaacugcccugg

SEQ ID NO: 157139 - RNA, 32 nt, Human
gagauggaacccuaaguggagaaugguuauuc

SEQ ID NO: 157140 - RNA, 28 nt, Human
gagauggaacugguaaaggcagcccugg

SEQ ID NO: 157141 - RNA, 32 nt, Human
gagauggaagaggagacacagacacaaagcag

SEQ ID NO: 157142 - RNA, 32 nt, Human
gagauggaagaggaggaggaggaggagcugga

SEQ ID NO: 157143 - RNA, 32 nt, Human
gagauggaagagucuuuaaccuuuguaauuac

SEQ ID NO: 157144 - RNA, 32 nt, Human
gagauggaagcauaggucaaagcuguuuggag

SEQ ID NO: 157145 - RNA, 32 nt, Human
gagauggaagcuuguugaaaacccagacuguc

SEQ ID NO: 157146 - RNA, 32 nt, Human
gagauggaaggaugagaggugaaauugaccuu

SEQ ID NO: 157147 - RNA, 32 nt, Human
gagauggaagucacuagaggugagagauguua

SEQ ID NO: 157148 - RNA, 32 nt, Human
gagauggaaugagauauagaccaagaagugca

SEQ ID NO: 157149 - RNA, 22 nt, Human
gagauggaauuucaccauguua

SEQ ID NO: 157150 - RNA, 32 nt, Human
gagauggacauuuacugacuccccuucugugu

SEQ ID NO: 157151 - RNA, 28 nt, Human
gagauggaccucaaccgguucauccagg

SEQ ID NO: 157152 - RNA, 32 nt, Human
gagauggacucucauucugucacccgggcugg

SEQ ID NO: 157153 - RNA, 32 nt, Human
gagauggagaaggggaaggaaggggcuuuggg

SEQ ID NO: 157154 - RNA, 32 nt, Human
gagauggagacucacucuguugcccaggcugg

SEQ ID NO: 157155 - RNA, 32 nt, Human
gagauggagagaagaaugaagagguggugguu

SEQ ID NO: 157156 - RNA, 32 nt, Human
gagauggagagaagaaugaagggguggugguu

SEQ ID NO: 157157 - RNA, 32 nt, Human
gagauggagaucuugcuauauugcccaggcuu

SEQ ID NO: 157158 - RNA, 32 nt, Human
gagauggagccacugcacuccagccugggcga

SEQ ID NO: 157159 - RNA, 32 nt, Human
gagauggagccacugcacuccagccuggggga

SEQ ID NO: 157160 - RNA, 32 nt, Human
gagauggagccagcaggcugguagccuggcag

SEQ ID NO: 157161 - RNA, 32 nt, Human
gagauggagccgcggugagggugggcgggagg

SEQ ID NO: 157162 - RNA, 32 nt, Human
gagauggaggccugaggcuuuggguccagggu

SEQ ID NO: 157163 - RNA, 21 nt, Human
gagauggaggcugcaguaagc

SEQ ID NO: 157164 - RNA, 32 nt, Human
gagauggaggucucacuauguugcccaggcug

SEQ ID NO: 157165 - RNA, 32 nt, Human
gagauggagucucacuauguugcucaggcugg

SEQ ID NO: 157166 - RNA, 20 nt, Human
gagauggagucucacucugu

SEQ ID NO: 157167 - RNA, 32 nt, Human
gagauggagucucacucuguugcucaggcugg

SEQ ID NO: 157168 - RNA, 20 nt, Human
gagauggagucuuacucugu

SEQ ID NO: 157169 - RNA, 20 nt, Human
gagauggagucuugcucugu

SEQ ID NO: 157170 - RNA, 22 nt, Human
gagauggaguuucaccauguua

SEQ ID NO: 157171 - RNA, 22 nt, Human
gagauggaguuucaccauguug

SEQ ID NO: 157172 - RNA, 32 nt, Human
gagauggaguuucacccuuguugcccaggcug

SEQ ID NO: 157173 - RNA, 20 nt, Human
gagauggaguuucacucugu

SEQ ID NO: 157174 - RNA, 32 nt, Human
gagauggaguuucacucuuguugcccacgcug

SEQ ID NO: 157175 - RNA, 32 nt, Human
gagauggaguuucacucuuguugcccaggcug

SEQ ID NO: 157176 - RNA, 32 nt, Human
gagauggaguuucagucuuguugcccaggcug

SEQ ID NO: 157177 - RNA, 32 nt, Human
gagauggaguuucgcgcuuguugcccaggcug

SEQ ID NO: 157178 - RNA, 32 nt, Human
gagauggaguuucgcucuuguugcccaggcgg

SEQ ID NO: 157179 - RNA, 32 nt, Human
gagauggaguuucgcucuuguugcccaggcua

SEQ ID NO: 157180 - RNA, 32 nt, Human
gagauggaguuucgcucuuguugcccaggcug

SEQ ID NO: 157181 - RNA, 32 nt, Human
gagauggaguuucgcucuuguugcccaggcuu

SEQ ID NO: 157182 - RNA, 32 nt, Human
gagauggaguuucgcuuuuguugcccaggcug

SEQ ID NO: 157183 - RNA, 32 nt, Human
gagauggaguuucgugcuuguugcccaggcug

SEQ ID NO: 157184 - RNA, 32 nt, Human
gagauggaguuucguucuuguugcccaaccug

SEQ ID NO: 157185 - RNA, 32 nt, Human
gagauggaguuucucucuuguugcccaggcug

SEQ ID NO: 157186 - RNA, 32 nt, Human
gagauggaguuuugcucuuauugcccaggcug

SEQ ID NO: 157187 - RNA, 32 nt, Human
gagauggaguuuugcucuuguugcccagacug

SEQ ID NO: 157188 - RNA, 32 nt, Human
gagauggaguuuugcucuuguugcccaggcug

SEQ ID NO: 157189 - RNA, 32 nt, Human
gagauggaucugcuagaaggaaccuggagagc

SEQ ID NO: 157190 - RNA, 32 nt, Human
gagauggauguuuucugaccuugauaaggacu

SEQ ID NO: 157191 - RNA, 32 nt, Human
gagauggauuaaugugaguaacaggaaugugu

SEQ ID NO: 157192 - RNA, 32 nt, Human
gagauggcaacaguuuacuauuugguaagagu

SEQ ID NO: 157193 - RNA, 28 nt, Human
gagauggcaccacugcacuccagccugg

SEQ ID NO: 157194 - RNA, 32 nt, Human
gagauggcaccacugcacuccagccuggacga

SEQ ID NO: 157195 - RNA, 32 nt, Human
gagauggcaccacugcacuccagccugggaga

SEQ ID NO: 157196 - RNA, 32 nt, Human
gagauggcaccacugcacuccagccugggcaa

SEQ ID NO: 157197 - RNA, 32 nt, Human
gagauggcaccacugcacuccagccuggguga

SEQ ID NO: 157198 - RNA, 32 nt, Human
gagauggcaccacugcacuccagcuuggguga

SEQ ID NO: 157199 - RNA, 32 nt, Human
gagauggcaccacugcacuccggccuaggcaa

SEQ ID NO: 157200 - RNA, 32 nt, Human
gagauggcaccacugcauuccagccuggguga

SEQ ID NO: 157201 - RNA, 32 nt, Human
gagauggcaccacuggacuccagccugggcga

SEQ ID NO: 157202 - RNA, 32 nt, Human
gagauggcaccacuuauugcacuccagcccgg

SEQ ID NO: 157203 - RNA, 32 nt, Human
gagauggcaccauugcacuccagccuggguga

SEQ ID NO: 157204 - RNA, 32 nt, Human
gagauggcaggugugugaguucuguccuagac

SEQ ID NO: 157205 - RNA, 24 nt, Human
gagauggcauuucggggugcucug

SEQ ID NO: 157206 - RNA, 32 nt, Human
gagauggcauuuucuucugggcuucagcauga

SEQ ID NO: 157207 - RNA, 32 nt, Human
gagauggccagccugaagucacgguccuggcc

SEQ ID NO: 157208 - RNA, 32 nt, Human
gagauggcccugcuccccuccuaggaggugcu

SEQ ID NO: 157209 - RNA, 32 nt, Human
gagauggccucagcguggccagccugccaaac

SEQ ID NO: 157210 - RNA, 32 nt, Human
gagauggccuccagcgucagugccaagacuga

SEQ ID NO: 157211 - RNA, 28 nt, Human
gagauggcgauggagaugaggcuuccag

SEQ ID NO: 157212 - RNA, 32 nt, Human
gagauggcgccacugcacuccagcccgggcga

SEQ ID NO: 157213 - RNA, 32 nt, Human
gagauggcgccacugcacuccagccuaggcaa

SEQ ID NO: 157214 - RNA, 32 nt, Human
gagauggcgccacugcacuccagccugggcga

SEQ ID NO: 157215 - RNA, 32 nt, Human
gagauggcgccacugcacuccagccugggcgu

SEQ ID NO: 157216 - RNA, 32 nt, Human
gagauggcgccacugcacuccagccuggguga

SEQ ID NO: 157217 - RNA, 32 nt, Human
gagauggcgccacugcacucccgucuggggga

SEQ ID NO: 157218 - RNA, 32 nt, Human
gagauggcgccacugcgcuccagccugggcaa

SEQ ID NO: 157219 - RNA, 32 nt, Human
gagauggcgccaucacacuccagccugcucuu

SEQ ID NO: 157220 - RNA, 32 nt, Human
gagauggcgccauugcacuccagccugggcaa

SEQ ID NO: 157221 - RNA, 32 nt, Human
gagauggcgccauuucacuccagccugggcga

SEQ ID NO: 157222 - RNA, 32 nt, Human
gagauggcgcgacugcacuccagccugggcga

SEQ ID NO: 157223 - RNA, 32 nt, Human
gagauggcgcuauugcacuccagucuggguaa

SEQ ID NO: 157224 - RNA, 28 nt, Human
gagauggcgguucuccggaggcugagug

SEQ ID NO: 157225 - RNA, 28 nt, Human
gagauggcgguucucuggaggcugagug

SEQ ID NO: 157226 - RNA, 22 nt, Human
gagauggcguuucaccauguug

SEQ ID NO: 157227 - RNA, 28 nt, Human
gagauggcuagugcuucauccagccaaa

SEQ ID NO: 157228 - RNA, 32 nt, Human
gagauggcugcuagcuguguuuugaaauauuu

SEQ ID NO: 157229 - RNA, 32 nt, Human
gagauggcuuacaaaaagaaauauugaauuuu

SEQ ID NO: 157230 - RNA, 32 nt, Human
gagaugggaauagaggaugaugacaguuuauu

SEQ ID NO: 157231 - RNA, 32 nt, Human
gagaugggagacgggcgauggcugugguccuu

SEQ ID NO: 157232 - RNA, 32 nt, Human
gagaugggaggaggagaaaaagcgguacgaug

SEQ ID NO: 157233 - RNA, 32 nt, Human
gagaugggagucuugcucugucgcccaggcug

SEQ ID NO: 157234 - RNA, 32 nt, Human
gagaugggaguuucaccauguuggccaggcug

SEQ ID NO: 157235 - RNA, 22 nt, Human
gagaugggaucucaccauguug

SEQ ID NO: 157236 - RNA, 32 nt, Human
gagaugggaucucacuagguugcccaggcugg

SEQ ID NO: 157237 - RNA, 32 nt, Human
gagaugggaucucacuauguugcucaggcuga

SEQ ID NO: 157238 - RNA, 22 nt, Human
gagaugggauuucaccauguug

SEQ ID NO: 157239 - RNA, 23 nt, Human
gagaugggauuucaccauguugg

SEQ ID NO: 157240 - RNA, 21 nt, Human
gagaugggcaaauggcuauug

SEQ ID NO: 157241 - RNA, 32 nt, Human
gagaugggcagggagagugacggggagcagca

SEQ ID NO: 157242 - RNA, 32 nt, Human
gagaugggccggaggugcagagaggaccaagg

SEQ ID NO: 157243 - RNA, 22 nt, Human
gagaugggcggaucacgagguc

SEQ ID NO: 157244 - RNA, 20 nt, Human
gagaugggcuggcaucugca

SEQ ID NO: 157245 - RNA, 32 nt, Human
gagauggggagguugagggacaggaucuauag

SEQ ID NO: 157246 - RNA, 32 nt, Human
gagauggggauggagucccaaggcaagcgccc

SEQ ID NO: 157247 - RNA, 23 nt, Human
gagauggggcaguuaaugcugaa

SEQ ID NO: 157248 - RNA, 32 nt, Human
gagauggggccaccccuuccuuccaggcacau

SEQ ID NO: 157249 - RNA, 32 nt, Human
gagauggggccacugcacugcagccuguguga

SEQ ID NO: 157250 - RNA, 32 nt, Human
gagauggggcuucaccaucuugaccaggcugg

SEQ ID NO: 157251 - RNA, 22 nt, Human
gagauggggcuucaccauguug

SEQ ID NO: 157252 - RNA, 23 nt, Human
gagauggggcuucaccauguugg

SEQ ID NO: 157253 - RNA, 32 nt, Human
gagaugggggcagggggagcagcauccugcca

SEQ ID NO: 157254 - RNA, 32 nt, Human
gagaugggggucucacuauguugcccaggcug

SEQ ID NO: 157255 - RNA, 32 nt, Human
gagaugggggucuugcucuguugcccacgcag

SEQ ID NO: 157256 - RNA, 28 nt, Human
gagauggggguucccuucuucucuucuc

SEQ ID NO: 157257 - RNA, 19 nt, Human
gagauggggguuucaccau

SEQ ID NO: 157258 - RNA, 24 nt, Human
gagauggggguuucaccauauugg

SEQ ID NO: 157259 - RNA, 32 nt, Human
gagauggggguuucaccauauuggccagucug

SEQ ID NO: 157260 - RNA, 32 nt, Human
gagauggggguuucaccauauuggucaggcug

SEQ ID NO: 157261 - RNA, 23 nt, Human
gagauggggguuucaccauguug

SEQ ID NO: 157262 - RNA, 24 nt, Human
gagauggggguuucaccauguugg

SEQ ID NO: 157263 - RNA, 32 nt, Human
gagauggggguuucaccauguuggccaggcua

SEQ ID NO: 157264 - RNA, 32 nt, Human
gagauggggguuucuccuuguuggucaggcug

SEQ ID NO: 157265 - RNA, 32 nt, Human
gagauggggguuuugccauguugcccaagcag

SEQ ID NO: 157266 - RNA, 32 nt, Human
gagaugggguagcuuuucucucucacucucuc

SEQ ID NO: 157267 - RNA, 22 nt, Human
gagauggggucucaccauguua

SEQ ID NO: 157268 - RNA, 20 nt, Human
gagauggggucucacccugu

SEQ ID NO: 157269 - RNA, 32 nt, Human
gagaugggguggcccaauccccaaucaguuuu

SEQ ID NO: 157270 - RNA, 23 nt, Human
gagaugggguuucacaauguugg

SEQ ID NO: 157271 - RNA, 23 nt, Human
gagaugggguuucacaauuuugg

SEQ ID NO: 157272 - RNA, 23 nt, Human
gagaugggguuucaccacauugg

SEQ ID NO: 157273 - RNA, 21 nt, Human
gagaugggguuucaccacguu

SEQ ID NO: 157274 - RNA, 22 nt, Human
gagaugggguuucaccacguua

SEQ ID NO: 157275 - RNA, 22 nt, Human
gagaugggguuucaccacguug

SEQ ID NO: 157276 - RNA, 23 nt, Human
gagaugggguuucaccacguugg

SEQ ID NO: 157277 - RNA, 18 nt, Human
gagaugggguuucaccau

SEQ ID NO: 157278 - RNA, 23 nt, Human
gagaugggguuucaccauacugg

SEQ ID NO: 157279 - RNA, 23 nt, Human
gagaugggguuucaccauauugg

SEQ ID NO: 157280 - RNA, 19 nt, Human
gagaugggguuucaccaug

SEQ ID NO: 157281 - RNA, 23 nt, Human
gagaugggguuucaccaugcugg

SEQ ID NO: 157282 - RNA, 20 nt, Human
gagaugggguuucaccaugu

SEQ ID NO: 157283 - RNA, 21 nt, Human
gagaugggguuucaccauguu

SEQ ID NO: 157284 - RNA, 22 nt, Human
gagaugggguuucaccauguua

SEQ ID NO: 157285 - RNA, 22 nt, Human
gagaugggguuucaccauguug

SEQ ID NO: 157286 - RNA, 23 nt, Human
gagaugggguuucaccauguugg

SEQ ID NO: 157287 - RNA, 22 nt, Human
gagaugggguuucacccuguua

SEQ ID NO: 157288 - RNA, 22 nt, Human
gagaugggguuucaccguguua

SEQ ID NO: 157289 - RNA, 23 nt, Human
gagaugggguuucacgauguugg

SEQ ID NO: 157290 - RNA, 23 nt, Human
gagaugggguuucacuauguugg

SEQ ID NO: 157291 - RNA, 32 nt, Human
gagaugggguuucgccacauugcccagguugg

SEQ ID NO: 157292 - RNA, 22 nt, Human
gagaugggguuucgccauguua

SEQ ID NO: 157293 - RNA, 32 nt, Human
gagaugggugccuccccucugccucccauuuc

SEQ ID NO: 157294 - RNA, 32 nt, Human
gagauggguggaucaccugagcucaggaguuc

SEQ ID NO: 157295 - RNA, 21 nt, Human
gagauggguuucaccauguug

SEQ ID NO: 157296 - RNA, 22 nt, Human
gagauggguuucaccauguugg

SEQ ID NO: 157297 - RNA, 32 nt, Human
gagaugguaccacugcacuccagccuggguga

SEQ ID NO: 157298 - RNA, 32 nt, Human
gagaugguaguggcuucagccucugcagucag

SEQ ID NO: 157299 - RNA, 32 nt, Human
gagauggucaguuuagaguaggaugcugggca

SEQ ID NO: 157300 - RNA, 32 nt, Human
gagauggucgcaauaaugucugcccagaaccu

SEQ ID NO: 157301 - RNA, 32 nt, Human
gagauggucuaaaucagcugcaucccauuugg

SEQ ID NO: 157302 - RNA, 32 nt, Human
gagauggugccacugcacuccagaugaguaca

SEQ ID NO: 157303 - RNA, 32 nt, Human
gagauggugccacugcacuccagccuagguga

SEQ ID NO: 157304 - RNA, 32 nt, Human
gagauggugccacugcacuccagccuggcgac

SEQ ID NO: 157305 - RNA, 32 nt, Human
gagauggugccacugcacuccagccugggcaa

SEQ ID NO: 157306 - RNA, 32 nt, Human
gagauggugccacugcacuccagccugggcga

SEQ ID NO: 157307 - RNA, 32 nt, Human
gagauggugccacugcacuccagccuggggga

SEQ ID NO: 157308 - RNA, 32 nt, Human
gagauggugccacugcacuccagccuggguga

SEQ ID NO: 157309 - RNA, 32 nt, Human
gagauggugccacugcacuccagcuuagguga

SEQ ID NO: 157310 - RNA, 32 nt, Human
gagauggugccacugcacucuaaccugggcga

SEQ ID NO: 157311 - RNA, 32 nt, Human
gagauggugccacugcacuucagccugggcaa

SEQ ID NO: 157312 - RNA, 32 nt, Human
gagauggugccacugcauuccagccugggcaa

SEQ ID NO: 157313 - RNA, 32 nt, Human
gagauggugccacugcauuucugccuggcaac

SEQ ID NO: 157314 - RNA, 32 nt, Human
gagauggugccacuguacuccagccuggguga

SEQ ID NO: 157315 - RNA, 32 nt, Human
gagauggugccauugcccuccagccugggcaa

SEQ ID NO: 157316 - RNA, 32 nt, Human
gagauggugcuggagccagggagcugcugucc

SEQ ID NO: 157317 - RNA, 32 nt, Human
gagaugguggccugaggccaggaggcugcagc

SEQ ID NO: 157318 - RNA, 32 nt, Human
gagaugguggggugguggugggguugaagaaa

SEQ ID NO: 157319 - RNA, 22 nt, Human
gagaugguguuucaccauguug

SEQ ID NO: 157320 - RNA, 32 nt, Human
gagauguacaaaagcugaccgaauucacuacc

SEQ ID NO: 157321 - RNA, 32 nt, Human
gagauguaugcugccuguuauugcaguagcau

SEQ ID NO: 157322 - RNA, 32 nt, Human
gagaugucacagauuccugcagagccaugguc

SEQ ID NO: 157323 - RNA, 32 nt, Human
gagaugucaccacugcccuccagccuggguga

SEQ ID NO: 157324 - RNA, 32 nt, Human
gagaugucggccaggugcucccauugggguuu

SEQ ID NO: 157325 - RNA, 32 nt, Human
gagaugucuagaggcagacuccugagugagga

SEQ ID NO: 157326 - RNA, 32 nt, Human
gagaugucugcaggaagaugggauuuacaaag

SEQ ID NO: 157327 - RNA, 32 nt, Human
gagaugugaaggagggaaggagcaggagagca

SEQ ID NO: 157328 - RNA, 32 nt, Human
gagaugugcaccaaugaaaacuaugcuggguc

SEQ ID NO: 157329 - RNA, 32 nt, Human
gagaugugcccacugcccgugcagccuccuuc

SEQ ID NO: 157330 - RNA, 32 nt, Human
gagaugugggaaccgcugcacccuccacauca

SEQ ID NO: 157331 - RNA, 32 nt, Human
gagaugugggcagaggaagaggacacugaaga

SEQ ID NO: 157332 - RNA, 24 nt, Human
gagauguguuugcaccacugcacu

SEQ ID NO: 157333 - RNA, 32 nt, Human
gagauguuaauuuaaaaauuuccacuacacuu

SEQ ID NO: 157334 - RNA, 32 nt, Human
gagauguuaucccaccauguaaagucgccugc

SEQ ID NO: 157335 - RNA, 32 nt, Human
gagauguucaagcucauccauucuuuagacac

SEQ ID NO: 157336 - RNA, 28 nt, Human
gagauguucccgggaagccugucuagag

SEQ ID NO: 157337 - RNA, 32 nt, Human
gagauguuccgggcauacugcugugcucugug

SEQ ID NO: 157338 - RNA, 32 nt, Human
gagauguuccuucagaaggcaggaccuggagg

SEQ ID NO: 157339 - RNA, 32 nt, Human
gagauguugagaauguucaucucuccagcccc

SEQ ID NO: 157340 - RNA, 21 nt, Human
gagauguuuggaacacaguca

SEQ ID NO: 157341 - RNA, 32 nt, Human
gagauguuuuggagcaugguagaugggcauca

SEQ ID NO: 157342 - RNA, 32 nt, Human
gagauguuuuuaaauagagauuuguaacauca

SEQ ID NO: 157343 - RNA, 32 nt, Human
gagauuaaccccucccccagacucgugccuug

SEQ ID NO: 157344 - RNA, 32 nt, Human
gagauuaagaaugccaggaauauugucauccu

SEQ ID NO: 157345 - RNA, 32 nt, Human
gagauuaagccaccgcacuccagccugggcga

SEQ ID NO: 157346 - RNA, 32 nt, Human
gagauuacaccauugcauuccagccuaggcaa

SEQ ID NO: 157347 - RNA, 32 nt, Human
gagauuacaccccuggacuccagcuuggguga

SEQ ID NO: 157348 - RNA, 32 nt, Human
gagauuacagaagugagccacuguguccugcc

SEQ ID NO: 157349 - RNA, 32 nt, Human
gagauuacagugagcuauggaucggccacugc

SEQ ID NO: 157350 - RNA, 32 nt, Human
gagauuacgccacugcaccccaaccugggcga

SEQ ID NO: 157351 - RNA, 32 nt, Human
gagauuacgccacugcacuccagccugggcaa

SEQ ID NO: 157352 - RNA, 32 nt, Human
gagauuaggaaagagaaaagguugagaagauc

SEQ ID NO: 157353 - RNA, 21 nt, Human
gagauuaggagaagcugaaaa

SEQ ID NO: 157354 - RNA, 32 nt, Human
gagauuaggccaggagaggagcccggguuggu

SEQ ID NO: 157355 - RNA, 32 nt, Human
gagauuagggauuggugaugacucuuaacgag

SEQ ID NO: 157356 - RNA, 32 nt, Human
gagauuagggauuggugaugacucuuaaugag

SEQ ID NO: 157357 - RNA, 32 nt, Human
gagauuagguugugauacaugaagagccaaga

SEQ ID NO: 157358 - RNA, 32 nt, Human
gagauuauacaggagauucucuuucuucgcug

SEQ ID NO: 157359 - RNA, 32 nt, Human
gagauuaugccacugcacuccagccuggugac

SEQ ID NO: 157360 - RNA, 32 nt, Human
gagauuaugccacuguacuccagccuggguga

SEQ ID NO: 157361 - RNA, 32 nt, Human
gagauuaugccacuguacuccagcguggguga

SEQ ID NO: 157362 - RNA, 32 nt, Human
gagauuaugucacuccagccugggcaacagag

SEQ ID NO: 157363 - RNA, 32 nt, Human
gagauuauuucugcucuucaggaaauuucugc

SEQ ID NO: 157364 - RNA, 32 nt, Human
gagauuauuuguaucuaagaaaccagguaaaa

SEQ ID NO: 157365 - RNA, 21 nt, Human
gagauucaacuuuaccaucca

SEQ ID NO: 157366 - RNA, 32 nt, Human
gagauucacagaggcaaggcagagaacaagac

SEQ ID NO: 157367 - RNA, 32 nt, Human
gagauucagagcagggaggaaaaguuagggua

SEQ ID NO: 157368 - RNA, 32 nt, Human
gagauucaggcagacugguggcaguggaguag

SEQ ID NO: 157369 - RNA, 32 nt, Human
gagauucagucugucuggaaucccggaacccc

SEQ ID NO: 157370 - RNA, 32 nt, Human
gagauuccaggccugacccaucaugccuagcc

SEQ ID NO: 157371 - RNA, 32 nt, Human
gagauuccaucugaaaaacaaaaacaaaaaca

SEQ ID NO: 157372 - RNA, 32 nt, Human
gagauuccauguguuuugcucaucucaccagc

SEQ ID NO: 157373 - RNA, 32 nt, Human
gagauuccauuuuucuccuaucagacuggcag

SEQ ID NO: 157374 - RNA, 32 nt, Human
gagauuccccuggaaaugauguggaagaugag

SEQ ID NO: 157375 - RNA, 32 nt, Human
gagauuccuccccugcuaaaguucuucauggu

SEQ ID NO: 157376 - RNA, 32 nt, Human
gagauucgccugaacccgggaggcagagguug

SEQ ID NO: 157377 - RNA, 32 nt, Human
gagauucuagcaggggacaggauuggcucaga

SEQ ID NO: 157378 - RNA, 32 nt, Human
gagauucucgcucugcugcuuuaguuucggag

SEQ ID NO: 157379 - RNA, 32 nt, Human
gagauucugcauuucuaaggagucucagggau

SEQ ID NO: 157380 - RNA, 32 nt, Human
gagauucugcauuuuaaacaagcuccuggagg

SEQ ID NO: 157381 - RNA, 32 nt, Human
gagauucugcucaucauugcucagcuccucag

SEQ ID NO: 157382 - RNA, 32 nt, Human
gagauucugugccccuugucgggccgcuuguu

SEQ ID NO: 157383 - RNA, 32 nt, Human
gagauucuucauuucugcuuucugcccuguca

SEQ ID NO: 157384 - RNA, 32 nt, Human
gagauugaaaaugaagcaaagauaggaugaau

SEQ ID NO: 157385 - RNA, 32 nt, Human
gagauugaagagaggaagggaacguuggaacc

SEQ ID NO: 157386 - RNA, 32 nt, Human
gagauugagagggaugucgggcaguucccauu

SEQ ID NO: 157387 - RNA, 32 nt, Human
gagauugagcaacuguacuccagcuuggcgac

SEQ ID NO: 157388 - RNA, 32 nt, Human
gagauugagcaucuuguuuguuuugucaccac

SEQ ID NO: 157389 - RNA, 32 nt, Human
gagauugagccacugcacuccagccuggguga

SEQ ID NO: 157390 - RNA, 32 nt, Human
gagauugaggcugaaagaggauccaccauuuu

SEQ ID NO: 157391 - RNA, 21 nt, Human
gagauugaggcugcagugagc

SEQ ID NO: 157392 - RNA, 32 nt, Human
gagauugaggcugcagugagcuguguucacac

SEQ ID NO: 157393 - RNA, 32 nt, Human
gagauugaggugggaggaucaccugagccuaa

SEQ ID NO: 157394 - RNA, 32 nt, Human
gagauugauuauucaaccaggauaccuaauuc

SEQ ID NO: 157395 - RNA, 32 nt, Human
gagauugcaacacugccacuccagccugggug

SEQ ID NO: 157396 - RNA, 32 nt, Human
gagauugcacaauugcacuccagccuggcgac

SEQ ID NO: 157397 - RNA, 32 nt, Human
gagauugcaccacagcacuccaaccuggguga

SEQ ID NO: 157398 - RNA, 32 nt, Human
gagauugcaccaccgcacuccagccuggguga

SEQ ID NO: 157399 - RNA, 32 nt, Human
gagauugcaccacggcacuccagccuggguga

SEQ ID NO: 157400 - RNA, 32 nt, Human
gagauugcaccacuacacuccagccuggauga

SEQ ID NO: 157401 - RNA, 32 nt, Human
gagauugcaccacuacacuccagccugggcaa

SEQ ID NO: 157402 - RNA, 32 nt, Human
gagauugcaccacuacacuccagccuggguga

SEQ ID NO: 157403 - RNA, 32 nt, Human
gagauugcaccacugcacgccagccuggguga

SEQ ID NO: 157404 - RNA, 32 nt, Human
gagauugcaccacugcacuccagcccaggcaa

SEQ ID NO: 157405 - RNA, 32 nt, Human
gagauugcaccacugcacuccagccuaggcga

SEQ ID NO: 157406 - RNA, 32 nt, Human
gagauugcaccacugcacuccagccugaguga

SEQ ID NO: 157407 - RNA, 32 nt, Human
gagauugcaccacugcacuccagccuggcgac

SEQ ID NO: 157408 - RNA, 32 nt, Human
gagauugcaccacugcacuccagccugggcaa

SEQ ID NO: 157409 - RNA, 32 nt, Human
gagauugcaccacugcacuccagccugggcga

SEQ ID NO: 157410 - RNA, 32 nt, Human
gagauugcaccacugcacuccagccugggcgg

SEQ ID NO: 157411 - RNA, 32 nt, Human
gagauugcaccacugcacuccagccuggggac

SEQ ID NO: 157412 - RNA, 32 nt, Human
gagauugcaccacugcacuccagccuggguaa

SEQ ID NO: 157413 - RNA, 32 nt, Human
gagauugcaccacugcacuccagccuggguga

SEQ ID NO: 157414 - RNA, 32 nt, Human
gagauugcaccacugcacuccagccugggugg

SEQ ID NO: 157415 - RNA, 32 nt, Human
gagauugcaccacugcacuccagccuggugac

SEQ ID NO: 157416 - RNA, 32 nt, Human
gagauugcaccacugcacuccagcgagacucu

SEQ ID NO: 157417 - RNA, 32 nt, Human
gagauugcaccacugcacuccagucugggcaa

SEQ ID NO: 157418 - RNA, 32 nt, Human
gagauugcaccacugcacuccagucuggguga

SEQ ID NO: 157419 - RNA, 32 nt, Human
gagauugcaccacugcacuucagccuggugac

SEQ ID NO: 157420 - RNA, 32 nt, Human
gagauugcaccacugcaguucagccuggauga

SEQ ID NO: 157421 - RNA, 32 nt, Human
gagauugcaccacugcauuccaaccugggcgg

SEQ ID NO: 157422 - RNA, 32 nt, Human
gagauugcaccacugcauuccagccuggauga

SEQ ID NO: 157423 - RNA, 32 nt, Human
gagauugcaccacugcauuccagccuggcgac

SEQ ID NO: 157424 - RNA, 32 nt, Human
gagauugcaccacuguacuccaaccugggcga

SEQ ID NO: 157425 - RNA, 32 nt, Human
gagauugcaccacuguacuccagcacucuagc

SEQ ID NO: 157426 - RNA, 32 nt, Human
gagauugcaccacuuacuccagccugggcaac

SEQ ID NO: 157427 - RNA, 32 nt, Human
gagauugcaccacuucacuccagccuggguga

SEQ ID NO: 157428 - RNA, 32 nt, Human
gagauugcaccauugcacuccagccugggcaa

SEQ ID NO: 157429 - RNA, 32 nt, Human
gagauugcaccauugcacuccagccugggcga

SEQ ID NO: 157430 - RNA, 32 nt, Human
gagauugcaccauugcacuccagccugugcaa

SEQ ID NO: 157431 - RNA, 32 nt, Human
gagauugcaccauugcacuccagcuuggguga

SEQ ID NO: 157432 - RNA, 32 nt, Human
gagauugcaccauugcauuccagccugggcaa

SEQ ID NO: 157433 - RNA, 32 nt, Human
gagauugcaccauuguacuccagccugggcaa

SEQ ID NO: 157434 - RNA, 32 nt, Human
gagauugcaccauuucauuccagccugggcaa

SEQ ID NO: 157435 - RNA, 32 nt, Human
gagauugcaccccugcacuccaggcugggcaa

SEQ ID NO: 157436 - RNA, 32 nt, Human
gagauugcaccgcugcacuccagccuggcgac

SEQ ID NO: 157437 - RNA, 32 nt, Human
gagauugcaccuuuguacuccagccugggcaa

SEQ ID NO: 157438 - RNA, 32 nt, Human
gagauugcacuacugcacuccagacuggugac

SEQ ID NO: 157439 - RNA, 32 nt, Human
gagauugcacuauugcacuccagccugggcaa

SEQ ID NO: 157440 - RNA, 32 nt, Human
gagauugcagucaguuccugggugcauugucg

SEQ ID NO: 157441 - RNA, 32 nt, Human
gagauugcagugaaccaagaucgggccacugc

SEQ ID NO: 157442 - RNA, 32 nt, Human
gagauugcagugaacuaagaucacaccauugc

SEQ ID NO: 157443 - RNA, 32 nt, Human
gagauugcagugagcagagauugugccacugc

SEQ ID NO: 157444 - RNA, 32 nt, Human
gagauugcagugagccaagacugcgccacugc

SEQ ID NO: 157445 - RNA, 32 nt, Human
gagauugcagugagccaagaucaagccauugu

SEQ ID NO: 157446 - RNA, 32 nt, Human
gagauugcagugagccaagaucacaccacugc

SEQ ID NO: 157447 - RNA, 32 nt, Human
gagauugcagugagccaagaucgcaccgcugc

SEQ ID NO: 157448 - RNA, 32 nt, Human
gagauugcagugagcccagaucgcaccacugc

SEQ ID NO: 157449 - RNA, 32 nt, Human
gagauugcagugagcccagauugcaccacugc

SEQ ID NO: 157450 - RNA, 32 nt, Human
gagauugcagugagccgaaaucacgccacuac

SEQ ID NO: 157451 - RNA, 32 nt, Human
gagauugcagugagccgagaucacgccauugc

SEQ ID NO: 157452 - RNA, 32 nt, Human
gagauugcagugagccgagaucacgcuacugc

SEQ ID NO: 157453 - RNA, 32 nt, Human
gagauugcagugagccgagaucauugcauugc

SEQ ID NO: 157454 - RNA, 32 nt, Human
gagauugcagugagccgagaucccgccacugc

SEQ ID NO: 157455 - RNA, 32 nt, Human
gagauugcagugagccgagaucgugucacugc

SEQ ID NO: 157456 - RNA, 32 nt, Human
gagauugcagugagccgaggucaugccacugc

SEQ ID NO: 157457 - RNA, 32 nt, Human
gagauugcagugagcugagaccacaccacugc

SEQ ID NO: 157458 - RNA, 32 nt, Human
gagauugcagugagcugagauaaucccacugc

SEQ ID NO: 157459 - RNA, 32 nt, Human
gagauugcagugagcugagaucacgccacugc

SEQ ID NO: 157460 - RNA, 32 nt, Human
gagauugcagugagcugagaucacgccauugc

SEQ ID NO: 157461 - RNA, 32 nt, Human
gagauugcagugagcugagaucaugccauugc

SEQ ID NO: 157462 - RNA, 32 nt, Human
gagauugcagugagcugagaucgcaccacugc

SEQ ID NO: 157463 - RNA, 32 nt, Human
gagauugcagugagcugagaucgcaccauugc

SEQ ID NO: 157464 - RNA, 32 nt, Human
gagauugcagugagcugagaucgugccauugc

SEQ ID NO: 157465 - RNA, 32 nt, Human
gagauugcagugagcugagauugcaccacugc

SEQ ID NO: 157466 - RNA, 32 nt, Human
gagauugcagugagcugagauugcgccacugc

SEQ ID NO: 157467 - RNA, 32 nt, Human
gagauugcagugagcugagauugugccacugu

SEQ ID NO: 157468 - RNA, 32 nt, Human
gagauugcagugagucaagaucucaccacuga

SEQ ID NO: 157469 - RNA, 32 nt, Human
gagauugcaucacugcacuccagccugggcga

SEQ ID NO: 157470 - RNA, 32 nt, Human
gagauugcaucauugcacuccagccugggcaa

SEQ ID NO: 157471 - RNA, 32 nt, Human
gagauugcauggcugcacucuagccuggguga

SEQ ID NO: 157472 - RNA, 32 nt, Human
gagauugccaauuuuccugauuuccuuaaggu

SEQ ID NO: 157473 - RNA, 32 nt, Human
gagauugccacugcacuccagccugggcaaca

SEQ ID NO: 157474 - RNA, 32 nt, Human
gagauugccccacugcacuccagccuaggcaa

SEQ ID NO: 157475 - RNA, 32 nt, Human
gagauugcccccgcuacacuccagccuggucg

SEQ ID NO: 157476 - RNA, 32 nt, Human
gagauugcgccaccgcacuccagccugggcaa

SEQ ID NO: 157477 - RNA, 32 nt, Human
gagauugcgccaccgcacuccagccugggcga

SEQ ID NO: 157478 - RNA, 32 nt, Human
gagauugcgccacugcacaccagucuggagac

SEQ ID NO: 157479 - RNA, 32 nt, Human
gagauugcgccacugcacacuagcuuggguga

SEQ ID NO: 157480 - RNA, 32 nt, Human
gagauugcgccacugcaccccagcaugagcga

SEQ ID NO: 157481 - RNA, 32 nt, Human
gagauugcgccacugcaccccagccuggacaa

SEQ ID NO: 157482 - RNA, 32 nt, Human
gagauugcgccacugcaccccagccugggcga

SEQ ID NO: 157483 - RNA, 32 nt, Human
gagauugcgccacugcaccccagccuggguga

SEQ ID NO: 157484 - RNA, 19 nt, Human
gagauugcgccacugcacu

SEQ ID NO: 157485 - RNA, 32 nt, Human
gagauugcgccacugcacucaagucugggcga

SEQ ID NO: 157486 - RNA, 32 nt, Human
gagauugcgccacugcacuccaaccugggcaa

SEQ ID NO: 157487 - RNA, 32 nt, Human
gagauugcgccacugcacuccagcccuggcga

SEQ ID NO: 157488 - RNA, 32 nt, Human
gagauugcgccacugcacuccagccuagguga

SEQ ID NO: 157489 - RNA, 32 nt, Human
gagauugcgccacugcacuccagccuggcgac

SEQ ID NO: 157490 - RNA, 32 nt, Human
gagauugcgccacugcacuccagccugggaga

SEQ ID NO: 157491 - RNA, 32 nt, Human
gagauugcgccacugcacuccagccugggcaa

SEQ ID NO: 157492 - RNA, 32 nt, Human
gagauugcgccacugcacuccagccugggcag

SEQ ID NO: 157493 - RNA, 32 nt, Human
gagauugcgccacugcacuccagccugggcga

SEQ ID NO: 157494 - RNA, 32 nt, Human
gagauugcgccacugcacuccagccugggcua

SEQ ID NO: 157495 - RNA, 32 nt, Human
gagauugcgccacugcacuccagccuggggga

SEQ ID NO: 157496 - RNA, 32 nt, Human
gagauugcgccacugcacuccagccuggguaa

SEQ ID NO: 157497 - RNA, 32 nt, Human
gagauugcgccacugcacuccagccuggguga

SEQ ID NO: 157498 - RNA, 32 nt, Human
gagauugcgccacugcacuccagccugguuga

SEQ ID NO: 157499 - RNA, 32 nt, Human
gagauugcgccacugcacuccagcgugggcua

SEQ ID NO: 157500 - RNA, 32 nt, Human
gagauugcgccacugcacuccagucugggcga

SEQ ID NO: 157501 - RNA, 32 nt, Human
gagauugcgccacugcacuccagucuggucgg

SEQ ID NO: 157502 - RNA, 32 nt, Human
gagauugcgccacugcacucuagccuaagcaa

SEQ ID NO: 157503 - RNA, 32 nt, Human
gagauugcgccacugcacuucagccuggauga

SEQ ID NO: 157504 - RNA, 32 nt, Human
gagauugcgccacugcacuucagccugggcaa

SEQ ID NO: 157505 - RNA, 32 nt, Human
gagauugcgccacugcaguccgcaguccagcc

SEQ ID NO: 157506 - RNA, 32 nt, Human
gagauugcgccacugcaguccgcagucuggcc

SEQ ID NO: 157507 - RNA, 19 nt, Human
gagauugcgccacugcauu

SEQ ID NO: 157508 - RNA, 32 nt, Human
gagauugcgccacugcauuccagccuggguga

SEQ ID NO: 157509 - RNA, 32 nt, Human
gagauugcgccacugcauucuagccuggauga

SEQ ID NO: 157510 - RNA, 32 nt, Human
gagauugcgccacugcgcuccagccugggcaa

SEQ ID NO: 157511 - RNA, 32 nt, Human
gagauugcgccacuggacuccagccugcguga

SEQ ID NO: 157512 - RNA, 19 nt, Human
gagauugcgccacuguacu

SEQ ID NO: 157513 - RNA, 32 nt, Human
gagauugcgccacuguacuccagccuggcaac

SEQ ID NO: 157514 - RNA, 32 nt, Human
gagauugcgccacuguacuccagccuggguga

SEQ ID NO: 157515 - RNA, 32 nt, Human
gagauugcgccacuguacuccugggcaacagc

SEQ ID NO: 157516 - RNA, 32 nt, Human
gagauugcgccacuucacuccagccuggguga

SEQ ID NO: 157517 - RNA, 32 nt, Human
gagauugcgccauugcacuccagccuagguaa

SEQ ID NO: 157518 - RNA, 32 nt, Human
gagauugcgccauugcacuccagccugggcaa

SEQ ID NO: 157519 - RNA, 32 nt, Human
gagauugcgccauugcacuccagccuggggac

SEQ ID NO: 157520 - RNA, 32 nt, Human
gagauugcgccauugcauuccagccuggguga

SEQ ID NO: 157521 - RNA, 32 nt, Human
gagauugcgccauuguacuccagccugggcaa

SEQ ID NO: 157522 - RNA, 32 nt, Human
gagauugcgccauuguacuccagccuggggga

SEQ ID NO: 157523 - RNA, 32 nt, Human
gagauugcgccccugcacuccaaccuggacaa

SEQ ID NO: 157524 - RNA, 19 nt, Human
gagauugcgccgcugcacu

SEQ ID NO: 157525 - RNA, 32 nt, Human
gagauugcgccgcugcacuccagccugggcga

SEQ ID NO: 157526 - RNA, 32 nt, Human
gagauugcgcuacugaacuccagccuggguua

SEQ ID NO: 157527 - RNA, 32 nt, Human
gagauugcgcuacugcacuccagccugggcga

SEQ ID NO: 157528 - RNA, 32 nt, Human
gagauugcgcugcugcacuccaaccugggcga

SEQ ID NO: 157529 - RNA, 32 nt, Human
gagauugcggugagccaagaucgcgccccugc

SEQ ID NO: 157530 - RNA, 32 nt, Human
gagauugcggugagccaagauggcaccacugc

SEQ ID NO: 157531 - RNA, 32 nt, Human
gagauugcggugagccgggauugcgccagugc

SEQ ID NO: 157532 - RNA, 32 nt, Human
gagauugcggugagccuagaucuugccacugc

SEQ ID NO: 157533 - RNA, 32 nt, Human
gagauugcgucacugcacuccagccugagcaa

SEQ ID NO: 157534 - RNA, 32 nt, Human
gagauugcgucacugcacuccagccugggcga

SEQ ID NO: 157535 - RNA, 32 nt, Human
gagauugcuccauugcacuccagccugggcaa

SEQ ID NO: 157536 - RNA, 32 nt, Human
gagauugcuccauugcacuccagccugggcga

SEQ ID NO: 157537 - RNA, 32 nt, Human
gagauugcucuuaagcugauuucccaaacagg

SEQ ID NO: 157538 - RNA, 32 nt, Human
gagauugcuucuaacauaaaucugcauaaaaa

SEQ ID NO: 157539 - RNA, 32 nt, Human
gagauuggaaacagccagguuggagcagugag

SEQ ID NO: 157540 - RNA, 32 nt, Human
gagauuggaccacugcucuccagccugggcaa

SEQ ID NO: 157541 - RNA, 32 nt, Human
gagauuggccauugcacuccagccugggugac

SEQ ID NO: 157542 - RNA, 32 nt, Human
gagauugggccacugcacuccacccugggcga

SEQ ID NO: 157543 - RNA, 32 nt, Human
gagauugggccccagcaccuggacucaaggca

SEQ ID NO: 157544 - RNA, 32 nt, Human
gagauuggggaguggugaugacucucaacgag

SEQ ID NO: 157545 - RNA, 22 nt, Human
gagauuggguuucaccauguug

SEQ ID NO: 157546 - RNA, 23 nt, Human
gagauuggguuucaccauguugg

SEQ ID NO: 157547 - RNA, 26 nt, Human
gagauuggugacagucaggccuggga

SEQ ID NO: 157548 - RNA, 32 nt, Human
gagauuguaccacugcacuccagccuggucaa

SEQ ID NO: 157549 - RNA, 32 nt, Human
gagauuguaccacugcacuccagucugggcaa

SEQ ID NO: 157550 - RNA, 32 nt, Human
gagauuguaccacugcgcuccaaacuggguga

SEQ ID NO: 157551 - RNA, 32 nt, Human
gagauuguaccaugcacuccagccuggguaac

SEQ ID NO: 157552 - RNA, 32 nt, Human
gagauuguaccauggcacuccagccuggacaa

SEQ ID NO: 157553 - RNA, 32 nt, Human
gagauuguaccauugcacuccagccugggcaa

SEQ ID NO: 157554 - RNA, 32 nt, Human
gagauuguccagcccccgcccuugcacuggac

SEQ ID NO: 157555 - RNA, 32 nt, Human
gagauugucgaucucaucaccauaauaaagag

SEQ ID NO: 157556 - RNA, 32 nt, Human
gagauugugcacuccagccuggguaacagagc

SEQ ID NO: 157557 - RNA, 32 nt, Human
gagauugugcauugcacuccagccugagcaac

SEQ ID NO: 157558 - RNA, 32 nt, Human
gagauugugccacuacacuccagccuggccac

SEQ ID NO: 157559 - RNA, 32 nt, Human
gagauugugccacuacacuccagccugggcaa

SEQ ID NO: 157560 - RNA, 32 nt, Human
gagauugugccacuacacuccagccuggguga

SEQ ID NO: 157561 - RNA, 32 nt, Human
gagauugugccacuccccuccagccugggcga

SEQ ID NO: 157562 - RNA, 32 nt, Human
gagauugugccacugcacaccagccuggacaa

SEQ ID NO: 157563 - RNA, 32 nt, Human
gagauugugccacugcacaccggccuggguga

SEQ ID NO: 157564 - RNA, 32 nt, Human
gagauugugccacugcacacuccaaucugggu

SEQ ID NO: 157565 - RNA, 32 nt, Human
gagauugugccacugcacgcacuccagccugg

SEQ ID NO: 157566 - RNA, 19 nt, Human
gagauugugccacugcacu

SEQ ID NO: 157567 - RNA, 32 nt, Human
gagauugugccacugcacuccaaccuggguga

SEQ ID NO: 157568 - RNA, 32 nt, Human
gagauugugccacugcacuccagccuaggcaa

SEQ ID NO: 157569 - RNA, 32 nt, Human
gagauugugccacugcacuccagccuaggcga

SEQ ID NO: 157570 - RNA, 32 nt, Human
gagauugugccacugcacuccagccuggacga

SEQ ID NO: 157571 - RNA, 32 nt, Human
gagauugugccacugcacuccagccuggcaac

SEQ ID NO: 157572 - RNA, 32 nt, Human
gagauugugccacugcacuccagccugggaga

SEQ ID NO: 157573 - RNA, 32 nt, Human
gagauugugccacugcacuccagccugggcaa

SEQ ID NO: 157574 - RNA, 32 nt, Human
gagauugugccacugcacuccagccugggcca

SEQ ID NO: 157575 - RNA, 32 nt, Human
gagauugugccacugcacuccagccugggcga

SEQ ID NO: 157576 - RNA, 32 nt, Human
gagauugugccacugcacuccagccuggguga

SEQ ID NO: 157577 - RNA, 32 nt, Human
gagauugugccacugcacuccagccuuggcaa

SEQ ID NO: 157578 - RNA, 32 nt, Human
gagauugugccacugcacucccgccugggcga

SEQ ID NO: 157579 - RNA, 32 nt, Human
gagauugugccacugcacucgagccuggguga

SEQ ID NO: 157580 - RNA, 32 nt, Human
gagauugugccacugcacucuagccuggacag

SEQ ID NO: 157581 - RNA, 32 nt, Human
gagauugugccacugcacucuagccuggguga

SEQ ID NO: 157582 - RNA, 32 nt, Human
gagauugugccacugcacuucagccugggcga

SEQ ID NO: 157583 - RNA, 32 nt, Human
gagauugugccacugcacuucagcuuggguga

SEQ ID NO: 157584 - RNA, 32 nt, Human
gagauugugccacugcgcuccagccugggcga

SEQ ID NO: 157585 - RNA, 32 nt, Human
gagauugugccacuguacaccagccuggguga

SEQ ID NO: 157586 - RNA, 32 nt, Human
gagauugugccacuguacuccagccuggaaga

SEQ ID NO: 157587 - RNA, 32 nt, Human
gagauugugccacuguacuccagccuggugac

SEQ ID NO: 157588 - RNA, 32 nt, Human
gagauugugccacuucacuccagccuggguga

SEQ ID NO: 157589 - RNA, 32 nt, Human
gagauugugccacuucauuccagccugggcga

SEQ ID NO: 157590 - RNA, 32 nt, Human
gagauugugccauugcacuccaaccugggcaa

SEQ ID NO: 157591 - RNA, 32 nt, Human
gagauugugccauugcacuccagccugggcaa

SEQ ID NO: 157592 - RNA, 32 nt, Human
gagauugugccauugcacuccagccugggcga

SEQ ID NO: 157593 - RNA, 32 nt, Human
gagauugugccauugcacuccagccugggcua

SEQ ID NO: 157594 - RNA, 32 nt, Human
gagauugugccauugcacuccagccuggguga

SEQ ID NO: 157595 - RNA, 32 nt, Human
gagauugugccccugcacuccagccugagcga

SEQ ID NO: 157596 - RNA, 32 nt, Human
gagauugugccgcugcacuccagccuggcgac

SEQ ID NO: 157597 - RNA, 32 nt, Human
gagauugugcuauuugcacucuagccugggug

SEQ ID NO: 157598 - RNA, 32 nt, Human
gagauugugcugcugcacuccagccugggaga

SEQ ID NO: 157599 - RNA, 32 nt, Human
gagauugugcugcugcacuccagccuggguga

SEQ ID NO: 157600 - RNA, 32 nt, Human
gagauuguggcacugcacuccagucuggguga

SEQ ID NO: 157601 - RNA, 32 nt, Human
gagauugugucauugcacuccagccugggcaa

SEQ ID NO: 157602 - RNA, 32 nt, Human
gagauuguugcaaggaagagauuugugauagu

SEQ ID NO: 157603 - RNA, 32 nt, Human
gagauuuaaagaaaaagaaaguaguaccuuag

SEQ ID NO: 157604 - RNA, 32 nt, Human
gagauuuaaucaauuauacucuggaagcauuu

SEQ ID NO: 157605 - RNA, 32 nt, Human
gagauuuacagagagagaguaacuugcauaag

SEQ ID NO: 157606 - RNA, 32 nt, Human
gagauuuacagcuggcuuacacaugccuuaug

SEQ ID NO: 157607 - RNA, 32 nt, Human
gagauuuacugcacugauggaccucaucaaug

SEQ ID NO: 157608 - RNA, 25 nt, Human
gagauuuaucuauguuguauuauca

SEQ ID NO: 157609 - RNA, 32 nt, Human
gagauuucaagucguacuauggaacaccuuuc

SEQ ID NO: 157610 - RNA, 32 nt, Human
gagauuucaccagugcacuccagccuggguga

SEQ ID NO: 157611 - RNA, 32 nt, Human
gagauuucacuaccuuuauguuaaaaguugug

SEQ ID NO: 157612 - RNA, 32 nt, Human
gagauuucaguuacuuaccugcauguguugua

SEQ ID NO: 157613 - RNA, 32 nt, Human
gagauuuccuaccugauugagauuuucaguag

SEQ ID NO: 157614 - RNA, 32 nt, Human
gagauuugaagccagucaucucagcacugucu

SEQ ID NO: 157615 - RNA, 32 nt, Human
gagauuugcuccauucucuuuggaauaacagg

SEQ ID NO: 157616 - RNA, 32 nt, Human
gagauuugcuugaacccaggaggcagagguug

SEQ ID NO: 157617 - RNA, 32 nt, Human
gagauuuggagauuuguggaaaagugagacug

SEQ ID NO: 157618 - RNA, 20 nt, Human
gagauuugggcggggacaca

SEQ ID NO: 157619 - RNA, 21 nt, Human
gagauuugggugaggacacag

SEQ ID NO: 157620 - RNA, 24 nt, Human
gagauuuggguggagacacggcca

SEQ ID NO: 157621 - RNA, 24 nt, Human
gagauuuggguggggacacagcca

SEQ ID NO: 157622 - RNA, 24 nt, Human
gagauuugguugggaacacagcca

SEQ ID NO: 157623 - RNA, 24 nt, Human
gagauuugguuuauguuaccauua

SEQ ID NO: 157624 - RNA, 32 nt, Human
gagauuugucaccagugagcccuuggcacggu

SEQ ID NO: 157625 - RNA, 32 nt, Human
gagauuuuauuggaagccgcuggugagcaauu

SEQ ID NO: 157626 - RNA, 32 nt, Human
gagauuuugcaacugcacuccagccugggcua

SEQ ID NO: 157627 - RNA, 32 nt, Human
gagauuuugggagcuuuccaaucugccacaaa

SEQ ID NO: 157628 - RNA, 25 nt, Human
gagauuuuggguggggacacagcca

SEQ ID NO: 157629 - RNA, 32 nt, Human
gagauuuuggugaggaaacuugcuggaguuuu

SEQ ID NO: 157630 - RNA, 32 nt, Human
gagauuuuguagcauuuugcaaauggguaugc

SEQ ID NO: 157631 - RNA, 32 nt, Human
gagauuuugucauugaacuggugacaggaugu

SEQ ID NO: 157632 - RNA, 32 nt, Human
gagauuuugugaauaugguggaaaaaugaauu

SEQ ID NO: 157633 - RNA, 32 nt, Human
gagauuuuguugaaguucacacacagaucaca

SEQ ID NO: 157634 - RNA, 24 nt, Human
gagauuuuuacaagucagauuuuu

SEQ ID NO: 157635 - RNA, 32 nt, Human
gagauuuuucauuuuuccaugacauuuuuccu

SEQ ID NO: 157636 - RNA, 32 nt, Human
gagauuuuuccucugcguagagccauccagau

SEQ ID NO: 157637 - RNA, 32 nt, Human
gagcaaaaacuagaaugauacaaagaaagguc

SEQ ID NO: 157638 - RNA, 32 nt, Human
gagcaaaacaaccucugucacacacacaaaaa

SEQ ID NO: 157639 - RNA, 32 nt, Human
gagcaaaacagcugccauagugaacagcauca

SEQ ID NO: 157640 - RNA, 32 nt, Human
gagcaaaaccaccucagacacccgggccuucu

SEQ ID NO: 157641 - RNA, 32 nt, Human
gagcaaaacuaaggaugaaauguaauauucau

SEQ ID NO: 157642 - RNA, 32 nt, Human
gagcaaaacugaccggaaccugggcggugcau

SEQ ID NO: 157643 - RNA, 32 nt, Human
gagcaaaagaacaaagcuuccacaguguggaa

SEQ ID NO: 157644 - RNA, 32 nt, Human
gagcaaaagagacagggagagguggagaagga

SEQ ID NO: 157645 - RNA, 32 nt, Human
gagcaaaaucaacaugacugguggugagagac

SEQ ID NO: 157646 - RNA, 17 nt, Human
gagcaaacagagcagca

SEQ ID NO: 157647 - RNA, 32 nt, Human
gagcaaaccacauguucugucuugaggagcca

SEQ ID NO: 157648 - RNA, 32 nt, Human
gagcaaaccagccuuggcuuucaguuggaugu

SEQ ID NO: 157649 - RNA, 32 nt, Human
gagcaaacccacccuguccucugacgucccuu

SEQ ID NO: 157650 - RNA, 32 nt, Human
gagcaaacccuccaaagcccuccucacgcagu

SEQ ID NO: 157651 - RNA, 32 nt, Human
gagcaaacucaguggugaacagcuccauuucu

SEQ ID NO: 157652 - RNA, 32 nt, Human
gagcaaacugaaaauuacuaugcacuugucag

SEQ ID NO: 157653 - RNA, 32 nt, Human
gagcaaagagagggugacugaggcagacccca

SEQ ID NO: 157654 - RNA, 32 nt, Human
gagcaaagccacaacgcuuucucugcuggauu

SEQ ID NO: 157655 - RNA, 32 nt, Human
gagcaaaggaugcaucuucccacagccuccuc

SEQ ID NO: 157656 - RNA, 32 nt, Human
gagcaaagucacagaaugaaagagaugguucu

SEQ ID NO: 157657 - RNA, 32 nt, Human
gagcaaaucagcccuucucugaacguuguagg

SEQ ID NO: 157658 - RNA, 32 nt, Human
gagcaaaucaguugcuuccuggacuuguguua

SEQ ID NO: 157659 - RNA, 32 nt, Human
gagcaaaugaugaagacauccggaagaaggug

SEQ ID NO: 157660 - RNA, 32 nt, Human
gagcaaauggccacugaguagccccagagguc

SEQ ID NO: 157661 - RNA, 32 nt, Human
gagcaaaugguuuugggcaagggcuuuggcca

SEQ ID NO: 157662 - RNA, 32 nt, Human
gagcaaaugucuauugaacacuuaaaauuaau

SEQ ID NO: 157663 - RNA, 32 nt, Human
gagcaacaaaggcgugaaagaagugaaaagaa

SEQ ID NO: 157664 - RNA, 32 nt, Human
gagcaacaagauacaaggagcccagggcauga

SEQ ID NO: 157665 - RNA, 32 nt, Human
gagcaacacagaaccaaucuacuaaucuacuc

SEQ ID NO: 157666 - RNA, 32 nt, Human
gagcaacacagugagacccccaucucuacaaa

SEQ ID NO: 157667 - RNA, 29 nt, Human
gagcaacauagcgagaccccaucuuuacc

SEQ ID NO: 157668 - RNA, 32 nt, Human
gagcaacauagugagaccccaucccuauaaaa

SEQ ID NO: 157669 - RNA, 32 nt, Human
gagcaacauagugaggaucccaucucuacgcc

SEQ ID NO: 157670 - RNA, 32 nt, Human
gagcaacauaucaaaaccccaucucuacaaaa

SEQ ID NO: 157671 - RNA, 32 nt, Human
gagcaacaugaugagaccccaucucuacaaaa

SEQ ID NO: 157672 - RNA, 32 nt, Human
gagcaacauggcgaaaccccgucucuacuaaa

SEQ ID NO: 157673 - RNA, 32 nt, Human
gagcaacauggcgaaaccccgucuguaauaaa

SEQ ID NO: 157674 - RNA, 32 nt, Human
gagcaacaugguaaaaccccaucucuaccaaa

SEQ ID NO: 157675 - RNA, 32 nt, Human
gagcaacauggugaaacccugucucuaccaaa

SEQ ID NO: 157676 - RNA, 31 nt, Human
gagcaacauggugagagcucaucucuacauu

SEQ ID NO: 157677 - RNA, 32 nt, Human
gagcaaccacagugacaacaguuucauuuuuc

SEQ ID NO: 157678 - RNA, 32 nt, Human
gagcaaccagcaccugcccccuuggaaugcag

SEQ ID NO: 157679 - RNA, 32 nt, Human
gagcaacccugggaaaagugacuucaucccuu

SEQ ID NO: 157680 - RNA, 17 nt, Human
gagcaaccgagagagca

SEQ ID NO: 157681 - RNA, 32 nt, Human
gagcaaccuacugucuaagcaguuuuguaaau

SEQ ID NO: 157682 - RNA, 32 nt, Human
gagcaacgagauggugagcaucagugcaaaug

SEQ ID NO: 157683 - RNA, 32 nt, Human
gagcaacuaucagggcagcucugccuccuccu

SEQ ID NO: 157684 - RNA, 19 nt, Human
gagcaacucuggcaggcac

SEQ ID NO: 157685 - RNA, 32 nt, Human
gagcaacuggacuauagcagggcugggcucug

SEQ ID NO: 157686 - RNA, 32 nt, Human
gagcaacuguacuccagcuuggcgacagagca

SEQ ID NO: 157687 - RNA, 32 nt, Human
gagcaagaacagagccagcacacacauuggag

SEQ ID NO: 157688 - RNA, 32 nt, Human
gagcaagaagaaaagaggaauggugcccgaau

SEQ ID NO: 157689 - RNA, 32 nt, Human
gagcaagaagagcaaggaaggccaggcgcggu

SEQ ID NO: 157690 - RNA, 22 nt, Human
gagcaagaaggaaggaggcaga

SEQ ID NO: 157691 - RNA, 32 nt, Human
gagcaagaagguaggguugcaaggaagggccg

SEQ ID NO: 157692 - RNA, 32 nt, Human
gagcaagaaucagacaucacagaugcaacuuc

SEQ ID NO: 157693 - RNA, 32 nt, Human
gagcaagaccaacuaugugcacgaugcuaaga

SEQ ID NO: 157694 - RNA, 32 nt, Human
gagcaagacgccucucggggccugugccgcac

SEQ ID NO: 157695 - RNA, 32 nt, Human
gagcaagagagcgagggagggagcgcagggcc

SEQ ID NO: 157696 - RNA, 32 nt, Human
gagcaagagucauuccaucacagggacugcau

SEQ ID NO: 157697 - RNA, 32 nt, Human
gagcaagaugcugagcaagggucugaagcgga

SEQ ID NO: 157698 - RNA, 32 nt, Human
gagcaagauuugggucucuccagaccucuggg

SEQ ID NO: 157699 - RNA, 32 nt, Human
gagcaagcaagagcucugaagccagacugccu

SEQ ID NO: 157700 - RNA, 32 nt, Human
gagcaagcagauggccgggugccuggagcacu

SEQ ID NO: 157701 - RNA, 32 nt, Human
gagcaagcaggcccccaccugcccuuagugau

SEQ ID NO: 157702 - RNA, 20 nt, Human
gagcaagccaaggagcagca

SEQ ID NO: 157703 - RNA, 16 nt, Human
gagcaagccacagugc

SEQ ID NO: 157704 - RNA, 32 nt, Human
gagcaagcccagaggcagaggaggcgacagag

SEQ ID NO: 157705 - RNA, 31 nt, Human
gagcaagcccccuuggagcacugcguacaua

SEQ ID NO: 157706 - RNA, 22 nt, Human
gagcaagcucucgagggcagca

SEQ ID NO: 157707 - RNA, 32 nt, Human
gagcaagcuuaucugaucuccugggaucucua

SEQ ID NO: 157708 - RNA, 32 nt, Human
gagcaaggaccccuguaacacauucauccuug

SEQ ID NO: 157709 - RNA, 32 nt, Human
gagcaaggagaauauaacauguuugcaaaguc

SEQ ID NO: 157710 - RNA, 32 nt, Human
gagcaaggcccagccaaggagguacagauucc

SEQ ID NO: 157711 - RNA, 32 nt, Human
gagcaaggcuggaaguucuaaccuucucagua

SEQ ID NO: 157712 - RNA, 32 nt, Human
gagcaaggcuggaucugggcuaggugaccccu

SEQ ID NO: 157713 - RNA, 32 nt, Human
gagcaagggcacaaacugcagcugugagugcg

SEQ ID NO: 157714 - RNA, 32 nt, Human
gagcaagggggcuccugaugggugggggcagg

SEQ ID NO: 157715 - RNA, 32 nt, Human
gagcaagggucucccccagcaggauggguggg

SEQ ID NO: 157716 - RNA, 32 nt, Human
gagcaagguggagggugcagaggggcuggggu

SEQ ID NO: 157717 - RNA, 32 nt, Human
gagcaagucuccaaaucagacagcugccucag

SEQ ID NO: 157718 - RNA, 32 nt, Human
gagcaaguggacagaggagggagccagcuaag

SEQ ID NO: 157719 - RNA, 32 nt, Human
gagcaaguuugagagaagaaugaaucaacugc

SEQ ID NO: 157720 - RNA, 32 nt, Human
gagcaaguuuuguauuugugaccucagcuuug

SEQ ID NO: 157721 - RNA, 32 nt, Human
gagcaauaacugaagacaaggagagauggaac

SEQ ID NO: 157722 - RNA, 32 nt, Human
gagcaauagccuggcuucagagcuggagugcc

SEQ ID NO: 157723 - RNA, 32 nt, Human
gagcaauauuauauacaucuaggguaagaaca

SEQ ID NO: 157724 - RNA, 32 nt, Human
gagcaauccugcaagagcaagguacauaaaca

SEQ ID NO: 157725 - RNA, 32 nt, Human
gagcaaugacaugggggacaguuggcagaugg

SEQ ID NO: 157726 - RNA, 24 nt, Human
gagcaaugaucguaccacugcacu

SEQ ID NO: 157727 - RNA, 32 nt, Human
gagcaaugcagcacucuaggaagccugcuagg

SEQ ID NO: 157728 - RNA, 32 nt, Human
gagcaauggaaaauauguagcugcuuucauua

SEQ ID NO: 157729 - RNA, 32 nt, Human
gagcaauggagauccaggcuggguauagacaa

SEQ ID NO: 157730 - RNA, 32 nt, Human
gagcaauggcaccugggcagugccagggcuua

SEQ ID NO: 157731 - RNA, 32 nt, Human
gagcaauggugccaauagcggcucuuuauuug

SEQ ID NO: 157732 - RNA, 32 nt, Human
gagcaauguggugaaaccccaucucuacuaaa

SEQ ID NO: 157733 - RNA, 32 nt, Human
gagcaauuaugcuguuacuauguaugaguaau

SEQ ID NO: 157734 - RNA, 32 nt, Human
gagcaauugaagaaagggaggagccagauuag

SEQ ID NO: 157735 - RNA, 32 nt, Human
gagcaauugccagaucaugucacccacccagc

SEQ ID NO: 157736 - RNA, 32 nt, Human
gagcaauugccuggcccucccuaagcccuaua

SEQ ID NO: 157737 - RNA, 32 nt, Human
gagcaauuuauacuuuacccucaggcuguccu

SEQ ID NO: 157738 - RNA, 32 nt, Human
gagcaauuugggaggccaaggugggaguuuug

SEQ ID NO: 157739 - RNA, 32 nt, Human
gagcacaaaaggagauuuucauauaacuuguu

SEQ ID NO: 157740 - RNA, 32 nt, Human
gagcacaaagcccgcucuguugagggcugggu

SEQ ID NO: 157741 - RNA, 32 nt, Human
gagcacaagacggagguugagguggggcuaag

SEQ ID NO: 157742 - RNA, 17 nt, Human
gagcacacagagcagca

SEQ ID NO: 157743 - RNA, 32 nt, Human
gagcacacagauaagacagaggggaggaggug

SEQ ID NO: 157744 - RNA, 32 nt, Human
gagcacaccacugcacuccagccugggcaaca

SEQ ID NO: 157745 - RNA, 19 nt, Human
gagcacaccacuguccccu

SEQ ID NO: 157746 - RNA, 22 nt, Human
gagcacaccuagccugcuugcu

SEQ ID NO: 157747 - RNA, 32 nt, Human
gagcacacgacuuccuuggagccugggccuuu

SEQ ID NO: 157748 - RNA, 32 nt, Human
gagcacacuaguuagcagaacagaacccaggg

SEQ ID NO: 157749 - RNA, 32 nt, Human
gagcacacuccauuuucccaugucugacuucg

SEQ ID NO: 157750 - RNA, 32 nt, Human
gagcacacugaugggaagcuucccucucccag

SEQ ID NO: 157751 - RNA, 32 nt, Human
gagcacacugcuggcccaugcgccucggggcu

SEQ ID NO: 157752 - RNA, 32 nt, Human
gagcacagacuagaagucagguucaggaauca

SEQ ID NO: 157753 - RNA, 30 nt, Human
gagcacagacuggaaucagaagacacggag

SEQ ID NO: 157754 - RNA, 32 nt, Human
gagcacagagaagggguagaaugcuccuggga

SEQ ID NO: 157755 - RNA, 23 nt, Human
gagcacagaggagugggccggga

SEQ ID NO: 157756 - RNA, 24 nt, Human
gagcacagaucaugccacugcacu

SEQ ID NO: 157757 - RNA, 32 nt, Human
gagcacagcacugggaaaugggagcacaguac

SEQ ID NO: 157758 - RNA, 32 nt, Human
gagcacagcagcagcucgccuaccucugagcc

SEQ ID NO: 157759 - RNA, 32 nt, Human
gagcacagcaugggccagggccccagaacaca

SEQ ID NO: 157760 - RNA, 32 nt, Human
gagcacagccaagaccugcagagugcccucau

SEQ ID NO: 157761 - RNA, 32 nt, Human
gagcacagccuucuuccccuucgugucuacac

SEQ ID NO: 157762 - RNA, 21 nt, Human
gagcacagcgcccuacuuccc

SEQ ID NO: 157763 - RNA, 32 nt, Human
gagcacagcuaaaugaaacugcugcucuaauu

SEQ ID NO: 157764 - RNA, 32 nt, Human
gagcacagcucaggaacuagacugccuggguu

SEQ ID NO: 157765 - RNA, 32 nt, Human
gagcacaggagacggagguugcugugagcuga

SEQ ID NO: 157766 - RNA, 16 nt, Human
gagcacaggagcagca

SEQ ID NO: 157767 - RNA, 32 nt, Human
gagcacaggagggagguugagguggggcuaag

SEQ ID NO: 157768 - RNA, 32 nt, Human
gagcacaggaguuugaggcugcagugaccuau

SEQ ID NO: 157769 - RNA, 32 nt, Human
gagcacaggcccuguuuguuugcacauaauaa

SEQ ID NO: 157770 - RNA, 20 nt, Human
gagcacaggcuucaugcaca

SEQ ID NO: 157771 - RNA, 32 nt, Human
gagcacaggggcaucuggaggucaagggugcu

SEQ ID NO: 157772 - RNA, 32 nt, Human
gagcacagguucucaguccaagcuguggaaaa

SEQ ID NO: 157773 - RNA, 32 nt, Human
gagcacagguucucagucuaagcuguggaaaa

SEQ ID NO: 157774 - RNA, 32 nt, Human
gagcacaguaaugggaaaugggagcacagugc

SEQ ID NO: 157775 - RNA, 32 nt, Human
gagcacaguacuaggaaaugggagcacaguac

SEQ ID NO: 157776 - RNA, 32 nt, Human
gagcacaguacugggaaauggaagcacauggc

SEQ ID NO: 157777 - RNA, 32 nt, Human
gagcacaguacugggaaaugggagcacaguac

SEQ ID NO: 157778 - RNA, 32 nt, Human
gagcacaguacugggaaaugggagcacagugc

SEQ ID NO: 157779 - RNA, 32 nt, Human
gagcacaguacugggaaaugggagcauaguac

SEQ ID NO: 157780 - RNA, 32 nt, Human
gagcacaguacugggaaaugggagcccacagu

SEQ ID NO: 157781 - RNA, 32 nt, Human
gagcacaguacugggaaaugggagcccaguac

SEQ ID NO: 157782 - RNA, 32 nt, Human
gagcacaguacugggaaaugggaguucacagc

SEQ ID NO: 157783 - RNA, 32 nt, Human
gagcacaguacugggaaaugggggcucacagc

SEQ ID NO: 157784 - RNA, 32 nt, Human
gagcacaguacugggaaaugguagcacaguac

SEQ ID NO: 157785 - RNA, 32 nt, Human
gagcacaguauugggaaaugggagcacaguac

SEQ ID NO: 157786 - RNA, 32 nt, Human
gagcacagugagccuuacucagcacuggggag

SEQ ID NO: 157787 - RNA, 32 nt, Human
gagcacagugcugggaaaugggagcacaaagu

SEQ ID NO: 157788 - RNA, 32 nt, Human
gagcacaguuuugggaaaugggagcacaguac

SEQ ID NO: 157789 - RNA, 21 nt, Human
gagcacauaugcaaugccuga

SEQ ID NO: 157790 - RNA, 16 nt, Human
gagcacauaugggguc

SEQ ID NO: 157791 - RNA, 32 nt, Human
gagcacaucacacguauaggcaggugugaggg

SEQ ID NO: 157792 - RNA, 32 nt, Human
gagcacaugauauacgacuugcucugauaucc

SEQ ID NO: 157793 - RNA, 32 nt, Human
gagcacaugugaauuaaccugcauugauggaa

SEQ ID NO: 157794 - RNA, 32 nt, Human
gagcacaugugugcaugugugugcacacgugu

SEQ ID NO: 157795 - RNA, 26 nt, Human
gagcacauugcagccccaacgguggc

SEQ ID NO: 157796 - RNA, 21 nt, Human
gagcacauuuguggacuucca

SEQ ID NO: 157797 - RNA, 32 nt, Human
gagcacauuuuguggaccugguuccaccuuuc

SEQ ID NO: 157798 - RNA, 32 nt, Human
gagcaccaaacuccgccccaaaaaggagagua

SEQ ID NO: 157799 - RNA, 22 nt, Human
gagcaccaagcaagauggcagc

SEQ ID NO: 157800 - RNA, 32 nt, Human
gagcaccaccaccaccaccacugagauccggc

SEQ ID NO: 157801 - RNA, 32 nt, Human
gagcaccaccaggccucgggccccagaggucc

SEQ ID NO: 157802 - RNA, 32 nt, Human
gagcaccacugcacuaagccagugcggagcug

SEQ ID NO: 157803 - RNA, 32 nt, Human
gagcaccagcaaccccagcuaucuggaucuga

SEQ ID NO: 157804 - RNA, 20 nt, Human
gagcaccagccuaauggagg

SEQ ID NO: 157805 - RNA, 24 nt, Human
gagcaccagccuuggggacccugg

SEQ ID NO: 157806 - RNA, 32 nt, Human
gagcaccagcugggcguggagcugugucaggc

SEQ ID NO: 157807 - RNA, 32 nt, Human
gagcaccaggaucaugaagcccaagagcgaga

SEQ ID NO: 157808 - RNA, 32 nt, Human
gagcaccaggggcagaggcggccagacaaccu

SEQ ID NO: 157809 - RNA, 32 nt, Human
gagcaccauggccgcugggcucugccuuccac

SEQ ID NO: 157810 - RNA, 32 nt, Human
gagcacccaagccaggcagggggucuggcagc

SEQ ID NO: 157811 - RNA, 32 nt, Human
gagcacccaagccaggugggugguggcucuua

SEQ ID NO: 157812 - RNA, 32 nt, Human
gagcacccacagugggguauucuucauaaguu

SEQ ID NO: 157813 - RNA, 32 nt, Human
gagcacccagaacugcuggucagaggccugca

SEQ ID NO: 157814 - RNA, 32 nt, Human
gagcacccagagggauuuuucagugggaagca

SEQ ID NO: 157815 - RNA, 32 nt, Human
gagcacccaggcagacccaguccugguuggga

SEQ ID NO: 157816 - RNA, 32 nt, Human
gagcacccaggccaggaguggagccaggucgc

SEQ ID NO: 157817 - RNA, 32 nt, Human
gagcacccaucuugugucaggcacucugcuaa

SEQ ID NO: 157818 - RNA, 18 nt, Human
gagcaccccaggcaggac

SEQ ID NO: 157819 - RNA, 32 nt, Human
gagcacccccaggaggaggggagggugggagc

SEQ ID NO: 157820 - RNA, 32 nt, Human
gagcacccccuccugguugggccccucaguug

SEQ ID NO: 157821 - RNA, 32 nt, Human
gagcaccccuccugagaccccagacucagaag

SEQ ID NO: 157822 - RNA, 32 nt, Human
gagcacccuccaggauuucaggacaaggcucu

SEQ ID NO: 157823 - RNA, 32 nt, Human
gagcacccuggagggcagagacaagcgggagu

SEQ ID NO: 157824 - RNA, 32 nt, Human
gagcaccgagaagaacugggcgacucccaguc

SEQ ID NO: 157825 - RNA, 32 nt, Human
gagcaccgcagcgggagccagcagggggcagc

SEQ ID NO: 157826 - RNA, 32 nt, Human
gagcaccgccagccaccggcaccaagaccggc

SEQ ID NO: 157827 - RNA, 32 nt, Human
gagcaccgcugcacucgcggccggcgaugcgg

SEQ ID NO: 157828 - RNA, 32 nt, Human
gagcaccggguggcagauguucuaugcagugu

SEQ ID NO: 157829 - RNA, 32 nt, Human
gagcaccuacuaggcgcugggcauuuugcuag

SEQ ID NO: 157830 - RNA, 32 nt, Human
gagcaccuccagcagaugucacucugagugug

SEQ ID NO: 157831 - RNA, 32 nt, Human
gagcaccuccaggagccucaguuucgccuuua

SEQ ID NO: 157832 - RNA, 32 nt, Human
gagcaccucugccuucuuccucuguugccaug

SEQ ID NO: 157833 - RNA, 32 nt, Human
gagcaccugccugcccugccgauguguccugu

SEQ ID NO: 157834 - RNA, 32 nt, Human
gagcaccugcugugugugcacugcuguucuag

SEQ ID NO: 157835 - RNA, 32 nt, Human
gagcaccugggaagccgugaggaggacguggg

SEQ ID NO: 157836 - RNA, 32 nt, Human
gagcaccuggggaucccaggaacccuggucag

SEQ ID NO: 157837 - RNA, 32 nt, Human
gagcaccuggugacacaaaugaaguggcggcu

SEQ ID NO: 157838 - RNA, 32 nt, Human
gagcaccuguaaucccagcuacucgggaggcu

SEQ ID NO: 157839 - RNA, 32 nt, Human
gagcaccuguaaucccagcuacucuggaggcu

SEQ ID NO: 157840 - RNA, 32 nt, Human
gagcaccuguaaucccagcuucucgggaggcu

SEQ ID NO: 157841 - RNA, 32 nt, Human
gagcaccuguaaucccugcuacucgggaggcu

SEQ ID NO: 157842 - RNA, 32 nt, Human
gagcaccuguaauccuagcuacuugggaggcu

SEQ ID NO: 157843 - RNA, 32 nt, Human
gagcaccuguaaucucagcacuuugggaggcc

SEQ ID NO: 157844 - RNA, 32 nt, Human
gagcaccuguaaugucagcuacuugggaggcu

SEQ ID NO: 157845 - RNA, 32 nt, Human
gagcaccuguagucccagcuacucgggaggcu

SEQ ID NO: 157846 - RNA, 32 nt, Human
gagcaccugucauccaggcagcucuucccaau

SEQ ID NO: 157847 - RNA, 32 nt, Human
gagcaccuuccagagaagcuauuccaggucuc

SEQ ID NO: 157848 - RNA, 32 nt, Human
gagcaccuuuccucguggcuguuuccaggcac

SEQ ID NO: 157849 - RNA, 32 nt, Human
gagcaccuuugcucccccuuauccuccuuccu

SEQ ID NO: 157850 - RNA, 32 nt, Human
gagcaccuuuugaaugacuugcaccuggaaga

SEQ ID NO: 157851 - RNA, 32 nt, Human
gagcacgauggaggaggagcugagagagaaag

SEQ ID NO: 157852 - RNA, 20 nt, Human
gagcacgcagggcguccgag

SEQ ID NO: 157853 - RNA, 20 nt, Human
gagcacgcauccuaaugaga

SEQ ID NO: 157854 - RNA, 32 nt, Human
gagcacgccaagcagcuccccaucgcuccgga

SEQ ID NO: 157855 - RNA, 32 nt, Human
gagcacgccacugcacuccagccugggugaca

SEQ ID NO: 157856 - RNA, 32 nt, Human
gagcacgccauugcacuccacacuccagccug

SEQ ID NO: 157857 - RNA, 32 nt, Human
gagcacgccugccucccucuccccuccgcccu

SEQ ID NO: 157858 - RNA, 32 nt, Human
gagcacgcuguaccgccagccccagcccugcc

SEQ ID NO: 157859 - RNA, 32 nt, Human
gagcacgcuucagggauaggagaucauaguca

SEQ ID NO: 157860 - RNA, 32 nt, Human
gagcacggaggcagagacgugggagccgauga

SEQ ID NO: 157861 - RNA, 32 nt, Human
gagcacggcaccgagggagccgccacacgguc

SEQ ID NO: 157862 - RNA, 32 nt, Human
gagcacggcacugggaaaugggagcacaguac

SEQ ID NO: 157863 - RNA, 24 nt, Human
gagcacggccagccuuccgccacg

SEQ ID NO: 157864 - RNA, 32 nt, Human
gagcacgggcaggcucaggcgggaagaaggag

SEQ ID NO: 157865 - RNA, 32 nt, Human
gagcacgguagggcagccuggugagaggggcc

SEQ ID NO: 157866 - RNA, 32 nt, Human
gagcacguauuucuccccucuaguaccucugc

SEQ ID NO: 157867 - RNA, 32 nt, Human
gagcacgucccccacguccucuccuucucgcc

SEQ ID NO: 157868 - RNA, 32 nt, Human
gagcacguguuacugccagucugcgucagcgu

SEQ ID NO: 157869 - RNA, 32 nt, Human
gagcacguuuaaaaucucaguaacuuuggggu

SEQ ID NO: 157870 - RNA, 32 nt, Human
gagcacuaggggcagaggcggccagacaaccu

SEQ ID NO: 157871 - RNA, 32 nt, Human
gagcacuauaaaaucaaaaaccaaugaaaugg

SEQ ID NO: 157872 - RNA, 32 nt, Human
gagcacuauaaaccacauguuuucauuucuag

SEQ ID NO: 157873 - RNA, 32 nt, Human
gagcacuauuaaaauacaugcauuggcucaau

SEQ ID NO: 157874 - RNA, 32 nt, Human
gagcacucacagucuaaggcuggaaguuuaau

SEQ ID NO: 157875 - RNA, 21 nt, Human
gagcacucagcugugacccug

SEQ ID NO: 157876 - RNA, 32 nt, Human
gagcacuccauugcuuucuuuccuggccacac

SEQ ID NO: 157877 - RNA, 32 nt, Human
gagcacucccagcccggggccugcugccucca

SEQ ID NO: 157878 - RNA, 32 nt, Human
gagcacuccugcuuccuugccugcuugcaguu

SEQ ID NO: 157879 - RNA, 32 nt, Human
gagcacucucuaaacuguacagcugguauucc

SEQ ID NO: 157880 - RNA, 32 nt, Human
gagcacugacccacagcacuacaccgaggaca

SEQ ID NO: 157881 - RNA, 32 nt, Human
gagcacugagcagcgcucagaauggaagccau

SEQ ID NO: 157882 - RNA, 32 nt, Human
gagcacugagucucugggauucuggcaaggua

SEQ ID NO: 157883 - RNA, 32 nt, Human
gagcacugcagcauccagccuuucaaagcuga

SEQ ID NO: 157884 - RNA, 32 nt, Human
gagcacugcccgcugugccugccugcaagucu

SEQ ID NO: 157885 - RNA, 32 nt, Human
gagcacugcgcaugcgggaaacccacccugua

SEQ ID NO: 157886 - RNA, 32 nt, Human
gagcacuggagcuggagggagcuccagccaag

SEQ ID NO: 157887 - RNA, 32 nt, Human
gagcacuggagugcagggaggagaggggaagg

SEQ ID NO: 157888 - RNA, 32 nt, Human
gagcacuggggcaggaggaucgcuugugccca

SEQ ID NO: 157889 - RNA, 32 nt, Human
gagcacuguauguuccucucuuuuggaguugu

SEQ ID NO: 157890 - RNA, 32 nt, Human
gagcacugucguccuucagggcuccagccucu

SEQ ID NO: 157891 - RNA, 32 nt, Human
gagcacugugaccuuucuuucccuggaacucu

SEQ ID NO: 157892 - RNA, 32 nt, Human
gagcacuguuagacacacauagaccugcaggc

SEQ ID NO: 157893 - RNA, 22 nt, Human
gagcacuuaguccugcugguuu

SEQ ID NO: 157894 - RNA, 32 nt, Human
gagcacuucccccuccuugaggcaggaauacu

SEQ ID NO: 157895 - RNA, 32 nt, Human
gagcacuucgaggaggaggaggaggccggggu

SEQ ID NO: 157896 - RNA, 32 nt, Human
gagcacuucugagugauaacuaaagcaguuug

SEQ ID NO: 157897 - RNA, 32 nt, Human
gagcacuuuggaauguacauggaaaggaugga

SEQ ID NO: 157898 - RNA, 32 nt, Human
gagcacuuugggaggccaagacaggaggauca

SEQ ID NO: 157899 - RNA, 32 nt, Human
gagcacuuugggaggccgaggugggcggauca

SEQ ID NO: 157900 - RNA, 32 nt, Human
gagcacuuugggaggcugaggugggcagauca

SEQ ID NO: 157901 - RNA, 32 nt, Human
gagcagaaaacccaagggcagguggagagucc

SEQ ID NO: 157902 - RNA, 32 nt, Human
gagcagaaaggagagagaccuauguuugcuaa

SEQ ID NO: 157903 - RNA, 32 nt, Human
gagcagaaaugccaccaaugccaagugcccca

SEQ ID NO: 157904 - RNA, 32 nt, Human
gagcagaacagggaggcuagagcgcagcggga

SEQ ID NO: 157905 - RNA, 32 nt, Human
gagcagaacagucccucacaccuggcccggca

SEQ ID NO: 157906 - RNA, 32 nt, Human
gagcagaacccccauuccccagccucugcugg

SEQ ID NO: 157907 - RNA, 32 nt, Human
gagcagaacucuguggcuggcagccacuauuc

SEQ ID NO: 157908 - RNA, 21 nt, Human
gagcagaacugggagcagaug

SEQ ID NO: 157909 - RNA, 21 nt, Human
gagcagaacuucuuguaccca

SEQ ID NO: 157910 - RNA, 32 nt, Human
gagcagaagaaagguguuccuucccauggaua

SEQ ID NO: 157911 - RNA, 32 nt, Human
gagcagaagaaggagggagggagccagccgcu

SEQ ID NO: 157912 - RNA, 32 nt, Human
gagcagaagaauugagaaagagaaugagacca

SEQ ID NO: 157913 - RNA, 32 nt, Human
gagcagaaggcuugccuuccugggagcagguu

SEQ ID NO: 157914 - RNA, 32 nt, Human
gagcagaagggcugcauuuugcuuaucagaag

SEQ ID NO: 157915 - RNA, 32 nt, Human
gagcagaagucaguggcugcucaccagagagg

SEQ ID NO: 157916 - RNA, 32 nt, Human
gagcagaaucccccacucccaccccaccaacc

SEQ ID NO: 157917 - RNA, 32 nt, Human
gagcagacagagaaaugugaagggugggguuu

SEQ ID NO: 157918 - RNA, 32 nt, Human
gagcagacguaccccugccccaccucagcccg

SEQ ID NO: 157919 - RNA, 20 nt, Human
gagcagacgucugaagcagc

SEQ ID NO: 157920 - RNA, 32 nt, Human
gagcagacguggcuuuuuaugugucuuguugg

SEQ ID NO: 157921 - RNA, 32 nt, Human
gagcagacuggaagaaugggggugggagggug

SEQ ID NO: 157922 - RNA, 32 nt, Human
gagcagacuuucuaacauaccuaguuuugugu

SEQ ID NO: 157923 - RNA, 32 nt, Human
gagcagagaacacuggcuucacagaggacuuu

SEQ ID NO: 157924 - RNA, 32 nt, Human
gagcagagaagcagagauguuccuugaacugc

SEQ ID NO: 157925 - RNA, 32 nt, Human
gagcagagacaccacuucucaagcaccugauu

SEQ ID NO: 157926 - RNA, 22 nt, Human
gagcagagacagccccugguuu

SEQ ID NO: 157927 - RNA, 20 nt, Human
gagcagagacuuaaccccca

SEQ ID NO: 157928 - RNA, 32 nt, Human
gagcagagagacccaacugggagccagagaug

SEQ ID NO: 157929 - RNA, 32 nt, Human
gagcagagagcagaaccuggugugugggacac

SEQ ID NO: 157930 - RNA, 18 nt, Human
gagcagagagcgcaucga

SEQ ID NO: 157931 - RNA, 32 nt, Human
gagcagagaggaaggagaaagaggaggagaga

SEQ ID NO: 157932 - RNA, 32 nt, Human
gagcagagaggaagggauggguggacucacag

SEQ ID NO: 157933 - RNA, 32 nt, Human
gagcagagaggcccagggaggggccagguguc

SEQ ID NO: 157934 - RNA, 24 nt, Human
gagcagagaucacaccacugcacu

SEQ ID NO: 157935 - RNA, 24 nt, Human
gagcagagaucgcgccacugcacu

SEQ ID NO: 157936 - RNA, 32 nt, Human
gagcagagauggggagcuggauccgcgcagaa

SEQ ID NO: 157937 - RNA, 24 nt, Human
gagcagagauugcaccacugcacu

SEQ ID NO: 157938 - RNA, 24 nt, Human
gagcagagauugcgccacugcacu

SEQ ID NO: 157939 - RNA, 24 nt, Human
gagcagagauugcgccauugcacu

SEQ ID NO: 157940 - RNA, 32 nt, Human
gagcagagcagacagcagcagaggggcucccu

SEQ ID NO: 157941 - RNA, 24 nt, Human
gagcagagcagccagagcccugug

SEQ ID NO: 157942 - RNA, 18 nt, Human
gagcagagccaggcccag

SEQ ID NO: 157943 - RNA, 32 nt, Human
gagcagagccuggguuuggagugagugccugg

SEQ ID NO: 157944 - RNA, 32 nt, Human
gagcagagccuuugucucaggagcaaaccagc

SEQ ID NO: 157945 - RNA, 32 nt, Human
gagcagagcuggagcucgaucaugccugcgug

SEQ ID NO: 157946 - RNA, 32 nt, Human
gagcagaggaaagaggaaagacacagagagac

SEQ ID NO: 157947 - RNA, 32 nt, Human
gagcagaggaagagaucccagauaguagccag

SEQ ID NO: 157948 - RNA, 32 nt, Human
gagcagaggacccuguaccaggaugugaugcu

SEQ ID NO: 157949 - RNA, 32 nt, Human
gagcagaggacuccagaggcucagggagcagc

SEQ ID NO: 157950 - RNA, 32 nt, Human
gagcagaggacuggucuggagcugggcaaggg

SEQ ID NO: 157951 - RNA, 21 nt, Human
gagcagaggagcacacagaug

SEQ ID NO: 157952 - RNA, 32 nt, Human
gagcagaggaggaggaggcaugagcgaggcgg

SEQ ID NO: 157953 - RNA, 32 nt, Human
gagcagaggaggaggaggcaugagugaggcgg

SEQ ID NO: 157954 - RNA, 32 nt, Human
gagcagaggaggucuuggcagagguccgcggg

SEQ ID NO: 157955 - RNA, 22 nt, Human
gagcagaggcacaaguuagagc

SEQ ID NO: 157956 - RNA, 21 nt, Human
gagcagaggcagcacucgggc

SEQ ID NO: 157957 - RNA, 32 nt, Human
gagcagaggcagcauuuuugcacuggauaaac

SEQ ID NO: 157958 - RNA, 24 nt, Human
gagcagaggcagguguucccgggc

SEQ ID NO: 157959 - RNA, 24 nt, Human
gagcagaggcccuucacccagagc

SEQ ID NO: 157960 - RNA, 19 nt, Human
gagcagaggcucaggcaca

SEQ ID NO: 157961 - RNA, 21 nt, Human
gagcagaggcuucugggccag

SEQ ID NO: 157962 - RNA, 32 nt, Human
gagcagagggaaaggaggcuggagaggcuucu

SEQ ID NO: 157963 - RNA, 22 nt, Human
gagcagagggagcauggcccag

SEQ ID NO: 157964 - RNA, 32 nt, Human
gagcagagggcaugucaguaaugauugguccc

SEQ ID NO: 157965 - RNA, 32 nt, Human
gagcagagggugugugacagaggaggaaaaua

SEQ ID NO: 157966 - RNA, 18 nt, Human
gagcagaggugagcagca

SEQ ID NO: 157967 - RNA, 32 nt, Human
gagcagaggugagcugagugcagugagccaag

SEQ ID NO: 157968 - RNA, 22 nt, Human
gagcagaggugaggaccuggga

SEQ ID NO: 157969 - RNA, 32 nt, Human
gagcagaggugaggagaggcagccugggaaua

SEQ ID NO: 157970 - RNA, 19 nt, Human
gagcagagguggcagcaga

SEQ ID NO: 157971 - RNA, 24 nt, Human
gagcagagguggccgccguggggg

SEQ ID NO: 157972 - RNA, 21 nt, Human
gagcagagugcccgccccgug

SEQ ID NO: 157973 - RNA, 32 nt, Human
gagcagagugugagagagcuaauggaaguaag

SEQ ID NO: 157974 - RNA, 32 nt, Human
gagcagaguguuggagaccaggaacaaucaga

SEQ ID NO: 157975 - RNA, 22 nt, Human
gagcagaguuggaaacacagug

SEQ ID NO: 157976 - RNA, 23 nt, Human
gagcagaguugucauacugguuu

SEQ ID NO: 157977 - RNA, 32 nt, Human
gagcagauaaggggaucuauaaucuuguaaca

SEQ ID NO: 157978 - RNA, 18 nt, Human
gagcagauaugggcagca

SEQ ID NO: 157979 - RNA, 32 nt, Human
gagcagauccccagggacucaggcuggaauag

SEQ ID NO: 157980 - RNA, 32 nt, Human
gagcagaucucugccagcaagcuuaucuggcc

SEQ ID NO: 157981 - RNA, 23 nt, Human
gagcagaucuucuggugacccca

SEQ ID NO: 157982 - RNA, 32 nt, Human
gagcagaugagaccagcucuugcuugguugga

SEQ ID NO: 157983 - RNA, 21 nt, Human
gagcagaugaucggagcagca

SEQ ID NO: 157984 - RNA, 21 nt, Human
gagcagaugauucgagcagca

SEQ ID NO: 157985 - RNA, 31 nt, Human
gagcagaugcagguguuccagaugaucacca

SEQ ID NO: 157986 - RNA, 31 nt, Human
gagcagauggcagaaacagagagaaacgacg

SEQ ID NO: 157987 - RNA, 32 nt, Human
gagcagauggcagaaacagagagaaacgacga

SEQ ID NO: 157988 - RNA, 18 nt, Human
gagcagauggccaagcag

SEQ ID NO: 157989 - RNA, 18 nt, Human
gagcagauuagagcagca

SEQ ID NO: 157990 - RNA, 32 nt, Human
gagcagcaauuuauccgugugcagccccaaac

SEQ ID NO: 157991 - RNA, 18 nt, Human
gagcagcacagagcagca

SEQ ID NO: 157992 - RNA, 32 nt, Human
gagcagcacaugcaccaggagcaucugagucu

SEQ ID NO: 157993 - RNA, 32 nt, Human
gagcagcacccgcagcucagagcccgggacgu

SEQ ID NO: 157994 - RNA, 32 nt, Human
gagcagcacguggcagucacauggcaggccgu

SEQ ID NO: 157995 - RNA, 16 nt, Human
gagcagcacucggaga

SEQ ID NO: 157996 - RNA, 32 nt, Human
gagcagcacugcacccucacuagccagggugu

SEQ ID NO: 157997 - RNA, 20 nt, Human
gagcagcagaagcagcagau

SEQ ID NO: 157998 - RNA, 32 nt, Human
gagcagcagagcaacaggccugacccagggca

SEQ ID NO: 157999 - RNA, 32 nt, Human
gagcagcagauagagacacaggccuguggucc

SEQ ID NO: 158000 - RNA, 32 nt, Human
gagcagcagaugcucacagaccacacucagcu

SEQ ID NO: 158001 - RNA, 32 nt, Human
gagcagcagcacaacuaggaaaccccaaagcc

SEQ ID NO: 158002 - RNA, 20 nt, Human
gagcagcagcacgagcagua

SEQ ID NO: 158003 - RNA, 16 nt, Human
gagcagcagcagcagc

SEQ ID NO: 158004 - RNA, 21 nt, Human
gagcagcagcagcaggcacag

SEQ ID NO: 158005 - RNA, 32 nt, Human
gagcagcagcagcuggcggagcaauggagaug

SEQ ID NO: 158006 - RNA, 32 nt, Human
gagcagcagccugucuugugguaugucugugg

SEQ ID NO: 158007 - RNA, 32 nt, Human
gagcagcagccugucuugugugagguguucug

SEQ ID NO: 158008 - RNA, 32 nt, Human
gagcagcagcggcccccgcucccgggaaccgu

SEQ ID NO: 158009 - RNA, 21 nt, Human
gagcagcagcuacgggcagca

SEQ ID NO: 158010 - RNA, 32 nt, Human
gagcagcagcuaucugucuuuugcugaucuac

SEQ ID NO: 158011 - RNA, 32 nt, Human
gagcagcaggaguggggagggaagggagccaa

SEQ ID NO: 158012 - RNA, 32 nt, Human
gagcagcagggagagacagagacuggacaugu

SEQ ID NO: 158013 - RNA, 23 nt, Human
gagcagcaggggagcgggcacag

SEQ ID NO: 158014 - RNA, 32 nt, Human
gagcagcagggugcagggcuuggaaggaaugu

SEQ ID NO: 158015 - RNA, 32 nt, Human
gagcagcaggugugggugaggggaagguucug

SEQ ID NO: 158016 - RNA, 32 nt, Human
gagcagcagguguuggcagcagagaacaaacc

SEQ ID NO: 158017 - RNA, 32 nt, Human
gagcagcagugcaggccuggccuguguccccg

SEQ ID NO: 158018 - RNA, 32 nt, Human
gagcagcauaccuccauguugugaaggcaucu

SEQ ID NO: 158019 - RNA, 32 nt, Human
gagcagcauaguugauauuuacccacaaacac

SEQ ID NO: 158020 - RNA, 18 nt, Human
gagcagcauaucuuugcu

SEQ ID NO: 158021 - RNA, 32 nt, Human
gagcagccaacacaccagcccagacagcugca

SEQ ID NO: 158022 - RNA, 32 nt, Human
gagcagccaagaaacugccagcaaugcccaga

SEQ ID NO: 158023 - RNA, 32 nt, Human
gagcagccaagcacacaccugcuggcauguug

SEQ ID NO: 158024 - RNA, 32 nt, Human
gagcagccacacucgcaccuccugggugcugu

SEQ ID NO: 158025 - RNA, 32 nt, Human
gagcagccacuuccuggggccgccggccgggg

SEQ ID NO: 158026 - RNA, 32 nt, Human
gagcagccagaacuuucuuucacgguuacugu

SEQ ID NO: 158027 - RNA, 24 nt, Human
gagcagccagcagcuggcccagug

SEQ ID NO: 158028 - RNA, 32 nt, Human
gagcagccagcccagcccgggaacaagacgga

SEQ ID NO: 158029 - RNA, 32 nt, Human
gagcagccaggagagcuuagggucucagggug

SEQ ID NO: 158030 - RNA, 32 nt, Human
gagcagccaguaaugacaguguccuaacagcu

SEQ ID NO: 158031 - RNA, 32 nt, Human
gagcagccaucaggcuggaggugacgaugagu

SEQ ID NO: 158032 - RNA, 32 nt, Human
gagcagcccaggagaagagagauggggguucc

SEQ ID NO: 158033 - RNA, 32 nt, Human
gagcagcccaggagaugggccuaaaauguucu

SEQ ID NO: 158034 - RNA, 32 nt, Human
gagcagcccaggccugggcaaaaagcgcaaag

SEQ ID NO: 158035 - RNA, 32 nt, Human
gagcagcccagggagccaggccccagacaccg

SEQ ID NO: 158036 - RNA, 32 nt, Human
gagcagcccccaggggccgagcguaccuucug

SEQ ID NO: 158037 - RNA, 32 nt, Human
gagcagccccuccacucugcccaggagagggg

SEQ ID NO: 158038 - RNA, 20 nt, Human
gagcagccccuccucugccg

SEQ ID NO: 158039 - RNA, 32 nt, Human
gagcagcccggcucuuaacagagaugcaggac

SEQ ID NO: 158040 - RNA, 32 nt, Human
gagcagcccuaggcagguccugguuuuuccaa

SEQ ID NO: 158041 - RNA, 32 nt, Human
gagcagcccugccugcugcucuucccccacca

SEQ ID NO: 158042 - RNA, 32 nt, Human
gagcagcccugugaggcugaggcugcagccag

SEQ ID NO: 158043 - RNA, 22 nt, Human
gagcagcccuuuuacaugcaca

SEQ ID NO: 158044 - RNA, 20 nt, Human
gagcagccgcgggcgccgag

SEQ ID NO: 158045 - RNA, 32 nt, Human
gagcagccggguugccccagcgcuggcugccg

SEQ ID NO: 158046 - RNA, 18 nt, Human
gagcagccuagagcagca

SEQ ID NO: 158047 - RNA, 32 nt, Human
gagcagccuagugccagaaauguccaagaugc

SEQ ID NO: 158048 - RNA, 32 nt, Human
gagcagccuaucucccccaagcuggaggcggc

SEQ ID NO: 158049 - RNA, 32 nt, Human
gagcagccucaagcccagagaagacugaggcu

SEQ ID NO: 158050 - RNA, 32 nt, Human
gagcagccucaggaguugaaggggauccuguc

SEQ ID NO: 158051 - RNA, 32 nt, Human
gagcagccuccaugggcacacaggagggcugg

SEQ ID NO: 158052 - RNA, 32 nt, Human
gagcagccuccuaccuccccugccugagcccu

SEQ ID NO: 158053 - RNA, 32 nt, Human
gagcagccugcccugcaaucucuuucucagaa

SEQ ID NO: 158054 - RNA, 32 nt, Human
gagcagccugcuggauccagaacaugacaaca

SEQ ID NO: 158055 - RNA, 32 nt, Human
gagcagccuggacugcagcucucagaggccag

SEQ ID NO: 158056 - RNA, 32 nt, Human
gagcagcgaagaaggggguggggaggggaggg

SEQ ID NO: 158057 - RNA, 19 nt, Human
gagcagcgacccgcggcgg

SEQ ID NO: 158058 - RNA, 20 nt, Human
gagcagcgaccugagcagca

SEQ ID NO: 158059 - RNA, 32 nt, Human
gagcagcgagucagagggggcaucugaacgca

SEQ ID NO: 158060 - RNA, 32 nt, Human
gagcagcgcuucucaaacugacuauucaaguc

SEQ ID NO: 158061 - RNA, 32 nt, Human
gagcagcggacuccggagcgucagccugccuu

SEQ ID NO: 158062 - RNA, 21 nt, Human
gagcagcggccuggagcagca

SEQ ID NO: 158063 - RNA, 32 nt, Human
gagcagcgggcacuccuuccugggcagggugg

SEQ ID NO: 158064 - RNA, 21 nt, Human
gagcagcguccuauaauccua

SEQ ID NO: 158065 - RNA, 17 nt, Human
gagcagcuaccaugcac

SEQ ID NO: 158066 - RNA, 32 nt, Human
gagcagcucaagcaaccaggucuuccugccau

SEQ ID NO: 158067 - RNA, 32 nt, Human
gagcagcucaagccucccagcauugcaguuac

SEQ ID NO: 158068 - RNA, 20 nt, Human
gagcagcucagggcacugcg

SEQ ID NO: 158069 - RNA, 19 nt, Human
gagcagcucaucacaggca

SEQ ID NO: 158070 - RNA, 22 nt, Human
gagcagcuccccaggagcucag

SEQ ID NO: 158071 - RNA, 20 nt, Human
gagcagcuccccuaggucag

SEQ ID NO: 158072 - RNA, 19 nt, Human
gagcagcuccccugcccac

SEQ ID NO: 158073 - RNA, 22 nt, Human
gagcagcuccgaggccgcggcg

SEQ ID NO: 158074 - RNA, 19 nt, Human
gagcagcuccuagcagcau

SEQ ID NO: 158075 - RNA, 21 nt, Human
gagcagcuccuagcagcauca

SEQ ID NO: 158076 - RNA, 22 nt, Human
gagcagcuccuccagcuggcca

SEQ ID NO: 158077 - RNA, 22 nt, Human
gagcagcuccucuaggggccca

SEQ ID NO: 158078 - RNA, 22 nt, Human
gagcagcuccucugcaggcaca

SEQ ID NO: 158079 - RNA, 23 nt, Human
gagcagcuccucugcaggcacag

SEQ ID NO: 158080 - RNA, 20 nt, Human
gagcagcuccucugcauagu

SEQ ID NO: 158081 - RNA, 19 nt, Human
gagcagcuccucugcaugu

SEQ ID NO: 158082 - RNA, 32 nt, Human
gagcagcuccugggcugugcucuguuugaagg

SEQ ID NO: 158083 - RNA, 32 nt, Human
gagcagcucuccccaggcauuugccaagggag

SEQ ID NO: 158084 - RNA, 32 nt, Human
gagcagcucugcuuucucaggucucuacuuac

SEQ ID NO: 158085 - RNA, 22 nt, Human
gagcagcucuguccaaccacag

SEQ ID NO: 158086 - RNA, 32 nt, Human
gagcagcugaccucaucaaagauuuuaccaag

SEQ ID NO: 158087 - RNA, 32 nt, Human
gagcagcugaggaggaggcaggagagagggaa

SEQ ID NO: 158088 - RNA, 32 nt, Human
gagcagcugauaguggaaaacagaauaaugau

SEQ ID NO: 158089 - RNA, 32 nt, Human
gagcagcugccacaacuggccauguccugcca

SEQ ID NO: 158090 - RNA, 32 nt, Human
gagcagcugccuggaagaguucugggaaguau

SEQ ID NO: 158091 - RNA, 32 nt, Human
gagcagcugcucaugggcagagcagcccuugg

SEQ ID NO: 158092 - RNA, 32 nt, Human
gagcagcugcucaugggcagagcugcccucgg

SEQ ID NO: 158093 - RNA, 32 nt, Human
gagcagcugcugcagggcagacagccggaccc

SEQ ID NO: 158094 - RNA, 32 nt, Human
gagcagcuggagcuccuuggaggcaggggcug

SEQ ID NO: 158095 - RNA, 32 nt, Human
gagcagcuggauggugccugaguggguuuggg

SEQ ID NO: 158096 - RNA, 24 nt, Human
gagcagcuggcagagagcccagug

SEQ ID NO: 158097 - RNA, 18 nt, Human
gagcagcuggccccaggc

SEQ ID NO: 158098 - RNA, 23 nt, Human
gagcagcugggacuacaggcaca

SEQ ID NO: 158099 - RNA, 21 nt, Human
gagcagcugggauuacaggug

SEQ ID NO: 158100 - RNA, 31 nt, Human
gagcagcugggauucccgaccaaagccccag

SEQ ID NO: 158101 - RNA, 21 nt, Human
gagcagcugggauugcaggug

SEQ ID NO: 158102 - RNA, 20 nt, Human
gagcagcugggccccggggg

SEQ ID NO: 158103 - RNA, 32 nt, Human
gagcagcugggggcugcagccugcucuguccc

SEQ ID NO: 158104 - RNA, 32 nt, Human
gagcagcuggggguuccaccucaggguggggc

SEQ ID NO: 158105 - RNA, 32 nt, Human
gagcagcugguggccuuggagaacaaguuccg

SEQ ID NO: 158106 - RNA, 32 nt, Human
gagcagcugucugaacuauaggccccagugcu

SEQ ID NO: 158107 - RNA, 32 nt, Human
gagcagcugugagugaggggacaaggggcagg

SEQ ID NO: 158108 - RNA, 22 nt, Human
gagcagcuuagauuucccuacu

SEQ ID NO: 158109 - RNA, 19 nt, Human
gagcagcuucaacaccaca

SEQ ID NO: 158110 - RNA, 15 nt, Human
gagcagcuucagaga

SEQ ID NO: 158111 - RNA, 32 nt, Human
gagcagcuucucaacaugaacuacagccucca

SEQ ID NO: 158112 - RNA, 32 nt, Human
gagcagcuugaguugaagaagacacugcugga

SEQ ID NO: 158113 - RNA, 21 nt, Human
gagcagcuuuaaacucaggga

SEQ ID NO: 158114 - RNA, 21 nt, Human
gagcagcuuuuggcugcguaa

SEQ ID NO: 158115 - RNA, 32 nt, Human
gagcaggaaacuggaguugaggagggcagcuc

SEQ ID NO: 158116 - RNA, 21 nt, Human
gagcaggaacuggaguaaaug

SEQ ID NO: 158117 - RNA, 17 nt, Human
gagcaggaagagcagca

SEQ ID NO: 158118 - RNA, 32 nt, Human
gagcaggaagcacaccugugccauuucuggga

SEQ ID NO: 158119 - RNA, 20 nt, Human
gagcaggaaggcuguugggg

SEQ ID NO: 158120 - RNA, 21 nt, Human
gagcaggaagugcaggcagag

SEQ ID NO: 158121 - RNA, 22 nt, Human
gagcaggaaugcuuuacagaug

SEQ ID NO: 158122 - RNA, 32 nt, Human
gagcaggacacaucucacagugcccgcaggcu

SEQ ID NO: 158123 - RNA, 32 nt, Human
gagcaggacaggagagguacaagugaagugcc

SEQ ID NO: 158124 - RNA, 21 nt, Human
gagcaggacaguuggcagcag

SEQ ID NO: 158125 - RNA, 32 nt, Human
gagcaggaccuggucucccaagagcgggacua

SEQ ID NO: 158126 - RNA, 18 nt, Human
gagcaggacgugagcgca

SEQ ID NO: 158127 - RNA, 20 nt, Human
gagcaggacuugagcaggca

SEQ ID NO: 158128 - RNA, 32 nt, Human
gagcaggagaagcggugcccaccagcuuccag

SEQ ID NO: 158129 - RNA, 21 nt, Human
gagcaggagaauggcgcgaac

SEQ ID NO: 158130 - RNA, 32 nt, Human
gagcaggagaauuccgagcuucuugcccaggc

SEQ ID NO: 158131 - RNA, 32 nt, Human
gagcaggagacuggcaagagcucuuugucuca

SEQ ID NO: 158132 - RNA, 32 nt, Human
gagcaggagagcaggaaggaaacgcaggagga

SEQ ID NO: 158133 - RNA, 32 nt, Human
gagcaggagaggagugucgccgggaggccuuc

SEQ ID NO: 158134 - RNA, 22 nt, Human
gagcaggagcaggacagaagau

SEQ ID NO: 158135 - RNA, 32 nt, Human
gagcaggagccagcgugagacugaggcccccu

SEQ ID NO: 158136 - RNA, 21 nt, Human
gagcaggagcggcggcagcag

SEQ ID NO: 158137 - RNA, 32 nt, Human
gagcaggagcuucuuccaggaguucugagccu

SEQ ID NO: 158138 - RNA, 32 nt, Human
gagcaggaggcagagcccgcgggaagcucgga

SEQ ID NO: 158139 - RNA, 24 nt, Human
gagcaggaggcagaggagcagaug

SEQ ID NO: 158140 - RNA, 32 nt, Human
gagcaggaggcagaggagcagauggagcagcu

SEQ ID NO: 158141 - RNA, 32 nt, Human
gagcaggaggcccucauccuucugcugcccug

SEQ ID NO: 158142 - RNA, 32 nt, Human
gagcaggagggcaggggucaggagaacaggag

SEQ ID NO: 158143 - RNA, 20 nt, Human
gagcaggagguugcagugag

SEQ ID NO: 158144 - RNA, 21 nt, Human
gagcaggaugcagaggcacag

SEQ ID NO: 158145 - RNA, 23 nt, Human
gagcaggaugcucaggaccugga

SEQ ID NO: 158146 - RNA, 32 nt, Human
gagcaggauggaaauacuuugcugcccuugcc

SEQ ID NO: 158147 - RNA, 32 nt, Human
gagcaggcaagaacggggagcuucuguggauu

SEQ ID NO: 158148 - RNA, 18 nt, Human
gagcaggcacaagacagc

SEQ ID NO: 158149 - RNA, 19 nt, Human
gagcaggcacagcacagca

SEQ ID NO: 158150 - RNA, 18 nt, Human
gagcaggcaccagcagca

SEQ ID NO: 158151 - RNA, 17 nt, Human
gagcaggcaccgcagua

SEQ ID NO: 158152 - RNA, 18 nt, Human
gagcaggcacgagacagc

SEQ ID NO: 158153 - RNA, 17 nt, Human
gagcaggcacuugcagc

SEQ ID NO: 158154 - RNA, 17 nt, Human
gagcaggcagagcacca

SEQ ID NO: 158155 - RNA, 17 nt, Human
gagcaggcagagcugca

SEQ ID NO: 158156 - RNA, 19 nt, Human
gagcaggcagagcugcagu

SEQ ID NO: 158157 - RNA, 32 nt, Human
gagcaggcagagcuugucauccccagccuggu

SEQ ID NO: 158158 - RNA, 32 nt, Human
gagcaggcagcaggcuuaucccuucaccagca

SEQ ID NO: 158159 - RNA, 32 nt, Human
gagcaggcagccagggccaucaugagggagca

SEQ ID NO: 158160 - RNA, 32 nt, Human
gagcaggcagcucugggcaugugucuggucac

SEQ ID NO: 158161 - RNA, 32 nt, Human
gagcaggcaggcaaagggggcuuucugaggau

SEQ ID NO: 158162 - RNA, 32 nt, Human
gagcaggcaggcagaguggagagggagagacg

SEQ ID NO: 158163 - RNA, 32 nt, Human
gagcaggcaggcaggagguccuguuagcccug

SEQ ID NO: 158164 - RNA, 19 nt, Human
gagcaggcagggcacagca

SEQ ID NO: 158165 - RNA, 32 nt, Human
gagcaggcaggguggagcgaaggagcuccuua

SEQ ID NO: 158166 - RNA, 20 nt, Human
gagcaggcauaugagcaaca

SEQ ID NO: 158167 - RNA, 32 nt, Human
gagcaggcaugagcugggcuguggugcagagc

SEQ ID NO: 158168 - RNA, 17 nt, Human
gagcaggcaugucggca

SEQ ID NO: 158169 - RNA, 16 nt, Human
gagcaggccaagcugc

SEQ ID NO: 158170 - RNA, 19 nt, Human
gagcaggccacagaacgca

SEQ ID NO: 158171 - RNA, 17 nt, Human
gagcaggccacagaggc

SEQ ID NO: 158172 - RNA, 19 nt, Human
gagcaggccacagccuggc

SEQ ID NO: 158173 - RNA, 16 nt, Human
gagcaggccacagugc

SEQ ID NO: 158174 - RNA, 19 nt, Human
gagcaggccaccagcagca

SEQ ID NO: 158175 - RNA, 18 nt, Human
gagcaggccacugugagc

SEQ ID NO: 158176 - RNA, 19 nt, Human
gagcaggccagccaagcag

SEQ ID NO: 158177 - RNA, 15 nt, Human
gagcaggccaggcgc

SEQ ID NO: 158178 - RNA, 18 nt, Human
gagcaggccagugggagg

SEQ ID NO: 158179 - RNA, 18 nt, Human
gagcaggcccaagggcag

SEQ ID NO: 158180 - RNA, 18 nt, Human
gagcaggcccagaccagc

SEQ ID NO: 158181 - RNA, 19 nt, Human
gagcaggcccauauucagc

SEQ ID NO: 158182 - RNA, 32 nt, Human
gagcaggccccaggcuggaccugcccuguccu

SEQ ID NO: 158183 - RNA, 17 nt, Human
gagcaggccccggcagc

SEQ ID NO: 158184 - RNA, 16 nt, Human
gagcaggcccggccgc

SEQ ID NO: 158185 - RNA, 19 nt, Human
gagcaggcccgggcaggca

SEQ ID NO: 158186 - RNA, 19 nt, Human
gagcaggcccggggcagca

SEQ ID NO: 158187 - RNA, 32 nt, Human
gagcaggcccugcccuccacacccucaugagg

SEQ ID NO: 158188 - RNA, 19 nt, Human
gagcaggccgcgugucaca

SEQ ID NO: 158189 - RNA, 19 nt, Human
gagcaggccggacgcagca

SEQ ID NO: 158190 - RNA, 20 nt, Human
gagcaggccggugagcagca

SEQ ID NO: 158191 - RNA, 16 nt, Human
gagcaggccugccagc

SEQ ID NO: 158192 - RNA, 18 nt, Human
gagcaggccuggugcagc

SEQ ID NO: 158193 - RNA, 32 nt, Human
gagcaggcgauugaaguaauucuguccugcgg

SEQ ID NO: 158194 - RNA, 20 nt, Human
gagcaggcgccagaauccca

SEQ ID NO: 158195 - RNA, 17 nt, Human
gagcaggcggcgcagca

SEQ ID NO: 158196 - RNA, 18 nt, Human
gagcaggcggcugccgca

SEQ ID NO: 158197 - RNA, 32 nt, Human
gagcaggcgggaggcccgaggaagggagccug

SEQ ID NO: 158198 - RNA, 17 nt, Human
gagcaggcgggccagca

SEQ ID NO: 158199 - RNA, 22 nt, Human
gagcaggcggggccgcccagug

SEQ ID NO: 158200 - RNA, 18 nt, Human
gagcaggcgguggcggca

SEQ ID NO: 158201 - RNA, 32 nt, Human
gagcaggcggugggcacccacccugggaccua

SEQ ID NO: 158202 - RNA, 18 nt, Human
gagcaggcuagaggcaca

SEQ ID NO: 158203 - RNA, 18 nt, Human
gagcaggcucagagcagc

SEQ ID NO: 158204 - RNA, 17 nt, Human
gagcaggcucaucagua

SEQ ID NO: 158205 - RNA, 32 nt, Human
gagcaggcucucuccccuccccuccccucccc

SEQ ID NO: 158206 - RNA, 32 nt, Human
gagcaggcucuuccaccuccuucagcuccccc

SEQ ID NO: 158207 - RNA, 20 nt, Human
gagcaggcugcugcugaaaa

SEQ ID NO: 158208 - RNA, 17 nt, Human
gagcaggcuggagcagc

SEQ ID NO: 158209 - RNA, 32 nt, Human
gagcaggcuggcacagagaagaggacaugcgg

SEQ ID NO: 158210 - RNA, 19 nt, Human
gagcaggcugggaacugca

SEQ ID NO: 158211 - RNA, 19 nt, Human
gagcaggcuguggagcagc

SEQ ID NO: 158212 - RNA, 32 nt, Human
gagcaggcuucaucugcucugccauccagccc

SEQ ID NO: 158213 - RNA, 16 nt, Human
gagcaggcuugguaca

SEQ ID NO: 158214 - RNA, 18 nt, Human
gagcaggcuuguggcagc

SEQ ID NO: 158215 - RNA, 21 nt, Human
gagcagggaaaggacuuggaa

SEQ ID NO: 158216 - RNA, 18 nt, Human
gagcagggaagagcagua

SEQ ID NO: 158217 - RNA, 32 nt, Human
gagcagggaaggaggccaggguccgcgcggcu

SEQ ID NO: 158218 - RNA, 32 nt, Human
gagcagggacacacucucaccucaagguagcu

SEQ ID NO: 158219 - RNA, 19 nt, Human
gagcagggacaugggagca

SEQ ID NO: 158220 - RNA, 32 nt, Human
gagcagggacggagggggagaaugggaggaga

SEQ ID NO: 158221 - RNA, 32 nt, Human
gagcagggagaguuccagaaagggggaugaaa

SEQ ID NO: 158222 - RNA, 32 nt, Human
gagcagggagcacuggccguggucuacagcgu

SEQ ID NO: 158223 - RNA, 32 nt, Human
gagcagggcgagaggaacagagccaaugaugu

SEQ ID NO: 158224 - RNA, 32 nt, Human
gagcagggcggggcgggggcuugaggugauuc

SEQ ID NO: 158225 - RNA, 32 nt, Human
gagcagggcucgggggcagcggccaggccccu

SEQ ID NO: 158226 - RNA, 32 nt, Human
gagcagggcugacagcccugaagugaggcugc

SEQ ID NO: 158227 - RNA, 20 nt, Human
gagcagggcuggaaccagca

SEQ ID NO: 158228 - RNA, 32 nt, Human
gagcaggggagaccuggcugggcaugguggcu

SEQ ID NO: 158229 - RNA, 32 nt, Human
gagcaggggagagagugagcgugagcuuggca

SEQ ID NO: 158230 - RNA, 32 nt, Human
gagcaggggcaccucuggaggcaggagaggcc

SEQ ID NO: 158231 - RNA, 32 nt, Human
gagcagggggacaccagggugaaucaggaaga

SEQ ID NO: 158232 - RNA, 32 nt, Human
gagcagggggcugagggcaagcagguggggcu

SEQ ID NO: 158233 - RNA, 32 nt, Human
gagcagggguccagagaggcaggcuggggagg

SEQ ID NO: 158234 - RNA, 19 nt, Human
gagcaggggugagcaggca

SEQ ID NO: 158235 - RNA, 32 nt, Human
gagcaggggugagcaggcaggcuccccucccg

SEQ ID NO: 158236 - RNA, 32 nt, Human
gagcaggggugaggagagcaggagaguagggg

SEQ ID NO: 158237 - RNA, 32 nt, Human
gagcagggugaccccucaucugaaaggcccaa

SEQ ID NO: 158238 - RNA, 32 nt, Human
gagcagggugauggccugcuucugcugccuca

SEQ ID NO: 158239 - RNA, 32 nt, Human
gagcaggguggccugcagcccagagccccagu

SEQ ID NO: 158240 - RNA, 17 nt, Human
gagcagguagaggagca

SEQ ID NO: 158241 - RNA, 23 nt, Human
gagcagguaggaaacagcaaaug

SEQ ID NO: 158242 - RNA, 32 nt, Human
gagcagguaggcuuggcucccucuccagccuc

SEQ ID NO: 158243 - RNA, 20 nt, Human
gagcagguauaugagcaaca

SEQ ID NO: 158244 - RNA, 16 nt, Human
gagcaggucaacagua

SEQ ID NO: 158245 - RNA, 32 nt, Human
gagcaggucaccacgggggagcagccugccca

SEQ ID NO: 158246 - RNA, 17 nt, Human
gagcaggucgcugcagc

SEQ ID NO: 158247 - RNA, 32 nt, Human
gagcaggucgggggacacagggccgaggcagg

SEQ ID NO: 158248 - RNA, 32 nt, Human
gagcaggugaaguugagggggaugggaacuaa

SEQ ID NO: 158249 - RNA, 18 nt, Human
gagcaggugacagaagca

SEQ ID NO: 158250 - RNA, 16 nt, Human
gagcaggugcugcagc

SEQ ID NO: 158251 - RNA, 23 nt, Human
gagcaggugcuggcacaagagca

SEQ ID NO: 158252 - RNA, 19 nt, Human
gagcaggugcuggcaggca

SEQ ID NO: 158253 - RNA, 18 nt, Human
gagcaggugcuuauagca

SEQ ID NO: 158254 - RNA, 19 nt, Human
gagcaggugcuugaaagca

SEQ ID NO: 158255 - RNA, 32 nt, Human
gagcagguggagaaggcuuugcaccggccugc

SEQ ID NO: 158256 - RNA, 17 nt, Human
gagcaggugugagcagc

SEQ ID NO: 158257 - RNA, 32 nt, Human
gagcagguguugugccuggagcugcucuccug

SEQ ID NO: 158258 - RNA, 17 nt, Human
gagcagguucgggcagc

SEQ ID NO: 158259 - RNA, 18 nt, Human
gagcagguucuggcggca

SEQ ID NO: 158260 - RNA, 20 nt, Human
gagcagguugaugagcggca

SEQ ID NO: 158261 - RNA, 32 nt, Human
gagcagguugcugagccaguggcugccccgug

SEQ ID NO: 158262 - RNA, 20 nt, Human
gagcagguuugcaggcacag

SEQ ID NO: 158263 - RNA, 32 nt, Human
gagcaguaaaacugaugacauaaagaaauuaa

SEQ ID NO: 158264 - RNA, 32 nt, Human
gagcaguaaaugaagacagaguggaggacaca

SEQ ID NO: 158265 - RNA, 32 nt, Human
gagcaguagaaaccucacaccuagccagugcc

SEQ ID NO: 158266 - RNA, 32 nt, Human
gagcagucaaucuugcuacauuauuuuugucu

SEQ ID NO: 158267 - RNA, 32 nt, Human
gagcagucaaugacuaauguucuguccuagcc

SEQ ID NO: 158268 - RNA, 32 nt, Human
gagcagucaccaucugaucuucaucaaaggaa

SEQ ID NO: 158269 - RNA, 32 nt, Human
gagcagucagaguccagugcucugccucagac

SEQ ID NO: 158270 - RNA, 23 nt, Human
gagcagucccggagccugagcca

SEQ ID NO: 158271 - RNA, 32 nt, Human
gagcaguccuaucacaagcucauggccuugga

SEQ ID NO: 158272 - RNA, 32 nt, Human
gagcaguccuggggcuuccugguggcugugac

SEQ ID NO: 158273 - RNA, 32 nt, Human
gagcagucugagccugagaccccagcccuggc

SEQ ID NO: 158274 - RNA, 32 nt, Human
gagcagucuggacuucucacugcuacaugaug

SEQ ID NO: 158275 - RNA, 32 nt, Human
gagcagucuggguggauggaaguggcuguccc

SEQ ID NO: 158276 - RNA, 32 nt, Human
gagcagucuuccauuccaacuuuaguuucugc

SEQ ID NO: 158277 - RNA, 32 nt, Human
gagcagugagccccucccucaaggaggucugg

SEQ ID NO: 158278 - RNA, 32 nt, Human
gagcagugaguuacagcgagaggcagagaaag

SEQ ID NO: 158279 - RNA, 32 nt, Human
gagcagugaugccaccuccaagcuuguccuag

SEQ ID NO: 158280 - RNA, 32 nt, Human
gagcagugcacuccagucugcagguacugcac

SEQ ID NO: 158281 - RNA, 32 nt, Human
gagcagugcaggagcagggcgagaggaacaga

SEQ ID NO: 158282 - RNA, 31 nt, Human
gagcagugccucucacggcuugucucaugca

SEQ ID NO: 158283 - RNA, 18 nt, Human
gagcagugcucucggcau

SEQ ID NO: 158284 - RNA, 32 nt, Human
gagcaguggaaaugcaccaaggagaugaggga

SEQ ID NO: 158285 - RNA, 32 nt, Human
gagcaguggagugggagcccagguaagaguau

SEQ ID NO: 158286 - RNA, 20 nt, Human
gagcaguggcaguagcagca

SEQ ID NO: 158287 - RNA, 32 nt, Human
gagcaguggccacauuuucugcagaggaagaa

SEQ ID NO: 158288 - RNA, 32 nt, Human
gagcagugggaccucucauugaacagggcuuu

SEQ ID NO: 158289 - RNA, 23 nt, Human
gagcagugggcagagcccggacc

SEQ ID NO: 158290 - RNA, 32 nt, Human
gagcaguguccaggggaggugcgcagugaacu

SEQ ID NO: 158291 - RNA, 29 nt, Human
gagcagugucugucugcggcaggaugggg

SEQ ID NO: 158292 - RNA, 32 nt, Human
gagcagugugcacauccagacacaucaucucc

SEQ ID NO: 158293 - RNA, 32 nt, Human
gagcaguguggaggaagaugagggccaggaaa

SEQ ID NO: 158294 - RNA, 32 nt, Human
gagcaguguucuauguaugaaugccacauuuu

SEQ ID NO: 158295 - RNA, 20 nt, Human
gagcaguguuuuccugcugg

SEQ ID NO: 158296 - RNA, 21 nt, Human
gagcaguuccaauuccucuca

SEQ ID NO: 158297 - RNA, 32 nt, Human
gagcaguucccaaggacagucagcauuucuag

SEQ ID NO: 158298 - RNA, 24 nt, Human
gagcaguugcacucuacaggcaca

SEQ ID NO: 158299 - RNA, 20 nt, Human
gagcaguugcaggccucaga

SEQ ID NO: 158300 - RNA, 32 nt, Human
gagcaguugccaauauuugcaccaucuucaca

SEQ ID NO: 158301 - RNA, 32 nt, Human
gagcaguuguuuuucccucccugggccucacu

SEQ ID NO: 158302 - RNA, 32 nt, Human
gagcaguuuaggaguccauggaagaaagaaaa

SEQ ID NO: 158303 - RNA, 32 nt, Human
gagcauaaacucaagaaaauagccuugaacuu

SEQ ID NO: 158304 - RNA, 32 nt, Human
gagcauaacuggagggugggcuggggaggggu

SEQ ID NO: 158305 - RNA, 32 nt, Human
gagcauaauccuuggcagggcucagcaggcgc

SEQ ID NO: 158306 - RNA, 32 nt, Human
gagcauacaagaaaacugccaucuucaagcug

SEQ ID NO: 158307 - RNA, 32 nt, Human
gagcauagacuucauggcugacuugcagaaaa

SEQ ID NO: 158308 - RNA, 32 nt, Human
gagcauagaugucuuuuauacaauucuuuuga

SEQ ID NO: 158309 - RNA, 32 nt, Human
gagcauaggaguuugagaccagccuggguaac

SEQ ID NO: 158310 - RNA, 32 nt, Human
gagcauaggccuuccuaugaaguagugcaaag

SEQ ID NO: 158311 - RNA, 32 nt, Human
gagcauaguacugggaaaugggagcacaguac

SEQ ID NO: 158312 - RNA, 32 nt, Human
gagcauauauccacaauguucauuuaaccaau

SEQ ID NO: 158313 - RNA, 32 nt, Human
gagcauaugggugggagacagauggaggguac

SEQ ID NO: 158314 - RNA, 32 nt, Human
gagcauauuuugcucuuaggauggucuuuggg

SEQ ID NO: 158315 - RNA, 21 nt, Human
gagcaucaacaccaacauggc

SEQ ID NO: 158316 - RNA, 32 nt, Human
gagcaucaacagccacauuuuccuggccuuac

SEQ ID NO: 158317 - RNA, 32 nt, Human
gagcaucaacuccaggagaacagggauuucua

SEQ ID NO: 158318 - RNA, 32 nt, Human
gagcaucaagaugacccaccggcacagcccca

SEQ ID NO: 158319 - RNA, 32 nt, Human
gagcaucacaucucacuuuguucggagugguc

SEQ ID NO: 158320 - RNA, 32 nt, Human
gagcaucaccagaacccaggcgcugccccagc

SEQ ID NO: 158321 - RNA, 32 nt, Human
gagcaucacccagauugcugcauggaagccau

SEQ ID NO: 158322 - RNA, 32 nt, Human
gagcaucacuacugaccuguuguaggcagcua

SEQ ID NO: 158323 - RNA, 32 nt, Human
gagcaucagagaggaggcuggguuugacucca

SEQ ID NO: 158324 - RNA, 32 nt, Human
gagcaucagaucaagaaaaaggucugaggcag

SEQ ID NO: 158325 - RNA, 32 nt, Human
gagcaucagcaacccuuuccagguagaaauuc

SEQ ID NO: 158326 - RNA, 31 nt, Human
gagcaucaguuuccucuaaugccaaguggag

SEQ ID NO: 158327 - RNA, 32 nt, Human
gagcaucaugaguaggagggaggcaggagcuu

SEQ ID NO: 158328 - RNA, 32 nt, Human
gagcauccaccaggugggacggggaguguuga

SEQ ID NO: 158329 - RNA, 32 nt, Human
gagcauccaccuccuucucugucucaugugug

SEQ ID NO: 158330 - RNA, 21 nt, Human
gagcauccaggcccaaaggca

SEQ ID NO: 158331 - RNA, 23 nt, Human
gagcauccaucuggugacccugg

SEQ ID NO: 158332 - RNA, 32 nt, Human
gagcauccccagccacaacugccagcucucug

SEQ ID NO: 158333 - RNA, 32 nt, Human
gagcaucccucggggccgaaugcgcaguggac

SEQ ID NO: 158334 - RNA, 19 nt, Human
gagcauccgaccucuugga

SEQ ID NO: 158335 - RNA, 32 nt, Human
gagcauccucacggcauggccucugccuuccc

SEQ ID NO: 158336 - RNA, 32 nt, Human
gagcauccugccugccuucuccacugaggagc

SEQ ID NO: 158337 - RNA, 32 nt, Human
gagcauccuggaggaccuggagagcugggaga

SEQ ID NO: 158338 - RNA, 32 nt, Human
gagcaucuacaaacuccuguggcgagagcugc

SEQ ID NO: 158339 - RNA, 32 nt, Human
gagcaucuaccaugucuaagggucauucgagu

SEQ ID NO: 158340 - RNA, 32 nt, Human
gagcaucucagagugagagaaaaauguagaaa

SEQ ID NO: 158341 - RNA, 32 nt, Human
gagcaucuccucuucuugaaggccaaccugga

SEQ ID NO: 158342 - RNA, 32 nt, Human
gagcaucucucaucucccugaauuccacaucc

SEQ ID NO: 158343 - RNA, 32 nt, Human
gagcaucucugccucccaaagcaucuaccucu

SEQ ID NO: 158344 - RNA, 32 nt, Human
gagcaucucuggagagaaagaggagagccuca

SEQ ID NO: 158345 - RNA, 24 nt, Human
gagcaucucuucaccucuccuccu

SEQ ID NO: 158346 - RNA, 22 nt, Human
gagcaucugaaaggccacagca

SEQ ID NO: 158347 - RNA, 32 nt, Human
gagcaucugccauccaggcauggagagcuagg

SEQ ID NO: 158348 - RNA, 32 nt, Human
gagcaucugucccccuuuagaucucugaagcc

SEQ ID NO: 158349 - RNA, 32 nt, Human
gagcaugacagaaacaaaauguauucaccaag

SEQ ID NO: 158350 - RNA, 32 nt, Human
gagcaugacuccagugcugggcucuugggccc

SEQ ID NO: 158351 - RNA, 32 nt, Human
gagcaugacuuaaaguggaggucuucaguauc

SEQ ID NO: 158352 - RNA, 32 nt, Human
gagcaugaggcuggaugcagugguggugaggc

SEQ ID NO: 158353 - RNA, 32 nt, Human
gagcaugagggacccuuccccucccagggcca

SEQ ID NO: 158354 - RNA, 32 nt, Human
gagcaugagggagagaaaagaaugaggcuuag

SEQ ID NO: 158355 - RNA, 23 nt, Human
gagcaugaucgcgacacugcacu

SEQ ID NO: 158356 - RNA, 32 nt, Human
gagcaugcaaaaagcuuuuuccagcagaacau

SEQ ID NO: 158357 - RNA, 32 nt, Human
gagcaugcagaggaggugagagugggagggag

SEQ ID NO: 158358 - RNA, 32 nt, Human
gagcaugccacuguacuccagccugagcuaca

SEQ ID NO: 158359 - RNA, 32 nt, Human
gagcaugccgcugcacuccagccugggagacu

SEQ ID NO: 158360 - RNA, 32 nt, Human
gagcaugccuaaaagagcacugcaagauuauu

SEQ ID NO: 158361 - RNA, 32 nt, Human
gagcaugccuguagucucagcuacucaggagg

SEQ ID NO: 158362 - RNA, 18 nt, Human
gagcaugcggagccagca

SEQ ID NO: 158363 - RNA, 29 nt, Human
gagcaugcgugcaccauuccagcauccgg

SEQ ID NO: 158364 - RNA, 32 nt, Human
gagcaugcgugcaccauuccagcauccggcaa

SEQ ID NO: 158365 - RNA, 32 nt, Human
gagcaugcugagccaucaugcccaccguggau

SEQ ID NO: 158366 - RNA, 22 nt, Human
gagcaugcuguauucuaccacu

SEQ ID NO: 158367 - RNA, 32 nt, Human
gagcauggagccaggcugcggggucuggguuc

SEQ ID NO: 158368 - RNA, 29 nt, Human
gagcauggaggcgggggcggcugaggcag

SEQ ID NO: 158369 - RNA, 32 nt, Human
gagcauggagucuggagcaggagcagcuguug

SEQ ID NO: 158370 - RNA, 32 nt, Human
gagcauggaucccuccugauuccacucagccc

SEQ ID NO: 158371 - RNA, 32 nt, Human
gagcauggcaggcagagauacagcaagggcaa

SEQ ID NO: 158372 - RNA, 21 nt, Human
gagcauggccagacuauuccc

SEQ ID NO: 158373 - RNA, 32 nt, Human
gagcauggcgugaaccugggaggcagagcuug

SEQ ID NO: 158374 - RNA, 32 nt, Human
gagcaugggacaccuggcugaccacagcaugg

SEQ ID NO: 158375 - RNA, 32 nt, Human
gagcaugggaggcagagguugcagugagccaa

SEQ ID NO: 158376 - RNA, 32 nt, Human
gagcaugggagggaauagaaguuccugggucc

SEQ ID NO: 158377 - RNA, 32 nt, Human
gagcauggggaccacaauuaagccuuuguaac

SEQ ID NO: 158378 - RNA, 32 nt, Human
gagcauggggugggcagugaggucccuguacc

SEQ ID NO: 158379 - RNA, 32 nt, Human
gagcaugggugacagugggagcacacgacuuc

SEQ ID NO: 158380 - RNA, 32 nt, Human
gagcaugguacccuccuugguaaagguaaugg

SEQ ID NO: 158381 - RNA, 32 nt, Human
gagcaugguauucaaguacaagaguggauuaa

SEQ ID NO: 158382 - RNA, 16 nt, Human
gagcauggugagcagc

SEQ ID NO: 158383 - RNA, 32 nt, Human
gagcauggugagcagcccuggugcucagcagc

SEQ ID NO: 158384 - RNA, 32 nt, Human
gagcauguagagguggguccugcaguggucuc

SEQ ID NO: 158385 - RNA, 32 nt, Human
gagcaugucuguaaucccagcuacucgggagg

SEQ ID NO: 158386 - RNA, 18 nt, Human
gagcaugugcuggaucug

SEQ ID NO: 158387 - RNA, 32 nt, Human
gagcauguggagcgagagggaggcagguggac

SEQ ID NO: 158388 - RNA, 23 nt, Human
gagcauguggcucccagaaccca

SEQ ID NO: 158389 - RNA, 32 nt, Human
gagcaugugguacccauguaacaacccaagac

SEQ ID NO: 158390 - RNA, 32 nt, Human
gagcauguugagcuucugguuuggaaacagca

SEQ ID NO: 158391 - RNA, 32 nt, Human
gagcauuaaccccuuugaaaagaaauggacuu

SEQ ID NO: 158392 - RNA, 32 nt, Human
gagcauuaagacguucucccacacagcccuuc

SEQ ID NO: 158393 - RNA, 32 nt, Human
gagcauucagccugugucuucacacaacaaac

SEQ ID NO: 158394 - RNA, 32 nt, Human
gagcauucauucucuccaccaggccuccaggu

SEQ ID NO: 158395 - RNA, 32 nt, Human
gagcauuccaguaucaugcaggguccugugau

SEQ ID NO: 158396 - RNA, 21 nt, Human
gagcauucccauguacccugg

SEQ ID NO: 158397 - RNA, 32 nt, Human
gagcauucugaccucuucuuguuuagagugau

SEQ ID NO: 158398 - RNA, 32 nt, Human
gagcauucuguaauauucuagggucacucccc

SEQ ID NO: 158399 - RNA, 32 nt, Human
gagcauugagaggcagcauggcugcaacugug

SEQ ID NO: 158400 - RNA, 32 nt, Human
gagcauuguggcugucagcaggaagcaacgaa

SEQ ID NO: 158401 - RNA, 32 nt, Human
gagcauuuaagcugcaggugguggcacucggg

SEQ ID NO: 158402 - RNA, 19 nt, Human
gagcauuuaaucuaugcua

SEQ ID NO: 158403 - RNA, 32 nt, Human
gagcauuucuucugugcugggcgcuaugcaag

SEQ ID NO: 158404 - RNA, 32 nt, Human
gagcauuuuccucugcuauaauguccccucaa

SEQ ID NO: 158405 - RNA, 32 nt, Human
gagcauuuugggaacauucuccacccaauggg

SEQ ID NO: 158406 - RNA, 22 nt, Human
gagccaaaaccugccccagaga

SEQ ID NO: 158407 - RNA, 22 nt, Human
gagccaaaauaaccaacaaccu

SEQ ID NO: 158408 - RNA, 24 nt, Human
gagccaaaaucacgccacugcacu

SEQ ID NO: 158409 - RNA, 32 nt, Human
gagccaaaaucaggcuacagcacuccagccug

SEQ ID NO: 158410 - RNA, 24 nt, Human
gagccaaaaucauaacacugcacu

SEQ ID NO: 158411 - RNA, 32 nt, Human
gagccaaaaucauaacacugcacuccaggcug

SEQ ID NO: 158412 - RNA, 23 nt, Human
gagccaaaaucgcaccacugcac

SEQ ID NO: 158413 - RNA, 24 nt, Human
gagccaaaauuacgccacugcacu

SEQ ID NO: 158414 - RNA, 24 nt, Human
gagccaaaauugcaccacugcacu

SEQ ID NO: 158415 - RNA, 32 nt, Human
gagccaaaauugcaccacugcacuccagccug

SEQ ID NO: 158416 - RNA, 32 nt, Human
gagccaaaauugcaccacugcacuccauccug

SEQ ID NO: 158417 - RNA, 32 nt, Human
gagccaaacaggcuggagacguuuaaagaccg

SEQ ID NO: 158418 - RNA, 32 nt, Human
gagccaaacuugccaccaagagcccaacaauc

SEQ ID NO: 158419 - RNA, 19 nt, Human
gagccaaagagaagaggac

SEQ ID NO: 158420 - RNA, 32 nt, Human
gagccaaagagagauuucagcucuguauuugu

SEQ ID NO: 158421 - RNA, 32 nt, Human
gagccaaagaggaauccccucuucucaugcag

SEQ ID NO: 158422 - RNA, 32 nt, Human
gagccaaagguacaccacuacacuccagccug

SEQ ID NO: 158423 - RNA, 32 nt, Human
gagccaaauaugagucauuuguguacaaguau

SEQ ID NO: 158424 - RNA, 32 nt, Human
gagccaaaugucgcuuccugagcaccauacuc

SEQ ID NO: 158425 - RNA, 24 nt, Human
gagccaacaacacuaccucagaga

SEQ ID NO: 158426 - RNA, 32 nt, Human
gagccaacacccuucugauggaaggugggagc

SEQ ID NO: 158427 - RNA, 20 nt, Human
gagccaaccugggcgcauca

SEQ ID NO: 158428 - RNA, 32 nt, Human
gagccaacuaugagaauccagcugccuucuau

SEQ ID NO: 158429 - RNA, 20 nt, Human
gagccaacucugcauucaca

SEQ ID NO: 158430 - RNA, 32 nt, Human
gagccaacugccggaaaggccaugcccuuagg

SEQ ID NO: 158431 - RNA, 25 nt, Human
gagccaacuucaggcugcucagagg

SEQ ID NO: 158432 - RNA, 21 nt, Human
gagccaagaaaguccaguuua

SEQ ID NO: 158433 - RNA, 32 nt, Human
gagccaagaauccuggucuccuugggggaauu

SEQ ID NO: 158434 - RNA, 23 nt, Human
gagccaagacagcaccauugcac

SEQ ID NO: 158435 - RNA, 32 nt, Human
gagccaagacagugccauugcacuccagccug

SEQ ID NO: 158436 - RNA, 24 nt, Human
gagccaagaccacaccacugcacu

SEQ ID NO: 158437 - RNA, 24 nt, Human
gagccaagaccgcaccacugcacu

SEQ ID NO: 158438 - RNA, 32 nt, Human
gagccaagaccgcaccacugcacuccagccug

SEQ ID NO: 158439 - RNA, 24 nt, Human
gagccaagaccgugccacuguacu

SEQ ID NO: 158440 - RNA, 24 nt, Human
gagccaagacuacgccacugcacu

SEQ ID NO: 158441 - RNA, 24 nt, Human
gagccaagacugcaccacugcacu

SEQ ID NO: 158442 - RNA, 32 nt, Human
gagccaagacugcaccacugcacuccagccug

SEQ ID NO: 158443 - RNA, 24 nt, Human
gagccaagacugcgccacugcacu

SEQ ID NO: 158444 - RNA, 24 nt, Human
gagccaagacugugccacugcacu

SEQ ID NO: 158445 - RNA, 32 nt, Human
gagccaagacugugccacugcacuccagccug

SEQ ID NO: 158446 - RNA, 19 nt, Human
gagccaagacuucugagcu

SEQ ID NO: 158447 - RNA, 24 nt, Human
gagccaagacuuguggacagcacu

SEQ ID NO: 158448 - RNA, 24 nt, Human
gagccaagagcgcaccauugcacu

SEQ ID NO: 158449 - RNA, 24 nt, Human
gagccaagagcgugccacugcacu

SEQ ID NO: 158450 - RNA, 18 nt, Human
gagccaagaggcgaaguu

SEQ ID NO: 158451 - RNA, 32 nt, Human
gagccaagagggguggaaaggaagagagcuug

SEQ ID NO: 158452 - RNA, 24 nt, Human
gagccaagaguacaccacugcacu

SEQ ID NO: 158453 - RNA, 32 nt, Human
gagccaagauagcaccacugcacuccagccug

SEQ ID NO: 158454 - RNA, 19 nt, Human
gagccaagauagcucccau

SEQ ID NO: 158455 - RNA, 23 nt, Human
gagccaagauagcucccaugcac

SEQ ID NO: 158456 - RNA, 24 nt, Human
gagccaagauagugccacugcacu

SEQ ID NO: 158457 - RNA, 32 nt, Human
gagccaagauagugccacugcacuccagccug

SEQ ID NO: 158458 - RNA, 32 nt, Human
gagccaagauagugccaucgcacuccagccug

SEQ ID NO: 158459 - RNA, 24 nt, Human
gagccaagaucacaccacugaccu

SEQ ID NO: 158460 - RNA, 24 nt, Human
gagccaagaucacaccacugcacu

SEQ ID NO: 158461 - RNA, 23 nt, Human
gagccaagaucacaccacuguac

SEQ ID NO: 158462 - RNA, 24 nt, Human
gagccaagaucacaccagugcacu

SEQ ID NO: 158463 - RNA, 24 nt, Human
gagccaagaucacaccauugcacu

SEQ ID NO: 158464 - RNA, 24 nt, Human
gagccaagaucacacgacugcauu

SEQ ID NO: 158465 - RNA, 24 nt, Human
gagccaagaucacacuacugcacu

SEQ ID NO: 158466 - RNA, 24 nt, Human
gagccaagaucacagcauugcacu

SEQ ID NO: 158467 - RNA, 28 nt, Human
gagccaagaucacaggagccacugcacu

SEQ ID NO: 158468 - RNA, 24 nt, Human
gagccaagaucacgacacugcacu

SEQ ID NO: 158469 - RNA, 24 nt, Human
gagccaagaucacgccacugaacu

SEQ ID NO: 158470 - RNA, 24 nt, Human
gagccaagaucacgccacugcacu

SEQ ID NO: 158471 - RNA, 24 nt, Human
gagccaagaucacgccacuguacu

SEQ ID NO: 158472 - RNA, 24 nt, Human
gagccaagaucacgccauugcacu

SEQ ID NO: 158473 - RNA, 24 nt, Human
gagccaagaucacgccauuguacu

SEQ ID NO: 158474 - RNA, 24 nt, Human
gagccaagaucacgccucugcacu

SEQ ID NO: 158475 - RNA, 24 nt, Human
gagccaagaucacuccacugcacu

SEQ ID NO: 158476 - RNA, 23 nt, Human
gagccaagaucacugacagcaga

SEQ ID NO: 158477 - RNA, 24 nt, Human
gagccaagaucagaccacugcccu

SEQ ID NO: 158478 - RNA, 24 nt, Human
gagccaagaucaggccacugcacu

SEQ ID NO: 158479 - RNA, 24 nt, Human
gagccaagaucauaccacggcacu

SEQ ID NO: 158480 - RNA, 24 nt, Human
gagccaagaucauaccacugcacu

SEQ ID NO: 158481 - RNA, 24 nt, Human
gagccaagaucauaccauugcacu

SEQ ID NO: 158482 - RNA, 24 nt, Human
gagccaagaucauacuacugcacu

SEQ ID NO: 158483 - RNA, 24 nt, Human
gagccaagaucaugccacuccacu

SEQ ID NO: 158484 - RNA, 24 nt, Human
gagccaagaucaugccacugcacu

SEQ ID NO: 158485 - RNA, 32 nt, Human
gagccaagaucaugccauugcacagcagccug

SEQ ID NO: 158486 - RNA, 24 nt, Human
gagccaagaucaugccauugcacu

SEQ ID NO: 158487 - RNA, 24 nt, Human
gagccaagaucaugccgcugcacu

SEQ ID NO: 158488 - RNA, 24 nt, Human
gagccaagaucaugcuacugcacu

SEQ ID NO: 158489 - RNA, 24 nt, Human
gagccaagaucauuucaccucacu

SEQ ID NO: 158490 - RNA, 24 nt, Human
gagccaagaucccgccacugcacu

SEQ ID NO: 158491 - RNA, 24 nt, Human
gagccaagauccugccacugcacu

SEQ ID NO: 158492 - RNA, 24 nt, Human
gagccaagaucgagccauugcacu

SEQ ID NO: 158493 - RNA, 24 nt, Human
gagccaagaucgcaacauugcacu

SEQ ID NO: 158494 - RNA, 24 nt, Human
gagccaagaucgcaccacugaacu

SEQ ID NO: 158495 - RNA, 24 nt, Human
gagccaagaucgcaccacugcacu

SEQ ID NO: 158496 - RNA, 24 nt, Human
gagccaagaucgcaccacugcucu

SEQ ID NO: 158497 - RNA, 24 nt, Human
gagccaagaucgcaccauuacacu

SEQ ID NO: 158498 - RNA, 24 nt, Human
gagccaagaucgcaccauugcacu

SEQ ID NO: 158499 - RNA, 24 nt, Human
gagccaagaucgcaccauuguacu

SEQ ID NO: 158500 - RNA, 24 nt, Human
gagccaagaucgcacccuuacacu

SEQ ID NO: 158501 - RNA, 24 nt, Human
gagccaagaucgcaucacugcauu

SEQ ID NO: 158502 - RNA, 23 nt, Human
gagccaagaucgcccacugcacu

SEQ ID NO: 158503 - RNA, 24 nt, Human
gagccaagaucgcgccacuacacu

SEQ ID NO: 158504 - RNA, 22 nt, Human
gagccaagaucgcgccacugca

SEQ ID NO: 158505 - RNA, 23 nt, Human
gagccaagaucgcgccacugcac

SEQ ID NO: 158506 - RNA, 24 nt, Human
gagccaagaucgcgccacugcacu

SEQ ID NO: 158507 - RNA, 24 nt, Human
gagccaagaucgcgccacuguacu

SEQ ID NO: 158508 - RNA, 24 nt, Human
gagccaagaucgcgccaucgcacu

SEQ ID NO: 158509 - RNA, 24 nt, Human
gagccaagaucgcgccauucuacu

SEQ ID NO: 158510 - RNA, 24 nt, Human
gagccaagaucgcgccauugcacu

SEQ ID NO: 158511 - RNA, 24 nt, Human
gagccaagaucgcgccccugcacu

SEQ ID NO: 158512 - RNA, 24 nt, Human
gagccaagaucgcgcuacugcacu

SEQ ID NO: 158513 - RNA, 24 nt, Human
gagccaagaucgcgcuauugcacu

SEQ ID NO: 158514 - RNA, 24 nt, Human
gagccaagaucgcggcauugcacu

SEQ ID NO: 158515 - RNA, 24 nt, Human
gagccaagaucgcuccauugcacu

SEQ ID NO: 158516 - RNA, 24 nt, Human
gagccaagaucguaccacugcacu

SEQ ID NO: 158517 - RNA, 32 nt, Human
gagccaagaucguaccacugcacuccagccug

SEQ ID NO: 158518 - RNA, 32 nt, Human
gagccaagaucguaccacugcacuccagucug

SEQ ID NO: 158519 - RNA, 24 nt, Human
gagccaagaucgugacacugcacu

SEQ ID NO: 158520 - RNA, 32 nt, Human
gagccaagaucgugacacugcacuccagccug

SEQ ID NO: 158521 - RNA, 24 nt, Human
gagccaagaucgugcaacugcacu

SEQ ID NO: 158522 - RNA, 32 nt, Human
gagccaagaucgugcaacugcacuccagccug

SEQ ID NO: 158523 - RNA, 24 nt, Human
gagccaagaucgugccaaugcacu

SEQ ID NO: 158524 - RNA, 23 nt, Human
gagccaagaucgugccacgcacu

SEQ ID NO: 158525 - RNA, 23 nt, Human
gagccaagaucgugccacugcac

SEQ ID NO: 158526 - RNA, 24 nt, Human
gagccaagaucgugccacugcacu

SEQ ID NO: 158527 - RNA, 24 nt, Human
gagccaagaucgugccacugcauu

SEQ ID NO: 158528 - RNA, 24 nt, Human
gagccaagaucgugccagugcacu

SEQ ID NO: 158529 - RNA, 24 nt, Human
gagccaagaucgugccauugcacu

SEQ ID NO: 158530 - RNA, 24 nt, Human
gagccaagaucgugucacugcacu

SEQ ID NO: 158531 - RNA, 24 nt, Human
gagccaagaucucgccacugcacu

SEQ ID NO: 158532 - RNA, 24 nt, Human
gagccaagaucuugccacuguacu

SEQ ID NO: 158533 - RNA, 24 nt, Human
gagccaagaugacacaacugcacu

SEQ ID NO: 158534 - RNA, 24 nt, Human
gagccaagaugacaccauugcacu

SEQ ID NO: 158535 - RNA, 24 nt, Human
gagccaagaugaugccauugcacu

SEQ ID NO: 158536 - RNA, 19 nt, Human
gagccaagaugcucagcuu

SEQ ID NO: 158537 - RNA, 24 nt, Human
gagccaagauggcaccacuacauu

SEQ ID NO: 158538 - RNA, 24 nt, Human
gagccaagauggcaccacugcacu

SEQ ID NO: 158539 - RNA, 23 nt, Human
gagccaagauggcaccauugcac

SEQ ID NO: 158540 - RNA, 24 nt, Human
gagccaagauggcgccacuacacu

SEQ ID NO: 158541 - RNA, 32 nt, Human
gagccaagauggcgccacuacacuccagccug

SEQ ID NO: 158542 - RNA, 24 nt, Human
gagccaagauggcgccacugcacu

SEQ ID NO: 158543 - RNA, 24 nt, Human
gagccaagauggcgccacugcauu

SEQ ID NO: 158544 - RNA, 24 nt, Human
gagccaagauggcgccauugcacu

SEQ ID NO: 158545 - RNA, 24 nt, Human
gagccaagauuaugccacugcacu

SEQ ID NO: 158546 - RNA, 24 nt, Human
gagccaagauuaugccauugcacu

SEQ ID NO: 158547 - RNA, 24 nt, Human
gagccaagauuaugucacugcacu

SEQ ID NO: 158548 - RNA, 23 nt, Human
gagccaagauugcacacugcacu

SEQ ID NO: 158549 - RNA, 24 nt, Human
gagccaagauugcaccaccacacu

SEQ ID NO: 158550 - RNA, 32 nt, Human
gagccaagauugcaccaccacacuccagccug

SEQ ID NO: 158551 - RNA, 23 nt, Human
gagccaagauugcaccacggcac

SEQ ID NO: 158552 - RNA, 24 nt, Human
gagccaagauugcaccacugcacu

SEQ ID NO: 158553 - RNA, 24 nt, Human
gagccaagauugcaccacugcauu

SEQ ID NO: 158554 - RNA, 24 nt, Human
gagccaagauugcaccacugcucu

SEQ ID NO: 158555 - RNA, 24 nt, Human
gagccaagauugcaccacuguacu

SEQ ID NO: 158556 - RNA, 24 nt, Human
gagccaagauugcaccagugcacu

SEQ ID NO: 158557 - RNA, 24 nt, Human
gagccaagauugcaccauugaacu

SEQ ID NO: 158558 - RNA, 24 nt, Human
gagccaagauugcaccauugcacu

SEQ ID NO: 158559 - RNA, 24 nt, Human
gagccaagauugcaucacugcacu

SEQ ID NO: 158560 - RNA, 24 nt, Human
gagccaagauugcaucacugcauu

SEQ ID NO: 158561 - RNA, 24 nt, Human
gagccaagauugcgacacugcacu

SEQ ID NO: 158562 - RNA, 24 nt, Human
gagccaagauugcgccacugcacu

SEQ ID NO: 158563 - RNA, 24 nt, Human
gagccaagauugcgccacuguacu

SEQ ID NO: 158564 - RNA, 24 nt, Human
gagccaagauugcgccauugcacu

SEQ ID NO: 158565 - RNA, 24 nt, Human
gagccaagauugcgccauugcauu

SEQ ID NO: 158566 - RNA, 24 nt, Human
gagccaagauugcgccccugcacu

SEQ ID NO: 158567 - RNA, 24 nt, Human
gagccaagauugcgccgcuacauu

SEQ ID NO: 158568 - RNA, 24 nt, Human
gagccaagauugcgccguuguacu

SEQ ID NO: 158569 - RNA, 24 nt, Human
gagccaagauugcgucacugcacu

SEQ ID NO: 158570 - RNA, 22 nt, Human
gagccaagauuguaaccagaga

SEQ ID NO: 158571 - RNA, 24 nt, Human
gagccaagauuguaccacugcacu

SEQ ID NO: 158572 - RNA, 32 nt, Human
gagccaagauuguaccacugcacuccaaccug

SEQ ID NO: 158573 - RNA, 32 nt, Human
gagccaagauuguaccacugcacuccaguuug

SEQ ID NO: 158574 - RNA, 32 nt, Human
gagccaagauugugacacugcacuccagccug

SEQ ID NO: 158575 - RNA, 24 nt, Human
gagccaagauugugccaccacacu

SEQ ID NO: 158576 - RNA, 24 nt, Human
gagccaagauugugccacggcacu

SEQ ID NO: 158577 - RNA, 22 nt, Human
gagccaagauugugccacuacu

SEQ ID NO: 158578 - RNA, 24 nt, Human
gagccaagauugugccacugcacu

SEQ ID NO: 158579 - RNA, 32 nt, Human
gagccaagauugugccacugcacuccagccug

SEQ ID NO: 158580 - RNA, 32 nt, Human
gagccaagauugugccacugcacuccagcgug

SEQ ID NO: 158581 - RNA, 23 nt, Human
gagccaagauugugccacugccu

SEQ ID NO: 158582 - RNA, 24 nt, Human
gagccaagauugugccauugcacu

SEQ ID NO: 158583 - RNA, 24 nt, Human
gagccaagauuuugccacugcacu

SEQ ID NO: 158584 - RNA, 32 nt, Human
gagccaagcagcauccugguucuuggacagca

SEQ ID NO: 158585 - RNA, 22 nt, Human
gagccaagcaucuucccuggga

SEQ ID NO: 158586 - RNA, 21 nt, Human
gagccaagcggcggcagagcg

SEQ ID NO: 158587 - RNA, 21 nt, Human
gagccaagcuccuccaaccac

SEQ ID NO: 158588 - RNA, 19 nt, Human
gagccaaggaagcuuccac

SEQ ID NO: 158589 - RNA, 32 nt, Human
gagccaaggaauucuguggcugugcugcguuu

SEQ ID NO: 158590 - RNA, 32 nt, Human
gagccaaggaguucaagaccagccugggcaac

SEQ ID NO: 158591 - RNA, 24 nt, Human
gagccaaggcagcaaggcaaggag

SEQ ID NO: 158592 - RNA, 32 nt, Human
gagccaagggaugucagggcagcucugugcau

SEQ ID NO: 158593 - RNA, 19 nt, Human
gagccaagggccucacuua

SEQ ID NO: 158594 - RNA, 24 nt, Human
gagccaaggucacaccauugcacu

SEQ ID NO: 158595 - RNA, 24 nt, Human
gagccaaggucacgucacugcacu

SEQ ID NO: 158596 - RNA, 24 nt, Human
gagccaaggucaugccacugcacu

SEQ ID NO: 158597 - RNA, 24 nt, Human
gagccaaggucgcgacacugcacu

SEQ ID NO: 158598 - RNA, 24 nt, Human
gagccaaggucgcgccacugcgcu

SEQ ID NO: 158599 - RNA, 24 nt, Human
gagccaaggucgugccacugcacu

SEQ ID NO: 158600 - RNA, 21 nt, Human
gagccaagguggugucagagg

SEQ ID NO: 158601 - RNA, 32 nt, Human
gagccaagguugaagagucaccucuucccauu

SEQ ID NO: 158602 - RNA, 24 nt, Human
gagccaagguugcgccacugcacu

SEQ ID NO: 158603 - RNA, 27 nt, Human
gagccaagucccuuccauuccuuucca

SEQ ID NO: 158604 - RNA, 17 nt, Human
gagccaagucuguggca

SEQ ID NO: 158605 - RNA, 32 nt, Human
gagccaagugagugaguuugcagaaagcaggu

SEQ ID NO: 158606 - RNA, 24 nt, Human
gagccaaguuugcgccacugcacu

SEQ ID NO: 158607 - RNA, 24 nt, Human
gagccaauaucaugccacugcacu

SEQ ID NO: 158608 - RNA, 24 nt, Human
gagccaauauugcaccauugcacu

SEQ ID NO: 158609 - RNA, 32 nt, Human
gagccaaugaguuggaggcugcagugagcuau

SEQ ID NO: 158610 - RNA, 32 nt, Human
gagccacacagcaggaggugggaccauccagu

SEQ ID NO: 158611 - RNA, 32 nt, Human
gagccacacagcagucacacaacucagaguua

SEQ ID NO: 158612 - RNA, 32 nt, Human
gagccacacagggugaacgggcagcagccggc

SEQ ID NO: 158613 - RNA, 20 nt, Human
gagccacacaugggcaucua

SEQ ID NO: 158614 - RNA, 32 nt, Human
gagccacacucaccuugucaggagacucuucu

SEQ ID NO: 158615 - RNA, 32 nt, Human
gagccacacugaggagaagcacucugaauuca

SEQ ID NO: 158616 - RNA, 32 nt, Human
gagccacacugcauuccagcuggguaacagag

SEQ ID NO: 158617 - RNA, 32 nt, Human
gagccacagcacaggccgugcuggcacuuucu

SEQ ID NO: 158618 - RNA, 32 nt, Human
gagccacagccagcaguaguccucauucaaca

SEQ ID NO: 158619 - RNA, 32 nt, Human
gagccacagcgcccggcccucuugcuuuaacu

SEQ ID NO: 158620 - RNA, 32 nt, Human
gagccacaggaaagggccagaagccagagaaa

SEQ ID NO: 158621 - RNA, 32 nt, Human
gagccacaggcaggggugagagcacccacuga

SEQ ID NO: 158622 - RNA, 32 nt, Human
gagccacagguucucauuccuuuucccauuau

SEQ ID NO: 158623 - RNA, 24 nt, Human
gagccacagucacgccacugcauu

SEQ ID NO: 158624 - RNA, 32 nt, Human
gagccacagucacucuggaacugguccucuga

SEQ ID NO: 158625 - RNA, 21 nt, Human
gagccacagugccuggccuga

SEQ ID NO: 158626 - RNA, 32 nt, Human
gagccacaucacaguauuaccuuuuugaagaa

SEQ ID NO: 158627 - RNA, 32 nt, Human
gagccacaucccucuuacagcuagugaaugag

SEQ ID NO: 158628 - RNA, 15 nt, Human
gagccacaugccuga

SEQ ID NO: 158629 - RNA, 32 nt, Human
gagccacaugcugcugcccugaucucaguggg

SEQ ID NO: 158630 - RNA, 20 nt, Human
gagccacaugcuucucucca

SEQ ID NO: 158631 - RNA, 32 nt, Human
gagccacauuuacaauaccucaggcuaauuac

SEQ ID NO: 158632 - RNA, 21 nt, Human
gagccaccaaacccggccuga

SEQ ID NO: 158633 - RNA, 24 nt, Human
gagccaccaagcaggacagagcag

SEQ ID NO: 158634 - RNA, 21 nt, Human
gagccaccacaacuggccuga

SEQ ID NO: 158635 - RNA, 32 nt, Human
gagccaccacaccaggcccgagaaaugcuuuu

SEQ ID NO: 158636 - RNA, 32 nt, Human
gagccaccacacccagccagugaacucuucuu

SEQ ID NO: 158637 - RNA, 21 nt, Human
gagccaccacacccagccuaa

SEQ ID NO: 158638 - RNA, 32 nt, Human
gagccaccacacccggcacuauauaaguauuu

SEQ ID NO: 158639 - RNA, 32 nt, Human
gagccaccacacccggcccugauaaaacucau

SEQ ID NO: 158640 - RNA, 32 nt, Human
gagccaccacacccggccguggaaugguuuuc

SEQ ID NO: 158641 - RNA, 20 nt, Human
gagccaccacacccggccua

SEQ ID NO: 158642 - RNA, 21 nt, Human
gagccaccacacccggccuga

SEQ ID NO: 158643 - RNA, 32 nt, Human
gagccaccacacccggccugaguagagucuuu

SEQ ID NO: 158644 - RNA, 21 nt, Human
gagccaccacaccuggccuaa

SEQ ID NO: 158645 - RNA, 20 nt, Human
gagccaccacaccuggccug

SEQ ID NO: 158646 - RNA, 21 nt, Human
gagccaccacacguggccuaa

SEQ ID NO: 158647 - RNA, 18 nt, Human
gagccaccacacuuggcc

SEQ ID NO: 158648 - RNA, 20 nt, Human
gagccaccacacuuggccua

SEQ ID NO: 158649 - RNA, 21 nt, Human
gagccaccacauccagccuaa

SEQ ID NO: 158650 - RNA, 21 nt, Human
gagccaccacauccggucuaa

SEQ ID NO: 158651 - RNA, 20 nt, Human
gagccaccacaucuggccua

SEQ ID NO: 158652 - RNA, 21 nt, Human
gagccaccacaucuggccuag

SEQ ID NO: 158653 - RNA, 32 nt, Human
gagccaccaccagccaccucucaggagaagcc

SEQ ID NO: 158654 - RNA, 32 nt, Human
gagccaccacccagcaucccaggcugguggca

SEQ ID NO: 158655 - RNA, 21 nt, Human
gagccaccacgccaagccuga

SEQ ID NO: 158656 - RNA, 32 nt, Human
gagccaccacgccaagccugacuuuaagauuu

SEQ ID NO: 158657 - RNA, 20 nt, Human
gagccaccacgcccagccua

SEQ ID NO: 158658 - RNA, 21 nt, Human
gagccaccacgcccagccuag

SEQ ID NO: 158659 - RNA, 20 nt, Human
gagccaccacgcccagccug

SEQ ID NO: 158660 - RNA, 21 nt, Human
gagccaccacgccccgccuaa

SEQ ID NO: 158661 - RNA, 21 nt, Human
gagccaccacgcccgaccuga

SEQ ID NO: 158662 - RNA, 19 nt, Human
gagccaccacgcccggccu

SEQ ID NO: 158663 - RNA, 20 nt, Human
gagccaccacgcccggccug

SEQ ID NO: 158664 - RNA, 18 nt, Human
gagccaccacgccuggcc

SEQ ID NO: 158665 - RNA, 32 nt, Human
gagccaccacgccuggccaaggcggcacucuu

SEQ ID NO: 158666 - RNA, 19 nt, Human
gagccaccacgccuggccu

SEQ ID NO: 158667 - RNA, 21 nt, Human
gagccaccacgccuggccuaa

SEQ ID NO: 158668 - RNA, 18 nt, Human
gagccaccacgccuggcu

SEQ ID NO: 158669 - RNA, 20 nt, Human
gagccaccacgccuggucua

SEQ ID NO: 158670 - RNA, 18 nt, Human
gagccaccacgcuuggcc

SEQ ID NO: 158671 - RNA, 19 nt, Human
gagccaccacgcuuggucu

SEQ ID NO: 158672 - RNA, 21 nt, Human
gagccaccacucccagccuga

SEQ ID NO: 158673 - RNA, 18 nt, Human
gagccaccacucuuggcc

SEQ ID NO: 158674 - RNA, 17 nt, Human
gagccaccagccaggcc

SEQ ID NO: 158675 - RNA, 20 nt, Human
gagccaccaggcccagccua

SEQ ID NO: 158676 - RNA, 17 nt, Human
gagccaccaggccggcc

SEQ ID NO: 158677 - RNA, 19 nt, Human
gagccaccagggcugcagg

SEQ ID NO: 158678 - RNA, 18 nt, Human
gagccaccauaccuggcc

SEQ ID NO: 158679 - RNA, 24 nt, Human
gagccaccaucguaccacugcacu

SEQ ID NO: 158680 - RNA, 15 nt, Human
gagccaccaucugcc

SEQ ID NO: 158681 - RNA, 17 nt, Human
gagccaccaugauggcc

SEQ ID NO: 158682 - RNA, 18 nt, Human
gagccaccaugccaggcu

SEQ ID NO: 158683 - RNA, 20 nt, Human
gagccaccaugcccaacuaa

SEQ ID NO: 158684 - RNA, 18 nt, Human
gagccaccaugcccagcc

SEQ ID NO: 158685 - RNA, 19 nt, Human
gagccaccaugcccagccu

SEQ ID NO: 158686 - RNA, 20 nt, Human
gagccaccaugcccagccua

SEQ ID NO: 158687 - RNA, 21 nt, Human
gagccaccaugcccagccuaa

SEQ ID NO: 158688 - RNA, 32 nt, Human
gagccaccaugcccagccucuucaagcuuuuu

SEQ ID NO: 158689 - RNA, 20 nt, Human
gagccaccaugcccagccug

SEQ ID NO: 158690 - RNA, 18 nt, Human
gagccaccaugccccgcc

SEQ ID NO: 158691 - RNA, 18 nt, Human
gagccaccaugcccggcc

SEQ ID NO: 158692 - RNA, 19 nt, Human
gagccaccaugcccggccu

SEQ ID NO: 158693 - RNA, 21 nt, Human
gagccaccaugcccggccuaa

SEQ ID NO: 158694 - RNA, 18 nt, Human
gagccaccaugcccggcu

SEQ ID NO: 158695 - RNA, 18 nt, Human
gagccaccaugccuagcc

SEQ ID NO: 158696 - RNA, 18 nt, Human
gagccaccaugccugacc

SEQ ID NO: 158697 - RNA, 18 nt, Human
gagccaccaugccugccc

SEQ ID NO: 158698 - RNA, 18 nt, Human
gagccaccaugccuggcc

SEQ ID NO: 158699 - RNA, 32 nt, Human
gagccaccaugccuggccaggacauauuugaa

SEQ ID NO: 158700 - RNA, 19 nt, Human
gagccaccaugccuggccu

SEQ ID NO: 158701 - RNA, 20 nt, Human
gagccaccaugccuggccua

SEQ ID NO: 158702 - RNA, 32 nt, Human
gagccaccaugccuggccucugugguuuuaau

SEQ ID NO: 158703 - RNA, 20 nt, Human
gagccaccaugccuggccug

SEQ ID NO: 158704 - RNA, 18 nt, Human
gagccaccaugccuggcu

SEQ ID NO: 158705 - RNA, 18 nt, Human
gagccaccaugcucagcc

SEQ ID NO: 158706 - RNA, 21 nt, Human
gagccaccaugcucggccuaa

SEQ ID NO: 158707 - RNA, 18 nt, Human
gagccaccaugcuugccu

SEQ ID NO: 158708 - RNA, 20 nt, Human
gagccaccaugcuugccuga

SEQ ID NO: 158709 - RNA, 32 nt, Human
gagccacccagccuggaagccccugcacgggc

SEQ ID NO: 158710 - RNA, 32 nt, Human
gagccacccggcccuuccuuccucauuguugu

SEQ ID NO: 158711 - RNA, 21 nt, Human
gagccaccgaggcuggccuga

SEQ ID NO: 158712 - RNA, 21 nt, Human
gagccaccgcacccagccuga

SEQ ID NO: 158713 - RNA, 21 nt, Human
gagccaccgcacccggccuga

SEQ ID NO: 158714 - RNA, 19 nt, Human
gagccaccgcaccuggccu

SEQ ID NO: 158715 - RNA, 21 nt, Human
gagccaccgcaccuggccuaa

SEQ ID NO: 158716 - RNA, 21 nt, Human
gagccaccgcaccuggccuga

SEQ ID NO: 158717 - RNA, 20 nt, Human
gagccaccgcacuggccuaa

SEQ ID NO: 158718 - RNA, 32 nt, Human
gagccaccgcccccagccuggccuggcauuuc

SEQ ID NO: 158719 - RNA, 22 nt, Human
gagccaccgccccugacaugag

SEQ ID NO: 158720 - RNA, 22 nt, Human
gagccaccgcgcccagccaaga

SEQ ID NO: 158721 - RNA, 20 nt, Human
gagccaccgcgcccagccua

SEQ ID NO: 158722 - RNA, 21 nt, Human
gagccaccgcgcccagccuaa

SEQ ID NO: 158723 - RNA, 21 nt, Human
gagccaccgcgccccaccuaa

SEQ ID NO: 158724 - RNA, 19 nt, Human
gagccaccgcgcccggccu

SEQ ID NO: 158725 - RNA, 20 nt, Human
gagccaccgcgcccggccua

SEQ ID NO: 158726 - RNA, 21 nt, Human
gagccaccgcgcccggccuag

SEQ ID NO: 158727 - RNA, 32 nt, Human
gagccaccgcgcccggccucagcagguuuuuc

SEQ ID NO: 158728 - RNA, 21 nt, Human
gagccaccgcgcccggccuga

SEQ ID NO: 158729 - RNA, 32 nt, Human
gagccaccgcgcccggccugagugagucuuaa

SEQ ID NO: 158730 - RNA, 18 nt, Human
gagccaccgcgccuggcc

SEQ ID NO: 158731 - RNA, 32 nt, Human
gagccaccgcgccuggccgaugugguucauau

SEQ ID NO: 158732 - RNA, 19 nt, Human
gagccaccgcgccuggccu

SEQ ID NO: 158733 - RNA, 20 nt, Human
gagccaccgcgccuggccua

SEQ ID NO: 158734 - RNA, 21 nt, Human
gagccaccgcgccuggccuaa

SEQ ID NO: 158735 - RNA, 21 nt, Human
gagccaccgcgccuggccuag

SEQ ID NO: 158736 - RNA, 20 nt, Human
gagccaccguacccggccua

SEQ ID NO: 158737 - RNA, 32 nt, Human
gagccaccgugccaggccaacagaguguguuc

SEQ ID NO: 158738 - RNA, 21 nt, Human
gagccaccgugcccaacccua

SEQ ID NO: 158739 - RNA, 19 nt, Human
gagccaccgugcccagccu

SEQ ID NO: 158740 - RNA, 20 nt, Human
gagccaccgugcccagccua

SEQ ID NO: 158741 - RNA, 21 nt, Human
gagccaccgugcccagccuaa

SEQ ID NO: 158742 - RNA, 18 nt, Human
gagccaccgugcccggcc

SEQ ID NO: 158743 - RNA, 20 nt, Human
gagccaccgugcccggccua

SEQ ID NO: 158744 - RNA, 32 nt, Human
gagccaccgugcccggccugugcuuaaauauu

SEQ ID NO: 158745 - RNA, 18 nt, Human
gagccaccgugccuggcc

SEQ ID NO: 158746 - RNA, 32 nt, Human
gagccaccgugccuggccaggccccuucucuu

SEQ ID NO: 158747 - RNA, 32 nt, Human
gagccaccgugccuggccgaggcuccuucuuu

SEQ ID NO: 158748 - RNA, 32 nt, Human
gaggaagccagagacagaaauaggcuaagccu

SEQ ID NO: 158749 - RNA, 32 nt, Human
gaggaagcccaagcuaaccacaugggcaaaaa

SEQ ID NO: 158750 - RNA, 21 nt, Human
gaggaagcccccucuccuucu

SEQ ID NO: 158751 - RNA, 24 nt, Human
gaggaagccccgagcccucggcgg

SEQ ID NO: 158752 - RNA, 32 nt, Human
gaggaagccucagacuuagcacugugaacugg

SEQ ID NO: 158753 - RNA, 32 nt, Human
gaggaagccuggggaguggggugcaggaaaag

SEQ ID NO: 158754 - RNA, 19 nt, Human
gaggaagccugguggcucu

SEQ ID NO: 158755 - RNA, 19 nt, Human
gaggaagcggcggcggcgg

SEQ ID NO: 158756 - RNA, 19 nt, Human
gaggaagcgucagugcccu

SEQ ID NO: 158757 - RNA, 19 nt, Human
gaggaagcuaagugcugcu

SEQ ID NO: 158758 - RNA, 18 nt, Human
gaggaagcucagaucucu

SEQ ID NO: 158759 - RNA, 22 nt, Human
gaggaagcucugcucaggccuc

SEQ ID NO: 158760 - RNA, 32 nt, Human
gaggaagcugcuaaagcacacaaaauguccac

SEQ ID NO: 158761 - RNA, 32 nt, Human
gaggaagcuguucuccccaccccaggugccuu

SEQ ID NO: 158762 - RNA, 21 nt, Human
gaggaagcuuuagauagagac

SEQ ID NO: 158763 - RNA, 21 nt, Human
gaggaaggaauaagcagacag

SEQ ID NO: 158764 - RNA, 32 nt, Human
gaggaaggaauagcacaggucucuccaaagug

SEQ ID NO: 158765 - RNA, 32 nt, Human
gaggaaggacugguaugcccagcuggagggaa

SEQ ID NO: 158766 - RNA, 32 nt, Human
gaggaaggagaaaacugcaucauaacuuuaca

SEQ ID NO: 158767 - RNA, 32 nt, Human
gaggaaggagagaacagugucuuggggaugcu

SEQ ID NO: 158768 - RNA, 19 nt, Human
gaggaaggagaggagaggg

SEQ ID NO: 158769 - RNA, 32 nt, Human
gaggaaggagcaggaggagggaagagaaugaa

SEQ ID NO: 158770 - RNA, 21 nt, Human
gaggaaggagcggcgggcagg

SEQ ID NO: 158771 - RNA, 32 nt, Human
gaggaaggaggaacuguggcgcccagcgcucc

SEQ ID NO: 158772 - RNA, 24 nt, Human
gaggaaggaggaggaaugagaggg

SEQ ID NO: 158773 - RNA, 32 nt, Human
gaggaaggaggcaggcuguggugggacugggu

SEQ ID NO: 158774 - RNA, 19 nt, Human
gaggaaggaggccagcagg

SEQ ID NO: 158775 - RNA, 23 nt, Human
gaggaaggaggcccagcuguggg

SEQ ID NO: 158776 - RNA, 32 nt, Human
gaggaaggaggcggaggucugaguuucgaggg

SEQ ID NO: 158777 - RNA, 21 nt, Human
gaggaaggagggcaggggcgg

SEQ ID NO: 158778 - RNA, 17 nt, Human
gaggaaggagguggagc

SEQ ID NO: 158779 - RNA, 32 nt, Human
gaggaaggaucccuucuccuucuguugacucu

SEQ ID NO: 158780 - RNA, 32 nt, Human
gaggaaggcaccuugcugaaugacuagaaugg

SEQ ID NO: 158781 - RNA, 32 nt, Human
gaggaaggcagagugugacagagcagagccag

SEQ ID NO: 158782 - RNA, 32 nt, Human
gaggaaggccagaggaacagcuuugugcuccg

SEQ ID NO: 158783 - RNA, 32 nt, Human
gaggaaggccgggagaaggggagccaggaccu

SEQ ID NO: 158784 - RNA, 20 nt, Human
gaggaaggcggaggagcggg

SEQ ID NO: 158785 - RNA, 32 nt, Human
gaggaaggcgggcuaaugcagagcagaugggc

SEQ ID NO: 158786 - RNA, 19 nt, Human
gaggaaggcucuugagaug

SEQ ID NO: 158787 - RNA, 32 nt, Human
gaggaaggcucuugagaugguggagaagugcc

SEQ ID NO: 158788 - RNA, 32 nt, Human
gaggaaggcugaggccaagaccccggaagaga

SEQ ID NO: 158789 - RNA, 32 nt, Human
gaggaaggcugccuggaggaaguggccacuuu

SEQ ID NO: 158790 - RNA, 32 nt, Human
gaggaagggaaagacccagagggacgccuaga

SEQ ID NO: 158791 - RNA, 32 nt, Human
gaggaagggaaagagaugugagggaagcauuu

SEQ ID NO: 158792 - RNA, 32 nt, Human
gaggaagggaccggccucccacguccacaggg

SEQ ID NO: 158793 - RNA, 19 nt, Human
gaggaagggagaaggcaga

SEQ ID NO: 158794 - RNA, 32 nt, Human
gaggaagggagggaugaggagguggagugcag

SEQ ID NO: 158795 - RNA, 32 nt, Human
gaggaagggagggcagagggggcuguggccgu

SEQ ID NO: 158796 - RNA, 31 nt, Human
gaggaagggcauguuguaaugccaagcugau

SEQ ID NO: 158797 - RNA, 32 nt, Human
gaggaagggcuggggagaagagcgaggcugua

SEQ ID NO: 158798 - RNA, 32 nt, Human
gaggaaggggaccaagccagagagggacaggu

SEQ ID NO: 158799 - RNA, 32 nt, Human
gaggaagggggugcccugccacccugagaaca

SEQ ID NO: 158800 - RNA, 32 nt, Human
gaggaagggguguggagguccagggagagggu

SEQ ID NO: 158801 - RNA, 23 nt, Human
gaggaagguacugcccauuggga

SEQ ID NO: 158802 - RNA, 32 nt, Human
gaggaaggucugcagggagcagcuggccauuu

SEQ ID NO: 158803 - RNA, 32 nt, Human
gaggaagguggccauggauggaugggcuguau

SEQ ID NO: 158804 - RNA, 31 nt, Human
gaggaagguggggguuucaaagacuggggga

SEQ ID NO: 158805 - RNA, 31 nt, Human
gaggaaguacuuagggagguuggugucagag

SEQ ID NO: 158806 - RNA, 23 nt, Human
gaggaaguagaagggcaaagaca

SEQ ID NO: 158807 - RNA, 32 nt, Human
gaggaaguagauucagagguaaggagaauuuu

SEQ ID NO: 158808 - RNA, 22 nt, Human
gaggaaguccagagacagagca

SEQ ID NO: 158809 - RNA, 32 nt, Human
gaggaagugaacacuggagugaagaagcgguc

SEQ ID NO: 158810 - RNA, 24 nt, Human
gaggaagugaagaaaucaagagca

SEQ ID NO: 158811 - RNA, 32 nt, Human
gaggaagugagaaaguuggcacagucacgccg

SEQ ID NO: 158812 - RNA, 32 nt, Human
gaggaagugagcucuccuggggcgugguuguu

SEQ ID NO: 158813 - RNA, 22 nt, Human
gaggaagugaggauaaagagca

SEQ ID NO: 158814 - RNA, 21 nt, Human
gaggaaguggaaccagagagc

SEQ ID NO: 158815 - RNA, 23 nt, Human
gaggaaguggaagggacaggagc

SEQ ID NO: 158816 - RNA, 24 nt, Human
gaggaaguggaagggacaggagca

SEQ ID NO: 158817 - RNA, 32 nt, Human
gaggaaguggcaccccuccccucaccacagau

SEQ ID NO: 158818 - RNA, 32 nt, Human
gaggaagugggaacagggaggugggaggugga

SEQ ID NO: 158819 - RNA, 32 nt, Human
gaggaagugggagcucagggaggaccccgggc

SEQ ID NO: 158820 - RNA, 32 nt, Human
gaggaagugggguuggaaaaugacgagaugga

SEQ ID NO: 158821 - RNA, 23 nt, Human
gaggaagugugucacagugaaca

SEQ ID NO: 158822 - RNA, 21 nt, Human
gaggaauaaagaacaggagca

SEQ ID NO: 158823 - RNA, 32 nt, Human
gaggaauaaagaacaggagcagagggaagccg

SEQ ID NO: 158824 - RNA, 19 nt, Human
gaggaauagggauggggag

SEQ ID NO: 158825 - RNA, 19 nt, Human
gaggaauaugaacauuuua

SEQ ID NO: 158826 - RNA, 32 nt, Human
gaggaauauggaauccaagggggccaguuccu

SEQ ID NO: 158827 - RNA, 32 nt, Human
gaggaauaugguaaagccaaaauaguugacag

SEQ ID NO: 158828 - RNA, 32 nt, Human
gaggaauauuugacaguacuuauuugauauug

SEQ ID NO: 158829 - RNA, 32 nt, Human
gaggaaucaccguaccaugagcauuaaucaau

SEQ ID NO: 158830 - RNA, 32 nt, Human
gaggaaucaugucaggccugugugugaaagga

SEQ ID NO: 158831 - RNA, 32 nt, Human
gaggaauccauucucuuugaacaucagaaugu

SEQ ID NO: 158832 - RNA, 32 nt, Human
gaggaauccuaccagcggcccauuaguagcac

SEQ ID NO: 158833 - RNA, 32 nt, Human
gaggaaucuauuccugucauggucuagugccu

SEQ ID NO: 158834 - RNA, 32 nt, Human
gaggaaugacacaccacucccuccccaccuug

SEQ ID NO: 158835 - RNA, 32 nt, Human
gaggaaugagccuuuuaauucagaaauggggc

SEQ ID NO: 158836 - RNA, 31 nt, Human
gaggaaugaguguccaggcagaguucagaag

SEQ ID NO: 158837 - RNA, 30 nt, Human
gaggaaugcaccggccgcgccgccgcggga

SEQ ID NO: 158838 - RNA, 32 nt, Human
gaggaauggaaagggaacccagauaggaagcu

SEQ ID NO: 158839 - RNA, 30 nt, Human
gaggaauggacagaagcauccagcaugggg

SEQ ID NO: 158840 - RNA, 32 nt, Human
gaggaauggaguuuccuugaugagccugagag

SEQ ID NO: 158841 - RNA, 32 nt, Human
gaggaaugggucuugugaaauucugagcaaaa

SEQ ID NO: 158842 - RNA, 32 nt, Human
gaggaauguaucagccaguggcuggugguaug

SEQ ID NO: 158843 - RNA, 32 nt, Human
gaggaaugugguuuacauuugagauccaccuu

SEQ ID NO: 158844 - RNA, 32 nt, Human
gaggaauguguugcugucagacugauguagaa

SEQ ID NO: 158845 - RNA, 32 nt, Human
gaggaauuaaacuaucauuuauuugaaauguu

SEQ ID NO: 158846 - RNA, 32 nt, Human
gaggaauuaauacccaccauuaaaggaugucc

SEQ ID NO: 158847 - RNA, 32 nt, Human
gaggaauucugagacuuuagaggccgcacagc

SEQ ID NO: 158848 - RNA, 32 nt, Human
gaggaauucugggaacuaaguuuuucuucucc

SEQ ID NO: 158849 - RNA, 32 nt, Human
gaggaauuguucuggggguccuggagacuuac

SEQ ID NO: 158850 - RNA, 19 nt, Human
gaggaauuugaacauuuua

SEQ ID NO: 158851 - RNA, 32 nt, Human
gaggaauuuguaccuauucuccagaaaacagu

SEQ ID NO: 158852 - RNA, 19 nt, Human
gaggaauuuugaacauuuc

SEQ ID NO: 158853 - RNA, 32 nt, Human
gaggaauuuuucauuuucuuccuggcuggguu

SEQ ID NO: 158854 - RNA, 32 nt, Human
gaggacaaagagagcucaagaggaaugcuuug

SEQ ID NO: 158855 - RNA, 32 nt, Human
gaggacaaagugggcggaucaccugaggucag

SEQ ID NO: 158856 - RNA, 32 nt, Human
gaggacaaauaagaaaugaaacauccuaugaa

SEQ ID NO: 158857 - RNA, 19 nt, Human
gaggacaacuaacauuuua

SEQ ID NO: 158858 - RNA, 32 nt, Human
gaggacaauaagaguuauggcaaaaagcaaaa

SEQ ID NO: 158859 - RNA, 32 nt, Human
gaggacacagaaggacuuggcagcagggugau

SEQ ID NO: 158860 - RNA, 32 nt, Human
gaggacacagcccagcugcaggugugggugua

SEQ ID NO: 158861 - RNA, 20 nt, Human
gaggacacaggcagcuucca

SEQ ID NO: 158862 - RNA, 21 nt, Human
gaggacacauagagcaugcca

SEQ ID NO: 158863 - RNA, 21 nt, Human
gaggacaccagugagcuucca

SEQ ID NO: 158864 - RNA, 32 nt, Human
gaggacaccaucaaccuauauugaaugucaua

SEQ ID NO: 158865 - RNA, 26 nt, Human
gaggacacccuggaagagcaggagca

SEQ ID NO: 158866 - RNA, 18 nt, Human
gaggacaccggcggucca

SEQ ID NO: 158867 - RNA, 20 nt, Human
gaggacacgaggauauugua

SEQ ID NO: 158868 - RNA, 32 nt, Human
gaggacacgggccgcaccacacagugcucccu

SEQ ID NO: 158869 - RNA, 17 nt, Human
gaggacacuaagauucc

SEQ ID NO: 158870 - RNA, 18 nt, Human
gaggacacuagacggucc

SEQ ID NO: 158871 - RNA, 18 nt, Human
gaggacacuagcuuuuca

SEQ ID NO: 158872 - RNA, 32 nt, Human
gaggacacucugagccccuugugaccugcuuc

SEQ ID NO: 158873 - RNA, 21 nt, Human
gaggacacuggaaucaauucu

SEQ ID NO: 158874 - RNA, 32 nt, Human
gaggacacuggcaggagaguagcuggagauga

SEQ ID NO: 158875 - RNA, 23 nt, Human
gaggacacugggaauauauucua

SEQ ID NO: 158876 - RNA, 19 nt, Human
gaggacacuggugguucua

SEQ ID NO: 158877 - RNA, 32 nt, Human
gaggacagaaggaaagaaaaaggaaggcaggg

SEQ ID NO: 158878 - RNA, 32 nt, Human
gaggacagacacaggcuccaaacuccacuaac

SEQ ID NO: 158879 - RNA, 20 nt, Human
gaggacagacagcaauucua

SEQ ID NO: 158880 - RNA, 22 nt, Human
gaggacagacugggacaggaac

SEQ ID NO: 158881 - RNA, 32 nt, Human
gaggacagaggugggggagugggaagugggaa

SEQ ID NO: 158882 - RNA, 32 nt, Human
gaggacagagugacaggagugaggggagagag

SEQ ID NO: 158883 - RNA, 19 nt, Human
gaggacagccaagggccau

SEQ ID NO: 158884 - RNA, 32 nt, Human
gaggacagccuuaugaggguuugcuugagagg

SEQ ID NO: 158885 - RNA, 32 nt, Human
gaggacagcuccugccugcagcuuccagaccc

SEQ ID NO: 158886 - RNA, 18 nt, Human
gaggacagcucgcgacgg

SEQ ID NO: 158887 - RNA, 32 nt, Human
gaggacagcugcagagguggcaguguguggac

SEQ ID NO: 158888 - RNA, 32 nt, Human
gaggacagcuuuaaaagaugaaugacucaaaa

SEQ ID NO: 158889 - RNA, 32 nt, Human
gaggacaggagaagggcccagacacucccucc

SEQ ID NO: 158890 - RNA, 32 nt, Human
gaggacaggcagccccgcgccccugagacugg

SEQ ID NO: 158891 - RNA, 32 nt, Human
gaggacagggcacagagacauggagguguuca

SEQ ID NO: 158892 - RNA, 32 nt, Human
gaggacagggccugggacuguucuuccagauc

SEQ ID NO: 158893 - RNA, 32 nt, Human
gaggacaggugugaggcccucaugggauguag

SEQ ID NO: 158894 - RNA, 32 nt, Human
gaggacagucacugcaaucucuuuaccaccuc

SEQ ID NO: 158895 - RNA, 21 nt, Human
gaggacagucuagggcauuuu

SEQ ID NO: 158896 - RNA, 32 nt, Human
gaggacagugaugugacuucuuggucagaaga

SEQ ID NO: 158897 - RNA, 32 nt, Human
gaggacaguuuugccccacaaggggcacuugg

SEQ ID NO: 158898 - RNA, 21 nt, Human
gaggacauaagauggguacag

SEQ ID NO: 158899 - RNA, 32 nt, Human
gaggacauaaguaucaugucuccuuuaacuag

SEQ ID NO: 158900 - RNA, 32 nt, Human
gaggacauaaugggggccuggccaucccacaa

SEQ ID NO: 158901 - RNA, 32 nt, Human
gaggacauacaugauuuugaaaagcuggaacc

SEQ ID NO: 158902 - RNA, 32 nt, Human
gaggacauaguuuccaggcugcaaugcugaau

SEQ ID NO: 158903 - RNA, 21 nt, Human
gaggacauauucugggcacug

SEQ ID NO: 158904 - RNA, 32 nt, Human
gaggacaucaccaucaucucaggaugaggggc

SEQ ID NO: 158905 - RNA, 22 nt, Human
gaggacaucaccuggggugcug

SEQ ID NO: 158906 - RNA, 22 nt, Human
gaggacaucccaugcggcuacu

SEQ ID NO: 158907 - RNA, 24 nt, Human
gaggacaucccugcugggcugcug

SEQ ID NO: 158908 - RNA, 32 nt, Human
gaggacauccucuccauguucucagcuauccg

SEQ ID NO: 158909 - RNA, 20 nt, Human
gaggacaucuaucguauucu

SEQ ID NO: 158910 - RNA, 32 nt, Human
gaggacaucuuggggagggggagggagcuggg

SEQ ID NO: 158911 - RNA, 32 nt, Human
gaggacaugaagcuauuccucccaccaccagu

SEQ ID NO: 158912 - RNA, 20 nt, Human
gaggacaugagaauaauuca

SEQ ID NO: 158913 - RNA, 32 nt, Human
gaggacaugagauuggggaggggccaggggca

SEQ ID NO: 158914 - RNA, 32 nt, Human
gaggacaugagauuuggaaggggccaggggug

SEQ ID NO: 158915 - RNA, 21 nt, Human
gaggacaugcacauauaucca

SEQ ID NO: 158916 - RNA, 24 nt, Human
gaggacaugccucuucuuccuccu

SEQ ID NO: 158917 - RNA, 20 nt, Human
gaggacauggcaccauucca

SEQ ID NO: 158918 - RNA, 32 nt, Human
gaggacaugggaagguaggaguugccgcccug

SEQ ID NO: 158919 - RNA, 20 nt, Human
gaggacauuccugucaucca

SEQ ID NO: 158920 - RNA, 19 nt, Human
gaggacauuguggcagcca

SEQ ID NO: 158921 - RNA, 18 nt, Human
gaggacauuguggcauuc

SEQ ID NO: 158922 - RNA, 19 nt, Human
gaggacauuuaauauucua

SEQ ID NO: 158923 - RNA, 32 nt, Human
gaggaccaaccaugagccagagcccgggugca

SEQ ID NO: 158924 - RNA, 32 nt, Human
gaggaccacaguuggggguguagggaccaccc

SEQ ID NO: 158925 - RNA, 32 nt, Human
gaggaccacuugagcccaggagauugaggcug

SEQ ID NO: 158926 - RNA, 32 nt, Human
gaggaccagccauugagggguggacccucaga

SEQ ID NO: 158927 - RNA, 19 nt, Human
gaggaccagccccuccucc

SEQ ID NO: 158928 - RNA, 22 nt, Human
gaggaccagccgcccuccuucc

SEQ ID NO: 158929 - RNA, 20 nt, Human
gaggaccagcuaggcucucc

SEQ ID NO: 158930 - RNA, 32 nt, Human
gaggaccagcuuuauccagggacucuaccauu

SEQ ID NO: 158931 - RNA, 32 nt, Human
gaggaccaggaacccggcgacugaggugcuuc

SEQ ID NO: 158932 - RNA, 32 nt, Human
gaggaccaggagacggcuguguagcgggccgc

SEQ ID NO: 158933 - RNA, 32 nt, Human
gaggaccaggagcugguguuccaaggcagaag

SEQ ID NO: 158934 - RNA, 23 nt, Human
gaggaccaggggaucaugucucc

SEQ ID NO: 158935 - RNA, 32 nt, Human
gaggaccaggguggagcugagaagaggaggag

SEQ ID NO: 158936 - RNA, 23 nt, Human
gaggaccaggucucuccgcuccu

SEQ ID NO: 158937 - RNA, 32 nt, Human
gaggaccagugucccccaaagccccucaacua

SEQ ID NO: 158938 - RNA, 32 nt, Human
gaggaccaugcugugagcagcagggcgagagu

SEQ ID NO: 158939 - RNA, 23 nt, Human
gaggacccacugugagcacucca

SEQ ID NO: 158940 - RNA, 32 nt, Human
gaggacccauccugccacaggacccagaaaaa

SEQ ID NO: 158941 - RNA, 32 nt, Human
gaggacccaugcgccacguccuggguggugga

SEQ ID NO: 158942 - RNA, 32 nt, Human
gaggaccccacucugaagccagccuggagcca

SEQ ID NO: 158943 - RNA, 32 nt, Human
gaggaccccugccaccgacuucggcacgguaa

SEQ ID NO: 158944 - RNA, 32 nt, Human
gaggaccccugcccugaauccugcacuugaga

SEQ ID NO: 158945 - RNA, 32 nt, Human
gaggacccucauucccagccuggcuguccaca

SEQ ID NO: 158946 - RNA, 20 nt, Human
gaggacccucccagguuucc

SEQ ID NO: 158947 - RNA, 32 nt, Human
gaggacccuguaugucuggaguucaguccccu

SEQ ID NO: 158948 - RNA, 32 nt, Human
gaggacccuucagagccacccuuucuaguuug

SEQ ID NO: 158949 - RNA, 32 nt, Human
gaggaccgaggcacagaggugcggugacuugc

SEQ ID NO: 158950 - RNA, 32 nt, Human
gaggaccgcuugagcccaggaguuugagacug

SEQ ID NO: 158951 - RNA, 32 nt, Human
gaggaccggccaccccagacuuccugucccgc

SEQ ID NO: 158952 - RNA, 32 nt, Human
gaggaccggcucuuccaccaguucaagcgcuu

SEQ ID NO: 158953 - RNA, 32 nt, Human
gaggaccucacugaggccgagugggaggaccu

SEQ ID NO: 158954 - RNA, 32 nt, Human
gaggaccucagggacuugagguugcauuuuug

SEQ ID NO: 158955 - RNA, 32 nt, Human
gaggaccuccacccucugaccuuucaguuuuc

SEQ ID NO: 158956 - RNA, 32 nt, Human
gaggaccuccaugcccccgccaccuccccacu

SEQ ID NO: 158957 - RNA, 32 nt, Human
gaggaccugaccucacagagggaggcguccag

SEQ ID NO: 158958 - RNA, 32 nt, Human
gaggaccugagccagaugcacaccaucucuga

SEQ ID NO: 158959 - RNA, 32 nt, Human
gaggaccugagcgcugcggcucugcugaaugg

SEQ ID NO: 158960 - RNA, 32 nt, Human
gaggaccugaugccaagggguaaugggcccag

SEQ ID NO: 158961 - RNA, 32 nt, Human
gaggaccuggaaacugcuguuugcccugguau

SEQ ID NO: 158962 - RNA, 32 nt, Human
gaggaccuggagagcugggagaccaugaugag

SEQ ID NO: 158963 - RNA, 32 nt, Human
gaggaccugggccucugcugucagcccaacac

SEQ ID NO: 158964 - RNA, 32 nt, Human
gaggaccuguaaggcaggcccauucagagcua

SEQ ID NO: 158965 - RNA, 32 nt, Human
gaggaccuuuuggcuucucuggagccugcaag

SEQ ID NO: 158966 - RNA, 32 nt, Human
gaggacgaacagcaucuuagccaagaccacaa

SEQ ID NO: 158967 - RNA, 32 nt, Human
gaggacgacauccugaccugcugcugaggcug

SEQ ID NO: 158968 - RNA, 32 nt, Human
gaggacgagagaccuccagccccggcacccgc

SEQ ID NO: 158969 - RNA, 32 nt, Human
gaggacgaggaggcagcaggagcagugacggu

SEQ ID NO: 158970 - RNA, 32 nt, Human
gaggacgaggaugaggaggaggaaggugaaga

SEQ ID NO: 158971 - RNA, 32 nt, Human
gaggacgaggcauguggaucaccugaggucgg

SEQ ID NO: 158972 - RNA, 32 nt, Human
gaggacgaggugccgcugccuggagaauccuc

SEQ ID NO: 158973 - RNA, 32 nt, Human
gaggacgcagagggcagaggcccaguggagcc

SEQ ID NO: 158974 - RNA, 32 nt, Human
gaggacgcccaggaggaggcggcggcggcggc

SEQ ID NO: 158975 - RNA, 32 nt, Human
gaggacgccgaggccuggagugggugguagcc

SEQ ID NO: 158976 - RNA, 20 nt, Human
gaggacgcgagccccgcggc

SEQ ID NO: 158977 - RNA, 32 nt, Human
gaggacgcgccaacauccccgcugcugugcug

SEQ ID NO: 158978 - RNA, 20 nt, Human
gaggacgcgcggaacuucua

SEQ ID NO: 158979 - RNA, 19 nt, Human
gaggacgcugugaucucca

SEQ ID NO: 158980 - RNA, 32 nt, Human
gaggacgcugugaucuccaccuugaagccagg

SEQ ID NO: 158981 - RNA, 32 nt, Human
gaggacgcuuccccuuccuuguuucugcucag

SEQ ID NO: 158982 - RNA, 32 nt, Human
gaggacggagucuugcucugucgcccagguug

SEQ ID NO: 158983 - RNA, 18 nt, Human
gaggacggauugauucca

SEQ ID NO: 158984 - RNA, 32 nt, Human
gaggacgggcaggccagcaagcaggcugccug

SEQ ID NO: 158985 - RNA, 32 nt, Human
gaggacgggcggggccauuuggccucuuucgc

SEQ ID NO: 158986 - RNA, 20 nt, Human
gaggacggguggauauuuca

SEQ ID NO: 158987 - RNA, 22 nt, Human
gaggacgugcuuccugcuucau

SEQ ID NO: 158988 - RNA, 24 nt, Human
gaggacguuaucuuccucuccucc

SEQ ID NO: 158989 - RNA, 32 nt, Human
gaggacuacagcuccacggaggggucuggggg

SEQ ID NO: 158990 - RNA, 19 nt, Human
gaggacuaggcucuccccu

SEQ ID NO: 158991 - RNA, 32 nt, Human
gaggacuagggcuuauccaugccugggaaaug

SEQ ID NO: 158992 - RNA, 19 nt, Human
gaggacucaccuggggcag

SEQ ID NO: 158993 - RNA, 32 nt, Human
gaggacuccaggcagcagacacaugccagggc

SEQ ID NO: 158994 - RNA, 32 nt, Human
gaggacuccauucaugaugaguucgugcggag

SEQ ID NO: 158995 - RNA, 32 nt, Human
gaggacuccugccuuuccuguuuagacaccca

SEQ ID NO: 158996 - RNA, 32 nt, Human
gaggacucucuacccuugccguaucuaaggag

SEQ ID NO: 158997 - RNA, 21 nt, Human
gaggacucucugaagcauucu

SEQ ID NO: 158998 - RNA, 32 nt, Human
gaggacucugcacuuguccaagagaagaaucc

SEQ ID NO: 158999 - RNA, 32 nt, Human
gaggacucugcaguaccuucuccuacaucuag

SEQ ID NO: 159000 - RNA, 32 nt, Human
gaggacucuguggagaugccuguaacccaccg

SEQ ID NO: 159001 - RNA, 32 nt, Human
gaggacugacccuuuccccacaaggaccugcc

SEQ ID NO: 159002 - RNA, 32 nt, Human
gaggacugacgcugcuggccugggcguccccu

SEQ ID NO: 159003 - RNA, 32 nt, Human
gaggacugagcaccccuccuagcggcaucccu

SEQ ID NO: 159004 - RNA, 32 nt, Human
gaggacugaguguguggaaguuuuucauaaac

SEQ ID NO: 159005 - RNA, 32 nt, Human
gaggacugaugggaaagggaaggcuggcagca

SEQ ID NO: 159006 - RNA, 32 nt, Human
gaggacugcaaugagaggauccuggccaugag

SEQ ID NO: 159007 - RNA, 32 nt, Human
gaggacugccccgugcccugaggugacuuccu

SEQ ID NO: 159008 - RNA, 32 nt, Human
gaggacugcccuuuggauguuuaucuucauua

SEQ ID NO: 159009 - RNA, 24 nt, Human
gaggacugcggcucccucccuccu

SEQ ID NO: 159010 - RNA, 32 nt, Human
gaggacugcuggugaccugggaagaaaccuuc

SEQ ID NO: 159011 - RNA, 32 nt, Human
gaggacugcuguccggagaggagggagccuga

SEQ ID NO: 159012 - RNA, 32 nt, Human
gaggacugcuugagcccaggaggucaaggcug

SEQ ID NO: 159013 - RNA, 32 nt, Human
gaggacugcuugagcccaggaguucagggcug

SEQ ID NO: 159014 - RNA, 32 nt, Human
gaggacugcuugagcccaggaguuugagacca

SEQ ID NO: 159015 - RNA, 32 nt, Human
gaggacugcuugagcccaggaguuugagauga

SEQ ID NO: 159016 - RNA, 32 nt, Human
gaggacuggaaaugucuuugagcugaagguca

SEQ ID NO: 159017 - RNA, 20 nt, Human
gaggacuggcugcccuggag

SEQ ID NO: 159018 - RNA, 32 nt, Human
gaggacugggcugugguugggccugaggccug

SEQ ID NO: 159019 - RNA, 32 nt, Human
gaggacuggggagggggccgugggagagcccu

SEQ ID NO: 159020 - RNA, 32 nt, Human
gaggacuggggugcuccgcugagccacuccug

SEQ ID NO: 159021 - RNA, 21 nt, Human
gaggacugggugcugggcugc

SEQ ID NO: 159022 - RNA, 32 nt, Human
gaggacugguugccauggcaaaugcugguucu

SEQ ID NO: 159023 - RNA, 32 nt, Human
gaggacugugucugcuccgugagagcugcgug

SEQ ID NO: 159024 - RNA, 32 nt, Human
gaggacuguuugagcccaggaguucagggcug

SEQ ID NO: 159025 - RNA, 18 nt, Human
gaggacuuaaaauauucc

SEQ ID NO: 159026 - RNA, 32 nt, Human
gaggacuucauucaagacucuauugcaauaga

SEQ ID NO: 159027 - RNA, 32 nt, Human
gaggacuucccccugcugcacagguucagcau

SEQ ID NO: 159028 - RNA, 32 nt, Human
gaggacuucucccacucaucccuguaccugag

SEQ ID NO: 159029 - RNA, 32 nt, Human
gaggacuucuccugccaagcccagggagucug

SEQ ID NO: 159030 - RNA, 32 nt, Human
gaggacuucucuaggaaguccuuccugacuac

SEQ ID NO: 159031 - RNA, 21 nt, Human
gaggacuucuggaacauucca

SEQ ID NO: 159032 - RNA, 32 nt, Human
gaggacuugaagcagaaagcaagugaauacca

SEQ ID NO: 159033 - RNA, 32 nt, Human
gaggacuugaagcagaguucaccagugagcuc

SEQ ID NO: 159034 - RNA, 32 nt, Human
gaggacuugcagagacacguaccacacaguaa

SEQ ID NO: 159035 - RNA, 32 nt, Human
gaggacuugcuguggagaagagagaaaagaga

SEQ ID NO: 159036 - RNA, 32 nt, Human
gaggacuuggagaccaccuuccugugcaggcc

SEQ ID NO: 159037 - RNA, 32 nt, Human
gaggacuuggaggaugcagggaagagaggggc

SEQ ID NO: 159038 - RNA, 32 nt, Human
gaggacuuggcgggcagcaggaggcaaggguu

SEQ ID NO: 159039 - RNA, 32 nt, Human
gaggacuugggaacugccgaggccucugccaa

SEQ ID NO: 159040 - RNA, 32 nt, Human
gaggacuugggauuuggugguuuguugaccuu

SEQ ID NO: 159041 - RNA, 32 nt, Human
gaggacuuugccucuucuccugccucauuccc

SEQ ID NO: 159042 - RNA, 17 nt, Human
gaggagaaaaaauguag

SEQ ID NO: 159043 - RNA, 18 nt, Human
gaggagaaaaaauuaaga

SEQ ID NO: 159044 - RNA, 17 nt, Human
gaggagaaaaagacaga

SEQ ID NO: 159045 - RNA, 18 nt, Human
gaggagaaaaagcccagg

SEQ ID NO: 159046 - RNA, 15 nt, Human
gaggagaaaaagcgg

SEQ ID NO: 159047 - RNA, 18 nt, Human
gaggagaaaacauacaga

SEQ ID NO: 159048 - RNA, 16 nt, Human
gaggagaaaacugcag

SEQ ID NO: 159049 - RNA, 19 nt, Human
gaggagaaaagaucugaga

SEQ ID NO: 159050 - RNA, 18 nt, Human
gaggagaaaccugcauga

SEQ ID NO: 159051 - RNA, 17 nt, Human
gaggagaaaccuugaga

SEQ ID NO: 159052 - RNA, 17 nt, Human
gaggagaaacuuguaga

SEQ ID NO: 159053 - RNA, 17 nt, Human
gaggagaaagaaacaga

SEQ ID NO: 159054 - RNA, 16 nt, Human
gaggagaaagaacaga

SEQ ID NO: 159055 - RNA, 32 nt, Human
gaggagaaagaaugucuuuucgaggcggaggu

SEQ ID NO: 159056 - RNA, 19 nt, Human
gaggagaaagagccccaga

SEQ ID NO: 159057 - RNA, 32 nt, Human
gaggagaaagagugugcguucaagaggcagau

SEQ ID NO: 159058 - RNA, 20 nt, Human
gaggagaaagaugacccaga

SEQ ID NO: 159059 - RNA, 17 nt, Human
gaggagaaagauggaga

SEQ ID NO: 159060 - RNA, 18 nt, Human
gaggagaaagcagugcag

SEQ ID NO: 159061 - RNA, 26 nt, Human
gaggagaaagccccuguguugccaga

SEQ ID NO: 159062 - RNA, 20 nt, Human
gaggagaaagcuaggcuaga

SEQ ID NO: 159063 - RNA, 18 nt, Human
gaggagaaagcugacagg

SEQ ID NO: 159064 - RNA, 19 nt, Human
gaggagaaaggaaaugaga

SEQ ID NO: 159065 - RNA, 32 nt, Human
gaggagaaaggagaaccacugauuuuaucugg

SEQ ID NO: 159066 - RNA, 32 nt, Human
gaggagaaaggagcccaggaaacgggucauuu

SEQ ID NO: 159067 - RNA, 32 nt, Human
gaggagaaaggaugagaguaacuguggagagg

SEQ ID NO: 159068 - RNA, 19 nt, Human
gaggagaaaguucuggaga

SEQ ID NO: 159069 - RNA, 19 nt, Human
gaggagaaauguggacaga

SEQ ID NO: 159070 - RNA, 32 nt, Human
gaggagaaauguguucuucaguaccaucagau

SEQ ID NO: 159071 - RNA, 18 nt, Human
gaggagaacauguugaga

SEQ ID NO: 159072 - RNA, 18 nt, Human
gaggagaacgacgcacgg

SEQ ID NO: 159073 - RNA, 24 nt, Human
gaggagaacuugguagauggggag

SEQ ID NO: 159074 - RNA, 32 nt, Human
gaggagaagaagaaagcggaaaagaggcagau

SEQ ID NO: 159075 - RNA, 18 nt, Human
gaggagaagacgcgcgga

SEQ ID NO: 159076 - RNA, 18 nt, Human
gaggagaagagacgcagg

SEQ ID NO: 159077 - RNA, 32 nt, Human
gaggagaagaggaggaggcagaggaagaaaga

SEQ ID NO: 159078 - RNA, 32 nt, Human
gaggagaagcagcuggcagcggagagagcagc

SEQ ID NO: 159079 - RNA, 19 nt, Human
gaggagaagccauugcaga

SEQ ID NO: 159080 - RNA, 32 nt, Human
gaggagaagcugcaagggaaaagggagggaca

SEQ ID NO: 159081 - RNA, 17 nt, Human
gaggagaagcugcgcga

SEQ ID NO: 159082 - RNA, 17 nt, Human
gaggagaagcuugcaga

SEQ ID NO: 159083 - RNA, 19 nt, Human
gaggagaaggacuggcaga

SEQ ID NO: 159084 - RNA, 17 nt, Human
gaggagaaggagcaaga

SEQ ID NO: 159085 - RNA, 32 nt, Human
gaggagaaggaggucagugcucagggagacau

SEQ ID NO: 159086 - RNA, 16 nt, Human
gaggagaaggaugcag

SEQ ID NO: 159087 - RNA, 32 nt, Human
gaggagaaggcaggcagggcccagugagaggg

SEQ ID NO: 159088 - RNA, 19 nt, Human
gaggagaaggcggcggcgg

SEQ ID NO: 159089 - RNA, 19 nt, Human
gaggagaaggguuuccaga

SEQ ID NO: 159090 - RNA, 32 nt, Human
gaggagaagguggugacccugaucgucggcca

SEQ ID NO: 159091 - RNA, 32 nt, Human
gaggagaaguaagccauuucugccacuuuccc

SEQ ID NO: 159092 - RNA, 17 nt, Human
gaggagaaguuugaaga

SEQ ID NO: 159093 - RNA, 32 nt, Human
gaggagaaucagcuuagagaacuaucaacaca

SEQ ID NO: 159094 - RNA, 23 nt, Human
gaggagaaucaguggcccagcca

SEQ ID NO: 159095 - RNA, 18 nt, Human
gaggagaauuauagcaga

SEQ ID NO: 159096 - RNA, 32 nt, Human
gaggagaauugagccugggaggcggguccgga

SEQ ID NO: 159097 - RNA, 20 nt, Human
gaggagacaaaggccaggac

SEQ ID NO: 159098 - RNA, 24 nt, Human
gaggagacaccauaguggaaacug

SEQ ID NO: 159099 - RNA, 18 nt, Human
gaggagacacgcagagac

SEQ ID NO: 159100 - RNA, 19 nt, Human
gaggagacagagaacuuua

SEQ ID NO: 159101 - RNA, 32 nt, Human
gaggagacagcggcacguucuagcugcgucug

SEQ ID NO: 159102 - RNA, 19 nt, Human
gaggagacagugguaugac

SEQ ID NO: 159103 - RNA, 21 nt, Human
gaggagacauggagccuggga

SEQ ID NO: 159104 - RNA, 17 nt, Human
gaggagaccaagaaagg

SEQ ID NO: 159105 - RNA, 21 nt, Human
gaggagaccaaggcccuggga

SEQ ID NO: 159106 - RNA, 22 nt, Human
gaggagaccaggaggcuaggac

SEQ ID NO: 159107 - RNA, 18 nt, Human
gaggagaccaggcaggac

SEQ ID NO: 159108 - RNA, 19 nt, Human
gaggagaccagggcaggau

SEQ ID NO: 159109 - RNA, 17 nt, Human
gaggagacccagaggac

SEQ ID NO: 159110 - RNA, 19 nt, Human
gaggagaccccaggcaggg

SEQ ID NO: 159111 - RNA, 18 nt, Human
gaggagacccccaggcag

SEQ ID NO: 159112 - RNA, 18 nt, Human
gaggagacccccggagga

SEQ ID NO: 159113 - RNA, 18 nt, Human
gaggagacccccgugggc

SEQ ID NO: 159114 - RNA, 18 nt, Human
gaggagaccccgaaggga

SEQ ID NO: 159115 - RNA, 20 nt, Human
gaggagaccccgggcgagga

SEQ ID NO: 159116 - RNA, 17 nt, Human
gaggagaccccugagac

SEQ ID NO: 159117 - RNA, 17 nt, Human
gaggagacccgaguagg

SEQ ID NO: 159118 - RNA, 18 nt, Human
gaggagacccuuugaagg

SEQ ID NO: 159119 - RNA, 17 nt, Human
gaggagaccgaagagac

SEQ ID NO: 159120 - RNA, 18 nt, Human
gaggagaccggaguggac

SEQ ID NO: 159121 - RNA, 19 nt, Human
gaggagaccuaggaaugac

SEQ ID NO: 159122 - RNA, 20 nt, Human
gaggagaccuauggagggac

SEQ ID NO: 159123 - RNA, 32 nt, Human
gaggagaccucacccacuccucgcucaguuug

SEQ ID NO: 159124 - RNA, 19 nt, Human
gaggagaccucagcagggc

SEQ ID NO: 159125 - RNA, 20 nt, Human
gaggagaccugguccaggau

SEQ ID NO: 159126 - RNA, 20 nt, Human
gaggagacgaaugauagggc

SEQ ID NO: 159127 - RNA, 32 nt, Human
gaggagacgcgaggaggagggaggaggaagag

SEQ ID NO: 159128 - RNA, 17 nt, Human
gaggagacgggcgggac

SEQ ID NO: 159129 - RNA, 23 nt, Human
gaggagacuaagcugucuguaga

SEQ ID NO: 159130 - RNA, 19 nt, Human
gaggagacuaugauauaac

SEQ ID NO: 159131 - RNA, 32 nt, Human
gaggagacucaccucugucgcuuggguuaaac

SEQ ID NO: 159132 - RNA, 17 nt, Human
gaggagacuccacagac

SEQ ID NO: 159133 - RNA, 20 nt, Human
gaggagacucugcacagggc

SEQ ID NO: 159134 - RNA, 27 nt, Human
gaggagacuggccccaggccccagcca

SEQ ID NO: 159135 - RNA, 20 nt, Human
gaggagacugucccagagac

SEQ ID NO: 159136 - RNA, 19 nt, Human
gaggagacuguucagagac

SEQ ID NO: 159137 - RNA, 17 nt, Human
gaggagagaaacugaga

SEQ ID NO: 159138 - RNA, 32 nt, Human
gaggagagaaagagagcaugagagggagcgag

SEQ ID NO: 159139 - RNA, 32 nt, Human
gaggagagaaggaaggagaggugaucuccaga

SEQ ID NO: 159140 - RNA, 32 nt, Human
gaggagagaauguuccaggcagaggaaaaggc

SEQ ID NO: 159141 - RNA, 21 nt, Human
gaggagagaccagucgguaga

SEQ ID NO: 159142 - RNA, 17 nt, Human
gaggagagaccuguaga

SEQ ID NO: 159143 - RNA, 32 nt, Human
gaggagagagaggagaagggaggcaagggagg

SEQ ID NO: 159144 - RNA, 32 nt, Human
gaggagagagaggagaagggaggcaggggagg

SEQ ID NO: 159145 - RNA, 17 nt, Human
gaggagagagauugaga

SEQ ID NO: 159146 - RNA, 32 nt, Human
gaggagagagcagcuucugccacuucccaggu

SEQ ID NO: 159147 - RNA, 17 nt, Human
gaggagagagcggcaga

SEQ ID NO: 159148 - RNA, 32 nt, Human
gaggagagagcggcagagaagcucugagagcc

SEQ ID NO: 159149 - RNA, 32 nt, Human
gaggagagaggagcagcaggcaggcagcucag

SEQ ID NO: 159150 - RNA, 22 nt, Human
gaggagagagggagucuggaga

SEQ ID NO: 159151 - RNA, 32 nt, Human
gaggagagaguagaggccagagcccaggcagg

SEQ ID NO: 159152 - RNA, 20 nt, Human
gaggagagauggauauuuca

SEQ ID NO: 159153 - RNA, 32 nt, Human
gaggagagccagagaaaugacagggaaucuac

SEQ ID NO: 159154 - RNA, 32 nt, Human
gaggagagccagagaaguaacagggaagcuac

SEQ ID NO: 159155 - RNA, 32 nt, Human
gaggagagccagagaagugacagggaagcuac

SEQ ID NO: 159156 - RNA, 24 nt, Human
gaggagagccugguugcccaggga

SEQ ID NO: 159157 - RNA, 22 nt, Human
gaggagagcgcacacccaggca

SEQ ID NO: 159158 - RNA, 24 nt, Human
gaggagagcgcgagagccccagcc

SEQ ID NO: 159159 - RNA, 24 nt, Human
gaggagagcggccggucccagcca

SEQ ID NO: 159160 - RNA, 25 nt, Human
gaggagagcugaagugccccagcca

SEQ ID NO: 159161 - RNA, 22 nt, Human
gaggagagcugacugcccuggg

SEQ ID NO: 159162 - RNA, 24 nt, Human
gaggagagcuuggagcccaagcca

SEQ ID NO: 159163 - RNA, 31 nt, Human
gaggagaggaaacuucucucaguugcuucua

SEQ ID NO: 159164 - RNA, 32 nt, Human
gaggagaggaaaggccaagggaagagaaaagu

SEQ ID NO: 159165 - RNA, 32 nt, Human
gaggagaggaaccauuugugcagaucaucuag

SEQ ID NO: 159166 - RNA, 32 nt, Human
gaggagaggaagagaggacuaagaggggagca

SEQ ID NO: 159167 - RNA, 32 nt, Human
gaggagaggaagagccgcacacuuuuaaacaa

SEQ ID NO: 159168 - RNA, 32 nt, Human
gaggagaggaagugcuuugucaggaacuaggc

SEQ ID NO: 159169 - RNA, 32 nt, Human
gaggagaggagaaaguccaaggaaagauggcu

SEQ ID NO: 159170 - RNA, 32 nt, Human
gaggagaggagaaggccaggggaaugaauuca

SEQ ID NO: 159171 - RNA, 32 nt, Human
gaggagaggagagaggcagagagcggucucag

SEQ ID NO: 159172 - RNA, 32 nt, Human
gaggagaggaugacacuuccucucuguuuccc

SEQ ID NO: 159173 - RNA, 22 nt, Human
gaggagaggcagagccagugug

SEQ ID NO: 159174 - RNA, 19 nt, Human
gaggagaggccugcggcgg

SEQ ID NO: 159175 - RNA, 18 nt, Human
gaggagaggcgacagucg

SEQ ID NO: 159176 - RNA, 16 nt, Human
gaggagaggcugcagg

SEQ ID NO: 159177 - RNA, 19 nt, Human
gaggagaggcugcaggaac

SEQ ID NO: 159178 - RNA, 32 nt, Human
gaggagaggcugucucagcugcagagggguca

SEQ ID NO: 159179 - RNA, 23 nt, Human
gaggagagggaugguucucuaga

SEQ ID NO: 159180 - RNA, 21 nt, Human
gaggagagggccgacuggaga

SEQ ID NO: 159181 - RNA, 24 nt, Human
gaggagagggccugugucuguaga

SEQ ID NO: 159182 - RNA, 19 nt, Human
gaggagagggcggcggcgg

SEQ ID NO: 159183 - RNA, 32 nt, Human
gaggagaggggaggggaccugcccccuccuca

SEQ ID NO: 159184 - RNA, 32 nt, Human
gaggagaggggcaguguucccacccaccugcu

SEQ ID NO: 159185 - RNA, 20 nt, Human
gaggagaguaauacugaaga

SEQ ID NO: 159186 - RNA, 32 nt, Human
gaggagagucccgaggggcagaacagcgggac

SEQ ID NO: 159187 - RNA, 32 nt, Human
gaggagagugguacuggcaguuuauggcugaa

SEQ ID NO: 159188 - RNA, 17 nt, Human
gaggagaguuauacaga

SEQ ID NO: 159189 - RNA, 32 nt, Human
gaggagaguuuggggcagggaggaacagacau

SEQ ID NO: 159190 - RNA, 19 nt, Human
gaggagauaagacagagac

SEQ ID NO: 159191 - RNA, 19 nt, Human
gaggagauauaggacagga

SEQ ID NO: 159192 - RNA, 32 nt, Human
gaggagaucaagcucauuagcaagacuggugg

SEQ ID NO: 159193 - RNA, 32 nt, Human
gaggagaucagaaaaucccucugacaucucca

SEQ ID NO: 159194 - RNA, 20 nt, Human
gaggagaucaugaagaggac

SEQ ID NO: 159195 - RNA, 19 nt, Human
gaggagauccugcaggaac

SEQ ID NO: 159196 - RNA, 23 nt, Human
gaggagaucuguauaauauucua

SEQ ID NO: 159197 - RNA, 32 nt, Human
gaggagaugaaagaggagggacagguucuugg

SEQ ID NO: 159198 - RNA, 32 nt, Human
gaggagaugagggagaagcagcaagcugccca

SEQ ID NO: 159199 - RNA, 32 nt, Human
gaggagaugaggugcagacuccacacuggggu

SEQ ID NO: 159200 - RNA, 20 nt, Human
gaggagaugauggauaaggc

SEQ ID NO: 159201 - RNA, 21 nt, Human
gaggagaugcugggaacuuug

SEQ ID NO: 159202 - RNA, 25 nt, Human
gaggagaugcuuaccaggccugaga

SEQ ID NO: 159203 - RNA, 32 nt, Human
gaggagauggcagaaacggagagaaacgagga

SEQ ID NO: 159204 - RNA, 18 nt, Human
gaggagauggccauagga

SEQ ID NO: 159205 - RNA, 19 nt, Human
gaggagauggggacagggc

SEQ ID NO: 159206 - RNA, 18 nt, Human
gaggagauggggauggac

SEQ ID NO: 159207 - RNA, 22 nt, Human
gaggagauggggcucugggaga

SEQ ID NO: 159208 - RNA, 32 nt, Human
gaggagauggugcuggagccagggagcugcug

SEQ ID NO: 159209 - RNA, 18 nt, Human
gaggagaugucagaagac

SEQ ID NO: 159210 - RNA, 32 nt, Human
gaggagauuuccaugaagggagaggagcccag

SEQ ID NO: 159211 - RNA, 32 nt, Human
gaggagauuuugaaaguagagcagaaauauaa

SEQ ID NO: 159212 - RNA, 32 nt, Human
gaggagcaaagacuggggucuuuugcgaaagg

SEQ ID NO: 159213 - RNA, 32 nt, Human
gaggagcaaagcagcccucuccaggugaacug

SEQ ID NO: 159214 - RNA, 32 nt, Human
gaggagcaaagcuguauccuggaguuggucug

SEQ ID NO: 159215 - RNA, 32 nt, Human
gaggagcaacagcagcagccuuggccgacgcg

SEQ ID NO: 159216 - RNA, 32 nt, Human
gaggagcaagugagcccaggaguucaaggcug

SEQ ID NO: 159217 - RNA, 32 nt, Human
gaggagcacacuuuggggagauguccugguuu

SEQ ID NO: 159218 - RNA, 32 nt, Human
gaggagcacaggcucuuggguggcgaagccag

SEQ ID NO: 159219 - RNA, 32 nt, Human
gaggagcaccacucacuucugcagggagcaag

SEQ ID NO: 159220 - RNA, 22 nt, Human
gaggagcaccugggaagcucug

SEQ ID NO: 159221 - RNA, 18 nt, Human
gaggagcacgaauauucc

SEQ ID NO: 159222 - RNA, 32 nt, Human
gaggagcacgugggaccuucagcugcuccuaa

SEQ ID NO: 159223 - RNA, 32 nt, Human
gaggagcagaggacaggugauggaaauccugc

SEQ ID NO: 159224 - RNA, 32 nt, Human
gaggagcagagggagcggaggaggggccggcc

SEQ ID NO: 159225 - RNA, 32 nt, Human
gaggagcagcagaggaaggggaacaggaaaga

SEQ ID NO: 159226 - RNA, 20 nt, Human
gaggagcagccacaccgaga

SEQ ID NO: 159227 - RNA, 21 nt, Human
gaggagcagcucagucaggac

SEQ ID NO: 159228 - RNA, 32 nt, Human
gaggagcagcugagacaguucaagaugacgac

SEQ ID NO: 159229 - RNA, 32 nt, Human
gaggagcaggagacacaggagacaauggccag

SEQ ID NO: 159230 - RNA, 32 nt, Human
gaggagcaggagaggaaggaaguuaauaccua

SEQ ID NO: 159231 - RNA, 21 nt, Human
gaggagcaggaggagagccug

SEQ ID NO: 159232 - RNA, 32 nt, Human
gaggagcaggagguggagauucccaguuaaaa

SEQ ID NO: 159233 - RNA, 32 nt, Human
gaggagcaggcagcaggcuuaucccuucacca

SEQ ID NO: 159234 - RNA, 26 nt, Human
gaggagcaggcccgcauggccuggga

SEQ ID NO: 159235 - RNA, 32 nt, Human
gaggagcagggacucaccugagcccaggaaua

SEQ ID NO: 159236 - RNA, 32 nt, Human
gaggagcagggguccagagaggcaggcugggg

SEQ ID NO: 159237 - RNA, 32 nt, Human
gaggagcaguagcccgcggagcagggagagaa

SEQ ID NO: 159238 - RNA, 23 nt, Human
gaggagcaucucugaggguucua

SEQ ID NO: 159239 - RNA, 19 nt, Human
gaggagccaccucuucuca

SEQ ID NO: 159240 - RNA, 32 nt, Human
gaggagccacuccuauucccagcugauucuuu

SEQ ID NO: 159241 - RNA, 32 nt, Human
gaggagccacuucugaauucagaguaggacug

SEQ ID NO: 159242 - RNA, 32 nt, Human
gaggagccagagcagggugagcuggagcggcu

SEQ ID NO: 159243 - RNA, 32 nt, Human
gaggagccagagguuggcuuucugggauguga

SEQ ID NO: 159244 - RNA, 32 nt, Human
gaggagccagcaggcaggggagagggagcggg

SEQ ID NO: 159245 - RNA, 32 nt, Human
gaggagccaguguugcaugaugaaaagauggu

SEQ ID NO: 159246 - RNA, 32 nt, Human
gaggagccaucuccuggaggagaaaacucacc

SEQ ID NO: 159247 - RNA, 32 nt, Human
gaggagcccgcccugcacuaucagccucgaga

SEQ ID NO: 159248 - RNA, 32 nt, Human
gaggagcccgggcuauccuucccugaaggagc

SEQ ID NO: 159249 - RNA, 32 nt, Human
gaggagcccgggucaggcuggggaggaacaga

SEQ ID NO: 159250 - RNA, 24 nt, Human
gaggagcccuaggccagccuggga

SEQ ID NO: 159251 - RNA, 32 nt, Human
gaggagcccucagacagcaguggcaucaacuu

SEQ ID NO: 159252 - RNA, 32 nt, Human
gaggagcccuccauuccaauuguccaccccuu

SEQ ID NO: 159253 - RNA, 32 nt, Human
gaggagcccugagaguccgccgccaacgcgca

SEQ ID NO: 159254 - RNA, 32 nt, Human
gaggagcccugccucuccgccccugagcccac

SEQ ID NO: 159255 - RNA, 32 nt, Human
gaggagcccugccugccccgacacccagccca

SEQ ID NO: 159256 - RNA, 32 nt, Human
gaggagccggaggaggaggaggaggaggaggc

SEQ ID NO: 159257 - RNA, 21 nt, Human
gaggagccgggagcccugggg

SEQ ID NO: 159258 - RNA, 26 nt, Human
gaggagccgggccgaggccgcggcgg

SEQ ID NO: 159259 - RNA, 18 nt, Human
gaggagccggggugcucu

SEQ ID NO: 159260 - RNA, 19 nt, Human
gaggagccggggugcucug

SEQ ID NO: 159261 - RNA, 32 nt, Human
gaggagccugcaggaagcugaacuuugaaaga

SEQ ID NO: 159262 - RNA, 32 nt, Human
gaggagccuggcuuagaaucucagccugaaau

SEQ ID NO: 159263 - RNA, 32 nt, Human
gaggagccugugagccaccggcccacgugaaa

SEQ ID NO: 159264 - RNA, 22 nt, Human
gaggagccuugccuugaguucc

SEQ ID NO: 159265 - RNA, 32 nt, Human
gaggagccuuuccagaacuaccaaaaugaaga

SEQ ID NO: 159266 - RNA, 20 nt, Human
gaggagcgauggggacucug

SEQ ID NO: 159267 - RNA, 23 nt, Human
gaggagcgauuugccaucgugcu

SEQ ID NO: 159268 - RNA, 20 nt, Human
gaggagcgcgaacccgcggc

SEQ ID NO: 159269 - RNA, 23 nt, Human
gaggagcgcgcuuccuuuccucc

SEQ ID NO: 159270 - RNA, 32 nt, Human
gaggagcgcuggcugcgcuuaggcaacguucc

SEQ ID NO: 159271 - RNA, 21 nt, Human
gaggagcggccgggccugggg

SEQ ID NO: 159272 - RNA, 20 nt, Human
gaggagcggcgcccgcgggg

SEQ ID NO: 159273 - RNA, 32 nt, Human
gaggagcggcgggagagccaggagggccgccc

SEQ ID NO: 159274 - RNA, 22 nt, Human
gaggagcggcugggcuggggga

SEQ ID NO: 159275 - RNA, 21 nt, Human
gaggagcgggaaccgcggcgg

SEQ ID NO: 159276 - RNA, 25 nt, Human
gaggagcgggaacuggggaauucug

SEQ ID NO: 159277 - RNA, 20 nt, Human
gaggagcgggcgcgcggcgg

SEQ ID NO: 159278 - RNA, 32 nt, Human
gaggagcggggguggagccgggggaagggugg

SEQ ID NO: 159279 - RNA, 32 nt, Human
gaggagcgucucucccuggccgccccgucuga

SEQ ID NO: 159280 - RNA, 32 nt, Human
gaggagcuacacuucccucccuuagugcccgg

SEQ ID NO: 159281 - RNA, 32 nt, Human
gaggagcuacagcccugugcucccgggacccu

SEQ ID NO: 159282 - RNA, 32 nt, Human
gaggagcuagaugacaccaagacacagacacg

SEQ ID NO: 159283 - RNA, 32 nt, Human
gaggagcucucccggcugcaccggcuggagac

SEQ ID NO: 159284 - RNA, 32 nt, Human
gaggagcucugagaacagucuccuucaacagu

SEQ ID NO: 159285 - RNA, 19 nt, Human
gaggagcugaaaaugcaga

SEQ ID NO: 159286 - RNA, 32 nt, Human
gaggagcugaacuugcucaaucuaaggcugau

SEQ ID NO: 159287 - RNA, 19 nt, Human
gaggagcugacacauuuca

SEQ ID NO: 159288 - RNA, 22 nt, Human
gaggagcugagagaagugcucu

SEQ ID NO: 159289 - RNA, 32 nt, Human
gaggagcugagggggaacaggagcagggccac

SEQ ID NO: 159290 - RNA, 32 nt, Human
gaggagcugagugccccaggagcuaguggagg

SEQ ID NO: 159291 - RNA, 19 nt, Human
gaggagcugccaggccugg

SEQ ID NO: 159292 - RNA, 32 nt, Human
gaggagcugccuucggaggcucagggaguccc

SEQ ID NO: 159293 - RNA, 32 nt, Human
gaggagcugcucuuaugaagaagaaccaugaa

SEQ ID NO: 159294 - RNA, 18 nt, Human
gaggagcugcugcugcug

SEQ ID NO: 159295 - RNA, 32 nt, Human
gaggagcuggcgugggagaccgacggccgcug

SEQ ID NO: 159296 - RNA, 20 nt, Human
gaggagcugggaccgcggcg

SEQ ID NO: 159297 - RNA, 19 nt, Human
gaggagcugggauugcagg

SEQ ID NO: 159298 - RNA, 32 nt, Human
gaggagcugucggcugcuuuccauccagcugg

SEQ ID NO: 159299 - RNA, 32 nt, Human
gaggagcugugggaagggggaggagggaggga

SEQ ID NO: 159300 - RNA, 32 nt, Human
gaggagcugugguccagccugcgcggcgggaa

SEQ ID NO: 159301 - RNA, 32 nt, Human
gaggagcuguuggccugggugggcaggaacug

SEQ ID NO: 159302 - RNA, 32 nt, Human
gaggagcuucuaaagaggugacugguauuuug

SEQ ID NO: 159303 - RNA, 32 nt, Human
gaggagcuuuacucuucucucucuuacacaau

SEQ ID NO: 159304 - RNA, 32 nt, Human
gaggaggaaaagagcaucucagagcgccggga

SEQ ID NO: 159305 - RNA, 23 nt, Human
gaggaggaaacugaggcagggac

SEQ ID NO: 159306 - RNA, 21 nt, Human
gaggaggaaagccuccuaauu

SEQ ID NO: 159307 - RNA, 32 nt, Human
gaggaggaaaggaaggagagagaugccucagg

SEQ ID NO: 159308 - RNA, 22 nt, Human
gaggaggaaaggggagaggaac

SEQ ID NO: 159309 - RNA, 32 nt, Human
gaggaggaaauuuggaaauacagugaauauau

SEQ ID NO: 159310 - RNA, 32 nt, Human
gaggaggaacagaaaagaaaagaaaagaaaaa

SEQ ID NO: 159311 - RNA, 32 nt, Human
gaggaggaaccaggcuacuuuccccaguacug

SEQ ID NO: 159312 - RNA, 22 nt, Human
gaggaggaacuccuccccaacu

SEQ ID NO: 159313 - RNA, 32 nt, Human
gaggaggaagaaaaacaggccgagugaaggug

SEQ ID NO: 159314 - RNA, 32 nt, Human
gaggaggaagaaaaugaagaaggagugauuga

SEQ ID NO: 159315 - RNA, 32 nt, Human
gaggaggaagaaaaugagagugggaaggacgc

SEQ ID NO: 159316 - RNA, 32 nt, Human
gaggaggaagaagaggaggaggaggagauggu

SEQ ID NO: 159317 - RNA, 32 nt, Human
gaggaggaagaagaggaggaggaggaggagga

SEQ ID NO: 159318 - RNA, 32 nt, Human
gaggaggaagaagaggaggagggaggaagaaa

SEQ ID NO: 159319 - RNA, 32 nt, Human
gaggaggaagagagggagggaggcgggaggag

SEQ ID NO: 159320 - RNA, 32 nt, Human
gaggaggaagaggagaaggaaaagugacgaag

SEQ ID NO: 159321 - RNA, 32 nt, Human
gaggaggaagaggaggaggaggaagggagcac

SEQ ID NO: 159322 - RNA, 32 nt, Human
gaggaggaagaggggauggagcaggggcugga

SEQ ID NO: 159323 - RNA, 32 nt, Human
gaggaggaagaucaggaggaggaggaagaaga

SEQ ID NO: 159324 - RNA, 32 nt, Human
gaggaggaagauggacuuucagaggagugcga

SEQ ID NO: 159325 - RNA, 32 nt, Human
gaggaggaaggaagaaauggagauuagauugg

SEQ ID NO: 159326 - RNA, 32 nt, Human
gaggaggaaggaggaucacuguggaaaucguc

SEQ ID NO: 159327 - RNA, 19 nt, Human
gaggaggaaggcggcggcg

SEQ ID NO: 159328 - RNA, 32 nt, Human
gaggaggaaggggacagagggagcagguagga

SEQ ID NO: 159329 - RNA, 32 nt, Human
gaggaggaagugagacggggaagggaggagca

SEQ ID NO: 159330 - RNA, 22 nt, Human
gaggaggaaguggcggcggcgg

SEQ ID NO: 159331 - RNA, 32 nt, Human
gaggaggaaugagaggggcaggaagugggguc

SEQ ID NO: 159332 - RNA, 32 nt, Human
gaggaggaaugaggauggguuggggagcgggg

SEQ ID NO: 159333 - RNA, 20 nt, Human
gaggaggacaaagacggcgg

SEQ ID NO: 159334 - RNA, 22 nt, Human
gaggaggacaaagauaaggugg

SEQ ID NO: 159335 - RNA, 19 nt, Human
gaggaggacaacucggacg

SEQ ID NO: 159336 - RNA, 21 nt, Human
gaggaggacaagcggcggcgg

SEQ ID NO: 159337 - RNA, 21 nt, Human
gaggaggacacaggccuggga

SEQ ID NO: 159338 - RNA, 19 nt, Human
gaggaggacagcgccgagg

SEQ ID NO: 159339 - RNA, 20 nt, Human
gaggaggacagggccccggc

SEQ ID NO: 159340 - RNA, 20 nt, Human
gaggaggacaggggcggggg

SEQ ID NO: 159341 - RNA, 20 nt, Human
gaggaggacaucccaugcgg

SEQ ID NO: 159342 - RNA, 32 nt, Human
gaggaggaccccugccuuccucugaggacagg

SEQ ID NO: 159343 - RNA, 32 nt, Human
gaggaggacccgcagagguggcagcggccggg

SEQ ID NO: 159344 - RNA, 19 nt, Human
gaggaggacgacgaggagg

SEQ ID NO: 159345 - RNA, 21 nt, Human
gaggaggacgaggacgacugg

SEQ ID NO: 159346 - RNA, 19 nt, Human
gaggaggacgaggagcugg

SEQ ID NO: 159347 - RNA, 19 nt, Human
gaggaggacgaggaggagg

SEQ ID NO: 159348 - RNA, 21 nt, Human
gaggaggacgaggaugacugg

SEQ ID NO: 159349 - RNA, 22 nt, Human
gaggaggacgagggccuagugg

SEQ ID NO: 159350 - RNA, 18 nt, Human
gaggaggacgcagcggcg

SEQ ID NO: 159351 - RNA, 19 nt, Human
gaggaggacgccgcagagg

SEQ ID NO: 159352 - RNA, 18 nt, Human
gaggaggacgcggcgccg

SEQ ID NO: 159353 - RNA, 32 nt, Human
gaggaggacgcgggccugguggccgaggccga

SEQ ID NO: 159354 - RNA, 21 nt, Human
gaggaggacgggcggacggcg

SEQ ID NO: 159355 - RNA, 32 nt, Human
gaggaggacgugggggcugcaaguggaaagcu

SEQ ID NO: 159356 - RNA, 19 nt, Human
gaggaggacuacauggcgg

SEQ ID NO: 159357 - RNA, 20 nt, Human
gaggaggacucagugcuggc

SEQ ID NO: 159358 - RNA, 19 nt, Human
gaggaggacuccacggugg

SEQ ID NO: 159359 - RNA, 20 nt, Human
gaggaggacugacacggagg

SEQ ID NO: 159360 - RNA, 19 nt, Human
gaggaggacuuccugcggc

SEQ ID NO: 159361 - RNA, 21 nt, Human
gaggaggacuuggagggucug

SEQ ID NO: 159362 - RNA, 19 nt, Human
gaggaggacuuucugcggc

SEQ ID NO: 159363 - RNA, 32 nt, Human
gaggaggagaagcaggggcaggagcggugagg

SEQ ID NO: 159364 - RNA, 32 nt, Human
gaggaggagaaggaggaggaggaagaggagga

SEQ ID NO: 159365 - RNA, 32 nt, Human
gaggaggagaaggaggaggaggagagcgcgag

SEQ ID NO: 159366 - RNA, 32 nt, Human
gaggaggagagaaaggcggcucuucccgugcc

SEQ ID NO: 159367 - RNA, 32 nt, Human
gaggaggagaggaggaaaggaugggggcugaa

SEQ ID NO: 159368 - RNA, 32 nt, Human
gaggaggagaggaggaggggaggagaaggagg

SEQ ID NO: 159369 - RNA, 32 nt, Human
gaggaggagagggaguagaaaggagggaugcg

SEQ ID NO: 159370 - RNA, 32 nt, Human
gaggaggagaugggcaggauuuaguaggacaa

SEQ ID NO: 159371 - RNA, 32 nt, Human
gaggaggagcagagggccuaggaggaccccgg

SEQ ID NO: 159372 - RNA, 18 nt, Human
gaggaggagcccgggcgg

SEQ ID NO: 159373 - RNA, 16 nt, Human
gaggaggagcgccuga

SEQ ID NO: 159374 - RNA, 32 nt, Human
gaggaggagcgcuacccaccuccagggagcac

SEQ ID NO: 159375 - RNA, 32 nt, Human
gaggaggagcugaaaaugcagauuuagcauca

SEQ ID NO: 159376 - RNA, 32 nt, Human
gaggaggagcuggagacaggagggugggagca

SEQ ID NO: 159377 - RNA, 32 nt, Human
gaggaggaggaaaaggagggaaaggggacagg

SEQ ID NO: 159378 - RNA, 32 nt, Human
gaggaggaggaagaggaggagaagguagcuac

SEQ ID NO: 159379 - RNA, 32 nt, Human
gaggaggaggaagaggaggaggaggaagggag

SEQ ID NO: 159380 - RNA, 32 nt, Human
gaggaggaggagaaggaggagagagaggggaa

SEQ ID NO: 159381 - RNA, 32 nt, Human
gaggaggaggagaaggaggaggaggaagagga

SEQ ID NO: 159382 - RNA, 32 nt, Human
gaggaggaggagaaggaggagggcagcuccuu

SEQ ID NO: 159383 - RNA, 32 nt, Human
gaggaggaggagagaggaaagagcggagcagc

SEQ ID NO: 159384 - RNA, 32 nt, Human
gaggaggaggagaugggauagcuuaagcaagu

SEQ ID NO: 159385 - RNA, 32 nt, Human
gaggaggaggaggagaugacuggggagcggga

SEQ ID NO: 159386 - RNA, 32 nt, Human
gaggaggaggaggaggaagagguggaggagga

SEQ ID NO: 159387 - RNA, 32 nt, Human
gaggaggaggaggaggagaggagcagucagca

SEQ ID NO: 159388 - RNA, 32 nt, Human
gaggaggaggaggaggaggagaaggcucuggg

SEQ ID NO: 159389 - RNA, 32 nt, Human
gaggaggaggaggaggaggaggaagagggcag

SEQ ID NO: 159390 - RNA, 32 nt, Human
gaggaggaggaggaggaggaggacgcgggccu

SEQ ID NO: 159391 - RNA, 32 nt, Human
gaggaggaggaggaggaggaggagagcgcggg

SEQ ID NO: 159392 - RNA, 32 nt, Human
gaggaggaggaggaggaggaggaggaggagga

SEQ ID NO: 159393 - RNA, 32 nt, Human
gaggaggaggaggaggaggaggaggaggaggc

SEQ ID NO: 159394 - RNA, 32 nt, Human
gaggaggaggaggaggaggaggaggaggcggc

SEQ ID NO: 159395 - RNA, 32 nt, Human
gaggaggaggaggaggaggaggaggagggggc

SEQ ID NO: 159396 - RNA, 32 nt, Human
gaggaggaggaggaggaggaggaggccagguc

SEQ ID NO: 159397 - RNA, 32 nt, Human
gaggaggaggaggaggaggaggaggcggcggc

SEQ ID NO: 159398 - RNA, 32 nt, Human
gaggaggaggaggaggaggaggagggggcggc

SEQ ID NO: 159399 - RNA, 32 nt, Human
gaggaggaggaggaggaggaggagguggcggc

SEQ ID NO: 159400 - RNA, 32 nt, Human
gaggaggaggaggaggaggaggcaaaguuaga

SEQ ID NO: 159401 - RNA, 32 nt, Human
gaggaggaggaggaggaggaggccagguccug

SEQ ID NO: 159402 - RNA, 32 nt, Human
gaggaggaggaggaggaggagggggccgagaa

SEQ ID NO: 159403 - RNA, 32 nt, Human
gaggaggaggaggaggaggaggucguggauga

SEQ ID NO: 159404 - RNA, 32 nt, Human
gaggaggaggaggaggaggcagcuccggcagc

SEQ ID NO: 159405 - RNA, 32 nt, Human
gaggaggaggaggagguugcagugagccgaga

SEQ ID NO: 159406 - RNA, 32 nt, Human
gaggaggaggaggcggaggaggcgguggaggg

SEQ ID NO: 159407 - RNA, 32 nt, Human
gaggaggaggagguggcggcgagaagauggcg

SEQ ID NO: 159408 - RNA, 32 nt, Human
gaggaggaggcagagaggaguggagggcggag

SEQ ID NO: 159409 - RNA, 32 nt, Human
gaggaggaggcaggagaagcaggcagccugcc

SEQ ID NO: 159410 - RNA, 20 nt, Human
gaggaggaggcccggggcgg

SEQ ID NO: 159411 - RNA, 32 nt, Human
gaggaggaggcgaacccagagaggggcagcaa

SEQ ID NO: 159412 - RNA, 32 nt, Human
gaggaggaggcgaggaggagagacugcuccau

SEQ ID NO: 159413 - RNA, 32 nt, Human
gaggaggaggcggaggaggaggagcaugucgg

SEQ ID NO: 159414 - RNA, 19 nt, Human
gaggaggaggcggcggcgg

SEQ ID NO: 159415 - RNA, 32 nt, Human
gaggaggaggcugagagagggagggcgacggg

SEQ ID NO: 159416 - RNA, 23 nt, Human
gaggaggaggcugcagugagcua

SEQ ID NO: 159417 - RNA, 32 nt, Human
gaggaggagggaaaaggcgagcaaaaaggaag

SEQ ID NO: 159418 - RNA, 32 nt, Human
gaggaggagggaggaggaagagagggagggag

SEQ ID NO: 159419 - RNA, 32 nt, Human
gaggaggagggagggagggaaggagcgcggag

SEQ ID NO: 159420 - RNA, 32 nt, Human
gaggaggagggggaagaggagugggacgauga

SEQ ID NO: 159421 - RNA, 32 nt, Human
gaggaggagggugagagagaagcugggagagc

SEQ ID NO: 159422 - RNA, 20 nt, Human
gaggaggaggucaucgacgg

SEQ ID NO: 159423 - RNA, 21 nt, Human
gaggaggaggugcggcggcgg

SEQ ID NO: 159424 - RNA, 32 nt, Human
gaggaggagguggagcaggaguggggagagag

SEQ ID NO: 159425 - RNA, 21 nt, Human
gaggaggagguggaggaggag

SEQ ID NO: 159426 - RNA, 32 nt, Human
gaggaggagguggaggaggagagguggcagga

SEQ ID NO: 159427 - RNA, 32 nt, Human
gaggaggagguggauguggcagcugagaucua

SEQ ID NO: 159428 - RNA, 32 nt, Human
gaggaggaggugggggcuggaggugcugguag

SEQ ID NO: 159429 - RNA, 32 nt, Human
gaggaggagguguucaucugcaccacagagag

SEQ ID NO: 159430 - RNA, 19 nt, Human
gaggaggagguugcaguga

SEQ ID NO: 159431 - RNA, 32 nt, Human
gaggaggaguuagaggaggaggaggaggagga

SEQ ID NO: 159432 - RNA, 32 nt, Human
gaggaggaguuucuauuaaaaucugucacuug

SEQ ID NO: 159433 - RNA, 32 nt, Human
gaggaggaucagaucuccgcucgagaaucuga

SEQ ID NO: 159434 - RNA, 32 nt, Human
gaggaggauggagagaaugugcuaccauggaa

SEQ ID NO: 159435 - RNA, 32 nt, Human
gaggaggauucugccuuuccuccagugccaug

SEQ ID NO: 159436 - RNA, 18 nt, Human
gaggaggcaagauacaac

SEQ ID NO: 159437 - RNA, 22 nt, Human
gaggaggcaaggcccacggugg

SEQ ID NO: 159438 - RNA, 24 nt, Human
gaggaggcaccggccgcgcggcgg

SEQ ID NO: 159439 - RNA, 32 nt, Human
gaggaggcaccugggagcugagcuuaagaguu

SEQ ID NO: 159440 - RNA, 16 nt, Human
gaggaggcagacagga

SEQ ID NO: 159441 - RNA, 32 nt, Human
gaggaggcagagaagaaagaacggaagaagag

SEQ ID NO: 159442 - RNA, 32 nt, Human
gaggaggcagagccaugaccaaggggaccugg

SEQ ID NO: 159443 - RNA, 32 nt, Human
gaggaggcaggagagagggaaaaagaaaagaa

SEQ ID NO: 159444 - RNA, 32 nt, Human
gaggaggcaggcaagaggggguggaggcgcca

SEQ ID NO: 159445 - RNA, 21 nt, Human
gaggaggcaguuagggaaacu

SEQ ID NO: 159446 - RNA, 23 nt, Human
gaggaggcaugaagagguaacug

SEQ ID NO: 159447 - RNA, 32 nt, Human
gaggaggccagaccugcccugccccauugucc

SEQ ID NO: 159448 - RNA, 32 nt, Human
gaggaggccagcugguaggcagccuggugagg

SEQ ID NO: 159449 - RNA, 32 nt, Human
gaggaggccccagcucccuaggggcugagaag

SEQ ID NO: 159450 - RNA, 22 nt, Human
gaggaggccgacugggcugcug

SEQ ID NO: 159451 - RNA, 32 nt, Human
gaggaggccgagagaugaggccggagcccacc

SEQ ID NO: 159452 - RNA, 22 nt, Human
gaggaggccgagggccccagga

SEQ ID NO: 159453 - RNA, 32 nt, Human
gaggaggccgcaggcaggugguucagugguua

SEQ ID NO: 159454 - RNA, 22 nt, Human
gaggaggccgccggucccaacc

SEQ ID NO: 159455 - RNA, 32 nt, Human
gaggaggccguguuacaaacccugcgcggagc

SEQ ID NO: 159456 - RNA, 32 nt, Human
gaggaggccugaguuccgucauggcccucuau

SEQ ID NO: 159457 - RNA, 22 nt, Human
gaggaggcgagggacagagaca

SEQ ID NO: 159458 - RNA, 32 nt, Human
gaggaggcgcgcuaguggacuggaccucagcg

SEQ ID NO: 159459 - RNA, 21 nt, Human
gaggaggcgcggccagggcgg

SEQ ID NO: 159460 - RNA, 18 nt, Human
gaggaggcggaaaaggac

SEQ ID NO: 159461 - RNA, 32 nt, Human
gaggaggcggagcaucuugaaccugcagcccu

SEQ ID NO: 159462 - RNA, 32 nt, Human
gaggaggcggaggaggaggagcaugucggacg

SEQ ID NO: 159463 - RNA, 32 nt, Human
gaggaggcggaggcagcggcuggaggagcgcg

SEQ ID NO: 159464 - RNA, 21 nt, Human
gaggaggcggaggccgcggcg

SEQ ID NO: 159465 - RNA, 19 nt, Human
gaggaggcggcagacagga

SEQ ID NO: 159466 - RNA, 21 nt, Human
gaggaggcggcagacaggagc

SEQ ID NO: 159467 - RNA, 19 nt, Human
gaggaggcggcagcggcgg

SEQ ID NO: 159468 - RNA, 19 nt, Human
gaggaggcggcauugcuuu

SEQ ID NO: 159469 - RNA, 17 nt, Human
gaggaggcggccacggc

SEQ ID NO: 159470 - RNA, 19 nt, Human
gaggaggcggcggcggcgg

SEQ ID NO: 159471 - RNA, 32 nt, Human
gaggaggcgguggugucagcacugcugcagug

SEQ ID NO: 159472 - RNA, 32 nt, Human
gaggaggcucagacagcaggaaggagagaagg

SEQ ID NO: 159473 - RNA, 19 nt, Human
gaggaggcuccuggugucu

SEQ ID NO: 159474 - RNA, 32 nt, Human
gaggaggcugaaaugaugcaucagauuuacag

SEQ ID NO: 159475 - RNA, 32 nt, Human
gaggaggcugcgacugcggaccccagauucgu

SEQ ID NO: 159476 - RNA, 32 nt, Human
gaggaggcuggcagagcuggggacugagggca

SEQ ID NO: 159477 - RNA, 32 nt, Human
gaggaggcuguggcuguaguugaagaucugga

SEQ ID NO: 159478 - RNA, 32 nt, Human
gaggaggcuguuauuuugggccugaugugaca

SEQ ID NO: 159479 - RNA, 32 nt, Human
gaggaggcuuugacugggcugccugccuguga

SEQ ID NO: 159480 - RNA, 32 nt, Human
gaggagggaaaggcagucagauuccaggcugg

SEQ ID NO: 159481 - RNA, 32 nt, Human
gaggagggaagaggaagaggcaaggggagggu

SEQ ID NO: 159482 - RNA, 32 nt, Human
gaggagggacccuggucucccucuuuggcuac

SEQ ID NO: 159483 - RNA, 31 nt, Human
gaggagggaccuacaaagacuggaaacuauu

SEQ ID NO: 159484 - RNA, 32 nt, Human
gaggagggaccuacaaagacuggaaacuauuc

SEQ ID NO: 159485 - RNA, 32 nt, Human
gaggagggagaagcucuggggagccagcuuug

SEQ ID NO: 159486 - RNA, 32 nt, Human
gaggagggagagaaggaggccgccagacucga

SEQ ID NO: 159487 - RNA, 32 nt, Human
gaggagggagagaaggagggaggcgcuccugg

SEQ ID NO: 159488 - RNA, 18 nt, Human
gaggagggagagggggag

SEQ ID NO: 159489 - RNA, 20 nt, Human
gaggagggagcccgcggcgg

SEQ ID NO: 159490 - RNA, 32 nt, Human
gaggagggaggaacagucagccacagcucucu

SEQ ID NO: 159491 - RNA, 32 nt, Human
gaggagggaggcaggaggugagguuggaaguu

SEQ ID NO: 159492 - RNA, 19 nt, Human
gaggagggaggccaggcgg

SEQ ID NO: 159493 - RNA, 19 nt, Human
gaggagggaggccgggcgg

SEQ ID NO: 159494 - RNA, 32 nt, Human
gaggagggagggagggacaggugccuggagcc

SEQ ID NO: 159495 - RNA, 32 nt, Human
gaggagggagggggaaguggagaggggagcau

SEQ ID NO: 159496 - RNA, 32 nt, Human
gaggagggaggugcugugagccuagcgagaug

SEQ ID NO: 159497 - RNA, 23 nt, Human
gaggagggauggagccgcugaga

SEQ ID NO: 159498 - RNA, 32 nt, Human
gaggagggcaaaucacuugagcucaggaguuu

SEQ ID NO: 159499 - RNA, 32 nt, Human
gaggagggcagaucaacugaggucaggaguuu

SEQ ID NO: 159500 - RNA, 22 nt, Human
gaggagggcagaucacgagguc

SEQ ID NO: 159501 - RNA, 32 nt, Human
gaggagggcagaucacuugagaucaggaguuc

SEQ ID NO: 159502 - RNA, 22 nt, Human
gaggagggcaggagccgcggga

SEQ ID NO: 159503 - RNA, 32 nt, Human
gaggagggcaggcagagucgguggccagucug

SEQ ID NO: 159504 - RNA, 32 nt, Human
gaggagggcaucaccuucccagugggaaaagg

SEQ ID NO: 159505 - RNA, 19 nt, Human
gaggagggccaugccgcug

SEQ ID NO: 159506 - RNA, 23 nt, Human
gaggagggccccagcaguucugg

SEQ ID NO: 159507 - RNA, 20 nt, Human
gaggagggccccagcgagga

SEQ ID NO: 159508 - RNA, 22 nt, Human
gaggagggcccccagccuggga

SEQ ID NO: 159509 - RNA, 21 nt, Human
gaggagggccgagacaggagc

SEQ ID NO: 159510 - RNA, 18 nt, Human
gaggagggccggcggcgg

SEQ ID NO: 159511 - RNA, 32 nt, Human
gaggagggcguucccaggaggagggagugaug

SEQ ID NO: 159512 - RNA, 21 nt, Human
gaggagggcuaugcacuggga

SEQ ID NO: 159513 - RNA, 32 nt, Human
gaggagggcucugggcugaggagcucaguggg

SEQ ID NO: 159514 - RNA, 20 nt, Human
gaggagggcuggacaagaau

SEQ ID NO: 159515 - RNA, 32 nt, Human
gaggagggcuggaggcagagaguguaagugug

SEQ ID NO: 159516 - RNA, 32 nt, Human
gaggagggcuggagggacaggagggcggauca

SEQ ID NO: 159517 - RNA, 32 nt, Human
gaggagggcuguguguugcugccugagggcac

SEQ ID NO: 159518 - RNA, 32 nt, Human
gaggaggggaaagagaagcccagacaaacagc

SEQ ID NO: 159519 - RNA, 32 nt, Human
gaggaggggaaagagcugcuggcggucgggag

SEQ ID NO: 159520 - RNA, 32 nt, Human
gaggaggggagagagaaagagagguggggaga

SEQ ID NO: 159521 - RNA, 32 nt, Human
gaggaggggagaggagaagggaaauggaggug

SEQ ID NO: 159522 - RNA, 32 nt, Human
gaggaggggagaggagaggaaagugggaggag

SEQ ID NO: 159523 - RNA, 32 nt, Human
gaggaggggaggacuugccucgccgaggccgc

SEQ ID NO: 159524 - RNA, 32 nt, Human
gaggaggggaggaggaggaggaggaggagguc

SEQ ID NO: 159525 - RNA, 32 nt, Human
gaggaggggaggugcagggaagaggggccggc

SEQ ID NO: 159526 - RNA, 32 nt, Human
gaggaggggagguggaagaauuauaaugguac

SEQ ID NO: 159527 - RNA, 32 nt, Human
gaggaggggaugggagaaaguaggggaugugg

SEQ ID NO: 159528 - RNA, 32 nt, Human
gaggaggggcaaaggccgcgcuccucagcugg

SEQ ID NO: 159529 - RNA, 22 nt, Human
gaggaggggcagagaccuggga

SEQ ID NO: 159530 - RNA, 19 nt, Human
gaggaggggccgcgggcgg

SEQ ID NO: 159531 - RNA, 32 nt, Human
gaggaggggccgcugccacccaccucccugcc

SEQ ID NO: 159532 - RNA, 20 nt, Human
gaggaggggccggcccgcgg

SEQ ID NO: 159533 - RNA, 32 nt, Human
gaggagggggaagaggaggaggaggcugugga

SEQ ID NO: 159534 - RNA, 32 nt, Human
gaggagggggaagaggaggaggagguuguuga

SEQ ID NO: 159535 - RNA, 32 nt, Human
gaggagggggaggaagaggagguggagaagga

SEQ ID NO: 159536 - RNA, 32 nt, Human
gaggagggggaugcagaggugaugcagcuggg

SEQ ID NO: 159537 - RNA, 32 nt, Human
gaggagggggccugagacuggaccugggucug

SEQ ID NO: 159538 - RNA, 18 nt, Human
gaggaggggggcggggag

SEQ ID NO: 159539 - RNA, 32 nt, Human
gaggagggguacagggcucucaagccugaggu

SEQ ID NO: 159540 - RNA, 32 nt, Human
gaggagggguggcagaggauuguuuggccagg

SEQ ID NO: 159541 - RNA, 32 nt, Human
gaggaggguagggagagaagcugagaccagga

SEQ ID NO: 159542 - RNA, 32 nt, Human
gaggagggucugcagccaguucauucccaggg

SEQ ID NO: 159543 - RNA, 32 nt, Human
gaggagggucugugauacaucacaaggaggaa

SEQ ID NO: 159544 - RNA, 31 nt, Human
gaggagggugagagagaagcugggagagcag

SEQ ID NO: 159545 - RNA, 22 nt, Human
gaggaggguggaucacgagguc

SEQ ID NO: 159546 - RNA, 32 nt, Human
gaggagggugggccaugaggagaagaugcugu

SEQ ID NO: 159547 - RNA, 23 nt, Human
gaggagggugugaagccuugaga

SEQ ID NO: 159548 - RNA, 20 nt, Human
gaggagguaaacauuggaga

SEQ ID NO: 159549 - RNA, 19 nt, Human
gaggagguagaauugcaga

SEQ ID NO: 159550 - RNA, 32 nt, Human
gaggagguagugcuguaggcccagggggucag

SEQ ID NO: 159551 - RNA, 32 nt, Human
gaggaggucgaggcgcacagggcaagcaggaa

SEQ ID NO: 159552 - RNA, 21 nt, Human
gaggaggucucagucccagcc

SEQ ID NO: 159553 - RNA, 16 nt, Human
gaggaggucugggaga

SEQ ID NO: 159554 - RNA, 17 nt, Human
gaggaggucuggugaga

SEQ ID NO: 159555 - RNA, 18 nt, Human
gaggaggugaauauuuca

SEQ ID NO: 159556 - RNA, 32 nt, Human
gaggaggugagaggagaggaaggagaaaacug

SEQ ID NO: 159557 - RNA, 20 nt, Human
gaggagguggaacccgcggc

SEQ ID NO: 159558 - RNA, 21 nt, Human
gaggagguggaacccgcggcg

SEQ ID NO: 159559 - RNA, 19 nt, Human
gaggagguggagaaggagg

SEQ ID NO: 159560 - RNA, 21 nt, Human
gaggagguggaggaggaggag

SEQ ID NO: 159561 - RNA, 32 nt, Human
gaggagguggaggaggaggaggaagaucagga

SEQ ID NO: 159562 - RNA, 32 nt, Human
gaggagguggaggaggaggaggaggaggagga

SEQ ID NO: 159563 - RNA, 32 nt, Human
gaggagguggcauccaccagcccaggcaucga

SEQ ID NO: 159564 - RNA, 32 nt, Human
gaggaggugggaacagaagagagaaggaggca

SEQ ID NO: 159565 - RNA, 32 nt, Human
gaggaggugggccggcacacagcuccagugcu

SEQ ID NO: 159566 - RNA, 32 nt, Human
gaggagguggguggaggcaugcaggggagacg

SEQ ID NO: 159567 - RNA, 16 nt, Human
gaggaggugguggaga

SEQ ID NO: 159568 - RNA, 18 nt, Human
gaggagguucgagaggac

SEQ ID NO: 159569 - RNA, 32 nt, Human
gaggagguuucucaccccacagauaacccaag

SEQ ID NO: 159570 - RNA, 32 nt, Human
gaggaguaaaugcagggcuggccaggcgaccu

SEQ ID NO: 159571 - RNA, 20 nt, Human
gaggaguacauggaggacuc

SEQ ID NO: 159572 - RNA, 32 nt, Human
gaggaguacugcagaggucacagggaagucac

SEQ ID NO: 159573 - RNA, 32 nt, Human
gaggaguacugcagaggucacagggaagucag

SEQ ID NO: 159574 - RNA, 32 nt, Human
gaggaguacuugagcccaggaguucgagguua

SEQ ID NO: 159575 - RNA, 32 nt, Human
gaggaguaggagccggucucccagaaggcgga

SEQ ID NO: 159576 - RNA, 32 nt, Human
gaggaguagggugggagggaacgacagagacg

SEQ ID NO: 159577 - RNA, 32 nt, Human
gaggagucaggcuuaaaacuuguuggagggga

SEQ ID NO: 159578 - RNA, 32 nt, Human
gaggagucauguuggagguuggggaagaaccu

SEQ ID NO: 159579 - RNA, 32 nt, Human
gaggaguccagggagaggcgggaucacggccc

SEQ ID NO: 159580 - RNA, 32 nt, Human
gaggaguccuuuccucucugccugcccuuucc

SEQ ID NO: 159581 - RNA, 31 nt, Human
gaggaguccuuuucugaguagaguccacaga

SEQ ID NO: 159582 - RNA, 32 nt, Human
gaggagucgccgcugccgccacugccugugcu

SEQ ID NO: 159583 - RNA, 32 nt, Human
gaggagucucagagcaaggugcguucuagaug

SEQ ID NO: 159584 - RNA, 32 nt, Human
gaggagucuguggcuuuuuguucagaauuaag

SEQ ID NO: 159585 - RNA, 21 nt, Human
gaggagugaaagcgccuaggg

SEQ ID NO: 159586 - RNA, 32 nt, Human
gaggagugacuucucccucucuuccaguccug

SEQ ID NO: 159587 - RNA, 24 nt, Human
gaggagugagcagagggucuggga

SEQ ID NO: 159588 - RNA, 22 nt, Human
gaggagugagcaggccccgggg

SEQ ID NO: 159589 - RNA, 22 nt, Human
gaggagugagggaacccugggg

SEQ ID NO: 159590 - RNA, 19 nt, Human
gaggagugaggucaccugg

SEQ ID NO: 159591 - RNA, 32 nt, Human
gaggagugagguggcucuggccucccauguca

SEQ ID NO: 159592 - RNA, 32 nt, Human
gaggagugagugugcauguugucaaaguuucu

SEQ ID NO: 159593 - RNA, 22 nt, Human
gaggagugcacagccccagcca

SEQ ID NO: 159594 - RNA, 32 nt, Human
gaggagugcccaggagagauggugaaaaugac

SEQ ID NO: 159595 - RNA, 21 nt, Human
gaggagugcuuuucuucucaa

SEQ ID NO: 159596 - RNA, 19 nt, Human
gaggaguggaaaugccugg

SEQ ID NO: 159597 - RNA, 32 nt, Human
gaggaguggaaggaaaccgcugccuuuaucuu

SEQ ID NO: 159598 - RNA, 32 nt, Human
gaggaguggaguucucuguucuagagugacag

SEQ ID NO: 159599 - RNA, 32 nt, Human
gaggaguggcaggaaagagggagcaggugccc

SEQ ID NO: 159600 - RNA, 20 nt, Human
gaggaguggcccggcccugg

SEQ ID NO: 159601 - RNA, 31 nt, Human
gaggaguggcuacuggagccguguguuaggc

SEQ ID NO: 159602 - RNA, 23 nt, Human
gaggagugggagaauaaccggga

SEQ ID NO: 159603 - RNA, 23 nt, Human
gaggagugggagggcccagcaag

SEQ ID NO: 159604 - RNA, 21 nt, Human
gaggagugggagggccugagg

SEQ ID NO: 159605 - RNA, 24 nt, Human
gaggagugggcaucaggccuggga

SEQ ID NO: 159606 - RNA, 27 nt, Human
gaggagugggguggugucagacccugg

SEQ ID NO: 159607 - RNA, 32 nt, Human
gaggagugugggcuggcagagagcuucgaggg

SEQ ID NO: 159608 - RNA, 32 nt, Human
gaggagugugugugcacguauucaucugugug

SEQ ID NO: 159609 - RNA, 32 nt, Human
gaggaguguuugagcccaggaguucaaggcca

SEQ ID NO: 159610 - RNA, 32 nt, Human
gaggaguuaaucauucagaccuuuaucagcag

SEQ ID NO: 159611 - RNA, 32 nt, Human
gaggaguuagaggaggaggaggaggaggaaga

SEQ ID NO: 159612 - RNA, 21 nt, Human
gaggaguucucaggccugggg

SEQ ID NO: 159613 - RNA, 32 nt, Human
gaggaguucugaugacccagggguuagggcug

SEQ ID NO: 159614 - RNA, 32 nt, Human
gaggaguucuguugccuuuccugcugcucacc

SEQ ID NO: 159615 - RNA, 32 nt, Human
gaggaguugcuacuggcaucuccuggguggag

SEQ ID NO: 159616 - RNA, 32 nt, Human
gaggaguuuaacgccggaagguggugacuaau

SEQ ID NO: 159617 - RNA, 32 nt, Human
gaggaguuuccccugcugaagagcccugccug

SEQ ID NO: 159618 - RNA, 32 nt, Human
gaggauaacuugaacccaggaguucaagauca

SEQ ID NO: 159619 - RNA, 22 nt, Human
gaggauaagccacugggcacug

SEQ ID NO: 159620 - RNA, 23 nt, Human
gaggauacaaacuggauauuuua

SEQ ID NO: 159621 - RNA, 32 nt, Human
gaggauacacagauagcggauaagcacaugag

SEQ ID NO: 159622 - RNA, 32 nt, Human
gaggauacccagggcaggccucacauagaaaa

SEQ ID NO: 159623 - RNA, 32 nt, Human
gaggauacccuuugacaaacccuguggauaaa

SEQ ID NO: 159624 - RNA, 18 nt, Human
gaggauacucucauccca

SEQ ID NO: 159625 - RNA, 19 nt, Human
gaggauagaacauugcagg

SEQ ID NO: 159626 - RNA, 32 nt, Human
gaggauagcaaucagagguugggcuggcugga

SEQ ID NO: 159627 - RNA, 32 nt, Human
gaggauagcgauuaucucuacuucuccaccuc

SEQ ID NO: 159628 - RNA, 32 nt, Human
gaggauagcgugagcccaggaguuugagacca

SEQ ID NO: 159629 - RNA, 32 nt, Human
gaggauagcuugagcccaggaguucgagacuu

SEQ ID NO: 159630 - RNA, 32 nt, Human
gaggauagcuugagcccaggaguuugaggcua

SEQ ID NO: 159631 - RNA, 32 nt, Human
gaggauaggagaagaggaggaggaggagcggg

SEQ ID NO: 159632 - RNA, 32 nt, Human
gaggauaguuggcuuccugccucucuccucua

SEQ ID NO: 159633 - RNA, 18 nt, Human
gaggauauaaauauuuca

SEQ ID NO: 159634 - RNA, 20 nt, Human
gaggauauagggcguuucca

SEQ ID NO: 159635 - RNA, 32 nt, Human
gaggauaucucuggugcugcuucuguauauuu

SEQ ID NO: 159636 - RNA, 31 nt, Human
gaggauaugcccuccauucuugcugauguau

SEQ ID NO: 159637 - RNA, 21 nt, Human
gaggauauguaaaacauucua

SEQ ID NO: 159638 - RNA, 24 nt, Human
gaggauauucauugugagguucua

SEQ ID NO: 159639 - RNA, 32 nt, Human
gaggauauugcuucucagccuuuuggcuaaga

SEQ ID NO: 159640 - RNA, 21 nt, Human
gaggauauuguaguauuauca

SEQ ID NO: 159641 - RNA, 32 nt, Human
gaggaucaaaguaggcaagauggcgucgagcg

SEQ ID NO: 159642 - RNA, 32 nt, Human
gaggaucaaaugaggggcuccacccacggcaa

SEQ ID NO: 159643 - RNA, 32 nt, Human
gaggaucaacacagauagcacuuccuccagga

SEQ ID NO: 159644 - RNA, 32 nt, Human
gaggaucaagacgaaaaccugcaaugacaacu

SEQ ID NO: 159645 - RNA, 32 nt, Human
gaggaucaauugagcccaggagcucuagacca

SEQ ID NO: 159646 - RNA, 32 nt, Human
gaggaucacaagagcccaggagguugagaaug

SEQ ID NO: 159647 - RNA, 32 nt, Human
gaggaucacaugaacccaggagguugaagcug

SEQ ID NO: 159648 - RNA, 32 nt, Human
gaggaucacaugagcccaggagguugaggcug

SEQ ID NO: 159649 - RNA, 32 nt, Human
gaggaucaccagaggccagcagguccacacca

SEQ ID NO: 159650 - RNA, 32 nt, Human
gaggaucaccugagacuggagauguagaggcu

SEQ ID NO: 159651 - RNA, 32 nt, Human
gaggaucaccugagcccaggaguuugagacua

SEQ ID NO: 159652 - RNA, 32 nt, Human
gaggaucaccugaguccaggaggucgaggcug

SEQ ID NO: 159653 - RNA, 32 nt, Human
gaggaucacugagaccagccugggcaacauag

SEQ ID NO: 159654 - RNA, 32 nt, Human
gaggaucacuggagcccaggaggucaaggcug

SEQ ID NO: 159655 - RNA, 32 nt, Human
gaggaucacuggaguucgaggcugcagugagc

SEQ ID NO: 159656 - RNA, 32 nt, Human
gaggaucacuugaacccaagaggcagaguuug

SEQ ID NO: 159657 - RNA, 32 nt, Human
gaggaucacuugaacccaggagguagaggcug

SEQ ID NO: 159658 - RNA, 32 nt, Human
gaggaucacuugaacccaggagguugaggcug

SEQ ID NO: 159659 - RNA, 32 nt, Human
gaggaucacuugaaccuaggaggcagagguug

SEQ ID NO: 159660 - RNA, 32 nt, Human
gaggaucacuugagcccaggagauugaggcug

SEQ ID NO: 159661 - RNA, 32 nt, Human
gaggaucacuugagcccaggaggucaaggcug

SEQ ID NO: 159662 - RNA, 32 nt, Human
gaggaucacuugagcccaggaggucgaggcug

SEQ ID NO: 159663 - RNA, 32 nt, Human
gaggaucacuugagcccaggaggucgagguug

SEQ ID NO: 159664 - RNA, 32 nt, Human
gaggaucacuugagcccaggaggucuaggcug

SEQ ID NO: 159665 - RNA, 32 nt, Human
gaggaucacuugagcccaggagguggaggcug

SEQ ID NO: 159666 - RNA, 32 nt, Human
gaggaucacuugagcccaggagguugaggcug

SEQ ID NO: 159667 - RNA, 32 nt, Human
gaggaucacuugagcccaggagucugaggcuu

SEQ ID NO: 159668 - RNA, 32 nt, Human
gaggaucacuugagcccaggaguuggagacca

SEQ ID NO: 159669 - RNA, 32 nt, Human
gaggaucacuugagcccaggaguuugagacca

SEQ ID NO: 159670 - RNA, 32 nt, Human
gaggaucacuugagcccaggaguuugaggcca

SEQ ID NO: 159671 - RNA, 32 nt, Human
gaggaucacuugagcccaggaguuugaggcug

SEQ ID NO: 159672 - RNA, 32 nt, Human
gaggaucacuugagcccaggaguuugagguug

SEQ ID NO: 159673 - RNA, 32 nt, Human
gaggaucacuugaguccaggaggcggaggcug

SEQ ID NO: 159674 - RNA, 32 nt, Human
gaggaucagagggaggggaggcagccaagaga

SEQ ID NO: 159675 - RNA, 32 nt, Human
gaggaucagaugcuugagcuucugagcaggcc

SEQ ID NO: 159676 - RNA, 31 nt, Human
gaggaucagcccaaggaggaggaagaggaaa

SEQ ID NO: 159677 - RNA, 32 nt, Human
gaggaucagcccaaggaggaggaagaggaaaa

SEQ ID NO: 159678 - RNA, 32 nt, Human
gaggaucaguugagcccaggaguucaagacca

SEQ ID NO: 159679 - RNA, 32 nt, Human
gaggaucauuugagcccaggaggucaaggcug

SEQ ID NO: 159680 - RNA, 32 nt, Human
gaggaucauuugagcccaggaguucgagacca

SEQ ID NO: 159681 - RNA, 32 nt, Human
gaggaucauuugagcccaggaguuugagacca

SEQ ID NO: 159682 - RNA, 32 nt, Human
gaggauccagaacugcagcccauccucgcugg

SEQ ID NO: 159683 - RNA, 32 nt, Human
gaggaucccaggaguucaaauccugccugggc

SEQ ID NO: 159684 - RNA, 21 nt, Human
gaggauccccgaccacccuag

SEQ ID NO: 159685 - RNA, 19 nt, Human
gaggaucccuggagcccug

SEQ ID NO: 159686 - RNA, 32 nt, Human
gaggaucccuugagcccaggaggucgaggcug

SEQ ID NO: 159687 - RNA, 32 nt, Human
gaggaucccuugaggccaggagguggagucua

SEQ ID NO: 159688 - RNA, 32 nt, Human
gaggaucccuugaguccaggagguugaggcug

SEQ ID NO: 159689 - RNA, 32 nt, Human
gaggaucccuuucccucccgcccugcuuuugc

SEQ ID NO: 159690 - RNA, 32 nt, Human
gaggauccuuccugccucuuccagcucccagg

SEQ ID NO: 159691 - RNA, 32 nt, Human
gaggaucgccugaaccucagaggcagagguug

SEQ ID NO: 159692 - RNA, 32 nt, Human
gaggaucgccugagcaugggaggcagagguug

SEQ ID NO: 159693 - RNA, 32 nt, Human
gaggaucgccugagcccaggagguggagguug

SEQ ID NO: 159694 - RNA, 32 nt, Human
gaggaucgccugagcccaggaguuugagacca

SEQ ID NO: 159695 - RNA, 21 nt, Human
gaggaucgcuggagccuggga

SEQ ID NO: 159696 - RNA, 32 nt, Human
gaggaucgcuugaacccaggaagcagagguug

SEQ ID NO: 159697 - RNA, 32 nt, Human
gaggaucgcuugaacccaggaaguagagguug

SEQ ID NO: 159698 - RNA, 32 nt, Human
gaggaucgcuugaacccaggaaguggagacug

SEQ ID NO: 159699 - RNA, 32 nt, Human
gaggaucgcuugaacccaggaggcggagguug

SEQ ID NO: 159700 - RNA, 32 nt, Human
gaggaucgcuugaacccaggagguagaagcug

SEQ ID NO: 159701 - RNA, 32 nt, Human
gaggaucgcuugaacccaggagguagaggcug

SEQ ID NO: 159702 - RNA, 32 nt, Human
gaggaucgcuugaacccaggagguggagguug

SEQ ID NO: 159703 - RNA, 32 nt, Human
gaggaucgcuugaacccgggaggcagcaguug

SEQ ID NO: 159704 - RNA, 32 nt, Human
gaggaucgcuugaaccugagaggcagagguug

SEQ ID NO: 159705 - RNA, 32 nt, Human
gaggaucgcuugagcccaggagcucgagacca

SEQ ID NO: 159706 - RNA, 32 nt, Human
gaggaucgcuugagcccaggaggcagaggcug

SEQ ID NO: 159707 - RNA, 32 nt, Human
gaggaucgcuugagcccaggaggcggagguug

SEQ ID NO: 159708 - RNA, 32 nt, Human
gaggaucgcuugagcccaggaggucgaagcug

SEQ ID NO: 159709 - RNA, 32 nt, Human
gaggaucgcuugagcccaggagucugagacca

SEQ ID NO: 159710 - RNA, 32 nt, Human
gaggaucgcuugagcccaggaguucaagacca

SEQ ID NO: 159711 - RNA, 32 nt, Human
gaggaucgcuugagcccaggaguucaggaccu

SEQ ID NO: 159712 - RNA, 32 nt, Human
gaggaucgcuugagcccaggaguuccagacua

SEQ ID NO: 159713 - RNA, 32 nt, Human
gaggaucgcuugagcccaggaguucgagauua

SEQ ID NO: 159714 - RNA, 32 nt, Human
gaggaucgcuugagcccaggaguugaagucca

SEQ ID NO: 159715 - RNA, 32 nt, Human
gaggaucgcuugagcccaggaguuuaagacca

SEQ ID NO: 159716 - RNA, 32 nt, Human
gaggaucgcuugagcccaggaguuuaagaccu

SEQ ID NO: 159717 - RNA, 32 nt, Human
gaggaucgcuugagcccaggaguuugaaacca

SEQ ID NO: 159718 - RNA, 32 nt, Human
gaggaucgcuugagcccaggaguuugacacca

SEQ ID NO: 159719 - RNA, 32 nt, Human
gaggaucgcuugagcccaggaguuugagacca

SEQ ID NO: 159720 - RNA, 32 nt, Human
gaggaucgcuugagcccaggaguuugaggaug

SEQ ID NO: 159721 - RNA, 32 nt, Human
gaggaucgguugagcccaggaguucgaagcug

SEQ ID NO: 159722 - RNA, 32 nt, Human
gaggaucgucuuuaccugaggauuucuagcca

SEQ ID NO: 159723 - RNA, 32 nt, Human
gaggaucguuugagcccaggaguugaagacca

SEQ ID NO: 159724 - RNA, 18 nt, Human
gaggaucuaauuugcaga

SEQ ID NO: 159725 - RNA, 32 nt, Human
gaggaucucuugagcccaggagaugcaggcuu

SEQ ID NO: 159726 - RNA, 32 nt, Human
gaggaucucuugagcccaggaggucaaggcua

SEQ ID NO: 159727 - RNA, 32 nt, Human
gaggaucucuugagcccaggaguucgagacca

SEQ ID NO: 159728 - RNA, 32 nt, Human
gaggaucucuugagcccaggaguuggagucca

SEQ ID NO: 159729 - RNA, 32 nt, Human
gaggaucucuugagcccaggaguuugagaccc

SEQ ID NO: 159730 - RNA, 32 nt, Human
gaggaucucuugagcccaggaguuugagacua

SEQ ID NO: 159731 - RNA, 32 nt, Human
gaggaucucuugaggcugggaggcagagguug

SEQ ID NO: 159732 - RNA, 32 nt, Human
gaggaucugcuuggucuugauaagcuauguug

SEQ ID NO: 159733 - RNA, 32 nt, Human
gaggaucuucccaccauacagacagcgagauc

SEQ ID NO: 159734 - RNA, 32 nt, Human
gaggaucuuuugaacccaggaguucaggguca

SEQ ID NO: 159735 - RNA, 29 nt, Human
gaggaugaacaacaaguucgacgcuuuga

SEQ ID NO: 159736 - RNA, 32 nt, Human
gaggaugaagugauauggugagcagcggacuu

SEQ ID NO: 159737 - RNA, 32 nt, Human
gaggaugacaucaccacauuucuaguuucaug

SEQ ID NO: 159738 - RNA, 32 nt, Human
gaggaugaccagagccaaggcucacagaaaag

SEQ ID NO: 159739 - RNA, 32 nt, Human
gaggaugaccagcuagacucccauggaauugg

SEQ ID NO: 159740 - RNA, 32 nt, Human
gaggaugaccugcaccgugugccuuuaaugca

SEQ ID NO: 159741 - RNA, 32 nt, Human
gaggaugacuccagucccugcacgcccuggca

SEQ ID NO: 159742 - RNA, 32 nt, Human
gaggaugacuugaacgcaggaggcugaggcug

SEQ ID NO: 159743 - RNA, 32 nt, Human
gaggaugacuugagcccaggaguuugagacca

SEQ ID NO: 159744 - RNA, 29 nt, Human
gaggaugagagagaacauggccaggggcc

SEQ ID NO: 159745 - RNA, 32 nt, Human
gaggaugagagggcacagggagguggguuggg

SEQ ID NO: 159746 - RNA, 32 nt, Human
gaggaugaggacaaaccaaagccuuuguucuu

SEQ ID NO: 159747 - RNA, 32 nt, Human
gaggaugaggagaaacggaaugaggaagugcg

SEQ ID NO: 159748 - RNA, 32 nt, Human
gaggaugaggagacagaaaacaaguagcccuu

SEQ ID NO: 159749 - RNA, 32 nt, Human
gaggaugaggaggaggcccugcccucaaacgu

SEQ ID NO: 159750 - RNA, 32 nt, Human
gaggaugaggagggggagagccuggacucugu

SEQ ID NO: 159751 - RNA, 32 nt, Human
gaggaugaggaguaugccgaggaggagguggc

SEQ ID NO: 159752 - RNA, 32 nt, Human
gaggaugaggaugaggaggaguaugaugaaga

SEQ ID NO: 159753 - RNA, 32 nt, Human
gaggaugagguagggaggugauccagagaagg

SEQ ID NO: 159754 - RNA, 20 nt, Human
gaggaugagucaguuccuga

SEQ ID NO: 159755 - RNA, 18 nt, Human
gaggaugcaaacauucca

SEQ ID NO: 159756 - RNA, 32 nt, Human
gaggaugcaaagacauccagagugauauaaug

SEQ ID NO: 159757 - RNA, 32 nt, Human
gaggaugcaauggcacggaccuuggcuugacc

SEQ ID NO: 159758 - RNA, 32 nt, Human
gaggaugcagaauuaggagcaagcauuccgag

SEQ ID NO: 159759 - RNA, 32 nt, Human
gaggaugcagagugggagaccuuaaaaccguc

SEQ ID NO: 159760 - RNA, 32 nt, Human
gaggaugcagugagcuauggucauaccaccgc

SEQ ID NO: 159761 - RNA, 32 nt, Human
gaggaugccagaguucauggguuucuagaaga

SEQ ID NO: 159762 - RNA, 32 nt, Human
gaggaugccaggaugcaggucaaggaaggcau

SEQ ID NO: 159763 - RNA, 32 nt, Human
gaggaugcccguauuuucaucuuccauucuaa

SEQ ID NO: 159764 - RNA, 22 nt, Human
gaggaugccgccgcggcugcug

SEQ ID NO: 159765 - RNA, 24 nt, Human
gaggaugccucauuuuagcaaacu

SEQ ID NO: 159766 - RNA, 22 nt, Human
gaggaugcggagaagaaccaga

SEQ ID NO: 159767 - RNA, 29 nt, Human
gaggaugcuggagcuggagugggaagccc

SEQ ID NO: 159768 - RNA, 19 nt, Human
gaggaugcugugaaauucc

SEQ ID NO: 159769 - RNA, 32 nt, Human
gaggaugcuguggccacacaagugcuggacga

SEQ ID NO: 159770 - RNA, 21 nt, Human
gaggaugcuguggcuguucua

SEQ ID NO: 159771 - RNA, 20 nt, Human
gaggaugcuuaaugauucca

SEQ ID NO: 159772 - RNA, 17 nt, Human
gaggaugcuugauucca

SEQ ID NO: 159773 - RNA, 32 nt, Human
gaggauggaaacaccugccgcgcucugagccc

SEQ ID NO: 159774 - RNA, 32 nt, Human
gaggauggaagcaggugaggagcuagaccaca

SEQ ID NO: 159775 - RNA, 29 nt, Human
gaggauggacccaggagaucccgcuggug

SEQ ID NO: 159776 - RNA, 32 nt, Human
gaggauggagagaggcacugauagaggccaga

SEQ ID NO: 159777 - RNA, 32 nt, Human
gaggauggagugaugggguagggaggaggaaa

SEQ ID NO: 159778 - RNA, 32 nt, Human
gaggauggaguggggucccauggugcaggucu

SEQ ID NO: 159779 - RNA, 31 nt, Human
gaggauggcaaagagagucgcaucucagugc

SEQ ID NO: 159780 - RNA, 32 nt, Human
gaggauggcccagggugagguggcauggucca

SEQ ID NO: 159781 - RNA, 32 nt, Human
gaggauggccuggucugaaucuggaguaauua

SEQ ID NO: 159782 - RNA, 22 nt, Human
gaggauggcgcugguacugcug

SEQ ID NO: 159783 - RNA, 32 nt, Human
gaggauggcgugaacccgggaggcagagcuug

SEQ ID NO: 159784 - RNA, 32 nt, Human
gaggauggcucacgccuguaaucccagcacuu

SEQ ID NO: 159785 - RNA, 32 nt, Human
gaggauggcuucaagcccuaauguugcuugag

SEQ ID NO: 159786 - RNA, 32 nt, Human
gaggauggcuugaacccaagagguggaggcug

SEQ ID NO: 159787 - RNA, 32 nt, Human
gaggauggcuugaaccugggaggcagagguug

SEQ ID NO: 159788 - RNA, 32 nt, Human
gaggauggcuugagcccaagaggcagagguug

SEQ ID NO: 159789 - RNA, 32 nt, Human
gaggauggcuugagcccaggagauugaggcug

SEQ ID NO: 159790 - RNA, 32 nt, Human
gaggauggcuugagcccaggaguucaagacca

SEQ ID NO: 159791 - RNA, 32 nt, Human
gaggauggcuugagcccaggaguucaaggaug

SEQ ID NO: 159792 - RNA, 32 nt, Human
gaggauggcuugagcccaggaguuugagauca

SEQ ID NO: 159793 - RNA, 32 nt, Human
gaggauggcuugagcccaggaguuugaggcug

SEQ ID NO: 159794 - RNA, 32 nt, Human
gaggauggcuugagcccaggaguuugagguug

SEQ ID NO: 159795 - RNA, 32 nt, Human
gaggauggcuugcgcucaggaggcagagguua

SEQ ID NO: 159796 - RNA, 32 nt, Human
gaggauggcuugggcccaggaggucgaggcug

SEQ ID NO: 159797 - RNA, 32 nt, Human
gaggaugggaagagggagaggagcagaaaaag

SEQ ID NO: 159798 - RNA, 32 nt, Human
gaggaugggaggggugagcagcagggagagug

SEQ ID NO: 159799 - RNA, 32 nt, Human
gaggaugggauuagcgaagcuguggagacugc

SEQ ID NO: 159800 - RNA, 32 nt, Human
gaggauggggcuccuauccacccuggccagca

SEQ ID NO: 159801 - RNA, 32 nt, Human
gaggaugggggcaugacacuccagugucaaaa

SEQ ID NO: 159802 - RNA, 24 nt, Human
gaggauggggguuugggaccaguu

SEQ ID NO: 159803 - RNA, 31 nt, Human
gaggaugggguggaaucugaggggugagccu

SEQ ID NO: 159804 - RNA, 32 nt, Human
gaggaugggguuucacuauguuggccagacug

SEQ ID NO: 159805 - RNA, 29 nt, Human
gaggauggugcagaaggagagucaagcga

SEQ ID NO: 159806 - RNA, 32 nt, Human
gaggauggugugaaccugggaggcagagcuug

SEQ ID NO: 159807 - RNA, 32 nt, Human
gaggauguaauauauacagacacacacauguu

SEQ ID NO: 159808 - RNA, 32 nt, Human
gaggauguauuuauaugagauguauguguucu

SEQ ID NO: 159809 - RNA, 32 nt, Human
gaggauguccacccucugucucaggccuuuuu

SEQ ID NO: 159810 - RNA, 32 nt, Human
gaggaugugaaugacagugucagcaagugagc

SEQ ID NO: 159811 - RNA, 32 nt, Human
gaggauguggguugggacagguaguaccuaaa

SEQ ID NO: 159812 - RNA, 32 nt, Human
gaggaugugguagugaccucaccagaggaguu

SEQ ID NO: 159813 - RNA, 32 nt, Human
gaggauguggugagccccaucauucugcaccu

SEQ ID NO: 159814 - RNA, 32 nt, Human
gaggauguuagacuugcucccucuccaagaca

SEQ ID NO: 159815 - RNA, 32 nt, Human
gaggauguuccacuuagagcagucuucaaaau

SEQ ID NO: 159816 - RNA, 32 nt, Human
gaggauguucucugcgcucccaggccggcauc

SEQ ID NO: 159817 - RNA, 32 nt, Human
gaggauuaccucugugacccagaagagaugcc

SEQ ID NO: 159818 - RNA, 32 nt, Human
gaggauuaccugagcccaggaguucgagacca

SEQ ID NO: 159819 - RNA, 32 nt, Human
gaggauuacuugagcccaggaguucgagauca

SEQ ID NO: 159820 - RNA, 23 nt, Human
gaggauuaggaaugaguauucca

SEQ ID NO: 159821 - RNA, 32 nt, Human
gaggauuaggagaaggaagagggaacgccaca

SEQ ID NO: 159822 - RNA, 32 nt, Human
gaggauuaguagaagagaguggguccagauuu

SEQ ID NO: 159823 - RNA, 32 nt, Human
gaggauuaguccaccugucccuccugggcugc

SEQ ID NO: 159824 - RNA, 32 nt, Human
gaggauucaaacuguuggggcuggaagaacuu

SEQ ID NO: 159825 - RNA, 32 nt, Human
gaggauucagggccggagguucuggugggggc

SEQ ID NO: 159826 - RNA, 32 nt, Human
gaggauucauguccaaagggcucccagagacc

SEQ ID NO: 159827 - RNA, 32 nt, Human
gaggauucucauaaggaaagcaaugacuguuc

SEQ ID NO: 159828 - RNA, 32 nt, Human
gaggauucucccccgaguccccaaaucagcag

SEQ ID NO: 159829 - RNA, 32 nt, Human
gaggauucugaccuugacuuucauaucaacaa

SEQ ID NO: 159830 - RNA, 32 nt, Human
gaggauucuggcugggaagaaaaagagccuca

SEQ ID NO: 159831 - RNA, 32 nt, Human
gaggauugcauucuauuuucuauaugacccuc

SEQ ID NO: 159832 - RNA, 32 nt, Human
gaggauugccucugcugacccucagucuccuc

SEQ ID NO: 159833 - RNA, 32 nt, Human
gaggauugccugagcccaggagguggaaacug

SEQ ID NO: 159834 - RNA, 32 nt, Human
gaggauugccugagcccaggaguuugaggcuc

SEQ ID NO: 159835 - RNA, 32 nt, Human
gaggauugccugagcccaggaguuugagggug

SEQ ID NO: 159836 - RNA, 21 nt, Human
gaggauugcuggagccuggga

SEQ ID NO: 159837 - RNA, 32 nt, Human
gaggauugcuuaagcccaggagcuagagccua

SEQ ID NO: 159838 - RNA, 32 nt, Human
gaggauugcuuaagcccgggaggcagaaccug

SEQ ID NO: 159839 - RNA, 32 nt, Human
gaggauugcuugaacccaagaggucgaggcug

SEQ ID NO: 159840 - RNA, 32 nt, Human
gaggauugcuugaacccaggaguuucagacca

SEQ ID NO: 159841 - RNA, 32 nt, Human
gaggauugcuugaacccgggaggcagagguug

SEQ ID NO: 159842 - RNA, 32 nt, Human
gaggauugcuugagaccagccugggugacaca

SEQ ID NO: 159843 - RNA, 32 nt, Human
gaggauugcuugagcccaggagagugaggcua

SEQ ID NO: 159844 - RNA, 32 nt, Human
gaggauugcuugagcccaggagcuggagauca

SEQ ID NO: 159845 - RNA, 32 nt, Human
gaggauugcuugagcccaggaggcagagguug

SEQ ID NO: 159846 - RNA, 32 nt, Human
gaggauugcuugagcccaggaggucgaggcug

SEQ ID NO: 159847 - RNA, 32 nt, Human
gaggauugcuugagcccaggaguucaagacca

SEQ ID NO: 159848 - RNA, 32 nt, Human
gaggauugcuugagcccaggaguuugacacca

SEQ ID NO: 159849 - RNA, 32 nt, Human
gaggauugcuugagcccaggaguuugagacca

SEQ ID NO: 159850 - RNA, 32 nt, Human
gaggauugcuugagcccaggaguuugaggcug

SEQ ID NO: 159851 - RNA, 32 nt, Human
gaggauugcuugagcccaggaguuugagguug

SEQ ID NO: 159852 - RNA, 32 nt, Human
gaggauugcuugagcccaggaguuugagucca

SEQ ID NO: 159853 - RNA, 18 nt, Human
gaggauugcuugaggcca

SEQ ID NO: 159854 - RNA, 32 nt, Human
gaggauugcuugaggccagccugggcaacaua

SEQ ID NO: 159855 - RNA, 18 nt, Human
gaggauugcuugagucca

SEQ ID NO: 159856 - RNA, 32 nt, Human
gaggauugcuugaguccaggagguugaggcug

SEQ ID NO: 159857 - RNA, 18 nt, Human
gaggauuguagcauuuua

SEQ ID NO: 159858 - RNA, 32 nt, Human
gaggauuguuugagcccaggagguugaggcug

SEQ ID NO: 159859 - RNA, 32 nt, Human
gaggauuguuugagcccaggaguucaaggcag

SEQ ID NO: 159860 - RNA, 32 nt, Human
gaggauuuauccugccuucuccacaagcaugu

SEQ ID NO: 159861 - RNA, 32 nt, Human
gaggauuucucagacacaugcaccagauucug

SEQ ID NO: 159862 - RNA, 32 nt, Human
gaggauuugacagcauuuccccaguugcccuu

SEQ ID NO: 159863 - RNA, 32 nt, Human
gaggauuugcagcccccagcccuggguucaag

SEQ ID NO: 159864 - RNA, 32 nt, Human
gaggauuuggagaaguuaaggcugcaaggcca

SEQ ID NO: 159865 - RNA, 26 nt, Human
gaggauuuggagcuuuuaagccaguu

SEQ ID NO: 159866 - RNA, 32 nt, Human
gaggauuugggcagaaccugagguuuugccau

SEQ ID NO: 159867 - RNA, 32 nt, Human
gaggauuuucacccaugugcauggaaaagaug

SEQ ID NO: 159868 - RNA, 32 nt, Human
gaggauuuucacccaugugcauggaauaaaug

SEQ ID NO: 159869 - RNA, 32 nt, Human
gaggauuuuggagaagagagacaggaggggua

SEQ ID NO: 159870 - RNA, 32 nt, Human
gaggauuuuguuuuguaguuugcagaugagca

SEQ ID NO: 159871 - RNA, 26 nt, Human
gaggauuuuugguauugauauaguua

SEQ ID NO: 159872 - RNA, 32 nt, Human
gaggcaaaaggacucuuguggaagauggaacu

SEQ ID NO: 159873 - RNA, 32 nt, Human
gaggcaaaaggcagcucacggggccuuccauu

SEQ ID NO: 159874 - RNA, 32 nt, Human
gaggcaaacagccugggcuucucaccccacca

SEQ ID NO: 159875 - RNA, 32 nt, Human
gaggcaaagaaaaggaacggacauucgguccu

SEQ ID NO: 159876 - RNA, 32 nt, Human
gaggcaaagaggagggcaggucugagggaccc

SEQ ID NO: 159877 - RNA, 32 nt, Human
gaggcaaagccaggccaggguacagugagaac

SEQ ID NO: 159878 - RNA, 32 nt, Human
gaggcaaaggaaacuggguggggaggaucaau

SEQ ID NO: 159879 - RNA, 19 nt, Human
gaggcaaaggaugcaguga

SEQ ID NO: 159880 - RNA, 22 nt, Human
gaggcaaaggcagguggaucac

SEQ ID NO: 159881 - RNA, 32 nt, Human
gaggcaaaggcagguggaucaccugaggucag

SEQ ID NO: 159882 - RNA, 32 nt, Human
gaggcaaaggccuggacagcuugacuuguggg

SEQ ID NO: 159883 - RNA, 22 nt, Human
gaggcaaaggcgggcggaucac

SEQ ID NO: 159884 - RNA, 21 nt, Human
gaggcaaaggcugcagugagc

SEQ ID NO: 159885 - RNA, 32 nt, Human
gaggcaaagguggguagaucaccugaggucgg

SEQ ID NO: 159886 - RNA, 21 nt, Human
gaggcaaagguugcagugagc

SEQ ID NO: 159887 - RNA, 18 nt, Human
gaggcaaaugacauuuca

SEQ ID NO: 159888 - RNA, 22 nt, Human
gaggcaacaagaaucgcuugaa

SEQ ID NO: 159889 - RNA, 32 nt, Human
gaggcaacacagggugggcacugacccacccc

SEQ ID NO: 159890 - RNA, 32 nt, Human
gaggcaacauggcaagauccccucucuaccaa

SEQ ID NO: 159891 - RNA, 32 nt, Human
gaggcaacgggcggcagguugcaguggagggg

SEQ ID NO: 159892 - RNA, 21 nt, Human
gaggcaagaaaaucgcuugaa

SEQ ID NO: 159893 - RNA, 22 nt, Human
gaggcaagaaaaucgcuugaac

SEQ ID NO: 159894 - RNA, 32 nt, Human
gaggcaagaaacucgcacccacuguggacugg

SEQ ID NO: 159895 - RNA, 32 nt, Human
gaggcaagaagagcaccaucacugccuauuuc

SEQ ID NO: 159896 - RNA, 32 nt, Human
gaggcaagagaaucacuugaaccucggaggcu

SEQ ID NO: 159897 - RNA, 22 nt, Human
gaggcaagagaaucgcuugaac

SEQ ID NO: 159898 - RNA, 32 nt, Human
gaggcaagagcagaggccccugagugugcacc

SEQ ID NO: 159899 - RNA, 18 nt, Human
gaggcaagaggacugcuu

SEQ ID NO: 159900 - RNA, 32 nt, Human
gaggcaagauggcaccauuacacuccagccug

SEQ ID NO: 159901 - RNA, 32 nt, Human
gaggcaagcaagcucucuugccgaggagccag

SEQ ID NO: 159902 - RNA, 24 nt, Human
gaggcaaggaguuugagaccagcu

SEQ ID NO: 159903 - RNA, 32 nt, Human
gaggcaaggcaaucacuucgucuugccauuga

SEQ ID NO: 159904 - RNA, 32 nt, Human
gaggcaaggcaugagagggcaaguuuguugug

SEQ ID NO: 159905 - RNA, 22 nt, Human
gaggcaaggggacgccggcggg

SEQ ID NO: 159906 - RNA, 21 nt, Human
gaggcaagguggggccugcag

SEQ ID NO: 159907 - RNA, 32 nt, Human
gaggcaagucucugguacucaggcuggagugc

SEQ ID NO: 159908 - RNA, 32 nt, Human
gaggcaauaucacuaggacuuuagcugugacc

SEQ ID NO: 159909 - RNA, 32 nt, Human
gaggcaaugacuguuggccaguucucaccggg

SEQ ID NO: 159910 - RNA, 21 nt, Human
gaggcacaagaaucgcuugaa

SEQ ID NO: 159911 - RNA, 21 nt, Human
gaggcacaagaaucgcuugag

SEQ ID NO: 159912 - RNA, 21 nt, Human
gaggcacaagaauugcuugaa

SEQ ID NO: 159913 - RNA, 32 nt, Human
gaggcacaaggcacaacaggcugcucugggau

SEQ ID NO: 159914 - RNA, 32 nt, Human
gaggcacacagccuaaagucagcacagcagag

SEQ ID NO: 159915 - RNA, 32 nt, Human
gaggcacaccucagacugaaugagucagaauc

SEQ ID NO: 159916 - RNA, 32 nt, Human
gaggcacacugacgaacagccuggguuaaucc

SEQ ID NO: 159917 - RNA, 32 nt, Human
gaggcacagacaccuggugagugaggcuucaa

SEQ ID NO: 159918 - RNA, 32 nt, Human
gaggcacagacacgugcuccugguccaugugc

SEQ ID NO: 159919 - RNA, 18 nt, Human
gaggcacagagggcugcu

SEQ ID NO: 159920 - RNA, 32 nt, Human
gaggcacagaugggcuaagggagcaccuguag

SEQ ID NO: 159921 - RNA, 32 nt, Human
gaggcacagcugagcgccaaagccacaggcug

SEQ ID NO: 159922 - RNA, 24 nt, Human
gaggcacaggcgggaggaucacuu

SEQ ID NO: 159923 - RNA, 32 nt, Human
gaggcacagggagagggcaggaagggacagga

SEQ ID NO: 159924 - RNA, 32 nt, Human
gaggcacagggaggggagagaugggcgacccc

SEQ ID NO: 159925 - RNA, 32 nt, Human
gaggcacagggaggggagagaugggcggcccc

SEQ ID NO: 159926 - RNA, 32 nt, Human
gaggcaccaagugucucaggcagcgaggaaau

SEQ ID NO: 159927 - RNA, 32 nt, Human
gaggcaccaccagguuacagacaaggaccuuc

SEQ ID NO: 159928 - RNA, 32 nt, Human
gaggcaccacugcacucuagccugggcaagag

SEQ ID NO: 159929 - RNA, 21 nt, Human
gaggcaccagaauugcuugaa

SEQ ID NO: 159930 - RNA, 32 nt, Human
gaggcaccaggcacccagaagugaaagacagg

SEQ ID NO: 159931 - RNA, 23 nt, Human
gaggcacccaaagggcaggagca

SEQ ID NO: 159932 - RNA, 23 nt, Human
gaggcacccagaggcagugucca

SEQ ID NO: 159933 - RNA, 23 nt, Human
gaggcacccuucccauugugcca

SEQ ID NO: 159934 - RNA, 32 nt, Human
gaggcaccuagaaguugaggcagccagcugug

SEQ ID NO: 159935 - RNA, 32 nt, Human
gaggcaccuccaccaacagcccacgcugcugg

SEQ ID NO: 159936 - RNA, 32 nt, Human
gaggcaccuccaggcaggccaggcugccucgg

SEQ ID NO: 159937 - RNA, 18 nt, Human
gaggcaccuguaauccca

SEQ ID NO: 159938 - RNA, 32 nt, Human
gaggcaccuguaaucccagcuacuugggaggc

SEQ ID NO: 159939 - RNA, 32 nt, Human
gaggcacgagagcugggagaagaggcaaagcu

SEQ ID NO: 159940 - RNA, 32 nt, Human
gaggcacgagggcuggaguccacaggcuuuua

SEQ ID NO: 159941 - RNA, 32 nt, Human
gaggcacggaaagucuggacccuugugggacc

SEQ ID NO: 159942 - RNA, 21 nt, Human
gaggcacuagaaucgcuugag

SEQ ID NO: 159943 - RNA, 32 nt, Human
gaggcacucaggcugguuuccaggacaaacau

SEQ ID NO: 159944 - RNA, 32 nt, Human
gaggcacugcagcuaugggcacugccucagcc

SEQ ID NO: 159945 - RNA, 32 nt, Human
gaggcacugcagcugcucgguugcccagccuc

SEQ ID NO: 159946 - RNA, 19 nt, Human
gaggcacugggcccuggga

SEQ ID NO: 159947 - RNA, 32 nt, Human
gaggcacuggggaugcuuccugccuggccuuc

SEQ ID NO: 159948 - RNA, 32 nt, Human
gaggcagaaaaagugggggagguggaggggga

SEQ ID NO: 159949 - RNA, 32 nt, Human
gaggcagaaacaccagccucugccaacaccgg

SEQ ID NO: 159950 - RNA, 15 nt, Human
gaggcagaaaccuca

SEQ ID NO: 159951 - RNA, 21 nt, Human
gaggcagaaccugcagugagc

SEQ ID NO: 159952 - RNA, 22 nt, Human
gaggcagaagaaccccuugaac

SEQ ID NO: 159953 - RNA, 21 nt, Human
gaggcagaagaauagcuugag

SEQ ID NO: 159954 - RNA, 22 nt, Human
gaggcagaagaaucacuucaac

SEQ ID NO: 159955 - RNA, 22 nt, Human
gaggcagaagaaucacuugaac

SEQ ID NO: 159956 - RNA, 22 nt, Human
gaggcagaagaaucgcuuaaac

SEQ ID NO: 159957 - RNA, 21 nt, Human
gaggcagaagaaucgcuugaa

SEQ ID NO: 159958 - RNA, 22 nt, Human
gaggcagaagaaucgcuugaac

SEQ ID NO: 159959 - RNA, 21 nt, Human
gaggcagaagaaucgcuugag

SEQ ID NO: 159960 - RNA, 22 nt, Human
gaggcagaagaaucgcuugagc

SEQ ID NO: 159961 - RNA, 21 nt, Human
gaggcagaagaaucguuugaa

SEQ ID NO: 159962 - RNA, 21 nt, Human
gaggcagaagaauggcuugaa

SEQ ID NO: 159963 - RNA, 21 nt, Human
gaggcagaagaauugcuugaa

SEQ ID NO: 159964 - RNA, 21 nt, Human
gaggcagaaggaucgcuugaa

SEQ ID NO: 159965 - RNA, 22 nt, Human
gaggcagaaggaucgcuugaac

SEQ ID NO: 159966 - RNA, 19 nt, Human
gaggcagaaguugcaguga

SEQ ID NO: 159967 - RNA, 21 nt, Human
gaggcagaaguugcagugagc

SEQ ID NO: 159968 - RNA, 32 nt, Human
gaggcagaaucaugugaaugggugcauccaag

SEQ ID NO: 159969 - RNA, 32 nt, Human
gaggcagaauggcgugaacccaggaggcggag

SEQ ID NO: 159970 - RNA, 32 nt, Human
gaggcagacauacaccagaaaugggggagaaa

SEQ ID NO: 159971 - RNA, 32 nt, Human
gaggcagacggaucacuccugaggccaggagu

SEQ ID NO: 159972 - RNA, 22 nt, Human
gaggcagagacggaaccagaga

SEQ ID NO: 159973 - RNA, 32 nt, Human
gaggcagagagacagagagggagagagggaca

SEQ ID NO: 159974 - RNA, 32 nt, Human
gaggcagagagaugaauggaauggagccgcau

SEQ ID NO: 159975 - RNA, 32 nt, Human
gaggcagagagggagagaaacagaggagacag

SEQ ID NO: 159976 - RNA, 32 nt, Human
gaggcagagagggagagaggcagagagacaga

SEQ ID NO: 159977 - RNA, 32 nt, Human
gaggcagagagggagagagggagagugacagc

SEQ ID NO: 159978 - RNA, 32 nt, Human
gaggcagagaugggcggaucacgaggucagga

SEQ ID NO: 159979 - RNA, 32 nt, Human
gaggcagagauggggugguggcugagagagau

SEQ ID NO: 159980 - RNA, 24 nt, Human
gaggcagagauugcacugagccga

SEQ ID NO: 159981 - RNA, 19 nt, Human
gaggcagagauugcaguga

SEQ ID NO: 159982 - RNA, 21 nt, Human
gaggcagagauugcagugagc

SEQ ID NO: 159983 - RNA, 32 nt, Human
gaggcagagcccaggguaggggacagagcugc

SEQ ID NO: 159984 - RNA, 32 nt, Human
gaggcagagcgggagcgcgcagccagguggaa

SEQ ID NO: 159985 - RNA, 19 nt, Human
gaggcagagcugccuggag

SEQ ID NO: 159986 - RNA, 32 nt, Human
gaggcagagcugccuggagccugcugggcugg

SEQ ID NO: 159987 - RNA, 19 nt, Human
gaggcagagcuugcaguga

SEQ ID NO: 159988 - RNA, 21 nt, Human
gaggcagagcuugcagugagc

SEQ ID NO: 159989 - RNA, 32 nt, Human
gaggcagagcuuggcagccacugaugguggua

SEQ ID NO: 159990 - RNA, 22 nt, Human
gaggcagaggcaggcggaucac

SEQ ID NO: 159991 - RNA, 32 nt, Human
gaggcagaggcagguggaucaccugaggucgg

SEQ ID NO: 159992 - RNA, 23 nt, Human
gaggcagaggcuacagugagcug

SEQ ID NO: 159993 - RNA, 21 nt, Human
gaggcagaggcuacagugagu

SEQ ID NO: 159994 - RNA, 32 nt, Human
gaggcagaggcugaagugagccaagauuacgu

SEQ ID NO: 159995 - RNA, 32 nt, Human
gaggcagaggcugcacucuagccugggcaaca

SEQ ID NO: 159996 - RNA, 19 nt, Human
gaggcagaggcugcaguga

SEQ ID NO: 159997 - RNA, 21 nt, Human
gaggcagaggcugcagugagc

SEQ ID NO: 159998 - RNA, 23 nt, Human
gaggcagaggcugcagugagcug

SEQ ID NO: 159999 - RNA, 21 nt, Human
gaggcagaggcuguggugagc

SEQ ID NO: 160000 - RNA, 32 nt, Human
gaggcagagggcagcgcagggugccggggaag

SEQ ID NO: 160001 - RNA, 24 nt, Human
gaggcagaggucgcagugagcugu

SEQ ID NO: 160002 - RNA, 32 nt, Human
gaggcagaggugugggaggcagaaggcuacaa

SEQ ID NO: 160003 - RNA, 32 nt, Human
gaggcagagguuacagguuacagugagcaaag

SEQ ID NO: 160004 - RNA, 21 nt, Human
gaggcagagguuacagugagc

SEQ ID NO: 160005 - RNA, 21 nt, Human
gaggcagagguuccagugagc

SEQ ID NO: 160006 - RNA, 21 nt, Human
gaggcagagguugcaaugagc

SEQ ID NO: 160007 - RNA, 24 nt, Human
gaggcagagguugcacugagcuga

SEQ ID NO: 160008 - RNA, 21 nt, Human
gaggcagagguugcaguaagc

SEQ ID NO: 160009 - RNA, 23 nt, Human
gaggcagagguugcaguaagcua

SEQ ID NO: 160010 - RNA, 19 nt, Human
gaggcagagguugcaguga

SEQ ID NO: 160011 - RNA, 21 nt, Human
gaggcagagguugcagugagc

SEQ ID NO: 160012 - RNA, 32 nt, Human
gaggcagagguugcagugagccaaggucacgu

SEQ ID NO: 160013 - RNA, 32 nt, Human
gaggcagagguugcagugagccaaggucauac

SEQ ID NO: 160014 - RNA, 22 nt, Human
gaggcagagguugcagugagcu

SEQ ID NO: 160015 - RNA, 23 nt, Human
gaggcagagguugcagugagcua

SEQ ID NO: 160016 - RNA, 19 nt, Human
gaggcagagguugcgguga

SEQ ID NO: 160017 - RNA, 21 nt, Human
gaggcagagguugcggugagc

SEQ ID NO: 160018 - RNA, 19 nt, Human
gaggcagagguugcuguga

SEQ ID NO: 160019 - RNA, 19 nt, Human
gaggcagagguuguaguga

SEQ ID NO: 160020 - RNA, 21 nt, Human
gaggcagagguuguagugagc

SEQ ID NO: 160021 - RNA, 23 nt, Human
gaggcagagguuguggugagcua

SEQ ID NO: 160022 - RNA, 19 nt, Human
gaggcagagguuucaguga

SEQ ID NO: 160023 - RNA, 21 nt, Human
gaggcagagguuucagugagc

SEQ ID NO: 160024 - RNA, 19 nt, Human
gaggcagaguuugcaguga

SEQ ID NO: 160025 - RNA, 21 nt, Human
gaggcagaguuugcagugagc

SEQ ID NO: 160026 - RNA, 32 nt, Human
gaggcagaguuuugcucuuguugcccaggcug

SEQ ID NO: 160027 - RNA, 32 nt, Human
gaggcagauagcacugggugugagaaugauca

SEQ ID NO: 160028 - RNA, 22 nt, Human
gaggcagauggaucacgagguc

SEQ ID NO: 160029 - RNA, 32 nt, Human
gaggcagauggucagacccaggaggaggcauu

SEQ ID NO: 160030 - RNA, 32 nt, Human
gaggcagcaaacccugcaaagggcugggacug

SEQ ID NO: 160031 - RNA, 32 nt, Human
gaggcagcagaacuaagucugaaccgccaaga

SEQ ID NO: 160032 - RNA, 21 nt, Human
gaggcagcagaaucacuugaa

SEQ ID NO: 160033 - RNA, 32 nt, Human
gaggcagcagagacuaugauagaggcuaugau

SEQ ID NO: 160034 - RNA, 32 nt, Human
gaggcagcagagccgaggagagcagguccaca

SEQ ID NO: 160035 - RNA, 32 nt, Human
gaggcagcagcccagacgcggcacagagaggg

SEQ ID NO: 160036 - RNA, 32 nt, Human
gaggcagcagggagaggaaggaggugggggag

SEQ ID NO: 160037 - RNA, 32 nt, Human
gaggcagcagugagccgagauugcgccacuuc

SEQ ID NO: 160038 - RNA, 18 nt, Human
gaggcagccaccccagag

SEQ ID NO: 160039 - RNA, 19 nt, Human
gaggcagccaccccagaga

SEQ ID NO: 160040 - RNA, 23 nt, Human
gaggcagccagccccuggcaggg

SEQ ID NO: 160041 - RNA, 32 nt, Human
gaggcagcccaucuuggcccuggaugaagaag

SEQ ID NO: 160042 - RNA, 32 nt, Human
gaggcagcccuugaguguuaauuugucuucua

SEQ ID NO: 160043 - RNA, 19 nt, Human
gaggcagccgaggccuggc

SEQ ID NO: 160044 - RNA, 32 nt, Human
gaggcagccguggucugccaggcccucgcucc

SEQ ID NO: 160045 - RNA, 32 nt, Human
gaggcagccuccagggcaggaaggacccugug

SEQ ID NO: 160046 - RNA, 32 nt, Human
gaggcagccucuuccaggaagaaagugguguc

SEQ ID NO: 160047 - RNA, 32 nt, Human
gaggcagcgagggacacggaguagaagaggcu

SEQ ID NO: 160048 - RNA, 19 nt, Human
gaggcagcggccgcgcgga

SEQ ID NO: 160049 - RNA, 19 nt, Human
gaggcagcgguugcaguaa

SEQ ID NO: 160050 - RNA, 32 nt, Human
gaggcagcguggacuggugacugugaaggaag

SEQ ID NO: 160051 - RNA, 19 nt, Human
gaggcagcuaaggggcagg

SEQ ID NO: 160052 - RNA, 32 nt, Human
gaggcagcuaccucgggaggaaggucucacau

SEQ ID NO: 160053 - RNA, 32 nt, Human
gaggcagcuagggagagugggagguaggcaga

SEQ ID NO: 160054 - RNA, 22 nt, Human
gaggcagcuaguagccggaggg

SEQ ID NO: 160055 - RNA, 32 nt, Human
gaggcagcuauugguugcuuucuuggagguaa

SEQ ID NO: 160056 - RNA, 24 nt, Human
gaggcagcugaagggcagggaggg

SEQ ID NO: 160057 - RNA, 22 nt, Human
gaggcagcugagaucagaaggg

SEQ ID NO: 160058 - RNA, 26 nt, Human
gaggcagcugaggaaggaugcugggg

SEQ ID NO: 160059 - RNA, 32 nt, Human
gaggcagcugccagccggccugggcagucuug

SEQ ID NO: 160060 - RNA, 25 nt, Human
gaggcagcugccuucccucuccucc

SEQ ID NO: 160061 - RNA, 32 nt, Human
gaggcagcugcugacccagcuguggacugugc

SEQ ID NO: 160062 - RNA, 32 nt, Human
gaggcagcugggccuuugucuccugggcaccg

SEQ ID NO: 160063 - RNA, 32 nt, Human
gaggcagcuguccuccccagcccuguggaaag

SEQ ID NO: 160064 - RNA, 32 nt, Human
gaggcagcugugucccccagacauagccugga

SEQ ID NO: 160065 - RNA, 21 nt, Human
gaggcaggaaaaucacuugaa

SEQ ID NO: 160066 - RNA, 22 nt, Human
gaggcaggaaaaucacuugaac

SEQ ID NO: 160067 - RNA, 32 nt, Human
gaggcaggaaaaucacuugaacucgggaggca

SEQ ID NO: 160068 - RNA, 21 nt, Human
gaggcaggaaaaucgcuugaa

SEQ ID NO: 160069 - RNA, 22 nt, Human
gaggcaggaaaaucgcuugaac

SEQ ID NO: 160070 - RNA, 21 nt, Human
gaggcaggaaaauugcuugaa

SEQ ID NO: 160071 - RNA, 32 nt, Human
gaggcaggaacccuggagguugagguugcagu

SEQ ID NO: 160072 - RNA, 22 nt, Human
gaggcaggaagaaucgcuugaa

SEQ ID NO: 160073 - RNA, 22 nt, Human
gaggcaggaagaauugcuugaa

SEQ ID NO: 160074 - RNA, 23 nt, Human
gaggcaggaagaggggccugagg

SEQ ID NO: 160075 - RNA, 21 nt, Human
gaggcaggaagauagcuugag

SEQ ID NO: 160076 - RNA, 21 nt, Human
gaggcaggaagaucacuugaa

SEQ ID NO: 160077 - RNA, 21 nt, Human
gaggcaggaagauugcuugaa

SEQ ID NO: 160078 - RNA, 32 nt, Human
gaggcaggaagggagagaagcaaugccucgac

SEQ ID NO: 160079 - RNA, 32 nt, Human
gaggcaggaagggagagucagagagagaaugg

SEQ ID NO: 160080 - RNA, 22 nt, Human
gaggcaggagaaaucacuugaa

SEQ ID NO: 160081 - RNA, 21 nt, Human
gaggcaggagaaaugcuugaa

SEQ ID NO: 160082 - RNA, 22 nt, Human
gaggcaggagaaccgcuuaaac

SEQ ID NO: 160083 - RNA, 21 nt, Human
gaggcaggagaaccgcuugaa

SEQ ID NO: 160084 - RNA, 22 nt, Human
gaggcaggagaaccgcuugaac

SEQ ID NO: 160085 - RNA, 21 nt, Human
gaggcaggagaacuacuugaa

SEQ ID NO: 160086 - RNA, 22 nt, Human
gaggcaggagaacuacuugaac

SEQ ID NO: 160087 - RNA, 21 nt, Human
gaggcaggagaacugcuugaa

SEQ ID NO: 160088 - RNA, 22 nt, Human
gaggcaggagaacugcuugaac

SEQ ID NO: 160089 - RNA, 21 nt, Human
gaggcaggagaauaacuggaa

SEQ ID NO: 160090 - RNA, 21 nt, Human
gaggcaggagaauagccugaa

SEQ ID NO: 160091 - RNA, 22 nt, Human
gaggcaggagaauagccugaac

SEQ ID NO: 160092 - RNA, 21 nt, Human
gaggcaggagaauagcgugaa

SEQ ID NO: 160093 - RNA, 21 nt, Human
gaggcaggagaauagcuggaa

SEQ ID NO: 160094 - RNA, 21 nt, Human
gaggcaggagaauagcuugaa

SEQ ID NO: 160095 - RNA, 22 nt, Human
gaggcaggagaauagcuugaac

SEQ ID NO: 160096 - RNA, 21 nt, Human
gaggcaggagaauaucuugaa

SEQ ID NO: 160097 - RNA, 22 nt, Human
gaggcaggagaaucaauugaac

SEQ ID NO: 160098 - RNA, 22 nt, Human
gaggcaggagaaucaccugaac

SEQ ID NO: 160099 - RNA, 22 nt, Human
gaggcaggagaaucacuagaac

SEQ ID NO: 160100 - RNA, 22 nt, Human
gaggcaggagaaucacucgaac

SEQ ID NO: 160101 - RNA, 22 nt, Human
gaggcaggagaaucacucggac

SEQ ID NO: 160102 - RNA, 22 nt, Human
gaggcaggagaaucacuuaaac

SEQ ID NO: 160103 - RNA, 21 nt, Human
gaggcaggagaaucacuugaa

SEQ ID NO: 160104 - RNA, 22 nt, Human
gaggcaggagaaucacuugaac

SEQ ID NO: 160105 - RNA, 32 nt, Human
gaggcaggagaaucacuugaacucaggaggcg

SEQ ID NO: 160106 - RNA, 32 nt, Human
gaggcaggagaaucacuugaacucaggaggug

SEQ ID NO: 160107 - RNA, 32 nt, Human
gaggcaggagaaucacuugaacucagguggca

SEQ ID NO: 160108 - RNA, 32 nt, Human
gaggcaggagaaucacuugaacucgggaggcg

SEQ ID NO: 160109 - RNA, 32 nt, Human
gaggcaggagaaucacuugaacucgggaggug

SEQ ID NO: 160110 - RNA, 22 nt, Human
gaggcaggagaaucacuugaau

SEQ ID NO: 160111 - RNA, 22 nt, Human
gaggcaggagaaucacuugcac

SEQ ID NO: 160112 - RNA, 32 nt, Human
gaggcaggagaaucacuugcacuccggaggua

SEQ ID NO: 160113 - RNA, 22 nt, Human
gaggcaggagaaucacuuggac

SEQ ID NO: 160114 - RNA, 22 nt, Human
gaggcaggagaaucacuuguac

SEQ ID NO: 160115 - RNA, 32 nt, Human
gaggcaggagaaucacuuucacuuaaacccag

SEQ ID NO: 160116 - RNA, 32 nt, Human
gaggcaggagaaucagagguugcagugaaccg

SEQ ID NO: 160117 - RNA, 22 nt, Human
gaggcaggagaaucaguugaac

SEQ ID NO: 160118 - RNA, 22 nt, Human
gaggcaggagaaucaucugaac

SEQ ID NO: 160119 - RNA, 22 nt, Human
gaggcaggagaaucauuugaac

SEQ ID NO: 160120 - RNA, 22 nt, Human
gaggcaggagaaucgccugaac

SEQ ID NO: 160121 - RNA, 22 nt, Human
gaggcaggagaaucgcuagaac

SEQ ID NO: 160122 - RNA, 22 nt, Human
gaggcaggagaaucgcuggaac

SEQ ID NO: 160123 - RNA, 22 nt, Human
gaggcaggagaaucgcuuaaac

SEQ ID NO: 160124 - RNA, 21 nt, Human
gaggcaggagaaucgcuugaa

SEQ ID NO: 160125 - RNA, 22 nt, Human
gaggcaggagaaucgcuugaac

SEQ ID NO: 160126 - RNA, 22 nt, Human
gaggcaggagaaucgcuugaau

SEQ ID NO: 160127 - RNA, 22 nt, Human
gaggcaggagaaucgcuugagc

SEQ ID NO: 160128 - RNA, 22 nt, Human
gaggcaggagaaucgcuuggac

SEQ ID NO: 160129 - RNA, 22 nt, Human
gaggcaggagaaucguuugaac

SEQ ID NO: 160130 - RNA, 22 nt, Human
gaggcaggagaaucucuugaac

SEQ ID NO: 160131 - RNA, 21 nt, Human
gaggcaggagaauggccugaa

SEQ ID NO: 160132 - RNA, 22 nt, Human
gaggcaggagaauggccugaac

SEQ ID NO: 160133 - RNA, 21 nt, Human
gaggcaggagaauggcucgaa

SEQ ID NO: 160134 - RNA, 22 nt, Human
gaggcaggagaauggcucgaac

SEQ ID NO: 160135 - RNA, 22 nt, Human
gaggcaggagaauggcuuaaac

SEQ ID NO: 160136 - RNA, 21 nt, Human
gaggcaggagaauggcuugaa

SEQ ID NO: 160137 - RNA, 22 nt, Human
gaggcaggagaauggcuugaac

SEQ ID NO: 160138 - RNA, 19 nt, Human
gaggcaggagaauggggag

SEQ ID NO: 160139 - RNA, 21 nt, Human
gaggcaggagaauuacuugaa

SEQ ID NO: 160140 - RNA, 22 nt, Human
gaggcaggagaauuacuugaac

SEQ ID NO: 160141 - RNA, 22 nt, Human
gaggcaggagaauugcucaaac

SEQ ID NO: 160142 - RNA, 22 nt, Human
gaggcaggagaauugcuggaac

SEQ ID NO: 160143 - RNA, 21 nt, Human
gaggcaggagaauugcuugaa

SEQ ID NO: 160144 - RNA, 22 nt, Human
gaggcaggagaauugcuugaac

SEQ ID NO: 160145 - RNA, 22 nt, Human
gaggcaggagacucgcuugaac

SEQ ID NO: 160146 - RNA, 32 nt, Human
gaggcaggagagaagaauugggcagauucuuu

SEQ ID NO: 160147 - RNA, 23 nt, Human
gaggcaggagagaaucgcuugaa

SEQ ID NO: 160148 - RNA, 22 nt, Human
gaggcaggagagucacuugaac

SEQ ID NO: 160149 - RNA, 22 nt, Human
gaggcaggagauucgccugaac

SEQ ID NO: 160150 - RNA, 22 nt, Human
gaggcaggagauucgcuugaac

SEQ ID NO: 160151 - RNA, 21 nt, Human
gaggcaggagcauugcuugaa

SEQ ID NO: 160152 - RNA, 18 nt, Human
gaggcaggagcccugggg

SEQ ID NO: 160153 - RNA, 21 nt, Human
gaggcaggaggauagcuugag

SEQ ID NO: 160154 - RNA, 21 nt, Human
gaggcaggaggaucacuugaa

SEQ ID NO: 160155 - RNA, 32 nt, Human
gaggcaggaggaucacuugaguccagaaguuu

SEQ ID NO: 160156 - RNA, 32 nt, Human
gaggcaggaggaucacuugaguccaggaguuu

SEQ ID NO: 160157 - RNA, 21 nt, Human
gaggcaggaggaucgcuugaa

SEQ ID NO: 160158 - RNA, 21 nt, Human
gaggcaggaggauugcuugaa

SEQ ID NO: 160159 - RNA, 32 nt, Human
gaggcaggaggauuguuugaggccagaaauuu

SEQ ID NO: 160160 - RNA, 19 nt, Human
gaggcaggaggguccccca

SEQ ID NO: 160161 - RNA, 32 nt, Human
gaggcaggagggucccccacacccucaggcuc

SEQ ID NO: 160162 - RNA, 21 nt, Human
gaggcaggauaaucacuugaa

SEQ ID NO: 160163 - RNA, 22 nt, Human
gaggcaggauaaucacuugaac

SEQ ID NO: 160164 - RNA, 32 nt, Human
gaggcaggcagaccugggccucccaggaugga

SEQ ID NO: 160165 - RNA, 21 nt, Human
gaggcaggcagauaacuugag

SEQ ID NO: 160166 - RNA, 22 nt, Human
gaggcaggcagaucacaagguc

SEQ ID NO: 160167 - RNA, 32 nt, Human
gaggcaggcagaucacaugaggucaggaguuu

SEQ ID NO: 160168 - RNA, 22 nt, Human
gaggcaggcagaucacgggguc

SEQ ID NO: 160169 - RNA, 21 nt, Human
gaggcaggcagaucacuugaa

SEQ ID NO: 160170 - RNA, 32 nt, Human
gaggcaggcagaucacuugaacucaggaguuu

SEQ ID NO: 160171 - RNA, 21 nt, Human
gaggcaggcauguauauucca

SEQ ID NO: 160172 - RNA, 32 nt, Human
gaggcaggcccaguccuccuccagaaaauaag

SEQ ID NO: 160173 - RNA, 32 nt, Human
gaggcaggccgaaguccgcagccccggcucgg

SEQ ID NO: 160174 - RNA, 21 nt, Human
gaggcaggccugggccaggca

SEQ ID NO: 160175 - RNA, 22 nt, Human
gaggcaggcgaaucacgagguc

SEQ ID NO: 160176 - RNA, 21 nt, Human
gaggcaggcgaauugcuugaa

SEQ ID NO: 160177 - RNA, 32 nt, Human
gaggcaggcgaggucccugauucacucacuca

SEQ ID NO: 160178 - RNA, 32 nt, Human
gaggcaggcggacacuugagcccagggguuca

SEQ ID NO: 160179 - RNA, 22 nt, Human
gaggcaggcggaccacgagguc

SEQ ID NO: 160180 - RNA, 32 nt, Human
gaggcaggcggauagccugagcacaggaguug

SEQ ID NO: 160181 - RNA, 22 nt, Human
gaggcaggcggaucacaagguc

SEQ ID NO: 160182 - RNA, 32 nt, Human
gaggcaggcggaucacaugaggucaggaguuc

SEQ ID NO: 160183 - RNA, 22 nt, Human
gaggcaggcggaucacgagguc

SEQ ID NO: 160184 - RNA, 21 nt, Human
gaggcaggcggaucacuugaa

SEQ ID NO: 160185 - RNA, 22 nt, Human
gaggcaggcggaucaugagguc

SEQ ID NO: 160186 - RNA, 22 nt, Human
gaggcaggcggcucacgagguc

SEQ ID NO: 160187 - RNA, 32 nt, Human
gaggcaggcgggaggccaggggugcagaauug

SEQ ID NO: 160188 - RNA, 32 nt, Human
gaggcaggcuguggccaggcucaggcccugac

SEQ ID NO: 160189 - RNA, 32 nt, Human
gaggcaggcuuccuauggauguuggaguaccu

SEQ ID NO: 160190 - RNA, 22 nt, Human
gaggcagggagaaucgcuugaa

SEQ ID NO: 160191 - RNA, 22 nt, Human
gaggcagggagaauugcuugaa

SEQ ID NO: 160192 - RNA, 32 nt, Human
gaggcagggagccaccuccucagcuucccuga

SEQ ID NO: 160193 - RNA, 32 nt, Human
gaggcagggagcggggugcugaaggaauccua

SEQ ID NO: 160194 - RNA, 32 nt, Human
gaggcagggaggauccauugagcccaggaguc

SEQ ID NO: 160195 - RNA, 32 nt, Human
gaggcagggaggcagggaggcagggaggaacg

SEQ ID NO: 160196 - RNA, 22 nt, Human
gaggcagggcaggggcuccagg

SEQ ID NO: 160197 - RNA, 32 nt, Human
gaggcagggccugcuugucaugagcugcacuc

SEQ ID NO: 160198 - RNA, 21 nt, Human
gaggcaggggaacacaagguc

SEQ ID NO: 160199 - RNA, 21 nt, Human
gaggcaggggaaucacuugaa

SEQ ID NO: 160200 - RNA, 21 nt, Human
gaggcaggggaaucgcuugaa

SEQ ID NO: 160201 - RNA, 21 nt, Human
gaggcaggggaauggcuugaa

SEQ ID NO: 160202 - RNA, 21 nt, Human
gaggcaggggaauugcuugaa

SEQ ID NO: 160203 - RNA, 32 nt, Human
gaggcaggggagagagaauggcaucucgcgug

SEQ ID NO: 160204 - RNA, 32 nt, Human
gaggcaggggcagaggugacgacagugccccu

SEQ ID NO: 160205 - RNA, 32 nt, Human
gaggcaggggcggguggaucaccugaggucag

SEQ ID NO: 160206 - RNA, 32 nt, Human
gaggcagggggagggggaggaggaggagcccg

SEQ ID NO: 160207 - RNA, 32 nt, Human
gaggcaggggugcugagaaggcggcugcuggg

SEQ ID NO: 160208 - RNA, 32 nt, Human
gaggcagggguugaagccagggaguggucagc

SEQ ID NO: 160209 - RNA, 19 nt, Human
gaggcagggguugcaguga

SEQ ID NO: 160210 - RNA, 21 nt, Human
gaggcagggguugcagugagc

SEQ ID NO: 160211 - RNA, 32 nt, Human
gaggcagggucucacucugguugcccaggcug

SEQ ID NO: 160212 - RNA, 20 nt, Human
gaggcagggucucacucugu

SEQ ID NO: 160213 - RNA, 32 nt, Human
gaggcagggucugagccuugccuggggccccg

SEQ ID NO: 160214 - RNA, 32 nt, Human
gaggcagggucugugcuccacucugagggccc

SEQ ID NO: 160215 - RNA, 21 nt, Human
gaggcaggguuucaccauguu

SEQ ID NO: 160216 - RNA, 22 nt, Human
gaggcaggguuucaccauguua

SEQ ID NO: 160217 - RNA, 22 nt, Human
gaggcaggguuucaccauguug

SEQ ID NO: 160218 - RNA, 23 nt, Human
gaggcaggguuucaccauguugg

SEQ ID NO: 160219 - RNA, 21 nt, Human
gaggcagguacaucaccugag

SEQ ID NO: 160220 - RNA, 22 nt, Human
gaggcagguagaucaugagguc

SEQ ID NO: 160221 - RNA, 32 nt, Human
gaggcaggucgggcugccagcccagcuggccg

SEQ ID NO: 160222 - RNA, 32 nt, Human
gaggcaggucucccagcucagaccccgccccg

SEQ ID NO: 160223 - RNA, 21 nt, Human
gaggcaggugaaucacuugaa

SEQ ID NO: 160224 - RNA, 22 nt, Human
gaggcaggugaaucacuugaac

SEQ ID NO: 160225 - RNA, 21 nt, Human
gaggcaggugaaucgcuugaa

SEQ ID NO: 160226 - RNA, 22 nt, Human
gaggcaggugaaucgcuugaac

SEQ ID NO: 160227 - RNA, 19 nt, Human
gaggcagguggaucacaag

SEQ ID NO: 160228 - RNA, 22 nt, Human
gaggcagguggaucacaagguc

SEQ ID NO: 160229 - RNA, 22 nt, Human
gaggcagguggaucacaagguu

SEQ ID NO: 160230 - RNA, 22 nt, Human
gaggcagguggaucacgagguc

SEQ ID NO: 160231 - RNA, 22 nt, Human
gaggcagguggaucacgauguc

SEQ ID NO: 160232 - RNA, 24 nt, Human
gaggcagguggaucacgugagguc

SEQ ID NO: 160233 - RNA, 24 nt, Human
gaggcagguggaucacucaagguc

SEQ ID NO: 160234 - RNA, 22 nt, Human
gaggcagguggaucacugaggu

SEQ ID NO: 160235 - RNA, 32 nt, Human
gaggcagguggaucacuugagcucaggagcuu

SEQ ID NO: 160236 - RNA, 32 nt, Human
gaggcagguggaucacuugagcucaggaguuc

SEQ ID NO: 160237 - RNA, 32 nt, Human
gaggcagguggaucacuugagcucaggaguuu

SEQ ID NO: 160238 - RNA, 21 nt, Human
gaggcagguggaucauagguc

SEQ ID NO: 160239 - RNA, 22 nt, Human
gaggcagguggaucaugagguc

SEQ ID NO: 160240 - RNA, 32 nt, Human
gaggcagguggaucgcuugagcucaggaguuc

SEQ ID NO: 160241 - RNA, 22 nt, Human
gaggcagguggaucgugagguc

SEQ ID NO: 160242 - RNA, 21 nt, Human
gaggcagguggaugacaaggu

SEQ ID NO: 160243 - RNA, 21 nt, Human
gaggcagguggauugcuugaa

SEQ ID NO: 160244 - RNA, 32 nt, Human
gaggcagguggguggagggggaugcugggaau

SEQ ID NO: 160245 - RNA, 32 nt, Human
gaggcagguggguggagggggaugcugggagu

SEQ ID NO: 160246 - RNA, 32 nt, Human
gaggcagguugaaggauucacaggguaagauc

SEQ ID NO: 160247 - RNA, 21 nt, Human
gaggcaguagaaucacuugaa

SEQ ID NO: 160248 - RNA, 21 nt, Human
gaggcaguagaaucauuugaa

SEQ ID NO: 160249 - RNA, 21 nt, Human
gaggcaguagaaucgcuugaa

SEQ ID NO: 160250 - RNA, 32 nt, Human
gaggcaguauaggagagagagcaaggauugag

SEQ ID NO: 160251 - RNA, 21 nt, Human
gaggcaguauccugcccugga

SEQ ID NO: 160252 - RNA, 32 nt, Human
gaggcagucugggcacuuuucugcaaguccac

SEQ ID NO: 160253 - RNA, 32 nt, Human
gaggcagucuguccuugagacuaacaaaguca

SEQ ID NO: 160254 - RNA, 32 nt, Human
gaggcagugcagccacagcucccccggccuuc

SEQ ID NO: 160255 - RNA, 32 nt, Human
gaggcagugcaggaggccugugggagcagccu

SEQ ID NO: 160256 - RNA, 32 nt, Human
gaggcagugcugcugcucccgcccgaggcuca

SEQ ID NO: 160257 - RNA, 32 nt, Human
gaggcaguggguggagagagaauggggagacg

SEQ ID NO: 160258 - RNA, 32 nt, Human
gaggcaguugaagaguugaggaaagguuuuuc

SEQ ID NO: 160259 - RNA, 32 nt, Human
gaggcaguuugcaaucccaugacaacuggauu

SEQ ID NO: 160260 - RNA, 32 nt, Human
gaggcauaaauacuucaaaguccccauuggcc

SEQ ID NO: 160261 - RNA, 32 nt, Human
gaggcauaagccaccaugcccagccacgugaa

SEQ ID NO: 160262 - RNA, 32 nt, Human
gaggcauaccggaagaggaugcaucagcuccu

SEQ ID NO: 160263 - RNA, 22 nt, Human
gaggcauagaauacacauuuuu

SEQ ID NO: 160264 - RNA, 32 nt, Human
gaggcauagguuaccacccccaccccggcccg

SEQ ID NO: 160265 - RNA, 32 nt, Human
gaggcauagucgcccccagcuggguugugcuc

SEQ ID NO: 160266 - RNA, 32 nt, Human
gaggcaucagccacugugucuuucauuuauuc

SEQ ID NO: 160267 - RNA, 32 nt, Human
gaggcauccugaagcauuagaaugauuccaac

SEQ ID NO: 160268 - RNA, 32 nt, Human
gaggcaugaacacacauggaugcacacacaca

SEQ ID NO: 160269 - RNA, 32 nt, Human
gaggcaugagccaccgugcccagccucaaagc

SEQ ID NO: 160270 - RNA, 32 nt, Human
gaggcaugcaguugggagguccuggcucgguu

SEQ ID NO: 160271 - RNA, 32 nt, Human
gaggcauggagaacaagaaaguugaguucgaa

SEQ ID NO: 160272 - RNA, 22 nt, Human
gaggcauggagaaucgcuugaa

SEQ ID NO: 160273 - RNA, 32 nt, Human
gaggcauggaggagggaggcgugggaugggaa

SEQ ID NO: 160274 - RNA, 32 nt, Human
gaggcaugggucucacuguguugcccaggcug

SEQ ID NO: 160275 - RNA, 32 nt, Human
gaggcauuagcagcagcaccucugggucaaca

SEQ ID NO: 160276 - RNA, 32 nt, Human
gaggcauucaaggaugcacagcucaaguauuu

SEQ ID NO: 160277 - RNA, 32 nt, Human
gaggcauucagccaucaugauguggccuuuac

SEQ ID NO: 160278 - RNA, 18 nt, Human
gaggcauuccagaaggac

SEQ ID NO: 160279 - RNA, 32 nt, Human
gaggcauuuaauuaaggcucuacuuccagguu

SEQ ID NO: 160280 - RNA, 32 nt, Human
gaggcauuuuuaucuucugucacuacuacuua

SEQ ID NO: 160281 - RNA, 32 nt, Human
gaggccaaaaguuugagaccagccugggcaac

SEQ ID NO: 160282 - RNA, 27 nt, Human
gaggccaaagcaggagaauugcuugaa

SEQ ID NO: 160283 - RNA, 22 nt, Human
gaggccaaagcaggaggaucac

SEQ ID NO: 160284 - RNA, 27 nt, Human
gaggccaaagcaggaggaucgcuugag

SEQ ID NO: 160285 - RNA, 22 nt, Human
gaggccaaagcaggcggaucac

SEQ ID NO: 160286 - RNA, 22 nt, Human
gaggccaaagcagguggauuac

SEQ ID NO: 160287 - RNA, 32 nt, Human
gaggccaaaggccaacuguacucccaaaggca

SEQ ID NO: 160288 - RNA, 32 nt, Human
gaggccaaagugggaggauugcuuggcucaag

SEQ ID NO: 160289 - RNA, 32 nt, Human
gaggccaaagugggccgaucaccugagcucag

SEQ ID NO: 160290 - RNA, 32 nt, Human
gaggccaaagugggcggaucaccugaggccag

SEQ ID NO: 160291 - RNA, 32 nt, Human
gaggccaaaguggguggaucaccugaggucag

SEQ ID NO: 160292 - RNA, 26 nt, Human
gaggccaaaugggagaauugcuugaa

SEQ ID NO: 160293 - RNA, 32 nt, Human
gaggccaacacaggaggaucacuugagacugg

SEQ ID NO: 160294 - RNA, 32 nt, Human
gaggccaacagcacgcagcugaagagcagggc

SEQ ID NO: 160295 - RNA, 32 nt, Human
gaggccaaccccuuuccaaggcugcuuggaaa

SEQ ID NO: 160296 - RNA, 32 nt, Human
gaggccaacguggauggaucaccugaggucag

SEQ ID NO: 160297 - RNA, 32 nt, Human
gaggccaagaagaggaagauugcuugagccca

SEQ ID NO: 160298 - RNA, 32 nt, Human
gaggccaagaagcagaagcuaagggagggggu

SEQ ID NO: 160299 - RNA, 22 nt, Human
gaggccaagacagaaggaucac

SEQ ID NO: 160300 - RNA, 22 nt, Human
gaggccaagacaggaggaucac

SEQ ID NO: 160301 - RNA, 22 nt, Human
gaggccaagacaggcagaucac

SEQ ID NO: 160302 - RNA, 22 nt, Human
gaggccaagacagguagaucac

SEQ ID NO: 160303 - RNA, 22 nt, Human
gaggccaagacagguggaucac

SEQ ID NO: 160304 - RNA, 32 nt, Human
gaggccaagacagguggaucaccugagguuag

SEQ ID NO: 160305 - RNA, 22 nt, Human
gaggccaagacgggcggaucac

SEQ ID NO: 160306 - RNA, 32 nt, Human
gaggccaagacgggcggaucaccugaggugag

SEQ ID NO: 160307 - RNA, 22 nt, Human
gaggccaagacgggugaaucac

SEQ ID NO: 160308 - RNA, 32 nt, Human
gaggccaagagucugagaccagccuggcuaac

SEQ ID NO: 160309 - RNA, 32 nt, Human
gaggccaagaguuaaagaccagccuggucaau

SEQ ID NO: 160310 - RNA, 32 nt, Human
gaggccaagaguucaagaccagccugggcaac

SEQ ID NO: 160311 - RNA, 32 nt, Human
gaggccaagaguuucagaccagccugggcaac

SEQ ID NO: 160312 - RNA, 32 nt, Human
gaggccaagauggcugcugccugcucauggcc

SEQ ID NO: 160313 - RNA, 32 nt, Human
gaggccaagaugggcggaucaccugaggucag

SEQ ID NO: 160314 - RNA, 32 nt, Human
gaggccaagauggguggaucaccugaggucag

SEQ ID NO: 160315 - RNA, 32 nt, Human
gaggccaagcagccucgcccagaagcugaugu

SEQ ID NO: 160316 - RNA, 24 nt, Human
gaggccaagccugggggcuggggg

SEQ ID NO: 160317 - RNA, 32 nt, Human
gaggccaagcuaugugcuagagcccaggccag

SEQ ID NO: 160318 - RNA, 19 nt, Human
gaggccaagcuggaucuga

SEQ ID NO: 160319 - RNA, 22 nt, Human
gaggccaaggaaggcagaucac

SEQ ID NO: 160320 - RNA, 32 nt, Human
gaggccaaggacaguggaucaccugaggucag

SEQ ID NO: 160321 - RNA, 32 nt, Human
gaggccaaggagaguggaucaccugaggucgg

SEQ ID NO: 160322 - RNA, 24 nt, Human
gaggccaaggagggaggaucgcuu

SEQ ID NO: 160323 - RNA, 32 nt, Human
gaggccaaggagggcaaaucaccugagaucag

SEQ ID NO: 160324 - RNA, 32 nt, Human
gaggccaaggagggcagaucaccugaggucag

SEQ ID NO: 160325 - RNA, 32 nt, Human
gaggccaaggaggguggaucaccugaggucag

SEQ ID NO: 160326 - RNA, 20 nt, Human
gaggccaaggagguggauca

SEQ ID NO: 160327 - RNA, 27 nt, Human
gaggccaaggcaaaaggauugcuugag

SEQ ID NO: 160328 - RNA, 22 nt, Human
gaggccaaggcaagaggaucac

SEQ ID NO: 160329 - RNA, 22 nt, Human
gaggccaaggcaagcagaucac

SEQ ID NO: 160330 - RNA, 22 nt, Human
gaggccaaggcaaggggaucac

SEQ ID NO: 160331 - RNA, 27 nt, Human
gaggccaaggcacaagaaucgcuugaa

SEQ ID NO: 160332 - RNA, 32 nt, Human
gaggccaaggcacauaggucacuugaggucaa

SEQ ID NO: 160333 - RNA, 32 nt, Human
gaggccaaggcacauaggucacuugaggucag

SEQ ID NO: 160334 - RNA, 27 nt, Human
gaggccaaggcacgagaauugcuugaa

SEQ ID NO: 160335 - RNA, 24 nt, Human
gaggccaaggcagaaggauauuga

SEQ ID NO: 160336 - RNA, 22 nt, Human
gaggccaaggcagaaggaucac

SEQ ID NO: 160337 - RNA, 22 nt, Human
gaggccaaggcagauggaacac

SEQ ID NO: 160338 - RNA, 22 nt, Human
gaggccaaggcagauggaucau

SEQ ID NO: 160339 - RNA, 24 nt, Human
gaggccaaggcagcauugcuugaa

SEQ ID NO: 160340 - RNA, 22 nt, Human
gaggccaaggcaggaagaucac

SEQ ID NO: 160341 - RNA, 27 nt, Human
gaggccaaggcaggagaagcgcuugag

SEQ ID NO: 160342 - RNA, 22 nt, Human
gaggccaaggcaggagaaucac

SEQ ID NO: 160343 - RNA, 27 nt, Human
gaggccaaggcaggagaaucgcucgaa

SEQ ID NO: 160344 - RNA, 27 nt, Human
gaggccaaggcaggagaaucgcuugaa

SEQ ID NO: 160345 - RNA, 27 nt, Human
gaggccaaggcaggagaauugcucgaa

SEQ ID NO: 160346 - RNA, 22 nt, Human
gaggccaaggcaggaggaucac

SEQ ID NO: 160347 - RNA, 27 nt, Human
gaggccaaggcaggaggaucgcuugag

SEQ ID NO: 160348 - RNA, 22 nt, Human
gaggccaaggcaggcagaccac

SEQ ID NO: 160349 - RNA, 22 nt, Human
gaggccaaggcaggcagaucac

SEQ ID NO: 160350 - RNA, 22 nt, Human
gaggccaaggcaggcagaucau

SEQ ID NO: 160351 - RNA, 22 nt, Human
gaggccaaggcaggcagaucgc

SEQ ID NO: 160352 - RNA, 27 nt, Human
gaggccaaggcaggcagaucgcuugag

SEQ ID NO: 160353 - RNA, 25 nt, Human
gaggccaaggcaggcagguggauca

SEQ ID NO: 160354 - RNA, 32 nt, Human
gaggccaaggcaggcagguggaucaccugagg

SEQ ID NO: 160355 - RNA, 22 nt, Human
gaggccaaggcaggcauaucac

SEQ ID NO: 160356 - RNA, 22 nt, Human
gaggccaaggcaggcggaccac

SEQ ID NO: 160357 - RNA, 22 nt, Human
gaggccaaggcaggcggaucac

SEQ ID NO: 160358 - RNA, 22 nt, Human
gaggccaaggcagggggaucac

SEQ ID NO: 160359 - RNA, 22 nt, Human
gaggccaaggcagguagaucac

SEQ ID NO: 160360 - RNA, 21 nt, Human
gaggccaaggcagguggauca

SEQ ID NO: 160361 - RNA, 22 nt, Human
gaggccaaggcagguggaucac

SEQ ID NO: 160362 - RNA, 32 nt, Human
gaggccaaggcagguggaucacuugggucggg

SEQ ID NO: 160363 - RNA, 22 nt, Human
gaggccaaggcagguggaucau

SEQ ID NO: 160364 - RNA, 22 nt, Human
gaggccaaggcagguggaucgc

SEQ ID NO: 160365 - RNA, 27 nt, Human
gaggccaaggcagguggaucgcuugag

SEQ ID NO: 160366 - RNA, 23 nt, Human
gaggccaaggcaugagaaucgcu

SEQ ID NO: 160367 - RNA, 27 nt, Human
gaggccaaggcaugagaaucgcuugaa

SEQ ID NO: 160368 - RNA, 22 nt, Human
gaggccaaggccagcggaucac

SEQ ID NO: 160369 - RNA, 22 nt, Human
gaggccaaggcggacggaucac

SEQ ID NO: 160370 - RNA, 22 nt, Human
gaggccaaggcggauggaucac

SEQ ID NO: 160371 - RNA, 22 nt, Human
gaggccaaggcgggcaaaucac

SEQ ID NO: 160372 - RNA, 22 nt, Human
gaggccaaggcgggcagaucac

SEQ ID NO: 160373 - RNA, 22 nt, Human
gaggccaaggcgggcggaucac

SEQ ID NO: 160374 - RNA, 32 nt, Human
gaggccaaggcgggcguaucaccugaggucag

SEQ ID NO: 160375 - RNA, 32 nt, Human
gaggccaaggcgggucaaucaccugaggucag

SEQ ID NO: 160376 - RNA, 22 nt, Human
gaggccaaggcgggugaaucac

SEQ ID NO: 160377 - RNA, 32 nt, Human
gaggccaaggcgggugaaucaccugaggucag

SEQ ID NO: 160378 - RNA, 32 nt, Human
gaggccaaggcgggugcaucaccugaggucgg

SEQ ID NO: 160379 - RNA, 22 nt, Human
gaggccaaggcggguggaucac

SEQ ID NO: 160380 - RNA, 32 nt, Human
gaggccaaggcggguggaucaccugagaucag

SEQ ID NO: 160381 - RNA, 32 nt, Human
gaggccaaggcggguggaucaccugaggccag

SEQ ID NO: 160382 - RNA, 32 nt, Human
gaggccaaggcggguggaucaccugaggucac

SEQ ID NO: 160383 - RNA, 32 nt, Human
gaggccaaggcggguggaucaccugaggucag

SEQ ID NO: 160384 - RNA, 32 nt, Human
gaggccaaggcguguggaucaccugaggucag

SEQ ID NO: 160385 - RNA, 32 nt, Human
gaggccaaggcguguggauugcuuggcccagg

SEQ ID NO: 160386 - RNA, 22 nt, Human
gaggccaaggcuggcagaucac

SEQ ID NO: 160387 - RNA, 22 nt, Human
gaggccaaggcugguggaucac

SEQ ID NO: 160388 - RNA, 32 nt, Human
gaggccaagggaggcggaucaccugaggucag

SEQ ID NO: 160389 - RNA, 22 nt, Human
gaggccaagguaggcagaucac

SEQ ID NO: 160390 - RNA, 32 nt, Human
gaggccaaggugaguggaucaccugaggucag

SEQ ID NO: 160391 - RNA, 32 nt, Human
gaggccaaggugggaggaucaccugaggucag

SEQ ID NO: 160392 - RNA, 32 nt, Human
gaggccaaggugggcaaaucaccugaggucag

SEQ ID NO: 160393 - RNA, 32 nt, Human
gaggccaaggugggcagaucaccugaggucag

SEQ ID NO: 160394 - RNA, 32 nt, Human
gaggccaaggugggcggaucaccugagaucga

SEQ ID NO: 160395 - RNA, 32 nt, Human
gaggccaaggugggcggaucaccugagcucag

SEQ ID NO: 160396 - RNA, 32 nt, Human
gaggccaaggugggcggaucaccugaggucag

SEQ ID NO: 160397 - RNA, 32 nt, Human
gaggccaaggugggcggaucaccugaggucgg

SEQ ID NO: 160398 - RNA, 32 nt, Human
gaggccaaggugggcggaucaccugagguuag

SEQ ID NO: 160399 - RNA, 21 nt, Human
gaggccaagguggguggauca

SEQ ID NO: 160400 - RNA, 32 nt, Human
gaggccaagguggguggaucaccugagggcag

SEQ ID NO: 160401 - RNA, 32 nt, Human
gaggccaagguggguggaucaccugaggucag

SEQ ID NO: 160402 - RNA, 32 nt, Human
gaggccaagguggguggaucaccuguggucaa

SEQ ID NO: 160403 - RNA, 24 nt, Human
gaggccaagucugcagugagcuau

SEQ ID NO: 160404 - RNA, 20 nt, Human
gaggccaagugagggacugc

SEQ ID NO: 160405 - RNA, 18 nt, Human
gaggccaaguuggcugcu

SEQ ID NO: 160406 - RNA, 32 nt, Human
gaggccaaugcauguggaucaccugaggucag

SEQ ID NO: 160407 - RNA, 32 nt, Human
gaggccaauguggguggaucaccugaggucag

SEQ ID NO: 160408 - RNA, 32 nt, Human
gaggccacaaguuugagaccagccugggcaac

SEQ ID NO: 160409 - RNA, 32 nt, Human
gaggccacacaggcuggugggccccgaaugcc

SEQ ID NO: 160410 - RNA, 32 nt, Human
gaggccacagcaucuucuacaaaggacucaca

SEQ ID NO: 160411 - RNA, 32 nt, Human
gaggccacagccccagccuuaggccaggcccu

SEQ ID NO: 160412 - RNA, 18 nt, Human
gaggccacagcccuggga

SEQ ID NO: 160413 - RNA, 32 nt, Human
gaggccacagugagcuaugacuaugccacugu

SEQ ID NO: 160414 - RNA, 32 nt, Human
gaggccacaguucugugagcagaggaagagcu

SEQ ID NO: 160415 - RNA, 32 nt, Human
gaggccacaugcugaccagccugaugaggcaa

SEQ ID NO: 160416 - RNA, 32 nt, Human
gaggccacaugguggaggcagcgaugagaccu

SEQ ID NO: 160417 - RNA, 32 nt, Human
gaggccacauguagcugauuucagagauuugc

SEQ ID NO: 160418 - RNA, 23 nt, Human
gaggccaccaaccaaagucaguu

SEQ ID NO: 160419 - RNA, 32 nt, Human
gaggccaccagcugacucaccgccuaggaagg

SEQ ID NO: 160420 - RNA, 18 nt, Human
gaggccacccagauggac

SEQ ID NO: 160421 - RNA, 32 nt, Human
gaggccacccuccagcuuucucuuaucccagu

SEQ ID NO: 160422 - RNA, 22 nt, Human
gaggccacccugcugggccacu

SEQ ID NO: 160423 - RNA, 32 nt, Human
gaggccaccugcagccuccacccggcucucac

SEQ ID NO: 160424 - RNA, 18 nt, Human
gaggccacgaguauuuca

SEQ ID NO: 160425 - RNA, 32 nt, Human
gaggccacgccuggacccagagcugauguuug

SEQ ID NO: 160426 - RNA, 32 nt, Human
gaggccacgguggguggaucaccugaggucag

SEQ ID NO: 160427 - RNA, 32 nt, Human
gaggccacgugaggacacagugagaagguggc

SEQ ID NO: 160428 - RNA, 22 nt, Human
gaggccacgugcaguggcucac

SEQ ID NO: 160429 - RNA, 32 nt, Human
gaggccacucauuucagggaagcgaagggaag

SEQ ID NO: 160430 - RNA, 32 nt, Human
gaggccacugaagaggaggaggagggucuaga

SEQ ID NO: 160431 - RNA, 32 nt, Human
gaggccacugagccacccuuccagccccagcc

SEQ ID NO: 160432 - RNA, 20 nt, Human
gaggccacugcaacauuuua

SEQ ID NO: 160433 - RNA, 32 nt, Human
gaggccacugcacccuuucucggggaagauga

SEQ ID NO: 160434 - RNA, 32 nt, Human
gaggccacugcacugcucacuuguggcccagc

SEQ ID NO: 160435 - RNA, 32 nt, Human
gaggccacugggcuuucccccucccaggccuc

SEQ ID NO: 160436 - RNA, 32 nt, Human
gaggccacuguaggagccuccagggaguucuc

SEQ ID NO: 160437 - RNA, 24 nt, Human
gaggccagaaaagcugcccaguga

SEQ ID NO: 160438 - RNA, 24 nt, Human
gaggccagaaaagugaacugaguu

SEQ ID NO: 160439 - RNA, 32 nt, Human
gaggccagaaauuugagaccagccugggcaac

SEQ ID NO: 160440 - RNA, 32 nt, Human
gaggccagaaguucaagaucagccuggccaac

SEQ ID NO: 160441 - RNA, 32 nt, Human
gaggccagaaguuugagacuagccugggcaau

SEQ ID NO: 160442 - RNA, 21 nt, Human
gaggccagaccaggccagacu

SEQ ID NO: 160443 - RNA, 32 nt, Human
gaggccagacugcacaacacagugagaccucg

SEQ ID NO: 160444 - RNA, 21 nt, Human
gaggccagacugggcaggaga

SEQ ID NO: 160445 - RNA, 21 nt, Human
gaggccagagaaucgcuugaa

SEQ ID NO: 160446 - RNA, 32 nt, Human
gaggccagagacaaagcugugggagccaagaa

SEQ ID NO: 160447 - RNA, 22 nt, Human
gaggccagaggucgggccagcu

SEQ ID NO: 160448 - RNA, 32 nt, Human
gaggccagagguucaagaccagccugggcaac

SEQ ID NO: 160449 - RNA, 32 nt, Human
gaggccagagugagugacuuggagcuggaaaa

SEQ ID NO: 160450 - RNA, 32 nt, Human
gaggccagaguuuggugggggcagauggcagg

SEQ ID NO: 160451 - RNA, 24 nt, Human
gaggccagauuuuuaaagccagcu

SEQ ID NO: 160452 - RNA, 21 nt, Human
gaggccagcagccacccgaga

SEQ ID NO: 160453 - RNA, 32 nt, Human
gaggccagcaguuugagaccagccuggccaac

SEQ ID NO: 160454 - RNA, 32 nt, Human
gaggccagccagggcaacacagcaagacccca

SEQ ID NO: 160455 - RNA, 20 nt, Human
gaggccagccccgagccagc

SEQ ID NO: 160456 - RNA, 30 nt, Human
gaggccagccucuccaccuucugagccugc

SEQ ID NO: 160457 - RNA, 32 nt, Human
gaggccagccucuggcuuuucugccguggauu

SEQ ID NO: 160458 - RNA, 32 nt, Human
gaggccagccugaccaacguggagaaaugcca

SEQ ID NO: 160459 - RNA, 32 nt, Human
gaggccagccuggaucugucucucccuucccc

SEQ ID NO: 160460 - RNA, 21 nt, Human
gaggccagccuggccaacaug

SEQ ID NO: 160461 - RNA, 32 nt, Human
gaggccagccugggaaauauagugagacccug

SEQ ID NO: 160462 - RNA, 32 nt, Human
gaggccagccugggcaacacagcaagacccca

SEQ ID NO: 160463 - RNA, 21 nt, Human
gaggccagccugggcaacaua

SEQ ID NO: 160464 - RNA, 32 nt, Human
gaggccagccugggcaacauagagagacccca

SEQ ID NO: 160465 - RNA, 32 nt, Human
gaggccagccugggcaacauagugagaccccc

SEQ ID NO: 160466 - RNA, 32 nt, Human
gaggccagccugggggacuugacuaccuggac

SEQ ID NO: 160467 - RNA, 32 nt, Human
gaggccagcugcacuccugcacgggguuccua

SEQ ID NO: 160468 - RNA, 19 nt, Human
gaggccagcugggggccag

SEQ ID NO: 160469 - RNA, 32 nt, Human
gaggccagcugguaggcagccuggugaggggg

SEQ ID NO: 160470 - RNA, 32 nt, Human
gaggccagcugguugcuacgcagcaacaggaa

SEQ ID NO: 160471 - RNA, 23 nt, Human
gaggccagcugguuuugugagga

SEQ ID NO: 160472 - RNA, 21 nt, Human
gaggccaggaaagggucagcu

SEQ ID NO: 160473 - RNA, 17 nt, Human
gaggccaggaacauucc

SEQ ID NO: 160474 - RNA, 32 nt, Human
gaggccaggaauucgagaccagccuggcaaca

SEQ ID NO: 160475 - RNA, 32 nt, Human
gaggccaggaauucgagaccagccuggccaac

SEQ ID NO: 160476 - RNA, 32 nt, Human
gaggccaggaauucgagaccagccugggcagc

SEQ ID NO: 160477 - RNA, 32 nt, Human
gaggccaggaauuugaaaccagccugggcaaa

SEQ ID NO: 160478 - RNA, 23 nt, Human
gaggccaggaauuuuagaccagc

SEQ ID NO: 160479 - RNA, 32 nt, Human
gaggccaggacagaucacuugaggucaggagu

SEQ ID NO: 160480 - RNA, 32 nt, Human
gaggccaggagagaguauaaggggauagcagc

SEQ ID NO: 160481 - RNA, 24 nt, Human
gaggccaggagccagccacuggcu

SEQ ID NO: 160482 - RNA, 32 nt, Human
gaggccaggagccuccaugcaggagggagaga

SEQ ID NO: 160483 - RNA, 23 nt, Human
gaggccaggagcucgaaaccagu

SEQ ID NO: 160484 - RNA, 32 nt, Human
gaggccaggaggagcaguaugugcacagccga

SEQ ID NO: 160485 - RNA, 24 nt, Human
gaggccaggaggcccggaccaguu

SEQ ID NO: 160486 - RNA, 32 nt, Human
gaggccaggaggcggagcuugcagugagccga

SEQ ID NO: 160487 - RNA, 22 nt, Human
gaggccaggagggcagugagcu

SEQ ID NO: 160488 - RNA, 22 nt, Human
gaggccaggagggcugcugggg

SEQ ID NO: 160489 - RNA, 21 nt, Human
gaggccaggaggggagcugcu

SEQ ID NO: 160490 - RNA, 23 nt, Human
gaggccaggagggguccuggaga

SEQ ID NO: 160491 - RNA, 32 nt, Human
gaggccaggagguccaggccgcaaugagaugu

SEQ ID NO: 160492 - RNA, 32 nt, Human
gaggccaggagguggagucuagccugggaaac

SEQ ID NO: 160493 - RNA, 32 nt, Human
gaggccaggagguugaggcugcagugagcugu

SEQ ID NO: 160494 - RNA, 32 nt, Human
gaggccaggaguauaagagcagccugggcaaa

SEQ ID NO: 160495 - RNA, 32 nt, Human
gaggccaggagucccagagcagccugggcaac

SEQ ID NO: 160496 - RNA, 23 nt, Human
gaggccaggagugggauucagcu

SEQ ID NO: 160497 - RNA, 32 nt, Human
gaggccaggaguuaaagagcagccuggcuaac

SEQ ID NO: 160498 - RNA, 32 nt, Human
gaggccaggaguuagagaccagccuggccaac

SEQ ID NO: 160499 - RNA, 32 nt, Human
gaggccaggaguuagagacugcagugagcuau

SEQ ID NO: 160500 - RNA, 23 nt, Human
gaggccaggaguucaagaccagc

SEQ ID NO: 160501 - RNA, 32 nt, Human
gaggccaggaguucaagaccagccuggccaac

SEQ ID NO: 160502 - RNA, 32 nt, Human
gaggccaggaguucaagaccagccuggcuaac

SEQ ID NO: 160503 - RNA, 32 nt, Human
gaggccaggaguucaagaccagccugggcaac

SEQ ID NO: 160504 - RNA, 24 nt, Human
gaggccaggaguucaagaccagcu

SEQ ID NO: 160505 - RNA, 23 nt, Human
gaggccaggaguucaagaccagu

SEQ ID NO: 160506 - RNA, 23 nt, Human
gaggccaggaguucaagacuagc

SEQ ID NO: 160507 - RNA, 23 nt, Human
gaggccaggaguucaagaucagc

SEQ ID NO: 160508 - RNA, 32 nt, Human
gaggccaggaguucaagaucagccuggccaac

SEQ ID NO: 160509 - RNA, 32 nt, Human
gaggccaggaguucaagaucagccugggcaau

SEQ ID NO: 160510 - RNA, 23 nt, Human
gaggccaggaguucaaggccagc

SEQ ID NO: 160511 - RNA, 32 nt, Human
gaggccaggaguucaaggccagccuggacaac

SEQ ID NO: 160512 - RNA, 23 nt, Human
gaggccaggaguucaauaccagc

SEQ ID NO: 160513 - RNA, 23 nt, Human
gaggccaggaguucacaaccagc

SEQ ID NO: 160514 - RNA, 23 nt, Human
gaggccaggaguucaggaccagc

SEQ ID NO: 160515 - RNA, 23 nt, Human
gaggccaggaguuccagaccagc

SEQ ID NO: 160516 - RNA, 32 nt, Human
gaggccaggaguuccagaccagccuggccaac

SEQ ID NO: 160517 - RNA, 32 nt, Human
gaggccaggaguuccagaccagccugggcaac

SEQ ID NO: 160518 - RNA, 32 nt, Human
gaggccaggaguuccagaccagccuggguaau

SEQ ID NO: 160519 - RNA, 32 nt, Human
gaggccaggaguuccagagcagccugggcaac

SEQ ID NO: 160520 - RNA, 23 nt, Human
gaggccaggaguuccagaucagc

SEQ ID NO: 160521 - RNA, 20 nt, Human
gaggccaggaguucgagacc

SEQ ID NO: 160522 - RNA, 23 nt, Human
gaggccaggaguucgagaccagc

SEQ ID NO: 160523 - RNA, 32 nt, Human
gaggccaggaguucgagaccagccuggacaac

SEQ ID NO: 160524 - RNA, 32 nt, Human
gaggccaggaguucgagaccagccuggccaac

SEQ ID NO: 160525 - RNA, 32 nt, Human
gaggccaggaguucgagaccagccuggccagc

SEQ ID NO: 160526 - RNA, 32 nt, Human
gaggccaggaguucgagaccagccuggcuaac

SEQ ID NO: 160527 - RNA, 32 nt, Human
gaggccaggaguucgagaccagccuggcuggc

SEQ ID NO: 160528 - RNA, 32 nt, Human
gaggccaggaguucgagaccagccugggcaac

SEQ ID NO: 160529 - RNA, 32 nt, Human
gaggccaggaguucgagaccagccuggucaag

SEQ ID NO: 160530 - RNA, 32 nt, Human
gaggccaggaguucgagaccagccugguccac

SEQ ID NO: 160531 - RNA, 32 nt, Human
gaggccaggaguucgagaucagccuggccaac

SEQ ID NO: 160532 - RNA, 32 nt, Human
gaggccaggaguucgauaccagccuggccaau

SEQ ID NO: 160533 - RNA, 23 nt, Human
gaggccaggaguucggguccggc

SEQ ID NO: 160534 - RNA, 23 nt, Human
gaggccaggaguucuagaccagc

SEQ ID NO: 160535 - RNA, 32 nt, Human
gaggccaggaguucuagaccagccuggccagc

SEQ ID NO: 160536 - RNA, 24 nt, Human
gaggccaggaguucugagaccagc

SEQ ID NO: 160537 - RNA, 32 nt, Human
gaggccaggaguugcagaccagccuggguaac

SEQ ID NO: 160538 - RNA, 23 nt, Human
gaggccaggaguuggagaccagc

SEQ ID NO: 160539 - RNA, 32 nt, Human
gaggccaggaguuggagaccagccuggccaac

SEQ ID NO: 160540 - RNA, 32 nt, Human
gaggccaggaguuggagaccagccugggcaac

SEQ ID NO: 160541 - RNA, 23 nt, Human
gaggccaggaguuggagaucagc

SEQ ID NO: 160542 - RNA, 32 nt, Human
gaggccaggaguuggagaucagccugggcaac

SEQ ID NO: 160543 - RNA, 32 nt, Human
gaggccaggaguuuaagaccagccugggcaac

SEQ ID NO: 160544 - RNA, 32 nt, Human
gaggccaggaguuuaaggccagccugggcaac

SEQ ID NO: 160545 - RNA, 23 nt, Human
gaggccaggaguuuaaggcuagc

SEQ ID NO: 160546 - RNA, 23 nt, Human
gaggccaggaguuucagaucagc

SEQ ID NO: 160547 - RNA, 23 nt, Human
gaggccaggaguuugaaaccagc

SEQ ID NO: 160548 - RNA, 32 nt, Human
gaggccaggaguuugaaaccagccuggccaac

SEQ ID NO: 160549 - RNA, 32 nt, Human
gaggccaggaguuugaaacuagucuggucaac

SEQ ID NO: 160550 - RNA, 22 nt, Human
gaggccaggaguuugacacagc

SEQ ID NO: 160551 - RNA, 32 nt, Human
gaggccaggaguuugacaccagccugggcaac

SEQ ID NO: 160552 - RNA, 20 nt, Human
gaggccaggaguuugagacc

SEQ ID NO: 160553 - RNA, 25 nt, Human
gaggccaggaguuugagaccagacu

SEQ ID NO: 160554 - RNA, 23 nt, Human
gaggccaggaguuugagaccagc

SEQ ID NO: 160555 - RNA, 32 nt, Human
gaggccaggaguuugagaccagccuggcaaac

SEQ ID NO: 160556 - RNA, 32 nt, Human
gaggccaggaguuugagaccagccuggccaac

SEQ ID NO: 160557 - RNA, 32 nt, Human
gaggccaggaguuugagaccagccugggcaac

SEQ ID NO: 160558 - RNA, 32 nt, Human
gaggccaggaguuugagaccagccugggcagc

SEQ ID NO: 160559 - RNA, 25 nt, Human
gaggccaggaguuugagacuagacu

SEQ ID NO: 160560 - RNA, 23 nt, Human
gaggccaggaguuugagacuagc

SEQ ID NO: 160561 - RNA, 23 nt, Human
gaggccaggaguuugagaucagc

SEQ ID NO: 160562 - RNA, 24 nt, Human
gaggccaggaguuugaggccagcu

SEQ ID NO: 160563 - RNA, 32 nt, Human
gaggccaggaguuugaggcugcagugagcuau

SEQ ID NO: 160564 - RNA, 32 nt, Human
gaggccaggaguuugaggcugcagugaguuau

SEQ ID NO: 160565 - RNA, 23 nt, Human
gaggccaggaguuuguuaccagc

SEQ ID NO: 160566 - RNA, 32 nt, Human
gaggccaggaguuuguuaccagccugggcaac

SEQ ID NO: 160567 - RNA, 24 nt, Human
gaggccaggaguuuugagaccagc

SEQ ID NO: 160568 - RNA, 21 nt, Human
gaggccaggcagcgcugcgga

SEQ ID NO: 160569 - RNA, 22 nt, Human
gaggccaggcaggaggauugcu

SEQ ID NO: 160570 - RNA, 24 nt, Human
gaggccaggccacuucugcugagg

SEQ ID NO: 160571 - RNA, 19 nt, Human
gaggccaggccagggcugg

SEQ ID NO: 160572 - RNA, 23 nt, Human
gaggccaggcccagcccgggcgg

SEQ ID NO: 160573 - RNA, 20 nt, Human
gaggccaggcccccagcggg

SEQ ID NO: 160574 - RNA, 19 nt, Human
gaggccaggcccgcgcccg

SEQ ID NO: 160575 - RNA, 22 nt, Human
gaggccaggccgcagcccagga

SEQ ID NO: 160576 - RNA, 24 nt, Human
gaggccaggccuccccggacugcu

SEQ ID NO: 160577 - RNA, 19 nt, Human
gaggccaggccucuccugg

SEQ ID NO: 160578 - RNA, 32 nt, Human
gaggccaggcugacuuggacauggcaagaggg

SEQ ID NO: 160579 - RNA, 24 nt, Human
gaggccaggcugaugcaccaggga

SEQ ID NO: 160580 - RNA, 32 nt, Human
gaggccaggcuggggugggguguggcaggagg

SEQ ID NO: 160581 - RNA, 18 nt, Human
gaggccagggauugcggg

SEQ ID NO: 160582 - RNA, 24 nt, Human
gaggccagggcaggcagaucaucu

SEQ ID NO: 160583 - RNA, 32 nt, Human
gaggccagggcugaacgcucacagcuaaggag

SEQ ID NO: 160584 - RNA, 23 nt, Human
gaggccagggggagagccaggcu

SEQ ID NO: 160585 - RNA, 21 nt, Human
gaggccaggggucacuagggg

SEQ ID NO: 160586 - RNA, 23 nt, Human
gaggccagggguuugagaccagc

SEQ ID NO: 160587 - RNA, 32 nt, Human
gaggccagggguuugagaccagccuggccaac

SEQ ID NO: 160588 - RNA, 24 nt, Human
gaggccagguguauuucgagccag

SEQ ID NO: 160589 - RNA, 32 nt, Human
gaggccagguguucaagagcagccuggucaac

SEQ ID NO: 160590 - RNA, 32 nt, Human
gaggccagguguucgagaccagccugggcaac

SEQ ID NO: 160591 - RNA, 32 nt, Human
gaggccagguguuggugcauggagaggccagg

SEQ ID NO: 160592 - RNA, 32 nt, Human
gaggccagguguuugagaucagccuggccagc

SEQ ID NO: 160593 - RNA, 32 nt, Human
gaggccagguucccaagagcucagggaacggg

SEQ ID NO: 160594 - RNA, 32 nt, Human
gaggccaguagggagagaagauggugguucuc

SEQ ID NO: 160595 - RNA, 32 nt, Human
gaggccaguaguuggagaccagccuggccaac

SEQ ID NO: 160596 - RNA, 32 nt, Human
gaggccaguccccaggagcagccccaggagca

SEQ ID NO: 160597 - RNA, 32 nt, Human
gaggccagugccugucccccaggcccacuugu

SEQ ID NO: 160598 - RNA, 23 nt, Human
gaggccagugcgcucaagccagc

SEQ ID NO: 160599 - RNA, 32 nt, Human
gaggccagugcucuccugccucuucgucuuuc

SEQ ID NO: 160600 - RNA, 32 nt, Human
gaggccagugcuuguuuagcugcuggagaaaa

SEQ ID NO: 160601 - RNA, 21 nt, Human
gaggccaguggacucugagga

SEQ ID NO: 160602 - RNA, 32 nt, Human
gaggccaguggccccuucacaugccccaacaa

SEQ ID NO: 160603 - RNA, 17 nt, Human
gaggccaguggugcugg

SEQ ID NO: 160604 - RNA, 32 nt, Human
gaggccaguucugcagggugucagcuccagga

SEQ ID NO: 160605 - RNA, 32 nt, Human
gaggccaguuuucuagugaagacagagugcac

SEQ ID NO: 160606 - RNA, 22 nt, Human
gaggccauaaggccagccaguu

SEQ ID NO: 160607 - RNA, 22 nt, Human
gaggccauauauagggcuacau

SEQ ID NO: 160608 - RNA, 32 nt, Human
gaggccaucacagcggugcacgcccagcucac

SEQ ID NO: 160609 - RNA, 32 nt, Human
gaggccauccuccucuucuuggaccuccuugg

SEQ ID NO: 160610 - RNA, 32 nt, Human
gaggccaugagcucauuggcugccuuuguagc

SEQ ID NO: 160611 - RNA, 32 nt, Human
gaggccaugaucucugcucuucccucucccag

SEQ ID NO: 160612 - RNA, 19 nt, Human
gaggccaugauuucacaaa

SEQ ID NO: 160613 - RNA, 32 nt, Human
gaggccaugccaccucccuuccaguccacaug

SEQ ID NO: 160614 - RNA, 32 nt, Human
gaggccaugccagagcccagaacucacgccgg

SEQ ID NO: 160615 - RNA, 22 nt, Human
gaggccauggcagguggaucac

SEQ ID NO: 160616 - RNA, 26 nt, Human
gaggccauguauggcugugucuucac

SEQ ID NO: 160617 - RNA, 32 nt, Human
gaggccauuaacaaaucguccuuguccugagg

SEQ ID NO: 160618 - RNA, 32 nt, Human
gaggccauucugagccacacugaaaaggaaaa

SEQ ID NO: 160619 - RNA, 32 nt, Human
gaggccauucuuucccaacaccucuuggggag

SEQ ID NO: 160620 - RNA, 32 nt, Human
gaggccauugaaucccaguccuaacagaagua

SEQ ID NO: 160621 - RNA, 21 nt, Human
gaggccauuggcucccagagg

SEQ ID NO: 160622 - RNA, 20 nt, Human
gaggcccaacugaaaccaag

SEQ ID NO: 160623 - RNA, 21 nt, Human
gaggcccaagauucuacagca

SEQ ID NO: 160624 - RNA, 20 nt, Human
gaggcccaagcccagggcag

SEQ ID NO: 160625 - RNA, 22 nt, Human
gaggcccaaggccaccuccgca

SEQ ID NO: 160626 - RNA, 23 nt, Human
gaggcccaaguucccugcacgca

SEQ ID NO: 160627 - RNA, 23 nt, Human
gaggcccacaggaagauccagca

SEQ ID NO: 160628 - RNA, 17 nt, Human
gaggcccaccccagagg

SEQ ID NO: 160629 - RNA, 32 nt, Human
gaggcccacgugcugccuccugcuccagauuu

SEQ ID NO: 160630 - RNA, 32 nt, Human
gaggcccacuuccuucuuugggcacaggaaac

SEQ ID NO: 160631 - RNA, 32 nt, Human
gaggcccagacuggcggaucaccugaggucag

SEQ ID NO: 160632 - RNA, 32 nt, Human
gaggcccagagucuaagacugcagugagcucu

SEQ ID NO: 160633 - RNA, 32 nt, Human
gaggcccagcaccagggaugaauugguuaucu

SEQ ID NO: 160634 - RNA, 32 nt, Human
gaggcccagcagagggaggcagggcacugccu

SEQ ID NO: 160635 - RNA, 24 nt, Human
gaggcccagccaggcccccaggaa

SEQ ID NO: 160636 - RNA, 32 nt, Human
gaggcccagccccagaacucagagaauggggc

SEQ ID NO: 160637 - RNA, 32 nt, Human
gaggcccagcccucagaaacccuucagugcua

SEQ ID NO: 160638 - RNA, 32 nt, Human
gaggcccagccuugucccuccugccacguccu

SEQ ID NO: 160639 - RNA, 32 nt, Human
gaggcccagcucaguguggaggcugcuggccc

SEQ ID NO: 160640 - RNA, 32 nt, Human
gaggcccaggcagaacccugcauggacccuga

SEQ ID NO: 160641 - RNA, 22 nt, Human
gaggcccaggcaggcagaucac

SEQ ID NO: 160642 - RNA, 22 nt, Human
gaggcccaggcaggcggaucac

SEQ ID NO: 160643 - RNA, 32 nt, Human
gaggcccaggcaggugaagaggaaguggcuuu

SEQ ID NO: 160644 - RNA, 32 nt, Human
gaggcccagggaggggccaggugucaggagcu

SEQ ID NO: 160645 - RNA, 32 nt, Human
gaggcccagggguggagguuagggguggagcu

SEQ ID NO: 160646 - RNA, 32 nt, Human
gaggcccaggugagcagaucaccugaggucag

SEQ ID NO: 160647 - RNA, 32 nt, Human
gaggcccagguggggcgaucaccugagguuag

SEQ ID NO: 160648 - RNA, 32 nt, Human
gaggcccagguucgcccuuccacacacggaau

SEQ ID NO: 160649 - RNA, 32 nt, Human
gaggcccaugacccagaacccaggaaggauag

SEQ ID NO: 160650 - RNA, 22 nt, Human
gaggcccaugugucgcugggga

SEQ ID NO: 160651 - RNA, 21 nt, Human
gaggccccaaagagacugcuu

SEQ ID NO: 160652 - RNA, 32 nt, Human
gaggccccacuccccgagguugccuagacaac

SEQ ID NO: 160653 - RNA, 32 nt, Human
gaggccccagaggcggcggggagguggcccgc

SEQ ID NO: 160654 - RNA, 32 nt, Human
gaggccccagcugccccuuccuccaggcaccu

SEQ ID NO: 160655 - RNA, 32 nt, Human
gaggccccaggagcaaagguccuggcccucgu

SEQ ID NO: 160656 - RNA, 18 nt, Human
gaggccccagggagccag

SEQ ID NO: 160657 - RNA, 32 nt, Human
gaggccccaucucucggggacugagggggugg

SEQ ID NO: 160658 - RNA, 32 nt, Human
gaggcccccaaagcccugugaacugccugcug

SEQ ID NO: 160659 - RNA, 32 nt, Human
gaggcccccgggauguccuggggacagggagu

SEQ ID NO: 160660 - RNA, 32 nt, Human
gaggcccccugauccaauucugugccaauaac

SEQ ID NO: 160661 - RNA, 32 nt, Human
gaggcccccuggccugggcacccagcugcagg

SEQ ID NO: 160662 - RNA, 25 nt, Human
gaggccccgcugccccccuccuccu

SEQ ID NO: 160663 - RNA, 32 nt, Human
gaggccccgugcuccccaccucucaaggaguc

SEQ ID NO: 160664 - RNA, 32 nt, Human
gaggccccuagccuguggcccaggcucucucc

SEQ ID NO: 160665 - RNA, 32 nt, Human
gaggccccuccagagagagcacuggagcugga

SEQ ID NO: 160666 - RNA, 32 nt, Human
gaggccccugcacccugcgcaucaggacugcu

SEQ ID NO: 160667 - RNA, 22 nt, Human
gaggccccugugagcugggaga

SEQ ID NO: 160668 - RNA, 32 nt, Human
gaggccccuugucuguucccacggacgggggc

SEQ ID NO: 160669 - RNA, 32 nt, Human
gaggcccgagaggacaccccacccuccagcgu

SEQ ID NO: 160670 - RNA, 32 nt, Human
gaggcccgcaaacugugucuggggaccugugg

SEQ ID NO: 160671 - RNA, 19 nt, Human
gaggcccgccugcccuggg

SEQ ID NO: 160672 - RNA, 32 nt, Human
gaggcccgggggcaggagugcagggcucugag

SEQ ID NO: 160673 - RNA, 32 nt, Human
gaggcccggugugguuccgccucggcgaggcg

SEQ ID NO: 160674 - RNA, 32 nt, Human
gaggcccgugugaggacugacccuggauuccu

SEQ ID NO: 160675 - RNA, 32 nt, Human
gaggcccucacagaugucuaggcaggccucau

SEQ ID NO: 160676 - RNA, 32 nt, Human
gaggcccucaugggcaauggcugagggggccg

SEQ ID NO: 160677 - RNA, 20 nt, Human
gaggcccucggcugcugggg

SEQ ID NO: 160678 - RNA, 32 nt, Human
gaggcccucucccccacuccuccaaagaaaca

SEQ ID NO: 160679 - RNA, 32 nt, Human
gaggcccucucgggggugaccugggcgucagc

SEQ ID NO: 160680 - RNA, 22 nt, Human
gaggcccucuggcccccaggaa

SEQ ID NO: 160681 - RNA, 32 nt, Human
gaggcccugcagcagcucuucuccuccaugcc

SEQ ID NO: 160682 - RNA, 32 nt, Human
gaggcccugccugaacccacagugccaggcaa

SEQ ID NO: 160683 - RNA, 32 nt, Human
gaggcccugccuggucucgucugggaccuggg

SEQ ID NO: 160684 - RNA, 32 nt, Human
gaggcccugcgaggggacaaggacaggcccug

SEQ ID NO: 160685 - RNA, 31 nt, Human
gaggcccugcuggcugggccugguuuucaag

SEQ ID NO: 160686 - RNA, 32 nt, Human
gaggcccuggacaaccucuugcggcccuggcu

SEQ ID NO: 160687 - RNA, 32 nt, Human
gaggcccuggacagcgacagcaggcccagcuc

SEQ ID NO: 160688 - RNA, 32 nt, Human
gaggcccuggagccucacgccgucgaggcugc

SEQ ID NO: 160689 - RNA, 32 nt, Human
gaggcccuggcagaggugaaggacauggagca

SEQ ID NO: 160690 - RNA, 32 nt, Human
gaggcccuggcucugaucccaggcuggaugga

SEQ ID NO: 160691 - RNA, 32 nt, Human
gaggcccugggccgaggugcagugacccugca

SEQ ID NO: 160692 - RNA, 23 nt, Human
gaggcccugggcugggugcuggg

SEQ ID NO: 160693 - RNA, 32 nt, Human
gaggcccuggguugucgcggcagcaguggucu

SEQ ID NO: 160694 - RNA, 32 nt, Human
gaggcccuguccaucuucuccccaccaccgcc

SEQ ID NO: 160695 - RNA, 23 nt, Human
gaggcccuucagacucuggcggg

SEQ ID NO: 160696 - RNA, 32 nt, Human
gaggcccuucccuucagaggcuccugggggau

SEQ ID NO: 160697 - RNA, 20 nt, Human
gaggccgaacgcggacucgc

SEQ ID NO: 160698 - RNA, 22 nt, Human
gaggccgaagcaggcagaucac

SEQ ID NO: 160699 - RNA, 22 nt, Human
gaggccgaagcaggcggaucac

SEQ ID NO: 160700 - RNA, 21 nt, Human
gaggccgaagcgaguggauca

SEQ ID NO: 160701 - RNA, 32 nt, Human
gaggccgaagcgaguggaucaccugaggucag

SEQ ID NO: 160702 - RNA, 32 nt, Human
gaggccgaagcgggcggaucaccugaggucgg

SEQ ID NO: 160703 - RNA, 32 nt, Human
gaggccgaagcggguggaucaccugaggucag

SEQ ID NO: 160704 - RNA, 32 nt, Human
gaggccgaaguggguggaucaccugagguccg

SEQ ID NO: 160705 - RNA, 22 nt, Human
gaggccgagacaggcggaucac

SEQ ID NO: 160706 - RNA, 32 nt, Human
gaggccgagacaggcggaucaccugaggucgg

SEQ ID NO: 160707 - RNA, 22 nt, Human
gaggccgagacagguggaucac

SEQ ID NO: 160708 - RNA, 22 nt, Human
gaggccgagacccugcagguga

SEQ ID NO: 160709 - RNA, 24 nt, Human
gaggccgagaccugaaacccucua

SEQ ID NO: 160710 - RNA, 32 nt, Human
gaggccgagacgggcggaucaccugaggucag

SEQ ID NO: 160711 - RNA, 32 nt, Human
gaggccgagacggguggaucaccugaggucag

SEQ ID NO: 160712 - RNA, 32 nt, Human
gaggccgagacggguguauaacgaggucagga

SEQ ID NO: 160713 - RNA, 23 nt, Human
gaggccgagacucagaccugcua

SEQ ID NO: 160714 - RNA, 32 nt, Human
gaggccgagauagguggaucaccugaagucag

SEQ ID NO: 160715 - RNA, 24 nt, Human
gaggccgagaucaggagggagcug

SEQ ID NO: 160716 - RNA, 32 nt, Human
gaggccgagaugggaggaucgcuugagcccag

SEQ ID NO: 160717 - RNA, 32 nt, Human
gaggccgagaugggcagagcacuugaggccag

SEQ ID NO: 160718 - RNA, 32 nt, Human
gaggccgagaugggcggaucacgaggucagga

SEQ ID NO: 160719 - RNA, 32 nt, Human
gaggccgagaugggugaaucaugaggucagga

SEQ ID NO: 160720 - RNA, 32 nt, Human
gaggccgagauggguggaucaccugaggucag

SEQ ID NO: 160721 - RNA, 32 nt, Human
gaggccgagauggguggaucaucugaggucag

SEQ ID NO: 160722 - RNA, 32 nt, Human
gaggccgagauggguggaucaugaggucagca

SEQ ID NO: 160723 - RNA, 32 nt, Human
gaggccgagccaccccucuguaaccuccauaa

SEQ ID NO: 160724 - RNA, 32 nt, Human
gaggccgagcgagcccccagcccagccuggcg

SEQ ID NO: 160725 - RNA, 20 nt, Human
gaggccgaggagaacccagc

SEQ ID NO: 160726 - RNA, 24 nt, Human
gaggccgaggagggaggacugcuu

SEQ ID NO: 160727 - RNA, 32 nt, Human
gaggccgaggagggaggaucaccugaggucag

SEQ ID NO: 160728 - RNA, 32 nt, Human
gaggccgaggagggccgaucaccugaggucag

SEQ ID NO: 160729 - RNA, 23 nt, Human
gaggccgaggcaagaggauugcu

SEQ ID NO: 160730 - RNA, 22 nt, Human
gaggccgaggcaagcagaucac

SEQ ID NO: 160731 - RNA, 22 nt, Human
gaggccgaggcaaguggaucac

SEQ ID NO: 160732 - RNA, 23 nt, Human
gaggccgaggcacgagaaucgcu

SEQ ID NO: 160733 - RNA, 23 nt, Human
gaggccgaggcacgagaauugcu

SEQ ID NO: 160734 - RNA, 22 nt, Human
gaggccgaggcagacagaucac

SEQ ID NO: 160735 - RNA, 22 nt, Human
gaggccgaggcagacggaucac

SEQ ID NO: 160736 - RNA, 22 nt, Human
gaggccgaggcagauggaucac

SEQ ID NO: 160737 - RNA, 32 nt, Human
gaggccgaggcaggaggaucaccugaggucag

SEQ ID NO: 160738 - RNA, 22 nt, Human
gaggccgaggcaggcagaucac

SEQ ID NO: 160739 - RNA, 32 nt, Human
gaggccgaggcaggcagaucaccugaggucaa

SEQ ID NO: 160740 - RNA, 32 nt, Human
gaggccgaggcaggcagaucaccugaggucag

SEQ ID NO: 160741 - RNA, 32 nt, Human
gaggccgaggcaggcagaucaccugaggucgg

SEQ ID NO: 160742 - RNA, 32 nt, Human
gaggccgaggcaggcagaucaccugagguugg

SEQ ID NO: 160743 - RNA, 22 nt, Human
gaggccgaggcaggcgaaucac

SEQ ID NO: 160744 - RNA, 22 nt, Human
gaggccgaggcaggcggaccac

SEQ ID NO: 160745 - RNA, 21 nt, Human
gaggccgaggcaggcggauca

SEQ ID NO: 160746 - RNA, 22 nt, Human
gaggccgaggcaggcggaucac

SEQ ID NO: 160747 - RNA, 32 nt, Human
gaggccgaggcaggcggaucaccugagauugg

SEQ ID NO: 160748 - RNA, 32 nt, Human
gaggccgaggcaggcggaucaccugaggucag

SEQ ID NO: 160749 - RNA, 32 nt, Human
gaggccgaggcaggcggaucaccugaggucgg

SEQ ID NO: 160750 - RNA, 32 nt, Human
gaggccgaggcaggcggaucaccugaggugag

SEQ ID NO: 160751 - RNA, 32 nt, Human
gaggccgaggcaggcggaucaccugagguugg

SEQ ID NO: 160752 - RNA, 32 nt, Human
gaggccgaggcagggggaucaccugaggucuc

SEQ ID NO: 160753 - RNA, 32 nt, Human
gaggccgaggcagguacaucaccugaggucaa

SEQ ID NO: 160754 - RNA, 21 nt, Human
gaggccgaggcagguggauca

SEQ ID NO: 160755 - RNA, 22 nt, Human
gaggccgaggcagguggaucac

SEQ ID NO: 160756 - RNA, 32 nt, Human
gaggccgaggcagguggaucaccugagaucag

SEQ ID NO: 160757 - RNA, 32 nt, Human
gaggccgaggcagguggaucaccugaggucag

SEQ ID NO: 160758 - RNA, 32 nt, Human
gaggccgaggcagguggaucaccugagguccg

SEQ ID NO: 160759 - RNA, 32 nt, Human
gaggccgaggcagguugaucaccugaggucag

SEQ ID NO: 160760 - RNA, 32 nt, Human
gaggccgaggcaguuggaucaccugagguuag

SEQ ID NO: 160761 - RNA, 23 nt, Human
gaggccgaggcaugagaaucacu

SEQ ID NO: 160762 - RNA, 32 nt, Human
gaggccgaggcauguggaucaccugaggucag

SEQ ID NO: 160763 - RNA, 20 nt, Human
gaggccgaggccgcucccgc

SEQ ID NO: 160764 - RNA, 32 nt, Human
gaggccgaggccggcagaucaccugagaucag

SEQ ID NO: 160765 - RNA, 17 nt, Human
gaggccgaggccugggc

SEQ ID NO: 160766 - RNA, 32 nt, Human
gaggccgaggcggauggaucaccugaggucgg

SEQ ID NO: 160767 - RNA, 32 nt, Human
gaggccgaggcgggaggaucaccugagguuag

SEQ ID NO: 160768 - RNA, 21 nt, Human
gaggccgaggcgggcagauca

SEQ ID NO: 160769 - RNA, 32 nt, Human
gaggccgaggcgggcagaucaccugaggucac

SEQ ID NO: 160770 - RNA, 32 nt, Human
gaggccgaggcgggcagaucaccugaggucag

SEQ ID NO: 160771 - RNA, 32 nt, Human
gaggccgaggcgggcagaucaccugaggucgg

SEQ ID NO: 160772 - RNA, 32 nt, Human
gaggccgaggcgggcggaucaccugagaucag

SEQ ID NO: 160773 - RNA, 32 nt, Human
gaggccgaggcgggcggaucaccugagaucug

SEQ ID NO: 160774 - RNA, 32 nt, Human
gaggccgaggcgggcggaucaccugaggucag

SEQ ID NO: 160775 - RNA, 32 nt, Human
gaggccgaggcgggcggaucaccugagguggg

SEQ ID NO: 160776 - RNA, 32 nt, Human
gaggccgaggcgggcggaucaccugagguugg

SEQ ID NO: 160777 - RNA, 32 nt, Human
gaggccgaggcgggcggaucaccugaguucag

SEQ ID NO: 160778 - RNA, 32 nt, Human
gaggccgaggcggggagaucaccugaggucag

SEQ ID NO: 160779 - RNA, 32 nt, Human
gaggccgaggcggguagaucaccugagguuag

SEQ ID NO: 160780 - RNA, 32 nt, Human
gaggccgaggcggguggaccaccugaggucag

SEQ ID NO: 160781 - RNA, 32 nt, Human
gaggccgaggcggguggaucaccugaggacag

SEQ ID NO: 160782 - RNA, 32 nt, Human
gaggccgaggcggguggaucaccugaggccag

SEQ ID NO: 160783 - RNA, 32 nt, Human
gaggccgaggcggguggaucaccugaggucag

SEQ ID NO: 160784 - RNA, 32 nt, Human
gaggccgaggcggguggaucaccugagguuag

SEQ ID NO: 160785 - RNA, 21 nt, Human
gaggccgaggcggguggguca

SEQ ID NO: 160786 - RNA, 32 nt, Human
gaggccgaggcgggugggucaccugaggucag

SEQ ID NO: 160787 - RNA, 32 nt, Human
gaggccgaggcggguguaucaccugaggucag

SEQ ID NO: 160788 - RNA, 32 nt, Human
gaggccgaggcggguguaucaccugaggucgg

SEQ ID NO: 160789 - RNA, 32 nt, Human
gaggccgaggcguguggaucaccugagaucgg

SEQ ID NO: 160790 - RNA, 21 nt, Human
gaggccgaggcucuguggcug

SEQ ID NO: 160791 - RNA, 32 nt, Human
gaggccgaggggaccauguccgggaggcgcuu

SEQ ID NO: 160792 - RNA, 32 nt, Human
gaggccgaggggaguggaucaccugaguucga

SEQ ID NO: 160793 - RNA, 32 nt, Human
gaggccgaggggcagcaagggcagccagggca

SEQ ID NO: 160794 - RNA, 32 nt, Human
gaggccgagguaggcggaucaccugaggucgg

SEQ ID NO: 160795 - RNA, 32 nt, Human
gaggccgagguaggcggaucaccugagguuag

SEQ ID NO: 160796 - RNA, 32 nt, Human
gaggccgaggugagcagaucaccugagguuag

SEQ ID NO: 160797 - RNA, 32 nt, Human
gaggccgaggugagcggaucaccugaggucag

SEQ ID NO: 160798 - RNA, 32 nt, Human
gaggccgaggugaguggaucaccugaggucag

SEQ ID NO: 160799 - RNA, 32 nt, Human
gaggccgagguggauggaucaccugaggucag

SEQ ID NO: 160800 - RNA, 32 nt, Human
gaggccgagguggccagaucaccugaggucag

SEQ ID NO: 160801 - RNA, 32 nt, Human
gaggccgaggugggaggaucaccugaggucag

SEQ ID NO: 160802 - RNA, 32 nt, Human
gaggccgaggugggcagaucaccugaggucag

SEQ ID NO: 160803 - RNA, 32 nt, Human
gaggccgaggugggcagaucaccugaggucgg

SEQ ID NO: 160804 - RNA, 32 nt, Human
gaggccgaggugggcggaucaccugaagucag

SEQ ID NO: 160805 - RNA, 32 nt, Human
gaggccgaggugggcggaucaccugaggucag

SEQ ID NO: 160806 - RNA, 32 nt, Human
gaggccgaggugggcggaucaccugaggucgg

SEQ ID NO: 160807 - RNA, 32 nt, Human
gaggccgaggugggugaaucaccugaggucag

SEQ ID NO: 160808 - RNA, 32 nt, Human
gaggccgagguggguggaccaccugagguuag

SEQ ID NO: 160809 - RNA, 32 nt, Human
gaggccgagguggguggaucaccugaagucag

SEQ ID NO: 160810 - RNA, 32 nt, Human
gaggccgagguggguggaucaccugagaucag

SEQ ID NO: 160811 - RNA, 32 nt, Human
gaggccgagguggguggaucaccugaggucag

SEQ ID NO: 160812 - RNA, 19 nt, Human
gaggccgagguugcaguga

SEQ ID NO: 160813 - RNA, 21 nt, Human
gaggccgagguugcagugagc

SEQ ID NO: 160814 - RNA, 32 nt, Human
gaggccgagucagguggaucaccugaggucag

SEQ ID NO: 160815 - RNA, 32 nt, Human
gaggccgaguggacaggauuggucagggagcc

SEQ ID NO: 160816 - RNA, 32 nt, Human
gaggccgaguuggguggauugcuugggccagg

SEQ ID NO: 160817 - RNA, 32 nt, Human
gaggccgaugcgggcugaucacuugagugauu

SEQ ID NO: 160818 - RNA, 32 nt, Human
gaggccgauguggguggaucaccugagguuag

SEQ ID NO: 160819 - RNA, 32 nt, Human
gaggccgcaccacugcacuccagccuggguga

SEQ ID NO: 160820 - RNA, 32 nt, Human
gaggccgcagccgcccggccaguaaggcggcg

SEQ ID NO: 160821 - RNA, 21 nt, Human
gaggccgcaggacacugaagg

SEQ ID NO: 160822 - RNA, 32 nt, Human
gaggccgcaggggccuacagaccucauccccc

SEQ ID NO: 160823 - RNA, 32 nt, Human
gaggccgcagugagcugugaucaugccacugc

SEQ ID NO: 160824 - RNA, 32 nt, Human
gaggccgccgccgccucuccuugcugcagcca

SEQ ID NO: 160825 - RNA, 19 nt, Human
gaggccgcgcccccgcccg

SEQ ID NO: 160826 - RNA, 32 nt, Human
gaggccgcggcgacaagguagccacccccgca

SEQ ID NO: 160827 - RNA, 21 nt, Human
gaggccgcggucugaacugcu

SEQ ID NO: 160828 - RNA, 32 nt, Human
gaggccgcgguggguggaucaccugaggucag

SEQ ID NO: 160829 - RNA, 22 nt, Human
gaggccgcugccccugaguucu

SEQ ID NO: 160830 - RNA, 32 nt, Human
gaggccgcugcgcccccgccuccucgcgggag

SEQ ID NO: 160831 - RNA, 32 nt, Human
gaggccgcuggaagccaccgggccaagggagc

SEQ ID NO: 160832 - RNA, 22 nt, Human
gaggccggaacccuagauagcu

SEQ ID NO: 160833 - RNA, 32 nt, Human
gaggccggacacaggcuucuuugccuacacgu

SEQ ID NO: 160834 - RNA, 19 nt, Human
gaggccggacccgcggcgg

SEQ ID NO: 160835 - RNA, 21 nt, Human
gaggccggagaaucgcuugaa

SEQ ID NO: 160836 - RNA, 26 nt, Human
gaggccggagaccuccuggacuaguu

SEQ ID NO: 160837 - RNA, 32 nt, Human
gaggccggagaggaguucaggaacccuucucc

SEQ ID NO: 160838 - RNA, 21 nt, Human
gaggccggagcaccacaucca

SEQ ID NO: 160839 - RNA, 32 nt, Human
gaggccggcagaucaccugagaucagaaguuc

SEQ ID NO: 160840 - RNA, 26 nt, Human
gaggccggccgagggcugggguucca

SEQ ID NO: 160841 - RNA, 32 nt, Human
gaggccggccucaugccagggugaagggacag

SEQ ID NO: 160842 - RNA, 22 nt, Human
gaggccggcgccgagccggacu

SEQ ID NO: 160843 - RNA, 21 nt, Human
gaggccggcggccggccggcu

SEQ ID NO: 160844 - RNA, 23 nt, Human
gaggccggcgugggugagcucca

SEQ ID NO: 160845 - RNA, 21 nt, Human
gaggccgggacacacuuagcu

SEQ ID NO: 160846 - RNA, 32 nt, Human
gaggccgggacagguggaucaccugaggucug

SEQ ID NO: 160847 - RNA, 20 nt, Human
gaggccgggacugggccggc

SEQ ID NO: 160848 - RNA, 32 nt, Human
gaggccgggaggcgaggaaaccguggaaauug

SEQ ID NO: 160849 - RNA, 32 nt, Human
gaggccgggaggcggcugcaaggggcggggaa

SEQ ID NO: 160850 - RNA, 23 nt, Human
gaggccgggaguucaagaccagc

SEQ ID NO: 160851 - RNA, 23 nt, Human
gaggccgggaguucgggaccagc

SEQ ID NO: 160852 - RNA, 23 nt, Human
gaggccgggaguuggagaccagc

SEQ ID NO: 160853 - RNA, 23 nt, Human
gaggccgggaguuugagaccagc

SEQ ID NO: 160854 - RNA, 32 nt, Human
gaggccgggaguuugagaccagccugggcaac

SEQ ID NO: 160855 - RNA, 21 nt, Human
gaggccgggcacgguggcuca

SEQ ID NO: 160856 - RNA, 32 nt, Human
gaggccgggcaugguggcagagcgagacuccg

SEQ ID NO: 160857 - RNA, 32 nt, Human
gaggccgggccacgcucagacacuucgaucgu

SEQ ID NO: 160858 - RNA, 32 nt, Human
gaggccgggcccugcgccucaggccugagaac

SEQ ID NO: 160859 - RNA, 21 nt, Human
gaggccgggcgcaguggcuca

SEQ ID NO: 160860 - RNA, 32 nt, Human
gaggccgggcugggucgcugcgcgucugcucc

SEQ ID NO: 160861 - RNA, 22 nt, Human
gaggccggggggaccgacugcu

SEQ ID NO: 160862 - RNA, 22 nt, Human
gaggccggggguccugccaacu

SEQ ID NO: 160863 - RNA, 32 nt, Human
gaggccggguaccugggcugggauccggagca

SEQ ID NO: 160864 - RNA, 21 nt, Human
gaggccgggugcgguggcuca

SEQ ID NO: 160865 - RNA, 19 nt, Human
gaggccgguccgggugcca

SEQ ID NO: 160866 - RNA, 22 nt, Human
gaggccggugauucacaagguc

SEQ ID NO: 160867 - RNA, 32 nt, Human
gaggccggugggcagaucaugaggucaggagu

SEQ ID NO: 160868 - RNA, 32 nt, Human
gaggccgguggguugcuuuagcucaggaguug

SEQ ID NO: 160869 - RNA, 22 nt, Human
gaggccguaucacccucuucac

SEQ ID NO: 160870 - RNA, 32 nt, Human
gaggccguggugagaggauagcuuaagcccag

SEQ ID NO: 160871 - RNA, 32 nt, Human
gaggccguggugggcggaucaccugaggucag

SEQ ID NO: 160872 - RNA, 32 nt, Human
gaggccguuauucugcccaccgcacccuccgu

SEQ ID NO: 160873 - RNA, 32 nt, Human
gaggccuaaccaggaucaggcaggagggcagg

SEQ ID NO: 160874 - RNA, 24 nt, Human
gaggccuaagcuggccugguccag

SEQ ID NO: 160875 - RNA, 32 nt, Human
gaggccuaaguccugcauuaacucaguccaac

SEQ ID NO: 160876 - RNA, 32 nt, Human
gaggccuaccugcuggagcacagccacaaugg

SEQ ID NO: 160877 - RNA, 32 nt, Human
gaggccuagauggguggaucacuugagcucag

SEQ ID NO: 160878 - RNA, 22 nt, Human
gaggccuaggcaggcagaucac

SEQ ID NO: 160879 - RNA, 32 nt, Human
gaggccuaguuaauuacugaccagagaacggc

SEQ ID NO: 160880 - RNA, 32 nt, Human
gaggccuauauuacuuauacuggaccaccugg

SEQ ID NO: 160881 - RNA, 32 nt, Human
gaggccucaguggaagugacggcuacugugga

SEQ ID NO: 160882 - RNA, 32 nt, Human
gaggccucaguguggcugugcguggcccgugu

SEQ ID NO: 160883 - RNA, 32 nt, Human
gaggccuccacucagcaguaauaaaagcuguu

SEQ ID NO: 160884 - RNA, 21 nt, Human
gaggccuccccucuccugccu

SEQ ID NO: 160885 - RNA, 32 nt, Human
gaggccuccuagugaaaggcugggcccuugcc

SEQ ID NO: 160886 - RNA, 32 nt, Human
gaggccuccucauuaggugauccaggaguauu

SEQ ID NO: 160887 - RNA, 24 nt, Human
gaggccucgaggcagguggaucac

SEQ ID NO: 160888 - RNA, 32 nt, Human
gaggccucggccuccuccucuggggcggcggu

SEQ ID NO: 160889 - RNA, 32 nt, Human
gaggccucuaacgcaggagcugccuguauggg

SEQ ID NO: 160890 - RNA, 32 nt, Human
gaggccucucaggggaagucucaaggucucca

SEQ ID NO: 160891 - RNA, 32 nt, Human
gaggccucugcggguggaucaccugaggucag

SEQ ID NO: 160892 - RNA, 32 nt, Human
gaggccucugcucucugggauguggcccucuc

SEQ ID NO: 160893 - RNA, 32 nt, Human
gaggccugaaaccucugucggccagagaacag

SEQ ID NO: 160894 - RNA, 32 nt, Human
gaggccugaaggaaccgcugaagaaccagagg

SEQ ID NO: 160895 - RNA, 31 nt, Human
gaggccugacuucucugggcugaggcugguc

SEQ ID NO: 160896 - RNA, 32 nt, Human
gaggccugagcccucucagaagcagggacagc

SEQ ID NO: 160897 - RNA, 32 nt, Human
gaggccugagggagggaggcgcauggaagccg

SEQ ID NO: 160898 - RNA, 32 nt, Human
gaggccugccuucugccugcucuccugcacug

SEQ ID NO: 160899 - RNA, 32 nt, Human
gaggccugcuccaguacuucccagaggcuggc

SEQ ID NO: 160900 - RNA, 32 nt, Human
gaggccuggaccaccuggggcucccugaggau

SEQ ID NO: 160901 - RNA, 32 nt, Human
gaggccuggcuuagaucuuucauuccaccuca

SEQ ID NO: 160902 - RNA, 32 nt, Human
gaggccuggcuucaggagggagcggagcagcc

SEQ ID NO: 160903 - RNA, 32 nt, Human
gaggccugggagaaggcccaggcugcucgcaa

SEQ ID NO: 160904 - RNA, 32 nt, Human
gaggccugggccgaccucacaccucagcccuu

SEQ ID NO: 160905 - RNA, 32 nt, Human
gaggccugggccugcacugccugcagccgaca

SEQ ID NO: 160906 - RNA, 32 nt, Human
gaggccuggggguggcagacgagcccacggcg

SEQ ID NO: 160907 - RNA, 32 nt, Human
gaggccuggggugggacagggagggccggcgg

SEQ ID NO: 160908 - RNA, 32 nt, Human
gaggccugguggcuuagccugggcaggucgug

SEQ ID NO: 160909 - RNA, 32 nt, Human
gaggccuguaaucccagcuacuugggaggcug

SEQ ID NO: 160910 - RNA, 32 nt, Human
gaggccugugagagcugccucugccucagugg

SEQ ID NO: 160911 - RNA, 32 nt, Human
gaggccuuauuucuuaacugugcugggauugc

SEQ ID NO: 160912 - RNA, 32 nt, Human
gaggccuuccaaggggguuucagucuggacuu

SEQ ID NO: 160913 - RNA, 32 nt, Human
gaggccuuccuugaccucccuccuccauuccu

SEQ ID NO: 160914 - RNA, 20 nt, Human
gaggccuucugcaaauguca

SEQ ID NO: 160915 - RNA, 19 nt, Human
gaggccuugaaaguccuug

SEQ ID NO: 160916 - RNA, 32 nt, Human
gaggccuugcccaguggguagacagcuacuac

SEQ ID NO: 160917 - RNA, 18 nt, Human
gaggccuugugcauuuca

SEQ ID NO: 160918 - RNA, 32 nt, Human
gaggccuuugcuggacaggugaagagugacuu

SEQ ID NO: 160919 - RNA, 32 nt, Human
gaggcgaacagaggaaaaauauggcggagaca

SEQ ID NO: 160920 - RNA, 32 nt, Human
gaggcgaacagcuccaggugccccucuggagc

SEQ ID NO: 160921 - RNA, 32 nt, Human
gaggcgaacgcaggcagaucacuugaggucag

SEQ ID NO: 160922 - RNA, 32 nt, Human
gaggcgaaggcgucugucucuuggcuauuuua

SEQ ID NO: 160923 - RNA, 32 nt, Human
gaggcgaagggugggagcauagcauaggaacg

SEQ ID NO: 160924 - RNA, 32 nt, Human
gaggcgacuggguaaauuaggaagagguggau

SEQ ID NO: 160925 - RNA, 32 nt, Human
gaggcgagaaguguaacauucucuccacccag

SEQ ID NO: 160926 - RNA, 32 nt, Human
gaggcgagaggaggaggaggaggaggagaagg

SEQ ID NO: 160927 - RNA, 32 nt, Human
gaggcgagaggaucacuugagcacaggaguuc

SEQ ID NO: 160928 - RNA, 22 nt, Human
gaggcgagcagaucacgagguc

SEQ ID NO: 160929 - RNA, 18 nt, Human
gaggcgagcagggaccag

SEQ ID NO: 160930 - RNA, 32 nt, Human
gaggcgagccgaugccgagcugcuccacgucc

SEQ ID NO: 160931 - RNA, 32 nt, Human
gaggcgaggaagaguaauauuuagcauucagg

SEQ ID NO: 160932 - RNA, 32 nt, Human
gaggcgaggaaggcuucuccaucgucgccacc

SEQ ID NO: 160933 - RNA, 32 nt, Human
gaggcgagggagcagguuagagggacaaagag

SEQ ID NO: 160934 - RNA, 22 nt, Human
gaggcgaguggaucacgagguc

SEQ ID NO: 160935 - RNA, 32 nt, Human
gaggcgauggcagagagcagcugcaggcaugg

SEQ ID NO: 160936 - RNA, 32 nt, Human
gaggcgauuuaauuaaauggcugugaugcauu

SEQ ID NO: 160937 - RNA, 32 nt, Human
gaggcgcaagggcaucgaccuccgcaccaauc

SEQ ID NO: 160938 - RNA, 32 nt, Human
gaggcgcagacaccaggcccguucugugcucu

SEQ ID NO: 160939 - RNA, 32 nt, Human
gaggcgcagccugggcagagcucagcuugguc

SEQ ID NO: 160940 - RNA, 32 nt, Human
gaggcgcaggcuccagcccggccugcaggccg

SEQ ID NO: 160941 - RNA, 22 nt, Human
gaggcgcaggcugcagugagcu

SEQ ID NO: 160942 - RNA, 32 nt, Human
gaggcgcagggaggggaccccggagcugggcu

SEQ ID NO: 160943 - RNA, 22 nt, Human
gaggcgcaguuucaccguguua

SEQ ID NO: 160944 - RNA, 32 nt, Human
gaggcgcaugagcgagagcagaggaggaggag

SEQ ID NO: 160945 - RNA, 32 nt, Human
gaggcgccagccuggucaggggaggugacugu

SEQ ID NO: 160946 - RNA, 19 nt, Human
gaggcgcccaccacuucac

SEQ ID NO: 160947 - RNA, 32 nt, Human
gaggcgcccgggcuggagcgccccggccgugu

SEQ ID NO: 160948 - RNA, 32 nt, Human
gaggcgcccucagacagcaguggcaucaacuu

SEQ ID NO: 160949 - RNA, 32 nt, Human
gaggcgcccugggugguggaaggcagccgccc

SEQ ID NO: 160950 - RNA, 21 nt, Human
gaggcgccgccgccaucgguc

SEQ ID NO: 160951 - RNA, 32 nt, Human
gaggcgccgggauguggagcggcccaccccag

SEQ ID NO: 160952 - RNA, 32 nt, Human
gaggcgccucuagucugugccuuugccguugg

SEQ ID NO: 160953 - RNA, 32 nt, Human
gaggcgccuggccuccgcagagcugcaaaggc

SEQ ID NO: 160954 - RNA, 32 nt, Human
gaggcgccugggaagggcucccuaccggcccc

SEQ ID NO: 160955 - RNA, 32 nt, Human
gaggcgcgagaggaggggaugggcggggcgcg

SEQ ID NO: 160956 - RNA, 32 nt, Human
gaggcgcggaggggcuggcugggcaggagggg

SEQ ID NO: 160957 - RNA, 32 nt, Human
gaggcgcggcagggucaggagcucgguggcau

SEQ ID NO: 160958 - RNA, 18 nt, Human
gaggcgcgggacauucca

SEQ ID NO: 160959 - RNA, 32 nt, Human
gaggcgcggugaggagucaggcuuaaaacuug

SEQ ID NO: 160960 - RNA, 32 nt, Human
gaggcgcguggagagccaggguccgggccuga

SEQ ID NO: 160961 - RNA, 32 nt, Human
gaggcgcucgacuuucucaggauacugucccu

SEQ ID NO: 160962 - RNA, 32 nt, Human
gaggcgcucugguaaggugcucaggccaguug

SEQ ID NO: 160963 - RNA, 32 nt, Human
gaggcgcugcuugucgacagcuagaggcuggc

SEQ ID NO: 160964 - RNA, 32 nt, Human
gaggcgcugguggccuucaggcuggacggcgc

SEQ ID NO: 160965 - RNA, 32 nt, Human
gaggcgcuucaggucaugacagugaugccccu

SEQ ID NO: 160966 - RNA, 32 nt, Human
gaggcggaagugagcccucauccugccacucc

SEQ ID NO: 160967 - RNA, 32 nt, Human
gaggcggacacacagcgacccccaucccugca

SEQ ID NO: 160968 - RNA, 22 nt, Human
gaggcggacagaucacgagguc

SEQ ID NO: 160969 - RNA, 22 nt, Human
gaggcggacggaucacgagguc

SEQ ID NO: 160970 - RNA, 32 nt, Human
gaggcggacuggcagcccugagcgucgcaguc

SEQ ID NO: 160971 - RNA, 21 nt, Human
gaggcggagacugcagugagc

SEQ ID NO: 160972 - RNA, 32 nt, Human
gaggcggagagggaccgcgcccgcaggagaga

SEQ ID NO: 160973 - RNA, 19 nt, Human
gaggcggagcuugcaguga

SEQ ID NO: 160974 - RNA, 20 nt, Human
gaggcggagcuugcagugag

SEQ ID NO: 160975 - RNA, 32 nt, Human
gaggcggaggcagaggcugcagugacccaaga

SEQ ID NO: 160976 - RNA, 32 nt, Human
gaggcggaggcagagguggaggcgcuuugaaa

SEQ ID NO: 160977 - RNA, 32 nt, Human
gaggcggaggcagcggcuggaggagcgcgagc

SEQ ID NO: 160978 - RNA, 32 nt, Human
gaggcggaggcaggcggguugcuugagcuccg

SEQ ID NO: 160979 - RNA, 22 nt, Human
gaggcggaggcagguggaucac

SEQ ID NO: 160980 - RNA, 32 nt, Human
gaggcggaggcggagguugcagugagccaaga

SEQ ID NO: 160981 - RNA, 32 nt, Human
gaggcggaggcggguguaucacgaggucagga

SEQ ID NO: 160982 - RNA, 32 nt, Human
gaggcggaggcugcagugagcugggauuacac

SEQ ID NO: 160983 - RNA, 32 nt, Human
gaggcggaggcugcagugagcugugauugugc

SEQ ID NO: 160984 - RNA, 32 nt, Human
gaggcggaggugagcagaucaccugaggucag

SEQ ID NO: 160985 - RNA, 32 nt, Human
gaggcggagguggaggcgaccgagugcugaga

SEQ ID NO: 160986 - RNA, 19 nt, Human
gaggcggagguggcaguga

SEQ ID NO: 160987 - RNA, 32 nt, Human
gaggcggagguggggguggggguaguuuaagc

SEQ ID NO: 160988 - RNA, 20 nt, Human
gaggcggagguugcacugag

SEQ ID NO: 160989 - RNA, 24 nt, Human
gaggcggagguugcacugagccga

SEQ ID NO: 160990 - RNA, 19 nt, Human
gaggcggagguugcaguaa

SEQ ID NO: 160991 - RNA, 19 nt, Human
gaggcggagguugcaguga

SEQ ID NO: 160992 - RNA, 32 nt, Human
gaggcggagguugcagugagccuggaucaugc

SEQ ID NO: 160993 - RNA, 19 nt, Human
gaggcggagguugcauuga

SEQ ID NO: 160994 - RNA, 19 nt, Human
gaggcggagguuguaguga

SEQ ID NO: 160995 - RNA, 32 nt, Human
gaggcggagucugaggagcuggggaaggaaca

SEQ ID NO: 160996 - RNA, 19 nt, Human
gaggcggaguuugcaguga

SEQ ID NO: 160997 - RNA, 20 nt, Human
gaggcggaguuugcagugag

SEQ ID NO: 160998 - RNA, 18 nt, Human
gaggcggaucacgagguc

SEQ ID NO: 160999 - RNA, 18 nt, Human
gaggcggaucauaagguc

SEQ ID NO: 161000 - RNA, 32 nt, Human
gaggcggcaggaucacuaggaggcagagguug

SEQ ID NO: 161001 - RNA, 32 nt, Human
gaggcggcagugagucaugaguaugccgcugc

SEQ ID NO: 161002 - RNA, 32 nt, Human
gaggcggcccgaaugcagcccugguucaggcc

SEQ ID NO: 161003 - RNA, 32 nt, Human
gaggcggcgcugugugugugaagcguaccuag

SEQ ID NO: 161004 - RNA, 32 nt, Human
gaggcggcggagcacaaggcaagugaguuugc

SEQ ID NO: 161005 - RNA, 32 nt, Human
gaggcggcggcggcaggagcugaggggaguug

SEQ ID NO: 161006 - RNA, 22 nt, Human
gaggcggcggcggcagugucca

SEQ ID NO: 161007 - RNA, 32 nt, Human
gaggcggcggcggcccccagcccagcccggcg

SEQ ID NO: 161008 - RNA, 25 nt, Human
gaggcggcggcggggagagccgaga

SEQ ID NO: 161009 - RNA, 32 nt, Human
gaggcggcggcggguggaucaccugagaucag

SEQ ID NO: 161010 - RNA, 32 nt, Human
gaggcggcgggcggaggcggcgggagcggugg

SEQ ID NO: 161011 - RNA, 32 nt, Human
gaggcggcgggcuggggagggagcggcgccag

SEQ ID NO: 161012 - RNA, 32 nt, Human
gaggcggcggggaaggaggaggagggggagag

SEQ ID NO: 161013 - RNA, 21 nt, Human
gaggcggcggggacaccggcg

SEQ ID NO: 161014 - RNA, 32 nt, Human
gaggcggcuccagccccagacaacagcccagg

SEQ ID NO: 161015 - RNA, 32 nt, Human
gaggcggcuccccagccuggguuuccauguga

SEQ ID NO: 161016 - RNA, 21 nt, Human
gaggcgggagaacugcuugaa

SEQ ID NO: 161017 - RNA, 21 nt, Human
gaggcgggagaaucgcuugaa

SEQ ID NO: 161018 - RNA, 21 nt, Human
gaggcgggagaauugcuugaa

SEQ ID NO: 161019 - RNA, 21 nt, Human
gaggcgggagacucgcuugaa

SEQ ID NO: 161020 - RNA, 22 nt, Human
gaggcgggaggaucacaaaguc

SEQ ID NO: 161021 - RNA, 32 nt, Human
gaggcgggaggaucacaugagcccaggagguu

SEQ ID NO: 161022 - RNA, 32 nt, Human
gaggcgggaggcggaggcgggagggcgggcgc

SEQ ID NO: 161023 - RNA, 32 nt, Human
gaggcgggaggucccauggaauuuguucuggu

SEQ ID NO: 161024 - RNA, 32 nt, Human
gaggcgggaguggaggugcgcggagucaggca

SEQ ID NO: 161025 - RNA, 32 nt, Human
gaggcgggaucacggcccaggcugcugacacc

SEQ ID NO: 161026 - RNA, 32 nt, Human
gaggcgggauccgagcgcgccggcggggcgca

SEQ ID NO: 161027 - RNA, 32 nt, Human
gaggcgggauugcuugaguccagccugggcag

SEQ ID NO: 161028 - RNA, 22 nt, Human
gaggcgggcagaucacaagguc

SEQ ID NO: 161029 - RNA, 32 nt, Human
gaggcgggcagaucaccugagaucgggaguuu

SEQ ID NO: 161030 - RNA, 22 nt, Human
gaggcgggcagaucacgagguc

SEQ ID NO: 161031 - RNA, 32 nt, Human
gaggcgggcagaucacuugagaucaggaguuc

SEQ ID NO: 161032 - RNA, 32 nt, Human
gaggcgggcccagugcaggaggcugcaucccu

SEQ ID NO: 161033 - RNA, 32 nt, Human
gaggcgggccugccgacugacuguguggcaug

SEQ ID NO: 161034 - RNA, 22 nt, Human
gaggcgggcgaaucacgagguc

SEQ ID NO: 161035 - RNA, 32 nt, Human
gaggcgggcggaucaacugaggucgggaguuc

SEQ ID NO: 161036 - RNA, 22 nt, Human
gaggcgggcggaucacaaaguc

SEQ ID NO: 161037 - RNA, 20 nt, Human
gaggcgggcggaucacaagg

SEQ ID NO: 161038 - RNA, 22 nt, Human
gaggcgggcggaucacaagguc

SEQ ID NO: 161039 - RNA, 22 nt, Human
gaggcgggcggaucacacgguc

SEQ ID NO: 161040 - RNA, 32 nt, Human
gaggcgggcggaucaccugagaucaggaguuc

SEQ ID NO: 161041 - RNA, 22 nt, Human
gaggcgggcggaucacgagguc

SEQ ID NO: 161042 - RNA, 32 nt, Human
gaggcgggcuguagcaaaguccuguuucucag

SEQ ID NO: 161043 - RNA, 32 nt, Human
gaggcggggagaggagaggagagaagagccgc

SEQ ID NO: 161044 - RNA, 32 nt, Human
gaggcggggaggauccauugagcccagcaguc

SEQ ID NO: 161045 - RNA, 32 nt, Human
gaggcggggccugggccgggagcccaggggaa

SEQ ID NO: 161046 - RNA, 32 nt, Human
gaggcggggcgaggcaggcggcgcggggaccc

SEQ ID NO: 161047 - RNA, 22 nt, Human
gaggcggggggaucacaagguc

SEQ ID NO: 161048 - RNA, 32 nt, Human
gaggcggggguuucaccaugccauccaggcug

SEQ ID NO: 161049 - RNA, 19 nt, Human
gaggcgggguuucaccaug

SEQ ID NO: 161050 - RNA, 23 nt, Human
gaggcgggguuucaccaugcugg

SEQ ID NO: 161051 - RNA, 21 nt, Human
gaggcgggguuucaccauguu

SEQ ID NO: 161052 - RNA, 22 nt, Human
gaggcgggguuucaccauguua

SEQ ID NO: 161053 - RNA, 22 nt, Human
gaggcgggguuucaccauguug

SEQ ID NO: 161054 - RNA, 23 nt, Human
gaggcgggguuucaccauguugg

SEQ ID NO: 161055 - RNA, 22 nt, Human
gaggcgggguuucgccauguua

SEQ ID NO: 161056 - RNA, 32 nt, Human
gaggcgggucgggcugggccagcugggguaga

SEQ ID NO: 161057 - RNA, 32 nt, Human
gaggcgggugaaagcuccgucuucugaauuca

SEQ ID NO: 161058 - RNA, 32 nt, Human
gaggcggguggaggagcagcagaggaagggga

SEQ ID NO: 161059 - RNA, 22 nt, Human
gaggcggguggaucacaagguc

SEQ ID NO: 161060 - RNA, 19 nt, Human
gaggcggguggaucacgag

SEQ ID NO: 161061 - RNA, 22 nt, Human
gaggcggguggaucacgagguc

SEQ ID NO: 161062 - RNA, 22 nt, Human
gaggcggguggaucagaagguc

SEQ ID NO: 161063 - RNA, 32 nt, Human
gaggcggguggaucgcuugagcacaggcguuc

SEQ ID NO: 161064 - RNA, 22 nt, Human
gaggcggucaggcugcugagga

SEQ ID NO: 161065 - RNA, 32 nt, Human
gaggcggugaagcucucggaaaugcugccacc

SEQ ID NO: 161066 - RNA, 22 nt, Human
gaggcgguuggaucacgagguc

SEQ ID NO: 161067 - RNA, 32 nt, Human
gaggcgguuucugcucuuagggaguggcaguc

SEQ ID NO: 161068 - RNA, 32 nt, Human
gaggcgucaagucuucucaagucuuaggauug

SEQ ID NO: 161069 - RNA, 32 nt, Human
gaggcguccuccggcucugggcuccggucggu

SEQ ID NO: 161070 - RNA, 32 nt, Human
gaggcgucggaauggaccugugccacccagag

SEQ ID NO: 161071 - RNA, 32 nt, Human
gaggcgucucucaacagccauauggcggacac

SEQ ID NO: 161072 - RNA, 21 nt, Human
gaggcgugagaaucgcuugaa

SEQ ID NO: 161073 - RNA, 32 nt, Human
gaggcgugagccacagugguuaucuccaagcu

SEQ ID NO: 161074 - RNA, 32 nt, Human
gaggcgugagccaccgcgccuguccaggaauc

SEQ ID NO: 161075 - RNA, 32 nt, Human
gaggcgugagccacugcaccugaccuaagagg

SEQ ID NO: 161076 - RNA, 32 nt, Human
gaggcgugcaaagacuccagaauuggaggcau

SEQ ID NO: 161077 - RNA, 32 nt, Human
gaggcguggaaggcugcggaaaagaaagcccg

SEQ ID NO: 161078 - RNA, 32 nt, Human
gaggcguggaggagaggagacuguuugaugug

SEQ ID NO: 161079 - RNA, 32 nt, Human
gaggcguggccacgaucucccucccagguggu

SEQ ID NO: 161080 - RNA, 32 nt, Human
gaggcgugggguuucggcugagcccacagggc

SEQ ID NO: 161081 - RNA, 32 nt, Human
gaggcguguggucccaguuggccaacauggag

SEQ ID NO: 161082 - RNA, 32 nt, Human
gaggcguuccaggaaagacuuguuuuugccug

SEQ ID NO: 161083 - RNA, 32 nt, Human
gaggcguuucaggcaugagucacaggccgggu

SEQ ID NO: 161084 - RNA, 25 nt, Human
gaggcuaaaaguuuuuaaauuagcu

SEQ ID NO: 161085 - RNA, 27 nt, Human
gaggcuaaagcaggagaauugcuugaa

SEQ ID NO: 161086 - RNA, 32 nt, Human
gaggcuaaagcaggcuagagcaguggaggggu

SEQ ID NO: 161087 - RNA, 27 nt, Human
gaggcuaagacaggagaaucgcuugaa

SEQ ID NO: 161088 - RNA, 24 nt, Human
gaggcuaagacgggaggauugcuu

SEQ ID NO: 161089 - RNA, 27 nt, Human
gaggcuaaggcaagagaauugcuugaa

SEQ ID NO: 161090 - RNA, 22 nt, Human
gaggcuaaggcaagaggaucac

SEQ ID NO: 161091 - RNA, 24 nt, Human
gaggcuaaggcagaaggaucgcuu

SEQ ID NO: 161092 - RNA, 27 nt, Human
gaggcuaaggcaggaaaaucgcuugaa

SEQ ID NO: 161093 - RNA, 22 nt, Human
gaggcuaaggcaggagaaucac

SEQ ID NO: 161094 - RNA, 27 nt, Human
gaggcuaaggcaggagaaucgcuugaa

SEQ ID NO: 161095 - RNA, 27 nt, Human
gaggcuaaggcaggagaauugcuugaa

SEQ ID NO: 161096 - RNA, 22 nt, Human
gaggcuaaggcaggcagaucac

SEQ ID NO: 161097 - RNA, 22 nt, Human
gaggcuaaggcaggcggaccac

SEQ ID NO: 161098 - RNA, 22 nt, Human
gaggcuaaggcaggcggaucac

SEQ ID NO: 161099 - RNA, 28 nt, Human
gaggcuaaggcagggagaaucgcuugaa

SEQ ID NO: 161100 - RNA, 32 nt, Human
gaggcuaaggcagggagaaucgcuugaaguag

SEQ ID NO: 161101 - RNA, 25 nt, Human
gaggcuaaggcagggagaauugcuu

SEQ ID NO: 161102 - RNA, 27 nt, Human
gaggcuaaggcaggggaaucgcuugaa

SEQ ID NO: 161103 - RNA, 22 nt, Human
gaggcuaaggcagguggaucac

SEQ ID NO: 161104 - RNA, 22 nt, Human
gaggcuaaggcagguggaucgc

SEQ ID NO: 161105 - RNA, 24 nt, Human
gaggcuaaggcagguggaucgcuu

SEQ ID NO: 161106 - RNA, 23 nt, Human
gaggcuaagguaggaucacuuga

SEQ ID NO: 161107 - RNA, 27 nt, Human
gaggcuaaggugggagaauugcuugaa

SEQ ID NO: 161108 - RNA, 24 nt, Human
gaggcuaaggugggaggaucacuu

SEQ ID NO: 161109 - RNA, 32 nt, Human
gaggcuaagguggguggaucaccugaggucaa

SEQ ID NO: 161110 - RNA, 32 nt, Human
gaggcuaaguuaaugccguguugcccagaaca

SEQ ID NO: 161111 - RNA, 27 nt, Human
gaggcuaaugcaggagaaucgcuugaa

SEQ ID NO: 161112 - RNA, 24 nt, Human
gaggcuacaaccacauuuguucac

SEQ ID NO: 161113 - RNA, 32 nt, Human
gaggcuacacuuuccuuuccagaagacuucaa

SEQ ID NO: 161114 - RNA, 32 nt, Human
gaggcuacagcaggagaauugcuugaacucgg

SEQ ID NO: 161115 - RNA, 32 nt, Human
gaggcuacagcaucuacuaccccucggcugcu

SEQ ID NO: 161116 - RNA, 32 nt, Human
gaggcuacagugagcaaagaucacgccacugc

SEQ ID NO: 161117 - RNA, 32 nt, Human
gaggcuacagugagccaugauccuaccacugc

SEQ ID NO: 161118 - RNA, 32 nt, Human
gaggcuacagugagccuugauugugucacugc

SEQ ID NO: 161119 - RNA, 32 nt, Human
gaggcuacagugagcuaugaucacaccauugc

SEQ ID NO: 161120 - RNA, 32 nt, Human
gaggcuacagugagcuaugauuacaccacugc

SEQ ID NO: 161121 - RNA, 32 nt, Human
gaggcuacagugagcugagaucgugccauugc

SEQ ID NO: 161122 - RNA, 32 nt, Human
gaggcuacagugagcugugauugcaccacugu

SEQ ID NO: 161123 - RNA, 32 nt, Human
gaggcuacagugagcugugcuugugccacugu

SEQ ID NO: 161124 - RNA, 32 nt, Human
gaggcuaccagggccagagacagggaaugggg

SEQ ID NO: 161125 - RNA, 32 nt, Human
gaggcuacgauggguggaucaccugaggucag

SEQ ID NO: 161126 - RNA, 32 nt, Human
gaggcuacucggcuuggcccgcagguccuccg

SEQ ID NO: 161127 - RNA, 25 nt, Human
gaggcuacuuaugucuugguuuuau

SEQ ID NO: 161128 - RNA, 32 nt, Human
gaggcuagagagagacagaaugacagagagag

SEQ ID NO: 161129 - RNA, 32 nt, Human
gaggcuagaguggacaaaugagggccagggag

SEQ ID NO: 161130 - RNA, 23 nt, Human
gaggcuaggacccuggccgcgcu

SEQ ID NO: 161131 - RNA, 20 nt, Human
gaggcuaggacguggccggc

SEQ ID NO: 161132 - RNA, 23 nt, Human
gaggcuaggaguucaagaccagc

SEQ ID NO: 161133 - RNA, 23 nt, Human
gaggcuaggaguucaagacuagc

SEQ ID NO: 161134 - RNA, 23 nt, Human
gaggcuaggaguucgaggucagc

SEQ ID NO: 161135 - RNA, 32 nt, Human
gaggcuaggaguugcagaccagccuggccaac

SEQ ID NO: 161136 - RNA, 24 nt, Human
gaggcuaggaguuugagaccagcu

SEQ ID NO: 161137 - RNA, 32 nt, Human
gaggcuaggauuuugagaccagccuggggaaa

SEQ ID NO: 161138 - RNA, 20 nt, Human
gaggcuagggggccacaguu

SEQ ID NO: 161139 - RNA, 32 nt, Human
gaggcuaguguuugcauuccugguuauaugua

SEQ ID NO: 161140 - RNA, 32 nt, Human
gaggcuauaugaaauuccaucuuaggugcaac

SEQ ID NO: 161141 - RNA, 32 nt, Human
gaggcuaucugucccuuccgggggcacccugc

SEQ ID NO: 161142 - RNA, 32 nt, Human
gaggcucaaacuugugaagguuaauaccauaa

SEQ ID NO: 161143 - RNA, 32 nt, Human
gaggcucaaaggacugugagccgggagaucug

SEQ ID NO: 161144 - RNA, 32 nt, Human
gaggcucaagccuucacagugagcugaugguc

SEQ ID NO: 161145 - RNA, 31 nt, Human
gaggcucacagcuuggcaaaugcuagggcuu

SEQ ID NO: 161146 - RNA, 32 nt, Human
gaggcucaccccucucugagggcuguuguucu

SEQ ID NO: 161147 - RNA, 32 nt, Human
gaggcucaccuggcagcugccgucucugcccc

SEQ ID NO: 161148 - RNA, 32 nt, Human
gaggcucaccuuagagcuucugaguuuccaag

SEQ ID NO: 161149 - RNA, 22 nt, Human
gaggcucacgccuguaauccca

SEQ ID NO: 161150 - RNA, 18 nt, Human
gaggcucacggggugcca

SEQ ID NO: 161151 - RNA, 32 nt, Human
gaggcucagagagguuuagucauuugcccaaa

SEQ ID NO: 161152 - RNA, 32 nt, Human
gaggcucagagggagaaaggggcuugccaagg

SEQ ID NO: 161153 - RNA, 32 nt, Human
gaggcucagaucuugcuuaugugaggauaggc

SEQ ID NO: 161154 - RNA, 24 nt, Human
gaggcucagccuguccuguuucau

SEQ ID NO: 161155 - RNA, 32 nt, Human
gaggcucagcugaggcaagaagagcaccauca

SEQ ID NO: 161156 - RNA, 32 nt, Human
gaggcucaggaguucaagaccagccuggccaa

SEQ ID NO: 161157 - RNA, 32 nt, Human
gaggcucaggcagagcagguguggacuaaguc

SEQ ID NO: 161158 - RNA, 32 nt, Human
gaggcucaggcagaggauugcuugaggccagg

SEQ ID NO: 161159 - RNA, 32 nt, Human
gaggcucaggccgggacugagauggacagacc

SEQ ID NO: 161160 - RNA, 32 nt, Human
gaggcucagggugggagagggccccgggcugc

SEQ ID NO: 161161 - RNA, 32 nt, Human
gaggcucaucccucaguggcaacagaaacagg

SEQ ID NO: 161162 - RNA, 22 nt, Human
gaggcucaugccuguaauccca

SEQ ID NO: 161163 - RNA, 32 nt, Human
gaggcuccagaagaaaagcugcgcauuuaccc

SEQ ID NO: 161164 - RNA, 32 nt, Human
gaggcuccagcgagggcaccagugccugcagc

SEQ ID NO: 161165 - RNA, 32 nt, Human
gaggcuccagugagcugugauugugccauugc

SEQ ID NO: 161166 - RNA, 32 nt, Human
gaggcuccaguucucaucugcucagguguccc

SEQ ID NO: 161167 - RNA, 32 nt, Human
gaggcucccaucugccuuucucuguaauaaug

SEQ ID NO: 161168 - RNA, 32 nt, Human
gaggcuccccugcccuccuucuccuuaggagu

SEQ ID NO: 161169 - RNA, 32 nt, Human
gaggcuccccugggaacuagagccaggaacag

SEQ ID NO: 161170 - RNA, 32 nt, Human
gaggcucccucggggcucgggaucugcagcau

SEQ ID NO: 161171 - RNA, 32 nt, Human
gaggcucccugagaugugcuguccacuaagca

SEQ ID NO: 161172 - RNA, 32 nt, Human
gaggcucccugagccgccuccccaccaucacc

SEQ ID NO: 161173 - RNA, 32 nt, Human
gaggcucccuggggcucggcuuggaccgcgau

SEQ ID NO: 161174 - RNA, 23 nt, Human
gaggcuccggcauaggccugaga

SEQ ID NO: 161175 - RNA, 32 nt, Human
gaggcuccuccucuguggauggucacugcccc

SEQ ID NO: 161176 - RNA, 32 nt, Human
gaggcuccugcucucccauccaccugucuguc

SEQ ID NO: 161177 - RNA, 32 nt, Human
gaggcuccugcucuccugugccuccgaggccc

SEQ ID NO: 161178 - RNA, 32 nt, Human
gaggcuccugugguaguccucccaagcugugc

SEQ ID NO: 161179 - RNA, 31 nt, Human
gaggcucgccucucuggccgggugcagugaa

SEQ ID NO: 161180 - RNA, 32 nt, Human
gaggcucgcuucuugauguuguguacaaacuc

SEQ ID NO: 161181 - RNA, 32 nt, Human
gaggcucggagagagaagacguggagggaggg

SEQ ID NO: 161182 - RNA, 32 nt, Human
gaggcucggagaggaacccugccccuccgaug

SEQ ID NO: 161183 - RNA, 32 nt, Human
gaggcucggggguggaggagccuuaguguguc

SEQ ID NO: 161184 - RNA, 18 nt, Human
gaggcucggguugugcca

SEQ ID NO: 161185 - RNA, 32 nt, Human
gaggcucuaggccagauguuuacauaauuuua

SEQ ID NO: 161186 - RNA, 32 nt, Human
gaggcucucaaacuuugagggucauaagacuu

SEQ ID NO: 161187 - RNA, 32 nt, Human
gaggcucucauauccuggaauugcccuccagg

SEQ ID NO: 161188 - RNA, 32 nt, Human
gaggcucucuaagaaaagagaggaucuaggau

SEQ ID NO: 161189 - RNA, 32 nt, Human
gaggcucugagcggaugcacaggucacccaug

SEQ ID NO: 161190 - RNA, 32 nt, Human
gaggcucugagcuggagcccuagaagguaacc

SEQ ID NO: 161191 - RNA, 21 nt, Human
gaggcucugaugaacauucca

SEQ ID NO: 161192 - RNA, 32 nt, Human
gaggcucugcccugagguucugcuccggagaa

SEQ ID NO: 161193 - RNA, 22 nt, Human
gaggcucugccuccccucugcc

SEQ ID NO: 161194 - RNA, 32 nt, Human
gaggcucuggccagagggagagaggacucugg

SEQ ID NO: 161195 - RNA, 32 nt, Human
gaggcucugggcggaggugcagugaccccgca

SEQ ID NO: 161196 - RNA, 21 nt, Human
gaggcucuggggcagccccca

SEQ ID NO: 161197 - RNA, 32 nt, Human
gaggcucugguuccucacuccuccugccucca

SEQ ID NO: 161198 - RNA, 32 nt, Human
gaggcucugugagggccagagcugaggggguc

SEQ ID NO: 161199 - RNA, 32 nt, Human
gaggcucuguucugccucuuaucagccagguc

SEQ ID NO: 161200 - RNA, 32 nt, Human
gaggcucuuucuacccaauauuuccuucucuu

SEQ ID NO: 161201 - RNA, 24 nt, Human
gaggcugaaaacgagggcccagga

SEQ ID NO: 161202 - RNA, 18 nt, Human
gaggcugaagacaggugc

SEQ ID NO: 161203 - RNA, 32 nt, Human
gaggcugaagcaggcgggucaccugaggucaa

SEQ ID NO: 161204 - RNA, 17 nt, Human
gaggcugaagcugggag

SEQ ID NO: 161205 - RNA, 18 nt, Human
gaggcugaagcugggagg

SEQ ID NO: 161206 - RNA, 32 nt, Human
gaggcugaagugagccaagaucgcgccacugc

SEQ ID NO: 161207 - RNA, 32 nt, Human
gaggcugaagugagccaagauuacgucacugc

SEQ ID NO: 161208 - RNA, 32 nt, Human
gaggcugaauucuuggagcugaagggaaaacu

SEQ ID NO: 161209 - RNA, 32 nt, Human
gaggcugacagaggcaggaugggugcaaggca

SEQ ID NO: 161210 - RNA, 32 nt, Human
gaggcugacauuaagcagggaucugucguggg

SEQ ID NO: 161211 - RNA, 22 nt, Human
gaggcugacggaggaggcgcug

SEQ ID NO: 161212 - RNA, 32 nt, Human
gaggcugacggcagagguggagaacgacaagc

SEQ ID NO: 161213 - RNA, 32 nt, Human
gaggcugacugacgucuuggaggcagaagucc

SEQ ID NO: 161214 - RNA, 32 nt, Human
gaggcugagaaauaagcucagauggaagagau

SEQ ID NO: 161215 - RNA, 22 nt, Human
gaggcugagacagguggaucac

SEQ ID NO: 161216 - RNA, 32 nt, Human
gaggcugagacagguggaucaccugaggccgg

SEQ ID NO: 161217 - RNA, 32 nt, Human
gaggcugagacgcaaggaucacuugagcccag

SEQ ID NO: 161218 - RNA, 32 nt, Human
gaggcugagacgggcagaucaccugagaucag

SEQ ID NO: 161219 - RNA, 32 nt, Human
gaggcugagagagaaggggaaaagaggauauu

SEQ ID NO: 161220 - RNA, 32 nt, Human
gaggcugagagauugagccugcagugagcuau

SEQ ID NO: 161221 - RNA, 32 nt, Human
gaggcugagaggucaagguugcagugagccau

SEQ ID NO: 161222 - RNA, 32 nt, Human
gaggcugagauggaucaucugagccucaggag

SEQ ID NO: 161223 - RNA, 32 nt, Human
gaggcugagaugggaggaccauuugagccugg

SEQ ID NO: 161224 - RNA, 32 nt, Human
gaggcugagaugggaggagcacuugagccuag

SEQ ID NO: 161225 - RNA, 32 nt, Human
gaggcugagaugggaggaucacuugaggccaa

SEQ ID NO: 161226 - RNA, 32 nt, Human
gaggcugagaugggaggaucaucugagccugg

SEQ ID NO: 161227 - RNA, 32 nt, Human
gaggcugagaugggaggaucgcuugagcccag

SEQ ID NO: 161228 - RNA, 32 nt, Human
gaggcugagaugggaggaucucuugagaccag

SEQ ID NO: 161229 - RNA, 32 nt, Human
gaggcugagaugggaggauugccugagcccag

SEQ ID NO: 161230 - RNA, 32 nt, Human
gaggcugagaugggaggauugcuugagcccag

SEQ ID NO: 161231 - RNA, 32 nt, Human
gaggcugagaugggaggauugcuugagccugu

SEQ ID NO: 161232 - RNA, 32 nt, Human
gaggcugagaugggaggguggcuugagcccag

SEQ ID NO: 161233 - RNA, 32 nt, Human
gaggcugagaugggcagaucacuugaggucag

SEQ ID NO: 161234 - RNA, 32 nt, Human
gaggcugagaugggcggaucacgaggucagga

SEQ ID NO: 161235 - RNA, 32 nt, Human
gaggcugagauggguggauugcuugagcccag

SEQ ID NO: 161236 - RNA, 25 nt, Human
gaggcugagccaggccuuggguuuc

SEQ ID NO: 161237 - RNA, 32 nt, Human
gaggcugagccccuggacugggagucaggguu

SEQ ID NO: 161238 - RNA, 32 nt, Human
gaggcugagcgcucuggcugggacagcuagag

SEQ ID NO: 161239 - RNA, 32 nt, Human
gaggcugagcugggcagaucaccugaggucag

SEQ ID NO: 161240 - RNA, 32 nt, Human
gaggcugaggaaggagaggaugacagagacag

SEQ ID NO: 161241 - RNA, 32 nt, Human
gaggcugaggagaaggaggagcgggccgugga

SEQ ID NO: 161242 - RNA, 32 nt, Human
gaggcugaggaguucaagaccagccuggccaa

SEQ ID NO: 161243 - RNA, 32 nt, Human
gaggcugaggcaacaagaaucgcuugaaccug

SEQ ID NO: 161244 - RNA, 22 nt, Human
gaggcugaggcaaguggaucac

SEQ ID NO: 161245 - RNA, 32 nt, Human
gaggcugaggcagaaggaucccuugagcccag

SEQ ID NO: 161246 - RNA, 32 nt, Human
gaggcugaggcaggaagaaucgcuugaacccg

SEQ ID NO: 161247 - RNA, 25 nt, Human
gaggcugaggcaggaaucgcuugaa

SEQ ID NO: 161248 - RNA, 32 nt, Human
gaggcugaggcaggagaauuugcuugauccug

SEQ ID NO: 161249 - RNA, 24 nt, Human
gaggcugaggcaggaggacugcuu

SEQ ID NO: 161250 - RNA, 24 nt, Human
gaggcugaggcaggaggauugcuu

SEQ ID NO: 161251 - RNA, 32 nt, Human
gaggcugaggcaggcagaucaccugaggccag

SEQ ID NO: 161252 - RNA, 32 nt, Human
gaggcugaggcaggcagaucaccugaggcuag

SEQ ID NO: 161253 - RNA, 32 nt, Human
gaggcugaggcaggcagaucaccugaggucag

SEQ ID NO: 161254 - RNA, 32 nt, Human
gaggcugaggcaggcagaucaccugaggucgg

SEQ ID NO: 161255 - RNA, 32 nt, Human
gaggcugaggcaggccaaucaccugaggucgg

SEQ ID NO: 161256 - RNA, 22 nt, Human
gaggcugaggcaggcggaucac

SEQ ID NO: 161257 - RNA, 32 nt, Human
gaggcugaggcaggcggaucaccugaggucag

SEQ ID NO: 161258 - RNA, 32 nt, Human
gaggcugaggcaggcggaucaccugaggucgg

SEQ ID NO: 161259 - RNA, 32 nt, Human
gaggcugaggcagggagaaucgcuugaaccug

SEQ ID NO: 161260 - RNA, 32 nt, Human
gaggcugaggcagguagcucaccugagucagg

SEQ ID NO: 161261 - RNA, 22 nt, Human
gaggcugaggcaggugaaucac

SEQ ID NO: 161262 - RNA, 22 nt, Human
gaggcugaggcagguggaucac

SEQ ID NO: 161263 - RNA, 32 nt, Human
gaggcugaggcagguggaucaccugaggucag

SEQ ID NO: 161264 - RNA, 32 nt, Human
gaggcugaggcagguggaucaccugaggucgg

SEQ ID NO: 161265 - RNA, 32 nt, Human
gaggcugaggcagguggaucaccugagguuag

SEQ ID NO: 161266 - RNA, 32 nt, Human
gaggcugaggcauggagaaucgcuugaaccca

SEQ ID NO: 161267 - RNA, 32 nt, Human
gaggcugaggcgcguggaucaccugaggucag

SEQ ID NO: 161268 - RNA, 32 nt, Human
gaggcugaggcggauggaucaccugaggucag

SEQ ID NO: 161269 - RNA, 32 nt, Human
gaggcugaggcgggagaaucaccugagccugg

SEQ ID NO: 161270 - RNA, 24 nt, Human
gaggcugaggcgggaggaucgcuu

SEQ ID NO: 161271 - RNA, 32 nt, Human
gaggcugaggcgggaugaucaccugaggucag

SEQ ID NO: 161272 - RNA, 32 nt, Human
gaggcugaggcgggcagaucaccugagaucgg

SEQ ID NO: 161273 - RNA, 32 nt, Human
gaggcugaggcgggcagaucaccugaggccag

SEQ ID NO: 161274 - RNA, 32 nt, Human
gaggcugaggcgggcagaucaccugaggucaa

SEQ ID NO: 161275 - RNA, 32 nt, Human
gaggcugaggcgggcagaucaccugaggucag

SEQ ID NO: 161276 - RNA, 21 nt, Human
gaggcugaggcgggcggauca

SEQ ID NO: 161277 - RNA, 32 nt, Human
gaggcugaggcgggcggaucaccugaggucgg

SEQ ID NO: 161278 - RNA, 32 nt, Human
gaggcugaggcgggcggaucaccugagguugg

SEQ ID NO: 161279 - RNA, 32 nt, Human
gaggcugaggcgggcggaucaccugagucagg

SEQ ID NO: 161280 - RNA, 21 nt, Human
gaggcugaggcggguggauca

SEQ ID NO: 161281 - RNA, 32 nt, Human
gaggcugaggcggguggaucaccugaggccag

SEQ ID NO: 161282 - RNA, 32 nt, Human
gaggcugaggcggguggaucaccugaggucag

SEQ ID NO: 161283 - RNA, 32 nt, Human
gaggcugaggcggguggaucaccugaggucgg

SEQ ID NO: 161284 - RNA, 32 nt, Human
gaggcugaggcggguggaucaccugagguuag

SEQ ID NO: 161285 - RNA, 32 nt, Human
gaggcugaggcgggugggucaccugagguugg

SEQ ID NO: 161286 - RNA, 32 nt, Human
gaggcugaggcggguugaucaccugaggucag

SEQ ID NO: 161287 - RNA, 32 nt, Human
gaggcugaggcugaggggcagucaccagcacc

SEQ ID NO: 161288 - RNA, 22 nt, Human
gaggcugaggcugcagccagcu

SEQ ID NO: 161289 - RNA, 32 nt, Human
gaggcugaggcuggcguaucaccugagguugg

SEQ ID NO: 161290 - RNA, 32 nt, Human
gaggcugaggcugggggaucaccugaggucag

SEQ ID NO: 161291 - RNA, 32 nt, Human
gaggcugagggaggaaagagcaguuaacaaac

SEQ ID NO: 161292 - RNA, 32 nt, Human
gaggcugagggcaggagaauugcuugaaccug

SEQ ID NO: 161293 - RNA, 32 nt, Human
gaggcugagggcaggagaauugcuugaaucca

SEQ ID NO: 161294 - RNA, 32 nt, Human
gaggcugagggcccucggaacagagccccugu

SEQ ID NO: 161295 - RNA, 32 nt, Human
gaggcugagggugagggaacagccuggaugug

SEQ ID NO: 161296 - RNA, 32 nt, Human
gaggcugagguaggagaaucaccugagccugg

SEQ ID NO: 161297 - RNA, 32 nt, Human
gaggcugagguaggagaauucgcuugagccug

SEQ ID NO: 161298 - RNA, 32 nt, Human
gaggcugagguaggagcaucaccuggggcugg

SEQ ID NO: 161299 - RNA, 32 nt, Human
gaggcugagguaggaggaucaccugagacugg

SEQ ID NO: 161300 - RNA, 32 nt, Human
gaggcugagguaggaggaucaccugagccugg

SEQ ID NO: 161301 - RNA, 32 nt, Human
gaggcugaggugagaggagcaagugagcccag

SEQ ID NO: 161302 - RNA, 32 nt, Human
gaggcugaggugagaggauaccuugagccagg

SEQ ID NO: 161303 - RNA, 32 nt, Human
gaggcugaggugagaggaucgcuugagcucag

SEQ ID NO: 161304 - RNA, 32 nt, Human
gaggcugaggugagagggucacuugagcccag

SEQ ID NO: 161305 - RNA, 31 nt, Human
gaggcugagguggaaagauggcccaggaauu

SEQ ID NO: 161306 - RNA, 32 nt, Human
gaggcugagguggauggaucaccugagccugg

SEQ ID NO: 161307 - RNA, 32 nt, Human
gaggcugaggugggagaaucaccugagcccag

SEQ ID NO: 161308 - RNA, 24 nt, Human
gaggcugaggugggagaaucgcuu

SEQ ID NO: 161309 - RNA, 32 nt, Human
gaggcugaggugggaggaucaccugaggucgg

SEQ ID NO: 161310 - RNA, 32 nt, Human
gaggcugaggugggaggaucaccugagugagc

SEQ ID NO: 161311 - RNA, 24 nt, Human
gaggcugaggugggaggaucgcuu

SEQ ID NO: 161312 - RNA, 24 nt, Human
gaggcugaggugggaggauugcuu

SEQ ID NO: 161313 - RNA, 32 nt, Human
gaggcugaggugggcaaaucaccugaggucag

SEQ ID NO: 161314 - RNA, 32 nt, Human
gaggcugaggugggcagaucaccugagaucgg

SEQ ID NO: 161315 - RNA, 32 nt, Human
gaggcugaggugggcagaucaccugaggucag

SEQ ID NO: 161316 - RNA, 32 nt, Human
gaggcugaggugggcagaucaccugagguugg

SEQ ID NO: 161317 - RNA, 32 nt, Human
gaggcugaggugggcauaucaccugaggucag

SEQ ID NO: 161318 - RNA, 32 nt, Human
gaggcugaggugggcgcaucaccugaggucag

SEQ ID NO: 161319 - RNA, 32 nt, Human
gaggcugaggugggcggaucaccugaggucag

SEQ ID NO: 161320 - RNA, 32 nt, Human
gaggcugaggugggcggaucaccugaguucag

SEQ ID NO: 161321 - RNA, 32 nt, Human
gaggcugagguggguggaucaccugagaagaa

SEQ ID NO: 161322 - RNA, 32 nt, Human
gaggcugagguggguggaucaccugaggucag

SEQ ID NO: 161323 - RNA, 32 nt, Human
gaggcugagguggguguaucaccugaggucgg

SEQ ID NO: 161324 - RNA, 32 nt, Human
gaggcugagguggguguaucacuugaggucag

SEQ ID NO: 161325 - RNA, 32 nt, Human
gaggcugaggugguaggaucaccugaggucag

SEQ ID NO: 161326 - RNA, 32 nt, Human
gaggcugaguagccucagaaggguuuaggcga

SEQ ID NO: 161327 - RNA, 32 nt, Human
gaggcugagugguguggaggcagcugcugggc

SEQ ID NO: 161328 - RNA, 32 nt, Human
gaggcugaguugggcagaucaccugagaucag

SEQ ID NO: 161329 - RNA, 32 nt, Human
gaggcugaguuuccagaagaccuguucaacca

SEQ ID NO: 161330 - RNA, 32 nt, Human
gaggcugauuucuccccucuccugggccaggg

SEQ ID NO: 161331 - RNA, 32 nt, Human
gaggcugcaauauuccauccugggugucuggg

SEQ ID NO: 161332 - RNA, 32 nt, Human
gaggcugcaaugagcuguguucaugccacugc

SEQ ID NO: 161333 - RNA, 32 nt, Human
gaggcugcaccaggagaggacagggaggguuc

SEQ ID NO: 161334 - RNA, 32 nt, Human
gaggcugcacuguggcagucuaggugagagac

SEQ ID NO: 161335 - RNA, 32 nt, Human
gaggcugcagcaaaaacaaagcaaagaagaua

SEQ ID NO: 161336 - RNA, 32 nt, Human
gaggcugcagcgagcuaugaucgcgccacuac

SEQ ID NO: 161337 - RNA, 19 nt, Human
gaggcugcaggaaacagca

SEQ ID NO: 161338 - RNA, 32 nt, Human
gaggcugcaggaacaggagaggcugcuggaca

SEQ ID NO: 161339 - RNA, 18 nt, Human
gaggcugcagggaugcca

SEQ ID NO: 161340 - RNA, 32 nt, Human
gaggcugcaguaagcuaugaucaugccacugc

SEQ ID NO: 161341 - RNA, 32 nt, Human
gaggcugcagugaaccaagaucaugccacugc

SEQ ID NO: 161342 - RNA, 32 nt, Human
gaggcugcagugaacuaagaagaugccauugc

SEQ ID NO: 161343 - RNA, 32 nt, Human
gaggcugcagugaacuaagaucaugccacugc

SEQ ID NO: 161344 - RNA, 32 nt, Human
gaggcugcagugaacuaugaucaaaccacugu

SEQ ID NO: 161345 - RNA, 32 nt, Human
gaggcugcagugaacuaugauuuuaccacugc

SEQ ID NO: 161346 - RNA, 32 nt, Human
gaggcugcagugaacugagaucacgucacuga

SEQ ID NO: 161347 - RNA, 32 nt, Human
gaggcugcagugaauuaugauuguggcauugc

SEQ ID NO: 161348 - RNA, 32 nt, Human
gaggcugcagugacccaagauugugccacugc

SEQ ID NO: 161349 - RNA, 32 nt, Human
gaggcugcagugaccgaugaucaugccacugc

SEQ ID NO: 161350 - RNA, 32 nt, Human
gaggcugcagugaccuaugauggcaccacugu

SEQ ID NO: 161351 - RNA, 32 nt, Human
gaggcugcagugagacgagaucgcgccacugc

SEQ ID NO: 161352 - RNA, 32 nt, Human
gaggcugcagugagcaaugaucguaccacugc

SEQ ID NO: 161353 - RNA, 32 nt, Human
gaggcugcagugagcagagcgugccgcuacac

SEQ ID NO: 161354 - RNA, 32 nt, Human
gaggcugcagugagcagggaucgcaccacugc

SEQ ID NO: 161355 - RNA, 32 nt, Human
gaggcugcagugagcaugaucgcgacacugca

SEQ ID NO: 161356 - RNA, 32 nt, Human
gaggcugcagugagccaagaucacggcacugc

SEQ ID NO: 161357 - RNA, 32 nt, Human
gaggcugcagugagccaagaucaugcuacugc

SEQ ID NO: 161358 - RNA, 32 nt, Human
gaggcugcagugagccaagaucgcaccauugc

SEQ ID NO: 161359 - RNA, 32 nt, Human
gaggcugcagugagccaagaucgcacuacugc

SEQ ID NO: 161360 - RNA, 32 nt, Human
gaggcugcagugagccaagauggcgccacugc

SEQ ID NO: 161361 - RNA, 32 nt, Human
gaggcugcagugagccaagauugugccacugc

SEQ ID NO: 161362 - RNA, 32 nt, Human
gaggcugcagugagccacagucacgccacugc

SEQ ID NO: 161363 - RNA, 32 nt, Human
gaggcugcagugagccaugacggugccacugc

SEQ ID NO: 161364 - RNA, 32 nt, Human
gaggcugcagugagccaugacugugccacugc

SEQ ID NO: 161365 - RNA, 32 nt, Human
gaggcugcagugagccaugaucacaucacugc

SEQ ID NO: 161366 - RNA, 32 nt, Human
gaggcugcagugagccaugaucaugccacugc

SEQ ID NO: 161367 - RNA, 32 nt, Human
gaggcugcagugagccaugaucauuccacugc

SEQ ID NO: 161368 - RNA, 32 nt, Human
gaggcugcagugagccaugaucuugccacugc

SEQ ID NO: 161369 - RNA, 32 nt, Human
gaggcugcagugagccaugauuaugccauuac

SEQ ID NO: 161370 - RNA, 32 nt, Human
gaggcugcagugagccaugauuaugcugcugc

SEQ ID NO: 161371 - RNA, 32 nt, Human
gaggcugcagugagccaugauugagccaccac

SEQ ID NO: 161372 - RNA, 32 nt, Human
gaggcugcagugagccaugauugcaccacugc

SEQ ID NO: 161373 - RNA, 32 nt, Human
gaggcugcagugagccaugauugugcuacugc

SEQ ID NO: 161374 - RNA, 32 nt, Human
gaggcugcagugagccaugcucacaccacugc

SEQ ID NO: 161375 - RNA, 32 nt, Human
gaguaggaauggugccuggcaccccugaacca

SEQ ID NO: 161376 - RNA, 32 nt, Human
gaguaggagagagggagcgagagccaggcagg

SEQ ID NO: 161377 - RNA, 32 nt, Human
gaguaggagcauuuggugcuccugguugcuga

SEQ ID NO: 161378 - RNA, 32 nt, Human
gaguaggagccggucucccagaaggcggaguc

SEQ ID NO: 161379 - RNA, 32 nt, Human
gaguaggaggcgaaucugcaaagggaauaaag

SEQ ID NO: 161380 - RNA, 32 nt, Human
gaguaggagggaggugcaguccccagccccca

SEQ ID NO: 161381 - RNA, 32 nt, Human
gaguaggaguagcugggacuacaagcaugcac

SEQ ID NO: 161382 - RNA, 32 nt, Human
gaguaggaugucucuuggaaauguuaagaaag

SEQ ID NO: 161383 - RNA, 32 nt, Human
gaguaggcaaagggcuguagcaugcaugauca

SEQ ID NO: 161384 - RNA, 32 nt, Human
gaguaggccauggacaccuucagcaccaagag

SEQ ID NO: 161385 - RNA, 32 nt, Human
gaguagggcgaguuugccugaagcucugcugc

SEQ ID NO: 161386 - RNA, 32 nt, Human
gaguagggggagaggcaccaccuggggaagac

SEQ ID NO: 161387 - RNA, 32 nt, Human
gaguagguccccauggcuggcaggccagagcc

SEQ ID NO: 161388 - RNA, 32 nt, Human
gaguaggugagcugucggggcuagugauggag

SEQ ID NO: 161389 - RNA, 21 nt, Human
gaguaggugggacuacaggug

SEQ ID NO: 161390 - RNA, 32 nt, Human
gaguaguagcugaagagcaagaggaggacaug

SEQ ID NO: 161391 - RNA, 32 nt, Human
gaguagucacacugaagaaauguccacucagu

SEQ ID NO: 161392 - RNA, 32 nt, Human
gaguagucuggaaaauuagacuucugagccuu

SEQ ID NO: 161393 - RNA, 32 nt, Human
gaguagugcuuccaggguccaagggauucuca

SEQ ID NO: 161394 - RNA, 32 nt, Human
gaguagugcuuugguguucacagucuguuuuu

SEQ ID NO: 161395 - RNA, 21 nt, Human
gaguaguggaaauuacaggug

SEQ ID NO: 161396 - RNA, 19 nt, Human
gaguaguugggauuacagg

SEQ ID NO: 161397 - RNA, 21 nt, Human
gaguaguugggauuacaggug

SEQ ID NO: 161398 - RNA, 32 nt, Human
gaguaguuguagcagacaccacaugcccuuga

SEQ ID NO: 161399 - RNA, 32 nt, Human
gaguaguuuagaagccucuccuccccaugacu

SEQ ID NO: 161400 - RNA, 32 nt, Human
gaguaguuuccucugcugacauuccaaauccc

SEQ ID NO: 161401 - RNA, 32 nt, Human
gaguaguuugcagcugugugguagugguuuaa

SEQ ID NO: 161402 - RNA, 32 nt, Human
gaguaguuugccaugagauaacacaguguaaa

SEQ ID NO: 161403 - RNA, 32 nt, Human
gaguauaaguugagcauagcauacuuccagag

SEQ ID NO: 161404 - RNA, 32 nt, Human
gaguauauggugugugccaguuaugaguugac

SEQ ID NO: 161405 - RNA, 32 nt, Human
gaguaucagagccugaaggugaagagcgcgag

SEQ ID NO: 161406 - RNA, 23 nt, Human
gaguauccaaauccaaaaaucca

SEQ ID NO: 161407 - RNA, 32 nt, Human
gaguaucgguucuccccuucccggcuuucggu

SEQ ID NO: 161408 - RNA, 32 nt, Human
gaguaucuaggacuacaggcccgcacaacaau

SEQ ID NO: 161409 - RNA, 23 nt, Human
gaguaucucucgagaaccuggag

SEQ ID NO: 161410 - RNA, 32 nt, Human
gaguaucucugccucccuuguccuguuguuuc

SEQ ID NO: 161411 - RNA, 20 nt, Human
gaguaucuggaccucagaga

SEQ ID NO: 161412 - RNA, 32 nt, Human
gaguaucuggaugucuuggauuuucuucccau

SEQ ID NO: 161413 - RNA, 32 nt, Human
gaguaucuggauuacccaggaagguugagcug

SEQ ID NO: 161414 - RNA, 32 nt, Human
gaguaucuuuuuccuuuuauuuucuuucuuuu

SEQ ID NO: 161415 - RNA, 32 nt, Human
gaguaugagagacagagcuccaggcauguccc

SEQ ID NO: 161416 - RNA, 32 nt, Human
gaguaugagcugcccccgcccgcuccugagaa

SEQ ID NO: 161417 - RNA, 32 nt, Human
gaguaugauuacacauuuaaauacugcacuca

SEQ ID NO: 161418 - RNA, 32 nt, Human
gaguaugccgcugcacuccagccugggggaca

SEQ ID NO: 161419 - RNA, 32 nt, Human
gaguaugcucuggaccuuauccuugaaagaug

SEQ ID NO: 161420 - RNA, 32 nt, Human
gaguaugcugcuaccucucuccuugaagggag

SEQ ID NO: 161421 - RNA, 32 nt, Human
gaguaugcuggaggcagagggcaagggagggg

SEQ ID NO: 161422 - RNA, 32 nt, Human
gaguaugcuguaaucuuaaggcauagguuauu

SEQ ID NO: 161423 - RNA, 32 nt, Human
gaguauggcugugauaagucucuccuuaaaug

SEQ ID NO: 161424 - RNA, 32 nt, Human
gaguaugggaagaaggaggaauggagggucag

SEQ ID NO: 161425 - RNA, 32 nt, Human
gaguaugggaggaggagguggccuagaacucu

SEQ ID NO: 161426 - RNA, 32 nt, Human
gaguaugucuagcucuuuacugguccaucuuc

SEQ ID NO: 161427 - RNA, 32 nt, Human
gaguaugucuguuccacagacagaugaggcag

SEQ ID NO: 161428 - RNA, 32 nt, Human
gaguauuaggaagaagauggauaaaaaccuau

SEQ ID NO: 161429 - RNA, 32 nt, Human
gaguauucauuuccuggguuuuccucuucccu

SEQ ID NO: 161430 - RNA, 32 nt, Human
gaguauucauuuugcaacuuggagauuuugcu

SEQ ID NO: 161431 - RNA, 32 nt, Human
gaguauugaggugcuagguagaaaguuaggaa

SEQ ID NO: 161432 - RNA, 32 nt, Human
gaguauugggauuacagacaugagccacugca

SEQ ID NO: 161433 - RNA, 32 nt, Human
gaguauugugcacaacuuccuccaccuuuccc

SEQ ID NO: 161434 - RNA, 32 nt, Human
gaguauuuauuugagccuaaauuguagguagc

SEQ ID NO: 161435 - RNA, 32 nt, Human
gaguauuugaguaaguuuuacaugacaguggg

SEQ ID NO: 161436 - RNA, 32 nt, Human
gaguauuugcaaagagcaacaacugaauguga

SEQ ID NO: 161437 - RNA, 32 nt, Human
gaguauuuuaaaaggaaaacauucuuuacuuu

SEQ ID NO: 161438 - RNA, 32 nt, Human
gaguauuuuugacagaauauguuucaaacuuu

SEQ ID NO: 161439 - RNA, 32 nt, Human
gaguauuuuuggcuuuauauaaaacaagguuu

SEQ ID NO: 161440 - RNA, 23 nt, Human
gagucaaaagcugcagugagcua

SEQ ID NO: 161441 - RNA, 32 nt, Human
gagucaaaagugguucauaggccggucauggu

SEQ ID NO: 161442 - RNA, 32 nt, Human
gagucaaaccacugcaauccagccugggcaac

SEQ ID NO: 161443 - RNA, 24 nt, Human
gagucaaaggcuguagugagcuau

SEQ ID NO: 161444 - RNA, 32 nt, Human
gagucaacacagacugauguacccacagacac

SEQ ID NO: 161445 - RNA, 32 nt, Human
gagucaacgagaaaaucucaguccaagccuau

SEQ ID NO: 161446 - RNA, 32 nt, Human
gagucaagacagcaccacugcacuccagccug

SEQ ID NO: 161447 - RNA, 24 nt, Human
gagucaagaucacgccacugcacu

SEQ ID NO: 161448 - RNA, 24 nt, Human
gagucaagaucgcgccacugcacu

SEQ ID NO: 161449 - RNA, 24 nt, Human
gagucaagauugcaccacugcacu

SEQ ID NO: 161450 - RNA, 32 nt, Human
gagucaaggaggagacagggacgcaggagggu

SEQ ID NO: 161451 - RNA, 32 nt, Human
gagucaaggauaaccugacagacucaggccac

SEQ ID NO: 161452 - RNA, 32 nt, Human
gagucaagggcucgggacuggagaagcagcca

SEQ ID NO: 161453 - RNA, 32 nt, Human
gagucaagggcucggugcggggaccagcuggg

SEQ ID NO: 161454 - RNA, 32 nt, Human
gagucaagucagcuaggaaggaagcaggacau

SEQ ID NO: 161455 - RNA, 32 nt, Human
gagucaauucuaccccugacuuuuggccaaaa

SEQ ID NO: 161456 - RNA, 32 nt, Human
gagucacacaggaaguuggcagcucugcucca

SEQ ID NO: 161457 - RNA, 32 nt, Human
gagucacaccacuggcugccagucagggccug

SEQ ID NO: 161458 - RNA, 32 nt, Human
gagucacaccuauagucccagcauuuugggaa

SEQ ID NO: 161459 - RNA, 32 nt, Human
gagucacagacacacucugccaugucuuagcu

SEQ ID NO: 161460 - RNA, 32 nt, Human
gagucacagagcaggcugggcacgguggcuca

SEQ ID NO: 161461 - RNA, 32 nt, Human
gagucacagaugggaagacagaagcgccccug

SEQ ID NO: 161462 - RNA, 32 nt, Human
gagucacagcacaagggcacucacaugcccca

SEQ ID NO: 161463 - RNA, 32 nt, Human
gagucacaguagaggccccacaaggaccugcu

SEQ ID NO: 161464 - RNA, 32 nt, Human
gagucacagugaauguggcaugcaugccugug

SEQ ID NO: 161465 - RNA, 32 nt, Human
gagucaccacgggggcucgagauagcuuccug

SEQ ID NO: 161466 - RNA, 32 nt, Human
gagucacccaggcuggagugcaguggugagau

SEQ ID NO: 161467 - RNA, 22 nt, Human
gagucaccccucugucuaacca

SEQ ID NO: 161468 - RNA, 32 nt, Human
gagucaccgugccuggccgaacuucuuuuauu

SEQ ID NO: 161469 - RNA, 32 nt, Human
gagucaccuccacauuugggcauggcaucuuc

SEQ ID NO: 161470 - RNA, 32 nt, Human
gagucacgccacugcacuccagccugggugac

SEQ ID NO: 161471 - RNA, 32 nt, Human
gagucacgcugccuccguuccuaggagagaag

SEQ ID NO: 161472 - RNA, 32 nt, Human
gagucacgcuggggcucucugagacucuuuag

SEQ ID NO: 161473 - RNA, 32 nt, Human
gagucacgugccuguggucacucgauagaaaa

SEQ ID NO: 161474 - RNA, 32 nt, Human
gagucacuauuggaggcagagaggcaugcagg

SEQ ID NO: 161475 - RNA, 32 nt, Human
gagucacucuacugcuguuuccuguguccaca

SEQ ID NO: 161476 - RNA, 32 nt, Human
gagucacucuguuccuugacugucuuuguguu

SEQ ID NO: 161477 - RNA, 32 nt, Human
gagucacugaugcugccucugccuucugaugc

SEQ ID NO: 161478 - RNA, 32 nt, Human
gagucacugcagccugugucuccuggguucaa

SEQ ID NO: 161479 - RNA, 32 nt, Human
gagucacugcgccuggcuuccucuuccucuug

SEQ ID NO: 161480 - RNA, 32 nt, Human
gagucacugcucccugcugcaaauuucuuauu

SEQ ID NO: 161481 - RNA, 32 nt, Human
gagucacugcuugugugguuccugggacacuu

SEQ ID NO: 161482 - RNA, 32 nt, Human
gagucacuggagaaaggggcugugcuggggcc

SEQ ID NO: 161483 - RNA, 32 nt, Human
gagucacugucugcccugggccucaguuuccc

SEQ ID NO: 161484 - RNA, 20 nt, Human
gagucacugugaggauucua

SEQ ID NO: 161485 - RNA, 32 nt, Human
gagucacugugccuggcucuuuuaaucuugaa

SEQ ID NO: 161486 - RNA, 32 nt, Human
gagucagaaaaauguuguuuuucaacuugcuu

SEQ ID NO: 161487 - RNA, 32 nt, Human
gagucagaacucggauucccagccucacuccc

SEQ ID NO: 161488 - RNA, 32 nt, Human
gagucagagaacacagaggugauguuugggac

SEQ ID NO: 161489 - RNA, 32 nt, Human
gagucagagaucuggccaaccuuggccgacau

SEQ ID NO: 161490 - RNA, 32 nt, Human
gagucagagaucugugcacacuuuuuaaacag

SEQ ID NO: 161491 - RNA, 32 nt, Human
gagucagagaucuugguaugggcuguucuguu

SEQ ID NO: 161492 - RNA, 32 nt, Human
gagucagagcaguucuugagguucaaggaggc

SEQ ID NO: 161493 - RNA, 32 nt, Human
gagucagagcucagcauuuaaucuccucucca

SEQ ID NO: 161494 - RNA, 32 nt, Human
gagucagagcucugcaugucugcaccaugucc

SEQ ID NO: 161495 - RNA, 32 nt, Human
gagucagcaccacccucacugugagucgucag

SEQ ID NO: 161496 - RNA, 31 nt, Human
gagucagcaggugaggagaaagacugaaaac

SEQ ID NO: 161497 - RNA, 32 nt, Human
gagucagcaggugaggagaaagacugaaaacu

SEQ ID NO: 161498 - RNA, 21 nt, Human
gagucagcagugagguccuca

SEQ ID NO: 161499 - RNA, 32 nt, Human
gagucagcaguuucagauucuuacacuccaua

SEQ ID NO: 161500 - RNA, 32 nt, Human
gagucagccaggagcugucaccaaggaaacgc

SEQ ID NO: 161501 - RNA, 32 nt, Human
gagucagccaggcguuccuccuuguccgguag

SEQ ID NO: 161502 - RNA, 21 nt, Human
gagucagcccugcaggcucag

SEQ ID NO: 161503 - RNA, 20 nt, Human
gagucagccugagacucuca

SEQ ID NO: 161504 - RNA, 32 nt, Human
gagucagcuccaggaaccaucaugaauggaca

SEQ ID NO: 161505 - RNA, 32 nt, Human
gagucagcuccgagacaccugaagagcccucc

SEQ ID NO: 161506 - RNA, 32 nt, Human
gagucagcugauuucagugcugcugaacuaau

SEQ ID NO: 161507 - RNA, 32 nt, Human
gagucagcuucaccaccucacugggucuggaa

SEQ ID NO: 161508 - RNA, 32 nt, Human
gagucaggacauugcugccucugccugggcug

SEQ ID NO: 161509 - RNA, 32 nt, Human
gagucaggacccucuccacucucccucuccac

SEQ ID NO: 161510 - RNA, 32 nt, Human
gagucaggagaaucacuugagcucaggaguuc

SEQ ID NO: 161511 - RNA, 21 nt, Human
gagucaggagaaucgcuugaa

SEQ ID NO: 161512 - RNA, 32 nt, Human
gagucaggagguugaggcugcagugagcuaug

SEQ ID NO: 161513 - RNA, 32 nt, Human
gagucaggaugcaccagcucagcaccaggaag

SEQ ID NO: 161514 - RNA, 32 nt, Human
gagucaggauuuggggccggcucucuuggguc

SEQ ID NO: 161515 - RNA, 24 nt, Human
gagucaggcauuuccgcucaggga

SEQ ID NO: 161516 - RNA, 32 nt, Human
gagucaggccagggccuuccagcugcucuugg

SEQ ID NO: 161517 - RNA, 32 nt, Human
gagucaggcugguggagggggagggagcacaa

SEQ ID NO: 161518 - RNA, 32 nt, Human
gagucaggcuguugcgcucccaccucagcccc

SEQ ID NO: 161519 - RNA, 32 nt, Human
gagucagggucugaguccucgucccaggaggc

SEQ ID NO: 161520 - RNA, 32 nt, Human
gagucaguccuaggcuggaugggaggguggcc

SEQ ID NO: 161521 - RNA, 31 nt, Human
gagucagugaacagggaaugggugaaugaca

SEQ ID NO: 161522 - RNA, 32 nt, Human
gagucagugggacucccagacacugccaccac

SEQ ID NO: 161523 - RNA, 32 nt, Human
gagucaguucucucaucagcucuccuccuagg

SEQ ID NO: 161524 - RNA, 31 nt, Human
gagucauagccaguuuggcaugcagaggucu

SEQ ID NO: 161525 - RNA, 32 nt, Human
gagucauagccuugggcaaccacacauagagg

SEQ ID NO: 161526 - RNA, 32 nt, Human
gagucauaugccacucaucagcuugggaauga

SEQ ID NO: 161527 - RNA, 32 nt, Human
gagucaucaccacucccuaaucucaaguaccc

SEQ ID NO: 161528 - RNA, 32 nt, Human
gagucaucagcaaacuguccaaguagcuaggc

SEQ ID NO: 161529 - RNA, 32 nt, Human
gagucaucagcaaacuguccaaguaggcuagg

SEQ ID NO: 161530 - RNA, 32 nt, Human
gagucaucaggagaggagaaugaggaugaggc

SEQ ID NO: 161531 - RNA, 32 nt, Human
gagucaucaucaucaucaucaucauugucguc

SEQ ID NO: 161532 - RNA, 32 nt, Human
gagucaucauuuuucuuccuguggaauaaaau

SEQ ID NO: 161533 - RNA, 32 nt, Human
gagucauccacaggaccccgugggugugcuga

SEQ ID NO: 161534 - RNA, 32 nt, Human
gagucauccagaauguauagacaggaaaagca

SEQ ID NO: 161535 - RNA, 32 nt, Human
gagucaucucauuccccuccguggaucagagg

SEQ ID NO: 161536 - RNA, 32 nt, Human
gagucaucucuaguuccccaccucaaucccgg

SEQ ID NO: 161537 - RNA, 32 nt, Human
gagucaucucugagagcaaauguauguuccug

SEQ ID NO: 161538 - RNA, 32 nt, Human
gagucaugagcgccaaguuucccacuggcgcg

SEQ ID NO: 161539 - RNA, 24 nt, Human
gagucaugauagcaccacugcacu

SEQ ID NO: 161540 - RNA, 24 nt, Human
gagucaugaucacgccacugcgcu

SEQ ID NO: 161541 - RNA, 24 nt, Human
gagucaugauugcgccacugcacu

SEQ ID NO: 161542 - RNA, 32 nt, Human
gagucauggcugcaggccagggagaugccuga

SEQ ID NO: 161543 - RNA, 30 nt, Human
gagucauguucccagccgccccuucuccgc

SEQ ID NO: 161544 - RNA, 25 nt, Human
gagucauuaccuucuuggugaccuc

SEQ ID NO: 161545 - RNA, 32 nt, Human
gagucauucacaggcaggagggagacugauca

SEQ ID NO: 161546 - RNA, 32 nt, Human
gagucauucuuuccucauuccugugaccaucu

SEQ ID NO: 161547 - RNA, 20 nt, Human
gagucauuguguauauucca

SEQ ID NO: 161548 - RNA, 32 nt, Human
gagucauuuuuaccacacaguccaguuugcau

SEQ ID NO: 161549 - RNA, 32 nt, Human
gaguccaaaccaacggcucuuuucagggccac

SEQ ID NO: 161550 - RNA, 22 nt, Human
gaguccaaggcgggcggaucac

SEQ ID NO: 161551 - RNA, 32 nt, Human
gaguccaaggugggcggaucaccugaggucgg

SEQ ID NO: 161552 - RNA, 32 nt, Human
gaguccaagguggguggaucaccugaggucag

SEQ ID NO: 161553 - RNA, 19 nt, Human
gaguccaagguuacaguga

SEQ ID NO: 161554 - RNA, 32 nt, Human
gaguccaauaaaaucgcugccucccagcuguu

SEQ ID NO: 161555 - RNA, 32 nt, Human
gaguccaccagccugccccauggccccggcuc

SEQ ID NO: 161556 - RNA, 18 nt, Human
gaguccacccuuugugca

SEQ ID NO: 161557 - RNA, 32 nt, Human
gaguccacgaguuuaagaccagccugggcaac

SEQ ID NO: 161558 - RNA, 32 nt, Human
gaguccacgcugacauacagaaugacgaaaag

SEQ ID NO: 161559 - RNA, 32 nt, Human
gaguccacggaggauccucagagccagcgggg

SEQ ID NO: 161560 - RNA, 32 nt, Human
gaguccacgggccaaugcugagcugcucaggc

SEQ ID NO: 161561 - RNA, 32 nt, Human
gaguccacuauugacauggaaaccccagugga

SEQ ID NO: 161562 - RNA, 32 nt, Human
gaguccagaaaguggcaguugcagugagugga

SEQ ID NO: 161563 - RNA, 31 nt, Human
gaguccagaagacugccucaguggcucauac

SEQ ID NO: 161564 - RNA, 32 nt, Human
gaguccagaaguuugagaucagccugggcaau

SEQ ID NO: 161565 - RNA, 32 nt, Human
gaguccagagcccaccuccucaguuccugugg

SEQ ID NO: 161566 - RNA, 32 nt, Human
gaguccagaugcagcuugucaccaucugcauu

SEQ ID NO: 161567 - RNA, 32 nt, Human
gaguccagccaucuugguucugaaucauaacc

SEQ ID NO: 161568 - RNA, 32 nt, Human
gaguccagccuggacgauauagccagacccug

SEQ ID NO: 161569 - RNA, 32 nt, Human
gaguccagccugggcaaaauagcgagagaccc

SEQ ID NO: 161570 - RNA, 32 nt, Human
gaguccagccugggcagcauagugugagaccc

SEQ ID NO: 161571 - RNA, 32 nt, Human
gaguccagccugggcaguauagcaagacccuc

SEQ ID NO: 161572 - RNA, 32 nt, Human
gaguccagccugggugacagagugagacccua

SEQ ID NO: 161573 - RNA, 32 nt, Human
gaguccagccugggugacauagcaagacccug

SEQ ID NO: 161574 - RNA, 20 nt, Human
gaguccagcugcagcaucca

SEQ ID NO: 161575 - RNA, 32 nt, Human
gaguccagcuuaaugcaggcagccuggcuuuu

SEQ ID NO: 161576 - RNA, 32 nt, Human
gaguccagcuuuccuucugcccuuccuccagg

SEQ ID NO: 161577 - RNA, 23 nt, Human
gaguccaggaaggggcggggaga

SEQ ID NO: 161578 - RNA, 32 nt, Human
gaguccaggaauuagagguugcagugagguau

SEQ ID NO: 161579 - RNA, 32 nt, Human
gaguccaggaauuugagaccagccuggacaac

SEQ ID NO: 161580 - RNA, 32 nt, Human
gaguccaggaauuugagaccagccuggccaau

SEQ ID NO: 161581 - RNA, 32 nt, Human
gaguccaggacauaugguaauacuagaccaaa

SEQ ID NO: 161582 - RNA, 32 nt, Human
gaguccaggaccuuagacccaggaugagcaaa

SEQ ID NO: 161583 - RNA, 32 nt, Human
gaguccaggagaaggugcugcucuccuugcuu

SEQ ID NO: 161584 - RNA, 32 nt, Human
gaguccaggagaccagccugggcaacauagca

SEQ ID NO: 161585 - RNA, 32 nt, Human
gaguccaggaggcggaggcugcagugagcugu

SEQ ID NO: 161586 - RNA, 32 nt, Human
gaguccaggaggucgaggcugcagugagccaa

SEQ ID NO: 161587 - RNA, 32 nt, Human
gaguccaggagguugaggcugcagugagcugu

SEQ ID NO: 161588 - RNA, 32 nt, Human
gaguccaggaguucaaggccagccugggcaac

SEQ ID NO: 161589 - RNA, 32 nt, Human
gaguccaggaguucaaggcugcagugaguugu

SEQ ID NO: 161590 - RNA, 32 nt, Human
gaguccaggaguuuaagaccagccuggacaac

SEQ ID NO: 161591 - RNA, 32 nt, Human
gaguccaggaguuugagaccagccuggacaac

SEQ ID NO: 161592 - RNA, 32 nt, Human
gaguccaggaguuugagaccagccugggcaac

SEQ ID NO: 161593 - RNA, 32 nt, Human
gaguccaggauucagaucugguuucagaaucg

SEQ ID NO: 161594 - RNA, 32 nt, Human
gaguccagggagaggcaagauugagcaauagu

SEQ ID NO: 161595 - RNA, 32 nt, Human
gaguccagggagaucccaaaaauaaggcaaag

SEQ ID NO: 161596 - RNA, 32 nt, Human
gaguccauacagccaagacaauccucagcaga

SEQ ID NO: 161597 - RNA, 32 nt, Human
gaguccauccuucccagguucuccccugggag

SEQ ID NO: 161598 - RNA, 32 nt, Human
gaguccauggugcuaggaggaggaguugcauc

SEQ ID NO: 161599 - RNA, 32 nt, Human
gaguccauguguuuagaagcaggccacacagc

SEQ ID NO: 161600 - RNA, 32 nt, Human
gaguccauuacuuccuuucuuccuucauauuu

SEQ ID NO: 161601 - RNA, 32 nt, Human
gagucccaaaacugaagaacugggaguccgau

SEQ ID NO: 161602 - RNA, 32 nt, Human
gagucccaaccaccgaaacaccaccauccugu

SEQ ID NO: 161603 - RNA, 32 nt, Human
gagucccagaauuugaggccagccugggcaac

SEQ ID NO: 161604 - RNA, 32 nt, Human
gagucccagcaccuccugaugucuggcuccau

SEQ ID NO: 161605 - RNA, 32 nt, Human
gagucccagcgacuugggaggcugagguggga

SEQ ID NO: 161606 - RNA, 32 nt, Human
gagucccagcuacucaggaggcugagguggga

SEQ ID NO: 161607 - RNA, 32 nt, Human
gagucccagcuacuccggaggcugagggagga

SEQ ID NO: 161608 - RNA, 32 nt, Human
gagucccagcuacucgggaggcugaggcacaa

SEQ ID NO: 161609 - RNA, 32 nt, Human
gagucccagcuacucgggaggcugaggcagga

SEQ ID NO: 161610 - RNA, 32 nt, Human
gagucccaggaacucggagacuggcacagcug

SEQ ID NO: 161611 - RNA, 32 nt, Human
gagucccaggauccagauuuagccucagaucu

SEQ ID NO: 161612 - RNA, 32 nt, Human
gagucccagguaagcugcguucccugggcuga

SEQ ID NO: 161613 - RNA, 32 nt, Human
gagucccaguuacaucaaacagugacuuccag

SEQ ID NO: 161614 - RNA, 32 nt, Human
gagucccauauguaaucaagagaccuggaggg

SEQ ID NO: 161615 - RNA, 32 nt, Human
gagucccaucccauccucugcccucuguuggc

SEQ ID NO: 161616 - RNA, 32 nt, Human
gagucccaugacuguuucucuuccucucuuuc

SEQ ID NO: 161617 - RNA, 32 nt, Human
gaguccccagaaccagcugcagauggagguuu

SEQ ID NO: 161618 - RNA, 32 nt, Human
gaguccccagcaccugcuacagugagcugcca

SEQ ID NO: 161619 - RNA, 32 nt, Human
gaguccccagcaggaaggucucaccugaggug

SEQ ID NO: 161620 - RNA, 22 nt, Human
gaguccccgcacccuaaccacu

SEQ ID NO: 161621 - RNA, 20 nt, Human
gaguccccgcgucccugccc

SEQ ID NO: 161622 - RNA, 32 nt, Human
gaguccccguucacacugaggaacggagaccu

SEQ ID NO: 161623 - RNA, 32 nt, Human
gaguccccuccagaccuggcuggccccugcag

SEQ ID NO: 161624 - RNA, 25 nt, Human
gagucccggggcggugccugucuca

SEQ ID NO: 161625 - RNA, 25 nt, Human
gagucccucccugcuucccaaaagc

SEQ ID NO: 161626 - RNA, 32 nt, Human
gagucccugagcccaccucccagcccucuccu

SEQ ID NO: 161627 - RNA, 32 nt, Human
gagucccugcagccacucaugcgggcccagag

SEQ ID NO: 161628 - RNA, 32 nt, Human
gagucccugcagcucagcacccccagccuggu

SEQ ID NO: 161629 - RNA, 32 nt, Human
gagucccugccaucauguuuacagaggacagu

SEQ ID NO: 161630 - RNA, 32 nt, Human
gagucccugcuguaacuggcccuguccaggga

SEQ ID NO: 161631 - RNA, 32 nt, Human
gagucccuggagcagggguuuggggcugcgcc

SEQ ID NO: 161632 - RNA, 20 nt, Human
gagucccuggagggaacauu

SEQ ID NO: 161633 - RNA, 32 nt, Human
gagucccugggcuggggaagacagauccacca

SEQ ID NO: 161634 - RNA, 32 nt, Human
gagucccuuuccacauuguggaagcuuuguuc

SEQ ID NO: 161635 - RNA, 32 nt, Human
gagucccuuuuguggagaaagggagaugaaaa

SEQ ID NO: 161636 - RNA, 32 nt, Human
gaguccgagcccugcuccuugugggcgcucac

SEQ ID NO: 161637 - RNA, 22 nt, Human
gaguccgaggcagguggaucac

SEQ ID NO: 161638 - RNA, 32 nt, Human
gaguccgaggcagguggaucaccugaggucag

SEQ ID NO: 161639 - RNA, 32 nt, Human
gaguccgaggcaugcggaucacuugaggucag

SEQ ID NO: 161640 - RNA, 32 nt, Human
gaguccgagguggguggaucaccugaggccag

SEQ ID NO: 161641 - RNA, 32 nt, Human
gaguccgagguggguggaucaccugagguugg

SEQ ID NO: 161642 - RNA, 32 nt, Human
gaguccgcagaggccguaucacccucuucacc

SEQ ID NO: 161643 - RNA, 32 nt, Human
gaguccgcgauggagaaaacuuuagaaacugu

SEQ ID NO: 161644 - RNA, 32 nt, Human
gaguccgcugguagugggcugcauggugugac

SEQ ID NO: 161645 - RNA, 32 nt, Human
gaguccggagcaugguccugggucaccguugg

SEQ ID NO: 161646 - RNA, 32 nt, Human
gaguccggauuucuaacagucccugcuuuggg

SEQ ID NO: 161647 - RNA, 32 nt, Human
gaguccggccccaggccagggacuaaggagca

SEQ ID NO: 161648 - RNA, 32 nt, Human
gaguccgggaagggagacgagcgucugaagac

SEQ ID NO: 161649 - RNA, 32 nt, Human
gaguccgggaguucagaaccagccuggacaac

SEQ ID NO: 161650 - RNA, 32 nt, Human
gaguccgggaguuugagucugcagugagcuau

SEQ ID NO: 161651 - RNA, 32 nt, Human
gaguccgguggcccaaucgcuguuacuacuuc

SEQ ID NO: 161652 - RNA, 32 nt, Human
gaguccguccccggugcugccugcgcguucac

SEQ ID NO: 161653 - RNA, 32 nt, Human
gaguccgucucauucuggcuggucgagugacc

SEQ ID NO: 161654 - RNA, 32 nt, Human
gaguccgucuguccuauccagcacuacccuuc

SEQ ID NO: 161655 - RNA, 32 nt, Human
gaguccguucaugucaugugguuugggaugaa

SEQ ID NO: 161656 - RNA, 32 nt, Human
gaguccuagagaggcagacaauguugaugagc

SEQ ID NO: 161657 - RNA, 32 nt, Human
gaguccuagccccaaaugugacuuuauuugga

SEQ ID NO: 161658 - RNA, 32 nt, Human
gaguccuaggcucccauuccugcuccauuacc

SEQ ID NO: 161659 - RNA, 26 nt, Human
gaguccucaucaucccccuccugccc

SEQ ID NO: 161660 - RNA, 21 nt, Human
gaguccuccgacuccugccca

SEQ ID NO: 161661 - RNA, 22 nt, Human
gaguccuccggaccccugccca

SEQ ID NO: 161662 - RNA, 23 nt, Human
gaguccucgagucgcccugccca

SEQ ID NO: 161663 - RNA, 22 nt, Human
gaguccucgcugcucaugccca

SEQ ID NO: 161664 - RNA, 20 nt, Human
gaguccucgcuguccccgcc

SEQ ID NO: 161665 - RNA, 27 nt, Human
gaguccucggccagcccugccugccca

SEQ ID NO: 161666 - RNA, 32 nt, Human
gaguccucuccucugcaauguguuauucuuuc

SEQ ID NO: 161667 - RNA, 32 nt, Human
gaguccucucugucacacaugaagccagguga

SEQ ID NO: 161668 - RNA, 22 nt, Human
gaguccucugacguccugccca

SEQ ID NO: 161669 - RNA, 22 nt, Human
gaguccucugacuuccugccca

SEQ ID NO: 161670 - RNA, 32 nt, Human
gaguccucugauggaaauguagucccuggauu

SEQ ID NO: 161671 - RNA, 32 nt, Human
gaguccucugcucuccagaggaccaagaaaua

SEQ ID NO: 161672 - RNA, 32 nt, Human
gaguccucuguggucccugcugccaccauggc

SEQ ID NO: 161673 - RNA, 32 nt, Human
gaguccugaacaucccuccuuucaggcugcag

SEQ ID NO: 161674 - RNA, 32 nt, Human
gaguccugagacacuuagcuucccucucccuc

SEQ ID NO: 161675 - RNA, 32 nt, Human
gaguccugagagcagcgcagaggcuuuggagg

SEQ ID NO: 161676 - RNA, 32 nt, Human
gaguccugauugccugauucagucccaaaaau

SEQ ID NO: 161677 - RNA, 32 nt, Human
gaguccugcagaguccuuccagccuaggccug

SEQ ID NO: 161678 - RNA, 32 nt, Human
gaguccuggaagagagagaugagccagggcag

SEQ ID NO: 161679 - RNA, 23 nt, Human
gaguccuggaccuccuaaccacu

SEQ ID NO: 161680 - RNA, 32 nt, Human
gaguccuggaguuaagggaugaaggcaaggcu

SEQ ID NO: 161681 - RNA, 32 nt, Human
gaguccuggaguuugagaucagccugggcaac

SEQ ID NO: 161682 - RNA, 32 nt, Human
gaguccuggcucccucacuccuggguuccagg

SEQ ID NO: 161683 - RNA, 32 nt, Human
gaguccuggcuugggagggaaggucugaguuc

SEQ ID NO: 161684 - RNA, 32 nt, Human
gaguccugggaggccggugguaaucauguagg

SEQ ID NO: 161685 - RNA, 32 nt, Human
gaguccuggggucuccgcaaggccucagugcc

SEQ ID NO: 161686 - RNA, 32 nt, Human
gaguccuggguggagaaagaagagaagcagaa

SEQ ID NO: 161687 - RNA, 32 nt, Human
gaguccugguuucccuguucaccagcuggaug

SEQ ID NO: 161688 - RNA, 32 nt, Human
gaguccuguaguaguuucaguguuagauacag

SEQ ID NO: 161689 - RNA, 32 nt, Human
gaguccugucccucaccuccuucaccaguguc

SEQ ID NO: 161690 - RNA, 24 nt, Human
gaguccuuaccgccucccuaccca

SEQ ID NO: 161691 - RNA, 32 nt, Human
gaguccuuccgccuggggcccugccgaccccc

SEQ ID NO: 161692 - RNA, 21 nt, Human
gaguccuuccuccuccaccca

SEQ ID NO: 161693 - RNA, 32 nt, Human
gaguccuuccuccuccacccagaccucacugc

SEQ ID NO: 161694 - RNA, 32 nt, Human
gaguccuugaaaccagcccuccgaacauaaau

SEQ ID NO: 161695 - RNA, 19 nt, Human
gaguccuugcaggaccuca

SEQ ID NO: 161696 - RNA, 32 nt, Human
gaguccuugcccaggcuggagugcaguggcgc

SEQ ID NO: 161697 - RNA, 32 nt, Human
gaguccuuggacucccccugggucucccuccg

SEQ ID NO: 161698 - RNA, 32 nt, Human
gagucgaccagaggcaucgcgccagccagcuc

SEQ ID NO: 161699 - RNA, 32 nt, Human
gagucgagaucauugcacuccagccugggcaa

SEQ ID NO: 161700 - RNA, 32 nt, Human
gagucgagauugcaccacuacacuccagccug

SEQ ID NO: 161701 - RNA, 22 nt, Human
gagucgauacugugaguuucca

SEQ ID NO: 161702 - RNA, 32 nt, Human
gagucgaugccuuucuaaggguuggagcugcu

SEQ ID NO: 161703 - RNA, 32 nt, Human
gagucgcaggccgaggagacagugagugcgcg

SEQ ID NO: 161704 - RNA, 32 nt, Human
gagucgcccaggcuggagagcgguggcgcgau

SEQ ID NO: 161705 - RNA, 32 nt, Human
gagucgcccgggagcaggugcugcagccagag

SEQ ID NO: 161706 - RNA, 32 nt, Human
gagucgcgaggccggacgcagcgcggcgccgc

SEQ ID NO: 161707 - RNA, 32 nt, Human
gagucgcugcuggccucaggcauuugaauuag

SEQ ID NO: 161708 - RNA, 32 nt, Human
gagucggaaagagaagcuaaaguucuacagug

SEQ ID NO: 161709 - RNA, 32 nt, Human
gagucggauucccuccugccugcacgccuuca

SEQ ID NO: 161710 - RNA, 32 nt, Human
gagucggcacaaugaggaccaggcuugcugug

SEQ ID NO: 161711 - RNA, 32 nt, Human
gagucggcagccgccuacaccaaggcaacagc

SEQ ID NO: 161712 - RNA, 32 nt, Human
gagucgggaggccugaguguuccuuccagcau

SEQ ID NO: 161713 - RNA, 32 nt, Human
gagucgggguggcggccaggaggaaaggcaga

SEQ ID NO: 161714 - RNA, 22 nt, Human
gagucgggguuucaccauguug

SEQ ID NO: 161715 - RNA, 32 nt, Human
gagucggucccugcuccugugaggcucucacc

SEQ ID NO: 161716 - RNA, 32 nt, Human
gagucguauucaaccacugucugccaucacug

SEQ ID NO: 161717 - RNA, 32 nt, Human
gagucgucacccuuggauuuuauggaucacgg

SEQ ID NO: 161718 - RNA, 24 nt, Human
gagucgugauugugccacugcacu

SEQ ID NO: 161719 - RNA, 22 nt, Human
gagucgugauuuuuacuuugaa

SEQ ID NO: 161720 - RNA, 22 nt, Human
gagucgugguuucuugccuuga

SEQ ID NO: 161721 - RNA, 32 nt, Human
gagucgugugcgugccuuggucgcuucuguag

SEQ ID NO: 161722 - RNA, 32 nt, Human
gagucguucccucuguuucuguccucagauga

SEQ ID NO: 161723 - RNA, 32 nt, Human
gagucuaaauccaaggaacugucugucucaaa

SEQ ID NO: 161724 - RNA, 32 nt, Human
gagucuaagaguuugagaccagccugggcaac

SEQ ID NO: 161725 - RNA, 32 nt, Human
gagucuaaggagaccuggcagccugagauacc

SEQ ID NO: 161726 - RNA, 32 nt, Human
gagucuaauagacuguuuugcaauaauuagaa

SEQ ID NO: 161727 - RNA, 32 nt, Human
gagucuacagcaguaucucugccugguguccc

SEQ ID NO: 161728 - RNA, 32 nt, Human
gagucuacaggcacaacugcugccucacaaca

SEQ ID NO: 161729 - RNA, 32 nt, Human
gagucuagagcugacaggccuuagagagggaa

SEQ ID NO: 161730 - RNA, 32 nt, Human
gagucuagccugggaaacauagcaagacccug

SEQ ID NO: 161731 - RNA, 32 nt, Human
gagucuagcuuuccuguacuagaugguguucu

SEQ ID NO: 161732 - RNA, 32 nt, Human
gagucuaggcuguuuuccucagcacugacugc

SEQ ID NO: 161733 - RNA, 32 nt, Human
gagucuagggcuggggcuacauuuggcuucug

SEQ ID NO: 161734 - RNA, 32 nt, Human
gagucuaggugcagcagcuccaagcaugggac

SEQ ID NO: 161735 - RNA, 22 nt, Human
gagucuagugcagacccgugau

SEQ ID NO: 161736 - RNA, 32 nt, Human
gagucucaacucacucuagccugggugacaga

SEQ ID NO: 161737 - RNA, 32 nt, Human
gagucucacucucgucgcccaggcuggaaugc

SEQ ID NO: 161738 - RNA, 32 nt, Human
gagucucacucugucacccagacuggagugca

SEQ ID NO: 161739 - RNA, 32 nt, Human
gagucucacucugucucccaggcuggagugca

SEQ ID NO: 161740 - RNA, 32 nt, Human
gagucucacucugucucccaggcuggagugug

SEQ ID NO: 161741 - RNA, 32 nt, Human
gagucucacucugucucccaggcuggaguugc

SEQ ID NO: 161742 - RNA, 32 nt, Human
gagucucacugggcugguugugcugcaggcuc

SEQ ID NO: 161743 - RNA, 32 nt, Human
gagucucacuuuccuccucugugaaauggggg

SEQ ID NO: 161744 - RNA, 32 nt, Human
gagucucagaagaccugugcaggcuggcguga

SEQ ID NO: 161745 - RNA, 32 nt, Human
gagucucagccgcgcaccccuuccucgcguua

SEQ ID NO: 161746 - RNA, 32 nt, Human
gagucucaggucagcuggaugaugccacaagg

SEQ ID NO: 161747 - RNA, 32 nt, Human
gagucucagucgcccaggcuggagugcagcag

SEQ ID NO: 161748 - RNA, 32 nt, Human
gagucuccagccugugcagaaggggcaggacu

SEQ ID NO: 161749 - RNA, 32 nt, Human
gagucucccguugagccugcagaaggagcaug

SEQ ID NO: 161750 - RNA, 32 nt, Human
gagucucccucucagcccuggagguucacggc

SEQ ID NO: 161751 - RNA, 32 nt, Human
gagucucccuuggaauucauccugcuccuucu

SEQ ID NO: 161752 - RNA, 32 nt, Human
gagucuccucuugccucuaccuacuccgccuu

SEQ ID NO: 161753 - RNA, 32 nt, Human
gagucuccugcacugugucucccacacugaga

SEQ ID NO: 161754 - RNA, 32 nt, Human
gagucucgcucucuggagugcaauggcgcaau

SEQ ID NO: 161755 - RNA, 32 nt, Human
gagucucgcucugcacuccagccuggcgacug

SEQ ID NO: 161756 - RNA, 32 nt, Human
gagucucgcucugucucccaggcuagaguacc

SEQ ID NO: 161757 - RNA, 20 nt, Human
gagucucggcauagucccca

SEQ ID NO: 161758 - RNA, 32 nt, Human
gagucucggcuggagugcaguggugcaguggu

SEQ ID NO: 161759 - RNA, 32 nt, Human
gagucucucccaguagaaugcagccucccuuc

SEQ ID NO: 161760 - RNA, 32 nt, Human
gagucucuccuuuucagacauccugggaugaa

SEQ ID NO: 161761 - RNA, 21 nt, Human
gagucucucucuuccugccca

SEQ ID NO: 161762 - RNA, 32 nt, Human
gagucucucugcacuccagccugggugacaga

SEQ ID NO: 161763 - RNA, 20 nt, Human
gagucucucugccucaacca

SEQ ID NO: 161764 - RNA, 32 nt, Human
gagucucucuuccuccucagcgaaccacuagg

SEQ ID NO: 161765 - RNA, 32 nt, Human
gagucucucuuuccuuccuccucgaucuuuag

SEQ ID NO: 161766 - RNA, 32 nt, Human
gagucucugcauagauacaaaauauuauuaaa

SEQ ID NO: 161767 - RNA, 32 nt, Human
gagucucuggcgucccaaauugccuguuuuuc

SEQ ID NO: 161768 - RNA, 32 nt, Human
gagucucugguagccugcagaaguaagccuca

SEQ ID NO: 161769 - RNA, 32 nt, Human
gagucucugucacccaggcuggagugcaaugg

SEQ ID NO: 161770 - RNA, 32 nt, Human
gagucucuguugcccaggcugcagugcagugg

SEQ ID NO: 161771 - RNA, 32 nt, Human
gagucucuguugcccaggcuggagugcagugg

SEQ ID NO: 161772 - RNA, 32 nt, Human
gagucugaaaccauuccauuucauuuugguga

SEQ ID NO: 161773 - RNA, 32 nt, Human
gagucugaaauccuguuuaguccucugugcau

SEQ ID NO: 161774 - RNA, 32 nt, Human
gagucugagacaggcagaucaccugaggucac

SEQ ID NO: 161775 - RNA, 32 nt, Human
gagucugagcuaugaguggccccuguggagag

SEQ ID NO: 161776 - RNA, 32 nt, Human
gagucugaggcaccagggugugcucaaaggcu

SEQ ID NO: 161777 - RNA, 32 nt, Human
gagucugaggcagaggauggcaugugccagga

SEQ ID NO: 161778 - RNA, 32 nt, Human
gagucugaggcugauuccaguagaauuagcag

SEQ ID NO: 161779 - RNA, 32 nt, Human
gagucugaggcugcgguaagcuguguucgcac

SEQ ID NO: 161780 - RNA, 32 nt, Human
gagucugagggaggggagugggagucucagca

SEQ ID NO: 161781 - RNA, 32 nt, Human
gagucugagucccagcccugagcacuuaggag

SEQ ID NO: 161782 - RNA, 32 nt, Human
gagucugauguccaagggcaggaagcauccag

SEQ ID NO: 161783 - RNA, 32 nt, Human
gagucugcagugagccaagaucgcggcauugc

SEQ ID NO: 161784 - RNA, 32 nt, Human
gagucugcagugagccgagaucaugccacugc

SEQ ID NO: 161785 - RNA, 32 nt, Human
gagucugcagugagcuaugaucaugccacugc

SEQ ID NO: 161786 - RNA, 32 nt, Human
gagucugcagugagcuaugaucgcaccacugc

SEQ ID NO: 161787 - RNA, 32 nt, Human
gagucugccacauugcuuuaaggagcgcagaa

SEQ ID NO: 161788 - RNA, 32 nt, Human
gagucugccacccaggcuggaguccaguggcg

SEQ ID NO: 161789 - RNA, 32 nt, Human
gagucugccccagggagaaagaauccugcuuc

SEQ ID NO: 161790 - RNA, 32 nt, Human
gagucugcguaacagucucccacuggcuggcu

SEQ ID NO: 161791 - RNA, 32 nt, Human
gagucugcguguguuagcaugccuguauguga

SEQ ID NO: 161792 - RNA, 32 nt, Human
gagucugcucucauccuaucagaaagaggcuu

SEQ ID NO: 161793 - RNA, 32 nt, Human
gagucugcugggauuccacugucauggacaac

SEQ ID NO: 161794 - RNA, 32 nt, Human
gagucuggaaugucugccugugccucagcugu

SEQ ID NO: 161795 - RNA, 32 nt, Human
gagucuggacucaggucagcagagggaagcgu

SEQ ID NO: 161796 - RNA, 32 nt, Human
gagucuggagugaaccacggguugaggaaguc

SEQ ID NO: 161797 - RNA, 22 nt, Human
gagucuggccuuuccaaucccc

SEQ ID NO: 161798 - RNA, 22 nt, Human
gagucuggcucagcagcccccu

SEQ ID NO: 161799 - RNA, 32 nt, Human
gagucuggcucugucucccaggcuggagugca

SEQ ID NO: 161800 - RNA, 21 nt, Human
gagucugggaaauacuaguuu

SEQ ID NO: 161801 - RNA, 32 nt, Human
gagucugggaacaaagagaggagccagccucc

SEQ ID NO: 161802 - RNA, 32 nt, Human
gagucugggaccccuccugggauccccagcac

SEQ ID NO: 161803 - RNA, 32 nt, Human
gagucugggacugcccuggccuaagaugggcc

SEQ ID NO: 161804 - RNA, 32 nt, Human
gagucugggaggcagguuuccaagagcaggga

SEQ ID NO: 161805 - RNA, 32 nt, Human
gagucugggaggcggagguugcagugagcuga

SEQ ID NO: 161806 - RNA, 32 nt, Human
gagucugggagguggaggcugcagugagccgu

SEQ ID NO: 161807 - RNA, 32 nt, Human
gagucugggcugagaccaguccuggccagggc

SEQ ID NO: 161808 - RNA, 32 nt, Human
gagucugggcugagaccaguccuggccagggu

SEQ ID NO: 161809 - RNA, 32 nt, Human
gagucugggugaagccagagguggcucuggga

SEQ ID NO: 161810 - RNA, 32 nt, Human
gagucugguaccuccccuccauuauagcucuc

SEQ ID NO: 161811 - RNA, 32 nt, Human
gagucugguccugccuagcucagauuucaugg

SEQ ID NO: 161812 - RNA, 32 nt, Human
gagucugguggaggagcugagggagggagcca

SEQ ID NO: 161813 - RNA, 32 nt, Human
gagucuguacucugcacuccaaugaggcuuca

SEQ ID NO: 161814 - RNA, 32 nt, Human
gagucugucccaaacaauauugagauauuugc

SEQ ID NO: 161815 - RNA, 32 nt, Human
gagucugucugagaguacaguaaauguuuuua

SEQ ID NO: 161816 - RNA, 32 nt, Human
gagucugugacuacaggcaaaucacgccaccu

SEQ ID NO: 161817 - RNA, 31 nt, Human
gagucugugguuuuaagacaugcaugauuuc

SEQ ID NO: 161818 - RNA, 32 nt, Human
gagucuguuaguaaaaauggcacuuugauucc

SEQ ID NO: 161819 - RNA, 32 nt, Human
gagucuguucacagccaaaauucuucccacug

SEQ ID NO: 161820 - RNA, 20 nt, Human
gagucuguuguguggaugug

SEQ ID NO: 161821 - RNA, 32 nt, Human
gagucuguuuuccucucuggaccucagucuuc

SEQ ID NO: 161822 - RNA, 32 nt, Human
gagucuguuuugcuccgauggaagcaucugua

SEQ ID NO: 161823 - RNA, 32 nt, Human
gagucuuaaccuuguacucagggaauuuugag

SEQ ID NO: 161824 - RNA, 32 nt, Human
gagucuuagggacuugaaaauguaucaugaua

SEQ ID NO: 161825 - RNA, 32 nt, Human
gagucuucaaagccagccugagccacauagug

SEQ ID NO: 161826 - RNA, 32 nt, Human
gagucuucaggcguggaugcagccugggggaa

SEQ ID NO: 161827 - RNA, 32 nt, Human
gagucuucagggacuccccauggccuagagua

SEQ ID NO: 161828 - RNA, 32 nt, Human
gagucuucagggacuccccauggccuggagua

SEQ ID NO: 161829 - RNA, 32 nt, Human
gagucuucuagucccaagggauugggagauga

SEQ ID NO: 161830 - RNA, 32 nt, Human
gagucuucuccucucucugaucucugugcugu

SEQ ID NO: 161831 - RNA, 32 nt, Human
gagucuugaacggggaacaugaccucggagcc

SEQ ID NO: 161832 - RNA, 32 nt, Human
gagucuugaggcccauugagugcagugugaga

SEQ ID NO: 161833 - RNA, 32 nt, Human
gagucuugcucugucucccaggcuagagugca

SEQ ID NO: 161834 - RNA, 32 nt, Human
gagucuugggauacugcuggcuuuacucuacc

SEQ ID NO: 161835 - RNA, 32 nt, Human
gagucuugggguacuggcagagcuguggcucg

SEQ ID NO: 161836 - RNA, 32 nt, Human
gagucuuuaaagaggaaggggaguggagggaa

SEQ ID NO: 161837 - RNA, 32 nt, Human
gagucuuucagcugaaaacuuuugccaugaag

SEQ ID NO: 161838 - RNA, 32 nt, Human
gagucuuucuccagcauuuccaguacaucuau

SEQ ID NO: 161839 - RNA, 32 nt, Human
gagucuuugcacauccugcucuuuccgccugg

SEQ ID NO: 161840 - RNA, 32 nt, Human
gagucuuuuaggacagauucucagaugggaug

SEQ ID NO: 161841 - RNA, 32 nt, Human
gagugaaaaugccacucuccugugccuaccaa

SEQ ID NO: 161842 - RNA, 32 nt, Human
gagugaaacagcaaaccccaaaucuucaaagu

SEQ ID NO: 161843 - RNA, 32 nt, Human
gagugaaagaggaugucuaaaaggggacagcc

SEQ ID NO: 161844 - RNA, 32 nt, Human
gagugaaaguggcgcaaccucugccucccagg

SEQ ID NO: 161845 - RNA, 32 nt, Human
gagugaacccagaggcacguaugaaugaaagu

SEQ ID NO: 161846 - RNA, 32 nt, Human
gagugaaccugaccugauagccucaggauuca

SEQ ID NO: 161847 - RNA, 32 nt, Human
gagugaagaaccuagauauaaagcuuuacaga

SEQ ID NO: 161848 - RNA, 32 nt, Human
gagugaagaagaggaggagacgccaagcagag

SEQ ID NO: 161849 - RNA, 32 nt, Human
gagugaagacaacauggggcauuuagaaaaua

SEQ ID NO: 161850 - RNA, 23 nt, Human
gagugaagaccaccuggaucucc

SEQ ID NO: 161851 - RNA, 32 nt, Human
gagugaagagaauccaggcuggcagagcugga

SEQ ID NO: 161852 - RNA, 32 nt, Human
gagugaagaggaggaggcagccuggacuccag

SEQ ID NO: 161853 - RNA, 21 nt, Human
gagugaagauaaucucuccua

SEQ ID NO: 161854 - RNA, 32 nt, Human
gagugaagcccaggccuugugcaggcagggag

SEQ ID NO: 161855 - RNA, 32 nt, Human
gagugaaggaagagagacagaggaucaagggc

SEQ ID NO: 161856 - RNA, 32 nt, Human
gagugaaggagguggcguugcugagagcaguc

SEQ ID NO: 161857 - RNA, 32 nt, Human
gagugaaggccuugaaggaugggugagaggug

SEQ ID NO: 161858 - RNA, 32 nt, Human
gagugaaguacggagccagggagggaggugag

SEQ ID NO: 161859 - RNA, 32 nt, Human
gagugaagucaugaccuccagggagccuagaa

SEQ ID NO: 161860 - RNA, 20 nt, Human
gagugaaucacuugagguca

SEQ ID NO: 161861 - RNA, 32 nt, Human
gagugaauguaguugcaccagguuaugaaaac

SEQ ID NO: 161862 - RNA, 32 nt, Human
gagugaauuaaaaugucugccucuccagacau

SEQ ID NO: 161863 - RNA, 32 nt, Human
gagugacaauccagcaagaaaucccucgcuag

SEQ ID NO: 161864 - RNA, 32 nt, Human
gagugacacugcaccuaguaggcacucaaaua

SEQ ID NO: 161865 - RNA, 32 nt, Human
gagugacagcaaccccagagaugaggcaccag

SEQ ID NO: 161866 - RNA, 32 nt, Human
gagugacagccuuuuuaugguugguguuacua

SEQ ID NO: 161867 - RNA, 32 nt, Human
gagugacaguaaccccagauggagagauaggg

SEQ ID NO: 161868 - RNA, 32 nt, Human
gagugacaguuacaguuguaacaagccuacuu

SEQ ID NO: 161869 - RNA, 32 nt, Human
gagugacauuuuaaaagacaucaaagaacucu

SEQ ID NO: 161870 - RNA, 32 nt, Human
gagugacccaucccuaagggcuucugggccaa

SEQ ID NO: 161871 - RNA, 17 nt, Human
gagugaccccugcucca

SEQ ID NO: 161872 - RNA, 32 nt, Human
gagugacccugcagagucacucagccaaaucu

SEQ ID NO: 161873 - RNA, 19 nt, Human
gagugaccucccuuugccu

SEQ ID NO: 161874 - RNA, 22 nt, Human
gagugaccuggaagaccuggag

SEQ ID NO: 161875 - RNA, 32 nt, Human
gagugaccuucuagaaaggaacugugagcucu

SEQ ID NO: 161876 - RNA, 23 nt, Human
gagugacgcgccugcacccgcug

SEQ ID NO: 161877 - RNA, 32 nt, Human
gagugacgcggcggagguguaguuugacgcgg

SEQ ID NO: 161878 - RNA, 32 nt, Human
gagugacgucucccugcugggagugcugguuc

SEQ ID NO: 161879 - RNA, 32 nt, Human
gagugacucccgcggucccaaggcuuuccaga

SEQ ID NO: 161880 - RNA, 32 nt, Human
gagugacucccguugucccaaggcuucccaga

SEQ ID NO: 161881 - RNA, 15 nt, Human
gagugacugacucca

SEQ ID NO: 161882 - RNA, 32 nt, Human
gagugacugccuggcccugcugcaacacuuag

SEQ ID NO: 161883 - RNA, 17 nt, Human
gagugacugcugcucca

SEQ ID NO: 161884 - RNA, 16 nt, Human
gagugacuggcuucca

SEQ ID NO: 161885 - RNA, 32 nt, Human
gagugacuguccaggggaaccagcagagggcg

SEQ ID NO: 161886 - RNA, 32 nt, Human
gagugacuuccucgggggauucccaggacaca

SEQ ID NO: 161887 - RNA, 32 nt, Human
gagugagaaaaggagagcaggaaaggcaaugg

SEQ ID NO: 161888 - RNA, 22 nt, Human
gagugagaaagacauggaggga

SEQ ID NO: 161889 - RNA, 32 nt, Human
gagugagaacagcauuuagugaaguugugcaa

SEQ ID NO: 161890 - RNA, 32 nt, Human
gagugagaaccuuggcggcuguggaggcugcc

SEQ ID NO: 161891 - RNA, 32 nt, Human
gagugagaagaaaagagcaccuccucauuuua

SEQ ID NO: 161892 - RNA, 32 nt, Human
gagugagaagcugaggauaaggaaagagcaag

SEQ ID NO: 161893 - RNA, 32 nt, Human
gagugagaaggugggaucuggugggaaggaaa

SEQ ID NO: 161894 - RNA, 32 nt, Human
gagugagacccugcggcagagacgacggaggc

SEQ ID NO: 161895 - RNA, 18 nt, Human
gagugagacccuguucca

SEQ ID NO: 161896 - RNA, 18 nt, Human
gagugagacucugcuuca

SEQ ID NO: 161897 - RNA, 32 nt, Human
gagugagagaagagaagaaaauuaguaaaagc

SEQ ID NO: 161898 - RNA, 32 nt, Human
gagugagagacaccagccuccacugccaggaa

SEQ ID NO: 161899 - RNA, 32 nt, Human
gagugagaggcagagcgaggacgccccucugc

SEQ ID NO: 161900 - RNA, 32 nt, Human
gagugagauuccaucugaaaaacaaaaacaaa

SEQ ID NO: 161901 - RNA, 32 nt, Human
gagugagcaagcagcacccccaccugcuggcu

SEQ ID NO: 161902 - RNA, 32 nt, Human
gagugagcaagcucuggugucucuuccucuuc

SEQ ID NO: 161903 - RNA, 32 nt, Human
gagugagcagaagaagccuggagaagagagaa

SEQ ID NO: 161904 - RNA, 31 nt, Human
gagugagcaggugaggagaaagacugaaaac

SEQ ID NO: 161905 - RNA, 32 nt, Human
gagugagcaggugaggagaaagacugaaaacu

SEQ ID NO: 161906 - RNA, 32 nt, Human
gagugagcagugaggcugucuccugcccucuu

SEQ ID NO: 161907 - RNA, 32 nt, Human
gagugagcaugcuggagaaugagagaccacau

SEQ ID NO: 161908 - RNA, 32 nt, Human
gagugagccagugccacccccugggccugagc

SEQ ID NO: 161909 - RNA, 32 nt, Human
gagugagcccauggugggcagugggcaaggcg

SEQ ID NO: 161910 - RNA, 32 nt, Human
gagugagcccuccgacccuggaggaguucaag

SEQ ID NO: 161911 - RNA, 32 nt, Human
gagugagcccugugcaugcacacacacuuacg

SEQ ID NO: 161912 - RNA, 32 nt, Human
gagugagccugggaguucgaggcugcagugag

SEQ ID NO: 161913 - RNA, 32 nt, Human
gagugagcgaugagccggcuucugucccuggc

SEQ ID NO: 161914 - RNA, 32 nt, Human
gagugagcucugcugccucuucugcugcccgc

SEQ ID NO: 161915 - RNA, 32 nt, Human
gagugagcugaccgaggcagagcgacuccaag

SEQ ID NO: 161916 - RNA, 32 nt, Human
gagugagcugccggaggauguccaccgccacg

SEQ ID NO: 161917 - RNA, 32 nt, Human
gagugagcugccugagaaaagaggguagggaa

SEQ ID NO: 161918 - RNA, 32 nt, Human
gagugagcuguugccgcagaaugggcugcugg

SEQ ID NO: 161919 - RNA, 32 nt, Human
gagugagcuuugccaaggacaucgcaucaggg

SEQ ID NO: 161920 - RNA, 32 nt, Human
gagugaggaagagcagaguauguggauacccg

SEQ ID NO: 161921 - RNA, 32 nt, Human
gagugaggaagugggauggggccugaccggaa

SEQ ID NO: 161922 - RNA, 32 nt, Human
gagugaggaaugugggagagaggcagaaaaag

SEQ ID NO: 161923 - RNA, 32 nt, Human
gagugaggacgcagggguaugaggcagggaga

SEQ ID NO: 161924 - RNA, 32 nt, Human
gagugaggacuucugcagcuuaucuucuggug

SEQ ID NO: 161925 - RNA, 32 nt, Human
gagugaggagaggaggagagaggcuugucaaa

SEQ ID NO: 161926 - RNA, 22 nt, Human
gagugaggaggaggagcuggaa

SEQ ID NO: 161927 - RNA, 23 nt, Human
gagugaggagggagaacuuggaa

SEQ ID NO: 161928 - RNA, 32 nt, Human
gagugaggcagugggagaagaggugguggucg

SEQ ID NO: 161929 - RNA, 32 nt, Human
gagugaggccaggagugggauucagcugcagc

SEQ ID NO: 161930 - RNA, 32 nt, Human
gagugaggccgaggccgggaggccgugcccgg

SEQ ID NO: 161931 - RNA, 32 nt, Human
gagugaggcggcggaggagccaggugaggagg

SEQ ID NO: 161932 - RNA, 32 nt, Human
gagugaggcugacagcggggaaccugggagac

SEQ ID NO: 161933 - RNA, 32 nt, Human
gagugaggcugcugccugcgcccugcucccac

SEQ ID NO: 161934 - RNA, 32 nt, Human
gagugaggcuggggcguccagguccgagaggu

SEQ ID NO: 161935 - RNA, 32 nt, Human
gagugagggaagggacagggaggggaagcccu

SEQ ID NO: 161936 - RNA, 32 nt, Human
gagugagggaguagauaaaacagcugcaauau

SEQ ID NO: 161937 - RNA, 32 nt, Human
gagugagggcuguggcccugccucacacaacc

SEQ ID NO: 161938 - RNA, 32 nt, Human
gagugaggguaagggaaagaauaucuuauuuc

SEQ ID NO: 161939 - RNA, 22 nt, Human
gagugaggguuucaccauguug

SEQ ID NO: 161940 - RNA, 23 nt, Human
gagugaggguuucaccauguugg

SEQ ID NO: 161941 - RNA, 32 nt, Human
gagugaguccauccuucccagguucuccccug

SEQ ID NO: 161942 - RNA, 32 nt, Human
gagugagugagagggcagaggaaauacucaau

SEQ ID NO: 161943 - RNA, 32 nt, Human
gagugaguggagagaggagaggcaacgaaguc

SEQ ID NO: 161944 - RNA, 32 nt, Human
gagugagugugugccuggcaggaaagcaggga

SEQ ID NO: 161945 - RNA, 32 nt, Human
gagugaguuauggugcuggcuauauuuugcua

SEQ ID NO: 161946 - RNA, 32 nt, Human
gagugaguuggaguccuuucugucugucucca

SEQ ID NO: 161947 - RNA, 32 nt, Human
gagugaguuuuuagaagagaacuuuacgagcg

SEQ ID NO: 161948 - RNA, 32 nt, Human
gagugauaacaaggcuccacagagcgcaguuu

SEQ ID NO: 161949 - RNA, 32 nt, Human
gagugauaagaaguuuggcuucucccacccac

SEQ ID NO: 161950 - RNA, 32 nt, Human
gagugauagccaaacuccuuggucaccugcuc

SEQ ID NO: 161951 - RNA, 18 nt, Human
gagugauaggacauucua

SEQ ID NO: 161952 - RNA, 32 nt, Human
gagugauccugccucuggucccagcauccagc

SEQ ID NO: 161953 - RNA, 32 nt, Human
gagugaucucagcucacugcaaccucugucuc

SEQ ID NO: 161954 - RNA, 32 nt, Human
gagugaugcaauugcuggaggaagagccauga

SEQ ID NO: 161955 - RNA, 24 nt, Human
gagugaugcaccuucccgcugcug

SEQ ID NO: 161956 - RNA, 32 nt, Human
gagugauggagagagaccucucuaagaaggug

SEQ ID NO: 161957 - RNA, 29 nt, Human
gagugaugucuguguguuccuugccugcc

SEQ ID NO: 161958 - RNA, 32 nt, Human
gagugauuccaagugggaugguuguggcauua

SEQ ID NO: 161959 - RNA, 32 nt, Human
gagugauucuucagaugcccuucccaacuggu

SEQ ID NO: 161960 - RNA, 32 nt, Human
gagugauuucagcguugaacacaguauacuau

SEQ ID NO: 161961 - RNA, 32 nt, Human
gagugauuuccgauuucucuccuuucaguugu

SEQ ID NO: 161962 - RNA, 32 nt, Human
gagugauuugcaccuugcaaaaaugguccugg

SEQ ID NO: 161963 - RNA, 32 nt, Human
gagugcaaaucugccagccuaggcaacauagc

SEQ ID NO: 161964 - RNA, 32 nt, Human
gagugcaacaucacacuuggccguggcugagg

SEQ ID NO: 161965 - RNA, 19 nt, Human
gagugcaagcccugcucca

SEQ ID NO: 161966 - RNA, 32 nt, Human
gagugcaaucauggcucacugcagccuugaac

SEQ ID NO: 161967 - RNA, 32 nt, Human
gagugcaauguagucaacuccucacuuagggu

SEQ ID NO: 161968 - RNA, 32 nt, Human
gagugcacagagaccaacucccugggcuucau

SEQ ID NO: 161969 - RNA, 32 nt, Human
gagugcaccacugcacuccagccugggcaaca

SEQ ID NO: 161970 - RNA, 32 nt, Human
gagugcaccauugcacuccagccugggcaaaa

SEQ ID NO: 161971 - RNA, 32 nt, Human
gagugcaccucucuacuugggagguacaauug

SEQ ID NO: 161972 - RNA, 32 nt, Human
gagugcaccuguaaucccagcuacucuggagg

SEQ ID NO: 161973 - RNA, 32 nt, Human
gagugcacgccuguaaucccagcuucuuggga

SEQ ID NO: 161974 - RNA, 32 nt, Human
gagugcacuacuguacuccagccagggcaaga

SEQ ID NO: 161975 - RNA, 32 nt, Human
gagugcacuggcaggaagcagagauaagacuu

SEQ ID NO: 161976 - RNA, 32 nt, Human
gagugcagacugaagccagcagagaggaagga

SEQ ID NO: 161977 - RNA, 32 nt, Human
gagugcagacuucacaggugggggaagaauua

SEQ ID NO: 161978 - RNA, 18 nt, Human
gagugcagauugcucccc

SEQ ID NO: 161979 - RNA, 32 nt, Human
gagugcagcaggaaggaacaaagacaggcaaa

SEQ ID NO: 161980 - RNA, 32 nt, Human
gagugcagcgagcaaggggagagccaguugcg

SEQ ID NO: 161981 - RNA, 32 nt, Human
gagugcagcucgagagagauucagagauggaa

SEQ ID NO: 161982 - RNA, 16 nt, Human
gagugcagcucuggga

SEQ ID NO: 161983 - RNA, 32 nt, Human
gagugcaggaguuugagaccagccugggcaac

SEQ ID NO: 161984 - RNA, 32 nt, Human
gagugcagggauuacaggcgugagccacugcu

SEQ ID NO: 161985 - RNA, 32 nt, Human
gagugcaggggagggggcaaugguggaggugg

SEQ ID NO: 161986 - RNA, 32 nt, Human
gagugcagggugggggcaagacugggcuguag

SEQ ID NO: 161987 - RNA, 32 nt, Human
gagugcaggugggcauaggugcagugagugca

SEQ ID NO: 161988 - RNA, 32 nt, Human
gagugcaguccuugcucauauuuccuucaucu

SEQ ID NO: 161989 - RNA, 32 nt, Human
gagugcaguggcacagucucggcucacugcaa

SEQ ID NO: 161990 - RNA, 32 nt, Human
gagugcaguggcccaaucucggcucacugcaa

SEQ ID NO: 161991 - RNA, 32 nt, Human
gagugcaguggcgcgaucucagcugcugcaac

SEQ ID NO: 161992 - RNA, 32 nt, Human
gagugcaguggugccaucaccacggcucacug

SEQ ID NO: 161993 - RNA, 32 nt, Human
gagugcaguggugccaucauagcucacuguag

SEQ ID NO: 161994 - RNA, 32 nt, Human
gagugcaguggugccaucucggcucacugcaa

SEQ ID NO: 161995 - RNA, 32 nt, Human
gagugcaguggugccaucucggcucacugcag

SEQ ID NO: 161996 - RNA, 32 nt, Human
gagugcaguuugaacuugagauacagucaacu

SEQ ID NO: 161997 - RNA, 32 nt, Human
gagugcauauagaauuccuguacccacaugau

SEQ ID NO: 161998 - RNA, 32 nt, Human
gagugcaucugucaagucuuuguguuuucuuc

SEQ ID NO: 161999 - RNA, 32 nt, Human
gagugccacaucuggcagguuuggaaauuucc

SEQ ID NO: 162000 - RNA, 32 nt, Human
gagugccacugcaugagacaccugugaccauu

SEQ ID NO: 162001 - RNA, 32 nt, Human
gagugccagggaggaggaggcacacggagacc

SEQ ID NO: 162002 - RNA, 32 nt, Human
gagugccagguggcgggcaagcggugggcuuu

SEQ ID NO: 162003 - RNA, 32 nt, Human
gagugcccacuccccucuacuugcugcucugg

SEQ ID NO: 162004 - RNA, 32 nt, Human
gagugcccaucaaccucugcccaacacagagc

SEQ ID NO: 162005 - RNA, 32 nt, Human
gagugccccacugcacuccagccugggugaca

SEQ ID NO: 162006 - RNA, 32 nt, Human
gagugcccccucaggccagagggcagggccaa

SEQ ID NO: 162007 - RNA, 32 nt, Human
gagugcccugagcuacguggagcugcugcccc

SEQ ID NO: 162008 - RNA, 32 nt, Human
gagugcccugccccaaaacacccuaggcaaga

SEQ ID NO: 162009 - RNA, 32 nt, Human
gagugcccuuggggacacuuuuggcccaagau

SEQ ID NO: 162010 - RNA, 32 nt, Human
gagugcccuugugugcugacagccuggcugcu

SEQ ID NO: 162011 - RNA, 32 nt, Human
gagugcccuuuccuggaagguguuuuuaucug

SEQ ID NO: 162012 - RNA, 32 nt, Human
gagugcccuuucuccccgccucuucccccucc

SEQ ID NO: 162013 - RNA, 32 nt, Human
gagugccgccagaccuacugcugugcuguuuc

SEQ ID NO: 162014 - RNA, 32 nt, Human
gagugccgcccaaggucacaggcacagaaccu

SEQ ID NO: 162015 - RNA, 32 nt, Human
gagugccgucauagguguggucaucauccucu

SEQ ID NO: 162016 - RNA, 32 nt, Human
gagugccuacccucgccugccugggccucagu

SEQ ID NO: 162017 - RNA, 32 nt, Human
gagugccuacucuggcuugagcacuucuauau

SEQ ID NO: 162018 - RNA, 32 nt, Human
gagugccuccacccugauuuuugccucugcac

SEQ ID NO: 162019 - RNA, 32 nt, Human
gagugccucugagcagcucacagugugugccc

SEQ ID NO: 162020 - RNA, 19 nt, Human
gagugccugacccagguca

SEQ ID NO: 162021 - RNA, 32 nt, Human
gagugccugaggccaccaugccacagucaaag

SEQ ID NO: 162022 - RNA, 32 nt, Human
gagugccugcagucccagcuacucgggaagcu

SEQ ID NO: 162023 - RNA, 32 nt, Human
gagugccugcugcagaccgaggcugggccaag

SEQ ID NO: 162024 - RNA, 32 nt, Human
gagugccugcuguugucuuugcccauguuguu

SEQ ID NO: 162025 - RNA, 32 nt, Human
gagugccuggauuacaggcaugagccacugca

SEQ ID NO: 162026 - RNA, 32 nt, Human
gagugccuggccaggucgguccugacucuccu

SEQ ID NO: 162027 - RNA, 32 nt, Human
gagugccuggcccggagugccugcuggugugu

SEQ ID NO: 162028 - RNA, 32 nt, Human
gagugccuguaaucacagcuacuugggaggcu

SEQ ID NO: 162029 - RNA, 32 nt, Human
gagugccuguaaucccagcuacucgggaggcu

SEQ ID NO: 162030 - RNA, 32 nt, Human
gagugccuguaaucccagcuacuugggaggcu

SEQ ID NO: 162031 - RNA, 32 nt, Human
gagugccuguaaucccagcuauucgggagccu

SEQ ID NO: 162032 - RNA, 32 nt, Human
gagugccuguaaucucaguuacucaggaggcu

SEQ ID NO: 162033 - RNA, 32 nt, Human
gagugccuguaguccaagcuacucaagaggcu

SEQ ID NO: 162034 - RNA, 32 nt, Human
gagugccuguagucccagcuacucaggaggcu

SEQ ID NO: 162035 - RNA, 32 nt, Human
gagugccuguccucccugucuacccaucucug

SEQ ID NO: 162036 - RNA, 32 nt, Human
gagugccuguguagcuggggauggggauuccu

SEQ ID NO: 162037 - RNA, 32 nt, Human
gagugccuuccagagaagcaucugcagccggc

SEQ ID NO: 162038 - RNA, 32 nt, Human
gagugcgccacuucacuccagccugggcaaca

SEQ ID NO: 162039 - RNA, 32 nt, Human
gagugcgcgggcugccccgggcuccucccugc

SEQ ID NO: 162040 - RNA, 32 nt, Human
gagugcggagagaaggggcaggauggggcugg

SEQ ID NO: 162041 - RNA, 32 nt, Human
gagugcggcaggcaguaccugccugacccuuc

SEQ ID NO: 162042 - RNA, 32 nt, Human
gagugcggcaucugcaggugcaccacauugcu

SEQ ID NO: 162043 - RNA, 32 nt, Human
gagugcggcucaagccuguaaucccagcacuu

SEQ ID NO: 162044 - RNA, 32 nt, Human
gagugcggcugcugagagccgagcccagcaau

SEQ ID NO: 162045 - RNA, 32 nt, Human
gagugcggggaggaguuugagaugggaggcgc

SEQ ID NO: 162046 - RNA, 32 nt, Human
gagugcggggcccuuccuccuggggacagaaa

SEQ ID NO: 162047 - RNA, 32 nt, Human
gagugcgggggagcuguggaugguggcaggag

SEQ ID NO: 162048 - RNA, 32 nt, Human
gagugcgggggcggaggcuggcagggggcgcu

SEQ ID NO: 162049 - RNA, 32 nt, Human
gagugcguguggggaccucagaacacugugac

SEQ ID NO: 162050 - RNA, 32 nt, Human
gagugcuaaucagcucaauggacccucugccu

SEQ ID NO: 162051 - RNA, 32 nt, Human
gagugcuagaagcaaagaaccaucaagucuag

SEQ ID NO: 162052 - RNA, 15 nt, Human
gagugcuagaagcca

SEQ ID NO: 162053 - RNA, 32 nt, Human
gagugcuaggaaaugaguccccugggaaaggg

SEQ ID NO: 162054 - RNA, 32 nt, Human
gagugcuaggauuacaggcaugagccacugca

SEQ ID NO: 162055 - RNA, 32 nt, Human
gagugcucagauagcccgcagaacaaaucaug

SEQ ID NO: 162056 - RNA, 32 nt, Human
gagugcucagucccuuggcacacugcuugcuc

SEQ ID NO: 162057 - RNA, 32 nt, Human
gagugcucugcacccuugggcuuuucaacucu

SEQ ID NO: 162058 - RNA, 32 nt, Human
gagugcucuguggacccacagccucagcugag

SEQ ID NO: 162059 - RNA, 32 nt, Human
gagugcucuguucaacagucugaggccucuga

SEQ ID NO: 162060 - RNA, 32 nt, Human
gagugcucuuucuucauacuuccuuuaaaaua

SEQ ID NO: 162061 - RNA, 32 nt, Human
gagugcugagagaaaggcucucugaguaggug

SEQ ID NO: 162062 - RNA, 32 nt, Human
gagugcugagauuacaggcgugagccuccgcg

SEQ ID NO: 162063 - RNA, 32 nt, Human
gagugcugagauuuacaggcgugagccaccgc

SEQ ID NO: 162064 - RNA, 32 nt, Human
gagugcugcacaucaugggcucugucugugag

SEQ ID NO: 162065 - RNA, 32 nt, Human
gagugcugcucuuuccaccugccuugcaaauu

SEQ ID NO: 162066 - RNA, 32 nt, Human
gagugcuggcucugcuauaugguacaacuaau

SEQ ID NO: 162067 - RNA, 32 nt, Human
gagugcugggaucacaggcgugagccaccgca

SEQ ID NO: 162068 - RNA, 32 nt, Human
gagugcugggauuacagacaugagccacugcg

SEQ ID NO: 162069 - RNA, 18 nt, Human
gagugcugggauuacagg

SEQ ID NO: 162070 - RNA, 32 nt, Human
gagugcugggauuacaggcaugagccacugca

SEQ ID NO: 162071 - RNA, 32 nt, Human
gagugcugggauuacaggcaugagccacugcg

SEQ ID NO: 162072 - RNA, 32 nt, Human
gagugcugggauuacaggcgucagccaccgug

SEQ ID NO: 162073 - RNA, 32 nt, Human
gagugcugggauuacaggcgugagccaccaca

SEQ ID NO: 162074 - RNA, 32 nt, Human
gagugcugggauuacaggcgugagccaccgca

SEQ ID NO: 162075 - RNA, 32 nt, Human
gagugcugggauuacaggcgugagccaccgcg

SEQ ID NO: 162076 - RNA, 32 nt, Human
gagugcugggauuacaggcgugagccacugca

SEQ ID NO: 162077 - RNA, 32 nt, Human
gagugcugggauuacaggcgugagccacugug

SEQ ID NO: 162078 - RNA, 32 nt, Human
gagugcugggauuacagggggagccacugugc

SEQ ID NO: 162079 - RNA, 20 nt, Human
gagugcugggauuacaggug

SEQ ID NO: 162080 - RNA, 32 nt, Human
gagugcugggauuacaggugugaaucaccaua

SEQ ID NO: 162081 - RNA, 32 nt, Human
gagugcugggauuacaggugugagccaccaug

SEQ ID NO: 162082 - RNA, 32 nt, Human
gagugcugggauuacaggugugagccacugcg

SEQ ID NO: 162083 - RNA, 32 nt, Human
gagugcugggauuacaggugugagccacugug

SEQ ID NO: 162084 - RNA, 32 nt, Human
gagugcugggauuacaggugugagcuacugcg

SEQ ID NO: 162085 - RNA, 20 nt, Human
gagugcugggauuacaguug

SEQ ID NO: 162086 - RNA, 32 nt, Human
gagugcugggauuacaguugugagccacugug

SEQ ID NO: 162087 - RNA, 32 nt, Human
gagugcuguaaggagagguuggaagugaagau

SEQ ID NO: 162088 - RNA, 32 nt, Human
gagugcugugggcucugguggggagggggcuc

SEQ ID NO: 162089 - RNA, 32 nt, Human
gagugcuguuuccuggcuggagugcaguggca

SEQ ID NO: 162090 - RNA, 32 nt, Human
gagugcuugcuaucccacuucauaaagcuuuu

SEQ ID NO: 162091 - RNA, 32 nt, Human
gaguggaaacuauucuaucauaacuacccaag

SEQ ID NO: 162092 - RNA, 32 nt, Human
gaguggaaagcagagggugaucuuugaaaaga

SEQ ID NO: 162093 - RNA, 32 nt, Human
gaguggaacccuggucaucgggguuuuuagcc

SEQ ID NO: 162094 - RNA, 32 nt, Human
gaguggaagaggggaaagagaggcagagaggg

SEQ ID NO: 162095 - RNA, 32 nt, Human
gaguggaaucaaguucuugucuuuaggaugac

SEQ ID NO: 162096 - RNA, 31 nt, Human
gaguggacaaugucuucccagcaggccagac

SEQ ID NO: 162097 - RNA, 32 nt, Human
gaguggacaguaagugguggcucugcagaugg

SEQ ID NO: 162098 - RNA, 32 nt, Human
gaguggacauagugucuugaggcuugcagggu

SEQ ID NO: 162099 - RNA, 32 nt, Human
gaguggaccaaaacacugcacacagugaagug

SEQ ID NO: 162100 - RNA, 32 nt, Human
gaguggaccgaggaaggaaggaaggcaaggcu

SEQ ID NO: 162101 - RNA, 32 nt, Human
gaguggaccucucugucccuugcccaccuuaa

SEQ ID NO: 162102 - RNA, 32 nt, Human
gaguggacggcauucagggcugggggacacgg

SEQ ID NO: 162103 - RNA, 32 nt, Human
gaguggacucuuccccucacccccaacugaaa

SEQ ID NO: 162104 - RNA, 32 nt, Human
gaguggagaaagggaaaggcaggucuggggug

SEQ ID NO: 162105 - RNA, 32 nt, Human
gaguggagagcagagccaggagcucuggcagc

SEQ ID NO: 162106 - RNA, 28 nt, Human
gaguggagaggagagagagcaaauauug

SEQ ID NO: 162107 - RNA, 32 nt, Human
gaguggagagguguuuaguugcuuagccaagc

SEQ ID NO: 162108 - RNA, 32 nt, Human
gaguggagagguuucucuagagguguagggga

SEQ ID NO: 162109 - RNA, 32 nt, Human
gaguggagagucuaccuucgucucacaugugc

SEQ ID NO: 162110 - RNA, 32 nt, Human
gaguggagagugaaucuagggagacucaagag

SEQ ID NO: 162111 - RNA, 32 nt, Human
gaguggagagugagugcgggaccugaggcugu

SEQ ID NO: 162112 - RNA, 32 nt, Human
gaguggagccaaaggaaaagaucguuagagac

SEQ ID NO: 162113 - RNA, 30 nt, Human
gaguggagcuugcaaugagccaagauugcg

SEQ ID NO: 162114 - RNA, 32 nt, Human
gaguggaggaagcacgggacuggagggaccaa

SEQ ID NO: 162115 - RNA, 32 nt, Human
gaguggaggagaggagacaaggcucuggacag

SEQ ID NO: 162116 - RNA, 32 nt, Human
gaguggaggguguaggauaugaggguuaggcc

SEQ ID NO: 162117 - RNA, 32 nt, Human
gaguggagucucucacugcaugugacguggaa

SEQ ID NO: 162118 - RNA, 19 nt, Human
gaguggagucuugcucugu

SEQ ID NO: 162119 - RNA, 32 nt, Human
gaguggaguggggcgagaguccuccgaguagu

SEQ ID NO: 162120 - RNA, 32 nt, Human
gaguggaguuacugcagggaagcuaccggacc

SEQ ID NO: 162121 - RNA, 32 nt, Human
gaguggaguucgagucucucccugcggcgcuu

SEQ ID NO: 162122 - RNA, 32 nt, Human
gaguggauaaacaccccaagguggugacaaug

SEQ ID NO: 162123 - RNA, 21 nt, Human
gaguggauaacucagaaguca

SEQ ID NO: 162124 - RNA, 20 nt, Human
gaguggaucaccugagguca

SEQ ID NO: 162125 - RNA, 20 nt, Human
gaguggaucacuugagguca

SEQ ID NO: 162126 - RNA, 32 nt, Human
gaguggaucaucucuuggaaaugcagaacuuc

SEQ ID NO: 162127 - RNA, 32 nt, Human
gaguggaugauagaugcaaaauaauaccuguc

SEQ ID NO: 162128 - RNA, 31 nt, Human
gaguggauguacccaacaggugcucucaucg

SEQ ID NO: 162129 - RNA, 32 nt, Human
gaguggcaagggauuuggucuucagcaguaga

SEQ ID NO: 162130 - RNA, 32 nt, Human
gaguggcacaaguacaaauccagccugccuug

SEQ ID NO: 162131 - RNA, 32 nt, Human
gaguggcagagggagcagucccaucagccaug

SEQ ID NO: 162132 - RNA, 32 nt, Human
gaguggcagcaacuggacuaugcucagaggac

SEQ ID NO: 162133 - RNA, 19 nt, Human
gaguggcaggggagcucug

SEQ ID NO: 162134 - RNA, 32 nt, Human
gaguggcagugugccugugcucccucaucaaa

SEQ ID NO: 162135 - RNA, 32 nt, Human
gaguggcaguuuacagaagaggucgcggggug

SEQ ID NO: 162136 - RNA, 32 nt, Human
gaguggcaucacaucuucaugccugcacagua

SEQ ID NO: 162137 - RNA, 32 nt, Human
gaguggcauggccaccaccacgguggucacug

SEQ ID NO: 162138 - RNA, 32 nt, Human
gaguggccacuggcacuugccugcugcuugga

SEQ ID NO: 162139 - RNA, 32 nt, Human
gaguggccauuuccuuaccuuugaucccugua

SEQ ID NO: 162140 - RNA, 32 nt, Human
gaguggcccagugagaagggaggccgggcacc

SEQ ID NO: 162141 - RNA, 32 nt, Human
gaguggccccagguucuucaucugggccuccu

SEQ ID NO: 162142 - RNA, 32 nt, Human
gaguggccggcugcaaccacggcuccucucca

SEQ ID NO: 162143 - RNA, 32 nt, Human
gaguggccgugccauaaaauagucccuuucca

SEQ ID NO: 162144 - RNA, 32 nt, Human
gaguggccguggcugugggcagcauccacacg

SEQ ID NO: 162145 - RNA, 32 nt, Human
gaguggccugauuacauauuccucccacagca

SEQ ID NO: 162146 - RNA, 32 nt, Human
gaguggccugcucucaccauggacccauucug

SEQ ID NO: 162147 - RNA, 32 nt, Human
gaguggccuuucuuuuccccucccucccgguu

SEQ ID NO: 162148 - RNA, 32 nt, Human
gaguggcgagguggugaccugaggccagugug

SEQ ID NO: 162149 - RNA, 32 nt, Human
gaguggcggccgcggcgguggcggagacugug

SEQ ID NO: 162150 - RNA, 32 nt, Human
gaguggcgugagcugcccggcgccugcccugc

SEQ ID NO: 162151 - RNA, 32 nt, Human
gaguggcucauaccuguaaucccagcacuuug

SEQ ID NO: 162152 - RNA, 32 nt, Human
gaguggcuccaauagccuccugccacccacac

SEQ ID NO: 162153 - RNA, 32 nt, Human
gaguggcuccacccuucccaccucagagccau

SEQ ID NO: 162154 - RNA, 32 nt, Human
gaguggcugacugccaucuccaugccugagag

SEQ ID NO: 162155 - RNA, 32 nt, Human
gaguggcugaguaaacugguacauccgggcug

SEQ ID NO: 162156 - RNA, 17 nt, Human
gaguggcugcugcccca

SEQ ID NO: 162157 - RNA, 21 nt, Human
gaguggcugggaccgcaggug

SEQ ID NO: 162158 - RNA, 32 nt, Human
gaguggcugggaugugggagcagcaucucuag

SEQ ID NO: 162159 - RNA, 19 nt, Human
gaguggcugggauuacagg

SEQ ID NO: 162160 - RNA, 19 nt, Human
gaguggcugggauuauagg

SEQ ID NO: 162161 - RNA, 24 nt, Human
gaguggcuuacaccuauaauccca

SEQ ID NO: 162162 - RNA, 32 nt, Human
gaguggcuucccaggggaaauucaagggcacc

SEQ ID NO: 162163 - RNA, 32 nt, Human
gaguggcuugugggguggcaggaugcaggaga

SEQ ID NO: 162164 - RNA, 32 nt, Human
gaguggcuuuguccaagaucccucaggugugg

SEQ ID NO: 162165 - RNA, 21 nt, Human
gagugggaagcaaacgggcag

SEQ ID NO: 162166 - RNA, 18 nt, Human
gagugggaaggccuggga

SEQ ID NO: 162167 - RNA, 32 nt, Human
gagugggaccggcuuccagccuguggcggugc

SEQ ID NO: 162168 - RNA, 32 nt, Human
gagugggagaccuuaaaaccgucugaucuggc

SEQ ID NO: 162169 - RNA, 32 nt, Human
gagugggagaucaucuuggaauggcaguggcc

SEQ ID NO: 162170 - RNA, 32 nt, Human
gagugggagcaagggagccagggagagcucac

SEQ ID NO: 162171 - RNA, 31 nt, Human
gagugggaggaggagagaugggugaagacaa

SEQ ID NO: 162172 - RNA, 32 nt, Human
gagugggaggcagagagagaagugugcucaga

SEQ ID NO: 162173 - RNA, 21 nt, Human
gagugggaggcagcagggcag

SEQ ID NO: 162174 - RNA, 32 nt, Human
gagugggaggcagggugcgguggcucaugccu

SEQ ID NO: 162175 - RNA, 32 nt, Human
gagugggagggguaugggacagguuuggguuu

SEQ ID NO: 162176 - RNA, 32 nt, Human
gagugggaggguagcgagccagcuggauuccg

SEQ ID NO: 162177 - RNA, 22 nt, Human
gagugggaguggggaccaggaa

SEQ ID NO: 162178 - RNA, 32 nt, Human
gagugggaguucugaggcagggugagggggca

SEQ ID NO: 162179 - RNA, 23 nt, Human
gagugggauuaacaacccuggaa

SEQ ID NO: 162180 - RNA, 32 nt, Human
gagugggcaauggugcuucugugcuuuucccc

SEQ ID NO: 162181 - RNA, 32 nt, Human
gagugggcagccccucuaccuccuggacugaa

SEQ ID NO: 162182 - RNA, 32 nt, Human
gagugggcaggcgguuccagggagacaagcag

SEQ ID NO: 162183 - RNA, 32 nt, Human
gagugggccacagcaggaucucaacgggaaag

SEQ ID NO: 162184 - RNA, 32 nt, Human
gagugggccaggaguucaagaucagccuggcc

SEQ ID NO: 162185 - RNA, 32 nt, Human
gagugggccaggaguuuaagaucagccuggcc

SEQ ID NO: 162186 - RNA, 23 nt, Human
gagugggcgccgccgccaccgcc

SEQ ID NO: 162187 - RNA, 32 nt, Human
gagugggcucuacugccuuguuccauauuauu

SEQ ID NO: 162188 - RNA, 32 nt, Human
gagugggcugggugggguggggugucucuggu

SEQ ID NO: 162189 - RNA, 32 nt, Human
gagugggcuucuggcuccuagaacaaaugucc

SEQ ID NO: 162190 - RNA, 32 nt, Human
gagugggcuuugcgagucugaacguuggcggg

SEQ ID NO: 162191 - RNA, 32 nt, Human
gaguggggaaacacugagucuuguugggucuu

SEQ ID NO: 162192 - RNA, 32 nt, Human
gaguggggacagagggagagcuugugacuggg

SEQ ID NO: 162193 - RNA, 32 nt, Human
gaguggggagagagaaggggaggaguagggug

SEQ ID NO: 162194 - RNA, 32 nt, Human
gaguggggagccugggcucagcuccucccccu

SEQ ID NO: 162195 - RNA, 32 nt, Human
gaguggggagcgcauuaagauccagggaugga

SEQ ID NO: 162196 - RNA, 32 nt, Human
gaguggggaggugcuucagcagcagcgggauc

SEQ ID NO: 162197 - RNA, 32 nt, Human
gaguggggaugaguccgucaagcacaacuguu

SEQ ID NO: 162198 - RNA, 32 nt, Human
gaguggggauggggacacagucuccaagugug

SEQ ID NO: 162199 - RNA, 19 nt, Human
gaguggggcagaggcccag

SEQ ID NO: 162200 - RNA, 21 nt, Human
gaguggggcagaggcccagaa

SEQ ID NO: 162201 - RNA, 32 nt, Human
gaguggggcaggcagugguugguggguggugu

SEQ ID NO: 162202 - RNA, 32 nt, Human
gaguggggcucccacaggcuggagugcaaugg

SEQ ID NO: 162203 - RNA, 32 nt, Human
gaguggggcugcauauuuggagaucaacuuug

SEQ ID NO: 162204 - RNA, 32 nt, Human
gaguggggcuggcuaguaggggaacauguagu

SEQ ID NO: 162205 - RNA, 32 nt, Human
gagugggggcaggcagaagggagaaccagcuc

SEQ ID NO: 162206 - RNA, 32 nt, Human
gagugggggcaguuucuggcccaggggucuga

SEQ ID NO: 162207 - RNA, 32 nt, Human
gagugggggcuccagcccuccccacuaugccc

SEQ ID NO: 162208 - RNA, 18 nt, Human
gaguggggggcguggcag

SEQ ID NO: 162209 - RNA, 16 nt, Human
gaguggggguggggug

SEQ ID NO: 162210 - RNA, 32 nt, Human
gagugggguuacuauguguaaauggagugcug

SEQ ID NO: 162211 - RNA, 20 nt, Human
gaguggguacccagagacca

SEQ ID NO: 162212 - RNA, 32 nt, Human
gagugggucauccugggggagcaaggccugag

SEQ ID NO: 162213 - RNA, 32 nt, Human
gagugggugacguccaggucacaggcugcagc

SEQ ID NO: 162214 - RNA, 32 nt, Human
gagugggugcgccagguggaccacgugaucga

SEQ ID NO: 162215 - RNA, 32 nt, Human
gagugguagggaggaucaggcugcagaagggc

SEQ ID NO: 162216 - RNA, 32 nt, Human
gagugguccguucucaccacccuucagcuugg

SEQ ID NO: 162217 - RNA, 32 nt, Human
gaguggucucugaggcggcggcggcggcgggg

SEQ ID NO: 162218 - RNA, 32 nt, Human
gaguggucuucuucagccuguuuccccagcca

SEQ ID NO: 162219 - RNA, 32 nt, Human
gaguggugaccaccccuuccagcaggcagguu

SEQ ID NO: 162220 - RNA, 32 nt, Human
gaguggugagggugaaccagaucugggccuuu

SEQ ID NO: 162221 - RNA, 32 nt, Human
gaguggugagguaccgucuacauuucacauua

SEQ ID NO: 162222 - RNA, 18 nt, Human
gaguggugagugcaucaa

SEQ ID NO: 162223 - RNA, 32 nt, Human
gaguggugaguggaagggaggagcagcaagaa

SEQ ID NO: 162224 - RNA, 32 nt, Human
gaguggugaguggccucccugcucuggggcca

SEQ ID NO: 162225 - RNA, 24 nt, Human
gaguggugauugcaccacugcacu

SEQ ID NO: 162226 - RNA, 32 nt, Human
gaguggugcuuccccaaaacagacucauggac

SEQ ID NO: 162227 - RNA, 32 nt, Human
gagugguguggaggcagcugcugggcaggacc

SEQ ID NO: 162228 - RNA, 32 nt, Human
gaguggugugggcacacugcuuaggagucaac

SEQ ID NO: 162229 - RNA, 32 nt, Human
gagugguuaacugggcaaaccuuaagcucaca

SEQ ID NO: 162230 - RNA, 32 nt, Human
gagugguuccacugccuggauaacccuugagg

SEQ ID NO: 162231 - RNA, 32 nt, Human
gagugguugcccaggccuaguuucaguggcag

SEQ ID NO: 162232 - RNA, 32 nt, Human
gagugguuuccagauuggagcgagguuauucu

SEQ ID NO: 162233 - RNA, 31 nt, Human
gaguguaaaccuuuucccaugcccagucuuc

SEQ ID NO: 162234 - RNA, 32 nt, Human
gaguguagcaagaaaaggcucggugaugccug

SEQ ID NO: 162235 - RNA, 32 nt, Human
gaguguaggauucccucugugaaggaaucauc

SEQ ID NO: 162236 - RNA, 32 nt, Human
gaguguaggucccacuucaccccauucuccuc

SEQ ID NO: 162237 - RNA, 32 nt, Human
gaguguaguggugccaucucagcucacugcaa

SEQ ID NO: 162238 - RNA, 32 nt, Human
gagugucaaugauugcuggaacaggugggggu

SEQ ID NO: 162239 - RNA, 32 nt, Human
gagugucacaaacuguaugacauguuauuucu

SEQ ID NO: 162240 - RNA, 32 nt, Human
gagugucacguggggagggaaggggccagugg

SEQ ID NO: 162241 - RNA, 32 nt, Human
gagugucagauuuuugaguaccaaugaucaug

SEQ ID NO: 162242 - RNA, 32 nt, Human
gagugucagcaguguguaagacagcguggggc

SEQ ID NO: 162243 - RNA, 32 nt, Human
gagugucagcugggaggaagccagucucuguc

SEQ ID NO: 162244 - RNA, 32 nt, Human
gagugucagcuuuuagaaggaucauggucaug

SEQ ID NO: 162245 - RNA, 32 nt, Human
gagugucaugacucacccaaccccuuguccaa

SEQ ID NO: 162246 - RNA, 32 nt, Human
gagugucauucaugcugcuguccccuggugaa

SEQ ID NO: 162247 - RNA, 32 nt, Human
gagugucccucuuguugcccaggcuggagugc

SEQ ID NO: 162248 - RNA, 32 nt, Human
gagugucccuggcaacgccacgcuuccgccuu

SEQ ID NO: 162249 - RNA, 32 nt, Human
gagugucccuucuucacaccuacucacuuuac

SEQ ID NO: 162250 - RNA, 32 nt, Human
gaguguccuaaaggcugugcugcuggggccuc

SEQ ID NO: 162251 - RNA, 32 nt, Human
gaguguccucaagggccuguuggugacaccga

SEQ ID NO: 162252 - RNA, 32 nt, Human
gaguguccugaagcucugccucuggcuuuccg

SEQ ID NO: 162253 - RNA, 32 nt, Human
gagugucgguaguucuugcaguaggcacuuua

SEQ ID NO: 162254 - RNA, 32 nt, Human
gagugucucaaagggcugauggcuuccugguc

SEQ ID NO: 162255 - RNA, 32 nt, Human
gagugucucaacacuuauuagugacaguauug

SEQ ID NO: 162256 - RNA, 32 nt, Human
gagugucucugcuggugcuucucccaagacua

SEQ ID NO: 162257 - RNA, 32 nt, Human
gagugucugcagcuggggacacaacugcccgg

SEQ ID NO: 162258 - RNA, 32 nt, Human
gagugucugcugucacccucuacucuccagcu

SEQ ID NO: 162259 - RNA, 32 nt, Human
gagugucuggagcggcuucaguucagcuuuaa

SEQ ID NO: 162260 - RNA, 32 nt, Human
gagugucuggaggccauugcugccucccucaa

SEQ ID NO: 162261 - RNA, 32 nt, Human
gagugucuggucuccggccugccugugcuguc

SEQ ID NO: 162262 - RNA, 32 nt, Human
gagugucuguaaucccagcuacucaggaggcu

SEQ ID NO: 162263 - RNA, 32 nt, Human
gagugucuuggggacagcucuuuccaccccug

SEQ ID NO: 162264 - RNA, 32 nt, Human
gagugucuuuuagugucacagggaacaguuau

SEQ ID NO: 162265 - RNA, 32 nt, Human
gagugugagagggaagcgccgcggccuguauu

SEQ ID NO: 162266 - RNA, 32 nt, Human
gagugugagccaccacacccagccagcaauau

SEQ ID NO: 162267 - RNA, 20 nt, Human
gagugugaguaucccugcca

SEQ ID NO: 162268 - RNA, 32 nt, Human
gagugugagucccaggggucccgccagcucca

SEQ ID NO: 162269 - RNA, 23 nt, Human
gagugugagugccggguccugcc

SEQ ID NO: 162270 - RNA, 32 nt, Human
gagugugauagggaagaaguagcacugcuguc

SEQ ID NO: 162271 - RNA, 24 nt, Human
gagugugauugcugccccuugcua

SEQ ID NO: 162272 - RNA, 32 nt, Human
gagugugcaaauaggugugggucacagacauc

SEQ ID NO: 162273 - RNA, 32 nt, Human
gagugugcagggauggaguuuugcauuucuag

SEQ ID NO: 162274 - RNA, 32 nt, Human
gagugugccaggaagccaggccaccgaagccc

SEQ ID NO: 162275 - RNA, 32 nt, Human
gagugugccaugcucaugaagccacagguccu

SEQ ID NO: 162276 - RNA, 32 nt, Human
gagugugccuguaaucucagcacuuugagggg

SEQ ID NO: 162277 - RNA, 32 nt, Human
gagugugcgccagcccgcggcccagccgaagc

SEQ ID NO: 162278 - RNA, 32 nt, Human
gagugugcgggaggggguagaguuggcagguu

SEQ ID NO: 162279 - RNA, 32 nt, Human
gagugugcugggacguugugugcaauagagag

SEQ ID NO: 162280 - RNA, 32 nt, Human
gaguguggaaacaccaaacccugagucaccac

SEQ ID NO: 162281 - RNA, 32 nt, Human
gaguguggaagagacggcgcuggaacccaugg

SEQ ID NO: 162282 - RNA, 32 nt, Human
gaguguggaaggaacccagcugccagcugcag

SEQ ID NO: 162283 - RNA, 32 nt, Human
gaguguggacauaaggcccucugugaucaugc

SEQ ID NO: 162284 - RNA, 24 nt, Human
gaguguggagaggaaggaggcaga

SEQ ID NO: 162285 - RNA, 32 nt, Human
gaguguggagcgagagaaaggccagcgugcug

SEQ ID NO: 162286 - RNA, 32 nt, Human
gaguguggcaaaaccuuccaucacaauucagu

SEQ ID NO: 162287 - RNA, 31 nt, Human
gaguguggcaaagccuuuggcaagcagucaa

SEQ ID NO: 162288 - RNA, 32 nt, Human
gaguguggcugcagugcgccgggacaccaggg

SEQ ID NO: 162289 - RNA, 32 nt, Human
gaguguggcuucaccagucagagggagcaguc

SEQ ID NO: 162290 - RNA, 32 nt, Human
gaguguggcuucccacuuuuccugcauugugg

SEQ ID NO: 162291 - RNA, 32 nt, Human
gagugugggagguggaugcgggagggugcacc

SEQ ID NO: 162292 - RNA, 32 nt, Human
gagugugggccaggcugagugcauaggugaca

SEQ ID NO: 162293 - RNA, 32 nt, Human
gagugugggccuuccagcugagcccaugcaag

SEQ ID NO: 162294 - RNA, 26 nt, Human
gagugugggggccacgccccuugcca

SEQ ID NO: 162295 - RNA, 32 nt, Human
gagugugggugagggucgaaaugccaaagguc

SEQ ID NO: 162296 - RNA, 32 nt, Human
gaguguggguuuuggagucugagccucaggcu

SEQ ID NO: 162297 - RNA, 32 nt, Human
gaguguggugcuaauaaaugcauuacuuuuuc

SEQ ID NO: 162298 - RNA, 32 nt, Human
gaguguggugcuggggaaggcaugugcuugga

SEQ ID NO: 162299 - RNA, 32 nt, Human
gagugugguguucaggaugcaccagcaccacc

SEQ ID NO: 162300 - RNA, 32 nt, Human
gaguguguaggccagccccggucacagagugc

SEQ ID NO: 162301 - RNA, 32 nt, Human
gagugugucccucaguggacaccagcuagagu

SEQ ID NO: 162302 - RNA, 32 nt, Human
gagugugugaguucaaggcugcagugagguau

SEQ ID NO: 162303 - RNA, 32 nt, Human
gagugugugcugccguucauuaccacggagau

SEQ ID NO: 162304 - RNA, 32 nt, Human
gaguguguggccccucccccucuccuuuugcu

SEQ ID NO: 162305 - RNA, 20 nt, Human
gagugugugggaguggggug

SEQ ID NO: 162306 - RNA, 32 nt, Human
gaguguguguggagcagcuggagcagcuggac

SEQ ID NO: 162307 - RNA, 32 nt, Human
gaguguguuggggugggauggggcaggccgug

SEQ ID NO: 162308 - RNA, 32 nt, Human
gaguguuaagaucuaggaucccuucccacugg

SEQ ID NO: 162309 - RNA, 32 nt, Human
gaguguuacaggcucuaaagugcaauggagaa

SEQ ID NO: 162310 - RNA, 32 nt, Human
gaguguuaccauuuacccaucgguugccaucu

SEQ ID NO: 162311 - RNA, 32 nt, Human
gaguguuaggauuacaggcgugagccaccaca

SEQ ID NO: 162312 - RNA, 32 nt, Human
gaguguuaggugcucccugucucucuacagac

SEQ ID NO: 162313 - RNA, 32 nt, Human
gaguguuauuuuugggaugugagggugaucug

SEQ ID NO: 162314 - RNA, 32 nt, Human
gaguguucagccacagucccacaagccucagc

SEQ ID NO: 162315 - RNA, 32 nt, Human
gaguguucagcccugugugcucuccagcuccu

SEQ ID NO: 162316 - RNA, 32 nt, Human
gaguguucauuucacaccuuaucaggcaaugu

SEQ ID NO: 162317 - RNA, 32 nt, Human
gaguguuccaacucaacucaaaggacacccag

SEQ ID NO: 162318 - RNA, 32 nt, Human
gaguguuccagaaaugagaguggcaucuuuau

SEQ ID NO: 162319 - RNA, 32 nt, Human
gaguguucuguggagaaacugcagccccacuu

SEQ ID NO: 162320 - RNA, 32 nt, Human
gaguguucuguuccggcauauccuggccguaa

SEQ ID NO: 162321 - RNA, 25 nt, Human
gaguguucuucucuaagaccuggaa

SEQ ID NO: 162322 - RNA, 32 nt, Human
gaguguugccgcaaccucgccuucagccuggc

SEQ ID NO: 162323 - RNA, 32 nt, Human
gaguguugggacugacuccuggaagacagccu

SEQ ID NO: 162324 - RNA, 32 nt, Human
gaguguugggauuacagccaugagccaccaug

SEQ ID NO: 162325 - RNA, 32 nt, Human
gaguguuggggcaaagaccgaggucccucucc

SEQ ID NO: 162326 - RNA, 22 nt, Human
gaguguugguggcccaagcaaa

SEQ ID NO: 162327 - RNA, 32 nt, Human
gaguguuuacagccacucagcccugcucugcu

SEQ ID NO: 162328 - RNA, 32 nt, Human
gaguguuuccagcauugcaaaguucuguugga

SEQ ID NO: 162329 - RNA, 32 nt, Human
gaguuaaaaauuacauacuaaaaguuuauugg

SEQ ID NO: 162330 - RNA, 32 nt, Human
gaguuaaaaccagcuuccuggcccagagaggu

SEQ ID NO: 162331 - RNA, 32 nt, Human
gaguuaaaccuaccuaaguagauuuuaggugg

SEQ ID NO: 162332 - RNA, 32 nt, Human
gaguuaaaccuccucagguucaaccugugaua

SEQ ID NO: 162333 - RNA, 32 nt, Human
gaguuaaccccaaaggugauaugguuuuauuu

SEQ ID NO: 162334 - RNA, 32 nt, Human
gaguuaacucaggcucguucuagggacucauu

SEQ ID NO: 162335 - RNA, 32 nt, Human
gaguuaagcauacauggcaaugcugaaaauaa

SEQ ID NO: 162336 - RNA, 20 nt, Human
gaguuaaggcaaggguugaa

SEQ ID NO: 162337 - RNA, 32 nt, Human
gaguuaagggagagaauaagaacggcgguaac

SEQ ID NO: 162338 - RNA, 32 nt, Human
gaguuaaucaaguauaauuuagccaggcuaug

SEQ ID NO: 162339 - RNA, 32 nt, Human
gaguuaauccauacagaaaccaguguguccau

SEQ ID NO: 162340 - RNA, 31 nt, Human
gaguuaauguaugcuggagcugcucuaaagg

SEQ ID NO: 162341 - RNA, 32 nt, Human
gaguuaauuccagugaagcaaaacuugggaag

SEQ ID NO: 162342 - RNA, 32 nt, Human
gaguuaauuuggggacaacagggaccucuuag

SEQ ID NO: 162343 - RNA, 32 nt, Human
gaguuacaaggcagccaacaaugauuauacac

SEQ ID NO: 162344 - RNA, 32 nt, Human
gaguuacacaugccaucauagacgucauacug

SEQ ID NO: 162345 - RNA, 32 nt, Human
gaguuacagcacuugcuccuuaugaggaugag

SEQ ID NO: 162346 - RNA, 32 nt, Human
gaguuaccauagcaaccagcaacuccagggua

SEQ ID NO: 162347 - RNA, 32 nt, Human
gaguuaccauggugaccgcagccccuuggacu

SEQ ID NO: 162348 - RNA, 32 nt, Human
gaguuaccgaaaacaaauggaacagagucgua

SEQ ID NO: 162349 - RNA, 19 nt, Human
gaguuaccucccgcagccg

SEQ ID NO: 162350 - RNA, 32 nt, Human
gaguuacgggccaggagacaagcacagaacga

SEQ ID NO: 162351 - RNA, 32 nt, Human
gaguuacguacccaguaucacacucacaguua

SEQ ID NO: 162352 - RNA, 32 nt, Human
gaguuacuauuuuuccuuuuccccauuuuauu

SEQ ID NO: 162353 - RNA, 32 nt, Human
gaguuacucacucugauucuuccuucagugac

SEQ ID NO: 162354 - RNA, 32 nt, Human
gaguuacugcacuccagccugggugacaagag

SEQ ID NO: 162355 - RNA, 32 nt, Human
gaguuagagacacuauccacuuccaucaguca

SEQ ID NO: 162356 - RNA, 32 nt, Human
gaguuagagagagacaaagagagagaguuaga

SEQ ID NO: 162357 - RNA, 32 nt, Human
gaguuagagaugagucaccgcugagagcagcu

SEQ ID NO: 162358 - RNA, 32 nt, Human
gaguuagaggaggaggaggaggaggaagaggu

SEQ ID NO: 162359 - RNA, 32 nt, Human
gaguuagcaagacccugcugugauuacuaugu

SEQ ID NO: 162360 - RNA, 32 nt, Human
gaguuagcuggguauagagguggcucaaagga

SEQ ID NO: 162361 - RNA, 32 nt, Human
gaguuaggaaggauaugucuuucuccaggugc

SEQ ID NO: 162362 - RNA, 21 nt, Human
gaguuaggagaagaaaaggac

SEQ ID NO: 162363 - RNA, 32 nt, Human
gaguuaggccaggcacuguauuggacauggau

SEQ ID NO: 162364 - RNA, 32 nt, Human
gaguuaggcccagagcugggcaguggucacuc

SEQ ID NO: 162365 - RNA, 32 nt, Human
gaguuaggcgggccucacaggucacccagcca

SEQ ID NO: 162366 - RNA, 32 nt, Human
gaguuagggcagcagaguggagcgauuuagaa

SEQ ID NO: 162367 - RNA, 32 nt, Human
gaguuaggggaacuccugcugccugaacacaa

SEQ ID NO: 162368 - RNA, 32 nt, Human
gaguuagggugaaagagaaaauguuuguugaa

SEQ ID NO: 162369 - RNA, 23 nt, Human
gaguuagucuaucucucuuugcc

SEQ ID NO: 162370 - RNA, 32 nt, Human
gaguuauacccuggagcagcucagggcucagg

SEQ ID NO: 162371 - RNA, 32 nt, Human
gaguuaucacaguucaugaaucuaagaggcgg

SEQ ID NO: 162372 - RNA, 32 nt, Human
gaguuaucauuuguagaaaagauuugauuuga

SEQ ID NO: 162373 - RNA, 32 nt, Human
gaguuauccuucuucccugccuuggaagcccu

SEQ ID NO: 162374 - RNA, 20 nt, Human
gaguuaucugugacauucca

SEQ ID NO: 162375 - RNA, 32 nt, Human
gaguuaugcccauuucuaaaagccuggcauau

SEQ ID NO: 162376 - RNA, 32 nt, Human
gaguuauggccucugcacuccagccuggguga

SEQ ID NO: 162377 - RNA, 32 nt, Human
gaguucaaagaguuaugaguugaagucuugaa

SEQ ID NO: 162378 - RNA, 32 nt, Human
gaguucaaccugcuggaccccaaagagaccgc

SEQ ID NO: 162379 - RNA, 32 nt, Human
gaguucaagaccagccucaacauggagaaacc

SEQ ID NO: 162380 - RNA, 32 nt, Human
gaguucaagaucaggaccaacauggugaaacc

SEQ ID NO: 162381 - RNA, 19 nt, Human
gaguucaaggcugcaguga

SEQ ID NO: 162382 - RNA, 24 nt, Human
gaguucaagucugcagugagcuau

SEQ ID NO: 162383 - RNA, 32 nt, Human
gaguucaagugaaggaaggaggagguuccugg

SEQ ID NO: 162384 - RNA, 31 nt, Human
gaguucaaucaguauuuauguugaaauuucu

SEQ ID NO: 162385 - RNA, 32 nt, Human
gaguucacagcccagucuggggacagcugggu

SEQ ID NO: 162386 - RNA, 32 nt, Human
gaguucaccaguguucagcauggcagucgugc

SEQ ID NO: 162387 - RNA, 32 nt, Human
gaguucaccaguguucagcauggcaguugugc

SEQ ID NO: 162388 - RNA, 32 nt, Human
gaguucacugcacugagcugugaucacaccac

SEQ ID NO: 162389 - RNA, 32 nt, Human
gaguucacuucuucagaaccuuccugaaauga

SEQ ID NO: 162390 - RNA, 32 nt, Human
gaguucagaggaagaggaaguguagccggcgg

SEQ ID NO: 162391 - RNA, 32 nt, Human
gaguucagcagaaaggaggaauccuggcccuc

SEQ ID NO: 162392 - RNA, 32 nt, Human
gaguucagccuggguagcauaugggaacuuca

SEQ ID NO: 162393 - RNA, 32 nt, Human
gaguucaggaguuugagaccagccugggcaac

SEQ ID NO: 162394 - RNA, 32 nt, Human
gaguucaggcccugggaggcucagccaccucc

SEQ ID NO: 162395 - RNA, 32 nt, Human
gaguucagggagcaacugugggcagaugaaau

SEQ ID NO: 162396 - RNA, 32 nt, Human
gaguucagucugcaguccugugcucacagaca

SEQ ID NO: 162397 - RNA, 31 nt, Human
gaguucagugagagagaaaaugauuuagauc

SEQ ID NO: 162398 - RNA, 32 nt, Human
gaguucaguggugccaucucuguccacugcaa

SEQ ID NO: 162399 - RNA, 32 nt, Human
gaguucaguucagaaggcaggaaagacaguca

SEQ ID NO: 162400 - RNA, 23 nt, Human
gaguucauacuggagaaaggcau

SEQ ID NO: 162401 - RNA, 24 nt, Human
gaguucauaguuggaaaacuugug

SEQ ID NO: 162402 - RNA, 20 nt, Human
gaguucauaguugggcggug

SEQ ID NO: 162403 - RNA, 22 nt, Human
gaguucauccugaaaagcugug

SEQ ID NO: 162404 - RNA, 32 nt, Human
gaguucaucugaagaaauucaggccccaccuc

SEQ ID NO: 162405 - RNA, 32 nt, Human
gaguucaucuguggguguugggggcaaguggg

SEQ ID NO: 162406 - RNA, 32 nt, Human
gaguucaugcaauugcacuccagccugggcaa

SEQ ID NO: 162407 - RNA, 32 nt, Human
gaguucauuucaggcagccagcucuuccucac

SEQ ID NO: 162408 - RNA, 32 nt, Human
gaguuccacagcaaaacaggugugcccaggac

SEQ ID NO: 162409 - RNA, 32 nt, Human
gaguuccacaguugauuagcaguugaggccag

SEQ ID NO: 162410 - RNA, 32 nt, Human
gaguuccagcuacucaggaggcugaggcagga

SEQ ID NO: 162411 - RNA, 32 nt, Human
gaguuccccagccuggaggcucugguggagaa

SEQ ID NO: 162412 - RNA, 32 nt, Human
gaguuccccugcccaccgccucccagccacug

SEQ ID NO: 162413 - RNA, 32 nt, Human
gaguuccccuuagagcuucucaaggaaauccu

SEQ ID NO: 162414 - RNA, 32 nt, Human
gaguuccccuuuagguuccuagugauguggag

SEQ ID NO: 162415 - RNA, 32 nt, Human
gaguucccucauucuuauuaccagaaagagcu

SEQ ID NO: 162416 - RNA, 32 nt, Human
gaguucccugcagccugcggggccaagaagaa

SEQ ID NO: 162417 - RNA, 32 nt, Human
gaguucccuugcacuccccucugccuuugcaa

SEQ ID NO: 162418 - RNA, 32 nt, Human
gaguuccggaggcugggcugcagcccacucag

SEQ ID NO: 162419 - RNA, 32 nt, Human
gaguuccggccaggcagacaaaaguuugggag

SEQ ID NO: 162420 - RNA, 22 nt, Human
gaguuccggcuggcaucuggca

SEQ ID NO: 162421 - RNA, 32 nt, Human
gaguuccuagagcuuggcugggucuaggcugu

SEQ ID NO: 162422 - RNA, 32 nt, Human
gaguuccuccugcaccugugcuggggaguagg

SEQ ID NO: 162423 - RNA, 32 nt, Human
gaguuccugcaacaagaauacugcuguugaca

SEQ ID NO: 162424 - RNA, 18 nt, Human
gaguuccugcugcugcug

SEQ ID NO: 162425 - RNA, 22 nt, Human
gaguuccugucaccugcucccc

SEQ ID NO: 162426 - RNA, 32 nt, Human
gaguuccuuguagguacaagcuucuggcucaa

SEQ ID NO: 162427 - RNA, 32 nt, Human
gaguucgacgggaaaguacucuccccacccca

SEQ ID NO: 162428 - RNA, 32 nt, Human
gaguucgagaacuaagcaaauuagcugagacc

SEQ ID NO: 162429 - RNA, 32 nt, Human
gaguucgagaccagccucaacauggagaaacc

SEQ ID NO: 162430 - RNA, 32 nt, Human
gaguucgagaccagccugcccaaaaaggugaa

SEQ ID NO: 162431 - RNA, 19 nt, Human
gaguucgaggcugcaguga

SEQ ID NO: 162432 - RNA, 32 nt, Human
gaguucgaggcugcagugagcuaugacugugc

SEQ ID NO: 162433 - RNA, 32 nt, Human
gaguucgaggcugcagugagcuaugaucucac

SEQ ID NO: 162434 - RNA, 32 nt, Human
gaguucgcucacuggauccuuccucucugaug

SEQ ID NO: 162435 - RNA, 32 nt, Human
gaguucggaagacacucgaggagcggcagcug

SEQ ID NO: 162436 - RNA, 32 nt, Human
gaguucgucuuuaagccucccuugccucagca

SEQ ID NO: 162437 - RNA, 32 nt, Human
gaguucgugccauuacacuccagccuggguga

SEQ ID NO: 162438 - RNA, 32 nt, Human
gaguucguggucacugcacuccagccuggcua

SEQ ID NO: 162439 - RNA, 24 nt, Human
gaguucuaauugcgccacugcacu

SEQ ID NO: 162440 - RNA, 32 nt, Human
gaguucucaaccuagagacuaugugagaaaag

SEQ ID NO: 162441 - RNA, 32 nt, Human
gaguucucacauauggaaaggauacacacuuu

SEQ ID NO: 162442 - RNA, 32 nt, Human
gaguucucagaccccaccccacccucaggugg

SEQ ID NO: 162443 - RNA, 32 nt, Human
gaguucucauuuccuacccaucccugcgugaa

SEQ ID NO: 162444 - RNA, 32 nt, Human
gaguucuccaaaccagccucccaggaaugcca

SEQ ID NO: 162445 - RNA, 32 nt, Human
gaguucuccaaguggaguuccacccgccggac

SEQ ID NO: 162446 - RNA, 20 nt, Human
gaguucucccaccaccucac

SEQ ID NO: 162447 - RNA, 32 nt, Human
gaguucuccccaaaacccuagcucuuuacccu

SEQ ID NO: 162448 - RNA, 32 nt, Human
gaguucuccuggaggcaggggcugcugccuug

SEQ ID NO: 162449 - RNA, 32 nt, Human
gaguucucuccuaggcaaguggccaguugccu

SEQ ID NO: 162450 - RNA, 32 nt, Human
gaguucucucuuccuuccccugcauagagaau

SEQ ID NO: 162451 - RNA, 32 nt, Human
gaguucucuuugaggcuggaaugcaguagcgu

SEQ ID NO: 162452 - RNA, 32 nt, Human
gaguucugaaucucaaaacacucuacucuggc

SEQ ID NO: 162453 - RNA, 32 nt, Human
gaguucugagccuguuugcuagggagagugag

SEQ ID NO: 162454 - RNA, 29 nt, Human
gaguucugccugugugugcuggguuuugg

SEQ ID NO: 162455 - RNA, 32 nt, Human
gaguucugcuuugguaaagucugacccuaguc

SEQ ID NO: 162456 - RNA, 32 nt, Human
gaguucugggagguguggcggaccagcugggc

SEQ ID NO: 162457 - RNA, 32 nt, Human
gaguucugguaccagaugaagggggaacggau

SEQ ID NO: 162458 - RNA, 32 nt, Human
gaguucuggugagggcccucuucugggaugca

SEQ ID NO: 162459 - RNA, 32 nt, Human
gaguucuguacuucaaccagccuacaagcugg

SEQ ID NO: 162460 - RNA, 21 nt, Human
gaguucuguccuccagguuca

SEQ ID NO: 162461 - RNA, 32 nt, Human
gaguucuguguauuuucagucaaaacuuuaaa

SEQ ID NO: 162462 - RNA, 19 nt, Human
gaguucuucacgggcagca

SEQ ID NO: 162463 - RNA, 20 nt, Human
gaguucuugcccucugucca

SEQ ID NO: 162464 - RNA, 32 nt, Human
gaguucuugccucuguguccuguccuuccugg

SEQ ID NO: 162465 - RNA, 32 nt, Human
gaguucuugucaccgauggaacagucugucuu

SEQ ID NO: 162466 - RNA, 32 nt, Human
gaguucuuuaugagccucgauguucccuggua

SEQ ID NO: 162467 - RNA, 32 nt, Human
gaguucuuuguugugcguggggcucaaaggac

SEQ ID NO: 162468 - RNA, 32 nt, Human
gaguucuuuuuauguugaggcaccaugcuagg

SEQ ID NO: 162469 - RNA, 21 nt, Human
gaguugaaaaagaauaacaga

SEQ ID NO: 162470 - RNA, 32 nt, Human
gaguugaaaaagaguuucauuguggagagaaa

SEQ ID NO: 162471 - RNA, 32 nt, Human
gaguugaaaaugcagaagaggagaggcagguu

SEQ ID NO: 162472 - RNA, 19 nt, Human
gaguugaaaccggcaguua

SEQ ID NO: 162473 - RNA, 32 nt, Human
gaguugaacagugguggcugggcucacagcuc

SEQ ID NO: 162474 - RNA, 20 nt, Human
gaguugaaggagaagcugga

SEQ ID NO: 162475 - RNA, 32 nt, Human
gaguugaagugugagugagagugaagaggaac

SEQ ID NO: 162476 - RNA, 32 nt, Human
gaguugaauaguugggacagggacaguauagc

SEQ ID NO: 162477 - RNA, 32 nt, Human
gaguugaaugauugcuguuuuccucucacucu

SEQ ID NO: 162478 - RNA, 32 nt, Human
gaguugaauuuggggugggaggauggaugcaa

SEQ ID NO: 162479 - RNA, 32 nt, Human
gaguugacugcucauacccaggaagagcugac

SEQ ID NO: 162480 - RNA, 32 nt, Human
gaguugacuugacagaacacugucuugaagac

SEQ ID NO: 162481 - RNA, 32 nt, Human
gaguugagaaggacaggagguauggggugggg

SEQ ID NO: 162482 - RNA, 32 nt, Human
gaguugagauuggagagcagcgccgucuguac

SEQ ID NO: 162483 - RNA, 32 nt, Human
gaguugagcacagagggacagaggcacggaac

SEQ ID NO: 162484 - RNA, 32 nt, Human
gaguugaugugauacuucuagaacaaaauuau

SEQ ID NO: 162485 - RNA, 31 nt, Human
gaguugcacaggagagaaagaagaaguuguc

SEQ ID NO: 162486 - RNA, 20 nt, Human
gaguugcagaauccaaggac

SEQ ID NO: 162487 - RNA, 32 nt, Human
gaguugcagccagggcuguggggaaggggcag

SEQ ID NO: 162488 - RNA, 32 nt, Human
gaguugcagcccaugaccucaccugguuccag

SEQ ID NO: 162489 - RNA, 32 nt, Human
gaguugcaggcagaggagauugggucuugacu

SEQ ID NO: 162490 - RNA, 32 nt, Human
gaguugcaggucaccuccccuaccugcuucuc

SEQ ID NO: 162491 - RNA, 32 nt, Human
gaguugcccaaaaccauuacuuuuaaacgcug

SEQ ID NO: 162492 - RNA, 32 nt, Human
gaguugcccagaggaaucccuguucccacuga

SEQ ID NO: 162493 - RNA, 32 nt, Human
gaguugcccaggcuggagugcagcgcaugguc

SEQ ID NO: 162494 - RNA, 32 nt, Human
gaguugccuccacccugucccaacagcugaca

SEQ ID NO: 162495 - RNA, 32 nt, Human
gaguugccucugaguuagcucuuuggaaucgu

SEQ ID NO: 162496 - RNA, 32 nt, Human
gaguugccuggcggcaggcuagcagcuggcca

SEQ ID NO: 162497 - RNA, 32 nt, Human
gaguugcgggagagagaaggagcaggcacgcu

SEQ ID NO: 162498 - RNA, 32 nt, Human
gaguugcggugagccgagaucgcgccauugca

SEQ ID NO: 162499 - RNA, 32 nt, Human
gaguugcuaccugucuucuccuggggccuugc

SEQ ID NO: 162500 - RNA, 32 nt, Human
gaguugcucuuggaucucuacagugccgcgua

SEQ ID NO: 162501 - RNA, 32 nt, Human
gaguugcugccaguacccgcucccucugcuca

SEQ ID NO: 162502 - RNA, 32 nt, Human
gaguugcugccuguucuucacacuuagcucca

SEQ ID NO: 162503 - RNA, 21 nt, Human
gaguugcugggacuauaggug

SEQ ID NO: 162504 - RNA, 32 nt, Human
gaguugcugggcucagcgcagcucccauucau

SEQ ID NO: 162505 - RNA, 32 nt, Human
gaguuggaaagaaacaacuauagguagcuaca

SEQ ID NO: 162506 - RNA, 32 nt, Human
gaguuggaacaaaugucuguucccuggaggcc

SEQ ID NO: 162507 - RNA, 32 nt, Human
gaguuggacacauugugcccagggcagcccug

SEQ ID NO: 162508 - RNA, 32 nt, Human
gaguuggacacuauuccugcucccucuuguuu

SEQ ID NO: 162509 - RNA, 32 nt, Human
gaguuggagacagaacaacagagucucaggga

SEQ ID NO: 162510 - RNA, 32 nt, Human
gaguuggagccugggacuaggagcagccuuau

SEQ ID NO: 162511 - RNA, 32 nt, Human
gaguuggagcucuccagcaacaugccugagca

SEQ ID NO: 162512 - RNA, 32 nt, Human
gaguuggagcugaaggaggaauggcaggauga

SEQ ID NO: 162513 - RNA, 32 nt, Human
gaguuggaggaggaggaggaggaggcgagggc

SEQ ID NO: 162514 - RNA, 32 nt, Human
gaguuggaggggcggggugcuggcgguguggc

SEQ ID NO: 162515 - RNA, 19 nt, Human
gaguuggagguugcaguga

SEQ ID NO: 162516 - RNA, 32 nt, Human
gaguuggcaaagccugucccccagcucagcgc

SEQ ID NO: 162517 - RNA, 32 nt, Human
gaguuggcagccuguggcauggggaggugugg

SEQ ID NO: 162518 - RNA, 32 nt, Human
gaguuggcggauauucggaacugugaauguac

SEQ ID NO: 162519 - RNA, 32 nt, Human
gaguuggcgggccaggagggcaguugagagcu

SEQ ID NO: 162520 - RNA, 32 nt, Human
gaguugggaaacagguggagaauaaugcaaga

SEQ ID NO: 162521 - RNA, 32 nt, Human
gaguugggagagaaaggcccucagcuuuuaga

SEQ ID NO: 162522 - RNA, 21 nt, Human
gaguugggagagauggaggga

SEQ ID NO: 162523 - RNA, 32 nt, Human
gaguugggagccugccugguggaguugaguga

SEQ ID NO: 162524 - RNA, 32 nt, Human
gaguugggcagaucaccugagaucaggaguuc

SEQ ID NO: 162525 - RNA, 22 nt, Human
gaguugggcggaucacaagguc

SEQ ID NO: 162526 - RNA, 32 nt, Human
gaguuggggaaaggaacgaacccuggcuggag

SEQ ID NO: 162527 - RNA, 32 nt, Human
gaguuggggcccugucuguccuaggccuggag

SEQ ID NO: 162528 - RNA, 32 nt, Human
gaguugggggauggcggcagauguuagccagg

SEQ ID NO: 162529 - RNA, 32 nt, Human
gaguugggggccccuucauuucccaggucugg

SEQ ID NO: 162530 - RNA, 24 nt, Human
gaguugggggcucugcuuuuuccc

SEQ ID NO: 162531 - RNA, 32 nt, Human
gaguuggggguuucacuauguuggccaggcug

SEQ ID NO: 162532 - RNA, 32 nt, Human
gaguuggggugaggccugggcagccggagggc

SEQ ID NO: 162533 - RNA, 32 nt, Human
gaguuggggugagggccagagcuggcagugga

SEQ ID NO: 162534 - RNA, 32 nt, Human
gaguugggugggcccugacuccccugcccucc

SEQ ID NO: 162535 - RNA, 32 nt, Human
gaguuggugaacagcaggauggaugggauguc

SEQ ID NO: 162536 - RNA, 32 nt, Human
gaguugguuccuucuggaggcucuaaggaaga

SEQ ID NO: 162537 - RNA, 32 nt, Human
gaguugguuucaucuucuggugcccacggcca

SEQ ID NO: 162538 - RNA, 32 nt, Human
gaguugguuuugaacuccuggccucccaaggu

SEQ ID NO: 162539 - RNA, 32 nt, Human
gaguuguacacauuuccaucagagaagauuuu

SEQ ID NO: 162540 - RNA, 32 nt, Human
gaguuguacauuuuugaagugugcagggcagc

SEQ ID NO: 162541 - RNA, 32 nt, Human
gaguuguagugagccgagaucaugacacugca

SEQ ID NO: 162542 - RNA, 32 nt, Human
gaguuguauuaaaaauaaacaagcauuucaaa

SEQ ID NO: 162543 - RNA, 32 nt, Human
gaguugucagcccuuaaaagagcuaggaauuu

SEQ ID NO: 162544 - RNA, 32 nt, Human
gaguugucaggggugucuucugccuggucuau

SEQ ID NO: 162545 - RNA, 32 nt, Human
gaguugucuauauucaugcacccaguccccua

SEQ ID NO: 162546 - RNA, 32 nt, Human
gaguugucucaggaccccgucacugcgacguu

SEQ ID NO: 162547 - RNA, 32 nt, Human
gaguugugagccaccgcugccagcccagaguu

SEQ ID NO: 162548 - RNA, 24 nt, Human
gaguugugaucgcaccacugcauu

SEQ ID NO: 162549 - RNA, 32 nt, Human
gaguugugccauucacagcacaguggugagga

SEQ ID NO: 162550 - RNA, 32 nt, Human
gaguuguggccaaacuucagcuggcuuggccc

SEQ ID NO: 162551 - RNA, 32 nt, Human
gaguugugucucgucuucugucuccauguggu

SEQ ID NO: 162552 - RNA, 29 nt, Human
gaguugugucugugugaccugagagugau

SEQ ID NO: 162553 - RNA, 32 nt, Human
gaguugugucuugucuucugucuccauguggu

SEQ ID NO: 162554 - RNA, 32 nt, Human
gaguuguuaauuucuugucaucuuuaaauaua

SEQ ID NO: 162555 - RNA, 32 nt, Human
gaguuguucccuuugaaauuaaagcuauuuug

SEQ ID NO: 162556 - RNA, 32 nt, Human
gaguuguucucagcccaguggaggguguucag

SEQ ID NO: 162557 - RNA, 32 nt, Human
gaguuguuucagugcuagaucuugccagcuaa

SEQ ID NO: 162558 - RNA, 32 nt, Human
gaguuguuucccaaucacccuacucacugauc

SEQ ID NO: 162559 - RNA, 32 nt, Human
gaguuguuucuccaacucuucgagcagcucag

SEQ ID NO: 162560 - RNA, 32 nt, Human
gaguuuaaagagagucuggcucugucgcccag

SEQ ID NO: 162561 - RNA, 32 nt, Human
gaguuuaagaacagaaugccuaguuguuagua

SEQ ID NO: 162562 - RNA, 32 nt, Human
gaguuuaagggcuaauaauuuaauuuguuguu

SEQ ID NO: 162563 - RNA, 32 nt, Human
gaguuuaauuacuucaggggaagagaagacaa

SEQ ID NO: 162564 - RNA, 32 nt, Human
gaguuuacagugagccgagauccugccacugc

SEQ ID NO: 162565 - RNA, 32 nt, Human
gaguuuaccaacaaauauugacugcagugauu

SEQ ID NO: 162566 - RNA, 32 nt, Human
gaguuuacucagagcucucugaagauguggca

SEQ ID NO: 162567 - RNA, 32 nt, Human
gaguuuacugacuucuagagccauucucuuua

SEQ ID NO: 162568 - RNA, 32 nt, Human
gaguuuaucccaaugacuucucuguuugaguu

SEQ ID NO: 162569 - RNA, 32 nt, Human
gaguuuaucugauuccuuaucaaccaugaucu

SEQ ID NO: 162570 - RNA, 32 nt, Human
gaguuuaucuugccauccuccccuucugguuc

SEQ ID NO: 162571 - RNA, 32 nt, Human
gaguuuaucuugccauccuccccuuuugguuc

SEQ ID NO: 162572 - RNA, 32 nt, Human
gaguuuaugccaagaaaacuuucugcugaaag

SEQ ID NO: 162573 - RNA, 32 nt, Human
gaguuuauugagugggagacaggcggcaggug

SEQ ID NO: 162574 - RNA, 32 nt, Human
gaguuucaauucuucuuugcaagcuccauucu

SEQ ID NO: 162575 - RNA, 32 nt, Human
gaguuucacuccuguuacccaggcuggaggac

SEQ ID NO: 162576 - RNA, 32 nt, Human
gaguuucacucucguugcccaggcuggagugc

SEQ ID NO: 162577 - RNA, 32 nt, Human
gaguuucacucugucucccaggcuggagugca

SEQ ID NO: 162578 - RNA, 32 nt, Human
gaguuucaggaggagagaaggaaggagaggug

SEQ ID NO: 162579 - RNA, 32 nt, Human
gaguuucagucaccuaaguacacccacaaaac

SEQ ID NO: 162580 - RNA, 32 nt, Human
gaguuucaucccugacagguggaugggugaaa

SEQ ID NO: 162581 - RNA, 32 nt, Human
gaguuucauucuguaauucagcaguucugggu

SEQ ID NO: 162582 - RNA, 32 nt, Human
gaguuuccaagcucugagucaccuccacauuu

SEQ ID NO: 162583 - RNA, 32 nt, Human
gaguuuccagcagcagagcuuuagguaugauu

SEQ ID NO: 162584 - RNA, 32 nt, Human
gaguuuccagggagaaugggaaagccaggggg

SEQ ID NO: 162585 - RNA, 32 nt, Human
gaguuuccagugcaagucaucuggauuugcau

SEQ ID NO: 162586 - RNA, 32 nt, Human
gaguuucccaaggcaauagagcagggggaaaa

SEQ ID NO: 162587 - RNA, 18 nt, Human
gaguuuccccagccguug

SEQ ID NO: 162588 - RNA, 32 nt, Human
gaguuucccucuuguugcccaggcuggaaaug

SEQ ID NO: 162589 - RNA, 32 nt, Human
gaguuucccucuuguugcccaggcuggagugc

SEQ ID NO: 162590 - RNA, 32 nt, Human
gaguuuccuagcuggugccuguccucucuuga

SEQ ID NO: 162591 - RNA, 32 nt, Human
gaguuuccuuuccugauuccaggcugggcucg

SEQ ID NO: 162592 - RNA, 32 nt, Human
gaguuucgcucuuguugcccagccuggccaac

SEQ ID NO: 162593 - RNA, 32 nt, Human
gaguuucgcuguuccagucuggaccucuuugg

SEQ ID NO: 162594 - RNA, 32 nt, Human
gaguuucgcuguuguugcccaggcuggagugc

SEQ ID NO: 162595 - RNA, 32 nt, Human
gaguuucucacaccaauucauuggguccaccc

SEQ ID NO: 162596 - RNA, 32 nt, Human
gaguuucucaucaagaugaaagcccuaauaug

SEQ ID NO: 162597 - RNA, 32 nt, Human
gaguuucuccaccucugccgaauggcuacuuc

SEQ ID NO: 162598 - RNA, 32 nt, Human
gaguuucucucuugucgcccaggcuggagugc

SEQ ID NO: 162599 - RNA, 32 nt, Human
gaguuucucucuugucucccaggcuggagugc

SEQ ID NO: 162600 - RNA, 32 nt, Human
gaguuucucucuuguuacccaggcuggagugc

SEQ ID NO: 162601 - RNA, 32 nt, Human
gaguuucucucuuguugcccaggcuggagugc

SEQ ID NO: 162602 - RNA, 32 nt, Human
gaguuucucuucccucuccauuggaaauccug

SEQ ID NO: 162603 - RNA, 32 nt, Human
gaguuucucuuuucuuuuccuugcucacaccc

SEQ ID NO: 162604 - RNA, 32 nt, Human
gaguuucugauucuguuucucaguaguccuuu

SEQ ID NO: 162605 - RNA, 32 nt, Human
gaguuucugcuuuugaaaauugcuuguaauuc

SEQ ID NO: 162606 - RNA, 32 nt, Human
gaguuucuuaucuuuuuccuggaccugaagcu

SEQ ID NO: 162607 - RNA, 32 nt, Human
gaguuucuucccagagagucugucccagaagg

SEQ ID NO: 162608 - RNA, 21 nt, Human
gaguuucuuugugaaaagguc

SEQ ID NO: 162609 - RNA, 32 nt, Human
gaguuugaaauacaugucucuuuuaguuucuu

SEQ ID NO: 162610 - RNA, 32 nt, Human
gaguuugacgaauuuacagaaggaggcuucag

SEQ ID NO: 162611 - RNA, 32 nt, Human
gaguuugagaagcaaggaccuaggcuggggau

SEQ ID NO: 162612 - RNA, 31 nt, Human
gaguuugagaccagcuuagccaacauaguaa

SEQ ID NO: 162613 - RNA, 31 nt, Human
gaguuugagaccaguccagccaacacggcaa

SEQ ID NO: 162614 - RNA, 32 nt, Human
gaguuugagaggagggaggugcuggggccaaa

SEQ ID NO: 162615 - RNA, 32 nt, Human
gaguuugagcuuccccacugccugacccugcu

SEQ ID NO: 162616 - RNA, 19 nt, Human
gaguuugaggcugcaguga

SEQ ID NO: 162617 - RNA, 32 nt, Human
gaguuugaggcugcagugaccuaugaccacau

SEQ ID NO: 162618 - RNA, 32 nt, Human
gaguuugaggcugcagugagcuaugaucgcac

SEQ ID NO: 162619 - RNA, 32 nt, Human
gaguuugaggcugcagugagcuaugauuaugc

SEQ ID NO: 162620 - RNA, 32 nt, Human
gaguuugaggcugcagugagcuaugauuccac

SEQ ID NO: 162621 - RNA, 32 nt, Human
gaguuugaggcugcagugagcuaugauugcac

SEQ ID NO: 162622 - RNA, 32 nt, Human
gaguuugaggcugcagugagcuaugauugugc

SEQ ID NO: 162623 - RNA, 32 nt, Human
gaguuugaggcugcagugcacuaugcuugcac

SEQ ID NO: 162624 - RNA, 32 nt, Human
gaguuugaguccuuguuauggucaucauaagg

SEQ ID NO: 162625 - RNA, 24 nt, Human
gaguuugagucugcagugagcuau

SEQ ID NO: 162626 - RNA, 32 nt, Human
gaguuugaucugcaggggcaggcucaucuuuu

SEQ ID NO: 162627 - RNA, 32 nt, Human
gaguuugcagucagccaagaucacgccacugu

SEQ ID NO: 162628 - RNA, 32 nt, Human
gaguuugcagugaaccaagaucacgccacugc

SEQ ID NO: 162629 - RNA, 32 nt, Human
gaguuugcagugagccaagauagugccaucgc

SEQ ID NO: 162630 - RNA, 32 nt, Human
gaguuugcagugagccaagaucgagccauugc

SEQ ID NO: 162631 - RNA, 32 nt, Human
gaguuugcagugagccaagaucucgccacugc

SEQ ID NO: 162632 - RNA, 32 nt, Human
gaguuugcagugagccgagauagugccauugu

SEQ ID NO: 162633 - RNA, 32 nt, Human
gaguuugcagugagccgagaucgugucacugc

SEQ ID NO: 162634 - RNA, 32 nt, Human
gaguuugcagugagcggagaugaugccacugu

SEQ ID NO: 162635 - RNA, 32 nt, Human
gaguuugcagugagcuaagaucgugccacugc

SEQ ID NO: 162636 - RNA, 32 nt, Human
gaguuugcagugagcugagaucacaccaucgc

SEQ ID NO: 162637 - RNA, 32 nt, Human
gaguuugcagugagcugagaucacaccauugc

SEQ ID NO: 162638 - RNA, 32 nt, Human
gaguuugcagugagcugagaucaugccacugc

SEQ ID NO: 162639 - RNA, 32 nt, Human
gaguuugcagugagcugagaucgugccacugc

SEQ ID NO: 162640 - RNA, 32 nt, Human
gaguuugcagugagcugagauggugccacugc

SEQ ID NO: 162641 - RNA, 32 nt, Human
gaguuugcagugagcugaggucacaccgcugc

SEQ ID NO: 162642 - RNA, 32 nt, Human
gaguuugcaucacugcacuccagccugggcaa

SEQ ID NO: 162643 - RNA, 32 nt, Human
gaguuugccguguuagcaaccacagucaccuu

SEQ ID NO: 162644 - RNA, 32 nt, Human
gaguuugccuagaggagacuaauucucuuucu

SEQ ID NO: 162645 - RNA, 32 nt, Human
gaguuugccucaguagauacuaaagcaaauug

SEQ ID NO: 162646 - RNA, 32 nt, Human
gaguuugcucuuguugaugaggcuggagugca

SEQ ID NO: 162647 - RNA, 32 nt, Human
gaguuugcugaacgaggacucacagcugcaac

SEQ ID NO: 162648 - RNA, 32 nt, Human
gaguuugcugacugggcccagccaacugaaga

SEQ ID NO: 162649 - RNA, 32 nt, Human
gaguuugcuggcagcacaagagaagccugugc

SEQ ID NO: 162650 - RNA, 32 nt, Human
gaguuugcuggcagcacaagggaagccugcgc

SEQ ID NO: 162651 - RNA, 32 nt, Human
gaguuugcuggcagcauaagagaagccugugc

SEQ ID NO: 162652 - RNA, 25 nt, Human
gaguuugcuguuugcaauuuuucca

SEQ ID NO: 162653 - RNA, 32 nt, Human
gaguuugcuucugauagggucagcuuucccau

SEQ ID NO: 162654 - RNA, 32 nt, Human
gaguuuggacaagcuccucuccagcuccucua

SEQ ID NO: 162655 - RNA, 32 nt, Human
gaguuuggcaaguccucugcuccuggaugccc

SEQ ID NO: 162656 - RNA, 32 nt, Human
gaguuugggagagaggagagaagugggugugg

SEQ ID NO: 162657 - RNA, 32 nt, Human
gaguuugggaguuggagguuucuuugaauauu

SEQ ID NO: 162658 - RNA, 32 nt, Human
gaguuugggccacugcacucuagccuggcaac

SEQ ID NO: 162659 - RNA, 32 nt, Human
gaguuugggccccagaggcugggugacaugug

SEQ ID NO: 162660 - RNA, 32 nt, Human
gaguuugggcugcaagugcucacagcucuugu

SEQ ID NO: 162661 - RNA, 32 nt, Human
gaguuuggggucaucagauguggcuuuaggcu

SEQ ID NO: 162662 - RNA, 32 nt, Human
gaguuugucuggaaagccucuugagauggggu

SEQ ID NO: 162663 - RNA, 32 nt, Human
gaguuugugcagaaugagcuugcugacacaca

SEQ ID NO: 162664 - RNA, 32 nt, Human
gaguuuguggugaguugagaucgcgccacugc

SEQ ID NO: 162665 - RNA, 32 nt, Human
gaguuuguguccuggaagucccagacucggcu

SEQ ID NO: 162666 - RNA, 32 nt, Human
gaguuugugugggcgggcgcaugugcaccaca

SEQ ID NO: 162667 - RNA, 32 nt, Human
gaguuuguugcccaggcuggagugaguggcac

SEQ ID NO: 162668 - RNA, 32 nt, Human
gaguuuuaaauuauuuaugugccuguugcuuc

SEQ ID NO: 162669 - RNA, 32 nt, Human
gaguuuuaacuguaaggugcuacaaugccccu

SEQ ID NO: 162670 - RNA, 31 nt, Human
gaguuuuaggaagucaguugucagagacagg

SEQ ID NO: 162671 - RNA, 32 nt, Human
gaguuuuagguuucaggggcaagagcaguuuu

SEQ ID NO: 162672 - RNA, 32 nt, Human
gaguuuucaaagcuuaggcuccaaacuccacg

SEQ ID NO: 162673 - RNA, 32 nt, Human
gaguuuucacuggccucacucagaccaauuuc

SEQ ID NO: 162674 - RNA, 32 nt, Human
gaguuuucagaaccugacauuguuaaacauac

SEQ ID NO: 162675 - RNA, 32 nt, Human
gaguuuucagaaccugacauuguuaaagauac

SEQ ID NO: 162676 - RNA, 32 nt, Human
gaguuuucagcuuuauaaauuguuaaacauuu

SEQ ID NO: 162677 - RNA, 32 nt, Human
gaguuuucagugagccaagaucaugccacugg

SEQ ID NO: 162678 - RNA, 23 nt, Human
gaguuuucccaaagcagugucca

SEQ ID NO: 162679 - RNA, 32 nt, Human
gaguuuucccgcaguucaguuccugacugugc

SEQ ID NO: 162680 - RNA, 32 nt, Human
gaguuuuccuuuaaccuggacuguguuucuca

SEQ ID NO: 162681 - RNA, 32 nt, Human
gaguuuucgaggugacugugcugugcucggug

SEQ ID NO: 162682 - RNA, 32 nt, Human
gaguuuucuuagugaagggcuaccuuucugug

SEQ ID NO: 162683 - RNA, 32 nt, Human
gaguuuugaagugccuaagaugaccuauuugu

SEQ ID NO: 162684 - RNA, 32 nt, Human
gaguuuugauaaggagagggaucugcuuguua

SEQ ID NO: 162685 - RNA, 32 nt, Human
gaguuuugaugucaaauauauuucucuuucag

SEQ ID NO: 162686 - RNA, 32 nt, Human
gaguuuugcauuaagcauauccuugaagacaa

SEQ ID NO: 162687 - RNA, 32 nt, Human
gaguuuugcccaggccugcugucuugaguaca

SEQ ID NO: 162688 - RNA, 32 nt, Human
gaguuuugcccuucuugcccaggcuggagugc

SEQ ID NO: 162689 - RNA, 32 nt, Human
gaguuuugccuaggccuuuccugggccuuaaa

SEQ ID NO: 162690 - RNA, 32 nt, Human
gaguuuugcuaaaaucauccuauuacuuauga

SEQ ID NO: 162691 - RNA, 32 nt, Human
gaguuuugcucuugcacuccauccuggacaac

SEQ ID NO: 162692 - RNA, 32 nt, Human
gaguuuugggagagagcagagguaaacaugau

SEQ ID NO: 162693 - RNA, 24 nt, Human
gaguuuuggguggagacacagcca

SEQ ID NO: 162694 - RNA, 32 nt, Human
gaguuuuggugacuuuugucaccuggacacac

SEQ ID NO: 162695 - RNA, 32 nt, Human
gaguuuuguaauggaagaaccaggcacagaaa

SEQ ID NO: 162696 - RNA, 32 nt, Human
gaguuuuguguguacacacacagaaacaugua

SEQ ID NO: 162697 - RNA, 32 nt, Human
gaguuuuucagccuguggcccagcacugguca

SEQ ID NO: 162698 - RNA, 32 nt, Human
gaguuuuuguggaauuaaagugcugcugcugc

SEQ ID NO: 162699 - RNA, 32 nt, Human
gauaaaaacacccagcugggugcaguggcucg

SEQ ID NO: 162700 - RNA, 20 nt, Human
gauaaaaaccugguuucaaa

SEQ ID NO: 162701 - RNA, 32 nt, Human
gauaaaaagccuuggugcuucccaggagccga

SEQ ID NO: 162702 - RNA, 32 nt, Human
gauaaaaaguggaauuucuuguuucuccagau

SEQ ID NO: 162703 - RNA, 32 nt, Human
gauaaaaauggagccugaagggaaucaggcaa

SEQ ID NO: 162704 - RNA, 32 nt, Human
gauaaaacaaauuuccuuacaaaagggcacuu

SEQ ID NO: 162705 - RNA, 32 nt, Human
gauaaaagaggccuaguaauguucuuuugagg

SEQ ID NO: 162706 - RNA, 32 nt, Human
gauaaaagccacugcagugugcagugagaaac

SEQ ID NO: 162707 - RNA, 32 nt, Human
gauaaaaggagcgaccgcucagcagcgagagg

SEQ ID NO: 162708 - RNA, 32 nt, Human
gauaaaaggcuugcagucccagcugggaaaaa

SEQ ID NO: 162709 - RNA, 32 nt, Human
gauaaaagggagcauggguguuggggagacac

SEQ ID NO: 162710 - RNA, 32 nt, Human
gauaaaaguagaaggcacaggagagguagcaa

SEQ ID NO: 162711 - RNA, 32 nt, Human
gauaaaagugaguguguuuugucgggagggaa

SEQ ID NO: 162712 - RNA, 32 nt, Human
gauaaaauacugccuucugccuuugggaccau

SEQ ID NO: 162713 - RNA, 32 nt, Human
gauaaaaucaugggagagggcaguaggauguu

SEQ ID NO: 162714 - RNA, 22 nt, Human
gauaaaauuuaaugacaguuua

SEQ ID NO: 162715 - RNA, 32 nt, Human
gauaaacaaaacugaucaacccaaugugauuu

SEQ ID NO: 162716 - RNA, 32 nt, Human
gauaaacaagauaaacacuaggugcuuuugaa

SEQ ID NO: 162717 - RNA, 32 nt, Human
gauaaacacagcuguuuucuuuacucaugaga

SEQ ID NO: 162718 - RNA, 32 nt, Human
gauaaacaccuuaaaugucuugucaacuggau

SEQ ID NO: 162719 - RNA, 32 nt, Human
gauaaaccaaaacugggaaggccaaguacagu

SEQ ID NO: 162720 - RNA, 32 nt, Human
gauaaaccaaagauuuagaagucauuccauug

SEQ ID NO: 162721 - RNA, 32 nt, Human
gauaaaccaaguuuuuggaaaugguccuguua

SEQ ID NO: 162722 - RNA, 32 nt, Human
gauaaaccuaucucaguggucagccccugggg

SEQ ID NO: 162723 - RNA, 32 nt, Human
gauaaacgucaucugcugggggugucacuuca

SEQ ID NO: 162724 - RNA, 31 nt, Human
gauaaacuaggaauuuugucacuggaguuuu

SEQ ID NO: 162725 - RNA, 32 nt, Human
gauaaacuauaugguccucccagcuucaguac

SEQ ID NO: 162726 - RNA, 32 nt, Human
gauaaacuccaaacggaucaggagucuaaaug

SEQ ID NO: 162727 - RNA, 32 nt, Human
gauaaacucuguggugcuguuggaucagguau

SEQ ID NO: 162728 - RNA, 32 nt, Human
gauaaacugccucgucugaucuuguggccccc

SEQ ID NO: 162729 - RNA, 32 nt, Human
gauaaacugcugccuggggcugugggaugaau

SEQ ID NO: 162730 - RNA, 32 nt, Human
gauaaacugucauucauucacuucucccaugu

SEQ ID NO: 162731 - RNA, 32 nt, Human
gauaaacuuacaccacauacuuggugggugaa

SEQ ID NO: 162732 - RNA, 32 nt, Human
gauaaagaaaaauagacaaccaguucgcauuu

SEQ ID NO: 162733 - RNA, 32 nt, Human
gauaaagaaaaaugaaaacugaaucggugccu

SEQ ID NO: 162734 - RNA, 32 nt, Human
gauaaagaccuuauuaauacggggaucuguga

SEQ ID NO: 162735 - RNA, 32 nt, Human
gauaaagacugggcugccaaggaggacuccuc

SEQ ID NO: 162736 - RNA, 32 nt, Human
gauaaagaguuaggaugcucaaaagugaacua

SEQ ID NO: 162737 - RNA, 32 nt, Human
gauaaagaugcugaguuuagagucugcaaggc

SEQ ID NO: 162738 - RNA, 32 nt, Human
gauaaagcaacaaaagauuugucccaagcugc

SEQ ID NO: 162739 - RNA, 32 nt, Human
gauaaagcauuugaaugguacaguagauguaa

SEQ ID NO: 162740 - RNA, 32 nt, Human
gauaaagccacugcacucaaacguggggaaca

SEQ ID NO: 162741 - RNA, 32 nt, Human
gauaaagccccuaccagugcugauaaagucuu

SEQ ID NO: 162742 - RNA, 32 nt, Human
gauaaagcccgugaaacauuaguagaaaauac

SEQ ID NO: 162743 - RNA, 32 nt, Human
gauaaagcugaggaggaggcugugugugaugg

SEQ ID NO: 162744 - RNA, 32 nt, Human
gauaaaggaaagagauguggcuuuugugauau

SEQ ID NO: 162745 - RNA, 32 nt, Human
gauaaaggaagugcuggucacccuggaggugc

SEQ ID NO: 162746 - RNA, 32 nt, Human
gauaaaggaagugcuggucacccuggaggugu

SEQ ID NO: 162747 - RNA, 20 nt, Human
gauaaaggacugugcuuuaa

SEQ ID NO: 162748 - RNA, 32 nt, Human
gauaaaggaucucauugaucagcugggugagg

SEQ ID NO: 162749 - RNA, 32 nt, Human
gauaaaggcaaaacucaacagccccuggagcu

SEQ ID NO: 162750 - RNA, 32 nt, Human
gauaaaggggaagauagaaacacacacauaug

SEQ ID NO: 162751 - RNA, 32 nt, Human
gauaaaggggaagugaggagaauuucuuucaa

SEQ ID NO: 162752 - RNA, 32 nt, Human
gauaaaguaugagugaaaaagagacugaaggu

SEQ ID NO: 162753 - RNA, 32 nt, Human
gauaaagucuugggcugggugcaguggcucau

SEQ ID NO: 162754 - RNA, 32 nt, Human
gauaaauaaagugguacugaaacacagccaca

SEQ ID NO: 162755 - RNA, 32 nt, Human
gauaaauaaauaaauaaauuagccuggcgugg

SEQ ID NO: 162756 - RNA, 32 nt, Human
gauaaauaauggagcaugcagugagcacaucu

SEQ ID NO: 162757 - RNA, 32 nt, Human
gauaaauacaucugguauggcagaaacuccgu

SEQ ID NO: 162758 - RNA, 32 nt, Human
gauaaauaccauuaucccucugggcacacaga

SEQ ID NO: 162759 - RNA, 32 nt, Human
gauaaauacuucaugaaaacuaaagucugaaa

SEQ ID NO: 162760 - RNA, 32 nt, Human
gauaaauagaauacacagaauagugaugaaau

SEQ ID NO: 162761 - RNA, 32 nt, Human
gauaaaucaagaguccucagcacuccacauuc

SEQ ID NO: 162762 - RNA, 32 nt, Human
gauaaauccgauaacauauauguccucaaucu

SEQ ID NO: 162763 - RNA, 32 nt, Human
gauaaaucuaauucuuaacucuauuucuccag

SEQ ID NO: 162764 - RNA, 32 nt, Human
gauaaaugccuguagucccagccacugaagcc

SEQ ID NO: 162765 - RNA, 32 nt, Human
gauaaaugggcuagagaggcagaggaaggcua

SEQ ID NO: 162766 - RNA, 21 nt, Human
gauaaauggguuucaagcaca

SEQ ID NO: 162767 - RNA, 32 nt, Human
gauaaauguugauguuuucuguguacaaacac

SEQ ID NO: 162768 - RNA, 32 nt, Human
gauaaauuauuuccucagcuaucuuuggauga

SEQ ID NO: 162769 - RNA, 32 nt, Human
gauaaauuccucucccuccucuccuuuccucu

SEQ ID NO: 162770 - RNA, 32 nt, Human
gauaaauuuaauccuucuuuguaauacuuucu

SEQ ID NO: 162771 - RNA, 32 nt, Human
gauaaauuucucagcuuguccagaccuggaac

SEQ ID NO: 162772 - RNA, 32 nt, Human
gauaaauuuguuguauuccaaaacuugaaaug

SEQ ID NO: 162773 - RNA, 32 nt, Human
gauaacaaaauacuucuccucuuuccauuuuc

SEQ ID NO: 162774 - RNA, 32 nt, Human
gauaacaacugcacuccagccuggaugacaga

SEQ ID NO: 162775 - RNA, 32 nt, Human
gauaacaagccugaaaccacacaguacgacag

SEQ ID NO: 162776 - RNA, 32 nt, Human
gauaacacauuugauucuguguguuuuccaua

SEQ ID NO: 162777 - RNA, 23 nt, Human
gauaacaccacugcacuccugcu

SEQ ID NO: 162778 - RNA, 32 nt, Human
gauaacacgcaaaaucacaaaguagcauaaau

SEQ ID NO: 162779 - RNA, 32 nt, Human
gauaacacuacugcauuccagccugggugaca

SEQ ID NO: 162780 - RNA, 32 nt, Human
gauaacacuuaccaaaagaucacugcaaaccu

SEQ ID NO: 162781 - RNA, 32 nt, Human
gauaacagccaaagauagaauuccaaguuaua

SEQ ID NO: 162782 - RNA, 32 nt, Human
gauaacagcuccaagggguuauuuucuugcau

SEQ ID NO: 162783 - RNA, 32 nt, Human
gauaacagcuugcacccuccucagaauguuuu

SEQ ID NO: 162784 - RNA, 32 nt, Human
gauaacaguaccuagagagagaguguguguga

SEQ ID NO: 162785 - RNA, 21 nt, Human
gauaacaguaugguacugcuu

SEQ ID NO: 162786 - RNA, 32 nt, Human
gauaacaguguaacacauuugagaucuuuucc

SEQ ID NO: 162787 - RNA, 32 nt, Human
gauaacagugugccugguuaauauuaauauuc

SEQ ID NO: 162788 - RNA, 32 nt, Human
gauaacauacaaaaucuuuuuguaacguaaaa

SEQ ID NO: 162789 - RNA, 32 nt, Human
gauaacauaguuuauuuuuacacugucuuauu

SEQ ID NO: 162790 - RNA, 32 nt, Human
gauaacauuucaguaccugaauagaugucauu

SEQ ID NO: 162791 - RNA, 32 nt, Human
gauaaccaaauucugucacucaagacacagac

SEQ ID NO: 162792 - RNA, 32 nt, Human
gauaaccagugucaccuacaacauggaaugga

SEQ ID NO: 162793 - RNA, 32 nt, Human
gauaacccaagugucccacaggccaagguaca

SEQ ID NO: 162794 - RNA, 32 nt, Human
gauaaccccuuucuccccuuuggaccaucugc

SEQ ID NO: 162795 - RNA, 32 nt, Human
gauaacccuaugucuccucccccagaauccuu

SEQ ID NO: 162796 - RNA, 32 nt, Human
gauaaccgaacagagguauggaacagaaaggg

SEQ ID NO: 162797 - RNA, 32 nt, Human
gauaaccugggacugaccguucccuggggauc

SEQ ID NO: 162798 - RNA, 32 nt, Human
gauaaccugugggguuagaacauaucacauug

SEQ ID NO: 162799 - RNA, 32 nt, Human
gauaaccuuccagauaaagaguugcugcuacc

SEQ ID NO: 162800 - RNA, 32 nt, Human
gauaaccuuugaaccuugaauuuuggagaugu

SEQ ID NO: 162801 - RNA, 32 nt, Human
gauaacgacugcacuccagccuggaugacaga

SEQ ID NO: 162802 - RNA, 32 nt, Human
gauaacgcagggcggucuucugcuccaugcuc

SEQ ID NO: 162803 - RNA, 32 nt, Human
gauaacgccacugcacuccaguguaggcaaca

SEQ ID NO: 162804 - RNA, 32 nt, Human
gauaacgggucauaaagaaccugcugauaaaa

SEQ ID NO: 162805 - RNA, 32 nt, Human
gauaacguaggucuagagcuucuuuuauauuc

SEQ ID NO: 162806 - RNA, 32 nt, Human
gauaacuauacagcucaacaacuagaaaaaua

SEQ ID NO: 162807 - RNA, 32 nt, Human
gauaacucaagaaaucaaaagauaguugauuc

SEQ ID NO: 162808 - RNA, 32 nt, Human
gauaacucacaacccuaccaaugcuacucuca

SEQ ID NO: 162809 - RNA, 32 nt, Human
gauaacugaauuauauccauuucuaaaguaug

SEQ ID NO: 162810 - RNA, 32 nt, Human
gauaacugcauccuucauuccaggaaagcccu

SEQ ID NO: 162811 - RNA, 32 nt, Human
gauaacugcuuauccagguuugguguccugug

SEQ ID NO: 162812 - RNA, 32 nt, Human
gauaacugggauuacaggugcccaccaccaug

SEQ ID NO: 162813 - RNA, 32 nt, Human
gauaacuguguacuucuggugacuguacaguu

SEQ ID NO: 162814 - RNA, 32 nt, Human
gauaacuguugaaucuggaugagggcaugugg

SEQ ID NO: 162815 - RNA, 32 nt, Human
gauaacuucaagaucauaccacuggacuaaga

SEQ ID NO: 162816 - RNA, 32 nt, Human
gauaacuuggggaggcaagagacugggagcca

SEQ ID NO: 162817 - RNA, 32 nt, Human
gauaacuuuguaagaugggagacaucugaaau

SEQ ID NO: 162818 - RNA, 32 nt, Human
gauaagaaaauguaaugaauuuuaucagauau

SEQ ID NO: 162819 - RNA, 32 nt, Human
gauaagaaacuaagggccacagaccaaaugac

SEQ ID NO: 162820 - RNA, 32 nt, Human
gauaagaaauacauuuguuuuauacuucuaug

SEQ ID NO: 162821 - RNA, 32 nt, Human
gauaagaacucuaacaaacacaagguauuuug

SEQ ID NO: 162822 - RNA, 32 nt, Human
gauaagaaugauaauguacuuauuuacaaggu

SEQ ID NO: 162823 - RNA, 32 nt, Human
gauaagaaugugccucucaagccuugacuccc

SEQ ID NO: 162824 - RNA, 16 nt, Human
gauaagagacacagca

SEQ ID NO: 162825 - RNA, 32 nt, Human
gauaagagcuaaaccaccugccacuggggacu

SEQ ID NO: 162826 - RNA, 32 nt, Human
gauaagaggagacuugagagcuugcuucuucu

SEQ ID NO: 162827 - RNA, 32 nt, Human
gauaagaggaggcucacuugagcccaggaggu

SEQ ID NO: 162828 - RNA, 32 nt, Human
gauaagaggauugggccaggugcaguggauca

SEQ ID NO: 162829 - RNA, 32 nt, Human
gauaagaguaucuugcacagcaggugcagguu

SEQ ID NO: 162830 - RNA, 32 nt, Human
gauaagaugauggcuacauuccauuccuaucc

SEQ ID NO: 162831 - RNA, 32 nt, Human
gauaagcaaaagaaauaguuagaugaagaagu

SEQ ID NO: 162832 - RNA, 32 nt, Human
gauaagcaaagccacacacaauauuguugguu

SEQ ID NO: 162833 - RNA, 32 nt, Human
gauaagccaccacacccagccuagagaccucu

SEQ ID NO: 162834 - RNA, 32 nt, Human
gauaagccuccccucaugaaaugccacucacc

SEQ ID NO: 162835 - RNA, 32 nt, Human
gauaagccugcaaccucuugaccuucagcucc

SEQ ID NO: 162836 - RNA, 32 nt, Human
gauaagcggccuguccugccuccugggagaag

SEQ ID NO: 162837 - RNA, 32 nt, Human
gauaagcuauugcagcacuuucugaggcuuuc

SEQ ID NO: 162838 - RNA, 21 nt, Human
gauaagcucugugaaagagaa

SEQ ID NO: 162839 - RNA, 32 nt, Human
gauaagcucugugcuguguccauggcccguca

SEQ ID NO: 162840 - RNA, 32 nt, Human
gauaaggaaagaaaaugucguuguuguuguuu

SEQ ID NO: 162841 - RNA, 32 nt, Human
gauaaggaagcaccuagacuccacucugacca

SEQ ID NO: 162842 - RNA, 32 nt, Human
gauaaggagcaggugcuuugcugcagucuccc

SEQ ID NO: 162843 - RNA, 32 nt, Human
gauaaggaugauacagucuccauaaggcagug

SEQ ID NO: 162844 - RNA, 32 nt, Human
gauaaggauuccagauggcacuugagugaaga

SEQ ID NO: 162845 - RNA, 32 nt, Human
gauaaggcccuggaguccaccuccaggcuggg

SEQ ID NO: 162846 - RNA, 32 nt, Human
gauaaggcccuucagccccaagguuguccucg

SEQ ID NO: 162847 - RNA, 32 nt, Human
gauaaggcucacagcccugagcucuuuacggg

SEQ ID NO: 162848 - RNA, 30 nt, Human
gauaagggaagccacaaggagacgaucgag

SEQ ID NO: 162849 - RNA, 32 nt, Human
gauaagggaggcggagugugcggagaggaggc

SEQ ID NO: 162850 - RNA, 32 nt, Human
gauaagggauuggccaaggcugugugcauccu

SEQ ID NO: 162851 - RNA, 32 nt, Human
gauaaggggcagagauggaggccccacucccc

SEQ ID NO: 162852 - RNA, 32 nt, Human
gauaaggugaagggauuaaaaauguacguaaa

SEQ ID NO: 162853 - RNA, 32 nt, Human
gauaaguaaacaaugcauaaacuaguagacuu

SEQ ID NO: 162854 - RNA, 32 nt, Human
gauaaguacuggucaguggcccagggguuggg

SEQ ID NO: 162855 - RNA, 32 nt, Human
gauaaguaggauucagagucucuucuccuagc

SEQ ID NO: 162856 - RNA, 32 nt, Human
gauaaguccccaaggcugcauguauuagcagg

SEQ ID NO: 162857 - RNA, 32 nt, Human
gauaagucuguggcccaauccccuuccucucc

SEQ ID NO: 162858 - RNA, 32 nt, Human
gauaaguggggacuggggacaugugaaaugau

SEQ ID NO: 162859 - RNA, 31 nt, Human
gauaagugggugggaggcacggggaagguuu

SEQ ID NO: 162860 - RNA, 32 nt, Human
gauaaguucccuuuucucauuuuguugagagu

SEQ ID NO: 162861 - RNA, 32 nt, Human
gauaauaagccacauaugaauguuguauacaa

SEQ ID NO: 162862 - RNA, 17 nt, Human
gauaauaauaugggguc

SEQ ID NO: 162863 - RNA, 32 nt, Human
gauaauaaucuuggcucaguuuguauaaacug

SEQ ID NO: 162864 - RNA, 32 nt, Human
gauaauacauggccaguaaucccaggcuggcc

SEQ ID NO: 162865 - RNA, 32 nt, Human
gauaauacccuugaaaucagagaaugaggugc

SEQ ID NO: 162866 - RNA, 32 nt, Human
gauaauacccuuucauacuuccuugacuuugu

SEQ ID NO: 162867 - RNA, 32 nt, Human
gauaauaccuaagaggaacacuguaaaaugcc

SEQ ID NO: 162868 - RNA, 32 nt, Human
gauaauacuguacuucaucuuacuugccacaa

SEQ ID NO: 162869 - RNA, 32 nt, Human
gauaauacuguacuucaucuuacuugccacua

SEQ ID NO: 162870 - RNA, 32 nt, Human
gauaauacuguacuucaucuuauuugccacaa

SEQ ID NO: 162871 - RNA, 32 nt, Human
gauaauagagggcuggaauuuaaaccuguauu

SEQ ID NO: 162872 - RNA, 32 nt, Human
gauaauaggguuuucagaugaaaagaaaacuu

SEQ ID NO: 162873 - RNA, 22 nt, Human
gauaauaucaugaacugauaaa

SEQ ID NO: 162874 - RNA, 32 nt, Human
gauaauaugccccugcacuugagaccuuacuu

SEQ ID NO: 162875 - RNA, 32 nt, Human
gauaauauggcggcuggagcugccugggcauc

SEQ ID NO: 162876 - RNA, 31 nt, Human
gauaaucacagcuggcuuaucaauauugcug

SEQ ID NO: 162877 - RNA, 32 nt, Human
gauaaucagagcuugaggcuggcacucugacu

SEQ ID NO: 162878 - RNA, 32 nt, Human
gauaaucaggagaagaaaaggagauccagaau

SEQ ID NO: 162879 - RNA, 32 nt, Human
gauaaucaggagaagaaaaggagauccagacu

SEQ ID NO: 162880 - RNA, 32 nt, Human
gauaaucaguugaacccaggagguggagguug

SEQ ID NO: 162881 - RNA, 32 nt, Human
gauaauccacaugcucccuccccagcuccacu

SEQ ID NO: 162882 - RNA, 32 nt, Human
gauaauccaccucccuaucccccaggcaaggg

SEQ ID NO: 162883 - RNA, 31 nt, Human
gauaauccacugucucccaucccaggaggug

SEQ ID NO: 162884 - RNA, 32 nt, Human
gauaauccauuuucucacccugacaaacucaa

SEQ ID NO: 162885 - RNA, 32 nt, Human
gauaaucccaccguuucuggcaugucagauau

SEQ ID NO: 162886 - RNA, 32 nt, Human
gauaaucccacugcauuccagccugggcaaca

SEQ ID NO: 162887 - RNA, 32 nt, Human
gauaauccccugucccccuccuccuccccacu

SEQ ID NO: 162888 - RNA, 32 nt, Human
gauaaucggcggccggggcugaagggagaggc

SEQ ID NO: 162889 - RNA, 32 nt, Human
gauaaucgggcuuccuacuggcccaggguauu

SEQ ID NO: 162890 - RNA, 32 nt, Human
gauaaucuaagucuuccaaugccugcaucaaa

SEQ ID NO: 162891 - RNA, 32 nt, Human
gauaaucuagcuucuccaccucuuguuucaca

SEQ ID NO: 162892 - RNA, 32 nt, Human
gauaaucucagugcuuuccuccuucacuguuu

SEQ ID NO: 162893 - RNA, 32 nt, Human
gauaaucucauuaauccuccacucaaccuuca

SEQ ID NO: 162894 - RNA, 32 nt, Human
gauaaucugaugcugaagaucaaauaaccaau

SEQ ID NO: 162895 - RNA, 32 nt, Human
gauaaucuuuguaauauguccaagagagugug

SEQ ID NO: 162896 - RNA, 32 nt, Human
gauaaugaaagccaggaguuucugggguuucc

SEQ ID NO: 162897 - RNA, 32 nt, Human
gauaaugauaaagauaccucagcaagaacaua

SEQ ID NO: 162898 - RNA, 32 nt, Human
gauaaugauucccagcccaggagcugaggggu

SEQ ID NO: 162899 - RNA, 32 nt, Human
gauaaugcauuacauguuuuucuguugcaugu

SEQ ID NO: 162900 - RNA, 32 nt, Human
gauaaugccacugcacuccagccugccuggau

SEQ ID NO: 162901 - RNA, 32 nt, Human
gauaaugcuggaugccuugcagacaucauuca

SEQ ID NO: 162902 - RNA, 32 nt, Human
gauaauggagccagggccuuguagaagcacag

SEQ ID NO: 162903 - RNA, 32 nt, Human
gauaaugggcaggcacccggcagggaggacaa

SEQ ID NO: 162904 - RNA, 32 nt, Human
gauaauggggagcacagaaggccaguugcuga

SEQ ID NO: 162905 - RNA, 32 nt, Human
gauaaugggugagagagcagguaagagccaaa

SEQ ID NO: 162906 - RNA, 32 nt, Human
gauaaugguuguacugaagaugacaccuccuc

SEQ ID NO: 162907 - RNA, 32 nt, Human
gauaaugugagauucuuuagccacuuugggga

SEQ ID NO: 162908 - RNA, 32 nt, Human
gauaaugugucuaaaaauauugcugaaguuau

SEQ ID NO: 162909 - RNA, 32 nt, Human
gauaauguugccaaacuuuggaaauguuaaug

SEQ ID NO: 162910 - RNA, 32 nt, Human
gauaauuacaaaaggcagauagaguaauuauu

SEQ ID NO: 162911 - RNA, 32 nt, Human
gauaauuacuggcaccugccucccaggccauu

SEQ ID NO: 162912 - RNA, 32 nt, Human
gauaauuauugcaccacugaacuccagccugg

SEQ ID NO: 162913 - RNA, 32 nt, Human
gauaauucauucuucaccugguucaaaaauca

SEQ ID NO: 162914 - RNA, 32 nt, Human
gauaauucucacguucacaccugguggcaggc

SEQ ID NO: 162915 - RNA, 32 nt, Human
gauaauuggaaaccuucaucacugagguuggc

SEQ ID NO: 162916 - RNA, 32 nt, Human
gauaauuggugacugaggaagauggugaagau

SEQ ID NO: 162917 - RNA, 32 nt, Human
gauaauugugcacaccugaguucacagcuuca

SEQ ID NO: 162918 - RNA, 32 nt, Human
gauaauuuauuuuuaccuucacugugaccuug

SEQ ID NO: 162919 - RNA, 32 nt, Human
gauaauuucuuaaauauugaugaacuuuggag

SEQ ID NO: 162920 - RNA, 32 nt, Human
gauaauuugugucgauggauguucugugaagg

SEQ ID NO: 162921 - RNA, 32 nt, Human
gauaauuuucagcuaauuaucugggugaccca

SEQ ID NO: 162922 - RNA, 32 nt, Human
gauaauuuuguaucuugguugcaguggugcuu

SEQ ID NO: 162923 - RNA, 32 nt, Human
gauacaaaauuagccaggcaugguggugcaug

SEQ ID NO: 162924 - RNA, 32 nt, Human
gauacaaaauuagccgggcaugguggcacacg

SEQ ID NO: 162925 - RNA, 32 nt, Human
gauacaaacuacuaaacuaaaaagcaaacaca

SEQ ID NO: 162926 - RNA, 32 nt, Human
gauacaaagaauugaaaaguguggaggaucug

SEQ ID NO: 162927 - RNA, 32 nt, Human
gauacaaccugacagcacagccugagaucuug

SEQ ID NO: 162928 - RNA, 32 nt, Human
gauacaagagucagcaucauuaaaggaaacgu

SEQ ID NO: 162929 - RNA, 32 nt, Human
gauacaaugcacgauucucugcgcgcaaggac

SEQ ID NO: 162930 - RNA, 31 nt, Human
gauacaauguauaagcuacucacuuaucuga

SEQ ID NO: 162931 - RNA, 21 nt, Human
gauacacaaauaagucaguua

SEQ ID NO: 162932 - RNA, 16 nt, Human
gauacacaaaugguca

SEQ ID NO: 162933 - RNA, 32 nt, Human
gauacacaaugccaucacaguacacaugaaca

SEQ ID NO: 162934 - RNA, 19 nt, Human
gauacacaauuuguaguua

SEQ ID NO: 162935 - RNA, 32 nt, Human
gauacacacaacaaugagaacucagugacuuu

SEQ ID NO: 162936 - RNA, 16 nt, Human
gauacacagcauguug

SEQ ID NO: 162937 - RNA, 22 nt, Human
gauacacuuuauaacauuuuau

SEQ ID NO: 162938 - RNA, 22 nt, Human
gauacacuuuugucuuugcuau

SEQ ID NO: 162939 - RNA, 32 nt, Human
gauacagaaaugcaaaagauacggcccaugca

SEQ ID NO: 162940 - RNA, 32 nt, Human
gauacagaaguauugcagcccagauccccuau

SEQ ID NO: 162941 - RNA, 32 nt, Human
gauacagacaguuccaagauugacaacagaga

SEQ ID NO: 162942 - RNA, 32 nt, Human
gauacagcaaacaugucugacaaagagcuaaa

SEQ ID NO: 162943 - RNA, 32 nt, Human
gauacagccagccaggccugucgucugggacc

SEQ ID NO: 162944 - RNA, 32 nt, Human
gauacagccauggcuaggaaggacaagaaguu

SEQ ID NO: 162945 - RNA, 32 nt, Human
gauacagcuuuccauguggcucagggaacagu

SEQ ID NO: 162946 - RNA, 32 nt, Human
gauacagggugaucuguuuggccccgccccca

SEQ ID NO: 162947 - RNA, 32 nt, Human
gauacaggguuucaccacguugcucaggcugg

SEQ ID NO: 162948 - RNA, 32 nt, Human
gauacagucauaggggguugcagugagguuuu

SEQ ID NO: 162949 - RNA, 32 nt, Human
gauacagucauuuugccucuacuugaggauca

SEQ ID NO: 162950 - RNA, 32 nt, Human
gauacagucugcacuuucacccguuucagggu

SEQ ID NO: 162951 - RNA, 32 nt, Human
gauacauaguuguauauagaaaaugcuaaaga

SEQ ID NO: 162952 - RNA, 32 nt, Human
gauacauauaaauauauuacaagaucauaauu

SEQ ID NO: 162953 - RNA, 32 nt, Human
gauacaucacaaggaggaagaaggagaaguug

SEQ ID NO: 162954 - RNA, 32 nt, Human
gauacaucacacuugagucaaauccuggauac

SEQ ID NO: 162955 - RNA, 31 nt, Human
gauacaucagaggugaauaccagcaccuauu

SEQ ID NO: 162956 - RNA, 32 nt, Human
gauacaucauuucuauauuccuugcuuaauuu

SEQ ID NO: 162957 - RNA, 32 nt, Human
gauacaucguaaacuccgccuccacggaacgu

SEQ ID NO: 162958 - RNA, 32 nt, Human
gauacaucucucuuaaaaaggcagagcacagg

SEQ ID NO: 162959 - RNA, 32 nt, Human
gauacaugccuguaauccuggcuacuugggag

SEQ ID NO: 162960 - RNA, 32 nt, Human
gauacaugccuguggucucagcuacucgggag

SEQ ID NO: 162961 - RNA, 32 nt, Human
gauacaugccuguggucucagcuacuugggag

SEQ ID NO: 162962 - RNA, 32 nt, Human
gauacauggaaggaaguggaaccagaugcaga

SEQ ID NO: 162963 - RNA, 32 nt, Human
gauacauuucacucacccuccaccccugcuau

SEQ ID NO: 162964 - RNA, 25 nt, Human
gauacauuuuaagcuugauuaucau

SEQ ID NO: 162965 - RNA, 32 nt, Human
gauaccaaaaucaggagcaucuugggauuuau

SEQ ID NO: 162966 - RNA, 32 nt, Human
gauaccaaccucuuuccuuuggaaguaggaaa

SEQ ID NO: 162967 - RNA, 32 nt, Human
gauaccaauaaaacaugucacuaguuuccaaa

SEQ ID NO: 162968 - RNA, 32 nt, Human
gauaccacaagucuuuugacaugcugaggucu

SEQ ID NO: 162969 - RNA, 32 nt, Human
gauaccacucagucucuuuccccagccacccc

SEQ ID NO: 162970 - RNA, 32 nt, Human
gauaccacuugcuguaggcuguggaccaagau

SEQ ID NO: 162971 - RNA, 32 nt, Human
gauaccagcaccccacuccagccucgaggaag

SEQ ID NO: 162972 - RNA, 32 nt, Human
gauaccagcacuuuugggaggcugaggcgggu

SEQ ID NO: 162973 - RNA, 32 nt, Human
gauaccagccugggcaacauagugggauccug

SEQ ID NO: 162974 - RNA, 32 nt, Human
gauaccagcuacuugggaggcugaggcagaag

SEQ ID NO: 162975 - RNA, 32 nt, Human
gauaccagcugagucugaauucugcucuaaau

SEQ ID NO: 162976 - RNA, 32 nt, Human
gauaccagggcccagacagaggcagagagucc

SEQ ID NO: 162977 - RNA, 32 nt, Human
gauaccaucccccagacccgauccauucaguc

SEQ ID NO: 162978 - RNA, 32 nt, Human
gauacccacugcccugaccccugggcaggccc

SEQ ID NO: 162979 - RNA, 32 nt, Human
gauacccacugcuuagaguuauugugagaauu

SEQ ID NO: 162980 - RNA, 32 nt, Human
gauacccagaacaacauuaaaucaaugaguga

SEQ ID NO: 162981 - RNA, 32 nt, Human
gauacccaggggccgcgcccaucccccgcccc

SEQ ID NO: 162982 - RNA, 32 nt, Human
gauacccagucccagaaccacacuguugaguu

SEQ ID NO: 162983 - RNA, 32 nt, Human
gauaccccagcuguuuaucaucagcuccucug

SEQ ID NO: 162984 - RNA, 32 nt, Human
gauacccuggacugaccugcccuggcuggcuc

SEQ ID NO: 162985 - RNA, 32 nt, Human
gauaccgcaucaccaccagcagcucuugccca

SEQ ID NO: 162986 - RNA, 32 nt, Human
gauaccggacacaccucugcuccaaaggaaau

SEQ ID NO: 162987 - RNA, 32 nt, Human
gauaccgguuucagaguccugggcagcgugcg

SEQ ID NO: 162988 - RNA, 32 nt, Human
gauaccguagcccaugggcaccagcuuggagg

SEQ ID NO: 162989 - RNA, 23 nt, Human
gauaccgucugggaggauugcug

SEQ ID NO: 162990 - RNA, 25 nt, Human
gauaccgugcuguuguguuuuucug

SEQ ID NO: 162991 - RNA, 32 nt, Human
gauaccuagaagccaggaaaccgcgagcugca

SEQ ID NO: 162992 - RNA, 32 nt, Human
gauaccucauugaaucccuaaauuuaaaagca

SEQ ID NO: 162993 - RNA, 32 nt, Human
gauaccuccagccaggccucuguggccucugu

SEQ ID NO: 162994 - RNA, 32 nt, Human
gauaccuccugagaccuccguccucugcuuuc

SEQ ID NO: 162995 - RNA, 32 nt, Human
gauaccuccuugugccuccacugaugcaggag

SEQ ID NO: 162996 - RNA, 32 nt, Human
gauaccugagccugcaauagagcccugaaauc

SEQ ID NO: 162997 - RNA, 32 nt, Human
gauaccugcacuccggcuuccuagacucuggc

SEQ ID NO: 162998 - RNA, 32 nt, Human
gauaccugcuucuucuauaugauacaauauuu

SEQ ID NO: 162999 - RNA, 32 nt, Human
gauaccugcuuuuaaaauggagcuagaaugcu

SEQ ID NO: 163000 - RNA, 32 nt, Human
gauaccuggagaccaugaagagcugcggccgc

SEQ ID NO: 163001 - RNA, 32 nt, Human
gauaccuguaaucccagcuacgugggaggcug

SEQ ID NO: 163002 - RNA, 32 nt, Human
gauaccuguggagcugucuguagguugggaag

SEQ ID NO: 163003 - RNA, 32 nt, Human
gauaccuuauuuuccuccuccuccuuggccua

SEQ ID NO: 163004 - RNA, 32 nt, Human
gauaccuucccucccaggcuccuuaccuuggu

SEQ ID NO: 163005 - RNA, 32 nt, Human
gauaccuuugggcugccugggacaggcuccug

SEQ ID NO: 163006 - RNA, 32 nt, Human
gauaccuuuguucuguccccugccccaucccc

SEQ ID NO: 163007 - RNA, 19 nt, Human
gauacgaagcaaaccuggg

SEQ ID NO: 163008 - RNA, 32 nt, Human
gauacgaggacagguuggagcugcagggacug

SEQ ID NO: 163009 - RNA, 32 nt, Human
gauacgcaaacacaccgaugcacacgcacaua

SEQ ID NO: 163010 - RNA, 32 nt, Human
gauacgcacuuuugcaggaugaccucagggcu

SEQ ID NO: 163011 - RNA, 19 nt, Human
gauacggagauuucagggu

SEQ ID NO: 163012 - RNA, 32 nt, Human
gauacgggaagaagaaauggcuggugaucuuu

SEQ ID NO: 163013 - RNA, 32 nt, Human
gauacgggagagaaagaacgugccaggcagga

SEQ ID NO: 163014 - RNA, 32 nt, Human
gauacggggagagagagcuuagugaaggcagu

SEQ ID NO: 163015 - RNA, 23 nt, Human
gauacgggguuucaccauguugg

SEQ ID NO: 163016 - RNA, 32 nt, Human
gauacggucuggcucugucacuuaggcuggag

SEQ ID NO: 163017 - RNA, 32 nt, Human
gauacguggcuggccuuuggcuugccuuugac

SEQ ID NO: 163018 - RNA, 32 nt, Human
gauacguguuaguccuguuauuuggaggcuuu

SEQ ID NO: 163019 - RNA, 32 nt, Human
gauacguugaagcaaacucuuacugccuuucu

SEQ ID NO: 163020 - RNA, 32 nt, Human
gauacuaacccauggacuuuccaagggaggga

SEQ ID NO: 163021 - RNA, 32 nt, Human
gauacuaacucccuccccaaccccuguuguug

SEQ ID NO: 163022 - RNA, 32 nt, Human
gauacuacacaaaaauagaacaauuagucuga

SEQ ID NO: 163023 - RNA, 32 nt, Human
gauacuagacuagacaucacaagaaaacuaua

SEQ ID NO: 163024 - RNA, 32 nt, Human
gauacuaguuugagccaagggcagcaggggcu

SEQ ID NO: 163025 - RNA, 31 nt, Human
gauacucacagcuuuucagagcagaaacugu

SEQ ID NO: 163026 - RNA, 32 nt, Human
gauacucagaccuucagacucuggcugaauua

SEQ ID NO: 163027 - RNA, 32 nt, Human
gauacucagcugucauguuuauaauucaaaca

SEQ ID NO: 163028 - RNA, 32 nt, Human
gauacuccagcccuguggcaccccagacccuc

SEQ ID NO: 163029 - RNA, 30 nt, Human
gauacucgaagccacaggaucaauguggug

SEQ ID NO: 163030 - RNA, 32 nt, Human
gauacucucaagccuguaucccugcccacugg

SEQ ID NO: 163031 - RNA, 32 nt, Human
gauacucucaagccuguaucccugccccacug

SEQ ID NO: 163032 - RNA, 32 nt, Human
gauacucuguuccuaagaccucagguuaccca

SEQ ID NO: 163033 - RNA, 32 nt, Human
gauacucuucucccaucucccuucacaggaug

SEQ ID NO: 163034 - RNA, 32 nt, Human
gauacugaaagaaauaguuaaugaguuugcau

SEQ ID NO: 163035 - RNA, 32 nt, Human
gauacugaacagcuucaguacuacgaugucau

SEQ ID NO: 163036 - RNA, 32 nt, Human
gauacugacuaccugggguaggcacauugugu

SEQ ID NO: 163037 - RNA, 32 nt, Human
gauacugaggcauagcuguacuguguguuuuc

SEQ ID NO: 163038 - RNA, 32 nt, Human
gauacugaggcugagucgggggucacaagcca

SEQ ID NO: 163039 - RNA, 32 nt, Human
gauacugauggaccuacccugccuuguucugu

SEQ ID NO: 163040 - RNA, 32 nt, Human
gauacugcagugagcuaggaucauaccaacau

SEQ ID NO: 163041 - RNA, 32 nt, Human
gauacugcuaaccucuuuguuauuugagcagc

SEQ ID NO: 163042 - RNA, 32 nt, Human
gauacuggcaauacuccagccuggugacagag

SEQ ID NO: 163043 - RNA, 32 nt, Human
gauacugguacuacgggguggggaagaggaac

SEQ ID NO: 163044 - RNA, 32 nt, Human
gauacugguccuuagccccaucugccacgugu

SEQ ID NO: 163045 - RNA, 32 nt, Human
gauacuguaaaauguggaggcagggcaaacgu

SEQ ID NO: 163046 - RNA, 32 nt, Human
gauacuguccaaggcagggguacggcugacca

SEQ ID NO: 163047 - RNA, 32 nt, Human
gauacugugauucucucaccguucucuggaaa

SEQ ID NO: 163048 - RNA, 32 nt, Human
gauacugugccauugcacuccaagccugggca

SEQ ID NO: 163049 - RNA, 32 nt, Human
gauacugugguuugauggaaugaaucaccugg

SEQ ID NO: 163050 - RNA, 22 nt, Human
gauacuguucuguuuuucuuca

SEQ ID NO: 163051 - RNA, 32 nt, Human
gauacuguugguaaccaggaguauaaggcagu

SEQ ID NO: 163052 - RNA, 32 nt, Human
gauacuguuuuauaucaaacaauguuuauaau

SEQ ID NO: 163053 - RNA, 32 nt, Human
gauacuuacagauguugagauggcugcccugc

SEQ ID NO: 163054 - RNA, 32 nt, Human
gauacuuacuuagauguucccugagaggagug

SEQ ID NO: 163055 - RNA, 32 nt, Human
gauacuuaggaaauccuaaaagaggcggcaag

SEQ ID NO: 163056 - RNA, 32 nt, Human
gauacuuauagacagacuuauuggacaauuau

SEQ ID NO: 163057 - RNA, 32 nt, Human
gauacuucagugacacagccucugcugccccu

SEQ ID NO: 163058 - RNA, 32 nt, Human
gauacuucauuuucuuagcguuucuggagauu

SEQ ID NO: 163059 - RNA, 32 nt, Human
gauacuuccacaugcuaucauaaucaacugua

SEQ ID NO: 163060 - RNA, 32 nt, Human
gauacuuccagcuucuuggcucagccuggcuu

SEQ ID NO: 163061 - RNA, 32 nt, Human
gauacuuccauuuucaggcucagacuuugaau

SEQ ID NO: 163062 - RNA, 32 nt, Human
gauacuucccuguacaugcauaaauaugcaug

SEQ ID NO: 163063 - RNA, 32 nt, Human
gauacuucugauguuucggaacagucauuuca

SEQ ID NO: 163064 - RNA, 32 nt, Human
gauacuucuugguuuuaagcugucuaccuaau

SEQ ID NO: 163065 - RNA, 32 nt, Human
gauacuugagaaaguuguugugguguuguaug

SEQ ID NO: 163066 - RNA, 32 nt, Human
gauacuugggagguaggaagaaaaugggagua

SEQ ID NO: 163067 - RNA, 32 nt, Human
gauacuuggucuuacugguuuuauucccugcu

SEQ ID NO: 163068 - RNA, 32 nt, Human
gauacuuuccagagcuacaacaugccaucuau

SEQ ID NO: 163069 - RNA, 32 nt, Human
gauacuuugagaugcauuaugagaacuuucag

SEQ ID NO: 163070 - RNA, 32 nt, Human
gauagaaaaacuucauccagccacuuuaauga

SEQ ID NO: 163071 - RNA, 32 nt, Human
gauagaaaccaucccuucccuuucucccuugg

SEQ ID NO: 163072 - RNA, 32 nt, Human
gauagaaauucagcuacaacccaaagagagaa

SEQ ID NO: 163073 - RNA, 32 nt, Human
gauagaaccccuggcaguguugucagcucaac

SEQ ID NO: 163074 - RNA, 32 nt, Human
gauagaacuguacuguuuucugggccagugag

SEQ ID NO: 163075 - RNA, 32 nt, Human
gauagaaggauaaaggaugcauguguaguauu

SEQ ID NO: 163076 - RNA, 32 nt, Human
gauagaaggggaggggaggagagaugcauacc

SEQ ID NO: 163077 - RNA, 32 nt, Human
gauagaaggugaccucuccucauaaggacuug

SEQ ID NO: 163078 - RNA, 32 nt, Human
gauagaagugcucgggaaagaaagcaaagcgg

SEQ ID NO: 163079 - RNA, 32 nt, Human
gauagaauaagugcuaaugaugccauugccac

SEQ ID NO: 163080 - RNA, 32 nt, Human
gauagaauccacccugccucugacagcaucca

SEQ ID NO: 163081 - RNA, 18 nt, Human
gauagaaucuugcucugu

SEQ ID NO: 163082 - RNA, 32 nt, Human
gauagacaaacaaugaugaaacucagauggag

SEQ ID NO: 163083 - RNA, 32 nt, Human
gauagacaauccgcucuucauccagaaaacca

SEQ ID NO: 163084 - RNA, 32 nt, Human
gauagacagcauaggagguuugaagcagaaau

SEQ ID NO: 163085 - RNA, 32 nt, Human
gauagacaugaagagagcuuagcagugauuga

SEQ ID NO: 163086 - RNA, 32 nt, Human
gauagacccugugaauguaagcacuugguaaa

SEQ ID NO: 163087 - RNA, 32 nt, Human
gauagacggauccaucccaguuucugaccugu

SEQ ID NO: 163088 - RNA, 32 nt, Human
gauagagagcuauuuaauggccggcuggaaau

SEQ ID NO: 163089 - RNA, 32 nt, Human
gauagagagggcccugaacaccaggcucaggg

SEQ ID NO: 163090 - RNA, 32 nt, Human
gauagagauacuuugcgcgcacacacauacau

SEQ ID NO: 163091 - RNA, 32 nt, Human
gauagagcauacaauugaucucacuuuaggau

SEQ ID NO: 163092 - RNA, 20 nt, Human
gauagagcgagacucugucu

SEQ ID NO: 163093 - RNA, 32 nt, Human
gauagagcuaguuucaggaacagugaggcaag

SEQ ID NO: 163094 - RNA, 32 nt, Human
gauagaggguucaauuaugagacaccuaguac

SEQ ID NO: 163095 - RNA, 32 nt, Human
gauagagucccacucuugcccaggcuggagcg

SEQ ID NO: 163096 - RNA, 20 nt, Human
gauagagugagacccugucu

SEQ ID NO: 163097 - RNA, 32 nt, Human
gauagauauuugaguuguuugcagugaauggu

SEQ ID NO: 163098 - RNA, 24 nt, Human
gauagauccagcugaagaguucua

SEQ ID NO: 163099 - RNA, 32 nt, Human
gauagaugaaguauugcugaagccaaccagag

SEQ ID NO: 163100 - RNA, 23 nt, Human
gauagaugauuucagaacuucag

SEQ ID NO: 163101 - RNA, 19 nt, Human
gauagaugcuucaggugac

SEQ ID NO: 163102 - RNA, 32 nt, Human
gauagauggaaucucugucaggggacaaacag

SEQ ID NO: 163103 - RNA, 32 nt, Human
gauagauggagagagacagaaagagagaugga

SEQ ID NO: 163104 - RNA, 32 nt, Human
gauagauuucuguugggcaagggagacuucga

SEQ ID NO: 163105 - RNA, 32 nt, Human
gauagcaaacaacacaguagugacagaauuua

SEQ ID NO: 163106 - RNA, 32 nt, Human
gauagcaacaggccgggccacugaggcggugc

SEQ ID NO: 163107 - RNA, 32 nt, Human
gauagcacaauccaggcugcuuccuguuggcu

SEQ ID NO: 163108 - RNA, 32 nt, Human
gauagcacaguucuguccagagaaggaaggcg

SEQ ID NO: 163109 - RNA, 32 nt, Human
gauagcaccacugcacuccagccugggagaca

SEQ ID NO: 163110 - RNA, 32 nt, Human
gauagcaccacugcacuccagccugggcaaca

SEQ ID NO: 163111 - RNA, 32 nt, Human
gauagcaccacugcacuccagccugggugaca

SEQ ID NO: 163112 - RNA, 32 nt, Human
gauagcaccacugcacuccaggcugggugaca

SEQ ID NO: 163113 - RNA, 32 nt, Human
gauagcaccacugcacuuuagccugggcgaca

SEQ ID NO: 163114 - RNA, 32 nt, Human
gauagcaccacugcaguccagccugggcgaca

SEQ ID NO: 163115 - RNA, 32 nt, Human
gauagcaccacugcaugcaagccugggcaaua

SEQ ID NO: 163116 - RNA, 32 nt, Human
gauagcaccacugcgcuccagccugggugagg

SEQ ID NO: 163117 - RNA, 32 nt, Human
gauagcaccauugcacuccagccugggcgacu

SEQ ID NO: 163118 - RNA, 32 nt, Human
gauagcacugggugugagaaugaucaaggauc

SEQ ID NO: 163119 - RNA, 32 nt, Human
gauagcagaaugcauaacacugaguguuaauu

SEQ ID NO: 163120 - RNA, 32 nt, Human
gauagcagcagccucagccucugccuguccag

SEQ ID NO: 163121 - RNA, 32 nt, Human
gauagcaggaacaggaucaagucuuccauacc

SEQ ID NO: 163122 - RNA, 32 nt, Human
gauagcaggaaggcagaaagaaaacauaaaga

SEQ ID NO: 163123 - RNA, 32 nt, Human
gauagcagguuaauauugucucaggcgagacu

SEQ ID NO: 163124 - RNA, 32 nt, Human
gauagcaguuccuuguauaaaaugacuggaug

SEQ ID NO: 163125 - RNA, 32 nt, Human
gauagcauucuuacguguuacauauaguggac

SEQ ID NO: 163126 - RNA, 18 nt, Human
gauagccaaggaacagga

SEQ ID NO: 163127 - RNA, 32 nt, Human
gauagccaauagccccagcccacugaaagccu

SEQ ID NO: 163128 - RNA, 32 nt, Human
gauagccacugccuuuuccucaagggagcaac

SEQ ID NO: 163129 - RNA, 32 nt, Human
gauagccagcaguggauguuacuccaggaaaa

SEQ ID NO: 163130 - RNA, 32 nt, Human
gauagcccaggauaugaccuaucuugggauau

SEQ ID NO: 163131 - RNA, 32 nt, Human
gauagccccacugcacuccagccugggugaca

SEQ ID NO: 163132 - RNA, 32 nt, Human
gauagccuagagaacccaaagcaaacaguugc

SEQ ID NO: 163133 - RNA, 32 nt, Human
gauagccuagggugagggugacagagggacag

SEQ ID NO: 163134 - RNA, 32 nt, Human
gauagcgaucccuagugaauggcauagauguu

SEQ ID NO: 163135 - RNA, 32 nt, Human
gauagcgauuuuccugugcuggaaugugccca

SEQ ID NO: 163136 - RNA, 32 nt, Human
gauagcgccacugcacugcacgccagccuagg

SEQ ID NO: 163137 - RNA, 32 nt, Human
gauagcgccacugcaguccggccugggugaaa

SEQ ID NO: 163138 - RNA, 32 nt, Human
gauagcgccauugcacuccagccugagcgaca

SEQ ID NO: 163139 - RNA, 32 nt, Human
gauagcgccauugcacuccagccugggcaaca

SEQ ID NO: 163140 - RNA, 32 nt, Human
gauagcgccauugcacuccagccugggcgacu

SEQ ID NO: 163141 - RNA, 32 nt, Human
gauagcggcacugcacuccagccugggugaca

SEQ ID NO: 163142 - RNA, 32 nt, Human
gauagcggcaggcaccgcaguggagcggcucc

SEQ ID NO: 163143 - RNA, 32 nt, Human
gauagcggcauugcacuccagccugggcaaca

SEQ ID NO: 163144 - RNA, 32 nt, Human
gauagcgggagggaggaaguacgacuaauguu

SEQ ID NO: 163145 - RNA, 32 nt, Human
gauagcuaauaaauugggaaugggagaaggga

SEQ ID NO: 163146 - RNA, 32 nt, Human
gauagcuagucacucaggcugcagagagagac

SEQ ID NO: 163147 - RNA, 32 nt, Human
gauagcuauuuacauagccuucuaaguaaagg

SEQ ID NO: 163148 - RNA, 32 nt, Human
gauagcucacugccagagcagccuggguuccc

SEQ ID NO: 163149 - RNA, 32 nt, Human
gauagcucucucuugaaaacaaaaaggaaaca

SEQ ID NO: 163150 - RNA, 32 nt, Human
gauagcucugcagccagaaauggucuucucac

SEQ ID NO: 163151 - RNA, 32 nt, Human
gauagcugaaaccaaggcugaagacuguuuua

SEQ ID NO: 163152 - RNA, 21 nt, Human
gauagcugaggcuaggggaga

SEQ ID NO: 163153 - RNA, 32 nt, Human
gauagcugcauucauuuaucaccagcauauug

SEQ ID NO: 163154 - RNA, 32 nt, Human
gauagcuguaguuucuuucauagaaaguagcu

SEQ ID NO: 163155 - RNA, 22 nt, Human
gauagcugugcagaaagugaga

SEQ ID NO: 163156 - RNA, 32 nt, Human
gauagcuguguacuucuggugacuguacaguu

SEQ ID NO: 163157 - RNA, 32 nt, Human
gauagcuucagaaaucagaaaaacauuuggga

SEQ ID NO: 163158 - RNA, 32 nt, Human
gauagcuucaugcacacuaugcauuuuauugg

SEQ ID NO: 163159 - RNA, 32 nt, Human
gauagcuugacaaggagugcugucuguccuua

SEQ ID NO: 163160 - RNA, 32 nt, Human
gauagcuuuuuauuugccaauauugugcaacc

SEQ ID NO: 163161 - RNA, 32 nt, Human
gauaggaaaauguuggauauuugaggccaugc

SEQ ID NO: 163162 - RNA, 32 nt, Human
gauaggaaagaaugucugcugcaagaguguau

SEQ ID NO: 163163 - RNA, 32 nt, Human
gauaggacauuguagccagccucagcacucag

SEQ ID NO: 163164 - RNA, 32 nt, Human
gauaggacggcugcucuccaccucgcagacug

SEQ ID NO: 163165 - RNA, 31 nt, Human
gauaggagaaaacugccuuagggcuggaaau

SEQ ID NO: 163166 - RNA, 32 nt, Human
gauaggagaaagugccagcccugaagcuggag

SEQ ID NO: 163167 - RNA, 32 nt, Human
gauaggagaagaggaggaggaggagcgggguc

SEQ ID NO: 163168 - RNA, 32 nt, Human
gauaggagagacuaauuccaaccuucuaaauu

SEQ ID NO: 163169 - RNA, 32 nt, Human
gauaggagccaccuuggcuuccuguggagaua

SEQ ID NO: 163170 - RNA, 32 nt, Human
gauaggaggaggcagaggggugccuggaguuu

SEQ ID NO: 163171 - RNA, 32 nt, Human
gauaggagggagagagggaaggggcugaggaa

SEQ ID NO: 163172 - RNA, 32 nt, Human
gauaggaugaaucugaacaucucuccaucuag

SEQ ID NO: 163173 - RNA, 32 nt, Human
gauaggauggucagaaaggaccucuuuguaga

SEQ ID NO: 163174 - RNA, 32 nt, Human
gauaggcagcugccauggcaacuggaggcugu

SEQ ID NO: 163175 - RNA, 32 nt, Human
gauaggcauucaauaaauacuccaaugcuguc

SEQ ID NO: 163176 - RNA, 32 nt, Human
gauaggccaaagguucucagagugugguuccu

SEQ ID NO: 163177 - RNA, 32 nt, Human
gauaggccaggggaguggagguaacggggccc

SEQ ID NO: 163178 - RNA, 22 nt, Human
gauaggccuucacaccuucaca

SEQ ID NO: 163179 - RNA, 32 nt, Human
gauaggcgugagccaccacacccggccaagca

SEQ ID NO: 163180 - RNA, 32 nt, Human
gauaggcgugugacccugguugaguggcacuu

SEQ ID NO: 163181 - RNA, 32 nt, Human
gauaggcucuuucgugcuguguuaucuuuaua

SEQ ID NO: 163182 - RNA, 32 nt, Human
gauaggcuggaucccuggggcaggccucuccu

SEQ ID NO: 163183 - RNA, 32 nt, Human
gauagggacagcugcccccagaacucccuuca

SEQ ID NO: 163184 - RNA, 32 nt, Human
gauagggagagggagcgaggcuggugccgcuu

SEQ ID NO: 163185 - RNA, 32 nt, Human
gauagggagggaggggacauaaagggaaugca

SEQ ID NO: 163186 - RNA, 32 nt, Human
gauagggaggugaguccucucuaucuccucug

SEQ ID NO: 163187 - RNA, 32 nt, Human
gauagggccaaggagaaaacaaccaagaacuc

SEQ ID NO: 163188 - RNA, 32 nt, Human
gauagggcccaccacacaacacggccucaucg

SEQ ID NO: 163189 - RNA, 32 nt, Human
gauagggccuuggaggagaagguccaguuuua

SEQ ID NO: 163190 - RNA, 32 nt, Human
gauagggcggaaggggacaggcuugaggcuug

SEQ ID NO: 163191 - RNA, 32 nt, Human
gauagggcggacuuaccuggcccagcccugcc

SEQ ID NO: 163192 - RNA, 32 nt, Human
gauaggggaagggaggagggagagggaggaca

SEQ ID NO: 163193 - RNA, 32 nt, Human
gauagggggcugugguccuuccuuucuccuga

SEQ ID NO: 163194 - RNA, 32 nt, Human
gauagggguaggaggagaggaggcaggcugcu

SEQ ID NO: 163195 - RNA, 18 nt, Human
gauagggucucgcucugu

SEQ ID NO: 163196 - RNA, 32 nt, Human
gauaggguucccaggcugccuggaguuacaua

SEQ ID NO: 163197 - RNA, 32 nt, Human
gauaggguugacguucguggauagacucauau

SEQ ID NO: 163198 - RNA, 32 nt, Human
gauagguagauaagagaaaaacaguugcauuc

SEQ ID NO: 163199 - RNA, 32 nt, Human
gauagguagcagagaccaaggcgcagggugcu

SEQ ID NO: 163200 - RNA, 32 nt, Human
gauaggucucaaacuccugacuucaggugauc

SEQ ID NO: 163201 - RNA, 32 nt, Human
gauaggugagugccuuucagguagcuuugcau

SEQ ID NO: 163202 - RNA, 32 nt, Human
gauaguaagagaggugacaacccacccagacu

SEQ ID NO: 163203 - RNA, 32 nt, Human
gauaguacauaaacgucccaaaauuagaagau

SEQ ID NO: 163204 - RNA, 32 nt, Human
gauaguaccacugcacuccagccugggcaaca

SEQ ID NO: 163205 - RNA, 32 nt, Human
gauaguaccacugcacuccagccugggcgaca

SEQ ID NO: 163206 - RNA, 32 nt, Human
gauaguacuugcagcuagauggaugcuuuuag

SEQ ID NO: 163207 - RNA, 31 nt, Human
gauaguaggaaacagucuggaugcuggugcc

SEQ ID NO: 163208 - RNA, 32 nt, Human
gauaguaguauuaucucauuuuacugaugaag

SEQ ID NO: 163209 - RNA, 32 nt, Human
gauaguagucacauacacuacacacacugugc

SEQ ID NO: 163210 - RNA, 32 nt, Human
gauagucaagcauuuagaagugcagugaacuu

SEQ ID NO: 163211 - RNA, 32 nt, Human
gauagucaccugcugguuguugccagguugca

SEQ ID NO: 163212 - RNA, 32 nt, Human
gauagucagagccuguggcacaccugggaugg

SEQ ID NO: 163213 - RNA, 32 nt, Human
gauagucauaaguggaagaaaaagccaagcau

SEQ ID NO: 163214 - RNA, 32 nt, Human
gauagucauauauaaucauaucuaagaucuau

SEQ ID NO: 163215 - RNA, 32 nt, Human
gauagucauggacucacuaggcugcugaggaa

SEQ ID NO: 163216 - RNA, 32 nt, Human
gauaguccacacucaagagaacgggaugauac

SEQ ID NO: 163217 - RNA, 32 nt, Human
gauagucguacaacaacccaggggauccagau

SEQ ID NO: 163218 - RNA, 32 nt, Human
gauagucuccaucucuugaccucgugaucugc

SEQ ID NO: 163219 - RNA, 32 nt, Human
gauagucucccaggcccagaagaugcuccuau

SEQ ID NO: 163220 - RNA, 32 nt, Human
gauagucugccuggucaaugcugagcuguacc

SEQ ID NO: 163221 - RNA, 32 nt, Human
gauagucuucuuuuuguccuuucuggccucug

SEQ ID NO: 163222 - RNA, 32 nt, Human
gauagugaggcuaagagagggaaagugacuua

SEQ ID NO: 163223 - RNA, 32 nt, Human
gauagugccacagcucuccagccugggcgaca

SEQ ID NO: 163224 - RNA, 32 nt, Human
gauagugccacugcaauucagccugggugaca

SEQ ID NO: 163225 - RNA, 32 nt, Human
gauagugccacugcacuacagcccgggcgaca

SEQ ID NO: 163226 - RNA, 32 nt, Human
gauagugccacugcacuccagccugggcaaca

SEQ ID NO: 163227 - RNA, 32 nt, Human
gauagugccacugcacuccagccugggugaca

SEQ ID NO: 163228 - RNA, 32 nt, Human
gauagugccacugcacuucagccugggugaca

SEQ ID NO: 163229 - RNA, 32 nt, Human
gauagugccacugcacuucagcuugggcaaca

SEQ ID NO: 163230 - RNA, 32 nt, Human
gauagugccacugcauuccggccugggcgaca

SEQ ID NO: 163231 - RNA, 32 nt, Human
gauagugccauugcacuccggccugggcaaca

SEQ ID NO: 163232 - RNA, 32 nt, Human
gauagugccauuguacuccagcuugggcaaca

SEQ ID NO: 163233 - RNA, 32 nt, Human
gauagugccgcugcacuccauucugggcaaga

SEQ ID NO: 163234 - RNA, 32 nt, Human
gauaguggagugagaaagggaggguggagggu

SEQ ID NO: 163235 - RNA, 32 nt, Human
gauaguggauuucagaggaaggugagauauuu

SEQ ID NO: 163236 - RNA, 32 nt, Human
gauaguggccuccagcuccauucauguuccug

SEQ ID NO: 163237 - RNA, 32 nt, Human
gauagugggggaacagacaauuuuguccuuau

SEQ ID NO: 163238 - RNA, 32 nt, Human
gauagugucugguucaagggcaaccaaucucu

SEQ ID NO: 163239 - RNA, 32 nt, Human
gauaguuccucuuucucauuuugcaaacuacc

SEQ ID NO: 163240 - RNA, 31 nt, Human
gauaguugccaaagauaccuguggaauacaa

SEQ ID NO: 163241 - RNA, 32 nt, Human
gauaguugcuauuuuuguaaaguuuccgugcg

SEQ ID NO: 163242 - RNA, 32 nt, Human
gauaguuuaccugaauaaaugguaguaaucac

SEQ ID NO: 163243 - RNA, 32 nt, Human
gauaguuucaauccucccuuuuggguuuuacc

SEQ ID NO: 163244 - RNA, 32 nt, Human
gauaguuuccgaguaagaccuuaaggacacag

SEQ ID NO: 163245 - RNA, 32 nt, Human
gauaguuucugccucacucaucccuccuguac

SEQ ID NO: 163246 - RNA, 32 nt, Human
gauaguuuguagaacugaagauuuccauugau

SEQ ID NO: 163247 - RNA, 32 nt, Human
gauauaaacuauuaagccaugaaaucuaauuu

SEQ ID NO: 163248 - RNA, 32 nt, Human
gauauaaagggaagagaaggaggcucaccgga

SEQ ID NO: 163249 - RNA, 32 nt, Human
gauauaaauguucuuaaacuaugaguuuaagc

SEQ ID NO: 163250 - RNA, 32 nt, Human
gauauaacacagaaaaaugccuugagggcaaa

SEQ ID NO: 163251 - RNA, 32 nt, Human
gauauaacaguuaacaggaugcagacauggca

SEQ ID NO: 163252 - RNA, 20 nt, Human
gauauaaccaucacccugga

SEQ ID NO: 163253 - RNA, 32 nt, Human
gauauaacugauuuuauagaaucugucuguuc

SEQ ID NO: 163254 - RNA, 32 nt, Human
gauauaacugucuuguuucagugagagacgcc

SEQ ID NO: 163255 - RNA, 32 nt, Human
gauauaagggaaaaugauaugaauguguauuu

SEQ ID NO: 163256 - RNA, 25 nt, Human
gauauaaugaugguugcuggauuag

SEQ ID NO: 163257 - RNA, 32 nt, Human
gauauaauucacauaccauaaaagccacucuu

SEQ ID NO: 163258 - RNA, 32 nt, Human
gauauaauugguggaaaggguggguggauaca

SEQ ID NO: 163259 - RNA, 32 nt, Human
gauauacaucuucuuccuuuugguuucuugau

SEQ ID NO: 163260 - RNA, 22 nt, Human
gauauacaugaaaauuuuaaaa

SEQ ID NO: 163261 - RNA, 20 nt, Human
gauauacauguuguguaaaa

SEQ ID NO: 163262 - RNA, 32 nt, Human
gauauacccacauccccggaacuaggugaucg

SEQ ID NO: 163263 - RNA, 21 nt, Human
gauauacuacuauugcuugua

SEQ ID NO: 163264 - RNA, 22 nt, Human
gauauacugaucuucauuacca

SEQ ID NO: 163265 - RNA, 32 nt, Human
gauauagaaaaauugugccggacuuaccuuuc

SEQ ID NO: 163266 - RNA, 32 nt, Human
gauauagaaggugguuucgaaggaggagacuc

SEQ ID NO: 163267 - RNA, 32 nt, Human
gauauagacacuaaccuugauagugauacguu

SEQ ID NO: 163268 - RNA, 32 nt, Human
gauauagagaaaucuggcuggcuacaguguag

SEQ ID NO: 163269 - RNA, 32 nt, Human
gauauagcaauagaagucugaagacgguaaac

SEQ ID NO: 163270 - RNA, 32 nt, Human
gauauagcucaaggggcaaccaggcagucgca

SEQ ID NO: 163271 - RNA, 32 nt, Human
gauauagcugagauugggaugucaacacucag

SEQ ID NO: 163272 - RNA, 32 nt, Human
gauauaguuuuuaaaaauaacuauuuuguuau

SEQ ID NO: 163273 - RNA, 32 nt, Human
gauauauaccucuuccuuuugucuuuugcugu

SEQ ID NO: 163274 - RNA, 32 nt, Human
gauauaucaagaaaucugaggaggaugcaggu

SEQ ID NO: 163275 - RNA, 32 nt, Human
gauauaucagugggagaugauucauaggggag

SEQ ID NO: 163276 - RNA, 32 nt, Human
gauauaugaguauuuaaacuaaggcauuaaga

SEQ ID NO: 163277 - RNA, 32 nt, Human
gauauaugccuguagucccaacuacuuggaag

SEQ ID NO: 163278 - RNA, 32 nt, Human
gauauauguaguucaucaucgacaaaaauauc

SEQ ID NO: 163279 - RNA, 32 nt, Human
gauauauucaaacuuucaaaaaggacaguguu

SEQ ID NO: 163280 - RNA, 32 nt, Human
gauauauucuuuggauccugcaaagaagagau

SEQ ID NO: 163281 - RNA, 32 nt, Human
gauauauugccuuacagaccuaccucaaacac

SEQ ID NO: 163282 - RNA, 23 nt, Human
gauauauuucaauccauugccau

SEQ ID NO: 163283 - RNA, 24 nt, Human
gauauauuuuaguuccauuacuau

SEQ ID NO: 163284 - RNA, 32 nt, Human
gauauauuuucuuucucuuccuccuuccucuu

SEQ ID NO: 163285 - RNA, 32 nt, Human
gauaucaacagcuucccuauuuugaaugcaga

SEQ ID NO: 163286 - RNA, 32 nt, Human
gauaucaagaggaguaugcaccaaauaaauuu

SEQ ID NO: 163287 - RNA, 32 nt, Human
gauaucaagaguuugaggccagccuggccaac

SEQ ID NO: 163288 - RNA, 32 nt, Human
gauaucaagcccagagccccagccucucccca

SEQ ID NO: 163289 - RNA, 32 nt, Human
gauaucacacagucaggagucaacugaguugg

SEQ ID NO: 163290 - RNA, 32 nt, Human
gauaucacaccuaacagaggcagcagcagucc

SEQ ID NO: 163291 - RNA, 32 nt, Human
gauaucacccaggcuggagugcaguggcgcga

SEQ ID NO: 163292 - RNA, 32 nt, Human
gauaucaccgcaaugcccuagaacagcuauga

SEQ ID NO: 163293 - RNA, 32 nt, Human
gauaucagcuaauucaggacugugagccggcu

SEQ ID NO: 163294 - RNA, 32 nt, Human
gauaucaucuuuucucagauauuuugugugau

SEQ ID NO: 163295 - RNA, 32 nt, Human
gauaucaugcagaugcagucugaauuccuugc

SEQ ID NO: 163296 - RNA, 32 nt, Human
gauaucaugccccuguacuccagccuggguga

SEQ ID NO: 163297 - RNA, 32 nt, Human
gauaucauuucgaggcccagcugagaaggauc

SEQ ID NO: 163298 - RNA, 32 nt, Human
gauauccagauacuugagauccugguaauugg

SEQ ID NO: 163299 - RNA, 32 nt, Human
gauauccaggaauugaacucagcucugcacca

SEQ ID NO: 163300 - RNA, 32 nt, Human
gauaucccaagugacacagaaacacagcuccu

SEQ ID NO: 163301 - RNA, 32 nt, Human
gauaucccagaagaagaggcaagggcauccac

SEQ ID NO: 163302 - RNA, 28 nt, Human
gauauccccaaggcugccucucccacca

SEQ ID NO: 163303 - RNA, 32 nt, Human
gauauccccugcccuccacaaauucuucuuuc

SEQ ID NO: 163304 - RNA, 32 nt, Human
gauaucccuccagguggggcuggcugcccuua

SEQ ID NO: 163305 - RNA, 20 nt, Human
gauauccgacauucaccuga

SEQ ID NO: 163306 - RNA, 32 nt, Human
gauauccgggaauugaacucagcucugcacca

SEQ ID NO: 163307 - RNA, 32 nt, Human
gauauccugaccacugcugcccuaggcuuaug

SEQ ID NO: 163308 - RNA, 32 nt, Human
gauauccugaucuugccccuccagagacagga

SEQ ID NO: 163309 - RNA, 32 nt, Human
gauauccugcaggagaccagggccaggagggu

SEQ ID NO: 163310 - RNA, 32 nt, Human
gauauccugccuggaugggguugcugugauuu

SEQ ID NO: 163311 - RNA, 32 nt, Human
gauaucgcaccacagcgcuccagccuggucga

SEQ ID NO: 163312 - RNA, 32 nt, Human
gauaucgcaccauuguacuccagccuguguga

SEQ ID NO: 163313 - RNA, 32 nt, Human
gauaucgccacugcacuccagccugggugaca

SEQ ID NO: 163314 - RNA, 32 nt, Human
gauaucgucuuucuguguuguccacacugguc

SEQ ID NO: 163315 - RNA, 32 nt, Human
gauaucgugccacugcacuccagccuggagga

SEQ ID NO: 163316 - RNA, 32 nt, Human
gauaucguuaccaagcaauggcaugcuacgau

SEQ ID NO: 163317 - RNA, 32 nt, Human
gauaucuacaauuauagaaucauacagaauag

SEQ ID NO: 163318 - RNA, 32 nt, Human
gauaucuagaugauguacauuucuugacuuac

SEQ ID NO: 163319 - RNA, 32 nt, Human
gauaucuauacuguucuuuucugcuacagaga

SEQ ID NO: 163320 - RNA, 32 nt, Human
gauaucuauuaccaaaccacauggagagaaau

SEQ ID NO: 163321 - RNA, 32 nt, Human
gauaucucauugugguuuugauuugcauuucu

SEQ ID NO: 163322 - RNA, 32 nt, Human
gauaucucugagggccugcaaggaggcaaagu

SEQ ID NO: 163323 - RNA, 32 nt, Human
gauaucugaaaccagguaaaggaagccuagau

SEQ ID NO: 163324 - RNA, 32 nt, Human
gauaucugagaaauccuccucauuauucugcu

SEQ ID NO: 163325 - RNA, 32 nt, Human
gauaucuggucucagggauugcuccuauguau

SEQ ID NO: 163326 - RNA, 32 nt, Human
gauaucuucuccacccuccuugcaccagacua

SEQ ID NO: 163327 - RNA, 32 nt, Human
gauaugaaagugucauuuauaucaauuugucc

SEQ ID NO: 163328 - RNA, 32 nt, Human
gauaugaagagccugguuacaguuucuacugu

SEQ ID NO: 163329 - RNA, 32 nt, Human
gauaugacgguguacuuacugccuuguagcaa

SEQ ID NO: 163330 - RNA, 32 nt, Human
gauaugacuccaggacccuugaguguaaugca

SEQ ID NO: 163331 - RNA, 32 nt, Human
gauaugagcauguugaacaucuugggagcugc

SEQ ID NO: 163332 - RNA, 32 nt, Human
gauaugaggcagcaggucucagaucugcuguc

SEQ ID NO: 163333 - RNA, 32 nt, Human
gauaugauggcauuuauaagguggugaaauac

SEQ ID NO: 163334 - RNA, 32 nt, Human
gauaugauggcuuagcuugggcucagaggccu

SEQ ID NO: 163335 - RNA, 32 nt, Human
gauaugauuugcaaaugaggagagagaagaug

SEQ ID NO: 163336 - RNA, 32 nt, Human
gauaugcaacacacuaaaccacucucaugucu

SEQ ID NO: 163337 - RNA, 22 nt, Human
gauaugcacacuuccauuacca

SEQ ID NO: 163338 - RNA, 32 nt, Human
gauaugcauauccugugaucugaggcauucgc

SEQ ID NO: 163339 - RNA, 32 nt, Human
gauaugccuccgcaacucacacaccugccugc

SEQ ID NO: 163340 - RNA, 32 nt, Human
gauaugccugcucuuuggccugaugaccaauu

SEQ ID NO: 163341 - RNA, 32 nt, Human
gauaugccuuugggguucgaaguggcccugga

SEQ ID NO: 163342 - RNA, 32 nt, Human
gauaugcugaagauuuccaggcaguuuuugug

SEQ ID NO: 163343 - RNA, 32 nt, Human
gauaugcugucuggacaggcacacacaugcag

SEQ ID NO: 163344 - RNA, 32 nt, Human
gauaugcuguuuagucacuacagugcccucaa

SEQ ID NO: 163345 - RNA, 32 nt, Human
gauaugcuugauaugcuuuuccuuccacaugu

SEQ ID NO: 163346 - RNA, 32 nt, Human
gauauggagaugggucugauuauagcguuguu

SEQ ID NO: 163347 - RNA, 32 nt, Human
gauauggagugaagcagcgggaacuauucuac

SEQ ID NO: 163348 - RNA, 32 nt, Human
gauauggaguuuugcucuuguugcccaggcug

SEQ ID NO: 163349 - RNA, 28 nt, Human
gauauggcaaugguaguuagcagcuggc

SEQ ID NO: 163350 - RNA, 32 nt, Human
gauauggucaucugugugucuaugggacaugg

SEQ ID NO: 163351 - RNA, 32 nt, Human
gauauggugguggagggagcccugggucgagu

SEQ ID NO: 163352 - RNA, 28 nt, Human
gauaugguugcagaagaaucagguccug

SEQ ID NO: 163353 - RNA, 32 nt, Human
gauauguagggaggaaggagguugauagcaua

SEQ ID NO: 163354 - RNA, 32 nt, Human
gauauguccucagccuuugggggccuggauaa

SEQ ID NO: 163355 - RNA, 32 nt, Human
gauaugucgaagaacuguuucauuagaagaca

SEQ ID NO: 163356 - RNA, 32 nt, Human
gauaugucuaacuacgaugaagaaggagcuug

SEQ ID NO: 163357 - RNA, 32 nt, Human
gauaugugaacauuucuucuccuucauaggua

SEQ ID NO: 163358 - RNA, 32 nt, Human
gauauguggggaaagcucuggugacccugggc

SEQ ID NO: 163359 - RNA, 32 nt, Human
gauauguguauguguauuagauccuagugguu

SEQ ID NO: 163360 - RNA, 32 nt, Human
gauauguguucuguuucuaagcgacauuugug

SEQ ID NO: 163361 - RNA, 32 nt, Human
gauauguuacacaguaaacaccugccaacccc

SEQ ID NO: 163362 - RNA, 32 nt, Human
gauauguuacaggauguuuuacauucucuugg

SEQ ID NO: 163363 - RNA, 32 nt, Human
gauauguuucaauucuuaaugaaaauuucuaa

SEQ ID NO: 163364 - RNA, 32 nt, Human
gauauguuuccaguucacaagucuuguauuca

SEQ ID NO: 163365 - RNA, 32 nt, Human
gauauuaaaaguaagaaaaauguguggguuuu

SEQ ID NO: 163366 - RNA, 32 nt, Human
gauauuaaaguuaggggaaagaaaagaucauu

SEQ ID NO: 163367 - RNA, 32 nt, Human
gauauuacucacugcacaucauaaaucuccau

SEQ ID NO: 163368 - RNA, 23 nt, Human
gauauuaguaagaaaggaucaug

SEQ ID NO: 163369 - RNA, 24 nt, Human
gauauuauacugucugccuugcug

SEQ ID NO: 163370 - RNA, 32 nt, Human
gauauuauagcagaacuucgauaugaccugcc

SEQ ID NO: 163371 - RNA, 31 nt, Human
gauauuauggcagcaacuuacagacuugugg

SEQ ID NO: 163372 - RNA, 32 nt, Human
gauauucaaacaucauaugccggaaauuuuca

SEQ ID NO: 163373 - RNA, 32 nt, Human
gauauuccaaauggauuguggaagagaaaccu

SEQ ID NO: 163374 - RNA, 32 nt, Human
gauauuccaccuguaauagcacuuuggaacug

SEQ ID NO: 163375 - RNA, 32 nt, Human
gauauucccagcuucaggauguguuuuaauag

SEQ ID NO: 163376 - RNA, 32 nt, Human
gauauucccucaaggcccugagcuagagacca

SEQ ID NO: 163377 - RNA, 32 nt, Human
gauauucgguuacuacacgugcaccuguagca

SEQ ID NO: 163378 - RNA, 32 nt, Human
gauauucucaacagaaaggguuaaaggcugau

SEQ ID NO: 163379 - RNA, 32 nt, Human
gauauucugaguccccacccccaaucacugac

SEQ ID NO: 163380 - RNA, 32 nt, Human
gauauucugaguucaagaacccuguccagugc

SEQ ID NO: 163381 - RNA, 32 nt, Human
gauauucuggcccagggaauccagccaugacc

SEQ ID NO: 163382 - RNA, 32 nt, Human
gauauucuuacagguugguuugcaguguuaac

SEQ ID NO: 163383 - RNA, 32 nt, Human
gauauucuugacaaucaucagcaacaaagauc

SEQ ID NO: 163384 - RNA, 32 nt, Human
gauauucuuggccaauaguuucagagaaaguc

SEQ ID NO: 163385 - RNA, 32 nt, Human
gauauugaagaaaagacugaagugaaagaaga

SEQ ID NO: 163386 - RNA, 32 nt, Human
gauauugauguuggucguuuccaaacacuaau

SEQ ID NO: 163387 - RNA, 32 nt, Human
gauauugcauuuucauauucuuuauuuauaaa

SEQ ID NO: 163388 - RNA, 32 nt, Human
gauauugcuaucuucuuaguacccguaccuua

SEQ ID NO: 163389 - RNA, 32 nt, Human
gauauugcuauguuggccaggcuggucucaaa

SEQ ID NO: 163390 - RNA, 32 nt, Human
gauauugcugggauauugaggguuguggauga

SEQ ID NO: 163391 - RNA, 32 nt, Human
gauauugcuucagcauuucaaauauguugcaa

SEQ ID NO: 163392 - RNA, 32 nt, Human
gauauuggcacaaauguuuuauacaaagaguu

SEQ ID NO: 163393 - RNA, 32 nt, Human
gauauuggggcugaggggaguuugagguguua

SEQ ID NO: 163394 - RNA, 32 nt, Human
gauauuggugaguugccaaagaagcaauacag

SEQ ID NO: 163395 - RNA, 32 nt, Human
gauauugucuucaugcgaacuugguauccugu

SEQ ID NO: 163396 - RNA, 32 nt, Human
gauauugucuucaugugaacuugguauccugu

SEQ ID NO: 163397 - RNA, 32 nt, Human
gauauugugccacugcacuccagccugggcga

SEQ ID NO: 163398 - RNA, 32 nt, Human
gauauuguuuuucuaaaaacaaaugcuguuua

SEQ ID NO: 163399 - RNA, 32 nt, Human
gauauuuaugauacauguaugacuugucuaag

SEQ ID NO: 163400 - RNA, 32 nt, Human
gauauuuauggaggggacuaugagagguuugg

SEQ ID NO: 163401 - RNA, 32 nt, Human
gauauuuauuuauuuucccugagccuauaucu

SEQ ID NO: 163402 - RNA, 32 nt, Human
gauauuucaagaacuggaccagcuccaaaagg

SEQ ID NO: 163403 - RNA, 32 nt, Human
gauauuucacauugaaaugaaaagccuuucuc

SEQ ID NO: 163404 - RNA, 32 nt, Human
gauauuucagcccuuuccuguggccugguccu

SEQ ID NO: 163405 - RNA, 19 nt, Human
gauauuucagcuccaggaa

SEQ ID NO: 163406 - RNA, 32 nt, Human
gauauuucugcacuugggcccuccucugggag

SEQ ID NO: 163407 - RNA, 32 nt, Human
gauauuucuggaccacucaagcucuucgauac

SEQ ID NO: 163408 - RNA, 32 nt, Human
gauauuucuguaacucauucucuuggugcuca

SEQ ID NO: 163409 - RNA, 32 nt, Human
gauauuucuuaacccagaccuuaugccucugu

SEQ ID NO: 163410 - RNA, 32 nt, Human
gauauuucuugcccuguucccccuggaaugug

SEQ ID NO: 163411 - RNA, 32 nt, Human
gauauuugauuuuacaaaaaugguuauuaaag

SEQ ID NO: 163412 - RNA, 32 nt, Human
gauauuuggaguucuuacaacauggcagacau

SEQ ID NO: 163413 - RNA, 32 nt, Human
gauauuugggaaucaaggcaacagauggauua

SEQ ID NO: 163414 - RNA, 32 nt, Human
gauauuuguaaucuuuuaccacuuugggguug

SEQ ID NO: 163415 - RNA, 32 nt, Human
gauauuuuagaguuggaaguuaugcaguaaaa

SEQ ID NO: 163416 - RNA, 32 nt, Human
gauauuuuccagauuuguuggaucuauuuggu

SEQ ID NO: 163417 - RNA, 32 nt, Human
gauauuuugccucauucacuuguacuguaaca

SEQ ID NO: 163418 - RNA, 32 nt, Human
gauauuuugcggggagcagggaagaucuuuga

SEQ ID NO: 163419 - RNA, 32 nt, Human
gauauuuuuacugugaagguguuuucaguugu

SEQ ID NO: 163420 - RNA, 32 nt, Human
gauauuuuuccgcuuggcaauuuccuuuccug

SEQ ID NO: 163421 - RNA, 32 nt, Human
gaucaaaacauagaaaccccaucucuacuaaa

SEQ ID NO: 163422 - RNA, 32 nt, Human
gaucaaaaccagccuggccaacauggugaaac

SEQ ID NO: 163423 - RNA, 32 nt, Human
gaucaaaaccuacaagauucaacugaaaaguu

SEQ ID NO: 163424 - RNA, 32 nt, Human
gaucaaaagacuaauaguuaaaaaccucagca

SEQ ID NO: 163425 - RNA, 31 nt, Human
gaucaaaagagacuugccuuuuaaggaucga

SEQ ID NO: 163426 - RNA, 32 nt, Human
gaucaaacaacugccugagaacugaauuagga

SEQ ID NO: 163427 - RNA, 32 nt, Human
gaucaaacaagugucuuuuacuuaagaagaaa

SEQ ID NO: 163428 - RNA, 32 nt, Human
gaucaaaccacuguaguccagccugagugaca

SEQ ID NO: 163429 - RNA, 32 nt, Human
gaucaaagacacacuuuucaugaccucaaaug

SEQ ID NO: 163430 - RNA, 32 nt, Human
gaucaaaggcgcagcccaggaggcgggagccc

SEQ ID NO: 163431 - RNA, 32 nt, Human
gaucaaaguucugcuuucuccccaaugagacu

SEQ ID NO: 163432 - RNA, 32 nt, Human
gaucaaauacuccuggcccauggauccauucc

SEQ ID NO: 163433 - RNA, 32 nt, Human
gaucaaauauagaaaguugauauucaaccuca

SEQ ID NO: 163434 - RNA, 32 nt, Human
gaucaaauggcagaaaagcaguuagacuacaa

SEQ ID NO: 163435 - RNA, 32 nt, Human
gaucaaauuaucuguaugacaauuguaucuuc

SEQ ID NO: 163436 - RNA, 32 nt, Human
gaucaacacaaauagcugcagccuggguuaaa

SEQ ID NO: 163437 - RNA, 32 nt, Human
gaucaacauauguuaagaacaugcaguucagu

SEQ ID NO: 163438 - RNA, 32 nt, Human
gaucaacauggugaaaccccgucucuacuaaa

SEQ ID NO: 163439 - RNA, 32 nt, Human
gaucaacauggugaaaccccgucuuuacuaaa

SEQ ID NO: 163440 - RNA, 32 nt, Human
gaucaaccaaguuugggaacccuuccccacau

SEQ ID NO: 163441 - RNA, 32 nt, Human
gaucaacccaggaagggaugaucaggagaggc

SEQ ID NO: 163442 - RNA, 32 nt, Human
gaucaaccuccaggagcuagcagcgggcgcgg

SEQ ID NO: 163443 - RNA, 32 nt, Human
gaucaacguggugaaaccucuacuaaaaauac

SEQ ID NO: 163444 - RNA, 32 nt, Human
gaucaacuggaagaaaggguaucagcaauggc

SEQ ID NO: 163445 - RNA, 32 nt, Human
gaucaacuucuuucuugugucucccagcacac

SEQ ID NO: 163446 - RNA, 32 nt, Human
gaucaagaaaauuucuuucuucaugacccugc

SEQ ID NO: 163447 - RNA, 32 nt, Human
gaucaagaacauccuggcuaacacggugaaac

SEQ ID NO: 163448 - RNA, 18 nt, Human
gaucaagaaccugguggg

SEQ ID NO: 163449 - RNA, 32 nt, Human
gaucaagaccagccuggccaacauagugaaac

SEQ ID NO: 163450 - RNA, 32 nt, Human
gaucaagagcuuaaaaccagcccaggcaacau

SEQ ID NO: 163451 - RNA, 32 nt, Human
gaucaagagguugaagcugcagugagcuguga

SEQ ID NO: 163452 - RNA, 32 nt, Human
gaucaagaugaugaagccagaguucaguauga

SEQ ID NO: 163453 - RNA, 32 nt, Human
gaucaagcaagaaagaaaaagacagaaaacaa

SEQ ID NO: 163454 - RNA, 32 nt, Human
gaucaagcacauauucuucuaguccagaucua

SEQ ID NO: 163455 - RNA, 32 nt, Human
gaucaagcacuggccucugccccuccuccuuc

SEQ ID NO: 163456 - RNA, 32 nt, Human
gaucaagccaaagaauucucauguacucuacc

SEQ ID NO: 163457 - RNA, 32 nt, Human
gaucaagccacugcacuccagccugggcgaca

SEQ ID NO: 163458 - RNA, 32 nt, Human
gaucaagccauugcacuccagccugggcaaca

SEQ ID NO: 163459 - RNA, 32 nt, Human
gaucaagccauuguacuccagccuggacaaca

SEQ ID NO: 163460 - RNA, 32 nt, Human
gaucaagcuccggaagaugguggagggucaug

SEQ ID NO: 163461 - RNA, 32 nt, Human
gaucaaggaguaaaccagaagaagaagaaaaa

SEQ ID NO: 163462 - RNA, 32 nt, Human
gaucaagggaaacuacucuaagaggcuacacu

SEQ ID NO: 163463 - RNA, 32 nt, Human
gaucaaggguuccacugugggaacggcuuggc

SEQ ID NO: 163464 - RNA, 19 nt, Human
gaucaaguccucugguagg

SEQ ID NO: 163465 - RNA, 32 nt, Human
gaucaagugaaaaagcugcaucaagacccauu

SEQ ID NO: 163466 - RNA, 32 nt, Human
gaucaaguucgggggaauaaagacagaccaca

SEQ ID NO: 163467 - RNA, 18 nt, Human
gaucaaguugaugauggg

SEQ ID NO: 163468 - RNA, 19 nt, Human
gaucaaguugucugaagga

SEQ ID NO: 163469 - RNA, 32 nt, Human
gaucaauaugaccacacuccagccaaggacaa

SEQ ID NO: 163470 - RNA, 32 nt, Human
gaucaauaugaugaaaccccugucucuacuaa

SEQ ID NO: 163471 - RNA, 32 nt, Human
gaucaaucagugugauuagcuuucucagcaga

SEQ ID NO: 163472 - RNA, 30 nt, Human
gaucaauggaaaggaauagugaguccagaa

SEQ ID NO: 163473 - RNA, 32 nt, Human
gaucaauguguguguccucugacgcaguuucc

SEQ ID NO: 163474 - RNA, 32 nt, Human
gaucaauuucccauugaacugaacaugcaaca

SEQ ID NO: 163475 - RNA, 32 nt, Human
gaucacaaauccaaacccuucagaagaaggua

SEQ ID NO: 163476 - RNA, 32 nt, Human
gaucacaaggcagacucagugggauccuccua

SEQ ID NO: 163477 - RNA, 24 nt, Human
gaucacaagguccagaguucaaga

SEQ ID NO: 163478 - RNA, 32 nt, Human
gaucacaauggcaggggacagaaugugcaugg

SEQ ID NO: 163479 - RNA, 32 nt, Human
gaucacacaacugcacuccagccugggcaaca

SEQ ID NO: 163480 - RNA, 32 nt, Human
gaucacacaauugcaguccagccugggcagca

SEQ ID NO: 163481 - RNA, 32 nt, Human
gaucacacaucuguauuccagccugggcaaua

SEQ ID NO: 163482 - RNA, 32 nt, Human
gaucacaccacaguacuccagccuaggugaca

SEQ ID NO: 163483 - RNA, 32 nt, Human
gaucacaccaccacacuccagccugagcagca

SEQ ID NO: 163484 - RNA, 32 nt, Human
gaucacaccaccacuccagccugggcgagagc

SEQ ID NO: 163485 - RNA, 32 nt, Human
gaucacaccaccgcacuccacccugggaagca

SEQ ID NO: 163486 - RNA, 32 nt, Human
gaucacaccaccucacuccagccugggcaaca

SEQ ID NO: 163487 - RNA, 32 nt, Human
gaucacaccacuacacuccagccuaggcaaca

SEQ ID NO: 163488 - RNA, 32 nt, Human
gaucacaccacuacacuccagccuggacaaca

SEQ ID NO: 163489 - RNA, 32 nt, Human
gaucacaccacuacacuccagccugggcgaca

SEQ ID NO: 163490 - RNA, 32 nt, Human
gaucacaccacuacacuccagccugggcgaga

SEQ ID NO: 163491 - RNA, 32 nt, Human
gaucacaccacuccacuccagucuggacaaca

SEQ ID NO: 163492 - RNA, 32 nt, Human
gaucacaccacugaccucuagccugguggcag

SEQ ID NO: 163493 - RNA, 32 nt, Human
gaucacaccacugcaauccagccucgguaaca

SEQ ID NO: 163494 - RNA, 32 nt, Human
gaucacaccacugcaauccagccugggcgaca

SEQ ID NO: 163495 - RNA, 32 nt, Human
gaucacaccacugcaccccagccugggugaca

SEQ ID NO: 163496 - RNA, 32 nt, Human
gaucacaccacugcacuacagccucggcaaua

SEQ ID NO: 163497 - RNA, 32 nt, Human
gaucacaccacugcacucagccugggugacag

SEQ ID NO: 163498 - RNA, 32 nt, Human
gaucacaccacugcacuccaaccuggacaaca

SEQ ID NO: 163499 - RNA, 32 nt, Human
gaucacaccacugcacuccaaccugggaaacg

SEQ ID NO: 163500 - RNA, 32 nt, Human
gaucacaccacugcacuccagccagggcaaca

SEQ ID NO: 163501 - RNA, 32 nt, Human
gaucacaccacugcacuccagcccaggugaca

SEQ ID NO: 163502 - RNA, 32 nt, Human
gaucacaccacugcacuccagccuaggcaaca

SEQ ID NO: 163503 - RNA, 32 nt, Human
gaucacaccacugcacuccagccuggacaaca

SEQ ID NO: 163504 - RNA, 32 nt, Human
gaucacaccacugcacuccagccuggacgaca

SEQ ID NO: 163505 - RNA, 32 nt, Human
gaucacaccacugcacuccagccuggcaacag

SEQ ID NO: 163506 - RNA, 32 nt, Human
gaucacaccacugcacuccagccuggcgacag

SEQ ID NO: 163507 - RNA, 32 nt, Human
gaucacaccacugcacuccagccugggagaga

SEQ ID NO: 163508 - RNA, 32 nt, Human
gaucacaccacugcacuccagccugggcaaca

SEQ ID NO: 163509 - RNA, 32 nt, Human
gaucacaccacugcacuccagccugggcaaua

SEQ ID NO: 163510 - RNA, 32 nt, Human
gaucacaccacugcacuccagccugggcgaca

SEQ ID NO: 163511 - RNA, 32 nt, Human
gaucacaccacugcacuccagccugggcggca

SEQ ID NO: 163512 - RNA, 32 nt, Human
gaucacaccacugcacuccagccugggggaca

SEQ ID NO: 163513 - RNA, 32 nt, Human
gaucacaccacugcacuccagccuggggugau

SEQ ID NO: 163514 - RNA, 32 nt, Human
gaucacaccacugcacuccagccuggguaaaa

SEQ ID NO: 163515 - RNA, 32 nt, Human
gaucacaccacugcacuccagccugggugaca

SEQ ID NO: 163516 - RNA, 32 nt, Human
gaucacaccacugcacuccagccugggugaua

SEQ ID NO: 163517 - RNA, 32 nt, Human
gaucacaccacugcacuccagccuggguggca

SEQ ID NO: 163518 - RNA, 32 nt, Human
gaucacaccacugcacuccagccuggguguca

SEQ ID NO: 163519 - RNA, 32 nt, Human
gaucacaccacugcacuccagccuggucaaca

SEQ ID NO: 163520 - RNA, 32 nt, Human
gaucacaccacugcacuccagccuggugacag

SEQ ID NO: 163521 - RNA, 32 nt, Human
gaucacaccacugcacuccagccugugcgaca

SEQ ID NO: 163522 - RNA, 32 nt, Human
gaucacaccacugcacuccagccuuggcgaca

SEQ ID NO: 163523 - RNA, 32 nt, Human
gaucacaccacugcacuccagucugggcacca

SEQ ID NO: 163524 - RNA, 32 nt, Human
gaucacaccacugcacuccagugugagcaaca

SEQ ID NO: 163525 - RNA, 32 nt, Human
gaucacaccacugcacuccauccagccugggu

SEQ ID NO: 163526 - RNA, 32 nt, Human
gaucacaccacugcacuccggccugggcgaca

SEQ ID NO: 163527 - RNA, 32 nt, Human
gaucacaccacugcacucuagccugggcaaca

SEQ ID NO: 163528 - RNA, 32 nt, Human
gaucacaccacugcacucuagccugggugaca

SEQ ID NO: 163529 - RNA, 32 nt, Human
gaucacaccacugcacucuggccugcaugcac

SEQ ID NO: 163530 - RNA, 32 nt, Human
gaucacaccacugcacuucagccugggcaaca

SEQ ID NO: 163531 - RNA, 32 nt, Human
gaucacaccacugcacuucauccuaggcaaca

SEQ ID NO: 163532 - RNA, 32 nt, Human
gaucacaccacugcauuccagccugggcacua

SEQ ID NO: 163533 - RNA, 32 nt, Human
gaucacaccacugcauuccagccugggugaca

SEQ ID NO: 163534 - RNA, 32 nt, Human
gaucacaccacugcauucccgccugggcagca

SEQ ID NO: 163535 - RNA, 32 nt, Human
gaucacaccacugcauucuggccugggugaca

SEQ ID NO: 163536 - RNA, 32 nt, Human
gaucacaccacugcgcucuagccuggacaaca

SEQ ID NO: 163537 - RNA, 32 nt, Human
gaucacaccacugcgcucuagccugggcaaca

SEQ ID NO: 163538 - RNA, 32 nt, Human
gaucacaccacuggcacuccagccugggcaac

SEQ ID NO: 163539 - RNA, 32 nt, Human
gaucacaccacuguaccacagccugagcaacg

SEQ ID NO: 163540 - RNA, 32 nt, Human
gaucacaccacuguacuccagcccggcacucc

SEQ ID NO: 163541 - RNA, 32 nt, Human
gaucacaccacuguacuccagccugagugaca

SEQ ID NO: 163542 - RNA, 32 nt, Human
gaucacaccacuguacuccagccuggaugaca

SEQ ID NO: 163543 - RNA, 32 nt, Human
gaucacaccacuguacuccagccugggcaaca

SEQ ID NO: 163544 - RNA, 32 nt, Human
gaucacaccacuguacuccagccugggugaca

SEQ ID NO: 163545 - RNA, 32 nt, Human
gaucacaccacuguauuccagccugggugacu

SEQ ID NO: 163546 - RNA, 32 nt, Human
gaucacaccacugugcucuagccuggacaaca

SEQ ID NO: 163547 - RNA, 32 nt, Human
gaucacaccagccuaaccaacaugaugaaacu

SEQ ID NO: 163548 - RNA, 32 nt, Human
gaucacaccagugcacuccagccugggcgaca

SEQ ID NO: 163549 - RNA, 32 nt, Human
gaucacaccaucgcacuccagccuaggcaaca

SEQ ID NO: 163550 - RNA, 32 nt, Human
gaucacaccauugcacuccaaccugggcaaca

SEQ ID NO: 163551 - RNA, 32 nt, Human
gaucacaccauugcacuccagccuagauaaca

SEQ ID NO: 163552 - RNA, 32 nt, Human
gaucacaccauugcacuccagccuaggcaaca

SEQ ID NO: 163553 - RNA, 32 nt, Human
gaucacaccauugcacuccagccuaggcaugg

SEQ ID NO: 163554 - RNA, 32 nt, Human
gaucacaccauugcacuccagccugagcaaca

SEQ ID NO: 163555 - RNA, 32 nt, Human
gaucacaccauugcacuccagccugggaaaca

SEQ ID NO: 163556 - RNA, 32 nt, Human
gaucacaccauugcacuccagccugggcaaaa

SEQ ID NO: 163557 - RNA, 32 nt, Human
gaucacaccauugcacuccagccugggcaaca

SEQ ID NO: 163558 - RNA, 32 nt, Human
gaucacaccauugcacuccagccugggcgaca

SEQ ID NO: 163559 - RNA, 32 nt, Human
gaucacaccauugcacugcagccugggugaag

SEQ ID NO: 163560 - RNA, 32 nt, Human
gaucacaccauugcacuucagccugggcgaca

SEQ ID NO: 163561 - RNA, 32 nt, Human
gaucacaccauugcccuccagccugggugaca

SEQ ID NO: 163562 - RNA, 24 nt, Human
gaucacaccauugcgcuucagccu

SEQ ID NO: 163563 - RNA, 32 nt, Human
gaucacaccauugcgcuucagccugggcaaca

SEQ ID NO: 163564 - RNA, 32 nt, Human
gaucacaccauugcuguccagccugggugaca

SEQ ID NO: 163565 - RNA, 32 nt, Human
gaucacaccgcugcacucaagccugggugaca

SEQ ID NO: 163566 - RNA, 32 nt, Human
gaucacaccugacugcacuccagccugggugg

SEQ ID NO: 163567 - RNA, 32 nt, Human
gaucacaccugcaaucccagcacuuugggagg

SEQ ID NO: 163568 - RNA, 32 nt, Human
gaucacaccuguaaucccagcacuuugggagg

SEQ ID NO: 163569 - RNA, 32 nt, Human
gaucacacgacugcauucuagccugggugaca

SEQ ID NO: 163570 - RNA, 32 nt, Human
gaucacacgccacugcacuccagccuggguga

SEQ ID NO: 163571 - RNA, 32 nt, Human
gaucacacuacugcacuccagccugggcaaca

SEQ ID NO: 163572 - RNA, 32 nt, Human
gaucacacuacugcacuccagccugggcgaca

SEQ ID NO: 163573 - RNA, 32 nt, Human
gaucacacuacugcacuccugcaugggcgacu

SEQ ID NO: 163574 - RNA, 32 nt, Human
gaucacacuacugcauuccagccugagcaaca

SEQ ID NO: 163575 - RNA, 32 nt, Human
gaucacacuauugcacuccagccugggcgaca

SEQ ID NO: 163576 - RNA, 32 nt, Human
gaucacacugcugcacuccagccugugcaaca

SEQ ID NO: 163577 - RNA, 32 nt, Human
gaucacacuuauuugugcaaaauugauuuuca

SEQ ID NO: 163578 - RNA, 32 nt, Human
gaucacagaggcuucuucagaucaaugcuuga

SEQ ID NO: 163579 - RNA, 32 nt, Human
gaucacagauggagagacauuuugccacacga

SEQ ID NO: 163580 - RNA, 32 nt, Human
gaucacagcacacacauacauacacccuccac

SEQ ID NO: 163581 - RNA, 32 nt, Human
gaucacagcacugcacugcugccugggcgaca

SEQ ID NO: 163582 - RNA, 24 nt, Human
gaucacagcauugcacuucagccu

SEQ ID NO: 163583 - RNA, 25 nt, Human
gaucacagccccccuaccuuuugcc

SEQ ID NO: 163584 - RNA, 23 nt, Human
gaucacagcccuuggcccugcuu

SEQ ID NO: 163585 - RNA, 31 nt, Human
gaucacagccucucuugggccguacuguguu

SEQ ID NO: 163586 - RNA, 31 nt, Human
gaucacagccucucuugggcuguacuguguu

SEQ ID NO: 163587 - RNA, 32 nt, Human
gaucacagcuacucgggaggcugaggcacgag

SEQ ID NO: 163588 - RNA, 21 nt, Human
gaucacagcucacugcagcuu

SEQ ID NO: 163589 - RNA, 32 nt, Human
gaucacagcuuacugcagccuugaccucccag

SEQ ID NO: 163590 - RNA, 32 nt, Human
gaucacaggcugagggacagagcaaagacccc

SEQ ID NO: 163591 - RNA, 32 nt, Human
gaucacaggcuucuuuuguuuuguuucuugcu

SEQ ID NO: 163592 - RNA, 32 nt, Human
gaucacaguauuuaaguguuuugcguuuuaua

SEQ ID NO: 163593 - RNA, 21 nt, Human
gaucacagucgcuuccugucu

SEQ ID NO: 163594 - RNA, 32 nt, Human
gaucacagugcugggaaaugggagcacaguaa

SEQ ID NO: 163595 - RNA, 24 nt, Human
gaucacaguucuguguucuggccu

SEQ ID NO: 163596 - RNA, 32 nt, Human
gaucacaguucuguguucuggccuguggcagg

SEQ ID NO: 163597 - RNA, 32 nt, Human
gaucacaucaccucucugccucaguuucccca

SEQ ID NO: 163598 - RNA, 32 nt, Human
gaucacaucacugcacuccagccuggguaaca

SEQ ID NO: 163599 - RNA, 32 nt, Human
gaucacaucacugcacuccauccugggugaca

SEQ ID NO: 163600 - RNA, 32 nt, Human
gaucacaucacugcaguccagccugggugaca

SEQ ID NO: 163601 - RNA, 32 nt, Human
gaucacauccagcccccagugccugcacggcu

SEQ ID NO: 163602 - RNA, 32 nt, Human
gaucacauucuuuaacaaggaccuguccaaca

SEQ ID NO: 163603 - RNA, 20 nt, Human
gaucacauugcaaagcuuuc

SEQ ID NO: 163604 - RNA, 32 nt, Human
gaucacauuuuucugccuguguacuuuugcuu

SEQ ID NO: 163605 - RNA, 32 nt, Human
gaucaccaaacagacaagccgguccuucauuc

SEQ ID NO: 163606 - RNA, 32 nt, Human
gaucaccaaaggacugagaaucugggagggca

SEQ ID NO: 163607 - RNA, 32 nt, Human
gaucaccaaaggccaggaguuugaggcugcag

SEQ ID NO: 163608 - RNA, 32 nt, Human
gaucaccaagaguaugaggcuccugcucugau

SEQ ID NO: 163609 - RNA, 32 nt, Human
gaucaccaagccccacccagacuuccgccugu

SEQ ID NO: 163610 - RNA, 32 nt, Human
gaucaccaauccagaugguauugcucccucag

SEQ ID NO: 163611 - RNA, 32 nt, Human
gaucaccacagcccuccucuuccgugagccuu

SEQ ID NO: 163612 - RNA, 32 nt, Human
gaucaccagcucacuccgcugcagccgcccca

SEQ ID NO: 163613 - RNA, 32 nt, Human
gaucacccagcuguguucagaauuuucuuacu

SEQ ID NO: 163614 - RNA, 32 nt, Human
gaucaccccacugcauuccagccugggugaca

SEQ ID NO: 163615 - RNA, 32 nt, Human
gaucaccccacuguccuccagccugggcaaca

SEQ ID NO: 163616 - RNA, 32 nt, Human
gaucaccccacugugcuguagccugggugaca

SEQ ID NO: 163617 - RNA, 32 nt, Human
gaucaccccaggaauuagucacuaagaauucc

SEQ ID NO: 163618 - RNA, 32 nt, Human
gaucaccccauugcacuccagccuggacaaca

SEQ ID NO: 163619 - RNA, 32 nt, Human
gaucaccccauuucacuccagccugggcgaca

SEQ ID NO: 163620 - RNA, 32 nt, Human
gaucacccuccacaggcuugagcccaguccca

SEQ ID NO: 163621 - RNA, 32 nt, Human
gaucaccucacugcacgcuagccugggcaaca

SEQ ID NO: 163622 - RNA, 32 nt, Human
gaucaccugagguccggagaccagccuggcca

SEQ ID NO: 163623 - RNA, 32 nt, Human
gaucaccugagguuaagaguucaagaccagcc

SEQ ID NO: 163624 - RNA, 32 nt, Human
gaucaccugcagcuggccacaccacaggcccc

SEQ ID NO: 163625 - RNA, 32 nt, Human
gaucaccuuuaucuaaagugggagaagauaca

SEQ ID NO: 163626 - RNA, 32 nt, Human
gaucacgacacugcacuccagccugggcaacg

SEQ ID NO: 163627 - RNA, 32 nt, Human
gaucacgagggcagauuucucccuugcuguuc

SEQ ID NO: 163628 - RNA, 24 nt, Human
gaucacgauccugcacuccagccu

SEQ ID NO: 163629 - RNA, 32 nt, Human
gaucacgauccugcacuccagccugggcaaca

SEQ ID NO: 163630 - RNA, 19 nt, Human
gaucacgcagucaauggca

SEQ ID NO: 163631 - RNA, 32 nt, Human
gaucacgccacagcacuccagccugggcgaca

SEQ ID NO: 163632 - RNA, 32 nt, Human
gaucacgccacuacacuccagccugggcgaca

SEQ ID NO: 163633 - RNA, 32 nt, Human
gaucacgccacugaacuccagccugggagaca

SEQ ID NO: 163634 - RNA, 32 nt, Human
gaucacgccacugaacuccagccugggugaca

SEQ ID NO: 163635 - RNA, 32 nt, Human
gaucacgccacugcaacuccagcuugggugac

SEQ ID NO: 163636 - RNA, 32 nt, Human
gaucacgccacugcaccccagccugggugaca

SEQ ID NO: 163637 - RNA, 32 nt, Human
gaucacgccacugcacuacagccuggacgaca

SEQ ID NO: 163638 - RNA, 32 nt, Human
gaucacgccacugcacuauagccuaggugaca

SEQ ID NO: 163639 - RNA, 32 nt, Human
gaucacgccacugcacucaagccugggcgaca

SEQ ID NO: 163640 - RNA, 32 nt, Human
gaucacgccacugcacuccaaccugggugaca

SEQ ID NO: 163641 - RNA, 32 nt, Human
gaucacgccacugcacuccaacuugggcaaca

SEQ ID NO: 163642 - RNA, 32 nt, Human
gaucacgccacugcacuccaccugggcaacaa

SEQ ID NO: 163643 - RNA, 32 nt, Human
gaucacgccacugcacuccagcacccugggcg

SEQ ID NO: 163644 - RNA, 32 nt, Human
gaucacgccacugcacuccagcccgggcgaca

SEQ ID NO: 163645 - RNA, 32 nt, Human
gaucacgccacugcacuccagcccgggcggca

SEQ ID NO: 163646 - RNA, 32 nt, Human
gaucacgccacugcacuccagcccggggacag

SEQ ID NO: 163647 - RNA, 32 nt, Human
gaucacgccacugcacuccagccuaggcgaca

SEQ ID NO: 163648 - RNA, 32 nt, Human
gaucacgccacugcacuccagccucggugaca

SEQ ID NO: 163649 - RNA, 32 nt, Human
gaucacgccacugcacuccagccugagugaca

SEQ ID NO: 163650 - RNA, 32 nt, Human
gaucacgccacugcacuccagccugcggacag

SEQ ID NO: 163651 - RNA, 32 nt, Human
gaucacgccacugcacuccagccuggacaaca

SEQ ID NO: 163652 - RNA, 32 nt, Human
gaucacgccacugcacuccagccuggaugaca

SEQ ID NO: 163653 - RNA, 32 nt, Human
gaucacgccacugcacuccagccuggcgacag

SEQ ID NO: 163654 - RNA, 32 nt, Human
gaucacgccacugcacuccagccugggagaca

SEQ ID NO: 163655 - RNA, 32 nt, Human
gaucacgccacugcacuccagccugggcaaca

SEQ ID NO: 163656 - RNA, 32 nt, Human
gaucacgccacugcacuccagccugggcaacg

SEQ ID NO: 163657 - RNA, 32 nt, Human
gaucacgccacugcacuccagccugggccaca

SEQ ID NO: 163658 - RNA, 32 nt, Human
gaucacgccacugcacuccagccugggcgaca

SEQ ID NO: 163659 - RNA, 32 nt, Human
gaucacgccacugcacuccagccugggcgaug

SEQ ID NO: 163660 - RNA, 32 nt, Human
gaucacgccacugcacuccagccuggguaaca

SEQ ID NO: 163661 - RNA, 32 nt, Human
gaucacgccacugcacuccagccugggugaca

SEQ ID NO: 163662 - RNA, 32 nt, Human
gaucacgccacugcacuccagccuggucaaca

SEQ ID NO: 163663 - RNA, 32 nt, Human
gaucacgccacugcacuccagccuggugacag

SEQ ID NO: 163664 - RNA, 32 nt, Human
gaucacgccacugcacuccagccuguugacaa

SEQ ID NO: 163665 - RNA, 32 nt, Human
gaucacgccacugcacuccagcuggagugaca

SEQ ID NO: 163666 - RNA, 32 nt, Human
gaucacgccacugcacuccagcuugggugaca

SEQ ID NO: 163667 - RNA, 32 nt, Human
gaucacgccacugcacuccagucugggugaca

SEQ ID NO: 163668 - RNA, 32 nt, Human
gaucacgccacugcacuccauccagccugggu

SEQ ID NO: 163669 - RNA, 32 nt, Human
gaucacgccacugcacucuagccuaggcgaca

SEQ ID NO: 163670 - RNA, 32 nt, Human
gaucacgccacugcacucuagccugggauaca

SEQ ID NO: 163671 - RNA, 32 nt, Human
gaucacgccacugcacucuagccugggcaaca

SEQ ID NO: 163672 - RNA, 32 nt, Human
gaucacgccacugcacucuagccugggcaaua

SEQ ID NO: 163673 - RNA, 32 nt, Human
gaucacgccacugcacuugagccugggcgaca

SEQ ID NO: 163674 - RNA, 32 nt, Human
gaucacgccacugcauuacagccuggugcaga

SEQ ID NO: 163675 - RNA, 32 nt, Human
gaucacgccacugcauuccagacugggcgaca

SEQ ID NO: 163676 - RNA, 32 nt, Human
gaucacgccacugcauuccagccugggcgaca

SEQ ID NO: 163677 - RNA, 32 nt, Human
gaucacgccacugcauuccagccuggugacag

SEQ ID NO: 163678 - RNA, 32 nt, Human
gaucacgccacugcauuccagccugugcgaca

SEQ ID NO: 163679 - RNA, 32 nt, Human
gaucacgccacugcccuccagccuggggagac

SEQ ID NO: 163680 - RNA, 32 nt, Human
gaucacgccacugcgcuacagccugggcgaca

SEQ ID NO: 163681 - RNA, 32 nt, Human
gaucacgccacugcgcuccagccugggcgaaa

SEQ ID NO: 163682 - RNA, 32 nt, Human
gaucacgccacuguacuccagccuggaugaca

SEQ ID NO: 163683 - RNA, 32 nt, Human
gaucacgccacuguacuccagccugggagaca

SEQ ID NO: 163684 - RNA, 24 nt, Human
gaucacgccacuguacuucagccu

SEQ ID NO: 163685 - RNA, 32 nt, Human
gaucacgccacugugcuccagccugggcaaca

SEQ ID NO: 163686 - RNA, 32 nt, Human
gaucacgccagugcacuccagccugagagaca

SEQ ID NO: 163687 - RNA, 32 nt, Human
gaucacgccauuacacuccagccuggcugaca

SEQ ID NO: 163688 - RNA, 32 nt, Human
gaucacgccauuacacuccagccugggcaaca

SEQ ID NO: 163689 - RNA, 32 nt, Human
gaucacgccauugcacuacagccugggugaca

SEQ ID NO: 163690 - RNA, 32 nt, Human
gaucacgccauugcacuccaaccugggugaca

SEQ ID NO: 163691 - RNA, 32 nt, Human
gaucacgccauugcacuccagccuaggcaacg

SEQ ID NO: 163692 - RNA, 32 nt, Human
gaucacgccauugcacuccagccuaggcgaca

SEQ ID NO: 163693 - RNA, 32 nt, Human
gaucacgccauugcacuccagccugggcaaca

SEQ ID NO: 163694 - RNA, 32 nt, Human
gaucacgccauugcacuccagccugggcaacg

SEQ ID NO: 163695 - RNA, 32 nt, Human
gaucacgccauugcacuccagccugggcaaua

SEQ ID NO: 163696 - RNA, 32 nt, Human
gaucacgccauugcacuccagccugggcgaca

SEQ ID NO: 163697 - RNA, 32 nt, Human
gaucacgccauugcacuccagccugggggaca

SEQ ID NO: 163698 - RNA, 32 nt, Human
gaucacgccauugcacuccagccugggugaca

SEQ ID NO: 163699 - RNA, 32 nt, Human
gaucacgccauugcacuccagccugugcgaca

SEQ ID NO: 163700 - RNA, 32 nt, Human
gaucacgccauugcacuccagucugagcaaca

SEQ ID NO: 163701 - RNA, 32 nt, Human
gaucacgccauugcacuccagucugguugaca

SEQ ID NO: 163702 - RNA, 32 nt, Human
gaucacgccauuguacuccagccuggcaacag

SEQ ID NO: 163703 - RNA, 32 nt, Human
gaucacgccauuguacuccagccugggcaaca

SEQ ID NO: 163704 - RNA, 32 nt, Human
gaucacgccauuguacuccagccugggcgaca

SEQ ID NO: 163705 - RNA, 32 nt, Human
gaucacgccgcugcacuccagccugagcacag

SEQ ID NO: 163706 - RNA, 32 nt, Human
gaucacgccguugcacuccagccugggcaaca

SEQ ID NO: 163707 - RNA, 32 nt, Human
gaucacgccucugcacuccagccugggcaaca

SEQ ID NO: 163708 - RNA, 32 nt, Human
gaucacgccuguaaucccagcacauugggagg

SEQ ID NO: 163709 - RNA, 32 nt, Human
gaucacgccuguaaucccagcacuuagggagg

SEQ ID NO: 163710 - RNA, 32 nt, Human
gaucacgccuguaaucccagcgcuuugggagg

SEQ ID NO: 163711 - RNA, 32 nt, Human
gaucacgcuacugcgcuccagccugagugaua

SEQ ID NO: 163712 - RNA, 32 nt, Human
gaucacggcacugcgcugcagccugggcaaca

SEQ ID NO: 163713 - RNA, 21 nt, Human
gaucacggcucacucuagccu

SEQ ID NO: 163714 - RNA, 32 nt, Human
gaucacgucacugcacuccagcuugggcaaca

SEQ ID NO: 163715 - RNA, 32 nt, Human
gaucacgucacugcacuccggccugggugaca

SEQ ID NO: 163716 - RNA, 32 nt, Human
gaucacgucacugcauuccagccuggauaaua

SEQ ID NO: 163717 - RNA, 24 nt, Human
gaucacgucacugcauuucagccu

SEQ ID NO: 163718 - RNA, 32 nt, Human
gaucacgucacuguacuccagccugggugaca

SEQ ID NO: 163719 - RNA, 32 nt, Human
gaucacgucauugcacuccagccuggucaaca

SEQ ID NO: 163720 - RNA, 32 nt, Human
gaucacgucauugcucuccagccugggcaaca

SEQ ID NO: 163721 - RNA, 32 nt, Human
gaucacuacaaccuccaccucccggguucaag

SEQ ID NO: 163722 - RNA, 32 nt, Human
gaucacuaggaggcagagguugcagugagcag

SEQ ID NO: 163723 - RNA, 32 nt, Human
gaucacuccacugcacuccagccugggcaaca

SEQ ID NO: 163724 - RNA, 32 nt, Human
gaucacuccacugcacuccagccugggcgaca

SEQ ID NO: 163725 - RNA, 32 nt, Human
gaucacuccacugcacuccagccugggugaca

SEQ ID NO: 163726 - RNA, 32 nt, Human
gaucacuccagugcacucgagccugggugaca

SEQ ID NO: 163727 - RNA, 32 nt, Human
gaucacucuacagccugccuccuggguuuucc

SEQ ID NO: 163728 - RNA, 32 nt, Human
gaucacugaaguccaagaguucgagaccggcc

SEQ ID NO: 163729 - RNA, 32 nt, Human
gaucacugacccagggcucagagcagaggcca

SEQ ID NO: 163730 - RNA, 32 nt, Human
gaucacugcaaccuccaccucccagguucaag

SEQ ID NO: 163731 - RNA, 32 nt, Human
gaucacugcaaccuccaccuccuagguucaag

SEQ ID NO: 163732 - RNA, 32 nt, Human
gaucacugcaaccuccgccuccuggguucaag

SEQ ID NO: 163733 - RNA, 32 nt, Human
gaucacugcaaccucugccuccuggguucaag

SEQ ID NO: 163734 - RNA, 32 nt, Human
gaucacugcagccucaaacuccugggcucaag

SEQ ID NO: 163735 - RNA, 32 nt, Human
gaucacugcagccuccaacuccugggcucaag

SEQ ID NO: 163736 - RNA, 32 nt, Human
gaucacugcccuuuuugaaaucaccugguauu

SEQ ID NO: 163737 - RNA, 32 nt, Human
gaucacuggaacggagugaccacugagaugcu

SEQ ID NO: 163738 - RNA, 32 nt, Human
gaucacuggagaaagagaaacuauccaccagg

SEQ ID NO: 163739 - RNA, 32 nt, Human
gaucacuggaguucgaggcugcagugagcuau

SEQ ID NO: 163740 - RNA, 32 nt, Human
gaucacuggcacaaaccaccaugcccagcuaa

SEQ ID NO: 163741 - RNA, 32 nt, Human
gaucacugggcugacauggagaaggcuggcaa

SEQ ID NO: 163742 - RNA, 32 nt, Human
gaucacugucugcagucaccaccggcuuggag

SEQ ID NO: 163743 - RNA, 32 nt, Human
gaucacuuaagccugggaggcaauggcugcag

SEQ ID NO: 163744 - RNA, 31 nt, Human
gaucacuugagcccaggaguuggagaccaga

SEQ ID NO: 163745 - RNA, 31 nt, Human
gaucacuugagcccaggaguuggagaccagc

SEQ ID NO: 163746 - RNA, 31 nt, Human
gaucacuugagccugggaguuggagaccagc

SEQ ID NO: 163747 - RNA, 32 nt, Human
gaucacuugagccugggggacugaggcugcag

SEQ ID NO: 163748 - RNA, 32 nt, Human
gaucacuugaggucaggagaccagccgggcca

SEQ ID NO: 163749 - RNA, 31 nt, Human
gaucacuugaguucaggaguuggagaccagg

SEQ ID NO: 163750 - RNA, 32 nt, Human
gaucacuuuagcagguugcagcuuggagcgug

SEQ ID NO: 163751 - RNA, 32 nt, Human
gaucacuuugagaaacaaacuuuuauuaaaug

SEQ ID NO: 163752 - RNA, 32 nt, Human
gaucacuuuggaggcaggguggugggggugua

SEQ ID NO: 163753 - RNA, 32 nt, Human
gaucagaaagcuaccaaacacacugcucagaa

SEQ ID NO: 163754 - RNA, 32 nt, Human
gaucagaacugauuauuugguuuucuguguga

SEQ ID NO: 163755 - RNA, 32 nt, Human
gaucagaagaaagaaagacaacuuuccucugc

SEQ ID NO: 163756 - RNA, 32 nt, Human
gaucagaagcauuucuuuacuaauuuagauuc

SEQ ID NO: 163757 - RNA, 32 nt, Human
gaucagaaggcaagggauaggcaguggucacc

SEQ ID NO: 163758 - RNA, 32 nt, Human
gaucagaaguuugagaccauccuggccaacau

SEQ ID NO: 163759 - RNA, 32 nt, Human
gaucagaaugcaagcuguagguggguggguga

SEQ ID NO: 163760 - RNA, 32 nt, Human
gaucagacacaccugucuucaguggcuugcag

SEQ ID NO: 163761 - RNA, 18 nt, Human
gaucagaccacacccuca

SEQ ID NO: 163762 - RNA, 32 nt, Human
gaucagaccacugcccuccagccugggcaaua

SEQ ID NO: 163763 - RNA, 32 nt, Human
gaucagacucuccuucaggguuuauuuagguu

SEQ ID NO: 163764 - RNA, 32 nt, Human
gaucagacuugaccauucaccuccaguaccug

SEQ ID NO: 163765 - RNA, 32 nt, Human
gaucagacuuuaauuucucugcaucaggugua

SEQ ID NO: 163766 - RNA, 32 nt, Human
gaucagagcaguuacucucagcagaacaccua

SEQ ID NO: 163767 - RNA, 32 nt, Human
gaucagagugggaagaccucagccuugggugg

SEQ ID NO: 163768 - RNA, 32 nt, Human
gaucagaguucaggacucugagugcccacaca

SEQ ID NO: 163769 - RNA, 32 nt, Human
gaucagaucaaauaucuauguaaugaaaagag

SEQ ID NO: 163770 - RNA, 32 nt, Human
gaucagaugguuuuacuauuguggcagaagcg

SEQ ID NO: 163771 - RNA, 32 nt, Human
gaucagauucaucaaaugguacguaguccaau

SEQ ID NO: 163772 - RNA, 32 nt, Human
gaucagauuugcuaacaggaagcauucuuuac

SEQ ID NO: 163773 - RNA, 32 nt, Human
gaucagcaacccuuccugcugcugcuacugcu

SEQ ID NO: 163774 - RNA, 32 nt, Human
gaucagcaccuuguauaggaauucccaugaau

SEQ ID NO: 163775 - RNA, 32 nt, Human
gaucagcacugcacuguuagcugagagugcgg

SEQ ID NO: 163776 - RNA, 32 nt, Human
gaucagcagacugggagguggggagaaguccg

SEQ ID NO: 163777 - RNA, 32 nt, Human
gaucagcagcaucuccaccugccaucucaccc

SEQ ID NO: 163778 - RNA, 32 nt, Human
gaucagcaguuccagccccucgcugcuggggg

SEQ ID NO: 163779 - RNA, 32 nt, Human
gaucagcauggagcuccuuauggagaaagagc

SEQ ID NO: 163780 - RNA, 32 nt, Human
gaucagccauggagcagccacaggaggaagcc

SEQ ID NO: 163781 - RNA, 32 nt, Human
gaucagccccuccugguggccagccuuucccc

SEQ ID NO: 163782 - RNA, 32 nt, Human
gaucagccccuuaaaaugaguucuagagcagg

SEQ ID NO: 163783 - RNA, 32 nt, Human
gaucagccggaagagaaaaugagaccccagag

SEQ ID NO: 163784 - RNA, 32 nt, Human
gaucagcgauaggugaggggacacaguguagg

SEQ ID NO: 163785 - RNA, 32 nt, Human
gaucagcgcagaccugcagucucuccaggugg

SEQ ID NO: 163786 - RNA, 32 nt, Human
gaucagcgugggguggaggagaaguggaguuu

SEQ ID NO: 163787 - RNA, 32 nt, Human
gaucagcucagcggcccagcugcuuaucuguc

SEQ ID NO: 163788 - RNA, 32 nt, Human
gaucagcuccacccucgagcacuuugccagca

SEQ ID NO: 163789 - RNA, 32 nt, Human
gaucagcuggguuuuggccaggaaguugucuu

SEQ ID NO: 163790 - RNA, 32 nt, Human
gaucagcugguuuaaaggucuugauuccuagg

SEQ ID NO: 163791 - RNA, 32 nt, Human
gaucagcuuaccggaagaaaugaagaauuaag

SEQ ID NO: 163792 - RNA, 32 nt, Human
gaucagcuugauacaagaacuacugauuucaa

SEQ ID NO: 163793 - RNA, 32 nt, Human
gaucaggaagagaaggagcagagcagagcuga

SEQ ID NO: 163794 - RNA, 32 nt, Human
gaucaggaaggaugagucugaucuggaguaaa

SEQ ID NO: 163795 - RNA, 32 nt, Human
gaucaggaaugcugggcuggaguucagguccu

SEQ ID NO: 163796 - RNA, 32 nt, Human
gaucaggacaggcagagguggucagggagaag

SEQ ID NO: 163797 - RNA, 32 nt, Human
gaucaggaccaacauggugaaaccccaucucu

SEQ ID NO: 163798 - RNA, 32 nt, Human
gaucaggaccauccacugugcacgguuaaaag

SEQ ID NO: 163799 - RNA, 32 nt, Human
gaucaggagacugagauucagagcagggaggg

SEQ ID NO: 163800 - RNA, 32 nt, Human
gaucaggagaggcuucccugaggacauaaugu

SEQ ID NO: 163801 - RNA, 32 nt, Human
gaucaggagagggagcagaggcagguguuccc

SEQ ID NO: 163802 - RNA, 32 nt, Human
gaucaggaggcugaucccaaaguugucagaug

SEQ ID NO: 163803 - RNA, 32 nt, Human
gaucaggaguuugagaccauccuggccaacau

SEQ ID NO: 163804 - RNA, 32 nt, Human
gaucaggauccagcaggaaccagaggauaauu

SEQ ID NO: 163805 - RNA, 32 nt, Human
gaucaggcaacccucucaccucagccucccaa

SEQ ID NO: 163806 - RNA, 32 nt, Human
gaucaggcacagaaagcugaaggugcuggaga

SEQ ID NO: 163807 - RNA, 32 nt, Human
gaucaggccacugcacuccagccugaacaaca

SEQ ID NO: 163808 - RNA, 32 nt, Human
gaucaggccacugcacuccagccugggcaaca

SEQ ID NO: 163809 - RNA, 32 nt, Human
gaucaggccacugcacuccagccuggguaaca

SEQ ID NO: 163810 - RNA, 32 nt, Human
gaucaggccauugcacuccagccugggcaaua

SEQ ID NO: 163811 - RNA, 24 nt, Human
gaucaggccauugcacuucagccu

SEQ ID NO: 163812 - RNA, 32 nt, Human
gaucaggccauugcacuucagccugggugaca

SEQ ID NO: 163813 - RNA, 32 nt, Human
gaucaggccccucuccugggccugcugugcag

SEQ ID NO: 163814 - RNA, 32 nt, Human
gaucaggcucugccucaccuuggggcuugacu

SEQ ID NO: 163815 - RNA, 32 nt, Human
gaucaggcugucuugggugcacuggacuugga

SEQ ID NO: 163816 - RNA, 32 nt, Human
gaucagggaaaaagaugggaugacagaugggg

SEQ ID NO: 163817 - RNA, 32 nt, Human
gaucagggagagaaggcccuuggucagagugg

SEQ ID NO: 163818 - RNA, 32 nt, Human
gaucagggaggcauagcagugagagccauagg

SEQ ID NO: 163819 - RNA, 22 nt, Human
gaucagggcugaggguaaggaa

SEQ ID NO: 163820 - RNA, 32 nt, Human
gaucaggggaagccucuggccuggaggguaug

SEQ ID NO: 163821 - RNA, 32 nt, Human
gaucaggggugaggcugagagacucuggguuu

SEQ ID NO: 163822 - RNA, 32 nt, Human
gaucaggucacucugccccagugcucucuugc

SEQ ID NO: 163823 - RNA, 32 nt, Human
gaucaggucucugcucuucugcagccucaucu

SEQ ID NO: 163824 - RNA, 32 nt, Human
gaucaggucugcuuuuaguuucauuuuuguuu

SEQ ID NO: 163825 - RNA, 32 nt, Human
gaucaggucuguuccuguuacuguugggucuu

SEQ ID NO: 163826 - RNA, 32 nt, Human
gaucaggugcugguagggcugcaggagacccc

SEQ ID NO: 163827 - RNA, 32 nt, Human
gaucaggugucuggagguugcugagcagcgca

SEQ ID NO: 163828 - RNA, 32 nt, Human
gaucaguaacacaucaaggagucuuguuucuu

SEQ ID NO: 163829 - RNA, 32 nt, Human
gaucaguacugacuuucugauuacuguccagc

SEQ ID NO: 163830 - RNA, 32 nt, Human
gaucaguagucucucuggagagauaaaggaaa

SEQ ID NO: 163831 - RNA, 32 nt, Human
gaucaguauuagggguagagugagguagacac

SEQ ID NO: 163832 - RNA, 32 nt, Human
gaucagucuugcaaauggagaaccugcucucu

SEQ ID NO: 163833 - RNA, 32 nt, Human
gaucagugaaggaagagaaggccagcagauca

SEQ ID NO: 163834 - RNA, 32 nt, Human
gaucagugacacaccucuccccucaaccuuga

SEQ ID NO: 163835 - RNA, 32 nt, Human
gaucagugagccuuuuguagucuuccaggaga

SEQ ID NO: 163836 - RNA, 32 nt, Human
gaucaguggaagucucaggucagucccguggc

SEQ ID NO: 163837 - RNA, 32 nt, Human
gaucaguggagugccuggcaugcugaacccau

SEQ ID NO: 163838 - RNA, 32 nt, Human
gaucaguuccuauauuucuaggaguuugguga

SEQ ID NO: 163839 - RNA, 32 nt, Human
gaucaguuuccugguggccuguaggguggaga

SEQ ID NO: 163840 - RNA, 32 nt, Human
gaucauaaauuuaugugugaucuuugacuuuc

SEQ ID NO: 163841 - RNA, 23 nt, Human
gaucauaacccgcacauucaucu

SEQ ID NO: 163842 - RNA, 25 nt, Human
gaucauaauagcagucuucuugcuu

SEQ ID NO: 163843 - RNA, 32 nt, Human
gaucauaaucacugccuuaccucccucacggu

SEQ ID NO: 163844 - RNA, 32 nt, Human
gaucauaccacggcacuccagccugggugaca

SEQ ID NO: 163845 - RNA, 32 nt, Human
gaucauaccacugcacuccagccuggcgacag

SEQ ID NO: 163846 - RNA, 32 nt, Human
gaugguccuccauuucaacuccagaagugggg

SEQ ID NO: 163847 - RNA, 32 nt, Human
gaugguccucucccaggagcagccccuggaug

SEQ ID NO: 163848 - RNA, 32 nt, Human
gaugguccugccaugaggaggcugcaacgcua

SEQ ID NO: 163849 - RNA, 32 nt, Human
gauggucggaggcagagguguuuccagugauc

SEQ ID NO: 163850 - RNA, 32 nt, Human
gauggucggcggcgccggaugggcagcugagg

SEQ ID NO: 163851 - RNA, 31 nt, Human
gauggucuauaaguugccuguugaggaugug

SEQ ID NO: 163852 - RNA, 32 nt, Human
gauggucuccacccaucuuucuauuuccagua

SEQ ID NO: 163853 - RNA, 32 nt, Human
gauggucuccaucuccugaccucaugauccgc

SEQ ID NO: 163854 - RNA, 32 nt, Human
gauggucuccaucuccugaccucaugaugugc

SEQ ID NO: 163855 - RNA, 32 nt, Human
gauggucuccaucuccugaccuugugauccac

SEQ ID NO: 163856 - RNA, 32 nt, Human
gauggucuccaucucuugaccucaugaucugc

SEQ ID NO: 163857 - RNA, 32 nt, Human
gauggucucugccuaucuccaccuuucugaau

SEQ ID NO: 163858 - RNA, 32 nt, Human
gauggucuuguucugucaaccaggcuagaaug

SEQ ID NO: 163859 - RNA, 32 nt, Human
gauggugaccugccauggaaaaugcugggucc

SEQ ID NO: 163860 - RNA, 32 nt, Human
gauggugacuccugaaaccucuuccuaggcca

SEQ ID NO: 163861 - RNA, 32 nt, Human
gauggugagggagggcuggugaggggcucaga

SEQ ID NO: 163862 - RNA, 32 nt, Human
gauggugagggagggcuggugaggggcugaga

SEQ ID NO: 163863 - RNA, 32 nt, Human
gauggugcaagaggcaggauggucuccagaca

SEQ ID NO: 163864 - RNA, 32 nt, Human
gauggugcagaagcagcaggaggcacuugagg

SEQ ID NO: 163865 - RNA, 32 nt, Human
gauggugccacuacacuccagccuggguaaaa

SEQ ID NO: 163866 - RNA, 23 nt, Human
gauggugccacugcacuccagcc

SEQ ID NO: 163867 - RNA, 32 nt, Human
gauggugccacugcacuccagccuaggugaca

SEQ ID NO: 163868 - RNA, 32 nt, Human
gauggugccacugcacuccagccuggcgacag

SEQ ID NO: 163869 - RNA, 32 nt, Human
gauggugccacugcacuccagccugggcaaca

SEQ ID NO: 163870 - RNA, 32 nt, Human
gauggugccacugcacuccagccugggcgaaa

SEQ ID NO: 163871 - RNA, 32 nt, Human
gauggugccacugcacuccagccugggggaca

SEQ ID NO: 163872 - RNA, 32 nt, Human
gauggugccacugcacuccagccugggugaca

SEQ ID NO: 163873 - RNA, 32 nt, Human
gauggugccacugcacuccagccuggguggca

SEQ ID NO: 163874 - RNA, 32 nt, Human
gauggugccacugcacuccagcuuaggugaca

SEQ ID NO: 163875 - RNA, 32 nt, Human
gauggugccacugcacucuaaccugggcgaca

SEQ ID NO: 163876 - RNA, 32 nt, Human
gauggugccacugcacuucagccugggcaaca

SEQ ID NO: 163877 - RNA, 32 nt, Human
gauggugccacugcauuccagccugggcaaca

SEQ ID NO: 163878 - RNA, 32 nt, Human
gauggugccacugcauuccagccugggugaca

SEQ ID NO: 163879 - RNA, 32 nt, Human
gauggugccacuguacuccagccugggugaua

SEQ ID NO: 163880 - RNA, 32 nt, Human
gauggugccaucgcacucuagccuggggaaua

SEQ ID NO: 163881 - RNA, 32 nt, Human
gauggugccauugcccuccagccugggcaaga

SEQ ID NO: 163882 - RNA, 32 nt, Human
gauggugcccauauaggugagcaucccuuuag

SEQ ID NO: 163883 - RNA, 32 nt, Human
gauggugcccuugagccucccuucaucacuca

SEQ ID NO: 163884 - RNA, 32 nt, Human
gauggugccguugcacuccagccgggcaacaa

SEQ ID NO: 163885 - RNA, 32 nt, Human
gauggugccucaaagcaguaacuuuuugcuua

SEQ ID NO: 163886 - RNA, 32 nt, Human
gauggugccugagaccccugccuuagaaacag

SEQ ID NO: 163887 - RNA, 32 nt, Human
gauggugcuacucuuggucucccacaggaaaa

SEQ ID NO: 163888 - RNA, 32 nt, Human
gauggugcucugagagagggcagaguggaugc

SEQ ID NO: 163889 - RNA, 32 nt, Human
gaugguggaaacaguggggaacuacugcugga

SEQ ID NO: 163890 - RNA, 32 nt, Human
gaugguggaagagauaaaggcuuaggaagggg

SEQ ID NO: 163891 - RNA, 32 nt, Human
gaugguggaggccaauacuuugccaaaccaug

SEQ ID NO: 163892 - RNA, 32 nt, Human
gaugguggagguuucucaaggagcuggagacu

SEQ ID NO: 163893 - RNA, 32 nt, Human
gaugguggcacacaccuguagucccagcuacu

SEQ ID NO: 163894 - RNA, 32 nt, Human
gaugguggcacgaggccuagcacacaaggaau

SEQ ID NO: 163895 - RNA, 32 nt, Human
gaugguggcggaagggcggagcaggggcgggg

SEQ ID NO: 163896 - RNA, 32 nt, Human
gaugguggcucacaccugaaaucccagcacuu

SEQ ID NO: 163897 - RNA, 32 nt, Human
gaugguggcucacaccugugaucccaacauuu

SEQ ID NO: 163898 - RNA, 32 nt, Human
gaugguggcucacgcuuguaaucccaguacuu

SEQ ID NO: 163899 - RNA, 32 nt, Human
gaugguggcucacguccauaaucccaggacuu

SEQ ID NO: 163900 - RNA, 32 nt, Human
gaugguggcucagaccuauaaucccagcacuu

SEQ ID NO: 163901 - RNA, 32 nt, Human
gauggugggcagaucacuugaggucaggaguu

SEQ ID NO: 163902 - RNA, 32 nt, Human
gauggugggcaggaggccggcugcgggggagg

SEQ ID NO: 163903 - RNA, 32 nt, Human
gaugguggggaggggaggauggggaagcuuuu

SEQ ID NO: 163904 - RNA, 31 nt, Human
gaugguggucuucuccccuugccaggccuug

SEQ ID NO: 163905 - RNA, 32 nt, Human
gaugguggugccacuggcagagcugggaaguc

SEQ ID NO: 163906 - RNA, 32 nt, Human
gauggugguucccagagguggugacugagauc

SEQ ID NO: 163907 - RNA, 32 nt, Human
gaugguguagcccacuacacaccuaagcuaug

SEQ ID NO: 163908 - RNA, 32 nt, Human
gaugguguauuagcaugagcagcguggcccug

SEQ ID NO: 163909 - RNA, 32 nt, Human
gauggugucauuuaguaaggauuuuauuaguu

SEQ ID NO: 163910 - RNA, 32 nt, Human
gaugguguccccagcacagccgagagaccuga

SEQ ID NO: 163911 - RNA, 32 nt, Human
gaugguguccccagggcugagcaccaccccac

SEQ ID NO: 163912 - RNA, 32 nt, Human
gauggugucuuccucuccucagccgagaauga

SEQ ID NO: 163913 - RNA, 32 nt, Human
gauggugugaaaagcuugcagaaccagacaga

SEQ ID NO: 163914 - RNA, 32 nt, Human
gaugguguggcuuccucgccccucucuggggu

SEQ ID NO: 163915 - RNA, 32 nt, Human
gauggugugguguccugccugucugccccagc

SEQ ID NO: 163916 - RNA, 32 nt, Human
gaugguguuggggcaugauguguggaggaacu

SEQ ID NO: 163917 - RNA, 32 nt, Human
gaugguguuuaugaagugagccuggacaacaa

SEQ ID NO: 163918 - RNA, 32 nt, Human
gaugguuaaaggcaacuuaugaaggcaaaaca

SEQ ID NO: 163919 - RNA, 32 nt, Human
gaugguuaaaucuaggagguuggguguuuggg

SEQ ID NO: 163920 - RNA, 32 nt, Human
gaugguuacaggucaguacaaccucaguccuu

SEQ ID NO: 163921 - RNA, 32 nt, Human
gaugguuaguacaguuguucugucgucugcag

SEQ ID NO: 163922 - RNA, 32 nt, Human
gaugguuauuuauacguccagaagaacauccc

SEQ ID NO: 163923 - RNA, 32 nt, Human
gaugguucauaucaugaagauguugguuaugg

SEQ ID NO: 163924 - RNA, 32 nt, Human
gaugguucccagcauguguccagugcuucaug

SEQ ID NO: 163925 - RNA, 32 nt, Human
gaugguucuacccuuucugccuucuguuuggg

SEQ ID NO: 163926 - RNA, 32 nt, Human
gaugguucucuccugggcucaggcgcuucucc

SEQ ID NO: 163927 - RNA, 32 nt, Human
gaugguucugggaggcgagggcucaggaacag

SEQ ID NO: 163928 - RNA, 32 nt, Human
gaugguucugggaggugagggcucaggaacag

SEQ ID NO: 163929 - RNA, 32 nt, Human
gaugguucuuaggggacugugaaaguguuggg

SEQ ID NO: 163930 - RNA, 32 nt, Human
gaugguucuucaacuauaaauggagauaaugg

SEQ ID NO: 163931 - RNA, 32 nt, Human
gaugguuggaggcagagcuuggaaaggaagca

SEQ ID NO: 163932 - RNA, 32 nt, Human
gaugguuggggauacuucccaaaacuuuuucc

SEQ ID NO: 163933 - RNA, 32 nt, Human
gaugguuguggggguuucuaggaagcagcugc

SEQ ID NO: 163934 - RNA, 32 nt, Human
gaugguuucaugagucacaagcaagcguuccc

SEQ ID NO: 163935 - RNA, 32 nt, Human
gaugguuucuuagcucuccauuugccaugauu

SEQ ID NO: 163936 - RNA, 32 nt, Human
gaugguuugcauccuuccuccuuugucccaau

SEQ ID NO: 163937 - RNA, 32 nt, Human
gaugguuugcuauuuuucucuccuggggguuu

SEQ ID NO: 163938 - RNA, 32 nt, Human
gaugguuuucccaggcuaaaggaaagucaccu

SEQ ID NO: 163939 - RNA, 32 nt, Human
gauguaaaaagcuuccugaagggguguuuugg

SEQ ID NO: 163940 - RNA, 32 nt, Human
gauguaaaacacaucaaguagaaaauuucuua

SEQ ID NO: 163941 - RNA, 31 nt, Human
gauguaaaacgucuccccugccaaaggaggg

SEQ ID NO: 163942 - RNA, 32 nt, Human
gauguaaaacucaagcaaaggucaguacacaa

SEQ ID NO: 163943 - RNA, 32 nt, Human
gauguaaaagauguggccaucuagccucguaa

SEQ ID NO: 163944 - RNA, 32 nt, Human
gauguaaacagcaagugggggcugaggcagag

SEQ ID NO: 163945 - RNA, 21 nt, Human
gauguaaacuagcuuugugga

SEQ ID NO: 163946 - RNA, 32 nt, Human
gauguaaacugagacucaguucaaacaaucug

SEQ ID NO: 163947 - RNA, 32 nt, Human
gauguaaagaauuuucugcaauaaaagaaacu

SEQ ID NO: 163948 - RNA, 32 nt, Human
gauguaaccaacaaccacagaacuacagaacu

SEQ ID NO: 163949 - RNA, 32 nt, Human
gauguaaccugcuauaguuuacauuuuuaaau

SEQ ID NO: 163950 - RNA, 20 nt, Human
gauguaacucucaaggcugg

SEQ ID NO: 163951 - RNA, 32 nt, Human
gauguaagcgaucugguucccaccucagccuc

SEQ ID NO: 163952 - RNA, 32 nt, Human
gauguaaggccuuagccaugaucugcaggggu

SEQ ID NO: 163953 - RNA, 32 nt, Human
gauguaaguuuaccuauguaacaaaccugcac

SEQ ID NO: 163954 - RNA, 24 nt, Human
gauguaauaaauacauuuuggugu

SEQ ID NO: 163955 - RNA, 23 nt, Human
gauguaauaaauguaauggaugu

SEQ ID NO: 163956 - RNA, 23 nt, Human
gauguaauaaaugucuuuuagug

SEQ ID NO: 163957 - RNA, 32 nt, Human
gauguaaucacuucugaaauuuuugugcccuc

SEQ ID NO: 163958 - RNA, 32 nt, Human
gauguaauccuugccaucguaagcaagcuggu

SEQ ID NO: 163959 - RNA, 32 nt, Human
gauguaaugaguugacaugcaccagaacagau

SEQ ID NO: 163960 - RNA, 23 nt, Human
gauguaaugcacauuauuggcgu

SEQ ID NO: 163961 - RNA, 32 nt, Human
gauguaauguuuucuuuuucuuucucuugcug

SEQ ID NO: 163962 - RNA, 32 nt, Human
gauguacaagacauuuauuacacuuuuuacca

SEQ ID NO: 163963 - RNA, 32 nt, Human
gauguacacacagcauacucccagcuaacggc

SEQ ID NO: 163964 - RNA, 32 nt, Human
gauguacacaugcuccagccccagcucugcau

SEQ ID NO: 163965 - RNA, 32 nt, Human
gauguacagguggguuuuugguguguggaugu

SEQ ID NO: 163966 - RNA, 32 nt, Human
gauguacaugauuuuagaaauuguuaugaaug

SEQ ID NO: 163967 - RNA, 32 nt, Human
gauguaccauguuaaagaggcgucuuguauuu

SEQ ID NO: 163968 - RNA, 32 nt, Human
gauguaccccuaucgauucuuuuaaaguagcu

SEQ ID NO: 163969 - RNA, 32 nt, Human
gauguacccugaggugcccucucacuuccucc

SEQ ID NO: 163970 - RNA, 32 nt, Human
gauguaccucuguuacucucagccuggaaucc

SEQ ID NO: 163971 - RNA, 32 nt, Human
gauguaccugaacaagaggauuuccucacauc

SEQ ID NO: 163972 - RNA, 32 nt, Human
gauguacuaagcugcugacaucauccacugcc

SEQ ID NO: 163973 - RNA, 32 nt, Human
gauguacugaaggccccucucacuuuucacag

SEQ ID NO: 163974 - RNA, 32 nt, Human
gauguagacaaauguuacaaggcugcauguaa

SEQ ID NO: 163975 - RNA, 32 nt, Human
gauguagaggcugaagugagcugucaucaugc

SEQ ID NO: 163976 - RNA, 32 nt, Human
gauguagaggcugcaaugagcuguguucaugc

SEQ ID NO: 163977 - RNA, 32 nt, Human
gauguagcaaacuggacuuuaagaacuggaaa

SEQ ID NO: 163978 - RNA, 32 nt, Human
gauguagcacaauuuccacacugugaaggcag

SEQ ID NO: 163979 - RNA, 32 nt, Human
gauguagcaguggaugauauuuccuuccaaga

SEQ ID NO: 163980 - RNA, 32 nt, Human
gauguagccuccaggcacuucugcucucuggc

SEQ ID NO: 163981 - RNA, 32 nt, Human
gauguagcucauucucuuuucuaccucuaugg

SEQ ID NO: 163982 - RNA, 32 nt, Human
gauguagcugggauugaguccauguuaucggc

SEQ ID NO: 163983 - RNA, 32 nt, Human
gauguaggaggacauuacaaaguuaccugcaa

SEQ ID NO: 163984 - RNA, 32 nt, Human
gauguaggccugaccuccagagcccagcguuc

SEQ ID NO: 163985 - RNA, 32 nt, Human
gauguaggggcuuggagguguucuggacagug

SEQ ID NO: 163986 - RNA, 32 nt, Human
gauguaguaaauuaaauagaagaaauauauuu

SEQ ID NO: 163987 - RNA, 32 nt, Human
gauguagugccacccaccuccugagcuguuuu

SEQ ID NO: 163988 - RNA, 32 nt, Human
gauguauccaacaagccagaaucagcacagau

SEQ ID NO: 163989 - RNA, 32 nt, Human
gauguaucuaauucuccugacuguucuuccca

SEQ ID NO: 163990 - RNA, 32 nt, Human
gauguaucucggcacagcaucuuggacacuca

SEQ ID NO: 163991 - RNA, 32 nt, Human
gauguaucuggggagagaaugagcuggaggag

SEQ ID NO: 163992 - RNA, 32 nt, Human
gauguaugaaggaguuggaguuguugaaacca

SEQ ID NO: 163993 - RNA, 32 nt, Human
gauguaugaggauuugaaauuaagagacaaaa

SEQ ID NO: 163994 - RNA, 32 nt, Human
gauguauggcaaugaguggcccaugggaaaca

SEQ ID NO: 163995 - RNA, 30 nt, Human
gauguauguuuggaaagaugugugaauacu

SEQ ID NO: 163996 - RNA, 31 nt, Human
gauguauguuuggaaagaugugugaauacuu

SEQ ID NO: 163997 - RNA, 26 nt, Human
gauguauucguccccgcucugccuca

SEQ ID NO: 163998 - RNA, 26 nt, Human
gauguauucuuuacaugguggaggac

SEQ ID NO: 163999 - RNA, 32 nt, Human
gauguauugugccguggaaguacuguguguga

SEQ ID NO: 164000 - RNA, 32 nt, Human
gauguauuuaauuuuacuaugcuccaacauua

SEQ ID NO: 164001 - RNA, 32 nt, Human
gaugucaaaggugugcagcuuccaaauggcau

SEQ ID NO: 164002 - RNA, 22 nt, Human
gaugucaacgcugccauugcug

SEQ ID NO: 164003 - RNA, 32 nt, Human
gaugucaaugcaaguaucugaccaacaggggg

SEQ ID NO: 164004 - RNA, 32 nt, Human
gaugucacagccggauaguacgcuuccuaggc

SEQ ID NO: 164005 - RNA, 32 nt, Human
gaugucacagcuugaggcuguggugugaaagg

SEQ ID NO: 164006 - RNA, 32 nt, Human
gaugucaccacccuuugccacuguccuugcag

SEQ ID NO: 164007 - RNA, 32 nt, Human
gaugucaccacugcccuccagccugggugaca

SEQ ID NO: 164008 - RNA, 32 nt, Human
gaugucacccaugucagcugacuuuaaguaaa

SEQ ID NO: 164009 - RNA, 32 nt, Human
gaugucacguauuuugaaaugauagaacuaca

SEQ ID NO: 164010 - RNA, 21 nt, Human
gaugucacucugagugugggu

SEQ ID NO: 164011 - RNA, 32 nt, Human
gaugucacuuucucccccucugccuuuuagug

SEQ ID NO: 164012 - RNA, 32 nt, Human
gaugucagacuggcuggcugcagugacgugca

SEQ ID NO: 164013 - RNA, 32 nt, Human
gaugucagagcuaccagugugcugcugggaga

SEQ ID NO: 164014 - RNA, 32 nt, Human
gaugucagcacagcagugucagcagcuucguc

SEQ ID NO: 164015 - RNA, 32 nt, Human
gaugucagccgaggugacagugaagauaucaa

SEQ ID NO: 164016 - RNA, 32 nt, Human
gaugucaggagaucgaaaucagccuggccaag

SEQ ID NO: 164017 - RNA, 32 nt, Human
gaugucaggaguuugagaccagccuggccaac

SEQ ID NO: 164018 - RNA, 32 nt, Human
gaugucaggauaaaaauauacacaccauuggg

SEQ ID NO: 164019 - RNA, 32 nt, Human
gaugucaggccagggccauggccacacuggcc

SEQ ID NO: 164020 - RNA, 32 nt, Human
gaugucaggccuggaccuccugggcaggaaag

SEQ ID NO: 164021 - RNA, 32 nt, Human
gaugucagggacaggcuugaagauuccugaug

SEQ ID NO: 164022 - RNA, 32 nt, Human
gaugucagggguuugagaccagccuggucaac

SEQ ID NO: 164023 - RNA, 32 nt, Human
gaugucaguacugcagagaguaugaauggagg

SEQ ID NO: 164024 - RNA, 32 nt, Human
gaugucagugccuguacauaccuccaaaggca

SEQ ID NO: 164025 - RNA, 32 nt, Human
gaugucaucauucaggggcagccuggggacuu

SEQ ID NO: 164026 - RNA, 32 nt, Human
gaugucauccagggucacgggaggcuucugag

SEQ ID NO: 164027 - RNA, 32 nt, Human
gaugucaucccauugucuucugaccucuauaa

SEQ ID NO: 164028 - RNA, 32 nt, Human
gaugucaucccccgaccccacccuguuuucca

SEQ ID NO: 164029 - RNA, 22 nt, Human
gaugucaucuagagcagugggu

SEQ ID NO: 164030 - RNA, 21 nt, Human
gaugucaucucuggucagagu

SEQ ID NO: 164031 - RNA, 23 nt, Human
gaugucaugaggaaacuacugaa

SEQ ID NO: 164032 - RNA, 32 nt, Human
gaugucauugaggaggaaaggcgguugggcag

SEQ ID NO: 164033 - RNA, 32 nt, Human
gauguccaaaagcaccagaaggagggugucuu

SEQ ID NO: 164034 - RNA, 32 nt, Human
gauguccaagggcaggaagcauccagaacaga

SEQ ID NO: 164035 - RNA, 32 nt, Human
gauguccagcccaggcccaggugcaggugccc

SEQ ID NO: 164036 - RNA, 32 nt, Human
gauguccauaguuccuucccccuagauuguuu

SEQ ID NO: 164037 - RNA, 32 nt, Human
gauguccaugaagagguuugccgucugggcag

SEQ ID NO: 164038 - RNA, 32 nt, Human
gauguccaugagguucugccacaugcccuuga

SEQ ID NO: 164039 - RNA, 32 nt, Human
gauguccaugauccagguggcucugagaagcu

SEQ ID NO: 164040 - RNA, 32 nt, Human
gaugucccaucuuaccaugugcaauuuguccu

SEQ ID NO: 164041 - RNA, 32 nt, Human
gauguccccagaagcugcugugccucacagcg

SEQ ID NO: 164042 - RNA, 26 nt, Human
gauguccccuuccaucucugacccuu

SEQ ID NO: 164043 - RNA, 32 nt, Human
gaugucccgaccguugccacguauagggcacu

SEQ ID NO: 164044 - RNA, 32 nt, Human
gaugucccucccccuaccuguaaccuuucuuu

SEQ ID NO: 164045 - RNA, 32 nt, Human
gaugucccugcagggagcagaguuuggccagg

SEQ ID NO: 164046 - RNA, 32 nt, Human
gaugucccuggaacaggaacucgccugacccu

SEQ ID NO: 164047 - RNA, 32 nt, Human
gaugucccuguagagcagccccagggaagggg

SEQ ID NO: 164048 - RNA, 32 nt, Human
gaugucccuucaccccuccccuuucaccacca

SEQ ID NO: 164049 - RNA, 32 nt, Human
gauguccuauaauaaaggggcuucugggaggu

SEQ ID NO: 164050 - RNA, 32 nt, Human
gauguccugaugcucaauggguagaugccuuc

SEQ ID NO: 164051 - RNA, 32 nt, Human
gauguccugcagccccucagcccuacccccaa

SEQ ID NO: 164052 - RNA, 32 nt, Human
gauguccuggggacagggaguccuugggacug

SEQ ID NO: 164053 - RNA, 32 nt, Human
gauguccuguuuucaccagaggcacagcgcga

SEQ ID NO: 164054 - RNA, 32 nt, Human
gaugucgcugggacucggaagugccgaaagag

SEQ ID NO: 164055 - RNA, 32 nt, Human
gaugucggcaggcauagagaaaggaguaagaa

SEQ ID NO: 164056 - RNA, 32 nt, Human
gaugucgguccaugagcgcacacacaagacug

SEQ ID NO: 164057 - RNA, 32 nt, Human
gaugucuagagaugaacuagaaauaagggguc

SEQ ID NO: 164058 - RNA, 31 nt, Human
gaugucucaucuucuuuauauguuaagcagc

SEQ ID NO: 164059 - RNA, 32 nt, Human
gaugucuccacgcacagcuauggcaguaccug

SEQ ID NO: 164060 - RNA, 32 nt, Human
gaugucuccauccuugaucuucaucaacaauu

SEQ ID NO: 164061 - RNA, 32 nt, Human
gaugucucccaggacaagccagucugccucuu

SEQ ID NO: 164062 - RNA, 32 nt, Human
gaugucucuacucaaacugugccugcaggagg

SEQ ID NO: 164063 - RNA, 32 nt, Human
gaugucucugugugccaaacagccuggaaaug

SEQ ID NO: 164064 - RNA, 26 nt, Human
gaugucucuuucuaagaaguugacuu

SEQ ID NO: 164065 - RNA, 32 nt, Human
gaugucugagcacggacucucccaggccugcc

SEQ ID NO: 164066 - RNA, 32 nt, Human
gaugucugagccacucagaacucaccaaaaug

SEQ ID NO: 164067 - RNA, 32 nt, Human
gaugucugcaaggagcuuagcacaugguaggc

SEQ ID NO: 164068 - RNA, 32 nt, Human
gaugucugcacuccuggcugcagcuggacaac

SEQ ID NO: 164069 - RNA, 21 nt, Human
gaugucugccaaacccagguu

SEQ ID NO: 164070 - RNA, 32 nt, Human
gaugucugccaaggaugggggugcagaggcca

SEQ ID NO: 164071 - RNA, 17 nt, Human
gaugucugccuccaguu

SEQ ID NO: 164072 - RNA, 32 nt, Human
gaugucugccuggucccuucucacugugagga

SEQ ID NO: 164073 - RNA, 21 nt, Human
gaugucuggcugcaccuggca

SEQ ID NO: 164074 - RNA, 32 nt, Human
gaugucugugcugcugucaccaggcaccuuug

SEQ ID NO: 164075 - RNA, 32 nt, Human
gaugucuguggacagugcagcugggggcuuua

SEQ ID NO: 164076 - RNA, 32 nt, Human
gaugucuguugugaaauauuccaguauaacaa

SEQ ID NO: 164077 - RNA, 32 nt, Human
gaugucuguuucccagggcucagaccuaaucc

SEQ ID NO: 164078 - RNA, 32 nt, Human
gaugucuucacugagggcuauggauuuggcuu

SEQ ID NO: 164079 - RNA, 32 nt, Human
gaugucuucugcagguugcagauccugaccau

SEQ ID NO: 164080 - RNA, 32 nt, Human
gaugucuugagaguauuacagguagacuuggu

SEQ ID NO: 164081 - RNA, 32 nt, Human
gaugucuugagcucugcaaagaucagagcagg

SEQ ID NO: 164082 - RNA, 31 nt, Human
gaugucuuguuuccugagccugugucaaauu

SEQ ID NO: 164083 - RNA, 22 nt, Human
gaugucuuuacacugacuucag

SEQ ID NO: 164084 - RNA, 23 nt, Human
gaugucuuucaaacuagcuucag

SEQ ID NO: 164085 - RNA, 32 nt, Human
gaugucuuuccuuauguugcuuuuucaacaua

SEQ ID NO: 164086 - RNA, 24 nt, Human
gaugugaaaauugaggcucagaga

SEQ ID NO: 164087 - RNA, 32 nt, Human
gaugugaaaccagagaugcccgccaaccugga

SEQ ID NO: 164088 - RNA, 32 nt, Human
gaugugaaagugguggagggcaauggaaggga

SEQ ID NO: 164089 - RNA, 32 nt, Human
gaugugaagggggacaagucacucggcaucag

SEQ ID NO: 164090 - RNA, 32 nt, Human
gaugugaauagggacauaggcacagauaguua

SEQ ID NO: 164091 - RNA, 31 nt, Human
gaugugaaucucucuggggugugucucagag

SEQ ID NO: 164092 - RNA, 32 nt, Human
gaugugaauuccugccuguuccauggaggggu

SEQ ID NO: 164093 - RNA, 32 nt, Human
gaugugacacauacuauaaaaauuaugucacc

SEQ ID NO: 164094 - RNA, 32 nt, Human
gaugugacaugguucuuggauuuccucuguag

SEQ ID NO: 164095 - RNA, 32 nt, Human
gaugugaccagccacgccuaccagguggcaga

SEQ ID NO: 164096 - RNA, 32 nt, Human
gaugugacugauuuuaacaaauccuauuagau

SEQ ID NO: 164097 - RNA, 32 nt, Human
gaugugagaaaacuuugugaccagguugucac

SEQ ID NO: 164098 - RNA, 32 nt, Human
gaugugagagugaaauggacguaagauuuuau

SEQ ID NO: 164099 - RNA, 32 nt, Human
gaugugagccaccacacacaccaucugauuaa

SEQ ID NO: 164100 - RNA, 32 nt, Human
gaugugaggaggaggaggaagaaaaugagagu

SEQ ID NO: 164101 - RNA, 32 nt, Human
gaugugaggccagacagcuccuugguggccgc

SEQ ID NO: 164102 - RNA, 32 nt, Human
gaugugaggcgcucagccagggccaaggggag

SEQ ID NO: 164103 - RNA, 32 nt, Human
gaugugauaacaccaaggcagggaccuucuga

SEQ ID NO: 164104 - RNA, 32 nt, Human
gaugugauaggagcagcuuaacaggcagggag

SEQ ID NO: 164105 - RNA, 32 nt, Human
gaugugauauguuauggaugugauguguuagu

SEQ ID NO: 164106 - RNA, 32 nt, Human
gaugugaugggagcagcuuaacaggcagggag

SEQ ID NO: 164107 - RNA, 32 nt, Human
gaugugcaaagucacagaauguaauggaaguc

SEQ ID NO: 164108 - RNA, 32 nt, Human
gaugugcaaccagcaucucugucuaguuccaa

SEQ ID NO: 164109 - RNA, 32 nt, Human
gaugugcaccaccacacuggcucauuguuuuc

SEQ ID NO: 164110 - RNA, 32 nt, Human
gaugugcagcagcaaauugcucuggcuccggg

SEQ ID NO: 164111 - RNA, 15 nt, Human
gaugugcagcagcuu

SEQ ID NO: 164112 - RNA, 32 nt, Human
gaugugcagggcuuccucucagagccgcccaa

SEQ ID NO: 164113 - RNA, 32 nt, Human
gaugugcaguucuacacagaagugggagagac

SEQ ID NO: 164114 - RNA, 32 nt, Human
gaugugcauccuagggaagauaaaaucguaua

SEQ ID NO: 164115 - RNA, 32 nt, Human
gaugugccaaggcuggagcgugaacuggcucu

SEQ ID NO: 164116 - RNA, 32 nt, Human
gaugugccagaugugggcaacauggugucaga

SEQ ID NO: 164117 - RNA, 32 nt, Human
gaugugccaggaaggugacgcacuccagcuuu

SEQ ID NO: 164118 - RNA, 32 nt, Human
gaugugcccagccugugcccgccaugccgccc

SEQ ID NO: 164119 - RNA, 32 nt, Human
gaugugccgaugauggggcugacaguaugggc

SEQ ID NO: 164120 - RNA, 32 nt, Human
gaugugcgcacacacagauaugcacacacaug

SEQ ID NO: 164121 - RNA, 31 nt, Human
gaugugcgcgugucucccugccaguuaccca

SEQ ID NO: 164122 - RNA, 29 nt, Human
gaugugcguauguguguguaugccuggag

SEQ ID NO: 164123 - RNA, 32 nt, Human
gaugugcuccagcuuuccagugacaugugacg

SEQ ID NO: 164124 - RNA, 32 nt, Human
gaugugcuccuuggagcuggugugcagugucc

SEQ ID NO: 164125 - RNA, 32 nt, Human
gaugugcucuguaugcagaacacacuuggcag

SEQ ID NO: 164126 - RNA, 32 nt, Human
gaugugcuggagcuacacgacuggaugugcac

SEQ ID NO: 164127 - RNA, 32 nt, Human
gauguggaaaucaagccugucuuccagugggg

SEQ ID NO: 164128 - RNA, 32 nt, Human
gauguggaagccagacccacagaggcacuuag

SEQ ID NO: 164129 - RNA, 32 nt, Human
gauguggaaggaggggaagcacugugaccucc

SEQ ID NO: 164130 - RNA, 32 nt, Human
gauguggaaggaggggaaggcacugggccgag

SEQ ID NO: 164131 - RNA, 32 nt, Human
gauguggaaggcaccuucuagaagagagcgug

SEQ ID NO: 164132 - RNA, 32 nt, Human
gauguggacaagaacuuagaccugccaaaugg

SEQ ID NO: 164133 - RNA, 32 nt, Human
gauguggacaugcacccgcauguacaaaaaca

SEQ ID NO: 164134 - RNA, 32 nt, Human
gauguggaggaauacacauacacacacaaaca

SEQ ID NO: 164135 - RNA, 32 nt, Human
gauguggaggcccagggaauagacccucaaga

SEQ ID NO: 164136 - RNA, 20 nt, Human
gauguggagggcguagggug

SEQ ID NO: 164137 - RNA, 32 nt, Human
gauguggaggggcggggcagagggguccagcc

SEQ ID NO: 164138 - RNA, 32 nt, Human
gauguggaguuccuacaugcagugaguggaaa

SEQ ID NO: 164139 - RNA, 32 nt, Human
gauguggauaccuuucggagcuauuauuuagu

SEQ ID NO: 164140 - RNA, 32 nt, Human
gauguggaugaaagcugauccaacugucgcca

SEQ ID NO: 164141 - RNA, 32 nt, Human
gauguggcaggcaggggagacucacagaaaaa

SEQ ID NO: 164142 - RNA, 32 nt, Human
gauguggccauccugucaccagguaguuuuuc

SEQ ID NO: 164143 - RNA, 32 nt, Human
gauguggccuuggccagcagggcucagaacaa

SEQ ID NO: 164144 - RNA, 32 nt, Human
gauguggcugcagcagcgguggccucuuuuca

SEQ ID NO: 164145 - RNA, 32 nt, Human
gauguggcugggacacaaucaaaggaggaauu

SEQ ID NO: 164146 - RNA, 32 nt, Human
gaugugggcacgccucagagccagaaguuuau

SEQ ID NO: 164147 - RNA, 32 nt, Human
gaugugggcagagcaccagccugggcaucagg

SEQ ID NO: 164148 - RNA, 32 nt, Human
gaugugggccuuagccuccagguccagacuac

SEQ ID NO: 164149 - RNA, 32 nt, Human
gauguggggaauggaccuugugaggucacggu

SEQ ID NO: 164150 - RNA, 32 nt, Human
gauguggggaucugguaaauuucaguuucuug

SEQ ID NO: 164151 - RNA, 32 nt, Human
gauguggggccugggacuucuccagaagcuua

SEQ ID NO: 164152 - RNA, 32 nt, Human
gauguggggcugggaguccucuccccauccua

SEQ ID NO: 164153 - RNA, 32 nt, Human
gaugugggggaaaaguaacaucaacacugucc

SEQ ID NO: 164154 - RNA, 32 nt, Human
gaugugggguggggcuggcauccucccaggaa

SEQ ID NO: 164155 - RNA, 32 nt, Human
gauguggggugggggugagaaaaugcuucugc

SEQ ID NO: 164156 - RNA, 22 nt, Human
gauguggguggaucacaagguc

SEQ ID NO: 164157 - RNA, 32 nt, Human
gaugugguagggagugcuuagcagaaugugug

SEQ ID NO: 164158 - RNA, 32 nt, Human
gauguggucaccaagaucuaaguuacuuguug

SEQ ID NO: 164159 - RNA, 32 nt, Human
gaugugguggagcugggcugggaccuccgggc

SEQ ID NO: 164160 - RNA, 32 nt, Human
gaugugguggccgaguccaggcacaggcuggu

SEQ ID NO: 164161 - RNA, 32 nt, Human
gauguggugggaugauccgcaccaucuucacu

SEQ ID NO: 164162 - RNA, 32 nt, Human
gaugugguggugcuggaggugagcagcucgcu

SEQ ID NO: 164163 - RNA, 32 nt, Human
gauguggugguguuugccugcgguccuagcua

SEQ ID NO: 164164 - RNA, 32 nt, Human
gaugugguuuacaauagugugacaacgaugaa

SEQ ID NO: 164165 - RNA, 32 nt, Human
gaugugguuuccagccuggugccuggggugcu

SEQ ID NO: 164166 - RNA, 32 nt, Human
gaugugguuucugccuucuagagagagaucag

SEQ ID NO: 164167 - RNA, 32 nt, Human
gauguguaaagcacaggaaaccaggcagagga

SEQ ID NO: 164168 - RNA, 32 nt, Human
gauguguaacaaguugauuuggaacacuggac

SEQ ID NO: 164169 - RNA, 32 nt, Human
gauguguaaggagaaugagaggaaugaguuaa

SEQ ID NO: 164170 - RNA, 32 nt, Human
gauguguaccugcuuaguuaauuggcucagaa

SEQ ID NO: 164171 - RNA, 32 nt, Human
gauguguacugagggggcuggaggcgaagggu

SEQ ID NO: 164172 - RNA, 32 nt, Human
gauguguagagagagaaaggaagggaaggaag

SEQ ID NO: 164173 - RNA, 32 nt, Human
gauguguaguuggugacugccucuccagaugc

SEQ ID NO: 164174 - RNA, 18 nt, Human
gauguguauggcaacaca

SEQ ID NO: 164175 - RNA, 32 nt, Human
gaugugucaguuacaccuuauccacauagccu

SEQ ID NO: 164176 - RNA, 32 nt, Human
gaugugucauuggucaugauauuugaaaaggg

SEQ ID NO: 164177 - RNA, 32 nt, Human
gauguguccaagucuguaucacuucuggccau

SEQ ID NO: 164178 - RNA, 32 nt, Human
gauguguccccauccacacaucauggagcaga

SEQ ID NO: 164179 - RNA, 32 nt, Human
gaugugucggcucagcagccuccaacuucucc

SEQ ID NO: 164180 - RNA, 32 nt, Human
gaugugucuauggugcggcaucuugcuguugu

SEQ ID NO: 164181 - RNA, 32 nt, Human
gaugugucuauggugcugcaucuugcuguugu

SEQ ID NO: 164182 - RNA, 32 nt, Human
gaugugucuguauucugggguuggucauuugg

SEQ ID NO: 164183 - RNA, 32 nt, Human
gaugugugcaauaucacccacacucucagagg

SEQ ID NO: 164184 - RNA, 32 nt, Human
gaugugugcaccacuccagugggaacugaagc

SEQ ID NO: 164185 - RNA, 32 nt, Human
gaugugugcauaaaugaugucacugcagugau

SEQ ID NO: 164186 - RNA, 32 nt, Human
gaugugugcauauuuagcaucccuggaaauca

SEQ ID NO: 164187 - RNA, 32 nt, Human
gaugugugccuguaaucccaccuacuugggag

SEQ ID NO: 164188 - RNA, 32 nt, Human
gaugugugcuagagugugggacccuggccaag

SEQ ID NO: 164189 - RNA, 32 nt, Human
gaugugugcuccuggagggaaaaagaaauaca

SEQ ID NO: 164190 - RNA, 32 nt, Human
gauguguguguaugccuauuuaauauguacac

SEQ ID NO: 164191 - RNA, 32 nt, Human
gauguguuggccacagggagaggcggaccggc

SEQ ID NO: 164192 - RNA, 32 nt, Human
gauguguuugggcccuaccuggcacagagucc

SEQ ID NO: 164193 - RNA, 32 nt, Human
gauguguuuuuccauguugcccaagcuggucu

SEQ ID NO: 164194 - RNA, 32 nt, Human
gauguuaagucaaaucacuaaaacaggguucu

SEQ ID NO: 164195 - RNA, 32 nt, Human
gauguuacagaggccacacagggccacuuuuu

SEQ ID NO: 164196 - RNA, 18 nt, Human
gauguuagagacaaacac

SEQ ID NO: 164197 - RNA, 32 nt, Human
gauguuauagaauuauuuuugagcaggagcag

SEQ ID NO: 164198 - RNA, 32 nt, Human
gauguuauagauguugcugggauccugcccuc

SEQ ID NO: 164199 - RNA, 32 nt, Human
gauguuaucugugacagucaccagcuuuaagc

SEQ ID NO: 164200 - RNA, 32 nt, Human
gauguuauguacccacuguggggccaggcugg

SEQ ID NO: 164201 - RNA, 20 nt, Human
gauguucaaauauuguaaaa

SEQ ID NO: 164202 - RNA, 32 nt, Human
gauguucaacaucacuaauaacuagaagaaau

SEQ ID NO: 164203 - RNA, 32 nt, Human
gauguucaacaucaguuuacuugcagcuggaa

SEQ ID NO: 164204 - RNA, 32 nt, Human
gauguucaggcauagguuguuuacaggugaau

SEQ ID NO: 164205 - RNA, 32 nt, Human
gauguucaguucucuuggccccucucuacccc

SEQ ID NO: 164206 - RNA, 32 nt, Human
gauguucauauuguguaaaauaacucauuuaa

SEQ ID NO: 164207 - RNA, 23 nt, Human
gauguucaugguacauuguaaaa

SEQ ID NO: 164208 - RNA, 32 nt, Human
gauguucaugucuaucucaaccaggaccagac

SEQ ID NO: 164209 - RNA, 32 nt, Human
gauguuccaaaaacccaaguagucagucccuu

SEQ ID NO: 164210 - RNA, 32 nt, Human
gauguucccucuuuccuucaagugccuguugc

SEQ ID NO: 164211 - RNA, 32 nt, Human
gauguuccucagagaagugaggugggaaauau

SEQ ID NO: 164212 - RNA, 32 nt, Human
gauguuccucuggccuucuugccuggggcugc

SEQ ID NO: 164213 - RNA, 32 nt, Human
gauguucucguguugcuucuccacuuugagag

SEQ ID NO: 164214 - RNA, 32 nt, Human
gauguucucuaauccucccucuccuuaccacg

SEQ ID NO: 164215 - RNA, 32 nt, Human
gauguucucugcgcucccaggccggcaucgag

SEQ ID NO: 164216 - RNA, 32 nt, Human
gauguucugcccaccagcaccagaggucacuc

SEQ ID NO: 164217 - RNA, 32 nt, Human
gauguucugggaaaccccaaggaagcuaaagu

SEQ ID NO: 164218 - RNA, 32 nt, Human
gauguucuguaucuauguaaacaugauuccuu

SEQ ID NO: 164219 - RNA, 32 nt, Human
gauguucuuaguuaacucugggaaagauguua

SEQ ID NO: 164220 - RNA, 32 nt, Human
gauguucuugugggcauguuauucuuggugcu

SEQ ID NO: 164221 - RNA, 32 nt, Human
gauguugaaacugcuugagcaucaggauacuc

SEQ ID NO: 164222 - RNA, 32 nt, Human
gauguugaaagggagaggcagaguuccagaua

SEQ ID NO: 164223 - RNA, 32 nt, Human
gauguugacagacagacagaggggcggaugca

SEQ ID NO: 164224 - RNA, 32 nt, Human
gauguugagauggcugcccugcauuuccagcu

SEQ ID NO: 164225 - RNA, 32 nt, Human
gauguugagggaacagacaggagaaaugcauc

SEQ ID NO: 164226 - RNA, 32 nt, Human
gauguugaucagcuccaccagagggagcucug

SEQ ID NO: 164227 - RNA, 32 nt, Human
gauguugaucugugcuuccuggauuugacuuu

SEQ ID NO: 164228 - RNA, 32 nt, Human
gauguugcaccagaagagagugcaguguugga

SEQ ID NO: 164229 - RNA, 32 nt, Human
gauguugcagccugcagcaagugcuuccgucu

SEQ ID NO: 164230 - RNA, 32 nt, Human
gauguugcagugagcugagaccaugccauugg

SEQ ID NO: 164231 - RNA, 32 nt, Human
gauguugcagugagcugagauugugccacugu

SEQ ID NO: 164232 - RNA, 32 nt, Human
gauguugccacuuugcugaagauguuucuagg

SEQ ID NO: 164233 - RNA, 32 nt, Human
gauguugcgaaaccugucucucugccucucuu

SEQ ID NO: 164234 - RNA, 32 nt, Human
gauguugcggugagccgaaaucgcgccacugc

SEQ ID NO: 164235 - RNA, 22 nt, Human
gauguugcguuccggugugggu

SEQ ID NO: 164236 - RNA, 32 nt, Human
gauguugcugggugguugagugagugaauuuu

SEQ ID NO: 164237 - RNA, 32 nt, Human
gauguugcuugcacuccagccugggugacaga

SEQ ID NO: 164238 - RNA, 32 nt, Human
gauguuggaagacauucuggaagggguggggu

SEQ ID NO: 164239 - RNA, 32 nt, Human
gauguuggacaacuggaaggaggacucaggua

SEQ ID NO: 164240 - RNA, 32 nt, Human
gauguuggacucccauugaagaggguaaacug

SEQ ID NO: 164241 - RNA, 32 nt, Human
gauguuggagaauucuucuaauuuucagaacu

SEQ ID NO: 164242 - RNA, 32 nt, Human
gauguuggauaccuagggagaaugagauuuga

SEQ ID NO: 164243 - RNA, 32 nt, Human
gauguuggaugccauggaaugccauauccucc

SEQ ID NO: 164244 - RNA, 32 nt, Human
gauguuggcuguaggugucucuuagauguuua

SEQ ID NO: 164245 - RNA, 32 nt, Human
gauguugggaacacagugggcaaacucacaaa

SEQ ID NO: 164246 - RNA, 31 nt, Human
gauguugguaggguagaaaaagagggaguca

SEQ ID NO: 164247 - RNA, 32 nt, Human
gauguugguguuuugugauuuggugaacagaa

SEQ ID NO: 164248 - RNA, 32 nt, Human
gauguuguaagccugcacuacagcagccccag

SEQ ID NO: 164249 - RNA, 32 nt, Human
gauguuguacauaccuacaaguaccauuuuug

SEQ ID NO: 164250 - RNA, 32 nt, Human
gauguuguacccuuucuccuugaucccacucu

SEQ ID NO: 164251 - RNA, 32 nt, Human
gauguuguccguggccagcucuccccagggag

SEQ ID NO: 164252 - RNA, 32 nt, Human
gauguugugaagauaaugagauggugugugua

SEQ ID NO: 164253 - RNA, 32 nt, Human
gauguugugaggacauguggaagcacuuuaag

SEQ ID NO: 164254 - RNA, 32 nt, Human
gauguugugauggagggcuggaggagcagcga

SEQ ID NO: 164255 - RNA, 18 nt, Human
gauguugugcugggagug

SEQ ID NO: 164256 - RNA, 32 nt, Human
gauguuguggugagccgagaucaagccauugc

SEQ ID NO: 164257 - RNA, 32 nt, Human
gauguuguuaucucccuccuggccuuuguagc

SEQ ID NO: 164258 - RNA, 32 nt, Human
gauguuguucucuacugccuccagaaagacag

SEQ ID NO: 164259 - RNA, 32 nt, Human
gauguuguuugaucuucucaaacaucuaguuc

SEQ ID NO: 164260 - RNA, 32 nt, Human
gauguuuagcaguggcuggugcccaugaagag

SEQ ID NO: 164261 - RNA, 32 nt, Human
gauguuucagcagccccugagaaggaagagga

SEQ ID NO: 164262 - RNA, 32 nt, Human
gauguuucaggagguuugggggacuugguuuu

SEQ ID NO: 164263 - RNA, 32 nt, Human
gauguuucagucagugacagaccucauauaug

SEQ ID NO: 164264 - RNA, 32 nt, Human
gauguuuccaauaaagauuuacuuggguggcc

SEQ ID NO: 164265 - RNA, 32 nt, Human
gauguuuccagauuacacuccagccugaguca

SEQ ID NO: 164266 - RNA, 32 nt, Human
gauguuuccucuuccucccuuaugucuaccuc

SEQ ID NO: 164267 - RNA, 32 nt, Human
gauguuucucuagcccccuuagcuagagcgag

SEQ ID NO: 164268 - RNA, 32 nt, Human
gauguuucuggucacagugaaaagccaugcua

SEQ ID NO: 164269 - RNA, 32 nt, Human
gauguuucugucagcaaggacauggcauggaa

SEQ ID NO: 164270 - RNA, 32 nt, Human
gauguuucuucucuuuuacaaguaagaccuac

SEQ ID NO: 164271 - RNA, 32 nt, Human
gauguuugacaguagagcugugugagagggag

SEQ ID NO: 164272 - RNA, 23 nt, Human
gauguuugacuugcucaaaguca

SEQ ID NO: 164273 - RNA, 32 nt, Human
gauguuugaggugacgguaggaaugugagcag

SEQ ID NO: 164274 - RNA, 32 nt, Human
gauguuugcacaguuuauccagaucugugcag

SEQ ID NO: 164275 - RNA, 32 nt, Human
gauguuuggcugaggacauuucuaugcaaugu

SEQ ID NO: 164276 - RNA, 32 nt, Human
gauguuuggucucaggaaguggggcccaccca

SEQ ID NO: 164277 - RNA, 32 nt, Human
gauguuuguacuuuuguguuacugcagugacc

SEQ ID NO: 164278 - RNA, 32 nt, Human
gauguuuuaucuuuacaagucucucucguuaa

SEQ ID NO: 164279 - RNA, 32 nt, Human
gauguuuucaaacuuuuagaacucacauuuua

SEQ ID NO: 164280 - RNA, 32 nt, Human
gauguuuucccuuaacuuuuccuuguauguuc

SEQ ID NO: 164281 - RNA, 32 nt, Human
gauuaaaaacaacauuuugaaucuucaggaaa

SEQ ID NO: 164282 - RNA, 32 nt, Human
gauuaaaauggggagguugcagggagcagagc

SEQ ID NO: 164283 - RNA, 32 nt, Human
gauuaaacagaucucuacagacuugcaugagg

SEQ ID NO: 164284 - RNA, 32 nt, Human
gauuaaaccaaggcacuccagccugggugaca

SEQ ID NO: 164285 - RNA, 32 nt, Human
gauuaaaccaccacaaacaaauaaagcacugc

SEQ ID NO: 164286 - RNA, 32 nt, Human
gauuaaaccauccuuuauuauagccagagucu

SEQ ID NO: 164287 - RNA, 32 nt, Human
gauuaaaccauggauggacacaauucuaagac

SEQ ID NO: 164288 - RNA, 32 nt, Human
gauuaaacugucaaaucugucauugcauaugc

SEQ ID NO: 164289 - RNA, 32 nt, Human
gauuaaagaacugccugaauugcugcaaugaa

SEQ ID NO: 164290 - RNA, 32 nt, Human
gauuaaagagcucuugguuugucaucaggauu

SEQ ID NO: 164291 - RNA, 32 nt, Human
gauuaaagugaagaaacaauggccagcaauca

SEQ ID NO: 164292 - RNA, 32 nt, Human
gauuaacaagucagagucugugguguaugugg

SEQ ID NO: 164293 - RNA, 32 nt, Human
gauuaacacacugggcuagggccacacaauga

SEQ ID NO: 164294 - RNA, 32 nt, Human
gauuaacacuagcagauucuguuccaucuuug

SEQ ID NO: 164295 - RNA, 32 nt, Human
gauuaacaggaaacuuccaagauggaaacuuu

SEQ ID NO: 164296 - RNA, 32 nt, Human
gauuaacaggcacuauacauggugcugugcaa

SEQ ID NO: 164297 - RNA, 32 nt, Human
gauuaacguccacauggagauauggaagagga

SEQ ID NO: 164298 - RNA, 32 nt, Human
gauuaacugcguuuguucugcuucuguaagcu

SEQ ID NO: 164299 - RNA, 32 nt, Human
gauuaacuuucauuuaacugugguuauuguua

SEQ ID NO: 164300 - RNA, 32 nt, Human
gauuaagaagcuuucagaaugauucuauggau

SEQ ID NO: 164301 - RNA, 32 nt, Human
gauuaagccacagccucuaauuggaacggcau

SEQ ID NO: 164302 - RNA, 32 nt, Human
gauuaagccaccgcacuccagccugggcgaca

SEQ ID NO: 164303 - RNA, 32 nt, Human
gauuaaggcgugagccacugcgcccggcccaa

SEQ ID NO: 164304 - RNA, 32 nt, Human
gauuaaggguggccucacccuuaaucuccucu

SEQ ID NO: 164305 - RNA, 32 nt, Human
gauuaagguguugacuugccucuuucagagau

SEQ ID NO: 164306 - RNA, 32 nt, Human
gauuaauaauguucccuuuucuucuuuucuau

SEQ ID NO: 164307 - RNA, 32 nt, Human
gauuaaugaaagugggaaaauacacaugaaga

SEQ ID NO: 164308 - RNA, 32 nt, Human
gauuaaugaauccauuccaguugccucaacug

SEQ ID NO: 164309 - RNA, 32 nt, Human
gauuaaugcccuuuuaaaagcagucaccagag

SEQ ID NO: 164310 - RNA, 21 nt, Human
gauuaaugcugcucuuuaggg

SEQ ID NO: 164311 - RNA, 25 nt, Human
gauuaauguacccugcguuuugucu

SEQ ID NO: 164312 - RNA, 32 nt, Human
gauuaauuaagaacacuggggccaggcgcagu

SEQ ID NO: 164313 - RNA, 32 nt, Human
gauuaauugaagaugcuugccauacaguaggg

SEQ ID NO: 164314 - RNA, 32 nt, Human
gauuaauuucuaauaccucuuucaacuccacu

SEQ ID NO: 164315 - RNA, 32 nt, Human
gauuacaaaauauacaaaaguuuccugaguau

SEQ ID NO: 164316 - RNA, 26 nt, Human
gauuacaacauccugcgguuccguuu

SEQ ID NO: 164317 - RNA, 32 nt, Human
gauuacaaguuugagccacugcaccuggcuaa

SEQ ID NO: 164318 - RNA, 32 nt, Human
gauuacaauucaacaacaaauuuuggagcaua

SEQ ID NO: 164319 - RNA, 32 nt, Human
gauuacacauauuucagaaagacuuuacccaa

SEQ ID NO: 164320 - RNA, 24 nt, Human
gauuacaccacugcacuucagucu

SEQ ID NO: 164321 - RNA, 32 nt, Human
gauuacaccacugcacuucagucugugugacu

SEQ ID NO: 164322 - RNA, 32 nt, Human
gauuacaccacugcacuugagccugggcagca

SEQ ID NO: 164323 - RNA, 32 nt, Human
gauuacaccauugcauuccagccuaggcaaca

SEQ ID NO: 164324 - RNA, 32 nt, Human
gauuacaccauugcauuccagccugggcaaca

SEQ ID NO: 164325 - RNA, 32 nt, Human
gauuacaccccugcacuccagccugggcggca

SEQ ID NO: 164326 - RNA, 32 nt, Human
gauuacaccccuggacuccagcuugggugaca

SEQ ID NO: 164327 - RNA, 32 nt, Human
gauuacacugcucucccugaaguaguggauuc

SEQ ID NO: 164328 - RNA, 32 nt, Human
gauuacagaagaguguccaccuaacaagaugg

SEQ ID NO: 164329 - RNA, 32 nt, Human
gauuacagagaaggcuuuuucucaggucaggc

SEQ ID NO: 164330 - RNA, 32 nt, Human
gauuacagauguaagucacuaccccagccaga

SEQ ID NO: 164331 - RNA, 32 nt, Human
gauuacagccugauaagaggagacuugagagc

SEQ ID NO: 164332 - RNA, 32 nt, Human
gauuacaggaugagccacugagcccagcugac

SEQ ID NO: 164333 - RNA, 18 nt, Human
gauuacaggcaugagcca

SEQ ID NO: 164334 - RNA, 32 nt, Human
gauuacaggcaugagccaccacggccagccca

SEQ ID NO: 164335 - RNA, 32 nt, Human
gauuacaggcauggccaccacgcccagccauc

SEQ ID NO: 164336 - RNA, 18 nt, Human
gauuacaggcgugagcca

SEQ ID NO: 164337 - RNA, 32 nt, Human
gauuacaggcgugagccaccaggccuggcucc

SEQ ID NO: 164338 - RNA, 32 nt, Human
gauuacagggaaggaaaauagcuggcauuucu

SEQ ID NO: 164339 - RNA, 18 nt, Human
gauuacagguaugagcca

SEQ ID NO: 164340 - RNA, 32 nt, Human
gauuacaggugugagcuacugugcccagccug

SEQ ID NO: 164341 - RNA, 32 nt, Human
gauuacaggugugugccaaccaugcucagcua

SEQ ID NO: 164342 - RNA, 32 nt, Human
gauuacagucuuucucagauuuuuaguaaaug

SEQ ID NO: 164343 - RNA, 22 nt, Human
gauuacaucauguauuuugccu

SEQ ID NO: 164344 - RNA, 32 nt, Human
gauuacaugagacuggggaguccuucccugcc

SEQ ID NO: 164345 - RNA, 25 nt, Human
gauuaccaacuaauuugugauuuca

SEQ ID NO: 164346 - RNA, 32 nt, Human
gauuaccaggacuccuacacacucucugaaac

SEQ ID NO: 164347 - RNA, 32 nt, Human
gauuaccagguaauuccugucccaagacagcc

SEQ ID NO: 164348 - RNA, 32 nt, Human
gauuaccagugauauaacuaggaauagucaga

SEQ ID NO: 164349 - RNA, 32 nt, Human
gauuacccaagaguucaaggcugcagugaacu

SEQ ID NO: 164350 - RNA, 28 nt, Human
gauuacccacgugcugccguccuggucu

SEQ ID NO: 164351 - RNA, 32 nt, Human
gauuaccccagccugugagcggcagugggcac

SEQ ID NO: 164352 - RNA, 32 nt, Human
gauuaccgacagugacuagggcagcauguuua

SEQ ID NO: 164353 - RNA, 32 nt, Human
gauuaccuacagacaauaaugagacuucagaa

SEQ ID NO: 164354 - RNA, 32 nt, Human
gauuaccucacugcauuccagccugggcaaca

SEQ ID NO: 164355 - RNA, 32 nt, Human
gauuaccucuuguuugugacaagacuaagcau

SEQ ID NO: 164356 - RNA, 32 nt, Human
gauuaccugugcagugcagagcacuuuaaugc

SEQ ID NO: 164357 - RNA, 32 nt, Human
gauuacgccacugcaccccaaccugggcgaca

SEQ ID NO: 164358 - RNA, 32 nt, Human
gauuacgccacugcacuaaugucuggugacag

SEQ ID NO: 164359 - RNA, 32 nt, Human
gauuacgccacugcacuccagccugggcaaca

SEQ ID NO: 164360 - RNA, 32 nt, Human
gauuacgccacugcacuccagccugggugacg

SEQ ID NO: 164361 - RNA, 32 nt, Human
gauuacgccacugcauuguagccugggcaaca

SEQ ID NO: 164362 - RNA, 32 nt, Human
gauuacgccuguaaucccagcacuuugggagg

SEQ ID NO: 164363 - RNA, 32 nt, Human
gauuacgcugaggcccagccugggggagaauu

SEQ ID NO: 164364 - RNA, 32 nt, Human
gauuacgcuugcaugucaaaccccugucuuug

SEQ ID NO: 164365 - RNA, 32 nt, Human
gauuacggcucacuccuguaaucccagcacuu

SEQ ID NO: 164366 - RNA, 32 nt, Human
gauuacgucacugcauuccagccugggugaca

SEQ ID NO: 164367 - RNA, 32 nt, Human
gauuacuaauuauuccucuuugcccaaaauac

SEQ ID NO: 164368 - RNA, 32 nt, Human
gauuacuccacugcacuccagccugggcaaca

SEQ ID NO: 164369 - RNA, 32 nt, Human
gauuacugagcuuuuugacauuuccuuagacu

SEQ ID NO: 164370 - RNA, 32 nt, Human
gauuacugauguccauggcaagugaucuguuc

SEQ ID NO: 164371 - RNA, 32 nt, Human
gauuacugcaggaacuucuggaggaaagcacu

SEQ ID NO: 164372 - RNA, 32 nt, Human
gauuacuggcuugagccacugcacccaccccu

SEQ ID NO: 164373 - RNA, 32 nt, Human
gauuacugguaguuguugacauuucugaagca

SEQ ID NO: 164374 - RNA, 32 nt, Human
gauuacuggugugagccaccacggccagcugc

SEQ ID NO: 164375 - RNA, 32 nt, Human
gauuacuucauuggagggaaaaugaaucguuc

SEQ ID NO: 164376 - RNA, 32 nt, Human
gauuacuucuuuguuuccuuguggcuucuugu

SEQ ID NO: 164377 - RNA, 32 nt, Human
gauuacuuuaugcagcagucagguacauaguu

SEQ ID NO: 164378 - RNA, 32 nt, Human
gauuagaaaauagcaucccaccucuggguauc

SEQ ID NO: 164379 - RNA, 25 nt, Human
gauuagaauaaagucauuuucuucc

SEQ ID NO: 164380 - RNA, 32 nt, Human
gauuagaauuuguccagcgguaauccugaugc

SEQ ID NO: 164381 - RNA, 32 nt, Human
gauuagagaccacguuggucugcugagaacca

SEQ ID NO: 164382 - RNA, 32 nt, Human
gauuagagagugaguagaagugagccagacaa

SEQ ID NO: 164383 - RNA, 25 nt, Human
gauuagagggagcaacacccuucca

SEQ ID NO: 164384 - RNA, 28 nt, Human
gauuagccagucgccggagcgcuucgag

SEQ ID NO: 164385 - RNA, 32 nt, Human
gauuagccauuuuaaaccaacgaggaauaaaa

SEQ ID NO: 164386 - RNA, 32 nt, Human
gauuagcccaccugucccuccugggcugcugc

SEQ ID NO: 164387 - RNA, 32 nt, Human
gauuagcuacuaagagguaaagagaugucuaa

SEQ ID NO: 164388 - RNA, 32 nt, Human
gauuagcucaccuuucuccuaggcaauuauaa

SEQ ID NO: 164389 - RNA, 32 nt, Human
gauuagcugcaaucucuacuuucgaugaggaa

SEQ ID NO: 164390 - RNA, 21 nt, Human
gauuagcugggaucacaggug

SEQ ID NO: 164391 - RNA, 32 nt, Human
gauuagcugggcgugguugcacaugccuauag

SEQ ID NO: 164392 - RNA, 32 nt, Human
gauuagcuuccugccugcugucagugcuggac

SEQ ID NO: 164393 - RNA, 32 nt, Human
gauuaggagccuugcuucauuucagaaucucc

SEQ ID NO: 164394 - RNA, 32 nt, Human
gauuaggcaggcagaggcaguuaugggcuucu

SEQ ID NO: 164395 - RNA, 32 nt, Human
gauuaggcauugaaggaacauaccucaaaaua

SEQ ID NO: 164396 - RNA, 32 nt, Human
gauuaggccaaagucugggaguaaggagagga

SEQ ID NO: 164397 - RNA, 32 nt, Human
gauuagggagagaagauagcagggcauggcug

SEQ ID NO: 164398 - RNA, 32 nt, Human
gauuagggccuccccaugaccuaauuuaaaua

SEQ ID NO: 164399 - RNA, 31 nt, Human
gauuaggggagacuggagcacguuuguaauc

SEQ ID NO: 164400 - RNA, 32 nt, Human
gauuaggugguccucacagggguggggccauc

SEQ ID NO: 164401 - RNA, 32 nt, Human
gauuaguccaccugucccuccugggcugcugg

SEQ ID NO: 164402 - RNA, 32 nt, Human
gauuagugccuucugcccucccuggagccucc

SEQ ID NO: 164403 - RNA, 32 nt, Human
gauuaguggguuaucuuuuccaaggaacaggu

SEQ ID NO: 164404 - RNA, 32 nt, Human
gauuaguugaaaggccucaagaacaaacacug

SEQ ID NO: 164405 - RNA, 32 nt, Human
gauuaguuguuauaccuuaaugccuaguguuu

SEQ ID NO: 164406 - RNA, 32 nt, Human
gauuaguuugccuaauucauguuuucacuuaa

SEQ ID NO: 164407 - RNA, 32 nt, Human
gauuauaaacaacagaaacuucucaguuuugg

SEQ ID NO: 164408 - RNA, 32 nt, Human
gauuauaacagcuguauuucauauuugccucc

SEQ ID NO: 164409 - RNA, 26 nt, Human
gauuauaacauccuguauuucaguuu

SEQ ID NO: 164410 - RNA, 32 nt, Human
gauuauaauggcacuauucuggucauuauccu

SEQ ID NO: 164411 - RNA, 32 nt, Human
gauuauaccacugcacuccagccugggugaca

SEQ ID NO: 164412 - RNA, 32 nt, Human
gauuauacuucaugagucuuagcaauauggga

SEQ ID NO: 164413 - RNA, 32 nt, Human
gauuauagagcacagaaagaauucucaaacua

SEQ ID NO: 164414 - RNA, 32 nt, Human
gauuauagagguuugacuggcaaauucacuuu

SEQ ID NO: 164415 - RNA, 32 nt, Human
gauuauagcaccuccucuccagccucaggacc

SEQ ID NO: 164416 - RNA, 21 nt, Human
gauuauagcuagcuagccuca

SEQ ID NO: 164417 - RNA, 32 nt, Human
gauuauaggcuugagcuacugugcccggccca

SEQ ID NO: 164418 - RNA, 32 nt, Human
gauuauaggcuuuggucuuuucaucugcaaag

SEQ ID NO: 164419 - RNA, 32 nt, Human
gauuauaguggaacuucaccuucaccugcuau

SEQ ID NO: 164420 - RNA, 18 nt, Human
gauuauauacuucagggu

SEQ ID NO: 164421 - RNA, 32 nt, Human
gauuaucaacuguguguucgacagugaauauu

SEQ ID NO: 164422 - RNA, 32 nt, Human
gauuaucaauaugagccaccaugccagauuug

SEQ ID NO: 164423 - RNA, 32 nt, Human
gauuaucaauggcaaaugcaggcuccuccugu

SEQ ID NO: 164424 - RNA, 32 nt, Human
gauuaucacaacuguuuggugaccuacuucac

SEQ ID NO: 164425 - RNA, 22 nt, Human
gauuaucagacacuaaaacuac

SEQ ID NO: 164426 - RNA, 24 nt, Human
gauuaucauuaugugauacuggca

SEQ ID NO: 164427 - RNA, 32 nt, Human
gauuaucauuggguuucuucuuugucaugggu

SEQ ID NO: 164428 - RNA, 32 nt, Human
gauuaucccuccaguccccauggauuggaaau

SEQ ID NO: 164429 - RNA, 32 nt, Human
gauuaucgggagggcagcagaggcagagaacg

SEQ ID NO: 164430 - RNA, 32 nt, Human
gauuaucuauuuuucucccaugauaacuaauc

SEQ ID NO: 164431 - RNA, 32 nt, Human
gauuaucuguaagccuuuguggggagggaggc

SEQ ID NO: 164432 - RNA, 32 nt, Human
gauuaucuucagcccaggcuuuugcuagaugg

SEQ ID NO: 164433 - RNA, 32 nt, Human
gauuaucuuggaggggacaggaggauggcaga

SEQ ID NO: 164434 - RNA, 32 nt, Human
gauuaucuuugaacccccuuguguggaucauu

SEQ ID NO: 164435 - RNA, 32 nt, Human
gauuaucuuuuccuugcuuucuuguuucuguu

SEQ ID NO: 164436 - RNA, 32 nt, Human
gauuaugaagccuuugauuccuagccacagca

SEQ ID NO: 164437 - RNA, 32 nt, Human
gauuaugauuaugauuaauuacucugaccuga

SEQ ID NO: 164438 - RNA, 32 nt, Human
gauuaugccacugcacuccagccugggugaca

SEQ ID NO: 164439 - RNA, 32 nt, Human
gauuaugccacugcacuccagccuggugacag

SEQ ID NO: 164440 - RNA, 24 nt, Human
gauuaugccacugcacuucagccu

SEQ ID NO: 164441 - RNA, 32 nt, Human
gauuaugccacugcacuucagccugggugaca

SEQ ID NO: 164442 - RNA, 32 nt, Human
gauuaugccacugcuuuccagccugggcaaca

SEQ ID NO: 164443 - RNA, 32 nt, Human
gauuaugccacuguacuccagccugggugaca

SEQ ID NO: 164444 - RNA, 32 nt, Human
gauuaugccacuguacuccagcgugggugaca

SEQ ID NO: 164445 - RNA, 32 nt, Human
gauuaugccauuacacuccagccugggcaaca

SEQ ID NO: 164446 - RNA, 32 nt, Human
gauuaugccauugcacuccagccugggugaca

SEQ ID NO: 164447 - RNA, 32 nt, Human
gauuaugccccugcacaucagccugggugaua

SEQ ID NO: 164448 - RNA, 30 nt, Human
gauuaugcccuccuggggcuccugugaggu

SEQ ID NO: 164449 - RNA, 32 nt, Human
gauuaugcugcugcacuccagccuggacaaca

SEQ ID NO: 164450 - RNA, 29 nt, Human
gauuauggaaacaagucaugcucaugaaa

SEQ ID NO: 164451 - RNA, 32 nt, Human
gauuauggaaacucaauugucagaggacccaa

SEQ ID NO: 164452 - RNA, 32 nt, Human
gauuauggaggcugagaagucucaagaucaca

SEQ ID NO: 164453 - RNA, 32 nt, Human
gauuaugggcugggcuccauuucuuggacuua

SEQ ID NO: 164454 - RNA, 32 nt, Human
gauuauggggccuccuuagccauggggacugu

SEQ ID NO: 164455 - RNA, 32 nt, Human
gauuaugucacuccagccugggcaacagagug

SEQ ID NO: 164456 - RNA, 32 nt, Human
gauuaugucacugcacuccauccugggugaca

SEQ ID NO: 164457 - RNA, 32 nt, Human
gauuauguccccaucaaaaagaaucuccauuu

SEQ ID NO: 164458 - RNA, 32 nt, Human
gauuauguuagcauuuacacugaggagaaaau

SEQ ID NO: 164459 - RNA, 32 nt, Human
gauuauuacauacauuugaacauucccaaaug

SEQ ID NO: 164460 - RNA, 32 nt, Human
gauuauuaggccuucagggccagugucuccau

SEQ ID NO: 164461 - RNA, 32 nt, Human
gauuauuauacugcuauuuuucccugaauucu

SEQ ID NO: 164462 - RNA, 32 nt, Human
gauuauuauauacuguauuuucuucuaaauua

SEQ ID NO: 164463 - RNA, 32 nt, Human
gauuauucauucuaucucagaguuaccggcaa

SEQ ID NO: 164464 - RNA, 32 nt, Human
gauuauucuauuuccccucccucucucccgcc

SEQ ID NO: 164465 - RNA, 32 nt, Human
gauuauucucaccaacccgcugccuucaugcu

SEQ ID NO: 164466 - RNA, 32 nt, Human
gauuauucucaccaauugauucaguuacaaau

SEQ ID NO: 164467 - RNA, 32 nt, Human
gauuauucucuagccaagccccaccuuuguua

SEQ ID NO: 164468 - RNA, 32 nt, Human
gauuauugagagcccuagaaagcugcugugau

SEQ ID NO: 164469 - RNA, 32 nt, Human
gauuauugcuuuccucucuagugaaguccuug

SEQ ID NO: 164470 - RNA, 32 nt, Human
gauuauuggcugcuuugccucuaccaguuggc

SEQ ID NO: 164471 - RNA, 32 nt, Human
gauuauugggaugaagcuaaauccccagaaug

SEQ ID NO: 164472 - RNA, 32 nt, Human
gauuauugugaguaugaaaaagguuuuaauca

SEQ ID NO: 164473 - RNA, 21 nt, Human
gauuauugugcugcuugcuca

SEQ ID NO: 164474 - RNA, 32 nt, Human
gauuauuuagagccauuagagcacagcuucuu

SEQ ID NO: 164475 - RNA, 32 nt, Human
gauuauuuccucugugcuuucucagcuucuuu

SEQ ID NO: 164476 - RNA, 32 nt, Human
gauuauuucuccuuggauacagauauauuuug

SEQ ID NO: 164477 - RNA, 32 nt, Human
gauuauuugcacgaacuggacugugugcaacg

SEQ ID NO: 164478 - RNA, 32 nt, Human
gauuauuuggcccaggcugagggugcaaacag

SEQ ID NO: 164479 - RNA, 32 nt, Human
gauuauuuuaugcacaccuaagcccaaauaua

SEQ ID NO: 164480 - RNA, 32 nt, Human
gauucaaacagcuuuaaacacuuccaaugaga

SEQ ID NO: 164481 - RNA, 32 nt, Human
gauucaaacauguagagaaguuguagauucaa

SEQ ID NO: 164482 - RNA, 32 nt, Human
gauucaaacucauaaacucaguauuuuaacuc

SEQ ID NO: 164483 - RNA, 32 nt, Human
gauucaaacugcugccuuugccuccagugcau

SEQ ID NO: 164484 - RNA, 32 nt, Human
gauucaaagcaacaccaccaccacugaaguau

SEQ ID NO: 164485 - RNA, 24 nt, Human
gauucaaaucacaaucauauuuca

SEQ ID NO: 164486 - RNA, 32 nt, Human
gauucaacaaauaccauauguccuuaucauuu

SEQ ID NO: 164487 - RNA, 32 nt, Human
gauucaaccagcucuucaccacugccuggggc

SEQ ID NO: 164488 - RNA, 32 nt, Human
gauucaaccaugggagccaacacuucaagaaa

SEQ ID NO: 164489 - RNA, 32 nt, Human
gauucaagugagccaggaaagcagcaaaggaa

SEQ ID NO: 164490 - RNA, 32 nt, Human
gauucaagugcaauccauguaucuguaugggu

SEQ ID NO: 164491 - RNA, 32 nt, Human
gauucaaucugcaugccagccuggaggaggaa

SEQ ID NO: 164492 - RNA, 32 nt, Human
gauucaaugggaauauuaauugcugcucuugu

SEQ ID NO: 164493 - RNA, 32 nt, Human
gauucacacaugccuauauuaucauaagaauu

SEQ ID NO: 164494 - RNA, 32 nt, Human
gauucacacguacacacauaaacacacccacc

SEQ ID NO: 164495 - RNA, 22 nt, Human
gauucacagagacgacaagaaa

SEQ ID NO: 164496 - RNA, 32 nt, Human
gauucacagcacaaaagaccucaccaccacac

SEQ ID NO: 164497 - RNA, 32 nt, Human
gauucacagcacugcacugcagccugggugac

SEQ ID NO: 164498 - RNA, 19 nt, Human
gauucacagcagaauucua

SEQ ID NO: 164499 - RNA, 32 nt, Human
gauucacaucccaggcaggacagagcaggaga

SEQ ID NO: 164500 - RNA, 22 nt, Human
gauucacccaggaggucacaga

SEQ ID NO: 164501 - RNA, 32 nt, Human
gauucaccccaaagugcugggauuacaggcgu

SEQ ID NO: 164502 - RNA, 21 nt, Human
gauucaccccgucuccaccca

SEQ ID NO: 164503 - RNA, 32 nt, Human
gauucacccugauuuuacacacauuaaaaugu

SEQ ID NO: 164504 - RNA, 32 nt, Human
gauucacgccuguaaucccagcacuuugagag

SEQ ID NO: 164505 - RNA, 32 nt, Human
gauucacgccuguaaucccagcacuuugggag

SEQ ID NO: 164506 - RNA, 32 nt, Human
gauucacuagcccccagcccgccaaaccccac

SEQ ID NO: 164507 - RNA, 32 nt, Human
gauucacuucuuuagggagacaagguguggcg

SEQ ID NO: 164508 - RNA, 32 nt, Human
gauucagaacacaagaggagaaugagcuggag

SEQ ID NO: 164509 - RNA, 32 nt, Human
gauucagaaguuaaauaggagcuuuggaauca

SEQ ID NO: 164510 - RNA, 32 nt, Human
gauucagaaguuagggguagcggggguaggau

SEQ ID NO: 164511 - RNA, 32 nt, Human
gauucagagacgccaaaagagaagauacagag

SEQ ID NO: 164512 - RNA, 32 nt, Human
gauucagagacuuagaagcaucagaguugaua

SEQ ID NO: 164513 - RNA, 32 nt, Human
gauucagagggaaaggaggaagcugcguggca

SEQ ID NO: 164514 - RNA, 32 nt, Human
gauucagcaacagguuuccacagggaaggccc

SEQ ID NO: 164515 - RNA, 32 nt, Human
gauucagcaacagguuuucacagggaaggccc

SEQ ID NO: 164516 - RNA, 32 nt, Human
gauucagcaaugguggaauggaagacagaacu

SEQ ID NO: 164517 - RNA, 32 nt, Human
gauucagccacagccucugccucccguugcuc

SEQ ID NO: 164518 - RNA, 32 nt, Human
gauucagccuggagaugguggaagagauaaag

SEQ ID NO: 164519 - RNA, 32 nt, Human
gauucagcucaaggauucagugucuucauuuu

SEQ ID NO: 164520 - RNA, 32 nt, Human
gauucagcucacugcaaucuccgccucccggg

SEQ ID NO: 164521 - RNA, 32 nt, Human
gauucaggaaggagcccaggagcagaggaagu

SEQ ID NO: 164522 - RNA, 32 nt, Human
gauucaggcccaaauuauggcagacaucuuga

SEQ ID NO: 164523 - RNA, 32 nt, Human
gauucagggaaagacuaacugugaaaaggaag

SEQ ID NO: 164524 - RNA, 32 nt, Human
gauucagggaugcuugcucuccacuuuucaag

SEQ ID NO: 164525 - RNA, 32 nt, Human
gauucagggccagcagguuucacucagcucuc

SEQ ID NO: 164526 - RNA, 23 nt, Human
gauucaggggaccuguauuucca

SEQ ID NO: 164527 - RNA, 32 nt, Human
gauucaggggcacuaugcccacugccuccucu

SEQ ID NO: 164528 - RNA, 32 nt, Human
gauucaggugugagccacugugcccagcaggg

SEQ ID NO: 164529 - RNA, 32 nt, Human
gauucaguggcugggaauugagaauuuauuug

SEQ ID NO: 164530 - RNA, 32 nt, Human
gauucagugggccuggguggggccaagaaauc

SEQ ID NO: 164531 - RNA, 32 nt, Human
gauucagugggugagagggaagaaggggaggu

SEQ ID NO: 164532 - RNA, 32 nt, Human
gauucaguguguucacuccuugcagcugcugu

SEQ ID NO: 164533 - RNA, 32 nt, Human
gauucaguucucuuacccacagacacagaacc

SEQ ID NO: 164534 - RNA, 32 nt, Human
gauucauacuccugaugcuacugacaacgugg

SEQ ID NO: 164535 - RNA, 32 nt, Human
gauucauagaagaaagccagagguucugcuug

SEQ ID NO: 164536 - RNA, 32 nt, Human
gauucauauuccuguaaggaaaauccgggcag

SEQ ID NO: 164537 - RNA, 32 nt, Human
gauucauccccaggcuggagucaggcucagcu

SEQ ID NO: 164538 - RNA, 22 nt, Human
gauucaucuccaugagugcaca

SEQ ID NO: 164539 - RNA, 32 nt, Human
gauucaucugccucagccucuggaguagcugg

SEQ ID NO: 164540 - RNA, 32 nt, Human
gauucaucugugaccuccaggcagcagucucu

SEQ ID NO: 164541 - RNA, 32 nt, Human
gauucaugagaggagaucaaaauaucaacaua

SEQ ID NO: 164542 - RNA, 32 nt, Human
gauucaugcacuguagggcugggcgcagcauc

SEQ ID NO: 164543 - RNA, 32 nt, Human
gauucauggagaccagucccaguagcaaccgc

SEQ ID NO: 164544 - RNA, 32 nt, Human
gauucaugucgaggcuagaggcauuuggaaca

SEQ ID NO: 164545 - RNA, 32 nt, Human
gauucauguggacauucaggaagcuuauucuc

SEQ ID NO: 164546 - RNA, 32 nt, Human
gauucaugugguuucuaagauuuggacauguc

SEQ ID NO: 164547 - RNA, 32 nt, Human
gauucauuccuuccucacucaaaucccuugaa

SEQ ID NO: 164548 - RNA, 32 nt, Human
gauucauucuucuugcucuuucucagcagaac

SEQ ID NO: 164549 - RNA, 32 nt, Human
gauucauuuaaguaggagauggucaaauauau

SEQ ID NO: 164550 - RNA, 24 nt, Human
gauucauuuuauuuucaucaccau

SEQ ID NO: 164551 - RNA, 32 nt, Human
gauuccaagaagcaagagucagaagugggaag

SEQ ID NO: 164552 - RNA, 32 nt, Human
gauuccaagccaggcuuacucccaggcccagg

SEQ ID NO: 164553 - RNA, 32 nt, Human
gauuccaagguaaacagucuccaugagaaagu

SEQ ID NO: 164554 - RNA, 24 nt, Human
gauuccaaggugaggcccaacuga

SEQ ID NO: 164555 - RNA, 32 nt, Human
gauuccaauuuaaaagcagaaaagcaaaaacc

SEQ ID NO: 164556 - RNA, 32 nt, Human
gauuccacaaagccucucuccccucccucguc

SEQ ID NO: 164557 - RNA, 32 nt, Human
gauuccacaacaaaauucuuaucuuccaugga

SEQ ID NO: 164558 - RNA, 32 nt, Human
gauuccacagaguugaccucucugauuuucua

SEQ ID NO: 164559 - RNA, 32 nt, Human
gauuccaccauugcacuccagucugggcaaca

SEQ ID NO: 164560 - RNA, 32 nt, Human
gauuccacgcugcuggaucugccuccugugcc

SEQ ID NO: 164561 - RNA, 32 nt, Human
gauuccacuccgggaaccucggcgaugcugag

SEQ ID NO: 164562 - RNA, 32 nt, Human
gauuccacugguguccccuuguggguuuuccu

SEQ ID NO: 164563 - RNA, 32 nt, Human
gauuccagaagaagccaagaucugccagcccu

SEQ ID NO: 164564 - RNA, 32 nt, Human
gauuccagcaauucuccugccucggcuuccca

SEQ ID NO: 164565 - RNA, 32 nt, Human
gauuccagccucccagccccucucuccgcccc

SEQ ID NO: 164566 - RNA, 32 nt, Human
gauuccagccuucagaagguucuugggauaug

SEQ ID NO: 164567 - RNA, 32 nt, Human
gauuccagcgccugacagccaggaccccaggc

SEQ ID NO: 164568 - RNA, 32 nt, Human
gauuccagcuacuugggagguugaggcaggag

SEQ ID NO: 164569 - RNA, 32 nt, Human
gauuccaggaaggaaggagccucugacaaagc

SEQ ID NO: 164570 - RNA, 32 nt, Human
gauuccaggcagcagguuggagugacuggugg

SEQ ID NO: 164571 - RNA, 32 nt, Human
gauuccaggccuggugucacaugacaccagca

SEQ ID NO: 164572 - RNA, 32 nt, Human
gauuccagguaccaaaucaucuguaaaaucac

SEQ ID NO: 164573 - RNA, 32 nt, Human
gauuccagguggacuggaccaagagcaggcaa

SEQ ID NO: 164574 - RNA, 32 nt, Human
gauuccaggugugagcuacugugcccagcuaa

SEQ ID NO: 164575 - RNA, 31 nt, Human
gauuccaguaaguaccaacuaccucacaggc

SEQ ID NO: 164576 - RNA, 32 nt, Human
gauuccaguagccuaguuuccacagcacgaua

SEQ ID NO: 164577 - RNA, 32 nt, Human
gauuccagucucugguuccuuuccugagucag

SEQ ID NO: 164578 - RNA, 32 nt, Human
gauuccagugagggagaaagugaucugcaggg

SEQ ID NO: 164579 - RNA, 21 nt, Human
gauuccaguuuggacagggug

SEQ ID NO: 164580 - RNA, 32 nt, Human
gauuccaugcccaccugcccucugucugccuc

SEQ ID NO: 164581 - RNA, 32 nt, Human
gauuccaugguuuugcacacacgauggggagg

SEQ ID NO: 164582 - RNA, 32 nt, Human
gauuccauguguuugcagcaggacuacaucga

SEQ ID NO: 164583 - RNA, 32 nt, Human
gauuccauuacccuuucuuccucauagguagu

SEQ ID NO: 164584 - RNA, 32 nt, Human
gauucccacagccagcucuuggcuccaagaug

SEQ ID NO: 164585 - RNA, 32 nt, Human
gauucccagagacaggaaaauccucuggcugg

SEQ ID NO: 164586 - RNA, 32 nt, Human
gauucccagcauccaucuaaaaagcaauacuc

SEQ ID NO: 164587 - RNA, 32 nt, Human
gauucccaggcugggugcaguggcucacgccu

SEQ ID NO: 164588 - RNA, 21 nt, Human
gauucccauggaagauggaug

SEQ ID NO: 164589 - RNA, 32 nt, Human
gauuccccacccaacccuuccccaccggacug

SEQ ID NO: 164590 - RNA, 32 nt, Human
gauuccccagcgacgugguguugcagccccgu

SEQ ID NO: 164591 - RNA, 32 nt, Human
gauuccccaggagguccccugccccucccccu

SEQ ID NO: 164592 - RNA, 32 nt, Human
gauuccccaucucaggccagagccaaggggcu

SEQ ID NO: 164593 - RNA, 32 nt, Human
gauucccccauagggaguaaugaggacagcau

SEQ ID NO: 164594 - RNA, 32 nt, Human
gauucccccugcccugugccgcacucuggcgg

SEQ ID NO: 164595 - RNA, 32 nt, Human
gauucccccuggcaagugcucccugguuguga

SEQ ID NO: 164596 - RNA, 32 nt, Human
gauucccccuugcccaucagagaggagcauuu

SEQ ID NO: 164597 - RNA, 32 nt, Human
gauuccccuggguaugccucugugccacagga

SEQ ID NO: 164598 - RNA, 22 nt, Human
gauucccgaccucaggugaucc

SEQ ID NO: 164599 - RNA, 32 nt, Human
gauucccgggacuagguugcgggagaaagccu

SEQ ID NO: 164600 - RNA, 32 nt, Human
gauucccucagauggggaggcagcaguaugag

SEQ ID NO: 164601 - RNA, 32 nt, Human
gauucccucaucccugggggcagcccugccgc

SEQ ID NO: 164602 - RNA, 32 nt, Human
gauucccucugauaagcuguucugguggcagu

SEQ ID NO: 164603 - RNA, 32 nt, Human
gauucccucugccucugucuccccacaucguc

SEQ ID NO: 164604 - RNA, 32 nt, Human
gauucccugcagccccuccuuagcccauguca

SEQ ID NO: 164605 - RNA, 32 nt, Human
gauucccugcccuugugaccucccaggaaaca

SEQ ID NO: 164606 - RNA, 32 nt, Human
gauucccugcgccucugcucugcggcaaauac

SEQ ID NO: 164607 - RNA, 32 nt, Human
gauucccuucaagcaucucccucauccuggac

SEQ ID NO: 164608 - RNA, 32 nt, Human
gauuccgaggaaaaggagauaggagacgaaaa

SEQ ID NO: 164609 - RNA, 32 nt, Human
gauuccgaggugcagaaguugucugagugcgu

SEQ ID NO: 164610 - RNA, 32 nt, Human
gauuccgccacacauccuuuuagcuacagggc

SEQ ID NO: 164611 - RNA, 32 nt, Human
gauuccggauccuaagcaucuaaguuauaaga

SEQ ID NO: 164612 - RNA, 32 nt, Human
gauuccggaucucuccguucucaggccagacc

SEQ ID NO: 164613 - RNA, 32 nt, Human
gauuccggauuaggggaugacaucccaaacag

SEQ ID NO: 164614 - RNA, 32 nt, Human
gauuccggggaaguggaggcagagggagcggg

SEQ ID NO: 164615 - RNA, 32 nt, Human
gauuccggguagcagaggcagcgccgcaggag

SEQ ID NO: 164616 - RNA, 19 nt, Human
gauuccuagauuuagcaca

SEQ ID NO: 164617 - RNA, 32 nt, Human
gauuccucaacccuaucaugggcugcucugag

SEQ ID NO: 164618 - RNA, 32 nt, Human
gauuccuccuccugccggacgccgaggcccag

SEQ ID NO: 164619 - RNA, 32 nt, Human
gauuccucucccauccuuuucugcuccaaccu

SEQ ID NO: 164620 - RNA, 32 nt, Human
gauuccucuuccuuuuacuuccuuccuauuuc

SEQ ID NO: 164621 - RNA, 23 nt, Human
gauuccugaccucaagugaccca

SEQ ID NO: 164622 - RNA, 32 nt, Human
gauuccugagacaaauacucacugaagggcuu

SEQ ID NO: 164623 - RNA, 32 nt, Human
gauuccugaggcaugauuauuccugaggguuu

SEQ ID NO: 164624 - RNA, 32 nt, Human
gauuccugauccagagacaacggccccaaugg

SEQ ID NO: 164625 - RNA, 32 nt, Human
gauuccugaugggcuuucucuugaaguccaaa

SEQ ID NO: 164626 - RNA, 32 nt, Human
gauuccugccaaguaggguuuagccgggcccc

SEQ ID NO: 164627 - RNA, 32 nt, Human
gauuccugcccaggggagagaggcgcugggaa

SEQ ID NO: 164628 - RNA, 32 nt, Human
gauuccugcucuggugagauccaagacccaca

SEQ ID NO: 164629 - RNA, 32 nt, Human
gauuccuggcaaccuccccuccccugacacau

SEQ ID NO: 164630 - RNA, 32 nt, Human
gauuccuggcagcugcccagaacccugcugau

SEQ ID NO: 164631 - RNA, 32 nt, Human
gauuccuggcgcagggcauccaggccgcccgc

SEQ ID NO: 164632 - RNA, 32 nt, Human
gauuccugggcaagaaccuaaaguagcaggac

SEQ ID NO: 164633 - RNA, 32 nt, Human
gauuccugguaucacuugcucgcuacuuucua

SEQ ID NO: 164634 - RNA, 32 nt, Human
gauuccugguucccugaaggaggagagggaug

SEQ ID NO: 164635 - RNA, 32 nt, Human
gauuccuuacuguagcuaauucuagaugcccu

SEQ ID NO: 164636 - RNA, 32 nt, Human
gauuccuuccaagucaguuacaggugguuuua

SEQ ID NO: 164637 - RNA, 32 nt, Human
gauuccuugcugcugcuuauguucuguuguuu

SEQ ID NO: 164638 - RNA, 32 nt, Human
gauuccuugcuugguacuuucuggaccugaag

SEQ ID NO: 164639 - RNA, 32 nt, Human
gauuccuugguauuucuggugggguaaggggc

SEQ ID NO: 164640 - RNA, 32 nt, Human
gauuccuuggugagccuggacaagccccuccc

SEQ ID NO: 164641 - RNA, 32 nt, Human
gauuccuugugucugggaguuuggacagcuuc

SEQ ID NO: 164642 - RNA, 32 nt, Human
gauuccuuuuacacaagagcugccucccaaag

SEQ ID NO: 164643 - RNA, 32 nt, Human
gauuccuuuuuccuccugaacccuccaguggg

SEQ ID NO: 164644 - RNA, 32 nt, Human
gauucgaguccuggcccugcugcuugccagcu

SEQ ID NO: 164645 - RNA, 32 nt, Human
gauucgcaaaccacagauaguaccaaacucca

SEQ ID NO: 164646 - RNA, 28 nt, Human
gauucgcucaauaaacauguuugaaucc

SEQ ID NO: 164647 - RNA, 32 nt, Human
gauucgcucacugacccucaauuguccucuuu

SEQ ID NO: 164648 - RNA, 32 nt, Human
gauucgggagggcugagggcgcggccgagaga

SEQ ID NO: 164649 - RNA, 32 nt, Human
gauucgguuuuuaagaagaugcaugccuaaug

SEQ ID NO: 164650 - RNA, 31 nt, Human
gauucguguagcuacccuugccacaguugug

SEQ ID NO: 164651 - RNA, 32 nt, Human
gauucuaaccaccaugccuacuuguuugcuug

SEQ ID NO: 164652 - RNA, 32 nt, Human
gauucuaagacaaugcaauugagugguaggca

SEQ ID NO: 164653 - RNA, 32 nt, Human
gauucuacagcaaauccacccucucagcucag

SEQ ID NO: 164654 - RNA, 32 nt, Human
gauucuaccaauccaauuucaccaggaaaauu

SEQ ID NO: 164655 - RNA, 32 nt, Human
gauucuaccauguugcccaggcuggucucaaa

SEQ ID NO: 164656 - RNA, 32 nt, Human
gauucuacucugcuuuuauccuuuggagccug

SEQ ID NO: 164657 - RNA, 32 nt, Human
gauucuagaacaggagaaauaaaacagcuauc

SEQ ID NO: 164658 - RNA, 32 nt, Human
gauucuagauuugugcaguaggauugugggac

SEQ ID NO: 164659 - RNA, 32 nt, Human
gauucuaguggcccaccaccucccucuccugc

SEQ ID NO: 164660 - RNA, 32 nt, Human
gauucuaucucggcucagacuuuugguuggaa

SEQ ID NO: 164661 - RNA, 32 nt, Human
gauucuaugccuguauuuccaacaaacuuacu

SEQ ID NO: 164662 - RNA, 32 nt, Human
gauucucaaaauaccaguuuuuauuccaaaaa

SEQ ID NO: 164663 - RNA, 32 nt, Human
gauucucacccaguugcuguguucgguggggc

SEQ ID NO: 164664 - RNA, 32 nt, Human
gauucucaccccaggccucugccugcuuucuc

SEQ ID NO: 164665 - RNA, 32 nt, Human
gauucucacucugucucccaggcuagagugca

SEQ ID NO: 164666 - RNA, 32 nt, Human
gauucucagcacuugggggaucuguuguguac

SEQ ID NO: 164667 - RNA, 32 nt, Human
gauucucagcgccaaacuuuuugcuaguucag

SEQ ID NO: 164668 - RNA, 32 nt, Human
gauucucauccccaaagucccaaaagagggug

SEQ ID NO: 164669 - RNA, 17 nt, Human
gauucucauucaagucc

SEQ ID NO: 164670 - RNA, 32 nt, Human
gauucucauuugugucucugguguuuaguaua

SEQ ID NO: 164671 - RNA, 32 nt, Human
gauucuccaacaggcugggugcauguaucccc

SEQ ID NO: 164672 - RNA, 32 nt, Human
gauucuccagccucagccuccccaguagcugg

SEQ ID NO: 164673 - RNA, 32 nt, Human
gauucuccagccucagcuuccugaguagaugg

SEQ ID NO: 164674 - RNA, 32 nt, Human
gauucuccagccugggcaacggagugagacuc

SEQ ID NO: 164675 - RNA, 32 nt, Human
gauucucccaacaaugcauaucagcuauucau

SEQ ID NO: 164676 - RNA, 32 nt, Human
gauucucccagagauugccuggaacaccagcu

SEQ ID NO: 164677 - RNA, 32 nt, Human
gauucucccuaaaauaacuaaauuuaaaccaa

SEQ ID NO: 164678 - RNA, 32 nt, Human
gauucucccuauuuauacucagacugaccaag

SEQ ID NO: 164679 - RNA, 32 nt, Human
gauucucccucuggguaaccagucccagguga

SEQ ID NO: 164680 - RNA, 32 nt, Human
gauucucccuuagagccucuggaaggagcaug

SEQ ID NO: 164681 - RNA, 32 nt, Human
gauucuccuaccucagcuuccuaaguagcugg

SEQ ID NO: 164682 - RNA, 32 nt, Human
gauucuccucccucagccuccugaguagcugg

SEQ ID NO: 164683 - RNA, 32 nt, Human
gauucuccugaagaugccuggaaagguugcaa

SEQ ID NO: 164684 - RNA, 23 nt, Human
gauucuccugccucagccuucca

SEQ ID NO: 164685 - RNA, 32 nt, Human
gauucuccugccucagcuacucgggaggcuga

SEQ ID NO: 164686 - RNA, 32 nt, Human
gauucuccugccucagcuucccagguggugcg

SEQ ID NO: 164687 - RNA, 32 nt, Human
gauucuccugccucagcuucccgaguagcugg

SEQ ID NO: 164688 - RNA, 32 nt, Human
gauucuccugccucagcuuccuaaguagcugg

SEQ ID NO: 164689 - RNA, 32 nt, Human
gauucuccugccucagcuuccugaguagcugg

SEQ ID NO: 164690 - RNA, 18 nt, Human
gauucuccugccuccgcc

SEQ ID NO: 164691 - RNA, 32 nt, Human
gauucuccuggcucacccuccugagcugggau

SEQ ID NO: 164692 - RNA, 32 nt, Human
gauucuccugucucagcuuccugaguagcugg

SEQ ID NO: 164693 - RNA, 32 nt, Human
gauucuccuucaaguggcaacauggcauauau

SEQ ID NO: 164694 - RNA, 32 nt, Human
gauucuccuucaccaucuacgcgcagcccaca

SEQ ID NO: 164695 - RNA, 32 nt, Human
gauucuccuucaccaucuacgugcagcccaca

SEQ ID NO: 164696 - RNA, 32 nt, Human
gauucuccuucaccaucuaugugcagcccaca

SEQ ID NO: 164697 - RNA, 21 nt, Human
gauucucgcuccuucauuuca

SEQ ID NO: 164698 - RNA, 32 nt, Human
gauucucgugccucagccucuggaguagcugg

SEQ ID NO: 164699 - RNA, 32 nt, Human
gauucucgugccucagcuucccaaguggcugg

SEQ ID NO: 164700 - RNA, 32 nt, Human
gauucucguguaacacuuguugcuuggcaaca

SEQ ID NO: 164701 - RNA, 32 nt, Human
gauucucuaccucccucuuccaucucauuccc

SEQ ID NO: 164702 - RNA, 32 nt, Human
gauucucuagggucucuacuucugcucaagag

SEQ ID NO: 164703 - RNA, 32 nt, Human
gauucucuaguuuucucccuagggaugggaag

SEQ ID NO: 164704 - RNA, 32 nt, Human
gauucucuccgcccugcacuuuugccagcuga

SEQ ID NO: 164705 - RNA, 32 nt, Human
gauucucucucccucuccgcguccagugcugg

SEQ ID NO: 164706 - RNA, 32 nt, Human
gauucucucucccucuuugcccagagcuuccc

SEQ ID NO: 164707 - RNA, 32 nt, Human
gauucucugaaaaagaaaucaucucugauuuc

SEQ ID NO: 164708 - RNA, 32 nt, Human
gauucucuggccagagaaaggaguagcugacu

SEQ ID NO: 164709 - RNA, 32 nt, Human
gauucucuggcuuauuguggcauucaugauau

SEQ ID NO: 164710 - RNA, 32 nt, Human
gauucucugggggagguuguuucuugagagua

SEQ ID NO: 164711 - RNA, 32 nt, Human
gauucucuuaccucagcuuccugaguagcugg

SEQ ID NO: 164712 - RNA, 32 nt, Human
gauucucuucacuauaacugagugguaauuua

SEQ ID NO: 164713 - RNA, 22 nt, Human
gauucucuuuaaaaaucaauga

SEQ ID NO: 164714 - RNA, 15 nt, Human
gauucugaaccccgg

SEQ ID NO: 164715 - RNA, 32 nt, Human
gauucugaagacaguguggagucaauaugcua

SEQ ID NO: 164716 - RNA, 32 nt, Human
gauucugaagccgagcaacuugcccaaguccu

SEQ ID NO: 164717 - RNA, 32 nt, Human
gauucugagaccuacuggaggcugaggaggag

SEQ ID NO: 164718 - RNA, 32 nt, Human
gauucugaggcaggaaggaauuugggucugga

SEQ ID NO: 164719 - RNA, 32 nt, Human
gauucugaggccucccuagccauggggaccug

SEQ ID NO: 164720 - RNA, 32 nt, Human
gauucugaugcaaguggucucuccagccuguc

SEQ ID NO: 164721 - RNA, 32 nt, Human
gauucugcaagggacagggggccugacuaccc

SEQ ID NO: 164722 - RNA, 32 nt, Human
gauucugccccaggagagguaaugcaccccug

SEQ ID NO: 164723 - RNA, 32 nt, Human
gauucugccucagcuccugucuugcugagccc

SEQ ID NO: 164724 - RNA, 32 nt, Human
gauucugccuguaaucccagaauuuugggagg

SEQ ID NO: 164725 - RNA, 32 nt, Human
gauucugcuaaagcuucucugucuuucccugu

SEQ ID NO: 164726 - RNA, 24 nt, Human
gauucugcuaccaucuuucucuua

SEQ ID NO: 164727 - RNA, 32 nt, Human
gauucuggaagcuuccugaaggauuugagugg

SEQ ID NO: 164728 - RNA, 32 nt, Human
gauucuggaaugcagaaggaggggucugggca

SEQ ID NO: 164729 - RNA, 32 nt, Human
gauucuggaccagaccaugcagccugaccugu

SEQ ID NO: 164730 - RNA, 32 nt, Human
gauucuggagccacagaagauagacagaugga

SEQ ID NO: 164731 - RNA, 32 nt, Human
gauucuggagccagagggagagaccccagaaa

SEQ ID NO: 164732 - RNA, 32 nt, Human
gauucugggaacagaugaaacuuuuugcaucg

SEQ ID NO: 164733 - RNA, 32 nt, Human
gauucugggaggcaauggggagugacugcuaa

SEQ ID NO: 164734 - RNA, 32 nt, Human
gauucugggguuucuguguugaacgguucuug

SEQ ID NO: 164735 - RNA, 32 nt, Human
gauucugguagcuccuucuccuugugacaugg

SEQ ID NO: 164736 - RNA, 32 nt, Human
gauucuguaauauugggucuauugggcucugu

SEQ ID NO: 164737 - RNA, 32 nt, Human
gauucugucuauuggaacaaaaagccagugag

SEQ ID NO: 164738 - RNA, 32 nt, Human
gauucugugaguccuucuuucuaccuuugcuu

SEQ ID NO: 164739 - RNA, 32 nt, Human
gauucuguggauguuacuuaaagagaaaagca

SEQ ID NO: 164740 - RNA, 32 nt, Human
gauucuguguagguucugcaggcccaguguag

SEQ ID NO: 164741 - RNA, 32 nt, Human
gauucuguguguguccucagaugcucagccac

SEQ ID NO: 164742 - RNA, 32 nt, Human
gauucuguuaucuaaagaagcuuuuugcuggg

SEQ ID NO: 164743 - RNA, 32 nt, Human
gauucuguucugcccucggcugcagcagccuu

SEQ ID NO: 164744 - RNA, 32 nt, Human
gauucuguugucuugcauauguuauucucuca

SEQ ID NO: 164745 - RNA, 32 nt, Human
gauucuuauauucagcugccuuuuggauaucu

SEQ ID NO: 164746 - RNA, 32 nt, Human
gauucuucaaagaggcacagagccaaauuggu

SEQ ID NO: 164747 - RNA, 32 nt, Human
gauucuucaaagaguguguccacgauccuuug

SEQ ID NO: 164748 - RNA, 32 nt, Human
gauucuucaagcaaucacuaugucaacagaca

SEQ ID NO: 164749 - RNA, 32 nt, Human
gauucuucacgcccagccucugccucacagug

SEQ ID NO: 164750 - RNA, 32 nt, Human
gauucuucaucuuuaucacucucuaugagaag

SEQ ID NO: 164751 - RNA, 32 nt, Human
gauucuucauuaucuucaugguguuuuguugu

SEQ ID NO: 164752 - RNA, 32 nt, Human
gauucuucauuucuucuuccuacugccuccac

SEQ ID NO: 164753 - RNA, 32 nt, Human
gauucuucccgagauagccaccuggaaacacu

SEQ ID NO: 164754 - RNA, 32 nt, Human
gauucuuccucacagcccucagaaggauccag

SEQ ID NO: 164755 - RNA, 32 nt, Human
gauucuuccucucccuucgucagcuuuuccuc

SEQ ID NO: 164756 - RNA, 32 nt, Human
gauucuucucucucauuuuaucccucaccugu

SEQ ID NO: 164757 - RNA, 32 nt, Human
gauucuugaaauugucuaacauguggguacug

SEQ ID NO: 164758 - RNA, 32 nt, Human
gauucuugcaucccuggcugggauccacgacg

SEQ ID NO: 164759 - RNA, 32 nt, Human
gauucuugcccgagugggcagcugagcagagg

SEQ ID NO: 164760 - RNA, 32 nt, Human
gauucuuguugggagcuuaagaauagauuccu

SEQ ID NO: 164761 - RNA, 32 nt, Human
gauucuuuaaggcugcaauacaagcauucagu

SEQ ID NO: 164762 - RNA, 32 nt, Human
gauucuuuugggugucuuuuguuuuccuacac

SEQ ID NO: 164763 - RNA, 32 nt, Human
gauucuuuugguucccuccuggagguucauac

SEQ ID NO: 164764 - RNA, 32 nt, Human
gauucuuuuguuuguuguugugguguuguucu

SEQ ID NO: 164765 - RNA, 32 nt, Human
gauucuuuuugucgucauugcuggugacucau

SEQ ID NO: 164766 - RNA, 32 nt, Human
gauugaaaacaugcuuaaccacuagcaaucaa

SEQ ID NO: 164767 - RNA, 32 nt, Human
gauugaaagcgugugcuuuacccaucugcugu

SEQ ID NO: 164768 - RNA, 32 nt, Human
gauugaaaugcagauuuaacaaucuuauaauc

SEQ ID NO: 164769 - RNA, 32 nt, Human
gauugaacaagaaaucccagccuuucuaggug

SEQ ID NO: 164770 - RNA, 32 nt, Human
gauugaaccccaauucagccauggugacuccu

SEQ ID NO: 164771 - RNA, 32 nt, Human
gauugaacuagacacagacacaugagcaggac

SEQ ID NO: 164772 - RNA, 32 nt, Human
gauugaagcccagccacccaaaguuucugagg

SEQ ID NO: 164773 - RNA, 32 nt, Human
gauugaaggaagcauggucauaguugcccugg

SEQ ID NO: 164774 - RNA, 32 nt, Human
gauugaaggacccgguggaccuugggguuggu

SEQ ID NO: 164775 - RNA, 32 nt, Human
gauugacacuggaggcagauaguugcaaaguu

SEQ ID NO: 164776 - RNA, 32 nt, Human
gauugacacuggcugucaaacucauccuucaa

SEQ ID NO: 164777 - RNA, 32 nt, Human
gauugacauuacagcacagaaaacuguuagug

SEQ ID NO: 164778 - RNA, 32 nt, Human
gauugacugucaggcauggcuuuguuucuagu

SEQ ID NO: 164779 - RNA, 32 nt, Human
gauugacuucagaaacuuuuucuaaauuauaa

SEQ ID NO: 164780 - RNA, 32 nt, Human
gauugacuuggagguggacaauggaccugcgc

SEQ ID NO: 164781 - RNA, 32 nt, Human
gauugagaaacuaugguucaagaagagaggac

SEQ ID NO: 164782 - RNA, 32 nt, Human
gauugagaacacacuggcaguugaaucuugag

SEQ ID NO: 164783 - RNA, 32 nt, Human
gauugagaacucaacuguauuuugccauaaau

SEQ ID NO: 164784 - RNA, 32 nt, Human
gauugagaccagccuggccaacauggugaaac

SEQ ID NO: 164785 - RNA, 32 nt, Human
gauugagaccagccugggcaacauaguaagac

SEQ ID NO: 164786 - RNA, 32 nt, Human
gauugagaccuacaggcugacguuccgggcaa

SEQ ID NO: 164787 - RNA, 32 nt, Human
gauugagacuccugccucagucacauuugguu

SEQ ID NO: 164788 - RNA, 32 nt, Human
gauugagaggaguuccagaccaaccugggcaa

SEQ ID NO: 164789 - RNA, 32 nt, Human
gauugagcaacuguacuccagcuuggcgacag

SEQ ID NO: 164790 - RNA, 32 nt, Human
gauugagcauuggaagggguaucagagaccau

SEQ ID NO: 164791 - RNA, 32 nt, Human
gauugagccaauauacaaauaccucaucuguu

SEQ ID NO: 164792 - RNA, 32 nt, Human
gauugagccacugcacuccaaucugggugaca

SEQ ID NO: 164793 - RNA, 32 nt, Human
gauugagccacugcacuccagccucggccaca

SEQ ID NO: 164794 - RNA, 32 nt, Human
gauugagccacugcacuccagccugggugaca

SEQ ID NO: 164795 - RNA, 32 nt, Human
gauugagccacugcacuccagccugggugacu

SEQ ID NO: 164796 - RNA, 32 nt, Human
gauugagccagugagguccaggcugcacuaag

SEQ ID NO: 164797 - RNA, 32 nt, Human
gauugagccauugcucuccagccugggugaca

SEQ ID NO: 164798 - RNA, 32 nt, Human
gauugagccugcgaggccaaggcugcagcagg

SEQ ID NO: 164799 - RNA, 32 nt, Human
gauugagcuuagauugccucucuagacaacua

SEQ ID NO: 164800 - RNA, 32 nt, Human
gauugaggagagaauuauucuuggugggaaca

SEQ ID NO: 164801 - RNA, 32 nt, Human
gauugaggagugaggaaggcaggaagagagca

SEQ ID NO: 164802 - RNA, 32 nt, Human
gauugaggcaugaguaagacccaaugagggga

SEQ ID NO: 164803 - RNA, 32 nt, Human
gauugaggcuaggaaagguugaagcaagagaa

SEQ ID NO: 164804 - RNA, 32 nt, Human
gauugagggaggaggaggaggaagagguaugg

SEQ ID NO: 164805 - RNA, 32 nt, Human
gauugagggcuuaagacuggauccugacagug

SEQ ID NO: 164806 - RNA, 32 nt, Human
gauugagggugggucugccucucccagcccac

SEQ ID NO: 164807 - RNA, 32 nt, Human
gauugaggguucaccucugccuuggggaggcu

SEQ ID NO: 164808 - RNA, 32 nt, Human
gauugagguuagggcugguggugagggaucau

SEQ ID NO: 164809 - RNA, 32 nt, Human
gauugaguaugaaccacagcuguguuuucaaa

SEQ ID NO: 164810 - RNA, 32 nt, Human
gauugagucaucgacauucaggauuuaagucu

SEQ ID NO: 164811 - RNA, 32 nt, Human
gauugagucuauuuuucacugaucucagcaac

SEQ ID NO: 164812 - RNA, 32 nt, Human
gauugagucuugcucuuguuucccaggcugga

SEQ ID NO: 164813 - RNA, 32 nt, Human
gauugagugcugcuguuaguuuagagaaggag

SEQ ID NO: 164814 - RNA, 32 nt, Human
gauugaguuucacuuccucacugacauuuugu

SEQ ID NO: 164815 - RNA, 32 nt, Human
gauugauacugaugcacugcaucccaaaccau

SEQ ID NO: 164816 - RNA, 32 nt, Human
gauugauaggcacuuccucuugcucagugcaa

SEQ ID NO: 164817 - RNA, 32 nt, Human
gauugaucuauucuugcacgauuuccucugaa

SEQ ID NO: 164818 - RNA, 32 nt, Human
gauugaucuguaauuauugggauuauuuauuc

SEQ ID NO: 164819 - RNA, 32 nt, Human
gauugaugccagccccuccaaaggcucuuucc

SEQ ID NO: 164820 - RNA, 32 nt, Human
gauugaugcugauagaagagccuggacagaug

SEQ ID NO: 164821 - RNA, 32 nt, Human
gauugaugggcuggggaacccuggagagccuc

SEQ ID NO: 164822 - RNA, 32 nt, Human
gauugaugguaguuuggccuguuaguuccugu

SEQ ID NO: 164823 - RNA, 32 nt, Human
gauugauuuuuauuuuauucuauuauuuucuc

SEQ ID NO: 164824 - RNA, 32 nt, Human
gauugcaaacacacaaacaguuggaacagagc

SEQ ID NO: 164825 - RNA, 32 nt, Human
gauugcaacacugccacuccagccugggugac

SEQ ID NO: 164826 - RNA, 32 nt, Human
gauugcaaccuugacaggccacugccucuuaa

SEQ ID NO: 164827 - RNA, 32 nt, Human
gauugcaacuccuggauuucucuuacacuaga

SEQ ID NO: 164828 - RNA, 32 nt, Human
gauugcaaucacagcaaacuuuguuauuuuua

SEQ ID NO: 164829 - RNA, 32 nt, Human
gauugcacaauugcacuccagccuggcgacag

SEQ ID NO: 164830 - RNA, 32 nt, Human
gauugcacacugcacuccagccugggugacua

SEQ ID NO: 164831 - RNA, 32 nt, Human
gauugcacagcugcacuccagccugugcugag

SEQ ID NO: 164832 - RNA, 32 nt, Human
gauugcaccacagcacucaagccugggugaca

SEQ ID NO: 164833 - RNA, 32 nt, Human
gauugcaccacagcacuccaaccugggugaca

SEQ ID NO: 164834 - RNA, 32 nt, Human
gauugcaccaccacacuccagccugcgcgaca

SEQ ID NO: 164835 - RNA, 32 nt, Human
gauugcaccaccacacuccagccugggugaca

SEQ ID NO: 164836 - RNA, 32 nt, Human
gauugcaccaccgcacuccagccugggugaca

SEQ ID NO: 164837 - RNA, 32 nt, Human
gauugcaccacggcacgcuagccugggugaca

SEQ ID NO: 164838 - RNA, 32 nt, Human
gauugcaccacggcacuccagccugggugaca

SEQ ID NO: 164839 - RNA, 32 nt, Human
gauugcaccacuacacuccagccuggaugaca

SEQ ID NO: 164840 - RNA, 32 nt, Human
gauugcaccacuacacuccagccugggcaaca

SEQ ID NO: 164841 - RNA, 32 nt, Human
gauugcaccacuacacuccagccugggugaca

SEQ ID NO: 164842 - RNA, 32 nt, Human
gauugcaccacugcacgccagccugggugaaa

SEQ ID NO: 164843 - RNA, 32 nt, Human
gauugcaccacugcacuacagcuugggugaca

SEQ ID NO: 164844 - RNA, 32 nt, Human
gauugcaccacugcacucaagccugggcaaca

SEQ ID NO: 164845 - RNA, 32 nt, Human
gauugcaccacugcacuccaaccugggcaaca

SEQ ID NO: 164846 - RNA, 32 nt, Human
gauugcaccacugcacuccaaccugggugaca

SEQ ID NO: 164847 - RNA, 32 nt, Human
gauugcaccacugcacuccagcccaggcaaca

SEQ ID NO: 164848 - RNA, 32 nt, Human
gauugcaccacugcacuccagccggggugaca

SEQ ID NO: 164849 - RNA, 32 nt, Human
gauugcaccacugcacuccagccuaggcgaca

SEQ ID NO: 164850 - RNA, 32 nt, Human
gauugcaccacugcacuccagccugagugaca

SEQ ID NO: 164851 - RNA, 32 nt, Human
gauugcaccacugcacuccagccugagugagg

SEQ ID NO: 164852 - RNA, 32 nt, Human
gauugcaccacugcacuccagccuggaaaacg

SEQ ID NO: 164853 - RNA, 32 nt, Human
gauugcaccacugcacuccagccuggcgacaa

SEQ ID NO: 164854 - RNA, 32 nt, Human
gauugcaccacugcacuccagccugggcaaca

SEQ ID NO: 164855 - RNA, 32 nt, Human
gauugcaccacugcacuccagccugggcaaua

SEQ ID NO: 164856 - RNA, 32 nt, Human
gauugcaccacugcacuccagccugggcgaca

SEQ ID NO: 164857 - RNA, 32 nt, Human
gauugcaccacugcacuccagccugggcgacu

SEQ ID NO: 164858 - RNA, 32 nt, Human
gauugcaccacugcacuccagccugggcggca

SEQ ID NO: 164859 - RNA, 32 nt, Human
gauugcaccacugcacuccagccugggcuaca

SEQ ID NO: 164860 - RNA, 32 nt, Human
gauugcaccacugcacuccagccuggggacag

SEQ ID NO: 164861 - RNA, 32 nt, Human
gauugcaccacugcacuccagccuggguaaca

SEQ ID NO: 164862 - RNA, 32 nt, Human
gauugcaccacugcacuccagccugggugaca

SEQ ID NO: 164863 - RNA, 32 nt, Human
gauugcaccacugcacuccagccugggugaua

SEQ ID NO: 164864 - RNA, 32 nt, Human
gauugcaccacugcacuccagccuggguggca

SEQ ID NO: 164865 - RNA, 32 nt, Human
gauugcaccacugcacuccagccuggguguca

SEQ ID NO: 164866 - RNA, 32 nt, Human
gauugcaccacugcacuccagccuggugacag

SEQ ID NO: 164867 - RNA, 32 nt, Human
gauugcaccacugcacuccaggcuggguaaca

SEQ ID NO: 164868 - RNA, 32 nt, Human
gauugcaccacugcacuccagucugggcaaca

SEQ ID NO: 164869 - RNA, 32 nt, Human
gauugcaccacugcacuccagucugggugaga

SEQ ID NO: 164870 - RNA, 32 nt, Human
gauugcaccacugcacuccagucugguugaga

SEQ ID NO: 164871 - RNA, 32 nt, Human
gauugcaccacugcacucccuuccaggugaaa

SEQ ID NO: 164872 - RNA, 32 nt, Human
gauugcaccacugcacucuaacuugggcaaca

SEQ ID NO: 164873 - RNA, 32 nt, Human
gauugcaccacugcacucuacucugggugaca

SEQ ID NO: 164874 - RNA, 32 nt, Human
gauugcaccacugcacucuagccugcgugaca

SEQ ID NO: 164875 - RNA, 32 nt, Human
gauugcaccacugcacucuagccuggggaaca

SEQ ID NO: 164876 - RNA, 32 nt, Human
gauugcaccacugcacucuagccuggguaaca

SEQ ID NO: 164877 - RNA, 24 nt, Human
gauugcaccacugcacuucagccu

SEQ ID NO: 164878 - RNA, 32 nt, Human
gauugcaccacugcacuucagccuggugacag

SEQ ID NO: 164879 - RNA, 24 nt, Human
gauugcaccacugcacuucagcuu

SEQ ID NO: 164880 - RNA, 32 nt, Human
gauugcaccacugcacuucagcuugggcaaca

SEQ ID NO: 164881 - RNA, 24 nt, Human
gauugcaccacugcacuuuagucu

SEQ ID NO: 164882 - RNA, 32 nt, Human
gauugcaccacugcacuuuagucugggugaca

SEQ ID NO: 164883 - RNA, 32 nt, Human
gauugcaccacugcaguucagccuggaugaug

SEQ ID NO: 164884 - RNA, 32 nt, Human
gauugcaccacugcauuccaaccugggcggca

SEQ ID NO: 164885 - RNA, 32 nt, Human
gauugcaccacugcauuccagcauggccacaa

SEQ ID NO: 164886 - RNA, 32 nt, Human
gauugcaccacugcauuccagccuggaugaca

SEQ ID NO: 164887 - RNA, 32 nt, Human
gauugcaccacugcauuccagccuggcgacag

SEQ ID NO: 164888 - RNA, 32 nt, Human
gauugcaccacugcucuccagccuggggaaca

SEQ ID NO: 164889 - RNA, 32 nt, Human
gauugcaccacugcucucuagccugggcaaaa

SEQ ID NO: 164890 - RNA, 32 nt, Human
gauugcaccacuggacgccagccuaggcaaca

SEQ ID NO: 164891 - RNA, 32 nt, Human
gauugcaccacuguacuccaaccugggcgaca

SEQ ID NO: 164892 - RNA, 32 nt, Human
gauugcaccacuguacuccagacuggauaaca

SEQ ID NO: 164893 - RNA, 32 nt, Human
gauugcaccacuguacuccagccugggcaaca

SEQ ID NO: 164894 - RNA, 32 nt, Human
gauugcaccacuguacuccagccugggugaca

SEQ ID NO: 164895 - RNA, 32 nt, Human
gauugcaccacuuacuccagccugggcaacag

SEQ ID NO: 164896 - RNA, 32 nt, Human
gauugcaccacuucacuccagccugggugacg

SEQ ID NO: 164897 - RNA, 32 nt, Human
gauugcaccacuucaucccagccugggagaca

SEQ ID NO: 164898 - RNA, 32 nt, Human
gauugcaccacuuguaacuccagccugggcaa

SEQ ID NO: 164899 - RNA, 32 nt, Human
gauugcaccagugcacuccagcugggcgacag

SEQ ID NO: 164900 - RNA, 32 nt, Human
gauugcaccauugaacuccagccugggcaaca

SEQ ID NO: 164901 - RNA, 32 nt, Human
gauugcaccauugcaccuccagccugggcaac

SEQ ID NO: 164902 - RNA, 32 nt, Human
gauugcaccauugcacuccagccugcgcaaca

SEQ ID NO: 164903 - RNA, 32 nt, Human
gauugcaccauugcacuccagccuggcgacag

SEQ ID NO: 164904 - RNA, 32 nt, Human
gauugcaccauugcacuccagccugggcaaca

SEQ ID NO: 164905 - RNA, 32 nt, Human
gauugcaccauugcacuccagccugggcgaca

SEQ ID NO: 164906 - RNA, 32 nt, Human
gauugcaccauugcacuccagccugggugaca

SEQ ID NO: 164907 - RNA, 32 nt, Human
gauugcaccauugcacuccagccugugcaaca

SEQ ID NO: 164908 - RNA, 32 nt, Human
gauugcaccauugcacuccagcuugggugaca

SEQ ID NO: 164909 - RNA, 32 nt, Human
gauugcaccauugcauuccagccugggcaaca

SEQ ID NO: 164910 - RNA, 32 nt, Human
gauugcaccauugcauuccagccugggugaca

SEQ ID NO: 164911 - RNA, 32 nt, Human
gauugcaccauugcccuccagccugagcaaca

SEQ ID NO: 164912 - RNA, 32 nt, Human
gauugcaccauugcgcucuagccugggcaaca

SEQ ID NO: 164913 - RNA, 32 nt, Human
gauugcaccauuguacuccagccugggcaaua

SEQ ID NO: 164914 - RNA, 32 nt, Human
gauugcaccauuucauuccagccugggcaaca

SEQ ID NO: 164915 - RNA, 32 nt, Human
gauugcaccccugcacuccagccugggugaca

SEQ ID NO: 164916 - RNA, 32 nt, Human
gauugcaccccugcacuccaggcugggcaaca

SEQ ID NO: 164917 - RNA, 32 nt, Human
gauugcacccugcacucuagccugggcaacaa

SEQ ID NO: 164918 - RNA, 32 nt, Human
gauugcaccgcugcacuccagccuggcgacag

SEQ ID NO: 164919 - RNA, 32 nt, Human
gauugcaccgugacacuccagccugggcaaca

SEQ ID NO: 164920 - RNA, 32 nt, Human
gauugcaccuuuguacuccagccugggcaacg

SEQ ID NO: 164921 - RNA, 32 nt, Human
gauugcacgacugcacuccagccugggcaaug

SEQ ID NO: 164922 - RNA, 32 nt, Human
gauugcacuacuacacuccagccuggugacag

SEQ ID NO: 164923 - RNA, 32 nt, Human
gauugcacuacugcacuccagacuggugacgg

SEQ ID NO: 164924 - RNA, 32 nt, Human
gauugcacuacugcacuccagccugggugaca

SEQ ID NO: 164925 - RNA, 32 nt, Human
gauugcacuauugcacuccagccugggcaaca

SEQ ID NO: 164926 - RNA, 32 nt, Human
gauugcacuguucugauuauguaagcauuugu

SEQ ID NO: 164927 - RNA, 32 nt, Human
gauugcagacuggagggguaaccuccgcugag

SEQ ID NO: 164928 - RNA, 32 nt, Human
gauugcagagggcgcagcuccaccgugguaac

SEQ ID NO: 164929 - RNA, 32 nt, Human
gauugcagcaauguuggcuacauguauuauua

SEQ ID NO: 164930 - RNA, 32 nt, Human
gauugcagcugaucauagcucacugcagcuuc

SEQ ID NO: 164931 - RNA, 25 nt, Human
gauugcagcuuggcuauuugguuga

SEQ ID NO: 164932 - RNA, 18 nt, Human
gauugcaggcaugagcca

SEQ ID NO: 164933 - RNA, 32 nt, Human
gauugcauagucagugcuuccagcucugcucc

SEQ ID NO: 164934 - RNA, 32 nt, Human
gauugcaucacugcacuccagccugggcgaug

SEQ ID NO: 164935 - RNA, 32 nt, Human
gauugcaucacugcacuccagccugggugaca

SEQ ID NO: 164936 - RNA, 32 nt, Human
gauugcaucacugcacuccagcuugggugaca

SEQ ID NO: 164937 - RNA, 32 nt, Human
gauugcaucacugcacugcagccugggcaaca

SEQ ID NO: 164938 - RNA, 32 nt, Human
gauugcaucauugcacuccagccugggcaaca

SEQ ID NO: 164939 - RNA, 32 nt, Human
gauugcaugagacucguucaggagacaucugc

SEQ ID NO: 164940 - RNA, 32 nt, Human
gauugcauggcugcacucuagccugggugaca

SEQ ID NO: 164941 - RNA, 32 nt, Human
gauugcauuuaauagauaaaacguuuaggcaa

SEQ ID NO: 164942 - RNA, 32 nt, Human
gauugcauuuauggacuuuucacacacucauu

SEQ ID NO: 164943 - RNA, 32 nt, Human
gauugccaaauugacauguugucacauucuca

SEQ ID NO: 164944 - RNA, 32 nt, Human
gauugccaacgccucuggagugcuggcuggga

SEQ ID NO: 164945 - RNA, 32 nt, Human
gauugccacugcacuccagccugggcaacaag

SEQ ID NO: 164946 - RNA, 32 nt, Human
gauugccagaagcugcuggcuacaguggcuuu

SEQ ID NO: 164947 - RNA, 32 nt, Human
gauugcccacugcacuccagccugggcaacag

SEQ ID NO: 164948 - RNA, 32 nt, Human
gauugccccacugcacuccacccugggcaaug

SEQ ID NO: 164949 - RNA, 32 nt, Human
gauugccccacugcacuccagccuaggcaaca

SEQ ID NO: 164950 - RNA, 32 nt, Human
gauugcccccgcuacacuccagccuggucgac

SEQ ID NO: 164951 - RNA, 32 nt, Human
gauugccccuaucuugugcucuucugucugca

SEQ ID NO: 164952 - RNA, 32 nt, Human
gauugcccucauuaacaaucugaccagcucgu

SEQ ID NO: 164953 - RNA, 32 nt, Human
gauugcccugcuggcccuaccucacagcugaa

SEQ ID NO: 164954 - RNA, 32 nt, Human
gauugcccuguauugauguagaaaugucugua

SEQ ID NO: 164955 - RNA, 32 nt, Human
gauugccucaucaucccccauuuggucauuca

SEQ ID NO: 164956 - RNA, 32 nt, Human
gauugccucugcugacccucagucuccucccc

SEQ ID NO: 164957 - RNA, 32 nt, Human
gauugccugccucugcugcgucuuugcccacu

SEQ ID NO: 164958 - RNA, 22 nt, Human
gauugccuuuacuguguucuca

SEQ ID NO: 164959 - RNA, 32 nt, Human
gauugccuuuccccaggaucugugucggccau

SEQ ID NO: 164960 - RNA, 32 nt, Human
gauugcgagagcucggcaacccugccgacuca

SEQ ID NO: 164961 - RNA, 32 nt, Human
gauugcgccacagcauuccagccugggcgaug

SEQ ID NO: 164962 - RNA, 32 nt, Human
gauugcgccaccacacuccagccugggcaaca

SEQ ID NO: 164963 - RNA, 32 nt, Human
gauugcgccaccacugcacuccagccugggca

SEQ ID NO: 164964 - RNA, 32 nt, Human
gauugcgccaccgcacuccagccugggcaaca

SEQ ID NO: 164965 - RNA, 32 nt, Human
gauugcgccaccgcacuccagccugggcgaca

SEQ ID NO: 164966 - RNA, 32 nt, Human
gauugcgccacuacacucuagccugggcaacg

SEQ ID NO: 164967 - RNA, 32 nt, Human
gauugcgccacugcacaccagucuggagacag

SEQ ID NO: 164968 - RNA, 32 nt, Human
gauugcgccacugcacacuagcuugggugaca

SEQ ID NO: 164969 - RNA, 32 nt, Human
gauugcgccacugcaccccagcccgggugaca

SEQ ID NO: 164970 - RNA, 32 nt, Human
gauugcgccacugcaccccagccuggacaaca

SEQ ID NO: 164971 - RNA, 32 nt, Human
gauugcgccacugcaccccagccugggcgaca

SEQ ID NO: 164972 - RNA, 32 nt, Human
gauugcgccacugcaccccagccugggugaca

SEQ ID NO: 164973 - RNA, 32 nt, Human
gauugcgccacugcacucaagucugggcgaca

SEQ ID NO: 164974 - RNA, 32 nt, Human
gauugcgccacugcacuccaaccugggcaaua

SEQ ID NO: 164975 - RNA, 32 nt, Human
gauugcgccacugcacuccacccugggugaca

SEQ ID NO: 164976 - RNA, 32 nt, Human
gauugcgccacugcacuccagccagggcgaag

SEQ ID NO: 164977 - RNA, 32 nt, Human
gauugcgccacugcacuccagcccuggcgaca

SEQ ID NO: 164978 - RNA, 32 nt, Human
gauugcgccacugcacuccagccuaggugaua

SEQ ID NO: 164979 - RNA, 32 nt, Human
gauugcgccacugcacuccagccugacgacaa

SEQ ID NO: 164980 - RNA, 32 nt, Human
gauugcgccacugcacuccagccuggcgacag

SEQ ID NO: 164981 - RNA, 32 nt, Human
gauugcgccacugcacuccagccugggagaca

SEQ ID NO: 164982 - RNA, 32 nt, Human
gauugcgccacugcacuccagccugggcaaca

SEQ ID NO: 164983 - RNA, 32 nt, Human
gauugcgccacugcacuccagccugggcaaua

SEQ ID NO: 164984 - RNA, 32 nt, Human
gauugcgccacugcacuccagccugggcagca

SEQ ID NO: 164985 - RNA, 32 nt, Human
gauugcgccacugcacuccagccugggcgaca

SEQ ID NO: 164986 - RNA, 32 nt, Human
gauugcgccacugcacuccagccugggcgacg

SEQ ID NO: 164987 - RNA, 32 nt, Human
gauugcgccacugcacuccagccugggcuaca

SEQ ID NO: 164988 - RNA, 32 nt, Human
gauugcgccacugcacuccagccugggggaca

SEQ ID NO: 164989 - RNA, 32 nt, Human
gauugcgccacugcacuccagccuggguaaca

SEQ ID NO: 164990 - RNA, 32 nt, Human
gauugcgccacugcacuccagccugggugaca

SEQ ID NO: 164991 - RNA, 32 nt, Human
gauugcgccacugcacuccagccugggugacu

SEQ ID NO: 164992 - RNA, 32 nt, Human
gauugcgccacugcacuccagccugguugaca

SEQ ID NO: 164993 - RNA, 32 nt, Human
gauugcgccacugcacuccagcgugggcuaca

SEQ ID NO: 164994 - RNA, 32 nt, Human
gauugcgccacugcacuccagucugggcgaca

SEQ ID NO: 164995 - RNA, 32 nt, Human
gauugcgccacugcacuccagucuggucggca

SEQ ID NO: 164996 - RNA, 32 nt, Human
gauugcgccacugcacucuagccuaagcaaug

SEQ ID NO: 164997 - RNA, 32 nt, Human
gauugcgccacugcacuucagccuggaugaca

SEQ ID NO: 164998 - RNA, 32 nt, Human
gauugcgccacugcacuucagccugggcaaca

SEQ ID NO: 164999 - RNA, 32 nt, Human
gauugcgccacugcaguccgcagcccagccug

SEQ ID NO: 165000 - RNA, 32 nt, Human
gauugcgccacugcaguccgcaguccagccug

SEQ ID NO: 165001 - RNA, 32 nt, Human
gauugcgccacugcaguccgcaguccggccug

SEQ ID NO: 165002 - RNA, 32 nt, Human
gauugcgccacugcaguccgcagucuggccug

SEQ ID NO: 165003 - RNA, 32 nt, Human
gauugcgccacugcauuccagccugggugacu

SEQ ID NO: 165004 - RNA, 32 nt, Human
gauugcgccacugcauuccagcuugggcgaca

SEQ ID NO: 165005 - RNA, 32 nt, Human
gauugcgccacugcauucuagccuggaugaca

SEQ ID NO: 165006 - RNA, 32 nt, Human
gauugcgccacugcgcuccagccugggcaaca

SEQ ID NO: 165007 - RNA, 32 nt, Human
gauugcgccacuggacuccagccugcgugaca

SEQ ID NO: 165008 - RNA, 32 nt, Human
gauugcgccacuguacuccagccuggcaacag

SEQ ID NO: 165009 - RNA, 32 nt, Human
gauugcgccacuguacuccagccugggugacg

SEQ ID NO: 165010 - RNA, 32 nt, Human
gauugcgccacuguacuccagcuugggcaaca

SEQ ID NO: 165011 - RNA, 32 nt, Human
gauugcgccacuucacuccagccugggugaca

SEQ ID NO: 165012 - RNA, 32 nt, Human
gauugcgccagugcacuccagcugggcgacag

SEQ ID NO: 165013 - RNA, 32 nt, Human
gauugcgccauugcacuccagccuagguaaca

SEQ ID NO: 165014 - RNA, 32 nt, Human
gauugcgccauugcacuccagccugggcaaaa

SEQ ID NO: 165015 - RNA, 32 nt, Human
gauugcgccauugcacuccagccugggcaaca

SEQ ID NO: 165016 - RNA, 32 nt, Human
gauugcgccauugcacuccagccugggcaacg

SEQ ID NO: 165017 - RNA, 32 nt, Human
gauugcgccauugcacuccagccuggggacaa

SEQ ID NO: 165018 - RNA, 32 nt, Human
gauugcgccauugcagcacagccugguuacag

SEQ ID NO: 165019 - RNA, 32 nt, Human
gauugcgccauugcagggcagccugguuacag

SEQ ID NO: 165020 - RNA, 32 nt, Human
gauugcgccauugcauuccagccugggcaaca

SEQ ID NO: 165021 - RNA, 32 nt, Human
gauugcgccauugcauuccagccugggugaca

SEQ ID NO: 165022 - RNA, 32 nt, Human
gauugcgccauuguacuccagccugggcaaca

SEQ ID NO: 165023 - RNA, 32 nt, Human
gauugcgccauuguacuccagccugggggaca

SEQ ID NO: 165024 - RNA, 32 nt, Human
gauugcgccauugugcuccagccugggugaca

SEQ ID NO: 165025 - RNA, 32 nt, Human
gauugcgcccccugcacuccagccugggcuuc

SEQ ID NO: 165026 - RNA, 32 nt, Human
gauugcgccccugcacuccaaccuggacaaca

SEQ ID NO: 165027 - RNA, 32 nt, Human
gauugcgccgcuacauuccagccugggcaaca

SEQ ID NO: 165028 - RNA, 32 nt, Human
gauugcgccgcugcacuccagccugggcaaca

SEQ ID NO: 165029 - RNA, 32 nt, Human
gauugcgccgcugcacuccagccugggcgaca

SEQ ID NO: 165030 - RNA, 32 nt, Human
gauugcgccguuguacuccagccugggcaaca

SEQ ID NO: 165031 - RNA, 32 nt, Human
gauugcgccugagauacaaggcccagaagccu

SEQ ID NO: 165032 - RNA, 32 nt, Human
gauugcgcuacuacgcuacagccugggugaca

SEQ ID NO: 165033 - RNA, 32 nt, Human
gauugcgcuacugaacuccagccuggguuaca

SEQ ID NO: 165034 - RNA, 32 nt, Human
gauugcgcuacugcacuccagccuaggcaaca

SEQ ID NO: 165035 - RNA, 32 nt, Human
gauugcgcuacugcacuccagccugggcgaca

SEQ ID NO: 165036 - RNA, 32 nt, Human
gauugcgcuacugcacuccagccugggugaca

SEQ ID NO: 165037 - RNA, 32 nt, Human
gauugcgcugcugcacuccaaccugggcgaca

SEQ ID NO: 165038 - RNA, 32 nt, Human
gauugcgucacugcacuccaaccugggugaca

SEQ ID NO: 165039 - RNA, 32 nt, Human
gauugcgucacugcacuccagccugagcaaca

SEQ ID NO: 165040 - RNA, 32 nt, Human
gauugcgucacugcacuccagccugggcgaca

SEQ ID NO: 165041 - RNA, 32 nt, Human
gauugcgucacugcacugcagccugggugaca

SEQ ID NO: 165042 - RNA, 32 nt, Human
gauugcuagacuccucuuccuccuggacccca

SEQ ID NO: 165043 - RNA, 32 nt, Human
gauugcuaugugagcuggagagagaaaaggug

SEQ ID NO: 165044 - RNA, 32 nt, Human
gauugcucaaauacugauaucagcucaauguc

SEQ ID NO: 165045 - RNA, 32 nt, Human
gauugcucagcagcucugguggggcggguggg

SEQ ID NO: 165046 - RNA, 32 nt, Human
gauugcucagccacucaugccucaggcuccuc

SEQ ID NO: 165047 - RNA, 32 nt, Human
gauugcucaggucagcugcuuggggcucccag

SEQ ID NO: 165048 - RNA, 32 nt, Human
gauugcuccauugcacuccagccugggcaacg

SEQ ID NO: 165049 - RNA, 32 nt, Human
gauugcuccauugcacuccagccugggcgaua

SEQ ID NO: 165050 - RNA, 32 nt, Human
gauugcucuccucccgcuucaggccuaggaug

SEQ ID NO: 165051 - RNA, 32 nt, Human
gauugcucugcagccagugagggagguccccg

SEQ ID NO: 165052 - RNA, 32 nt, Human
gauugcucuuucuccuucuucccugagucucu

SEQ ID NO: 165053 - RNA, 32 nt, Human
gauugcugccaggcacuguucaucucaguuuu

SEQ ID NO: 165054 - RNA, 32 nt, Human
gauugcugcccuaaaggagaaugcucuuuccu

SEQ ID NO: 165055 - RNA, 21 nt, Human
gauugcuggaagugugacgga

SEQ ID NO: 165056 - RNA, 32 nt, Human
gauugcuguguguugccugggacacagaucaa

SEQ ID NO: 165057 - RNA, 32 nt, Human
gauugcuuaagagaucaagagguugaagcugc

SEQ ID NO: 165058 - RNA, 32 nt, Human
gauugcuucucuucucuccuccaaggucuagu

SEQ ID NO: 165059 - RNA, 32 nt, Human
gauugcuugagaccagccugggugacacagca

SEQ ID NO: 165060 - RNA, 32 nt, Human
gauugcuugaggccagccugggcaacauagug

SEQ ID NO: 165061 - RNA, 32 nt, Human
gauugcuugaguccagccugggcaguauagca

SEQ ID NO: 165062 - RNA, 32 nt, Human
gauugcuugaguccaggagaccagccugggca

SEQ ID NO: 165063 - RNA, 32 nt, Human
gauugcuuggcucaagacaagugugggcaaca

SEQ ID NO: 165064 - RNA, 32 nt, Human
gauugcuuugccugcugagguuaguuuuggga

SEQ ID NO: 165065 - RNA, 32 nt, Human
gauuggaaaauguuaggauggaccaagguggg

SEQ ID NO: 165066 - RNA, 32 nt, Human
gauuggaagccagccugcugucgcucuguggg

SEQ ID NO: 165067 - RNA, 32 nt, Human
gauuggaauucuuugaacccucgaagugcucc

SEQ ID NO: 165068 - RNA, 32 nt, Human
gauuggacaagcuucagcccacucuugaagcc

SEQ ID NO: 165069 - RNA, 32 nt, Human
gauuggacaguuucagaggccuuauuuuguca

SEQ ID NO: 165070 - RNA, 32 nt, Human
gauuggaccacuauacuccagccuggcaacag

SEQ ID NO: 165071 - RNA, 32 nt, Human
gauuggaccacugcucuccagccugggcaaca

SEQ ID NO: 165072 - RNA, 32 nt, Human
gauuggaccuggaagaagugagucuccucuca

SEQ ID NO: 165073 - RNA, 32 nt, Human
gauuggaggauagagccagcugucugacacac

SEQ ID NO: 165074 - RNA, 32 nt, Human
gauuggaguuggggagaaagaagacagauuag

SEQ ID NO: 165075 - RNA, 32 nt, Human
gauuggauaugagacagaagauauaagaauca

SEQ ID NO: 165076 - RNA, 32 nt, Human
gauuggcaaaggcccuugaggggcuuggggau

SEQ ID NO: 165077 - RNA, 32 nt, Human
gauuggcaacaggaacugaagcuuaaaguauu

SEQ ID NO: 165078 - RNA, 32 nt, Human
gauuggcaccagacuguauacccuucucuucu

SEQ ID NO: 165079 - RNA, 32 nt, Human
gauuggcacccaggcugggagcuugccaggaa

SEQ ID NO: 165080 - RNA, 32 nt, Human
gauuggcagcugcauccaaccuccaggucaaa

SEQ ID NO: 165081 - RNA, 18 nt, Human
gauuggcagcuucucucg

SEQ ID NO: 165082 - RNA, 32 nt, Human
gauuggcauaaagagcuucuguuuucuuuggc

SEQ ID NO: 165083 - RNA, 32 nt, Human
gauuggcauacguguucacaggcagaguaguu

SEQ ID NO: 165084 - RNA, 32 nt, Human
gauuggcauuguuuuugauucagcuuuuugga

SEQ ID NO: 165085 - RNA, 32 nt, Human
gauuggccaccaccccuccucacucucacccc

SEQ ID NO: 165086 - RNA, 32 nt, Human
gauuggccauugcacuccagccugggugacag

SEQ ID NO: 165087 - RNA, 32 nt, Human
gauuggcccagcuuggagugcuuguguggucc

SEQ ID NO: 165088 - RNA, 32 nt, Human
gauuggcccuccagagaaggggcggccccuuc

SEQ ID NO: 165089 - RNA, 32 nt, Human
gauuggcccuggcugcugccacacacauaucc

SEQ ID NO: 165090 - RNA, 32 nt, Human
gauuggccgggaauuugaggcugcaaggauag

SEQ ID NO: 165091 - RNA, 32 nt, Human
gauuggcucauuuugugcagaccuuagagcaa

SEQ ID NO: 165092 - RNA, 32 nt, Human
gauuggcuccaucccuccaggcucucauugug

SEQ ID NO: 165093 - RNA, 32 nt, Human
gauuggcugcccggaaggaggcggagacagcc

SEQ ID NO: 165094 - RNA, 32 nt, Human
gauugggaacuggaacccugaggucuuugagg

SEQ ID NO: 165095 - RNA, 32 nt, Human
gauugggaagaaguucaaagagcugaaccuca

SEQ ID NO: 165096 - RNA, 32 nt, Human
gauugggaaggcaccugcucccacagaagggg

SEQ ID NO: 165097 - RNA, 32 nt, Human
gauugggaauuuaucugccuaaucagacuuau

SEQ ID NO: 165098 - RNA, 32 nt, Human
gauugggacacacuuucuggacacugcuggcc

SEQ ID NO: 165099 - RNA, 32 nt, Human
gauugggacccacuuucugggcacugcuggcc

SEQ ID NO: 165100 - RNA, 32 nt, Human
gauugggagaggguaaggcaaacagcgacugc

SEQ ID NO: 165101 - RNA, 32 nt, Human
gauugggaggacuuuacugugguucugccuuc

SEQ ID NO: 165102 - RNA, 32 nt, Human
gauugggaggugcguguucagcagaaccugca

SEQ ID NO: 165103 - RNA, 32 nt, Human
gauugggcaaaagagagccagugaagauacaa

SEQ ID NO: 165104 - RNA, 32 nt, Human
gauugggccacugcacuccacccugggcgaca

SEQ ID NO: 165105 - RNA, 32 nt, Human
gauugggcuucuaaaucaaaagccugauguuc

SEQ ID NO: 165106 - RNA, 32 nt, Human
gauuggggaggcagcuuaucuccuaaaaggag

SEQ ID NO: 165107 - RNA, 32 nt, Human
gauuggggcucccugaggauggggcugugucu

SEQ ID NO: 165108 - RNA, 32 nt, Human
gauugggggaauggggagaugaugaugauggu

SEQ ID NO: 165109 - RNA, 32 nt, Human
gauugggggccuugcccggaagcuggaccuca

SEQ ID NO: 165110 - RNA, 32 nt, Human
gauuggggugagagaggaaggaagcacgccaa

SEQ ID NO: 165111 - RNA, 32 nt, Human
gauuggggugcacgaugacgucagaacacgug

SEQ ID NO: 165112 - RNA, 32 nt, Human
gauuggguaggugaaggggucaggggacuggu

SEQ ID NO: 165113 - RNA, 32 nt, Human
gauugggucuuggaacaaaaacaggacauuag

SEQ ID NO: 165114 - RNA, 32 nt, Human
gauugggugcaguggcucacaccugucauucc

SEQ ID NO: 165115 - RNA, 32 nt, Human
gauugggugccauguggaguggacauucaaaa

SEQ ID NO: 165116 - RNA, 32 nt, Human
gauuggguuuucaggcccucugcuccaccccu

SEQ ID NO: 165117 - RNA, 32 nt, Human
gauugguaaagugccacaguauuccagauaac

SEQ ID NO: 165118 - RNA, 32 nt, Human
gauugguaauuugccagcagaccucccaacuc

SEQ ID NO: 165119 - RNA, 32 nt, Human
gauuggucccaccgcacuccagccugggcaac

SEQ ID NO: 165120 - RNA, 32 nt, Human
gauuggucucaaacuccuggacucaagugauc

SEQ ID NO: 165121 - RNA, 32 nt, Human
gauuggucuggguggaugugagcagaagacua

SEQ ID NO: 165122 - RNA, 32 nt, Human
gauugguggguuguuuccuccuuuuugcuuuu

SEQ ID NO: 165123 - RNA, 32 nt, Human
gauugguguaaaccucuuguugugcauccuca

SEQ ID NO: 165124 - RNA, 32 nt, Human
gauugguguggaggcagaaagaggaaggagac

SEQ ID NO: 165125 - RNA, 32 nt, Human
gauugguguguauuggccaaguuuugcuuguu

SEQ ID NO: 165126 - RNA, 32 nt, Human
gauugguuagugaaggucagugugagaagaag

SEQ ID NO: 165127 - RNA, 32 nt, Human
gauugguuugcacuucuuggcuggguuccccc

SEQ ID NO: 165128 - RNA, 32 nt, Human
gauugguuuuauaguucauugaaaauccucaa

SEQ ID NO: 165129 - RNA, 32 nt, Human
gauuguaaauauaaacauuaacuuuccuauaa

SEQ ID NO: 165130 - RNA, 19 nt, Human
gauuguaaaugaguucuga

SEQ ID NO: 165131 - RNA, 32 nt, Human
gauuguaacuuaaauuaacgaggggaaacgac

SEQ ID NO: 165132 - RNA, 32 nt, Human
gauuguaaguuaccugaaagcugcaguucaca

SEQ ID NO: 165133 - RNA, 32 nt, Human
gauuguaauaauguuacaugaucaugggugug

SEQ ID NO: 165134 - RNA, 32 nt, Human
gauuguaccacugcacuccaaccuggguuaca

SEQ ID NO: 165135 - RNA, 32 nt, Human
gauuguaccacugcacuccagccugggcaaca

SEQ ID NO: 165136 - RNA, 32 nt, Human
gauuguaccacugcacuccagccugggcgaca

SEQ ID NO: 165137 - RNA, 32 nt, Human
gauuguaccacugcacuccagccugggugaca

SEQ ID NO: 165138 - RNA, 32 nt, Human
gauuguaccacugcacuccagccuggucaaug

SEQ ID NO: 165139 - RNA, 32 nt, Human
gauuguaccacugcacuccagcucggggaaca

SEQ ID NO: 165140 - RNA, 32 nt, Human
gauuguaccacugcacuccagucugggcaaca

SEQ ID NO: 165141 - RNA, 32 nt, Human
gauuguaccacugcacuccaguuuggcaacag

SEQ ID NO: 165142 - RNA, 32 nt, Human
gauuguaccacugcgcuccaaacugggugaca

SEQ ID NO: 165143 - RNA, 32 nt, Human
gauuguaccacuguacuccagccugggcugga

SEQ ID NO: 165144 - RNA, 32 nt, Human
gauuguaccacuguauuccagccuggacgacu

SEQ ID NO: 165145 - RNA, 32 nt, Human
gauuguaccaugcacuccagccuggguaacag

SEQ ID NO: 165146 - RNA, 32 nt, Human
gauuguaccauggcacuccagccuggacaaca

SEQ ID NO: 165147 - RNA, 32 nt, Human
gauuguaccauugcacuccagccugggcaaca

SEQ ID NO: 165148 - RNA, 32 nt, Human
gauuguagauuuuugcuuuuucuuuuuguuuu

SEQ ID NO: 165149 - RNA, 32 nt, Human
gauuguagcucugaagaaagcaaauggugaug

SEQ ID NO: 165150 - RNA, 32 nt, Human
gauuguaggcaagagggugaggaagagaugcu

SEQ ID NO: 165151 - RNA, 32 nt, Human
gauuguauaccuucuugguuucuuuuaagaau

SEQ ID NO: 165152 - RNA, 32 nt, Human
gauuguauccagaagcuucauccccaagauaa

SEQ ID NO: 165153 - RNA, 32 nt, Human
gauuguaugacugcacuccagccugggugaca

SEQ ID NO: 165154 - RNA, 32 nt, Human
gauuguaugcaguugguauucucuccaguaua

SEQ ID NO: 165155 - RNA, 32 nt, Human
gauuguauuuaccuucuaccucuuggcugccu

SEQ ID NO: 165156 - RNA, 32 nt, Human
gauuguauuuaugagugcaaguuuacaaauca

SEQ ID NO: 165157 - RNA, 32 nt, Human
gauugucacugcuguuccaagggcacacgcag

SEQ ID NO: 165158 - RNA, 32 nt, Human
gauugucauccuggcagguauugcugagggcc

SEQ ID NO: 165159 - RNA, 22 nt, Human
gauugucaucuccuuuggggug

SEQ ID NO: 165160 - RNA, 32 nt, Human
gauugucauuccacuccagguccuggcaaaug

SEQ ID NO: 165161 - RNA, 32 nt, Human
gauugucauuggcuuuuuccauaaaguuuaga

SEQ ID NO: 165162 - RNA, 32 nt, Human
gauuguccauguccagaaacaacagugucuuu

SEQ ID NO: 165163 - RNA, 32 nt, Human
gauugucccagccccucuucccuuccccucac

SEQ ID NO: 165164 - RNA, 32 nt, Human
gauuguccucagccuccacuuccccagaguaa

SEQ ID NO: 165165 - RNA, 32 nt, Human
gauuguccucaucaaucucuuuacaucuuuau

SEQ ID NO: 165166 - RNA, 32 nt, Human
gauugucuagacacagaugaugagacagaguu

SEQ ID NO: 165167 - RNA, 32 nt, Human
gauugucuccaucucuugaccuugugauccac

SEQ ID NO: 165168 - RNA, 32 nt, Human
gauugugacacugcacuccagccugggcaaca

SEQ ID NO: 165169 - RNA, 32 nt, Human
gauugugacacugcccuccagccugggugaca

SEQ ID NO: 165170 - RNA, 32 nt, Human
gauugugacuccccagccccugcccucaaagc

SEQ ID NO: 165171 - RNA, 32 nt, Human
gauugugaggcuuccccagccauguggaacua

SEQ ID NO: 165172 - RNA, 32 nt, Human
gauugugaggguucccucacagccagcacgac

SEQ ID NO: 165173 - RNA, 32 nt, Human
gauugugcaagagagaaggaagaacgaagcuu

SEQ ID NO: 165174 - RNA, 32 nt, Human
gauugugcacugcacucuagccugggggaaga

SEQ ID NO: 165175 - RNA, 32 nt, Human
gauugugccaauguacuccagccuaggugaca

SEQ ID NO: 165176 - RNA, 32 nt, Human
gauugugccacacacuccagccuggguggcaa

SEQ ID NO: 165177 - RNA, 32 nt, Human
gauugugccaccacacuccagccugggcgaca

SEQ ID NO: 165178 - RNA, 32 nt, Human
gauugugccaccgcacuccagcaugggugaca

SEQ ID NO: 165179 - RNA, 32 nt, Human
gauugugccacggcacuccagccugggcagca

SEQ ID NO: 165180 - RNA, 32 nt, Human
gauugugccacuacacuccagccuggccacag

SEQ ID NO: 165181 - RNA, 32 nt, Human
gauugugccacuacacuccagccuggccgaca

SEQ ID NO: 165182 - RNA, 32 nt, Human
gauugugccacuacacuccagccugggagaca

SEQ ID NO: 165183 - RNA, 32 nt, Human
gauugugccacuacacuccagccugggcaaca

SEQ ID NO: 165184 - RNA, 32 nt, Human
gauugugccacuacacuccagccugggugaca

SEQ ID NO: 165185 - RNA, 32 nt, Human
gauugugccacuccccuccagccugggcgaca

SEQ ID NO: 165186 - RNA, 32 nt, Human
gauugugccacugaacucuagccuggguaaca

SEQ ID NO: 165187 - RNA, 32 nt, Human
gauugugccacugcacaccagccuggacaaca

SEQ ID NO: 165188 - RNA, 32 nt, Human
gauugugccacugcacaccggccugggugaca

SEQ ID NO: 165189 - RNA, 32 nt, Human
gauugugccacugcacacuccaaucuggguga

SEQ ID NO: 165190 - RNA, 32 nt, Human
gauugugccacugcacgcacuccagccugggc

SEQ ID NO: 165191 - RNA, 32 nt, Human
gauugugccacugcacucaagccugggugacg

SEQ ID NO: 165192 - RNA, 32 nt, Human
gauugugccacugcacuccaaccugggugaca

SEQ ID NO: 165193 - RNA, 32 nt, Human
gauugugccacugcacuccacccugggcaaca

SEQ ID NO: 165194 - RNA, 32 nt, Human
gauugugccacugcacuccagccggggugaca

SEQ ID NO: 165195 - RNA, 32 nt, Human
gauugugccacugcacuccagccuaggcaaca

SEQ ID NO: 165196 - RNA, 32 nt, Human
gauugugccacugcacuccagccuaggcgaca

SEQ ID NO: 165197 - RNA, 32 nt, Human
gauugugccacugcacuccagccugagcaaca

SEQ ID NO: 165198 - RNA, 32 nt, Human
gauugugccacugcacuccagccuggacgaca

SEQ ID NO: 165199 - RNA, 32 nt, Human
gauugugccacugcacuccagccuggcaacag

SEQ ID NO: 165200 - RNA, 32 nt, Human
gauugugccacugcacuccagccugggagaca

SEQ ID NO: 165201 - RNA, 32 nt, Human
gauugugccacugcacuccagccugggcaaca

SEQ ID NO: 165202 - RNA, 32 nt, Human
gauugugccacugcacuccagccugggcaacu

SEQ ID NO: 165203 - RNA, 32 nt, Human
gauugugccacugcacuccagccugggcaaua

SEQ ID NO: 165204 - RNA, 32 nt, Human
gauugugccacugcacuccagccugggcacca

SEQ ID NO: 165205 - RNA, 32 nt, Human
gauugugccacugcacuccagccugggccaca

SEQ ID NO: 165206 - RNA, 32 nt, Human
gauugugccacugcacuccagccugggcgaca

SEQ ID NO: 165207 - RNA, 32 nt, Human
gauugugccacugcacuccagccugggcgaua

SEQ ID NO: 165208 - RNA, 32 nt, Human
gauugugccacugcacuccagccuggguaaca

SEQ ID NO: 165209 - RNA, 32 nt, Human
gauugugccacugcacuccagccugggugaaa

SEQ ID NO: 165210 - RNA, 32 nt, Human
gauugugccacugcacuccagccugggugaca

SEQ ID NO: 165211 - RNA, 32 nt, Human
gauugugccacugcacuccagccugggugacu

SEQ ID NO: 165212 - RNA, 32 nt, Human
gauugugccacugcacuccagccuggguggca

SEQ ID NO: 165213 - RNA, 32 nt, Human
gauugugccacugcacuccagccuggguuaca

SEQ ID NO: 165214 - RNA, 32 nt, Human
gauugugccacugcacuccagcgugggcaacg

SEQ ID NO: 165215 - RNA, 32 nt, Human
gauugugccacugcacuccagcuggguggcag

SEQ ID NO: 165216 - RNA, 32 nt, Human
gauugugccacugcacuccagcuuggugacag

SEQ ID NO: 165217 - RNA, 32 nt, Human
gauugugccacugcacuccagucuggacaaca

SEQ ID NO: 165218 - RNA, 32 nt, Human
gauugugccacugcacucccgccugggcgaca

SEQ ID NO: 165219 - RNA, 32 nt, Human
gauugugccacugcacucgagccugggugaca

SEQ ID NO: 165220 - RNA, 32 nt, Human
gauugugccacugcacucuagccuagguggcu

SEQ ID NO: 165221 - RNA, 32 nt, Human
gauugugccacugcacucuagccucggugaca

SEQ ID NO: 165222 - RNA, 32 nt, Human
gauugugccacugcacucuagccuggacagca

SEQ ID NO: 165223 - RNA, 32 nt, Human
gauugugccacugcacucuagccugggcaaua

SEQ ID NO: 165224 - RNA, 32 nt, Human
gauugugccacugcacucuagccugggugaca

SEQ ID NO: 165225 - RNA, 32 nt, Human
gauugugccacugcacugcaggcugggugaca

SEQ ID NO: 165226 - RNA, 32 nt, Human
gauugugccacugcacuucagccugggcgaca

SEQ ID NO: 165227 - RNA, 32 nt, Human
gauugugccacugcacuucagcuugggugaca

SEQ ID NO: 165228 - RNA, 32 nt, Human
gauugugccacugcauaccagccuaggugaca

SEQ ID NO: 165229 - RNA, 32 nt, Human
gauugugccacugcauucuagccugggcgaua

SEQ ID NO: 165230 - RNA, 32 nt, Human
gauugugccacugcccuccagccugggugaca

SEQ ID NO: 165231 - RNA, 32 nt, Human
gauugugccacugcgcuccagccugggcgaca

SEQ ID NO: 165232 - RNA, 32 nt, Human
gauugugccacugcucuccagccugggaggca

SEQ ID NO: 165233 - RNA, 32 nt, Human
gauugugccacuguacaccagccugggugaca

SEQ ID NO: 165234 - RNA, 32 nt, Human
gauugugccacuguacuccagccuggaagaca

SEQ ID NO: 165235 - RNA, 32 nt, Human
gauugugccacuguacuccagccugggagaua

SEQ ID NO: 165236 - RNA, 32 nt, Human
gauugugccacuguacuccagccugggcgaca

SEQ ID NO: 165237 - RNA, 32 nt, Human
gauugugccacuguacuccagccugggugaca

SEQ ID NO: 165238 - RNA, 32 nt, Human
gauugugccacuguacuccagccuggugacag

SEQ ID NO: 165239 - RNA, 32 nt, Human
gauugugccacuguacugcagccugggugaca

SEQ ID NO: 165240 - RNA, 32 nt, Human
gauugugccacuguuuuccagccugggcaaua

SEQ ID NO: 165241 - RNA, 32 nt, Human
gauugugccacuucacuccagccugggugaca

SEQ ID NO: 165242 - RNA, 32 nt, Human
gauugugccacuucauuccagccugggcgaca

SEQ ID NO: 165243 - RNA, 32 nt, Human
gauugugccacuucccuccagccugggcaaua

SEQ ID NO: 165244 - RNA, 32 nt, Human
gauugugccagugcacuccggccugggugaca

SEQ ID NO: 165245 - RNA, 32 nt, Human
gauugugccauugcacuccaaccugggcaaca

SEQ ID NO: 165246 - RNA, 32 nt, Human
gauugugccauugcacuccagccuggacaaca

SEQ ID NO: 165247 - RNA, 32 nt, Human
gauugugccauugcacuccagccugggcaaca

SEQ ID NO: 165248 - RNA, 32 nt, Human
gauugugccauugcacuccagccugggcaacg

SEQ ID NO: 165249 - RNA, 32 nt, Human
gauugugccauugcacuccagccugggcgaca

SEQ ID NO: 165250 - RNA, 32 nt, Human
gauugugccauugcacuccagccugggcuaca

SEQ ID NO: 165251 - RNA, 32 nt, Human
gauugugccauugcacuccagccugggugaca

SEQ ID NO: 165252 - RNA, 32 nt, Human
gauugugccauugcacuccagccugggugaua

SEQ ID NO: 165253 - RNA, 32 nt, Human
gauugugccauugcacucuagccugggcaaca

SEQ ID NO: 165254 - RNA, 32 nt, Human
gauugugccauuguacuccagccugggcgaca

SEQ ID NO: 165255 - RNA, 32 nt, Human
gauugugccccugcauucuagccugggugaca

SEQ ID NO: 165256 - RNA, 32 nt, Human
gauugugccgcaaccaccucagccuggaugac

SEQ ID NO: 165257 - RNA, 32 nt, Human
gauugugccgcugcacuccagccuggcgacaa

SEQ ID NO: 165258 - RNA, 32 nt, Human
gauugugcuacugcacucuagauugggugaca

SEQ ID NO: 165259 - RNA, 32 nt, Human
gauugugcugcugcacuccagccugggagaca

SEQ ID NO: 165260 - RNA, 32 nt, Human
gauugugcugcugcacuccagccugggugaaa

SEQ ID NO: 165261 - RNA, 32 nt, Human
gauuguggcacugcacuccagucugggugaca

SEQ ID NO: 165262 - RNA, 32 nt, Human
gauuguggcauugcacuccagccuggguggua

SEQ ID NO: 165263 - RNA, 32 nt, Human
gauuguggccacugugacucucaccagcagug

SEQ ID NO: 165264 - RNA, 32 nt, Human
gauuguggccaugugacugaacuuuagacagu

SEQ ID NO: 165265 - RNA, 32 nt, Human
gauuguggccucuggcugccucaggcauuuuc

SEQ ID NO: 165266 - RNA, 32 nt, Human
gauugugggcagccuccugcccucucuggguc

SEQ ID NO: 165267 - RNA, 32 nt, Human
gauugugggguggucaggaggccggcugccuu

SEQ ID NO: 165268 - RNA, 32 nt, Human
gauugugguaauucgagccaucuggagaaugc

SEQ ID NO: 165269 - RNA, 32 nt, Human
gauugugguauagggauaucuugucuuauuuu

SEQ ID NO: 165270 - RNA, 32 nt, Human
gauuguggugggcccugaguccugguuuccug

SEQ ID NO: 165271 - RNA, 32 nt, Human
gauugugucaaaugauuccuggaauccuuuac

SEQ ID NO: 165272 - RNA, 32 nt, Human
gauugugucacugcacuccagccugggcaaca

SEQ ID NO: 165273 - RNA, 32 nt, Human
gauugugucacugcacuccagcuugggugaca

SEQ ID NO: 165274 - RNA, 32 nt, Human
gauugugucauugcacuccagccugggcaaca

SEQ ID NO: 165275 - RNA, 32 nt, Human
gauuguguccuaggaagacuuuucuuuuccuc

SEQ ID NO: 165276 - RNA, 32 nt, Human
gauuguguggguugugggaugagaugcagcaa

SEQ ID NO: 165277 - RNA, 32 nt, Human
gauuguguuaguugaucaagaucaaggguaaa

SEQ ID NO: 165278 - RNA, 32 nt, Human
gauuguguuccuucccuaugggauccaucugu

SEQ ID NO: 165279 - RNA, 32 nt, Human
gauuguguucuuccucucucaggggugauaac

SEQ ID NO: 165280 - RNA, 32 nt, Human
gauuguguuuauggacuuuucacacacuaauu

SEQ ID NO: 165281 - RNA, 32 nt, Human
gauuguuaaacauuuggggaaauaugaacugu

SEQ ID NO: 165282 - RNA, 32 nt, Human
gauuguuacugugucuguguagaaagaaguag

SEQ ID NO: 165283 - RNA, 32 nt, Human
gauuguucaccuuugcugcauuugggaguuau

SEQ ID NO: 165284 - RNA, 32 nt, Human
gauuguucaucuucccucucugggucuccaga

SEQ ID NO: 165285 - RNA, 32 nt, Human
gauuguuccacugucuggaagcaccauccccu

SEQ ID NO: 165286 - RNA, 32 nt, Human
gauuguucuguucaacuaauagagaaccuaca

SEQ ID NO: 165287 - RNA, 32 nt, Human
gauuguugcaccauuagaagcuagguugaucc

SEQ ID NO: 165288 - RNA, 32 nt, Human
gauuguuggagaaugccagcugcuagaaaccu

SEQ ID NO: 165289 - RNA, 32 nt, Human
gauuguuggcaggccagccugcagugacagug

SEQ ID NO: 165290 - RNA, 32 nt, Human
gauuguuggcauggggacagagcggacuaacu

SEQ ID NO: 165291 - RNA, 32 nt, Human
gauuguuguaucaguggugauccuguuaauau

SEQ ID NO: 165292 - RNA, 32 nt, Human
gauuguugucauugcuaccgugguagucaccu

SEQ ID NO: 165293 - RNA, 32 nt, Human
gauuguuucugagcuugagaagcuucuggagg

SEQ ID NO: 165294 - RNA, 32 nt, Human
gauuguuugccucuuuggaaacuguuauccuu

SEQ ID NO: 165295 - RNA, 32 nt, Human
gauuguuugguuuuuggguuuuucccuaagcc

SEQ ID NO: 165296 - RNA, 32 nt, Human
gauuguuuucagguuugccaccagagaugcaa

SEQ ID NO: 165297 - RNA, 32 nt, Human
gauuuaaaaaggauucuccuucaaugugccuu

SEQ ID NO: 165298 - RNA, 32 nt, Human
gauuuaaaaccagcucaggagacgccaaggaa

SEQ ID NO: 165299 - RNA, 32 nt, Human
gauuuaacccaaguaaugcagcuuugauugau

SEQ ID NO: 165300 - RNA, 32 nt, Human
gauuuaacuccccacaggcaauggguuuauag

SEQ ID NO: 165301 - RNA, 32 nt, Human
gauuuaaggaagcacagaaaacuguaauuccu

SEQ ID NO: 165302 - RNA, 32 nt, Human
gauuuaaggcugguuguaagggaucagucagu

SEQ ID NO: 165303 - RNA, 32 nt, Human
gauuuaagggaagaccuucacacagauuuuuc

SEQ ID NO: 165304 - RNA, 32 nt, Human
gauuuaaggggcuguaaaaggcaaguucaggg

SEQ ID NO: 165305 - RNA, 32 nt, Human
gauuuaauaacuacagguuucucuccaauggc

SEQ ID NO: 165306 - RNA, 32 nt, Human
gauuuacaaauauuucauauuccaaugcuucg

SEQ ID NO: 165307 - RNA, 32 nt, Human
gauuuacaacugggggagggugaagugaagac

SEQ ID NO: 165308 - RNA, 32 nt, Human
gauuuacacacgucuucaguuuuucagcacag

SEQ ID NO: 165309 - RNA, 32 nt, Human
gauuuacacuaauugugagcagucuucuuaug

SEQ ID NO: 165310 - RNA, 19 nt, Human
gauuuacagcugaauucua

SEQ ID NO: 165311 - RNA, 32 nt, Human
gauuuacaucuuaggaaauaacauguauacuc

SEQ ID NO: 165312 - RNA, 32 nt, Human
gauuuacauucaacucugaucccugggccuua

SEQ ID NO: 165313 - RNA, 32 nt, Human
gauuuaccaagugcuucaaugagagcaguccu

SEQ ID NO: 165314 - RNA, 32 nt, Human
gauuuaccaguguuuuuaacuuccugcugggc

SEQ ID NO: 165315 - RNA, 20 nt, Human
gauuuacccugcccuugaac

SEQ ID NO: 165316 - RNA, 32 nt, Human
gauuuacccuggcacgugugccacuugcccag

SEQ ID NO: 165317 - RNA, 32 nt, Human
gauuuacuaaacaaaagaaacucuccaccuag

SEQ ID NO: 165318 - RNA, 31 nt, Human
gauuuacuauauaaggaggucagagauggac

SEQ ID NO: 165319 - RNA, 32 nt, Human
gauuuacuggaaucuauuggugcugcugcaug

SEQ ID NO: 165320 - RNA, 32 nt, Human
gauuuacuuccaccaucaaaucuucaacuguu

SEQ ID NO: 165321 - RNA, 32 nt, Human
gauuuacuugagauggaguuugguucuguccc

SEQ ID NO: 165322 - RNA, 32 nt, Human
gauuuagaaaaugcuagagcugaugcauauac

SEQ ID NO: 165323 - RNA, 32 nt, Human
gauuuagaaacugccuugaaaucuuuuaaauu

SEQ ID NO: 165324 - RNA, 32 nt, Human
gauuuagaaguacucagucacuuuaaguggau

SEQ ID NO: 165325 - RNA, 32 nt, Human
gauuuagagugaaggcaccaacuuggaaaugu

SEQ ID NO: 165326 - RNA, 32 nt, Human
gauuuagaucucaagaaauagaaagaacuaca

SEQ ID NO: 165327 - RNA, 32 nt, Human
gauuuagcagagagaggaggcagaggcuggga

SEQ ID NO: 165328 - RNA, 32 nt, Human
gauuuaggaaaugagugugugcaccaaagaca

SEQ ID NO: 165329 - RNA, 32 nt, Human
gauuuaggagaucuuguuaccuccucaucuac

SEQ ID NO: 165330 - RNA, 32 nt, Human
gauuuaggucaugucugcacauucugguggca

SEQ ID NO: 165331 - RNA, 32 nt, Human
gauuuaggugcugcucugcugcucuggauggc

SEQ ID NO: 165332 - RNA, 32 nt, Human
gauuuagguugcaaauguuucaagcaugugca

SEQ ID NO: 165333 - RNA, 32 nt, Human
gauuuagguuuuaaaaugccuccuaauaucau

SEQ ID NO: 165334 - RNA, 32 nt, Human
gauuuagugggacaagcaaaugacagaauacc

SEQ ID NO: 165335 - RNA, 32 nt, Human
gauuuagugggugggaagaggcccugaugcug

SEQ ID NO: 165336 - RNA, 32 nt, Human
gauuuauacuccugacgugucucauucacagc

SEQ ID NO: 165337 - RNA, 32 nt, Human
gauuuaucaccacugccuaaagaaaagcagag

SEQ ID NO: 165338 - RNA, 32 nt, Human
gauuuauccauuaucucauaaacaucugaaca

SEQ ID NO: 165339 - RNA, 18 nt, Human
gauuuaucccauaugcua

SEQ ID NO: 165340 - RNA, 32 nt, Human
gauuuauccugaacucauggaccucagaucuc

SEQ ID NO: 165341 - RNA, 32 nt, Human
gauuuauccuguaauuucaugcagcuuugugg

SEQ ID NO: 165342 - RNA, 32 nt, Human
gauuuaucuggucccuucccaucccagagcuu

SEQ ID NO: 165343 - RNA, 30 nt, Human
gauuuaugacccuuuccccaucacugagag

SEQ ID NO: 165344 - RNA, 25 nt, Human
gauuuaugaucuucauuuauuuuaa

SEQ ID NO: 165345 - RNA, 32 nt, Human
gauuuaugcuucuguaacacuuuuacagaaau

SEQ ID NO: 165346 - RNA, 32 nt, Human
gauuuauggaaauacacuaaaugaguaauuca

SEQ ID NO: 165347 - RNA, 32 nt, Human
gauuuaugguaucagaugcacauuuuuaacac

SEQ ID NO: 165348 - RNA, 32 nt, Human
gauuuauguaguaauuucuucucagguaugga

SEQ ID NO: 165349 - RNA, 30 nt, Human
gauuuaugucacugcacuucucuacucuca

SEQ ID NO: 165350 - RNA, 32 nt, Human
gauuuauucauagcuuaccuaagaauuucaaa

SEQ ID NO: 165351 - RNA, 32 nt, Human
gauuuauuugaagauggagcacugcugauuua

SEQ ID NO: 165352 - RNA, 32 nt, Human
gauuuauuuuccccugcaugugagaagcaguu

SEQ ID NO: 165353 - RNA, 32 nt, Human
gauuucaaacauuuucguuuuguggaguggug

SEQ ID NO: 165354 - RNA, 32 nt, Human
gauuucaaaccuggagaccucaucuucgccaa

SEQ ID NO: 165355 - RNA, 32 nt, Human
gauuucaaagaaaggaaggaaggaaggacaac

SEQ ID NO: 165356 - RNA, 32 nt, Human
gauuucaacacugagggccuggagaccucggc

SEQ ID NO: 165357 - RNA, 32 nt, Human
gauuucaagguacaaacgucucaccuuuuuac

SEQ ID NO: 165358 - RNA, 32 nt, Human
gauuucaagguacaaacuucucaccuuuauau

SEQ ID NO: 165359 - RNA, 32 nt, Human
gauuucaagguacaaacuucucaccuuuuuac

SEQ ID NO: 165360 - RNA, 32 nt, Human
gauuucaauguagcugucuccucuucaaauaa

SEQ ID NO: 165361 - RNA, 32 nt, Human
gauuucaccaccacuccagccugggugagaaa

SEQ ID NO: 165362 - RNA, 32 nt, Human
gauuucaccacugcauucuagccugggcaaca

SEQ ID NO: 165363 - RNA, 32 nt, Human
gauuucaccagugcacuccagccugggugaca

SEQ ID NO: 165364 - RNA, 32 nt, Human
gauuucaccauguugcccaggcuggucucgaa

SEQ ID NO: 165365 - RNA, 32 nt, Human
gauuucaccauguuggccaggcuggucucaaa

SEQ ID NO: 165366 - RNA, 32 nt, Human
gauuucaccauguuggccaggcuggucucgaa

SEQ ID NO: 165367 - RNA, 32 nt, Human
gauuucaccauguuggccaggcuggucuugaa

SEQ ID NO: 165368 - RNA, 32 nt, Human
gauuucaccauguuggccgggcuggucucaaa

SEQ ID NO: 165369 - RNA, 32 nt, Human
gauuucaccauguuggcuaggcuggucuugaa

SEQ ID NO: 165370 - RNA, 32 nt, Human
gauuucacccccgcgacuaucuccccaaaacg

SEQ ID NO: 165371 - RNA, 32 nt, Human
gauuucacuuugaauuguuugcuuaagaucac

SEQ ID NO: 165372 - RNA, 32 nt, Human
gauuucagacacauucuguuucuucauaaaaa

SEQ ID NO: 165373 - RNA, 32 nt, Human
gauuucagaugccccugcccucuugucugcca

SEQ ID NO: 165374 - RNA, 32 nt, Human
gauuucagauucccuuucaaucaugcccguuu

SEQ ID NO: 165375 - RNA, 32 nt, Human
gauuucagcucacuacaaccuccugcuccugg

SEQ ID NO: 165376 - RNA, 32 nt, Human
gauuucagcuggagccgccaggccaggccgcc

SEQ ID NO: 165377 - RNA, 32 nt, Human
gauuucaggaucagucaggaccugccaauguc

SEQ ID NO: 165378 - RNA, 32 nt, Human
gauuucaggcagcaggggcugcugugaugccg

SEQ ID NO: 165379 - RNA, 20 nt, Human
gauuucagggagcuggcuga

SEQ ID NO: 165380 - RNA, 24 nt, Human
gauuucagggugucuuccaacuga

SEQ ID NO: 165381 - RNA, 24 nt, Human
gauuucaggguguuuucuaacuga

SEQ ID NO: 165382 - RNA, 32 nt, Human
gauuucauaaauguaaaaugcacagaaaugca

SEQ ID NO: 165383 - RNA, 32 nt, Human
gauuucauacucgauagugucauuucaggauc

SEQ ID NO: 165384 - RNA, 32 nt, Human
gauuucauaugcaugaaacccaagcaaauuau

SEQ ID NO: 165385 - RNA, 32 nt, Human
gauuucaucacacuacucagaaaggcaugcag

SEQ ID NO: 165386 - RNA, 32 nt, Human
gauuucaucauguugcccaggcuggucuugaa

SEQ ID NO: 165387 - RNA, 32 nt, Human
gauuucaucauguuggccaggcuggucucgaa

SEQ ID NO: 165388 - RNA, 32 nt, Human
gauuucaucauguuggcuaggcuggucuugaa

SEQ ID NO: 165389 - RNA, 32 nt, Human
gauuucaucuuccuaaacuggaaaugucaaug

SEQ ID NO: 165390 - RNA, 32 nt, Human
gauuucauguacacaguauucacuugucuccc

SEQ ID NO: 165391 - RNA, 23 nt, Human
gauuucauguguuuccauuauuu

SEQ ID NO: 165392 - RNA, 24 nt, Human
gauuucauugauuuuacuaacugg

SEQ ID NO: 165393 - RNA, 32 nt, Human
gauuucauuuucaauaaauguagguuuguuac

SEQ ID NO: 165394 - RNA, 32 nt, Human
gauuuccacagcugccuccugucucagaaauc

SEQ ID NO: 165395 - RNA, 32 nt, Human
gauuuccagaggaaagcuagaggaucuaguuc

SEQ ID NO: 165396 - RNA, 32 nt, Human
gauuuccagccaaagccuccuccagccgccau

SEQ ID NO: 165397 - RNA, 32 nt, Human
gauuuccaggacugcccucuccagaaaaacag

SEQ ID NO: 165398 - RNA, 32 nt, Human
gauuuccaggagcugcaagggcagugagagga

SEQ ID NO: 165399 - RNA, 32 nt, Human
gauuucccaagugcauccucagaagcucuggg

SEQ ID NO: 165400 - RNA, 28 nt, Human
gauuucccaagugcccacucuccuuugu

SEQ ID NO: 165401 - RNA, 28 nt, Human
gauuucccaagugcuuuaccuuaucugu

SEQ ID NO: 165402 - RNA, 32 nt, Human
gauuucccacugcacuccagccugagugacag

SEQ ID NO: 165403 - RNA, 32 nt, Human
gauuucccauuuuaaagaagaaguggaucuaa

SEQ ID NO: 165404 - RNA, 24 nt, Human
gauuucccuaauuaguggugugug

SEQ ID NO: 165405 - RNA, 22 nt, Human
gauuucccuaguaaccuugcag

SEQ ID NO: 165406 - RNA, 32 nt, Human
gauuucccuucauuuaaacuaaauuacuguuu

SEQ ID NO: 165407 - RNA, 32 nt, Human
gauuuccucaaagacaacaacuaccugcccua

SEQ ID NO: 165408 - RNA, 32 nt, Human
gauuuccucugccucucucuuugcugagcuuu

SEQ ID NO: 165409 - RNA, 32 nt, Human
gauuuccuguuucauguagaauaguguuuguc

SEQ ID NO: 165410 - RNA, 32 nt, Human
gauuuccuuccccugcuccaucagccagacaa

SEQ ID NO: 165411 - RNA, 32 nt, Human
gauuuccuuguuauuauucaugauauuuagaa

SEQ ID NO: 165412 - RNA, 32 nt, Human
gauuucgccauguugcccaggcuggucucgaa

SEQ ID NO: 165413 - RNA, 32 nt, Human
gauuucgccauguuggccaggcuggucucgaa

SEQ ID NO: 165414 - RNA, 32 nt, Human
gauuucgccguguuggccaggcuggucucgaa

SEQ ID NO: 165415 - RNA, 32 nt, Human
gauuucgcuaccguacaacucugacaagggaa

SEQ ID NO: 165416 - RNA, 32 nt, Human
gauuucgcuucauaccauugccaagcaagaga

SEQ ID NO: 165417 - RNA, 32 nt, Human
gauuucguacuacugcuggggcugccaccucc

SEQ ID NO: 165418 - RNA, 32 nt, Human
gauuucuacuacccucucagucaccauguugc

SEQ ID NO: 165419 - RNA, 32 nt, Human
gauuucuauaaucacucgaugugauacaguau

SEQ ID NO: 165420 - RNA, 32 nt, Human
gauuucucaaugcuaacuaaucaagagaagua

SEQ ID NO: 165421 - RNA, 32 nt, Human
gauuucucaggaagacagcagagcagaggaau

SEQ ID NO: 165422 - RNA, 32 nt, Human
gauuucuccauguugaucaggcuggucaugaa

SEQ ID NO: 165423 - RNA, 32 nt, Human
gauuucucuccucgguccugaucaagguguua

SEQ ID NO: 165424 - RNA, 32 nt, Human
gauuucucugugagaaauguaaugcugacuuu

SEQ ID NO: 165425 - RNA, 32 nt, Human
gauuucucuucucuccacaccagaccucguuc

SEQ ID NO: 165426 - RNA, 32 nt, Human
gauuucugauaccuugucauuugggggauuuu

SEQ ID NO: 165427 - RNA, 32 nt, Human
gauuucugcacuaucuuuuucucaguuaccug

SEQ ID NO: 165428 - RNA, 21 nt, Human
gauuucugcauuuccaacuga

SEQ ID NO: 165429 - RNA, 32 nt, Human
gauuucugcuuuaaggaaaacugugaacuuuc

SEQ ID NO: 165430 - RNA, 32 nt, Human
gauuucuggaaggagaaaaaguguagguauuu

SEQ ID NO: 165431 - RNA, 31 nt, Human
gauuucuggacaaucucggcugcagacaucu

SEQ ID NO: 165432 - RNA, 29 nt, Human
gauuucuggcugcugucaccuccuugcuc

SEQ ID NO: 165433 - RNA, 32 nt, Human
gauuucugugcagaaccaaggacucagugcuu

SEQ ID NO: 165434 - RNA, 32 nt, Human
gauuucugugccagucaucugaccugauucuu

SEQ ID NO: 165435 - RNA, 32 nt, Human
gauuucuuagaaaugcugcucucucuauuuaa

SEQ ID NO: 165436 - RNA, 32 nt, Human
gauuucuuaguucucacagaacuucuaucauu

SEQ ID NO: 165437 - RNA, 32 nt, Human
gauuucuuauuuaaaaucagaauggaguuugc

SEQ ID NO: 165438 - RNA, 32 nt, Human
gauuucuucucagcuuucuccaccuuucaguu

SEQ ID NO: 165439 - RNA, 32 nt, Human
gauuucuucuccccugcuguuuccugcccauc

SEQ ID NO: 165440 - RNA, 32 nt, Human
gauuucuuggacuagugcaucucccuguauau

SEQ ID NO: 165441 - RNA, 32 nt, Human
gauuucuuugccaaguuaaugcacugaugacc

SEQ ID NO: 165442 - RNA, 19 nt, Human
gauuucuuuuccuggugga

SEQ ID NO: 165443 - RNA, 32 nt, Human
gauuugaacagcacauaugcucugguuugcuc

SEQ ID NO: 165444 - RNA, 32 nt, Human
gauuugaagaagagaagagagccucacaucuc

SEQ ID NO: 165445 - RNA, 32 nt, Human
gauuugaagaagaugacaggagauggagaagc

SEQ ID NO: 165446 - RNA, 32 nt, Human
gauuugaagccagucaucucagcacugucuga

SEQ ID NO: 165447 - RNA, 32 nt, Human
gauuugaauuuauaaagaaccugccuuccuuc

SEQ ID NO: 165448 - RNA, 32 nt, Human
gauuugaccucauuugcauugccaccaaggcc

SEQ ID NO: 165449 - RNA, 32 nt, Human
gauuugaccugcaccugucagucagguaagcg

SEQ ID NO: 165450 - RNA, 32 nt, Human
gauuugacuaaaucugccccgaggagggugaa

SEQ ID NO: 165451 - RNA, 32 nt, Human
gauuugacucaaagaggaaggauggaaaacau

SEQ ID NO: 165452 - RNA, 32 nt, Human
gauuugacuggaccuuuuacaggaagcuagag

SEQ ID NO: 165453 - RNA, 32 nt, Human
gauuugaggaacagcagaaaaaugauguggaa

SEQ ID NO: 165454 - RNA, 32 nt, Human
gauuugaggaacaguaaccaggaugugaauga

SEQ ID NO: 165455 - RNA, 32 nt, Human
gauuugaggccaggcguggaggcucacaccua

SEQ ID NO: 165456 - RNA, 32 nt, Human
gauuugagguuucccccugucuccuuauucgg

SEQ ID NO: 165457 - RNA, 32 nt, Human
gauuugaugaggaacuuaggagagaggaguuu

SEQ ID NO: 165458 - RNA, 32 nt, Human
gauuugaugccauggcaaaccucacugacuua

SEQ ID NO: 165459 - RNA, 32 nt, Human
gauuugauggacacugcaccagcuuccuucag

SEQ ID NO: 165460 - RNA, 32 nt, Human
gauuugauucgcccuccucccugucauagagc

SEQ ID NO: 165461 - RNA, 32 nt, Human
gauuugauugagucaccuugaaugacauaaca

SEQ ID NO: 165462 - RNA, 32 nt, Human
gauuugcacagucggcugggcggugcaauggc

SEQ ID NO: 165463 - RNA, 32 nt, Human
gauuugcacccacugcauuugcagccuugagg

SEQ ID NO: 165464 - RNA, 32 nt, Human
gauuugcaccgcuguacuccagccugggcaac

SEQ ID NO: 165465 - RNA, 22 nt, Human
gauuugcacuuuucuauccuca

SEQ ID NO: 165466 - RNA, 32 nt, Human
gauuugcagaguccaugaaacaggaacacucc

SEQ ID NO: 165467 - RNA, 32 nt, Human
gauuugcagggcaguggcauggagccccucuu

SEQ ID NO: 165468 - RNA, 32 nt, Human
gauuugcaggggauggggccuuuuccagggaa

SEQ ID NO: 165469 - RNA, 32 nt, Human
gauuugcauacauucuucaagaucccauuuga

SEQ ID NO: 165470 - RNA, 32 nt, Human
gauuugcaugugugaagccuuaaaccaaaacu

SEQ ID NO: 165471 - RNA, 31 nt, Human
gauuugccaguaggaacugagauucaacguc

SEQ ID NO: 165472 - RNA, 32 nt, Human
gauuugcccaaagcagccugacagcaaggggc

SEQ ID NO: 165473 - RNA, 32 nt, Human
gauuugcccccucugguagauaccagaacuau

SEQ ID NO: 165474 - RNA, 32 nt, Human
gauuugccgacagccuugcaggcugggcucag

SEQ ID NO: 165475 - RNA, 32 nt, Human
gauuugccucaaggccucuucaguauaaggaa

SEQ ID NO: 165476 - RNA, 32 nt, Human
gauuugccugugggagguaugggcaggagagg

SEQ ID NO: 165477 - RNA, 32 nt, Human
gauuugcuauucuguuccauuggucuacauga

SEQ ID NO: 165478 - RNA, 32 nt, Human
gauuugcuccacccucgagggcagccagacag

SEQ ID NO: 165479 - RNA, 18 nt, Human
gauuugcuccucugcaca

SEQ ID NO: 165480 - RNA, 32 nt, Human
gauuugcugcagcugugaagccauggccgugu

SEQ ID NO: 165481 - RNA, 32 nt, Human
gauuugcugccuccacacugucagcuccuugg

SEQ ID NO: 165482 - RNA, 32 nt, Human
gauuugcugcuggcucaguuuguugugauucu

SEQ ID NO: 165483 - RNA, 32 nt, Human
gauuugcugcuuauuaaaccuccuucuggacc

SEQ ID NO: 165484 - RNA, 32 nt, Human
gauuugcugggagugguagguggacauaucua

SEQ ID NO: 165485 - RNA, 32 nt, Human
gauuugcuuucuccauuagagcauuaagcuaa

SEQ ID NO: 165486 - RNA, 32 nt, Human
gauuugcuuuggugaaggacacgugucuucua

SEQ ID NO: 165487 - RNA, 32 nt, Human
gauuuggaacuccauuccaccugacccugugu

SEQ ID NO: 165488 - RNA, 32 nt, Human
gauuuggaagacaaagaaggagagauucaagc

SEQ ID NO: 165489 - RNA, 32 nt, Human
gauuuggaagccauuuggggaggcaggcuggg

SEQ ID NO: 165490 - RNA, 32 nt, Human
gauuuggagacaggagucaggccaggucugaa

SEQ ID NO: 165491 - RNA, 32 nt, Human
gauuuggagaccugggcuugaguuccagcuga

SEQ ID NO: 165492 - RNA, 32 nt, Human
gauuuggauaccuucaagacaccugaaccuua

SEQ ID NO: 165493 - RNA, 32 nt, Human
gauuuggcaugcuggaggcucuagggaaagcc

SEQ ID NO: 165494 - RNA, 32 nt, Human
gauuuggccauguugcccaggcuggucucgaa

SEQ ID NO: 165495 - RNA, 32 nt, Human
gauuuggcccugggaagcagcccagcguaccc

SEQ ID NO: 165496 - RNA, 32 nt, Human
gauuuggccuccccucucccccaugcuaauua

SEQ ID NO: 165497 - RNA, 32 nt, Human
gauuuggcuagaaggcugggccggcagcgguu

SEQ ID NO: 165498 - RNA, 32 nt, Human
gauuugggaagaacaaagaggccaggccccuc

SEQ ID NO: 165499 - RNA, 32 nt, Human
gauuugggaccuucauaucagcacuuuggacc

SEQ ID NO: 165500 - RNA, 32 nt, Human
gauuugggcaccugacuguccaguuuaccuua

SEQ ID NO: 165501 - RNA, 32 nt, Human
gauuuggggagcuguggagggugcaggaggaa

SEQ ID NO: 165502 - RNA, 32 nt, Human
gauuuggggagugguuaauugaaauagucaau

SEQ ID NO: 165503 - RNA, 32 nt, Human
gauuuggggcucagaaggcccugcucucuccc

SEQ ID NO: 165504 - RNA, 32 nt, Human
gauuugggugagacacuuuuccuugcugacuc

SEQ ID NO: 165505 - RNA, 32 nt, Human
gauuugggugagcuugaugcccagggaacaac

SEQ ID NO: 165506 - RNA, 32 nt, Human
gauuuggguguguugggaugaggcggagugcc

SEQ ID NO: 165507 - RNA, 32 nt, Human
gauuuggguucugccuguggcuauuugcuaca

SEQ ID NO: 165508 - RNA, 32 nt, Human
gauuugguagcccugggcaagagccuggaagc

SEQ ID NO: 165509 - RNA, 32 nt, Human
gauuuggucagaauuugaggccaguuuccuag

SEQ ID NO: 165510 - RNA, 32 nt, Human
gauuuggucagccuggcuuuugucgugguggc

SEQ ID NO: 165511 - RNA, 32 nt, Human
gauuuggugugugaaagguuccaagaaucagu

SEQ ID NO: 165512 - RNA, 32 nt, Human
gauuugguuucugagucuguggaggcaccgac

SEQ ID NO: 165513 - RNA, 32 nt, Human
gauuuguagguguggagggcuucaucaccggc

SEQ ID NO: 165514 - RNA, 32 nt, Human
gauuuguaguaucagcuuguugagcaaugacu

SEQ ID NO: 165515 - RNA, 32 nt, Human
gauuuguauauuuucgcuuucuccucaaguaa

SEQ ID NO: 165516 - RNA, 32 nt, Human
gauuuguaucucugugcuugaacuugaauggc

SEQ ID NO: 165517 - RNA, 32 nt, Human
gauuuguauucaaaauaaacauaguuuucaca

SEQ ID NO: 165518 - RNA, 32 nt, Human
gauuugucaaggauagaguacaguuguagggg

SEQ ID NO: 165519 - RNA, 32 nt, Human
gauuugucuuuuccucaccaccuucccuccaa

SEQ ID NO: 165520 - RNA, 32 nt, Human
gauuugugaauaucaucaucuuugccagacaa

SEQ ID NO: 165521 - RNA, 32 nt, Human
gauuuguggcccuuccccagaggaauugugga

SEQ ID NO: 165522 - RNA, 32 nt, Human
gauuugugugcaaaggaaaaucgugguugagu

SEQ ID NO: 165523 - RNA, 32 nt, Human
gauuugugugugguccaagaucauugcaguuu

SEQ ID NO: 165524 - RNA, 32 nt, Human
gauuugugugugugaaggacauaccacguuua

SEQ ID NO: 165525 - RNA, 32 nt, Human
gauuuguguuaugaaagauugagaaacuaaau

SEQ ID NO: 165526 - RNA, 32 nt, Human
gauuuguuaauuuccaugggaagccaugaugg

SEQ ID NO: 165527 - RNA, 32 nt, Human
gauuuguuagauugucaguuggaagggguuua

SEQ ID NO: 165528 - RNA, 19 nt, Human
gauuuguucuccuggugga

SEQ ID NO: 165529 - RNA, 22 nt, Human
gauuuguugauuuugcauuuga

SEQ ID NO: 165530 - RNA, 32 nt, Human
gauuuguuuaagaagaaaaaugaaaccagacc

SEQ ID NO: 165531 - RNA, 32 nt, Human
gauuuguuuugguagcuauuucacugaaggaa

SEQ ID NO: 165532 - RNA, 32 nt, Human
gauuuguuuuucuguucucuucuguccugucu

SEQ ID NO: 165533 - RNA, 32 nt, Human
gauuuuaaauagauuuccuuuuguaaaucaau

SEQ ID NO: 165534 - RNA, 32 nt, Human
gauuuuaacaaaagcaagacuguugcucaaau

SEQ ID NO: 165535 - RNA, 32 nt, Human
gauuuuaacacaugcuaauaaaagccaagaaa

SEQ ID NO: 165536 - RNA, 32 nt, Human
gauuuuaacauguuuuucugaaugaccagaug

SEQ ID NO: 165537 - RNA, 32 nt, Human
gauuuuaagauagaacaggcugguucugaguu

SEQ ID NO: 165538 - RNA, 32 nt, Human
gauuuuaagcuaccaacugugaugucacugaa

SEQ ID NO: 165539 - RNA, 32 nt, Human
gauuuuaagcucaaaaaggcaacagugguguc

SEQ ID NO: 165540 - RNA, 32 nt, Human
gauuuuaaguuggaacaguauuuucccauuga

SEQ ID NO: 165541 - RNA, 32 nt, Human
gauuuuaaugauucugagcacaugguuucugc

SEQ ID NO: 165542 - RNA, 32 nt, Human
gauuuuaaugcuuggcauagguggugaggggu

SEQ ID NO: 165543 - RNA, 18 nt, Human
gauuuuacagucaucuua

SEQ ID NO: 165544 - RNA, 32 nt, Human
gauuuuaccacugcacuccagcuugggcgacg

SEQ ID NO: 165545 - RNA, 32 nt, Human
gauuuuaccaugggauauuccauuuuagaaca

SEQ ID NO: 165546 - RNA, 32 nt, Human
gauuuuaccauguuggccaggcuggucucgaa

SEQ ID NO: 165547 - RNA, 32 nt, Human
gauuuuacuaugucgcccagacuggucucaaa

SEQ ID NO: 165548 - RNA, 32 nt, Human
gauuuuagcaggaagagacaggcaaggaaagg

SEQ ID NO: 165549 - RNA, 32 nt, Human
gauuuuaguuacagcugugauuuggaagggaa

SEQ ID NO: 165550 - RNA, 32 nt, Human
gauuuuauauccaccuaccuauucaucuaccu

SEQ ID NO: 165551 - RNA, 32 nt, Human
gauuuuauauuugacaauaaaguguuagacuc

SEQ ID NO: 165552 - RNA, 32 nt, Human
gauuuuaucauguuggccaggcuggucucgaa

SEQ ID NO: 165553 - RNA, 32 nt, Human
gauuuuaugcugcuguuuacaaaagcccaaug

SEQ ID NO: 165554 - RNA, 32 nt, Human
gauuuuaugugagagaaaaguuggaugcucac

SEQ ID NO: 165555 - RNA, 32 nt, Human
gauuuucacuucccacugagguugucauaaca

SEQ ID NO: 165556 - RNA, 32 nt, Human
gauuuucagauggggaaaugggggcucagaga

SEQ ID NO: 165557 - RNA, 32 nt, Human
gauuuucaguccagcacauacagucccagugc

SEQ ID NO: 165558 - RNA, 32 nt, Human
gauuuucaucccucgcacaaggacuacggguu

SEQ ID NO: 165559 - RNA, 32 nt, Human
gauuuucauggaggccaggacagagaguggua

SEQ ID NO: 165560 - RNA, 32 nt, Human
gauuuucauuuggggagaaugagggagaaaag

SEQ ID NO: 165561 - RNA, 32 nt, Human
gauuuuccaaaggaggugaccugugucucuca

SEQ ID NO: 165562 - RNA, 32 nt, Human
gauuuuccaauaaacugcuaucacaaugucaa

SEQ ID NO: 165563 - RNA, 19 nt, Human
gauuuucccuagaggccaa

SEQ ID NO: 165564 - RNA, 32 nt, Human
gauuuucccuuauggcuuucagaaggaaccaa

SEQ ID NO: 165565 - RNA, 32 nt, Human
gauuuuccucuacgugcuucagucuucucuac

SEQ ID NO: 165566 - RNA, 32 nt, Human
gauuuuccugguggugguauccaaaaucuuca

SEQ ID NO: 165567 - RNA, 32 nt, Human
gauuuuccuuuaauuucucuggaguaauacug

SEQ ID NO: 165568 - RNA, 32 nt, Human
gauuuucgggcugagaaggcaguaguuuucaa

SEQ ID NO: 165569 - RNA, 32 nt, Human
gauuuucuaaguggcuggcaccagagauaacu

SEQ ID NO: 165570 - RNA, 32 nt, Human
gauuuucuaggugaauuccugaugaauaccag

SEQ ID NO: 165571 - RNA, 32 nt, Human
gauuuucucaagauguagggugugugaauucu

SEQ ID NO: 165572 - RNA, 32 nt, Human
gauuuucucccaggagaggcuggaguguccaa

SEQ ID NO: 165573 - RNA, 32 nt, Human
gauuuucucuaauguaacuuccucuuaggaug

SEQ ID NO: 165574 - RNA, 32 nt, Human
gauuuucugggagcaaacuggucugccuuuac

SEQ ID NO: 165575 - RNA, 32 nt, Human
gauuuucugggagcuaucuugucuaccuugag

SEQ ID NO: 165576 - RNA, 32 nt, Human
gauuuucugugauaccaaaaucucagcuucac

SEQ ID NO: 165577 - RNA, 32 nt, Human
gauuuucuucuuuuucccccuguaggacugac

SEQ ID NO: 165578 - RNA, 32 nt, Human
gauuuugaaaaaugucuuuuccagcuuuuagu

SEQ ID NO: 165579 - RNA, 32 nt, Human
gauuuugaaaguacauaauauuuuauacuuug

SEQ ID NO: 165580 - RNA, 32 nt, Human
gauuuugaacagcuccgcaggugaaugaaagg

SEQ ID NO: 165581 - RNA, 32 nt, Human
gauuuugaauuuaggcugggugcaguggcuca

SEQ ID NO: 165582 - RNA, 32 nt, Human
gauuuugagauggggagauuaucugggagagc

SEQ ID NO: 165583 - RNA, 25 nt, Human
gauuuugagccucauauuucuuuga

SEQ ID NO: 165584 - RNA, 32 nt, Human
gauuuugaggaaaaggaggaucagaaguucaa

SEQ ID NO: 165585 - RNA, 32 nt, Human
gauuuugaugauagccacaaagcaagcagggu

SEQ ID NO: 165586 - RNA, 32 nt, Human
gauuuugcaacugcacuccagccugggcuaca

SEQ ID NO: 165587 - RNA, 32 nt, Human
gauuuugcagcgcuucaguguacguguuagag

SEQ ID NO: 165588 - RNA, 32 nt, Human
gauuuugcagggaaaguucuguuucuucuuug

SEQ ID NO: 165589 - RNA, 32 nt, Human
gauuuugccacugcacuccugccugggugaca

SEQ ID NO: 165590 - RNA, 32 nt, Human
gauuuugccagccuggugggugugaaguggau

SEQ ID NO: 165591 - RNA, 32 nt, Human
gauuuugccauguugcccaggcuggucucgaa

SEQ ID NO: 165592 - RNA, 32 nt, Human
gauuuugccauguuggccaggcuggucucgaa

SEQ ID NO: 165593 - RNA, 32 nt, Human
gauuuugccuuucuuuuggaaggaaggaggcg

SEQ ID NO: 165594 - RNA, 32 nt, Human
gauuuugcuguacuggguacuuccuuucccau

SEQ ID NO: 165595 - RNA, 32 nt, Human
gauuuugcuucucccuagugcugguauacuau

SEQ ID NO: 165596 - RNA, 32 nt, Human
gauuuuggauaaacugaccugauuuucuguua

SEQ ID NO: 165597 - RNA, 22 nt, Human
gauuuuggccaaauuacuuuaa

SEQ ID NO: 165598 - RNA, 32 nt, Human
gauuuuggcgucucacccucccuccucccgua

SEQ ID NO: 165599 - RNA, 32 nt, Human
gauuuugggaauugggaggcaaguuugauuau

SEQ ID NO: 165600 - RNA, 32 nt, Human
gauuuugggacuguucugucucauguuuaucu

SEQ ID NO: 165601 - RNA, 32 nt, Human
gauuuuggggagaagagaaucaccagcuuuau

SEQ ID NO: 165602 - RNA, 32 nt, Human
gauuuugggggagagagcagggaguggcucag

SEQ ID NO: 165603 - RNA, 32 nt, Human
gauuuuggugggaggaggagaaaacaauuguu

SEQ ID NO: 165604 - RNA, 32 nt, Human
gauuuugguuucuuuuggcuuucccuugccuu

SEQ ID NO: 165605 - RNA, 32 nt, Human
gauuuuguacauaguccucuggucuaucucau

SEQ ID NO: 165606 - RNA, 32 nt, Human
gauuuuguaguguugaaaucauagcuacuuac

SEQ ID NO: 165607 - RNA, 32 nt, Human
gauuuuguggccuggguuuuguugcauaccac

SEQ ID NO: 165608 - RNA, 32 nt, Human
gauuuuguuuggagccucagcaugccggggcc

SEQ ID NO: 165609 - RNA, 32 nt, Human
gauuuuguuuuagcuguaacagguaaugguuu

SEQ ID NO: 165610 - RNA, 32 nt, Human
gauuuuuaaaaaguaagagaguuucagagaag

SEQ ID NO: 165611 - RNA, 32 nt, Human
gauuuuuaccaucuggauacagccugguguaa

SEQ ID NO: 165612 - RNA, 32 nt, Human
gauuuuuacccaggccagugcagagagguguu

SEQ ID NO: 165613 - RNA, 32 nt, Human
gauuuuuacugauuguccuggaugaauagacu

SEQ ID NO: 165614 - RNA, 32 nt, Human
gauuuuuagccccugaucuacaaauguacauu

SEQ ID NO: 165615 - RNA, 32 nt, Human
gauuuuuagcugaaccaacaaggaggcuuuga

SEQ ID NO: 165616 - RNA, 32 nt, Human
gauuuuuauaaacccucuccagccucucccaa

SEQ ID NO: 165617 - RNA, 32 nt, Human
gauuuuuaucucucucaacuuccugcacuuaa

SEQ ID NO: 165618 - RNA, 32 nt, Human
gauuuuuaucuguuuacaaucaugucacacug

SEQ ID NO: 165619 - RNA, 32 nt, Human
gauuuuuaucuucucaccauuuuaccucuuuu

SEQ ID NO: 165620 - RNA, 32 nt, Human
gauuuuucaaagaauucuugcuggugagaaac

SEQ ID NO: 165621 - RNA, 32 nt, Human
gauuuuucaaauaucacugucauuucuauuuu

SEQ ID NO: 165622 - RNA, 32 nt, Human
gauuuuucaggaguucaagcgacaauggcagc

SEQ ID NO: 165623 - RNA, 32 nt, Human
gauuuuucauucugccacuccaucuucaaacc

SEQ ID NO: 165624 - RNA, 32 nt, Human
gauuuuucccagagaaagcuggucaggcccuc

SEQ ID NO: 165625 - RNA, 32 nt, Human
gauuuuuccucuucuguuccagcccucucuug

SEQ ID NO: 165626 - RNA, 32 nt, Human
gauuuuucuccucugucccgaggucgucgucu

SEQ ID NO: 165627 - RNA, 32 nt, Human
gauuuuugacaaacaguggcugcucugcugac

SEQ ID NO: 165628 - RNA, 32 nt, Human
gauuuuugagaacugauagugcaucagccgac

SEQ ID NO: 165629 - RNA, 32 nt, Human
gauuuuugagcagcaccugaagagccugaagc

SEQ ID NO: 165630 - RNA, 32 nt, Human
gauuuuuggacaaauucaauguuuuaauugaa

SEQ ID NO: 165631 - RNA, 32 nt, Human
gauuuuugggcccugaacgcgggcaugcuggu

SEQ ID NO: 165632 - RNA, 32 nt, Human
gauuuuugugcacucugcucuaaaacagauau

SEQ ID NO: 165633 - RNA, 32 nt, Human
gauuuuuguggucaacaaccaggaggagcuug

SEQ ID NO: 165634 - RNA, 32 nt, Human
gauuuuuguuauucuagcucaacuuacugaag

SEQ ID NO: 165635 - RNA, 32 nt, Human
gcaaaaacacagcagaaucaaugaguaaauuu

SEQ ID NO: 165636 - RNA, 17 nt, Human
gcaaaaacagaagcaaa

SEQ ID NO: 165637 - RNA, 21 nt, Human
gcaaaaacagucaaaaaaccc

SEQ ID NO: 165638 - RNA, 32 nt, Human
gcaaaaacauaaaacaaauaaaacuuccccca

SEQ ID NO: 165639 - RNA, 32 nt, Human
gcaaaaaccaccucauacacacacaauucagu

SEQ ID NO: 165640 - RNA, 32 nt, Human
gcaaaaagaaaugacuccuuuccuucaccucc

SEQ ID NO: 165641 - RNA, 32 nt, Human
gcaaaaagaaauucacugucuuuuaauaguga

SEQ ID NO: 165642 - RNA, 19 nt, Human
gcaaaaagaacaugcuucc

SEQ ID NO: 165643 - RNA, 22 nt, Human
gcaaaaagaagagugagaguga

SEQ ID NO: 165644 - RNA, 32 nt, Human
gcaaaaagaggaggaggaagaggagcucaggg

SEQ ID NO: 165645 - RNA, 32 nt, Human
gcaaaaagccagguuuuggggaugugucuuac

SEQ ID NO: 165646 - RNA, 32 nt, Human
gcaaaaagcugcagagaggauucggcccaaac

SEQ ID NO: 165647 - RNA, 22 nt, Human
gcaaaaaggaagagugggagga

SEQ ID NO: 165648 - RNA, 32 nt, Human
gcaaaaagucuacauacuuucauccugacucu

SEQ ID NO: 165649 - RNA, 32 nt, Human
gcaaaaagucugcaaaccccagggucaagccu

SEQ ID NO: 165650 - RNA, 32 nt, Human
gcaaaaagucugccaagugggaauguuuaaua

SEQ ID NO: 165651 - RNA, 32 nt, Human
gcaaaaaucagugguugcuaggggcuggaaug

SEQ ID NO: 165652 - RNA, 32 nt, Human
gcaaaaaugcagcauuccgcuuuuaacuaucu

SEQ ID NO: 165653 - RNA, 32 nt, Human
gcaaaaauguuuaaaaugcuuaucucuaagau

SEQ ID NO: 165654 - RNA, 20 nt, Human
gcaaaaauucugacguucuc

SEQ ID NO: 165655 - RNA, 32 nt, Human
gcaaaacaauuaagcacacaacuucuucuaua

SEQ ID NO: 165656 - RNA, 32 nt, Human
gcaaaacaccuaaaaugucaacagucaaaaug

SEQ ID NO: 165657 - RNA, 32 nt, Human
gcaaaacaggaaaguuuccagauagguauugu

SEQ ID NO: 165658 - RNA, 32 nt, Human
gcaaaacauccuuccuugaagccuagcacuga

SEQ ID NO: 165659 - RNA, 32 nt, Human
gcaaaacaucuccaaagaagucuuuuggaaca

SEQ ID NO: 165660 - RNA, 32 nt, Human
gcaaaaccauacuuagucaucaccaacaagcu

SEQ ID NO: 165661 - RNA, 32 nt, Human
gcaaaacccugaauccagccagucgugcacag

SEQ ID NO: 165662 - RNA, 32 nt, Human
gcaaaaccuuccagccuugccugcuugguguc

SEQ ID NO: 165663 - RNA, 32 nt, Human
gcaaaacuacacagucuugacuguguaguuuu

SEQ ID NO: 165664 - RNA, 32 nt, Human
gcaaaacuagaacguagccacuuuaaauauac

SEQ ID NO: 165665 - RNA, 20 nt, Human
gcaaaacuauugagccagug

SEQ ID NO: 165666 - RNA, 32 nt, Human
gcaaaacucaucuugaccccuguugcaggcaa

SEQ ID NO: 165667 - RNA, 32 nt, Human
gcaaaacucccagccgccucauggcaaaugcc

SEQ ID NO: 165668 - RNA, 32 nt, Human
gcaaaacucccaucgauguugccaucagucau

SEQ ID NO: 165669 - RNA, 32 nt, Human
gcaaaacugaaagcuucagggauuugcuguag

SEQ ID NO: 165670 - RNA, 32 nt, Human
gcaaaacuggaagcacagccucggggaugggg

SEQ ID NO: 165671 - RNA, 32 nt, Human
gcaaaacuuuccaacugaguggagucugauua

SEQ ID NO: 165672 - RNA, 32 nt, Human
gcaaaagaaacgugagaaggagggucucuugc

SEQ ID NO: 165673 - RNA, 32 nt, Human
gcaaaagaacagagguuucucaaaugccucag

SEQ ID NO: 165674 - RNA, 32 nt, Human
gcaaaagaaguggccaugugagagggacacuc

SEQ ID NO: 165675 - RNA, 32 nt, Human
gcaaaagagaaaaggagccaggcugggcuucc

SEQ ID NO: 165676 - RNA, 32 nt, Human
gcaaaagagcuuggcccugcugucuuucuucu

SEQ ID NO: 165677 - RNA, 32 nt, Human
gcaaaagaguucgagccccacuucaaacaacu

SEQ ID NO: 165678 - RNA, 19 nt, Human
gcaaaagcaacaaaacacc

SEQ ID NO: 165679 - RNA, 32 nt, Human
gcaaaagcagccugagcaacauagugagaccc

SEQ ID NO: 165680 - RNA, 32 nt, Human
gcaaaagccaaguaugcaaccaggaagcuuuu

SEQ ID NO: 165681 - RNA, 32 nt, Human
gcaaaagccuccaagcucuccaaaaagaaagc

SEQ ID NO: 165682 - RNA, 32 nt, Human
gcaaaagccuccgagcucuccaaaaagaaagc

SEQ ID NO: 165683 - RNA, 20 nt, Human
gcaaaagcgcagcgugcuug

SEQ ID NO: 165684 - RNA, 32 nt, Human
gcaaaagcuucaaauuaaaacagcugcauuag

SEQ ID NO: 165685 - RNA, 32 nt, Human
gcaaaaggacaguaaacuguggaccuugaagu

SEQ ID NO: 165686 - RNA, 32 nt, Human
gcaaaaggacugagcccaggagagcggggaca

SEQ ID NO: 165687 - RNA, 32 nt, Human
gcaaaaggagagaagagagaaauagccugcgc

SEQ ID NO: 165688 - RNA, 32 nt, Human
gcaaaaggcuagauaacuaacaacaccugggu

SEQ ID NO: 165689 - RNA, 32 nt, Human
gcaaaaggcugacgguauggaauauguuucca

SEQ ID NO: 165690 - RNA, 32 nt, Human
gcaaaagggccucucccuuuguguucuauaca

SEQ ID NO: 165691 - RNA, 32 nt, Human
gcaaaagggcuugccuaaggccagccauuuuu

SEQ ID NO: 165692 - RNA, 32 nt, Human
gcaaaaggggaagggaagaggcagucagagga

SEQ ID NO: 165693 - RNA, 32 nt, Human
gcaaaaggucagaacaguuaaacacugccuuu

SEQ ID NO: 165694 - RNA, 32 nt, Human
gcaaaagucagagaggcugacaaggaccaaug

SEQ ID NO: 165695 - RNA, 24 nt, Human
gcaaaagugcaagauggggaguga

SEQ ID NO: 165696 - RNA, 32 nt, Human
gcaaaagugggagcaggagcuuggaggugagc

SEQ ID NO: 165697 - RNA, 32 nt, Human
gcaaaaguuuuuaauaaaaggcauuuuuauag

SEQ ID NO: 165698 - RNA, 32 nt, Human
gcaaaauaagcauggauuaagugagaagggag

SEQ ID NO: 165699 - RNA, 32 nt, Human
gcaaaauaaguucugccugggcauuuuguaga

SEQ ID NO: 165700 - RNA, 21 nt, Human
gcaaaauacugagugucauug

SEQ ID NO: 165701 - RNA, 32 nt, Human
gcaaaauaguaagcuagcaucuuacugccguc

SEQ ID NO: 165702 - RNA, 32 nt, Human
gcaaaauauacauauaaacagaguaagccuuu

SEQ ID NO: 165703 - RNA, 32 nt, Human
gcaaaaucauggcucacugcagccuggagcuc

SEQ ID NO: 165704 - RNA, 32 nt, Human
gcaaaaucauguuccccacccccggggcagaa

SEQ ID NO: 165705 - RNA, 32 nt, Human
gcaaaauccauaccaaaacaacgacaacaacg

SEQ ID NO: 165706 - RNA, 18 nt, Human
gcaaaauccaucuucaga

SEQ ID NO: 165707 - RNA, 32 nt, Human
gcaaaaucucaaggccuggggcucagaguagu

SEQ ID NO: 165708 - RNA, 32 nt, Human
gcaaaaugaauccagauugcugucauuuucuu

SEQ ID NO: 165709 - RNA, 32 nt, Human
gcaaaaugagacauauuuacacuguuuauacu

SEQ ID NO: 165710 - RNA, 32 nt, Human
gcaaaaugaucuuccaaaccuguuaucuuuug

SEQ ID NO: 165711 - RNA, 17 nt, Human
gcaaaaugaugcuuucc

SEQ ID NO: 165712 - RNA, 32 nt, Human
gcaaaaugcacaauuccuacagaagaggcaag

SEQ ID NO: 165713 - RNA, 32 nt, Human
gcaaaauggaaagagaugaagauguuccaagg

SEQ ID NO: 165714 - RNA, 32 nt, Human
gcaaaauggcugcuugagcuacucugugucgu

SEQ ID NO: 165715 - RNA, 32 nt, Human
gcaaaaugggaaacauaauaccugccaucagg

SEQ ID NO: 165716 - RNA, 32 nt, Human
gcaaaauggggagggggaggaagcagugacuu

SEQ ID NO: 165717 - RNA, 32 nt, Human
gcaaaaugugugucagcacuuuucccuccuuu

SEQ ID NO: 165718 - RNA, 32 nt, Human
gcaaaauguuauuaucaggaaugaucgagaga

SEQ ID NO: 165719 - RNA, 32 nt, Human
gcaaaauuauauuguaacuuccccucacccca

SEQ ID NO: 165720 - RNA, 24 nt, Human
gcaaaauucauccuugcaacccca

SEQ ID NO: 165721 - RNA, 18 nt, Human
gcaaaauuccacccagaa

SEQ ID NO: 165722 - RNA, 32 nt, Human
gcaaaauuccaucuaaaacaaacaaacaaaca

SEQ ID NO: 165723 - RNA, 32 nt, Human
gcaaaauucccccuugucacagaaaccaggga

SEQ ID NO: 165724 - RNA, 32 nt, Human
gcaaaauugcauucaaaaauguguaaaaauga

SEQ ID NO: 165725 - RNA, 32 nt, Human
gcaaaauuugccuguccagcucccucucccca

SEQ ID NO: 165726 - RNA, 32 nt, Human
gcaaacaaccucgaccuccugcucaauuccgg

SEQ ID NO: 165727 - RNA, 32 nt, Human
gcaaacaacuccaggacaaggcaggacaugau

SEQ ID NO: 165728 - RNA, 32 nt, Human
gcaaacaagagggcaugggagcacacagagag

SEQ ID NO: 165729 - RNA, 32 nt, Human
gcaaacaauuggaaggaaguugcuugaauguu

SEQ ID NO: 165730 - RNA, 32 nt, Human
gcaaacacagcaucgugaucacugagccauca

SEQ ID NO: 165731 - RNA, 32 nt, Human
gcaaacacaugcuuuuguaucuugucauaguu

SEQ ID NO: 165732 - RNA, 32 nt, Human
gcaaacacauuaagccuuccacacucaccucu

SEQ ID NO: 165733 - RNA, 32 nt, Human
gcaaacaccaagcagaaugccuggccuguauu

SEQ ID NO: 165734 - RNA, 32 nt, Human
gcaaacaccacugccugcaggagccugggcug

SEQ ID NO: 165735 - RNA, 32 nt, Human
gcaaacaccugacauggcagccucgagggaga

SEQ ID NO: 165736 - RNA, 32 nt, Human
gcaaacacucuuuaacaugaguuggggccuga

SEQ ID NO: 165737 - RNA, 32 nt, Human
gcaaacacugaggucaacuacaagccacaggc

SEQ ID NO: 165738 - RNA, 32 nt, Human
gcaaacagaccguucaccaccaucuccagcug

SEQ ID NO: 165739 - RNA, 32 nt, Human
gcaaacagcagcaggaggagccgcuagagcag

SEQ ID NO: 165740 - RNA, 32 nt, Human
gcaaacagcuccucuuccagaggggaguugug

SEQ ID NO: 165741 - RNA, 30 nt, Human
gcaaacagcucuuaaguagaaagacugaaa

SEQ ID NO: 165742 - RNA, 30 nt, Human
gcaaacagcuugccaagaggaaguggcagu

SEQ ID NO: 165743 - RNA, 32 nt, Human
gcaaacaggcugaaagagucccuggugcgcag

SEQ ID NO: 165744 - RNA, 32 nt, Human
gcaaacaggcuguucaccaccaucuccagcug

SEQ ID NO: 165745 - RNA, 32 nt, Human
gcaaacaucaguguccuucuagcuuuagccga

SEQ ID NO: 165746 - RNA, 32 nt, Human
gcaaacaucggccuuguccuccuuguguucau

SEQ ID NO: 165747 - RNA, 32 nt, Human
gcaaacaugcccacaggaaauucaagggcuga

SEQ ID NO: 165748 - RNA, 32 nt, Human
gcaaaccaccuaucuggccccaacacaccuga

SEQ ID NO: 165749 - RNA, 32 nt, Human
gcaaaccacuuugacugaaagcagaaagagug

SEQ ID NO: 165750 - RNA, 31 nt, Human
gcaaaccagagagauagggagggggaaugca

SEQ ID NO: 165751 - RNA, 32 nt, Human
gcaaaccagcacuggagcaacucugaaagaag

SEQ ID NO: 165752 - RNA, 32 nt, Human
gcaaaccagccuuuucuaauaggcuaauauug

SEQ ID NO: 165753 - RNA, 32 nt, Human
gcaaaccaucaucaguuauauuagguuaauau

SEQ ID NO: 165754 - RNA, 32 nt, Human
gcaaacccaacaagaugagacacuuaaaccca

SEQ ID NO: 165755 - RNA, 32 nt, Human
gcaaacccacagaacccgccugccugucccug

SEQ ID NO: 165756 - RNA, 32 nt, Human
gcaaacccagccucccuccacccccagaaaau

SEQ ID NO: 165757 - RNA, 22 nt, Human
gcaaacccaugaaccucaagaa

SEQ ID NO: 165758 - RNA, 32 nt, Human
gcaaaccccagcagugaacuucccucucuguc

SEQ ID NO: 165759 - RNA, 32 nt, Human
gcaaacccucauuuaaauugguccagcauuug

SEQ ID NO: 165760 - RNA, 32 nt, Human
gcaaacccugcagugaucccaaucugucugug

SEQ ID NO: 165761 - RNA, 32 nt, Human
gcaaaccgugaaggagaaugggacacuggguc

SEQ ID NO: 165762 - RNA, 32 nt, Human
gcaaaccuacacacaaagacacagagcacacu

SEQ ID NO: 165763 - RNA, 32 nt, Human
gcaaaccucacaggguccccacacaacagugc

SEQ ID NO: 165764 - RNA, 32 nt, Human
gcaaaccuccaagccugugcgggccaaucuuu

SEQ ID NO: 165765 - RNA, 32 nt, Human
gcaaaccucccccagccccuaccauccaaugu

SEQ ID NO: 165766 - RNA, 32 nt, Human
gcaaaccuccuugucucucauccaggacagaa

SEQ ID NO: 165767 - RNA, 24 nt, Human
gcaaaccugaauuucuaaagagaa

SEQ ID NO: 165768 - RNA, 22 nt, Human
gcaaaccugaggccucccggca

SEQ ID NO: 165769 - RNA, 21 nt, Human
gcaaaccugagggcccaaaga

SEQ ID NO: 165770 - RNA, 32 nt, Human
gcaaaccugagggcccaaagagggacaggggc

SEQ ID NO: 165771 - RNA, 32 nt, Human
gcaaaccugcccccucugccucccagugcacc

SEQ ID NO: 165772 - RNA, 32 nt, Human
gcaaaccuguagucccagcuaccugggaggcu

SEQ ID NO: 165773 - RNA, 32 nt, Human
gcaaaccuucccccggccuccuggucggcugu

SEQ ID NO: 165774 - RNA, 32 nt, Human
gcaaaccuucugcuguguuaauucuggucagu

SEQ ID NO: 165775 - RNA, 32 nt, Human
gcaaaccuugcuuugaacucugccaguauuuc

SEQ ID NO: 165776 - RNA, 32 nt, Human
gcaaacgagcaaguuuaaaacggagugggcuu

SEQ ID NO: 165777 - RNA, 32 nt, Human
gcaaacgauccuggccucucccgccagcugac

SEQ ID NO: 165778 - RNA, 32 nt, Human
gcaaacgaugcacacaggcuugacgagggccu

SEQ ID NO: 165779 - RNA, 32 nt, Human
gcaaacgcagcggguggcugggguaggggcuc

SEQ ID NO: 165780 - RNA, 22 nt, Human
gcaaacgccccuccccccacca

SEQ ID NO: 165781 - RNA, 19 nt, Human
gcaaacgccuguaauccca

SEQ ID NO: 165782 - RNA, 32 nt, Human
gcaaacggacaugcuggaauccucauccccaa

SEQ ID NO: 165783 - RNA, 32 nt, Human
gcaaacggcaggagguugcagacccgacagcg

SEQ ID NO: 165784 - RNA, 32 nt, Human
gcaaacggggaccccaggaugagucugccggc

SEQ ID NO: 165785 - RNA, 20 nt, Human
gcaaacguacuagaccagug

SEQ ID NO: 165786 - RNA, 32 nt, Human
gcaaacgugaguagagaaugaaauacacaguu

SEQ ID NO: 165787 - RNA, 32 nt, Human
gcaaacuauuuuucucuuuucuuauuuauuuc

SEQ ID NO: 165788 - RNA, 32 nt, Human
gcaaacucaaauggugcuucaaagggagagac

SEQ ID NO: 165789 - RNA, 32 nt, Human
gcaaacucacacacacgagcaugcacaggcag

SEQ ID NO: 165790 - RNA, 32 nt, Human
gcaaacucacauauugcuggugcuaaccuuau

SEQ ID NO: 165791 - RNA, 32 nt, Human
gcaaacucccuuucaaagcugugugaccggcu

SEQ ID NO: 165792 - RNA, 32 nt, Human
gcaaacucgacccccguuccugcccagauaau

SEQ ID NO: 165793 - RNA, 32 nt, Human
gcaaacucugcaggugucuuucuuauccuagu

SEQ ID NO: 165794 - RNA, 32 nt, Human
gcaaacucugcugucuaaccugugaccagucu

SEQ ID NO: 165795 - RNA, 32 nt, Human
gcaaacucuuacugccuuucuccugguuucau

SEQ ID NO: 165796 - RNA, 32 nt, Human
gcaaacucuucuccauagcaguccaguagugg

SEQ ID NO: 165797 - RNA, 32 nt, Human
gcaaacugaggcaagagaaucgcuugaggcca

SEQ ID NO: 165798 - RNA, 32 nt, Human
gcaaacugcgcagcaggcaccuccagaaaggu

SEQ ID NO: 165799 - RNA, 32 nt, Human
gcaaacugcuuuccagccugaagccugcuuaa

SEQ ID NO: 165800 - RNA, 21 nt, Human
gcaaacuggccuugaucagug

SEQ ID NO: 165801 - RNA, 32 nt, Human
gcaaacuggcugagucuguggaaaaggccguu

SEQ ID NO: 165802 - RNA, 32 nt, Human
gcaaacuguccaaguagcuaggcuccagauuu

SEQ ID NO: 165803 - RNA, 32 nt, Human
gcaaacuucucccucccugggguaauucaaca

SEQ ID NO: 165804 - RNA, 32 nt, Human
gcaaagaacaaauuucauccauuuuucugucu

SEQ ID NO: 165805 - RNA, 24 nt, Human
gcaaagaaccuugcccaaggugac

SEQ ID NO: 165806 - RNA, 32 nt, Human
gcaaagaagagaggcagcaccucccauuggca

SEQ ID NO: 165807 - RNA, 32 nt, Human
gcaaagaagggcccgagcuuaguuuccccagg

SEQ ID NO: 165808 - RNA, 32 nt, Human
gcaaagaagguaacaaagaagcauaagaauuc

SEQ ID NO: 165809 - RNA, 32 nt, Human
gcaaagacagcuaagaaaaaggaaaagaaaug

SEQ ID NO: 165810 - RNA, 32 nt, Human
gcaaagacagcuuuacuacucccuuuucccuu

SEQ ID NO: 165811 - RNA, 32 nt, Human
gcaaagacauggagcauaucuuggguccaggu

SEQ ID NO: 165812 - RNA, 32 nt, Human
gcaaagacuggcucuagguauuugaggagcac

SEQ ID NO: 165813 - RNA, 32 nt, Human
gcaaagagaaccugggcugagacauggccgcu

SEQ ID NO: 165814 - RNA, 32 nt, Human
gcaaagagaagaucagggcagcuuaagugguc

SEQ ID NO: 165815 - RNA, 18 nt, Human
gcaaagagaauccuguac

SEQ ID NO: 165816 - RNA, 32 nt, Human
gcaaagagcgacccucacaaggcccaaguccu

SEQ ID NO: 165817 - RNA, 32 nt, Human
gcaaagaggaauaggagggacauggaaccauu

SEQ ID NO: 165818 - RNA, 32 nt, Human
gcaaagaggauauaucacuggcuaucuaaucc

SEQ ID NO: 165819 - RNA, 32 nt, Human
gcaaagaggcagggcagcgagcacagcuguuc

SEQ ID NO: 165820 - RNA, 32 nt, Human
gcaaagagggcgcaggcccugcagugacgguu

SEQ ID NO: 165821 - RNA, 32 nt, Human
gcaaagaguacaccacuguaagauauucugag

SEQ ID NO: 165822 - RNA, 32 nt, Human
gcaaagaucugccagccccaggccucuaccua

SEQ ID NO: 165823 - RNA, 32 nt, Human
gcaaagaugcccugaacaaagcaggacacacg

SEQ ID NO: 165824 - RNA, 32 nt, Human
gcaaagauucgucaacuuucuuagcucaagag

SEQ ID NO: 165825 - RNA, 32 nt, Human
gcaaagauuguccccucugcuguucucugggg

SEQ ID NO: 165826 - RNA, 32 nt, Human
gcaaagauugugccacuacacuccagccuggg

SEQ ID NO: 165827 - RNA, 32 nt, Human
gcaaagcaaagucagugaaagacaaucuuuau

SEQ ID NO: 165828 - RNA, 25 nt, Human
gcaaagcaacauggcagagcaguca

SEQ ID NO: 165829 - RNA, 32 nt, Human
gcaaagcacagccuggccaacauggugaaauc

SEQ ID NO: 165830 - RNA, 32 nt, Human
gcaaagcacauagagccagcuguccugucagu

SEQ ID NO: 165831 - RNA, 32 nt, Human
gcaaagcacugacccguguccuccguugcucg

SEQ ID NO: 165832 - RNA, 32 nt, Human
gcaaagcacugucaccggccucagggaguuua

SEQ ID NO: 165833 - RNA, 32 nt, Human
gcaaagcagaggaacggugucagcauuuugaa

SEQ ID NO: 165834 - RNA, 32 nt, Human
gcaaagcaggccauuucucccaccugaaagua

SEQ ID NO: 165835 - RNA, 32 nt, Human
gcaaagcaggccuuucacauuuacaggccucu

SEQ ID NO: 165836 - RNA, 18 nt, Human
gcaaagcaguaugcuccc

SEQ ID NO: 165837 - RNA, 32 nt, Human
gcaaagccaccuguagucuauucuaaccucac

SEQ ID NO: 165838 - RNA, 26 nt, Human
gcaaagccagaaacuucucucaagaa

SEQ ID NO: 165839 - RNA, 22 nt, Human
gcaaagccagaaaugcucucuc

SEQ ID NO: 165840 - RNA, 32 nt, Human
gcaaagccagccuggggcuugcauguugaucc

SEQ ID NO: 165841 - RNA, 32 nt, Human
gcaaagccaucuuagcaacuuucucacugaga

SEQ ID NO: 165842 - RNA, 32 nt, Human
gcaaagccuagccugcauaucauucacccaaa

SEQ ID NO: 165843 - RNA, 18 nt, Human
gcaaagccuccugcuccu

SEQ ID NO: 165844 - RNA, 18 nt, Human
gcaaagccucugaccagu

SEQ ID NO: 165845 - RNA, 32 nt, Human
gcaaagccucugaggcacgucgcuugaucugc

SEQ ID NO: 165846 - RNA, 32 nt, Human
gcaaagcgugagcccccaaauccacaccuggg

SEQ ID NO: 165847 - RNA, 24 nt, Human
gcaaagcuacaacgauggacucuu

SEQ ID NO: 165848 - RNA, 21 nt, Human
gcaaagcugaagaggcagcuu

SEQ ID NO: 165849 - RNA, 22 nt, Human
gcaaagcugaccccagccccca

SEQ ID NO: 165850 - RNA, 32 nt, Human
gcaaagcugaugcagagagaugagccaauuga

SEQ ID NO: 165851 - RNA, 32 nt, Human
gcaaagcugcacaacauaacaagacccuaucu

SEQ ID NO: 165852 - RNA, 32 nt, Human
gcaaagcugccuuccaagugccugucugugcc

SEQ ID NO: 165853 - RNA, 20 nt, Human
gcaaagcugcugggccagug

SEQ ID NO: 165854 - RNA, 22 nt, Human
gcaaagcuuguccgauguccuc

SEQ ID NO: 165855 - RNA, 20 nt, Human
gcaaagcuuuuaacguccuc

SEQ ID NO: 165856 - RNA, 32 nt, Human
gcaaaggaaagaauaaggcagcauaugacauc

SEQ ID NO: 165857 - RNA, 32 nt, Human
gcaaaggaaaggggaaaaagaaaaacgacuaa

SEQ ID NO: 165858 - RNA, 32 nt, Human
gcaaaggaagagcagagaaaucuuagacggug

SEQ ID NO: 165859 - RNA, 23 nt, Human
gcaaaggaagcuugaaaaauaug

SEQ ID NO: 165860 - RNA, 32 nt, Human
gcaaaggaaguccucagcuguaccggccuuuc

SEQ ID NO: 165861 - RNA, 32 nt, Human
gcaaaggaauccugccugccuucagcagagaa

SEQ ID NO: 165862 - RNA, 32 nt, Human
gcaaaggacacaucucuccagcaaaggacacc

SEQ ID NO: 165863 - RNA, 32 nt, Human
gcaaaggacaccucucuccagcaaaggacacc

SEQ ID NO: 165864 - RNA, 32 nt, Human
gcaaaggacugggaguuccugaggaaggggga

SEQ ID NO: 165865 - RNA, 32 nt, Human
gcaaaggagaacagagccaggagccaggauau

SEQ ID NO: 165866 - RNA, 32 nt, Human
gcaaaggagaagcacagcuccugccaggguga

SEQ ID NO: 165867 - RNA, 32 nt, Human
gcaaaggagaggagggagaugaggucauuguu

SEQ ID NO: 165868 - RNA, 32 nt, Human
gcaaaggagagggaaagcucggauccauugcc

SEQ ID NO: 165869 - RNA, 32 nt, Human
gcaaaggagagguggggagaaaagagggugaa

SEQ ID NO: 165870 - RNA, 32 nt, Human
gcaaaggagaugcagagaugcccaugccgaga

SEQ ID NO: 165871 - RNA, 32 nt, Human
gcaaaggagcagccaugagggccgggcccagu

SEQ ID NO: 165872 - RNA, 32 nt, Human
gcaaaggaggaggaaaagggaggacuugguag

SEQ ID NO: 165873 - RNA, 32 nt, Human
gcaaaggaggcugggcacaguggcucaugccu

SEQ ID NO: 165874 - RNA, 32 nt, Human
gcaaaggaggggaaacaaugaaaacaaauaaa

SEQ ID NO: 165875 - RNA, 32 nt, Human
gcaaaggagguggggagcaggagagagagggu

SEQ ID NO: 165876 - RNA, 32 nt, Human
gcaaaggagugugagagaggaguggaugguca

SEQ ID NO: 165877 - RNA, 32 nt, Human
gcaaaggcaggggaaaguccugccuuggggag

SEQ ID NO: 165878 - RNA, 32 nt, Human
gcaaaggccagugaggcagcugugaguuggac

SEQ ID NO: 165879 - RNA, 32 nt, Human
gcaaaggccccgagacuggaguguguuccuga

SEQ ID NO: 165880 - RNA, 20 nt, Human
gcaaaggcccgucacccccg

SEQ ID NO: 165881 - RNA, 32 nt, Human
gcaaaggccugauaauagcuuaauaccaugac

SEQ ID NO: 165882 - RNA, 32 nt, Human
gcaaaggcugaagaccaguucuccccagugaa

SEQ ID NO: 165883 - RNA, 32 nt, Human
gcaaagggaaagaggaaaagagccuucaggga

SEQ ID NO: 165884 - RNA, 32 nt, Human
gcaaagggaacccagcaguucugagugaguuc

SEQ ID NO: 165885 - RNA, 32 nt, Human
gcaaagggaggaagacugguagcggggagggg

SEQ ID NO: 165886 - RNA, 32 nt, Human
gcaaagggcaggcaguucgugcgcggacacaa

SEQ ID NO: 165887 - RNA, 32 nt, Human
gcaaagggcugccuugcuguucuugaagcugg

SEQ ID NO: 165888 - RNA, 32 nt, Human
gcaaagggcuguagcaugcaugaucacuugug

SEQ ID NO: 165889 - RNA, 32 nt, Human
gcaaaggggugggggcugggugcaguggcuca

SEQ ID NO: 165890 - RNA, 32 nt, Human
gcaaaggucaacuagcugcuuccccagggaau

SEQ ID NO: 165891 - RNA, 32 nt, Human
gcaaaggugcaaucauagcucacugcagccuc

SEQ ID NO: 165892 - RNA, 32 nt, Human
gcaaagguggaggguuuuagacucucaugcuu

SEQ ID NO: 165893 - RNA, 32 nt, Human
gcaaaggugguggugcuuucaucuucaggcag

SEQ ID NO: 165894 - RNA, 19 nt, Human
gcaaagguguaugcuuuaa

SEQ ID NO: 165895 - RNA, 32 nt, Human
gcaaagguuugcugaaaagcccagugaacaag

SEQ ID NO: 165896 - RNA, 32 nt, Human
gcaaaguaaucaucguucaggcccaacccuua

SEQ ID NO: 165897 - RNA, 32 nt, Human
gcaaaguacugagcagaagcuuugaauguagc

SEQ ID NO: 165898 - RNA, 32 nt, Human
gcaaaguaggagagaggcccagaggaaagccc

SEQ ID NO: 165899 - RNA, 32 nt, Human
gcaaaguaguacuucuucuguaauauuuacaa

SEQ ID NO: 165900 - RNA, 32 nt, Human
gcaaaguaugcacacauaucuugaauggcuuu

SEQ ID NO: 165901 - RNA, 32 nt, Human
gcaaagucccacgcggcgaagaguuuuggagc

SEQ ID NO: 165902 - RNA, 32 nt, Human
gcaaagucucugcuuacaucauuuugguuguc

SEQ ID NO: 165903 - RNA, 22 nt, Human
gcaaagugcuagccacuggaaa

SEQ ID NO: 165904 - RNA, 32 nt, Human
gcaaaguggaaaguuagaccagcugggaccag

SEQ ID NO: 165905 - RNA, 32 nt, Human
gcaaaguggaagcaaggaacaaggcagaauaa

SEQ ID NO: 165906 - RNA, 32 nt, Human
gcaaaguggacucugcugcaaaauggugcuuc

SEQ ID NO: 165907 - RNA, 24 nt, Human
gcaaaguggcucaugcccguaauc

SEQ ID NO: 165908 - RNA, 32 nt, Human
gcaaagugggguccccagccagcggcaccagc

SEQ ID NO: 165909 - RNA, 21 nt, Human
gcaaagugggguggggagcga

SEQ ID NO: 165910 - RNA, 31 nt, Human
gcaaagugugagagaaggguuaagacuggcu

SEQ ID NO: 165911 - RNA, 32 nt, Human
gcaaagugugagccaaaggauccuuccuuauu

SEQ ID NO: 165912 - RNA, 32 nt, Human
gcaaagugugcgugaaaacuuuugaaacugaa

SEQ ID NO: 165913 - RNA, 20 nt, Human
gcaaaguuaagcagaccagu

SEQ ID NO: 165914 - RNA, 32 nt, Human
gcaaaguuaaggcuugauaccaaucgagcuaa

SEQ ID NO: 165915 - RNA, 21 nt, Human
gcaaaguuacaacugaccgug

SEQ ID NO: 165916 - RNA, 18 nt, Human
gcaaaguuacaggccagu

SEQ ID NO: 165917 - RNA, 19 nt, Human
gcaaaguuauuuaccaugu

SEQ ID NO: 165918 - RNA, 31 nt, Human
gcaaaguuccaaagacagcagaaaacuuuug

SEQ ID NO: 165919 - RNA, 32 nt, Human
gcaaaguucguguccagcucuaugacccugac

SEQ ID NO: 165920 - RNA, 18 nt, Human
gcaaaguuggagcgagug

SEQ ID NO: 165921 - RNA, 19 nt, Human
gcaaaguuguuauucagug

SEQ ID NO: 165922 - RNA, 21 nt, Human
gcaaaguuuuucaaccaagug

SEQ ID NO: 165923 - RNA, 32 nt, Human
gcaaauaaaauuauugaaaauaauuuuaaagu

SEQ ID NO: 165924 - RNA, 32 nt, Human
gcaaauaagaggagugagugaaauagagaaag

SEQ ID NO: 165925 - RNA, 32 nt, Human
gcaaauaauuucugugcuucaaggagcuucag

SEQ ID NO: 165926 - RNA, 32 nt, Human
gcaaauacaugcagaaggagggcugcgcuggg

SEQ ID NO: 165927 - RNA, 32 nt, Human
gcaaauacucaggguuugaagggagaccuggc

SEQ ID NO: 165928 - RNA, 32 nt, Human
gcaaauacugguuugcuucuguuuuccagaga

SEQ ID NO: 165929 - RNA, 32 nt, Human
gcaaauacuugauugauuugauauuuagcuua

SEQ ID NO: 165930 - RNA, 32 nt, Human
gcaaauagaagagagagguugaaaaacaaaau

SEQ ID NO: 165931 - RNA, 32 nt, Human
gcaaauaggcaauauaccauacaaucaauucc

SEQ ID NO: 165932 - RNA, 32 nt, Human
gcaaauauggcuuaaauauuucauggcaguuu

SEQ ID NO: 165933 - RNA, 32 nt, Human
gcaaaucagaaagaaaauggaugcagacucca

SEQ ID NO: 165934 - RNA, 32 nt, Human
gcaaaucagaagacacagcuuuuggugcgggc

SEQ ID NO: 165935 - RNA, 32 nt, Human
gcaaaucaucuccugugccacuggccuugggc

SEQ ID NO: 165936 - RNA, 32 nt, Human
gcaaaucauucaacgacccccgacccuccgac

SEQ ID NO: 165937 - RNA, 20 nt, Human
gcaaauccaaaagucugggg

SEQ ID NO: 165938 - RNA, 32 nt, Human
gcaaaucccagccacggcaucuucccgaccac

SEQ ID NO: 165939 - RNA, 32 nt, Human
gcaaauccccuccccaaacccacccauaccag

SEQ ID NO: 165940 - RNA, 32 nt, Human
gcaaaucccucagaggacagagcuaaggugga

SEQ ID NO: 165941 - RNA, 32 nt, Human
gcaaauccuguucacccaggaggucaacaaug

SEQ ID NO: 165942 - RNA, 32 nt, Human
gcaaauccuuuaauacuaucucucauuguuuu

SEQ ID NO: 165943 - RNA, 32 nt, Human
gcaaaucgccuuucugacucuugaguaggaug

SEQ ID NO: 165944 - RNA, 32 nt, Human
gcaaaucuacaguucuguuuuugcuacucuau

SEQ ID NO: 165945 - RNA, 32 nt, Human
gcaaaucucagccucuggaaaugcagcuucuu

SEQ ID NO: 165946 - RNA, 32 nt, Human
gcaaaucugcuggcaucuuucuucccaaaggc

SEQ ID NO: 165947 - RNA, 31 nt, Human
gcaaaugaaaacaguagccuaaagugucagu

SEQ ID NO: 165948 - RNA, 32 nt, Human
gcaaaugaaaacaguagccuaaagugucaguu

SEQ ID NO: 165949 - RNA, 19 nt, Human
gcaaaugaaaacucucucc

SEQ ID NO: 165950 - RNA, 20 nt, Human
gcaaaugaaaacucucucca

SEQ ID NO: 165951 - RNA, 32 nt, Human
gcaaaugaaagccaucugacaguuggcucaca

SEQ ID NO: 165952 - RNA, 32 nt, Human
gcaaaugagagccugggcuuggugucgaggga

SEQ ID NO: 165953 - RNA, 31 nt, Human
gcaaaugaggagagagaagaugagguuggac

SEQ ID NO: 165954 - RNA, 32 nt, Human
gcaaaugaggggugcaggagaggaaugcagac

SEQ ID NO: 165955 - RNA, 32 nt, Human
gcaaaugaucacuguaaacuggcucugucuca

SEQ ID NO: 165956 - RNA, 20 nt, Human
gcaaaugcaaacaucucugc

SEQ ID NO: 165957 - RNA, 20 nt, Human
gcaaaugcaauaaugcccuc

SEQ ID NO: 165958 - RNA, 32 nt, Human
gcaaaugcacacaaacccaugcauacacaagc

SEQ ID NO: 165959 - RNA, 19 nt, Human
gcaaaugcaugauuucucu

SEQ ID NO: 165960 - RNA, 20 nt, Human
gcaaaugccaagugcucugc

SEQ ID NO: 165961 - RNA, 32 nt, Human
gcaaaugccgacccuguggccugcugcccgcc

SEQ ID NO: 165962 - RNA, 32 nt, Human
gcaaaugccuguaaucccagcacuuugggagg

SEQ ID NO: 165963 - RNA, 18 nt, Human
gcaaaugcucagcucucc

SEQ ID NO: 165964 - RNA, 32 nt, Human
gcaaaugcuucuacacacuccaccuccagcac

SEQ ID NO: 165965 - RNA, 32 nt, Human
gcaaaugcuuggugguucgacuucucccucug

SEQ ID NO: 165966 - RNA, 32 nt, Human
gcaaauggagaaugaaaucgggugcaugugac

SEQ ID NO: 165967 - RNA, 32 nt, Human
gcaaauggccacugaguagccccagaggucgc

SEQ ID NO: 165968 - RNA, 31 nt, Human
gcaaauggcccagcucugccuguguuuuucu

SEQ ID NO: 165969 - RNA, 32 nt, Human
gcaaauggcuaauugagguucugaaguucuuc

SEQ ID NO: 165970 - RNA, 29 nt, Human
gcaaauggcugaagucccggaggauuaug

SEQ ID NO: 165971 - RNA, 32 nt, Human
gcaaaugguaacacccucauggagaucucagg

SEQ ID NO: 165972 - RNA, 32 nt, Human
gcaaauggugcuguucccgaugacccuucucc

SEQ ID NO: 165973 - RNA, 25 nt, Human
gcaaaugguuuguaagcacuggaaa

SEQ ID NO: 165974 - RNA, 18 nt, Human
gcaaauguauacauguua

SEQ ID NO: 165975 - RNA, 32 nt, Human
gcaaaugucucuuggaacacacugccuuaaac

SEQ ID NO: 165976 - RNA, 20 nt, Human
gcaaaugugcagauucaaug

SEQ ID NO: 165977 - RNA, 29 nt, Human
gcaaauguuccagguauuuaagccacaug

SEQ ID NO: 165978 - RNA, 18 nt, Human
gcaaauguugaugccucc

SEQ ID NO: 165979 - RNA, 32 nt, Human
gcaaauuaaagaaugaaagaaguacuucuuuu

SEQ ID NO: 165980 - RNA, 32 nt, Human
gcaaauuagaacuucagaaucuaaugauaguu

SEQ ID NO: 165981 - RNA, 32 nt, Human
gcaaauucaaguguuuuccugggugaagacuu

SEQ ID NO: 165982 - RNA, 32 nt, Human
gcaaauucaggaaagucugggauacaaaauca

SEQ ID NO: 165983 - RNA, 32 nt, Human
gcaaauucaguuugccuuccuggauuuguaaa

SEQ ID NO: 165984 - RNA, 32 nt, Human
gcaaauucuagauagacacuguauuuauuggu

SEQ ID NO: 165985 - RNA, 18 nt, Human
gcaaauugaaugcucucu

SEQ ID NO: 165986 - RNA, 32 nt, Human
gcaaauugagaucaaugaggccaaaaggaaac

SEQ ID NO: 165987 - RNA, 32 nt, Human
gcaaauuggggaggggaggguguaucuagcuc

SEQ ID NO: 165988 - RNA, 32 nt, Human
gcaaauuguggacacaccaccgcaugugccag

SEQ ID NO: 165989 - RNA, 32 nt, Human
gcaaauuuggcaaagacuaccugcuggagaug

SEQ ID NO: 165990 - RNA, 32 nt, Human
gcaaauuugggaggggagagguccagaagcug

SEQ ID NO: 165991 - RNA, 32 nt, Human
gcaaauuuguuuuccuuuuugcaccugccaaa

SEQ ID NO: 165992 - RNA, 32 nt, Human
gcaaauuuuucagacaucguccauaccuugca

SEQ ID NO: 165993 - RNA, 32 nt, Human
gcaaauuuuucagacauuguucauaccuugca

SEQ ID NO: 165994 - RNA, 32 nt, Human
gcaacaaaacuucuggcaaggccaggcuguga

SEQ ID NO: 165995 - RNA, 32 nt, Human
gcaacaaaaugucuuuauugaaagaaguggaa

SEQ ID NO: 165996 - RNA, 32 nt, Human
gcaacaaacaccugcaguuaaaggaauaccuu

SEQ ID NO: 165997 - RNA, 32 nt, Human
gcaacaaagaauccaacccacacagcuuuaua

SEQ ID NO: 165998 - RNA, 32 nt, Human
gcaacaaagagauacuuucucaguccugcagg

SEQ ID NO: 165999 - RNA, 21 nt, Human
gcaacaaagccccaaaggcuc

SEQ ID NO: 166000 - RNA, 32 nt, Human
gcaacaaaggagaaaaggaagugauuggagaa

SEQ ID NO: 166001 - RNA, 32 nt, Human
gcaacaaaggcagagggggcggggcgggggag

SEQ ID NO: 166002 - RNA, 32 nt, Human
gcaacaacaaaggcggccuccuuguccacuuu

SEQ ID NO: 166003 - RNA, 32 nt, Human
gcaacaacaacacacacgcacacacgcacaca

SEQ ID NO: 166004 - RNA, 32 nt, Human
gcaacaaccaucacccucccuccuuaagcuuc

SEQ ID NO: 166005 - RNA, 32 nt, Human
gcaacaacccagaaaucguuacaguuggagag

SEQ ID NO: 166006 - RNA, 32 nt, Human
gcaacaaccuuaaaggccgucauuucauuagu

SEQ ID NO: 166007 - RNA, 32 nt, Human
gcaacaacugauuucauacaacugaguuacuc

SEQ ID NO: 166008 - RNA, 32 nt, Human
gcaacaacuuagaagaaaucauuuagugacuu

SEQ ID NO: 166009 - RNA, 32 nt, Human
gcaacaagaccaccacuucgaaaccugggauu

SEQ ID NO: 166010 - RNA, 32 nt, Human
gcaacaagcaagagagaaagaaacacagaaag

SEQ ID NO: 166011 - RNA, 32 nt, Human
gcaacaaggaaacuauccuguggccugagagc

SEQ ID NO: 166012 - RNA, 32 nt, Human
gcaacaaggacaguaacacacauguaugaccc

SEQ ID NO: 166013 - RNA, 32 nt, Human
gcaacaaggaggcagugaccagcaugggagga

SEQ ID NO: 166014 - RNA, 32 nt, Human
gcaacaaggcccuagcuggagacucuggggau

SEQ ID NO: 166015 - RNA, 32 nt, Human
gcaacaagggcugagcugcgcuugcguggcug

SEQ ID NO: 166016 - RNA, 32 nt, Human
gcaacaaguccuaggagcacacaaagcaaccc

SEQ ID NO: 166017 - RNA, 32 nt, Human
gcaacaagugccggagguagcagagccaagcc

SEQ ID NO: 166018 - RNA, 32 nt, Human
gcaacaaguucaugcugauccuggccagcugc

SEQ ID NO: 166019 - RNA, 32 nt, Human
gcaacaaugccuuugcaggcagccugcucccc

SEQ ID NO: 166020 - RNA, 32 nt, Human
gcaacacagacuuguaccuguaucagcaaugu

SEQ ID NO: 166021 - RNA, 32 nt, Human
gcaacacagcaagacccuaucucuaccaaaaa

SEQ ID NO: 166022 - RNA, 23 nt, Human
gcaacacagucuuccucggucug

SEQ ID NO: 166023 - RNA, 32 nt, Human
gcaacacagugaggcccccuacccacauccuc

SEQ ID NO: 166024 - RNA, 19 nt, Human
gcaacaccagggcugaccu

SEQ ID NO: 166025 - RNA, 32 nt, Human
gcaacaccagugccaggaaaaggccaaaagaa

SEQ ID NO: 166026 - RNA, 32 nt, Human
gcaacaccaucaugacaucacaaccuguuccc

SEQ ID NO: 166027 - RNA, 32 nt, Human
gcaacaccaucccagggagaucugccacaauu

SEQ ID NO: 166028 - RNA, 32 nt, Human
gcaacacccacuugggcucuagggaaugcaag

SEQ ID NO: 166029 - RNA, 32 nt, Human
gcaacacccagccucuugaaacgagcugcugc

SEQ ID NO: 166030 - RNA, 23 nt, Human
gcaacacccauuugggguuacca

SEQ ID NO: 166031 - RNA, 32 nt, Human
gcaacacgaagcuuccagaaccauaaaauauc

SEQ ID NO: 166032 - RNA, 32 nt, Human
gcaacacgccccugcuggaccacucggcgccc

SEQ ID NO: 166033 - RNA, 32 nt, Human
gcaacacgccgcugccccaggccaucccgccg

SEQ ID NO: 166034 - RNA, 32 nt, Human
gcaacacuacaaaggagaaguuacucauuuca

SEQ ID NO: 166035 - RNA, 32 nt, Human
gcaacacuacacuccagccugggcgacagagc

SEQ ID NO: 166036 - RNA, 32 nt, Human
gcaacacuccucuuucccagccagcaaaggcu

SEQ ID NO: 166037 - RNA, 32 nt, Human
gcaacacugcacuccagccugggcgacagagc

SEQ ID NO: 166038 - RNA, 32 nt, Human
gcaacacugcacuccagccugggugacagagu

SEQ ID NO: 166039 - RNA, 32 nt, Human
gcaacacugccacuccagccugggugacagag

SEQ ID NO: 166040 - RNA, 32 nt, Human
gcaacacugcccuccagccugggcaacagagc

SEQ ID NO: 166041 - RNA, 32 nt, Human
gcaacacugcgcuccagccuggcagacagagg

SEQ ID NO: 166042 - RNA, 32 nt, Human
gcaacacuggaagaauugcacacaguuuccag

SEQ ID NO: 166043 - RNA, 32 nt, Human
gcaacacuggggagagccuggagcagccggac

SEQ ID NO: 166044 - RNA, 32 nt, Human
gcaacacuguacuccagccugggcaacagagg

SEQ ID NO: 166045 - RNA, 32 nt, Human
gcaacacuugacuucaucuuaauguacauuca

SEQ ID NO: 166046 - RNA, 32 nt, Human
gcaacagaaagccugccaauguagcugaaaua

SEQ ID NO: 166047 - RNA, 32 nt, Human
gcaacagaaauguucauuucugucagaaaacu

SEQ ID NO: 166048 - RNA, 32 nt, Human
gcaacagaaggugaguuuggggccugcagagc

SEQ ID NO: 166049 - RNA, 32 nt, Human
gcaacagacaggcuuggcaacugugaauaccu

SEQ ID NO: 166050 - RNA, 32 nt, Human
gcaacagacauccuccacauugugcacacugg

SEQ ID NO: 166051 - RNA, 32 nt, Human
gcaacagaggcuugggaugaagggugggugaa

SEQ ID NO: 166052 - RNA, 32 nt, Human
gcaacagagucagugccccaggaagaggaagu

SEQ ID NO: 166053 - RNA, 32 nt, Human
gcaacagcagcucuguaccucaucuguugauc

SEQ ID NO: 166054 - RNA, 32 nt, Human
gcaacagcaguuucauggaaccucucuuagcu

SEQ ID NO: 166055 - RNA, 32 nt, Human
gcaacagccagagguguuccuggggagauggc

SEQ ID NO: 166056 - RNA, 22 nt, Human
gcaacagccuuggggggcacuu

SEQ ID NO: 166057 - RNA, 32 nt, Human
gcaacagcugauagaagagaacagagacgcac

SEQ ID NO: 166058 - RNA, 32 nt, Human
gcaacagcuggguuucugagucagaaagacuu

SEQ ID NO: 166059 - RNA, 32 nt, Human
gcaacaggaacuuggaguggagaggaaaagca

SEQ ID NO: 166060 - RNA, 32 nt, Human
gcaacaggaagggagagcgcacgagggagagg

SEQ ID NO: 166061 - RNA, 32 nt, Human
gcaacaggagaaagaugacaugggcauggagc

SEQ ID NO: 166062 - RNA, 32 nt, Human
gcaacaggauacaaauggccacuagaggucau

SEQ ID NO: 166063 - RNA, 32 nt, Human
gcaacaggcaaaggagaaacagcucugacaua

SEQ ID NO: 166064 - RNA, 32 nt, Human
gcaacaggcaaaggccagagucagaguggugg

SEQ ID NO: 166065 - RNA, 32 nt, Human
gcaacagggaaagagggugggcacggggaggg

SEQ ID NO: 166066 - RNA, 32 nt, Human
gcaacagggcacuugcucccugggcaacuccu

SEQ ID NO: 166067 - RNA, 32 nt, Human
gcaacagggcugggacaggaaggcucucuucu

SEQ ID NO: 166068 - RNA, 32 nt, Human
gcaacagggugaccagcuguccugguuuccca

SEQ ID NO: 166069 - RNA, 32 nt, Human
gcaacagguccacuuugcucuccagucucuuu

SEQ ID NO: 166070 - RNA, 32 nt, Human
gcaacagguucaagcuggagaauccuucaaaa

SEQ ID NO: 166071 - RNA, 24 nt, Human
gcaacagguuuucuuuaaauccaa

SEQ ID NO: 166072 - RNA, 32 nt, Human
gcaacaguaacagcagcagcaaacuuuuccuc

SEQ ID NO: 166073 - RNA, 32 nt, Human
gcaacaguacacacaaacauacauaaagagag

SEQ ID NO: 166074 - RNA, 32 nt, Human
gcaacaguaguaggauauauuucuccuagaac

SEQ ID NO: 166075 - RNA, 22 nt, Human
gcaacaguggccuacacugccu

SEQ ID NO: 166076 - RNA, 32 nt, Human
gcaacagugggggccuguggggugggguggga

SEQ ID NO: 166077 - RNA, 32 nt, Human
gcaacaguuuuuaaaauauauugcugcauuuu

SEQ ID NO: 166078 - RNA, 32 nt, Human
gcaacauagugagacucggucucuaccaaaaa

SEQ ID NO: 166079 - RNA, 32 nt, Human
gcaacauagugaggccccaucucuagaaaaag

SEQ ID NO: 166080 - RNA, 32 nt, Human
gcaacauauaauaaaugcaugcuauucaauga

SEQ ID NO: 166081 - RNA, 32 nt, Human
gcaacaucccugguacuccagcuuugaggucc

SEQ ID NO: 166082 - RNA, 24 nt, Human
gcaacauccuacaugcagcuguga

SEQ ID NO: 166083 - RNA, 32 nt, Human
gcaacaucuugaaaaccagucuagucauugaa

SEQ ID NO: 166084 - RNA, 25 nt, Human
gcaacaugaaaagagcauaucaaug

SEQ ID NO: 166085 - RNA, 32 nt, Human
gcaacaugaugugaaaacccaucucuacaaaa

SEQ ID NO: 166086 - RNA, 32 nt, Human
gcaacaugcagagucccugagcccaccuccca

SEQ ID NO: 166087 - RNA, 32 nt, Human
gcaacaugcuagaaaauccucacugcacucca

SEQ ID NO: 166088 - RNA, 32 nt, Human
gcaacaugcucaaggaagaugcagccccuucc

SEQ ID NO: 166089 - RNA, 32 nt, Human
gcaacauggagaaaccccgucucuaucagaaa

SEQ ID NO: 166090 - RNA, 32 nt, Human
gcaacauggaguucauuguccuguugcuuacu

SEQ ID NO: 166091 - RNA, 32 nt, Human
gcaacauggugaaacugucucuaucaaaaaua

SEQ ID NO: 166092 - RNA, 32 nt, Human
gcaacauguggccuguucacagcuacauaauu

SEQ ID NO: 166093 - RNA, 32 nt, Human
gcaacauguuccaagcaaaaucuccccgccug

SEQ ID NO: 166094 - RNA, 32 nt, Human
gcaacauuacauugaagaccacuguggccaug

SEQ ID NO: 166095 - RNA, 32 nt, Human
gcaacauugcacuccaggcugggcagcaagag

SEQ ID NO: 166096 - RNA, 32 nt, Human
gcaacauugccucaccgcugagcuugaaaucc

SEQ ID NO: 166097 - RNA, 32 nt, Human
gcaacauuuaaaggaauaagaccuguucacua

SEQ ID NO: 166098 - RNA, 32 nt, Human
gcaacauuucuucaauuagcagucuagacauu

SEQ ID NO: 166099 - RNA, 27 nt, Human
gcaaccaaaacaaucagacucuucguu

SEQ ID NO: 166100 - RNA, 32 nt, Human
gcaaccaacugcugcugugcacauuuaugaau

SEQ ID NO: 166101 - RNA, 21 nt, Human
gcaaccaagaagauggaucaa

SEQ ID NO: 166102 - RNA, 31 nt, Human
gcaaccaagagugucaguuguacccgaggcg

SEQ ID NO: 166103 - RNA, 32 nt, Human
gcaaccaagcccugcugcuccaggacauauaa

SEQ ID NO: 166104 - RNA, 32 nt, Human
gcaaccaccauucugcuucaugacauugauuu

SEQ ID NO: 166105 - RNA, 32 nt, Human
gcaaccacccuuguugaagucucugcccgagg

SEQ ID NO: 166106 - RNA, 32 nt, Human
gcaaccacugacuggucuuaagcuguucuugc

SEQ ID NO: 166107 - RNA, 32 nt, Human
gcaaccacugacuggucuuagcuguucuugca

SEQ ID NO: 166108 - RNA, 32 nt, Human
gcaaccacugguguuuucugucccucuuguuc

SEQ ID NO: 166109 - RNA, 32 nt, Human
gcaaccagaauagcacuuuaccuuuugguugg

SEQ ID NO: 166110 - RNA, 32 nt, Human
gcaaccagcauaugugagugacagcauguguc

SEQ ID NO: 166111 - RNA, 32 nt, Human
gcaaccagcauaugugagugacagcauguguu

SEQ ID NO: 166112 - RNA, 32 nt, Human
gcaaccagccagagaaggagggccgggcgcac

SEQ ID NO: 166113 - RNA, 32 nt, Human
gcaaccagccugagucgcggugaggggaugag

SEQ ID NO: 166114 - RNA, 32 nt, Human
gcaaccagccuggccaauauggugagacccca

SEQ ID NO: 166115 - RNA, 32 nt, Human
gcaaccagccugggagucagggaggacucuuc

SEQ ID NO: 166116 - RNA, 32 nt, Human
gcaaccaggccugaggucagaauuugaacaua

SEQ ID NO: 166117 - RNA, 32 nt, Human
gcaaccaggccuggccuccuggugucugcggu

SEQ ID NO: 166118 - RNA, 21 nt, Human
gcaaccagggagcugcagggg

SEQ ID NO: 166119 - RNA, 32 nt, Human
gcaaccaggggcccugaucaggggacugagcc

SEQ ID NO: 166120 - RNA, 32 nt, Human
gcaaccaguuggcuaggggagcagggggccca

SEQ ID NO: 166121 - RNA, 32 nt, Human
gcaaccaucuuucagccccacuggucuuuuca

SEQ ID NO: 166122 - RNA, 32 nt, Human
gcaaccaucuuuccuccagcacuuuuggggua

SEQ ID NO: 166123 - RNA, 32 nt, Human
gcaaccaucuuucuguuugucgucuuguugau

SEQ ID NO: 166124 - RNA, 32 nt, Human
gcaaccauggaucaaaaguauuuggagcaucc

SEQ ID NO: 166125 - RNA, 20 nt, Human
gcaaccaugugguuccagcu

SEQ ID NO: 166126 - RNA, 32 nt, Human
gcaacccaaaugguggccauugugcuuggggc

SEQ ID NO: 166127 - RNA, 32 nt, Human
gcaacccaguagcuggagucugaagauggaga

SEQ ID NO: 166128 - RNA, 22 nt, Human
gcaacccaguucccaaauccag

SEQ ID NO: 166129 - RNA, 32 nt, Human
gcaacccaugcuguguucaugugacauaauac

SEQ ID NO: 166130 - RNA, 21 nt, Human
gcaaccccacacccuugacau

SEQ ID NO: 166131 - RNA, 32 nt, Human
gcaaccccagacccuggugacaaaauaagcaa

SEQ ID NO: 166132 - RNA, 32 nt, Human
gcaaccccagagaugaggcaccagagagugcc

SEQ ID NO: 166133 - RNA, 18 nt, Human
gcaaccccagaucagggu

SEQ ID NO: 166134 - RNA, 32 nt, Human
gcaaccccagcuccacuccagccuggcgucca

SEQ ID NO: 166135 - RNA, 32 nt, Human
gcaaccccagcucuccccagagaggggccggc

SEQ ID NO: 166136 - RNA, 32 nt, Human
gcaaccccaguucugcuccucuccaggcaccc

SEQ ID NO: 166137 - RNA, 23 nt, Human
gcaaccccuacccccgcccacca

SEQ ID NO: 166138 - RNA, 20 nt, Human
gcaaccccucccucgccccu

SEQ ID NO: 166139 - RNA, 32 nt, Human
gcaaccccugcagcuccucugccuuugugcuc

SEQ ID NO: 166140 - RNA, 32 nt, Human
gcaaccccugcucucagguucaagugguucuc

SEQ ID NO: 166141 - RNA, 32 nt, Human
gcaaccccugugccccuccccuccaggcuacc

SEQ ID NO: 166142 - RNA, 32 nt, Human
gcaacccugagucccuaaggcagcagcucaag

SEQ ID NO: 166143 - RNA, 32 nt, Human
gcaacccugcaaccucugccuaccggguucaa

SEQ ID NO: 166144 - RNA, 32 nt, Human
gcaacccugugacaauggcagguagugugcau

SEQ ID NO: 166145 - RNA, 32 nt, Human
gcaacccuucauuugcucucugugccaccaau

SEQ ID NO: 166146 - RNA, 32 nt, Human
gcaacccuuccaggaaggaguuggggagagag

SEQ ID NO: 166147 - RNA, 32 nt, Human
gcaaccgacaggccauucccacccccacacac

SEQ ID NO: 166148 - RNA, 24 nt, Human
gcaaccgcagcccagccccagucc

SEQ ID NO: 166149 - RNA, 32 nt, Human
gcaaccgcugcucuccgccucuccccucgcgg

SEQ ID NO: 166150 - RNA, 32 nt, Human
gcaaccggaccccgcccgcacccauggcgccc

SEQ ID NO: 166151 - RNA, 31 nt, Human
gcaaccuaaauguccaucaacagaugaaugg

SEQ ID NO: 166152 - RNA, 31 nt, Human
gcaaccuaaguguccaucaacagaugaaugg

SEQ ID NO: 166153 - RNA, 32 nt, Human
gcaaccuagaaacacacauuucuuugaauuua

SEQ ID NO: 166154 - RNA, 32 nt, Human
gcaaccuauucaucugacaaagggcuaauauc

SEQ ID NO: 166155 - RNA, 32 nt, Human
gcaaccucagcacacuuagccucccagugauu

SEQ ID NO: 166156 - RNA, 32 nt, Human
gcaaccucauacacuaaugauaugacuauaaa

SEQ ID NO: 166157 - RNA, 23 nt, Human
gcaaccuccaccucccggguuca

SEQ ID NO: 166158 - RNA, 22 nt, Human
gcaaccuccaccuccugaguuc

SEQ ID NO: 166159 - RNA, 23 nt, Human
gcaaccuccaccuccuggguuca

SEQ ID NO: 166160 - RNA, 23 nt, Human
gcaaccuccaccuuccugguuca

SEQ ID NO: 166161 - RNA, 32 nt, Human
gcaaccucccacugcuggagugcgagugggaa

SEQ ID NO: 166162 - RNA, 23 nt, Human
gcaaccuccgcccccuggguuca

SEQ ID NO: 166163 - RNA, 23 nt, Human
gcaaccuccgccucccagguuca

SEQ ID NO: 166164 - RNA, 23 nt, Human
gcaaccuccgccucccggauuca

SEQ ID NO: 166165 - RNA, 23 nt, Human
gcaaccuccgccucccggguuca

SEQ ID NO: 166166 - RNA, 23 nt, Human
gcaaccuccgccuccuaggucca

SEQ ID NO: 166167 - RNA, 23 nt, Human
gcaaccuccgucuccuggguuca

SEQ ID NO: 166168 - RNA, 23 nt, Human
gcaaccuccgucuuccggguuca

SEQ ID NO: 166169 - RNA, 32 nt, Human
gcaaccuccuacugcucuuccucucucccucu

SEQ ID NO: 166170 - RNA, 32 nt, Human
gcaaccucgacuucucagccuccugggguucc

SEQ ID NO: 166171 - RNA, 32 nt, Human
gcaaccucgcgguuccuggggugcuugugccc

SEQ ID NO: 166172 - RNA, 23 nt, Human
gcaaccucugccucccggguuca

SEQ ID NO: 166173 - RNA, 23 nt, Human
gcaaccucugccuccuggguuca

SEQ ID NO: 166174 - RNA, 32 nt, Human
gcaaccucugcuuacuugcccaacacacccua

SEQ ID NO: 166175 - RNA, 32 nt, Human
gcaaccucuucauuccagagcuagcccaggga

SEQ ID NO: 166176 - RNA, 32 nt, Human
gcaaccucuuccaucgcccugccuacacccgc

SEQ ID NO: 166177 - RNA, 32 nt, Human
gcaaccugaagcuugcaucucagccagcagau

SEQ ID NO: 166178 - RNA, 32 nt, Human
gcaaccugaggaugagauacaccagcuggcug

SEQ ID NO: 166179 - RNA, 32 nt, Human
gcaaccugcacuccagccugggugacagagcg

SEQ ID NO: 166180 - RNA, 32 nt, Human
gcaaccugcggcacacaguccccagcugccgg

SEQ ID NO: 166181 - RNA, 32 nt, Human
gcaaccuggaagagagccucaccagaaccuaa

SEQ ID NO: 166182 - RNA, 29 nt, Human
gcaaccuggcugcuccuggcccuuggcug

SEQ ID NO: 166183 - RNA, 32 nt, Human
gcaaccuggggaagccacaucccacuggaucc

SEQ ID NO: 166184 - RNA, 23 nt, Human
gcaaccugggugacagagcgaga

SEQ ID NO: 166185 - RNA, 32 nt, Human
gcaaccuggugcccagcgugcccagcugcccu

SEQ ID NO: 166186 - RNA, 19 nt, Human
gcaaccugugcaggucuug

SEQ ID NO: 166187 - RNA, 24 nt, Human
gcaaccugugggaaaucugugaga

SEQ ID NO: 166188 - RNA, 32 nt, Human
gcaaccugugugacugggggcaaggagcucaa

SEQ ID NO: 166189 - RNA, 32 nt, Human
gcaaccuugcccugagugaaucauguuaaagc

SEQ ID NO: 166190 - RNA, 32 nt, Human
gcaaccuugccuuccugaccucagcggcccuu

SEQ ID NO: 166191 - RNA, 32 nt, Human
gcaaccuuguaugucugugucugcacugcucc

SEQ ID NO: 166192 - RNA, 32 nt, Human
gcaaccuuguggauugaagguggagaguccuu

SEQ ID NO: 166193 - RNA, 32 nt, Human
gcaaccuuugcacuccacugugcaaugcuggc

SEQ ID NO: 166194 - RNA, 32 nt, Human
gcaaccuuuuacuugauacgauuugcaccuuu

SEQ ID NO: 166195 - RNA, 32 nt, Human
gcaacgaacacucgccuggccugggaaacugc

SEQ ID NO: 166196 - RNA, 32 nt, Human
gcaacgcaccugugccaaacccugccagaagc

SEQ ID NO: 166197 - RNA, 32 nt, Human
gcaacgcagaccaacagaacuucacagugaca

SEQ ID NO: 166198 - RNA, 32 nt, Human
gcaacgcagcagacuccugggccugaugugcu

SEQ ID NO: 166199 - RNA, 28 nt, Human
gcaacgcagugagagaccccaucucuac

SEQ ID NO: 166200 - RNA, 32 nt, Human
gcaacgcagugagagaccccaucucuacaaaa

SEQ ID NO: 166201 - RNA, 32 nt, Human
gcaacgccaguggcaaugggggagaugggaag

SEQ ID NO: 166202 - RNA, 32 nt, Human
gcaacgcgagaggccaagaccauggcugcuac

SEQ ID NO: 166203 - RNA, 32 nt, Human
gcaacgcggaggaaacgggagugaacggagag

SEQ ID NO: 166204 - RNA, 32 nt, Human
gcaacgcuaguggcucaugccuguaauccagc

SEQ ID NO: 166205 - RNA, 32 nt, Human
gcaacggaaagccauagcuaaguucaaggagc

SEQ ID NO: 166206 - RNA, 32 nt, Human
gcaacggaaauuucauugcuccuggguggaaa

SEQ ID NO: 166207 - RNA, 32 nt, Human
gcaacggaacagcucuagaugggggaugcccc

SEQ ID NO: 166208 - RNA, 32 nt, Human
gcaacggcccaggagcucagagcuccacaucu

SEQ ID NO: 166209 - RNA, 32 nt, Human
gcaacggcccuccaaaauugcccccacauugg

SEQ ID NO: 166210 - RNA, 32 nt, Human
gcaacggccguuagaggagcugagggagggaa

SEQ ID NO: 166211 - RNA, 32 nt, Human
gcaacggcggccuccaggccucaggcccccuc

SEQ ID NO: 166212 - RNA, 32 nt, Human
gcaacgggcacugcuaccgccuggugguggag

SEQ ID NO: 166213 - RNA, 32 nt, Human
gcaacgggggccucacagcacagagugaccgc

SEQ ID NO: 166214 - RNA, 32 nt, Human
gcaacgguggccuggauucguggccuggauuc

SEQ ID NO: 166215 - RNA, 32 nt, Human
gcaacguagccugggcucacugugcuggggca

SEQ ID NO: 166216 - RNA, 32 nt, Human
gcaacguggaggcgcugacacgcacggcugcg

SEQ ID NO: 166217 - RNA, 32 nt, Human
gcaacguggcugcugcccugcccaacacucgg

SEQ ID NO: 166218 - RNA, 32 nt, Human
gcaacgugggagaaagaaguugcuggaccagg

SEQ ID NO: 166219 - RNA, 32 nt, Human
gcaacguggggcucaucugccucucucugagc

SEQ ID NO: 166220 - RNA, 32 nt, Human
gcaacuaaacucagccaacaaccugaauaagu

SEQ ID NO: 166221 - RNA, 32 nt, Human
gcaacuacucuacauagccaaauguuuguaaa

SEQ ID NO: 166222 - RNA, 32 nt, Human
gcaacuaguugauguucaucagaaagaggauc

SEQ ID NO: 166223 - RNA, 32 nt, Human
gcaacuaucagggcagcucugccuccuccucc

SEQ ID NO: 166224 - RNA, 32 nt, Human
gcaacuauucuguuucucuccugggcuccccc

SEQ ID NO: 166225 - RNA, 32 nt, Human
gcaacuauuggugcgcuccagccgggcagguu

SEQ ID NO: 166226 - RNA, 32 nt, Human
gcaacucaacacucauggucaagugugauuag

SEQ ID NO: 166227 - RNA, 32 nt, Human
gcaacucaacauccucuucacccugcccugcc

SEQ ID NO: 166228 - RNA, 32 nt, Human
gcaacucacccagcuaauuuuguauuuuuagu

SEQ ID NO: 166229 - RNA, 32 nt, Human
gcaacucagccaagacccagugccuuggauug

SEQ ID NO: 166230 - RNA, 32 nt, Human
gcaacucagggcagaaaacucucuccauuugu

SEQ ID NO: 166231 - RNA, 32 nt, Human
gcaacucaggguggugucugaagagcagagag

SEQ ID NO: 166232 - RNA, 32 nt, Human
gcaacucagguccccagacugcagugagcuga

SEQ ID NO: 166233 - RNA, 32 nt, Human
gcaacucauacuuggcuaaugauauggagcag

SEQ ID NO: 166234 - RNA, 19 nt, Human
gcaacuccacuccuaggua

SEQ ID NO: 166235 - RNA, 32 nt, Human
gcaacucccgcauccuuugcucugccugucgg

SEQ ID NO: 166236 - RNA, 32 nt, Human
gcaacuccuaggcucagucaucagccucauuu

SEQ ID NO: 166237 - RNA, 32 nt, Human
gcaacuccugccucccuuccucacccugucuc

SEQ ID NO: 166238 - RNA, 32 nt, Human
gcaacucggaccugggcuuuucucccagcuuu

SEQ ID NO: 166239 - RNA, 32 nt, Human
gcaacucuacaaaaauacaaaaauuagccagg

SEQ ID NO: 166240 - RNA, 32 nt, Human
gcaacucucaccacaaucaauuuuggaacauu

SEQ ID NO: 166241 - RNA, 32 nt, Human
gcaacucucccacuccccuuucuuggaucaac

SEQ ID NO: 166242 - RNA, 32 nt, Human
gcaacucuccgaggaggaggaggaggagggag

SEQ ID NO: 166243 - RNA, 32 nt, Human
gcaacucucuccuuuuguuaucuugcuuuuau

SEQ ID NO: 166244 - RNA, 32 nt, Human
gcaacucucuuugacagugguaccccaugauc

SEQ ID NO: 166245 - RNA, 32 nt, Human
gcaacucugcaagcucaccugcuggacgugag

SEQ ID NO: 166246 - RNA, 32 nt, Human
gcaacucugcagaaaauguccauccuuguggc

SEQ ID NO: 166247 - RNA, 32 nt, Human
gcaacucugccucuguucucuugcauucuguu

SEQ ID NO: 166248 - RNA, 32 nt, Human
gcaacucugccuuuguguguauuggcgaucau

SEQ ID NO: 166249 - RNA, 32 nt, Human
gcaacucugucucaaaaacaaacaaacaaaca

SEQ ID NO: 166250 - RNA, 32 nt, Human
gcaacucuguucucccccuuccccuagacuuu

SEQ ID NO: 166251 - RNA, 32 nt, Human
gcaacugaaccugaaacucuuccacugugagu

SEQ ID NO: 166252 - RNA, 32 nt, Human
gcaacugagccagcugcuggagauauguaaag

SEQ ID NO: 166253 - RNA, 32 nt, Human
gcaacugagcuuccccaucccuccccagagcu

SEQ ID NO: 166254 - RNA, 32 nt, Human
gcaacugaugaaaggaggaagaagaaagggac

SEQ ID NO: 166255 - RNA, 32 nt, Human
gcaacugaugccacuauauuugccuagcaacu

SEQ ID NO: 166256 - RNA, 32 nt, Human
gcaacugauuucagccagguuuugccacuacc

SEQ ID NO: 166257 - RNA, 32 nt, Human
gcaacugcaacaacacccucgccugcccgcuc

SEQ ID NO: 166258 - RNA, 22 nt, Human
gcaacugcacagccccacaggc

SEQ ID NO: 166259 - RNA, 32 nt, Human
gcaacugcaccggugccagcugucuugggggc

SEQ ID NO: 166260 - RNA, 32 nt, Human
gcaacugccuggggccgggguuucccuuccug

SEQ ID NO: 166261 - RNA, 17 nt, Human
gcaacugcuuccaugcc

SEQ ID NO: 166262 - RNA, 18 nt, Human
gcaacugcuugaccacug

SEQ ID NO: 166263 - RNA, 32 nt, Human
gcaacugcuuuuauguucugucuccuuccaua

SEQ ID NO: 166264 - RNA, 32 nt, Human
gcaacuggaaccacgggugcaccccaccacgc

SEQ ID NO: 166265 - RNA, 32 nt, Human
gcaacuggaagguagaauagucuuauucaagg

SEQ ID NO: 166266 - RNA, 19 nt, Human
gcaacuggaauggcagcaa

SEQ ID NO: 166267 - RNA, 32 nt, Human
gcaacuggcugcagaucacagacacagugagg

SEQ ID NO: 166268 - RNA, 32 nt, Human
gcaacugggaaggcuuggagcggcacugauau

SEQ ID NO: 166269 - RNA, 32 nt, Human
gcaacuguaccuucuccaacauaggccacuca

SEQ ID NO: 166270 - RNA, 32 nt, Human
gcaacuguaugaggaggaggaggaggaggaug

SEQ ID NO: 166271 - RNA, 22 nt, Human
gcaacuguauucauacauguca

SEQ ID NO: 166272 - RNA, 32 nt, Human
gcaacuguccccucaguuccguggucgcgugg

SEQ ID NO: 166273 - RNA, 18 nt, Human
gcaacuguguacauguca

SEQ ID NO: 166274 - RNA, 32 nt, Human
gcaacuguugauuuccucaacauggcucacaa

SEQ ID NO: 166275 - RNA, 32 nt, Human
gcaacuguuggauuuucucauguuuggaacaa

SEQ ID NO: 166276 - RNA, 32 nt, Human
gcaacuuagcugauguggaggaaugguucuca

SEQ ID NO: 166277 - RNA, 32 nt, Human
gcaacuucagaccauuaugauagagccugcuc

SEQ ID NO: 166278 - RNA, 31 nt, Human
gcaacuuccuguagugagcacuuuguaugaa

SEQ ID NO: 166279 - RNA, 32 nt, Human
gcaacuucuagcagucaucugagaugagcacc

SEQ ID NO: 166280 - RNA, 32 nt, Human
gcaacuucuucgcaggacuccagccuggccgc

SEQ ID NO: 166281 - RNA, 32 nt, Human
gcaacuugccgcggacugccugggcuuagcca

SEQ ID NO: 166282 - RNA, 32 nt, Human
gcaacuuggcaaaacaaagcccaaguuuucaa

SEQ ID NO: 166283 - RNA, 32 nt, Human
gcaacuuggcuucacaggaucugccugguuga

SEQ ID NO: 166284 - RNA, 31 nt, Human
gcaacuuuaguguaauuccuaccucauuugg

SEQ ID NO: 166285 - RNA, 32 nt, Human
gcaacuuucccaacuacccaaccccaccaugg

SEQ ID NO: 166286 - RNA, 32 nt, Human
gcaacuuugaaugcuuucuuacuuguuuugug

SEQ ID NO: 166287 - RNA, 32 nt, Human
gcaacuuuggcagugagccucuguggcacagc

SEQ ID NO: 166288 - RNA, 32 nt, Human
gcaacuuuucuuggugucucaaaggaguaacu

SEQ ID NO: 166289 - RNA, 32 nt, Human
gcaagaaaaggagccugugagcagggguucca

SEQ ID NO: 166290 - RNA, 32 nt, Human
gcaagaaagcuccaagagagucaguguagcug

SEQ ID NO: 166291 - RNA, 32 nt, Human
gcaagaaaggaaaggauccuguggaagggucu

SEQ ID NO: 166292 - RNA, 18 nt, Human
gcaagaaaucaccugcug

SEQ ID NO: 166293 - RNA, 32 nt, Human
gcaagaacagcucagcaggaauacucauaaag

SEQ ID NO: 166294 - RNA, 32 nt, Human
gcaagaacaggcagagguaaaaagaugaugga

SEQ ID NO: 166295 - RNA, 32 nt, Human
gcaagaacaggggcacuagcugccuuauuagc

SEQ ID NO: 166296 - RNA, 32 nt, Human
gcaagaacaguucuauccuggugccuuacgaa

SEQ ID NO: 166297 - RNA, 32 nt, Human
gcaagaacauuaauaaacuaaaaacuucaugu

SEQ ID NO: 166298 - RNA, 32 nt, Human
gcaagaacauucauguaggagcccgaggacca

SEQ ID NO: 166299 - RNA, 32 nt, Human
gcaagaacucugcagcuuccugccuucugggu

SEQ ID NO: 166300 - RNA, 32 nt, Human
gcaagaacugcaacaggcucuccuggguccug

SEQ ID NO: 166301 - RNA, 32 nt, Human
gcaagaagaaaagcacaugaacaggugucuua

SEQ ID NO: 166302 - RNA, 32 nt, Human
gcaagaagaaaauucucguccuuuuucauuac

SEQ ID NO: 166303 - RNA, 32 nt, Human
gcaagaagaaaccaggcucuuccuucaacauu

SEQ ID NO: 166304 - RNA, 32 nt, Human
gcaagaagaugggucuucauccuaacccacgg

SEQ ID NO: 166305 - RNA, 32 nt, Human
gcaagaagauguuucuguggcuguuucugauu

SEQ ID NO: 166306 - RNA, 32 nt, Human
gcaagaagcugggaucgcugcagccauguuuu

SEQ ID NO: 166307 - RNA, 32 nt, Human
gcaagaaggagagaagcgaaggaguggggacu

SEQ ID NO: 166308 - RNA, 19 nt, Human
gcaagaaggcggggagcag

SEQ ID NO: 166309 - RNA, 25 nt, Human
gcaagaagggaaagacagagaguga

SEQ ID NO: 166310 - RNA, 32 nt, Human
gcaagaaguccuuggggaagcugcuggucugg

SEQ ID NO: 166311 - RNA, 32 nt, Human
gcaagaagucuggaugaugccuuaaacuuaau

SEQ ID NO: 166312 - RNA, 32 nt, Human
gcaagaagugugcuuugcugguuuaguccuau

SEQ ID NO: 166313 - RNA, 32 nt, Human
gcaagaauagagcaggccugagggccauaggc

SEQ ID NO: 166314 - RNA, 24 nt, Human
gcacuccagccuggccuauaagag

SEQ ID NO: 166315 - RNA, 23 nt, Human
gcacuccagccuggcgacaagag

SEQ ID NO: 166316 - RNA, 22 nt, Human
gcacuccagccuggcgacagag

SEQ ID NO: 166317 - RNA, 32 nt, Human
gcacuccagccuggcgacagagcaagacucca

SEQ ID NO: 166318 - RNA, 32 nt, Human
gcacuccagccuggcgacagagcaagacucug

SEQ ID NO: 166319 - RNA, 32 nt, Human
gcacuccagccuggcgacagagcaagacuucg

SEQ ID NO: 166320 - RNA, 32 nt, Human
gcacuccagccuggcgacagagcgagacaccg

SEQ ID NO: 166321 - RNA, 32 nt, Human
gcacuccagccuggcgacagagcgagacuccc

SEQ ID NO: 166322 - RNA, 32 nt, Human
gcacuccagccuggcgacagagcgagacuccg

SEQ ID NO: 166323 - RNA, 32 nt, Human
gcacuccagccuggcgacagagcgagacucgu

SEQ ID NO: 166324 - RNA, 32 nt, Human
gcacuccagccuggcgacagagcgagacucug

SEQ ID NO: 166325 - RNA, 22 nt, Human
gcacuccagccuggcuacagag

SEQ ID NO: 166326 - RNA, 23 nt, Human
gcacuccagccuggcugacagag

SEQ ID NO: 166327 - RNA, 24 nt, Human
gcacuccagccugggaaacaagag

SEQ ID NO: 166328 - RNA, 23 nt, Human
gcacuccagccugggaaauagag

SEQ ID NO: 166329 - RNA, 23 nt, Human
gcacuccagccugggaagcagag

SEQ ID NO: 166330 - RNA, 20 nt, Human
gcacuccagccugggagaca

SEQ ID NO: 166331 - RNA, 23 nt, Human
gcacuccagccugggagacagag

SEQ ID NO: 166332 - RNA, 32 nt, Human
gcacuccagccugggagacagagcaagacuca

SEQ ID NO: 166333 - RNA, 32 nt, Human
gcacuccagccugggagacagagcaagacucc

SEQ ID NO: 166334 - RNA, 32 nt, Human
gcacuccagccugggagacagagcaagacucu

SEQ ID NO: 166335 - RNA, 20 nt, Human
gcacuccagccugggagaua

SEQ ID NO: 166336 - RNA, 18 nt, Human
gcacuccagccugggcaa

SEQ ID NO: 166337 - RNA, 24 nt, Human
gcacuccagccugggcaaaaagag

SEQ ID NO: 166338 - RNA, 32 nt, Human
gcacuccagccugggcaaaaagagugagacuc

SEQ ID NO: 166339 - RNA, 23 nt, Human
gcacuccagccugggcaaaagag

SEQ ID NO: 166340 - RNA, 19 nt, Human
gcacuccagccugggcaac

SEQ ID NO: 166341 - RNA, 20 nt, Human
gcacuccagccugggcaaca

SEQ ID NO: 166342 - RNA, 21 nt, Human
gcacuccagccugggcaacaa

SEQ ID NO: 166343 - RNA, 22 nt, Human
gcacuccagccugggcaacaag

SEQ ID NO: 166344 - RNA, 24 nt, Human
gcacuccagccugggcaacaagaa

SEQ ID NO: 166345 - RNA, 24 nt, Human
gcacuccagccugggcaacaagag

SEQ ID NO: 166346 - RNA, 23 nt, Human
gcacuccagccugggcaacaagg

SEQ ID NO: 166347 - RNA, 24 nt, Human
gcacuccagccugggcaacacaga

SEQ ID NO: 166348 - RNA, 21 nt, Human
gcacuccagccugggcaacag

SEQ ID NO: 166349 - RNA, 22 nt, Human
gcacuccagccugggcaacaga

SEQ ID NO: 166350 - RNA, 23 nt, Human
gcacuccagccugggcaacagaa

SEQ ID NO: 166351 - RNA, 23 nt, Human
gcacuccagccugggcaacagag

SEQ ID NO: 166352 - RNA, 32 nt, Human
gcacuccagccugggcaacagagcaagacccc

SEQ ID NO: 166353 - RNA, 32 nt, Human
gcacuccagccugggcaacagagcaagaccuu

SEQ ID NO: 166354 - RNA, 32 nt, Human
gcacuccagccugggcaacagagcaagacucc

SEQ ID NO: 166355 - RNA, 32 nt, Human
gcacuccagccugggcaacagagcaagacucg

SEQ ID NO: 166356 - RNA, 32 nt, Human
gcacuccagccugggcaacagagcaagacucu

SEQ ID NO: 166357 - RNA, 32 nt, Human
gcacuccagccugggcaacagagcaagacugc

SEQ ID NO: 166358 - RNA, 32 nt, Human
gcacuccagccugggcaacagagcaagacugu

SEQ ID NO: 166359 - RNA, 32 nt, Human
gcacuccagccugggcaacagagcaagagucc

SEQ ID NO: 166360 - RNA, 32 nt, Human
gcacuccagccugggcaacagagcaagauccu

SEQ ID NO: 166361 - RNA, 32 nt, Human
gcacuccagccugggcaacagagcaaggcucu

SEQ ID NO: 166362 - RNA, 32 nt, Human
gcacuccagccugggcaacagagcaaggcugu

SEQ ID NO: 166363 - RNA, 32 nt, Human
gcacuccagccugggcaacagagccaggcccu

SEQ ID NO: 166364 - RNA, 32 nt, Human
gcacuccagccugggcaacagagcgaggcucu

SEQ ID NO: 166365 - RNA, 22 nt, Human
gcacuccagccugggcaacagg

SEQ ID NO: 166366 - RNA, 24 nt, Human
gcacuccagccugggcaacaggag

SEQ ID NO: 166367 - RNA, 23 nt, Human
gcacuccagccugggcaacaggg

SEQ ID NO: 166368 - RNA, 25 nt, Human
gcacuccagccugggcaacagugag

SEQ ID NO: 166369 - RNA, 21 nt, Human
gcacuccagccugggcaacga

SEQ ID NO: 166370 - RNA, 22 nt, Human
gcacuccagccugggcaacgag

SEQ ID NO: 166371 - RNA, 24 nt, Human
gcacuccagccugggcaacgagag

SEQ ID NO: 166372 - RNA, 22 nt, Human
gcacuccagccugggcaacgga

SEQ ID NO: 166373 - RNA, 24 nt, Human
gcacuccagccugggcaacggaga

SEQ ID NO: 166374 - RNA, 22 nt, Human
gcacuccagccugggcaacggg

SEQ ID NO: 166375 - RNA, 23 nt, Human
gcacuccagccugggcaacugag

SEQ ID NO: 166376 - RNA, 24 nt, Human
gcacuccagccugggcaauaagag

SEQ ID NO: 166377 - RNA, 23 nt, Human
gcacuccagccugggcaauagag

SEQ ID NO: 166378 - RNA, 21 nt, Human
gcacuccagccugggcaaugg

SEQ ID NO: 166379 - RNA, 24 nt, Human
gcacuccagccugggcaauggaga

SEQ ID NO: 166380 - RNA, 21 nt, Human
gcacuccagccugggcaccaa

SEQ ID NO: 166381 - RNA, 23 nt, Human
gcacuccagccugggcaccagag

SEQ ID NO: 166382 - RNA, 24 nt, Human
gcacuccagccugggcagcaagag

SEQ ID NO: 166383 - RNA, 23 nt, Human
gcacuccagccugggcagcagag

SEQ ID NO: 166384 - RNA, 23 nt, Human
gcacuccagccugggcagcugaa

SEQ ID NO: 166385 - RNA, 22 nt, Human
gcacuccagccugggcauagag

SEQ ID NO: 166386 - RNA, 22 nt, Human
gcacuccagccugggcaugaga

SEQ ID NO: 166387 - RNA, 20 nt, Human
gcacuccagccugggccaca

SEQ ID NO: 166388 - RNA, 23 nt, Human
gcacuccagccugggccacagaa

SEQ ID NO: 166389 - RNA, 23 nt, Human
gcacuccagccugggccacagag

SEQ ID NO: 166390 - RNA, 18 nt, Human
gcacuccagccugggcga

SEQ ID NO: 166391 - RNA, 23 nt, Human
gcacuccagccugggcgaaagag

SEQ ID NO: 166392 - RNA, 20 nt, Human
gcacuccagccugggcgaca

SEQ ID NO: 166393 - RNA, 21 nt, Human
gcacuccagccugggcgacaa

SEQ ID NO: 166394 - RNA, 24 nt, Human
gcacuccagccugggcgacaagag

SEQ ID NO: 166395 - RNA, 21 nt, Human
gcacuccagccugggcgacag

SEQ ID NO: 166396 - RNA, 23 nt, Human
gcacuccagccugggcgacagaa

SEQ ID NO: 166397 - RNA, 23 nt, Human
gcacuccagccugggcgacagag

SEQ ID NO: 166398 - RNA, 32 nt, Human
gcacuccagccugggcgacagagggugacucc

SEQ ID NO: 166399 - RNA, 24 nt, Human
gcacuccagccugggcgacaguga

SEQ ID NO: 166400 - RNA, 32 nt, Human
gcacuccagccugggcgacagugcaagacucu

SEQ ID NO: 166401 - RNA, 22 nt, Human
gcacuccagccugggcgacgag

SEQ ID NO: 166402 - RNA, 23 nt, Human
gcacuccagccugggcgacggag

SEQ ID NO: 166403 - RNA, 23 nt, Human
gcacuccagccugggcgacugaa

SEQ ID NO: 166404 - RNA, 24 nt, Human
gcacuccagccugggcgacuguga

SEQ ID NO: 166405 - RNA, 23 nt, Human
gcacuccagccugggcgauagag

SEQ ID NO: 166406 - RNA, 21 nt, Human
gcacuccagccugggcgaugg

SEQ ID NO: 166407 - RNA, 23 nt, Human
gcacuccagccugggcggcagag

SEQ ID NO: 166408 - RNA, 23 nt, Human
gcacuccagccugggcgucagag

SEQ ID NO: 166409 - RNA, 21 nt, Human
gcacuccagccugggcuacaa

SEQ ID NO: 166410 - RNA, 24 nt, Human
gcacuccagccugggcuacaagag

SEQ ID NO: 166411 - RNA, 22 nt, Human
gcacuccagccugggcuacaga

SEQ ID NO: 166412 - RNA, 23 nt, Human
gcacuccagccugggcuacagag

SEQ ID NO: 166413 - RNA, 24 nt, Human
gcacuccagccugggcuauaagag

SEQ ID NO: 166414 - RNA, 20 nt, Human
gcacuccagccugggcucaa

SEQ ID NO: 166415 - RNA, 23 nt, Human
gcacuccagccuggggaacagag

SEQ ID NO: 166416 - RNA, 32 nt, Human
gcacuccagccuggggaacagagcaagauucu

SEQ ID NO: 166417 - RNA, 32 nt, Human
gcacuccagccuggggaacagagcgagacucc

SEQ ID NO: 166418 - RNA, 22 nt, Human
gcacuccagccuggggacagag

SEQ ID NO: 166419 - RNA, 32 nt, Human
gcacuccagccuggggacagagcaagacucuu

SEQ ID NO: 166420 - RNA, 23 nt, Human
gcacuccagccuggggcugacag

SEQ ID NO: 166421 - RNA, 24 nt, Human
gcacuccagccugggggacaagag

SEQ ID NO: 166422 - RNA, 23 nt, Human
gcacuccagccugggggacagaa

SEQ ID NO: 166423 - RNA, 23 nt, Human
gcacuccagccugggggacagag

SEQ ID NO: 166424 - RNA, 32 nt, Human
gcacuccagccugggggacagagcaagacccu

SEQ ID NO: 166425 - RNA, 32 nt, Human
gcacuccagccugggggacagagcaagacucu

SEQ ID NO: 166426 - RNA, 32 nt, Human
gcacuccagccugggggacagagcaagacugu

SEQ ID NO: 166427 - RNA, 32 nt, Human
gcacuccagccugggggacagagcaaggcucc

SEQ ID NO: 166428 - RNA, 24 nt, Human
gcacuccagccuggggugacagag

SEQ ID NO: 166429 - RNA, 24 nt, Human
gcacuccagccuggggugauagaa

SEQ ID NO: 166430 - RNA, 24 nt, Human
gcacuccagccuggguaacaagag

SEQ ID NO: 166431 - RNA, 21 nt, Human
gcacuccagccuggguaacag

SEQ ID NO: 166432 - RNA, 23 nt, Human
gcacuccagccuggguaacagag

SEQ ID NO: 166433 - RNA, 32 nt, Human
gcacuccagccuggguaacagagcaagaccau

SEQ ID NO: 166434 - RNA, 32 nt, Human
gcacuccagccuggguaacagagcaagacucc

SEQ ID NO: 166435 - RNA, 32 nt, Human
gcacuccagccuggguaacagagcaagacucu

SEQ ID NO: 166436 - RNA, 32 nt, Human
gcacuccagccuggguaacagagcaagagucu

SEQ ID NO: 166437 - RNA, 23 nt, Human
gcacuccagccugggugaaagag

SEQ ID NO: 166438 - RNA, 20 nt, Human
gcacuccagccugggugaca

SEQ ID NO: 166439 - RNA, 21 nt, Human
gcacuccagccugggugacaa

SEQ ID NO: 166440 - RNA, 22 nt, Human
gcacuccagccugggugacaag

SEQ ID NO: 166441 - RNA, 24 nt, Human
gcacuccagccugggugacaagag

SEQ ID NO: 166442 - RNA, 21 nt, Human
gcacuccagccugggugacag

SEQ ID NO: 166443 - RNA, 22 nt, Human
gcacuccagccugggugacaga

SEQ ID NO: 166444 - RNA, 23 nt, Human
gcacuccagccugggugacagaa

SEQ ID NO: 166445 - RNA, 23 nt, Human
gcacuccagccugggugacagag

SEQ ID NO: 166446 - RNA, 24 nt, Human
gcacuccagccugggugacagaga

SEQ ID NO: 166447 - RNA, 22 nt, Human
gcacuccagccugggugacgag

SEQ ID NO: 166448 - RNA, 23 nt, Human
gcacuccagccugggugacggaa

SEQ ID NO: 166449 - RNA, 23 nt, Human
gcacuccagccugggugacugag

SEQ ID NO: 166450 - RNA, 24 nt, Human
gcacuccagccugggugagaagag

SEQ ID NO: 166451 - RNA, 23 nt, Human
gcacuccagccugggugagagag

SEQ ID NO: 166452 - RNA, 24 nt, Human
gcacuccagccugggugauaagag

SEQ ID NO: 166453 - RNA, 23 nt, Human
gcacuccagccugggugauagag

SEQ ID NO: 166454 - RNA, 24 nt, Human
gcacuccagccugggugauggaga

SEQ ID NO: 166455 - RNA, 23 nt, Human
gcacuccagccugggugauggga

SEQ ID NO: 166456 - RNA, 23 nt, Human
gcacuccagccuggguggcagag

SEQ ID NO: 166457 - RNA, 23 nt, Human
gcacuccagccugggugucagag

SEQ ID NO: 166458 - RNA, 22 nt, Human
gcacuccagccuggguuacaga

SEQ ID NO: 166459 - RNA, 21 nt, Human
gcacuccagccuggucaacaa

SEQ ID NO: 166460 - RNA, 32 nt, Human
gcacuccagccuggucaacagagcaagacucc

SEQ ID NO: 166461 - RNA, 24 nt, Human
gcacuccagccuggucgacaagag

SEQ ID NO: 166462 - RNA, 23 nt, Human
gcacuccagccuggucgacagag

SEQ ID NO: 166463 - RNA, 22 nt, Human
gcacuccagccuggugacagaa

SEQ ID NO: 166464 - RNA, 22 nt, Human
gcacuccagccuggugacagag

SEQ ID NO: 166465 - RNA, 32 nt, Human
gcacuccagccuggugacagagcaagacucca

SEQ ID NO: 166466 - RNA, 32 nt, Human
gcacuccagccuggugacagagcaagacuccg

SEQ ID NO: 166467 - RNA, 32 nt, Human
gcacuccagccuggugacagagcaagacucug

SEQ ID NO: 166468 - RNA, 32 nt, Human
gcacuccagccuggugacagagcgagacucca

SEQ ID NO: 166469 - RNA, 32 nt, Human
gcacuccagccuggugacagagcgagacuccg

SEQ ID NO: 166470 - RNA, 32 nt, Human
gcacuccagccuggugacagagcuagauucca

SEQ ID NO: 166471 - RNA, 32 nt, Human
gcacuccagccuggugacagagugagacuccg

SEQ ID NO: 166472 - RNA, 32 nt, Human
gcacuccagccuggugacagagugagacucug

SEQ ID NO: 166473 - RNA, 32 nt, Human
gcacuccagccuggugacagcgugagacucuu

SEQ ID NO: 166474 - RNA, 32 nt, Human
gcacuccagccuggugacagggcgagacuccg

SEQ ID NO: 166475 - RNA, 22 nt, Human
gcacuccagccugguuacagag

SEQ ID NO: 166476 - RNA, 23 nt, Human
gcacuccagccugguugacagag

SEQ ID NO: 166477 - RNA, 32 nt, Human
gcacuccagccugguugacagagcaagacucc

SEQ ID NO: 166478 - RNA, 32 nt, Human
gcacuccagccugguugacagagcaagacucu

SEQ ID NO: 166479 - RNA, 32 nt, Human
gcacuccagccugucgcugugcagaccuggcu

SEQ ID NO: 166480 - RNA, 21 nt, Human
gcacuccagccugugcaacaa

SEQ ID NO: 166481 - RNA, 24 nt, Human
gcacuccagccugugcgacaagag

SEQ ID NO: 166482 - RNA, 23 nt, Human
gcacuccagccugugugaaagag

SEQ ID NO: 166483 - RNA, 23 nt, Human
gcacuccagccugugugacagaa

SEQ ID NO: 166484 - RNA, 20 nt, Human
gcacuccagccuguugacaa

SEQ ID NO: 166485 - RNA, 32 nt, Human
gcacuccagccuugagacagagcgagacccug

SEQ ID NO: 166486 - RNA, 21 nt, Human
gcacuccagccuuggcaacaa

SEQ ID NO: 166487 - RNA, 22 nt, Human
gcacuccagccuugggcgacaa

SEQ ID NO: 166488 - RNA, 24 nt, Human
gcacuccagcucaggcaacaagag

SEQ ID NO: 166489 - RNA, 32 nt, Human
gcacuccagcucggggaacagagcgagaccuu

SEQ ID NO: 166490 - RNA, 32 nt, Human
gcacuccagcugggcgacagagcgagacucca

SEQ ID NO: 166491 - RNA, 32 nt, Human
gcacuccagcugggcgacagagcgagauucca

SEQ ID NO: 166492 - RNA, 32 nt, Human
gcacuccagcuuggugacagagugagauccug

SEQ ID NO: 166493 - RNA, 32 nt, Human
gcacuccaggcgggugacagagcaagacugcg

SEQ ID NO: 166494 - RNA, 32 nt, Human
gcacuccaggcuggacgacagagcaagacccu

SEQ ID NO: 166495 - RNA, 32 nt, Human
gcacuccaguaggagagcaggagaagauaucu

SEQ ID NO: 166496 - RNA, 32 nt, Human
gcacuccagucggguuaacagagcaagacacu

SEQ ID NO: 166497 - RNA, 32 nt, Human
gcacuccagucuggacaacagagcaagacucu

SEQ ID NO: 166498 - RNA, 32 nt, Human
gcacuccagucugggcaacagagcaagacccu

SEQ ID NO: 166499 - RNA, 32 nt, Human
gcacuccagucugggcaacagagcaagacucu

SEQ ID NO: 166500 - RNA, 32 nt, Human
gcacuccaguuuccuuucccugccucuugucc

SEQ ID NO: 166501 - RNA, 24 nt, Human
gcacuccaguuugggcaacaagag

SEQ ID NO: 166502 - RNA, 23 nt, Human
gcacuccaguuugggcaacagaa

SEQ ID NO: 166503 - RNA, 32 nt, Human
gcacuccauccagccugggugacagggcgaga

SEQ ID NO: 166504 - RNA, 32 nt, Human
gcacuccauccagccugggugacagggugaga

SEQ ID NO: 166505 - RNA, 32 nt, Human
gcacuccauccagcuacaggagagauagaagc

SEQ ID NO: 166506 - RNA, 24 nt, Human
gcacuccauccugggcaacaagaa

SEQ ID NO: 166507 - RNA, 32 nt, Human
gcacuccauccugggugacagagcaagacuuc

SEQ ID NO: 166508 - RNA, 32 nt, Human
gcacuccaugcuuagucacugccugcagaggu

SEQ ID NO: 166509 - RNA, 32 nt, Human
gcacuccauuccggaaccuccuggacccucua

SEQ ID NO: 166510 - RNA, 32 nt, Human
gcacucccaccugacacaccaggcgcuaauuc

SEQ ID NO: 166511 - RNA, 32 nt, Human
gcacucccagccaccagugccugucaccucuu

SEQ ID NO: 166512 - RNA, 32 nt, Human
gcacucccagccugggcaacggagugagacuc

SEQ ID NO: 166513 - RNA, 32 nt, Human
gcacuccccaaaacaucccauuuugcaggugu

SEQ ID NO: 166514 - RNA, 32 nt, Human
gcacucccccugggugucgcucuccccuccug

SEQ ID NO: 166515 - RNA, 32 nt, Human
gcacuccccuauugaagaccugcuggagcuca

SEQ ID NO: 166516 - RNA, 32 nt, Human
gcacucccgcccuauuucugcaaguagaacuc

SEQ ID NO: 166517 - RNA, 32 nt, Human
gcacucccuccagccuacccacaaacaggacc

SEQ ID NO: 166518 - RNA, 32 nt, Human
gcacucccuccagcuggccccugcugcugccu

SEQ ID NO: 166519 - RNA, 32 nt, Human
gcacucccugcaggagccaucaucugugaaaa

SEQ ID NO: 166520 - RNA, 32 nt, Human
gcacuccgcagccuuuaagguucgcgcggggg

SEQ ID NO: 166521 - RNA, 21 nt, Human
gcacuccgcugguccaggcgg

SEQ ID NO: 166522 - RNA, 32 nt, Human
gcacuccggagguagagguuguggugagccga

SEQ ID NO: 166523 - RNA, 32 nt, Human
gcacuccggccugaugacagagcgagauuccg

SEQ ID NO: 166524 - RNA, 24 nt, Human
gcacuccggccugggcaacaagag

SEQ ID NO: 166525 - RNA, 32 nt, Human
gcacuccgugagccauguccagucccuuuuau

SEQ ID NO: 166526 - RNA, 32 nt, Human
gcacuccucaagcugucuuuugugcuuagauc

SEQ ID NO: 166527 - RNA, 23 nt, Human
gcacuccucccggguuucugcuc

SEQ ID NO: 166528 - RNA, 20 nt, Human
gcacuccucugucucugcuc

SEQ ID NO: 166529 - RNA, 24 nt, Human
gcacuccugccugggcaacaagag

SEQ ID NO: 166530 - RNA, 32 nt, Human
gcacuccugcugucaaugccuucucauccucc

SEQ ID NO: 166531 - RNA, 32 nt, Human
gcacuccuggacaaccuggacccagaugcaag

SEQ ID NO: 166532 - RNA, 32 nt, Human
gcacuccugggcaacagagcaagacuucgucu

SEQ ID NO: 166533 - RNA, 32 nt, Human
gcacuccuguaacccugggacuuugggaagcu

SEQ ID NO: 166534 - RNA, 32 nt, Human
gcacuccuguaaucccagcuacucagaaggcu

SEQ ID NO: 166535 - RNA, 32 nt, Human
gcacuccuguagucccagcuaaucaggaggcu

SEQ ID NO: 166536 - RNA, 32 nt, Human
gcacuccuguagucccagcuacuaggaaggcu

SEQ ID NO: 166537 - RNA, 21 nt, Human
gcacuccugucccuggccugc

SEQ ID NO: 166538 - RNA, 31 nt, Human
gcacuccuuuggcuggagcacuuguguccau

SEQ ID NO: 166539 - RNA, 32 nt, Human
gcacucgcuggcgaccugcuccagucuccaaa

SEQ ID NO: 166540 - RNA, 32 nt, Human
gcacucggaugucaaguugcucuggcuguuug

SEQ ID NO: 166541 - RNA, 32 nt, Human
gcacucggccaauccgcaucucagcccucuca

SEQ ID NO: 166542 - RNA, 32 nt, Human
gcacucggccccggagagugcagcagacaggg

SEQ ID NO: 166543 - RNA, 32 nt, Human
gcacucggccucccccucaucaccauuccuuc

SEQ ID NO: 166544 - RNA, 32 nt, Human
gcacucgggaguugcucaguggcucugcaccg

SEQ ID NO: 166545 - RNA, 32 nt, Human
gcacucuaagaugaguucaucaacauuguaaa

SEQ ID NO: 166546 - RNA, 32 nt, Human
gcacucuacccaccuauugcuggacuucuguu

SEQ ID NO: 166547 - RNA, 32 nt, Human
gcacucuagccuaggcuacagagcaggacccc

SEQ ID NO: 166548 - RNA, 32 nt, Human
gcacucuagccugagugacagagcagacuccu

SEQ ID NO: 166549 - RNA, 32 nt, Human
gcacucuagccuggcaacagagcgagauucca

SEQ ID NO: 166550 - RNA, 24 nt, Human
gcacucuagccugggcaacaagag

SEQ ID NO: 166551 - RNA, 32 nt, Human
gcacucuagccugggcaacagagcaaggcucu

SEQ ID NO: 166552 - RNA, 32 nt, Human
gcacucuaggagaaggaggggaaccagauguu

SEQ ID NO: 166553 - RNA, 32 nt, Human
gcacucuauuaagcugagggcagagaacuugg

SEQ ID NO: 166554 - RNA, 32 nt, Human
gcacucucaugcuugccgcaucaugccucccu

SEQ ID NO: 166555 - RNA, 32 nt, Human
gcacucuccagccuuuuccuggcugaggaggg

SEQ ID NO: 166556 - RNA, 32 nt, Human
gcacucucugcucugcuguuacucagccccug

SEQ ID NO: 166557 - RNA, 32 nt, Human
gcacucugccuugccagagauuggcuccagaa

SEQ ID NO: 166558 - RNA, 32 nt, Human
gcacucugcucgggggaggcaaggucauuccc

SEQ ID NO: 166559 - RNA, 32 nt, Human
gcacucugcuugcuuuccuaccaguccucccc

SEQ ID NO: 166560 - RNA, 32 nt, Human
gcacucuggaaccucuggccucaggggaccug

SEQ ID NO: 166561 - RNA, 32 nt, Human
gcacucugggaggcggaggcgguggaucacuu

SEQ ID NO: 166562 - RNA, 32 nt, Human
gcacucuggggcuucuccucuccuggagccca

SEQ ID NO: 166563 - RNA, 21 nt, Human
gcacucuggggggccaaggca

SEQ ID NO: 166564 - RNA, 32 nt, Human
gcacucuggggucagcagaguucaaaacgacc

SEQ ID NO: 166565 - RNA, 32 nt, Human
gcacucuggggugggagggucugcagggaauu

SEQ ID NO: 166566 - RNA, 32 nt, Human
gcacucugucuccuccccuccugccugggucc

SEQ ID NO: 166567 - RNA, 31 nt, Human
gcacucugucuucacagcaggagugcugucu

SEQ ID NO: 166568 - RNA, 32 nt, Human
gcacucugugagccauguccagucccuuuuau

SEQ ID NO: 166569 - RNA, 32 nt, Human
gcacucugugucuuguuuaucagcuuugccuc

SEQ ID NO: 166570 - RNA, 31 nt, Human
gcacucuucaugcucauucauuuaaagcauu

SEQ ID NO: 166571 - RNA, 32 nt, Human
gcacucuucauguaaucacauaugugcauaga

SEQ ID NO: 166572 - RNA, 32 nt, Human
gcacucuuccucuucuccuuuuuccgcacuuc

SEQ ID NO: 166573 - RNA, 32 nt, Human
gcacucuucucccacacauacacacacgugca

SEQ ID NO: 166574 - RNA, 32 nt, Human
gcacucuucucucuccaucucuccuuccuccc

SEQ ID NO: 166575 - RNA, 32 nt, Human
gcacucuuguagucccagcuauuugggaggcu

SEQ ID NO: 166576 - RNA, 32 nt, Human
gcacucuuguuugcuuucugcuucacuaucuu

SEQ ID NO: 166577 - RNA, 32 nt, Human
gcacugaaaaccucuccaccugggccaggguu

SEQ ID NO: 166578 - RNA, 24 nt, Human
gcacugaaauagcuuauggcccug

SEQ ID NO: 166579 - RNA, 32 nt, Human
gcacugaacaccaauucuuuacauuccuugaa

SEQ ID NO: 166580 - RNA, 32 nt, Human
gcacugaaccuaccucauccuccuggagggug

SEQ ID NO: 166581 - RNA, 21 nt, Human
gcacugaaccugggaaagaga

SEQ ID NO: 166582 - RNA, 32 nt, Human
gcacugaaccuuaaggcuuuguaugacaguga

SEQ ID NO: 166583 - RNA, 32 nt, Human
gcacugaaccuuaggcuuuguaugacagugaa

SEQ ID NO: 166584 - RNA, 32 nt, Human
gcacugaagguggaacaguugaaggcugagcu

SEQ ID NO: 166585 - RNA, 24 nt, Human
gcacugaaguauaauaaguaaccu

SEQ ID NO: 166586 - RNA, 22 nt, Human
gcacugaaguauuacauaaccu

SEQ ID NO: 166587 - RNA, 32 nt, Human
gcacugacagccaagcugcagcugcagacucg

SEQ ID NO: 166588 - RNA, 18 nt, Human
gcacugacaggaaaccuu

SEQ ID NO: 166589 - RNA, 32 nt, Human
gcacugaccacaccuguauagaccaugcacag

SEQ ID NO: 166590 - RNA, 32 nt, Human
gcacugaccaugagccucaacuccucccucag

SEQ ID NO: 166591 - RNA, 32 nt, Human
gcacugaccccugccccugccugggcccuccc

SEQ ID NO: 166592 - RNA, 32 nt, Human
gcacugaccugccuucugauuggaggcugguu

SEQ ID NO: 166593 - RNA, 32 nt, Human
gcacugagaaaagaauguaaggaugaauagac

SEQ ID NO: 166594 - RNA, 23 nt, Human
gcacugagaaacuccagaggcuu

SEQ ID NO: 166595 - RNA, 32 nt, Human
gcacugagaggagacacaaggagcagcccgca

SEQ ID NO: 166596 - RNA, 32 nt, Human
gcacugagcgcuuugcuucuucaagaguugcg

SEQ ID NO: 166597 - RNA, 32 nt, Human
gcacugagcuaggcagaggagccacagcugag

SEQ ID NO: 166598 - RNA, 32 nt, Human
gcacugagcuugcaaccagauccagagacacu

SEQ ID NO: 166599 - RNA, 20 nt, Human
gcacugaggacccccggaga

SEQ ID NO: 166600 - RNA, 32 nt, Human
gcacugaggagaaugguagagaggagaggaga

SEQ ID NO: 166601 - RNA, 32 nt, Human
gcacugaggcccuggagacagcuguuccacuu

SEQ ID NO: 166602 - RNA, 32 nt, Human
gcacugaggccggccaggucucggggcugccu

SEQ ID NO: 166603 - RNA, 32 nt, Human
gcacugagggaucugaguaggucugggaugga

SEQ ID NO: 166604 - RNA, 32 nt, Human
gcacugagggaugccaguucugccuguucauc

SEQ ID NO: 166605 - RNA, 20 nt, Human
gcacugagggcagaggcccc

SEQ ID NO: 166606 - RNA, 21 nt, Human
gcacugagggccuggcugccc

SEQ ID NO: 166607 - RNA, 32 nt, Human
gcacugaguuugaaugguauaaaaaguauaac

SEQ ID NO: 166608 - RNA, 32 nt, Human
gcacugauacaacauuaccauucuucuaugga

SEQ ID NO: 166609 - RNA, 19 nt, Human
gcacugaucacugugcuug

SEQ ID NO: 166610 - RNA, 32 nt, Human
gcacugaucuuugcaaaggagacuuaauuuca

SEQ ID NO: 166611 - RNA, 32 nt, Human
gcacugaugaggugcuggggaugacaggaagg

SEQ ID NO: 166612 - RNA, 32 nt, Human
gcacugauugcuaaaagaauaacugaauaagg

SEQ ID NO: 166613 - RNA, 21 nt, Human
gcacugauuguuuuagagacu

SEQ ID NO: 166614 - RNA, 32 nt, Human
gcacugcaacacaugcaggcagcuauuugggg

SEQ ID NO: 166615 - RNA, 32 nt, Human
gcacugcaagggcagucaugcccauuauacag

SEQ ID NO: 166616 - RNA, 31 nt, Human
gcacugcaaguguccccaggaggagcacaug

SEQ ID NO: 166617 - RNA, 32 nt, Human
gcacugcacaugcaucgugccguggagaguuu

SEQ ID NO: 166618 - RNA, 18 nt, Human
gcacugcaccugccucca

SEQ ID NO: 166619 - RNA, 32 nt, Human
gcacugcacugaggacccggugccggaggccg

SEQ ID NO: 166620 - RNA, 32 nt, Human
gcacugcagaucagcaaccucagccccaccug

SEQ ID NO: 166621 - RNA, 32 nt, Human
gcacugcagccuagacaacagagcaagacccu

SEQ ID NO: 166622 - RNA, 23 nt, Human
gcacugcagccugggcaacagaa

SEQ ID NO: 166623 - RNA, 25 nt, Human
gcacugcagccuugacccccucccu

SEQ ID NO: 166624 - RNA, 31 nt, Human
gcacugcaggggugucacacagcaggcacac

SEQ ID NO: 166625 - RNA, 32 nt, Human
gcacugcagucuccagccugagccaugggccg

SEQ ID NO: 166626 - RNA, 32 nt, Human
gcacugcaguggcaaaaauggaaacacugacc

SEQ ID NO: 166627 - RNA, 25 nt, Human
gcacugccacgguccuccaggaccu

SEQ ID NO: 166628 - RNA, 32 nt, Human
gcacugccacguauagcacugcagccuuggga

SEQ ID NO: 166629 - RNA, 32 nt, Human
gcacugccacugccuuuggccaccugagguga

SEQ ID NO: 166630 - RNA, 32 nt, Human
gcacugccagguagcugggggaguggcauggg

SEQ ID NO: 166631 - RNA, 32 nt, Human
gcacugccaguggagaugggcgucacuacugc

SEQ ID NO: 166632 - RNA, 32 nt, Human
gcacugccaucuuugagcagagcccagcucug

SEQ ID NO: 166633 - RNA, 32 nt, Human
gcacugccauuuugaggggagaagaaucaauu

SEQ ID NO: 166634 - RNA, 32 nt, Human
gcacugcccagcaacccggucacugcccagga

SEQ ID NO: 166635 - RNA, 21 nt, Human
gcacugcccagccggcugcgg

SEQ ID NO: 166636 - RNA, 32 nt, Human
gcacugccccaucccuggugcuacuggucuuu

SEQ ID NO: 166637 - RNA, 17 nt, Human
gcacugccccgccgcca

SEQ ID NO: 166638 - RNA, 32 nt, Human
gcacugccccuucagcuagccugccuccgucc

SEQ ID NO: 166639 - RNA, 32 nt, Human
gcacugcccgcugugccugccugcaagucuga

SEQ ID NO: 166640 - RNA, 32 nt, Human
gcacugcccugagcgugugcacaccuggccag

SEQ ID NO: 166641 - RNA, 32 nt, Human
gcacugcccugaggcagccucugccuaccuag

SEQ ID NO: 166642 - RNA, 32 nt, Human
gcacugcccuggcucuggguaaggacgagaag

SEQ ID NO: 166643 - RNA, 32 nt, Human
gcacugccgccacacuccccuccugggauggg

SEQ ID NO: 166644 - RNA, 32 nt, Human
gcacugccucuggcaccuggggcagccgcgcc

SEQ ID NO: 166645 - RNA, 32 nt, Human
gcacugccuuucucuguccccaugacuguccc

SEQ ID NO: 166646 - RNA, 32 nt, Human
gcacugccuuuggggcuggagggagacguggg

SEQ ID NO: 166647 - RNA, 32 nt, Human
gcacugcgcagguugcagcccaggcugcagga

SEQ ID NO: 166648 - RNA, 17 nt, Human
gcacugcggccgcgcgg

SEQ ID NO: 166649 - RNA, 32 nt, Human
gcacugcggccugguggcaguguggggaguca

SEQ ID NO: 166650 - RNA, 32 nt, Human
gcacugcuaccgccuggugguggagaaggcgg

SEQ ID NO: 166651 - RNA, 32 nt, Human
gcacugcucacuguggcccguguauucauucc

SEQ ID NO: 166652 - RNA, 32 nt, Human
gcacugcucaucugggcagaggaagcuucaga

SEQ ID NO: 166653 - RNA, 32 nt, Human
gcacugcuccccacucaccugugcucagggcg

SEQ ID NO: 166654 - RNA, 32 nt, Human
gcacugcucugccaagcccugucgaccaauua

SEQ ID NO: 166655 - RNA, 32 nt, Human
gcacugcugcacuccagccugcgggacagagu

SEQ ID NO: 166656 - RNA, 32 nt, Human
gcacugcugccuggucuccacaguagccuccc

SEQ ID NO: 166657 - RNA, 32 nt, Human
gcacugcugcucauagguaccuuuccgcugcc

SEQ ID NO: 166658 - RNA, 32 nt, Human
gcacugcuggggaaguuuguuggucuuuauua

SEQ ID NO: 166659 - RNA, 32 nt, Human
gcacugcuggggucagacaaggcuccauccaa

SEQ ID NO: 166660 - RNA, 32 nt, Human
gcacugcuguacccagccugggccacagugca

SEQ ID NO: 166661 - RNA, 32 nt, Human
gcacugcuuccucccuucuucaacggcaucuc

SEQ ID NO: 166662 - RNA, 32 nt, Human
gcacugcuucucggugucauugcagugugcug

SEQ ID NO: 166663 - RNA, 32 nt, Human
gcacuggaaauugcugcuggagccuggugaag

SEQ ID NO: 166664 - RNA, 19 nt, Human
gcacuggaaccaccuggac

SEQ ID NO: 166665 - RNA, 32 nt, Human
gcacuggaaggcccucccuuuggccugaguac

SEQ ID NO: 166666 - RNA, 19 nt, Human
gcacuggaaucaaaggcuc

SEQ ID NO: 166667 - RNA, 32 nt, Human
gcacuggacacugcucaucccugggugucagg

SEQ ID NO: 166668 - RNA, 32 nt, Human
gcacuggacagagaauguuacugugaauagag

SEQ ID NO: 166669 - RNA, 32 nt, Human
gcacuggacuuaguaucaggagcacugagcuc

SEQ ID NO: 166670 - RNA, 32 nt, Human
gcacuggagagggcggucgcaggagccugcga

SEQ ID NO: 166671 - RNA, 32 nt, Human
gcacuggagccaggcuggaagucaaguggcuu

SEQ ID NO: 166672 - RNA, 32 nt, Human
gcacuggaggauuucucagacacaugcaccag

SEQ ID NO: 166673 - RNA, 32 nt, Human
gcacuggaguuggugagcaugugcucucucuu

SEQ ID NO: 166674 - RNA, 32 nt, Human
gcacuggaugggcugcagcagaggcacugggg

SEQ ID NO: 166675 - RNA, 19 nt, Human
gcacuggcaccuaccacca

SEQ ID NO: 166676 - RNA, 32 nt, Human
gcacuggcagccucugggggaagccugcuccc

SEQ ID NO: 166677 - RNA, 32 nt, Human
gcacuggcagugaccaauuauuauuuuagaga

SEQ ID NO: 166678 - RNA, 32 nt, Human
gcacuggcaugcugggucauggggacagcacg

SEQ ID NO: 166679 - RNA, 32 nt, Human
gcacuggccagacccagccagggauccucgua

SEQ ID NO: 166680 - RNA, 19 nt, Human
gcacuggcccccaagguca

SEQ ID NO: 166681 - RNA, 32 nt, Human
gcacuggccugcccuauugucucccauccuag

SEQ ID NO: 166682 - RNA, 32 nt, Human
gcacuggccuuggacgguauugccugucagug

SEQ ID NO: 166683 - RNA, 19 nt, Human
gcacuggcgccagaggcuu

SEQ ID NO: 166684 - RNA, 22 nt, Human
gcacuggcucacgccuguaauc

SEQ ID NO: 166685 - RNA, 32 nt, Human
gcacuggcucauuuuaugugcaaagaaaagau

SEQ ID NO: 166686 - RNA, 32 nt, Human
gcacuggcuccgaguuccccuccugggauuug

SEQ ID NO: 166687 - RNA, 32 nt, Human
gcacuggcucucaggggccagcuccccauggg

SEQ ID NO: 166688 - RNA, 32 nt, Human
gcacuggcugccuggcugccuccuggaguggg

SEQ ID NO: 166689 - RNA, 32 nt, Human
gcacuggcugggaccauggugggcaggggcuu

SEQ ID NO: 166690 - RNA, 32 nt, Human
gcacuggcuucucuucucuguguccuuagcau

SEQ ID NO: 166691 - RNA, 32 nt, Human
gcacuggcuucuggacagcaaugagugcccgg

SEQ ID NO: 166692 - RNA, 16 nt, Human
gcacugggagaagccu

SEQ ID NO: 166693 - RNA, 32 nt, Human
gcacugggagcacagccagguucccccagacc

SEQ ID NO: 166694 - RNA, 32 nt, Human
gcacugggauucuucacucugccccucacuuc

SEQ ID NO: 166695 - RNA, 32 nt, Human
gcacugggcagccccuuggacugaggcaguuu

SEQ ID NO: 166696 - RNA, 32 nt, Human
gcacugggcguggugcaugccuguaaucccag

SEQ ID NO: 166697 - RNA, 32 nt, Human
gcacugggcugcaggugcagggcacgagcagg

SEQ ID NO: 166698 - RNA, 32 nt, Human
gcacugggcuuccugaccuaagcaguaugacu

SEQ ID NO: 166699 - RNA, 24 nt, Human
gcacugggcuucugcuuucugcuc

SEQ ID NO: 166700 - RNA, 32 nt, Human
gcacugggcuucugcuuucugcucuggcccac

SEQ ID NO: 166701 - RNA, 22 nt, Human
gcacuggggagcgcacugguga

SEQ ID NO: 166702 - RNA, 32 nt, Human
gcacuggggagucuuuguggauucugaggccc

SEQ ID NO: 166703 - RNA, 32 nt, Human
gcacuggggcaggggccgggggcagucugaga

SEQ ID NO: 166704 - RNA, 32 nt, Human
gcacuggggcuggggccugugccuuaucggcu

SEQ ID NO: 166705 - RNA, 32 nt, Human
gcacugggggcugggugcuggggaggggcugg

SEQ ID NO: 166706 - RNA, 20 nt, Human
gcacugggggcuucucccca

SEQ ID NO: 166707 - RNA, 32 nt, Human
gcacuggggugagggaugcaaugcggguuuau

SEQ ID NO: 166708 - RNA, 32 nt, Human
gcacuggggugcccugaauggcacggacaacc

SEQ ID NO: 166709 - RNA, 32 nt, Human
gcacuggggugggggagcaggagaaagccaga

SEQ ID NO: 166710 - RNA, 32 nt, Human
gcacuggguggaagaaggguaggagggcuauu

SEQ ID NO: 166711 - RNA, 23 nt, Human
gcacugguaaucccagguacuca

SEQ ID NO: 166712 - RNA, 32 nt, Human
gcacuggugaagcugccguggggucaggagga

SEQ ID NO: 166713 - RNA, 32 nt, Human
gcacuggugcaggagauuucagagugagagug

SEQ ID NO: 166714 - RNA, 32 nt, Human
gcacuggugcucaccucuaccuccuguccuca

SEQ ID NO: 166715 - RNA, 32 nt, Human
gcacuggugggauguggagucaggagcaacca

SEQ ID NO: 166716 - RNA, 32 nt, Human
gcacuggugguccuccuccuccucacucuucu

SEQ ID NO: 166717 - RNA, 32 nt, Human
gcacugguguggggcccaggagaggaccacgg

SEQ ID NO: 166718 - RNA, 32 nt, Human
gcacugguucucaaacuuuuuggucucagacc

SEQ ID NO: 166719 - RNA, 32 nt, Human
gcacugguuuagggacuuagagagguaggcac

SEQ ID NO: 166720 - RNA, 32 nt, Human
gcacuguaaaugcagccuucuuuucaaaacug

SEQ ID NO: 166721 - RNA, 32 nt, Human
gcacuguacuaaccuacagagaugcuaagaga

SEQ ID NO: 166722 - RNA, 32 nt, Human
gcacuguacuggguagagaagugccuauacuu

SEQ ID NO: 166723 - RNA, 18 nt, Human
gcacuguagcaaaagcca

SEQ ID NO: 166724 - RNA, 32 nt, Human
gcacuguagccucgccgucugugaauuggacc

SEQ ID NO: 166725 - RNA, 32 nt, Human
gcacuguaggcauguaccaccaugcccagcua

SEQ ID NO: 166726 - RNA, 32 nt, Human
gcacuguaggcggccgaggugggugaaucaca

SEQ ID NO: 166727 - RNA, 32 nt, Human
gcacugucacccaggcugcuggaguacagugg

SEQ ID NO: 166728 - RNA, 32 nt, Human
gcacugucacccaggcuggagugcaguggcau

SEQ ID NO: 166729 - RNA, 32 nt, Human
gcacugucacccaggcuggagugcaguggcgc

SEQ ID NO: 166730 - RNA, 32 nt, Human
gcacugucacccgggcuggagugcaauggcuc

SEQ ID NO: 166731 - RNA, 32 nt, Human
gcacugucacugcaaguccagcccccuuugcc

SEQ ID NO: 166732 - RNA, 32 nt, Human
gcacugucacugcccaccuccuugggccuccu

SEQ ID NO: 166733 - RNA, 32 nt, Human
gcacugucaugucuauuuccaugccuaacuca

SEQ ID NO: 166734 - RNA, 32 nt, Human
gcacuguccacccagggagaguccauuaagcc

SEQ ID NO: 166735 - RNA, 32 nt, Human
gcacugucccccaaggucgcggcagaggagau

SEQ ID NO: 166736 - RNA, 32 nt, Human
gcacugucccccaggcuggagugcaguggcau

SEQ ID NO: 166737 - RNA, 32 nt, Human
gcacugucgccuaggcuggagugcaacagugu

SEQ ID NO: 166738 - RNA, 32 nt, Human
gcacugucucccaggcuggacugcagcagcgc

SEQ ID NO: 166739 - RNA, 22 nt, Human
gcacugucucggcucacugcag

SEQ ID NO: 166740 - RNA, 32 nt, Human
gcacugucuuucccaucucuaucucuccucua

SEQ ID NO: 166741 - RNA, 32 nt, Human
gcacugugacggugcccaccucguggggugug

SEQ ID NO: 166742 - RNA, 32 nt, Human
gcacugugaggcggggcgauggggaagggccg

SEQ ID NO: 166743 - RNA, 32 nt, Human
gcacugugaugggaguccacggcuagggagga

SEQ ID NO: 166744 - RNA, 32 nt, Human
gcacugugaugggggcccucuccucugcugac

SEQ ID NO: 166745 - RNA, 32 nt, Human
gcacugugcaagacacuggggauaagaaauga

SEQ ID NO: 166746 - RNA, 32 nt, Human
gcacugugcugggagccagggggccugggagg

SEQ ID NO: 166747 - RNA, 20 nt, Human
gcacuguggcacugccacca

SEQ ID NO: 166748 - RNA, 32 nt, Human
gcacuguggccgaggcccaccugcugacaucu

SEQ ID NO: 166749 - RNA, 32 nt, Human
gcacuguggccuuggucuaacuuuugugugaa

SEQ ID NO: 166750 - RNA, 24 nt, Human
gcacuguggcucacgccuguaauc

SEQ ID NO: 166751 - RNA, 24 nt, Human
gcacuguggcucacuccuguaauc

SEQ ID NO: 166752 - RNA, 24 nt, Human
gcacuguggcuuacaccuauaauc

SEQ ID NO: 166753 - RNA, 32 nt, Human
gcacugugggaacagacacagagauggagaag

SEQ ID NO: 166754 - RNA, 32 nt, Human
gcacugugggaggccaagggggcagaucacuu

SEQ ID NO: 166755 - RNA, 32 nt, Human
gcacugugggaggcugaggugguuguauugcu

SEQ ID NO: 166756 - RNA, 21 nt, Human
gcacuguggggagucaaggca

SEQ ID NO: 166757 - RNA, 32 nt, Human
gcacugugggucccuggcaagugucuugugau

SEQ ID NO: 166758 - RNA, 24 nt, Human
gcacugugguucaugccuauaauc

SEQ ID NO: 166759 - RNA, 32 nt, Human
gcacuguguaccuaccagucuccagggacuau

SEQ ID NO: 166760 - RNA, 32 nt, Human
gcacugugucuugccuuucagaucuuaacaga

SEQ ID NO: 166761 - RNA, 32 nt, Human
gcacugugugagugugcacguguaugcacaca

SEQ ID NO: 166762 - RNA, 32 nt, Human
gcacuguguuccagaccgugucugacuuagug

SEQ ID NO: 166763 - RNA, 32 nt, Human
gcacuguuaucugagcaugaaagaacuggaaa

SEQ ID NO: 166764 - RNA, 32 nt, Human
gcacuguucaaccuccugaguggucgcuuuaa

SEQ ID NO: 166765 - RNA, 32 nt, Human
gcacuguugcccaggcuggacugcaguggcgu

SEQ ID NO: 166766 - RNA, 32 nt, Human
gcacuguugcccaggcuggagagcaguggcgc

SEQ ID NO: 166767 - RNA, 32 nt, Human
gcacuguugcccaggcuggagugcaguggcgu

SEQ ID NO: 166768 - RNA, 32 nt, Human
gcacuguugcccagugugggaguugguuuaaa

SEQ ID NO: 166769 - RNA, 32 nt, Human
gcacuguugcugacuacuacucugccaaucgg

SEQ ID NO: 166770 - RNA, 32 nt, Human
gcacuguuggggcucccauggcagggagaaua

SEQ ID NO: 166771 - RNA, 18 nt, Human
gcacuguuuucaaaguua

SEQ ID NO: 166772 - RNA, 32 nt, Human
gcacuuaaagcuuucagaauaugucagugcug

SEQ ID NO: 166773 - RNA, 32 nt, Human
gcacuuaaaugauguaauauuccaggaugcug

SEQ ID NO: 166774 - RNA, 32 nt, Human
gcacuuaaccacccagcaacuacuccuggaug

SEQ ID NO: 166775 - RNA, 32 nt, Human
gcacuuaaccauuucucuuucuucuuauggau

SEQ ID NO: 166776 - RNA, 20 nt, Human
gcacuuaaggggccaaggca

SEQ ID NO: 166777 - RNA, 32 nt, Human
gcacuuaauaccugcaauguuugcuacuguac

SEQ ID NO: 166778 - RNA, 32 nt, Human
gcacuuacagaagagucucuaaugaaaacacu

SEQ ID NO: 166779 - RNA, 32 nt, Human
gcacuuaccacacucugaggaagccugacucu

SEQ ID NO: 166780 - RNA, 32 nt, Human
gcacuuacggauucuggugggguguguuccaa

SEQ ID NO: 166781 - RNA, 32 nt, Human
gcacuuacugaaaucgcugguacucugaauaa

SEQ ID NO: 166782 - RNA, 32 nt, Human
gcacuuagaagaggacaggagauaguaaaagg

SEQ ID NO: 166783 - RNA, 20 nt, Human
gcacuuagaccugccagcca

SEQ ID NO: 166784 - RNA, 32 nt, Human
gcacuuagauauggaaaauggaagccaaauuu

SEQ ID NO: 166785 - RNA, 32 nt, Human
gcacuuagccucucccuuccuaauuucuagcc

SEQ ID NO: 166786 - RNA, 32 nt, Human
gcacuuagcucucccuggggacuuaaauuuug

SEQ ID NO: 166787 - RNA, 32 nt, Human
gcacuuaggagagagaggagggggaauaauag

SEQ ID NO: 166788 - RNA, 32 nt, Human
gcacuuaguaagucuucaucuaugcauguuuu

SEQ ID NO: 166789 - RNA, 32 nt, Human
gcacuuauguuacugguguccagcugaguuuc

SEQ ID NO: 166790 - RNA, 32 nt, Human
gcacuuauugcuuucugacagaauuauagaug

SEQ ID NO: 166791 - RNA, 23 nt, Human
gcacuuauuuauuguuguuggag

SEQ ID NO: 166792 - RNA, 32 nt, Human
gcacuucaaccuggucaacagagcgagacucc

SEQ ID NO: 166793 - RNA, 32 nt, Human
gcacuucagaggaggagccaggaucgaaugga

SEQ ID NO: 166794 - RNA, 32 nt, Human
gcacuucagaugagaauggagagguagggagc

SEQ ID NO: 166795 - RNA, 24 nt, Human
gcacuucagcccgggcaacaagag

SEQ ID NO: 166796 - RNA, 24 nt, Human
gcacuucagccugggcaacaagag

SEQ ID NO: 166797 - RNA, 32 nt, Human
gcacuucagccuggugacagagcgagacucgu

SEQ ID NO: 166798 - RNA, 32 nt, Human
gcacuucaggggcagagaguuucuaugaugug

SEQ ID NO: 166799 - RNA, 32 nt, Human
gcacuucaguccuauucaacauaguacuggaa

SEQ ID NO: 166800 - RNA, 32 nt, Human
gcacuucauccuaggcaacagagcgagacucu

SEQ ID NO: 166801 - RNA, 32 nt, Human
gcacuuccaacauuauuaaauaauaagaaagc

SEQ ID NO: 166802 - RNA, 32 nt, Human
gcacuuccaacuucuuguuugacaguguuauu

SEQ ID NO: 166803 - RNA, 32 nt, Human
gcacuuccagaaacuugacacacacgugcaca

SEQ ID NO: 166804 - RNA, 32 nt, Human
gcacuuccagcacuuugagaacgaguugaaua

SEQ ID NO: 166805 - RNA, 32 nt, Human
gcacuuccagccugggugacacagugagaccc

SEQ ID NO: 166806 - RNA, 32 nt, Human
gcacuuccagccugggugacagagugagaccc

SEQ ID NO: 166807 - RNA, 32 nt, Human
gcacuucccaggaucugcuccaacagaauauu

SEQ ID NO: 166808 - RNA, 32 nt, Human
gcacuucccugcuggggcagaggccaagccag

SEQ ID NO: 166809 - RNA, 27 nt, Human
gcacuuccgaaaaacacagcccugaca

SEQ ID NO: 166810 - RNA, 32 nt, Human
gcacuuccguucagauucauuuugcuaaucuc

SEQ ID NO: 166811 - RNA, 32 nt, Human
gcacuuccuccacagucccccacccaccuccu

SEQ ID NO: 166812 - RNA, 17 nt, Human
gcacuuccucuugcccu

SEQ ID NO: 166813 - RNA, 32 nt, Human
gcacuuccugucugauguccaggaugucacau

SEQ ID NO: 166814 - RNA, 32 nt, Human
gcacuuccuucucggcuagauuaucugaaacu

SEQ ID NO: 166815 - RNA, 32 nt, Human
gcacuuccuuuguuuucuuucugccauagggu

SEQ ID NO: 166816 - RNA, 18 nt, Human
gcacuuccuuuugcugcc

SEQ ID NO: 166817 - RNA, 32 nt, Human
gcacuucgcauuuuggcauugacauuuaauuu

SEQ ID NO: 166818 - RNA, 32 nt, Human
gcacuucgccacugucuccaucagugcuguug

SEQ ID NO: 166819 - RNA, 32 nt, Human
gcacuucgggaggcugaagugggaagauccag

SEQ ID NO: 166820 - RNA, 32 nt, Human
gcacuucuccaccccucccacauuuacagcca

SEQ ID NO: 166821 - RNA, 31 nt, Human
gcacuucuccucucugggccuuggcuuggga

SEQ ID NO: 166822 - RNA, 32 nt, Human
gcacuucucgcacauccucacguggcccuuau

SEQ ID NO: 166823 - RNA, 32 nt, Human
gcacuucucuccccaucgcuccacaaccugaa

SEQ ID NO: 166824 - RNA, 32 nt, Human
gcacuucugauagucagcauucucccugacac

SEQ ID NO: 166825 - RNA, 32 nt, Human
gcacuucugcccaggcagcagggugggugggu

SEQ ID NO: 166826 - RNA, 32 nt, Human
gcacuucugcccgggcugccucucccccgcua

SEQ ID NO: 166827 - RNA, 32 nt, Human
gcacuucugcucuccucuaccagaaucacuca

SEQ ID NO: 166828 - RNA, 19 nt, Human
gcacuucugcucucuggca

SEQ ID NO: 166829 - RNA, 32 nt, Human
gcacuucugucaagccucccccgccccaauug

SEQ ID NO: 166830 - RNA, 32 nt, Human
gcacuucugucuccccggagcagcuccuccag

SEQ ID NO: 166831 - RNA, 32 nt, Human
gcacuucuugcccaggcuggaguacaauggug

SEQ ID NO: 166832 - RNA, 32 nt, Human
gcacuugaacccaggaggcagugguugcaaug

SEQ ID NO: 166833 - RNA, 32 nt, Human
gcacuugacagcucucccucugugcugggcug

SEQ ID NO: 166834 - RNA, 32 nt, Human
gcacuugacccuauuugaauucugagcauuau

SEQ ID NO: 166835 - RNA, 32 nt, Human
gcacuugaguuuacaccuuagauguguagguc

SEQ ID NO: 166836 - RNA, 32 nt, Human
gcacuugccccgggacacccugugcuggcuuu

SEQ ID NO: 166837 - RNA, 32 nt, Human
gcacuugccuguagucucagcuacuuaggagg

SEQ ID NO: 166838 - RNA, 20 nt, Human
gcacuugcuucccuauggcc

SEQ ID NO: 166839 - RNA, 32 nt, Human
gcacuuggaagagaguuuauguucuguugaaa

SEQ ID NO: 166840 - RNA, 32 nt, Human
gcacuuggagcagcaaaauagggcacugacag

SEQ ID NO: 166841 - RNA, 32 nt, Human
gcacuuggagccaaggguucagagacucaggg

SEQ ID NO: 166842 - RNA, 32 nt, Human
gcacuuggagcugggggacccacccaccgucu

SEQ ID NO: 166843 - RNA, 32 nt, Human
gcacuuggagggcugggaagacccaugcugua

SEQ ID NO: 166844 - RNA, 30 nt, Human
gcacuuggccucuccauaagccuuggaggg

SEQ ID NO: 166845 - RNA, 32 nt, Human
gcacuuggcuccagucaccaguguggagagaa

SEQ ID NO: 166846 - RNA, 32 nt, Human
gcacuuggcuccuggcagagggagaggacagg

SEQ ID NO: 166847 - RNA, 32 nt, Human
gcacuugggaagcccaggcgggcggaucacuu

SEQ ID NO: 166848 - RNA, 32 nt, Human
gcacuugggguccagaggcagggccuuccuug

SEQ ID NO: 166849 - RNA, 32 nt, Human
gcacuugguggagguaguaggggcagggaaag

SEQ ID NO: 166850 - RNA, 32 nt, Human
gcacuuguaaacaucuuuugaaugaagcccua

SEQ ID NO: 166851 - RNA, 22 nt, Human
gcacuuguaaucccagcuacuc

SEQ ID NO: 166852 - RNA, 23 nt, Human
gcacuuguagucccagcuacuca

SEQ ID NO: 166853 - RNA, 32 nt, Human
gcacuugucacccaggcuggagugcaauggug

SEQ ID NO: 166854 - RNA, 32 nt, Human
gcacuugugaugccuccaugccccgagggccu

SEQ ID NO: 166855 - RNA, 32 nt, Human
gcacuuguuccuucugcuucucccuagcugac

SEQ ID NO: 166856 - RNA, 32 nt, Human
gcacuuguucucucuggcucaguuccuucucc

SEQ ID NO: 166857 - RNA, 32 nt, Human
gcacuuguugcccaggcuggagugcaauggua

SEQ ID NO: 166858 - RNA, 32 nt, Human
gcacuuguuuucaugcaggagcggggcaagua

SEQ ID NO: 166859 - RNA, 32 nt, Human
gcacuuuacuuccugacuccuuuccuuuuucc

SEQ ID NO: 166860 - RNA, 32 nt, Human
gcacuuuagggauuguagauggcuacaagcag

SEQ ID NO: 166861 - RNA, 32 nt, Human
gcacuuucacccagaaccaaugcgguguuucu

SEQ ID NO: 166862 - RNA, 32 nt, Human
gcacuuucagggauguggucagauucgagguu

SEQ ID NO: 166863 - RNA, 32 nt, Human
gcacuuucccuggaguggaagcugcuggaagg

SEQ ID NO: 166864 - RNA, 32 nt, Human
gcacuuucuauccucuguaaacuuuuugugcu

SEQ ID NO: 166865 - RNA, 32 nt, Human
gcacuuucuccucccuugucaguuugcaaagu

SEQ ID NO: 166866 - RNA, 32 nt, Human
gcacuuucugagaaaccuuuguccucacuuga

SEQ ID NO: 166867 - RNA, 32 nt, Human
gcacuuucugguuugaccuccuaauaccacaa

SEQ ID NO: 166868 - RNA, 32 nt, Human
gcacuuugcaaaagccucugcccuuccaucuc

SEQ ID NO: 166869 - RNA, 32 nt, Human
gcacuuugcucagcacgucuucccaggccucc

SEQ ID NO: 166870 - RNA, 32 nt, Human
gcacuuuggaacaggcccagguucucccacca

SEQ ID NO: 166871 - RNA, 32 nt, Human
gcacuuuggaaugccaaggcagguggaucacc

SEQ ID NO: 166872 - RNA, 32 nt, Human
gcacuuuggaggccgaggcggguagaucaccu

SEQ ID NO: 166873 - RNA, 32 nt, Human
gcacuuuggcaggccaagguggaaggaucacu

SEQ ID NO: 166874 - RNA, 32 nt, Human
gcacuuuggcaggccgaggcagguggaucacc

SEQ ID NO: 166875 - RNA, 32 nt, Human
gcacuuugggagacugaggugggagcaucacu

SEQ ID NO: 166876 - RNA, 21 nt, Human
gcacuuugggagccccaggug

SEQ ID NO: 166877 - RNA, 32 nt, Human
gcacuuugggaggcagaggccgguggguugcu

SEQ ID NO: 166878 - RNA, 32 nt, Human
gcacuuugggaggccaaagugggagaucaucu

SEQ ID NO: 166879 - RNA, 32 nt, Human
gcacuuugggaggccaagauggguggaucacc

SEQ ID NO: 166880 - RNA, 32 nt, Human
gcacuuugggaggccaagggaggcggaucacc

SEQ ID NO: 166881 - RNA, 32 nt, Human
gcacuuugggaggccaaggugaguggaucacc

SEQ ID NO: 166882 - RNA, 32 nt, Human
gcacuuugggaggccaaggugggugaaucacc

SEQ ID NO: 166883 - RNA, 32 nt, Human
gcacuuugggaggccgaagugggcagaucacu

SEQ ID NO: 166884 - RNA, 32 nt, Human
gcacuuugggaggccgaaguggguggaucacc

SEQ ID NO: 166885 - RNA, 32 nt, Human
gcacuuugggaggccgaaguggguggaucacu

SEQ ID NO: 166886 - RNA, 32 nt, Human
gcacuuugggaggccgagaugggugaaucaug

SEQ ID NO: 166887 - RNA, 32 nt, Human
gcacuuugggaggccgagauggguggaucacc

SEQ ID NO: 166888 - RNA, 32 nt, Human
gcacuuugggaggccgagauggguggaucaug

SEQ ID NO: 166889 - RNA, 32 nt, Human
gcacuuugggaggccgaggccaguggaucacc

SEQ ID NO: 166890 - RNA, 32 nt, Human
gcacuuugggaggccgaggccggugauucaca

SEQ ID NO: 166891 - RNA, 32 nt, Human
gcacuuugggaggccgaggccgguggaucacu

SEQ ID NO: 166892 - RNA, 32 nt, Human
gcacuuugggaggccgaggcgaguggaucacg

SEQ ID NO: 166893 - RNA, 32 nt, Human
gcacuuugggaggccgaggcgaguggauuucc

SEQ ID NO: 166894 - RNA, 32 nt, Human
gcacuuugggaggccgaggcgggcagaugacc

SEQ ID NO: 166895 - RNA, 32 nt, Human
gcacuuugggaggccgaggggaguggaucacc

SEQ ID NO: 166896 - RNA, 32 nt, Human
gcacuuugggaggccgaggggaguggaucacu

SEQ ID NO: 166897 - RNA, 32 nt, Human
gcacuuugggaggccgaggugaguggaucacc

SEQ ID NO: 166898 - RNA, 32 nt, Human
gcacuuugggaggccgaggugcauggaucacu

SEQ ID NO: 166899 - RNA, 32 nt, Human
gcacuuugggaggccgaggugggugaaucacc

SEQ ID NO: 166900 - RNA, 32 nt, Human
gcacuuugggaggccgagguggguggaucagu

SEQ ID NO: 166901 - RNA, 32 nt, Human
gcacuuugggaggcggaggagggcgcauugcu

SEQ ID NO: 166902 - RNA, 32 nt, Human
gcacuuugggaggcuaggugggcagaucacga

SEQ ID NO: 166903 - RNA, 32 nt, Human
gcacuuugggaggcugaagugggcagaucacg

SEQ ID NO: 166904 - RNA, 32 nt, Human
gcacuuugggaggcugaaguggguggaucaca

SEQ ID NO: 166905 - RNA, 32 nt, Human
gcacuuugggaggcugaaguggguggaucacc

SEQ ID NO: 166906 - RNA, 32 nt, Human
gcacuuugggaggcugaggagagcagaucacu

SEQ ID NO: 166907 - RNA, 32 nt, Human
gcacuuugggaggcugaggcaaguggaucacu

SEQ ID NO: 166908 - RNA, 32 nt, Human
gcacuuugggaggcugaggccgguggaucacc

SEQ ID NO: 166909 - RNA, 32 nt, Human
gcacuuugggaggcugaggcgaguggaucaca

SEQ ID NO: 166910 - RNA, 32 nt, Human
gcacuuugggaggcugagggaggcggaucacu

SEQ ID NO: 166911 - RNA, 32 nt, Human
gcacuuugggaggcugaggugaguggauuaca

SEQ ID NO: 166912 - RNA, 32 nt, Human
gcacuuuggggaggggugggacaaacugcaag

SEQ ID NO: 166913 - RNA, 23 nt, Human
gcacuuugggggaggcccaggug

SEQ ID NO: 166914 - RNA, 20 nt, Human
gcacuuuguccuugccacca

SEQ ID NO: 166915 - RNA, 32 nt, Human
gcacuuuguuagcaaugcauuuuccugcauuu

SEQ ID NO: 166916 - RNA, 32 nt, Human
gcacuuuguugacgugguggugagagcacacg

SEQ ID NO: 166917 - RNA, 32 nt, Human
gcacuuuguuuuaaauguggagaagauaacac

SEQ ID NO: 166918 - RNA, 32 nt, Human
gcacuuuuaaaaauagagaaaugagugaaugu

SEQ ID NO: 166919 - RNA, 32 nt, Human
gcacuuuuagguaaucugcacuguuuguuuga

SEQ ID NO: 166920 - RNA, 32 nt, Human
gcacuuuucaugccucagccuccugaguagcu

SEQ ID NO: 166921 - RNA, 32 nt, Human
gcacuuuuccaaugggcaagcccaguggaggc

SEQ ID NO: 166922 - RNA, 32 nt, Human
gcacuuuuccccaaguucuuguuuuuauuuuu

SEQ ID NO: 166923 - RNA, 22 nt, Human
gcacuuuucuguguguauguua

SEQ ID NO: 166924 - RNA, 32 nt, Human
gcacuuuugaacuugacaucaaacuuucugau

SEQ ID NO: 166925 - RNA, 32 nt, Human
gcacuuuugaggcugaggcgggcggauuaccu

SEQ ID NO: 166926 - RNA, 32 nt, Human
gcacuuuugcacuaccaaccacuuuaaaccaa

SEQ ID NO: 166927 - RNA, 32 nt, Human
gcacuuuugggaggcagagaugggaggauacu

SEQ ID NO: 166928 - RNA, 32 nt, Human
gcacuuuuguuaaacucaaacaugcucuuugu

SEQ ID NO: 166929 - RNA, 32 nt, Human
gcacuuuuuaacaacaugaaacuauaaaccau

SEQ ID NO: 166930 - RNA, 32 nt, Human
gcacuuuuucccugcuugauuccaagaguagg

SEQ ID NO: 166931 - RNA, 32 nt, Human
gcacuuuuuguaguuuccgaaaauuaccaucu

SEQ ID NO: 166932 - RNA, 32 nt, Human
gcagaaaaacacaaaaagagaacacugguuca

SEQ ID NO: 166933 - RNA, 32 nt, Human
gcagaaaaacauuuguaauaauuaauggcuuu

SEQ ID NO: 166934 - RNA, 32 nt, Human
gcagaaaaagugggggagguggagggggaggc

SEQ ID NO: 166935 - RNA, 32 nt, Human
gcagaaaacagaaacgcgcacauaccgaccaa

SEQ ID NO: 166936 - RNA, 32 nt, Human
gcagaaaacagaaauagcuaaaugugacucag

SEQ ID NO: 166937 - RNA, 32 nt, Human
gcagaaaacagcuucacuccucaggaaguacc

SEQ ID NO: 166938 - RNA, 32 nt, Human
gcagaaaaccaccaaaaggccagugccucaac

SEQ ID NO: 166939 - RNA, 18 nt, Human
gcagaaaagcucccacca

SEQ ID NO: 166940 - RNA, 32 nt, Human
gcagaaaaggcaguugaaggaggcagagaagg

SEQ ID NO: 166941 - RNA, 32 nt, Human
gcagaaaagggccugccuccugaggggugugu

SEQ ID NO: 166942 - RNA, 32 nt, Human
gcagaaaauugacaaugccugccuguguaaau

SEQ ID NO: 166943 - RNA, 32 nt, Human
gcagaaacacagaaagcugucuucugagucuc

SEQ ID NO: 166944 - RNA, 32 nt, Human
gcagaaacaguggauuaagacuuccugagcga

SEQ ID NO: 166945 - RNA, 17 nt, Human
gcagaaacaugcuuucc

SEQ ID NO: 166946 - RNA, 26 nt, Human
gcagaaacauggaaugccagacgcug

SEQ ID NO: 166947 - RNA, 32 nt, Human
gcagaaacauggucaguauaagaauacugaga

SEQ ID NO: 166948 - RNA, 32 nt, Human
gcagaaacauguucauuuucccaugaaggaac

SEQ ID NO: 166949 - RNA, 23 nt, Human
gcagaaaccaugugcagaggcug

SEQ ID NO: 166950 - RNA, 32 nt, Human
gcagaaaccuaucucagggagggaaggggaug

SEQ ID NO: 166951 - RNA, 32 nt, Human
gcagaaagagaugguuaguacaguuguucugu

SEQ ID NO: 166952 - RNA, 32 nt, Human
gcagaaagagggacuccucucucccuccgugu

SEQ ID NO: 166953 - RNA, 17 nt, Human
gcagaaagaugcucucc

SEQ ID NO: 166954 - RNA, 32 nt, Human
gcagaaagcaaaggggaugcagaggugaaggu

SEQ ID NO: 166955 - RNA, 32 nt, Human
gcagaaagcaugaucggagaagagauauuuua

SEQ ID NO: 166956 - RNA, 32 nt, Human
gcagaaagcugugaaaugucuugugucuuaug

SEQ ID NO: 166957 - RNA, 32 nt, Human
gcagaaaggaaacugcacaguguccccaggag

SEQ ID NO: 166958 - RNA, 32 nt, Human
gcagaaaggaagcgggugcaggagccagugcu

SEQ ID NO: 166959 - RNA, 32 nt, Human
gcagaaaggaccugcauuuuccuacauugagg

SEQ ID NO: 166960 - RNA, 32 nt, Human
gcagaaaggagagagagggaucugauggcaaa

SEQ ID NO: 166961 - RNA, 32 nt, Human
gcagaaaggagagaugugugcagagugagacc

SEQ ID NO: 166962 - RNA, 22 nt, Human
gcagaaaggagugccugcacag

SEQ ID NO: 166963 - RNA, 32 nt, Human
gcagaaagggcugcggaggcagugagugguuu

SEQ ID NO: 166964 - RNA, 32 nt, Human
gcagaaaggggucugugcugccucuaaaggau

SEQ ID NO: 166965 - RNA, 32 nt, Human
gcagaaagguugcaaugccucacuuugccuua

SEQ ID NO: 166966 - RNA, 21 nt, Human
gcagaaaguccuggaaaagua

SEQ ID NO: 166967 - RNA, 32 nt, Human
gcagaaagugccugugcaucagcauuccccgu

SEQ ID NO: 166968 - RNA, 32 nt, Human
gcagaaauaaugguuggcaaagcaguggaaca

SEQ ID NO: 166969 - RNA, 32 nt, Human
gcagaaauacauaggaugaaaaauaccaagau

SEQ ID NO: 166970 - RNA, 32 nt, Human
gcagaaauaguugucugugcuuccuugguuca

SEQ ID NO: 166971 - RNA, 22 nt, Human
gcagaaaugguaaugagaguga

SEQ ID NO: 166972 - RNA, 32 nt, Human
gcagaaauuaacucucugucauggccucucuu

SEQ ID NO: 166973 - RNA, 32 nt, Human
gcagaaauucagaacccccuguccugaaggug

SEQ ID NO: 166974 - RNA, 32 nt, Human
gcagaacaagggcaagaaacucggugcccgcc

SEQ ID NO: 166975 - RNA, 32 nt, Human
gcagaacacacguuucuaagugcacagggaac

SEQ ID NO: 166976 - RNA, 32 nt, Human
gcagaacacaugcacaaacucaugccauaccc

SEQ ID NO: 166977 - RNA, 32 nt, Human
gcagaacacugcacuccaauuuccucgggcag

SEQ ID NO: 166978 - RNA, 21 nt, Human
gcagaacagaacacuuucuca

SEQ ID NO: 166979 - RNA, 32 nt, Human
gcagaacagccugucuguucugcuccuagaca

SEQ ID NO: 166980 - RNA, 32 nt, Human
gcagaacagcgaaaagaauaaagggaaagggg

SEQ ID NO: 166981 - RNA, 32 nt, Human
gcagaacaggcagaagggauggaauuuggcuu

SEQ ID NO: 166982 - RNA, 32 nt, Human
gcagaacaggcagagaugcuacgcaaugauuc

SEQ ID NO: 166983 - RNA, 32 nt, Human
gcagaacagggugggcggcucgcaggggcgcu

SEQ ID NO: 166984 - RNA, 32 nt, Human
gcagaacagugagagcuucauuuugugauucu

SEQ ID NO: 166985 - RNA, 32 nt, Human
gcagaacagugaucuugggggaggaagaggau

SEQ ID NO: 166986 - RNA, 32 nt, Human
gcagaacauacuagggagaugcacccagagcc

SEQ ID NO: 166987 - RNA, 32 nt, Human
gcagaacaucaacuccuccuucaaggggaaca

SEQ ID NO: 166988 - RNA, 32 nt, Human
gcagaacauugucaccuccugaggcugugggc

SEQ ID NO: 166989 - RNA, 32 nt, Human
gcagaaccaaaucaguuugcccugccauauuu

SEQ ID NO: 166990 - RNA, 20 nt, Human
gcagaaccacuccucaggga

SEQ ID NO: 166991 - RNA, 32 nt, Human
gcagaaccagaguagagauugacagugagcug

SEQ ID NO: 166992 - RNA, 32 nt, Human
gcagaaccauacagauuuuguucuccauuuca

SEQ ID NO: 166993 - RNA, 32 nt, Human
gcagaaccaucaggaacagccugccuggcucc

SEQ ID NO: 166994 - RNA, 32 nt, Human
gcagaaccaugagggugcaccagcacggaccc

SEQ ID NO: 166995 - RNA, 32 nt, Human
gcagaacccagccucugcucacacccgcccca

SEQ ID NO: 166996 - RNA, 22 nt, Human
gcagaacccagugcacguccuc

SEQ ID NO: 166997 - RNA, 18 nt, Human
gcagaaccccauguccuc

SEQ ID NO: 166998 - RNA, 32 nt, Human
gcagaacccugagagguguccaucuucuugcu

SEQ ID NO: 166999 - RNA, 32 nt, Human
gcagaaccucaccuuuaggucucccucauccc

SEQ ID NO: 167000 - RNA, 32 nt, Human
gcagaaccuccaggagcacccaggcuugggca

SEQ ID NO: 167001 - RNA, 20 nt, Human
gcagaaccuccugaacgucu

SEQ ID NO: 167002 - RNA, 19 nt, Human
gcagaacuacaaagaugag

SEQ ID NO: 167003 - RNA, 32 nt, Human
gcagaacuagggccucuccccuggugaagacc

SEQ ID NO: 167004 - RNA, 32 nt, Human
gcagaacucuguucccaggcaccacaagaaua

SEQ ID NO: 167005 - RNA, 32 nt, Human
gcagaacucuucucuccccaucaugggccaca

SEQ ID NO: 167006 - RNA, 32 nt, Human
gcagaacugauucuccagcccugguagcauuu

SEQ ID NO: 167007 - RNA, 32 nt, Human
gcagaacugcaaccuuuuguaccuuucuuugg

SEQ ID NO: 167008 - RNA, 32 nt, Human
gcagaacugcucaugcuagcaaggcccaccuu

SEQ ID NO: 167009 - RNA, 24 nt, Human
gcagaacuggaccccagggguguc

SEQ ID NO: 167010 - RNA, 32 nt, Human
gcagaacugggauguggagcuggaagugccuc

SEQ ID NO: 167011 - RNA, 32 nt, Human
gcagaacuuccagaggaaaucgacaucuccac

SEQ ID NO: 167012 - RNA, 32 nt, Human
gcagaacuucuccaugucaagcagcagguguc

SEQ ID NO: 167013 - RNA, 20 nt, Human
gcagaagaaccagcuucggg

SEQ ID NO: 167014 - RNA, 32 nt, Human
gcagaagaauacagccuugcacaaucauuuuu

SEQ ID NO: 167015 - RNA, 32 nt, Human
gcagaagaauaugacagaugucagcuucuccc

SEQ ID NO: 167016 - RNA, 32 nt, Human
gcagaagaauuggaguuggaagguugcauagg

SEQ ID NO: 167017 - RNA, 32 nt, Human
gcagaagacaaaauuaacauauacaaguuaau

SEQ ID NO: 167018 - RNA, 32 nt, Human
gcagaagaccuccaggaguucauucuucuuau

SEQ ID NO: 167019 - RNA, 32 nt, Human
gcagaagacuggagaggagcuaagggggucgg

SEQ ID NO: 167020 - RNA, 32 nt, Human
gcagaagagaaaagcuggaggaaggccguggg

SEQ ID NO: 167021 - RNA, 32 nt, Human
gcagaagagaaacugagucaccagcuuaggag

SEQ ID NO: 167022 - RNA, 32 nt, Human
gcagaagagauggaaccaaaauagcgggcagg

SEQ ID NO: 167023 - RNA, 32 nt, Human
gcagaagagauggaugaauggaaggacacaca

SEQ ID NO: 167024 - RNA, 32 nt, Human
gcagaagaggccuggaugcacaccuggcacgc

SEQ ID NO: 167025 - RNA, 32 nt, Human
gcagaagaguaccgugagggaggcggggacca

SEQ ID NO: 167026 - RNA, 21 nt, Human
gcagaagaucuuggagagugg

SEQ ID NO: 167027 - RNA, 22 nt, Human
gcagaagauggcccugaugucc

SEQ ID NO: 167028 - RNA, 32 nt, Human
gcagaagcagagccacugugaaguaagacacu

SEQ ID NO: 167029 - RNA, 24 nt, Human
gcagaagcaggaggaucauuugag

SEQ ID NO: 167030 - RNA, 32 nt, Human
gcagaagcaggcagcggcagagagggaauggu

SEQ ID NO: 167031 - RNA, 32 nt, Human
gcagaagccacagcagccucuguccagccugc

SEQ ID NO: 167032 - RNA, 32 nt, Human
gcagaagccagcccccaaccccagcccuuccg

SEQ ID NO: 167033 - RNA, 32 nt, Human
gcagaagccccacugcaugaaggccugagugc

SEQ ID NO: 167034 - RNA, 18 nt, Human
gcagaagcgcgugcguug

SEQ ID NO: 167035 - RNA, 32 nt, Human
gcagaagcgggagcugccccagagagucugug

SEQ ID NO: 167036 - RNA, 32 nt, Human
gcagaagcucggcgaccucccaccccgagucu

SEQ ID NO: 167037 - RNA, 32 nt, Human
gcagaagcucuaucuuugauugcugccaucca

SEQ ID NO: 167038 - RNA, 32 nt, Human
gcagaagcugcagagaauuuucugccugacga

SEQ ID NO: 167039 - RNA, 17 nt, Human
gcagaagcugccuguga

SEQ ID NO: 167040 - RNA, 32 nt, Human
gcagaagcugcugaagcacggggugaacuugc

SEQ ID NO: 167041 - RNA, 19 nt, Human
gcagaagcugucugaggca

SEQ ID NO: 167042 - RNA, 32 nt, Human
gcagaagcuuacaaccugggacaagguguuag

SEQ ID NO: 167043 - RNA, 23 nt, Human
gcagaaggaaagggcgauggugg

SEQ ID NO: 167044 - RNA, 23 nt, Human
gcagaaggaaauacuuggcagca

SEQ ID NO: 167045 - RNA, 22 nt, Human
gcagaaggaaccugagcaggac

SEQ ID NO: 167046 - RNA, 24 nt, Human
gcagaaggaacuucaaggagauga

SEQ ID NO: 167047 - RNA, 32 nt, Human
gcagaaggaaggcagggaggaggcagagaaga

SEQ ID NO: 167048 - RNA, 23 nt, Human
gcagaaggaauggaaugcuacag

SEQ ID NO: 167049 - RNA, 32 nt, Human
gcagaaggacaagcucuucaugaugcacugcg

SEQ ID NO: 167050 - RNA, 32 nt, Human
gcagaaggacagaagagaaaagacuugaguaa

SEQ ID NO: 167051 - RNA, 24 nt, Human
gcagaaggaggagaagcugaggcu

SEQ ID NO: 167052 - RNA, 21 nt, Human
gcagaaggaggcacugcuaca

SEQ ID NO: 167053 - RNA, 24 nt, Human
gcagaaggaucaccugaagucagg

SEQ ID NO: 167054 - RNA, 24 nt, Human
gcagaaggaucacuugagaccagg

SEQ ID NO: 167055 - RNA, 32 nt, Human
gcagaaggaucucuggagcccaggaguucgag

SEQ ID NO: 167056 - RNA, 32 nt, Human
gcagaaggaucucuugagccaggaguuugaga

SEQ ID NO: 167057 - RNA, 23 nt, Human
gcagaaggauggcagaugaguga

SEQ ID NO: 167058 - RNA, 32 nt, Human
gcagaaggcacaggagcugggccugguggagc

SEQ ID NO: 167059 - RNA, 32 nt, Human
gcagaaggccuuggugcacacccaggggccau

SEQ ID NO: 167060 - RNA, 23 nt, Human
gcagaaggcgcugccugccacag

SEQ ID NO: 167061 - RNA, 23 nt, Human
gcagaagggaauuggagcaguga

SEQ ID NO: 167062 - RNA, 21 nt, Human
gcagaagggcaggaacaguga

SEQ ID NO: 167063 - RNA, 32 nt, Human
gcagaagggccuuccccuggacccucagagca

SEQ ID NO: 167064 - RNA, 32 nt, Human
gcagaagggcgguugcugcagcuuuggccgag

SEQ ID NO: 167065 - RNA, 32 nt, Human
gcagaaggggcacggcccgcaugcauucucaa

SEQ ID NO: 167066 - RNA, 18 nt, Human
gcagaaggggcagagagu

SEQ ID NO: 167067 - RNA, 22 nt, Human
gcagaaggggcucggaaagugg

SEQ ID NO: 167068 - RNA, 17 nt, Human
gcagaagguccguggcc

SEQ ID NO: 167069 - RNA, 32 nt, Human
gcagaagguccugguucucugggaucugcggu

SEQ ID NO: 167070 - RNA, 32 nt, Human
gcagaagguggaaggugggaacagagguuuag

SEQ ID NO: 167071 - RNA, 20 nt, Human
gcagaagguucccugagguc

SEQ ID NO: 167072 - RNA, 32 nt, Human
gcagaaguaaaggaaucucacguugugagggu

SEQ ID NO: 167073 - RNA, 32 nt, Human
gcagaaguaggauugugaacccagggaaucuc

SEQ ID NO: 167074 - RNA, 32 nt, Human
gcagaagugaagccccgcaggggaggccacag

SEQ ID NO: 167075 - RNA, 32 nt, Human
gcagaagugcaucgugaucuuugcccuggugu

SEQ ID NO: 167076 - RNA, 18 nt, Human
gcagaaguggcugggcca

SEQ ID NO: 167077 - RNA, 32 nt, Human
gcagaagugggagcuucucccuuccuuccauc

SEQ ID NO: 167078 - RNA, 32 nt, Human
gcagaaguguggcaaaugcaucaggaaccggu

SEQ ID NO: 167079 - RNA, 32 nt, Human
gcagaaguugaugugcugagcagcagccuuau

SEQ ID NO: 167080 - RNA, 32 nt, Human
gcagaauaauacaucacucugcuccaggagca

SEQ ID NO: 167081 - RNA, 32 nt, Human
gcagaauaaucgcuugaacccaggaggcagag

SEQ ID NO: 167082 - RNA, 19 nt, Human
gcagaauaauuggugcuug

SEQ ID NO: 167083 - RNA, 18 nt, Human
gcagaauacaacgcauug

SEQ ID NO: 167084 - RNA, 15 nt, Human
gcagaauaccaggca

SEQ ID NO: 167085 - RNA, 32 nt, Human
gcagaauagauaaaacacagguuuccacuaau

SEQ ID NO: 167086 - RNA, 32 nt, Human
gcagaauaggugcagagaugaagugagcuuag

SEQ ID NO: 167087 - RNA, 17 nt, Human
gcagaauaucaaaguca

SEQ ID NO: 167088 - RNA, 18 nt, Human
gcagaauaugcaugcauu

SEQ ID NO: 167089 - RNA, 32 nt, Human
gcagaaucaauccagucuccugcccugggcuc

SEQ ID NO: 167090 - RNA, 32 nt, Human
gcagaaucagccagugggcagguggacgcucu

SEQ ID NO: 167091 - RNA, 18 nt, Human
gcagaaucaggagucacc

SEQ ID NO: 167092 - RNA, 24 nt, Human
gcagaaucaggagucaccagauga

SEQ ID NO: 167093 - RNA, 32 nt, Human
gcagaaucauaauggacccgcacaaaaucuca

SEQ ID NO: 167094 - RNA, 32 nt, Human
gcagaaucaucaaggcuuuccuuuguaacugc

SEQ ID NO: 167095 - RNA, 32 nt, Human
gcagaaucucacaugggcaccauggaggaacc

SEQ ID NO: 167096 - RNA, 32 nt, Human
gcagaaucucccaccgagugugguaagaagga

SEQ ID NO: 167097 - RNA, 32 nt, Human
gcagaaucuguuguccuuaauuauauuugcaa

SEQ ID NO: 167098 - RNA, 32 nt, Human
gcagaaucuugacccagggaaagggaagcagg

SEQ ID NO: 167099 - RNA, 32 nt, Human
gcagaaugaacauuuucuccagccucugagac

SEQ ID NO: 167100 - RNA, 32 nt, Human
gcagaaugaacccacaccuggagugaggaagg

SEQ ID NO: 167101 - RNA, 32 nt, Human
gcagaaugaacccauagggagcugaucguaau

SEQ ID NO: 167102 - RNA, 32 nt, Human
gcagaaugaccagcgaaaucggaaaagaaaag

SEQ ID NO: 167103 - RNA, 32 nt, Human
gcagaaugagaggagagagggaaggcagguca

SEQ ID NO: 167104 - RNA, 32 nt, Human
gcagaaugagcucuuccugaacgugggcacca

SEQ ID NO: 167105 - RNA, 30 nt, Human
gcagaaugcagccagaggagggcacaggcu

SEQ ID NO: 167106 - RNA, 18 nt, Human
gcagaaugcauugcauug

SEQ ID NO: 167107 - RNA, 31 nt, Human
gcagaaugccucucagccucauguguugguc

SEQ ID NO: 167108 - RNA, 32 nt, Human
gcagaauggaggagggaaguugaaggagccac

SEQ ID NO: 167109 - RNA, 32 nt, Human
gcagaaugggcuccaggguagcucucagaaca

SEQ ID NO: 167110 - RNA, 32 nt, Human
gcagaauguuucacccugaucuuaugggagga

SEQ ID NO: 167111 - RNA, 32 nt, Human
gcagaauuccccgcagccaccaugagggucag

SEQ ID NO: 167112 - RNA, 32 nt, Human
gcagaauucugaagucgacuucccucuggcuc

SEQ ID NO: 167113 - RNA, 32 nt, Human
gcagaauugacaguugaacagagcuagaggcc

SEQ ID NO: 167114 - RNA, 32 nt, Human
gcagaauugauugccuucagcacagcauccuc

SEQ ID NO: 167115 - RNA, 32 nt, Human
gcagaauuuuccaaagucaaugggcuuagcau

SEQ ID NO: 167116 - RNA, 32 nt, Human
gcagacaacagcuucugagcuuuggacuaauc

SEQ ID NO: 167117 - RNA, 32 nt, Human
gcagacaauggcccuccuggugccucaccaca

SEQ ID NO: 167118 - RNA, 32 nt, Human
gcagacaauggcuugaaccugggaggcagagg

SEQ ID NO: 167119 - RNA, 32 nt, Human
gcagacacacuuagaacacucacugcacuggu

SEQ ID NO: 167120 - RNA, 32 nt, Human
gcagacacagaacauaucaucacugcagauag

SEQ ID NO: 167121 - RNA, 32 nt, Human
gcagacacagaauuacaaagagcugcaaugga

SEQ ID NO: 167122 - RNA, 32 nt, Human
gcagacacagccccucaagacaagaaacugcu

SEQ ID NO: 167123 - RNA, 32 nt, Human
gcagacacagcccuuccaggaccagaggccaa

SEQ ID NO: 167124 - RNA, 32 nt, Human
gcagacacagcuguucucucccucucuccuuc

SEQ ID NO: 167125 - RNA, 32 nt, Human
gcagacacaggacagaacguccccugcaaagc

SEQ ID NO: 167126 - RNA, 18 nt, Human
gcagacacaggugccuca

SEQ ID NO: 167127 - RNA, 32 nt, Human
gcagacaccagauaggugaguccuuaaccaaa

SEQ ID NO: 167128 - RNA, 32 nt, Human
gcagacaccagccugguguccuccuucauccc

SEQ ID NO: 167129 - RNA, 32 nt, Human
gcagacaccccagcuuuugagggugcuggggg

SEQ ID NO: 167130 - RNA, 32 nt, Human
gcagacaccuccggcccacacagccguucacc

SEQ ID NO: 167131 - RNA, 19 nt, Human
gcagacaccuguaguccca

SEQ ID NO: 167132 - RNA, 32 nt, Human
gcagacacucaaugccagcccacgaaagcagc

SEQ ID NO: 167133 - RNA, 32 nt, Human
gcagacacuccaccccaaagccugcagaaggg

SEQ ID NO: 167134 - RNA, 32 nt, Human
gcagacacugaguggaaugacaucuuaacgca

SEQ ID NO: 167135 - RNA, 32 nt, Human
gcagacacugcaacagaugccuccuagaaaau

SEQ ID NO: 167136 - RNA, 32 nt, Human
gcagacacugcaguuaauagugaaucaggcuc

SEQ ID NO: 167137 - RNA, 32 nt, Human
gcagacacuguggagcaacaucugcaggucua

SEQ ID NO: 167138 - RNA, 32 nt, Human
gcagacacuguggagcgacaucugcaggucua

SEQ ID NO: 167139 - RNA, 32 nt, Human
gcagacacuuucuggguacaacaggguaggac

SEQ ID NO: 167140 - RNA, 22 nt, Human
gcagacagaaaaauacugggga

SEQ ID NO: 167141 - RNA, 32 nt, Human
gcagacagacagguggaggaugggaccuugaa

SEQ ID NO: 167142 - RNA, 32 nt, Human
gcagacagaccugaaaauuuucaucugaagca

SEQ ID NO: 167143 - RNA, 24 nt, Human
gcagacagaucaccugaggucagg

SEQ ID NO: 167144 - RNA, 32 nt, Human
gcagacagcaguccucuagcauggccccagca

SEQ ID NO: 167145 - RNA, 30 nt, Human
gcagacagccucagcaagcuccuguagccc

SEQ ID NO: 167146 - RNA, 32 nt, Human
gcagacagccucuucuccucuggggccucaag

SEQ ID NO: 167147 - RNA, 32 nt, Human
gcagacagcugcauaguuugguaaaaugacug

SEQ ID NO: 167148 - RNA, 32 nt, Human
gcagacaggaauagugaacaacagagcuggga

SEQ ID NO: 167149 - RNA, 32 nt, Human
gcagacaggcuggcagggcaggugcugcgugg

SEQ ID NO: 167150 - RNA, 32 nt, Human
gcagacagggaagggaaacauuuucagggaaa

SEQ ID NO: 167151 - RNA, 32 nt, Human
gcagacagggaagggaauuucacuuaaaagga

SEQ ID NO: 167152 - RNA, 32 nt, Human
gcagacaggguuucaccauguuggccaggcuc

SEQ ID NO: 167153 - RNA, 23 nt, Human
gcagacagucaccccaaggcagg

SEQ ID NO: 167154 - RNA, 32 nt, Human
gcagacagugauguucauguucuuaaaaugcc

SEQ ID NO: 167155 - RNA, 32 nt, Human
gcagacaguuaagagaaaugagcuugacauuu

SEQ ID NO: 167156 - RNA, 32 nt, Human
gcagacaucuggaggagagagucggagagcag

SEQ ID NO: 167157 - RNA, 19 nt, Human
gcagacaucuguaauccca

SEQ ID NO: 167158 - RNA, 32 nt, Human
gcagacaugagcuguacuacucaguaugcacc

SEQ ID NO: 167159 - RNA, 32 nt, Human
gcagacaugaggcagcauuuccuccacacuag

SEQ ID NO: 167160 - RNA, 32 nt, Human
gcagacaugccuggagccuggugagggcagga

SEQ ID NO: 167161 - RNA, 32 nt, Human
gcagacauguguuucuggagcaucacagaagg

SEQ ID NO: 167162 - RNA, 32 nt, Human
gcagaccaaacagcccagcagcccagcagccc

SEQ ID NO: 167163 - RNA, 32 nt, Human
gcagaccaagaagaaaggagccaaggcaaaga

SEQ ID NO: 167164 - RNA, 32 nt, Human
gcagaccaccuccaggagccgcuuucuugacc

SEQ ID NO: 167165 - RNA, 32 nt, Human
gcagaccacgagcgcggagcuuggggaggcgc

SEQ ID NO: 167166 - RNA, 32 nt, Human
gcagaccagagagcucaaguuucagagucaga

SEQ ID NO: 167167 - RNA, 32 nt, Human
gcagaccagagccuugcagagccagacagagg

SEQ ID NO: 167168 - RNA, 32 nt, Human
gcagaccaggaaggaagagcaagcuguacaaa

SEQ ID NO: 167169 - RNA, 32 nt, Human
gcagaccaugaauuacguggggcaguuagccg

SEQ ID NO: 167170 - RNA, 32 nt, Human
gcagaccaugaggaggugaaucagggugggca

SEQ ID NO: 167171 - RNA, 18 nt, Human
gcagaccaugaggucagg

SEQ ID NO: 167172 - RNA, 32 nt, Human
gcagaccaugcacagugccuggggcggaagga

SEQ ID NO: 167173 - RNA, 32 nt, Human
gcagaccccaagacagagauucuggugcaagu

SEQ ID NO: 167174 - RNA, 32 nt, Human
gcagaccccaaucugcggcuucucccaccuca

SEQ ID NO: 167175 - RNA, 32 nt, Human
gcagacccccgugcuauuucucucacggaagg

SEQ ID NO: 167176 - RNA, 21 nt, Human
gcagacccucacugguugggg

SEQ ID NO: 167177 - RNA, 32 nt, Human
gcagacccuccaccaugagcccgggucagcgc

SEQ ID NO: 167178 - RNA, 22 nt, Human
gcagacccuccaggcuggagga

SEQ ID NO: 167179 - RNA, 32 nt, Human
gcagacccuccaggggcccugaggucuguucc

SEQ ID NO: 167180 - RNA, 32 nt, Human
gcagacccucuacccaggcuuguucugcagga

SEQ ID NO: 167181 - RNA, 19 nt, Human
gcagacccucuagcugggg

SEQ ID NO: 167182 - RNA, 22 nt, Human
gcagacccucuaggacuggggg

SEQ ID NO: 167183 - RNA, 32 nt, Human
gcagacccucuggcuaagcuucucccaaauuu

SEQ ID NO: 167184 - RNA, 22 nt, Human
gcagacccugagcacugaguca

SEQ ID NO: 167185 - RNA, 32 nt, Human
gcagacccugcagcuggugaaagccagccccu

SEQ ID NO: 167186 - RNA, 32 nt, Human
gcagacccugcaggacuugcucacugaucuuc

SEQ ID NO: 167187 - RNA, 32 nt, Human
gcagacccuucacaagcaaaaucagccagcac

SEQ ID NO: 167188 - RNA, 22 nt, Human
gcagacccuugacuccagggga

SEQ ID NO: 167189 - RNA, 32 nt, Human
gcagaccggagcuguuccuauuugcccauccu

SEQ ID NO: 167190 - RNA, 32 nt, Human
gcagaccgguuugcagcaccugccgcaacagc

SEQ ID NO: 167191 - RNA, 32 nt, Human
gcagaccuaggcagacaccuugagacuaaaag

SEQ ID NO: 167192 - RNA, 32 nt, Human
gcagaccuauccuacaagaaaugcuaaaggaa

SEQ ID NO: 167193 - RNA, 32 nt, Human
gcagaccuccacccuucuuuccuccaccccuc

SEQ ID NO: 167194 - RNA, 22 nt, Human
gcagaccuccgccaucuggggg

SEQ ID NO: 167195 - RNA, 32 nt, Human
gcagaccugccuggagguucucccuggggugg

SEQ ID NO: 167196 - RNA, 32 nt, Human
gcagaccugcggcugaggaugcagggcucccg

SEQ ID NO: 167197 - RNA, 21 nt, Human
gcagaccugcucauuccagga

SEQ ID NO: 167198 - RNA, 32 nt, Human
gcagaccuggacucacagccuggcugugaugc

SEQ ID NO: 167199 - RNA, 32 nt, Human
gcagaccuuagaguggauguccggucuccugu

SEQ ID NO: 167200 - RNA, 32 nt, Human
gcagacgaagcauguaagaaauauuuaguguc

SEQ ID NO: 167201 - RNA, 32 nt, Human
gcagacgaagccauugcagaggcagaauaugc

SEQ ID NO: 167202 - RNA, 32 nt, Human
gcagacgacacacacggccucagucuauggga

SEQ ID NO: 167203 - RNA, 32 nt, Human
gcagacgacuccgucugaggaagagcagccca

SEQ ID NO: 167204 - RNA, 32 nt, Human
gcagacgaugaaacucagcugacauucuacac

SEQ ID NO: 167205 - RNA, 32 nt, Human
gcagacgccgaccacucagacggaggggcccc

SEQ ID NO: 167206 - RNA, 19 nt, Human
gcagacgccuugucuccau

SEQ ID NO: 167207 - RNA, 24 nt, Human
gcagacggaucacuugaggucagg

SEQ ID NO: 167208 - RNA, 20 nt, Human
gcagacggcggcagcagcag

SEQ ID NO: 167209 - RNA, 32 nt, Human
gcagacggcugcugcccuucucugggcauguu

SEQ ID NO: 167210 - RNA, 32 nt, Human
gcagacguaggccucaggucucgggccucagg

SEQ ID NO: 167211 - RNA, 32 nt, Human
gcagacgucauccuuuggcucaaagccagaug

SEQ ID NO: 167212 - RNA, 32 nt, Human
gcagacguucccgugcaccacugugugccugg

SEQ ID NO: 167213 - RNA, 32 nt, Human
gcagacucagcuuuuuaaagaugggaggucag

SEQ ID NO: 167214 - RNA, 32 nt, Human
gcagacuccagccccuggaccccugggguggc

SEQ ID NO: 167215 - RNA, 26 nt, Human
gcagacucuaacagaugccagcugaa

SEQ ID NO: 167216 - RNA, 32 nt, Human
gcagacucuggcagagcugagaagggcaggga

SEQ ID NO: 167217 - RNA, 32 nt, Human
gcagacugacacacccucccccaccccgggua

SEQ ID NO: 167218 - RNA, 32 nt, Human
gcagacugacugaaccugccucccacuacuga

SEQ ID NO: 167219 - RNA, 32 nt, Human
gcagacugaucuccuccacuuccuucagcgcc

SEQ ID NO: 167220 - RNA, 22 nt, Human
gcagacuggagggaaagaguga

SEQ ID NO: 167221 - RNA, 32 nt, Human
gcagacuggcccacccugccuacuucccuacu

SEQ ID NO: 167222 - RNA, 32 nt, Human
gcagacuggcuaaggaccagcccagggcaauu

SEQ ID NO: 167223 - RNA, 32 nt, Human
gcagacugggcaacauagcgagaccucaucuc

SEQ ID NO: 167224 - RNA, 32 nt, Human
gcagacugguuccuaacucucucccuccuccu

SEQ ID NO: 167225 - RNA, 32 nt, Human
gcagacugucauggguggggaauguucucuga

SEQ ID NO: 167226 - RNA, 32 nt, Human
gcagacuguccaaugugcucagccaggcugga

SEQ ID NO: 167227 - RNA, 32 nt, Human
gcagacugucuggaggaggagccggcacugag

SEQ ID NO: 167228 - RNA, 32 nt, Human
gcagacugugaccacacuaaaagugaugcuuc

SEQ ID NO: 167229 - RNA, 32 nt, Human
gcagacuguggcuagaacggugggaucagagc

SEQ ID NO: 167230 - RNA, 26 nt, Human
gcagacuuaaaucaagaggcugggga

SEQ ID NO: 167231 - RNA, 32 nt, Human
gcagacuuagccccagcagagccugggaggaa

SEQ ID NO: 167232 - RNA, 20 nt, Human
gcagacuuagccgugcauug

SEQ ID NO: 167233 - RNA, 32 nt, Human
gcagacuucugugcuuucuuuccuguucccua

SEQ ID NO: 167234 - RNA, 23 nt, Human
gcagacuugggguugggagaaca

SEQ ID NO: 167235 - RNA, 32 nt, Human
gcagacuuuccaggccuagcguuugcugcuuu

SEQ ID NO: 167236 - RNA, 32 nt, Human
gcagagaaaaacaugccuaaggcuuuucucca

SEQ ID NO: 167237 - RNA, 32 nt, Human
gcagagaaaggaaguccucucccuggaggccu

SEQ ID NO: 167238 - RNA, 32 nt, Human
gcagagaaaggcagaaaacccagucuucagug

SEQ ID NO: 167239 - RNA, 20 nt, Human
gcagagaaaugccagcugca

SEQ ID NO: 167240 - RNA, 32 nt, Human
gcagagaacagcucauugggucacuggugauc

SEQ ID NO: 167241 - RNA, 32 nt, Human
gcagagaacaguuccucagcuggucaugcuga

SEQ ID NO: 167242 - RNA, 30 nt, Human
gcagagaaccugcuuuacuuugcccaggga

SEQ ID NO: 167243 - RNA, 32 nt, Human
gcagagaagccaugcguuccagccuuccacgg

SEQ ID NO: 167244 - RNA, 20 nt, Human
gcagagaagccuccaugguc

SEQ ID NO: 167245 - RNA, 32 nt, Human
gcagagaagccuguggcuaaaguuuccacauc

SEQ ID NO: 167246 - RNA, 32 nt, Human
gcagagaaggagagaggcagagagggagagag

SEQ ID NO: 167247 - RNA, 18 nt, Human
gcagagaaggcagcagca

SEQ ID NO: 167248 - RNA, 32 nt, Human
gcagagaaggggccagcucccuccuggggacc

SEQ ID NO: 167249 - RNA, 32 nt, Human
gcagagacaacugccacccagccugggccuuc

SEQ ID NO: 167250 - RNA, 32 nt, Human
gcagagacagaaacagcaauagccaggacucc

SEQ ID NO: 167251 - RNA, 32 nt, Human
gcagagacagagagacagagagacagagagag

SEQ ID NO: 167252 - RNA, 32 nt, Human
gcagagacaggaguggcccugcagugauguug

SEQ ID NO: 167253 - RNA, 32 nt, Human
gcagagaccacugcacuccagccugggcaaca

SEQ ID NO: 167254 - RNA, 32 nt, Human
gcagagaccagaggcauaucgcggcuugagcu

SEQ ID NO: 167255 - RNA, 32 nt, Human
gcagagaccagccuggagccuagaucuggugc

SEQ ID NO: 167256 - RNA, 32 nt, Human
gcagagaccaugggaacccucucagccccucc

SEQ ID NO: 167257 - RNA, 32 nt, Human
gcagagaccccaacucugccuuccuggaacua

SEQ ID NO: 167258 - RNA, 32 nt, Human
gcagagaccgaggcugcaccggcagaggcugc

SEQ ID NO: 167259 - RNA, 32 nt, Human
gcagagacgagaugaaccuguggcugcgguug

SEQ ID NO: 167260 - RNA, 32 nt, Human
gcagagacgagauggcuguuugucaggaggcg

SEQ ID NO: 167261 - RNA, 32 nt, Human
gcagagacgugaaaggaggccaccugggguag

SEQ ID NO: 167262 - RNA, 32 nt, Human
gcagagacucaggccuguuugagggcucacga

SEQ ID NO: 167263 - RNA, 17 nt, Human
gcagagacuucccagga

SEQ ID NO: 167264 - RNA, 32 nt, Human
gcagagagaacagcgauguugugcgcccauuu

SEQ ID NO: 167265 - RNA, 32 nt, Human
gcagagagaagcuauaggaaacccaguaccac

SEQ ID NO: 167266 - RNA, 32 nt, Human
gcagagagacagagagggagagagggacagag

SEQ ID NO: 167267 - RNA, 32 nt, Human
gcagagagacagauucccaggcuauaaagcag

SEQ ID NO: 167268 - RNA, 32 nt, Human
gcagagagacccacagagcaggagggaggcag

SEQ ID NO: 167269 - RNA, 32 nt, Human
gcagagagagaugcccuggaccaucuugcucu

SEQ ID NO: 167270 - RNA, 20 nt, Human
gcagagagagaugcugggga

SEQ ID NO: 167271 - RNA, 32 nt, Human
gcagagagccccggacaggaaucaagagaaaa

SEQ ID NO: 167272 - RNA, 32 nt, Human
gcagagagccgggccaaggcagcccuggagaa

SEQ ID NO: 167273 - RNA, 32 nt, Human
gcagagagcugaggcauccaagaaauguucca

SEQ ID NO: 167274 - RNA, 32 nt, Human
gcagagagcuggaaagguaagacugaggucag

SEQ ID NO: 167275 - RNA, 32 nt, Human
gcagagaggaaagaggggcagaaagccuggca

SEQ ID NO: 167276 - RNA, 32 nt, Human
gcagagaggaagagggcagcaguugaggaugg

SEQ ID NO: 167277 - RNA, 32 nt, Human
gcagagaggaaggcugccuacaagcaucacag

SEQ ID NO: 167278 - RNA, 32 nt, Human
gcagagaggacaggggugggcuuuuguucaaa

SEQ ID NO: 167279 - RNA, 32 nt, Human
gcagagaggagaacugaaaauaaaacuggaaa

SEQ ID NO: 167280 - RNA, 20 nt, Human
gcagagaggaggauguccuc

SEQ ID NO: 167281 - RNA, 32 nt, Human
gcagagaggcagacgugagcugagggcgcaga

SEQ ID NO: 167282 - RNA, 32 nt, Human
gcagagaggcauuccuuucuccuccucucauc

SEQ ID NO: 167283 - RNA, 32 nt, Human
gcagagaggcugagaccaacccagaaaccacc

SEQ ID NO: 167284 - RNA, 32 nt, Human
gcagagaggcugggcuugcaggcgcaguagcu

SEQ ID NO: 167285 - RNA, 25 nt, Human
gcagagagggaaaaacggagaguga

SEQ ID NO: 167286 - RNA, 32 nt, Human
gcagagagggccugggagcacaaugcugagcc

SEQ ID NO: 167287 - RNA, 32 nt, Human
gcagagaggggacaagcaggacuggggaacug

SEQ ID NO: 167288 - RNA, 32 nt, Human
gcagagagguugagaacaacccagaaaccuuc

SEQ ID NO: 167289 - RNA, 32 nt, Human
gcagagaguaacuauccucaacuucgauuggu

SEQ ID NO: 167290 - RNA, 21 nt, Human
gcagagaguggccuggcccug

SEQ ID NO: 167291 - RNA, 32 nt, Human
gcagagaguugcugcucucuccaacucaccca

SEQ ID NO: 167292 - RNA, 17 nt, Human
gcagagaucacauggug

SEQ ID NO: 167293 - RNA, 32 nt, Human
gcagagaucagggguuaccucugcuucugagc

SEQ ID NO: 167294 - RNA, 32 nt, Human
gcagagauccagccccuccaaccucccucugu

SEQ ID NO: 167295 - RNA, 32 nt, Human
gcagagaugccucuggagucccuguggccacg

SEQ ID NO: 167296 - RNA, 18 nt, Human
gcagagaugcgugcaucc

SEQ ID NO: 167297 - RNA, 32 nt, Human
gcagagauggcuucucagauauggcuugcaaa

SEQ ID NO: 167298 - RNA, 32 nt, Human
gcagagauugugccacugcacuccagccuggc

SEQ ID NO: 167299 - RNA, 19 nt, Human
gcagagauuucaucaugga

SEQ ID NO: 167300 - RNA, 32 nt, Human
gcagagcaagggcagcaggaccccaacaaaaa

SEQ ID NO: 167301 - RNA, 32 nt, Human
gcagagcacagcccacggggaucacagcguuu

SEQ ID NO: 167302 - RNA, 32 nt, Human
gcagagcacagcccacugccucccucuccuuc

SEQ ID NO: 167303 - RNA, 19 nt, Human
gcagagcaccaccauggcc

SEQ ID NO: 167304 - RNA, 32 nt, Human
gcagagcaccacugugauuuguucuccuggug

SEQ ID NO: 167305 - RNA, 32 nt, Human
gcagagcaccggggccagaggcucaaagcacc

SEQ ID NO: 167306 - RNA, 32 nt, Human
gcagagcaccuaagccugucucugccucccug

SEQ ID NO: 167307 - RNA, 32 nt, Human
gcagagcacuauggagcaauacuggcuaaugc

SEQ ID NO: 167308 - RNA, 32 nt, Human
gcagagcagacacagcagcaauggagugugca

SEQ ID NO: 167309 - RNA, 27 nt, Human
gcagagcagagggaaggcagcggaaga

SEQ ID NO: 167310 - RNA, 32 nt, Human
gcagagcagauggcagaugcacauguuggagg

SEQ ID NO: 167311 - RNA, 32 nt, Human
gcagagcagcacaaagaaacagccuuacacug

SEQ ID NO: 167312 - RNA, 32 nt, Human
gcagagcagcgcccuggccgggccaagcagga

SEQ ID NO: 167313 - RNA, 32 nt, Human
gcagagcagcuccuccccaacuucugucccag

SEQ ID NO: 167314 - RNA, 32 nt, Human
gcagagcaggaaugcguggcaggaaggaaucu

SEQ ID NO: 167315 - RNA, 20 nt, Human
gcagagcaggcuacguccuc

SEQ ID NO: 167316 - RNA, 32 nt, Human
gcagagcaggcugggcgggaaaacuuaaaugc

SEQ ID NO: 167317 - RNA, 32 nt, Human
gcagagcagggugguccgggcacacugggccu

SEQ ID NO: 167318 - RNA, 32 nt, Human
gcagagcaggguuccuggggcagcccugguau

SEQ ID NO: 167319 - RNA, 32 nt, Human
gcagagccagaggcacgcagccgcacaggggc

SEQ ID NO: 167320 - RNA, 32 nt, Human
gcagagccaggccagccuccuccacaugcaga

SEQ ID NO: 167321 - RNA, 32 nt, Human
gcagagccaggggugagaggcagcagugaugg

SEQ ID NO: 167322 - RNA, 32 nt, Human
gcagagccauggggccuucacaggcugcagug

SEQ ID NO: 167323 - RNA, 32 nt, Human
gcagagcccaagaaaucacuggugaugagaug

SEQ ID NO: 167324 - RNA, 32 nt, Human
gcagagcccaggagaugugggcaggagcuuuc

SEQ ID NO: 167325 - RNA, 32 nt, Human
gcagagcccaggaggcagcaucuccagagcug

SEQ ID NO: 167326 - RNA, 32 nt, Human
gcagagcccaggauggggucagggucaggccc

SEQ ID NO: 167327 - RNA, 32 nt, Human
gcagagcccaggcuggagcaggaggcauuuca

SEQ ID NO: 167328 - RNA, 17 nt, Human
gcagagcccagggaaga

SEQ ID NO: 167329 - RNA, 32 nt, Human
gcagagcccagggagcuggaggucggcgcuuc

SEQ ID NO: 167330 - RNA, 17 nt, Human
gcagagcccccauggcc

SEQ ID NO: 167331 - RNA, 32 nt, Human
gcagagccccgguacaaacagacaaggcugca

SEQ ID NO: 167332 - RNA, 20 nt, Human
gcagagccccucguguccuc

SEQ ID NO: 167333 - RNA, 32 nt, Human
gcagagccgagaggagggaagccagggguccc

SEQ ID NO: 167334 - RNA, 19 nt, Human
gcagagccgcccaagauga

SEQ ID NO: 167335 - RNA, 32 nt, Human
gcagagccgcccugcaccaccaugugcaucau

SEQ ID NO: 167336 - RNA, 17 nt, Human
gcagagccgggcagcuu

SEQ ID NO: 167337 - RNA, 32 nt, Human
gcagagccuagacuuccacucggaucuauuua

SEQ ID NO: 167338 - RNA, 32 nt, Human
gcagagccuagagagaaggcgaggacgcugaa

SEQ ID NO: 167339 - RNA, 20 nt, Human
gcagagccuccugcacccuc

SEQ ID NO: 167340 - RNA, 21 nt, Human
gcagagccuccugcgggacuu

SEQ ID NO: 167341 - RNA, 32 nt, Human
gcagagccucugccuaggcccugggccccacg

SEQ ID NO: 167342 - RNA, 32 nt, Human
gcagagccugcacucuggcacucgcugaagaa

SEQ ID NO: 167343 - RNA, 32 nt, Human
gcagagccugcgaaccccuccugugcuaccac

SEQ ID NO: 167344 - RNA, 32 nt, Human
gcagagccuggaauugcacugaggcuugaguc

SEQ ID NO: 167345 - RNA, 32 nt, Human
gcagagccuggaggagcuuuuagguguugaga

SEQ ID NO: 167346 - RNA, 32 nt, Human
gcagagccuuucuccccuucccggaucauuau

SEQ ID NO: 167347 - RNA, 32 nt, Human
gcagagcgaguagagagcagcccucauucacc

SEQ ID NO: 167348 - RNA, 32 nt, Human
gcagagcgaugcucuuugaccucccagaagag

SEQ ID NO: 167349 - RNA, 32 nt, Human
gcagagcgcagggagagccggagcggcgagcu

SEQ ID NO: 167350 - RNA, 32 nt, Human
gcagagcggcggcuucucucgcgaggacggac

SEQ ID NO: 167351 - RNA, 32 nt, Human
gcagagcggggaggugccugagcuggggccug

SEQ ID NO: 167352 - RNA, 17 nt, Human
gcagagcgggggagcuu

SEQ ID NO: 167353 - RNA, 17 nt, Human
gcagagcgggggcaguu

SEQ ID NO: 167354 - RNA, 32 nt, Human
gcagagcguccugcaaccccagcccucaccag

SEQ ID NO: 167355 - RNA, 32 nt, Human
gcagagcgugagccaccagggaagccacucgc

SEQ ID NO: 167356 - RNA, 32 nt, Human
gcagagcuagagccaugaaacccacagacuug

SEQ ID NO: 167357 - RNA, 32 nt, Human
gcagagcuaggauuugaccccagacaaucuga

SEQ ID NO: 167358 - RNA, 21 nt, Human
gcagagcucacagucucaugg

SEQ ID NO: 167359 - RNA, 21 nt, Human
gcagagcucacucaccgggac

SEQ ID NO: 167360 - RNA, 19 nt, Human
gcagagcucagacuaagug

SEQ ID NO: 167361 - RNA, 32 nt, Human
gcagagcucagcucuugcccucucacauccuu

SEQ ID NO: 167362 - RNA, 32 nt, Human
gcagagcucauuuuuauuccugucugcaaucg

SEQ ID NO: 167363 - RNA, 32 nt, Human
gcagagcuccaggcuggcaccaugguaggccu

SEQ ID NO: 167364 - RNA, 19 nt, Human
gcagagcuccagggagcuu

SEQ ID NO: 167365 - RNA, 32 nt, Human
gcagagcuccgaagcaggcaggacggagcgga

SEQ ID NO: 167366 - RNA, 23 nt, Human
gcagagcuccugacaaaggcggc

SEQ ID NO: 167367 - RNA, 32 nt, Human
gcagagcuccuuccugucuguggacucggagc

SEQ ID NO: 167368 - RNA, 19 nt, Human
gcagagcugaccugccugg

SEQ ID NO: 167369 - RNA, 32 nt, Human
gcagagcugagccagccagaagaaaaagcgau

SEQ ID NO: 167370 - RNA, 32 nt, Human
gcagagcugaggggacagggaggagcagaagc

SEQ ID NO: 167371 - RNA, 32 nt, Human
gcagagcugccagcagggagcucacagaaggg

SEQ ID NO: 167372 - RNA, 32 nt, Human
gcagagcugccuggagccugcugggcuggugg

SEQ ID NO: 167373 - RNA, 32 nt, Human
gcagagcugccugucuugugucugcugaugag

SEQ ID NO: 167374 - RNA, 32 nt, Human
gcagagcuggaaagcauggcuguuauaaauga

SEQ ID NO: 167375 - RNA, 21 nt, Human
gcagagcuggaacuagagcuu

SEQ ID NO: 167376 - RNA, 32 nt, Human
gcagagcuggaaggucugugcaagcuggcucc

SEQ ID NO: 167377 - RNA, 18 nt, Human
gcagagcuggacuggggc

SEQ ID NO: 167378 - RNA, 32 nt, Human
gcagagcuggacuggggcaggcugggcuucca

SEQ ID NO: 167379 - RNA, 20 nt, Human
gcagagcuggagguucuguc

SEQ ID NO: 167380 - RNA, 21 nt, Human
gcagagcuggagguuggggug

SEQ ID NO: 167381 - RNA, 32 nt, Human
gcagagcugggauguggugcaugccuuugugu

SEQ ID NO: 167382 - RNA, 32 nt, Human
gcagagcugggauguguagcauccagguaggu

SEQ ID NO: 167383 - RNA, 32 nt, Human
gcagagcugggauugaaggaccccuauagaga

SEQ ID NO: 167384 - RNA, 32 nt, Human
gcagagcugggggagcgaggcugacaaugacu

SEQ ID NO: 167385 - RNA, 32 nt, Human
gcagagcuggggucuagccaggagccccagca

SEQ ID NO: 167386 - RNA, 32 nt, Human
gcagagcugguuuccuggaauguuccuuuggc

SEQ ID NO: 167387 - RNA, 20 nt, Human
gcagagcuguuuggcagacu

SEQ ID NO: 167388 - RNA, 32 nt, Human
gcagagcuugaacacagucucacccagacucc

SEQ ID NO: 167389 - RNA, 32 nt, Human
gcagagcuugaggcaaagacuuacgugugauu

SEQ ID NO: 167390 - RNA, 32 nt, Human
gcagaggaaaggacagggaaaaagaaaaagac

SEQ ID NO: 167391 - RNA, 32 nt, Human
gcagaggacacgcugcaugggccccgcuugcg

SEQ ID NO: 167392 - RNA, 32 nt, Human
gcagaggacgaagaggaggaggaugaggagga

SEQ ID NO: 167393 - RNA, 32 nt, Human
gcagaggacugcaggccaucagcgugcacugu

SEQ ID NO: 167394 - RNA, 32 nt, Human
gcagaggagaagacccagacugugcauaguuc

SEQ ID NO: 167395 - RNA, 32 nt, Human
gcagaggagaaugacccuguggccaccaccau

SEQ ID NO: 167396 - RNA, 32 nt, Human
gcagaggagauggagacaggaaacgggagaac

SEQ ID NO: 167397 - RNA, 32 nt, Human
gcagaggagccccaagucuuggggaccacaga

SEQ ID NO: 167398 - RNA, 32 nt, Human
gcagaggaggagggcagcagcugagaggccag

SEQ ID NO: 167399 - RNA, 32 nt, Human
gcagaggaggaguuugguggguuucauacacc

SEQ ID NO: 167400 - RNA, 17 nt, Human
gcagaggaggcugcacc

SEQ ID NO: 167401 - RNA, 32 nt, Human
gcagaggaggggcugccuggagcuucccaccc

SEQ ID NO: 167402 - RNA, 32 nt, Human
gcagaggagggugggggagcuggugagaccaa

SEQ ID NO: 167403 - RNA, 32 nt, Human
gcagaggaguuucuucaggaagaaccagggca

SEQ ID NO: 167404 - RNA, 32 nt, Human
gcagaggaugugagaggcagaggcaggcuccu

SEQ ID NO: 167405 - RNA, 32 nt, Human
gcagaggauuaaaggugacugggaggaccagc

SEQ ID NO: 167406 - RNA, 32 nt, Human
gcagaggauugaggcuuaauucugagcuggcc

SEQ ID NO: 167407 - RNA, 32 nt, Human
gcagaggcaaagugcauagcuuagaggaagga

SEQ ID NO: 167408 - RNA, 32 nt, Human
gcagaggcaaaucaccgggcagagggagggga

SEQ ID NO: 167409 - RNA, 32 nt, Human
gcagaggcaacaguguuuaggauuuggguuau

SEQ ID NO: 167410 - RNA, 32 nt, Human
gcagaggcacaugcagacccugccuggagccu

SEQ ID NO: 167411 - RNA, 32 nt, Human
gcagaggcacgggaugagucugggugaccucu

SEQ ID NO: 167412 - RNA, 32 nt, Human
gcagaggcagaauaugcugagugucuggaguc

SEQ ID NO: 167413 - RNA, 32 nt, Human
gcagaggcagaggcagccacacagccccuccc

SEQ ID NO: 167414 - RNA, 32 nt, Human
gcagaggcagcccgcucacuucccgcggaggc

SEQ ID NO: 167415 - RNA, 32 nt, Human
gcagaggcagcgccgcaggaggcgggugcccg

SEQ ID NO: 167416 - RNA, 18 nt, Human
gcagaggcaggccagagg

SEQ ID NO: 167417 - RNA, 32 nt, Human
gcagaggcagggcuagggugauuuuuggccgu

SEQ ID NO: 167418 - RNA, 32 nt, Human
gcagaggcaguuaacacugggaagcccugccc

SEQ ID NO: 167419 - RNA, 32 nt, Human
gcagaggcauccagaccuucugcugacuaaga

SEQ ID NO: 167420 - RNA, 32 nt, Human
gcagaggcauggaggagggaggcgugggaugg

SEQ ID NO: 167421 - RNA, 22 nt, Human
gcagaggcaugggacccggggc

SEQ ID NO: 167422 - RNA, 26 nt, Human
gcagaggccaacagcacgcagcugaa

SEQ ID NO: 167423 - RNA, 32 nt, Human
gcagaggccaacggaucccccugccugucgca

SEQ ID NO: 167424 - RNA, 32 nt, Human
gcagaggccagccugcacuggagucugaggcc

SEQ ID NO: 167425 - RNA, 32 nt, Human
gcagaggccauugcaggaugaaucacuuguca

SEQ ID NO: 167426 - RNA, 32 nt, Human
gcagaggcccuaggcagcuuguugacugcugu

SEQ ID NO: 167427 - RNA, 32 nt, Human
gcagaggccggcagauggagauucagaaacau

SEQ ID NO: 167428 - RNA, 32 nt, Human
gcagaggccucagccuuagaggcuggaucaga

SEQ ID NO: 167429 - RNA, 32 nt, Human
gcagaggccucccaggaggagagcaaggaccu

SEQ ID NO: 167430 - RNA, 32 nt, Human
gcagaggccuguaaucccagcuacuugggagg

SEQ ID NO: 167431 - RNA, 32 nt, Human
gcagaggccuguaaucccaguuccuugggagg

SEQ ID NO: 167432 - RNA, 32 nt, Human
gcagaggcgggcagcuccuccuccagggccca

SEQ ID NO: 167433 - RNA, 22 nt, Human
gcagaggcucacgccuguaauc

SEQ ID NO: 167434 - RNA, 32 nt, Human
gcagaggcucaguguucacagucagagcugag

SEQ ID NO: 167435 - RNA, 32 nt, Human
gcagaggcuccucugauggcugacaucaguca

SEQ ID NO: 167436 - RNA, 32 nt, Human
gcagaggcucuuccuguucauccgccgggaag

SEQ ID NO: 167437 - RNA, 32 nt, Human
gcagaggcugaggcacggggagccagccccac

SEQ ID NO: 167438 - RNA, 32 nt, Human
gcagaggcugaggcugauuccaccccagccug

SEQ ID NO: 167439 - RNA, 32 nt, Human
gcagaggcugcacucuagccugggcaacagag

SEQ ID NO: 167440 - RNA, 19 nt, Human
gcagaggcugcccgggcgg

SEQ ID NO: 167441 - RNA, 32 nt, Human
gcagaggcugggacacaaggggcuggcgaggg

SEQ ID NO: 167442 - RNA, 32 nt, Human
gcagaggcugggaggcggcagaaugcagccag

SEQ ID NO: 167443 - RNA, 32 nt, Human
gcagaggcugggccugaggucucaguguggag

SEQ ID NO: 167444 - RNA, 32 nt, Human
gcagaggcugggggagggaugcagugacuuuu

SEQ ID NO: 167445 - RNA, 19 nt, Human
gcagaggcuguggcugcag

SEQ ID NO: 167446 - RNA, 32 nt, Human
gcagaggcuuaaggagcuacacugggggaagg

SEQ ID NO: 167447 - RNA, 32 nt, Human
gcagaggcuuucucugggugccaagccauaua

SEQ ID NO: 167448 - RNA, 32 nt, Human
gcagagggaaagggguacacugagggagaaag

SEQ ID NO: 167449 - RNA, 32 nt, Human
gcagagggaaggcaugggggcaggaagagagc

SEQ ID NO: 167450 - RNA, 32 nt, Human
gcagagggacuugguccuccuugucugguacu

SEQ ID NO: 167451 - RNA, 32 nt, Human
gcagagggagaaauggaucagaggggucaggg

SEQ ID NO: 167452 - RNA, 32 nt, Human
gcagagggagagagaaggugacacggauggaa

SEQ ID NO: 167453 - RNA, 32 nt, Human
gcagagggagaggagacaggaaggaaagauga

SEQ ID NO: 167454 - RNA, 32 nt, Human
gcagagggagcgagcgggcggccggcuagggu

SEQ ID NO: 167455 - RNA, 32 nt, Human
gcagagggaggagaggugagggcagauaaggg

SEQ ID NO: 167456 - RNA, 32 nt, Human
gcagagggaggcacuuucacccggccagcaac

SEQ ID NO: 167457 - RNA, 32 nt, Human
gcagagggagggagccaaggucacuccaauaa

SEQ ID NO: 167458 - RNA, 32 nt, Human
gcagagggagggcagaggcuuaaaggcuguga

SEQ ID NO: 167459 - RNA, 32 nt, Human
gcagagggagggcuuuguggauuccaaaggcc

SEQ ID NO: 167460 - RNA, 32 nt, Human
gcagagggaggggaagcagcccagggacaccc

SEQ ID NO: 167461 - RNA, 32 nt, Human
gcagagggcaagacgggcacucacagacagag

SEQ ID NO: 167462 - RNA, 32 nt, Human
gcagagggcaggacaccaugagcucaggaucu

SEQ ID NO: 167463 - RNA, 32 nt, Human
gcagagggcagguauaacacagcacuacauau

SEQ ID NO: 167464 - RNA, 32 nt, Human
gcagagggcaguuccccagcuugaugguuucu

SEQ ID NO: 167465 - RNA, 32 nt, Human
gcagagggcccaacccugacccaugcucuuuc

SEQ ID NO: 167466 - RNA, 32 nt, Human
gcagagggccuggguccuccugagccccugca

SEQ ID NO: 167467 - RNA, 32 nt, Human
gcagaggggaggaggaagcacaagaaguggga

SEQ ID NO: 167468 - RNA, 32 nt, Human
gcagaggggauagaagucugguggagguggag

SEQ ID NO: 167469 - RNA, 32 nt, Human
gcagaggggaugucuggcuugccugaagggag

SEQ ID NO: 167470 - RNA, 15 nt, Human
gcagaggggcagcuu

SEQ ID NO: 167471 - RNA, 32 nt, Human
gcagaggggccaggucugcccagcguuuacca

SEQ ID NO: 167472 - RNA, 32 nt, Human
gcagaggggccuggggcugggcccagagucca

SEQ ID NO: 167473 - RNA, 32 nt, Human
gcagaggggcuacgaaccaggugcaggguccc

SEQ ID NO: 167474 - RNA, 32 nt, Human
gcagaggggcugcaccuggccuuauggggauc

SEQ ID NO: 167475 - RNA, 32 nt, Human
gcagagggggcugcggacacagcaggcccccu

SEQ ID NO: 167476 - RNA, 20 nt, Human
gcagaggggugcggcagcuu

SEQ ID NO: 167477 - RNA, 32 nt, Human
gcagaggguccccaccaugcagcugaagugcc

SEQ ID NO: 167478 - RNA, 32 nt, Human
gcagaggguccucagagcaggagugacaaggg

SEQ ID NO: 167479 - RNA, 31 nt, Human
gcagagggucuugggcggcagcgacgaagga

SEQ ID NO: 167480 - RNA, 32 nt, Human
gcagagggugaaguuucucucaguucucuccc

SEQ ID NO: 167481 - RNA, 32 nt, Human
gcagagggugaguggggaccuacgagguucaa

SEQ ID NO: 167482 - RNA, 16 nt, Human
gcagaggguggggcag

SEQ ID NO: 167483 - RNA, 32 nt, Human
gcagagguaccacuguuagccuggugggaaaa

SEQ ID NO: 167484 - RNA, 32 nt, Human
gcagagguagcugcacaugcagcuggucagag

SEQ ID NO: 167485 - RNA, 32 nt, Human
gcagaggucaccagagccaaggcagcaaggca

SEQ ID NO: 167486 - RNA, 32 nt, Human
gcagaggucccucggccuccugacugacugac

SEQ ID NO: 167487 - RNA, 32 nt, Human
gcagaggucucucacuguguugcccagacaag

SEQ ID NO: 167488 - RNA, 32 nt, Human
gcagaggucucucauuguguugcccagacaag

SEQ ID NO: 167489 - RNA, 20 nt, Human
gcagaggucuucucuuccca

SEQ ID NO: 167490 - RNA, 32 nt, Human
gcagaggugaagccaagaaaauccagaugccu

SEQ ID NO: 167491 - RNA, 27 nt, Human
gcagaggugacuucaaagugcugggga

SEQ ID NO: 167492 - RNA, 32 nt, Human
gcagaggugagcugagugcagugagccaagac

SEQ ID NO: 167493 - RNA, 32 nt, Human
gcagaggugcagguccuggugcuugauggucg

SEQ ID NO: 167494 - RNA, 32 nt, Human
gcagagguggccacugcccucguccccagccu

SEQ ID NO: 167495 - RNA, 32 nt, Human
gcagagguucucuccccugccgcugagagggc

SEQ ID NO: 167496 - RNA, 32 nt, Human
gcagagguugcaaacuggcaaccugugguugg

SEQ ID NO: 167497 - RNA, 32 nt, Human
gcagaguacagaagggugaagaagugagcaga

SEQ ID NO: 167498 - RNA, 32 nt, Human
gcagaguauugaacccugccucccaguuaaag

SEQ ID NO: 167499 - RNA, 32 nt, Human
gcagagucaaagcugcaaccagaauugccuga

SEQ ID NO: 167500 - RNA, 32 nt, Human
gcagagucaagggacuugcaugugcaaguugg

SEQ ID NO: 167501 - RNA, 18 nt, Human
gcagagucacaagaugaa

SEQ ID NO: 167502 - RNA, 32 nt, Human
gcagagucagcagaacugggguggauuugguu

SEQ ID NO: 167503 - RNA, 25 nt, Human
gcagagucaucuucuaugcaggcug

SEQ ID NO: 167504 - RNA, 32 nt, Human
gcagaguccugcaccaggccugggugagugga

SEQ ID NO: 167505 - RNA, 32 nt, Human
gcagagucgugagaaagguguugucaagggac

SEQ ID NO: 167506 - RNA, 32 nt, Human
gcagagucuagaggaauuuuuguuuccuugau

SEQ ID NO: 167507 - RNA, 32 nt, Human
gcagagucuagccugugaaaggccucuugcaa

SEQ ID NO: 167508 - RNA, 32 nt, Human
gcagagucuaggccucacccuauaccucccga

SEQ ID NO: 167509 - RNA, 32 nt, Human
gcagagucuccauccagcagcuggggguucug

SEQ ID NO: 167510 - RNA, 32 nt, Human
gcagagucucccgcugcaaucugggugguaac

SEQ ID NO: 167511 - RNA, 32 nt, Human
gcagagucucuccugcccucccuccuuccugc

SEQ ID NO: 167512 - RNA, 32 nt, Human
gcagagucuugcucugcuggagugcgguggug

SEQ ID NO: 167513 - RNA, 32 nt, Human
gcagagugacccagacugcaggcaguaacuga

SEQ ID NO: 167514 - RNA, 22 nt, Human
gcagagugagagggacauggug

SEQ ID NO: 167515 - RNA, 22 nt, Human
gcagagugcgaguggagagaga

SEQ ID NO: 167516 - RNA, 32 nt, Human
gcagaguggagagggugugugaaaugccggug

SEQ ID NO: 167517 - RNA, 24 nt, Human
gcagaguggcuuacaccuauaauc

SEQ ID NO: 167518 - RNA, 32 nt, Human
gcagaguggggcugagaaacaggcugcgguga

SEQ ID NO: 167519 - RNA, 20 nt, Human
gcagagugguaaccaugcuu

SEQ ID NO: 167520 - RNA, 32 nt, Human
gcagaguguguauucuuggauggcugaugcau

SEQ ID NO: 167521 - RNA, 32 nt, Human
gcagaguuaccaggaaucuuuccuuccagcau

SEQ ID NO: 167522 - RNA, 22 nt, Human
gcagaguugagcuggcagggga

SEQ ID NO: 167523 - RNA, 32 nt, Human
gcagaguugaguaguuguagcagacaccacau

SEQ ID NO: 167524 - RNA, 17 nt, Human
gcagaguuggggcagcu

SEQ ID NO: 167525 - RNA, 32 nt, Human
gcagauaacccuggcccuacagccugcuugcu

SEQ ID NO: 167526 - RNA, 20 nt, Human
gcagauaaccugaggucagg

SEQ ID NO: 167527 - RNA, 20 nt, Human
gcagauaaccugcggucagg

SEQ ID NO: 167528 - RNA, 32 nt, Human
gcagauaagacuguucuucagaaucauguuaa

SEQ ID NO: 167529 - RNA, 32 nt, Human
gcagauaauuuccagagacuguuuauaugcac

SEQ ID NO: 167530 - RNA, 32 nt, Human
gcagauacaggcugguauagaggaugcagaaa

SEQ ID NO: 167531 - RNA, 23 nt, Human
gcagauaccacccggaggcagug

SEQ ID NO: 167532 - RNA, 32 nt, Human
gcagauacucuccauuccuuccuuccuccagc

SEQ ID NO: 167533 - RNA, 32 nt, Human
gcagauagacuugaggacagaaaacaaaaaca

SEQ ID NO: 167534 - RNA, 32 nt, Human
gcagauagggagaagggaaaaggggccucacu

SEQ ID NO: 167535 - RNA, 32 nt, Human
gcagauaggguagaggaaagggucuagaauau

SEQ ID NO: 167536 - RNA, 19 nt, Human
gcagauaguauacacauca

SEQ ID NO: 167537 - RNA, 32 nt, Human
gcagauaguggaguuucacguggcaguccggu

SEQ ID NO: 167538 - RNA, 32 nt, Human
gcagauaguucugcaauuuagucuguagccuc

SEQ ID NO: 167539 - RNA, 32 nt, Human
gcagauaucuggacucaccacauucaguaacu

SEQ ID NO: 167540 - RNA, 32 nt, Human
gcagauauggcuccuggcugcgucagccuccc

SEQ ID NO: 167541 - RNA, 32 nt, Human
gcagauauucuagcuucauuguaagcaaucua

SEQ ID NO: 167542 - RNA, 32 nt, Human
gcagauauuuggcaaugaggguucagaagagg

SEQ ID NO: 167543 - RNA, 32 nt, Human
gcagaucacaaccuuaacucaggcaaucggac

SEQ ID NO: 167544 - RNA, 32 nt, Human
gcagaucacacaagauuucaucacaguacuca

SEQ ID NO: 167545 - RNA, 32 nt, Human
gcagaucacagugccuugcaaggaaccccuga

SEQ ID NO: 167546 - RNA, 32 nt, Human
gcagaucacaucaacauccuggcauugggcug

SEQ ID NO: 167547 - RNA, 20 nt, Human
gcagaucaccagaggucagg

SEQ ID NO: 167548 - RNA, 20 nt, Human
gcagaucaccgaaggucagg

SEQ ID NO: 167549 - RNA, 20 nt, Human
gcagaucaccggaggucagg

SEQ ID NO: 167550 - RNA, 18 nt, Human
gcagaucaccugagguca

SEQ ID NO: 167551 - RNA, 20 nt, Human
gcagaucaccugaggucagg

SEQ ID NO: 167552 - RNA, 20 nt, Human
gcagaucaccugagguccgg

SEQ ID NO: 167553 - RNA, 20 nt, Human
gcagaucaccugaggucggg

SEQ ID NO: 167554 - RNA, 20 nt, Human
gcagaucaccugagguuagg

SEQ ID NO: 167555 - RNA, 32 nt, Human
gcagaucacgaaugcaccugcuuccaggcagu

SEQ ID NO: 167556 - RNA, 32 nt, Human
gcagaucagcaaccucagccccaccugggaau

SEQ ID NO: 167557 - RNA, 20 nt, Human
gcagaucagcugaggucagg

SEQ ID NO: 167558 - RNA, 32 nt, Human
gcagaucaggccacuacuuacugugacuugga

SEQ ID NO: 167559 - RNA, 32 nt, Human
gcagaucauccccagcucuucguccagaggga

SEQ ID NO: 167560 - RNA, 20 nt, Human
gcagaucaucugaggccagg

SEQ ID NO: 167561 - RNA, 20 nt, Human
gcagaucaucugaggucagg

SEQ ID NO: 167562 - RNA, 32 nt, Human
gcagaucaugaggucagaagauaaagaccacc

SEQ ID NO: 167563 - RNA, 32 nt, Human
gcagaucaugaggucagaagaucgagaccauc

SEQ ID NO: 167564 - RNA, 22 nt, Human
gcagauccacguguuguuggag

SEQ ID NO: 167565 - RNA, 32 nt, Human
gcagauccagaagauaggagggugacagcacg

SEQ ID NO: 167566 - RNA, 32 nt, Human
gcagauccagcaccuauugaauuaccauagag

SEQ ID NO: 167567 - RNA, 32 nt, Human
gcagauccagccuuccugucaacagcgacagg

SEQ ID NO: 167568 - RNA, 32 nt, Human
gcagauccaucuccaccaacacagacaacacc

SEQ ID NO: 167569 - RNA, 32 nt, Human
gcagaucccagaccuucucuaccuucaggaau

SEQ ID NO: 167570 - RNA, 17 nt, Human
gcagaucccagcuguga

SEQ ID NO: 167571 - RNA, 32 nt, Human
gcagaucccaggagagaagagcucaggagaug

SEQ ID NO: 167572 - RNA, 25 nt, Human
gcagaucccaggcugggcauggggg

SEQ ID NO: 167573 - RNA, 24 nt, Human
gcagaucccauggacauuugggga

SEQ ID NO: 167574 - RNA, 23 nt, Human
gcagauccccaggggcugcuggg

SEQ ID NO: 167575 - RNA, 32 nt, Human
gcagaucccuaugggggagcugccucacguuc

SEQ ID NO: 167576 - RNA, 20 nt, Human
gcagaucccuggagaggggg

SEQ ID NO: 167577 - RNA, 32 nt, Human
gcagaucccuuucuuagcuuauaucuucuucu

SEQ ID NO: 167578 - RNA, 32 nt, Human
gcagauccucaagcagaccuacagcaaguuug

SEQ ID NO: 167579 - RNA, 19 nt, Human
gcagauccugaacacuccu

SEQ ID NO: 167580 - RNA, 32 nt, Human
gcagauccugaagccagaacuccaccccggcg

SEQ ID NO: 167581 - RNA, 32 nt, Human
gcagauccuggcugcgaguccauccgagggag

SEQ ID NO: 167582 - RNA, 21 nt, Human
gcagauccuuauccucaggga

SEQ ID NO: 167583 - RNA, 20 nt, Human
gcagaucguuuuacauguca

SEQ ID NO: 167584 - RNA, 20 nt, Human
gcagaucuccgaggcccuga

SEQ ID NO: 167585 - RNA, 23 nt, Human
gcagaucuccgaggcccugagga

SEQ ID NO: 167586 - RNA, 32 nt, Human
gcagaucugaugcugauuugaugcuguaugau

SEQ ID NO: 167587 - RNA, 32 nt, Human
gcagaucugcucccuucugggacccaggcuuc

SEQ ID NO: 167588 - RNA, 21 nt, Human
gcagaucugggaacugugaga

SEQ ID NO: 167589 - RNA, 32 nt, Human
gcagaucuguccagcacugauauugcucuaua

SEQ ID NO: 167590 - RNA, 32 nt, Human
gcagaucuguuucaaaaacaaauacaaaaaug

SEQ ID NO: 167591 - RNA, 24 nt, Human
gcagaucuucgggcggcuagggga

SEQ ID NO: 167592 - RNA, 32 nt, Human
gcagaucuugaaguaaggaagccagacacagc

SEQ ID NO: 167593 - RNA, 32 nt, Human
gcagaucuuggggccggaggccaguccaaccc

SEQ ID NO: 167594 - RNA, 25 nt, Human
gcagaugaaaccaggucacugggga

SEQ ID NO: 167595 - RNA, 32 nt, Human
gcagaugaagaaaaugaggugcagagaggauu

SEQ ID NO: 167596 - RNA, 29 nt, Human
gcagaugaagcuugcccgcgcccaguggc

SEQ ID NO: 167597 - RNA, 32 nt, Human
gcagaugaaggaguuuucaggagcuuuugaca

SEQ ID NO: 167598 - RNA, 32 nt, Human
gcagaugacaacacaucuccuggacuggagca

SEQ ID NO: 167599 - RNA, 32 nt, Human
gcagaugacacuuuuucccacccuuuuaaagc

SEQ ID NO: 167600 - RNA, 32 nt, Human
gcagaugacagagaaggacaaggugaucgaga

SEQ ID NO: 167601 - RNA, 20 nt, Human
gcagaugacuugaggucagg

SEQ ID NO: 167602 - RNA, 32 nt, Human
gcagaugagaaaaccaagaaugacagaaguuu

SEQ ID NO: 167603 - RNA, 32 nt, Human
gcagaugagaucuucuggcucaccuugaucuu

SEQ ID NO: 167604 - RNA, 32 nt, Human
gcagaugagcagcaugguaaucauguccagcc

SEQ ID NO: 167605 - RNA, 20 nt, Human
gcagaugaggaaacugaggc

SEQ ID NO: 167606 - RNA, 21 nt, Human
gcagaugaggaaacugaggcu

SEQ ID NO: 167607 - RNA, 32 nt, Human
gcagaugagggagcccguacacucccugccac

SEQ ID NO: 167608 - RNA, 20 nt, Human
gcagaugauagacacugggg

SEQ ID NO: 167609 - RNA, 32 nt, Human
gcagaugaugaaacuggguucaucccaguucc

SEQ ID NO: 167610 - RNA, 32 nt, Human
gcagaugaugggcucccugaaacugcugccgc

SEQ ID NO: 167611 - RNA, 32 nt, Human
gcagaugcacaccggaccuggucaaggccagg

SEQ ID NO: 167612 - RNA, 32 nt, Human
gcagaugcagaaggagagaauguguggaggau

SEQ ID NO: 167613 - RNA, 32 nt, Human
gcagaugcaggugccggcugcugcagugcagu

SEQ ID NO: 167614 - RNA, 32 nt, Human
gcagaugccagcagugccugcccgugucccca

SEQ ID NO: 167615 - RNA, 32 nt, Human
gcagaugccagugucugcucucuuuaccaccg

SEQ ID NO: 167616 - RNA, 32 nt, Human
gcagaugcccugaccucugcccccagguagca

SEQ ID NO: 167617 - RNA, 29 nt, Human
gcagaugccgguggccgugggucccuacg

SEQ ID NO: 167618 - RNA, 32 nt, Human
gcagaugccugcacaagccaagugugucuuau

SEQ ID NO: 167619 - RNA, 32 nt, Human
gcagaugcgagggcccagaguuguuuguaguu

SEQ ID NO: 167620 - RNA, 32 nt, Human
gcagaugcguagcauuugcugcauggguuaau

SEQ ID NO: 167621 - RNA, 32 nt, Human
gcagaugcuaagucuguaaacugugaauuaac

SEQ ID NO: 167622 - RNA, 19 nt, Human
gcagaugcuccuccccugg

SEQ ID NO: 167623 - RNA, 32 nt, Human
gcagaugcuccugcccuggccuccaggaaguc

SEQ ID NO: 167624 - RNA, 32 nt, Human
gcagaugcugauuuccuagaugaccugcucuc

SEQ ID NO: 167625 - RNA, 23 nt, Human
gcagaugcuuagauuuuguguca

SEQ ID NO: 167626 - RNA, 22 nt, Human
gcagaugcuuguaaucccagcu

SEQ ID NO: 167627 - RNA, 20 nt, Human
gcagauggaaaagcugaggc

SEQ ID NO: 167628 - RNA, 32 nt, Human
gcagauggaaaggagccuaggccaggugcaac

SEQ ID NO: 167629 - RNA, 24 nt, Human
gcagauggaacacuugaggucagg

SEQ ID NO: 167630 - RNA, 32 nt, Human
gcagauggacucugccaccuccucccagcugg

SEQ ID NO: 167631 - RNA, 32 nt, Human
gcagauggagguuuagagucucagggauuaag

SEQ ID NO: 167632 - RNA, 32 nt, Human
gcagauggcagcgggccucuccccagcccuga

SEQ ID NO: 167633 - RNA, 29 nt, Human
gcagauggcccaggcagugcggggcgacg

SEQ ID NO: 167634 - RNA, 25 nt, Human
gcagauggcccaguacacagcugag

SEQ ID NO: 167635 - RNA, 32 nt, Human
gcagauggccgggugccuggagcacugcacgc

SEQ ID NO: 167636 - RNA, 32 nt, Human
gcagauggcugcagagcuucguugauggucuu

SEQ ID NO: 167637 - RNA, 32 nt, Human
gcagauggcuugccuuggcacauacauucagc

SEQ ID NO: 167638 - RNA, 32 nt, Human
gcagaugggaaagagaaagcagaaaguaugaa

SEQ ID NO: 167639 - RNA, 32 nt, Human
gcagaugggagcaggcaccagcuauggagagg

SEQ ID NO: 167640 - RNA, 32 nt, Human
gcagaugggaggaccccgaggccagacgcaca

SEQ ID NO: 167641 - RNA, 32 nt, Human
gcagauggggguggcaagggggagacgggugg

SEQ ID NO: 167642 - RNA, 32 nt, Human
gcagaugguacagauguuccugccuuagaguc

SEQ ID NO: 167643 - RNA, 32 nt, Human
gcagaugguacagugaguguucagagacgugg

SEQ ID NO: 167644 - RNA, 32 nt, Human
gcagaugguccuccauuucaacuccagaagug

SEQ ID NO: 167645 - RNA, 32 nt, Human
gcagaugguggagucaagggugggcagcguac

SEQ ID NO: 167646 - RNA, 32 nt, Human
gcagaugguguuuucuucuucuagaaaggguc

SEQ ID NO: 167647 - RNA, 32 nt, Human
gcagauguaagccuguccaugcagucagccga

SEQ ID NO: 167648 - RNA, 32 nt, Human
gcagauguuggagaauucuucuaauuuucaga

SEQ ID NO: 167649 - RNA, 19 nt, Human
gcagauguuucaaauucuc

SEQ ID NO: 167650 - RNA, 32 nt, Human
gcagauguuucagcccaaaagcucuucuacag

SEQ ID NO: 167651 - RNA, 32 nt, Human
gcagauguuucgcuuucccuccuuccucgcug

SEQ ID NO: 167652 - RNA, 32 nt, Human
gcagauuaggagccaacguuguuugcacaugu

SEQ ID NO: 167653 - RNA, 32 nt, Human
gcagauucaaagugauccugugucuaaaccuu

SEQ ID NO: 167654 - RNA, 32 nt, Human
gcagauuccagaaaaaggagguuggggcacca

SEQ ID NO: 167655 - RNA, 32 nt, Human
gcagauuccagccuuugggcugggggccucuc

SEQ ID NO: 167656 - RNA, 22 nt, Human
gcagauucccaagcaaggguga

SEQ ID NO: 167657 - RNA, 32 nt, Human
gcagauuccguccgggcacaggaagcuuuccc

SEQ ID NO: 167658 - RNA, 32 nt, Human
gcagauucuauuaagcacucucauuucaggag

SEQ ID NO: 167659 - RNA, 32 nt, Human
gcagauucuauuuccccucuucugcuaauacc

SEQ ID NO: 167660 - RNA, 32 nt, Human
gcagauucugcagcuggugugggguucagguc

SEQ ID NO: 167661 - RNA, 32 nt, Human
gcagauucuucccagccaauccuucugaugac

SEQ ID NO: 167662 - RNA, 22 nt, Human
gcagauugaaggagcugaggcu

SEQ ID NO: 167663 - RNA, 32 nt, Human
gcagauugaugaacagcaaaagaugcuagaga

SEQ ID NO: 167664 - RNA, 32 nt, Human
gcagauugcaugaacugaaagcuccuucuaau

SEQ ID NO: 167665 - RNA, 32 nt, Human
gcagauuggauagccagaaagccagucacucg

SEQ ID NO: 167666 - RNA, 19 nt, Human
gcagauuguccacacagua

SEQ ID NO: 167667 - RNA, 32 nt, Human
gcagauuguggggacccagggaagggaggaau

SEQ ID NO: 167668 - RNA, 32 nt, Human
gcagauuguucuguugccgggcaacgcgacuu

SEQ ID NO: 167669 - RNA, 32 nt, Human
gcagauuuaugacauccauauaagcuaucugg

SEQ ID NO: 167670 - RNA, 32 nt, Human
gcagauuugcucucccucccgcuuccucccuc

SEQ ID NO: 167671 - RNA, 32 nt, Human
gcagauuuguaaccucugguucucugcaggga

SEQ ID NO: 167672 - RNA, 32 nt, Human
gcagauuuugacuauguuuacaggacgguuua

SEQ ID NO: 167673 - RNA, 32 nt, Human
gcagauuuuucagacauuguucauaccuugca

SEQ ID NO: 167674 - RNA, 32 nt, Human
gcagcaaacacuccacccuccaccuuccauuu

SEQ ID NO: 167675 - RNA, 32 nt, Human
gcagcaaaccaccauggcacacauuuaccuau

SEQ ID NO: 167676 - RNA, 32 nt, Human
gcagcaaaccaccauggcacacauuuuccuau

SEQ ID NO: 167677 - RNA, 32 nt, Human
gcagcaaaccaccauggcacacguuuaccugu

SEQ ID NO: 167678 - RNA, 32 nt, Human
gcagcaaaccaccauggcacauguauaccuau

SEQ ID NO: 167679 - RNA, 32 nt, Human
gcagcaaaccaccauggcacauguguaccuau

SEQ ID NO: 167680 - RNA, 32 nt, Human
gcagcaaaccaccauggcacauguuuaccuau

SEQ ID NO: 167681 - RNA, 32 nt, Human
gcagcaaaccaccauggcaugucuauaccuau

SEQ ID NO: 167682 - RNA, 32 nt, Human
gcagcaaacuuggugaaacuacaucuccaaug

SEQ ID NO: 167683 - RNA, 32 nt, Human
gcagcaaagagggagaagaggaacagcgcuug

SEQ ID NO: 167684 - RNA, 32 nt, Human
gcagcaaagccuugcaaucccaggcugggguc

SEQ ID NO: 167685 - RNA, 32 nt, Human
gcagcaaaggggccugcugagcucugguuagg

SEQ ID NO: 167686 - RNA, 32 nt, Human
gcagcaaaugccacucugggcagucuuuugug

SEQ ID NO: 167687 - RNA, 18 nt, Human
gcagcaacaagaacagca

SEQ ID NO: 167688 - RNA, 32 nt, Human
gcagcaacaagagggcuggaagggggagcugc

SEQ ID NO: 167689 - RNA, 32 nt, Human
gcagcaacauaguaagaccccaucucuauaaa

SEQ ID NO: 167690 - RNA, 32 nt, Human
gcagcaacaucacuaaccacaucccagacaua

SEQ ID NO: 167691 - RNA, 32 nt, Human
gcagcaacgcccuaggauuugcagugaauguc

SEQ ID NO: 167692 - RNA, 32 nt, Human
gcagcaacgcccuaggguuugcagugaauguc

SEQ ID NO: 167693 - RNA, 32 nt, Human
gcagcaacuccuugauucuuggaugacugaac

SEQ ID NO: 167694 - RNA, 32 nt, Human
gcagcaacucgacugguucucccaggagcagg

SEQ ID NO: 167695 - RNA, 32 nt, Human
gcagcaagaagcggggagagagagggauagaa

SEQ ID NO: 167696 - RNA, 24 nt, Human
gcagcaagaaugaccuccugcagc

SEQ ID NO: 167697 - RNA, 32 nt, Human
gcagcaagagauacaugacauucuuucuuccu

SEQ ID NO: 167698 - RNA, 20 nt, Human
gcagcaagaggcucucucca

SEQ ID NO: 167699 - RNA, 18 nt, Human
gcagcaagaucaugugca

SEQ ID NO: 167700 - RNA, 21 nt, Human
gcagcaagcacuaagcuguga

SEQ ID NO: 167701 - RNA, 19 nt, Human
gcagcaagcagacauuuca

SEQ ID NO: 167702 - RNA, 32 nt, Human
gcagcaagcagcguuuauggugcuuccuucuc

SEQ ID NO: 167703 - RNA, 32 nt, Human
gcagcaagccagcugcgggccuugggggcuca

SEQ ID NO: 167704 - RNA, 32 nt, Human
gcagcaagccaggcacagugaguggcagagca

SEQ ID NO: 167705 - RNA, 32 nt, Human
gcagcaagcccaggcggcgguggaaaggcuaa

SEQ ID NO: 167706 - RNA, 32 nt, Human
gcagcaagcccaggcggcgguggaaaggcugg

SEQ ID NO: 167707 - RNA, 32 nt, Human
gcagcaagcuaaauaagcaucuucccacugcg

SEQ ID NO: 167708 - RNA, 18 nt, Human
gcagcaagcuauacuguc

SEQ ID NO: 167709 - RNA, 24 nt, Human
gcagcaagcucccagcccagagca

SEQ ID NO: 167710 - RNA, 18 nt, Human
gcagcaagcugcuacugc

SEQ ID NO: 167711 - RNA, 19 nt, Human
gcagcaagcugcuacugca

SEQ ID NO: 167712 - RNA, 19 nt, Human
gcagcaagcugcucuguua

SEQ ID NO: 167713 - RNA, 19 nt, Human
gcagcaagcugcugguguc

SEQ ID NO: 167714 - RNA, 18 nt, Human
gcagcaaggagaugugca

SEQ ID NO: 167715 - RNA, 32 nt, Human
gcagcaaggauguagagagaaauaggacuuaa

SEQ ID NO: 167716 - RNA, 32 nt, Human
gcagcaaggcacugcgggugccccagagacac

SEQ ID NO: 167717 - RNA, 19 nt, Human
gcagcaagggaccugcuca

SEQ ID NO: 167718 - RNA, 32 nt, Human
gcagcaagggggagacugcgguauggccccgg

SEQ ID NO: 167719 - RNA, 19 nt, Human
gcagcaaggucccugcggc

SEQ ID NO: 167720 - RNA, 23 nt, Human
gcagcaagguggcuccuguggca

SEQ ID NO: 167721 - RNA, 19 nt, Human
gcagcaaguaagaauuuca

SEQ ID NO: 167722 - RNA, 18 nt, Human
gcagcaagucagaggcuc

SEQ ID NO: 167723 - RNA, 19 nt, Human
gcagcaagugcuccgugca

SEQ ID NO: 167724 - RNA, 19 nt, Human
gcagcaaguuuauuaauca

SEQ ID NO: 167725 - RNA, 18 nt, Human
gcagcaaguuuuuaugca

SEQ ID NO: 167726 - RNA, 32 nt, Human
gcagcaaucuccacagccuccugggucucacc

SEQ ID NO: 167727 - RNA, 31 nt, Human
gcagcaauggccaagaucaaggcuccagauc

SEQ ID NO: 167728 - RNA, 21 nt, Human
gcagcaauugcuacucuauac

SEQ ID NO: 167729 - RNA, 20 nt, Human
gcagcaauuuguaaaggcuc

SEQ ID NO: 167730 - RNA, 32 nt, Human
gcagcacaaccuugccagagcuuggguccuac

SEQ ID NO: 167731 - RNA, 32 nt, Human
gcagcacaagugcucaccggggccagagccag

SEQ ID NO: 167732 - RNA, 32 nt, Human
gcagcacacacauuuacuacacacacaguguu

SEQ ID NO: 167733 - RNA, 32 nt, Human
gcagcacacgcaaggcucacccugccacgagc

SEQ ID NO: 167734 - RNA, 20 nt, Human
gcagcacagaggagcuguga

SEQ ID NO: 167735 - RNA, 32 nt, Human
gcagcacagaugugcaggaggagaccauuucc

SEQ ID NO: 167736 - RNA, 32 nt, Human
gcagcacagcagaguucaggcagggcacagcc

SEQ ID NO: 167737 - RNA, 32 nt, Human
gcagcacagcugagugcugagaaucuggcugg

SEQ ID NO: 167738 - RNA, 32 nt, Human
gcagcacagcuuagaugcccugguuugucccu

SEQ ID NO: 167739 - RNA, 24 nt, Human
gcagcacaggaaaaguaauucaga

SEQ ID NO: 167740 - RNA, 32 nt, Human
gcagcacaggcgccccaccaccacccaguuug

SEQ ID NO: 167741 - RNA, 32 nt, Human
gcagcacaggcuagucaggaacaucggaugcc

SEQ ID NO: 167742 - RNA, 32 nt, Human
gcagcacaguacucaggcagugcaauacucag

SEQ ID NO: 167743 - RNA, 23 nt, Human
gcagcacaguauuaauauuuaga

SEQ ID NO: 167744 - RNA, 32 nt, Human
gcagcacaucacaguggaccuucugccuccuc

SEQ ID NO: 167745 - RNA, 32 nt, Human
gcagcacaucucaggacccaggcaauagacug

SEQ ID NO: 167746 - RNA, 32 nt, Human
gcagcacaucuuccuccucgcaggagggacca

SEQ ID NO: 167747 - RNA, 32 nt, Human
gcagcaccaaagguuuuugucuugggaaggca

SEQ ID NO: 167748 - RNA, 22 nt, Human
gcagcaccaccccagggcagag

SEQ ID NO: 167749 - RNA, 32 nt, Human
gcagcaccacugccugcucccuggaagguaga

SEQ ID NO: 167750 - RNA, 24 nt, Human
gcagcaccagcuuugggggcagag

SEQ ID NO: 167751 - RNA, 26 nt, Human
gcagcaccaggccaucauggugcugg

SEQ ID NO: 167752 - RNA, 21 nt, Human
gcagcaccaggugcugggcuc

SEQ ID NO: 167753 - RNA, 32 nt, Human
gcagcacccaggacacagccagcaugaacugg

SEQ ID NO: 167754 - RNA, 32 nt, Human
gcagcaccccucaguuccugugccucagccca

SEQ ID NO: 167755 - RNA, 32 nt, Human
gcagcacccuccacuucucuccuaggcaauga

SEQ ID NO: 167756 - RNA, 32 nt, Human
gcagcacccuggcaaagcagcucacacacugc

SEQ ID NO: 167757 - RNA, 32 nt, Human
gcagcacccugggccacgccgaugacuacugc

SEQ ID NO: 167758 - RNA, 32 nt, Human
gcagcacccuuccugcugaagcagccaauaga

SEQ ID NO: 167759 - RNA, 32 nt, Human
gcagcaccggcagagggaagauacggggcaaa

SEQ ID NO: 167760 - RNA, 18 nt, Human
gcagcaccggccgucaca

SEQ ID NO: 167761 - RNA, 27 nt, Human
gcagcaccggcggcagcaccagcgcga

SEQ ID NO: 167762 - RNA, 23 nt, Human
gcagcaccggguauagggcagag

SEQ ID NO: 167763 - RNA, 32 nt, Human
gcagcaccuagagagagcaucugagcugaagg

SEQ ID NO: 167764 - RNA, 32 nt, Human
gcagcaccuggaucuugccuuuauaagaacau

SEQ ID NO: 167765 - RNA, 32 nt, Human
gcagcaccugggaggccugucugaagcaugca

SEQ ID NO: 167766 - RNA, 32 nt, Human
gcagcacgcugaggcccugcaggcccugaggc

SEQ ID NO: 167767 - RNA, 32 nt, Human
gcagcacggcacuucagccuaggugacagagu

SEQ ID NO: 167768 - RNA, 32 nt, Human
gcagcacgucgccauccgucaccagaauuagu

SEQ ID NO: 167769 - RNA, 25 nt, Human
gcagcacuaagacaaaggaacaggg

SEQ ID NO: 167770 - RNA, 25 nt, Human
gcagcacuagcaacagcagagcagg

SEQ ID NO: 167771 - RNA, 16 nt, Human
gcagcacugacugcuu

SEQ ID NO: 167772 - RNA, 22 nt, Human
gcagcacugagacacgagcccc

SEQ ID NO: 167773 - RNA, 19 nt, Human
gcagcacugaguaaaguuc

SEQ ID NO: 167774 - RNA, 17 nt, Human
gcagcacugaucuggcu

SEQ ID NO: 167775 - RNA, 32 nt, Human
gcagcacugcagccacaagccauggcagucgu

SEQ ID NO: 167776 - RNA, 32 nt, Human
gcagcacugccacugccuuuggccaccugagg

SEQ ID NO: 167777 - RNA, 32 nt, Human
gcagcacugccucucuguuuggggagauguaa

SEQ ID NO: 167778 - RNA, 32 nt, Human
gcagcacugccucugcccaccugccuuuaaga

SEQ ID NO: 167779 - RNA, 19 nt, Human
gcagcacuggaagcaguuc

SEQ ID NO: 167780 - RNA, 32 nt, Human
gcagcacuggagccugguaaaugcagauaaaa

SEQ ID NO: 167781 - RNA, 32 nt, Human
gcagcacuggagcgggggauggggaagcgcgc

SEQ ID NO: 167782 - RNA, 18 nt, Human
gcagcacuggcaggagcu

SEQ ID NO: 167783 - RNA, 20 nt, Human
gcagcacuggcccagggugc

SEQ ID NO: 167784 - RNA, 17 nt, Human
gcagcacuggcgggggc

SEQ ID NO: 167785 - RNA, 20 nt, Human
gcagcacugggcucaggcuu

SEQ ID NO: 167786 - RNA, 16 nt, Human
gcagcacuggggaggc

SEQ ID NO: 167787 - RNA, 21 nt, Human
gcagcacuggguuggagagag

SEQ ID NO: 167788 - RNA, 22 nt, Human
gcagcacuggucccaagcagag

SEQ ID NO: 167789 - RNA, 32 nt, Human
gcagcacuguacuccagccugggcgauggagc

SEQ ID NO: 167790 - RNA, 20 nt, Human
gcagcacuguguccaggcuc

SEQ ID NO: 167791 - RNA, 19 nt, Human
gcagcacuuccacaagccc

SEQ ID NO: 167792 - RNA, 22 nt, Human
gcagcacuucccugccacuccu

SEQ ID NO: 167793 - RNA, 32 nt, Human
gcagcacuuuguuauguggaagacagguuuuu

SEQ ID NO: 167794 - RNA, 32 nt, Human
gcagcagaaacagauucucaguucauuuuuac

SEQ ID NO: 167795 - RNA, 32 nt, Human
gcagcagaaagccaaaaugacaggcaagcaca

SEQ ID NO: 167796 - RNA, 32 nt, Human
gcagcagaaagccagaggcaggcaguggugcc

SEQ ID NO: 167797 - RNA, 21 nt, Human
gcagcagaacgcccugcggca

SEQ ID NO: 167798 - RNA, 32 nt, Human
gcagcagaagcaggcacuuccaaaccugcgaa

SEQ ID NO: 167799 - RNA, 32 nt, Human
gcagcagaaguugcaaaaugaccuacugcaga

SEQ ID NO: 167800 - RNA, 19 nt, Human
gcagcagaaucgcuugaac

SEQ ID NO: 167801 - RNA, 32 nt, Human
gcagcagacaagcuggacuggggaagauucuu

SEQ ID NO: 167802 - RNA, 26 nt, Human
gcagcagacauccugaagaaauggua

SEQ ID NO: 167803 - RNA, 19 nt, Human
gcagcagacccggcagcgc

SEQ ID NO: 167804 - RNA, 32 nt, Human
gcagcagacucccucagccaugagaaccagcu

SEQ ID NO: 167805 - RNA, 32 nt, Human
gcagcagagaaaagcugaugggagugagagaa

SEQ ID NO: 167806 - RNA, 32 nt, Human
gcagcagagcgcgauccagucuggggccgggc

SEQ ID NO: 167807 - RNA, 32 nt, Human
gcagcagaggcagagaacgaggacaggacccu

SEQ ID NO: 167808 - RNA, 32 nt, Human
gcagcagaggcagaggcggcggcggcagcggc

SEQ ID NO: 167809 - RNA, 32 nt, Human
gcagcagaggcagccagccagcaaagaggggc

SEQ ID NO: 167810 - RNA, 32 nt, Human
gcagcagaggcagggaccacucggggucuggu

SEQ ID NO: 167811 - RNA, 32 nt, Human
gcagcagagggacauugggaaggguccaugga

SEQ ID NO: 167812 - RNA, 32 nt, Human
gcagcagagggaggugggggagagggaaauaa

SEQ ID NO: 167813 - RNA, 20 nt, Human
gcagcagagggcuuugccca

SEQ ID NO: 167814 - RNA, 20 nt, Human
gcagcagaucagagcuguga

SEQ ID NO: 167815 - RNA, 32 nt, Human
gcagcagaucagugggaugagggagacuguuc

SEQ ID NO: 167816 - RNA, 32 nt, Human
gcagcagauggacaaggcgucuccuggggugg

SEQ ID NO: 167817 - RNA, 32 nt, Human
gcagcagauggaccaugcccuugcuggguuuu

SEQ ID NO: 167818 - RNA, 32 nt, Human
gcagcagauugguggcuccagaugcugugugu

SEQ ID NO: 167819 - RNA, 32 nt, Human
gcagcagcaaacauuugcuagucagacaagug

SEQ ID NO: 167820 - RNA, 27 nt, Human
gcagcagcaaaggcaccauaagucaaa

SEQ ID NO: 167821 - RNA, 32 nt, Human
gcagcagcacagagccaccaagcagugcugca

SEQ ID NO: 167822 - RNA, 32 nt, Human
gcagcagcaccaugggcacggugcugucccug

SEQ ID NO: 167823 - RNA, 32 nt, Human
gcagcagcacccugcaagccagccuggccagc

SEQ ID NO: 167824 - RNA, 32 nt, Human
gcagcagcaccuucaaauucucagccaaagca

SEQ ID NO: 167825 - RNA, 32 nt, Human
gcagcagcagagagcagagagcagaaagcagu

SEQ ID NO: 167826 - RNA, 32 nt, Human
gcagcagcagaggcccccgcccucaccccagc

SEQ ID NO: 167827 - RNA, 32 nt, Human
gcagcagcagaggcggaggcuccagcgcgucu

SEQ ID NO: 167828 - RNA, 32 nt, Human
gcagcagcagaggcggcggcggcccccagccc

SEQ ID NO: 167829 - RNA, 32 nt, Human
gcagcagcagaguaagccuccaaaaagaagca

SEQ ID NO: 167830 - RNA, 32 nt, Human
gcagcagcagauuuuacguguaugaauccaaa

SEQ ID NO: 167831 - RNA, 32 nt, Human
gcagcagcagcagcagcagcaaccuuugauca

SEQ ID NO: 167832 - RNA, 32 nt, Human
gcagcagcagcagcagcagcacuugaauauga

SEQ ID NO: 167833 - RNA, 26 nt, Human
gcagcagcagcagcagcagcaggcgg

SEQ ID NO: 167834 - RNA, 26 nt, Human
gcagcagcagcagcagcaguuuguga

SEQ ID NO: 167835 - RNA, 21 nt, Human
gcagcagcagcagcagcgaga

SEQ ID NO: 167836 - RNA, 20 nt, Human
gcagcagcagcagcagcgga

SEQ ID NO: 167837 - RNA, 32 nt, Human
gcagcagcagcagcaggcgguggccaggccgg

SEQ ID NO: 167838 - RNA, 32 nt, Human
gcagcagcagcagcaggugccugugacauacc

SEQ ID NO: 167839 - RNA, 27 nt, Human
gcagcagcagcagccagggcagcgcgg

SEQ ID NO: 167840 - RNA, 32 nt, Human
gcagcagcagcaguacucagugauagggggcu

SEQ ID NO: 167841 - RNA, 32 nt, Human
gcagcagcagcaguuugugaucuguccuucca

SEQ ID NO: 167842 - RNA, 32 nt, Human
gcagcagcagcaucuggugcagcugaccccuc

SEQ ID NO: 167843 - RNA, 32 nt, Human
gcagcagcagccacacucccaccauccucaca

SEQ ID NO: 167844 - RNA, 32 nt, Human
gcagcagcagccacagcagcagccaggagaag

SEQ ID NO: 167845 - RNA, 32 nt, Human
gcagcagcagccgccgccgccgccgccaguaa

SEQ ID NO: 167846 - RNA, 32 nt, Human
gcagcagcagccucuucccauggauccaccac

SEQ ID NO: 167847 - RNA, 24 nt, Human
gcagcagcagcggcagcaguucgg

SEQ ID NO: 167848 - RNA, 23 nt, Human
gcagcagcagcggcggcagcagc

SEQ ID NO: 167849 - RNA, 20 nt, Human
gcagcagcagcggcggccga

SEQ ID NO: 167850 - RNA, 23 nt, Human
gcagcagcagcggcggccggggc

SEQ ID NO: 167851 - RNA, 22 nt, Human
gcagcagcaggcagggcagcgc

SEQ ID NO: 167852 - RNA, 32 nt, Human
gcagcagcauugaaagauaacaauuccauguc

SEQ ID NO: 167853 - RNA, 32 nt, Human
gcagcagcauugaaagcuaacaauuccauguc

SEQ ID NO: 167854 - RNA, 32 nt, Human
gcagcagcauugaaagcuaacaguuccauguc

SEQ ID NO: 167855 - RNA, 32 nt, Human
gcagcagccaacgcucccguggcuccaagguc

SEQ ID NO: 167856 - RNA, 18 nt, Human
gcagcagccacagccaca

SEQ ID NO: 167857 - RNA, 32 nt, Human
gcagcagccaccgccgcgucccucucuccacg

SEQ ID NO: 167858 - RNA, 32 nt, Human
gcagcagccagaaagcauaaccccuacuguag

SEQ ID NO: 167859 - RNA, 32 nt, Human
gcagcagccagccagcagccucucccaggcgg

SEQ ID NO: 167860 - RNA, 32 nt, Human
gcagcagccagccuuaaaguaguccauucuug

SEQ ID NO: 167861 - RNA, 21 nt, Human
gcagcagccgcagcggcgcga

SEQ ID NO: 167862 - RNA, 32 nt, Human
gcagcagccucagccucugccuguccagcgcc

SEQ ID NO: 167863 - RNA, 32 nt, Human
gcagcagccugaguguucucacuaggggucac

SEQ ID NO: 167864 - RNA, 22 nt, Human
gcagcagccuggggcagggacu

SEQ ID NO: 167865 - RNA, 32 nt, Human
gcagcagccuuggucuuucuccagaaggaugu

SEQ ID NO: 167866 - RNA, 32 nt, Human
gcagcagcgacagccuggacgaggccagaucg

SEQ ID NO: 167867 - RNA, 20 nt, Human
gcagcagcgaggguggugca

SEQ ID NO: 167868 - RNA, 32 nt, Human
gcagcagcgauagcagccgcagaagagccagc

SEQ ID NO: 167869 - RNA, 21 nt, Human
gcagcagcggcggcagcccga

SEQ ID NO: 167870 - RNA, 20 nt, Human
gcagcagcggcggcgcggcg

SEQ ID NO: 167871 - RNA, 20 nt, Human
gcagcagcggcggcggcagc

SEQ ID NO: 167872 - RNA, 25 nt, Human
gcagcagcggcggcggcggcagcgg

SEQ ID NO: 167873 - RNA, 25 nt, Human
gcagcagcggcggcggcggcggcgg

SEQ ID NO: 167874 - RNA, 23 nt, Human
gcagcagcggcggcggcggcugc

SEQ ID NO: 167875 - RNA, 25 nt, Human
gcagcagcggcggcggcggcugcgg

SEQ ID NO: 167876 - RNA, 23 nt, Human
gcagcagcggcggcggcgggcgg

SEQ ID NO: 167877 - RNA, 20 nt, Human
gcagcagcggcgguggcagc

SEQ ID NO: 167878 - RNA, 32 nt, Human
gcagcagcuagugccgacucccgccuagcucu

SEQ ID NO: 167879 - RNA, 19 nt, Human
gcagcagcuauagcuguga

SEQ ID NO: 167880 - RNA, 24 nt, Human
gcagcagcucaaggauggcacuca

SEQ ID NO: 167881 - RNA, 32 nt, Human
gcagcagcucacacccuaccuuccccagacuu

SEQ ID NO: 167882 - RNA, 25 nt, Human
gcagcagcuccaccagcagccccag

SEQ ID NO: 167883 - RNA, 25 nt, Human
gcagcagcuccgucagcagcaccag

SEQ ID NO: 167884 - RNA, 18 nt, Human
gcagcagcucuuugccca

SEQ ID NO: 167885 - RNA, 32 nt, Human
gcagcagcugacacuuuuucccagaagggaga

SEQ ID NO: 167886 - RNA, 32 nt, Human
gcagcagcugaggagacagguuugagcuggcu

SEQ ID NO: 167887 - RNA, 32 nt, Human
gcagcagcugccugcucuccagccucuggagg

SEQ ID NO: 167888 - RNA, 32 nt, Human
gcagcagcugcuggagagauccggagagcugg

SEQ ID NO: 167889 - RNA, 21 nt, Human
gcagcagcuguggcagcacgc

SEQ ID NO: 167890 - RNA, 32 nt, Human
gcagcagcuucugcuucuuugggcuugcaagu

SEQ ID NO: 167891 - RNA, 32 nt, Human
gcagcagcuuggggagagggauuucccugcag

SEQ ID NO: 167892 - RNA, 32 nt, Human
gcagcagcuuuuccagaauuuggcuggcaggc

SEQ ID NO: 167893 - RNA, 30 nt, Human
gcagcaggaagccauacugcccaguguccc

SEQ ID NO: 167894 - RNA, 32 nt, Human
gcagcaggaauggggcugggcccgugggccag

SEQ ID NO: 167895 - RNA, 32 nt, Human
gcagcaggacaguggagguguguggaaggcac

SEQ ID NO: 167896 - RNA, 19 nt, Human
gcagcaggacccugggcca

SEQ ID NO: 167897 - RNA, 32 nt, Human
gcagcaggacuuccuacccagaggagguucga

SEQ ID NO: 167898 - RNA, 32 nt, Human
gcagcaggagaagcaguggccagaggggagau

SEQ ID NO: 167899 - RNA, 32 nt, Human
gcagcaggagcagaggaaggcagacacccaca

SEQ ID NO: 167900 - RNA, 32 nt, Human
gcagcaggaggcacgcacccagagaaugcugg

SEQ ID NO: 167901 - RNA, 32 nt, Human
gcagcaggaggcagaaggaagccccagcuucc

SEQ ID NO: 167902 - RNA, 32 nt, Human
gcagcaggaggcagagcugugggaugaaugag

SEQ ID NO: 167903 - RNA, 32 nt, Human
gcagcaggaguggggagggaagggagccaagg

SEQ ID NO: 167904 - RNA, 32 nt, Human
gcagcaggcaaggagccugggucuaggcuaag

SEQ ID NO: 167905 - RNA, 23 nt, Human
gcagcaggcaggugaucaugcug

SEQ ID NO: 167906 - RNA, 22 nt, Human
gcagcaggccaacaccaaccug

SEQ ID NO: 167907 - RNA, 32 nt, Human
gcagcaggccaagggggaggugcgagcgugga

SEQ ID NO: 167908 - RNA, 19 nt, Human
gcagcaggcccagggccgg

SEQ ID NO: 167909 - RNA, 32 nt, Human
gcagcaggccgaggaggaagaagaggggcagu

SEQ ID NO: 167910 - RNA, 18 nt, Human
gcagcaggccuguggggc

SEQ ID NO: 167911 - RNA, 21 nt, Human
gcagcaggccuugucucugaa

SEQ ID NO: 167912 - RNA, 32 nt, Human
gcagcaggcggcgggccagggccgggcugcgc

SEQ ID NO: 167913 - RNA, 21 nt, Human
gcagcaggcucuggguggggc

SEQ ID NO: 167914 - RNA, 32 nt, Human
gcagcaggcugaagggaucauggugcaguacg

SEQ ID NO: 167915 - RNA, 32 nt, Human
gcagcaggcuugggccuggggugcagcagaga

SEQ ID NO: 167916 - RNA, 32 nt, Human
gcagcagggaauggcuuugccugacaacaccc

SEQ ID NO: 167917 - RNA, 17 nt, Human
gcagcagggaucagccu

SEQ ID NO: 167918 - RNA, 32 nt, Human
gcagcagggaucccuccuccuccaggggaucu

SEQ ID NO: 167919 - RNA, 32 nt, Human
gcagcagggauugccggcuccgggaggcgcuc

SEQ ID NO: 167920 - RNA, 32 nt, Human
gcagcagggcaggcacguggccagccacgagg

SEQ ID NO: 167921 - RNA, 32 nt, Human
gcagcagggccugcuguauuugguuuguuagu

SEQ ID NO: 167922 - RNA, 32 nt, Human
gcagcagggcucaguggaggucuggaaugacg

SEQ ID NO: 167923 - RNA, 23 nt, Human
gcagcagggggagcucccgggca

SEQ ID NO: 167924 - RNA, 32 nt, Human
gcagcagggugagggagcagcacagacaaaag

SEQ ID NO: 167925 - RNA, 21 nt, Human
gcagcaggguggcagggcaga

SEQ ID NO: 167926 - RNA, 32 nt, Human
gcagcagguacccccuccacaucccuagggcu

SEQ ID NO: 167927 - RNA, 18 nt, Human
gcagcaggugcauaguca

SEQ ID NO: 167928 - RNA, 32 nt, Human
gcagcaggugccugugacauaccucagacgcc

SEQ ID NO: 167929 - RNA, 32 nt, Human
gcagcagguggaaaacagagagguuguuagac

SEQ ID NO: 167930 - RNA, 18 nt, Human
gcagcagguggacaugca

SEQ ID NO: 167931 - RNA, 32 nt, Human
gcagcaggugucugcugaaguccuccacacuc

SEQ ID NO: 167932 - RNA, 32 nt, Human
gcagcagguucccagccccguucagcuggugg

SEQ ID NO: 167933 - RNA, 32 nt, Human
gcagcaguagcaauucuggagcuguugccggc

SEQ ID NO: 167934 - RNA, 19 nt, Human
gcagcaguagcagcagcgu

SEQ ID NO: 167935 - RNA, 17 nt, Human
gcagcaguagcggcagc

SEQ ID NO: 167936 - RNA, 32 nt, Human
gcagcagucccagauaaccaagcaagcucagc

SEQ ID NO: 167937 - RNA, 32 nt, Human
gcagcagugaccacagccuuaccaaagcagac

SEQ ID NO: 167938 - RNA, 32 nt, Human
gcagcagugcacuggccuccagccucaaucug

SEQ ID NO: 167939 - RNA, 21 nt, Human
gcagcagugcaugggcgcugg

SEQ ID NO: 167940 - RNA, 21 nt, Human
gcagcagugcccucaccuaca

SEQ ID NO: 167941 - RNA, 32 nt, Human
gcagcaguggacaguggccaggagggcgccgc

SEQ ID NO: 167942 - RNA, 32 nt, Human
gcagcaguggacaguggccaggagggcgcugc

SEQ ID NO: 167943 - RNA, 16 nt, Human
gcagcaguggcagcuu

SEQ ID NO: 167944 - RNA, 20 nt, Human
gcagcaguggcaguggcagc

SEQ ID NO: 167945 - RNA, 20 nt, Human
gcagcaguggcccucaucac

SEQ ID NO: 167946 - RNA, 22 nt, Human
gcagcaguggcugaucaucacu

SEQ ID NO: 167947 - RNA, 32 nt, Human
gcagcagugggauccacuggggagaggcugga

SEQ ID NO: 167948 - RNA, 21 nt, Human
gcagcaguuccaggagcugag

SEQ ID NO: 167949 - RNA, 19 nt, Human
gcagcaguucucaaaggcu

SEQ ID NO: 167950 - RNA, 32 nt, Human
gcagcaguugaucagacugaaaaacgguuuuu

SEQ ID NO: 167951 - RNA, 21 nt, Human
gcagcaucacugagcaggaag

SEQ ID NO: 167952 - RNA, 32 nt, Human
gcagcaucaggcacagucugucugggugcaac

SEQ ID NO: 167953 - RNA, 32 nt, Human
gcagcaucauuuccuuacaauacuguccggug

SEQ ID NO: 167954 - RNA, 20 nt, Human
gcagcauccaccagcccgcu

SEQ ID NO: 167955 - RNA, 32 nt, Human
gcagcauccacuguccuuucagcuccaaauuu

SEQ ID NO: 167956 - RNA, 32 nt, Human
gcagcauccauagcccacaagccagcgugggu

SEQ ID NO: 167957 - RNA, 32 nt, Human
gcagcauccucugaggccccggggccuguugg

SEQ ID NO: 167958 - RNA, 32 nt, Human
gcagcaucuagagagaaaagaggaagauucug

SEQ ID NO: 167959 - RNA, 32 nt, Human
gcagcaucucaucuacccuccuugacaccucc

SEQ ID NO: 167960 - RNA, 20 nt, Human
gcagcaucucccagaggcuc

SEQ ID NO: 167961 - RNA, 32 nt, Human
gcagcaucucuaccuucuccccagcucccagg

SEQ ID NO: 167962 - RNA, 23 nt, Human
gcagcaucuugucauacguguca

SEQ ID NO: 167963 - RNA, 21 nt, Human
gcagcaugaaugccaugaaug

SEQ ID NO: 167964 - RNA, 32 nt, Human
gcagcaugacagcugcuugccaugacugaugc

SEQ ID NO: 167965 - RNA, 18 nt, Human
gcagcaugacucagacug

SEQ ID NO: 167966 - RNA, 20 nt, Human
gcagcaugagaaggcuguga

SEQ ID NO: 167967 - RNA, 22 nt, Human
gcagcaugagaaggcugugaga

SEQ ID NO: 167968 - RNA, 22 nt, Human
gcagcaugagcaucaucuguga

SEQ ID NO: 167969 - RNA, 18 nt, Human
gcagcaugaggcugggcc

SEQ ID NO: 167970 - RNA, 20 nt, Human
gcagcaugagguggugcugg

SEQ ID NO: 167971 - RNA, 21 nt, Human
gcagcaugaucuauuuggcug

SEQ ID NO: 167972 - RNA, 32 nt, Human
gcagcaugaucuucaaaaugcaucauugauuu

SEQ ID NO: 167973 - RNA, 23 nt, Human
gcagcaugaugcuuuguuuaaug

SEQ ID NO: 167974 - RNA, 32 nt, Human
gcagcaugauuugcacaaagucgaccaacaaa

SEQ ID NO: 167975 - RNA, 32 nt, Human
gcagcaugcacaccccucuggcagcccuuugu

SEQ ID NO: 167976 - RNA, 22 nt, Human
gcagcaugcagaccagcugugg

SEQ ID NO: 167977 - RNA, 32 nt, Human
gcagcaugcccugacuguuccaacaccaccug

SEQ ID NO: 167978 - RNA, 32 nt, Human
gcagcaugcuacaggccagccuucaaagaaag

SEQ ID NO: 167979 - RNA, 22 nt, Human
gcagcauggacaagaaggcugg

SEQ ID NO: 167980 - RNA, 23 nt, Human
gcagcauggaccacgguugcugg

SEQ ID NO: 167981 - RNA, 23 nt, Human
gcagcauggaguagggcagggcu

SEQ ID NO: 167982 - RNA, 32 nt, Human
gcagcauggccaggcuggccagggcgugggca

SEQ ID NO: 167983 - RNA, 21 nt, Human
gcagcauggggcaguggcugg

SEQ ID NO: 167984 - RNA, 30 nt, Human
gcagcaugguucacuccagcaugggggcuc

SEQ ID NO: 167985 - RNA, 30 nt, Human
gcagcaugucuagacugggagcccugggug

SEQ ID NO: 167986 - RNA, 32 nt, Human
gcagcaugugcucgcugcugggcauagguggc

SEQ ID NO: 167987 - RNA, 20 nt, Human
gcagcauguucagcucuuga

SEQ ID NO: 167988 - RNA, 21 nt, Human
gcagcauguuccagcucuuga

SEQ ID NO: 167989 - RNA, 32 nt, Human
gcagcauuauaauuaauuuucaggguuuugag

SEQ ID NO: 167990 - RNA, 19 nt, Human
gcagcauuaucaaaggauc

SEQ ID NO: 167991 - RNA, 21 nt, Human
gcagcauuauuggcaauagcu

SEQ ID NO: 167992 - RNA, 19 nt, Human
gcagcauucacaaagacuu

SEQ ID NO: 167993 - RNA, 22 nt, Human
gcagcauucagugaaacuggcu

SEQ ID NO: 167994 - RNA, 23 nt, Human
gcagcauucuucugucaaaggcu

SEQ ID NO: 167995 - RNA, 32 nt, Human
gcagcauugcacuccagccugggugacagaac

SEQ ID NO: 167996 - RNA, 32 nt, Human
gcagcauuggccgagugcaguggcucacgccu

SEQ ID NO: 167997 - RNA, 32 nt, Human
gcagcauuuacaucugcccuaaucagaggggc

SEQ ID NO: 167998 - RNA, 32 nt, Human
gcagcauuucugagagcauucaauggaaguua

SEQ ID NO: 167999 - RNA, 21 nt, Human
gcagccaaauaccgagugcua

SEQ ID NO: 168000 - RNA, 19 nt, Human
gcagccaacaccugugugg

SEQ ID NO: 168001 - RNA, 32 nt, Human
gcagccaacauuucucugcucuccuuagaaau

SEQ ID NO: 168002 - RNA, 32 nt, Human
gcagccaacccuggcucaucucaucugccgcu

SEQ ID NO: 168003 - RNA, 32 nt, Human
gcagccaacucccagcccuguucacacaaauu

SEQ ID NO: 168004 - RNA, 21 nt, Human
gcagccaagaacagcauguca

SEQ ID NO: 168005 - RNA, 22 nt, Human
gcagccaagcgcagcugucagg

SEQ ID NO: 168006 - RNA, 32 nt, Human
gcagccaaggcccuguccuuucuugaauggug

SEQ ID NO: 168007 - RNA, 25 nt, Human
gcagccaaggggcuggggcaggaga

SEQ ID NO: 168008 - RNA, 23 nt, Human
gcagccaaugccuuuguguggua

SEQ ID NO: 168009 - RNA, 32 nt, Human
gcagccacaaauucuagguacacuggcugcug

SEQ ID NO: 168010 - RNA, 21 nt, Human
gcagccacaaccucaccacca

SEQ ID NO: 168011 - RNA, 32 nt, Human
gcagccacacagccccucccagccacaaucac

SEQ ID NO: 168012 - RNA, 32 nt, Human
gcagccacagcaguaccuccucugaguccuuu

SEQ ID NO: 168013 - RNA, 32 nt, Human
gcagccacagccgcaacgccacccgcagccac

SEQ ID NO: 168014 - RNA, 32 nt, Human
gcagccacagccgcugcagccggggcagccuc

SEQ ID NO: 168015 - RNA, 32 nt, Human
gcagccacaggcagaggacgaggacgacuggg

SEQ ID NO: 168016 - RNA, 32 nt, Human
gcagccacaugcccuggcugccaugggccaga

SEQ ID NO: 168017 - RNA, 32 nt, Human
gcagccaccagcaaacaccacugccugcagga

SEQ ID NO: 168018 - RNA, 17 nt, Human
gcagccaccagcuggcc

SEQ ID NO: 168019 - RNA, 32 nt, Human
gcagccaccagcuggccugguuggcucuggau

SEQ ID NO: 168020 - RNA, 32 nt, Human
gcagccaccaguggaccuagccuggauggccc

SEQ ID NO: 168021 - RNA, 32 nt, Human
gcagccacccagcagugaccuggauuucccug

SEQ ID NO: 168022 - RNA, 32 nt, Human
gcagccaccccacauccagccuacacagaacu

SEQ ID NO: 168023 - RNA, 32 nt, Human
gcagccaccgccgcagcccccaugcuccccgc

SEQ ID NO: 168024 - RNA, 32 nt, Human
gcagccaccgccgcgucccucucuccacgagg

SEQ ID NO: 168025 - RNA, 32 nt, Human
gcagccaccuaaaagaaaaacgaacgaaggac

SEQ ID NO: 168026 - RNA, 32 nt, Human
gcagccaccugccuccaccccgucugucaucc

SEQ ID NO: 168027 - RNA, 20 nt, Human
gcagccaccugcucccggcc

SEQ ID NO: 168028 - RNA, 19 nt, Human
gcagccaccugcugggagg

SEQ ID NO: 168029 - RNA, 32 nt, Human
gcagccaccugugucuguguucuugccacugu

SEQ ID NO: 168030 - RNA, 21 nt, Human
gcagccaccuuccucaccagc

SEQ ID NO: 168031 - RNA, 32 nt, Human
gcagccacugccuccuggguucaggugauucu

SEQ ID NO: 168032 - RNA, 32 nt, Human
gcagccacuggguggauccaggggagaugcau

SEQ ID NO: 168033 - RNA, 32 nt, Human
gcagccagaagaggugggaaaagcggaggagg

SEQ ID NO: 168034 - RNA, 32 nt, Human
gcagccagaaggcagagaaagugaagaccaag

SEQ ID NO: 168035 - RNA, 32 nt, Human
gcagccagagcccagaucggaagagccgaguc

SEQ ID NO: 168036 - RNA, 32 nt, Human
gcagccagagccuacugcugccaucugaagac

SEQ ID NO: 168037 - RNA, 32 nt, Human
gcagccagagccucaggcagagcccgguacag

SEQ ID NO: 168038 - RNA, 32 nt, Human
gcagccagagggcuggagccugcucagaggug

SEQ ID NO: 168039 - RNA, 32 nt, Human
gcagccagcacccugggcucucagggacugag

SEQ ID NO: 168040 - RNA, 17 nt, Human
gcagccagcaccuggcc

SEQ ID NO: 168041 - RNA, 32 nt, Human
gcagccagcagcccugcccugccagguggugg

SEQ ID NO: 168042 - RNA, 17 nt, Human
gcagccagcagcuggcc

SEQ ID NO: 168043 - RNA, 32 nt, Human
gcagccagcaugccuggcugugugcaguggcc

SEQ ID NO: 168044 - RNA, 32 nt, Human
gcagccagccaagaucgggccgcugcacucca

SEQ ID NO: 168045 - RNA, 32 nt, Human
gcagccagccacagguacagagcccaggaccc

SEQ ID NO: 168046 - RNA, 22 nt, Human
gcagccagccagaugccuggcc

SEQ ID NO: 168047 - RNA, 18 nt, Human
gcagccagccaucaugcc

SEQ ID NO: 168048 - RNA, 15 nt, Human
gcagccagccaugcu

SEQ ID NO: 168049 - RNA, 15 nt, Human
gcagccagcccagcc

SEQ ID NO: 168050 - RNA, 15 nt, Human
gcagccagcccaggc

SEQ ID NO: 168051 - RNA, 16 nt, Human
gcagccagcccaggcc

SEQ ID NO: 168052 - RNA, 18 nt, Human
gcagccagccccgugucc

SEQ ID NO: 168053 - RNA, 21 nt, Human
gcagccagccccuguccggcu

SEQ ID NO: 168054 - RNA, 17 nt, Human
gcagccagcccgacgcu

SEQ ID NO: 168055 - RNA, 17 nt, Human
gcagccagcccgugggc

SEQ ID NO: 168056 - RNA, 22 nt, Human
gcagccagcccucgcuguccag

SEQ ID NO: 168057 - RNA, 16 nt, Human
gcagccagcccugguu

SEQ ID NO: 168058 - RNA, 32 nt, Human
gcagccagcccuucccccuccggcucccgcac

SEQ ID NO: 168059 - RNA, 18 nt, Human
gcagccagccuccaagcu

SEQ ID NO: 168060 - RNA, 32 nt, Human
gcagccagccucccgccuucguccccuccccg

SEQ ID NO: 168061 - RNA, 18 nt, Human
gcagccagccucgugaag

SEQ ID NO: 168062 - RNA, 32 nt, Human
gcagccagccugccggcaggacuugccugccu

SEQ ID NO: 168063 - RNA, 17 nt, Human
gcagccagccugggacc

SEQ ID NO: 168064 - RNA, 16 nt, Human
gcagccagccuuuggc

SEQ ID NO: 168065 - RNA, 32 nt, Human
gcagccagcggcagcucagagcagggcacugu

SEQ ID NO: 168066 - RNA, 20 nt, Human
gcagccagcgggagcaggaa

SEQ ID NO: 168067 - RNA, 16 nt, Human
gcagccagcguccggc

SEQ ID NO: 168068 - RNA, 16 nt, Human
gcagccagcuaguggc

SEQ ID NO: 168069 - RNA, 17 nt, Human
gcagccagcucucagcc

SEQ ID NO: 168070 - RNA, 32 nt, Human
gcagccagcugcacucugcugcgggcacgggc

SEQ ID NO: 168071 - RNA, 17 nt, Human
gcagccagcugccagcc

SEQ ID NO: 168072 - RNA, 15 nt, Human
gcagccagcuguggc

SEQ ID NO: 168073 - RNA, 32 nt, Human
gcagccagcuuucaggaaaggcugagacucag

SEQ ID NO: 168074 - RNA, 19 nt, Human
gcagccagcuuugcggggc

SEQ ID NO: 168075 - RNA, 32 nt, Human
gcagccaggagaaugggucaucacccaggcuc

SEQ ID NO: 168076 - RNA, 32 nt, Human
gcagccaggagccgcuguugccucccagcccc

SEQ ID NO: 168077 - RNA, 32 nt, Human
gcagccaggagcuuccugucaguaaccauguu

SEQ ID NO: 168078 - RNA, 32 nt, Human
gcagccaggagugcucgagaacagauggggcc

SEQ ID NO: 168079 - RNA, 21 nt, Human
gcagccaggaguggcugggga

SEQ ID NO: 168080 - RNA, 18 nt, Human
gcagccaggauucuggcu

SEQ ID NO: 168081 - RNA, 32 nt, Human
gcagccaggauuugaacccugguagccuggug

SEQ ID NO: 168082 - RNA, 21 nt, Human
gcagccaggccccucaccagc

SEQ ID NO: 168083 - RNA, 19 nt, Human
gcagccaggccccuccgga

SEQ ID NO: 168084 - RNA, 32 nt, Human
gcagccaggccugggguuuugcacugagauga

SEQ ID NO: 168085 - RNA, 32 nt, Human
gcagccaggcgcgcacugcacagcucucuucu

SEQ ID NO: 168086 - RNA, 16 nt, Human
gcagccaggcuuggcc

SEQ ID NO: 168087 - RNA, 32 nt, Human
gcagccagggcuggggaacacugugaaaguua

SEQ ID NO: 168088 - RNA, 30 nt, Human
gcagccagggucacccugcuccugugagga

SEQ ID NO: 168089 - RNA, 32 nt, Human
gcagccagguaucucagguugcaauggucaga

SEQ ID NO: 168090 - RNA, 18 nt, Human
gcagccagguggaaacua

SEQ ID NO: 168091 - RNA, 19 nt, Human
gcagccagucacccuggcc

SEQ ID NO: 168092 - RNA, 32 nt, Human
gcagccagucauggggacccuccagggaaauu

SEQ ID NO: 168093 - RNA, 20 nt, Human
gcagccagugacagaggaga

SEQ ID NO: 168094 - RNA, 32 nt, Human
gcagccaguggagaggaagcagugcauggcca

SEQ ID NO: 168095 - RNA, 22 nt, Human
gcagccauaccccucaccauca

SEQ ID NO: 168096 - RNA, 32 nt, Human
gcagccauagacaacacauacaugaacgaacg

SEQ ID NO: 168097 - RNA, 32 nt, Human
gcagccaucccucgccgcugucccuuagcuga

SEQ ID NO: 168098 - RNA, 32 nt, Human
gcagccauccuuucucuuucuucucucucauu

SEQ ID NO: 168099 - RNA, 21 nt, Human
gcagccaucugagcaagggcu

SEQ ID NO: 168100 - RNA, 32 nt, Human
gcagccaucugcaaggagaggggcaaccuggg

SEQ ID NO: 168101 - RNA, 32 nt, Human
gcagccaucuuucucuugccgcgugcuggugu

SEQ ID NO: 168102 - RNA, 31 nt, Human
gcagccaugcagcccccgcccccgggcccgc

SEQ ID NO: 168103 - RNA, 31 nt, Human
gcagccaugccuggccgucugcugcggggcc

SEQ ID NO: 168104 - RNA, 32 nt, Human
gcagccauggacuggcucauggggaaguccaa

SEQ ID NO: 168105 - RNA, 32 nt, Human
gcagccauggccacugccuuccucucugauga

SEQ ID NO: 168106 - RNA, 31 nt, Human
gcagccauggcucugcggaggcugggggccg

SEQ ID NO: 168107 - RNA, 32 nt, Human
gcagccauguagaaugaaccguccagagagcc

SEQ ID NO: 168108 - RNA, 31 nt, Human
gcagccaugucgggccgcucagugccacaug

SEQ ID NO: 168109 - RNA, 32 nt, Human
gcagccauuccccggguucccuucccaggccc

SEQ ID NO: 168110 - RNA, 18 nt, Human
gcagccauucuccaggcc

SEQ ID NO: 168111 - RNA, 32 nt, Human
gcagcccaaccaggaggcccugcuccaagccc

SEQ ID NO: 168112 - RNA, 18 nt, Human
gcagcccaacuacucggg

SEQ ID NO: 168113 - RNA, 32 nt, Human
gcagcccaaggaggggagaggaaagcugccca

SEQ ID NO: 168114 - RNA, 32 nt, Human
gcagcccaaucagcccagggcaagugccacau

SEQ ID NO: 168115 - RNA, 32 nt, Human
gcagcccacagcucucuuucggaccucugaag

SEQ ID NO: 168116 - RNA, 21 nt, Human
gcagcccacccugaccgggac

SEQ ID NO: 168117 - RNA, 32 nt, Human
gcagcccaccucugagucucagcuuugcuucg

SEQ ID NO: 168118 - RNA, 32 nt, Human
gcagcccacggaaggcaagcagaagcagggug

SEQ ID NO: 168119 - RNA, 32 nt, Human
gcagcccacggaagggcucuuucacagcuggc

SEQ ID NO: 168120 - RNA, 32 nt, Human
gcagcccacuccccagccccagccccuuccau

SEQ ID NO: 168121 - RNA, 32 nt, Human
gcagcccacucccucacuuuuacuccuuccuc

SEQ ID NO: 168122 - RNA, 18 nt, Human
gcagcccacugccugggg

SEQ ID NO: 168123 - RNA, 23 nt, Human
gcagcccacuguugacccggccc

SEQ ID NO: 168124 - RNA, 32 nt, Human
gcagcccagaaacacuccccaaggcccugucu

SEQ ID NO: 168125 - RNA, 32 nt, Human
gcagcccagaggggagccgggaagggacccuc

SEQ ID NO: 168126 - RNA, 21 nt, Human
gcagcccagauccuccccugg

SEQ ID NO: 168127 - RNA, 32 nt, Human
gcagcccagcacaacccccaggaaacacaaau

SEQ ID NO: 168128 - RNA, 32 nt, Human
gcagcccagcagagggcucuaugcacggguuu

SEQ ID NO: 168129 - RNA, 32 nt, Human
gcagcccagccaagcacugucaggaauccugu

SEQ ID NO: 168130 - RNA, 22 nt, Human
gcagcccagccccggccuccca

SEQ ID NO: 168131 - RNA, 32 nt, Human
gcagcccagccucugucccucuuugccugugu

SEQ ID NO: 168132 - RNA, 32 nt, Human
gcagcccaggagaagagagauggggguucccu

SEQ ID NO: 168133 - RNA, 32 nt, Human
gcagcccaggagaugggccuaaaauguucugg

SEQ ID NO: 168134 - RNA, 32 nt, Human
gcagcccaggagccucucugaaggaccagucu

SEQ ID NO: 168135 - RNA, 32 nt, Human
gcagcccaggcccugccccuuuacagucuagg

SEQ ID NO: 168136 - RNA, 21 nt, Human
gcagcccaggcuccugggcca

SEQ ID NO: 168137 - RNA, 32 nt, Human
gcagcccagggcgaugcacaggaugccagauc

SEQ ID NO: 168138 - RNA, 32 nt, Human
gcagcccagggcgggucuguucugccaaugcc

SEQ ID NO: 168139 - RNA, 32 nt, Human
gcagcccaguccccacagucacggccaagcca

SEQ ID NO: 168140 - RNA, 32 nt, Human
gcagcccauccaccccaguggaguucccacgg

SEQ ID NO: 168141 - RNA, 32 nt, Human
gcagcccaugggggaggagauggggaagugga

SEQ ID NO: 168142 - RNA, 32 nt, Human
gcagcccauuccagcacacaggcuucugcagc

SEQ ID NO: 168143 - RNA, 32 nt, Human
gcagcccauucccagcccugaggcccacccca

SEQ ID NO: 168144 - RNA, 32 nt, Human
gcagccccaacaagaacagguaccugaacgug

SEQ ID NO: 168145 - RNA, 32 nt, Human
gcagccccaaccacagcauucccuaacaugga

SEQ ID NO: 168146 - RNA, 32 nt, Human
gcagccccaaccuucagggcucaggugauccu

SEQ ID NO: 168147 - RNA, 32 nt, Human
gcagccccaccccauccagccugggcuccccg

SEQ ID NO: 168148 - RNA, 21 nt, Human
gcagccccaccccgucccugg

SEQ ID NO: 168149 - RNA, 32 nt, Human
gcagccccaccccuccuccacccccacggcag

SEQ ID NO: 168150 - RNA, 17 nt, Human
gcagccccaccugcccc

SEQ ID NO: 168151 - RNA, 32 nt, Human
gcagccccagaacugggaccaccggggguggu

SEQ ID NO: 168152 - RNA, 32 nt, Human
gcagccccagcccagcccgccgggagcaagga

SEQ ID NO: 168153 - RNA, 32 nt, Human
gcagccccaggcauagcaucccuucuccuggg

SEQ ID NO: 168154 - RNA, 32 nt, Human
gcagccccaggccaaaggggaccuggaaggga

SEQ ID NO: 168155 - RNA, 32 nt, Human
gcagccccaggugggagcugggagggucccca

SEQ ID NO: 168156 - RNA, 32 nt, Human
gcagccccagucaggggccuauagauaaaacu

SEQ ID NO: 168157 - RNA, 32 nt, Human
gcagccccaucucaguguggcuuuguuuuugc

SEQ ID NO: 168158 - RNA, 32 nt, Human
gcagccccaucuuacccgucugguuuuugagu

SEQ ID NO: 168159 - RNA, 32 nt, Human
gcagccccaucuuuguccggccuccgcgcuuu

SEQ ID NO: 168160 - RNA, 32 nt, Human
gcagcccccacccacucuguucucguagccuc

SEQ ID NO: 168161 - RNA, 32 nt, Human
gcagcccccacccucccacucagggugggauu

SEQ ID NO: 168162 - RNA, 18 nt, Human
gcagcccccaccuacccc

SEQ ID NO: 168163 - RNA, 20 nt, Human
gcagcccccagcccuccccu

SEQ ID NO: 168164 - RNA, 23 nt, Human
gcagcccccagcucccaccuccc

SEQ ID NO: 168165 - RNA, 18 nt, Human
gcagccccccagcuucca

SEQ ID NO: 168166 - RNA, 20 nt, Human
gcagccccccagcuuccaag

SEQ ID NO: 168167 - RNA, 23 nt, Human
gcagccccccagcuuccaaggcc

SEQ ID NO: 168168 - RNA, 18 nt, Human
gcagccccccugggcuca

SEQ ID NO: 168169 - RNA, 17 nt, Human
gcagcccccgccgcccc

SEQ ID NO: 168170 - RNA, 32 nt, Human
gcagcccccgcgcuggugcagccacccucgcu

SEQ ID NO: 168171 - RNA, 32 nt, Human
gcagcccccggcauugaccuccuggguguccc

SEQ ID NO: 168172 - RNA, 32 nt, Human
gcagcccccucggggacgcccccaccagcuca

SEQ ID NO: 168173 - RNA, 32 nt, Human
gcagcccccuuccccuggguguguucugggga

SEQ ID NO: 168174 - RNA, 22 nt, Human
gcagcccccuuccuccaucccu

SEQ ID NO: 168175 - RNA, 23 nt, Human
gcagccccggccgcgcccagccc

SEQ ID NO: 168176 - RNA, 20 nt, Human
gcagccccggcggccagcag

SEQ ID NO: 168177 - RNA, 32 nt, Human
gcagccccggcugcacucuagccgccugggug

SEQ ID NO: 168178 - RNA, 23 nt, Human
gcagccccgggacacccuacccc

SEQ ID NO: 168179 - RNA, 32 nt, Human
gcagccccgggcagcaucucccagaggcuccg

SEQ ID NO: 168180 - RNA, 22 nt, Human
gcagccccuccacaggcgcccc

SEQ ID NO: 168181 - RNA, 32 nt, Human
gcagccccuccaccauggcagggagcuggccu

SEQ ID NO: 168182 - RNA, 32 nt, Human
gcagccccucccagccucucccgcuaggagag

SEQ ID NO: 168183 - RNA, 22 nt, Human
gcagccccuccccaccaucccu

SEQ ID NO: 168184 - RNA, 32 nt, Human
gcagccccuccuucgcuccuuccagagcucag

SEQ ID NO: 168185 - RNA, 21 nt, Human
gcagccccucgcggcagcccc

SEQ ID NO: 168186 - RNA, 21 nt, Human
gcagccccugcauuccugcca

SEQ ID NO: 168187 - RNA, 19 nt, Human
gcagccccugcccacaccc

SEQ ID NO: 168188 - RNA, 18 nt, Human
gcagccccugcccacucc

SEQ ID NO: 168189 - RNA, 19 nt, Human
gcagccccugcccccaccc

SEQ ID NO: 168190 - RNA, 20 nt, Human
gcagccccugccccccgggg

SEQ ID NO: 168191 - RNA, 32 nt, Human
gcagccccugcucaucuuccuggaggaaccuc

SEQ ID NO: 168192 - RNA, 32 nt, Human
gcagccccugcucccuccuggagacccuuguc

SEQ ID NO: 168193 - RNA, 32 nt, Human
gcagccccuuuccuugaagugggcuuggcagg

SEQ ID NO: 168194 - RNA, 17 nt, Human
gcagcccgaccccggcc

SEQ ID NO: 168195 - RNA, 32 nt, Human
gcagcccgagcggcggggugaccauggaggaa

SEQ ID NO: 168196 - RNA, 19 nt, Human
gcagcccgccgcacugggg

SEQ ID NO: 168197 - RNA, 25 nt, Human
gcagcccgccgcugcccgcaccugc

SEQ ID NO: 168198 - RNA, 32 nt, Human
gcagcccgccuuccucugccuccugagcgcgg

SEQ ID NO: 168199 - RNA, 32 nt, Human
gcagcccggcagcagcccccagaggaacugcu

SEQ ID NO: 168200 - RNA, 32 nt, Human
gcagcccggcuccuccccuccuccgccccuuc

SEQ ID NO: 168201 - RNA, 21 nt, Human
gcagcccggcuggcccaggcc

SEQ ID NO: 168202 - RNA, 32 nt, Human
gcagcccggggacagaggccagcugggaucug

SEQ ID NO: 168203 - RNA, 23 nt, Human
gcagcccgggugcacgcccugca

SEQ ID NO: 168204 - RNA, 19 nt, Human
gcagcccggugccguggcc

SEQ ID NO: 168205 - RNA, 32 nt, Human
gcagcccgguuccuaacagaccacagacccca

SEQ ID NO: 168206 - RNA, 24 nt, Human
gcagcccguccuggacauccugca

SEQ ID NO: 168207 - RNA, 32 nt, Human
gcagcccgugaauucaagaccagccuggccaa

SEQ ID NO: 168208 - RNA, 32 nt, Human
gcagcccuagcccuaggccuuagucagguauc

SEQ ID NO: 168209 - RNA, 32 nt, Human
gcagcccucacacccaugcucccuccuuuagg

SEQ ID NO: 168210 - RNA, 32 nt, Human
gcagcccuccacagcguacuacccagcaggca

SEQ ID NO: 168211 - RNA, 32 nt, Human
gcagcccucccagcgccccauggggucgccca

SEQ ID NO: 168212 - RNA, 32 nt, Human
gcagcccuccccucccuccccuuaugaggucu

SEQ ID NO: 168213 - RNA, 32 nt, Human
gcagcccucccugaguggcucucccucccacu

SEQ ID NO: 168214 - RNA, 32 nt, Human
gcagcccuccgcaucuaucagcagguugcccc

SEQ ID NO: 168215 - RNA, 32 nt, Human
gcagcccucgacaacaaauacagggucuguug

SEQ ID NO: 168216 - RNA, 32 nt, Human
gcagcccucggggcaucucagugccucacucc

SEQ ID NO: 168217 - RNA, 32 nt, Human
gcagcccucuccacccagaggucucccuauac

SEQ ID NO: 168218 - RNA, 24 nt, Human
gcagcccugacucccaccuccaca

SEQ ID NO: 168219 - RNA, 32 nt, Human
gcagcccugagcugcaacagaagacugaaugg

SEQ ID NO: 168220 - RNA, 32 nt, Human
gcagcccugaggaggaagaggaggcgagggaa

SEQ ID NO: 168221 - RNA, 32 nt, Human
gcagcccugcagacaugguuaaaacucgggcc

SEQ ID NO: 168222 - RNA, 18 nt, Human
gcagcccugcccugccag

SEQ ID NO: 168223 - RNA, 32 nt, Human
gcagcccugccugcugcucuucccccaccauu

SEQ ID NO: 168224 - RNA, 32 nt, Human
gcagcccugccuggacuccacuuggcaugaua

SEQ ID NO: 168225 - RNA, 16 nt, Human
gcagcccugccuguga

SEQ ID NO: 168226 - RNA, 32 nt, Human
gcagcccuggacagacauaagacucuuggagc

SEQ ID NO: 168227 - RNA, 32 nt, Human
gcagcccuggcuccuuuccuuuggcagguugg

SEQ ID NO: 168228 - RNA, 32 nt, Human
gcagcccugggaaagucuugggagugaggggu

SEQ ID NO: 168229 - RNA, 32 nt, Human
gcagcccugggauuccacauauccaaugccuc

SEQ ID NO: 168230 - RNA, 32 nt, Human
gcagcccugggguggcggcgggcagagaaacc

SEQ ID NO: 168231 - RNA, 32 nt, Human
gcagcccugggucuucccuuagggaggaaggg

SEQ ID NO: 168232 - RNA, 32 nt, Human
gcagcccugugguccugcccuccuggggcuca

SEQ ID NO: 168233 - RNA, 32 nt, Human
gcagcccuucccagacacagaguucucauucu

SEQ ID NO: 168234 - RNA, 16 nt, Human
gcagcccuucguggcc

SEQ ID NO: 168235 - RNA, 32 nt, Human
gcagccgagcggagcccaggagagcagagagc

SEQ ID NO: 168236 - RNA, 23 nt, Human
gcagccgagggagcugaguaggg

SEQ ID NO: 168237 - RNA, 32 nt, Human
gcagccgauggcaggagaguucagagaagcgc

SEQ ID NO: 168238 - RNA, 32 nt, Human
gcagccgcagccgccgcuacaguccgggccgg

SEQ ID NO: 168239 - RNA, 32 nt, Human
gcagccgcagccgccucgcgcccggucccgcg

SEQ ID NO: 168240 - RNA, 22 nt, Human
gcagccgcagccgggcggcggg

SEQ ID NO: 168241 - RNA, 32 nt, Human
gcagccgcaggaggaggaggaggucgucgggg

SEQ ID NO: 168242 - RNA, 32 nt, Human
gcagccgcagggaggcagggauggcaaggcgu

SEQ ID NO: 168243 - RNA, 19 nt, Human
gcagccgcauucucaugca

SEQ ID NO: 168244 - RNA, 32 nt, Human
gcagccgccacauucaacaggcagcagcgcag

SEQ ID NO: 168245 - RNA, 31 nt, Human
gcagccgccagcugggagcacuggugugaac

SEQ ID NO: 168246 - RNA, 22 nt, Human
gcagccgcccgagcccccagcc

SEQ ID NO: 168247 - RNA, 18 nt, Human
gcagccgccgccgcagcg

SEQ ID NO: 168248 - RNA, 21 nt, Human
gcagccgccgccgccaccgcc

SEQ ID NO: 168249 - RNA, 23 nt, Human
gcagccgccgccgccacugccac

SEQ ID NO: 168250 - RNA, 20 nt, Human
gcagccgccgccgccgccgc

SEQ ID NO: 168251 - RNA, 21 nt, Human
gcagccgccgccgccgccgcc

SEQ ID NO: 168252 - RNA, 32 nt, Human
gcagccgccgccgccucagucagucagucagu

SEQ ID NO: 168253 - RNA, 32 nt, Human
gcagccgcgagguggacggggcgguggggccu

SEQ ID NO: 168254 - RNA, 32 nt, Human
gcagccgcgccucggccccauggacgcccugu

SEQ ID NO: 168255 - RNA, 32 nt, Human
gcagccgcucagagacaggaauagaaauuuca

SEQ ID NO: 168256 - RNA, 32 nt, Human
gcagccgcugacagcaugcagagcaaguuagg

SEQ ID NO: 168257 - RNA, 19 nt, Human
gcagccgcugaccauagcc

SEQ ID NO: 168258 - RNA, 32 nt, Human
gcagccggaccagccuugggcaacagcgugcg

SEQ ID NO: 168259 - RNA, 32 nt, Human
gcagccggacugccugcccaccaguuacccgc

SEQ ID NO: 168260 - RNA, 26 nt, Human
gcagccggagaccccgccgagccccu

SEQ ID NO: 168261 - RNA, 32 nt, Human
gcagccggagcagcaugguccagcugaggaag

SEQ ID NO: 168262 - RNA, 32 nt, Human
gcagccggcaccugacggcgugaccgacccga

SEQ ID NO: 168263 - RNA, 24 nt, Human
gcagccggccuggggaccuggggg

SEQ ID NO: 168264 - RNA, 32 nt, Human
gcagccggcuccacagaggcccucucuccucc

SEQ ID NO: 168265 - RNA, 17 nt, Human
gcagccggcuccaugcc

SEQ ID NO: 168266 - RNA, 32 nt, Human
gcagccgggaccauuggcaaugccauggagcc

SEQ ID NO: 168267 - RNA, 32 nt, Human
gcagccgggagaggccuugccgccaccgcugu

SEQ ID NO: 168268 - RNA, 32 nt, Human
gcagccgggaggugaacagcagagagaagaau

SEQ ID NO: 168269 - RNA, 19 nt, Human
gcagccggggagcugcagg

SEQ ID NO: 168270 - RNA, 32 nt, Human
gcagccggggccugacauuugaggcccaggac

SEQ ID NO: 168271 - RNA, 32 nt, Human
gcagccgggguacccucuagauucagggaugc

SEQ ID NO: 168272 - RNA, 32 nt, Human
gcagccggucaucugcuguccucucugucagg

SEQ ID NO: 168273 - RNA, 32 nt, Human
gcagccggucccacuuguauuggacguagaag

SEQ ID NO: 168274 - RNA, 18 nt, Human
gcagccguuccccagggg

SEQ ID NO: 168275 - RNA, 32 nt, Human
gcagccguugcucagagagaagguggaggaag

SEQ ID NO: 168276 - RNA, 32 nt, Human
gcagccguugggagcccaggaggcggggcgcc

SEQ ID NO: 168277 - RNA, 32 nt, Human
gcagccuacaucuccccucagccucuccucac

SEQ ID NO: 168278 - RNA, 23 nt, Human
gcagccuacuagggaccugggga

SEQ ID NO: 168279 - RNA, 32 nt, Human
gcagccuagacagaaccugcagcucuguggaa

SEQ ID NO: 168280 - RNA, 30 nt, Human
gcagccuagauaugaagaaucugcucugaa

SEQ ID NO: 168281 - RNA, 32 nt, Human
gcagccuagauaugaagaaucugcucugaaaa

SEQ ID NO: 168282 - RNA, 32 nt, Human
gcagccuagccucaccccuccuguccggucac

SEQ ID NO: 168283 - RNA, 25 nt, Human
gcagccuagcuccucacagcugccu

SEQ ID NO: 168284 - RNA, 19 nt, Human
gcagccuauaccaaaggcu

SEQ ID NO: 168285 - RNA, 32 nt, Human
gcagccuaucaucuguuucacaucuguucuga

SEQ ID NO: 168286 - RNA, 32 nt, Human
gcagccucaaacuccugggcucaggccauccu

SEQ ID NO: 168287 - RNA, 32 nt, Human
gcagccucaaccuccugggcucaggugauucu

SEQ ID NO: 168288 - RNA, 20 nt, Human
gcagccucaaucuccugguc

SEQ ID NO: 168289 - RNA, 19 nt, Human
gcagccucaccagcuguga

SEQ ID NO: 168290 - RNA, 32 nt, Human
gcagccucaccccucuggaaguguggcugaga

SEQ ID NO: 168291 - RNA, 32 nt, Human
gcagccucagagaaaagucaccaggggcuggc

SEQ ID NO: 168292 - RNA, 32 nt, Human
gcagccucagcagcugucuugguaaaggagag

SEQ ID NO: 168293 - RNA, 32 nt, Human
gcagccucagcuucugaagugcaugaaaagag

SEQ ID NO: 168294 - RNA, 32 nt, Human
gcagccucagcuuggcaagguguggagaugac

SEQ ID NO: 168295 - RNA, 32 nt, Human
gcagccucagcuuuacaaaugccuugguaugu

SEQ ID NO: 168296 - RNA, 32 nt, Human
gcagccucaggcacgcccuugccuuguuuugg

SEQ ID NO: 168297 - RNA, 32 nt, Human
gcagccucauaagggcuggagugcuguggugc

SEQ ID NO: 168298 - RNA, 32 nt, Human
gcagccucaucauuucccaucuggaccuggua

SEQ ID NO: 168299 - RNA, 19 nt, Human
gcagccuccaaugugcuca

SEQ ID NO: 168300 - RNA, 32 nt, Human
gcagccuccaccuugcucuucuuucugagagu

SEQ ID NO: 168301 - RNA, 19 nt, Human
gcagccuccacgcggccca

SEQ ID NO: 168302 - RNA, 32 nt, Human
gcagccuccagccucgaccucccgaggcucag

SEQ ID NO: 168303 - RNA, 32 nt, Human
gcagccucccaagaagcugggauuacaggcau

SEQ ID NO: 168304 - RNA, 21 nt, Human
gcagccucccccuugagcccc

SEQ ID NO: 168305 - RNA, 32 nt, Human
gcagccucccgaguagcugggauuacaggcgc

SEQ ID NO: 168306 - RNA, 23 nt, Human
gcagccuccgccuccugggguca

SEQ ID NO: 168307 - RNA, 32 nt, Human
gcagccuccgcggccgagagugcagcgagcaa

SEQ ID NO: 168308 - RNA, 32 nt, Human
gcagccuccucccuggauccuuagaucccaga

SEQ ID NO: 168309 - RNA, 32 nt, Human
gcagccuccugggaauccagucuacccucaga

SEQ ID NO: 168310 - RNA, 32 nt, Human
gcagccucgaccucccuggcuugagugauccu

SEQ ID NO: 168311 - RNA, 19 nt, Human
gcagccucggccuagguca

SEQ ID NO: 168312 - RNA, 32 nt, Human
gcagccucgggcccuccugccugcaggaucau

SEQ ID NO: 168313 - RNA, 32 nt, Human
gcagccucuaccugacccccuggaccacagag

SEQ ID NO: 168314 - RNA, 32 nt, Human
gcagccucuacggggccagcuccugccuugca

SEQ ID NO: 168315 - RNA, 32 nt, Human
gcagccucuagucucuguuucuucuggaauag

SEQ ID NO: 168316 - RNA, 32 nt, Human
gcagccucugacugcccuuacccaugaggauc

SEQ ID NO: 168317 - RNA, 32 nt, Human
gcagccucugccuccagcccggcagcucuggg

SEQ ID NO: 168318 - RNA, 21 nt, Human
gcagccucuggcggcagcgcg

SEQ ID NO: 168319 - RNA, 32 nt, Human
gcagccucuguccccuccaccucugaggagcg

SEQ ID NO: 168320 - RNA, 32 nt, Human
gcagccucuguuuauagaagcuucugaaugua

SEQ ID NO: 168321 - RNA, 32 nt, Human
gcagccucuucgcauaggcagugauuugcgau

SEQ ID NO: 168322 - RNA, 32 nt, Human
gcagccucuucugccagcaccuugcuccccgc

SEQ ID NO: 168323 - RNA, 24 nt, Human
gcagccugaaguaacucccacaga

SEQ ID NO: 168324 - RNA, 32 nt, Human
gcagccugagauacccuuggguguucagggag

SEQ ID NO: 168325 - RNA, 32 nt, Human
gcagccugagcaacauagugagaccccauccc

SEQ ID NO: 168326 - RNA, 23 nt, Human
gcagccugagcccaggagcagag

SEQ ID NO: 168327 - RNA, 32 nt, Human
gcagccugagcuccacccuccccucuucuugc

SEQ ID NO: 168328 - RNA, 23 nt, Human
gcagccugaggagacaucucaga

SEQ ID NO: 168329 - RNA, 32 nt, Human
gcagccugagucucuugguuucugagcuggcu

SEQ ID NO: 168330 - RNA, 20 nt, Human
gcagccugagugacacagua

SEQ ID NO: 168331 - RNA, 32 nt, Human
gcagccugaugacccacccaccaaggaagaaa

SEQ ID NO: 168332 - RNA, 19 nt, Human
gcagccugauggggcaguu

SEQ ID NO: 168333 - RNA, 21 nt, Human
gcagccugcaaccaccucaga

SEQ ID NO: 168334 - RNA, 32 nt, Human
gcagccugcaaucccagcuacuugagaggcug

SEQ ID NO: 168335 - RNA, 32 nt, Human
gcagccugcaccaccacaccuggcuaaauuuu

SEQ ID NO: 168336 - RNA, 32 nt, Human
gcagccugcaccuggugggugguguccugaag

SEQ ID NO: 168337 - RNA, 32 nt, Human
gcagccugcagccugcagcccgcagcccgcag

SEQ ID NO: 168338 - RNA, 32 nt, Human
gcagccugcaucauccucccauugggcugaca

SEQ ID NO: 168339 - RNA, 32 nt, Human
gcagccugcauucugcacacagcaucugcucc

SEQ ID NO: 168340 - RNA, 32 nt, Human
gcagccugccagagcagagagccacccgcugg

SEQ ID NO: 168341 - RNA, 32 nt, Human
gcagccugcccagcugaaucuuggcuucugga

SEQ ID NO: 168342 - RNA, 32 nt, Human
gcagccugcccuggcccuggcucuggcccugg

SEQ ID NO: 168343 - RNA, 32 nt, Human
gcagccugcugugcugagcccugcugcagucc

SEQ ID NO: 168344 - RNA, 21 nt, Human
gcagccuggagcuccugggca

SEQ ID NO: 168345 - RNA, 32 nt, Human
gcagccuggcagggcacaguuucuaagggccc

SEQ ID NO: 168346 - RNA, 32 nt, Human
gcagccuggccaacaugaugaaaccccaucuc

SEQ ID NO: 168347 - RNA, 32 nt, Human
gcagccuggccaacauggugaaaccucauuuc

SEQ ID NO: 168348 - RNA, 32 nt, Human
gcagccuggccaauaugaugaaaccccaucuc

SEQ ID NO: 168349 - RNA, 32 nt, Human
gcagccuggcccugcccgccuccgccuucugg

SEQ ID NO: 168350 - RNA, 32 nt, Human
gcagccuggccuugccuucacagggcucacca

SEQ ID NO: 168351 - RNA, 32 nt, Human
gcagccugggcaaaauagugagacaccgucuu

SEQ ID NO: 168352 - RNA, 30 nt, Human
gcagccugggcaacacagugagacccuguc

SEQ ID NO: 168353 - RNA, 32 nt, Human
gcagccugggcaacagaaugagacugugucuu

SEQ ID NO: 168354 - RNA, 32 nt, Human
gcagccugggcaacauagcaagaacucauccc

SEQ ID NO: 168355 - RNA, 31 nt, Human
gcagccugggcaacauagcgagacucugucu

SEQ ID NO: 168356 - RNA, 32 nt, Human
gcagccugggcaacauggcaaaaccccaucuc

SEQ ID NO: 168357 - RNA, 32 nt, Human
gcagccugggcaacauggugaaacccgucucu

SEQ ID NO: 168358 - RNA, 32 nt, Human
gcagccugggcaacauggugaaagcccgucuc

SEQ ID NO: 168359 - RNA, 32 nt, Human
gcagccugggcaacgcagugagagaccccauc

SEQ ID NO: 168360 - RNA, 32 nt, Human
gcagccugggcaacguagagauccccaucucu

SEQ ID NO: 168361 - RNA, 32 nt, Human
gcagccugggcaacguggugaacccugucucu

SEQ ID NO: 168362 - RNA, 32 nt, Human
gcagccugggcaauacagcaagaccucaucuc

SEQ ID NO: 168363 - RNA, 32 nt, Human
gcagccugggcaauauagaaagaccucuuccc

SEQ ID NO: 168364 - RNA, 32 nt, Human
gcagccugggccaggacugcucugagauuuga

SEQ ID NO: 168365 - RNA, 32 nt, Human
gcagccugggccugggcuuggcccagggaacc

SEQ ID NO: 168366 - RNA, 32 nt, Human
gcagccugggcugcuggcagggaagaggaaga

SEQ ID NO: 168367 - RNA, 32 nt, Human
gcagccuggggcaaggggaggggccagccugg

SEQ ID NO: 168368 - RNA, 32 nt, Human
gcagccugggugacacuccagccugggugaca

SEQ ID NO: 168369 - RNA, 23 nt, Human
gcagccugggugacagaaugaga

SEQ ID NO: 168370 - RNA, 23 nt, Human
gcagccugggugacagagcaaga

SEQ ID NO: 168371 - RNA, 22 nt, Human
gcagccuggugacagagugaga

SEQ ID NO: 168372 - RNA, 32 nt, Human
gcagccuguccguggaugucucugccuuaagg

SEQ ID NO: 168373 - RNA, 32 nt, Human
gcagccugugggcucuuaagacaggggccgcu

SEQ ID NO: 168374 - RNA, 31 nt, Human
gcagccuguguggaaagacaggagugagauc

SEQ ID NO: 168375 - RNA, 32 nt, Human
gcagccugugugugugcuggcacaagcccaug

SEQ ID NO: 168376 - RNA, 24 nt, Human
gcagccuguuucagagccuccaca

SEQ ID NO: 168377 - RNA, 21 nt, Human
gcagccuucggaguaagggcu

SEQ ID NO: 168378 - RNA, 19 nt, Human
gcagccuucuccccugggg

SEQ ID NO: 168379 - RNA, 32 nt, Human
gcagccuugaccuccagggcucaaggauccuc

SEQ ID NO: 168380 - RNA, 32 nt, Human
gcagccuugcagccucuccagauguuugggga

SEQ ID NO: 168381 - RNA, 25 nt, Human
gcagccuugcccgucucccuccgca

SEQ ID NO: 168382 - RNA, 32 nt, Human
gcagccuugccuggcgaucgugcugagcagca

SEQ ID NO: 168383 - RNA, 32 nt, Human
gcagccuugcuacgugacccaggcuggagugu

SEQ ID NO: 168384 - RNA, 32 nt, Human
gcagccuuggcuuuuccucuccugggugcucu

SEQ ID NO: 168385 - RNA, 23 nt, Human
gcagccuugguguuugaucuaca

SEQ ID NO: 168386 - RNA, 32 nt, Human
gcagccuugguuuccugcugagcuccaguauu

SEQ ID NO: 168387 - RNA, 32 nt, Human
gcagccuuguguccugggauccccagccccug

SEQ ID NO: 168388 - RNA, 32 nt, Human
gcagccuuuauguucaucaccagcuagaaccu

SEQ ID NO: 168389 - RNA, 32 nt, Human
gcagccuuucaggaaagaugcagccacuccug

SEQ ID NO: 168390 - RNA, 32 nt, Human
gcagccuuuccaggccuagcguuugcugcuuu

SEQ ID NO: 168391 - RNA, 32 nt, Human
gcagccuuucccguccccuccucgacccguac

SEQ ID NO: 168392 - RNA, 32 nt, Human
gcagccuuuccuggcccagcuuuugccuguug

SEQ ID NO: 168393 - RNA, 32 nt, Human
gcagccuuuuccagagaggcugugguccauag

SEQ ID NO: 168394 - RNA, 32 nt, Human
gcagccuuuucucuccccuccugauagcauuu

SEQ ID NO: 168395 - RNA, 32 nt, Human
gcagcgacagaggcggcagcugcggcggcggc

SEQ ID NO: 168396 - RNA, 32 nt, Human
gcagcgacugugaggccacagcuccucagauu

SEQ ID NO: 168397 - RNA, 32 nt, Human
gcagcgagagcgagaccugggagccagggcag

SEQ ID NO: 168398 - RNA, 32 nt, Human
gcagcgagaguggaccuggugccuucagaagc

SEQ ID NO: 168399 - RNA, 32 nt, Human
gcagcgagcagcaccuggaucuugccuuuaua

SEQ ID NO: 168400 - RNA, 32 nt, Human
gcagcgagcagcccugcccugccagguggugg

SEQ ID NO: 168401 - RNA, 32 nt, Human
gcagcgaggaggagccacagggcugagcucgg

SEQ ID NO: 168402 - RNA, 32 nt, Human
gcagcgaggagggaccccucucucaugguugu

SEQ ID NO: 168403 - RNA, 32 nt, Human
gcagcgagggcaccuugugaucauguuguuaa

SEQ ID NO: 168404 - RNA, 32 nt, Human
gcagcgagggccacuacacuccagccugggug

SEQ ID NO: 168405 - RNA, 32 nt, Human
gcagcgaguccuugccucccggcggcucagga

SEQ ID NO: 168406 - RNA, 32 nt, Human
gcagcgaguuggcagagcagggcugcauuucc

SEQ ID NO: 168407 - RNA, 32 nt, Human
gcagcgauauggucauagcucacugcagccuc

SEQ ID NO: 168408 - RNA, 31 nt, Human
gcagcgaugccuggcggagccugcgugcugg

SEQ ID NO: 168409 - RNA, 24 nt, Human
gcagcgcaaggcccgccggcccca

SEQ ID NO: 168410 - RNA, 24 nt, Human
gcagcgcaagggcuccggcgacca

SEQ ID NO: 168411 - RNA, 18 nt, Human
gcagcgcaaucccggcgc

SEQ ID NO: 168412 - RNA, 17 nt, Human
gcagcgcaccugccacc

SEQ ID NO: 168413 - RNA, 24 nt, Human
gcagcgcacgcccaggcgaugcca

SEQ ID NO: 168414 - RNA, 32 nt, Human
gcagcgcacguguccgcucagcagguggcgau

SEQ ID NO: 168415 - RNA, 32 nt, Human
gcagcgcagaggccuggggcucaggugagucc

SEQ ID NO: 168416 - RNA, 32 nt, Human
gcagcgcagauuaaaaaucaagaaauauaaac

SEQ ID NO: 168417 - RNA, 20 nt, Human
gcagcgcaggcagagccgcc

SEQ ID NO: 168418 - RNA, 32 nt, Human
gcagcgcagggagccaggcgggcugccggcgg

SEQ ID NO: 168419 - RNA, 18 nt, Human
gcagcgcaguccagggcc

SEQ ID NO: 168420 - RNA, 23 nt, Human
gcagcgcauacaggccaauucca

SEQ ID NO: 168421 - RNA, 32 nt, Human
gcagcgccaccuggaagccgcgcggccgcuuu

SEQ ID NO: 168422 - RNA, 32 nt, Human
gcagcgccacuguccgcugucucccuccugau

SEQ ID NO: 168423 - RNA, 32 nt, Human
gcagcgcccacacaggcucuggcccauggcuu

SEQ ID NO: 168424 - RNA, 32 nt, Human
gcagcgcccagccaugugggccaggugcauuc

SEQ ID NO: 168425 - RNA, 32 nt, Human
gcagcgcccauaccuggugagucuggaauggu

SEQ ID NO: 168426 - RNA, 22 nt, Human
gcagcgccccagccugcagcag

SEQ ID NO: 168427 - RNA, 19 nt, Human
gcagcgccccgccccggcc

SEQ ID NO: 168428 - RNA, 20 nt, Human
gcagcgcccgcagcgggcca

SEQ ID NO: 168429 - RNA, 32 nt, Human
gcagcgcccguuuauuugaggcuucuaaugug

SEQ ID NO: 168430 - RNA, 32 nt, Human
gcagcgcccucggggagccggccggccugcgg

SEQ ID NO: 168431 - RNA, 32 nt, Human
gcagcgcccugagccugucccgcgcccgcggg

SEQ ID NO: 168432 - RNA, 20 nt, Human
gcagcgcccuggccgggcca

SEQ ID NO: 168433 - RNA, 32 nt, Human
gcagcgccgcagccugcaccacugcagcaugc

SEQ ID NO: 168434 - RNA, 17 nt, Human
gcagcgccgccgugguc

SEQ ID NO: 168435 - RNA, 32 nt, Human
gcagcgccgccuggcccgccggcugggcaggg

SEQ ID NO: 168436 - RNA, 17 nt, Human
gcagcgccgcgagcucc

SEQ ID NO: 168437 - RNA, 32 nt, Human
gcagcgccgcggucucuccagccucugguccc

SEQ ID NO: 168438 - RNA, 27 nt, Human
gcagcgccgugagcgccagcagcgcga

SEQ ID NO: 168439 - RNA, 24 nt, Human
gcagcgccuaugugaaguuagcua

SEQ ID NO: 168440 - RNA, 32 nt, Human
gcagcgccucuccaccaugcggacccugagca

SEQ ID NO: 168441 - RNA, 20 nt, Human
gcagcgcgagcagcagcgcg

SEQ ID NO: 168442 - RNA, 32 nt, Human
gcagcgcgcacacgcacgcacacacacauaca

SEQ ID NO: 168443 - RNA, 32 nt, Human
gcagcgcgccgcgauucaccagccuggucccu

SEQ ID NO: 168444 - RNA, 21 nt, Human
gcagcgcgccggccgcuacca

SEQ ID NO: 168445 - RNA, 21 nt, Human
gcagcgcgcggacccacgcca

SEQ ID NO: 168446 - RNA, 32 nt, Human
gcagcgcgggauuuccuuucucucucacucuc

SEQ ID NO: 168447 - RNA, 21 nt, Human
gcagcgcgggcagccggcgcc

SEQ ID NO: 168448 - RNA, 32 nt, Human
gcagcgcucagguggauccugggaagcagccu

SEQ ID NO: 168449 - RNA, 26 nt, Human
gcagcgcuccucgcggccacacgggg

SEQ ID NO: 168450 - RNA, 32 nt, Human
gcagcgcucugagcgccuuucuaucuguccgu

SEQ ID NO: 168451 - RNA, 32 nt, Human
gcagcgcugcauggcccuggcccagcuccucg

SEQ ID NO: 168452 - RNA, 32 nt, Human
gcagcgcugccuccugcccacauuccugccac

SEQ ID NO: 168453 - RNA, 22 nt, Human
gcagcgcugcggacggugcugg

SEQ ID NO: 168454 - RNA, 32 nt, Human
gcagcgcuggccuucuccagggauggcccaag

SEQ ID NO: 168455 - RNA, 32 nt, Human
gcagcgcuuccucuggcagggccgaggcucgc

SEQ ID NO: 168456 - RNA, 32 nt, Human
gcagcgcuugcgggccagagugaguuccgggu

SEQ ID NO: 168457 - RNA, 32 nt, Human
gcagcggaacccagagaagcugagggggcggu

SEQ ID NO: 168458 - RNA, 23 nt, Human
gcagcggaaggggcugacugggu

SEQ ID NO: 168459 - RNA, 32 nt, Human
gcagcggacuugcuccagccugggugaggagg

SEQ ID NO: 168460 - RNA, 32 nt, Human
gcagcggagccgcggagcgggcggcggggccc

SEQ ID NO: 168461 - RNA, 32 nt, Human
gcagcggaggagaaggaggaggaggcgaaccc

SEQ ID NO: 168462 - RNA, 32 nt, Human
gcagcggaggaggaagcugagcagggcggcgg

SEQ ID NO: 168463 - RNA, 32 nt, Human
gcagcggaggaguaggaggagacggaggagga

SEQ ID NO: 168464 - RNA, 32 nt, Human
gcagcggaugcugaagcaccagagcucaaggc

SEQ ID NO: 168465 - RNA, 32 nt, Human
gcagcggauuccaggaugacggaggccuggga

SEQ ID NO: 168466 - RNA, 32 nt, Human
gcagcggcaaaggcuucucgcucacugcgcuc

SEQ ID NO: 168467 - RNA, 32 nt, Human
gcagcggcacccauuucugggcccagccacag

SEQ ID NO: 168468 - RNA, 32 nt, Human
gcagcggcaugacugcagccuugaacuccugg

SEQ ID NO: 168469 - RNA, 18 nt, Human
gcagcggccaccauggcc

SEQ ID NO: 168470 - RNA, 18 nt, Human
gcagcggcccuccccugg

SEQ ID NO: 168471 - RNA, 32 nt, Human
gcagcggccggggaagaugguggaggacggcg

SEQ ID NO: 168472 - RNA, 21 nt, Human
gcagcggccuguaacacagua

SEQ ID NO: 168473 - RNA, 32 nt, Human
gcagcggcggagugcacagagcagggaaaggc

SEQ ID NO: 168474 - RNA, 17 nt, Human
gcagcggcggccagcag

SEQ ID NO: 168475 - RNA, 32 nt, Human
gcagcggcggcccagugguggaaaaggugcca

SEQ ID NO: 168476 - RNA, 20 nt, Human
gcagcggcggggccacaggg

SEQ ID NO: 168477 - RNA, 32 nt, Human
gcagcggcgugaggcccgucccggagcgagcc

SEQ ID NO: 168478 - RNA, 22 nt, Human
gcagcggcucacgccugcaauc

SEQ ID NO: 168479 - RNA, 22 nt, Human
gcagcggcucacgccuguaauc

SEQ ID NO: 168480 - RNA, 20 nt, Human
gcagcggcucaugccuguaa

SEQ ID NO: 168481 - RNA, 22 nt, Human
gcagcggcucaugccuguaauc

SEQ ID NO: 168482 - RNA, 32 nt, Human
gcagcgggaagagacccggagagaugcaucuu

SEQ ID NO: 168483 - RNA, 32 nt, Human
gcagcgggaggcagaggaaggcggcagaagau

SEQ ID NO: 168484 - RNA, 32 nt, Human
gcagcgggccuccagccacagccugcuggcau

SEQ ID NO: 168485 - RNA, 32 nt, Human
gcagcgggccugcucccagcucugccuccugc

SEQ ID NO: 168486 - RNA, 32 nt, Human
gcagcgggcggcggaggcagcgugcggcgguc

SEQ ID NO: 168487 - RNA, 32 nt, Human
gcagcgggcugagauuguuguccucugucacc

SEQ ID NO: 168488 - RNA, 32 nt, Human
gcagcggggcagggacagggagccgagugccc

SEQ ID NO: 168489 - RNA, 32 nt, Human
gcagcggggccaccuccacaaccaccaccaca

SEQ ID NO: 168490 - RNA, 18 nt, Human
gcagcggggccgccugca

SEQ ID NO: 168491 - RNA, 32 nt, Human
gcagcgggggcugauggaagugcagugggggc

SEQ ID NO: 168492 - RNA, 21 nt, Human
gcagcgggggcuucuguggga

SEQ ID NO: 168493 - RNA, 32 nt, Human
gcagcggguauucuccucccaccuaagucucu

SEQ ID NO: 168494 - RNA, 32 nt, Human
gcagcggugaagccccucggcucggccgagac

SEQ ID NO: 168495 - RNA, 32 nt, Human
gcagcgguggagacucucuccugugugugucc

SEQ ID NO: 168496 - RNA, 32 nt, Human
gcagcggugggagcagcagcaaguuugaaaau

SEQ ID NO: 168497 - RNA, 32 nt, Human
gcagcgguggggagggagggccuggacauggc

SEQ ID NO: 168498 - RNA, 19 nt, Human
gcagcgguguaagauucug

SEQ ID NO: 168499 - RNA, 32 nt, Human
gcagcggugugaggaccagcagagagaagaga

SEQ ID NO: 168500 - RNA, 32 nt, Human
gcagcguaaggacgaacuccuccagcaagcuc

SEQ ID NO: 168501 - RNA, 32 nt, Human
gcagcguauagcaguaacuccccagcucgguu

SEQ ID NO: 168502 - RNA, 32 nt, Human
gcagcguauguaagcaccgacacccacucaaa

SEQ ID NO: 168503 - RNA, 32 nt, Human
gcagcguccagugcccugccaguagcuccuag

SEQ ID NO: 168504 - RNA, 32 nt, Human
gcagcgucccgaggagcugggauuacaggcac

SEQ ID NO: 168505 - RNA, 20 nt, Human
gcagcgucccuuacauguca

SEQ ID NO: 168506 - RNA, 32 nt, Human
gcagcgucgcgggcugauuagguuucacccaa

SEQ ID NO: 168507 - RNA, 24 nt, Human
gcagcgucggagccgcgcagggga

SEQ ID NO: 168508 - RNA, 32 nt, Human
gcagcgucggggcuggagcgauggcggcgacc

SEQ ID NO: 168509 - RNA, 32 nt, Human
gcagcgucuuccugaacagccugaagcagaag

SEQ ID NO: 168510 - RNA, 32 nt, Human
gcagcgugaaagcagaugagcuguggacuagc

SEQ ID NO: 168511 - RNA, 32 nt, Human
gcagcgugagggugugucuucccuggauagca

SEQ ID NO: 168512 - RNA, 32 nt, Human
gcagcgugcacaucugcuguggucugaagugg

SEQ ID NO: 168513 - RNA, 32 nt, Human
gcagcguucagggauccucucagucccagagc

SEQ ID NO: 168514 - RNA, 21 nt, Human
gcagcuaacaaugucugguua

SEQ ID NO: 168515 - RNA, 18 nt, Human
gcagcuaaccacaaggca

SEQ ID NO: 168516 - RNA, 32 nt, Human
gcagcuaagaagcagugaccaggauguggauu

SEQ ID NO: 168517 - RNA, 20 nt, Human
gcagcuaagcaggucugacc

SEQ ID NO: 168518 - RNA, 32 nt, Human
gcagcuaagcagucuucucuucugccuuuaug

SEQ ID NO: 168519 - RNA, 32 nt, Human
gcagcuaagugguccuggggcauggagucuuc

SEQ ID NO: 168520 - RNA, 22 nt, Human
gcagcuaaugcuuucuugguca

SEQ ID NO: 168521 - RNA, 32 nt, Human
gcagcuacagccaggccggcugccucaucuca

SEQ ID NO: 168522 - RNA, 32 nt, Human
gcagcuaccauguucaagguaaggagacagga

SEQ ID NO: 168523 - RNA, 32 nt, Human
gcagcuacuugguagucacuguggcaugucgg

SEQ ID NO: 168524 - RNA, 32 nt, Human
gcagcuagaauuuccaggggaaaguacuggag

SEQ ID NO: 168525 - RNA, 19 nt, Human
gcagcuagacuccaggacc

SEQ ID NO: 168526 - RNA, 32 nt, Human
gcagcuagcccgugaucucugccgucaccgau

SEQ ID NO: 168527 - RNA, 32 nt, Human
gcagcuagcugcagcgacuaccgcaucaucac

SEQ ID NO: 168528 - RNA, 32 nt, Human
gcagcuagcugcaugacaguccaugacaaguu

SEQ ID NO: 168529 - RNA, 32 nt, Human
gcagcuagcuuggaaacaaugcuuacaacgug

SEQ ID NO: 168530 - RNA, 32 nt, Human
gcagcuagcuuggaaagaaugcuuacaacgug

SEQ ID NO: 168531 - RNA, 32 nt, Human
gcagcuagucuuucuucuuucuuaggcuauug

SEQ ID NO: 168532 - RNA, 32 nt, Human
gcagcuaucacaggugaauugcagugagcgcu

SEQ ID NO: 168533 - RNA, 32 nt, Human
gcagcuaugaggaugcagcagccuucuguuaa

SEQ ID NO: 168534 - RNA, 23 nt, Human
gcagcuauucaauuguuauugca

SEQ ID NO: 168535 - RNA, 24 nt, Human
gcagcuauuggcuucuucauugca

SEQ ID NO: 168536 - RNA, 32 nt, Human
gcagcuauuucagagaaggccugaccuucagc

SEQ ID NO: 168537 - RNA, 20 nt, Human
gcagcuauuuccuucugcca

SEQ ID NO: 168538 - RNA, 25 nt, Human
gcagcuauuuuguuuugcaaugaga

SEQ ID NO: 168539 - RNA, 32 nt, Human
gcagcucaagccacagaguccaggccaccuca

SEQ ID NO: 168540 - RNA, 24 nt, Human
gcagcucaaggcccugcuggaccc

SEQ ID NO: 168541 - RNA, 32 nt, Human
gcagcucaaguggccaaggcaagaugggucaa

SEQ ID NO: 168542 - RNA, 31 nt, Human
gcagcucaaugagugccuacagcagaaagcc

SEQ ID NO: 168543 - RNA, 19 nt, Human
gcagcucacaccuguaauc

SEQ ID NO: 168544 - RNA, 19 nt, Human
gcagcucacacuuguaauc

SEQ ID NO: 168545 - RNA, 32 nt, Human
gcagcucacagaauuuugaguauuccaugagc

SEQ ID NO: 168546 - RNA, 32 nt, Human
gcagcucacagauggcaagcugcgcuucgugg

SEQ ID NO: 168547 - RNA, 32 nt, Human
gcagcucacagcccugggggcagcucaggcua

SEQ ID NO: 168548 - RNA, 31 nt, Human
gcagcucacagcuguaaucccagcacuuagg

SEQ ID NO: 168549 - RNA, 32 nt, Human
gcagcucacaggcugggggugaggagucccug

SEQ ID NO: 168550 - RNA, 32 nt, Human
gcagcucacaucugaggcccugggaggucuug

SEQ ID NO: 168551 - RNA, 32 nt, Human
gcagcucacaugcucagggccaccugagacug

SEQ ID NO: 168552 - RNA, 32 nt, Human
gcagcucaccccucagcuccccuuggggccca

SEQ ID NO: 168553 - RNA, 20 nt, Human
gcagcucaccugaggucagg

SEQ ID NO: 168554 - RNA, 32 nt, Human
gcagcucacuguagcuuugaccucucaggcuc

SEQ ID NO: 168555 - RNA, 15 nt, Human
gcagcucagaggcuc

SEQ ID NO: 168556 - RNA, 32 nt, Human
gcagcucagcaacccuugcugugcucaaguuc

SEQ ID NO: 168557 - RNA, 32 nt, Human
gcagcucagcaacuauuacagcaucauugaga

SEQ ID NO: 168558 - RNA, 22 nt, Human
gcagcucagcauucucccccgg

SEQ ID NO: 168559 - RNA, 23 nt, Human
gcagcucagcccucuuccugcca

SEQ ID NO: 168560 - RNA, 32 nt, Human
gcagcucaggaggcaggugaaauggcguggca

SEQ ID NO: 168561 - RNA, 32 nt, Human
gcagcucaggcagucccuaugauggugguuau

SEQ ID NO: 168562 - RNA, 32 nt, Human
gcagcucagggcaacggcaggccaggucgugg

SEQ ID NO: 168563 - RNA, 18 nt, Human
gcagcucagucacaggca

SEQ ID NO: 168564 - RNA, 32 nt, Human
gcagcucagucacaggcagaagaaggaaacug

SEQ ID NO: 168565 - RNA, 32 nt, Human
gcagcucauccagcuggugcucaaugaugguc

SEQ ID NO: 168566 - RNA, 32 nt, Human
gcagcucaucugcagagcagggaaacauuuuu

SEQ ID NO: 168567 - RNA, 19 nt, Human
gcagcucaugccuguaauc

SEQ ID NO: 168568 - RNA, 32 nt, Human
gcagcucauggaauuuugaguauuccaugagc

SEQ ID NO: 168569 - RNA, 32 nt, Human
gcagcuccaaaacuggaccaccagagaaugga

SEQ ID NO: 168570 - RNA, 32 nt, Human
gcagcuccacaaccaccuccagccugggagau

SEQ ID NO: 168571 - RNA, 20 nt, Human
gcagcuccacucaccuccug

SEQ ID NO: 168572 - RNA, 32 nt, Human
gcagcuccagagagacagcgaccagcgagaag

SEQ ID NO: 168573 - RNA, 18 nt, Human
gcagcuccagagcccugg

SEQ ID NO: 168574 - RNA, 32 nt, Human
gcagcuccagcagcuucaccuggagggagggg

SEQ ID NO: 168575 - RNA, 32 nt, Human
gcagcuccagccgccuccuccgcgcagccgcc

SEQ ID NO: 168576 - RNA, 32 nt, Human
gcagcuccagccugggggacaggugaccccag

SEQ ID NO: 168577 - RNA, 20 nt, Human
gcagcuccaggaccucggcc

SEQ ID NO: 168578 - RNA, 18 nt, Human
gcagcucccaccuccugg

SEQ ID NO: 168579 - RNA, 32 nt, Human
gcagcucccacugugaccuggcccacggcugc

SEQ ID NO: 168580 - RNA, 32 nt, Human
gcagcucccagccuuuucaggcacggagauug

SEQ ID NO: 168581 - RNA, 19 nt, Human
gcagcucccagcgugauug

SEQ ID NO: 168582 - RNA, 32 nt, Human
gcagcucccaggaugaacugguugcaguggcu

SEQ ID NO: 168583 - RNA, 20 nt, Human
gcagcucccaggcccuuggg

SEQ ID NO: 168584 - RNA, 22 nt, Human
gcagcuccccaaggcccugccc

SEQ ID NO: 168585 - RNA, 23 nt, Human
gcagcucccgcccagcccagccc

SEQ ID NO: 168586 - RNA, 32 nt, Human
gcagcucccugcggaaggugggguaggguggg

SEQ ID NO: 168587 - RNA, 32 nt, Human
gcagcucccuguccaagugccuuggagaacuc

SEQ ID NO: 168588 - RNA, 32 nt, Human
gcagcucccuuucucaggagcuugggcagugc

SEQ ID NO: 168589 - RNA, 32 nt, Human
gcagcuccgggugacacgaggggacugaagau

SEQ ID NO: 168590 - RNA, 32 nt, Human
gcagcuccuaggugcuuuccucaggcugggua

SEQ ID NO: 168591 - RNA, 32 nt, Human
gcagcuccucaucucucuucuaauccaccacu

SEQ ID NO: 168592 - RNA, 18 nt, Human
gcagcuccuccacacaca

SEQ ID NO: 168593 - RNA, 32 nt, Human
gcagcuccuccaccuuguccagcagccucucc

SEQ ID NO: 168594 - RNA, 25 nt, Human
gcagcuccugcaacugacccagucc

SEQ ID NO: 168595 - RNA, 32 nt, Human
gcagcuccuggaguccaauggcugcuuagagu

SEQ ID NO: 168596 - RNA, 21 nt, Human
gcagcuccuguuuucuugguu

SEQ ID NO: 168597 - RNA, 32 nt, Human
gcagcuccuucucauggccccugggccuucac

SEQ ID NO: 168598 - RNA, 32 nt, Human
gcagcucgcuacgugaccaucaugcuuuuuac

SEQ ID NO: 168599 - RNA, 20 nt, Human
gcagcucgggggccacaagg

SEQ ID NO: 168600 - RNA, 32 nt, Human
gcagcucguagaggagagaaaacaagagugga

SEQ ID NO: 168601 - RNA, 21 nt, Human
gcagcucgucgaguuuccugg

SEQ ID NO: 168602 - RNA, 19 nt, Human
gcagcucuauauccugcug

SEQ ID NO: 168603 - RNA, 32 nt, Human
gcagcucucaugccaagaccugcgccuaacgg

SEQ ID NO: 168604 - RNA, 32 nt, Human
gcagcucucccaauguuucuccucuccuuccc

SEQ ID NO: 168605 - RNA, 32 nt, Human
gcagcucucccagagaagauccaagggagagg

SEQ ID NO: 168606 - RNA, 32 nt, Human
gcagcucuccccucagagugcaagccccugcu

SEQ ID NO: 168607 - RNA, 32 nt, Human
gcagcucuccccuuagcugacucuggugcucu

SEQ ID NO: 168608 - RNA, 32 nt, Human
gcagcucucuaaauugacucagcuccaggcua

SEQ ID NO: 168609 - RNA, 32 nt, Human
gcagcucucugccucucugcccuuuggucuau

SEQ ID NO: 168610 - RNA, 32 nt, Human
gcagcucucugccugcucaccacagccuggag

SEQ ID NO: 168611 - RNA, 23 nt, Human
gcagcucucugggucccccggug

SEQ ID NO: 168612 - RNA, 32 nt, Human
gcagcucugacuggaaugcacacaacuuccca

SEQ ID NO: 168613 - RNA, 21 nt, Human
gcagcucugcaccaggagcag

SEQ ID NO: 168614 - RNA, 32 nt, Human
gcagcucugccugguuggccugcagugccgug

SEQ ID NO: 168615 - RNA, 32 nt, Human
gcagcucugcuccccuagcaacgcucgccaca

SEQ ID NO: 168616 - RNA, 32 nt, Human
gcagcucuggaaggcagccuuggggcuggccc

SEQ ID NO: 168617 - RNA, 32 nt, Human
gcagcucuggaaggcagugcucagccccauca

SEQ ID NO: 168618 - RNA, 21 nt, Human
gcagcucuggacaccauggcc

SEQ ID NO: 168619 - RNA, 32 nt, Human
gcagcucuggagggagccgcugccucagcagu

SEQ ID NO: 168620 - RNA, 32 nt, Human
gcagcucuggagguacgaaaagaggggaagag

SEQ ID NO: 168621 - RNA, 32 nt, Human
gcagcucuggcuccuugucucccaggcugauc

SEQ ID NO: 168622 - RNA, 32 nt, Human
gcagcucugggagagaaaggaggccagccugc

SEQ ID NO: 168623 - RNA, 32 nt, Human
gcagcucuguuagcucguacauguggguucuu

SEQ ID NO: 168624 - RNA, 32 nt, Human
gcagcucuguugugcccugccugaagcuuauc

SEQ ID NO: 168625 - RNA, 32 nt, Human
gcagcucuucaucagccugcugucuacucaga

SEQ ID NO: 168626 - RNA, 32 nt, Human
gcagcucuuccugccacugaaugcguucugca

SEQ ID NO: 168627 - RNA, 32 nt, Human
gcagcucuucucggacuccccugggccaauga

SEQ ID NO: 168628 - RNA, 32 nt, Human
gcagcucuugcccagagcugugcagugcagug

SEQ ID NO: 168629 - RNA, 32 nt, Human
gcagcucuuugcccaucucuuuggacaguggc

SEQ ID NO: 168630 - RNA, 32 nt, Human
gcagcugaagaaacaaacuggucuccaggcug

SEQ ID NO: 168631 - RNA, 32 nt, Human
gcagcugacugaaaaucagcacugccugagua

SEQ ID NO: 168632 - RNA, 32 nt, Human
gcagcugacugaggagacuuggggucuuccug

SEQ ID NO: 168633 - RNA, 23 nt, Human
gcagcugagagcaggagcaggaa

SEQ ID NO: 168634 - RNA, 32 nt, Human
gcagcugagcagcuacggcagaaggaucugag

SEQ ID NO: 168635 - RNA, 32 nt, Human
gcagcugagccgggucccuuaggggaggugac

SEQ ID NO: 168636 - RNA, 32 nt, Human
gcagcugaggaggaggcaggagagagggaaaa

SEQ ID NO: 168637 - RNA, 32 nt, Human
gcagcugaggagggagugaaccucaagccuaa

SEQ ID NO: 168638 - RNA, 32 nt, Human
gcagcugaggcgaguggaucaccugaggucag

SEQ ID NO: 168639 - RNA, 24 nt, Human
gcagcugagggagcugagcuggga

SEQ ID NO: 168640 - RNA, 32 nt, Human
gcagcugagugagagacacagagagaaggaga

SEQ ID NO: 168641 - RNA, 22 nt, Human
gcagcugaucagaccucaauaa

SEQ ID NO: 168642 - RNA, 32 nt, Human
gcagcugaucauagcucacugcagcuucaaac

SEQ ID NO: 168643 - RNA, 32 nt, Human
gcagcugaugggauaagguggggaaggacggu

SEQ ID NO: 168644 - RNA, 32 nt, Human
gcagcugauugacaccguccugccuuccuuau

SEQ ID NO: 168645 - RNA, 32 nt, Human
gcagcugcaacaacugcugcaagcaggaucgg

SEQ ID NO: 168646 - RNA, 23 nt, Human
gcagcugcacagccucugcuaca

SEQ ID NO: 168647 - RNA, 32 nt, Human
gcagcugcaccacuuuguguuacucucugaug

SEQ ID NO: 168648 - RNA, 32 nt, Human
gcagcugcacuccccucccaggaaaggggcag

SEQ ID NO: 168649 - RNA, 24 nt, Human
gcagcugcagaccgccccucacca

SEQ ID NO: 168650 - RNA, 19 nt, Human
gcagcugcagauccacuua

SEQ ID NO: 168651 - RNA, 22 nt, Human
gcagcugcagccgagcgggaag

SEQ ID NO: 168652 - RNA, 32 nt, Human
gcagcugcagccgccgccgcgcagauccacgc

SEQ ID NO: 168653 - RNA, 32 nt, Human
gcagcugcagcuccggcgcgagggcucccuug

SEQ ID NO: 168654 - RNA, 22 nt, Human
gcagcugcagguacccccagca

SEQ ID NO: 168655 - RNA, 20 nt, Human
gcagcugcaggucccaggag

SEQ ID NO: 168656 - RNA, 21 nt, Human
gcagcugcauggcuuuggccu

SEQ ID NO: 168657 - RNA, 32 nt, Human
gcagcugccaccgcagcugccuccucaggauc

SEQ ID NO: 168658 - RNA, 32 nt, Human
gcagcugccagcuuauagauggggcggauggc

SEQ ID NO: 168659 - RNA, 21 nt, Human
gcagcugccaucggcccgcuu

SEQ ID NO: 168660 - RNA, 32 nt, Human
gcagcugccaugaugccuugggaugcccuggu

SEQ ID NO: 168661 - RNA, 32 nt, Human
gcagcugcccagaacccugcugaugagccugc

SEQ ID NO: 168662 - RNA, 20 nt, Human
gcagcugcccagcugucaag

SEQ ID NO: 168663 - RNA, 18 nt, Human
gcagcugccccaccccaa

SEQ ID NO: 168664 - RNA, 32 nt, Human
gcagcugccccagggacaugggaagaccacgg

SEQ ID NO: 168665 - RNA, 26 nt, Human
gcagcugccccuccuggagcagaaag

SEQ ID NO: 168666 - RNA, 21 nt, Human
gcagcugccgccucgccgcgg

SEQ ID NO: 168667 - RNA, 31 nt, Human
gcagcugccguacuccaggcuugugucggcc

SEQ ID NO: 168668 - RNA, 20 nt, Human
gcagcugccucagucggcua

SEQ ID NO: 168669 - RNA, 22 nt, Human
gcagcugccuggcagccggcca

SEQ ID NO: 168670 - RNA, 32 nt, Human
gcagcugccugggaaggccguguuucagcccu

SEQ ID NO: 168671 - RNA, 32 nt, Human
gcagcugccugggacucaauuugccccaucca

SEQ ID NO: 168672 - RNA, 20 nt, Human
gcagcugcgagacuccucca

SEQ ID NO: 168673 - RNA, 28 nt, Human
gcagcugcgccuaggcuggagcuggaag

SEQ ID NO: 168674 - RNA, 18 nt, Human
gcagcugcgccucagggg

SEQ ID NO: 168675 - RNA, 32 nt, Human
gcagcugcgcggagaacuggggcucaccguca

SEQ ID NO: 168676 - RNA, 21 nt, Human
gcagcugcggcggcggcagcg

SEQ ID NO: 168677 - RNA, 32 nt, Human
gcagcugcguuccucuggaggaggagaggcgc

SEQ ID NO: 168678 - RNA, 32 nt, Human
gcagcugcuauagauagcacugccuucuuguu

SEQ ID NO: 168679 - RNA, 32 nt, Human
gcagcugcuaucugcagcuccuaggugcuuuc

SEQ ID NO: 168680 - RNA, 16 nt, Human
gcagcugcucaaaggc

SEQ ID NO: 168681 - RNA, 22 nt, Human
gcagcugcucaccugagcucag

SEQ ID NO: 168682 - RNA, 21 nt, Human
gcagcugcucugcucaccagc

SEQ ID NO: 168683 - RNA, 23 nt, Human
gcagcugcugaaaaaucuaauga

SEQ ID NO: 168684 - RNA, 32 nt, Human
gcagcugcugaacuccagccaucaacacggug

SEQ ID NO: 168685 - RNA, 32 nt, Human
gcagcugcugaaucugucuguucaguuuguca

SEQ ID NO: 168686 - RNA, 32 nt, Human
gcagcugcugccacucugcugccuguacagaa

SEQ ID NO: 168687 - RNA, 21 nt, Human
gcagcugcugccucacccaca

SEQ ID NO: 168688 - RNA, 32 nt, Human
gcagcugcuggcacaaauagccugcuucuauu

SEQ ID NO: 168689 - RNA, 32 nt, Human
gcagcugcugggacucagggacuggugcaggu

SEQ ID NO: 168690 - RNA, 32 nt, Human
gcagcugcugggaguugaggguaggguggugu

SEQ ID NO: 168691 - RNA, 32 nt, Human
gcagcugcugugccaggcucugcugaauagaa

SEQ ID NO: 168692 - RNA, 32 nt, Human
gcagcugcuguggaggcuggguggccacacag

SEQ ID NO: 168693 - RNA, 32 nt, Human
gcagcugcuguugccaccaccacuaguucaag

SEQ ID NO: 168694 - RNA, 32 nt, Human
gcagcugcuucaccccucucucugcagccaug

SEQ ID NO: 168695 - RNA, 21 nt, Human
gcagcuggaaggcacaagggg

SEQ ID NO: 168696 - RNA, 22 nt, Human
gcagcuggaaggcacaagggga

SEQ ID NO: 168697 - RNA, 32 nt, Human
gcagcuggaauguuaaccuuagaaaguuucca

SEQ ID NO: 168698 - RNA, 22 nt, Human
gcagcuggaccagucuggcggg

SEQ ID NO: 168699 - RNA, 32 nt, Human
gcagcuggacccaagcccagcuccccuugggu

SEQ ID NO: 168700 - RNA, 25 nt, Human
gcagcuggacuuccuggagcagaag

SEQ ID NO: 168701 - RNA, 32 nt, Human
gcagcuggagaaugaagagcagcucagaggaa

SEQ ID NO: 168702 - RNA, 32 nt, Human
gcagcuggagagaagagaaggcagcagcagag

SEQ ID NO: 168703 - RNA, 32 nt, Human
gcagcuggagagaaguuaggcagguccuaggg

SEQ ID NO: 168704 - RNA, 18 nt, Human
gcagcuggagaggagcgu

SEQ ID NO: 168705 - RNA, 32 nt, Human
gcagcuggagccaaaaaggcaagguagaaaga

SEQ ID NO: 168706 - RNA, 32 nt, Human
gcagcuggagccacugcacacucagaacaccc

SEQ ID NO: 168707 - RNA, 22 nt, Human
gcagcuggaggagcugggacgg

SEQ ID NO: 168708 - RNA, 21 nt, Human
gcagcuggaggaggagcaggg

SEQ ID NO: 168709 - RNA, 23 nt, Human
gcagcuggaggaggagcagggag

SEQ ID NO: 168710 - RNA, 24 nt, Human
gcagcuggaggaggaggaggagga

SEQ ID NO: 168711 - RNA, 32 nt, Human
gcagcuggagggaaggaagcgauggcggagga

SEQ ID NO: 168712 - RNA, 32 nt, Human
gcagcuggagugagaggcagguggcggccggg

SEQ ID NO: 168713 - RNA, 20 nt, Human
gcagcuggauguggcagagg

SEQ ID NO: 168714 - RNA, 23 nt, Human
gcagcuggauuuggagcuggugg

SEQ ID NO: 168715 - RNA, 32 nt, Human
gcagcuggccccuucccugccugcugucacca

SEQ ID NO: 168716 - RNA, 19 nt, Human
gcagcuggccuccauggcc

SEQ ID NO: 168717 - RNA, 24 nt, Human
gcagcuggcggagcggcccagccc

SEQ ID NO: 168718 - RNA, 32 nt, Human
gcagcuggcucuguuuccaagccuggggaggg

SEQ ID NO: 168719 - RNA, 21 nt, Human
gcagcuggcuggaccagaaag

SEQ ID NO: 168720 - RNA, 32 nt, Human
gcagcuggcuuccuggggugaagaggcaggca

SEQ ID NO: 168721 - RNA, 32 nt, Human
gcagcugggaggacccucccgccccaggcaga

SEQ ID NO: 168722 - RNA, 32 nt, Human
gcagcugggaggagguggugacgguggcaacg

SEQ ID NO: 168723 - RNA, 32 nt, Human
gcagcugggauuacaggcgcuggccacacacc

SEQ ID NO: 168724 - RNA, 32 nt, Human
gcagcugggauuacagguaugcgccaccaugc

SEQ ID NO: 168725 - RNA, 32 nt, Human
gcagcugggauuacaggugcccgccaccacgc

SEQ ID NO: 168726 - RNA, 32 nt, Human
gcagcugggauuacaggugcgugccaccacac

SEQ ID NO: 168727 - RNA, 32 nt, Human
gcagcugggauuugaaccaggccuucugauuu

SEQ ID NO: 168728 - RNA, 32 nt, Human
gcagcugggcagcagggguagggguagggagc

SEQ ID NO: 168729 - RNA, 32 nt, Human
gcagcugggcaggucuccucugggaggucuug

SEQ ID NO: 168730 - RNA, 27 nt, Human
gcagcugggccgggccaaggcaggaag

SEQ ID NO: 168731 - RNA, 32 nt, Human
gcagcuggggcagaggagcuggggucaggggc

SEQ ID NO: 168732 - RNA, 32 nt, Human
gcagcuggggccugaggaggagggguucacuu

SEQ ID NO: 168733 - RNA, 32 nt, Human
gcagcuggggcugaggaugucucaagaggcca

SEQ ID NO: 168734 - RNA, 23 nt, Human
gcagcugggggagaaccauggga

SEQ ID NO: 168735 - RNA, 22 nt, Human
gcagcugggggaggguucaggg

SEQ ID NO: 168736 - RNA, 32 nt, Human
gcagcugggggcucuuuuccuggucauugggu

SEQ ID NO: 168737 - RNA, 23 nt, Human
gcagcugggguucugaacggaga

SEQ ID NO: 168738 - RNA, 32 nt, Human
gcagcuggguuggcuucugagaacaggacuua

SEQ ID NO: 168739 - RNA, 32 nt, Human
gcagcugguucucaaugugccagcagggacuc

SEQ ID NO: 168740 - RNA, 32 nt, Human
gcagcugguuggacgaggggagcuggugggca

SEQ ID NO: 168741 - RNA, 32 nt, Human
gcagcuguaccaggcuggcaggucacugagag

SEQ ID NO: 168742 - RNA, 32 nt, Human
gcagcuguacuaggacugggaacggagcugaa

SEQ ID NO: 168743 - RNA, 32 nt, Human
gcagcugucacucacugagcacuggccauagc

SEQ ID NO: 168744 - RNA, 22 nt, Human
gcagcugucaggccugaggaag

SEQ ID NO: 168745 - RNA, 32 nt, Human
gcagcugucauccuccugggaagccgagcagu

SEQ ID NO: 168746 - RNA, 32 nt, Human
gcagcugucaucucgcugguguccgcagcgag

SEQ ID NO: 168747 - RNA, 32 nt, Human
gcagcuguccagccaacugucucuccacccuu

SEQ ID NO: 168748 - RNA, 32 nt, Human
gcagcuguccccaucaggccaagagcgagcga

SEQ ID NO: 168749 - RNA, 16 nt, Human
gcagcuguccguggcc

SEQ ID NO: 168750 - RNA, 32 nt, Human
gcagcuguccuaguucucuccaacaagaaguu

SEQ ID NO: 168751 - RNA, 21 nt, Human
gcagcuguccuguguguggua

SEQ ID NO: 168752 - RNA, 32 nt, Human
gcagcugucgcugaagccacgucaaucugagc

SEQ ID NO: 168753 - RNA, 32 nt, Human
gcagcugucugggagucaaggcugcaguagcg

SEQ ID NO: 168754 - RNA, 32 nt, Human
gcagcugugaugguaccugggagggagggaag

SEQ ID NO: 168755 - RNA, 32 nt, Human
gcagcugugaugguuucagagcucagacugau

SEQ ID NO: 168756 - RNA, 18 nt, Human
gcagcugugcccgggcgg

SEQ ID NO: 168757 - RNA, 18 nt, Human
gcagcugugccuggaggc

SEQ ID NO: 168758 - RNA, 32 nt, Human
gcagcugugcuccugcucccuccuggaaugug

SEQ ID NO: 168759 - RNA, 20 nt, Human
gcagcugugcugagcugagg

SEQ ID NO: 168760 - RNA, 20 nt, Human
gcagcugugcuggcucccgg

SEQ ID NO: 168761 - RNA, 32 nt, Human
gcagcuguggacccaggaaucucuguacucuu

SEQ ID NO: 168762 - RNA, 20 nt, Human
gcagcugugggggccggugg

SEQ ID NO: 168763 - RNA, 32 nt, Human
gcagcugugucgcaucagcugcauggguggca

SEQ ID NO: 168764 - RNA, 24 nt, Human
gcagcuguuuuggggucugugaga

SEQ ID NO: 168765 - RNA, 32 nt, Human
gcagcuuaauuuuucuguauugcaguguuuau

SEQ ID NO: 168766 - RNA, 32 nt, Human
gcagcuucaacuuuucucuuuaguguucuguu

SEQ ID NO: 168767 - RNA, 32 nt, Human
gcagcuucauagacaccccucccugucccugg

SEQ ID NO: 168768 - RNA, 32 nt, Human
gcagcuucaucauugucaugugaggauguguc

SEQ ID NO: 168769 - RNA, 32 nt, Human
gcagcuucauuucuaaggacaggaagccaaau

SEQ ID NO: 168770 - RNA, 32 nt, Human
gcagcuuccauggccuggggcugugagaggcc

SEQ ID NO: 168771 - RNA, 32 nt, Human
gcagcuuccaugguuggaaugcugagccauug

SEQ ID NO: 168772 - RNA, 32 nt, Human
gcagcuucgccuccacccuccguccagcgccc

SEQ ID NO: 168773 - RNA, 18 nt, Human
gcagcuucucugcuccuu

SEQ ID NO: 168774 - RNA, 32 nt, Human
gcagcuucugugguucagcuugugacaugaua

SEQ ID NO: 168775 - RNA, 32 nt, Human
gcagcuucuucacagagacugguuacaaccag

SEQ ID NO: 168776 - RNA, 32 nt, Human
gcagcuugaaacugagaugugaacacaucagc

SEQ ID NO: 168777 - RNA, 17 nt, Human
gcagcuugacccuggaa

SEQ ID NO: 168778 - RNA, 31 nt, Human
gcagcuugagcuacaaucaggagggaaauug

SEQ ID NO: 168779 - RNA, 32 nt, Human
gcagcuugcacacccaucaucuuuaaccccaa

SEQ ID NO: 168780 - RNA, 32 nt, Human
gcagcuugccacuccugggcuggguaaacagg

SEQ ID NO: 168781 - RNA, 32 nt, Human
gcagcuugcccagcucuugaguacaguggugg

SEQ ID NO: 168782 - RNA, 32 nt, Human
gcagcuugcccgaggcugcggcuaagacuggg

SEQ ID NO: 168783 - RNA, 19 nt, Human
gcagcuugcccucaaaggc

SEQ ID NO: 168784 - RNA, 32 nt, Human
gcagcuugcugaaugucagcugccugagagag

SEQ ID NO: 168785 - RNA, 32 nt, Human
gcagcuuggccccuccagccagucccauucgg

SEQ ID NO: 168786 - RNA, 32 nt, Human
gcagcuugggaggccaaggugggugaauugcu

SEQ ID NO: 168787 - RNA, 32 nt, Human
gcagcuugggaggcggcucuccccaggcggcg

SEQ ID NO: 168788 - RNA, 32 nt, Human
gcagcuugguucuccccucuggccccuggaga

SEQ ID NO: 168789 - RNA, 32 nt, Human
gcagcuuguacuauuaaaauaauagagaaugu

SEQ ID NO: 168790 - RNA, 32 nt, Human
gcagcuuuaagcucugcuucucucuuccucau

SEQ ID NO: 168791 - RNA, 32 nt, Human
gcagcuuuccagcaaagccaaaguugacugug

SEQ ID NO: 168792 - RNA, 32 nt, Human
gcagcuuuccagccuugguggggaagaaagug

SEQ ID NO: 168793 - RNA, 32 nt, Human
gcagcuuuccuuucuuuuguguguuuucugug

SEQ ID NO: 168794 - RNA, 32 nt, Human
gcagcuuucgcccucugcuuugauggcugagg

SEQ ID NO: 168795 - RNA, 25 nt, Human
gcagcuuucuccaaggacgcggggg

SEQ ID NO: 168796 - RNA, 32 nt, Human
gcagcuuucuuuggggcuucagugagaacucu

SEQ ID NO: 168797 - RNA, 32 nt, Human
gcagcuuugaacuagggcugggguugugggug

SEQ ID NO: 168798 - RNA, 17 nt, Human
gcagcuuugagucugga

SEQ ID NO: 168799 - RNA, 32 nt, Human
gcagcuuugcccuguccaccuguugggugggc

SEQ ID NO: 168800 - RNA, 32 nt, Human
gcagcuuugccgccucuccaucgucuugggcc

SEQ ID NO: 168801 - RNA, 32 nt, Human
gcagcuuuggagcacagcgaggaggacggcuc

SEQ ID NO: 168802 - RNA, 32 nt, Human
gcagcuuuguccccacugugcaugccggcuug

SEQ ID NO: 168803 - RNA, 24 nt, Human
gcagcuuugugaaacuucuucaca

SEQ ID NO: 168804 - RNA, 32 nt, Human
gcagcuuuuagagugagugcugcuguggguuc

SEQ ID NO: 168805 - RNA, 32 nt, Human
gcagcuuuuccuccucuucccugcacuuccca

SEQ ID NO: 168806 - RNA, 32 nt, Human
gcagcuuuugacuguuucccggacacaaccgc

SEQ ID NO: 168807 - RNA, 22 nt, Human
gcaggaaaaaagacagauguug

SEQ ID NO: 168808 - RNA, 32 nt, Human
gcaggaaaaaccaguguccugcacucucuagc

SEQ ID NO: 168809 - RNA, 21 nt, Human
gcaggaaaagugcagacucug

SEQ ID NO: 168810 - RNA, 32 nt, Human
gcaggaaaaucacuugaacccaggaggcagag

SEQ ID NO: 168811 - RNA, 32 nt, Human
gcaggaaaauuguuugaacccaggagguggag

SEQ ID NO: 168812 - RNA, 21 nt, Human
gcaggaaacauggugaugcug

SEQ ID NO: 168813 - RNA, 23 nt, Human
gcaggaaaccauccagaaugcug

SEQ ID NO: 168814 - RNA, 32 nt, Human
gcaggaaacgugaacauaugugcugccugccc

SEQ ID NO: 168815 - RNA, 32 nt, Human
gcaggaaaggaaagguuggcugaacagggaag

SEQ ID NO: 168816 - RNA, 32 nt, Human
gcaggaaaggcggggccuuucuugucauagcu

SEQ ID NO: 168817 - RNA, 25 nt, Human
gcaggaaagggaaaaggagaguagu

SEQ ID NO: 168818 - RNA, 18 nt, Human
gcaggaaaguacagaugc

SEQ ID NO: 168819 - RNA, 22 nt, Human
gcaggaaauaaagagacagcug

SEQ ID NO: 168820 - RNA, 32 nt, Human
gcaggaaaugaccaagcucacacaugcuggcu

SEQ ID NO: 168821 - RNA, 32 nt, Human
gcaggaacaauauuccuguagccauggaagag

SEQ ID NO: 168822 - RNA, 18 nt, Human
gcaggaacacucucccca

SEQ ID NO: 168823 - RNA, 32 nt, Human
gcaggaacagagagacagagccugaguaauug

SEQ ID NO: 168824 - RNA, 32 nt, Human
gcaggaacagcacagacccagacgaggggaug

SEQ ID NO: 168825 - RNA, 32 nt, Human
gcaggaaccaacagacauacagcuucagccua

SEQ ID NO: 168826 - RNA, 32 nt, Human
gcaggaacccccagucuaggacuugggcauuu

SEQ ID NO: 168827 - RNA, 32 nt, Human
gcaggaacgcuaggcagucucuuuccaccaga

SEQ ID NO: 168828 - RNA, 32 nt, Human
gcaggaacugagcgaggaaggaagggagggaa

SEQ ID NO: 168829 - RNA, 32 nt, Human
gcaggaagaaagaccugcauccugcaucugua

SEQ ID NO: 168830 - RNA, 32 nt, Human
gcaggaagaaggcaggcuucuggcuuccagag

SEQ ID NO: 168831 - RNA, 20 nt, Human
gcaggaagaaucgcuugaac

SEQ ID NO: 168832 - RNA, 20 nt, Human
gcaggaagaauugcuugaac

SEQ ID NO: 168833 - RNA, 20 nt, Human
gcaggaagagaguccuccuu

SEQ ID NO: 168834 - RNA, 32 nt, Human
gcaggaagaggcgagggcacuugggggucauu

SEQ ID NO: 168835 - RNA, 32 nt, Human
gcaggaagaggggaguggaggcagcccauuca

SEQ ID NO: 168836 - RNA, 24 nt, Human
gcaggaagaucacuugagaucagg

SEQ ID NO: 168837 - RNA, 32 nt, Human
gcaggaagcagagagagcagggcuguucgacu

SEQ ID NO: 168838 - RNA, 32 nt, Human
gcaggaagccaagguacagagagcagccuggc

SEQ ID NO: 168839 - RNA, 32 nt, Human
gcaggaagccagcugucauauucggagggaau

SEQ ID NO: 168840 - RNA, 20 nt, Human
gcaggaagccauagaugcug

SEQ ID NO: 168841 - RNA, 32 nt, Human
gcaggaagcggaggaggaaaggagcagaaggu

SEQ ID NO: 168842 - RNA, 20 nt, Human
gcaggaagcucaggcagcuc

SEQ ID NO: 168843 - RNA, 32 nt, Human
gcaggaagcucgcuugagcucaggaguucaag

SEQ ID NO: 168844 - RNA, 32 nt, Human
gcaggaagcugcaggccggcgguggauggggc

SEQ ID NO: 168845 - RNA, 32 nt, Human
gcaggaagcuguuccaggccucaauacagaaa

SEQ ID NO: 168846 - RNA, 32 nt, Human
gcaggaaggagaaaggagggaagguaaaagac

SEQ ID NO: 168847 - RNA, 32 nt, Human
gcaggaaggagacagacagcuggcaguuccuc

SEQ ID NO: 168848 - RNA, 32 nt, Human
gcaggaaggagagcagaaaaggggaugggcug

SEQ ID NO: 168849 - RNA, 20 nt, Human
gcaggaaggaggcagagcug

SEQ ID NO: 168850 - RNA, 32 nt, Human
gcaggaaggaggcagagcuguccgugggaggu

SEQ ID NO: 168851 - RNA, 32 nt, Human
gcaggaaggccagagguucugguggaguugau

SEQ ID NO: 168852 - RNA, 32 nt, Human
gcaggaagggcugaggccaaccacaaaggggc

SEQ ID NO: 168853 - RNA, 25 nt, Human
gcaggaaggggaagccagcagggga

SEQ ID NO: 168854 - RNA, 32 nt, Human
gcaggaaggggaggggcagugagguuggcucc

SEQ ID NO: 168855 - RNA, 32 nt, Human
gcaggaaggggaguucgcaggagcuccagucc

SEQ ID NO: 168856 - RNA, 32 nt, Human
gcaggaaggggcccugcacgccgggacgccac

SEQ ID NO: 168857 - RNA, 20 nt, Human
gcaggaagggggccgacucc

SEQ ID NO: 168858 - RNA, 32 nt, Human
gcaggaagguaaaggggagaccaucugagcag

SEQ ID NO: 168859 - RNA, 32 nt, Human
gcaggaagucaaaaggagagugauggagccac

SEQ ID NO: 168860 - RNA, 32 nt, Human
gcaggaauaaguaaucuuauauacaagcuucg

SEQ ID NO: 168861 - RNA, 32 nt, Human
gcaggaauaaguaaucuuauauacaagcuuug

SEQ ID NO: 168862 - RNA, 32 nt, Human
gcaggaaucaacaaagggucagagcgaaguga

SEQ ID NO: 168863 - RNA, 20 nt, Human
gcaggaaucauuacacagug

SEQ ID NO: 168864 - RNA, 32 nt, Human
gcaggaauccuccaacaaccacaaacacaucg

SEQ ID NO: 168865 - RNA, 23 nt, Human
gcaggaaugcuuuacagauguug

SEQ ID NO: 168866 - RNA, 32 nt, Human
gcaggaauguggccacagggagcagagguuug

SEQ ID NO: 168867 - RNA, 32 nt, Human
gcaggacaaacauccucucaagcagucaacgu

SEQ ID NO: 168868 - RNA, 32 nt, Human
gcaggacaaacaucuucucaagcagucaacgu

SEQ ID NO: 168869 - RNA, 32 nt, Human
gcaggacaacuaagggcaucuagcagcaguag

SEQ ID NO: 168870 - RNA, 32 nt, Human
gcaggacaaggcaggaggaucacuugaaccua

SEQ ID NO: 168871 - RNA, 32 nt, Human
gcaggacacagcaaacaggacacauuugccug

SEQ ID NO: 168872 - RNA, 32 nt, Human
gcaggacacaggcagagauacgagggaaccgu

SEQ ID NO: 168873 - RNA, 32 nt, Human
gcaggacacgcuggucugagaugagggggagc

SEQ ID NO: 168874 - RNA, 32 nt, Human
gcaggacacugggcuccggcggccagaguggg

SEQ ID NO: 168875 - RNA, 18 nt, Human
gcaggacagaaaaaccaa

SEQ ID NO: 168876 - RNA, 32 nt, Human
gcaggacagaaagagagagagugaagggggaa

SEQ ID NO: 168877 - RNA, 32 nt, Human
gcaggacagagaugugaucuugcucagaagug

SEQ ID NO: 168878 - RNA, 32 nt, Human
gcaggacagcagaggacgugcugggauuaaac

SEQ ID NO: 168879 - RNA, 32 nt, Human
gcaggacagcagaggaugugcugggauuaaac

SEQ ID NO: 168880 - RNA, 20 nt, Human
gcaggacagcagggccccuc

SEQ ID NO: 168881 - RNA, 22 nt, Human
gcaggaccacggcccgcucccc

SEQ ID NO: 168882 - RNA, 32 nt, Human
gcaggaccacugcaauaaacgccuucuccugc

SEQ ID NO: 168883 - RNA, 16 nt, Human
gcaggaccagcuggga

SEQ ID NO: 168884 - RNA, 24 nt, Human
gcaggacccuggagaagcugaagc

SEQ ID NO: 168885 - RNA, 21 nt, Human
gcaggaccgccauggugcugg

SEQ ID NO: 168886 - RNA, 20 nt, Human
gcaggaccuacuaggagagg

SEQ ID NO: 168887 - RNA, 32 nt, Human
gcaggaccuccaccuucgcccucaccaucauc

SEQ ID NO: 168888 - RNA, 32 nt, Human
gcaggaccugaccuuuugcaaagcaaacauag

SEQ ID NO: 168889 - RNA, 18 nt, Human
gcaggaccuguccuggga

SEQ ID NO: 168890 - RNA, 24 nt, Human
gcaggacgagcauaugcagcugaa

SEQ ID NO: 168891 - RNA, 32 nt, Human
gcaggacgcucagccucagggcucagaaggug

SEQ ID NO: 168892 - RNA, 21 nt, Human
gcaggacgggaggcugagucc

SEQ ID NO: 168893 - RNA, 18 nt, Human
gcaggacgggcugaggga

SEQ ID NO: 168894 - RNA, 20 nt, Human
gcaggacgguggcugggagg

SEQ ID NO: 168895 - RNA, 32 nt, Human
gcaggacguggaccagcuggagcugcugccca

SEQ ID NO: 168896 - RNA, 32 nt, Human
gcaggacguuugagguugcacagaccuggaau

SEQ ID NO: 168897 - RNA, 24 nt, Human
gcaggacuaaccuuugagaaaucc

SEQ ID NO: 168898 - RNA, 32 nt, Human
gcaggacuaaugcuuuuaaaaugaggucuaaa

SEQ ID NO: 168899 - RNA, 23 nt, Human
gcaggacuaucaaaauggacucc

SEQ ID NO: 168900 - RNA, 21 nt, Human
gcaggacuaugcugaaucucc

SEQ ID NO: 168901 - RNA, 32 nt, Human
gcaggacucaugcacacguucaaugcccacau

SEQ ID NO: 168902 - RNA, 32 nt, Human
gcaggacuccggaggcagccugggugggugag

SEQ ID NO: 168903 - RNA, 32 nt, Human
gcaugcuguggucggaucugcccagccgugga

SEQ ID NO: 168904 - RNA, 32 nt, Human
gcaugcuuauaaucccagcuacuugggaggcu

SEQ ID NO: 168905 - RNA, 32 nt, Human
gcaugcuucacaccacugccagaagagcugcc

SEQ ID NO: 168906 - RNA, 32 nt, Human
gcaugcuucauugaggcccaggaagaggcccu

SEQ ID NO: 168907 - RNA, 32 nt, Human
gcaugcuucuuaagaauaaauccacacuuuag

SEQ ID NO: 168908 - RNA, 32 nt, Human
gcaugcuugagcccacgggcccaacuccugag

SEQ ID NO: 168909 - RNA, 32 nt, Human
gcaugcuugguuauuuccaguacuugugaguc

SEQ ID NO: 168910 - RNA, 32 nt, Human
gcaugcuuguaaucccagcuacucagaaggcu

SEQ ID NO: 168911 - RNA, 32 nt, Human
gcaugcuuguaaucccagcuacucgggaggcu

SEQ ID NO: 168912 - RNA, 32 nt, Human
gcaugcuuguaaucccagcuacuugggaggcu

SEQ ID NO: 168913 - RNA, 32 nt, Human
gcaugcuuguaauccuagcuacucaagaggcu

SEQ ID NO: 168914 - RNA, 32 nt, Human
gcaugcuuguagauccagcuacucgggaggcu

SEQ ID NO: 168915 - RNA, 32 nt, Human
gcaugcuuguagucccagcuacucaugaggcu

SEQ ID NO: 168916 - RNA, 32 nt, Human
gcaugcuuguagucccagcuacucgggaggcu

SEQ ID NO: 168917 - RNA, 32 nt, Human
gcaugcuuguagucccagcuacuugggaggcu

SEQ ID NO: 168918 - RNA, 32 nt, Human
gcaugcuuguggucccagcuacuuugggaggu

SEQ ID NO: 168919 - RNA, 32 nt, Human
gcaugcuuuccaucugcacuccagacggcuuu

SEQ ID NO: 168920 - RNA, 32 nt, Human
gcaugcuuuggaaauuuggaagaugguuuuau

SEQ ID NO: 168921 - RNA, 32 nt, Human
gcauggaaaugagaaugugcuguggcugucuu

SEQ ID NO: 168922 - RNA, 32 nt, Human
gcauggaacagcaucuccccugggcuugcucc

SEQ ID NO: 168923 - RNA, 32 nt, Human
gcauggaacuacgaggcaccacagacccuguu

SEQ ID NO: 168924 - RNA, 32 nt, Human
gcauggaacucacaccucuagccccagcuacu

SEQ ID NO: 168925 - RNA, 32 nt, Human
gcauggaacuccugggcucuuguggggacguu

SEQ ID NO: 168926 - RNA, 32 nt, Human
gcauggaaggcagaggcugggugggguggggg

SEQ ID NO: 168927 - RNA, 32 nt, Human
gcauggaaucagauccuaagccauaacaggcu

SEQ ID NO: 168928 - RNA, 32 nt, Human
gcauggaauuauagcaccaccuugugguuaac

SEQ ID NO: 168929 - RNA, 32 nt, Human
gcauggacaggaggagggaaaagggaccugug

SEQ ID NO: 168930 - RNA, 32 nt, Human
gcauggaccucuguggaccacagcguaccugc

SEQ ID NO: 168931 - RNA, 32 nt, Human
gcauggacggggcccagcuaggcgccaggacu

SEQ ID NO: 168932 - RNA, 32 nt, Human
gcauggagaaagauccuagaaaaggucagacc

SEQ ID NO: 168933 - RNA, 32 nt, Human
gcauggagaaguccuuccgaagcugccgauga

SEQ ID NO: 168934 - RNA, 32 nt, Human
gcauggagaaugcagaggugagccugucgugg

SEQ ID NO: 168935 - RNA, 32 nt, Human
gcauggagcucccagcugguggguacagcuug

SEQ ID NO: 168936 - RNA, 32 nt, Human
gcauggagcucuggcauccccaccucaguauc

SEQ ID NO: 168937 - RNA, 32 nt, Human
gcauggagcugcacucuaggagaaggagggga

SEQ ID NO: 168938 - RNA, 32 nt, Human
gcauggaggaaaggaagagggcacggaguugc

SEQ ID NO: 168939 - RNA, 32 nt, Human
gcauggaggaggcggaggccgcggcgagccgg

SEQ ID NO: 168940 - RNA, 32 nt, Human
gcauggagggcgugccuggugaagggaacagu

SEQ ID NO: 168941 - RNA, 32 nt, Human
gcauggagggcuccugcccuucugcugagcca

SEQ ID NO: 168942 - RNA, 32 nt, Human
gcauggagggguccccagagcccccaaccagu

SEQ ID NO: 168943 - RNA, 20 nt, Human
gcauggaguuugagaucuaa

SEQ ID NO: 168944 - RNA, 32 nt, Human
gcauggaugggcagaggcucucucccugccca

SEQ ID NO: 168945 - RNA, 32 nt, Human
gcauggauggggcuuuggguccucgagguugg

SEQ ID NO: 168946 - RNA, 24 nt, Human
gcauggauguacucaacuguguuu

SEQ ID NO: 168947 - RNA, 32 nt, Human
gcauggauguccugcucagacacuccacuuag

SEQ ID NO: 168948 - RNA, 32 nt, Human
gcauggaugugugguuggaggagacgggggug

SEQ ID NO: 168949 - RNA, 32 nt, Human
gcauggauuucaucuuugaggaguucaaaacc

SEQ ID NO: 168950 - RNA, 32 nt, Human
gcauggcaaaaauuuagaauagccagggucug

SEQ ID NO: 168951 - RNA, 32 nt, Human
gcauggcaaacagcaggcugugugcacggauu

SEQ ID NO: 168952 - RNA, 32 nt, Human
gcauggcaaauuuugaccauugcccagaaccc

SEQ ID NO: 168953 - RNA, 32 nt, Human
gcauggcaccugucgcccagugcccuggggcu

SEQ ID NO: 168954 - RNA, 32 nt, Human
gcauggcagaaggaggccagcacgcagccccu

SEQ ID NO: 168955 - RNA, 32 nt, Human
gcauggcagcacuuaugcucugugacaguauu

SEQ ID NO: 168956 - RNA, 32 nt, Human
gcauggcaggcagagauacagcaagggcaaag

SEQ ID NO: 168957 - RNA, 32 nt, Human
gcauggcaggcagaggcccagggacacugacg

SEQ ID NO: 168958 - RNA, 32 nt, Human
gcauggcagggacaauggugggcaguugcucu

SEQ ID NO: 168959 - RNA, 32 nt, Human
gcauggcagugccacucaagaaaaugaaucuc

SEQ ID NO: 168960 - RNA, 32 nt, Human
gcauggcaucaccuccaccauacuccaucagu

SEQ ID NO: 168961 - RNA, 32 nt, Human
gcauggccaccaaggagcuggaccuuggaugc

SEQ ID NO: 168962 - RNA, 19 nt, Human
gcauggccagacucaggca

SEQ ID NO: 168963 - RNA, 32 nt, Human
gcauggccaucguggcuacaucagucccggcu

SEQ ID NO: 168964 - RNA, 32 nt, Human
gcauggcccaggagaagagacacuagccauaa

SEQ ID NO: 168965 - RNA, 32 nt, Human
gcauggccccuccaggaacauucccacauaau

SEQ ID NO: 168966 - RNA, 32 nt, Human
gcauggccccuccagguaaccuugcacucucc

SEQ ID NO: 168967 - RNA, 27 nt, Human
gcauggcccugagaggcgucuccgugc

SEQ ID NO: 168968 - RNA, 32 nt, Human
gcauggcccugcugccccucccugccuccacc

SEQ ID NO: 168969 - RNA, 32 nt, Human
gcauggcccuguuuccuguugauauggugaua

SEQ ID NO: 168970 - RNA, 19 nt, Human
gcauggccgagcugggagg

SEQ ID NO: 168971 - RNA, 32 nt, Human
gcauggccuaacucaggcagaguaguuggcga

SEQ ID NO: 168972 - RNA, 32 nt, Human
gcauggccuccagaggaggggugguguccuuc

SEQ ID NO: 168973 - RNA, 25 nt, Human
gcauggccugagcccccugcugcca

SEQ ID NO: 168974 - RNA, 32 nt, Human
gcauggccugccugucuugagcuagauacugu

SEQ ID NO: 168975 - RNA, 18 nt, Human
gcauggcgccugccacca

SEQ ID NO: 168976 - RNA, 27 nt, Human
gcauggcggcccugggacaucuugcug

SEQ ID NO: 168977 - RNA, 32 nt, Human
gcauggcuauuagugggugcuuccaugucuua

SEQ ID NO: 168978 - RNA, 32 nt, Human
gcauggcucaccagccagccucuguggucuuu

SEQ ID NO: 168979 - RNA, 21 nt, Human
gcauggcucacgccuguaauc

SEQ ID NO: 168980 - RNA, 32 nt, Human
gcauggcucuugcccacccagaagaaggugca

SEQ ID NO: 168981 - RNA, 32 nt, Human
gcauggcugagcuccuggagacgagggcgggc

SEQ ID NO: 168982 - RNA, 32 nt, Human
gcauggcugcacucuagccugggugacagugu

SEQ ID NO: 168983 - RNA, 32 nt, Human
gcauggcugccuguaaucccagcacuuuggga

SEQ ID NO: 168984 - RNA, 32 nt, Human
gcauggcugcgugugugccugugcgugcgucu

SEQ ID NO: 168985 - RNA, 32 nt, Human
gcauggcugcuuguuuacaaagcaucucauuc

SEQ ID NO: 168986 - RNA, 32 nt, Human
gcauggcugggaggacacagaaacagggcucu

SEQ ID NO: 168987 - RNA, 32 nt, Human
gcauggcuggugccugaagaccccagauguga

SEQ ID NO: 168988 - RNA, 32 nt, Human
gcauggcuguaauccuggcuacucaggaggcc

SEQ ID NO: 168989 - RNA, 32 nt, Human
gcauggcugucaggagggcuuccugggaggug

SEQ ID NO: 168990 - RNA, 32 nt, Human
gcauggcuuccuauaacuucuuccugcuggac

SEQ ID NO: 168991 - RNA, 32 nt, Human
gcauggcuucuaaagggcaugacagugaccug

SEQ ID NO: 168992 - RNA, 32 nt, Human
gcauggcuuuauccucccucucaucccaaagc

SEQ ID NO: 168993 - RNA, 32 nt, Human
gcauggcuuuugacaguaaaucccggagagga

SEQ ID NO: 168994 - RNA, 32 nt, Human
gcaugggaagcagccuucagugccuucaugaa

SEQ ID NO: 168995 - RNA, 19 nt, Human
gcaugggaagggaggcauc

SEQ ID NO: 168996 - RNA, 32 nt, Human
gcaugggacagaagcaggcccagcaaguaaug

SEQ ID NO: 168997 - RNA, 32 nt, Human
gcaugggagaugucugugcuuggagguaccuc

SEQ ID NO: 168998 - RNA, 32 nt, Human
gcaugggaggcagagguugcagugagccaaga

SEQ ID NO: 168999 - RNA, 32 nt, Human
gcaugggaggugggcguuggaaaggcugagua

SEQ ID NO: 169000 - RNA, 32 nt, Human
gcaugggaugggcucaguugggcaguucuucu

SEQ ID NO: 169001 - RNA, 30 nt, Human
gcaugggauugggcucugggcacugacuca

SEQ ID NO: 169002 - RNA, 30 nt, Human
gcaugggauugggcucugggcacugacuua

SEQ ID NO: 169003 - RNA, 17 nt, Human
gcaugggcaccaaaguc

SEQ ID NO: 169004 - RNA, 32 nt, Human
gcaugggcaggcauuuguucccuaccugggug

SEQ ID NO: 169005 - RNA, 32 nt, Human
gcaugggcaucacaccccucacagaugaacaa

SEQ ID NO: 169006 - RNA, 32 nt, Human
gcaugggccagccccuccaucuguacuugguc

SEQ ID NO: 169007 - RNA, 32 nt, Human
gcaugggcucagcucauccucccucuggcccc

SEQ ID NO: 169008 - RNA, 32 nt, Human
gcaugggcucgccgugucucagccucugccag

SEQ ID NO: 169009 - RNA, 32 nt, Human
gcauggggaauaagaaucaguguuaauuuaaa

SEQ ID NO: 169010 - RNA, 32 nt, Human
gcauggggagcagcuaaacaaugcagauucau

SEQ ID NO: 169011 - RNA, 32 nt, Human
gcauggggaggcggcggcagcggguggacccc

SEQ ID NO: 169012 - RNA, 32 nt, Human
gcauggggaggguaggcagggagcagcauguc

SEQ ID NO: 169013 - RNA, 32 nt, Human
gcauggggcaaagaucugaggggccagaucuu

SEQ ID NO: 169014 - RNA, 21 nt, Human
gcauggggcauguccuuucca

SEQ ID NO: 169015 - RNA, 32 nt, Human
gcauggggcccagcugcagcugugcuuguucu

SEQ ID NO: 169016 - RNA, 32 nt, Human
gcauggggccccucccuucuuccacacccacc

SEQ ID NO: 169017 - RNA, 30 nt, Human
gcauggggccucuccuugccccuggagcua

SEQ ID NO: 169018 - RNA, 32 nt, Human
gcauggggcggguccuagcuguuagggacauu

SEQ ID NO: 169019 - RNA, 21 nt, Human
gcauggggcugggaggucuca

SEQ ID NO: 169020 - RNA, 22 nt, Human
gcauggggcuguggagugggug

SEQ ID NO: 169021 - RNA, 32 nt, Human
gcaugggggaaagcagugguccuagcauccau

SEQ ID NO: 169022 - RNA, 32 nt, Human
gcaugggggaaugcccauccuggagaagaauu

SEQ ID NO: 169023 - RNA, 32 nt, Human
gcaugggggaggcacagaaugcuggagagaug

SEQ ID NO: 169024 - RNA, 32 nt, Human
gcaugggggcaggaagagagcugagcauugau

SEQ ID NO: 169025 - RNA, 32 nt, Human
gcaugggggcauggugccagaggcucuggcug

SEQ ID NO: 169026 - RNA, 32 nt, Human
gcaugggggccaggcugucaacugugcauaga

SEQ ID NO: 169027 - RNA, 17 nt, Human
gcauggggggcuggacc

SEQ ID NO: 169028 - RNA, 32 nt, Human
gcaugggguggguggaggccagggacgcugcu

SEQ ID NO: 169029 - RNA, 32 nt, Human
gcauggggugugugcuuuuggggauggggagg

SEQ ID NO: 169030 - RNA, 32 nt, Human
gcaugggguugugggguggaggcuggcagcug

SEQ ID NO: 169031 - RNA, 32 nt, Human
gcaugggguuuucugccccacacccuuuagga

SEQ ID NO: 169032 - RNA, 32 nt, Human
gcauggguccccaccaagaggauucccuggcc

SEQ ID NO: 169033 - RNA, 22 nt, Human
gcaugggugcaccaaucaucuu

SEQ ID NO: 169034 - RNA, 32 nt, Human
gcauggguggagggucccuaauucucuucgcu

SEQ ID NO: 169035 - RNA, 32 nt, Human
gcaugggugggacuugugacccuacccuguca

SEQ ID NO: 169036 - RNA, 32 nt, Human
gcaugguaaacccacaguagaagggaaaaagu

SEQ ID NO: 169037 - RNA, 24 nt, Human
gcaugguaacucacgccuguaauc

SEQ ID NO: 169038 - RNA, 23 nt, Human
gcaugguacaucucacacuagga

SEQ ID NO: 169039 - RNA, 32 nt, Human
gcaugguacucaugccuguaaucccagcacuu

SEQ ID NO: 169040 - RNA, 32 nt, Human
gcaugguacugacugagcugaggagucaaacu

SEQ ID NO: 169041 - RNA, 32 nt, Human
gcaugguagccugagcgcgcccccaggguagu

SEQ ID NO: 169042 - RNA, 24 nt, Human
gcaugguagcucacgccuguaauc

SEQ ID NO: 169043 - RNA, 32 nt, Human
gcaugguagggagagacacaaaagaugggaaa

SEQ ID NO: 169044 - RNA, 32 nt, Human
gcaugguaucacagcaagucugucaaaucagu

SEQ ID NO: 169045 - RNA, 16 nt, Human
gcauggucaaaggcuc

SEQ ID NO: 169046 - RNA, 32 nt, Human
gcaugguccugccccagcaucuugcuggguug

SEQ ID NO: 169047 - RNA, 32 nt, Human
gcauggucgucacgccuguaaucccagcacuu

SEQ ID NO: 169048 - RNA, 32 nt, Human
gcauggucuagagguugugggcagcauggaca

SEQ ID NO: 169049 - RNA, 20 nt, Human
gcauggucugacaccugggc

SEQ ID NO: 169050 - RNA, 32 nt, Human
gcauggucugugaaauggagagaaggaaacau

SEQ ID NO: 169051 - RNA, 32 nt, Human
gcauggucuuucuccuuuauggccuccccacu

SEQ ID NO: 169052 - RNA, 32 nt, Human
gcauggugaaaccucaucccucuaacaauaua

SEQ ID NO: 169053 - RNA, 30 nt, Human
gcauggugaaaugaaaccccaucucaacua

SEQ ID NO: 169054 - RNA, 24 nt, Human
gcauggugacacacaccuguaauc

SEQ ID NO: 169055 - RNA, 24 nt, Human
gcauggugacccacaccuguaauc

SEQ ID NO: 169056 - RNA, 24 nt, Human
gcauggugacucacaucuguaauc

SEQ ID NO: 169057 - RNA, 24 nt, Human
gcauggugacucauaccuguaauc

SEQ ID NO: 169058 - RNA, 32 nt, Human
gcauggugagacuccuaaaaugacaggaguuu

SEQ ID NO: 169059 - RNA, 32 nt, Human
gcauggugcacacgccuguaaucccagcuacu

SEQ ID NO: 169060 - RNA, 32 nt, Human
gcauggugcauggucugugcugccuucugccu

SEQ ID NO: 169061 - RNA, 32 nt, Human
gcauggugcgggcaccuguaguccuagcuauc

SEQ ID NO: 169062 - RNA, 32 nt, Human
gcaugguggagcugggcuguggucuggggcag

SEQ ID NO: 169063 - RNA, 32 nt, Human
gcaugguggaguagaggagaaaucuuggcuca

SEQ ID NO: 169064 - RNA, 24 nt, Human
gcaugguggcacacaccuguaauc

SEQ ID NO: 169065 - RNA, 32 nt, Human
gcaugguggcacgcucuguaaucccaaauacg

SEQ ID NO: 169066 - RNA, 24 nt, Human
gcaugguggcccacgccuguaauc

SEQ ID NO: 169067 - RNA, 32 nt, Human
gcaugguggccuugacuaaguuuauggcgaca

SEQ ID NO: 169068 - RNA, 24 nt, Human
gcaugguggcgcacaccuauaauc

SEQ ID NO: 169069 - RNA, 24 nt, Human
gcaugguggcgcacaccuguaauc

SEQ ID NO: 169070 - RNA, 24 nt, Human
gcaugguggcucacaccgguaauc

SEQ ID NO: 169071 - RNA, 24 nt, Human
gcaugguggcucacaccuauaauc

SEQ ID NO: 169072 - RNA, 24 nt, Human
gcaugguggcucacaccuguaauc

SEQ ID NO: 169073 - RNA, 24 nt, Human
gcaugguggcucacaccuguaauu

SEQ ID NO: 169074 - RNA, 24 nt, Human
gcaugguggcucacaccugugauc

SEQ ID NO: 169075 - RNA, 24 nt, Human
gcaugguggcucacacguguaauc

SEQ ID NO: 169076 - RNA, 24 nt, Human
gcaugguggcucacacuuauaauc

SEQ ID NO: 169077 - RNA, 22 nt, Human
gcaugguggcucaccccuguaa

SEQ ID NO: 169078 - RNA, 24 nt, Human
gcaugguggcucacgcccguaauc

SEQ ID NO: 169079 - RNA, 22 nt, Human
gcaugguggcucacgccuguaa

SEQ ID NO: 169080 - RNA, 32 nt, Human
gcaugguggcucacgccuguaaccucagcacu

SEQ ID NO: 169081 - RNA, 24 nt, Human
gcaugguggcucacgccuguaauc

SEQ ID NO: 169082 - RNA, 24 nt, Human
gcaugguggcucauaccuguaauc

SEQ ID NO: 169083 - RNA, 32 nt, Human
gcaugguggcucaugcacaccuguaaucccaa

SEQ ID NO: 169084 - RNA, 32 nt, Human
gcaugguggugcauccuguaaucauagcuacu

SEQ ID NO: 169085 - RNA, 32 nt, Human
gcaugguguccaccugccugcugaccacugga

SEQ ID NO: 169086 - RNA, 29 nt, Human
gcauggugucugugugauguugguguguu

SEQ ID NO: 169087 - RNA, 32 nt, Human
gcaugguguuggcuggcaugcccaucagcuga

SEQ ID NO: 169088 - RNA, 32 nt, Human
gcaugguuaaacagugcuccauucucucucca

SEQ ID NO: 169089 - RNA, 32 nt, Human
gcaugguucuccuggcaggccugcugugugcc

SEQ ID NO: 169090 - RNA, 32 nt, Human
gcaugguugccuggcuaccugcucaugaggga

SEQ ID NO: 169091 - RNA, 32 nt, Human
gcaugguuuaaucccuucuuuacacuugugua

SEQ ID NO: 169092 - RNA, 32 nt, Human
gcauguaaaucaggaacaacuuucuccuuauu

SEQ ID NO: 169093 - RNA, 32 nt, Human
gcauguaauuccagugacuuacuaugugagau

SEQ ID NO: 169094 - RNA, 32 nt, Human
gcauguacagugguuugccauuaggguauucg

SEQ ID NO: 169095 - RNA, 32 nt, Human
gcauguaccaccgcgccuggccugugucuauu

SEQ ID NO: 169096 - RNA, 32 nt, Human
gcauguaccugauuucagcugugucaccaccc

SEQ ID NO: 169097 - RNA, 32 nt, Human
gcauguacuccccucauccgauuccccucuau

SEQ ID NO: 169098 - RNA, 32 nt, Human
gcauguacucugguuucaacagacacaaauuu

SEQ ID NO: 169099 - RNA, 32 nt, Human
gcauguacuuguauacauacaacaguaugucu

SEQ ID NO: 169100 - RNA, 32 nt, Human
gcauguagagcaauugucccaaugccacuugc

SEQ ID NO: 169101 - RNA, 32 nt, Human
gcauguagcucauucugcucagccucuggcgc

SEQ ID NO: 169102 - RNA, 32 nt, Human
gcauguaguaagccagaaaauauucaaagaga

SEQ ID NO: 169103 - RNA, 23 nt, Human
gcauguagucccaacuacucagg

SEQ ID NO: 169104 - RNA, 32 nt, Human
gcauguauaauagauuucuccucuuccugccc

SEQ ID NO: 169105 - RNA, 32 nt, Human
gcauguauaauagguuucuccucuuccugccc

SEQ ID NO: 169106 - RNA, 32 nt, Human
gcauguaugaacacacaugcuugucggaacgc

SEQ ID NO: 169107 - RNA, 32 nt, Human
gcauguaugcacacacacagggguuaaccacc

SEQ ID NO: 169108 - RNA, 32 nt, Human
gcauguauuggucagaaagaaaaagaaagaaa

SEQ ID NO: 169109 - RNA, 18 nt, Human
gcauguauuuccauggcc

SEQ ID NO: 169110 - RNA, 32 nt, Human
gcaugucacagcaaggacugccgcauugguga

SEQ ID NO: 169111 - RNA, 22 nt, Human
gcaugucacaugugaccauguu

SEQ ID NO: 169112 - RNA, 32 nt, Human
gcaugucaccacugcccucacagucgaggccu

SEQ ID NO: 169113 - RNA, 32 nt, Human
gcaugucaugucugauagcucuuuggauuuac

SEQ ID NO: 169114 - RNA, 32 nt, Human
gcauguccaguaugcuuugcaggguguguuug

SEQ ID NO: 169115 - RNA, 32 nt, Human
gcauguccccugcuugaacacugaagggcagg

SEQ ID NO: 169116 - RNA, 32 nt, Human
gcaugucccuucccuuccccagcccugccagg

SEQ ID NO: 169117 - RNA, 32 nt, Human
gcauguccucccucugucccucuuguggugcu

SEQ ID NO: 169118 - RNA, 32 nt, Human
gcaugucucucaugccaagaaccaagaucgga

SEQ ID NO: 169119 - RNA, 32 nt, Human
gcaugucugcaaacccagcuacucgggaggcu

SEQ ID NO: 169120 - RNA, 32 nt, Human
gcaugucugccuggagugcugugcuguguuua

SEQ ID NO: 169121 - RNA, 24 nt, Human
gcaugucuggagggaccugaggca

SEQ ID NO: 169122 - RNA, 32 nt, Human
gcaugucuguaaucccagcuacucgggaggcu

SEQ ID NO: 169123 - RNA, 32 nt, Human
gcaugucuguaaucccagcuacuggggaagcu

SEQ ID NO: 169124 - RNA, 32 nt, Human
gcaugucuguaaucccagcuacuggggaggcu

SEQ ID NO: 169125 - RNA, 32 nt, Human
gcaugucuguagucacagcuacucagggaggu

SEQ ID NO: 169126 - RNA, 19 nt, Human
gcaugucuuugccaugggc

SEQ ID NO: 169127 - RNA, 32 nt, Human
gcaugugaacaggguuucuguuuaccauguca

SEQ ID NO: 169128 - RNA, 32 nt, Human
gcaugugaaccaaaugauuguauuccauuaua

SEQ ID NO: 169129 - RNA, 32 nt, Human
gcaugugaagugagugggugagcacggacucc

SEQ ID NO: 169130 - RNA, 32 nt, Human
gcaugugagcaucugcccagcaaccuguggag

SEQ ID NO: 169131 - RNA, 32 nt, Human
gcaugugaucccucccuccuucugaccucuua

SEQ ID NO: 169132 - RNA, 32 nt, Human
gcaugugcacacacaaaccuccaggcuaucac

SEQ ID NO: 169133 - RNA, 32 nt, Human
gcaugugcacacacacucaaacauguacacac

SEQ ID NO: 169134 - RNA, 18 nt, Human
gcaugugcaccaaagcca

SEQ ID NO: 169135 - RNA, 32 nt, Human
gcaugugcacuucgggaagcaggccugcaucu

SEQ ID NO: 169136 - RNA, 32 nt, Human
gcaugugcaggaaaugacaaauuuguauguca

SEQ ID NO: 169137 - RNA, 23 nt, Human
gcaugugcagucccagcuacuca

SEQ ID NO: 169138 - RNA, 32 nt, Human
gcaugugccagccuccacaacgucugcguccc

SEQ ID NO: 169139 - RNA, 32 nt, Human
gcaugugccaggaguuugaggcugcagugcac

SEQ ID NO: 169140 - RNA, 32 nt, Human
gcaugugcccagccccuccaccaccaggggca

SEQ ID NO: 169141 - RNA, 32 nt, Human
gcaugugccgucuggacuuccaccuccagugc

SEQ ID NO: 169142 - RNA, 32 nt, Human
gcaugugccuaugugggugacccuguggaagu

SEQ ID NO: 169143 - RNA, 32 nt, Human
gcaugugccugaccagguagaaacugaaagca

SEQ ID NO: 169144 - RNA, 22 nt, Human
gcaugugccuguaaucccagcu

SEQ ID NO: 169145 - RNA, 32 nt, Human
gcaugugccuguaaucccagcuauuuggcagg

SEQ ID NO: 169146 - RNA, 32 nt, Human
gcaugugccuguaaucccagcuucuugggaag

SEQ ID NO: 169147 - RNA, 32 nt, Human
gcaugugccuguaaucccaguuacuggggagg

SEQ ID NO: 169148 - RNA, 22 nt, Human
gcaugugccuguaauuccagcu

SEQ ID NO: 169149 - RNA, 32 nt, Human
gcaugugccuguaauuccagcuacucgggagg

SEQ ID NO: 169150 - RNA, 32 nt, Human
gcaugugccuguagucccagcuacucuggagu

SEQ ID NO: 169151 - RNA, 32 nt, Human
gcaugugccuguagucccagcuacuugggagg

SEQ ID NO: 169152 - RNA, 32 nt, Human
gcaugugcguuuuccugagaagugaaugaguc

SEQ ID NO: 169153 - RNA, 32 nt, Human
gcaugugcugugggcccugccggcgccugagu

SEQ ID NO: 169154 - RNA, 32 nt, Human
gcauguggacacucagucacauuaacaacuug

SEQ ID NO: 169155 - RNA, 24 nt, Human
gcauguggaucaccugaggucagg

SEQ ID NO: 169156 - RNA, 32 nt, Human
gcauguggcucacgccuauaaucccaacaguu

SEQ ID NO: 169157 - RNA, 32 nt, Human
gcauguggcucaugccugcaaucccagcacuu

SEQ ID NO: 169158 - RNA, 32 nt, Human
gcauguggcuucauuauacugagccauguguc

SEQ ID NO: 169159 - RNA, 32 nt, Human
gcaugugggaagggagcaggagggccuggcug

SEQ ID NO: 169160 - RNA, 32 nt, Human
gcaugugggaggcugaggauggagcugggaac

SEQ ID NO: 169161 - RNA, 17 nt, Human
gcaugugggcaggggga

SEQ ID NO: 169162 - RNA, 32 nt, Human
gcauguggugauccugccagggccaggugggg

SEQ ID NO: 169163 - RNA, 32 nt, Human
gcauguguauauguucgugugugaaauguagg

SEQ ID NO: 169164 - RNA, 32 nt, Human
gcaugugucaaugucauaacugucuuuauacg

SEQ ID NO: 169165 - RNA, 19 nt, Human
gcaugugugaaaggggguu

SEQ ID NO: 169166 - RNA, 32 nt, Human
gcaugugugagcacccagcuacuggggacggg

SEQ ID NO: 169167 - RNA, 32 nt, Human
gcaugugugauggggaaggagcagucucccag

SEQ ID NO: 169168 - RNA, 32 nt, Human
gcaugugugcccaggaccggggcagucaccca

SEQ ID NO: 169169 - RNA, 32 nt, Human
gcaugugugccuguaguccaagcuacuugaag

SEQ ID NO: 169170 - RNA, 32 nt, Human
gcauguguguauaagugcacacagaaauauau

SEQ ID NO: 169171 - RNA, 32 nt, Human
gcaugugugugcacucggaccgagcaucuccc

SEQ ID NO: 169172 - RNA, 32 nt, Human
gcauguguguggguguggauguuuauaaacaa

SEQ ID NO: 169173 - RNA, 32 nt, Human
gcaugugugugugaguguguuuguguguuccc

SEQ ID NO: 169174 - RNA, 32 nt, Human
gcauguguguucaugcacacuugcacccaugu

SEQ ID NO: 169175 - RNA, 32 nt, Human
gcauguucagggaugcucauuccaugacucug

SEQ ID NO: 169176 - RNA, 32 nt, Human
gcauguucauguccagaccucggcaguggcgu

SEQ ID NO: 169177 - RNA, 32 nt, Human
gcauguuccuggcaaggagcacauaccaucaa

SEQ ID NO: 169178 - RNA, 32 nt, Human
gcauguuccuguuucagccucugccuuuccac

SEQ ID NO: 169179 - RNA, 32 nt, Human
gcauguucggcaccugucugugccucuggcac

SEQ ID NO: 169180 - RNA, 32 nt, Human
gcauguucucauaagugggagcuaaaucauga

SEQ ID NO: 169181 - RNA, 32 nt, Human
gcauguucuccaggaggccaggccgggguugc

SEQ ID NO: 169182 - RNA, 23 nt, Human
gcauguucucucuguuguuggag

SEQ ID NO: 169183 - RNA, 32 nt, Human
gcauguugagccaggccugggucugugucucu

SEQ ID NO: 169184 - RNA, 27 nt, Human
gcauguugcaguguccaucaguagaag

SEQ ID NO: 169185 - RNA, 32 nt, Human
gcauguugcauccugaauucacagaaguuuag

SEQ ID NO: 169186 - RNA, 32 nt, Human
gcauguugcccuguugcugccugcccuauucu

SEQ ID NO: 169187 - RNA, 32 nt, Human
gcauguugccuagcauuuuauagauauuuauu

SEQ ID NO: 169188 - RNA, 32 nt, Human
gcauguugcuguacugaauacucuaagcaauu

SEQ ID NO: 169189 - RNA, 32 nt, Human
gcauguuggagacugagcugggugcacuggcc

SEQ ID NO: 169190 - RNA, 19 nt, Human
gcauguuggggaccaggag

SEQ ID NO: 169191 - RNA, 32 nt, Human
gcauguuggucuuuuaagucuguuuugcucua

SEQ ID NO: 169192 - RNA, 32 nt, Human
gcauguuguuguugaaguguggaguuguaacu

SEQ ID NO: 169193 - RNA, 32 nt, Human
gcauguuuacugccacuggccuagaggagaca

SEQ ID NO: 169194 - RNA, 32 nt, Human
gcauguuuccagcagaagacaaaaagacaaac

SEQ ID NO: 169195 - RNA, 32 nt, Human
gcauguuuggggucagucaguguuggagagcc

SEQ ID NO: 169196 - RNA, 32 nt, Human
gcauguuuucucccucaauccaaggcacuggg

SEQ ID NO: 169197 - RNA, 32 nt, Human
gcauuaaaagaaugugcuuucucagauuaagg

SEQ ID NO: 169198 - RNA, 32 nt, Human
gcauuaaaggugccaugaaagguagacucuga

SEQ ID NO: 169199 - RNA, 32 nt, Human
gcauuaaauaauugagaacuguuucuucaaaa

SEQ ID NO: 169200 - RNA, 32 nt, Human
gcauuaaauauauguuguguaugaaguaucuc

SEQ ID NO: 169201 - RNA, 32 nt, Human
gcauuaaaucagauacaacucagcauuaaaaa

SEQ ID NO: 169202 - RNA, 32 nt, Human
gcauuaacaaaacauuuuccuccuucauauau

SEQ ID NO: 169203 - RNA, 32 nt, Human
gcauuaacauguaagaacaugugccucagaca

SEQ ID NO: 169204 - RNA, 18 nt, Human
gcauuaagaagcccagug

SEQ ID NO: 169205 - RNA, 32 nt, Human
gcauuaaguggggcuuaucuuugguuuggagu

SEQ ID NO: 169206 - RNA, 32 nt, Human
gcauuaauagcucuugaguagacuggauggaa

SEQ ID NO: 169207 - RNA, 32 nt, Human
gcauuaaucuaugccuuuuauucucaaacuaa

SEQ ID NO: 169208 - RNA, 32 nt, Human
gcauuaauucaccaaugcauuuggacaacuug

SEQ ID NO: 169209 - RNA, 32 nt, Human
gcauuacaaagauggauguucuucaguuccua

SEQ ID NO: 169210 - RNA, 32 nt, Human
gcauuacaaugagcuaaugcuccagaucccag

SEQ ID NO: 169211 - RNA, 32 nt, Human
gcauuacaggcaugugucaccaugcccggcua

SEQ ID NO: 169212 - RNA, 32 nt, Human
gcauuacaggcgcccaccaccacgcucggcua

SEQ ID NO: 169213 - RNA, 32 nt, Human
gcauuacaggcgccugccaccaccccuggcua

SEQ ID NO: 169214 - RNA, 32 nt, Human
gcauuacauguauuucagaguagguccuaggc

SEQ ID NO: 169215 - RNA, 32 nt, Human
gcauuacauuccauccagccugggcgacaaga

SEQ ID NO: 169216 - RNA, 32 nt, Human
gcauuaccacuguuagcaaauauuucaugaua

SEQ ID NO: 169217 - RNA, 22 nt, Human
gcauuacccaccauuguagcca

SEQ ID NO: 169218 - RNA, 32 nt, Human
gcauuacccacuguucucugucacaagcauca

SEQ ID NO: 169219 - RNA, 32 nt, Human
gcauuacccgccauuuucaucuuugccagucc

SEQ ID NO: 169220 - RNA, 32 nt, Human
gcauuaccuagguccaucaucauguaccaagc

SEQ ID NO: 169221 - RNA, 32 nt, Human
gcauuaccucugugauacagcucucaacagac

SEQ ID NO: 169222 - RNA, 32 nt, Human
gcauuaccugggcaguggacccugccgaggcu

SEQ ID NO: 169223 - RNA, 32 nt, Human
gcauuacucugccuaaccacuguguguaccau

SEQ ID NO: 169224 - RNA, 32 nt, Human
gcauuacugcacuccagccuggguaacagagu

SEQ ID NO: 169225 - RNA, 32 nt, Human
gcauuacugcugcuucugcauugcuccgcgcu

SEQ ID NO: 169226 - RNA, 32 nt, Human
gcauuagaaaaauugaaacuccuguguggaga

SEQ ID NO: 169227 - RNA, 32 nt, Human
gcauuagaaauguuuagcuuuguaugaacuga

SEQ ID NO: 169228 - RNA, 19 nt, Human
gcauuagaagcugccacca

SEQ ID NO: 169229 - RNA, 32 nt, Human
gcauuagagauccagcacauucucaguacugu

SEQ ID NO: 169230 - RNA, 32 nt, Human
gcauuagaggaguccucacccacccaccuccu

SEQ ID NO: 169231 - RNA, 32 nt, Human
gcauuagaguaugaauuuagcauugggaaaag

SEQ ID NO: 169232 - RNA, 32 nt, Human
gcauuagagucaguucuggcucugccuagcug

SEQ ID NO: 169233 - RNA, 32 nt, Human
gcauuagaucacacccuuuaguccaucacauu

SEQ ID NO: 169234 - RNA, 32 nt, Human
gcauuagauuccuuuccugugugaagaaagcc

SEQ ID NO: 169235 - RNA, 32 nt, Human
gcauuagcaggaaugcaaaaagaaauggaaca

SEQ ID NO: 169236 - RNA, 32 nt, Human
gcauuagcauuagcagcaccuaaguccucauu

SEQ ID NO: 169237 - RNA, 32 nt, Human
gcauuagcucacugcagucuccaccuccugag

SEQ ID NO: 169238 - RNA, 32 nt, Human
gcauuagcugcuuccuccccuccuggcaccca

SEQ ID NO: 169239 - RNA, 32 nt, Human
gcauuaggaagaaaggagcuccccguaaucgu

SEQ ID NO: 169240 - RNA, 32 nt, Human
gcauuagggccaccuccauggccccagacaga

SEQ ID NO: 169241 - RNA, 32 nt, Human
gcauuaguuuagaucaacucaaggaguauuua

SEQ ID NO: 169242 - RNA, 32 nt, Human
gcauuauaagugaccuuauuucugcuuuucug

SEQ ID NO: 169243 - RNA, 32 nt, Human
gcauuauacaauacaauuuguuucuauuuuga

SEQ ID NO: 169244 - RNA, 32 nt, Human
gcauuauacuccauaccugcuuuucccauggc

SEQ ID NO: 169245 - RNA, 32 nt, Human
gcauuauaggugcccaccaccaugccuggcug

SEQ ID NO: 169246 - RNA, 19 nt, Human
gcauuauccucucuuacaa

SEQ ID NO: 169247 - RNA, 32 nt, Human
gcauuaucugcagaagagaaacucaugucaug

SEQ ID NO: 169248 - RNA, 32 nt, Human
gcauuaugaaagucaacagcucuuuccccuca

SEQ ID NO: 169249 - RNA, 32 nt, Human
gcauuaugucuguugcucacagaugcagagac

SEQ ID NO: 169250 - RNA, 32 nt, Human
gcauuauguguauggccugaaguguuggacuu

SEQ ID NO: 169251 - RNA, 32 nt, Human
gcauuauucuccagccuuaagaucuuaggacg

SEQ ID NO: 169252 - RNA, 32 nt, Human
gcauucaaaaauguguaaaaaugaguaaauac

SEQ ID NO: 169253 - RNA, 32 nt, Human
gcauucaaaccucacauccucccuucaguuua

SEQ ID NO: 169254 - RNA, 22 nt, Human
gcauucacccccagucacaaug

SEQ ID NO: 169255 - RNA, 32 nt, Human
gcauucacccuugggcugcagauaguaauaua

SEQ ID NO: 169256 - RNA, 32 nt, Human
gcauucaccuugccaucugucuugucauugua

SEQ ID NO: 169257 - RNA, 32 nt, Human
gcauucacuuaauaaagacacuguuaagcacu

SEQ ID NO: 169258 - RNA, 32 nt, Human
gcauucagagaagagucaggaaaacaauugua

SEQ ID NO: 169259 - RNA, 32 nt, Human
gcauucagagcaucagagcaaguaccauggca

SEQ ID NO: 169260 - RNA, 32 nt, Human
gcauucagaucccugccucucugccuuaaaaa

SEQ ID NO: 169261 - RNA, 32 nt, Human
gcauucagaugugagcucaucaacauugaacc

SEQ ID NO: 169262 - RNA, 32 nt, Human
gcauucaggcuucucagguguuucuagacccc

SEQ ID NO: 169263 - RNA, 32 nt, Human
gcauucagguggccaaguauuugcauuuccuu

SEQ ID NO: 169264 - RNA, 32 nt, Human
gcauucagguucuaaauggcuucuaagaaguu

SEQ ID NO: 169265 - RNA, 22 nt, Human
gcauucaguugacuuucagggu

SEQ ID NO: 169266 - RNA, 32 nt, Human
gcauucaucucacagccacuugcccacagagu

SEQ ID NO: 169267 - RNA, 31 nt, Human
gcauucauggcugaaguggaggaucaggcag

SEQ ID NO: 169268 - RNA, 32 nt, Human
gcauucauguuucuccccaccuuauccccauc

SEQ ID NO: 169269 - RNA, 32 nt, Human
gcauucauucucuccaccaggccuccaggucc

SEQ ID NO: 169270 - RNA, 32 nt, Human
gcauucauuuuuaucugccccuuuaucagacc

SEQ ID NO: 169271 - RNA, 32 nt, Human
gcauucauuuuuccucacuuuaagucucuccc

SEQ ID NO: 169272 - RNA, 32 nt, Human
gcauuccaccuucccccuuucucccccacugc

SEQ ID NO: 169273 - RNA, 32 nt, Human
gcauuccacugugccagcacucuacauucagu

SEQ ID NO: 169274 - RNA, 32 nt, Human
gcauuccagacugggcgacagagcaagacucu

SEQ ID NO: 169275 - RNA, 32 nt, Human
gcauuccagagaugcacuccgcucuggaacuc

SEQ ID NO: 169276 - RNA, 32 nt, Human
gcauuccagccagcagggcagucucagugugg

SEQ ID NO: 169277 - RNA, 32 nt, Human
gcauuccagccaggaugacagagcaagacugc

SEQ ID NO: 169278 - RNA, 32 nt, Human
gcauuccagccuggcgacagagcaagacucca

SEQ ID NO: 169279 - RNA, 24 nt, Human
gcauuccagccugggcaacaagag

SEQ ID NO: 169280 - RNA, 32 nt, Human
gcauuccagccuggugacagagcgagacucag

SEQ ID NO: 169281 - RNA, 32 nt, Human
gcauucccagggggaccagcagcuacccaagg

SEQ ID NO: 169282 - RNA, 32 nt, Human
gcauucccagugccuggccgaaacugaggcug

SEQ ID NO: 169283 - RNA, 32 nt, Human
gcauucccaugaacauccagggccaggugugg

SEQ ID NO: 169284 - RNA, 32 nt, Human
gcauuccccacacaacacccacacucagccac

SEQ ID NO: 169285 - RNA, 32 nt, Human
gcauucccgacaccuggugcccuauaccagcc

SEQ ID NO: 169286 - RNA, 32 nt, Human
gcauucccucaccucuaccuuuuuauccuucc

SEQ ID NO: 169287 - RNA, 32 nt, Human
gcauucccugcaggaccucccgggucaggcag

SEQ ID NO: 169288 - RNA, 23 nt, Human
gcauuccgcagcccccaccccca

SEQ ID NO: 169289 - RNA, 32 nt, Human
gcauuccucccacccuggccucccagagugcu

SEQ ID NO: 169290 - RNA, 32 nt, Human
gcauuccucccaggacaccauuugucacgcuu

SEQ ID NO: 169291 - RNA, 23 nt, Human
gcauuccugacccaagaaagacu

SEQ ID NO: 169292 - RNA, 32 nt, Human
gcauuccugagaaagagggccacucuaccucu

SEQ ID NO: 169293 - RNA, 32 nt, Human
gcauuccugccuguaagucuucccaagacaga

SEQ ID NO: 169294 - RNA, 32 nt, Human
gcauuccugcugcuacagccuauuugcugagu

SEQ ID NO: 169295 - RNA, 32 nt, Human
gcauuccuggcuuguugguccacauuuaugau

SEQ ID NO: 169296 - RNA, 22 nt, Human
gcauucgaggaggccagaggug

SEQ ID NO: 169297 - RNA, 32 nt, Human
gcauucgcugccgaaaugagcaacuccauuca

SEQ ID NO: 169298 - RNA, 32 nt, Human
gcauucggagugagcugguggagccagacaga

SEQ ID NO: 169299 - RNA, 32 nt, Human
gcauucggcuguggcccuagagcagagcauug

SEQ ID NO: 169300 - RNA, 32 nt, Human
gcauucggcuuccuuggagcagccucuucugg

SEQ ID NO: 169301 - RNA, 19 nt, Human
gcauucgguggacaccaug

SEQ ID NO: 169302 - RNA, 32 nt, Human
gcauucguggggaauggacgccagcagaguug

SEQ ID NO: 169303 - RNA, 32 nt, Human
gcauucuagguagaggagacagccuggacaaa

SEQ ID NO: 169304 - RNA, 32 nt, Human
gcauucucagugccagggcuucaucccuguga

SEQ ID NO: 169305 - RNA, 32 nt, Human
gcauucucauacaaccgaaucucaauguacau

SEQ ID NO: 169306 - RNA, 32 nt, Human
gcauucuccagacucugugcuuuccuaagaua

SEQ ID NO: 169307 - RNA, 32 nt, Human
gcauucuccccagcaugucucuuccagcuuaa

SEQ ID NO: 169308 - RNA, 32 nt, Human
gcauucuccugccucagccuccagagcaacug

SEQ ID NO: 169309 - RNA, 32 nt, Human
gcauucucgcagccccugcccccgaggcuucu

SEQ ID NO: 169310 - RNA, 32 nt, Human
gcauucucucauucccuuuuccucuauggagc

SEQ ID NO: 169311 - RNA, 32 nt, Human
gcauucucuccucuuugccuuuauguuuuguu

SEQ ID NO: 169312 - RNA, 32 nt, Human
gcauucucugcaggaagaaaguuugaugguau

SEQ ID NO: 169313 - RNA, 32 nt, Human
gcauucucuggagcuuccugagcccaguggga

SEQ ID NO: 169314 - RNA, 32 nt, Human
gcauucucugggaggcaaaggcuggcacugga

SEQ ID NO: 169315 - RNA, 32 nt, Human
gcauucucuuucucaaggauguuccuugcuga

SEQ ID NO: 169316 - RNA, 32 nt, Human
gcauucucuuucucagggguguuccuugcuga

SEQ ID NO: 169317 - RNA, 32 nt, Human
gcauucucuuugcaccuggcgagagggucuga

SEQ ID NO: 169318 - RNA, 32 nt, Human
gcauucugaacaaauaaccauggcuuccaaag

SEQ ID NO: 169319 - RNA, 32 nt, Human
gcauucugaguccucuuugucugccuuuaauu

SEQ ID NO: 169320 - RNA, 32 nt, Human
gcauucugauuaugcugccuucacaaaacacu

SEQ ID NO: 169321 - RNA, 32 nt, Human
gcauucugcccaggcuacguggguucaggcag

SEQ ID NO: 169322 - RNA, 32 nt, Human
gcauucugccccacuuacuaacugccaguucu

SEQ ID NO: 169323 - RNA, 32 nt, Human
gcauucugcccuccugggccccucucucccug

SEQ ID NO: 169324 - RNA, 31 nt, Human
gcauucugccucucuaggaccaugguuaaga

SEQ ID NO: 169325 - RNA, 32 nt, Human
gcauucugcucuucugaugaugcgcugugacc

SEQ ID NO: 169326 - RNA, 32 nt, Human
gcauucugcucuucuuuagauggcuguaaauc

SEQ ID NO: 169327 - RNA, 25 nt, Human
gcauucuggaguccgucugucuugg

SEQ ID NO: 169328 - RNA, 32 nt, Human
gcauucugggcagaggagacagcaaaggucaa

SEQ ID NO: 169329 - RNA, 32 nt, Human
gcauucugucuguccuuuuccuccuuggagcc

SEQ ID NO: 169330 - RNA, 32 nt, Human
gcauucuucaaaaccauuccugauagaguagc

SEQ ID NO: 169331 - RNA, 32 nt, Human
gcauucuugacagacuccuggcugucaguuuc

SEQ ID NO: 169332 - RNA, 32 nt, Human
gcauucuugucccauuccucacuuuacugcaa

SEQ ID NO: 169333 - RNA, 32 nt, Human
gcauucuuuccagcauugugcuuuuucccugg

SEQ ID NO: 169334 - RNA, 32 nt, Human
gcauugaccacgacuaauuucaaaaugcuuuu

SEQ ID NO: 169335 - RNA, 32 nt, Human
gcauugaccauggggcuccaucuaggcucuga

SEQ ID NO: 169336 - RNA, 32 nt, Human
gcauugacuccaggacuccaggcgagggaaga

SEQ ID NO: 169337 - RNA, 32 nt, Human
gcauugacuuccucuuccuagacuugaggccu

SEQ ID NO: 169338 - RNA, 32 nt, Human
gcauugagaacaggacagaucuugacaccaau

SEQ ID NO: 169339 - RNA, 32 nt, Human
gcauugagagaagaggaggagauaccccgugc

SEQ ID NO: 169340 - RNA, 32 nt, Human
gcauugagcacuuuaucucccacgacucagug

SEQ ID NO: 169341 - RNA, 32 nt, Human
gcauugagcugccuccagccugguggcccagc

SEQ ID NO: 169342 - RNA, 32 nt, Human
gcauugagggagcagagauacccauacacaga

SEQ ID NO: 169343 - RNA, 32 nt, Human
gcauugaugucugacugccacuccuuucuuuc

SEQ ID NO: 169344 - RNA, 32 nt, Human
gcauugcacauccgugcagaaaucuuucugac

SEQ ID NO: 169345 - RNA, 32 nt, Human
gcauugcacccagggagcuggaguugagcugu

SEQ ID NO: 169346 - RNA, 32 nt, Human
gcauugcagcccaaaucaggaacgugguaaga

SEQ ID NO: 169347 - RNA, 32 nt, Human
gcauugcagccuggugacagagugagacucca

SEQ ID NO: 169348 - RNA, 32 nt, Human
gcauugcaggcagaaaaggguggccgacguga

SEQ ID NO: 169349 - RNA, 32 nt, Human
gcauugccaaaauugcccaguguauuuuuauu

SEQ ID NO: 169350 - RNA, 32 nt, Human
gcauugccaagugccauaaccaugagcacuac

SEQ ID NO: 169351 - RNA, 32 nt, Human
gcauugccagccggcuguaggcauucagggca

SEQ ID NO: 169352 - RNA, 32 nt, Human
gcauugcccagccugggaaucuuuucuuugug

SEQ ID NO: 169353 - RNA, 32 nt, Human
gcauugcccaggauagcagccuugccuggcuc

SEQ ID NO: 169354 - RNA, 32 nt, Human
gcauugcccgggcuagucucgaacuccugacc

SEQ ID NO: 169355 - RNA, 32 nt, Human
gcauugcccuucgggcuggagaugcuuugccg

SEQ ID NO: 169356 - RNA, 32 nt, Human
gcauugccuccuaccagaacuagacagugaau

SEQ ID NO: 169357 - RNA, 32 nt, Human
gcauugccuuaaaucuuauccaguuagaacau

SEQ ID NO: 169358 - RNA, 19 nt, Human
gcauugccuucucugccca

SEQ ID NO: 169359 - RNA, 32 nt, Human
gcauugcuauaaaugaauaccugaggcugagu

SEQ ID NO: 169360 - RNA, 32 nt, Human
gcauugcugccaccccagguccaccugucucc

SEQ ID NO: 169361 - RNA, 32 nt, Human
gcauugcuucuguaaaugcaggcgcaguuugu

SEQ ID NO: 169362 - RNA, 20 nt, Human
gcauugcuugagguugccca

SEQ ID NO: 169363 - RNA, 32 nt, Human
gcauugcuugggcacugucugugugcagguca

SEQ ID NO: 169364 - RNA, 32 nt, Human
gcauugcuuuccucugagcuuuaguggguccu

SEQ ID NO: 169365 - RNA, 32 nt, Human
gcauuggaaauuucaaacuuuggaggaaucuu

SEQ ID NO: 169366 - RNA, 32 nt, Human
gcauuggacccgaaaugagggagcccagcugg

SEQ ID NO: 169367 - RNA, 16 nt, Human
gcauuggagagaagcc

SEQ ID NO: 169368 - RNA, 32 nt, Human
gcauuggagcagcagucccucacuuugaaacc

SEQ ID NO: 169369 - RNA, 32 nt, Human
gcauuggcacuuccugagcaagcaucauuuua

SEQ ID NO: 169370 - RNA, 32 nt, Human
gcauuggcaggcugggugaaaaugagaaagau

SEQ ID NO: 169371 - RNA, 32 nt, Human
gcauuggcucagaaguagagggagaagaggaa

SEQ ID NO: 169372 - RNA, 22 nt, Human
gcauuggcucaugucuguaauc

SEQ ID NO: 169373 - RNA, 32 nt, Human
gcauuggcuugucugccgcaggcacagaaggg

SEQ ID NO: 169374 - RNA, 32 nt, Human
gcauugggcuaaacucuugacaagcaccaucu

SEQ ID NO: 169375 - RNA, 32 nt, Human
gcauuggggguguggaggccgagccagggccc

SEQ ID NO: 169376 - RNA, 32 nt, Human
gcauugggguuccucagauguccucuuugcac

SEQ ID NO: 169377 - RNA, 32 nt, Human
gcauugggguuccucuguacagcaagauguuu

SEQ ID NO: 169378 - RNA, 32 nt, Human
gcauugguauauacgugccauggugguuugcu

SEQ ID NO: 169379 - RNA, 31 nt, Human
gcauuggucacagaagucuucuucuguguug

SEQ ID NO: 169380 - RNA, 32 nt, Human
gcauuggugaauucauacaggagagaaaccuu

SEQ ID NO: 169381 - RNA, 32 nt, Human
gcauuggugcaaucuuggcucacuacaaccuc

SEQ ID NO: 169382 - RNA, 32 nt, Human
gcauugguguuuuucagaugaaagagaaaucc

SEQ ID NO: 169383 - RNA, 32 nt, Human
gcauugguucugacauucauuguaaaucagug

SEQ ID NO: 169384 - RNA, 32 nt, Human
gcauugguucugcuguagccucggugaccauu

SEQ ID NO: 169385 - RNA, 32 nt, Human
gcauugguuuuccaguccuguuaaaaguuuag

SEQ ID NO: 169386 - RNA, 32 nt, Human
gcauuguacaaccuugaaucacuugagcaugu

SEQ ID NO: 169387 - RNA, 32 nt, Human
gcauuguagccaguagggcuucugagcaggcu

SEQ ID NO: 169388 - RNA, 32 nt, Human
gcauuguagccugggcaacagagcaagacccu

SEQ ID NO: 169389 - RNA, 32 nt, Human
gcauuguauuccaaacguguuuacagguucuc

SEQ ID NO: 169390 - RNA, 32 nt, Human
gcauugucagcccuauacuguggucuuaauaa

SEQ ID NO: 169391 - RNA, 32 nt, Human
gcauugucgcugcagccaacuuugccauuaaa

SEQ ID NO: 169392 - RNA, 32 nt, Human
gcauugucuuccaguaucuacagcuucagaac

SEQ ID NO: 169393 - RNA, 23 nt, Human
gcauugugauggaaauacucuua

SEQ ID NO: 169394 - RNA, 32 nt, Human
gcauugugcccaggcuagggggcuauagaaac

SEQ ID NO: 169395 - RNA, 22 nt, Human
gcauugugcucagccgaagaga

SEQ ID NO: 169396 - RNA, 32 nt, Human
gcauuguggaacauuucuuuaccuucaaaguu

SEQ ID NO: 169397 - RNA, 32 nt, Human
gcauuguucagaaacugucgaccagaguuaga

SEQ ID NO: 169398 - RNA, 32 nt, Human
gcauuguuccagccuuggcugccugcauccag

SEQ ID NO: 169399 - RNA, 32 nt, Human
gcauuguugguaucaagguggucugguugagu

SEQ ID NO: 169400 - RNA, 32 nt, Human
gcauuuaacuucuuguuaggauucagggaagg

SEQ ID NO: 169401 - RNA, 32 nt, Human
gcauuuaagccuuuggaaaaauguuugucauu

SEQ ID NO: 169402 - RNA, 32 nt, Human
gcauuuaaggagcauuuaaaaauauguauaua

SEQ ID NO: 169403 - RNA, 32 nt, Human
gcauuuacaaaagcacacagguguuuagaaaa

SEQ ID NO: 169404 - RNA, 32 nt, Human
gcauuuacacacagcacacuccagcucugcca

SEQ ID NO: 169405 - RNA, 32 nt, Human
gcauuuacccccagcuccuugagggggugagg

SEQ ID NO: 169406 - RNA, 32 nt, Human
gcauuuacucucaucaaacgccugcagucuga

SEQ ID NO: 169407 - RNA, 32 nt, Human
gcauuuagagaguguguugucuuccagaguca

SEQ ID NO: 169408 - RNA, 32 nt, Human
gcauuuagccugggcgacagagcgagaccuug

SEQ ID NO: 169409 - RNA, 32 nt, Human
gcauuuagcugaucucuuaccccugguauuuc

SEQ ID NO: 169410 - RNA, 32 nt, Human
gcauuuaggccaugcugugcucuacuucauug

SEQ ID NO: 169411 - RNA, 32 nt, Human
gcauuuaggggcuuucaggaauuuaguaaaag

SEQ ID NO: 169412 - RNA, 32 nt, Human
gcauuuaggucuggaugcaguggcucaugcuu

SEQ ID NO: 169413 - RNA, 32 nt, Human
gcauuuaguagcuucaguuucuuuugaauaca

SEQ ID NO: 169414 - RNA, 32 nt, Human
gcauuuaguggugguagaaaugauucaccagg

SEQ ID NO: 169415 - RNA, 31 nt, Human
gcauuuaucaauaaaagccuuugaaaauacu

SEQ ID NO: 169416 - RNA, 32 nt, Human
gcauuuaucagcugccgcuuauucauugccuu

SEQ ID NO: 169417 - RNA, 32 nt, Human
gcauuuauccugcugaucaguucuuagcuaag

SEQ ID NO: 169418 - RNA, 32 nt, Human
gcauuuaucuuucuggcuccuaauuccuuuaa

SEQ ID NO: 169419 - RNA, 17 nt, Human
gcauuucacaaucccuu

SEQ ID NO: 169420 - RNA, 17 nt, Human
gcauuucacccugcucc

SEQ ID NO: 169421 - RNA, 17 nt, Human
gcauuucagcaaaguca

SEQ ID NO: 169422 - RNA, 32 nt, Human
gcauuucagcagcuccacugggaugcucuaac

SEQ ID NO: 169423 - RNA, 32 nt, Human
gcauuucaucacucuugacauguucuucaauc

SEQ ID NO: 169424 - RNA, 32 nt, Human
gcauuucaugaaacaacacauucuuccagcug

SEQ ID NO: 169425 - RNA, 32 nt, Human
gcauuuccagggacuguggccauaccuuaugu

SEQ ID NO: 169426 - RNA, 32 nt, Human
gcauuucccgaaggccgacaccacuccugcca

SEQ ID NO: 169427 - RNA, 32 nt, Human
gcauuuccugugacccaggaggucugguguag

SEQ ID NO: 169428 - RNA, 32 nt, Human
gcauuuccuuaucuauggauaaggagaucuga

SEQ ID NO: 169429 - RNA, 32 nt, Human
gcauuuccuuuccaauugaauuaaaguguggc

SEQ ID NO: 169430 - RNA, 32 nt, Human
gcauuucggugcuucccuuucacugaagugaa

SEQ ID NO: 169431 - RNA, 32 nt, Human
gcauuucuaccccauccagaacauucuuggaa

SEQ ID NO: 169432 - RNA, 22 nt, Human
gcauuucucaaaauggagccuc

SEQ ID NO: 169433 - RNA, 32 nt, Human
gcauuucucagcugggcaguaaucaauuuaau

SEQ ID NO: 169434 - RNA, 32 nt, Human
gcauuucucccaggacuuggggguggggugaa

SEQ ID NO: 169435 - RNA, 32 nt, Human
gcauuucuccgugcguccucccugcacugaaa

SEQ ID NO: 169436 - RNA, 32 nt, Human
gcauuucucugccucucucuccugccaugucg

SEQ ID NO: 169437 - RNA, 32 nt, Human
gcauuucucugugcugcccuccuggagaaccg

SEQ ID NO: 169438 - RNA, 32 nt, Human
gcauuucugcaaccucuguucuuucugauuuu

SEQ ID NO: 169439 - RNA, 32 nt, Human
gcauuucugcauucgaagaagaaucugagaga

SEQ ID NO: 169440 - RNA, 32 nt, Human
gcauuucugccuggcaacagagcgagacuccg

SEQ ID NO: 169441 - RNA, 32 nt, Human
gcauuucuguucugugcugugcuaagcuauac

SEQ ID NO: 169442 - RNA, 32 nt, Human
gcauuucuucacugcaauugccauuugccuuu

SEQ ID NO: 169443 - RNA, 32 nt, Human
gcauuucuucacuugcaaggggacagagugug

SEQ ID NO: 169444 - RNA, 32 nt, Human
gcauuucuugucucccuguggcuuguuccacu

SEQ ID NO: 169445 - RNA, 32 nt, Human
gcauuugaaagauaccaaccgcacagggaaag

SEQ ID NO: 169446 - RNA, 32 nt, Human
gcauuugaaagcuucuggcugauaaaucucca

SEQ ID NO: 169447 - RNA, 32 nt, Human
gcauuugaaaucuguaugauaaaagauguggc

SEQ ID NO: 169448 - RNA, 32 nt, Human
gcauuugaacuauauuuacugcuccaauaucc

SEQ ID NO: 169449 - RNA, 32 nt, Human
gcauuugaagaaauaguacgacaacuuauuuu

SEQ ID NO: 169450 - RNA, 32 nt, Human
gcauuugaagcagcugcauacuucagaguaaa

SEQ ID NO: 169451 - RNA, 32 nt, Human
gcauuugaauuggaaagagaagagugaagauc

SEQ ID NO: 169452 - RNA, 32 nt, Human
gcauuugacacuuugccaaucugacaagcugc

SEQ ID NO: 169453 - RNA, 32 nt, Human
gcauuugaguccuuauuuggcacagagacgga

SEQ ID NO: 169454 - RNA, 32 nt, Human
gcauuugauuuccaagucagguagaucauugg

SEQ ID NO: 169455 - RNA, 32 nt, Human
gcauuugcaaucagcuaccauucaaaauugcu

SEQ ID NO: 169456 - RNA, 32 nt, Human
gcauuugcagcucggcugaaggccuugagcuu

SEQ ID NO: 169457 - RNA, 25 nt, Human
gcauuugccaacuuacaugcucucc

SEQ ID NO: 169458 - RNA, 32 nt, Human
gcauuugccaagggaggcggauuucccuggua

SEQ ID NO: 169459 - RNA, 32 nt, Human
gcauuugcccagagacagggaaaagaaugccu

SEQ ID NO: 169460 - RNA, 32 nt, Human
gcauuugcccuuucuugccucuugagaccuuc

SEQ ID NO: 169461 - RNA, 32 nt, Human
gcauuugcuuggcugcagccuccuuccgaccu

SEQ ID NO: 169462 - RNA, 32 nt, Human
gcauuuggccacagauaggcaggaggagcuca

SEQ ID NO: 169463 - RNA, 25 nt, Human
gcauuugggagaucauacacagaga

SEQ ID NO: 169464 - RNA, 32 nt, Human
gcauuugggaggaggccucuggacucagugcu

SEQ ID NO: 169465 - RNA, 32 nt, Human
gcauuugggcaaugaggaaggaaagguuucaa

SEQ ID NO: 169466 - RNA, 32 nt, Human
gcauuugggucugagaucggcccagcucugac

SEQ ID NO: 169467 - RNA, 32 nt, Human
gcauuugguaacucaaagaaggcuguacagau

SEQ ID NO: 169468 - RNA, 32 nt, Human
gcauuugguaggaagccugaggcaaaaacugc

SEQ ID NO: 169469 - RNA, 32 nt, Human
gcauuuggugccaguucaguggggucuacuca

SEQ ID NO: 169470 - RNA, 32 nt, Human
gcauuugguggggacagcugcagagaagaggc

SEQ ID NO: 169471 - RNA, 32 nt, Human
gcauuuguauuaccuaugaacaaaauuaccug

SEQ ID NO: 169472 - RNA, 19 nt, Human
gcauuugucaacaaaguca

SEQ ID NO: 169473 - RNA, 32 nt, Human
gcauuugugucuagcuacacaccgcuaacaaa

SEQ ID NO: 169474 - RNA, 32 nt, Human
gcauuugugugugauguuggauagucauccac

SEQ ID NO: 169475 - RNA, 32 nt, Human
gcauuugugugugauguuggauagucauccau

SEQ ID NO: 169476 - RNA, 32 nt, Human
gcauuuguucacgugccucacagcaggccuuu

SEQ ID NO: 169477 - RNA, 32 nt, Human
gcauuuguuccaggucacacagcuggaaagag

SEQ ID NO: 169478 - RNA, 32 nt, Human
gcauuuguugguuuaucagacucggaaucuau

SEQ ID NO: 169479 - RNA, 32 nt, Human
gcauuuguuucaucuuacaguuggaguucaau

SEQ ID NO: 169480 - RNA, 32 nt, Human
gcauuuuaccauagauuggagugcauccuuag

SEQ ID NO: 169481 - RNA, 32 nt, Human
gcauuuuagugaauuguacaguggguggaaag

SEQ ID NO: 169482 - RNA, 32 nt, Human
gcauuuucacaaagcagcccucuuucaagaag

SEQ ID NO: 169483 - RNA, 32 nt, Human
gcauuuucacauguaccuucaggggguuaucu

SEQ ID NO: 169484 - RNA, 32 nt, Human
gcauuuucagggaccagccccaucacuggcuc

SEQ ID NO: 169485 - RNA, 32 nt, Human
gcauuuucauggcaaguaccccucugccccca

SEQ ID NO: 169486 - RNA, 32 nt, Human
gcauuuucauucucuuagaaauucaaguauuu

SEQ ID NO: 169487 - RNA, 32 nt, Human
gcauuuucccccaagguugaaggugagugguc

SEQ ID NO: 169488 - RNA, 18 nt, Human
gcauuuuccucuucccuu

SEQ ID NO: 169489 - RNA, 18 nt, Human
gcauuuucucaccuggau

SEQ ID NO: 169490 - RNA, 32 nt, Human
gcauuuucuccccucucccucccuccuucucu

SEQ ID NO: 169491 - RNA, 32 nt, Human
gcauuuucuccugugcugaccaaccaaauaau

SEQ ID NO: 169492 - RNA, 32 nt, Human
gcauuuucuggggaauaugacaucccaucuga

SEQ ID NO: 169493 - RNA, 32 nt, Human
gcauuuugaucuguaacugcacaacccugggg

SEQ ID NO: 169494 - RNA, 32 nt, Human
gcauuuugaugaagaagaggauggcuuugagg

SEQ ID NO: 169495 - RNA, 32 nt, Human
gcauuuugggaggcccagaugggagcccagga

SEQ ID NO: 169496 - RNA, 32 nt, Human
gcauuuugggaggcugaggcaaguggauaacu

SEQ ID NO: 169497 - RNA, 32 nt, Human
gcauuuugggagguugaaguggguggaucacc

SEQ ID NO: 169498 - RNA, 32 nt, Human
gcauuuuggucccugcuccuugcccauaguaa

SEQ ID NO: 169499 - RNA, 32 nt, Human
gcauuuuggucuucagcacaaagccuuguucc

SEQ ID NO: 169500 - RNA, 32 nt, Human
gcauuuuguaaaaaugaaaaugugacucacau

SEQ ID NO: 169501 - RNA, 32 nt, Human
gcauuuuguaccaucugcuccccaauggccaa

SEQ ID NO: 169502 - RNA, 32 nt, Human
gcauuuugugggguguuagugccaaacuugaa

SEQ ID NO: 169503 - RNA, 32 nt, Human
gcauuuuguuccuguguuuaauagugaucugu

SEQ ID NO: 169504 - RNA, 22 nt, Human
gcauuuuuaacccuacagugaa

SEQ ID NO: 169505 - RNA, 32 nt, Human
gcauuuuucacucuuaacccgaggguguguuu

SEQ ID NO: 169506 - RNA, 32 nt, Human
gcauuuuucccuuuauugccucauuucuugug

SEQ ID NO: 169507 - RNA, 32 nt, Human
gcauuuuucucuucaauuuccaggguuuccua

SEQ ID NO: 169508 - RNA, 32 nt, Human
gcauuuuucuuuuaaaagacaaguguaauaga

SEQ ID NO: 169509 - RNA, 20 nt, Human
gcauuuuugcaggagcagua

SEQ ID NO: 169510 - RNA, 32 nt, Human
gcauuuuugugaaaugaaaacauguaauaaaa

SEQ ID NO: 169511 - RNA, 20 nt, Human
gccaaaaaauuuggcacuga

SEQ ID NO: 169512 - RNA, 32 nt, Human
gccaaaaagcugcaggcagaggcguugaggac

SEQ ID NO: 169513 - RNA, 32 nt, Human
gccaaaaaucugagucagcuuagaagaguacu

SEQ ID NO: 169514 - RNA, 32 nt, Human
gccaaaaauuacaccagagagacagaguccuc

SEQ ID NO: 169515 - RNA, 32 nt, Human
gccaaaacagaauuuggggcacagcaucuuuu

SEQ ID NO: 169516 - RNA, 32 nt, Human
gccaaaacaugagcuucaacuccaccuccagc

SEQ ID NO: 169517 - RNA, 32 nt, Human
gccaaaacaugaguuucaacuccaccuccagc

SEQ ID NO: 169518 - RNA, 32 nt, Human
gccaaaacccgccgucaucuaaggcugugggu

SEQ ID NO: 169519 - RNA, 32 nt, Human
gccaaaaccuuugaccagagucuccuugccag

SEQ ID NO: 169520 - RNA, 32 nt, Human
gccaaaacuguccucaggucagccucuccagg

SEQ ID NO: 169521 - RNA, 32 nt, Human
gccaaaagucagggaaaggggcacugaccugu

SEQ ID NO: 169522 - RNA, 21 nt, Human
gccaaaauaauguccacuucu

SEQ ID NO: 169523 - RNA, 32 nt, Human
gccaaaaucucuucucccuucucccuccauca

SEQ ID NO: 169524 - RNA, 20 nt, Human
gccaaaaugaaaccuagcaa

SEQ ID NO: 169525 - RNA, 24 nt, Human
gccaaaaugagacucuccgucggc

SEQ ID NO: 169526 - RNA, 20 nt, Human
gccaaaaugagaucugaagc

SEQ ID NO: 169527 - RNA, 31 nt, Human
gccaaaaugucugucaaugucaaccgcagcg

SEQ ID NO: 169528 - RNA, 32 nt, Human
gccaaaauuaagcugugguuucccucugagua

SEQ ID NO: 169529 - RNA, 32 nt, Human
gccaaaauuguccucaggucagccucuccagg

SEQ ID NO: 169530 - RNA, 20 nt, Human
gccaaacaaauccccuuccu

SEQ ID NO: 169531 - RNA, 23 nt, Human
gccaaacacaccgcccccacccc

SEQ ID NO: 169532 - RNA, 20 nt, Human
gccaaacacauuuacccuuu

SEQ ID NO: 169533 - RNA, 19 nt, Human
gccaaacaccuacccagaa

SEQ ID NO: 169534 - RNA, 32 nt, Human
gccaaacaccucagggcaagggccaggcacag

SEQ ID NO: 169535 - RNA, 32 nt, Human
gccaaacacgugcucacccucacacucgcccc

SEQ ID NO: 169536 - RNA, 18 nt, Human
gccaaacacuccaccucu

SEQ ID NO: 169537 - RNA, 26 nt, Human
gccaaacagaauguaacaccccuccc

SEQ ID NO: 169538 - RNA, 21 nt, Human
gccaaacagaccccccacccc

SEQ ID NO: 169539 - RNA, 32 nt, Human
gccaaacagcacaugacacacgacagccacuu

SEQ ID NO: 169540 - RNA, 32 nt, Human
gccaaacagcagaguggagcugagcuguggac

SEQ ID NO: 169541 - RNA, 24 nt, Human
gccaaacaggcccuccucccuccc

SEQ ID NO: 169542 - RNA, 17 nt, Human
gccaaacauccaccuuu

SEQ ID NO: 169543 - RNA, 18 nt, Human
gccaaacaucucaccuuu

SEQ ID NO: 169544 - RNA, 32 nt, Human
gccaaacauggugaaacccugucuacaaaaau

SEQ ID NO: 169545 - RNA, 17 nt, Human
gccaaacauuucacucu

SEQ ID NO: 169546 - RNA, 32 nt, Human
gccaaacccagcccuucucuaaccacccuacu

SEQ ID NO: 169547 - RNA, 32 nt, Human
gccaaaccucuuuuucugcucauaaaggaggu

SEQ ID NO: 169548 - RNA, 32 nt, Human
gccaaaccuggcugucagcugugugggagcca

SEQ ID NO: 169549 - RNA, 32 nt, Human
gccaaaccuugauccauuuugacauuuguuau

SEQ ID NO: 169550 - RNA, 24 nt, Human
gccaaacgaaguggcucccaugug

SEQ ID NO: 169551 - RNA, 32 nt, Human
gccaaacggauuggagacucaccccgcauucu

SEQ ID NO: 169552 - RNA, 20 nt, Human
gccaaacuagacuacaugga

SEQ ID NO: 169553 - RNA, 32 nt, Human
gccaaacuauuggcugaccaagguuuuuaaau

SEQ ID NO: 169554 - RNA, 32 nt, Human
gccaaacucaugcacacacacgcagacacaca

SEQ ID NO: 169555 - RNA, 32 nt, Human
gccaaacuccaaagaccguugcugaugucuuu

SEQ ID NO: 169556 - RNA, 32 nt, Human
gccaaacucuucugucacuaucaguguccauc

SEQ ID NO: 169557 - RNA, 32 nt, Human
gccaaacugcaaaggcugugguggcugugagg

SEQ ID NO: 169558 - RNA, 32 nt, Human
gccaaacuuaaccuuggugggguuuggauuug

SEQ ID NO: 169559 - RNA, 32 nt, Human
gccaaacuucugccacucacacacugcugagu

SEQ ID NO: 169560 - RNA, 32 nt, Human
gccaaagaccacucagaucauggcagugucug

SEQ ID NO: 169561 - RNA, 32 nt, Human
gccaaagagacugggccuaggccaggaguucc

SEQ ID NO: 169562 - RNA, 32 nt, Human
gccaaagagcaucuaccuuaccuccuaagaag

SEQ ID NO: 169563 - RNA, 32 nt, Human
gccaaagagcccagagggacucuaagaaccua

SEQ ID NO: 169564 - RNA, 32 nt, Human
gccaaagagccucccaccagagccgggaggaa

SEQ ID NO: 169565 - RNA, 32 nt, Human
gccaaagaggaagaagaaaguguuaaaaggaa

SEQ ID NO: 169566 - RNA, 32 nt, Human
gccaaagaggggcaguggguugggguuguuuu

SEQ ID NO: 169567 - RNA, 32 nt, Human
gccaaagaugcugcugcuccuaccucacugcc

SEQ ID NO: 169568 - RNA, 23 nt, Human
gccaaagcagcgcacagggugcg

SEQ ID NO: 169569 - RNA, 24 nt, Human
gccaaagcaggacgaucacuugag

SEQ ID NO: 169570 - RNA, 23 nt, Human
gccaaagcaggagaauugcuuga

SEQ ID NO: 169571 - RNA, 24 nt, Human
gccaaagcaggaggauagcuugag

SEQ ID NO: 169572 - RNA, 24 nt, Human
gccaaagcaggaggaucacuugag

SEQ ID NO: 169573 - RNA, 24 nt, Human
gccaaagcaggaggaucgcuugag

SEQ ID NO: 169574 - RNA, 32 nt, Human
gccaaagcagggaaacagggagguguggacaa

SEQ ID NO: 169575 - RNA, 32 nt, Human
gccaaagcaguucacccaauggacaaacucuu

SEQ ID NO: 169576 - RNA, 32 nt, Human
gccaaagccaagccagccccacccuuaagcuu

SEQ ID NO: 169577 - RNA, 32 nt, Human
gccaaagccagccugugcacagauuccaggau

SEQ ID NO: 169578 - RNA, 32 nt, Human
gccaaagccccagccacucuccuuuacugcag

SEQ ID NO: 169579 - RNA, 22 nt, Human
gccaaagcccccaaggguggca

SEQ ID NO: 169580 - RNA, 32 nt, Human
gccaaagccugcagccuggccugggccuggcc

SEQ ID NO: 169581 - RNA, 32 nt, Human
gccaaagccugcccugagcccagacacaccug

SEQ ID NO: 169582 - RNA, 32 nt, Human
gccaaagcuagcccaaggcuggggaaggggag

SEQ ID NO: 169583 - RNA, 32 nt, Human
gccaaagcugcagccaucagcaccagccaagu

SEQ ID NO: 169584 - RNA, 32 nt, Human
gccaaagcuguuacagagaugacaucuuuugu

SEQ ID NO: 169585 - RNA, 32 nt, Human
gccaaagcuguucacgucugugcucaaccauc

SEQ ID NO: 169586 - RNA, 20 nt, Human
gccaaaggaggcagagccag

SEQ ID NO: 169587 - RNA, 32 nt, Human
gccaaaggagggcugcggcuuccuucccucac

SEQ ID NO: 169588 - RNA, 32 nt, Human
gccaaaggauaugcccugucaugguuucuguu

SEQ ID NO: 169589 - RNA, 32 nt, Human
gccaaaggcaagguacuaggugaccuccuggu

SEQ ID NO: 169590 - RNA, 20 nt, Human
gccaaaggcgguuccacccu

SEQ ID NO: 169591 - RNA, 32 nt, Human
gccaaagggaaagaagaagaacggaaggaaca

SEQ ID NO: 169592 - RNA, 32 nt, Human
gccaaagggaggacacaguagcuuaaaaucac

SEQ ID NO: 169593 - RNA, 32 nt, Human
gccaaagggaugcccuaucugaaggaaagggg

SEQ ID NO: 169594 - RNA, 21 nt, Human
gccaaaggguccgcggcgugg

SEQ ID NO: 169595 - RNA, 32 nt, Human
gccaaagguacaccacuacacuccagccuggg

SEQ ID NO: 169596 - RNA, 32 nt, Human
gccaaagguacgccgggugggguggggugggg

SEQ ID NO: 169597 - RNA, 32 nt, Human
gccaaaggugccaggccuuagagcagacaagg

SEQ ID NO: 169598 - RNA, 32 nt, Human
gccaaaguccucuucaugacauauagagacug

SEQ ID NO: 169599 - RNA, 32 nt, Human
gccaaagugcugcugauucccacucccuuggu

SEQ ID NO: 169600 - RNA, 30 nt, Human
gccaaagugcugggauuacuuuacaggcgu

SEQ ID NO: 169601 - RNA, 32 nt, Human
gccaaagugggagcccaggcagaggaggcacc

SEQ ID NO: 169602 - RNA, 32 nt, Human
gccaaagugggagcccaggcagaggaggcgcc

SEQ ID NO: 169603 - RNA, 24 nt, Human
gccaaagugggaggauugcuugag

SEQ ID NO: 169604 - RNA, 32 nt, Human
gccaaaguguggagaucugauuccuagauuuc

SEQ ID NO: 169605 - RNA, 32 nt, Human
gccaaauaaugucucugugagacucgagaacu

SEQ ID NO: 169606 - RNA, 31 nt, Human
gccaaauacauuuucugacauuguaagauug

SEQ ID NO: 169607 - RNA, 32 nt, Human
gccaaauagugugcuagccauugaggauggag

SEQ ID NO: 169608 - RNA, 18 nt, Human
gccaaauauuccagcccu

SEQ ID NO: 169609 - RNA, 32 nt, Human
gccaaaucacccaagaaagaaaguauaugacg

SEQ ID NO: 169610 - RNA, 22 nt, Human
gccaaaucacuuuuccaucucu

SEQ ID NO: 169611 - RNA, 20 nt, Human
gccaaaucauuucaacugaa

SEQ ID NO: 169612 - RNA, 32 nt, Human
gccaaauccagccugcugccuguuuuuauaua

SEQ ID NO: 169613 - RNA, 32 nt, Human
gccaaaucccuaacugaacacagaugucucag

SEQ ID NO: 169614 - RNA, 32 nt, Human
gccaaauccucuuccucugagaaccagugaaa

SEQ ID NO: 169615 - RNA, 21 nt, Human
gccaaaucgugacaccaugaa

SEQ ID NO: 169616 - RNA, 32 nt, Human
gccaaaucuguagaaucaguuuuugauuaaag

SEQ ID NO: 169617 - RNA, 32 nt, Human
gccaaaucugucucccuucaugggccucccag

SEQ ID NO: 169618 - RNA, 32 nt, Human
gccaaaucugucugcugcucccucuccucagc

SEQ ID NO: 169619 - RNA, 32 nt, Human
gccaaaugaggccuacugauuacuugaggugu

SEQ ID NO: 169620 - RNA, 30 nt, Human
gccaaaugcugggcucaggccugggugcug

SEQ ID NO: 169621 - RNA, 20 nt, Human
gccaaaugcuucccaccucu

SEQ ID NO: 169622 - RNA, 30 nt, Human
gccaaauggaggccacugagccacaggaua

SEQ ID NO: 169623 - RNA, 20 nt, Human
gccaaauggcaacaccacgu

SEQ ID NO: 169624 - RNA, 32 nt, Human
gccaaaugugagagcauugaauaaauaucuua

SEQ ID NO: 169625 - RNA, 32 nt, Human
gccaaauucaaggagcuugcgggaacauuuga

SEQ ID NO: 169626 - RNA, 18 nt, Human
gccaaauucccaguaaca

SEQ ID NO: 169627 - RNA, 32 nt, Human
gccaaauucccugccugugccugcugggacca

SEQ ID NO: 169628 - RNA, 32 nt, Human
gccaaauuguguuugcuuugguuauaguuacu

SEQ ID NO: 169629 - RNA, 32 nt, Human
gccaacaaaagagagcaucucuucucaugaag

SEQ ID NO: 169630 - RNA, 31 nt, Human
gccaacaacaacagaacaggguggagugagu

SEQ ID NO: 169631 - RNA, 32 nt, Human
gccaacaagaaucaguagaagugcugggagca

SEQ ID NO: 169632 - RNA, 20 nt, Human
gccaacaagaccauccagaa

SEQ ID NO: 169633 - RNA, 32 nt, Human
gccaacaagaugaccuauuuugccaauauuca

SEQ ID NO: 169634 - RNA, 32 nt, Human
gccaacaagcaacguuugcaucauguuaucuc

SEQ ID NO: 169635 - RNA, 32 nt, Human
gccaacaagguggagagaaaaauguucuuuug

SEQ ID NO: 169636 - RNA, 21 nt, Human
gccaacacagugaaacccugu

SEQ ID NO: 169637 - RNA, 32 nt, Human
gccaacaccaagcagacauuucagaggauuca

SEQ ID NO: 169638 - RNA, 32 nt, Human
gccaacaccauguacuacccacaaacucccca

SEQ ID NO: 169639 - RNA, 19 nt, Human
gccaacaccuguaauccca

SEQ ID NO: 169640 - RNA, 32 nt, Human
gccaacaccuguaaucccagcaccuugcgagg

SEQ ID NO: 169641 - RNA, 28 nt, Human
gccaacacggcaaaacuccaccucuacu

SEQ ID NO: 169642 - RNA, 32 nt, Human
gccaacacuuguuucugaaacuuuuuacagca

SEQ ID NO: 169643 - RNA, 32 nt, Human
gccaacagaagcacauuugucuuccagaacac

SEQ ID NO: 169644 - RNA, 32 nt, Human
gccaacagaagcuuccauuccaagccugacca

SEQ ID NO: 169645 - RNA, 32 nt, Human
gccaacagaccagcuccucuuccuccggaucc

SEQ ID NO: 169646 - RNA, 32 nt, Human
gccaacagagcugugcccugaggacccggccu

SEQ ID NO: 169647 - RNA, 32 nt, Human
gccaacagccugggagaugagacaggguuaga

SEQ ID NO: 169648 - RNA, 32 nt, Human
gccaacagcuacucuugaacuaugguauuuga

SEQ ID NO: 169649 - RNA, 32 nt, Human
gccaacagcugaagccgagcacagaccucccu

SEQ ID NO: 169650 - RNA, 32 nt, Human
gccaacagcuucuuucuaauguucugugaaaa

SEQ ID NO: 169651 - RNA, 32 nt, Human
gccaacaggagagagacagugagugaaaggag

SEQ ID NO: 169652 - RNA, 32 nt, Human
gccaacaguccaggccaugacaagcuggcacc

SEQ ID NO: 169653 - RNA, 32 nt, Human
gccaacaguuugaaugguaagacaacauaaua

SEQ ID NO: 169654 - RNA, 21 nt, Human
gccaacauagugaaacccugu

SEQ ID NO: 169655 - RNA, 32 nt, Human
gccaacauccaccuggccuaugcccccaccag

SEQ ID NO: 169656 - RNA, 32 nt, Human
gccaacaugaggcucucugcugccuuuuguuu

SEQ ID NO: 169657 - RNA, 21 nt, Human
gccaacaugauaaaaccccgu

SEQ ID NO: 169658 - RNA, 24 nt, Human
gccaacaugaugaaaccccaugug

SEQ ID NO: 169659 - RNA, 32 nt, Human
gccaacaugaugaaacccuguucucuacuaaa

SEQ ID NO: 169660 - RNA, 32 nt, Human
gccaacaugcugagcaugcucacaaagaaggc

SEQ ID NO: 169661 - RNA, 32 nt, Human
gccaacauggcagaaaccccaucucuacuaaa

SEQ ID NO: 169662 - RNA, 19 nt, Human
gccaacauggugaaacccc

SEQ ID NO: 169663 - RNA, 32 nt, Human
gccaacauggugaaacccccaucucuacuaaa

SEQ ID NO: 169664 - RNA, 32 nt, Human
gccaacauggugaaacccccaucucuccuggg

SEQ ID NO: 169665 - RNA, 21 nt, Human
gccaacauggugaaaccccgu

SEQ ID NO: 169666 - RNA, 32 nt, Human
gccaacauggugugagaccccgucucuacuaa

SEQ ID NO: 169667 - RNA, 21 nt, Human
gccaacaugugucugaaccug

SEQ ID NO: 169668 - RNA, 32 nt, Human
gccaacauuugcuucaaguuccugggccugcu

SEQ ID NO: 169669 - RNA, 32 nt, Human
gccaaccaacuugcuguauacaccuuggacaa

SEQ ID NO: 169670 - RNA, 32 nt, Human
gccaaccacaucucccugcuguguccccuggg

SEQ ID NO: 169671 - RNA, 32 nt, Human
gccaaccaccacucucccgccugguguagcuu

SEQ ID NO: 169672 - RNA, 32 nt, Human
gccaaccacugaccuuguaucuucaucaucag

SEQ ID NO: 169673 - RNA, 20 nt, Human
gccaaccaucaguauuuucc

SEQ ID NO: 169674 - RNA, 32 nt, Human
gccaaccaugaccgccgccaguaugggccccg

SEQ ID NO: 169675 - RNA, 32 nt, Human
gccaaccaugccagugccugggaugagggcac

SEQ ID NO: 169676 - RNA, 32 nt, Human
gccaacccagccuggucaacauggugaaaccc

SEQ ID NO: 169677 - RNA, 19 nt, Human
gccaacccaguagcccccu

SEQ ID NO: 169678 - RNA, 32 nt, Human
gccaacccaugagcuucacccaggaagagggc

SEQ ID NO: 169679 - RNA, 32 nt, Human
gccaaccccacaccccuccacuuccagucgcu

SEQ ID NO: 169680 - RNA, 21 nt, Human
gccaaccccagcguccccccu

SEQ ID NO: 169681 - RNA, 32 nt, Human
gccaaccccugccccuugccccacacagacca

SEQ ID NO: 169682 - RNA, 32 nt, Human
gccaacccuaaaggauuguccucuuggccagc

SEQ ID NO: 169683 - RNA, 32 nt, Human
gccaacccugagcgagccuguccucuguggca

SEQ ID NO: 169684 - RNA, 32 nt, Human
gccaacccugcaggaaagugguuuauaggcca

SEQ ID NO: 169685 - RNA, 25 nt, Human
gccaacccuucaaugccugcuccug

SEQ ID NO: 169686 - RNA, 32 nt, Human
gccaacccuucaaugccugcuccuggaagucu

SEQ ID NO: 169687 - RNA, 32 nt, Human
gccaacccuucccauaacugguugccucggag

SEQ ID NO: 169688 - RNA, 18 nt, Human
gccaaccgccacccagag

SEQ ID NO: 169689 - RNA, 32 nt, Human
gccaaccuacaauacuacgccuaggcacacag

SEQ ID NO: 169690 - RNA, 32 nt, Human
gccaaccuacagccaugaucuuuagcacagug

SEQ ID NO: 169691 - RNA, 32 nt, Human
gccaaccucacacugcuaugauugccaacucc

SEQ ID NO: 169692 - RNA, 32 nt, Human
gccaaccucuucagcauaaagcuccugcccaa

SEQ ID NO: 169693 - RNA, 32 nt, Human
gccaaccugaccccuucccuccaggagccagg

SEQ ID NO: 169694 - RNA, 18 nt, Human
gccaaccugccccucccu

SEQ ID NO: 169695 - RNA, 32 nt, Human
gccaaccuggggagccagggcuaugggagcag

SEQ ID NO: 169696 - RNA, 32 nt, Human
gccaaccugggucacauagcaagacucuguuu

SEQ ID NO: 169697 - RNA, 32 nt, Human
gccaacgauuuucuuuacuaccaugcuccuuc

SEQ ID NO: 169698 - RNA, 32 nt, Human
gccaacgccaggcugcuauuuaucucccuauc

SEQ ID NO: 169699 - RNA, 16 nt, Human
gccaacggacccgggg

SEQ ID NO: 169700 - RNA, 32 nt, Human
gccaacggggacacccuccgugucuucaagau

SEQ ID NO: 169701 - RNA, 32 nt, Human
gccaacuaugagaauccagcugccuucuauua

SEQ ID NO: 169702 - RNA, 32 nt, Human
gccaacucauccucugcccccaccucgaaacc

SEQ ID NO: 169703 - RNA, 32 nt, Human
gccaacucauugcuuucugcugugcugugauc

SEQ ID NO: 169704 - RNA, 32 nt, Human
gccaacuccaucaagguggagauguacagcga

SEQ ID NO: 169705 - RNA, 22 nt, Human
gccaacuccaucuucaauaaag

SEQ ID NO: 169706 - RNA, 32 nt, Human
gccaacuccugccucgugccaccucaugcuua

SEQ ID NO: 169707 - RNA, 18 nt, Human
gccaacuccugggcucaa

SEQ ID NO: 169708 - RNA, 32 nt, Human
gccaacucuccccucaaaaucauugucaaaga

SEQ ID NO: 169709 - RNA, 32 nt, Human
gccaacugcacucuggaggcggcggcagccag

SEQ ID NO: 169710 - RNA, 32 nt, Human
gccaacugccuagucagucccaaugagagaac

SEQ ID NO: 169711 - RNA, 32 nt, Human
gccaacugcgagcugcuccacuucucagcucu

SEQ ID NO: 169712 - RNA, 32 nt, Human
gccaacugcucacucgcucaccucccuccuug

SEQ ID NO: 169713 - RNA, 32 nt, Human
gccaacuggagcugauauucgggaagcuaagc

SEQ ID NO: 169714 - RNA, 32 nt, Human
gccaacuggcugcggccaucacagcugcgugc

SEQ ID NO: 169715 - RNA, 17 nt, Human
gccaacuguccaccucu

SEQ ID NO: 169716 - RNA, 32 nt, Human
gccaacugugacuuccccagaaaggagccagc

SEQ ID NO: 169717 - RNA, 32 nt, Human
gccaacuguguggcagaacgugcagugagggu

SEQ ID NO: 169718 - RNA, 32 nt, Human
gccaacugugugugcagguacuguguguaccu

SEQ ID NO: 169719 - RNA, 32 nt, Human
gccaacuucaacaaaaagaaacuugacuaaga

SEQ ID NO: 169720 - RNA, 32 nt, Human
gccaacuucagagccugucaccaggaaaggua

SEQ ID NO: 169721 - RNA, 32 nt, Human
gccaacuucucccaccccuuggccccucacau

SEQ ID NO: 169722 - RNA, 32 nt, Human
gccaagaaaaaugaaggcccugcauguuuuuc

SEQ ID NO: 169723 - RNA, 32 nt, Human
gccaagaaacaacacugaguuccagauuucgg

SEQ ID NO: 169724 - RNA, 32 nt, Human
gccaagaaagagagaagaugagagggaauggu

SEQ ID NO: 169725 - RNA, 19 nt, Human
gccaagaaaggugggccuc

SEQ ID NO: 169726 - RNA, 32 nt, Human
gccaagaaaugagacgaauguuugggguuuau

SEQ ID NO: 169727 - RNA, 32 nt, Human
gccaagaaccuucuggcucugagggagcaaga

SEQ ID NO: 169728 - RNA, 32 nt, Human
gccaagaacucaaguguaacugugauaaaaua

SEQ ID NO: 169729 - RNA, 32 nt, Human
gccaagaagaaagugugagaaguugaugggca

SEQ ID NO: 169730 - RNA, 32 nt, Human
gccaagaagagaggccucaccagacaccaaac

SEQ ID NO: 169731 - RNA, 32 nt, Human
gccaagaagagcugaaauagaaaacagccuag

SEQ ID NO: 169732 - RNA, 32 nt, Human
gccaagaagggagaguuucgugcacugugguu

SEQ ID NO: 169733 - RNA, 32 nt, Human
gccaagaagggccagggugaggguggggcugg

SEQ ID NO: 169734 - RNA, 22 nt, Human
gccaagaaguaguggcuccaag

SEQ ID NO: 169735 - RNA, 32 nt, Human
gccaagaaguaguggcuccaagaacugaaugc

SEQ ID NO: 169736 - RNA, 32 nt, Human
gccaagacaccagaugccaaagcugcccccac

SEQ ID NO: 169737 - RNA, 25 nt, Human
gccaagacaccauugucucccuuua

SEQ ID NO: 169738 - RNA, 22 nt, Human
gccaagacaggaggaucacuuu

SEQ ID NO: 169739 - RNA, 25 nt, Human
gccaagacagguagaucacuugaga

SEQ ID NO: 169740 - RNA, 32 nt, Human
gccaagaccagucugcaaacuccaucccgccg

SEQ ID NO: 169741 - RNA, 32 nt, Human
gccaagaccaucucucccuccuggugaagugu

SEQ ID NO: 169742 - RNA, 30 nt, Human
gccaagaccccuggccacccagacccccca

SEQ ID NO: 169743 - RNA, 32 nt, Human
gccaagacccuccauccaagcagggcuggauc

SEQ ID NO: 169744 - RNA, 32 nt, Human
gccaagacccucccauugcaggggaggcgggg

SEQ ID NO: 169745 - RNA, 32 nt, Human
gccaagacccuccccuggugggacguugaagc

SEQ ID NO: 169746 - RNA, 32 nt, Human
gccaagacccuggcccucuccucugcccagcc

SEQ ID NO: 169747 - RNA, 32 nt, Human
gccaagaccuucgcuugugaugacuuuugaag

SEQ ID NO: 169748 - RNA, 32 nt, Human
gccaagacgccauugcaccccagccugggcaa

SEQ ID NO: 169749 - RNA, 32 nt, Human
gccaagacucuguucugaaucuaccuccucua

SEQ ID NO: 169750 - RNA, 32 nt, Human
gccaagacugugccacugcacuccagccuggg

SEQ ID NO: 169751 - RNA, 32 nt, Human
gccaagagaagaucgaauggcuuuuugcagcu

SEQ ID NO: 169752 - RNA, 22 nt, Human
gccaagagacagagcuguccug

SEQ ID NO: 169753 - RNA, 17 nt, Human
gccaagagacuggcaua

SEQ ID NO: 169754 - RNA, 32 nt, Human
gccaagagcccaugaauggaggcugcaggagg

SEQ ID NO: 169755 - RNA, 32 nt, Human
gccaagagccugagugacagagcaagacccca

SEQ ID NO: 169756 - RNA, 21 nt, Human
gccaagagcucugucucccuc

SEQ ID NO: 169757 - RNA, 21 nt, Human
gccaagaggcacccccuuccc

SEQ ID NO: 169758 - RNA, 32 nt, Human
gccaagagucucaucccuacccuggggcaccu

SEQ ID NO: 169759 - RNA, 32 nt, Human
gccaagagugaagggaagagacagcccaggau

SEQ ID NO: 169760 - RNA, 32 nt, Human
gccaagagugucccucugagacccuugggaag

SEQ ID NO: 169761 - RNA, 17 nt, Human
gccaagaucccaucucu

SEQ ID NO: 169762 - RNA, 32 nt, Human
gccaagaucccucccagcguccacaucguccu

SEQ ID NO: 169763 - RNA, 32 nt, Human
gccaagaucgacaucaugccacccugggcaaa

SEQ ID NO: 169764 - RNA, 22 nt, Human
gccaagaucgcaccacugcacu

SEQ ID NO: 169765 - RNA, 21 nt, Human
gccaagaucgcaccacugcuc

SEQ ID NO: 169766 - RNA, 22 nt, Human
gccaagaucgccccacugcacu

SEQ ID NO: 169767 - RNA, 32 nt, Human
gccaagaugcacugcaccccagccugggcgac

SEQ ID NO: 169768 - RNA, 32 nt, Human
gccaagaugccacccaaauccacucugcaguc

SEQ ID NO: 169769 - RNA, 32 nt, Human
gccaagauggcagaggauggaggcuccuucau

SEQ ID NO: 169770 - RNA, 32 nt, Human
gccaagauugugccacugcacuccagccugag

SEQ ID NO: 169771 - RNA, 32 nt, Human
gccaagauugugccacugcacuccagccuggg

SEQ ID NO: 169772 - RNA, 32 nt, Human
gccaagauugugccacuguacuccagccuggg

SEQ ID NO: 169773 - RNA, 32 nt, Human
gccaagauugugccacuguauuccaacuuggg

SEQ ID NO: 169774 - RNA, 32 nt, Human
gccaagauugugccacuguauuccagacuggg

SEQ ID NO: 169775 - RNA, 32 nt, Human
gccaagcacaaucagguggaggcugcauggcu

SEQ ID NO: 169776 - RNA, 32 nt, Human
gccaagcacacagcaggaccagggacaucagc

SEQ ID NO: 169777 - RNA, 18 nt, Human
gccaagcacauguuuccu

SEQ ID NO: 169778 - RNA, 21 nt, Human
gccaagcacgcagaucccaug

SEQ ID NO: 169779 - RNA, 32 nt, Human
gccaagcacgccagcucucagcagguuuucug

SEQ ID NO: 169780 - RNA, 32 nt, Human
gccaagcacuuauggaccagaguggcccaggc

SEQ ID NO: 169781 - RNA, 22 nt, Human
gccaagcagagcccccucuccc

SEQ ID NO: 169782 - RNA, 32 nt, Human
gccaagcagcagagcuaguagaaggggaugca

SEQ ID NO: 169783 - RNA, 18 nt, Human
gccaagcagcaugcucag

SEQ ID NO: 169784 - RNA, 32 nt, Human
gccaagcagccagcagccuagcagccagucag

SEQ ID NO: 169785 - RNA, 32 nt, Human
gccaagcaggggagaggaaugaggggagcagc

SEQ ID NO: 169786 - RNA, 32 nt, Human
gccaagcaggguggggaauggaggauagacau

SEQ ID NO: 169787 - RNA, 18 nt, Human
gccaagcauauccaucuc

SEQ ID NO: 169788 - RNA, 32 nt, Human
gccaagcauggcagggggaaggucagugggug

SEQ ID NO: 169789 - RNA, 18 nt, Human
gccaagccaaggugggca

SEQ ID NO: 169790 - RNA, 32 nt, Human
gccaagccaccugcaucccccgccccagaucu

SEQ ID NO: 169791 - RNA, 20 nt, Human
gccaagccagggacuaagca

SEQ ID NO: 169792 - RNA, 32 nt, Human
gccaagccagugugggggagccuggaaaauga

SEQ ID NO: 169793 - RNA, 32 nt, Human
gccaagccauaucuaacagaacuaucuucaac

SEQ ID NO: 169794 - RNA, 32 nt, Human
gccaagcccaccacuuccaccugggcccuaca

SEQ ID NO: 169795 - RNA, 22 nt, Human
gccaagcccacccggggugcag

SEQ ID NO: 169796 - RNA, 18 nt, Human
gccaagcccacggccaug

SEQ ID NO: 169797 - RNA, 32 nt, Human
gccaagcccagccugagccagcaccugccuuu

SEQ ID NO: 169798 - RNA, 32 nt, Human
gccaagcccagccugagccagcacuugccuuu

SEQ ID NO: 169799 - RNA, 32 nt, Human
gccaagcccagcgcaacaaaggaaaacuacga

SEQ ID NO: 169800 - RNA, 32 nt, Human
gccaagcccaggcaucaggaggcuguuaugau

SEQ ID NO: 169801 - RNA, 16 nt, Human
gccaagcccaugccca

SEQ ID NO: 169802 - RNA, 19 nt, Human
gccaagccccaguacuugg

SEQ ID NO: 169803 - RNA, 23 nt, Human
gccaagcccuccccaucccaugu

SEQ ID NO: 169804 - RNA, 32 nt, Human
gccaagcccugaguggccacugccaagcugcg

SEQ ID NO: 169805 - RNA, 20 nt, Human
gccaagcccuguucucggug

SEQ ID NO: 169806 - RNA, 20 nt, Human
gccaagccggaggcccgagg

SEQ ID NO: 169807 - RNA, 21 nt, Human
gccaagccgguccuccuuccc

SEQ ID NO: 169808 - RNA, 32 nt, Human
gccaagccuccuccaucucccaucagugcugu

SEQ ID NO: 169809 - RNA, 32 nt, Human
gccaagccucuccacuccuuccacuuuuucug

SEQ ID NO: 169810 - RNA, 22 nt, Human
gccaagccugacacauuugaca

SEQ ID NO: 169811 - RNA, 32 nt, Human
gccaagccuggggcugggucuuggggaccugu

SEQ ID NO: 169812 - RNA, 32 nt, Human
gccaagcgcaucgggagcacaccagaaaccgg

SEQ ID NO: 169813 - RNA, 32 nt, Human
gccaagcgcaugaaccuucagaccauggugga

SEQ ID NO: 169814 - RNA, 32 nt, Human
gccaagcgccagccaccacggcccuccggaca

SEQ ID NO: 169815 - RNA, 21 nt, Human
gccaagcgcgcccccaccucu

SEQ ID NO: 169816 - RNA, 32 nt, Human
gccaagcggaggcugcagcccgggccgcgaug

SEQ ID NO: 169817 - RNA, 32 nt, Human
gccaagcuaccugaaauuggaauaagggggug

SEQ ID NO: 169818 - RNA, 32 nt, Human
gccaagcuagugggcuucaggugcaaggguac

SEQ ID NO: 169819 - RNA, 32 nt, Human
gccaagcucccuggagcccuguuggcagcucu

SEQ ID NO: 169820 - RNA, 32 nt, Human
gccaagcucugagcucugcucccagggagcac

SEQ ID NO: 169821 - RNA, 32 nt, Human
gccaagcugagccuggccaagcuagguggaca

SEQ ID NO: 169822 - RNA, 32 nt, Human
gccaagcugcagcugcagacucggcggcccuc

SEQ ID NO: 169823 - RNA, 32 nt, Human
gccaagcuggccgagguugcaguccaugagcu

SEQ ID NO: 169824 - RNA, 32 nt, Human
gccaagcuuaucaguugacucucuccagaaua

SEQ ID NO: 169825 - RNA, 21 nt, Human
gccaagcuucugguucccaug

SEQ ID NO: 169826 - RNA, 32 nt, Human
gccaaggacuccuuccgcugggccacagggga

SEQ ID NO: 169827 - RNA, 23 nt, Human
gccaaggacuggccugugcacug

SEQ ID NO: 169828 - RNA, 32 nt, Human
gccaaggagagaggcuccugaagaaaccggcc

SEQ ID NO: 169829 - RNA, 32 nt, Human
gccaaggagcggagcgcgcucagcugcgccca

SEQ ID NO: 169830 - RNA, 32 nt, Human
gccaaggagcggagggaguugaacuugucaaa

SEQ ID NO: 169831 - RNA, 32 nt, Human
gccaaggaggcagcaggggccagcaaggcccu

SEQ ID NO: 169832 - RNA, 32 nt, Human
gccaaggaggcugugcagcccgaggcucucaa

SEQ ID NO: 169833 - RNA, 32 nt, Human
gccaaggaggggccugaggcucucccuacucc

SEQ ID NO: 169834 - RNA, 24 nt, Human
gccaaggcaaaaggaucgcuugag

SEQ ID NO: 169835 - RNA, 24 nt, Human
gccaaggcaaaaggauugcuugag

SEQ ID NO: 169836 - RNA, 32 nt, Human
gccaaggcacugauguuugaacuggaaacuuc

SEQ ID NO: 169837 - RNA, 21 nt, Human
gccaaggcagccaccccgggg

SEQ ID NO: 169838 - RNA, 22 nt, Human
gccaaggcagcucuucuggagu

SEQ ID NO: 169839 - RNA, 24 nt, Human
gccaaggcaggagaagcgcuugag

SEQ ID NO: 169840 - RNA, 23 nt, Human
gccaaggcaggagaaucgcuuga

SEQ ID NO: 169841 - RNA, 24 nt, Human
gccaaggcaggagaaucgcuuuag

SEQ ID NO: 169842 - RNA, 24 nt, Human
gccaaggcaggagaauugcuugag

SEQ ID NO: 169843 - RNA, 24 nt, Human
gccaaggcaggaggaccgcuugag

SEQ ID NO: 169844 - RNA, 24 nt, Human
gccaaggcaggaggacugcuugag

SEQ ID NO: 169845 - RNA, 24 nt, Human
gccaaggcaggaggaucacuugag

SEQ ID NO: 169846 - RNA, 24 nt, Human
gccaaggcaggaggaucgcuggag

SEQ ID NO: 169847 - RNA, 24 nt, Human
gccaaggcaggaggaucgcuugag

SEQ ID NO: 169848 - RNA, 24 nt, Human
gccaaggcaggaggaucguuugag

SEQ ID NO: 169849 - RNA, 24 nt, Human
gccaaggcaggaggaucucuugag

SEQ ID NO: 169850 - RNA, 24 nt, Human
gccaaggcaggaggauggcuugag

SEQ ID NO: 169851 - RNA, 24 nt, Human
gccaaggcaggaggauugcuugag

SEQ ID NO: 169852 - RNA, 25 nt, Human
gccaaggcaggcagaucacuugagg

SEQ ID NO: 169853 - RNA, 24 nt, Human
gccaaggcaggcagaucgcuugag

SEQ ID NO: 169854 - RNA, 19 nt, Human
gccaaggcaggcggaucac

SEQ ID NO: 169855 - RNA, 32 nt, Human
gccaaggcaggcggaucacgaagucaggagau

SEQ ID NO: 169856 - RNA, 32 nt, Human
gccaaggcaggcggaucacgaggucaggagau

SEQ ID NO: 169857 - RNA, 32 nt, Human
gccaaggcaggcggaucacgaggucaggaguu

SEQ ID NO: 169858 - RNA, 20 nt, Human
gccaaggcaggcuggaucac

SEQ ID NO: 169859 - RNA, 19 nt, Human
gccaaggcagguggaucgc

SEQ ID NO: 169860 - RNA, 24 nt, Human
gccaaggcagguggaucgcuugag

SEQ ID NO: 169861 - RNA, 32 nt, Human
gccaaggcagugaaauagaguggaugguacuu

SEQ ID NO: 169862 - RNA, 32 nt, Human
gccaaggccacaucugggaagaguggagaaau

SEQ ID NO: 169863 - RNA, 32 nt, Human
gccaaggccagaggauugcuugagucuagcag

SEQ ID NO: 169864 - RNA, 32 nt, Human
gccaaggccccaggcucagagcacucacacgc

SEQ ID NO: 169865 - RNA, 23 nt, Human
gccaaggccuggccggggcucgg

SEQ ID NO: 169866 - RNA, 32 nt, Human
gccaaggcgcuuuggggguggaggggguggug

SEQ ID NO: 169867 - RNA, 24 nt, Human
gccaaggcgggaggaucacuugag

SEQ ID NO: 169868 - RNA, 24 nt, Human
gccaaggcgggaggaucgcuugag

SEQ ID NO: 169869 - RNA, 24 nt, Human
gccaaggcgggaggauggcuugag

SEQ ID NO: 169870 - RNA, 24 nt, Human
gccaaggcgggaggauugcuugag

SEQ ID NO: 169871 - RNA, 25 nt, Human
gccaaggcgggcagaucacuugaga

SEQ ID NO: 169872 - RNA, 24 nt, Human
gccaaggcgggcagaucgcuugag

SEQ ID NO: 169873 - RNA, 31 nt, Human
gccaaggcgguggguuccaugccacaggcag

SEQ ID NO: 169874 - RNA, 23 nt, Human
gccaaggcugcagggagcaccac

SEQ ID NO: 169875 - RNA, 21 nt, Human
gccaaggcuggaaugcagugg

SEQ ID NO: 169876 - RNA, 19 nt, Human
gccaaggcuggagugcagu

SEQ ID NO: 169877 - RNA, 20 nt, Human
gccaaggcuggagugcagug

SEQ ID NO: 169878 - RNA, 21 nt, Human
gccaaggcuggagugcagugg

SEQ ID NO: 169879 - RNA, 23 nt, Human
gccaaggcuggagugcaguggug

SEQ ID NO: 169880 - RNA, 24 nt, Human
gccaaggcuggagugcaguggugu

SEQ ID NO: 169881 - RNA, 32 nt, Human
gccaaggcuuacugaggcugguggagggagcc

SEQ ID NO: 169882 - RNA, 32 nt, Human
gccaaggcuuccagggucuggugcagggacga

SEQ ID NO: 169883 - RNA, 32 nt, Human
gccaaggcuuggggcuuccacucugaagccac

SEQ ID NO: 169884 - RNA, 32 nt, Human
gccaagggaagagagacaggcuaggaguugac

SEQ ID NO: 169885 - RNA, 32 nt, Human
gccaagggacugaugguggacacuccagaugu

SEQ ID NO: 169886 - RNA, 32 nt, Human
gccaagggagccaaacacacuagauuucuguu

SEQ ID NO: 169887 - RNA, 32 nt, Human
gccaagggagcuuguugaugugggucacacgg

SEQ ID NO: 169888 - RNA, 32 nt, Human
gccaagggcaagugcuagaguugcagugaauu

SEQ ID NO: 169889 - RNA, 32 nt, Human
gccaagggccacgggaacuuggagagggagcu

SEQ ID NO: 169890 - RNA, 32 nt, Human
gccaagggcuuuuccccucugagcucugggag

SEQ ID NO: 169891 - RNA, 21 nt, Human
gccaaggggccgcgggcucag

SEQ ID NO: 169892 - RNA, 32 nt, Human
gccaagggggacccccagaaaaagguauggag

SEQ ID NO: 169893 - RNA, 32 nt, Human
gccaagggggcagagggcuuucagcgccccca

SEQ ID NO: 169894 - RNA, 32 nt, Human
gccaaggguccaggcugcuuuaggccaucugu

SEQ ID NO: 169895 - RNA, 18 nt, Human
gccaagggugaaggcccc

SEQ ID NO: 169896 - RNA, 32 nt, Human
gccaaggguuguucgccaggguaggauguguc

SEQ ID NO: 169897 - RNA, 24 nt, Human
gccaagguaagaggaucgcuugag

SEQ ID NO: 169898 - RNA, 24 nt, Human
gccaagguaagaggauugcuugag

SEQ ID NO: 169899 - RNA, 22 nt, Human
gccaagguagacuaggaagagu

SEQ ID NO: 169900 - RNA, 24 nt, Human
gccaagguaggaggaucacuugag

SEQ ID NO: 169901 - RNA, 24 nt, Human
gccaagguaggaggaucgcuugag

SEQ ID NO: 169902 - RNA, 24 nt, Human
gccaagguaggaggauggcuugag

SEQ ID NO: 169903 - RNA, 23 nt, Human
gccaagguaggaggauugcuuga

SEQ ID NO: 169904 - RNA, 24 nt, Human
gccaagguaggaggauugcuugag

SEQ ID NO: 169905 - RNA, 32 nt, Human
gccaagguagguggauaccugaggucaggagu

SEQ ID NO: 169906 - RNA, 32 nt, Human
gccaagguaugacaauuaaugguucugcauga

SEQ ID NO: 169907 - RNA, 32 nt, Human
gccaaggucauaccagugcacuccaggcgggu

SEQ ID NO: 169908 - RNA, 16 nt, Human
gccaaggucccucagg

SEQ ID NO: 169909 - RNA, 32 nt, Human
gccaagguccugcaugggccugggugaccccu

SEQ ID NO: 169910 - RNA, 32 nt, Human
gccaaggucucggaggccaggaugccugcccu

SEQ ID NO: 169911 - RNA, 19 nt, Human
gccaaggugaccuuggagg

SEQ ID NO: 169912 - RNA, 32 nt, Human
gccaaggugagcccaaggugggaggaucacuu

SEQ ID NO: 169913 - RNA, 19 nt, Human
gccaagguggcagagcuag

SEQ ID NO: 169914 - RNA, 21 nt, Human
gccaagguggccaaggcccuc

SEQ ID NO: 169915 - RNA, 24 nt, Human
gccaaggugggaggaucgcuugag

SEQ ID NO: 169916 - RNA, 24 nt, Human
gccaaggugggaggauugcuugag

SEQ ID NO: 169917 - RNA, 24 nt, Human
gccaaggugggaguaucgcuugag

SEQ ID NO: 169918 - RNA, 32 nt, Human
gccaaggugggcaaucauuugaggucaggagu

SEQ ID NO: 169919 - RNA, 32 nt, Human
gccaaggugggucgaucacugaggucaggagu

SEQ ID NO: 169920 - RNA, 25 nt, Human
gccaagguggguggaccacaugagg

SEQ ID NO: 169921 - RNA, 32 nt, Human
gccaagguguacaugcagcuacucgggaggcu

SEQ ID NO: 169922 - RNA, 32 nt, Human
gccaaggugugggcgcaucuagggcaggucuu

SEQ ID NO: 169923 - RNA, 19 nt, Human
gccaaggugugucccggga

SEQ ID NO: 169924 - RNA, 19 nt, Human
gccaagguugauccacuua

SEQ ID NO: 169925 - RNA, 32 nt, Human
gccaagguugcgccacugcacuccagccuggg

SEQ ID NO: 169926 - RNA, 32 nt, Human
gccaaguacaucucuguaacccagcuggcccc

SEQ ID NO: 169927 - RNA, 19 nt, Human
gccaaguaccugcucacca

SEQ ID NO: 169928 - RNA, 32 nt, Human
gccaaguaccuuuucagcuuuuuaacugcccc

SEQ ID NO: 169929 - RNA, 32 nt, Human
gccaaguauagagagaauagugaaaaauuaau

SEQ ID NO: 169930 - RNA, 32 nt, Human
gccaaguauauacucuucuuuacauggugaug

SEQ ID NO: 169931 - RNA, 24 nt, Human
gccaaguaucagauugagggcuua

SEQ ID NO: 169932 - RNA, 18 nt, Human
gccaagucacuucaccuc

SEQ ID NO: 169933 - RNA, 19 nt, Human
gccaagucagagaagaaac

SEQ ID NO: 169934 - RNA, 22 nt, Human
gccaagucauccucccaccuca

SEQ ID NO: 169935 - RNA, 19 nt, Human
gccaaguccccacugacca

SEQ ID NO: 169936 - RNA, 18 nt, Human
gccaaguccccuccccaa

SEQ ID NO: 169937 - RNA, 32 nt, Human
gccaaguccgcagaagcccugauguguccuca

SEQ ID NO: 169938 - RNA, 20 nt, Human
gccaaguccucaguuuccaa

SEQ ID NO: 169939 - RNA, 32 nt, Human
gccaaguccugcggcucccuggggcugagauc

SEQ ID NO: 169940 - RNA, 18 nt, Human
gccaagucuacaaugucc

SEQ ID NO: 169941 - RNA, 21 nt, Human
gccaagucucccaauauccaa

SEQ ID NO: 169942 - RNA, 19 nt, Human
gccaagucucggcccucca

SEQ ID NO: 169943 - RNA, 20 nt, Human
gccaagucugugccccccaa

SEQ ID NO: 169944 - RNA, 22 nt, Human
gccaagugaaggacccccuccc

SEQ ID NO: 169945 - RNA, 32 nt, Human
gccaagugauuguaagucaggagacuuuccuu

SEQ ID NO: 169946 - RNA, 32 nt, Human
gccaagugcaggaggcccaguguggagaaggg

SEQ ID NO: 169947 - RNA, 32 nt, Human
gccaagugccauuuggggucagcauccucguu

SEQ ID NO: 169948 - RNA, 32 nt, Human
gccaagugccugcuuaguagcuuuggaaaggu

SEQ ID NO: 169949 - RNA, 24 nt, Human
gccaagugcucacacacaaccuca

SEQ ID NO: 169950 - RNA, 32 nt, Human
gccaagugcuucugaauaaagaucccucucug

SEQ ID NO: 169951 - RNA, 32 nt, Human
gccaaguggaaagagaaagguagaagagaaga

SEQ ID NO: 169952 - RNA, 32 nt, Human
gccaaguggaggaagcgggagaagugcugggg

SEQ ID NO: 169953 - RNA, 18 nt, Human
gccaaguggcauauccag

SEQ ID NO: 169954 - RNA, 32 nt, Human
gccaagugggcaagcuuccagcagcagucugg

SEQ ID NO: 169955 - RNA, 32 nt, Human
gccaagugggcccagcccuggcuccugcgccc

SEQ ID NO: 169956 - RNA, 22 nt, Human
gccaaguggggccagggccaag

SEQ ID NO: 169957 - RNA, 32 nt, Human
gccaaguguccugcuugguuuagcugugcaga

SEQ ID NO: 169958 - RNA, 32 nt, Human
gccaagugugacugagcagugugcagagagug

SEQ ID NO: 169959 - RNA, 32 nt, Human
gccaaguguuagagucaggaaacccauugagg

SEQ ID NO: 169960 - RNA, 32 nt, Human
gccaaguuccaggugucuguguucccaggaac

SEQ ID NO: 169961 - RNA, 32 nt, Human
gccaaguucgcuccuggugaucacucgaaugc

SEQ ID NO: 169962 - RNA, 32 nt, Human
gccaaguugcaaccucuuucauucuagaaacu

SEQ ID NO: 169963 - RNA, 32 nt, Human
gccaaguugccuuacagagccaggacagcuuc

SEQ ID NO: 169964 - RNA, 19 nt, Human
gccaaguuggagugcaaug

SEQ ID NO: 169965 - RNA, 32 nt, Human
gccaaguuucaaggacugucuuugagucuguc

SEQ ID NO: 169966 - RNA, 32 nt, Human
gccaauaacaugacaggagcugggacugguuu

SEQ ID NO: 169967 - RNA, 32 nt, Human
gccaauaaccacaaaaugaucaguaaugagaa

SEQ ID NO: 169968 - RNA, 32 nt, Human
gccaauaacccacauaugcccaaaaggagcuu

SEQ ID NO: 169969 - RNA, 18 nt, Human
gccaauaccuggcugcug

SEQ ID NO: 169970 - RNA, 32 nt, Human
gccaauaccuggcugcugucuuaacucguagu

SEQ ID NO: 169971 - RNA, 32 nt, Human
gccaauaccuugauugcaaccuggugagagau

SEQ ID NO: 169972 - RNA, 32 nt, Human
gccaauacguucuaccgagagcacuuuggaau

SEQ ID NO: 169973 - RNA, 24 nt, Human
gccaauacugugaacccccuuccc

SEQ ID NO: 169974 - RNA, 32 nt, Human
gccaauagaagagacaggagacaggaagccuu

SEQ ID NO: 169975 - RNA, 32 nt, Human
gccaauagcacccauuaaaagaaauaccuaaa

SEQ ID NO: 169976 - RNA, 32 nt, Human
gccaauagggcucagacugagaaacauugagu

SEQ ID NO: 169977 - RNA, 20 nt, Human
gccaauagugccgaggucag

SEQ ID NO: 169978 - RNA, 19 nt, Human
gccaauauaaagaggaaac

SEQ ID NO: 169979 - RNA, 32 nt, Human
gccaauauagugggacccccaucucuacaaaa

SEQ ID NO: 169980 - RNA, 32 nt, Human
gccaauaucccaccaucaccucaaacccaauc

SEQ ID NO: 169981 - RNA, 32 nt, Human
gccaauaugcugcugucuccaauuucaauaga

SEQ ID NO: 169982 - RNA, 32 nt, Human
gccaauauuccaugcaguccugggcuuagcuu

SEQ ID NO: 169983 - RNA, 19 nt, Human
gccaaucaaagccuucccu

SEQ ID NO: 169984 - RNA, 32 nt, Human
gccaaucaagggcaaaaagucuacauacuuuc

SEQ ID NO: 169985 - RNA, 32 nt, Human
gccaaucacaagacccaggguugugcuuuuga

SEQ ID NO: 169986 - RNA, 32 nt, Human
gccaaucacagcugcucagcucuggcuucugu

SEQ ID NO: 169987 - RNA, 32 nt, Human
gccaaucacaggacagguguccuggccuuucu

SEQ ID NO: 169988 - RNA, 32 nt, Human
gccaaucacaggcaggaagaugaagguucugu

SEQ ID NO: 169989 - RNA, 32 nt, Human
gccaaucaccacugcccuccaagaccgguaca

SEQ ID NO: 169990 - RNA, 19 nt, Human
gccaaucacugcccaucug

SEQ ID NO: 169991 - RNA, 19 nt, Human
gccaaucagacaaacuuug

SEQ ID NO: 169992 - RNA, 32 nt, Human
gccaaucagagagagcucgcccccguuuucuu

SEQ ID NO: 169993 - RNA, 32 nt, Human
gccaaucagugcacauccugugucaucaaugu

SEQ ID NO: 169994 - RNA, 21 nt, Human
gccaaucaugcgcccaccucu

SEQ ID NO: 169995 - RNA, 19 nt, Human
gccaauccacuccuuccuu

SEQ ID NO: 169996 - RNA, 32 nt, Human
gccaauccaugcucucuuucuuuucucugucu

SEQ ID NO: 169997 - RNA, 32 nt, Human
gccaaucccagccccagacuccaaagcauccc

SEQ ID NO: 169998 - RNA, 20 nt, Human
gccaaucccauuccuguccc

SEQ ID NO: 169999 - RNA, 19 nt, Human
gccaauccuuuccuugccu

SEQ ID NO: 170000 - RNA, 32 nt, Human
gccaaucggugcuuccauccaacugucagacu

SEQ ID NO: 170001 - RNA, 32 nt, Human
gccaaucuaaaugcaucuccauuuucucaagc

SEQ ID NO: 170002 - RNA, 32 nt, Human
gccaaucuaagccagucucacugugaaccaca

SEQ ID NO: 170003 - RNA, 18 nt, Human
gccaaucuacucuucccu

SEQ ID NO: 170004 - RNA, 32 nt, Human
gccaaucucagaacuaaaugauaaaaaugaaa

SEQ ID NO: 170005 - RNA, 23 nt, Human
gccaaucuccaggcucccucccu

SEQ ID NO: 170006 - RNA, 32 nt, Human
gccaaucuggacacuucuuuauacucucuucc

SEQ ID NO: 170007 - RNA, 32 nt, Human
gccaaucuguucugggcccugauuuugccaca

SEQ ID NO: 170008 - RNA, 23 nt, Human
gccaaucuuuccagcccuccccu

SEQ ID NO: 170009 - RNA, 32 nt, Human
gccaaugagcccccaacagagcucuucaucuu

SEQ ID NO: 170010 - RNA, 32 nt, Human
gccaaugaggcagggcucaugggauugcuuuu

SEQ ID NO: 170011 - RNA, 32 nt, Human
gccaaugagggagggcacguggagccgcgucu

SEQ ID NO: 170012 - RNA, 32 nt, Human
gccaaugaguuggaggcugcagugagcuauaa

SEQ ID NO: 170013 - RNA, 32 nt, Human
gccaaugauccccagauucggggucugaguuu

SEQ ID NO: 170014 - RNA, 21 nt, Human
gccaaugaugcaaaggucccc

SEQ ID NO: 170015 - RNA, 32 nt, Human
gccaaugcacacaaagcacucaauaaauauug

SEQ ID NO: 170016 - RNA, 32 nt, Human
gccaaugcacccccaaccuccaucgcguugca

SEQ ID NO: 170017 - RNA, 32 nt, Human
gccaaugcagccgccauccacgcacaagcaaa

SEQ ID NO: 170018 - RNA, 17 nt, Human
gccaaugccacucagaa

SEQ ID NO: 170019 - RNA, 32 nt, Human
gccaaugccagugacaucaaccaacuuacuuu

SEQ ID NO: 170020 - RNA, 21 nt, Human
gccaauggagacaauuccuga

SEQ ID NO: 170021 - RNA, 20 nt, Human
gccaauggauguccuucccu

SEQ ID NO: 170022 - RNA, 32 nt, Human
gccaauggcaacugccauuugaguccggugag

SEQ ID NO: 170023 - RNA, 32 nt, Human
gccaauggccacuccccuuucagaggaaacca

SEQ ID NO: 170024 - RNA, 32 nt, Human
gccaauggccuggauuaaggguuaggauuauu

SEQ ID NO: 170025 - RNA, 32 nt, Human
gccaaugggaagacacagcaggaagcuagagg

SEQ ID NO: 170026 - RNA, 32 nt, Human
gccaaugggcagaaucuucacuccaggcacau

SEQ ID NO: 170027 - RNA, 32 nt, Human
gccaauggggaaaggacacagaaacaggaacu

SEQ ID NO: 170028 - RNA, 29 nt, Human
gccaauggggagcagccaggaggagggac

SEQ ID NO: 170029 - RNA, 32 nt, Human
gccaaugguaccacccaguuuccugagcuaag

SEQ ID NO: 170030 - RNA, 32 nt, Human
gccaaugguggaguguugguugguaggagagg

SEQ ID NO: 170031 - RNA, 32 nt, Human
gccaauguacuccagccuaggugacagaguga

SEQ ID NO: 170032 - RNA, 32 nt, Human
gccaauguauuccagucugggugacagaguga

SEQ ID NO: 170033 - RNA, 22 nt, Human
gccaauguccacgcggcugcca

SEQ ID NO: 170034 - RNA, 32 nt, Human
gccaauguggcccagggggcuguggggacagu

SEQ ID NO: 170035 - RNA, 32 nt, Human
gccaauguuucuucuguauagauugcuucucg

SEQ ID NO: 170036 - RNA, 32 nt, Human
gccaauguuugaggagaaggccagcaguccuu

SEQ ID NO: 170037 - RNA, 32 nt, Human
gccaauuaggagagugggaagaaaggagcaga

SEQ ID NO: 170038 - RNA, 32 nt, Human
gccaauuauugaccuuccuuccuuccuuccuu

SEQ ID NO: 170039 - RNA, 32 nt, Human
gccaauuccuucuccccgccuuggccacgugu

SEQ ID NO: 170040 - RNA, 32 nt, Human
gccaauugcuuccccucugugaucucauuuca

SEQ ID NO: 170041 - RNA, 32 nt, Human
gccaauuuccacccucucucuggaaacuguca

SEQ ID NO: 170042 - RNA, 32 nt, Human
gccaauuuccacugcuucuuuuuccugugccu

SEQ ID NO: 170043 - RNA, 32 nt, Human
gccaauuucucccauuuggaauggguguauuu

SEQ ID NO: 170044 - RNA, 32 nt, Human
gccaauuuugaguuugguuuguuccugcuuau

SEQ ID NO: 170045 - RNA, 20 nt, Human
gccacaaacaccggcuccgg

SEQ ID NO: 170046 - RNA, 32 nt, Human
gccacaaaucucuacaagugccugcuaucccu

SEQ ID NO: 170047 - RNA, 32 nt, Human
gccacaaauuguauggugauaaaagucacgug

SEQ ID NO: 170048 - RNA, 32 nt, Human
gccacaaauuuccacugguaaccaaagaguac

SEQ ID NO: 170049 - RNA, 32 nt, Human
gccacaacacuuggauuccuguugauuaacuu

SEQ ID NO: 170050 - RNA, 17 nt, Human
gccacaaccacauacaa

SEQ ID NO: 170051 - RNA, 32 nt, Human
gccacaacccaccccgcuuucguaguuuucau

SEQ ID NO: 170052 - RNA, 32 nt, Human
gccacaacccagugaguuuccccagaucucac

SEQ ID NO: 170053 - RNA, 32 nt, Human
gccacaaccgcgcguccucagagccagcccgg

SEQ ID NO: 170054 - RNA, 18 nt, Human
gccacaacuugcuagcug

SEQ ID NO: 170055 - RNA, 19 nt, Human
gccacaagcagccaucacc

SEQ ID NO: 170056 - RNA, 21 nt, Human
gccacaagccugccuccuccc

SEQ ID NO: 170057 - RNA, 32 nt, Human
gccacaaggaagcacaaccagcucgcccuccc

SEQ ID NO: 170058 - RNA, 32 nt, Human
gccacaaggacugcaauuccugggcaaguuca

SEQ ID NO: 170059 - RNA, 32 nt, Human
gccacaaggauagaugcuggcccagggccaga

SEQ ID NO: 170060 - RNA, 19 nt, Human
gccacaaggcgugcgccag

SEQ ID NO: 170061 - RNA, 21 nt, Human
gccacaaguccuccucaggga

SEQ ID NO: 170062 - RNA, 20 nt, Human
gccacaaguuagggcugcug

SEQ ID NO: 170063 - RNA, 18 nt, Human
gccacaaguugcgcugcu

SEQ ID NO: 170064 - RNA, 18 nt, Human
gccacaauacccaccucu

SEQ ID NO: 170065 - RNA, 21 nt, Human
gccacacaaauggucuccaug

SEQ ID NO: 170066 - RNA, 31 nt, Human
gccacacacagcuagaaguccucucccagcu

SEQ ID NO: 170067 - RNA, 32 nt, Human
gccacacacaugcacacauaucuagcauucuu

SEQ ID NO: 170068 - RNA, 32 nt, Human
gccacacacucugcauccgacacccacccccu

SEQ ID NO: 170069 - RNA, 32 nt, Human
gccacacacugcacaucuuuuggugaucgggg

SEQ ID NO: 170070 - RNA, 20 nt, Human
gccacacacuucucccccca

SEQ ID NO: 170071 - RNA, 32 nt, Human
gccacacagcaaguuccgagaccauggauucg

SEQ ID NO: 170072 - RNA, 17 nt, Human
gccacacagccaggguc

SEQ ID NO: 170073 - RNA, 32 nt, Human
gccacacagccccagacccguuuaggaccggg

SEQ ID NO: 170074 - RNA, 23 nt, Human
gccacacagcgugcgcuugcgug

SEQ ID NO: 170075 - RNA, 32 nt, Human
gccacacagcuggucugagauuaggccaggag

SEQ ID NO: 170076 - RNA, 32 nt, Human
gccacacagcuuguaaguggccaaccagaugu

SEQ ID NO: 170077 - RNA, 32 nt, Human
gccacacaggagagaauauacagccugcagag

SEQ ID NO: 170078 - RNA, 18 nt, Human
gccacacaggcacaugca

SEQ ID NO: 170079 - RNA, 22 nt, Human
gccacacaggccacgcacccca

SEQ ID NO: 170080 - RNA, 24 nt, Human
gccacacauuagcugcacugcgug

SEQ ID NO: 170081 - RNA, 32 nt, Human
gccacacauuauacuccaagucccugccgggc

SEQ ID NO: 170082 - RNA, 32 nt, Human
gccacaccaaaccaggaauucuugucgugauu

SEQ ID NO: 170083 - RNA, 28 nt, Human
gccacaccaagugcagcccucguccugg

SEQ ID NO: 170084 - RNA, 20 nt, Human
gccacaccacaucccaggga

SEQ ID NO: 170085 - RNA, 32 nt, Human
gccacaccaccugagcaugugugagggguugg

SEQ ID NO: 170086 - RNA, 32 nt, Human
gccacaccaccugugacuccagcucugacuuc

SEQ ID NO: 170087 - RNA, 18 nt, Human
gccacaccagacucugga

SEQ ID NO: 170088 - RNA, 32 nt, Human
gccacaccagcagaggaugcgaggacgaugac

SEQ ID NO: 170089 - RNA, 32 nt, Human
gccacaccagcuguuucccaccugcugugcag

SEQ ID NO: 170090 - RNA, 22 nt, Human
gccacaccaguccucccaggga

SEQ ID NO: 170091 - RNA, 32 nt, Human
gccacaccauguuucaggcuuggggcuggggc

SEQ ID NO: 170092 - RNA, 32 nt, Human
gccacacccaagggcccagcugucuugccugc

SEQ ID NO: 170093 - RNA, 21 nt, Human
gccacaccccaagaucagggg

SEQ ID NO: 170094 - RNA, 23 nt, Human
gccacaccccaugcaccucaggg

SEQ ID NO: 170095 - RNA, 18 nt, Human
gccacaccccucacaggg

SEQ ID NO: 170096 - RNA, 19 nt, Human
gccacaccccucccuggga

SEQ ID NO: 170097 - RNA, 32 nt, Human
gccacaccccuuaaccuguucugacaaaauag

SEQ ID NO: 170098 - RNA, 32 nt, Human
gccacacccucccuuuuccucacuggaaugga

SEQ ID NO: 170099 - RNA, 32 nt, Human
gccacaccguacuccagccugggcgacaucua

SEQ ID NO: 170100 - RNA, 32 nt, Human
gccacaccgucccucugggccugcuggcuccu

SEQ ID NO: 170101 - RNA, 19 nt, Human
gccacaccgucucgaggga

SEQ ID NO: 170102 - RNA, 32 nt, Human
gccacaccgugccugguggaagaggccgcggu

SEQ ID NO: 170103 - RNA, 20 nt, Human
gccacaccgugucccaggga

SEQ ID NO: 170104 - RNA, 21 nt, Human
gccacaccucucuccccaggg

SEQ ID NO: 170105 - RNA, 32 nt, Human
gccacaccugauauauagaaaaguuuauugug

SEQ ID NO: 170106 - RNA, 19 nt, Human
gccacaccugcaggcgcug

SEQ ID NO: 170107 - RNA, 18 nt, Human
gccacaccugccccugcu

SEQ ID NO: 170108 - RNA, 20 nt, Human
gccacaccuggccuuaaaga

SEQ ID NO: 170109 - RNA, 32 nt, Human
gccacaccugggagcgcauguggaugcacgug

SEQ ID NO: 170110 - RNA, 18 nt, Human
gccacaccugguguucug

SEQ ID NO: 170111 - RNA, 32 nt, Human
gccacaccuugaaaaaggugacuuuggucagc

SEQ ID NO: 170112 - RNA, 19 nt, Human
gccacaccuuucuuuuggg

SEQ ID NO: 170113 - RNA, 32 nt, Human
gccacacgcagcucagccugggcggcacagcc

SEQ ID NO: 170114 - RNA, 22 nt, Human
gccacacgcgguggcaugcaug

SEQ ID NO: 170115 - RNA, 23 nt, Human
gccacacggacucagaggggcca

SEQ ID NO: 170116 - RNA, 32 nt, Human
gccacacuaagcucuguacaagcaugcaccaa

SEQ ID NO: 170117 - RNA, 32 nt, Human
gccacacucagcaacaccaaccccaguuuugu

SEQ ID NO: 170118 - RNA, 22 nt, Human
gccacacucagcuccucaaggg

SEQ ID NO: 170119 - RNA, 32 nt, Human
gccacacucccaccauccucacagaauuccug

SEQ ID NO: 170120 - RNA, 18 nt, Human
gccacacuccgaguccug

SEQ ID NO: 170121 - RNA, 18 nt, Human
gccacacuccgccuugcu

SEQ ID NO: 170122 - RNA, 18 nt, Human
gccacacuccugucagcu

SEQ ID NO: 170123 - RNA, 19 nt, Human
gccacacuccugucagcuu

SEQ ID NO: 170124 - RNA, 18 nt, Human
gccacacucggguaccug

SEQ ID NO: 170125 - RNA, 18 nt, Human
gccacacucucgccgcug

SEQ ID NO: 170126 - RNA, 18 nt, Human
gccacacucucugaacug

SEQ ID NO: 170127 - RNA, 32 nt, Human
gccacacucugccuuccugagucccuuccagu

SEQ ID NO: 170128 - RNA, 18 nt, Human
gccacacucuuucuccug

SEQ ID NO: 170129 - RNA, 23 nt, Human
gccacacucuuuucucccaggga

SEQ ID NO: 170130 - RNA, 32 nt, Human
gccacacugcaaccucagcuuaacaugaauaa

SEQ ID NO: 170131 - RNA, 32 nt, Human
gccacacugcagccuccgccgacucccuccuu

SEQ ID NO: 170132 - RNA, 18 nt, Human
gccacacugccgcugcug

SEQ ID NO: 170133 - RNA, 22 nt, Human
gccacacugcggccccacgccc

SEQ ID NO: 170134 - RNA, 20 nt, Human
gccacacugcugccaccucu

SEQ ID NO: 170135 - RNA, 32 nt, Human
gccacacugcuucucagaaaugagcugcuugc

SEQ ID NO: 170136 - RNA, 32 nt, Human
gccacacuggacuggcgagccuugccgccgcc

SEQ ID NO: 170137 - RNA, 20 nt, Human
gccacacuggcuacccagaa

SEQ ID NO: 170138 - RNA, 32 nt, Human
gccacacuggcuacccagaaaauuucaggcag

SEQ ID NO: 170139 - RNA, 32 nt, Human
gccacacugugacacacuacaccacacacaac

SEQ ID NO: 170140 - RNA, 32 nt, Human
gccacacuuaggcugagcugcagguuuucgca

SEQ ID NO: 170141 - RNA, 32 nt, Human
gccacacuucaaacuacuuugcugcuaauauu

SEQ ID NO: 170142 - RNA, 18 nt, Human
gccacacuucccuuccug

SEQ ID NO: 170143 - RNA, 32 nt, Human
gccacacuucugcccaugccaggagccagcug

SEQ ID NO: 170144 - RNA, 18 nt, Human
gccacacuucugccugcu

SEQ ID NO: 170145 - RNA, 32 nt, Human
gccacagaaagccggacccgcaggagcugugu

SEQ ID NO: 170146 - RNA, 32 nt, Human
gccacagaacaucuuagaugucagccuugacc

SEQ ID NO: 170147 - RNA, 32 nt, Human
gccacagaaccagcucaaguacaugccaaugu

SEQ ID NO: 170148 - RNA, 32 nt, Human
gccacagaagcuggaaaagacaaggaccagau

SEQ ID NO: 170149 - RNA, 32 nt, Human
gccacagacacacacugcuaaaugugaagaug

SEQ ID NO: 170150 - RNA, 32 nt, Human
gccacagacagaaagcauaacauacacucgcc

SEQ ID NO: 170151 - RNA, 17 nt, Human
gccacagaccccucagg

SEQ ID NO: 170152 - RNA, 19 nt, Human
gccacagaccccucagggg

SEQ ID NO: 170153 - RNA, 32 nt, Human
gccacagaccuucagccccacacagcuguagc

SEQ ID NO: 170154 - RNA, 32 nt, Human
gccacagacuccaggagggaggcugcugugug

SEQ ID NO: 170155 - RNA, 32 nt, Human
gccacagacuucuuaagguaaagcuuuucagg

SEQ ID NO: 170156 - RNA, 18 nt, Human
gccacagagcccacccca

SEQ ID NO: 170157 - RNA, 20 nt, Human
gccacagagcccacucccag

SEQ ID NO: 170158 - RNA, 22 nt, Human
gccacagaggagcggaggggcc

SEQ ID NO: 170159 - RNA, 32 nt, Human
gccacagagggcucucgugugggguggugucc

SEQ ID NO: 170160 - RNA, 21 nt, Human
gccacagaguuggggggccau

SEQ ID NO: 170161 - RNA, 19 nt, Human
gccacagauucacccagga

SEQ ID NO: 170162 - RNA, 21 nt, Human
gccacagcaaaggccugcaug

SEQ ID NO: 170163 - RNA, 19 nt, Human
gccacagcaaggagcccga

SEQ ID NO: 170164 - RNA, 32 nt, Human
gccacagcaauggcacacacgugcuccuggag

SEQ ID NO: 170165 - RNA, 32 nt, Human
gccacagcacgcaagagauugccugugauggg

SEQ ID NO: 170166 - RNA, 32 nt, Human
gccacagcacuccagccugggugacagagcaa

SEQ ID NO: 170167 - RNA, 32 nt, Human
gccacagcagccagggcuccagggcgaggaca

SEQ ID NO: 170168 - RNA, 32 nt, Human
gccacagcaggcggugggggcugcguggggac

SEQ ID NO: 170169 - RNA, 32 nt, Human
gccacagcauuuuauuaccuagcuucauauga

SEQ ID NO: 170170 - RNA, 21 nt, Human
gccacagccacagccccugcc

SEQ ID NO: 170171 - RNA, 32 nt, Human
gccacagccagccagcccauccacuucuucca

SEQ ID NO: 170172 - RNA, 32 nt, Human
gccacagccagccugccauaggauccaacugg

SEQ ID NO: 170173 - RNA, 32 nt, Human
gccacagccagccugucguguccagccugacg

SEQ ID NO: 170174 - RNA, 32 nt, Human
gccacagcccauugcagcacugugcuggccag

SEQ ID NO: 170175 - RNA, 32 nt, Human
gccacagcccccuugcccuccgccugggaucu

SEQ ID NO: 170176 - RNA, 32 nt, Human
gccacagcccugccccuccaguuccuuggcag

SEQ ID NO: 170177 - RNA, 31 nt, Human
gccacagcccugccugggccugucucucaag

SEQ ID NO: 170178 - RNA, 32 nt, Human
gccacagccgccgccuccacccccggccccac

SEQ ID NO: 170179 - RNA, 20 nt, Human
gccacagccgccucuccagg

SEQ ID NO: 170180 - RNA, 32 nt, Human
gccacagccggacucaguggagcugcucuucc

SEQ ID NO: 170181 - RNA, 21 nt, Human
gccacagccggcgacccggag

SEQ ID NO: 170182 - RNA, 32 nt, Human
gccacagccuccacaccagaucuccacauugu

SEQ ID NO: 170183 - RNA, 32 nt, Human
gccacagccuccucgccuccccaaacucccag

SEQ ID NO: 170184 - RNA, 32 nt, Human
gccacagccugagugaauccuacaaauauuac

SEQ ID NO: 170185 - RNA, 32 nt, Human
gccacagccugcccaggcagcccugcucaggg

SEQ ID NO: 170186 - RNA, 32 nt, Human
gccacagccuucucaaguccuuccugcagagg

SEQ ID NO: 170187 - RNA, 21 nt, Human
gccacagcggaggacuggcug

SEQ ID NO: 170188 - RNA, 32 nt, Human
gccacagcuaugccccugauaacugcaaaaug

SEQ ID NO: 170189 - RNA, 32 nt, Human
gccacagcucacugugaccuugaccuucugga

SEQ ID NO: 170190 - RNA, 32 nt, Human
gccacagcucagagacugggaaacaugguucc

SEQ ID NO: 170191 - RNA, 22 nt, Human
gccacagcucagggucaaugca

SEQ ID NO: 170192 - RNA, 23 nt, Human
gccacagcucucaccuccuccau

SEQ ID NO: 170193 - RNA, 19 nt, Human
gccacagcucuggcuccug

SEQ ID NO: 170194 - RNA, 32 nt, Human
gccacagcugaggcccuggaccagcucucucc

SEQ ID NO: 170195 - RNA, 32 nt, Human
gccacagcuggggcuuugcaccagccuggcuu

SEQ ID NO: 170196 - RNA, 32 nt, Human
gccacaggaacagcagagcagcucccccaucc

SEQ ID NO: 170197 - RNA, 20 nt, Human
gccacaggaacaggccccgu

SEQ ID NO: 170198 - RNA, 23 nt, Human
gccacaggaaggggccucaggca

SEQ ID NO: 170199 - RNA, 32 nt, Human
gccacaggacugcccauucagucuuguuaaga

SEQ ID NO: 170200 - RNA, 32 nt, Human
gccacaggaggaggaggaggacaugggguuug

SEQ ID NO: 170201 - RNA, 32 nt, Human
gccacaggcaaggggguugcaguggccgccug

SEQ ID NO: 170202 - RNA, 32 nt, Human
gccacaggcccuccgggagcucaggggaacgc

SEQ ID NO: 170203 - RNA, 19 nt, Human
gccacaggcuccagcucug

SEQ ID NO: 170204 - RNA, 32 nt, Human
gccacaggcugcagaagcugcagagaauuuuc

SEQ ID NO: 170205 - RNA, 19 nt, Human
gccacaggcuguggcugcu

SEQ ID NO: 170206 - RNA, 32 nt, Human
gccacagggaaccaugagcucaguggucuugg

SEQ ID NO: 170207 - RNA, 23 nt, Human
gccacagggagcuccgucagcuu

SEQ ID NO: 170208 - RNA, 20 nt, Human
gccacagggcagccuucccu

SEQ ID NO: 170209 - RNA, 32 nt, Human
gccacaggggccccuccucuaaugaguggucg

SEQ ID NO: 170210 - RNA, 32 nt, Human
gccacaggggccugagagcugaagagcaccag

SEQ ID NO: 170211 - RNA, 32 nt, Human
gccacagggguauucugccuucaggacucugc

SEQ ID NO: 170212 - RNA, 19 nt, Human
gccacaggucccucgagug

SEQ ID NO: 170213 - RNA, 32 nt, Human
gccacaggugccacugccuccucaaaucacau

SEQ ID NO: 170214 - RNA, 32 nt, Human
gccacaggugcccacuccccacccugcaggac

SEQ ID NO: 170215 - RNA, 32 nt, Human
gccacaggugccguuaggcugcagccuaauga

SEQ ID NO: 170216 - RNA, 32 nt, Human
gccacaguaaagcaucugcacuugacucaaug

SEQ ID NO: 170217 - RNA, 19 nt, Human
gccacaguaggaggggcca

SEQ ID NO: 170218 - RNA, 23 nt, Human
gccacaguauucccuccuugagg

SEQ ID NO: 170219 - RNA, 32 nt, Human
gccacagucaguccuuuaagcaucaccaugua

SEQ ID NO: 170220 - RNA, 21 nt, Human
gccacaguccagagaaggcca

SEQ ID NO: 170221 - RNA, 32 nt, Human
gccacaguccauggcacuccccauggaggcuu

SEQ ID NO: 170222 - RNA, 20 nt, Human
gccacagucccaugagggcc

SEQ ID NO: 170223 - RNA, 20 nt, Human
gccacaguccuucccagucu

SEQ ID NO: 170224 - RNA, 20 nt, Human
gccacaguccuuccuggggc

SEQ ID NO: 170225 - RNA, 20 nt, Human
gccacagucugggagagcca

SEQ ID NO: 170226 - RNA, 32 nt, Human
gccacagugagcugaugugcccaccaccgugu

SEQ ID NO: 170227 - RNA, 32 nt, Human
gccacagugccacccuccugacccugccgagg

SEQ ID NO: 170228 - RNA, 23 nt, Human
gccacagugcccccacccagugg

SEQ ID NO: 170229 - RNA, 19 nt, Human
gccacagugcucacugcug

SEQ ID NO: 170230 - RNA, 20 nt, Human
gccacagugcugcggcugcu

SEQ ID NO: 170231 - RNA, 26 nt, Human
gccacaguugagaagcggaggggcca

SEQ ID NO: 170232 - RNA, 32 nt, Human
gccacaguugagaagcggaggggccagcugug

SEQ ID NO: 170233 - RNA, 32 nt, Human
gccacaguugauggugagaagcuccuuugacg

SEQ ID NO: 170234 - RNA, 32 nt, Human
gccacaguugcuggauguuuauauagagagua

SEQ ID NO: 170235 - RNA, 21 nt, Human
gccacaguuucagcagaccau

SEQ ID NO: 170236 - RNA, 23 nt, Human
gccacauaagcuguccaccagug

SEQ ID NO: 170237 - RNA, 32 nt, Human
gccacauacuccugcaaagcuuuuaugcugcu

SEQ ID NO: 170238 - RNA, 32 nt, Human
gccacauaggagacacauggugaacagugagc

SEQ ID NO: 170239 - RNA, 32 nt, Human
gccacauauacauacauauauguguauguaug

SEQ ID NO: 170240 - RNA, 32 nt, Human
gccacauaucuagauuuuucugugaaagcucu

SEQ ID NO: 170241 - RNA, 32 nt, Human
gccacauaugagagcucuaguauuuccacaaa

SEQ ID NO: 170242 - RNA, 20 nt, Human
gccacaucaacagaaguaac

SEQ ID NO: 170243 - RNA, 19 nt, Human
gccacaucacuacaguaca

SEQ ID NO: 170244 - RNA, 32 nt, Human
gccacaucacugggacagcuguggauguggau

SEQ ID NO: 170245 - RNA, 32 nt, Human
gccacaucagaaagcagaagaaaacaguauuu

SEQ ID NO: 170246 - RNA, 32 nt, Human
gccacaucagaauaaggccuuggccccauccu

SEQ ID NO: 170247 - RNA, 32 nt, Human
gccacaucagagcugguugggaacccuuugcu

SEQ ID NO: 170248 - RNA, 25 nt, Human
gccacauccacaaauucaaccaacu

SEQ ID NO: 170249 - RNA, 32 nt, Human
gccacauccaccauucacuugcacuugaguga

SEQ ID NO: 170250 - RNA, 32 nt, Human
gccacaucccaaagggggcacaugucccugga

SEQ ID NO: 170251 - RNA, 32 nt, Human
gccacaucccacuggauccacacccgccccca

SEQ ID NO: 170252 - RNA, 32 nt, Human
gccacaucccagggcuuauggugcagcaggug

SEQ ID NO: 170253 - RNA, 32 nt, Human
gccacaucccccaauccaucagugccaaacua

SEQ ID NO: 170254 - RNA, 32 nt, Human
gccacaucccuaagcugccaucucagaccaga

SEQ ID NO: 170255 - RNA, 19 nt, Human
gccacaucccuauagacca

SEQ ID NO: 170256 - RNA, 18 nt, Human
gccacauccuccaccucu

SEQ ID NO: 170257 - RNA, 32 nt, Human
gccacaucuccugccuaguggagaagccuugg

SEQ ID NO: 170258 - RNA, 16 nt, Human
gccacaucugccacca

SEQ ID NO: 170259 - RNA, 32 nt, Human
gccacaucugccucuggcugccugcguccucu

SEQ ID NO: 170260 - RNA, 32 nt, Human
gccacaucugggcugcucugcacccacgggag

SEQ ID NO: 170261 - RNA, 32 nt, Human
gccacaugacaggcacggugggcaccgaucca

SEQ ID NO: 170262 - RNA, 21 nt, Human
gccacaugaggggacagugca

SEQ ID NO: 170263 - RNA, 32 nt, Human
gccacaugauggacaaacgcuugggggaaaaa

SEQ ID NO: 170264 - RNA, 21 nt, Human
gccacaugauuaauccagucu

SEQ ID NO: 170265 - RNA, 32 nt, Human
gccacaugccaacccucaccuccccgaggacu

SEQ ID NO: 170266 - RNA, 18 nt, Human
gccacaugcccuggcugc

SEQ ID NO: 170267 - RNA, 32 nt, Human
gccacaugccuguaauuccagcuacuugggag

SEQ ID NO: 170268 - RNA, 32 nt, Human
gccacaugccuguagucccagcuacuugggaa

SEQ ID NO: 170269 - RNA, 24 nt, Human
gccacauggacuggggugcaaugg

SEQ ID NO: 170270 - RNA, 32 nt, Human
gccacauggauagucccuggauauccuugcug

SEQ ID NO: 170271 - RNA, 21 nt, Human
gccacauggcagggacaaugc

SEQ ID NO: 170272 - RNA, 29 nt, Human
gccacauggcugcuaaaaucaucuuuccc

SEQ ID NO: 170273 - RNA, 19 nt, Human
gccacaugggcacaugcua

SEQ ID NO: 170274 - RNA, 32 nt, Human
gccacaugggguuucaguugcgaaacaggucu

SEQ ID NO: 170275 - RNA, 15 nt, Human
gccacauggguccag

SEQ ID NO: 170276 - RNA, 22 nt, Human
gccacauggguguggucugcau

SEQ ID NO: 170277 - RNA, 17 nt, Human
gccacaugugcacaaug

SEQ ID NO: 170278 - RNA, 32 nt, Human
gccacauguggacccucagccuggguggguuc

SEQ ID NO: 170279 - RNA, 18 nt, Human
gccacauuagugaaccua

SEQ ID NO: 170280 - RNA, 21 nt, Human
gccacauuaucugauccaguc

SEQ ID NO: 170281 - RNA, 22 nt, Human
gccacauucugagguacugggg

SEQ ID NO: 170282 - RNA, 18 nt, Human
gccacauuggugcuguug

SEQ ID NO: 170283 - RNA, 24 nt, Human
gccacauugguucucauccagucu

SEQ ID NO: 170284 - RNA, 23 nt, Human
gccacauugucuuuauccagucu

SEQ ID NO: 170285 - RNA, 32 nt, Human
gccacauuucucaggauuccaugagagaguug

SEQ ID NO: 170286 - RNA, 18 nt, Human
gccacauuuuccucaggu

SEQ ID NO: 170287 - RNA, 32 nt, Human
gccacauuuuguuagcuacugccuguaggcau

SEQ ID NO: 170288 - RNA, 32 nt, Human
gccacauuuuucaugcagaaaagaaccacagg

SEQ ID NO: 170289 - RNA, 21 nt, Human
gccaccaaacccagcccagaa

SEQ ID NO: 170290 - RNA, 32 nt, Human
gccaccaaaggccagggucacugaaggccugg

SEQ ID NO: 170291 - RNA, 23 nt, Human
gccaccaaagggcagccaaggca

SEQ ID NO: 170292 - RNA, 21 nt, Human
gccaccaacagccacucagaa

SEQ ID NO: 170293 - RNA, 32 nt, Human
gccaccaaccaccacugagccuucgaccacug

SEQ ID NO: 170294 - RNA, 18 nt, Human
gccaccaaccccagggaa

SEQ ID NO: 170295 - RNA, 32 nt, Human
gccaccaagaagcuccucgacaacagccacuu

SEQ ID NO: 170296 - RNA, 32 nt, Human
gccaccaagacacagcccugccccacacccac

SEQ ID NO: 170297 - RNA, 32 nt, Human
gccaccaagcacugcaugugggacagggcaca

SEQ ID NO: 170298 - RNA, 25 nt, Human
gccaccaagcugguggcucugugug

SEQ ID NO: 170299 - RNA, 32 nt, Human
gccaccaagggcucugcuccagccucucagag

SEQ ID NO: 170300 - RNA, 32 nt, Human
gccaccaaguauacugaauucuaaggcuagcu

SEQ ID NO: 170301 - RNA, 18 nt, Human
gccaccaauccacccaga

SEQ ID NO: 170302 - RNA, 32 nt, Human
gccaccaaucuaugaagaccucaggccagggg

SEQ ID NO: 170303 - RNA, 19 nt, Human
gccaccacacacaccaucu

SEQ ID NO: 170304 - RNA, 23 nt, Human
gccaccacacaccucugcugccc

SEQ ID NO: 170305 - RNA, 20 nt, Human
gccaccacacccggccgugg

SEQ ID NO: 170306 - RNA, 32 nt, Human
gccaccacacucccacacuccagccuggguaa

SEQ ID NO: 170307 - RNA, 32 nt, Human
gccaccacaucaccccagagaaauuucuggaa

SEQ ID NO: 170308 - RNA, 32 nt, Human
gccaccaccagaucccccucccaggccuuccu

SEQ ID NO: 170309 - RNA, 32 nt, Human
gccaccaccaggagagaggcagaggggcugug

SEQ ID NO: 170310 - RNA, 32 nt, Human
gccaccaccaggagcuagaaagaggcaaggaa

SEQ ID NO: 170311 - RNA, 23 nt, Human
gccaccaccaguucccaucagca

SEQ ID NO: 170312 - RNA, 19 nt, Human
gccaccacccagcauccca

SEQ ID NO: 170313 - RNA, 32 nt, Human
gccaccacccagccuucucuuuauuuucagug

SEQ ID NO: 170314 - RNA, 17 nt, Human
gccaccacccucaggug

SEQ ID NO: 170315 - RNA, 17 nt, Human
gccaccacccucccaga

SEQ ID NO: 170316 - RNA, 20 nt, Human
gccaccaccgccgccgccac

SEQ ID NO: 170317 - RNA, 20 nt, Human
gccaccaccgccgccgccgc

SEQ ID NO: 170318 - RNA, 21 nt, Human
gccaccaccgcgugggucuga

SEQ ID NO: 170319 - RNA, 32 nt, Human
gccaccaccgcuaccucacacagccggggcgc

SEQ ID NO: 170320 - RNA, 32 nt, Human
gccaccaccgcugccgcagccuggcuggggag

SEQ ID NO: 170321 - RNA, 23 nt, Human
gccaccaccggggcacuggcugc

SEQ ID NO: 170322 - RNA, 32 nt, Human
gccaccaccucccacaucccugagguuggcga

SEQ ID NO: 170323 - RNA, 32 nt, Human
gccaccaccuccuccuccuccuggcccugcug

SEQ ID NO: 170324 - RNA, 32 nt, Human
gccaccaccugcugggguccugccucagccca

SEQ ID NO: 170325 - RNA, 16 nt, Human
gccaccacgcccagga

SEQ ID NO: 170326 - RNA, 19 nt, Human
gccaccacgccuggccugc

SEQ ID NO: 170327 - RNA, 32 nt, Human
gccaccacgccuggccuugauuuccuucuuaa

SEQ ID NO: 170328 - RNA, 23 nt, Human
gccaccacugaugccacccagga

SEQ ID NO: 170329 - RNA, 32 nt, Human
gccaccacugcaacuuuuguauucacaggcau

SEQ ID NO: 170330 - RNA, 32 nt, Human
gccaccacugcacuccagccugggcaacagag

SEQ ID NO: 170331 - RNA, 19 nt, Human
gccaccacugccaccacgg

SEQ ID NO: 170332 - RNA, 20 nt, Human
gccaccacugccacucggga

SEQ ID NO: 170333 - RNA, 32 nt, Human
gccaccacugcggccaccgccaaugaaacgcc

SEQ ID NO: 170334 - RNA, 19 nt, Human
gccaccacugcucccagga

SEQ ID NO: 170335 - RNA, 17 nt, Human
gccaccacuguuuagaa

SEQ ID NO: 170336 - RNA, 32 nt, Human
gccaccacuuuauuugguguagcuccucgcuc

SEQ ID NO: 170337 - RNA, 32 nt, Human
gccaccagaaggcuguugucugccuggccuuc

SEQ ID NO: 170338 - RNA, 32 nt, Human
gccaccagacugcuuccugccagccugugcuu

SEQ ID NO: 170339 - RNA, 32 nt, Human
gccaccagagggcgcgcgaucccgccccaacc

SEQ ID NO: 170340 - RNA, 19 nt, Human
gccaccagcaccacccaga

SEQ ID NO: 170341 - RNA, 32 nt, Human
gccaccagcacucacuccagccacuaaagcca

SEQ ID NO: 170342 - RNA, 22 nt, Human
gccaccagcagagccauccuga

SEQ ID NO: 170343 - RNA, 23 nt, Human
gccaccagcagugaguguccuga

SEQ ID NO: 170344 - RNA, 32 nt, Human
gccaccagccaagggcccuggccacgugugcg

SEQ ID NO: 170345 - RNA, 32 nt, Human
gccaccagccaggaagcggaaggugcagaaau

SEQ ID NO: 170346 - RNA, 32 nt, Human
gccaccagccauucagaaaacuucuuauagcu

SEQ ID NO: 170347 - RNA, 32 nt, Human
gccaccagcccagcaugcaccagcucuuucag

SEQ ID NO: 170348 - RNA, 32 nt, Human
gccaccagcccagcuaauuuuuguauuuuuag

SEQ ID NO: 170349 - RNA, 19 nt, Human
gccaccagccccuuaggug

SEQ ID NO: 170350 - RNA, 25 nt, Human
gccaccagccuccauccacagggag

SEQ ID NO: 170351 - RNA, 22 nt, Human
gccaccagccugacacccagaa

SEQ ID NO: 170352 - RNA, 32 nt, Human
gccaccagcucuccacccuccugguuccgcug

SEQ ID NO: 170353 - RNA, 24 nt, Human
gccaccagcugccagccaccagca

SEQ ID NO: 170354 - RNA, 32 nt, Human
gccaccagcugcucgcagcccaugccuggggg

SEQ ID NO: 170355 - RNA, 32 nt, Human
gccaccagcugcuggaugucaccaagaagggg

SEQ ID NO: 170356 - RNA, 30 nt, Human
gccaccagcuugcgguaguagcaagaugcu

SEQ ID NO: 170357 - RNA, 32 nt, Human
gccaccaggaccugaugggccaggaagggcgu

SEQ ID NO: 170358 - RNA, 32 nt, Human
gccaccaggacuccuuguucugcucuggcaag

SEQ ID NO: 170359 - RNA, 32 nt, Human
gccaccaggcacgacuuccuaaacacccacag

SEQ ID NO: 170360 - RNA, 32 nt, Human
gccaccaggccugcugguguuuggcuucucua

SEQ ID NO: 170361 - RNA, 32 nt, Human
gccaccaggccuggcuccuuuuccacuuucau

SEQ ID NO: 170362 - RNA, 32 nt, Human
gccaccaggcucccugugucccuuccauggga

SEQ ID NO: 170363 - RNA, 32 nt, Human
gccaccaggcuggacugggugcagcuuacgga

SEQ ID NO: 170364 - RNA, 21 nt, Human
gccaccaggcugggugcaaug

SEQ ID NO: 170365 - RNA, 32 nt, Human
gccaccagggaccaggggguugaguggaacag

SEQ ID NO: 170366 - RNA, 32 nt, Human
gccaccagggcugaagaugcgagcccguccuc

SEQ ID NO: 170367 - RNA, 32 nt, Human
gccaccagggggagugggcugaagggagagua

SEQ ID NO: 170368 - RNA, 32 nt, Human
gccaccaggguugggcccuguuuagguaauuc

SEQ ID NO: 170369 - RNA, 18 nt, Human
gccaccagucauccagaa

SEQ ID NO: 170370 - RNA, 24 nt, Human
gccaccaucaucaucaucaucauc

SEQ ID NO: 170371 - RNA, 32 nt, Human
gccaccaucccaggacuuugggcaagucaccc

SEQ ID NO: 170372 - RNA, 32 nt, Human
gccaccaucccgcgggggccugggugaggcac

SEQ ID NO: 170373 - RNA, 32 nt, Human
gccaccauccuugucugugcuacugucugcug

SEQ ID NO: 170374 - RNA, 32 nt, Human
gccaccaucugaagauuuaggccagucccuug

SEQ ID NO: 170375 - RNA, 32 nt, Human
gccaccaugagacuugaaggcuucuagcuguc

SEQ ID NO: 170376 - RNA, 31 nt, Human
gccaccaugccacugcacuccagccugggug

SEQ ID NO: 170377 - RNA, 20 nt, Human
gccaccaugccuggcaacau

SEQ ID NO: 170378 - RNA, 32 nt, Human
gccaccaugccuggcuaaucuuuugcagcgau

SEQ ID NO: 170379 - RNA, 32 nt, Human
gccaccaugccuggcuaauuuugguauuuuua

SEQ ID NO: 170380 - RNA, 32 nt, Human
gccaccaugccuggcuaauuuuguauuuuuag

SEQ ID NO: 170381 - RNA, 32 nt, Human
gccaccaugccuggcuaauuuuuguacuuuug

SEQ ID NO: 170382 - RNA, 32 nt, Human
gccaccaugccuggcuaauuuuuguauuuuua

SEQ ID NO: 170383 - RNA, 32 nt, Human
gccaccaugccuggguaauucuguauuuuuag

SEQ ID NO: 170384 - RNA, 32 nt, Human
gccaccaugccuguggccucagccacuuugug

SEQ ID NO: 170385 - RNA, 31 nt, Human
gccaccaugcuggccucagggcugcuucugg

SEQ ID NO: 170386 - RNA, 31 nt, Human
gccaccauggagcuggaggacgguguggugu

SEQ ID NO: 170387 - RNA, 32 nt, Human
gccaccauggccagcuaauuuuuguauuuuua

SEQ ID NO: 170388 - RNA, 32 nt, Human
gccaccauggccugagugguuuucugcugaag

SEQ ID NO: 170389 - RNA, 31 nt, Human
gccaccauggggaaggggguuggacgugaua

SEQ ID NO: 170390 - RNA, 32 nt, Human
gccaccauggggaccugagagggaaggggaca

SEQ ID NO: 170391 - RNA, 22 nt, Human
gccaccaugguuccccauccca

SEQ ID NO: 170392 - RNA, 32 nt, Human
gccaccauguuacacuggacucuaagccacuu

SEQ ID NO: 170393 - RNA, 32 nt, Human
gccaccauuaaugccagcgcauugagggagau

SEQ ID NO: 170394 - RNA, 28 nt, Human
gccaccauuggugcugccuucucuuccc

SEQ ID NO: 170395 - RNA, 32 nt, Human
gccacccaaacagacccuugacucucaagugg

SEQ ID NO: 170396 - RNA, 32 nt, Human
gccacccaaggcaagacacagagcaggaggcu

SEQ ID NO: 170397 - RNA, 32 nt, Human
gccacccaagugccaagacacagcagggccaa

SEQ ID NO: 170398 - RNA, 32 nt, Human
gccacccaauaugcccaccuauuccccggugu

SEQ ID NO: 170399 - RNA, 25 nt, Human
gccacccacaggggcgcuguggcuc

SEQ ID NO: 170400 - RNA, 32 nt, Human
gccacccacaugcagacagcacuuaucccaag

SEQ ID NO: 170401 - RNA, 16 nt, Human
gccacccaccagaguc

SEQ ID NO: 170402 - RNA, 19 nt, Human
gccacccaccagggcucag

SEQ ID NO: 170403 - RNA, 23 nt, Human
gccacccacccaccacucaggug

SEQ ID NO: 170404 - RNA, 18 nt, Human
gccacccacccacccaca

SEQ ID NO: 170405 - RNA, 17 nt, Human
gccacccacccaccucu

SEQ ID NO: 170406 - RNA, 18 nt, Human
gccacccacccagguguc

SEQ ID NO: 170407 - RNA, 20 nt, Human
gccacccacucagcccagaa

SEQ ID NO: 170408 - RNA, 32 nt, Human
gccacccacugcacuggggccagcugggaagc

SEQ ID NO: 170409 - RNA, 18 nt, Human
gccacccagccaggaggg

SEQ ID NO: 170410 - RNA, 18 nt, Human
gccacccagcccagcuuc

SEQ ID NO: 170411 - RNA, 32 nt, Human
gccacccagccccagccagggcucaaucucug

SEQ ID NO: 170412 - RNA, 32 nt, Human
gccacccagccugugugcccucccuggggcug

SEQ ID NO: 170413 - RNA, 19 nt, Human
gccacccagccuugguguc

SEQ ID NO: 170414 - RNA, 19 nt, Human
gccacccagcgucucaggg

SEQ ID NO: 170415 - RNA, 32 nt, Human
gccacccagcuaaucagcagugggaaaagaau

SEQ ID NO: 170416 - RNA, 17 nt, Human
gccacccagcugagguc

SEQ ID NO: 170417 - RNA, 19 nt, Human
gccacccagcugugucccu

SEQ ID NO: 170418 - RNA, 18 nt, Human
gccacccaggacugacug

SEQ ID NO: 170419 - RNA, 32 nt, Human
gccacccaucucccauucacauggcccaccuc

SEQ ID NO: 170420 - RNA, 32 nt, Human
gccacccauucaacaauccccuaagccaggaa

SEQ ID NO: 170421 - RNA, 32 nt, Human
gccaccccaagcucugcucuccuccucuguga

SEQ ID NO: 170422 - RNA, 28 nt, Human
gccaccccaagugugguuaugccuccuc

SEQ ID NO: 170423 - RNA, 32 nt, Human
gccaccccacaaugaauccacccugcuccacu

SEQ ID NO: 170424 - RNA, 27 nt, Human
gccaccccagcccucugguccaucccu

SEQ ID NO: 170425 - RNA, 32 nt, Human
gccaccccagccucauccugcugugccaggcg

SEQ ID NO: 170426 - RNA, 30 nt, Human
gccaccccaggcccugccagagcaggggga

SEQ ID NO: 170427 - RNA, 32 nt, Human
gccaccccaucuuuauaaaauagccucucucu

SEQ ID NO: 170428 - RNA, 15 nt, Human
gccacccccacccca

SEQ ID NO: 170429 - RNA, 32 nt, Human
gccacccccaggaaggaguuugagguucauug

SEQ ID NO: 170430 - RNA, 18 nt, Human
gccacccccaggggccuc

SEQ ID NO: 170431 - RNA, 19 nt, Human
gccacccccauggcgacuc

SEQ ID NO: 170432 - RNA, 16 nt, Human
gccaccccccacccca

SEQ ID NO: 170433 - RNA, 20 nt, Human
gccacccccgggcucgggug

SEQ ID NO: 170434 - RNA, 32 nt, Human
gccacccccucagccuccacagccugccccgc

SEQ ID NO: 170435 - RNA, 18 nt, Human
gccaccccuaauuucuga

SEQ ID NO: 170436 - RNA, 32 nt, Human
gccaccccuccacccccacccccaagugccuu

SEQ ID NO: 170437 - RNA, 32 nt, Human
gccaccccuccaggacagucccucucugugga

SEQ ID NO: 170438 - RNA, 32 nt, Human
gccaccccuccccagucaccaguucuccucug

SEQ ID NO: 170439 - RNA, 32 nt, Human
gccaccccuccuguuccugcagccucuccucc

SEQ ID NO: 170440 - RNA, 20 nt, Human
gccaccccugccacucaccc

SEQ ID NO: 170441 - RNA, 32 nt, Human
gccaccccuucccaguuaccccuuuacccuua

SEQ ID NO: 170442 - RNA, 32 nt, Human
gccacccgaagcucgcucccucucacaguagc

SEQ ID NO: 170443 - RNA, 32 nt, Human
gccacccgcuguucggguucacuggcuuaggg

SEQ ID NO: 170444 - RNA, 25 nt, Human
gccacccgcuuucagcccugugcuc

SEQ ID NO: 170445 - RNA, 32 nt, Human
gccacccggacgccgcugugcagugcguggcc

SEQ ID NO: 170446 - RNA, 17 nt, Human
gccacccgggaacagcu

SEQ ID NO: 170447 - RNA, 23 nt, Human
gccacccguaggcagccucucug

SEQ ID NO: 170448 - RNA, 31 nt, Human
gccacccucaauaaauguugcuuggagugga

SEQ ID NO: 170449 - RNA, 23 nt, Human
gccacccucagaagcugcugguc

SEQ ID NO: 170450 - RNA, 32 nt, Human
gccacccucauacccuguaauuuugucccaaa

SEQ ID NO: 170451 - RNA, 32 nt, Human
gccacccuccacccuucuccccagcgugcugu

SEQ ID NO: 170452 - RNA, 32 nt, Human
gccacccuccauucuaaggcagucucccccuu

SEQ ID NO: 170453 - RNA, 19 nt, Human
gccacccucccucuucaga

SEQ ID NO: 170454 - RNA, 21 nt, Human
gccacccucccucuucagaga

SEQ ID NO: 170455 - RNA, 26 nt, Human
gccacccuccucaugcccacccagca

SEQ ID NO: 170456 - RNA, 32 nt, Human
gccacccucuacugacccucccagggcauucc

SEQ ID NO: 170457 - RNA, 32 nt, Human
gccacccucuccccucccuccugcaaacacca

SEQ ID NO: 170458 - RNA, 17 nt, Human
gccacccucucuccagg

SEQ ID NO: 170459 - RNA, 20 nt, Human
gccacccucugggccuccua

SEQ ID NO: 170460 - RNA, 19 nt, Human
gccacccugaagaaugugc

SEQ ID NO: 170461 - RNA, 32 nt, Human
gccacccugacuuaaaaccacucagagcuaaa

SEQ ID NO: 170462 - RNA, 32 nt, Human
gccacccugaggcagcaagaccagccccuccu

SEQ ID NO: 170463 - RNA, 32 nt, Human
gccacccugcaacccacccucccagccaagga

SEQ ID NO: 170464 - RNA, 16 nt, Human
gccacccugcccaggg

SEQ ID NO: 170465 - RNA, 19 nt, Human
gccacccugccuccucccg

SEQ ID NO: 170466 - RNA, 32 nt, Human
gccacccugccucucaggggucuguguuggga

SEQ ID NO: 170467 - RNA, 32 nt, Human
gccacccugccuggacgccagcuguucuucuc

SEQ ID NO: 170468 - RNA, 32 nt, Human
gccacccugcugcacagcacacugacugagca

SEQ ID NO: 170469 - RNA, 32 nt, Human
gccacccugcuuguugguuauaugaggaugua

SEQ ID NO: 170470 - RNA, 32 nt, Human
gccacccuggacacauguuggcccccucaaag

SEQ ID NO: 170471 - RNA, 32 nt, Human
gccacccuggacaucguggauggcauggcuca

SEQ ID NO: 170472 - RNA, 30 nt, Human
gccacccuggaggacagggcacaacaaccg

SEQ ID NO: 170473 - RNA, 32 nt, Human
gccacccuggaggucauggaggccccagcuga

SEQ ID NO: 170474 - RNA, 32 nt, Human
gccacccugggaaccucacuguucucucuuuc

SEQ ID NO: 170475 - RNA, 32 nt, Human
gccacccugggugccagucucuccuucuguag

SEQ ID NO: 170476 - RNA, 32 nt, Human
gccacccuguucuuccgugucucccucugccu

SEQ ID NO: 170477 - RNA, 18 nt, Human
gccacccuucccacccca

SEQ ID NO: 170478 - RNA, 18 nt, Human
gccacccuucuugcugcc

SEQ ID NO: 170479 - RNA, 29 nt, Human
gccacccuugcaacaaauacaggcgccug

SEQ ID NO: 170480 - RNA, 32 nt, Human
gccacccuugccauuucugcucccagagucuc

SEQ ID NO: 170481 - RNA, 32 nt, Human
gccacccuuggcuccugucccugcugcuccuc

SEQ ID NO: 170482 - RNA, 32 nt, Human
gccacccuuucaggaacccuguaugguuuuua

SEQ ID NO: 170483 - RNA, 32 nt, Human
gccaccgaagccacccugcccuggugaaaggg

SEQ ID NO: 170484 - RNA, 20 nt, Human
gccaccgacgccgguugcug

SEQ ID NO: 170485 - RNA, 32 nt, Human
gccaccgacuuaagguccccagcuucuacagc

SEQ ID NO: 170486 - RNA, 23 nt, Human
gccaccgagccgccgcugugcuc

SEQ ID NO: 170487 - RNA, 20 nt, Human
gccaccgagugcacccagga

SEQ ID NO: 170488 - RNA, 32 nt, Human
gccaccgaugauuuuuguucucccuucuugaa

SEQ ID NO: 170489 - RNA, 32 nt, Human
gccaccgauugcaggacacaagcacaguuuua

SEQ ID NO: 170490 - RNA, 32 nt, Human
gccaccgcacuccagcaugggugacagaguga

SEQ ID NO: 170491 - RNA, 32 nt, Human
gccaccgcacuucagccugggugacagagaag

SEQ ID NO: 170492 - RNA, 32 nt, Human
gccaccgcacuuccagccugggugacagagug

SEQ ID NO: 170493 - RNA, 32 nt, Human
gccaccgcagagcccaggaggcagcaucucca

SEQ ID NO: 170494 - RNA, 18 nt, Human
gccaccgccaacugcagc

SEQ ID NO: 170495 - RNA, 32 nt, Human
gccaccgccaccaccaccuccaccgccgccuc

SEQ ID NO: 170496 - RNA, 23 nt, Human
gccaccgccaccgccaccgccgc

SEQ ID NO: 170497 - RNA, 32 nt, Human
gccaccgccccuccgaauccuccggggccgca

SEQ ID NO: 170498 - RNA, 18 nt, Human
gccaccgcccgccgccac

SEQ ID NO: 170499 - RNA, 22 nt, Human
gccaccgcccgccgccaccagc

SEQ ID NO: 170500 - RNA, 23 nt, Human
gccaccgccgccaccgccgccgc

SEQ ID NO: 170501 - RNA, 20 nt, Human
gccaccgccgccgcccgccg

SEQ ID NO: 170502 - RNA, 20 nt, Human
gccaccgccgccgccgccac

SEQ ID NO: 170503 - RNA, 20 nt, Human
gccaccgccgccgccgccgc

SEQ ID NO: 170504 - RNA, 23 nt, Human
gccaccgccgccgccgccgccac

SEQ ID NO: 170505 - RNA, 23 nt, Human
gccaccgccgccgccgccgccgc

SEQ ID NO: 170506 - RNA, 24 nt, Human
gccaccgccgccguccgccgucac

SEQ ID NO: 170507 - RNA, 23 nt, Human
gccaccgccgccuccgccgccgc

SEQ ID NO: 170508 - RNA, 23 nt, Human
gccaccgccgggaggcugcugua

SEQ ID NO: 170509 - RNA, 32 nt, Human
gccaccgccuccaauccugggccaggagcuuc

SEQ ID NO: 170510 - RNA, 32 nt, Human
gccaccgccugccacaccacuccugccuggug

SEQ ID NO: 170511 - RNA, 32 nt, Human
gccaccgcgaccggcccugcuguugcuucuga

SEQ ID NO: 170512 - RNA, 32 nt, Human
gccaccgcgccuggccugaugccuguguguca

SEQ ID NO: 170513 - RNA, 32 nt, Human
gccaccgcgcuccagccugggugacagagcga

SEQ ID NO: 170514 - RNA, 25 nt, Human
gccaccgcuacgcggccuaccagca

SEQ ID NO: 170515 - RNA, 32 nt, Human
gccaccgcucacugcaagcacugccucccucc

SEQ ID NO: 170516 - RNA, 32 nt, Human
gccaccgcugaggaagagucuccucugagggg

SEQ ID NO: 170517 - RNA, 32 nt, Human
gccaccgcugccucuuuccggcugugacccuc

SEQ ID NO: 170518 - RNA, 32 nt, Human
gccaccgcugugcagugucauguuccagaaau

SEQ ID NO: 170519 - RNA, 32 nt, Human
gccaccggcuccacuuuccccuuuuauuaaua

SEQ ID NO: 170520 - RNA, 32 nt, Human
gccaccgggauccagaggucagcguggggccc

SEQ ID NO: 170521 - RNA, 32 nt, Human
gccaccgggccuggccugcauuuucuuaacug

SEQ ID NO: 170522 - RNA, 32 nt, Human
gccaccgggggaggaggaggaggagaaggugg

SEQ ID NO: 170523 - RNA, 32 nt, Human
gccaccgggugagcucaccgcccagcccaaac

SEQ ID NO: 170524 - RNA, 32 nt, Human
gccaccgugagggggaccauccauccaggaga

SEQ ID NO: 170525 - RNA, 32 nt, Human
gccaccgugccuggccaaugcacacugucauu

SEQ ID NO: 170526 - RNA, 32 nt, Human
gccaccgugccuggccccuaaucugcugaaga

SEQ ID NO: 170527 - RNA, 32 nt, Human
gccaccgugccuugcuauuaaugccaucuauu

SEQ ID NO: 170528 - RNA, 32 nt, Human
gccaccgugggagaggagaggcugcugucacu

SEQ ID NO: 170529 - RNA, 21 nt, Human
gccaccguuagccggggcuca

SEQ ID NO: 170530 - RNA, 32 nt, Human
gccaccuacaaacaccagggaagagcaagauu

SEQ ID NO: 170531 - RNA, 32 nt, Human
gccaccuacacuccagccugggugacagagca

SEQ ID NO: 170532 - RNA, 32 nt, Human
gccaccuacuauauuaaucaugcuaguaacau

SEQ ID NO: 170533 - RNA, 32 nt, Human
gccaccuaugccacagugccuaagggcuaggc

SEQ ID NO: 170534 - RNA, 32 nt, Human
gccaccucacucagccuccucugacagcuccg

SEQ ID NO: 170535 - RNA, 19 nt, Human
gccaccucaucacccagag

SEQ ID NO: 170536 - RNA, 32 nt, Human
gccaccucauuucauccucacagccaccucag

SEQ ID NO: 170537 - RNA, 32 nt, Human
gccaccucauuuccaaacaucucacucaggaa

SEQ ID NO: 170538 - RNA, 32 nt, Human
gccaccuccaaggacucuaaaagggggcuauu

SEQ ID NO: 170539 - RNA, 32 nt, Human
gccaccuccaggcuggcuucagucucccaucc

SEQ ID NO: 170540 - RNA, 32 nt, Human
gccaccuccaugacucuacucucccaaagguu

SEQ ID NO: 170541 - RNA, 32 nt, Human
gccaccucccacuccugcugcacaggcccugg

SEQ ID NO: 170542 - RNA, 19 nt, Human
gccaccucccagaggggcc

SEQ ID NO: 170543 - RNA, 25 nt, Human
gccaccuccccugccagcccaccca

SEQ ID NO: 170544 - RNA, 32 nt, Human
gccaccucccgaugccuccagagucaguggga

SEQ ID NO: 170545 - RNA, 18 nt, Human
gccaccucccgggacaga

SEQ ID NO: 170546 - RNA, 32 nt, Human
gccaccucccuuccucccucccucucuccacu

SEQ ID NO: 170547 - RNA, 32 nt, Human
gccaccuccuaaaaggcccagagagaagagcc

SEQ ID NO: 170548 - RNA, 32 nt, Human
gccaccuccucguccagcccccaaaccucccc

SEQ ID NO: 170549 - RNA, 32 nt, Human
gccaccuccucucuccucugugcucagugagg

SEQ ID NO: 170550 - RNA, 32 nt, Human
gccaccuccugcaugcugugcauguuauuggg

SEQ ID NO: 170551 - RNA, 17 nt, Human
gccaccuccugccacca

SEQ ID NO: 170552 - RNA, 19 nt, Human
gccaccuccugccaccaca

SEQ ID NO: 170553 - RNA, 32 nt, Human
gccaccuccugccucagguguccgcuauccac

SEQ ID NO: 170554 - RNA, 32 nt, Human
gccaccucgccuggccagaugcuagcauuuua

SEQ ID NO: 170555 - RNA, 32 nt, Human
gccaccucggggaacuccagaccaagggugag

SEQ ID NO: 170556 - RNA, 19 nt, Human
gccaccucuccacccagga

SEQ ID NO: 170557 - RNA, 32 nt, Human
gccaccucugagcacuugggcagccacuccuc

SEQ ID NO: 170558 - RNA, 32 nt, Human
gccaccucugcaacugcagcccucagucaccc

SEQ ID NO: 170559 - RNA, 32 nt, Human
gccaccucugcagggguuuccucuucagccug

SEQ ID NO: 170560 - RNA, 17 nt, Human
gccaccucugccugaga

SEQ ID NO: 170561 - RNA, 18 nt, Human
gccaccucugcggcugcu

SEQ ID NO: 170562 - RNA, 32 nt, Human
gccaccucuguccucaccuuguggccagaaua

SEQ ID NO: 170563 - RNA, 32 nt, Human
gccaccugaagcagccacugcccagggggugc

SEQ ID NO: 170564 - RNA, 20 nt, Human
gccaccugacucucaccucu

SEQ ID NO: 170565 - RNA, 32 nt, Human
gccaccugagccaccaccgagccauggcagga

SEQ ID NO: 170566 - RNA, 32 nt, Human
gccaccugagcgccgcucccucucaggaugaa

SEQ ID NO: 170567 - RNA, 32 nt, Human
gccaccugagcuccagccgcccacaaacugcu

SEQ ID NO: 170568 - RNA, 32 nt, Human
gccaccugagcuccugaggccaugucucacca

SEQ ID NO: 170569 - RNA, 32 nt, Human
gccaccugaggcacauccucucugaaacggcu

SEQ ID NO: 170570 - RNA, 21 nt, Human
gccaccugcaauagucuccug

SEQ ID NO: 170571 - RNA, 32 nt, Human
gccaccugcaccugggccuuuuccccaagcaa

SEQ ID NO: 170572 - RNA, 32 nt, Human
gccaccugcagggccucuuuagugcagagaaa

SEQ ID NO: 170573 - RNA, 15 nt, Human
gccaccugcccacca

SEQ ID NO: 170574 - RNA, 32 nt, Human
gccaccugcccagccauguuuggggcuuuauu

SEQ ID NO: 170575 - RNA, 21 nt, Human
gccaccugcccccuucuccca

SEQ ID NO: 170576 - RNA, 32 nt, Human
gccaccugccugacacccagggaugagcagug

SEQ ID NO: 170577 - RNA, 32 nt, Human
gccaccugcuaacucccugccuguguggucau

SEQ ID NO: 170578 - RNA, 32 nt, Human
gccaccugcucaccccacugccuguucuucuc

SEQ ID NO: 170579 - RNA, 32 nt, Human
gccaccugcuguagccacugggcucagcccug

SEQ ID NO: 170580 - RNA, 32 nt, Human
gccaccugcuuuguaaguggauugauuaauaa

SEQ ID NO: 170581 - RNA, 32 nt, Human
gccaccuggacuuccagucuggcuccaaaccu

SEQ ID NO: 170582 - RNA, 32 nt, Human
gccaccuggagggagagcagaccugcggcuga

SEQ ID NO: 170583 - RNA, 32 nt, Human
gccaccuggaggggcgaugaggcuccacgccc

SEQ ID NO: 170584 - RNA, 18 nt, Human
gccaccuggcaccuagaa

SEQ ID NO: 170585 - RNA, 32 nt, Human
gccaccugggcccaccuccucucacugucucu

SEQ ID NO: 170586 - RNA, 32 nt, Human
gccaccugggcccugaguguccacauauguuc

SEQ ID NO: 170587 - RNA, 32 nt, Human
gccaccugggcugcggcggcgacagcgacuuc

SEQ ID NO: 170588 - RNA, 32 nt, Human
gccaccuggugauuuugucucuagugaaacug

SEQ ID NO: 170589 - RNA, 32 nt, Human
gccaccuguagccaucugcacacaccuccgag

SEQ ID NO: 170590 - RNA, 32 nt, Human
gccaccuguccugcagugggccuguguggguu

SEQ ID NO: 170591 - RNA, 32 nt, Human
gccaccugugcccaugggcaccccagagcacc

SEQ ID NO: 170592 - RNA, 32 nt, Human
gccaccugugcuucaccaugcuccauccuccc

SEQ ID NO: 170593 - RNA, 25 nt, Human
gccaccuuacccugcccugacucua

SEQ ID NO: 170594 - RNA, 32 nt, Human
gccaccuuccaggggguaugggagacagguuu

SEQ ID NO: 170595 - RNA, 23 nt, Human
gccaccuucgggagccgccugca

SEQ ID NO: 170596 - RNA, 32 nt, Human
gccaccuucuccccgagcacugcccggccggc

SEQ ID NO: 170597 - RNA, 32 nt, Human
gccaccuucucccuuuccuggaccccagaguc

SEQ ID NO: 170598 - RNA, 21 nt, Human
gccaccuucugagccccaccc

SEQ ID NO: 170599 - RNA, 32 nt, Human
gccaccuucugcugccccggaguccccucccu

SEQ ID NO: 170600 - RNA, 32 nt, Human
gccaccuugccucaccaggccagccccacugg

SEQ ID NO: 170601 - RNA, 32 nt, Human
gccaccuuggaacucugaauagagacuugaag

SEQ ID NO: 170602 - RNA, 32 nt, Human
gccaccuuggccaggcuggcugugggaggguc

SEQ ID NO: 170603 - RNA, 32 nt, Human
gccaccuuggccugcuccucugggccaccucu

SEQ ID NO: 170604 - RNA, 32 nt, Human
gccaccuuggugacauaacagaaacaaaauca

SEQ ID NO: 170605 - RNA, 32 nt, Human
gccaccuuguacagaaccagcacucccagggc

SEQ ID NO: 170606 - RNA, 32 nt, Human
gccaccuuguucagcugccucuuccagagcac

SEQ ID NO: 170607 - RNA, 31 nt, Human
gccaccuuguuucucccugcucaugaggucg

SEQ ID NO: 170608 - RNA, 32 nt, Human
gccaccuuugcugucuugucuccugggacgag

SEQ ID NO: 170609 - RNA, 32 nt, Human
gccaccuuugugcagcuucgaggacaggaaag

SEQ ID NO: 170610 - RNA, 32 nt, Human
gccaccuuuuucucccccgcuggccaggggcu

SEQ ID NO: 170611 - RNA, 32 nt, Human
gccacgaagagagugaacaaucuuaagagcuu

SEQ ID NO: 170612 - RNA, 32 nt, Human
gccacgacagugccaaaaaguugugggucuuc

SEQ ID NO: 170613 - RNA, 32 nt, Human
gccacgacuacaccauggauaccagcuccagc

SEQ ID NO: 170614 - RNA, 32 nt, Human
gccacgagaggcaggcuggcugggacaugagg

SEQ ID NO: 170615 - RNA, 32 nt, Human
gccacgagcuaagaucuggacagggaaccuga

SEQ ID NO: 170616 - RNA, 32 nt, Human
gccacgauggguuuguuucuguuuucuugggu

SEQ ID NO: 170617 - RNA, 32 nt, Human
gccacgcacagacguaacacacaggugccagg

SEQ ID NO: 170618 - RNA, 21 nt, Human
gccacgcacaggcccugcaug

SEQ ID NO: 170619 - RNA, 32 nt, Human
gccacgcacccuacucuugcugguaaaaucac

SEQ ID NO: 170620 - RNA, 32 nt, Human
gccacgcacuccucuguagaugugugcccagu

SEQ ID NO: 170621 - RNA, 19 nt, Human
gccacgcagaguccugccu

SEQ ID NO: 170622 - RNA, 19 nt, Human
gccacgcagccccgccucu

SEQ ID NO: 170623 - RNA, 32 nt, Human
gccacgcaggccugaagccaggagugcggggu

SEQ ID NO: 170624 - RNA, 32 nt, Human
gccacgccacagccacagccgccgccaucacu

SEQ ID NO: 170625 - RNA, 15 nt, Human
gccacgccacgcacu

SEQ ID NO: 170626 - RNA, 32 nt, Human
gccacgcccuuagauuucugcaugagaaucag

SEQ ID NO: 170627 - RNA, 32 nt, Human
gccacgccgaagcucaccuggucagcgcacag

SEQ ID NO: 170628 - RNA, 21 nt, Human
gccacgccgcgugcgcuccgg

SEQ ID NO: 170629 - RNA, 23 nt, Human
gccacgccguguguaggcuuagc

SEQ ID NO: 170630 - RNA, 32 nt, Human
gccacgccuaucuucucucucugcuccuccuu

SEQ ID NO: 170631 - RNA, 32 nt, Human
gccacgccuggacccagagcugauguuuggcu

SEQ ID NO: 170632 - RNA, 32 nt, Human
gccacgccugggaggggcccagcugggguuac

SEQ ID NO: 170633 - RNA, 19 nt, Human
gccacgccuucuucgcaga

SEQ ID NO: 170634 - RNA, 32 nt, Human
gccacgcucagcccugguccggcaggggcucc

SEQ ID NO: 170635 - RNA, 21 nt, Human
gccacgcuccacagccgccgc

SEQ ID NO: 170636 - RNA, 32 nt, Human
gccacgcucuggggcaacuggcaccaggagcu

SEQ ID NO: 170637 - RNA, 32 nt, Human
gccacgcugaccuccugccucuccuaaccuca

SEQ ID NO: 170638 - RNA, 32 nt, Human
gccacgcugcagcagcucacaccucucugcgg

SEQ ID NO: 170639 - RNA, 32 nt, Human
gccacgcugccucucggccuaagcauguagca

SEQ ID NO: 170640 - RNA, 32 nt, Human
gccacgcugccuuccgcuccuccuggucuuuc

SEQ ID NO: 170641 - RNA, 32 nt, Human
gccacgcuuggugcacaggcaagacuugcuuc

SEQ ID NO: 170642 - RNA, 32 nt, Human
gccacggaacaggaagagggugaggcugucca

SEQ ID NO: 170643 - RNA, 32 nt, Human
gccacggaagucucccccuuugccaagccucg

SEQ ID NO: 170644 - RNA, 32 nt, Human
gccacggaauccuauguggagcagaguucuuu

SEQ ID NO: 170645 - RNA, 20 nt, Human
gccacggaauccuucaggug

SEQ ID NO: 170646 - RNA, 32 nt, Human
gccacggagcaguucagaguggaggcgggcuu

SEQ ID NO: 170647 - RNA, 32 nt, Human
gccacggagccccaccuggacacucaccauug

SEQ ID NO: 170648 - RNA, 32 nt, Human
gccacggaggggccaggagucucacaguggag

SEQ ID NO: 170649 - RNA, 32 nt, Human
gccacggcacuccagccugggugacagaguga

SEQ ID NO: 170650 - RNA, 21 nt, Human
gccacggcaggcagcgagcag

SEQ ID NO: 170651 - RNA, 26 nt, Human
gccacggccauggccaugggcagagg

SEQ ID NO: 170652 - RNA, 32 nt, Human
gccacggccauggggccgaaacccagaccucg

SEQ ID NO: 170653 - RNA, 19 nt, Human
gccacggcccccaccagca

SEQ ID NO: 170654 - RNA, 32 nt, Human
gccacggcucugcacagggccuagaugacucu

SEQ ID NO: 170655 - RNA, 32 nt, Human
gccacggcuuacagaccacuacaugaccuaua

SEQ ID NO: 170656 - RNA, 32 nt, Human
gccacgggaacuuggagagggagcuuggagaa

SEQ ID NO: 170657 - RNA, 20 nt, Human
gccacgggacaccucaggug

SEQ ID NO: 170658 - RNA, 32 nt, Human
gccacgggagcuacagcagucgcagccauggg

SEQ ID NO: 170659 - RNA, 32 nt, Human
gccacgggcagggauggaaggagcagugugau

SEQ ID NO: 170660 - RNA, 32 nt, Human
gccacgggccugauuccagaggagccgaacug

SEQ ID NO: 170661 - RNA, 32 nt, Human
gccacgggcucucagggugcuggggcagcccc

SEQ ID NO: 170662 - RNA, 32 nt, Human
gccacgggcucugccagcagacagccuuggca

SEQ ID NO: 170663 - RNA, 32 nt, Human
gccacggggaauggggcugagagccgguuccc

SEQ ID NO: 170664 - RNA, 32 nt, Human
gccacggggaaugguugcaauggcggaggcag

SEQ ID NO: 170665 - RNA, 31 nt, Human
gccacgggugagagagcaggagguaugaauu

SEQ ID NO: 170666 - RNA, 32 nt, Human
gccacggucagagggccccacugugaggcgug

SEQ ID NO: 170667 - RNA, 32 nt, Human
gccacggucggcgggggcugggcgcggccggg

SEQ ID NO: 170668 - RNA, 32 nt, Human
gccacggugcccugugcaccuuugggcugccc

SEQ ID NO: 170669 - RNA, 31 nt, Human
gccacguaccucucuggccuugugcagccag

SEQ ID NO: 170670 - RNA, 21 nt, Human
gccacgucccaccccaccucu

SEQ ID NO: 170671 - RNA, 32 nt, Human
gccacguccucccaaggggccuucugcccgcc

SEQ ID NO: 170672 - RNA, 32 nt, Human
gccacgucugcugaagccaugacuguagcaau

SEQ ID NO: 170673 - RNA, 32 nt, Human
gccacgugcagcugugcucaccccaggucauc

SEQ ID NO: 170674 - RNA, 32 nt, Human
gccacgugcccucuccccucuugaauguacuc

SEQ ID NO: 170675 - RNA, 31 nt, Human
gccacgugugagagagaagaaaaugguggcc

SEQ ID NO: 170676 - RNA, 32 nt, Human
gccacguucccuuuccuccucucccuccugug

SEQ ID NO: 170677 - RNA, 24 nt, Human
gccacguugccuaggcuggucuca

SEQ ID NO: 170678 - RNA, 32 nt, Human
gccacguuuccucugcggaguguagcagcccu

SEQ ID NO: 170679 - RNA, 22 nt, Human
gccacuaaggggaaaaugcaga

SEQ ID NO: 170680 - RNA, 32 nt, Human
gccacuacacuccaaccugggugacagagcga

SEQ ID NO: 170681 - RNA, 32 nt, Human
gccacuacacuccagccugggugacagagaga

SEQ ID NO: 170682 - RNA, 32 nt, Human
gccacuacacuccagccugggugacagaguga

SEQ ID NO: 170683 - RNA, 32 nt, Human
gccacuacaguacagugguuuucuuuucuuug

SEQ ID NO: 170684 - RNA, 32 nt, Human
gccacuaccauccugucaccagugggaccucu

SEQ ID NO: 170685 - RNA, 32 nt, Human
gccacuacuguacucuagccugggcagcagag

SEQ ID NO: 170686 - RNA, 32 nt, Human
gccacuagguauucuugcucccagaggcugaa

SEQ ID NO: 170687 - RNA, 32 nt, Human
gccacuaguacuccagccugggugacagagca

SEQ ID NO: 170688 - RNA, 32 nt, Human
gccacuaguauccuccugcuucccccugccau

SEQ ID NO: 170689 - RNA, 32 nt, Human
gccacuagucuggcagccuccaccucuugacc

SEQ ID NO: 170690 - RNA, 32 nt, Human
gccacuagugaaguuagucaauaaaagacuug

SEQ ID NO: 170691 - RNA, 32 nt, Human
gccacuaucagauuugcacaucaggagaaaag

SEQ ID NO: 170692 - RNA, 22 nt, Human
gccacuauccgcagcagccucg

SEQ ID NO: 170693 - RNA, 32 nt, Human
gccacuaugacuagucccauccuguacaugga

SEQ ID NO: 170694 - RNA, 22 nt, Human
gccacuaugcuuccuccucagg

SEQ ID NO: 170695 - RNA, 32 nt, Human
gccacucaaaagugcugggauuacuggcguca

SEQ ID NO: 170696 - RNA, 32 nt, Human
gccacucacauccucacuuugcugccccacca

SEQ ID NO: 170697 - RNA, 32 nt, Human
gccacucaccacugcugccaccucucuggcca

SEQ ID NO: 170698 - RNA, 32 nt, Human
gccacucacccucucugugcugucuccuccug

SEQ ID NO: 170699 - RNA, 21 nt, Human
gccacucacccuucugcuggc

SEQ ID NO: 170700 - RNA, 32 nt, Human
gccacucacugccuccuuccuccugguguugc

SEQ ID NO: 170701 - RNA, 32 nt, Human
gccacucagaggcucccagcuggguugguggg

SEQ ID NO: 170702 - RNA, 20 nt, Human
gccacucagcuuccuaccca

SEQ ID NO: 170703 - RNA, 24 nt, Human
gccacucaggugaggugcugguca

SEQ ID NO: 170704 - RNA, 32 nt, Human
gccacucaguucuuccuccaccuccacccagu

SEQ ID NO: 170705 - RNA, 32 nt, Human
gccacucauccccuugucucccucucugaacc

SEQ ID NO: 170706 - RNA, 32 nt, Human
gccacuccacaaaccacuaaaauuuuaguuuu

SEQ ID NO: 170707 - RNA, 32 nt, Human
gccacuccacaaccccagcgccagucagcaag

SEQ ID NO: 170708 - RNA, 19 nt, Human
gccacuccaccggcuccua

SEQ ID NO: 170709 - RNA, 32 nt, Human
gccacuccagcagcccugagugggaggagcca

SEQ ID NO: 170710 - RNA, 32 nt, Human
gccacuccagccagcccgccuccggggcggac

SEQ ID NO: 170711 - RNA, 32 nt, Human
gccacuccagggucuccguucugcuagaagcu

SEQ ID NO: 170712 - RNA, 32 nt, Human
gccacucccaccacccugacccugucuuucuc

SEQ ID NO: 170713 - RNA, 32 nt, Human
gccacucccacugucaucagcuuucaccuugg

SEQ ID NO: 170714 - RNA, 32 nt, Human
gccacucccccucccuuucccgcucuucuugc

SEQ ID NO: 170715 - RNA, 32 nt, Human
gccacucccggcacuccaugcuuagucacugc

SEQ ID NO: 170716 - RNA, 22 nt, Human
gccacucccuccagcagccugg

SEQ ID NO: 170717 - RNA, 32 nt, Human
gccacucccugccucucacuccagaccuguuc

SEQ ID NO: 170718 - RNA, 32 nt, Human
gccacuccucccagcucuucugugcuguccac

SEQ ID NO: 170719 - RNA, 20 nt, Human
gccacuccugcauaaagcuc

SEQ ID NO: 170720 - RNA, 21 nt, Human
gccacuccugcugcccuagaa

SEQ ID NO: 170721 - RNA, 32 nt, Human
gccacuccugcuggagggugaacuggggaccc

SEQ ID NO: 170722 - RNA, 22 nt, Human
gccacucgcagcacccuucccu

SEQ ID NO: 170723 - RNA, 32 nt, Human
gccacucgcuguuuggggcccggccuucaaau

SEQ ID NO: 170724 - RNA, 32 nt, Human
gccacucgcuucccugccaucuggcccuuccc

SEQ ID NO: 170725 - RNA, 17 nt, Human
gccacucggccucaggu

SEQ ID NO: 170726 - RNA, 32 nt, Human
gccacucgugucuuucgauggcucccuucccg

SEQ ID NO: 170727 - RNA, 32 nt, Human
gccacucuaagcugggcagacggagcacgagc

SEQ ID NO: 170728 - RNA, 32 nt, Human
gccacucuaccugaaccugcacaccuacgugc

SEQ ID NO: 170729 - RNA, 32 nt, Human
gccacucucaaugacaucugcuguaauuuugg

SEQ ID NO: 170730 - RNA, 32 nt, Human
gccacucucccaggaaggcguggggcugcggc

SEQ ID NO: 170731 - RNA, 22 nt, Human
gccacucuccugaggagcagcc

SEQ ID NO: 170732 - RNA, 32 nt, Human
gccacucucuccagggcucccaacaggauggg

SEQ ID NO: 170733 - RNA, 32 nt, Human
gccacucugagccagagaaggaaggggcaucu

SEQ ID NO: 170734 - RNA, 15 nt, Human
gccacucugccacca

SEQ ID NO: 170735 - RNA, 32 nt, Human
gccacucugccucugccugcauucugccgugu

SEQ ID NO: 170736 - RNA, 32 nt, Human
gccacucuugagccacaauaccugucaccagc

SEQ ID NO: 170737 - RNA, 32 nt, Human
gccacugaaaguccccacacacaaagccuuua

SEQ ID NO: 170738 - RNA, 32 nt, Human
gccacugaacuccagccugggugacagagcaa

SEQ ID NO: 170739 - RNA, 32 nt, Human
gccacugaacuccagccugggugacagaguga

SEQ ID NO: 170740 - RNA, 32 nt, Human
gccacugaagaggaggaggagggucuagaggc

SEQ ID NO: 170741 - RNA, 22 nt, Human
gccacugaaggggguaggggca

SEQ ID NO: 170742 - RNA, 32 nt, Human
gccacugaauacuguuaagaaggagguuuaua

SEQ ID NO: 170743 - RNA, 32 nt, Human
gccacugacccaccgccaccuccgcggagaga

SEQ ID NO: 170744 - RNA, 32 nt, Human
gccacugacccugacagcccacggcggguaca

SEQ ID NO: 170745 - RNA, 32 nt, Human
gccacugacucuuccugcuuccucacuuuccc

SEQ ID NO: 170746 - RNA, 32 nt, Human
gccacugagaacagccaaauucacaaacccuc

SEQ ID NO: 170747 - RNA, 32 nt, Human
gccacugagaagcaggcggguugggugggagg

SEQ ID NO: 170748 - RNA, 32 nt, Human
gccacugagacagcauagccuggguaacggaa

SEQ ID NO: 170749 - RNA, 32 nt, Human
gccacugagaccacgaacccaccagaaggaag

SEQ ID NO: 170750 - RNA, 32 nt, Human
gccacugagcccggccacagugcaguauuucu

SEQ ID NO: 170751 - RNA, 32 nt, Human
gccacugaggagaagguaagggaguacuuugg

SEQ ID NO: 170752 - RNA, 32 nt, Human
gccacugagguggaggaguccucggagacuaa

SEQ ID NO: 170753 - RNA, 32 nt, Human
gccacugaguugcugguugacugaggccaguc

SEQ ID NO: 170754 - RNA, 32 nt, Human
gccacugaucauaccacugcacuccagucugg

SEQ ID NO: 170755 - RNA, 22 nt, Human
gccacugauccugcaacuugcu

SEQ ID NO: 170756 - RNA, 16 nt, Human
gccacugaugcccagg

SEQ ID NO: 170757 - RNA, 32 nt, Human
gccacugcaaagauuccagccuggguccagga

SEQ ID NO: 170758 - RNA, 32 nt, Human
gccacugcaaaugacuugcaguuuccccuaca

SEQ ID NO: 170759 - RNA, 32 nt, Human
gccacugcaacccagccugggugacagagcga

SEQ ID NO: 170760 - RNA, 32 nt, Human
gccacugcaacuccagcuugggugacagagug

SEQ ID NO: 170761 - RNA, 32 nt, Human
gccacugcaaucuagccugggugacagagcaa

SEQ ID NO: 170762 - RNA, 32 nt, Human
gccacugcacaccagccugggugacagagcga

SEQ ID NO: 170763 - RNA, 32 nt, Human
gccacugcacaccagccugggugacaguguga

SEQ ID NO: 170764 - RNA, 32 nt, Human
gccacugcacaccggccugggugacagcauga

SEQ ID NO: 170765 - RNA, 32 nt, Human
gccacugcacacuagcuugggugacagaggaa

SEQ ID NO: 170766 - RNA, 32 nt, Human
gccacugcaccacuccagccugggcaacaaga

SEQ ID NO: 170767 - RNA, 19 nt, Human
gccacugcaccacugcacu

SEQ ID NO: 170768 - RNA, 32 nt, Human
gccacugcaccccagcccgggugacagagcga

SEQ ID NO: 170769 - RNA, 32 nt, Human
gccacugcaccccagccugggugacagagcga

SEQ ID NO: 170770 - RNA, 19 nt, Human
gccacugcacccggccgug

SEQ ID NO: 170771 - RNA, 32 nt, Human
gccacugcaccucuagucugggugacagagca

SEQ ID NO: 170772 - RNA, 32 nt, Human
gccacugcacgcacuccagccugggcgacaga

SEQ ID NO: 170773 - RNA, 32 nt, Human
gccacugcacuauagccuaggugacagaguga

SEQ ID NO: 170774 - RNA, 32 nt, Human
gccacugcacucaagccugggugacagagcga

SEQ ID NO: 170775 - RNA, 32 nt, Human
gccacugcacuccaaccugggugacagacucu

SEQ ID NO: 170776 - RNA, 32 nt, Human
gccacugcacuccaaccugggugacagagcga

SEQ ID NO: 170777 - RNA, 32 nt, Human
gccacugcacuccaaccugggugacagaguga

SEQ ID NO: 170778 - RNA, 32 nt, Human
gccacugcacuccaaucugggugacagaauaa

SEQ ID NO: 170779 - RNA, 32 nt, Human
gccacugcacuccacccugggugacagaguga

SEQ ID NO: 170780 - RNA, 32 nt, Human
gccacugcacuccagacuuggugacagagcaa

SEQ ID NO: 170781 - RNA, 32 nt, Human
gccacugcacuccagcacccugggcgacagag

SEQ ID NO: 170782 - RNA, 32 nt, Human
gccacugcacuccagcagucugggcgacagag

SEQ ID NO: 170783 - RNA, 32 nt, Human
gccacugcacuccagcccaggugacagagcga

SEQ ID NO: 170784 - RNA, 32 nt, Human
gccacugcacuccagcccaggugacagaggga

SEQ ID NO: 170785 - RNA, 32 nt, Human
gccacugcacuccagcccaggugacagaguga

SEQ ID NO: 170786 - RNA, 32 nt, Human
gccacugcacuccagcccgggugacagagcaa

SEQ ID NO: 170787 - RNA, 32 nt, Human
gccacugcacuccagcccgggugacagagcga

SEQ ID NO: 170788 - RNA, 32 nt, Human
gccacugcacuccagccggggugacagaagag

SEQ ID NO: 170789 - RNA, 32 nt, Human
gccacugcacuccagccuaggugacagagcaa

SEQ ID NO: 170790 - RNA, 32 nt, Human
gccacugcacuccagccuaggugacagaggga

SEQ ID NO: 170791 - RNA, 32 nt, Human
gccacugcacuccagccucggugacagagcaa

SEQ ID NO: 170792 - RNA, 32 nt, Human
gccacugcacuccagccugggugacagaacaa

SEQ ID NO: 170793 - RNA, 32 nt, Human
gccacugcacuccagccugggugacagaacga

SEQ ID NO: 170794 - RNA, 32 nt, Human
gccacugcacuccagccugggugacagaauga

SEQ ID NO: 170795 - RNA, 32 nt, Human
gccacugcacuccagccugggugacagagaca

SEQ ID NO: 170796 - RNA, 32 nt, Human
gccacugcacuccagccugggugacagagaga

SEQ ID NO: 170797 - RNA, 32 nt, Human
gccacugcacuccagccugggugacagagcaa

SEQ ID NO: 170798 - RNA, 32 nt, Human
gccacugcacuccagccugggugacagagcag

SEQ ID NO: 170799 - RNA, 32 nt, Human
gccacugcacuccagccugggugacagagcca

SEQ ID NO: 170800 - RNA, 32 nt, Human
gccacugcacuccagccugggugacagagcga

SEQ ID NO: 170801 - RNA, 32 nt, Human
gccacugcacuccagccugggugacagagcgu

SEQ ID NO: 170802 - RNA, 32 nt, Human
gccacugcacuccagccugggugacagaggga

SEQ ID NO: 170803 - RNA, 32 nt, Human
gccacugcacuccagccugggugacagaguaa

SEQ ID NO: 170804 - RNA, 32 nt, Human
gccacugcacuccagccugggugacagaguca

SEQ ID NO: 170805 - RNA, 32 nt, Human
gccacugcacuccagccugggugacagaguga

SEQ ID NO: 170806 - RNA, 32 nt, Human
gccacugcacuccagccugggugacagcgaga

SEQ ID NO: 170807 - RNA, 32 nt, Human
gccacugcacuccagccugggugacagcgcga

SEQ ID NO: 170808 - RNA, 32 nt, Human
gccacugcacuccagccugggugacagggcaa

SEQ ID NO: 170809 - RNA, 32 nt, Human
gccacugcacuccagccugggugacagugaga

SEQ ID NO: 170810 - RNA, 32 nt, Human
gccacugcacuccagccuuggugacagagcaa

SEQ ID NO: 170811 - RNA, 32 nt, Human
gccacugcacuccagcuggagugacagagcca

SEQ ID NO: 170812 - RNA, 32 nt, Human
gccacugcacuccagcuuaggugacagaguga

SEQ ID NO: 170813 - RNA, 32 nt, Human
gccacugcacuccagcuugggugacagagcaa

SEQ ID NO: 170814 - RNA, 32 nt, Human
gccacugcacuccagcuugggugacagaguga

SEQ ID NO: 170815 - RNA, 32 nt, Human
gccacugcacuccaggccugggugacagugcg

SEQ ID NO: 170816 - RNA, 32 nt, Human
gccacugcacuccaggcugggugacagagcga

SEQ ID NO: 170817 - RNA, 32 nt, Human
gccacugcacuccagucugggugacagagaga

SEQ ID NO: 170818 - RNA, 32 nt, Human
gccacugcacuccagucugggugacagaguga

SEQ ID NO: 170819 - RNA, 32 nt, Human
gccacugcacuccagucugggugacagcaaga

SEQ ID NO: 170820 - RNA, 32 nt, Human
gccacugcacuccauccagccugggugacagg

SEQ ID NO: 170821 - RNA, 32 nt, Human
gccacugcacuccauccugggugacagcaaga

SEQ ID NO: 170822 - RNA, 32 nt, Human
gccacugcacucccagccugggcaacggagug

SEQ ID NO: 170823 - RNA, 32 nt, Human
gccacugcacuccggccuaggugacagaggga

SEQ ID NO: 170824 - RNA, 32 nt, Human
gccacugcacuccugccugggugacagaagag

SEQ ID NO: 170825 - RNA, 32 nt, Human
gccacugcacucgagccugggugacagaguga

SEQ ID NO: 170826 - RNA, 32 nt, Human
gccacugcacucuagccucggugacagaguaa

SEQ ID NO: 170827 - RNA, 32 nt, Human
gccacugcacucuagccugggugacagagaga

SEQ ID NO: 170828 - RNA, 32 nt, Human
gccacugcacucuagccugggugacagagcaa

SEQ ID NO: 170829 - RNA, 32 nt, Human
gccacugcacucuagccugggugacagagcga

SEQ ID NO: 170830 - RNA, 32 nt, Human
gccacugcacucuagccugggugacagaguga

SEQ ID NO: 170831 - RNA, 32 nt, Human
gccacugcacucuagccugggugacagauaaa

SEQ ID NO: 170832 - RNA, 32 nt, Human
gccacugcacugcacgccagccuaggcgacag

SEQ ID NO: 170833 - RNA, 32 nt, Human
gccacugcacugcacuccagccugggugacaa

SEQ ID NO: 170834 - RNA, 32 nt, Human
gccacugcacugcaggcugggugacagaguga

SEQ ID NO: 170835 - RNA, 32 nt, Human
gccacugcacuucagccugggugacagaaaga

SEQ ID NO: 170836 - RNA, 32 nt, Human
gccacugcacuucagccugggugacagagcaa

SEQ ID NO: 170837 - RNA, 32 nt, Human
gccacugcacuucagccugggugacagagcua

SEQ ID NO: 170838 - RNA, 32 nt, Human
gccacugcacuucagccugggugacagaguga

SEQ ID NO: 170839 - RNA, 32 nt, Human
gccacugcacuucagcuugggugacagagcca

SEQ ID NO: 170840 - RNA, 32 nt, Human
gccacugcacuuccagccugggugacacagug

SEQ ID NO: 170841 - RNA, 32 nt, Human
gccacugcacuuccagccugggugacagagug

SEQ ID NO: 170842 - RNA, 32 nt, Human
gccacugcacuuuagccugggugacagagcga

SEQ ID NO: 170843 - RNA, 32 nt, Human
gccacugcaggauuugggggcgguggggaaga

SEQ ID NO: 170844 - RNA, 32 nt, Human
gccacugcaguccagccugggugacagagcca

SEQ ID NO: 170845 - RNA, 32 nt, Human
gccacugcaguccgcagcccagccugggcgac

SEQ ID NO: 170846 - RNA, 32 nt, Human
gccacugcaguccgcaguccagccugggcgac

SEQ ID NO: 170847 - RNA, 32 nt, Human
gccacugcauaccagccuaggugacagaauga

SEQ ID NO: 170848 - RNA, 32 nt, Human
gccacugcauuccagccugggcaacagagcaa

SEQ ID NO: 170849 - RNA, 32 nt, Human
gccacugcauuccagccugggcaacagagcga

SEQ ID NO: 170850 - RNA, 32 nt, Human
gccacugcauuccagccugggugacagaauga

SEQ ID NO: 170851 - RNA, 32 nt, Human
gccacugcauuccggccugggcgacagagcga

SEQ ID NO: 170852 - RNA, 22 nt, Human
gccacugccaccgccgccgccu

SEQ ID NO: 170853 - RNA, 32 nt, Human
gccacugccccagggcaugucucuacucacca

SEQ ID NO: 170854 - RNA, 17 nt, Human
gccacugccccaggguc

SEQ ID NO: 170855 - RNA, 32 nt, Human
gccacugcccuccagccugggugacagaguga

SEQ ID NO: 170856 - RNA, 32 nt, Human
gccacugccucccagguucaagugauucuccu

SEQ ID NO: 170857 - RNA, 32 nt, Human
gccacugccuccuggguucaggugauucuccu

SEQ ID NO: 170858 - RNA, 32 nt, Human
gccacugccucuuccucccucauuccaccuuc

SEQ ID NO: 170859 - RNA, 32 nt, Human
gccacugccucuucuuuucccugcugccacuu

SEQ ID NO: 170860 - RNA, 20 nt, Human
gccacugccuucaugcugcc

SEQ ID NO: 170861 - RNA, 19 nt, Human
gccacugccuucugcugcc

SEQ ID NO: 170862 - RNA, 32 nt, Human
gccacugcgacccggcgaagagaaaaaggaac

SEQ ID NO: 170863 - RNA, 32 nt, Human
gccacugcgccuggccuguugcuuauuuuaaa

SEQ ID NO: 170864 - RNA, 32 nt, Human
gccacugcgcuccagccugggugacagaguga

SEQ ID NO: 170865 - RNA, 32 nt, Human
gccacugcguccgguccaucugacuucucaaa

SEQ ID NO: 170866 - RNA, 32 nt, Human
gccacugcucaacuucccccuccugcagggga

SEQ ID NO: 170867 - RNA, 32 nt, Human
gccacugcucuccagccugggugacagaggaa

SEQ ID NO: 170868 - RNA, 32 nt, Human
gccacugcucucuggaugaccuugccaccucc

SEQ ID NO: 170869 - RNA, 32 nt, Human
gccacugcuggcacggugugagcgccaggcau

SEQ ID NO: 170870 - RNA, 32 nt, Human
gccacugcuguuccugucacacauuccugcaa

SEQ ID NO: 170871 - RNA, 32 nt, Human
gccacuggaaaaucccacagggguauaucgag

SEQ ID NO: 170872 - RNA, 16 nt, Human
gccacuggaccacagg

SEQ ID NO: 170873 - RNA, 16 nt, Human
gccacuggacccaggu

SEQ ID NO: 170874 - RNA, 32 nt, Human
gccacuggacucccagccugggugacagagcg

SEQ ID NO: 170875 - RNA, 18 nt, Human
gccacuggagaccucagg

SEQ ID NO: 170876 - RNA, 20 nt, Human
gccacuggaggguccgggug

SEQ ID NO: 170877 - RNA, 18 nt, Human
gccacuggauccagccag

SEQ ID NO: 170878 - RNA, 16 nt, Human
gccacuggaucccagg

SEQ ID NO: 170879 - RNA, 16 nt, Human
gccacuggauccuggu

SEQ ID NO: 170880 - RNA, 32 nt, Human
gccacuggaucggccucacagacucagagcgu

SEQ ID NO: 170881 - RNA, 18 nt, Human
gccacuggaucuucaugg

SEQ ID NO: 170882 - RNA, 17 nt, Human
gccacuggaucuuuggg

SEQ ID NO: 170883 - RNA, 32 nt, Human
gccacuggauuggugguagggcggggcgggcc

SEQ ID NO: 170884 - RNA, 32 nt, Human
gccacuggcaaauguaacugugccaguucuuu

SEQ ID NO: 170885 - RNA, 32 nt, Human
gccacuggcauugccaagaacgugugggcugu

SEQ ID NO: 170886 - RNA, 23 nt, Human
gccacuggcccuugcccaaggca

SEQ ID NO: 170887 - RNA, 17 nt, Human
gccacuggccuuucagg

SEQ ID NO: 170888 - RNA, 32 nt, Human
gccacuggcuaugcaaggccacaaguugugcu

SEQ ID NO: 170889 - RNA, 16 nt, Human
gccacuggcucccagg

SEQ ID NO: 170890 - RNA, 18 nt, Human
gccacuggcucucacgug

SEQ ID NO: 170891 - RNA, 32 nt, Human
gccacuggcugcagaaauggcucgacggggug

SEQ ID NO: 170892 - RNA, 19 nt, Human
gccacuggcuuagcccagg

SEQ ID NO: 170893 - RNA, 22 nt, Human
gccacugggaaauaccaccagu

SEQ ID NO: 170894 - RNA, 32 nt, Human
gccacugggaccccacgcucagcuccgacugg

SEQ ID NO: 170895 - RNA, 32 nt, Human
gccacugggaccccuccccuacaugcaccaau

SEQ ID NO: 170896 - RNA, 32 nt, Human
gccacugggacccgucucagcacauccuggcc

SEQ ID NO: 170897 - RNA, 32 nt, Human
gccacugggagaggggccagaggagcggcuau

SEQ ID NO: 170898 - RNA, 18 nt, Human
gccacugggcacaagcca

SEQ ID NO: 170899 - RNA, 18 nt, Human
gccacugggcgacagagu

SEQ ID NO: 170900 - RNA, 32 nt, Human
gccacugggcuggucugugucugggccugucc

SEQ ID NO: 170901 - RNA, 16 nt, Human
gccacuggggcucagg

SEQ ID NO: 170902 - RNA, 32 nt, Human
gccacuggggucagcauuugagcucagcuaug

SEQ ID NO: 170903 - RNA, 32 nt, Human
gccacugggugaggacacagcaagaagccgcc

SEQ ID NO: 170904 - RNA, 32 nt, Human
gccacugguaccgcggcccagccuggggccug

SEQ ID NO: 170905 - RNA, 18 nt, Human
gccacugguaccugaggu

SEQ ID NO: 170906 - RNA, 17 nt, Human
gccacuggucaaucagg

SEQ ID NO: 170907 - RNA, 19 nt, Human
gccacugguccugcugcug

SEQ ID NO: 170908 - RNA, 32 nt, Human
gccacuggucucaaagcugggcagcccauugc

SEQ ID NO: 170909 - RNA, 18 nt, Human
gccacuggugccucgagu

SEQ ID NO: 170910 - RNA, 32 nt, Human
gccacuggugccuucucuuaguaacagggaac

SEQ ID NO: 170911 - RNA, 32 nt, Human
gccacugguggaggugcacuggaaggucaggg

SEQ ID NO: 170912 - RNA, 32 nt, Human
gccacugguguuuucccugccagugcagguga

SEQ ID NO: 170913 - RNA, 24 nt, Human
gccacugguuucucagaauccaaa

SEQ ID NO: 170914 - RNA, 32 nt, Human
gccacuguacaccagccugggugacagagcaa

SEQ ID NO: 170915 - RNA, 32 nt, Human
gccacuguacaucaccagccugggcgacagag

SEQ ID NO: 170916 - RNA, 32 nt, Human
gccacuguacuccagccuaggugacagagcaa

SEQ ID NO: 170917 - RNA, 32 nt, Human
gccacuguacuccagccugggugacagagcga

SEQ ID NO: 170918 - RNA, 32 nt, Human
gccacuguacuccagccugggugacagaguga

SEQ ID NO: 170919 - RNA, 32 nt, Human
gccacuguacuccagcgugggugacagaguga

SEQ ID NO: 170920 - RNA, 32 nt, Human
gccacuguacugcagccugggugacagaauga

SEQ ID NO: 170921 - RNA, 32 nt, Human
gccacuguauuccaacuugggugacagagcac

SEQ ID NO: 170922 - RNA, 32 nt, Human
gccacuguauuccagacugggugacagaguga

SEQ ID NO: 170923 - RNA, 32 nt, Human
gccacuguccccaccaugaugaugacacagcc

SEQ ID NO: 170924 - RNA, 32 nt, Human
gccacugugaagccucaggaaggggcucggau

SEQ ID NO: 170925 - RNA, 32 nt, Human
gccacugugcaggaguagggaggaaaaggagu

SEQ ID NO: 170926 - RNA, 32 nt, Human
gccacugugccacccccagcccccacccagcc

SEQ ID NO: 170927 - RNA, 19 nt, Human
gccacugugccaggcucag

SEQ ID NO: 170928 - RNA, 32 nt, Human
gccacugugcccagccucacagcugcaucuua

SEQ ID NO: 170929 - RNA, 32 nt, Human
gccacugugccuggccucaacuguugcuucuu

SEQ ID NO: 170930 - RNA, 32 nt, Human
gccacuguucugcgcuuuaauugugggagaag

SEQ ID NO: 170931 - RNA, 32 nt, Human
gccacuuaagguguuggaaucccugggcaaag

SEQ ID NO: 170932 - RNA, 32 nt, Human
gccacuuaauagcucugugaucuugggcaagu

SEQ ID NO: 170933 - RNA, 32 nt, Human
gccacuuagucgggauagaacaugguucgcaa

SEQ ID NO: 170934 - RNA, 32 nt, Human
gccacuucacuccagccugggugacagagacc

SEQ ID NO: 170935 - RNA, 20 nt, Human
gccacuucccaggcugccuc

SEQ ID NO: 170936 - RNA, 18 nt, Human
gccacuuccggggacaga

SEQ ID NO: 170937 - RNA, 22 nt, Human
gccacuuccuagugcacaccuc

SEQ ID NO: 170938 - RNA, 32 nt, Human
gccacuuccuuuccauaaaccauaaugauggg

SEQ ID NO: 170939 - RNA, 32 nt, Human
gccacuucucuuccaggcagggcucucaucgg

SEQ ID NO: 170940 - RNA, 32 nt, Human
gccacuucucuucccuucauucuucgccaggc

SEQ ID NO: 170941 - RNA, 32 nt, Human
gccacuucuuccuacauugauuuaggaugggg

SEQ ID NO: 170942 - RNA, 32 nt, Human
gccacuugaauccuccagggccuguguccuca

SEQ ID NO: 170943 - RNA, 32 nt, Human
gccacuugauuagagaccuagcacaggaggaa

SEQ ID NO: 170944 - RNA, 32 nt, Human
gccacuugcgccucuccagccuccgcaggccc

SEQ ID NO: 170945 - RNA, 32 nt, Human
gccacuuggcugaccagguuguggcagaggau

SEQ ID NO: 170946 - RNA, 32 nt, Human
gccacuugggccaagacugcgccaggugacac

SEQ ID NO: 170947 - RNA, 21 nt, Human
gccacuuggugacagagccag

SEQ ID NO: 170948 - RNA, 32 nt, Human
gccacuuguaucaacuuuacugccuuugucgg

SEQ ID NO: 170949 - RNA, 32 nt, Human
gccacuugucuacaaccaucugaucuuugaca

SEQ ID NO: 170950 - RNA, 31 nt, Human
gccacuuucaauaaagaccugacuuggagac

SEQ ID NO: 170951 - RNA, 32 nt, Human
gccacuuucauggcagcucaucaggcgcaggg

SEQ ID NO: 170952 - RNA, 32 nt, Human
gccacuuucucagggaauuggacagaggaaag

SEQ ID NO: 170953 - RNA, 32 nt, Human
gccacuuucugcauggcucccaccgcagcuga

SEQ ID NO: 170954 - RNA, 32 nt, Human
gccacuuugcaaaggagcucacuguggugucu

SEQ ID NO: 170955 - RNA, 32 nt, Human
gccacuuugccacagaggccucaggcuucucc

SEQ ID NO: 170956 - RNA, 32 nt, Human
gccacuuugguacauggccagugugaucccaa

SEQ ID NO: 170957 - RNA, 32 nt, Human
gccacuuuucuuuccccuuccuuccuuccuuu

SEQ ID NO: 170958 - RNA, 32 nt, Human
gccacuuuuuacucucccuccugaccagucca

SEQ ID NO: 170959 - RNA, 20 nt, Human
gccagaaaacacccaccucu

SEQ ID NO: 170960 - RNA, 32 nt, Human
gccagaaaacaugccuacuacuaccagcagaa

SEQ ID NO: 170961 - RNA, 25 nt, Human
gccagaaaagggccccgccuugcca

SEQ ID NO: 170962 - RNA, 32 nt, Human
gccagaaacagcuucauauggacacugggacu

SEQ ID NO: 170963 - RNA, 23 nt, Human
gccagaaacagugggagcccuga

SEQ ID NO: 170964 - RNA, 32 nt, Human
gccagaaacuuccagaaagaaggagaaacucu

SEQ ID NO: 170965 - RNA, 32 nt, Human
gccagaaagagcugcugcaggagcagccggau

SEQ ID NO: 170966 - RNA, 23 nt, Human
gccagaaagcagaguggcaucac

SEQ ID NO: 170967 - RNA, 32 nt, Human
gccagaaagcccggaagcaaggaaggaaagug

SEQ ID NO: 170968 - RNA, 20 nt, Human
gccagaaauccaggcucuga

SEQ ID NO: 170969 - RNA, 21 nt, Human
gccagaaaugcaaggaacuga

SEQ ID NO: 170970 - RNA, 32 nt, Human
gccagaacacccugagggucucggggcucugg

SEQ ID NO: 170971 - RNA, 32 nt, Human
gccagaaccagcuucuggacucccugcaugga

SEQ ID NO: 170972 - RNA, 32 nt, Human
gccagaaccaggcaccaugguggagaagggau

SEQ ID NO: 170973 - RNA, 32 nt, Human
gccagaaccccuggcagccacagagcucaggc

SEQ ID NO: 170974 - RNA, 32 nt, Human
gccagaacgcaccuggccucugcuccaccuca

SEQ ID NO: 170975 - RNA, 20 nt, Human
gccagaacgccggggcccgg

SEQ ID NO: 170976 - RNA, 32 nt, Human
gccagaacuaugaggguccucucuggcacuag

SEQ ID NO: 170977 - RNA, 21 nt, Human
gccagaacugacuugaaccua

SEQ ID NO: 170978 - RNA, 32 nt, Human
gccagaacugugcccaggcccaaaggagacaa

SEQ ID NO: 170979 - RNA, 23 nt, Human
gccagaagacccaagcuaagcua

SEQ ID NO: 170980 - RNA, 32 nt, Human
gccagaagagaaacugugucacccuaaagaag

SEQ ID NO: 170981 - RNA, 19 nt, Human
gccagaagagaagcacugg

SEQ ID NO: 170982 - RNA, 32 nt, Human
gccagaagcaggugaagagcaaccacaaguuu

SEQ ID NO: 170983 - RNA, 26 nt, Human
gccagaagcaguaagaagacauguug

SEQ ID NO: 170984 - RNA, 32 nt, Human
gccagaagccaggggguggggaagagagacgu

SEQ ID NO: 170985 - RNA, 21 nt, Human
gccagaagcccaggggcucag

SEQ ID NO: 170986 - RNA, 20 nt, Human
gccagaagcccauucccgcc

SEQ ID NO: 170987 - RNA, 32 nt, Human
gccagaagcugauguugaguccguuuugggug

SEQ ID NO: 170988 - RNA, 27 nt, Human
gccagaaggaaugaaggccugcaguga

SEQ ID NO: 170989 - RNA, 32 nt, Human
gccagaaggaaugaaggccugcagugaggaug

SEQ ID NO: 170990 - RNA, 21 nt, Human
gccagaaggccgggugcccag

SEQ ID NO: 170991 - RNA, 25 nt, Human
gccagaaggccgggugcccaggagc

SEQ ID NO: 170992 - RNA, 32 nt, Human
gccagaaggccugcugagggcuguugggagug

SEQ ID NO: 170993 - RNA, 32 nt, Human
gccagaaggccuggcuggcugugacuuaccau

SEQ ID NO: 170994 - RNA, 32 nt, Human
gccagaagggagccagaaguggggcagacaug

SEQ ID NO: 170995 - RNA, 21 nt, Human
gccagaagggagggaaacuga

SEQ ID NO: 170996 - RNA, 32 nt, Human
gccagaaggguccucagacagcccaauaaggg

SEQ ID NO: 170997 - RNA, 32 nt, Human
gccagaagggugccugggaggccagguucugg

SEQ ID NO: 170998 - RNA, 32 nt, Human
gccagaagguucucucugcacagcugccuccc

SEQ ID NO: 170999 - RNA, 22 nt, Human
gccagaagguuguccagcagug

SEQ ID NO: 171000 - RNA, 31 nt, Human
gccagaaguagaccugucuaggcacuaaggg

SEQ ID NO: 171001 - RNA, 32 nt, Human
gccagaagugcaacauguaugugcaaaagcua

SEQ ID NO: 171002 - RNA, 32 nt, Human
gccagaaucgucugauuccuguuucugauuuc

SEQ ID NO: 171003 - RNA, 21 nt, Human
gccagaaucugcuucaccucu

SEQ ID NO: 171004 - RNA, 32 nt, Human
gccagaaugcagauggagcuggcuuggcuguu

SEQ ID NO: 171005 - RNA, 32 nt, Human
gccagaaugguggcucaugccuguaaucccag

SEQ ID NO: 171006 - RNA, 32 nt, Human
gccagacaaagaauucagaaggucaaguauua

SEQ ID NO: 171007 - RNA, 32 nt, Human
gccagacaagauggcaaagugugcagaugguu

SEQ ID NO: 171008 - RNA, 32 nt, Human
gccagacaaucccuccuuuagccagggauuug

SEQ ID NO: 171009 - RNA, 32 nt, Human
gccagacacacccacaccacccacugucugca

SEQ ID NO: 171010 - RNA, 18 nt, Human
gccagacacacuuccucu

SEQ ID NO: 171011 - RNA, 20 nt, Human
gccagacacaggcccucccu

SEQ ID NO: 171012 - RNA, 18 nt, Human
gccagacacaggugccuc

SEQ ID NO: 171013 - RNA, 19 nt, Human
gccagacacaggugccuca

SEQ ID NO: 171014 - RNA, 20 nt, Human
gccagacacauccugccccu

SEQ ID NO: 171015 - RNA, 24 nt, Human
gccagacacaugaugugggcucag

SEQ ID NO: 171016 - RNA, 32 nt, Human
gccagacacaugcacacacaucacacccucaa

SEQ ID NO: 171017 - RNA, 20 nt, Human
gccagacacauggcuauccu

SEQ ID NO: 171018 - RNA, 20 nt, Human
gccagacacauuccaccucu

SEQ ID NO: 171019 - RNA, 21 nt, Human
gccagacaccaccuguucuca

SEQ ID NO: 171020 - RNA, 17 nt, Human
gccagacacccucaccu

SEQ ID NO: 171021 - RNA, 17 nt, Human
gccagacaccuccccuc

SEQ ID NO: 171022 - RNA, 19 nt, Human
gccagacaccugcaucccu

SEQ ID NO: 171023 - RNA, 18 nt, Human
gccagacaccugcgcccu

SEQ ID NO: 171024 - RNA, 32 nt, Human
gccagacacucucuuucagccucuuuugcagg

SEQ ID NO: 171025 - RNA, 17 nt, Human
gccagacacugcacccu

SEQ ID NO: 171026 - RNA, 32 nt, Human
gccagacacugcacccugacuggggauccugu

SEQ ID NO: 171027 - RNA, 32 nt, Human
gccagacacugcacucaugcagcggaaaggac

SEQ ID NO: 171028 - RNA, 17 nt, Human
gccagacacuggccuuu

SEQ ID NO: 171029 - RNA, 32 nt, Human
gccagacagacccugaaaagaaggacggguug

SEQ ID NO: 171030 - RNA, 19 nt, Human
gccagacagacuucaccuc

SEQ ID NO: 171031 - RNA, 19 nt, Human
gccagacagaggccccucu

SEQ ID NO: 171032 - RNA, 32 nt, Human
gccagacaggcagacugggaggauggaggacg

SEQ ID NO: 171033 - RNA, 31 nt, Human
gccagaccaauaaaauaccugguugaaauac

SEQ ID NO: 171034 - RNA, 32 nt, Human
gccagaccagcaaccagauuaucuagugccac

SEQ ID NO: 171035 - RNA, 20 nt, Human
gccagaccagcagagcaggg

SEQ ID NO: 171036 - RNA, 22 nt, Human
gccagaccaggaaccugagcca

SEQ ID NO: 171037 - RNA, 23 nt, Human
gccagaccaggaggccuaggggu

SEQ ID NO: 171038 - RNA, 26 nt, Human
gccagaccaggccagacugaggguca

SEQ ID NO: 171039 - RNA, 32 nt, Human
gccagaccaggccagacugagggucaggggac

SEQ ID NO: 171040 - RNA, 32 nt, Human
gccagaccagugcaauggauagaaugggcugu

SEQ ID NO: 171041 - RNA, 30 nt, Human
gccagacccacuccugccucccacccgggu

SEQ ID NO: 171042 - RNA, 32 nt, Human
gccagacccacugucgccauucccacuucugg

SEQ ID NO: 171043 - RNA, 32 nt, Human
gccagacccaggaccuggacuuccagcagcug

SEQ ID NO: 171044 - RNA, 32 nt, Human
gccagacccaggagccaagagaaggcugaagc

SEQ ID NO: 171045 - RNA, 21 nt, Human
gccagacccagggaccuggag

SEQ ID NO: 171046 - RNA, 32 nt, Human
gccagacccaggugccccagugccuuugucua

SEQ ID NO: 171047 - RNA, 20 nt, Human
gccagacccggagccggagc

SEQ ID NO: 171048 - RNA, 32 nt, Human
gccagacccgggcccugagcucccagcuggag

SEQ ID NO: 171049 - RNA, 32 nt, Human
gccagacccugccuccccucccgccggccaac

SEQ ID NO: 171050 - RNA, 32 nt, Human
gccagacccugggcccucucuccucacugcac

SEQ ID NO: 171051 - RNA, 32 nt, Human
gccagaccgacaccucgcugccagguuguuuc

SEQ ID NO: 171052 - RNA, 19 nt, Human
gccagaccgccuccaccuc

SEQ ID NO: 171053 - RNA, 32 nt, Human
gccagaccuacugcugugcuguuucuuuuucu

SEQ ID NO: 171054 - RNA, 31 nt, Human
gccagaccuagaguguccacagcaggccugu

SEQ ID NO: 171055 - RNA, 32 nt, Human
gccagacgccucaccuucucuccauucuaugg

SEQ ID NO: 171056 - RNA, 17 nt, Human
gccagacgcgccaccuu

SEQ ID NO: 171057 - RNA, 18 nt, Human
gccagacggacagccagc

SEQ ID NO: 171058 - RNA, 20 nt, Human
gccagacggagagccaccuc

SEQ ID NO: 171059 - RNA, 20 nt, Human
gccagacgggcccacccaca

SEQ ID NO: 171060 - RNA, 19 nt, Human
gccagacggggaugcucag

SEQ ID NO: 171061 - RNA, 32 nt, Human
gccagacuccagccuguuuccccagcccugca

SEQ ID NO: 171062 - RNA, 22 nt, Human
gccagacucguaugaggcuccc

SEQ ID NO: 171063 - RNA, 20 nt, Human
gccagacugagaaggcuccc

SEQ ID NO: 171064 - RNA, 32 nt, Human
gccagacugcaacuuaagcuaucuggaaucuu

SEQ ID NO: 171065 - RNA, 32 nt, Human
gccagacugcagcagagugaggagugagggca

SEQ ID NO: 171066 - RNA, 32 nt, Human
gccagacugccuggccuugaaaaucucagcuu

SEQ ID NO: 171067 - RNA, 32 nt, Human
gccagacugccuggcugugcaacuagccuugu

SEQ ID NO: 171068 - RNA, 32 nt, Human
gccagacugccugggccugcccagauggccac

SEQ ID NO: 171069 - RNA, 32 nt, Human
gccagacugccuggguccuggcgccuggcggu

SEQ ID NO: 171070 - RNA, 32 nt, Human
gccagacuggucucaaacuccugggcugaaac

SEQ ID NO: 171071 - RNA, 32 nt, Human
gccagacuguucuguagguuaaguccauugau

SEQ ID NO: 171072 - RNA, 32 nt, Human
gccagacuucucuccagcagcaaagccagccu

SEQ ID NO: 171073 - RNA, 32 nt, Human
gccagacuuggcugauguuuucuuguuucugu

SEQ ID NO: 171074 - RNA, 32 nt, Human
gccagagaaccagcuauaaguccugagaagac

SEQ ID NO: 171075 - RNA, 32 nt, Human
gccagagaaccagcucugaguccugaggagac

SEQ ID NO: 171076 - RNA, 32 nt, Human
gccagagaagaguccuuucuucucuacaucca

SEQ ID NO: 171077 - RNA, 32 nt, Human
gccagagaagccaggugaccagggacccgcgg

SEQ ID NO: 171078 - RNA, 32 nt, Human
gccagagacagcaggagaaggguuggcugugg

SEQ ID NO: 171079 - RNA, 32 nt, Human
gccagagacugauccuggcucugacggcugaa

SEQ ID NO: 171080 - RNA, 21 nt, Human
gccagagagaggcggcagcaa

SEQ ID NO: 171081 - RNA, 18 nt, Human
gccagagagcaccaggga

SEQ ID NO: 171082 - RNA, 32 nt, Human
gccagagagcagagaagagaccuagaggaucu

SEQ ID NO: 171083 - RNA, 32 nt, Human
gccagagagcaucuuuccccugugcuuggaaa

SEQ ID NO: 171084 - RNA, 32 nt, Human
gccagagagcggggcuuagggagacuggccuu

SEQ ID NO: 171085 - RNA, 32 nt, Human
gccagagagcucuucugcaguggugcggccuu

SEQ ID NO: 171086 - RNA, 32 nt, Human
gccagagaggagccaggagccaugaggguggc

SEQ ID NO: 171087 - RNA, 32 nt, Human
gccagagagguagaggcugcagugagcuauga

SEQ ID NO: 171088 - RNA, 32 nt, Human
gccagagaguauuaugagggaggccgaggacu

SEQ ID NO: 171089 - RNA, 20 nt, Human
gccagagauauuccaacucu

SEQ ID NO: 171090 - RNA, 32 nt, Human
gccagagaugcugaagauacagaccuuggaca

SEQ ID NO: 171091 - RNA, 32 nt, Human
gccagagauggacuggacgccgccgggcgcug

SEQ ID NO: 171092 - RNA, 32 nt, Human
gccagagaugucucacagcacauauguacuuu

SEQ ID NO: 171093 - RNA, 32 nt, Human
gccagagcagcacagcaucacacuccacguag

SEQ ID NO: 171094 - RNA, 32 nt, Human
gccagagcaggguggcgcaggagcuggcaaga

SEQ ID NO: 171095 - RNA, 32 nt, Human
gccagagcaguuagccaguuaguccccaggcc

SEQ ID NO: 171096 - RNA, 22 nt, Human
gccagagcaucccccuccucca

SEQ ID NO: 171097 - RNA, 19 nt, Human
gccagagcaucuccaggga

SEQ ID NO: 171098 - RNA, 20 nt, Human
gccagagccaaagccagcua

SEQ ID NO: 171099 - RNA, 21 nt, Human
gccagagccacuuggaacaag

SEQ ID NO: 171100 - RNA, 32 nt, Human
gccagagccagccagcauggccacccucaaga

SEQ ID NO: 171101 - RNA, 32 nt, Human
gccagagccagccuauaguagaguccccugac

SEQ ID NO: 171102 - RNA, 19 nt, Human
gccagagccauuccaccuc

SEQ ID NO: 171103 - RNA, 32 nt, Human
gccagagccauuccaccuccccucccccagca

SEQ ID NO: 171104 - RNA, 21 nt, Human
gccagagcccaagagccagag

SEQ ID NO: 171105 - RNA, 22 nt, Human
gccagagcccaggcuggccuca

SEQ ID NO: 171106 - RNA, 19 nt, Human
gccagagccccuccaccuc

SEQ ID NO: 171107 - RNA, 32 nt, Human
gccagagcccugcugaguuccugcuuucugac

SEQ ID NO: 171108 - RNA, 32 nt, Human
gccagagccgaggcgggcgggggugagaacau

SEQ ID NO: 171109 - RNA, 32 nt, Human
gccagagccugcucuuaacaccuguguuuccu

SEQ ID NO: 171110 - RNA, 32 nt, Human
gccagagccuggggccuccagccugggacugc

SEQ ID NO: 171111 - RNA, 32 nt, Human
gccagagccuugaucccucccuaggcccugcc

SEQ ID NO: 171112 - RNA, 32 nt, Human
gccagagcgaggucuucccacgucacucccgg

SEQ ID NO: 171113 - RNA, 32 nt, Human
gccagagcgccuccucucagauuccuucucga

SEQ ID NO: 171114 - RNA, 32 nt, Human
gccagagcguggaggcggacugugcaugacau

SEQ ID NO: 171115 - RNA, 32 nt, Human
gccagagcuagccaccacccacacugcaaguc

SEQ ID NO: 171116 - RNA, 18 nt, Human
gccagagcugcccccucu

SEQ ID NO: 171117 - RNA, 18 nt, Human
gccagagcugccuccucu

SEQ ID NO: 171118 - RNA, 32 nt, Human
gccagagcuggagcccccacaggguaaggaag

SEQ ID NO: 171119 - RNA, 21 nt, Human
gccagagcugggcccaagggc

SEQ ID NO: 171120 - RNA, 32 nt, Human
gccagagcuguucucccuccccuuaaacuaug

SEQ ID NO: 171121 - RNA, 32 nt, Human
gccagagcuuggaaagaggcagcucugagauu

SEQ ID NO: 171122 - RNA, 32 nt, Human
gccagaggaagaaaggagcuaccugcccuuuc

SEQ ID NO: 171123 - RNA, 21 nt, Human
gccagaggacaaggggccuga

SEQ ID NO: 171124 - RNA, 24 nt, Human
gccagaggacacggcugaugugga

SEQ ID NO: 171125 - RNA, 32 nt, Human
gccagaggacagucaguaaaaaugugaugagu

SEQ ID NO: 171126 - RNA, 22 nt, Human
gccagaggacccagcuaagcca

SEQ ID NO: 171127 - RNA, 32 nt, Human
gccagaggaggcagcgggauuguaguggcgcg

SEQ ID NO: 171128 - RNA, 32 nt, Human
gccagaggaggccacagaccccucaggggagu

SEQ ID NO: 171129 - RNA, 32 nt, Human
gccagaggaggcgguccugguagggagugcgu

SEQ ID NO: 171130 - RNA, 32 nt, Human
gccagaggagggaagagagcgccagacgaagg

SEQ ID NO: 171131 - RNA, 32 nt, Human
gccagaggaggugggagcagagggagcugccc

SEQ ID NO: 171132 - RNA, 32 nt, Human
gccagaggauagaaaucaggaaaucugaaaac

SEQ ID NO: 171133 - RNA, 20 nt, Human
gccagaggcagagacacuga

SEQ ID NO: 171134 - RNA, 32 nt, Human
gccagaggcauggaagucaguguuugugggaa

SEQ ID NO: 171135 - RNA, 32 nt, Human
gccagaggcccaggcugaggagcuuggcggcg

SEQ ID NO: 171136 - RNA, 22 nt, Human
gccagaggccugcggucuccca

SEQ ID NO: 171137 - RNA, 32 nt, Human
gccagaggccuugccuuucagaagaacccuga

SEQ ID NO: 171138 - RNA, 32 nt, Human
gccagaggcuuccuggagguggcagcuuucuu

SEQ ID NO: 171139 - RNA, 32 nt, Human
gccagagggaacaguaacagcccaggggccuu

SEQ ID NO: 171140 - RNA, 32 nt, Human
gccagagggacaccuugguggcacugguggac

SEQ ID NO: 171141 - RNA, 32 nt, Human
gccagagggaguggggacagugcaggcaguau

SEQ ID NO: 171142 - RNA, 32 nt, Human
gccagagggcagcagggagaucagcgaagagg

SEQ ID NO: 171143 - RNA, 32 nt, Human
gccagagggcccagcagccacuguggaccugg

SEQ ID NO: 171144 - RNA, 32 nt, Human
gccagagggcucaggaugggaaaggaagaagg

SEQ ID NO: 171145 - RNA, 32 nt, Human
gccagaggggccugggcuuggcggugccaggc

SEQ ID NO: 171146 - RNA, 32 nt, Human
gccagaggggugggucagagcaguggagggga

SEQ ID NO: 171147 - RNA, 32 nt, Human
gccagaggguccacauccugcccaaaccacuc

SEQ ID NO: 171148 - RNA, 32 nt, Human
gccagaggguuuuaccaaguguucuuugaagc

SEQ ID NO: 171149 - RNA, 21 nt, Human
gccagaggucccaccuuguca

SEQ ID NO: 171150 - RNA, 32 nt, Human
gccagagguggaaggaaggaggaaaggagagg

SEQ ID NO: 171151 - RNA, 32 nt, Human
gccagagguucugcuuguucuugucugccagc

SEQ ID NO: 171152 - RNA, 18 nt, Human
gccagaguauguuccacc

SEQ ID NO: 171153 - RNA, 32 nt, Human
gccagagucaggggacagggagagagcuccac

SEQ ID NO: 171154 - RNA, 32 nt, Human
gccagagucaggggacagggagggagcuccac

SEQ ID NO: 171155 - RNA, 32 nt, Human
gccagaguccugggggccccagaggagcagga

SEQ ID NO: 171156 - RNA, 32 nt, Human
gccagaguccuugagcugucaguucccacagu

SEQ ID NO: 171157 - RNA, 32 nt, Human
gccagagugcgggggccccagcagguucucac

SEQ ID NO: 171158 - RNA, 32 nt, Human
gccagagugguuuaccccauucacaaaauuuc

SEQ ID NO: 171159 - RNA, 32 nt, Human
gccagaguguguucucuggaaacccauccaua

SEQ ID NO: 171160 - RNA, 32 nt, Human
gccagaguuuaaggagggaauggggaaagggg

SEQ ID NO: 171161 - RNA, 20 nt, Human
gccagaguuugucuaccucu

SEQ ID NO: 171162 - RNA, 32 nt, Human
gccagauaaaguggguagguuugcaagcagac

SEQ ID NO: 171163 - RNA, 32 nt, Human
gccagauaccccaugcccaccuggugaagaga

SEQ ID NO: 171164 - RNA, 32 nt, Human
gccagauagccucugucugccuagugagacau

SEQ ID NO: 171165 - RNA, 19 nt, Human
gccagauauaagggcacug

SEQ ID NO: 171166 - RNA, 21 nt, Human
gccagaucaauccacaguucu

SEQ ID NO: 171167 - RNA, 32 nt, Human
gccagauccaggagacaaauuggaccuacagg

SEQ ID NO: 171168 - RNA, 32 nt, Human
gccagauccauggcaauggucuccccacagac

SEQ ID NO: 171169 - RNA, 32 nt, Human
gccagaucccaggcacugcagcaauaucucug

SEQ ID NO: 171170 - RNA, 32 nt, Human
gccagauccucaccuuugaucaucaaggcuga

SEQ ID NO: 171171 - RNA, 32 nt, Human
gccagauccucccagggaaucacuacaggcug

SEQ ID NO: 171172 - RNA, 32 nt, Human
gccagauccucccccuacuucuccccaagggc

SEQ ID NO: 171173 - RNA, 32 nt, Human
gccagauccugagacgcuuccccucccugccc

SEQ ID NO: 171174 - RNA, 32 nt, Human
gccagauccuuucaaagauugccuuuuuauaa

SEQ ID NO: 171175 - RNA, 32 nt, Human
gccagaucggcugcuucucucucuucaagacg

SEQ ID NO: 171176 - RNA, 18 nt, Human
gccagaucuuccacgucu

SEQ ID NO: 171177 - RNA, 32 nt, Human
gccagaugacacuuaagaccuacuugugauau

SEQ ID NO: 171178 - RNA, 18 nt, Human
gccagaugcaccagcccu

SEQ ID NO: 171179 - RNA, 21 nt, Human
gccagaugccugcccaccucu

SEQ ID NO: 171180 - RNA, 32 nt, Human
gccagaugcucaucucugccuggugagcgccc

SEQ ID NO: 171181 - RNA, 32 nt, Human
gccagauggacuccagccugccuggcaggcug

SEQ ID NO: 171182 - RNA, 32 nt, Human
gccagauggaggugguggugccaggaagaaau

SEQ ID NO: 171183 - RNA, 32 nt, Human
gccagauggcaacuauuuugagcuuuaugggc

SEQ ID NO: 171184 - RNA, 21 nt, Human
gccagauggcaggugccuggg

SEQ ID NO: 171185 - RNA, 32 nt, Human
gccagaugugcaccugagaccugaugucuauc

SEQ ID NO: 171186 - RNA, 32 nt, Human
gccagauguggagucugugucugcccccgucu

SEQ ID NO: 171187 - RNA, 22 nt, Human
gccagauguuggcaccaccucu

SEQ ID NO: 171188 - RNA, 32 nt, Human
gccagauguuuuccuuucuuccuucuuuacug

SEQ ID NO: 171189 - RNA, 24 nt, Human
gccagauugacuggggauguccgg

SEQ ID NO: 171190 - RNA, 32 nt, Human
gccagauugcagcccgcgaccuucccggauua

SEQ ID NO: 171191 - RNA, 32 nt, Human
gccagauuggagaagauccaagccaggaagau

SEQ ID NO: 171192 - RNA, 32 nt, Human
gccagcaaagccuccagcaucuuuuccauccu

SEQ ID NO: 171193 - RNA, 16 nt, Human
gccagcaaaucuggga

SEQ ID NO: 171194 - RNA, 32 nt, Human
gccagcaacagcuuccuucuuugagcuuaggu

SEQ ID NO: 171195 - RNA, 32 nt, Human
gccagcaacauucugaggguucuaggaauggc

SEQ ID NO: 171196 - RNA, 21 nt, Human
gccagcaaccaaaucccaugu

SEQ ID NO: 171197 - RNA, 32 nt, Human
gccagcaagauagcaaaagcaggaagagagcc

SEQ ID NO: 171198 - RNA, 25 nt, Human
gccagcaagcagggaaguggagcaa

SEQ ID NO: 171199 - RNA, 19 nt, Human
gccagcaagcccagaggca

SEQ ID NO: 171200 - RNA, 32 nt, Human
gccagcaagcuaaagcauggcggccauccccu

SEQ ID NO: 171201 - RNA, 20 nt, Human
gccagcaagcugcccccucc

SEQ ID NO: 171202 - RNA, 32 nt, Human
gccagcaauccaaaggcucuuuucagagccac

SEQ ID NO: 171203 - RNA, 32 nt, Human
gccagcaauugcugaagguggcgaugaacacc

SEQ ID NO: 171204 - RNA, 32 nt, Human
gccagcacaagagcacacaggaggccggcaua

SEQ ID NO: 171205 - RNA, 32 nt, Human
gccagcacagcagcucaugccuguaauccuag

SEQ ID NO: 171206 - RNA, 32 nt, Human
gccagcacagugccugaugccucccuaggcau

SEQ ID NO: 171207 - RNA, 32 nt, Human
gccagcacauccugccugcuguugcagccugg

SEQ ID NO: 171208 - RNA, 20 nt, Human
gccagcaccacaugcagcag

SEQ ID NO: 171209 - RNA, 22 nt, Human
gccagcacccagaaacccagca

SEQ ID NO: 171210 - RNA, 17 nt, Human
gccagcacccccacccu

SEQ ID NO: 171211 - RNA, 32 nt, Human
gccagcaccccuggcuggaguggguuaaaggg

SEQ ID NO: 171212 - RNA, 19 nt, Human
gccagcacccucugcugcu

SEQ ID NO: 171213 - RNA, 19 nt, Human
gccagcaccgcucuagcug

SEQ ID NO: 171214 - RNA, 19 nt, Human
gccagcaccugcucaggga

SEQ ID NO: 171215 - RNA, 20 nt, Human
gccagcaccuggagcaccaa

SEQ ID NO: 171216 - RNA, 23 nt, Human
gccagcaccuugacuuggcagca

SEQ ID NO: 171217 - RNA, 32 nt, Human
gccagcaccuugacuuuagccuggugagaucc

SEQ ID NO: 171218 - RNA, 32 nt, Human
gccagcacggcugcuaacagacugccacuuga

SEQ ID NO: 171219 - RNA, 32 nt, Human
gccagcacuaaacaccagaaaggaggagggaa

SEQ ID NO: 171220 - RNA, 21 nt, Human
gccagcacuaacuccaccucu

SEQ ID NO: 171221 - RNA, 32 nt, Human
gccagcacucagggcucucugccuucuaugug

SEQ ID NO: 171222 - RNA, 22 nt, Human
gccagcacuccucaccccggua

SEQ ID NO: 171223 - RNA, 32 nt, Human
gccagcacuccugccaucacagggccccucaa

SEQ ID NO: 171224 - RNA, 32 nt, Human
gccagcacucugaagcuuguucccucuccucc

SEQ ID NO: 171225 - RNA, 32 nt, Human
gccagcacucuggaggcugcugcuaaguggau

SEQ ID NO: 171226 - RNA, 32 nt, Human
gccagcacucuggaggcugcugcugaguggac

SEQ ID NO: 171227 - RNA, 32 nt, Human
gccagcacugccgcuuccaccugggccaccca

SEQ ID NO: 171228 - RNA, 32 nt, Human
gccagcacugggugagaguggggagggggcau

SEQ ID NO: 171229 - RNA, 32 nt, Human
gccagcacugucccccuuccucuucuucugcc

SEQ ID NO: 171230 - RNA, 32 nt, Human
gccagcagaaacauuugucugcccucacccuu

SEQ ID NO: 171231 - RNA, 32 nt, Human
gccagcagaaaggagccagggaguacgcaccc

SEQ ID NO: 171232 - RNA, 32 nt, Human
gccagcagaacagcacuccugggcggcuccug

SEQ ID NO: 171233 - RNA, 32 nt, Human
gccagcagacuggccagcgccucuguguaggg

SEQ ID NO: 171234 - RNA, 32 nt, Human
gccagcagaggagccagcuuacaggaugggag

SEQ ID NO: 171235 - RNA, 32 nt, Human
gccagcagaggggucuggggucagccuuugga

SEQ ID NO: 171236 - RNA, 23 nt, Human
gccagcagaugaggcagcagcaa

SEQ ID NO: 171237 - RNA, 32 nt, Human
gccagcagccccagacugcccaaaaacuugcc

SEQ ID NO: 171238 - RNA, 18 nt, Human
gccagcagccccgccucu

SEQ ID NO: 171239 - RNA, 17 nt, Human
gccagcagccccugccc

SEQ ID NO: 171240 - RNA, 18 nt, Human
gccagcagcccggggcuc

SEQ ID NO: 171241 - RNA, 32 nt, Human
gccagcagcccugcacuccacgcuggccaaga

SEQ ID NO: 171242 - RNA, 24 nt, Human
gccagcagccuguccguccggcuc

SEQ ID NO: 171243 - RNA, 21 nt, Human
gccagcagcgccggggcccgg

SEQ ID NO: 171244 - RNA, 32 nt, Human
gccagcagcucugugguucaaguuuccucaag

SEQ ID NO: 171245 - RNA, 32 nt, Human
gccagcagcugaugccuccuuggccaccagac

SEQ ID NO: 171246 - RNA, 32 nt, Human
gccagcagcugcagaggaugugccgguccccu

SEQ ID NO: 171247 - RNA, 21 nt, Human
gccagcagcugccagggccuc

SEQ ID NO: 171248 - RNA, 18 nt, Human
gccagcagcugcuccugg

SEQ ID NO: 171249 - RNA, 32 nt, Human
gccagcagcuuggguugagaugaaugaugugu

SEQ ID NO: 171250 - RNA, 32 nt, Human
gccagcaggaagcacagccgccaccgccgccg

SEQ ID NO: 171251 - RNA, 18 nt, Human
gccagcaggccgccugca

SEQ ID NO: 171252 - RNA, 17 nt, Human
gccagcaggcucacgca

SEQ ID NO: 171253 - RNA, 32 nt, Human
gccagcaggcugggggagcagugagggcaggg

SEQ ID NO: 171254 - RNA, 20 nt, Human
gccagcagggccccaucucu

SEQ ID NO: 171255 - RNA, 32 nt, Human
gccagcaggggaagaaaaagaugcugcugcuc

SEQ ID NO: 171256 - RNA, 32 nt, Human
gccagcagguggagcuugacgugacgucuuaa

SEQ ID NO: 171257 - RNA, 32 nt, Human
gccagcagucugcgaggcuggggaggauggag

SEQ ID NO: 171258 - RNA, 21 nt, Human
gccagcagugaccacaguucu

SEQ ID NO: 171259 - RNA, 19 nt, Human
gccagcagugaccuugggg

SEQ ID NO: 171260 - RNA, 32 nt, Human
gccagcagugcacagugccuggcagguugacu

SEQ ID NO: 171261 - RNA, 32 nt, Human
gccagcaguuuccugccagauauugcccagcg

SEQ ID NO: 171262 - RNA, 32 nt, Human
gccagcaucaugcuugcugugcagccugcaga

SEQ ID NO: 171263 - RNA, 32 nt, Human
gccagcauccugagccuccucaugcccuggac

SEQ ID NO: 171264 - RNA, 32 nt, Human
gccagcauccuugagccaggaucucaucuguu

SEQ ID NO: 171265 - RNA, 32 nt, Human
gccagcauccuuggaucaguacugaacucagu

SEQ ID NO: 171266 - RNA, 17 nt, Human
gccagcaucuccaccuu

SEQ ID NO: 171267 - RNA, 32 nt, Human
gccagcaugccugccugacccaccucagagcc

SEQ ID NO: 171268 - RNA, 32 nt, Human
gccagcaugccugucuaauuuuuguauuuuag

SEQ ID NO: 171269 - RNA, 32 nt, Human
gccagcaugcuacccugggaggcacauccagg

SEQ ID NO: 171270 - RNA, 32 nt, Human
gccagcauggacaacauagugaggccuugucu

SEQ ID NO: 171271 - RNA, 23 nt, Human
gccagcauggcagacagaagaaa

SEQ ID NO: 171272 - RNA, 32 nt, Human
gccagcaugguggcucaugccuguaaucccag

SEQ ID NO: 171273 - RNA, 32 nt, Human
gccagcaugucacugguuuugaagggaugagc

SEQ ID NO: 171274 - RNA, 20 nt, Human
gccagcauuggagaagaagc

SEQ ID NO: 171275 - RNA, 32 nt, Human
gccagcauugugcccaggcuagggggcuauag

SEQ ID NO: 171276 - RNA, 22 nt, Human
gccagcauuuugccacguucua

SEQ ID NO: 171277 - RNA, 32 nt, Human
gccagccaaggccaguggagugcugugggguc

SEQ ID NO: 171278 - RNA, 32 nt, Human
gccagccaagucaguuccuggugaggguucuc

SEQ ID NO: 171279 - RNA, 32 nt, Human
gccagccaaucagcaggacuccugccuuccuu

SEQ ID NO: 171280 - RNA, 32 nt, Human
gccagccacucgccccuggccucgcgggccgu

SEQ ID NO: 171281 - RNA, 32 nt, Human
gccagccacucuaccagugcaggcuggccagc

SEQ ID NO: 171282 - RNA, 32 nt, Human
gccagccacuguguugucacugggcgaguaau

SEQ ID NO: 171283 - RNA, 32 nt, Human
gccagccagacaucauucucuggacuacuuug

SEQ ID NO: 171284 - RNA, 32 nt, Human
gccagccagaccaugaacccaccagaaggaaa

SEQ ID NO: 171285 - RNA, 32 nt, Human
gccagccagcacucaggcccggagcucgggga

SEQ ID NO: 171286 - RNA, 32 nt, Human
gccagccagcacucuggccuccugccgccgca

SEQ ID NO: 171287 - RNA, 32 nt, Human
gccagccagcuccaucucgcugccuauuggac

SEQ ID NO: 171288 - RNA, 20 nt, Human
gccagccagcugcuguucua

SEQ ID NO: 171289 - RNA, 32 nt, Human
gccagccaggagcugaaagaagcaguuagguc

SEQ ID NO: 171290 - RNA, 32 nt, Human
gccagccaggcagcuucucugccugggagggg

SEQ ID NO: 171291 - RNA, 24 nt, Human
gccagccaggcuggagugcagugg

SEQ ID NO: 171292 - RNA, 32 nt, Human
gccagccagggacauagccagggaggggccac

SEQ ID NO: 171293 - RNA, 26 nt, Human
gccagcccaaguucgcucucugcaca

SEQ ID NO: 171294 - RNA, 32 nt, Human
gccagcccacaggguucccccaccucagaguu

SEQ ID NO: 171295 - RNA, 32 nt, Human
gccagcccacuacccacccccacuacagcauu

SEQ ID NO: 171296 - RNA, 32 nt, Human
gccagcccagaacagagaaucagcuggagccc

SEQ ID NO: 171297 - RNA, 32 nt, Human
gccagcccagacaacagagugagacccccauc

SEQ ID NO: 171298 - RNA, 21 nt, Human
gccagcccagacccuccccca

SEQ ID NO: 171299 - RNA, 32 nt, Human
gccagcccagaucaacugggaaccacugaugg

SEQ ID NO: 171300 - RNA, 32 nt, Human
gccagcccagaugagcaacuuucucauaacaa

SEQ ID NO: 171301 - RNA, 19 nt, Human
gccagcccagcccagcucc

SEQ ID NO: 171302 - RNA, 19 nt, Human
gccagcccagcgcccgcuc

SEQ ID NO: 171303 - RNA, 20 nt, Human
gccagcccagcuccagcucc

SEQ ID NO: 171304 - RNA, 32 nt, Human
gccagcccagcuccaguguccaaaaagcgguu

SEQ ID NO: 171305 - RNA, 32 nt, Human
gccagcccagcucuccccucugcacccuuggc

SEQ ID NO: 171306 - RNA, 32 nt, Human
gccagcccaggagaucaucaugcaaucgucuu

SEQ ID NO: 171307 - RNA, 19 nt, Human
gccagcccaggcacccucc

SEQ ID NO: 171308 - RNA, 22 nt, Human
gccagcccaggcgccccuuccc

SEQ ID NO: 171309 - RNA, 32 nt, Human
gccagcccaucaggaagccuuccuggcuucuc

SEQ ID NO: 171310 - RNA, 17 nt, Human
gccagccccacccagga

SEQ ID NO: 171311 - RNA, 32 nt, Human
gccagccccacccaggagggagggggcuauag

SEQ ID NO: 171312 - RNA, 32 nt, Human
gccagccccacuccugacaccugggcccuuga

SEQ ID NO: 171313 - RNA, 18 nt, Human
gccagccccaggcugcug

SEQ ID NO: 171314 - RNA, 32 nt, Human
gccagccccauccccuccaccccacaccugag

SEQ ID NO: 171315 - RNA, 20 nt, Human
gccagcccccaccuaggguc

SEQ ID NO: 171316 - RNA, 32 nt, Human
gccagcccccaggagcaagaccaagaccgcag

SEQ ID NO: 171317 - RNA, 16 nt, Human
gccagcccccaggguc

SEQ ID NO: 171318 - RNA, 32 nt, Human
gccagcccccgacuggccuggccacacugcuc

SEQ ID NO: 171319 - RNA, 32 nt, Human
gccagcccccgcccagcucaucagucugaaug

SEQ ID NO: 171320 - RNA, 32 nt, Human
gccagcccccuuccauuuagucuccugccguu

SEQ ID NO: 171321 - RNA, 32 nt, Human
gccagccccuccacacaucucccuaagucaga

SEQ ID NO: 171322 - RNA, 32 nt, Human
gccagccccuccaccccagccugccugcugcc

SEQ ID NO: 171323 - RNA, 32 nt, Human
gccagccccuucuccucuccccagggccuggc

SEQ ID NO: 171324 - RNA, 19 nt, Human
gccagcccggccaccagcc

SEQ ID NO: 171325 - RNA, 32 nt, Human
gccagcccggccuggccacaggugaggucugu

SEQ ID NO: 171326 - RNA, 32 nt, Human
gccagcccggugcgccccuccaccuccugcuc

SEQ ID NO: 171327 - RNA, 18 nt, Human
gccagcccguccuccucu

SEQ ID NO: 171328 - RNA, 32 nt, Human
gccagcccguccuccucuaccucucuccucuc

SEQ ID NO: 171329 - RNA, 32 nt, Human
gccagcccucagccauccuagccagacccccu

SEQ ID NO: 171330 - RNA, 32 nt, Human
gccagcccucgucguucuuucuccccugccuc

SEQ ID NO: 171331 - RNA, 28 nt, Human
gccagcccucgugcugccucuggucccu

SEQ ID NO: 171332 - RNA, 32 nt, Human
gccagcccucuacuccuccaaccuuuuccaag

SEQ ID NO: 171333 - RNA, 17 nt, Human
gccagcccucuccaguc

SEQ ID NO: 171334 - RNA, 22 nt, Human
gccagcccugcagugugaguga

SEQ ID NO: 171335 - RNA, 32 nt, Human
gccagcccugcuaaugugcuguguggccuucu

SEQ ID NO: 171336 - RNA, 32 nt, Human
gccagcccugcuccucccgccaugacccugca

SEQ ID NO: 171337 - RNA, 32 nt, Human
gccagcccugcucucagcacuucccaugugga

SEQ ID NO: 171338 - RNA, 32 nt, Human
gccagcccugcucucucccucuucccuccagg

SEQ ID NO: 171339 - RNA, 32 nt, Human
gccagcccugcucugccuaaguguacuccaga

SEQ ID NO: 171340 - RNA, 32 nt, Human
gccagcccuucaggaagcagguguccuuuccc

SEQ ID NO: 171341 - RNA, 22 nt, Human
gccagcccuucccuggccccgc

SEQ ID NO: 171342 - RNA, 32 nt, Human
gccagcccuugaccaagaacaaguucagaguc

SEQ ID NO: 171343 - RNA, 32 nt, Human
gccagcccuugcucuaccuggccgguaggcug

SEQ ID NO: 171344 - RNA, 32 nt, Human
gccagccgcccuggcccuggucacugcaugau

SEQ ID NO: 171345 - RNA, 32 nt, Human
gccagccgcgcagaggaugccgagcacuuucc

SEQ ID NO: 171346 - RNA, 22 nt, Human
gccagccggcgccggggcccag

SEQ ID NO: 171347 - RNA, 32 nt, Human
gccagccggcgccggggcccagugcgccgcgc

SEQ ID NO: 171348 - RNA, 32 nt, Human
gccagccguggacagcugagguuggggucaau

SEQ ID NO: 171349 - RNA, 32 nt, Human
gccagccguuccugccagaagccagggcauga

SEQ ID NO: 171350 - RNA, 32 nt, Human
gccagccguuucucccuacggugccgccgcuc

SEQ ID NO: 171351 - RNA, 32 nt, Human
gccagccucaaggagacaucugguuuaggccc

SEQ ID NO: 171352 - RNA, 32 nt, Human
gccagccucaggccagggguucagagagcaag

SEQ ID NO: 171353 - RNA, 32 nt, Human
gccagccuccacccucacgccauuuccaggga

SEQ ID NO: 171354 - RNA, 23 nt, Human
gccagccuccccgccacccgcgc

SEQ ID NO: 171355 - RNA, 20 nt, Human
gccagccuccccgcccgcuc

SEQ ID NO: 171356 - RNA, 32 nt, Human
gccagccugcaugccuggucaucaggagguug

SEQ ID NO: 171357 - RNA, 32 nt, Human
gccagccugcccggccccagcaugcgggaggc

SEQ ID NO: 171358 - RNA, 32 nt, Human
gccagccugccugccugccugccugcccgccc

SEQ ID NO: 171359 - RNA, 32 nt, Human
gccagccugccuggcugucuuccaccggcccu

SEQ ID NO: 171360 - RNA, 32 nt, Human
gccagccugcuggccucagcuccggguugggc

SEQ ID NO: 171361 - RNA, 32 nt, Human
gccagccuggacaacauaguaagacccuaucu

SEQ ID NO: 171362 - RNA, 32 nt, Human
gccagccugggaaauauagugagacccugucu

SEQ ID NO: 171363 - RNA, 32 nt, Human
gccagccugggagcugggccauguuggccgca

SEQ ID NO: 171364 - RNA, 20 nt, Human
gccagccugggcaacagagc

SEQ ID NO: 171365 - RNA, 32 nt, Human
gccagccugggcaacagagcaagacucugucu

SEQ ID NO: 171366 - RNA, 22 nt, Human
gccagccugggcaacagagcga

SEQ ID NO: 171367 - RNA, 18 nt, Human
gccagccugggcaacaua

SEQ ID NO: 171368 - RNA, 32 nt, Human
gccagccugggcaacauaacaagauccugucu

SEQ ID NO: 171369 - RNA, 32 nt, Human
gccagccugggcaacauagugagacccccauc

SEQ ID NO: 171370 - RNA, 32 nt, Human
gccagccugggcgacagagcgagacuccgucu

SEQ ID NO: 171371 - RNA, 32 nt, Human
gccagccugggugaaagagugagacccugucu

SEQ ID NO: 171372 - RNA, 32 nt, Human
gccagccugggugacaaagcgagacuccgucu

SEQ ID NO: 171373 - RNA, 32 nt, Human
gccagccugggugacagagcaagaccuugucu

SEQ ID NO: 171374 - RNA, 32 nt, Human
gccagccuguggugaucccagcagcuuuggag

SEQ ID NO: 171375 - RNA, 32 nt, Human
gccagccuguucucugacuaacgccauccagg

SEQ ID NO: 171376 - RNA, 32 nt, Human
gccagccuguucucugacuacgccauccaggc

SEQ ID NO: 171377 - RNA, 32 nt, Human
gccagccuguuuccuucauucucugacguauu

SEQ ID NO: 171378 - RNA, 32 nt, Human
gccagccuucauuccucccaguguccaagccc

SEQ ID NO: 171379 - RNA, 32 nt, Human
gccagccuuccagggagcagccaugccuuacc

SEQ ID NO: 171380 - RNA, 32 nt, Human
gccagccuuuaugcuucucucaacccuucaag

SEQ ID NO: 171381 - RNA, 32 nt, Human
gccagccuuugcagccacuuuugaagaguagg

SEQ ID NO: 171382 - RNA, 24 nt, Human
gccagccuuuggccacagcaccac

SEQ ID NO: 171383 - RNA, 26 nt, Human
gccagcgaagguggcgaaggcuccca

SEQ ID NO: 171384 - RNA, 20 nt, Human
gccagcgacacacaguucua

SEQ ID NO: 171385 - RNA, 22 nt, Human
gccagcgacagcagccccgccc

SEQ ID NO: 171386 - RNA, 21 nt, Human
gccagcgacagcagcccgccc

SEQ ID NO: 171387 - RNA, 32 nt, Human
gccagcgacagcgggcgcuaccagugcucggg

SEQ ID NO: 171388 - RNA, 32 nt, Human
gccagcgagaccacgaacucaccagaaggaag

SEQ ID NO: 171389 - RNA, 32 nt, Human
gccagcgagagggaccagggcaccacucucua

SEQ ID NO: 171390 - RNA, 23 nt, Human
gccagcgagcaggcugccugccc

SEQ ID NO: 171391 - RNA, 32 nt, Human
gccagcgagucaggagcaggggagacagggcu

SEQ ID NO: 171392 - RNA, 32 nt, Human
gccagcgaugggcaggcgagaccccuccagaa

SEQ ID NO: 171393 - RNA, 23 nt, Human
gccagcgcagcgccagggcucag

SEQ ID NO: 171394 - RNA, 32 nt, Human
gccagcgcaguggcucacaccuguaaucccag

SEQ ID NO: 171395 - RNA, 32 nt, Human
gccagcgccagcugcagccccggcugcccacu

SEQ ID NO: 171396 - RNA, 32 nt, Human
gccagcgccauggcuuaccacccguuccacgc

SEQ ID NO: 171397 - RNA, 32 nt, Human
gccagcgcccagccagggagccggccgggaag

SEQ ID NO: 171398 - RNA, 32 nt, Human
gccagcgcccugaagcuccgugcucaacugau

SEQ ID NO: 171399 - RNA, 17 nt, Human
gccagcgccuccaccuu

SEQ ID NO: 171400 - RNA, 19 nt, Human
gccagcgcuagcgccagca

SEQ ID NO: 171401 - RNA, 18 nt, Human
gccagcgcucucaccucu

SEQ ID NO: 171402 - RNA, 32 nt, Human
gccagcgcuuucuggacuggcugugcugcagg

SEQ ID NO: 171403 - RNA, 32 nt, Human
gccagcggagaggacaggcagggccuuccaca

SEQ ID NO: 171404 - RNA, 20 nt, Human
gccagcggagccggggccag

SEQ ID NO: 171405 - RNA, 21 nt, Human
gccagcggagccggggccaga

SEQ ID NO: 171406 - RNA, 21 nt, Human
gccagcggagcgaacccgaga

SEQ ID NO: 171407 - RNA, 32 nt, Human
gccagcggcaggggacuccagccugcuggaca

SEQ ID NO: 171408 - RNA, 23 nt, Human
gccagcggccgggcgcccagcgg

SEQ ID NO: 171409 - RNA, 32 nt, Human
gccagcggccugccgggaguugcagugaaccc

SEQ ID NO: 171410 - RNA, 32 nt, Human
gccagcggcggcaacggcggcagcggcggcag

SEQ ID NO: 171411 - RNA, 32 nt, Human
gccagcggcugaugcugcaggugggccugauc

SEQ ID NO: 171412 - RNA, 32 nt, Human
gccagcgggaccugggcaggggcgcccggagc

SEQ ID NO: 171413 - RNA, 24 nt, Human
gccagcgggagcggcggggcucag

SEQ ID NO: 171414 - RNA, 32 nt, Human
gccagcgggcgccgucggcggcuggcccuguc

SEQ ID NO: 171415 - RNA, 32 nt, Human
gccagcggugaagcagguggccagcagccagu

SEQ ID NO: 171416 - RNA, 32 nt, Human
gccagcgguggaggcugagucgcaggacacau

SEQ ID NO: 171417 - RNA, 21 nt, Human
gccagcggugggcuggcgguu

SEQ ID NO: 171418 - RNA, 17 nt, Human
gccagcgguuccugcgg

SEQ ID NO: 171419 - RNA, 16 nt, Human
gccagcgguuccuggg

SEQ ID NO: 171420 - RNA, 32 nt, Human
gccagcguccagcuucucccccaaaccacagc

SEQ ID NO: 171421 - RNA, 32 nt, Human
gccagcgugggccugggcuugaucuccauucu

SEQ ID NO: 171422 - RNA, 32 nt, Human
gccagcguggggcucccugccuucuggacucc

SEQ ID NO: 171423 - RNA, 32 nt, Human
gccagcuacccaggcugaacagcaucaggagc

SEQ ID NO: 171424 - RNA, 17 nt, Human
gccagcuacuccacccu

SEQ ID NO: 171425 - RNA, 32 nt, Human
gccagcuacugcucuggguuugaggagaaagg

SEQ ID NO: 171426 - RNA, 32 nt, Human
gccagcuagaaaaagaaagaaaggggagggga

SEQ ID NO: 171427 - RNA, 32 nt, Human
gccagcuagcuccauagggaagccugugucuc

SEQ ID NO: 171428 - RNA, 32 nt, Human
gccagcuagggugggggcgauagggucagcgg

SEQ ID NO: 171429 - RNA, 23 nt, Human
gccagcucacacucugcugcaca

SEQ ID NO: 171430 - RNA, 32 nt, Human
gccagcucacagagaagaaaauaacuugcagu

SEQ ID NO: 171431 - RNA, 32 nt, Human
gccagcucacauuuauuuggaaauuacccucc

SEQ ID NO: 171432 - RNA, 22 nt, Human
gccagcucagcacagaagacac

SEQ ID NO: 171433 - RNA, 32 nt, Human
gccagcucaugcugcugaccacugacucagcu

SEQ ID NO: 171434 - RNA, 32 nt, Human
gccagcucauuucacuuuacacgcucauggac

SEQ ID NO: 171435 - RNA, 32 nt, Human
gccagcuccagccuggccccggggcagcgggu

SEQ ID NO: 171436 - RNA, 32 nt, Human
gccagcucccacccaucuuuucuugaaucucu

SEQ ID NO: 171437 - RNA, 18 nt, Human
gccagcucccagcucucc

SEQ ID NO: 171438 - RNA, 32 nt, Human
gccagcuccguggguguccucccagggagcuu

SEQ ID NO: 171439 - RNA, 32 nt, Human
gccagcuccugccucccggugcccucugcagg

SEQ ID NO: 171440 - RNA, 32 nt, Human
gccagcucggcugaggccugaggagaaaugau

SEQ ID NO: 171441 - RNA, 24 nt, Human
gccagcucucccgcuucucgcaca

SEQ ID NO: 171442 - RNA, 21 nt, Human
gccagcucuccuccucgcaca

SEQ ID NO: 171443 - RNA, 32 nt, Human
gccagcucugcguuuaagacaggaagcugccg

SEQ ID NO: 171444 - RNA, 19 nt, Human
gccagcucugcugcaggug

SEQ ID NO: 171445 - RNA, 21 nt, Human
gccagcucugcugccaccucu

SEQ ID NO: 171446 - RNA, 32 nt, Human
gccagcucugcuguucacuggcccuacccgag

SEQ ID NO: 171447 - RNA, 32 nt, Human
gccagcucugcuuccuggccucgguggcgcug

SEQ ID NO: 171448 - RNA, 32 nt, Human
gccagcucuuccaaucuccaucaccuuugggc

SEQ ID NO: 171449 - RNA, 32 nt, Human
gccagcucuugccucccggcggccucugcagg

SEQ ID NO: 171450 - RNA, 32 nt, Human
gccagcugaaugugugucucccaacuuucucu

SEQ ID NO: 171451 - RNA, 32 nt, Human
gccagcugaccuucaaacccugcauuugaacc

SEQ ID NO: 171452 - RNA, 26 nt, Human
gccagcugagcaaggcgaaagccaag

SEQ ID NO: 171453 - RNA, 32 nt, Human
gccagcugaggggaaguugcuggugaguuucc

SEQ ID NO: 171454 - RNA, 32 nt, Human
gccagcugagucucuaucauagcugaacccug

SEQ ID NO: 171455 - RNA, 32 nt, Human
gccagcugauucaucagaaucaggugagugug

SEQ ID NO: 171456 - RNA, 21 nt, Human
gccagcugcaccagggcucag

SEQ ID NO: 171457 - RNA, 25 nt, Human
gccagcugcaccccgccuggcucgc

SEQ ID NO: 171458 - RNA, 32 nt, Human
gccagcugcaggguccuuccacacgcaggucc

SEQ ID NO: 171459 - RNA, 23 nt, Human
gccagcugcccaccccagugcca

SEQ ID NO: 171460 - RNA, 32 nt, Human
gccagcugcucccaaugugccgauguccgugg

SEQ ID NO: 171461 - RNA, 32 nt, Human
gccagcugcugccccagaguccugcccccugc

SEQ ID NO: 171462 - RNA, 32 nt, Human
gccagcugcuggugauccucagccggagggca

SEQ ID NO: 171463 - RNA, 32 nt, Human
gccagcugcuucuccucuccauggaaggagga

SEQ ID NO: 171464 - RNA, 32 nt, Human
gccagcuggaaagaggacauggacaggccuau

SEQ ID NO: 171465 - RNA, 32 nt, Human
gccagcuggaacccagcccauccucucaggca

SEQ ID NO: 171466 - RNA, 32 nt, Human
gccagcuggaaccugaguugucagcucagaaa

SEQ ID NO: 171467 - RNA, 32 nt, Human
gccagcuggaccaggcccugccuaggcccugc

SEQ ID NO: 171468 - RNA, 32 nt, Human
gccagcuggagcuggccuaccuuggaggacug

SEQ ID NO: 171469 - RNA, 32 nt, Human
gccagcuggaggaaggaagggcaggcugggcc

SEQ ID NO: 171470 - RNA, 32 nt, Human
gccagcuggaggaaggaagggcgggcugggcc

SEQ ID NO: 171471 - RNA, 18 nt, Human
gccagcuggagugcagug

SEQ ID NO: 171472 - RNA, 32 nt, Human
gccagcuggauuggccagugcaccuuguauuc

SEQ ID NO: 171473 - RNA, 32 nt, Human
gccagcugggaaggcagcgcccagcugcacuu

SEQ ID NO: 171474 - RNA, 32 nt, Human
gccagcugggacagcgaccgagcccagagaga

SEQ ID NO: 171475 - RNA, 32 nt, Human
gccagcugggaggggagggggccgugggggcg

SEQ ID NO: 171476 - RNA, 32 nt, Human
gccagcugggcaaggaguuggggagcggggag

SEQ ID NO: 171477 - RNA, 32 nt, Human
gccagcugggggaguggguagaggccggguga

SEQ ID NO: 171478 - RNA, 32 nt, Human
gccagcugggucuagcaucacagggaaggggg

SEQ ID NO: 171479 - RNA, 32 nt, Human
gccagcuggguguuauuucucaaacucugagg

SEQ ID NO: 171480 - RNA, 17 nt, Human
gccagcugucccgaguc

SEQ ID NO: 171481 - RNA, 31 nt, Human
gccagcugucucucugggaugagucaggagg

SEQ ID NO: 171482 - RNA, 32 nt, Human
gccagcugugcagccaggugugacuguuacug

SEQ ID NO: 171483 - RNA, 32 nt, Human
gccagcugugugaauuuggucaagggaccuaa

SEQ ID NO: 171484 - RNA, 32 nt, Human
gccagcugugugaccauccagggguggagggg

SEQ ID NO: 171485 - RNA, 32 nt, Human
gccagcuucauacuugagugugcacaucuuga

SEQ ID NO: 171486 - RNA, 32 nt, Human
gcccaugcugugugugugccucuguuggugag

SEQ ID NO: 171487 - RNA, 32 nt, Human
gcccauggagccagaccccacucugucccugu

SEQ ID NO: 171488 - RNA, 32 nt, Human
gcccauggaggagacaggaagccucaaguucc

SEQ ID NO: 171489 - RNA, 26 nt, Human
gcccauggagugcucucccacuggca

SEQ ID NO: 171490 - RNA, 29 nt, Human
gcccauggcccucaccuccaucaaugcca

SEQ ID NO: 171491 - RNA, 21 nt, Human
gcccauggcugggcgcagugg

SEQ ID NO: 171492 - RNA, 29 nt, Human
gcccaugggaggagugggaguggcagagg

SEQ ID NO: 171493 - RNA, 32 nt, Human
gcccaugggaggcuggaguuggggcagaggag

SEQ ID NO: 171494 - RNA, 32 nt, Human
gcccauggggacagggacaggugaggggcuuc

SEQ ID NO: 171495 - RNA, 32 nt, Human
gcccauggggccugaagggaaaugggcagcug

SEQ ID NO: 171496 - RNA, 32 nt, Human
gcccauggugccugucagcccgcagagcccau

SEQ ID NO: 171497 - RNA, 29 nt, Human
gcccauggugcugcccaccugccccaugg

SEQ ID NO: 171498 - RNA, 32 nt, Human
gcccauggugggagcgagcaugugacaguccc

SEQ ID NO: 171499 - RNA, 32 nt, Human
gcccauguaggagcugaguucuuaaagacuga

SEQ ID NO: 171500 - RNA, 32 nt, Human
gcccaugucaaaugcuugguuuugaaaacuga

SEQ ID NO: 171501 - RNA, 32 nt, Human
gcccaugucaugccaagagucagugccaucug

SEQ ID NO: 171502 - RNA, 19 nt, Human
gcccauguccuccuuggug

SEQ ID NO: 171503 - RNA, 32 nt, Human
gcccauguccugcagcagagcugggcaggcug

SEQ ID NO: 171504 - RNA, 21 nt, Human
gcccaugucucccccaccuca

SEQ ID NO: 171505 - RNA, 32 nt, Human
gcccaugugccaccucccuuccucccucccuc

SEQ ID NO: 171506 - RNA, 32 nt, Human
gcccaugugggagcugaguucuuaaagacuga

SEQ ID NO: 171507 - RNA, 32 nt, Human
gcccaugugugaucuugugggguggagggaag

SEQ ID NO: 171508 - RNA, 32 nt, Human
gcccauguguuuuggaacauuuauguaagauu

SEQ ID NO: 171509 - RNA, 32 nt, Human
gcccauuaaccaggagcuuggcacaggccaca

SEQ ID NO: 171510 - RNA, 21 nt, Human
gcccauuauccugccuugagg

SEQ ID NO: 171511 - RNA, 21 nt, Human
gcccauucaaguuucuggcca

SEQ ID NO: 171512 - RNA, 32 nt, Human
gcccauucagccucgucucuuuacagaaguag

SEQ ID NO: 171513 - RNA, 22 nt, Human
gcccauucagggcugccugagc

SEQ ID NO: 171514 - RNA, 32 nt, Human
gcccauucaguggugcuggagggagacuucag

SEQ ID NO: 171515 - RNA, 32 nt, Human
gcccauuccucccauucaagauucccacuccc

SEQ ID NO: 171516 - RNA, 32 nt, Human
gcccauuccucugucccugcagacucagugca

SEQ ID NO: 171517 - RNA, 32 nt, Human
gcccauuccucuuucuccaccgucacccaaca

SEQ ID NO: 171518 - RNA, 32 nt, Human
gcccauucuacuuuugaauuuagcuuuuacua

SEQ ID NO: 171519 - RNA, 24 nt, Human
gcccauucuggagugcaguggugu

SEQ ID NO: 171520 - RNA, 32 nt, Human
gcccauucuucgcucuguguuugaagagagca

SEQ ID NO: 171521 - RNA, 19 nt, Human
gcccauugcccugcugcug

SEQ ID NO: 171522 - RNA, 24 nt, Human
gcccauuguggggggcaaaggcau

SEQ ID NO: 171523 - RNA, 32 nt, Human
gcccauuucaggaaucugcagccuggaagcca

SEQ ID NO: 171524 - RNA, 21 nt, Human
gcccauuucccuccugucucc

SEQ ID NO: 171525 - RNA, 32 nt, Human
gcccauuucucaucucuucauacuagcucaca

SEQ ID NO: 171526 - RNA, 32 nt, Human
gcccauuugaaaggagugggaggaauacagca

SEQ ID NO: 171527 - RNA, 18 nt, Human
gcccauuugagaucuuug

SEQ ID NO: 171528 - RNA, 32 nt, Human
gcccauuugcucgcaguuuccucucucuguuu

SEQ ID NO: 171529 - RNA, 32 nt, Human
gcccauuuggagggaggaaguaagggaagagg

SEQ ID NO: 171530 - RNA, 21 nt, Human
gcccauuuggcuacucugcug

SEQ ID NO: 171531 - RNA, 32 nt, Human
gcccauuugucggcuuacagcucuuccggagu

SEQ ID NO: 171532 - RNA, 32 nt, Human
gcccauuuuaugggcuggaguuaaauggaagu

SEQ ID NO: 171533 - RNA, 21 nt, Human
gcccauuuucuuuccuucaca

SEQ ID NO: 171534 - RNA, 32 nt, Human
gcccauuuugaggggcgaugcagccacucacu

SEQ ID NO: 171535 - RNA, 32 nt, Human
gccccaaaacuuccaccucccucccuggccac

SEQ ID NO: 171536 - RNA, 24 nt, Human
gccccaaaccagcccagagcaggg

SEQ ID NO: 171537 - RNA, 18 nt, Human
gccccaaauuccacuucu

SEQ ID NO: 171538 - RNA, 32 nt, Human
gccccaacacacgguccacagcucaucaugau

SEQ ID NO: 171539 - RNA, 32 nt, Human
gccccaacacaugcacauguguguacacaacu

SEQ ID NO: 171540 - RNA, 21 nt, Human
gccccaacaugccugcaccug

SEQ ID NO: 171541 - RNA, 32 nt, Human
gccccaacauuccucacuacuacuuuuucuuc

SEQ ID NO: 171542 - RNA, 32 nt, Human
gccccaaccagagacucagcaacagcuccucc

SEQ ID NO: 171543 - RNA, 21 nt, Human
gccccaaccccacuccacucc

SEQ ID NO: 171544 - RNA, 19 nt, Human
gccccaaccccgccagcgc

SEQ ID NO: 171545 - RNA, 32 nt, Human
gccccaacccuguggucacucuccccauuuug

SEQ ID NO: 171546 - RNA, 32 nt, Human
gccccaacuacacacccccaagccacagggaa

SEQ ID NO: 171547 - RNA, 18 nt, Human
gccccaacucuccccuga

SEQ ID NO: 171548 - RNA, 32 nt, Human
gccccaagaaacacauugcaccugccaauagc

SEQ ID NO: 171549 - RNA, 32 nt, Human
gccccaagacacacccuagccccuccuuauuc

SEQ ID NO: 171550 - RNA, 32 nt, Human
gccccaagcagcuggccaacauguguagagac

SEQ ID NO: 171551 - RNA, 23 nt, Human
gccccaagcccuggccucuagug

SEQ ID NO: 171552 - RNA, 22 nt, Human
gccccaagcuuuacacuggaug

SEQ ID NO: 171553 - RNA, 32 nt, Human
gccccaaggaagcaggcagcaugggaagcagg

SEQ ID NO: 171554 - RNA, 32 nt, Human
gccccaaggagccacugucacuucagguccgu

SEQ ID NO: 171555 - RNA, 32 nt, Human
gccccaaggagccgcugucacuucagguccgu

SEQ ID NO: 171556 - RNA, 25 nt, Human
gccccaaggcugccucugggccaug

SEQ ID NO: 171557 - RNA, 21 nt, Human
gccccaagggcaaaauuccca

SEQ ID NO: 171558 - RNA, 32 nt, Human
gccccaagucaggaguagggaggcagacggca

SEQ ID NO: 171559 - RNA, 32 nt, Human
gccccaaguccuggugucuccagccuggcucu

SEQ ID NO: 171560 - RNA, 23 nt, Human
gccccaagugauccucccaccuc

SEQ ID NO: 171561 - RNA, 32 nt, Human
gccccaaucaucucgcuggaugccauugccca

SEQ ID NO: 171562 - RNA, 32 nt, Human
gccccaauccuggcuccaacccucucuggaaa

SEQ ID NO: 171563 - RNA, 32 nt, Human
gccccaaucuaucuaguacuucccaggcaaau

SEQ ID NO: 171564 - RNA, 32 nt, Human
gccccaaugccagguaggaggaagggcugggg

SEQ ID NO: 171565 - RNA, 32 nt, Human
gccccaauuucuaacagccugccugucccccg

SEQ ID NO: 171566 - RNA, 32 nt, Human
gccccacacacaacaggguaaauuccuacucc

SEQ ID NO: 171567 - RNA, 32 nt, Human
gccccacacaccuggaacacacagugccccac

SEQ ID NO: 171568 - RNA, 32 nt, Human
gccccacacagcagaaaaugcccacgaugcaa

SEQ ID NO: 171569 - RNA, 31 nt, Human
gccccacacagcuagagcggccaggagagcg

SEQ ID NO: 171570 - RNA, 32 nt, Human
gccccacaccacugcaggcagguggauagaag

SEQ ID NO: 171571 - RNA, 22 nt, Human
gccccacaccagccccaaucca

SEQ ID NO: 171572 - RNA, 32 nt, Human
gccccacacccaggcugugggggacgggaugg

SEQ ID NO: 171573 - RNA, 21 nt, Human
gccccacacugcagaagcccu

SEQ ID NO: 171574 - RNA, 32 nt, Human
gccccacacugccucuguggccuggacuuuga

SEQ ID NO: 171575 - RNA, 32 nt, Human
gccccacagacaaaagcgcuuuuccuuggcau

SEQ ID NO: 171576 - RNA, 32 nt, Human
gccccacagaccccucccuggggcagagggac

SEQ ID NO: 171577 - RNA, 24 nt, Human
gccccacagcccugagagauggug

SEQ ID NO: 171578 - RNA, 24 nt, Human
gccccacagcccuguggccuggug

SEQ ID NO: 171579 - RNA, 19 nt, Human
gccccacagccuccaguga

SEQ ID NO: 171580 - RNA, 32 nt, Human
gccccacagccuucuacaagggguggccuccu

SEQ ID NO: 171581 - RNA, 32 nt, Human
gccccacagcuucagacugaggaucuagggcu

SEQ ID NO: 171582 - RNA, 32 nt, Human
gccccacagggaccccagccuggguggucacu

SEQ ID NO: 171583 - RNA, 32 nt, Human
gccccacagggagaucccgaagagccuguuuc

SEQ ID NO: 171584 - RNA, 21 nt, Human
gccccacagucggugugcuug

SEQ ID NO: 171585 - RNA, 22 nt, Human
gccccacauaccucacugucuc

SEQ ID NO: 171586 - RNA, 21 nt, Human
gccccacaucucccaccacca

SEQ ID NO: 171587 - RNA, 32 nt, Human
gccccacauggguuguuucuguuucuuuggcu

SEQ ID NO: 171588 - RNA, 21 nt, Human
gccccaccaaaugcccagggg

SEQ ID NO: 171589 - RNA, 29 nt, Human
gccccaccaacauccugcagggauggggu

SEQ ID NO: 171590 - RNA, 32 nt, Human
gccccaccaauuccucccuccugguaauccug

SEQ ID NO: 171591 - RNA, 32 nt, Human
gccccaccacccuucugaucuuagggguugga

SEQ ID NO: 171592 - RNA, 32 nt, Human
gccccaccagcaggucaagucagcuucaaagg

SEQ ID NO: 171593 - RNA, 25 nt, Human
gccccaccaggccugccccaaggug

SEQ ID NO: 171594 - RNA, 23 nt, Human
gccccaccagucagagcccugaa

SEQ ID NO: 171595 - RNA, 32 nt, Human
gccccaccagugagcuggcuacucggggauaa

SEQ ID NO: 171596 - RNA, 32 nt, Human
gccccaccaugauccagccucugccucacacu

SEQ ID NO: 171597 - RNA, 32 nt, Human
gccccaccaugccccaggcugcagccucuguc

SEQ ID NO: 171598 - RNA, 25 nt, Human
gccccacccacagauccccugcucc

SEQ ID NO: 171599 - RNA, 18 nt, Human
gccccacccaccccuccu

SEQ ID NO: 171600 - RNA, 19 nt, Human
gccccacccaccccuuccu

SEQ ID NO: 171601 - RNA, 32 nt, Human
gccccacccaccuuccuuccucuucccucuuc

SEQ ID NO: 171602 - RNA, 21 nt, Human
gccccacccagcagacugagg

SEQ ID NO: 171603 - RNA, 21 nt, Human
gccccaccccacccccacucc

SEQ ID NO: 171604 - RNA, 21 nt, Human
gccccaccccaccuccacucc

SEQ ID NO: 171605 - RNA, 21 nt, Human
gccccacccccacucccgccc

SEQ ID NO: 171606 - RNA, 32 nt, Human
gccccacccccuuauagcaucucccuccagga

SEQ ID NO: 171607 - RNA, 22 nt, Human
gccccaccccgcaacuccugaa

SEQ ID NO: 171608 - RNA, 20 nt, Human
gccccaccccgccccgcccc

SEQ ID NO: 171609 - RNA, 32 nt, Human
gccccaccccuccagaacacggcucacgcuua

SEQ ID NO: 171610 - RNA, 21 nt, Human
gccccaccccugaccccgcuc

SEQ ID NO: 171611 - RNA, 32 nt, Human
gccccacccuccaaucugcacuuugauuugcu

SEQ ID NO: 171612 - RNA, 18 nt, Human
gccccacccucuacccca

SEQ ID NO: 171613 - RNA, 21 nt, Human
gccccacccuggccccgcccc

SEQ ID NO: 171614 - RNA, 32 nt, Human
gccccacccugggccacugccugcuccagaga

SEQ ID NO: 171615 - RNA, 32 nt, Human
gccccacccuguggcuucugcagcugcaccuc

SEQ ID NO: 171616 - RNA, 32 nt, Human
gccccacccuguguaguuguugaggagaagaa

SEQ ID NO: 171617 - RNA, 32 nt, Human
gccccacccuuaagcuuccucugacgguuacc

SEQ ID NO: 171618 - RNA, 32 nt, Human
gccccacccuugucccucagcaacaucccauc

SEQ ID NO: 171619 - RNA, 32 nt, Human
gccccaccgagagccaggcagcuuugaguggc

SEQ ID NO: 171620 - RNA, 32 nt, Human
gccccaccgccaccccuacucccuucaacccu

SEQ ID NO: 171621 - RNA, 22 nt, Human
gccccaccgccacgccccaggg

SEQ ID NO: 171622 - RNA, 21 nt, Human
gccccaccgccccuccacucc

SEQ ID NO: 171623 - RNA, 23 nt, Human
gccccaccgcccucgccccgccc

SEQ ID NO: 171624 - RNA, 32 nt, Human
gccccaccgccggccgcgaccugcugcugccc

SEQ ID NO: 171625 - RNA, 32 nt, Human
gccccaccggccugcagccccugcugcccaau

SEQ ID NO: 171626 - RNA, 32 nt, Human
gccccaccggcggcggagggagcuguggcgau

SEQ ID NO: 171627 - RNA, 32 nt, Human
gccccaccuccaccuuagucucgauccgaaaa

SEQ ID NO: 171628 - RNA, 27 nt, Human
gccccaccucuucacucccugccaagg

SEQ ID NO: 171629 - RNA, 16 nt, Human
gccccaccugccagca

SEQ ID NO: 171630 - RNA, 32 nt, Human
gccccaccugccagcucuacugggcuuggagc

SEQ ID NO: 171631 - RNA, 16 nt, Human
gccccaccugccccca

SEQ ID NO: 171632 - RNA, 22 nt, Human
gccccaccuggagcccccgccc

SEQ ID NO: 171633 - RNA, 32 nt, Human
gccccaccuucugcuacuauuauguucuucag

SEQ ID NO: 171634 - RNA, 32 nt, Human
gccccaccuuggugauguugcaaccuuuccuu

SEQ ID NO: 171635 - RNA, 32 nt, Human
gccccaccuuugcuuccucccucucuccuccc

SEQ ID NO: 171636 - RNA, 21 nt, Human
gccccacgcaggagcgaggac

SEQ ID NO: 171637 - RNA, 32 nt, Human
gccccacgcuuuucucucuuccuuccccucuc

SEQ ID NO: 171638 - RNA, 20 nt, Human
gccccacggaccccacgccc

SEQ ID NO: 171639 - RNA, 18 nt, Human
gccccacgggccaugccc

SEQ ID NO: 171640 - RNA, 32 nt, Human
gccccacguuucaagucaaaucaagcugcuga

SEQ ID NO: 171641 - RNA, 32 nt, Human
gccccacuacacuccagccuggucaacagagu

SEQ ID NO: 171642 - RNA, 32 nt, Human
gccccacuacuuccuucccugccucccagcuc

SEQ ID NO: 171643 - RNA, 32 nt, Human
gccccacucagacgccaaggugccucccgccu

SEQ ID NO: 171644 - RNA, 20 nt, Human
gccccacucauuuguuuacc

SEQ ID NO: 171645 - RNA, 32 nt, Human
gccccacuccacucacuaaaggccagcgcacc

SEQ ID NO: 171646 - RNA, 19 nt, Human
gccccacuccagccccagc

SEQ ID NO: 171647 - RNA, 32 nt, Human
gccccacucccaccauccugugaaccccacuc

SEQ ID NO: 171648 - RNA, 21 nt, Human
gccccacucccaccccgcccc

SEQ ID NO: 171649 - RNA, 32 nt, Human
gccccacucccaguccuccugggauccugcug

SEQ ID NO: 171650 - RNA, 22 nt, Human
gccccacuccccuccugacagg

SEQ ID NO: 171651 - RNA, 32 nt, Human
gccccacuccucugcugaccugcugaccugug

SEQ ID NO: 171652 - RNA, 32 nt, Human
gccccacuccugaaugcaccacaugccucugu

SEQ ID NO: 171653 - RNA, 17 nt, Human
gccccacuccuguugcc

SEQ ID NO: 171654 - RNA, 32 nt, Human
gccccacucugagccugcccugggcagccucg

SEQ ID NO: 171655 - RNA, 32 nt, Human
gccccacucugccucuugcuccuccagggcag

SEQ ID NO: 171656 - RNA, 22 nt, Human
gccccacucugccugccugcug

SEQ ID NO: 171657 - RNA, 32 nt, Human
gccccacugacaccaccuacuugcuaaggcca

SEQ ID NO: 171658 - RNA, 32 nt, Human
gccccacugaggccaguagggggccaggccuc

SEQ ID NO: 171659 - RNA, 32 nt, Human
gccccacugcacccucucccccuuaucuaucu

SEQ ID NO: 171660 - RNA, 32 nt, Human
gccccacugcacuccacccugggcaauggagu

SEQ ID NO: 171661 - RNA, 32 nt, Human
gccccacugcacuccagccuaggcaacagagu

SEQ ID NO: 171662 - RNA, 32 nt, Human
gccccacugcacuccagccuggcaauagaccg

SEQ ID NO: 171663 - RNA, 32 nt, Human
gccccacugcacuccagccugggcgacagaac

SEQ ID NO: 171664 - RNA, 32 nt, Human
gccccacugcacuccagccugggugacagagc

SEQ ID NO: 171665 - RNA, 32 nt, Human
gccccacugcacuccagccugggugacagagg

SEQ ID NO: 171666 - RNA, 32 nt, Human
gccccacugcacuccagccuggugacuccguc

SEQ ID NO: 171667 - RNA, 32 nt, Human
gccccacugccagcugccccuccugggagggc

SEQ ID NO: 171668 - RNA, 32 nt, Human
gccccacugccauggagcagccuguguuccug

SEQ ID NO: 171669 - RNA, 32 nt, Human
gccccacugccucaccuccccuguaucugcag

SEQ ID NO: 171670 - RNA, 32 nt, Human
gccccacugccucucacugcccgugagucccu

SEQ ID NO: 171671 - RNA, 21 nt, Human
gccccacugcgcccgcgcucu

SEQ ID NO: 171672 - RNA, 22 nt, Human
gccccacugcugcuaccugggg

SEQ ID NO: 171673 - RNA, 20 nt, Human
gccccacugguauaaauaca

SEQ ID NO: 171674 - RNA, 17 nt, Human
gccccacuguccccuca

SEQ ID NO: 171675 - RNA, 32 nt, Human
gccccacugucucuaaccacuccugggcuaag

SEQ ID NO: 171676 - RNA, 20 nt, Human
gccccacuguuccccaacuu

SEQ ID NO: 171677 - RNA, 32 nt, Human
gccccacuguuuagaaucuuagauggaaaugu

SEQ ID NO: 171678 - RNA, 23 nt, Human
gccccacuucccaccccgucucc

SEQ ID NO: 171679 - RNA, 32 nt, Human
gccccacuucccucagcccccagggcuuccuu

SEQ ID NO: 171680 - RNA, 32 nt, Human
gccccacuucugcuuugugucucccucugucu

SEQ ID NO: 171681 - RNA, 32 nt, Human
gccccagaaagccucccuucuucuccaggucc

SEQ ID NO: 171682 - RNA, 32 nt, Human
gccccagaacaacaguuucacuuuguggcuuu

SEQ ID NO: 171683 - RNA, 23 nt, Human
gccccagaacaccagagaccuca

SEQ ID NO: 171684 - RNA, 20 nt, Human
gccccagaagcgccccagga

SEQ ID NO: 171685 - RNA, 22 nt, Human
gccccagacaccgcacucaggg

SEQ ID NO: 171686 - RNA, 22 nt, Human
gccccagacaccuucccugagg

SEQ ID NO: 171687 - RNA, 21 nt, Human
gccccagacagccccagccca

SEQ ID NO: 171688 - RNA, 32 nt, Human
gccccagacccuccccuguccaaacaggagau

SEQ ID NO: 171689 - RNA, 23 nt, Human
gccccagaccggcagccuggcca

SEQ ID NO: 171690 - RNA, 32 nt, Human
gccccagacugugcccuuacgagcucaucucu

SEQ ID NO: 171691 - RNA, 32 nt, Human
gccccagagaccagaacugauccagagcugga

SEQ ID NO: 171692 - RNA, 21 nt, Human
gccccagagagaggagcuggg

SEQ ID NO: 171693 - RNA, 32 nt, Human
gccccagagagaggauguggaaagcacuuuuu

SEQ ID NO: 171694 - RNA, 32 nt, Human
gccccagagagggacccccacagcggcagcug

SEQ ID NO: 171695 - RNA, 32 nt, Human
gccccagagcccaagggugcaaagcaguaauu

SEQ ID NO: 171696 - RNA, 32 nt, Human
gccccagagccccagccccucaugucuugccg

SEQ ID NO: 171697 - RNA, 32 nt, Human
gccccagagcccugcccgaggcugaggcuggg

SEQ ID NO: 171698 - RNA, 32 nt, Human
gccccagaggacuuaucucagcuguacaugcu

SEQ ID NO: 171699 - RNA, 32 nt, Human
gccccagaggcaccagcuccuggcgggggagg

SEQ ID NO: 171700 - RNA, 32 nt, Human
gccccagaggcagagguuguggugagccgaga

SEQ ID NO: 171701 - RNA, 32 nt, Human
gccccagaggguguucagcuuguugccaacag

SEQ ID NO: 171702 - RNA, 32 nt, Human
gccccagaggucaaggcugcagugagcuguga

SEQ ID NO: 171703 - RNA, 32 nt, Human
gccccagagguccccugcaucccccuucuuug

SEQ ID NO: 171704 - RNA, 32 nt, Human
gccccagaggugucacaggaaggcaccagcaa

SEQ ID NO: 171705 - RNA, 32 nt, Human
gccccagaguagcuggaauuacaggcacacac

SEQ ID NO: 171706 - RNA, 16 nt, Human
gccccagaguggcuca

SEQ ID NO: 171707 - RNA, 32 nt, Human
gccccagaguugucccccucugcuggggcaag

SEQ ID NO: 171708 - RNA, 21 nt, Human
gccccagaguuugcaaacuca

SEQ ID NO: 171709 - RNA, 23 nt, Human
gccccagaguuugccuguuucca

SEQ ID NO: 171710 - RNA, 32 nt, Human
gccccagauggcacugaguuuuucauucauug

SEQ ID NO: 171711 - RNA, 32 nt, Human
gccccagauugcuucauuugcuggguguggaa

SEQ ID NO: 171712 - RNA, 32 nt, Human
gccccagauuugcugcacauccuggccagcac

SEQ ID NO: 171713 - RNA, 32 nt, Human
gccccagcacagaagaggccccugccacccua

SEQ ID NO: 171714 - RNA, 32 nt, Human
gccccagcacagacccaaacuggggcugggcc

SEQ ID NO: 171715 - RNA, 32 nt, Human
gccccagcacgucugccucuggcuucacccag

SEQ ID NO: 171716 - RNA, 32 nt, Human
gccccagcagagccugggaggaaggcggccgc

SEQ ID NO: 171717 - RNA, 32 nt, Human
gccccagcagcaucugaacugaggcuucuuca

SEQ ID NO: 171718 - RNA, 32 nt, Human
gccccagcagcuggauucucaggcugggcccc

SEQ ID NO: 171719 - RNA, 32 nt, Human
gccccagcaggcaaaccacuucacagugcuag

SEQ ID NO: 171720 - RNA, 19 nt, Human
gccccagcaggcccaggca

SEQ ID NO: 171721 - RNA, 21 nt, Human
gccccagcagucagccagccg

SEQ ID NO: 171722 - RNA, 20 nt, Human
gccccagcaugcccuuggca

SEQ ID NO: 171723 - RNA, 17 nt, Human
gccccagcauuugcuca

SEQ ID NO: 171724 - RNA, 32 nt, Human
gccccagcauuuugccccgggcuccagcauca

SEQ ID NO: 171725 - RNA, 32 nt, Human
gccccagccaaaacaaaagagcugaagaauaa

SEQ ID NO: 171726 - RNA, 22 nt, Human
gccccagccaacgagauugcug

SEQ ID NO: 171727 - RNA, 21 nt, Human
gccccagccacaccaggugca

SEQ ID NO: 171728 - RNA, 23 nt, Human
gccccagccacacugugaccugg

SEQ ID NO: 171729 - RNA, 32 nt, Human
gccccagccacccccacugccugggccuucau

SEQ ID NO: 171730 - RNA, 32 nt, Human
gccccagccacucugaacgcugagaugggaag

SEQ ID NO: 171731 - RNA, 21 nt, Human
gccccagccagccagccagcc

SEQ ID NO: 171732 - RNA, 25 nt, Human
gccccagccaggacagccccuggcc

SEQ ID NO: 171733 - RNA, 23 nt, Human
gccccagccaggcccugcagggc

SEQ ID NO: 171734 - RNA, 32 nt, Human
gccccagccaggucacaccuggccucacacuu

SEQ ID NO: 171735 - RNA, 32 nt, Human
gccccagccauccugaccccucucauuauuuu

SEQ ID NO: 171736 - RNA, 23 nt, Human
gccccagcccaccugcgacccgg

SEQ ID NO: 171737 - RNA, 28 nt, Human
gccccagcccagccugccucaucccacc

SEQ ID NO: 171738 - RNA, 32 nt, Human
gccccagcccagccuggggugcacugacggag

SEQ ID NO: 171739 - RNA, 32 nt, Human
gccccagcccaggaguagucuuaccucugagg

SEQ ID NO: 171740 - RNA, 32 nt, Human
gccccagccccacagaccagcccagcauucag

SEQ ID NO: 171741 - RNA, 22 nt, Human
gccccagccccagccccagugg

SEQ ID NO: 171742 - RNA, 32 nt, Human
gccccagccccauccccagccccagccccagc

SEQ ID NO: 171743 - RNA, 17 nt, Human
gccccagccccauggcc

SEQ ID NO: 171744 - RNA, 32 nt, Human
gccccagccccgccaccuuccugggcccugug

SEQ ID NO: 171745 - RNA, 26 nt, Human
gccccagcccgacgacgagcccgccg

SEQ ID NO: 171746 - RNA, 32 nt, Human
gccccagcccuaguccccuugugaccucagag

SEQ ID NO: 171747 - RNA, 32 nt, Human
gccccagccgagaucacagcgcgacaggagug

SEQ ID NO: 171748 - RNA, 21 nt, Human
gccccagccgccacccgaccc

SEQ ID NO: 171749 - RNA, 32 nt, Human
gccccagccgcugcagcagcggagacagucgc

SEQ ID NO: 171750 - RNA, 32 nt, Human
gccccagccuccaaggaugcggcuccucgaga

SEQ ID NO: 171751 - RNA, 32 nt, Human
gccccagccuccaucuucgucucucaggaugg

SEQ ID NO: 171752 - RNA, 32 nt, Human
gccccagccugaggaggagggagagggaggaa

SEQ ID NO: 171753 - RNA, 32 nt, Human
gccccagccuuucuccccagcauacagugagc

SEQ ID NO: 171754 - RNA, 32 nt, Human
gccccagcuacccuucuucuccagcugggcuc

SEQ ID NO: 171755 - RNA, 23 nt, Human
gccccagcuacuagggaggcuga

SEQ ID NO: 171756 - RNA, 23 nt, Human
gccccagcuacucaggaggcuga

SEQ ID NO: 171757 - RNA, 32 nt, Human
gccccagcuacucaggcuggggugggaggaug

SEQ ID NO: 171758 - RNA, 23 nt, Human
gccccagcuacucgggaggcuga

SEQ ID NO: 171759 - RNA, 23 nt, Human
gccccagcuacuugggaggcuga

SEQ ID NO: 171760 - RNA, 32 nt, Human
gccccagcuaggaagcaagaucgcugugcuag

SEQ ID NO: 171761 - RNA, 23 nt, Human
gccccagcuauucaggagacuga

SEQ ID NO: 171762 - RNA, 32 nt, Human
gccccagcuauucaggagacugaggcaggaga

SEQ ID NO: 171763 - RNA, 32 nt, Human
gccccagcucacacccucccaaugcuuauaug

SEQ ID NO: 171764 - RNA, 32 nt, Human
gccccagcucacucugaccacuucucugccug

SEQ ID NO: 171765 - RNA, 32 nt, Human
gccccagcuccucuuccugccucucucauggc

SEQ ID NO: 171766 - RNA, 16 nt, Human
gccccagcucugcugc

SEQ ID NO: 171767 - RNA, 22 nt, Human
gccccagcugaccagccccgcc

SEQ ID NO: 171768 - RNA, 19 nt, Human
gccccagcuggcccagccc

SEQ ID NO: 171769 - RNA, 19 nt, Human
gccccagcuucgcgcaggg

SEQ ID NO: 171770 - RNA, 21 nt, Human
gccccagcuugagugcagugg

SEQ ID NO: 171771 - RNA, 32 nt, Human
gccccagcuuuccuaggccagaauuguguuug

SEQ ID NO: 171772 - RNA, 32 nt, Human
gccccaggaaacaacagagcagcuuggcaucu

SEQ ID NO: 171773 - RNA, 24 nt, Human
gccccaggaaagggagcgaggaca

SEQ ID NO: 171774 - RNA, 20 nt, Human
gccccaggaacagcagaucu

SEQ ID NO: 171775 - RNA, 32 nt, Human
gccccaggaacagcagaucuaacagcugaugu

SEQ ID NO: 171776 - RNA, 23 nt, Human
gccccaggaagccaaggcugggg

SEQ ID NO: 171777 - RNA, 32 nt, Human
gccccaggaaggcucggaagcugugugggaag

SEQ ID NO: 171778 - RNA, 32 nt, Human
gccccaggaagggcaaggcaagaugguggaca

SEQ ID NO: 171779 - RNA, 32 nt, Human
gccccaggaccccucuucaagagccacugcgu

SEQ ID NO: 171780 - RNA, 26 nt, Human
gccccaggacccuucaaagggcuggg

SEQ ID NO: 171781 - RNA, 32 nt, Human
gccccaggacccuucaaagggcugggacaucc

SEQ ID NO: 171782 - RNA, 32 nt, Human
gccccaggagcauuggguuuguuugcacgggg

SEQ ID NO: 171783 - RNA, 22 nt, Human
gccccaggagcccccugccgga

SEQ ID NO: 171784 - RNA, 32 nt, Human
gccccaggagccucucaggagucuacauccca

SEQ ID NO: 171785 - RNA, 32 nt, Human
gccccaggagcuggagacaagaccuuguggcu

SEQ ID NO: 171786 - RNA, 32 nt, Human
gccccaggaggucgaggcugcagugagccaug

SEQ ID NO: 171787 - RNA, 25 nt, Human
gccccaggauccagguccaccagcc

SEQ ID NO: 171788 - RNA, 32 nt, Human
gccccaggcaagcuggaacuuggguggggagg

SEQ ID NO: 171789 - RNA, 17 nt, Human
gccccaggcacaguggc

SEQ ID NO: 171790 - RNA, 32 nt, Human
gccccaggcauccucagccucuggugggugcc

SEQ ID NO: 171791 - RNA, 32 nt, Human
gccccaggccacagcgugggaacucacuuucc

SEQ ID NO: 171792 - RNA, 32 nt, Human
gccccaggcccagcuucucuccugccuuccaa

SEQ ID NO: 171793 - RNA, 17 nt, Human
gccccaggccgcagggg

SEQ ID NO: 171794 - RNA, 32 nt, Human
gccccaggccugaguccuuagcaaggguuggg

SEQ ID NO: 171795 - RNA, 32 nt, Human
gccccaggcugcagcccauucgcaggcacccg

SEQ ID NO: 171796 - RNA, 32 nt, Human
gccccaggcugcaggugaggcuucaggggaug

SEQ ID NO: 171797 - RNA, 32 nt, Human
gccccaggcugcuggggugaccgcggagagag

SEQ ID NO: 171798 - RNA, 22 nt, Human
gccccaggcuggagugcagugg

SEQ ID NO: 171799 - RNA, 28 nt, Human
gccccaggcuuuagagcccucagcaggu

SEQ ID NO: 171800 - RNA, 24 nt, Human
gccccaggcuuugcagaaaccaca

SEQ ID NO: 171801 - RNA, 32 nt, Human
gccccaggcuuugcagaaaccacacacacugu

SEQ ID NO: 171802 - RNA, 32 nt, Human
gccccagggaaaggacaaggcugagagaauuc

SEQ ID NO: 171803 - RNA, 32 nt, Human
gccccagggaauggacccuuggagacucccau

SEQ ID NO: 171804 - RNA, 19 nt, Human
gccccagggagccaccuga

SEQ ID NO: 171805 - RNA, 32 nt, Human
gccccagggccaauccaagauccagagguagc

SEQ ID NO: 171806 - RNA, 32 nt, Human
gccccagggccagaggaguuggggucaucugu

SEQ ID NO: 171807 - RNA, 32 nt, Human
gccccagggccagauggagccaaaggucagcu

SEQ ID NO: 171808 - RNA, 23 nt, Human
gccccagggccagcaggcugggg

SEQ ID NO: 171809 - RNA, 32 nt, Human
gccccagggcccauccugaggucugcuagcca

SEQ ID NO: 171810 - RNA, 32 nt, Human
gccccagggcccuaccuccuggaaugcuuucc

SEQ ID NO: 171811 - RNA, 32 nt, Human
gccccagggcggagcucccagccagcaugguc

SEQ ID NO: 171812 - RNA, 21 nt, Human
gccccagggcucagagcuggg

SEQ ID NO: 171813 - RNA, 20 nt, Human
gccccaggggagcucagcag

SEQ ID NO: 171814 - RNA, 24 nt, Human
gccccaggggagcuggggcagcau

SEQ ID NO: 171815 - RNA, 22 nt, Human
gccccaggggccuccugggcca

SEQ ID NO: 171816 - RNA, 27 nt, Human
gccccagguagugccagcagaguaggg

SEQ ID NO: 171817 - RNA, 22 nt, Human
gccccaggucucaggaggggug

SEQ ID NO: 171818 - RNA, 32 nt, Human
gccccaggucuuccuccgccugcuccacacca

SEQ ID NO: 171819 - RNA, 28 nt, Human
gccccaggugaugcugccuuugcugucc

SEQ ID NO: 171820 - RNA, 32 nt, Human
gccccagguuaggaauaguggugggaggaagg

SEQ ID NO: 171821 - RNA, 32 nt, Human
gccccagguuauuacuggauuuauaggggccu

SEQ ID NO: 171822 - RNA, 32 nt, Human
gccccaguauaaguguugggaacucucugcca

SEQ ID NO: 171823 - RNA, 32 nt, Human
gccccagucaucuaccaguauccagcaugggg

SEQ ID NO: 171824 - RNA, 32 nt, Human
gccccagucccagagacccccaccuggugccc

SEQ ID NO: 171825 - RNA, 21 nt, Human
gccccagucuauaaauacagu

SEQ ID NO: 171826 - RNA, 20 nt, Human
gccccagugacccucaguga

SEQ ID NO: 171827 - RNA, 32 nt, Human
gccccagugcccggauguccaucaggauuagc

SEQ ID NO: 171828 - RNA, 32 nt, Human
gccccagugcgugcugucuguggagugugucu

SEQ ID NO: 171829 - RNA, 22 nt, Human
gccccaguggcucgccccaggg

SEQ ID NO: 171830 - RNA, 32 nt, Human
gccccagugggcgccucacacucagaaccuca

SEQ ID NO: 171831 - RNA, 32 nt, Human
gccccaguuguuucuacuacauggaagaccuc

SEQ ID NO: 171832 - RNA, 21 nt, Human
gccccaguuucucuucaggga

SEQ ID NO: 171833 - RNA, 32 nt, Human
gccccaguuuuccagagcacuggggauauauc

SEQ ID NO: 171834 - RNA, 32 nt, Human
gccccauacacaccuuagaugaugcauauggc

SEQ ID NO: 171835 - RNA, 20 nt, Human
gccccauacuuugggggucu

SEQ ID NO: 171836 - RNA, 32 nt, Human
gccccauagaagcagcaaagcagcaagcgacg

SEQ ID NO: 171837 - RNA, 32 nt, Human
gccccauagcccauaagggaggcugcugugca

SEQ ID NO: 171838 - RNA, 32 nt, Human
gccccauagccccugccggccgcacguguaaa

SEQ ID NO: 171839 - RNA, 25 nt, Human
gccccauaggcagagccccagggca

SEQ ID NO: 171840 - RNA, 32 nt, Human
gccccauauuaaaagaacucauucauaggaag

SEQ ID NO: 171841 - RNA, 32 nt, Human
gccccaucacucuggccucugccuucaucuca

SEQ ID NO: 171842 - RNA, 32 nt, Human
gccccaucacugccaacugcagggggccccuc

SEQ ID NO: 171843 - RNA, 28 nt, Human
gccccaucagaggcugccuccuccuucu

SEQ ID NO: 171844 - RNA, 32 nt, Human
gccccauccaaggagccagggcccugggucua

SEQ ID NO: 171845 - RNA, 18 nt, Human
gccccauccacccugccu

SEQ ID NO: 171846 - RNA, 32 nt, Human
gccccauccaccgccagcuucccuucacuccc

SEQ ID NO: 171847 - RNA, 32 nt, Human
gccccauccaucccaccugccacuaccuuggg

SEQ ID NO: 171848 - RNA, 32 nt, Human
gccccauccauguuccugcaaaggacaugauc

SEQ ID NO: 171849 - RNA, 32 nt, Human
gccccauccccagccccagccccagcccaguc

SEQ ID NO: 171850 - RNA, 21 nt, Human
gccccaucccccacagccagg

SEQ ID NO: 171851 - RNA, 18 nt, Human
gccccaucccggcuguug

SEQ ID NO: 171852 - RNA, 32 nt, Human
gccccaucccuucucucucugccaccauuucg

SEQ ID NO: 171853 - RNA, 32 nt, Human
gccccauccgcccucuggaccuguguagggcc

SEQ ID NO: 171854 - RNA, 25 nt, Human
gccccauccucucucugaagccagg

SEQ ID NO: 171855 - RNA, 18 nt, Human
gccccauccuggcugcug

SEQ ID NO: 171856 - RNA, 32 nt, Human
gccccauccuucucccccuguuagagaggggc

SEQ ID NO: 171857 - RNA, 32 nt, Human
gccccauccuuugcuuccuuccuuccuuccuu

SEQ ID NO: 171858 - RNA, 23 nt, Human
gccccaucgcuucccuucaugca

SEQ ID NO: 171859 - RNA, 19 nt, Human
gccccaucuccccagcggg

SEQ ID NO: 171860 - RNA, 32 nt, Human
gccccaucugcgggggcagugcucacccacac

SEQ ID NO: 171861 - RNA, 32 nt, Human
gccccaucugugcauucuccuggaugcuuaga

SEQ ID NO: 171862 - RNA, 32 nt, Human
gccccaucuuagagucaaaggcagaggggcuu

SEQ ID NO: 171863 - RNA, 32 nt, Human
gccccaucuucuggcccuuagcuggugccacu

SEQ ID NO: 171864 - RNA, 32 nt, Human
gccccaucuuuguccggccuccgcgcuuuguu

SEQ ID NO: 171865 - RNA, 30 nt, Human
gccccaugaagugcuggaaggcagcccugg

SEQ ID NO: 171866 - RNA, 18 nt, Human
gccccaugagaacagcuu

SEQ ID NO: 171867 - RNA, 32 nt, Human
gccccaugcacggggagccaggugggcugggc

SEQ ID NO: 171868 - RNA, 32 nt, Human
gccccaugcacucccuguaucuugcacuaaau

SEQ ID NO: 171869 - RNA, 20 nt, Human
gccccaugcaugcugcugcc

SEQ ID NO: 171870 - RNA, 21 nt, Human
gccccaugcccagcccugccu

SEQ ID NO: 171871 - RNA, 32 nt, Human
gccccaugcccagcccugccuuggucccccaa

SEQ ID NO: 171872 - RNA, 23 nt, Human
gccccaugccccgaggaggggug

SEQ ID NO: 171873 - RNA, 32 nt, Human
gccccaugccuguccagccugggcagccaggc

SEQ ID NO: 171874 - RNA, 32 nt, Human
gccccaugcuaggugcaccaucuuccuccauu

SEQ ID NO: 171875 - RNA, 24 nt, Human
gccccaugcuguccuccuacccca

SEQ ID NO: 171876 - RNA, 30 nt, Human
gccccauggagguggcggugcccgugaagc

SEQ ID NO: 171877 - RNA, 32 nt, Human
gccccauggcucccagacucugucugugccga

SEQ ID NO: 171878 - RNA, 32 nt, Human
gccccaugggcuguguuacauagagacagcag

SEQ ID NO: 171879 - RNA, 32 nt, Human
gccccaugguacgcccugcccaguuuccaguu

SEQ ID NO: 171880 - RNA, 32 nt, Human
gccccauguaacagaggagaaagggaagcuca

SEQ ID NO: 171881 - RNA, 31 nt, Human
gccccauguccaucugggccacugucaggac

SEQ ID NO: 171882 - RNA, 32 nt, Human
gccccauguuaaccccuccacucuuucuuuca

SEQ ID NO: 171883 - RNA, 32 nt, Human
gccccauuaguggguuagcgggucugaccuca

SEQ ID NO: 171884 - RNA, 32 nt, Human
gccccauuccccagaucauccauuucguccuc

SEQ ID NO: 171885 - RNA, 20 nt, Human
gccccauuccugcugagcag

SEQ ID NO: 171886 - RNA, 32 nt, Human
gccccauugcuggccuugcaucugaauaggcc

SEQ ID NO: 171887 - RNA, 32 nt, Human
gccccauuguacuccagccuggggaacaagaa

SEQ ID NO: 171888 - RNA, 32 nt, Human
gccccauugucagccccaggcccagccccagg

SEQ ID NO: 171889 - RNA, 20 nt, Human
gccccauuguccucaccagu

SEQ ID NO: 171890 - RNA, 32 nt, Human
gccccauuuccucacacuaagagggcagacug

SEQ ID NO: 171891 - RNA, 32 nt, Human
gccccauuuccuuuacaaacccccgcacaauu

SEQ ID NO: 171892 - RNA, 32 nt, Human
gccccauuugcuuuuaccuguacuguauucuu

SEQ ID NO: 171893 - RNA, 29 nt, Human
gccccauuugucugugugccugccaggau

SEQ ID NO: 171894 - RNA, 32 nt, Human
gcccccaaaacagccugagcaaaaagaccagc

SEQ ID NO: 171895 - RNA, 32 nt, Human
gcccccaaaccuggaaacuuccucugcaccuc

SEQ ID NO: 171896 - RNA, 18 nt, Human
gcccccaaagagcaaagg

SEQ ID NO: 171897 - RNA, 32 nt, Human
gcccccaaagugcugggauuacaggcaugagc

SEQ ID NO: 171898 - RNA, 19 nt, Human
gcccccaaccccuccuucc

SEQ ID NO: 171899 - RNA, 22 nt, Human
gcccccaaccuccaacccacca

SEQ ID NO: 171900 - RNA, 17 nt, Human
gcccccaacuacccucc

SEQ ID NO: 171901 - RNA, 23 nt, Human
gcccccaagaaaggcucuggugg

SEQ ID NO: 171902 - RNA, 22 nt, Human
gcccccaagacugcucuggugg

SEQ ID NO: 171903 - RNA, 18 nt, Human
gcccccaagccggugggc

SEQ ID NO: 171904 - RNA, 19 nt, Human
gcccccaaggcggaggcug

SEQ ID NO: 171905 - RNA, 32 nt, Human
gcccccaaggcucuccucugagagccaccaag

SEQ ID NO: 171906 - RNA, 19 nt, Human
gcccccaagguccagggca

SEQ ID NO: 171907 - RNA, 23 nt, Human
gcccccaaucacccgccccgccc

SEQ ID NO: 171908 - RNA, 32 nt, Human
gcccccaauccugcuugcucccagcuugguaa

SEQ ID NO: 171909 - RNA, 32 nt, Human
gcccccaaugcccaccaccugggccccgguca

SEQ ID NO: 171910 - RNA, 32 nt, Human
gcccccaaugugccuuggaccaguuccugugu

SEQ ID NO: 171911 - RNA, 17 nt, Human
gcccccaauuccacucu

SEQ ID NO: 171912 - RNA, 32 nt, Human
gcccccacaagccuggucaucagccaggcagc

SEQ ID NO: 171913 - RNA, 18 nt, Human
gcccccacacccaccucu

SEQ ID NO: 171914 - RNA, 20 nt, Human
gcccccacaccccugcugcc

SEQ ID NO: 171915 - RNA, 17 nt, Human
gcccccacacugcgccu

SEQ ID NO: 171916 - RNA, 19 nt, Human
gcccccacacugugccuga

SEQ ID NO: 171917 - RNA, 32 nt, Human
gcccccacagaggcacaguccccagccaccuc

SEQ ID NO: 171918 - RNA, 24 nt, Human
gcccccacagauccuauccuccaa

SEQ ID NO: 171919 - RNA, 20 nt, Human
gcccccacagcccuccaggu

SEQ ID NO: 171920 - RNA, 32 nt, Human
gcccccacagcccucuggggagccucacccug

SEQ ID NO: 171921 - RNA, 32 nt, Human
gcccccacagccggauccccucagccuuccag

SEQ ID NO: 171922 - RNA, 32 nt, Human
gcccccacaugccagccccacccuccagucgg

SEQ ID NO: 171923 - RNA, 18 nt, Human
gcccccaccacagcagaa

SEQ ID NO: 171924 - RNA, 32 nt, Human
gcccccaccauccuuucucuggcuucuuuuag

SEQ ID NO: 171925 - RNA, 21 nt, Human
gcccccacccacgcugccucc

SEQ ID NO: 171926 - RNA, 25 nt, Human
gcccccacccacugcccauccccca

SEQ ID NO: 171927 - RNA, 23 nt, Human
gcccccacccacuucccugggca

SEQ ID NO: 171928 - RNA, 21 nt, Human
gcccccacccaggucccccga

SEQ ID NO: 171929 - RNA, 32 nt, Human
gcccccacccaggucccccgacugccugucuc

SEQ ID NO: 171930 - RNA, 32 nt, Human
gcccccacccaguggaccuugauguccugagg

SEQ ID NO: 171931 - RNA, 24 nt, Human
gcccccacccaucucaugccccag

SEQ ID NO: 171932 - RNA, 32 nt, Human
gcccccaccccacgggaggguggggaugggag

SEQ ID NO: 171933 - RNA, 32 nt, Human
gcccccacccccaaaggcucagccucuaaauc

SEQ ID NO: 171934 - RNA, 24 nt, Human
gcccccacccccaagguucuccaa

SEQ ID NO: 171935 - RNA, 32 nt, Human
gcccccacccccacccuccaccugccccucuu

SEQ ID NO: 171936 - RNA, 32 nt, Human
gcccccacccccagcucugccugccuguccua

SEQ ID NO: 171937 - RNA, 25 nt, Human
gcccccacccccugucggcgucugg

SEQ ID NO: 171938 - RNA, 25 nt, Human
gcccccaccccgccccccgcccuga

SEQ ID NO: 171939 - RNA, 18 nt, Human
gcccccacccggugggua

SEQ ID NO: 171940 - RNA, 19 nt, Human
gcccccacccucagccguu

SEQ ID NO: 171941 - RNA, 19 nt, Human
gcccccacccugccuggug

SEQ ID NO: 171942 - RNA, 32 nt, Human
gcccccacccugcuucugcugccuguuugggg

SEQ ID NO: 171943 - RNA, 32 nt, Human
gcccccacccuugaccucaacaggguccugga

SEQ ID NO: 171944 - RNA, 32 nt, Human
gcccccaccgcuguggccggcacuccauuccg

SEQ ID NO: 171945 - RNA, 32 nt, Human
gcccccaccucugcccuccaccagcgucgaga

SEQ ID NO: 171946 - RNA, 22 nt, Human
gcccccaccucugccuccaggu

SEQ ID NO: 171947 - RNA, 21 nt, Human
gcccccaccucuggccugcag

SEQ ID NO: 171948 - RNA, 21 nt, Human
gcccccaccugcccucccggg

SEQ ID NO: 171949 - RNA, 22 nt, Human
gcccccacguggaacauucugg

SEQ ID NO: 171950 - RNA, 32 nt, Human
gcccccacucaggcccccgggccccgcuggaa

SEQ ID NO: 171951 - RNA, 32 nt, Human
gcccccacucccguguuuucugaccuccugcc

SEQ ID NO: 171952 - RNA, 32 nt, Human
gcccccacuccuccuccuuucuuugcuguuug

SEQ ID NO: 171953 - RNA, 32 nt, Human
gcccccacucuuuuugucuugcucugaggaug

SEQ ID NO: 171954 - RNA, 32 nt, Human
gcccccacugagcaggccaacaugcuguugug

SEQ ID NO: 171955 - RNA, 24 nt, Human
gcccccacugcaccagcaaugcua

SEQ ID NO: 171956 - RNA, 32 nt, Human
gcccccacugucccuccuccaggcauccuggu

SEQ ID NO: 171957 - RNA, 32 nt, Human
gcccccacuuccuuugagaccugcacucucau

SEQ ID NO: 171958 - RNA, 21 nt, Human
gcccccagaaccaggccccca

SEQ ID NO: 171959 - RNA, 24 nt, Human
gcccccagaacccuggccugugug

SEQ ID NO: 171960 - RNA, 32 nt, Human
gcccccagaaccuggcuccagccagggggcca

SEQ ID NO: 171961 - RNA, 32 nt, Human
gcccccagaagaagcuggagugcauagugcgg

SEQ ID NO: 171962 - RNA, 32 nt, Human
gcccccagaagcagagcuuuguuuuggagguu

SEQ ID NO: 171963 - RNA, 32 nt, Human
gcccccagaaggucauacucugccauuuuguc

SEQ ID NO: 171964 - RNA, 32 nt, Human
gcccccagaccccugaaaacccacgcaagccc

SEQ ID NO: 171965 - RNA, 21 nt, Human
gcccccagaccucccaguggg

SEQ ID NO: 171966 - RNA, 32 nt, Human
gcccccagagacugacuuguggggcccagcug

SEQ ID NO: 171967 - RNA, 18 nt, Human
gcccccagagcuccuccc

SEQ ID NO: 171968 - RNA, 20 nt, Human
gcccccagagcugggccaca

SEQ ID NO: 171969 - RNA, 32 nt, Human
gcccccagagggcagaagcagcguggaggggc

SEQ ID NO: 171970 - RNA, 32 nt, Human
gcccccagagugugcagcugugauucagaauc

SEQ ID NO: 171971 - RNA, 19 nt, Human
gcccccagcaccccugccu

SEQ ID NO: 171972 - RNA, 32 nt, Human
gcccccagcaccuugcacauaggugucugaua

SEQ ID NO: 171973 - RNA, 32 nt, Human
gcccccagcauccucuugcacuggcuggcaca

SEQ ID NO: 171974 - RNA, 32 nt, Human
gcccccagccaagcauuggggccgccauccug

SEQ ID NO: 171975 - RNA, 22 nt, Human
gcccccagccagaguccuggcu

SEQ ID NO: 171976 - RNA, 32 nt, Human
gcccccagccauggcccugucccugccucugg

SEQ ID NO: 171977 - RNA, 21 nt, Human
gcccccagcccaccccugccc

SEQ ID NO: 171978 - RNA, 32 nt, Human
gcccccagccccagcagucagcgcgguggacg

SEQ ID NO: 171979 - RNA, 32 nt, Human
gcccccagccccucgucgcggguucagguccg

SEQ ID NO: 171980 - RNA, 32 nt, Human
gcccccagccgaucccuccacccucuaccgag

SEQ ID NO: 171981 - RNA, 32 nt, Human
gcccccagccgcggcaucgcuucuguggcccc

SEQ ID NO: 171982 - RNA, 32 nt, Human
gcccccagccuaugggggaucuggccucugcc

SEQ ID NO: 171983 - RNA, 32 nt, Human
gcccccagccucccacucgacuuuccucuuag

SEQ ID NO: 171984 - RNA, 32 nt, Human
gcccccagccucccccucggccgccuccacga

SEQ ID NO: 171985 - RNA, 32 nt, Human
gcccccagccuccuagccauaacccucccugc

SEQ ID NO: 171986 - RNA, 32 nt, Human
gcccccagccucuggccucccuccaguagccc

SEQ ID NO: 171987 - RNA, 21 nt, Human
gcccccagccugugccuugcu

SEQ ID NO: 171988 - RNA, 32 nt, Human
gcccccagccuugccuacagggaggguagaug

SEQ ID NO: 171989 - RNA, 18 nt, Human
gcccccagcgucgccccu

SEQ ID NO: 171990 - RNA, 32 nt, Human
gcccccagcugccccaugcucugcaccugcua

SEQ ID NO: 171991 - RNA, 19 nt, Human
gcccccagcuuccagcagg

SEQ ID NO: 171992 - RNA, 32 nt, Human
gcccccagcuucccucccuccaugaagccacu

SEQ ID NO: 171993 - RNA, 30 nt, Human
gcccccagcuugcauugaaaggcucuaguu

SEQ ID NO: 171994 - RNA, 32 nt, Human
gcccccaggaaagacgggccugggggaggcgg

SEQ ID NO: 171995 - RNA, 32 nt, Human
gcccccaggaaucccuuccucccauguccugg

SEQ ID NO: 171996 - RNA, 32 nt, Human
gcccccaggaccacuaccccacggccagccag

SEQ ID NO: 171997 - RNA, 32 nt, Human
gcccccaggacuaguggagguucucugcccac

SEQ ID NO: 171998 - RNA, 32 nt, Human
gcccccaggauacuaacuagaccuuuggccug

SEQ ID NO: 171999 - RNA, 32 nt, Human
gcccccaggcccucccgcaucucagguugggg

SEQ ID NO: 172000 - RNA, 18 nt, Human
gcccccagggccuucccu

SEQ ID NO: 172001 - RNA, 32 nt, Human
gcccccagggcugagcuguguggugcaggcca

SEQ ID NO: 172002 - RNA, 32 nt, Human
gcccccagggcuggucugagugcagguggggg

SEQ ID NO: 172003 - RNA, 32 nt, Human
gcccccaggguagccauagaaaagcaacucca

SEQ ID NO: 172004 - RNA, 32 nt, Human
gcccccagguaacugggacuacaggcaugcac

SEQ ID NO: 172005 - RNA, 23 nt, Human
gcccccagucucuccccuugccu

SEQ ID NO: 172006 - RNA, 32 nt, Human
gcccccagugccucaccuuccaacacuccauu

SEQ ID NO: 172007 - RNA, 32 nt, Human
gcccccaguguuuuccccacugguuagcauuc

SEQ ID NO: 172008 - RNA, 32 nt, Human
gcccccaguuccacaagauccaaccaagaauu

SEQ ID NO: 172009 - RNA, 32 nt, Human
gcccccaguuuuggaggaaggaggaaauggga

SEQ ID NO: 172010 - RNA, 32 nt, Human
gcccccauaccaggcccuagcucccagacaac

SEQ ID NO: 172011 - RNA, 32 nt, Human
gcccccauauugcguggcaaaggggcuaggua

SEQ ID NO: 172012 - RNA, 23 nt, Human
gcccccaucaagcagagcuaggg

SEQ ID NO: 172013 - RNA, 24 nt, Human
gcccccaucaauacaaccagcucc

SEQ ID NO: 172014 - RNA, 21 nt, Human
gcccccaucacccucguuucc

SEQ ID NO: 172015 - RNA, 23 nt, Human
gcccccaucaccucaggcuucuc

SEQ ID NO: 172016 - RNA, 24 nt, Human
gcccccaucaccucuacugucucc

SEQ ID NO: 172017 - RNA, 32 nt, Human
gcccccaucaucacgauggagucagcuucagg

SEQ ID NO: 172018 - RNA, 32 nt, Human
gcccccauccaccuccucgcugcgacccucuc

SEQ ID NO: 172019 - RNA, 22 nt, Human
gcccccaucccagucccgggag

SEQ ID NO: 172020 - RNA, 27 nt, Human
gcccccauccccagcacuguguguugg

SEQ ID NO: 172021 - RNA, 23 nt, Human
gcccccauccccuuguuuucugg

SEQ ID NO: 172022 - RNA, 23 nt, Human
gcccccaucccucccagugcugg

SEQ ID NO: 172023 - RNA, 19 nt, Human
gcccccauccucgcauggc

SEQ ID NO: 172024 - RNA, 16 nt, Human
gcccccaucugcugcc

SEQ ID NO: 172025 - RNA, 19 nt, Human
gcccccaucuuggggguca

SEQ ID NO: 172026 - RNA, 32 nt, Human
gcccccaucuuuccuccaaacuccugccugug

SEQ ID NO: 172027 - RNA, 32 nt, Human
gcccccaugauucaauuaccuaccacaacacc

SEQ ID NO: 172028 - RNA, 20 nt, Human
gcccccaugcagccgccaca

SEQ ID NO: 172029 - RNA, 32 nt, Human
gcccccaugccaccuccaugacucuacucucc

SEQ ID NO: 172030 - RNA, 20 nt, Human
gcccccaugcccccacccca

SEQ ID NO: 172031 - RNA, 32 nt, Human
gcccccaugccccugcccaacaugcugggggu

SEQ ID NO: 172032 - RNA, 31 nt, Human
gcccccaugccggcggccaacaugauggaga

SEQ ID NO: 172033 - RNA, 32 nt, Human
gcccccaugccuggcccugccugagccaggug

SEQ ID NO: 172034 - RNA, 32 nt, Human
gcccccauguucugcuuuccuccacugugccu

SEQ ID NO: 172035 - RNA, 32 nt, Human
gcccccauucacguugguccucagggaaacca

SEQ ID NO: 172036 - RNA, 32 nt, Human
gcccccauuccacagacacuggagucuucacu

SEQ ID NO: 172037 - RNA, 19 nt, Human
gcccccauugcagccccca

SEQ ID NO: 172038 - RNA, 17 nt, Human
gcccccauuucugcugc

SEQ ID NO: 172039 - RNA, 22 nt, Human
gcccccauuugagaaccacugg

SEQ ID NO: 172040 - RNA, 32 nt, Human
gcccccauuuucacccgauccugggcucuccc

SEQ ID NO: 172041 - RNA, 23 nt, Human
gccccccaacccccgaccugggg

SEQ ID NO: 172042 - RNA, 17 nt, Human
gccccccacacuucccu

SEQ ID NO: 172043 - RNA, 18 nt, Human
gccccccaccaaccacca

SEQ ID NO: 172044 - RNA, 21 nt, Human
gccccccagcccaggcccagc

SEQ ID NO: 172045 - RNA, 23 nt, Human
gccccccagcccaguuacugcag

SEQ ID NO: 172046 - RNA, 24 nt, Human
gccccccagccccacagccugagc

SEQ ID NO: 172047 - RNA, 20 nt, Human
gccccccagccccgcgcagc

SEQ ID NO: 172048 - RNA, 24 nt, Human
gccccccagcccuggcuccccagc

SEQ ID NO: 172049 - RNA, 20 nt, Human
gccccccagccuccauggcu

SEQ ID NO: 172050 - RNA, 24 nt, Human
gccccccaggagagcugggcacau

SEQ ID NO: 172051 - RNA, 16 nt, Human
gccccccaggcugccu

SEQ ID NO: 172052 - RNA, 17 nt, Human
gccccccauccugcuca

SEQ ID NO: 172053 - RNA, 18 nt, Human
gccccccgcucccacccc

SEQ ID NO: 172054 - RNA, 22 nt, Human
gccccccggccgccccgacggg

SEQ ID NO: 172055 - RNA, 22 nt, Human
gccccccucagccccugccucc

SEQ ID NO: 172056 - RNA, 22 nt, Human
gccccccucaucuccacccucc

SEQ ID NO: 172057 - RNA, 20 nt, Human
gccccccucgcccugagcca

SEQ ID NO: 172058 - RNA, 18 nt, Human
gccccccucgccgcgcgu

SEQ ID NO: 172059 - RNA, 20 nt, Human
gccccccucuauccuugaua

SEQ ID NO: 172060 - RNA, 17 nt, Human
gccccccugcugcugcc

SEQ ID NO: 172061 - RNA, 17 nt, Human
gccccccuggcuccagg

SEQ ID NO: 172062 - RNA, 21 nt, Human
gccccccuugugcagagccag

SEQ ID NO: 172063 - RNA, 18 nt, Human
gcccccgacauccugccu

SEQ ID NO: 172064 - RNA, 32 nt, Human
gcccccgaccacacaaacccagccuggggagg

SEQ ID NO: 172065 - RNA, 32 nt, Human
gcccccgaccuggaggcccucagucugggcug

SEQ ID NO: 172066 - RNA, 32 nt, Human
gcccccgagacaccuugaggaggccgcuccuu

SEQ ID NO: 172067 - RNA, 32 nt, Human
gcccccgagcccugacuccuggacuccggagg

SEQ ID NO: 172068 - RNA, 32 nt, Human
gcccccgagcugcucccuuuccugcaccuccc

SEQ ID NO: 172069 - RNA, 32 nt, Human
gcccccgaggaggaggaggaggaggaggacgc

SEQ ID NO: 172070 - RNA, 32 nt, Human
gcccccgcagaacuggcugcugcgugugaacu

SEQ ID NO: 172071 - RNA, 32 nt, Human
gcccccgcaggcuucugugugcugcuaacugu

SEQ ID NO: 172072 - RNA, 21 nt, Human
gcccccgcauccccugccucc

SEQ ID NO: 172073 - RNA, 19 nt, Human
gcccccgccccuccucccg

SEQ ID NO: 172074 - RNA, 19 nt, Human
gcccccgcccgcgcccccu

SEQ ID NO: 172075 - RNA, 21 nt, Human
gcccccgcccugccccaggga

SEQ ID NO: 172076 - RNA, 20 nt, Human
gcccccgcccugucccaagg

SEQ ID NO: 172077 - RNA, 19 nt, Human
gcccccgccgccgcugcca

SEQ ID NO: 172078 - RNA, 32 nt, Human
gcccccgccgcugcucagaccuccaggaggga

SEQ ID NO: 172079 - RNA, 21 nt, Human
gcccccgccggccgaggcugg

SEQ ID NO: 172080 - RNA, 32 nt, Human
gcccccgccggccuggccaggacugagugcag

SEQ ID NO: 172081 - RNA, 32 nt, Human
gcccccgccguggagccgugugguguaugugu

SEQ ID NO: 172082 - RNA, 32 nt, Human
gcccccgccuccuuccccuccucggccauggc

SEQ ID NO: 172083 - RNA, 22 nt, Human
gcccccgccuggccccaaccuc

SEQ ID NO: 172084 - RNA, 20 nt, Human
gcccccgcgaugcccugggg

SEQ ID NO: 172085 - RNA, 27 nt, Human
gcccccgcgcaggcgcgccccacgccc

SEQ ID NO: 172086 - RNA, 17 nt, Human
gcccccgcgccgcgccc

SEQ ID NO: 172087 - RNA, 23 nt, Human
gcccccgcgcuggacuggggcag

SEQ ID NO: 172088 - RNA, 32 nt, Human
gcccccgcggccacuccucacccuccgaccac

SEQ ID NO: 172089 - RNA, 22 nt, Human
gcccccgcggcucccugccagg

SEQ ID NO: 172090 - RNA, 32 nt, Human
gcccccgcuacacuccagccuggucgacagag

SEQ ID NO: 172091 - RNA, 24 nt, Human
gcccccgcugaccuccccaccuca

SEQ ID NO: 172092 - RNA, 32 nt, Human
gcccccgcugacucccacagaaacccaccuac

SEQ ID NO: 172093 - RNA, 19 nt, Human
gcccccggagcccccgcgg

SEQ ID NO: 172094 - RNA, 32 nt, Human
gcccccggauacugcagucguaucuccggaaa

SEQ ID NO: 172095 - RNA, 32 nt, Human
gcccccggcaggcaagguucugcugggagacg

SEQ ID NO: 172096 - RNA, 25 nt, Human
gcccccggcagucucuggggcgcau

SEQ ID NO: 172097 - RNA, 32 nt, Human
gcccccggcccaggcccuugggguggacaagu

SEQ ID NO: 172098 - RNA, 32 nt, Human
gcccccggcccggccacugcaggaugcccacc

SEQ ID NO: 172099 - RNA, 32 nt, Human
gcccccggcugcagcccaggccauggacaugu

SEQ ID NO: 172100 - RNA, 21 nt, Human
gcccccggcuuggggcgccuu

SEQ ID NO: 172101 - RNA, 32 nt, Human
gcccccgggaccccaccucuggccccaccucc

SEQ ID NO: 172102 - RNA, 32 nt, Human
gcccccgggcaguucuggugaggcuaagcaag

SEQ ID NO: 172103 - RNA, 20 nt, Human
gcccccgggggcggggcacg

SEQ ID NO: 172104 - RNA, 32 nt, Human
gcccccguaagaacccacgaagcaggcgaagu

SEQ ID NO: 172105 - RNA, 26 nt, Human
gcccccguagucccagcuacucagga

SEQ ID NO: 172106 - RNA, 16 nt, Human
gcccccgucugcugcu

SEQ ID NO: 172107 - RNA, 32 nt, Human
gcccccguggagucugcagagaggccuuggcc

SEQ ID NO: 172108 - RNA, 17 nt, Human
gcccccguguccaggug

SEQ ID NO: 172109 - RNA, 20 nt, Human
gcccccguucccguccaggu

SEQ ID NO: 172110 - RNA, 32 nt, Human
gcccccguugugcccagcauugcccgggugag

SEQ ID NO: 172111 - RNA, 32 nt, Human
gcccccuaauccccuucuccccugcacuguaa

SEQ ID NO: 172112 - RNA, 18 nt, Human
gcccccuaccacuccacg

SEQ ID NO: 172113 - RNA, 32 nt, Human
gcccccuagagugcagagaugccugggucugc

SEQ ID NO: 172114 - RNA, 21 nt, Human
gcccccuaggaagcaccagcc

SEQ ID NO: 172115 - RNA, 32 nt, Human
gcccccuaguagcuggcauuacaggcacaugc

SEQ ID NO: 172116 - RNA, 32 nt, Human
gcccccucacccuccucccucucccuccuccu

SEQ ID NO: 172117 - RNA, 32 nt, Human
gcccccucaccuuuuuggguagguaaaagacu

SEQ ID NO: 172118 - RNA, 32 nt, Human
gcccccucacgccugccuuccugggccagcuu

SEQ ID NO: 172119 - RNA, 32 nt, Human
gcccccucacuaauagcggccaccccggcagc

SEQ ID NO: 172120 - RNA, 32 nt, Human
gcccccucaggcaccuuuccuccccuggacac

SEQ ID NO: 172121 - RNA, 32 nt, Human
gcccccucaguaacacgggcucugcugacggc

SEQ ID NO: 172122 - RNA, 32 nt, Human
gcccccucaguguugucaccagaucugauuug

SEQ ID NO: 172123 - RNA, 32 nt, Human
gcccccuccaccgcgccugccucccaggccug

SEQ ID NO: 172124 - RNA, 31 nt, Human
gcccccuccacuccggggccugugccgccag

SEQ ID NO: 172125 - RNA, 22 nt, Human
gcccccuccacuggaggggucu

SEQ ID NO: 172126 - RNA, 32 nt, Human
gcccccuccagcccccggcucccggcagcaga

SEQ ID NO: 172127 - RNA, 32 nt, Human
gcccccuccagcucaugacacuguuuggccuu

SEQ ID NO: 172128 - RNA, 32 nt, Human
gcccccucccaaacugugacugguauuuauug

SEQ ID NO: 172129 - RNA, 32 nt, Human
gcccccucccauccauagugcauggugugugg

SEQ ID NO: 172130 - RNA, 22 nt, Human
gcccccucccccagcacggcuu

SEQ ID NO: 172131 - RNA, 19 nt, Human
gcccccuccccuugcccuu

SEQ ID NO: 172132 - RNA, 32 nt, Human
gcccccucccucucccuugagaagcugagucu

SEQ ID NO: 172133 - RNA, 32 nt, Human
gcccccucccuggaugacauuaaagaaggguu

SEQ ID NO: 172134 - RNA, 18 nt, Human
gcccccucccuguccagg

SEQ ID NO: 172135 - RNA, 32 nt, Human
gcccccuccucagcugccuccuccaggcaucu

SEQ ID NO: 172136 - RNA, 19 nt, Human
gcccccuccucagucucca

SEQ ID NO: 172137 - RNA, 32 nt, Human
gcccccuccuccaggaaggcaaccccugugcc

SEQ ID NO: 172138 - RNA, 19 nt, Human
gcccccuccucccccggga

SEQ ID NO: 172139 - RNA, 32 nt, Human
gcccccuccuccccucucuccugggcccucau

SEQ ID NO: 172140 - RNA, 32 nt, Human
gcccccuccuucaagcccugagaucuucagga

SEQ ID NO: 172141 - RNA, 32 nt, Human
gcccccuccuucaggcucucucacugucuaaa

SEQ ID NO: 172142 - RNA, 32 nt, Human
gcccccuccuucaguugcccuuucugaggcaa

SEQ ID NO: 172143 - RNA, 24 nt, Human
gcccccucgccuucccuguuccca

SEQ ID NO: 172144 - RNA, 32 nt, Human
gcccccucggcccucugguccggccagcuccg

SEQ ID NO: 172145 - RNA, 32 nt, Human
gcccccucuccuccuuggcacuggcggccucc

SEQ ID NO: 172146 - RNA, 32 nt, Human
gcccccucuccucgcguaguccggcccgagcc

SEQ ID NO: 172147 - RNA, 25 nt, Human
gcccccucuccuucuccuagcucug

SEQ ID NO: 172148 - RNA, 32 nt, Human
gcccccucucuccuggcugcaguccuuggcgc

SEQ ID NO: 172149 - RNA, 32 nt, Human
gcccccucugacagccauccuccugggagccc

SEQ ID NO: 172150 - RNA, 32 nt, Human
gcccccucugcaggcucucugucugcccuggg

SEQ ID NO: 172151 - RNA, 22 nt, Human
gcccccucugccacacgcuuug

SEQ ID NO: 172152 - RNA, 19 nt, Human
gcccccucuguccuucccu

SEQ ID NO: 172153 - RNA, 32 nt, Human
gcccccucuucaacuccucucacuuuuuaaag

SEQ ID NO: 172154 - RNA, 32 nt, Human
gcccccucuuccuaugcagcuuuaaugucccc

SEQ ID NO: 172155 - RNA, 28 nt, Human
gcccccugaccuuccaaaccucaauaaa

SEQ ID NO: 172156 - RNA, 32 nt, Human
gcccccugacgcugcugauucgggcuguggcc

SEQ ID NO: 172157 - RNA, 31 nt, Human
gcccccugacuucuggcuggccagaggcugc

SEQ ID NO: 172158 - RNA, 32 nt, Human
gcccccugagagugaauucaaaguuaacuuca

SEQ ID NO: 172159 - RNA, 32 nt, Human
gcccccugaggguuugcucuccucucaagguu

SEQ ID NO: 172160 - RNA, 32 nt, Human
gcccccugcacccugcucucucccgggccuug

SEQ ID NO: 172161 - RNA, 32 nt, Human
gcccccugcccaggcuggguaagagaugggcu

SEQ ID NO: 172162 - RNA, 32 nt, Human
gcccccugccccagggcucuucagaaagcauc

SEQ ID NO: 172163 - RNA, 18 nt, Human
gcccccugcccccacccc

SEQ ID NO: 172164 - RNA, 32 nt, Human
gcccccugcccgaggggcggggcugacggcuc

SEQ ID NO: 172165 - RNA, 32 nt, Human
gcccccugcccuccucucccucccagauggac

SEQ ID NO: 172166 - RNA, 32 nt, Human
gcccccugcccugagaacaggaaagggcccgg

SEQ ID NO: 172167 - RNA, 22 nt, Human
gcccccugcccugcccaccuca

SEQ ID NO: 172168 - RNA, 32 nt, Human
gcccccugccuucucugcuccccaucauguag

SEQ ID NO: 172169 - RNA, 32 nt, Human
gcccccugcuaccacacacugcugcaucuugg

SEQ ID NO: 172170 - RNA, 32 nt, Human
gcccccugcucugcugcucugccuguccgccu

SEQ ID NO: 172171 - RNA, 16 nt, Human
gcccccugcugcugcc

SEQ ID NO: 172172 - RNA, 32 nt, Human
gcccccugcuggacucaggugcccagaacucu

SEQ ID NO: 172173 - RNA, 32 nt, Human
gcccccuggacucgcaggcgagcccaggacuc

SEQ ID NO: 172174 - RNA, 32 nt, Human
gcccccuggagcuccuccuagagcagagucug

SEQ ID NO: 172175 - RNA, 32 nt, Human
gcccccuggaggcagagcacugagcuggaccc

SEQ ID NO: 172176 - RNA, 32 nt, Human
gcccccuggggaaacguggcagcagguggccc

SEQ ID NO: 172177 - RNA, 32 nt, Human
gcccccuggggcccugccccacagcaucauga

SEQ ID NO: 172178 - RNA, 32 nt, Human
gcccccuggggccugggcugcugcugguucuu

SEQ ID NO: 172179 - RNA, 32 nt, Human
gcccccugggucccaagcaaccucagccaaug

SEQ ID NO: 172180 - RNA, 32 nt, Human
gcccccugggucccaagcaaccucagccagug

SEQ ID NO: 172181 - RNA, 24 nt, Human
gcccccugguccugaccugugaug

SEQ ID NO: 172182 - RNA, 32 nt, Human
gcccccugugcuguuugaggcgugaaacucac

SEQ ID NO: 172183 - RNA, 32 nt, Human
gcccccuguuccuggguuuaugcaguuuucuu

SEQ ID NO: 172184 - RNA, 32 nt, Human
gcccccuucauugcaccuaucucccccaucuc

SEQ ID NO: 172185 - RNA, 32 nt, Human
gcccccuuccucaccucuuccaccccucagac

SEQ ID NO: 172186 - RNA, 32 nt, Human
gcccccuuccuccaaagucccugccacaggag

SEQ ID NO: 172187 - RNA, 17 nt, Human
gcccccuuccugccaga

SEQ ID NO: 172188 - RNA, 32 nt, Human
gcccccuuccuugcucuggaccccuuagguau

SEQ ID NO: 172189 - RNA, 22 nt, Human
gcccccuucuaggacaacccca

SEQ ID NO: 172190 - RNA, 32 nt, Human
gcccccuucuaucuccccuucuguccagggcc

SEQ ID NO: 172191 - RNA, 32 nt, Human
gcccccuucucccacacugcuaggugggccag

SEQ ID NO: 172192 - RNA, 32 nt, Human
gcccccuucuccuccuuucccuucccuuacuu

SEQ ID NO: 172193 - RNA, 32 nt, Human
gcccccuucucuuuucacauacagucacauug

SEQ ID NO: 172194 - RNA, 18 nt, Human
gcccccuucuuccagaug

SEQ ID NO: 172195 - RNA, 32 nt, Human
gcccccuugccuguaaaacaccugggaaguuc

SEQ ID NO: 172196 - RNA, 16 nt, Human
gcccccuuucugcucc

SEQ ID NO: 172197 - RNA, 32 nt, Human
gcccccuuugggcccagggacaccagccaggc

SEQ ID NO: 172198 - RNA, 32 nt, Human
gccccgaagagggagacagagaugugccagag

SEQ ID NO: 172199 - RNA, 32 nt, Human
gccccgaagccagcucaguaccugaggggcug

SEQ ID NO: 172200 - RNA, 21 nt, Human
gccccgaaggcugagagcugg

SEQ ID NO: 172201 - RNA, 18 nt, Human
gccccgaagguccugccu

SEQ ID NO: 172202 - RNA, 32 nt, Human
gccccgacagccagggcuaacaagacgguuaa

SEQ ID NO: 172203 - RNA, 32 nt, Human
gccccgacauuccagucucgaccccgagcccc

SEQ ID NO: 172204 - RNA, 23 nt, Human
gccccgaccacacaugagcuggg

SEQ ID NO: 172205 - RNA, 22 nt, Human
gccccgaccccagcucuggugg

SEQ ID NO: 172206 - RNA, 23 nt, Human
gccccgacccugcuccgcgaucg

SEQ ID NO: 172207 - RNA, 32 nt, Human
gccccgacucacaaauccaaguucuuaaaaca

SEQ ID NO: 172208 - RNA, 32 nt, Human
gccccgagacaacauggccuccuugauccaac

SEQ ID NO: 172209 - RNA, 22 nt, Human
gccccgagacgacagcccggcg

SEQ ID NO: 172210 - RNA, 18 nt, Human
gccccgagccccgcgccc

SEQ ID NO: 172211 - RNA, 19 nt, Human
gccccgagcgccuucuccc

SEQ ID NO: 172212 - RNA, 32 nt, Human
gccccgaggaggaggaggaggaggaggaagag

SEQ ID NO: 172213 - RNA, 23 nt, Human
gccccgaggccgcgugcgugaga

SEQ ID NO: 172214 - RNA, 32 nt, Human
gccccgagggccuggaucggagcugcuagauc

SEQ ID NO: 172215 - RNA, 19 nt, Human
gccccgaguggcaggccag

SEQ ID NO: 172216 - RNA, 32 nt, Human
gccccgauuaggcugcuagcaaaggaaaggac

SEQ ID NO: 172217 - RNA, 32 nt, Human
gccccgcagagcccuggacucuggcauuggag

SEQ ID NO: 172218 - RNA, 32 nt, Human
gccccgcagccugggccugugcucggcgccau

SEQ ID NO: 172219 - RNA, 32 nt, Human
gccccgcagcugcccccacuuccuuugagacc

SEQ ID NO: 172220 - RNA, 32 nt, Human
gccccgcaggaggcagaugcagucccaggcau

SEQ ID NO: 172221 - RNA, 32 nt, Human
gccccgcaggcagacguggcugugggccgagc

SEQ ID NO: 172222 - RNA, 32 nt, Human
gccccgccacugcccauggccaggaggcccca

SEQ ID NO: 172223 - RNA, 32 nt, Human
gccccgccagccccagcccugcagccuugggc

SEQ ID NO: 172224 - RNA, 18 nt, Human
gccccgccagccugggca

SEQ ID NO: 172225 - RNA, 24 nt, Human
gccccgcccacagugcccggcucc

SEQ ID NO: 172226 - RNA, 32 nt, Human
gccccgcccacccucgucgacgugauucccgc

SEQ ID NO: 172227 - RNA, 23 nt, Human
gccccgcccaccgagccccgccc

SEQ ID NO: 172228 - RNA, 23 nt, Human
gccccgcccacucucccaccccu

SEQ ID NO: 172229 - RNA, 21 nt, Human
gccccgcccacuuccagggug

SEQ ID NO: 172230 - RNA, 23 nt, Human
gccccgcccacuuucccaccucc

SEQ ID NO: 172231 - RNA, 32 nt, Human
gccccgcccagcugcaccugccagccuggcuu

SEQ ID NO: 172232 - RNA, 22 nt, Human
gccccgcccccaggcccagcgg

SEQ ID NO: 172233 - RNA, 21 nt, Human
gccccgccccccagagccagg

SEQ ID NO: 172234 - RNA, 22 nt, Human
gccccgcccccgcccccgcucc

SEQ ID NO: 172235 - RNA, 25 nt, Human
gccccgcccccgccccuccccgccc

SEQ ID NO: 172236 - RNA, 19 nt, Human
gccccgcccccgccuugca

SEQ ID NO: 172237 - RNA, 23 nt, Human
gccccgcccccggcgcccgcucc

SEQ ID NO: 172238 - RNA, 32 nt, Human
gccccgcccccuacucauggcuggcagauucg

SEQ ID NO: 172239 - RNA, 21 nt, Human
gccccgcccccucccugcucc

SEQ ID NO: 172240 - RNA, 22 nt, Human
gccccgcccccuccucugcucc

SEQ ID NO: 172241 - RNA, 32 nt, Human
gccccgccccgauucaccgcucaggcccaagc

SEQ ID NO: 172242 - RNA, 20 nt, Human
gccccgccccgccccgcccc

SEQ ID NO: 172243 - RNA, 21 nt, Human
gccccgccccgccccgcccgc

SEQ ID NO: 172244 - RNA, 21 nt, Human
gccccgccccggccccgcccc

SEQ ID NO: 172245 - RNA, 32 nt, Human
gccccgccccuccacaggacccuggaccaggg

SEQ ID NO: 172246 - RNA, 20 nt, Human
gccccgccccugcugagcca

SEQ ID NO: 172247 - RNA, 22 nt, Human
gccccgcccgaccaggaggccc

SEQ ID NO: 172248 - RNA, 21 nt, Human
gccccgcccgcagcucccucc

SEQ ID NO: 172249 - RNA, 32 nt, Human
gccccgcccgucgccucaggugccauuuggau

SEQ ID NO: 172250 - RNA, 23 nt, Human
gccccgcccgucggccucgcucc

SEQ ID NO: 172251 - RNA, 22 nt, Human
gccccgcccuccccccaccucc

SEQ ID NO: 172252 - RNA, 21 nt, Human
gccccgcccucgccccgcccc

SEQ ID NO: 172253 - RNA, 32 nt, Human
gccccgcccucuuuuguccucuucccagguuc

SEQ ID NO: 172254 - RNA, 32 nt, Human
gccccgccgaaccgaggccacccggagccgug

SEQ ID NO: 172255 - RNA, 20 nt, Human
gccccgccgcccccacccca

SEQ ID NO: 172256 - RNA, 19 nt, Human
gccccgccgccgccgccgc

SEQ ID NO: 172257 - RNA, 24 nt, Human
gccccgccgcgcgccccuccgccc

SEQ ID NO: 172258 - RNA, 32 nt, Human
gccccgccgcugcggaagagguuucuagagag

SEQ ID NO: 172259 - RNA, 23 nt, Human
gccccgccgucucccugccgcag

SEQ ID NO: 172260 - RNA, 32 nt, Human
gccccgccucaccccggcuccugggccccagc

SEQ ID NO: 172261 - RNA, 32 nt, Human
gccccgccuccaggccacauggggcugggcag

SEQ ID NO: 172262 - RNA, 22 nt, Human
gccccgccucccacccccaccc

SEQ ID NO: 172263 - RNA, 32 nt, Human
gccccgccuccgccccagaggggcgaggaucc

SEQ ID NO: 172264 - RNA, 21 nt, Human
gccccgccuccgccggcucug

SEQ ID NO: 172265 - RNA, 32 nt, Human
gccccgccucuccaaaaagcuacaccgacgcg

SEQ ID NO: 172266 - RNA, 25 nt, Human
gccccgccugccugccacccugccc

SEQ ID NO: 172267 - RNA, 32 nt, Human
gccccgccugcucuuuccucccauggggccgc

SEQ ID NO: 172268 - RNA, 32 nt, Human
gccccgccugggagccgcgggcaggcgagacu

SEQ ID NO: 172269 - RNA, 32 nt, Human
gccccgccuuugccuacucccugcugccccca

SEQ ID NO: 172270 - RNA, 32 nt, Human
gccccgcgagcuaggaugaggggccaggccgc

SEQ ID NO: 172271 - RNA, 22 nt, Human
gccccgcgcccgugcgcgcgcu

SEQ ID NO: 172272 - RNA, 23 nt, Human
gccccgcgcccucccugccgggg

SEQ ID NO: 172273 - RNA, 21 nt, Human
gccccgcgccgccgccgccgc

SEQ ID NO: 172274 - RNA, 23 nt, Human
gccccgcgccgccgccgccgccg

SEQ ID NO: 172275 - RNA, 32 nt, Human
gccccgcgcucugccgccccucaggcccgcac

SEQ ID NO: 172276 - RNA, 20 nt, Human
gccccgcggagcccccgccc

SEQ ID NO: 172277 - RNA, 24 nt, Human
gccccgcguccggccccuccgccc

SEQ ID NO: 172278 - RNA, 24 nt, Human
gccccgcucagccuugcagccccg

SEQ ID NO: 172279 - RNA, 18 nt, Human
gccccgcucagcgcgggg

SEQ ID NO: 172280 - RNA, 32 nt, Human
gccccgcucccagaucucuauccuuuugggac

SEQ ID NO: 172281 - RNA, 20 nt, Human
gccccgcuccccccaccagg

SEQ ID NO: 172282 - RNA, 22 nt, Human
gccccgcuccgcgccccgggca

SEQ ID NO: 172283 - RNA, 19 nt, Human
gccccgcucgcccgugccg

SEQ ID NO: 172284 - RNA, 32 nt, Human
gccccgcucucuuccccucuuucuguccccca

SEQ ID NO: 172285 - RNA, 32 nt, Human
gccccgcucugccugcuccgaucuuucacuuc

SEQ ID NO: 172286 - RNA, 32 nt, Human
gccccgcucuucccuggcugggcuggcggagg

SEQ ID NO: 172287 - RNA, 32 nt, Human
gccccgcugaagaacucgccuccugggaccca

SEQ ID NO: 172288 - RNA, 32 nt, Human
gccccgcugcagcuguguguccuucuccaucu

SEQ ID NO: 172289 - RNA, 32 nt, Human
gccccgcugcccucucuggcucaggggaaagu

SEQ ID NO: 172290 - RNA, 32 nt, Human
gccccgcugccugcccugcuccaggcuccacc

SEQ ID NO: 172291 - RNA, 32 nt, Human
gccccgcugccuggcacugguccuuugcagcc

SEQ ID NO: 172292 - RNA, 32 nt, Human
gccccgcugccuguccccuuggacucaacuua

SEQ ID NO: 172293 - RNA, 32 nt, Human
gccccgcuggagaggcaccaugggcguggagg

SEQ ID NO: 172294 - RNA, 32 nt, Human
gccccgcuggaggcgaccgaggagaacuucuu

SEQ ID NO: 172295 - RNA, 32 nt, Human
gccccgcuggugcacugagagccacccugugg

SEQ ID NO: 172296 - RNA, 32 nt, Human
gccccgcuguccccaucuagccucuuccuggg

SEQ ID NO: 172297 - RNA, 23 nt, Human
gccccgcugugccugccccaggg

SEQ ID NO: 172298 - RNA, 32 nt, Human
gccccgcuuccucuggaucucucuaggagcug

SEQ ID NO: 172299 - RNA, 32 nt, Human
gccccgcuuugggcccccuccugugaccucag

SEQ ID NO: 172300 - RNA, 19 nt, Human
gccccggaacccgagcugg

SEQ ID NO: 172301 - RNA, 22 nt, Human
gccccggacaccagagaguuuc

SEQ ID NO: 172302 - RNA, 32 nt, Human
gccccggacccagccacacuaggagagaaacc

SEQ ID NO: 172303 - RNA, 32 nt, Human
gccccggacccccaguuccuggguugaacgac

SEQ ID NO: 172304 - RNA, 32 nt, Human
gccccggagaaacugagguauggccaugcccu

SEQ ID NO: 172305 - RNA, 32 nt, Human
gccccggagaagcaggcagcgcagugacagcu

SEQ ID NO: 172306 - RNA, 23 nt, Human
gccccggagagggagaggcgggg

SEQ ID NO: 172307 - RNA, 32 nt, Human
gccccggagagggagaggcggggucggcugua

SEQ ID NO: 172308 - RNA, 32 nt, Human
gccccggagcccggucgcaggagcgcgggccc

SEQ ID NO: 172309 - RNA, 22 nt, Human
gccccggagccgcggcgggaga

SEQ ID NO: 172310 - RNA, 32 nt, Human
gccccggagccugugcagcuugcccauggccc

SEQ ID NO: 172311 - RNA, 32 nt, Human
gccccggagggugggaggagguugcaguauuc

SEQ ID NO: 172312 - RNA, 32 nt, Human
gccccggagguagagguugcagugagcugaga

SEQ ID NO: 172313 - RNA, 32 nt, Human
gccccggauggaucucagagaugaggaucgga

SEQ ID NO: 172314 - RNA, 24 nt, Human
gccccggccaacguccacgccgcc

SEQ ID NO: 172315 - RNA, 18 nt, Human
gccccggccacccaggga

SEQ ID NO: 172316 - RNA, 26 nt, Human
gccccggccacuccaucaggcacuga

SEQ ID NO: 172317 - RNA, 32 nt, Human
gccccggcccagguccccuugugguguugcca

SEQ ID NO: 172318 - RNA, 22 nt, Human
gccccggcccccgcccgcagug

SEQ ID NO: 172319 - RNA, 18 nt, Human
gccccggccgccccagcg

SEQ ID NO: 172320 - RNA, 23 nt, Human
gccccggccggccacccccgggg

SEQ ID NO: 172321 - RNA, 22 nt, Human
gccccggccggccgggcgggga

SEQ ID NO: 172322 - RNA, 32 nt, Human
gccccggccuagaagcucucucuccccgcucc

SEQ ID NO: 172323 - RNA, 32 nt, Human
gccccggccucauccuccucagcggcaggcca

SEQ ID NO: 172324 - RNA, 21 nt, Human
gccccggccuccaccgccgca

SEQ ID NO: 172325 - RNA, 25 nt, Human
gccccggccuccugaguaccuggga

SEQ ID NO: 172326 - RNA, 19 nt, Human
gccccggcgcgcccgcgcg

SEQ ID NO: 172327 - RNA, 23 nt, Human
gccccggcggggaggagcgggug

SEQ ID NO: 172328 - RNA, 32 nt, Human
gccccggcucuauucugggcugcgggccuggg

SEQ ID NO: 172329 - RNA, 32 nt, Human
gccccggcugcacucuagccgccugggugugu

SEQ ID NO: 172330 - RNA, 32 nt, Human
gccccggcugugucuacuccaggccaagccug

SEQ ID NO: 172331 - RNA, 32 nt, Human
gccccgggaacagcagaggcggcggcacuggc

SEQ ID NO: 172332 - RNA, 23 nt, Human
gccccgggaagaaaaggcugagg

SEQ ID NO: 172333 - RNA, 32 nt, Human
gccccgggaaggcgaccccugcccucagugcu

SEQ ID NO: 172334 - RNA, 25 nt, Human
gccccgggacccagcagagcugggg

SEQ ID NO: 172335 - RNA, 32 nt, Human
gccccgggacccugccugccucccucuggagc

SEQ ID NO: 172336 - RNA, 32 nt, Human
gccccgggaccugggcugggaacccgcggugg

SEQ ID NO: 172337 - RNA, 21 nt, Human
gccccgggacgcaagcgcugg

SEQ ID NO: 172338 - RNA, 22 nt, Human
gccccgggacggggaggugggg

SEQ ID NO: 172339 - RNA, 19 nt, Human
gccccgggacugcaccugg

SEQ ID NO: 172340 - RNA, 32 nt, Human
gccccgggacuugccugucguugcugguggcg

SEQ ID NO: 172341 - RNA, 20 nt, Human
gccccgggagaaaaguuggg

SEQ ID NO: 172342 - RNA, 32 nt, Human
gccccgggagagaggagcgaagauccggaacu

SEQ ID NO: 172343 - RNA, 23 nt, Human
gccccgggagcggagagcgaggg

SEQ ID NO: 172344 - RNA, 32 nt, Human
gccccgggagggcuggccaggccacucccugc

SEQ ID NO: 172345 - RNA, 32 nt, Human
gccccgggcaaccggccagggucgggcacagg

SEQ ID NO: 172346 - RNA, 32 nt, Human
gccccgggcacugccucacagccaaggcugga

SEQ ID NO: 172347 - RNA, 21 nt, Human
gccccgggccaggccccagca

SEQ ID NO: 172348 - RNA, 21 nt, Human
gccccgggccgggccgggcca

SEQ ID NO: 172349 - RNA, 32 nt, Human
gccccgggccugcagaacaucuguccccaagc

SEQ ID NO: 172350 - RNA, 18 nt, Human
gccccgggcgcccgcugg

SEQ ID NO: 172351 - RNA, 32 nt, Human
gccccgggcgcugaagccgggcgggcgaugcc

SEQ ID NO: 172352 - RNA, 32 nt, Human
gccccgggcggcggucgccaggucucagggcc

SEQ ID NO: 172353 - RNA, 23 nt, Human
gccccggggaagaagagacaggg

SEQ ID NO: 172354 - RNA, 32 nt, Human
gccccggggagcuccaggagagaggggagccc

SEQ ID NO: 172355 - RNA, 32 nt, Human
gccccggggaggcaggcuggcagguggacagg

SEQ ID NO: 172356 - RNA, 21 nt, Human
gccccggggagggcaaguaca

SEQ ID NO: 172357 - RNA, 18 nt, Human
gccccggggcgcucgcuc

SEQ ID NO: 172358 - RNA, 32 nt, Human
gccccggggcugggaacgccugugccuuccug

SEQ ID NO: 172359 - RNA, 32 nt, Human
gccccggggcuggggugcaacagacucuuaac

SEQ ID NO: 172360 - RNA, 32 nt, Human
gccccgggggcugagguugcugugagccgaga

SEQ ID NO: 172361 - RNA, 32 nt, Human
gccccggguccgccccagaggaguccacacag

SEQ ID NO: 172362 - RNA, 32 nt, Human
gccccgggucuccagcccccuccaucuccccu

SEQ ID NO: 172363 - RNA, 24 nt, Human
gccccgggucuggcagaacucggg

SEQ ID NO: 172364 - RNA, 32 nt, Human
gccccgggugccaaggaaaucccuuuuagccu

SEQ ID NO: 172365 - RNA, 32 nt, Human
gccccggguggugggagugaucagaagaaccu

SEQ ID NO: 172366 - RNA, 32 nt, Human
gccccggguucccaggccaccuccucuguucu

SEQ ID NO: 172367 - RNA, 32 nt, Human
gccccgguaggacacccagcugugcaucccgc

SEQ ID NO: 172368 - RNA, 18 nt, Human
gccccgguccccacgccu

SEQ ID NO: 172369 - RNA, 32 nt, Human
gccccgguccggcgcaggcagcgcggcgggca

SEQ ID NO: 172370 - RNA, 23 nt, Human
gccccggucucagaacagagcug

SEQ ID NO: 172371 - RNA, 32 nt, Human
gccccggugcagcccuggcgggaccgcagcaa

SEQ ID NO: 172372 - RNA, 22 nt, Human
gccccggugcauugugccacca

SEQ ID NO: 172373 - RNA, 23 nt, Human
gccccggugcccggcucccagca

SEQ ID NO: 172374 - RNA, 22 nt, Human
gccccggugcggccgagcuggg

SEQ ID NO: 172375 - RNA, 22 nt, Human
gccccggugcuggagccaggca

SEQ ID NO: 172376 - RNA, 20 nt, Human
gccccgguggcuccaccgca

SEQ ID NO: 172377 - RNA, 20 nt, Human
gccccggugucggacacaca

SEQ ID NO: 172378 - RNA, 32 nt, Human
gccccgguugcccucgcccccugggccggccu

SEQ ID NO: 172379 - RNA, 32 nt, Human
gccccguagcacaggcggagugcagcggaggc

SEQ ID NO: 172380 - RNA, 32 nt, Human
gccccgucaccucccugcccucccgucauuug

SEQ ID NO: 172381 - RNA, 20 nt, Human
gccccgucagcgugugcugg

SEQ ID NO: 172382 - RNA, 32 nt, Human
gccccgucccagguugcacugcaaccaagugu

SEQ ID NO: 172383 - RNA, 32 nt, Human
gccccguccccaccauccuccucccaagccaa

SEQ ID NO: 172384 - RNA, 32 nt, Human
gccccguccucuuccuuucugcuagccuggcu

SEQ ID NO: 172385 - RNA, 32 nt, Human
gccccguccugccuccgccccgcccccgcuug

SEQ ID NO: 172386 - RNA, 32 nt, Human
gccccguccuugagcagauugaccucaucuuu

SEQ ID NO: 172387 - RNA, 32 nt, Human
gccccgucucaagugcuccucuuccuuccaag

SEQ ID NO: 172388 - RNA, 32 nt, Human
gccccgucuccuccucuugcucccucggccgg

SEQ ID NO: 172389 - RNA, 32 nt, Human
gccccgucucuuuugguccuggcuccagaaaa

SEQ ID NO: 172390 - RNA, 32 nt, Human
gccccgugaaggaggcagugaggagcuuuuga

SEQ ID NO: 172391 - RNA, 20 nt, Human
gccccgugcacccgcggccg

SEQ ID NO: 172392 - RNA, 32 nt, Human
gccccgugcgagggcccugcuuguagcuggac

SEQ ID NO: 172393 - RNA, 18 nt, Human
gccccgugcucccguggc

SEQ ID NO: 172394 - RNA, 21 nt, Human
gccccguggacugaagcucuu

SEQ ID NO: 172395 - RNA, 32 nt, Human
gccccgugggucccacccuuuaaggaugcuga

SEQ ID NO: 172396 - RNA, 31 nt, Human
gccccgugggugggggcagggcaugaguucc

SEQ ID NO: 172397 - RNA, 32 nt, Human
gccccguguccacaggaggccaccucggugug

SEQ ID NO: 172398 - RNA, 32 nt, Human
gccccgugucuugcacucucauggccccucca

SEQ ID NO: 172399 - RNA, 22 nt, Human
gccccgugugggccgcggcccg

SEQ ID NO: 172400 - RNA, 22 nt, Human
gccccguguucccuggccugug

SEQ ID NO: 172401 - RNA, 21 nt, Human
gccccguucugcuccgggcca

SEQ ID NO: 172402 - RNA, 32 nt, Human
gccccuaaagccuaccccuugugcacccgcag

SEQ ID NO: 172403 - RNA, 22 nt, Human
gccccuaacggagauuuguuca

SEQ ID NO: 172404 - RNA, 32 nt, Human
gccccuaacucauaaagcaaucaaagaaccau

SEQ ID NO: 172405 - RNA, 21 nt, Human
gccccuacagcccucacugug

SEQ ID NO: 172406 - RNA, 32 nt, Human
gccccuacaggcuggcccugcaauggggcccu

SEQ ID NO: 172407 - RNA, 32 nt, Human
gccccuacaguugcccuggccuuggggccccc

SEQ ID NO: 172408 - RNA, 23 nt, Human
gccccuacauuaugccucugugg

SEQ ID NO: 172409 - RNA, 32 nt, Human
gccccuaccagcuggcugagcccccuggccuc

SEQ ID NO: 172410 - RNA, 32 nt, Human
gccccuaccaugagcauuaaugccauguaaag

SEQ ID NO: 172411 - RNA, 32 nt, Human
gccccuacccaccccuuuuccuucagcugugu

SEQ ID NO: 172412 - RNA, 21 nt, Human
gccccuacccgggcucggcgg

SEQ ID NO: 172413 - RNA, 32 nt, Human
gccccuacccucagaguaucuggaccucagag

SEQ ID NO: 172414 - RNA, 18 nt, Human
gccccuaccggccccccu

SEQ ID NO: 172415 - RNA, 17 nt, Human
gccccuaccugccacca

SEQ ID NO: 172416 - RNA, 21 nt, Human
gccccuacgccugccccggug

SEQ ID NO: 172417 - RNA, 32 nt, Human
gccccuacuguggcugaacauaccuucccccg

SEQ ID NO: 172418 - RNA, 32 nt, Human
gccccuacuugcuuucugcuuccuucugguga

SEQ ID NO: 172419 - RNA, 32 nt, Human
gccccuagagcugaggcuggagaagacaccag

SEQ ID NO: 172420 - RNA, 32 nt, Human
gccccuagagggcugacaacauuuggccucug

SEQ ID NO: 172421 - RNA, 32 nt, Human
gccccuagcacgcgccccagccccagagcagg

SEQ ID NO: 172422 - RNA, 32 nt, Human
gccccuagcccuccgcccagaaacccagcccu

SEQ ID NO: 172423 - RNA, 20 nt, Human
gccccuagccugggccccca

SEQ ID NO: 172424 - RNA, 24 nt, Human
gccccuagcuggccccgucuccca

SEQ ID NO: 172425 - RNA, 31 nt, Human
gccccuaggaucccuguuucuacgggccugg

SEQ ID NO: 172426 - RNA, 32 nt, Human
gccccuagggggagaagccaggacagcagcuu

SEQ ID NO: 172427 - RNA, 25 nt, Human
gccccuaucaugcccuggccugugg

SEQ ID NO: 172428 - RNA, 32 nt, Human
gccccucaacccgguggcauucugggggagga

SEQ ID NO: 172429 - RNA, 32 nt, Human
gccccucacacacuugcuccccaaucccuuca

SEQ ID NO: 172430 - RNA, 28 nt, Human
gccccucacagccucugaccccuccuca

SEQ ID NO: 172431 - RNA, 32 nt, Human
gccccucacccaggccuggcugggcccuggag

SEQ ID NO: 172432 - RNA, 32 nt, Human
gccccucacccugcaucacugaagagcggcgc

SEQ ID NO: 172433 - RNA, 21 nt, Human
gccccucaccuuguccacgua

SEQ ID NO: 172434 - RNA, 32 nt, Human
gccccucacugaucuugcuuuucccuggucuc

SEQ ID NO: 172435 - RNA, 32 nt, Human
gccccucacugcagcugccagcacuuggucag

SEQ ID NO: 172436 - RNA, 32 nt, Human
gccccucacugcaguggauccaguggggcaga

SEQ ID NO: 172437 - RNA, 32 nt, Human
gccccucacuucaggaggggccuggagcaggg

SEQ ID NO: 172438 - RNA, 32 nt, Human
gccccucagagcccugcccugcacccuuguac

SEQ ID NO: 172439 - RNA, 19 nt, Human
gccccucagcccccgcugg

SEQ ID NO: 172440 - RNA, 32 nt, Human
gccccucagccuggccugcucucaccaccucc

SEQ ID NO: 172441 - RNA, 19 nt, Human
gccccucagcugucagcug

SEQ ID NO: 172442 - RNA, 32 nt, Human
gccccucaggacugcuggaaaauaaauccuuu

SEQ ID NO: 172443 - RNA, 32 nt, Human
gccccucaggcagagauggaccaggcggugga

SEQ ID NO: 172444 - RNA, 32 nt, Human
gccccucagggggccagcuggggagauggggg

SEQ ID NO: 172445 - RNA, 23 nt, Human
gccccucagucuccgcacuugca

SEQ ID NO: 172446 - RNA, 32 nt, Human
gccccucaucagccuuuucagcagguuccagu

SEQ ID NO: 172447 - RNA, 18 nt, Human
gccccucaucuccaggug

SEQ ID NO: 172448 - RNA, 32 nt, Human
gccccucaucugcaggcgcucacaaccuaguu

SEQ ID NO: 172449 - RNA, 32 nt, Human
gccccucaugcacagcugagggagaggaagug

SEQ ID NO: 172450 - RNA, 29 nt, Human
gccccucaugccacagugguacucugugu

SEQ ID NO: 172451 - RNA, 32 nt, Human
gccccucaugcugacucagggugggcccugca

SEQ ID NO: 172452 - RNA, 32 nt, Human
gccccuccaacuucaucgacugcccagcccag

SEQ ID NO: 172453 - RNA, 19 nt, Human
gccccuccacaccugugga

SEQ ID NO: 172454 - RNA, 32 nt, Human
gccccuccaccaccucuccaucccagggagcc

SEQ ID NO: 172455 - RNA, 32 nt, Human
gccccuccaccccagccugccugcugccucgg

SEQ ID NO: 172456 - RNA, 32 nt, Human
gccccuccaccgucaacucagguucggccggu

SEQ ID NO: 172457 - RNA, 16 nt, Human
gccccuccacgccugc

SEQ ID NO: 172458 - RNA, 20 nt, Human
gccccuccacucugcccagg

SEQ ID NO: 172459 - RNA, 32 nt, Human
gccccuccacugugcccucugugucagugugu

SEQ ID NO: 172460 - RNA, 32 nt, Human
gccccuccagacagcuuacuuaccucauacgc

SEQ ID NO: 172461 - RNA, 32 nt, Human
gccccuccagcugagcccuugugugagccccg

SEQ ID NO: 172462 - RNA, 19 nt, Human
gccccuccagcuuccuggg

SEQ ID NO: 172463 - RNA, 32 nt, Human
gccccuccagcuuguggagccccacacugggg

SEQ ID NO: 172464 - RNA, 32 nt, Human
gccccuccagugccaggggcacgugcugugag

SEQ ID NO: 172465 - RNA, 32 nt, Human
gccccuccaucuuugucagcccccuguuucuc

SEQ ID NO: 172466 - RNA, 32 nt, Human
gccccuccaugccugcuuggugcagugcucuc

SEQ ID NO: 172467 - RNA, 32 nt, Human
gccccucccaacacccccagccccacgaccau

SEQ ID NO: 172468 - RNA, 32 nt, Human
gccccucccaccacccuccaccuagagcucac

SEQ ID NO: 172469 - RNA, 23 nt, Human
gccccucccagccacaccugccc

SEQ ID NO: 172470 - RNA, 24 nt, Human
gccccucccagccaccuccuccca

SEQ ID NO: 172471 - RNA, 17 nt, Human
gccccucccagccucuc

SEQ ID NO: 172472 - RNA, 23 nt, Human
gccccuccccacgucgcccccuc

SEQ ID NO: 172473 - RNA, 25 nt, Human
gccccuccccagccagcccuucccu

SEQ ID NO: 172474 - RNA, 21 nt, Human
gccccuccccagcuccacucc

SEQ ID NO: 172475 - RNA, 32 nt, Human
gccccuccccauccuggaugggcuguugagcc

SEQ ID NO: 172476 - RNA, 20 nt, Human
gccccuccccaucuuccucu

SEQ ID NO: 172477 - RNA, 32 nt, Human
gccccucccccaacccccaccccacacuuguu

SEQ ID NO: 172478 - RNA, 17 nt, Human
gccccucccccaaggaa

SEQ ID NO: 172479 - RNA, 21 nt, Human
gccccucccccagccuugagg

SEQ ID NO: 172480 - RNA, 19 nt, Human
gccccuccccgcccccacc

SEQ ID NO: 172481 - RNA, 32 nt, Human
gccccuccccgccccucuccccacuccgcauc

SEQ ID NO: 172482 - RNA, 17 nt, Human
gccccuccccgccucuc

SEQ ID NO: 172483 - RNA, 32 nt, Human
gccccuccccgggagcccugggugcaggugca

SEQ ID NO: 172484 - RNA, 32 nt, Human
gccccuccccggggaauccucucugccaaucc

SEQ ID NO: 172485 - RNA, 32 nt, Human
gccccuccccuccaggcuaccucugcacuuug

SEQ ID NO: 172486 - RNA, 32 nt, Human
gccccuccccucgccuccucuccuaggugccg

SEQ ID NO: 172487 - RNA, 18 nt, Human
gccccuccccuuccucca

SEQ ID NO: 172488 - RNA, 32 nt, Human
gccccucccgcuagacucccagccugggcccu

SEQ ID NO: 172489 - RNA, 32 nt, Human
gccccucccucguccuccucucccacuuccuc

SEQ ID NO: 172490 - RNA, 16 nt, Human
gccccucccugcuguc

SEQ ID NO: 172491 - RNA, 32 nt, Human
gccccucccugcuucccuguguggaagaggaa

SEQ ID NO: 172492 - RNA, 20 nt, Human
gccccucccuuccuggggug

SEQ ID NO: 172493 - RNA, 32 nt, Human
gccccuccggacggcuuacuuaccucauacgc

SEQ ID NO: 172494 - RNA, 32 nt, Human
gccccuccguucugucucccucgacuccaagu

SEQ ID NO: 172495 - RNA, 18 nt, Human
gccccuccuacccccucc

SEQ ID NO: 172496 - RNA, 32 nt, Human
gccccuccuaccuucucuuccccaccagccua

SEQ ID NO: 172497 - RNA, 19 nt, Human
gccccuccuagagcuugcu

SEQ ID NO: 172498 - RNA, 32 nt, Human
gccccuccucaccccuucuuugccuccuaccc

SEQ ID NO: 172499 - RNA, 32 nt, Human
gccccuccucagacuccgccuuugggagcaca

SEQ ID NO: 172500 - RNA, 32 nt, Human
gccccuccucaucaugaacagaggcuucuccc

SEQ ID NO: 172501 - RNA, 21 nt, Human
gccccuccuccucagccacuc

SEQ ID NO: 172502 - RNA, 16 nt, Human
gccccuccuccucccu

SEQ ID NO: 172503 - RNA, 32 nt, Human
gccccuccucucccccuccacaccucuagacc

SEQ ID NO: 172504 - RNA, 19 nt, Human
gccccuccucugccaccuc

SEQ ID NO: 172505 - RNA, 19 nt, Human
gccccuccugagggacaga

SEQ ID NO: 172506 - RNA, 18 nt, Human
gccccuccugcagcccuc

SEQ ID NO: 172507 - RNA, 18 nt, Human
gccccuccugcccaagug

SEQ ID NO: 172508 - RNA, 22 nt, Human
gccccuccugccccuccugcca

SEQ ID NO: 172509 - RNA, 32 nt, Human
gccccuccugcucucccaggagcagugaguug

SEQ ID NO: 172510 - RNA, 21 nt, Human
gccccuccugcugccuggcca

SEQ ID NO: 172511 - RNA, 32 nt, Human
gccccuccuggaugccugcagacucagaggau

SEQ ID NO: 172512 - RNA, 23 nt, Human
gccccuccuggcaccaacugcuc

SEQ ID NO: 172513 - RNA, 32 nt, Human
gccccuccuggcccauacgccuugccagggcg

SEQ ID NO: 172514 - RNA, 20 nt, Human
gccccuccuguccucaggga

SEQ ID NO: 172515 - RNA, 32 nt, Human
gccccuccuucuccccuccagaccccuacccu

SEQ ID NO: 172516 - RNA, 21 nt, Human
gccccuccuuucucccugcuc

SEQ ID NO: 172517 - RNA, 19 nt, Human
gccccucgcagccaacuca

SEQ ID NO: 172518 - RNA, 32 nt, Human
gccccucgccgccucugccuggccacaucgau

SEQ ID NO: 172519 - RNA, 19 nt, Human
gccccucgccucccugcuc

SEQ ID NO: 172520 - RNA, 32 nt, Human
gccccucggcacagcccuccugugucuccggg

SEQ ID NO: 172521 - RNA, 32 nt, Human
gccccucggcucuggaggcaaucaagcagaca

SEQ ID NO: 172522 - RNA, 32 nt, Human
gccccucgguggugccuucucaaggcaguguu

SEQ ID NO: 172523 - RNA, 32 nt, Human
gccccucguccacccaccccuggcuggcagcc

SEQ ID NO: 172524 - RNA, 32 nt, Human
gccccucguguagaugugcugcagccuugggc

SEQ ID NO: 172525 - RNA, 32 nt, Human
gccccucuacucccugagcuuccccaccccaa

SEQ ID NO: 172526 - RNA, 32 nt, Human
gccccucuagccuuuccgguccuuccugggca

SEQ ID NO: 172527 - RNA, 32 nt, Human
gccccucucagcuuuccauccccagcuaggaa

SEQ ID NO: 172528 - RNA, 32 nt, Human
gccccucuccaauggcucaguuuugcugaaua

SEQ ID NO: 172529 - RNA, 32 nt, Human
gccccucuccacaccucaaaacuccugcccca

SEQ ID NO: 172530 - RNA, 32 nt, Human
gccccucuccaccucaccccauguugaugccc

SEQ ID NO: 172531 - RNA, 21 nt, Human
gccccucuccccugcccaagu

SEQ ID NO: 172532 - RNA, 32 nt, Human
gccccucucccgcuucccaugaugggguggcu

SEQ ID NO: 172533 - RNA, 18 nt, Human
gccccucuccgccugcuc

SEQ ID NO: 172534 - RNA, 32 nt, Human
gccccucuccuccucacuauucucaccaggcc

SEQ ID NO: 172535 - RNA, 20 nt, Human
gccccucuccucucuguccc

SEQ ID NO: 172536 - RNA, 22 nt, Human
gccccucuccucucuguccccu

SEQ ID NO: 172537 - RNA, 32 nt, Human
gccccucucucccucugccccucucuccucuc

SEQ ID NO: 172538 - RNA, 32 nt, Human
gccccucucucgggggaaccggacagcagcuu

SEQ ID NO: 172539 - RNA, 32 nt, Human
gccccucucuggguggagaagcucccggccgc

SEQ ID NO: 172540 - RNA, 21 nt, Human
gccccucucuuucaccuguuc

SEQ ID NO: 172541 - RNA, 32 nt, Human
gccccucugcagaucuccucuggccacugcag

SEQ ID NO: 172542 - RNA, 32 nt, Human
gccccucugcagauggaaucagcuccaggcug

SEQ ID NO: 172543 - RNA, 18 nt, Human
gccccucugccacuccac

SEQ ID NO: 172544 - RNA, 32 nt, Human
gccccucugccuggcccuggggacuguuggcu

SEQ ID NO: 172545 - RNA, 32 nt, Human
gccccucugcugcagcggcuccugagcucaug

SEQ ID NO: 172546 - RNA, 32 nt, Human
gccccucugcuggcacagccugggcaagggga

SEQ ID NO: 172547 - RNA, 20 nt, Human
gccccucuguaccauccccu

SEQ ID NO: 172548 - RNA, 32 nt, Human
gccccucuguggccugagagugagcaggaggg

SEQ ID NO: 172549 - RNA, 17 nt, Human
gccccucuguguccagg

SEQ ID NO: 172550 - RNA, 32 nt, Human
gccccucuguucugcauggaagcugucaccug

SEQ ID NO: 172551 - RNA, 19 nt, Human
gccccucuucacucugcuc

SEQ ID NO: 172552 - RNA, 32 nt, Human
gccccucuucucccucuccaaacagagggaac

SEQ ID NO: 172553 - RNA, 18 nt, Human
gccccucuucucuuccuc

SEQ ID NO: 172554 - RNA, 17 nt, Human
gccccucuucugcuguc

SEQ ID NO: 172555 - RNA, 32 nt, Human
gccccucuucuggagcucagcagcagcagcug

SEQ ID NO: 172556 - RNA, 16 nt, Human
gccccucuucugugcc

SEQ ID NO: 172557 - RNA, 29 nt, Human
gccccucuucugugugcgucuggaagguc

SEQ ID NO: 172558 - RNA, 32 nt, Human
gccccucuucuuuccagcccuucuccugugug

SEQ ID NO: 172559 - RNA, 32 nt, Human
gccccugaacagcauggaguugcugugaguuu

SEQ ID NO: 172560 - RNA, 32 nt, Human
gccccugaagcugccggguucuggucuccgcg

SEQ ID NO: 172561 - RNA, 32 nt, Human
gccccugacacauacaggccagaggcagagag

SEQ ID NO: 172562 - RNA, 32 nt, Human
gccccugaccccuggaagccggccugccuguc

SEQ ID NO: 172563 - RNA, 32 nt, Human
gccccugacucugguaagggcagccugcagca

SEQ ID NO: 172564 - RNA, 16 nt, Human
gccccugagaacuuug

SEQ ID NO: 172565 - RNA, 18 nt, Human
gccccugagacccagcca

SEQ ID NO: 172566 - RNA, 32 nt, Human
gccccugagccccauuccauucauacagacac

SEQ ID NO: 172567 - RNA, 18 nt, Human
gccccugagcccccagcc

SEQ ID NO: 172568 - RNA, 21 nt, Human
gccccugagggacuccgggca

SEQ ID NO: 172569 - RNA, 32 nt, Human
gccccugaguagcugggauuacaggcacguac

SEQ ID NO: 172570 - RNA, 32 nt, Human
gccccugaucacucccagcacuccccuugccu

SEQ ID NO: 172571 - RNA, 32 nt, Human
gccccugaugcccaggcugggugcaggcucuc

SEQ ID NO: 172572 - RNA, 32 nt, Human
gccccugauguguagugagcacucgauaaaua

SEQ ID NO: 172573 - RNA, 32 nt, Human
gccccugcacaggcacacagggcccggccaca

SEQ ID NO: 172574 - RNA, 20 nt, Human
gccccugcacaugccaggug

SEQ ID NO: 172575 - RNA, 32 nt, Human
gccccugcacuccagccugggugacagagcca

SEQ ID NO: 172576 - RNA, 32 nt, Human
gccccugcagagccugggagcugcaggaacug

SEQ ID NO: 172577 - RNA, 32 nt, Human
gccccugcagaggaaugaaacuacuuacaaca

SEQ ID NO: 172578 - RNA, 32 nt, Human
gccccugcagcaggaagcccccagucccagcc

SEQ ID NO: 172579 - RNA, 32 nt, Human
gccccugcagccgccggucggcgcccgggcuc

SEQ ID NO: 172580 - RNA, 32 nt, Human
gccccugcaggacccuccccugcuccauguga

SEQ ID NO: 172581 - RNA, 17 nt, Human
gccccugcagggagcgg

SEQ ID NO: 172582 - RNA, 32 nt, Human
gccccugcaggggcccaggcugccucucaucu

SEQ ID NO: 172583 - RNA, 19 nt, Human
gccccugcagguccaggug

SEQ ID NO: 172584 - RNA, 32 nt, Human
gccccugcaguggcgggacucaagcuccugac

SEQ ID NO: 172585 - RNA, 17 nt, Human
gccccugcaugcccagg

SEQ ID NO: 172586 - RNA, 17 nt, Human
gccccugcauucaggug

SEQ ID NO: 172587 - RNA, 32 nt, Human
gccccugcauuccagccuaggcgacagaguga

SEQ ID NO: 172588 - RNA, 32 nt, Human
gccccugcauucuagccugggugacagugaga

SEQ ID NO: 172589 - RNA, 21 nt, Human
gccccugccacaccuggggca

SEQ ID NO: 172590 - RNA, 32 nt, Human
gccccugccacccaguggccaggaugacaagg

SEQ ID NO: 172591 - RNA, 32 nt, Human
gccccugccacuccgagauaaccaguggaugc

SEQ ID NO: 172592 - RNA, 18 nt, Human
gccccugccacuuucaau

SEQ ID NO: 172593 - RNA, 32 nt, Human
gccccugccagaccuccugcuaccgucccaga

SEQ ID NO: 172594 - RNA, 18 nt, Human
gccccugccagcucaggu

SEQ ID NO: 172595 - RNA, 17 nt, Human
gccccugccaucgcagg

SEQ ID NO: 172596 - RNA, 32 nt, Human
gccccugccaugaggucaauggcagccuggau

SEQ ID NO: 172597 - RNA, 16 nt, Human
gccccugccaugcagg

SEQ ID NO: 172598 - RNA, 32 nt, Human
gccccugccauggagccgugugguguaugugu

SEQ ID NO: 172599 - RNA, 17 nt, Human
gccccugccauugcagg

SEQ ID NO: 172600 - RNA, 32 nt, Human
gccccugccauuuccacccuccagucauuucu

SEQ ID NO: 172601 - RNA, 21 nt, Human
gccccugcccacaaaacccca

SEQ ID NO: 172602 - RNA, 18 nt, Human
gccccugcccaccaggua

SEQ ID NO: 172603 - RNA, 20 nt, Human
gccccugcccagaaccaagu

SEQ ID NO: 172604 - RNA, 24 nt, Human
gccccugcccagcacaaaacccca

SEQ ID NO: 172605 - RNA, 19 nt, Human
gccccugcccagugaacag

SEQ ID NO: 172606 - RNA, 18 nt, Human
gccccugcccauguacag

SEQ ID NO: 172607 - RNA, 32 nt, Human
gccccugccccaacugauucugcccagauaau

SEQ ID NO: 172608 - RNA, 19 nt, Human
gccccugccccacacaggu

SEQ ID NO: 172609 - RNA, 20 nt, Human
gccccugccccagcccaagu

SEQ ID NO: 172610 - RNA, 32 nt, Human
gccccugccccaggaacauggcagaagcacag

SEQ ID NO: 172611 - RNA, 16 nt, Human
gccccugccccaggug

SEQ ID NO: 172612 - RNA, 20 nt, Human
gccccugccccaucuccuca

SEQ ID NO: 172613 - RNA, 23 nt, Human
gccccugccccauuuccuccuca

SEQ ID NO: 172614 - RNA, 19 nt, Human
gccccugcccccaaaggug

SEQ ID NO: 172615 - RNA, 21 nt, Human
gccccugcccccacccgcacc

SEQ ID NO: 172616 - RNA, 21 nt, Human
gccccugcccccacccucacc

SEQ ID NO: 172617 - RNA, 15 nt, Human
gccccugcccccagg

SEQ ID NO: 172618 - RNA, 16 nt, Human
gccccugccccccggg

SEQ ID NO: 172619 - RNA, 15 nt, Human
gccccugcccccggg

SEQ ID NO: 172620 - RNA, 18 nt, Human
gccccugccccgugaagg

SEQ ID NO: 172621 - RNA, 32 nt, Human
gccccugccccuccucucccucaucaaggaca

SEQ ID NO: 172622 - RNA, 18 nt, Human
gccccugccccugcccag

SEQ ID NO: 172623 - RNA, 19 nt, Human
gccccugccccugcugcgg

SEQ ID NO: 172624 - RNA, 16 nt, Human
gccccugcccgaggug

SEQ ID NO: 172625 - RNA, 20 nt, Human
gccccugcccgggcgcgcuc

SEQ ID NO: 172626 - RNA, 18 nt, Human
gccccugcccuaccccag

SEQ ID NO: 172627 - RNA, 17 nt, Human
gccccugcccuaccugg

SEQ ID NO: 172628 - RNA, 18 nt, Human
gccccugcccuaggggug

SEQ ID NO: 172629 - RNA, 15 nt, Human
gccccugcccucagg

SEQ ID NO: 172630 - RNA, 32 nt, Human
gccccugcccuccccuuccucccauccuuguc

SEQ ID NO: 172631 - RNA, 16 nt, Human
gccccugcccucggug

SEQ ID NO: 172632 - RNA, 32 nt, Human
gccccugcccucucuccuuugccccucagucu

SEQ ID NO: 172633 - RNA, 17 nt, Human
gccccugcccucugugg

SEQ ID NO: 172634 - RNA, 15 nt, Human
gccccugcccugagg

SEQ ID NO: 172635 - RNA, 18 nt, Human
gccccugcccugccuggg

SEQ ID NO: 172636 - RNA, 17 nt, Human
gccccugcccuggcagg

SEQ ID NO: 172637 - RNA, 15 nt, Human
gccccugcccugggg

SEQ ID NO: 172638 - RNA, 16 nt, Human
gccccugcccuguggg

SEQ ID NO: 172639 - RNA, 17 nt, Human
gccccugcccuuuuagg

SEQ ID NO: 172640 - RNA, 19 nt, Human
gccccugccgacuccaggu

SEQ ID NO: 172641 - RNA, 20 nt, Human
gccccugccgcagcccggua

SEQ ID NO: 172642 - RNA, 17 nt, Human
gccccugccgugcaggu

SEQ ID NO: 172643 - RNA, 17 nt, Human
gccccugccguggcagg

SEQ ID NO: 172644 - RNA, 21 nt, Human
gccccugccucaugggcuccc

SEQ ID NO: 172645 - RNA, 32 nt, Human
gccccugccuccagggcuagguagagagggcc

SEQ ID NO: 172646 - RNA, 32 nt, Human
gccccugccuccauuucucgcucucuguccac

SEQ ID NO: 172647 - RNA, 16 nt, Human
gccccugccucccagg

SEQ ID NO: 172648 - RNA, 32 nt, Human
gccccugccucuaccuguccccaaauuuuuau

SEQ ID NO: 172649 - RNA, 21 nt, Human
gccccugccucugcccaagug

SEQ ID NO: 172650 - RNA, 17 nt, Human
gccccugccucuucagg

SEQ ID NO: 172651 - RNA, 19 nt, Human
gccccugccugaaagugua

SEQ ID NO: 172652 - RNA, 20 nt, Human
gccccugccugaugcaugua

SEQ ID NO: 172653 - RNA, 17 nt, Human
gccccugccugccacca

SEQ ID NO: 172654 - RNA, 32 nt, Human
gccccugccugggcccgcagccucccccgcgg

SEQ ID NO: 172655 - RNA, 32 nt, Human
gccccugccugggggcuugucaccucccccac

SEQ ID NO: 172656 - RNA, 32 nt, Human
gccccugccuggguucugucccagcucccugg

SEQ ID NO: 172657 - RNA, 19 nt, Human
gccccugccuguaauaggu

SEQ ID NO: 172658 - RNA, 17 nt, Human
gccccugccuucccagg

SEQ ID NO: 172659 - RNA, 32 nt, Human
gccccugccuuucucuuccuccaucaggcccu

SEQ ID NO: 172660 - RNA, 21 nt, Human
gccccugcgaagaaaaggcau

SEQ ID NO: 172661 - RNA, 32 nt, Human
gccccugcgaggaguugaggggccaguucggc

SEQ ID NO: 172662 - RNA, 19 nt, Human
gccccugcgccuccgcccg

SEQ ID NO: 172663 - RNA, 32 nt, Human
gccccugcggccgccucucgcggcucccgggg

SEQ ID NO: 172664 - RNA, 19 nt, Human
gccccugcggguccccagg

SEQ ID NO: 172665 - RNA, 24 nt, Human
gccccugcgguuccuguccgagua

SEQ ID NO: 172666 - RNA, 32 nt, Human
gccccugcucacugggcccgagccugaacuga

SEQ ID NO: 172667 - RNA, 32 nt, Human
gccccugcucaggugcuucugaaaguuccuuu

SEQ ID NO: 172668 - RNA, 17 nt, Human
gccccugcuccaccagg

SEQ ID NO: 172669 - RNA, 19 nt, Human
gccccugcuccugcccagg

SEQ ID NO: 172670 - RNA, 21 nt, Human
gccccugcucugguccuccag

SEQ ID NO: 172671 - RNA, 32 nt, Human
gccccugcucuguagccaccuccuuggcaccg

SEQ ID NO: 172672 - RNA, 22 nt, Human
gccccugcugcacguccggugg

SEQ ID NO: 172673 - RNA, 17 nt, Human
gccccugcugcugcagg

SEQ ID NO: 172674 - RNA, 32 nt, Human
gccccugcugcugcugcugcacaugccacagc

SEQ ID NO: 172675 - RNA, 32 nt, Human
gccccugcuggcugagcuccagccugugccca

SEQ ID NO: 172676 - RNA, 23 nt, Human
gccccugcugggcccagccacca

SEQ ID NO: 172677 - RNA, 17 nt, Human
gccccugcugucccagg

SEQ ID NO: 172678 - RNA, 19 nt, Human
gccccugcugugccuggua

SEQ ID NO: 172679 - RNA, 32 nt, Human
gccccugcuuccauuucuccccaccucacucu

SEQ ID NO: 172680 - RNA, 32 nt, Human
gccccugcuucuccagccuggacccccagcuu

SEQ ID NO: 172681 - RNA, 17 nt, Human
gccccugcuucuccagg

SEQ ID NO: 172682 - RNA, 32 nt, Human
gccccugcuucuccaggccucuugccuuugag

SEQ ID NO: 172683 - RNA, 17 nt, Human
gccccugcuucuggaua

SEQ ID NO: 172684 - RNA, 20 nt, Human
gccccugcuuucugcccagg

SEQ ID NO: 172685 - RNA, 16 nt, Human
gccccuggaaacuuug

SEQ ID NO: 172686 - RNA, 32 nt, Human
gccccuggaacaugccagcacacacugccaug

SEQ ID NO: 172687 - RNA, 32 nt, Human
gccccuggaaccuuucccuuguguguaccaca

SEQ ID NO: 172688 - RNA, 32 nt, Human
gccccuggaaggcagaaaaguugggagcaugg

SEQ ID NO: 172689 - RNA, 31 nt, Human
gccccuggaauagcuuucaugccaaguuuag

SEQ ID NO: 172690 - RNA, 32 nt, Human
gccccuggacccuucucuccggaccagggagg

SEQ ID NO: 172691 - RNA, 19 nt, Human
gccccuggagcgcccgccg

SEQ ID NO: 172692 - RNA, 32 nt, Human
gccccuggcagaguccacgcugccucagguau

SEQ ID NO: 172693 - RNA, 32 nt, Human
gccccuggcagccccuguucuggcagaguuga

SEQ ID NO: 172694 - RNA, 32 nt, Human
gccccuggccacucuaagcugggcagacggag

SEQ ID NO: 172695 - RNA, 32 nt, Human
gccccuggccagaggccuugcuggguggagcc

SEQ ID NO: 172696 - RNA, 16 nt, Human
gccccuggccugaggc

SEQ ID NO: 172697 - RNA, 16 nt, Human
gccccuggcuccaggu

SEQ ID NO: 172698 - RNA, 32 nt, Human
gccccuggcucccaucuuggucucaccuuuuc

SEQ ID NO: 172699 - RNA, 32 nt, Human
gccccuggcugcagaugacuggaaacaaggaa

SEQ ID NO: 172700 - RNA, 32 nt, Human
gccccuggcugcuguuucccagccuuuccaca

SEQ ID NO: 172701 - RNA, 32 nt, Human
gccccugggaagggcguggcaggggcucugca

SEQ ID NO: 172702 - RNA, 32 nt, Human
gccccugggagcugccagggaagaaccgacuc

SEQ ID NO: 172703 - RNA, 32 nt, Human
gccccugggagggagagagauaaggcgcuauc

SEQ ID NO: 172704 - RNA, 32 nt, Human
gccccugggaguggacacagggugcagggagc

SEQ ID NO: 172705 - RNA, 32 nt, Human
gccccugggcugggacagcccacuguuccaug

SEQ ID NO: 172706 - RNA, 18 nt, Human
gccccuggggggcagcuu

SEQ ID NO: 172707 - RNA, 31 nt, Human
gccccugggguggaagugggguaggggaaga

SEQ ID NO: 172708 - RNA, 32 nt, Human
gccccugguauccaaagggcccagggacccug

SEQ ID NO: 172709 - RNA, 32 nt, Human
gccccuggucccacuccugcccccgcccuacc

SEQ ID NO: 172710 - RNA, 32 nt, Human
gccccuggugccucuuccccagcccuaaagcc

SEQ ID NO: 172711 - RNA, 32 nt, Human
gccccuggugugagcauuagaccagccacagu

SEQ ID NO: 172712 - RNA, 32 nt, Human
gccccuguacuccagccugggugacagagcaa

SEQ ID NO: 172713 - RNA, 32 nt, Human
gccccuguacuuggguugccucuugucccuga

SEQ ID NO: 172714 - RNA, 32 nt, Human
gccccuguagccucagcacccagcacaggccu

SEQ ID NO: 172715 - RNA, 32 nt, Human
gccccuguccagccccuccaccugugucugaa

SEQ ID NO: 172716 - RNA, 32 nt, Human
gccccuguccccaccucuggagaauccacccc

SEQ ID NO: 172717 - RNA, 32 nt, Human
gccccugucucaggauugucucuucacgccca

SEQ ID NO: 172718 - RNA, 32 nt, Human
gccccugucucugccaggugccuccucucagu

SEQ ID NO: 172719 - RNA, 16 nt, Human
gccccugucugcugcu

SEQ ID NO: 172720 - RNA, 32 nt, Human
gccccugucuguucuuacccuuuggaacaguu

SEQ ID NO: 172721 - RNA, 17 nt, Human
gccccugugauccaggu

SEQ ID NO: 172722 - RNA, 32 nt, Human
gccccugugauugggccacgguugccaaggua

SEQ ID NO: 172723 - RNA, 23 nt, Human
gccccugugccaggcccuggugg

SEQ ID NO: 172724 - RNA, 17 nt, Human
gccccugugcccgggau

SEQ ID NO: 172725 - RNA, 32 nt, Human
gccccuguggcaaaccaggaaggccaaggcug

SEQ ID NO: 172726 - RNA, 32 nt, Human
gccccuguggcucgacuggaguguucguucac

SEQ ID NO: 172727 - RNA, 18 nt, Human
gccccugugggucccagg

SEQ ID NO: 172728 - RNA, 32 nt, Human
gccccugugggugggguggagggugaaauucu

SEQ ID NO: 172729 - RNA, 24 nt, Human
gccccugugucauagccccaagua

SEQ ID NO: 172730 - RNA, 32 nt, Human
gccccuguguuaccugggcagcuccagaucac

SEQ ID NO: 172731 - RNA, 18 nt, Human
gccccuguucauccaagu

SEQ ID NO: 172732 - RNA, 19 nt, Human
gccccuguuccuccaagug

SEQ ID NO: 172733 - RNA, 32 nt, Human
gccccuguuucguggcagacagcaggugccug

SEQ ID NO: 172734 - RNA, 19 nt, Human
gccccuuaaggccaccagc

SEQ ID NO: 172735 - RNA, 21 nt, Human
gccccuuaaggccaccagcaa

SEQ ID NO: 172736 - RNA, 32 nt, Human
gccccuuacaccacuuuccaccuuccuguccg

SEQ ID NO: 172737 - RNA, 32 nt, Human
gccccuuaccgagcucccagacuggucauaug

SEQ ID NO: 172738 - RNA, 32 nt, Human
gccccuuacgccugucauucagccuggcaggu

SEQ ID NO: 172739 - RNA, 32 nt, Human
gccccuuaguaagccgaggacccgaacccuua

SEQ ID NO: 172740 - RNA, 32 nt, Human
gccccuuauuugguggcggaaguggccuccac

SEQ ID NO: 172741 - RNA, 20 nt, Human
gccccuucaccaccccgccc

SEQ ID NO: 172742 - RNA, 32 nt, Human
gccccuucaucaccaucuccaucauucagcug

SEQ ID NO: 172743 - RNA, 32 nt, Human
gccccuucauggggcucaccugguggauucac

SEQ ID NO: 172744 - RNA, 17 nt, Human
gccccuucccccugccu

SEQ ID NO: 172745 - RNA, 22 nt, Human
gccccuuccccugcccagggug

SEQ ID NO: 172746 - RNA, 18 nt, Human
gccccuucccguccaggu

SEQ ID NO: 172747 - RNA, 31 nt, Human
gccccuucccucucugggacuugucuucugg

SEQ ID NO: 172748 - RNA, 32 nt, Human
gccccuucccuucccuucccuucccuuccuuu

SEQ ID NO: 172749 - RNA, 19 nt, Human
gccccuucccuuugcugcc

SEQ ID NO: 172750 - RNA, 18 nt, Human
gccccuuccuccuccucu

SEQ ID NO: 172751 - RNA, 32 nt, Human
gccccuuccucgguccuaucauccuacccucu

SEQ ID NO: 172752 - RNA, 32 nt, Human
gccccuuccucugccaggugcuuggcucucug

SEQ ID NO: 172753 - RNA, 32 nt, Human
gccccuuccucuuucuccuccuaccucugccc

SEQ ID NO: 172754 - RNA, 16 nt, Human
gccccuuccugcugcc

SEQ ID NO: 172755 - RNA, 32 nt, Human
gccccuuccugggagaggcuguuaacacgggg

SEQ ID NO: 172756 - RNA, 31 nt, Human
gccccuuccuuccucccuugcccaaagaucc

SEQ ID NO: 172757 - RNA, 32 nt, Human
gccccuuccuuuccaaaccaugcaauggaaga

SEQ ID NO: 172758 - RNA, 32 nt, Human
gccccuuccuuucuaaauuaaaaauguuuuca

SEQ ID NO: 172759 - RNA, 22 nt, Human
gccccuucgcccaccuccgccc

SEQ ID NO: 172760 - RNA, 21 nt, Human
gccccuucuacgcuccaggug

SEQ ID NO: 172761 - RNA, 22 nt, Human
gccccuucuacgcuccaggugg

SEQ ID NO: 172762 - RNA, 32 nt, Human
gccccuucucauaggaccccuaugacccacag

SEQ ID NO: 172763 - RNA, 32 nt, Human
gccccuucuccucaccaugucucccccacccu

SEQ ID NO: 172764 - RNA, 32 nt, Human
gccccuucuccuccuccuaccugggccucugc

SEQ ID NO: 172765 - RNA, 32 nt, Human
gccccuucuccucuccccagggccuggcccua

SEQ ID NO: 172766 - RNA, 32 nt, Human
gccccuucuccugccccagccccagccccacc

SEQ ID NO: 172767 - RNA, 22 nt, Human
gccccuucucucccugccagag

SEQ ID NO: 172768 - RNA, 32 nt, Human
gccccuucucucgccaccccugcccaaggucg

SEQ ID NO: 172769 - RNA, 32 nt, Human
gccccuucuggggugaggaguaccaagugcac

SEQ ID NO: 172770 - RNA, 32 nt, Human
gccccuucuuuaugcagaggugcagaaccagg

SEQ ID NO: 172771 - RNA, 32 nt, Human
gccccuucuuucuccacagcucuggaccuuuc

SEQ ID NO: 172772 - RNA, 32 nt, Human
gccccuugagauggguuucccuaugcagcccc

SEQ ID NO: 172773 - RNA, 32 nt, Human
gccccuugcauauccccacugucaggggcagc

SEQ ID NO: 172774 - RNA, 32 nt, Human
gccccuugccagcauccccacacccaccucuc

SEQ ID NO: 172775 - RNA, 32 nt, Human
gccccuugcccagggccagugccauggggaag

SEQ ID NO: 172776 - RNA, 19 nt, Human
gccccuugcccccagucac

SEQ ID NO: 172777 - RNA, 32 nt, Human
gccccuugcccugagcucuguucuccauggug

SEQ ID NO: 172778 - RNA, 18 nt, Human
gccccuugccucccagaa

SEQ ID NO: 172779 - RNA, 21 nt, Human
gccccuugccugcgugccccu

SEQ ID NO: 172780 - RNA, 32 nt, Human
gccccuugcuccaugaggaguugcaggguguu

SEQ ID NO: 172781 - RNA, 32 nt, Human
gccccuugcucuccccugcccugcugccgccu

SEQ ID NO: 172782 - RNA, 32 nt, Human
gccccuugcugccgugugcuccugccuuccug

SEQ ID NO: 172783 - RNA, 32 nt, Human
gccccuuggaaccuggccaugcaaagcaaggg

SEQ ID NO: 172784 - RNA, 32 nt, Human
gccccuuggcaaaccucaccacucacagaggc

SEQ ID NO: 172785 - RNA, 29 nt, Human
gccccuuggcugcucucggacucccuacc

SEQ ID NO: 172786 - RNA, 32 nt, Human
gccccuuggcugcugcugcugcuuacuccuga

SEQ ID NO: 172787 - RNA, 32 nt, Human
gccccuuggcuggcagauguguuaacaugccc

SEQ ID NO: 172788 - RNA, 32 nt, Human
gccccuuggcuugccauucuuucagcagcaca

SEQ ID NO: 172789 - RNA, 32 nt, Human
gccccuuggucuucaguguuuuucucuucccc

SEQ ID NO: 172790 - RNA, 32 nt, Human
gccccuuguccaccccucuccacaccccuucc

SEQ ID NO: 172791 - RNA, 32 nt, Human
gccccuuguccaccuucucuugaggccacaga

SEQ ID NO: 172792 - RNA, 26 nt, Human
gccccuugucuugcgccugccuuccu

SEQ ID NO: 172793 - RNA, 32 nt, Human
gccccuuguuucucccuccuuccaggguuuag

SEQ ID NO: 172794 - RNA, 23 nt, Human
gccccuuuauugccacuacccca

SEQ ID NO: 172795 - RNA, 32 nt, Human
gccccuuucagccauggcuggaguggcuggga

SEQ ID NO: 172796 - RNA, 32 nt, Human
gccccuuucauuuugggccucugacaaugcuu

SEQ ID NO: 172797 - RNA, 23 nt, Human
gccccuuuccacacgccgcugcc

SEQ ID NO: 172798 - RNA, 32 nt, Human
gccccuuuccaucuucaagagagauggaauua

SEQ ID NO: 172799 - RNA, 32 nt, Human
gccccuuuccccuuuguuuuccuuccuuucuu

SEQ ID NO: 172800 - RNA, 24 nt, Human
gccccuuuccuugccgaaugggac

SEQ ID NO: 172801 - RNA, 32 nt, Human
gccccuuucucuuccgguucuaggcgcuucgg

SEQ ID NO: 172802 - RNA, 22 nt, Human
gccccuuugcaaggggcagagg

SEQ ID NO: 172803 - RNA, 32 nt, Human
gccccuuugccuuugcauccuuagccaguguc

SEQ ID NO: 172804 - RNA, 32 nt, Human
gccccuuuguguccuccgggggcggaggcagc

SEQ ID NO: 172805 - RNA, 32 nt, Human
gccccuuuguguccugauggcuggaggacgcu

SEQ ID NO: 172806 - RNA, 32 nt, Human
gcccgaaagccgccucccccucccagacccga

SEQ ID NO: 172807 - RNA, 32 nt, Human
gcccgaacccaggagucaaaagcugcagugag

SEQ ID NO: 172808 - RNA, 18 nt, Human
gcccgaacucccaccucu

SEQ ID NO: 172809 - RNA, 32 nt, Human
gcccgaacugcagcuccagccccagccgugcg

SEQ ID NO: 172810 - RNA, 32 nt, Human
gcccgaagccucugucccuccuguucuugucc

SEQ ID NO: 172811 - RNA, 32 nt, Human
gcccgaaguugugagacugaaaccagaaguug

SEQ ID NO: 172812 - RNA, 32 nt, Human
gcccgacagaagaaagagagugaggcuaugga

SEQ ID NO: 172813 - RNA, 32 nt, Human
gcccgacagccacgugggccgagagcugaccc

SEQ ID NO: 172814 - RNA, 32 nt, Human
gcccgaccaagcuguccccuuccccugugcca

SEQ ID NO: 172815 - RNA, 32 nt, Human
gcccgacccacugucucagcccagaggucaag

SEQ ID NO: 172816 - RNA, 32 nt, Human
gcccgacccaugucuaugcucuaccccagggu

SEQ ID NO: 172817 - RNA, 32 nt, Human
gcccgacccugccgccucccucacggagccag

SEQ ID NO: 172818 - RNA, 32 nt, Human
gcccgaccucugcaccugguccgcauggggga

SEQ ID NO: 172819 - RNA, 32 nt, Human
gcccgaccuggagggcccccggggcacugggc

SEQ ID NO: 172820 - RNA, 16 nt, Human
gcccgacgcagagcag

SEQ ID NO: 172821 - RNA, 32 nt, Human
gcccgacggagcagaagagagagcauggagcu

SEQ ID NO: 172822 - RNA, 32 nt, Human
gcccgacggcaacccagcuugggaagagaagc

SEQ ID NO: 172823 - RNA, 32 nt, Human
gcccgacucucaagccucagcucccaggcuag

SEQ ID NO: 172824 - RNA, 19 nt, Human
gcccgacugcccuccuccc

SEQ ID NO: 172825 - RNA, 19 nt, Human
gcccgacuucagccccagc

SEQ ID NO: 172826 - RNA, 32 nt, Human
gcccgagacaggcuacauccaggcacagucgu

SEQ ID NO: 172827 - RNA, 23 nt, Human
gcccgagacccagcgcccaggcg

SEQ ID NO: 172828 - RNA, 19 nt, Human
gcccgagacccccaccucu

SEQ ID NO: 172829 - RNA, 32 nt, Human
gcccgagagacagagguugcagugagccgaga

SEQ ID NO: 172830 - RNA, 32 nt, Human
gcccgagagcgagcucuggccucccaggcgcc

SEQ ID NO: 172831 - RNA, 32 nt, Human
gcccgagagguggagacugcaguaagccaaga

SEQ ID NO: 172832 - RNA, 32 nt, Human
gcccgagagguggagguugcagugagccgaga

SEQ ID NO: 172833 - RNA, 18 nt, Human
gcccgagaguaccaggga

SEQ ID NO: 172834 - RNA, 22 nt, Human
gcccgagauggaccaggggcug

SEQ ID NO: 172835 - RNA, 32 nt, Human
gcccgagcagaggcccuacacccaccgaggca

SEQ ID NO: 172836 - RNA, 32 nt, Human
gcccgagcagagggucaugcgggccccacagg

SEQ ID NO: 172837 - RNA, 32 nt, Human
gcccgagcagcacaggccgcugccucagcauc

SEQ ID NO: 172838 - RNA, 32 nt, Human
gcccgagcagccgccgccgccucagucaguca

SEQ ID NO: 172839 - RNA, 32 nt, Human
gcccgagcccaggaccuguuggcagaguugcc

SEQ ID NO: 172840 - RNA, 22 nt, Human
gcccgagccgcagccgccgccu

SEQ ID NO: 172841 - RNA, 23 nt, Human
gcccgagccgccgccgccgccgc

SEQ ID NO: 172842 - RNA, 18 nt, Human
gcccgagcggcgcauccc

SEQ ID NO: 172843 - RNA, 32 nt, Human
gcccgagcucuucuccguaauucaaagaucau

SEQ ID NO: 172844 - RNA, 23 nt, Human
gcccgagcugggguccgcccuca

SEQ ID NO: 172845 - RNA, 21 nt, Human
gcccgaggacagccccagggg

SEQ ID NO: 172846 - RNA, 32 nt, Human
gcccgaggacugggacauuaaaccugaccucc

SEQ ID NO: 172847 - RNA, 18 nt, Human
gcccgaggagaccaggga

SEQ ID NO: 172848 - RNA, 24 nt, Human
gcccgaggcccccaccagcaguug

SEQ ID NO: 172849 - RNA, 22 nt, Human
gcccgaggcccugcgggcgcug

SEQ ID NO: 172850 - RNA, 22 nt, Human
gcccgaggccucauccauagcu

SEQ ID NO: 172851 - RNA, 21 nt, Human
gcccgaggccuccggggacug

SEQ ID NO: 172852 - RNA, 23 nt, Human
gcccgaggcugcggcuaagacug

SEQ ID NO: 172853 - RNA, 32 nt, Human
gcccgagggaagcacaggccucggccucccag

SEQ ID NO: 172854 - RNA, 32 nt, Human
gcccgagggaggaagagagggagggaggaacu

SEQ ID NO: 172855 - RNA, 32 nt, Human
gcccgagggcaggcuugaguuaggcagacuga

SEQ ID NO: 172856 - RNA, 20 nt, Human
gcccgagggccgggcugcug

SEQ ID NO: 172857 - RNA, 20 nt, Human
gcccgagggcguccagcgcg

SEQ ID NO: 172858 - RNA, 32 nt, Human
gcccgagggcugggcccuugagucucuccucu

SEQ ID NO: 172859 - RNA, 32 nt, Human
gcccgagggcuggugcaggcuuggagcugggg

SEQ ID NO: 172860 - RNA, 24 nt, Human
gcccgaggucuccaagccgggcug

SEQ ID NO: 172861 - RNA, 22 nt, Human
gcccgaggugcucccaggugcu

SEQ ID NO: 172862 - RNA, 32 nt, Human
gcccgagguggcagaggaagggggcugccugg

SEQ ID NO: 172863 - RNA, 31 nt, Human
gcccgaguccaggaauuagagguugcaguga

SEQ ID NO: 172864 - RNA, 32 nt, Human
gcccgaguggagccgggcugagauucuucuca

SEQ ID NO: 172865 - RNA, 32 nt, Human
gcccgaguuagaaaucuccuugcuaggagcau

SEQ ID NO: 172866 - RNA, 32 nt, Human
gcccgaucugggcugccuccagcccgggccug

SEQ ID NO: 172867 - RNA, 32 nt, Human
gcccgauggaggagggaggagacucccugaac

SEQ ID NO: 172868 - RNA, 32 nt, Human
gcccgauuugccugguucugauucuccaggcu

SEQ ID NO: 172869 - RNA, 32 nt, Human
gcccgauuugguaguugaggaaagcacagagg

SEQ ID NO: 172870 - RNA, 32 nt, Human
gcccgcaaaccugugaacuuucgccagugccu

SEQ ID NO: 172871 - RNA, 21 nt, Human
gcccgcaagaggccucagcgg

SEQ ID NO: 172872 - RNA, 32 nt, Human
gcccgcacaagcgccucacgcucagcggcauc

SEQ ID NO: 172873 - RNA, 32 nt, Human
gcccgcacaggcaggcuguguuguggggucca

SEQ ID NO: 172874 - RNA, 32 nt, Human
gcccgcacccggccaaagcccaggaagcucgg

SEQ ID NO: 172875 - RNA, 18 nt, Human
gcccgcacucccgcccug

SEQ ID NO: 172876 - RNA, 32 nt, Human
gcccgcagaagcaagggaugacuugguucuug

SEQ ID NO: 172877 - RNA, 32 nt, Human
gcccgcagaaucccagcgccauguaugcccag

SEQ ID NO: 172878 - RNA, 32 nt, Human
gcccgcagauaaccagcccgagucaugcaguc

SEQ ID NO: 172879 - RNA, 32 nt, Human
gcccgcagcccacaugcccucugugaugagug

SEQ ID NO: 172880 - RNA, 17 nt, Human
gcccgcagcccaccucu

SEQ ID NO: 172881 - RNA, 20 nt, Human
gcccgcagccgccagccucc

SEQ ID NO: 172882 - RNA, 32 nt, Human
gcccgcagccggcgcagccaggagaccgaggu

SEQ ID NO: 172883 - RNA, 32 nt, Human
gcccgcagcugcagagagucccgcugcgucuc

SEQ ID NO: 172884 - RNA, 32 nt, Human
gcccgcaggcaaggucucccacugcagggcuu

SEQ ID NO: 172885 - RNA, 19 nt, Human
gcccgcaggcacgccugca

SEQ ID NO: 172886 - RNA, 32 nt, Human
gcccgcaggugggaggugugguugcaggugcg

SEQ ID NO: 172887 - RNA, 32 nt, Human
gcccgcaguaucuguggugcucugggcccucc

SEQ ID NO: 172888 - RNA, 32 nt, Human
gcccgcagugcucugcaagauccugcucugca

SEQ ID NO: 172889 - RNA, 32 nt, Human
gcccgcagugcugggaccagagccagaugcag

SEQ ID NO: 172890 - RNA, 20 nt, Human
gcccgccaagcgcggccgca

SEQ ID NO: 172891 - RNA, 17 nt, Human
gcccgccaaggcugcag

SEQ ID NO: 172892 - RNA, 32 nt, Human
gcccgccacaucugcagugccgcacacagaca

SEQ ID NO: 172893 - RNA, 21 nt, Human
gcccgccaccgugcaagcucu

SEQ ID NO: 172894 - RNA, 32 nt, Human
gcccgccaccuugcccagcuaauuuuuguauu

SEQ ID NO: 172895 - RNA, 19 nt, Human
gcccgccacgcgccgccac

SEQ ID NO: 172896 - RNA, 16 nt, Human
gcccgccacggagcug

SEQ ID NO: 172897 - RNA, 32 nt, Human
gcccgccacuggcuucucucuuuuucuccguu

SEQ ID NO: 172898 - RNA, 32 nt, Human
gcccgccagacccucuggagaagccccugccc

SEQ ID NO: 172899 - RNA, 32 nt, Human
gcccgccagcuuccucccaggacagugcugcu

SEQ ID NO: 172900 - RNA, 32 nt, Human
gcccgccaugccacaaggugggggaggcccug

SEQ ID NO: 172901 - RNA, 20 nt, Human
gcccgcccaacucccagcgg

SEQ ID NO: 172902 - RNA, 18 nt, Human
gcccgcccaccccugccu

SEQ ID NO: 172903 - RNA, 32 nt, Human
gcccgcccagcacccugagaccacacuguugc

SEQ ID NO: 172904 - RNA, 32 nt, Human
gcccgcccaguucucugagcgugcggcggacg

SEQ ID NO: 172905 - RNA, 32 nt, Human
gcccgcccccagaaccccugaugcugguuagg

SEQ ID NO: 172906 - RNA, 32 nt, Human
gcccgcccccuucucauggugcuacuuccucu

SEQ ID NO: 172907 - RNA, 20 nt, Human
gcccgccccggcgcaggcag

SEQ ID NO: 172908 - RNA, 32 nt, Human
gcccgccccugccuuucucuuccuccaucagg

SEQ ID NO: 172909 - RNA, 32 nt, Human
gcccgccccuuuccucuggccccuccucucca

SEQ ID NO: 172910 - RNA, 19 nt, Human
gcccgcccgcgcccagggg

SEQ ID NO: 172911 - RNA, 32 nt, Human
gcccgcccggcccagccgcuccugcugggcgc

SEQ ID NO: 172912 - RNA, 32 nt, Human
gcccgcccucacugcuguucuugccuuacagc

SEQ ID NO: 172913 - RNA, 32 nt, Human
gcccgcccuccaccuucuccaccacccagcag

SEQ ID NO: 172914 - RNA, 32 nt, Human
gcccgcccucucugguccucccaaaccccaaa

SEQ ID NO: 172915 - RNA, 32 nt, Human
gcccgcccucucuuccugcagccugggaacuu

SEQ ID NO: 172916 - RNA, 32 nt, Human
gcccgcccugcacuaucagccucgagagggac

SEQ ID NO: 172917 - RNA, 16 nt, Human
gcccgccgaguccugc

SEQ ID NO: 172918 - RNA, 22 nt, Human
gcccgccgauuauuccuuggua

SEQ ID NO: 172919 - RNA, 20 nt, Human
gcccgccgccagccccacgg

SEQ ID NO: 172920 - RNA, 18 nt, Human
gcccgccgccgccccccu

SEQ ID NO: 172921 - RNA, 17 nt, Human
gcccgccgcgcagcccg

SEQ ID NO: 172922 - RNA, 32 nt, Human
gcccgccgcggucccgucuccugggccugucc

SEQ ID NO: 172923 - RNA, 20 nt, Human
gcccgccgcuccacuccccg

SEQ ID NO: 172924 - RNA, 20 nt, Human
gcccgccgcucccggccccg

SEQ ID NO: 172925 - RNA, 22 nt, Human
gcccgccgggcucgcagccccg

SEQ ID NO: 172926 - RNA, 32 nt, Human
gcccgccggucccucugggauguccguaggac

SEQ ID NO: 172927 - RNA, 26 nt, Human
gcccgccucagcgcccccacuccgcg

SEQ ID NO: 172928 - RNA, 32 nt, Human
gcccgccucaucugcaugcgcauuccucgcgc

SEQ ID NO: 172929 - RNA, 15 nt, Human
gcccgccuccucccu

SEQ ID NO: 172930 - RNA, 32 nt, Human
gcccgccucugcaccacacaaggagcucuuug

SEQ ID NO: 172931 - RNA, 32 nt, Human
gcccgccucugccuccccaaagugcugggauu

SEQ ID NO: 172932 - RNA, 32 nt, Human
gcccgccucugucagucuuccugaccccuucc

SEQ ID NO: 172933 - RNA, 32 nt, Human
gcccgccugaggacgggggugccuucaugcgg

SEQ ID NO: 172934 - RNA, 32 nt, Human
gcccgccugcagcgcccggcacccgcccagga

SEQ ID NO: 172935 - RNA, 20 nt, Human
gcccgccugccaaugugagg

SEQ ID NO: 172936 - RNA, 32 nt, Human
gcccgccugcccccauccccuccaggccacgu

SEQ ID NO: 172937 - RNA, 32 nt, Human
gcccgccugccugccugcccgcccgcucgcuc

SEQ ID NO: 172938 - RNA, 32 nt, Human
gcccgccugccuggcugcccaaccagcuccaa

SEQ ID NO: 172939 - RNA, 32 nt, Human
gcccgccugccugggcccaccugcugcugcug

SEQ ID NO: 172940 - RNA, 32 nt, Human
gcccgcgaggcugagggggcucagaggucccc

SEQ ID NO: 172941 - RNA, 19 nt, Human
gcccgcgccagccccgcgg

SEQ ID NO: 172942 - RNA, 20 nt, Human
gcccgcgccgccgccgccgc

SEQ ID NO: 172943 - RNA, 32 nt, Human
gcccgcgcgguuuggggcaggcguggccgucg

SEQ ID NO: 172944 - RNA, 17 nt, Human
gcccgcgcuguccuccc

SEQ ID NO: 172945 - RNA, 32 nt, Human
gcccgcggaccacccugugugugucauccuga

SEQ ID NO: 172946 - RNA, 32 nt, Human
gcccgcggagcgcagcugagacugggggagcg

SEQ ID NO: 172947 - RNA, 32 nt, Human
gcccgcggaggagcccgcgccgccccgaugcc

SEQ ID NO: 172948 - RNA, 32 nt, Human
gcccgcggaggcaccgaugcccgcagagcccg

SEQ ID NO: 172949 - RNA, 32 nt, Human
gcccgcggcaggcggcggccaugaacuucucc

SEQ ID NO: 172950 - RNA, 24 nt, Human
gcccgcggcccagccgaagcucuu

SEQ ID NO: 172951 - RNA, 32 nt, Human
gcccgcggcucccagggugaucccgagcacag

SEQ ID NO: 172952 - RNA, 32 nt, Human
gcccgcgggaggcccggggcagcggcugggau

SEQ ID NO: 172953 - RNA, 32 nt, Human
gcccgcggucaggagcagcaaugucugugcag

SEQ ID NO: 172954 - RNA, 32 nt, Human
gcccgcggugcagcuccagccccgggaagccc

SEQ ID NO: 172955 - RNA, 20 nt, Human
gcccgcgucacccggcagca

SEQ ID NO: 172956 - RNA, 22 nt, Human
gcccgcgucuagcuuaguuuca

SEQ ID NO: 172957 - RNA, 24 nt, Human
gcccgcgucuuugcaguaguugca

SEQ ID NO: 172958 - RNA, 32 nt, Human
gcccgcucacgauuccggccacggugaugacg

SEQ ID NO: 172959 - RNA, 32 nt, Human
gcccgcucagcagccugcugaggaguggggac

SEQ ID NO: 172960 - RNA, 32 nt, Human
gcccgcucuacaucuucugccuuagucucagu

SEQ ID NO: 172961 - RNA, 32 nt, Human
gcccgcucuaggccuuauccucccucuagguc

SEQ ID NO: 172962 - RNA, 32 nt, Human
gcccgcucucccucaucucucucugauaaucu

SEQ ID NO: 172963 - RNA, 32 nt, Human
gcccgcucugagcuggaagcagcaugugggac

SEQ ID NO: 172964 - RNA, 32 nt, Human
gcccgcucuggccgcuugcuuuuugcugagaa

SEQ ID NO: 172965 - RNA, 32 nt, Human
gcccgcugccaagagcuagagaggaggaucca

SEQ ID NO: 172966 - RNA, 32 nt, Human
gcccgcugcccaggcuggccgccgccgugccg

SEQ ID NO: 172967 - RNA, 23 nt, Human
gcccgcugccccgcgagcccgcg

SEQ ID NO: 172968 - RNA, 32 nt, Human
gcccgcugcccucugucaucccauucaagauu

SEQ ID NO: 172969 - RNA, 31 nt, Human
gcccgcugccucuuggcuucucagccccuuu

SEQ ID NO: 172970 - RNA, 20 nt, Human
gcccgcugcuccccgcugcg

SEQ ID NO: 172971 - RNA, 32 nt, Human
gcccgcuggagcgguugagugcagaagggugc

SEQ ID NO: 172972 - RNA, 32 nt, Human
gcccgcuggcaccugcagccuccugggcgccc

SEQ ID NO: 172973 - RNA, 29 nt, Human
gcccgcuggcugcagagcaucccugggag

SEQ ID NO: 172974 - RNA, 32 nt, Human
gcccgcuggggagggguccgggaagaagggga

SEQ ID NO: 172975 - RNA, 24 nt, Human
gcccgcugucccagcuccuugaga

SEQ ID NO: 172976 - RNA, 32 nt, Human
gcccgcuuaauauuaucagagccgagccugga

SEQ ID NO: 172977 - RNA, 21 nt, Human
gcccgcuucccaagccagcca

SEQ ID NO: 172978 - RNA, 32 nt, Human
gcccgcuucccugucuaaccggauucuuccag

SEQ ID NO: 172979 - RNA, 23 nt, Human
gcccgcuuucugggaaagacaga

SEQ ID NO: 172980 - RNA, 23 nt, Human
gcccggaaagacgccagagccag

SEQ ID NO: 172981 - RNA, 32 nt, Human
gcccggaacagcccggggauuguuccucucuc

SEQ ID NO: 172982 - RNA, 32 nt, Human
gcccggaagccagucccucccccuagaccccg

SEQ ID NO: 172983 - RNA, 32 nt, Human
gcccggaaggcagagguugcagugagcugaga

SEQ ID NO: 172984 - RNA, 32 nt, Human
gcccggaaggcggagguugcagugagcugaga

SEQ ID NO: 172985 - RNA, 32 nt, Human
gcccggaauccuccaaggaggcuugcacuugu

SEQ ID NO: 172986 - RNA, 32 nt, Human
gcccggacaccucauuccccucccacuacagg

SEQ ID NO: 172987 - RNA, 32 nt, Human
gcccggacauccuggaagcugggaaaugguga

SEQ ID NO: 172988 - RNA, 32 nt, Human
gcccggaccacaggcuccagauggacccuggg

SEQ ID NO: 172989 - RNA, 32 nt, Human
gcccggacccuccuaucccgggaggagccuca

SEQ ID NO: 172990 - RNA, 32 nt, Human
gcccggaccgaggaagaagaugcaagccagcc

SEQ ID NO: 172991 - RNA, 20 nt, Human
gcccggaccucggccucccc

SEQ ID NO: 172992 - RNA, 32 nt, Human
gcccggaccuuggcugucuccucuuugugccg

SEQ ID NO: 172993 - RNA, 32 nt, Human
gcccggacgccucauucccccucugggcccug

SEQ ID NO: 172994 - RNA, 32 nt, Human
gcccggagacuugccuugcaaugccauguuug

SEQ ID NO: 172995 - RNA, 32 nt, Human
gcccggagaugcaggagguccugcuagaggug

SEQ ID NO: 172996 - RNA, 32 nt, Human
gcccggagcagccuguuccugcacuccacccu

SEQ ID NO: 172997 - RNA, 22 nt, Human
gcccggagcccgccgccccagg

SEQ ID NO: 172998 - RNA, 32 nt, Human
gcccggagcccuugccccugcccgcgccgccg

SEQ ID NO: 172999 - RNA, 32 nt, Human
gcccggagcugagcuccccaccugccgguagc

SEQ ID NO: 173000 - RNA, 32 nt, Human
gcccggagcugccucuuagacucgucuggccc

SEQ ID NO: 173001 - RNA, 23 nt, Human
gcccggagcuggguacccaagcg

SEQ ID NO: 173002 - RNA, 32 nt, Human
gcccggaggacacucuuggccuagggagugga

SEQ ID NO: 173003 - RNA, 21 nt, Human
gcccggaggagcucccaggcg

SEQ ID NO: 173004 - RNA, 32 nt, Human
gcccggaggaggaggaggaggaggaggaggag

SEQ ID NO: 173005 - RNA, 21 nt, Human
gcccggaggcccuaggagcug

SEQ ID NO: 173006 - RNA, 21 nt, Human
gcccggaggccgguacccagg

SEQ ID NO: 173007 - RNA, 31 nt, Human
gcccggagggugucuccccaagccaggcaca

SEQ ID NO: 173008 - RNA, 32 nt, Human
gcccggauccaggauucugggaggcuucaguu

SEQ ID NO: 173009 - RNA, 16 nt, Human
gcccggaucccucagg

SEQ ID NO: 173010 - RNA, 23 nt, Human
gcccggaucgccgccgccgccgc

SEQ ID NO: 173011 - RNA, 32 nt, Human
gcccggauguacugaggaugcguuacaguuuc

SEQ ID NO: 173012 - RNA, 29 nt, Human
gcccggcaaaguuggagcccuugcgguac

SEQ ID NO: 173013 - RNA, 32 nt, Human
gcccggcacagccaugaucaaggcgauccuaa

SEQ ID NO: 173014 - RNA, 18 nt, Human
gcccggcaccccacuucu

SEQ ID NO: 173015 - RNA, 21 nt, Human
gcccggcaccuccaacaacau

SEQ ID NO: 173016 - RNA, 32 nt, Human
gcccggcagccagcucugcagagccauuuguc

SEQ ID NO: 173017 - RNA, 32 nt, Human
gcccggcaggccuccagccaggagugcaucaa

SEQ ID NO: 173018 - RNA, 32 nt, Human
gcccggcagugucuucucagugucuucaccug

SEQ ID NO: 173019 - RNA, 32 nt, Human
gcccggcaucugaaugagagcucucuuuguaa

SEQ ID NO: 173020 - RNA, 32 nt, Human
gcccggccaauacauuauuauuaacuuaaggc

SEQ ID NO: 173021 - RNA, 32 nt, Human
gcccggccaccacugcuggcuucagccccuug

SEQ ID NO: 173022 - RNA, 19 nt, Human
gcccggccacccugcccca

SEQ ID NO: 173023 - RNA, 32 nt, Human
gcccggccagcccgagaaagacaggacggagu

SEQ ID NO: 173024 - RNA, 18 nt, Human
gcccggccagcgcugcgg

SEQ ID NO: 173025 - RNA, 26 nt, Human
gcccggccaggauggagggggcucag

SEQ ID NO: 173026 - RNA, 32 nt, Human
gcccggcccaagcucuacuuguguacagugua

SEQ ID NO: 173027 - RNA, 32 nt, Human
gcccggcccagaggggacaggaagccaggaca

SEQ ID NO: 173028 - RNA, 32 nt, Human
gcccggcccagcugcagccacccuucucaucu

SEQ ID NO: 173029 - RNA, 32 nt, Human
gcccggcccgagguaucgcaugugcgggggag

SEQ ID NO: 173030 - RNA, 32 nt, Human
gcccggcccgcacauggucgagcgggggucuc

SEQ ID NO: 173031 - RNA, 32 nt, Human
gcccggcccgggaggagcaggacgcgccgggg

SEQ ID NO: 173032 - RNA, 32 nt, Human
gcccggcccgggcccgcgguucuccacccgua

SEQ ID NO: 173033 - RNA, 32 nt, Human
gcccggcccugagccuccucugcugagccagc

SEQ ID NO: 173034 - RNA, 32 nt, Human
gcccggcccugccucauagcaggcugccaugu

SEQ ID NO: 173035 - RNA, 19 nt, Human
gcccggccgugguaacugu

SEQ ID NO: 173036 - RNA, 32 nt, Human
gcccggccguuuucucuucuuccucuugcguc

SEQ ID NO: 173037 - RNA, 32 nt, Human
gcccggccuccagggcccgcuggccccacagc

SEQ ID NO: 173038 - RNA, 32 nt, Human
gcccggccucccucccccugcagccaucccaa

SEQ ID NO: 173039 - RNA, 24 nt, Human
gcccggccucgccgccgccgccgc

SEQ ID NO: 173040 - RNA, 32 nt, Human
gcccggccucgccugcccuccugggccaguca

SEQ ID NO: 173041 - RNA, 32 nt, Human
gcccggcgacacugcacccaucccggcugcuu

SEQ ID NO: 173042 - RNA, 20 nt, Human
gcccggcgccaugggcucag

SEQ ID NO: 173043 - RNA, 32 nt, Human
gcccggcgcguguggcccugcccggcguggac

SEQ ID NO: 173044 - RNA, 22 nt, Human
gcccggcgcuucggcccgggcc

SEQ ID NO: 173045 - RNA, 32 nt, Human
gcccggcggcagcugagccagcgcggcggguc

SEQ ID NO: 173046 - RNA, 32 nt, Human
gcccggcuaauuuuuguuuuuguauuuuuagu

SEQ ID NO: 173047 - RNA, 32 nt, Human
gcccggcucacugcagccugguuacgacggga

SEQ ID NO: 173048 - RNA, 32 nt, Human
gcccggcuccacuucuaggccauguuuugacu

SEQ ID NO: 173049 - RNA, 21 nt, Human
gcccggcuccuaagucuaccc

SEQ ID NO: 173050 - RNA, 32 nt, Human
gcccggcuccucccagaaccagucccagccug

SEQ ID NO: 173051 - RNA, 32 nt, Human
gcccggcucuggaaggcuuuggagaguccagc

SEQ ID NO: 173052 - RNA, 32 nt, Human
gcccggcugcggaaugaaccacaucuugcucu

SEQ ID NO: 173053 - RNA, 32 nt, Human
gcccggcugcuaccucugcagacauggccugg

SEQ ID NO: 173054 - RNA, 32 nt, Human
gcccggcuggaaggcagagcuccgaagcaggc

SEQ ID NO: 173055 - RNA, 32 nt, Human
gcccggcuucacuaggccugggugucuggguu

SEQ ID NO: 173056 - RNA, 23 nt, Human
gcccggcuugcucagccuggcca

SEQ ID NO: 173057 - RNA, 32 nt, Human
  misc_feature (31)..(31): n is a, c, g or u
gcccgggaagcagagguugcagugaacugang

SEQ ID NO: 173058 - RNA, 32 nt, Human
gcccgggaagcucaagggcugagagggagccg

SEQ ID NO: 173059 - RNA, 17 nt, Human
gcccgggaagcugggug

SEQ ID NO: 173060 - RNA, 32 nt, Human
gcccgggaaguggagguugcacugagcugaga

SEQ ID NO: 173061 - RNA, 32 nt, Human
gcccgggacagaacagacaugcacaggaccug

SEQ ID NO: 173062 - RNA, 32 nt, Human
gcccgggacauggccaaggcgggccgugcagg

SEQ ID NO: 173063 - RNA, 32 nt, Human
gcccgggacgaggaggaggaggaggaagaggg

SEQ ID NO: 173064 - RNA, 19 nt, Human
gcccgggacucgcucgcuc

SEQ ID NO: 173065 - RNA, 23 nt, Human
gcccgggagacagcaagauucug

SEQ ID NO: 173066 - RNA, 32 nt, Human
gcccgggagacccaggaggagcccgcagauaa

SEQ ID NO: 173067 - RNA, 32 nt, Human
gcccgggagagaacccaggagcgccgccgccc

SEQ ID NO: 173068 - RNA, 32 nt, Human
gcccgggagagggaacggggacaggagcagag

SEQ ID NO: 173069 - RNA, 32 nt, Human
gcccgggagagggaggcccgagcugccaccgg

SEQ ID NO: 173070 - RNA, 22 nt, Human
gcccgggagaggggggugcagg

SEQ ID NO: 173071 - RNA, 32 nt, Human
gcccgggagcaggugugcaggagcgcagcgcg

SEQ ID NO: 173072 - RNA, 32 nt, Human
gcccgggagcccagggcucugaugaggcauga

SEQ ID NO: 173073 - RNA, 32 nt, Human
gcccgggagccgcggcgauggcggugcaggcg

SEQ ID NO: 173074 - RNA, 32 nt, Human
gcccgggagcgggccagcugccgggagcccug

SEQ ID NO: 173075 - RNA, 32 nt, Human
gcccgggagcgugggagcaggaggguggcgcg

SEQ ID NO: 173076 - RNA, 31 nt, Human
gcccgggaggaggaggaggagguugcaguga

SEQ ID NO: 173077 - RNA, 32 nt, Human
gcccgggaggcagaaccugcagugagccaaaa

SEQ ID NO: 173078 - RNA, 32 nt, Human
gcccgggaggcagaggcugcagugaaccaaga

SEQ ID NO: 173079 - RNA, 32 nt, Human
gcccgggaggcagaggcugcaguggcugagau

SEQ ID NO: 173080 - RNA, 22 nt, Human
gcccgggaggcagagguugcag

SEQ ID NO: 173081 - RNA, 24 nt, Human
gcccgggaggcagagguugcagug

SEQ ID NO: 173082 - RNA, 32 nt, Human
gcccgggaggcagagguugcagugagccauga

SEQ ID NO: 173083 - RNA, 32 nt, Human
gcccgggaggcagagguugcagugagccgaga

SEQ ID NO: 173084 - RNA, 32 nt, Human
gcccgggaggcagagguugcagugagccguga

SEQ ID NO: 173085 - RNA, 24 nt, Human
gcccgggaggcggagauugcggug

SEQ ID NO: 173086 - RNA, 24 nt, Human
gcccgggaggcggagcuuacagug

SEQ ID NO: 173087 - RNA, 32 nt, Human
gcccgggaggcggagcuuacagugagcugaga

SEQ ID NO: 173088 - RNA, 32 nt, Human
gcccgggaggcggagcuugcagugagcugaga

SEQ ID NO: 173089 - RNA, 21 nt, Human
gcccgggaggcggaggcgcgg

SEQ ID NO: 173090 - RNA, 24 nt, Human
gcccgggaggcggagguugcagug

SEQ ID NO: 173091 - RNA, 32 nt, Human
gcccgggaggcggagguugcagugagcugaga

SEQ ID NO: 173092 - RNA, 32 nt, Human
gcccgggaggcggagguugccgagccgagaua

SEQ ID NO: 173093 - RNA, 19 nt, Human
gcccgggaggcgggggcgg

SEQ ID NO: 173094 - RNA, 32 nt, Human
gcccgggagggaggggugugcaggagccgcag

SEQ ID NO: 173095 - RNA, 32 nt, Human
gcccgggaggucaagguugcagugagcuguca

SEQ ID NO: 173096 - RNA, 32 nt, Human
gcccgggaggucaagguugcagugagucauga

SEQ ID NO: 173097 - RNA, 25 nt, Human
gcccgggagguggagcuugcagugg

SEQ ID NO: 173098 - RNA, 24 nt, Human
gcccgggagguggagguugcagug

SEQ ID NO: 173099 - RNA, 25 nt, Human
gcccgggagguggagguugcaguga

SEQ ID NO: 173100 - RNA, 32 nt, Human
gcccgggagguggagguugcagugagccaaga

SEQ ID NO: 173101 - RNA, 32 nt, Human
gcccgggagguggagguugcagugagcccaga

SEQ ID NO: 173102 - RNA, 32 nt, Human
gcccgggagguggagguugcagugagcugagg

SEQ ID NO: 173103 - RNA, 32 nt, Human
gcccgggagguggagguugcagugagucaaga

SEQ ID NO: 173104 - RNA, 24 nt, Human
gcccgggagguugaggcugcagug

SEQ ID NO: 173105 - RNA, 32 nt, Human
gcccgggagugccccaccacguggcuuucacc

SEQ ID NO: 173106 - RNA, 32 nt, Human
gcccgggaguuugaaguugcagugagcuauga

SEQ ID NO: 173107 - RNA, 32 nt, Human
gcccgggaucccggcggcggcgggggaaggag

SEQ ID NO: 173108 - RNA, 23 nt, Human
gcccgggaugcgccagggaacag

SEQ ID NO: 173109 - RNA, 32 nt, Human
gcccgggcaacauagcaagaccccuaucucua

SEQ ID NO: 173110 - RNA, 20 nt, Human
gcccgggcagccccacgccc

SEQ ID NO: 173111 - RNA, 32 nt, Human
gcccgggcaggugguugcagcauugcagaaga

SEQ ID NO: 173112 - RNA, 23 nt, Human
gcccgggcaucuccugaagcuca

SEQ ID NO: 173113 - RNA, 21 nt, Human
gcccgggccagcaccuaggcg

SEQ ID NO: 173114 - RNA, 32 nt, Human
gcccgggcccaggagugccugguguagcaguc

SEQ ID NO: 173115 - RNA, 19 nt, Human
gcccgggccccugcugcug

SEQ ID NO: 173116 - RNA, 18 nt, Human
gcccgggcccggcugccu

SEQ ID NO: 173117 - RNA, 21 nt, Human
gcccgggccgaacggcugcgg

SEQ ID NO: 173118 - RNA, 18 nt, Human
gcccgggccgcucaggug

SEQ ID NO: 173119 - RNA, 20 nt, Human
gcccgggcgccuggguccuc

SEQ ID NO: 173120 - RNA, 32 nt, Human
gcccgggcgcuccuacagcagugccugcacgc

SEQ ID NO: 173121 - RNA, 32 nt, Human
gcccgggcucgccccauaccacgagccagccc

SEQ ID NO: 173122 - RNA, 21 nt, Human
gcccgggcuggaaugcaaugg

SEQ ID NO: 173123 - RNA, 21 nt, Human
gcccgggcuggagugcaaugg

SEQ ID NO: 173124 - RNA, 21 nt, Human
gcccgggcuggagugcagcgg

SEQ ID NO: 173125 - RNA, 24 nt, Human
gcccgggcuggagugcagcggcgu

SEQ ID NO: 173126 - RNA, 32 nt, Human
gcccgggcuggucuagaacuccuggguucaag

SEQ ID NO: 173127 - RNA, 32 nt, Human
gcccgggcuggucucaaacuccuggguucaag

SEQ ID NO: 173128 - RNA, 18 nt, Human
gcccgggcuuggaggccu

SEQ ID NO: 173129 - RNA, 32 nt, Human
gcccggggaaggcggagcucaguggccacagg

SEQ ID NO: 173130 - RNA, 18 nt, Human
gcccggggauccagcacg

SEQ ID NO: 173131 - RNA, 32 nt, Human
gcccggggcaggcaggacgcagaggaggaggc

SEQ ID NO: 173132 - RNA, 32 nt, Human
gcccggggcccaggcagaaugcgagaacacca

SEQ ID NO: 173133 - RNA, 32 nt, Human
gcccggggccgccgccuggccugggagucccu

SEQ ID NO: 173134 - RNA, 32 nt, Human
gcccggggccuggggcgucagcugggauauau

SEQ ID NO: 173135 - RNA, 20 nt, Human
gcccggggcgagugggccuc

SEQ ID NO: 173136 - RNA, 32 nt, Human
gcccggggcgcacggcccgcacgacgccuucc

SEQ ID NO: 173137 - RNA, 21 nt, Human
gcccggggcugcagccugacc

SEQ ID NO: 173138 - RNA, 22 nt, Human
gcccggggcuggagcgcagcgg

SEQ ID NO: 173139 - RNA, 32 nt, Human
gcccgggggaccccgccccgacccaggggcug

SEQ ID NO: 173140 - RNA, 32 nt, Human
gcccgggggacgccugcccugcccagguggcc

SEQ ID NO: 173141 - RNA, 32 nt, Human
gcccgggggaggacgcagacccgggcaggcgg

SEQ ID NO: 173142 - RNA, 32 nt, Human
gcccgggggaggcgacggcagcggcggcggcu

SEQ ID NO: 173143 - RNA, 32 nt, Human
gcccgggggaggcggccgaggcggcggcggcg

SEQ ID NO: 173144 - RNA, 20 nt, Human
gcccgggggucuggggccuc

SEQ ID NO: 173145 - RNA, 32 nt, Human
gcccggggucuaagauguaaagagguaaacag

SEQ ID NO: 173146 - RNA, 32 nt, Human
gcccgggguggaggagggagccaggcuucgcu

SEQ ID NO: 173147 - RNA, 32 nt, Human
gcccgggguggccacaccacagcaagccggcc

SEQ ID NO: 173148 - RNA, 32 nt, Human
gcccgggucaccaugcacaauccucuggccug

SEQ ID NO: 173149 - RNA, 32 nt, Human
gcccgggucaccccagcccugggguggaggcc

SEQ ID NO: 173150 - RNA, 20 nt, Human
gcccgggucccgccucgggg

SEQ ID NO: 173151 - RNA, 32 nt, Human
gcccgggucuucgugcagaaccauugggcaca

SEQ ID NO: 173152 - RNA, 32 nt, Human
gcccgggucuugcuccccauuggccgccaccu

SEQ ID NO: 173153 - RNA, 32 nt, Human
gcccgggugacggcgguaggggaccagcaacu

SEQ ID NO: 173154 - RNA, 19 nt, Human
gcccgggugccggggccca

SEQ ID NO: 173155 - RNA, 19 nt, Human
gcccgggugggucugcgca

SEQ ID NO: 173156 - RNA, 20 nt, Human
gcccggguucuccugcugcc

SEQ ID NO: 173157 - RNA, 32 nt, Human
gcccggguuugccccuagcugcggaggcuguu

SEQ ID NO: 173158 - RNA, 32 nt, Human
gcccgguaggaaagagagaggaggagggggaa

SEQ ID NO: 173159 - RNA, 32 nt, Human
gcccgguaugccaguguccugggaggauggac

SEQ ID NO: 173160 - RNA, 32 nt, Human
gcccggucacugacuccuccgcgcuuuccucg

SEQ ID NO: 173161 - RNA, 32 nt, Human
gcccggucagugcugcaugcacugcauaugaa

SEQ ID NO: 173162 - RNA, 22 nt, Human
gcccggucccaauggccaaugg

SEQ ID NO: 173163 - RNA, 23 nt, Human
gcccggucccuggccaucagcga

SEQ ID NO: 173164 - RNA, 32 nt, Human
gcccggucucggagaagaggggagaguggagg

SEQ ID NO: 173165 - RNA, 32 nt, Human
gcccggugagcagcacccgcagcucagagccc

SEQ ID NO: 173166 - RNA, 32 nt, Human
gcccggugcagccucuaacuccugggcucaag

SEQ ID NO: 173167 - RNA, 20 nt, Human
gcccggugcccacccugcug

SEQ ID NO: 173168 - RNA, 32 nt, Human
gcccggugcccaggcuggggccgccaagcagc

SEQ ID NO: 173169 - RNA, 32 nt, Human
gcccggugccgccuuccggcuccaguccccgg

SEQ ID NO: 173170 - RNA, 32 nt, Human
gcccggugcgccccuccaccuccugcucgggg

SEQ ID NO: 173171 - RNA, 32 nt, Human
gcccgguggccagcuccucuccuccuugccca

SEQ ID NO: 173172 - RNA, 32 nt, Human
gcccgguggcccagagggaagcggggcacggc

SEQ ID NO: 173173 - RNA, 21 nt, Human
gcccgguggcggcagggccag

SEQ ID NO: 173174 - RNA, 20 nt, Human
gcccgguuccuuuccugagg

SEQ ID NO: 173175 - RNA, 32 nt, Human
gcccgguucuccgcuucuccccauccccuacu

SEQ ID NO: 173176 - RNA, 18 nt, Human
gcccgguuucccucggug

SEQ ID NO: 173177 - RNA, 32 nt, Human
gcccgguuucccucguggcuggagcaggggug

SEQ ID NO: 173178 - RNA, 23 nt, Human
gcccguaaucccagcuacuaagg

SEQ ID NO: 173179 - RNA, 23 nt, Human
gcccguaaucccagcuacucagg

SEQ ID NO: 173180 - RNA, 24 nt, Human
gcccguaaucccagcuacucagga

SEQ ID NO: 173181 - RNA, 23 nt, Human
gcccguaaucccagcuacucggg

SEQ ID NO: 173182 - RNA, 24 nt, Human
gcccguaaucccagcuacucggga

SEQ ID NO: 173183 - RNA, 32 nt, Human
gcccguaaucccagcuagucaggaggcugagg

SEQ ID NO: 173184 - RNA, 32 nt, Human
gcccguacugcccguggcaugagggagccgga

SEQ ID NO: 173185 - RNA, 32 nt, Human
gcccguagaucugggaggccaggcuggcauga

SEQ ID NO: 173186 - RNA, 32 nt, Human
gcccguagcugcguggccgccuggugggacau

SEQ ID NO: 173187 - RNA, 24 nt, Human
gcccguagucccagcuacucagga

SEQ ID NO: 173188 - RNA, 32 nt, Human
gcccgucaagugcugccccugccugugucugg

SEQ ID NO: 173189 - RNA, 32 nt, Human
gcccgucaauaaucccagcuacucgggaggcu

SEQ ID NO: 173190 - RNA, 32 nt, Human
gcccgucacaugcccucugggugacaucggag

SEQ ID NO: 173191 - RNA, 32 nt, Human
gcccguccccagagaaccauggagucuggcag

SEQ ID NO: 173192 - RNA, 21 nt, Human
gcccguccccgcucugcucgc

SEQ ID NO: 173193 - RNA, 32 nt, Human
gcccgucuccccuuaccuccucggcccagcgc

SEQ ID NO: 173194 - RNA, 32 nt, Human
gcccgucucccuggcccaccauguggcugcag

SEQ ID NO: 173195 - RNA, 19 nt, Human
gcccgucuccucuucccuu

SEQ ID NO: 173196 - RNA, 32 nt, Human
gcccgucucuaggagacaggcggggagcguga

SEQ ID NO: 173197 - RNA, 22 nt, Human
gcccgucucuugucuuuccugg

SEQ ID NO: 173198 - RNA, 32 nt, Human
gcccgucugcccaccaugaggaagauccgcgc

SEQ ID NO: 173199 - RNA, 32 nt, Human
gcccgucugccggcucugccugugcugcaagu

SEQ ID NO: 173200 - RNA, 32 nt, Human
gcccgucugccucugagacugcgguaguguuu

SEQ ID NO: 173201 - RNA, 32 nt, Human
gcccgugaagucgaggcugcagugagcccaga

SEQ ID NO: 173202 - RNA, 32 nt, Human
gcccgugaauagugacaaaacaugguuugcag

SEQ ID NO: 173203 - RNA, 32 nt, Human
gcccgugcacggcagagagucugguggggugg

SEQ ID NO: 173204 - RNA, 32 nt, Human
gcccgugcagagcagaggacagugagugucug

SEQ ID NO: 173205 - RNA, 18 nt, Human
gcccgugcccgccugcgg

SEQ ID NO: 173206 - RNA, 32 nt, Human
gcccgugccuuuccucuuccuccuccuccucc

SEQ ID NO: 173207 - RNA, 21 nt, Human
gcccgugcugccugcuggagc

SEQ ID NO: 173208 - RNA, 32 nt, Human
gcccguggagcccugggccuguugacccacca

SEQ ID NO: 173209 - RNA, 32 nt, Human
gcccgugggaggauguacuuaucucagaugcu

SEQ ID NO: 173210 - RNA, 21 nt, Human
gcccguguccugccuugauga

SEQ ID NO: 173211 - RNA, 32 nt, Human
gcccgugucugcccucaucccucucuccuacu

SEQ ID NO: 173212 - RNA, 32 nt, Human
gcccguguggguggcacccugaggucagggga

SEQ ID NO: 173213 - RNA, 32 nt, Human
gcccguguucuccuggcauuaugggcccugga

SEQ ID NO: 173214 - RNA, 32 nt, Human
gcccguuaccucucugcagcagucccccaucc

SEQ ID NO: 173215 - RNA, 32 nt, Human
gcccguuagcuguaacuuggagcuccacucug

SEQ ID NO: 173216 - RNA, 32 nt, Human
gcccguugaaguuccagggagcuugcccgggu

SEQ ID NO: 173217 - RNA, 32 nt, Human
gcccguugcuucugugcuaugcacauuuucua

SEQ ID NO: 173218 - RNA, 23 nt, Human
gcccguuuguuccgcccgugucg

SEQ ID NO: 173219 - RNA, 32 nt, Human
gcccguuuguugucgggggagaagacuuagac

SEQ ID NO: 173220 - RNA, 32 nt, Human
gcccuaaaaagaugauuggcccaauggauggu

SEQ ID NO: 173221 - RNA, 32 nt, Human
gcccuaaaucugcugaggccacugcugguuau

SEQ ID NO: 173222 - RNA, 21 nt, Human
gcccuaacccgccagccuccu

SEQ ID NO: 173223 - RNA, 23 nt, Human
gcccuaagaagucucccuccuca

SEQ ID NO: 173224 - RNA, 32 nt, Human
gcccuaagcuaccugaggguuuaggaggucug

SEQ ID NO: 173225 - RNA, 32 nt, Human
gcccuaaggccuucccucugcagcgcaugcug

SEQ ID NO: 173226 - RNA, 32 nt, Human
gcccuaauaaaccugcuuuugucuucugcaaa

SEQ ID NO: 173227 - RNA, 32 nt, Human
gcccuaaucuggacucauugcaauggcucagc

SEQ ID NO: 173228 - RNA, 32 nt, Human
gcccuaaucuggacucauugcaauggcucagg

SEQ ID NO: 173229 - RNA, 23 nt, Human
gcccuacacuccacgaccugggg

SEQ ID NO: 173230 - RNA, 32 nt, Human
gcccuacacucccuacaccacacccauacuca

SEQ ID NO: 173231 - RNA, 32 nt, Human
gcccuacagugaauccuuaccaguguucaguc

SEQ ID NO: 173232 - RNA, 32 nt, Human
gcccuacaugugggguuggaggagaacuauaa

SEQ ID NO: 173233 - RNA, 22 nt, Human
gcccuacccaaggccaccagcc

SEQ ID NO: 173234 - RNA, 32 nt, Human
gcccuacccuccacucuuucauuccuugaaag

SEQ ID NO: 173235 - RNA, 24 nt, Human
gcccuacccucuugcagcccggga

SEQ ID NO: 173236 - RNA, 19 nt, Human
gcccuaccgaauccugccu

SEQ ID NO: 173237 - RNA, 32 nt, Human
gcccuaccucggggcugaccaggcuggggguc

SEQ ID NO: 173238 - RNA, 32 nt, Human
gcccuaccugacuuggguucucagucaacccu

SEQ ID NO: 173239 - RNA, 32 nt, Human
gcccuaccugcaaccaccgcuugccaugguuu

SEQ ID NO: 173240 - RNA, 32 nt, Human
gcccuaccuugaucaucguccuuuuuagcaug

SEQ ID NO: 173241 - RNA, 32 nt, Human
gcccuacuccacccugucccugcacucccuug

SEQ ID NO: 173242 - RNA, 23 nt, Human
gcccuacuccacugcccuggcag

SEQ ID NO: 173243 - RNA, 32 nt, Human
gcccuacuccagccuggagcucccugagggag

SEQ ID NO: 173244 - RNA, 32 nt, Human
gcccuacuccccaguuuccuggcgaugagcca

SEQ ID NO: 173245 - RNA, 16 nt, Human
gcccuacuuccaccuc

SEQ ID NO: 173246 - RNA, 23 nt, Human
gcccuagaauaugggagugggug

SEQ ID NO: 173247 - RNA, 32 nt, Human
gcccuagacaucuucucccucccuugccucag

SEQ ID NO: 173248 - RNA, 32 nt, Human
gcccuagacccaagcaagaaaccaccacaucu

SEQ ID NO: 173249 - RNA, 32 nt, Human
gcccuagagcacuucuagcagagauuaguugu

SEQ ID NO: 173250 - RNA, 32 nt, Human
gcccuagagcacuucuagcagagauuauuugu

SEQ ID NO: 173251 - RNA, 32 nt, Human
gcccuagaggucgaggcugcagugagcuaugu

SEQ ID NO: 173252 - RNA, 32 nt, Human
gcccuagagguugaggcugcagugagcuaugu

SEQ ID NO: 173253 - RNA, 32 nt, Human
gcccuagauaguuuugccaucuuagaccccuu

SEQ ID NO: 173254 - RNA, 32 nt, Human
gcccuagcauugaucaugauauugcacauauc

SEQ ID NO: 173255 - RNA, 32 nt, Human
gcccuagccggagccguucacagggaggcggc

SEQ ID NO: 173256 - RNA, 32 nt, Human
gcccuaggaaauucacaggguucucaucggag

SEQ ID NO: 173257 - RNA, 22 nt, Human
gcccuaggcccuggccgcagug

SEQ ID NO: 173258 - RNA, 20 nt, Human
gcccuaggcugccugcuccu

SEQ ID NO: 173259 - RNA, 24 nt, Human
gcccuagggaaggaggcuguccca

SEQ ID NO: 173260 - RNA, 20 nt, Human
gcccuagggccgcugcugcc

SEQ ID NO: 173261 - RNA, 32 nt, Human
gcccuagggccugcuucuauguauuuaucaac

SEQ ID NO: 173262 - RNA, 22 nt, Human
gcccuaggggugucugucucca

SEQ ID NO: 173263 - RNA, 32 nt, Human
gcccuagguagcuaaagguugcaugaaggccc

SEQ ID NO: 173264 - RNA, 32 nt, Human
gcccuagguagcuugcucaucuguaaaguggg

SEQ ID NO: 173265 - RNA, 32 nt, Human
gcccuagucaccagcaccagagcccagcugcc

SEQ ID NO: 173266 - RNA, 32 nt, Human
gcccuauaaggagaaagccaacuauguuaagu

SEQ ID NO: 173267 - RNA, 32 nt, Human
gcccuaucaagaccaacaaagcugagaguucu

SEQ ID NO: 173268 - RNA, 21 nt, Human
gcccuauccccacugauacca

SEQ ID NO: 173269 - RNA, 32 nt, Human
gcccuauccuggaagaugggggccaccacacg

SEQ ID NO: 173270 - RNA, 18 nt, Human
gcccuauccuucucugcc

SEQ ID NO: 173271 - RNA, 32 nt, Human
gcccuaucgccucccauuuucccuucaaagua

SEQ ID NO: 173272 - RNA, 32 nt, Human
gcccuaucucccauccuguggaacccgcccca

SEQ ID NO: 173273 - RNA, 32 nt, Human
gcccuaucuccugcaaccucagugccucagcc

SEQ ID NO: 173274 - RNA, 32 nt, Human
gcccuaugcucuggugagaaggugcaacccug

SEQ ID NO: 173275 - RNA, 32 nt, Human
gcccuauuccagcccccuugcuucacucuacc

SEQ ID NO: 173276 - RNA, 20 nt, Human
gcccucaaagacgaggguca

SEQ ID NO: 173277 - RNA, 32 nt, Human
gcccucaacuauucuguuccacacccaaugcu

SEQ ID NO: 173278 - RNA, 32 nt, Human
gcccucaagaacugaagacaauggagcucucu

SEQ ID NO: 173279 - RNA, 32 nt, Human
gcccucaagccacccaggcucccaccacucuc

SEQ ID NO: 173280 - RNA, 32 nt, Human
gcccucaaguagguguuggagagaggggugau

SEQ ID NO: 173281 - RNA, 32 nt, Human
gcccucaaguuucccagaacagucuccccacc

SEQ ID NO: 173282 - RNA, 21 nt, Human
gcccucaaucccagcuacuca

SEQ ID NO: 173283 - RNA, 32 nt, Human
gcccucacaauguaauugaccaaccaaaggaa

SEQ ID NO: 173284 - RNA, 32 nt, Human
gcccucacaccucuaggccucuguuuagauag

SEQ ID NO: 173285 - RNA, 32 nt, Human
gcccucacagcccagacccucacugggaggug

SEQ ID NO: 173286 - RNA, 32 nt, Human
gcccucacauccccuggccuggacccaggaga

SEQ ID NO: 173287 - RNA, 21 nt, Human
gcccucacauucagagccacu

SEQ ID NO: 173288 - RNA, 20 nt, Human
gcccucaccagcccccgcgg

SEQ ID NO: 173289 - RNA, 32 nt, Human
gcccucacccacccucuguguuuccccuucuu

SEQ ID NO: 173290 - RNA, 32 nt, Human
gcccucacccaccuuccuggcccagcagccca

SEQ ID NO: 173291 - RNA, 32 nt, Human
gcccucaccccagagcagcugcagccucagcc

SEQ ID NO: 173292 - RNA, 20 nt, Human
gcccucaccccgccaggagc

SEQ ID NO: 173293 - RNA, 18 nt, Human
gcccucacccuucuuguc

SEQ ID NO: 173294 - RNA, 21 nt, Human
gcccucacccuuuccccaggg

SEQ ID NO: 173295 - RNA, 32 nt, Human
gcccucaccgaggaaccaaauuggccaguauc

SEQ ID NO: 173296 - RNA, 32 nt, Human
gcccucaccgcaggaagcaguuuggguuuuga

SEQ ID NO: 173297 - RNA, 19 nt, Human
gcccucaccuccucugccu

SEQ ID NO: 173298 - RNA, 32 nt, Human
gcccucacgcuggccuccauggagacuccagg

SEQ ID NO: 173299 - RNA, 32 nt, Human
gcccucacggagaggaagggaaggaaggagag

SEQ ID NO: 173300 - RNA, 21 nt, Human
gcccucacuccacagcccucc

SEQ ID NO: 173301 - RNA, 32 nt, Human
gcccucacucccgagccccacacccacaucac

SEQ ID NO: 173302 - RNA, 32 nt, Human
gcccucacugaggagauucagccugggcucca

SEQ ID NO: 173303 - RNA, 32 nt, Human
gcccucacugcacccaccaagucaagcagagc

SEQ ID NO: 173304 - RNA, 24 nt, Human
gcccucacuucauccggcgacuag

SEQ ID NO: 173305 - RNA, 32 nt, Human
gcccucagacacaacuaucccugcccccaccu

SEQ ID NO: 173306 - RNA, 32 nt, Human
gcccucagaccccuuccuuccaaaggagccuc

SEQ ID NO: 173307 - RNA, 18 nt, Human
gcccucagacuccucccu

SEQ ID NO: 173308 - RNA, 32 nt, Human
gcccucagacuggaucuucugccuccaaauua

SEQ ID NO: 173309 - RNA, 18 nt, Human
gcccucagagaccugcug

SEQ ID NO: 173310 - RNA, 32 nt, Human
gcccucagagagaagagagacuccagagaagg

SEQ ID NO: 173311 - RNA, 31 nt, Human
gcccucagagucaaggaggcaggaugaauuu

SEQ ID NO: 173312 - RNA, 32 nt, Human
gcccucagaucccugcucuuccugccuuuccu

SEQ ID NO: 173313 - RNA, 32 nt, Human
gcccucagauguguugacagcugcucuucuga

SEQ ID NO: 173314 - RNA, 32 nt, Human
gcccucagcacacacaucugcacacacgcagc

SEQ ID NO: 173315 - RNA, 20 nt, Human
gcccucagcacccccucccu

SEQ ID NO: 173316 - RNA, 18 nt, Human
gcccucagcauuccugcc

SEQ ID NO: 173317 - RNA, 32 nt, Human
gcccucagcauugucagccugaagaucagagc

SEQ ID NO: 173318 - RNA, 19 nt, Human
gcccucagccagcccagaa

SEQ ID NO: 173319 - RNA, 32 nt, Human
gcccucagccagcuucccagcaagacaaaggg

SEQ ID NO: 173320 - RNA, 21 nt, Human
gcccucagccagcuuuucccu

SEQ ID NO: 173321 - RNA, 19 nt, Human
gcccucagccauccuagcc

SEQ ID NO: 173322 - RNA, 17 nt, Human
gcccucagccccaggcc

SEQ ID NO: 173323 - RNA, 23 nt, Human
gcccucagcccugccagaccucc

SEQ ID NO: 173324 - RNA, 32 nt, Human
gcccucagccuaggggguguaguguaagggaa

SEQ ID NO: 173325 - RNA, 32 nt, Human
gcccucagccuccuccugcuccuucuccuccu

SEQ ID NO: 173326 - RNA, 32 nt, Human
gcccucagccugccucacugcugggccagggu

SEQ ID NO: 173327 - RNA, 20 nt, Human
gcccucagccugggcugccu

SEQ ID NO: 173328 - RNA, 18 nt, Human
gcccucagcgucugcucc

SEQ ID NO: 173329 - RNA, 32 nt, Human
gcccucagcuauuaacugugcuguguauuuau

SEQ ID NO: 173330 - RNA, 32 nt, Human
gcccucagcucaguuuuuggcucuguuaugga

SEQ ID NO: 173331 - RNA, 32 nt, Human
gcccucagcugcaacuccaauggcuacaccag

SEQ ID NO: 173332 - RNA, 19 nt, Human
gcccucagcugcaccuccu

SEQ ID NO: 173333 - RNA, 32 nt, Human
gcccucagcugcagggaaaccgcacucaaacc

SEQ ID NO: 173334 - RNA, 17 nt, Human
gcccucagcuggcugcc

SEQ ID NO: 173335 - RNA, 20 nt, Human
gcccucagcugguccauccu

SEQ ID NO: 173336 - RNA, 32 nt, Human
gcccucaggaacccuucucugaucaucaggau

SEQ ID NO: 173337 - RNA, 32 nt, Human
gcccucaggaaggcggccuuccccugcagucc

SEQ ID NO: 173338 - RNA, 32 nt, Human
gcccucaggaccagcaccagccaagggaaugc

SEQ ID NO: 173339 - RNA, 32 nt, Human
gcccucaggaccugggcgugaauucagggaca

SEQ ID NO: 173340 - RNA, 32 nt, Human
gcccucaggagagaccaggaggacugacagcg

SEQ ID NO: 173341 - RNA, 32 nt, Human
gcccucaggagccugggcugcgaggcuccaua

SEQ ID NO: 173342 - RNA, 24 nt, Human
gcccucaggagcgucaggaucauu

SEQ ID NO: 173343 - RNA, 32 nt, Human
gcccucaggagcgucaggaucauuuucaacuc

SEQ ID NO: 173344 - RNA, 32 nt, Human
gcccucaggcaccugcacuuacaggccuugcu

SEQ ID NO: 173345 - RNA, 32 nt, Human
gcccucaggcccacagguuuaaggcugaggcu

SEQ ID NO: 173346 - RNA, 20 nt, Human
gcccucaggcccucccugcc

SEQ ID NO: 173347 - RNA, 32 nt, Human
gcccucaggccgcggcgacuggguuagagaug

SEQ ID NO: 173348 - RNA, 32 nt, Human
gcccucaggcuugccuguaggauuuaauauuu

SEQ ID NO: 173349 - RNA, 18 nt, Human
gcccucagucacuugccu

SEQ ID NO: 173350 - RNA, 19 nt, Human
gcccucaguccccacccca

SEQ ID NO: 173351 - RNA, 32 nt, Human
gcccucagucuagggaucuggccacagacucc

SEQ ID NO: 173352 - RNA, 32 nt, Human
gcccucagugggcucccuggcccagccagcca

SEQ ID NO: 173353 - RNA, 25 nt, Human
gcccucaguguccaagacccaggca

SEQ ID NO: 173354 - RNA, 19 nt, Human
gcccucauacccccucccu

SEQ ID NO: 173355 - RNA, 24 nt, Human
gcccucauagcccugcuccaggaa

SEQ ID NO: 173356 - RNA, 32 nt, Human
gcccucaucagagucaucagcaaacuguccaa

SEQ ID NO: 173357 - RNA, 32 nt, Human
gcccucauccacccucccaagcugugcgagca

SEQ ID NO: 173358 - RNA, 32 nt, Human
gcccucauccccacagucuugggaucucaggg

SEQ ID NO: 173359 - RNA, 22 nt, Human
gcccucauccccagucucggga

SEQ ID NO: 173360 - RNA, 18 nt, Human
gcccucauccccucuccc

SEQ ID NO: 173361 - RNA, 19 nt, Human
gcccucaucccugcccacg

SEQ ID NO: 173362 - RNA, 16 nt, Human
gcccucauccucagcc

SEQ ID NO: 173363 - RNA, 19 nt, Human
gcccucauccucccuugcu

SEQ ID NO: 173364 - RNA, 18 nt, Human
gcccucauccucucuacc

SEQ ID NO: 173365 - RNA, 32 nt, Human
gcccucaucucuccucaccccugccuucuggc

SEQ ID NO: 173366 - RNA, 19 nt, Human
gcccucaucugucagcucc

SEQ ID NO: 173367 - RNA, 32 nt, Human
gcccucauggugcuggugcuguuguguguagg

SEQ ID NO: 173368 - RNA, 21 nt, Human
gcccucauuuugccugcugcc

SEQ ID NO: 173369 - RNA, 32 nt, Human
gcccuccaacuuugcagauauuacaaaaagag

SEQ ID NO: 173370 - RNA, 32 nt, Human
gcccuccaagugguagaagaagauugcaaagu

SEQ ID NO: 173371 - RNA, 32 nt, Human
gcccuccacagccuccccuucugguuucuggc

SEQ ID NO: 173372 - RNA, 32 nt, Human
gcccuccacaggcugcuuagugagggagacac

SEQ ID NO: 173373 - RNA, 32 nt, Human
gcccuccaccugccaacccuugggcucggagc

SEQ ID NO: 173374 - RNA, 19 nt, Human
gcccuccaccugcccacca

SEQ ID NO: 173375 - RNA, 18 nt, Human
gcccuccaccugccucca

SEQ ID NO: 173376 - RNA, 32 nt, Human
gcccuccacgcuaucccucugcagccugggcc

SEQ ID NO: 173377 - RNA, 32 nt, Human
gcccuccagaacuucaggcucucagugacccu

SEQ ID NO: 173378 - RNA, 32 nt, Human
gcccuccagaauguagcugcugaccccgcgcc

SEQ ID NO: 173379 - RNA, 32 nt, Human
gcccuccagccacuuccccaugcuggcuggca

SEQ ID NO: 173380 - RNA, 32 nt, Human
gcccuccagccccuucgaaccacagcaucuca

SEQ ID NO: 173381 - RNA, 19 nt, Human
gcccuccagccucacccca

SEQ ID NO: 173382 - RNA, 24 nt, Human
gcccuccagccugggcaacaagag

SEQ ID NO: 173383 - RNA, 32 nt, Human
gcccuccagccugugcgcucaccccgcccucc

SEQ ID NO: 173384 - RNA, 32 nt, Human
gcccuccagcuacuuccugccugccaugcccc

SEQ ID NO: 173385 - RNA, 32 nt, Human
gcccuccaggugggcaguugauuauuuccacc

SEQ ID NO: 173386 - RNA, 21 nt, Human
gcccuccagucugggcaacaa

SEQ ID NO: 173387 - RNA, 19 nt, Human
gcccuccaugguccugucu

SEQ ID NO: 173388 - RNA, 32 nt, Human
gcccucccaaagugcugggauuacaggcguaa

SEQ ID NO: 173389 - RNA, 32 nt, Human
gcccucccaaaguguugggauuacaggcauaa

SEQ ID NO: 173390 - RNA, 32 nt, Human
gcccucccaaaguguugggauuauaggcauga

SEQ ID NO: 173391 - RNA, 32 nt, Human
gcccucccaagugcagcugcagccacccaagc

SEQ ID NO: 173392 - RNA, 32 nt, Human
gcccucccaauccagucuacccucaaaggagc

SEQ ID NO: 173393 - RNA, 32 nt, Human
gcccucccaccaacugagcugugugauccugg

SEQ ID NO: 173394 - RNA, 32 nt, Human
gcccucccacuuuccccugccugcuccuccau

SEQ ID NO: 173395 - RNA, 32 nt, Human
gcccucccagaguaucccgaaggggcuggagg

SEQ ID NO: 173396 - RNA, 32 nt, Human
gcccucccagagugcugggauuacaggcguca

SEQ ID NO: 173397 - RNA, 32 nt, Human
gcccucccagcaguggcuugcuuucuucuccu

SEQ ID NO: 173398 - RNA, 32 nt, Human
gcccucccagcuggugucacucugccucuaag

SEQ ID NO: 173399 - RNA, 32 nt, Human
gcccucccaucacuggaagucugcaguggggg

SEQ ID NO: 173400 - RNA, 22 nt, Human
gcccuccccaccaugccuccuu

SEQ ID NO: 173401 - RNA, 21 nt, Human
gcccuccccaccugcucacca

SEQ ID NO: 173402 - RNA, 18 nt, Human
gcccuccccagcugccca

SEQ ID NO: 173403 - RNA, 32 nt, Human
gcccuccccaggagccaggucugcccacgccu

SEQ ID NO: 173404 - RNA, 32 nt, Human
gcccuccccaguuaaaguggggaagacagacu

SEQ ID NO: 173405 - RNA, 17 nt, Human
gcccucccccugcugcu

SEQ ID NO: 173406 - RNA, 32 nt, Human
gcccucccccuucacucuccccacaagugggc

SEQ ID NO: 173407 - RNA, 32 nt, Human
gcccuccccucggcgggcacgguauuuuuauc

SEQ ID NO: 173408 - RNA, 32 nt, Human
gcccuccccugccgcauucccucacuggcugu

SEQ ID NO: 173409 - RNA, 32 nt, Human
gcccuccccugggcucgcguucaucggucccc

SEQ ID NO: 173410 - RNA, 32 nt, Human
gcccucccgugggccgcacccuugccacugcc

SEQ ID NO: 173411 - RNA, 32 nt, Human
gcccucccuaguagcugggacuacagcaccca

SEQ ID NO: 173412 - RNA, 32 nt, Human
gcccucccuccaggaccgaggggcucccaagg

SEQ ID NO: 173413 - RNA, 19 nt, Human
gcccucccucccagcccca

SEQ ID NO: 173414 - RNA, 32 nt, Human
gcccucccuccccagguccuuccuacccuccc

SEQ ID NO: 173415 - RNA, 32 nt, Human
gcccucccuccccugcugggucucuccaaccc

SEQ ID NO: 173416 - RNA, 16 nt, Human
gcccucccuccgcucc

SEQ ID NO: 173417 - RNA, 32 nt, Human
gcccucccucgcccgcgccucuccuuaguccu

SEQ ID NO: 173418 - RNA, 23 nt, Human
gcccucccucuaaauaccuaccc

SEQ ID NO: 173419 - RNA, 32 nt, Human
gcccucccucucauucccauccuuccugguac

SEQ ID NO: 173420 - RNA, 32 nt, Human
gcccucccugagggcccugcaugcuugugccu

SEQ ID NO: 173421 - RNA, 32 nt, Human
gcccucccugcaauugggcagcuccccuggaa

SEQ ID NO: 173422 - RNA, 32 nt, Human
gcccucccugcuccccauaacagaccccuccc

SEQ ID NO: 173423 - RNA, 32 nt, Human
gcccucccuggcucccugucccugggcucagc

SEQ ID NO: 173424 - RNA, 32 nt, Human
gcccucccugucucccccacuuccuggccagg

SEQ ID NO: 173425 - RNA, 32 nt, Human
gcccucccuugaccaucuccuagcauuccuua

SEQ ID NO: 173426 - RNA, 22 nt, Human
gcccucccuuggaaaccugccc

SEQ ID NO: 173427 - RNA, 32 nt, Human
gcccucccuugguuccagucucucuucucucu

SEQ ID NO: 173428 - RNA, 32 nt, Human
gcccuccgaccccucacuuugugccuuuagua

SEQ ID NO: 173429 - RNA, 23 nt, Human
gcccuccgagucgagccucugcc

SEQ ID NO: 173430 - RNA, 32 nt, Human
gcccuccgcacccucugcccucugccuggcag

SEQ ID NO: 173431 - RNA, 32 nt, Human
gcccuccgcaggccgggccuccugggcgcccc

SEQ ID NO: 173432 - RNA, 32 nt, Human
gcccuccgcaucuuacccucccuuucucuuuc

SEQ ID NO: 173433 - RNA, 32 nt, Human
gcccuccgcucccuccgggguggcgcgcccgg

SEQ ID NO: 173434 - RNA, 32 nt, Human
gcccuccggcucccccucccccuccucccugc

SEQ ID NO: 173435 - RNA, 32 nt, Human
gcccuccguggccucuugccccuuggacuccu

SEQ ID NO: 173436 - RNA, 32 nt, Human
gcccuccguucccugucagcauuauccccugg

SEQ ID NO: 173437 - RNA, 20 nt, Human
gcccuccuaaaugucagcug

SEQ ID NO: 173438 - RNA, 32 nt, Human
gcccuccuacucuccccucccugcuccuucgc

SEQ ID NO: 173439 - RNA, 18 nt, Human
gcccuccuaucccuucca

SEQ ID NO: 173440 - RNA, 22 nt, Human
gcccuccuaugggcuccaguga

SEQ ID NO: 173441 - RNA, 20 nt, Human
gcccuccucacccucaggga

SEQ ID NO: 173442 - RNA, 32 nt, Human
gcccuccuccacccccucucccaucacccucc

SEQ ID NO: 173443 - RNA, 32 nt, Human
gcccuccuccacucccuuuuuguaacucccuu

SEQ ID NO: 173444 - RNA, 32 nt, Human
gcccuccuccagggcccucugggguuggggug

SEQ ID NO: 173445 - RNA, 32 nt, Human
gcccuccuccauggcccugcuggggugcagga

SEQ ID NO: 173446 - RNA, 32 nt, Human
gcccuccucccugaggaauguugcaggugcug

SEQ ID NO: 173447 - RNA, 31 nt, Human
gcccuccuccucccugggccuucaccgcacc

SEQ ID NO: 173448 - RNA, 22 nt, Human
gcccuccuccucuuccuccucu

SEQ ID NO: 173449 - RNA, 32 nt, Human
gcccuccucucagaccuaaggccgggcuccac

SEQ ID NO: 173450 - RNA, 32 nt, Human
gcccuccucucccacuuccucuuccauacccc

SEQ ID NO: 173451 - RNA, 32 nt, Human
gcccuccucucccauugucccucugccccauc

SEQ ID NO: 173452 - RNA, 32 nt, Human
gcccuccucuguguggagucucucgccggacc

SEQ ID NO: 173453 - RNA, 32 nt, Human
gcccuccucuucacugccuccaccugcucccg

SEQ ID NO: 173454 - RNA, 20 nt, Human
gcccuccugaccccugguag

SEQ ID NO: 173455 - RNA, 32 nt, Human
gcccuccugagccuccgccuucccagcagcgg

SEQ ID NO: 173456 - RNA, 32 nt, Human
gcccuccugauccuccugucauuccucacauc

SEQ ID NO: 173457 - RNA, 32 nt, Human
gcccuccugauucuuggcuggcccagggauga

SEQ ID NO: 173458 - RNA, 24 nt, Human
gcccuccugcaccgccuccuccac

SEQ ID NO: 173459 - RNA, 32 nt, Human
gcccuccugccacccuuccccuuguagauacu

SEQ ID NO: 173460 - RNA, 21 nt, Human
gcccuccugcccagcugcucu

SEQ ID NO: 173461 - RNA, 24 nt, Human
gcccuccugcccgcccucccuccu

SEQ ID NO: 173462 - RNA, 19 nt, Human
gcccuccugccucucccuu

SEQ ID NO: 173463 - RNA, 32 nt, Human
gcccuccuggaaucugcugcaguggcuaccuc

SEQ ID NO: 173464 - RNA, 32 nt, Human
gcccuccuggaaucuugaggcacugugaaauu

SEQ ID NO: 173465 - RNA, 22 nt, Human
gcccuccuggagaaccgggaca

SEQ ID NO: 173466 - RNA, 32 nt, Human
gcccuccuggagcucaggaggccgaggcugcc

SEQ ID NO: 173467 - RNA, 24 nt, Human
gcccuccuggccagcagagugggg

SEQ ID NO: 173468 - RNA, 32 nt, Human
gcccuccuggggacuuggaaucagucggcagu

SEQ ID NO: 173469 - RNA, 32 nt, Human
gcccuccuggguggacguggaggcuucagaaa

SEQ ID NO: 173470 - RNA, 32 nt, Human
gcccuccugguaccagcccucaguguggaggc

SEQ ID NO: 173471 - RNA, 21 nt, Human
gcccuccuggugcagggccga

SEQ ID NO: 173472 - RNA, 32 nt, Human
gcccuccugguucacaaagagcauuaagaaag

SEQ ID NO: 173473 - RNA, 32 nt, Human
gcccuccuguccagcuggaggaggcuucaagg

SEQ ID NO: 173474 - RNA, 32 nt, Human
gcccuccugugucucaggcccguuuuccccca

SEQ ID NO: 173475 - RNA, 31 nt, Human
gcccuccuguuucucccuugccuggaaguca

SEQ ID NO: 173476 - RNA, 27 nt, Human
gcccuccuuagccucccaauccucucu

SEQ ID NO: 173477 - RNA, 32 nt, Human
gcccuccuucuccuggcagcaggcccagcuga

SEQ ID NO: 173478 - RNA, 30 nt, Human
gcccucgacaagaccacacuuugggacuug

SEQ ID NO: 173479 - RNA, 18 nt, Human
gcccucgaggagcggcug

SEQ ID NO: 173480 - RNA, 32 nt, Human
gcccucgauuccuuucccaccaccccacaggc

SEQ ID NO: 173481 - RNA, 32 nt, Human
gcccucgcacagaucccagcugggucacccgc

SEQ ID NO: 173482 - RNA, 32 nt, Human
gcccucgccccgccaugcuccugcugcugggg

SEQ ID NO: 173483 - RNA, 32 nt, Human
gcccucgccgccgccucucguccgguccuggc

SEQ ID NO: 173484 - RNA, 32 nt, Human
gcccucgcugugcaggccaggaugccucuccc

SEQ ID NO: 173485 - RNA, 24 nt, Human
gcccucggaaccagagccuggagu

SEQ ID NO: 173486 - RNA, 32 nt, Human
gcccucggacuucaucucauugcucagcgcgg

SEQ ID NO: 173487 - RNA, 32 nt, Human
gcccucggccauugaacacugcacccuccaca

SEQ ID NO: 173488 - RNA, 19 nt, Human
gcccucggcgccccgcuga

SEQ ID NO: 173489 - RNA, 19 nt, Human
gcccucggcgccgccgccu

SEQ ID NO: 173490 - RNA, 32 nt, Human
gcccucggcugccucuuaacuuuggguugacu

SEQ ID NO: 173491 - RNA, 32 nt, Human
gcccucgggaccccuccccaccuaacugcacu

SEQ ID NO: 173492 - RNA, 32 nt, Human
gcccucgggaguccgcaucucagcccccagga

SEQ ID NO: 173493 - RNA, 32 nt, Human
gcccucggggugcgaggcggcagcagggccgu

SEQ ID NO: 173494 - RNA, 18 nt, Human
gcccucggguggaagcug

SEQ ID NO: 173495 - RNA, 16 nt, Human
gcccucguccccugcc

SEQ ID NO: 173496 - RNA, 32 nt, Human
gcccucguccuggggacguggaggguggcacg

SEQ ID NO: 173497 - RNA, 32 nt, Human
gcccucgucugccucuccaggauuguauguuu

SEQ ID NO: 173498 - RNA, 32 nt, Human
gcccucuaagggguggcggggaagggaggagg

SEQ ID NO: 173499 - RNA, 32 nt, Human
gcccucuacacugcaagcugcauuccagccac

SEQ ID NO: 173500 - RNA, 32 nt, Human
gcccucuacagccugacuuucucuccagcggu

SEQ ID NO: 173501 - RNA, 32 nt, Human
gcccucuacccuugggccaccugcugcccaag

SEQ ID NO: 173502 - RNA, 31 nt, Human
gcccucuauaaagacuuccuguugaggugaa

SEQ ID NO: 173503 - RNA, 32 nt, Human
gcccucucaccugguucccccuugccagccua

SEQ ID NO: 173504 - RNA, 32 nt, Human
gcccucucaggagcagucuuccaucaugcuga

SEQ ID NO: 173505 - RNA, 32 nt, Human
gcccucucauuuccucccuccuuggggcuucu

SEQ ID NO: 173506 - RNA, 32 nt, Human
gcccucuccaaacuggcuggggcugcugggag

SEQ ID NO: 173507 - RNA, 23 nt, Human
gcccucuccaaaucaaggaucuu

SEQ ID NO: 173508 - RNA, 32 nt, Human
gcccucuccacacccaugacugccccuugcuu

SEQ ID NO: 173509 - RNA, 32 nt, Human
gcccucuccaccacugcguucccucggcuaag

SEQ ID NO: 173510 - RNA, 21 nt, Human
gcccucuccacccagaggucu

SEQ ID NO: 173511 - RNA, 21 nt, Human
gcccucuccaccugugggucu

SEQ ID NO: 173512 - RNA, 32 nt, Human
gcccucuccagccucagggccucuucuggaaa

SEQ ID NO: 173513 - RNA, 32 nt, Human
gcccucuccagccuccggcucagccggcucau

SEQ ID NO: 173514 - RNA, 32 nt, Human
gcccucuccagggaagaacccagagggagagc

SEQ ID NO: 173515 - RNA, 32 nt, Human
gcccucuccaucuucaaagccaguaagagcau

SEQ ID NO: 173516 - RNA, 32 nt, Human
gcccucucccacccucuuccuacuggucucuc

SEQ ID NO: 173517 - RNA, 20 nt, Human
gcccucucccagccuugccu

SEQ ID NO: 173518 - RNA, 32 nt, Human
gcccucuccccugccucucucucccauuagaa

SEQ ID NO: 173519 - RNA, 21 nt, Human
gcccucucccugaggagguuu

SEQ ID NO: 173520 - RNA, 32 nt, Human
gcccucuccuacuuugaucaccauuucucucc

SEQ ID NO: 173521 - RNA, 32 nt, Human
gcccucuccuccaaccuccccuuucauagaag

SEQ ID NO: 173522 - RNA, 32 nt, Human
gcccucuccugccucaugcuuguugcuguccu

SEQ ID NO: 173523 - RNA, 32 nt, Human
gcccucuccuuccccgaacacagcacacgguc

SEQ ID NO: 173524 - RNA, 32 nt, Human
gcccucucgccaggcuggaguguaguggcaca

SEQ ID NO: 173525 - RNA, 23 nt, Human
gcccucucgcgcugcacugucuc

SEQ ID NO: 173526 - RNA, 32 nt, Human
gcccucucgcuccugcucacacagucacccuc

SEQ ID NO: 173527 - RNA, 32 nt, Human
gcccucucuaacucuccuuuacacugcaauga

SEQ ID NO: 173528 - RNA, 32 nt, Human
gcccucucuccucccugccuccugacccucag

SEQ ID NO: 173529 - RNA, 32 nt, Human
gcccucucuccuccugaacucucucaucugca

SEQ ID NO: 173530 - RNA, 32 nt, Human
gcccucucugcucgcccugccuagcuugagga

SEQ ID NO: 173531 - RNA, 15 nt, Human
gcccucucugcugcc

SEQ ID NO: 173532 - RNA, 32 nt, Human
gcccucucuguggcgccggcugcuucuggagc

SEQ ID NO: 173533 - RNA, 18 nt, Human
gcccucucuguuugaacc

SEQ ID NO: 173534 - RNA, 32 nt, Human
gcccucucuugacuccagccuagggaaugguu

SEQ ID NO: 173535 - RNA, 32 nt, Human
gcccucugacuuccuuucuuccccaucaacug

SEQ ID NO: 173536 - RNA, 32 nt, Human
gcccucugacuucuugcccuuuggaaauggug

SEQ ID NO: 173537 - RNA, 32 nt, Human
gcccucugagauacugauuauuuuagguucuu

SEQ ID NO: 173538 - RNA, 32 nt, Human
gcccucugagccuuuugagucugggcccuggu

SEQ ID NO: 173539 - RNA, 32 nt, Human
gcccucugauagaagugggagaacaaggguuu

SEQ ID NO: 173540 - RNA, 32 nt, Human
gcccucugcagaccccucccagccgcagcacc

SEQ ID NO: 173541 - RNA, 16 nt, Human
gcccucugcccaggug

SEQ ID NO: 173542 - RNA, 22 nt, Human
gcccucugccccccucagaggg

SEQ ID NO: 173543 - RNA, 21 nt, Human
gcccucugcccccucagcccc

SEQ ID NO: 173544 - RNA, 22 nt, Human
gcccucugccccugugucccca

SEQ ID NO: 173545 - RNA, 22 nt, Human
gcccucugcuaaagcccgggca

SEQ ID NO: 173546 - RNA, 21 nt, Human
gcccucugcugcccugccaga

SEQ ID NO: 173547 - RNA, 32 nt, Human
gcccucugcugucugcugagaugccaggcuag

SEQ ID NO: 173548 - RNA, 32 nt, Human
gcccucuggaaagaaaaggacagacccugugc

SEQ ID NO: 173549 - RNA, 32 nt, Human
gcccucuggacuccuuucuccuuuucuuuccu

SEQ ID NO: 173550 - RNA, 32 nt, Human
gcccucuggccuuuugcagcugauccagagga

SEQ ID NO: 173551 - RNA, 32 nt, Human
gcccucuggcgccaugucgcagaacggagcgc

SEQ ID NO: 173552 - RNA, 32 nt, Human
gcccucugggcccuggcuguaccgaggccgca

SEQ ID NO: 173553 - RNA, 32 nt, Human
gcccucugggcuuggguaggggccuuggacua

SEQ ID NO: 173554 - RNA, 32 nt, Human
gcccucuggggaccccagaguccuguucugcu

SEQ ID NO: 173555 - RNA, 32 nt, Human
gcccucuggucugccgugcaucucccugugcc

SEQ ID NO: 173556 - RNA, 17 nt, Human
gcccucuguccuccagg

SEQ ID NO: 173557 - RNA, 32 nt, Human
gcccucugugccaccagggagugccuauacau

SEQ ID NO: 173558 - RNA, 32 nt, Human
gcccucugugggcuucuggguaugggugagug

SEQ ID NO: 173559 - RNA, 31 nt, Human
gcccucuguguuuguccuugccacagucacg

SEQ ID NO: 173560 - RNA, 20 nt, Human
gcccucuuccuccuuccucu

SEQ ID NO: 173561 - RNA, 22 nt, Human
gcccucuucugcccugcgugcc

SEQ ID NO: 173562 - RNA, 32 nt, Human
gcccucuugauguggugaggcaggcuuuguuu

SEQ ID NO: 173563 - RNA, 32 nt, Human
gcccucuugcacccucugugcccugugggacc

SEQ ID NO: 173564 - RNA, 32 nt, Human
gcccucuugccugagcaaucugacgcagaggc

SEQ ID NO: 173565 - RNA, 32 nt, Human
gcccucuugccugggcucuguggaagugaggu

SEQ ID NO: 173566 - RNA, 32 nt, Human
gcccucuugucucugcugacuucagccugguc

SEQ ID NO: 173567 - RNA, 32 nt, Human
gcccucuuuccaccaccccuugcucagcaugu

SEQ ID NO: 173568 - RNA, 23 nt, Human
gcccucuuuccccacugggcguc

SEQ ID NO: 173569 - RNA, 21 nt, Human
gcccucuuucucugugggucu

SEQ ID NO: 173570 - RNA, 18 nt, Human
gcccucuuugguccuccu

SEQ ID NO: 173571 - RNA, 32 nt, Human
gcccugaaagucgagguugcagugagccuuga

SEQ ID NO: 173572 - RNA, 32 nt, Human
gcccugaaauaacauuagugcuuacucauugc

SEQ ID NO: 173573 - RNA, 32 nt, Human
gcccugaaaugaggggacccugacuggagagg

SEQ ID NO: 173574 - RNA, 32 nt, Human
gcccugaaauuacuggguucucagggagaugc

SEQ ID NO: 173575 - RNA, 32 nt, Human
gcccugaaccagcucugacccaggaagaagac

SEQ ID NO: 173576 - RNA, 32 nt, Human
gcccugaacuccuggccucaagcaauccuccc

SEQ ID NO: 173577 - RNA, 32 nt, Human
gcccugaacucuugagacaacucucuccagca

SEQ ID NO: 173578 - RNA, 32 nt, Human
gcccugaagaccaacaccagcccgugggcugc

SEQ ID NO: 173579 - RNA, 32 nt, Human
gcccugaagacgguuccagccuuguccuuccu

SEQ ID NO: 173580 - RNA, 32 nt, Human
gcccugaagcagcuguaguggaggagaggccu

SEQ ID NO: 173581 - RNA, 32 nt, Human
gcccugaaggaagaccugggcccagugcccuc

SEQ ID NO: 173582 - RNA, 32 nt, Human
gcccugaaggcagaguccagggaccuugaccc

SEQ ID NO: 173583 - RNA, 32 nt, Human
gcccugaagggcccggaccucggcgagcccac

SEQ ID NO: 173584 - RNA, 22 nt, Human
gcccugaagggggcuggauggg

SEQ ID NO: 173585 - RNA, 21 nt, Human
gcccugaagugccggccgcgg

SEQ ID NO: 173586 - RNA, 32 nt, Human
gcccugacaaagcaguuggauuuggcaugugu

SEQ ID NO: 173587 - RNA, 32 nt, Human
gcccugacacugauugcugugaguuccugcau

SEQ ID NO: 173588 - RNA, 27 nt, Human
gcccugaccaccagagugcccaaaaca

SEQ ID NO: 173589 - RNA, 16 nt, Human
gcccugaccaccagcu

SEQ ID NO: 173590 - RNA, 32 nt, Human
gcccugaccacuucugugccaguugucuaagc

SEQ ID NO: 173591 - RNA, 32 nt, Human
gcccugaccauaauaaagaagacuucaucauu

SEQ ID NO: 173592 - RNA, 20 nt, Human
gcccugacccaauaaaggcu

SEQ ID NO: 173593 - RNA, 32 nt, Human
gcccugaccccugccauucugccuuguuguga

SEQ ID NO: 173594 - RNA, 17 nt, Human
gcccugacgcccaccuc

SEQ ID NO: 173595 - RNA, 23 nt, Human
gcccugacuggaguucaguggug

SEQ ID NO: 173596 - RNA, 24 nt, Human
gcccugacuuagaagaagugggug

SEQ ID NO: 173597 - RNA, 32 nt, Human
gcccugagaaaagccauuguggagccaacucc

SEQ ID NO: 173598 - RNA, 32 nt, Human
gcccugagaaagaacuuaaagagcuaggagga

SEQ ID NO: 173599 - RNA, 32 nt, Human
gcccugagaacugcaccucauuuucuuuaucc

SEQ ID NO: 173600 - RNA, 32 nt, Human
gcccugagacuguggaugagggggcuaggcuc

SEQ ID NO: 173601 - RNA, 32 nt, Human
gcccugagacuucuuucucuccuugccuccac

SEQ ID NO: 173602 - RNA, 32 nt, Human
gcccugagagaggagcgugccacccaccaggg

SEQ ID NO: 173603 - RNA, 32 nt, Human
gcccugagagugaggucaagaucaagaggcgg

SEQ ID NO: 173604 - RNA, 32 nt, Human
gcccugagauguuacaguugaagagcuugguu

SEQ ID NO: 173605 - RNA, 19 nt, Human
gcccugagcagagcagcca

SEQ ID NO: 173606 - RNA, 32 nt, Human
gcccugagccucgagcugcucucugucacugu

SEQ ID NO: 173607 - RNA, 32 nt, Human
gcccugagccuuggugugcuguauccauccau

SEQ ID NO: 173608 - RNA, 32 nt, Human
gcccugagcuugguagaggaguccccugccuc

SEQ ID NO: 173609 - RNA, 32 nt, Human
gcccugaggaagaagaaaauccucagcaaagu

SEQ ID NO: 173610 - RNA, 32 nt, Human
gcccugaggagaaggcugaagacugaggaauc

SEQ ID NO: 173611 - RNA, 32 nt, Human
gcccugaggcagccucugccuaccuagaucug

SEQ ID NO: 173612 - RNA, 32 nt, Human
gcccugaggccccuccugccuggcccugcucc

SEQ ID NO: 173613 - RNA, 22 nt, Human
gcccugaggcugggcacagugg

SEQ ID NO: 173614 - RNA, 32 nt, Human
gcccugaggcuguaggcauggcccagaccugc

SEQ ID NO: 173615 - RNA, 32 nt, Human
gcccugaggggugugcccugaagaggagggug

SEQ ID NO: 173616 - RNA, 32 nt, Human
gcccugagggugggaaagcaagggaugacuga

SEQ ID NO: 173617 - RNA, 32 nt, Human
gcccugaggucagcucccaggucggucgugcu

SEQ ID NO: 173618 - RNA, 32 nt, Human
gcccugagucacccugagauagagauucccag

SEQ ID NO: 173619 - RNA, 32 nt, Human
gcccugagucuaagcaaaagcccauggguugg

SEQ ID NO: 173620 - RNA, 24 nt, Human
gcccugagucugcuggggaguggg

SEQ ID NO: 173621 - RNA, 32 nt, Human
gcccugaguguccagaucuggccaaggugucu

SEQ ID NO: 173622 - RNA, 32 nt, Human
gcccugaguguggcuaggaagggggugcuggg

SEQ ID NO: 173623 - RNA, 20 nt, Human
gcccugauaccauucuguaa

SEQ ID NO: 173624 - RNA, 23 nt, Human
gcccugaucacaaacaccugccu

SEQ ID NO: 173625 - RNA, 32 nt, Human
gcccugauccaaauguuagcacuugcuaguga

SEQ ID NO: 173626 - RNA, 20 nt, Human
gcccugaucuagugcaguaa

SEQ ID NO: 173627 - RNA, 32 nt, Human
gcccugaucugacuuccagccuccagaacuau

SEQ ID NO: 173628 - RNA, 21 nt, Human
gcccugaugacccacccgccc

SEQ ID NO: 173629 - RNA, 31 nt, Human
gcccugaugauuugggguucaacugaaaagg

SEQ ID NO: 173630 - RNA, 20 nt, Human
gcccugaugcagacauccag

SEQ ID NO: 173631 - RNA, 17 nt, Human
gcccugaugcugcugcc

SEQ ID NO: 173632 - RNA, 20 nt, Human
gcccugcaaagcaaaggcuc

SEQ ID NO: 173633 - RNA, 21 nt, Human
gcccugcaaagcaaaguccca

SEQ ID NO: 173634 - RNA, 18 nt, Human
gcccugcaaccccagcgg

SEQ ID NO: 173635 - RNA, 32 nt, Human
gcccugcaagcagaauaagcugacccucccca

SEQ ID NO: 173636 - RNA, 32 nt, Human
gcccugcaaguuggcugucuaugagcauuuag

SEQ ID NO: 173637 - RNA, 32 nt, Human
gcccugcaaucggugggccacagugccggcca

SEQ ID NO: 173638 - RNA, 32 nt, Human
gcccugcacaaaccacaacagaaguugcacac

SEQ ID NO: 173639 - RNA, 32 nt, Human
gcccugcacaaccccauuaagccugggcaauc

SEQ ID NO: 173640 - RNA, 32 nt, Human
gcccugcacccacucagagccucagcccuuca

SEQ ID NO: 173641 - RNA, 19 nt, Human
gcccugcaccccagagcuc

SEQ ID NO: 173642 - RNA, 32 nt, Human
gcccugcaccgacuccagcccagccccugcuc

SEQ ID NO: 173643 - RNA, 32 nt, Human
gcccugcaccucagggcuuuggauccaggucu

SEQ ID NO: 173644 - RNA, 32 nt, Human
gcccugcaccugcagccagcuggccucgggcu

SEQ ID NO: 173645 - RNA, 19 nt, Human
gcccugcaccugccuagcu

SEQ ID NO: 173646 - RNA, 19 nt, Human
gcccugcacuccaaggcuc

SEQ ID NO: 173647 - RNA, 32 nt, Human
gcccugcacucugcccucuuugcccaggauac

SEQ ID NO: 173648 - RNA, 32 nt, Human
gcccugcagagggagauggcagagaggaaggc

SEQ ID NO: 173649 - RNA, 32 nt, Human
gcccugcagaucugcugcuuuuccugauucuc

SEQ ID NO: 173650 - RNA, 32 nt, Human
gcccugcagcaaggaggaagaggacucaaaag

SEQ ID NO: 173651 - RNA, 32 nt, Human
gcccugcagccccaccauccacacuacaugau

SEQ ID NO: 173652 - RNA, 32 nt, Human
gcccugcagcuauuucuaggcauuucagaggg

SEQ ID NO: 173653 - RNA, 32 nt, Human
gcccugcagcuggcgggagaggugucuggugg

SEQ ID NO: 173654 - RNA, 31 nt, Human
gcccugcagcuucagcaccugccccacccag

SEQ ID NO: 173655 - RNA, 32 nt, Human
gcccugcagcuucagcaccugccccacccaga

SEQ ID NO: 173656 - RNA, 32 nt, Human
gcccugcagcuuuaacagagugaaccaugugu

SEQ ID NO: 173657 - RNA, 23 nt, Human
gcccugcaggccaagacccggag

SEQ ID NO: 173658 - RNA, 32 nt, Human
gcccugcagggacggugcaggcugguuggguu

SEQ ID NO: 173659 - RNA, 32 nt, Human
gcccugcagggugagccggcacaacagccccu

SEQ ID NO: 173660 - RNA, 32 nt, Human
gcccugcaggucccacacucucccaggcccua

SEQ ID NO: 173661 - RNA, 32 nt, Human
gcccugcagugucugcucacugcugccaucuu

SEQ ID NO: 173662 - RNA, 32 nt, Human
gcccugcaguuucagacuggagggcgguggac

SEQ ID NO: 173663 - RNA, 32 nt, Human
gcccugcauggauuuuccuccuuccuaugcua

SEQ ID NO: 173664 - RNA, 32 nt, Human
gcccugccaauaccuugauugcaaccugguga

SEQ ID NO: 173665 - RNA, 18 nt, Human
gcccugccacagccccca

SEQ ID NO: 173666 - RNA, 18 nt, Human
gcccugccacagcccucc

SEQ ID NO: 173667 - RNA, 21 nt, Human
gcccugccacccucugcuguc

SEQ ID NO: 173668 - RNA, 32 nt, Human
gcccugccaccuggcaggaggcccacucacug

SEQ ID NO: 173669 - RNA, 32 nt, Human
gcccugccaccugggcccaccuccucucacug

SEQ ID NO: 173670 - RNA, 32 nt, Human
gcccugccaccugggucccagccugcuccucg

SEQ ID NO: 173671 - RNA, 32 nt, Human
gcccugccacugacccuccugucccucucaua

SEQ ID NO: 173672 - RNA, 22 nt, Human
gcccugccacugccccggcgug

SEQ ID NO: 173673 - RNA, 32 nt, Human
gcccugccagcugcagccugguuggcagcauc

SEQ ID NO: 173674 - RNA, 32 nt, Human
gcccugccaggggugcuguuucaggcugggca

SEQ ID NO: 173675 - RNA, 32 nt, Human
gcccugccaucccgucugccugccaugggacg

SEQ ID NO: 173676 - RNA, 32 nt, Human
gcccugccaucuuugucacagccucuguccag

SEQ ID NO: 173677 - RNA, 32 nt, Human
gcccugccaugguggucuguuucccccagacu

SEQ ID NO: 173678 - RNA, 24 nt, Human
gcccugccauguccccacucaccc

SEQ ID NO: 173679 - RNA, 17 nt, Human
gcccugcccaccccucc

SEQ ID NO: 173680 - RNA, 32 nt, Human
gcccugcccagccccggaacucugcgcgauau

SEQ ID NO: 173681 - RNA, 23 nt, Human
gcccugcccagcucaggccccuu

SEQ ID NO: 173682 - RNA, 18 nt, Human
gcccugcccaucgcauca

SEQ ID NO: 173683 - RNA, 32 nt, Human
gcccugcccauggcugugcagcucccuccgug

SEQ ID NO: 173684 - RNA, 32 nt, Human
gcccugccccacacccaccuccuguguuucug

SEQ ID NO: 173685 - RNA, 23 nt, Human
gcccugccccacccaacuccaca

SEQ ID NO: 173686 - RNA, 24 nt, Human
gcccugccccacuugucccuggga

SEQ ID NO: 173687 - RNA, 15 nt, Human
gcccugccccaggga

SEQ ID NO: 173688 - RNA, 32 nt, Human
gcccugccccaggucggccaucuaucaaaagc

SEQ ID NO: 173689 - RNA, 15 nt, Human
gcccugccccgggau

SEQ ID NO: 173690 - RNA, 18 nt, Human
gcccugccccucucccca

SEQ ID NO: 173691 - RNA, 32 nt, Human
gcccugccccuuggcccugccccuguccccgg

SEQ ID NO: 173692 - RNA, 32 nt, Human
gcccugcccuacccucuccucugaccuccacu

SEQ ID NO: 173693 - RNA, 21 nt, Human
gcccugcccuccagccacagc

SEQ ID NO: 173694 - RNA, 32 nt, Human
gcccugcccucccaggaguccagccaggggcu

SEQ ID NO: 173695 - RNA, 32 nt, Human
gcccugcccugagcugaguccuuucccuggga

SEQ ID NO: 173696 - RNA, 32 nt, Human
gcccugcccugccuagccucugcuacucccac

SEQ ID NO: 173697 - RNA, 32 nt, Human
gcccugcccugcuggcuuccugacuggagaga

SEQ ID NO: 173698 - RNA, 32 nt, Human
gcccugcccuggaagacuggagggaggcccca

SEQ ID NO: 173699 - RNA, 32 nt, Human
gcccugcccuucuccguuccagccuggacaga

SEQ ID NO: 173700 - RNA, 32 nt, Human
gcccugcccuuggauuugagaucauguccauc

SEQ ID NO: 173701 - RNA, 32 nt, Human
gcccugccgcccaggcuagagugcaguggcac

SEQ ID NO: 173702 - RNA, 20 nt, Human
gcccugccgccgccccgcag

SEQ ID NO: 173703 - RNA, 19 nt, Human
gcccugccgccgccgccgc

SEQ ID NO: 173704 - RNA, 32 nt, Human
gcccugccgggcuauuuuuacgcgcggacacc

SEQ ID NO: 173705 - RNA, 32 nt, Human
gcccugccuagagaagggccucucccccaacc

SEQ ID NO: 173706 - RNA, 32 nt, Human
gcccugccucagccaggcccugagauggggga

SEQ ID NO: 173707 - RNA, 32 nt, Human
gcccugccucagcugcugccugccagaggcgu

SEQ ID NO: 173708 - RNA, 32 nt, Human
gcccugccuccaccccuccagcccauccagca

SEQ ID NO: 173709 - RNA, 32 nt, Human
gcccugccuccagcccucaccucucucacccc

SEQ ID NO: 173710 - RNA, 32 nt, Human
gcccugccuccagggcuccugggcugccaggg

SEQ ID NO: 173711 - RNA, 32 nt, Human
gcccugccucccaagaggcugcuguggauggc

SEQ ID NO: 173712 - RNA, 32 nt, Human
gcccugccuccccuuucaccauguuuccucug

SEQ ID NO: 173713 - RNA, 32 nt, Human
gcccugccuccuuaggccaggacgccugagcu

SEQ ID NO: 173714 - RNA, 32 nt, Human
gcccugccucuaggaagccucagcucuggaca

SEQ ID NO: 173715 - RNA, 32 nt, Human
gcccugccucuucucccucuauugggacuggu

SEQ ID NO: 173716 - RNA, 32 nt, Human
gcccugccugccacccuaggcagggaaagcug

SEQ ID NO: 173717 - RNA, 21 nt, Human
gcccugccugccaggucccuu

SEQ ID NO: 173718 - RNA, 32 nt, Human
gcccugccugccugcugccccucccagccugc

SEQ ID NO: 173719 - RNA, 32 nt, Human
gcccugccugcucugagggccacagccugugc

SEQ ID NO: 173720 - RNA, 32 nt, Human
gcccugccuggccucauccuuguauuuaauua

SEQ ID NO: 173721 - RNA, 32 nt, Human
gcccugccugucucacaggccugcugugaagg

SEQ ID NO: 173722 - RNA, 32 nt, Human
gcccugccuguucccuguccauccaggccagc

SEQ ID NO: 173723 - RNA, 32 nt, Human
gcccugcgccaccauuccgauggcucugucag

SEQ ID NO: 173724 - RNA, 18 nt, Human
gcccugcgcgcucaggga

SEQ ID NO: 173725 - RNA, 32 nt, Human
gcccugcgcuccuccacagccugggccgggcc

SEQ ID NO: 173726 - RNA, 32 nt, Human
gcccugcggaaccagagccucaggcugggaug

SEQ ID NO: 173727 - RNA, 32 nt, Human
gcccugcggccaggccuggugccaugagccgg

SEQ ID NO: 173728 - RNA, 32 nt, Human
gcccugcgggaggaccauucacugugagaaaa

SEQ ID NO: 173729 - RNA, 32 nt, Human
gcccugcguccucagggaaggcagaagggcag

SEQ ID NO: 173730 - RNA, 32 nt, Human
gcccugcgugccugcugcuggccgggcacccc

SEQ ID NO: 173731 - RNA, 32 nt, Human
gcccugcguuuaaaggaauugucuuuucuugc

SEQ ID NO: 173732 - RNA, 32 nt, Human
gcccugcuaccacauucacuguuugaaucuuu

SEQ ID NO: 173733 - RNA, 32 nt, Human
gcccugcuauuccucugcgugccuguaguguc

SEQ ID NO: 173734 - RNA, 32 nt, Human
gcccugcucaccuuucuuaccucucuggcccc

SEQ ID NO: 173735 - RNA, 32 nt, Human
gcccugcucacucucauugucuggccucagga

SEQ ID NO: 173736 - RNA, 32 nt, Human
gcccugcucaggggaggguggugcucguggcu

SEQ ID NO: 173737 - RNA, 32 nt, Human
gcccugcucaggggaugggaggcugcagggga

SEQ ID NO: 173738 - RNA, 32 nt, Human
gcccugcucauucccacucaccagcugagguc

SEQ ID NO: 173739 - RNA, 32 nt, Human
gcccugcucauuccucacgcccuucaaugcug

SEQ ID NO: 173740 - RNA, 32 nt, Human
gcccugcucauuucuuuacugccuuccugccu

SEQ ID NO: 173741 - RNA, 32 nt, Human
gcccugcuccacccccucuccccauuccuccg

SEQ ID NO: 173742 - RNA, 32 nt, Human
gcccugcuccaccccgccaugcccccuacuug

SEQ ID NO: 173743 - RNA, 32 nt, Human
gcccugcucccacucccuagaggcaggaaugg

SEQ ID NO: 173744 - RNA, 32 nt, Human
gcccugcucccaucuggcaccuucaagucagc

SEQ ID NO: 173745 - RNA, 32 nt, Human
gcccugcuccccacagggccaggcuggcaggg

SEQ ID NO: 173746 - RNA, 32 nt, Human
gcccugcucccccaaugaaaggccagcuucga

SEQ ID NO: 173747 - RNA, 22 nt, Human
gcccugcuccucucuguccucu

SEQ ID NO: 173748 - RNA, 32 nt, Human
gcccugcuccugggagcuggaagagcacuugg

SEQ ID NO: 173749 - RNA, 32 nt, Human
gcccugcuccuguuccgcgcagccucuccggc

SEQ ID NO: 173750 - RNA, 17 nt, Human
gcccugcucugcccagg

SEQ ID NO: 173751 - RNA, 19 nt, Human
gcccugcucugccuaagug

SEQ ID NO: 173752 - RNA, 32 nt, Human
gcccugcucuggggaugcacggcggcagggug

SEQ ID NO: 173753 - RNA, 32 nt, Human
gcccugcucuguccagggaggagcugccucag

SEQ ID NO: 173754 - RNA, 32 nt, Human
gcccugcucugugacagagccuggagacuugg

SEQ ID NO: 173755 - RNA, 32 nt, Human
gcccugcucuuccucaagcuccagaaccucuc

SEQ ID NO: 173756 - RNA, 32 nt, Human
gcccugcugagaguccucccuccugggcuccc

SEQ ID NO: 173757 - RNA, 18 nt, Human
gcccugcugcacagggug

SEQ ID NO: 173758 - RNA, 32 nt, Human
gcccugcugcacuccagccugggcaacagagg

SEQ ID NO: 173759 - RNA, 32 nt, Human
gcccugcugcacuccagccugggugacagagg

SEQ ID NO: 173760 - RNA, 20 nt, Human
gcccugcugcagcgcaacgg

SEQ ID NO: 173761 - RNA, 32 nt, Human
gcccugcugcagcuugaggcggcucggugccu

SEQ ID NO: 173762 - RNA, 32 nt, Human
gcccugcugcccaaucuccaucugucaacagg

SEQ ID NO: 173763 - RNA, 32 nt, Human
gcccugcugcccucccccuccucuccaccauc

SEQ ID NO: 173764 - RNA, 23 nt, Human
gcccugcugccgaccaggagcug

SEQ ID NO: 173765 - RNA, 32 nt, Human
gcccugcugccugucuggggauguguggccug

SEQ ID NO: 173766 - RNA, 32 nt, Human
gcccugcugcgagucacuccauuuaucuuaaa

SEQ ID NO: 173767 - RNA, 18 nt, Human
gcccugcugcucagagug

SEQ ID NO: 173768 - RNA, 16 nt, Human
gcccugcugcuccagg

SEQ ID NO: 173769 - RNA, 28 nt, Human
gcccugcugcucccauccccaccccaga

SEQ ID NO: 173770 - RNA, 24 nt, Human
gcccugcuggauccaccuccuaga

SEQ ID NO: 173771 - RNA, 21 nt, Human
gcccugcuggcagccccgaga

SEQ ID NO: 173772 - RNA, 32 nt, Human
gcccugcuguaaccucugucuuggcagggcug

SEQ ID NO: 173773 - RNA, 32 nt, Human
gcccugcuguaccccagccuucccaggacgug

SEQ ID NO: 173774 - RNA, 32 nt, Human
gcccugcugucaaccucuccuccaggcccugc

SEQ ID NO: 173775 - RNA, 32 nt, Human
gcccugcuguccugagcgucuccugggccaga

SEQ ID NO: 173776 - RNA, 32 nt, Human
gcccugcuuccuccuccacuccuggccgccuu

SEQ ID NO: 173777 - RNA, 32 nt, Human
gcccugcuucucugcuccccugggugaugggu

SEQ ID NO: 173778 - RNA, 32 nt, Human
gcccugcuugaaugucaugaacaggugugcug

SEQ ID NO: 173779 - RNA, 20 nt, Human
gcccugcuuugccccgggcu

SEQ ID NO: 173780 - RNA, 32 nt, Human
gcccugcuuuucucccuccccuuccuuccugc

SEQ ID NO: 173781 - RNA, 23 nt, Human
gcccuggaaaacggagcauggug

SEQ ID NO: 173782 - RNA, 32 nt, Human
gcccuggaagacuggagggaggccccaagcca

SEQ ID NO: 173783 - RNA, 19 nt, Human
gcccuggaaggaggggugg

SEQ ID NO: 173784 - RNA, 32 nt, Human
gcccuggaagugaaucagugaaucacacacca

SEQ ID NO: 173785 - RNA, 32 nt, Human
gcccuggaauggggcuccauggagaggugcau

SEQ ID NO: 173786 - RNA, 32 nt, Human
gcccuggacagaagccacauccugacuuccaa

SEQ ID NO: 173787 - RNA, 32 nt, Human
gcccuggaccgagggaaccuuaagucagaauu

SEQ ID NO: 173788 - RNA, 32 nt, Human
gcccuggaccuuucugagccaggcuggccaca

SEQ ID NO: 173789 - RNA, 32 nt, Human
gcccuggacuauucacccccuagucucaauuu

SEQ ID NO: 173790 - RNA, 32 nt, Human
gcccuggacuggccucacaggacaggaggcag

SEQ ID NO: 173791 - RNA, 24 nt, Human
gcccuggagaaggacagagcggug

SEQ ID NO: 173792 - RNA, 23 nt, Human
gcccuggagacagccguugggug

SEQ ID NO: 173793 - RNA, 18 nt, Human
gcccuggagacuuguggg

SEQ ID NO: 173794 - RNA, 23 nt, Human
gcccuggagagaaacaucaguca

SEQ ID NO: 173795 - RNA, 32 nt, Human
gcccuggagagggaaagcacuggucaacauca

SEQ ID NO: 173796 - RNA, 32 nt, Human
gcccuggagagucgcugggaugcacggugggc

SEQ ID NO: 173797 - RNA, 21 nt, Human
gcccuggagauggagugggcg

SEQ ID NO: 173798 - RNA, 19 nt, Human
gcccuggagcagggagugg

SEQ ID NO: 173799 - RNA, 20 nt, Human
gcccuggagccagcacaaga

SEQ ID NO: 173800 - RNA, 23 nt, Human
gcccuggagccgagcuucagcca

SEQ ID NO: 173801 - RNA, 21 nt, Human
gcccuggagcuggaggagugg

SEQ ID NO: 173802 - RNA, 20 nt, Human
gcccuggaggagaggaaggg

SEQ ID NO: 173803 - RNA, 19 nt, Human
gcccuggaggaggcagugg

SEQ ID NO: 173804 - RNA, 21 nt, Human
gcccuggaggaugagaaggug

SEQ ID NO: 173805 - RNA, 32 nt, Human
gcccuggaggcacggaaggcugugggguucca

SEQ ID NO: 173806 - RNA, 32 nt, Human
gcccuggaggcccagccacagagcaguagcca

SEQ ID NO: 173807 - RNA, 20 nt, Human
gcccuggaggcugagcuggg

SEQ ID NO: 173808 - RNA, 21 nt, Human
gcccuggaggcuuuugcuggg

SEQ ID NO: 173809 - RNA, 32 nt, Human
gcccuggagggaggggcagagcgguguggacu

SEQ ID NO: 173810 - RNA, 32 nt, Human
gcccuggagggcuccguaggucucagcaacag

SEQ ID NO: 173811 - RNA, 32 nt, Human
gcccuggagggcugcuaggugguucugagcag

SEQ ID NO: 173812 - RNA, 31 nt, Human
gcccuggaggggacuuccacaccuccugccu

SEQ ID NO: 173813 - RNA, 32 nt, Human
gcccuggaggggccugacaguggguuccuucc

SEQ ID NO: 173814 - RNA, 32 nt, Human
gcccuggaggucaaggcugcagugagccauga

SEQ ID NO: 173815 - RNA, 32 nt, Human
gcccuggaggucaaggcugcagugagucaaga

SEQ ID NO: 173816 - RNA, 32 nt, Human
gcccuggaggucgaggcuacagugagcuauga

SEQ ID NO: 173817 - RNA, 22 nt, Human
gcccuggagguuccagaguagg

SEQ ID NO: 173818 - RNA, 32 nt, Human
gcccuggagguugaggcugcagugagcuggga

SEQ ID NO: 173819 - RNA, 32 nt, Human
gcccuggaguaguggcccggggagaccugggc

SEQ ID NO: 173820 - RNA, 32 nt, Human
gcccuggagugaggaggaccgggagcuggcuc

SEQ ID NO: 173821 - RNA, 32 nt, Human
gcccuggagugggguuucuccuuguugaagaa

SEQ ID NO: 173822 - RNA, 32 nt, Human
gcccuggaguucaaggcugcagugagcuguga

SEQ ID NO: 173823 - RNA, 32 nt, Human
gcccuggaguucgauacugcagugagcuagga

SEQ ID NO: 173824 - RNA, 32 nt, Human
gcccuggaguuggagguugcagugagcagaga

SEQ ID NO: 173825 - RNA, 32 nt, Human
gcccuggaguuugaguccagccugggugacau

SEQ ID NO: 173826 - RNA, 32 nt, Human
gcccuggaguuugugagcuuggcucuaguccc

SEQ ID NO: 173827 - RNA, 20 nt, Human
gcccuggauacugccucaga

SEQ ID NO: 173828 - RNA, 32 nt, Human
gcccuggauccagucggcugcaccaggcgagc

SEQ ID NO: 173829 - RNA, 32 nt, Human
gcccuggaugaggaauccuacuccuaugaccc

SEQ ID NO: 173830 - RNA, 32 nt, Human
gcccuggaugaugacugucagggagguuaaac

SEQ ID NO: 173831 - RNA, 22 nt, Human
gcccuggaugccacccagugca

SEQ ID NO: 173832 - RNA, 24 nt, Human
gcccuggaugccugcaaccucaga

SEQ ID NO: 173833 - RNA, 32 nt, Human
gcccuggauggaggaggaaagaguuggaagcc

SEQ ID NO: 173834 - RNA, 28 nt, Human
gcccuggauggccccugagccagcccca

SEQ ID NO: 173835 - RNA, 21 nt, Human
gcccuggaugguagggcagca

SEQ ID NO: 173836 - RNA, 22 nt, Human
gcccuggauuggguagugggug

SEQ ID NO: 173837 - RNA, 20 nt, Human
gcccuggauuuccugcugcc

SEQ ID NO: 173838 - RNA, 22 nt, Human
gcccuggcacccucuguuccca

SEQ ID NO: 173839 - RNA, 23 nt, Human
gcccuggcaccuccaaccccaga

SEQ ID NO: 173840 - RNA, 23 nt, Human
gcccuggcaccucuaaccccaga

SEQ ID NO: 173841 - RNA, 18 nt, Human
gcccuggcagaagcucuu

SEQ ID NO: 173842 - RNA, 21 nt, Human
gcccuggcagccagcagggga

SEQ ID NO: 173843 - RNA, 24 nt, Human
gcccuggcagcccauggcaacuca

SEQ ID NO: 173844 - RNA, 32 nt, Human
gcccuggcaggcaggggcccugcagcucucau

SEQ ID NO: 173845 - RNA, 32 nt, Human
gcccuggccaaggaggaggcugaaagagccug

SEQ ID NO: 173846 - RNA, 22 nt, Human
gcccuggccacacggacucaga

SEQ ID NO: 173847 - RNA, 32 nt, Human
gcccuggccagacauguccacaggguucuccu

SEQ ID NO: 173848 - RNA, 19 nt, Human
gcccuggccagcccuuccu

SEQ ID NO: 173849 - RNA, 32 nt, Human
gcccuggccagcucccuguggccuuggaggac

SEQ ID NO: 173850 - RNA, 32 nt, Human
gcccuggcccagccccgauccagccugcgccu

SEQ ID NO: 173851 - RNA, 32 nt, Human
gcccuggcccagcucuggagugcaugugugug

SEQ ID NO: 173852 - RNA, 20 nt, Human
gcccuggcccuccagcaagg

SEQ ID NO: 173853 - RNA, 32 nt, Human
gcccuggcccuggccuugcuugcccauggugu

SEQ ID NO: 173854 - RNA, 17 nt, Human
gcccuggccuccacccc

SEQ ID NO: 173855 - RNA, 18 nt, Human
gcccuggccucugcucaa

SEQ ID NO: 173856 - RNA, 32 nt, Human
gcccuggccugggaggaggucauaccccaccg

SEQ ID NO: 173857 - RNA, 32 nt, Human
gcccuggccuuucacuccaguucugggugagg

SEQ ID NO: 173858 - RNA, 23 nt, Human
gcccuggcgccuucaaacccaga

SEQ ID NO: 173859 - RNA, 32 nt, Human
gcccuggcggcagagguugcagugagccaaga

SEQ ID NO: 173860 - RNA, 21 nt, Human
gcccuggcuaaugucucucag

SEQ ID NO: 173861 - RNA, 22 nt, Human
gcccuggcucacaccuguaauc

SEQ ID NO: 173862 - RNA, 32 nt, Human
gcccuggcucaggagcucauagauggaggagg

SEQ ID NO: 173863 - RNA, 32 nt, Human
gcccuggcuccuggucgggaagggagguggcc

SEQ ID NO: 173864 - RNA, 32 nt, Human
gcccuggcucugcuccuggguccucccgccau

SEQ ID NO: 173865 - RNA, 32 nt, Human
gcccuggcugaggccaaugcugugaagcucca

SEQ ID NO: 173866 - RNA, 20 nt, Human
gcccuggcuggagugcaaug

SEQ ID NO: 173867 - RNA, 21 nt, Human
gcccuggcuggagugcaaugg

SEQ ID NO: 173868 - RNA, 24 nt, Human
gcccuggcuggagugcaauggugu

SEQ ID NO: 173869 - RNA, 20 nt, Human
gcccuggcuggaguggaaug

SEQ ID NO: 173870 - RNA, 20 nt, Human
gcccuggcuggaguucagug

SEQ ID NO: 173871 - RNA, 21 nt, Human
gcccuggcuggaguucagugg

SEQ ID NO: 173872 - RNA, 24 nt, Human
gcccuggcuggaguucaguggugu

SEQ ID NO: 173873 - RNA, 32 nt, Human
gcccuggcuguccccucucccucaguccuucc

SEQ ID NO: 173874 - RNA, 32 nt, Human
gcccuggcuuucucccugucugguuucagugg

SEQ ID NO: 173875 - RNA, 22 nt, Human
gcccugggaaccaguccaaggg

SEQ ID NO: 173876 - RNA, 22 nt, Human
gcccugggaacgucccggagag

SEQ ID NO: 173877 - RNA, 30 nt, Human
gcccugggaagauucucccaccuccucccu

SEQ ID NO: 173878 - RNA, 21 nt, Human
gcccugggaagcccgcaagag

SEQ ID NO: 173879 - RNA, 32 nt, Human
gcccugggaaggagggguggggaacgacaugc

SEQ ID NO: 173880 - RNA, 21 nt, Human
gcccugggaaucaauuccuca

SEQ ID NO: 173881 - RNA, 22 nt, Human
gcccugggaaucagcaugggag

SEQ ID NO: 173882 - RNA, 30 nt, Human
gcccugggacaucucacuccacuccuaccu

SEQ ID NO: 173883 - RNA, 32 nt, Human
gcccugggacucaggucgccuggagcguggca

SEQ ID NO: 173884 - RNA, 32 nt, Human
gcccugggacuccuaucaggaagcuugacagg

SEQ ID NO: 173885 - RNA, 16 nt, Human
gcccugggacugggag

SEQ ID NO: 173886 - RNA, 32 nt, Human
gcccugggagacauccuugucuuugcaacucc

SEQ ID NO: 173887 - RNA, 22 nt, Human
gcccugggagauaccaaccuca

SEQ ID NO: 173888 - RNA, 32 nt, Human
gcccugggagcaccgcucugcagcgcggccgg

SEQ ID NO: 173889 - RNA, 32 nt, Human
gcccugggagcaccggcucugcuuaccugucc

SEQ ID NO: 173890 - RNA, 32 nt, Human
gcccugggagcaccggcucugcuuaccugucu

SEQ ID NO: 173891 - RNA, 32 nt, Human
gcccugggagcagagguggagcgaccccauua

SEQ ID NO: 173892 - RNA, 23 nt, Human
gcccugggagccaccagguggga

SEQ ID NO: 173893 - RNA, 32 nt, Human
gcccugggagccucuggaaggccuugcuagug

SEQ ID NO: 173894 - RNA, 32 nt, Human
gcccugggaggucaaggcugcagugagcugca

SEQ ID NO: 173895 - RNA, 24 nt, Human
gcccugggaguugccaucugagag

SEQ ID NO: 173896 - RNA, 32 nt, Human
gcccugggauccagcacccauggaagcuucug

SEQ ID NO: 173897 - RNA, 32 nt, Human
gcccugggaugugccgcauucccacuggggug

SEQ ID NO: 173898 - RNA, 32 nt, Human
gcccugggcacauagcauaggcuggggacaca

SEQ ID NO: 173899 - RNA, 18 nt, Human
gcccugggcacccaccuc

SEQ ID NO: 173900 - RNA, 32 nt, Human
gcccugggcaugaggccacagagcagggccga

SEQ ID NO: 173901 - RNA, 23 nt, Human
gcccugggccagcacuccgagag

SEQ ID NO: 173902 - RNA, 19 nt, Human
gcccugggcccccaccucu

SEQ ID NO: 173903 - RNA, 32 nt, Human
gcccugggccugcagcccuggagcuugggccc

SEQ ID NO: 173904 - RNA, 32 nt, Human
gcccugggccugggccuguggcucggggcgcu

SEQ ID NO: 173905 - RNA, 20 nt, Human
gcccugggccugugccgcug

SEQ ID NO: 173906 - RNA, 32 nt, Human
gcccugggcugaggccaggcugcuccaggggc

SEQ ID NO: 173907 - RNA, 32 nt, Human
gcccugggcugcaggagguugcggcggccgcg

SEQ ID NO: 173908 - RNA, 19 nt, Human
gcccugggcugccaccaga

SEQ ID NO: 173909 - RNA, 32 nt, Human
gcccugggcuggcgucgugccuagccaaggag

SEQ ID NO: 173910 - RNA, 18 nt, Human
gcccugggcuggugcagg

SEQ ID NO: 173911 - RNA, 32 nt, Human
gcccugggcuugucuguucccuccugagccug

SEQ ID NO: 173912 - RNA, 32 nt, Human
gcccuggggaaggggagccaggucagcugggu

SEQ ID NO: 173913 - RNA, 32 nt, Human
gcccuggggaccccugacccaucccaaaacac

SEQ ID NO: 173914 - RNA, 32 nt, Human
gcccuggggacuagacaaagugcugaugauga

SEQ ID NO: 173915 - RNA, 32 nt, Human
gcccuggggaggcagggguuggugcccugacu

SEQ ID NO: 173916 - RNA, 32 nt, Human
gcccuggggaggggcccugcucgcuguccccc

SEQ ID NO: 173917 - RNA, 32 nt, Human
gcccuggggccaggacugcugcugucacugcc

SEQ ID NO: 173918 - RNA, 32 nt, Human
gcccuggggcccuggccucccuggaggggcug

SEQ ID NO: 173919 - RNA, 32 nt, Human
gcccuggggcccuucaccuuguggggcuggcc

SEQ ID NO: 173920 - RNA, 22 nt, Human
gcccuggggccggaggaugagu

SEQ ID NO: 173921 - RNA, 21 nt, Human
gcccuggggcucggccuccuc

SEQ ID NO: 173922 - RNA, 22 nt, Human
gcccugggggacccccagggca

SEQ ID NO: 173923 - RNA, 32 nt, Human
gcccugggggagagaaguguuuugaagaugac

SEQ ID NO: 173924 - RNA, 32 nt, Human
gcccugggggcagacuuccagccaggaaguag

SEQ ID NO: 173925 - RNA, 32 nt, Human
gcccugggggcagagcuccuggccagucccga

SEQ ID NO: 173926 - RNA, 32 nt, Human
gcccugggguagugucagagcgggagugaggc

SEQ ID NO: 173927 - RNA, 24 nt, Human
gcccugggguggagugacaaaccg

SEQ ID NO: 173928 - RNA, 22 nt, Human
gcccugggguucugggccccca

SEQ ID NO: 173929 - RNA, 22 nt, Human
gcccuggguaccccucuucuca

SEQ ID NO: 173930 - RNA, 32 nt, Human
gcccuggguagccucagacuuuggguauugau

SEQ ID NO: 173931 - RNA, 32 nt, Human
gcccugggucaauucuccuuccugacucaagg

SEQ ID NO: 173932 - RNA, 32 nt, Human
gcccugggucaccugaugacaggugugguggu

SEQ ID NO: 173933 - RNA, 23 nt, Human
gcccugggucugcagaaggcuga

SEQ ID NO: 173934 - RNA, 31 nt, Human
gcccugggucuuuggcugccuguguccucag

SEQ ID NO: 173935 - RNA, 21 nt, Human
gcccugggugccuggcugcug

SEQ ID NO: 173936 - RNA, 32 nt, Human
gcccuggguucugccauauacccagaggagcc

SEQ ID NO: 173937 - RNA, 32 nt, Human
gcccuggucagcuccacuugggucggggcuga

SEQ ID NO: 173938 - RNA, 32 nt, Human
gcccugguccaaugcugcuguugucugaggaa

SEQ ID NO: 173939 - RNA, 32 nt, Human
gcccugguccacccuuccccugugcaccuccg

SEQ ID NO: 173940 - RNA, 31 nt, Human
gcccuggugaaacugcuuuaagaugccucuu

SEQ ID NO: 173941 - RNA, 24 nt, Human
gcccuggugaccaccagccuccuu

SEQ ID NO: 173942 - RNA, 19 nt, Human
gcccugguggcagcgccag

SEQ ID NO: 173943 - RNA, 32 nt, Human
gcccugguggcagcugggcugguuagccagua

SEQ ID NO: 173944 - RNA, 22 nt, Human
gcccugguggcugccugugcuc

SEQ ID NO: 173945 - RNA, 32 nt, Human
gcccuggugugggcguuuuuauaaagcucuuc

SEQ ID NO: 173946 - RNA, 18 nt, Human
gcccugguucccagggug

SEQ ID NO: 173947 - RNA, 32 nt, Human
gcccugguuccugcucuuccaugaucagugug

SEQ ID NO: 173948 - RNA, 32 nt, Human
gcccugguuggaggagcuccuagucuguguuc

SEQ ID NO: 173949 - RNA, 32 nt, Human
gcccugguuuauuaacacuugaacugggaugg

SEQ ID NO: 173950 - RNA, 20 nt, Human
gcccugguuuccaucuggga

SEQ ID NO: 173951 - RNA, 32 nt, Human
gcccugguuuuucaauccccagggucggguag

SEQ ID NO: 173952 - RNA, 20 nt, Human
gcccuguaagauggacucuu

SEQ ID NO: 173953 - RNA, 32 nt, Human
gcccuguacagugacccugccugcucgcucuu

SEQ ID NO: 173954 - RNA, 20 nt, Human
gcccuguacgcugcccggga

SEQ ID NO: 173955 - RNA, 32 nt, Human
gcccuguagcgcccucugggccccgguucaug

SEQ ID NO: 173956 - RNA, 32 nt, Human
gcccuguauucaccuccacugcccccaggggc

SEQ ID NO: 173957 - RNA, 32 nt, Human
gcccuguauuuaggcuuugccugcuuggugug

SEQ ID NO: 173958 - RNA, 32 nt, Human
gcccugucaacaccacacugugcucagcucuc

SEQ ID NO: 173959 - RNA, 32 nt, Human
gcccugucacagugagaaguaguuccuguccu

SEQ ID NO: 173960 - RNA, 32 nt, Human
gcccugucacccaggcuggagugcaauggugc

SEQ ID NO: 173961 - RNA, 32 nt, Human
gcccugucacccaggcuggagugcaguggcac

SEQ ID NO: 173962 - RNA, 32 nt, Human
gcccugucacccaggcuggagugcaguggugu

SEQ ID NO: 173963 - RNA, 32 nt, Human
gcccugucacccaggcugggguacgguggcau

SEQ ID NO: 173964 - RNA, 32 nt, Human
gcccugucacucaggauggaguucaauggucc

SEQ ID NO: 173965 - RNA, 32 nt, Human
gcccugucacucaggauggaguucaguggucc

SEQ ID NO: 173966 - RNA, 17 nt, Human
gcccugucacugcugcc

SEQ ID NO: 173967 - RNA, 32 nt, Human
gcccugucagccacccucucucagucugaaac

SEQ ID NO: 173968 - RNA, 32 nt, Human
gcccugucagccgccucggcgcccccaggacc

SEQ ID NO: 173969 - RNA, 24 nt, Human
gcccugucagugcagcccgugugg

SEQ ID NO: 173970 - RNA, 32 nt, Human
gcccugucagugcugcucagaccuucauagcc

SEQ ID NO: 173971 - RNA, 32 nt, Human
gcccugucauuuaggauggaguucaguggucc

SEQ ID NO: 173972 - RNA, 32 nt, Human
gcccuguccaggcacuagaggcucccuugacg

SEQ ID NO: 173973 - RNA, 32 nt, Human
gcccugucccccaggcucuggguccgguugag

SEQ ID NO: 173974 - RNA, 17 nt, Human
gcccuguccccucuuca

SEQ ID NO: 173975 - RNA, 32 nt, Human
gcccugucccguguccuguccucuacugucgg

SEQ ID NO: 173976 - RNA, 32 nt, Human
gcccugucccugcuugguucuugaaguuuuua

SEQ ID NO: 173977 - RNA, 32 nt, Human
gcccuguccuccucacaggcugguguggccgu

SEQ ID NO: 173978 - RNA, 32 nt, Human
gcccuguccugucauguguccucaccggggua

SEQ ID NO: 173979 - RNA, 32 nt, Human
gcccuguccuguccuugcacagucuccuaugu

SEQ ID NO: 173980 - RNA, 32 nt, Human
gcccugucgccaggcuggaguguaguggcaug

SEQ ID NO: 173981 - RNA, 32 nt, Human
gcccugucgcccaggcuggagugccauggcgc

SEQ ID NO: 173982 - RNA, 32 nt, Human
gcccugucgccuggcuggaguggaguggcaca

SEQ ID NO: 173983 - RNA, 32 nt, Human
gcccugucucaaaucucacuugacaaaugguc

SEQ ID NO: 173984 - RNA, 32 nt, Human
gcccugucucagagcugaugaccucaccguug

SEQ ID NO: 173985 - RNA, 32 nt, Human
gcccugucucggcuggcccauaacuccugagc

SEQ ID NO: 173986 - RNA, 19 nt, Human
gcccugucuggccagggag

SEQ ID NO: 173987 - RNA, 32 nt, Human
gcccugucugggagguugaggccacaguguau

SEQ ID NO: 173988 - RNA, 17 nt, Human
gcccugucugugccaug

SEQ ID NO: 173989 - RNA, 32 nt, Human
gcccugucuguucauucaaggcugguucaggu

SEQ ID NO: 173990 - RNA, 32 nt, Human
gcccugucuucugaagucucaggcuuagaagu

SEQ ID NO: 173991 - RNA, 32 nt, Human
gcccugugaaagauaggaugugaggugagcau

SEQ ID NO: 173992 - RNA, 32 nt, Human
gcccugugaaccaccugcugcccugugaggcc

SEQ ID NO: 173993 - RNA, 19 nt, Human
gcccugugaagccagagga

SEQ ID NO: 173994 - RNA, 32 nt, Human
gcccugugacucaggaccagcucuggagucuc

SEQ ID NO: 173995 - RNA, 25 nt, Human
gcccugugagagcuuccugugccca

SEQ ID NO: 173996 - RNA, 32 nt, Human
gcccugugagcugugcccuuguggcccugaug

SEQ ID NO: 173997 - RNA, 32 nt, Human
gcccugugcagcugccuggcaguggcugggac

SEQ ID NO: 173998 - RNA, 32 nt, Human
gcccugugcaucuugcacaaagccugguccug

SEQ ID NO: 173999 - RNA, 32 nt, Human
gcccugugccauaggacagaagaggcacuggc

SEQ ID NO: 174000 - RNA, 32 nt, Human
gcccugugcccuggcccuguugcggagagacg

SEQ ID NO: 174001 - RNA, 32 nt, Human
gcccugugccugagugggucugaaaaagcuuu

SEQ ID NO: 174002 - RNA, 32 nt, Human
gcccugugcggauccugaaccugcgcugucug

SEQ ID NO: 174003 - RNA, 32 nt, Human
gcccugugcguggggcucugcaggcccagcca

SEQ ID NO: 174004 - RNA, 32 nt, Human
gcccuguggaaagaagagacagacagagugug

SEQ ID NO: 174005 - RNA, 32 nt, Human
gcccuguggaagggacuaggagcacuguagua

SEQ ID NO: 174006 - RNA, 32 nt, Human
gcccuguggccugagaacugagcccagacuuu

SEQ ID NO: 174007 - RNA, 32 nt, Human
gcccuguggcucacugucuuacaaucacugcu

SEQ ID NO: 174008 - RNA, 32 nt, Human
gcccuguggcucuggaggccacuugugguuca

SEQ ID NO: 174009 - RNA, 32 nt, Human
gcccuguggcugggcuggagugcaauggcgcg

SEQ ID NO: 174010 - RNA, 32 nt, Human
gcccuguggcuucauggcagcagaucagagcu

SEQ ID NO: 174011 - RNA, 32 nt, Human
gcccuguggggaggggcgcggacacugaaggg

SEQ ID NO: 174012 - RNA, 32 nt, Human
gcccugugggucuugcucaauacuguucauac

SEQ ID NO: 174013 - RNA, 32 nt, Human
gcccugugucuacugccaggauagcauucuua

SEQ ID NO: 174014 - RNA, 32 nt, Human
gcccuguguuaguucaugcauucaguugaguc

SEQ ID NO: 174015 - RNA, 20 nt, Human
gcccuguguucuccagcacc

SEQ ID NO: 174016 - RNA, 32 nt, Human
gcccuguucccccuggaaugugcagugggcca

SEQ ID NO: 174017 - RNA, 32 nt, Human
gcccuguucccuccaccuagacugccugcuga

SEQ ID NO: 174018 - RNA, 32 nt, Human
gcccuguuccuuccuguccuuugcuggucuuu

SEQ ID NO: 174019 - RNA, 32 nt, Human
gcccuguucugugccagacgcuaacacacuuu

SEQ ID NO: 174020 - RNA, 32 nt, Human
gcccuguugccaggcuggaaugcaguggcgug

SEQ ID NO: 174021 - RNA, 32 nt, Human
gcccuguugcccaggcugaagugcaguggugc

SEQ ID NO: 174022 - RNA, 32 nt, Human
gcccuguugcccaggcuggagagcaguggugc

SEQ ID NO: 174023 - RNA, 32 nt, Human
gcccuguugcccaggcuggaguauaguagugc

SEQ ID NO: 174024 - RNA, 32 nt, Human
gcccuguugcccaggcuggagugcaguggcac

SEQ ID NO: 174025 - RNA, 32 nt, Human
gcccuguugcccaugcuggagugcaauggcac

SEQ ID NO: 174026 - RNA, 32 nt, Human
gcccuguugccuuuuaagcauguaccgcuccc

SEQ ID NO: 174027 - RNA, 21 nt, Human
gcccuguugugccacagagug

SEQ ID NO: 174028 - RNA, 32 nt, Human
gcccuguuuccccucaguccuccuuugcuccu

SEQ ID NO: 174029 - RNA, 32 nt, Human
gcccuguuuuguuaaauugcagucuccagggu

SEQ ID NO: 174030 - RNA, 32 nt, Human
gcccuuaacugcuguauaaauaacaacuugaa

SEQ ID NO: 174031 - RNA, 32 nt, Human
gcccuuaacuggaaaggcagaggggaacucag

SEQ ID NO: 174032 - RNA, 32 nt, Human
gcccuuaauaaauauaaaauaucauuauuugu

SEQ ID NO: 174033 - RNA, 32 nt, Human
gcccuuacaguuucacucaugaagcaccuuga

SEQ ID NO: 174034 - RNA, 18 nt, Human
gcccuuacccuccucagg

SEQ ID NO: 174035 - RNA, 32 nt, Human
gcccuuagaguauggaggcugagccaggccuu

SEQ ID NO: 174036 - RNA, 32 nt, Human
gcccuuagcugaaggggguggggagaagcgug

SEQ ID NO: 174037 - RNA, 32 nt, Human
gcccuuaggcuucuguacucaguucuuucccc

SEQ ID NO: 174038 - RNA, 32 nt, Human
gcccuuaguuucuggcccacgugaagcagggg

SEQ ID NO: 174039 - RNA, 32 nt, Human
gcccuuaucucagagacugagauuucuguggu

SEQ ID NO: 174040 - RNA, 32 nt, Human
gcccuucaaagacauaggagaauucauacugg

SEQ ID NO: 174041 - RNA, 32 nt, Human
gcccuucacaggauaggauccgucucuguccu

SEQ ID NO: 174042 - RNA, 32 nt, Human
gcccuucaccaugagagggugcagugagaaga

SEQ ID NO: 174043 - RNA, 32 nt, Human
gcccuucagaagacucguuuuuaagguggaaa

SEQ ID NO: 174044 - RNA, 32 nt, Human
gcccuucagagcagaguccacaggcggguggu

SEQ ID NO: 174045 - RNA, 32 nt, Human
gcccuucagcaacucuucugagaaggucuuug

SEQ ID NO: 174046 - RNA, 21 nt, Human
gcccuucagccccugugcucg

SEQ ID NO: 174047 - RNA, 32 nt, Human
gcccuucagccucagcuggguucuacaaaacc

SEQ ID NO: 174048 - RNA, 23 nt, Human
gcccuucaggccugagaucagag

SEQ ID NO: 174049 - RNA, 32 nt, Human
gcccuucagucaccugguggcuaauuagaccc

SEQ ID NO: 174050 - RNA, 32 nt, Human
gcccuucaguuuccucacuguccccaggugcu

SEQ ID NO: 174051 - RNA, 32 nt, Human
gcccuucauccagcaaaucagaaggacucagu

SEQ ID NO: 174052 - RNA, 32 nt, Human
gcccuucauccagccagaccugcggcgagagg

SEQ ID NO: 174053 - RNA, 20 nt, Human
gcccuucauccuccagcgcc

SEQ ID NO: 174054 - RNA, 32 nt, Human
gcccuucauccugaacgugaccaguggggccc

SEQ ID NO: 174055 - RNA, 32 nt, Human
gcccuucauggaggucagagaggaagaaacaa

SEQ ID NO: 174056 - RNA, 32 nt, Human
gcccuuccaccagaaaagcuagucuaggugug

SEQ ID NO: 174057 - RNA, 22 nt, Human
gcccuuccacccaccuuugccc

SEQ ID NO: 174058 - RNA, 32 nt, Human
gcccuuccacgauguggcuccgugccuuuauc

SEQ ID NO: 174059 - RNA, 32 nt, Human
gcccuuccagcagccaugagggaaggacagga

SEQ ID NO: 174060 - RNA, 25 nt, Human
gcccuuccagcuguaaacacugccc

SEQ ID NO: 174061 - RNA, 32 nt, Human
gcccuuccagggccuuaucauaaaacucugga

SEQ ID NO: 174062 - RNA, 32 nt, Human
gcccuucccagacagacccucagucuggagcc

SEQ ID NO: 174063 - RNA, 32 nt, Human
gcccuucccagugagggguggaagggaucucu

SEQ ID NO: 174064 - RNA, 32 nt, Human
gcccuuccccacccucccgucccugccacugg

SEQ ID NO: 174065 - RNA, 16 nt, Human
gcccuuccccaggggc

SEQ ID NO: 174066 - RNA, 32 nt, Human
gcccuuccccucccgacagcccaucaccucua

SEQ ID NO: 174067 - RNA, 32 nt, Human
gcccuuccccuucaagcauuuuccucuucccu

SEQ ID NO: 174068 - RNA, 32 nt, Human
gcccuuccccuucacgaaaccccuuuugucca

SEQ ID NO: 174069 - RNA, 32 nt, Human
gcccuucccuccauccuguaggauuuuguaga

SEQ ID NO: 174070 - RNA, 32 nt, Human
gcccuucccuccccaucuccccuacuucccug

SEQ ID NO: 174071 - RNA, 19 nt, Human
gcccuucccucccucugca

SEQ ID NO: 174072 - RNA, 32 nt, Human
gcccuucccugacccaauaaauccugaagagg

SEQ ID NO: 174073 - RNA, 32 nt, Human
gcccuucccuggggaguaccugauggcugccc

SEQ ID NO: 174074 - RNA, 17 nt, Human
gcccuucccuugcccuu

SEQ ID NO: 174075 - RNA, 32 nt, Human
gcccuuccuaaggucccugccuggcauccgag

SEQ ID NO: 174076 - RNA, 32 nt, Human
gcccuuccuagaagagucaggaagggaaagcc

SEQ ID NO: 174077 - RNA, 32 nt, Human
gcccuuccucacccuuccccuccccgcaccgc

SEQ ID NO: 174078 - RNA, 32 nt, Human
gcccuuccucaucuccaugcucuuucacccug

SEQ ID NO: 174079 - RNA, 32 nt, Human
gcccuuccucaucucucccugccugugcagac

SEQ ID NO: 174080 - RNA, 32 nt, Human
gcccuuccuccacucccaccagacuugcucau

SEQ ID NO: 174081 - RNA, 32 nt, Human
gcccuuccuccaggcuucucaaaggaauugcu

SEQ ID NO: 174082 - RNA, 20 nt, Human
gcccuuccuccccaggggug

SEQ ID NO: 174083 - RNA, 32 nt, Human
gcccuuccucuagccucuugucacauguggug

SEQ ID NO: 174084 - RNA, 32 nt, Human
gcccuuccucucccagugggcccucggcgccc

SEQ ID NO: 174085 - RNA, 32 nt, Human
gcccuuccugcccuuuguuucucucuucaugu

SEQ ID NO: 174086 - RNA, 32 nt, Human
gcccuuccuggagacagcuuggaagagaggga

SEQ ID NO: 174087 - RNA, 32 nt, Human
gcccuuccugguggaggcucagugugaaccgg

SEQ ID NO: 174088 - RNA, 30 nt, Human
gcccuucgccucuccaugaacccgugagcc

SEQ ID NO: 174089 - RNA, 32 nt, Human
gcccuucgcuccccgaccuccugcugcagcuc

SEQ ID NO: 174090 - RNA, 32 nt, Human
gcccuucuaaaccaaucuuucaucauuuuacu

SEQ ID NO: 174091 - RNA, 32 nt, Human
gcccuucuccacccaucccaaccccauugcua

SEQ ID NO: 174092 - RNA, 32 nt, Human
gcccuucuccaucucuuccuccuuguucauuu

SEQ ID NO: 174093 - RNA, 32 nt, Human
gcccuucucccccaucuccguguccucguucc

SEQ ID NO: 174094 - RNA, 32 nt, Human
gcccuucucccucccucccuuccucccucucc

SEQ ID NO: 174095 - RNA, 32 nt, Human
gcccuucucccuccugcuucugaggucaagcu

SEQ ID NO: 174096 - RNA, 32 nt, Human
gcccuucucccugacccugggcugcuuccugg

SEQ ID NO: 174097 - RNA, 32 nt, Human
gcccuucucccugguuucacacauucccaugc

SEQ ID NO: 174098 - RNA, 17 nt, Human
gcccuucuccugcugcu

SEQ ID NO: 174099 - RNA, 32 nt, Human
gcccuucuccuggaccucagggaggaaugacc

SEQ ID NO: 174100 - RNA, 32 nt, Human
gcccuucucuaugccuuagucucuccagcaca

SEQ ID NO: 174101 - RNA, 32 nt, Human
gcccuucucuccccaucuucccucaguuccca

SEQ ID NO: 174102 - RNA, 32 nt, Human
gcccuucucugccucccuaaguugcugggauu

SEQ ID NO: 174103 - RNA, 32 nt, Human
gcccuucucuggaagaagaggcugggaccaaa

SEQ ID NO: 174104 - RNA, 18 nt, Human
gcccuucugaaaacuuug

SEQ ID NO: 174105 - RNA, 23 nt, Human
gcccuucugagcaucaguggugu

SEQ ID NO: 174106 - RNA, 32 nt, Human
gcccuucugcaggucugcggggccaagugucc

SEQ ID NO: 174107 - RNA, 21 nt, Human
gcccuucugcccucuccccuc

SEQ ID NO: 174108 - RNA, 32 nt, Human
gcccuucuugcccaggcuggagugcaagggcg

SEQ ID NO: 174109 - RNA, 32 nt, Human
gcccuugaaguaaaauggagccagcaggagua

SEQ ID NO: 174110 - RNA, 32 nt, Human
gcccuugaccaacaucggcuuccccaguccag

SEQ ID NO: 174111 - RNA, 22 nt, Human
gcccuugaccacuauagacuca

SEQ ID NO: 174112 - RNA, 32 nt, Human
gcccuugacucugcccugagcuugcagcugga

SEQ ID NO: 174113 - RNA, 32 nt, Human
gcccuugagccuggcuggaguagguggaauau

SEQ ID NO: 174114 - RNA, 32 nt, Human
gcccuugaggcagaggugccgagugacugcca

SEQ ID NO: 174115 - RNA, 32 nt, Human
gcccuugaugucccucaauaggaucaggaguu

SEQ ID NO: 174116 - RNA, 21 nt, Human
gcccuugauuucccugcugcc

SEQ ID NO: 174117 - RNA, 32 nt, Human
gcccuugcacacuggagacacucaucaauccc

SEQ ID NO: 174118 - RNA, 32 nt, Human
gcccuugccagcugacgucacagucuaagaug

SEQ ID NO: 174119 - RNA, 32 nt, Human
gcccuugccccacugcaggcugccugggacgc

SEQ ID NO: 174120 - RNA, 21 nt, Human
gcccuugccccugcugcugcc

SEQ ID NO: 174121 - RNA, 32 nt, Human
gcccuugccuccagauggggucgaggauuugg

SEQ ID NO: 174122 - RNA, 32 nt, Human
gccuccuucucccucccacccaccucaagcag

SEQ ID NO: 174123 - RNA, 32 nt, Human
gccuccuucuccuggguccaagcaauuauugu

SEQ ID NO: 174124 - RNA, 32 nt, Human
gccuccuucuucugccgcuccuggugcugcuu

SEQ ID NO: 174125 - RNA, 32 nt, Human
gccuccuugcagacuggugcucuguguucugu

SEQ ID NO: 174126 - RNA, 32 nt, Human
gccuccuugcagggaucugagccacccucccc

SEQ ID NO: 174127 - RNA, 32 nt, Human
gccuccuugcccagcccaguccaggcugcugu

SEQ ID NO: 174128 - RNA, 32 nt, Human
gccuccuugcccauccuucaccggugccuuug

SEQ ID NO: 174129 - RNA, 32 nt, Human
gccuccuugcccaugccucucucacucuucau

SEQ ID NO: 174130 - RNA, 32 nt, Human
gccuccuugccgcugccuccaggaagcccacc

SEQ ID NO: 174131 - RNA, 32 nt, Human
gccuccuugcuccccucccuuacuccucccuc

SEQ ID NO: 174132 - RNA, 32 nt, Human
gccuccuugcuuguuacauaccuggguaugug

SEQ ID NO: 174133 - RNA, 32 nt, Human
gccuccuugucuggaaagagggugggucaucu

SEQ ID NO: 174134 - RNA, 32 nt, Human
gccuccuugugcaaacugggcccccaugccac

SEQ ID NO: 174135 - RNA, 32 nt, Human
gccuccuuguguuuuugccucauuccuacugu

SEQ ID NO: 174136 - RNA, 32 nt, Human
gccuccuuuaguaggugggauuacaggugcau

SEQ ID NO: 174137 - RNA, 32 nt, Human
gccuccuuucaaggaguucacagugaacaaga

SEQ ID NO: 174138 - RNA, 32 nt, Human
gccuccuuucccagugucuccccaugggguua

SEQ ID NO: 174139 - RNA, 32 nt, Human
gccuccuuuccuccuccugugcuuccuuucuc

SEQ ID NO: 174140 - RNA, 19 nt, Human
gccuccuuucuccuccagg

SEQ ID NO: 174141 - RNA, 17 nt, Human
gccuccuuuucuagaug

SEQ ID NO: 174142 - RNA, 32 nt, Human
gccuccuuuucuugagcugguggagagccacu

SEQ ID NO: 174143 - RNA, 32 nt, Human
gccuccuuuuucuauuacuagagaacuccagg

SEQ ID NO: 174144 - RNA, 32 nt, Human
gccuccuuuuugguucuucauuccugagcucu

SEQ ID NO: 174145 - RNA, 32 nt, Human
gccucgaacuccugggcucaagcaauccuccu

SEQ ID NO: 174146 - RNA, 32 nt, Human
gccucgaccucccaggcucaagcaauucuccu

SEQ ID NO: 174147 - RNA, 32 nt, Human
gccucgaccucccaggugauccucccaccuca

SEQ ID NO: 174148 - RNA, 32 nt, Human
gccucgaccuccugggcucaagcaauccucac

SEQ ID NO: 174149 - RNA, 32 nt, Human
gccucgaccuccugggcucaagcaauccuccc

SEQ ID NO: 174150 - RNA, 32 nt, Human
gccucgaccuccugggcucaagcaauccuccu

SEQ ID NO: 174151 - RNA, 32 nt, Human
gccucgacuccuggcccagcguggggcuggcu

SEQ ID NO: 174152 - RNA, 32 nt, Human
gccucgacuuccugggauccagcgauccuccc

SEQ ID NO: 174153 - RNA, 32 nt, Human
gccucgagaugcgccaccucccagaaagccag

SEQ ID NO: 174154 - RNA, 32 nt, Human
gccucgagcacagccugugcccaggggagccg

SEQ ID NO: 174155 - RNA, 32 nt, Human
gccucgagccauccuccugccugggccuccca

SEQ ID NO: 174156 - RNA, 32 nt, Human
gccucgagcuguagccacccucaggccuggga

SEQ ID NO: 174157 - RNA, 32 nt, Human
gccucgagggcuuaagauccagcugggacucc

SEQ ID NO: 174158 - RNA, 21 nt, Human
gccucgauggugccucugcca

SEQ ID NO: 174159 - RNA, 24 nt, Human
gccucgauguccuccucugugaaa

SEQ ID NO: 174160 - RNA, 32 nt, Human
gccucgauuaaccaggaggagguggcugcugu

SEQ ID NO: 174161 - RNA, 32 nt, Human
gccucgauuuaaagagacagaagcugucgggg

SEQ ID NO: 174162 - RNA, 32 nt, Human
gccucgcaagcccacggcccgcugggggugcc

SEQ ID NO: 174163 - RNA, 19 nt, Human
gccucgcacccccaccucu

SEQ ID NO: 174164 - RNA, 20 nt, Human
gccucgcacccgcagccucg

SEQ ID NO: 174165 - RNA, 31 nt, Human
gccucgcagaagaaagcucucacuuauaaac

SEQ ID NO: 174166 - RNA, 32 nt, Human
gccucgcagccaccccuccugcgucuccacaa

SEQ ID NO: 174167 - RNA, 32 nt, Human
gccucgcagcccaccugggaagccacagugac

SEQ ID NO: 174168 - RNA, 32 nt, Human
gccucgcaggcagaugaaaacagaggucaugc

SEQ ID NO: 174169 - RNA, 32 nt, Human
gccucgccaccagcgggggcucagaggaggag

SEQ ID NO: 174170 - RNA, 32 nt, Human
gccucgccaccuggcgacccugaccccaccac

SEQ ID NO: 174171 - RNA, 32 nt, Human
gccucgccgcgauggaccuggcaccuggcgcg

SEQ ID NO: 174172 - RNA, 21 nt, Human
gccucgccgggguucugcgga

SEQ ID NO: 174173 - RNA, 32 nt, Human
gccucgccuccccucaccuugccucaccucgc

SEQ ID NO: 174174 - RNA, 32 nt, Human
gccucgccugaagccuuccucuggcuucacag

SEQ ID NO: 174175 - RNA, 32 nt, Human
gccucgccuggguucuggaggcugcggggcca

SEQ ID NO: 174176 - RNA, 32 nt, Human
gccucgcgcuagcagcaagcugcucuguuaaa

SEQ ID NO: 174177 - RNA, 32 nt, Human
gccucgcgcugcacauucucuccuggcggcgg

SEQ ID NO: 174178 - RNA, 32 nt, Human
gccucgcggagaugcccagcugcggugcuugu

SEQ ID NO: 174179 - RNA, 32 nt, Human
gccucgcgggugcagcagcacagcagggagug

SEQ ID NO: 174180 - RNA, 32 nt, Human
gccucgcgucucucacccaugcgacucgggcc

SEQ ID NO: 174181 - RNA, 19 nt, Human
gccucgcuccccgcccgga

SEQ ID NO: 174182 - RNA, 32 nt, Human
gccucgcucccucccuucaccuuuccucuccu

SEQ ID NO: 174183 - RNA, 20 nt, Human
gccucgcuccucuucaggga

SEQ ID NO: 174184 - RNA, 32 nt, Human
gccucgcugccucuguuucuugcucuguaaaa

SEQ ID NO: 174185 - RNA, 21 nt, Human
gccucgcugcgccccaucccg

SEQ ID NO: 174186 - RNA, 32 nt, Human
gccucgcugcuggggcucugcaggggcagcac

SEQ ID NO: 174187 - RNA, 32 nt, Human
gccucgcugcuucauguggcucagggaggcuc

SEQ ID NO: 174188 - RNA, 32 nt, Human
gccucgcuggaagaagucuggaagaagaggaa

SEQ ID NO: 174189 - RNA, 32 nt, Human
gccucgcuggccagagguggaaggaaggagga

SEQ ID NO: 174190 - RNA, 32 nt, Human
gccucgcugugucuugcuguucccaggcacca

SEQ ID NO: 174191 - RNA, 32 nt, Human
gccucgcuguucccauggacauggcccaggag

SEQ ID NO: 174192 - RNA, 21 nt, Human
gccucgcuugucccucugcca

SEQ ID NO: 174193 - RNA, 32 nt, Human
gccucggacaggcagaggcugugaaauacgug

SEQ ID NO: 174194 - RNA, 32 nt, Human
gccucggaccuacagcccaggauacuuuggga

SEQ ID NO: 174195 - RNA, 22 nt, Human
gccucggaggcggagguugcag

SEQ ID NO: 174196 - RNA, 24 nt, Human
gccucggaggcggagguugcagug

SEQ ID NO: 174197 - RNA, 25 nt, Human
gccucggaggcggagguugcaguga

SEQ ID NO: 174198 - RNA, 32 nt, Human
gccucggaggcggagguugcagugagcugaga

SEQ ID NO: 174199 - RNA, 32 nt, Human
gccucggagggagggauuagaagccgcuagac

SEQ ID NO: 174200 - RNA, 32 nt, Human
gccucggaggggcagaggcugaaccgccccug

SEQ ID NO: 174201 - RNA, 32 nt, Human
gccucggcaguggcggcugccgggaggaugug

SEQ ID NO: 174202 - RNA, 32 nt, Human
gccucggccacccggcccugagucccuggggg

SEQ ID NO: 174203 - RNA, 32 nt, Human
gccucggccaucucucccuccugcccucugcu

SEQ ID NO: 174204 - RNA, 32 nt, Human
gccucggccccgcugcacuccaccuccgcccc

SEQ ID NO: 174205 - RNA, 18 nt, Human
gccucggcccuccgcgcg

SEQ ID NO: 174206 - RNA, 32 nt, Human
gccucggccuccaggagugggaguuggaguug

SEQ ID NO: 174207 - RNA, 32 nt, Human
gccucggccuccuuuaguaggugggauuacag

SEQ ID NO: 174208 - RNA, 21 nt, Human
gccucggccucucaaaaugcu

SEQ ID NO: 174209 - RNA, 20 nt, Human
gccucggcgagcccucugca

SEQ ID NO: 174210 - RNA, 23 nt, Human
gccucggcgcucacccaagccgc

SEQ ID NO: 174211 - RNA, 23 nt, Human
gccucggcugagcagaugcacag

SEQ ID NO: 174212 - RNA, 21 nt, Human
gccucggcuucccucuuucca

SEQ ID NO: 174213 - RNA, 32 nt, Human
gccucggcuuccugggcucaggugauucuucc

SEQ ID NO: 174214 - RNA, 32 nt, Human
gccucgggacacaccaaccccuauacucacac

SEQ ID NO: 174215 - RNA, 32 nt, Human
gccucgggacaccugcccugcccccacgaggg

SEQ ID NO: 174216 - RNA, 32 nt, Human
gccucgggaggugguggagugaccuggcccca

SEQ ID NO: 174217 - RNA, 32 nt, Human
gccucggggaaagggaagcggacgggcaucug

SEQ ID NO: 174218 - RNA, 32 nt, Human
gccucggggaggacgaggaggaaaggcggccu

SEQ ID NO: 174219 - RNA, 32 nt, Human
gccucggggcugcgaggcuggggaagggguug

SEQ ID NO: 174220 - RNA, 32 nt, Human
gccucgggggcagaggugauagauguggggug

SEQ ID NO: 174221 - RNA, 32 nt, Human
gccucggugccaccccaguggauguccccuga

SEQ ID NO: 174222 - RNA, 32 nt, Human
gccucggugcccaccgaagcccccucuggcug

SEQ ID NO: 174223 - RNA, 23 nt, Human
gccucgguguucucauuugugaa

SEQ ID NO: 174224 - RNA, 23 nt, Human
gccucgguuuccucaucugugaa

SEQ ID NO: 174225 - RNA, 24 nt, Human
gccucgguuuccucaucugugaaa

SEQ ID NO: 174226 - RNA, 17 nt, Human
gccucgucaucugugga

SEQ ID NO: 174227 - RNA, 22 nt, Human
gccucgugccacacuggcuuug

SEQ ID NO: 174228 - RNA, 32 nt, Human
gccucgugccagcugcuggugcagccucuccu

SEQ ID NO: 174229 - RNA, 32 nt, Human
gccucgugccugugaucccagcacuuugggag

SEQ ID NO: 174230 - RNA, 32 nt, Human
gccucgugcugggcucugcccugggcagacag

SEQ ID NO: 174231 - RNA, 21 nt, Human
gccucguggaaaauuaccuug

SEQ ID NO: 174232 - RNA, 32 nt, Human
gccucguucucuuucuucucaagaggcucucu

SEQ ID NO: 174233 - RNA, 24 nt, Human
gccucguuuuacucaucugugaaa

SEQ ID NO: 174234 - RNA, 32 nt, Human
gccucuaaaagccucagucuccuuaucugcaa

SEQ ID NO: 174235 - RNA, 32 nt, Human
gccucuaacuccugggcucaagcaauccaagu

SEQ ID NO: 174236 - RNA, 27 nt, Human
gccucuaagacaucucccuuccccaug

SEQ ID NO: 174237 - RNA, 18 nt, Human
gccucuaauaccuucaca

SEQ ID NO: 174238 - RNA, 21 nt, Human
gccucuaaucccagcuacuca

SEQ ID NO: 174239 - RNA, 24 nt, Human
gccucuaaucccagcuacucagga

SEQ ID NO: 174240 - RNA, 24 nt, Human
gccucuaaucccagcuacucggga

SEQ ID NO: 174241 - RNA, 32 nt, Human
gccucuacaggcccagcuccugccucacaguu

SEQ ID NO: 174242 - RNA, 32 nt, Human
gccucuacaggccuagcugcugccucccaaug

SEQ ID NO: 174243 - RNA, 32 nt, Human
gccucuacagucccaacaucugccucauagca

SEQ ID NO: 174244 - RNA, 32 nt, Human
gccucuaccuggaccuuuugucucacacagca

SEQ ID NO: 174245 - RNA, 32 nt, Human
gccucuacuccccacaccccagugccacugug

SEQ ID NO: 174246 - RNA, 32 nt, Human
gccucuagccccaccauugcucucucugucuu

SEQ ID NO: 174247 - RNA, 32 nt, Human
gccucuagccucuccuggaaaggccuggauau

SEQ ID NO: 174248 - RNA, 32 nt, Human
gccucuagcugugggcccagacuacagccugg

SEQ ID NO: 174249 - RNA, 20 nt, Human
gccucuaggaaaacuuaaaa

SEQ ID NO: 174250 - RNA, 32 nt, Human
gccucuaguagcaaaccauucuuuugcacacc

SEQ ID NO: 174251 - RNA, 24 nt, Human
gccucuagucccagcuacuuggga

SEQ ID NO: 174252 - RNA, 32 nt, Human
gccucuauagcucucccagaacauggaucaga

SEQ ID NO: 174253 - RNA, 23 nt, Human
gccucuaucccagaacgugcugg

SEQ ID NO: 174254 - RNA, 32 nt, Human
gccucuauccuaaugacucaaaacuugguucu

SEQ ID NO: 174255 - RNA, 32 nt, Human
gccucuauccugucccuccaccccacccucca

SEQ ID NO: 174256 - RNA, 22 nt, Human
gccucuaugccaacugguuccu

SEQ ID NO: 174257 - RNA, 32 nt, Human
gccucuauguuauuucuagaaugcugaaaagc

SEQ ID NO: 174258 - RNA, 32 nt, Human
gccucuauuguaccccagccucguuggagagc

SEQ ID NO: 174259 - RNA, 32 nt, Human
gccucucaaccucagacuucucagccugccua

SEQ ID NO: 174260 - RNA, 32 nt, Human
gccucucaacugcauuaaccagucacaggcuc

SEQ ID NO: 174261 - RNA, 32 nt, Human
gccucucaauaugacauguucaauguuguauu

SEQ ID NO: 174262 - RNA, 32 nt, Human
gccucucaauucuucaggcucagucuggacuc

SEQ ID NO: 174263 - RNA, 19 nt, Human
gccucucacaucuugcaca

SEQ ID NO: 174264 - RNA, 19 nt, Human
gccucucaccacugccaca

SEQ ID NO: 174265 - RNA, 32 nt, Human
gccucucaccagcucugugaccuugggcaagg

SEQ ID NO: 174266 - RNA, 20 nt, Human
gccucucacccgccccggcc

SEQ ID NO: 174267 - RNA, 32 nt, Human
gccucucaccucagagcugcggaggagccgcu

SEQ ID NO: 174268 - RNA, 28 nt, Human
gccucucacugccgaggccagccuuccu

SEQ ID NO: 174269 - RNA, 32 nt, Human
gccucucacugccuccccaaggcccccugccu

SEQ ID NO: 174270 - RNA, 32 nt, Human
gccucucagauugcuuuuuggccaggucucag

SEQ ID NO: 174271 - RNA, 32 nt, Human
gccucucagcccucucuccauaaaggccacua

SEQ ID NO: 174272 - RNA, 32 nt, Human
gccucucaggaagcaugugcaggguuuauggu

SEQ ID NO: 174273 - RNA, 21 nt, Human
gccucucaggcuccccuuccc

SEQ ID NO: 174274 - RNA, 32 nt, Human
gccucucagucuuaggggacauggcagagaug

SEQ ID NO: 174275 - RNA, 32 nt, Human
gccucucagugcccuccagccccgcgaccaug

SEQ ID NO: 174276 - RNA, 32 nt, Human
gccucucaucucccacaaucucuggccuccag

SEQ ID NO: 174277 - RNA, 32 nt, Human
gccucuccaaccacugugccacugacuugcug

SEQ ID NO: 174278 - RNA, 21 nt, Human
gccucuccaaggacccaggcg

SEQ ID NO: 174279 - RNA, 32 nt, Human
gccucuccaauccaaaagcugccuccugcccu

SEQ ID NO: 174280 - RNA, 32 nt, Human
gccucuccacggucacagcagccucgugauga

SEQ ID NO: 174281 - RNA, 32 nt, Human
gccucuccacugaauuccugaauuaugcauug

SEQ ID NO: 174282 - RNA, 25 nt, Human
gccucuccagacuuccauuucuuca

SEQ ID NO: 174283 - RNA, 32 nt, Human
gccucuccagagaaguuugguuucuuugcugc

SEQ ID NO: 174284 - RNA, 32 nt, Human
gccucuccagccacugggcucccuucacccug

SEQ ID NO: 174285 - RNA, 32 nt, Human
gccucuccagccuguuugagugcuccacccgg

SEQ ID NO: 174286 - RNA, 32 nt, Human
gccucuccaggcaccaucucccuuccuguggg

SEQ ID NO: 174287 - RNA, 32 nt, Human
gccucuccaucaccaucucucuccacuucccc

SEQ ID NO: 174288 - RNA, 24 nt, Human
gccucuccauccagcaucuucucu

SEQ ID NO: 174289 - RNA, 32 nt, Human
gccucuccauuuggaacccaguggaguuggga

SEQ ID NO: 174290 - RNA, 19 nt, Human
gccucucccacuuuccucu

SEQ ID NO: 174291 - RNA, 32 nt, Human
gccucucccagaggagccgggcugccggugcg

SEQ ID NO: 174292 - RNA, 32 nt, Human
gccucucccagcuccacuucuaaugcuagaga

SEQ ID NO: 174293 - RNA, 32 nt, Human
gccucucccaggucucagcucuggguggggag

SEQ ID NO: 174294 - RNA, 19 nt, Human
gccucucccaguuuccucu

SEQ ID NO: 174295 - RNA, 32 nt, Human
gccucuccccaccuucuuuggagcaaggagau

SEQ ID NO: 174296 - RNA, 32 nt, Human
gccucuccccgcucuggauccugcacucuaac

SEQ ID NO: 174297 - RNA, 32 nt, Human
gccucucccgagagcuggagccaugggagggg

SEQ ID NO: 174298 - RNA, 32 nt, Human
gccucucccugcacucccuccuggagcucugu

SEQ ID NO: 174299 - RNA, 32 nt, Human
gccucuccgaaucucucucuucuccuggcgcu

SEQ ID NO: 174300 - RNA, 32 nt, Human
gccucuccuaacucagcuccugccucaugucg

SEQ ID NO: 174301 - RNA, 32 nt, Human
gccucuccuaccacugugccacugacuugcua

SEQ ID NO: 174302 - RNA, 18 nt, Human
gccucuccuauucaggua

SEQ ID NO: 174303 - RNA, 32 nt, Human
gccucuccuccacagccccaaccucccacccc

SEQ ID NO: 174304 - RNA, 32 nt, Human
gccucuccuccaccucucccuucucaaaauac

SEQ ID NO: 174305 - RNA, 32 nt, Human
gccucuccuccaccuucaccccaagacuaggg

SEQ ID NO: 174306 - RNA, 32 nt, Human
gccucuccucccaagaggccugagagauucac

SEQ ID NO: 174307 - RNA, 32 nt, Human
gccucuccuccccuccccucccucaguccucc

SEQ ID NO: 174308 - RNA, 32 nt, Human
gccucuccugcccaccucuacuucucugugaa

SEQ ID NO: 174309 - RNA, 32 nt, Human
gccucuccuguugccaucagugcccagcaccu

SEQ ID NO: 174310 - RNA, 32 nt, Human
gccucuccuucucuuccuucacuuugcagagg

SEQ ID NO: 174311 - RNA, 32 nt, Human
gccucuccuuuaaaacaaaucaagcauuuucu

SEQ ID NO: 174312 - RNA, 32 nt, Human
gccucuccuuucuccgcccgcccgccugcuuu

SEQ ID NO: 174313 - RNA, 32 nt, Human
gccucuccuuucucucuguccugucgucucuu

SEQ ID NO: 174314 - RNA, 24 nt, Human
gccucucgaccgccugaggcccuu

SEQ ID NO: 174315 - RNA, 32 nt, Human
gccucucgaugggcagcucgcacuugcucaac

SEQ ID NO: 174316 - RNA, 32 nt, Human
gccucucgcuaccacuuccucuuccaacuaca

SEQ ID NO: 174317 - RNA, 32 nt, Human
gccucucggugcugcugacggcggccacagug

SEQ ID NO: 174318 - RNA, 32 nt, Human
gccucucgucuccagccagcaccaagaggaug

SEQ ID NO: 174319 - RNA, 21 nt, Human
gccucucuauccucucuccuc

SEQ ID NO: 174320 - RNA, 32 nt, Human
gccucucucacuuuccuccuucccucuuuguu

SEQ ID NO: 174321 - RNA, 32 nt, Human
gccucucucagcccaggucuccugggcaucug

SEQ ID NO: 174322 - RNA, 17 nt, Human
gccucucucaucugcca

SEQ ID NO: 174323 - RNA, 32 nt, Human
gccucucuccaccgccuccucuggcuccccgg

SEQ ID NO: 174324 - RNA, 32 nt, Human
gccucucuccccuuggcgucugaugaccacag

SEQ ID NO: 174325 - RNA, 19 nt, Human
gccucucucccgcccagcc

SEQ ID NO: 174326 - RNA, 32 nt, Human
gccucucucccuccuuucagcccucuccaggu

SEQ ID NO: 174327 - RNA, 32 nt, Human
gccucucuccugcugcuccuccagcuguaucu

SEQ ID NO: 174328 - RNA, 32 nt, Human
gccucucuccuggagugagggggcugaaguca

SEQ ID NO: 174329 - RNA, 32 nt, Human
gccucucucucccauuagaaugccaucaccuc

SEQ ID NO: 174330 - RNA, 20 nt, Human
gccucucucucccauucaga

SEQ ID NO: 174331 - RNA, 20 nt, Human
gccucucucucccucccucu

SEQ ID NO: 174332 - RNA, 21 nt, Human
gccucucucuccuccucuucu

SEQ ID NO: 174333 - RNA, 32 nt, Human
gccucucucugccucuuuucuccugucccucc

SEQ ID NO: 174334 - RNA, 24 nt, Human
gccucucugaaauguccauccacu

SEQ ID NO: 174335 - RNA, 32 nt, Human
gccucucugaaggaugugcguggucauccacu

SEQ ID NO: 174336 - RNA, 20 nt, Human
gccucucugagcugguuucc

SEQ ID NO: 174337 - RNA, 32 nt, Human
gccucucugaggaggagguggccaagaagcgg

SEQ ID NO: 174338 - RNA, 32 nt, Human
gccucucugaggcggaggaugcgggagcgcau

SEQ ID NO: 174339 - RNA, 27 nt, Human
gccucucugaugcacucucuuccaucu

SEQ ID NO: 174340 - RNA, 24 nt, Human
gccucucugauucucucucccucu

SEQ ID NO: 174341 - RNA, 32 nt, Human
gccucucugcagcugcuagcucagacaccaaa

SEQ ID NO: 174342 - RNA, 27 nt, Human
gccucucugcccaccucugcuuccucu

SEQ ID NO: 174343 - RNA, 32 nt, Human
gccucucugcccaccucugcuuccucuaggaa

SEQ ID NO: 174344 - RNA, 23 nt, Human
gccucucugcccaggcucuccuc

SEQ ID NO: 174345 - RNA, 32 nt, Human
gccucucugccugaaucugccucucucugccu

SEQ ID NO: 174346 - RNA, 18 nt, Human
gccucucugcugcugcgu

SEQ ID NO: 174347 - RNA, 21 nt, Human
gccucucuggccucuucccuu

SEQ ID NO: 174348 - RNA, 23 nt, Human
gccucucugggaagcucuuccuc

SEQ ID NO: 174349 - RNA, 32 nt, Human
gccucucugggcuggaggugggggugggggca

SEQ ID NO: 174350 - RNA, 24 nt, Human
gccucucuguacaguaacgccacu

SEQ ID NO: 174351 - RNA, 22 nt, Human
gccucucugucaucuccccuuc

SEQ ID NO: 174352 - RNA, 18 nt, Human
gccucucuguccuucccu

SEQ ID NO: 174353 - RNA, 32 nt, Human
gccucucugugaagcuccucaagugccacccu

SEQ ID NO: 174354 - RNA, 19 nt, Human
gccucucugugccagggag

SEQ ID NO: 174355 - RNA, 25 nt, Human
gccucucugugggccucucuccagg

SEQ ID NO: 174356 - RNA, 22 nt, Human
gccucucuguuucccuccuucu

SEQ ID NO: 174357 - RNA, 32 nt, Human
gccucucuucacacacuuggcggugaggaucg

SEQ ID NO: 174358 - RNA, 32 nt, Human
gccucucuucauuuucuuucaucuacauggcu

SEQ ID NO: 174359 - RNA, 32 nt, Human
gccucucuucucuucucuuccuccuccacuuc

SEQ ID NO: 174360 - RNA, 21 nt, Human
gccucucuugguuccuuccuu

SEQ ID NO: 174361 - RNA, 22 nt, Human
gccucugaacccccuuucccca

SEQ ID NO: 174362 - RNA, 32 nt, Human
gccucugaacucagcuggcuugagaagcccag

SEQ ID NO: 174363 - RNA, 32 nt, Human
gccucugaagggauuccucacugugggcagcu

SEQ ID NO: 174364 - RNA, 32 nt, Human
gccucugaauauacacagauugccaaagucac

SEQ ID NO: 174365 - RNA, 32 nt, Human
gccucugacacacagcucuguccugggaguga

SEQ ID NO: 174366 - RNA, 18 nt, Human
gccucugacuccacuucu

SEQ ID NO: 174367 - RNA, 32 nt, Human
gccucugacucuguccccaugggcuggucucc

SEQ ID NO: 174368 - RNA, 21 nt, Human
gccucugagccagccucccca

SEQ ID NO: 174369 - RNA, 32 nt, Human
gccucugagccccaggcccggcccagcccgcc

SEQ ID NO: 174370 - RNA, 32 nt, Human
gccucugagccccggccucggaccgcccacuc

SEQ ID NO: 174371 - RNA, 32 nt, Human
gccucugagccccugaucugaagccagaaggg

SEQ ID NO: 174372 - RNA, 32 nt, Human
gccucugaguagcugggacuacaagugcaugc

SEQ ID NO: 174373 - RNA, 32 nt, Human
gccucugaguagcugggauuacaggcacacac

SEQ ID NO: 174374 - RNA, 32 nt, Human
gccucugagugaggacagcaggcagggacugu

SEQ ID NO: 174375 - RNA, 25 nt, Human
gccucugaguuagguacccaagcca

SEQ ID NO: 174376 - RNA, 32 nt, Human
gccucugaucagugaugaccuugguaugcugg

SEQ ID NO: 174377 - RNA, 32 nt, Human
gccucugauuuacacugguucaauuuacaaau

SEQ ID NO: 174378 - RNA, 32 nt, Human
gccucugcaacagcucugccuccucuccagug

SEQ ID NO: 174379 - RNA, 32 nt, Human
gccucugcaacuugagccuggcugcgaccccu

SEQ ID NO: 174380 - RNA, 32 nt, Human
gccucugcacacacauuggcggguggggugca

SEQ ID NO: 174381 - RNA, 32 nt, Human
gccucugcacuccagccugggugacagaguga

SEQ ID NO: 174382 - RNA, 21 nt, Human
gccucugcagagccaccagcc

SEQ ID NO: 174383 - RNA, 32 nt, Human
gccucugcagagccaccagccaugcccgggau

SEQ ID NO: 174384 - RNA, 32 nt, Human
gccucugcagaggggaccucagccugucacug

SEQ ID NO: 174385 - RNA, 32 nt, Human
gccucugcagcccaagacucaggcuggggcca

SEQ ID NO: 174386 - RNA, 32 nt, Human
gccucugcagcucgaggcaaggccuggggugc

SEQ ID NO: 174387 - RNA, 21 nt, Human
gccucugcagggcaaggcagg

SEQ ID NO: 174388 - RNA, 32 nt, Human
gccucugcagggugguccagccuaggugacag

SEQ ID NO: 174389 - RNA, 32 nt, Human
gccucugcaggugaccguaacaacaugcaaau

SEQ ID NO: 174390 - RNA, 32 nt, Human
gccucugcauuccagccuuggugacagagcaa

SEQ ID NO: 174391 - RNA, 32 nt, Human
gccucugccacaccugguggcugaacaucucu

SEQ ID NO: 174392 - RNA, 16 nt, Human
gccucugccacccaga

SEQ ID NO: 174393 - RNA, 32 nt, Human
gccucugccacccuccaccuccucggucagcc

SEQ ID NO: 174394 - RNA, 21 nt, Human
gccucugccagcagccgcucg

SEQ ID NO: 174395 - RNA, 32 nt, Human
gccucugccaugggacaccaccucucaggcag

SEQ ID NO: 174396 - RNA, 32 nt, Human
gccucugcccacccuuccccaggccucugcca

SEQ ID NO: 174397 - RNA, 20 nt, Human
gccucugcccaccucuucuc

SEQ ID NO: 174398 - RNA, 19 nt, Human
gccucugcccagccaagcc

SEQ ID NO: 174399 - RNA, 32 nt, Human
gccucugccccacugccagccugagugggcaa

SEQ ID NO: 174400 - RNA, 16 nt, Human
gccucugccccagccc

SEQ ID NO: 174401 - RNA, 32 nt, Human
gccucugccccagcccacuggcaugccaccca

SEQ ID NO: 174402 - RNA, 18 nt, Human
gccucugcccccagggug

SEQ ID NO: 174403 - RNA, 18 nt, Human
gccucugccccucagggg

SEQ ID NO: 174404 - RNA, 32 nt, Human
gccucugcccuccuccagcccggauggcucuc

SEQ ID NO: 174405 - RNA, 32 nt, Human
gccucugcccuccuucugucuccugggugguc

SEQ ID NO: 174406 - RNA, 20 nt, Human
gccucugccgccgccgccgc

SEQ ID NO: 174407 - RNA, 17 nt, Human
gccucugccuccagccc

SEQ ID NO: 174408 - RNA, 18 nt, Human
gccucugccucccaagua

SEQ ID NO: 174409 - RNA, 32 nt, Human
gccucugccucccggguucaagcaauucuccu

SEQ ID NO: 174410 - RNA, 32 nt, Human
gccucugccuccuggguucaagcgauucuccu

SEQ ID NO: 174411 - RNA, 32 nt, Human
gccucugccuccuggguuccaagcgauucucc

SEQ ID NO: 174412 - RNA, 17 nt, Human
gccucugccucgggcca

SEQ ID NO: 174413 - RNA, 32 nt, Human
gccucugccucucucagccgcaucacccuguu

SEQ ID NO: 174414 - RNA, 32 nt, Human
gccucugccugccucccgccugugcacucugg

SEQ ID NO: 174415 - RNA, 32 nt, Human
gccucugccuugccugcauacaugcaauguau

SEQ ID NO: 174416 - RNA, 21 nt, Human
gccucugcgccugucccuccc

SEQ ID NO: 174417 - RNA, 32 nt, Human
gccucugcuacagcguggagugggauggcucu

SEQ ID NO: 174418 - RNA, 32 nt, Human
gccucugcuccugcccauagacauuuucuuac

SEQ ID NO: 174419 - RNA, 32 nt, Human
gccucugcuccugcuccugccugcauguucuc

SEQ ID NO: 174420 - RNA, 32 nt, Human
gccucugcucugauuacugcucugccuuccau

SEQ ID NO: 174421 - RNA, 32 nt, Human
gccucugcugaguguaccugacaguaagucua

SEQ ID NO: 174422 - RNA, 32 nt, Human
gccucugcuggagccccugccugaccagcuuc

SEQ ID NO: 174423 - RNA, 32 nt, Human
gccucugcugggacagggaacagagggaugcg

SEQ ID NO: 174424 - RNA, 32 nt, Human
gccucugcugggacagggaauagagggaugug

SEQ ID NO: 174425 - RNA, 19 nt, Human
gccucugcuguccuuccca

SEQ ID NO: 174426 - RNA, 32 nt, Human
gccucugcuguuccugucuuugcucacacccu

SEQ ID NO: 174427 - RNA, 32 nt, Human
gccucuggaccugcuacagaucaaagacuccu

SEQ ID NO: 174428 - RNA, 32 nt, Human
gccucuggaccugcuggucugcacugacagcc

SEQ ID NO: 174429 - RNA, 32 nt, Human
gccucuggagaugcuuaggaugcugaauuuua

SEQ ID NO: 174430 - RNA, 32 nt, Human
gccucuggauccuccguggaccgaaccguccc

SEQ ID NO: 174431 - RNA, 32 nt, Human
gccucuggauccuggggaagguuccagucccu

SEQ ID NO: 174432 - RNA, 32 nt, Human
gccucuggauggcccugcccugacuggggcug

SEQ ID NO: 174433 - RNA, 32 nt, Human
gccucuggauucucuucauggccagguggcug

SEQ ID NO: 174434 - RNA, 32 nt, Human
gccucuggcagcguucucaggcuagcccuccc

SEQ ID NO: 174435 - RNA, 19 nt, Human
gccucuggccauugccaua

SEQ ID NO: 174436 - RNA, 32 nt, Human
gccucuggcccaggccccuccccaccagggcu

SEQ ID NO: 174437 - RNA, 17 nt, Human
gccucuggccucugaug

SEQ ID NO: 174438 - RNA, 23 nt, Human
gccucuggcgcccccacucaaga

SEQ ID NO: 174439 - RNA, 32 nt, Human
gccucuggcugaggcaguagcauagaggaucc

SEQ ID NO: 174440 - RNA, 32 nt, Human
gccucuggcugcagaagagcaggaccacaauc

SEQ ID NO: 174441 - RNA, 32 nt, Human
gccucuggcugcagaauacaaagucccgggcu

SEQ ID NO: 174442 - RNA, 32 nt, Human
gccucuggcuuccauucugggccuggcaaggc

SEQ ID NO: 174443 - RNA, 32 nt, Human
gccucuggcuucccuuggagaggggcagaguc

SEQ ID NO: 174444 - RNA, 32 nt, Human
gccucugggaagcacaggccagcaccucccca

SEQ ID NO: 174445 - RNA, 32 nt, Human
gccucugggaccccgccucgccucugagacac

SEQ ID NO: 174446 - RNA, 32 nt, Human
gccucugggaccucggggucccagggaaccca

SEQ ID NO: 174447 - RNA, 32 nt, Human
gccucugggagagaggaagaagaaaggggccc

SEQ ID NO: 174448 - RNA, 32 nt, Human
gccucugggagcccccuaggaagcaccagccu

SEQ ID NO: 174449 - RNA, 32 nt, Human
gccucugggaggcgcagaugcccacacagcca

SEQ ID NO: 174450 - RNA, 32 nt, Human
gccucugggagguguaacugaggcaggcaucg

SEQ ID NO: 174451 - RNA, 32 nt, Human
gccucugggauuauacucugaagaacccgcag

SEQ ID NO: 174452 - RNA, 32 nt, Human
gccucugggauuccaccuugcuaucucugcuc

SEQ ID NO: 174453 - RNA, 32 nt, Human
gccucugggcaggcuugcuuuuaugggggagg

SEQ ID NO: 174454 - RNA, 22 nt, Human
gccucugggccaugccaggcca

SEQ ID NO: 174455 - RNA, 32 nt, Human
gccucugggcccugaaccccugcuggggcucc

SEQ ID NO: 174456 - RNA, 32 nt, Human
gccucugggccugugugucugugagcucaacc

SEQ ID NO: 174457 - RNA, 32 nt, Human
gccucuggggccuuggcacacacacauucgug

SEQ ID NO: 174458 - RNA, 32 nt, Human
gccucugguagccuuaagcccaaagggcagug

SEQ ID NO: 174459 - RNA, 32 nt, Human
gccucuggugagccaacggggcccaguccccu

SEQ ID NO: 174460 - RNA, 32 nt, Human
gccucugguggaccucuggugggcaggagcuu

SEQ ID NO: 174461 - RNA, 32 nt, Human
gccucugguguuuucccugcccaggcuggagc

SEQ ID NO: 174462 - RNA, 32 nt, Human
gccucugguguuuuccgugcccaggcuggagc

SEQ ID NO: 174463 - RNA, 32 nt, Human
gccucuguaaccuuccacccccucugcggaag

SEQ ID NO: 174464 - RNA, 32 nt, Human
gccucuguaagccuguguauguuaucaauacu

SEQ ID NO: 174465 - RNA, 32 nt, Human
gccucuguaccauuuuuccuugagugugcuuu

SEQ ID NO: 174466 - RNA, 31 nt, Human
gccucuguaugcccuaggccugugccaaagu

SEQ ID NO: 174467 - RNA, 32 nt, Human
gccucugucagagguguuuaaaccagauugac

SEQ ID NO: 174468 - RNA, 19 nt, Human
gccucugucccauauccaa

SEQ ID NO: 174469 - RNA, 21 nt, Human
gccucuguccccuccaccucu

SEQ ID NO: 174470 - RNA, 32 nt, Human
gccucugucgcccaggcuggagugcaguggcg

SEQ ID NO: 174471 - RNA, 18 nt, Human
gccucugucucuuccgcu

SEQ ID NO: 174472 - RNA, 24 nt, Human
gccucugucuuccuuggggcaccu

SEQ ID NO: 174473 - RNA, 32 nt, Human
gccucugugaccaccugcuagagggagauucu

SEQ ID NO: 174474 - RNA, 32 nt, Human
gccucuguggaggaugcaggauugggcuuggg

SEQ ID NO: 174475 - RNA, 32 nt, Human
gccucuguggcacagcugcuugccauugccug

SEQ ID NO: 174476 - RNA, 32 nt, Human
gccucuguggggagucugccucccagacuggc

SEQ ID NO: 174477 - RNA, 32 nt, Human
gccucuguuggcacaggucuggagaagugcag

SEQ ID NO: 174478 - RNA, 32 nt, Human
gccucuguuuaucucugaccucaucgcuuacu

SEQ ID NO: 174479 - RNA, 32 nt, Human
gccucuguuuccuguaccagauuuuuguauuc

SEQ ID NO: 174480 - RNA, 24 nt, Human
gccucuguuuucucaucugugaaa

SEQ ID NO: 174481 - RNA, 25 nt, Human
gccucuuaagucuguucucugggga

SEQ ID NO: 174482 - RNA, 22 nt, Human
gccucuuacucccugggcaccu

SEQ ID NO: 174483 - RNA, 32 nt, Human
gccucuuacuugggcugaccugacccccgaaa

SEQ ID NO: 174484 - RNA, 32 nt, Human
gccucuuagcagagccaaaagccagcagagag

SEQ ID NO: 174485 - RNA, 22 nt, Human
gccucuuagcagccucuucccu

SEQ ID NO: 174486 - RNA, 32 nt, Human
gccucuuauuugauguggaucagagcuaagau

SEQ ID NO: 174487 - RNA, 32 nt, Human
gccucuucacuuccccuaaaccccugucccau

SEQ ID NO: 174488 - RNA, 19 nt, Human
gccucuucagccuuucuca

SEQ ID NO: 174489 - RNA, 19 nt, Human
gccucuucagucugucuca

SEQ ID NO: 174490 - RNA, 18 nt, Human
gccucuucauccguccag

SEQ ID NO: 174491 - RNA, 32 nt, Human
gccucuuccacucuggagugaaguuaaugaaa

SEQ ID NO: 174492 - RNA, 32 nt, Human
gccucuuccacugugaucuccuccagggcuuu

SEQ ID NO: 174493 - RNA, 32 nt, Human
gccucuuccaucuuuugccacugaucuugugu

SEQ ID NO: 174494 - RNA, 32 nt, Human
gccucuuccauugaccagcugugugaccuugg

SEQ ID NO: 174495 - RNA, 22 nt, Human
gccucuuccccaagccgagcca

SEQ ID NO: 174496 - RNA, 32 nt, Human
gccucuuccccgcaggcucuggcuggccgcag

SEQ ID NO: 174497 - RNA, 32 nt, Human
gccucuucccucuuccuucccugcugugaaag

SEQ ID NO: 174498 - RNA, 32 nt, Human
gccucuucccuggggcugaaucaggcccugcu

SEQ ID NO: 174499 - RNA, 32 nt, Human
gccucuuccucccucccugcaggguagggcgc

SEQ ID NO: 174500 - RNA, 19 nt, Human
gccucuuccuccucaggga

SEQ ID NO: 174501 - RNA, 32 nt, Human
gccucuuccuuggggguggcuaccuccaaaaa

SEQ ID NO: 174502 - RNA, 32 nt, Human
gccucuucggacccucucucacucccugucuu

SEQ ID NO: 174503 - RNA, 21 nt, Human
gccucuucggccuccucgccc

SEQ ID NO: 174504 - RNA, 19 nt, Human
gccucuucuccaucugaga

SEQ ID NO: 174505 - RNA, 15 nt, Human
gccucuucucucaga

SEQ ID NO: 174506 - RNA, 32 nt, Human
gccucuucucuucagcucccuuagcuuggcuc

SEQ ID NO: 174507 - RNA, 18 nt, Human
gccucuucugcccaggug

SEQ ID NO: 174508 - RNA, 32 nt, Human
gccucuucugcgcgcacaaccuaggcaguaau

SEQ ID NO: 174509 - RNA, 32 nt, Human
gccucuucuggaccaggaaacucuccacauau

SEQ ID NO: 174510 - RNA, 32 nt, Human
gccucuucuggccuggugucuccucaugcccc

SEQ ID NO: 174511 - RNA, 32 nt, Human
gccucuucugggagaccccucuccccacguag

SEQ ID NO: 174512 - RNA, 32 nt, Human
gccucuucugggcuacugccacugugugccuu

SEQ ID NO: 174513 - RNA, 32 nt, Human
gccucuucuucgcccuguucugugccagacgc

SEQ ID NO: 174514 - RNA, 17 nt, Human
gccucuucuucuucaga

SEQ ID NO: 174515 - RNA, 32 nt, Human
gccucuugaaugcuuaaaugaucaaggaggga

SEQ ID NO: 174516 - RNA, 32 nt, Human
gccucuugagcaguggcugguccagggcuagu

SEQ ID NO: 174517 - RNA, 24 nt, Human
gccucuugccugcucuggccuccu

SEQ ID NO: 174518 - RNA, 32 nt, Human
gccucuugcucgcucuagcugcugggaggaaa

SEQ ID NO: 174519 - RNA, 32 nt, Human
gccucuugcugccauucuuucucuccucugcu

SEQ ID NO: 174520 - RNA, 32 nt, Human
gccucuuggagacagaugaugacuggcaagga

SEQ ID NO: 174521 - RNA, 32 nt, Human
gccucuuggaugcacacuuuguguguacauag

SEQ ID NO: 174522 - RNA, 29 nt, Human
gccucuuggcugcuuccaguucccgccau

SEQ ID NO: 174523 - RNA, 32 nt, Human
gccucuuggcugcuuccaguucccgccauuac

SEQ ID NO: 174524 - RNA, 32 nt, Human
gccucuugggccaggcugugcccagccagccc

SEQ ID NO: 174525 - RNA, 32 nt, Human
gccucuugguacugcugaccccagccaggcua

SEQ ID NO: 174526 - RNA, 32 nt, Human
gccucuuggugcugccuuggccguauuuggca

SEQ ID NO: 174527 - RNA, 32 nt, Human
gccucuugguuucuuuucuugccuuccccuac

SEQ ID NO: 174528 - RNA, 20 nt, Human
gccucuuguccuccugccuc

SEQ ID NO: 174529 - RNA, 32 nt, Human
gccucuuguccucuccccaguggcuccaggcc

SEQ ID NO: 174530 - RNA, 32 nt, Human
gccucuuguuuuccaucuucauggccuuuucu

SEQ ID NO: 174531 - RNA, 32 nt, Human
gccucuuucacacccacuacagaccucagccc

SEQ ID NO: 174532 - RNA, 32 nt, Human
gccucuuucacucagaagcucaggucgccucc

SEQ ID NO: 174533 - RNA, 32 nt, Human
gccucuuuccagggaagccucauucuacugcu

SEQ ID NO: 174534 - RNA, 32 nt, Human
gccucuuucccagcuuucuugcuugccuucug

SEQ ID NO: 174535 - RNA, 32 nt, Human
gccucuuuccucagccuuaagaaccaucugcc

SEQ ID NO: 174536 - RNA, 18 nt, Human
gccucuuuccuccuccuc

SEQ ID NO: 174537 - RNA, 32 nt, Human
gccucuuucucagguccugcaggcuggucucu

SEQ ID NO: 174538 - RNA, 24 nt, Human
gccucuuucuccucucugcccccu

SEQ ID NO: 174539 - RNA, 32 nt, Human
gccucuuucugcucuaucuccaccuccuuuuc

SEQ ID NO: 174540 - RNA, 32 nt, Human
gccucuuucuuucugcucccucauucucuccc

SEQ ID NO: 174541 - RNA, 32 nt, Human
gccucuuugccucugcuuugucaugccauuaa

SEQ ID NO: 174542 - RNA, 32 nt, Human
gccucuuugcuacuuugugagggaggcaggaa

SEQ ID NO: 174543 - RNA, 32 nt, Human
gccucuuugcucuccccucuugccucaggaaa

SEQ ID NO: 174544 - RNA, 32 nt, Human
gccucuuugcugcaaaagggaauuggaaaguc

SEQ ID NO: 174545 - RNA, 32 nt, Human
gccucuuugcugcuuuguuuuccuccugauuc

SEQ ID NO: 174546 - RNA, 32 nt, Human
gccucuuuguccauuauucauuuuguggcaaa

SEQ ID NO: 174547 - RNA, 32 nt, Human
gccucuuugugagccuccuggcugggugcuca

SEQ ID NO: 174548 - RNA, 32 nt, Human
gccucuuugugccaggcaugugggugucuuag

SEQ ID NO: 174549 - RNA, 32 nt, Human
gccucuuuucaugugggaugaagacaucugug

SEQ ID NO: 174550 - RNA, 32 nt, Human
gccucuuuuccccuuaacaaggauuucuuaug

SEQ ID NO: 174551 - RNA, 32 nt, Human
gccucuuuucuccugucccuccaggagucucu

SEQ ID NO: 174552 - RNA, 32 nt, Human
gccucuuuugccgguauucagugaagaaagca

SEQ ID NO: 174553 - RNA, 32 nt, Human
gccucuuuuguaugugggagaccaugguguug

SEQ ID NO: 174554 - RNA, 21 nt, Human
gccugaaaaggagcagccucg

SEQ ID NO: 174555 - RNA, 32 nt, Human
gccugaaaaguggcauggugcguggggccugg

SEQ ID NO: 174556 - RNA, 32 nt, Human
gccugaaacaacaccucugccugugcucccac

SEQ ID NO: 174557 - RNA, 32 nt, Human
gccugaaacagccuggaucuuauuccuguacu

SEQ ID NO: 174558 - RNA, 24 nt, Human
gccugaaaccccagcuacuuggga

SEQ ID NO: 174559 - RNA, 32 nt, Human
gccugaaacgcccaugugccacugacuaggag

SEQ ID NO: 174560 - RNA, 32 nt, Human
gccugaaagagacacagucacauggccagaug

SEQ ID NO: 174561 - RNA, 32 nt, Human
gccugaaagagagcaagaacauguggaucuuu

SEQ ID NO: 174562 - RNA, 32 nt, Human
gccugaaagugcuaggauuacaggcgugagcc

SEQ ID NO: 174563 - RNA, 21 nt, Human
gccugaaauccaagucuuccu

SEQ ID NO: 174564 - RNA, 21 nt, Human
gccugaaaucccagcuacuca

SEQ ID NO: 174565 - RNA, 24 nt, Human
gccugaaaucccagcuacucaaga

SEQ ID NO: 174566 - RNA, 24 nt, Human
gccugaaaucccagcuacuuggga

SEQ ID NO: 174567 - RNA, 32 nt, Human
gccugaacagccccuucucucccuccaccccc

SEQ ID NO: 174568 - RNA, 32 nt, Human
gccugaacccagaagcggagguugcagugagc

SEQ ID NO: 174569 - RNA, 32 nt, Human
gccugaacccagaggcggagguuguagugagc

SEQ ID NO: 174570 - RNA, 32 nt, Human
gccugaacccaggaagcagauguuguaccgag

SEQ ID NO: 174571 - RNA, 32 nt, Human
gccugaacccaggaggcagagguugcaguaag

SEQ ID NO: 174572 - RNA, 32 nt, Human
gccugaacccaggaggcagagguugcggugag

SEQ ID NO: 174573 - RNA, 32 nt, Human
gccugaacccaggaggcggagcuugcagugag

SEQ ID NO: 174574 - RNA, 32 nt, Human
gccugaacccaggaggcggagguugcagggag

SEQ ID NO: 174575 - RNA, 32 nt, Human
gccugaacccaggaggcggagguugcagugag

SEQ ID NO: 174576 - RNA, 32 nt, Human
gccugaacccaggagguggagguugcagugag

SEQ ID NO: 174577 - RNA, 32 nt, Human
gccugaaccccagggcuguaacugccaggcuc

SEQ ID NO: 174578 - RNA, 32 nt, Human
gccugaaccccggccuccacccugggggaggc

SEQ ID NO: 174579 - RNA, 32 nt, Human
gccugaacccgggaggcagaggcugcagugag

SEQ ID NO: 174580 - RNA, 32 nt, Human
gccugaaccuaggagguggaggcugcagcgag

SEQ ID NO: 174581 - RNA, 32 nt, Human
gccugaacgugccuucagaggaggaggucuac

SEQ ID NO: 174582 - RNA, 32 nt, Human
gccugaacucaggcagcccuucaguggcuucu

SEQ ID NO: 174583 - RNA, 32 nt, Human
gccugaacugugcccccacccuccaggaaggg

SEQ ID NO: 174584 - RNA, 32 nt, Human
gccugaacuuuccuuccugucacugugaauac

SEQ ID NO: 174585 - RNA, 32 nt, Human
gccugaagacgaagagaaagagcaagguuauu

SEQ ID NO: 174586 - RNA, 32 nt, Human
gccugaagagccccaaagcaggaagaagcucc

SEQ ID NO: 174587 - RNA, 32 nt, Human
gccugaagauccaggaggacuucuuggaggag

SEQ ID NO: 174588 - RNA, 24 nt, Human
gccugaagcaauccgcccaccuca

SEQ ID NO: 174589 - RNA, 32 nt, Human
gccugaagcagaagguggugacccuggcaagc

SEQ ID NO: 174590 - RNA, 32 nt, Human
gccugaagccugggcaauaagugagaguuaga

SEQ ID NO: 174591 - RNA, 32 nt, Human
gccugaagcuacucgaugggcgagguccgccc

SEQ ID NO: 174592 - RNA, 32 nt, Human
gccugaaggagaaggguggagugagaugggaa

SEQ ID NO: 174593 - RNA, 32 nt, Human
gccugaaguacacucucgcugugcugucauuc

SEQ ID NO: 174594 - RNA, 21 nt, Human
gccugaagucccagcuacuca

SEQ ID NO: 174595 - RNA, 24 nt, Human
gccugaagucccagcuacucagga

SEQ ID NO: 174596 - RNA, 32 nt, Human
gccugaagugguagccccgccugcugcuucuc

SEQ ID NO: 174597 - RNA, 32 nt, Human
gccugaauacuggcccuggacucccuuuucca

SEQ ID NO: 174598 - RNA, 32 nt, Human
gccugaauccaucaggacuugggaaacagaga

SEQ ID NO: 174599 - RNA, 32 nt, Human
gccugaaucuucaguuccccagucucgggggc

SEQ ID NO: 174600 - RNA, 32 nt, Human
gccugaauggcagaagaagaagaggaaaacuc

SEQ ID NO: 174601 - RNA, 18 nt, Human
gccugaauuccugacaca

SEQ ID NO: 174602 - RNA, 32 nt, Human
gccugaauucuuucuuuucgccgacacgaugg

SEQ ID NO: 174603 - RNA, 32 nt, Human
gccugaauuucaguggccucagccugagccug

SEQ ID NO: 174604 - RNA, 32 nt, Human
gccugaauuuggauugccugcucucuuuaaag

SEQ ID NO: 174605 - RNA, 32 nt, Human
gccugacacaggacaggagcugcacgaguuug

SEQ ID NO: 174606 - RNA, 32 nt, Human
gccugacacccaaggcuggauguuugugcucc

SEQ ID NO: 174607 - RNA, 32 nt, Human
gccugacacccagggaugagcaguguccagug

SEQ ID NO: 174608 - RNA, 24 nt, Human
gccugacacucauggcuuccuagg

SEQ ID NO: 174609 - RNA, 23 nt, Human
gccugacagagacccccagggca

SEQ ID NO: 174610 - RNA, 32 nt, Human
gccugacagccuggcuagcacaggaggacaug

SEQ ID NO: 174611 - RNA, 17 nt, Human
gccugacaguccaccuc

SEQ ID NO: 174612 - RNA, 32 nt, Human
gccugacagugaugggacagggaggcuucagu

SEQ ID NO: 174613 - RNA, 32 nt, Human
gccugacaucuucugcccugguccccuuucuc

SEQ ID NO: 174614 - RNA, 32 nt, Human
gccugacauggugaaaccccaucucuacgaaa

SEQ ID NO: 174615 - RNA, 32 nt, Human
gccugaccacagauucccagagggccaggugu

SEQ ID NO: 174616 - RNA, 32 nt, Human
gccugaccaccaccccugcacccccagacaaa

SEQ ID NO: 174617 - RNA, 32 nt, Human
gccugaccaccauccugccaccaccuucucuu

SEQ ID NO: 174618 - RNA, 32 nt, Human
gccugaccaggaguucgaggcugcagugagcc

SEQ ID NO: 174619 - RNA, 32 nt, Human
gccugacccacugcccuagccccacgcuaugc

SEQ ID NO: 174620 - RNA, 18 nt, Human
gccugacccagcugcccg

SEQ ID NO: 174621 - RNA, 32 nt, Human
gccugacccaggccggccagcauggcagagag

SEQ ID NO: 174622 - RNA, 32 nt, Human
gccugacccaggcugcuaagagggcaaggaga

SEQ ID NO: 174623 - RNA, 32 nt, Human
gccugacccauacaaaagucugggacaggggc

SEQ ID NO: 174624 - RNA, 32 nt, Human
gccugaccccacugcagccucugcccagccag

SEQ ID NO: 174625 - RNA, 32 nt, Human
gccugacccuagaauggggacagggaaaguga

SEQ ID NO: 174626 - RNA, 32 nt, Human
gccugacccuggucuggucucagaaucacuuu

SEQ ID NO: 174627 - RNA, 32 nt, Human
gccugaccggcuccauggcagcuccccaucuu

SEQ ID NO: 174628 - RNA, 32 nt, Human
gccugaccucaagugauccguccgccucggcc

SEQ ID NO: 174629 - RNA, 32 nt, Human
gccugaccuccaccguaccuccacaucacuau

SEQ ID NO: 174630 - RNA, 32 nt, Human
gccugaccucgaccuccgccgugcgggcccga

SEQ ID NO: 174631 - RNA, 21 nt, Human
gccugaccuggcugcugcucu

SEQ ID NO: 174632 - RNA, 32 nt, Human
gccugaccugguguauugcuggauucuuggcc

SEQ ID NO: 174633 - RNA, 32 nt, Human
gccugaccuguguuuuggcaaggugauccuuc

SEQ ID NO: 174634 - RNA, 32 nt, Human
gccugaccuugaggagucuugugugcauugcu

SEQ ID NO: 174635 - RNA, 32 nt, Human
gccugacgaaauggaaacacacacagacacac

SEQ ID NO: 174636 - RNA, 21 nt, Human
gccugacgcuggagugcggug

SEQ ID NO: 174637 - RNA, 32 nt, Human
gccugacggagccggaggcugggagccgcggc

SEQ ID NO: 174638 - RNA, 32 nt, Human
gccugacggcuucucggcucuacccucacccu

SEQ ID NO: 174639 - RNA, 32 nt, Human
gccugacucagaugucucucuuugccauuuuu

SEQ ID NO: 174640 - RNA, 32 nt, Human
gccugacucaggaagccaggugagaaaaccau

SEQ ID NO: 174641 - RNA, 32 nt, Human
gccugacucagggcagcucagaguguggggca

SEQ ID NO: 174642 - RNA, 17 nt, Human
gccugacuccaaaguca

SEQ ID NO: 174643 - RNA, 32 nt, Human
gccugacucuagacacuaacuuaguuccaggu

SEQ ID NO: 174644 - RNA, 22 nt, Human
gccugacucucucccucccucu

SEQ ID NO: 174645 - RNA, 32 nt, Human
gccugacucugguuccccaacucccuguucug

SEQ ID NO: 174646 - RNA, 32 nt, Human
gccugacugcaacucaccucgaaggcggacca

SEQ ID NO: 174647 - RNA, 32 nt, Human
gccugacugccaggaccccaggucaggggcuc

SEQ ID NO: 174648 - RNA, 32 nt, Human
gccugacuggaagacggacacacguuguggaa

SEQ ID NO: 174649 - RNA, 32 nt, Human
gccugacuggggacaccugagaguaguauagu

SEQ ID NO: 174650 - RNA, 32 nt, Human
gccugacuguauuuuucauccaucuuuucuga

SEQ ID NO: 174651 - RNA, 19 nt, Human
gccugacugugccagggag

SEQ ID NO: 174652 - RNA, 32 nt, Human
gccugacuugcuggagucacacaggaaguugg

SEQ ID NO: 174653 - RNA, 32 nt, Human
gccugacuugggaggccggcggaucagcaauu

SEQ ID NO: 174654 - RNA, 23 nt, Human
gccugacuuucauggaaggagac

SEQ ID NO: 174655 - RNA, 32 nt, Human
gccugagaaauccuggcauuuguagcccaggg

SEQ ID NO: 174656 - RNA, 32 nt, Human
gccugagaacugggaggaagcuggagaaaaga

SEQ ID NO: 174657 - RNA, 19 nt, Human
gccugagacacucaccucu

SEQ ID NO: 174658 - RNA, 32 nt, Human
gccugagacaucugcugcuuggcucaaacugu

SEQ ID NO: 174659 - RNA, 32 nt, Human
gccugagaccaggagguugaggcugcagugag

SEQ ID NO: 174660 - RNA, 32 nt, Human
gccugagaccugggaggaagcuggagaaaaga

SEQ ID NO: 174661 - RNA, 32 nt, Human
gccugagagacauggcuuucagaaaacgggaa

SEQ ID NO: 174662 - RNA, 32 nt, Human
gccugagagaugaagguugcagugagccguga

SEQ ID NO: 174663 - RNA, 32 nt, Human
gccugagaucagcuuaguguuugaaauugcuc

SEQ ID NO: 174664 - RNA, 22 nt, Human
gccugagaucaggaguucaaga

SEQ ID NO: 174665 - RNA, 22 nt, Human
gccugagaucaggaguucgaga

SEQ ID NO: 174666 - RNA, 32 nt, Human
gccugagauggaaagucucuucccugcccugg

SEQ ID NO: 174667 - RNA, 32 nt, Human
gccugagauggcugugccagagguucgacucc

SEQ ID NO: 174668 - RNA, 32 nt, Human
gccugagauucugcauuuuucccaagucccua

SEQ ID NO: 174669 - RNA, 32 nt, Human
gccugagcaacaaaagcaaaacucuaucuuua

SEQ ID NO: 174670 - RNA, 32 nt, Human
gccugagcacaggaguuggaggcugcaguaag

SEQ ID NO: 174671 - RNA, 32 nt, Human
gccugagcagaggugggggaguccacccucuc

SEQ ID NO: 174672 - RNA, 32 nt, Human
gccugagcaguuucguggaggggaagaaacag

SEQ ID NO: 174673 - RNA, 32 nt, Human
gccugagcauaagaacugggauugcaggcgug

SEQ ID NO: 174674 - RNA, 32 nt, Human
gccugagcaugcagccuggagaguguucuugu

SEQ ID NO: 174675 - RNA, 32 nt, Human
gccugagcauggaccugagcucuggcucaugg

SEQ ID NO: 174676 - RNA, 32 nt, Human
gccugagccacgcuggacucuguccguucugc

SEQ ID NO: 174677 - RNA, 32 nt, Human
gccugagcccaggaaggggcugcguggcucac

SEQ ID NO: 174678 - RNA, 32 nt, Human
gccugagcccaggaggucaaggcuacagugag

SEQ ID NO: 174679 - RNA, 32 nt, Human
gccugagcccaggagguggaaacugcagagag

SEQ ID NO: 174680 - RNA, 32 nt, Human
gccugagcccaggagguggagguugcagugag

SEQ ID NO: 174681 - RNA, 32 nt, Human
gccugagcccaggaguucaagaccagcuugug

SEQ ID NO: 174682 - RNA, 32 nt, Human
gccugagcccaggaguuugaggcuccagugag

SEQ ID NO: 174683 - RNA, 32 nt, Human
gccugagcccagggaggucaaggcugcaguga

SEQ ID NO: 174684 - RNA, 32 nt, Human
gccugagcccgcugccccagcaggaggucuac

SEQ ID NO: 174685 - RNA, 32 nt, Human
gccugagcccggcgaggguggggagggcaggc

SEQ ID NO: 174686 - RNA, 32 nt, Human
gccugagccgagagaagagaccugggaaauua

SEQ ID NO: 174687 - RNA, 32 nt, Human
gccugagccgcaaaccaaaauuacaacaguac

SEQ ID NO: 174688 - RNA, 32 nt, Human
gccugagccgggaagcaguugcugugguaccu

SEQ ID NO: 174689 - RNA, 32 nt, Human
gccugagccuagggacaguccccagccuggcc

SEQ ID NO: 174690 - RNA, 32 nt, Human
gccugagccugagagcucagaggauuccugcc

SEQ ID NO: 174691 - RNA, 32 nt, Human
gccugagccugcccugaacccaggacccaagg

SEQ ID NO: 174692 - RNA, 32 nt, Human
gccugagccuucaaaggguaaauuuaaucaug

SEQ ID NO: 174693 - RNA, 32 nt, Human
gccugagcuaggagaguaucuagagggcgugg

SEQ ID NO: 174694 - RNA, 32 nt, Human
gccugagcucaagagguugaggcugcagugag

SEQ ID NO: 174695 - RNA, 22 nt, Human
gccugagcucaggaguuugaga

SEQ ID NO: 174696 - RNA, 32 nt, Human
gccugagcucuaucaccugagcuccccugccc

SEQ ID NO: 174697 - RNA, 32 nt, Human
gccugagcugcuuuuuccugccuggauuucug

SEQ ID NO: 174698 - RNA, 20 nt, Human
gccugagcuuuccucaggga

SEQ ID NO: 174699 - RNA, 32 nt, Human
gccugaggaacccccagaugucaccugugccc

SEQ ID NO: 174700 - RNA, 32 nt, Human
gccugaggaaggagagcgccagcucugggcug

SEQ ID NO: 174701 - RNA, 32 nt, Human
gccugaggagcccuccuggagcucaggaggcc

SEQ ID NO: 174702 - RNA, 32 nt, Human
gccugaggagcuggaggaaggggaagccccca

SEQ ID NO: 174703 - RNA, 32 nt, Human
gccugaggaggaggaggagaagcggaugagau

SEQ ID NO: 174704 - RNA, 32 nt, Human
gccugaggagggagcgugagccucccagagcc

SEQ ID NO: 174705 - RNA, 32 nt, Human
gccugaggauucagugccuggugaggacccau

SEQ ID NO: 174706 - RNA, 32 nt, Human
gccugaggcaggcggaucaugaggucaggaga

SEQ ID NO: 174707 - RNA, 19 nt, Human
gccugaggcaucagcguca

SEQ ID NO: 174708 - RNA, 32 nt, Human
gccugaggccaucccacuaacaggagccaggg

SEQ ID NO: 174709 - RNA, 32 nt, Human
gccugaggcucaggcugugcuggcauaagugc

SEQ ID NO: 174710 - RNA, 32 nt, Human
gccugaggcugaagcagugagagaggcccgug

SEQ ID NO: 174711 - RNA, 32 nt, Human
gccugaggcugcaggcaggggaugaccgggac

SEQ ID NO: 174712 - RNA, 32 nt, Human
gccugaggcuuaggagagcugccuucgcugca

SEQ ID NO: 174713 - RNA, 32 nt, Human
gccugagggaagggaggaaggggcggggagag

SEQ ID NO: 174714 - RNA, 22 nt, Human
gccugagggagaggaaaggaca

SEQ ID NO: 174715 - RNA, 32 nt, Human
gccugagggcaggccagagcugaggggcugcu

SEQ ID NO: 174716 - RNA, 32 nt, Human
gccugagggcuguccagaacugcucacccugc

SEQ ID NO: 174717 - RNA, 32 nt, Human
gccugaggggccugggcucagaguccacgucc

SEQ ID NO: 174718 - RNA, 32 nt, Human
gccugagggugggcaugagucuugccagaaug

SEQ ID NO: 174719 - RNA, 32 nt, Human
gccugaggucagaauuugaacauaucagggac

SEQ ID NO: 174720 - RNA, 22 nt, Human
gccugaggucaggaguucaaga

SEQ ID NO: 174721 - RNA, 22 nt, Human
gccugaggucaggaguucgaga

SEQ ID NO: 174722 - RNA, 32 nt, Human
gccugaggucccaucccucccucagacccaug

SEQ ID NO: 174723 - RNA, 23 nt, Human
gccugagguccucaccuuccucu

SEQ ID NO: 174724 - RNA, 32 nt, Human
gccugaggugugauucaaacucagcucagguc

SEQ ID NO: 174725 - RNA, 32 nt, Human
gccugagucccaggaccuggaagcggcugaaa

SEQ ID NO: 174726 - RNA, 32 nt, Human
gccugagucccaggaggccuccuggaagccca

SEQ ID NO: 174727 - RNA, 32 nt, Human
gccugagucccucagcccugaggugccccuga

SEQ ID NO: 174728 - RNA, 21 nt, Human
gccugaguccuuucuuccucu

SEQ ID NO: 174729 - RNA, 24 nt, Human
gccugagugaaggacaaggacaga

SEQ ID NO: 174730 - RNA, 32 nt, Human
gccugagugaggagaggaaggccagcucccag

SEQ ID NO: 174731 - RNA, 32 nt, Human
gccugagugagggcuucccauugcagacaagc

SEQ ID NO: 174732 - RNA, 32 nt, Human
gccugagugggcccuggggacacugucaccag

SEQ ID NO: 174733 - RNA, 32 nt, Human
gccugaguuccagcuacucaggaggcugaggc

SEQ ID NO: 174734 - RNA, 32 nt, Human
gccugaguucuaguucgugcucugucaacugg

SEQ ID NO: 174735 - RNA, 32 nt, Human
gccugaguugacccauggcaggggagaaagcu

SEQ ID NO: 174736 - RNA, 32 nt, Human
gccugauaaaucuauugaacuuaaacauagaa

SEQ ID NO: 174737 - RNA, 32 nt, Human
gccugauaagcuucaaagcugcuuuauucaau

SEQ ID NO: 174738 - RNA, 32 nt, Human
gccugauagggaggggcaggaggcgugcacga

SEQ ID NO: 174739 - RNA, 32 nt, Human
gccugaucaaggcaccuccucugcccacucgg

SEQ ID NO: 174740 - RNA, 32 nt, Human
gccugaucuggagcuugucccagaucuggagc

SEQ ID NO: 174741 - RNA, 17 nt, Human
gccugaugaaagcuuug

SEQ ID NO: 174742 - RNA, 32 nt, Human
gccugaugacagccagaucuguucacaguuag

SEQ ID NO: 174743 - RNA, 32 nt, Human
gccugaugcccaccccugccagucauuccucc

SEQ ID NO: 174744 - RNA, 32 nt, Human
gccugaugccgccucggucucugggugccggg

SEQ ID NO: 174745 - RNA, 17 nt, Human
gccugaugccucaggug

SEQ ID NO: 174746 - RNA, 32 nt, Human
gccugaugcucucugauagcugugccauaagu

SEQ ID NO: 174747 - RNA, 32 nt, Human
gccugauggaccucuccagcucuggcuuccug

SEQ ID NO: 174748 - RNA, 32 nt, Human
gccugaugucaccucaugauuugcuguuacuu

SEQ ID NO: 174749 - RNA, 32 nt, Human
gccugaugucuuucaaaugggagaggaguaaa

SEQ ID NO: 174750 - RNA, 32 nt, Human
gccugaugugggaacagcucuucucccagaug

SEQ ID NO: 174751 - RNA, 32 nt, Human
gccugauucccaagucuguccucucaauuuca

SEQ ID NO: 174752 - RNA, 32 nt, Human
gccugauugcugacccagucucaggccugugg

SEQ ID NO: 174753 - RNA, 24 nt, Human
gccugauuuuagaauucaccagcu

SEQ ID NO: 174754 - RNA, 31 nt, Human
gccugcaaagguggagucaccaaagcucauu

SEQ ID NO: 174755 - RNA, 32 nt, Human
gccugcaacaggcuggccaacaaggcggugca

SEQ ID NO: 174756 - RNA, 32 nt, Human
gccugcaaccauccugccuuuccccagggguc

SEQ ID NO: 174757 - RNA, 32 nt, Human
gccugcaagauggagguugcagugagcucaga

SEQ ID NO: 174758 - RNA, 32 nt, Human
gccugcaagcacuuaaccagccacccagaguu

SEQ ID NO: 174759 - RNA, 20 nt, Human
gccugcaaucccagcacuuu

SEQ ID NO: 174760 - RNA, 23 nt, Human
gccugcaaucccagcuacucagg

SEQ ID NO: 174761 - RNA, 24 nt, Human
gccugcaaucccagcuacucagga

SEQ ID NO: 174762 - RNA, 23 nt, Human
gccugcaaucccagcuacucggg

SEQ ID NO: 174763 - RNA, 24 nt, Human
gccugcaaucccagcuacucggga

SEQ ID NO: 174764 - RNA, 21 nt, Human
gccugcaaucccagcuacuug

SEQ ID NO: 174765 - RNA, 24 nt, Human
gccugcaaucccagcuacuugaga

SEQ ID NO: 174766 - RNA, 22 nt, Human
gccugcaaucccagcuacuugg

SEQ ID NO: 174767 - RNA, 23 nt, Human
gccugcaaucccagcuacuugga

SEQ ID NO: 174768 - RNA, 32 nt, Human
gccugcaauggggaacaggcccuccccaucag

SEQ ID NO: 174769 - RNA, 32 nt, Human
gccugcaauguagaugagccuuuuaguagagc

SEQ ID NO: 174770 - RNA, 32 nt, Human
gccugcacacagcugcucagcaccauuucauu

SEQ ID NO: 174771 - RNA, 32 nt, Human
gccugcacagcaucgugaauuaacugaagugu

SEQ ID NO: 174772 - RNA, 32 nt, Human
gccugcacagcaucuguuccuucugagaccag

SEQ ID NO: 174773 - RNA, 32 nt, Human
gccugcacagcccaagcccagggaaguguccu

SEQ ID NO: 174774 - RNA, 32 nt, Human
gccugcacagcgacuccagcagcagcacacag

SEQ ID NO: 174775 - RNA, 32 nt, Human
gccugcacaggcccagccucugccucacagca

SEQ ID NO: 174776 - RNA, 32 nt, Human
gccugcacaggcccagccucugccucacagcg

SEQ ID NO: 174777 - RNA, 32 nt, Human
gccugcacaggcucgggggcaggagcaauugc

SEQ ID NO: 174778 - RNA, 32 nt, Human
gccugcacaggcuggggaguccucaggaccuu

SEQ ID NO: 174779 - RNA, 18 nt, Human
gccugcaccagcauguca

SEQ ID NO: 174780 - RNA, 19 nt, Human
gccugcaccaguccugccu

SEQ ID NO: 174781 - RNA, 32 nt, Human
gccugcacccacucccuucauacaaucuaguc

SEQ ID NO: 174782 - RNA, 32 nt, Human
gccugcaccccucccuugucucauagaugcuc

SEQ ID NO: 174783 - RNA, 18 nt, Human
gccugcacccucaccucu

SEQ ID NO: 174784 - RNA, 32 nt, Human
gccugcacccucuuucuguuggcuccaccucc

SEQ ID NO: 174785 - RNA, 32 nt, Human
gccugcaccucggccagcaucuccuaugcucc

SEQ ID NO: 174786 - RNA, 32 nt, Human
gccugcacuagcaacagcauccaacuaguucg

SEQ ID NO: 174787 - RNA, 22 nt, Human
gccugcacugagagggcaagga

SEQ ID NO: 174788 - RNA, 32 nt, Human
gccugcacuguagcuucccugguuugggggau

SEQ ID NO: 174789 - RNA, 32 nt, Human
gccugcacuuggaccugaccucaagccucagc

SEQ ID NO: 174790 - RNA, 32 nt, Human
gccugcagaauuuggguucugccugccagcug

SEQ ID NO: 174791 - RNA, 32 nt, Human
gccugcagacugggcuggugccuccuccgcuu

SEQ ID NO: 174792 - RNA, 32 nt, Human
gccugcagagggccuggcacuaucaccaccuc

SEQ ID NO: 174793 - RNA, 32 nt, Human
gccugcagcaacuggaacaaggccccaccgua

SEQ ID NO: 174794 - RNA, 32 nt, Human
gccugcagcaaugcucaugucuugaggagaag

SEQ ID NO: 174795 - RNA, 32 nt, Human
gccugcagcagacucaaggcuccgagugcccu

SEQ ID NO: 174796 - RNA, 32 nt, Human
gccugcagcaucugaguggggccucuaggaug

SEQ ID NO: 174797 - RNA, 32 nt, Human
gccugcagcccuggagaauuugcucaccgagg

SEQ ID NO: 174798 - RNA, 32 nt, Human
gccugcagccuccucugaggcuccccugcugc

SEQ ID NO: 174799 - RNA, 32 nt, Human
gccugcagcuccaaggaacauugccucucugg

SEQ ID NO: 174800 - RNA, 32 nt, Human
gccugcagcucuccacaggagcuguaaaaguc

SEQ ID NO: 174801 - RNA, 32 nt, Human
gccugcagcucuucccagccccgagagagcuu

SEQ ID NO: 174802 - RNA, 19 nt, Human
gccugcagcugcccaaggc

SEQ ID NO: 174803 - RNA, 32 nt, Human
gccugcagcuuucucccuacuggaccagagac

SEQ ID NO: 174804 - RNA, 32 nt, Human
gccugcaggaacacgccccuucacccggcgcg

SEQ ID NO: 174805 - RNA, 32 nt, Human
gccugcaggaagaucuggcucagucuacuaug

SEQ ID NO: 174806 - RNA, 19 nt, Human
gccugcaggacccuugcug

SEQ ID NO: 174807 - RNA, 32 nt, Human
gccugcaggagaaacacacuccccuccugggu

SEQ ID NO: 174808 - RNA, 32 nt, Human
gccugcaggagagacacccaggaggaguuuuu

SEQ ID NO: 174809 - RNA, 32 nt, Human
gccugcaggaggagaggcuggggaggguucuc

SEQ ID NO: 174810 - RNA, 32 nt, Human
gccugcaggaggaggaacagagaagccugggc

SEQ ID NO: 174811 - RNA, 32 nt, Human
gccugcaggaugggccgcgccgccguggcccg

SEQ ID NO: 174812 - RNA, 32 nt, Human
gccugcaggcauucacugaccaggccuuuccu

SEQ ID NO: 174813 - RNA, 20 nt, Human
gccugcaggccacccaggga

SEQ ID NO: 174814 - RNA, 32 nt, Human
gccugcaggcuggggacccugggugcaggugc

SEQ ID NO: 174815 - RNA, 32 nt, Human
gccugcagggugaccugcuuccccaaaggcca

SEQ ID NO: 174816 - RNA, 32 nt, Human
gccugcaggucucgcucagagcugugucccug

SEQ ID NO: 174817 - RNA, 32 nt, Human
gccugcagguuagaaagaggcgagcguggauu

SEQ ID NO: 174818 - RNA, 32 nt, Human
gccugcaguaggagggagaggaaggggugcca

SEQ ID NO: 174819 - RNA, 23 nt, Human
gccugcagucccagcacuuuggg

SEQ ID NO: 174820 - RNA, 24 nt, Human
gccugcagucccagcacuuuggga

SEQ ID NO: 174821 - RNA, 23 nt, Human
gccugcagucccagcuaccuggg

SEQ ID NO: 174822 - RNA, 24 nt, Human
gccugcagucccagcuaccuggga

SEQ ID NO: 174823 - RNA, 23 nt, Human
gccugcagucccagcuacucagg

SEQ ID NO: 174824 - RNA, 24 nt, Human
gccugcagucccagcuacucagga

SEQ ID NO: 174825 - RNA, 23 nt, Human
gccugcagucccagcuacuuggg

SEQ ID NO: 174826 - RNA, 24 nt, Human
gccugcagucccagcuacuuggga

SEQ ID NO: 174827 - RNA, 24 nt, Human
gccugcagucccagcuauucagga

SEQ ID NO: 174828 - RNA, 23 nt, Human
gccugcagucccagcugcuccgg

SEQ ID NO: 174829 - RNA, 24 nt, Human
gccugcagucccagcugcuccgga

SEQ ID NO: 174830 - RNA, 23 nt, Human
gccugcagucccaguuacuuggg

SEQ ID NO: 174831 - RNA, 24 nt, Human
gccugcagucccaguuacuuggga

SEQ ID NO: 174832 - RNA, 32 nt, Human
gccugcagucucauccugcccuugccauccuc

SEQ ID NO: 174833 - RNA, 21 nt, Human
gccugcagugcccggcccugg

SEQ ID NO: 174834 - RNA, 20 nt, Human
gccugcagugcugguccugc

SEQ ID NO: 174835 - RNA, 32 nt, Human
gccugcagugcuguacauguuuacagaagcug

SEQ ID NO: 174836 - RNA, 32 nt, Human
gccugcaguggccgggaccgugacuguuucug

SEQ ID NO: 174837 - RNA, 32 nt, Human
gccugcaguucugggaauccuguccagacaug

SEQ ID NO: 174838 - RNA, 25 nt, Human
gccugcaguugggggccugcccuga

SEQ ID NO: 174839 - RNA, 32 nt, Human
gccugcaucccucccuuccuuucucuuacugc

SEQ ID NO: 174840 - RNA, 32 nt, Human
gccugcaucuccuggcgccggcugcuucuggg

SEQ ID NO: 174841 - RNA, 32 nt, Human
gccugcaugcauucaggcuucucagguguuuc

SEQ ID NO: 174842 - RNA, 23 nt, Human
gccugcauguaaacacgccugca

SEQ ID NO: 174843 - RNA, 32 nt, Human
gccugcauuugcaauggaauaacugacaaauc

SEQ ID NO: 174844 - RNA, 32 nt, Human
gccugccaaguagcuggauuacaggcacgugc

SEQ ID NO: 174845 - RNA, 32 nt, Human
gccugccaaguugaguucagcuucaguuggau

SEQ ID NO: 174846 - RNA, 32 nt, Human
gccugccaaugccacagccaagcccacccugg

SEQ ID NO: 174847 - RNA, 32 nt, Human
gccugccacacacccucugccuaggaggcugu

SEQ ID NO: 174848 - RNA, 20 nt, Human
gccugccacaccaagcauua

SEQ ID NO: 174849 - RNA, 32 nt, Human
gccugccacaccacuccugccuggugcucggc

SEQ ID NO: 174850 - RNA, 32 nt, Human
gccugccacauuuuuacuggaucuguguuugc

SEQ ID NO: 174851 - RNA, 32 nt, Human
gccugccaccacagcacgcggccuccugaucc

SEQ ID NO: 174852 - RNA, 19 nt, Human
gccugccacccccuagggg

SEQ ID NO: 174853 - RNA, 32 nt, Human
gccugccaccuccuccucaucuccggugguuc

SEQ ID NO: 174854 - RNA, 32 nt, Human
gccugccaccucucggacuccagcuugaugga

SEQ ID NO: 174855 - RNA, 32 nt, Human
gccugccaccucucuugucucucccucugaag

SEQ ID NO: 174856 - RNA, 32 nt, Human
gccugccacugaggguucccagcaccaugagg

SEQ ID NO: 174857 - RNA, 32 nt, Human
gccugccagaagcuggaggggugcuggagacc

SEQ ID NO: 174858 - RNA, 32 nt, Human
gccugccagcccaccccagccuggggagaggu

SEQ ID NO: 174859 - RNA, 32 nt, Human
gccugccagcccugagguuaaauguuccugaa

SEQ ID NO: 174860 - RNA, 32 nt, Human
gccugccagcccugcgguuaaauguuccugaa

SEQ ID NO: 174861 - RNA, 32 nt, Human
gccugccagccgcggggacuccgggcccgggu

SEQ ID NO: 174862 - RNA, 32 nt, Human
gccugccagcuccguccucccugccgagggcu

SEQ ID NO: 174863 - RNA, 32 nt, Human
gccugccagcugucuccacuguggaguuacua

SEQ ID NO: 174864 - RNA, 31 nt, Human
gccugccaggucucugggccuucagcgcggg

SEQ ID NO: 174865 - RNA, 32 nt, Human
gccugccaucuucuccccgaggcugccccagg

SEQ ID NO: 174866 - RNA, 32 nt, Human
gccugccauucccagaccccagcccuuugugc

SEQ ID NO: 174867 - RNA, 32 nt, Human
gccugcccaaccagacugguaguccugcaguc

SEQ ID NO: 174868 - RNA, 32 nt, Human
gccugcccacagcuaugcuuuggccucuccag

SEQ ID NO: 174869 - RNA, 32 nt, Human
gccugcccacuacauccagccuguggcuuugc

SEQ ID NO: 174870 - RNA, 32 nt, Human
gccugcccacuugagcaacucuguccuugagc

SEQ ID NO: 174871 - RNA, 23 nt, Human
gccugcccagcccuccgcccuga

SEQ ID NO: 174872 - RNA, 32 nt, Human
gccugcccagccuccuggaacugcgcccugga

SEQ ID NO: 174873 - RNA, 32 nt, Human
gccugcccagccugcaccacccugcccgcccu

SEQ ID NO: 174874 - RNA, 32 nt, Human
gccugcccagggccugcagccuucucuacuug

SEQ ID NO: 174875 - RNA, 32 nt, Human
gccugccccacagacacagcugugaggccugg

SEQ ID NO: 174876 - RNA, 18 nt, Human
gccugccccacuuuugua

SEQ ID NO: 174877 - RNA, 18 nt, Human
gccugccccagccccagc

SEQ ID NO: 174878 - RNA, 32 nt, Human
gccugccccagccucugcuucaccccacuggu

SEQ ID NO: 174879 - RNA, 32 nt, Human
gccugccccaggagggcccugcugaggugaag

SEQ ID NO: 174880 - RNA, 32 nt, Human
gccugccccaugcuuccagccugcagaacaca

SEQ ID NO: 174881 - RNA, 32 nt, Human
gccugcccccagcacucuagguggugguuagu

SEQ ID NO: 174882 - RNA, 24 nt, Human
gccugcccccgagggcacuggagg

SEQ ID NO: 174883 - RNA, 18 nt, Human
gccugcccccgccuugag

SEQ ID NO: 174884 - RNA, 15 nt, Human
gccugcccccugaug

SEQ ID NO: 174885 - RNA, 16 nt, Human
gccugcccccuucaug

SEQ ID NO: 174886 - RNA, 21 nt, Human
gccugcccccuuccauuccca

SEQ ID NO: 174887 - RNA, 32 nt, Human
gccugcccccuucccuggacagggcuguggag

SEQ ID NO: 174888 - RNA, 32 nt, Human
gccugccccgagggacagagacuggagcucaa

SEQ ID NO: 174889 - RNA, 32 nt, Human
gccugccccgccuuccccaacaccucgcucca

SEQ ID NO: 174890 - RNA, 32 nt, Human
gccugccccggcuuaagccgagcugcuggugc

SEQ ID NO: 174891 - RNA, 32 nt, Human
gccugccccucccagaacacacuccaucagcu

SEQ ID NO: 174892 - RNA, 22 nt, Human
gccugccccuccgcugucccca

SEQ ID NO: 174893 - RNA, 32 nt, Human
gccugccccucgucccuuccuccgcccccucu

SEQ ID NO: 174894 - RNA, 18 nt, Human
gccugccccucuucagau

SEQ ID NO: 174895 - RNA, 32 nt, Human
gccugccccugccugcugcccaccaucccugc

SEQ ID NO: 174896 - RNA, 32 nt, Human
gccugccccugccuuggccaaugcgagguccu

SEQ ID NO: 174897 - RNA, 22 nt, Human
gccugccccuguguauucacca

SEQ ID NO: 174898 - RNA, 16 nt, Human
gccugccccuuuggug

SEQ ID NO: 174899 - RNA, 22 nt, Human
gccugcccgcccccugcugcug

SEQ ID NO: 174900 - RNA, 32 nt, Human
gccugcccggagccccagccccaggggaccau

SEQ ID NO: 174901 - RNA, 15 nt, Human
gccugcccggcauca

SEQ ID NO: 174902 - RNA, 18 nt, Human
gccugcccgucagugaug

SEQ ID NO: 174903 - RNA, 32 nt, Human
gccugcccuaggaaucuguucuugaagacaac

SEQ ID NO: 174904 - RNA, 32 nt, Human
gccugcccuauggauuucggacuugccagcca

SEQ ID NO: 174905 - RNA, 32 nt, Human
gccugcccucaggagccugggcugcgaggcuc

SEQ ID NO: 174906 - RNA, 18 nt, Human
gccugcccuccaccuuga

SEQ ID NO: 174907 - RNA, 32 nt, Human
gccugcccuccaggauggcugguuuagucugg

SEQ ID NO: 174908 - RNA, 32 nt, Human
gccugcccuccagggcuggggccucgccuggc

SEQ ID NO: 174909 - RNA, 17 nt, Human
gccugcccuccccggug

SEQ ID NO: 174910 - RNA, 18 nt, Human
gccugcccucccuggggu

SEQ ID NO: 174911 - RNA, 21 nt, Human
gccugcccucccuugggacca

SEQ ID NO: 174912 - RNA, 16 nt, Human
gccugcccuccuggua

SEQ ID NO: 174913 - RNA, 18 nt, Human
gccugcccuccugugaug

SEQ ID NO: 174914 - RNA, 32 nt, Human
gccugcccucuagccucuacucuuccaguugc

SEQ ID NO: 174915 - RNA, 18 nt, Human
gccugcccucugccgaug

SEQ ID NO: 174916 - RNA, 17 nt, Human
gccugcccucugcugcc

SEQ ID NO: 174917 - RNA, 32 nt, Human
gccugcccugagccacuguucccagcucacca

SEQ ID NO: 174918 - RNA, 32 nt, Human
gccugcccugcagcugucuuggcuaaccuggc

SEQ ID NO: 174919 - RNA, 20 nt, Human
gccugcccugcccuccgaug

SEQ ID NO: 174920 - RNA, 32 nt, Human
gccugcccugcuccaggcuccaccugcgccgc

SEQ ID NO: 174921 - RNA, 32 nt, Human
gccugcccugcucgccccuccacagccucggu

SEQ ID NO: 174922 - RNA, 32 nt, Human
gccugcccugcucugcggcuguggccccuacc

SEQ ID NO: 174923 - RNA, 18 nt, Human
gccugcccugggcggggg

SEQ ID NO: 174924 - RNA, 32 nt, Human
gccugcccuucccacaugucucccuaaccuuu

SEQ ID NO: 174925 - RNA, 22 nt, Human
gccugcccuuccuagacggcca

SEQ ID NO: 174926 - RNA, 24 nt, Human
gccugcccuuccuccauuguugcc

SEQ ID NO: 174927 - RNA, 32 nt, Human
gccugcccuuccuccauuguugcccuggaaug

SEQ ID NO: 174928 - RNA, 18 nt, Human
gccugcccuuccucugug

SEQ ID NO: 174929 - RNA, 22 nt, Human
gccugcccuuccucuguguggc

SEQ ID NO: 174930 - RNA, 17 nt, Human
gccugcccuuccugaug

SEQ ID NO: 174931 - RNA, 20 nt, Human
gccugcccuucuccacugcc

SEQ ID NO: 174932 - RNA, 32 nt, Human
gccugcccuugucugagaugcugguaauggcc

SEQ ID NO: 174933 - RNA, 32 nt, Human
gccugcccuuucucagcugccuccccugcccu

SEQ ID NO: 174934 - RNA, 32 nt, Human
gccugcccuuucucuccgcuccagccucuccc

SEQ ID NO: 174935 - RNA, 32 nt, Human
gccugccgcagggauggggcagcugugcuggc

SEQ ID NO: 174936 - RNA, 32 nt, Human
gccugccgcugccugcccaaccccugcacauu

SEQ ID NO: 174937 - RNA, 30 nt, Human
gccugccgguuccacaggguacaguuagga

SEQ ID NO: 174938 - RNA, 32 nt, Human
gccugccguugcccugagcugcagccucggcc

SEQ ID NO: 174939 - RNA, 32 nt, Human
gccugccuaagacccuuugcucccucugggau

SEQ ID NO: 174940 - RNA, 32 nt, Human
gccugccuagugcuggaguaggggacaauggg

SEQ ID NO: 174941 - RNA, 32 nt, Human
gccugccucaaaaccccuucugccucaggugg

SEQ ID NO: 174942 - RNA, 32 nt, Human
gccugccucaccuccagcaccuguaggaacuc

SEQ ID NO: 174943 - RNA, 32 nt, Human
gccugccucauuuccuccucuccugccuguga

SEQ ID NO: 174944 - RNA, 32 nt, Human
gccugccuccaauccccacaacguccagggug

SEQ ID NO: 174945 - RNA, 32 nt, Human
gccugccuccacccguccucccucagccuccc

SEQ ID NO: 174946 - RNA, 32 nt, Human
gccugccuccacccucccgaauggugcuccuc

SEQ ID NO: 174947 - RNA, 32 nt, Human
gccugccuccacccugcucuccaucucccgcu

SEQ ID NO: 174948 - RNA, 32 nt, Human
gccugccucccaucccgcuccgcugggguuca

SEQ ID NO: 174949 - RNA, 32 nt, Human
gccugccucccucccugucugccuccugcccc

SEQ ID NO: 174950 - RNA, 21 nt, Human
gccugccucccuuccccgcca

SEQ ID NO: 174951 - RNA, 32 nt, Human
gccugccuccuaggcuggaagccauggucccg

SEQ ID NO: 174952 - RNA, 25 nt, Human
gccugccuccuggaagacuuucugg

SEQ ID NO: 174953 - RNA, 26 nt, Human
gccugccuccugggcugguuccuggg

SEQ ID NO: 174954 - RNA, 24 nt, Human
gccugccuccuggguuuuccuggg

SEQ ID NO: 174955 - RNA, 21 nt, Human
gccugccucggagaggacaga

SEQ ID NO: 174956 - RNA, 23 nt, Human
gccugccucggccucccaaaggg

SEQ ID NO: 174957 - RNA, 32 nt, Human
gccugccucuccccgucucugagcucuggacg

SEQ ID NO: 174958 - RNA, 32 nt, Human
gccugccucucuggcugucugcuuuugcaggg

SEQ ID NO: 174959 - RNA, 20 nt, Human
gccugccucuguuucccugg

SEQ ID NO: 174960 - RNA, 32 nt, Human
gccugccucuuuguugccaugagagcugccua

SEQ ID NO: 174961 - RNA, 32 nt, Human
gccugccugccacccugccccuugccauccau

SEQ ID NO: 174962 - RNA, 32 nt, Human
gccugccugcccaccucucucucugguccugu

SEQ ID NO: 174963 - RNA, 32 nt, Human
gccugccugcccagcgaggcccccagguucaa

SEQ ID NO: 174964 - RNA, 32 nt, Human
gccugccugcccaggccaccuccugggagugc

SEQ ID NO: 174965 - RNA, 32 nt, Human
gccugccugcccggcccugcacaacaugcagc

SEQ ID NO: 174966 - RNA, 32 nt, Human
gccugccugcccuagccagcucccaggugaag

SEQ ID NO: 174967 - RNA, 32 nt, Human
gccugccugccucaguuuauuucccagucuua

SEQ ID NO: 174968 - RNA, 32 nt, Human
gccugccugccugagguccccgcugccagucc

SEQ ID NO: 174969 - RNA, 32 nt, Human
gccugccugccugcccgcccgcucgcucgccc

SEQ ID NO: 174970 - RNA, 32 nt, Human
gccugccugccugccucuccaccacaugcuuu

SEQ ID NO: 174971 - RNA, 32 nt, Human
gccugccugccugccugagguccccgcugcca

SEQ ID NO: 174972 - RNA, 32 nt, Human
gccugccugccugccugcccgcccagagcugu

SEQ ID NO: 174973 - RNA, 32 nt, Human
gccugccugccugccugccucaguuuauuucc

SEQ ID NO: 174974 - RNA, 32 nt, Human
gccugccugccugccugccugagguccccgcu

SEQ ID NO: 174975 - RNA, 32 nt, Human
gccugccugccugccugccugcccgcccagag

SEQ ID NO: 174976 - RNA, 32 nt, Human
gccugccugccugccugccugccucuccacca

SEQ ID NO: 174977 - RNA, 32 nt, Human
gccugccugccugccugccugccugccugccu

SEQ ID NO: 174978 - RNA, 32 nt, Human
gccugccugccugccugccugccugccugucu

SEQ ID NO: 174979 - RNA, 32 nt, Human
gccugccugccugccugccugccugucugccu

SEQ ID NO: 174980 - RNA, 32 nt, Human
gccugccugccugccugccugucugccuaugu

SEQ ID NO: 174981 - RNA, 32 nt, Human
gccugccugccugccugcuacggcucagcagc

SEQ ID NO: 174982 - RNA, 32 nt, Human
gccugccugccugccugcuacggugagugugg

SEQ ID NO: 174983 - RNA, 32 nt, Human
gccugccugccugccugucugccuaugugaug

SEQ ID NO: 174984 - RNA, 32 nt, Human
gccugccugccugcgcuuccauccauccaucc

SEQ ID NO: 174985 - RNA, 32 nt, Human
gccugccugccugucugccuaugugaugauga

SEQ ID NO: 174986 - RNA, 32 nt, Human
gccugccugccuguguggucugccucucaaag

SEQ ID NO: 174987 - RNA, 32 nt, Human
gccugccugcggccugucuguguuugucuuac

SEQ ID NO: 174988 - RNA, 32 nt, Human
gccugccugcugccccucccagccugccaaga

SEQ ID NO: 174989 - RNA, 32 nt, Human
gccugccugcuuguuagaaaggccugaggagc

SEQ ID NO: 174990 - RNA, 32 nt, Human
gccugccuggaugacagagcgagacuccaucu

SEQ ID NO: 174991 - RNA, 17 nt, Human
gccugccuggccuggua

SEQ ID NO: 174992 - RNA, 31 nt, Human
gccugccuggcguccccuugccucagcacac

SEQ ID NO: 174993 - RNA, 32 nt, Human
gccugccugggaacgggguggacgagggagug

SEQ ID NO: 174994 - RNA, 31 nt, Human
gccugccuggucucuggggguguugagugag

SEQ ID NO: 174995 - RNA, 32 nt, Human
gccugccuguaauccagcuacucaggaggcug

SEQ ID NO: 174996 - RNA, 32 nt, Human
gccugccuguaaucccagcacugugggaggcc

SEQ ID NO: 174997 - RNA, 32 nt, Human
gccugccuguaaucccagcuacuaaggaggcu

SEQ ID NO: 174998 - RNA, 32 nt, Human
gccugccuguagucccagcuacucgggaggcu

SEQ ID NO: 174999 - RNA, 21 nt, Human
gccugccuguccuccagcagg

SEQ ID NO: 175000 - RNA, 32 nt, Human
gccugccuguccuccagcugucugacuaucca

SEQ ID NO: 175001 - RNA, 32 nt, Human
gccugccugucucccuccucugucaccaccag

SEQ ID NO: 175002 - RNA, 32 nt, Human
gccugccugucucuaguuucucucacaucccu

SEQ ID NO: 175003 - RNA, 32 nt, Human
gccugccuguggucucagcuacucggcauucu

SEQ ID NO: 175004 - RNA, 32 nt, Human
gccugccuucugaccaaccucuccccaucguu

SEQ ID NO: 175005 - RNA, 16 nt, Human
gccugccuucugcgcc

SEQ ID NO: 175006 - RNA, 32 nt, Human
gccugccuucuuucuuuucuuuaccuacucuc

SEQ ID NO: 175007 - RNA, 21 nt, Human
gccugccuugcuguuccuggg

SEQ ID NO: 175008 - RNA, 18 nt, Human
gccugccuuggccugaug

SEQ ID NO: 175009 - RNA, 32 nt, Human
gccugcgagagccacagcaaggagcucagcca

SEQ ID NO: 175010 - RNA, 20 nt, Human
gccugcgagccggagagaca

SEQ ID NO: 175011 - RNA, 29 nt, Human
gccugcgcaaacagcaagacccugucuac

SEQ ID NO: 175012 - RNA, 32 nt, Human
gccugcgcagagugcccggggugcagggcagc

SEQ ID NO: 175013 - RNA, 32 nt, Human
gccugcgcagccgccauguucgguugcuaugc

SEQ ID NO: 175014 - RNA, 32 nt, Human
gccugcgccaagagacagacagagaaggcugc

SEQ ID NO: 175015 - RNA, 19 nt, Human
gccugcgccccacccagca

SEQ ID NO: 175016 - RNA, 32 nt, Human
gccugcgccuccauccaucuguccguccagag

SEQ ID NO: 175017 - RNA, 20 nt, Human
gccugcgccugagcugcaug

SEQ ID NO: 175018 - RNA, 32 nt, Human
gccugcgccuguaaucccagcacuuugggagg

SEQ ID NO: 175019 - RNA, 32 nt, Human
gccugcgcucagcugcucuggcaccccgcugc

SEQ ID NO: 175020 - RNA, 32 nt, Human
gccugcgcuugccucccugccucaucucuauu

SEQ ID NO: 175021 - RNA, 32 nt, Human
gccugcggaaccugaggcagcuggggagggcc

SEQ ID NO: 175022 - RNA, 32 nt, Human
gccugcggccugucuguguuugucuuacucau

SEQ ID NO: 175023 - RNA, 16 nt, Human
gccugcggcgggggga

SEQ ID NO: 175024 - RNA, 32 nt, Human
gccugcggcucaagcggaccagcuccauggau

SEQ ID NO: 175025 - RNA, 32 nt, Human
gccugcggcugccugggcuggggcucgcucca

SEQ ID NO: 175026 - RNA, 32 nt, Human
gccugcggcuggaguaaggcuugcugugggac

SEQ ID NO: 175027 - RNA, 32 nt, Human
gccugcgggacggugaggcccugcugaggacu

SEQ ID NO: 175028 - RNA, 32 nt, Human
gccugcgggagagguccuucacuguguguaca

SEQ ID NO: 175029 - RNA, 32 nt, Human
gccugcggggaggcgcggggcccugcucugua

SEQ ID NO: 175030 - RNA, 32 nt, Human
gccugcggguccuugugucccugccgcugaag

SEQ ID NO: 175031 - RNA, 24 nt, Human
gccugcggucccagcuacuuggga

SEQ ID NO: 175032 - RNA, 32 nt, Human
gccugcgguccuagcuacacaggaaguugagg

SEQ ID NO: 175033 - RNA, 32 nt, Human
gccugcguccagggaaguugcuuggaauucca

SEQ ID NO: 175034 - RNA, 32 nt, Human
gccugcgucucucugcuguaccagcucuguuc

SEQ ID NO: 175035 - RNA, 32 nt, Human
gccugcgucuggucugugucacacacagcagc

SEQ ID NO: 175036 - RNA, 32 nt, Human
gccugcgucuuccucagugcucagcuggaggu

SEQ ID NO: 175037 - RNA, 20 nt, Human
gccugcgugccgccacgccc

SEQ ID NO: 175038 - RNA, 32 nt, Human
gccugcguggucaacuccugucuucaggccac

SEQ ID NO: 175039 - RNA, 32 nt, Human
gccugcuaacauggaggagcugaccgaaguca

SEQ ID NO: 175040 - RNA, 32 nt, Human
gccugcuaacuuugaaaaggagcacugugucc

SEQ ID NO: 175041 - RNA, 32 nt, Human
gccugcuaauuccuucaggauccaucacaaca

SEQ ID NO: 175042 - RNA, 32 nt, Human
gccugcuacagccuugaacucaugggcucaag

SEQ ID NO: 175043 - RNA, 22 nt, Human
gccugcuaccugccugcugacc

SEQ ID NO: 175044 - RNA, 32 nt, Human
gccugcuacuggacauccagaaccacagcaag

SEQ ID NO: 175045 - RNA, 21 nt, Human
gccugcuaggagccucuacca

SEQ ID NO: 175046 - RNA, 32 nt, Human
gccugcuagugauagcucacacaucacauccc

SEQ ID NO: 175047 - RNA, 32 nt, Human
gccugcucaccugaaaguucccacccaagccg

SEQ ID NO: 175048 - RNA, 32 nt, Human
gccugcucagaggcgcccuagggaagggccau

SEQ ID NO: 175049 - RNA, 32 nt, Human
gccugcucagcccuccuggaggcccuccuuuc

SEQ ID NO: 175050 - RNA, 32 nt, Human
gccugcucagcucucccuggccccuaacaauu

SEQ ID NO: 175051 - RNA, 32 nt, Human
gccugcucaggaaaccucuuugcuccacacag

SEQ ID NO: 175052 - RNA, 32 nt, Human
gccugcucagggacuguuccugucucagcaac

SEQ ID NO: 175053 - RNA, 32 nt, Human
gccugcucauuucccagcccucuucuucucaa

SEQ ID NO: 175054 - RNA, 32 nt, Human
gccugcuccagacauuuuguucuugaaucugu

SEQ ID NO: 175055 - RNA, 32 nt, Human
gccugcuccaggccuugcuucucccucugcag

SEQ ID NO: 175056 - RNA, 32 nt, Human
gccugcucccacccuccucccagcagcagaca

SEQ ID NO: 175057 - RNA, 32 nt, Human
gccugcucccucucucugcagaacgggcucau

SEQ ID NO: 175058 - RNA, 32 nt, Human
gccugcuccuccugggcauuggcuccagcgga

SEQ ID NO: 175059 - RNA, 19 nt, Human
gccugcuccuccuuccucu

SEQ ID NO: 175060 - RNA, 32 nt, Human
gccugcuccugccucucucccaacauguuucc

SEQ ID NO: 175061 - RNA, 18 nt, Human
gccugcuccuucucgaua

SEQ ID NO: 175062 - RNA, 32 nt, Human
gccugcucuccuccucuguccugcagaccggg

SEQ ID NO: 175063 - RNA, 32 nt, Human
gccugcucucugggcuggagcagguggauucg

SEQ ID NO: 175064 - RNA, 32 nt, Human
gccugcucucuuucccuacaacuaggucagcc

SEQ ID NO: 175065 - RNA, 32 nt, Human
gccugcucuggccuaauggaucuuacuguaug

SEQ ID NO: 175066 - RNA, 32 nt, Human
gccugcucugguugaagguggggugggggcgg

SEQ ID NO: 175067 - RNA, 32 nt, Human
gccugcucugugucuguguugugaagcuugag

SEQ ID NO: 175068 - RNA, 32 nt, Human
gccugcucuuccuguuucuuucccaaggguca

SEQ ID NO: 175069 - RNA, 32 nt, Human
gccugcugaaggacuuccugaagaagcacaac

SEQ ID NO: 175070 - RNA, 32 nt, Human
gccugcugagcggggucugugggagcuagcuu

SEQ ID NO: 175071 - RNA, 18 nt, Human
gccugcugcaaagcuuug

SEQ ID NO: 175072 - RNA, 32 nt, Human
gccugcugcaucccuucccccgagcauggcag

SEQ ID NO: 175073 - RNA, 32 nt, Human
gccugcugccaagggcagcggaggaggaaaug

SEQ ID NO: 175074 - RNA, 32 nt, Human
gccugcugcccaggcugugcagcgcagcugga

SEQ ID NO: 175075 - RNA, 18 nt, Human
gccugcugccucagcaca

SEQ ID NO: 175076 - RNA, 21 nt, Human
gccugcugcgcgcccccuccc

SEQ ID NO: 175077 - RNA, 21 nt, Human
gccugcugcucccuccuaggg

SEQ ID NO: 175078 - RNA, 32 nt, Human
gccugcugcugaacauccagaacgacagcaag

SEQ ID NO: 175079 - RNA, 32 nt, Human
gccugcugcuucucacagacaccucacauccu

SEQ ID NO: 175080 - RNA, 32 nt, Human
gccugcugcuucucugucuccgagaccggagu

SEQ ID NO: 175081 - RNA, 23 nt, Human
gccugcugcuuggccccaucuca

SEQ ID NO: 175082 - RNA, 32 nt, Human
gccugcugcuuuccuaaaucacaauauggccu

SEQ ID NO: 175083 - RNA, 32 nt, Human
gccugcugcuuuggcagugccaugggugagcc

SEQ ID NO: 175084 - RNA, 32 nt, Human
gccugcuggacagauggcuggccaagugggag

SEQ ID NO: 175085 - RNA, 20 nt, Human
gccugcuggagccgccugca

SEQ ID NO: 175086 - RNA, 32 nt, Human
gccugcuggauccagaacaugacaacagagag

SEQ ID NO: 175087 - RNA, 32 nt, Human
gccugcuggccggcuuccugcgauguggcuca

SEQ ID NO: 175088 - RNA, 32 nt, Human
gccugcugggagaggaugaggaggaggcccug

SEQ ID NO: 175089 - RNA, 32 nt, Human
gccugcugggcugagggaagucagagccccag

SEQ ID NO: 175090 - RNA, 21 nt, Human
gccugcugguggcagagccag

SEQ ID NO: 175091 - RNA, 32 nt, Human
gccugcuguccugggcauggugcaguaccugu

SEQ ID NO: 175092 - RNA, 32 nt, Human
gccugcugugaagccaguagcuauuuuaaaag

SEQ ID NO: 175093 - RNA, 32 nt, Human
gccugcugugaaguuaacauugccaggacgau

SEQ ID NO: 175094 - RNA, 32 nt, Human
gccugcugugagagccagaaugaagcauguac

SEQ ID NO: 175095 - RNA, 24 nt, Human
gccugcugugcccacccaccccac

SEQ ID NO: 175096 - RNA, 32 nt, Human
gccugcuguggcacagagcugggaaggccuua

SEQ ID NO: 175097 - RNA, 32 nt, Human
gccugcugugggaggcaugagcuggagauggg

SEQ ID NO: 175098 - RNA, 32 nt, Human
gccugcugugugccaggcauugugcuaaguau

SEQ ID NO: 175099 - RNA, 32 nt, Human
gccugcuguucccaacugugcccagcugcacu

SEQ ID NO: 175100 - RNA, 19 nt, Human
gccugcuuacuuucugcca

SEQ ID NO: 175101 - RNA, 32 nt, Human
gccugcuuaguccagaaugcaggauagagaaa

SEQ ID NO: 175102 - RNA, 32 nt, Human
gccugcuuauugccucuuucucagaauccucu

SEQ ID NO: 175103 - RNA, 32 nt, Human
gccugcuucacuguggaugggaagaggugaca

SEQ ID NO: 175104 - RNA, 32 nt, Human
gccugcuuccaucuuuugcucuguaaaguugu

SEQ ID NO: 175105 - RNA, 32 nt, Human
gccugcuucccaacugcaucccccacccagcu

SEQ ID NO: 175106 - RNA, 32 nt, Human
gccugcuuccccuccagcuccugggcucugcc

SEQ ID NO: 175107 - RNA, 32 nt, Human
gccugcuucucccaucccugccuucuggccga

SEQ ID NO: 175108 - RNA, 32 nt, Human
gccugcuucuuccccucugcggcuuucacugc

SEQ ID NO: 175109 - RNA, 31 nt, Human
gccugcuugcucucuggcugugcuccugcuu

SEQ ID NO: 175110 - RNA, 32 nt, Human
gccugcuugcucuuuacagccucucucuguga

SEQ ID NO: 175111 - RNA, 32 nt, Human
gccugcuugguggcgggggugauguaugugga

SEQ ID NO: 175112 - RNA, 32 nt, Human
gccugcuuguaauuccagcuacuugggaggcu

SEQ ID NO: 175113 - RNA, 32 nt, Human
gccugcuuucgagggccuccuggacucagacu

SEQ ID NO: 175114 - RNA, 17 nt, Human
gccugcuuucucagaua

SEQ ID NO: 175115 - RNA, 32 nt, Human
gccugcuuuuucucaggcugcccugaggaucu

SEQ ID NO: 175116 - RNA, 32 nt, Human
gccuggaaacaugcuuggcucacccagcaggg

SEQ ID NO: 175117 - RNA, 32 nt, Human
gccuggaaaccagcuuccuccucagcuccagc

SEQ ID NO: 175118 - RNA, 32 nt, Human
gccuggaagacauagguugcaguguaauggga

SEQ ID NO: 175119 - RNA, 32 nt, Human
gccuggaagggccugugccagcaccaggcaga

SEQ ID NO: 175120 - RNA, 32 nt, Human
gccuggaaggucaagacugcagugagcuguga

SEQ ID NO: 175121 - RNA, 32 nt, Human
gccuggaagguggaaguugcagugagucgaga

SEQ ID NO: 175122 - RNA, 21 nt, Human
gccuggaaucccagcuacuug

SEQ ID NO: 175123 - RNA, 24 nt, Human
gccuggaaucccagcuacuugaga

SEQ ID NO: 175124 - RNA, 23 nt, Human
gccuggaauuaggaccccaugga

SEQ ID NO: 175125 - RNA, 32 nt, Human
gccuggacaacaaacaugcugaucccauuuuc

SEQ ID NO: 175126 - RNA, 18 nt, Human
gccuggacaacagaguga

SEQ ID NO: 175127 - RNA, 18 nt, Human
gccuggacaacagagugg

SEQ ID NO: 175128 - RNA, 18 nt, Human
gccuggacaacggaguga

SEQ ID NO: 175129 - RNA, 32 nt, Human
gccuggacacagacagagacagagccaggccc

SEQ ID NO: 175130 - RNA, 32 nt, Human
gccuggacaccaccaucuacccuauucugagu

SEQ ID NO: 175131 - RNA, 21 nt, Human
gccuggacaccuuuggcccug

SEQ ID NO: 175132 - RNA, 19 nt, Human
gccuggacagcaggagcga

SEQ ID NO: 175133 - RNA, 19 nt, Human
gccuggacagcgcccgcuc

SEQ ID NO: 175134 - RNA, 16 nt, Human
gccuggacagcggugg

SEQ ID NO: 175135 - RNA, 18 nt, Human
gccuggacagcuuaguga

SEQ ID NO: 175136 - RNA, 32 nt, Human
gccuggacagggccaccagagggcuuggucua

SEQ ID NO: 175137 - RNA, 18 nt, Human
gccuggacaguagagcga

SEQ ID NO: 175138 - RNA, 32 nt, Human
gccuggacauucucuggcagcaccuccaggau

SEQ ID NO: 175139 - RNA, 22 nt, Human
gccuggaccacaagcccagugg

SEQ ID NO: 175140 - RNA, 21 nt, Human
gccuggaccaccgccgaguga

SEQ ID NO: 175141 - RNA, 32 nt, Human
gccuggaccagaagacagagggcaagaggagc

SEQ ID NO: 175142 - RNA, 32 nt, Human
gccuggaccagccucuccacucaugugacucu

SEQ ID NO: 175143 - RNA, 32 nt, Human
gccuggacccagggagaggagccagugacaca

SEQ ID NO: 175144 - RNA, 22 nt, Human
gccuggaccccccucuuucucc

SEQ ID NO: 175145 - RNA, 22 nt, Human
gccuggaccucccuccuuccuc

SEQ ID NO: 175146 - RNA, 24 nt, Human
gccuggaccucccugcgauuuccc

SEQ ID NO: 175147 - RNA, 18 nt, Human
gccuggacgacagaguga

SEQ ID NO: 175148 - RNA, 32 nt, Human
gccuggacgagcccucacacaccuggucucca

SEQ ID NO: 175149 - RNA, 32 nt, Human
gccuggacgcugcauccugggcccagauccac

SEQ ID NO: 175150 - RNA, 19 nt, Human
gccuggacggcucugcugg

SEQ ID NO: 175151 - RNA, 32 nt, Human
gccuggacuacaccacucacccucccagugug

SEQ ID NO: 175152 - RNA, 32 nt, Human
gccuggacuagggugagcacaagccuugagcg

SEQ ID NO: 175153 - RNA, 32 nt, Human
gccuggacugcacucacagaggcaaguguugu

SEQ ID NO: 175154 - RNA, 32 nt, Human
gccuggacugccucucggcugugcuccgugga

SEQ ID NO: 175155 - RNA, 32 nt, Human
gccuggacuggaucccagcuguucuaggcagg

SEQ ID NO: 175156 - RNA, 32 nt, Human
gccuggacugggacuguuagagcugcuuccuc

SEQ ID NO: 175157 - RNA, 32 nt, Human
gccuggacuugcaaucccuuccugggucccau

SEQ ID NO: 175158 - RNA, 32 nt, Human
gccuggagaccacccagcccugaccugggacc

SEQ ID NO: 175159 - RNA, 32 nt, Human
gccuggagagaguggcuggucucugagaaagg

SEQ ID NO: 175160 - RNA, 32 nt, Human
gccuggagauauccucaggaagcacaucugua

SEQ ID NO: 175161 - RNA, 32 nt, Human
gccuggagauguagaggcugcagugagcugug

SEQ ID NO: 175162 - RNA, 21 nt, Human
gccuggagcaagcccugguca

SEQ ID NO: 175163 - RNA, 32 nt, Human
gccuggagcaccauggggguccugguuuaguc

SEQ ID NO: 175164 - RNA, 22 nt, Human
gccuggagcauccugaagcauc

SEQ ID NO: 175165 - RNA, 32 nt, Human
gccuggagccccacuccagcccugggacaacu

SEQ ID NO: 175166 - RNA, 32 nt, Human
gccuggaggaaggaugucccugcacugauaca

SEQ ID NO: 175167 - RNA, 32 nt, Human
gccuggaggaggaccugaaggaaggggcuucc

SEQ ID NO: 175168 - RNA, 32 nt, Human
gccuggaggcagcaaugggguugccgggaggg

SEQ ID NO: 175169 - RNA, 18 nt, Human
gccuggaggccagaguga

SEQ ID NO: 175170 - RNA, 32 nt, Human
gccuggaggccuggaggaaggggccaggccuc

SEQ ID NO: 175171 - RNA, 32 nt, Human
gccuggaggccuucguccauucugcuaccgcg

SEQ ID NO: 175172 - RNA, 32 nt, Human
gccuggaggcggaggcugcacugagcugaggu

SEQ ID NO: 175173 - RNA, 32 nt, Human
gccuggagggaagggaaggcugaggucuccuc

SEQ ID NO: 175174 - RNA, 32 nt, Human
gccuggagggcaggggcacagagcagagagga

SEQ ID NO: 175175 - RNA, 32 nt, Human
gccuggaggggccgugaacacagaacccucaa

SEQ ID NO: 175176 - RNA, 32 nt, Human
gccuggaggggcggagggcagggugggcccgc

SEQ ID NO: 175177 - RNA, 32 nt, Human
gccuggaggugugggagggaagaugaguuauu

SEQ ID NO: 175178 - RNA, 32 nt, Human
gccuggagucagcaaccagccucuacagcugc

SEQ ID NO: 175179 - RNA, 21 nt, Human
gccuggagucccagcuacuca

SEQ ID NO: 175180 - RNA, 24 nt, Human
gccuggagucccagcuacucagga

SEQ ID NO: 175181 - RNA, 24 nt, Human
gccuggagucccagcuacucggga

SEQ ID NO: 175182 - RNA, 21 nt, Human
gccuggagugccguggcccag

SEQ ID NO: 175183 - RNA, 32 nt, Human
gccuggaguggccggcccugcuugugccaugu

SEQ ID NO: 175184 - RNA, 32 nt, Human
gccuggaguuccucccccugccugaccuagaa

SEQ ID NO: 175185 - RNA, 32 nt, Human
gccuggauaaauuggagauugugaugacuucu

SEQ ID NO: 175186 - RNA, 18 nt, Human
gccuggauaauagaguga

SEQ ID NO: 175187 - RNA, 32 nt, Human
gccuggauacaaaaucacacuguguaccaaag

SEQ ID NO: 175188 - RNA, 32 nt, Human
gccuggauagggaaguuguuuuccuuuuaaag

SEQ ID NO: 175189 - RNA, 22 nt, Human
gccuggaucaccugaggucagg

SEQ ID NO: 175190 - RNA, 32 nt, Human
gccuggauccccagaguuugucuggaaagccu

SEQ ID NO: 175191 - RNA, 32 nt, Human
gccuggaucucccugcuucaccccuguggccc

SEQ ID NO: 175192 - RNA, 18 nt, Human
gccuggaugacagaguga

SEQ ID NO: 175193 - RNA, 19 nt, Human
gccuggaugacggagccag

SEQ ID NO: 175194 - RNA, 18 nt, Human
gccuggaugcccaccccu

SEQ ID NO: 175195 - RNA, 32 nt, Human
gccuggauggccaucccacauuccuuuaacgg

SEQ ID NO: 175196 - RNA, 19 nt, Human
gccuggauggcccagagug

SEQ ID NO: 175197 - RNA, 32 nt, Human
gccuggaugucugccaagaucucagucuucuu

SEQ ID NO: 175198 - RNA, 32 nt, Human
gccuggauugcaacauccucccagagaaggaa

SEQ ID NO: 175199 - RNA, 32 nt, Human
gccuggauuuggaggcagaguugucaggcuuu

SEQ ID NO: 175200 - RNA, 23 nt, Human
gccuggcaacaaugcaguggugu

SEQ ID NO: 175201 - RNA, 32 nt, Human
gccuggcaacacagcaagacccuaucucuacc

SEQ ID NO: 175202 - RNA, 32 nt, Human
gccuggcaacagagcaagacccugucuuuaag

SEQ ID NO: 175203 - RNA, 32 nt, Human
gccuggcaacagagcaagacucugucuaaaaa

SEQ ID NO: 175204 - RNA, 17 nt, Human
gccuggcaacagaguga

SEQ ID NO: 175205 - RNA, 32 nt, Human
gccuggcaacauggcaagacccugccucuuug

SEQ ID NO: 175206 - RNA, 32 nt, Human
gccuggcaaucagggacccccagcugccgcag

SEQ ID NO: 175207 - RNA, 32 nt, Human
gccuggcacaaaacaaaugcucaguggaugga

SEQ ID NO: 175208 - RNA, 32 nt, Human
gccuggcacacagcaaacacucaauagaauau

SEQ ID NO: 175209 - RNA, 19 nt, Human
gccuggcacgaaggccccg

SEQ ID NO: 175210 - RNA, 32 nt, Human
gccuggcacuccucgaugcccagugaaaccag

SEQ ID NO: 175211 - RNA, 32 nt, Human
gccuggcacucugccggugccuugggaagguc

SEQ ID NO: 175212 - RNA, 32 nt, Human
gccuggcacugagccagcccccagauucuuug

SEQ ID NO: 175213 - RNA, 32 nt, Human
gccuggcacugcuuccuccaccguuuucacag

SEQ ID NO: 175214 - RNA, 32 nt, Human
gccuggcacuggcuguacaucagcucuuacaa

SEQ ID NO: 175215 - RNA, 32 nt, Human
gccuggcacuuaugugaaagaaaugaaugaug

SEQ ID NO: 175216 - RNA, 32 nt, Human
gccuggcacuuccccacaaccagcacaggcuu

SEQ ID NO: 175217 - RNA, 32 nt, Human
gccuggcagaagaaauagacuauuuggaucac

SEQ ID NO: 175218 - RNA, 32 nt, Human
gccuggcagagcuguguuaccgucuuggccuc

SEQ ID NO: 175219 - RNA, 32 nt, Human
gccuggcagcagcauugugauuagaaugaagg

SEQ ID NO: 175220 - RNA, 32 nt, Human
gccuggcagccaaggguguuggucgcgaagcu

SEQ ID NO: 175221 - RNA, 32 nt, Human
gccuggcagccccuggcacagagcagacccgg

SEQ ID NO: 175222 - RNA, 32 nt, Human
gccuggcagccuggcccuccuggugcccacuc

SEQ ID NO: 175223 - RNA, 32 nt, Human
gccuggcagcuccccauguuuagccuguucca

SEQ ID NO: 175224 - RNA, 32 nt, Human
gccuggcagcuccugagcccuugggaaguucu

SEQ ID NO: 175225 - RNA, 32 nt, Human
gccuggcaggcagaagcagcuguggucccugg

SEQ ID NO: 175226 - RNA, 32 nt, Human
gccuggcagguggugggccugggaucuagccg

SEQ ID NO: 175227 - RNA, 32 nt, Human
gccuggcaguucccagcgcccugggcccuuca

SEQ ID NO: 175228 - RNA, 32 nt, Human
gccuggcauguucacagauuccacagaaacuc

SEQ ID NO: 175229 - RNA, 32 nt, Human
gccuggcauucccagccaugcauagucugggc

SEQ ID NO: 175230 - RNA, 23 nt, Human
gccuggccaaaauuuuuauugcc

SEQ ID NO: 175231 - RNA, 32 nt, Human
gccuggccaacauuuucuccagauaucuuacu

SEQ ID NO: 175232 - RNA, 32 nt, Human
gccuggccaaccuccgccuccuggguucaagu

SEQ ID NO: 175233 - RNA, 32 nt, Human
gccuggccaauacaaaaauuagccgggcaugg

SEQ ID NO: 175234 - RNA, 32 nt, Human
gccuggccaccacucgccccaggcugggaaac

SEQ ID NO: 175235 - RNA, 32 nt, Human
gccuggccaccucugugcuucuugugaagucu

SEQ ID NO: 175236 - RNA, 32 nt, Human
gccuggccacgcccucccucucccaggcccga

SEQ ID NO: 175237 - RNA, 32 nt, Human
gccuggccacugagcacuggccgaggugaugc

SEQ ID NO: 175238 - RNA, 32 nt, Human
gccuggccagcauccccagccuaggagaagga

SEQ ID NO: 175239 - RNA, 18 nt, Human
gccuggccaucagccccg

SEQ ID NO: 175240 - RNA, 24 nt, Human
gccuggccaucaguauuuauugcc

SEQ ID NO: 175241 - RNA, 32 nt, Human
gccuggccauguccaagaggcuguagaaaggg

SEQ ID NO: 175242 - RNA, 32 nt, Human
gccuggccauuuccuaaccugccaccguugga

SEQ ID NO: 175243 - RNA, 21 nt, Human
gccuggcccaacggugcggug

SEQ ID NO: 175244 - RNA, 20 nt, Human
gccuggcccaagccaguaca

SEQ ID NO: 175245 - RNA, 32 nt, Human
gccuggcccagccccaccucagucuccaggac

SEQ ID NO: 175246 - RNA, 32 nt, Human
gccuggcccagccucagcacccagggccagug

SEQ ID NO: 175247 - RNA, 32 nt, Human
gccuggcccaggacuugggacaguggccuugu

SEQ ID NO: 175248 - RNA, 16 nt, Human
gccuggcccaggguga

SEQ ID NO: 175249 - RNA, 32 nt, Human
gccuggcccccacccucugccacccaguccuc

SEQ ID NO: 175250 - RNA, 16 nt, Human
gccuggcccccucucc

SEQ ID NO: 175251 - RNA, 17 nt, Human
gccuggccccgcucgcc

SEQ ID NO: 175252 - RNA, 18 nt, Human
gccuggccccggcucucu

SEQ ID NO: 175253 - RNA, 19 nt, Human
gccuggccccucccuggug

SEQ ID NO: 175254 - RNA, 32 nt, Human
gccuggccccugggauugcaguugagaguuau

SEQ ID NO: 175255 - RNA, 18 nt, Human
gccuggccccuucuguac

SEQ ID NO: 175256 - RNA, 32 nt, Human
gccuggcccgggagcugcggucgcagaggccg

SEQ ID NO: 175257 - RNA, 21 nt, Human
gccuggcccgugagugccuca

SEQ ID NO: 175258 - RNA, 32 nt, Human
gccuggcccuccgaggagacagaagggagugu

SEQ ID NO: 175259 - RNA, 32 nt, Human
gccuggcccugagagcggcucugcugucaucu

SEQ ID NO: 175260 - RNA, 32 nt, Human
gccuggcccugagcugucaccaccgacacucu

SEQ ID NO: 175261 - RNA, 32 nt, Human
gccuggcccugcaggccccaaccuucccucau

SEQ ID NO: 175262 - RNA, 32 nt, Human
gccuggcccugccucgaugccucucuggcgca

SEQ ID NO: 175263 - RNA, 32 nt, Human
gccuggcccuggagggagcuggguggccuggc

SEQ ID NO: 175264 - RNA, 32 nt, Human
gccuggcccuggaggguggucacggccccucc

SEQ ID NO: 175265 - RNA, 32 nt, Human
gccuggcccuggggacuguuggcugcucuccc

SEQ ID NO: 175266 - RNA, 20 nt, Human
gccuggcccuguggcucuuc

SEQ ID NO: 175267 - RNA, 32 nt, Human
gccuggccgcgccuuggguuccugccuugcag

SEQ ID NO: 175268 - RNA, 19 nt, Human
gccuggccgggcgcagugg

SEQ ID NO: 175269 - RNA, 32 nt, Human
gccuggccguagauuacuagucuucuagaugu

SEQ ID NO: 175270 - RNA, 32 nt, Human
gccuggccgugugcauggccucccgggcugug

SEQ ID NO: 175271 - RNA, 19 nt, Human
gccuggccuaagcaccugg

SEQ ID NO: 175272 - RNA, 32 nt, Human
gccuggccucaaacuuuaccuuuagacagugg

SEQ ID NO: 175273 - RNA, 32 nt, Human
gccuggccucccagcccugcccggcugcucug

SEQ ID NO: 175274 - RNA, 32 nt, Human
gccuggccuccccgucgaccucagugccuuuu

SEQ ID NO: 175275 - RNA, 32 nt, Human
gccuggccucuucuccccucucuucccagcag

SEQ ID NO: 175276 - RNA, 16 nt, Human
gccuggccucuugaua

SEQ ID NO: 175277 - RNA, 32 nt, Human
gccuggccugcagaagagcccagauccaugag

SEQ ID NO: 175278 - RNA, 32 nt, Human
gccuggccugccagccauuggagguguuuaag

SEQ ID NO: 175279 - RNA, 32 nt, Human
gccuggccugcucuugugggcugugguugcug

SEQ ID NO: 175280 - RNA, 32 nt, Human
gccuggccugggcagcccuggaagcucggagg

SEQ ID NO: 175281 - RNA, 32 nt, Human
gccuggccuguccuacuguguguggguugucu

SEQ ID NO: 175282 - RNA, 32 nt, Human
gccuggccuguucuguccuuagcuuccccaag

SEQ ID NO: 175283 - RNA, 32 nt, Human
gccuggcgacagagcaagacuccaucccaaaa

SEQ ID NO: 175284 - RNA, 32 nt, Human
gccuggcgacagagcaagacucugucucaaaa

SEQ ID NO: 175285 - RNA, 32 nt, Human
gccuggcgacagagcaagacucugucucucaa

SEQ ID NO: 175286 - RNA, 32 nt, Human
gccuggcgacagagcaagucuccgucuaaaag

SEQ ID NO: 175287 - RNA, 32 nt, Human
gccuggcgagguuuuggccaggaggacgugaa

SEQ ID NO: 175288 - RNA, 32 nt, Human
gccuggcgccagaauaagaccucuuaucauga

SEQ ID NO: 175289 - RNA, 16 nt, Human
gccuggcgccggggcu

SEQ ID NO: 175290 - RNA, 32 nt, Human
gccuggcggagggugcgcgccgagccccgguc

SEQ ID NO: 175291 - RNA, 32 nt, Human
gccuggcgucugaucuggggccgcccuuacgg

SEQ ID NO: 175292 - RNA, 32 nt, Human
gccuggcgugcacuccgcaccucggggacauu

SEQ ID NO: 175293 - RNA, 32 nt, Human
gccuggcgugggaacaauguggccucuauccc

SEQ ID NO: 175294 - RNA, 32 nt, Human
gccuggcuaaccccugucccuccuggagggcu

SEQ ID NO: 175295 - RNA, 23 nt, Human
gccuggcucagcugggcugcagg

SEQ ID NO: 175296 - RNA, 21 nt, Human
gccuggcucaggagugcugga

SEQ ID NO: 175297 - RNA, 32 nt, Human
gccuggcucaggagugcuggaaaagcucacgc

SEQ ID NO: 175298 - RNA, 17 nt, Human
gccuggcuccaacauca

SEQ ID NO: 175299 - RNA, 32 nt, Human
gccuggcucccaggacaggaggccugcccugg

SEQ ID NO: 175300 - RNA, 17 nt, Human
gccuggcucccucaggu

SEQ ID NO: 175301 - RNA, 32 nt, Human
gccuggcucccucucgcugagacacacauaca

SEQ ID NO: 175302 - RNA, 20 nt, Human
gccuggcuccuagaagcccc

SEQ ID NO: 175303 - RNA, 32 nt, Human
gccuggcuccuggaugguccuggaggggccug

SEQ ID NO: 175304 - RNA, 32 nt, Human
gccuggcucugccccucccccaugggcugugu

SEQ ID NO: 175305 - RNA, 23 nt, Human
gccuggcugaacgacccagggca

SEQ ID NO: 175306 - RNA, 32 nt, Human
gccuggcugcaagcuagaaaugcuggguccau

SEQ ID NO: 175307 - RNA, 32 nt, Human
gccuggcugcccagagguggcagaugacauga

SEQ ID NO: 175308 - RNA, 18 nt, Human
gccuggcugcucuccuca

SEQ ID NO: 175309 - RNA, 32 nt, Human
gccuggcugcugcaggagcugggagccaccau

SEQ ID NO: 175310 - RNA, 32 nt, Human
gccuggcugcugccgcugccuccuccugggua

SEQ ID NO: 175311 - RNA, 19 nt, Human
gccuggcuggagugcagug

SEQ ID NO: 175312 - RNA, 20 nt, Human
gccuggcuggagugcagugg

SEQ ID NO: 175313 - RNA, 23 nt, Human
gccuggcuggagugcaguggugu

SEQ ID NO: 175314 - RNA, 20 nt, Human
gccuggcuggaguggagugg

SEQ ID NO: 175315 - RNA, 32 nt, Human
gccuggcuggcuuuucuucuucuucuggugaa

SEQ ID NO: 175316 - RNA, 32 nt, Human
gccuggcugggaaaggggguguggaaagagca

SEQ ID NO: 175317 - RNA, 19 nt, Human
gccuggcugggugcagugg

SEQ ID NO: 175318 - RNA, 22 nt, Human
gccuggcuguaguagugaguga

SEQ ID NO: 175319 - RNA, 32 nt, Human
gccuggcuuccaccucuccacuccugugucua

SEQ ID NO: 175320 - RNA, 32 nt, Human
gccuggcuucucugccuccagccuuuggggua

SEQ ID NO: 175321 - RNA, 32 nt, Human
gccuggcuuggcuucccuuccccauggcuggg

SEQ ID NO: 175322 - RNA, 32 nt, Human
gccuggcuuucuuauuuuaccaaggcauaagc

SEQ ID NO: 175323 - RNA, 32 nt, Human
gccuggcuuugaauuuugaggaauucugguua

SEQ ID NO: 175324 - RNA, 32 nt, Human
gccugggaaaacacugcagcggugcucggacu

SEQ ID NO: 175325 - RNA, 32 nt, Human
gccugggaaaacagcaagccacagagcggaac

SEQ ID NO: 175326 - RNA, 20 nt, Human
gccugggaaaacagcuucug

SEQ ID NO: 175327 - RNA, 24 nt, Human
gccugggaaaucuucaacauguua

SEQ ID NO: 175328 - RNA, 32 nt, Human
gccugggaaaugcucccuuggcauaaauagca

SEQ ID NO: 175329 - RNA, 32 nt, Human
gccugggaacaacagucauucuuccucuuugu

SEQ ID NO: 175330 - RNA, 32 nt, Human
gccugggaacacagcgagacccucucauuaaa

SEQ ID NO: 175331 - RNA, 24 nt, Human
gccugggaacgaggccaucagcug

SEQ ID NO: 175332 - RNA, 24 nt, Human
gccugggaacucaaggcugcagug

SEQ ID NO: 175333 - RNA, 32 nt, Human
gccugggaacuggcaaugggggagacauauua

SEQ ID NO: 175334 - RNA, 32 nt, Human
gccugggaagaggacaccuccuugggggagug

SEQ ID NO: 175335 - RNA, 18 nt, Human
gccugggaagcagaguga

SEQ ID NO: 175336 - RNA, 25 nt, Human
gccugggaagccugggaggacggug

SEQ ID NO: 175337 - RNA, 32 nt, Human
gccugggaagccugguacaaccugccacgggc

SEQ ID NO: 175338 - RNA, 22 nt, Human
gccugggaaggagggugcugug

SEQ ID NO: 175339 - RNA, 32 nt, Human
gccugggaagucaagccugcagugagccauga

SEQ ID NO: 175340 - RNA, 24 nt, Human
gccugggaaguggaaguugcagug

SEQ ID NO: 175341 - RNA, 32 nt, Human
gccugggaaguggaaguugcagugagccaaga

SEQ ID NO: 175342 - RNA, 32 nt, Human
gccugggaaguggaggcugcagugagccuagg

SEQ ID NO: 175343 - RNA, 32 nt, Human
gccugggaaguggagguugcaguaggcugaag

SEQ ID NO: 175344 - RNA, 32 nt, Human
gccugggaagugguagagagaccccagagagg

SEQ ID NO: 175345 - RNA, 24 nt, Human
gccugggaaguugaggcugcagug

SEQ ID NO: 175346 - RNA, 32 nt, Human
gccugggaaguugaggcugcagugagccguga

SEQ ID NO: 175347 - RNA, 21 nt, Human
gccugggaaugggggugagug

SEQ ID NO: 175348 - RNA, 32 nt, Human
gccugggacagcccuggggacacagucaccca

SEQ ID NO: 175349 - RNA, 32 nt, Human
gccugggacagggcuuaccaccugccaccaag

SEQ ID NO: 175350 - RNA, 24 nt, Human
gccugggacauugaggcugcagug

SEQ ID NO: 175351 - RNA, 23 nt, Human
gccugggacccaccagggugcag

SEQ ID NO: 175352 - RNA, 19 nt, Human
gccugggacccagguucug

SEQ ID NO: 175353 - RNA, 32 nt, Human
gccugggacgggagguggagaguuugcagagc

SEQ ID NO: 175354 - RNA, 18 nt, Human
gccugggagacagaguga

SEQ ID NO: 175355 - RNA, 21 nt, Human
gccugggagacgcggugcugu

SEQ ID NO: 175356 - RNA, 32 nt, Human
gccugggagaucgaggcugcagugagccaaga

SEQ ID NO: 175357 - RNA, 32 nt, Human
gccugggagaugagacaggguuagaggaaaca

SEQ ID NO: 175358 - RNA, 24 nt, Human
gccugggagauggagguugcagug

SEQ ID NO: 175359 - RNA, 32 nt, Human
gccugggagauggagguugcagugagcugaga

SEQ ID NO: 175360 - RNA, 32 nt, Human
gccugggagaugggguaagaagagcuuucauu

SEQ ID NO: 175361 - RNA, 24 nt, Human
gccugggagauugaggcugcagug

SEQ ID NO: 175362 - RNA, 32 nt, Human
gccugggagcaugauuguggacaagcugcugg

SEQ ID NO: 175363 - RNA, 32 nt, Human
gccugggagcccagaggguggcaagaacagug

SEQ ID NO: 175364 - RNA, 23 nt, Human
gccugggagccgagagaggcggu

SEQ ID NO: 175365 - RNA, 21 nt, Human
gccugggagcggcuggcgcgg

SEQ ID NO: 175366 - RNA, 24 nt, Human
gccugggaggaagagguugcagug

SEQ ID NO: 175367 - RNA, 32 nt, Human
gccugggaggaagagguugcagugagccgaga

SEQ ID NO: 175368 - RNA, 24 nt, Human
gccugggaggcaaagguugcagug

SEQ ID NO: 175369 - RNA, 32 nt, Human
gccugggaggcagagauugcacugagccgaga

SEQ ID NO: 175370 - RNA, 32 nt, Human
gccugggaggcagaggcugcagugagccgaga

SEQ ID NO: 175371 - RNA, 24 nt, Human
gccugggaggcagagguugcagug

SEQ ID NO: 175372 - RNA, 32 nt, Human
gccugggaggcagagguugcagugagccaaga

SEQ ID NO: 175373 - RNA, 32 nt, Human
gccugggaggcagagguugcagugagccgaga

SEQ ID NO: 175374 - RNA, 32 nt, Human
gccugggaggcagagguugcagugagcugaga

SEQ ID NO: 175375 - RNA, 24 nt, Human
gccugggaggcagagguugcugug

SEQ ID NO: 175376 - RNA, 32 nt, Human
gccugggaggcagagguugcugugagccgaga

SEQ ID NO: 175377 - RNA, 32 nt, Human
gccugggaggcagggccugggcagggcuucug

SEQ ID NO: 175378 - RNA, 32 nt, Human
gccugggaggcauagguugcagugagccgaga

SEQ ID NO: 175379 - RNA, 23 nt, Human
gccugggaggccagaaugaagug

SEQ ID NO: 175380 - RNA, 20 nt, Human
gccugggaggccagguucug

SEQ ID NO: 175381 - RNA, 23 nt, Human
gccugggaggcccagguguagcg

SEQ ID NO: 175382 - RNA, 20 nt, Human
gccugggaggcggagguugc

SEQ ID NO: 175383 - RNA, 24 nt, Human
gccugggaggcggagguugcagug

SEQ ID NO: 175384 - RNA, 25 nt, Human
gccugggaggcggagguugcaguga

SEQ ID NO: 175385 - RNA, 32 nt, Human
gccugggaggcggagguugcagugagccgaga

SEQ ID NO: 175386 - RNA, 32 nt, Human
gccugggaggcggagguugcagugagccgagg

SEQ ID NO: 175387 - RNA, 26 nt, Human
gccugggaggcggcccggaggugggg

SEQ ID NO: 175388 - RNA, 22 nt, Human
gccugggaggcgggggccggcg

SEQ ID NO: 175389 - RNA, 32 nt, Human
gccugggaggcugaggcgggagaaucaccuga

SEQ ID NO: 175390 - RNA, 32 nt, Human
gccugggaggcugccaggggguggggcuucug

SEQ ID NO: 175391 - RNA, 25 nt, Human
gccugggaggcuuccugguguggug

SEQ ID NO: 175392 - RNA, 22 nt, Human
gccugggaggguccaucagcug

SEQ ID NO: 175393 - RNA, 32 nt, Human
gccugggagggugaggaugcaugagccaugau

SEQ ID NO: 175394 - RNA, 32 nt, Human
gccugggaggucaagccuacagugagccauga

SEQ ID NO: 175395 - RNA, 32 nt, Human
gccugggaggucaaggcaucagugagcgaugg

SEQ ID NO: 175396 - RNA, 24 nt, Human
gccugggaggucaaggcugcagug

SEQ ID NO: 175397 - RNA, 32 nt, Human
gccugggaggucaaggcugcagugagccauga

SEQ ID NO: 175398 - RNA, 32 nt, Human
gccugggaggucaaggcugcagugagccgaga

SEQ ID NO: 175399 - RNA, 32 nt, Human
gccugggaggucaaggcugcagugagccguga

SEQ ID NO: 175400 - RNA, 32 nt, Human
gccugggaggucaaggcugcagugagcuguga

SEQ ID NO: 175401 - RNA, 24 nt, Human
gccugggaggucgaggcugcagug

SEQ ID NO: 175402 - RNA, 32 nt, Human
gccugggaggucgaggcugcagugagcuguga

SEQ ID NO: 175403 - RNA, 32 nt, Human
gccugggagguggaggcuacugugagccauga

SEQ ID NO: 175404 - RNA, 32 nt, Human
gccugggagguggagguugcacugaguagaga

SEQ ID NO: 175405 - RNA, 24 nt, Human
gccugggagguggagguugcagug

SEQ ID NO: 175406 - RNA, 32 nt, Human
gccugggagguggagguugcagugagcuaaga

SEQ ID NO: 175407 - RNA, 32 nt, Human
gccugggagguggagguugcagugaguggaga

SEQ ID NO: 175408 - RNA, 25 nt, Human
gccugggagguggagguugcagugg

SEQ ID NO: 175409 - RNA, 32 nt, Human
gccugggagguggagguugccagugagucgag

SEQ ID NO: 175410 - RNA, 32 nt, Human
gccugggagguggagguuucagugagcuggga

SEQ ID NO: 175411 - RNA, 32 nt, Human
gccugggagguggaguuugcagugagcuaaga

SEQ ID NO: 175412 - RNA, 32 nt, Human
gccugggaggugggugugggggugguggguga

SEQ ID NO: 175413 - RNA, 24 nt, Human
gccugggagguugaggcugcagug

SEQ ID NO: 175414 - RNA, 32 nt, Human
gccugggagguugaggcugcagugagccauga

SEQ ID NO: 175415 - RNA, 24 nt, Human
gccugggagguugugguugcagug

SEQ ID NO: 175416 - RNA, 32 nt, Human
gccugggagguugugguugcagugagcuauga

SEQ ID NO: 175417 - RNA, 21 nt, Human
gccugggagugggggugcagg

SEQ ID NO: 175418 - RNA, 24 nt, Human
gccugggaguucgaggcugcagug

SEQ ID NO: 175419 - RNA, 32 nt, Human
gccugggaguucgaggcugcagugagcaauga

SEQ ID NO: 175420 - RNA, 24 nt, Human
gccugggaguuugaggcugcagug

SEQ ID NO: 175421 - RNA, 32 nt, Human
gccugggaguuugaggcugcagugagcuauga

SEQ ID NO: 175422 - RNA, 32 nt, Human
gccugggauagccgcugguaacuguuaggaac

SEQ ID NO: 175423 - RNA, 32 nt, Human
gccugggauccaggaaccagugggauuggaug

SEQ ID NO: 175424 - RNA, 32 nt, Human
gccugggauggccacagaaggggcaggccagg

SEQ ID NO: 175425 - RNA, 32 nt, Human
gccugggaugucaaggcugcagugagcuguga

SEQ ID NO: 175426 - RNA, 32 nt, Human
gccugggaugucagggcuacagugagccauaa

SEQ ID NO: 175427 - RNA, 32 nt, Human
gccugggauugugcacuguccaggguccugaa

SEQ ID NO: 175428 - RNA, 32 nt, Human
gccugggcaaaaagagccagacuccgucucaa

SEQ ID NO: 175429 - RNA, 32 nt, Human
gccugggcaaaaaugcuucaacacgccacugg

SEQ ID NO: 175430 - RNA, 32 nt, Human
gccugggcaacacagugagugagacccugucu

SEQ ID NO: 175431 - RNA, 18 nt, Human
gccugggcaacagaguga

SEQ ID NO: 175432 - RNA, 32 nt, Human
gccugggcaacagagugacacucugucucaaa

SEQ ID NO: 175433 - RNA, 18 nt, Human
gccugggcaacagagugg

SEQ ID NO: 175434 - RNA, 21 nt, Human
gccugggcaacauggcaaaug

SEQ ID NO: 175435 - RNA, 20 nt, Human
gccugggcaacauggcgaaa

SEQ ID NO: 175436 - RNA, 20 nt, Human
gccugggcaacauggugaaa

SEQ ID NO: 175437 - RNA, 32 nt, Human
gccugggcaacgagcaagacccagucucuacu

SEQ ID NO: 175438 - RNA, 18 nt, Human
gccugggcaacggaguga

SEQ ID NO: 175439 - RNA, 32 nt, Human
gccugggcacacacaggcaucgggcaccugca

SEQ ID NO: 175440 - RNA, 32 nt, Human
gccugggcacacaccacaugcagauuucagug

SEQ ID NO: 175441 - RNA, 18 nt, Human
gccugggcacuagaguga

SEQ ID NO: 175442 - RNA, 19 nt, Human
gccugggcagcaagaguga

SEQ ID NO: 175443 - RNA, 18 nt, Human
gccugggcagcagagcga

SEQ ID NO: 175444 - RNA, 17 nt, Human
gccugggcagcagagga

SEQ ID NO: 175445 - RNA, 18 nt, Human
gccugggcagcagaguga

SEQ ID NO: 175446 - RNA, 32 nt, Human
gccugggcagcccucacacccaugcucccucc

SEQ ID NO: 175447 - RNA, 15 nt, Human
gccugggcaggggga

SEQ ID NO: 175448 - RNA, 32 nt, Human
gccugggcaguucuagggcuggagggcagggg

SEQ ID NO: 175449 - RNA, 21 nt, Human
gccugggcaucugaccucccc

SEQ ID NO: 175450 - RNA, 18 nt, Human
gccugggccacagaguga

SEQ ID NO: 175451 - RNA, 32 nt, Human
gccugggccacccuuccugccugggccucccc

SEQ ID NO: 175452 - RNA, 32 nt, Human
gccugggccagccugccuccuggccucaggau

SEQ ID NO: 175453 - RNA, 32 nt, Human
gccugggccagcucaaggugggcacgggggcc

SEQ ID NO: 175454 - RNA, 32 nt, Human
gccugggccaggugugacagaguagagguagc

SEQ ID NO: 175455 - RNA, 32 nt, Human
gccugggcccaggauuggagggcuucacacca

SEQ ID NO: 175456 - RNA, 19 nt, Human
gccugggcccccucaggga

SEQ ID NO: 175457 - RNA, 32 nt, Human
gccugggcccccuccuuccccugggccugguc

SEQ ID NO: 175458 - RNA, 17 nt, Human
gccugggccccuuccag

SEQ ID NO: 175459 - RNA, 32 nt, Human
gccugggcccgccucaaccaaaaguuugaccu

SEQ ID NO: 175460 - RNA, 32 nt, Human
gccugggcccugccaggcagaggcgcucuugc

SEQ ID NO: 175461 - RNA, 28 nt, Human
gccugggccgacacaaccuugagcacag

SEQ ID NO: 175462 - RNA, 28 nt, Human
gccugggccgacccaggaugcaacacag

SEQ ID NO: 175463 - RNA, 23 nt, Human
gccugggccgcugggacgcggug

SEQ ID NO: 175464 - RNA, 32 nt, Human
gccugggccgugaggucacugccaccaugagu

SEQ ID NO: 175465 - RNA, 22 nt, Human
gccugggccuccccaggagcug

SEQ ID NO: 175466 - RNA, 22 nt, Human
gccugggccugcuggacuccaa

SEQ ID NO: 175467 - RNA, 32 nt, Human
gccugggccugucaggcgguuccguccggguc

SEQ ID NO: 175468 - RNA, 32 nt, Human
gccugggccuguugcuuuugagcccagcgguu

SEQ ID NO: 175469 - RNA, 32 nt, Human
gccugggcgacaaagcaauaccccuaucucua

SEQ ID NO: 175470 - RNA, 18 nt, Human
gccugggcgacagaguga

SEQ ID NO: 175471 - RNA, 19 nt, Human
gccugggcggcagagccag

SEQ ID NO: 175472 - RNA, 18 nt, Human
gccugggcggcagaguga

SEQ ID NO: 175473 - RNA, 18 nt, Human
gccugggcgucagaguga

SEQ ID NO: 175474 - RNA, 32 nt, Human
gccugggcguggcagccucacagggaacacgg

SEQ ID NO: 175475 - RNA, 32 nt, Human
gccugggcuaagccuggcuaggagccgcgcag

SEQ ID NO: 175476 - RNA, 18 nt, Human
gccugggcuacagaguga

SEQ ID NO: 175477 - RNA, 32 nt, Human
gccugggcuaggcugcagccugccuccugggg

SEQ ID NO: 175478 - RNA, 32 nt, Human
gccugggcuaucucuuuaaaguuaucuugauu

SEQ ID NO: 175479 - RNA, 32 nt, Human
gccugggcucaagcaacccucccgccucccug

SEQ ID NO: 175480 - RNA, 32 nt, Human
gccugggcucaagcgauccucccaccucagcc

SEQ ID NO: 175481 - RNA, 32 nt, Human
gccugggcucaagugaucuuacuccagccucc

SEQ ID NO: 175482 - RNA, 32 nt, Human
gccugggcucccaggauucgggucugagacuu

SEQ ID NO: 175483 - RNA, 32 nt, Human
gccugggcucccuggcccugccccacccaccu

SEQ ID NO: 175484 - RNA, 32 nt, Human
gccugggcucugaaugcccacccugcgacggu

SEQ ID NO: 175485 - RNA, 32 nt, Human
gccugggcucugagccucagcugagcccugga

SEQ ID NO: 175486 - RNA, 32 nt, Human
gccugggcugccucuucgcggggugucccgag

SEQ ID NO: 175487 - RNA, 21 nt, Human
gccugggcuggaaugcagugg

SEQ ID NO: 175488 - RNA, 23 nt, Human
gccugggcuggaaugcaguggug

SEQ ID NO: 175489 - RNA, 21 nt, Human
gccugggcuggaguacagugg

SEQ ID NO: 175490 - RNA, 23 nt, Human
gccugggcuggaguacaguggug

SEQ ID NO: 175491 - RNA, 20 nt, Human
gccugggcuggagugcagug

SEQ ID NO: 175492 - RNA, 21 nt, Human
gccugggcuggagugcagugg

SEQ ID NO: 175493 - RNA, 24 nt, Human
gccugggcuggagugcaguggcgu

SEQ ID NO: 175494 - RNA, 32 nt, Human
gccugggcuggcuggcaucccugggucgaugg

SEQ ID NO: 175495 - RNA, 32 nt, Human
gccugggcuggcuguggcccagugcucaggac

SEQ ID NO: 175496 - RNA, 32 nt, Human
gccugggcuggggcucgcuccagggcuuugca

SEQ ID NO: 175497 - RNA, 32 nt, Human
gccugggcugggugucuggugccuggaacaga

SEQ ID NO: 175498 - RNA, 32 nt, Human
gccugggcuggucucaaacuccuggguucaag

SEQ ID NO: 175499 - RNA, 32 nt, Human
gccuggggaaggggagucagugcuggagguga

SEQ ID NO: 175500 - RNA, 32 nt, Human
gccuggggaccuugaagaaugcccuucagugg

SEQ ID NO: 175501 - RNA, 32 nt, Human
gccuggggacgcccacccacacccacugcuuc

SEQ ID NO: 175502 - RNA, 32 nt, Human
gccuggggagagaagcaagagcaggcuggagu

SEQ ID NO: 175503 - RNA, 32 nt, Human
gccuggggagaguggucccugcccuuccgcgc

SEQ ID NO: 175504 - RNA, 32 nt, Human
gccuggggagcuuguuaaaaguguagauucca

SEQ ID NO: 175505 - RNA, 32 nt, Human
gccuggggagggcugugcuggggaugagcgcc

SEQ ID NO: 175506 - RNA, 21 nt, Human
gccuggggaggucgagggugc

SEQ ID NO: 175507 - RNA, 32 nt, Human
gccuggggaucuuguuaaaaugcagauccuga

SEQ ID NO: 175508 - RNA, 32 nt, Human
gccuggggauuccagcugucuugucuuuuucc

SEQ ID NO: 175509 - RNA, 32 nt, Human
gccuggggcagccuccugauggggauguuugg

SEQ ID NO: 175510 - RNA, 32 nt, Human
gccuggggcaggaaguggagugacaggggaca

SEQ ID NO: 175511 - RNA, 32 nt, Human
gccuggggcaggcauggcggauuccagcgaag

SEQ ID NO: 175512 - RNA, 32 nt, Human
gccuggggcauuuaguguuuucccuggugaua

SEQ ID NO: 175513 - RNA, 18 nt, Human
gccuggggccagcggcgc

SEQ ID NO: 175514 - RNA, 32 nt, Human
gccuggggcccaggacugcagcggcuucggaa

SEQ ID NO: 175515 - RNA, 32 nt, Human
gccuggggcccucacuccugcccacgccuccc

SEQ ID NO: 175516 - RNA, 32 nt, Human
gccuggggccugggccucuccugggcugugcc

SEQ ID NO: 175517 - RNA, 32 nt, Human
gccuggggccuggggaaagggcuuggacugug

SEQ ID NO: 175518 - RNA, 32 nt, Human
gccuggggcugcaggauccuaguugguuccug

SEQ ID NO: 175519 - RNA, 32 nt, Human
gccuggggcugccucugcucuccaagacccaa

SEQ ID NO: 175520 - RNA, 32 nt, Human
gccuggggcugggcgggggccauggcgcugcc

SEQ ID NO: 175521 - RNA, 32 nt, Human
gccuggggcuggggccucccucccaggcccug

SEQ ID NO: 175522 - RNA, 32 nt, Human
gccugggggacugaggcugcagugagccauga

SEQ ID NO: 175523 - RNA, 32 nt, Human
gccugggggcaggcgggcuagaggagcaggua

SEQ ID NO: 175524 - RNA, 32 nt, Human
gccugggggcccccaccuccacucucuggguu

SEQ ID NO: 175525 - RNA, 32 nt, Human
gccugggggcccugccuuccgggcgcuccugg

SEQ ID NO: 175526 - RNA, 32 nt, Human
gccugggggcucccccgacccucucucuauuc

SEQ ID NO: 175527 - RNA, 32 nt, Human
gccugggguagagagacagaaacuugagagaa

SEQ ID NO: 175528 - RNA, 26 nt, Human
gccuggggucacucagaccaccagcc

SEQ ID NO: 175529 - RNA, 32 nt, Human
gccuggggugagagcacagaggagugggccgg

SEQ ID NO: 175530 - RNA, 32 nt, Human
gccugggguuacugcugaccuuucagugcugu

SEQ ID NO: 175531 - RNA, 32 nt, Human
gccugggguugugguugaggccgggucuccgc

SEQ ID NO: 175532 - RNA, 19 nt, Human
gccuggguaacagagcuag

SEQ ID NO: 175533 - RNA, 15 nt, Human
gccugggucaggggg

SEQ ID NO: 175534 - RNA, 32 nt, Human
gccugggucaugcaccuggaguugggagauca

SEQ ID NO: 175535 - RNA, 32 nt, Human
gccugggucccugaaucaucauguggaaggcu

SEQ ID NO: 175536 - RNA, 32 nt, Human
gccuggguccuacccugucuggucaugacccc

SEQ ID NO: 175537 - RNA, 32 nt, Human
gccuggguccugacuuuuccauugacuaagcu

SEQ ID NO: 175538 - RNA, 32 nt, Human
gccugggucggccucuggaguauggucuggcg

SEQ ID NO: 175539 - RNA, 32 nt, Human
gccugggucuccaggagaagcugagggcacag

SEQ ID NO: 175540 - RNA, 32 nt, Human
gccugggucuguccuccaagagaacccugaga

SEQ ID NO: 175541 - RNA, 32 nt, Human
gccugggugaagcaucugcuggacaagucgga

SEQ ID NO: 175542 - RNA, 18 nt, Human
gccugggugacaaaguaa

SEQ ID NO: 175543 - RNA, 29 nt, Human
gccugggugacaagggaagacucucucuu

SEQ ID NO: 175544 - RNA, 32 nt, Human
gccugggugacacuccagccugggugacaaag

SEQ ID NO: 175545 - RNA, 18 nt, Human
gccugggugacagagcca

SEQ ID NO: 175546 - RNA, 19 nt, Human
gccugggugacagagccag

SEQ ID NO: 175547 - RNA, 19 nt, Human
gccugggugacagagcuag

SEQ ID NO: 175548 - RNA, 19 nt, Human
gccugggugacagagucag

SEQ ID NO: 175549 - RNA, 32 nt, Human
gccugggugacagauccagacucugucucaaa

SEQ ID NO: 175550 - RNA, 32 nt, Human
gccugggugagucaggaguccgggggcuuucu

SEQ ID NO: 175551 - RNA, 32 nt, Human
gccugggugaugaggcugcuggaagcuuugaa

SEQ ID NO: 175552 - RNA, 32 nt, Human
gccugggugccuggagcugagcugcggcaagg

SEQ ID NO: 175553 - RNA, 32 nt, Human
gccugggugcuggccugcccucuccggccgcu

SEQ ID NO: 175554 - RNA, 21 nt, Human
gccuggguggcaagggugaga

SEQ ID NO: 175555 - RNA, 32 nt, Human
gccuggguggcaccaggcaaugcaggugaagu

SEQ ID NO: 175556 - RNA, 18 nt, Human
gccuggguggcagaguga

SEQ ID NO: 175557 - RNA, 20 nt, Human
gccuggguggcggggcccag

SEQ ID NO: 175558 - RNA, 32 nt, Human
gccuggguggggagcaggucucaggccucuug

SEQ ID NO: 175559 - RNA, 32 nt, Human
gccugggugggugccuggcugugugcagugag

SEQ ID NO: 175560 - RNA, 32 nt, Human
gccuggguugcaggcccugcuugugguggcgc

SEQ ID NO: 175561 - RNA, 32 nt, Human
gccuggguugggagggaagugggaggagggaa

SEQ ID NO: 175562 - RNA, 32 nt, Human
gccuggguuggguuuagaaagaucucaggaaa

SEQ ID NO: 175563 - RNA, 17 nt, Human
gccuggguuucugugga

SEQ ID NO: 175564 - RNA, 32 nt, Human
gccuggguuugcagccuggcucugccccuugc

SEQ ID NO: 175565 - RNA, 32 nt, Human
gccugguaggagagagacaggacagacccgcu

SEQ ID NO: 175566 - RNA, 32 nt, Human
gccugguaggcugaggcugcagugagccaaga

SEQ ID NO: 175567 - RNA, 23 nt, Human
gccugguaucagggaaauugaga

SEQ ID NO: 175568 - RNA, 32 nt, Human
gccuggucaguaggggaagcaaggugaccgca

SEQ ID NO: 175569 - RNA, 21 nt, Human
gccugguccagacauugcaga

SEQ ID NO: 175570 - RNA, 24 nt, Human
gccuggucccacgagggugccgug

SEQ ID NO: 175571 - RNA, 20 nt, Human
gccuggucccaucuucugcc

SEQ ID NO: 175572 - RNA, 20 nt, Human
gccugguccucacacucacc

SEQ ID NO: 175573 - RNA, 20 nt, Human
gccugguccugcccaccuca

SEQ ID NO: 175574 - RNA, 32 nt, Human
gccugguccugccccuuccugguucuuaucuc

SEQ ID NO: 175575 - RNA, 19 nt, Human
gccugguccuucccugaug

SEQ ID NO: 175576 - RNA, 32 nt, Human
gccuggucucacuccuuggacuugucaccuug

SEQ ID NO: 175577 - RNA, 20 nt, Human
gccuggucucccgagcauca

SEQ ID NO: 175578 - RNA, 32 nt, Human
gccuggucucgaacuccugaccucaggugauc

SEQ ID NO: 175579 - RNA, 32 nt, Human
gccuggucuuaaacuccuaaccucaggugauc

SEQ ID NO: 175580 - RNA, 18 nt, Human
gccuggucuucucuccca

SEQ ID NO: 175581 - RNA, 32 nt, Human
gccuggucuugaacuccugaccucaggugauc

SEQ ID NO: 175582 - RNA, 32 nt, Human
gccuggugaauuggcuggccagcuggggugga

SEQ ID NO: 175583 - RNA, 32 nt, Human
gccuggugacacugcugccgcugcuaaacaug

SEQ ID NO: 175584 - RNA, 32 nt, Human
gccuggugacaucaaccagcaggaugagcgcu

SEQ ID NO: 175585 - RNA, 31 nt, Human
gccuggugacuucucccuccccggccucagg

SEQ ID NO: 175586 - RNA, 32 nt, Human
gccuggugagccaccuacccucuugggcauuu

SEQ ID NO: 175587 - RNA, 32 nt, Human
gccuggugagcgcccgccggcccacacaagcc

SEQ ID NO: 175588 - RNA, 17 nt, Human
gccuggugaggaggggg

SEQ ID NO: 175589 - RNA, 32 nt, Human
gccuggugcacugugucuguggugccagaggc

SEQ ID NO: 175590 - RNA, 32 nt, Human
gccuggugcagggagcaguagcagggacagca

SEQ ID NO: 175591 - RNA, 32 nt, Human
gccuggugcccuggcccagccuguggccucag

SEQ ID NO: 175592 - RNA, 32 nt, Human
gccuggugccuguaaucccagcuacucgggag

SEQ ID NO: 175593 - RNA, 32 nt, Human
gccuggugcgggcagagagguuucaguugauc

SEQ ID NO: 175594 - RNA, 32 nt, Human
gccuggugcucaauaaaugaacagugagugaa

SEQ ID NO: 175595 - RNA, 32 nt, Human
gccuggugcuucuccccacaccccuguaggcc

SEQ ID NO: 175596 - RNA, 17 nt, Human
gccugguggcagaguga

SEQ ID NO: 175597 - RNA, 21 nt, Human
gccugguggcagaugaaugca

SEQ ID NO: 175598 - RNA, 32 nt, Human
gccugguggcugcuugauuaugucaccagacu

SEQ ID NO: 175599 - RNA, 32 nt, Human
gccugguggggagcuugggugagucuguuuuc

SEQ ID NO: 175600 - RNA, 32 nt, Human
gccugguggggaggggagagcucagcccccga

SEQ ID NO: 175601 - RNA, 18 nt, Human
gccugguggguucugggg

SEQ ID NO: 175602 - RNA, 20 nt, Human
gccuggugucucuagacuca

SEQ ID NO: 175603 - RNA, 32 nt, Human
gccugguguggaggggaguccgggagggccug

SEQ ID NO: 175604 - RNA, 32 nt, Human
gccuggugugugcgugcugugugugcaugugu

SEQ ID NO: 175605 - RNA, 18 nt, Human
gccugguguuucuugaua

SEQ ID NO: 175606 - RNA, 19 nt, Human
gccugguuacucugcgaga

SEQ ID NO: 175607 - RNA, 21 nt, Human
gccugguuacugaccuuuccc

SEQ ID NO: 175608 - RNA, 32 nt, Human
gccugguucauccccagcuuccuggcaaaguu

SEQ ID NO: 175609 - RNA, 32 nt, Human
gccugguucucuucccugcucaggcugccaga

SEQ ID NO: 175610 - RNA, 29 nt, Human
gccugguugcugcuauugcucccaagggc

SEQ ID NO: 175611 - RNA, 32 nt, Human
gccugguuggguccuuggggcgggcagggcca

SEQ ID NO: 175612 - RNA, 32 nt, Human
gccugguugguagaauguuggcauucgguuga

SEQ ID NO: 175613 - RNA, 32 nt, Human
gccugguuguuccccucuuuggcccucucagg

SEQ ID NO: 175614 - RNA, 32 nt, Human
gccugguuuucuaaugcugucaucucaguucg

SEQ ID NO: 175615 - RNA, 32 nt, Human
gccugguuuugcucagcaccuaccccaguuua

SEQ ID NO: 175616 - RNA, 23 nt, Human
gccuguaaacccaacuacuuggg

SEQ ID NO: 175617 - RNA, 24 nt, Human
gccuguaaacccaacuacuuggga

SEQ ID NO: 175618 - RNA, 21 nt, Human
gccuguaaacccagcuacuca

SEQ ID NO: 175619 - RNA, 24 nt, Human
gccuguaaacccagcuacucagga

SEQ ID NO: 175620 - RNA, 25 nt, Human
gccuguaaaccucagcuacccagga

SEQ ID NO: 175621 - RNA, 32 nt, Human
gccuguaacccagcuacucaggaggcugaggc

SEQ ID NO: 175622 - RNA, 32 nt, Human
gccuguaacccagcuacucgggaggcugaagc

SEQ ID NO: 175623 - RNA, 23 nt, Human
gccuguaacccagcuacucguga

SEQ ID NO: 175624 - RNA, 21 nt, Human
gccuguaaccccagcuacuca

SEQ ID NO: 175625 - RNA, 23 nt, Human
gccuguaaccccagcuacucagg

SEQ ID NO: 175626 - RNA, 24 nt, Human
gccuguaaccccagcuacucagga

SEQ ID NO: 175627 - RNA, 23 nt, Human
gccuguaaccccagcuacucggg

SEQ ID NO: 175628 - RNA, 24 nt, Human
gccuguaaccccagcuacucggga

SEQ ID NO: 175629 - RNA, 32 nt, Human
gccuguaaccccaucacuuugggaggccagag

SEQ ID NO: 175630 - RNA, 24 nt, Human
gccuguaacuccagcuacuuggga

SEQ ID NO: 175631 - RNA, 23 nt, Human
gccuguaauaccagcuacucagg

SEQ ID NO: 175632 - RNA, 24 nt, Human
gccuguaauaccagcuacucagga

SEQ ID NO: 175633 - RNA, 32 nt, Human
gccuguaauaccaugucuucccaugagggguc

SEQ ID NO: 175634 - RNA, 24 nt, Human
gccuguaauagcagcuacucggga

SEQ ID NO: 175635 - RNA, 24 nt, Human
gccuguaauaucagcuacucagga

SEQ ID NO: 175636 - RNA, 24 nt, Human
gccuguaaucacagcuacucggga

SEQ ID NO: 175637 - RNA, 23 nt, Human
gccuguaaucacagcuacuuggg

SEQ ID NO: 175638 - RNA, 24 nt, Human
gccuguaaucacagcuacuuggga

SEQ ID NO: 175639 - RNA, 32 nt, Human
gccuguaaucacugcacccagccucaaauucc

SEQ ID NO: 175640 - RNA, 22 nt, Human
gccuguaaucagcuacucggga

SEQ ID NO: 175641 - RNA, 22 nt, Human
gccuguaauccaagcuacucgg

SEQ ID NO: 175642 - RNA, 22 nt, Human
gccuguaauccagcuacucagg

SEQ ID NO: 175643 - RNA, 23 nt, Human
gccuguaauccagcuacucagga

SEQ ID NO: 175644 - RNA, 32 nt, Human
gccuguaauccagcuacucaggaggcugaggc

SEQ ID NO: 175645 - RNA, 22 nt, Human
gccuguaauccagcuacucggg

SEQ ID NO: 175646 - RNA, 23 nt, Human
gccuguaauccagcuacucggga

SEQ ID NO: 175647 - RNA, 32 nt, Human
gccuguaauccagcuacucgggaggcugaggc

SEQ ID NO: 175648 - RNA, 32 nt, Human
gccuguaauccagcuacuugggaggcugaggc

SEQ ID NO: 175649 - RNA, 22 nt, Human
gccuguaaucccaacacuuagg

SEQ ID NO: 175650 - RNA, 20 nt, Human
gccuguaaucccaacacuuu

SEQ ID NO: 175651 - RNA, 22 nt, Human
gccuguaaucccaacuaccugg

SEQ ID NO: 175652 - RNA, 21 nt, Human
gccuguaaucccaacuacuca

SEQ ID NO: 175653 - RNA, 23 nt, Human
gccuguaaucccaacuacucagg

SEQ ID NO: 175654 - RNA, 23 nt, Human
gccuguaaucccaacuacucggg

SEQ ID NO: 175655 - RNA, 23 nt, Human
gccuguaaucccaacuacuuggg

SEQ ID NO: 175656 - RNA, 24 nt, Human
gccuguaaucccaacuacuuggga

SEQ ID NO: 175657 - RNA, 24 nt, Human
gccuguaaucccagauacuuggga

SEQ ID NO: 175658 - RNA, 24 nt, Human
gccuguaaucccagcaauuuggga

SEQ ID NO: 175659 - RNA, 24 nt, Human
gccuguaaucccagcacauuggga

SEQ ID NO: 175660 - RNA, 18 nt, Human
gccuguaaucccagcacu

SEQ ID NO: 175661 - RNA, 22 nt, Human
gccuguaaucccagcacugaga

SEQ ID NO: 175662 - RNA, 22 nt, Human
gccuguaaucccagcacuuagg

SEQ ID NO: 175663 - RNA, 32 nt, Human
gccuguaaucccagcacuucacuuugggaggc

SEQ ID NO: 175664 - RNA, 21 nt, Human
gccuguaaucccagcacuugg

SEQ ID NO: 175665 - RNA, 22 nt, Human
gccuguaaucccagcacuuggg

SEQ ID NO: 175666 - RNA, 23 nt, Human
gccuguaaucccagcacuuggga

SEQ ID NO: 175667 - RNA, 20 nt, Human
gccuguaaucccagcacuuu

SEQ ID NO: 175668 - RNA, 23 nt, Human
gccuguaaucccagcacuuuaga

SEQ ID NO: 175669 - RNA, 24 nt, Human
gccuguaaucccagcaguuuggga

SEQ ID NO: 175670 - RNA, 23 nt, Human
gccuguaaucccagcauuuggga

SEQ ID NO: 175671 - RNA, 24 nt, Human
gccuguaaucccagcauuuuggga

SEQ ID NO: 175672 - RNA, 21 nt, Human
gccuguaaucccagccacuca

SEQ ID NO: 175673 - RNA, 23 nt, Human
gccuguaaucccagccacucagg

SEQ ID NO: 175674 - RNA, 32 nt, Human
gccuguaaucccagccacucaggaagcugagg

SEQ ID NO: 175675 - RNA, 23 nt, Human
gccuguaaucccagccacuuggg

SEQ ID NO: 175676 - RNA, 24 nt, Human
gccuguaaucccagccacuuggga

SEQ ID NO: 175677 - RNA, 23 nt, Human
gccuguaaucccagcuaaucagg

SEQ ID NO: 175678 - RNA, 24 nt, Human
gccuguaaucccagcuaaucagga

SEQ ID NO: 175679 - RNA, 24 nt, Human
gccuguaaucccagcuacauggga

SEQ ID NO: 175680 - RNA, 21 nt, Human
gccuguaaucccagcuaccca

SEQ ID NO: 175681 - RNA, 23 nt, Human
gccuguaaucccagcuacccagg

SEQ ID NO: 175682 - RNA, 24 nt, Human
gccuguaaucccagcuacccagga

SEQ ID NO: 175683 - RNA, 23 nt, Human
gccuguaaucccagcuacccggg

SEQ ID NO: 175684 - RNA, 24 nt, Human
gccuguaaucccagcuacccgggg

SEQ ID NO: 175685 - RNA, 24 nt, Human
gccuguaaucccagcuacgcagga

SEQ ID NO: 175686 - RNA, 24 nt, Human
gccuguaaucccagcuacgucagg

SEQ ID NO: 175687 - RNA, 24 nt, Human
gccuguaaucccagcuacguggga

SEQ ID NO: 175688 - RNA, 19 nt, Human
gccuguaaucccagcuacu

SEQ ID NO: 175689 - RNA, 23 nt, Human
gccuguaaucccagcuacuaagg

SEQ ID NO: 175690 - RNA, 24 nt, Human
gccuguaaucccagcuacuaagga

SEQ ID NO: 175691 - RNA, 24 nt, Human
gccuguaaucccagcuacuagaga

SEQ ID NO: 175692 - RNA, 22 nt, Human
gccuguaaucccagcuacuagg

SEQ ID NO: 175693 - RNA, 23 nt, Human
gccuguaaucccagcuacuaggg

SEQ ID NO: 175694 - RNA, 24 nt, Human
gccuguaaucccagcuacuaggga

SEQ ID NO: 175695 - RNA, 24 nt, Human
gccuguaaucccagcuacuagggg

SEQ ID NO: 175696 - RNA, 21 nt, Human
gccuguaaucccagcuacuca

SEQ ID NO: 175697 - RNA, 24 nt, Human
gccuguaaucccagcuacucaaga

SEQ ID NO: 175698 - RNA, 23 nt, Human
gccuguaaucccagcuacucaga

SEQ ID NO: 175699 - RNA, 23 nt, Human
gccuguaaucccagcuacucagg

SEQ ID NO: 175700 - RNA, 24 nt, Human
gccuguaaucccagcuacucagga

SEQ ID NO: 175701 - RNA, 23 nt, Human
gccuguaaucccagcuacuccgg

SEQ ID NO: 175702 - RNA, 24 nt, Human
gccuguaaucccagcuacuccgga

SEQ ID NO: 175703 - RNA, 24 nt, Human
gccuguaaucccagcuacuccggg

SEQ ID NO: 175704 - RNA, 22 nt, Human
gccuguaaucccagcuacucgg

SEQ ID NO: 175705 - RNA, 23 nt, Human
gccuguaaucccagcuacucgga

SEQ ID NO: 175706 - RNA, 24 nt, Human
gccuguaaucccagcuacucggag

SEQ ID NO: 175707 - RNA, 23 nt, Human
gccuguaaucccagcuacucggg

SEQ ID NO: 175708 - RNA, 24 nt, Human
gccuguaaucccagcuacucggga

SEQ ID NO: 175709 - RNA, 24 nt, Human
gccuguaaucccagcuacucgggg

SEQ ID NO: 175710 - RNA, 24 nt, Human
gccuguaaucccagcuacucugga

SEQ ID NO: 175711 - RNA, 23 nt, Human
gccuguaaucccagcuacugagg

SEQ ID NO: 175712 - RNA, 22 nt, Human
gccuguaaucccagcuacuggg

SEQ ID NO: 175713 - RNA, 23 nt, Human
gccuguaaucccagcuacuggga

SEQ ID NO: 175714 - RNA, 24 nt, Human
gccuguaaucccagcuacugggga

SEQ ID NO: 175715 - RNA, 23 nt, Human
gccuguaaucccagcuacuuagg

SEQ ID NO: 175716 - RNA, 24 nt, Human
gccuguaaucccagcuacuuagga

SEQ ID NO: 175717 - RNA, 23 nt, Human
gccuguaaucccagcuacuucgg

SEQ ID NO: 175718 - RNA, 24 nt, Human
gccuguaaucccagcuacuucgga

SEQ ID NO: 175719 - RNA, 21 nt, Human
gccuguaaucccagcuacuug

SEQ ID NO: 175720 - RNA, 24 nt, Human
gccuguaaucccagcuacuugaga

SEQ ID NO: 175721 - RNA, 22 nt, Human
gccuguaaucccagcuacuugg

SEQ ID NO: 175722 - RNA, 23 nt, Human
gccuguaaucccagcuacuugga

SEQ ID NO: 175723 - RNA, 23 nt, Human
gccuguaaucccagcuacuuggg

SEQ ID NO: 175724 - RNA, 24 nt, Human
gccuguaaucccagcuacuuggga

SEQ ID NO: 175725 - RNA, 24 nt, Human
gccuguaaucccagcuacuugggg

SEQ ID NO: 175726 - RNA, 24 nt, Human
gccuguaaucccagcuacuuugga

SEQ ID NO: 175727 - RNA, 20 nt, Human
gccuguaaucccagcuagga

SEQ ID NO: 175728 - RNA, 22 nt, Human
gccuguaaucccagcuaggagg

SEQ ID NO: 175729 - RNA, 24 nt, Human
gccuguaaucccagcuauauagga

SEQ ID NO: 175730 - RNA, 23 nt, Human
gccuguaaucccagcuauucagg

SEQ ID NO: 175731 - RNA, 24 nt, Human
gccuguaaucccagcuauucagga

SEQ ID NO: 175732 - RNA, 22 nt, Human
gccuguaaucccagcuauucgg

SEQ ID NO: 175733 - RNA, 23 nt, Human
gccuguaaucccagcuauucgga

SEQ ID NO: 175734 - RNA, 23 nt, Human
gccuguaaucccagcuauucggg

SEQ ID NO: 175735 - RNA, 24 nt, Human
gccuguaaucccagcuauucggga

SEQ ID NO: 175736 - RNA, 23 nt, Human
gccuguaaucccagcuauuuggg

SEQ ID NO: 175737 - RNA, 24 nt, Human
gccuguaaucccagcuauuuggga

SEQ ID NO: 175738 - RNA, 23 nt, Human
gccuguaaucccagcuccuuggg

SEQ ID NO: 175739 - RNA, 24 nt, Human
gccuguaaucccagcuccuuggga

SEQ ID NO: 175740 - RNA, 21 nt, Human
gccuguaaucccagcucugga

SEQ ID NO: 175741 - RNA, 21 nt, Human
gccuguaaucccagcucuuug

SEQ ID NO: 175742 - RNA, 23 nt, Human
gccuguaaucccagcucuuuggg

SEQ ID NO: 175743 - RNA, 24 nt, Human
gccuguaaucccagcucuuuggga

SEQ ID NO: 175744 - RNA, 23 nt, Human
gccuguaaucccagcugcucagg

SEQ ID NO: 175745 - RNA, 24 nt, Human
gccuguaaucccagcugcucagga

SEQ ID NO: 175746 - RNA, 23 nt, Human
gccuguaaucccagcugcucggg

SEQ ID NO: 175747 - RNA, 24 nt, Human
gccuguaaucccagcugcucggga

SEQ ID NO: 175748 - RNA, 23 nt, Human
gccuguaaucccagcugcuuggg

SEQ ID NO: 175749 - RNA, 24 nt, Human
gccuguaaucccagcugcuuggga

SEQ ID NO: 175750 - RNA, 24 nt, Human
gccuguaaucccagcuguucggga

SEQ ID NO: 175751 - RNA, 21 nt, Human
gccuguaaucccagcuguuug

SEQ ID NO: 175752 - RNA, 24 nt, Human
gccuguaaucccagcuucuggagg

SEQ ID NO: 175753 - RNA, 24 nt, Human
gccuguaaucccagcuucuuggga

SEQ ID NO: 175754 - RNA, 24 nt, Human
gccuguaaucccagcuuugggaga

SEQ ID NO: 175755 - RNA, 20 nt, Human
gccuguaaucccaggacuuu

SEQ ID NO: 175756 - RNA, 24 nt, Human
gccuguaaucccagguacuugaga

SEQ ID NO: 175757 - RNA, 23 nt, Human
gccuguaaucccagguacuugga

SEQ ID NO: 175758 - RNA, 22 nt, Human
gccuguaaucccaguacuuggg

SEQ ID NO: 175759 - RNA, 23 nt, Human
gccuguaaucccaguacuuggga

SEQ ID NO: 175760 - RNA, 20 nt, Human
gccuguaaucccaguacuuu

SEQ ID NO: 175761 - RNA, 24 nt, Human
gccuguaaucccaguaguuuggga

SEQ ID NO: 175762 - RNA, 24 nt, Human
gccuguaaucccagugacuuggga

SEQ ID NO: 175763 - RNA, 24 nt, Human
gccuguaaucccaguuacucagga

SEQ ID NO: 175764 - RNA, 24 nt, Human
gccuguaaucccaguuacuccaga

SEQ ID NO: 175765 - RNA, 24 nt, Human
gccuguaaucccaguuacucgaga

SEQ ID NO: 175766 - RNA, 23 nt, Human
gccuguaaucccaguuacucggg

SEQ ID NO: 175767 - RNA, 24 nt, Human
gccuguaaucccaguuacucggga

SEQ ID NO: 175768 - RNA, 23 nt, Human
gccuguaaucccaguuacuuagg

SEQ ID NO: 175769 - RNA, 24 nt, Human
gccuguaaucccaguuacuuagga

SEQ ID NO: 175770 - RNA, 23 nt, Human
gccuguaaucccaguuacuuggg

SEQ ID NO: 175771 - RNA, 24 nt, Human
gccuguaaucccaguuacuuggga

SEQ ID NO: 175772 - RNA, 24 nt, Human
gccuguaaucccaguuagucggga

SEQ ID NO: 175773 - RNA, 24 nt, Human
gccuguaaucccaguuccuuggga

SEQ ID NO: 175774 - RNA, 23 nt, Human
gccuguaaucccaucuacucagg

SEQ ID NO: 175775 - RNA, 24 nt, Human
gccuguaaucccggcuacucagga

SEQ ID NO: 175776 - RNA, 23 nt, Human
gccuguaaucccggcuacucggg

SEQ ID NO: 175777 - RNA, 24 nt, Human
gccuguaaucccggcuacucggga

SEQ ID NO: 175778 - RNA, 24 nt, Human
gccuguaaucccugcuacuuggga

SEQ ID NO: 175779 - RNA, 26 nt, Human
gccuguaaucccuuagcuacucagga

SEQ ID NO: 175780 - RNA, 23 nt, Human
gccuguaauccuagcacuuggga

SEQ ID NO: 175781 - RNA, 23 nt, Human
gccuguaauccuagcuacucagg

SEQ ID NO: 175782 - RNA, 24 nt, Human
gccuguaauccuagcuacucagga

SEQ ID NO: 175783 - RNA, 23 nt, Human
gccuguaauccuagcuacuuggg

SEQ ID NO: 175784 - RNA, 24 nt, Human
gccuguaauccuagcuacuuggga

SEQ ID NO: 175785 - RNA, 24 nt, Human
gccuguaauccuggcuacuuggga

SEQ ID NO: 175786 - RNA, 24 nt, Human
gccuguaaucgcagcuacucagga

SEQ ID NO: 175787 - RNA, 24 nt, Human
gccuguaaucuaagcuacuuggga

SEQ ID NO: 175788 - RNA, 24 nt, Human
gccuguaaucucaacuacuuggga

SEQ ID NO: 175789 - RNA, 20 nt, Human
gccuguaaucucagcacuuu

SEQ ID NO: 175790 - RNA, 24 nt, Human
gccuguaaucucagcuacuagaga

SEQ ID NO: 175791 - RNA, 23 nt, Human
gccuguaaucucagcuacucagg

SEQ ID NO: 175792 - RNA, 24 nt, Human
gccuguaaucucagcuacucagga

SEQ ID NO: 175793 - RNA, 24 nt, Human
gccuguaaucucagcuacucggga

SEQ ID NO: 175794 - RNA, 23 nt, Human
gccuguaaucucagcuacuuggg

SEQ ID NO: 175795 - RNA, 24 nt, Human
gccuguaaucucagcuacuuggga

SEQ ID NO: 175796 - RNA, 23 nt, Human
gccuguaaugccagcuacucagg

SEQ ID NO: 175797 - RNA, 24 nt, Human
gccuguaaugccagcuacucagga

SEQ ID NO: 175798 - RNA, 23 nt, Human
gccuguaaugccagcuacucggg

SEQ ID NO: 175799 - RNA, 24 nt, Human
gccuguaaugccagcuacucggga

SEQ ID NO: 175800 - RNA, 32 nt, Human
gccuguaauucagccugccugccuugccuugg

SEQ ID NO: 175801 - RNA, 32 nt, Human
gccuguaauuccagcggcuuggaaggcugagg

SEQ ID NO: 175802 - RNA, 23 nt, Human
gccuguaauuccagcuacccagg

SEQ ID NO: 175803 - RNA, 24 nt, Human
gccuguaauuccagcuacccagga

SEQ ID NO: 175804 - RNA, 23 nt, Human
gccuguaauuccagcuacucagg

SEQ ID NO: 175805 - RNA, 24 nt, Human
gccuguaauuccagcuacucagga

SEQ ID NO: 175806 - RNA, 32 nt, Human
gccuguaauuccagcuacucaggagucugagg

SEQ ID NO: 175807 - RNA, 23 nt, Human
gccuguaauuccagcuacucggg

SEQ ID NO: 175808 - RNA, 24 nt, Human
gccuguaauuccagcuacucggga

SEQ ID NO: 175809 - RNA, 23 nt, Human
gccuguaauuccagcuacuuggg

SEQ ID NO: 175810 - RNA, 24 nt, Human
gccuguaauuccagcuacuuggga

SEQ ID NO: 175811 - RNA, 32 nt, Human
gccuguaauuccagcugcuugggagccugagg

SEQ ID NO: 175812 - RNA, 24 nt, Human
gccuguaauuucagcuacuuggga

SEQ ID NO: 175813 - RNA, 32 nt, Human
gccuguacaagcugauguuuuguauuuugugu

SEQ ID NO: 175814 - RNA, 32 nt, Human
gccuguaccccugcaccuccagccuccacccu

SEQ ID NO: 175815 - RNA, 32 nt, Human
gccuguaccucaccaggcagaguaaauaucua

SEQ ID NO: 175816 - RNA, 32 nt, Human
gccuguacgaggcuuuguuuaagaacuguuua

SEQ ID NO: 175817 - RNA, 32 nt, Human
gccuguacuguacuccagccugggaaacaaug

SEQ ID NO: 175818 - RNA, 32 nt, Human
gccuguacuucucugcugguuugcugcccuau

SEQ ID NO: 175819 - RNA, 32 nt, Human
gccuguagcaaaaaucacagccagcugcaucu

SEQ ID NO: 175820 - RNA, 23 nt, Human
gccuguagcccaagcuacucaga

SEQ ID NO: 175821 - RNA, 22 nt, Human
gccuguagcccacucugcucgc

SEQ ID NO: 175822 - RNA, 24 nt, Human
gccuguagccccagcuacucagga

SEQ ID NO: 175823 - RNA, 23 nt, Human
gccuguagccccagcuacucggg

SEQ ID NO: 175824 - RNA, 24 nt, Human
gccuguagccccagcuacucggga

SEQ ID NO: 175825 - RNA, 23 nt, Human
gccuguagccccagcuacuuggg

SEQ ID NO: 175826 - RNA, 24 nt, Human
gccuguagccccagcuacuuggga

SEQ ID NO: 175827 - RNA, 32 nt, Human
gccuguaggaggugagguagcaggaggugagg

SEQ ID NO: 175828 - RNA, 24 nt, Human
gccuguaggccuagcuacuuagga

SEQ ID NO: 175829 - RNA, 32 nt, Human
gccuguaguaaucccagcacuuuuggaggcca

SEQ ID NO: 175830 - RNA, 24 nt, Human
gccuguaguccaagcuacucaaga

SEQ ID NO: 175831 - RNA, 22 nt, Human
gccuguaguccaagcuacuuga

SEQ ID NO: 175832 - RNA, 20 nt, Human
gccuguaguccagcuacuug

SEQ ID NO: 175833 - RNA, 23 nt, Human
gccuguaguccagcuacuugagg

SEQ ID NO: 175834 - RNA, 32 nt, Human
gccuguaguccagcuacuugaggcugagaugg

SEQ ID NO: 175835 - RNA, 23 nt, Human
gccuguaguccaggccacucgag

SEQ ID NO: 175836 - RNA, 23 nt, Human
gccuguagucccaacacuuaggg

SEQ ID NO: 175837 - RNA, 24 nt, Human
gccuguagucccaacacuuaggga

SEQ ID NO: 175838 - RNA, 23 nt, Human
gccuguagucccaacacuuuggg

SEQ ID NO: 175839 - RNA, 24 nt, Human
gccuguagucccaacacuuuggga

SEQ ID NO: 175840 - RNA, 24 nt, Human
gccuguagucccaacuacuaggga

SEQ ID NO: 175841 - RNA, 23 nt, Human
gccuguagucccaacuacucagg

SEQ ID NO: 175842 - RNA, 24 nt, Human
gccuguagucccaacuacucagga

SEQ ID NO: 175843 - RNA, 24 nt, Human
gccuguagucccaccuacuuggga

SEQ ID NO: 175844 - RNA, 21 nt, Human
gccuguagucccaccuuugag

SEQ ID NO: 175845 - RNA, 24 nt, Human
gccuguagucccacuuacuuggga

SEQ ID NO: 175846 - RNA, 23 nt, Human
gccuguagucccagagcuuuggg

SEQ ID NO: 175847 - RNA, 24 nt, Human
gccuguagucccagagcuuuggga

SEQ ID NO: 175848 - RNA, 23 nt, Human
gccuguagucccagauacucagg

SEQ ID NO: 175849 - RNA, 24 nt, Human
gccuguagucccagauacucagga

SEQ ID NO: 175850 - RNA, 24 nt, Human
gccuguagucccagauacuuggga

SEQ ID NO: 175851 - RNA, 24 nt, Human
gccuguagucccagcaacucagga

SEQ ID NO: 175852 - RNA, 23 nt, Human
gccuguagucccagcacucggga

SEQ ID NO: 175853 - RNA, 22 nt, Human
gccuguagucccagcacuuuga

SEQ ID NO: 175854 - RNA, 24 nt, Human
gccuguagucccagcacuuugaga

SEQ ID NO: 175855 - RNA, 23 nt, Human
gccuguagucccagcacuuuggg

SEQ ID NO: 175856 - RNA, 24 nt, Human
gccuguagucccagcacuuuggga

SEQ ID NO: 175857 - RNA, 23 nt, Human
gccuguagucccagcagcuuggg

SEQ ID NO: 175858 - RNA, 24 nt, Human
gccuguagucccagcagcuuggga

SEQ ID NO: 175859 - RNA, 23 nt, Human
gccuguagucccagcauuuuggg

SEQ ID NO: 175860 - RNA, 24 nt, Human
gccuguagucccagcauuuuggga

SEQ ID NO: 175861 - RNA, 23 nt, Human
gccuguagucccagccacuaggg

SEQ ID NO: 175862 - RNA, 23 nt, Human
gccuguagucccagccacucaga

SEQ ID NO: 175863 - RNA, 23 nt, Human
gccuguagucccagccacucggg

SEQ ID NO: 175864 - RNA, 24 nt, Human
gccuguagucccagccacucggga

SEQ ID NO: 175865 - RNA, 23 nt, Human
gccuguagucccagccacugaag

SEQ ID NO: 175866 - RNA, 23 nt, Human
gccuguagucccagccacuuggg

SEQ ID NO: 175867 - RNA, 24 nt, Human
gccuguagucccagccacuuggga

SEQ ID NO: 175868 - RNA, 24 nt, Human
gccuguagucccagcuaacuggga

SEQ ID NO: 175869 - RNA, 24 nt, Human
gccuguagucccagcuaaucagga

SEQ ID NO: 175870 - RNA, 23 nt, Human
gccuguagucccagcuaaucggg

SEQ ID NO: 175871 - RNA, 24 nt, Human
gccuguagucccagcuaaucggga

SEQ ID NO: 175872 - RNA, 18 nt, Human
gccuguagucccagcuac

SEQ ID NO: 175873 - RNA, 24 nt, Human
gccuguagucccagcuacacggga

SEQ ID NO: 175874 - RNA, 24 nt, Human
gccuguagucccagcuacauggga

SEQ ID NO: 175875 - RNA, 23 nt, Human
gccuguagucccagcuacccagg

SEQ ID NO: 175876 - RNA, 24 nt, Human
gccuguagucccagcuacccagga

SEQ ID NO: 175877 - RNA, 23 nt, Human
gccuguagucccagcuaccuagg

SEQ ID NO: 175878 - RNA, 24 nt, Human
gccuguagucccagcuaccuagga

SEQ ID NO: 175879 - RNA, 23 nt, Human
gccuguagucccagcuaccuggg

SEQ ID NO: 175880 - RNA, 24 nt, Human
gccuguagucccagcuaccuggga

SEQ ID NO: 175881 - RNA, 24 nt, Human
gccuguagucccagcuacguggga

SEQ ID NO: 175882 - RNA, 19 nt, Human
gccuguagucccagcuacu

SEQ ID NO: 175883 - RNA, 24 nt, Human
gccuguagucccagcuacuaugga

SEQ ID NO: 175884 - RNA, 24 nt, Human
gccuguagucccagcuacucaaga

SEQ ID NO: 175885 - RNA, 23 nt, Human
gccuguagucccagcuacucaga

SEQ ID NO: 175886 - RNA, 23 nt, Human
gccuguagucccagcuacucagg

SEQ ID NO: 175887 - RNA, 24 nt, Human
gccuguagucccagcuacucagga

SEQ ID NO: 175888 - RNA, 24 nt, Human
gccuguagucccagcuacucaggg

SEQ ID NO: 175889 - RNA, 24 nt, Human
gccuguagucccagcuacuccaga

SEQ ID NO: 175890 - RNA, 24 nt, Human
gccuguagucccagcuacuccgga

SEQ ID NO: 175891 - RNA, 24 nt, Human
gccuguagucccagcuacucgaga

SEQ ID NO: 175892 - RNA, 24 nt, Human
gccuguagucccagcuacucgagg

SEQ ID NO: 175893 - RNA, 22 nt, Human
gccuguagucccagcuacucgg

SEQ ID NO: 175894 - RNA, 23 nt, Human
gccuguagucccagcuacucgga

SEQ ID NO: 175895 - RNA, 24 nt, Human
gccuguagucccagcuacucggag

SEQ ID NO: 175896 - RNA, 23 nt, Human
gccuguagucccagcuacucggg

SEQ ID NO: 175897 - RNA, 24 nt, Human
gccuguagucccagcuacucggga

SEQ ID NO: 175898 - RNA, 23 nt, Human
gccuguagucccagcuacucuga

SEQ ID NO: 175899 - RNA, 23 nt, Human
gccuguagucccagcuacucugg

SEQ ID NO: 175900 - RNA, 24 nt, Human
gccuguagucccagcuacucugga

SEQ ID NO: 175901 - RNA, 22 nt, Human
gccuguagucccagcuacuggg

SEQ ID NO: 175902 - RNA, 24 nt, Human
gccuguagucccagcuacugggga

SEQ ID NO: 175903 - RNA, 24 nt, Human
gccuguagucccagcuacugguga

SEQ ID NO: 175904 - RNA, 23 nt, Human
gccuguagucccagcuacuuagg

SEQ ID NO: 175905 - RNA, 24 nt, Human
gccuguagucccagcuacuuagga

SEQ ID NO: 175906 - RNA, 24 nt, Human
gccuguagucccagcuacuucggg

SEQ ID NO: 175907 - RNA, 21 nt, Human
gccuguagucccagcuacuug

SEQ ID NO: 175908 - RNA, 24 nt, Human
gccuguagucccagcuacuugaga

SEQ ID NO: 175909 - RNA, 22 nt, Human
gccuguagucccagcuacuugg

SEQ ID NO: 175910 - RNA, 23 nt, Human
gccuguagucccagcuacuugga

SEQ ID NO: 175911 - RNA, 23 nt, Human
gccuguagucccagcuacuuggg

SEQ ID NO: 175912 - RNA, 24 nt, Human
gccuguagucccagcuacuuggga

SEQ ID NO: 175913 - RNA, 32 nt, Human
gccuguagucccagcuagucgggaggcugagg

SEQ ID NO: 175914 - RNA, 24 nt, Human
gccuguagucccagcuagucugga

SEQ ID NO: 175915 - RNA, 24 nt, Human
gccuguagucccagcuaucuggga

SEQ ID NO: 175916 - RNA, 22 nt, Human
gccuguagucccagcuaugcga

SEQ ID NO: 175917 - RNA, 24 nt, Human
gccuguagucccagcuaugcgaga

SEQ ID NO: 175918 - RNA, 24 nt, Human
gccuguagucccagcuauucagga

SEQ ID NO: 175919 - RNA, 23 nt, Human
gccuguagucccagcuauucggg

SEQ ID NO: 175920 - RNA, 24 nt, Human
gccuguagucccagcuauucggga

SEQ ID NO: 175921 - RNA, 24 nt, Human
gccuguagucccagcuauucugga

SEQ ID NO: 175922 - RNA, 23 nt, Human
gccuguagucccagcuauuuggg

SEQ ID NO: 175923 - RNA, 24 nt, Human
gccuguagucccagcuauuuggga

SEQ ID NO: 175924 - RNA, 23 nt, Human
gccuguagucccagcuccucagg

SEQ ID NO: 175925 - RNA, 24 nt, Human
gccuguagucccagcuccucagga

SEQ ID NO: 175926 - RNA, 24 nt, Human
gccuguagucccagcuccuuggga

SEQ ID NO: 175927 - RNA, 23 nt, Human
gccuguagucccagcugcucagg

SEQ ID NO: 175928 - RNA, 24 nt, Human
gccuguagucccagcugcucagga

SEQ ID NO: 175929 - RNA, 24 nt, Human
gccuguagucccagcugcuuggga

SEQ ID NO: 175930 - RNA, 24 nt, Human
gccuguagucccagcuguucgaga

SEQ ID NO: 175931 - RNA, 24 nt, Human
gccuguagucccagguacucagga

SEQ ID NO: 175932 - RNA, 24 nt, Human
gccuguagucccagguacuugcga

SEQ ID NO: 175933 - RNA, 23 nt, Human
gccuguagucccagguacuuggg

SEQ ID NO: 175934 - RNA, 24 nt, Human
gccuguagucccagguacuuggga

SEQ ID NO: 175935 - RNA, 23 nt, Human
gccuguagucccaguacucagga

SEQ ID NO: 175936 - RNA, 32 nt, Human
gccuguagucccaguacucaggaggcugaggc

SEQ ID NO: 175937 - RNA, 24 nt, Human
gccuguagucccaguuacucagga

SEQ ID NO: 175938 - RNA, 23 nt, Human
gccuguagucccaguuacuuggg

SEQ ID NO: 175939 - RNA, 24 nt, Human
gccuguagucccaguuacuuggga

SEQ ID NO: 175940 - RNA, 23 nt, Human
gccuguagucccaucuacuuggg

SEQ ID NO: 175941 - RNA, 24 nt, Human
gccuguagucccaucuacuuggga

SEQ ID NO: 175942 - RNA, 24 nt, Human
gccuguagucccauguacuuggga

SEQ ID NO: 175943 - RNA, 24 nt, Human
gccuguagucccgguuacucggga

SEQ ID NO: 175944 - RNA, 23 nt, Human
gccuguagucccugcuacuugga

SEQ ID NO: 175945 - RNA, 24 nt, Human
gccuguagucccugcuacuuggga

SEQ ID NO: 175946 - RNA, 24 nt, Human
gccuguagucccugcuagucaaga

SEQ ID NO: 175947 - RNA, 23 nt, Human
gccuguaguccuagccacucagg

SEQ ID NO: 175948 - RNA, 24 nt, Human
gccuguaguccuagccacucagga

SEQ ID NO: 175949 - RNA, 24 nt, Human
gccuguaguccuagcuacucgagg

SEQ ID NO: 175950 - RNA, 24 nt, Human
gccuguaguccuagcuacucggga

SEQ ID NO: 175951 - RNA, 24 nt, Human
gccuguaguccuagcuacuuggga

SEQ ID NO: 175952 - RNA, 24 nt, Human
gccuguaguccuaguuacuuggga

SEQ ID NO: 175953 - RNA, 32 nt, Human
gccuguaguccuucuuugccuccuggggcggc

SEQ ID NO: 175954 - RNA, 23 nt, Human
gccuguagucgcagcuacucaga

SEQ ID NO: 175955 - RNA, 24 nt, Human
gccuguagucgcagcuacucgcga

SEQ ID NO: 175956 - RNA, 32 nt, Human
gccuguagucuacuugggaggcugagguggga

SEQ ID NO: 175957 - RNA, 23 nt, Human
gccuguagucucagccacucggg

SEQ ID NO: 175958 - RNA, 24 nt, Human
gccuguagucucagccacucggga

SEQ ID NO: 175959 - RNA, 23 nt, Human
gccuguagucucagcuacucagg

SEQ ID NO: 175960 - RNA, 24 nt, Human
gccuguagucucagcuacucagga

SEQ ID NO: 175961 - RNA, 23 nt, Human
gccuguagucucagcuacucggg

SEQ ID NO: 175962 - RNA, 24 nt, Human
gccuguagucucagcuacucggga

SEQ ID NO: 175963 - RNA, 23 nt, Human
gccuguagucucagcuacuuagg

SEQ ID NO: 175964 - RNA, 24 nt, Human
gccuguagucucagcuacuuagga

SEQ ID NO: 175965 - RNA, 24 nt, Human
gccuguagucucagcuacuuggga

SEQ ID NO: 175966 - RNA, 24 nt, Human
gccuguagugccagcuacucagga

SEQ ID NO: 175967 - RNA, 23 nt, Human
gccuguagugcuagcuacucaga

SEQ ID NO: 175968 - RNA, 32 nt, Human
gccuguaguucagcuacucagggggcugaggu

SEQ ID NO: 175969 - RNA, 24 nt, Human
gccuguaguuccagcuaccuggga

SEQ ID NO: 175970 - RNA, 24 nt, Human
gccuguaguuccagcuacucagga

SEQ ID NO: 175971 - RNA, 24 nt, Human
gccuguaguuccagcuacucggga

SEQ ID NO: 175972 - RNA, 24 nt, Human
gccuguaguuccagcuacuuggga

SEQ ID NO: 175973 - RNA, 24 nt, Human
gccuguaguuccagcuacuuguga

SEQ ID NO: 175974 - RNA, 23 nt, Human
gccuguaguucuagcuacuuggg

SEQ ID NO: 175975 - RNA, 24 nt, Human
gccuguaguucuagcuacuuggga

SEQ ID NO: 175976 - RNA, 24 nt, Human
gccuguaguugcagcuacucagga

SEQ ID NO: 175977 - RNA, 20 nt, Human
gccuguaucccagcuacuca

SEQ ID NO: 175978 - RNA, 22 nt, Human
gccuguaucccagcuacucagg

SEQ ID NO: 175979 - RNA, 23 nt, Human
gccuguaucccagcuacucagga

SEQ ID NO: 175980 - RNA, 32 nt, Human
gccuguaucccagcuacucaggaagcugagac

SEQ ID NO: 175981 - RNA, 32 nt, Human
gccuguaucccagcuacucgggaggcugaggc

SEQ ID NO: 175982 - RNA, 22 nt, Human
gccuguaucccagcuacuuggg

SEQ ID NO: 175983 - RNA, 23 nt, Human
gccuguaucccagcuacuuggga

SEQ ID NO: 175984 - RNA, 32 nt, Human
gccuguaucccagcuacuugggaggcagaggc

SEQ ID NO: 175985 - RNA, 32 nt, Human
gccuguaucccagcuacuugggaggcugaagc

SEQ ID NO: 175986 - RNA, 32 nt, Human
gccuguaugagcacauccaggauuagauaagg

SEQ ID NO: 175987 - RNA, 32 nt, Human
gccuguauggaacacauuugucccagaucuga

SEQ ID NO: 175988 - RNA, 32 nt, Human
gccuguauuccaggugcucaggaggcugaggc

SEQ ID NO: 175989 - RNA, 23 nt, Human
gccuguauucccagcuacucagg

SEQ ID NO: 175990 - RNA, 24 nt, Human
gccuguauucccagcuacucagga

SEQ ID NO: 175991 - RNA, 24 nt, Human
gccuguauucccagcuacucauga

SEQ ID NO: 175992 - RNA, 23 nt, Human
gccuguauucccagcuacucggg

SEQ ID NO: 175993 - RNA, 24 nt, Human
gccuguauucccagcuacucggga

SEQ ID NO: 175994 - RNA, 32 nt, Human
gccuguauuggccuauaggucugcacuuuagu

SEQ ID NO: 175995 - RNA, 32 nt, Human
gccuguauuuuuagcuaauuaccaaggucucu

SEQ ID NO: 175996 - RNA, 32 nt, Human
gccugucacaacacaaauaccccucuugaaag

SEQ ID NO: 175997 - RNA, 32 nt, Human
gccugucacagaaacccgauccagcguaccaa

SEQ ID NO: 175998 - RNA, 32 nt, Human
gccugucaccacugccauauuccugccugcug

SEQ ID NO: 175999 - RNA, 32 nt, Human
gccugucacccacacaguaggugcugagaguu

SEQ ID NO: 176000 - RNA, 32 nt, Human
gccugucaccucagggcaucacugaacaaaca

SEQ ID NO: 176001 - RNA, 32 nt, Human
gccugucaccugucuucacugccuccuuuucc

SEQ ID NO: 176002 - RNA, 32 nt, Human
gccugucacucgagcaagccuggguguuccuu

SEQ ID NO: 176003 - RNA, 32 nt, Human
gccugucacugaguaagaugcaggagaaguug

SEQ ID NO: 176004 - RNA, 32 nt, Human
gccugucagcagcugcaccccucagcauauug

SEQ ID NO: 176005 - RNA, 32 nt, Human
gccugucagccaacauugccuugcauuuguac

SEQ ID NO: 176006 - RNA, 32 nt, Human
gccugucagcguucuccaucacuggcauaugg

SEQ ID NO: 176007 - RNA, 32 nt, Human
gccugucauaugcaucaacaaccauguauuuu

SEQ ID NO: 176008 - RNA, 32 nt, Human
gccugucaucccaucacuuugagaggccagga

SEQ ID NO: 176009 - RNA, 32 nt, Human
gccuguccaccaucucccuauuacccuuuggu

SEQ ID NO: 176010 - RNA, 32 nt, Human
gccuguccacccugccaagacuccucaggcag

SEQ ID NO: 176011 - RNA, 32 nt, Human
gccuguccauagaccuccaggcagagaucaca

SEQ ID NO: 176012 - RNA, 32 nt, Human
gccugucccacagauagaaauggggcaggccc

SEQ ID NO: 176013 - RNA, 32 nt, Human
gccugucccagcccuggcugcgaggacagguu

SEQ ID NO: 176014 - RNA, 32 nt, Human
gccugucccauggacacuccagugccagcaau

SEQ ID NO: 176015 - RNA, 32 nt, Human
gccugucccauggcuggggcagugagggggcc

SEQ ID NO: 176016 - RNA, 32 nt, Human
gccugucccggaggcugcagagcugcuacugc

SEQ ID NO: 176017 - RNA, 32 nt, Human
gccugucccucucaggcaugccugugugacau

SEQ ID NO: 176018 - RNA, 17 nt, Human
gccugucccuucuggua

SEQ ID NO: 176019 - RNA, 18 nt, Human
gccugucccuuguuuccu

SEQ ID NO: 176020 - RNA, 32 nt, Human
gccuguccggagcagaacaccccugauuagcc

SEQ ID NO: 176021 - RNA, 32 nt, Human
gccuguccuccaggcuggggcagguucuuagu

SEQ ID NO: 176022 - RNA, 21 nt, Human
gccuguccucccuggcugcug

SEQ ID NO: 176023 - RNA, 20 nt, Human
gccuguccuccgugagcucc

SEQ ID NO: 176024 - RNA, 32 nt, Human
gccuguccucuccguggaagacccugggcccu

SEQ ID NO: 176025 - RNA, 32 nt, Human
gccuguccucuccguggaggacccugggcccu

SEQ ID NO: 176026 - RNA, 32 nt, Human
gccuguccugaugcccuccccaccucaaccgc

SEQ ID NO: 176027 - RNA, 32 nt, Human
gccuguccugccucuggccuguguccugggug

SEQ ID NO: 176028 - RNA, 32 nt, Human
gccuguccuuucucccacucuacugaaacccg

SEQ ID NO: 176029 - RNA, 18 nt, Human
gccuguccuuucugugga

SEQ ID NO: 176030 - RNA, 16 nt, Human
gccugucgauacuuug

SEQ ID NO: 176031 - RNA, 32 nt, Human
gccugucggacaauuuugcagcaacagcagcg

SEQ ID NO: 176032 - RNA, 24 nt, Human
gccugucgucccagcuacucagga

SEQ ID NO: 176033 - RNA, 32 nt, Human
gccugucgucuguggccaugcccaucaugggc

SEQ ID NO: 176034 - RNA, 32 nt, Human
gccugucgugcaggccaggucauuggccccuu

SEQ ID NO: 176035 - RNA, 32 nt, Human
gccugucguuagggcauggcuuaugcuugaca

SEQ ID NO: 176036 - RNA, 19 nt, Human
gccugucuaaacuuucgga

SEQ ID NO: 176037 - RNA, 18 nt, Human
gccugucuaggccugaua

SEQ ID NO: 176038 - RNA, 32 nt, Human
gccugucucauuucccucccucccucugacac

SEQ ID NO: 176039 - RNA, 32 nt, Human
gccugucuccaacccaggucugagaugguguc

SEQ ID NO: 176040 - RNA, 32 nt, Human
gccugucucccccuucccuccccaccggcccg

SEQ ID NO: 176041 - RNA, 32 nt, Human
gccugucucccuccagcacugccgagguucuc

SEQ ID NO: 176042 - RNA, 32 nt, Human
gccugucuccgcacguguugggccacagcaag

SEQ ID NO: 176043 - RNA, 19 nt, Human
gccugucuccuagucugcc

SEQ ID NO: 176044 - RNA, 32 nt, Human
gccugucuccucggcggagccugcugcccguc

SEQ ID NO: 176045 - RNA, 20 nt, Human
gccugucucgagcuccccgg

SEQ ID NO: 176046 - RNA, 21 nt, Human
gccugucucuagcuguucugg

SEQ ID NO: 176047 - RNA, 32 nt, Human
gccugucucucccuacccucuucucagcucca

SEQ ID NO: 176048 - RNA, 20 nt, Human
gccugucucucggggccugg

SEQ ID NO: 176049 - RNA, 32 nt, Human
gccugucucugccucccugucuaccggacugg

SEQ ID NO: 176050 - RNA, 32 nt, Human
gccugucucuggcuaaccacacaggccauucc

SEQ ID NO: 176051 - RNA, 24 nt, Human
gccugucucuuguagcuuccuggg

SEQ ID NO: 176052 - RNA, 20 nt, Human
gccugucucuuuucccuggg

SEQ ID NO: 176053 - RNA, 32 nt, Human
gccugucugcagcugguggaugccugugggca

SEQ ID NO: 176054 - RNA, 32 nt, Human
gccugucugccucuguccugcuuucugucugc

SEQ ID NO: 176055 - RNA, 32 nt, Human
gccugucugcugucccuguacuccaggcaccu

SEQ ID NO: 176056 - RNA, 20 nt, Human
gccugucuggcugcuggacc

SEQ ID NO: 176057 - RNA, 21 nt, Human
gccugucugggaauuccuggg

SEQ ID NO: 176058 - RNA, 21 nt, Human
gccugucugggggaaaggaca

SEQ ID NO: 176059 - RNA, 32 nt, Human
gccugucuguacagugcuuugccccuaccagc

SEQ ID NO: 176060 - RNA, 32 nt, Human
gccugucuucacucuucuccccagaaucacca

SEQ ID NO: 176061 - RNA, 32 nt, Human
gccugucuucccucgcgcguagagagugacuc

SEQ ID NO: 176062 - RNA, 32 nt, Human
gccugucuuccuauucaccgugggcagcagag

SEQ ID NO: 176063 - RNA, 32 nt, Human
gccugucuuccuccaaccucccccuuuuucgu

SEQ ID NO: 176064 - RNA, 23 nt, Human
gccugucuuguggacuccacggg

SEQ ID NO: 176065 - RNA, 32 nt, Human
gccugucuuuaaggcuggugugagagcaggcc

SEQ ID NO: 176066 - RNA, 20 nt, Human
gccugucuuucccagcguca

SEQ ID NO: 176067 - RNA, 32 nt, Human
gccugucuuucccccuuccuucucaccugaca

SEQ ID NO: 176068 - RNA, 32 nt, Human
gccugucuuugggugcugcaguucaguaggaa

SEQ ID NO: 176069 - RNA, 32 nt, Human
gccugugaacuaggcccugccucugucaccuc

SEQ ID NO: 176070 - RNA, 32 nt, Human
gccugugaagcucucccucuugucgcucuggg

SEQ ID NO: 176071 - RNA, 32 nt, Human
gccugugacacacacagcccuccagaccuucc

SEQ ID NO: 176072 - RNA, 17 nt, Human
gccugugaccagggggg

SEQ ID NO: 176073 - RNA, 32 nt, Human
gccugugacuccaagcugggcccaagcccaga

SEQ ID NO: 176074 - RNA, 32 nt, Human
gccugugagacuggggcaggaggaucacuuga

SEQ ID NO: 176075 - RNA, 32 nt, Human
gccugugagaucgagauuacagugagcuaugg

SEQ ID NO: 176076 - RNA, 18 nt, Human
gccugugagccccuuggg

SEQ ID NO: 176077 - RNA, 19 nt, Human
gccugugagccucugcaca

SEQ ID NO: 176078 - RNA, 32 nt, Human
gccugugagcgaguccagcagaaagcugcagu

SEQ ID NO: 176079 - RNA, 32 nt, Human
gccugugagcggcagugggcacugacacuaag

SEQ ID NO: 176080 - RNA, 32 nt, Human
gccugugagggagugcagaacaccuggccggg

SEQ ID NO: 176081 - RNA, 32 nt, Human
gccugugaggucaugguugcaaugagucauga

SEQ ID NO: 176082 - RNA, 32 nt, Human
gccugugaggucgaggcuacagugagcaaaga

SEQ ID NO: 176083 - RNA, 32 nt, Human
gccugugaggucgaggcugcagugagccgaga

SEQ ID NO: 176084 - RNA, 21 nt, Human
gccugugagugccccuugaug

SEQ ID NO: 176085 - RNA, 32 nt, Human
gccugugauacagcccucaggagauucuggga

SEQ ID NO: 176086 - RNA, 32 nt, Human
gccugugauacuugggcugugauccucuagag

SEQ ID NO: 176087 - RNA, 24 nt, Human
gccugugaucacagcuacucggga

SEQ ID NO: 176088 - RNA, 21 nt, Human
gccugugaucccagcuacuca

SEQ ID NO: 176089 - RNA, 24 nt, Human
gccugugaucccagcuacucagga

SEQ ID NO: 176090 - RNA, 24 nt, Human
gccugugaucccagcuacucggga

SEQ ID NO: 176091 - RNA, 24 nt, Human
gccugugaucccagcuacuugaga

SEQ ID NO: 176092 - RNA, 23 nt, Human
gccugugaucccagcuacuugga

SEQ ID NO: 176093 - RNA, 24 nt, Human
gccugugaucccagcuacuuggga

SEQ ID NO: 176094 - RNA, 24 nt, Human
gccugugaucgcagcuacucggga

SEQ ID NO: 176095 - RNA, 32 nt, Human
gccugugaucgucugaugaggcucccucccaa

SEQ ID NO: 176096 - RNA, 24 nt, Human
gccugugaucucagcuacccagga

SEQ ID NO: 176097 - RNA, 32 nt, Human
gccugugaugaagacucacucucaggccuuug

SEQ ID NO: 176098 - RNA, 32 nt, Human
gccugugaugucguggcagcaaacaagaugga

SEQ ID NO: 176099 - RNA, 24 nt, Human
gccugugauuccagcuacuuggga

SEQ ID NO: 176100 - RNA, 32 nt, Human
gccugugcacacaccagcccacccugagagac

SEQ ID NO: 176101 - RNA, 32 nt, Human
gccugugcaggcuggggaucucaggcugauca

SEQ ID NO: 176102 - RNA, 32 nt, Human
gccugugcauuuccuuccucuccucuucccca

SEQ ID NO: 176103 - RNA, 32 nt, Human
gccugugccaagagacagacagagaaggcugc

SEQ ID NO: 176104 - RNA, 32 nt, Human
gccugugccaccccuuccucagccugggguuu

SEQ ID NO: 176105 - RNA, 32 nt, Human
gccugugccaccugucuaggcaagcuggcuuc

SEQ ID NO: 176106 - RNA, 32 nt, Human
gccugugccacugagcauguuagguggagcag

SEQ ID NO: 176107 - RNA, 32 nt, Human
gccugugccacuggugccagccuggaugcagg

SEQ ID NO: 176108 - RNA, 32 nt, Human
gccugugcccaugacaucucccugaaagagga

SEQ ID NO: 176109 - RNA, 22 nt, Human
gccugugccccacaaggagcug

SEQ ID NO: 176110 - RNA, 32 nt, Human
gccugugccccaggcaucugcauccagggcug

SEQ ID NO: 176111 - RNA, 21 nt, Human
gccugugccugcacccugggg

SEQ ID NO: 176112 - RNA, 32 nt, Human
gccugugccugcugggaaguugcagugcucug

SEQ ID NO: 176113 - RNA, 32 nt, Human
gccugugccuggggccuuauguugcucuuucu

SEQ ID NO: 176114 - RNA, 32 nt, Human
gccugugcguggugccugggucuagggaagcu

SEQ ID NO: 176115 - RNA, 32 nt, Human
gccugugcuaggcccugggcuuggggagggag

SEQ ID NO: 176116 - RNA, 32 nt, Human
gccugugcuccccucagaagcucugcucuucc

SEQ ID NO: 176117 - RNA, 32 nt, Human
gccugugcuccugcugggcugugggaggugug

SEQ ID NO: 176118 - RNA, 32 nt, Human
gccugugcuccugcuggggaaggcugggggcu

SEQ ID NO: 176119 - RNA, 32 nt, Human
gccugugcuccuugacugucucuccccaccgg

SEQ ID NO: 176120 - RNA, 21 nt, Human
gccugugcuucucacucacca

SEQ ID NO: 176121 - RNA, 32 nt, Human
gccuguggaccuugauuucuagauuucagugu

SEQ ID NO: 176122 - RNA, 22 nt, Human
gccuguggagagcagcgcggug

SEQ ID NO: 176123 - RNA, 32 nt, Human
gccuguggagcucagcccugagcuguccccgu

SEQ ID NO: 176124 - RNA, 32 nt, Human
gccuguggauccuggggcaucuggaagggcgc

SEQ ID NO: 176125 - RNA, 20 nt, Human
gccuguggcccucucugcca

SEQ ID NO: 176126 - RNA, 19 nt, Human
gccuguggccuccacaucc

SEQ ID NO: 176127 - RNA, 23 nt, Human
gccuguggcgcuggagugcgugg

SEQ ID NO: 176128 - RNA, 32 nt, Human
gccuguggcucucaccugccaguuguuugcuu

SEQ ID NO: 176129 - RNA, 32 nt, Human
gccuguggcugcaaguuccugccugugcuugg

SEQ ID NO: 176130 - RNA, 32 nt, Human
gccuguggcugcagacucccagagaaccagca

SEQ ID NO: 176131 - RNA, 32 nt, Human
gccuguggcugcagcuacaagaggaccugggg

SEQ ID NO: 176132 - RNA, 32 nt, Human
gccuguggcugcaguccaggcauguaggccuc

SEQ ID NO: 176133 - RNA, 32 nt, Human
gccuguggcugcaguucagaggagaagaaggu

SEQ ID NO: 176134 - RNA, 19 nt, Human
gccuguggcugucccucaa

SEQ ID NO: 176135 - RNA, 32 nt, Human
gccuguggcuuccuuugugcauuugagcaugc

SEQ ID NO: 176136 - RNA, 22 nt, Human
gccugugggacagcccagggca

SEQ ID NO: 176137 - RNA, 32 nt, Human
gccugugggacccagagggcuugaggacaucu

SEQ ID NO: 176138 - RNA, 32 nt, Human
gccugugggagacucgcacgcccacacucacc

SEQ ID NO: 176139 - RNA, 32 nt, Human
gccugugggaggugguuaggucaugagggugg

SEQ ID NO: 176140 - RNA, 19 nt, Human
gccugugggcauccaccuc

SEQ ID NO: 176141 - RNA, 32 nt, Human
gccugugggcugcuucacauccaccccggcuc

SEQ ID NO: 176142 - RNA, 32 nt, Human
gccugugggcugggucacgugggucucgcugg

SEQ ID NO: 176143 - RNA, 32 nt, Human
gccuguggggcuggggacagcgccaaggagcu

SEQ ID NO: 176144 - RNA, 32 nt, Human
gccugugggggcccuggacagucacaccccag

SEQ ID NO: 176145 - RNA, 22 nt, Human
gccuguggguccccacucaccc

SEQ ID NO: 176146 - RNA, 32 nt, Human
gccugugggugagggaagccagaaugacacaa

SEQ ID NO: 176147 - RNA, 32 nt, Human
gccugugggugaggggaacggagcaggcucag

SEQ ID NO: 176148 - RNA, 32 nt, Human
gccuguggucaccaccaucaaaugagcugcaa

SEQ ID NO: 176149 - RNA, 32 nt, Human
gccuguggucaggauuggcugcagugaggucc

SEQ ID NO: 176150 - RNA, 32 nt, Human
gccuguggucccagcuacacaggaggcuaagg

SEQ ID NO: 176151 - RNA, 24 nt, Human
gccuguggucccagcuacucaaga

SEQ ID NO: 176152 - RNA, 23 nt, Human
gccuguggucccagcuacucaga

SEQ ID NO: 176153 - RNA, 24 nt, Human
gccuguggucccagcuacucagga

SEQ ID NO: 176154 - RNA, 24 nt, Human
gccuguggucccagcuacucgaga

SEQ ID NO: 176155 - RNA, 24 nt, Human
gccuguggucccagcuacucggga

SEQ ID NO: 176156 - RNA, 24 nt, Human
gccuguggucccagcuacuugaga

SEQ ID NO: 176157 - RNA, 23 nt, Human
gccuguggucccagcuacuugga

SEQ ID NO: 176158 - RNA, 24 nt, Human
gccuguggucccagcuacuuggga

SEQ ID NO: 176159 - RNA, 24 nt, Human
gccuguggucucaacuacucagga

SEQ ID NO: 176160 - RNA, 24 nt, Human
gccuguggucucagcuacucagga

SEQ ID NO: 176161 - RNA, 24 nt, Human
gccuguggucucagcuacucggga

SEQ ID NO: 176162 - RNA, 24 nt, Human
gccuguggucucagcuacuuggga

SEQ ID NO: 176163 - RNA, 32 nt, Human
gccugugguggacacagaugugugcaggacuu

SEQ ID NO: 176164 - RNA, 25 nt, Human
gccugugguggccagcuacucagga

SEQ ID NO: 176165 - RNA, 32 nt, Human
gccugugguggggucacuugaguugagccgga

SEQ ID NO: 176166 - RNA, 24 nt, Human
gccugugguuccagccacucagga

SEQ ID NO: 176167 - RNA, 32 nt, Human
gccugugguugauggaaauucacaaagugagg

SEQ ID NO: 176168 - RNA, 32 nt, Human
gccuguguacacggcuauuugggaaacuuaag

SEQ ID NO: 176169 - RNA, 32 nt, Human
gccuguguccacccuggccugcaggaacaagg

SEQ ID NO: 176170 - RNA, 32 nt, Human
gccugugucccagugagaacugaccugagucc

SEQ ID NO: 176171 - RNA, 18 nt, Human
gccuguguccuccaggua

SEQ ID NO: 176172 - RNA, 24 nt, Human
gccuguguccugauggcccaaaug

SEQ ID NO: 176173 - RNA, 32 nt, Human
gccugugucuccuggguucaagcgauucuccu

SEQ ID NO: 176174 - RNA, 32 nt, Human
gccugugucuucacccaccugccaucauuggc

SEQ ID NO: 176175 - RNA, 32 nt, Human
gccugugugacugucaugcaggccugucugug

SEQ ID NO: 176176 - RNA, 32 nt, Human
gccugugugccuggccuuggggauggcugugg

SEQ ID NO: 176177 - RNA, 32 nt, Human
gccuguguggagccgcccugcccguauggagu

SEQ ID NO: 176178 - RNA, 22 nt, Human
gccuguguggagcggccacuga

SEQ ID NO: 176179 - RNA, 22 nt, Human
gccugugugguggcaaagccgg

SEQ ID NO: 176180 - RNA, 32 nt, Human
gccugugugucucugugccuauguggcugugc

SEQ ID NO: 176181 - RNA, 32 nt, Human
gccugugugugccugggagugaccucacagcu

SEQ ID NO: 176182 - RNA, 20 nt, Human
gccuguguuacaaagucucc

SEQ ID NO: 176183 - RNA, 24 nt, Human
gccuguguuacagcagcuccauga

SEQ ID NO: 176184 - RNA, 32 nt, Human
gccuguguucaccaccaccaucagacucacca

SEQ ID NO: 176185 - RNA, 24 nt, Human
gccuguguucccagcuacucagga

SEQ ID NO: 176186 - RNA, 24 nt, Human
gccuguguucccagcuacuuggga

SEQ ID NO: 176187 - RNA, 32 nt, Human
gccuguguucucuccuaggcaggccucucaac

SEQ ID NO: 176188 - RNA, 32 nt, Human
gccuguguucucuccuagguaggccuaucaac

SEQ ID NO: 176189 - RNA, 19 nt, Human
gccuguguugaaagcucug

SEQ ID NO: 176190 - RNA, 22 nt, Human
gccuguguuuccagcuacauga

SEQ ID NO: 176191 - RNA, 24 nt, Human
gccuguguuuccagcuacaugaga

SEQ ID NO: 176192 - RNA, 32 nt, Human
gccuguguuuuucucaacacuacuuuucugau

SEQ ID NO: 176193 - RNA, 32 nt, Human
gccuguuaagucugagaaggcuaaagaagaca

SEQ ID NO: 176194 - RNA, 24 nt, Human
gccuguuaucacagcuacuuggga

SEQ ID NO: 176195 - RNA, 20 nt, Human
gccuguuaucccagcacuuu

SEQ ID NO: 176196 - RNA, 24 nt, Human
gccuguuaucccagcuacuuggga

SEQ ID NO: 176197 - RNA, 24 nt, Human
gccuguuaucucagcuacuuggga

SEQ ID NO: 176198 - RNA, 32 nt, Human
gccuguucaagugcccuugcuaccaguuccga

SEQ ID NO: 176199 - RNA, 32 nt, Human
gccuguucacacacuggccuuucaguugaaga

SEQ ID NO: 176200 - RNA, 32 nt, Human
gccuguucacauguccuuacauuuguaaagau

SEQ ID NO: 176201 - RNA, 32 nt, Human
gccuguuccacuuguaccuguccagcccugcc

SEQ ID NO: 176202 - RNA, 24 nt, Human
gccuguuccagcacccuucuccca

SEQ ID NO: 176203 - RNA, 32 nt, Human
gccuguucccccaggcucucagugccaccacc

SEQ ID NO: 176204 - RNA, 32 nt, Human
gccuguuccccuacaucugugccugcacaucc

SEQ ID NO: 176205 - RNA, 32 nt, Human
gccuguuccugcacuccacccugcuggcccca

SEQ ID NO: 176206 - RNA, 16 nt, Human
gccuguucuccagaug

SEQ ID NO: 176207 - RNA, 32 nt, Human
gccuguucuccuccuccagaccuaguauucua

SEQ ID NO: 176208 - RNA, 19 nt, Human
gccuguucuccugauccug

SEQ ID NO: 176209 - RNA, 32 nt, Human
gccuguucugcuccuaggagaccugagcccgu

SEQ ID NO: 176210 - RNA, 32 nt, Human
gccuguucugcuccucuccaugcaccccagcc

SEQ ID NO: 176211 - RNA, 32 nt, Human
gccuguucuguauuccccauauccaguauggu

SEQ ID NO: 176212 - RNA, 21 nt, Human
gccuguucuugcugcugguaa

SEQ ID NO: 176213 - RNA, 32 nt, Human
gccuguucuuuucuccccugugcugccgccgc

SEQ ID NO: 176214 - RNA, 32 nt, Human
gccuguugccuaucuuuguccucucucuuccg

SEQ ID NO: 176215 - RNA, 32 nt, Human
gccuguugccucugcugcccuuugaaccagug

SEQ ID NO: 176216 - RNA, 32 nt, Human
gccuguuggagcucccuguccuuguccuguuc

SEQ ID NO: 176217 - RNA, 19 nt, Human
gccuguuggcgacaaggug

SEQ ID NO: 176218 - RNA, 32 nt, Human
gccuguuggcugcuccuggcuuacccacuuag

SEQ ID NO: 176219 - RNA, 32 nt, Human
gccuguuggguugguaucagaucaggggauua

SEQ ID NO: 176220 - RNA, 32 nt, Human
gccuguuguauuuaacuucacagugccuugca

SEQ ID NO: 176221 - RNA, 32 nt, Human
gccuguugugugugucugcaccacauacaugg

SEQ ID NO: 176222 - RNA, 32 nt, Human
gccuguuguugaggaggacugagcacagugcu

SEQ ID NO: 176223 - RNA, 32 nt, Human
gccuguuucaucacguaugugcugcuaccugu

SEQ ID NO: 176224 - RNA, 32 nt, Human
gccuguuucccuuuuucucccuucccugaaag

SEQ ID NO: 176225 - RNA, 16 nt, Human
gccuguuuccuuaaua

SEQ ID NO: 176226 - RNA, 32 nt, Human
gccuguuucguuccccaguggagggagccggu

SEQ ID NO: 176227 - RNA, 32 nt, Human
gccuguuucuucucucuuucuccuucaaacuu

SEQ ID NO: 176228 - RNA, 32 nt, Human
gccuguuuguuucucucuaccugauuucucca

SEQ ID NO: 176229 - RNA, 32 nt, Human
gccuguuuugcaccugggaagugcccuggucu

SEQ ID NO: 176230 - RNA, 18 nt, Human
gccuguuuuuucuugaua

SEQ ID NO: 176231 - RNA, 32 nt, Human
gccuuaaagaguugauugugaagaaccaguaa

SEQ ID NO: 176232 - RNA, 32 nt, Human
gccuuaaagguggugagggagauacugggggc

SEQ ID NO: 176233 - RNA, 32 nt, Human
gccuuaacauucucuuccccugcuccuccuau

SEQ ID NO: 176234 - RNA, 32 nt, Human
gccuuaaccccagcaccucagugugggacugg

SEQ ID NO: 176235 - RNA, 32 nt, Human
gccuuaacccugggaaaugccugcugccccca

SEQ ID NO: 176236 - RNA, 32 nt, Human
gccuuaaccuucugggggagggggauuagcua

SEQ ID NO: 176237 - RNA, 32 nt, Human
gccuuaaccuuucaaggaccagaaggauucca

SEQ ID NO: 176238 - RNA, 32 nt, Human
gccuuaacuauacuuggcucuuuacucuuuca

SEQ ID NO: 176239 - RNA, 32 nt, Human
gccuuaacuggcccucgggcccucucuccgcc

SEQ ID NO: 176240 - RNA, 32 nt, Human
gccuuaagaacaugcuccugcugcaguuaacu

SEQ ID NO: 176241 - RNA, 32 nt, Human
gccuuaagccauccuccuaucucggccucaca

SEQ ID NO: 176242 - RNA, 32 nt, Human
gccuuaagcuaguggcaacugcuggggcccca

SEQ ID NO: 176243 - RNA, 32 nt, Human
gccuuaagucuuuccucuguugcugaccagau

SEQ ID NO: 176244 - RNA, 24 nt, Human
gccuuaagugauccucccaccuca

SEQ ID NO: 176245 - RNA, 32 nt, Human
gccuuaauagcagcagaaggcuuuuuggauuc

SEQ ID NO: 176246 - RNA, 32 nt, Human
gccuuaaucucaucagcccuguauuuacagau

SEQ ID NO: 176247 - RNA, 32 nt, Human
gccuuaaucugaggcagagacacagcagaacc

SEQ ID NO: 176248 - RNA, 32 nt, Human
gccuuacaaguggcgagggaaagcacacaaac

SEQ ID NO: 176249 - RNA, 32 nt, Human
gccuuacaaucugaaaacccacugccuuucga

SEQ ID NO: 176250 - RNA, 32 nt, Human
gccuuacacaaggggugcaggauuugaauucu

SEQ ID NO: 176251 - RNA, 32 nt, Human
gccuuacaccugcccggccgucugucucuugg

SEQ ID NO: 176252 - RNA, 32 nt, Human
gccuuacagcacggggaugaguucaccaaacu

SEQ ID NO: 176253 - RNA, 32 nt, Human
gccuuacagcagcagaggcuggaagagaagcu

SEQ ID NO: 176254 - RNA, 32 nt, Human
gccuuacagccccuguuccuccaagugcacau

SEQ ID NO: 176255 - RNA, 32 nt, Human
gccuuacaggcaggcaggggugguugguguca

SEQ ID NO: 176256 - RNA, 32 nt, Human
gccuuacagguguggcugacucugagcccagg

SEQ ID NO: 176257 - RNA, 32 nt, Human
gccuuaccccagauucucuauaucucaugguu

SEQ ID NO: 176258 - RNA, 32 nt, Human
gccuuacccugccuuccugccuccagagucug

SEQ ID NO: 176259 - RNA, 32 nt, Human
gccuuaccucauuuuuccugcaaagggcugac

SEQ ID NO: 176260 - RNA, 32 nt, Human
gccuuacguccagcucguuccugggccccgag

SEQ ID NO: 176261 - RNA, 18 nt, Human
gccuuacuggaaacuuug

SEQ ID NO: 176262 - RNA, 32 nt, Human
gccuuagagaggaggaggaaagggggagagga

SEQ ID NO: 176263 - RNA, 32 nt, Human
gccuuagagagggaaacaggaaagcuucugaa

SEQ ID NO: 176264 - RNA, 32 nt, Human
gccuuagagcaagggaaacagcucucauucaa

SEQ ID NO: 176265 - RNA, 32 nt, Human
gccuuagauggaauugagugugccaguccuag

SEQ ID NO: 176266 - RNA, 32 nt, Human
gccuuagcagacucuggcuuuccuuugaauuu

SEQ ID NO: 176267 - RNA, 19 nt, Human
gccuuagcagagcuggggu

SEQ ID NO: 176268 - RNA, 32 nt, Human
gccuuagccaguguaccuccuaccucagucua

SEQ ID NO: 176269 - RNA, 26 nt, Human
gccuuagccugggcgacagagcgaga

SEQ ID NO: 176270 - RNA, 17 nt, Human
gccuuagcgacccagaa

SEQ ID NO: 176271 - RNA, 32 nt, Human
gccuuagcucaguuuccaggugguuccucugc

SEQ ID NO: 176272 - RNA, 32 nt, Human
gccuuagcuucaggaaccucgaguacuguggg

SEQ ID NO: 176273 - RNA, 32 nt, Human
gccuuagcuucuccauccuccaccuccucccc

SEQ ID NO: 176274 - RNA, 32 nt, Human
gccuuaggaaagcaaaagagcacuuuuuauug

SEQ ID NO: 176275 - RNA, 32 nt, Human
gccuuaggaggcggccggagcggugggcacag

SEQ ID NO: 176276 - RNA, 32 nt, Human
gccuuaggauaaaaggaauacagacuuuaucc

SEQ ID NO: 176277 - RNA, 21 nt, Human
gccuuaggcuauuccaccucu

SEQ ID NO: 176278 - RNA, 32 nt, Human
gccuuagguauucacacauuuaaggaacucua

SEQ ID NO: 176279 - RNA, 32 nt, Human
gccuuagguauuccugucugggaaaauggagg

SEQ ID NO: 176280 - RNA, 32 nt, Human
gccuuaguaguacuuuggcuucuugaagagga

SEQ ID NO: 176281 - RNA, 23 nt, Human
gccuuagucccagcuacuuggga

SEQ ID NO: 176282 - RNA, 32 nt, Human
gccuuagucccagcuacuugggaggcugaggc

SEQ ID NO: 176283 - RNA, 32 nt, Human
gccuuaguguccuucuuaacagacucaaacca

SEQ ID NO: 176284 - RNA, 32 nt, Human
gccuuauagaagaaccaaggaggcagagccac

SEQ ID NO: 176285 - RNA, 32 nt, Human
gccuuaucagaagacauuggaaagagggauuc

SEQ ID NO: 176286 - RNA, 32 nt, Human
gccuuaucauaccauccccucugugauggguu

SEQ ID NO: 176287 - RNA, 32 nt, Human
gccuuaucccagggcugucaccuagagaggcu

SEQ ID NO: 176288 - RNA, 32 nt, Human
gccuuauccucuuccuccuuauuccucagucc

SEQ ID NO: 176289 - RNA, 32 nt, Human
gccuuaucgcucuucacaccugccuuaggucu

SEQ ID NO: 176290 - RNA, 22 nt, Human
gccuuaucuccuaacauuuuga

SEQ ID NO: 176291 - RNA, 32 nt, Human
gccuuaucuugccccucuaccuggcucuguca

SEQ ID NO: 176292 - RNA, 29 nt, Human
gccuuauggcugcugcuuuuccuuuuuac

SEQ ID NO: 176293 - RNA, 32 nt, Human
gccuuauuggagcuuuucuucuaaucugaauu

SEQ ID NO: 176294 - RNA, 19 nt, Human
gccuuauuggaucaaagua

SEQ ID NO: 176295 - RNA, 32 nt, Human
gccuuauuuaccuagugcaaaaacuguaaaag

SEQ ID NO: 176296 - RNA, 32 nt, Human
gccuuauuuccucuuuaugaacauggauugga

SEQ ID NO: 176297 - RNA, 32 nt, Human
gccuucaagugagaagcuaagcaccagccucu

SEQ ID NO: 176298 - RNA, 22 nt, Human
gccuucacaccaucuacccuua

SEQ ID NO: 176299 - RNA, 32 nt, Human
gccuucacccagccaaccacaggaguagccac

SEQ ID NO: 176300 - RNA, 32 nt, Human
gccuucaccucccggguucaagugauucuucu

SEQ ID NO: 176301 - RNA, 23 nt, Human
gccuucaccuucaccuucaucca

SEQ ID NO: 176302 - RNA, 32 nt, Human
gccuucaccuucucucugggaucaguguccgg

SEQ ID NO: 176303 - RNA, 17 nt, Human
gccuucacuccaccuuu

SEQ ID NO: 176304 - RNA, 32 nt, Human
gccuucacuucccuaggcugggcugagggcaa

SEQ ID NO: 176305 - RNA, 32 nt, Human
gccuucacuuccucaucugucaaaugaagacc

SEQ ID NO: 176306 - RNA, 32 nt, Human
gccuucacuucucuguauucuuccucauacuu

SEQ ID NO: 176307 - RNA, 32 nt, Human
gccuucagaacugcaauucuuacucccuuuca

SEQ ID NO: 176308 - RNA, 32 nt, Human
gccuucagacaaacaggaaacuucugcaguca

SEQ ID NO: 176309 - RNA, 32 nt, Human
gccuucagagagcugaaaagggucccucgguc

SEQ ID NO: 176310 - RNA, 32 nt, Human
gccuucagagcacaccuguuggacggugcaaa

SEQ ID NO: 176311 - RNA, 32 nt, Human
gccuucagagcugcgagagaagaaaugucugu

SEQ ID NO: 176312 - RNA, 32 nt, Human
gccuucagagggcaguugauuccaguccaguu

SEQ ID NO: 176313 - RNA, 32 nt, Human
gccuucagagguuucuccaggacgucaccugu

SEQ ID NO: 176314 - RNA, 32 nt, Human
gccuucagaugacugcagcucuagccuacauc

SEQ ID NO: 176315 - RNA, 32 nt, Human
gccuucagauuugauggcuugggaaacugagg

SEQ ID NO: 176316 - RNA, 32 nt, Human
gccuucagcagcucccccucccgggccccucg

SEQ ID NO: 176317 - RNA, 32 nt, Human
gccuucagccacggagcagacaaggaccagcg

SEQ ID NO: 176318 - RNA, 20 nt, Human
gccuucagcugagggggcag

SEQ ID NO: 176319 - RNA, 32 nt, Human
gccuucaggaacagguuucccaucacauagcu

SEQ ID NO: 176320 - RNA, 32 nt, Human
gccuucaggaacagguuuuccaccacgucgcu

SEQ ID NO: 176321 - RNA, 32 nt, Human
gccuucagggccugauggcugggguggugaca

SEQ ID NO: 176322 - RNA, 32 nt, Human
gccuucagucacuggggaaagcagggaagcag

SEQ ID NO: 176323 - RNA, 32 nt, Human
gccuucagugccuucaugaauucaccuuccag

SEQ ID NO: 176324 - RNA, 32 nt, Human
gccuucagugcuaucagcagggauucauguga

SEQ ID NO: 176325 - RNA, 32 nt, Human
gccuucagugcuguauuuagugcagugcccgg

SEQ ID NO: 176326 - RNA, 20 nt, Human
gccuucaguggccgcaucaa

SEQ ID NO: 176327 - RNA, 21 nt, Human
gccuucaguuccucccaccuc

SEQ ID NO: 176328 - RNA, 32 nt, Human
gccuucaguugcaaaugggaagggcucggaua

SEQ ID NO: 176329 - RNA, 23 nt, Human
gccuucauaaauauucaccauca

SEQ ID NO: 176330 - RNA, 32 nt, Human
gccuucauacugaguucugggcccuucugcaa

SEQ ID NO: 176331 - RNA, 32 nt, Human
gccuucaucaagaagcccauguuuugagauuu

SEQ ID NO: 176332 - RNA, 20 nt, Human
gccuucaucauuucaccucu

SEQ ID NO: 176333 - RNA, 32 nt, Human
gccuucaucccgccucgacuccuggcccagcg

SEQ ID NO: 176334 - RNA, 32 nt, Human
gccuucaugccuguaauccgagugcuuuagga

SEQ ID NO: 176335 - RNA, 32 nt, Human
gccuucauggaguugggaacaggcugggaagg

SEQ ID NO: 176336 - RNA, 32 nt, Human
gccuucauuaaccauuauuguauguuggaaau

SEQ ID NO: 176337 - RNA, 32 nt, Human
gccuucauuucaaccaccugucuucauacccu

SEQ ID NO: 176338 - RNA, 32 nt, Human
gccuuccaaaagugcugggauuacaggcguga

SEQ ID NO: 176339 - RNA, 28 nt, Human
gccuuccaaagugcugggauaucaggca

SEQ ID NO: 176340 - RNA, 32 nt, Human
gccuuccaacuugcugugugcacauuaacaac

SEQ ID NO: 176341 - RNA, 19 nt, Human
gccuuccacacucaccucu

SEQ ID NO: 176342 - RNA, 32 nt, Human
gccuuccacagcccggguucuccugcugccuc

SEQ ID NO: 176343 - RNA, 32 nt, Human
gccuuccacaguugaaacuugagaagcagagc

SEQ ID NO: 176344 - RNA, 32 nt, Human
gccuuccaccccuuguaccucagucuaaacau

SEQ ID NO: 176345 - RNA, 32 nt, Human
gccuuccaccugugcuagcagccuggggccuc

SEQ ID NO: 176346 - RNA, 32 nt, Human
gccuuccacgguggccagcccugcugccauca

SEQ ID NO: 176347 - RNA, 32 nt, Human
gccuuccacuuccuuccaucucauuucuaaac

SEQ ID NO: 176348 - RNA, 32 nt, Human
gccuuccagacccacuccccacccuucucccc

SEQ ID NO: 176349 - RNA, 32 nt, Human
gccuuccagcagacuucaguagcucauuuuac

SEQ ID NO: 176350 - RNA, 32 nt, Human
gccuuccagcaggcgcugacagcugcugaccu

SEQ ID NO: 176351 - RNA, 32 nt, Human
gccuuccagcuguuccugcuuccacucuugcu

SEQ ID NO: 176352 - RNA, 20 nt, Human
gccuuccaggaaccugugga

SEQ ID NO: 176353 - RNA, 32 nt, Human
gccuuccaggcagcaggcuggcauggggacuu

SEQ ID NO: 176354 - RNA, 32 nt, Human
gccuuccagugaucuggaccaggaagacggau

SEQ ID NO: 176355 - RNA, 20 nt, Human
gccuuccaguuugcuugaua

SEQ ID NO: 176356 - RNA, 32 nt, Human
gccuuccaugaaaauugcucucugccaaagag

SEQ ID NO: 176357 - RNA, 32 nt, Human
gccuucccaacaccuccuucccaaaccccucu

SEQ ID NO: 176358 - RNA, 32 nt, Human
gccuucccaacaccuccuucccaaaccccuuu

SEQ ID NO: 176359 - RNA, 32 nt, Human
gccuuccccaagcauccagccuggggaugggc

SEQ ID NO: 176360 - RNA, 32 nt, Human
gccuuccccacaaccguuuucucccccguuuu

SEQ ID NO: 176361 - RNA, 21 nt, Human
gccuuccccacucccaccuca

SEQ ID NO: 176362 - RNA, 32 nt, Human
gccuuccccagccucuucuagagccgugaugc

SEQ ID NO: 176363 - RNA, 32 nt, Human
gccuuccccagcugccucaacucugucucugg

SEQ ID NO: 176364 - RNA, 32 nt, Human
gccuuccccauccucacccuggcuccauccag

SEQ ID NO: 176365 - RNA, 32 nt, Human
gccuuccccauccugguccacagggagaucca

SEQ ID NO: 176366 - RNA, 32 nt, Human
gccuucccccaccacagcagcccugccuguga

SEQ ID NO: 176367 - RNA, 32 nt, Human
gccuucccccucagacuacccaugucuccacg

SEQ ID NO: 176368 - RNA, 17 nt, Human
gccuucccccugcugcc

SEQ ID NO: 176369 - RNA, 18 nt, Human
gccuucccccuucuggca

SEQ ID NO: 176370 - RNA, 32 nt, Human
gccuuccccuacucuguucuguaucacaggga

SEQ ID NO: 176371 - RNA, 32 nt, Human
gccuuccccucagccucuccccacaccaccca

SEQ ID NO: 176372 - RNA, 32 nt, Human
gccuuccccucuggucccuuguguggaggccc

SEQ ID NO: 176373 - RNA, 32 nt, Human
gccuuccccuggcacuggcaaacagggccucu

SEQ ID NO: 176374 - RNA, 32 nt, Human
gccuucccgggccuuucucuccugggcugucu

SEQ ID NO: 176375 - RNA, 27 nt, Human
gccuucccuccacccaggccagcagcc

SEQ ID NO: 176376 - RNA, 32 nt, Human
gccuucccuccaggugcccaguguagguccag

SEQ ID NO: 176377 - RNA, 32 nt, Human
gccuucccuccugccccacuccuggcugugcc

SEQ ID NO: 176378 - RNA, 32 nt, Human
gccuucccuguucuccagccuaggugguucac

SEQ ID NO: 176379 - RNA, 32 nt, Human
gccuucccuucccauuuccuccccugccuccu

SEQ ID NO: 176380 - RNA, 32 nt, Human
gccuucccuuucuccccuuuggggucuguccg

SEQ ID NO: 176381 - RNA, 19 nt, Human
gccuuccgccagccgcgcc

SEQ ID NO: 176382 - RNA, 32 nt, Human
gccuuccgccgagucccugggcuccgaggcca

SEQ ID NO: 176383 - RNA, 20 nt, Human
gccuuccgcggguccugccu

SEQ ID NO: 176384 - RNA, 22 nt, Human
gccuuccgcugcgccuccuccc

SEQ ID NO: 176385 - RNA, 18 nt, Human
gccuuccggagcugcgcc

SEQ ID NO: 176386 - RNA, 32 nt, Human
gccuuccgggcacuggucgagcuguuugaggc

SEQ ID NO: 176387 - RNA, 22 nt, Human
gccuuccuaguugguuuuucua

SEQ ID NO: 176388 - RNA, 32 nt, Human
gccuuccuccacuggcuaugcauuggacuuga

SEQ ID NO: 176389 - RNA, 32 nt, Human
gccuuccucccaggcccccacguugcuggccg

SEQ ID NO: 176390 - RNA, 17 nt, Human
gccuuccuccugacccc

SEQ ID NO: 176391 - RNA, 32 nt, Human
gccuuccuccuggccuucucguccgacuuccu

SEQ ID NO: 176392 - RNA, 32 nt, Human
gccuuccucuacuucucacaguucaggccugu

SEQ ID NO: 176393 - RNA, 32 nt, Human
gccuuccucuccccugccucuuucuuccucau

SEQ ID NO: 176394 - RNA, 32 nt, Human
gccuuccucugcagcugaccucuguuguccuc

SEQ ID NO: 176395 - RNA, 20 nt, Human
gccuuccucugugaaccccu

SEQ ID NO: 176396 - RNA, 32 nt, Human
gccuuccucuucuuccugcucuguguggaagg

SEQ ID NO: 176397 - RNA, 32 nt, Human
gccuuccugaacaccuuaggcugguggggcug

SEQ ID NO: 176398 - RNA, 32 nt, Human
gccuuccugaguagcugggauuacaggcagcc

SEQ ID NO: 176399 - RNA, 32 nt, Human
gccuuccugaguaguugggaauacaggcaugc

SEQ ID NO: 176400 - RNA, 32 nt, Human
gccuuccugcagccacacacccacccggggug

SEQ ID NO: 176401 - RNA, 32 nt, Human
gccuuccugcagccuccacuaagguaacaacc

SEQ ID NO: 176402 - RNA, 32 nt, Human
gccuuccugcagccucuuccgcucgccggcug

SEQ ID NO: 176403 - RNA, 32 nt, Human
gccuuccugccgccuccacugaucugaggaga

SEQ ID NO: 176404 - RNA, 32 nt, Human
gccuuccugccuccagccuggcuucuagcugg

SEQ ID NO: 176405 - RNA, 32 nt, Human
gccuuccugccugcccuuuuugugcaggugga

SEQ ID NO: 176406 - RNA, 32 nt, Human
gccuuccuggaaggagugcugagcagcaaagc

SEQ ID NO: 176407 - RNA, 32 nt, Human
gccuuccuggcuuagcucagauggcagaugag

SEQ ID NO: 176408 - RNA, 32 nt, Human
gccuuccuggcuucuccacaaccuucugacug

SEQ ID NO: 176409 - RNA, 32 nt, Human
gccuuccugugcccagaaaggaaggggcuauu

SEQ ID NO: 176410 - RNA, 32 nt, Human
gccuuccugugcccagcuucugggcccacucc

SEQ ID NO: 176411 - RNA, 32 nt, Human
gccuuccuuccagugagagaaaaauagaaugg

SEQ ID NO: 176412 - RNA, 16 nt, Human
gccuuccuucugcucc

SEQ ID NO: 176413 - RNA, 32 nt, Human
gccuuccuucuuccuuuccuuugcacuauccc

SEQ ID NO: 176414 - RNA, 21 nt, Human
gccuuccuugcaccucggagc

SEQ ID NO: 176415 - RNA, 32 nt, Human
gccuuccuuuauuacaaaucaguauuaaaacu

SEQ ID NO: 176416 - RNA, 32 nt, Human
gccuuccuuugucccugugguauucauaaagu

SEQ ID NO: 176417 - RNA, 32 nt, Human
gccuucgacagcugagagacaaaaagaagccc

SEQ ID NO: 176418 - RNA, 32 nt, Human
gccuucgaggucagaggagagauagccugugg

SEQ ID NO: 176419 - RNA, 32 nt, Human
gccuucgcagaagucacauguaucgaagcaga

SEQ ID NO: 176420 - RNA, 32 nt, Human
gccuucgcagaggcggccugugccauccugca

SEQ ID NO: 176421 - RNA, 32 nt, Human
gccuucgccucccggguucaagugauucuccu

SEQ ID NO: 176422 - RNA, 32 nt, Human
gccuucgcuacgccugaccccaaaaagacaac

SEQ ID NO: 176423 - RNA, 32 nt, Human
gccuucggcacuguagcuuuggguggugggcu

SEQ ID NO: 176424 - RNA, 25 nt, Human
gccuucggcgagucuuuuuguuugg

SEQ ID NO: 176425 - RNA, 32 nt, Human
gccuucgggaggaggaggcggaggaggcggag

SEQ ID NO: 176426 - RNA, 32 nt, Human
gccuucgggaggcgagcaggcagcaguuggcc

SEQ ID NO: 176427 - RNA, 32 nt, Human
gccuucggggccugagacccugagagccacgc

SEQ ID NO: 176428 - RNA, 21 nt, Human
gccuucuaacuuauagacuca

SEQ ID NO: 176429 - RNA, 32 nt, Human
gccuucuacucccagugccaaagccagaccac

SEQ ID NO: 176430 - RNA, 32 nt, Human
gccuucuacugcucuccuccaccucaacuccg

SEQ ID NO: 176431 - RNA, 32 nt, Human
gccuucuagacacugaaggcaaaucuccuuug

SEQ ID NO: 176432 - RNA, 32 nt, Human
gccuucuaggaaguuaggagguugaggcacag

SEQ ID NO: 176433 - RNA, 32 nt, Human
gccuucuaggugagacacuuuuaagguacacu

SEQ ID NO: 176434 - RNA, 32 nt, Human
gccuucuaguucaugguacgcaucccugccuc

SEQ ID NO: 176435 - RNA, 32 nt, Human
gccuucuauaugcaaacacugcaguuuuaacu

SEQ ID NO: 176436 - RNA, 23 nt, Human
gccuucucaguccucucucccuc

SEQ ID NO: 176437 - RNA, 32 nt, Human
gccuucucaucuugggagaugacuccucuuca

SEQ ID NO: 176438 - RNA, 25 nt, Human
gccuucucaugcgcauugucacuug

SEQ ID NO: 176439 - RNA, 32 nt, Human
gccuucuccaaccugaguuuggaaaucgggaa

SEQ ID NO: 176440 - RNA, 32 nt, Human
gccuucuccaccuuccccuccuuuggcucugu

SEQ ID NO: 176441 - RNA, 32 nt, Human
gccuucuccacugucucauuuccuuuucccac

SEQ ID NO: 176442 - RNA, 20 nt, Human
gccuucuccagccgcugcca

SEQ ID NO: 176443 - RNA, 32 nt, Human
gccuucuccaggugccucucccucaccagcuc

SEQ ID NO: 176444 - RNA, 32 nt, Human
gccuucuccaguggcaguccaaaagcagaaau

SEQ ID NO: 176445 - RNA, 32 nt, Human
gccuucuccauaccccucuccccagcaucaug

SEQ ID NO: 176446 - RNA, 32 nt, Human
gccuucuccuccucccccuccuuccuuccgcc

SEQ ID NO: 176447 - RNA, 32 nt, Human
gccuucuccuccuucucuccccagagcccccu

SEQ ID NO: 176448 - RNA, 32 nt, Human
gccuucuccuuccugcuucauccggcuuagcu

SEQ ID NO: 176449 - RNA, 32 nt, Human
gccuucucuagaaucugaaggccaggcuuacc

SEQ ID NO: 176450 - RNA, 32 nt, Human
gccuucucuccuggucccuggugcuguuuggg

SEQ ID NO: 176451 - RNA, 32 nt, Human
gccuucucugcagucccuucugcccugccggg

SEQ ID NO: 176452 - RNA, 32 nt, Human
gccuucucuuucuccuucacugccucaaguua

SEQ ID NO: 176453 - RNA, 32 nt, Human
gccuucugaaaauaauaaacucucauuaaccc

SEQ ID NO: 176454 - RNA, 32 nt, Human
gccuucugaaacuuccucuuuaggguaaccau

SEQ ID NO: 176455 - RNA, 32 nt, Human
gccuucugagccuugaaauugaggagguuaaa

SEQ ID NO: 176456 - RNA, 32 nt, Human
gccuucugagcuggccucucacugccucccca

SEQ ID NO: 176457 - RNA, 24 nt, Human
gccuucugaugccacuucuucuca

SEQ ID NO: 176458 - RNA, 32 nt, Human
gccuucugccaacgccuccuguccccaccuaa

SEQ ID NO: 176459 - RNA, 32 nt, Human
gccuucugccagcucccuccccagucaccaga

SEQ ID NO: 176460 - RNA, 19 nt, Human
gccuucugcccgacccagg

SEQ ID NO: 176461 - RNA, 32 nt, Human
gccuucugccuagaaagaucuaugacuggguu

SEQ ID NO: 176462 - RNA, 32 nt, Human
gccuucugccuccucgccucuccuggacuggc

SEQ ID NO: 176463 - RNA, 18 nt, Human
gccuucuggaagacuuca

SEQ ID NO: 176464 - RNA, 23 nt, Human
gccuucuggcaccugugcuccaa

SEQ ID NO: 176465 - RNA, 19 nt, Human
gccuucuggccacccagag

SEQ ID NO: 176466 - RNA, 32 nt, Human
gccuucugggcuggggaugggugagcaaaggg

SEQ ID NO: 176467 - RNA, 32 nt, Human
gccuucuggucugaggcgcagcucccucugcc

SEQ ID NO: 176468 - RNA, 32 nt, Human
gccuucuguaucugugccuggccaguggcagc

SEQ ID NO: 176469 - RNA, 32 nt, Human
gccuucuguccuucauccgccugcugcugaau

SEQ ID NO: 176470 - RNA, 32 nt, Human
gccuucuguuaagccaggcuuuaaggaucugc

SEQ ID NO: 176471 - RNA, 32 nt, Human
gccuucuuauuguccuccuccuccuggcucgg

SEQ ID NO: 176472 - RNA, 32 nt, Human
gccuucuucaccuguguccucugccucugagu

SEQ ID NO: 176473 - RNA, 32 nt, Human
gccuucuuccccaggcuggaagugggcgacac

SEQ ID NO: 176474 - RNA, 32 nt, Human
gccuucuuccccaggcugggagugggugagac

SEQ ID NO: 176475 - RNA, 32 nt, Human
gccuucuuccuucacaauuagcucuugccccu

SEQ ID NO: 176476 - RNA, 32 nt, Human
gccuucuucucccccuuccccugugcucccuu

SEQ ID NO: 176477 - RNA, 19 nt, Human
gccuucuugaagcaguucc

SEQ ID NO: 176478 - RNA, 29 nt, Human
gccuucuugcugcuaucaacucccaagag

SEQ ID NO: 176479 - RNA, 32 nt, Human
gccuucuugcugcugucacguuccaagagaac

SEQ ID NO: 176480 - RNA, 32 nt, Human
gccuucuuuccugugugucuguuaacauuucc

SEQ ID NO: 176481 - RNA, 32 nt, Human
gccuucuuugagauggagucuugcucuguugc

SEQ ID NO: 176482 - RNA, 32 nt, Human
gccuucuuugggcagacgugcagagaagaaca

SEQ ID NO: 176483 - RNA, 16 nt, Human
gccuugaaacccggga

SEQ ID NO: 176484 - RNA, 32 nt, Human
gccuugaaaugugaggaggaggaagauagcug

SEQ ID NO: 176485 - RNA, 32 nt, Human
gccuugaacaaccagauggugacccagaacag

SEQ ID NO: 176486 - RNA, 32 nt, Human
gccuugaacuccugggcucaagcaauccuccu

SEQ ID NO: 176487 - RNA, 32 nt, Human
gccuugaagaacuaccagaaggccaaugaccu

SEQ ID NO: 176488 - RNA, 32 nt, Human
gccuugaagauggggaaacugaggcucaagga

SEQ ID NO: 176489 - RNA, 32 nt, Human
gccuugaaggaugggugagaggugagaaggga

SEQ ID NO: 176490 - RNA, 32 nt, Human
gccuugaagggaagacaaaacuggauguucuu

SEQ ID NO: 176491 - RNA, 32 nt, Human
gccuugaauccaagaaugagagaggacaaauc

SEQ ID NO: 176492 - RNA, 32 nt, Human
gccuugaauuccugggcccaagcaauucuccc

SEQ ID NO: 176493 - RNA, 32 nt, Human
gccuugaauuccugggcucgagcgguucuccu

SEQ ID NO: 176494 - RNA, 18 nt, Human
gccuugaauuccuuggua

SEQ ID NO: 176495 - RNA, 32 nt, Human
gccuugaccacagcucccucucucacacagcu

SEQ ID NO: 176496 - RNA, 32 nt, Human
gccuugacccagccuuuaacaaucuuuaaaau

SEQ ID NO: 176497 - RNA, 32 nt, Human
gccuugaccuccagggcucaaggauccuccug

SEQ ID NO: 176498 - RNA, 32 nt, Human
gccuugaccuccuggguuccggugauucucau

SEQ ID NO: 176499 - RNA, 32 nt, Human
gccuugacuuccugggcucaagugaucauccc

SEQ ID NO: 176500 - RNA, 32 nt, Human
gccuugagaaaggcauuggccauugguugcca

SEQ ID NO: 176501 - RNA, 32 nt, Human
gccuugagaagagagcccgcucuccguggggc

SEQ ID NO: 176502 - RNA, 28 nt, Human
gccuugagcaguguugccucauccagaa

SEQ ID NO: 176503 - RNA, 21 nt, Human
gccuugagccucuccucaggg

SEQ ID NO: 176504 - RNA, 32 nt, Human
gccuugagcuccugggcucaagcaauccuccc

SEQ ID NO: 176505 - RNA, 32 nt, Human
gccuugagcucuucucugagcuggcagaagac

SEQ ID NO: 176506 - RNA, 32 nt, Human
gccuugagcuucaaaaugagauaugcaauaaa

SEQ ID NO: 176507 - RNA, 32 nt, Human
gccuugaggccaggagggcagugagcugugau

SEQ ID NO: 176508 - RNA, 32 nt, Human
gccuugagggucggucuguggcauuuuaaaug

SEQ ID NO: 176509 - RNA, 32 nt, Human
gccuugagucuccgggccgccuugccauggcu

SEQ ID NO: 176510 - RNA, 32 nt, Human
gccuugauaccaaaauugggaaagaacaugug

SEQ ID NO: 176511 - RNA, 18 nt, Human
gccuugauccccuugaua

SEQ ID NO: 176512 - RNA, 32 nt, Human
gccuugaucguccugguguccucugcaagaca

SEQ ID NO: 176513 - RNA, 32 nt, Human
gccuugaugacugccuugccuccucaguaugu

SEQ ID NO: 176514 - RNA, 32 nt, Human
gccuugauggaugaggagagacuucccuuccc

SEQ ID NO: 176515 - RNA, 32 nt, Human
gccuugauguacuggagcaaucagaucacacg

SEQ ID NO: 176516 - RNA, 32 nt, Human
gccuugaugucuccaccaccaaagucguccuu

SEQ ID NO: 176517 - RNA, 32 nt, Human
gccuugauuaaaccagaaaacugucaucguuu

SEQ ID NO: 176518 - RNA, 32 nt, Human
gccuugcacacucaccuccaccuucacaggcc

SEQ ID NO: 176519 - RNA, 32 nt, Human
gccuugcacgggacagaccacacccaccgcaa

SEQ ID NO: 176520 - RNA, 32 nt, Human
gccuugcagagaugcacgugugcauuucagcu

SEQ ID NO: 176521 - RNA, 22 nt, Human
gccuugcagcuccuccagaggg

SEQ ID NO: 176522 - RNA, 23 nt, Human
gccuugcagucaguuguguuugg

SEQ ID NO: 176523 - RNA, 22 nt, Human
gccuugcauccuuggaaccaau

SEQ ID NO: 176524 - RNA, 32 nt, Human
gccuugccaacuuggcagcccagaaacagucc

SEQ ID NO: 176525 - RNA, 32 nt, Human
gccuugccagccucaucgagaucuggcagccc

SEQ ID NO: 176526 - RNA, 32 nt, Human
gccuugcccagaguccagcuguguggcuuuua

SEQ ID NO: 176527 - RNA, 32 nt, Human
gccuugcccagggccucaaaggcaccaaacgu

SEQ ID NO: 176528 - RNA, 20 nt, Human
gccuugcccggauucuggga

SEQ ID NO: 176529 - RNA, 32 nt, Human
gccuugcccuccauccuuccucuguuccuucu

SEQ ID NO: 176530 - RNA, 32 nt, Human
gccuugcccuuugggcuggagaugcuuugcca

SEQ ID NO: 176531 - RNA, 32 nt, Human
gccuugcccuuuucugaggcucagggaagugg

SEQ ID NO: 176532 - RNA, 32 nt, Human
gccuugccgagacugugggcagccugguugug

SEQ ID NO: 176533 - RNA, 19 nt, Human
gccuugccuaagggggcau

SEQ ID NO: 176534 - RNA, 32 nt, Human
gccuugccuaggggcccgggcacugccaucac

SEQ ID NO: 176535 - RNA, 32 nt, Human
gccuugccuagugggccuuccuucccaggucg

SEQ ID NO: 176536 - RNA, 20 nt, Human
gccuugccucacuuccacca

SEQ ID NO: 176537 - RNA, 32 nt, Human
gccuugccucagacuacuuugccaacccacuu

SEQ ID NO: 176538 - RNA, 32 nt, Human
gccuugccucaggaguugcugguuagccuaug

SEQ ID NO: 176539 - RNA, 32 nt, Human
gccuugccuccccugccuccccuccuuuuucc

SEQ ID NO: 176540 - RNA, 17 nt, Human
gccuugccucucaggug

SEQ ID NO: 176541 - RNA, 32 nt, Human
gccuugccugugagcuaugucacuccccuccc

SEQ ID NO: 176542 - RNA, 32 nt, Human
gccuugccuuauaaggucugucuuccauccag

SEQ ID NO: 176543 - RNA, 32 nt, Human
gccuugccuuuccccucugccuguuuccuuuu

SEQ ID NO: 176544 - RNA, 32 nt, Human
gccuugcggacgaugcacucacaugccacagc

SEQ ID NO: 176545 - RNA, 32 nt, Human
gccuugcgguagccauggcagcaggcuccgag

SEQ ID NO: 176546 - RNA, 20 nt, Human
gccuugcgucuuuccuccca

SEQ ID NO: 176547 - RNA, 20 nt, Human
gccuugcucaccuguccccu

SEQ ID NO: 176548 - RNA, 32 nt, Human
gccuugcucagucccuuccaccaaagucaucu

SEQ ID NO: 176549 - RNA, 32 nt, Human
gccuugcuccucuuccuccuuucuuggcgggu

SEQ ID NO: 176550 - RNA, 32 nt, Human
gccuugcucugccccuucugcucacugugaag

SEQ ID NO: 176551 - RNA, 32 nt, Human
gccuugcugacaccugggccuugccuccaugu

SEQ ID NO: 176552 - RNA, 32 nt, Human
gccuugcugagcuccugggaaggaggcgugcc

SEQ ID NO: 176553 - RNA, 32 nt, Human
gccuugcugcagccccagcccagauggcacuc

SEQ ID NO: 176554 - RNA, 32 nt, Human
gccuugcugcugcugcacccaacuacugagcu

SEQ ID NO: 176555 - RNA, 32 nt, Human
gccuugcuuacugccugcaaauuuugagaaau

SEQ ID NO: 176556 - RNA, 32 nt, Human
gccuugcuucauuucagaaucucccuucaacc

SEQ ID NO: 176557 - RNA, 32 nt, Human
gccuugcuuuucucucuucuucauucauauuc

SEQ ID NO: 176558 - RNA, 22 nt, Human
gccuuggaaaaaccccaaaaca

SEQ ID NO: 176559 - RNA, 32 nt, Human
gccuuggaaggcucucccuuguggaaccaagu

SEQ ID NO: 176560 - RNA, 32 nt, Human
gccuuggaagggaagucaggcucacuuggaca

SEQ ID NO: 176561 - RNA, 31 nt, Human
gccuuggaccuucucccuugcuuagaagugc

SEQ ID NO: 176562 - RNA, 32 nt, Human
gccuuggacgcugcagcccccuccucaacggc

SEQ ID NO: 176563 - RNA, 32 nt, Human
gccuuggagacaggggagacccuaugucaaaa

SEQ ID NO: 176564 - RNA, 32 nt, Human
gccuuggagaccuccaggucugaaaaguuagc

SEQ ID NO: 176565 - RNA, 32 nt, Human
gccuuggagagggaaacaggaaauacguugcu

SEQ ID NO: 176566 - RNA, 32 nt, Human
gccuuggagauggagaauucucaguuguguaa

SEQ ID NO: 176567 - RNA, 32 nt, Human
gccuuggaggcagaagcugugaguuucagaac

SEQ ID NO: 176568 - RNA, 32 nt, Human
gccuuggaggcggagguugcagugagcugaga

SEQ ID NO: 176569 - RNA, 32 nt, Human
gccuuggaggcugcagugcacugugauugugc

SEQ ID NO: 176570 - RNA, 32 nt, Human
gccuuggaggguacaagauccacugagggugg

SEQ ID NO: 176571 - RNA, 32 nt, Human
gccuuggaggucaaaacugcagugagccaugg

SEQ ID NO: 176572 - RNA, 32 nt, Human
gccuuggaugaggcggggcaguguguauaugg

SEQ ID NO: 176573 - RNA, 32 nt, Human
gccuuggauuuauauugcacuucauagacccc

SEQ ID NO: 176574 - RNA, 31 nt, Human
gccuuggcagugucucccacagacccaggag

SEQ ID NO: 176575 - RNA, 32 nt, Human
gccuuggccaagcagagccuggucauggaugc

SEQ ID NO: 176576 - RNA, 32 nt, Human
gccuuggccagccuggccagccgccgagcagc

SEQ ID NO: 176577 - RNA, 20 nt, Human
gccuuggccuggcccagccc

SEQ ID NO: 176578 - RNA, 32 nt, Human
gccuuggcguccggcccggccugggcccuuag

SEQ ID NO: 176579 - RNA, 32 nt, Human
gccuuggcuagaaaaugcuuuuaaugucucaa

SEQ ID NO: 176580 - RNA, 32 nt, Human
gccuuggcuccugguauaggccgcuuuccuuc

SEQ ID NO: 176581 - RNA, 32 nt, Human
gccuuggcucuuuggcucccuuuugcuuaauu

SEQ ID NO: 176582 - RNA, 32 nt, Human
gccuuggcuguacugcuauucuuacugcugcu

SEQ ID NO: 176583 - RNA, 32 nt, Human
gccuuggcuugaguuuuuguccuugccuccuu

SEQ ID NO: 176584 - RNA, 32 nt, Human
gccuugggaaauuuaucuaacucucugggccc

SEQ ID NO: 176585 - RNA, 32 nt, Human
gccuugggaaucaggagcuggagccaggaugc

SEQ ID NO: 176586 - RNA, 32 nt, Human
gccuugggacagcugggaacuuaacuugaaau

SEQ ID NO: 176587 - RNA, 18 nt, Human
gccuugggacccguccuc

SEQ ID NO: 176588 - RNA, 32 nt, Human
gccuugggagagaugccuuccaggcagacaca

SEQ ID NO: 176589 - RNA, 32 nt, Human
gccuugggagcagcagugcuaccacgguaaug

SEQ ID NO: 176590 - RNA, 32 nt, Human
gccuugggagccacugccacuccaguccugcc

SEQ ID NO: 176591 - RNA, 32 nt, Human
gccuugggagcucuuuggccuccuggcuggcc

SEQ ID NO: 176592 - RNA, 24 nt, Human
gccuugggauuagccucuuccuca

SEQ ID NO: 176593 - RNA, 32 nt, Human
gccuugggcagugccuccuccugggccugggu

SEQ ID NO: 176594 - RNA, 18 nt, Human
gccuugggcccacccuca

SEQ ID NO: 176595 - RNA, 32 nt, Human
gccuugggccugggaaucuaagugggagacaa

SEQ ID NO: 176596 - RNA, 22 nt, Human
gccuugggccuucgaccugggg

SEQ ID NO: 176597 - RNA, 32 nt, Human
gccuugggcuguacauaguguucccucucauc

SEQ ID NO: 176598 - RNA, 32 nt, Human
gccuuggggagaagaaacauggugaaaacagg

SEQ ID NO: 176599 - RNA, 32 nt, Human
gccuuggggaggcccaguguucccagggugga

SEQ ID NO: 176600 - RNA, 21 nt, Human
gccuuggggcuccgagucccu

SEQ ID NO: 176601 - RNA, 19 nt, Human
gccuuggggcucuggcucc

SEQ ID NO: 176602 - RNA, 30 nt, Human
gccuugggguauaguuuuaucuuucugcuu

SEQ ID NO: 176603 - RNA, 32 nt, Human
gccuuggguccccauccucuggaaccaggggg

SEQ ID NO: 176604 - RNA, 32 nt, Human
gccuuggguguauguaacuauguauguauaua

SEQ ID NO: 176605 - RNA, 32 nt, Human
gccuuggucuucaugguaaccaccgcgucugu

SEQ ID NO: 176606 - RNA, 32 nt, Human
gccuuggucuuggacaacuguaaggaacaaca

SEQ ID NO: 176607 - RNA, 32 nt, Human
gccuuggugagcucccgugguggguucccagc

SEQ ID NO: 176608 - RNA, 32 nt, Human
gccuuggugccuguagcucuggacuucccugg

SEQ ID NO: 176609 - RNA, 32 nt, Human
gccuugguuaauugacucacaccagcugugcg

SEQ ID NO: 176610 - RNA, 32 nt, Human
gccuugguuugggagcagggagggggaagucc

SEQ ID NO: 176611 - RNA, 32 nt, Human
gccuuguaagaggcaagaaacacuugccgaau

SEQ ID NO: 176612 - RNA, 32 nt, Human
gccuugucacccaggcuggaguccaguggcac

SEQ ID NO: 176613 - RNA, 32 nt, Human
gccuuguccacacuccccucugagcuuuacug

SEQ ID NO: 176614 - RNA, 32 nt, Human
gccuuguccagccugaccaacauggugaaacc

SEQ ID NO: 176615 - RNA, 32 nt, Human
gccuugucgcccaggaaguggggcucggcacc

SEQ ID NO: 176616 - RNA, 32 nt, Human
gccuugucucugcugcuccucuccuuggaaac

SEQ ID NO: 176617 - RNA, 22 nt, Human
gccuugucuuccucuuuccucu

SEQ ID NO: 176618 - RNA, 32 nt, Human
gccuugucuuuuccucucucugccucaguuuc

SEQ ID NO: 176619 - RNA, 32 nt, Human
gccuugugccuccaaaagccucacgcugcaac

SEQ ID NO: 176620 - RNA, 32 nt, Human
gccuugugccugcaguggagguuccaguugug

SEQ ID NO: 176621 - RNA, 32 nt, Human
gccuuguggccaccccucacccugacaccgac

SEQ ID NO: 176622 - RNA, 32 nt, Human
gccuugugggauggcagaugaucagggcugua

SEQ ID NO: 176623 - RNA, 32 nt, Human
gccuugugggggcuccagaaaagaggcuagga

SEQ ID NO: 176624 - RNA, 32 nt, Human
gccuugugggugaagccagggagggagacagg

SEQ ID NO: 176625 - RNA, 19 nt, Human
gccuuguggugugugcgca

SEQ ID NO: 176626 - RNA, 32 nt, Human
gccuugugucagagcugggaguagcauggacu

SEQ ID NO: 176627 - RNA, 32 nt, Human
gccuuguguguaguuguuuggagcacacugca

SEQ ID NO: 176628 - RNA, 32 nt, Human
gccuuguucuuucucacaguaucuaucccacu

SEQ ID NO: 176629 - RNA, 32 nt, Human
gccuuguugccuuaucuucuuccaaauguacu

SEQ ID NO: 176630 - RNA, 32 nt, Human
gccuuguuuacuuuucagagcugacagauugc

SEQ ID NO: 176631 - RNA, 32 nt, Human
gccuuguuuaugcuucuugucugagaacagua

SEQ ID NO: 176632 - RNA, 32 nt, Human
gccuuguuugcagaauaaacagggcauuuagc

SEQ ID NO: 176633 - RNA, 32 nt, Human
gccuuguuugccucagcucuggaagcugacuu

SEQ ID NO: 176634 - RNA, 32 nt, Human
gccuuguuugcugagggcacacacaguggaga

SEQ ID NO: 176635 - RNA, 23 nt, Human
gccuuguuuuguuuguuuguuug

SEQ ID NO: 176636 - RNA, 32 nt, Human
gccuuuaaagugaagaagaggagccaguugug

SEQ ID NO: 176637 - RNA, 32 nt, Human
gccuuuaacagagagacaagagagcuuguucu

SEQ ID NO: 176638 - RNA, 32 nt, Human
gccuuuaauaaaagaaaguggccauaagaagg

SEQ ID NO: 176639 - RNA, 24 nt, Human
gccuuuaaucccagcuacucggga

SEQ ID NO: 176640 - RNA, 32 nt, Human
gccuuuacaaaaguuaauuuacauucucuguu

SEQ ID NO: 176641 - RNA, 32 nt, Human
gccuuuacacucucgugacugggaaauagaga

SEQ ID NO: 176642 - RNA, 18 nt, Human
gccuuuaccacagcaagg

SEQ ID NO: 176643 - RNA, 32 nt, Human
gccuuuacuaccucuaccugcagaagacgaug

SEQ ID NO: 176644 - RNA, 32 nt, Human
gccuuuacugacaccuugugcucaggccugug

SEQ ID NO: 176645 - RNA, 24 nt, Human
gccuuuagucccagcuacucagga

SEQ ID NO: 176646 - RNA, 32 nt, Human
gccuuuauccugggagauggggaggaagcccc

SEQ ID NO: 176647 - RNA, 20 nt, Human
gccuuuaucuagaugaggua

SEQ ID NO: 176648 - RNA, 22 nt, Human
gccuuuaugccacacucugugg

SEQ ID NO: 176649 - RNA, 17 nt, Human
gccuuuauuccaucucu

SEQ ID NO: 176650 - RNA, 32 nt, Human
gccuuuauucugucuucucuuguccuaucuca

SEQ ID NO: 176651 - RNA, 32 nt, Human
gccuuuauuuuucugucccagaaggauucugu

SEQ ID NO: 176652 - RNA, 32 nt, Human
gccuuucaaccagcaaccaggcacaggcagaa

SEQ ID NO: 176653 - RNA, 32 nt, Human
gccuuucaccacccccacacccugccaugacu

SEQ ID NO: 176654 - RNA, 32 nt, Human
gccuuucaccagggcuccaucugugaagaguc

SEQ ID NO: 176655 - RNA, 22 nt, Human
gccuuucacccaggcucucagc

SEQ ID NO: 176656 - RNA, 32 nt, Human
gccuuucacgccuuccaccuccugcgugucca

SEQ ID NO: 176657 - RNA, 32 nt, Human
gccuuucacggcugcugacuucucagggcugc

SEQ ID NO: 176658 - RNA, 32 nt, Human
gccuuucacuauccgccauucuugucaccuca

SEQ ID NO: 176659 - RNA, 19 nt, Human
gccuuucacugccacaguu

SEQ ID NO: 176660 - RNA, 32 nt, Human
gccuuucacuugcauccaacuccuggggcugg

SEQ ID NO: 176661 - RNA, 32 nt, Human
gccuuucagaaggagaaggcagcucuguuucu

SEQ ID NO: 176662 - RNA, 32 nt, Human
gccuuucagaaggagucuccugguuuucuuac

SEQ ID NO: 176663 - RNA, 32 nt, Human
gccuuucagagcccaagucuguggguuggcuu

SEQ ID NO: 176664 - RNA, 19 nt, Human
gccuuucagaucuuugaua

SEQ ID NO: 176665 - RNA, 32 nt, Human
gccuuucagauucagguguauggaauuuuuga

SEQ ID NO: 176666 - RNA, 32 nt, Human
gccuuucaugaugcaggagagcagggaucccg

SEQ ID NO: 176667 - RNA, 32 nt, Human
gccuuuccaccugcuuucuccugggcccgcuu

SEQ ID NO: 176668 - RNA, 32 nt, Human
gccuuuccacgcccuccagccccgggggagau

SEQ ID NO: 176669 - RNA, 32 nt, Human
gccuuuccauuuucccugcuccccucugcaga

SEQ ID NO: 176670 - RNA, 32 nt, Human
gccuuucccacugguccaucugguuuucucuc

SEQ ID NO: 176671 - RNA, 24 nt, Human
gccuuucccaugugccaaaccaga

SEQ ID NO: 176672 - RNA, 32 nt, Human
gccuuucccccuuaccugcccugcugccugca

SEQ ID NO: 176673 - RNA, 32 nt, Human
gccuuucccgaggccugugagugccucaggaa

SEQ ID NO: 176674 - RNA, 32 nt, Human
gccuuucccuuuccucuuugccugcuauauaa

SEQ ID NO: 176675 - RNA, 32 nt, Human
gccuuuccucccccuuccucucccccuuccuc

SEQ ID NO: 176676 - RNA, 32 nt, Human
gccuuuccuggugguuuccaacaucaaggaca

SEQ ID NO: 176677 - RNA, 18 nt, Human
gccuuuccuucugcugcu

SEQ ID NO: 176678 - RNA, 32 nt, Human
gccuuuccuucuugugggcaucugggaccguc

SEQ ID NO: 176679 - RNA, 32 nt, Human
gccuuuccuuucuccagcuucugcucugcccc

SEQ ID NO: 176680 - RNA, 32 nt, Human
gccuuucuacuuccuggaccccugacccggcu

SEQ ID NO: 176681 - RNA, 32 nt, Human
gccuuucuauacaaagcuacuauuaucgacau

SEQ ID NO: 176682 - RNA, 32 nt, Human
gccuuucuccaccaggccccucaucugaauac

SEQ ID NO: 176683 - RNA, 32 nt, Human
gccuuucuccaucuauugucucuuucaccccu

SEQ ID NO: 176684 - RNA, 32 nt, Human
gccuuucucugccucuuccuccccugucuugg

SEQ ID NO: 176685 - RNA, 32 nt, Human
gccuuucucugccugcccugcccuuggggcca

SEQ ID NO: 176686 - RNA, 32 nt, Human
gccuuucucuuaaucaguccugccucaaacau

SEQ ID NO: 176687 - RNA, 32 nt, Human
gccuuucugauuuugccuccaaaggagagcgc

SEQ ID NO: 176688 - RNA, 32 nt, Human
gccuuucugcaccccuucucuccuggggagcu

SEQ ID NO: 176689 - RNA, 32 nt, Human
gccuuucugccucacaucagcccuguguauaa

SEQ ID NO: 176690 - RNA, 32 nt, Human
gccuuucuggacccaauuuuuccccagugaaa

SEQ ID NO: 176691 - RNA, 22 nt, Human
gccuuucuggccccuucccuca

SEQ ID NO: 176692 - RNA, 32 nt, Human
gccuuucuggccugcuaugucuucccaauguu

SEQ ID NO: 176693 - RNA, 32 nt, Human
gccuuucuggugaaggaagguugcuaugaaac

SEQ ID NO: 176694 - RNA, 22 nt, Human
gccuuucuggugcuguucucca

SEQ ID NO: 176695 - RNA, 32 nt, Human
gccuuucuguaucuuggggaaauaagaccgau

SEQ ID NO: 176696 - RNA, 32 nt, Human
gccuuucugucugccugaugucaagggcuucu

SEQ ID NO: 176697 - RNA, 32 nt, Human
gccuuucuucaugugugcgugcauaucagccc

SEQ ID NO: 176698 - RNA, 32 nt, Human
gccuuucuugcccucugaccucaaaggcuagc

SEQ ID NO: 176699 - RNA, 32 nt, Human
gccuuucuugcuuucaaauaugcuauggagcc

SEQ ID NO: 176700 - RNA, 32 nt, Human
gccuuucuuucacagagccuucagagggaaac

SEQ ID NO: 176701 - RNA, 32 nt, Human
gccuuugaaaaguggaggaaagaaaagcccuu

SEQ ID NO: 176702 - RNA, 32 nt, Human
gccuuugaaauggauacaugaaaauuagugaa

SEQ ID NO: 176703 - RNA, 32 nt, Human
gccuuugaacaaguaagugagccacccucgga

SEQ ID NO: 176704 - RNA, 32 nt, Human
gccuuugacuccaggcugggcgauuccgaugc

SEQ ID NO: 176705 - RNA, 32 nt, Human
gccuuugagaugaaguaggcugcucuguuugg

SEQ ID NO: 176706 - RNA, 32 nt, Human
gccuuugagcugcugacuuucagcuggaacuu

SEQ ID NO: 176707 - RNA, 32 nt, Human
gccuuugaggaugaggaggaggaagaccugcg

SEQ ID NO: 176708 - RNA, 23 nt, Human
gccuuugaggccgggugcagugg

SEQ ID NO: 176709 - RNA, 32 nt, Human
gccuuugaggccgggugcaguggcucacgccu

SEQ ID NO: 176710 - RNA, 32 nt, Human
gccuuugaguguuaucucucaguggcuagagg

SEQ ID NO: 176711 - RNA, 32 nt, Human
gccuuugauucuggaaaaaugcuuaacaaaaa

SEQ ID NO: 176712 - RNA, 19 nt, Human
gccuuugauuugaguggga

SEQ ID NO: 176713 - RNA, 32 nt, Human
gccuuugcaaaccugccuguuggcauauugaa

SEQ ID NO: 176714 - RNA, 32 nt, Human
gccuuugcaauaccugcauccccagcacuggu

SEQ ID NO: 176715 - RNA, 32 nt, Human
gccuuugcauucucuauagccucugcagagag

SEQ ID NO: 176716 - RNA, 32 nt, Human
gccuuugccacaaggucaaaagcacaaagggg

SEQ ID NO: 176717 - RNA, 22 nt, Human
gccuuugccagcagagccaggg

SEQ ID NO: 176718 - RNA, 32 nt, Human
gccuuugcccacucggggagcagaucaugcau

SEQ ID NO: 176719 - RNA, 32 nt, Human
gccuuugcccugauccaaauguuagcacuugc

SEQ ID NO: 176720 - RNA, 32 nt, Human
gccuuugccugggaacugguccuuguuugccg

SEQ ID NO: 176721 - RNA, 32 nt, Human
gccuuugccuggggaucacuccccaaccacca

SEQ ID NO: 176722 - RNA, 32 nt, Human
gccuuugcuaucucgccgucgcccgcccacgc

SEQ ID NO: 176723 - RNA, 32 nt, Human
gccuuugcucagagaggagcugccuuaggagu

SEQ ID NO: 176724 - RNA, 32 nt, Human
gccuuugcucuucuuccuucuuccugccacac

SEQ ID NO: 176725 - RNA, 32 nt, Human
gccuuugcuuguucacugcagucuuaagaaag

SEQ ID NO: 176726 - RNA, 32 nt, Human
gccuuuggaacauguuccugcccagcuuucca

SEQ ID NO: 176727 - RNA, 32 nt, Human
gccuuuggaugaccagaacaagguucccucug

SEQ ID NO: 176728 - RNA, 32 nt, Human
gccuuuggcacgcgcuacacccuuuugcuuug

SEQ ID NO: 176729 - RNA, 32 nt, Human
gcgggccucugggcagaggaugcaauggcacg

SEQ ID NO: 176730 - RNA, 32 nt, Human
gcgggccugcucccagcucugccuccugcccg

SEQ ID NO: 176731 - RNA, 32 nt, Human
gcgggccuggagacccagagcgagacggccua

SEQ ID NO: 176732 - RNA, 19 nt, Human
gcgggccuggcucaggcgg

SEQ ID NO: 176733 - RNA, 32 nt, Human
gcgggccuguggucccagcugcucgggagguu

SEQ ID NO: 176734 - RNA, 32 nt, Human
gcgggccuuuggugggugagcgggacugugug

SEQ ID NO: 176735 - RNA, 32 nt, Human
gcgggcgagggcccuguguggaccaccuccac

SEQ ID NO: 176736 - RNA, 32 nt, Human
gcgggcgaggugcguuccccagccugguuugc

SEQ ID NO: 176737 - RNA, 32 nt, Human
gcgggcgcaagggggcgggcgcugccguacuc

SEQ ID NO: 176738 - RNA, 32 nt, Human
gcgggcgcacacuguauguaccuauaauaaac

SEQ ID NO: 176739 - RNA, 32 nt, Human
gcgggcgccacagcggaaucagcgguuccgug

SEQ ID NO: 176740 - RNA, 32 nt, Human
gcgggcgccauggaggagggcuccagcucgcc

SEQ ID NO: 176741 - RNA, 18 nt, Human
gcgggcgccccgcagccg

SEQ ID NO: 176742 - RNA, 32 nt, Human
gcgggcgccgagcucccgccauggcccggaac

SEQ ID NO: 176743 - RNA, 21 nt, Human
gcgggcgccgcgucggcgcgg

SEQ ID NO: 176744 - RNA, 32 nt, Human
gcgggcgccggggcuucugggcuccgggcacu

SEQ ID NO: 176745 - RNA, 32 nt, Human
gcgggcgccuguaauaucagcuacuugggaga

SEQ ID NO: 176746 - RNA, 32 nt, Human
gcgggcgccuguaaucacagcuacuugggagg

SEQ ID NO: 176747 - RNA, 32 nt, Human
gcgggcgccuguaauccaagcuacuggggagg

SEQ ID NO: 176748 - RNA, 32 nt, Human
gcgggcgccuguaaucccagcuacucgggaag

SEQ ID NO: 176749 - RNA, 32 nt, Human
gcgggcgccuguaaucccagcuacucgggagg

SEQ ID NO: 176750 - RNA, 32 nt, Human
gcgggcgccuguaaucccagcuacuugggaag

SEQ ID NO: 176751 - RNA, 32 nt, Human
gcgggcgccuguaaucccagcuacuugggagg

SEQ ID NO: 176752 - RNA, 32 nt, Human
gcgggcgccuguaaucccagcuacuugggugg

SEQ ID NO: 176753 - RNA, 32 nt, Human
gcgggcgccuguaaucccagcugcuggggaag

SEQ ID NO: 176754 - RNA, 32 nt, Human
gcgggcgcgagggggaggcacguggccccgcu

SEQ ID NO: 176755 - RNA, 32 nt, Human
gcgggcgcugguaaucccagcuacucaggugg

SEQ ID NO: 176756 - RNA, 32 nt, Human
gcgggcggacggcacagagggagggagcgagc

SEQ ID NO: 176757 - RNA, 32 nt, Human
gcgggcggaggaacuacaauucccagcgugac

SEQ ID NO: 176758 - RNA, 22 nt, Human
gcgggcggaggggacccggggc

SEQ ID NO: 176759 - RNA, 32 nt, Human
gcgggcggaggugcuuguuccaccggcacucc

SEQ ID NO: 176760 - RNA, 32 nt, Human
gcgggcggcagcaugucgguggcggggcugaa

SEQ ID NO: 176761 - RNA, 32 nt, Human
gcgggcggccagcgaagguggcgaaggcuccc

SEQ ID NO: 176762 - RNA, 32 nt, Human
gcgggcggcccugaagccucaggagcagcccc

SEQ ID NO: 176763 - RNA, 32 nt, Human
gcgggcggccgaguuuuccaagagauaacuuc

SEQ ID NO: 176764 - RNA, 32 nt, Human
gcgggcggcgacauggaggacggcgugcucaa

SEQ ID NO: 176765 - RNA, 32 nt, Human
gcgggcggcggcggaggaggagacugaggagc

SEQ ID NO: 176766 - RNA, 32 nt, Human
gcgggcggcggcggaggcugcgggagucgcug

SEQ ID NO: 176767 - RNA, 32 nt, Human
gcgggcggcggcggcccggaggagaacgggcg

SEQ ID NO: 176768 - RNA, 32 nt, Human
gcgggcggcgggaugagagggagccaucgggc

SEQ ID NO: 176769 - RNA, 32 nt, Human
gcgggcggcgggcggcaaaggagcagccauga

SEQ ID NO: 176770 - RNA, 32 nt, Human
gcgggcggcugggucugugcauuucugguugc

SEQ ID NO: 176771 - RNA, 32 nt, Human
gcgggcgggagagaggaagagaggggagcgcg

SEQ ID NO: 176772 - RNA, 32 nt, Human
gcgggcgggaggcuagcuguugucgugguugc

SEQ ID NO: 176773 - RNA, 32 nt, Human
gcgggcgggcagcagcugcaggaaggcucuga

SEQ ID NO: 176774 - RNA, 32 nt, Human
gcgggcgggccuggggcacuccgucgccuuug

SEQ ID NO: 176775 - RNA, 32 nt, Human
gcgggcggggcgcagagccaggcagcgcaggu

SEQ ID NO: 176776 - RNA, 32 nt, Human
gcgggcggggcggagcggagggccagcgggcc

SEQ ID NO: 176777 - RNA, 32 nt, Human
gcgggcggggcggccgcugccuccccgggacg

SEQ ID NO: 176778 - RNA, 32 nt, Human
gcgggcgggggugggagggccauuuugucacu

SEQ ID NO: 176779 - RNA, 32 nt, Human
gcgggcgugcaggacgccagagcugggucaga

SEQ ID NO: 176780 - RNA, 32 nt, Human
gcgggcguggguggaacagagcggccaggagu

SEQ ID NO: 176781 - RNA, 32 nt, Human
gcgggcucacgcaauccuccugccacagcuuc

SEQ ID NO: 176782 - RNA, 21 nt, Human
gcgggcucagggucugugagg

SEQ ID NO: 176783 - RNA, 32 nt, Human
gcgggcuccagggagaccugggugggcagcgu

SEQ ID NO: 176784 - RNA, 32 nt, Human
gcgggcucccacccucugcuccuggccuuggg

SEQ ID NO: 176785 - RNA, 21 nt, Human
gcgggcucccgcugcuggggg

SEQ ID NO: 176786 - RNA, 18 nt, Human
gcgggcuccgcgcagccg

SEQ ID NO: 176787 - RNA, 32 nt, Human
gcgggcuccguggaagcguggccggcagcguc

SEQ ID NO: 176788 - RNA, 20 nt, Human
gcgggcuccucagcuggggg

SEQ ID NO: 176789 - RNA, 23 nt, Human
gcgggcuccuggagccuggagga

SEQ ID NO: 176790 - RNA, 32 nt, Human
gcgggcuccuggcaaggcauucgcuccugagc

SEQ ID NO: 176791 - RNA, 32 nt, Human
gcgggcugaugucuucuugggggcagaccaga

SEQ ID NO: 176792 - RNA, 32 nt, Human
gcgggcugcccaggcagugcagagcggagaga

SEQ ID NO: 176793 - RNA, 32 nt, Human
gcgggcuggcaggcgggggaggcugcaggcuc

SEQ ID NO: 176794 - RNA, 32 nt, Human
gcgggcugggaaggucuccuccccucaccaca

SEQ ID NO: 176795 - RNA, 32 nt, Human
gcgggcugggaggcgcuguggauggcagcggg

SEQ ID NO: 176796 - RNA, 32 nt, Human
gcgggcugggcugggcccgggauggcgguggc

SEQ ID NO: 176797 - RNA, 32 nt, Human
gcgggcuguggcugcggagguugaggggcguc

SEQ ID NO: 176798 - RNA, 32 nt, Human
gcgggcuucauggccuucuccuccaggaagcu

SEQ ID NO: 176799 - RNA, 32 nt, Human
gcgggcuugcagcugcggcaagugcuggcggc

SEQ ID NO: 176800 - RNA, 32 nt, Human
gcgggcuuggaacccggugcucccucugucau

SEQ ID NO: 176801 - RNA, 32 nt, Human
gcgggcuuguuggcucgugccuguaaucccag

SEQ ID NO: 176802 - RNA, 32 nt, Human
gcggggaagauggcggaugacaaggauucucu

SEQ ID NO: 176803 - RNA, 32 nt, Human
gcggggaagcaaagcacaggagcgcuguggug

SEQ ID NO: 176804 - RNA, 32 nt, Human
gcggggacaacaaagaguucuucucugggaaa

SEQ ID NO: 176805 - RNA, 32 nt, Human
gcggggacaaguccguugaggcugccaggcga

SEQ ID NO: 176806 - RNA, 32 nt, Human
gcggggacacaccuguguccuccucaccccac

SEQ ID NO: 176807 - RNA, 32 nt, Human
gcggggacagggaaggaggaagaagcuucgag

SEQ ID NO: 176808 - RNA, 32 nt, Human
gcggggaccaugcugccuucucugggcucacg

SEQ ID NO: 176809 - RNA, 18 nt, Human
gcggggacgagcucgggu

SEQ ID NO: 176810 - RNA, 22 nt, Human
gcggggacuuccaggcacuccc

SEQ ID NO: 176811 - RNA, 32 nt, Human
gcggggagagagaaucugaacuuucagcugua

SEQ ID NO: 176812 - RNA, 32 nt, Human
gcggggagagagagggauagaaaacaagcgca

SEQ ID NO: 176813 - RNA, 21 nt, Human
gcggggagagauuggcugcgg

SEQ ID NO: 176814 - RNA, 18 nt, Human
gcggggagcauggcucag

SEQ ID NO: 176815 - RNA, 32 nt, Human
gcggggagccuaggaccuggagcgagagccgc

SEQ ID NO: 176816 - RNA, 32 nt, Human
gcggggagccugggaccaggagcgagagccgc

SEQ ID NO: 176817 - RNA, 19 nt, Human
gcggggagcucgggccccg

SEQ ID NO: 176818 - RNA, 32 nt, Human
gcggggaggaagcaugcucaagcagcccagcg

SEQ ID NO: 176819 - RNA, 32 nt, Human
gcggggaggagcgugcagggaggaggcagccg

SEQ ID NO: 176820 - RNA, 32 nt, Human
gcggggaggaggaggagaaggcggcggcggac

SEQ ID NO: 176821 - RNA, 21 nt, Human
gcggggaggcagagggugcgg

SEQ ID NO: 176822 - RNA, 32 nt, Human
gcggggaggccaugcugcaaagcugccgugau

SEQ ID NO: 176823 - RNA, 32 nt, Human
gcggggaggcggggcgcagggauccggaaaca

SEQ ID NO: 176824 - RNA, 18 nt, Human
gcggggaggcuggggccc

SEQ ID NO: 176825 - RNA, 32 nt, Human
gcggggagggcagaggggucagggcugaggag

SEQ ID NO: 176826 - RNA, 32 nt, Human
gcggggagggcgcggcccuggcucugccaccu

SEQ ID NO: 176827 - RNA, 32 nt, Human
gcggggagggggcgccgcgccgcgggggccau

SEQ ID NO: 176828 - RNA, 32 nt, Human
gcggggaguaugguggggguccuggccauggc

SEQ ID NO: 176829 - RNA, 23 nt, Human
gcggggaguuguugauuugugag

SEQ ID NO: 176830 - RNA, 20 nt, Human
gcggggaucaaauccuggaa

SEQ ID NO: 176831 - RNA, 19 nt, Human
gcggggauugaggcugcgg

SEQ ID NO: 176832 - RNA, 31 nt, Human
gcggggcaagggucucccagcgcgacaggac

SEQ ID NO: 176833 - RNA, 32 nt, Human
gcggggcacagagacagagagcaaggcuguga

SEQ ID NO: 176834 - RNA, 32 nt, Human
gcggggcagacccugagagaugguuggugcca

SEQ ID NO: 176835 - RNA, 18 nt, Human
gcggggcagcggcugcgg

SEQ ID NO: 176836 - RNA, 30 nt, Human
gcggggcagcugcugagggcacagucgccu

SEQ ID NO: 176837 - RNA, 32 nt, Human
gcggggcaggacacacugcugaccucaccacu

SEQ ID NO: 176838 - RNA, 32 nt, Human
gcggggcaggauuccaggcaggagccuugccu

SEQ ID NO: 176839 - RNA, 32 nt, Human
gcggggcaggcagagcgggcgaaggcgcggag

SEQ ID NO: 176840 - RNA, 15 nt, Human
gcggggcaggcgcug

SEQ ID NO: 176841 - RNA, 32 nt, Human
gcggggcagggaggggcaggguguucuagagg

SEQ ID NO: 176842 - RNA, 32 nt, Human
gcggggcagggggcagggagaggagggcggcg

SEQ ID NO: 176843 - RNA, 32 nt, Human
gcggggccaccaugcuccugcccaggccugga

SEQ ID NO: 176844 - RNA, 32 nt, Human
gcggggccacccucuccggcccuucccccagc

SEQ ID NO: 176845 - RNA, 32 nt, Human
gcggggccacugccccgcuugggggaagccga

SEQ ID NO: 176846 - RNA, 32 nt, Human
gcggggccagcaggcugucccagcccucaccc

SEQ ID NO: 176847 - RNA, 32 nt, Human
gcggggccaggggaggggcgggcagguaggug

SEQ ID NO: 176848 - RNA, 32 nt, Human
gcggggccauggcgcggagaccccgggcgccg

SEQ ID NO: 176849 - RNA, 32 nt, Human
gcggggcccacaguaccugccccaccaggaca

SEQ ID NO: 176850 - RNA, 32 nt, Human
gcggggcccagccaccuucgggaguccggguu

SEQ ID NO: 176851 - RNA, 32 nt, Human
gcggggcccaggagcccaccuggccucccuca

SEQ ID NO: 176852 - RNA, 32 nt, Human
gcggggcccaggucccuuugggcccgcggagg

SEQ ID NO: 176853 - RNA, 32 nt, Human
gcggggccccagcccccugagcacccccucac

SEQ ID NO: 176854 - RNA, 32 nt, Human
gcggggcccggcccuggcggcgcggcgcggcg

SEQ ID NO: 176855 - RNA, 19 nt, Human
gcggggcccggcggcgcgg

SEQ ID NO: 176856 - RNA, 32 nt, Human
gcggggcccuccuggcaggguagggaaggagg

SEQ ID NO: 176857 - RNA, 32 nt, Human
gcggggcccucgggagcccaggugcagagcga

SEQ ID NO: 176858 - RNA, 32 nt, Human
gcggggcccugagccucccccugugccagcag

SEQ ID NO: 176859 - RNA, 22 nt, Human
gcggggccgccgccggcugcag

SEQ ID NO: 176860 - RNA, 32 nt, Human
gcggggccggggccggggaggggccaggcccg

SEQ ID NO: 176861 - RNA, 18 nt, Human
gcggggccucugacaccc

SEQ ID NO: 176862 - RNA, 32 nt, Human
gcggggccuggcucugcacacccaggaaaagu

SEQ ID NO: 176863 - RNA, 32 nt, Human
gcggggccuggggcucagaggggugggcuuug

SEQ ID NO: 176864 - RNA, 32 nt, Human
gcggggccuuccugcaaccuuugcggcuccaa

SEQ ID NO: 176865 - RNA, 17 nt, Human
gcggggccuuggcugca

SEQ ID NO: 176866 - RNA, 21 nt, Human
gcggggcgacgcuggcugcag

SEQ ID NO: 176867 - RNA, 19 nt, Human
gcggggcgcgcccgcuccc

SEQ ID NO: 176868 - RNA, 32 nt, Human
gcggggcgggccacagucuccagccugaagcg

SEQ ID NO: 176869 - RNA, 32 nt, Human
gcggggcggggaggggccaggcgggagcgcag

SEQ ID NO: 176870 - RNA, 17 nt, Human
gcggggcggggcagggg

SEQ ID NO: 176871 - RNA, 21 nt, Human
gcggggcgggggcccagggca

SEQ ID NO: 176872 - RNA, 32 nt, Human
gcggggcggggguggaggacgagagagcgguc

SEQ ID NO: 176873 - RNA, 32 nt, Human
gcggggcgucuccagcccccugcccucuccuc

SEQ ID NO: 176874 - RNA, 32 nt, Human
gcggggcucacugccacccucccacaccagac

SEQ ID NO: 176875 - RNA, 32 nt, Human
gcggggcucggaucugaaaggcggccagaucc

SEQ ID NO: 176876 - RNA, 32 nt, Human
gcggggcucugccgauguccucagggcugggc

SEQ ID NO: 176877 - RNA, 32 nt, Human
gcggggcugcagcuuccugcaugaugcugggg

SEQ ID NO: 176878 - RNA, 32 nt, Human
gcggggcugccagagaaccccagaccugcccu

SEQ ID NO: 176879 - RNA, 32 nt, Human
gcggggcuggagaaggccagggccaggagccu

SEQ ID NO: 176880 - RNA, 32 nt, Human
gcggggcugggugggagaugggagggccaacu

SEQ ID NO: 176881 - RNA, 32 nt, Human
gcggggcugucgggguugggaagcacagucug

SEQ ID NO: 176882 - RNA, 16 nt, Human
gcggggcuuccaggcc

SEQ ID NO: 176883 - RNA, 21 nt, Human
gcgggggaacugcccugugga

SEQ ID NO: 176884 - RNA, 32 nt, Human
gcgggggaaggaggagcugcagcuggacugug

SEQ ID NO: 176885 - RNA, 32 nt, Human
gcgggggaaggcgaaaaagaaaaagaaagaag

SEQ ID NO: 176886 - RNA, 24 nt, Human
gcgggggagagaaggagguggccc

SEQ ID NO: 176887 - RNA, 32 nt, Human
gcgggggagaggggagaauggaguagaguccc

SEQ ID NO: 176888 - RNA, 32 nt, Human
gcgggggagaggguaaacuggggcgcgcgggu

SEQ ID NO: 176889 - RNA, 32 nt, Human
gcgggggagauggaguuugcaguuccacuugc

SEQ ID NO: 176890 - RNA, 21 nt, Human
gcgggggagcugcgacgcgca

SEQ ID NO: 176891 - RNA, 32 nt, Human
gcgggggaggcagaggcggaggcggagucaag

SEQ ID NO: 176892 - RNA, 32 nt, Human
gcgggggaggcggcggagagaccccgccagcg

SEQ ID NO: 176893 - RNA, 32 nt, Human
gcgggggaggcucccgcccuccccagucccac

SEQ ID NO: 176894 - RNA, 32 nt, Human
gcgggggagguggaggugcgaguauaaaugau

SEQ ID NO: 176895 - RNA, 32 nt, Human
gcgggggauaggauuuugcaacaaaaagcuga

SEQ ID NO: 176896 - RNA, 20 nt, Human
gcgggggcaccgggccgcgg

SEQ ID NO: 176897 - RNA, 20 nt, Human
gcgggggcacucgcugugga

SEQ ID NO: 176898 - RNA, 17 nt, Human
gcgggggcagcgggcug

SEQ ID NO: 176899 - RNA, 19 nt, Human
gcgggggcaggaggcgcag

SEQ ID NO: 176900 - RNA, 32 nt, Human
gcgggggcagggaccauggcagagcgagaguu

SEQ ID NO: 176901 - RNA, 32 nt, Human
gcgggggcaggggcaggggcagcucuccuuua

SEQ ID NO: 176902 - RNA, 18 nt, Human
gcgggggcaguggaggca

SEQ ID NO: 176903 - RNA, 17 nt, Human
gcgggggccagggcuca

SEQ ID NO: 176904 - RNA, 21 nt, Human
gcgggggccagugaagcucag

SEQ ID NO: 176905 - RNA, 21 nt, Human
gcgggggccaugugggcccag

SEQ ID NO: 176906 - RNA, 17 nt, Human
gcgggggccccagcugc

SEQ ID NO: 176907 - RNA, 32 nt, Human
gcgggggccgauccggcggagagcagagcccg

SEQ ID NO: 176908 - RNA, 19 nt, Human
gcgggggccgaugguggag

SEQ ID NO: 176909 - RNA, 19 nt, Human
gcgggggccgccagccgca

SEQ ID NO: 176910 - RNA, 19 nt, Human
gcgggggccgccgccgcag

SEQ ID NO: 176911 - RNA, 17 nt, Human
gcgggggccgccggcgc

SEQ ID NO: 176912 - RNA, 20 nt, Human
gcgggggccgcggaagcugc

SEQ ID NO: 176913 - RNA, 17 nt, Human
gcgggggccgcggccgc

SEQ ID NO: 176914 - RNA, 18 nt, Human
gcgggggccgcgggacug

SEQ ID NO: 176915 - RNA, 18 nt, Human
gcgggggccgcgugggcg

SEQ ID NO: 176916 - RNA, 17 nt, Human
gcgggggccgcugacag

SEQ ID NO: 176917 - RNA, 19 nt, Human
gcgggggccggcggcgcgg

SEQ ID NO: 176918 - RNA, 18 nt, Human
gcgggggccgggccgcgg

SEQ ID NO: 176919 - RNA, 20 nt, Human
gcgggggccggggaggagcg

SEQ ID NO: 176920 - RNA, 32 nt, Human
gcgggggccguaggaagccaaccuucccugcu

SEQ ID NO: 176921 - RNA, 32 nt, Human
gcgggggccuccugccggcuccacgggcacuu

SEQ ID NO: 176922 - RNA, 19 nt, Human
gcgggggcgacagcggcag

SEQ ID NO: 176923 - RNA, 21 nt, Human
gcgggggcgcgggcacagcag

SEQ ID NO: 176924 - RNA, 17 nt, Human
gcgggggcgcgggcggc

SEQ ID NO: 176925 - RNA, 32 nt, Human
gcgggggcgcugaccucggccuaggaggccca

SEQ ID NO: 176926 - RNA, 20 nt, Human
gcgggggcggcagcugacag

SEQ ID NO: 176927 - RNA, 17 nt, Human
gcgggggcggcggccgc

SEQ ID NO: 176928 - RNA, 19 nt, Human
gcgggggcggcggggccag

SEQ ID NO: 176929 - RNA, 32 nt, Human
gcgggggcgggacuuccgccguccuccuggug

SEQ ID NO: 176930 - RNA, 18 nt, Human
gcgggggcggggcggcag

SEQ ID NO: 176931 - RNA, 17 nt, Human
gcgggggcggggcugca

SEQ ID NO: 176932 - RNA, 20 nt, Human
gcgggggcgugccggcccag

SEQ ID NO: 176933 - RNA, 32 nt, Human
gcgggggcuacaccaaccggaccuucgaguuu

SEQ ID NO: 176934 - RNA, 19 nt, Human
gcgggggcucacgccugua

SEQ ID NO: 176935 - RNA, 22 nt, Human
gcgggggcucacgccuguaauc

SEQ ID NO: 176936 - RNA, 32 nt, Human
gcgggggcucccggggucaguguucaagaagg

SEQ ID NO: 176937 - RNA, 19 nt, Human
gcgggggcucucggcccag

SEQ ID NO: 176938 - RNA, 18 nt, Human
gcgggggcucuggcucag

SEQ ID NO: 176939 - RNA, 21 nt, Human
gcgggggcugcacggcgccag

SEQ ID NO: 176940 - RNA, 21 nt, Human
gcgggggcugcacgugcgcag

SEQ ID NO: 176941 - RNA, 19 nt, Human
gcgggggcugccgcugcag

SEQ ID NO: 176942 - RNA, 21 nt, Human
gcgggggcugcuacacuacag

SEQ ID NO: 176943 - RNA, 20 nt, Human
gcgggggcuggaggcagcag

SEQ ID NO: 176944 - RNA, 18 nt, Human
gcgggggcuggggcgcgg

SEQ ID NO: 176945 - RNA, 32 nt, Human
gcgggggcuuucucauggcuguccuucagggu

SEQ ID NO: 176946 - RNA, 20 nt, Human
gcggggggccgcggcugcgg

SEQ ID NO: 176947 - RNA, 20 nt, Human
gcggggggcuggggaugcag

SEQ ID NO: 176948 - RNA, 20 nt, Human
gcggggguccuacagcgcag

SEQ ID NO: 176949 - RNA, 32 nt, Human
gcgggggucugcagaggccucaguguggcugu

SEQ ID NO: 176950 - RNA, 18 nt, Human
gcgggggugagauggcug

SEQ ID NO: 176951 - RNA, 32 nt, Human
gcgggggugaggacugaccacagauucccugg

SEQ ID NO: 176952 - RNA, 19 nt, Human
gcggggguggcagcagcag

SEQ ID NO: 176953 - RNA, 32 nt, Human
gcggggguggcugccauuuccagcaugcaggu

SEQ ID NO: 176954 - RNA, 17 nt, Human
gcggggguggggcugca

SEQ ID NO: 176955 - RNA, 22 nt, Human
gcggggguggggucagugguga

SEQ ID NO: 176956 - RNA, 21 nt, Human
gcggggguggugcuggcucag

SEQ ID NO: 176957 - RNA, 21 nt, Human
gcggggguggugucacugcag

SEQ ID NO: 176958 - RNA, 32 nt, Human
gcgggggugucugaggccgcacugucagcugg

SEQ ID NO: 176959 - RNA, 32 nt, Human
gcgggggugugcaggccaggguucgcgcgggc

SEQ ID NO: 176960 - RNA, 21 nt, Human
gcggggguucgcuggcugcgg

SEQ ID NO: 176961 - RNA, 20 nt, Human
gcggggguuugccaugguga

SEQ ID NO: 176962 - RNA, 32 nt, Human
gcgggguaggagaccuggagcuggagaacccg

SEQ ID NO: 176963 - RNA, 32 nt, Human
gcgggguaggagaggguucugagaggaggcag

SEQ ID NO: 176964 - RNA, 32 nt, Human
gcgggguccagcugcuccaaucccuccuccuc

SEQ ID NO: 176965 - RNA, 32 nt, Human
gcggggugaugaucucuagcagcuguuggaua

SEQ ID NO: 176966 - RNA, 23 nt, Human
gcggggugcucacgccuguaauc

SEQ ID NO: 176967 - RNA, 32 nt, Human
gcggggugcucacgccuguaauccuagcacuu

SEQ ID NO: 176968 - RNA, 32 nt, Human
gcgggguggaguucagccuacucuuucuuaga

SEQ ID NO: 176969 - RNA, 32 nt, Human
gcgggguggaucacuugaggucagggguuuga

SEQ ID NO: 176970 - RNA, 24 nt, Human
gcgggguggcucacgccuguaauc

SEQ ID NO: 176971 - RNA, 24 nt, Human
gcgggguggcucaugccuguaauu

SEQ ID NO: 176972 - RNA, 32 nt, Human
gcgggguggggaccccaaggcuuucuggggca

SEQ ID NO: 176973 - RNA, 32 nt, Human
gcgggguuuagccuguggugggcgcugcgggu

SEQ ID NO: 176974 - RNA, 32 nt, Human
gcggguaccguaauccuagcuacucgggagac

SEQ ID NO: 176975 - RNA, 31 nt, Human
gcggguagcagugcugggccugugucuugag

SEQ ID NO: 176976 - RNA, 32 nt, Human
gcggguaugggugggauuccugguggacaggg

SEQ ID NO: 176977 - RNA, 21 nt, Human
gcgggucaagugacccagccc

SEQ ID NO: 176978 - RNA, 32 nt, Human
gcgggucacucaauccuggccugggggagaau

SEQ ID NO: 176979 - RNA, 32 nt, Human
gcgggucccagaggcauggguguccaguccaa

SEQ ID NO: 176980 - RNA, 32 nt, Human
gcggguccccuucggcccuggagccgggguca

SEQ ID NO: 176981 - RNA, 32 nt, Human
gcgggucccuggcugcuguggccuccccugac

SEQ ID NO: 176982 - RNA, 32 nt, Human
gcggguccucagcugcucccacacuugugcca

SEQ ID NO: 176983 - RNA, 22 nt, Human
gcgggucgcccccgccccgacc

SEQ ID NO: 176984 - RNA, 32 nt, Human
gcgggucgggcuucgaggucagcugguccgca

SEQ ID NO: 176985 - RNA, 32 nt, Human
gcgggucuccugguccuucugccaucaugccg

SEQ ID NO: 176986 - RNA, 32 nt, Human
gcgggucucggaagguuccgaccucaguaaag

SEQ ID NO: 176987 - RNA, 20 nt, Human
gcgggucugagaccuccggg

SEQ ID NO: 176988 - RNA, 24 nt, Human
gcgggucugagggaugaggagggg

SEQ ID NO: 176989 - RNA, 32 nt, Human
gcgggucuugucgggccuccagccuggacuuc

SEQ ID NO: 176990 - RNA, 32 nt, Human
gcgggugaagugagagguaacggggcuccggg

SEQ ID NO: 176991 - RNA, 32 nt, Human
gcgggugacucaggcagguaaucccagaacuu

SEQ ID NO: 176992 - RNA, 32 nt, Human
gcgggugagaagcaggaaggaggcugaugaua

SEQ ID NO: 176993 - RNA, 32 nt, Human
gcgggugagccccaggcuggcagcuagcaaga

SEQ ID NO: 176994 - RNA, 21 nt, Human
gcgggugagccgcggcugcag

SEQ ID NO: 176995 - RNA, 32 nt, Human
gcgggugagccgcggcugcagaggccugagcg

SEQ ID NO: 176996 - RNA, 32 nt, Human
gcgggugcaccguggagucauuccaagacucc

SEQ ID NO: 176997 - RNA, 32 nt, Human
gcgggugccagggacuuggagguggaggggac

SEQ ID NO: 176998 - RNA, 32 nt, Human
gcgggugccccagagacacagacaggcugcgu

SEQ ID NO: 176999 - RNA, 32 nt, Human
gcgggugccuguaaucagcuacucgggaggcu

SEQ ID NO: 177000 - RNA, 32 nt, Human
gcgggugccuguaaucccagcuacucgggaga

SEQ ID NO: 177001 - RNA, 32 nt, Human
gcgggugccuguaaucccagcuacucgggagg

SEQ ID NO: 177002 - RNA, 32 nt, Human
gcgggugccuguaaucccagcuacuggggagg

SEQ ID NO: 177003 - RNA, 32 nt, Human
gcgggugccuguaaucccagcuacuugggagg

SEQ ID NO: 177004 - RNA, 32 nt, Human
gcgggugccuguaaucucagcuacucaggaga

SEQ ID NO: 177005 - RNA, 32 nt, Human
gcgggugccuguaaucucagcuacuugagagg

SEQ ID NO: 177006 - RNA, 32 nt, Human
gcgggugccuguagucccagccacuugggagu

SEQ ID NO: 177007 - RNA, 32 nt, Human
gcgggugccuguagucccagcuacucgggagg

SEQ ID NO: 177008 - RNA, 32 nt, Human
gcgggugccuguagucccagcuauuugggagg

SEQ ID NO: 177009 - RNA, 32 nt, Human
gcgggugccuguagucccagcugcucgggagg

SEQ ID NO: 177010 - RNA, 32 nt, Human
gcgggugcgagggcgcgagggaagggaggcgg

SEQ ID NO: 177011 - RNA, 22 nt, Human
gcgggugcggcggggccgagcc

SEQ ID NO: 177012 - RNA, 32 nt, Human
gcgggugcguggucgugcggcaagugagcgau

SEQ ID NO: 177013 - RNA, 32 nt, Human
gcggguggacguggagccacaguuccuccuuu

SEQ ID NO: 177014 - RNA, 32 nt, Human
gcggguggagcagcgcgagcccgccucgcuga

SEQ ID NO: 177015 - RNA, 32 nt, Human
gcggguggaucacaaggucaagagauagagac

SEQ ID NO: 177016 - RNA, 32 nt, Human
gcgggugggaagggaugggacacagcuucugg

SEQ ID NO: 177017 - RNA, 32 nt, Human
gcgggugggaggcggggaggagcagcgggaag

SEQ ID NO: 177018 - RNA, 32 nt, Human
gcgggugggaggugggaguggcugcagggacc

SEQ ID NO: 177019 - RNA, 32 nt, Human
gcgggugggcagggaaugggagaggggaaguc

SEQ ID NO: 177020 - RNA, 32 nt, Human
gcggguggggccccuccuccuccugagcugua

SEQ ID NO: 177021 - RNA, 32 nt, Human
gcggguggggugcuugcugugugaccuugggu

SEQ ID NO: 177022 - RNA, 31 nt, Human
gcgggugggucacaugagguugggaauucga

SEQ ID NO: 177023 - RNA, 32 nt, Human
gcggguguagaaggagcuaaagagaucugguu

SEQ ID NO: 177024 - RNA, 32 nt, Human
gcggguuacuuucacauacagcccucccccag

SEQ ID NO: 177025 - RNA, 32 nt, Human
gcggguuauggcggcggcggcagugagagcug

SEQ ID NO: 177026 - RNA, 32 nt, Human
gcggguucacgucccaccucaggccgcaucuu

SEQ ID NO: 177027 - RNA, 32 nt, Human
gcggguucugcacucaugagguuuuggcagua

SEQ ID NO: 177028 - RNA, 32 nt, Human
gcggguugauuuucucacuuuggacugguuuu

SEQ ID NO: 177029 - RNA, 32 nt, Human
gcggguuuguuuuggaaagggcugcuauuguc

SEQ ID NO: 177030 - RNA, 32 nt, Human
gcgguaaaaccucuaccaccccaaaccugguc

SEQ ID NO: 177031 - RNA, 32 nt, Human
gcgguaaagaggaggccugaggagcugggcgg

SEQ ID NO: 177032 - RNA, 32 nt, Human
gcgguaccuuuccuacugucuuuucuuugacu

SEQ ID NO: 177033 - RNA, 32 nt, Human
gcgguacucacguggcggaagggaaacugcau

SEQ ID NO: 177034 - RNA, 19 nt, Human
gcgguacuucucugcaucu

SEQ ID NO: 177035 - RNA, 32 nt, Human
gcgguacuuggacagcgguucuugagcucucg

SEQ ID NO: 177036 - RNA, 32 nt, Human
gcgguacuuucucuugguuuccgccuuccagg

SEQ ID NO: 177037 - RNA, 32 nt, Human
gcgguagcagcggucgaaggggaccaagcucc

SEQ ID NO: 177038 - RNA, 31 nt, Human
gcgguagcuacuuguuuacaugcagauuuuu

SEQ ID NO: 177039 - RNA, 22 nt, Human
gcgguagcucacgccuguaauc

SEQ ID NO: 177040 - RNA, 32 nt, Human
gcgguaggaagggagagggggagcuguuuguc

SEQ ID NO: 177041 - RNA, 32 nt, Human
gcgguaggcagcagcaggcugaagggaucaug

SEQ ID NO: 177042 - RNA, 21 nt, Human
gcgguaggcucugucugcgug

SEQ ID NO: 177043 - RNA, 32 nt, Human
gcgguagguagaauaaugcccccaggccccag

SEQ ID NO: 177044 - RNA, 21 nt, Human
gcgguagucacgccuguaauc

SEQ ID NO: 177045 - RNA, 19 nt, Human
gcggucaccgccgccgugg

SEQ ID NO: 177046 - RNA, 32 nt, Human
gcggucacucaggccucugcagaagccaaggg

SEQ ID NO: 177047 - RNA, 32 nt, Human
gcggucaguggaggcccuuccacccucgccgc

SEQ ID NO: 177048 - RNA, 32 nt, Human
gcggucaugccacugcacuccagccuggguga

SEQ ID NO: 177049 - RNA, 32 nt, Human
gcgguccagaagcuugcggugagugugugcca

SEQ ID NO: 177050 - RNA, 32 nt, Human
gcgguccaggagaaucaggcagucuguggccu

SEQ ID NO: 177051 - RNA, 32 nt, Human
gcgguccccagcugccagggugcuuggggagg

SEQ ID NO: 177052 - RNA, 23 nt, Human
gcgguccccgcgcacagcgcccg

SEQ ID NO: 177053 - RNA, 32 nt, Human
gcgguccccuuugccgggauguuuccauugcu

SEQ ID NO: 177054 - RNA, 21 nt, Human
gcggucccgcgcacugagccc

SEQ ID NO: 177055 - RNA, 32 nt, Human
gcggucccggcccagccggcucuccuggccuc

SEQ ID NO: 177056 - RNA, 32 nt, Human
gcggucccuccagaggauuugagggacagggu

SEQ ID NO: 177057 - RNA, 32 nt, Human
gcggucccucccccucacguucucucuuccuc

SEQ ID NO: 177058 - RNA, 32 nt, Human
gcgguccgaacgugcccccaccccugaccuca

SEQ ID NO: 177059 - RNA, 32 nt, Human
gcgguccgcgagccaccgaggcccagcucagu

SEQ ID NO: 177060 - RNA, 32 nt, Human
gcgguccgcggcggagguucaugugggggugc

SEQ ID NO: 177061 - RNA, 32 nt, Human
gcgguccugcagcagccaucuuggcugccaac

SEQ ID NO: 177062 - RNA, 32 nt, Human
gcgguccuggcaggaaggccggccagugugca

SEQ ID NO: 177063 - RNA, 32 nt, Human
gcggucgcaccucuucuguccaggccucggcc

SEQ ID NO: 177064 - RNA, 32 nt, Human
gcggucgccgccuugcagacccucucucgagg

SEQ ID NO: 177065 - RNA, 32 nt, Human
gcggucggagcggggugacgaggaccucaugc

SEQ ID NO: 177066 - RNA, 32 nt, Human
gcggucgggugaggcgggacggaguuggggcc

SEQ ID NO: 177067 - RNA, 32 nt, Human
gcggucggugggcuccggcgggcucagcgguc

SEQ ID NO: 177068 - RNA, 21 nt, Human
gcggucgucacgccuguaauc

SEQ ID NO: 177069 - RNA, 32 nt, Human
gcggucuagaggagucccaggagcagccagga

SEQ ID NO: 177070 - RNA, 32 nt, Human
gcggucuagcgggcuguuaggcucccucgccc

SEQ ID NO: 177071 - RNA, 19 nt, Human
gcggucuccccagccugcc

SEQ ID NO: 177072 - RNA, 32 nt, Human
gcggucuccuaccugcggaugcagcagaagcu

SEQ ID NO: 177073 - RNA, 32 nt, Human
gcggucucuccuccccuuucccuccaggccca

SEQ ID NO: 177074 - RNA, 32 nt, Human
gcggucucuccuccuuucagccuccucuuucc

SEQ ID NO: 177075 - RNA, 32 nt, Human
gcggucucuggccagcacgcuggacugcgaga

SEQ ID NO: 177076 - RNA, 32 nt, Human
gcggucugcccuuuugaagcaggacuggcuca

SEQ ID NO: 177077 - RNA, 32 nt, Human
gcggucuucccgcauccucuucugccgucucc

SEQ ID NO: 177078 - RNA, 32 nt, Human
gcggucuugccuucccccuccccacaggcucu

SEQ ID NO: 177079 - RNA, 32 nt, Human
gcggugaagguccugggugagguaggggugga

SEQ ID NO: 177080 - RNA, 19 nt, Human
gcggugacaccugcucccc

SEQ ID NO: 177081 - RNA, 32 nt, Human
gcggugaccagcuguggucaggagagccucag

SEQ ID NO: 177082 - RNA, 32 nt, Human
gcggugacccuugagccggucuugccccucag

SEQ ID NO: 177083 - RNA, 16 nt, Human
gcggugaccucucgaa

SEQ ID NO: 177084 - RNA, 22 nt, Human
gcggugacucacaccuguaauc

SEQ ID NO: 177085 - RNA, 22 nt, Human
gcggugacucacgccuauaauc

SEQ ID NO: 177086 - RNA, 22 nt, Human
gcggugacucaugccuguaauc

SEQ ID NO: 177087 - RNA, 22 nt, Human
gcggugacucgcaccuguaauc

SEQ ID NO: 177088 - RNA, 32 nt, Human
gcggugacugcacuuucccuggaguggaagcu

SEQ ID NO: 177089 - RNA, 32 nt, Human
gcggugagcauuccgggaaccaucucugggcu

SEQ ID NO: 177090 - RNA, 32 nt, Human
gcggugaggccuggucuccggcugccagacca

SEQ ID NO: 177091 - RNA, 22 nt, Human
gcggugauucacgccuguaauc

SEQ ID NO: 177092 - RNA, 32 nt, Human
gcggugauugugccacugcacuccagccuggg

SEQ ID NO: 177093 - RNA, 32 nt, Human
gcggugcaaugcagcacccacccugcgagccu

SEQ ID NO: 177094 - RNA, 32 nt, Human
gcggugcagauuggaggggugacauuggaagc

SEQ ID NO: 177095 - RNA, 32 nt, Human
gcggugccaggcccagugucccccaggccguc

SEQ ID NO: 177096 - RNA, 19 nt, Human
gcggugcccaccagcuucc

SEQ ID NO: 177097 - RNA, 32 nt, Human
gcggugcccgcuauuucuaccucuuguccaaa

SEQ ID NO: 177098 - RNA, 32 nt, Human
gcggugcccgcuggcccgggguugagacaggc

SEQ ID NO: 177099 - RNA, 32 nt, Human
gcggugccuccuccuccucgccccggcgccgg

SEQ ID NO: 177100 - RNA, 32 nt, Human
gcggugcgacaguccucuucucaggcccucug

SEQ ID NO: 177101 - RNA, 32 nt, Human
gcggugcgacgaaggaguagguggugggaucu

SEQ ID NO: 177102 - RNA, 32 nt, Human
gcggugcgacggggaagcaggagguguggggu

SEQ ID NO: 177103 - RNA, 20 nt, Human
gcggugcgaggggccgagcc

SEQ ID NO: 177104 - RNA, 32 nt, Human
gcggugcgcccacagcugccuggguaaggccc

SEQ ID NO: 177105 - RNA, 32 nt, Human
gcggugcgccugggaggaagggggaggucgga

SEQ ID NO: 177106 - RNA, 32 nt, Human
gcggugcgcugcaggccaucugccggcgcccu

SEQ ID NO: 177107 - RNA, 32 nt, Human
gcggugcggcuguuucacaacacuccuggcca

SEQ ID NO: 177108 - RNA, 20 nt, Human
gcggugcgggcgcgcguggg

SEQ ID NO: 177109 - RNA, 21 nt, Human
gcggugcucacgccuguaauc

SEQ ID NO: 177110 - RNA, 32 nt, Human
gcggugcugcaggaccuggccugguggcauag

SEQ ID NO: 177111 - RNA, 32 nt, Human
gcggugcugccuccacccuccugagccuggag

SEQ ID NO: 177112 - RNA, 32 nt, Human
gcgguggaaguuaagggagucaggggcuaucg

SEQ ID NO: 177113 - RNA, 32 nt, Human
gcgguggagaaaaggcagaaccagaguagaga

SEQ ID NO: 177114 - RNA, 32 nt, Human
gcgguggagaaacugaggcucuccuccagcug

SEQ ID NO: 177115 - RNA, 32 nt, Human
gcgguggagccgcacagcccacccgcaccaaa

SEQ ID NO: 177116 - RNA, 32 nt, Human
gcgguggaggcugagucgcaggacacaugccg

SEQ ID NO: 177117 - RNA, 32 nt, Human
gcgguggaggcuggcgcuaggcggccucagcc

SEQ ID NO: 177118 - RNA, 22 nt, Human
gcgguggaucacgccuguaauc

SEQ ID NO: 177119 - RNA, 32 nt, Human
gcgguggaugccugacuggaagcccgaguggg

SEQ ID NO: 177120 - RNA, 32 nt, Human
gcgguggcaagguuugguuuggugaaaacgaa

SEQ ID NO: 177121 - RNA, 22 nt, Human
gcgguggcacacaccuauaauc

SEQ ID NO: 177122 - RNA, 32 nt, Human
gcgguggcagcagagguggcaggggcggggcg

SEQ ID NO: 177123 - RNA, 22 nt, Human
gcgguggcccacaucuguaauc

SEQ ID NO: 177124 - RNA, 19 nt, Human
gcgguggcggcggcagcgc

SEQ ID NO: 177125 - RNA, 32 nt, Human
gcgguggcgggcggaggcggcgggcgagggcg

SEQ ID NO: 177126 - RNA, 32 nt, Human
gcgguggcgguggcugggcagggcugggcagg

SEQ ID NO: 177127 - RNA, 32 nt, Human
gcgguggcuauaauccuagcacuuugggaggc

SEQ ID NO: 177128 - RNA, 22 nt, Human
gcgguggcucaagcccauaauc

SEQ ID NO: 177129 - RNA, 22 nt, Human
gcgguggcucaagccuguaauc

SEQ ID NO: 177130 - RNA, 22 nt, Human
gcgguggcucacacccguaauc

SEQ ID NO: 177131 - RNA, 22 nt, Human
gcgguggcucacaccuauaauc

SEQ ID NO: 177132 - RNA, 22 nt, Human
gcgguggcucacaccuguaauc

SEQ ID NO: 177133 - RNA, 32 nt, Human
gcgguggcucacaccuguaauuccagcacuuu

SEQ ID NO: 177134 - RNA, 22 nt, Human
gcgguggcucacaccugucauc

SEQ ID NO: 177135 - RNA, 32 nt, Human
gcgguggcucacaccugucaucccagcacuuu

SEQ ID NO: 177136 - RNA, 32 nt, Human
gcgguggcucacaccugucaucccagcaguuu

SEQ ID NO: 177137 - RNA, 22 nt, Human
gcgguggcucacaccugugauc

SEQ ID NO: 177138 - RNA, 21 nt, Human
gcgguggcucacaccuuaauc

SEQ ID NO: 177139 - RNA, 22 nt, Human
gcgguggcucacacuuguaauc

SEQ ID NO: 177140 - RNA, 22 nt, Human
gcgguggcucacaucuguaauc

SEQ ID NO: 177141 - RNA, 22 nt, Human
gcgguggcucaccccuguaauc

SEQ ID NO: 177142 - RNA, 22 nt, Human
gcgguggcucacgccuauaauc

SEQ ID NO: 177143 - RNA, 22 nt, Human
gcgguggcucacgccugcaauc

SEQ ID NO: 177144 - RNA, 22 nt, Human
gcgguggcucacgccugcaguc

SEQ ID NO: 177145 - RNA, 22 nt, Human
gcgguggcucacgccuggaauc

SEQ ID NO: 177146 - RNA, 20 nt, Human
gcgguggcucacgccuguaa

SEQ ID NO: 177147 - RNA, 22 nt, Human
gcgguggcucacgccuguaauc

SEQ ID NO: 177148 - RNA, 32 nt, Human
gcgguggcucacgccuguaauccuagcauuuu

SEQ ID NO: 177149 - RNA, 22 nt, Human
gcgguggcucacgccuguaauu

SEQ ID NO: 177150 - RNA, 22 nt, Human
gcgguggcucacgccuguaguc

SEQ ID NO: 177151 - RNA, 22 nt, Human
gcgguggcucacgucuauaauc

SEQ ID NO: 177152 - RNA, 22 nt, Human
gcgguggcucacgucuguaauc

SEQ ID NO: 177153 - RNA, 22 nt, Human
gcgguggcucacuccuguaauc

SEQ ID NO: 177154 - RNA, 22 nt, Human
gcgguggcucaggccuguaauc

SEQ ID NO: 177155 - RNA, 22 nt, Human
gcgguggcucauaccuauaauc

SEQ ID NO: 177156 - RNA, 22 nt, Human
gcgguggcucauaccuguaauc

SEQ ID NO: 177157 - RNA, 21 nt, Human
gcgguggcucaugccugaauc

SEQ ID NO: 177158 - RNA, 20 nt, Human
gcgguggcucaugccuguaa

SEQ ID NO: 177159 - RNA, 22 nt, Human
gcgguggcucaugccuguaauc

SEQ ID NO: 177160 - RNA, 32 nt, Human
gcgguggcucaugccuguaaucccagcauuuu

SEQ ID NO: 177161 - RNA, 32 nt, Human
gcgguggcucaugccuguaauccuagcauuuu

SEQ ID NO: 177162 - RNA, 22 nt, Human
gcgguggcucaugccuguaauu

SEQ ID NO: 177163 - RNA, 22 nt, Human
gcgguggcugaugccuguaauc

SEQ ID NO: 177164 - RNA, 23 nt, Human
gcgguggcuguccgguuucugcg

SEQ ID NO: 177165 - RNA, 22 nt, Human
gcgguggcuuacaccuguaauc

SEQ ID NO: 177166 - RNA, 32 nt, Human
gcgguggcuuacaccuguaauuccagcacuuu

SEQ ID NO: 177167 - RNA, 22 nt, Human
gcgguggcuuacgccuauaauc

SEQ ID NO: 177168 - RNA, 22 nt, Human
gcgguggcuuacgccuguaauc

SEQ ID NO: 177169 - RNA, 22 nt, Human
gcgguggcuuaugccuguaauc

SEQ ID NO: 177170 - RNA, 32 nt, Human
gcggugggaaaaguugggggagcgcggaggug

SEQ ID NO: 177171 - RNA, 32 nt, Human
gcggugggauuccagcugucugauuaaugaga

SEQ ID NO: 177172 - RNA, 32 nt, Human
gcgguggggagguggcugcgcgguggggaggu

SEQ ID NO: 177173 - RNA, 32 nt, Human
gcgguggggcaguggagguugaggagaaugua

SEQ ID NO: 177174 - RNA, 32 nt, Human
gcgguggggcugccuguccucgggcuacagga

SEQ ID NO: 177175 - RNA, 32 nt, Human
gcgguggggcugggggauuccuuaagugacuu

SEQ ID NO: 177176 - RNA, 32 nt, Human
gcggugggucuccaccacagccacuuugaguc

SEQ ID NO: 177177 - RNA, 32 nt, Human
gcggugggucugcaccuggauuuuggaguccc

SEQ ID NO: 177178 - RNA, 32 nt, Human
gcgguggguugcccaauaaacggcuguggagu

SEQ ID NO: 177179 - RNA, 31 nt, Human
gcggugguagagagagauaaaagguggaguu

SEQ ID NO: 177180 - RNA, 32 nt, Human
gcgguggucuccauucagcaaaaucucaugua

SEQ ID NO: 177181 - RNA, 32 nt, Human
gcgguggugcaaucucagcucacugcaaccuc

SEQ ID NO: 177182 - RNA, 32 nt, Human
gcggugguggaggaggcaaaggccuuggacga

SEQ ID NO: 177183 - RNA, 32 nt, Human
gcggugguggugagccaacacgcccagcacca

SEQ ID NO: 177184 - RNA, 22 nt, Human
gcggugguucacaccuguaauc

SEQ ID NO: 177185 - RNA, 22 nt, Human
gcggugguucacgccuguaauc

SEQ ID NO: 177186 - RNA, 22 nt, Human
gcggugguucaugccuauaauc

SEQ ID NO: 177187 - RNA, 22 nt, Human
gcggugguucaugccuguaauc

SEQ ID NO: 177188 - RNA, 32 nt, Human
gcggugguucccaggcccgcccccucucgcag

SEQ ID NO: 177189 - RNA, 32 nt, Human
gcgguguaaaauguuuacugugguguacacug

SEQ ID NO: 177190 - RNA, 32 nt, Human
gcgguguccucggggugcgagcugcacgugga

SEQ ID NO: 177191 - RNA, 22 nt, Human
gcggugucucacaccuguaauc

SEQ ID NO: 177192 - RNA, 32 nt, Human
gcggugucuggugcgucagccugcugcuucgu

SEQ ID NO: 177193 - RNA, 32 nt, Human
gcggugugagagggagggcacacguuguacgu

SEQ ID NO: 177194 - RNA, 32 nt, Human
gcgguguggagcggagagaauacucgaagggc

SEQ ID NO: 177195 - RNA, 32 nt, Human
gcgguguuucugagaggaaugcgcagcugaag

SEQ ID NO: 177196 - RNA, 32 nt, Human
gcgguuccagcagcagcaguagcuauggcagu

SEQ ID NO: 177197 - RNA, 32 nt, Human
gcgguuccgccuguaaucccagcacuuuggga

SEQ ID NO: 177198 - RNA, 32 nt, Human
gcgguuccuccaccgccuccgccgccgcaucc

SEQ ID NO: 177199 - RNA, 32 nt, Human
gcgguuccuccuggccccaaggcaccgcugca

SEQ ID NO: 177200 - RNA, 32 nt, Human
gcgguuccuccuggcccuguuaaugucggggc

SEQ ID NO: 177201 - RNA, 32 nt, Human
gcgguuccuggacuaguccggcucguucaaga

SEQ ID NO: 177202 - RNA, 21 nt, Human
gcgguuccugugcagaugcug

SEQ ID NO: 177203 - RNA, 32 nt, Human
gcgguucuacugccucagccuccugaguagcu

SEQ ID NO: 177204 - RNA, 32 nt, Human
gcgguugaaggguggggaauacgacuaaaaac

SEQ ID NO: 177205 - RNA, 32 nt, Human
gcgguugaauugccauggcaaugcggugggcg

SEQ ID NO: 177206 - RNA, 32 nt, Human
gcgguugcagugagcacagaucaugccacugc

SEQ ID NO: 177207 - RNA, 32 nt, Human
gcgguugcagugagccaagaucgccccacugc

SEQ ID NO: 177208 - RNA, 22 nt, Human
gcgguugcucacgccuguaauc

SEQ ID NO: 177209 - RNA, 32 nt, Human
gcgguugcucucugucaccgcuggcagucugc

SEQ ID NO: 177210 - RNA, 32 nt, Human
gcgguuggagcggcugucgccauguugucggu

SEQ ID NO: 177211 - RNA, 32 nt, Human
gcgguugggaccgcggcugagcuuuuuccggg

SEQ ID NO: 177212 - RNA, 32 nt, Human
gcgguugggagcggguucuggagcucacgccu

SEQ ID NO: 177213 - RNA, 32 nt, Human
gcgguuguggugagcugugauugugccauugc

SEQ ID NO: 177214 - RNA, 32 nt, Human
gcgguuuccgggagucaaggacagguugaugu

SEQ ID NO: 177215 - RNA, 32 nt, Human
gcgguuuccuugcccggggccgcgggaaggcc

SEQ ID NO: 177216 - RNA, 32 nt, Human
gcgguuucuccucucugaaacggggaugcuga

SEQ ID NO: 177217 - RNA, 32 nt, Human
gcgguuucuuucuuuccgcgccgauagcgcuc

SEQ ID NO: 177218 - RNA, 32 nt, Human
gcgguuugccugugccuggacaaugaggcgga

SEQ ID NO: 177219 - RNA, 32 nt, Human
gcguaaaagccagggagagauccagagaguuu

SEQ ID NO: 177220 - RNA, 32 nt, Human
gcguaaggacgaacuccuccagcaagcucgca

SEQ ID NO: 177221 - RNA, 22 nt, Human
gcguaauagugacuggcugggg

SEQ ID NO: 177222 - RNA, 32 nt, Human
gcguaaugcucagcuuuuuguaaagaaauauu

SEQ ID NO: 177223 - RNA, 32 nt, Human
gcguacaaacgcuguagacaccuucaccucca

SEQ ID NO: 177224 - RNA, 32 nt, Human
gcguacacugacuuuggggccuggguguuggg

SEQ ID NO: 177225 - RNA, 32 nt, Human
gcguacacuugcauccugaaguggguucggga

SEQ ID NO: 177226 - RNA, 32 nt, Human
gcguaccacacuccagccugggugacagagcg

SEQ ID NO: 177227 - RNA, 32 nt, Human
gcguaccacgccugguucuguacauguggaaa

SEQ ID NO: 177228 - RNA, 32 nt, Human
gcguaccgguagucccagcuacucaggaggcu

SEQ ID NO: 177229 - RNA, 32 nt, Human
gcguacgcugguuggcauuugcucugagcauc

SEQ ID NO: 177230 - RNA, 32 nt, Human
gcguagaaaccucaaaugaaaaaccuaacauc

SEQ ID NO: 177231 - RNA, 32 nt, Human
gcguagacuugagcuagacuacccagguugaa

SEQ ID NO: 177232 - RNA, 32 nt, Human
gcguagcaggagcaugcgcuuccuuccucacu

SEQ ID NO: 177233 - RNA, 32 nt, Human
gcguagcgugugccaccaugccuggcuaauuu

SEQ ID NO: 177234 - RNA, 32 nt, Human
gcguagcugaggaaggggaagagaaguccagc

SEQ ID NO: 177235 - RNA, 32 nt, Human
gcguagcuggacugggcucuugggccagccag

SEQ ID NO: 177236 - RNA, 32 nt, Human
gcguaggacuuagggguuauaagcccagaucc

SEQ ID NO: 177237 - RNA, 22 nt, Human
gcguaggagagggagaugaucc

SEQ ID NO: 177238 - RNA, 32 nt, Human
gcguaggcuaucucccaucuucccacucaagu

SEQ ID NO: 177239 - RNA, 32 nt, Human
gcguaggugugggcguggcaagguuccuggaa

SEQ ID NO: 177240 - RNA, 32 nt, Human
gcguagugcgcuccccgcccagccugcagagc

SEQ ID NO: 177241 - RNA, 32 nt, Human
gcguaguggagacccacggcaggccugaagaa

SEQ ID NO: 177242 - RNA, 24 nt, Human
gcguaguggcucacaccuguaauc

SEQ ID NO: 177243 - RNA, 32 nt, Human
gcguauacauuuguuuugggauuuuugugugu

SEQ ID NO: 177244 - RNA, 32 nt, Human
gcguauacugauuccuccaacucuccacccca

SEQ ID NO: 177245 - RNA, 32 nt, Human
gcguauauguacaaauguacaauuuuuacaug

SEQ ID NO: 177246 - RNA, 20 nt, Human
gcguaucaccugaggucagg

SEQ ID NO: 177247 - RNA, 32 nt, Human
gcguauccaagaggauggacuuagugaugggg

SEQ ID NO: 177248 - RNA, 32 nt, Human
gcguaucgagucuccgcccccuucccgccucc

SEQ ID NO: 177249 - RNA, 32 nt, Human
gcguaucugaaccaucaucccugcucucaucu

SEQ ID NO: 177250 - RNA, 32 nt, Human
gcguaugacauggugaauaaacacaacucucu

SEQ ID NO: 177251 - RNA, 32 nt, Human
gcguaugcaguuaagagcaagugccuuggccg

SEQ ID NO: 177252 - RNA, 32 nt, Human
gcguaugccuguaaucccagcuacuuaggagg

SEQ ID NO: 177253 - RNA, 32 nt, Human
gcguauguauuagccggcagccuguugguucc

SEQ ID NO: 177254 - RNA, 32 nt, Human
gcguauguuuguguccuucauuaggaacauug

SEQ ID NO: 177255 - RNA, 32 nt, Human
gcguauuauaccaaaauguugcugaaaaaugg

SEQ ID NO: 177256 - RNA, 32 nt, Human
gcguauuucugaguuaugccuguauuuaagaa

SEQ ID NO: 177257 - RNA, 32 nt, Human
gcgucaacgcaaccucagcgucugccggaacc

SEQ ID NO: 177258 - RNA, 21 nt, Human
gcgucaagacugcccuuggca

SEQ ID NO: 177259 - RNA, 32 nt, Human
gcgucacaagcugugcagcuguguaggccucu

SEQ ID NO: 177260 - RNA, 32 nt, Human
gcgucacaccuauaaucccagcacuuugggag

SEQ ID NO: 177261 - RNA, 32 nt, Human
gcgucacagcacaaccugcaaaaacggagcug

SEQ ID NO: 177262 - RNA, 32 nt, Human
gcgucacauaagccagcccacaggguccugca

SEQ ID NO: 177263 - RNA, 32 nt, Human
gcgucaccaaaaacagacaggaucagugauca

SEQ ID NO: 177264 - RNA, 32 nt, Human
gcgucacccugacucugcucagagccagcauu

SEQ ID NO: 177265 - RNA, 22 nt, Human
gcgucaccgucacauucaacca

SEQ ID NO: 177266 - RNA, 20 nt, Human
gcgucaccuagacgucagcc

SEQ ID NO: 177267 - RNA, 32 nt, Human
gcgucaccuccucccaggcuccugggaagcac

SEQ ID NO: 177268 - RNA, 31 nt, Human
gcgucaccugucucuuacccugugucuccac

SEQ ID NO: 177269 - RNA, 32 nt, Human
gcgucacgccuguaaucccagcacuuugggag

SEQ ID NO: 177270 - RNA, 32 nt, Human
gcgucacggguggggcugcagcuucuggaccu

SEQ ID NO: 177271 - RNA, 32 nt, Human
gcgucacuccagugcucagcuguggcuggagg

SEQ ID NO: 177272 - RNA, 32 nt, Human
gcgucacugcacccuccgccaggcuccgcggg

SEQ ID NO: 177273 - RNA, 32 nt, Human
gcgucacugcacuccaaccugggugacagagc

SEQ ID NO: 177274 - RNA, 32 nt, Human
gcgucacugcacuccagccugagcaacagagu

SEQ ID NO: 177275 - RNA, 32 nt, Human
gcgucacugcacuccagccugagugacagagc

SEQ ID NO: 177276 - RNA, 32 nt, Human
gcgucacugcacuccagccuggacaacagagc

SEQ ID NO: 177277 - RNA, 32 nt, Human
gcgucacugcacuccagccugggagacagagu

SEQ ID NO: 177278 - RNA, 32 nt, Human
gcgucacugcacuccagccugggcgacagagu

SEQ ID NO: 177279 - RNA, 32 nt, Human
gcgucacugcacuccagcgugggcgacagagc

SEQ ID NO: 177280 - RNA, 32 nt, Human
gcgucacugcacuccagucuagcaacagagcg

SEQ ID NO: 177281 - RNA, 32 nt, Human
gcgucacugcacugcagccugggugacagaau

SEQ ID NO: 177282 - RNA, 32 nt, Human
gcgucacugcagccuccaccucccgggcucca

SEQ ID NO: 177283 - RNA, 32 nt, Human
gcgucacuguauguaguucauggcuacuguac

SEQ ID NO: 177284 - RNA, 24 nt, Human
gcgucacuuaauccaaaucaacca

SEQ ID NO: 177285 - RNA, 32 nt, Human
gcgucagagggaagggaacacaucccagccac

SEQ ID NO: 177286 - RNA, 32 nt, Human
gcgucagcugggauauaugggggcagggaguc

SEQ ID NO: 177287 - RNA, 32 nt, Human
gcgucaggccuucuggggaaaguuuccucauu

SEQ ID NO: 177288 - RNA, 18 nt, Human
gcgucaggcugggggcag

SEQ ID NO: 177289 - RNA, 32 nt, Human
gcgucaguacacuccagccugggcaacaaugc

SEQ ID NO: 177290 - RNA, 32 nt, Human
gcgucagugucgcgcuggagcuggcagaggug

SEQ ID NO: 177291 - RNA, 32 nt, Human
gcgucaguguucuccagccugggcaacagagu

SEQ ID NO: 177292 - RNA, 32 nt, Human
gcgucauauuuuaugaccccuacuugcaggau

SEQ ID NO: 177293 - RNA, 32 nt, Human
gcgucauccugcgagucccucugacgggaggg

SEQ ID NO: 177294 - RNA, 32 nt, Human
gcgucaucuccccagccugcuguucccgcuuu

SEQ ID NO: 177295 - RNA, 21 nt, Human
gcgucaucugcaaagcagcca

SEQ ID NO: 177296 - RNA, 32 nt, Human
gcgucaugccagaaugcacagggcagcccagg

SEQ ID NO: 177297 - RNA, 32 nt, Human
gcgucauggcgcuccuccgcagccugggguac

SEQ ID NO: 177298 - RNA, 24 nt, Human
gcgucauggcucacaccuguaauc

SEQ ID NO: 177299 - RNA, 32 nt, Human
gcgucaugucaccccuuccuuuacagguccug

SEQ ID NO: 177300 - RNA, 32 nt, Human
gcgucauugcacuccagccugggcaacaagag

SEQ ID NO: 177301 - RNA, 20 nt, Human
gcgucauuuguucccugcca

SEQ ID NO: 177302 - RNA, 32 nt, Human
gcguccacaauguuuaaaauauuucauaggcg

SEQ ID NO: 177303 - RNA, 32 nt, Human
gcguccacacccagacggguccaguccagccc

SEQ ID NO: 177304 - RNA, 32 nt, Human
gcguccaccacaaccucugcuguaucagaggg

SEQ ID NO: 177305 - RNA, 32 nt, Human
gcguccacgccgcucacuccagccgaggcccc

SEQ ID NO: 177306 - RNA, 32 nt, Human
gcguccagaacugccgccaccuucccugcccc

SEQ ID NO: 177307 - RNA, 32 nt, Human
gcguccagccccaggcccuggagcuugucguu

SEQ ID NO: 177308 - RNA, 32 nt, Human
gcguccagccuagagcccccggugggagccag

SEQ ID NO: 177309 - RNA, 32 nt, Human
gcguccagcugggggaugccugccuggauauc

SEQ ID NO: 177310 - RNA, 32 nt, Human
gcguccaugcuguagcuuccuaccucagucca

SEQ ID NO: 177311 - RNA, 32 nt, Human
gcguccauuccucuggagucucuccuuguuug

SEQ ID NO: 177312 - RNA, 32 nt, Human
gcgucccacgucuccuccucgaagccaugugc

SEQ ID NO: 177313 - RNA, 32 nt, Human
gcgucccacuggcucugaucuugcuuccugcu

SEQ ID NO: 177314 - RNA, 32 nt, Human
gcgucccagccccagccagggggccggccuug

SEQ ID NO: 177315 - RNA, 32 nt, Human
gcgucccagccccuccagcagcacagcauguc

SEQ ID NO: 177316 - RNA, 32 nt, Human
gcgucccaggaggcaggcaguggcuaugacag

SEQ ID NO: 177317 - RNA, 32 nt, Human
gcgucccaggccuccuucccucccucugccac

SEQ ID NO: 177318 - RNA, 32 nt, Human
gcgucccauuuucuccccuggccucuuacuug

SEQ ID NO: 177319 - RNA, 32 nt, Human
gcguccccagaacccaagggaacgucauggag

SEQ ID NO: 177320 - RNA, 32 nt, Human
gcguccccaucuccacagaggcaggguggcug

SEQ ID NO: 177321 - RNA, 32 nt, Human
gcgucccccacccccgucgugguguagucaua

SEQ ID NO: 177322 - RNA, 32 nt, Human
gcgucccccucacccgcugauguggccuacga

SEQ ID NO: 177323 - RNA, 32 nt, Human
gcgucccccugccggccggggcugagacuccg

SEQ ID NO: 177324 - RNA, 19 nt, Human
gcguccccgaagcucuccc

SEQ ID NO: 177325 - RNA, 32 nt, Human
gcguccccugcagcagaugcugucucagucau

SEQ ID NO: 177326 - RNA, 32 nt, Human
gcguccccugcuugaguuuugcacuuggaaga

SEQ ID NO: 177327 - RNA, 32 nt, Human
gcgucccgagagccccagaagucggcggggaa

SEQ ID NO: 177328 - RNA, 32 nt, Human
gcgucccgcacugggguguccucgcugucugg

SEQ ID NO: 177329 - RNA, 32 nt, Human
gcgucccggcugaguccucuugcacaugggag

SEQ ID NO: 177330 - RNA, 32 nt, Human
gcgucccuccagaagcugugugcucaauggaa

SEQ ID NO: 177331 - RNA, 32 nt, Human
gcgucccuccaggccuugccuccugcgggagg

SEQ ID NO: 177332 - RNA, 32 nt, Human
gcgucccugcagcagccacucugcuuuccagg

SEQ ID NO: 177333 - RNA, 32 nt, Human
gcgucccugcugcagcaaccggagcuggaguc

SEQ ID NO: 177334 - RNA, 32 nt, Human
gcgucccuuugguuuggcccagaggggcgaac

SEQ ID NO: 177335 - RNA, 32 nt, Human
gcguccgagggugggagucgggguguggcagg

SEQ ID NO: 177336 - RNA, 23 nt, Human
gcguccgggaggccgggccccgg

SEQ ID NO: 177337 - RNA, 32 nt, Human
gcguccgggggaggggaaggaagggccgcugu

SEQ ID NO: 177338 - RNA, 32 nt, Human
gcguccggucagggaagcgugcagcccaaaug

SEQ ID NO: 177339 - RNA, 32 nt, Human
gcguccguguguggucugucaccacggggccu

SEQ ID NO: 177340 - RNA, 32 nt, Human
gcguccuaagagagucucacucugucucccag

SEQ ID NO: 177341 - RNA, 32 nt, Human
gcguccucauuuccccucccaauccucucucc

SEQ ID NO: 177342 - RNA, 32 nt, Human
gcguccuccagccccgggcggccggcggcugu

SEQ ID NO: 177343 - RNA, 32 nt, Human
gcguccucccaaagugcugggauuacaggccu

SEQ ID NO: 177344 - RNA, 32 nt, Human
gcguccucuucccaccagcgugggauucgguu

SEQ ID NO: 177345 - RNA, 32 nt, Human
gcguccugagcaggagaccugaguggcgggga

SEQ ID NO: 177346 - RNA, 32 nt, Human
gcguccugaguagcuggggauuacaggcgccc

SEQ ID NO: 177347 - RNA, 32 nt, Human
gcguccugagucuuuggcagccuggucccucu

SEQ ID NO: 177348 - RNA, 32 nt, Human
gcguccugaugcccccaagcucccucuccuga

SEQ ID NO: 177349 - RNA, 32 nt, Human
gcguccugccugacaaacugaaggugagcugg

SEQ ID NO: 177350 - RNA, 32 nt, Human
gcguccugcugagcucuguucucuccagcacc

SEQ ID NO: 177351 - RNA, 32 nt, Human
gcguccuggagcugcuccugcccauccgcuac

SEQ ID NO: 177352 - RNA, 32 nt, Human
gcguccuggggucugggaggaaggcagacaga

SEQ ID NO: 177353 - RNA, 32 nt, Human
gcguccuguccaccaugcccucagacucagaa

SEQ ID NO: 177354 - RNA, 32 nt, Human
gcguccuuccccagggcaggagagaggagaug

SEQ ID NO: 177355 - RNA, 32 nt, Human
gcgucgcccgggaucuggguuuuggaagaagg

SEQ ID NO: 177356 - RNA, 19 nt, Human
gcgucgccgccgccgccgc

SEQ ID NO: 177357 - RNA, 32 nt, Human
gcgucgcugcaggagcuccaggggcagcacaa

SEQ ID NO: 177358 - RNA, 32 nt, Human
gcgucgcuggacuccagcccgggcgacagagu

SEQ ID NO: 177359 - RNA, 32 nt, Human
gcgucggagauggaguuaggagagggcgccaa

SEQ ID NO: 177360 - RNA, 32 nt, Human
gcgucggcaccugaacgcgaggcgcuccauug

SEQ ID NO: 177361 - RNA, 32 nt, Human
gcgucggcagcagaggaugccccaggcccugg

SEQ ID NO: 177362 - RNA, 32 nt, Human
gcgucgggagagagcgcggagguagcgggcgc

SEQ ID NO: 177363 - RNA, 32 nt, Human
gcgucggugaagcaagagcucagaggggagag

SEQ ID NO: 177364 - RNA, 32 nt, Human
gcgucguccauccucagugagaacaccagaga

SEQ ID NO: 177365 - RNA, 24 nt, Human
gcgucgugcgcccgcaacagagcc

SEQ ID NO: 177366 - RNA, 32 nt, Human
gcgucgugggugggggacgcugucuuucacgg

SEQ ID NO: 177367 - RNA, 32 nt, Human
gcgucuaagaugagggggccaggcgguggcuu

SEQ ID NO: 177368 - RNA, 32 nt, Human
gcgucuacaggcccgucuccugccucacaaca

SEQ ID NO: 177369 - RNA, 32 nt, Human
gcgucuacaggcccgucuccugccucacaacc

SEQ ID NO: 177370 - RNA, 32 nt, Human
gcgucuacccacccucccuucuagcagauucu

SEQ ID NO: 177371 - RNA, 32 nt, Human
gcgucuagguuuuccuugucccuuccuggggc

SEQ ID NO: 177372 - RNA, 32 nt, Human
gcgucuaugcgggccugcagacugccuccgug

SEQ ID NO: 177373 - RNA, 32 nt, Human
gcgucuccaacagggcaggagugaguggagua

SEQ ID NO: 177374 - RNA, 32 nt, Human
gcgucuccacaaccccagcgcagaggggcccg

SEQ ID NO: 177375 - RNA, 31 nt, Human
gcgucucccucucugcagccuguguaagcua

SEQ ID NO: 177376 - RNA, 32 nt, Human
gcgucuccgccuucccugggccgcacugcugc

SEQ ID NO: 177377 - RNA, 32 nt, Human
gcgucucgcccagaugcugaaggaucacuugg

SEQ ID NO: 177378 - RNA, 32 nt, Human
gcgucucucuaggagccgcgcgggaaggaugc

SEQ ID NO: 177379 - RNA, 32 nt, Human
gcgucucucuccucccccucagccugagccgg

SEQ ID NO: 177380 - RNA, 32 nt, Human
gcgucucugccuggcagaggcugcaaucucug

SEQ ID NO: 177381 - RNA, 32 nt, Human
gcgucucuguguauauccuugcuuuauuuucu

SEQ ID NO: 177382 - RNA, 32 nt, Human
gcgucugaggagaaggaggaaagguuucaggg

SEQ ID NO: 177383 - RNA, 32 nt, Human
gcgucugcacccacccuuccacccucagggcc

SEQ ID NO: 177384 - RNA, 32 nt, Human
gcgucugcaggcgccaccgcugccucuuuccg

SEQ ID NO: 177385 - RNA, 32 nt, Human
gcgucugccagccuggcuggcaguccgucugu

SEQ ID NO: 177386 - RNA, 32 nt, Human
gcgucugcucacuggcucuggggccucgaggu

SEQ ID NO: 177387 - RNA, 32 nt, Human
gcgucugcucauaggaccugcauccuuccugg

SEQ ID NO: 177388 - RNA, 32 nt, Human
gcgucuggacaagccucauggggacuggggau

SEQ ID NO: 177389 - RNA, 32 nt, Human
gcgucuggcgcgaucucugccugcuuacucgg

SEQ ID NO: 177390 - RNA, 32 nt, Human
gcgucuggcuagcuaauuuuuguauuuuuagu

SEQ ID NO: 177391 - RNA, 18 nt, Human
gcgucuggcuggcugcag

SEQ ID NO: 177392 - RNA, 32 nt, Human
gcgucuguacgggaagaggcagagggaggcag

SEQ ID NO: 177393 - RNA, 32 nt, Human
gcgucuguagugcuuccuguuugcugaauaaa

SEQ ID NO: 177394 - RNA, 32 nt, Human
gcgucuguauaauuauaauguugcccagugug

SEQ ID NO: 177395 - RNA, 17 nt, Human
gcgucuguccugcgcca

SEQ ID NO: 177396 - RNA, 32 nt, Human
gcgucugugaugggucucuuuagggacaaaug

SEQ ID NO: 177397 - RNA, 32 nt, Human
gcgucuguggaagaagaagaagaagaggagga

SEQ ID NO: 177398 - RNA, 27 nt, Human
gcgucugugguccuaugguaucaacca

SEQ ID NO: 177399 - RNA, 32 nt, Human
gcgucugugucuuugugccuguaucucgcugg

SEQ ID NO: 177400 - RNA, 32 nt, Human
gcgucuuccccgaacccuucccaaaccucccc

SEQ ID NO: 177401 - RNA, 32 nt, Human
gcgucuucucuucuccaggccuaugguccugc

SEQ ID NO: 177402 - RNA, 32 nt, Human
gcgugaacacccucuggcuaccuagggaccug

SEQ ID NO: 177403 - RNA, 32 nt, Human
gcgugaaccacugcacccagccuaucuuuugc

SEQ ID NO: 177404 - RNA, 32 nt, Human
gcgugaaccacugcacccagccugcugauccu

SEQ ID NO: 177405 - RNA, 32 nt, Human
gcgugaacccagcgggaagagguugcagugag

SEQ ID NO: 177406 - RNA, 32 nt, Human
gcgugaacccaggagacggagcuugcagugag

SEQ ID NO: 177407 - RNA, 32 nt, Human
gcgugaacccaggaggaggagcuugcagugag

SEQ ID NO: 177408 - RNA, 32 nt, Human
gcgugaacccaggaggcagagguugcagugag

SEQ ID NO: 177409 - RNA, 32 nt, Human
gcgugaacccaggaggcggaccuuguagugag

SEQ ID NO: 177410 - RNA, 32 nt, Human
gcgugaacccaggaggcggagcuggcagugag

SEQ ID NO: 177411 - RNA, 32 nt, Human
gcgugaacccaggaggcggagcuugcagugag

SEQ ID NO: 177412 - RNA, 32 nt, Human
gcgugaacccaggaggcggaggcugcagugag

SEQ ID NO: 177413 - RNA, 32 nt, Human
gcgugaacccaggaggcggagguugcagugag

SEQ ID NO: 177414 - RNA, 32 nt, Human
gcgugaacccaggaggcggcgguugcagugag

SEQ ID NO: 177415 - RNA, 32 nt, Human
gcgugaacccaggagguggagcuugcaaugag

SEQ ID NO: 177416 - RNA, 32 nt, Human
gcgugaacccaggagguggagcuugcagugag

SEQ ID NO: 177417 - RNA, 32 nt, Human
gcgugaaccucuuagaggaggaauggcugggc

SEQ ID NO: 177418 - RNA, 32 nt, Human
gcgugaagggauuuuagucacacguggucuuu

SEQ ID NO: 177419 - RNA, 32 nt, Human
gcgugaauacacacaugcacacacauauacac

SEQ ID NO: 177420 - RNA, 32 nt, Human
gcgugacagagggcucaccucuugccuucuag

SEQ ID NO: 177421 - RNA, 32 nt, Human
gcgugacaggaaaucccaagacugcuuccgcc

SEQ ID NO: 177422 - RNA, 32 nt, Human
gcgugaccaccuccuucgcagcuccugguggc

SEQ ID NO: 177423 - RNA, 32 nt, Human
gcgugaccgguaacugcccucugccccgcccc

SEQ ID NO: 177424 - RNA, 32 nt, Human
gcgugaccuccaggcagccacagccuggaaaa

SEQ ID NO: 177425 - RNA, 32 nt, Human
gcgugacgccugaugcaagaugggcaucggca

SEQ ID NO: 177426 - RNA, 32 nt, Human
gcgugagagccggagagcagggggcgggggcg

SEQ ID NO: 177427 - RNA, 32 nt, Human
gcgugagaucacugugaccucaaauucuaggc

SEQ ID NO: 177428 - RNA, 32 nt, Human
gcgugagccacugcacccagccugggagaggg

SEQ ID NO: 177429 - RNA, 32 nt, Human
gcgugagccacugcacccagccuguaaaauau

SEQ ID NO: 177430 - RNA, 32 nt, Human
gcgugagcccaggaggcggagcuugcagugag

SEQ ID NO: 177431 - RNA, 32 nt, Human
gcgugagcccaggaguuccagaccaggcuggg

SEQ ID NO: 177432 - RNA, 32 nt, Human
gcgugagcccuaggauccagguccucucucac

SEQ ID NO: 177433 - RNA, 32 nt, Human
gcgugagcucacuacaaucucuggcuucuggu

SEQ ID NO: 177434 - RNA, 32 nt, Human
gcgugaggaaaguaccaaacagcagcggaguu

SEQ ID NO: 177435 - RNA, 32 nt, Human
gcgugaggccgggcccgcgccgccaugaaccu

SEQ ID NO: 177436 - RNA, 32 nt, Human
gcgugaggcugcauagaaguguguacggcuug

SEQ ID NO: 177437 - RNA, 32 nt, Human
gcgugaggggccugaggcgagcgguuagagcg

SEQ ID NO: 177438 - RNA, 32 nt, Human
gcgugagggggcagaggcgagguggaggcguu

SEQ ID NO: 177439 - RNA, 22 nt, Human
gcgugagucaccaugcccugcu

SEQ ID NO: 177440 - RNA, 32 nt, Human
gcgugauaccuggaggggucugugaagggaca

SEQ ID NO: 177441 - RNA, 32 nt, Human
gcgugaucacacuuaccgagcuuacuuugauc

SEQ ID NO: 177442 - RNA, 32 nt, Human
gcgugaucucagcucaccacaaccuccgccuc

SEQ ID NO: 177443 - RNA, 21 nt, Human
gcgugaucucagcucacugca

SEQ ID NO: 177444 - RNA, 32 nt, Human
gcgugaucucagcucacugcaaccuccgccuc

SEQ ID NO: 177445 - RNA, 21 nt, Human
gcgugaucucggcucacugca

SEQ ID NO: 177446 - RNA, 22 nt, Human
gcgugaucucuacucacugcag

SEQ ID NO: 177447 - RNA, 32 nt, Human
gcgugauggagaaggugaccgugugggcucca

SEQ ID NO: 177448 - RNA, 32 nt, Human
gcgugcacagccggcgcucguuccagcggccu

SEQ ID NO: 177449 - RNA, 32 nt, Human
gcgugcacauggcauaggcccaguaacuuaca

SEQ ID NO: 177450 - RNA, 32 nt, Human
gcgugcacccgcguuccaucugucuucugaga

SEQ ID NO: 177451 - RNA, 32 nt, Human
gcgugcaccuguaaucucagcuacucgggagg

SEQ ID NO: 177452 - RNA, 32 nt, Human
gcgugcacuucccagagcaucuugcauccaaa

SEQ ID NO: 177453 - RNA, 32 nt, Human
gcgugcagagcccacugggcacgguggucggc

SEQ ID NO: 177454 - RNA, 32 nt, Human
gcgugcagccggcccaguacccagaccacggc

SEQ ID NO: 177455 - RNA, 32 nt, Human
gcgugcagggcuguuuuucuggaacauccuuu

SEQ ID NO: 177456 - RNA, 32 nt, Human
gcgugcagugccaggaccuggccgcacuguac

SEQ ID NO: 177457 - RNA, 32 nt, Human
gcgugcaguggcacagucucggcucacugcaa

SEQ ID NO: 177458 - RNA, 32 nt, Human
gcgugcaguggcacuaucuuggcucauugcaa

SEQ ID NO: 177459 - RNA, 32 nt, Human
gcgugcagugggccgucucaguucacugcagc

SEQ ID NO: 177460 - RNA, 32 nt, Human
gcgugcagugugacgcucuguccugaaucccu

SEQ ID NO: 177461 - RNA, 32 nt, Human
gcgugcauagcccagacacagaagaggcuggu

SEQ ID NO: 177462 - RNA, 32 nt, Human
gcgugcaucccucugugaccucagcccagaug

SEQ ID NO: 177463 - RNA, 31 nt, Human
gcgugccaaguguccagagccuuggaagcag

SEQ ID NO: 177464 - RNA, 32 nt, Human
gcgugccaggguggugacaguugaacaaagug

SEQ ID NO: 177465 - RNA, 32 nt, Human
gcgugccauccagagucaucucagcccugccu

SEQ ID NO: 177466 - RNA, 32 nt, Human
gcgugccauuucacuccagccuggacaacaag

SEQ ID NO: 177467 - RNA, 32 nt, Human
gcgugcccaggccgaggaaagcgcggcggcgg

SEQ ID NO: 177468 - RNA, 32 nt, Human
gcgugcccaggucuggcauccugcacuugcug

SEQ ID NO: 177469 - RNA, 32 nt, Human
gcgugcccuccucuggcugguaccaugcagcu

SEQ ID NO: 177470 - RNA, 32 nt, Human
gcgugccgagcaggcuugguggggaagggacu

SEQ ID NO: 177471 - RNA, 32 nt, Human
gcgugccgauagucccagcuacuugagaggcu

SEQ ID NO: 177472 - RNA, 32 nt, Human
gcgugccgcuacacuccagccugaugacagac

SEQ ID NO: 177473 - RNA, 32 nt, Human
gcgugccgcucuucuccuccaggccggcugcu

SEQ ID NO: 177474 - RNA, 32 nt, Human
gcgugccgggaaccccagaggaggucgcaguu

SEQ ID NO: 177475 - RNA, 18 nt, Human
gcgugccgugugcacgga

SEQ ID NO: 177476 - RNA, 32 nt, Human
gcgugccuauaaucccagcuacucgggaggcu

SEQ ID NO: 177477 - RNA, 32 nt, Human
gcgugccuauagucccagcuacaugggaggcu

SEQ ID NO: 177478 - RNA, 32 nt, Human
gcgugccuccgucugccugugugcuggcuguc

SEQ ID NO: 177479 - RNA, 32 nt, Human
gcgugccucuagucccagcuacuugggaggcu

SEQ ID NO: 177480 - RNA, 32 nt, Human
gcgugccucuaguuccagcuacucgggagucu

SEQ ID NO: 177481 - RNA, 32 nt, Human
gcgugccugaaaccccagcuacuugggaggcu

SEQ ID NO: 177482 - RNA, 32 nt, Human
gcgugccugccugcacggcccuugccucucuu

SEQ ID NO: 177483 - RNA, 32 nt, Human
gcgugccugccugcucacagaagcugccuaug

SEQ ID NO: 177484 - RNA, 32 nt, Human
gcgugccugccuggcggccgucggcguacucu

SEQ ID NO: 177485 - RNA, 32 nt, Human
gcgugccuguaaucccaacuacuugggaggcu

SEQ ID NO: 177486 - RNA, 32 nt, Human
gcgugccuguaaucccagcuacucaggaggcu

SEQ ID NO: 177487 - RNA, 32 nt, Human
gcgugccuguaaucccagcuacucgggaagcu

SEQ ID NO: 177488 - RNA, 32 nt, Human
gcgugccuguaaucccagcuacucgggaggcu

SEQ ID NO: 177489 - RNA, 32 nt, Human
gcgugccuguaaucccagcuacuugggaggcu

SEQ ID NO: 177490 - RNA, 32 nt, Human
gcgugccuguaaucccagcuacuugggagucu

SEQ ID NO: 177491 - RNA, 32 nt, Human
gcgugccuguaaucccagcuauucaggaggcu

SEQ ID NO: 177492 - RNA, 32 nt, Human
gcgugccuguaauccuagcuacucaggaggcu

SEQ ID NO: 177493 - RNA, 32 nt, Human
gcgugccuguagccucagcuacucggguggca

SEQ ID NO: 177494 - RNA, 32 nt, Human
gcgugccuguagucccagcuacucagggcuga

SEQ ID NO: 177495 - RNA, 32 nt, Human
gcgugccuguagucccagcuacucgagaggcu

SEQ ID NO: 177496 - RNA, 32 nt, Human
gcgugccuguagucccagcuacucgggaggcu

SEQ ID NO: 177497 - RNA, 32 nt, Human
gcgugccuguagucccagcuacuuaggaggcu

SEQ ID NO: 177498 - RNA, 32 nt, Human
gcgugccuguagucccagcuacuugggaggcu

SEQ ID NO: 177499 - RNA, 32 nt, Human
gcgugccuguagucucagcuacucaggaggcu

SEQ ID NO: 177500 - RNA, 32 nt, Human
gcgugccuguagugccagcuacucaggaggcc

SEQ ID NO: 177501 - RNA, 32 nt, Human
gcgugccuguaguuccagcuaccugggaggcu

SEQ ID NO: 177502 - RNA, 32 nt, Human
gcgugccuguaguuccagcuacuugggaggcu

SEQ ID NO: 177503 - RNA, 32 nt, Human
gcgugccugugaucccagcuacuugggaggcu

SEQ ID NO: 177504 - RNA, 32 nt, Human
gcgugccugugaucccagcugcucaggaggcu

SEQ ID NO: 177505 - RNA, 32 nt, Human
gcgugccuguggucccagcuacuggggaggcu

SEQ ID NO: 177506 - RNA, 32 nt, Human
gcgugccuguggucccagcuacuuggaaggcu

SEQ ID NO: 177507 - RNA, 32 nt, Human
gcgugccuguugucccagcuacuaggaagucu

SEQ ID NO: 177508 - RNA, 21 nt, Human
gcgugcgagcccugcaccccc

SEQ ID NO: 177509 - RNA, 32 nt, Human
gcgugcgcaccgcgccuacacgcccaacgacg

SEQ ID NO: 177510 - RNA, 32 nt, Human
gcgugcgccuguaaucccagcuacucgggagg

SEQ ID NO: 177511 - RNA, 32 nt, Human
gcgugcgccuguaaucccagcuacuugggagg

SEQ ID NO: 177512 - RNA, 32 nt, Human
gcgugcgccuguaaucucagcuacuugggagc

SEQ ID NO: 177513 - RNA, 32 nt, Human
gcgugcggccugaacccacaguggcggcggaa

SEQ ID NO: 177514 - RNA, 32 nt, Human
gcgugcgucugugugugccugugugcgagucu

SEQ ID NO: 177515 - RNA, 32 nt, Human
gcgugcgugcgcagaugugggccccgcgggag

SEQ ID NO: 177516 - RNA, 32 nt, Human
gcgugcguguccgcgcaugcaggugugccaga

SEQ ID NO: 177517 - RNA, 32 nt, Human
gcgugcguucugggcagggccuguaaugggca

SEQ ID NO: 177518 - RNA, 23 nt, Human
gcgugcuccuguagagcuugaca

SEQ ID NO: 177519 - RNA, 32 nt, Human
gcgugcuccuuaugagaaccuaaugccugaug

SEQ ID NO: 177520 - RNA, 32 nt, Human
gcgugcuccuuuugaccuguuugaaaacagaa

SEQ ID NO: 177521 - RNA, 32 nt, Human
gcgugcugacuggccuagggccccugccccuc

SEQ ID NO: 177522 - RNA, 31 nt, Human
gcgugcugccucucuucugugucguuuuguu

SEQ ID NO: 177523 - RNA, 32 nt, Human
gcgugcuggaaccugucggaacuccaugccuu

SEQ ID NO: 177524 - RNA, 32 nt, Human
gcgugcuggacucugcggacauagaggucaca

SEQ ID NO: 177525 - RNA, 32 nt, Human
gcgugcugggaauagaaagcagcucugggacc

SEQ ID NO: 177526 - RNA, 32 nt, Human
gcgugcugggacaugucuggccuccaaggacc

SEQ ID NO: 177527 - RNA, 32 nt, Human
gcgugcugucugucugcaggggccuggcuuga

SEQ ID NO: 177528 - RNA, 32 nt, Human
gcgugcugugugugcaugugugcgagagggug

SEQ ID NO: 177529 - RNA, 32 nt, Human
gcgugcuuguaaucccagcuacucaggaggcu

SEQ ID NO: 177530 - RNA, 32 nt, Human
gcguggaagcccugucaccccaccccaggcca

SEQ ID NO: 177531 - RNA, 32 nt, Human
gcguggaaggacagcaucaacaccuggcaugg

SEQ ID NO: 177532 - RNA, 32 nt, Human
gcguggacaagcuucaucugcagucagagaca

SEQ ID NO: 177533 - RNA, 32 nt, Human
gcguggaccagccgggccagggcgaugcugcg

SEQ ID NO: 177534 - RNA, 32 nt, Human
gcguggaccgagggucccagccugcaggcucc

SEQ ID NO: 177535 - RNA, 32 nt, Human
gcguggaccgggcaucucccuccaucaagcaa

SEQ ID NO: 177536 - RNA, 32 nt, Human
gcguggacuaugggcccgggaggucccuuacu

SEQ ID NO: 177537 - RNA, 32 nt, Human
gcguggacucccuuugugugggugggguuugu

SEQ ID NO: 177538 - RNA, 32 nt, Human
gcguggagaagagggagggagcgagagcgaga

SEQ ID NO: 177539 - RNA, 32 nt, Human
gcguggagcacaggagccgcagugaguccugc

SEQ ID NO: 177540 - RNA, 32 nt, Human
gcguggagccggcuuggaacagagccaagaca

SEQ ID NO: 177541 - RNA, 32 nt, Human
gcguggaggaaggaacaggaagaggcugauga

SEQ ID NO: 177542 - RNA, 32 nt, Human
gcguggaggaggaggaaaaggagggaaagggg

SEQ ID NO: 177543 - RNA, 32 nt, Human
gcguggaguguaugcgcagaguagcugucugu

SEQ ID NO: 177544 - RNA, 32 nt, Human
gcguggauuuuguggacagagccccagucacu

SEQ ID NO: 177545 - RNA, 32 nt, Human
gcguggcaagugugccccgacaugguggccuu

SEQ ID NO: 177546 - RNA, 32 nt, Human
gcguggcacauauugaagcauuucucaguguc

SEQ ID NO: 177547 - RNA, 32 nt, Human
gcguggcacugcugauccucucuggcugggaa

SEQ ID NO: 177548 - RNA, 32 nt, Human
gcguggcacuuccuuccuuccugggcccgcag

SEQ ID NO: 177549 - RNA, 32 nt, Human
gcguggccaccugaaugcugccuuaucacaag

SEQ ID NO: 177550 - RNA, 21 nt, Human
gcguggcccggaccucggccu

SEQ ID NO: 177551 - RNA, 32 nt, Human
gcguggccuucggccccaaggcugucgccugc

SEQ ID NO: 177552 - RNA, 32 nt, Human
gcguggcgcagcgucuggcuccgccaucucuu

SEQ ID NO: 177553 - RNA, 18 nt, Human
gcguggcggagauggaag

SEQ ID NO: 177554 - RNA, 32 nt, Human
gcguggcugaagccucgaggucaccaggcgga

SEQ ID NO: 177555 - RNA, 32 nt, Human
gcguggcugcaguucuggacgggcuggccgag

SEQ ID NO: 177556 - RNA, 32 nt, Human
gcguggcuggaacugacguuucccuggaggug

SEQ ID NO: 177557 - RNA, 32 nt, Human
gcguggcugggcuguguggugacuuugaugga

SEQ ID NO: 177558 - RNA, 32 nt, Human
gcgugggacagggcaguggcccaaggguaaag

SEQ ID NO: 177559 - RNA, 32 nt, Human
gcgugggagagucacaagccacuggcaagcaa

SEQ ID NO: 177560 - RNA, 32 nt, Human
gcgugggagcagugugaaggagaagaggcaag

SEQ ID NO: 177561 - RNA, 32 nt, Human
gcgugggaggaggcacgggcuugccacgccac

SEQ ID NO: 177562 - RNA, 32 nt, Human
gcgugggaggagggguggucugagggacgugg

SEQ ID NO: 177563 - RNA, 32 nt, Human
gcgugggaucagauuuggugauggaaaaagcg

SEQ ID NO: 177564 - RNA, 32 nt, Human
gcgugggaugcacacggaugacagaaucaagg

SEQ ID NO: 177565 - RNA, 32 nt, Human
gcgugggcaaggcuggccaaggauggcgacgc

SEQ ID NO: 177566 - RNA, 32 nt, Human
gcgugggcacauaggugcauguaaccuguuug

SEQ ID NO: 177567 - RNA, 32 nt, Human
gcgugggcagggccagggcgggaggagcuggg

SEQ ID NO: 177568 - RNA, 18 nt, Human
gcgugggcagggcugcag

SEQ ID NO: 177569 - RNA, 32 nt, Human
gcgugggcuaggauggugcagacacugacgug

SEQ ID NO: 177570 - RNA, 32 nt, Human
gcguggggccacucugagcuggaggcggguca

SEQ ID NO: 177571 - RNA, 19 nt, Human
gcguggggcccagcacaaa

SEQ ID NO: 177572 - RNA, 32 nt, Human
gcguggggcgcuaugggacugcgcagugacga

SEQ ID NO: 177573 - RNA, 23 nt, Human
gcguggggcucacaccuguaauc

SEQ ID NO: 177574 - RNA, 32 nt, Human
gcguggggcucacaccuguaaucccagcacuu

SEQ ID NO: 177575 - RNA, 32 nt, Human
gcguggggcucacgccugcaaucccagagcuu

SEQ ID NO: 177576 - RNA, 32 nt, Human
gcguggggcucacgccugcaaucccagcacca

SEQ ID NO: 177577 - RNA, 32 nt, Human
gcgugggggaggcggcccugcaggugcguacc

SEQ ID NO: 177578 - RNA, 32 nt, Human
gcgugggggccagucaggcugcagaggcaccu

SEQ ID NO: 177579 - RNA, 32 nt, Human
gcgugggggugaggggaucagucugguggaaa

SEQ ID NO: 177580 - RNA, 27 nt, Human
gcgugggucugggcaguaaccaugcuu

SEQ ID NO: 177581 - RNA, 32 nt, Human
gcguggguucuuggaagagguggaguuuggag

SEQ ID NO: 177582 - RNA, 32 nt, Human
gcguggucacggggagcuuccugggcaagcaa

SEQ ID NO: 177583 - RNA, 32 nt, Human
gcgugguccauagcacaguacaugcagcaucu

SEQ ID NO: 177584 - RNA, 32 nt, Human
gcgugguccaugcugaugauuuugccaaaaug

SEQ ID NO: 177585 - RNA, 32 nt, Human
gcguggugccacccuuccuguccgcagcggca

SEQ ID NO: 177586 - RNA, 32 nt, Human
gcgugguggaguuuuccuguguuuucggcccc

SEQ ID NO: 177587 - RNA, 32 nt, Human
gcgugguggcaagcaccuuaaucccagcuacu

SEQ ID NO: 177588 - RNA, 32 nt, Human
gcgugguggcucacaccugucauuccggccuc

SEQ ID NO: 177589 - RNA, 32 nt, Human
gcguggugggaccugggcuacgagguccggcc

SEQ ID NO: 177590 - RNA, 32 nt, Human
gcgugguggggaggggagcgggacaggcgaca

SEQ ID NO: 177591 - RNA, 32 nt, Human
gcguggugggggaacugcuggggaaggcgauu

SEQ ID NO: 177592 - RNA, 32 nt, Human
gcgugguuccagaacccagggugguggcgagg

SEQ ID NO: 177593 - RNA, 32 nt, Human
gcgugguuggacuuugaaggggaucggcgcca

SEQ ID NO: 177594 - RNA, 32 nt, Human
gcgugguuguucgugauccuugcaucuguuac

SEQ ID NO: 177595 - RNA, 32 nt, Human
gcgugguuuccagaccugcagcuuguuuugcu

SEQ ID NO: 177596 - RNA, 32 nt, Human
gcgugguuuuuauguguauuaggauuggggga

SEQ ID NO: 177597 - RNA, 32 nt, Human
gcguguaccugacuucagcugugucaccaccc

SEQ ID NO: 177598 - RNA, 32 nt, Human
gcguguacgggggaggugagugagugcggccg

SEQ ID NO: 177599 - RNA, 32 nt, Human
gcguguaggaaacccagugaccagagacccua

SEQ ID NO: 177600 - RNA, 32 nt, Human
gcguguaggggguggagguucuaagacaggcu

SEQ ID NO: 177601 - RNA, 32 nt, Human
gcgugucaucccuugugccgcaggcugggcgg

SEQ ID NO: 177602 - RNA, 22 nt, Human
gcgugucauuugcuggcuugaa

SEQ ID NO: 177603 - RNA, 32 nt, Human
gcguguccccuucugucagacagcuucacaga

SEQ ID NO: 177604 - RNA, 32 nt, Human
gcgugucugcagcugcuccggguagcccgcua

SEQ ID NO: 177605 - RNA, 32 nt, Human
gcgugucugcuccgggucucuaccuggucucc

SEQ ID NO: 177606 - RNA, 24 nt, Human
gcgugugaaaaccgcaacaaagcc

SEQ ID NO: 177607 - RNA, 32 nt, Human
gcgugugaacagcuccaccaccaagcgccugc

SEQ ID NO: 177608 - RNA, 32 nt, Human
gcgugugacaguguauggggcugcaguugguc

SEQ ID NO: 177609 - RNA, 32 nt, Human
gcgugugagcggccaccacaggcccuuccucu

SEQ ID NO: 177610 - RNA, 32 nt, Human
gcgugugcacaagcacacacaugcaaggcaua

SEQ ID NO: 177611 - RNA, 32 nt, Human
gcgugugccugggcccccuccuuccccugggc

SEQ ID NO: 177612 - RNA, 32 nt, Human
gcgugugccuguaaucccagcuacuugggagg

SEQ ID NO: 177613 - RNA, 32 nt, Human
gcgugugccuguaaucccagcuauuugggagg

SEQ ID NO: 177614 - RNA, 32 nt, Human
gcgugugccuguaaucucagcuacucaggagg

SEQ ID NO: 177615 - RNA, 32 nt, Human
gcgugugccuguaaugccagcuacucgggagg

SEQ ID NO: 177616 - RNA, 32 nt, Human
gcgugugccuguagucccagcuacuugggagg

SEQ ID NO: 177617 - RNA, 32 nt, Human
gcgugugcugggacaugugaugggggcacuag

SEQ ID NO: 177618 - RNA, 32 nt, Human
gcguguggccaaacagcgugaaaccuuggcac

SEQ ID NO: 177619 - RNA, 32 nt, Human
gcguguggcccagggcagcggcccagugcagc

SEQ ID NO: 177620 - RNA, 32 nt, Human
gcguguggcucacgccuauaaucccagcacuu

SEQ ID NO: 177621 - RNA, 32 nt, Human
gcgugugggacccgccgcggccucaacccggg

SEQ ID NO: 177622 - RNA, 32 nt, Human
gcgugugggacgcggcccugagccugugcaau

SEQ ID NO: 177623 - RNA, 32 nt, Human
gcguguggggaccccaucugaggucuuggcug

SEQ ID NO: 177624 - RNA, 32 nt, Human
gcguguggggcugcaaaaggagaggacgacgc

SEQ ID NO: 177625 - RNA, 32 nt, Human
gcguguggguucuaagugcgagcugcugugug

SEQ ID NO: 177626 - RNA, 32 nt, Human
gcgugugguggaggacaagguggggacagacu

SEQ ID NO: 177627 - RNA, 32 nt, Human
gcgugugguucuuccugcccucccuccccuuu

SEQ ID NO: 177628 - RNA, 32 nt, Human
gcguguguagugcugcaucuuaugacaagggg

SEQ ID NO: 177629 - RNA, 20 nt, Human
gcguguguaucacugugaca

SEQ ID NO: 177630 - RNA, 32 nt, Human
gcgugugucagccugcccuaggacuucauguc

SEQ ID NO: 177631 - RNA, 32 nt, Human
gcgugugucuguaaucccagcuacucgggagg

SEQ ID NO: 177632 - RNA, 32 nt, Human
gcgugugucugugucuuauugaaaccuuaaac

SEQ ID NO: 177633 - RNA, 32 nt, Human
gcgugugugaccuaggcuggacaucagaccug

SEQ ID NO: 177634 - RNA, 24 nt, Human
gcgugugugcgccuaaucucaggu

SEQ ID NO: 177635 - RNA, 32 nt, Human
gcguguguggguggccucgggaugggggaaua

SEQ ID NO: 177636 - RNA, 32 nt, Human
gcguguguguaaauguguacacacagacauaa

SEQ ID NO: 177637 - RNA, 32 nt, Human
gcguguucccugggcauggccggcuccguucc

SEQ ID NO: 177638 - RNA, 32 nt, Human
gcguguuggaagcaagaauuggauaagacuuc

SEQ ID NO: 177639 - RNA, 32 nt, Human
gcguguuguggauucuuuccaucaacugcuga

SEQ ID NO: 177640 - RNA, 32 nt, Human
gcguguuguugucuuaccuuuuuaaccuuacc

SEQ ID NO: 177641 - RNA, 32 nt, Human
gcguguuucucauccagccacgucucggaagg

SEQ ID NO: 177642 - RNA, 32 nt, Human
gcguguuucugcccugugacuccuggaaccug

SEQ ID NO: 177643 - RNA, 32 nt, Human
gcguguuucuucuucauaugcuuuguuuuagg

SEQ ID NO: 177644 - RNA, 32 nt, Human
gcguguuuugagggcaggaggucauuuucaag

SEQ ID NO: 177645 - RNA, 32 nt, Human
gcguuaacacaaaauccaugggcagcaugaug

SEQ ID NO: 177646 - RNA, 32 nt, Human
gcguuaaccugacaaaaccucagcagcagaag

SEQ ID NO: 177647 - RNA, 32 nt, Human
gcguuacacacgugggaagcugcagagagcaa

SEQ ID NO: 177648 - RNA, 32 nt, Human
gcguuaccccaagggcccucccgcuuccccuc

SEQ ID NO: 177649 - RNA, 32 nt, Human
gcguuacucuacuuuuaaauguaagacaagcu

SEQ ID NO: 177650 - RNA, 32 nt, Human
gcguuagagacaggguuucaacguguuagcca

SEQ ID NO: 177651 - RNA, 32 nt, Human
gcguuaggucuggggagauggagaagcugaaa

SEQ ID NO: 177652 - RNA, 32 nt, Human
gcguuagugccuggcugugcucucuuuuaugc

SEQ ID NO: 177653 - RNA, 32 nt, Human
gcguuagugcggcggagggucuugccaaaggc

SEQ ID NO: 177654 - RNA, 32 nt, Human
gcguuauaucuucucagcaacuggccgcaguc

SEQ ID NO: 177655 - RNA, 32 nt, Human
gcguuaucagggacugugcucgugagcgccga

SEQ ID NO: 177656 - RNA, 32 nt, Human
gcguuaucagggacugugcucgugagcgcgga

SEQ ID NO: 177657 - RNA, 32 nt, Human
gcguuaucccaaaggugggauuacgccuguaa

SEQ ID NO: 177658 - RNA, 26 nt, Human
gcguuauguuuuugguaaguuaacua

SEQ ID NO: 177659 - RNA, 23 nt, Human
gcguucaggguuugucuguuuga

SEQ ID NO: 177660 - RNA, 32 nt, Human
gcguucauccacccacuccccucggaccucag

SEQ ID NO: 177661 - RNA, 31 nt, Human
gcguucaugcaacgccugguggccugggacc

SEQ ID NO: 177662 - RNA, 32 nt, Human
gcguucauuuuacaggcuaguauuuuaaaagu

SEQ ID NO: 177663 - RNA, 32 nt, Human
gcguuccacaaacagauugaggcucuuuuuag

SEQ ID NO: 177664 - RNA, 32 nt, Human
gcguuccagaggagucucucccugugcccaca

SEQ ID NO: 177665 - RNA, 26 nt, Human
gcguuccccugccucucgugucgugg

SEQ ID NO: 177666 - RNA, 32 nt, Human
gcguuccucccaggacacccuugcugcgcucu

SEQ ID NO: 177667 - RNA, 21 nt, Human
gcguuccugccaggcucuccc

SEQ ID NO: 177668 - RNA, 32 nt, Human
gcguuccugcugucuggacuuuuucuguccca

SEQ ID NO: 177669 - RNA, 32 nt, Human
gcguuccuggccucugcagccaacacaguaga

SEQ ID NO: 177670 - RNA, 32 nt, Human
gcguuccuuguauucagcaagggcgguauauc

SEQ ID NO: 177671 - RNA, 32 nt, Human
gcguucgcagccgccgucaucccgcggaggag

SEQ ID NO: 177672 - RNA, 32 nt, Human
gcguucggucaccucguaggccagccuaguuu

SEQ ID NO: 177673 - RNA, 32 nt, Human
gcguucuacugcaccugccugcucuggguggc

SEQ ID NO: 177674 - RNA, 32 nt, Human
gcguucucacuguuucuuuucccuucaguucc

SEQ ID NO: 177675 - RNA, 32 nt, Human
gcguucucaucccauaggagguuugugagaac

SEQ ID NO: 177676 - RNA, 32 nt, Human
gcguucucccuaggacagauggagccucccuu

SEQ ID NO: 177677 - RNA, 32 nt, Human
gcguucucuccaccagcucccggcucacccac

SEQ ID NO: 177678 - RNA, 32 nt, Human
gcguucucuccccugaacgucaagguuuaagc

SEQ ID NO: 177679 - RNA, 32 nt, Human
gcguucucuuucccucucccaacaugccagcc

SEQ ID NO: 177680 - RNA, 22 nt, Human
gcguucuucacccccaccccca

SEQ ID NO: 177681 - RNA, 18 nt, Human
gcguugaaagcuccccca

SEQ ID NO: 177682 - RNA, 32 nt, Human
gcguugacugacugcagcagcuugccucaugg

SEQ ID NO: 177683 - RNA, 32 nt, Human
gcguugcacacacacauccaccgguggaagag

SEQ ID NO: 177684 - RNA, 32 nt, Human
gcguugccaagacugcagaucagcaccucucu

SEQ ID NO: 177685 - RNA, 32 nt, Human
gcguugcccagccuggacugcacccuuauucu

SEQ ID NO: 177686 - RNA, 32 nt, Human
gcguugccuccugagaucgaggcugcaggaua

SEQ ID NO: 177687 - RNA, 32 nt, Human
gcguugccuggaugcgguggugcauugugggc

SEQ ID NO: 177688 - RNA, 32 nt, Human
gcguuggaucuaaaacuacuagaucucauccc

SEQ ID NO: 177689 - RNA, 19 nt, Human
gcguuggcuccguccccag

SEQ ID NO: 177690 - RNA, 32 nt, Human
gcguugggagcuccucgaugucagcuuuuugu

SEQ ID NO: 177691 - RNA, 32 nt, Human
gcguugggcaaaacuccuguccccagcacuga

SEQ ID NO: 177692 - RNA, 32 nt, Human
gcguugggugggugcugagggagcgccagagu

SEQ ID NO: 177693 - RNA, 32 nt, Human
gcguugguguggugggcggagcucccagucgc

SEQ ID NO: 177694 - RNA, 32 nt, Human
gcguuguagccaguagggcuucugagcaggcu

SEQ ID NO: 177695 - RNA, 32 nt, Human
gcguugucccucagggacucaggcugaagagg

SEQ ID NO: 177696 - RNA, 24 nt, Human
gcguuguggcucaugccuguaauc

SEQ ID NO: 177697 - RNA, 32 nt, Human
gcguuguuugucggcugagcagcugguucccg

SEQ ID NO: 177698 - RNA, 32 nt, Human
gcguuguuuucugccauuuaucccaaacuuuu

SEQ ID NO: 177699 - RNA, 31 nt, Human
gcguuguuuuuacuggaggagcuugugugcg

SEQ ID NO: 177700 - RNA, 32 nt, Human
gcguuuagugagggcuggacugagggagagcc

SEQ ID NO: 177701 - RNA, 32 nt, Human
gcguuuaucugagaguucguguuccugaacgg

SEQ ID NO: 177702 - RNA, 31 nt, Human
gcguuucacagcuaaagacgccgaggcuuag

SEQ ID NO: 177703 - RNA, 32 nt, Human
gcguuucauucuauuggucaauuccauguggc

SEQ ID NO: 177704 - RNA, 32 nt, Human
gcguuuccacagccuucagccuguucuagaac

SEQ ID NO: 177705 - RNA, 32 nt, Human
gcguuucgcuuuccuucuucuuggcuuccucu

SEQ ID NO: 177706 - RNA, 32 nt, Human
gcguuucuaggugagggcaugagagcuggcau

SEQ ID NO: 177707 - RNA, 32 nt, Human
gcguuucugcagcugcugcagucgccgcagcg

SEQ ID NO: 177708 - RNA, 22 nt, Human
gcguuugaagccuggccuccca

SEQ ID NO: 177709 - RNA, 32 nt, Human
gcguuugcaaacuucucgccugggcaggaggc

SEQ ID NO: 177710 - RNA, 32 nt, Human
gcguuugccguagggguugaaaagaauugggg

SEQ ID NO: 177711 - RNA, 32 nt, Human
gcguuuggaccugucugugcguucuccugcgu

SEQ ID NO: 177712 - RNA, 32 nt, Human
gcguuuggagagcugcugaggagccaggggcu

SEQ ID NO: 177713 - RNA, 32 nt, Human
gcguuuggggaggaacagggagagagcuucgg

SEQ ID NO: 177714 - RNA, 32 nt, Human
gcguuugucccaggcucgggggcucaguggga

SEQ ID NO: 177715 - RNA, 32 nt, Human
gcguuuucucuccugggaaccccacugcuuag

SEQ ID NO: 177716 - RNA, 32 nt, Human
gcguuuuguaggcucuccagggguugagauga

SEQ ID NO: 177717 - RNA, 18 nt, Human
gcguuuuuacaccgggua

SEQ ID NO: 177718 - RNA, 32 nt, Human
gcguuuuucucaucccccucccuucccuuccc

SEQ ID NO: 177719 - RNA, 32 nt, Human
gcguuuuucucgucccccucccugcccaaacu

SEQ ID NO: 177720 - RNA, 32 nt, Human
gcuaaaaacccagagcagaagcagggagaagg

SEQ ID NO: 177721 - RNA, 32 nt, Human
gcuaaaaauacaaaauuagcugggcguggugg

SEQ ID NO: 177722 - RNA, 32 nt, Human
gcuaaaacaguccugaaucuuccaugaacagu

SEQ ID NO: 177723 - RNA, 32 nt, Human
gcuaaaacucagcugcagccuggacaguagag

SEQ ID NO: 177724 - RNA, 32 nt, Human
gcuaaaacuuuggcugggcaugguggcucacg

SEQ ID NO: 177725 - RNA, 32 nt, Human
gcuaaaaggccugagggccucggacgcgggug

SEQ ID NO: 177726 - RNA, 32 nt, Human
gcuaaaaggucuugcaguggcuuuucauggcc

SEQ ID NO: 177727 - RNA, 32 nt, Human
gcuaaaauguggagcuugggagaagaugaucg

SEQ ID NO: 177728 - RNA, 32 nt, Human
gcuaaaauguucaugaguaucaagcagaacag

SEQ ID NO: 177729 - RNA, 32 nt, Human
gcuaaaauuucagaacagucucuguaaggcuc

SEQ ID NO: 177730 - RNA, 32 nt, Human
gcuaaacaccaaaccauuuccaaaaauacccc

SEQ ID NO: 177731 - RNA, 32 nt, Human
gcuaaacagccaagacuggagcagucucucac

SEQ ID NO: 177732 - RNA, 32 nt, Human
gcuaaacaucaaaaacagaucugguaggggcg

SEQ ID NO: 177733 - RNA, 32 nt, Human
gcuaaaccugccucugugccaguggcucucaa

SEQ ID NO: 177734 - RNA, 32 nt, Human
gcuaaacguuuguuccccaucucugugccucc

SEQ ID NO: 177735 - RNA, 32 nt, Human
gcuaaagaaagccacagaaagccggacccgca

SEQ ID NO: 177736 - RNA, 32 nt, Human
gcuaaagaaugucaguaaauaaaagagcuuuc

SEQ ID NO: 177737 - RNA, 32 nt, Human
gcuaaagaguaugaaaaauguuuugauggaag

SEQ ID NO: 177738 - RNA, 32 nt, Human
gcuaaagcaaaaaguacuaggcuacuaagugc

SEQ ID NO: 177739 - RNA, 32 nt, Human
gcuaaagcaauguuguuaaaauuagcucaaua

SEQ ID NO: 177740 - RNA, 23 nt, Human
gcuaaagcaggagaauugcuuga

SEQ ID NO: 177741 - RNA, 24 nt, Human
gcuaaagcaggaggauggcuuuag

SEQ ID NO: 177742 - RNA, 32 nt, Human
gcuaaagcaguggcuggggcuuuguuuuuaaa

SEQ ID NO: 177743 - RNA, 32 nt, Human
gcuaaagccagcccucccuguccuuuccagag

SEQ ID NO: 177744 - RNA, 32 nt, Human
gcuaaagccuguaaucccagcacuuugggagg

SEQ ID NO: 177745 - RNA, 32 nt, Human
gcuaaagcugggucugaaauuuggucaguggg

SEQ ID NO: 177746 - RNA, 32 nt, Human
gcuaaaggacaguggaugcugcugggccucug

SEQ ID NO: 177747 - RNA, 32 nt, Human
gcuaaaggaggcugagguugcagugagcugag

SEQ ID NO: 177748 - RNA, 32 nt, Human
gcuaaaggccuuccuuccuuccagucagccug

SEQ ID NO: 177749 - RNA, 32 nt, Human
gcuaaaggcggccagguuugcagugcgggaag

SEQ ID NO: 177750 - RNA, 22 nt, Human
gcuaaagggugcacacuccaag

SEQ ID NO: 177751 - RNA, 32 nt, Human
gcuaaagguggaagcugaccuggagaaagaga

SEQ ID NO: 177752 - RNA, 32 nt, Human
gcuaaagugacucucuggguugccugcuucca

SEQ ID NO: 177753 - RNA, 24 nt, Human
gcuaaagugggaggauuacuugag

SEQ ID NO: 177754 - RNA, 32 nt, Human
gcuaaauaaccagcuagagcuagcugccagcc

SEQ ID NO: 177755 - RNA, 32 nt, Human
gcuaaauacucauguguaguuuuuauacuaca

SEQ ID NO: 177756 - RNA, 24 nt, Human
gcuaaauaucaaucaagccaugua

SEQ ID NO: 177757 - RNA, 24 nt, Human
gcuaaauauucuagcagugaugua

SEQ ID NO: 177758 - RNA, 22 nt, Human
gcuaaauauuuauggccaugua

SEQ ID NO: 177759 - RNA, 32 nt, Human
gcuaaaucagaagaaaaugccaaggaagaaaa

SEQ ID NO: 177760 - RNA, 32 nt, Human
gcuaaauccacaucuagcccugagcagcauuu

SEQ ID NO: 177761 - RNA, 32 nt, Human
gcuaaaucgguucagacucccaccucaccguu

SEQ ID NO: 177762 - RNA, 32 nt, Human
gcuaaaucuccaaaccauucccaaaccuuucc

SEQ ID NO: 177763 - RNA, 32 nt, Human
gcuaaaucuugcuuugcuuucaauaaaguguc

SEQ ID NO: 177764 - RNA, 32 nt, Human
gcuaaaucuuucaacucuccccaguccccuca

SEQ ID NO: 177765 - RNA, 32 nt, Human
gcuaaaugagauguuucuaaucugggcuucca

SEQ ID NO: 177766 - RNA, 32 nt, Human
gcuaaaugcuggguguguaugugugcauuuuc

SEQ ID NO: 177767 - RNA, 32 nt, Human
gcuaaaugcuuugcagaaagugaugaccuuac

SEQ ID NO: 177768 - RNA, 32 nt, Human
gcuaaauggacaucauguuuucuggugaugcc

SEQ ID NO: 177769 - RNA, 32 nt, Human
gcuaaauuaaaccaaacccuauugaagaauug

SEQ ID NO: 177770 - RNA, 32 nt, Human
gcuaaauucccccagccauuaucucacacuga

SEQ ID NO: 177771 - RNA, 32 nt, Human
gcuaaauucucagguggcucaaaggaaaacau

SEQ ID NO: 177772 - RNA, 32 nt, Human
gcuaaauuuaacuguugguuuugugguagagu

SEQ ID NO: 177773 - RNA, 32 nt, Human
gcuaacaaaagcuucucagcugaggacacuca

SEQ ID NO: 177774 - RNA, 32 nt, Human
gcuaacaaggacacuguacacaacaucgcuaa

SEQ ID NO: 177775 - RNA, 32 nt, Human
gcuaacaaggaugcuguacacaacaucgcuaa

SEQ ID NO: 177776 - RNA, 32 nt, Human
gcuaacaccacggcacuucagccugggugaca

SEQ ID NO: 177777 - RNA, 32 nt, Human
gcuaacaccuauaauucccagcacuuugggag

SEQ ID NO: 177778 - RNA, 32 nt, Human
gcuaacaccuggaucuccagaaaccuagccca

SEQ ID NO: 177779 - RNA, 32 nt, Human
gcuaacaccuguaaucccagcacuuugggagg

SEQ ID NO: 177780 - RNA, 32 nt, Human
gcuaacacgggugaaaccccgucucuauuaaa

SEQ ID NO: 177781 - RNA, 24 nt, Human
gcuaacacucguuugcugcugcug

SEQ ID NO: 177782 - RNA, 18 nt, Human
gcuaacacugccaccucu

SEQ ID NO: 177783 - RNA, 20 nt, Human
gcuaacagcaguuucaggua

SEQ ID NO: 177784 - RNA, 32 nt, Human
gcuaacagcauugccugugcucuccucucagg

SEQ ID NO: 177785 - RNA, 32 nt, Human
gcuaacaggauaugggcuaccaggaagaagga

SEQ ID NO: 177786 - RNA, 32 nt, Human
gcuaacagucucuuaggcuuccuucucauuuc

SEQ ID NO: 177787 - RNA, 32 nt, Human
gcuaacauggugaaauccuaucucuaccaaaa

SEQ ID NO: 177788 - RNA, 32 nt, Human
gcuaaccaccgugcgucucucucagcugcuga

SEQ ID NO: 177789 - RNA, 32 nt, Human
gcuaaccagggagagucagguuaauuuucugu

SEQ ID NO: 177790 - RNA, 32 nt, Human
gcuaaccaggugaagaucugagcccagaaaug

SEQ ID NO: 177791 - RNA, 32 nt, Human
gcuaaccaucaccaccagcucuccuuaauaca

SEQ ID NO: 177792 - RNA, 32 nt, Human
gcuaaccaucaucugguccuucaucaagucgu

SEQ ID NO: 177793 - RNA, 32 nt, Human
gcuaaccaucuauuucauccucucuucuggca

SEQ ID NO: 177794 - RNA, 32 nt, Human
gcuaacccagaaaauucgaaggaacacauuaa

SEQ ID NO: 177795 - RNA, 32 nt, Human
gcuaaccccacugugcuuccacaugccuggcc

SEQ ID NO: 177796 - RNA, 32 nt, Human
gcuaaccccuggcaaccacuaaucuguucccc

SEQ ID NO: 177797 - RNA, 20 nt, Human
gcuaaccccugucuucuucc

SEQ ID NO: 177798 - RNA, 32 nt, Human
gcuaaccuagugccuauagcuaaggcagguac

SEQ ID NO: 177799 - RNA, 32 nt, Human
gcuaaccucuguuucaagaaugcaguuauuaa

SEQ ID NO: 177800 - RNA, 32 nt, Human
gcuaaccugcauuugugugcuguguccaccuu

SEQ ID NO: 177801 - RNA, 32 nt, Human
gcuaaccuguaaucccagcuacuugggaggcu

SEQ ID NO: 177802 - RNA, 32 nt, Human
gcuaaccuuacauuucuuagaagcaaaauauu

SEQ ID NO: 177803 - RNA, 32 nt, Human
gcuaacgaggacgcuguacacaacaucgcuaa

SEQ ID NO: 177804 - RNA, 32 nt, Human
gcuaacgccuguaaucccagaacuuugggaag

SEQ ID NO: 177805 - RNA, 32 nt, Human
gcuaacgccuguaaucccagcacuugggaggc

SEQ ID NO: 177806 - RNA, 32 nt, Human
gcuaacgccuguaaucccagcacuuugagaug

SEQ ID NO: 177807 - RNA, 22 nt, Human
gcuaacgcugcugcugcugcug

SEQ ID NO: 177808 - RNA, 32 nt, Human
gcuaacgggaggcagugugauguggaggggaa

SEQ ID NO: 177809 - RNA, 32 nt, Human
gcuaacucacuggccagcucucaccagcggug

SEQ ID NO: 177810 - RNA, 32 nt, Human
gcuaacuccagaaauuccugcagacauccuac

SEQ ID NO: 177811 - RNA, 32 nt, Human
gcuaacucucccaaaaaggaccauggguagca

SEQ ID NO: 177812 - RNA, 32 nt, Human
gcuaacugcaaccuccagcuccuggguucagg

SEQ ID NO: 177813 - RNA, 32 nt, Human
gcuaacugcaacuuccaccuccuggguucaag

SEQ ID NO: 177814 - RNA, 32 nt, Human
gcuaacugcagccucaaccugcagugcucaag

SEQ ID NO: 177815 - RNA, 21 nt, Human
gcuaacugugcguuucucccu

SEQ ID NO: 177816 - RNA, 22 nt, Human
gcuaacuuccacuaauccauua

SEQ ID NO: 177817 - RNA, 32 nt, Human
gcuaagaacacagcuggcuggaagaagacagg

SEQ ID NO: 177818 - RNA, 32 nt, Human
gcuaagaacucauggccacuguggaaaucuug

SEQ ID NO: 177819 - RNA, 32 nt, Human
gcuaagaacuuuguauacaucaucucauuuaa

SEQ ID NO: 177820 - RNA, 32 nt, Human
gcuaagaaggagagauuggaagagaagcaagg

SEQ ID NO: 177821 - RNA, 32 nt, Human
gcuaagaaggcagaggccagcugguauauuca

SEQ ID NO: 177822 - RNA, 19 nt, Human
gcuaagaaggcucagggca

SEQ ID NO: 177823 - RNA, 32 nt, Human
gcuaagaagugagucagagaguagagggguag

SEQ ID NO: 177824 - RNA, 32 nt, Human
gcuaagacaacaguaacagccauuuacuccac

SEQ ID NO: 177825 - RNA, 21 nt, Human
gcuaagacaggaagaucaccu

SEQ ID NO: 177826 - RNA, 23 nt, Human
gcuaagacaggagaaucgcuuga

SEQ ID NO: 177827 - RNA, 32 nt, Human
gcuaagacauaaaaggugugaaagcacuagcc

SEQ ID NO: 177828 - RNA, 23 nt, Human
gcuaagacgggaggauugcuuga

SEQ ID NO: 177829 - RNA, 32 nt, Human
gcuaagacuccaggacccccuggaagccuaga

SEQ ID NO: 177830 - RNA, 32 nt, Human
gcuaagacugugccacugcacuccagccuggg

SEQ ID NO: 177831 - RNA, 21 nt, Human
gcuaagagacaaaggaggcgg

SEQ ID NO: 177832 - RNA, 32 nt, Human
gcuaagagauucccgcugauugggcucagugc

SEQ ID NO: 177833 - RNA, 32 nt, Human
gcuaagagggcaggacugugggccagugccag

SEQ ID NO: 177834 - RNA, 32 nt, Human
gcuaagcaagaggccucugcaucuugacaccu

SEQ ID NO: 177835 - RNA, 20 nt, Human
gcuaagcagugaccagaacc

SEQ ID NO: 177836 - RNA, 32 nt, Human
gcuaagcaugacagauaucaacagggcgggcu

SEQ ID NO: 177837 - RNA, 32 nt, Human
gcuaagcccaggaugccgcccaagccucgggg

SEQ ID NO: 177838 - RNA, 32 nt, Human
gcuaagcccaguucaaggcugcagugaacuau

SEQ ID NO: 177839 - RNA, 32 nt, Human
gcuaagccccuggaugauggagcgagaaggga

SEQ ID NO: 177840 - RNA, 32 nt, Human
gcuaagccugcaguaggaucucagccacaagg

SEQ ID NO: 177841 - RNA, 32 nt, Human
gcuaagcucuuugccagcucucauuuggaguu

SEQ ID NO: 177842 - RNA, 19 nt, Human
gcuaagcugggugcagugg

SEQ ID NO: 177843 - RNA, 32 nt, Human
gcuaaggaaaaaggacaccaaaaugaagaaga

SEQ ID NO: 177844 - RNA, 22 nt, Human
gcuaaggaaaagggacccaagg

SEQ ID NO: 177845 - RNA, 22 nt, Human
gcuaaggaaaagggacccaggg

SEQ ID NO: 177846 - RNA, 23 nt, Human
gcuaaggaaauaugcaggggguu

SEQ ID NO: 177847 - RNA, 32 nt, Human
gcuaaggaagcccugacaugcugcagucggaa

SEQ ID NO: 177848 - RNA, 25 nt, Human
gcuaaggacacuuguuuggggccac

SEQ ID NO: 177849 - RNA, 20 nt, Human
gcuaaggacauguccuuucc

SEQ ID NO: 177850 - RNA, 32 nt, Human
gcuaaggacccugaugaagucacugcacccuc

SEQ ID NO: 177851 - RNA, 32 nt, Human
gcuaaggagggaguugacaucccccuucuggc

SEQ ID NO: 177852 - RNA, 32 nt, Human
gcuaaggcaaagcaccuggcuaggcagcugga

SEQ ID NO: 177853 - RNA, 23 nt, Human
gcuaaggcaggaaaaucgcuuga

SEQ ID NO: 177854 - RNA, 23 nt, Human
gcuaaggcaggagaaucacuuga

SEQ ID NO: 177855 - RNA, 23 nt, Human
gcuaaggcaggagaaucgcuuga

SEQ ID NO: 177856 - RNA, 23 nt, Human
gcuaaggcaggagaaucucuuga

SEQ ID NO: 177857 - RNA, 23 nt, Human
gcuaaggcaggagaauugcuuga

SEQ ID NO: 177858 - RNA, 24 nt, Human
gcuaaggcaggaggauugcuugag

SEQ ID NO: 177859 - RNA, 24 nt, Human
gcuaaggcagggagaaucgcuuga

SEQ ID NO: 177860 - RNA, 23 nt, Human
gcuaaggcaggggaaucgcuuga

SEQ ID NO: 177861 - RNA, 19 nt, Human
gcuaaggcagguggaucac

SEQ ID NO: 177862 - RNA, 32 nt, Human
gcuaaggccguggagcugcugugugacugugu

SEQ ID NO: 177863 - RNA, 32 nt, Human
gcuaaggccugagaguuuuugcagaaaugggg

SEQ ID NO: 177864 - RNA, 24 nt, Human
gcuaaggcgggaggaucccuugag

SEQ ID NO: 177865 - RNA, 24 nt, Human
gcuaaggcgggaggaugacuugag

SEQ ID NO: 177866 - RNA, 32 nt, Human
gcuaaggcuuguguccaucaacagaugaaugg

SEQ ID NO: 177867 - RNA, 32 nt, Human
gcuaaggggagucaucacagggcuucagggcu

SEQ ID NO: 177868 - RNA, 32 nt, Human
gcuaaggggagugaguccagagagggacuuaa

SEQ ID NO: 177869 - RNA, 32 nt, Human
gcuaaggggguauguugugcagaugcuacugc

SEQ ID NO: 177870 - RNA, 32 nt, Human
gcuaagggguaguggcuggcagagguugccca

SEQ ID NO: 177871 - RNA, 32 nt, Human
gcuaaggucuccaggcugcugaugaagugagg

SEQ ID NO: 177872 - RNA, 24 nt, Human
gcuaaggugggagaauugcuugag

SEQ ID NO: 177873 - RNA, 24 nt, Human
gcuaaggugggaggaucacuugag

SEQ ID NO: 177874 - RNA, 24 nt, Human
gcuaaggugggaggaucccuugag

SEQ ID NO: 177875 - RNA, 32 nt, Human
gcuaaguauuauccugcuuccagaccuauguc

SEQ ID NO: 177876 - RNA, 32 nt, Human
gcuaagucagccaggcaggcugucaggcccua

SEQ ID NO: 177877 - RNA, 32 nt, Human
gcuaaguccagguguuuguauucgggcuagaa

SEQ ID NO: 177878 - RNA, 32 nt, Human
gcuaagucuaacacuccugggagcucaggagg

SEQ ID NO: 177879 - RNA, 32 nt, Human
gcuaagucuccucugugacucuagcaaaugcc

SEQ ID NO: 177880 - RNA, 29 nt, Human
gcuaagugucuguguggcuguggagcucg

SEQ ID NO: 177881 - RNA, 32 nt, Human
gcuaaguguguaugauaaugaaacucaucauu

SEQ ID NO: 177882 - RNA, 32 nt, Human
gcuaaguucacuugggaggauggcaguaggag

SEQ ID NO: 177883 - RNA, 32 nt, Human
gcuaauaauaagcuaaccuuugugcacaaaua

SEQ ID NO: 177884 - RNA, 32 nt, Human
gcuaauagagaaggagaaaggaaauaaaauaa

SEQ ID NO: 177885 - RNA, 32 nt, Human
gcuaauaugugaagugaauucuaccuuugacc

SEQ ID NO: 177886 - RNA, 32 nt, Human
gcuaauaugugcuccaucguucaugcccuggg

SEQ ID NO: 177887 - RNA, 32 nt, Human
gcuaaucaacuacccuuucuuuuaucaaguaa

SEQ ID NO: 177888 - RNA, 32 nt, Human
gcuaaucacaguuacaugcuucagaggacuua

SEQ ID NO: 177889 - RNA, 32 nt, Human
gcuaaucagcaucuggccaacauaguggagag

SEQ ID NO: 177890 - RNA, 32 nt, Human
gcuaaucauuuauccaaaggcuuuccauucuu

SEQ ID NO: 177891 - RNA, 32 nt, Human
gcuaaucauuuuaauuaaaaacaaauaagcau

SEQ ID NO: 177892 - RNA, 32 nt, Human
gcuaauccaguggaaaucaggaaaggugugau

SEQ ID NO: 177893 - RNA, 32 nt, Human
gcuaauccggagaacccaggccagagccugaa

SEQ ID NO: 177894 - RNA, 32 nt, Human
gcuaauccucaucugucauauccagaaaucac

SEQ ID NO: 177895 - RNA, 32 nt, Human
gcuaauccuccugagugcuggaccucauuaaa

SEQ ID NO: 177896 - RNA, 32 nt, Human
gcuaauccuuuccugccugugcucucuccccu

SEQ ID NO: 177897 - RNA, 32 nt, Human
gcuaaucucaaggagcuuccagugcagaggga

SEQ ID NO: 177898 - RNA, 32 nt, Human
gcuaaucugccuugguuccauuuccuuauucu

SEQ ID NO: 177899 - RNA, 32 nt, Human
gcuaaucuuggcuuuucuccaagucuacgacg

SEQ ID NO: 177900 - RNA, 32 nt, Human
gcuaaugaggagucaaaugcaggccugccugu

SEQ ID NO: 177901 - RNA, 21 nt, Human
gcuaaugaggugacucagggu

SEQ ID NO: 177902 - RNA, 23 nt, Human
gcuaaugcaggagaaucgcuuga

SEQ ID NO: 177903 - RNA, 32 nt, Human
gcuaauggaguguuugaaaacugacaucagau

SEQ ID NO: 177904 - RNA, 32 nt, Human
gcuaauggcugguagagauuguacugacuauu

SEQ ID NO: 177905 - RNA, 32 nt, Human
gcuaaugggugcugcacugggccagaugggca

SEQ ID NO: 177906 - RNA, 32 nt, Human
gcuaauuaucuuucccaccaaccuccuccauc

SEQ ID NO: 177907 - RNA, 32 nt, Human
gcuaauuccaaagccacuuuugaagucuauag

SEQ ID NO: 177908 - RNA, 32 nt, Human
gcuaauucgggagauagccauaugaaaacuuu

SEQ ID NO: 177909 - RNA, 32 nt, Human
gcuaauucucagaaaggcaaguagaugauaaa

SEQ ID NO: 177910 - RNA, 32 nt, Human
gcuaauucuuuuccuuucauuuugcuuucuga

SEQ ID NO: 177911 - RNA, 32 nt, Human
gcuaauuuagagagaccuauccauuucaaaau

SEQ ID NO: 177912 - RNA, 23 nt, Human
gcuaauuuauaauuacuauuauu

SEQ ID NO: 177913 - RNA, 32 nt, Human
gcuaauuucuguauuuuuaguagagacagggu

SEQ ID NO: 177914 - RNA, 32 nt, Human
gcuaauuucuguauuuuuaguagagauggggu

SEQ ID NO: 177915 - RNA, 32 nt, Human
gcuaauuucuugaacuccuggccucaagcagu

SEQ ID NO: 177916 - RNA, 32 nt, Human
gcuaauuuguauuuguauucccuucccccuac

SEQ ID NO: 177917 - RNA, 32 nt, Human
gcuaauuuuaauaaaaauaagaaaaauuaaua

SEQ ID NO: 177918 - RNA, 32 nt, Human
gcuacaaaagaaaucacagcugcuagaaguau

SEQ ID NO: 177919 - RNA, 32 nt, Human
gcuacaaaggaaagacaacuggggaaagaaga

SEQ ID NO: 177920 - RNA, 32 nt, Human
gcuacaagaggaccuggggcuuuggagugaag

SEQ ID NO: 177921 - RNA, 32 nt, Human
gcuacaagagguuaggaagcccaagaaaauga

SEQ ID NO: 177922 - RNA, 24 nt, Human
gcuacaauaauuccaacuaaguga

SEQ ID NO: 177923 - RNA, 32 nt, Human
gcuacaauccagguucuccucagucugacucc

SEQ ID NO: 177924 - RNA, 32 nt, Human
gcuacaauccaucuggucuccuccagcuccuu

SEQ ID NO: 177925 - RNA, 19 nt, Human
gcuacaaugcuguuaaauc

SEQ ID NO: 177926 - RNA, 32 nt, Human
gcuacaauggcccaccacccaccuacccacug

SEQ ID NO: 177927 - RNA, 20 nt, Human
gcuacaaugucucgugaauc

SEQ ID NO: 177928 - RNA, 25 nt, Human
gcuacacaaagucgugguuugcaug

SEQ ID NO: 177929 - RNA, 32 nt, Human
gcuacacaaucccaagacagagcuagagcaag

SEQ ID NO: 177930 - RNA, 23 nt, Human
gcuacacacgcugcgccuccaua

SEQ ID NO: 177931 - RNA, 32 nt, Human
gcuacacagaggccuuuguucuuuccuggcau

SEQ ID NO: 177932 - RNA, 32 nt, Human
gcuacacagcugcccacuccuccuggggaggc

SEQ ID NO: 177933 - RNA, 32 nt, Human
gcuacacaggaggcugaagugggaggaguguu

SEQ ID NO: 177934 - RNA, 32 nt, Human
gcuacacaguaggagauucuuuuucuucucuu

SEQ ID NO: 177935 - RNA, 21 nt, Human
gcuacacagucuccuauuauc

SEQ ID NO: 177936 - RNA, 32 nt, Human
gcuacacagugcagaggcucuugaugguggac

SEQ ID NO: 177937 - RNA, 32 nt, Human
gcuacacaucuccuucuggcucaggugaaauc

SEQ ID NO: 177938 - RNA, 32 nt, Human
gcuacacaugugcacacaugcacaguugcaca

SEQ ID NO: 177939 - RNA, 32 nt, Human
gcuacaccaccuagguuuguguaaguauacgc

SEQ ID NO: 177940 - RNA, 32 nt, Human
gcuacacccugccuggccacaugggguucccu

SEQ ID NO: 177941 - RNA, 32 nt, Human
gcuacacuagcccccauucucugggcgccugg

SEQ ID NO: 177942 - RNA, 32 nt, Human
gcuacacuccagccugggugacagagugagac

SEQ ID NO: 177943 - RNA, 32 nt, Human
gcuacacucccaucagcgccaugacaguuuac

SEQ ID NO: 177944 - RNA, 32 nt, Human
gcuacacugacacugguauuccugccuccaua

SEQ ID NO: 177945 - RNA, 32 nt, Human
gcuacacugcaacuuccguccagugcugugau

SEQ ID NO: 177946 - RNA, 32 nt, Human
gcuacacugcuggugugugcauucugagaccu

SEQ ID NO: 177947 - RNA, 32 nt, Human
gcuacacugggcagaguuggcagggugcuggu

SEQ ID NO: 177948 - RNA, 32 nt, Human
gcuacagaaaccaggucauuugugcacagccc

SEQ ID NO: 177949 - RNA, 32 nt, Human
gcuacagacagcuuugaugacuacccaccuag

SEQ ID NO: 177950 - RNA, 32 nt, Human
gcuacagacuucuccccaccccguaggagcug

SEQ ID NO: 177951 - RNA, 32 nt, Human
gcuacagagagggaagggaaagccugaggccg

SEQ ID NO: 177952 - RNA, 32 nt, Human
gcuacagaggcccagugguguaagcugcuucc

SEQ ID NO: 177953 - RNA, 32 nt, Human
gcuacagaucucucugcucaucaugcccuuuc

SEQ ID NO: 177954 - RNA, 20 nt, Human
gcuacagaugggacccaagg

SEQ ID NO: 177955 - RNA, 32 nt, Human
gcuacagcacaaaaucuucaagcugagugcau

SEQ ID NO: 177956 - RNA, 32 nt, Human
gcuacagcagcaagcagacaaaguaagcuguu

SEQ ID NO: 177957 - RNA, 23 nt, Human
gcuacagcaggagaauugcuuga

SEQ ID NO: 177958 - RNA, 20 nt, Human
gcuacagcccagaagccaga

SEQ ID NO: 177959 - RNA, 21 nt, Human
gcuacagcccagaccaaggca

SEQ ID NO: 177960 - RNA, 32 nt, Human
gcuacagccgccgaaauguugaugccuaagaa

SEQ ID NO: 177961 - RNA, 32 nt, Human
gcuacagcuccaggagcccagcgccgggcugu

SEQ ID NO: 177962 - RNA, 32 nt, Human
gcuacagcuucuuccuccuccuuggagcugcu

SEQ ID NO: 177963 - RNA, 32 nt, Human
gcuacaggacaugggagcugcugcuuguggga

SEQ ID NO: 177964 - RNA, 32 nt, Human
gcuacaggaggggucucauguccugcuggcuu

SEQ ID NO: 177965 - RNA, 20 nt, Human
gcuacaggagguucggggca

SEQ ID NO: 177966 - RNA, 32 nt, Human
gcuacaggccaucaacuuguggaagguggggc

SEQ ID NO: 177967 - RNA, 32 nt, Human
gcuacaggcuccauuucucugccuucccauug

SEQ ID NO: 177968 - RNA, 32 nt, Human
gcuacaggcugcaggcacgcagggcagcgggu

SEQ ID NO: 177969 - RNA, 23 nt, Human
gcuacaggcugcaggcacugcag

SEQ ID NO: 177970 - RNA, 32 nt, Human
gcuacagggaaugauuggucauggggaagucu

SEQ ID NO: 177971 - RNA, 32 nt, Human
gcuacaggucucuguguaaugugaagcucucc

SEQ ID NO: 177972 - RNA, 32 nt, Human
gcuacaggucugucacuaugcucucuugccuu

SEQ ID NO: 177973 - RNA, 32 nt, Human
gcuacaggugucuuuauuuccacugcacgcug

SEQ ID NO: 177974 - RNA, 32 nt, Human
gcuacagucaaaaauuccaaaguuccuacacc

SEQ ID NO: 177975 - RNA, 32 nt, Human
gcuacagugagcuccaggaguggagggggcuc

SEQ ID NO: 177976 - RNA, 32 nt, Human
gcuacagugagcugugauugcaccacuguacu

SEQ ID NO: 177977 - RNA, 32 nt, Human
gcuacaguguguacaaaagacuugcuguuuua

SEQ ID NO: 177978 - RNA, 32 nt, Human
gcuacaguuggguuuauaauaaacccugaauc

SEQ ID NO: 177979 - RNA, 32 nt, Human
gcuacauaucuagccauucacagauguggaua

SEQ ID NO: 177980 - RNA, 32 nt, Human
gcuacaucacaaaucaguuucaagagggccuu

SEQ ID NO: 177981 - RNA, 32 nt, Human
gcuacaucacccaaaguagauguuagaaaacc

SEQ ID NO: 177982 - RNA, 22 nt, Human
gcuacaugcuggggucaaggca

SEQ ID NO: 177983 - RNA, 32 nt, Human
gcuacaugcuuaguggcaacuucugccuuuuu

SEQ ID NO: 177984 - RNA, 21 nt, Human
gcuacaugggagccugaggca

SEQ ID NO: 177985 - RNA, 24 nt, Human
gcuacauugcccaggcuggucuca

SEQ ID NO: 177986 - RNA, 32 nt, Human
gcuacauuuaaaacaaaaucucacagcucggu

SEQ ID NO: 177987 - RNA, 32 nt, Human
gcuaccaaccacagccuggcagccuggucucc

SEQ ID NO: 177988 - RNA, 16 nt, Human
gcuaccaaccaggguc

SEQ ID NO: 177989 - RNA, 32 nt, Human
gcuaccaagauccugaaugucagagauguacu

SEQ ID NO: 177990 - RNA, 32 nt, Human
gcuaccaaguagcugggacuucagagauggcu

SEQ ID NO: 177991 - RNA, 32 nt, Human
gcuaccaaugagcuacccacagccugggcaac

SEQ ID NO: 177992 - RNA, 32 nt, Human
gcuaccacaagaaccugcgucuuggaccauug

SEQ ID NO: 177993 - RNA, 21 nt, Human
gcuaccacauggccucgcugu

SEQ ID NO: 177994 - RNA, 32 nt, Human
gcuaccacauucaauuaacuuugcuauuaauu

SEQ ID NO: 177995 - RNA, 19 nt, Human
gcuaccacauucuauuauu

SEQ ID NO: 177996 - RNA, 32 nt, Human
gcuaccacgccuggcccguguugcuguuuuaa

SEQ ID NO: 177997 - RNA, 32 nt, Human
gcuaccacuaaauuauggugacuguuccuaau

SEQ ID NO: 177998 - RNA, 32 nt, Human
gcuaccacuguccggcccggaggggaacuguu

SEQ ID NO: 177999 - RNA, 32 nt, Human
gcuaccagaagugaaugucaaccagcuggaac

SEQ ID NO: 178000 - RNA, 32 nt, Human
gcuaccagaucagguuagcacaguauagagca

SEQ ID NO: 178001 - RNA, 32 nt, Human
gcuaccaggaaaccuuugccuccuggggcugu

SEQ ID NO: 178002 - RNA, 32 nt, Human
gcuaccaugccuggcuaauuuuuguauuuuua

SEQ ID NO: 178003 - RNA, 32 nt, Human
gcuacccaaauuuucauuucuccacauuuugg

SEQ ID NO: 178004 - RNA, 32 nt, Human
gcuacccaagagaccauggacuguggacucuu

SEQ ID NO: 178005 - RNA, 32 nt, Human
gcuacccaagaguuggaaacuuccuguguugc

SEQ ID NO: 178006 - RNA, 32 nt, Human
gcuacccaaggcuaaggguggggaagaacccc

SEQ ID NO: 178007 - RNA, 32 nt, Human
gcuacccacagcaaccaaagagacuuccucuu

SEQ ID NO: 178008 - RNA, 20 nt, Human
gcuacccacuagcccucacu

SEQ ID NO: 178009 - RNA, 22 nt, Human
gcuacccagaggacccaucaga

SEQ ID NO: 178010 - RNA, 24 nt, Human
gcuacccaucuauguauguaguca

SEQ ID NO: 178011 - RNA, 23 nt, Human
gcuacccaucucuucccacuaga

SEQ ID NO: 178012 - RNA, 32 nt, Human
gcuaccccagccgguuuggauuacaggccugu

SEQ ID NO: 178013 - RNA, 20 nt, Human
gcuaccccaggagugggcca

SEQ ID NO: 178014 - RNA, 22 nt, Human
gcuaccccaggugaaacuggaa

SEQ ID NO: 178015 - RNA, 21 nt, Human
gcuacccccggccccagggca

SEQ ID NO: 178016 - RNA, 32 nt, Human
gcuaccccggcaccaucugcccagcuccaagg

SEQ ID NO: 178017 - RNA, 22 nt, Human
gcuaccccucuaccugcugcug

SEQ ID NO: 178018 - RNA, 21 nt, Human
gcuaccccugcccagcugcug

SEQ ID NO: 178019 - RNA, 32 nt, Human
gcuaccccugucagacagaggcugcggccugg

SEQ ID NO: 178020 - RNA, 32 nt, Human
gcuaccccuguccuggccucugauguuaucca

SEQ ID NO: 178021 - RNA, 32 nt, Human
gcuaccccuuacuccccucugcaacccccauu

SEQ ID NO: 178022 - RNA, 32 nt, Human
gcuacccgagacuggggugggaggauccauug

SEQ ID NO: 178023 - RNA, 32 nt, Human
gcuacccgagguuugcaaauccuucaugucuu

SEQ ID NO: 178024 - RNA, 32 nt, Human
gcuacccgaguuuaguaacagugcagauucca

SEQ ID NO: 178025 - RNA, 18 nt, Human
gcuacccgccagcguguc

SEQ ID NO: 178026 - RNA, 32 nt, Human
gcuacccgggaggcaguggcugcagugagcug

SEQ ID NO: 178027 - RNA, 32 nt, Human
gcuacccuaaagggagaaggaagggcagagaa

SEQ ID NO: 178028 - RNA, 32 nt, Human
gcuacccuccgagccgcgccccugucucaggc

SEQ ID NO: 178029 - RNA, 32 nt, Human
gcuacccugagauguugguggacuggaucucu

SEQ ID NO: 178030 - RNA, 32 nt, Human
gcuacccugaucagagucaucaugccucgagc

SEQ ID NO: 178031 - RNA, 23 nt, Human
gcuaccgccaccgccaccgccac

SEQ ID NO: 178032 - RNA, 27 nt, Human
gcuaccgcccggccucgccgccgccgc

SEQ ID NO: 178033 - RNA, 23 nt, Human
gcuaccgccgccgccgccgccgc

SEQ ID NO: 178034 - RNA, 23 nt, Human
gcuaccgccgucgccgccgccgc

SEQ ID NO: 178035 - RNA, 32 nt, Human
gcuaccguccuggccagcuaccgucagagaga

SEQ ID NO: 178036 - RNA, 32 nt, Human
gcuaccgugucuucacucuccagccugaggug

SEQ ID NO: 178037 - RNA, 32 nt, Human
gcuaccuaccucuuggggacauggcccuguuu

SEQ ID NO: 178038 - RNA, 32 nt, Human
gcuaccuaccuugcccagugcugacccggacc

SEQ ID NO: 178039 - RNA, 32 nt, Human
gcuaccuagugcuuuuucaaucaugccugauu

SEQ ID NO: 178040 - RNA, 32 nt, Human
gcuaccuaucucauguaugaaaauauuguuca

SEQ ID NO: 178041 - RNA, 32 nt, Human
gcuaccuauucuugagagagugagugagugua

SEQ ID NO: 178042 - RNA, 24 nt, Human
gcuaccucagggggacucauggca

SEQ ID NO: 178043 - RNA, 32 nt, Human
gcuaccucagugggagaugagguuggaggaac

SEQ ID NO: 178044 - RNA, 18 nt, Human
gcuaccuccagggacaga

SEQ ID NO: 178045 - RNA, 32 nt, Human
gcuaccucccaggacagaccccugucugacca

SEQ ID NO: 178046 - RNA, 22 nt, Human
gcuaccuccgccagccucgcca

SEQ ID NO: 178047 - RNA, 32 nt, Human
gcuaccucgggauuaugugcaagcugcuuugu

SEQ ID NO: 178048 - RNA, 32 nt, Human
gcuaccucuaccaacccucucucuccagcuag

SEQ ID NO: 178049 - RNA, 32 nt, Human
gcuaccucugcccugcccuccagccugggaca

SEQ ID NO: 178050 - RNA, 23 nt, Human
gcuaccucugggauggacugcgu

SEQ ID NO: 178051 - RNA, 32 nt, Human
gcuaccucuuauuuaccugaaaggaggacacg

SEQ ID NO: 178052 - RNA, 25 nt, Human
gcuaccugccugcugacccaccuga

SEQ ID NO: 178053 - RNA, 32 nt, Human
gcuaccuggcucuggugacacugugccgguug

SEQ ID NO: 178054 - RNA, 32 nt, Human
gcuaccugggcguggcgggugggcaggcggcc

SEQ ID NO: 178055 - RNA, 32 nt, Human
gcuaccuguuuguauccagcaguguuccucau

SEQ ID NO: 178056 - RNA, 32 nt, Human
gcuaccuugcuuguugggggacuggguacagu

SEQ ID NO: 178057 - RNA, 24 nt, Human
gcuaccuugucauguauacaguca

SEQ ID NO: 178058 - RNA, 32 nt, Human
gcuacgagaagcacagucucugccugaggcuc

SEQ ID NO: 178059 - RNA, 32 nt, Human
gcuacgaggcugcaucuggcuccagggaagcg

SEQ ID NO: 178060 - RNA, 23 nt, Human
gcuacgcaggaggauugcuugag

SEQ ID NO: 178061 - RNA, 32 nt, Human
gcuacgcaggguggaggcugggcugaggauua

SEQ ID NO: 178062 - RNA, 19 nt, Human
gcuacgccaaggucaucac

SEQ ID NO: 178063 - RNA, 18 nt, Human
gcuacgccgcugugcucc

SEQ ID NO: 178064 - RNA, 32 nt, Human
gcuacgcucacugcaggcuccgccuccugggu

SEQ ID NO: 178065 - RNA, 19 nt, Human
gcuacggaagggccagggc

SEQ ID NO: 178066 - RNA, 32 nt, Human
gcuacggagagggguggacggcucugcacggg

SEQ ID NO: 178067 - RNA, 32 nt, Human
gcuacggcuguugccaugaggcgaggcuaggg

SEQ ID NO: 178068 - RNA, 19 nt, Human
gcuacgggaggcccggggc

SEQ ID NO: 178069 - RNA, 32 nt, Human
gcuacggggaggacugagaggacagggcugga

SEQ ID NO: 178070 - RNA, 32 nt, Human
gcuacgggguggugauguuccucuuccagcug

SEQ ID NO: 178071 - RNA, 20 nt, Human
gcuacggugcaagcgggggg

SEQ ID NO: 178072 - RNA, 32 nt, Human
gcuacgucacccaaaguagauguuagaaaacc

SEQ ID NO: 178073 - RNA, 32 nt, Human
gcuacgucuuacccgccuccugccucaacagc

SEQ ID NO: 178074 - RNA, 32 nt, Human
gcuacgugacccaggcuggaguguaguagcua

SEQ ID NO: 178075 - RNA, 32 nt, Human
gcuacgugccaaggaggagaagguggaggagg

SEQ ID NO: 178076 - RNA, 32 nt, Human
gcuacgugcuuaaugggcacuggguggucagc

SEQ ID NO: 178077 - RNA, 32 nt, Human
gcuacguuuuauuaaauauuaccaggucagua

SEQ ID NO: 178078 - RNA, 32 nt, Human
gcuacuacacuuugcuccucuggcccaaggca

SEQ ID NO: 178079 - RNA, 32 nt, Human
gcuacuacagggaagaguguucucugcugucu

SEQ ID NO: 178080 - RNA, 32 nt, Human
gcuacuacgcuacagccugggugacagccaga

SEQ ID NO: 178081 - RNA, 32 nt, Human
gcuacuacuaugugcaggaacccuuggucaca

SEQ ID NO: 178082 - RNA, 32 nt, Human
gcuacuacugacuguauugccacuagagaauu

SEQ ID NO: 178083 - RNA, 32 nt, Human
gcuacuaggcaaaggccucuguuucucauuuc

SEQ ID NO: 178084 - RNA, 21 nt, Human
gcuacuaggggggcugaggca

SEQ ID NO: 178085 - RNA, 21 nt, Human
gcuacuaucauucacgauggc

SEQ ID NO: 178086 - RNA, 32 nt, Human
gcuacuauuaucgacauugaccuauuuccaga

SEQ ID NO: 178087 - RNA, 21 nt, Human
gcuacucaagaggcucaggca

SEQ ID NO: 178088 - RNA, 32 nt, Human
gcuacucaaggcugaggcaggagaaucacuug

SEQ ID NO: 178089 - RNA, 21 nt, Human
gcuacucacaaggccgaggua

SEQ ID NO: 178090 - RNA, 32 nt, Human
gcuacucagaguugcaaccucagccucgcuau

SEQ ID NO: 178091 - RNA, 32 nt, Human
gcuacucagcaaacuucuaaaaagcaacaaac

SEQ ID NO: 178092 - RNA, 32 nt, Human
gcuacucagccuuggaaauggagagcacugca

SEQ ID NO: 178093 - RNA, 21 nt, Human
gcuacucaggagccugaggca

SEQ ID NO: 178094 - RNA, 32 nt, Human
gcuacucaggagcugaggcaggagaauugcuu

SEQ ID NO: 178095 - RNA, 21 nt, Human
gcuacucaggaggcucaggca

SEQ ID NO: 178096 - RNA, 32 nt, Human
gcuacucaggaggcugaggcaggugaaucacu

SEQ ID NO: 178097 - RNA, 32 nt, Human
gcuacucaggaggcugaggugggaggaugacu

SEQ ID NO: 178098 - RNA, 32 nt, Human
gcuacucaggaggcugggcaggagaaucccuu

SEQ ID NO: 178099 - RNA, 32 nt, Human
gcuacucaggaggcugggcaggagaauggcgu

SEQ ID NO: 178100 - RNA, 19 nt, Human
gcuacucagggcugaggca

SEQ ID NO: 178101 - RNA, 32 nt, Human
gcuacucaguaggcugaggcagaaggauugcu

SEQ ID NO: 178102 - RNA, 21 nt, Human
gcuacucagugacccagguca

SEQ ID NO: 178103 - RNA, 32 nt, Human
gcuacucaguugauaagaauguuaacauacua

SEQ ID NO: 178104 - RNA, 32 nt, Human
gcuacuccaccccacucuggcuguagugugac

SEQ ID NO: 178105 - RNA, 32 nt, Human
gcuacuccacugaccuggaagagcuggguacc

SEQ ID NO: 178106 - RNA, 19 nt, Human
gcuacuccgagccaaggca

SEQ ID NO: 178107 - RNA, 32 nt, Human
gcuacuccucuccugggcaauauuggcugcuu

SEQ ID NO: 178108 - RNA, 21 nt, Human
gcuacucgagagccugaggca

SEQ ID NO: 178109 - RNA, 21 nt, Human
gcuacucgggaaccugaggca

SEQ ID NO: 178110 - RNA, 21 nt, Human
gcuacucgggagccugaggca

SEQ ID NO: 178111 - RNA, 32 nt, Human
gcuacucgggagguggagguugcagugagcca

SEQ ID NO: 178112 - RNA, 32 nt, Human
gcuacucgggggcugagccaggcggauagcuu

SEQ ID NO: 178113 - RNA, 21 nt, Human
gcuacucggggggccggggca

SEQ ID NO: 178114 - RNA, 32 nt, Human
gcuacucucaggcugcaaguaaguaugaagga

SEQ ID NO: 178115 - RNA, 21 nt, Human
gcuacucugaagacugaggca

SEQ ID NO: 178116 - RNA, 21 nt, Human
gcuacucugaagccugaggca

SEQ ID NO: 178117 - RNA, 32 nt, Human
gcuacucugcaccugggcuggccucaguugaa

SEQ ID NO: 178118 - RNA, 21 nt, Human
gcuacucugggggccaaggca

SEQ ID NO: 178119 - RNA, 32 nt, Human
gcuacucugguuacacagguguccccggcagg

SEQ ID NO: 178120 - RNA, 32 nt, Human
gcuacucuuaggcugcauaguuuaugagaaaa

SEQ ID NO: 178121 - RNA, 32 nt, Human
gcuacucuuccccucacaccuucuacaggcaa

SEQ ID NO: 178122 - RNA, 21 nt, Human
gcuacugaaauaucaauggca

SEQ ID NO: 178123 - RNA, 18 nt, Human
gcuacugaacuacagggu

SEQ ID NO: 178124 - RNA, 20 nt, Human
gcuacugaagaggcugaggu

SEQ ID NO: 178125 - RNA, 26 nt, Human
gcuacugaaguugaggcuuuagggua

SEQ ID NO: 178126 - RNA, 19 nt, Human
gcuacugacaaacucaggc

SEQ ID NO: 178127 - RNA, 20 nt, Human
gcuacugacaagccagggua

SEQ ID NO: 178128 - RNA, 32 nt, Human
gcuacugacacaugacaggaaacaaauggaau

SEQ ID NO: 178129 - RNA, 19 nt, Human
gcuacugaccucucaaggc

SEQ ID NO: 178130 - RNA, 32 nt, Human
gcuacugagacacggcggacacacacaaacac

SEQ ID NO: 178131 - RNA, 21 nt, Human
gcuacugaggaagcugaggca

SEQ ID NO: 178132 - RNA, 21 nt, Human
gcuacugaggaggcugaggca

SEQ ID NO: 178133 - RNA, 21 nt, Human
gcuacugagggggcugaggca

SEQ ID NO: 178134 - RNA, 32 nt, Human
gcuacugaggugucaggagugcagcugggccg

SEQ ID NO: 178135 - RNA, 20 nt, Human
gcuacugagugcuccaggca

SEQ ID NO: 178136 - RNA, 32 nt, Human
gcuacugaugauacaucacccuggggaauuca

SEQ ID NO: 178137 - RNA, 32 nt, Human
gcuacugcaaucaaagcuuauaugagugaaua

SEQ ID NO: 178138 - RNA, 32 nt, Human
gcuacugcacacgugcacccagaagaccgccc

SEQ ID NO: 178139 - RNA, 23 nt, Human
gcuacugcacuccagccagggca

SEQ ID NO: 178140 - RNA, 32 nt, Human
gcuacugcacuccagccuaggugacagaguga

SEQ ID NO: 178141 - RNA, 32 nt, Human
gcuacugcacuccagccugggugacagagcga

SEQ ID NO: 178142 - RNA, 32 nt, Human
gcuacugcacuccagccugggugacagaguga

SEQ ID NO: 178143 - RNA, 32 nt, Human
gcuacugcacuccagccugggugacaguguga

SEQ ID NO: 178144 - RNA, 32 nt, Human
gcuacugcacuccagucugggugacagaguga

SEQ ID NO: 178145 - RNA, 32 nt, Human
gcuacugcacucccgccugggugacagaguga

SEQ ID NO: 178146 - RNA, 32 nt, Human
gcuacugcacucuagauugggugacagagccu

SEQ ID NO: 178147 - RNA, 22 nt, Human
gcuacugcagggaccugagcca

SEQ ID NO: 178148 - RNA, 32 nt, Human
gcuacugcauuccugcuugggcgacagaguga

SEQ ID NO: 178149 - RNA, 32 nt, Human
gcuacugccauccagaaguuacaguuggauug

SEQ ID NO: 178150 - RNA, 32 nt, Human
gcuacugcuacugcugcugcugccaccgccac

SEQ ID NO: 178151 - RNA, 32 nt, Human
gcuacugcuccugcagggcauguggugauccu

SEQ ID NO: 178152 - RNA, 32 nt, Human
gcuacugcucugagcccacuuguugaaaccuc

SEQ ID NO: 178153 - RNA, 23 nt, Human
gcuacugcugcugcuacugcugc

SEQ ID NO: 178154 - RNA, 32 nt, Human
gcuacugcuuuccucccagugucugcugugaa

SEQ ID NO: 178155 - RNA, 32 nt, Human
gcuacugcuuuugcugugccuccaguuugcuc

SEQ ID NO: 178156 - RNA, 21 nt, Human
gcuacuggaagccccagagca

SEQ ID NO: 178157 - RNA, 20 nt, Human
gcuacuggagaggagagaca

SEQ ID NO: 178158 - RNA, 21 nt, Human
gcuacuggagaggcugaggca

SEQ ID NO: 178159 - RNA, 17 nt, Human
gcuacuggagggcgagg

SEQ ID NO: 178160 - RNA, 32 nt, Human
gcuacuggccgguagacuggagcccagcagca

SEQ ID NO: 178161 - RNA, 32 nt, Human
gcuacugggagcugauguggugcuucaccuac

SEQ ID NO: 178162 - RNA, 32 nt, Human
gcuacugggaggagucacugagagcuucguua

SEQ ID NO: 178163 - RNA, 22 nt, Human
gcuacuggggaaagcugaggca

SEQ ID NO: 178164 - RNA, 21 nt, Human
gcuacuggggaagcugaggca

SEQ ID NO: 178165 - RNA, 18 nt, Human
gcuacuggggacgggggc

SEQ ID NO: 178166 - RNA, 21 nt, Human
gcuacuggggaggcugaggca

SEQ ID NO: 178167 - RNA, 32 nt, Human
gcuacuggggcagggagccagguacagagcag

SEQ ID NO: 178168 - RNA, 32 nt, Human
gcuacugggguagcaacugacagcucagaaag

SEQ ID NO: 178169 - RNA, 21 nt, Human
gcuacuggguggaccggaggc

SEQ ID NO: 178170 - RNA, 20 nt, Human
gcuacugguaggccgaggca

SEQ ID NO: 178171 - RNA, 32 nt, Human
gcuacugguaggccgaggcaggagaaucacuu

SEQ ID NO: 178172 - RNA, 20 nt, Human
gcuacuggucaugccaggca

SEQ ID NO: 178173 - RNA, 22 nt, Human
gcuacuguaaguguucugagca

SEQ ID NO: 178174 - RNA, 32 nt, Human
gcuacugucacacccauacuaaccuagggagc

SEQ ID NO: 178175 - RNA, 32 nt, Human
gcuacuguuaaaaggcugcgguucauuucuga

SEQ ID NO: 178176 - RNA, 24 nt, Human
gcuacuuaaaaagagacccaggca

SEQ ID NO: 178177 - RNA, 32 nt, Human
gcuacuuaaauacaaaacuggacaggccaggc

SEQ ID NO: 178178 - RNA, 32 nt, Human
gcuacuuacuucuguggccucuggaaccuuau

SEQ ID NO: 178179 - RNA, 32 nt, Human
gcuacuuagggaggcuaagauaggaggaucac

SEQ ID NO: 178180 - RNA, 32 nt, Human
gcuacuucuccccuccucuugccucccuccug

SEQ ID NO: 178181 - RNA, 32 nt, Human
gcuacuugaaaccuacagaaccgacaaaaauu

SEQ ID NO: 178182 - RNA, 32 nt, Human
gcuacuugcccagguagugaucagugagaguu

SEQ ID NO: 178183 - RNA, 32 nt, Human
gcuacuugcuaguuagaaauucuuaucaauuu

SEQ ID NO: 178184 - RNA, 21 nt, Human
gcuacuugggacaccgaggca

SEQ ID NO: 178185 - RNA, 20 nt, Human
gcuacuugggagagcacugg

SEQ ID NO: 178186 - RNA, 32 nt, Human
gcuacuugggaggcagaggugggaagaugguu

SEQ ID NO: 178187 - RNA, 32 nt, Human
gcuacuugggaggcugaggcaagugaaucacu

SEQ ID NO: 178188 - RNA, 32 nt, Human
gcuacuugggaggcugaggcgggagaguggcg

SEQ ID NO: 178189 - RNA, 32 nt, Human
gcuacuugggaggcugaggugggagccuggga

SEQ ID NO: 178190 - RNA, 21 nt, Human
gcuacuugggagucugaggca

SEQ ID NO: 178191 - RNA, 21 nt, Human
gcuacuugggaugccgaggca

SEQ ID NO: 178192 - RNA, 21 nt, Human
gcuacuugggggccugaggca

SEQ ID NO: 178193 - RNA, 21 nt, Human
gcuacuuggggggcucaggca

SEQ ID NO: 178194 - RNA, 32 nt, Human
gcuacuuggggugggaggaucacaugaaccca

SEQ ID NO: 178195 - RNA, 32 nt, Human
gcuacuuuucacugaggaggugguggaaggug

SEQ ID NO: 178196 - RNA, 32 nt, Human
gcuagaaaaauuucaagacagaaacagucucc

SEQ ID NO: 178197 - RNA, 32 nt, Human
gcuagaaaaccaccacuuuuguccucaagcuu

SEQ ID NO: 178198 - RNA, 32 nt, Human
gcuagaaaauacugcuuucugccaucgauugg

SEQ ID NO: 178199 - RNA, 32 nt, Human
gcuagaaaccagaagacuacgggagggaauau

SEQ ID NO: 178200 - RNA, 32 nt, Human
gcuagaaauagaaagaaaagaaaauugaacau

SEQ ID NO: 178201 - RNA, 32 nt, Human
gcuagaacauaaugugagcaguguuugccuuc

SEQ ID NO: 178202 - RNA, 32 nt, Human
gcuagaaccauggucgccacuguuuucccucu

SEQ ID NO: 178203 - RNA, 32 nt, Human
gcuagaacccaggagacggagguugcagugag

SEQ ID NO: 178204 - RNA, 32 nt, Human
gcuagaaccugcugcaagucacugccuuccaa

SEQ ID NO: 178205 - RNA, 32 nt, Human
gcuagaaccuggagaacuagaaccuggagggc

SEQ ID NO: 178206 - RNA, 18 nt, Human
gcuagaagagaccagaga

SEQ ID NO: 178207 - RNA, 32 nt, Human
gcuagaaggaggaaucagauacccuuuaauau

SEQ ID NO: 178208 - RNA, 32 nt, Human
gcuagaauacagccugaagauccaggaggacu

SEQ ID NO: 178209 - RNA, 32 nt, Human
gcuagaaucuggguuuuauuuuucauagaugg

SEQ ID NO: 178210 - RNA, 32 nt, Human
gcuagaaucuuccuuuucccucucucccuugg

SEQ ID NO: 178211 - RNA, 32 nt, Human
gcuagaaugucacauggauggcugucauaggg

SEQ ID NO: 178212 - RNA, 32 nt, Human
gcuagacaagaagcguuccuggagcugcuuua

SEQ ID NO: 178213 - RNA, 32 nt, Human
gcuagacaaggcauggaagagagaguggccaa

SEQ ID NO: 178214 - RNA, 20 nt, Human
gcuagacacaggcuucucgu

SEQ ID NO: 178215 - RNA, 32 nt, Human
gcuagacagccgcggcggcugcggcgccgaua

SEQ ID NO: 178216 - RNA, 32 nt, Human
gcuagacaggcagguagggaaaucgugaggug

SEQ ID NO: 178217 - RNA, 32 nt, Human
gcuagacagugcuggagacauaguugggggug

SEQ ID NO: 178218 - RNA, 23 nt, Human
gcuagacagugucugccuuucca

SEQ ID NO: 178219 - RNA, 32 nt, Human
gcuagaccaucuuuauaacacugggcuccguc

SEQ ID NO: 178220 - RNA, 32 nt, Human
gcuagacccgugguaccccacagggagggaau

SEQ ID NO: 178221 - RNA, 32 nt, Human
gcuagacuccuaucuucugaauucuauagugc

SEQ ID NO: 178222 - RNA, 32 nt, Human
gcuagacuuauuguauuuacagccuggccacu

SEQ ID NO: 178223 - RNA, 32 nt, Human
gcuagacuucacugcacguuuucucaaguauc

SEQ ID NO: 178224 - RNA, 32 nt, Human
gcuagagaacagcaggucugugcagugucuga

SEQ ID NO: 178225 - RNA, 32 nt, Human
gcuagagaaguuugucucugaagaagcacaaa

SEQ ID NO: 178226 - RNA, 32 nt, Human
gcuagagacaagggggucuaugagcauuuacu

SEQ ID NO: 178227 - RNA, 32 nt, Human
gcuagagaccagccuggucaacauggugaaac

SEQ ID NO: 178228 - RNA, 32 nt, Human
gcuagagacgcugaaggaccuuuacaaucagg

SEQ ID NO: 178229 - RNA, 21 nt, Human
gcuagagacggcugggcccug

SEQ ID NO: 178230 - RNA, 18 nt, Human
gcuagagagcaccugaca

SEQ ID NO: 178231 - RNA, 32 nt, Human
gcuagagagugcucuuggaauauuguugaggc

SEQ ID NO: 178232 - RNA, 32 nt, Human
gcuagagaucauggaagggaagugguugcugu

SEQ ID NO: 178233 - RNA, 32 nt, Human
gcuagagaugugaguuaaaaagacuugccaaa

SEQ ID NO: 178234 - RNA, 32 nt, Human
gcuagagcacagaaaauaggugagcugcaugg

SEQ ID NO: 178235 - RNA, 32 nt, Human
gcuagagcaccagggucagggugcaaggaaga

SEQ ID NO: 178236 - RNA, 22 nt, Human
gcuagagcagcgccucccgccg

SEQ ID NO: 178237 - RNA, 32 nt, Human
gcuagagccagaggaggagggcaaaggggcag

SEQ ID NO: 178238 - RNA, 32 nt, Human
gcuagagccagccugcauccugcccaccgggc

SEQ ID NO: 178239 - RNA, 32 nt, Human
gcuagagcccaggaguucaaagcugcaacgac

SEQ ID NO: 178240 - RNA, 32 nt, Human
gcuagagccuccaggcccuaugaugcucccug

SEQ ID NO: 178241 - RNA, 32 nt, Human
gcuagaggacagugcuccuggccacccagccu

SEQ ID NO: 178242 - RNA, 18 nt, Human
gcuagaggcaugucuccu

SEQ ID NO: 178243 - RNA, 22 nt, Human
gcuagaggcggcucccugggug

SEQ ID NO: 178244 - RNA, 32 nt, Human
gcuagagguugaggacgcccagugagugugca

SEQ ID NO: 178245 - RNA, 32 nt, Human
gcuagagguuuucauuaaaacuuaucagauga

SEQ ID NO: 178246 - RNA, 32 nt, Human
gcuagagucaggaaggugggaguuggcugcug

SEQ ID NO: 178247 - RNA, 32 nt, Human
gcuagagugaacuugggccacugugaagagaa

SEQ ID NO: 178248 - RNA, 32 nt, Human
gcuagagugcaauggcacaaucucgguucacu

SEQ ID NO: 178249 - RNA, 32 nt, Human
gcuagaguucagagacaggaagugauuggucu

SEQ ID NO: 178250 - RNA, 32 nt, Human
gcuagaucaggugccccacuguguuuccugaa

SEQ ID NO: 178251 - RNA, 32 nt, Human
gcuagauccagcccaaaccugggaaggccagc

SEQ ID NO: 178252 - RNA, 32 nt, Human
gcuagaucccuccuuucauugcuguugucucu

SEQ ID NO: 178253 - RNA, 32 nt, Human
gcuagaucuucauuaguuacauucaugaaauu

SEQ ID NO: 178254 - RNA, 32 nt, Human
gcuagaugccacugcccauagacuuauaaguc

SEQ ID NO: 178255 - RNA, 32 nt, Human
gcuagauggucucaaucuccugaucucguggu

SEQ ID NO: 178256 - RNA, 32 nt, Human
gcuagaugugcaaaugcaagcuaguggcuuca

SEQ ID NO: 178257 - RNA, 32 nt, Human
gcuagauguucaauaaauauuuguugaaugag

SEQ ID NO: 178258 - RNA, 32 nt, Human
gcuagauugcagcucccacucagagcaguaug

SEQ ID NO: 178259 - RNA, 32 nt, Human
gcuagauugcuagccuuggcugcuccauuggc

SEQ ID NO: 178260 - RNA, 32 nt, Human
gcuagauuuggucauuccacaauguauaugua

SEQ ID NO: 178261 - RNA, 32 nt, Human
gcuagcaacaacugucucccguccucugcaag

SEQ ID NO: 178262 - RNA, 22 nt, Human
gcuagcaaccaugugccuccca

SEQ ID NO: 178263 - RNA, 32 nt, Human
gcuagcaagaacagaguccacccuccucugga

SEQ ID NO: 178264 - RNA, 32 nt, Human
gcuagcaauagagagacaagugagggaauuag

SEQ ID NO: 178265 - RNA, 32 nt, Human
gcuagcagaaaguuuauuuaaaccacuucuug

SEQ ID NO: 178266 - RNA, 32 nt, Human
gcuagcagagaguugcugcucucuccaacuca

SEQ ID NO: 178267 - RNA, 21 nt, Human
gcuagcagcaucccugcagca

SEQ ID NO: 178268 - RNA, 32 nt, Human
gcuagcagccccgggcccugagcucccgccga

SEQ ID NO: 178269 - RNA, 19 nt, Human
gcuagcagccuggggccuc

SEQ ID NO: 178270 - RNA, 24 nt, Human
gcuagcagcucagcagggccucua

SEQ ID NO: 178271 - RNA, 32 nt, Human
gcuagcaggaaucugauuuaauuucuugcugc

SEQ ID NO: 178272 - RNA, 32 nt, Human
gcuagcagggguugagacugcagccuggccug

SEQ ID NO: 178273 - RNA, 22 nt, Human
gcuagcaguucccauucaggca

SEQ ID NO: 178274 - RNA, 32 nt, Human
gcuagcaucucugucucucaaacauagggagg

SEQ ID NO: 178275 - RNA, 19 nt, Human
gcuagccaagaguucgagg

SEQ ID NO: 178276 - RNA, 32 nt, Human
gcuagccacugugcuccagccugggcaacacc

SEQ ID NO: 178277 - RNA, 32 nt, Human
gcuagccaggaggcccgggggcuccggcugag

SEQ ID NO: 178278 - RNA, 32 nt, Human
gcuagccauggucaucugacagucucuacgcu

SEQ ID NO: 178279 - RNA, 32 nt, Human
gcuagcccaccgcagcagccucccucccucuc

SEQ ID NO: 178280 - RNA, 32 nt, Human
gcuagcccacugacauuggaaaaagcugugaa

SEQ ID NO: 178281 - RNA, 32 nt, Human
gcuagcccccuuccccacuucuuacacuccaa

SEQ ID NO: 178282 - RNA, 32 nt, Human
gcuagccccugccccaauccugcccuggccug

SEQ ID NO: 178283 - RNA, 32 nt, Human
gcuagcccggaaggaggagcaagagccagggg

SEQ ID NO: 178284 - RNA, 32 nt, Human
gcuagcccuccuccugaagcagucuaggagcu

SEQ ID NO: 178285 - RNA, 32 nt, Human
gcuagcccucgccucugccauccgauacuaaa

SEQ ID NO: 178286 - RNA, 32 nt, Human
gcuagccggccuggccauggcugaccgcgggu

SEQ ID NO: 178287 - RNA, 24 nt, Human
gcuagccucaaacuccugggcuca

SEQ ID NO: 178288 - RNA, 32 nt, Human
gcuagccucccugagcuuucuggcuucaggcu

SEQ ID NO: 178289 - RNA, 32 nt, Human
gcuagccugagugcacccagaugcgcuucugu

SEQ ID NO: 178290 - RNA, 32 nt, Human
gcuagccugggcaacacgcugagacccuaucc

SEQ ID NO: 178291 - RNA, 32 nt, Human
gcuagccugggcaacagagugagaccccguuu

SEQ ID NO: 178292 - RNA, 32 nt, Human
gcuagccugggugacacaggaagacuccaucu

SEQ ID NO: 178293 - RNA, 32 nt, Human
gcuagcgagggcccuggccucaccuccuggug

SEQ ID NO: 178294 - RNA, 32 nt, Human
gcuagcgggaaagagauggggauggaguccca

SEQ ID NO: 178295 - RNA, 32 nt, Human
gcuagcggggacugaaggccgggagcccacuc

SEQ ID NO: 178296 - RNA, 32 nt, Human
gcuagcgucguggcucaugccuguaaucccag

SEQ ID NO: 178297 - RNA, 32 nt, Human
gcuagcgugugccaggcagauccucuggacac

SEQ ID NO: 178298 - RNA, 32 nt, Human
gcuagcuacacacacgcccucacgcccggcga

SEQ ID NO: 178299 - RNA, 32 nt, Human
gcuagcuaucauuaccaguuagaauuaacauu

SEQ ID NO: 178300 - RNA, 32 nt, Human
gcuagcuccauggcuuagcggaggaggcggca

SEQ ID NO: 178301 - RNA, 32 nt, Human
gcuagcucccucacccuuccaccuucucacuc

SEQ ID NO: 178302 - RNA, 32 nt, Human
gcuagcuccugaccccagcccagcaggcuguc

SEQ ID NO: 178303 - RNA, 32 nt, Human
gcuagcucgugcuacauugaaacuugaguuug

SEQ ID NO: 178304 - RNA, 32 nt, Human
gcuagcucuccucccuuccgcuccugcuucuc

SEQ ID NO: 178305 - RNA, 32 nt, Human
gcuagcucuuugagcuagagagcuguaggaag

SEQ ID NO: 178306 - RNA, 32 nt, Human
gcuagcugcugccuccuuacuccuggcccucu

SEQ ID NO: 178307 - RNA, 32 nt, Human
gcuagcuggauccucuaggcaggauggugaug

SEQ ID NO: 178308 - RNA, 16 nt, Human
gcuagcuggccaggug

SEQ ID NO: 178309 - RNA, 32 nt, Human
gcuagcugggcaagaaagcagcaguggaccug

SEQ ID NO: 178310 - RNA, 32 nt, Human
gcuagcugugagaaccucaucaugcuccuuga

SEQ ID NO: 178311 - RNA, 32 nt, Human
gcuaggaaaggaaaaggcuaggugcucccuga

SEQ ID NO: 178312 - RNA, 32 nt, Human
gcuaggaaaggcagaaacacaaccacucacca

SEQ ID NO: 178313 - RNA, 32 nt, Human
gcuaggaaaugagagcacaguuuugggaaaug

SEQ ID NO: 178314 - RNA, 32 nt, Human
gcuaggaagcaaaucuuccuucugcugcauaa

SEQ ID NO: 178315 - RNA, 32 nt, Human
gcuaggaagcucuauucuguucaccauagaaa

SEQ ID NO: 178316 - RNA, 32 nt, Human
gcuaggaaguguuggagccagaaauggaaccu

SEQ ID NO: 178317 - RNA, 23 nt, Human
gcuaggacagaaacuguaaaaag

SEQ ID NO: 178318 - RNA, 32 nt, Human
gcuaggaccagccucgccugugggguugagcu

SEQ ID NO: 178319 - RNA, 32 nt, Human
gcuaggacguuggccucagggccaggaaggac

SEQ ID NO: 178320 - RNA, 32 nt, Human
gcuaggacuacaggcagugugccaccacaucc

SEQ ID NO: 178321 - RNA, 32 nt, Human
gcuaggacuagggugagagggaguggggaggg

SEQ ID NO: 178322 - RNA, 19 nt, Human
gcuaggagaggcugggccc

SEQ ID NO: 178323 - RNA, 32 nt, Human
gcuaggagauacucuucugccuccuagaccug

SEQ ID NO: 178324 - RNA, 32 nt, Human
gcuaggagccagccuggguggcgcugcuccca

SEQ ID NO: 178325 - RNA, 32 nt, Human
gcuaggagccauguggaccugcuuuucugcca

SEQ ID NO: 178326 - RNA, 32 nt, Human
gcuaggaggacagccuggucagcagggcugca

SEQ ID NO: 178327 - RNA, 32 nt, Human
gcuaggaggcccuguuccucacugcggauggu

SEQ ID NO: 178328 - RNA, 32 nt, Human
gcuaggaggcugagacaggagaauggugugaa

SEQ ID NO: 178329 - RNA, 32 nt, Human
gcuaggaucccaaaggacuccuuguccccuag

SEQ ID NO: 178330 - RNA, 32 nt, Human
gcuaggaucgugccacugcacuccaaccuggg

SEQ ID NO: 178331 - RNA, 32 nt, Human
gcuaggaugcgcucuguccacccauggcccug

SEQ ID NO: 178332 - RNA, 32 nt, Human
gcuaggaugugagagacacagucaccugcagc

SEQ ID NO: 178333 - RNA, 32 nt, Human
gcuaggauugguucacccuugcucugaguugg

SEQ ID NO: 178334 - RNA, 32 nt, Human
gcuaggauuuggagaauaaguguguacagauc

SEQ ID NO: 178335 - RNA, 32 nt, Human
gcuaggcagacaguggggacugugcauauuug

SEQ ID NO: 178336 - RNA, 32 nt, Human
gcuaggcagcucccugcccuccgugugugucu

SEQ ID NO: 178337 - RNA, 32 nt, Human
gcuaggcaggagagacaagggguaggugggag

SEQ ID NO: 178338 - RNA, 32 nt, Human
gcuaggcaugccugggaauccugcugccagag

SEQ ID NO: 178339 - RNA, 32 nt, Human
gcuaggcaugguggacucgccuguaaucucac

SEQ ID NO: 178340 - RNA, 32 nt, Human
gcuaggcauucaagaccagccuaggcaggaua

SEQ ID NO: 178341 - RNA, 32 nt, Human
gcuaggccagagcuggaagcagacaguaaggg

SEQ ID NO: 178342 - RNA, 32 nt, Human
gcuaggcccagaaagaaaagaggcucucagca

SEQ ID NO: 178343 - RNA, 32 nt, Human
gcuaggcccgggaggcgcaggcgcaggcgcag

SEQ ID NO: 178344 - RNA, 16 nt, Human
gcuaggccggguccag

SEQ ID NO: 178345 - RNA, 32 nt, Human
gcuaggccucgaggccuagccgagugggagug

SEQ ID NO: 178346 - RNA, 32 nt, Human
gcuaggccugcugggagaggaugaggaggagg

SEQ ID NO: 178347 - RNA, 22 nt, Human
gcuaggccugggccaggccccg

SEQ ID NO: 178348 - RNA, 32 nt, Human
gcuaggccuuuccugccgagugcucugaugca

SEQ ID NO: 178349 - RNA, 16 nt, Human
gcuaggcgcucacaga

SEQ ID NO: 178350 - RNA, 23 nt, Human
gcuaggcucaaguguggggccac

SEQ ID NO: 178351 - RNA, 32 nt, Human
gcuaggcuccaggcgccucggaggcuuuggca

SEQ ID NO: 178352 - RNA, 20 nt, Human
gcuaggcugaaguguagugg

SEQ ID NO: 178353 - RNA, 32 nt, Human
gcuaggcugugaggugccuuagggcaggucuc

SEQ ID NO: 178354 - RNA, 32 nt, Human
gcuaggcuuuucucuuuuguccuuccuguugg

SEQ ID NO: 178355 - RNA, 32 nt, Human
gcuagggaaagagauuuagaagccuucagcag

SEQ ID NO: 178356 - RNA, 24 nt, Human
gcuagggaaggcagaacugggccc

SEQ ID NO: 178357 - RNA, 20 nt, Human
gcuagggagagugggggaag

SEQ ID NO: 178358 - RNA, 21 nt, Human
gcuagggccucgccgccagga

SEQ ID NO: 178359 - RNA, 32 nt, Human
gcuagggcuucccccuucuccccaucccgguc

SEQ ID NO: 178360 - RNA, 32 nt, Human
gcuaggggacgaugauguggcagauggcucgg

SEQ ID NO: 178361 - RNA, 17 nt, Human
gcuaggggagcaggggg

SEQ ID NO: 178362 - RNA, 32 nt, Human
gcuaggggaggaaggaaggaaggaagggcggc

SEQ ID NO: 178363 - RNA, 32 nt, Human
gcuaggggaggaaguucuccagccccuugugc

SEQ ID NO: 178364 - RNA, 32 nt, Human
gcuaggggagugcugugcugauucuccagcca

SEQ ID NO: 178365 - RNA, 32 nt, Human
gcuaggggccgaguccaggagccccagccagc

SEQ ID NO: 178366 - RNA, 23 nt, Human
gcuaggggcugggcaaggccccg

SEQ ID NO: 178367 - RNA, 32 nt, Human
gcuaggggguguuucucagcacacugcagaag

SEQ ID NO: 178368 - RNA, 32 nt, Human
gcuaggggguguuugcugagugagugagugaa

SEQ ID NO: 178369 - RNA, 32 nt, Human
gcuaggggucaggccagauggggcaggaaggc

SEQ ID NO: 178370 - RNA, 32 nt, Human
gcuagggguuuuccuguggaaggucugagcuc

SEQ ID NO: 178371 - RNA, 32 nt, Human
gcuagggucccaaacucucuugcauuuguuca

SEQ ID NO: 178372 - RNA, 32 nt, Human
gcuagggugcaggaggcuuccagaagcaguug

SEQ ID NO: 178373 - RNA, 32 nt, Human
gcuaggucaaagacgcccgggccaggugcccc

SEQ ID NO: 178374 - RNA, 32 nt, Human
gcuaggugcucagucacuaauggucucgcgaa

SEQ ID NO: 178375 - RNA, 32 nt, Human
gcuagguggguugaaagccaaggagucacuga

SEQ ID NO: 178376 - RNA, 31 nt, Human
gcuagguuaggcaaggaggugguuggccaga

SEQ ID NO: 178377 - RNA, 32 nt, Human
gcuaguaaaggacuggcuucauucuaauuaug

SEQ ID NO: 178378 - RNA, 32 nt, Human
gcuaguaaaggcuagcaagugaggcuuugucu

SEQ ID NO: 178379 - RNA, 32 nt, Human
gcuaguaccaagcugcuaucaucagcugaugc

SEQ ID NO: 178380 - RNA, 23 nt, Human
gcuaguaggacucuuccuugaca

SEQ ID NO: 178381 - RNA, 32 nt, Human
gcuaguaucaaagaagaacggggagaugaagu

SEQ ID NO: 178382 - RNA, 32 nt, Human
gcuagucccgagagugucagacaaggaagaaa

SEQ ID NO: 178383 - RNA, 32 nt, Human
gcuaguccuuucucgucgcugcucggcucgcg

SEQ ID NO: 178384 - RNA, 32 nt, Human
gcuagucggaggaucauaagcaagcucagacc

SEQ ID NO: 178385 - RNA, 32 nt, Human
gcuagucucuucucuucugugaucucaguagg

SEQ ID NO: 178386 - RNA, 24 nt, Human
gcuagucuggaacuccugagcuca

SEQ ID NO: 178387 - RNA, 24 nt, Human
gcuagucuugaacuccugggccca

SEQ ID NO: 178388 - RNA, 24 nt, Human
gcuagucuugaacuccugggcuca

SEQ ID NO: 178389 - RNA, 32 nt, Human
gcuagugaccugcgguucacauagagggguca

SEQ ID NO: 178390 - RNA, 32 nt, Human
gcuagugagaggaggaggaggugggcagagga

SEQ ID NO: 178391 - RNA, 32 nt, Human
gcuagugaucacaccagggguuagaguucacu

SEQ ID NO: 178392 - RNA, 32 nt, Human
gcuagugcagcugugacuuucaguuaaagcca

SEQ ID NO: 178393 - RNA, 32 nt, Human
gcuagugcccucucucugggcccagggcugug

SEQ ID NO: 178394 - RNA, 32 nt, Human
gcuagugcgauguuucaggaggcuggaggaag

SEQ ID NO: 178395 - RNA, 20 nt, Human
gcuagugcucccaccccgcc

SEQ ID NO: 178396 - RNA, 32 nt, Human
gcuagugcuggcugcagggucccaggugcagg

SEQ ID NO: 178397 - RNA, 32 nt, Human
gcuagugcuguccucccaucuccugugggcag

SEQ ID NO: 178398 - RNA, 23 nt, Human
gcuaguggcucaugccuguaauc

SEQ ID NO: 178399 - RNA, 32 nt, Human
gcuagugggcuucaggugcaaggguaccugug

SEQ ID NO: 178400 - RNA, 20 nt, Human
gcuagugggggacucgaggc

SEQ ID NO: 178401 - RNA, 32 nt, Human
gcuaguggugguggccagcgugcagugagcug

SEQ ID NO: 178402 - RNA, 32 nt, Human
gcuagugucacccaggcuggagugcagugauc

SEQ ID NO: 178403 - RNA, 32 nt, Human
gcuagugugguguuuccugggcacugcuucca

SEQ ID NO: 178404 - RNA, 31 nt, Human
gcuaguguugcccaggcuggagugcaguggc

SEQ ID NO: 178405 - RNA, 32 nt, Human
gcuaguuacuggggguguugggggagacagga

SEQ ID NO: 178406 - RNA, 32 nt, Human
gcuaguuagaucauuugcaucucuccaccauu

SEQ ID NO: 178407 - RNA, 32 nt, Human
gcuaguuaguacucaauaaacaaugcauugaa

SEQ ID NO: 178408 - RNA, 32 nt, Human
gcuaguuccgagcuagguaugacagggacagg

SEQ ID NO: 178409 - RNA, 32 nt, Human
gcuaguucucucucuauauaauuuauaaaaac

SEQ ID NO: 178410 - RNA, 32 nt, Human
gcuaguuguaguuucacucacucauucauuca

SEQ ID NO: 178411 - RNA, 32 nt, Human
gcuaguuucuguauuuuuaguagagacggcgu

SEQ ID NO: 178412 - RNA, 32 nt, Human
gcuaguuuggccugacacuaccaguaaccuac

SEQ ID NO: 178413 - RNA, 32 nt, Human
gcuaguuuguguggcccugccccuggugccca

SEQ ID NO: 178414 - RNA, 32 nt, Human
gcuaguuuuauuuuucuuguuuugcauuaugu

SEQ ID NO: 178415 - RNA, 32 nt, Human
gcuaguuuucuacugagugaagccauuacguc

SEQ ID NO: 178416 - RNA, 32 nt, Human
gcuauaaaaucagacaaacauuagcugggccu

SEQ ID NO: 178417 - RNA, 32 nt, Human
gcuauaaagguaauuguaaaaauaaauacagu

SEQ ID NO: 178418 - RNA, 32 nt, Human
gcuauaacauuugcugaauaugcaauuuguua

SEQ ID NO: 178419 - RNA, 32 nt, Human
gcuauaacuuugaaucccuucacuuucuuccu

SEQ ID NO: 178420 - RNA, 32 nt, Human
gcuauaaggggcuccaggugggugcugcuguu

SEQ ID NO: 178421 - RNA, 32 nt, Human
gcuauaauaauagcuaaugacacugugcuaag

SEQ ID NO: 178422 - RNA, 32 nt, Human
gcuauaaugcagacuugagcaaaaagaggagg

SEQ ID NO: 178423 - RNA, 32 nt, Human
gcuauaauguacugaaaccaccauauuacaga

SEQ ID NO: 178424 - RNA, 32 nt, Human
gcuauacauauacaacauuacagucugucugu

SEQ ID NO: 178425 - RNA, 32 nt, Human
gcuauacaucuucaucccuccccaccauccug

SEQ ID NO: 178426 - RNA, 32 nt, Human
gcuauacauucuauguaugaggugcuacauuu

SEQ ID NO: 178427 - RNA, 32 nt, Human
gcuauaccacagucuuucguuuccagccuuug

SEQ ID NO: 178428 - RNA, 32 nt, Human
gcuauacccaggagggagcaagcagccugaug

SEQ ID NO: 178429 - RNA, 32 nt, Human
gcuauaccccucuccccaucccuguuauagaa

SEQ ID NO: 178430 - RNA, 32 nt, Human
gcuauagaaaguugguacaaaugaucuguacu

SEQ ID NO: 178431 - RNA, 32 nt, Human
gcuauagacagaaauaauaagccacccugggu

SEQ ID NO: 178432 - RNA, 32 nt, Human
gcuauagacuccaagcaaggcuugggguccuu

SEQ ID NO: 178433 - RNA, 32 nt, Human
gcuauagagccgggugagagagcgagcgcccg

SEQ ID NO: 178434 - RNA, 32 nt, Human
gcuauagcauuuuuauagcauucaaaugcuug

SEQ ID NO: 178435 - RNA, 32 nt, Human
gcuauagccccagggacccagggcagagcaca

SEQ ID NO: 178436 - RNA, 32 nt, Human
gcuauagcggauucuguucugccugcugcuca

SEQ ID NO: 178437 - RNA, 32 nt, Human
gcuauaggaaggccucuggcucugccuuggac

SEQ ID NO: 178438 - RNA, 32 nt, Human
gcuauaggcgcauggaagguucccuggaacgg

SEQ ID NO: 178439 - RNA, 32 nt, Human
gcuauagggccgucugucucgagucagcuguc

SEQ ID NO: 178440 - RNA, 32 nt, Human
gcuauagguggagcaucagcagugagugaggc

SEQ ID NO: 178441 - RNA, 32 nt, Human
gcuauagucugagcuacucaggaggcugaugu

SEQ ID NO: 178442 - RNA, 32 nt, Human
gcuauauagguauuuuaccaacccauuuuaag

SEQ ID NO: 178443 - RNA, 32 nt, Human
gcuauauccauccuuuaauccaacacacaccu

SEQ ID NO: 178444 - RNA, 32 nt, Human
gcuauaugacucuucugcuuccugauaagaaa

SEQ ID NO: 178445 - RNA, 32 nt, Human
gcuauaugcauuugccuucauccacccauguu

SEQ ID NO: 178446 - RNA, 32 nt, Human
gcuauaugcugguacaugcuuuaaacauggag

SEQ ID NO: 178447 - RNA, 32 nt, Human
gcuauauggaaauguuccaucagcaaagagaa

SEQ ID NO: 178448 - RNA, 32 nt, Human
gcuauauugcccaggcuggucuugaaguccug

SEQ ID NO: 178449 - RNA, 32 nt, Human
gcuauauuugguaccugucucucuccuacugu

SEQ ID NO: 178450 - RNA, 32 nt, Human
gcuaucaaaccauuuacccuugcccccacaac

SEQ ID NO: 178451 - RNA, 31 nt, Human
gcuaucaacaauccuguacucacuugaagaa

SEQ ID NO: 178452 - RNA, 32 nt, Human
gcuaucaauccaaaacugaugcagcuugugga

SEQ ID NO: 178453 - RNA, 20 nt, Human
gcuaucacaccuggccccag

SEQ ID NO: 178454 - RNA, 32 nt, Human
gcuaucaccaguaccucucagcuuacucuuca

SEQ ID NO: 178455 - RNA, 32 nt, Human
gcuaucagaagaucuuguggauuccagcggga

SEQ ID NO: 178456 - RNA, 32 nt, Human
gcuaucaguucuguccuggcccuuucaguuuu

SEQ ID NO: 178457 - RNA, 32 nt, Human
gcuaucaugauuggcugggccugcugcuguuc

SEQ ID NO: 178458 - RNA, 32 nt, Human
gcuaucauuccaaaggaggauggcauauaaua

SEQ ID NO: 178459 - RNA, 32 nt, Human
gcuauccaauacaguaaccacaugcggcuguu

SEQ ID NO: 178460 - RNA, 32 nt, Human
gcuauccacaaacugcccagguaacugccaua

SEQ ID NO: 178461 - RNA, 32 nt, Human
gcuaucccagaggucgaggcugcagugagcug

SEQ ID NO: 178462 - RNA, 32 nt, Human
gcuaucccagcagccuucagggugggaggcac

SEQ ID NO: 178463 - RNA, 32 nt, Human
gcuaucccaguuccccacugccagggaacccc

SEQ ID NO: 178464 - RNA, 32 nt, Human
gcuaucccaucugcccccaucuggagcucggc

SEQ ID NO: 178465 - RNA, 32 nt, Human
gcuauccccaucucccugccuggcccccaacc

SEQ ID NO: 178466 - RNA, 32 nt, Human
gcuaucccccuuccuuuccucccucccucugc

SEQ ID NO: 178467 - RNA, 32 nt, Human
gcuauccucacacucauggcuaccagugggcc

SEQ ID NO: 178468 - RNA, 32 nt, Human
gcuauccuccaucccccuugaggcuuccacuu

SEQ ID NO: 178469 - RNA, 32 nt, Human
gcuauccucugccuucccaagucccucuuggg

SEQ ID NO: 178470 - RNA, 32 nt, Human
gcuauccuuccccucaccccucagcccaggag

SEQ ID NO: 178471 - RNA, 23 nt, Human
gcuauccuugcaccucagccucc

SEQ ID NO: 178472 - RNA, 32 nt, Human
gcuaucgagcccuggugcuauguggccccgga

SEQ ID NO: 178473 - RNA, 32 nt, Human
gcuaucgaggagacccagugagaauguagcau

SEQ ID NO: 178474 - RNA, 32 nt, Human
gcuaucuagcauggcauugucaccaacucccu

SEQ ID NO: 178475 - RNA, 32 nt, Human
gcuaucucaacuacaagcuacaagcuccucua

SEQ ID NO: 178476 - RNA, 32 nt, Human
gcuaucucagccacauuguuggcaauuuaauu

SEQ ID NO: 178477 - RNA, 32 nt, Human
gcuaucucaguucuguagcagaucccugguuc

SEQ ID NO: 178478 - RNA, 32 nt, Human
gcuaucucauuucacucuacugucucaaaauu

SEQ ID NO: 178479 - RNA, 24 nt, Human
gcuaucuccauacaugaacaaucu

SEQ ID NO: 178480 - RNA, 32 nt, Human
gcuaucugagucuuuccaagagcaauugccaa

SEQ ID NO: 178481 - RNA, 32 nt, Human
gcuaucuggccagauuuaaguagauucuauuu

SEQ ID NO: 178482 - RNA, 32 nt, Human
gcuaucuggggagggggagaggaggccgagca

SEQ ID NO: 178483 - RNA, 32 nt, Human
gcuaucuugcccaggcuugcaauuuauagagc

SEQ ID NO: 178484 - RNA, 32 nt, Human
gcuaucuuuccucugcucauggcauauaaagc

SEQ ID NO: 178485 - RNA, 32 nt, Human
gcuaucuuugaucucuuccuccagaucagagu

SEQ ID NO: 178486 - RNA, 32 nt, Human
gcuaugaaacaugcacuaaggucuaauaggga

SEQ ID NO: 178487 - RNA, 32 nt, Human
gcuaugaaaucaggaaacugucuccuuuuccu

SEQ ID NO: 178488 - RNA, 32 nt, Human
gcuaugaacaccacugcacuccaccuguccac

SEQ ID NO: 178489 - RNA, 32 nt, Human
gcuaugaagaagcucaagaccagccuguauca

SEQ ID NO: 178490 - RNA, 28 nt, Human
gcuaugaagucuuacacuccauauuuca

SEQ ID NO: 178491 - RNA, 32 nt, Human
gcuaugacgagcuccagaugcugcagucacgg

SEQ ID NO: 178492 - RNA, 32 nt, Human
gcuaugacugcaggaucagucuaacuauacua

SEQ ID NO: 178493 - RNA, 32 nt, Human
gcuaugagccuguaaaaucaaaagcaaguuag

SEQ ID NO: 178494 - RNA, 32 nt, Human
gcuaugagucccggggauggugaggaacgcca

SEQ ID NO: 178495 - RNA, 32 nt, Human
gcuaugaucacaccacuacacuccagccugga

SEQ ID NO: 178496 - RNA, 32 nt, Human
gcuaugauugugccacugcacuccagccuggg

SEQ ID NO: 178497 - RNA, 32 nt, Human
gcuaugauugugccacuguacuccagccuggg

SEQ ID NO: 178498 - RNA, 32 nt, Human
gcuaugcaaauguguucacaggcaaugggggu

SEQ ID NO: 178499 - RNA, 24 nt, Human
gcuaugcacuugauugccuuugug

SEQ ID NO: 178500 - RNA, 32 nt, Human
gcuaugcagggggagagcacaggacuggcccu

SEQ ID NO: 178501 - RNA, 32 nt, Human
gcuaugcagguggucugagcucggccuauggg

SEQ ID NO: 178502 - RNA, 32 nt, Human
gcuaugcaggugugugggcuggagggacuuug

SEQ ID NO: 178503 - RNA, 32 nt, Human
gcuaugccacuggccucaaugccagcuccuga

SEQ ID NO: 178504 - RNA, 18 nt, Human
gcuaugccagcugggcca

SEQ ID NO: 178505 - RNA, 32 nt, Human
gcuaugccagugagcagugauuuuaacuauuc

SEQ ID NO: 178506 - RNA, 32 nt, Human
gcuaugccaugaggccgggaauuuguguccgg

SEQ ID NO: 178507 - RNA, 32 nt, Human
gcuaugccugcacugcagcccagccccggaca

SEQ ID NO: 178508 - RNA, 32 nt, Human
gcuaugccugggaaaaugguuugucuuccagg

SEQ ID NO: 178509 - RNA, 32 nt, Human
gcuaugccuggugugacccccagggucuuggu

SEQ ID NO: 178510 - RNA, 32 nt, Human
gcuaugcguucgaggccaaccuaggcaaaauu

SEQ ID NO: 178511 - RNA, 24 nt, Human
gcuaugcugcccaggcugaucuca

SEQ ID NO: 178512 - RNA, 32 nt, Human
gcuaugcuuccugaacagcccacagaacuaug

SEQ ID NO: 178513 - RNA, 32 nt, Human
gcuauggaaaaccaggccagagggucacuguc

SEQ ID NO: 178514 - RNA, 32 nt, Human
gcuauggaaccaacacacccagcuccacccuc

SEQ ID NO: 178515 - RNA, 32 nt, Human
gcuauggaauacaaaauguacugacauuuugu

SEQ ID NO: 178516 - RNA, 32 nt, Human
gcuauggacaguucccggaaacgguugcccac

SEQ ID NO: 178517 - RNA, 32 nt, Human
gcuauggaggcagagaccagggugugcaaccu

SEQ ID NO: 178518 - RNA, 32 nt, Human
gcuauggaguuucuguaguauucacuacucca

SEQ ID NO: 178519 - RNA, 20 nt, Human
gcuauggauggggcccaggg

SEQ ID NO: 178520 - RNA, 32 nt, Human
gcuauggcaguggcagauuuuaauuaggaaac

SEQ ID NO: 178521 - RNA, 20 nt, Human
gcuauggcauaauuugcaga

SEQ ID NO: 178522 - RNA, 32 nt, Human
gcuauggccucccuaugcuuucacuucccacc

SEQ ID NO: 178523 - RNA, 32 nt, Human
gcuauggccuucgucugugccggcuuauccga

SEQ ID NO: 178524 - RNA, 20 nt, Human
gcuauggcggcggcagccga

SEQ ID NO: 178525 - RNA, 32 nt, Human
gcuauggcucagggaucuguguugacucuggc

SEQ ID NO: 178526 - RNA, 32 nt, Human
gcuauggcuuuauuucccucuaccuucguaac

SEQ ID NO: 178527 - RNA, 32 nt, Human
gcuaugggaagugccaucaggguggccgcagc

SEQ ID NO: 178528 - RNA, 32 nt, Human
gcuaugggggauggcaccucucagcccuccca

SEQ ID NO: 178529 - RNA, 32 nt, Human
gcuaugggucacguccugcagcuuugaccccc

SEQ ID NO: 178530 - RNA, 32 nt, Human
gcuaugguagugcagauuaugauuauggugaa

SEQ ID NO: 178531 - RNA, 28 nt, Human
gcuauggugccaggggaggagccagcgc

SEQ ID NO: 178532 - RNA, 32 nt, Human
gcuaugguuggggguaguuagggagagacuac

SEQ ID NO: 178533 - RNA, 32 nt, Human
gcuauguaaggaugagaugcaaaguggaguuu

SEQ ID NO: 178534 - RNA, 32 nt, Human
gcuaugucacucaggcuggagugcaguggcac

SEQ ID NO: 178535 - RNA, 32 nt, Human
gcuaugucucccaggcuggagugcaguggcac

SEQ ID NO: 178536 - RNA, 22 nt, Human
gcuaugucucuagcagugagua

SEQ ID NO: 178537 - RNA, 32 nt, Human
gcuaugugaccaggaaucuagccgggaguagc

SEQ ID NO: 178538 - RNA, 23 nt, Human
gcuaugugaugccugagcacaaa

SEQ ID NO: 178539 - RNA, 32 nt, Human
gcuaugugccagcuguugcacacucaccucca

SEQ ID NO: 178540 - RNA, 32 nt, Human
gcuaugugguauagccuguugcuucuaggcua

SEQ ID NO: 178541 - RNA, 32 nt, Human
gcuauguggucaccagcaggagaaagcuuuga

SEQ ID NO: 178542 - RNA, 32 nt, Human
gcuaugugugccagggcucaucuacuccugua

SEQ ID NO: 178543 - RNA, 32 nt, Human
gcuauguguuaagugccaggacauuucuagcu

SEQ ID NO: 178544 - RNA, 32 nt, Human
gcuauguucacagccuacuuuaucucuccuug

SEQ ID NO: 178545 - RNA, 32 nt, Human
gcuauguuccacccuccccuucaacugccccu

SEQ ID NO: 178546 - RNA, 32 nt, Human
gcuauguucuucauucugugcaauaucaaaac

SEQ ID NO: 178547 - RNA, 24 nt, Human
gcuauguugcccaggccagucuca

SEQ ID NO: 178548 - RNA, 32 nt, Human
gcuauguugcccaggcuagagugcaguggcua

SEQ ID NO: 178549 - RNA, 24 nt, Human
gcuauguugcccaggcuggucuca

SEQ ID NO: 178550 - RNA, 32 nt, Human
gcuauguugcccaggcuggucuuuaauuccug

SEQ ID NO: 178551 - RNA, 32 nt, Human
gcuauguugcccaggcugguugcaaacuucug

SEQ ID NO: 178552 - RNA, 32 nt, Human
gcuauuaacugugguugugcuggaauggagga

SEQ ID NO: 178553 - RNA, 32 nt, Human
gcuauuacuauauuuacuugcauaugucagaa

SEQ ID NO: 178554 - RNA, 32 nt, Human
gcuauuagcaugaaggauaguaaccacaaagu

SEQ ID NO: 178555 - RNA, 32 nt, Human
gcuauuaggaaaacuaaacaagaaaugaggcu

SEQ ID NO: 178556 - RNA, 32 nt, Human
gcuauuauaguuaauugaaauggaauuggcaa

SEQ ID NO: 178557 - RNA, 32 nt, Human
gcuauuaucuguguuaucuuuacagucacggg

SEQ ID NO: 178558 - RNA, 32 nt, Human
gcuauuaugacaacaucaccaauguuguggua

SEQ ID NO: 178559 - RNA, 32 nt, Human
gcuauuauuaagagaacaagcacacaguggaa

SEQ ID NO: 178560 - RNA, 32 nt, Human
gcuauuauucauggacuauccagucuaacagc

SEQ ID NO: 178561 - RNA, 32 nt, Human
gcuauucaccucaguagaaaagaaucuaaggg

SEQ ID NO: 178562 - RNA, 32 nt, Human
gcuauucaccucaguagaaaaggaucuaaggg

SEQ ID NO: 178563 - RNA, 21 nt, Human
gcuauucagggggcugaggca

SEQ ID NO: 178564 - RNA, 32 nt, Human
gcuauuccagaacccagccuccuggguuuccc

SEQ ID NO: 178565 - RNA, 32 nt, Human
gcuauuccccugcuccuccaccuuucaauccc

SEQ ID NO: 178566 - RNA, 20 nt, Human
gcuauucccuccagcaucug

SEQ ID NO: 178567 - RNA, 32 nt, Human
gcuauucccugaggacaccucuaccuuucgug

SEQ ID NO: 178568 - RNA, 32 nt, Human
gcuauucccuggggcugcugugcgcucccccu

SEQ ID NO: 178569 - RNA, 32 nt, Human
gcuauucccuucugaucuuggaaagagguucu

SEQ ID NO: 178570 - RNA, 32 nt, Human
gcuauuccuccaccuuauucccagccccugga

SEQ ID NO: 178571 - RNA, 32 nt, Human
gcuauucgagaugacccacagauggcagcugu

SEQ ID NO: 178572 - RNA, 32 nt, Human
gcuauucuaaggcuuuugcagaaaaauaagug

SEQ ID NO: 178573 - RNA, 32 nt, Human
gcuauucucuggagaaaaauaaaauggaaauu

SEQ ID NO: 178574 - RNA, 32 nt, Human
gcuauucuggaauguguccauugaaaagaaaa

SEQ ID NO: 178575 - RNA, 32 nt, Human
gcuauucugggaaaccuucuugagugcuaugc

SEQ ID NO: 178576 - RNA, 32 nt, Human
gcuauugaauuauaagaaagcaaaggcccagg

SEQ ID NO: 178577 - RNA, 32 nt, Human
gcuauugacuaaucuuugcugaagcugagcua

SEQ ID NO: 178578 - RNA, 21 nt, Human
gcuauugacuggccuaagaca

SEQ ID NO: 178579 - RNA, 21 nt, Human
gcuauugaggaggcugaggca

SEQ ID NO: 178580 - RNA, 32 nt, Human
gcuauugcacuccagccugggugacagacuaa

SEQ ID NO: 178581 - RNA, 32 nt, Human
gcuauugcacuccagccugggugacagagcaa

SEQ ID NO: 178582 - RNA, 32 nt, Human
gcuauugccagacccuuggcugauaggagaau

SEQ ID NO: 178583 - RNA, 32 nt, Human
gcuauugccccgcugcccucucuggcucaggg

SEQ ID NO: 178584 - RNA, 32 nt, Human
gcuauugcggccguggguggucgcgggcgaug

SEQ ID NO: 178585 - RNA, 20 nt, Human
gcuauugcgguuccgaggca

SEQ ID NO: 178586 - RNA, 32 nt, Human
gcuauuggaaacagcaaaaaucccagauaaaa

SEQ ID NO: 178587 - RNA, 32 nt, Human
gcuauuggugguuugucuucuuuguuaggcug

SEQ ID NO: 178588 - RNA, 32 nt, Human
gcuauuguccccacacugcaaaaucauaagag

SEQ ID NO: 178589 - RNA, 32 nt, Human
gcuauuguccccugccuccuuggucacugccu

SEQ ID NO: 178590 - RNA, 32 nt, Human
gcuauugugcuggcuggacacuuuggucacuu

SEQ ID NO: 178591 - RNA, 32 nt, Human
gcuauuguggugggaaagggagggugguuggu

SEQ ID NO: 178592 - RNA, 32 nt, Human
gcuauuguuguacaugagaaauucagcauuaa

SEQ ID NO: 178593 - RNA, 23 nt, Human
gcuauuuaaauucccacaaugca

SEQ ID NO: 178594 - RNA, 23 nt, Human
gcuauuuauuauguaaauaguca

SEQ ID NO: 178595 - RNA, 32 nt, Human
gcuauuucagagaaggccugaccuucagcaaa

SEQ ID NO: 178596 - RNA, 32 nt, Human
gcuauuucauucuuuuccaaugcucuuaauga

SEQ ID NO: 178597 - RNA, 32 nt, Human
gcuauuuccauccuccccauaggggcucucuc

SEQ ID NO: 178598 - RNA, 32 nt, Human
gcuauuucuccuuccuugucugccuuuacaga

SEQ ID NO: 178599 - RNA, 32 nt, Human
gcuauuucuuucauucuugcugguuuauaccu

SEQ ID NO: 178600 - RNA, 32 nt, Human
gcuauuugcacucuagccugggugacagagcg

SEQ ID NO: 178601 - RNA, 20 nt, Human
gcuauuugcugaccuuucca

SEQ ID NO: 178602 - RNA, 32 nt, Human
gcuauuuguucuaucacccagaauuuugagaa

SEQ ID NO: 178603 - RNA, 21 nt, Human
gcuauuuuaaaggcuaaggca

SEQ ID NO: 178604 - RNA, 32 nt, Human
gcuauuuucacuuaaaguaagcauuuuuaaag

SEQ ID NO: 178605 - RNA, 32 nt, Human
gcuauuuucagaguccccuccuaggccugcag

SEQ ID NO: 178606 - RNA, 32 nt, Human
gcuauuuucgguggcugcugagcccaggugcu

SEQ ID NO: 178607 - RNA, 32 nt, Human
gcuauuuuggggguagaaggcagugagagcgu

SEQ ID NO: 178608 - RNA, 32 nt, Human
gcuauuuuuaggcuagggauguuaacaucagg

SEQ ID NO: 178609 - RNA, 22 nt, Human
gcuauuuuuaugucaguuucca

SEQ ID NO: 178610 - RNA, 32 nt, Human
gcuauuuuucugccaugagacuagagguugcu

SEQ ID NO: 178611 - RNA, 32 nt, Human
gcucaaaaaggccauucaucugaagaagcuca

SEQ ID NO: 178612 - RNA, 32 nt, Human
gcucaaaagcuccuaggugcgcggguggauau

SEQ ID NO: 178613 - RNA, 32 nt, Human
gcucaaaaggaagucggccuucauggcgccgg

SEQ ID NO: 178614 - RNA, 32 nt, Human
gcucaaaauuacuauuuuuauuucucauuuuu

SEQ ID NO: 178615 - RNA, 32 nt, Human
gcucaaaccacauaaccaaaugugccaagaua

SEQ ID NO: 178616 - RNA, 19 nt, Human
gcucaaaccuauaauccca

SEQ ID NO: 178617 - RNA, 32 nt, Human
gcucaaaccuauaaucccagcacuuugggagg

SEQ ID NO: 178618 - RNA, 32 nt, Human
gcucaaaccugaccagacagcagaggggcggc

SEQ ID NO: 178619 - RNA, 32 nt, Human
gcucaaaccuguaaucccagcacuuugggaga

SEQ ID NO: 178620 - RNA, 32 nt, Human
gcucaaaccuguaaucccagcacuuugggagg

SEQ ID NO: 178621 - RNA, 32 nt, Human
gcucaaacucaggcugucuaacuccacauucu

SEQ ID NO: 178622 - RNA, 32 nt, Human
gcucaaacuguaaaccaggacaacaaguggau

SEQ ID NO: 178623 - RNA, 32 nt, Human
gcucaaacuugcuugaccuccacuuuucagga

SEQ ID NO: 178624 - RNA, 32 nt, Human
gcucaaagaugggagucucccuauguugccca

SEQ ID NO: 178625 - RNA, 32 nt, Human
gcucaaagccaacuguaugugcugacugggug

SEQ ID NO: 178626 - RNA, 32 nt, Human
gcucaaagcugucgccgcuagucuuaugagcu

SEQ ID NO: 178627 - RNA, 32 nt, Human
gcucaaaggagggcaccucugucugguuuccu

SEQ ID NO: 178628 - RNA, 32 nt, Human
gcucaaaggaucucugcaucaucuugaggugg

SEQ ID NO: 178629 - RNA, 32 nt, Human
gcucaaaguucagcuaaccuuugacacugcua

SEQ ID NO: 178630 - RNA, 32 nt, Human
gcucaaauccuccaucuccucacuuuucagac

SEQ ID NO: 178631 - RNA, 32 nt, Human
gcucaaaucucuucccucccucccucucccag

SEQ ID NO: 178632 - RNA, 32 nt, Human
gcucaaaugccaccuccaguaccagcuuuccu

SEQ ID NO: 178633 - RNA, 32 nt, Human
gcucaaaugccuguaaucccaguacuuuggga

SEQ ID NO: 178634 - RNA, 32 nt, Human
gcucaaauucuuugggaugguuuuuacuuaag

SEQ ID NO: 178635 - RNA, 32 nt, Human
gcucaacaaagccugaaagaagaaagggauga

SEQ ID NO: 178636 - RNA, 32 nt, Human
gcucaacacugccuccgaccagucccucugag

SEQ ID NO: 178637 - RNA, 18 nt, Human
gcucaacauggccaggug

SEQ ID NO: 178638 - RNA, 32 nt, Human
gcucaaccacuggaaaugccuccugggauaag

SEQ ID NO: 178639 - RNA, 21 nt, Human
gcucaaccauggcugaaggaa

SEQ ID NO: 178640 - RNA, 20 nt, Human
gcucaacccaaccaacagga

SEQ ID NO: 178641 - RNA, 20 nt, Human
gcucaaccugguggguucag

SEQ ID NO: 178642 - RNA, 32 nt, Human
gcucaacgucauuaaagaggcagaggcgcagc

SEQ ID NO: 178643 - RNA, 32 nt, Human
gcucaacugcaacaacacacuucccugacagc

SEQ ID NO: 178644 - RNA, 32 nt, Human
gcucaacugcagccccuccuccucgggcacag

SEQ ID NO: 178645 - RNA, 21 nt, Human
gcucaacuucaucacugagua

SEQ ID NO: 178646 - RNA, 20 nt, Human
gcucaacuuuuaaacaaacu

SEQ ID NO: 178647 - RNA, 32 nt, Human
gcucaagaaauccucccaccucagccuccuga

SEQ ID NO: 178648 - RNA, 32 nt, Human
gcucaagaacacugcucugucugccucccugg

SEQ ID NO: 178649 - RNA, 32 nt, Human
gcucaagaacagauuugaggccaggugcggug

SEQ ID NO: 178650 - RNA, 32 nt, Human
gcucaagaagcuggaaggaggaagggagggua

SEQ ID NO: 178651 - RNA, 32 nt, Human
gcucaagaccagccugaccaacauggugaaau

SEQ ID NO: 178652 - RNA, 32 nt, Human
gcucaagaccagccuggacaacauggcaagac

SEQ ID NO: 178653 - RNA, 32 nt, Human
gcucaagaccagccuggcuaacauggugaaac

SEQ ID NO: 178654 - RNA, 32 nt, Human
gcucaagaccagccuggucaacauggugaaac

SEQ ID NO: 178655 - RNA, 32 nt, Human
gcucaagacuuagugggccuccaugggacuug

SEQ ID NO: 178656 - RNA, 32 nt, Human
gcucaagagaaacccugagaaaccccaguagg

SEQ ID NO: 178657 - RNA, 32 nt, Human
gcucaagagaaggaggagaugugguuagcagu

SEQ ID NO: 178658 - RNA, 24 nt, Human
gcucaagaggcccagggagcaaug

SEQ ID NO: 178659 - RNA, 32 nt, Human
gcucaagaggccgagguugcagugagccguga

SEQ ID NO: 178660 - RNA, 32 nt, Human
gcucaagagguugaggcucccuccucagccuc

SEQ ID NO: 178661 - RNA, 32 nt, Human
gcucaagagguugaggcugcagugagcccuga

SEQ ID NO: 178662 - RNA, 32 nt, Human
gcucaagaucagccugggcaacauggugaaac

SEQ ID NO: 178663 - RNA, 32 nt, Human
gcucaagcaaaccucucaccucagccugcuga

SEQ ID NO: 178664 - RNA, 32 nt, Human
gcucaagcaaccaaccuccucuaucccauaua

SEQ ID NO: 178665 - RNA, 23 nt, Human
gcucaagcaauccucccaccuca

SEQ ID NO: 178666 - RNA, 22 nt, Human
gcucaagcaauccucccaucuc

SEQ ID NO: 178667 - RNA, 32 nt, Human
gcucaagcaauccucccaucucagccucuuaa

SEQ ID NO: 178668 - RNA, 23 nt, Human
gcucaagcaauccuccugccuca

SEQ ID NO: 178669 - RNA, 32 nt, Human
gcucaagcaauccuccugccucagcuuccuga

SEQ ID NO: 178670 - RNA, 32 nt, Human
gcucaagcaauccuccugccucggcuuccuaa

SEQ ID NO: 178671 - RNA, 32 nt, Human
gcucaagcaauccuccugccucugccucccaa

SEQ ID NO: 178672 - RNA, 32 nt, Human
gcucaagcaauucuccugccucagcuuccuga

SEQ ID NO: 178673 - RNA, 32 nt, Human
gcucaagcagcaaaauccuuacuuccagcaaa

SEQ ID NO: 178674 - RNA, 32 nt, Human
gcucaagcauuuucacuuuguuucuuacaugu

SEQ ID NO: 178675 - RNA, 32 nt, Human
gcucaagccauccauccuccuaccucagccuc

SEQ ID NO: 178676 - RNA, 32 nt, Human
gcucaagccauccucccaccucagccuccaga

SEQ ID NO: 178677 - RNA, 32 nt, Human
gcucaagccauccuccugccucagccucccca

SEQ ID NO: 178678 - RNA, 32 nt, Human
gcucaagccauccuccugccucagccuccuga

SEQ ID NO: 178679 - RNA, 32 nt, Human
gcucaagccaucuuuccaccucagccugccag

SEQ ID NO: 178680 - RNA, 32 nt, Human
gcucaagccauuuuucugccucagcuuuucga

SEQ ID NO: 178681 - RNA, 32 nt, Human
gcucaagcccaggaguuugaaguugcaaugag

SEQ ID NO: 178682 - RNA, 32 nt, Human
gcucaagcccauaaucccagcacuuugggagg

SEQ ID NO: 178683 - RNA, 32 nt, Human
gcucaagcccgugacuguacagaaggauccug

SEQ ID NO: 178684 - RNA, 19 nt, Human
gcucaagccuauaauccca

SEQ ID NO: 178685 - RNA, 32 nt, Human
gcucaagccucuaaucucaacgcuuugggagg

SEQ ID NO: 178686 - RNA, 19 nt, Human
gcucaagccuguaauccca

SEQ ID NO: 178687 - RNA, 21 nt, Human
gcucaagccuguaaucccagc

SEQ ID NO: 178688 - RNA, 32 nt, Human
gcucaagccuguaaucccagcacguugggagg

SEQ ID NO: 178689 - RNA, 32 nt, Human
gcucaagccuguaaucccagcacuuuaggugg

SEQ ID NO: 178690 - RNA, 32 nt, Human
gcucaagccuguaaucccagcacuuugggagg

SEQ ID NO: 178691 - RNA, 32 nt, Human
gcucaagccuguaaucccagcacuuugggugg

SEQ ID NO: 178692 - RNA, 32 nt, Human
gcucaagccuguaaucccagcauuuugggagg

SEQ ID NO: 178693 - RNA, 32 nt, Human
gcucaagccuguaaugucagcacuuuaaaagg

SEQ ID NO: 178694 - RNA, 32 nt, Human
gcucaagccuguacucccagcacuuuuggagg

SEQ ID NO: 178695 - RNA, 32 nt, Human
gcucaagcgauccucccaucucagccucccag

SEQ ID NO: 178696 - RNA, 32 nt, Human
gcucaagcgauccucccaucucagccucccug

SEQ ID NO: 178697 - RNA, 32 nt, Human
gcucaagcgauucuccugccucagcuuccuga

SEQ ID NO: 178698 - RNA, 32 nt, Human
gcucaagcuacacccuggcccuccacgcauga

SEQ ID NO: 178699 - RNA, 32 nt, Human
gcucaagcuauccucccaccucagccucucaa

SEQ ID NO: 178700 - RNA, 32 nt, Human
gcucaagcuauccuugcaccucagccucccaa

SEQ ID NO: 178701 - RNA, 21 nt, Human
gcucaagcuggaguggagugg

SEQ ID NO: 178702 - RNA, 32 nt, Human
gcucaagcuggucucaagcuccugggcucaag

SEQ ID NO: 178703 - RNA, 32 nt, Human
gcucaagcuuccuggacucaggaggcuuuuug

SEQ ID NO: 178704 - RNA, 32 nt, Human
gcucaagcuuguauuaccagcacuuuaggagg

SEQ ID NO: 178705 - RNA, 32 nt, Human
gcucaaggacccucagcaacuggggccagggg

SEQ ID NO: 178706 - RNA, 32 nt, Human
gcucaaggaggaacuggcaaaugcugaauauu

SEQ ID NO: 178707 - RNA, 32 nt, Human
gcucaagggaaagacugccccagaagagcaag

SEQ ID NO: 178708 - RNA, 32 nt, Human
gcucaagggaagagauugcccaggcacuacca

SEQ ID NO: 178709 - RNA, 32 nt, Human
gcucaagggccagagaucucaagugucaaccu

SEQ ID NO: 178710 - RNA, 32 nt, Human
gcucaagguacaaaugagagauuugcuauacc

SEQ ID NO: 178711 - RNA, 32 nt, Human
gcucaaggucccagccagugagcccagugugc

SEQ ID NO: 178712 - RNA, 23 nt, Human
gcucaaguaaucuucccgccuca

SEQ ID NO: 178713 - RNA, 32 nt, Human
gcucaagucuguaaucccagcgcuuugggagg

SEQ ID NO: 178714 - RNA, 23 nt, Human
gcucaagugacccucccaccuca

SEQ ID NO: 178715 - RNA, 23 nt, Human
gcucaagugauccacccaccuca

SEQ ID NO: 178716 - RNA, 23 nt, Human
gcucaagugauccucccaccuca

SEQ ID NO: 178717 - RNA, 23 nt, Human
gcucaagugauccuccuaccuca

SEQ ID NO: 178718 - RNA, 32 nt, Human
gcucaagugauccuccuaucucagccucccaa

SEQ ID NO: 178719 - RNA, 23 nt, Human
gcucaagugauccuccugacuca

SEQ ID NO: 178720 - RNA, 23 nt, Human
gcucaagugauccuccugccuca

SEQ ID NO: 178721 - RNA, 23 nt, Human
gcucaagugauccucuggacuca

SEQ ID NO: 178722 - RNA, 32 nt, Human
gcucaagugauccuuccaucucagccucccga

SEQ ID NO: 178723 - RNA, 23 nt, Human
gcucaagugaucugcccaucuca

SEQ ID NO: 178724 - RNA, 32 nt, Human
gcucaagugaucugcccaucucagccucccaa

SEQ ID NO: 178725 - RNA, 23 nt, Human
gcucaagugauucucccaucuca

SEQ ID NO: 178726 - RNA, 32 nt, Human
gcucaagugcugcucuggcaaagcuccggagc

SEQ ID NO: 178727 - RNA, 23 nt, Human
gcucaaguggacgucccccuuca

SEQ ID NO: 178728 - RNA, 32 nt, Human
gcucaagugggacaauggcacaguauuaaggu

SEQ ID NO: 178729 - RNA, 32 nt, Human
gcucaagugguccuccugccucagcuuacuga

SEQ ID NO: 178730 - RNA, 32 nt, Human
gcucaaguucuuggggauucagagcuaaguuc

SEQ ID NO: 178731 - RNA, 32 nt, Human
gcucaaguugaggcagguugaaggauucacag

SEQ ID NO: 178732 - RNA, 19 nt, Human
gcucaauaguacacagaua

SEQ ID NO: 178733 - RNA, 32 nt, Human
gcucaauccccacucccucaugcuuuggguua

SEQ ID NO: 178734 - RNA, 32 nt, Human
gcucaaugauuaucacauuugagacccugugu

SEQ ID NO: 178735 - RNA, 32 nt, Human
gcucaaugcaaccuccaccucccagguucaag

SEQ ID NO: 178736 - RNA, 32 nt, Human
gcucaauguugcugggggaccuacaaaaguca

SEQ ID NO: 178737 - RNA, 32 nt, Human
gcucaauuuaauuuugcuagauauuuaacaaa

SEQ ID NO: 178738 - RNA, 32 nt, Human
gcucaauuucuuaggcuggagugcaguggcac

SEQ ID NO: 178739 - RNA, 32 nt, Human
gcucacaaaaccaguugaggugcacuaaaggg

SEQ ID NO: 178740 - RNA, 32 nt, Human
gcucacaaaggcaggcacagacugcaacccug

SEQ ID NO: 178741 - RNA, 32 nt, Human
gcucacaacugcaaccuccgucucccggguuc

SEQ ID NO: 178742 - RNA, 32 nt, Human
gcucacaacuguaauccucgcacuuugggagg

SEQ ID NO: 178743 - RNA, 32 nt, Human
gcucacacaaccgguccacuccugccuuuuca

SEQ ID NO: 178744 - RNA, 32 nt, Human
gcucacacaauugcacuccauucuuccgccuu

SEQ ID NO: 178745 - RNA, 18 nt, Human
gcucacacacccaacacc

SEQ ID NO: 178746 - RNA, 32 nt, Human
gcucacacaggucacugcucucuaggcggaca

SEQ ID NO: 178747 - RNA, 20 nt, Human
gcucacacauaggcaugacc

SEQ ID NO: 178748 - RNA, 32 nt, Human
gcucacacauguuaauuccagcacuuugggag

SEQ ID NO: 178749 - RNA, 32 nt, Human
gcucacacauugucuggcagccuguguccaca

SEQ ID NO: 178750 - RNA, 32 nt, Human
gcucacaccacugcacuccagccugggugaca

SEQ ID NO: 178751 - RNA, 32 nt, Human
gcucacaccacugcacuccauccugggcaaca

SEQ ID NO: 178752 - RNA, 32 nt, Human
gcucacaccaggaugcuggagcagagcugaca

SEQ ID NO: 178753 - RNA, 32 nt, Human
gcucacacccauaaucccagcacuuugggagg

SEQ ID NO: 178754 - RNA, 32 nt, Human
gcucacacccauggcugaaucucugcagggca

SEQ ID NO: 178755 - RNA, 32 nt, Human
gcucacacccguaaucccagcacuuugcgggg

SEQ ID NO: 178756 - RNA, 31 nt, Human
gcucacacccguaaucccagcacuuugggag

SEQ ID NO: 178757 - RNA, 20 nt, Human
gcucacacccuguaauccca

SEQ ID NO: 178758 - RNA, 32 nt, Human
gcucacacccuguaaucccagcacuuugggag

SEQ ID NO: 178759 - RNA, 32 nt, Human
gcucacaccgguaaucccagcacuuugggagg

SEQ ID NO: 178760 - RNA, 32 nt, Human
gcucacaccuaaucccagcacuuugggaggcu

SEQ ID NO: 178761 - RNA, 19 nt, Human
gcucacaccuauaauccca

SEQ ID NO: 178762 - RNA, 27 nt, Human
gcucacaccuauaaucccagcacuuug

SEQ ID NO: 178763 - RNA, 32 nt, Human
gcucacaccuauaaucccagcacuuugggaag

SEQ ID NO: 178764 - RNA, 32 nt, Human
gcucacaccuauaaucccagcacuuugggagg

SEQ ID NO: 178765 - RNA, 32 nt, Human
gcucacaccuauaaucgagcacuuugggaggc

SEQ ID NO: 178766 - RNA, 32 nt, Human
gcucacaccuauaaucucagcacuuugggagg

SEQ ID NO: 178767 - RNA, 32 nt, Human
gcucacaccuaugaucucagcaccuugggagg

SEQ ID NO: 178768 - RNA, 32 nt, Human
gcucacaccucuaaucccagcacuuugggagg

SEQ ID NO: 178769 - RNA, 32 nt, Human
gcucacaccugaaaucccagcacuuugggagg

SEQ ID NO: 178770 - RNA, 32 nt, Human
gcucacaccugcaaucccagcacuuuggaagg

SEQ ID NO: 178771 - RNA, 32 nt, Human
gcucacaccugcaaucccagcacuuugggaga

SEQ ID NO: 178772 - RNA, 32 nt, Human
gcucacaccugcaaucccagcacuuugggagg

SEQ ID NO: 178773 - RNA, 19 nt, Human
gcucacaccuguaaaccca

SEQ ID NO: 178774 - RNA, 32 nt, Human
gcucacaccuguaaacccagcacuuugggaga

SEQ ID NO: 178775 - RNA, 32 nt, Human
gcucacaccuguaaccccagcacuuugggacg

SEQ ID NO: 178776 - RNA, 32 nt, Human
gcucacaccuguaaccccagcacuuugggagg

SEQ ID NO: 178777 - RNA, 32 nt, Human
gcucacaccuguaacccccagcacuuugggag

SEQ ID NO: 178778 - RNA, 32 nt, Human
gcucacaccuguaacccuagcacuuugggagg

SEQ ID NO: 178779 - RNA, 32 nt, Human
gcucacaccuguaauaaucccagcacuuuggg

SEQ ID NO: 178780 - RNA, 32 nt, Human
gcucacaccuguaauaccagcacuuugggaag

SEQ ID NO: 178781 - RNA, 32 nt, Human
gcucacaccuguaauaccagcaguuugagaag

SEQ ID NO: 178782 - RNA, 32 nt, Human
gcucacaccuguaaucaaaacacuuugggagg

SEQ ID NO: 178783 - RNA, 32 nt, Human
gcucacaccuguaaucacagcacuuugggagg

SEQ ID NO: 178784 - RNA, 32 nt, Human
gcucacaccuguaaucacugcacuccaaccug

SEQ ID NO: 178785 - RNA, 32 nt, Human
gcucacaccuguaauccaagcacuuugggagg

SEQ ID NO: 178786 - RNA, 19 nt, Human
gcucacaccuguaauccca

SEQ ID NO: 178787 - RNA, 32 nt, Human
gcucacaccuguaaucccaacacucugggaag

SEQ ID NO: 178788 - RNA, 32 nt, Human
gcucacaccuguaaucccaacacuuugagagg

SEQ ID NO: 178789 - RNA, 32 nt, Human
gcucacaccuguaaucccaacacuuugagcgg

SEQ ID NO: 178790 - RNA, 32 nt, Human
gcucacaccuguaaucccaacacuuuggaagg

SEQ ID NO: 178791 - RNA, 32 nt, Human
gcucacaccuguaaucccaacacuuugggaag

SEQ ID NO: 178792 - RNA, 32 nt, Human
gcucacaccuguaaucccaacacuuugggaau

SEQ ID NO: 178793 - RNA, 32 nt, Human
gcucacaccuguaaucccaacacuuugggacg

SEQ ID NO: 178794 - RNA, 32 nt, Human
gcucacaccuguaaucccaacacuuugggagc

SEQ ID NO: 178795 - RNA, 32 nt, Human
gcucacaccuguaaucccaacacuuugggagg

SEQ ID NO: 178796 - RNA, 32 nt, Human
gcucacaccuguaaucccaacacuuugggaug

SEQ ID NO: 178797 - RNA, 32 nt, Human
gcucacaccuguaaucccaacauuuugggaac

SEQ ID NO: 178798 - RNA, 32 nt, Human
gcucacaccuguaaucccaacauuuugggagg

SEQ ID NO: 178799 - RNA, 32 nt, Human
gcucacaccuguaaucccaauacuuugggugg

SEQ ID NO: 178800 - RNA, 32 nt, Human
gcucacaccuguaaucccagaacuuugggagg

SEQ ID NO: 178801 - RNA, 32 nt, Human
gcucacaccuguaaucccagcaauuugggaga

SEQ ID NO: 178802 - RNA, 32 nt, Human
gcucacaccuguaaucccagcaccuugggagg

SEQ ID NO: 178803 - RNA, 32 nt, Human
gcucacaccuguaaucccagcacuaugggagg

SEQ ID NO: 178804 - RNA, 32 nt, Human
gcucacaccuguaaucccagcacucugggagg

SEQ ID NO: 178805 - RNA, 32 nt, Human
gcucacaccuguaaucccagcacuguggaaag

SEQ ID NO: 178806 - RNA, 25 nt, Human
gcucacaccuguaaucccagcacuu

SEQ ID NO: 178807 - RNA, 32 nt, Human
gcucacaccuguaaucccagcacuucgggaag

SEQ ID NO: 178808 - RNA, 32 nt, Human
gcucacaccuguaaucccagcacuucgggagg

SEQ ID NO: 178809 - RNA, 32 nt, Human
gcucacaccuguaaucccagcacuuuaggagg

SEQ ID NO: 178810 - RNA, 32 nt, Human
gcucacaccuguaaucccagcacuuugagagg

SEQ ID NO: 178811 - RNA, 32 nt, Human
gcucacaccuguaaucccagcacuuugcgggg

SEQ ID NO: 178812 - RNA, 32 nt, Human
gcucacaccuguaaucccagcacuuuggcagg

SEQ ID NO: 178813 - RNA, 32 nt, Human
gcucacaccuguaaucccagcacuuugggaag

SEQ ID NO: 178814 - RNA, 32 nt, Human
gcucacaccuguaaucccagcacuuugggaca

SEQ ID NO: 178815 - RNA, 32 nt, Human
gcucacaccuguaaucccagcacuuugggaga

SEQ ID NO: 178816 - RNA, 32 nt, Human
gcucacaccuguaaucccagcacuuugggagc

SEQ ID NO: 178817 - RNA, 32 nt, Human
gcucacaccuguaaucccagcacuuugggagg

SEQ ID NO: 178818 - RNA, 32 nt, Human
gcucacaccuguaaucccagcacuuugggagu

SEQ ID NO: 178819 - RNA, 32 nt, Human
gcucacaccuguaaucccagcacuuugggauu

SEQ ID NO: 178820 - RNA, 32 nt, Human
gcucacaccuguaaucccagcacuuuggggag

SEQ ID NO: 178821 - RNA, 32 nt, Human
gcucacaccuguaaucccagcacuuugguagg

SEQ ID NO: 178822 - RNA, 32 nt, Human
gcucacaccuguaaucccagcacuuuuggagg

SEQ ID NO: 178823 - RNA, 32 nt, Human
gcucacaccuguaaucccagcaguuuggaagg

SEQ ID NO: 178824 - RNA, 32 nt, Human
gcucacaccuguaaucccagcaguuugggagg

SEQ ID NO: 178825 - RNA, 32 nt, Human
gcucacaccuguaaucccagcauuuugggaag

SEQ ID NO: 178826 - RNA, 32 nt, Human
gcucacaccuguaaucccagcauuuugggagg

SEQ ID NO: 178827 - RNA, 32 nt, Human
gcucacaccuguaaucccagcccuuugggagg

SEQ ID NO: 178828 - RNA, 32 nt, Human
gcucacaccuguaaucccagcgcuuugggagg

SEQ ID NO: 178829 - RNA, 32 nt, Human
gcucacaccuguaaucccagcucuuuggaggc

SEQ ID NO: 178830 - RNA, 32 nt, Human
gcucacaccuguaaucccagcucuuugggagg

SEQ ID NO: 178831 - RNA, 32 nt, Human
gcucacaccuguaaucccagcuguuugggagg

SEQ ID NO: 178832 - RNA, 32 nt, Human
gcucacaccuguaaucccaggacuuugggagg

SEQ ID NO: 178833 - RNA, 32 nt, Human
gcucacaccuguaaucccaguaccuugggagg

SEQ ID NO: 178834 - RNA, 32 nt, Human
gcucacaccuguaaucccaguacuuugagacg

SEQ ID NO: 178835 - RNA, 32 nt, Human
gcucacaccuguaaucccaguacuuugggagg

SEQ ID NO: 178836 - RNA, 32 nt, Human
gcucacaccuguaaucccagugcuuugggagg

SEQ ID NO: 178837 - RNA, 32 nt, Human
gcucacaccuguaauccccagcacuuugggag

SEQ ID NO: 178838 - RNA, 32 nt, Human
gcucacaccuguaaucccugcacuuugggagg

SEQ ID NO: 178839 - RNA, 19 nt, Human
gcucacaccuguaauccua

SEQ ID NO: 178840 - RNA, 32 nt, Human
gcucacaccuguaauccuaacacuuugggagg

SEQ ID NO: 178841 - RNA, 32 nt, Human
gcucacaccuguaauccuagcacauugggagg

SEQ ID NO: 178842 - RNA, 32 nt, Human
gcucacaccuguaauccuagcacuuugggagg

SEQ ID NO: 178843 - RNA, 32 nt, Human
gcucacaccuguaauccuagcaucuugggagg

SEQ ID NO: 178844 - RNA, 32 nt, Human
gcucacaccuguaauccuagcgcuuugggagg

SEQ ID NO: 178845 - RNA, 32 nt, Human
gcucacaccuguaauccugcacuuugggaguc

SEQ ID NO: 178846 - RNA, 32 nt, Human
gcucacaccuguaauccuugcauuuuggaagg

SEQ ID NO: 178847 - RNA, 19 nt, Human
gcucacaccuguaaucuca

SEQ ID NO: 178848 - RNA, 32 nt, Human
gcucacaccuguaaucucaacacuuugggagg

SEQ ID NO: 178849 - RNA, 32 nt, Human
gcucacaccuguaaucucaacgcuuugggagg

SEQ ID NO: 178850 - RNA, 32 nt, Human
gcucacaccuguaaucucagcaaccugggagu

SEQ ID NO: 178851 - RNA, 32 nt, Human
gcucacaccuguaaucucagcacucugggagg

SEQ ID NO: 178852 - RNA, 32 nt, Human
gcucacaccuguaaucucagcacuuugggaag

SEQ ID NO: 178853 - RNA, 32 nt, Human
gcucacaccuguaaucucagcacuuugggagg

SEQ ID NO: 178854 - RNA, 32 nt, Human
gcucacaccuguaaucucagcauuuugggagg

SEQ ID NO: 178855 - RNA, 32 nt, Human
gcucacaccuguaaucugaacacuuugggagg

SEQ ID NO: 178856 - RNA, 32 nt, Human
gcucacaccuguaaucugagcacauugggagg

SEQ ID NO: 178857 - RNA, 32 nt, Human
gcucacaccuguaaucugagcauucugggagg

SEQ ID NO: 178858 - RNA, 32 nt, Human
gcucacaccuguaaucuuaacacugugggagg

SEQ ID NO: 178859 - RNA, 32 nt, Human
gcucacaccuguaaugccagcacuuugggcag

SEQ ID NO: 178860 - RNA, 32 nt, Human
gcucacaccuguaaugccagcccuuugggagg

SEQ ID NO: 178861 - RNA, 32 nt, Human
gcucacaccuguaauuccaacacuuugggagg

SEQ ID NO: 178862 - RNA, 32 nt, Human
gcucacaccuguaauuccagcacuuugggagg

SEQ ID NO: 178863 - RNA, 32 nt, Human
gcucacaccuguaauuccagcacuuugugagg

SEQ ID NO: 178864 - RNA, 32 nt, Human
gcucacaccuguaauucccagcgcuuugggaa

SEQ ID NO: 178865 - RNA, 32 nt, Human
gcucacaccuguaauucuagcacuuugggagg

SEQ ID NO: 178866 - RNA, 32 nt, Human
gcucacaccuguaauugcagcacucugggagg

SEQ ID NO: 178867 - RNA, 32 nt, Human
gcucacaccuguaauuucagcaccuugggagg

SEQ ID NO: 178868 - RNA, 32 nt, Human
gcucacaccuguaauuucagcacucuggggag

SEQ ID NO: 178869 - RNA, 32 nt, Human
gcucacaccuguaucccaacacuuugggaggc

SEQ ID NO: 178870 - RNA, 32 nt, Human
gcucacaccuguaucccagcacuuugggagac

SEQ ID NO: 178871 - RNA, 32 nt, Human
gcucacaccuguaucccagcacuuugggaggc

SEQ ID NO: 178872 - RNA, 32 nt, Human
gcucacaccuguauucccagcacuuugggagg

SEQ ID NO: 178873 - RNA, 32 nt, Human
gcucacaccugucaucccagcacuuugggagg

SEQ ID NO: 178874 - RNA, 32 nt, Human
gcucacaccugucauuccagcacuuugagagg

SEQ ID NO: 178875 - RNA, 32 nt, Human
gcucacaccugugaucccagcacuuugggagg

SEQ ID NO: 178876 - RNA, 32 nt, Human
gcucacaccugugaucucagcacauugggagg

SEQ ID NO: 178877 - RNA, 32 nt, Human
gcucacaccugugaucucagcaccuugggagg

SEQ ID NO: 178878 - RNA, 32 nt, Human
gcucacaccugugcucccagcacuuugggagg

SEQ ID NO: 178879 - RNA, 32 nt, Human
gcucacaccuguguucucagcaccuugggagg

SEQ ID NO: 178880 - RNA, 32 nt, Human
gcucacaccuuuaaucccagcacuuugggaag

SEQ ID NO: 178881 - RNA, 32 nt, Human
gcucacaccuuuaaucccagcacuuugggaga

SEQ ID NO: 178882 - RNA, 32 nt, Human
gcucacacgccuguaaucccagcacuuuggga

SEQ ID NO: 178883 - RNA, 32 nt, Human
gcucacacuguaaucccagcacuuugggaggc

SEQ ID NO: 178884 - RNA, 32 nt, Human
gcucacacuguaaugccagcacuuugggaggc

SEQ ID NO: 178885 - RNA, 32 nt, Human
gcucacacuuauaaucacagcacuuugggagg

SEQ ID NO: 178886 - RNA, 32 nt, Human
gcucacacuuauaaucccagcacuuugggagg

SEQ ID NO: 178887 - RNA, 32 nt, Human
gcucacacuuguaaucacugcacuuugggaag

SEQ ID NO: 178888 - RNA, 32 nt, Human
gcucacacuuguaaucauagcacuuugggagg

SEQ ID NO: 178889 - RNA, 32 nt, Human
gcucacacuuguaaucccagcacuuugaggug

SEQ ID NO: 178890 - RNA, 32 nt, Human
gcucacacuuguaaucccagcacuuugggaag

SEQ ID NO: 178891 - RNA, 32 nt, Human
gcucacacuuguaaucccagcacuuugggagg

SEQ ID NO: 178892 - RNA, 32 nt, Human
gcucacacuuguaaucccagcacuuugggaug

SEQ ID NO: 178893 - RNA, 32 nt, Human
gcucacagaagcagugaggaugaugccaggau

SEQ ID NO: 178894 - RNA, 32 nt, Human
gcucacagaagucuaaccugcccgggacgccc

SEQ ID NO: 178895 - RNA, 32 nt, Human
gcucacagaccaccccacccuacccuguccuu

SEQ ID NO: 178896 - RNA, 32 nt, Human
gcucacagacuagacagagcuucagaaagccc

SEQ ID NO: 178897 - RNA, 32 nt, Human
gcucacagagcccagacugcuggaacagccaa

SEQ ID NO: 178898 - RNA, 32 nt, Human
gcucacagcaaccacucucuccuggguucaag

SEQ ID NO: 178899 - RNA, 32 nt, Human
gcucacagcaaccucuaccuccuggguucaag

SEQ ID NO: 178900 - RNA, 23 nt, Human
gcucacagcaaccucugccuccu

SEQ ID NO: 178901 - RNA, 32 nt, Human
gcucacagcaaccucugccuccuggguucaag

SEQ ID NO: 178902 - RNA, 32 nt, Human
gcucacagcacugggaaaugggaacauaguac

SEQ ID NO: 178903 - RNA, 32 nt, Human
gcucacagcccaggcaggguguguggcuccug

SEQ ID NO: 178904 - RNA, 19 nt, Human
gcucacagcccccacccca

SEQ ID NO: 178905 - RNA, 32 nt, Human
gcucacagccuggcacagacugggagcaaaau

SEQ ID NO: 178906 - RNA, 32 nt, Human
gcucacagcuauaaucucagcacuuugggagg

SEQ ID NO: 178907 - RNA, 19 nt, Human
gcucacagcuguaauccca

SEQ ID NO: 178908 - RNA, 32 nt, Human
gcucacagcuguaaucccagcacuuugagguu

SEQ ID NO: 178909 - RNA, 32 nt, Human
gcucacagcuuugaaccugccaaaggaccccu

SEQ ID NO: 178910 - RNA, 32 nt, Human
gcucacagggcucucauuucguccauccccuu

SEQ ID NO: 178911 - RNA, 32 nt, Human
gcucacagugaugucaggagugguuacccuuc

SEQ ID NO: 178912 - RNA, 32 nt, Human
gcucacagugcaaccucugcuucccagguuca

SEQ ID NO: 178913 - RNA, 32 nt, Human
gcucacagugccuguucucugcuccaggaaca

SEQ ID NO: 178914 - RNA, 19 nt, Human
gcucacaucaccugggaca

SEQ ID NO: 178915 - RNA, 32 nt, Human
gcucacaucagagcaccucacagagcaauagc

SEQ ID NO: 178916 - RNA, 32 nt, Human
gcucacauccacgauugugaccccuuaaggga

SEQ ID NO: 178917 - RNA, 17 nt, Human
gcucacaucccaucucu

SEQ ID NO: 178918 - RNA, 32 nt, Human
gcucacaucuggaagaaacaggaagauuggaa

SEQ ID NO: 178919 - RNA, 32 nt, Human
gcucacaucuguaaccccagcacuuugggagg

SEQ ID NO: 178920 - RNA, 32 nt, Human
gcucacaucuguaauaccagcucucugggagg

SEQ ID NO: 178921 - RNA, 32 nt, Human
gcucacaucuguaaucccagcacuuuggaagg

SEQ ID NO: 178922 - RNA, 32 nt, Human
gcucacaucuguaaucccagcacuuugggaga

SEQ ID NO: 178923 - RNA, 32 nt, Human
gcucacaucuguaaucccagcacuuugggagg

SEQ ID NO: 178924 - RNA, 32 nt, Human
gcucacaucuguaaucccagcacuuugggagu

SEQ ID NO: 178925 - RNA, 32 nt, Human
gcucacaucuguaaucucaacacuuugggagg

SEQ ID NO: 178926 - RNA, 32 nt, Human
gcucacaucuguaaucucagcauuuugggagg

SEQ ID NO: 178927 - RNA, 32 nt, Human
gcucacaucuguaaugccagcacuuugggagg

SEQ ID NO: 178928 - RNA, 32 nt, Human
gcucacauguacaaaucacuucuaggccucag

SEQ ID NO: 178929 - RNA, 20 nt, Human
gcucacaugucaccaccacc

SEQ ID NO: 178930 - RNA, 32 nt, Human
gcucacauguucacagugcagcuccuggcaga

SEQ ID NO: 178931 - RNA, 32 nt, Human
gcucacauucaccaaaguuuguuuucaugauc

SEQ ID NO: 178932 - RNA, 32 nt, Human
gcucacauuuucccuucucugccuugcuucaa

SEQ ID NO: 178933 - RNA, 32 nt, Human
gcucaccaaugagugaaagggaucguggguca

SEQ ID NO: 178934 - RNA, 32 nt, Human
gcucaccaaugccacauuuguucauucuguuc

SEQ ID NO: 178935 - RNA, 32 nt, Human
gcucaccacaacauccgccuccuggguucaag

SEQ ID NO: 178936 - RNA, 32 nt, Human
gcucaccacaaccuccaccuccuggguuuaag

SEQ ID NO: 178937 - RNA, 32 nt, Human
gcucaccacaaccuccgccuccuggguucaug

SEQ ID NO: 178938 - RNA, 32 nt, Human
gcucaccacaaccucugccuccuggguucaag

SEQ ID NO: 178939 - RNA, 32 nt, Human
gcucaccacaaccuugaacucccaggcucaag

SEQ ID NO: 178940 - RNA, 32 nt, Human
gcucaccacagccuccaacuccugggcucaag

SEQ ID NO: 178941 - RNA, 19 nt, Human
gcucaccaccacagccccu

SEQ ID NO: 178942 - RNA, 32 nt, Human
gcucaccagcaucuacuugcccccucguuccu

SEQ ID NO: 178943 - RNA, 32 nt, Human
gcucaccagcuuucauuucagcuccuguaggc

SEQ ID NO: 178944 - RNA, 32 nt, Human
gcucaccaucacccuuccugcccgacggagcu

SEQ ID NO: 178945 - RNA, 32 nt, Human
gcucaccaucuccacccugccugcuguggaau

SEQ ID NO: 178946 - RNA, 32 nt, Human
gcucaccauuggagaaucagcucacugcucuc

SEQ ID NO: 178947 - RNA, 28 nt, Human
gcucacccaagugcuagcucugcacuuc

SEQ ID NO: 178948 - RNA, 32 nt, Human
gcucacccaccccucccucucuuccaaggaga

SEQ ID NO: 178949 - RNA, 32 nt, Human
gcucacccagcucugcuccaaggccuuccucu

SEQ ID NO: 178950 - RNA, 26 nt, Human
gcucacccaggucuccagcaaacgga

SEQ ID NO: 178951 - RNA, 32 nt, Human
gcucacccauggcugcugugacuccuaccagg

SEQ ID NO: 178952 - RNA, 32 nt, Human
gcucacccauucuacacuugcucuuuugcucc

SEQ ID NO: 178953 - RNA, 32 nt, Human
gcucaccccaaccuccgccuccuggguucagg

SEQ ID NO: 178954 - RNA, 32 nt, Human
gcucaccccaucaucccuuucccuuggugccc

SEQ ID NO: 178955 - RNA, 32 nt, Human
gcucacccccuguaaucccagcacuuugggaa

SEQ ID NO: 178956 - RNA, 32 nt, Human
gcucaccccuagcuggcuucucaccagccugg

SEQ ID NO: 178957 - RNA, 32 nt, Human
gcucaccccucaggcucaggaaagccaauaac

SEQ ID NO: 178958 - RNA, 32 nt, Human
gcucaccccuccugccggcugccagaggcccc

SEQ ID NO: 178959 - RNA, 32 nt, Human
gcucaccccugcccucuugcacucucccugcc

SEQ ID NO: 178960 - RNA, 32 nt, Human
gcucaccccuggaaucccagcacuuugggagg

SEQ ID NO: 178961 - RNA, 19 nt, Human
gcucaccccuguaauccca

SEQ ID NO: 178962 - RNA, 32 nt, Human
gcucaccccuguaaucccagcacuuugggagg

SEQ ID NO: 178963 - RNA, 32 nt, Human
gcucaccccuguaaucccagcacuuugugagg

SEQ ID NO: 178964 - RNA, 32 nt, Human
gcucaccccuguaaucccaguacuuugggagg

SEQ ID NO: 178965 - RNA, 32 nt, Human
gcucaccccuguaauccuagcacuuugggagg

SEQ ID NO: 178966 - RNA, 32 nt, Human
gcucaccccuguaaucgcagcacuuugggagg

SEQ ID NO: 178967 - RNA, 32 nt, Human
gcucaccccuguaaucucagcacuuugggugg

SEQ ID NO: 178968 - RNA, 32 nt, Human
gcucaccccuguaaucucagcauuuugggagg

SEQ ID NO: 178969 - RNA, 32 nt, Human
gcucaccccuuuaaucccagcacuuuggaagg

SEQ ID NO: 178970 - RNA, 32 nt, Human
gcucacccuagauuguggcccagaucucagga

SEQ ID NO: 178971 - RNA, 23 nt, Human
gcucacccucaccccagccucuu

SEQ ID NO: 178972 - RNA, 19 nt, Human
gcucacccuccacagugac

SEQ ID NO: 178973 - RNA, 32 nt, Human
gcucacccuccaccugcauccccaccccacuc

SEQ ID NO: 178974 - RNA, 32 nt, Human
gcucacccuguucccugaucugcuccagauga

SEQ ID NO: 178975 - RNA, 24 nt, Human
gcucacccuguuuauuuccuggua

SEQ ID NO: 178976 - RNA, 19 nt, Human
gcucacccuuguaauccca

SEQ ID NO: 178977 - RNA, 32 nt, Human
gcucacccuuguaaucccagcacuuugggagg

SEQ ID NO: 178978 - RNA, 32 nt, Human
gcucacccuugugaucucagcacuuugagagg

SEQ ID NO: 178979 - RNA, 22 nt, Human
gcucaccgcaaccuccaccucc

SEQ ID NO: 178980 - RNA, 32 nt, Human
gcucaccgcaaccuccaccuccaggguugacg

SEQ ID NO: 178981 - RNA, 32 nt, Human
gcucaccgcaaccuccaccucccggguucaag

SEQ ID NO: 178982 - RNA, 23 nt, Human
gcucaccgcaaccuccaccuccu

SEQ ID NO: 178983 - RNA, 32 nt, Human
gcucaccgcaaccuccaccuccugaguuccag

SEQ ID NO: 178984 - RNA, 32 nt, Human
gcucaccgcaaccuccaccuccuggguucaag

SEQ ID NO: 178985 - RNA, 22 nt, Human
gcucaccgcaaccuccgccucc

SEQ ID NO: 178986 - RNA, 32 nt, Human
gcucaccgcaaccuccgccuccuggguucaag

SEQ ID NO: 178987 - RNA, 32 nt, Human
gcucaccgcaaccucugccuccuggguucaag

SEQ ID NO: 178988 - RNA, 22 nt, Human
gcucaccgcaaucuccgccucc

SEQ ID NO: 178989 - RNA, 32 nt, Human
gcucaccgcagccuccaccuccaggguucaag

SEQ ID NO: 178990 - RNA, 32 nt, Human
gcucaccgcagucuccaccucccggguucaag

SEQ ID NO: 178991 - RNA, 21 nt, Human
gcucaccgugcccagccuccu

SEQ ID NO: 178992 - RNA, 18 nt, Human
gcucaccuaccugccacc

SEQ ID NO: 178993 - RNA, 32 nt, Human
gcucaccucagacaaggggugcaucagggacc

SEQ ID NO: 178994 - RNA, 32 nt, Human
gcucaccuccacugcaucuuuuuacuggccau

SEQ ID NO: 178995 - RNA, 32 nt, Human
gcucaccuccaggacccagagucugcccuucu

SEQ ID NO: 178996 - RNA, 32 nt, Human
gcucaccuccgccaccuccucaggguucugcg

SEQ ID NO: 178997 - RNA, 32 nt, Human
gcucaccucucagcugcugggcucagcaccgg

SEQ ID NO: 178998 - RNA, 32 nt, Human
gcucaccucuguaaucccagcacuuugggagg

SEQ ID NO: 178999 - RNA, 32 nt, Human
gcucaccugagcccucccagggccagguuccu

SEQ ID NO: 179000 - RNA, 32 nt, Human
gcucaccugccuggacccugggcugccagaug

SEQ ID NO: 179001 - RNA, 32 nt, Human
gcucaccugcuguugagccuugugcugucaau

SEQ ID NO: 179002 - RNA, 32 nt, Human
gcucaccuggcaccuaccuggagcucaccugg

SEQ ID NO: 179003 - RNA, 32 nt, Human
gcucaccuggcuugcuugggcccagugugggg

SEQ ID NO: 179004 - RNA, 20 nt, Human
gcucaccugggcccaaggca

SEQ ID NO: 179005 - RNA, 32 nt, Human
gcucaccuggggauuuggggguggggugguca

SEQ ID NO: 179006 - RNA, 32 nt, Human
gcucaccuggggccuccaucccagaagcgcag

SEQ ID NO: 179007 - RNA, 16 nt, Human
gcucaccuguaauccc

SEQ ID NO: 179008 - RNA, 17 nt, Human
gcucaccuguaauccca

SEQ ID NO: 179009 - RNA, 32 nt, Human
gcucaccuguaaucccaacacuuugggaggcu

SEQ ID NO: 179010 - RNA, 32 nt, Human
gcucaccuguaaucccaccauuuugggaggcu

SEQ ID NO: 179011 - RNA, 32 nt, Human
gcucaccuguaaucccagcacuuugggaggcc

SEQ ID NO: 179012 - RNA, 20 nt, Human
gcucaccuguaaucccagcu

SEQ ID NO: 179013 - RNA, 32 nt, Human
gcucaccuguaaucccagcuacccaggaggcu

SEQ ID NO: 179014 - RNA, 20 nt, Human
gcucaccuguaaucccggcu

SEQ ID NO: 179015 - RNA, 32 nt, Human
gcucaccuguaaucccggcuacucgggaggcu

SEQ ID NO: 179016 - RNA, 32 nt, Human
gcucaccuuccucaccccuccucugacccacc

SEQ ID NO: 179017 - RNA, 23 nt, Human
gcucaccuucugaccuccuggca

SEQ ID NO: 179018 - RNA, 18 nt, Human
gcucaccuuggccucuca

SEQ ID NO: 179019 - RNA, 32 nt, Human
gcucacgaggagaucaagaccauccuggcuaa

SEQ ID NO: 179020 - RNA, 32 nt, Human
gcucacgcauguaaucccagcacuuugggagg

SEQ ID NO: 179021 - RNA, 32 nt, Human
gcucacgcauguaaucccugcacuuugggagg

SEQ ID NO: 179022 - RNA, 32 nt, Human
gcucacgccaggaaucccagcacuuugggagg

SEQ ID NO: 179023 - RNA, 32 nt, Human
gcucacgccaguaaucccagcacuuuggaggg

SEQ ID NO: 179024 - RNA, 32 nt, Human
gcucacgccaguaaucccagcacuuugggagg

SEQ ID NO: 179025 - RNA, 32 nt, Human
gcucacgccauucuuccaccucagccucccga

SEQ ID NO: 179026 - RNA, 32 nt, Human
gcucacgcccauaauccagcacuuugggaagc

SEQ ID NO: 179027 - RNA, 32 nt, Human
gcucacgcccauaaucccagcacuuugggagg

SEQ ID NO: 179028 - RNA, 32 nt, Human
gcucacgcccucccacccccacccuacagccc

SEQ ID NO: 179029 - RNA, 32 nt, Human
gcucacgccgguaaucccagcacuuugggagg

SEQ ID NO: 179030 - RNA, 32 nt, Human
gcucacgccguaaugccaacacuuugguagac

SEQ ID NO: 179031 - RNA, 32 nt, Human
gcucacgccuacaaucucagcacguugggagg

SEQ ID NO: 179032 - RNA, 32 nt, Human
gcucacgccuauaauccaagcacuuugggagg

SEQ ID NO: 179033 - RNA, 32 nt, Human
gcucacgccuauaaucccagcacuuccagagu

SEQ ID NO: 179034 - RNA, 32 nt, Human
gcucacgccuauaaucccagcacuuuaggagg

SEQ ID NO: 179035 - RNA, 32 nt, Human
gcucacgccuauaaucccagcacuuugcgagg

SEQ ID NO: 179036 - RNA, 32 nt, Human
gcucacgccuauaaucccagcacuuugggagg

SEQ ID NO: 179037 - RNA, 32 nt, Human
gcucacgccuauaaucucagcacucugggagg

SEQ ID NO: 179038 - RNA, 32 nt, Human
gcucacgccuauacacccagcacuuuggaagg

SEQ ID NO: 179039 - RNA, 32 nt, Human
gcucacgccuauaucccagcacuuugggaggc

SEQ ID NO: 179040 - RNA, 32 nt, Human
gcucacgccuaugaucccagcacuuugggagg

SEQ ID NO: 179041 - RNA, 32 nt, Human
gcucacgccuauuaucuuagcacuuugggagg

SEQ ID NO: 179042 - RNA, 32 nt, Human
gcucacgccucuaaucccagcacuuugggagg

SEQ ID NO: 179043 - RNA, 32 nt, Human
gcucacgccucuaaucgcagcacuuugggagg

SEQ ID NO: 179044 - RNA, 32 nt, Human
gcucacgccucuaaucucagcacuuugggagg

SEQ ID NO: 179045 - RNA, 32 nt, Human
gcucacgccugaaaucccagcacuuugggaga

SEQ ID NO: 179046 - RNA, 32 nt, Human
gcucacgccugaaaucccagcacuuugggagg

SEQ ID NO: 179047 - RNA, 32 nt, Human
gcucacgccugaaaucucagcacuuugguagg

SEQ ID NO: 179048 - RNA, 32 nt, Human
gcucacgccugcaaucccagcacuuugggaga

SEQ ID NO: 179049 - RNA, 32 nt, Human
gcucacgccugcaaucccagcacuuugggagg

SEQ ID NO: 179050 - RNA, 32 nt, Human
gcucacgccugcaaugccagcacuuugagagg

SEQ ID NO: 179051 - RNA, 32 nt, Human
gcucacgccugcagucccagcacuuugggagg

SEQ ID NO: 179052 - RNA, 32 nt, Human
gcucacgccuggaaucccagcacuuugggaag

SEQ ID NO: 179053 - RNA, 32 nt, Human
gcucacgccuggaaucccagcacuuugggagg

SEQ ID NO: 179054 - RNA, 32 nt, Human
gcucacgccuguaaacccagcacuuuaggagc

SEQ ID NO: 179055 - RNA, 32 nt, Human
gcucacgccuguaaccccaacacuuugggagg

SEQ ID NO: 179056 - RNA, 32 nt, Human
gcucacgccuguaaccccagcacauugggagg

SEQ ID NO: 179057 - RNA, 32 nt, Human
gcucacgccuguaaccccagcacuuugggagg

SEQ ID NO: 179058 - RNA, 32 nt, Human
gcucacgccuguaaccccaucacuuugggagg

SEQ ID NO: 179059 - RNA, 32 nt, Human
gcucacgccuguaacccuagcacuuugggagu

SEQ ID NO: 179060 - RNA, 32 nt, Human
gcucacgccuguaaccucagcacugugggagg

SEQ ID NO: 179061 - RNA, 32 nt, Human
gcucacgccuguaaccucagcacuuugggagg

SEQ ID NO: 179062 - RNA, 32 nt, Human
gcucacgccuguaacuccagcacuuugggagg

SEQ ID NO: 179063 - RNA, 32 nt, Human
gcucacgccuguaauaccagcacuuugggagg

SEQ ID NO: 179064 - RNA, 32 nt, Human
gcucacgccuguaauaucaacacuuugggacg

SEQ ID NO: 179065 - RNA, 32 nt, Human
gcucacgccuguaaucacaacacuuugggagg

SEQ ID NO: 179066 - RNA, 32 nt, Human
gcucacgccuguaaucacagcacuuugggagg

SEQ ID NO: 179067 - RNA, 32 nt, Human
gcucacgccuguaauccaacacuuugagaggc

SEQ ID NO: 179068 - RNA, 32 nt, Human
gcucacgccuguaauccaagcacuuggggagg

SEQ ID NO: 179069 - RNA, 32 nt, Human
gcucacgccuguaauccagcaauuugggaggc

SEQ ID NO: 179070 - RNA, 32 nt, Human
gcucacgccuguaauccagcacuuugggaggc

SEQ ID NO: 179071 - RNA, 19 nt, Human
gcucacgccuguaauccca

SEQ ID NO: 179072 - RNA, 32 nt, Human
gcucacgccuguaaucccaacaacacuuuggg

SEQ ID NO: 179073 - RNA, 32 nt, Human
gcucacgccuguaaucccaacaccuugggagg

SEQ ID NO: 179074 - RNA, 32 nt, Human
gcucacgccuguaaucccaacacucugggagg

SEQ ID NO: 179075 - RNA, 32 nt, Human
gcucacgccuguaaucccaacacuuuaggaga

SEQ ID NO: 179076 - RNA, 32 nt, Human
gcucacgccuguaaucccaacacuuuaggagu

SEQ ID NO: 179077 - RNA, 32 nt, Human
gcucacgccuguaaucccaacacuuugggagc

SEQ ID NO: 179078 - RNA, 32 nt, Human
gcucacgccuguaaucccaacacuuugggagg

SEQ ID NO: 179079 - RNA, 32 nt, Human
gcucacgccuguaaucccaacacuuuucgagg

SEQ ID NO: 179080 - RNA, 32 nt, Human
gcucacgccuguaaucccaacauuuugggagg

SEQ ID NO: 179081 - RNA, 32 nt, Human
gcucacgccuguaaucccaccacuuuggaaag

SEQ ID NO: 179082 - RNA, 32 nt, Human
gcucacgccuguaaucccaccacuuugggaga

SEQ ID NO: 179083 - RNA, 32 nt, Human
gcucacgccuguaaucccaccacuuugggagg

SEQ ID NO: 179084 - RNA, 32 nt, Human
gcucacgccuguaaucccagaacuaugugagg

SEQ ID NO: 179085 - RNA, 32 nt, Human
gcucacgccuguaaucccagaacuuuaggagg

SEQ ID NO: 179086 - RNA, 32 nt, Human
gcucacgccuguaaucccagaacuuugagagg

SEQ ID NO: 179087 - RNA, 32 nt, Human
gcucacgccuguaaucccagaacuuugggaag

SEQ ID NO: 179088 - RNA, 32 nt, Human
gcucacgccuguaaucccagaacuuugggagg

SEQ ID NO: 179089 - RNA, 32 nt, Human
gcucacgccuguaaucccagacuuugggaggc

SEQ ID NO: 179090 - RNA, 21 nt, Human
gcucacgccuguaaucccagc

SEQ ID NO: 179091 - RNA, 32 nt, Human
gcucacgccuguaaucccagcaaguugggagg

SEQ ID NO: 179092 - RNA, 32 nt, Human
gcucacgccuguaaucccagcaauugggaagg

SEQ ID NO: 179093 - RNA, 32 nt, Human
gcucacgccuguaaucccagcaauuugggagg

SEQ ID NO: 179094 - RNA, 32 nt, Human
gcucacgccuguaaucccagcaauuugggagu

SEQ ID NO: 179095 - RNA, 32 nt, Human
gcucacgccuguaaucccagcaccuugggagg

SEQ ID NO: 179096 - RNA, 32 nt, Human
gcucacgccuguaaucccagcacgcugggagg

SEQ ID NO: 179097 - RNA, 32 nt, Human
gcucacgccuguaaucccagcacucugggagg

SEQ ID NO: 179098 - RNA, 32 nt, Human
gcucacgccuguaaucccagcacugggaggcc

SEQ ID NO: 179099 - RNA, 32 nt, Human
gcucacgccuguaaucccagcacugugagagg

SEQ ID NO: 179100 - RNA, 32 nt, Human
gcucacgccuguaaucccagcacugugggagg

SEQ ID NO: 179101 - RNA, 32 nt, Human
gcucacgccuguaaucccagcacuuagggugg

SEQ ID NO: 179102 - RNA, 32 nt, Human
gcucacgccuguaaucccagcacuucgggagg

SEQ ID NO: 179103 - RNA, 32 nt, Human
gcucacgccuguaaucccagcacuugggaggc

SEQ ID NO: 179104 - RNA, 32 nt, Human
gcucacgccuguaaucccagcacuuggggagg

SEQ ID NO: 179105 - RNA, 32 nt, Human
gcucacgccuguaaucccagcacuuuaagagg

SEQ ID NO: 179106 - RNA, 32 nt, Human
gcucacgccuguaaucccagcacuuuaggagg

SEQ ID NO: 179107 - RNA, 32 nt, Human
gcucacgccuguaaucccagcacuuucggagg

SEQ ID NO: 179108 - RNA, 32 nt, Human
gcucacgccuguaaucccagcacuuugagaag

SEQ ID NO: 179109 - RNA, 32 nt, Human
gcucacgccuguaaucccagcacuuugagaga

SEQ ID NO: 179110 - RNA, 32 nt, Human
gcucacgccuguaaucccagcacuuugagagg

SEQ ID NO: 179111 - RNA, 32 nt, Human
gcucacgccuguaaucccagcacuuugagaug

SEQ ID NO: 179112 - RNA, 32 nt, Human
gcucacgccuguaaucccagcacuuugcgaua

SEQ ID NO: 179113 - RNA, 32 nt, Human
gcucacgccuguaaucccagcacuuugcgggg

SEQ ID NO: 179114 - RNA, 32 nt, Human
gcucacgccuguaaucccagcacuuuggaagg

SEQ ID NO: 179115 - RNA, 32 nt, Human
gcucacgccuguaaucccagcacuuuggaggc

SEQ ID NO: 179116 - RNA, 32 nt, Human
gcucacgccuguaaucccagcacuuuggcagg

SEQ ID NO: 179117 - RNA, 32 nt, Human
gcucacgccuguaaucccagcacuuugggaag

SEQ ID NO: 179118 - RNA, 32 nt, Human
gcucacgccuguaaucccagcacuuugggaca

SEQ ID NO: 179119 - RNA, 32 nt, Human
gcucacgccuguaaucccagcacuuugggaga

SEQ ID NO: 179120 - RNA, 32 nt, Human
gcucacgccuguaaucccagcacuuugggagc

SEQ ID NO: 179121 - RNA, 32 nt, Human
gcucacgccuguaaucccagcacuuugggagg

SEQ ID NO: 179122 - RNA, 32 nt, Human
gcucacgccuguaaucccagcacuuugggagu

SEQ ID NO: 179123 - RNA, 32 nt, Human
gcucacgccuguaaucccagcacuuuggggag

SEQ ID NO: 179124 - RNA, 32 nt, Human
gcucacgccuguaaucccagcacuuugguagg

SEQ ID NO: 179125 - RNA, 32 nt, Human
gcucacgccuguaaucccagcacuuugguugg

SEQ ID NO: 179126 - RNA, 32 nt, Human
gcucacgccuguaaucccagcacuuugugggg

SEQ ID NO: 179127 - RNA, 32 nt, Human
gcucacgccuguaaucccagcacuuuucagag

SEQ ID NO: 179128 - RNA, 32 nt, Human
gcucacgccuguaaucccagcacuuuuggagg

SEQ ID NO: 179129 - RNA, 32 nt, Human
gcucacgccuguaaucccagcacuuuugggag

SEQ ID NO: 179130 - RNA, 32 nt, Human
gcucacgccuguaaucccagcaguuugggaag

SEQ ID NO: 179131 - RNA, 32 nt, Human
gcucacgccuguaaucccagcaguuugggagg

SEQ ID NO: 179132 - RNA, 32 nt, Human
gcucacgccuguaaucccagcauuugggaggc

SEQ ID NO: 179133 - RNA, 32 nt, Human
gcucacgccuguaaucccagcauuuugggagc

SEQ ID NO: 179134 - RNA, 32 nt, Human
gcucacgccuguaaucccagcauuuugggagg

SEQ ID NO: 179135 - RNA, 32 nt, Human
gcucacgccuguaaucccagcccuuugggagg

SEQ ID NO: 179136 - RNA, 32 nt, Human
gcucacgccuguaaucccagcgcuuugggaga

SEQ ID NO: 179137 - RNA, 32 nt, Human
gcucacgccuguaaucccagcgcuuugggagg

SEQ ID NO: 179138 - RNA, 32 nt, Human
gcucacgccuguaaucccagcucuuugggagg

SEQ ID NO: 179139 - RNA, 32 nt, Human
gcucacgccuguaaucccagcucuuugugggg

SEQ ID NO: 179140 - RNA, 32 nt, Human
gcucacgccuguaaucccaggacuuuaggagg

SEQ ID NO: 179141 - RNA, 32 nt, Human
gcucacgccuguaaucccaggacuuugggagg

SEQ ID NO: 179142 - RNA, 32 nt, Human
gcucacgccuguaaucccaguacugugggagg

SEQ ID NO: 179143 - RNA, 32 nt, Human
gcucacgccuguaaucccaguacuugggaggc

SEQ ID NO: 179144 - RNA, 32 nt, Human
gcucacgccuguaaucccaguacuuugggagc

SEQ ID NO: 179145 - RNA, 32 nt, Human
gcucacgccuguaaucccaguacuuugggagg

SEQ ID NO: 179146 - RNA, 32 nt, Human
gcucacgccuguaaucccaguaguuugggagg

SEQ ID NO: 179147 - RNA, 32 nt, Human
gcucacgccuguaaucccaguauuuugggagu

SEQ ID NO: 179148 - RNA, 32 nt, Human
gcucacgccuguaaucccaucacuuugggagg

SEQ ID NO: 179149 - RNA, 32 nt, Human
gcucacgccuguaauccccgcacuuugggagg

SEQ ID NO: 179150 - RNA, 32 nt, Human
gcucacgccuguaaucccggcacugugggagg

SEQ ID NO: 179151 - RNA, 32 nt, Human
gcucacgccuguaaucccggcacuuugggagg

SEQ ID NO: 179152 - RNA, 32 nt, Human
gcucacgccuguaaucccggcaguuugggagg

SEQ ID NO: 179153 - RNA, 32 nt, Human
gcucacgccuguaaucccgguauuuugggagg

SEQ ID NO: 179154 - RNA, 32 nt, Human
gcucacgccuguaaucccuacacuuugggagg

SEQ ID NO: 179155 - RNA, 32 nt, Human
gcucacgccuguaauccuaacacuuugggagg

SEQ ID NO: 179156 - RNA, 32 nt, Human
gcucacgccuguaauccuagcaauuugggagg

SEQ ID NO: 179157 - RNA, 32 nt, Human
gcucacgccuguaauccuagcaccuugggagg

SEQ ID NO: 179158 - RNA, 32 nt, Human
gcucacgccuguaauccuagcaccuugggggu

SEQ ID NO: 179159 - RNA, 32 nt, Human
gcucacgccuguaauccuagcacuugggaggc

SEQ ID NO: 179160 - RNA, 32 nt, Human
gcucacgccuguaauccuagcacuuuggaagg

SEQ ID NO: 179161 - RNA, 32 nt, Human
gcucacgccuguaauccuagcacuuugggagg

SEQ ID NO: 179162 - RNA, 32 nt, Human
gcucacgccuguaauccuagcacuuuguaagg

SEQ ID NO: 179163 - RNA, 32 nt, Human
gcucacgccuguaauccuagcacuuuugggag

SEQ ID NO: 179164 - RNA, 32 nt, Human
gcucacgccuguaauccuagcaguuugggagg

SEQ ID NO: 179165 - RNA, 32 nt, Human
gcucacgccuguaauccuagcauuuugggagg

SEQ ID NO: 179166 - RNA, 32 nt, Human
gcucacgccuguaauccuagcauuuuggguga

SEQ ID NO: 179167 - RNA, 32 nt, Human
gcucacgccuguaauccuagcauuuuuggagg

SEQ ID NO: 179168 - RNA, 32 nt, Human
gcucacgccuguaauccuagcccuuuggaagg

SEQ ID NO: 179169 - RNA, 32 nt, Human
gcucacgccuguaauccugacacuuugggagg

SEQ ID NO: 179170 - RNA, 32 nt, Human
gcucacgccuguaauccuggcacuuugggagg

SEQ ID NO: 179171 - RNA, 32 nt, Human
gcucacgccuguaaucgcagcacuuugggagg

SEQ ID NO: 179172 - RNA, 32 nt, Human
gcucacgccuguaaucgcggcacuuugggagg

SEQ ID NO: 179173 - RNA, 32 nt, Human
gcucacgccuguaaucucaacacuuugggagg

SEQ ID NO: 179174 - RNA, 32 nt, Human
gcucacgccuguaaucucagcacauugggagg

SEQ ID NO: 179175 - RNA, 32 nt, Human
gcucacgccuguaaucucagcacuuuaagagg

SEQ ID NO: 179176 - RNA, 32 nt, Human
gcucacgccuguaaucucagcacuuugggagg

SEQ ID NO: 179177 - RNA, 32 nt, Human
gcucacgccuguaaucucagcacuuugggugg

SEQ ID NO: 179178 - RNA, 32 nt, Human
gcucacgccuguaaucucagcauuuugggagg

SEQ ID NO: 179179 - RNA, 32 nt, Human
gcucacgccuguaaucucggcacuuugggaga

SEQ ID NO: 179180 - RNA, 32 nt, Human
gcucacgccuguaaugccagcacucugggagg

SEQ ID NO: 179181 - RNA, 32 nt, Human
gcucacgccuguaaugccagcacuuugggagg

SEQ ID NO: 179182 - RNA, 19 nt, Human
gcucacgccuguaauucca

SEQ ID NO: 179183 - RNA, 20 nt, Human
gcucacgccuguaauuccag

SEQ ID NO: 179184 - RNA, 21 nt, Human
gcucacgccuguaauuccagc

SEQ ID NO: 179185 - RNA, 32 nt, Human
gcucacgccuguaauuccagcacuuugggaga

SEQ ID NO: 179186 - RNA, 32 nt, Human
gcucacgccuguaauuccagcacuuugggagg

SEQ ID NO: 179187 - RNA, 32 nt, Human
gcucacgccuguaauuccagcauguugggagg

SEQ ID NO: 179188 - RNA, 32 nt, Human
gcucacgccuguaauuccagugcuuugggagg

SEQ ID NO: 179189 - RNA, 32 nt, Human
gcucacgccuguaauuccaucauuuugggagg

SEQ ID NO: 179190 - RNA, 32 nt, Human
gcucacgccuguaauucuagcacuuugggaga

SEQ ID NO: 179191 - RNA, 32 nt, Human
gcucacgccuguaauucuagcacuuugggagg

SEQ ID NO: 179192 - RNA, 32 nt, Human
gcucacgccuguagucccagcacuuugagagg

SEQ ID NO: 179193 - RNA, 32 nt, Human
gcucacgccuguagucccagcacuuugggagg

SEQ ID NO: 179194 - RNA, 32 nt, Human
gcucacgccuguaguguccgcacuuugggagg

SEQ ID NO: 179195 - RNA, 32 nt, Human
gcucacgccugucaucccagcacuuugggagg

SEQ ID NO: 179196 - RNA, 32 nt, Human
gcucacgccugucaucucagcacuuugggagg

SEQ ID NO: 179197 - RNA, 32 nt, Human
gcucacgccugugauaccagcacuuuugggag

SEQ ID NO: 179198 - RNA, 32 nt, Human
gcucacgccugugaucccagcacuuugggagg

SEQ ID NO: 179199 - RNA, 32 nt, Human
gcucacgccugugauccuagcacuuugggagg

SEQ ID NO: 179200 - RNA, 32 nt, Human
gcucacgccugugaucucagcacuuugagggg

SEQ ID NO: 179201 - RNA, 32 nt, Human
gcucacgccugugauuccagcacuuugggagg

SEQ ID NO: 179202 - RNA, 32 nt, Human
gcucacgccuguggucccagcacuuuggcagg

SEQ ID NO: 179203 - RNA, 32 nt, Human
gcucacgccuguggucccagcacuuugggagg

SEQ ID NO: 179204 - RNA, 32 nt, Human
gcucacgccuguggucucagcacuuugggagg

SEQ ID NO: 179205 - RNA, 32 nt, Human
gcucacgccuguuaaguccagcacuuugggag

SEQ ID NO: 179206 - RNA, 32 nt, Human
gcucacgccuguuaucccagcacuuugggagg

SEQ ID NO: 179207 - RNA, 32 nt, Human
gcucacgccuuguaaucccagcacuuugggag

SEQ ID NO: 179208 - RNA, 32 nt, Human
gcucacgcuuauaaucccagcacuuugggagg

SEQ ID NO: 179209 - RNA, 32 nt, Human
gcucacgcuuguaaucccagcacuuugggaag

SEQ ID NO: 179210 - RNA, 32 nt, Human
gcucacgcuuguaaucccagcacuuugggagg

SEQ ID NO: 179211 - RNA, 32 nt, Human
gcucacgcuuguaaucgcagcacuuugggagg

SEQ ID NO: 179212 - RNA, 32 nt, Human
gcucacgcuuguaaucucagcacuuugggagg

SEQ ID NO: 179213 - RNA, 32 nt, Human
gcucacgcuuguaauuccagcacuuugggagg

SEQ ID NO: 179214 - RNA, 21 nt, Human
gcucacggagccucagccccg

SEQ ID NO: 179215 - RNA, 32 nt, Human
gcucacggcaaccuccaccucccggguucaag

SEQ ID NO: 179216 - RNA, 32 nt, Human
gcucacggcaacuucagccuucccagguucaa

SEQ ID NO: 179217 - RNA, 22 nt, Human
gcucacggcagccucaaccucc

SEQ ID NO: 179218 - RNA, 32 nt, Human
gcucacggcccgggcugggcugggcagggcaa

SEQ ID NO: 179219 - RNA, 32 nt, Human
gcucacggcuguaaucccagcacuuugggagg

SEQ ID NO: 179220 - RNA, 32 nt, Human
gcucacgggccuggggccauggcuuucuucuc

SEQ ID NO: 179221 - RNA, 32 nt, Human
gcucacguauguaaucccagcacuuugggaag

SEQ ID NO: 179222 - RNA, 32 nt, Human
gcucacgucgcgauccuggcuugaguggccca

SEQ ID NO: 179223 - RNA, 32 nt, Human
gcucacgucuguaaucccagcaauuugggagg

SEQ ID NO: 179224 - RNA, 32 nt, Human
gcucacgucuguaaucccagcaccuugggagg

SEQ ID NO: 179225 - RNA, 32 nt, Human
gcucacgucuguaaucccagcacuuuggaagg

SEQ ID NO: 179226 - RNA, 32 nt, Human
gcucacgucuguaaucccagcacuuugggagc

SEQ ID NO: 179227 - RNA, 32 nt, Human
gcucacgucuguaaucccagcacuuugggagg

SEQ ID NO: 179228 - RNA, 32 nt, Human
gcucacgucuguaaucccagcaguuugggagg

SEQ ID NO: 179229 - RNA, 32 nt, Human
gcucacgucuguaaucccagcgcuuugggagg

SEQ ID NO: 179230 - RNA, 32 nt, Human
gcucacgucuguaaucccaggacuuugggagg

SEQ ID NO: 179231 - RNA, 32 nt, Human
gcucacgucuguaaucucagcacuuagggagg

SEQ ID NO: 179232 - RNA, 32 nt, Human
gcucacgucuguaaucuuugggagcacuuugg

SEQ ID NO: 179233 - RNA, 32 nt, Human
gcucacgucuguaaugccagcacuucgggaga

SEQ ID NO: 179234 - RNA, 32 nt, Human
gcucacguuuguaaucccagcacuuugggagg

SEQ ID NO: 179235 - RNA, 32 nt, Human
gcucacguuuuuaaucccagcacuuugggagg

SEQ ID NO: 179236 - RNA, 32 nt, Human
gcucacuacaaccaccaccuccuggguccaaa

SEQ ID NO: 179237 - RNA, 32 nt, Human
gcucacuacaaccuccaccucccagguucaag

SEQ ID NO: 179238 - RNA, 32 nt, Human
gcucacuacaaccuccaccucccggguucagg

SEQ ID NO: 179239 - RNA, 23 nt, Human
gcucacuacaaccuccaccuccu

SEQ ID NO: 179240 - RNA, 32 nt, Human
gcucacuacaaccuccaccuccuggguuccag

SEQ ID NO: 179241 - RNA, 32 nt, Human
gcucacuacaaccuccgccuccuggguucaag

SEQ ID NO: 179242 - RNA, 32 nt, Human
gcucacuacaaccuccugcuccuggguucgag

SEQ ID NO: 179243 - RNA, 23 nt, Human
gcucacuacaaccucgaccuccu

SEQ ID NO: 179244 - RNA, 32 nt, Human
gcucacuacaaccucgaccuccuggguucaag

SEQ ID NO: 179245 - RNA, 32 nt, Human
gcucacuacagccucccaacucccaggcucaa

SEQ ID NO: 179246 - RNA, 32 nt, Human
gcucacuacagccuccgccuccuggguucaag

SEQ ID NO: 179247 - RNA, 32 nt, Human
gcucacuacagccuugaacuccugggcucaag

SEQ ID NO: 179248 - RNA, 20 nt, Human
gcucacuaccuccucaggga

SEQ ID NO: 179249 - RNA, 32 nt, Human
gcucacuacuguaauuccagcacuuugggagg

SEQ ID NO: 179250 - RNA, 32 nt, Human
gcucacuauaaccuccaccucccagguucaag

SEQ ID NO: 179251 - RNA, 32 nt, Human
gcucacuauaaccuugaacuccugggcucaag

SEQ ID NO: 179252 - RNA, 32 nt, Human
gcucacucaccucccuccucagcaccaugagc

SEQ ID NO: 179253 - RNA, 32 nt, Human
gcucugggagagagcgagagagaaauccgguu

SEQ ID NO: 179254 - RNA, 32 nt, Human
gcucugggagagaggagugucagacagcuguu

SEQ ID NO: 179255 - RNA, 32 nt, Human
gcucugggagcaccgcgggugggagcccuccc

SEQ ID NO: 179256 - RNA, 32 nt, Human
gcucugggagccucuggguuccugggcgcacc

SEQ ID NO: 179257 - RNA, 32 nt, Human
gcucugggaugcaggcaugcuucucaccgugc

SEQ ID NO: 179258 - RNA, 17 nt, Human
gcucugggccucagggg

SEQ ID NO: 179259 - RNA, 30 nt, Human
gcucugggccucuccaugcuguggcccugg

SEQ ID NO: 179260 - RNA, 22 nt, Human
gcucugggccugaugggacagg

SEQ ID NO: 179261 - RNA, 22 nt, Human
gcucugggccuucuuccugcca

SEQ ID NO: 179262 - RNA, 21 nt, Human
gcucugggcgcccguucccag

SEQ ID NO: 179263 - RNA, 21 nt, Human
gcucugggcugauucagaggu

SEQ ID NO: 179264 - RNA, 23 nt, Human
gcucugggcugcacccacaggua

SEQ ID NO: 179265 - RNA, 32 nt, Human
gcucugggcugcagcuuccagcacugaaucag

SEQ ID NO: 179266 - RNA, 20 nt, Human
gcucugggcugcuccaggga

SEQ ID NO: 179267 - RNA, 32 nt, Human
gcucugggcugggucuccgccuccaggguucu

SEQ ID NO: 179268 - RNA, 30 nt, Human
gcucugggcuuugauuccaucuccuugucu

SEQ ID NO: 179269 - RNA, 32 nt, Human
gcucuggggaaaaaggagaaagugagaggaga

SEQ ID NO: 179270 - RNA, 32 nt, Human
gcucuggggaugccagggcaggaggacgaggg

SEQ ID NO: 179271 - RNA, 32 nt, Human
gcucuggggccaggugccaccggccauugucc

SEQ ID NO: 179272 - RNA, 32 nt, Human
gcucuggggccugcugagccggcugcccuggg

SEQ ID NO: 179273 - RNA, 32 nt, Human
gcucuggggcuccaaggacucacaaagaggag

SEQ ID NO: 179274 - RNA, 18 nt, Human
gcucugggggacucaggc

SEQ ID NO: 179275 - RNA, 32 nt, Human
gcucugggggcagagguggcaggaauggugcu

SEQ ID NO: 179276 - RNA, 17 nt, Human
gcucugggggcaggggg

SEQ ID NO: 179277 - RNA, 32 nt, Human
gcucugggggcuguggcagggcaggggcggcu

SEQ ID NO: 179278 - RNA, 32 nt, Human
gcucuggguaugaccugccucuggcccugguc

SEQ ID NO: 179279 - RNA, 32 nt, Human
gcucuggguccugccccugccugauggccaag

SEQ ID NO: 179280 - RNA, 32 nt, Human
gcucuggguggcagaggguacaggguccugag

SEQ ID NO: 179281 - RNA, 32 nt, Human
gcucuggguuggaaacuagaagacuuaacugg

SEQ ID NO: 179282 - RNA, 32 nt, Human
gcucugguauugcucugccuuuauaaaagucu

SEQ ID NO: 179283 - RNA, 31 nt, Human
gcucuggucaccaaggaggcaaaggggagag

SEQ ID NO: 179284 - RNA, 32 nt, Human
gcucuggucagggcuggcaggcugggggcucu

SEQ ID NO: 179285 - RNA, 32 nt, Human
gcucuggucgcccgaccagccaugucucucgg

SEQ ID NO: 179286 - RNA, 32 nt, Human
gcucuggucuguucugaaacugugccaacuga

SEQ ID NO: 179287 - RNA, 32 nt, Human
gcucuggugaagcccucugagcccaggaggaa

SEQ ID NO: 179288 - RNA, 32 nt, Human
gcucuggugggaccacaggucaccugauacuu

SEQ ID NO: 179289 - RNA, 32 nt, Human
gcucugguggucuuggaugaggccccaugagc

SEQ ID NO: 179290 - RNA, 23 nt, Human
gcucugguucccgccugguccuc

SEQ ID NO: 179291 - RNA, 32 nt, Human
gcucugguugcccaggcugggguacaguggug

SEQ ID NO: 179292 - RNA, 32 nt, Human
gcucugguugcuggaucguguacaugaggacc

SEQ ID NO: 179293 - RNA, 32 nt, Human
gcucuguaacagaaccuuaccuccaggugcug

SEQ ID NO: 179294 - RNA, 32 nt, Human
gcucuguaaccugcacugugaccuacacuagu

SEQ ID NO: 179295 - RNA, 32 nt, Human
gcucuguaacucaggcuggagugcaguggcgc

SEQ ID NO: 179296 - RNA, 23 nt, Human
gcucuguaagaaagaaaagguca

SEQ ID NO: 179297 - RNA, 32 nt, Human
gcucuguacacaugauaugcaacaaagggcag

SEQ ID NO: 179298 - RNA, 32 nt, Human
gcucuguagaccagcagcaacuucuuaguauu

SEQ ID NO: 179299 - RNA, 32 nt, Human
gcucuguagaccaggcuggagcgcaguggcag

SEQ ID NO: 179300 - RNA, 32 nt, Human
gcucuguagcccaggccagagugcaguggcgc

SEQ ID NO: 179301 - RNA, 25 nt, Human
gcucuguagcccaggcuggagugca

SEQ ID NO: 179302 - RNA, 32 nt, Human
gcucuguagcccaggcuggagugcaguguggc

SEQ ID NO: 179303 - RNA, 32 nt, Human
gcucuguauugaagaacugagaucagugaaau

SEQ ID NO: 179304 - RNA, 32 nt, Human
gcucugucacacaggcuggagugcaguggugu

SEQ ID NO: 179305 - RNA, 32 nt, Human
gcucugucaccaaggcuggagugcagcggugu

SEQ ID NO: 179306 - RNA, 32 nt, Human
gcucugucaccaaggcuggagugcaggggcac

SEQ ID NO: 179307 - RNA, 32 nt, Human
gcucugucaccaggccggagugcagugguguc

SEQ ID NO: 179308 - RNA, 32 nt, Human
gcucugucaccaggcuggagggcaguggcgcc

SEQ ID NO: 179309 - RNA, 32 nt, Human
gcucugucaccaggcuggagggcaguggugcg

SEQ ID NO: 179310 - RNA, 32 nt, Human
gcucugucaccaggcuggaguacagugaugac

SEQ ID NO: 179311 - RNA, 32 nt, Human
gcucugucaccaggcuggagugcagcggcgca

SEQ ID NO: 179312 - RNA, 32 nt, Human
gcucugucaccaggcuggagugcagugacacg

SEQ ID NO: 179313 - RNA, 32 nt, Human
gcucugucaccaggcuggagugcaguggaggc

SEQ ID NO: 179314 - RNA, 32 nt, Human
gcucugucaccaggcuggagugcaguggcaug

SEQ ID NO: 179315 - RNA, 32 nt, Human
gcucugucaccaggcuggagugcaguggcgcg

SEQ ID NO: 179316 - RNA, 32 nt, Human
gcucugucaccaggcuggagugcaguggugca

SEQ ID NO: 179317 - RNA, 32 nt, Human
gcucugucaccaggcuggagugcaguggugug

SEQ ID NO: 179318 - RNA, 32 nt, Human
gcucugucaccaggcuggagugcgguggcaua

SEQ ID NO: 179319 - RNA, 32 nt, Human
gcucugucaccaggcuguacagugccguggcc

SEQ ID NO: 179320 - RNA, 32 nt, Human
gcucugucaccaggcuugagugcaguggugug

SEQ ID NO: 179321 - RNA, 32 nt, Human
gcucugucacccaaauuggagggcggugaugu

SEQ ID NO: 179322 - RNA, 32 nt, Human
gcucugucacccaagcaggauugcagugagcc

SEQ ID NO: 179323 - RNA, 32 nt, Human
gcucugucacccaagcuggaauacaguggcau

SEQ ID NO: 179324 - RNA, 32 nt, Human
gcucugucacccaagcuggagugcaguggcac

SEQ ID NO: 179325 - RNA, 32 nt, Human
gcucugucacccaagcuggagugcaguggugc

SEQ ID NO: 179326 - RNA, 32 nt, Human
gcucugucacccaagcuggugugcaguggugu

SEQ ID NO: 179327 - RNA, 32 nt, Human
gcucugucacccagacuagagugcaguggcac

SEQ ID NO: 179328 - RNA, 32 nt, Human
gcucugucacccagacuggaacacaguggcac

SEQ ID NO: 179329 - RNA, 32 nt, Human
gcucugucacccagacuggaguacaaugacac

SEQ ID NO: 179330 - RNA, 32 nt, Human
gcucugucacccagacuggagugcaauggcuu

SEQ ID NO: 179331 - RNA, 32 nt, Human
gcucugucacccagacuggagugcaguggcac

SEQ ID NO: 179332 - RNA, 32 nt, Human
gcucugucacccagacuggagugcaguggcau

SEQ ID NO: 179333 - RNA, 32 nt, Human
gcucugucacccagacuggagugcaguggugc

SEQ ID NO: 179334 - RNA, 32 nt, Human
gcucugucacccagacuggagugcaguggugu

SEQ ID NO: 179335 - RNA, 32 nt, Human
gcucugucacccagccuggaauguaguggcau

SEQ ID NO: 179336 - RNA, 32 nt, Human
gcucugucacccaggcaggagugcaguggcac

SEQ ID NO: 179337 - RNA, 32 nt, Human
gcucugucacccaggccggagugcaguggugc

SEQ ID NO: 179338 - RNA, 32 nt, Human
gcucugucacccaggcuagagugcaauggcac

SEQ ID NO: 179339 - RNA, 32 nt, Human
gcucugucacccaggcuagagugcaauggcau

SEQ ID NO: 179340 - RNA, 32 nt, Human
gcucugucacccaggcuagagugcaguagcac

SEQ ID NO: 179341 - RNA, 32 nt, Human
gcucugucacccaggcugaagugcaguggagc

SEQ ID NO: 179342 - RNA, 32 nt, Human
gcucugucacccaggcuggaaugcagugcagu

SEQ ID NO: 179343 - RNA, 32 nt, Human
gcucugucacccaggcuggaaugcaguggcac

SEQ ID NO: 179344 - RNA, 32 nt, Human
gcucugucacccaggcuggaaugcaguggcau

SEQ ID NO: 179345 - RNA, 32 nt, Human
gcucugucacccaggcuggagcacacuggugc

SEQ ID NO: 179346 - RNA, 32 nt, Human
gcucugucacccaggcuggagcguaauggcac

SEQ ID NO: 179347 - RNA, 32 nt, Human
gcucugucacccaggcuggaguacaauagcgu

SEQ ID NO: 179348 - RNA, 32 nt, Human
gcucugucacccaggcuggaguacacuggcac

SEQ ID NO: 179349 - RNA, 32 nt, Human
gcucugucacccaggcuggaguacaguggcau

SEQ ID NO: 179350 - RNA, 32 nt, Human
gcucugucacccaggcuggaguacaguggcgu

SEQ ID NO: 179351 - RNA, 32 nt, Human
gcucugucacccaggcuggaguaccgguggug

SEQ ID NO: 179352 - RNA, 32 nt, Human
gcucugucacccaggcuggaguauaguggugu

SEQ ID NO: 179353 - RNA, 32 nt, Human
gcucugucacccaggcuggagucuagugucgu

SEQ ID NO: 179354 - RNA, 32 nt, Human
gcucugucacccaggcuggagugaggugguac

SEQ ID NO: 179355 - RNA, 32 nt, Human
gcucugucacccaggcuggagugcaaugacgc

SEQ ID NO: 179356 - RNA, 32 nt, Human
gcucugucacccaggcuggagugcaauggcau

SEQ ID NO: 179357 - RNA, 32 nt, Human
gcucugucacccaggcuggagugcaauggcgu

SEQ ID NO: 179358 - RNA, 32 nt, Human
gcucugucacccaggcuggagugcaaugggca

SEQ ID NO: 179359 - RNA, 32 nt, Human
gcucugucacccaggcuggagugcaaugguga

SEQ ID NO: 179360 - RNA, 32 nt, Human
gcucugucacccaggcuggagugcaauggugc

SEQ ID NO: 179361 - RNA, 32 nt, Human
gcucugucacccaggcuggagugcacuggcuu

SEQ ID NO: 179362 - RNA, 32 nt, Human
gcucugucacccaggcuggagugcaguagcau

SEQ ID NO: 179363 - RNA, 28 nt, Human
gcucugucacccaggcuggagugcagug

SEQ ID NO: 179364 - RNA, 32 nt, Human
gcucugucacccaggcuggagugcagugacau

SEQ ID NO: 179365 - RNA, 32 nt, Human
gcucugucacccaggcuggagugcagugcugu

SEQ ID NO: 179366 - RNA, 32 nt, Human
gcucugucacccaggcuggagugcaguggagc

SEQ ID NO: 179367 - RNA, 32 nt, Human
gcucugucacccaggcuggagugcaguggcac

SEQ ID NO: 179368 - RNA, 32 nt, Human
gcucugucacccaggcuggagugcaguggcau

SEQ ID NO: 179369 - RNA, 32 nt, Human
gcucugucacccaggcuggagugcaguggccc

SEQ ID NO: 179370 - RNA, 32 nt, Human
gcucugucacccaggcuggagugcaguggcgc

SEQ ID NO: 179371 - RNA, 32 nt, Human
gcucugucacccaggcuggagugcaguggcgu

SEQ ID NO: 179372 - RNA, 32 nt, Human
gcucugucacccaggcuggagugcaguggcuu

SEQ ID NO: 179373 - RNA, 32 nt, Human
gcucugucacccaggcuggagugcagugguac

SEQ ID NO: 179374 - RNA, 32 nt, Human
gcucugucacccaggcuggagugcagugguau

SEQ ID NO: 179375 - RNA, 32 nt, Human
gcucugucacccaggcuggagugcaguggugc

SEQ ID NO: 179376 - RNA, 32 nt, Human
gcucugucacccaggcuggagugcaguggugu

SEQ ID NO: 179377 - RNA, 32 nt, Human
gcucugucacccaggcuggagugccauagugu

SEQ ID NO: 179378 - RNA, 32 nt, Human
gcucugucacccaggcuggagugccauggcau

SEQ ID NO: 179379 - RNA, 32 nt, Human
gcucugucacccaggcuggagugccguggcac

SEQ ID NO: 179380 - RNA, 32 nt, Human
gcucugucacccaggcuggagugcgauggcgc

SEQ ID NO: 179381 - RNA, 32 nt, Human
gcucugucacccaggcuggagugcgguggcgc

SEQ ID NO: 179382 - RNA, 32 nt, Human
gcucugucacccaggcuggagugcuauggcuc

SEQ ID NO: 179383 - RNA, 32 nt, Human
gcucugucacccaggcuggagugcuguggugc

SEQ ID NO: 179384 - RNA, 32 nt, Human
gcucugucacccaggcuggaguguaguggugc

SEQ ID NO: 179385 - RNA, 32 nt, Human
gcucugucacccaggcuggagugugcaguggc

SEQ ID NO: 179386 - RNA, 32 nt, Human
gcucugucacccaggcuggaguuauagugacg

SEQ ID NO: 179387 - RNA, 32 nt, Human
gcucugucacccaggcuggaguucaguggugc

SEQ ID NO: 179388 - RNA, 32 nt, Human
gcucugucacccaggcuggggcgcaauggcac

SEQ ID NO: 179389 - RNA, 32 nt, Human
gcucugucacccaggcuggggugcaguggcgc

SEQ ID NO: 179390 - RNA, 32 nt, Human
gcucugucacccaggcuguaguacaguggugc

SEQ ID NO: 179391 - RNA, 32 nt, Human
gcucugucacccaggcuguaguggaguggugu

SEQ ID NO: 179392 - RNA, 32 nt, Human
gcucugucacccaggcugucguaaguggcaau

SEQ ID NO: 179393 - RNA, 32 nt, Human
gcucugucacccaggcuugagugcaguggugc

SEQ ID NO: 179394 - RNA, 32 nt, Human
gcucugucacccagguggcuggaguacagugg

SEQ ID NO: 179395 - RNA, 32 nt, Human
gcucugucacccagguuggagcacaguggugc

SEQ ID NO: 179396 - RNA, 32 nt, Human
gcucugucacccagguuggagugcaguggugu

SEQ ID NO: 179397 - RNA, 32 nt, Human
gcucugucacccagguuggagugcauuggugu

SEQ ID NO: 179398 - RNA, 32 nt, Human
gcucugucacccagguuggagugccauggcau

SEQ ID NO: 179399 - RNA, 32 nt, Human
gcucugucacccagucuggagugcaguggcaa

SEQ ID NO: 179400 - RNA, 32 nt, Human
gcucugucacccagucuggagugcaguggugu

SEQ ID NO: 179401 - RNA, 32 nt, Human
gcucugucacccaguuuggagugcaguggugc

SEQ ID NO: 179402 - RNA, 32 nt, Human
gcucugucacccauccuggagugcaguagugu

SEQ ID NO: 179403 - RNA, 32 nt, Human
gcucugucacccaugcuugagugcaaccucug

SEQ ID NO: 179404 - RNA, 32 nt, Human
gcucugucacccgggcuggagugcaguggcgc

SEQ ID NO: 179405 - RNA, 32 nt, Human
gcucugucacccgggcuggagugcaguggugc

SEQ ID NO: 179406 - RNA, 32 nt, Human
gcucugucacccgggcuggagugcuguggcuu

SEQ ID NO: 179407 - RNA, 32 nt, Human
gcucugucacccgggcuggaguguaacguggc

SEQ ID NO: 179408 - RNA, 32 nt, Human
gcucugucaccgaggcuggagugcaguggcgc

SEQ ID NO: 179409 - RNA, 32 nt, Human
gcucugucaccuagacuggaauguguggcaua

SEQ ID NO: 179410 - RNA, 32 nt, Human
gcucugucaccuaggcuagagugcaguggugc

SEQ ID NO: 179411 - RNA, 32 nt, Human
gcucugucaccuaggcuagaguggaguggcau

SEQ ID NO: 179412 - RNA, 32 nt, Human
gcucugucaccuaggcugcagugcaguggcac

SEQ ID NO: 179413 - RNA, 32 nt, Human
gcucugucaccuaggcuggagugcaguggcau

SEQ ID NO: 179414 - RNA, 32 nt, Human
gcucugucaccuaggcuggagugcaguggcgc

SEQ ID NO: 179415 - RNA, 32 nt, Human
gcucugucaccuaggcuggagugcaguggggc

SEQ ID NO: 179416 - RNA, 32 nt, Human
gcucugucaccugagcucuagugcaguagugc

SEQ ID NO: 179417 - RNA, 32 nt, Human
gcucugucacgaggcuggagugcaguggcccc

SEQ ID NO: 179418 - RNA, 31 nt, Human
gcucugucacucaaugguugggaaauuugug

SEQ ID NO: 179419 - RNA, 32 nt, Human
gcucugucacucaggcugcagugcaguggcau

SEQ ID NO: 179420 - RNA, 32 nt, Human
gcucugucacucaggcuggaaugcaguggcgc

SEQ ID NO: 179421 - RNA, 32 nt, Human
gcucugucacucaggcuggaguacaguggcac

SEQ ID NO: 179422 - RNA, 32 nt, Human
gcucugucacucaggcuggagugcagugguau

SEQ ID NO: 179423 - RNA, 32 nt, Human
gcucugucacucaugcuggagugcaguggcgu

SEQ ID NO: 179424 - RNA, 32 nt, Human
gcucugucacugaggcuggagugcaguggcgc

SEQ ID NO: 179425 - RNA, 32 nt, Human
gcucugucacuuaggcuggagugcaguggcgu

SEQ ID NO: 179426 - RNA, 32 nt, Human
gcucugucacuuggguuggagugcaguugcag

SEQ ID NO: 179427 - RNA, 32 nt, Human
gcucugucacuuuaaaaagaccuguugaaauu

SEQ ID NO: 179428 - RNA, 32 nt, Human
gcucugucaucaggcuggagugcaguggcgca

SEQ ID NO: 179429 - RNA, 32 nt, Human
gcucugucaucaggcuggagugcaguggcuca

SEQ ID NO: 179430 - RNA, 32 nt, Human
gcucugucauccaaacuggagugcaguggcac

SEQ ID NO: 179431 - RNA, 32 nt, Human
gcucugucauccaggcuggaggguaguggcgu

SEQ ID NO: 179432 - RNA, 32 nt, Human
gcucugucauccaggcuggagugcagugaugc

SEQ ID NO: 179433 - RNA, 32 nt, Human
gcucugucauccaggcuggagugcaguggcau

SEQ ID NO: 179434 - RNA, 32 nt, Human
gcucugucauccaggcuggagugcaguggcgc

SEQ ID NO: 179435 - RNA, 32 nt, Human
gcucugucauccagguuggagugcaguggcau

SEQ ID NO: 179436 - RNA, 32 nt, Human
gcucugucaucuaggcuggagugcaguggugu

SEQ ID NO: 179437 - RNA, 32 nt, Human
gcucugucaugcaggcuggagugcgguggugc

SEQ ID NO: 179438 - RNA, 32 nt, Human
gcucugucauucaggcaagagugcaguagugu

SEQ ID NO: 179439 - RNA, 32 nt, Human
gcucugucauucaggcuggagugcaguggugc

SEQ ID NO: 179440 - RNA, 32 nt, Human
gcucugucccccaggcuggagugcaguggcau

SEQ ID NO: 179441 - RNA, 32 nt, Human
gcucugucccccaggcuggagugcaguggcuc

SEQ ID NO: 179442 - RNA, 32 nt, Human
gcucugucccccaggcuggcgugcaguagcau

SEQ ID NO: 179443 - RNA, 32 nt, Human
gcucugucccccaugcuggagugcaguggcau

SEQ ID NO: 179444 - RNA, 20 nt, Human
gcucuguccccucugcugcc

SEQ ID NO: 179445 - RNA, 32 nt, Human
gcucuguccccugggcuggagugcaauggugc

SEQ ID NO: 179446 - RNA, 32 nt, Human
gcucugucccucaggcuggagugcaguagcgu

SEQ ID NO: 179447 - RNA, 32 nt, Human
gcucugucccugcgggaagagcagggagagga

SEQ ID NO: 179448 - RNA, 32 nt, Human
gcucugucccuuuucagagccaaaggaaauaa

SEQ ID NO: 179449 - RNA, 32 nt, Human
gcucuguccgccaggcuggagugcaguggcgc

SEQ ID NO: 179450 - RNA, 32 nt, Human
gcucugucgaccaggcuggagugcaggggcac

SEQ ID NO: 179451 - RNA, 32 nt, Human
gcucugucgccaagccagagugcaguggugug

SEQ ID NO: 179452 - RNA, 32 nt, Human
gcucugucgccaaggcuggagggcaauggcau

SEQ ID NO: 179453 - RNA, 32 nt, Human
gcucugucgccaaggcuggagugcaguggugu

SEQ ID NO: 179454 - RNA, 32 nt, Human
gcucugucgccaaguuggagugcaauggugcg

SEQ ID NO: 179455 - RNA, 32 nt, Human
gcucugucgccagacuggagugcaguggcgca

SEQ ID NO: 179456 - RNA, 32 nt, Human
gcucugucgccaggacuggagugcagugacac

SEQ ID NO: 179457 - RNA, 32 nt, Human
gcucugucgccaggcuagagugcgguggcgcg

SEQ ID NO: 179458 - RNA, 32 nt, Human
gcucugucgccaggcugaagugcaguggcgca

SEQ ID NO: 179459 - RNA, 32 nt, Human
gcucugucgccaggcuggaguacaguggugug

SEQ ID NO: 179460 - RNA, 32 nt, Human
gcucugucgccaggcuggagugcaauggcgcg

SEQ ID NO: 179461 - RNA, 32 nt, Human
gcucugucgccaggcuggagugcaauggcgug

SEQ ID NO: 179462 - RNA, 32 nt, Human
gcucugucgccaggcuggagugcaguggcgca

SEQ ID NO: 179463 - RNA, 32 nt, Human
gcucugucgccaggcuggagugcaguggcgcg

SEQ ID NO: 179464 - RNA, 32 nt, Human
gcucugucgccaggcuggagugcaguggcgug

SEQ ID NO: 179465 - RNA, 32 nt, Human
gcucugucgccaggcuggagugcaguggugcg

SEQ ID NO: 179466 - RNA, 32 nt, Human
gcucugucgccagguuggagugcaguggcgug

SEQ ID NO: 179467 - RNA, 32 nt, Human
gcucugucgcccaagcugaagugcaguggugc

SEQ ID NO: 179468 - RNA, 32 nt, Human
gcucugucgcccaagcuggaguacaguggugc

SEQ ID NO: 179469 - RNA, 32 nt, Human
gcucugucgcccacccaggcuggaguacagug

SEQ ID NO: 179470 - RNA, 32 nt, Human
gcucugucgcccacguuggagugcagugaugu

SEQ ID NO: 179471 - RNA, 32 nt, Human
gcucugucgcccagacuagaaugcaguggugc

SEQ ID NO: 179472 - RNA, 32 nt, Human
gcucugucgcccagacuggagugcaauggugc

SEQ ID NO: 179473 - RNA, 32 nt, Human
gcucugucgcccagccuggagugcaguggcac

SEQ ID NO: 179474 - RNA, 32 nt, Human
gcucugucgcccaggauggagugcaguggcgc

SEQ ID NO: 179475 - RNA, 32 nt, Human
gcucugucgcccaggcgggaaugcaguggcgc

SEQ ID NO: 179476 - RNA, 32 nt, Human
gcucugucgcccaggcuagagugcagugguau

SEQ ID NO: 179477 - RNA, 32 nt, Human
gcucugucgcccaggcucgagugcaguggcau

SEQ ID NO: 179478 - RNA, 32 nt, Human
gcucugucgcccaggcugaaguguagagugca

SEQ ID NO: 179479 - RNA, 32 nt, Human
gcucugucgcccaggcugcagugcgguggugc

SEQ ID NO: 179480 - RNA, 32 nt, Human
gcucugucgcccaggcuggaaugcaguggcgc

SEQ ID NO: 179481 - RNA, 32 nt, Human
gcucugucgcccaggcuggaaugcaguggugc

SEQ ID NO: 179482 - RNA, 32 nt, Human
gcucugucgcccaggcuggaaugcaguuguga

SEQ ID NO: 179483 - RNA, 32 nt, Human
gcucugucgcccaggcuggaaugcuguagcaa

SEQ ID NO: 179484 - RNA, 32 nt, Human
gcucugucgcccaggcuggagcgcaauggcau

SEQ ID NO: 179485 - RNA, 32 nt, Human
gcucugucgcccaggcuggagggcaguggcac

SEQ ID NO: 179486 - RNA, 32 nt, Human
gcucugucgcccaggcuggaguacaguggugu

SEQ ID NO: 179487 - RNA, 32 nt, Human
gcucugucgcccaggcuggagugagugcagug

SEQ ID NO: 179488 - RNA, 32 nt, Human
gcucugucgcccaggcuggagugcaauggcac

SEQ ID NO: 179489 - RNA, 32 nt, Human
gcucugucgcccaggcuggagugcacuggcgc

SEQ ID NO: 179490 - RNA, 32 nt, Human
gcucugucgcccaggcuggagugcagaggugc

SEQ ID NO: 179491 - RNA, 32 nt, Human
gcucugucgcccaggcuggagugcaggggcgc

SEQ ID NO: 179492 - RNA, 32 nt, Human
gcucugucgcccaggcuggagugcagucgugc

SEQ ID NO: 179493 - RNA, 32 nt, Human
gcucugucgcccaggcuggagugcagugacau

SEQ ID NO: 179494 - RNA, 32 nt, Human
gcucugucgcccaggcuggagugcagugaugc

SEQ ID NO: 179495 - RNA, 32 nt, Human
gcucugucgcccaggcuggagugcagugccgc

SEQ ID NO: 179496 - RNA, 32 nt, Human
gcucugucgcccaggcuggagugcaguggagc

SEQ ID NO: 179497 - RNA, 32 nt, Human
gcucugucgcccaggcuggagugcaguggcac

SEQ ID NO: 179498 - RNA, 32 nt, Human
gcucugucgcccaggcuggagugcaguggcag

SEQ ID NO: 179499 - RNA, 32 nt, Human
gcucugucgcccaggcuggagugcaguggcau

SEQ ID NO: 179500 - RNA, 32 nt, Human
gcucugucgcccaggcuggagugcaguggccu

SEQ ID NO: 179501 - RNA, 32 nt, Human
gcucugucgcccaggcuggagugcaguggcgc

SEQ ID NO: 179502 - RNA, 32 nt, Human
gcucugucgcccaggcuggagugcaguggcgg

SEQ ID NO: 179503 - RNA, 32 nt, Human
gcucugucgcccaggcuggagugcaguggcgu

SEQ ID NO: 179504 - RNA, 32 nt, Human
gcucugucgcccaggcuggagugcagugguac

SEQ ID NO: 179505 - RNA, 32 nt, Human
gcucugucgcccaggcuggagugcagugguga

SEQ ID NO: 179506 - RNA, 32 nt, Human
gcucugucgcccaggcuggagugcaguggugc

SEQ ID NO: 179507 - RNA, 32 nt, Human
gcucugucgcccaggcuggagugcaguggugg

SEQ ID NO: 179508 - RNA, 32 nt, Human
gcucugucgcccaggcuggagugcaguggugu

SEQ ID NO: 179509 - RNA, 32 nt, Human
gcucugucgcccaggcuggagugcgguggcgc

SEQ ID NO: 179510 - RNA, 32 nt, Human
gcucugucgcccaggcuggaguucaguggcgc

SEQ ID NO: 179511 - RNA, 32 nt, Human
gcucugucgcccaggcuguagugcaauggcgc

SEQ ID NO: 179512 - RNA, 32 nt, Human
gcucugucgcccagggcuggagugcaguggcg

SEQ ID NO: 179513 - RNA, 32 nt, Human
gcucugucgcccaggguggagugcaguggcgu

SEQ ID NO: 179514 - RNA, 32 nt, Human
gcucugucgcccagguuggagugcaguggcac

SEQ ID NO: 179515 - RNA, 32 nt, Human
gcucugucgcccagguuggagugcaguggcgc

SEQ ID NO: 179516 - RNA, 32 nt, Human
gcucugucgcccagguuggagugcaguggcgu

SEQ ID NO: 179517 - RNA, 32 nt, Human
gcucugucgcccagguuggagugcaguggugc

SEQ ID NO: 179518 - RNA, 32 nt, Human
gcucugucgcccagguuguaaugcaguggcgc

SEQ ID NO: 179519 - RNA, 32 nt, Human
gcucugucgcccagguuugagugcaauggcac

SEQ ID NO: 179520 - RNA, 32 nt, Human
gcucugucgcccaugcuggagugcaguggcgc

SEQ ID NO: 179521 - RNA, 32 nt, Human
gcucugucgccgaggcugcagugcagcggugc

SEQ ID NO: 179522 - RNA, 32 nt, Human
gcucugucgccuaagcuggagugugguggcac

SEQ ID NO: 179523 - RNA, 32 nt, Human
gcucugucgccuaggcugcagugcaguggcgg

SEQ ID NO: 179524 - RNA, 32 nt, Human
gcucugucgccuggcuggagugcaguggugug

SEQ ID NO: 179525 - RNA, 32 nt, Human
gcucugucgcgcaggguggagugcgguggcac

SEQ ID NO: 179526 - RNA, 32 nt, Human
gcucugucgcucaggcuggagagcgguggugc

SEQ ID NO: 179527 - RNA, 32 nt, Human
gcucugucgcucaggcuggagugcaguggcgc

SEQ ID NO: 179528 - RNA, 32 nt, Human
gcucugucgcucaggcuggagugcaguggcgu

SEQ ID NO: 179529 - RNA, 32 nt, Human
gcucugucgcucgcgcuggagugcaguggcau

SEQ ID NO: 179530 - RNA, 32 nt, Human
gcucugucggccaggcuggagugcaguggcau

SEQ ID NO: 179531 - RNA, 32 nt, Human
gcucugucggccagguuggagugcaguggugc

SEQ ID NO: 179532 - RNA, 32 nt, Human
gcucugucguccaggcuggagugcagugacuc

SEQ ID NO: 179533 - RNA, 32 nt, Human
gcucugucguccaggcuggagugcagugcugc

SEQ ID NO: 179534 - RNA, 32 nt, Human
gcucugucguccaggcuggagugcaguggcgc

SEQ ID NO: 179535 - RNA, 32 nt, Human
gcucugucguccaggcuggagugccguggcgu

SEQ ID NO: 179536 - RNA, 32 nt, Human
gcucugucgucgaggcuggaguguaguggugc

SEQ ID NO: 179537 - RNA, 32 nt, Human
gcucugucuccaggcuggaguacaguggugcg

SEQ ID NO: 179538 - RNA, 32 nt, Human
gcucugucuccaggcuggagugcaguggcguc

SEQ ID NO: 179539 - RNA, 32 nt, Human
gcucugucucccaggccggagugcaguggcac

SEQ ID NO: 179540 - RNA, 32 nt, Human
gcucugucucccaggcuagaguaccguggcac

SEQ ID NO: 179541 - RNA, 32 nt, Human
gcucugucucccaggcuagagugcaauggcac

SEQ ID NO: 179542 - RNA, 32 nt, Human
gcucugucucccaggcugaagugcaguggcac

SEQ ID NO: 179543 - RNA, 32 nt, Human
gcucugucucccaggcuggagcguaguaaugc

SEQ ID NO: 179544 - RNA, 32 nt, Human
gcucugucucccaggcuggaggucaguggcac

SEQ ID NO: 179545 - RNA, 32 nt, Human
gcucugucucccaggcuggagugcaggcuugg

SEQ ID NO: 179546 - RNA, 32 nt, Human
gcucugucucccaggcuggagugcagugacac

SEQ ID NO: 179547 - RNA, 32 nt, Human
gcucugucucccaggcuggagugcaguggcac

SEQ ID NO: 179548 - RNA, 32 nt, Human
gcucugucucccaggcuggagugcaguggcau

SEQ ID NO: 179549 - RNA, 32 nt, Human
gcucugucucccaggcuggagugcaguggcgu

SEQ ID NO: 179550 - RNA, 32 nt, Human
gcucugucucccaggcuggagugcgguggcac

SEQ ID NO: 179551 - RNA, 32 nt, Human
gcucugucucccagguuggagugcaguggcac

SEQ ID NO: 179552 - RNA, 32 nt, Human
gcucugucucccgggcuggagugcaguggcgc

SEQ ID NO: 179553 - RNA, 32 nt, Human
gcucugucuccuaggcuggagcgcaguggugc

SEQ ID NO: 179554 - RNA, 32 nt, Human
gcucugucucucaggcuagagcagugugcgau

SEQ ID NO: 179555 - RNA, 22 nt, Human
gcucugucugccccggcccgug

SEQ ID NO: 179556 - RNA, 32 nt, Human
gcucugucuggggagcacccacaggcugccuu

SEQ ID NO: 179557 - RNA, 32 nt, Human
gcucugucuuccugccuucgucucgcuccauc

SEQ ID NO: 179558 - RNA, 18 nt, Human
gcucugucuuccugguca

SEQ ID NO: 179559 - RNA, 32 nt, Human
gcucugugauacaugacauucuuugggaauuu

SEQ ID NO: 179560 - RNA, 32 nt, Human
gcucugugauauguaagugaaaugcuagcugu

SEQ ID NO: 179561 - RNA, 32 nt, Human
gcucugugauuaccuaaucuggcuucccaauc

SEQ ID NO: 179562 - RNA, 32 nt, Human
gcucugugcaugccccagccuccugggccugc

SEQ ID NO: 179563 - RNA, 32 nt, Human
gcucugugcucacaccucggcugcaugcaccc

SEQ ID NO: 179564 - RNA, 32 nt, Human
gcucugugcucuucugugugcugcguuguggc

SEQ ID NO: 179565 - RNA, 32 nt, Human
gcucugugcugaaggguggaaggcuacccuga

SEQ ID NO: 179566 - RNA, 32 nt, Human
gcucuguggaaugagaaaaaugcgcucugcag

SEQ ID NO: 179567 - RNA, 32 nt, Human
gcucuguggaugagaggaaccaucgcaggaug

SEQ ID NO: 179568 - RNA, 32 nt, Human
gcucuguggccacccggcucccauggcgggag

SEQ ID NO: 179569 - RNA, 32 nt, Human
gcucuguggcccaggcugagagcagcagggua

SEQ ID NO: 179570 - RNA, 32 nt, Human
gcucuguggcccaggcuggagugcaguggcac

SEQ ID NO: 179571 - RNA, 32 nt, Human
gcucuguggcccaggcuggaguguaguggcgu

SEQ ID NO: 179572 - RNA, 32 nt, Human
gcucuguggcccaggcuggcgugcagugggcc

SEQ ID NO: 179573 - RNA, 32 nt, Human
gcucuguggcuaucugacaaccagucccagcc

SEQ ID NO: 179574 - RNA, 32 nt, Human
gcucugugggagggaggucggagccagcuguu

SEQ ID NO: 179575 - RNA, 32 nt, Human
gcucugugggaugagagcugggugcagacugu

SEQ ID NO: 179576 - RNA, 31 nt, Human
gcucugugggugggagugagacaaaacacag

SEQ ID NO: 179577 - RNA, 32 nt, Human
gcucugugugagccucuggggcucccucgcuc

SEQ ID NO: 179578 - RNA, 32 nt, Human
gcucuguguggguggucacgggagggugugag

SEQ ID NO: 179579 - RNA, 32 nt, Human
gcucuguguguguggguggucacaggagagug

SEQ ID NO: 179580 - RNA, 32 nt, Human
gcucuguguguguggguggucacaggagggug

SEQ ID NO: 179581 - RNA, 32 nt, Human
gcucuguuacccagacuggaguacagggaugc

SEQ ID NO: 179582 - RNA, 32 nt, Human
gcucuguuacccagauuggagugcaguggcgc

SEQ ID NO: 179583 - RNA, 32 nt, Human
gcucuguuacccaggcuggagugcagugggug

SEQ ID NO: 179584 - RNA, 32 nt, Human
gcucuguuacccaggcuggagugcaguggugu

SEQ ID NO: 179585 - RNA, 32 nt, Human
gcucuguuacccaggcuggaguguaguggugc

SEQ ID NO: 179586 - RNA, 32 nt, Human
gcucuguuacccaugcuggaguacgguggcga

SEQ ID NO: 179587 - RNA, 32 nt, Human
gcucuguuauccaggcuggugugcagugauac

SEQ ID NO: 179588 - RNA, 24 nt, Human
gcucuguucccacucagaaggcug

SEQ ID NO: 179589 - RNA, 20 nt, Human
gcucuguucccucccugcug

SEQ ID NO: 179590 - RNA, 20 nt, Human
gcucuguucuuccucagcca

SEQ ID NO: 179591 - RNA, 32 nt, Human
gcucuguugccaaggcuggagugcaguggaac

SEQ ID NO: 179592 - RNA, 32 nt, Human
gcucuguugccacugcacucuggccugggcaa

SEQ ID NO: 179593 - RNA, 32 nt, Human
gcucuguugccaggcuggagggcaguggcacg

SEQ ID NO: 179594 - RNA, 32 nt, Human
gcucuguugccaggcuggagugcacuggggcu

SEQ ID NO: 179595 - RNA, 32 nt, Human
gcucuguugccaggcuggagugcaguggugcg

SEQ ID NO: 179596 - RNA, 32 nt, Human
gcucuguugcccaagcuggagugaagugguac

SEQ ID NO: 179597 - RNA, 32 nt, Human
gcucuguugcccacauuggagugcaguggcac

SEQ ID NO: 179598 - RNA, 32 nt, Human
gcucuguugcccacgcaggagugcaguggcau

SEQ ID NO: 179599 - RNA, 32 nt, Human
gcucuguugcccagacuggagugcaguggcgu

SEQ ID NO: 179600 - RNA, 32 nt, Human
gcucuguugcccagacuggagugcaguggugu

SEQ ID NO: 179601 - RNA, 32 nt, Human
gcucuguugcccagccuggagugcaauggcac

SEQ ID NO: 179602 - RNA, 32 nt, Human
gcucuguugcccagcuggagugcaguggugug

SEQ ID NO: 179603 - RNA, 32 nt, Human
gcucuguugcccaggcaggaguacaguggcau

SEQ ID NO: 179604 - RNA, 32 nt, Human
gcucuguugcccaggcaguagugcaguggcgc

SEQ ID NO: 179605 - RNA, 32 nt, Human
gcucuguugcccaggcuagagugcaguggcau

SEQ ID NO: 179606 - RNA, 32 nt, Human
gcucuguugcccaggcuagagugcaguggugc

SEQ ID NO: 179607 - RNA, 32 nt, Human
gcucuguugcccaggcuccagugcaguggugu

SEQ ID NO: 179608 - RNA, 32 nt, Human
gcucuguugcccaggcugaagugcaguggggc

SEQ ID NO: 179609 - RNA, 32 nt, Human
gcucuguugcccaggcugaaguguaguggcac

SEQ ID NO: 179610 - RNA, 32 nt, Human
gcucuguugcccaggcuggaaugcaguggcac

SEQ ID NO: 179611 - RNA, 32 nt, Human
gcucuguugcccaggcuggaaugcaguggcgu

SEQ ID NO: 179612 - RNA, 32 nt, Human
gcucuguugcccaggcuggaguacagugguca

SEQ ID NO: 179613 - RNA, 32 nt, Human
gcucuguugcccaggcuggaguacauuggugu

SEQ ID NO: 179614 - RNA, 32 nt, Human
gcucuguugcccaggcuggaguacauuugccu

SEQ ID NO: 179615 - RNA, 32 nt, Human
gcucuguugcccaggcuggaguccaguggcau

SEQ ID NO: 179616 - RNA, 32 nt, Human
gcucuguugcccaggcuggagugcaaugacac

SEQ ID NO: 179617 - RNA, 32 nt, Human
gcucuguugcccaggcuggagugcaauggcac

SEQ ID NO: 179618 - RNA, 32 nt, Human
gcucuguugcccaggcuggagugcaauggcau

SEQ ID NO: 179619 - RNA, 32 nt, Human
gcucuguugcccaggcuggagugcacuggcuu

SEQ ID NO: 179620 - RNA, 32 nt, Human
gcucuguugcccaggcuggagugcagcggcau

SEQ ID NO: 179621 - RNA, 32 nt, Human
gcucuguugcccaggcuggagugcagggacac

SEQ ID NO: 179622 - RNA, 32 nt, Human
gcucuguugcccaggcuggagugcaguagcac

SEQ ID NO: 179623 - RNA, 32 nt, Human
gcucuguugcccaggcuggagugcagucgcac

SEQ ID NO: 179624 - RNA, 32 nt, Human
gcucuguugcccaggcuggagugcagugacgu

SEQ ID NO: 179625 - RNA, 32 nt, Human
gcucuguugcccaggcuggagugcaguggcac

SEQ ID NO: 179626 - RNA, 32 nt, Human
gcucuguugcccaggcuggagugcaguggcau

SEQ ID NO: 179627 - RNA, 32 nt, Human
gcucuguugcccaggcuggagugcaguggcga

SEQ ID NO: 179628 - RNA, 32 nt, Human
gcucuguugcccaggcuggagugcaguggcgc

SEQ ID NO: 179629 - RNA, 32 nt, Human
gcucuguugcccaggcuggagugcaguggcgu

SEQ ID NO: 179630 - RNA, 32 nt, Human
gcucuguugcccaggcuggagugcagugguau

SEQ ID NO: 179631 - RNA, 32 nt, Human
gcucuguugcccaggcuggagugcagugguga

SEQ ID NO: 179632 - RNA, 32 nt, Human
gcucuguugcccaggcuggagugcaguggugc

SEQ ID NO: 179633 - RNA, 32 nt, Human
gcucuguugcccaggcuggagugcaguggugu

SEQ ID NO: 179634 - RNA, 32 nt, Human
gcucuguugcccaggcuggagugcgguggacu

SEQ ID NO: 179635 - RNA, 32 nt, Human
gcucuguugcccaggcuggagugcgguggcau

SEQ ID NO: 179636 - RNA, 32 nt, Human
gcucuguugcccaggcuggagugcgguggugc

SEQ ID NO: 179637 - RNA, 32 nt, Human
gcucuguugcccaggcuggaguguaauggugc

SEQ ID NO: 179638 - RNA, 32 nt, Human
gcucuguugcccaggcuggaguguagagacac

SEQ ID NO: 179639 - RNA, 32 nt, Human
gcucuguugcccaggcuggaguguagugguau

SEQ ID NO: 179640 - RNA, 32 nt, Human
gcucuguugcccaggcuggaguguaguggugu

SEQ ID NO: 179641 - RNA, 32 nt, Human
gcucuguugcccaggcugggugcagcggugcg

SEQ ID NO: 179642 - RNA, 32 nt, Human
gcucuguugcccaggcugguguguagugaucu

SEQ ID NO: 179643 - RNA, 32 nt, Human
gcucuguugcccaggguggagugcagcggugc

SEQ ID NO: 179644 - RNA, 32 nt, Human
gcucuguugcccagguuagagugcaguggcuu

SEQ ID NO: 179645 - RNA, 32 nt, Human
gcucuguugcccagguuggagugcaguggcac

SEQ ID NO: 179646 - RNA, 32 nt, Human
gcucuguugcccaugcuggagugcauuggcac

SEQ ID NO: 179647 - RNA, 32 nt, Human
gcucuguugcccauucuggagugcaguggugu

SEQ ID NO: 179648 - RNA, 32 nt, Human
gcucuguugccccagcuugagugcaguggcgu

SEQ ID NO: 179649 - RNA, 32 nt, Human
gcucuguugccccaggcuggagugcaguggcg

SEQ ID NO: 179650 - RNA, 32 nt, Human
gcucuguugcccgggcuggaguacaauggcau

SEQ ID NO: 179651 - RNA, 32 nt, Human
gcucuguugcccgggcuggagugcaguggugu

SEQ ID NO: 179652 - RNA, 32 nt, Human
gcucuguugcccuggcuggaguacaguggcau

SEQ ID NO: 179653 - RNA, 32 nt, Human
gcucuguugcccuggcuggaguucagugacau

SEQ ID NO: 179654 - RNA, 32 nt, Human
gcucuguugccuaggcuagggugcaguggcac

SEQ ID NO: 179655 - RNA, 32 nt, Human
gcucuguugccuaggcuggaguacaguggccu

SEQ ID NO: 179656 - RNA, 32 nt, Human
gcucuguugccuaggcuggaguacaguggugc

SEQ ID NO: 179657 - RNA, 32 nt, Human
gcucuguugccuaggcuggagugcagugaggc

SEQ ID NO: 179658 - RNA, 32 nt, Human
gcucuguugccuaggcuggagugcaguggcgc

SEQ ID NO: 179659 - RNA, 32 nt, Human
gcucuguugccugggcuggagaacaguggcac

SEQ ID NO: 179660 - RNA, 32 nt, Human
gcucuguugccugggcuggagugcagugccac

SEQ ID NO: 179661 - RNA, 32 nt, Human
gcucuguugcucaggcuggauugcaguggcgu

SEQ ID NO: 179662 - RNA, 32 nt, Human
gcucuguugcucccccucucuagcucccucac

SEQ ID NO: 179663 - RNA, 32 nt, Human
gcucuguugcugaggcuggagugcagugaugu

SEQ ID NO: 179664 - RNA, 32 nt, Human
gcucuguugcugugccuagucuaguguccccc

SEQ ID NO: 179665 - RNA, 32 nt, Human
gcucuguuggccaggcuggaaugcaguggcac

SEQ ID NO: 179666 - RNA, 32 nt, Human
gcucuguuggccaggcuggagugcaguguucg

SEQ ID NO: 179667 - RNA, 32 nt, Human
gcucuguuguccaggcuagagugcaguggugu

SEQ ID NO: 179668 - RNA, 32 nt, Human
gcucuguuguccaggcuggagggcagugacau

SEQ ID NO: 179669 - RNA, 32 nt, Human
gcucuguuguccaggcuggagugcaauggcag

SEQ ID NO: 179670 - RNA, 32 nt, Human
gcucuguuguccaggcuggagugcaguggcac

SEQ ID NO: 179671 - RNA, 32 nt, Human
gcucuguuguguuuauucaccaauuuguacau

SEQ ID NO: 179672 - RNA, 32 nt, Human
gcucuguuguucugggauucaggcuggccggu

SEQ ID NO: 179673 - RNA, 32 nt, Human
gcucuguuucccaggcuggagugcaguggcgc

SEQ ID NO: 179674 - RNA, 32 nt, Human
gcucuguuucccagucucuccccgccucgccu

SEQ ID NO: 179675 - RNA, 32 nt, Human
gcucuguuucccccucuccccaaagccuucag

SEQ ID NO: 179676 - RNA, 17 nt, Human
gcucuguuucugacgca

SEQ ID NO: 179677 - RNA, 32 nt, Human
gcucuguuucugccuggucauccugagccccu

SEQ ID NO: 179678 - RNA, 17 nt, Human
gcucuguuugcuugaua

SEQ ID NO: 179679 - RNA, 32 nt, Human
gcucuguuuuaucagagauuauggagcaagaa

SEQ ID NO: 179680 - RNA, 32 nt, Human
gcucuuaaaugcugcauuauaacugagucuau

SEQ ID NO: 179681 - RNA, 32 nt, Human
gcucuuaacugcuaugcugcacugccucauuc

SEQ ID NO: 179682 - RNA, 32 nt, Human
gcucuuaacuuccuccccucugaauuuaguuu

SEQ ID NO: 179683 - RNA, 32 nt, Human
gcucuuaaguguugauuccauggaacugacgg

SEQ ID NO: 179684 - RNA, 21 nt, Human
gcucuuacagaaugccauaaa

SEQ ID NO: 179685 - RNA, 32 nt, Human
gcucuuacaggcccugcacagaguagcacuca

SEQ ID NO: 179686 - RNA, 32 nt, Human
gcucuuacccuugugaagcuuuuccuuuagcc

SEQ ID NO: 179687 - RNA, 32 nt, Human
gcucuuaccugucagugucucauugagugucg

SEQ ID NO: 179688 - RNA, 32 nt, Human
gcucuuacgcccaggcuggaaugaaguggcau

SEQ ID NO: 179689 - RNA, 32 nt, Human
gcucuuagccagaucauauguaauacuaaauu

SEQ ID NO: 179690 - RNA, 32 nt, Human
gcucuuagccagugacugcagagcagggauac

SEQ ID NO: 179691 - RNA, 32 nt, Human
gcucuuaguauucuuccuugaggcucacauca

SEQ ID NO: 179692 - RNA, 32 nt, Human
gcucuuaucuaugaagacaucuucccagagug

SEQ ID NO: 179693 - RNA, 32 nt, Human
gcucuuauugcccaggcuggagugcaauggca

SEQ ID NO: 179694 - RNA, 32 nt, Human
gcucuuauugcccaggcuggagugcagugacg

SEQ ID NO: 179695 - RNA, 32 nt, Human
gcucuuauugcccaggcuggagugcaguggca

SEQ ID NO: 179696 - RNA, 32 nt, Human
gcucuuauugcccaggcuggagugcaguggcg

SEQ ID NO: 179697 - RNA, 32 nt, Human
gcucuucacaccagauuucacuuuugauccuu

SEQ ID NO: 179698 - RNA, 32 nt, Human
gcucuucacaguccuggacuccugccaccagc

SEQ ID NO: 179699 - RNA, 32 nt, Human
gcucuucaccuuccucaccucacaucugaccc

SEQ ID NO: 179700 - RNA, 32 nt, Human
gcucuucacuguuccacggccucccagugccu

SEQ ID NO: 179701 - RNA, 32 nt, Human
gcucuucagaaagcaucugcaugugaacacca

SEQ ID NO: 179702 - RNA, 32 nt, Human
gcucuucagagccacagaccucaggguggagu

SEQ ID NO: 179703 - RNA, 24 nt, Human
gcucuucagccugcucuucggggu

SEQ ID NO: 179704 - RNA, 32 nt, Human
gcucuucaggaggcugagaaaagagaauuguu

SEQ ID NO: 179705 - RNA, 31 nt, Human
gcucuucauacuucuauuuugagguaacugu

SEQ ID NO: 179706 - RNA, 32 nt, Human
gcucuucaucuagacccaagccccaggucgug

SEQ ID NO: 179707 - RNA, 32 nt, Human
gcucuucauguugccaaagcaccaagacacac

SEQ ID NO: 179708 - RNA, 32 nt, Human
gcucuucauuauuuucagcuggaggacagagc

SEQ ID NO: 179709 - RNA, 22 nt, Human
gcucuuccacccaggagggccc

SEQ ID NO: 179710 - RNA, 32 nt, Human
gcucuuccaccuuguccacaaggcuuaucuag

SEQ ID NO: 179711 - RNA, 32 nt, Human
gcucuuccagaaguucaagcagcagaaggagc

SEQ ID NO: 179712 - RNA, 32 nt, Human
gcucuuccagccugaacccauggaguacuaac

SEQ ID NO: 179713 - RNA, 21 nt, Human
gcucuucccccuucccgaggu

SEQ ID NO: 179714 - RNA, 32 nt, Human
gcucuucccuccccucuccagcuacauacucu

SEQ ID NO: 179715 - RNA, 32 nt, Human
gcucuucccucccucacuuuuacuuucccuuc

SEQ ID NO: 179716 - RNA, 32 nt, Human
gcucuucccuccugggcccacaacagcgugua

SEQ ID NO: 179717 - RNA, 32 nt, Human
gcucuuccuaucccucuccuaacugccagccc

SEQ ID NO: 179718 - RNA, 32 nt, Human
gcucuuccucaccuuccugucuaguuugaauu

SEQ ID NO: 179719 - RNA, 32 nt, Human
gcucuuccuccaaggcuggagugcagugacgc

SEQ ID NO: 179720 - RNA, 32 nt, Human
gcucuuccuccccucacuaagaagacccaaac

SEQ ID NO: 179721 - RNA, 32 nt, Human
gcucuuccugaaaacuugucucucccucuccu

SEQ ID NO: 179722 - RNA, 32 nt, Human
gcucuuccugcacugcccucacccucagccgu

SEQ ID NO: 179723 - RNA, 32 nt, Human
gcucuuccugccccguucagcuucacucccac

SEQ ID NO: 179724 - RNA, 23 nt, Human
gcucuuccuggacacaccugccc

SEQ ID NO: 179725 - RNA, 32 nt, Human
gcucuuccuggaccaagggaggagccgcucau

SEQ ID NO: 179726 - RNA, 32 nt, Human
gcucuuccuggacuccugagcagaguugucga

SEQ ID NO: 179727 - RNA, 32 nt, Human
gcucuuccuucaccucuagucacuuucuauug

SEQ ID NO: 179728 - RNA, 32 nt, Human
gcucuucggcagcugcaccuucugccucaaca

SEQ ID NO: 179729 - RNA, 32 nt, Human
gcucuucggggcccggguggucuggaacaaug

SEQ ID NO: 179730 - RNA, 22 nt, Human
gcucuucguggcgcucucgggg

SEQ ID NO: 179731 - RNA, 32 nt, Human
gcucuucguguuucccaccugcccucggcacg

SEQ ID NO: 179732 - RNA, 32 nt, Human
gcucuucuaacacccauaucagugucuguuuc

SEQ ID NO: 179733 - RNA, 32 nt, Human
gcucuucucccgcaccuccauggaugcacugc

SEQ ID NO: 179734 - RNA, 32 nt, Human
gcucuucucggccaccugccauggcccggggg

SEQ ID NO: 179735 - RNA, 22 nt, Human
gcucuucucucccauccuacuc

SEQ ID NO: 179736 - RNA, 32 nt, Human
gcucuucucuccccuuugccucccucugcagg

SEQ ID NO: 179737 - RNA, 32 nt, Human
gcucuucucuccuucucucuucucuucuucuu

SEQ ID NO: 179738 - RNA, 32 nt, Human
gcucuucucucugguggcuccaccccaacccc

SEQ ID NO: 179739 - RNA, 32 nt, Human
gcucuucucugagaaaugaagccacaccacga

SEQ ID NO: 179740 - RNA, 32 nt, Human
gcucuucugccuggcauugcccacuucggccc

SEQ ID NO: 179741 - RNA, 32 nt, Human
gcucuucugucuguccugcuucuucaggugag

SEQ ID NO: 179742 - RNA, 32 nt, Human
gcucuucuucaaagcugaccuugcuuuagaaa

SEQ ID NO: 179743 - RNA, 32 nt, Human
gcucuucuucauuaugcucuucugccuggggc

SEQ ID NO: 179744 - RNA, 32 nt, Human
gcucuucuucauucucacccugaucccugggg

SEQ ID NO: 179745 - RNA, 32 nt, Human
gcucuucuucccaugcuggagugcaauggcgc

SEQ ID NO: 179746 - RNA, 32 nt, Human
gcucuucuuccccaccuucccucucucgucgc

SEQ ID NO: 179747 - RNA, 32 nt, Human
gcucuucuuccugcuuggcuuccaccuuuaac

SEQ ID NO: 179748 - RNA, 23 nt, Human
gcucuucuuccuucuuccugcca

SEQ ID NO: 179749 - RNA, 32 nt, Human
gcucuucuucuuuucuugaucuuccugucugg

SEQ ID NO: 179750 - RNA, 32 nt, Human
gcucuugaccuguccccucuggcugccucuga

SEQ ID NO: 179751 - RNA, 20 nt, Human
gcucuugagagugcaugcca

SEQ ID NO: 179752 - RNA, 32 nt, Human
gcucuugagauauuuaaaguuuuggcaguaaa

SEQ ID NO: 179753 - RNA, 32 nt, Human
gcucuugagauggguccuucagcuugcagugg

SEQ ID NO: 179754 - RNA, 32 nt, Human
gcucuugagcggaggagggacaugcucuccug

SEQ ID NO: 179755 - RNA, 32 nt, Human
gcucuugagcuggucuuuuaacauacugacga

SEQ ID NO: 179756 - RNA, 24 nt, Human
gcucuugaggaugucaccaauuaa

SEQ ID NO: 179757 - RNA, 32 nt, Human
gcucuugaggccagcugcagagcuuguggagg

SEQ ID NO: 179758 - RNA, 32 nt, Human
gcucuugagguuggggagaagcauuaggauua

SEQ ID NO: 179759 - RNA, 19 nt, Human
gcucuugaugaaauuugag

SEQ ID NO: 179760 - RNA, 21 nt, Human
gcucuugauguuccugauaca

SEQ ID NO: 179761 - RNA, 32 nt, Human
gcucuugauuccuugugucuccagucaugaca

SEQ ID NO: 179762 - RNA, 32 nt, Human
gcucuugcagacagaaaaauucgcugcaagua

SEQ ID NO: 179763 - RNA, 32 nt, Human
gcucuugcccugccgccgccucccgggucuca

SEQ ID NO: 179764 - RNA, 32 nt, Human
gcucuugccguccaggcuggagugcaauggcg

SEQ ID NO: 179765 - RNA, 32 nt, Human
gcucuugccucccaggggcuuuuccaagccca

SEQ ID NO: 179766 - RNA, 32 nt, Human
gcucuugccucgacccuuccuccuccuuugcc

SEQ ID NO: 179767 - RNA, 18 nt, Human
gcucuugccugcccuccu

SEQ ID NO: 179768 - RNA, 32 nt, Human
gcucuugccuguaaucccagcacuuugauagg

SEQ ID NO: 179769 - RNA, 32 nt, Human
gcucuugccuguaaucccagcacuuugggagg

SEQ ID NO: 179770 - RNA, 32 nt, Human
gcucuugccuguaaucccagcacuuuggggag

SEQ ID NO: 179771 - RNA, 32 nt, Human
gcucuugccuguaaucccagcauucugggagg

SEQ ID NO: 179772 - RNA, 32 nt, Human
gcucuugccuguaaucuuagcacuuugggagg

SEQ ID NO: 179773 - RNA, 32 nt, Human
gcucuugccuguaauuccagcuacuugggagg

SEQ ID NO: 179774 - RNA, 32 nt, Human
gcucuugccuguagucccggcacuuugggagg

SEQ ID NO: 179775 - RNA, 32 nt, Human
gcucuugcugucugcccugccucacccugccc

SEQ ID NO: 179776 - RNA, 32 nt, Human
gcucuuggaaccugggaggcagcaucuggggg

SEQ ID NO: 179777 - RNA, 32 nt, Human
gcucuuggagaaagcgugagcagggggccacc

SEQ ID NO: 179778 - RNA, 32 nt, Human
gcucuuggcaggcagacuuuccaggaagaggc

SEQ ID NO: 179779 - RNA, 32 nt, Human
gcucuuggccgggaggaggcugugcugcacca

SEQ ID NO: 179780 - RNA, 31 nt, Human
gcucuuggcguucucccuccaggggacacag

SEQ ID NO: 179781 - RNA, 32 nt, Human
gcucuuggcuaagaccaggaggcugcaagucu

SEQ ID NO: 179782 - RNA, 32 nt, Human
gcucuuggcuucagccagcccccagccagagu

SEQ ID NO: 179783 - RNA, 32 nt, Human
gcucuugggcaaacguccuuccucacggggcg

SEQ ID NO: 179784 - RNA, 32 nt, Human
gcucuugggcaacuacagcagagaagccuccc

SEQ ID NO: 179785 - RNA, 32 nt, Human
gcucuugggcccuggcauccugggugaccggu

SEQ ID NO: 179786 - RNA, 22 nt, Human
gcucuuggggccaaccccagga

SEQ ID NO: 179787 - RNA, 21 nt, Human
gcucuuggguggcgaagccag

SEQ ID NO: 179788 - RNA, 32 nt, Human
gcucuuggucaaagcacuguugcuauaagcua

SEQ ID NO: 179789 - RNA, 32 nt, Human
gcucuuggugcccaggcuagagugcaauggcg

SEQ ID NO: 179790 - RNA, 32 nt, Human
gcucuuguagcccaggcuggagugcaauggca

SEQ ID NO: 179791 - RNA, 32 nt, Human
gcucuuguagcccaggcugggaugcaauggca

SEQ ID NO: 179792 - RNA, 32 nt, Human
gcucuugucaacuggcugcaaaauacacuagu

SEQ ID NO: 179793 - RNA, 32 nt, Human
gcucuugucacccacgcuggagugcaauggug

SEQ ID NO: 179794 - RNA, 32 nt, Human
gcucuugucacccaggcaggagugcaguggcg

SEQ ID NO: 179795 - RNA, 32 nt, Human
gcucuugucacccaggcuggaguacaaugaug

SEQ ID NO: 179796 - RNA, 32 nt, Human
gcucuugucacccaggcuggagugcaauggcg

SEQ ID NO: 179797 - RNA, 32 nt, Human
gcucuugucacccaggcuggagugcaguggca

SEQ ID NO: 179798 - RNA, 32 nt, Human
gcucuugucacccaggcuggagugcaguggcg

SEQ ID NO: 179799 - RNA, 32 nt, Human
gcucuugucacccaggcuggagugcaguggug

SEQ ID NO: 179800 - RNA, 32 nt, Human
gcucuugucaccccagcuggagugcaguagca

SEQ ID NO: 179801 - RNA, 32 nt, Human
gcucuugucacguuccuuccuuccucacucuc

SEQ ID NO: 179802 - RNA, 32 nt, Human
gcucuugucauccuggcuggagugugauggug

SEQ ID NO: 179803 - RNA, 32 nt, Human
gcucuugucccccagacuggagugcaauggca

SEQ ID NO: 179804 - RNA, 32 nt, Human
gcucuugucgcccaggcuggagugcaacggua

SEQ ID NO: 179805 - RNA, 32 nt, Human
gcucuugucgcccaggcuggagugcaauggcg

SEQ ID NO: 179806 - RNA, 32 nt, Human
gcucuugucgcccaggcuggagugcaguggca

SEQ ID NO: 179807 - RNA, 32 nt, Human
gcucuugucgcccaggcuggagugcaguggcg

SEQ ID NO: 179808 - RNA, 32 nt, Human
gcucuugucgcccaggcuguagugcaguggua

SEQ ID NO: 179809 - RNA, 32 nt, Human
gcucuugucgcucagccuggagugcagugagc

SEQ ID NO: 179810 - RNA, 32 nt, Human
gcucuugucucccaggcuggagugcagugaca

SEQ ID NO: 179811 - RNA, 32 nt, Human
gcucuugucucccaguuccugguagggucugc

SEQ ID NO: 179812 - RNA, 32 nt, Human
gcucuugucuccccggcuggagugcaguggca

SEQ ID NO: 179813 - RNA, 32 nt, Human
gcucuugucuguaaucccagcgcucugggagg

SEQ ID NO: 179814 - RNA, 32 nt, Human
gcucuugugauuuuucucaggcuguuuuguca

SEQ ID NO: 179815 - RNA, 32 nt, Human
gcucuugugguuuuauguucuugaccuuucaa

SEQ ID NO: 179816 - RNA, 32 nt, Human
gcucuuguuacccaggcaggagugcaguggcg

SEQ ID NO: 179817 - RNA, 32 nt, Human
gcucuuguuacccaggcuggagugcaguggcg

SEQ ID NO: 179818 - RNA, 32 nt, Human
gcucuuguuccccaggcuggagugcaauggca

SEQ ID NO: 179819 - RNA, 20 nt, Human
gcucuuguucuccagaaacu

SEQ ID NO: 179820 - RNA, 32 nt, Human
gcucuuguugaugaggcuggagugcaguggcg

SEQ ID NO: 179821 - RNA, 32 nt, Human
gcucuuguugcccaagcuggagugcaauggca

SEQ ID NO: 179822 - RNA, 32 nt, Human
gcucuuguugcccaagcuggagugcaguggcg

SEQ ID NO: 179823 - RNA, 32 nt, Human
gcucuuguugcccagacuggagugcaauggca

SEQ ID NO: 179824 - RNA, 32 nt, Human
gcucuuguugcccagccuggagugcaauagcg

SEQ ID NO: 179825 - RNA, 32 nt, Human
gcucuuguugcccaggcggaguacaauggugg

SEQ ID NO: 179826 - RNA, 32 nt, Human
gcucuuguugcccaggcuagagugcaauggca

SEQ ID NO: 179827 - RNA, 32 nt, Human
gcucuuguugcccaggcuagagugcaauggcg

SEQ ID NO: 179828 - RNA, 32 nt, Human
gcucuuguugcccaggcuagcaugcaauggug

SEQ ID NO: 179829 - RNA, 32 nt, Human
gcucuuguugcccaggcuggagggcaauggug

SEQ ID NO: 179830 - RNA, 32 nt, Human
gcucuuguugcccaggcuggaguacaauggcg

SEQ ID NO: 179831 - RNA, 32 nt, Human
gcucuuguugcccaggcuggaguacaauggug

SEQ ID NO: 179832 - RNA, 32 nt, Human
gcucuuguugcccaggcuggaguacaguggua

SEQ ID NO: 179833 - RNA, 32 nt, Human
gcucuuguugcccaggcuggagugcaacggca

SEQ ID NO: 179834 - RNA, 32 nt, Human
gcucuuguugcccaggcuggagugcaauagcg

SEQ ID NO: 179835 - RNA, 32 nt, Human
gcucuuguugcccaggcuggagugcaaugaca

SEQ ID NO: 179836 - RNA, 32 nt, Human
gcucuuguugcccaggcuggagugcaauggag

SEQ ID NO: 179837 - RNA, 32 nt, Human
gcucuuguugcccaggcuggagugcaauggca

SEQ ID NO: 179838 - RNA, 32 nt, Human
gcucuuguugcccaggcuggagugcaauggcg

SEQ ID NO: 179839 - RNA, 32 nt, Human
gcucuuguugcccaggcuggagugcaauggua

SEQ ID NO: 179840 - RNA, 32 nt, Human
gcucuuguugcccaggcuggagugcaauggug

SEQ ID NO: 179841 - RNA, 32 nt, Human
gcucuuguugcccaggcuggagugcagugaca

SEQ ID NO: 179842 - RNA, 32 nt, Human
gcucuuguugcccaggcuggagugcaguggug

SEQ ID NO: 179843 - RNA, 32 nt, Human
gcucuuguugcccaggcuggagugugaugggc

SEQ ID NO: 179844 - RNA, 32 nt, Human
gcucuuguugcccaggcugggagggcaauggc

SEQ ID NO: 179845 - RNA, 32 nt, Human
gcucuuguugcccaggcuggugugcaauggcg

SEQ ID NO: 179846 - RNA, 32 nt, Human
gcucuuguugcccaggcuugagugcagugaug

SEQ ID NO: 179847 - RNA, 32 nt, Human
gcucuuguugcccgggcuggagugcaauggug

SEQ ID NO: 179848 - RNA, 32 nt, Human
gcucuuguugccuaggcuggagugcaguggcg

SEQ ID NO: 179849 - RNA, 32 nt, Human
gcucuuguugcugaggcuggagugcaguggca

SEQ ID NO: 179850 - RNA, 32 nt, Human
gcucuuguuguccaggcuagagugcaauggca

SEQ ID NO: 179851 - RNA, 32 nt, Human
gcucuuguuguccaggcuggagugcaauggca

SEQ ID NO: 179852 - RNA, 32 nt, Human
gcucuuguuguccaggcuggagugcaauggcg

SEQ ID NO: 179853 - RNA, 32 nt, Human
gcucuuguuguccaggcuggagugcaguggcg

SEQ ID NO: 179854 - RNA, 32 nt, Human
gcucuuguuucccaggcuggagugcaaugggu

SEQ ID NO: 179855 - RNA, 32 nt, Human
gcucuuuagcuggugaagugggagccacagcu

SEQ ID NO: 179856 - RNA, 32 nt, Human
gcucuuucacccaggccggacugcagcggcgc

SEQ ID NO: 179857 - RNA, 32 nt, Human
gcucuuucacccaggcuggagugcaguggcac

SEQ ID NO: 179858 - RNA, 32 nt, Human
gcucuuucauuucuuucugcccuucuccuuug

SEQ ID NO: 179859 - RNA, 32 nt, Human
gcucuuuccuaccugugugagucagagcccuc

SEQ ID NO: 179860 - RNA, 32 nt, Human
gcucuuuccuuuggcagcguguuuccuuuucc

SEQ ID NO: 179861 - RNA, 32 nt, Human
gcucuuucgccaaggcuggagugcaguggcac

SEQ ID NO: 179862 - RNA, 32 nt, Human
gcucuuucgcccaggauggagugcaguggugc

SEQ ID NO: 179863 - RNA, 32 nt, Human
gcucuuucgcccaggccggacugcaguggcag

SEQ ID NO: 179864 - RNA, 32 nt, Human
gcucuuucgcccaggccggacugcaguggcgc

SEQ ID NO: 179865 - RNA, 32 nt, Human
gcucuuucgcccaggcuggagugcaauggugu

SEQ ID NO: 179866 - RNA, 32 nt, Human
gcucuuucgcccaggcuggagugcaguggcgc

SEQ ID NO: 179867 - RNA, 32 nt, Human
gcucuuucgcccaggcuggcgugcaguggcac

SEQ ID NO: 179868 - RNA, 24 nt, Human
gcucuuucgcccaggcuggucuca

SEQ ID NO: 179869 - RNA, 23 nt, Human
gcucuuucuccauugccuggaga

SEQ ID NO: 179870 - RNA, 32 nt, Human
gcucuuucuccucacuguauccagguucccuc

SEQ ID NO: 179871 - RNA, 24 nt, Human
gcucuuucucuggcccugcaguca

SEQ ID NO: 179872 - RNA, 32 nt, Human
gcucuuucugccucugggcucauguaucugcg

SEQ ID NO: 179873 - RNA, 32 nt, Human
gcucuuucugcugccaccugcugggucucuug

SEQ ID NO: 179874 - RNA, 32 nt, Human
gcucuuucuggcucugccucuccuuugcuuuc

SEQ ID NO: 179875 - RNA, 32 nt, Human
gcucuuucugugcccugggagcugagaugcac

SEQ ID NO: 179876 - RNA, 32 nt, Human
gcucuuugagcaggacgugagcgcagagcaga

SEQ ID NO: 179877 - RNA, 32 nt, Human
gcucuuugcaaccucugccuccugggcucaag

SEQ ID NO: 179878 - RNA, 32 nt, Human
gcucuuugcccagcuccuggggugggaguggu

SEQ ID NO: 179879 - RNA, 32 nt, Human
gcucuuugcucauucuagggccaguggaggaa

SEQ ID NO: 179880 - RNA, 32 nt, Human
gcucuuuggagcuagaguuuugggagaacagu

SEQ ID NO: 179881 - RNA, 32 nt, Human
gcucuuugggaggcugaagugggugaaucacu

SEQ ID NO: 179882 - RNA, 32 nt, Human
gcucuuugguaaaaaugccugcuuuccaauac

SEQ ID NO: 179883 - RNA, 32 nt, Human
gcucuuuguauuuccuccccuuggugguguga

SEQ ID NO: 179884 - RNA, 32 nt, Human
gcucuuugucauuccaccuccucuggucaggc

SEQ ID NO: 179885 - RNA, 23 nt, Human
gcucuuuguuuaggccuaaucuu

SEQ ID NO: 179886 - RNA, 21 nt, Human
gcucuuuguuuuggggugcag

SEQ ID NO: 179887 - RNA, 32 nt, Human
gcucuuuuagagcccagaaauggcagucaccu

SEQ ID NO: 179888 - RNA, 32 nt, Human
gcucuuuuccuugaugcaguuucccagugugg

SEQ ID NO: 179889 - RNA, 23 nt, Human
gcucuuuugagaauucauaauuu

SEQ ID NO: 179890 - RNA, 22 nt, Human
gcucuuuugagaggaggccuaa

SEQ ID NO: 179891 - RNA, 32 nt, Human
gcucuuuugcccagacuggagugaaguagcau

SEQ ID NO: 179892 - RNA, 32 nt, Human
gcucuuuugcccaggcuggauggagugcagug

SEQ ID NO: 179893 - RNA, 32 nt, Human
gcucuuuuugcacaggcugagugcaaugccgu

SEQ ID NO: 179894 - RNA, 32 nt, Human
gcucuuuuugcccaggccggagugcaauggca

SEQ ID NO: 179895 - RNA, 32 nt, Human
gcugaaaaacacagcacgagaccuucgugaag

SEQ ID NO: 179896 - RNA, 32 nt, Human
gcugaaaaccuuugaaccucacgguguccuga

SEQ ID NO: 179897 - RNA, 32 nt, Human
gcugaaaagcuuugccuucgagaggccagaag

SEQ ID NO: 179898 - RNA, 32 nt, Human
gcugaaaauccuuuugccagcuaauugugaga

SEQ ID NO: 179899 - RNA, 32 nt, Human
gcugaaaaugcacugcauucauuuuucuaaag

SEQ ID NO: 179900 - RNA, 32 nt, Human
gcugaaaauguuacacaggaagacauaccaug

SEQ ID NO: 179901 - RNA, 32 nt, Human
gcugaaacaaauucggggcuaugaaguguuuu

SEQ ID NO: 179902 - RNA, 32 nt, Human
gcugaaacacacaagagaagagguugugucuc

SEQ ID NO: 179903 - RNA, 32 nt, Human
gcugaaacagcagcaucaccaucagcagcaac

SEQ ID NO: 179904 - RNA, 23 nt, Human
gcugaaacaggagaauugcuuga

SEQ ID NO: 179905 - RNA, 32 nt, Human
gcugaaacaucuucccuccucaaccuggaaaa

SEQ ID NO: 179906 - RNA, 32 nt, Human
gcugaaacccacccacccgcugugcugaccau

SEQ ID NO: 179907 - RNA, 32 nt, Human
gcugaaacccgggagucagaggcugcagagag

SEQ ID NO: 179908 - RNA, 25 nt, Human
gcugaaaccgugaggcccggaccac

SEQ ID NO: 179909 - RNA, 16 nt, Human
gcugaaaccuaaggca

SEQ ID NO: 179910 - RNA, 32 nt, Human
gcugaaacgcaucucacugucauucuauuguu

SEQ ID NO: 179911 - RNA, 20 nt, Human
gcugaaacuagguccuuucc

SEQ ID NO: 179912 - RNA, 32 nt, Human
gcugaaacugcuuccuagaacugugaagagag

SEQ ID NO: 179913 - RNA, 21 nt, Human
gcugaaagagggaccagggua

SEQ ID NO: 179914 - RNA, 32 nt, Human
gcugaaagagugagagaagauggaagggaagg

SEQ ID NO: 179915 - RNA, 32 nt, Human
gcugaaagcugaaauuugaggcgcccaggccc

SEQ ID NO: 179916 - RNA, 32 nt, Human
gcugaaagugccugucaguaaaccuuaugacc

SEQ ID NO: 179917 - RNA, 21 nt, Human
gcugaaaucauacagcuguga

SEQ ID NO: 179918 - RNA, 21 nt, Human
gcugaaaucaucaucuuucca

SEQ ID NO: 179919 - RNA, 32 nt, Human
gcugaaauguuauggcaucuuggauuugcuuu

SEQ ID NO: 179920 - RNA, 32 nt, Human
gcugaaauuaugucaguggugaaaugucacuc

SEQ ID NO: 179921 - RNA, 25 nt, Human
gcugaaauuggaaauaaaucuggaa

SEQ ID NO: 179922 - RNA, 32 nt, Human
gcugaacaacugagcucaugucaugggcaugu

SEQ ID NO: 179923 - RNA, 32 nt, Human
gcugaacacaccccaggcucuucugaccggca

SEQ ID NO: 179924 - RNA, 32 nt, Human
gcugaacacaccccaggcucuucugacuggca

SEQ ID NO: 179925 - RNA, 20 nt, Human
gcugaacagaggugggcccc

SEQ ID NO: 179926 - RNA, 32 nt, Human
gcugaacagcuuuucuucccugaucucucgga

SEQ ID NO: 179927 - RNA, 22 nt, Human
gcugaacaggagaaucgcuuga

SEQ ID NO: 179928 - RNA, 32 nt, Human
gcugaacagucaccccuccucuccuuggcaaa

SEQ ID NO: 179929 - RNA, 32 nt, Human
gcugaacagugaccuccaccaccuuggggugg

SEQ ID NO: 179930 - RNA, 19 nt, Human
gcugaacauuucuauuauc

SEQ ID NO: 179931 - RNA, 32 nt, Human
gcugaacauuugcuucaggaugccauuaagaa

SEQ ID NO: 179932 - RNA, 32 nt, Human
gcugaaccaccugagcaccauccugacgaggc

SEQ ID NO: 179933 - RNA, 23 nt, Human
gcugaaccaggagaauugcuuga

SEQ ID NO: 179934 - RNA, 19 nt, Human
gcugaacccaggcucaggu

SEQ ID NO: 179935 - RNA, 32 nt, Human
gcugaacccuggaagcaggaaggauugccaga

SEQ ID NO: 179936 - RNA, 32 nt, Human
gcugaaccgucagcuggcuguggugugggcuc

SEQ ID NO: 179937 - RNA, 22 nt, Human
gcugaaccucccgcugcugcug

SEQ ID NO: 179938 - RNA, 32 nt, Human
gcugaaccugccacugcuggagccauuucaac

SEQ ID NO: 179939 - RNA, 32 nt, Human
gcugaaccugccucuucaccuccaggcacuac

SEQ ID NO: 179940 - RNA, 32 nt, Human
gcugaaccuuccuauguccugccuuuaauuau

SEQ ID NO: 179941 - RNA, 18 nt, Human
gcugaacgacccagggca

SEQ ID NO: 179942 - RNA, 32 nt, Human
gcugaacgcauugguaacugugcucaagaaga

SEQ ID NO: 179943 - RNA, 32 nt, Human
gcugaacucagucuauggguuggggcucagau

SEQ ID NO: 179944 - RNA, 24 nt, Human
gcugaacuccaacuccugggcuca

SEQ ID NO: 179945 - RNA, 32 nt, Human
gcugaacucuuccuacccaggcucugaacaca

SEQ ID NO: 179946 - RNA, 22 nt, Human
gcugaacuggcugugaaaucua

SEQ ID NO: 179947 - RNA, 32 nt, Human
gcugaacuucaaggcccugcaccuccugcugc

SEQ ID NO: 179948 - RNA, 32 nt, Human
gcugaagaaaagagcaagggaagaggugagga

SEQ ID NO: 179949 - RNA, 32 nt, Human
gcugaagaaaccagaaucuucucgaaauguau

SEQ ID NO: 179950 - RNA, 32 nt, Human
gcugaagaauaugagagacaccaccuuuuaaa

SEQ ID NO: 179951 - RNA, 32 nt, Human
gcugaagacaaggggccggcauucagugggca

SEQ ID NO: 179952 - RNA, 32 nt, Human
gcugaagacagagaugauauguuagcuuggau

SEQ ID NO: 179953 - RNA, 19 nt, Human
gcugaagaccaaggguccc

SEQ ID NO: 179954 - RNA, 32 nt, Human
gcugaagaccaagggucccccuuguuaccugc

SEQ ID NO: 179955 - RNA, 32 nt, Human
gcugaagaccacaaccuuuugggucaacuguu

SEQ ID NO: 179956 - RNA, 32 nt, Human
gcugaagacggcacuaggacccagggaagucc

SEQ ID NO: 179957 - RNA, 32 nt, Human
gcugaagacguugauggagaagcucuaaguac

SEQ ID NO: 179958 - RNA, 18 nt, Human
gcugaagacuggaggaag

SEQ ID NO: 179959 - RNA, 32 nt, Human
gcugaagagaaaagaccagucugaaaucuaca

SEQ ID NO: 179960 - RNA, 32 nt, Human
gcugaagagacagaaaccagccccagaggugu

SEQ ID NO: 179961 - RNA, 21 nt, Human
gcugaagagacaggcauuguu

SEQ ID NO: 179962 - RNA, 21 nt, Human
gcugaagagaguccccauuuc

SEQ ID NO: 179963 - RNA, 32 nt, Human
gcugaagagauuuucuucugaagaugaucuag

SEQ ID NO: 179964 - RNA, 32 nt, Human
gcugaagaggaugcuguagucaugcccaggcu

SEQ ID NO: 179965 - RNA, 32 nt, Human
gcugaagaggcaagagacagaaugauauccag

SEQ ID NO: 179966 - RNA, 32 nt, Human
gcugaagaguguggagguauagaggagcuggu

SEQ ID NO: 179967 - RNA, 32 nt, Human
gcugaagauacuugaggcuucaagagguuaua

SEQ ID NO: 179968 - RNA, 32 nt, Human
gcugaagaucugauuaugucucugugcauauu

SEQ ID NO: 179969 - RNA, 32 nt, Human
gcugaagaugcugggagaauggcagaaauaua

SEQ ID NO: 179970 - RNA, 23 nt, Human
gcugaagcaagagaaucgcuuga

SEQ ID NO: 179971 - RNA, 24 nt, Human
gcugaagcaagcagaucacuugag

SEQ ID NO: 179972 - RNA, 24 nt, Human
gcugaagcagaaagauugcuugag

SEQ ID NO: 179973 - RNA, 23 nt, Human
gcugaagcagaagaacugcuuga

SEQ ID NO: 179974 - RNA, 23 nt, Human
gcugaagcagaagaaucacuuga

SEQ ID NO: 179975 - RNA, 23 nt, Human
gcugaagcagaagaaucgcuuga

SEQ ID NO: 179976 - RNA, 20 nt, Human
gcugaagcagaauagcuuga

SEQ ID NO: 179977 - RNA, 32 nt, Human
gcugaagcagaauuauuugaggccaggaguuc

SEQ ID NO: 179978 - RNA, 32 nt, Human
gcugaagcagaucgcugcagguuggagagugg

SEQ ID NO: 179979 - RNA, 24 nt, Human
gcugaagcagcaagaucacuugag

SEQ ID NO: 179980 - RNA, 23 nt, Human
gcugaagcaggagaacugccuga

SEQ ID NO: 179981 - RNA, 21 nt, Human
gcugaagcaggagaaucacuu

SEQ ID NO: 179982 - RNA, 23 nt, Human
gcugaagcaggagaaucacuuga

SEQ ID NO: 179983 - RNA, 23 nt, Human
gcugaagcaggagaaucccuuga

SEQ ID NO: 179984 - RNA, 23 nt, Human
gcugaagcaggagaaucgcugga

SEQ ID NO: 179985 - RNA, 21 nt, Human
gcugaagcaggagaaucgcuu

SEQ ID NO: 179986 - RNA, 23 nt, Human
gcugaagcaggagaaucgcuuga

SEQ ID NO: 179987 - RNA, 24 nt, Human
gcugaagcaggagaaucgcuugag

SEQ ID NO: 179988 - RNA, 23 nt, Human
gcugaagcaggagaauggcauga

SEQ ID NO: 179989 - RNA, 23 nt, Human
gcugaagcaggagaauugccuga

SEQ ID NO: 179990 - RNA, 20 nt, Human
gcugaagcaggagaauugcu

SEQ ID NO: 179991 - RNA, 23 nt, Human
gcugaagcaggagaauugcucga

SEQ ID NO: 179992 - RNA, 23 nt, Human
gcugaagcaggagaauugcuuga

SEQ ID NO: 179993 - RNA, 23 nt, Human
gcugaagcaggagauuugcuuga

SEQ ID NO: 179994 - RNA, 24 nt, Human
gcugaagcaggaggaccacucgag

SEQ ID NO: 179995 - RNA, 24 nt, Human
gcugaagcaggaggacugcuugag

SEQ ID NO: 179996 - RNA, 24 nt, Human
gcugaagcaggaggauagcuagag

SEQ ID NO: 179997 - RNA, 24 nt, Human
gcugaagcaggaggauagcuugag

SEQ ID NO: 179998 - RNA, 24 nt, Human
gcugaagcaggaggaucacuugag

SEQ ID NO: 179999 - RNA, 22 nt, Human
gcugaagcaggaggauugagga

SEQ ID NO: 180000 - RNA, 24 nt, Human
gcugaagcaggaggauugauugag

SEQ ID NO: 180001 - RNA, 24 nt, Human
gcugaagcaggaggauugcuugag

SEQ ID NO: 180002 - RNA, 23 nt, Human
gcugaagcaggauaaucgcuuga

SEQ ID NO: 180003 - RNA, 24 nt, Human
gcugaagcaggcagaucaccugag

SEQ ID NO: 180004 - RNA, 24 nt, Human
gcugaagcaggcagauugcuugag

SEQ ID NO: 180005 - RNA, 23 nt, Human
gcugaagcagguggaugcucaag

SEQ ID NO: 180006 - RNA, 32 nt, Human
gcugaagcauccccuuggagugccauguauaa

SEQ ID NO: 180007 - RNA, 23 nt, Human
gcugaagcaugagaaucacuuga

SEQ ID NO: 180008 - RNA, 32 nt, Human
gcugaagccaauaaucccagcacuuugagagg

SEQ ID NO: 180009 - RNA, 32 nt, Human
gcugaagccagcccacuacccacccccacuac

SEQ ID NO: 180010 - RNA, 32 nt, Human
gcugaagcccaugcuuucccaccagcauguca

SEQ ID NO: 180011 - RNA, 32 nt, Human
gcugaagccccacagcugugggcugcugaagu

SEQ ID NO: 180012 - RNA, 24 nt, Human
gcugaagcgggaggaucgcuugag

SEQ ID NO: 180013 - RNA, 24 nt, Human
gcugaagcgggaggaucgcuuggg

SEQ ID NO: 180014 - RNA, 32 nt, Human
gcugaagcgggguaauuccucuccugcaauua

SEQ ID NO: 180015 - RNA, 24 nt, Human
gcugaagcggguagaucacuugag

SEQ ID NO: 180016 - RNA, 24 nt, Human
gcugaagcggguggaucaccugag

SEQ ID NO: 180017 - RNA, 32 nt, Human
gcugaagcuccugcagcuucuguggccaagcc

SEQ ID NO: 180018 - RNA, 24 nt, Human
gcugaagcuggcggaucgcuugag

SEQ ID NO: 180019 - RNA, 32 nt, Human
gcugaagcuguaggaagcgccauucuucccug

SEQ ID NO: 180020 - RNA, 23 nt, Human
gcugaaggacccgcagggccccg

SEQ ID NO: 180021 - RNA, 32 nt, Human
gcugaaggaccuuuacaaucaggaugacaauc

SEQ ID NO: 180022 - RNA, 32 nt, Human
gcugaaggagaaacaucgagaggcagaaaagu

SEQ ID NO: 180023 - RNA, 17 nt, Human
gcugaaggagcccaagg

SEQ ID NO: 180024 - RNA, 32 nt, Human
gcugaaggaggcagaggacguggagcgggagg

SEQ ID NO: 180025 - RNA, 32 nt, Human
gcugaaggaucacuugagcucaggaguuggag

SEQ ID NO: 180026 - RNA, 32 nt, Human
gcugaaggcagaaagagaugcagagaaagugg

SEQ ID NO: 180027 - RNA, 32 nt, Human
gcugaaggcauuccagcugacacagaggaaua

SEQ ID NO: 180028 - RNA, 21 nt, Human
gcugaaggccauggccccuca

SEQ ID NO: 180029 - RNA, 32 nt, Human
gcugaaggcgcugccugaggccugugggccag

SEQ ID NO: 180030 - RNA, 32 nt, Human
gcugaaggcggacguuguuuccuaaccauagg

SEQ ID NO: 180031 - RNA, 32 nt, Human
gcugaaggcugaggcaggagaaucacucgaac

SEQ ID NO: 180032 - RNA, 32 nt, Human
gcugaaggcugaggcaggaguggagaggcaug

SEQ ID NO: 180033 - RNA, 32 nt, Human
gcugaaggcugcagcaggugcuagguagcagc

SEQ ID NO: 180034 - RNA, 32 nt, Human
gcugaagggaagagagguugcagcugagcaag

SEQ ID NO: 180035 - RNA, 17 nt, Human
gcugaagggaccaaggu

SEQ ID NO: 180036 - RNA, 31 nt, Human
gcugaagggacugagccucagauggcuggau

SEQ ID NO: 180037 - RNA, 32 nt, Human
gcugaaggggcagccagucaccagagcgccca

SEQ ID NO: 180038 - RNA, 32 nt, Human
gcugaaggggcugaaccauacacuccuuuuuc

SEQ ID NO: 180039 - RNA, 21 nt, Human
gcugaaguaggagggucacuu

SEQ ID NO: 180040 - RNA, 32 nt, Human
gcugaagucauugucgcucagcaauagggugc

SEQ ID NO: 180041 - RNA, 31 nt, Human
gcugaagucugcaaggagguugcuggcuugg

SEQ ID NO: 180042 - RNA, 32 nt, Human
gcugaagucuguaauccuagcacuuugggagg

SEQ ID NO: 180043 - RNA, 32 nt, Human
gcugaagucuguuaauucuacuuuuugaguac

SEQ ID NO: 180044 - RNA, 32 nt, Human
gcugaagugaacugcugccccucuggagucug

SEQ ID NO: 180045 - RNA, 32 nt, Human
gcugaagugagcuguguuugcaucacugcacu

SEQ ID NO: 180046 - RNA, 32 nt, Human
gcugaagugaguagcugagcagcuggagccau

SEQ ID NO: 180047 - RNA, 32 nt, Human
gcugaagugcaguagugcaaucucagcucacu

SEQ ID NO: 180048 - RNA, 24 nt, Human
gcugaagugggaagaucacuugag

SEQ ID NO: 180049 - RNA, 24 nt, Human
gcugaagugggaggacugcuugag

SEQ ID NO: 180050 - RNA, 24 nt, Human
gcugaagugggaggaucaccugag

SEQ ID NO: 180051 - RNA, 24 nt, Human
gcugaagugggaggaucccuugag

SEQ ID NO: 180052 - RNA, 24 nt, Human
gcugaagugggaggaucgcuugag

SEQ ID NO: 180053 - RNA, 24 nt, Human
gcugaagugggaggauggccugag

SEQ ID NO: 180054 - RNA, 24 nt, Human
gcugaagugggaggauugcuugag

SEQ ID NO: 180055 - RNA, 24 nt, Human
gcugaagugggaggguggcuugag

SEQ ID NO: 180056 - RNA, 32 nt, Human
gcugaagugggccagccuugcaccagccaggc

SEQ ID NO: 180057 - RNA, 25 nt, Human
gcugaaguggggaggaucguuugag

SEQ ID NO: 180058 - RNA, 32 nt, Human
gcugaagugugaagacagggcagacacuaaug

SEQ ID NO: 180059 - RNA, 24 nt, Human
gcugaaguuggaggauggcuugag

SEQ ID NO: 180060 - RNA, 30 nt, Human
gcugaauaaaaccauauucaccugccaagg

SEQ ID NO: 180061 - RNA, 32 nt, Human
gcugaauaaaguggguuugugucagcucguuu

SEQ ID NO: 180062 - RNA, 32 nt, Human
gcugaaucauuuccugccaucucuuuuaacac

SEQ ID NO: 180063 - RNA, 32 nt, Human
gcugaaucuuucuccucuaagcagucugguca

SEQ ID NO: 180064 - RNA, 32 nt, Human
gcugaaugaaugcagaaaucagcgguacugac

SEQ ID NO: 180065 - RNA, 32 nt, Human
gcugaaugagccaccacuccguagcuuuauau

SEQ ID NO: 180066 - RNA, 22 nt, Human
gcugaaugccaaggaccaaaga

SEQ ID NO: 180067 - RNA, 32 nt, Human
gcugaaugcccacgaggagcucugcugagacu

SEQ ID NO: 180068 - RNA, 32 nt, Human
gcugaauggaccuugacagauggccaagucaa

SEQ ID NO: 180069 - RNA, 32 nt, Human
gcugaauggacuccgugaaaauggcagacacg

SEQ ID NO: 180070 - RNA, 22 nt, Human
gcugaauggggccucagcaggu

SEQ ID NO: 180071 - RNA, 32 nt, Human
gcugaaugguaaacucuuccacaagcgaaaac

SEQ ID NO: 180072 - RNA, 32 nt, Human
gcugaaugucugagagaaccagaguuguucuc

SEQ ID NO: 180073 - RNA, 21 nt, Human
gcugaauuccaagcccagggu

SEQ ID NO: 180074 - RNA, 32 nt, Human
gcugaauucuuuugaacgaugaucuuaaaggc

SEQ ID NO: 180075 - RNA, 32 nt, Human
gcugaauuugacguuaaugauaugacuaggag

SEQ ID NO: 180076 - RNA, 32 nt, Human
gcugaauuuucacaugaacauacuggcuggug

SEQ ID NO: 180077 - RNA, 24 nt, Human
gcugacaaagaugaccugcugcug

SEQ ID NO: 180078 - RNA, 32 nt, Human
gcugacaaagugagcugagauccggccaacag

SEQ ID NO: 180079 - RNA, 32 nt, Human
gcugacaaauaacauuuaacaaguauugcagu

SEQ ID NO: 180080 - RNA, 32 nt, Human
gcugacaaauguguccuugauccacacugcuc

SEQ ID NO: 180081 - RNA, 32 nt, Human
gcugacaagggacuguaauuuaaugaugcguu

SEQ ID NO: 180082 - RNA, 32 nt, Human
gcugacaagggcagugugaaucugccaagggu

SEQ ID NO: 180083 - RNA, 32 nt, Human
gcugacacaagaauccauucucacagaaacug

SEQ ID NO: 180084 - RNA, 23 nt, Human
gcugacacaggagaauugcuuga

SEQ ID NO: 180085 - RNA, 32 nt, Human
gcugacacaggcugcagagaaaagugguugau

SEQ ID NO: 180086 - RNA, 32 nt, Human
gcugacaccagcagggcagggaggugaacuga

SEQ ID NO: 180087 - RNA, 19 nt, Human
gcugacacccacguccaaa

SEQ ID NO: 180088 - RNA, 32 nt, Human
gcugacaccgcgccccggguucccaggccacc

SEQ ID NO: 180089 - RNA, 32 nt, Human
gcugacaccuauaaucucagcacuuugggagg

SEQ ID NO: 180090 - RNA, 32 nt, Human
gcugacaccuggucugugcaccuguguugcuc

SEQ ID NO: 180091 - RNA, 32 nt, Human
gcugacaccuguaaucccagcacuuugggagg

SEQ ID NO: 180092 - RNA, 32 nt, Human
gcugacaccuguaaucccagcauuuugggaga

SEQ ID NO: 180093 - RNA, 32 nt, Human
gcugacacuacccuaaucuuccaggacccauu

SEQ ID NO: 180094 - RNA, 32 nt, Human
gcugacacucuggugagcugagcucuagaagg

SEQ ID NO: 180095 - RNA, 32 nt, Human
gcugacacugcaaaccugcaugggugggcuuu

SEQ ID NO: 180096 - RNA, 32 nt, Human
gcugacacugccaaccuccaguauccucaccc

SEQ ID NO: 180097 - RNA, 32 nt, Human
gcugacacuggcagagagguaaaggguggggc

SEQ ID NO: 180098 - RNA, 32 nt, Human
gcugacacuucaaggugacagaaggaccagcc

SEQ ID NO: 180099 - RNA, 32 nt, Human
gcugacacuuccucuacagagauggaccaaaa

SEQ ID NO: 180100 - RNA, 32 nt, Human
gcugacagaacugcuggauuugguucucauug

SEQ ID NO: 180101 - RNA, 32 nt, Human
gcugacagagagccucacccccgaccacacag

SEQ ID NO: 180102 - RNA, 32 nt, Human
gcugacagaggcaccguucaccagagggcuca

SEQ ID NO: 180103 - RNA, 32 nt, Human
gcugacagcacaucugcaggaagcaugagggu

SEQ ID NO: 180104 - RNA, 32 nt, Human
gcugacaggacuuccacacccaugcuccucuc

SEQ ID NO: 180105 - RNA, 32 nt, Human
gcugacaggagagaugagugugagagcuggga

SEQ ID NO: 180106 - RNA, 32 nt, Human
gcugacagggacgcuggccaacagggugguau

SEQ ID NO: 180107 - RNA, 32 nt, Human
gcugacagggggcuuaguggagauugggguua

SEQ ID NO: 180108 - RNA, 32 nt, Human
gcugacaguacugaaagcuuuccucuuuaacu

SEQ ID NO: 180109 - RNA, 22 nt, Human
gcugacaucacaaccugugaca

SEQ ID NO: 180110 - RNA, 32 nt, Human
gcugacaucccuaccccugccucacugccuau

SEQ ID NO: 180111 - RNA, 32 nt, Human
gcugacaucuaugugcuagcugccucaucacg

SEQ ID NO: 180112 - RNA, 32 nt, Human
gcugacaucugaggcccuucccaggaagacau

SEQ ID NO: 180113 - RNA, 32 nt, Human
gcugacaucuguaauccccgcacuuugugagg

SEQ ID NO: 180114 - RNA, 32 nt, Human
gcugacaucuuggagcucaguacccucauagu

SEQ ID NO: 180115 - RNA, 32 nt, Human
gcugacaugcaacugccuuaacuuugccuacc

SEQ ID NO: 180116 - RNA, 32 nt, Human
gcugacauucuagccuauuuuaaugguuugca

SEQ ID NO: 180117 - RNA, 28 nt, Human
gcugaccaacauggugaaaugaaacccc

SEQ ID NO: 180118 - RNA, 30 nt, Human
gcugaccaacauggugaaaugaaaccccau

SEQ ID NO: 180119 - RNA, 22 nt, Human
gcugaccacacagaugacccag

SEQ ID NO: 180120 - RNA, 26 nt, Human
gcugaccacacuaagcucuucucucu

SEQ ID NO: 180121 - RNA, 32 nt, Human
gcugaccacaggggaacgauguucuuuucuuu

SEQ ID NO: 180122 - RNA, 32 nt, Human
gcugaccaccaccaccuggccucuccgagacg

SEQ ID NO: 180123 - RNA, 19 nt, Human
gcugaccaccccucugagc

SEQ ID NO: 180124 - RNA, 32 nt, Human
gcugaccaccuauguuagaggaaguacagaag

SEQ ID NO: 180125 - RNA, 32 nt, Human
gcugaccacgcucuccuuucuggcaggagacg

SEQ ID NO: 180126 - RNA, 22 nt, Human
gcugaccagaagcaugcugcug

SEQ ID NO: 180127 - RNA, 32 nt, Human
gcugaccagcagaggugagagagcgagacagg

SEQ ID NO: 180128 - RNA, 32 nt, Human
gcugaccagcucgcgcccuccugaggcccuga

SEQ ID NO: 180129 - RNA, 20 nt, Human
gcugaccauccuguuuucca

SEQ ID NO: 180130 - RNA, 22 nt, Human
gcugaccaucugcuuuccucca

SEQ ID NO: 180131 - RNA, 32 nt, Human
gcugacccagcauggagcccaagagcagcucg

SEQ ID NO: 180132 - RNA, 21 nt, Human
gcugacccagcccugcugcug

SEQ ID NO: 180133 - RNA, 32 nt, Human
gcugaccccaaaacccuuccacacuuuauuag

SEQ ID NO: 180134 - RNA, 32 nt, Human
gcugaccccacacccaggaccacuguccggcu

SEQ ID NO: 180135 - RNA, 32 nt, Human
gcugaccccagccaggcuacagggaucgauug

SEQ ID NO: 180136 - RNA, 32 nt, Human
gcugaccccagccggcgccgagggcuuggaau

SEQ ID NO: 180137 - RNA, 32 nt, Human
gcugaccccaggccuggugauucugggccccu

SEQ ID NO: 180138 - RNA, 32 nt, Human
gcugaccccucggagcaagcgccgcacaggug

SEQ ID NO: 180139 - RNA, 32 nt, Human
gcugaccccuggggcaacguuggcugcagcgg

SEQ ID NO: 180140 - RNA, 32 nt, Human
gcugacccgaggucuuccuaucuggaaugacu

SEQ ID NO: 180141 - RNA, 26 nt, Human
gcugacccgccucccugcccggccgg

SEQ ID NO: 180142 - RNA, 32 nt, Human
gcugacccucgagucgcuucgcuagcugugcg

SEQ ID NO: 180143 - RNA, 32 nt, Human
gcugacccucuaaucacaaggcugguuccuca

SEQ ID NO: 180144 - RNA, 32 nt, Human
gcugaccgugccagagcuuguuuguaccucuc

SEQ ID NO: 180145 - RNA, 32 nt, Human
gcugaccucacagaucaacguauuaacaagac

SEQ ID NO: 180146 - RNA, 32 nt, Human
gcugaccuccaggggcacuuccucggcucauc

SEQ ID NO: 180147 - RNA, 32 nt, Human
gcugaccucccagugaccccugaccucacugu

SEQ ID NO: 180148 - RNA, 22 nt, Human
gcugaccuccugcagcucgcug

SEQ ID NO: 180149 - RNA, 20 nt, Human
gcugaccucuccaguugcug

SEQ ID NO: 180150 - RNA, 24 nt, Human
gcugaccucuccuggcugugccug

SEQ ID NO: 180151 - RNA, 32 nt, Human
gcugaccucugacuucuugguagugagaagaa

SEQ ID NO: 180152 - RNA, 32 nt, Human
gcugaccucuggauaggaacagcuucuccgcc

SEQ ID NO: 180153 - RNA, 21 nt, Human
gcugaccugaaccuggugcug

SEQ ID NO: 180154 - RNA, 32 nt, Human
gcugaccugaaccugguucaucccuuucugac

SEQ ID NO: 180155 - RNA, 32 nt, Human
gcugaccugacaaguacuaugugugugcaugu

SEQ ID NO: 180156 - RNA, 32 nt, Human
gcugaccugaguauccaccaugugccaggcac

SEQ ID NO: 180157 - RNA, 32 nt, Human
gcugaccugcugcugagcuggcugggcuggac

SEQ ID NO: 180158 - RNA, 32 nt, Human
gcugaccugugcuugguccaccccagguaggg

SEQ ID NO: 180159 - RNA, 22 nt, Human
gcugaccuguguuuccucccca

SEQ ID NO: 180160 - RNA, 32 nt, Human
gcugaccuuaguuucaaagcuuauucuuaauu

SEQ ID NO: 180161 - RNA, 32 nt, Human
gcugaccuucuuacugugaaagccacuugaug

SEQ ID NO: 180162 - RNA, 24 nt, Human
gcugaccuugaacuccugggcuca

SEQ ID NO: 180163 - RNA, 32 nt, Human
gcugacgaaauguuagccguggauucaaggac

SEQ ID NO: 180164 - RNA, 20 nt, Human
gcugacgaagcuggccuccc

SEQ ID NO: 180165 - RNA, 32 nt, Human
gcugacgacugagcccugcuucugcuggggcu

SEQ ID NO: 180166 - RNA, 24 nt, Human
gcugacgcaggaggauugcuugag

SEQ ID NO: 180167 - RNA, 32 nt, Human
gcugacgccugccagguuucugcugcagauaa

SEQ ID NO: 180168 - RNA, 32 nt, Human
gcugacgccuguaaucccagcacuuugggagg

SEQ ID NO: 180169 - RNA, 32 nt, Human
gcugacgcuacaccuuggucuuuccggguccu

SEQ ID NO: 180170 - RNA, 32 nt, Human
gcugacggcccagaacuggcagagagaagguu

SEQ ID NO: 180171 - RNA, 32 nt, Human
gcugacggggagggggacaggcagggaguuag

SEQ ID NO: 180172 - RNA, 32 nt, Human
gcugacgguucaguccugccucuacugucucu

SEQ ID NO: 180173 - RNA, 32 nt, Human
gcugacuaaucuucaucaccacuguagauuuu

SEQ ID NO: 180174 - RNA, 21 nt, Human
gcugacuacucacuucuccuu

SEQ ID NO: 180175 - RNA, 32 nt, Human
gcugacuagauguuguugauagucaucuuuaa

SEQ ID NO: 180176 - RNA, 32 nt, Human
gcugacuagcagcugcccagcugucaagguca

SEQ ID NO: 180177 - RNA, 32 nt, Human
gcugacucaaccucacagagucagggggugac

SEQ ID NO: 180178 - RNA, 32 nt, Human
gcugacucagugaccuuugaggauguggcugu

SEQ ID NO: 180179 - RNA, 32 nt, Human
gcugacuccagccuugggcucagcagcacccg

SEQ ID NO: 180180 - RNA, 32 nt, Human
gcugacucgaccucccugccucucacacucug

SEQ ID NO: 180181 - RNA, 32 nt, Human
gcugacucgguuuccccucagagccauuguug

SEQ ID NO: 180182 - RNA, 31 nt, Human
gcugacucuaucucugggccugcuuccuggg

SEQ ID NO: 180183 - RNA, 32 nt, Human
gcugacucugcagcuccucaugcuggccuauc

SEQ ID NO: 180184 - RNA, 32 nt, Human
gcugacucuguggacuuugacuucaucauuaa

SEQ ID NO: 180185 - RNA, 24 nt, Human
gcugacugaggccugcuucccccu

SEQ ID NO: 180186 - RNA, 32 nt, Human
gcugacugcaaccuccaccucccgggugcaag

SEQ ID NO: 180187 - RNA, 32 nt, Human
gcugacugcaaccuccaccuccuggguucaag

SEQ ID NO: 180188 - RNA, 32 nt, Human
gcugacugcaacuucugccuccuggguucaag

SEQ ID NO: 180189 - RNA, 32 nt, Human
gcugacugcaaucugugccuccugggcucaag

SEQ ID NO: 180190 - RNA, 19 nt, Human
gcugacugcacaccugagc

SEQ ID NO: 180191 - RNA, 20 nt, Human
gcugacugcacggcuucccc

SEQ ID NO: 180192 - RNA, 32 nt, Human
gcugacugcagccucaaccuuccaggcugaag

SEQ ID NO: 180193 - RNA, 32 nt, Human
gcugacugcagccucaaccuucugggcucaaa

SEQ ID NO: 180194 - RNA, 32 nt, Human
gcugacugcagucugugccuccugggcucaag

SEQ ID NO: 180195 - RNA, 32 nt, Human
gcugacugcccuggaucccucucccaggcucu

SEQ ID NO: 180196 - RNA, 24 nt, Human
gcugacugcccuucucuccucccu

SEQ ID NO: 180197 - RNA, 21 nt, Human
gcugacugccuuggccuccca

SEQ ID NO: 180198 - RNA, 32 nt, Human
gcugacugcgacucgggagcuccgggagcggc

SEQ ID NO: 180199 - RNA, 24 nt, Human
gcugacugcgccugucuucucccu

SEQ ID NO: 180200 - RNA, 21 nt, Human
gcugacugcguucugcccccu

SEQ ID NO: 180201 - RNA, 32 nt, Human
gcugacugcuguguccccacagaucugggccu

SEQ ID NO: 180202 - RNA, 32 nt, Human
gcugacuggaaguuccaugaggggaggaaauu

SEQ ID NO: 180203 - RNA, 21 nt, Human
gcugacuggagcacccccauu

SEQ ID NO: 180204 - RNA, 32 nt, Human
gcugacuggcagaggaagauugcagugacagc

SEQ ID NO: 180205 - RNA, 32 nt, Human
gcugacuggcaucugugccugccuuucuggcc

SEQ ID NO: 180206 - RNA, 22 nt, Human
gcugacuggccuaccugcuccc

SEQ ID NO: 180207 - RNA, 32 nt, Human
gcugacuggccuggcccggccccgccgcgcuc

SEQ ID NO: 180208 - RNA, 32 nt, Human
gcugacugggcuggcagaggagaacauguuga

SEQ ID NO: 180209 - RNA, 32 nt, Human
gcugacugggggccucugccuccaggagggca

SEQ ID NO: 180210 - RNA, 24 nt, Human
gcugacuggggugucugccccccu

SEQ ID NO: 180211 - RNA, 32 nt, Human
gcugacugggugugccuucuaguguccugugu

SEQ ID NO: 180212 - RNA, 32 nt, Human
gcugacugugauauacuguauuggagaaacca

SEQ ID NO: 180213 - RNA, 32 nt, Human
gcugacugugccagaugcagaucuuaccuguc

SEQ ID NO: 180214 - RNA, 22 nt, Human
gcugacugugccgucccuuccc

SEQ ID NO: 180215 - RNA, 19 nt, Human
gcugacuguggcccccucc

SEQ ID NO: 180216 - RNA, 32 nt, Human
gcugacuguguguacauauguauauaauaugu

SEQ ID NO: 180217 - RNA, 32 nt, Human
gcugacuuaggauuauuaaugaaaguguugca

SEQ ID NO: 180218 - RNA, 32 nt, Human
gcugacuucccaagcccuggugaccagaccaa

SEQ ID NO: 180219 - RNA, 32 nt, Human
gcugacuuccucacuaaccucuucacguguaa

SEQ ID NO: 180220 - RNA, 32 nt, Human
gcugacuuccucacuauccucuucacauguaa

SEQ ID NO: 180221 - RNA, 32 nt, Human
gcugacuuccugugcuccucuggccacaggua

SEQ ID NO: 180222 - RNA, 32 nt, Human
gcugacuucucaccugcgcguucacacuggcg

SEQ ID NO: 180223 - RNA, 32 nt, Human
gcugacuucucccuggccgccugcugaggagc

SEQ ID NO: 180224 - RNA, 32 nt, Human
gcugacuucugugguuuagcaagagguuuauu

SEQ ID NO: 180225 - RNA, 32 nt, Human
gcugacuugagaagcugugauggccaagcuuu

SEQ ID NO: 180226 - RNA, 32 nt, Human
gcugacuugcucggaaacccauuggagguauc

SEQ ID NO: 180227 - RNA, 32 nt, Human
gcugacuugcuuaugucuguuuggaagcugcu

SEQ ID NO: 180228 - RNA, 32 nt, Human
gcugagaaaacccuggaguggagggaggcuca

SEQ ID NO: 180229 - RNA, 32 nt, Human
gcugagaaaccagcaacccaugugaggauucc

SEQ ID NO: 180230 - RNA, 32 nt, Human
gcugagaaaggaagcagacaauaagggccucu

SEQ ID NO: 180231 - RNA, 18 nt, Human
gcugagaaaggcugcuca

SEQ ID NO: 180232 - RNA, 32 nt, Human
gcugagaaaugauacccaggagcagcaggcuu

SEQ ID NO: 180233 - RNA, 18 nt, Human
gcugagaaccccucagag

SEQ ID NO: 180234 - RNA, 23 nt, Human
gcugagaacuccugacuguaaca

SEQ ID NO: 180235 - RNA, 32 nt, Human
gcugagaacugguucuggccuaggugggcucu

SEQ ID NO: 180236 - RNA, 32 nt, Human
gcugagaagagcagagaugaagggugggaccu

SEQ ID NO: 180237 - RNA, 32 nt, Human
gcugagaagaggaggaggugggggcuggaggu

SEQ ID NO: 180238 - RNA, 32 nt, Human
gcugagaagagugugcuggagaugcucuagga

SEQ ID NO: 180239 - RNA, 32 nt, Human
gcugagaagggagggacagaaaagagaagaca

SEQ ID NO: 180240 - RNA, 20 nt, Human
gcugagaaggggcugaggca

SEQ ID NO: 180241 - RNA, 32 nt, Human
gcugagaaugagaagagguucaagugauucuu

SEQ ID NO: 180242 - RNA, 32 nt, Human
gcugagacaccuccuguuucccuuccccuuga

SEQ ID NO: 180243 - RNA, 32 nt, Human
gcugagacagauggaagccaggacaggggagc

SEQ ID NO: 180244 - RNA, 32 nt, Human
gcugagacagccugagauauggccucauggga

SEQ ID NO: 180245 - RNA, 23 nt, Human
gcugagacaggagaaucgcuuga

SEQ ID NO: 180246 - RNA, 23 nt, Human
gcugagacaggagaauugcuuga

SEQ ID NO: 180247 - RNA, 32 nt, Human
gcugagacaggagaguacagaaugacaacauu

SEQ ID NO: 180248 - RNA, 23 nt, Human
gcugagacaggagagucgcuuga

SEQ ID NO: 180249 - RNA, 23 nt, Human
gcugagacaggaggaucgcuuga

SEQ ID NO: 180250 - RNA, 18 nt, Human
gcugagacaggcucggca

SEQ ID NO: 180251 - RNA, 21 nt, Human
gcugagaccacaggcacccgc

SEQ ID NO: 180252 - RNA, 24 nt, Human
gcugagaccacaggcgugugccac

SEQ ID NO: 180253 - RNA, 24 nt, Human
gcugagaccacagggacacaccau

SEQ ID NO: 180254 - RNA, 32 nt, Human
gcugagaccagcuggucacugcugggccugcu

SEQ ID NO: 180255 - RNA, 20 nt, Human
gcugagaccaucauuuucca

SEQ ID NO: 180256 - RNA, 32 nt, Human
gcugagaccauccugauuucaaacacccaguc

SEQ ID NO: 180257 - RNA, 21 nt, Human
gcugagacgccauggggccgc

SEQ ID NO: 180258 - RNA, 32 nt, Human
gcugagacggagaagaggagaggcagagaggg

SEQ ID NO: 180259 - RNA, 24 nt, Human
gcugagacuacaggcacacaccac

SEQ ID NO: 180260 - RNA, 24 nt, Human
gcugagacuacaggcacgcaccac

SEQ ID NO: 180261 - RNA, 32 nt, Human
gcugagacugaaacagaggggcugggacaugg

SEQ ID NO: 180262 - RNA, 32 nt, Human
gcugagacugcacuagggucuggggacacaga

SEQ ID NO: 180263 - RNA, 32 nt, Human
gcugagacugccucacugaguugucaacacuu

SEQ ID NO: 180264 - RNA, 32 nt, Human
gcugagacugugccacugcacuccagccuggg

SEQ ID NO: 180265 - RNA, 32 nt, Human
gcugagacugugccacugcaguccagccuggg

SEQ ID NO: 180266 - RNA, 32 nt, Human
gcugagacuucucugcaaagaggggaggggga

SEQ ID NO: 180267 - RNA, 32 nt, Human
gcugagagacacgugaggaagaugaugggagg

SEQ ID NO: 180268 - RNA, 20 nt, Human
gcugagagacuaguugugau

SEQ ID NO: 180269 - RNA, 32 nt, Human
gcugagagccagaggaaaagauaauuagacuu

SEQ ID NO: 180270 - RNA, 21 nt, Human
gcugagagcccaaucgcauca

SEQ ID NO: 180271 - RNA, 32 nt, Human
gcugagagccucuagucgccuccugccaucug

SEQ ID NO: 180272 - RNA, 23 nt, Human
gcugagaggacuuucacaccaua

SEQ ID NO: 180273 - RNA, 32 nt, Human
gcugagaggagaaggagggagacaugagcaug

SEQ ID NO: 180274 - RNA, 32 nt, Human
gcugagaggagagagacuccagcuggguugga

SEQ ID NO: 180275 - RNA, 32 nt, Human
gcugagagggagacgcuccaagaggcuccuca

SEQ ID NO: 180276 - RNA, 32 nt, Human
gcugagagggccuggcccuggggugggcucca

SEQ ID NO: 180277 - RNA, 22 nt, Human
gcugagaggggacugggcgccg

SEQ ID NO: 180278 - RNA, 32 nt, Human
gcugagagggucugguccuggcccaggcuccc

SEQ ID NO: 180279 - RNA, 32 nt, Human
gcugagaggugguagagcaggaagcugccuga

SEQ ID NO: 180280 - RNA, 21 nt, Human
gcugagagugccuggggccac

SEQ ID NO: 180281 - RNA, 32 nt, Human
gcugagagugcuuccuucuugaagacgagugu

SEQ ID NO: 180282 - RNA, 32 nt, Human
gcugagaguguccugccugguccucugugccu

SEQ ID NO: 180283 - RNA, 32 nt, Human
gcugagaguucaagaccaaccugggcaacaua

SEQ ID NO: 180284 - RNA, 19 nt, Human
gcugagaguugaauugugg

SEQ ID NO: 180285 - RNA, 32 nt, Human
gcugagauauuuugguauugcauugguuuuua

SEQ ID NO: 180286 - RNA, 19 nt, Human
gcugagauccagcccaggg

SEQ ID NO: 180287 - RNA, 32 nt, Human
gcugagaucgcugcacuccagccugggcgaca

SEQ ID NO: 180288 - RNA, 32 nt, Human
gcugagaugagccccacguggagcucgggacg

SEQ ID NO: 180289 - RNA, 32 nt, Human
gcugagaugagguaggggcagccggggugaga

SEQ ID NO: 180290 - RNA, 32 nt, Human
gcugagaugccauggagugcccaucuggucac

SEQ ID NO: 180291 - RNA, 32 nt, Human
gcugagauggcagacaggagagaugggcccca

SEQ ID NO: 180292 - RNA, 32 nt, Human
gcugagaugggaaucacuugaaccugggaggc

SEQ ID NO: 180293 - RNA, 24 nt, Human
gcugagaugggaggaucgcuugag

SEQ ID NO: 180294 - RNA, 24 nt, Human
gcugagaugggaggauugcuugag

SEQ ID NO: 180295 - RNA, 24 nt, Human
gcugagauuacaggcgcacaccac

SEQ ID NO: 180296 - RNA, 32 nt, Human
gcugagauugagcagaagaucaaggaguacaa

SEQ ID NO: 180297 - RNA, 32 nt, Human
gcugagauugagccagggaagggugagcaggc

SEQ ID NO: 180298 - RNA, 32 nt, Human
gcugagauugcacuccagccugggcgacaggc

SEQ ID NO: 180299 - RNA, 32 nt, Human
gcugagauugugccacuacacuccagccuggg

SEQ ID NO: 180300 - RNA, 21 nt, Human
gcugagauugugccacugcac

SEQ ID NO: 180301 - RNA, 32 nt, Human
gcugagauugugccacugcacaccagccugga

SEQ ID NO: 180302 - RNA, 32 nt, Human
gcugagauugugccacugcacuccagccuggg

SEQ ID NO: 180303 - RNA, 32 nt, Human
gcugagauugugccacugcacuucagcuuggg

SEQ ID NO: 180304 - RNA, 32 nt, Human
gcugagauugugccacuguacuccauccuggg

SEQ ID NO: 180305 - RNA, 32 nt, Human
gcugagauugugccacuguauuccauccuggg

SEQ ID NO: 180306 - RNA, 32 nt, Human
gcugagauuguuguccucugucaccagggcgg

SEQ ID NO: 180307 - RNA, 32 nt, Human
gcugagcaaagcccugggcucacagcacccca

SEQ ID NO: 180308 - RNA, 32 nt, Human
gcugagcaaggcagaugaccuaaucaccucac

SEQ ID NO: 180309 - RNA, 32 nt, Human
gcugagcacaagacaaugcacauguguucucu

SEQ ID NO: 180310 - RNA, 32 nt, Human
gcugagcacgagggagcugcuuggggaagcca

SEQ ID NO: 180311 - RNA, 32 nt, Human
gcugagcagcucccaggcagacugccuucuuu

SEQ ID NO: 180312 - RNA, 16 nt, Human
gcugagcagcugugau

SEQ ID NO: 180313 - RNA, 19 nt, Human
gcugagcaggacagccagc

SEQ ID NO: 180314 - RNA, 22 nt, Human
gcugagcaggagaaccgcugga

SEQ ID NO: 180315 - RNA, 32 nt, Human
gcugagcaggaggcagaggugagaguccaaga

SEQ ID NO: 180316 - RNA, 32 nt, Human
gcugagcaggauaugugauacugugugguugg

SEQ ID NO: 180317 - RNA, 32 nt, Human
gcugagcaggccacuucccuggagcugacccc

SEQ ID NO: 180318 - RNA, 32 nt, Human
gcugagcaguagugccucucggguggcggguu

SEQ ID NO: 180319 - RNA, 32 nt, Human
gcugagcaguggcagcagagaggcagacguga

SEQ ID NO: 180320 - RNA, 32 nt, Human
gcugagcaucuucucccaggaguaccagaaac

SEQ ID NO: 180321 - RNA, 32 nt, Human
gcugagccagaagcaucacugcagugaaaguc

SEQ ID NO: 180322 - RNA, 32 nt, Human
gcugagccaggagcuaaaaccuuagauaucug

SEQ ID NO: 180323 - RNA, 24 nt, Human
gcugagccaggaggaucgcuugag

SEQ ID NO: 180324 - RNA, 32 nt, Human
gcugagccaggaguccucucccagaaguuggg

SEQ ID NO: 180325 - RNA, 32 nt, Human
gcugagccaggcuggcagcagcgcggucgcug

SEQ ID NO: 180326 - RNA, 32 nt, Human
gcugagccaugcagggcagccugguggcggcu

SEQ ID NO: 180327 - RNA, 19 nt, Human
gcugagccaugcccggugg

SEQ ID NO: 180328 - RNA, 32 nt, Human
gcugagccaugcucgcgaacugugggucuguc

SEQ ID NO: 180329 - RNA, 32 nt, Human
gcugagcccacccagagguuguuggaguucag

SEQ ID NO: 180330 - RNA, 21 nt, Human
gcugagcccacggcucagugg

SEQ ID NO: 180331 - RNA, 19 nt, Human
gcugagcccagcacugcgg

SEQ ID NO: 180332 - RNA, 20 nt, Human
gcugagcccaggagccggga

SEQ ID NO: 180333 - RNA, 32 nt, Human
gcugagcccaggagccgggaggccugcgggcu

SEQ ID NO: 180334 - RNA, 32 nt, Human
gcugagcccaggagccugccaggcugacgugc

SEQ ID NO: 180335 - RNA, 18 nt, Human
gcugagcccaggcacuug

SEQ ID NO: 180336 - RNA, 22 nt, Human
gcugagcccaggcugcguagug

SEQ ID NO: 180337 - RNA, 19 nt, Human
gcugagcccagggugggga

SEQ ID NO: 180338 - RNA, 32 nt, Human
gcugagcccccaccccugccccagcuccagga

SEQ ID NO: 180339 - RNA, 32 nt, Human
gcugagccccgccccuggcccugcugccaugu

SEQ ID NO: 180340 - RNA, 22 nt, Human
gcugagcccgcgggagcccagg

SEQ ID NO: 180341 - RNA, 22 nt, Human
gcugagccgggaccucgcguga

SEQ ID NO: 180342 - RNA, 32 nt, Human
gcugagccgggggagggcuccgggagggagug

SEQ ID NO: 180343 - RNA, 24 nt, Human
gcugagccuacugucuccuuccca

SEQ ID NO: 180344 - RNA, 32 nt, Human
gcugagccuagaggugaauuucauuggggaag

SEQ ID NO: 180345 - RNA, 32 nt, Human
gcugagccuagaggugaauuucguuggggaag

SEQ ID NO: 180346 - RNA, 20 nt, Human
gcugagccuagccccggcga

SEQ ID NO: 180347 - RNA, 32 nt, Human
gcugagccucagucucccucccuuggggccua

SEQ ID NO: 180348 - RNA, 32 nt, Human
gcugagccuccagcgcgugccagccugggccg

SEQ ID NO: 180349 - RNA, 32 nt, Human
gcugagccuccaggagcugccagaggacagga

SEQ ID NO: 180350 - RNA, 32 nt, Human
gcugagccucgcucgcugcuucuucagggacc

SEQ ID NO: 180351 - RNA, 32 nt, Human
gcugagccugcagggaagccccacauguccag

SEQ ID NO: 180352 - RNA, 32 nt, Human
gcugagccugcaucugugccucccagcccccu

SEQ ID NO: 180353 - RNA, 20 nt, Human
gcugagccuggcccgcacca

SEQ ID NO: 180354 - RNA, 19 nt, Human
gcugagccuggcucaggga

SEQ ID NO: 180355 - RNA, 32 nt, Human
gcugagccugggguuccccuggcauuggcccc

SEQ ID NO: 180356 - RNA, 32 nt, Human
gcugagccugucucugaauuguucccuccccc

SEQ ID NO: 180357 - RNA, 32 nt, Human
gcugagccuuccaugaaaauugcucucugcca

SEQ ID NO: 180358 - RNA, 32 nt, Human
gcugagcgcaugagugacagaggcagagaugc

SEQ ID NO: 180359 - RNA, 32 nt, Human
gcugagcggacaggcucuccagcuggagucca

SEQ ID NO: 180360 - RNA, 32 nt, Human
gcugagcgggaggugaaggcagagguggagga

SEQ ID NO: 180361 - RNA, 32 nt, Human
gcugagcguccaggcugcgcgauggcacacac

SEQ ID NO: 180362 - RNA, 32 nt, Human
gcugagcuaacaccacggcacuucagccuggg

SEQ ID NO: 180363 - RNA, 32 nt, Human
gcugagcucaccugaccucccaugccugugca

SEQ ID NO: 180364 - RNA, 32 nt, Human
gcugagcucagcugcccggaugaccuuuccag

SEQ ID NO: 180365 - RNA, 21 nt, Human
gcugagcucauggcccgcacc

SEQ ID NO: 180366 - RNA, 32 nt, Human
gcugagcuccacuguuggcaaagucuuggcag

SEQ ID NO: 180367 - RNA, 32 nt, Human
gcugagcuccucaccuggacagucuccuggac

SEQ ID NO: 180368 - RNA, 21 nt, Human
gcugagcucucaccucaguga

SEQ ID NO: 180369 - RNA, 32 nt, Human
gcugagcugaauguagugauguuuacauuguu

SEQ ID NO: 180370 - RNA, 32 nt, Human
gcugagcugagacaccuccuguuucccuuccc

SEQ ID NO: 180371 - RNA, 32 nt, Human
gcugagcugagcugagcaacgcugggggcuau

SEQ ID NO: 180372 - RNA, 32 nt, Human
gcugagcugcaagacauccuggaauugggagc

SEQ ID NO: 180373 - RNA, 32 nt, Human
gcugagcugcccaggcuucacggagcgguguu

SEQ ID NO: 180374 - RNA, 20 nt, Human
gcugagcugcugccugguga

SEQ ID NO: 180375 - RNA, 32 nt, Human
gcugagcugcuuccuguuuucuucugauugcu

SEQ ID NO: 180376 - RNA, 32 nt, Human
gcugagcugcuugcaggguucgcugagccaaa

SEQ ID NO: 180377 - RNA, 32 nt, Human
gcugagcuggacuuggcggugggagccggagc

SEQ ID NO: 180378 - RNA, 18 nt, Human
gcugagcuggaggccucc

SEQ ID NO: 180379 - RNA, 32 nt, Human
gcugagcugggagaguuggaggagguggcggc

SEQ ID NO: 180380 - RNA, 19 nt, Human
gcugagcugggccccggga

SEQ ID NO: 180381 - RNA, 32 nt, Human
gcugagcuguuucacugccucucgcaggcccc

SEQ ID NO: 180382 - RNA, 32 nt, Human
gcugagcuugagcuccccuggagccagcaggg

SEQ ID NO: 180383 - RNA, 32 nt, Human
gcugagcuugcccugagggugaggcugggucu

SEQ ID NO: 180384 - RNA, 32 nt, Human
gcugagcuugcucuggugcuagggucagcuag

SEQ ID NO: 180385 - RNA, 32 nt, Human
gcugagcuuggggccuggagccccaggaauga

SEQ ID NO: 180386 - RNA, 32 nt, Human
gcugagcuuggugggagccaaggcugagucgg

SEQ ID NO: 180387 - RNA, 21 nt, Human
gcugagcuugugccuugguga

SEQ ID NO: 180388 - RNA, 32 nt, Human
gcugaggaaacuuggcuguaacuucaaaagaa

SEQ ID NO: 180389 - RNA, 32 nt, Human
gcugaggaacaugcucccucccucccucccau

SEQ ID NO: 180390 - RNA, 21 nt, Human
gcugaggaacccgcagccccg

SEQ ID NO: 180391 - RNA, 32 nt, Human
gcugaggaaccucuaaucaucucccauggauu

SEQ ID NO: 180392 - RNA, 23 nt, Human
gcugaggaaggagaaucgcuuga

SEQ ID NO: 180393 - RNA, 24 nt, Human
gcugaggaaggagaaucgcuugag

SEQ ID NO: 180394 - RNA, 23 nt, Human
gcugaggaaggagaauugcuuga

SEQ ID NO: 180395 - RNA, 32 nt, Human
gcugaggaaggagaggaugacagagacagcgc

SEQ ID NO: 180396 - RNA, 24 nt, Human
gcugaggaaggaggaucgcuugag

SEQ ID NO: 180397 - RNA, 32 nt, Human
gcugaggaaguuauugugcuucugcuggaagg

SEQ ID NO: 180398 - RNA, 32 nt, Human
gcugaggaauccaagaaaauggccaguaagau

SEQ ID NO: 180399 - RNA, 32 nt, Human
gcugaggacagcacggcagcagacaagucagg

SEQ ID NO: 180400 - RNA, 32 nt, Human
gcugaggacaggcuggcgccuccacccacccu

SEQ ID NO: 180401 - RNA, 32 nt, Human
gcugaggacagggcuguggcuggagaaccugc

SEQ ID NO: 180402 - RNA, 32 nt, Human
gcugaggacauggagccaguugcccaaugaca

SEQ ID NO: 180403 - RNA, 25 nt, Human
gcugaggaccaaggcguguccccug

SEQ ID NO: 180404 - RNA, 32 nt, Human
gcugaggaccccuccaggccccucucuccugg

SEQ ID NO: 180405 - RNA, 31 nt, Human
gcugaggacguacuggucagccuggcugugu

SEQ ID NO: 180406 - RNA, 32 nt, Human
gcugaggacugcacgccgcugugcggaagccc

SEQ ID NO: 180407 - RNA, 32 nt, Human
gcugaggagaugggugcgguccucagugagcc

SEQ ID NO: 180408 - RNA, 32 nt, Human
gcugaggagccauccugucuucugcuugagug

SEQ ID NO: 180409 - RNA, 22 nt, Human
gcugaggagcccgccccaggcc

SEQ ID NO: 180410 - RNA, 26 nt, Human
gcugaggagcgccuggcugggcccug

SEQ ID NO: 180411 - RNA, 32 nt, Human
gcugaggagcuggccaagugacuugugccagc

SEQ ID NO: 180412 - RNA, 32 nt, Human
gcugaggaggacaaggugaaccaccugaccaa

SEQ ID NO: 180413 - RNA, 32 nt, Human
gcugaggaggcugaagguagugagggcaagug

SEQ ID NO: 180414 - RNA, 20 nt, Human
gcugaggaggggccugggca

SEQ ID NO: 180415 - RNA, 32 nt, Human
gcugaggaggguggaucacuugaggccaggaa

SEQ ID NO: 180416 - RNA, 32 nt, Human
gcugaggaggguggaucauuugaggccaggag

SEQ ID NO: 180417 - RNA, 23 nt, Human
gcugaggaguccuguguuccccc

SEQ ID NO: 180418 - RNA, 32 nt, Human
gcugaggaguguuaaaguagaagauugagaug

SEQ ID NO: 180419 - RNA, 23 nt, Human
gcugaggcaaaagaauugcuuga

SEQ ID NO: 180420 - RNA, 24 nt, Human
gcugaggcaacaagaaucgcuuga

SEQ ID NO: 180421 - RNA, 23 nt, Human
gcugaggcaagaaaaucgcuuga

SEQ ID NO: 180422 - RNA, 24 nt, Human
gcugaggcaagaagaucacuugag

SEQ ID NO: 180423 - RNA, 23 nt, Human
gcugaggcaagagaaucacuuga

SEQ ID NO: 180424 - RNA, 23 nt, Human
gcugaggcaagagaaucgcuuga

SEQ ID NO: 180425 - RNA, 23 nt, Human
gcugaggcaagagaaucucuuga

SEQ ID NO: 180426 - RNA, 24 nt, Human
gcugaggcaagagaauuacuugag

SEQ ID NO: 180427 - RNA, 23 nt, Human
gcugaggcaagagaauugcuuga

SEQ ID NO: 180428 - RNA, 23 nt, Human
gcugaggcaagagaguugcuuga

SEQ ID NO: 180429 - RNA, 24 nt, Human
gcugaggcaagaggaucacuugag

SEQ ID NO: 180430 - RNA, 23 nt, Human
gcugaggcaagaggauccuugag

SEQ ID NO: 180431 - RNA, 24 nt, Human
gcugaggcaagaggaucgcuugag

SEQ ID NO: 180432 - RNA, 32 nt, Human
gcugaggcaagucgacauagcucacagggaac

SEQ ID NO: 180433 - RNA, 24 nt, Human
gcugaggcaaguggaucacuugag

SEQ ID NO: 180434 - RNA, 23 nt, Human
gcugaggcacaagaaucgcuuga

SEQ ID NO: 180435 - RNA, 24 nt, Human
gcugaggcacaagaaucgcuugag

SEQ ID NO: 180436 - RNA, 23 nt, Human
gcugaggcacaagaauugcuuga

SEQ ID NO: 180437 - RNA, 23 nt, Human
gcugaggcacgagaaucacuuga

SEQ ID NO: 180438 - RNA, 24 nt, Human
gcugaggcacgagaaucacuugag

SEQ ID NO: 180439 - RNA, 23 nt, Human
gcugaggcacgagaaucgcuuga

SEQ ID NO: 180440 - RNA, 24 nt, Human
gcugaggcacgagaaucgcuugag

SEQ ID NO: 180441 - RNA, 24 nt, Human
gcugaggcacgagaaucgcuuggg

SEQ ID NO: 180442 - RNA, 23 nt, Human
gcugaggcacgagaauugcuuga

SEQ ID NO: 180443 - RNA, 23 nt, Human
gcugaggcacgagauucacuuga

SEQ ID NO: 180444 - RNA, 24 nt, Human
gcugaggcacuagaaucgcuugag

SEQ ID NO: 180445 - RNA, 32 nt, Human
gcugaggcacuucuuuuucagaugccaauaaa

SEQ ID NO: 180446 - RNA, 32 nt, Human
gcugaggcagaacucacugggggugggcaguu

SEQ ID NO: 180447 - RNA, 20 nt, Human
gcugaggcagaacugcuuga

SEQ ID NO: 180448 - RNA, 24 nt, Human
gcugaggcagaagaauagcuugag

SEQ ID NO: 180449 - RNA, 23 nt, Human
gcugaggcagaagaaucacuuga

SEQ ID NO: 180450 - RNA, 23 nt, Human
gcugaggcagaagaaucgcuuga

SEQ ID NO: 180451 - RNA, 24 nt, Human
gcugaggcagaagaaucgcuugag

SEQ ID NO: 180452 - RNA, 23 nt, Human
gcugaggcagaagaaucguuuga

SEQ ID NO: 180453 - RNA, 23 nt, Human
gcugaggcagaagaauggcuuga

SEQ ID NO: 180454 - RNA, 24 nt, Human
gcugaggcagaaggaucacuggag

SEQ ID NO: 180455 - RNA, 24 nt, Human
gcugaggcagaaggaucacuugag

SEQ ID NO: 180456 - RNA, 24 nt, Human
gcugaggcagaaggaucccuugag

SEQ ID NO: 180457 - RNA, 23 nt, Human
gcugaggcagaauaaucgcuuga

SEQ ID NO: 180458 - RNA, 20 nt, Human
gcugaggcagaauugcuuga

SEQ ID NO: 180459 - RNA, 22 nt, Human
gcugaggcagagaaucacuuga

SEQ ID NO: 180460 - RNA, 22 nt, Human
gcugaggcagagaauugcuuga

SEQ ID NO: 180461 - RNA, 32 nt, Human
gcugaggcagagaauugcuugaacccuggagg

SEQ ID NO: 180462 - RNA, 23 nt, Human
gcugaggcagcagaaucacuuga

SEQ ID NO: 180463 - RNA, 23 nt, Human
gcugaggcaggaaaaucacuuga

SEQ ID NO: 180464 - RNA, 23 nt, Human
gcugaggcaggaaaaucgcuuga

SEQ ID NO: 180465 - RNA, 23 nt, Human
gcugaggcaggaaaauugcuuga

SEQ ID NO: 180466 - RNA, 24 nt, Human
gcugaggcaggaagaaucgcuuga

SEQ ID NO: 180467 - RNA, 24 nt, Human
gcugaggcaggaagauagcuugag

SEQ ID NO: 180468 - RNA, 23 nt, Human
gcugaggcaggaagaucacuuga

SEQ ID NO: 180469 - RNA, 21 nt, Human
gcugaggcaggaagaucgcuu

SEQ ID NO: 180470 - RNA, 21 nt, Human
gcugaggcaggaaucgcuuga

SEQ ID NO: 180471 - RNA, 24 nt, Human
gcugaggcaggagaaacaccugag

SEQ ID NO: 180472 - RNA, 21 nt, Human
gcugaggcaggagaaccgcuu

SEQ ID NO: 180473 - RNA, 23 nt, Human
gcugaggcaggagaaccgcuuga

SEQ ID NO: 180474 - RNA, 23 nt, Human
gcugaggcaggagaacuacuuga

SEQ ID NO: 180475 - RNA, 23 nt, Human
gcugaggcaggagaacugcuuga

SEQ ID NO: 180476 - RNA, 23 nt, Human
gcugaggcaggagaauagccuga

SEQ ID NO: 180477 - RNA, 23 nt, Human
gcugaggcaggagaauagcuuga

SEQ ID NO: 180478 - RNA, 23 nt, Human
gcugaggcaggagaaucaauuga

SEQ ID NO: 180479 - RNA, 23 nt, Human
gcugaggcaggagaaucacuaga

SEQ ID NO: 180480 - RNA, 23 nt, Human
gcugaggcaggagaaucacucga

SEQ ID NO: 180481 - RNA, 24 nt, Human
gcugaggcaggagaaucacuucag

SEQ ID NO: 180482 - RNA, 22 nt, Human
gcugaggcaggagaaucacuug

SEQ ID NO: 180483 - RNA, 23 nt, Human
gcugaggcaggagaaucacuuga

SEQ ID NO: 180484 - RNA, 24 nt, Human
gcugaggcaggagaaucacuugag

SEQ ID NO: 180485 - RNA, 23 nt, Human
gcugaggcaggagaaucacuugg

SEQ ID NO: 180486 - RNA, 23 nt, Human
gcugaggcaggagaaucaguuga

SEQ ID NO: 180487 - RNA, 23 nt, Human
gcugaggcaggagaaucauuuga

SEQ ID NO: 180488 - RNA, 23 nt, Human
gcugaggcaggagaaucccuuga

SEQ ID NO: 180489 - RNA, 23 nt, Human
gcugaggcaggagaaucgccuga

SEQ ID NO: 180490 - RNA, 23 nt, Human
gcugaggcaggagaaucgcguga

SEQ ID NO: 180491 - RNA, 23 nt, Human
gcugaggcaggagaaucgcuaga

SEQ ID NO: 180492 - RNA, 23 nt, Human
gcugaggcaggagaaucgcugga

SEQ ID NO: 180493 - RNA, 21 nt, Human
gcugaggcaggagaaucgcuu

SEQ ID NO: 180494 - RNA, 23 nt, Human
gcugaggcaggagaaucgcuuga

SEQ ID NO: 180495 - RNA, 24 nt, Human
gcugaggcaggagaaucgcuugag

SEQ ID NO: 180496 - RNA, 23 nt, Human
gcugaggcaggagaaucgcuugg

SEQ ID NO: 180497 - RNA, 23 nt, Human
gcugaggcaggagaaucguuuga

SEQ ID NO: 180498 - RNA, 23 nt, Human
gcugaggcaggagaaucucuuga

SEQ ID NO: 180499 - RNA, 23 nt, Human
gcugaggcaggagaauggccuga

SEQ ID NO: 180500 - RNA, 23 nt, Human
gcugaggcaggagaauggcuuga

SEQ ID NO: 180501 - RNA, 23 nt, Human
gcugaggcaggagaauuacuuga

SEQ ID NO: 180502 - RNA, 23 nt, Human
gcugaggcaggagaauugcuuga

SEQ ID NO: 180503 - RNA, 24 nt, Human
gcugaggcaggagaauugcuugag

SEQ ID NO: 180504 - RNA, 23 nt, Human
gcugaggcaggagacucgcuuga

SEQ ID NO: 180505 - RNA, 25 nt, Human
gcugaggcaggagagaaucgcuuga

SEQ ID NO: 180506 - RNA, 23 nt, Human
gcugaggcaggagagucacuuga

SEQ ID NO: 180507 - RNA, 22 nt, Human
gcugaggcaggagagugcuuga

SEQ ID NO: 180508 - RNA, 23 nt, Human
gcugaggcaggagauucgccuga

SEQ ID NO: 180509 - RNA, 23 nt, Human
gcugaggcaggagauucgcuuga

SEQ ID NO: 180510 - RNA, 24 nt, Human
gcugaggcaggaggaccgcuugag

SEQ ID NO: 180511 - RNA, 24 nt, Human
gcugaggcaggaggacugcuugag

SEQ ID NO: 180512 - RNA, 24 nt, Human
gcugaggcaggaggauagcuugag

SEQ ID NO: 180513 - RNA, 24 nt, Human
gcugaggcaggaggaucaccugag

SEQ ID NO: 180514 - RNA, 24 nt, Human
gcugaggcaggaggaucacucaag

SEQ ID NO: 180515 - RNA, 24 nt, Human
gcugaggcaggaggaucacucgag

SEQ ID NO: 180516 - RNA, 21 nt, Human
gcugaggcaggaggaucacuu

SEQ ID NO: 180517 - RNA, 23 nt, Human
gcugaggcaggaggaucacuuga

SEQ ID NO: 180518 - RNA, 24 nt, Human
gcugaggcaggaggaucacuugag

SEQ ID NO: 180519 - RNA, 23 nt, Human
gcugaggcaggaggaucaguuga

SEQ ID NO: 180520 - RNA, 24 nt, Human
gcugaggcaggaggaucauuugag

SEQ ID NO: 180521 - RNA, 24 nt, Human
gcugaggcaggaggaucccuugag

SEQ ID NO: 180522 - RNA, 24 nt, Human
gcugaggcaggaggaucgccugag

SEQ ID NO: 180523 - RNA, 21 nt, Human
gcugaggcaggaggaucgcuu

SEQ ID NO: 180524 - RNA, 23 nt, Human
gcugaggcaggaggaucgcuuga

SEQ ID NO: 180525 - RNA, 24 nt, Human
gcugaggcaggaggaucgcuugag

SEQ ID NO: 180526 - RNA, 24 nt, Human
gcugaggcaggaggaucucuugag

SEQ ID NO: 180527 - RNA, 24 nt, Human
gcugaggcaggaggauuacuugag

SEQ ID NO: 180528 - RNA, 24 nt, Human
gcugaggcaggaggauugccugag

SEQ ID NO: 180529 - RNA, 23 nt, Human
gcugaggcaggaggauugcucga

SEQ ID NO: 180530 - RNA, 23 nt, Human
gcugaggcaggaggauugcuuga

SEQ ID NO: 180531 - RNA, 24 nt, Human
gcugaggcaggaggauugcuugag

SEQ ID NO: 180532 - RNA, 24 nt, Human
gcugaggcaggaggcucacuugag

SEQ ID NO: 180533 - RNA, 32 nt, Human
gcugaggcaggaguuugggaccagccugggcu

SEQ ID NO: 180534 - RNA, 23 nt, Human
gcugaggcaggauaaucacuuga

SEQ ID NO: 180535 - RNA, 24 nt, Human
gcugaggcaggcagaucaccugag

SEQ ID NO: 180536 - RNA, 24 nt, Human
gcugaggcaggcagaucacuugag

SEQ ID NO: 180537 - RNA, 24 nt, Human
gcugaggcaggcagaucgcuugag

SEQ ID NO: 180538 - RNA, 24 nt, Human
gcugaggcaggcggaucaccugag

SEQ ID NO: 180539 - RNA, 32 nt, Human
gcugaggcaggcggaucacgaggucaggagau

SEQ ID NO: 180540 - RNA, 24 nt, Human
gcugaggcaggcggaucacuugag

SEQ ID NO: 180541 - RNA, 32 nt, Human
gcugaggcaggcggaucaugaggucaggagau

SEQ ID NO: 180542 - RNA, 24 nt, Human
gcugaggcaggcggaucgcuugag

SEQ ID NO: 180543 - RNA, 32 nt, Human
gcugaggcaggcggcaggcguggugcacagga

SEQ ID NO: 180544 - RNA, 24 nt, Human
gcugaggcaggcgggucaccugag

SEQ ID NO: 180545 - RNA, 24 nt, Human
gcugaggcagggagaaucgcuuga

SEQ ID NO: 180546 - RNA, 24 nt, Human
gcugaggcagggagaauugcuuga

SEQ ID NO: 180547 - RNA, 23 nt, Human
gcugaggcaggggaaucacuuga

SEQ ID NO: 180548 - RNA, 23 nt, Human
gcugaggcaggggaaucgcuuga

SEQ ID NO: 180549 - RNA, 24 nt, Human
gcugaggcagggggaucgcuugag

SEQ ID NO: 180550 - RNA, 23 nt, Human
gcugaggcaggugaaucacuuga

SEQ ID NO: 180551 - RNA, 23 nt, Human
gcugaggcaggugaaucgcuuga

SEQ ID NO: 180552 - RNA, 24 nt, Human
gcugaggcagguggaucaccugag

SEQ ID NO: 180553 - RNA, 24 nt, Human
gcugaggcagguggaucacuugag

SEQ ID NO: 180554 - RNA, 24 nt, Human
gcugaggcagguggaucgccugag

SEQ ID NO: 180555 - RNA, 23 nt, Human
gcugaggcaguagaaucacuuga

SEQ ID NO: 180556 - RNA, 23 nt, Human
gcugaggcaguagaaucgcuuga

SEQ ID NO: 180557 - RNA, 32 nt, Human
gcugaggcagugugguuauguucccagcagug

SEQ ID NO: 180558 - RNA, 24 nt, Human
gcugaggcauaagaauugcuugag

SEQ ID NO: 180559 - RNA, 32 nt, Human
gcugaggcauccuuccucacaccaggcuugcc

SEQ ID NO: 180560 - RNA, 23 nt, Human
gcugaggcaugagaaucacuuga

SEQ ID NO: 180561 - RNA, 23 nt, Human
gcugaggcaugagaaucgcuuga

SEQ ID NO: 180562 - RNA, 24 nt, Human
gcugaggcaugagaaucgcuugag

SEQ ID NO: 180563 - RNA, 24 nt, Human
gcugaggcaugagaaucgcuuggg

SEQ ID NO: 180564 - RNA, 23 nt, Human
gcugaggcaugagaauugcuuga

SEQ ID NO: 180565 - RNA, 24 nt, Human
gcugaggcaugagaauugcuugag

SEQ ID NO: 180566 - RNA, 23 nt, Human
gcugaggcaugaggaucucuuga

SEQ ID NO: 180567 - RNA, 24 nt, Human
gcugaggcauggagaaucgcuuga

SEQ ID NO: 180568 - RNA, 32 nt, Human
gcugaggccacagcuggugaacagcucagcag

SEQ ID NO: 180569 - RNA, 18 nt, Human
gcugaggccagcugccca

SEQ ID NO: 180570 - RNA, 32 nt, Human
gcugaggccagcugcccacugagucuccuguc

SEQ ID NO: 180571 - RNA, 32 nt, Human
gcugaggccccgaggaucggggcggcaggucg

SEQ ID NO: 180572 - RNA, 24 nt, Human
gcugaggcccgagaaucgcuugag

SEQ ID NO: 180573 - RNA, 32 nt, Human
gcugaggccggccauggucauggaagugggca

SEQ ID NO: 180574 - RNA, 32 nt, Human
gcugaggccugagacucgcuugaacccagggg

SEQ ID NO: 180575 - RNA, 32 nt, Human
gcugaggccugcugugcugcagucccaggagg

SEQ ID NO: 180576 - RNA, 23 nt, Human
gcugaggcgagagaaucgcuuga

SEQ ID NO: 180577 - RNA, 24 nt, Human
gcugaggcgagagaaucgcuugag

SEQ ID NO: 180578 - RNA, 23 nt, Human
gcugaggcgagaggauugcuuga

SEQ ID NO: 180579 - RNA, 23 nt, Human
gcugaggcgagauaaucgcuuga

SEQ ID NO: 180580 - RNA, 24 nt, Human
gcugaggcgaguggaucacuugag

SEQ ID NO: 180581 - RNA, 21 nt, Human
gcugaggcgcacugagcaucc

SEQ ID NO: 180582 - RNA, 24 nt, Human
gcugaggcggaagauucgcuugag

SEQ ID NO: 180583 - RNA, 22 nt, Human
gcugaggcggagaauugcuuga

SEQ ID NO: 180584 - RNA, 23 nt, Human
gcugaggcggaggaccgccugag

SEQ ID NO: 180585 - RNA, 23 nt, Human
gcugaggcggcaggaucacuuga

SEQ ID NO: 180586 - RNA, 32 nt, Human
gcugaggcggcugaggcggcugaggggcugag

SEQ ID NO: 180587 - RNA, 24 nt, Human
gcugaggcgggagaaucaccugag

SEQ ID NO: 180588 - RNA, 23 nt, Human
gcugaggcgggagaaucacuuga

SEQ ID NO: 180589 - RNA, 23 nt, Human
gcugaggcgggagaaucccuuga

SEQ ID NO: 180590 - RNA, 23 nt, Human
gcugaggcgggagaaucgcuuga

SEQ ID NO: 180591 - RNA, 23 nt, Human
gcugaggcgggagaauugcuuga

SEQ ID NO: 180592 - RNA, 23 nt, Human
gcugaggcgggagacucgcuuga

SEQ ID NO: 180593 - RNA, 24 nt, Human
gcugaggcgggaggaucacaugag

SEQ ID NO: 180594 - RNA, 24 nt, Human
gcugaggcgggaggaucacuugag

SEQ ID NO: 180595 - RNA, 24 nt, Human
gcugaggcgggaggaucgccagag

SEQ ID NO: 180596 - RNA, 24 nt, Human
gcugaggcgggaggaucgcuugag

SEQ ID NO: 180597 - RNA, 24 nt, Human
gcugaggcgggaggauuacuugag

SEQ ID NO: 180598 - RNA, 24 nt, Human
gcugaggcgggaggauugcuugag

SEQ ID NO: 180599 - RNA, 24 nt, Human
gcugaggcgggcagaucaccugag

SEQ ID NO: 180600 - RNA, 24 nt, Human
gcugaggcgggcagaucacuugag

SEQ ID NO: 180601 - RNA, 24 nt, Human
gcugaggcgggcggaucaccugag

SEQ ID NO: 180602 - RNA, 24 nt, Human
gcugaggcgggcggaucacuugag

SEQ ID NO: 180603 - RNA, 32 nt, Human
gcugaggcgggugaggugaggagcagccccuc

SEQ ID NO: 180604 - RNA, 24 nt, Human
gcugaggcggguggaucaccugag

SEQ ID NO: 180605 - RNA, 23 nt, Human
gcugaggcggguggaucacuuga

SEQ ID NO: 180606 - RNA, 24 nt, Human
gcugaggcggguggaucacuugag

SEQ ID NO: 180607 - RNA, 23 nt, Human
gcugaggcgugagaaucgcuuga

SEQ ID NO: 180608 - RNA, 32 nt, Human
gcugaggcugcugguggccauguuccuaccag

SEQ ID NO: 180609 - RNA, 21 nt, Human
gcugaggcugcugucccggcg

SEQ ID NO: 180610 - RNA, 20 nt, Human
gcugaggcuggagugcagug

SEQ ID NO: 180611 - RNA, 24 nt, Human
gcugaggcuggagugcagugaugu

SEQ ID NO: 180612 - RNA, 21 nt, Human
gcugaggcuggagugcagugg

SEQ ID NO: 180613 - RNA, 32 nt, Human
gcugaggcuggcugccuggugggauggccuga

SEQ ID NO: 180614 - RNA, 32 nt, Human
gcugaggcugggagggagggccauugggcgug

SEQ ID NO: 180615 - RNA, 32 nt, Human
gcugaggcugggcagaggugggugagaagagg

SEQ ID NO: 180616 - RNA, 32 nt, Human
gcugagggacagacugccugcucaaguggguc

SEQ ID NO: 180617 - RNA, 32 nt, Human
gcugagggacuugggaaucaggcaggugcuuu

SEQ ID NO: 180618 - RNA, 32 nt, Human
gcugagggagaaucacuugggcucaggagcuu

SEQ ID NO: 180619 - RNA, 32 nt, Human
gcugagggagagacugaggugcagcagauggc

SEQ ID NO: 180620 - RNA, 32 nt, Human
gcugagggagagaggugggaggucagaggaga

SEQ ID NO: 180621 - RNA, 21 nt, Human
gcugagggagcuggcagagga

SEQ ID NO: 180622 - RNA, 32 nt, Human
gcugagggaggagaggaugcagagggaaggga

SEQ ID NO: 180623 - RNA, 32 nt, Human
gcugagggauuuucacagugugcuccagaugg

SEQ ID NO: 180624 - RNA, 24 nt, Human
gcugagggcaggagaauugcuuga

SEQ ID NO: 180625 - RNA, 32 nt, Human
gcugagggcaggcaaagccugugugacugugg

SEQ ID NO: 180626 - RNA, 31 nt, Human
gcugagggccaggaaagaugugaaaaacucu

SEQ ID NO: 180627 - RNA, 31 nt, Human
gcugagggccgaccacccaugccaagggaau

SEQ ID NO: 180628 - RNA, 19 nt, Human
gcugagggccuccuuucca

SEQ ID NO: 180629 - RNA, 32 nt, Human
gcugagggcucagaaaauaccugcuccgggug

SEQ ID NO: 180630 - RNA, 21 nt, Human
gcugagggcugcagcccgugg

SEQ ID NO: 180631 - RNA, 32 nt, Human
gcugaggggagaaaggacauggccuuccccgc

SEQ ID NO: 180632 - RNA, 32 nt, Human
gcugaggggaggaucacuggagcccaggaguu

SEQ ID NO: 180633 - RNA, 32 nt, Human
gcugaggggcaggauuuucagcagagcgucgg

SEQ ID NO: 180634 - RNA, 32 nt, Human
gcugaggggcaggcacaggaguccuggcugag

SEQ ID NO: 180635 - RNA, 32 nt, Human
gcugaggggcaggcggcugcaggcuaggggcg

SEQ ID NO: 180636 - RNA, 32 nt, Human
gcugaggggcuguucaccaccauccucguucu

SEQ ID NO: 180637 - RNA, 32 nt, Human
gcugaggggguggaucaccugaggucgggagu

SEQ ID NO: 180638 - RNA, 32 nt, Human
gcugagggguaagagguuguuguaguuguccu

SEQ ID NO: 180639 - RNA, 26 nt, Human
gcugagggguuggaaauugggccccg

SEQ ID NO: 180640 - RNA, 31 nt, Human
gcugaggguaacaaggaacucacuuggcagu

SEQ ID NO: 180641 - RNA, 32 nt, Human
gcugagggucugagagcaggacaggaaaaccc

SEQ ID NO: 180642 - RNA, 32 nt, Human
gcugagggucuggcuguuuguguccuugggcg

SEQ ID NO: 180643 - RNA, 20 nt, Human
gcugagggugaugacuguga

SEQ ID NO: 180644 - RNA, 23 nt, Human
gcugaggguggagaaucgcuuga

SEQ ID NO: 180645 - RNA, 32 nt, Human
gcugaggguuacuguaucuagcaggugaugga

SEQ ID NO: 180646 - RNA, 32 nt, Human
gcugagguacaagaaaggcaccugcaaggacu

SEQ ID NO: 180647 - RNA, 23 nt, Human
gcugagguaggagaaucacuuga

SEQ ID NO: 180648 - RNA, 23 nt, Human
gcugagguaggagaaucgcuuga

SEQ ID NO: 180649 - RNA, 23 nt, Human
gcugagguaggagaaucguuuga

SEQ ID NO: 180650 - RNA, 25 nt, Human
gcugagguaggagaauucgcuugag

SEQ ID NO: 180651 - RNA, 23 nt, Human
gcugagguaggagaauugcuuga

SEQ ID NO: 180652 - RNA, 24 nt, Human
gcugagguaggaggacugcuugag

SEQ ID NO: 180653 - RNA, 24 nt, Human
gcugagguaggaggaucaccugag

SEQ ID NO: 180654 - RNA, 24 nt, Human
gcugagguaggaggaucacgugag

SEQ ID NO: 180655 - RNA, 21 nt, Human
gcugagguaggaggaucgcuu

SEQ ID NO: 180656 - RNA, 24 nt, Human
gcugagguaggaggaucgcuugag

SEQ ID NO: 180657 - RNA, 24 nt, Human
gcugagguaggaggauugcuugag

SEQ ID NO: 180658 - RNA, 24 nt, Human
gcugagguaggcagaucacuugag

SEQ ID NO: 180659 - RNA, 32 nt, Human
gcugagguaguuucaguccaucacaguucauc

SEQ ID NO: 180660 - RNA, 32 nt, Human
gcugagguauaagcccugggccccagaucccu

SEQ ID NO: 180661 - RNA, 23 nt, Human
gcugagguaugagaaucgcuuga

SEQ ID NO: 180662 - RNA, 24 nt, Human
gcugagguaugaggauugcuugag

SEQ ID NO: 180663 - RNA, 24 nt, Human
gcugaggucagaggauggcuugag

SEQ ID NO: 180664 - RNA, 32 nt, Human
gcugaggucaguuucaggagggugaagcugau

SEQ ID NO: 180665 - RNA, 32 nt, Human
gcugagguccagggauggacacagguccgcug

SEQ ID NO: 180666 - RNA, 24 nt, Human
gcugaggucggucggaccaacgga

SEQ ID NO: 180667 - RNA, 24 nt, Human
gcugaggugaaaggaucacuugag

SEQ ID NO: 180668 - RNA, 24 nt, Human
gcugaggugaaaggauugcuugag

SEQ ID NO: 180669 - RNA, 24 nt, Human
gcugaggugagaggaucacuugag

SEQ ID NO: 180670 - RNA, 24 nt, Human
gcugaggugagagggucacuugag

SEQ ID NO: 180671 - RNA, 32 nt, Human
gcugaggugagccuguggcucagucacaguuu

SEQ ID NO: 180672 - RNA, 22 nt, Human
gcugaggugaggaucacuugag

SEQ ID NO: 180673 - RNA, 32 nt, Human
gcugaggugaggaucacuugagcccaggaguu

SEQ ID NO: 180674 - RNA, 21 nt, Human
gcugaggugcuggccggccgg

SEQ ID NO: 180675 - RNA, 24 nt, Human
gcugagguggaaggaucacuugag

SEQ ID NO: 180676 - RNA, 24 nt, Human
gcugagguggaaggaucgcuugag

SEQ ID NO: 180677 - RNA, 22 nt, Human
gcugagguggagaauugcuuga

SEQ ID NO: 180678 - RNA, 32 nt, Human
gcugagguggaggcggagggaggcggcggcgg

SEQ ID NO: 180679 - RNA, 24 nt, Human
gcugaggugggaaaaucacuugag

SEQ ID NO: 180680 - RNA, 24 nt, Human
gcugaggugggaaaaugacuugag

SEQ ID NO: 180681 - RNA, 24 nt, Human
gcugaggugggaagaucacuugag

SEQ ID NO: 180682 - RNA, 24 nt, Human
gcugaggugggaagaucucuugag

SEQ ID NO: 180683 - RNA, 23 nt, Human
gcugaggugggaagauugcuuga

SEQ ID NO: 180684 - RNA, 22 nt, Human
gcugaggugggacugggcccug

SEQ ID NO: 180685 - RNA, 24 nt, Human
gcugaggugggagaaucacuugag

SEQ ID NO: 180686 - RNA, 23 nt, Human
gcugaggugggagaaucgcuuga

SEQ ID NO: 180687 - RNA, 24 nt, Human
gcugaggugggagaaucgcuugag

SEQ ID NO: 180688 - RNA, 24 nt, Human
gcugaggugggagaauugccugag

SEQ ID NO: 180689 - RNA, 23 nt, Human
gcugaggugggagaauugcuuga

SEQ ID NO: 180690 - RNA, 24 nt, Human
gcugaggugggagaauugcuugag

SEQ ID NO: 180691 - RNA, 24 nt, Human
gcugaggugggaggauaacuugag

SEQ ID NO: 180692 - RNA, 24 nt, Human
gcugaggugggaggaucacaugag

SEQ ID NO: 180693 - RNA, 24 nt, Human
gcugaggugggaggaucaccugag

SEQ ID NO: 180694 - RNA, 24 nt, Human
gcugaggugggaggaucacuucag

SEQ ID NO: 180695 - RNA, 23 nt, Human
gcugaggugggaggaucacuuga

SEQ ID NO: 180696 - RNA, 24 nt, Human
gcugaggugggaggaucacuugag

SEQ ID NO: 180697 - RNA, 24 nt, Human
gcugaggugggaggaucacuuggg

SEQ ID NO: 180698 - RNA, 24 nt, Human
gcugaggugggaggaucauuugag

SEQ ID NO: 180699 - RNA, 24 nt, Human
gcugaggugggaggaucccuugag

SEQ ID NO: 180700 - RNA, 23 nt, Human
gcugaggugggaggaucgccuga

SEQ ID NO: 180701 - RNA, 24 nt, Human
gcugaggugggaggaucgccugag

SEQ ID NO: 180702 - RNA, 24 nt, Human
gcugaggugggaggaucgcuggag

SEQ ID NO: 180703 - RNA, 22 nt, Human
gcugaggugggaggaucgcuug

SEQ ID NO: 180704 - RNA, 23 nt, Human
gcugaggugggaggaucgcuuga

SEQ ID NO: 180705 - RNA, 24 nt, Human
gcugaggugggaggaucgcuugag

SEQ ID NO: 180706 - RNA, 24 nt, Human
gcugaggugggaggaucgguugag

SEQ ID NO: 180707 - RNA, 24 nt, Human
gcugaggugggaggaucucuugag

SEQ ID NO: 180708 - RNA, 23 nt, Human
gcugaggugggaggaugacuuga

SEQ ID NO: 180709 - RNA, 23 nt, Human
gcugaggugggaggauggcuuga

SEQ ID NO: 180710 - RNA, 24 nt, Human
gcugaggugggaggauggcuugag

SEQ ID NO: 180711 - RNA, 24 nt, Human
gcugaggugggaggauugccugag

SEQ ID NO: 180712 - RNA, 23 nt, Human
gcugaggugggaggauugcuuga

SEQ ID NO: 180713 - RNA, 24 nt, Human
gcugaggugggaggauugcuugag

SEQ ID NO: 180714 - RNA, 24 nt, Human
gcugaggugggagggucgcuugag

SEQ ID NO: 180715 - RNA, 24 nt, Human
gcugaggugggaggguugcuugag

SEQ ID NO: 180716 - RNA, 24 nt, Human
gcugaggugggaugaucacuugag

SEQ ID NO: 180717 - RNA, 32 nt, Human
gcugaggugggcagaucacgagcucaggagau

SEQ ID NO: 180718 - RNA, 24 nt, Human
gcugaggugggcagaucacuugag

SEQ ID NO: 180719 - RNA, 24 nt, Human
gcugaggugggcggaucacuugag

SEQ ID NO: 180720 - RNA, 24 nt, Human
gcugaggugggcggaucgcucgag

SEQ ID NO: 180721 - RNA, 24 nt, Human
gcugagguggggagaauugcuuga

SEQ ID NO: 180722 - RNA, 24 nt, Human
gcugaggugggggaaucacuugag

SEQ ID NO: 180723 - RNA, 32 nt, Human
gcugaggugggggugcagaaaagggguccucg

SEQ ID NO: 180724 - RNA, 24 nt, Human
gcugagguggguagaucacuugag

SEQ ID NO: 180725 - RNA, 24 nt, Human
gcugagguggguggaucacuugag

SEQ ID NO: 180726 - RNA, 24 nt, Human
gcugagguggguggaucgccugag

SEQ ID NO: 180727 - RNA, 32 nt, Human
gcugagguggguggaugccgaggugaguggau

SEQ ID NO: 180728 - RNA, 19 nt, Human
gcugaggugguggagggag

SEQ ID NO: 180729 - RNA, 32 nt, Human
gcugagguguccauguugucugccuuuguaua

SEQ ID NO: 180730 - RNA, 24 nt, Human
gcugagguugcaggaucgcuugag

SEQ ID NO: 180731 - RNA, 24 nt, Human
gcugagguuggaggauggcuugag

SEQ ID NO: 180732 - RNA, 24 nt, Human
gcugagguuggaggauugcuugag

SEQ ID NO: 180733 - RNA, 32 nt, Human
gcugagguuggcauuuuagugauuauuaagca

SEQ ID NO: 180734 - RNA, 32 nt, Human
gcugagguuuacuuccuugagaucacagacag

SEQ ID NO: 180735 - RNA, 21 nt, Human
gcugaguaaaaccaccaaaga

SEQ ID NO: 180736 - RNA, 21 nt, Human
gcugaguaacaggccaccaag

SEQ ID NO: 180737 - RNA, 21 nt, Human
gcugaguaauggucccccaag

SEQ ID NO: 180738 - RNA, 32 nt, Human
gcugaguauccagcaagagugaccggggugaa

SEQ ID NO: 180739 - RNA, 23 nt, Human
gcugagucaggagaaucgcuuga

SEQ ID NO: 180740 - RNA, 24 nt, Human
gcugagucaggagaauugcuugag

SEQ ID NO: 180741 - RNA, 32 nt, Human
gcugagucaucaucaucaucaucaucauuguc

SEQ ID NO: 180742 - RNA, 21 nt, Human
gcugagucccuucuccccgcc

SEQ ID NO: 180743 - RNA, 21 nt, Human
gcugaguccuagcccuaguga

SEQ ID NO: 180744 - RNA, 32 nt, Human
gcugaguccuugcugugggaugugccaguguc

SEQ ID NO: 180745 - RNA, 20 nt, Human
gcugagucuccucuugguga

SEQ ID NO: 180746 - RNA, 31 nt, Human
gcugagucuucccuggagguugaagagagca

SEQ ID NO: 180747 - RNA, 18 nt, Human
gcugagugaacccagggu

SEQ ID NO: 180748 - RNA, 32 nt, Human
gcugagugagaaggcaguuuguggaaauggaa

SEQ ID NO: 180749 - RNA, 16 nt, Human
gcugagugagcagggg

SEQ ID NO: 180750 - RNA, 32 nt, Human
gcugagugaggaggggacacgggcccugggcc

SEQ ID NO: 180751 - RNA, 19 nt, Human
gcugagugaggggcuguga

SEQ ID NO: 180752 - RNA, 18 nt, Human
gcugagugcaccugggau

SEQ ID NO: 180753 - RNA, 20 nt, Human
gcugagugcacuggcaggau

SEQ ID NO: 180754 - RNA, 32 nt, Human
gcugagugccaggcuuccucuccugggaagag

SEQ ID NO: 180755 - RNA, 32 nt, Human
gcugagugccuccuggguuuccugagacuugu

SEQ ID NO: 180756 - RNA, 19 nt, Human
gcugagugcugaguguaac

SEQ ID NO: 180757 - RNA, 24 nt, Human
gcugagugcugccgccccuuccca

SEQ ID NO: 180758 - RNA, 32 nt, Human
gcugaguggagaggacuuuuccccuggccucu

SEQ ID NO: 180759 - RNA, 20 nt, Human
gcugaguggcccgugugaca

SEQ ID NO: 180760 - RNA, 23 nt, Human
gcugagugggaugaccgcuugag

SEQ ID NO: 180761 - RNA, 32 nt, Human
gcugaguggggucugggcucugccccugcgcc

SEQ ID NO: 180762 - RNA, 20 nt, Human
gcugaguggucugacaccaa

SEQ ID NO: 180763 - RNA, 32 nt, Human
gcugaguguaccugacaguaagucuaaagaug

SEQ ID NO: 180764 - RNA, 19 nt, Human
gcugaguguggauuccaag

SEQ ID NO: 180765 - RNA, 32 nt, Human
gcugagugugggccaccaugagugggcccagc

SEQ ID NO: 180766 - RNA, 32 nt, Human
gcugaguguggugcucacgccuguaaucccag

SEQ ID NO: 180767 - RNA, 32 nt, Human
gcugaguuaaauuccagggucucagaugguua

SEQ ID NO: 180768 - RNA, 32 nt, Human
gcugaguuauggacacagcaugaacaagaugg

SEQ ID NO: 180769 - RNA, 32 nt, Human
gcugaguucagugaggacgauggagacccuug

SEQ ID NO: 180770 - RNA, 32 nt, Human
gcugaguuccagcggggguguugagaaaaagc

SEQ ID NO: 180771 - RNA, 32 nt, Human
gcugaguuccuucuuucccuuggacgcccagu

SEQ ID NO: 180772 - RNA, 32 nt, Human
gcugaguuggguggaaggugcugagagugugg

SEQ ID NO: 180773 - RNA, 21 nt, Human
gcugaguuguggcauuuucca

SEQ ID NO: 180774 - RNA, 23 nt, Human
gcugaguuuccucuucugaggca

SEQ ID NO: 180775 - RNA, 32 nt, Human
gcugaguuuugguaggagugcucaugguucug

SEQ ID NO: 180776 - RNA, 32 nt, Human
gcugauaaaagcugccuuccaggcucuuggac

SEQ ID NO: 180777 - RNA, 32 nt, Human
gcugauaagagcagccauuaccugccacuggg

SEQ ID NO: 180778 - RNA, 32 nt, Human
gcugauacaagaggcagaaacucacucaccua

SEQ ID NO: 180779 - RNA, 32 nt, Human
gcugauacacagaaaaggcugggaaacgggag

SEQ ID NO: 180780 - RNA, 32 nt, Human
gcugauacaccagcucccaaaggucccggagg

SEQ ID NO: 180781 - RNA, 32 nt, Human
gcugauagagugaguccucucccucauucauu

SEQ ID NO: 180782 - RNA, 32 nt, Human
gcugauagcuagggcuugaccaggaagucccg

SEQ ID NO: 180783 - RNA, 32 nt, Human
gcugauagugcagccaggacucuugggguggc

SEQ ID NO: 180784 - RNA, 32 nt, Human
gcugauaguugugguuuuguuuacaaauguuc

SEQ ID NO: 180785 - RNA, 32 nt, Human
gcugauaucacccaggcuggagugcaguggcg

SEQ ID NO: 180786 - RNA, 32 nt, Human
gcugauauggaagacauacauguaugcaaucc

SEQ ID NO: 180787 - RNA, 32 nt, Human
gcugauauggucuucuuuuucucccaacuucg

SEQ ID NO: 180788 - RNA, 32 nt, Human
gcugaucaacagcacuucugccacuugaaaac

SEQ ID NO: 180789 - RNA, 32 nt, Human
gcugaucacaucaccucucugccucaguuucc

SEQ ID NO: 180790 - RNA, 32 nt, Human
gcugaucaccaccaccugcuugcuccaguugu

SEQ ID NO: 180791 - RNA, 32 nt, Human
gcugaucaccucagcaaugaaugauuucaaua

SEQ ID NO: 180792 - RNA, 21 nt, Human
gcugaucauagcucacugcag

SEQ ID NO: 180793 - RNA, 32 nt, Human
gcugaucaucuuccucuucuucuucgugguag

SEQ ID NO: 180794 - RNA, 32 nt, Human
gcugaucaugccacugcacucuagccuaggcu

SEQ ID NO: 180795 - RNA, 32 nt, Human
gcugauccagcuguacuucagaaaaauaauau

SEQ ID NO: 180796 - RNA, 32 nt, Human
gcugaucccacauguguacaucaugcgagcca

SEQ ID NO: 180797 - RNA, 32 nt, Human
gcugauccucaaguaccccaguuucacacaua

SEQ ID NO: 180798 - RNA, 32 nt, Human
gcugauccucuuuuaaaaacccaagauacaau

SEQ ID NO: 180799 - RNA, 32 nt, Human
gcugauccugccucagcuguguggccaugugg

SEQ ID NO: 180800 - RNA, 24 nt, Human
gcugaucucaaacuccuggacuca

SEQ ID NO: 180801 - RNA, 32 nt, Human
gcugaucucacugcacacagccuagggcccca

SEQ ID NO: 180802 - RNA, 32 nt, Human
gcugaucucaggagaacaccugggcuagggaa

SEQ ID NO: 180803 - RNA, 24 nt, Human
gcugaucucgagcuccugggcuca

SEQ ID NO: 180804 - RNA, 32 nt, Human
gcugaucucucccugcuuugcuuuugaacugu

SEQ ID NO: 180805 - RNA, 24 nt, Human
gcugaucucuuccacgugcugcug

SEQ ID NO: 180806 - RNA, 32 nt, Human
gcugaucugagagggucucccuuuguuccuuu

SEQ ID NO: 180807 - RNA, 24 nt, Human
gcugaucuggaacuucugaccuca

SEQ ID NO: 180808 - RNA, 20 nt, Human
gcugaucuguguucccuccc

SEQ ID NO: 180809 - RNA, 24 nt, Human
gcugaucuugaacuccugggcuca

SEQ ID NO: 180810 - RNA, 32 nt, Human
gcugaucuugcacucccagccucaggugaucc

SEQ ID NO: 180811 - RNA, 20 nt, Human
gcugaugaagacccgagaca

SEQ ID NO: 180812 - RNA, 32 nt, Human
gcugaugagcaccuccaggagccucaguuucg

SEQ ID NO: 180813 - RNA, 32 nt, Human
gcugaugaggaggcggccgccccagugcugau

SEQ ID NO: 180814 - RNA, 32 nt, Human
gcugaugaggaucagagcguuuguucccccau

SEQ ID NO: 180815 - RNA, 32 nt, Human
gcugaugaggccgagugucaggaagcacuccc

SEQ ID NO: 180816 - RNA, 32 nt, Human
gcugaugaguuugccaaacuucaggauuauug

SEQ ID NO: 180817 - RNA, 32 nt, Human
gcugaugcaaagaaauuugccagucacuggaa

SEQ ID NO: 180818 - RNA, 24 nt, Human
gcugaugcaagaggaucgcuugag

SEQ ID NO: 180819 - RNA, 29 nt, Human
gcugaugcaccuccacagaggucuccuuc

SEQ ID NO: 180820 - RNA, 32 nt, Human
gcugaugcagcagaacucuugggaaaugucuu

SEQ ID NO: 180821 - RNA, 23 nt, Human
gcugaugcaugagaauugcuuga

SEQ ID NO: 180822 - RNA, 32 nt, Human
gcugaugccaggguuggcacauggaggguaca

SEQ ID NO: 180823 - RNA, 32 nt, Human
gcugaugcccugaggcugggcacaguggaaau

SEQ ID NO: 180824 - RNA, 32 nt, Human
gcugaugccuguaaucccagcacuuugggagg

SEQ ID NO: 180825 - RNA, 32 nt, Human
gcugaugcgguggcuaacaccuguaaucccag

SEQ ID NO: 180826 - RNA, 32 nt, Human
gcugaugcuaccugcuguggccgauuggggca

SEQ ID NO: 180827 - RNA, 32 nt, Human
gcugaugcuccuggcccugccccuggcggccc

SEQ ID NO: 180828 - RNA, 32 nt, Human
gcugaugcuccugguccacaaugugagaacca

SEQ ID NO: 180829 - RNA, 22 nt, Human
gcugauggacaggugucugaga

SEQ ID NO: 180830 - RNA, 32 nt, Human
gcugauggagaaagggcucccgcagaaggaac

SEQ ID NO: 180831 - RNA, 31 nt, Human
gcugauggcucaucugggccuggcuguuuua

SEQ ID NO: 180832 - RNA, 32 nt, Human
gcugauggggacggagagaggagccagucucc

SEQ ID NO: 180833 - RNA, 32 nt, Human
gcugauggggaguaaacccuggaguccgaggc

SEQ ID NO: 180834 - RNA, 32 nt, Human
gcugauggggguuugcucagcacugugccagu

SEQ ID NO: 180835 - RNA, 32 nt, Human
gcugaugggugccagcccugcauugcugaguc

SEQ ID NO: 180836 - RNA, 32 nt, Human
gcugauggguuggagugccuaauggcucauua

SEQ ID NO: 180837 - RNA, 32 nt, Human
gcugaugguaaucaccguguguuugcaguaag

SEQ ID NO: 180838 - RNA, 29 nt, Human
gcugaugguacuggaggaggaggacgucc

SEQ ID NO: 180839 - RNA, 32 nt, Human
gcugauggugucaaggaaggaggacuuggccu

SEQ ID NO: 180840 - RNA, 32 nt, Human
gcugaugguucccagccugcugugaagaaaua

SEQ ID NO: 180841 - RNA, 32 nt, Human
gcugauguacaauaaccuugaggucccccaua

SEQ ID NO: 180842 - RNA, 32 nt, Human
gcugauguccugaccauggacuucugagccuu

SEQ ID NO: 180843 - RNA, 32 nt, Human
gcugauguccuguuucucuuucccucugugac

SEQ ID NO: 180844 - RNA, 32 nt, Human
gcugaugugcaucuucccuuucuugguuuuag

SEQ ID NO: 180845 - RNA, 32 nt, Human
gcugauguggaggaaugguucucagcauacac

SEQ ID NO: 180846 - RNA, 32 nt, Human
gcugauguggccugaagaucugugagugggac

SEQ ID NO: 180847 - RNA, 32 nt, Human
gcugauguguuuccuguuagucugauuuugcu

SEQ ID NO: 180848 - RNA, 29 nt, Human
gcugauguucugccaagucucuggguguu

SEQ ID NO: 180849 - RNA, 32 nt, Human
gcugauguugcagccugcagcaagugcuuccg

SEQ ID NO: 180850 - RNA, 32 nt, Human
gcugauuagggaacuguguccuacccacacug

SEQ ID NO: 180851 - RNA, 32 nt, Human
gcugauuaucacagcccucuuuucuccugaau

SEQ ID NO: 180852 - RNA, 32 nt, Human
gcugauuccaccccagccugccuggacaaccc

SEQ ID NO: 180853 - RNA, 32 nt, Human
gcugauuccagccaggaggauugaggccugug

SEQ ID NO: 180854 - RNA, 32 nt, Human
gcugauucccagcgacccaucccuuagugccc

SEQ ID NO: 180855 - RNA, 32 nt, Human
gcugauuccuguccuggugagcucacugcccc

SEQ ID NO: 180856 - RNA, 32 nt, Human
gcugauucuacuccugcuauugcucacaaccc

SEQ ID NO: 180857 - RNA, 32 nt, Human
gcugauucugaacaauuguggucucucuuaac

SEQ ID NO: 180858 - RNA, 32 nt, Human
gcugauucuguagcaaaaccuggguggggguu

SEQ ID NO: 180859 - RNA, 32 nt, Human
gcugauucuuuuucccuccagcauccuaggaa

SEQ ID NO: 180860 - RNA, 32 nt, Human
gcugauugcagccuugaccuucccagcucaag

SEQ ID NO: 180861 - RNA, 32 nt, Human
gcugauugggcagcacccauaguagaauuguc

SEQ ID NO: 180862 - RNA, 32 nt, Human
gcugauuguguuguggggauguuggcagagaa

SEQ ID NO: 180863 - RNA, 22 nt, Human
gcugauuguucuccuucucccu

SEQ ID NO: 180864 - RNA, 32 nt, Human
gcugauuuccagauuucgauguuucuuaaguc

SEQ ID NO: 180865 - RNA, 32 nt, Human
gcugauuugcugucucugucuuugucucuaau

SEQ ID NO: 180866 - RNA, 32 nt, Human
gcugauuuggucaccuuccucugccuuuguuc

SEQ ID NO: 180867 - RNA, 32 nt, Human
gcugauuuuauuggucaugagaacaaauggau

SEQ ID NO: 180868 - RNA, 24 nt, Human
gcugcaaaagaaguuucuggagca

SEQ ID NO: 180869 - RNA, 32 nt, Human
gcugcaaacacauucaccuaagcagagcacag

SEQ ID NO: 180870 - RNA, 32 nt, Human
gcugcaaagaagaagaaaaagcuccuggaguc

SEQ ID NO: 180871 - RNA, 32 nt, Human
gcugcaaagacagaagcagaacaacuaguuug

SEQ ID NO: 180872 - RNA, 22 nt, Human
gcugcaaaggaggcaacggagg

SEQ ID NO: 180873 - RNA, 32 nt, Human
gcugcaaccaacagcuacagacucaguggcuu

SEQ ID NO: 180874 - RNA, 32 nt, Human
gcugcaacugaaaucagagcugggacacagcg

SEQ ID NO: 180875 - RNA, 32 nt, Human
gcugcaacuucugcuuucaucccaugccucau

SEQ ID NO: 180876 - RNA, 21 nt, Human
gcugcaagaagucucugggca

SEQ ID NO: 180877 - RNA, 32 nt, Human
gcugcaagagaaaaggggcuggaggaagaucc

SEQ ID NO: 180878 - RNA, 20 nt, Human
gcugcaagcccguggccugg

SEQ ID NO: 180879 - RNA, 32 nt, Human
gcugcaagcuuacuucaccucaucucaccuca

SEQ ID NO: 180880 - RNA, 32 nt, Human
gcugcaaggaggcaggggccagcgggaaggag

SEQ ID NO: 180881 - RNA, 19 nt, Human
gcugcaaggcaguggccag

SEQ ID NO: 180882 - RNA, 18 nt, Human
gcugcaaggggcagccag

SEQ ID NO: 180883 - RNA, 32 nt, Human
gcugcaagggguggaggcugagcuggaagggg

SEQ ID NO: 180884 - RNA, 28 nt, Human
gcugcaagggugcaaagggccugugcca

SEQ ID NO: 180885 - RNA, 22 nt, Human
gcugcaagguggcugcgcucag

SEQ ID NO: 180886 - RNA, 32 nt, Human
gcugcaagguuguuuccagcacuuugggaacu

SEQ ID NO: 180887 - RNA, 32 nt, Human
gcugcaaguccuccugggcuuccuucagagaa

SEQ ID NO: 180888 - RNA, 32 nt, Human
gcugcaagugcugaggcgcgguggaggaaagc

SEQ ID NO: 180889 - RNA, 32 nt, Human
gcugcaaucugagcucagccaccuacacacca

SEQ ID NO: 180890 - RNA, 23 nt, Human
gcugcaaucuucccgccccagcc

SEQ ID NO: 180891 - RNA, 32 nt, Human
gcugcaaugagccaugauuucccacugcacuc

SEQ ID NO: 180892 - RNA, 32 nt, Human
gcugcaaugugaguuaucacuucauuuaucuu

SEQ ID NO: 180893 - RNA, 18 nt, Human
gcugcacaaaauguguga

SEQ ID NO: 180894 - RNA, 32 nt, Human
gcugcacacagcacagagacccugggcccagc

SEQ ID NO: 180895 - RNA, 32 nt, Human
gcugcacacagcaggggguucugggcccacaa

SEQ ID NO: 180896 - RNA, 32 nt, Human
gcugcacacuuguaaucacagcacuuugggag

SEQ ID NO: 180897 - RNA, 32 nt, Human
gcugcacagaauaucaccauugcaguucaaaa

SEQ ID NO: 180898 - RNA, 18 nt, Human
gcugcacagagcaggggg

SEQ ID NO: 180899 - RNA, 32 nt, Human
gcugcacagcaaggcccugccacccaccuuca

SEQ ID NO: 180900 - RNA, 32 nt, Human
gcugcacaggaaaguucccuuugguccacagg

SEQ ID NO: 180901 - RNA, 32 nt, Human
gcugcacaggcuaaagcuaaauguauucuaag

SEQ ID NO: 180902 - RNA, 25 nt, Human
gcugcacaucagccugcagcacaaa

SEQ ID NO: 180903 - RNA, 32 nt, Human
gcugcacauucugauucagcaggccugagauu

SEQ ID NO: 180904 - RNA, 32 nt, Human
gcugcaccaccaccaucccccucucccaucca

SEQ ID NO: 180905 - RNA, 32 nt, Human
gcugcaccaccagcaggaggaggaggagaaga

SEQ ID NO: 180906 - RNA, 18 nt, Human
gcugcaccagcagccagc

SEQ ID NO: 180907 - RNA, 19 nt, Human
gcugcaccagcgccuggca

SEQ ID NO: 180908 - RNA, 32 nt, Human
gcugcaccaucccggcguucgcgugugccgcc

SEQ ID NO: 180909 - RNA, 32 nt, Human
gcugcaccauuuuacauucacaccagcagugu

SEQ ID NO: 180910 - RNA, 32 nt, Human
gcugcacccagagggagcagugaggcaggaca

SEQ ID NO: 180911 - RNA, 32 nt, Human
gcugcaccccacucccuguuugacggcccagc

SEQ ID NO: 180912 - RNA, 32 nt, Human
gcugcacccuagcucccugcuccagggaugug

SEQ ID NO: 180913 - RNA, 32 nt, Human
gcugcacccuccaaccucccauuggcucgcuc

SEQ ID NO: 180914 - RNA, 22 nt, Human
gcugcacccugccccaguacaa

SEQ ID NO: 180915 - RNA, 32 nt, Human
gcugcaccgaguggucaggacauugaggccgg

SEQ ID NO: 180916 - RNA, 32 nt, Human
gcugcaccggagagccugccuccgggagccag

SEQ ID NO: 180917 - RNA, 32 nt, Human
gcugcaccugggaggcaggcaggcaugcaugu

SEQ ID NO: 180918 - RNA, 32 nt, Human
gcugcaccuuccccacccccuccugggaagug

SEQ ID NO: 180919 - RNA, 32 nt, Human
gcugcacgcacaccccugcuccggcucacaca

SEQ ID NO: 180920 - RNA, 32 nt, Human
gcugcacgcccaggcugcggagcaccuggagg

SEQ ID NO: 180921 - RNA, 32 nt, Human
gcugcacggguacugaaucuucuacgacugaa

SEQ ID NO: 180922 - RNA, 32 nt, Human
gcugcacgucagguguccuccaccucaguacu

SEQ ID NO: 180923 - RNA, 21 nt, Human
gcugcacgucucccuccucca

SEQ ID NO: 180924 - RNA, 23 nt, Human
gcugcacuaacaguacaaugcuu

SEQ ID NO: 180925 - RNA, 32 nt, Human
gcugcacuacagcccuggccuccacccccacc

SEQ ID NO: 180926 - RNA, 32 nt, Human
gcugcacuagccccagucuggcccggcacggg

SEQ ID NO: 180927 - RNA, 20 nt, Human
gcugcacuaggagcagagcc

SEQ ID NO: 180928 - RNA, 32 nt, Human
gcugcacucacaugaggauacagacuuuguga

SEQ ID NO: 180929 - RNA, 32 nt, Human
gcugcacuccagccuaggcaacauagugagac

SEQ ID NO: 180930 - RNA, 32 nt, Human
gcugcacuccagccugggcaacagagugagac

SEQ ID NO: 180931 - RNA, 32 nt, Human
gcugcacuccagccugggcaauagagugagau

SEQ ID NO: 180932 - RNA, 32 nt, Human
gcugcacuccagccugggcgacagagugagac

SEQ ID NO: 180933 - RNA, 32 nt, Human
gcugcacuccagccugggugacagagugagac

SEQ ID NO: 180934 - RNA, 32 nt, Human
gcugcacuccagccugggugacagagugagag

SEQ ID NO: 180935 - RNA, 20 nt, Human
gcugcacucccgggcuccug

SEQ ID NO: 180936 - RNA, 23 nt, Human
gcugcacucccuccacagacagc

SEQ ID NO: 180937 - RNA, 32 nt, Human
gcugcacucuaaacagcccucuugccugagca

SEQ ID NO: 180938 - RNA, 20 nt, Human
gcugcacugaccaaucagcu

SEQ ID NO: 180939 - RNA, 32 nt, Human
gcugcacugcauuccagccugggugacagagu

SEQ ID NO: 180940 - RNA, 21 nt, Human
gcugcacugcgugcagaugcc

SEQ ID NO: 180941 - RNA, 20 nt, Human
gcugcacuggacaccaugcc

SEQ ID NO: 180942 - RNA, 23 nt, Human
gcugcacugggaggccaauggcu

SEQ ID NO: 180943 - RNA, 16 nt, Human
gcugcacugugaaccu

SEQ ID NO: 180944 - RNA, 32 nt, Human
gcugcacugugccagugaguccaggcuccuuc

SEQ ID NO: 180945 - RNA, 23 nt, Human
gcugcacugugugcggcaggccu

SEQ ID NO: 180946 - RNA, 32 nt, Human
gcugcacuucaccgcugaccuugccucaccuu

SEQ ID NO: 180947 - RNA, 20 nt, Human
gcugcacuucaccugcugcu

SEQ ID NO: 180948 - RNA, 32 nt, Human
gcugcacuugccugcccugccuugcuuggcac

SEQ ID NO: 180949 - RNA, 32 nt, Human
gcugcacuuggguucccgcccaggaaggccuu

SEQ ID NO: 180950 - RNA, 32 nt, Human
gcugcagaaaaaugauuggccccaguccccuu

SEQ ID NO: 180951 - RNA, 32 nt, Human
gcugcagaaaugcagcaguccggcgccuggcc

SEQ ID NO: 180952 - RNA, 32 nt, Human
gcugcagaacacagcgggguccuguccaggcc

SEQ ID NO: 180953 - RNA, 20 nt, Human
gcugcagaacuagacacccu

SEQ ID NO: 180954 - RNA, 21 nt, Human
gcugcagaacucucagucccu

SEQ ID NO: 180955 - RNA, 19 nt, Human
gcugcagaagacacaggca

SEQ ID NO: 180956 - RNA, 19 nt, Human
gcugcagaagacagagaca

SEQ ID NO: 180957 - RNA, 22 nt, Human
gcugcagaagacuccgacggca

SEQ ID NO: 180958 - RNA, 20 nt, Human
gcugcagaagcagggggcug

SEQ ID NO: 180959 - RNA, 20 nt, Human
gcugcagaagccagggugca

SEQ ID NO: 180960 - RNA, 18 nt, Human
gcugcagaagcucagggc

SEQ ID NO: 180961 - RNA, 32 nt, Human
gcugcagaagcugccgccaccuccaaugcaca

SEQ ID NO: 180962 - RNA, 20 nt, Human
gcugcagaagcuugaaugca

SEQ ID NO: 180963 - RNA, 19 nt, Human
gcugcagaaggaagaguca

SEQ ID NO: 180964 - RNA, 19 nt, Human
gcugcagaagggagaggca

SEQ ID NO: 180965 - RNA, 21 nt, Human
gcugcagaagggccaaccccu

SEQ ID NO: 180966 - RNA, 21 nt, Human
gcugcagaagguggugggaca

SEQ ID NO: 180967 - RNA, 22 nt, Human
gcugcagaaguaggcuaaggca

SEQ ID NO: 180968 - RNA, 19 nt, Human
gcugcagaaguccugcuga

SEQ ID NO: 180969 - RNA, 21 nt, Human
gcugcagaccuggaacucccu

SEQ ID NO: 180970 - RNA, 32 nt, Human
gcugcagagacagcuccccacgcccagccugc

SEQ ID NO: 180971 - RNA, 20 nt, Human
gcugcagagagcacagcccu

SEQ ID NO: 180972 - RNA, 32 nt, Human
gcugcagagaucaacccagggcagaggccugg

SEQ ID NO: 180973 - RNA, 25 nt, Human
gcugcagagcaaggaugaagccuca

SEQ ID NO: 180974 - RNA, 32 nt, Human
gcugcagagcagugggccuggccagcaggucc

SEQ ID NO: 180975 - RNA, 22 nt, Human
gcugcagagccgggccacaccu

SEQ ID NO: 180976 - RNA, 23 nt, Human
gcugcagagccugcucccucccu

SEQ ID NO: 180977 - RNA, 32 nt, Human
gcugcagagccugcucccucccugcccugguu

SEQ ID NO: 180978 - RNA, 32 nt, Human
gcugcagaggacagcagcuuauccugauuuca

SEQ ID NO: 180979 - RNA, 21 nt, Human
gcugcagaggagucugagaca

SEQ ID NO: 180980 - RNA, 19 nt, Human
gcugcagaggcuccgaggc

SEQ ID NO: 180981 - RNA, 18 nt, Human
gcugcagagggcugaagg

SEQ ID NO: 180982 - RNA, 23 nt, Human
gcugcagaguccugaacaucccu

SEQ ID NO: 180983 - RNA, 23 nt, Human
gcugcagagugaaggcgcugcag

SEQ ID NO: 180984 - RNA, 32 nt, Human
gcugcagagugcacagggagggucagaagugc

SEQ ID NO: 180985 - RNA, 31 nt, Human
gcugcagaguucacuaagcuguugaauauuu

SEQ ID NO: 180986 - RNA, 32 nt, Human
gcugcagaguugcagaggucccuguagagaua

SEQ ID NO: 180987 - RNA, 23 nt, Human
gcugcagaucggaccucagggua

SEQ ID NO: 180988 - RNA, 20 nt, Human
gcugcagaucuccuggagca

SEQ ID NO: 180989 - RNA, 22 nt, Human
gcugcagaugccaagcagugcu

SEQ ID NO: 180990 - RNA, 32 nt, Human
gcugcagauggcggaaauggauccgguagccg

SEQ ID NO: 180991 - RNA, 32 nt, Human
gcugcagauugauccaguggguacauaggcua

SEQ ID NO: 180992 - RNA, 32 nt, Human
gcugcagauugugccaucacccuucauucuuc

SEQ ID NO: 180993 - RNA, 32 nt, Human
gcugcagauuuuacuuuaugugagaaaaucua

SEQ ID NO: 180994 - RNA, 32 nt, Human
gcugcagcacagaggccugugacugcguucca

SEQ ID NO: 180995 - RNA, 32 nt, Human
gcugcagcacauaugaaugagguguccagcug

SEQ ID NO: 180996 - RNA, 32 nt, Human
gcugcagcacuggcccccugaggcccacagcc

SEQ ID NO: 180997 - RNA, 32 nt, Human
gcugcagcacuuguaaaccacacacacagccu

SEQ ID NO: 180998 - RNA, 32 nt, Human
gcugcagcagggagguggggugggcgguaaac

SEQ ID NO: 180999 - RNA, 32 nt, Human
gcugcagcagggccugaggagaaggugcugcu

SEQ ID NO: 181000 - RNA, 32 nt, Human
gcugcagccaguccucuugcagccugguguuc

SEQ ID NO: 181001 - RNA, 32 nt, Human
gcugcagccaugggaccugcuccaggcaaggc

SEQ ID NO: 181002 - RNA, 32 nt, Human
gcugcagccauucagaccucaggagcuggaaa

SEQ ID NO: 181003 - RNA, 23 nt, Human
gcugcagcccaaggagcagcagg

SEQ ID NO: 181004 - RNA, 32 nt, Human
gcugcagcccaggaguucgagacuagccuggg

SEQ ID NO: 181005 - RNA, 22 nt, Human
gcugcagcccaggccauggaca

SEQ ID NO: 181006 - RNA, 32 nt, Human
gcugcagcccccguagagaagauccuagagca

SEQ ID NO: 181007 - RNA, 19 nt, Human
gcugcagcccuucugaggc

SEQ ID NO: 181008 - RNA, 32 nt, Human
gcugcagccgcaccugcagcuccagggaguua

SEQ ID NO: 181009 - RNA, 32 nt, Human
gcugcagccgucgcugucuccucccagaccgg

SEQ ID NO: 181010 - RNA, 32 nt, Human
gcugcagccucaaccuccugggcucacgugau

SEQ ID NO: 181011 - RNA, 21 nt, Human
gcugcagccuccaacaggaag

SEQ ID NO: 181012 - RNA, 24 nt, Human
gcugcagccucccugcuuccagga

SEQ ID NO: 181013 - RNA, 32 nt, Human
gcugcagccugcuguugagugagaaaacaaaa

SEQ ID NO: 181014 - RNA, 32 nt, Human
gcugcagccugggaccaggcacccccagaaug

SEQ ID NO: 181015 - RNA, 32 nt, Human
gcugcagccugggagcucggccucccucgggg

SEQ ID NO: 181016 - RNA, 32 nt, Human
gcugcagcgcugggcuggugugcaguggugcg

SEQ ID NO: 181017 - RNA, 32 nt, Human
gcugcagcggagauccgagagcagggggaugg

SEQ ID NO: 181018 - RNA, 23 nt, Human
gcugcagcucaagaaacugaagg

SEQ ID NO: 181019 - RNA, 17 nt, Human
gcugcagcucaggaggc

SEQ ID NO: 181020 - RNA, 24 nt, Human
gcugcagcucagggggaugcgagg

SEQ ID NO: 181021 - RNA, 32 nt, Human
gcugcagcucuccaccagcuggguggacuuug

SEQ ID NO: 181022 - RNA, 32 nt, Human
gcugcagcucugaagagccacagcgggaacau

SEQ ID NO: 181023 - RNA, 22 nt, Human
gcugcagcugacaacaggcagg

SEQ ID NO: 181024 - RNA, 32 nt, Human
gcugcagcugcaggaggagcccagggaacacc

SEQ ID NO: 181025 - RNA, 32 nt, Human
gcugcagcugccggacucuucugcuugucacu

SEQ ID NO: 181026 - RNA, 32 nt, Human
gcugcagcugccgggagacucacgccuuagug

SEQ ID NO: 181027 - RNA, 32 nt, Human
gcugcagcuugggaggcggcucuccccaggcg

SEQ ID NO: 181028 - RNA, 21 nt, Human
gcugcaggaaaagcaaucagu

SEQ ID NO: 181029 - RNA, 19 nt, Human
gcugcaggaaacagcagca

SEQ ID NO: 181030 - RNA, 21 nt, Human
gcugcaggaagcccugcccag

SEQ ID NO: 181031 - RNA, 32 nt, Human
gcugcaggacaguaagcccucaccugggcaaa

SEQ ID NO: 181032 - RNA, 20 nt, Human
gcugcaggacuccggaggca

SEQ ID NO: 181033 - RNA, 32 nt, Human
gcugcaggagaugcagcucccgcugauccugg

SEQ ID NO: 181034 - RNA, 20 nt, Human
gcugcaggagcuccgaggca

SEQ ID NO: 181035 - RNA, 17 nt, Human
gcugcaggagcucugag

SEQ ID NO: 181036 - RNA, 32 nt, Human
gcugcaggagcugaggccagaguccuggcacg

SEQ ID NO: 181037 - RNA, 20 nt, Human
gcugcaggaggagcccaggg

SEQ ID NO: 181038 - RNA, 21 nt, Human
gcugcaggccacccucaggca

SEQ ID NO: 181039 - RNA, 32 nt, Human
gcugcaggcccagcuggaggagcagcugcggg

SEQ ID NO: 181040 - RNA, 32 nt, Human
gcugcaggcccagugacugguagcucagugac

SEQ ID NO: 181041 - RNA, 21 nt, Human
gcugcaggccggcaacggcag

SEQ ID NO: 181042 - RNA, 30 nt, Human
gcugcaggccuccugcugcuccuguuugug

SEQ ID NO: 181043 - RNA, 32 nt, Human
gcugcaggcgggcggagguuccaggagauggg

SEQ ID NO: 181044 - RNA, 32 nt, Human
gcugcaggcuccaagcccuuguuccuggaaga

SEQ ID NO: 181045 - RNA, 32 nt, Human
gcugcaggcugcugccccaaguguacagauga

SEQ ID NO: 181046 - RNA, 21 nt, Human
gcugcaggcuggagugcagug

SEQ ID NO: 181047 - RNA, 22 nt, Human
gcugcaggcuggagugcagugg

SEQ ID NO: 181048 - RNA, 32 nt, Human
gcugcaggcuggugcuaugacagcagauugca

SEQ ID NO: 181049 - RNA, 20 nt, Human
gcugcagggaaaacccagcu

SEQ ID NO: 181050 - RNA, 32 nt, Human
gcugcagggaacacguaaugagcagacagugu

SEQ ID NO: 181051 - RNA, 32 nt, Human
gcugcagggaaggcagcuuucauuuguuuaaa

SEQ ID NO: 181052 - RNA, 32 nt, Human
gcugcagggacacugagcuggcuaucucggcg

SEQ ID NO: 181053 - RNA, 22 nt, Human
gcugcagggagaaccgcgagcu

SEQ ID NO: 181054 - RNA, 21 nt, Human
gcugcagggagacaacgggug

SEQ ID NO: 181055 - RNA, 32 nt, Human
gcugcagggaggugggggaagcccuggcugca

SEQ ID NO: 181056 - RNA, 22 nt, Human
gcugcagggucuggcaucagcu

SEQ ID NO: 181057 - RNA, 32 nt, Human
gcugcagggugaggccaggcaggccuggguag

SEQ ID NO: 181058 - RNA, 32 nt, Human
gcugcaggguuugccaaacuauggcuuguggg

SEQ ID NO: 181059 - RNA, 32 nt, Human
gcugcaggucccaggagggccugaggucaaag

SEQ ID NO: 181060 - RNA, 21 nt, Human
gcugcaggugcagugacucca

SEQ ID NO: 181061 - RNA, 23 nt, Human
gcugcaggugccagcacggcagg

SEQ ID NO: 181062 - RNA, 32 nt, Human
gcugcaggugugaggggcgugcccagggcucg

SEQ ID NO: 181063 - RNA, 21 nt, Human
gcugcagguuacuuugagaca

SEQ ID NO: 181064 - RNA, 20 nt, Human
gcugcagguucuccgaggua

SEQ ID NO: 181065 - RNA, 32 nt, Human
gcugcagguucucucucacugccaucaaacug

SEQ ID NO: 181066 - RNA, 32 nt, Human
gcugcagguugcacacccucagccugagaaug

SEQ ID NO: 181067 - RNA, 32 nt, Human
gcugcagguuuagaggaccagugaguugggag

SEQ ID NO: 181068 - RNA, 32 nt, Human
gcugcaguagacgggucgccuuuugcccauac

SEQ ID NO: 181069 - RNA, 32 nt, Human
gcugcaguaucugauaccagacauccacauau

SEQ ID NO: 181070 - RNA, 32 nt, Human
gcugcaguauuauagcccccaggccuggcagg

SEQ ID NO: 181071 - RNA, 32 nt, Human
gcugcagucaaauacugcuacugucacuuuga

SEQ ID NO: 181072 - RNA, 32 nt, Human
gcugcagucagcccugauugugccagugcacu

SEQ ID NO: 181073 - RNA, 32 nt, Human
gcugcagucccccagugccguguuucgggggu

SEQ ID NO: 181074 - RNA, 23 nt, Human
gcugcagucgccgccgccgccgc

SEQ ID NO: 181075 - RNA, 21 nt, Human
gcugcagucucccagccucca

SEQ ID NO: 181076 - RNA, 26 nt, Human
gcugcagucuggggggcccaagggca

SEQ ID NO: 181077 - RNA, 32 nt, Human
gcugcagugagcuaugauugcaccacugcacu

SEQ ID NO: 181078 - RNA, 32 nt, Human
gcugcagugagcuaugauugugccacacacuc

SEQ ID NO: 181079 - RNA, 32 nt, Human
gcugcagugagcuaugauugugccacuucccu

SEQ ID NO: 181080 - RNA, 32 nt, Human
gcugcagugagcuaugguugcaccacuguacu

SEQ ID NO: 181081 - RNA, 32 nt, Human
gcugcagugagcucaugaucauaccacugcac

SEQ ID NO: 181082 - RNA, 32 nt, Human
gcugcagugagcugagaucgugccacugcucu

SEQ ID NO: 181083 - RNA, 32 nt, Human
gcugcagugagcugagauugugccacuucacu

SEQ ID NO: 181084 - RNA, 32 nt, Human
gcugcagugagcugugauggcgccacugcacu

SEQ ID NO: 181085 - RNA, 32 nt, Human
gcugcagugagcugugaugugcccuuaugcua

SEQ ID NO: 181086 - RNA, 32 nt, Human
gcugcagugagcugugauugcaccacugcacu

SEQ ID NO: 181087 - RNA, 32 nt, Human
gcugcagugagcugugauugugccaccacacu

SEQ ID NO: 181088 - RNA, 32 nt, Human
gcugcagugagcuguguuguaccacugcacuc

SEQ ID NO: 181089 - RNA, 32 nt, Human
gcugcagugagugguuccacugccuggauaac

SEQ ID NO: 181090 - RNA, 32 nt, Human
gcugcaguggcagaagacggcucacaagugag

SEQ ID NO: 181091 - RNA, 32 nt, Human
gcugcaguggccaggugacauuccuguggaga

SEQ ID NO: 181092 - RNA, 32 nt, Human
gcugcagugggcauuguguggaaggaugccgc

SEQ ID NO: 181093 - RNA, 32 nt, Human
gcugcaguguuucugauccaaugauucaguaa

SEQ ID NO: 181094 - RNA, 32 nt, Human
gcugcaguguuugaaaugaacaugcaucaugg

SEQ ID NO: 181095 - RNA, 25 nt, Human
gcugcauauauggauggcacugcag

SEQ ID NO: 181096 - RNA, 32 nt, Human
gcugcauauguuuuagaaaaccuguguuuaac

SEQ ID NO: 181097 - RNA, 32 nt, Human
gcugcauccagccugagcaacagagugagauc

SEQ ID NO: 181098 - RNA, 32 nt, Human
gcugcaucccccucagcaucugugcugcgagg

SEQ ID NO: 181099 - RNA, 32 nt, Human
gcugcaucuagcucuaaaccaccugcaucuag

SEQ ID NO: 181100 - RNA, 32 nt, Human
gcugcaucucaggcugaccacagggcaggugc

SEQ ID NO: 181101 - RNA, 32 nt, Human
gcugcaucugaggcggacgccgcaguguaggg

SEQ ID NO: 181102 - RNA, 32 nt, Human
gcugcaucuucagcaucucccauguucaagcc

SEQ ID NO: 181103 - RNA, 32 nt, Human
gcugcaucuuccagucucuccuccgucuucca

SEQ ID NO: 181104 - RNA, 32 nt, Human
gcugcaugaccuaucaguauggugcuaaugug

SEQ ID NO: 181105 - RNA, 32 nt, Human
gcugcaugacuauucagagaagggaggagcca

SEQ ID NO: 181106 - RNA, 32 nt, Human
gcugcaugcccagggcagggugugguacuggc

SEQ ID NO: 181107 - RNA, 32 nt, Human
gcugcaugcugcauacacaagucauacaggag

SEQ ID NO: 181108 - RNA, 32 nt, Human
gcugcauggaagagagcggcuagcaacuguuc

SEQ ID NO: 181109 - RNA, 32 nt, Human
gcugcaugggaaaggugagcgggcuggaaaug

SEQ ID NO: 181110 - RNA, 32 nt, Human
gcugcauggguggugaggagggcaguugccca

SEQ ID NO: 181111 - RNA, 32 nt, Human
gcugcauggugcuggggaggccacagccagcc

SEQ ID NO: 181112 - RNA, 32 nt, Human
gcugcaugucuucacacauauacaggucacuc

SEQ ID NO: 181113 - RNA, 32 nt, Human
gcugcaugugccaacuacgucuuaucucccca

SEQ ID NO: 181114 - RNA, 32 nt, Human
gcugcaugugugcauacuugcuguucuuucag

SEQ ID NO: 181115 - RNA, 32 nt, Human
gcugcauuaccagcuuaaaacacuucuuaggg

SEQ ID NO: 181116 - RNA, 32 nt, Human
gcugcauucagaaggucucucaguugaagaaa

SEQ ID NO: 181117 - RNA, 32 nt, Human
gcugcauuccacugugccagcacucuacauuc

SEQ ID NO: 181118 - RNA, 32 nt, Human
gcugcauucuccuuuggcaaacaucaggguca

SEQ ID NO: 181119 - RNA, 32 nt, Human
gcugcauugacaggcagcccuaggcagccaga

SEQ ID NO: 181120 - RNA, 32 nt, Human
gcugcauugagaagaaaauggcugucauuuaa

SEQ ID NO: 181121 - RNA, 32 nt, Human
gcugcauugcagccccugagcuccugcugcac

SEQ ID NO: 181122 - RNA, 24 nt, Human
gcugcauuguuggaugacaacucu

SEQ ID NO: 181123 - RNA, 32 nt, Human
gcugcauuucuggccuucacuccuuuuggguu

SEQ ID NO: 181124 - RNA, 32 nt, Human
gcugcauuugacuugcucugaaucaaucaaca

SEQ ID NO: 181125 - RNA, 32 nt, Human
gcugccaaacauguuuauuuagcagauacugu

SEQ ID NO: 181126 - RNA, 32 nt, Human
gcugccaaagagacugggcgcaguggcucaug

SEQ ID NO: 181127 - RNA, 32 nt, Human
gcugccaaaggggcagagggugguggagagga

SEQ ID NO: 181128 - RNA, 32 nt, Human
gcugccaacacccugcacuccugcuugcgccg

SEQ ID NO: 181129 - RNA, 32 nt, Human
gcugccaaccugauccugccugggcaacccuu

SEQ ID NO: 181130 - RNA, 32 nt, Human
gcugccaacugcacucggguacuggugugaca

SEQ ID NO: 181131 - RNA, 18 nt, Human
gcugccaagggcccgggc

SEQ ID NO: 181132 - RNA, 32 nt, Human
gcugccaaugagccauugacacuggagaauga

SEQ ID NO: 181133 - RNA, 22 nt, Human
gcugccacaacuggccaugccc

SEQ ID NO: 181134 - RNA, 32 nt, Human
gcugccacaacuggccaugcccugccauugaa

SEQ ID NO: 181135 - RNA, 32 nt, Human
gcugccacaagccuggaacaguccugcagagg

SEQ ID NO: 181136 - RNA, 22 nt, Human
gcugccacacagccucacgcuc

SEQ ID NO: 181137 - RNA, 32 nt, Human
gcugccacagcaccaugccagacuggauggcu

SEQ ID NO: 181138 - RNA, 18 nt, Human
gcugccacauguacuauu

SEQ ID NO: 181139 - RNA, 32 nt, Human
gcugccaccaagagacagcaaugacauguaca

SEQ ID NO: 181140 - RNA, 23 nt, Human
gcugccaccaccaccgccaccac

SEQ ID NO: 181141 - RNA, 32 nt, Human
gcugccaccagggacucggguccuggugcaac

SEQ ID NO: 181142 - RNA, 32 nt, Human
gcugccaccauggccaaagguggagaagcccu

SEQ ID NO: 181143 - RNA, 32 nt, Human
gcugccacccacccaccuccucccucugcucu

SEQ ID NO: 181144 - RNA, 32 nt, Human
gcugccacccaccccauuccucgcuccuuccg

SEQ ID NO: 181145 - RNA, 32 nt, Human
gcugccacccaccuccuccaucacuggaccag

SEQ ID NO: 181146 - RNA, 32 nt, Human
gcugccacccucuucugacccugcugcuguug

SEQ ID NO: 181147 - RNA, 18 nt, Human
gcugccaccgcuaccauc

SEQ ID NO: 181148 - RNA, 32 nt, Human
gcugccaccucguguucugucucccauguccc

SEQ ID NO: 181149 - RNA, 31 nt, Human
gcugccaccucuccugggccuguguccuuuc

SEQ ID NO: 181150 - RNA, 32 nt, Human
gcugccaccuuuucuucuuucucagagaacuc

SEQ ID NO: 181151 - RNA, 32 nt, Human
gcugccacggaggggguccgccagcagcugga

SEQ ID NO: 181152 - RNA, 18 nt, Human
gcugccacguggaggaag

SEQ ID NO: 181153 - RNA, 32 nt, Human
gcugccacguuguaugccccagaagguaccuu

SEQ ID NO: 181154 - RNA, 32 nt, Human
gcugccacucaaacuccagucguggcuaaaag

SEQ ID NO: 181155 - RNA, 32 nt, Human
gcugccacugacagucauccuaccgcacugcu

SEQ ID NO: 181156 - RNA, 32 nt, Human
gcugccacuggcuuaucaggagcaccugaauc

SEQ ID NO: 181157 - RNA, 32 nt, Human
gcugccacuguacuccaaccuggguaacagag

SEQ ID NO: 181158 - RNA, 32 nt, Human
gcugccacuguaguugccaagcucagguuggg

SEQ ID NO: 181159 - RNA, 32 nt, Human
gcugccacuugcuugggaaggaauucuccaga

SEQ ID NO: 181160 - RNA, 32 nt, Human
gcugccacuuucuccuccccuuccugagccgc

SEQ ID NO: 181161 - RNA, 17 nt, Human
gcugccagaagaggcag

SEQ ID NO: 181162 - RNA, 32 nt, Human
gcugccagacacacccuccccaggggccucuc

SEQ ID NO: 181163 - RNA, 32 nt, Human
gcugccagagagaccugcugccggagagaagg

SEQ ID NO: 181164 - RNA, 32 nt, Human
gcugccagagagccugcuuccugcugccugcc

SEQ ID NO: 181165 - RNA, 32 nt, Human
gcugccagaggaccugccccagcaagauuuuu

SEQ ID NO: 181166 - RNA, 32 nt, Human
gcugccagcacauucaugcagaaaagucuuuu

SEQ ID NO: 181167 - RNA, 22 nt, Human
gcugccagcaucgccgccgcca

SEQ ID NO: 181168 - RNA, 18 nt, Human
gcugccagccacagggaa

SEQ ID NO: 181169 - RNA, 23 nt, Human
gcugccagccccuggcugggcag

SEQ ID NO: 181170 - RNA, 32 nt, Human
gcugccagcccuggcccaucauguagcugcag

SEQ ID NO: 181171 - RNA, 32 nt, Human
gcugccagccucacccuccacaccuuagaaug

SEQ ID NO: 181172 - RNA, 32 nt, Human
gcugccagccuuccugcaguaucucuagcagc

SEQ ID NO: 181173 - RNA, 25 nt, Human
gcugccagcgagagggaccagggca

SEQ ID NO: 181174 - RNA, 21 nt, Human
gcugccagcggccgggacucu

SEQ ID NO: 181175 - RNA, 18 nt, Human
gcugccagcuccgcggcc

SEQ ID NO: 181176 - RNA, 18 nt, Human
gcugccagcugcugcgcc

SEQ ID NO: 181177 - RNA, 32 nt, Human
gcugccagcuuaguggaagcucugcucugggu

SEQ ID NO: 181178 - RNA, 32 nt, Human
gcugccaggagaagcaagggucucucucagug

SEQ ID NO: 181179 - RNA, 32 nt, Human
gcugccaggauggaaacuaacuaccugaagag

SEQ ID NO: 181180 - RNA, 32 nt, Human
gcugccaggcacuguucaucucaguuuuucug

SEQ ID NO: 181181 - RNA, 32 nt, Human
gcugccaggcuggaguggaguggcaugaucuc

SEQ ID NO: 181182 - RNA, 32 nt, Human
gcugccaggcuggcguacaguggcgcaaucuc

SEQ ID NO: 181183 - RNA, 32 nt, Human
gcugccagggaagacagagcaggcuuugugag

SEQ ID NO: 181184 - RNA, 32 nt, Human
gcugccagggacgugcugggaaagcccaagcc

SEQ ID NO: 181185 - RNA, 32 nt, Human
gcugccagggagcugcaaagggcugcugagga

SEQ ID NO: 181186 - RNA, 32 nt, Human
gcugccagggccuggggccacugggccagcgc

SEQ ID NO: 181187 - RNA, 32 nt, Human
gcugccagggccuguggaggacaggccagaga

SEQ ID NO: 181188 - RNA, 32 nt, Human
gcugccaggugagccccgggccaagggugguu

SEQ ID NO: 181189 - RNA, 23 nt, Human
gcugccagguugucuucaucuca

SEQ ID NO: 181190 - RNA, 32 nt, Human
gcugccaguaggggcgggaggaaaggcggagg

SEQ ID NO: 181191 - RNA, 32 nt, Human
gcugccagucccgggcccuggagagcagaugc

SEQ ID NO: 181192 - RNA, 32 nt, Human
gcugccagucccucguugcaggacagggucau

SEQ ID NO: 181193 - RNA, 32 nt, Human
gcugccagucuguggagaguccugcugcccuc

SEQ ID NO: 181194 - RNA, 25 nt, Human
gcugccagugugcucgccaugagcu

SEQ ID NO: 181195 - RNA, 32 nt, Human
gcugccauaaugaacuugaaaggacgggaauc

SEQ ID NO: 181196 - RNA, 32 nt, Human
gcugccauagcauggacccccaaaaagccacu

SEQ ID NO: 181197 - RNA, 32 nt, Human
gcugccauaucuuuuucccucuguaaagucau

SEQ ID NO: 181198 - RNA, 32 nt, Human
gcugccaucacuggaggcugcagggaccaaga

SEQ ID NO: 181199 - RNA, 32 nt, Human
gcugccaucacugggaggcucagaggacccuu

SEQ ID NO: 181200 - RNA, 18 nt, Human
gcugccaucaucacuuuu

SEQ ID NO: 181201 - RNA, 24 nt, Human
gcugccaucauuccuugguuugug

SEQ ID NO: 181202 - RNA, 18 nt, Human
gcugccauccacuucuca

SEQ ID NO: 181203 - RNA, 32 nt, Human
gcugccauccagccaagugcgguaccagcccu

SEQ ID NO: 181204 - RNA, 32 nt, Human
gcugccauccccaccccuccaccgcuugccuu

SEQ ID NO: 181205 - RNA, 32 nt, Human
gcugccaucuccagugccccagaaugguacag

SEQ ID NO: 181206 - RNA, 32 nt, Human
gcugccaucugaagaccucaucugagcccacu

SEQ ID NO: 181207 - RNA, 31 nt, Human
gcugccaugaaggugaagauuaagugcugga

SEQ ID NO: 181208 - RNA, 31 nt, Human
gcugccaugaaugccuuccugcucuccgcac

SEQ ID NO: 181209 - RNA, 32 nt, Human
gcugccaugcaagaagugccuuucggcuuccg

SEQ ID NO: 181210 - RNA, 32 nt, Human
gcugccaugcugucagcuggggagaggcccau

SEQ ID NO: 181211 - RNA, 23 nt, Human
gcugccaugcuucagccaugccu

SEQ ID NO: 181212 - RNA, 32 nt, Human
gcugccaugcuuuuccccuugaccugcaccuc

SEQ ID NO: 181213 - RNA, 31 nt, Human
gcugccauggcccagacacugcagauggaga

SEQ ID NO: 181214 - RNA, 32 nt, Human
gcugccauggucuccuugccugcuccaaggca

SEQ ID NO: 181215 - RNA, 32 nt, Human
gcugccauguaagaagugccuuuugccuccca

SEQ ID NO: 181216 - RNA, 32 nt, Human
gcugccaugucucagaugaggagggagagaag

SEQ ID NO: 181217 - RNA, 32 nt, Human
gcugccauuauggugacagagaggaagguacg

SEQ ID NO: 181218 - RNA, 32 nt, Human
gcugcccaaacaggacccuggcagccucccug

SEQ ID NO: 181219 - RNA, 32 nt, Human
gcugcccaaaugcacgcacacgcacagagaca

SEQ ID NO: 181220 - RNA, 31 nt, Human
gcugcccaacggggccuacucacuuauucuu

SEQ ID NO: 181221 - RNA, 32 nt, Human
gcugcccaagggucgccuuccccagcuugugc

SEQ ID NO: 181222 - RNA, 18 nt, Human
gcugcccaaucauuugca

SEQ ID NO: 181223 - RNA, 32 nt, Human
gcugcccaaucucucagacccaccccaccugc

SEQ ID NO: 181224 - RNA, 32 nt, Human
gcugcccacacagcaguuuggcgucagucugc

SEQ ID NO: 181225 - RNA, 32 nt, Human
gcugcccacaguucugcagccacucgguacgg

SEQ ID NO: 181226 - RNA, 22 nt, Human
gcugcccagagccucugaggca

SEQ ID NO: 181227 - RNA, 32 nt, Human
gcugcccagaggccuaaggcugccucagcacc

SEQ ID NO: 181228 - RNA, 18 nt, Human
gcugcccagauggggcug

SEQ ID NO: 181229 - RNA, 32 nt, Human
gcugcccagcagagaguggacgagcagcugag

SEQ ID NO: 181230 - RNA, 32 nt, Human
gcugcccagccgccuagacacagccaaccccg

SEQ ID NO: 181231 - RNA, 32 nt, Human
gcugcccagccuguccuugugucgucuuuuua

SEQ ID NO: 181232 - RNA, 32 nt, Human
gcugcccagcgcuggggugaggcugccguugu

SEQ ID NO: 181233 - RNA, 32 nt, Human
gcugcccagcuccuggccaucuguagagucag

SEQ ID NO: 181234 - RNA, 32 nt, Human
gcugcccaggcagaggagaauggggucuccac

SEQ ID NO: 181235 - RNA, 32 nt, Human
gcugcccaggccagucucaaacuccuggccuc

SEQ ID NO: 181236 - RNA, 32 nt, Human
gcugcccaggggcuuccaguccugucugugug

SEQ ID NO: 181237 - RNA, 23 nt, Human
gcugcccagugcccauggcucuu

SEQ ID NO: 181238 - RNA, 32 nt, Human
gcugccccaagaaacacauugcaccugccaau

SEQ ID NO: 181239 - RNA, 29 nt, Human
gcugccccacaucugcuuuuuggcuuugu

SEQ ID NO: 181240 - RNA, 16 nt, Human
gcugccccacuccacg

SEQ ID NO: 181241 - RNA, 32 nt, Human
gcugccccagaacauaggucuuggaauaaaau

SEQ ID NO: 181242 - RNA, 32 nt, Human
gcugccccagagagucugugugagaugaagac

SEQ ID NO: 181243 - RNA, 32 nt, Human
gcugccccagaggacaguggguggagugguac

SEQ ID NO: 181244 - RNA, 26 nt, Human
gcugccccagcacaucguccugagcc

SEQ ID NO: 181245 - RNA, 25 nt, Human
gcugccccagccuuuccgccuugca

SEQ ID NO: 181246 - RNA, 20 nt, Human
gcugccccaucccugaggca

SEQ ID NO: 181247 - RNA, 26 nt, Human
gcugccccauccucagccccgaguca

SEQ ID NO: 181248 - RNA, 32 nt, Human
gcugccccaucuugccugcuguuccaguucug

SEQ ID NO: 181249 - RNA, 32 nt, Human
gcugcccccaacaugagucggcugucuaggac

SEQ ID NO: 181250 - RNA, 21 nt, Human
gcugcccccagcacugacucu

SEQ ID NO: 181251 - RNA, 19 nt, Human
gcugcccccagccccggcc

SEQ ID NO: 181252 - RNA, 20 nt, Human
gcugcccccgccuggcguca

SEQ ID NO: 181253 - RNA, 20 nt, Human
gcugcccccggacccgggca

SEQ ID NO: 181254 - RNA, 32 nt, Human
gcugcccccuacacgccacccuaggcaccucu

SEQ ID NO: 181255 - RNA, 32 nt, Human
gcugcccccugcccucucucuggggcuauuug

SEQ ID NO: 181256 - RNA, 32 nt, Human
gcugcccccugccuccccacccuccccauggc

SEQ ID NO: 181257 - RNA, 21 nt, Human
gcugccccgcgcccgcugcug

SEQ ID NO: 181258 - RNA, 24 nt, Human
gcugccccgcuuccugguggccag

SEQ ID NO: 181259 - RNA, 32 nt, Human
gcugccccggggaggguggaaggccaggcgug

SEQ ID NO: 181260 - RNA, 32 nt, Human
gcugccccgucugccauucaccaggaaaaauu

SEQ ID NO: 181261 - RNA, 23 nt, Human
gcugccccgugcccuccuuccca

SEQ ID NO: 181262 - RNA, 21 nt, Human
gcugccccgugggcugugcca

SEQ ID NO: 181263 - RNA, 32 nt, Human
gcugccccuaguccugggcaugguggcaaaca

SEQ ID NO: 181264 - RNA, 32 nt, Human
gcugccccucaagggaccuguuaccuucagcg

SEQ ID NO: 181265 - RNA, 32 nt, Human
gcugccccucauuuaucacucugaccuucaca

SEQ ID NO: 181266 - RNA, 32 nt, Human
gcugccccuccccaucuccaugcccucuccuu

SEQ ID NO: 181267 - RNA, 32 nt, Human
gcugccccuccccuccggcccucuccacugcu

SEQ ID NO: 181268 - RNA, 19 nt, Human
gcugccccucccucaggga

SEQ ID NO: 181269 - RNA, 32 nt, Human
gcugccccucccucucucucccucucucuccc

SEQ ID NO: 181270 - RNA, 32 nt, Human
gcugccccucgaggcccuuucccugaccuagg

SEQ ID NO: 181271 - RNA, 32 nt, Human
gcugccccucuccucacuacuuccucucugau

SEQ ID NO: 181272 - RNA, 24 nt, Human
gcugccccucucuggccuggccgg

SEQ ID NO: 181273 - RNA, 17 nt, Human
gcugccccugaguucug

SEQ ID NO: 181274 - RNA, 32 nt, Human
gcugccccugccacuccaggcacagcggcacg

SEQ ID NO: 181275 - RNA, 32 nt, Human
gcugccccugcucugucccgggacccccuggc

SEQ ID NO: 181276 - RNA, 32 nt, Human
gcugccccuggaggagcagcagcucugggccg

SEQ ID NO: 181277 - RNA, 32 nt, Human
gcugccccuuccacaccccaucuugcucuaau

SEQ ID NO: 181278 - RNA, 32 nt, Human
gcugccccuucccugccuaacccuuuccuguc

SEQ ID NO: 181279 - RNA, 18 nt, Human
gcugccccuucccuggua

SEQ ID NO: 181280 - RNA, 32 nt, Human
gcugcccgacacugcccuuuagcugcagagcu

SEQ ID NO: 181281 - RNA, 31 nt, Human
gcugcccgacuuuucugaccaugugcggagc

SEQ ID NO: 181282 - RNA, 32 nt, Human
gcugcccgagagguuaagguggcuucuguggc

SEQ ID NO: 181283 - RNA, 32 nt, Human
gcugcccgcagaagcggcacugugcuggcggg

SEQ ID NO: 181284 - RNA, 32 nt, Human
gcugcccgccaccaugugaauucaucagcucu

SEQ ID NO: 181285 - RNA, 23 nt, Human
gcugcccgccagcuguuugugcu

SEQ ID NO: 181286 - RNA, 32 nt, Human
gcugcccgccauggccaccgcccagccgucgc

SEQ ID NO: 181287 - RNA, 31 nt, Human
gcugcccgcccaccugggccugguccuagcc

SEQ ID NO: 181288 - RNA, 19 nt, Human
gcugcccgccgcgcugccu

SEQ ID NO: 181289 - RNA, 18 nt, Human
gcugcccgcgcggucgcc

SEQ ID NO: 181290 - RNA, 24 nt, Human
gcugcccgcgcugcgcuguugcuc

SEQ ID NO: 181291 - RNA, 32 nt, Human
gcugcccgcucacuccaguagucagcaagucc

SEQ ID NO: 181292 - RNA, 32 nt, Human
gcugcccggaaagaaccauuugggagagccca

SEQ ID NO: 181293 - RNA, 19 nt, Human
gcugcccggacuggcgcca

SEQ ID NO: 181294 - RNA, 32 nt, Human
gcugcccggcagccuccccucgcucgcucucc

SEQ ID NO: 181295 - RNA, 18 nt, Human
gcugcccggccggagcca

SEQ ID NO: 181296 - RNA, 19 nt, Human
gcugcccggccuugcguca

SEQ ID NO: 181297 - RNA, 32 nt, Human
gcugcccggcggacaggcgugaagagcaaggg

SEQ ID NO: 181298 - RNA, 32 nt, Human
gcugcccggcuggaacugggggugcucggcag

SEQ ID NO: 181299 - RNA, 32 nt, Human
gcugcccgggagggcuuccuggacacgcuggu

SEQ ID NO: 181300 - RNA, 32 nt, Human
gcugcccggggugggagggagggugacgggcc

SEQ ID NO: 181301 - RNA, 32 nt, Human
gcugcccgucaauaaucccagcuacucgggag

SEQ ID NO: 181302 - RNA, 32 nt, Human
gcugcccguugcccaggccacccuccaccccc

SEQ ID NO: 181303 - RNA, 19 nt, Human
gcugcccuaagcugcacca

SEQ ID NO: 181304 - RNA, 32 nt, Human
gcugcccuaagcugcaccagcgcuuugccaag

SEQ ID NO: 181305 - RNA, 21 nt, Human
gcugcccuacuggacagccca

SEQ ID NO: 181306 - RNA, 20 nt, Human
gcugcccuagugaggcccca

SEQ ID NO: 181307 - RNA, 28 nt, Human
gcugcccucagcuccgccucaucagcua

SEQ ID NO: 181308 - RNA, 32 nt, Human
gcugcccuccaaccuccugggauucaugcaga

SEQ ID NO: 181309 - RNA, 32 nt, Human
gcugcccuccacccucacccuccacccuuugc

SEQ ID NO: 181310 - RNA, 20 nt, Human
gcugcccuccccuacuucuc

SEQ ID NO: 181311 - RNA, 32 nt, Human
gcugcccuccuggaacugcuguacugggucca

SEQ ID NO: 181312 - RNA, 32 nt, Human
gcugcccucuccccagccuggcguggcugggg

SEQ ID NO: 181313 - RNA, 19 nt, Human
gcugcccucugcuggcgcc

SEQ ID NO: 181314 - RNA, 22 nt, Human
gcugcccugaagaauggcgcca

SEQ ID NO: 181315 - RNA, 21 nt, Human
gcugcccugaagaccacccca

SEQ ID NO: 181316 - RNA, 22 nt, Human
gcugcccugaagugguucucca

SEQ ID NO: 181317 - RNA, 32 nt, Human
gcugcccugacucaaccccagccuggggcuuu

SEQ ID NO: 181318 - RNA, 19 nt, Human
gcugcccugagccaacgcc

SEQ ID NO: 181319 - RNA, 20 nt, Human
gcugcccugagggaaacgcc

SEQ ID NO: 181320 - RNA, 21 nt, Human
gcugcccugaggggaaacgcc

SEQ ID NO: 181321 - RNA, 20 nt, Human
gcugcccugagugaaacgcc

SEQ ID NO: 181322 - RNA, 32 nt, Human
gcugcccugagugcccgggaaaggcuucgcag

SEQ ID NO: 181323 - RNA, 32 nt, Human
gcugcccugcacuccugccucccagcccacag

SEQ ID NO: 181324 - RNA, 20 nt, Human
gcugcccugccaaaggagac

SEQ ID NO: 181325 - RNA, 21 nt, Human
gcugcccugcccuggcaucca

SEQ ID NO: 181326 - RNA, 17 nt, Human
gcugcccugcuccuggu

SEQ ID NO: 181327 - RNA, 20 nt, Human
gcugcccugcugcggcacca

SEQ ID NO: 181328 - RNA, 32 nt, Human
gcugcccugcugucacuucccgucgugaugau

SEQ ID NO: 181329 - RNA, 32 nt, Human
gcugcccuggacaagacuugaggcccgagccc

SEQ ID NO: 181330 - RNA, 24 nt, Human
gcugcccuggaccccgcaagccca

SEQ ID NO: 181331 - RNA, 32 nt, Human
gcugcccuggaccccucuauuuauuucccuuc

SEQ ID NO: 181332 - RNA, 32 nt, Human
gcugcccuggagcagauccaaacagcaaagac

SEQ ID NO: 181333 - RNA, 23 nt, Human
gcugcccuggccuugagcaucca

SEQ ID NO: 181334 - RNA, 19 nt, Human
gcugcccuggcgggggcca

SEQ ID NO: 181335 - RNA, 19 nt, Human
gcugcccuggcugggcgcc

SEQ ID NO: 181336 - RNA, 22 nt, Human
gcugcccugggcaccuggcacc

SEQ ID NO: 181337 - RNA, 32 nt, Human
gcugcccuggggacaggaaggagcaggagcua

SEQ ID NO: 181338 - RNA, 16 nt, Human
gcugcccuggguccag

SEQ ID NO: 181339 - RNA, 32 nt, Human
gcugcccugggucuuuggcugccuguguccuc

SEQ ID NO: 181340 - RNA, 32 nt, Human
gcugcccugguaaccagucucuagcuagugcc

SEQ ID NO: 181341 - RNA, 23 nt, Human
gcugcccuguccuggugguacca

SEQ ID NO: 181342 - RNA, 19 nt, Human
gcugcccugugccugguga

SEQ ID NO: 181343 - RNA, 32 nt, Human
gcugcccugugcuagcgccugccugugugaau

SEQ ID NO: 181344 - RNA, 32 nt, Human
gcugcccuuccaaggagcuucugcugcugcuc

SEQ ID NO: 181345 - RNA, 19 nt, Human
gcugcccuugaguccccug

SEQ ID NO: 181346 - RNA, 32 nt, Human
gcugcccuuuccucuucugucaucucaccgcc

SEQ ID NO: 181347 - RNA, 32 nt, Human
gcugccgacaggacagggcuggggagcggccu

SEQ ID NO: 181348 - RNA, 32 nt, Human
gcugccgacaugcccacccagcucgagauggc

SEQ ID NO: 181349 - RNA, 32 nt, Human
gcugccgacgcugggccagcacccucuccacc

SEQ ID NO: 181350 - RNA, 20 nt, Human
gcugccgacggcgggggcug

SEQ ID NO: 181351 - RNA, 32 nt, Human
gcugccgacugugcaugacugcucugaacguc

SEQ ID NO: 181352 - RNA, 32 nt, Human
gcugccgauuccuuccaagcuuuuggaguuuc

SEQ ID NO: 181353 - RNA, 32 nt, Human
gcugccgcagccgccgcgagccuccggacaga

SEQ ID NO: 181354 - RNA, 32 nt, Human
gcugccgcagggcacugaaagcccaggaccag

SEQ ID NO: 181355 - RNA, 20 nt, Human
gcugccgcauguacaagccc

SEQ ID NO: 181356 - RNA, 25 nt, Human
gcugccgccaccgccgugccgccgc

SEQ ID NO: 181357 - RNA, 21 nt, Human
gcugccgccagcccuauugcu

SEQ ID NO: 181358 - RNA, 32 nt, Human
gcugccgccaggaccagagcaguggugacgug

SEQ ID NO: 181359 - RNA, 32 nt, Human
gcugccgccaggagcugucaccaugacggggg

SEQ ID NO: 181360 - RNA, 25 nt, Human
gcugccgcccgccucgccgccccac

SEQ ID NO: 181361 - RNA, 20 nt, Human
gcugccgccgacugcagccc

SEQ ID NO: 181362 - RNA, 27 nt, Human
gcugccgccgccaccgcccucggccgc

SEQ ID NO: 181363 - RNA, 23 nt, Human
gcugccgccgccaccgccgccgc

SEQ ID NO: 181364 - RNA, 23 nt, Human
gcugccgccgccauggcugccau

SEQ ID NO: 181365 - RNA, 25 nt, Human
gcugccgccgcccaggagccgccgc

SEQ ID NO: 181366 - RNA, 27 nt, Human
gcugccgccgccgagcuccgccgccgc

SEQ ID NO: 181367 - RNA, 23 nt, Human
gcugccgccgccgccaccaccau

SEQ ID NO: 181368 - RNA, 23 nt, Human
gcugccgccgccgccgacgccgc

SEQ ID NO: 181369 - RNA, 18 nt, Human
gcugccgccgccgccgcc

SEQ ID NO: 181370 - RNA, 23 nt, Human
gcugccgccgccgccgcccccuc

SEQ ID NO: 181371 - RNA, 19 nt, Human
gcugccgccgccgccgccg

SEQ ID NO: 181372 - RNA, 28 nt, Human
gcugccgccgccgccgccgaggucccgc

SEQ ID NO: 181373 - RNA, 23 nt, Human
gcugccgccgccgccgccgccac

SEQ ID NO: 181374 - RNA, 24 nt, Human
gcugccgccgccgccgccgcccgc

SEQ ID NO: 181375 - RNA, 22 nt, Human
gcugccgccgccgccgccgccg

SEQ ID NO: 181376 - RNA, 23 nt, Human
gcugccgccgccgccgccgccgc

SEQ ID NO: 181377 - RNA, 23 nt, Human
gcugccgccgccgccgccgcgac

SEQ ID NO: 181378 - RNA, 22 nt, Human
gcugccgccgccgccgccucgc

SEQ ID NO: 181379 - RNA, 21 nt, Human
gcugccgccgccgccgcggcc

SEQ ID NO: 181380 - RNA, 23 nt, Human
gcugccgccgccgcgggagccgc

SEQ ID NO: 181381 - RNA, 23 nt, Human
gcugccgccgccgcuaccgccac

SEQ ID NO: 181382 - RNA, 20 nt, Human
gcugccgccgccgcugcuac

SEQ ID NO: 181383 - RNA, 23 nt, Human
gcugccgccgccgcugcugccgc

SEQ ID NO: 181384 - RNA, 20 nt, Human
gcugccgccgccggauccca

SEQ ID NO: 181385 - RNA, 23 nt, Human
gcugccgccgccgucgccgccac

SEQ ID NO: 181386 - RNA, 22 nt, Human
gcugccgccgcugccgccgccg

SEQ ID NO: 181387 - RNA, 21 nt, Human
gcugccgccggccucagccca

SEQ ID NO: 181388 - RNA, 23 nt, Human
gcugccgcggcccccaccgccac

SEQ ID NO: 181389 - RNA, 32 nt, Human
gcugccgcguucccuggcugguuccagcuguc

SEQ ID NO: 181390 - RNA, 32 nt, Human
gcugccgcugaggagagguaggguggagcggg

SEQ ID NO: 181391 - RNA, 20 nt, Human
gcugccgcugccgccgccgc

SEQ ID NO: 181392 - RNA, 32 nt, Human
gcugccgcugcucucccaggugaaauccacac

SEQ ID NO: 181393 - RNA, 32 nt, Human
gcugccgcuggcugagagaccaugaagaaagu

SEQ ID NO: 181394 - RNA, 32 nt, Human
gcugccgcugucaucuugagguuccagguagu

SEQ ID NO: 181395 - RNA, 23 nt, Human
gcugccgcuguugccgccgccgc

SEQ ID NO: 181396 - RNA, 32 nt, Human
gcugccggagagaaggggaggaggacuccagc

SEQ ID NO: 181397 - RNA, 32 nt, Human
gcugccggaggugguggcugcacagaggacgc

SEQ ID NO: 181398 - RNA, 18 nt, Human
gcugccggccgcugcgcc

SEQ ID NO: 181399 - RNA, 22 nt, Human
gcugccggccgggacucgggca

SEQ ID NO: 181400 - RNA, 23 nt, Human
gcugccggcggcccacgagccca

SEQ ID NO: 181401 - RNA, 32 nt, Human
gcugccggcugcccagccuggcuggcaccaug

SEQ ID NO: 181402 - RNA, 32 nt, Human
gcugccggcuggcugcuacccgcccgcgccag

SEQ ID NO: 181403 - RNA, 32 nt, Human
gcugccggcuucauuuauuccugcugauggcu

SEQ ID NO: 181404 - RNA, 32 nt, Human
gcugccgggaaggccaagaagcagguguucua

SEQ ID NO: 181405 - RNA, 32 nt, Human
gcugccgggagcccugaaucaccgccuggccc

SEQ ID NO: 181406 - RNA, 32 nt, Human
gcugccgggaggcgggagggagugcccugaaa

SEQ ID NO: 181407 - RNA, 32 nt, Human
gcugccgucauccaggcuggacaguucaguga

SEQ ID NO: 181408 - RNA, 32 nt, Human
gcugccguccccgcgugugaggcacagaaggg

SEQ ID NO: 181409 - RNA, 32 nt, Human
gcugccguccuucucuugcacugccuucugcg

SEQ ID NO: 181410 - RNA, 20 nt, Human
gcugccgucgccgccgccac

SEQ ID NO: 181411 - RNA, 20 nt, Human
gcugccgucgccgccgccau

SEQ ID NO: 181412 - RNA, 32 nt, Human
gcugccgugcaguucuugccucccucacgggg

SEQ ID NO: 181413 - RNA, 25 nt, Human
gcugccgugucgccgccgccgccgc

SEQ ID NO: 181414 - RNA, 32 nt, Human
gcugccgugugcgugugcgucagggcucuccg

SEQ ID NO: 181415 - RNA, 32 nt, Human
gcugccuaaaguuaaaggacuuggggaaaguc

SEQ ID NO: 181416 - RNA, 32 nt, Human
gcugccuaaggaaggccagcaugccuccaagg

SEQ ID NO: 181417 - RNA, 32 nt, Human
gcugccuacuuucugcccggaucucuggcucc

SEQ ID NO: 181418 - RNA, 32 nt, Human
gcugccuaggccuggagggaagcccaaggcua

SEQ ID NO: 181419 - RNA, 32 nt, Human
gcugccuaggcugagugcaguggugugaucga

SEQ ID NO: 181420 - RNA, 32 nt, Human
gcugccuaguacuauacaagaagcucuacuuu

SEQ ID NO: 181421 - RNA, 32 nt, Human
gcugccuaucucugucuaccucaggucugacu

SEQ ID NO: 181422 - RNA, 32 nt, Human
gcugccuaugcguccccagccugggcugacag

SEQ ID NO: 181423 - RNA, 32 nt, Human
gcugccucacauugggccucagcagcucccca

SEQ ID NO: 181424 - RNA, 32 nt, Human
gcugccucacccaggugaguggaauuggccuu

SEQ ID NO: 181425 - RNA, 32 nt, Human
gcugccucagcaggucauuuggcuucugagau

SEQ ID NO: 181426 - RNA, 32 nt, Human
gcugccucagccaagcugagccucucaacugg

SEQ ID NO: 181427 - RNA, 32 nt, Human
gcugccucagccaguggcacaggagacuccaa

SEQ ID NO: 181428 - RNA, 32 nt, Human
gcugccucagcgugcuaaucaauggcugcaga

SEQ ID NO: 181429 - RNA, 32 nt, Human
gcugccuccacagacugcugucuccuuguccu

SEQ ID NO: 181430 - RNA, 32 nt, Human
gcugccuccaccucacuguccccagccugccu

SEQ ID NO: 181431 - RNA, 20 nt, Human
gcugccuccacuccugccuc

SEQ ID NO: 181432 - RNA, 32 nt, Human
gcugccuccagccccagcaacccggccgcccu

SEQ ID NO: 181433 - RNA, 17 nt, Human
gcugccuccagccucug

SEQ ID NO: 181434 - RNA, 18 nt, Human
gcugccuccagcugccca

SEQ ID NO: 181435 - RNA, 32 nt, Human
gcugccuccagcugcccaccacaggccugccc

SEQ ID NO: 181436 - RNA, 25 nt, Human
gcugccuccagggggcaccaaggca

SEQ ID NO: 181437 - RNA, 32 nt, Human
gcugccucccaccuugccugggugauggugaa

SEQ ID NO: 181438 - RNA, 32 nt, Human
gcugccucccaggcugcugggacugggcuggu

SEQ ID NO: 181439 - RNA, 19 nt, Human
gcugccuccccauuuccuc

SEQ ID NO: 181440 - RNA, 20 nt, Human
gcugccuccccgcccccgcc

SEQ ID NO: 181441 - RNA, 22 nt, Human
gcugccuccccuaaauugacuc

SEQ ID NO: 181442 - RNA, 21 nt, Human
gcugccuccccugugacucug

SEQ ID NO: 181443 - RNA, 32 nt, Human
gcugccuccguggucccugccuggcugaggug

SEQ ID NO: 181444 - RNA, 32 nt, Human
gcugccuccuccacucagcauuccauggacca

SEQ ID NO: 181445 - RNA, 32 nt, Human
gcugccuccuccuccuccuccucugaggacag

SEQ ID NO: 181446 - RNA, 32 nt, Human
gcugccuccucugggcccucuccuucgucugg

SEQ ID NO: 181447 - RNA, 32 nt, Human
gcugccuccugccuuuucuuuuguaaagacaa

SEQ ID NO: 181448 - RNA, 32 nt, Human
gcugccuccuuuuaccuucugauaccuggaaa

SEQ ID NO: 181449 - RNA, 18 nt, Human
gcugccucgacacagcac

SEQ ID NO: 181450 - RNA, 32 nt, Human
gcugccucggugucccugucgggcuucccagc

SEQ ID NO: 181451 - RNA, 32 nt, Human
gcugccucuaccacagccuccugcccaccagc

SEQ ID NO: 181452 - RNA, 32 nt, Human
gcugccucucaaagcugauucacuggaggaag

SEQ ID NO: 181453 - RNA, 32 nt, Human
gcugccucucaucuccacccacugacugcaga

SEQ ID NO: 181454 - RNA, 24 nt, Human
gcugccucucccaccacaagccca

SEQ ID NO: 181455 - RNA, 25 nt, Human
gcugccucuccuauuaucuauuauc

SEQ ID NO: 181456 - RNA, 32 nt, Human
gcugccucuccuccugcugucucugcuggugg

SEQ ID NO: 181457 - RNA, 32 nt, Human
gcugccucuccucgaaaagucaucuucucgcg

SEQ ID NO: 181458 - RNA, 32 nt, Human
gcugccucuccucucuguguugucugggcccu

SEQ ID NO: 181459 - RNA, 32 nt, Human
gcugccucuccucuggauuggucucaggcucu

SEQ ID NO: 181460 - RNA, 32 nt, Human
gcugccucucucucugaagcauggcucaggug

SEQ ID NO: 181461 - RNA, 17 nt, Human
gcugccucucuuguccu

SEQ ID NO: 181462 - RNA, 20 nt, Human
gcugccucugaaauagcgcc

SEQ ID NO: 181463 - RNA, 19 nt, Human
gcugccucugaaggcacca

SEQ ID NO: 181464 - RNA, 19 nt, Human
gcugccucugccacugacu

SEQ ID NO: 181465 - RNA, 32 nt, Human
gcugccucugcuccuugccauuggaguucagc

SEQ ID NO: 181466 - RNA, 32 nt, Human
gcugccucuggcuuuauucuuuuugcuuagga

SEQ ID NO: 181467 - RNA, 32 nt, Human
gcugccucugggaaggaagaaacaggagcuag

SEQ ID NO: 181468 - RNA, 32 nt, Human
gcugccucuucaaguugacugcaguccaucac

SEQ ID NO: 181469 - RNA, 32 nt, Human
gcugccucuucaggaaccggagcucauuacug

SEQ ID NO: 181470 - RNA, 32 nt, Human
gcugccucuucccagccucaucacugcagugc

SEQ ID NO: 181471 - RNA, 19 nt, Human
gcugccucuuccugaggca

SEQ ID NO: 181472 - RNA, 32 nt, Human
gcugccucuuccuuccccuccucccuguugcc

SEQ ID NO: 181473 - RNA, 22 nt, Human
gcugccugaaacagccaugucc

SEQ ID NO: 181474 - RNA, 21 nt, Human
gcugccugacccccagcacaa

SEQ ID NO: 181475 - RNA, 32 nt, Human
gcugccugacuugccguccaccucucagcccc

SEQ ID NO: 181476 - RNA, 32 nt, Human
gcugccugauuucucauuucucgaagcacaca

SEQ ID NO: 181477 - RNA, 32 nt, Human
gcugccugccaggggagaccugggaccuggac

SEQ ID NO: 181478 - RNA, 32 nt, Human
gcugccugcccgaggcugguccugaaggccug

SEQ ID NO: 181479 - RNA, 18 nt, Human
gcugccugcccugcucca

SEQ ID NO: 181480 - RNA, 24 nt, Human
gcugccugccgccgccgccuccac

SEQ ID NO: 181481 - RNA, 32 nt, Human
gcugccugccugucugucucuccaucuguuug

SEQ ID NO: 181482 - RNA, 22 nt, Human
gcugccugcgcgccccggggcg

SEQ ID NO: 181483 - RNA, 32 nt, Human
gcugccugcuccagacauuuuguucuugaauc

SEQ ID NO: 181484 - RNA, 32 nt, Human
gcugccugcuccaugugucuuaugagagcccg

SEQ ID NO: 181485 - RNA, 32 nt, Human
gcugccugcucuaugcccugagaccccacugc

SEQ ID NO: 181486 - RNA, 18 nt, Human
gcugccugcuguccuccc

SEQ ID NO: 181487 - RNA, 32 nt, Human
gcugccuggagaaaggauggcagccucagggc

SEQ ID NO: 181488 - RNA, 32 nt, Human
gcugccuggcugccucaguuugcagaugugac

SEQ ID NO: 181489 - RNA, 32 nt, Human
gcugccugggacaggcuccugaggaggauuga

SEQ ID NO: 181490 - RNA, 25 nt, Human
gcugccugggcaccucucugaggca

SEQ ID NO: 181491 - RNA, 32 nt, Human
gcugccugggccccgauuccagcauggggcau

SEQ ID NO: 181492 - RNA, 20 nt, Human
gcugccuggggagcuggcca

SEQ ID NO: 181493 - RNA, 32 nt, Human
gcugccuggggcccaaguugcagugagcaggg

SEQ ID NO: 181494 - RNA, 32 nt, Human
gcugccuggggcuggcccugcucagacaaauc

SEQ ID NO: 181495 - RNA, 32 nt, Human
gcugccugguccucagcagugcagccccggcg

SEQ ID NO: 181496 - RNA, 27 nt, Human
gcugccugguguucccccucagcagca

SEQ ID NO: 181497 - RNA, 18 nt, Human
gcugccuguagcugcgcc

SEQ ID NO: 181498 - RNA, 32 nt, Human
gcugccuguagucccagcuacucagaaggccg

SEQ ID NO: 181499 - RNA, 32 nt, Human
gcugccugucaccacuguggccucuccaagcg

SEQ ID NO: 181500 - RNA, 32 nt, Human
gcugccuguccccaugcuuaacauacccgccu

SEQ ID NO: 181501 - RNA, 32 nt, Human
gcugccugucugucugucacucucuaucugcc

SEQ ID NO: 181502 - RNA, 32 nt, Human
gcugccugugugacuuuggggcucccucugcc

SEQ ID NO: 181503 - RNA, 32 nt, Human
gcugccuguugugaaugucccugcugcaaagu

SEQ ID NO: 181504 - RNA, 32 nt, Human
gcugccuucaaggacuguuucagugugaguca

SEQ ID NO: 181505 - RNA, 32 nt, Human
gcugccuucacuccuuucugaccaagcaacgc

SEQ ID NO: 181506 - RNA, 32 nt, Human
gcugccuuccacugccaucgggucuccucucc

SEQ ID NO: 181507 - RNA, 32 nt, Human
gcugccuuccccaagcauccagccuggggaug

SEQ ID NO: 181508 - RNA, 21 nt, Human
gcugccuuccuggccagccag

SEQ ID NO: 181509 - RNA, 32 nt, Human
gcugccuucucaaggaguccacagucuggagg

SEQ ID NO: 181510 - RNA, 32 nt, Human
gcugccuucucccuguccuccuccuggauugu

SEQ ID NO: 181511 - RNA, 32 nt, Human
gcugccuuggauggccucaggccagguaaccc

SEQ ID NO: 181512 - RNA, 26 nt, Human
gcugccuuggccguauuuggcaccca

SEQ ID NO: 181513 - RNA, 32 nt, Human
gcugccuugggaacugcaucuccugggcuggu

SEQ ID NO: 181514 - RNA, 32 nt, Human
gcugccuuuaagaauaccaugaauguaagaaa

SEQ ID NO: 181515 - RNA, 32 nt, Human
gcugccuuuccccagggaauccucuccagauc

SEQ ID NO: 181516 - RNA, 32 nt, Human
gcugccuuucugguuccaucuccuugggugug

SEQ ID NO: 181517 - RNA, 32 nt, Human
gcugccuuugcaaggacuacugggcuucccaa

SEQ ID NO: 181518 - RNA, 32 nt, Human
gcugccuuugccccacugccuccccuguucug

SEQ ID NO: 181519 - RNA, 32 nt, Human
gcugccuuuggacauaacuaagccaggaaacu

SEQ ID NO: 181520 - RNA, 32 nt, Human
gcugccuuuguaacugcauggaaacuuuucac

SEQ ID NO: 181521 - RNA, 32 nt, Human
gcugccuuuucaggaacccgaauuugggaagu

SEQ ID NO: 181522 - RNA, 22 nt, Human
gcugcgaauccugccugcucug

SEQ ID NO: 181523 - RNA, 32 nt, Human
gcugcgaaugucccugagucaacaccaauaga

SEQ ID NO: 181524 - RNA, 32 nt, Human
gcugcgagagccugugcuuaaguaagaaucag

SEQ ID NO: 181525 - RNA, 32 nt, Human
gcugcgagcacaugauggcgauacgggagcuc

SEQ ID NO: 181526 - RNA, 32 nt, Human
gcugcgagccugacagacaugggaggcucugc

SEQ ID NO: 181527 - RNA, 32 nt, Human
gcugcgagcucucuguggugcuggcagcgaca

SEQ ID NO: 181528 - RNA, 32 nt, Human
gcugcgaggagcccuccagacgucgccgagcg

SEQ ID NO: 181529 - RNA, 31 nt, Human
gcugcgagggcaugggagugaucucaccaac

SEQ ID NO: 181530 - RNA, 32 nt, Human
gcugcgaggucaggcuguaaccgggucaaugu

SEQ ID NO: 181531 - RNA, 25 nt, Human
gcugcgaggugggggacccugggca

SEQ ID NO: 181532 - RNA, 32 nt, Human
gcugcgaggugggggacccugggcaggaagcu

SEQ ID NO: 181533 - RNA, 19 nt, Human
gcugcgcaauuacuacuau

SEQ ID NO: 181534 - RNA, 32 nt, Human
gcugcgcaccugcugggugacuuggccaggau

SEQ ID NO: 181535 - RNA, 32 nt, Human
gcugcgcagcgcuccacucggccggcagcgga

SEQ ID NO: 181536 - RNA, 32 nt, Human
gcugcgcccacaggaaguccagucccgacagu

SEQ ID NO: 181537 - RNA, 32 nt, Human
gcugcgcccccagcuucucucucccugucaca

SEQ ID NO: 181538 - RNA, 32 nt, Human
gcugcgcccggcuccuccccucccaggccccg

SEQ ID NO: 181539 - RNA, 19 nt, Human
gcugcgccgccaggcccca

SEQ ID NO: 181540 - RNA, 21 nt, Human
gcugcgccgccggccgcugca

SEQ ID NO: 181541 - RNA, 22 nt, Human
gcugcgccgccuccgaccccag

SEQ ID NO: 181542 - RNA, 24 nt, Human
gcugcgccgcggggccggccccag

SEQ ID NO: 181543 - RNA, 22 nt, Human
gcugcgccgcuucccgccgcag

SEQ ID NO: 181544 - RNA, 32 nt, Human
gcugcgccguagugggaggccacggcgauuac

SEQ ID NO: 181545 - RNA, 32 nt, Human
gcugcgccuaggcuggagcuggaagggugggu

SEQ ID NO: 181546 - RNA, 32 nt, Human
gcugcgccuccaggcuggaccagcaguuccag

SEQ ID NO: 181547 - RNA, 32 nt, Human
gcugcgccugcucaacuucauccugcauguac

SEQ ID NO: 181548 - RNA, 32 nt, Human
gcugcgccuuccucacgugugugaaagguuuu

SEQ ID NO: 181549 - RNA, 32 nt, Human
gcugcgcgcacaccuucagcuccaugucgccc

SEQ ID NO: 181550 - RNA, 32 nt, Human
gcugcgcgcaggcugggcugcaggcucucggc

SEQ ID NO: 181551 - RNA, 32 nt, Human
gcugcgcgcuccucaugacaaucuaaugccug

SEQ ID NO: 181552 - RNA, 32 nt, Human
gcugcgcggagguugcccagccccaguuucuu

SEQ ID NO: 181553 - RNA, 18 nt, Human
gcugcgcgggccccgcca

SEQ ID NO: 181554 - RNA, 32 nt, Human
gcugcgcgguccuauacggucccugcuuagcc

SEQ ID NO: 181555 - RNA, 18 nt, Human
gcugcgcggugcugcgcc

SEQ ID NO: 181556 - RNA, 32 nt, Human
gcugcgcgucguuacuggccacaaguuugcuc

SEQ ID NO: 181557 - RNA, 32 nt, Human
gcugcgcgugugggucucugggcacagugggc

SEQ ID NO: 181558 - RNA, 32 nt, Human
gcugcgcucaguugauaacauaguugauaaua

SEQ ID NO: 181559 - RNA, 32 nt, Human
gcugcgcucuccgccgcgcucuaccuccauua

SEQ ID NO: 181560 - RNA, 32 nt, Human
gcugcgcuggcccccaucaucugcuccaaagc

SEQ ID NO: 181561 - RNA, 32 nt, Human
gcugcgcuugucuccagcuuccagcccuccuc

SEQ ID NO: 181562 - RNA, 32 nt, Human
gcugcggaagaaaaguaggagacuaggagagg

SEQ ID NO: 181563 - RNA, 32 nt, Human
gcugcggaagaacugaagguugcgaugccuua

SEQ ID NO: 181564 - RNA, 32 nt, Human
gcugcggacuacuucagccuaugugaaguagc

SEQ ID NO: 181565 - RNA, 32 nt, Human
gcugcggagagggggagagcaggcagcgggcg

SEQ ID NO: 181566 - RNA, 32 nt, Human
gcugcggaggcaggcugagggcgcaggggcug

SEQ ID NO: 181567 - RNA, 32 nt, Human
gcugcggaggcugcggcccccagaucuuucuc

SEQ ID NO: 181568 - RNA, 32 nt, Human
gcugcggagggcccugcgcgccgcaccacgcg

SEQ ID NO: 181569 - RNA, 23 nt, Human
gcugcggauccagcuggagcucu

SEQ ID NO: 181570 - RNA, 24 nt, Human
gcugcggcagcuucagcuggcaga

SEQ ID NO: 181571 - RNA, 23 nt, Human
gcugcggcaggagaauugcuuga

SEQ ID NO: 181572 - RNA, 21 nt, Human
gcugcggcaggcaacagaagg

SEQ ID NO: 181573 - RNA, 26 nt, Human
gcugcggccaaagaacauggaaaagc

SEQ ID NO: 181574 - RNA, 19 nt, Human
gcugcggccacugcagcag

SEQ ID NO: 181575 - RNA, 32 nt, Human
gcugcggccagggaggugcggagcagcuucgg

SEQ ID NO: 181576 - RNA, 32 nt, Human
gcugcggcccaggagcggcggccgcggagccc

SEQ ID NO: 181577 - RNA, 32 nt, Human
gcugcggcccaggcagccaguccugguggugu

SEQ ID NO: 181578 - RNA, 32 nt, Human
gcugcggccgggagcugcaugggggagcgccg

SEQ ID NO: 181579 - RNA, 19 nt, Human
gcugcggccuugaccuccu

SEQ ID NO: 181580 - RNA, 32 nt, Human
gcugcggcgacaccuacaagaaaaugaagggg

SEQ ID NO: 181581 - RNA, 23 nt, Human
gcugcggcgggagaaucgcuuga

SEQ ID NO: 181582 - RNA, 32 nt, Human
gcugcggcgggagaugcugucgggccgcggcg

SEQ ID NO: 181583 - RNA, 32 nt, Human
gcugcggcuccauccucggcuccugggcaccg

SEQ ID NO: 181584 - RNA, 22 nt, Human
gcugcggcucgaggccacgccc

SEQ ID NO: 181585 - RNA, 32 nt, Human
gcugcggcucuggccucccaggcccauccuca

SEQ ID NO: 181586 - RNA, 32 nt, Human
gcugcggcugcuagcccgaggucuccaagccg

SEQ ID NO: 181587 - RNA, 32 nt, Human
gcugcggcuucuggcugcgcggccugcgcgcg

SEQ ID NO: 181588 - RNA, 32 nt, Human
gcugcgggagcgacgaggcgggcgcggagggc

SEQ ID NO: 181589 - RNA, 32 nt, Human
gcugcgggaggaagugaagccgggaggggcug

SEQ ID NO: 181590 - RNA, 32 nt, Human
gcugcgggaggcagacagccaggacuugaagc

SEQ ID NO: 181591 - RNA, 32 nt, Human
gcugcgggaggcggcggcgguaggaagccgga

SEQ ID NO: 181592 - RNA, 32 nt, Human
gcugcgggaggcggggguuggcgugccugagg

SEQ ID NO: 181593 - RNA, 32 nt, Human
gcugcgggagguagguaccauggccauucagc

SEQ ID NO: 181594 - RNA, 32 nt, Human
gcugcgggccaccaacaugcugggcagcgccu

SEQ ID NO: 181595 - RNA, 32 nt, Human
gcugcggggagaaggggcagaggcucaccucc

SEQ ID NO: 181596 - RNA, 32 nt, Human
gcugcggggcagguguugcagcuugugggcga

SEQ ID NO: 181597 - RNA, 32 nt, Human
gcugcggggcugggacagcacuggcaucucca

SEQ ID NO: 181598 - RNA, 32 nt, Human
gcugcgggggcaggccgggccugcugucaccu

SEQ ID NO: 181599 - RNA, 32 nt, Human
gcugcgggucaucgugggaagggaggcugacu

SEQ ID NO: 181600 - RNA, 32 nt, Human
gcugcggguuccggcgaggccugagcugugcu

SEQ ID NO: 181601 - RNA, 32 nt, Human
gcugcggucugaggccccugcccagcuggaaa

SEQ ID NO: 181602 - RNA, 32 nt, Human
gcugcggugugacaacaugcaccaccaguggc

SEQ ID NO: 181603 - RNA, 32 nt, Human
gcugcgguuggcaccuccuuccucacucccuc

SEQ ID NO: 181604 - RNA, 32 nt, Human
gcugcguaacauccauccugcuacaacucuuc

SEQ ID NO: 181605 - RNA, 32 nt, Human
gcugcguacacggcgaguacaccgcaccugcc

SEQ ID NO: 181606 - RNA, 22 nt, Human
gcugcgucgcuuuaagcacaaa

SEQ ID NO: 181607 - RNA, 32 nt, Human
gcugcgucucugcuguggugucaguuccggau

SEQ ID NO: 181608 - RNA, 32 nt, Human
gcugcgugaccugaacacgucacuuuaccucu

SEQ ID NO: 181609 - RNA, 32 nt, Human
gcugcgugacugucugucucugccaugucucu

SEQ ID NO: 181610 - RNA, 32 nt, Human
gcugcgugcagagcccacugggcacggugguc

SEQ ID NO: 181611 - RNA, 32 nt, Human
gcugcgugcccuuuaagugaucaccucuuagu

SEQ ID NO: 181612 - RNA, 31 nt, Human
gcugcgugccuccgucugccugugugcuggc

SEQ ID NO: 181613 - RNA, 32 nt, Human
gcugcgugcgcugccugcucccgccugaggaa

SEQ ID NO: 181614 - RNA, 32 nt, Human
gcugcgugggaguccccacuucccaggcuauc

SEQ ID NO: 181615 - RNA, 18 nt, Human
gcugcgugggcagggcug

SEQ ID NO: 181616 - RNA, 32 nt, Human
gcugcguggucaccaaccgauucgaccaguua

SEQ ID NO: 181617 - RNA, 28 nt, Human
gcugcguguugauuuggaggcacugcag

SEQ ID NO: 181618 - RNA, 32 nt, Human
gcugcguguuggaugggagugggagggggcug

SEQ ID NO: 181619 - RNA, 32 nt, Human
gcugcguguuuuucauuuuaaacacacaagau

SEQ ID NO: 181620 - RNA, 32 nt, Human
gcugcguuggagcugcagaggcugcggaguga

SEQ ID NO: 181621 - RNA, 32 nt, Human
gcugcguuggggccaccagaaggaaccagccc

SEQ ID NO: 181622 - RNA, 32 nt, Human
gcugcguuuccucugccugcgccgggcaucac

SEQ ID NO: 181623 - RNA, 32 nt, Human
gcugcguuuuucucccaugcacuugcacgucc

SEQ ID NO: 181624 - RNA, 32 nt, Human
gcugcuaaaauagauguuucauuuuucugacu

SEQ ID NO: 181625 - RNA, 32 nt, Human
gcugcuaaauucacacuuucuacuuucauacc

SEQ ID NO: 181626 - RNA, 18 nt, Human
gcugcuaaccuggcacca

SEQ ID NO: 181627 - RNA, 32 nt, Human
gcugcuaaguacuccgguucccagcuucugca

SEQ ID NO: 181628 - RNA, 22 nt, Human
gcugcuaaguagggcuagggca

SEQ ID NO: 181629 - RNA, 21 nt, Human
gcugcuaaguggcugaaggca

SEQ ID NO: 181630 - RNA, 32 nt, Human
gcugcuacaccguguucaucaggaaaggucuu

SEQ ID NO: 181631 - RNA, 20 nt, Human
gcugcuaccccaguuccauc

SEQ ID NO: 181632 - RNA, 20 nt, Human
gcugcuacccgcccgcgcca

SEQ ID NO: 181633 - RNA, 32 nt, Human
gcugcuacccucaggccagggugugcggugga

SEQ ID NO: 181634 - RNA, 32 nt, Human
gcugcuaccgccgccccauccccagggaccac

SEQ ID NO: 181635 - RNA, 21 nt, Human
gcugcuaccucauaauaaauc

SEQ ID NO: 181636 - RNA, 19 nt, Human
gcugcuaccuucuguuauc

SEQ ID NO: 181637 - RNA, 18 nt, Human
gcugcuaccuugcuuuca

SEQ ID NO: 181638 - RNA, 20 nt, Human
gcugcuaccuuucggcagca

SEQ ID NO: 181639 - RNA, 31 nt, Human
gcugcuacucaaaauguccuguugaagaggg

SEQ ID NO: 181640 - RNA, 32 nt, Human
gcugcuagagcuggagcauuugccggucagua

SEQ ID NO: 181641 - RNA, 32 nt, Human
gcugcuagaguccucaauuuuauucuaaucau

SEQ ID NO: 181642 - RNA, 32 nt, Human
gcugcuaugcuguucauugaugacaugggauu

SEQ ID NO: 181643 - RNA, 32 nt, Human
gcugcuauggugcugaguuuccugguagagcc

SEQ ID NO: 181644 - RNA, 32 nt, Human
gcugcuaugguuuucuccaagagcuacauaau

SEQ ID NO: 181645 - RNA, 32 nt, Human
gcugcuauguuaggaguaauuaguuauuuagg

SEQ ID NO: 181646 - RNA, 32 nt, Human
gcugcucaaagcagguuucugagauagcugac

SEQ ID NO: 181647 - RNA, 32 nt, Human
gcugcucacagaacagagaguuucuacauaca

SEQ ID NO: 181648 - RNA, 32 nt, Human
gcugcucaccgcaaccuccgccuuccagguuc

SEQ ID NO: 181649 - RNA, 32 nt, Human
gcugcucaccggauccucagucuuccacaaug

SEQ ID NO: 181650 - RNA, 20 nt, Human
gcugcucaccugagcacaaa

SEQ ID NO: 181651 - RNA, 32 nt, Human
gcugcucacgcccaccaucucccuucuaccca

SEQ ID NO: 181652 - RNA, 32 nt, Human
gcugcucagacccuccagaugagguccagccc

SEQ ID NO: 181653 - RNA, 32 nt, Human
gcugcucagacuccuggguggcuuccagacgg

SEQ ID NO: 181654 - RNA, 32 nt, Human
gcugcucagcagaggauaugggugggagcgaa

SEQ ID NO: 181655 - RNA, 32 nt, Human
gcugcucagccuguuuucucucucauggucug

SEQ ID NO: 181656 - RNA, 32 nt, Human
gcugcucagcuuucucagggaagcaacuccag

SEQ ID NO: 181657 - RNA, 32 nt, Human
gcugcucaggaggugcagacugccccgugcuc

SEQ ID NO: 181658 - RNA, 32 nt, Human
gcugcucagggcccuccuccugaaggugagcc

SEQ ID NO: 181659 - RNA, 18 nt, Human
gcugcucagggcucaggc

SEQ ID NO: 181660 - RNA, 32 nt, Human
gcugcucaggggcuuaauucugccuuuugaug

SEQ ID NO: 181661 - RNA, 32 nt, Human
gcugcucaguugguggagacuggggcugggac

SEQ ID NO: 181662 - RNA, 32 nt, Human
gcugcucauuuucccaugagccuguguauuuu

SEQ ID NO: 181663 - RNA, 22 nt, Human
gcugcuccaaggggcccauggu

SEQ ID NO: 181664 - RNA, 32 nt, Human
gcugcuccaaucaaaacugaaaaugcuuuuaa

SEQ ID NO: 181665 - RNA, 32 nt, Human
gcugcuccagaaggaaccuggguggggagggc

SEQ ID NO: 181666 - RNA, 32 nt, Human
gcugcuccagcccgcgaugaggaaaaguccag

SEQ ID NO: 181667 - RNA, 32 nt, Human
gcugcuccagcugccaacuuugcugcagagcc

SEQ ID NO: 181668 - RNA, 32 nt, Human
gcugcuccaggaacagaggugccaugcagccc

SEQ ID NO: 181669 - RNA, 32 nt, Human
gcugcuccagucucagccugggcagcuucccc

SEQ ID NO: 181670 - RNA, 19 nt, Human
gcugcuccauccuccccug

SEQ ID NO: 181671 - RNA, 32 nt, Human
gcugcuccaugaggucaagacugggucuccuc

SEQ ID NO: 181672 - RNA, 32 nt, Human
gcugcuccauguguaccaagagcagcagggca

SEQ ID NO: 181673 - RNA, 32 nt, Human
gcugcuccauucuacacaggacagcauuucca

SEQ ID NO: 181674 - RNA, 21 nt, Human
gcugcucccacaccugcgcca

SEQ ID NO: 181675 - RNA, 16 nt, Human
gcugcucccagaugac

SEQ ID NO: 181676 - RNA, 32 nt, Human
gcugcucccaggacacugaggccaagagaaau

SEQ ID NO: 181677 - RNA, 32 nt, Human
gcugcucccaggcuggggcugugcugcaggcu

SEQ ID NO: 181678 - RNA, 19 nt, Human
gcugcuccccaaaagccac

SEQ ID NO: 181679 - RNA, 32 nt, Human
gcugcuccccaggacuaugaggccguggcucg

SEQ ID NO: 181680 - RNA, 32 nt, Human
gcugcuccccgagggccacaugcuggacgaca

SEQ ID NO: 181681 - RNA, 32 nt, Human
gcugcuccccuccccagacaccucuccacguc

SEQ ID NO: 181682 - RNA, 32 nt, Human
gcugcuccccuuuuagaauuuaccucuuauga

SEQ ID NO: 181683 - RNA, 32 nt, Human
gcugcucccggccgaagguggggacaggcagu

SEQ ID NO: 181684 - RNA, 32 nt, Human
gcugcucccuccugccugcuauccaaguaucc

SEQ ID NO: 181685 - RNA, 32 nt, Human
gcugcucccuuucucccucucuuccucccucu

SEQ ID NO: 181686 - RNA, 32 nt, Human
gcugcuccgaggacccaggaaaggcaggauug

SEQ ID NO: 181687 - RNA, 22 nt, Human
gcugcuccggguuucugaggca

SEQ ID NO: 181688 - RNA, 32 nt, Human
gcugcuccucagcaggcgccucaccagccucc

SEQ ID NO: 181689 - RNA, 32 nt, Human
gcugcuccuccagggccacgugccaggcccgg

SEQ ID NO: 181690 - RNA, 32 nt, Human
gcugcuccugccguuuucuuccugccaagccu

SEQ ID NO: 181691 - RNA, 32 nt, Human
gcugcuccugcucucugaucuuauugcuuaua

SEQ ID NO: 181692 - RNA, 24 nt, Human
gcugcuccugggaggggcucaggc

SEQ ID NO: 181693 - RNA, 32 nt, Human
gcugcuccuugggaugaugggagaagggggaa

SEQ ID NO: 181694 - RNA, 24 nt, Human
gcugcucggaccgcggccacagcc

SEQ ID NO: 181695 - RNA, 26 nt, Human
gcugcucggggcgccgccgccgccgc

SEQ ID NO: 181696 - RNA, 20 nt, Human
gcugcucggguucugaggca

SEQ ID NO: 181697 - RNA, 32 nt, Human
gcugcucuaagcaccgucccugcccagcccca

SEQ ID NO: 181698 - RNA, 32 nt, Human
gcugcucuaaugggagaagggagcuuugcaaa

SEQ ID NO: 181699 - RNA, 32 nt, Human
gcugcucuacgcgcuggcgcggauggggcacg

SEQ ID NO: 181700 - RNA, 32 nt, Human
gcugcucuaggagcagauacaggcugguauag

SEQ ID NO: 181701 - RNA, 32 nt, Human
gcugcucucagaacuccugagcucaggcaguc

SEQ ID NO: 181702 - RNA, 32 nt, Human
gcugcucucaugccaggaagggagcuuccauu

SEQ ID NO: 181703 - RNA, 32 nt, Human
gcugcucucccagaaaacugguggagccggug

SEQ ID NO: 181704 - RNA, 32 nt, Human
gcugcucucccagggccugggugugcuucgug

SEQ ID NO: 181705 - RNA, 32 nt, Human
gcugcucucucaccugagggucguucucaugu

SEQ ID NO: 181706 - RNA, 32 nt, Human
gcugcucucuccccaucuccuaccccacaucc

SEQ ID NO: 181707 - RNA, 32 nt, Human
gcugcucucugccuccuuuaaauucuugauac

SEQ ID NO: 181708 - RNA, 32 nt, Human
gcugcucucugccugccccaggucuuugggua

SEQ ID NO: 181709 - RNA, 32 nt, Human
gcugcucugacaccauggggagcugcugcagc

SEQ ID NO: 181710 - RNA, 18 nt, Human
gcugcucugagaagugua

SEQ ID NO: 181711 - RNA, 32 nt, Human
gcugcucugagggagagacagugagcugcaag

SEQ ID NO: 181712 - RNA, 32 nt, Human
gcugcucugcagccccaaauggcuccugggcc

SEQ ID NO: 181713 - RNA, 32 nt, Human
gcugcucugccggggucaucuccugggucauc

SEQ ID NO: 181714 - RNA, 32 nt, Human
gcugcucugggaggcuaaggcucaucucucua

SEQ ID NO: 181715 - RNA, 32 nt, Human
gcugcucugggccaggaaaucucucuauggau

SEQ ID NO: 181716 - RNA, 32 nt, Human
gcugcucugggccuccccaccuuuccuggggu

SEQ ID NO: 181717 - RNA, 32 nt, Human
gcugcucuguccacauuccauccaccaaagca

SEQ ID NO: 181718 - RNA, 32 nt, Human
gcugcucugucucgucagggcaaccaaggaga

SEQ ID NO: 181719 - RNA, 21 nt, Human
gcugcucuguggcccagggca

SEQ ID NO: 181720 - RNA, 32 nt, Human
gcugcucuuccagaagggacagugaugccacc

SEQ ID NO: 181721 - RNA, 32 nt, Human
gcugcucuuccagacuggcugugccugccugu

SEQ ID NO: 181722 - RNA, 32 nt, Human
gcugcucuucccucagcucugccggggcucua

SEQ ID NO: 181723 - RNA, 32 nt, Human
gcugcucuugcucucccucccagggcuugagg

SEQ ID NO: 181724 - RNA, 32 nt, Human
gcugcucuugcucuccucgugucugcuguuuu

SEQ ID NO: 181725 - RNA, 32 nt, Human
gcugcucuuggaggagagcagcucccacugug

SEQ ID NO: 181726 - RNA, 32 nt, Human
gcugcucuuggugaugggagaauggggacucu

SEQ ID NO: 181727 - RNA, 32 nt, Human
gcugcucuuucacuucucaggcaucaccgaga

SEQ ID NO: 181728 - RNA, 32 nt, Human
gcugcucuuucacuucucaggcgucaccgaga

SEQ ID NO: 181729 - RNA, 18 nt, Human
gcugcucuuuccacuugc

SEQ ID NO: 181730 - RNA, 32 nt, Human
gcugcucuuugucccacagagcagaaacagcu

SEQ ID NO: 181731 - RNA, 22 nt, Human
gcugcugaaaaugguccaggua

SEQ ID NO: 181732 - RNA, 32 nt, Human
gcugcugaaccagcucaagaaaaccuuccagc

SEQ ID NO: 181733 - RNA, 21 nt, Human
gcugcugaagaaauacaaggu

SEQ ID NO: 181734 - RNA, 32 nt, Human
gcugcugaagaaccagaccaaaaaccugcuuc

SEQ ID NO: 181735 - RNA, 19 nt, Human
gcugcugaaggaggaggca

SEQ ID NO: 181736 - RNA, 22 nt, Human
gcugcugaaggcauggaggaca

SEQ ID NO: 181737 - RNA, 19 nt, Human
gcugcugaaggccgcgagg

SEQ ID NO: 181738 - RNA, 20 nt, Human
gcugcugaaggcgucgaggu

SEQ ID NO: 181739 - RNA, 21 nt, Human
gcugcugaagggacuuguagg

SEQ ID NO: 181740 - RNA, 19 nt, Human
gcugcugaagggagcaugg

SEQ ID NO: 181741 - RNA, 20 nt, Human
gcugcugaagggagcauggu

SEQ ID NO: 181742 - RNA, 19 nt, Human
gcugcugaagggagggggc

SEQ ID NO: 181743 - RNA, 32 nt, Human
gcugcugaagggcgggagaaguugcggcgugg

SEQ ID NO: 181744 - RNA, 23 nt, Human
gcugcugaagguggggccuaggg

SEQ ID NO: 181745 - RNA, 24 nt, Human
gcugcugacagauuaacccaacaa

SEQ ID NO: 181746 - RNA, 32 nt, Human
gcugcugacaugacucuucacugacaguggug

SEQ ID NO: 181747 - RNA, 32 nt, Human
gcugcugaccaacacagcugcucacaguuccu

SEQ ID NO: 181748 - RNA, 21 nt, Human
gcugcugacgagccccaggca

SEQ ID NO: 181749 - RNA, 32 nt, Human
gcugcugacugacuccagccaaggugcaaaga

SEQ ID NO: 181750 - RNA, 32 nt, Human
gcugcugacugauguugagggaacagacagga

SEQ ID NO: 181751 - RNA, 32 nt, Human
gcugcugagaaagagaaugagaagaggcugcu

SEQ ID NO: 181752 - RNA, 18 nt, Human
gcugcugagaacagggca

SEQ ID NO: 181753 - RNA, 25 nt, Human
gcugcugagacugaacauguucaca

SEQ ID NO: 181754 - RNA, 19 nt, Human
gcugcugagagccaacagc

SEQ ID NO: 181755 - RNA, 24 nt, Human
gcugcugagagccuaguccagcag

SEQ ID NO: 181756 - RNA, 32 nt, Human
gcugcugagagcuuccuauagagccccugaca

SEQ ID NO: 181757 - RNA, 32 nt, Human
gcugcugagaggaggaggaggaugaagaguug

SEQ ID NO: 181758 - RNA, 32 nt, Human
gcugcugagccccacgccaagcuggagagcgg

SEQ ID NO: 181759 - RNA, 32 nt, Human
gcugcugagccccaggccaugguccccucucg

SEQ ID NO: 181760 - RNA, 32 nt, Human
gcugcugagccuguccuggcugggccucgggc

SEQ ID NO: 181761 - RNA, 32 nt, Human
gcugcugagcggaccugcugugugcucccucc

SEQ ID NO: 181762 - RNA, 21 nt, Human
gcugcugagcuuccccaagca

SEQ ID NO: 181763 - RNA, 20 nt, Human
gcugcugaggaaggauaggc

SEQ ID NO: 181764 - RNA, 21 nt, Human
gcugcugaggacagcacggca

SEQ ID NO: 181765 - RNA, 22 nt, Human
gcugcugaggagaccuggugca

SEQ ID NO: 181766 - RNA, 18 nt, Human
gcugcugaggagccaggg

SEQ ID NO: 181767 - RNA, 22 nt, Human
gcugcugaggaggcugaaggua

SEQ ID NO: 181768 - RNA, 26 nt, Human
gcugcugaggccacggcuucagggca

SEQ ID NO: 181769 - RNA, 24 nt, Human
gcugcugaggcggaggcugaggca

SEQ ID NO: 181770 - RNA, 20 nt, Human
gcugcugaggggcuagugca

SEQ ID NO: 181771 - RNA, 18 nt, Human
gcugcugagggggugggc

SEQ ID NO: 181772 - RNA, 20 nt, Human
gcugcugaggggucugaggc

SEQ ID NO: 181773 - RNA, 20 nt, Human
gcugcugaggggugagugca

SEQ ID NO: 181774 - RNA, 19 nt, Human
gcugcugagguaucaggca

SEQ ID NO: 181775 - RNA, 32 nt, Human
gcugcugagucacccacccagccuuggagcug

SEQ ID NO: 181776 - RNA, 32 nt, Human
gcugcugagucuccucuucugcuccuagccac

SEQ ID NO: 181777 - RNA, 32 nt, Human
gcugcugaguguccugcagcagcauuucaucc

SEQ ID NO: 181778 - RNA, 32 nt, Human
gcugcugaguguccugcagcagccuuucaucc

SEQ ID NO: 181779 - RNA, 32 nt, Human
gcugcugauagguucaaggaauucuuuaaacc

SEQ ID NO: 181780 - RNA, 19 nt, Human
gcugcugaucacgagggca

SEQ ID NO: 181781 - RNA, 19 nt, Human
gcugcugauccgccaggca

SEQ ID NO: 181782 - RNA, 32 nt, Human
gcugcugaucugaauauggaaaccccaugguu

SEQ ID NO: 181783 - RNA, 32 nt, Human
gcugcugauugugaucaccucucccgaucacc

SEQ ID NO: 181784 - RNA, 32 nt, Human
gcugcugcaagccagagggaggaagggggaga

SEQ ID NO: 181785 - RNA, 32 nt, Human
gcugcugcaaguccuccugggcuuccuucaga

SEQ ID NO: 181786 - RNA, 24 nt, Human
gcugcugcaccgcggggcccaggc

SEQ ID NO: 181787 - RNA, 32 nt, Human
gcugcugcacuccagccugggugacagaguga

SEQ ID NO: 181788 - RNA, 32 nt, Human
gcugcugcacuccccaaccucucccccacccc

SEQ ID NO: 181789 - RNA, 32 nt, Human
gcugcugcagagcuagaaggcccugcagcuac

SEQ ID NO: 181790 - RNA, 32 nt, Human
gcugcugcagcucucgggaaagcugcccagau

SEQ ID NO: 181791 - RNA, 32 nt, Human
gcugcugcagugagugguuccacugccuggau

SEQ ID NO: 181792 - RNA, 32 nt, Human
gcugcugccacucaaacuccagucguggcuaa

SEQ ID NO: 181793 - RNA, 32 nt, Human
gcugcugccaugaggcaccuuggggccuuccu

SEQ ID NO: 181794 - RNA, 32 nt, Human
gcugcugcccacccuccgccgcccgggccccc

SEQ ID NO: 181795 - RNA, 32 nt, Human
gcugcugccccacuacaggccccacaccugcc

SEQ ID NO: 181796 - RNA, 32 nt, Human
gcugcugcccugcuggccccuugugcacggca

SEQ ID NO: 181797 - RNA, 18 nt, Human
gcugcugccgcccagggc

SEQ ID NO: 181798 - RNA, 20 nt, Human
gcugcugccgcugccggguc

SEQ ID NO: 181799 - RNA, 32 nt, Human
gcugcugccugggauccacucauccccuucuu

SEQ ID NO: 181800 - RNA, 32 nt, Human
gcugcugccuggggaaguuuuuccuccccaag

SEQ ID NO: 181801 - RNA, 18 nt, Human
gcugcugcgggccagggc

SEQ ID NO: 181802 - RNA, 32 nt, Human
gcugcugcgggcuccccucaggcucugcuucg

SEQ ID NO: 181803 - RNA, 32 nt, Human
gcugcugcggggccaccaugcuccugcccagg

SEQ ID NO: 181804 - RNA, 20 nt, Human
gcugcugcuacuccaaggca

SEQ ID NO: 181805 - RNA, 32 nt, Human
gcugcugcuagccugcucacgcaugcagcccg

SEQ ID NO: 181806 - RNA, 32 nt, Human
gcugcugcucagaagaacuaagaaggaugggu

SEQ ID NO: 181807 - RNA, 32 nt, Human
gcugcugcucaggcaccugcccaugucgcggc

SEQ ID NO: 181808 - RNA, 32 nt, Human
gcugcugcuccaggaacucgcggucggccggg

SEQ ID NO: 181809 - RNA, 32 nt, Human
gcugcugcuccugcucagcuccugggaccaau

SEQ ID NO: 181810 - RNA, 32 nt, Human
gcugcugcucugcaccuuccucccgucuugcc

SEQ ID NO: 181811 - RNA, 32 nt, Human
gcugcugcugcacucacgcggcugggcuuucu

SEQ ID NO: 181812 - RNA, 32 nt, Human
gcugcugcugcacuccccaaccucucccccac

SEQ ID NO: 181813 - RNA, 32 nt, Human
gcugcugcugccgccagccuagagccgcccgc

SEQ ID NO: 181814 - RNA, 32 nt, Human
gcugcugcugccucuccgaagagcucgcggag

SEQ ID NO: 181815 - RNA, 32 nt, Human
gcugcugcugcugcuacuccugccaacacccc

SEQ ID NO: 181816 - RNA, 32 nt, Human
gcugcugcugcugcugcugccugcggcccggg

SEQ ID NO: 181817 - RNA, 18 nt, Human
gcugcugcuggccaaggc

SEQ ID NO: 181818 - RNA, 32 nt, Human
gcugcugcugucacuccuccaccgagggaggc

SEQ ID NO: 181819 - RNA, 32 nt, Human
gcugcugcugucgccugcgccugcugccccaa

SEQ ID NO: 181820 - RNA, 32 nt, Human
gcugcugcuguuauucaaagaucaaaggagua

SEQ ID NO: 181821 - RNA, 32 nt, Human
gcugcugcuguugcuacuguuugccucaaacg

SEQ ID NO: 181822 - RNA, 31 nt, Human
gcugcugcuguuugauggccugugcucuggg

SEQ ID NO: 181823 - RNA, 32 nt, Human
gcugcugcuucgagauccucccuuuuuaaagc

SEQ ID NO: 181824 - RNA, 32 nt, Human
gcugcugcuuuuccuuuuuacuuccuauuuuc

SEQ ID NO: 181825 - RNA, 23 nt, Human
gcugcuggaacccugccagggca

SEQ ID NO: 181826 - RNA, 32 nt, Human
gcugcuggaacccugcucucagccuggaggcu

SEQ ID NO: 181827 - RNA, 32 nt, Human
gcugcuggaagaaauagaagaaaacaacccac

SEQ ID NO: 181828 - RNA, 30 nt, Human
gcugcuggaagccagccagggcacugcccg

SEQ ID NO: 181829 - RNA, 32 nt, Human
gcugcuggaagucaccuuuggcaagcuguaug

SEQ ID NO: 181830 - RNA, 32 nt, Human
gcugcuggacaagggguaggagcugcuggaac

SEQ ID NO: 181831 - RNA, 32 nt, Human
gcugcuggaccccagaggccacugugaccgcc

SEQ ID NO: 181832 - RNA, 21 nt, Human
gcugcuggagaaauuaaggca

SEQ ID NO: 181833 - RNA, 32 nt, Human
gcugcuggagacagagucagagcagucaaggg

SEQ ID NO: 181834 - RNA, 18 nt, Human
gcugcuggagaggaaggu

SEQ ID NO: 181835 - RNA, 24 nt, Human
gcugcuggagagggagaucaaggc

SEQ ID NO: 181836 - RNA, 32 nt, Human
gcuuccagugccugggccgugccuaggugaug

SEQ ID NO: 181837 - RNA, 18 nt, Human
gcuuccaguuccauggcc

SEQ ID NO: 181838 - RNA, 32 nt, Human
gcuuccaguucccagguguucuuuguuugccu

SEQ ID NO: 181839 - RNA, 32 nt, Human
gcuuccauauucccuggggccagcacaugcaa

SEQ ID NO: 181840 - RNA, 32 nt, Human
gcuuccaucagaaccacugacuuccacaaucc

SEQ ID NO: 181841 - RNA, 32 nt, Human
gcuuccauccacggaaccucaccauggauacg

SEQ ID NO: 181842 - RNA, 32 nt, Human
gcuuccaucccuccuuccuucuuuccuccuac

SEQ ID NO: 181843 - RNA, 32 nt, Human
gcuuccaucucacuaaccacccaccccuaccu

SEQ ID NO: 181844 - RNA, 32 nt, Human
gcuuccaucucccggcugggcacgguggcuca

SEQ ID NO: 181845 - RNA, 32 nt, Human
gcuuccaucuguggugacuggaaugggaccca

SEQ ID NO: 181846 - RNA, 32 nt, Human
gcuuccauucuggauguuuggaacccuuuagc

SEQ ID NO: 181847 - RNA, 32 nt, Human
gcuuccauugcaagagaugaaaaagaaacaca

SEQ ID NO: 181848 - RNA, 32 nt, Human
gcuuccauuuuccuacaggcagucucucucuu

SEQ ID NO: 181849 - RNA, 32 nt, Human
gcuucccaaacaguaacucacuccaggccaag

SEQ ID NO: 181850 - RNA, 32 nt, Human
gcuucccaaagugcucaggauuacaggcguga

SEQ ID NO: 181851 - RNA, 22 nt, Human
gcuucccaacccaccacacagc

SEQ ID NO: 181852 - RNA, 32 nt, Human
gcuucccaagaguagccucaaccugugcuucu

SEQ ID NO: 181853 - RNA, 32 nt, Human
gcuucccaagccgcgcgacuccaugcuggggg

SEQ ID NO: 181854 - RNA, 24 nt, Human
gcuucccaaugagcacucagcagc

SEQ ID NO: 181855 - RNA, 21 nt, Human
gcuucccacagcccugccagc

SEQ ID NO: 181856 - RNA, 32 nt, Human
gcuucccaccagcagcuugacacccacagugu

SEQ ID NO: 181857 - RNA, 32 nt, Human
gcuucccaccugucuggggaggcugugggcuc

SEQ ID NO: 181858 - RNA, 32 nt, Human
gcuucccacugcagcagcaccagucuggggag

SEQ ID NO: 181859 - RNA, 32 nt, Human
gcuucccagaaagccuuucuccaucaucccag

SEQ ID NO: 181860 - RNA, 32 nt, Human
gcuucccagaacggaucuccccagccucgacu

SEQ ID NO: 181861 - RNA, 23 nt, Human
gcuucccagagaccccucugagc

SEQ ID NO: 181862 - RNA, 32 nt, Human
gcuucccagaugggaaacugaggcucagagaa

SEQ ID NO: 181863 - RNA, 22 nt, Human
gcuucccagcaacaccugcagu

SEQ ID NO: 181864 - RNA, 32 nt, Human
gcuucccagcagcugcccagugccucugucca

SEQ ID NO: 181865 - RNA, 15 nt, Human
gcuucccagcaggca

SEQ ID NO: 181866 - RNA, 20 nt, Human
gcuucccagccaugcccagg

SEQ ID NO: 181867 - RNA, 21 nt, Human
gcuucccagcccagcuggggc

SEQ ID NO: 181868 - RNA, 23 nt, Human
gcuucccagcccccagcauucca

SEQ ID NO: 181869 - RNA, 21 nt, Human
gcuucccagccgucuuggcgu

SEQ ID NO: 181870 - RNA, 22 nt, Human
gcuucccagccugucuacugua

SEQ ID NO: 181871 - RNA, 21 nt, Human
gcuucccagcugccgucugca

SEQ ID NO: 181872 - RNA, 32 nt, Human
gcuucccagggcugcccccgacaggcuggcuc

SEQ ID NO: 181873 - RNA, 32 nt, Human
gcuucccagguggucugaagucagguacucuc

SEQ ID NO: 181874 - RNA, 21 nt, Human
gcuucccauccaguccuucaa

SEQ ID NO: 181875 - RNA, 32 nt, Human
gcuucccaucccucccuuccucuucucuccuu

SEQ ID NO: 181876 - RNA, 32 nt, Human
gcuucccaucggaggugguuggugcagaugga

SEQ ID NO: 181877 - RNA, 32 nt, Human
gcuuccccaacauuggcagcuuaugaacgugu

SEQ ID NO: 181878 - RNA, 32 nt, Human
gcuuccccagaacugucaugagagcaucaccu

SEQ ID NO: 181879 - RNA, 32 nt, Human
gcuuccccagccagccucuccucacugugacc

SEQ ID NO: 181880 - RNA, 32 nt, Human
gcuuccccagcccagggaggguaucaguauca

SEQ ID NO: 181881 - RNA, 32 nt, Human
gcuuccccaucuuuaguuuuccacucugcccc

SEQ ID NO: 181882 - RNA, 32 nt, Human
gcuucccccaccccacuggcucuucuuaauua

SEQ ID NO: 181883 - RNA, 32 nt, Human
gcuucccccaguagaagagagccaggucugua

SEQ ID NO: 181884 - RNA, 17 nt, Human
gcuuccccccuuguaua

SEQ ID NO: 181885 - RNA, 32 nt, Human
gcuucccccucagcaccaggguaccaggagcu

SEQ ID NO: 181886 - RNA, 32 nt, Human
gcuucccccugccauucuccagggcuggacug

SEQ ID NO: 181887 - RNA, 32 nt, Human
gcuucccccuucuccccaucccggucuccaga

SEQ ID NO: 181888 - RNA, 28 nt, Human
gcuuccccgagugcugccuccuggucaa

SEQ ID NO: 181889 - RNA, 32 nt, Human
gcuuccccgccaggaacuuacuggggcugcau

SEQ ID NO: 181890 - RNA, 32 nt, Human
gcuuccccucacuccucgggccuugcucuucc

SEQ ID NO: 181891 - RNA, 24 nt, Human
gcuuccccuccaagacgcuggggg

SEQ ID NO: 181892 - RNA, 32 nt, Human
gcuuccccuccagccagaugcuggagaacaca

SEQ ID NO: 181893 - RNA, 32 nt, Human
gcuuccccugcccucacuccccucuggcuggg

SEQ ID NO: 181894 - RNA, 32 nt, Human
gcuuccccugcucaccacugaggccuaauaca

SEQ ID NO: 181895 - RNA, 32 nt, Human
gcuuccccuucccggcucucaccuccguguga

SEQ ID NO: 181896 - RNA, 32 nt, Human
gcuuccccuuucucccuccucaguuggccgag

SEQ ID NO: 181897 - RNA, 32 nt, Human
gcuucccgaggcccggccuccccacugggucc

SEQ ID NO: 181898 - RNA, 24 nt, Human
gcuucccgaguuagcucuuugggu

SEQ ID NO: 181899 - RNA, 32 nt, Human
gcuucccgcagagugcagagacaggaagcugg

SEQ ID NO: 181900 - RNA, 32 nt, Human
gcuucccgccacacuccagagcgggugugagg

SEQ ID NO: 181901 - RNA, 17 nt, Human
gcuucccgccacccgaa

SEQ ID NO: 181902 - RNA, 32 nt, Human
gcuucccggaccauggccaaccuggagcgcac

SEQ ID NO: 181903 - RNA, 32 nt, Human
gcuucccggccuggguuuuuagucuuccuugg

SEQ ID NO: 181904 - RNA, 21 nt, Human
gcuucccggcgaccucagcgu

SEQ ID NO: 181905 - RNA, 32 nt, Human
gcuucccgggcagacacucucucccucaggaa

SEQ ID NO: 181906 - RNA, 32 nt, Human
gcuucccgugcggcugaggacgauccgccagu

SEQ ID NO: 181907 - RNA, 32 nt, Human
gcuucccucccaggaucccuuuggugagugug

SEQ ID NO: 181908 - RNA, 20 nt, Human
gcuucccuccccuuccucca

SEQ ID NO: 181909 - RNA, 32 nt, Human
gcuucccucccucguuuccagcuccugggcga

SEQ ID NO: 181910 - RNA, 25 nt, Human
gcuucccugccccuccuggucugug

SEQ ID NO: 181911 - RNA, 32 nt, Human
gcuucccugccuccuccuaccuuucucuucca

SEQ ID NO: 181912 - RNA, 32 nt, Human
gcuucccugccugcugcugccccauuugauca

SEQ ID NO: 181913 - RNA, 32 nt, Human
gcuucccugccuggcccuggagggagcugggu

SEQ ID NO: 181914 - RNA, 32 nt, Human
gcuucccugcucucagugaagcauuuuauuaa

SEQ ID NO: 181915 - RNA, 32 nt, Human
gcuucccugggcaacauuggaaggaggaaaau

SEQ ID NO: 181916 - RNA, 32 nt, Human
gcuucccugggccacaucggaagaagaauugu

SEQ ID NO: 181917 - RNA, 32 nt, Human
gcuucccugggccacauuggaagaagaagaau

SEQ ID NO: 181918 - RNA, 32 nt, Human
gcuucccugggccacauuugaagaagaauuuu

SEQ ID NO: 181919 - RNA, 32 nt, Human
gcuucccugggcuacauuggaaggagaaaaau

SEQ ID NO: 181920 - RNA, 32 nt, Human
gcuucccuguggcugcuguuucuauccuccag

SEQ ID NO: 181921 - RNA, 25 nt, Human
gcuucccuguguccucucucccucu

SEQ ID NO: 181922 - RNA, 32 nt, Human
gcuucccuugggcuccucagagcuagugggga

SEQ ID NO: 181923 - RNA, 32 nt, Human
gcuucccuuucccuucccagcuacaggcaccc

SEQ ID NO: 181924 - RNA, 32 nt, Human
gcuuccgaagaaagagacaucccccuacuguu

SEQ ID NO: 181925 - RNA, 19 nt, Human
gcuuccgacaccagagugg

SEQ ID NO: 181926 - RNA, 32 nt, Human
gcuuccgacgggagaggguagaccgggggagg

SEQ ID NO: 181927 - RNA, 32 nt, Human
gcuuccgcccuacuuccuccuccuguuggcgg

SEQ ID NO: 181928 - RNA, 19 nt, Human
gcuuccgcguccgccccgg

SEQ ID NO: 181929 - RNA, 32 nt, Human
gcuuccgcugggacuaggaucaggauguggac

SEQ ID NO: 181930 - RNA, 32 nt, Human
gcuuccgcugggacuaggaucaggguguggac

SEQ ID NO: 181931 - RNA, 30 nt, Human
gcuuccggaagccacaggaaccacaaguca

SEQ ID NO: 181932 - RNA, 32 nt, Human
gcuuccggacuggccgcaccccggaggagcca

SEQ ID NO: 181933 - RNA, 32 nt, Human
gcuuccggaggaggggaugggagaaaguaggg

SEQ ID NO: 181934 - RNA, 32 nt, Human
gcuuccggaucgucagccaccuugccuuugcc

SEQ ID NO: 181935 - RNA, 32 nt, Human
gcuuccggcacgggauguuuucgguuguuuga

SEQ ID NO: 181936 - RNA, 32 nt, Human
gcuuccggcuccaggaaauaaccauucaugug

SEQ ID NO: 181937 - RNA, 32 nt, Human
gcuuccgggaggucuaggcggcugccgugagc

SEQ ID NO: 181938 - RNA, 32 nt, Human
gcuuccggggaguugcgagggagcgaggggga

SEQ ID NO: 181939 - RNA, 32 nt, Human
gcuuccggguaacaagcaaaagucaggccaag

SEQ ID NO: 181940 - RNA, 32 nt, Human
gcuuccgggugaggccaaggagugugagguca

SEQ ID NO: 181941 - RNA, 32 nt, Human
gcuuccgucgaagaggagggggcugcgguggc

SEQ ID NO: 181942 - RNA, 32 nt, Human
gcuuccuacacugggccaugcagaggacaggc

SEQ ID NO: 181943 - RNA, 32 nt, Human
gcuuccuaccugcagcuucacuuugcucuagu

SEQ ID NO: 181944 - RNA, 23 nt, Human
gcuuccuagagcgcucagcaggu

SEQ ID NO: 181945 - RNA, 32 nt, Human
gcuuccuagaggcgcugaaggaggaugccgcc

SEQ ID NO: 181946 - RNA, 32 nt, Human
gcuuccuagcacauuccauucuuuguggccca

SEQ ID NO: 181947 - RNA, 32 nt, Human
gcuuccuaguagcugggauugcaggcacucac

SEQ ID NO: 181948 - RNA, 32 nt, Human
gcuuccuaguuaacaacccccaugcugccucc

SEQ ID NO: 181949 - RNA, 32 nt, Human
gcuuccuaugccucugaaucuguccuuaucag

SEQ ID NO: 181950 - RNA, 18 nt, Human
gcuuccucaaccucuccu

SEQ ID NO: 181951 - RNA, 32 nt, Human
gcuuccucaccacccccacuguugggccuaua

SEQ ID NO: 181952 - RNA, 32 nt, Human
gcuuccucagcaacaggagccggaccuacaac

SEQ ID NO: 181953 - RNA, 32 nt, Human
gcuuccucagcccucugucauauggcuguuuu

SEQ ID NO: 181954 - RNA, 32 nt, Human
gcuuccucagccuacuaucauaggcuuccuca

SEQ ID NO: 181955 - RNA, 32 nt, Human
gcuuccucagcuccucacagaugguccacacg

SEQ ID NO: 181956 - RNA, 32 nt, Human
gcuuccucccacagcagcugugaauggcacag

SEQ ID NO: 181957 - RNA, 32 nt, Human
gcuuccucccagacuugccuuacccugggcug

SEQ ID NO: 181958 - RNA, 32 nt, Human
gcuuccucccagcugcucugcuggcuugcuga

SEQ ID NO: 181959 - RNA, 32 nt, Human
gcuuccucccauccucccaucucagugguucc

SEQ ID NO: 181960 - RNA, 32 nt, Human
gcuuccuccccgcucguccuccccgggcccag

SEQ ID NO: 181961 - RNA, 32 nt, Human
gcuuccucccucucuccucccucccagacacc

SEQ ID NO: 181962 - RNA, 32 nt, Human
gcuuccucccucuguugucugccugugugaca

SEQ ID NO: 181963 - RNA, 32 nt, Human
gcuuccucccuuccuuucccccuuccucccuc

SEQ ID NO: 181964 - RNA, 32 nt, Human
gcuuccuccgccuccccaucucuuuuaagcag

SEQ ID NO: 181965 - RNA, 32 nt, Human
gcuuccuccgcugcccaccucuugccacagau

SEQ ID NO: 181966 - RNA, 32 nt, Human
gcuuccuccggagucuccgcaggcuggaggug

SEQ ID NO: 181967 - RNA, 16 nt, Human
gcuuccuccugcugcc

SEQ ID NO: 181968 - RNA, 32 nt, Human
gcuuccuccuugugguuccguugcaaacauuu

SEQ ID NO: 181969 - RNA, 32 nt, Human
gcuuccucggcagccuugggaagcacgggcga

SEQ ID NO: 181970 - RNA, 32 nt, Human
gcuuccucuccuccccuguacgugccccagca

SEQ ID NO: 181971 - RNA, 32 nt, Human
gcuuccucucucucccuuccucucucucccuu

SEQ ID NO: 181972 - RNA, 32 nt, Human
gcuuccucugccaaaaaggaacugguggccuu

SEQ ID NO: 181973 - RNA, 18 nt, Human
gcuuccucuggccaggua

SEQ ID NO: 181974 - RNA, 32 nt, Human
gcuuccucugggcucagacucaggcugaugcu

SEQ ID NO: 181975 - RNA, 32 nt, Human
gcuuccucuguagagcucugaaaagguugacu

SEQ ID NO: 181976 - RNA, 32 nt, Human
gcuuccucuguggaaaucugucucagccuacu

SEQ ID NO: 181977 - RNA, 32 nt, Human
gcuuccucuuucuccagaagccuucuggcuga

SEQ ID NO: 181978 - RNA, 32 nt, Human
gcuuccugagccuggcccugcauccucauaga

SEQ ID NO: 181979 - RNA, 24 nt, Human
gcuuccugaggaaacgcgggcgga

SEQ ID NO: 181980 - RNA, 32 nt, Human
gcuuccugagggcagggaggcagaugggacag

SEQ ID NO: 181981 - RNA, 32 nt, Human
gcuuccugaugccucauucaccaggaugggua

SEQ ID NO: 181982 - RNA, 32 nt, Human
gcuuccugcaggaggcgggauuacuaugacga

SEQ ID NO: 181983 - RNA, 32 nt, Human
gcuuccugccaagaauuauggcagcugaggau

SEQ ID NO: 181984 - RNA, 32 nt, Human
gcuuccugccaagcaccugccugccugcauca

SEQ ID NO: 181985 - RNA, 32 nt, Human
gcuuccugccgucccccgacugccucauucuu

SEQ ID NO: 181986 - RNA, 23 nt, Human
gcuuccugccugguuuuucucuu

SEQ ID NO: 181987 - RNA, 32 nt, Human
gcuuccugcuccauggaguccugaguugcucu

SEQ ID NO: 181988 - RNA, 32 nt, Human
gcuuccugcuccuggguuuucucuccaugaug

SEQ ID NO: 181989 - RNA, 32 nt, Human
gcuuccugcugccgcucugcagccuggaccug

SEQ ID NO: 181990 - RNA, 32 nt, Human
gcuuccuggaaacccucauuuuccuugucugu

SEQ ID NO: 181991 - RNA, 32 nt, Human
gcuuccuggaaaugucacccucaccagagccu

SEQ ID NO: 181992 - RNA, 32 nt, Human
gcuuccuggaaaugucacucucaauggcgccu

SEQ ID NO: 181993 - RNA, 32 nt, Human
gcuuccuggaaguccugaagcucucgcagugc

SEQ ID NO: 181994 - RNA, 23 nt, Human
gcuuccuggacgggacccggggc

SEQ ID NO: 181995 - RNA, 32 nt, Human
gcuuccuggaggagguggagcugcagcuggga

SEQ ID NO: 181996 - RNA, 32 nt, Human
gcuuccuggaguucaggagaccccggacaccu

SEQ ID NO: 181997 - RNA, 21 nt, Human
gcuuccuggcacugcuggacc

SEQ ID NO: 181998 - RNA, 32 nt, Human
gcuuccuggcagugccauuuggagcaucaaaa

SEQ ID NO: 181999 - RNA, 32 nt, Human
gcuuccuggcagugccauuuggagcaucaaag

SEQ ID NO: 182000 - RNA, 29 nt, Human
gcuuccuggcugccaucuuuccuuuugac

SEQ ID NO: 182001 - RNA, 32 nt, Human
gcuuccugggaggugucucuggggguggggug

SEQ ID NO: 182002 - RNA, 32 nt, Human
gcuuccugggcagccacuggccaggccguugu

SEQ ID NO: 182003 - RNA, 32 nt, Human
gcuuccugggccccaucugaggccgugggcuc

SEQ ID NO: 182004 - RNA, 32 nt, Human
gcuuccugggcugaggacauggggauccaagg

SEQ ID NO: 182005 - RNA, 32 nt, Human
gcuuccuggugagagaggaagcaacucuccuu

SEQ ID NO: 182006 - RNA, 32 nt, Human
gcuuccuggugagccagguggggagggccucu

SEQ ID NO: 182007 - RNA, 32 nt, Human
gcuuccuguaccaucuacuggaccgugagcca

SEQ ID NO: 182008 - RNA, 32 nt, Human
gcuuccuguccccagagggcagggauagaaaa

SEQ ID NO: 182009 - RNA, 26 nt, Human
gcuuccugugaacauuuguaaccacu

SEQ ID NO: 182010 - RNA, 32 nt, Human
gcuuccugugccaccaggggccuguccaccuc

SEQ ID NO: 182011 - RNA, 32 nt, Human
gcuuccugugccucccuccaaccuucuccuac

SEQ ID NO: 182012 - RNA, 32 nt, Human
gcuuccuguggcugucacuccugggcccaggc

SEQ ID NO: 182013 - RNA, 32 nt, Human
gcuuccugugggcugcagccuaaugcccacgu

SEQ ID NO: 182014 - RNA, 32 nt, Human
gcuuccuguucuaauaaaugcacggcuuuacc

SEQ ID NO: 182015 - RNA, 32 nt, Human
gcuuccuguuucuaaguggccugcaggggcca

SEQ ID NO: 182016 - RNA, 32 nt, Human
gcuuccuuagcaugugggucaguggcuccuga

SEQ ID NO: 182017 - RNA, 18 nt, Human
gcuuccuuccacccagaa

SEQ ID NO: 182018 - RNA, 32 nt, Human
gcuuccuuccucacuuccucuccaggagggag

SEQ ID NO: 182019 - RNA, 32 nt, Human
gcuuccuuccuugccccaucuuccucccaacu

SEQ ID NO: 182020 - RNA, 32 nt, Human
gcuuccuucucaaaguccuguggaagaacaaa

SEQ ID NO: 182021 - RNA, 32 nt, Human
gcuuccuucucccuccucugucucaaacugcg

SEQ ID NO: 182022 - RNA, 32 nt, Human
gcuuccuugacgcgagaggcucugagggucug

SEQ ID NO: 182023 - RNA, 32 nt, Human
gcuuccuugccugagaucaccuagaaaggaac

SEQ ID NO: 182024 - RNA, 32 nt, Human
gcuuccuuuaaagggagggggagaagccaggg

SEQ ID NO: 182025 - RNA, 32 nt, Human
gcuuccuuucucaccugccucuacuugucagu

SEQ ID NO: 182026 - RNA, 32 nt, Human
gcuuccuuucucuccuggcucgggguaaaaag

SEQ ID NO: 182027 - RNA, 22 nt, Human
gcuuccuuuucucggucuuccu

SEQ ID NO: 182028 - RNA, 32 nt, Human
gcuucgaccacaguuuacugagggugauaucu

SEQ ID NO: 182029 - RNA, 25 nt, Human
gcuucgaccccgccgccgccgccgc

SEQ ID NO: 182030 - RNA, 32 nt, Human
gcuucgacugucaagguggcuguuauaaauuu

SEQ ID NO: 182031 - RNA, 32 nt, Human
gcuucgacugucucgcccaacaugugcacccc

SEQ ID NO: 182032 - RNA, 32 nt, Human
gcuucgagccacugccccagggucugcugcuc

SEQ ID NO: 182033 - RNA, 32 nt, Human
gcuucgaggugaucugcuaccuagccacauuc

SEQ ID NO: 182034 - RNA, 20 nt, Human
gcuucgaugagccagaguga

SEQ ID NO: 182035 - RNA, 32 nt, Human
gcuucgcacacagcuggcuccaggaaaauaca

SEQ ID NO: 182036 - RNA, 32 nt, Human
gcuucgcacagcccuuccuaggguguggagag

SEQ ID NO: 182037 - RNA, 19 nt, Human
gcuucgcacugagcacauc

SEQ ID NO: 182038 - RNA, 32 nt, Human
gcuucgcaggcagcaccgccucccgggccgcg

SEQ ID NO: 182039 - RNA, 32 nt, Human
gcuucgcagggacagcgcuggggaggugacgg

SEQ ID NO: 182040 - RNA, 32 nt, Human
gcuucgcaggguggcugugagaggauuccauu

SEQ ID NO: 182041 - RNA, 22 nt, Human
gcuucgccccacccggcccgug

SEQ ID NO: 182042 - RNA, 32 nt, Human
gcuucgccccacccggcccgugggggaguauc

SEQ ID NO: 182043 - RNA, 32 nt, Human
gcuucgcccggggagggggaaagagcagcgag

SEQ ID NO: 182044 - RNA, 32 nt, Human
gcuucgccggugggagaggauccucgccgccc

SEQ ID NO: 182045 - RNA, 32 nt, Human
gcuucgccugccuccuuccuccgcgcaccccc

SEQ ID NO: 182046 - RNA, 32 nt, Human
gcuucgccuugcccgccuccucccaggaagga

SEQ ID NO: 182047 - RNA, 32 nt, Human
gcuucgcgagggcccagagaggcgguggggug

SEQ ID NO: 182048 - RNA, 32 nt, Human
gcuucgcgguucaguccuccuaacugacagcc

SEQ ID NO: 182049 - RNA, 32 nt, Human
gcuucgcucagccuggccacgacaucacugug

SEQ ID NO: 182050 - RNA, 20 nt, Human
gcuucgcucccgcagcauca

SEQ ID NO: 182051 - RNA, 32 nt, Human
gcuucgcuucaaggcggccucuaccuuuucuc

SEQ ID NO: 182052 - RNA, 32 nt, Human
gcuucggaagagaagaaugaugugcagagugu

SEQ ID NO: 182053 - RNA, 32 nt, Human
gcuucggagcugccuggcucauggcccaaccc

SEQ ID NO: 182054 - RNA, 21 nt, Human
gcuucggcucauugacuuaga

SEQ ID NO: 182055 - RNA, 32 nt, Human
gcuucgggacagaccuuggcucagggacugcc

SEQ ID NO: 182056 - RNA, 32 nt, Human
gcuucgggagcaugagugcugcagugacugca

SEQ ID NO: 182057 - RNA, 32 nt, Human
gcuucggggcuugccaagagacgguguuuaga

SEQ ID NO: 182058 - RNA, 32 nt, Human
gcuucggguaucagaggaggcugaccuggccc

SEQ ID NO: 182059 - RNA, 32 nt, Human
gcuucgguucauuucaaccucuuuuccuccaa

SEQ ID NO: 182060 - RNA, 32 nt, Human
gcuucguccagccuguggauggagccugacug

SEQ ID NO: 182061 - RNA, 32 nt, Human
gcuucgucccacugcaccgccuggcugagggc

SEQ ID NO: 182062 - RNA, 32 nt, Human
gcuucgugagcagccucagcucggguggaggg

SEQ ID NO: 182063 - RNA, 32 nt, Human
gcuucgugccaucaugauccuugccuucauau

SEQ ID NO: 182064 - RNA, 32 nt, Human
gcuucgugccuggggcccucugcucuggggcc

SEQ ID NO: 182065 - RNA, 22 nt, Human
gcuucguggaaugagcaguacc

SEQ ID NO: 182066 - RNA, 32 nt, Human
gcuucguggucuucuccauccugggcuucaug

SEQ ID NO: 182067 - RNA, 32 nt, Human
gcuucguuggguucugcuuccuucccuucuua

SEQ ID NO: 182068 - RNA, 32 nt, Human
gcuucuaagacaccuccauuccaguuucugca

SEQ ID NO: 182069 - RNA, 32 nt, Human
gcuucuaagcaccaaucucccucugccaucag

SEQ ID NO: 182070 - RNA, 25 nt, Human
gcuucuaagcagcugucuucccccu

SEQ ID NO: 182071 - RNA, 32 nt, Human
gcuucuaagccaaaaggauuccucuuuguuua

SEQ ID NO: 182072 - RNA, 32 nt, Human
gcuucuaccagcugacugccccggcccggccu

SEQ ID NO: 182073 - RNA, 32 nt, Human
gcuucuacccagacuucuuuugcaauuugucc

SEQ ID NO: 182074 - RNA, 32 nt, Human
gcuucuaccgagucuucccccaccucaauccc

SEQ ID NO: 182075 - RNA, 32 nt, Human
gcuucuagaagacugccuagcacacaguaggc

SEQ ID NO: 182076 - RNA, 32 nt, Human
gcuucuagccccgcaucuggaaaaaggccccu

SEQ ID NO: 182077 - RNA, 32 nt, Human
gcuucuagggcuucacaucccuuccccucccc

SEQ ID NO: 182078 - RNA, 18 nt, Human
gcuucuaggggcccaggc

SEQ ID NO: 182079 - RNA, 32 nt, Human
gcuucuagguagggcugcgccacccaccuacu

SEQ ID NO: 182080 - RNA, 32 nt, Human
gcuucuaucaccaacagaaauuauaccauaua

SEQ ID NO: 182081 - RNA, 32 nt, Human
gcuucuaugaggagaccaugugccgaggucgu

SEQ ID NO: 182082 - RNA, 32 nt, Human
gcuucuauggggcucucucuucugccuucuca

SEQ ID NO: 182083 - RNA, 20 nt, Human
gcuucuauucccagccugcc

SEQ ID NO: 182084 - RNA, 32 nt, Human
gcuucuauuuugcuggacccucgcucugccaa

SEQ ID NO: 182085 - RNA, 32 nt, Human
gcuucucacccuauguggguggggccacagac

SEQ ID NO: 182086 - RNA, 32 nt, Human
gcuucucacuccccaaguuugccuccuuucuu

SEQ ID NO: 182087 - RNA, 32 nt, Human
gcuucucagacagcauuggauuuccuaaaggu

SEQ ID NO: 182088 - RNA, 21 nt, Human
gcuucucagccaccaaagggu

SEQ ID NO: 182089 - RNA, 22 nt, Human
gcuucucagcccccucuggggu

SEQ ID NO: 182090 - RNA, 23 nt, Human
gcuucucagugcucucuuuccaa

SEQ ID NO: 182091 - RNA, 32 nt, Human
gcuucucagugggcacagucucuuacucccau

SEQ ID NO: 182092 - RNA, 32 nt, Human
gcuucucauagcccugguacaugguacacaca

SEQ ID NO: 182093 - RNA, 32 nt, Human
gcuucucaucccugcauagaugcaguauucuu

SEQ ID NO: 182094 - RNA, 32 nt, Human
gcuucucauccugcugucaccaacuagcucug

SEQ ID NO: 182095 - RNA, 32 nt, Human
gcuucucauguggcucauucuuuaaucuauuc

SEQ ID NO: 182096 - RNA, 32 nt, Human
gcuucucauuugcacugaucacugugaguguc

SEQ ID NO: 182097 - RNA, 32 nt, Human
gcuucuccaaagggagggugacaugcuggcuu

SEQ ID NO: 182098 - RNA, 32 nt, Human
gcuucuccaagauauuuccuggcaucaccccu

SEQ ID NO: 182099 - RNA, 32 nt, Human
gcuucuccaccuauagccagagcccaccggac

SEQ ID NO: 182100 - RNA, 21 nt, Human
gcuucuccaccucggcccgug

SEQ ID NO: 182101 - RNA, 32 nt, Human
gcuucuccagaacuucccuuccucguagacac

SEQ ID NO: 182102 - RNA, 32 nt, Human
gcuucuccagaauagggguuuggggcuugcua

SEQ ID NO: 182103 - RNA, 19 nt, Human
gcuucuccagacuuucugu

SEQ ID NO: 182104 - RNA, 32 nt, Human
gcuucuccaggcccagaaauuccucaguucgg

SEQ ID NO: 182105 - RNA, 32 nt, Human
gcuucuccaugaccuccugcauggcccggugg

SEQ ID NO: 182106 - RNA, 32 nt, Human
gcuucucccaggcacagguguugcaccaggga

SEQ ID NO: 182107 - RNA, 32 nt, Human
gcuucucccauaacugcugccaccaccaucag

SEQ ID NO: 182108 - RNA, 32 nt, Human
gcuucucccgcaggagcuucgggcuucuccug

SEQ ID NO: 182109 - RNA, 32 nt, Human
gcuucucccucacuucuuuccucaaagaagca

SEQ ID NO: 182110 - RNA, 32 nt, Human
gcuucucccugcagcccugccuuugcugauac

SEQ ID NO: 182111 - RNA, 32 nt, Human
gcuucucccugcucugcccaucaugacucauu

SEQ ID NO: 182112 - RNA, 32 nt, Human
gcuucucccuuuccuucuguuccgguuucugg

SEQ ID NO: 182113 - RNA, 32 nt, Human
gcuucucccuuuccuugagcucucuggacacu

SEQ ID NO: 182114 - RNA, 32 nt, Human
gcuucuccggcggaacccaggcuggaccgcgg

SEQ ID NO: 182115 - RNA, 32 nt, Human
gcuucuccucacagggccuggccauauagcca

SEQ ID NO: 182116 - RNA, 23 nt, Human
gcuucuccucagcgcucauccgc

SEQ ID NO: 182117 - RNA, 32 nt, Human
gcuucuccuccucauccucccagccccacccu

SEQ ID NO: 182118 - RNA, 32 nt, Human
gcuucuccuccuccuccuccacaguugccugc

SEQ ID NO: 182119 - RNA, 32 nt, Human
gcuucuccuccuccucuugcuccuccagcucc

SEQ ID NO: 182120 - RNA, 32 nt, Human
gcuucuccucggcgcccugccugcugggcucc

SEQ ID NO: 182121 - RNA, 22 nt, Human
gcuucuccucugccucauccac

SEQ ID NO: 182122 - RNA, 32 nt, Human
gcuucuccugcaauuccaccuaaugccauccc

SEQ ID NO: 182123 - RNA, 20 nt, Human
gcuucuccuguagggcaccu

SEQ ID NO: 182124 - RNA, 23 nt, Human
gcuucuccuucagcccauccacu

SEQ ID NO: 182125 - RNA, 32 nt, Human
gcuucuccuugcaccuucauuuuaacccccau

SEQ ID NO: 182126 - RNA, 32 nt, Human
gcuucuccuuucucuccaccuccccugccacu

SEQ ID NO: 182127 - RNA, 21 nt, Human
gcuucucuacacagccucuac

SEQ ID NO: 182128 - RNA, 18 nt, Human
gcuucucuauuuuuuccu

SEQ ID NO: 182129 - RNA, 20 nt, Human
gcuucucucagccuccccac

SEQ ID NO: 182130 - RNA, 32 nt, Human
gcuucucuccacuguccaucccuccuaucauc

SEQ ID NO: 182131 - RNA, 32 nt, Human
gcuucucuccccuucuucuccucucucugucc

SEQ ID NO: 182132 - RNA, 19 nt, Human
gcuucucucccugccacca

SEQ ID NO: 182133 - RNA, 32 nt, Human
gcuucucuccuccugcuggagugccagucccu

SEQ ID NO: 182134 - RNA, 32 nt, Human
gcuucucucuacugcccuggcccguucauccu

SEQ ID NO: 182135 - RNA, 32 nt, Human
gcuucucucucaacaucucucuaccagacaga

SEQ ID NO: 182136 - RNA, 31 nt, Human
gcuucucucuucacggggccuguucgccaug

SEQ ID NO: 182137 - RNA, 32 nt, Human
gcuucucucuuccucaucucccaauaccucuu

SEQ ID NO: 182138 - RNA, 22 nt, Human
gcuucucucuugccugcuccug

SEQ ID NO: 182139 - RNA, 32 nt, Human
gcuucucugcccacucauuucuaguccagccg

SEQ ID NO: 182140 - RNA, 32 nt, Human
gcuucucugccgguggggccagcgcugaacag

SEQ ID NO: 182141 - RNA, 32 nt, Human
gcuucucugccuccagccuuugggguagccac

SEQ ID NO: 182142 - RNA, 32 nt, Human
gcuucucugccucucagaauucuuuuuaauug

SEQ ID NO: 182143 - RNA, 32 nt, Human
gcuucucugggagcuuggccuucaguuagccc

SEQ ID NO: 182144 - RNA, 32 nt, Human
gcuucucugggcaaaugggaaguucagcgggg

SEQ ID NO: 182145 - RNA, 17 nt, Human
gcuucucugggcuccca

SEQ ID NO: 182146 - RNA, 32 nt, Human
gcuucucugggcugugauggggaugugcaggg

SEQ ID NO: 182147 - RNA, 32 nt, Human
gcuucucuggggcugggcucuacucccugcag

SEQ ID NO: 182148 - RNA, 32 nt, Human
gcuucucugugccuguuucuucaugcaugcag

SEQ ID NO: 182149 - RNA, 32 nt, Human
gcuucucuguucaaugucuagggcugucuaua

SEQ ID NO: 182150 - RNA, 32 nt, Human
gcuucucuuccucccuacagaggggagaucuc

SEQ ID NO: 182151 - RNA, 32 nt, Human
gcuucucuucuuuccauucuucuugcuacacc

SEQ ID NO: 182152 - RNA, 32 nt, Human
gcuucucuugcaucuucuuccacugggcucug

SEQ ID NO: 182153 - RNA, 32 nt, Human
gcuucucuugugugugccucagcucugaagaa

SEQ ID NO: 182154 - RNA, 32 nt, Human
gcuucugaacagccuggcgggaaauguagucc

SEQ ID NO: 182155 - RNA, 32 nt, Human
gcuucugaagguaaagggacacuggauccaga

SEQ ID NO: 182156 - RNA, 32 nt, Human
gcuucugaauugaagaacaaggccauguccac

SEQ ID NO: 182157 - RNA, 32 nt, Human
gcuucugacagcagaaaucucugugauuuuca

SEQ ID NO: 182158 - RNA, 32 nt, Human
gcuucugacuccagacagacagugccucccca

SEQ ID NO: 182159 - RNA, 32 nt, Human
gcuucugagcaucuauuuuugggcucugaaau

SEQ ID NO: 182160 - RNA, 19 nt, Human
gcuucugaggacuuaggua

SEQ ID NO: 182161 - RNA, 32 nt, Human
gcuucugaggcccagaggagcaggugggaugg

SEQ ID NO: 182162 - RNA, 32 nt, Human
gcuucugaguagcgugggaguggagucagcac

SEQ ID NO: 182163 - RNA, 32 nt, Human
gcuucugaguagcuaggacuauggguacauuc

SEQ ID NO: 182164 - RNA, 32 nt, Human
gcuucugaguagcugggauuauaggugcgcac

SEQ ID NO: 182165 - RNA, 32 nt, Human
gcuucugagucuaucucaucccuaccuaauau

SEQ ID NO: 182166 - RNA, 32 nt, Human
gcuucugauuuuaaagaggcaucuagggaauu

SEQ ID NO: 182167 - RNA, 32 nt, Human
gcuucugcaacaaaagccuccacccagccaca

SEQ ID NO: 182168 - RNA, 32 nt, Human
gcuucugcaaugugauccuggugaaggaggag

SEQ ID NO: 182169 - RNA, 18 nt, Human
gcuucugcauccaccucu

SEQ ID NO: 182170 - RNA, 32 nt, Human
gcuucugcauuuccuucccugcuccuaacaaa

SEQ ID NO: 182171 - RNA, 18 nt, Human
gcuucugccacccugcug

SEQ ID NO: 182172 - RNA, 32 nt, Human
gcuucugccaggaccacaccgagggugcccac

SEQ ID NO: 182173 - RNA, 19 nt, Human
gcuucugccgcggcugcgg

SEQ ID NO: 182174 - RNA, 22 nt, Human
gcuucugcgaugccggccuucc

SEQ ID NO: 182175 - RNA, 32 nt, Human
gcuucugcuacuuggagaagagauuuagaauu

SEQ ID NO: 182176 - RNA, 32 nt, Human
gcuucugcuccuccucagccagcggcagaagc

SEQ ID NO: 182177 - RNA, 20 nt, Human
gcuucugcuccuugcuacca

SEQ ID NO: 182178 - RNA, 32 nt, Human
gcuucugcucuucucaccagaaagaacauuug

SEQ ID NO: 182179 - RNA, 32 nt, Human
gcuucugcugcaucugcagccaugucgggccg

SEQ ID NO: 182180 - RNA, 32 nt, Human
gcuucugcugucccugccucaaguacaggccg

SEQ ID NO: 182181 - RNA, 32 nt, Human
gcuucuggaaccugaggcuuggccccgguugg

SEQ ID NO: 182182 - RNA, 32 nt, Human
gcuucuggaagagaaaagaguuguucauuacu

SEQ ID NO: 182183 - RNA, 32 nt, Human
gcuucuggaaguuucugccucacucagaaugg

SEQ ID NO: 182184 - RNA, 32 nt, Human
gcuucuggaauagaaacagugguuugaagacc

SEQ ID NO: 182185 - RNA, 31 nt, Human
gcuucuggacucaaggaggaggagagagauu

SEQ ID NO: 182186 - RNA, 32 nt, Human
gcuucuggagcaggguggucuccggcuccucc

SEQ ID NO: 182187 - RNA, 32 nt, Human
gcuucuggagccaccggccgggccacgaugcu

SEQ ID NO: 182188 - RNA, 32 nt, Human
gcuucuggagccuugggacagagcaggcccac

SEQ ID NO: 182189 - RNA, 32 nt, Human
gcuucuggagggccagcucccagagcugagcu

SEQ ID NO: 182190 - RNA, 32 nt, Human
gcuucuggcccaaaccccaagcagaaaagaaa

SEQ ID NO: 182191 - RNA, 32 nt, Human
gcuucuggccugggugagcuagaagggagaag

SEQ ID NO: 182192 - RNA, 32 nt, Human
gcuucugggaagggagagaggggaggucugca

SEQ ID NO: 182193 - RNA, 32 nt, Human
gcuucugggagagagcaagagaggaccuuggg

SEQ ID NO: 182194 - RNA, 32 nt, Human
gcuucugggcccaggaagaggcuguggcuccc

SEQ ID NO: 182195 - RNA, 32 nt, Human
gcuucuggggaaagcauccaucacagaaccuc

SEQ ID NO: 182196 - RNA, 19 nt, Human
gcuucuggggacccagggc

SEQ ID NO: 182197 - RNA, 32 nt, Human
gcuucuggggagguaggaaggaccaggggcau

SEQ ID NO: 182198 - RNA, 32 nt, Human
gcuucugggguugcuccggggccagguucucc

SEQ ID NO: 182199 - RNA, 32 nt, Human
gcuucuggguccaccugagcacuggacggugc

SEQ ID NO: 182200 - RNA, 32 nt, Human
gcuucuggucggcugugaugugcuccagcuuu

SEQ ID NO: 182201 - RNA, 32 nt, Human
gcuucuggugaacuugucuggccggcauucau

SEQ ID NO: 182202 - RNA, 32 nt, Human
gcuucugguucaccgcccugauuccacagaug

SEQ ID NO: 182203 - RNA, 32 nt, Human
gcuucugguuucagcacacauggagauauaga

SEQ ID NO: 182204 - RNA, 32 nt, Human
gcuucugucauugacuaggccagguauggagc

SEQ ID NO: 182205 - RNA, 19 nt, Human
gcuucuguccagcugcacc

SEQ ID NO: 182206 - RNA, 32 nt, Human
gcuucugucccuucaucgguucaugucacagg

SEQ ID NO: 182207 - RNA, 32 nt, Human
gcuucugucggugccucagugccaagucagga

SEQ ID NO: 182208 - RNA, 32 nt, Human
gcuucugucuguucuuaauuuuuggguuugac

SEQ ID NO: 182209 - RNA, 32 nt, Human
gcuucuguggcccaggcuggagugcaguggcu

SEQ ID NO: 182210 - RNA, 32 nt, Human
gcuucuguguaagccaggcuuaagucaaucag

SEQ ID NO: 182211 - RNA, 32 nt, Human
gcuucuguuagguucccaucucuccuucugcc

SEQ ID NO: 182212 - RNA, 32 nt, Human
gcuucuguucucugcugagggccaauacccua

SEQ ID NO: 182213 - RNA, 32 nt, Human
gcuucuguugcugccucaugcuaagacucagu

SEQ ID NO: 182214 - RNA, 32 nt, Human
gcuucuguugucccuugccugccuguaaggaa

SEQ ID NO: 182215 - RNA, 32 nt, Human
gcuucuuacacagcagccuuacuucaucggcc

SEQ ID NO: 182216 - RNA, 32 nt, Human
gcuucuuacagacgcagccccuugucuguagc

SEQ ID NO: 182217 - RNA, 32 nt, Human
gcuucuuacccucccucccuuccucccucccu

SEQ ID NO: 182218 - RNA, 32 nt, Human
gcuucuuagcuuuucugaauucugcaguauuu

SEQ ID NO: 182219 - RNA, 32 nt, Human
gcuucuuauccugaacacuugacaccuugagg

SEQ ID NO: 182220 - RNA, 32 nt, Human
gcuucuucaagcaaaccaccucaccacacuau

SEQ ID NO: 182221 - RNA, 18 nt, Human
gcuucuucaaggcaucuc

SEQ ID NO: 182222 - RNA, 18 nt, Human
gcuucuucagcccccuca

SEQ ID NO: 182223 - RNA, 32 nt, Human
gcuucuucauccugccagaguuuccaaaugga

SEQ ID NO: 182224 - RNA, 22 nt, Human
gcuucuuccacggggcuugaca

SEQ ID NO: 182225 - RNA, 32 nt, Human
gcuucuuccagguaugggcaccagagagggag

SEQ ID NO: 182226 - RNA, 32 nt, Human
gcuucuuccccugcccagaaagaucuuucuag

SEQ ID NO: 182227 - RNA, 32 nt, Human
gcuucuuccuccaagagcccauugaagaagcc

SEQ ID NO: 182228 - RNA, 32 nt, Human
gcuucuuccugccucuuugcauacucagcaua

SEQ ID NO: 182229 - RNA, 32 nt, Human
gcuucuucgcagucuucggcccucuccugucg

SEQ ID NO: 182230 - RNA, 32 nt, Human
gcuucuucgguugcaguccucuugcuucuugc

SEQ ID NO: 182231 - RNA, 32 nt, Human
gcuucuucuacaccuuucauucuuuuuguuuu

SEQ ID NO: 182232 - RNA, 32 nt, Human
gcuucuucucagaucuauccuguucguuggag

SEQ ID NO: 182233 - RNA, 32 nt, Human
gcuucuucucagggaggcccuggcgcgggguc

SEQ ID NO: 182234 - RNA, 32 nt, Human
gcuucuucuccucacccaguuuggccaacagc

SEQ ID NO: 182235 - RNA, 32 nt, Human
gcuucuucucuuccugugguuccauccgaagg

SEQ ID NO: 182236 - RNA, 32 nt, Human
gcuucuucuguggagccuguuccucacuggaa

SEQ ID NO: 182237 - RNA, 32 nt, Human
gcuucuucuucugguggcgucuuuggauuguc

SEQ ID NO: 182238 - RNA, 18 nt, Human
gcuucuucuuuugagcaa

SEQ ID NO: 182239 - RNA, 32 nt, Human
gcuucuucuuuugagcaacuuucuuacacuga

SEQ ID NO: 182240 - RNA, 32 nt, Human
gcuucuugaguagagccaccaccaccauagcc

SEQ ID NO: 182241 - RNA, 32 nt, Human
gcuucuugcccagguuucaaagcugaaguaca

SEQ ID NO: 182242 - RNA, 23 nt, Human
gcuucuugccccuugggccuccc

SEQ ID NO: 182243 - RNA, 21 nt, Human
gcuucuugccucaguucuucc

SEQ ID NO: 182244 - RNA, 23 nt, Human
gcuucuugccuccacacccuccu

SEQ ID NO: 182245 - RNA, 32 nt, Human
gcuucuugcuccaggaaaugucuaucaauuua

SEQ ID NO: 182246 - RNA, 32 nt, Human
gcuucuugcuuugcagagugccauggucaugu

SEQ ID NO: 182247 - RNA, 22 nt, Human
gcuucuuggccucagcuccccu

SEQ ID NO: 182248 - RNA, 32 nt, Human
gcuucuuguccaccucuucuccccugcccacc

SEQ ID NO: 182249 - RNA, 32 nt, Human
gcuucuuguguuugugucauucuguccugaga

SEQ ID NO: 182250 - RNA, 32 nt, Human
gcuucuuucuucucccccaaaacuauuuaaug

SEQ ID NO: 182251 - RNA, 24 nt, Human
gcuucuuuggcggugacaggggug

SEQ ID NO: 182252 - RNA, 32 nt, Human
gcuucuuuggguuuguggcacccuggccaccc

SEQ ID NO: 182253 - RNA, 32 nt, Human
gcuucuuuuguaggugggaauccagccucugu

SEQ ID NO: 182254 - RNA, 32 nt, Human
gcuucuuuuuaaguaugaggguuuguugguca

SEQ ID NO: 182255 - RNA, 22 nt, Human
gcuucuuuuuccugugccuuuu

SEQ ID NO: 182256 - RNA, 32 nt, Human
gcuucuuuuuccugugccuuuuuaacacucaa

SEQ ID NO: 182257 - RNA, 32 nt, Human
gcuugaaaauguucauucucugggcuuguggc

SEQ ID NO: 182258 - RNA, 32 nt, Human
gcuugaaaccagccuggccaacguggugagac

SEQ ID NO: 182259 - RNA, 32 nt, Human
gcuugaaaccuacaauauuauuuuaaccugca

SEQ ID NO: 182260 - RNA, 32 nt, Human
gcuugaaacguuugccccaugggaaacguaug

SEQ ID NO: 182261 - RNA, 32 nt, Human
gcuugaaacuauuuuuguaauccaagaaugga

SEQ ID NO: 182262 - RNA, 32 nt, Human
gcuugaaauccagcaggauggaggacuuggcc

SEQ ID NO: 182263 - RNA, 32 nt, Human
gcuugaaaucuguguccccugccugcacuggc

SEQ ID NO: 182264 - RNA, 32 nt, Human
gcuugaacacugaagggcagguggugggccau

SEQ ID NO: 182265 - RNA, 32 nt, Human
gcuugaacagggaagcagagguugcggugaac

SEQ ID NO: 182266 - RNA, 32 nt, Human
gcuugaacagggaggcagagguugcagugagc

SEQ ID NO: 182267 - RNA, 32 nt, Human
gcuugaaccaggagacggagguugcagugagc

SEQ ID NO: 182268 - RNA, 32 nt, Human
gcuugaacccaagaggcagaggaugcaaugag

SEQ ID NO: 182269 - RNA, 32 nt, Human
gcuugaacccaagaggcagagguugcagugaa

SEQ ID NO: 182270 - RNA, 32 nt, Human
gcuugaacccaagaggcggagguugcagugag

SEQ ID NO: 182271 - RNA, 32 nt, Human
gcuugaacccaagaggcggagguuguggugag

SEQ ID NO: 182272 - RNA, 32 nt, Human
gcuugaacccaagagguccaaggcugcaguga

SEQ ID NO: 182273 - RNA, 32 nt, Human
gcuugaacccaagaggucgaggcugcagugag

SEQ ID NO: 182274 - RNA, 32 nt, Human
gcuugaacccaagagguggaggcugaagugag

SEQ ID NO: 182275 - RNA, 32 nt, Human
gcuugaacccaagagguggagguugcggugag

SEQ ID NO: 182276 - RNA, 32 nt, Human
gcuugaacccagcagauggagguugcagugag

SEQ ID NO: 182277 - RNA, 32 nt, Human
gcuugaacccaggaagcggagguuguggugag

SEQ ID NO: 182278 - RNA, 32 nt, Human
gcuugaacccaggagacagagguugcagugag

SEQ ID NO: 182279 - RNA, 32 nt, Human
gcuugaacccaggagacagagguuguagugag

SEQ ID NO: 182280 - RNA, 32 nt, Human
gcuugaacccaggagacagagguugugguggg

SEQ ID NO: 182281 - RNA, 32 nt, Human
gcuugaacccaggagacagggguugcagugag

SEQ ID NO: 182282 - RNA, 32 nt, Human
gcuugaacccaggagacauggguugcagugag

SEQ ID NO: 182283 - RNA, 32 nt, Human
gcuugaacccaggagacgagguugcagugagc

SEQ ID NO: 182284 - RNA, 32 nt, Human
gcuugaacccaggagacggagguugcagugag

SEQ ID NO: 182285 - RNA, 32 nt, Human
gcuugaacccaggagacggugguugcagugag

SEQ ID NO: 182286 - RNA, 32 nt, Human
gcuugaacccaggagauagagguugcaaugag

SEQ ID NO: 182287 - RNA, 32 nt, Human
gcuugaacccaggagauggaaguugcagugag

SEQ ID NO: 182288 - RNA, 32 nt, Human
gcuugaacccaggagauggagauugcaguagg

SEQ ID NO: 182289 - RNA, 32 nt, Human
gcuugaacccaggagauggagguugcagugag

SEQ ID NO: 182290 - RNA, 32 nt, Human
gcuugaacccaggagauggagguugcggugag

SEQ ID NO: 182291 - RNA, 32 nt, Human
gcuugaacccaggagauugagguuguagugag

SEQ ID NO: 182292 - RNA, 32 nt, Human
gcuugaacccaggaggaagagguugcagugag

SEQ ID NO: 182293 - RNA, 32 nt, Human
gcuugaacccaggaggcagaaguugcagugag

SEQ ID NO: 182294 - RNA, 32 nt, Human
gcuugaacccaggaggcagaggguugcaguga

SEQ ID NO: 182295 - RNA, 32 nt, Human
gcuugaacccaggaggcagagguuacaguaaa

SEQ ID NO: 182296 - RNA, 32 nt, Human
gcuugaacccaggaggcagagguuacagugag

SEQ ID NO: 182297 - RNA, 32 nt, Human
gcuugaacccaggaggcagagguugcaguaag

SEQ ID NO: 182298 - RNA, 32 nt, Human
gcuugaacccaggaggcagagguugcagugag

SEQ ID NO: 182299 - RNA, 32 nt, Human
gcuugaacccaggaggcagagguugcagugca

SEQ ID NO: 182300 - RNA, 32 nt, Human
gcuugaacccaggaggcagagguugcagugcg

SEQ ID NO: 182301 - RNA, 32 nt, Human
gcuugaacccaggaggcagagguuguagugag

SEQ ID NO: 182302 - RNA, 32 nt, Human
gcuugaacccaggaggcagugauugcagugag

SEQ ID NO: 182303 - RNA, 32 nt, Human
gcuugaacccaggaggcgaagguugcaguaaa

SEQ ID NO: 182304 - RNA, 32 nt, Human
gcuugaacccaggaggcggagauugcagugag

SEQ ID NO: 182305 - RNA, 32 nt, Human
gcuugaacccaggaggcggagcuugcagugag

SEQ ID NO: 182306 - RNA, 32 nt, Human
gcuugaacccaggaggcggaggcugcagugag

SEQ ID NO: 182307 - RNA, 32 nt, Human
gcuugaacccaggaggcggagguagcagugag

SEQ ID NO: 182308 - RNA, 32 nt, Human
gcuugaacccaggaggcggagguaguggugag

SEQ ID NO: 182309 - RNA, 32 nt, Human
gcuugaacccaggaggcggagguuacagugag

SEQ ID NO: 182310 - RNA, 32 nt, Human
gcuugaacccaggaggcggagguugcacugag

SEQ ID NO: 182311 - RNA, 32 nt, Human
gcuugaacccaggaggcggagguugcaguaag

SEQ ID NO: 182312 - RNA, 32 nt, Human
gcuugaacccaggaggcggagguugcagugag

SEQ ID NO: 182313 - RNA, 32 nt, Human
gcuugaacccaggaggcggagguugcagugau

SEQ ID NO: 182314 - RNA, 32 nt, Human
gcuugaacccaggaggcggagguugccgugag

SEQ ID NO: 182315 - RNA, 32 nt, Human
gcuugaacccaggaggcggagguugcggugag

SEQ ID NO: 182316 - RNA, 32 nt, Human
gcuugaacccaggaggcggagguuguagugag

SEQ ID NO: 182317 - RNA, 32 nt, Human
gcuugaacccaggaggcggagguuguggugag

SEQ ID NO: 182318 - RNA, 32 nt, Human
gcuugaacccaggaggcggaguuugcagugag

SEQ ID NO: 182319 - RNA, 32 nt, Human
gcuugaacccaggaggcggggguugcagugag

SEQ ID NO: 182320 - RNA, 32 nt, Human
gcuugaacccaggaggcugagguugcagugag

SEQ ID NO: 182321 - RNA, 32 nt, Human
gcuugaacccaggagguagaagcugcagugag

SEQ ID NO: 182322 - RNA, 32 nt, Human
gcuugaacccaggagguagaaguugcagugag

SEQ ID NO: 182323 - RNA, 32 nt, Human
gcuugaacccaggagguagaggcugcagugag

SEQ ID NO: 182324 - RNA, 32 nt, Human
gcuugaacccaggagguagagguugcagugag

SEQ ID NO: 182325 - RNA, 32 nt, Human
gcuugaacccaggaggugaagguugcagugac

SEQ ID NO: 182326 - RNA, 32 nt, Human
gcuugaacccaggaggugcagguugcagugag

SEQ ID NO: 182327 - RNA, 32 nt, Human
gcuugaacccaggagguggaaguugcuuugag

SEQ ID NO: 182328 - RNA, 32 nt, Human
gcuugaacccaggagguggagguagcagugag

SEQ ID NO: 182329 - RNA, 32 nt, Human
gcuugaacccaggagguggagguuacagugag

SEQ ID NO: 182330 - RNA, 32 nt, Human
gcuugaacccaggagguggagguuccagugag

SEQ ID NO: 182331 - RNA, 32 nt, Human
gcuugaacccaggagguggagguugcaaguga

SEQ ID NO: 182332 - RNA, 32 nt, Human
gcuugaacccaggagguggagguugcaguaag

SEQ ID NO: 182333 - RNA, 32 nt, Human
gcuugaacccaggagguggagguugcagugaa

SEQ ID NO: 182334 - RNA, 32 nt, Human
gcuugaacccaggagguggagguugcagugag

SEQ ID NO: 182335 - RNA, 32 nt, Human
gcuugaacccaggagguggagguugcaguggg

SEQ ID NO: 182336 - RNA, 32 nt, Human
gcuugaacccaggagguggagguugcaguuag

SEQ ID NO: 182337 - RNA, 32 nt, Human
gcuugaacccaggagguggagguugcggugag

SEQ ID NO: 182338 - RNA, 32 nt, Human
gcuugaacccaggagguggagguugcugugag

SEQ ID NO: 182339 - RNA, 32 nt, Human
gcuugaacccaggagguggagguuguggugag

SEQ ID NO: 182340 - RNA, 32 nt, Human
gcuugaacccaggagguggaguuugcagugag

SEQ ID NO: 182341 - RNA, 32 nt, Human
gcuugaacccaggagguggggguugcaccgag

SEQ ID NO: 182342 - RNA, 32 nt, Human
gcuugaacccaggagucagagguuucagugag

SEQ ID NO: 182343 - RNA, 32 nt, Human
gcuugaacccaggagucggagguugcagugag

SEQ ID NO: 182344 - RNA, 32 nt, Human
gcuugaacccaggaguucaagucugcagugag

SEQ ID NO: 182345 - RNA, 32 nt, Human
gcuugaacccaguggcggaggcugcagugagc

SEQ ID NO: 182346 - RNA, 32 nt, Human
gcuugaacccggaagguggagguuguugcggu

SEQ ID NO: 182347 - RNA, 32 nt, Human
gcuugaacccggaggcagagguugcagugagc

SEQ ID NO: 182348 - RNA, 32 nt, Human
gcuugaacccgggaggcagaggcugcacucua

SEQ ID NO: 182349 - RNA, 32 nt, Human
gcuugaacccgggaggcagaggcugcagugag

SEQ ID NO: 182350 - RNA, 32 nt, Human
gcuugaacccgggagguagaggcugcaauggg

SEQ ID NO: 182351 - RNA, 32 nt, Human
gcuugaacccgggagguggaggcugcaaugag

SEQ ID NO: 182352 - RNA, 32 nt, Human
gcuugaacccgggagguggaggcugcagcgag

SEQ ID NO: 182353 - RNA, 32 nt, Human
gcuugaacccgggagguggaggcugcagugag

SEQ ID NO: 182354 - RNA, 32 nt, Human
gcuugaacccgggagguggaggcugcggugag

SEQ ID NO: 182355 - RNA, 32 nt, Human
gcuugaacccggggacggagguugcagugaac

SEQ ID NO: 182356 - RNA, 32 nt, Human
gcuugaacccgggggcagaggcugcagugagc

SEQ ID NO: 182357 - RNA, 32 nt, Human
gcuugaaccgggaggcagaaguugcagugagc

SEQ ID NO: 182358 - RNA, 32 nt, Human
gcuugaaccgggaggcggagguugcagugagc

SEQ ID NO: 182359 - RNA, 32 nt, Human
gcuugaaccggggagguggaggcugcagugag

SEQ ID NO: 182360 - RNA, 32 nt, Human
gcuugaaccugagaggugagguugcagugagc

SEQ ID NO: 182361 - RNA, 32 nt, Human
gcuugaaccuggaggcagagauugcagugagc

SEQ ID NO: 182362 - RNA, 32 nt, Human
gcuugaaccuggagguggagguugcagugagc

SEQ ID NO: 182363 - RNA, 32 nt, Human
gcuugaaccugggaagucgaggcugcaaguga

SEQ ID NO: 182364 - RNA, 32 nt, Human
gcuugaaccugggaaguggaggcugcagugag

SEQ ID NO: 182365 - RNA, 32 nt, Human
gcuugaaccugggagauggaggcugcaguaag

SEQ ID NO: 182366 - RNA, 32 nt, Human
gcuugaaccugggaggcugagcuugcagugag

SEQ ID NO: 182367 - RNA, 32 nt, Human
gcuugaaccugggaguuggagguugcagugaa

SEQ ID NO: 182368 - RNA, 18 nt, Human
gcuugaaccugguaggug

SEQ ID NO: 182369 - RNA, 32 nt, Human
gcuugaacucacugcccgcgccucaucucucc

SEQ ID NO: 182370 - RNA, 32 nt, Human
gcuugaacucagaaggcggaggcugcagugag

SEQ ID NO: 182371 - RNA, 32 nt, Human
gcuugaacucaggagguggagguugcggugag

SEQ ID NO: 182372 - RNA, 32 nt, Human
gcuugaacugaggagaugaagguuacagugag

SEQ ID NO: 182373 - RNA, 32 nt, Human
gcuugaacugauuuaaacauuugucaauauac

SEQ ID NO: 182374 - RNA, 32 nt, Human
gcuugaagaacaguaaaucacagcggaaaaua

SEQ ID NO: 182375 - RNA, 32 nt, Human
gcuugaagaguaaccugagauugcaagggagc

SEQ ID NO: 182376 - RNA, 32 nt, Human
gcuugaagauuucagcaaaugugucuuacaga

SEQ ID NO: 182377 - RNA, 32 nt, Human
gcuugaagccagaggcagagguugcaaugagc

SEQ ID NO: 182378 - RNA, 32 nt, Human
gcuugaagccuggaggcggaggcugcacugag

SEQ ID NO: 182379 - RNA, 32 nt, Human
gcuugaagcugcagugagcuaggaucgugcca

SEQ ID NO: 182380 - RNA, 32 nt, Human
gcuugaagcuguuuccuuuacucacauugaag

SEQ ID NO: 182381 - RNA, 32 nt, Human
gcuugaaggacaguugcccuccaggagguucc

SEQ ID NO: 182382 - RNA, 32 nt, Human
gcuugaagggaccggccaugccuccaagccuu

SEQ ID NO: 182383 - RNA, 32 nt, Human
gcuugaaguccuuuuccccaaaaagagggaag

SEQ ID NO: 182384 - RNA, 32 nt, Human
gcuugaagugcaccuugagcagguucuccugg

SEQ ID NO: 182385 - RNA, 32 nt, Human
gcuugaaguggaagaaaaaugaaguuguuuau

SEQ ID NO: 182386 - RNA, 32 nt, Human
gcuugaaguucugcagagauguugauaugccu

SEQ ID NO: 182387 - RNA, 32 nt, Human
gcuugaauaagaaaaacaaauucuuccuccua

SEQ ID NO: 182388 - RNA, 32 nt, Human
gcuugaauccaggaguuagaccagccugggca

SEQ ID NO: 182389 - RNA, 32 nt, Human
gcuugaauuuaauacagacaucuaauguucuc

SEQ ID NO: 182390 - RNA, 32 nt, Human
gcuugacaagaguucagcucaaguugaacaua

SEQ ID NO: 182391 - RNA, 32 nt, Human
gcuugaccauccucugacuuccugggccccua

SEQ ID NO: 182392 - RNA, 32 nt, Human
gcuugacccaggaagcggagguugcagugagc

SEQ ID NO: 182393 - RNA, 32 nt, Human
gcuugacccaggaggcagagguugcagugagc

SEQ ID NO: 182394 - RNA, 32 nt, Human
gcuugacccaggaggcggagguugcggugacc

SEQ ID NO: 182395 - RNA, 32 nt, Human
gcuugaccccaggagguggacauugcagugag

SEQ ID NO: 182396 - RNA, 32 nt, Human
gcuugaccccgggagguggaggcugcagugag

SEQ ID NO: 182397 - RNA, 32 nt, Human
gcuugaccugcucuucacauguggcugcuuaa

SEQ ID NO: 182398 - RNA, 32 nt, Human
gcuugaccugggaggcggagauugcggugagc

SEQ ID NO: 182399 - RNA, 32 nt, Human
gcuugaccuuuccuuguugccguuuuugcuug

SEQ ID NO: 182400 - RNA, 31 nt, Human
gcuugacgcccuuccccuugccccaggccau

SEQ ID NO: 182401 - RNA, 32 nt, Human
gcuugacgggaagcggagguugcagugagccg

SEQ ID NO: 182402 - RNA, 32 nt, Human
gcuugacuccaaagcuuauguguuuuccagua

SEQ ID NO: 182403 - RNA, 32 nt, Human
gcuugacuccaggaggcgcaggcugcagugag

SEQ ID NO: 182404 - RNA, 22 nt, Human
gcuugacuggauuaaagaauac

SEQ ID NO: 182405 - RNA, 32 nt, Human
gcuugacugggcagagccgagccggcuggcug

SEQ ID NO: 182406 - RNA, 23 nt, Human
gcuugacuguuuccauguucucc

SEQ ID NO: 182407 - RNA, 32 nt, Human
gcuugacuucuuuccaguccacguggauauaa

SEQ ID NO: 182408 - RNA, 32 nt, Human
gcuugagaauacucagcuuucccagcaccuac

SEQ ID NO: 182409 - RNA, 32 nt, Human
gcuugagaccagccugggcaacauggugaaac

SEQ ID NO: 182410 - RNA, 32 nt, Human
gcuugagaccagccuggggaacauagugagac

SEQ ID NO: 182411 - RNA, 32 nt, Human
gcuugagaccaggaguuugaggcuucagugag

SEQ ID NO: 182412 - RNA, 32 nt, Human
gcuugagacuaggaguuugaggcugcagugaa

SEQ ID NO: 182413 - RNA, 32 nt, Human
gcuugagacugagaguuggaggcugcgaugag

SEQ ID NO: 182414 - RNA, 32 nt, Human
gcuugagagacacugggacacugucagugcua

SEQ ID NO: 182415 - RNA, 32 nt, Human
gcuugagaggcaggucccuggagaucaucuag

SEQ ID NO: 182416 - RNA, 32 nt, Human
gcuugagaggucuuucaggacugauuuuggug

SEQ ID NO: 182417 - RNA, 32 nt, Human
gcuugagagguugaagcugcagugagcuguga

SEQ ID NO: 182418 - RNA, 32 nt, Human
gcuugagaugaagggaagacucuuaccagaua

SEQ ID NO: 182419 - RNA, 32 nt, Human
gcuugagcagcaauucauauuacugucacagg

SEQ ID NO: 182420 - RNA, 22 nt, Human
gcuugagccaaggaguucaaga

SEQ ID NO: 182421 - RNA, 32 nt, Human
gcuugagccaaugaguuggaggcugcagugag

SEQ ID NO: 182422 - RNA, 32 nt, Human
gcuugagccaggaagguugagguugcagugag

SEQ ID NO: 182423 - RNA, 32 nt, Human
gcuugagccaggaguuuuaaguccagcuuggc

SEQ ID NO: 182424 - RNA, 32 nt, Human
gcuugagccagggaggucaaggcugcagugag

SEQ ID NO: 182425 - RNA, 32 nt, Human
gcuugagcccaagaggcagagguugcaggguc

SEQ ID NO: 182426 - RNA, 32 nt, Human
gcuugagcccaagagguagagguugcagugag

SEQ ID NO: 182427 - RNA, 32 nt, Human
gcuugagcccaagagguggagguuacagugag

SEQ ID NO: 182428 - RNA, 32 nt, Human
gcuugagcccaagagguugaggcugcagugag

SEQ ID NO: 182429 - RNA, 32 nt, Human
gcuugagcccaagaguucgacgcugcagugag

SEQ ID NO: 182430 - RNA, 22 nt, Human
gcuugagcccagaaguuugaga

SEQ ID NO: 182431 - RNA, 32 nt, Human
gcuugagcccagaaguuugaggcugcaaugag

SEQ ID NO: 182432 - RNA, 32 nt, Human
gcuugagcccagaggcggagguugcagugagc

SEQ ID NO: 182433 - RNA, 22 nt, Human
gcuugagcccagagguucgaga

SEQ ID NO: 182434 - RNA, 32 nt, Human
gcuugagcccagcaguuggaggcugcagugag

SEQ ID NO: 182435 - RNA, 32 nt, Human
gcuugagcccaggaagcggagguugcaaugag

SEQ ID NO: 182436 - RNA, 32 nt, Human
gcuugagcccaggaaguggaggcugcagugac

SEQ ID NO: 182437 - RNA, 32 nt, Human
gcuugagcccaggaauucaaggcuucaccgag

SEQ ID NO: 182438 - RNA, 32 nt, Human
gcuugagcccaggaauucaaguguagccuagg

SEQ ID NO: 182439 - RNA, 22 nt, Human
gcuugagcccaggaauuugaga

SEQ ID NO: 182440 - RNA, 32 nt, Human
gcuugagcccaggaauuugagguuguagugag

SEQ ID NO: 182441 - RNA, 32 nt, Human
gcuugagcccaggacaucgaggcugcggugaa

SEQ ID NO: 182442 - RNA, 32 nt, Human
gcuugagcccaggacucuaaggcugcagugag

SEQ ID NO: 182443 - RNA, 32 nt, Human
gcuugagcccaggagaccagguuggagaccag

SEQ ID NO: 182444 - RNA, 32 nt, Human
gcuugagcccaggagagugaggcuaggcaucu

SEQ ID NO: 182445 - RNA, 32 nt, Human
gcuugagcccaggagauugaggcugaggcugc

SEQ ID NO: 182446 - RNA, 22 nt, Human
gcuugagcccaggagcucgaga

SEQ ID NO: 182447 - RNA, 32 nt, Human
gcuugagcccaggagcuggagaucagccuggg

SEQ ID NO: 182448 - RNA, 32 nt, Human
gcuugagcccaggaggcagaggcugcagugag

SEQ ID NO: 182449 - RNA, 32 nt, Human
gcuugagcccaggaggcagagguugcaguaag

SEQ ID NO: 182450 - RNA, 32 nt, Human
gcuugagcccaggaggcagagguugcagugag

SEQ ID NO: 182451 - RNA, 32 nt, Human
gcuugagcccaggaggcggagauugcagugag

SEQ ID NO: 182452 - RNA, 32 nt, Human
gcuugagcccaggaggcggagguugcagugag

SEQ ID NO: 182453 - RNA, 32 nt, Human
gcuugagcccaggaggcugaggcugcagugca

SEQ ID NO: 182454 - RNA, 32 nt, Human
gcuugagcccaggaggucaaggcugcagugag

SEQ ID NO: 182455 - RNA, 32 nt, Human
gcuugagcccaggaggucaaggguacagugag

SEQ ID NO: 182456 - RNA, 32 nt, Human
gcuugagcccaggaggucagggcugcagugag

SEQ ID NO: 182457 - RNA, 32 nt, Human
gcuugagcccaggaggucgaagcugcagugag

SEQ ID NO: 182458 - RNA, 32 nt, Human
gcuugagcccaggaggucgaggcugcagugag

SEQ ID NO: 182459 - RNA, 32 nt, Human
gcuugagcccaggagguggagguugcaaugag

SEQ ID NO: 182460 - RNA, 32 nt, Human
gcuugagcccaggagguggagguugcagugag

SEQ ID NO: 182461 - RNA, 32 nt, Human
gcuugagcccaggagguugaggcugcagugaa

SEQ ID NO: 182462 - RNA, 32 nt, Human
gcuugagcccaggagguugaggcugcagugag

SEQ ID NO: 182463 - RNA, 32 nt, Human
gcuugagcccaggagguugaggucacagugag

SEQ ID NO: 182464 - RNA, 22 nt, Human
gcuugagcccaggagucugaga

SEQ ID NO: 182465 - RNA, 32 nt, Human
gcuugagcccaggaguucaaagcugcagugag

SEQ ID NO: 182466 - RNA, 22 nt, Human
gcuugagcccaggaguucaaga

SEQ ID NO: 182467 - RNA, 32 nt, Human
gcuugagcccaggaguucaagaccggccugag

SEQ ID NO: 182468 - RNA, 32 nt, Human
gcuugagcccaggaguucaagagcagccuggg

SEQ ID NO: 182469 - RNA, 32 nt, Human
gcuugagcccaggaguucaaggaugcagugug

SEQ ID NO: 182470 - RNA, 22 nt, Human
gcuugagcccaggaguucagga

SEQ ID NO: 182471 - RNA, 32 nt, Human
gcuugagcccaggaguucaggaccugccuggg

SEQ ID NO: 182472 - RNA, 32 nt, Human
gcuugagcccaggaguucagggcugcagugag

SEQ ID NO: 182473 - RNA, 22 nt, Human
gcuugagcccaggaguucgaga

SEQ ID NO: 182474 - RNA, 32 nt, Human
gcuugagcccaggaguucgagacuugccuggg

SEQ ID NO: 182475 - RNA, 22 nt, Human
gcuugagcccaggaguucgagg

SEQ ID NO: 182476 - RNA, 32 nt, Human
gcuugagcccaggaguucgaggcugcagucag

SEQ ID NO: 182477 - RNA, 32 nt, Human
gcuugagcccaggaguucgaggcugcagugag

SEQ ID NO: 182478 - RNA, 32 nt, Human
gcuugagcccaggaguugaagaacguggcgaa

SEQ ID NO: 182479 - RNA, 22 nt, Human
gcuugagcccaggaguuggaga

SEQ ID NO: 182480 - RNA, 32 nt, Human
gcuugagcccaggaguuggaggcugaagagag

SEQ ID NO: 182481 - RNA, 32 nt, Human
gcuugagcccaggaguuuaaagcugcagugcc

SEQ ID NO: 182482 - RNA, 22 nt, Human
gcuugagcccaggaguuuaaga

SEQ ID NO: 182483 - RNA, 32 nt, Human
gcuugagcccaggaguuuaagaccugccuggg

SEQ ID NO: 182484 - RNA, 32 nt, Human
gcuugagcccaggaguuuaagguuguagugcg

SEQ ID NO: 182485 - RNA, 20 nt, Human
gcuugagcccaggaguuuga

SEQ ID NO: 182486 - RNA, 32 nt, Human
gcuugagcccaggaguuugaagcugcagugag

SEQ ID NO: 182487 - RNA, 32 nt, Human
gcuugagcccaggaguuugacaccagcauggg

SEQ ID NO: 182488 - RNA, 22 nt, Human
gcuugagcccaggaguuugaga

SEQ ID NO: 182489 - RNA, 32 nt, Human
gcuugagcccaggaguuugagaccagcaugga

SEQ ID NO: 182490 - RNA, 32 nt, Human
gcuugagcccaggaguuugagaccaggcgagg

SEQ ID NO: 182491 - RNA, 32 nt, Human
gcuugagcccaggaguuugagaccgacauggg

SEQ ID NO: 182492 - RNA, 32 nt, Human
gcuugagcccaggaguuugagacuguagugca

SEQ ID NO: 182493 - RNA, 32 nt, Human
gcuugagcccaggaguuugagaucagccuggu

SEQ ID NO: 182494 - RNA, 32 nt, Human
gcuugagcccaggaguuugagccuucagugag

SEQ ID NO: 182495 - RNA, 32 nt, Human
gcuugagcccaggaguuugaggaugcagugag

SEQ ID NO: 182496 - RNA, 32 nt, Human
gcuugagcccaggaguuugaggcuacagugag

SEQ ID NO: 182497 - RNA, 32 nt, Human
gcuugagcccaggaguuugaggcugcagugag

SEQ ID NO: 182498 - RNA, 32 nt, Human
gcuugagcccaggaguuugagggcagccuggg

SEQ ID NO: 182499 - RNA, 32 nt, Human
gcuugagcccaggaguuugagggugaugugca

SEQ ID NO: 182500 - RNA, 32 nt, Human
gcuugagcccaggaguuugagguugcagugag

SEQ ID NO: 182501 - RNA, 32 nt, Human
gcuugagcccaggaguuugagguugcagugca

SEQ ID NO: 182502 - RNA, 32 nt, Human
gcuugagcccaggaguuugagguuguagggag

SEQ ID NO: 182503 - RNA, 32 nt, Human
gcuugagcccaggcaguuggagaccagucugg

SEQ ID NO: 182504 - RNA, 32 nt, Human
gcuugagcccaggcgguugaggcugcagugag

SEQ ID NO: 182505 - RNA, 32 nt, Human
gcuugagcccagggguuugcggcugcagugag

SEQ ID NO: 182506 - RNA, 32 nt, Human
gcuugagcccaguaggucgaggcugcagugag

SEQ ID NO: 182507 - RNA, 32 nt, Human
gcuugagcccaguaguuugaggcugcagcgag

SEQ ID NO: 182508 - RNA, 32 nt, Human
gcuugagcccaugagauugaggcugcagugag

SEQ ID NO: 182509 - RNA, 32 nt, Human
gcuugagccccggaggucgaggcugcaguggg

SEQ ID NO: 182510 - RNA, 32 nt, Human
gcuugagcccgcuugcccaacuccugagaugu

SEQ ID NO: 182511 - RNA, 32 nt, Human
gcuugagcccgggaggcagaggcugcagugaa

SEQ ID NO: 182512 - RNA, 32 nt, Human
gcuugagcccgugaagucgaggcugcagugag

SEQ ID NO: 182513 - RNA, 32 nt, Human
gcuugagcccuagaggucgaggcugcagugag

SEQ ID NO: 182514 - RNA, 32 nt, Human
gcuugagcccuagagguugaggcugcagugag

SEQ ID NO: 182515 - RNA, 32 nt, Human
gcuugagcccugcuuuaauauguagugaaaga

SEQ ID NO: 182516 - RNA, 32 nt, Human
gcuugagcccuggaggucaaggcugcagugag

SEQ ID NO: 182517 - RNA, 32 nt, Human
gcuugagcccuggaguucaaggcugcagugag

SEQ ID NO: 182518 - RNA, 32 nt, Human
gcuugagcccuggaguuggagguugcagugag

SEQ ID NO: 182519 - RNA, 22 nt, Human
gcuugagccgaggaguucaaga

SEQ ID NO: 182520 - RNA, 22 nt, Human
gcuugagccgaggaguucgaga

SEQ ID NO: 182521 - RNA, 32 nt, Human
gcuugagccggggaggaggggguugcagugag

SEQ ID NO: 182522 - RNA, 32 nt, Human
gcuugagccggggagguggaggcugcagugaa

SEQ ID NO: 182523 - RNA, 32 nt, Human
gcuugagccuaggaagucgaggcugcagugag

SEQ ID NO: 182524 - RNA, 32 nt, Human
gcuugagccuaggaggucgaggcugcaguggg

SEQ ID NO: 182525 - RNA, 32 nt, Human
gcuugagccuaggaguugaaggccagccuggg

SEQ ID NO: 182526 - RNA, 32 nt, Human
gcuugagccugaggccuugucgagaagcuucc

SEQ ID NO: 182527 - RNA, 32 nt, Human
gcuugagccugggaagucaagccugcagugag

SEQ ID NO: 182528 - RNA, 32 nt, Human
gcuugagccugggaaguggaggcugcagugag

SEQ ID NO: 182529 - RNA, 32 nt, Human
gcuugagccugggacauugaggcugcagugaa

SEQ ID NO: 182530 - RNA, 32 nt, Human
gcuugagccugggagauugaggcugcacugag

SEQ ID NO: 182531 - RNA, 32 nt, Human
gcuugagccugggagcaaggguugcagugagc

SEQ ID NO: 182532 - RNA, 32 nt, Human
gcuugagccugggagcgcagguugcaaugagc

SEQ ID NO: 182533 - RNA, 32 nt, Human
gcuugagccugggaggcagaggcugcagugag

SEQ ID NO: 182534 - RNA, 32 nt, Human
gcuugagccugggaggucaaggcugcagugag

SEQ ID NO: 182535 - RNA, 32 nt, Human
gcuugagccugggaggucgaggcugcagugag

SEQ ID NO: 182536 - RNA, 32 nt, Human
gcuugagccugggagguugaggcugcagugag

SEQ ID NO: 182537 - RNA, 32 nt, Human
gcuugagccugggaguuugaggcugcagugag

SEQ ID NO: 182538 - RNA, 32 nt, Human
gcuugagccugugaggucgaggcugcagugag

SEQ ID NO: 182539 - RNA, 32 nt, Human
gcuugagcucacacucaaagaucagaggaccu

SEQ ID NO: 182540 - RNA, 23 nt, Human
gcuugagcucagagaguucgaga

SEQ ID NO: 182541 - RNA, 32 nt, Human
gcuugagcucaggagguugaggcugcagagag

SEQ ID NO: 182542 - RNA, 22 nt, Human
gcuugagcucaggaguuagaga

SEQ ID NO: 182543 - RNA, 22 nt, Human
gcuugagcucaggaguucaaga

SEQ ID NO: 182544 - RNA, 32 nt, Human
gcuugagcucaggaguucaaggcugcagagag

SEQ ID NO: 182545 - RNA, 22 nt, Human
gcuugagcucaggaguucgaga

SEQ ID NO: 182546 - RNA, 32 nt, Human
gcuugagcucaggaguucgagagcagccuggg

SEQ ID NO: 182547 - RNA, 22 nt, Human
gcuugagcucaggaguucguga

SEQ ID NO: 182548 - RNA, 32 nt, Human
gcuugagcucaggaguuugaagccugcuuggg

SEQ ID NO: 182549 - RNA, 22 nt, Human
gcuugagcucaggaguuugaga

SEQ ID NO: 182550 - RNA, 32 nt, Human
gcuugagcucaggaguuugagaccagcugggc

SEQ ID NO: 182551 - RNA, 32 nt, Human
gcuugagcucaggaguuugagaccaggcuggg

SEQ ID NO: 182552 - RNA, 32 nt, Human
gcuugagcucagggggccaaggcugcagugag

SEQ ID NO: 182553 - RNA, 32 nt, Human
gcuugagcucggaagauggaggcugcagugag

SEQ ID NO: 182554 - RNA, 32 nt, Human
gcuugagcugcagaaacugagaccagaccucu

SEQ ID NO: 182555 - RNA, 32 nt, Human
gcuugagcuggguggggugaggggugagcagc

SEQ ID NO: 182556 - RNA, 32 nt, Human
gcuugagcuucccucugccugcccguggaagg

SEQ ID NO: 182557 - RNA, 32 nt, Human
gcuugagcuugggaagucgaggcugcagucag

SEQ ID NO: 182558 - RNA, 32 nt, Human
gcuugagcuuuggaaucagacugcccacauuc

SEQ ID NO: 182559 - RNA, 20 nt, Human
gcuugaggaaagaaauucug

SEQ ID NO: 182560 - RNA, 32 nt, Human
gcuugaggaggaaccugucuuuaaagcugucc

SEQ ID NO: 182561 - RNA, 32 nt, Human
gcuugaggccagccugggcaacauagugagac

SEQ ID NO: 182562 - RNA, 32 nt, Human
gcuugaggccaggaguuagagacugcagugag

SEQ ID NO: 182563 - RNA, 32 nt, Human
gcuugaggccaggaguuuaaguuacagaacua

SEQ ID NO: 182564 - RNA, 32 nt, Human
gcuugaggcccagagucugaggcugcgguaag

SEQ ID NO: 182565 - RNA, 22 nt, Human
gcuugaggccccgauggacucc

SEQ ID NO: 182566 - RNA, 32 nt, Human
gcuugagggaggaggaagagauagaggaggag

SEQ ID NO: 182567 - RNA, 32 nt, Human
gcuugaggggaggggcaagugggacccugcca

SEQ ID NO: 182568 - RNA, 32 nt, Human
gcuugaggucugggaggguggcccuggccagc

SEQ ID NO: 182569 - RNA, 32 nt, Human
gcuugaguaucagcuaugcugaaggaaaagac

SEQ ID NO: 182570 - RNA, 32 nt, Human
gcuugaguccaggagguugaggcugcagucag

SEQ ID NO: 182571 - RNA, 32 nt, Human
gcuugaguccaggaguucaaggcugcagugag

SEQ ID NO: 182572 - RNA, 32 nt, Human
gcuugaguccaggaguucacugcacugagcug

SEQ ID NO: 182573 - RNA, 32 nt, Human
gcuugaguccaggaguuugagacuagccugau

SEQ ID NO: 182574 - RNA, 32 nt, Human
gcuugaguccaggaguuugagguuacagugau

SEQ ID NO: 182575 - RNA, 32 nt, Human
gcuugagucccaugccuccacccugccaucug

SEQ ID NO: 182576 - RNA, 32 nt, Human
gcuugagucugugagccagugucugccuauag

SEQ ID NO: 182577 - RNA, 32 nt, Human
gcuugagugcaagaguuugaggcugcagagag

SEQ ID NO: 182578 - RNA, 32 nt, Human
gcuugagugcaggaguuugagaccagccuggg

SEQ ID NO: 182579 - RNA, 32 nt, Human
gcuugaguguguuguguuaugcccagaacagg

SEQ ID NO: 182580 - RNA, 32 nt, Human
gcuugauagaaucacccccaccuggaggggcu

SEQ ID NO: 182581 - RNA, 24 nt, Human
gcuugauccgccgccugcugcacc

SEQ ID NO: 182582 - RNA, 32 nt, Human
gcuugaucucaggagguugaggcugcagugaa

SEQ ID NO: 182583 - RNA, 32 nt, Human
gcuugaucucggcucacuauaaccuccaccuc

SEQ ID NO: 182584 - RNA, 32 nt, Human
gcuugaucuggacacccccucgcccagauugc

SEQ ID NO: 182585 - RNA, 31 nt, Human
gcuugaugacuucuuuugcucucaaaguucc

SEQ ID NO: 182586 - RNA, 17 nt, Human
gcuugaugcuggccagg

SEQ ID NO: 182587 - RNA, 18 nt, Human
gcuugauggucaguguga

SEQ ID NO: 182588 - RNA, 32 nt, Human
gcuugaugugugugcaauguacauacuugaua

SEQ ID NO: 182589 - RNA, 32 nt, Human
gcuugauuaugucaccagacucuuucagcaug

SEQ ID NO: 182590 - RNA, 32 nt, Human
gcuugauugucuccccuucaagccccugcccu

SEQ ID NO: 182591 - RNA, 32 nt, Human
gcuugauuugccuggugaccaaauuacuagug

SEQ ID NO: 182592 - RNA, 32 nt, Human
gcuugauuugccuggugaccgaauuacuagug

SEQ ID NO: 182593 - RNA, 24 nt, Human
gcuugcaaaaaguauguuauugcc

SEQ ID NO: 182594 - RNA, 21 nt, Human
gcuugcaaaacccgccuccag

SEQ ID NO: 182595 - RNA, 32 nt, Human
gcuugcaaaguuggcccuuggcuggcaucugg

SEQ ID NO: 182596 - RNA, 32 nt, Human
gcuugcaagaagcaggaaggggaauggaauag

SEQ ID NO: 182597 - RNA, 32 nt, Human
gcuugcaauagggauuuuaaaauacacuaacu

SEQ ID NO: 182598 - RNA, 32 nt, Human
gcuugcacacaugcacacagaccacauagcac

SEQ ID NO: 182599 - RNA, 32 nt, Human
gcuugcacagaucagaccgagaagcaggguga

SEQ ID NO: 182600 - RNA, 32 nt, Human
gcuugcacaggcugugcacagccuugcagaug

SEQ ID NO: 182601 - RNA, 32 nt, Human
gcuugcaccauugcacuccagccugggcgaca

SEQ ID NO: 182602 - RNA, 32 nt, Human
gcuugcacccaggagguggagguugcagugag

SEQ ID NO: 182603 - RNA, 19 nt, Human
gcuugcaccugcagccccg

SEQ ID NO: 182604 - RNA, 32 nt, Human
gcuugcaccuguaaucccagcacuuugggagg

SEQ ID NO: 182605 - RNA, 32 nt, Human
gcuugcacgguggcucacgccuguaaucccag

SEQ ID NO: 182606 - RNA, 32 nt, Human
gcuugcacuacugcacuccagccugggugaca

SEQ ID NO: 182607 - RNA, 20 nt, Human
gcuugcacugcccaauccca

SEQ ID NO: 182608 - RNA, 32 nt, Human
gcuugcagacaagugccuucucaauguguccu

SEQ ID NO: 182609 - RNA, 32 nt, Human
gcuugcagagugggugacagagccacggagcu

SEQ ID NO: 182610 - RNA, 32 nt, Human
gcuugcagcaacuugauuuccccaaguccugu

SEQ ID NO: 182611 - RNA, 32 nt, Human
gcuugcaggccccagcccuguuccaaucaaug

SEQ ID NO: 182612 - RNA, 32 nt, Human
gcuugcaguauagugagaaaagccugccaagu

SEQ ID NO: 182613 - RNA, 32 nt, Human
gcuugcaguccagugagguggacagaccuguc

SEQ ID NO: 182614 - RNA, 32 nt, Human
gcuugcagugagcugggauugcaucacugcac

SEQ ID NO: 182615 - RNA, 32 nt, Human
gcuugcaucccccaucccuuguucacacgccc

SEQ ID NO: 182616 - RNA, 20 nt, Human
gcuugcaucccucagaugca

SEQ ID NO: 182617 - RNA, 32 nt, Human
gcuugcaugaaccucccuucuggcccccucca

SEQ ID NO: 182618 - RNA, 32 nt, Human
gcuugcauuuugguggaggaagacagacaaaa

SEQ ID NO: 182619 - RNA, 32 nt, Human
gcuugccaggaggcuggcaguacagagugcag

SEQ ID NO: 182620 - RNA, 32 nt, Human
gcuugccauccagccaagcugcucgaggcccu

SEQ ID NO: 182621 - RNA, 32 nt, Human
gcuugccauuugcacuuuucaaaugccuuugg

SEQ ID NO: 182622 - RNA, 32 nt, Human
gcuugcccaaaaggcuggagagggcagggagc

SEQ ID NO: 182623 - RNA, 32 nt, Human
gcuugcccauuuacagaugagaaggcugauau

SEQ ID NO: 182624 - RNA, 32 nt, Human
gcuugccccacucugccugccugcuguugguc

SEQ ID NO: 182625 - RNA, 32 nt, Human
gcuugccccagccuguaccccagccccugcag

SEQ ID NO: 182626 - RNA, 32 nt, Human
gcuugcccggcugcagagcagagaugugcagc

SEQ ID NO: 182627 - RNA, 32 nt, Human
gcuugcccugcuggccucucaucccccuucuu

SEQ ID NO: 182628 - RNA, 32 nt, Human
gcuugcccugcugugaacuugcacuuggagcc

SEQ ID NO: 182629 - RNA, 17 nt, Human
gcuugccguggguccag

SEQ ID NO: 182630 - RNA, 32 nt, Human
gcuugccuagguaguaucagcacuggggugag

SEQ ID NO: 182631 - RNA, 32 nt, Human
gcuugccucacacccacccacaucacaggaug

SEQ ID NO: 182632 - RNA, 32 nt, Human
gcuugccuccacucccuucugacuuuccagac

SEQ ID NO: 182633 - RNA, 32 nt, Human
gcuugccucccaggccccuuguggacuuagac

SEQ ID NO: 182634 - RNA, 32 nt, Human
gcuugccucccagguaccccaguguggccugc

SEQ ID NO: 182635 - RNA, 32 nt, Human
gcuugccuccccucggauuuggaguguccguu

SEQ ID NO: 182636 - RNA, 32 nt, Human
gcuugccugcacuccauccugucugcaacgcu

SEQ ID NO: 182637 - RNA, 22 nt, Human
gcuugccugcagcucucagggu

SEQ ID NO: 182638 - RNA, 32 nt, Human
gcuugccugcaggaucagaaaaguuugagaaa

SEQ ID NO: 182639 - RNA, 32 nt, Human
gcuugccugccaacccucagagucacauacac

SEQ ID NO: 182640 - RNA, 21 nt, Human
gcuugccuggaguucagggca

SEQ ID NO: 182641 - RNA, 32 nt, Human
gcuugccugggcagauguaggcaggggcuaga

SEQ ID NO: 182642 - RNA, 32 nt, Human
gcuugccugguccccucuccucuccgcccucc

SEQ ID NO: 182643 - RNA, 32 nt, Human
gcuugccuguaaucccagcacuuugggaggcc

SEQ ID NO: 182644 - RNA, 19 nt, Human
gcuugccuguaucccagcu

SEQ ID NO: 182645 - RNA, 32 nt, Human
gcuugccuguaucccagcuacucaggaagcug

SEQ ID NO: 182646 - RNA, 32 nt, Human
gcuugccuuaggauggggccaggaggccaggc

SEQ ID NO: 182647 - RNA, 32 nt, Human
gcuugccuugcaacagugccugcgggaccugc

SEQ ID NO: 182648 - RNA, 32 nt, Human
gcuugccuuuccucccuccacaacaggacgcu

SEQ ID NO: 182649 - RNA, 32 nt, Human
gcuugccuuuggcuuuccccaggauuucuguc

SEQ ID NO: 182650 - RNA, 32 nt, Human
gcuugccuuuuccuccuccucacagaggagau

SEQ ID NO: 182651 - RNA, 32 nt, Human
gcuugcgacccuccucucaggcugcuucugac

SEQ ID NO: 182652 - RNA, 20 nt, Human
gcuugcgaggagcgcagggu

SEQ ID NO: 182653 - RNA, 32 nt, Human
gcuugcgggaggcgguggggcaugggaggaag

SEQ ID NO: 182654 - RNA, 19 nt, Human
gcuugcgugcugcugggcc

SEQ ID NO: 182655 - RNA, 32 nt, Human
gcuugcuaccucagcccauccccaccaccccu

SEQ ID NO: 182656 - RNA, 32 nt, Human
gcuugcuagggagcuugaaucuuuucuuuuua

SEQ ID NO: 182657 - RNA, 32 nt, Human
gcuugcuaggucagaaugagagacuggugggu

SEQ ID NO: 182658 - RNA, 31 nt, Human
gcuugcuaucaaugccuacucacuuaaaaga

SEQ ID NO: 182659 - RNA, 32 nt, Human
gcuugcucacaucuuggcacauuuaagagaca

SEQ ID NO: 182660 - RNA, 32 nt, Human
gcuugcuccaauuuuccaucugcucucucuuc

SEQ ID NO: 182661 - RNA, 20 nt, Human
gcuugcuccccucacugcag

SEQ ID NO: 182662 - RNA, 32 nt, Human
gcuugcucucucucaccaugugacacacuggc

SEQ ID NO: 182663 - RNA, 32 nt, Human
gcuugcucucuuccuucucauucaagaaaccu

SEQ ID NO: 182664 - RNA, 32 nt, Human
gcuugcugaaacccaggagcugaacagugagg

SEQ ID NO: 182665 - RNA, 32 nt, Human
gcuugcugauuggaugguguggggaagggaua

SEQ ID NO: 182666 - RNA, 32 nt, Human
gcuugcugcagaaaccuggccuacggaagaua

SEQ ID NO: 182667 - RNA, 32 nt, Human
gcuugcugcagccucaaccuccugggcucacg

SEQ ID NO: 182668 - RNA, 32 nt, Human
gcuugcugcccuaggauguccucuguucugag

SEQ ID NO: 182669 - RNA, 32 nt, Human
gcuugcuggaaacugugggaggaugugugaau

SEQ ID NO: 182670 - RNA, 29 nt, Human
gcuugcuggcugcccucuuugccuucugg

SEQ ID NO: 182671 - RNA, 32 nt, Human
gcuugcugggcuggggacuggaggggaacgug

SEQ ID NO: 182672 - RNA, 32 nt, Human
gcuugcugggugacccugggugaguggcuucc

SEQ ID NO: 182673 - RNA, 32 nt, Human
gcuugcugggugcugagugcagggggugccuu

SEQ ID NO: 182674 - RNA, 32 nt, Human
gcuugcugguuuugcuugcaucugaugaguag

SEQ ID NO: 182675 - RNA, 32 nt, Human
gcuugcuguaguggaagagcucagggaagagc

SEQ ID NO: 182676 - RNA, 32 nt, Human
gcuugcuguggaccacaggcaccgcaggauaa

SEQ ID NO: 182677 - RNA, 32 nt, Human
gcuugcugugugaccuuggguaagucccuuga

SEQ ID NO: 182678 - RNA, 32 nt, Human
gcuugcuuagauaacuccacacugugaugccu

SEQ ID NO: 182679 - RNA, 32 nt, Human
gcuugcuucagcugcagccugccugugcuggc

SEQ ID NO: 182680 - RNA, 32 nt, Human
gcuugcuuccugguaaccagcucucuuaucuc

SEQ ID NO: 182681 - RNA, 32 nt, Human
gcuugcuugauagacaucucuuacagugagac

SEQ ID NO: 182682 - RNA, 32 nt, Human
gcuugcuugcuggccggccugccugccugccu

SEQ ID NO: 182683 - RNA, 32 nt, Human
gcuugcuugguaugcuuaccugggcuugugua

SEQ ID NO: 182684 - RNA, 32 nt, Human
gcuugcuuuccuccucccuccuuuuuauuuuc

SEQ ID NO: 182685 - RNA, 32 nt, Human
gcuugcuuuugccucugcccaaccagguugca

SEQ ID NO: 182686 - RNA, 32 nt, Human
gcuuggaacagaggccuuggcugcuccgcagu

SEQ ID NO: 182687 - RNA, 32 nt, Human
gcuuggaacagggccagagccccacaugagau

SEQ ID NO: 182688 - RNA, 32 nt, Human
gcuuggaaccucugaagguggggagcggaaca

SEQ ID NO: 182689 - RNA, 23 nt, Human
gcuuggaagacgcugccuucccc

SEQ ID NO: 182690 - RNA, 32 nt, Human
gcuuggaagagauucuuggcagagagaagagg

SEQ ID NO: 182691 - RNA, 18 nt, Human
gcuuggacagcaaggugg

SEQ ID NO: 182692 - RNA, 17 nt, Human
gcuuggacagcaagugg

SEQ ID NO: 182693 - RNA, 24 nt, Human
gcuuggacagcuagagcacauccu

SEQ ID NO: 182694 - RNA, 23 nt, Human
gcuuggacaugaagacccucccc

SEQ ID NO: 182695 - RNA, 32 nt, Human
gcuuggacccuggagguagaggcugcagugag

SEQ ID NO: 182696 - RNA, 32 nt, Human
gcuuggacccuggugggcugagugcuccgagg

SEQ ID NO: 182697 - RNA, 32 nt, Human
gcuuggaccuaggagguggagguugcagugag

SEQ ID NO: 182698 - RNA, 32 nt, Human
gcuuggacggcagagucagagaucuccagucc

SEQ ID NO: 182699 - RNA, 29 nt, Human
gcuuggacuccagagguggagguugcagu

SEQ ID NO: 182700 - RNA, 32 nt, Human
gcuuggacugauucccagucuccugggucaag

SEQ ID NO: 182701 - RNA, 32 nt, Human
gcuuggacuugcccaucuagcacuuuggaaau

SEQ ID NO: 182702 - RNA, 23 nt, Human
gcuuggacuuuucugacuucccc

SEQ ID NO: 182703 - RNA, 32 nt, Human
gcuuggagaccucccucucagucaacagcuga

SEQ ID NO: 182704 - RNA, 32 nt, Human
gcuuggagagggagacagggccagacauguuc

SEQ ID NO: 182705 - RNA, 32 nt, Human
gcuuggaguaagggaggguggccucucugugg

SEQ ID NO: 182706 - RNA, 32 nt, Human
gcuuggaguuucugcuggucuugggccagccg

SEQ ID NO: 182707 - RNA, 32 nt, Human
gcuuggauaacaacugcacuccagccuggaug

SEQ ID NO: 182708 - RNA, 32 nt, Human
gcuuggauaccagcuucaugcaccuucuaguu

SEQ ID NO: 182709 - RNA, 32 nt, Human
gcuuggaugaauggucuucagagcgugguccc

SEQ ID NO: 182710 - RNA, 18 nt, Human
gcuuggaugccaaaggga

SEQ ID NO: 182711 - RNA, 32 nt, Human
gcuuggauguuucuuuugcauguugccuagca

SEQ ID NO: 182712 - RNA, 17 nt, Human
gcuuggauuacagguga

SEQ ID NO: 182713 - RNA, 32 nt, Human
gcuuggauugagggguuggagaggagccauuu

SEQ ID NO: 182714 - RNA, 32 nt, Human
gcuuggcaaaacuguccagcaaaaugaaaaga

SEQ ID NO: 182715 - RNA, 32 nt, Human
gcuuggcaaccagggaugaagcauccguucau

SEQ ID NO: 182716 - RNA, 32 nt, Human
gcuuggcacacagcaggcuuucaagaagugcc

SEQ ID NO: 182717 - RNA, 32 nt, Human
gcuuggcacaggaaguuccccuuuguagcuaa

SEQ ID NO: 182718 - RNA, 27 nt, Human
gcuuggcacaggccacaucugccccaa

SEQ ID NO: 182719 - RNA, 17 nt, Human
gcuuggcacccaccucu

SEQ ID NO: 182720 - RNA, 17 nt, Human
gcuuggcacuccaccuu

SEQ ID NO: 182721 - RNA, 32 nt, Human
gcuuggcacugaggucccuggcgucccugguu

SEQ ID NO: 182722 - RNA, 32 nt, Human
gcuuggcacugccuuuuccuuucucaggccaa

SEQ ID NO: 182723 - RNA, 32 nt, Human
gcuuggcagcugaacuauuggagggugggaga

SEQ ID NO: 182724 - RNA, 32 nt, Human
gcuuggcagcuggaccaagggagccagucuug

SEQ ID NO: 182725 - RNA, 19 nt, Human
gcuuggcaggcugggccuc

SEQ ID NO: 182726 - RNA, 32 nt, Human
gcuuggcaggugucgggggaaugggccagaug

SEQ ID NO: 182727 - RNA, 32 nt, Human
gcuuggcauacagcaggagcccaguaaauguu

SEQ ID NO: 182728 - RNA, 32 nt, Human
gcuuggccaggugaggaugaggcagggcagac

SEQ ID NO: 182729 - RNA, 32 nt, Human
gcuuggccagucuuugccuuucauccuguaaa

SEQ ID NO: 182730 - RNA, 32 nt, Human
gcuuggccaguguggagaggaaaggagccaca

SEQ ID NO: 182731 - RNA, 32 nt, Human
gcuuggcccaggaguucauaaccagccuggau

SEQ ID NO: 182732 - RNA, 18 nt, Human
gcuuggccccagccucca

SEQ ID NO: 182733 - RNA, 32 nt, Human
gcuuggcccccgcgcuccccucccucuccacu

SEQ ID NO: 182734 - RNA, 32 nt, Human
gcuuggccccuccagccagucccauucgggaa

SEQ ID NO: 182735 - RNA, 32 nt, Human
gcuuggcccugccaccuuccuccaggggaggg

SEQ ID NO: 182736 - RNA, 32 nt, Human
gcuuggcccuggcccuggcccagaucuuagau

SEQ ID NO: 182737 - RNA, 16 nt, Human
gcuuggccuagagugg

SEQ ID NO: 182738 - RNA, 32 nt, Human
gcuuggccuagauccagccaccacucugaaac

SEQ ID NO: 182739 - RNA, 32 nt, Human
gcuuggccuccaacaucccuugccugcugcca

SEQ ID NO: 182740 - RNA, 32 nt, Human
gcuuggccuccaccaccucccacgcuucugag

SEQ ID NO: 182741 - RNA, 32 nt, Human
gcuuggccucucucuguuccucccucugcacc

SEQ ID NO: 182742 - RNA, 32 nt, Human
gcuuggccucuggcuccaucugaguccccugg

SEQ ID NO: 182743 - RNA, 32 nt, Human
gcuuggcgaaacugaggucucauggagaagcc

SEQ ID NO: 182744 - RNA, 32 nt, Human
gcuuggcgaaugcacgucugccugagaacccc

SEQ ID NO: 182745 - RNA, 32 nt, Human
gcuuggcggcuguggaggcgagugggccacgu

SEQ ID NO: 182746 - RNA, 18 nt, Human
gcuuggcguccacccugc

SEQ ID NO: 182747 - RNA, 32 nt, Human
gcuuggcguccagcaaugaaggcuggagaaug

SEQ ID NO: 182748 - RNA, 32 nt, Human
gcuuggcuacaguguaauuccucuccuuguuc

SEQ ID NO: 182749 - RNA, 32 nt, Human
gcuuggcucacaaggcccaggagaccuccagc

SEQ ID NO: 182750 - RNA, 32 nt, Human
gcuuggcucaccgcaaccuccgccucccgggu

SEQ ID NO: 182751 - RNA, 32 nt, Human
gcuuggcucacugccaccccucuuugguccag

SEQ ID NO: 182752 - RNA, 32 nt, Human
gcuuggcucacugcuaccuccgccucccaggu

SEQ ID NO: 182753 - RNA, 32 nt, Human
gcuuggcucaggauguguucugggcuugcaag

SEQ ID NO: 182754 - RNA, 32 nt, Human
gcuuggcuccacccauuuccuugaccuggaau

SEQ ID NO: 182755 - RNA, 32 nt, Human
gcuuggcucccaggagcuccaggacagcccuc

SEQ ID NO: 182756 - RNA, 32 nt, Human
gcuuggcucccucugcugaucucaguuuccug

SEQ ID NO: 182757 - RNA, 32 nt, Human
gcuuggcugagaggagggggagaaggagggga

SEQ ID NO: 182758 - RNA, 32 nt, Human
gcuuggcugccuggccagggccgggggcucag

SEQ ID NO: 182759 - RNA, 31 nt, Human
gcuuggcugcgcuucugacagggcaggccgu

SEQ ID NO: 182760 - RNA, 31 nt, Human
gcuuggcugcuucuggggccuguguggcccu

SEQ ID NO: 182761 - RNA, 32 nt, Human
gcuuggcugucccuguagcccagccugcaccu

SEQ ID NO: 182762 - RNA, 32 nt, Human
gcuuggcuguucugcugcaccugaaugcuuuc

SEQ ID NO: 182763 - RNA, 32 nt, Human
gcuuggcuguuuagugguuuggagcauaguga

SEQ ID NO: 182764 - RNA, 32 nt, Human
gcuuggcuguuuccuguuuucucccgauugcu

SEQ ID NO: 182765 - RNA, 32 nt, Human
gcuuggcuuggguggcggguucauggccaguu

SEQ ID NO: 182766 - RNA, 32 nt, Human
gcuugggaaaacugcauugacuccaggacucc

SEQ ID NO: 182767 - RNA, 20 nt, Human
gcuugggaaauaaggcucug

SEQ ID NO: 182768 - RNA, 32 nt, Human
gcuugggaaaucaagguugcagugagcuauga

SEQ ID NO: 182769 - RNA, 21 nt, Human
gcuugggaaauuauggauucu

SEQ ID NO: 182770 - RNA, 19 nt, Human
gcuugggaaugugauuuug

SEQ ID NO: 182771 - RNA, 32 nt, Human
gcuugggacuacaggcgugugccaccaguccu

SEQ ID NO: 182772 - RNA, 31 nt, Human
gcuugggacucaaggccacucacuuaauacc

SEQ ID NO: 182773 - RNA, 32 nt, Human
gcuugggacuccugucuuuccagcaugcccug

SEQ ID NO: 182774 - RNA, 32 nt, Human
gcuugggacuggggcugcgagugagcaccagc

SEQ ID NO: 182775 - RNA, 31 nt, Human
gcuugggagagaccuguggcaccagguugga

SEQ ID NO: 182776 - RNA, 32 nt, Human
gcuugggagaucgaggcuacagugagcuauga

SEQ ID NO: 182777 - RNA, 20 nt, Human
gcuugggagccagccugcca

SEQ ID NO: 182778 - RNA, 32 nt, Human
gcuugggagccccuggccccagccuccaugcu

SEQ ID NO: 182779 - RNA, 30 nt, Human
gcuugggaggaccauggggcacaaugcggu

SEQ ID NO: 182780 - RNA, 32 nt, Human
gcuugggaggcugaagugggaggaucccuuga

SEQ ID NO: 182781 - RNA, 32 nt, Human
gcuugggaggcugaggcacgagaaucacuuga

SEQ ID NO: 182782 - RNA, 32 nt, Human
gcuugggaggcugaggcagagaauugcuugaa

SEQ ID NO: 182783 - RNA, 32 nt, Human
gcuugggaggcugaggcaggagaaucacuuga

SEQ ID NO: 182784 - RNA, 32 nt, Human
gcuugggaggcugaggcaggagaaucgcuuga

SEQ ID NO: 182785 - RNA, 32 nt, Human
gcuugggaggcugaggcaguagaaucacuuga

SEQ ID NO: 182786 - RNA, 32 nt, Human
gcuugggaggcugagggcaggagaauugcuug

SEQ ID NO: 182787 - RNA, 32 nt, Human
gcuugggaggcugagguaggaggaucacuugg

SEQ ID NO: 182788 - RNA, 32 nt, Human
gcuugggaggcugaggugaggaucacuugagc

SEQ ID NO: 182789 - RNA, 32 nt, Human
gcuugggaggcugaggugggaggaucacuuga

SEQ ID NO: 182790 - RNA, 32 nt, Human
gcuugggaggcugagguugcaggaucgcuuga

SEQ ID NO: 182791 - RNA, 32 nt, Human
gcuugggaggucgaggcugcagugagucauga

SEQ ID NO: 182792 - RNA, 32 nt, Human
gcuugggaucuucaaugaacugugcuuuucgc

SEQ ID NO: 182793 - RNA, 18 nt, Human
gcuugggcaacaaaguga

SEQ ID NO: 182794 - RNA, 18 nt, Human
gcuugggcaacacaguga

SEQ ID NO: 182795 - RNA, 18 nt, Human
gcuugggcaacagaguga

SEQ ID NO: 182796 - RNA, 18 nt, Human
gcuugggcaacagggcga

SEQ ID NO: 182797 - RNA, 18 nt, Human
gcuugggcaacauaguga

SEQ ID NO: 182798 - RNA, 32 nt, Human
gcuugggcacugcugucuacugaccccaaccc

SEQ ID NO: 182799 - RNA, 32 nt, Human
gcuugggcauugccaccagcuguggacugaac

SEQ ID NO: 182800 - RNA, 20 nt, Human
gcuugggccagcggcggcgg

SEQ ID NO: 182801 - RNA, 32 nt, Human
gcuugggccaggaguuugagaccagccuggcc

SEQ ID NO: 182802 - RNA, 32 nt, Human
gcuugggccaucugcacuuuucccaaggcccu

SEQ ID NO: 182803 - RNA, 32 nt, Human
gcuugggcccagcugggcucugccacccuacc

SEQ ID NO: 182804 - RNA, 32 nt, Human
gcuugggcccaggagauggagguugcggugag

SEQ ID NO: 182805 - RNA, 32 nt, Human
gcuugggcccaggagauggaugcugcgggaag

SEQ ID NO: 182806 - RNA, 32 nt, Human
gcuugggcccaggaggucgaggcugcggugag

SEQ ID NO: 182807 - RNA, 32 nt, Human
gcuugggcccaggagguggagguugcagugag

SEQ ID NO: 182808 - RNA, 32 nt, Human
gcuugggcccaggaguucaacgcugcagugag

SEQ ID NO: 182809 - RNA, 32 nt, Human
gcuugggcccaggaguucaaggccagccuggg

SEQ ID NO: 182810 - RNA, 32 nt, Human
gcuugggcccaggaguucaaggcugcagugag

SEQ ID NO: 182811 - RNA, 32 nt, Human
gcuugggcccucagaccggggacagcaggagg

SEQ ID NO: 182812 - RNA, 32 nt, Human
gcuugggcccuggaggucaaggcugcagugag

SEQ ID NO: 182813 - RNA, 32 nt, Human
gcuugggccgugacuuaggcagaggagugcag

SEQ ID NO: 182814 - RNA, 32 nt, Human
gcuugggccugggaggucgaggcugcagugag

SEQ ID NO: 182815 - RNA, 18 nt, Human
gcuugggcgacagagcga

SEQ ID NO: 182816 - RNA, 18 nt, Human
gcuugggcgacggaguga

SEQ ID NO: 182817 - RNA, 32 nt, Human
gcuugggcucaagcuaucugucugccuugggu

SEQ ID NO: 182818 - RNA, 32 nt, Human
gcuugggcucaggaaguuucucugugcaacua

SEQ ID NO: 182819 - RNA, 32 nt, Human
gcuugggcuccaggagggaggcugggaggcag

SEQ ID NO: 182820 - RNA, 32 nt, Human
gcuugggcuggaggggugucagaggaagcuga

SEQ ID NO: 182821 - RNA, 32 nt, Human
gcuugggcuggcgggcccuggagcucaagccg

SEQ ID NO: 182822 - RNA, 32 nt, Human
gcuugggcugugcagggcucuuugaggugggu

SEQ ID NO: 182823 - RNA, 32 nt, Human
gcuuggggaacgaggagcaggacgcggccucg

SEQ ID NO: 182824 - RNA, 30 nt, Human
gcuuggggaagccaauggggcacaauccuu

SEQ ID NO: 182825 - RNA, 32 nt, Human
gcuuggggacuuccuucgucagcacuggcuuu

SEQ ID NO: 182826 - RNA, 32 nt, Human
gcuuggggaugugcuuggagaggcagauaacg

SEQ ID NO: 182827 - RNA, 32 nt, Human
gcuuggggcagagacagcauggggaaggaggu

SEQ ID NO: 182828 - RNA, 24 nt, Human
gcuuggggcccccgucugcugcug

SEQ ID NO: 182829 - RNA, 24 nt, Human
gcuuggggccccugucugcugcug

SEQ ID NO: 182830 - RNA, 32 nt, Human
gcuuggggcgcuggcaccuccucuuacagcuu

SEQ ID NO: 182831 - RNA, 23 nt, Human
gcuuggggcucacgccuguaauc

SEQ ID NO: 182832 - RNA, 32 nt, Human
gcuuggggcucacgccuguaaucccagcacuu

SEQ ID NO: 182833 - RNA, 32 nt, Human
gcuuggggcugaugaaaggagcuguccgcgcc

SEQ ID NO: 182834 - RNA, 32 nt, Human
gcuugggggaaaagagguggauuccugggcaa

SEQ ID NO: 182835 - RNA, 32 nt, Human
gcuugggggugggaggugaggaaaaucugagg

SEQ ID NO: 182836 - RNA, 31 nt, Human
gcuugggggugugcaggcacagcagauggcc

SEQ ID NO: 182837 - RNA, 19 nt, Human
gcuuggggugcagauccug

SEQ ID NO: 182838 - RNA, 32 nt, Human
gcuugggguggugggaggcggggagcugccac

SEQ ID NO: 182839 - RNA, 32 nt, Human
gcuugggguugcaaugauggcugggccaguca

SEQ ID NO: 182840 - RNA, 32 nt, Human
gcuuggguagcuuggcuuauauucuagagcag

SEQ ID NO: 182841 - RNA, 32 nt, Human
gcuuggguaggcggggaagcagcuggagugcg

SEQ ID NO: 182842 - RNA, 23 nt, Human
gcuugggucacugucaccugagu

SEQ ID NO: 182843 - RNA, 23 nt, Human
gcuugggucauggucaucuucca

SEQ ID NO: 182844 - RNA, 21 nt, Human
gcuuggguccagacugcgcca

SEQ ID NO: 182845 - RNA, 18 nt, Human
gcuugggucccccugcug

SEQ ID NO: 182846 - RNA, 32 nt, Human
gcuugggucccugaacacugucauucacccaa

SEQ ID NO: 182847 - RNA, 32 nt, Human
gcuuggguccugcaguggccugggcaacccuc

SEQ ID NO: 182848 - RNA, 19 nt, Human
gcuugggugacagagccag

SEQ ID NO: 182849 - RNA, 18 nt, Human
gcuugggugacagaguga

SEQ ID NO: 182850 - RNA, 21 nt, Human
gcuugggugacagccagguga

SEQ ID NO: 182851 - RNA, 16 nt, Human
gcuugggugagagugg

SEQ ID NO: 182852 - RNA, 32 nt, Human
gcuugggugcuuaucaggugccaagcccuguu

SEQ ID NO: 182853 - RNA, 32 nt, Human
gcuuggguggcccgucgcucccuggcuucuuc

SEQ ID NO: 182854 - RNA, 32 nt, Human
gcuuggguggccugggacccugugggaggcuu

SEQ ID NO: 182855 - RNA, 32 nt, Human
gcuuggguuggugaucaugucuccucuuguca

SEQ ID NO: 182856 - RNA, 32 nt, Human
gcuuggguuuuuacuuucacuucauuucugag

SEQ ID NO: 182857 - RNA, 32 nt, Human
gcuugguagcuggcaggggcucaauaaaaggu

SEQ ID NO: 182858 - RNA, 32 nt, Human
gcuugguagguggguuucaggagcagucacua

SEQ ID NO: 182859 - RNA, 21 nt, Human
gcuugguauccccuggucuuc

SEQ ID NO: 182860 - RNA, 32 nt, Human
gcuugguauugagucuguggccgacuucgguu

SEQ ID NO: 182861 - RNA, 32 nt, Human
gcuuggucaucuaugacaccacaccagcacag

SEQ ID NO: 182862 - RNA, 32 nt, Human
gcuuggucgguucuggggucuaccucucuggc

SEQ ID NO: 182863 - RNA, 32 nt, Human
gcuuggucuucaagggcuucuaccuccccaaa

SEQ ID NO: 182864 - RNA, 32 nt, Human
gcuuggugaaguuacgaaacuuguccaaaauc

SEQ ID NO: 182865 - RNA, 32 nt, Human
gcuuggugaggaaggggacuccccagcucccc

SEQ ID NO: 182866 - RNA, 26 nt, Human
gcuuggugcagggaaggcgggcgcgg

SEQ ID NO: 182867 - RNA, 32 nt, Human
gcuuggugcauggagaaaaaggaagacccgua

SEQ ID NO: 182868 - RNA, 19 nt, Human
gcuuggugcccacccugcu

SEQ ID NO: 182869 - RNA, 18 nt, Human
gcuugguggagucagugg

SEQ ID NO: 182870 - RNA, 32 nt, Human
gcuugguggcucugggaguaagaucccugaag

SEQ ID NO: 182871 - RNA, 32 nt, Human
gcuuggugggagugaauuugcccacaccuuac

SEQ ID NO: 182872 - RNA, 32 nt, Human
gcuuggugggggaggugggcgcagcaggcacg

SEQ ID NO: 182873 - RNA, 32 nt, Human
gcuugguggucaugccuguaaucccagcauuu

SEQ ID NO: 182874 - RNA, 32 nt, Human
gcuugguggugaagccaccaagcugucuuugg

SEQ ID NO: 182875 - RNA, 32 nt, Human
gcuugguguaguccugcuccucuugggauggg

SEQ ID NO: 182876 - RNA, 24 nt, Human
gcuugguguucuacagugucucca

SEQ ID NO: 182877 - RNA, 32 nt, Human
gcuugguuaccuccaccuuccugcacucauuc

SEQ ID NO: 182878 - RNA, 32 nt, Human
gcuugguuccugaugcccauguuccagaggaa

SEQ ID NO: 182879 - RNA, 32 nt, Human
gcuugguuccuggaaaguaaaggugaaaacau

SEQ ID NO: 182880 - RNA, 32 nt, Human
gcuugguucgugccuccgagaaaggggucucc

SEQ ID NO: 182881 - RNA, 32 nt, Human
gcuugguuuucucacccagugcauguggcagg

SEQ ID NO: 182882 - RNA, 32 nt, Human
gcuugguuuucuugaccugccugccugcucuu

SEQ ID NO: 182883 - RNA, 32 nt, Human
gcuuguaaaguuuucagaauuugaaaugccuc

SEQ ID NO: 182884 - RNA, 21 nt, Human
gcuuguaaucccagcuacuca

SEQ ID NO: 182885 - RNA, 24 nt, Human
gcuuguaaucccagcuacucaaga

SEQ ID NO: 182886 - RNA, 32 nt, Human
gcuuguaauguucuuuacaggaguuuaaaacg

SEQ ID NO: 182887 - RNA, 32 nt, Human
gcuuguacagaaagugaaaauuaguuggcaau

SEQ ID NO: 182888 - RNA, 32 nt, Human
gcuuguacagccugcagaacugugagccaaau

SEQ ID NO: 182889 - RNA, 32 nt, Human
gcuuguacagguugaguaucccuuauccaaaa

SEQ ID NO: 182890 - RNA, 32 nt, Human
gcuuguacccaggaggcggagguuguagugag

SEQ ID NO: 182891 - RNA, 32 nt, Human
gcuuguacccaggagguggagguugcagugag

SEQ ID NO: 182892 - RNA, 32 nt, Human
gcuuguacccguaaucccagcacuuugggagg

SEQ ID NO: 182893 - RNA, 21 nt, Human
gcuuguaccucugauuucacc

SEQ ID NO: 182894 - RNA, 32 nt, Human
gcuuguacguagcuugccacucagugaaaaua

SEQ ID NO: 182895 - RNA, 32 nt, Human
gcuuguagacagggguugguuggcagcauagu

SEQ ID NO: 182896 - RNA, 32 nt, Human
gcuuguagcugaccaacagccugcucucccca

SEQ ID NO: 182897 - RNA, 32 nt, Human
gcuuguaggagagauggccaggguggcagccc

SEQ ID NO: 182898 - RNA, 32 nt, Human
gcuuguaggugugcuggucauggugggcuuca

SEQ ID NO: 182899 - RNA, 23 nt, Human
gcuuguagucccaacuaccuggg

SEQ ID NO: 182900 - RNA, 32 nt, Human
gcuuguagugagugcuguuuuccaggagaugg

SEQ ID NO: 182901 - RNA, 32 nt, Human
gcuuguauauuccgaaacuuucaguuccaauu

SEQ ID NO: 182902 - RNA, 32 nt, Human
gcuuguauuugccuaguucuccagaauguagg

SEQ ID NO: 182903 - RNA, 23 nt, Human
gcuuguauuuggggccuguggga

SEQ ID NO: 182904 - RNA, 32 nt, Human
gcuugucaaguucaccaccaacacagaggggg

SEQ ID NO: 182905 - RNA, 32 nt, Human
gcuugucacccaggcuggagugcaauggcaug

SEQ ID NO: 182906 - RNA, 32 nt, Human
gcuugucauccaagcuggaguacagugccaug

SEQ ID NO: 182907 - RNA, 32 nt, Human
gcuugucaugggagacuggagugcagauucuu

SEQ ID NO: 182908 - RNA, 32 nt, Human
gcuuguccacaugcgcugggcgucugggaccu

SEQ ID NO: 182909 - RNA, 32 nt, Human
gcuuguccagauggcaggaaggagaacggaug

SEQ ID NO: 182910 - RNA, 32 nt, Human
gcuugucccaggcugcugggcuguggucucug

SEQ ID NO: 182911 - RNA, 32 nt, Human
gcuuguccucacaaccaccucaguccucccuc

SEQ ID NO: 182912 - RNA, 20 nt, Human
gcuuguccucccuuccgucu

SEQ ID NO: 182913 - RNA, 32 nt, Human
gcuuguccugcucucacgcuugaaccuagucu

SEQ ID NO: 182914 - RNA, 32 nt, Human
gcuuguccugcucucuucaggaggcccuggug

SEQ ID NO: 182915 - RNA, 32 nt, Human
gcuuguccuggcaguaaggcucuccccuguaa

SEQ ID NO: 182916 - RNA, 18 nt, Human
gcuugucgguggccggua

SEQ ID NO: 182917 - RNA, 32 nt, Human
gcuugucuacuaauacaucugcuucaaaauga

SEQ ID NO: 182918 - RNA, 20 nt, Human
gcuugucuccucuccuguca

SEQ ID NO: 182919 - RNA, 20 nt, Human
gcuugucucuucaccugcua

SEQ ID NO: 182920 - RNA, 19 nt, Human
gcuugucucuugccugcca

SEQ ID NO: 182921 - RNA, 22 nt, Human
gcuugucucuugccugccacug

SEQ ID NO: 182922 - RNA, 32 nt, Human
gcuugucugccugguuuuccuccuacacaugg

SEQ ID NO: 182923 - RNA, 24 nt, Human
gcuugucuggaacuccugggcuca

SEQ ID NO: 182924 - RNA, 32 nt, Human
gcuugucugggcagagacagaagcugauuuaa

SEQ ID NO: 182925 - RNA, 32 nt, Human
gcuugucuguuucucaggcuccugugagccuc

SEQ ID NO: 182926 - RNA, 32 nt, Human
gcuugucuuagcgucagcgagggaagguugag

SEQ ID NO: 182927 - RNA, 32 nt, Human
gcuugucuucaaauacggccaagcagaaaaug

SEQ ID NO: 182928 - RNA, 19 nt, Human
gcuugucuucugguacuuu

SEQ ID NO: 182929 - RNA, 32 nt, Human
gcuugucuugccaauagacuccaggcuuacac

SEQ ID NO: 182930 - RNA, 21 nt, Human
gcuugugaaaaaacagcuucu

SEQ ID NO: 182931 - RNA, 32 nt, Human
gcuugugaaagaauuaucagugagugaaaggc

SEQ ID NO: 182932 - RNA, 32 nt, Human
gcuugugacgcuauaagacagagcaggccaca

SEQ ID NO: 182933 - RNA, 32 nt, Human
gcuugugacuggacuccagccugggcaacaga

SEQ ID NO: 182934 - RNA, 32 nt, Human
gcuugugagacgggcuccagagaaaggaccuc

SEQ ID NO: 182935 - RNA, 19 nt, Human
gcuugugaggcccgaggca

SEQ ID NO: 182936 - RNA, 32 nt, Human
gcuugugagucaggccagagcgagaggacagu

SEQ ID NO: 182937 - RNA, 32 nt, Human
gcuugugauacaguucuggaauucugauagug

SEQ ID NO: 182938 - RNA, 32 nt, Human
gcuugugauguauuucugccuccuggaguuuu

SEQ ID NO: 182939 - RNA, 32 nt, Human
gcuugugcaguagaaccugaaaguaugaugau

SEQ ID NO: 182940 - RNA, 32 nt, Human
gcuugugccacuguacuccagccuggcccaca

SEQ ID NO: 182941 - RNA, 32 nt, Human
gcuugugccaggaggugggguaugcggccacc

SEQ ID NO: 182942 - RNA, 32 nt, Human
gcuugugcccagaaguuugaggcugcagugag

SEQ ID NO: 182943 - RNA, 32 nt, Human
gcuugugcccagggguugcaggcugcagugag

SEQ ID NO: 182944 - RNA, 32 nt, Human
gcuugugccuauggggaguuacuccaacccac

SEQ ID NO: 182945 - RNA, 32 nt, Human
gcuugugccugauucuguggcccaaaacaauc

SEQ ID NO: 182946 - RNA, 32 nt, Human
gcuugugccuguaaucccagaacuuuggaagg

SEQ ID NO: 182947 - RNA, 32 nt, Human
gcuugugccuguagucccagcuacuugggagg

SEQ ID NO: 182948 - RNA, 32 nt, Human
gcuuguggacaacaggucaaucauuuucaaaa

SEQ ID NO: 182949 - RNA, 32 nt, Human
gcuuguggacugccucggacccagccacgcug

SEQ ID NO: 182950 - RNA, 32 nt, Human
gcuuguggccaaugcauccaaauaaggauacc

SEQ ID NO: 182951 - RNA, 23 nt, Human
gcuuguggccacgagccaugccc

SEQ ID NO: 182952 - RNA, 24 nt, Human
gcuuguggcuacagcucagccacu

SEQ ID NO: 182953 - RNA, 32 nt, Human
gcuuguggcuaggccagccuaggauguggguu

SEQ ID NO: 182954 - RNA, 32 nt, Human
gcuugugguuccucccuuggauagccuccaug

SEQ ID NO: 182955 - RNA, 32 nt, Human
gcuuguguagccccagucauuugauaaagaug

SEQ ID NO: 182956 - RNA, 32 nt, Human
gcuugugucuucaggggcagcucagcuuuccu

SEQ ID NO: 182957 - RNA, 32 nt, Human
gcuuguuaaugucagucugugcugaggaccuc

SEQ ID NO: 182958 - RNA, 32 nt, Human
gcuuguucaccucuuccuccagccgugguuag

SEQ ID NO: 182959 - RNA, 32 nt, Human
gcuuguuccccugagccccaccaggaaaucuc

SEQ ID NO: 182960 - RNA, 32 nt, Human
gcuuguucccuguccucuggcccuuugcaaau

SEQ ID NO: 182961 - RNA, 32 nt, Human
gcuuguucccugucuuguccaugugguucuuc

SEQ ID NO: 182962 - RNA, 32 nt, Human
gcuuguuccuauagucccagcacuuugggagg

SEQ ID NO: 182963 - RNA, 32 nt, Human
gcuuguucgacuguuucaaaacaugcuaauuc

SEQ ID NO: 182964 - RNA, 32 nt, Human
gcuuguucuccucugugugccaugugaggaca

SEQ ID NO: 182965 - RNA, 32 nt, Human
gcuuguucucugagggagguuccggagacuca

SEQ ID NO: 182966 - RNA, 32 nt, Human
gcuuguucuuccugccaaaugaucagagaggg

SEQ ID NO: 182967 - RNA, 32 nt, Human
gcuuguugacauuugaagaaguggccauguau

SEQ ID NO: 182968 - RNA, 32 nt, Human
gcuuguugcccaggcuggaaugcaauggcgug

SEQ ID NO: 182969 - RNA, 32 nt, Human
gcuuguugcccaggcuggagugcaauggcgcg

SEQ ID NO: 182970 - RNA, 32 nt, Human
gcuuguugcccaggcuggagugcaguggugca

SEQ ID NO: 182971 - RNA, 32 nt, Human
gcuuguugcgcuccuggcucucccggggcggg

SEQ ID NO: 182972 - RNA, 19 nt, Human
gcuuguuucccugcuggcc

SEQ ID NO: 182973 - RNA, 32 nt, Human
gcuuguuuccuuucucuuuuuguuuggcuucu

SEQ ID NO: 182974 - RNA, 32 nt, Human
gcuuguuugcuuguuuguuugcaccugguuga

SEQ ID NO: 182975 - RNA, 32 nt, Human
gcuuguuugggagauuagagaauaagauaaaa

SEQ ID NO: 182976 - RNA, 32 nt, Human
gcuuguuuuaaucuagccuguuccuccacuau

SEQ ID NO: 182977 - RNA, 32 nt, Human
gcuuguuuuccagucucuuguacagcguuuua

SEQ ID NO: 182978 - RNA, 32 nt, Human
gcuuguuuugacuuaauucuaaaauaggucuc

SEQ ID NO: 182979 - RNA, 32 nt, Human
gcuuguuuugauucuuuucccccuacuuuucc

SEQ ID NO: 182980 - RNA, 32 nt, Human
gcuuuaaaacaaaaccaaacaaaacuuuaaaa

SEQ ID NO: 182981 - RNA, 32 nt, Human
gcuuuaaaagaagccaaagcacuacuagcuuu

SEQ ID NO: 182982 - RNA, 32 nt, Human
gcuuuaaaauggagcuauuuugcuacaauaua

SEQ ID NO: 182983 - RNA, 32 nt, Human
gcuuuaaagaugaucuccucuaaccccuuuau

SEQ ID NO: 182984 - RNA, 32 nt, Human
gcuuuaaaguugugaccuucuuguacaugaau

SEQ ID NO: 182985 - RNA, 32 nt, Human
gcuuuaaauccuguggaaguggcauuggugac

SEQ ID NO: 182986 - RNA, 32 nt, Human
gcuuuaaaugcuguuugcauuucuggaugacu

SEQ ID NO: 182987 - RNA, 32 nt, Human
gcuuuaacacaccuuggcugggucuggauaaa

SEQ ID NO: 182988 - RNA, 32 nt, Human
gcuuuaacccaggaggcagagguugcagugag

SEQ ID NO: 182989 - RNA, 32 nt, Human
gcuuuaagaaucacugaaucacuguggccuca

SEQ ID NO: 182990 - RNA, 32 nt, Human
gcuuuaaggccuugcuuacugccugcaaauuu

SEQ ID NO: 182991 - RNA, 32 nt, Human
gcuuuaaguauuagcuaauuuucuuguuuugg

SEQ ID NO: 182992 - RNA, 32 nt, Human
gcuuuaagugacucagcacccugccucagcuu

SEQ ID NO: 182993 - RNA, 32 nt, Human
gcuuuaaugcacacuucucagagcugugaucc

SEQ ID NO: 182994 - RNA, 32 nt, Human
gcuuuaaugucuaugcugacaguuagguuuug

SEQ ID NO: 182995 - RNA, 32 nt, Human
gcuuuaauugaaugaaaguuccuaguagaucu

SEQ ID NO: 182996 - RNA, 32 nt, Human
gcuuuaauugaaugucugugcuuaugagaggc

SEQ ID NO: 182997 - RNA, 20 nt, Human
gcuuuacaauaaaacaugag

SEQ ID NO: 182998 - RNA, 32 nt, Human
gcuuuacacuucacaggagauugauggcauug

SEQ ID NO: 182999 - RNA, 32 nt, Human
gcuuuacaggagacgcgggcugugaagaugcu

SEQ ID NO: 183000 - RNA, 32 nt, Human
gcuuuacaucuggggaaaggaaaaccaggggu

SEQ ID NO: 183001 - RNA, 32 nt, Human
gcuuuaccagcaucuguuguuucuggacuuuu

SEQ ID NO: 183002 - RNA, 32 nt, Human
gcuuuacccagccuguuugcuuuacugcauga

SEQ ID NO: 183003 - RNA, 32 nt, Human
gcuuuaccucauucacuucucuuaaucgaaaa

SEQ ID NO: 183004 - RNA, 32 nt, Human
gcuuuaccuguauuuucauuccaguacuuuuu

SEQ ID NO: 183005 - RNA, 22 nt, Human
gcuuuacgaaacugcacuccug

SEQ ID NO: 183006 - RNA, 32 nt, Human
gcuuuacgaaacugcacuccugucuucuggcu

SEQ ID NO: 183007 - RNA, 32 nt, Human
gcuuuacgcaucagcugccuuagacagcuucu

SEQ ID NO: 183008 - RNA, 19 nt, Human
gcuuuacucuuucaugcca

SEQ ID NO: 183009 - RNA, 32 nt, Human
gcuuuacugagaugguacaaugucaagggcuu

SEQ ID NO: 183010 - RNA, 32 nt, Human
gcuuuacugagccauuugcaucucuaagaaau

SEQ ID NO: 183011 - RNA, 32 nt, Human
gcuuuacuucuuuccuguuuugccuggaccac

SEQ ID NO: 183012 - RNA, 32 nt, Human
gcuuuagaaaugcagguucuagggcuucuccc

SEQ ID NO: 183013 - RNA, 32 nt, Human
gcuuuagagcaguggucuucaaacuuugaaag

SEQ ID NO: 183014 - RNA, 32 nt, Human
gcuuuagagcuguguguugagcuaaaaauaua

SEQ ID NO: 183015 - RNA, 32 nt, Human
gcuuuagccaaaagcugaaugaccaccguuuc

SEQ ID NO: 183016 - RNA, 32 nt, Human
gcuuuagcccaggaguucaagaucagcuugug

SEQ ID NO: 183017 - RNA, 32 nt, Human
gcuuuagcccaggaguuugaggcugcggugag

SEQ ID NO: 183018 - RNA, 32 nt, Human
gcuuuagccugagacuugccauaagaaacugc

SEQ ID NO: 183019 - RNA, 32 nt, Human
gcuuuagcucaggaguuggagacaagccuggg

SEQ ID NO: 183020 - RNA, 32 nt, Human
gcuuuaggaacagcucaagaaccuuggaguuc

SEQ ID NO: 183021 - RNA, 32 nt, Human
gcuuuaggcccaggcaucggaguagaccaugg

SEQ ID NO: 183022 - RNA, 32 nt, Human
gcuuuaggugagcucugaaagccccacuguua

SEQ ID NO: 183023 - RNA, 32 nt, Human
gcuuuaguacuugcacccucacacacacucuc

SEQ ID NO: 183024 - RNA, 32 nt, Human
gcuuuagucuuucuguucccauuuuuauaaau

SEQ ID NO: 183025 - RNA, 21 nt, Human
gcuuuaguguggcacuccuga

SEQ ID NO: 183026 - RNA, 32 nt, Human
gcuuuauaaaugugccuggugcaugagaaacu

SEQ ID NO: 183027 - RNA, 32 nt, Human
gcuuuauaaggagagacaccagagagaugauc

SEQ ID NO: 183028 - RNA, 32 nt, Human
gcuuuauaaucagcugagacccucacaucugu

SEQ ID NO: 183029 - RNA, 32 nt, Human
gcuuuauagugguuuaccuucauuuagcuuug

SEQ ID NO: 183030 - RNA, 32 nt, Human
gcuuuauauacuaaaugcauuguagcucugag

SEQ ID NO: 183031 - RNA, 21 nt, Human
gcuuuauauccucugggccug

SEQ ID NO: 183032 - RNA, 32 nt, Human
gcuuuaucagcccagaaccuaaagaagagagu

SEQ ID NO: 183033 - RNA, 32 nt, Human
gcuuuaucgcccaggcuggaguacagugaugc

SEQ ID NO: 183034 - RNA, 32 nt, Human
gcuuuaucugcuguuguugaugcauccgucca

SEQ ID NO: 183035 - RNA, 32 nt, Human
gcuuuaucuguguucucccuugcuacauuccu

SEQ ID NO: 183036 - RNA, 32 nt, Human
gcuuuaugaaaauuauaucucaguccucagaa

SEQ ID NO: 183037 - RNA, 22 nt, Human
gcuuuaugaccuuggccaugug

SEQ ID NO: 183038 - RNA, 32 nt, Human
gcuuuauuacuuucauuuucugacccugcugu

SEQ ID NO: 183039 - RNA, 32 nt, Human
gcuuuauucaccugacuguuuccagagaccca

SEQ ID NO: 183040 - RNA, 32 nt, Human
gcuuuauucaggacacacuucuugccuucacu

SEQ ID NO: 183041 - RNA, 32 nt, Human
gcuuuauucuacucccuagucaugcggaacaa

SEQ ID NO: 183042 - RNA, 32 nt, Human
gcuuuauucucaaaugcuggguugaaaaaugu

SEQ ID NO: 183043 - RNA, 32 nt, Human
gcuuuauugcaaaugugaaaacuuuuuaugug

SEQ ID NO: 183044 - RNA, 32 nt, Human
gcuuuauuuuggggaaucaggggugaggaggg

SEQ ID NO: 183045 - RNA, 32 nt, Human
gcuuucaaaaggacuuuucucuccuagcugac

SEQ ID NO: 183046 - RNA, 32 nt, Human
gcuuucaaacaugaucccagcuacacggacug

SEQ ID NO: 183047 - RNA, 32 nt, Human
gcuuucaaccaggcucacccaggcuggggucu

SEQ ID NO: 183048 - RNA, 32 nt, Human
gcuuucaacgaccacuuuggacugccugucau

SEQ ID NO: 183049 - RNA, 32 nt, Human
gcuuucaagcuacagcuguaacaucaacuuuu

SEQ ID NO: 183050 - RNA, 32 nt, Human
gcuuucacaaauuuguaccacaugguaauucu

SEQ ID NO: 183051 - RNA, 20 nt, Human
gcuuucacaacauuugcaga

SEQ ID NO: 183052 - RNA, 32 nt, Human
gcuuucacaacugcagagccuccuggggccac

SEQ ID NO: 183053 - RNA, 32 nt, Human
gcuuucacagaauuauuccagaguuuauaugc

SEQ ID NO: 183054 - RNA, 32 nt, Human
gcuuucacagucagaagugggucugugggauc

SEQ ID NO: 183055 - RNA, 32 nt, Human
gcuuucacaucaagccuuccucggugacuugc

SEQ ID NO: 183056 - RNA, 32 nt, Human
gcuuucaccagcugcagggucugcuuuuacuu

SEQ ID NO: 183057 - RNA, 32 nt, Human
gcuuucaccauguuggccaggcuggucucaaa

SEQ ID NO: 183058 - RNA, 32 nt, Human
gcuuucacuaaggggagacuucaggggaggau

SEQ ID NO: 183059 - RNA, 32 nt, Human
gcuuucacuacguuagccaggcuggucucaaa

SEQ ID NO: 183060 - RNA, 32 nt, Human
gcuuucacugucagcaguuuuaaaggugaaau

SEQ ID NO: 183061 - RNA, 32 nt, Human
gcuuucagcugauucugucuuuucaggccagg

SEQ ID NO: 183062 - RNA, 32 nt, Human
gcuuucagugaagauggcagggccagaacugu

SEQ ID NO: 183063 - RNA, 32 nt, Human
gcuuucagugauaucuuucucauuaccaguga

SEQ ID NO: 183064 - RNA, 32 nt, Human
gcuuucagugcugcuguuuggcccagcucauu

SEQ ID NO: 183065 - RNA, 32 nt, Human
gcuuucaguggaagaugauauuagagaccaaa

SEQ ID NO: 183066 - RNA, 31 nt, Human
gcuuucaguuagggagaaaaauuagauugua

SEQ ID NO: 183067 - RNA, 32 nt, Human
gcuuucauaaagucuguugccauuccaucucu

SEQ ID NO: 183068 - RNA, 24 nt, Human
gcuuucauagcaguguguagagug

SEQ ID NO: 183069 - RNA, 32 nt, Human
gcuuucauaggccacacacaggugugcugcgc

SEQ ID NO: 183070 - RNA, 32 nt, Human
gcuuucaugcagaguguuuugccuucauguua

SEQ ID NO: 183071 - RNA, 22 nt, Human
gcuuucauuccugacacugccc

SEQ ID NO: 183072 - RNA, 32 nt, Human
gcuuuccacagcugccccgggccugcagaaca

SEQ ID NO: 183073 - RNA, 32 nt, Human
gcuuuccacccacagggagaagcacaaucagg

SEQ ID NO: 183074 - RNA, 32 nt, Human
gcuuuccagaacuugggguggcaacggguccu

SEQ ID NO: 183075 - RNA, 32 nt, Human
gcuuuccagacuccuggcucuggcucccugga

SEQ ID NO: 183076 - RNA, 32 nt, Human
gcuuuccagaugaucugccucggaugcgauuc

SEQ ID NO: 183077 - RNA, 32 nt, Human
gcuuuccagcagcugcgucagacaacgaccca

SEQ ID NO: 183078 - RNA, 32 nt, Human
gcuuuccaggcugguuucugguccccauccgc

SEQ ID NO: 183079 - RNA, 32 nt, Human
gcuuuccaggggccuuccugugcccagcuucu

SEQ ID NO: 183080 - RNA, 32 nt, Human
gcuuuccaggguaucuaugugugugcaugugu

SEQ ID NO: 183081 - RNA, 32 nt, Human
gcuuuccaggugaacauuggaaaugagaaucu

SEQ ID NO: 183082 - RNA, 22 nt, Human
gcuuuccagucucagcaugguu

SEQ ID NO: 183083 - RNA, 23 nt, Human
gcuuuccauaauucccaucacuu

SEQ ID NO: 183084 - RNA, 23 nt, Human
gcuuuccauccacucaccuuacc

SEQ ID NO: 183085 - RNA, 32 nt, Human
gcuuuccauccaucuucugugaucacaaggca

SEQ ID NO: 183086 - RNA, 32 nt, Human
gcuuuccaugaguuuugcuguaacuacuaugg

SEQ ID NO: 183087 - RNA, 31 nt, Human
gcuuucccacuuuucggggcugcuagauugc

SEQ ID NO: 183088 - RNA, 32 nt, Human
gcuuucccaggccuggugauucugcucuccag

SEQ ID NO: 183089 - RNA, 32 nt, Human
gcuuucccauccuugggcuuggcuccagcagu

SEQ ID NO: 183090 - RNA, 32 nt, Human
gcuuucccauggugcugcuccaaccaucagau

SEQ ID NO: 183091 - RNA, 32 nt, Human
gcuuucccauuuuacugaugagaaaaucaagg

SEQ ID NO: 183092 - RNA, 32 nt, Human
gcuuuccccagaggcuuccucauggcucacag

SEQ ID NO: 183093 - RNA, 32 nt, Human
gcuuuccccagcuccaaccucucuggucuuca

SEQ ID NO: 183094 - RNA, 32 nt, Human
gcuuucccccuuccgcccucucccacccucuc

SEQ ID NO: 183095 - RNA, 32 nt, Human
gcuuuccccgaagacccuccuggaccagcccc

SEQ ID NO: 183096 - RNA, 32 nt, Human
gcuuuccccgccagagugagguugggaagcag

SEQ ID NO: 183097 - RNA, 32 nt, Human
gcuuuccccggcgcuggcugggcucagcggcc

SEQ ID NO: 183098 - RNA, 32 nt, Human
gcuuuccccgucccccuuccucucucucacca

SEQ ID NO: 183099 - RNA, 32 nt, Human
gcuuuccccugccugccugucucuaguuucuc

SEQ ID NO: 183100 - RNA, 32 nt, Human
gcuuuccccuggcugcuucugccuccuaauag

SEQ ID NO: 183101 - RNA, 32 nt, Human
gcuuuccccuuccuccucccucucucccuuuc

SEQ ID NO: 183102 - RNA, 32 nt, Human
gcuuucccgaguagcugggacuacagagaugg

SEQ ID NO: 183103 - RNA, 22 nt, Human
gcuuucccuacuccugccccaa

SEQ ID NO: 183104 - RNA, 32 nt, Human
gcuuucccuccaucugccccaggacaagagca

SEQ ID NO: 183105 - RNA, 32 nt, Human
gcuuucccuccccugucaggucucuccugucc

SEQ ID NO: 183106 - RNA, 19 nt, Human
gcuuucccuccugggcuca

SEQ ID NO: 183107 - RNA, 32 nt, Human
gcuuucccucucgcgucucuggcugcagguga

SEQ ID NO: 183108 - RNA, 32 nt, Human
gcuuucccuucccuccucucuggcccucccuc

SEQ ID NO: 183109 - RNA, 32 nt, Human
gcuuuccgacauuuugccucucucacugguca

SEQ ID NO: 183110 - RNA, 32 nt, Human
gcuuuccggagaggcuuccugaugcucuaccc

SEQ ID NO: 183111 - RNA, 20 nt, Human
gcuuuccggagcucagcagg

SEQ ID NO: 183112 - RNA, 32 nt, Human
gcuuuccggcgcacuccagggggcguggcucg

SEQ ID NO: 183113 - RNA, 32 nt, Human
gcuuuccgggacuguggagggagcacaggcgg

SEQ ID NO: 183114 - RNA, 32 nt, Human
gcuuuccuaagauaggaacccagaagaggacu

SEQ ID NO: 183115 - RNA, 28 nt, Human
gcuuuccuacaugcugccucuccucagg

SEQ ID NO: 183116 - RNA, 32 nt, Human
gcuuuccucaaaucagaccauaugagaggaua

SEQ ID NO: 183117 - RNA, 32 nt, Human
gcuuuccuccacugccaucauuaaaccucagc

SEQ ID NO: 183118 - RNA, 32 nt, Human
gcuuuccucccccagcaugcauccaaaaauca

SEQ ID NO: 183119 - RNA, 20 nt, Human
gcuuuccuccgcccggggug

SEQ ID NO: 183120 - RNA, 32 nt, Human
gcuuuccucgcccucacugccuugcuccacaa

SEQ ID NO: 183121 - RNA, 21 nt, Human
gcuuuccucggccugagccag

SEQ ID NO: 183122 - RNA, 32 nt, Human
gcuuuccucugccgcaugguccugggccguug

SEQ ID NO: 183123 - RNA, 32 nt, Human
gcuuuccugacacuccagugucuggggugguu

SEQ ID NO: 183124 - RNA, 18 nt, Human
gcuuuccugagacuugag

SEQ ID NO: 183125 - RNA, 32 nt, Human
gcuuuccugaugcucuggacaaauuccuuucu

SEQ ID NO: 183126 - RNA, 32 nt, Human
gcuuuccugcagccauuuagugccgccccaug

SEQ ID NO: 183127 - RNA, 23 nt, Human
gcuuuccugcccccucuuccucu

SEQ ID NO: 183128 - RNA, 32 nt, Human
gcuuuccugccuccuucucuuugauuuauuua

SEQ ID NO: 183129 - RNA, 18 nt, Human
gcuuuccuggaacuugag

SEQ ID NO: 183130 - RNA, 18 nt, Human
gcuuuccugggccucuca

SEQ ID NO: 183131 - RNA, 32 nt, Human
gcuuuccugggccucucaguugaacaaagcag

SEQ ID NO: 183132 - RNA, 32 nt, Human
gcuuuccuggggagggagggagggaugaggca

SEQ ID NO: 183133 - RNA, 21 nt, Human
gcuuuccuguauuucuuccca

SEQ ID NO: 183134 - RNA, 32 nt, Human
gcuuuccuguccauucccagcauccagcuccu

SEQ ID NO: 183135 - RNA, 32 nt, Human
gcuuuccuuuauucuugaaucucccauggaag

SEQ ID NO: 183136 - RNA, 32 nt, Human
gcuuuccuuuuuaaaagauauuuuacugaaga

SEQ ID NO: 183137 - RNA, 32 nt, Human
gcuuuccuuuuugccucuuugccauuuccuug

SEQ ID NO: 183138 - RNA, 19 nt, Human
gcuuucgccuguaauccca

SEQ ID NO: 183139 - RNA, 32 nt, Human
gcuuucgccuguaaucccaacacuuugggagg

SEQ ID NO: 183140 - RNA, 32 nt, Human
gcuuucgcuggcgggaggcagcaacgaggcgg

SEQ ID NO: 183141 - RNA, 32 nt, Human
gcuuucggagcagcggugugaggaccagcaga

SEQ ID NO: 183142 - RNA, 20 nt, Human
gcuuucggagggacccgggc

SEQ ID NO: 183143 - RNA, 32 nt, Human
gcuuucgggaaagggaauaaggagcacgaugc

SEQ ID NO: 183144 - RNA, 32 nt, Human
gcuuucggucccuuucuuuuaaugcccauccu

SEQ ID NO: 183145 - RNA, 32 nt, Human
gcuuucguccauguuucucacauugcuguauu

SEQ ID NO: 183146 - RNA, 32 nt, Human
gcuuucgugcuuguuagugaacaccaacucag

SEQ ID NO: 183147 - RNA, 32 nt, Human
gcuuucguuuguuuuaaaugggagaaacugga

SEQ ID NO: 183148 - RNA, 32 nt, Human
gcuuucuaaggauauggcccaagaggaaggcu

SEQ ID NO: 183149 - RNA, 32 nt, Human
gcuuucuaccaaaagaaaauauagucacagga

SEQ ID NO: 183150 - RNA, 32 nt, Human
gcuuucuagaucucucccagugaggcauggag

SEQ ID NO: 183151 - RNA, 32 nt, Human
gcuuucuaggaaaauuuuacagacacuuaaag

SEQ ID NO: 183152 - RNA, 32 nt, Human
gcuuucuaucaucugccccacauugguccccu

SEQ ID NO: 183153 - RNA, 32 nt, Human
gcuuucuauggcuucuccuuaacuuauugauu

SEQ ID NO: 183154 - RNA, 32 nt, Human
gcuuucuaugugaauauaagcuugugcacaau

SEQ ID NO: 183155 - RNA, 32 nt, Human
gcuuucucaaagagaaugaaacuuuugcacca

SEQ ID NO: 183156 - RNA, 25 nt, Human
gcuuucucaccccaggcucugcagc

SEQ ID NO: 183157 - RNA, 32 nt, Human
gcuuucucacgggcuugauuccugccuacaga

SEQ ID NO: 183158 - RNA, 32 nt, Human
gcuuucucacuggcgugcucucuuucucucuc

SEQ ID NO: 183159 - RNA, 32 nt, Human
gcuuucucagcccugggaggggcgccugaacc

SEQ ID NO: 183160 - RNA, 32 nt, Human
gcuuucucauacauuaccucauugaauuaucc

SEQ ID NO: 183161 - RNA, 32 nt, Human
gcuuucuccagagccugugcaggauuuccuuc

SEQ ID NO: 183162 - RNA, 32 nt, Human
gcuuucuccagccaucggagaccagagccgcc

SEQ ID NO: 183163 - RNA, 32 nt, Human
gcuuucucccugucccuuccuuucuccccuau

SEQ ID NO: 183164 - RNA, 32 nt, Human
gcuuucucuaaccccugcagucacuuccagau

SEQ ID NO: 183165 - RNA, 32 nt, Human
gcuuucucucuggcuucucucuuuuccuccuc

SEQ ID NO: 183166 - RNA, 32 nt, Human
gcuuucucuggcagaauugaggaggaagaggu

SEQ ID NO: 183167 - RNA, 32 nt, Human
gcuuucucuuuuccucuaccuuccucaucccc

SEQ ID NO: 183168 - RNA, 32 nt, Human
gcuuucugaacugccaagaggggaucuggcuu

SEQ ID NO: 183169 - RNA, 32 nt, Human
gcuuucugacauguccagcccaucucuaauga

SEQ ID NO: 183170 - RNA, 32 nt, Human
gcuuucugaggauccaacgugugccagccacu

SEQ ID NO: 183171 - RNA, 32 nt, Human
gcuuucugccagccaauaucucucccucgugu

SEQ ID NO: 183172 - RNA, 32 nt, Human
gcuuucugccagccugggcaacauagugagac

SEQ ID NO: 183173 - RNA, 32 nt, Human
gcuuucugcccaggaggaaugagcuuucaagc

SEQ ID NO: 183174 - RNA, 32 nt, Human
gcuuucugcccccaccaacacccuccaaccag

SEQ ID NO: 183175 - RNA, 32 nt, Human
gcuuucugcuugggcccugcaccuggccagcg

SEQ ID NO: 183176 - RNA, 32 nt, Human
gcuuucuggccuucuuuucccaccuuaggcuu

SEQ ID NO: 183177 - RNA, 29 nt, Human
gcuuucuggcugcugugcugccuccuggg

SEQ ID NO: 183178 - RNA, 32 nt, Human
gcuuucuggguccugggcugcccccagugcuc

SEQ ID NO: 183179 - RNA, 32 nt, Human
gcuuucuguacuucucauagcuuuggagucug

SEQ ID NO: 183180 - RNA, 32 nt, Human
gcuuucugucuuccaacugcagucuccacagu

SEQ ID NO: 183181 - RNA, 32 nt, Human
gcuuucugugccagccuggcucugccccuccc

SEQ ID NO: 183182 - RNA, 32 nt, Human
gcuuucugugccaggaccaucuuuacuuucuc

SEQ ID NO: 183183 - RNA, 32 nt, Human
gcuuucuguggcugaggggcuggugagauuuu

SEQ ID NO: 183184 - RNA, 32 nt, Human
gcuuucuuccaaacuccugggccuccgacacu

SEQ ID NO: 183185 - RNA, 32 nt, Human
gcuuucuucccaggacccacaggcugccaugg

SEQ ID NO: 183186 - RNA, 32 nt, Human
gcuuucuuccccucaacucuggagccccaucc

SEQ ID NO: 183187 - RNA, 32 nt, Human
gcuuucuucccuuuuugaccuuuaguuuucca

SEQ ID NO: 183188 - RNA, 32 nt, Human
gcuuucuuccuugagcucuggucaccaaggag

SEQ ID NO: 183189 - RNA, 32 nt, Human
gcuuucuucuacugcccugagccugaacgcuu

SEQ ID NO: 183190 - RNA, 32 nt, Human
gcuuucuucucccaauucauccucacucaguc

SEQ ID NO: 183191 - RNA, 32 nt, Human
gcuuucuucuucagaucugccacccucuagcu

SEQ ID NO: 183192 - RNA, 32 nt, Human
gcuuucuucuuuccuuuacuccuggcucaagc

SEQ ID NO: 183193 - RNA, 32 nt, Human
gcuuucuucuuucugccccucuuccucccccu

SEQ ID NO: 183194 - RNA, 32 nt, Human
gcuuucuugcuucuggggaaauggcagguggu

SEQ ID NO: 183195 - RNA, 32 nt, Human
gcuuucuuggaagaagaaagaaacaaaaacug

SEQ ID NO: 183196 - RNA, 32 nt, Human
gcuuucuuggagccuuucucuuaaucaguccu

SEQ ID NO: 183197 - RNA, 32 nt, Human
gcuuucuuggcuguauugcuacuccagaccuc

SEQ ID NO: 183198 - RNA, 32 nt, Human
gcuuucuuucccuauguuuauuugaaauuuca

SEQ ID NO: 183199 - RNA, 32 nt, Human
gcuuucuuucuugcuuucuuucuugcuuucuu

SEQ ID NO: 183200 - RNA, 32 nt, Human
gcuuucuuucuuucuuucuuucuuucuuucuu

SEQ ID NO: 183201 - RNA, 32 nt, Human
gcuuucuuuggccucugacccugcugcccauu

SEQ ID NO: 183202 - RNA, 32 nt, Human
gcuuucuuuucucugcugcgguuccauauuca

SEQ ID NO: 183203 - RNA, 32 nt, Human
gcuuugaaagagaaacuggcucacagugagug

SEQ ID NO: 183204 - RNA, 32 nt, Human
gcuuugaaaggcauuuggggucucagcagugg

SEQ ID NO: 183205 - RNA, 32 nt, Human
gcuuugaacuugauguggcauuacauguucuu

SEQ ID NO: 183206 - RNA, 20 nt, Human
gcuuugaagaccuaccuguu

SEQ ID NO: 183207 - RNA, 32 nt, Human
gcuuugaagacgcggcccugccccgacacagg

SEQ ID NO: 183208 - RNA, 32 nt, Human
gcuuugaagagaguagcaguccucccagcaug

SEQ ID NO: 183209 - RNA, 30 nt, Human
gcuuugaagcuuuuugagggcaaacuuuac

SEQ ID NO: 183210 - RNA, 19 nt, Human
gcuuugaaggaucaaguaa

SEQ ID NO: 183211 - RNA, 32 nt, Human
gcuuugaaguugugaccuucuuguacaugaau

SEQ ID NO: 183212 - RNA, 32 nt, Human
gcuuugaaguuugcgucuuuucugccucuuuc

SEQ ID NO: 183213 - RNA, 32 nt, Human
gcuuugacacccaggcuggagugcaguagcac

SEQ ID NO: 183214 - RNA, 22 nt, Human
gcuuugacccccaaccuucucc

SEQ ID NO: 183215 - RNA, 32 nt, Human
gcuuugacuuccugggcucaagcaauccuccc

SEQ ID NO: 183216 - RNA, 32 nt, Human
gcuuugacuuuccuuugcuguggagguuuuug

SEQ ID NO: 183217 - RNA, 32 nt, Human
gcuuugagaagcagauaggcuugaaugagcau

SEQ ID NO: 183218 - RNA, 32 nt, Human
gcuuugagacuccacuuuugagcuuacuccuc

SEQ ID NO: 183219 - RNA, 32 nt, Human
gcuuugagcuaggccguuuccgggaggcggag

SEQ ID NO: 183220 - RNA, 32 nt, Human
gcuuugaggagaauccucucugccauucuucc

SEQ ID NO: 183221 - RNA, 32 nt, Human
gcuuugaggauggaggaaggaggccacaaacc

SEQ ID NO: 183222 - RNA, 31 nt, Human
gcuuugaggguggaaggaugggauggguucc

SEQ ID NO: 183223 - RNA, 32 nt, Human
gcuuugaggugguggaggaugccauugacacc

SEQ ID NO: 183224 - RNA, 32 nt, Human
gcuuugagucaaggggcuucacugccugcagc

SEQ ID NO: 183225 - RNA, 20 nt, Human
gcuuugagucaguggcauca

SEQ ID NO: 183226 - RNA, 20 nt, Human
gcuuugagugacagcaucau

SEQ ID NO: 183227 - RNA, 32 nt, Human
gcuuugauaaccugcuuaauacuccaaagugu

SEQ ID NO: 183228 - RNA, 32 nt, Human
gcuuugaucccuuggucugggggucgaaggaa

SEQ ID NO: 183229 - RNA, 32 nt, Human
gcuuugaucgccacuuucauaucuccugugau

SEQ ID NO: 183230 - RNA, 32 nt, Human
gcuuugaucuucuucaauaugugaauuugggc

SEQ ID NO: 183231 - RNA, 32 nt, Human
gcuuugaugccuagccaugucugccucauccu

SEQ ID NO: 183232 - RNA, 32 nt, Human
gcuuugaugucugggcaucgauuucccucggu

SEQ ID NO: 183233 - RNA, 32 nt, Human
gcuuugauucauaguaacuucuuauggaauug

SEQ ID NO: 183234 - RNA, 32 nt, Human
gcuuugauugcugaagaaguauguuuaagagg

SEQ ID NO: 183235 - RNA, 32 nt, Human
gcuuugauugguugugccuucccuucucuggu

SEQ ID NO: 183236 - RNA, 32 nt, Human
gcuuugauuuucuacauuugacauguauucau

SEQ ID NO: 183237 - RNA, 32 nt, Human
gcuuugcaaggggaaaucaagcugggagaauc

SEQ ID NO: 183238 - RNA, 32 nt, Human
gcuuugcaauaaaucacagccuuuuccauaua

SEQ ID NO: 183239 - RNA, 32 nt, Human
gcuuugcaaugccauaauccaaccaccuuauu

SEQ ID NO: 183240 - RNA, 32 nt, Human
gcuuugcaaugcugggauaauagggaagccac

SEQ ID NO: 183241 - RNA, 32 nt, Human
gcuuugcacagcccucugggcgcacugugugc

SEQ ID NO: 183242 - RNA, 32 nt, Human
gcuuugcacauguccacccaaacuaaagacua

SEQ ID NO: 183243 - RNA, 32 nt, Human
gcuuugcaccaaauccuccaccccuccaauug

SEQ ID NO: 183244 - RNA, 32 nt, Human
gcuuugcaccuccuauccccaggguccgccga

SEQ ID NO: 183245 - RNA, 32 nt, Human
gcuuugcaccuggccuucucagcucugaggca

SEQ ID NO: 183246 - RNA, 32 nt, Human
gcuuugcagaagcaagagguguagucacagug

SEQ ID NO: 183247 - RNA, 23 nt, Human
gcuuugcagagugucuugguuga

SEQ ID NO: 183248 - RNA, 32 nt, Human
gcuuugcagcaaccucugugcccagaacauac

SEQ ID NO: 183249 - RNA, 32 nt, Human
gcuuugcagccacacagcgaggucaguccggg

SEQ ID NO: 183250 - RNA, 27 nt, Human
gcuuugcagccacggaagcaacaagug

SEQ ID NO: 183251 - RNA, 26 nt, Human
gcuuugcagccagagaagcaagaagu

SEQ ID NO: 183252 - RNA, 32 nt, Human
gcuuugcaggacuauuuugagauacagcaaau

SEQ ID NO: 183253 - RNA, 32 nt, Human
gcuuugcaucuucuccaggcccuggacuuccu

SEQ ID NO: 183254 - RNA, 32 nt, Human
gcuuugccacacacaguuacagagugaacacu

SEQ ID NO: 183255 - RNA, 32 nt, Human
gcuuugccacauuguucacauuuguagggcuu

SEQ ID NO: 183256 - RNA, 22 nt, Human
gcuuugcccacuggacuccuga

SEQ ID NO: 183257 - RNA, 32 nt, Human
gcuuugcccaguaguuggaaagugaacucgac

SEQ ID NO: 183258 - RNA, 32 nt, Human
gcuuugcccucacgucaguuguacauggcaug

SEQ ID NO: 183259 - RNA, 32 nt, Human
gcuuugccuccaccagcgcccuggccuccgcu

SEQ ID NO: 183260 - RNA, 32 nt, Human
gcuuugccuccaccaucccuaaccaaccucuc

SEQ ID NO: 183261 - RNA, 32 nt, Human
gcuuugccuccaccauucccaccccacccucc

SEQ ID NO: 183262 - RNA, 32 nt, Human
gcuuugccugccacuucugccuccagaucagg

SEQ ID NO: 183263 - RNA, 32 nt, Human
gcuuugccuuuugcugacacagcuccauaaag

SEQ ID NO: 183264 - RNA, 32 nt, Human
gcuuugcggaggcugcucagauggccugagcc

SEQ ID NO: 183265 - RNA, 32 nt, Human
gcuuugcggggaagggaaguggcggagcccga

SEQ ID NO: 183266 - RNA, 23 nt, Human
gcuuugcgggguccgccugugug

SEQ ID NO: 183267 - RNA, 32 nt, Human
gcuuugcuauucagaccugugcagcccugauu

SEQ ID NO: 183268 - RNA, 32 nt, Human
gcuuugcucagaagccuccugucuccagcucu

SEQ ID NO: 183269 - RNA, 32 nt, Human
gcuuugcucagcacacucuccugggccccaag

SEQ ID NO: 183270 - RNA, 32 nt, Human
gcuuugcucuauuaagauuggaaauguacacu

SEQ ID NO: 183271 - RNA, 32 nt, Human
gcuuugcucugcccucugacucacuguguugg

SEQ ID NO: 183272 - RNA, 32 nt, Human
gcuuugcugagauguuaauuuguagcuuugcc

SEQ ID NO: 183273 - RNA, 19 nt, Human
gcuuugcugcacggucuga

SEQ ID NO: 183274 - RNA, 32 nt, Human
gcuuugcugccuggccuccugccagcaacaag

SEQ ID NO: 183275 - RNA, 32 nt, Human
gcuuugcugcugucagugcuuuccagucucag

SEQ ID NO: 183276 - RNA, 32 nt, Human
gcuuugcugggggaaagcaggagcaacagggc

SEQ ID NO: 183277 - RNA, 32 nt, Human
gcuuugcugugggcaccugcacuggcaucuau

SEQ ID NO: 183278 - RNA, 32 nt, Human
gcuuugcuuaugggugcucgcugggguccggu

SEQ ID NO: 183279 - RNA, 32 nt, Human
gcuuugcuuucuuguggacagcuuguaguuug

SEQ ID NO: 183280 - RNA, 32 nt, Human
gcuuuggaaauguuccugccaggacagugccu

SEQ ID NO: 183281 - RNA, 32 nt, Human
gcuuuggaaggcggaguucaggcugaggagau

SEQ ID NO: 183282 - RNA, 32 nt, Human
gcuuuggacacacgcguggcccagaggggaca

SEQ ID NO: 183283 - RNA, 32 nt, Human
gcuuuggaggcugagguuggaggauugcuuaa

SEQ ID NO: 183284 - RNA, 32 nt, Human
gcuuuggaguggguggccaucaugcauggccu

SEQ ID NO: 183285 - RNA, 32 nt, Human
gcuuuggaguuuaaccuuucugccaauccaga

SEQ ID NO: 183286 - RNA, 32 nt, Human
gcuuuggaucacugucuucuccuuuauaaaug

SEQ ID NO: 183287 - RNA, 32 nt, Human
gcuuuggcaagaucaaaggguugcuaugaccu

SEQ ID NO: 183288 - RNA, 32 nt, Human
gcuuuggcacucagaaugggcccagugggggc

SEQ ID NO: 183289 - RNA, 32 nt, Human
gcuuuggcaguuucuuggcacgcuggcugaag

SEQ ID NO: 183290 - RNA, 32 nt, Human
gcuuuggccacuaucugccacuccuuucucuu

SEQ ID NO: 183291 - RNA, 32 nt, Human
gcuuuggccaugggaggagcaagaacacuacg

SEQ ID NO: 183292 - RNA, 32 nt, Human
gcuuuggcccagccagcuucagaucuggucuu

SEQ ID NO: 183293 - RNA, 32 nt, Human
gcuuuggcccuucuucagcuuacucuuagugg

SEQ ID NO: 183294 - RNA, 23 nt, Human
gcuuuggcguuccaccccugcug

SEQ ID NO: 183295 - RNA, 32 nt, Human
gcuuuggcucaagauggccuucauuuacguuu

SEQ ID NO: 183296 - RNA, 32 nt, Human
gcuuuggcucccaggcuggaguccaguggugu

SEQ ID NO: 183297 - RNA, 32 nt, Human
gcuuuggcugcuaaaccugcugccuucagcug

SEQ ID NO: 183298 - RNA, 32 nt, Human
gcuuuggcuggcacaggggugaaggagagcca

SEQ ID NO: 183299 - RNA, 32 nt, Human
gcuuuggcuggcugggcguguaggacggugag

SEQ ID NO: 183300 - RNA, 32 nt, Human
gcuuuggcuguuaccuuucccugcugaggggc

SEQ ID NO: 183301 - RNA, 32 nt, Human
gcuuuggcuucugucuguuccugucuguuggg

SEQ ID NO: 183302 - RNA, 32 nt, Human
gcuuugggaaaacucuuuaucuuaugaggcug

SEQ ID NO: 183303 - RNA, 19 nt, Human
gcuuugggaagccagagga

SEQ ID NO: 183304 - RNA, 32 nt, Human
gcuuugggaagggcuucagaauucagccugag

SEQ ID NO: 183305 - RNA, 32 nt, Human
gcuuugggagagaguagcaaggagagaagaau

SEQ ID NO: 183306 - RNA, 32 nt, Human
gcuuugggagccaccccacaccuggccaacgc

SEQ ID NO: 183307 - RNA, 32 nt, Human
gcuuugggaggcggaggcaggaggaucgcuca

SEQ ID NO: 183308 - RNA, 31 nt, Human
gcuuugggcccuacugggccuggggaggucu

SEQ ID NO: 183309 - RNA, 23 nt, Human
gcuuugggccggggcagcgggug

SEQ ID NO: 183310 - RNA, 32 nt, Human
gcuuugggccuggaauugaggagaaagugagc

SEQ ID NO: 183311 - RNA, 32 nt, Human
gcuuugggcugagaggaugagggaggucuuuc

SEQ ID NO: 183312 - RNA, 32 nt, Human
gcuuugggcuggggccaugggaagaaaccauu

SEQ ID NO: 183313 - RNA, 32 nt, Human
gcuuugggcuggggcucuuuggacuugaaucc

SEQ ID NO: 183314 - RNA, 32 nt, Human
gcuuugggcuuuccugggcucucccaaaagga

SEQ ID NO: 183315 - RNA, 32 nt, Human
gcuuugggcuuugcaccugcacuuuggugaca

SEQ ID NO: 183316 - RNA, 32 nt, Human
gcuuuggggauggcuggaagugcaaugucuuc

SEQ ID NO: 183317 - RNA, 32 nt, Human
gcuuuggggccaaacucuucugucacuaucag

SEQ ID NO: 183318 - RNA, 32 nt, Human
gcuuugggggugccucacgaagcaucccugua

SEQ ID NO: 183319 - RNA, 32 nt, Human
gcuuuggggguggaggggguggugcuggugcu

SEQ ID NO: 183320 - RNA, 32 nt, Human
gcuuugggugguuccaauugguggagagaagc

SEQ ID NO: 183321 - RNA, 32 nt, Human
gcuuuggguucugggccucugccgcucucugg

SEQ ID NO: 183322 - RNA, 32 nt, Human
gcuuuggguuugcagagauuacacaggaaugu

SEQ ID NO: 183323 - RNA, 32 nt, Human
gcuuugguagcuggugggacugacgccuucuu

SEQ ID NO: 183324 - RNA, 32 nt, Human
gcuuuggucaugccaaagaggcagaguucagg

SEQ ID NO: 183325 - RNA, 24 nt, Human
gcuuuggugagaaaacuaaucuug

SEQ ID NO: 183326 - RNA, 32 nt, Human
gcuuugguguauuuaccuuccuucccuuccug

SEQ ID NO: 183327 - RNA, 32 nt, Human
gcuuugguuuucauuucucuucuucacugccu

SEQ ID NO: 183328 - RNA, 32 nt, Human
gcuuuguacauucaggagcugcagagaggaaa

SEQ ID NO: 183329 - RNA, 32 nt, Human
gcuuuguacugggggcguggggagacaggagg

SEQ ID NO: 183330 - RNA, 32 nt, Human
gcuuuguaggggcaagcaggcaaagaguacua

SEQ ID NO: 183331 - RNA, 32 nt, Human
gcuuuguauuagcagguuugcaugcagcaaaa

SEQ ID NO: 183332 - RNA, 32 nt, Human
gcuuugucaccaggcuggagugcaguggugca

SEQ ID NO: 183333 - RNA, 32 nt, Human
gcuuugucacccacgcuggaaugcaguggcgg

SEQ ID NO: 183334 - RNA, 32 nt, Human
gcuuugucacccaggcuggaguacaguggcgu

SEQ ID NO: 183335 - RNA, 32 nt, Human
gcuuugucacccaggcuggagugcaauggcac

SEQ ID NO: 183336 - RNA, 32 nt, Human
gcuuugucacccaggcuggagugcaguggugu

SEQ ID NO: 183337 - RNA, 32 nt, Human
gcuuugucacccaggcuggagugcagugucgu

SEQ ID NO: 183338 - RNA, 32 nt, Human
gcuuugucacccaggcuggagugcuguggugu

SEQ ID NO: 183339 - RNA, 32 nt, Human
gcuuugucacccaggguggugugcaguggagc

SEQ ID NO: 183340 - RNA, 32 nt, Human
gcuuugucacccaugcuggaguacaauggcac

SEQ ID NO: 183341 - RNA, 32 nt, Human
gcuuugucaccuaagcuggagugcagugcgcg

SEQ ID NO: 183342 - RNA, 32 nt, Human
gcuuugucaccuaggcuggcauguaguggcau

SEQ ID NO: 183343 - RNA, 32 nt, Human
gcuuugucacgcaggcuagagugcaguggcgc

SEQ ID NO: 183344 - RNA, 32 nt, Human
gcuuugucagccaggcuggagugcagugacac

SEQ ID NO: 183345 - RNA, 32 nt, Human
gcuuugucaugcuucuucaguaccauggauuu

SEQ ID NO: 183346 - RNA, 19 nt, Human
gcuuuguccaagaagguca

SEQ ID NO: 183347 - RNA, 17 nt, Human
gcuuuguccacccagaa

SEQ ID NO: 183348 - RNA, 32 nt, Human
gcuuugucccccaggcuggagugcgauggcag

SEQ ID NO: 183349 - RNA, 32 nt, Human
gcuuugucccuugccaucaugcccaacaagag

SEQ ID NO: 183350 - RNA, 32 nt, Human
gcuuuguccugagacauccggaaaggaaaggg

SEQ ID NO: 183351 - RNA, 32 nt, Human
gcuuuguccuucaguaccuggcucccuuuuca

SEQ ID NO: 183352 - RNA, 32 nt, Human
gcuuuguccuucagugccugccuccuuuuuca

SEQ ID NO: 183353 - RNA, 32 nt, Human
gcuuuguccuucagugccuggcuccuuuuuca

SEQ ID NO: 183354 - RNA, 32 nt, Human
gcuuugucgcccaggcuggagcgcagucccgc

SEQ ID NO: 183355 - RNA, 32 nt, Human
gcuuugucgcccaggcuggagugcaaugcacg

SEQ ID NO: 183356 - RNA, 32 nt, Human
gcuuugucgcccaggcuggagugcaguggcac

SEQ ID NO: 183357 - RNA, 32 nt, Human
gcuuugucgcccaggcuggagugcaguggcag

SEQ ID NO: 183358 - RNA, 32 nt, Human
gcuuugucgcccaggcuggagugcaguggcgu

SEQ ID NO: 183359 - RNA, 32 nt, Human
gcuuugucgcccuggcuggagugcaguugcgc

SEQ ID NO: 183360 - RNA, 32 nt, Human
gcuuugucucauuccuuuuuggaacaagcaca

SEQ ID NO: 183361 - RNA, 32 nt, Human
gcuuugucucugcuggcuucuuuuuccaugcg

SEQ ID NO: 183362 - RNA, 32 nt, Human
gcuuugucugcaauggcagcugccugagaacc

SEQ ID NO: 183363 - RNA, 32 nt, Human
gcuuugugaacuuuuaugugugcaaaggauca

SEQ ID NO: 183364 - RNA, 32 nt, Human
gcuuugugaagaaaccaucagcaggcugugag

SEQ ID NO: 183365 - RNA, 32 nt, Human
gcuuugugagaagaaugaaaaauaauguccau

SEQ ID NO: 183366 - RNA, 32 nt, Human
gcuuugugccacccucucccuugccaaagaag

SEQ ID NO: 183367 - RNA, 32 nt, Human
gcuuugugcccagaggccacugaagaugguag

SEQ ID NO: 183368 - RNA, 32 nt, Human
gcuuugugcuaaaagcaugggaaauguaaagg

SEQ ID NO: 183369 - RNA, 32 nt, Human
gcuuugugcucugagcaggagcugccaccgcc

SEQ ID NO: 183370 - RNA, 32 nt, Human
gcuuuguggauuccaaaggccaccaggcccuu

SEQ ID NO: 183371 - RNA, 32 nt, Human
gcuuugugucugcaugugugacacugauucuu

SEQ ID NO: 183372 - RNA, 32 nt, Human
gcuuugugucugcuggcaccaagagggcugag

SEQ ID NO: 183373 - RNA, 32 nt, Human
gcuuuguguggguuggaagagacugaagauau

SEQ ID NO: 183374 - RNA, 32 nt, Human
gcuuuguguguggaguuuuccaugaagugcag

SEQ ID NO: 183375 - RNA, 32 nt, Human
gcuuuguuaucucaagugguggcacagaguuc

SEQ ID NO: 183376 - RNA, 32 nt, Human
gcuuuguucacuuaaaaguuuccucuuccugg

SEQ ID NO: 183377 - RNA, 32 nt, Human
gcuuuguuccaggaguuuggugacaaaguuuu

SEQ ID NO: 183378 - RNA, 32 nt, Human
gcuuuguuccaguaaaacuuuguuuacaaaug

SEQ ID NO: 183379 - RNA, 32 nt, Human
gcuuuguugccaggcuggagugcaguggcgcg

SEQ ID NO: 183380 - RNA, 32 nt, Human
gcuuuguugcccagacuggagggcaguggcgc

SEQ ID NO: 183381 - RNA, 32 nt, Human
gcuuuguugcccagacuggagugcaguggcau

SEQ ID NO: 183382 - RNA, 32 nt, Human
gcuuuguugcccaggcuggagugcaguagcac

SEQ ID NO: 183383 - RNA, 32 nt, Human
gcuuuguugcccaggcuggagugccuuggcgc

SEQ ID NO: 183384 - RNA, 32 nt, Human
gcuuuguugcccaggcuggagugcgguggugc

SEQ ID NO: 183385 - RNA, 32 nt, Human
gcuuuguugcccaggcuggaguggaguggcgu

SEQ ID NO: 183386 - RNA, 32 nt, Human
gcuuuguugcccaggcuggagugugguggggc

SEQ ID NO: 183387 - RNA, 32 nt, Human
gcuuuguugcccaggcuggggugcaguggcac

SEQ ID NO: 183388 - RNA, 32 nt, Human
gcuuuguugccugucuugcugucuagggaugg

SEQ ID NO: 183389 - RNA, 32 nt, Human
gcuuuguuggaucagagcagauuuuucacccu

SEQ ID NO: 183390 - RNA, 32 nt, Human
gcuuuguuuaaaaacaauaaaugaagugaaaa

SEQ ID NO: 183391 - RNA, 32 nt, Human
gcuuuguuucccaggcuggagugcaguggcac

SEQ ID NO: 183392 - RNA, 32 nt, Human
gcuuuuaaaauacauuuggccucugcccuuca

SEQ ID NO: 183393 - RNA, 32 nt, Human
gcuuuuaaaauuauaauaagggaaguuuauuu

SEQ ID NO: 183394 - RNA, 32 nt, Human
gcuuuuaaacgucagguaagaggggaacagcu

SEQ ID NO: 183395 - RNA, 26 nt, Human
gcuuuuaaagcaaaaaaugcuuuaaa

SEQ ID NO: 183396 - RNA, 32 nt, Human
gcuuuuaaccaagucucaacacuuacuauaca

SEQ ID NO: 183397 - RNA, 32 nt, Human
gcuuuuaacgaaaaucacaacuucaggagaca

SEQ ID NO: 183398 - RNA, 32 nt, Human
gcuuuuaacugauucucaacucuuacuacaug

SEQ ID NO: 183399 - RNA, 32 nt, Human
gcuuuuaagagcuuccuuugaccacugucuuu

SEQ ID NO: 183400 - RNA, 32 nt, Human
gcuuuuaaguugagagcggaaucuuuuugaaa

SEQ ID NO: 183401 - RNA, 32 nt, Human
gcuuuuacaagagauuuucuuccucacaugaa

SEQ ID NO: 183402 - RNA, 32 nt, Human
gcuuuuacaauguguuagcagaaaccaguggg

SEQ ID NO: 183403 - RNA, 32 nt, Human
gcuuuuacagggagaauggaagcauguggcgu

SEQ ID NO: 183404 - RNA, 32 nt, Human
gcuuuuaccagcuggccccauuccuucugcug

SEQ ID NO: 183405 - RNA, 20 nt, Human
gcuuuuaccuacccacuccu

SEQ ID NO: 183406 - RNA, 32 nt, Human
gcuuuuacuaugagagguacuacuuuuuauaa

SEQ ID NO: 183407 - RNA, 32 nt, Human
gcuuuuagaacuuggguucaaggaagauggag

SEQ ID NO: 183408 - RNA, 32 nt, Human
gcuuuuagacuuuucaguguuuucuuuuucca

SEQ ID NO: 183409 - RNA, 32 nt, Human
gcuuuuagaugagacaucuuuccaggaguaga

SEQ ID NO: 183410 - RNA, 32 nt, Human
gcuuuuaggacuagccgccaacuuucuguaca

SEQ ID NO: 183411 - RNA, 32 nt, Human
gcuuuuaggagaaacgaagacaacucaggacc

SEQ ID NO: 183412 - RNA, 32 nt, Human
gcuuuuagucuccccuuccuucugccuugggg

SEQ ID NO: 183413 - RNA, 32 nt, Human
gcuuuuaguuggagagauacaggaagccuccu

SEQ ID NO: 183414 - RNA, 32 nt, Human
gcuuuuauccauucuucucuguccugucuucc

SEQ ID NO: 183415 - RNA, 32 nt, Human
gcuuuuaucugugucuuuuggaaaaggagcug

SEQ ID NO: 183416 - RNA, 32 nt, Human
gcuuuuaucuuuacuauuuucucccucuuaau

SEQ ID NO: 183417 - RNA, 32 nt, Human
gcuuuuauucauuucccccauccugguuuaag

SEQ ID NO: 183418 - RNA, 32 nt, Human
gcuuuuauugcccaggcuggaguguaguggcg

SEQ ID NO: 183419 - RNA, 32 nt, Human
gcuuuuauugggaggaaaggaggcagcugcag

SEQ ID NO: 183420 - RNA, 32 nt, Human
gcuuuuauuuucuccucuccagugggguuggc

SEQ ID NO: 183421 - RNA, 32 nt, Human
gcuuuucacccaggaggagaggcguggcugag

SEQ ID NO: 183422 - RNA, 32 nt, Human
gcuuuucacuagcugugaaccagccuuccugu

SEQ ID NO: 183423 - RNA, 32 nt, Human
gcuuuucagaacuugagauguggcagcacugg

SEQ ID NO: 183424 - RNA, 23 nt, Human
gcuuuucaguauccucuuucaca

SEQ ID NO: 183425 - RNA, 32 nt, Human
gcuuuucaugggguucuauaaggaggcaugcc

SEQ ID NO: 183426 - RNA, 32 nt, Human
gcuuuucauucccacccccacccggaaccucc

SEQ ID NO: 183427 - RNA, 32 nt, Human
gcuuuuccaagaaaagcuagagcagagcagcc

SEQ ID NO: 183428 - RNA, 32 nt, Human
gcuuuuccaagaaacaauacaauauuacuggc

SEQ ID NO: 183429 - RNA, 31 nt, Human
gcuuuucccagauagcaccuacccaacccag

SEQ ID NO: 183430 - RNA, 18 nt, Human
gcuuuuccccugcaccac

SEQ ID NO: 183431 - RNA, 32 nt, Human
gcuuuuccuaggagaacgauaagaaauggaaa

SEQ ID NO: 183432 - RNA, 32 nt, Human
gcuuuuccucaggcucuucauugguuuccaag

SEQ ID NO: 183433 - RNA, 32 nt, Human
gcuuuuccuccaggaaggggcuucuggguguc

SEQ ID NO: 183434 - RNA, 32 nt, Human
gcuuuuccuuccaucuccuucucuccacccgc

SEQ ID NO: 183435 - RNA, 32 nt, Human
gcuuuucuacccuacccugccggugagggaca

SEQ ID NO: 183436 - RNA, 32 nt, Human
gcuuuucuagcuguuuuuaccuaguuagcuug

SEQ ID NO: 183437 - RNA, 32 nt, Human
gcuuuucuccacccagcaugucuccugcccau

SEQ ID NO: 183438 - RNA, 32 nt, Human
gcuuuucuccacugccauguguccuggucaag

SEQ ID NO: 183439 - RNA, 32 nt, Human
gcuuuucucccaccccuccuagcacccccaca

SEQ ID NO: 183440 - RNA, 32 nt, Human
gcuuuucucccucauccuccccaauccccaaa

SEQ ID NO: 183441 - RNA, 21 nt, Human
gcuuuucucccugucggccag

SEQ ID NO: 183442 - RNA, 32 nt, Human
gcuuuucucucucacucucucucccccaaccc

SEQ ID NO: 183443 - RNA, 32 nt, Human
gcuuuucucugccuuucuaccgaccaugugac

SEQ ID NO: 183444 - RNA, 32 nt, Human
gcuuuucugcgaguucuucugccuccugcugg

SEQ ID NO: 183445 - RNA, 32 nt, Human
gcuuuucugcugucuuuguuacuucuugugcc

SEQ ID NO: 183446 - RNA, 23 nt, Human
gcuuuucuggauaaaguuugguu

SEQ ID NO: 183447 - RNA, 32 nt, Human
gcuuuucuguuuaaagugugugugcacaugag

SEQ ID NO: 183448 - RNA, 32 nt, Human
gcuuuucuucuuggaaauuccucguggaccuc

SEQ ID NO: 183449 - RNA, 32 nt, Human
gcuuuucuugacucacagcccagguucuucug

SEQ ID NO: 183450 - RNA, 32 nt, Human
gcuuuucuugacuugccaaaucagugaauggu

SEQ ID NO: 183451 - RNA, 32 nt, Human
gcuuuucuuuauguuuuuaaagggccucugcu

SEQ ID NO: 183452 - RNA, 32 nt, Human
gcuuuucuuuucccuuccacaggcugguugca

SEQ ID NO: 183453 - RNA, 32 nt, Human
gcuuuugaaagaagagaaauauggcucuguuc

SEQ ID NO: 183454 - RNA, 32 nt, Human
gcuuuugaacccaggaggcagagguugcagcg

SEQ ID NO: 183455 - RNA, 32 nt, Human
gcuuuugaauccuuaauuagcacaguagaaau

SEQ ID NO: 183456 - RNA, 32 nt, Human
gcuuuugaccucaagucuuuugucuucugagu

SEQ ID NO: 183457 - RNA, 32 nt, Human
gcuuuugagaaaacaaugauguaaauuccuua

SEQ ID NO: 183458 - RNA, 32 nt, Human
gcuuuugaggagacagacucccagugguacua

SEQ ID NO: 183459 - RNA, 32 nt, Human
gcuuuugagucugacaaaaucagaguuaggau

SEQ ID NO: 183460 - RNA, 32 nt, Human
gcuuuugcagccaggggucaggagguggcucg

SEQ ID NO: 183461 - RNA, 32 nt, Human
gcuuuugcaggugaggcagggaagaggcauga

SEQ ID NO: 183462 - RNA, 32 nt, Human
gcuuuugcaugcuuaaggauuccaaacgacua

SEQ ID NO: 183463 - RNA, 32 nt, Human
gcuuuugcaugcuuaaggauuccaaaggacua

SEQ ID NO: 183464 - RNA, 32 nt, Human
gcuuuugccucugcccaaccagguugcaguag

SEQ ID NO: 183465 - RNA, 32 nt, Human
gcuuuugccugcacucuugccugcugcccuga

SEQ ID NO: 183466 - RNA, 32 nt, Human
gcuuuugccugggaccacuuccucccugaaac

SEQ ID NO: 183467 - RNA, 32 nt, Human
gcuuuugccugggagaguauucucuugcugcu

SEQ ID NO: 183468 - RNA, 32 nt, Human
gcuuuugccuguaaucccaacacuuugggagg

SEQ ID NO: 183469 - RNA, 32 nt, Human
gcuuuugccuguuuguagaggaaaaggugggc

SEQ ID NO: 183470 - RNA, 32 nt, Human
gcuuuugccuucuugaugccagccugcugcaa

SEQ ID NO: 183471 - RNA, 32 nt, Human
gcuuuugcgucaggcuucugccugagcucggu

SEQ ID NO: 183472 - RNA, 32 nt, Human
gcuuuugcugagcuuugcaucuugccuccuuc

SEQ ID NO: 183473 - RNA, 32 nt, Human
gcuuuugcuggagcugugcuaggcugagggaa

SEQ ID NO: 183474 - RNA, 32 nt, Human
gcuuuugcuggcacguaggcuaccacucuccg

SEQ ID NO: 183475 - RNA, 32 nt, Human
gcuuuugcuguuggugggcuuugagaaaaaca

SEQ ID NO: 183476 - RNA, 32 nt, Human
gcuuuugcuguuuucuuuacucuugucaaggu

SEQ ID NO: 183477 - RNA, 32 nt, Human
gcuuuugcuugauccagaagagcccauaucac

SEQ ID NO: 183478 - RNA, 32 nt, Human
gcuuuuggagugaccaaaagcacagaggcagc

SEQ ID NO: 183479 - RNA, 32 nt, Human
gcuuuuggccggcuuggcauugggugggcggc

SEQ ID NO: 183480 - RNA, 21 nt, Human
gcuuuugggaagucucagcag

SEQ ID NO: 183481 - RNA, 32 nt, Human
gcuuuugggcucaucacuggccuggggagggc

SEQ ID NO: 183482 - RNA, 32 nt, Human
gcuuuugggcuuauuuucuugcacuggugcag

SEQ ID NO: 183483 - RNA, 32 nt, Human
gcuuuugguccuccaggcaucuugcugaaacu

SEQ ID NO: 183484 - RNA, 32 nt, Human
gcuuuuguaaauugaauaaagauggacuucua

SEQ ID NO: 183485 - RNA, 32 nt, Human
gcuuuugucaaagaggccuccuuucccucacc

SEQ ID NO: 183486 - RNA, 32 nt, Human
gcuuuugucaccaagacaugaaaagcugccau

SEQ ID NO: 183487 - RNA, 32 nt, Human
gcuuuugucaucucccggaguauucauccuca

SEQ ID NO: 183488 - RNA, 32 nt, Human
gcuuuugucccccaagcuggaguacaaugaca

SEQ ID NO: 183489 - RNA, 32 nt, Human
gcuuuugucccuucucuucaucuggucuuggg

SEQ ID NO: 183490 - RNA, 32 nt, Human
gcuuuugucugguccucugagccccagugaga

SEQ ID NO: 183491 - RNA, 32 nt, Human
gcuuuugucuuuucauaguuuuccuuguauag

SEQ ID NO: 183492 - RNA, 32 nt, Human
gcuuuuguugcccaggcuggagugcaauggcg

SEQ ID NO: 183493 - RNA, 32 nt, Human
gcuuuuguugugugugacuccaaagaaugccc

SEQ ID NO: 183494 - RNA, 32 nt, Human
gcuuuuuaaaugauguaauucccacuguaaua

SEQ ID NO: 183495 - RNA, 32 nt, Human
gcuuuuuaacagggcauuuaaguggcuagcaa

SEQ ID NO: 183496 - RNA, 32 nt, Human
gcuuuuucagaucagucuccacagcuaccauc

SEQ ID NO: 183497 - RNA, 32 nt, Human
gcuuuuuccucucaucagcccugugcaguagg

SEQ ID NO: 183498 - RNA, 32 nt, Human
gcuuuuuccugccuccuuccucuccucucucu

SEQ ID NO: 183499 - RNA, 32 nt, Human
gcuuuuuccugccucuguuucccuagcaagug

SEQ ID NO: 183500 - RNA, 32 nt, Human
gcuuuuucuccccuccucuauuccuuuuaggg

SEQ ID NO: 183501 - RNA, 17 nt, Human
gcuuuuugaaaauuuug

SEQ ID NO: 183502 - RNA, 32 nt, Human
gcuuuuugaauagagacuccauggaguugguc

SEQ ID NO: 183503 - RNA, 32 nt, Human
gcuuuuugagacaaggucucacugucacccag

SEQ ID NO: 183504 - RNA, 32 nt, Human
gcuuuuugauugcugcagguaacugaaacaaa

SEQ ID NO: 183505 - RNA, 32 nt, Human
gcuuuuugcaccacuguucuagccuuuaaugc

SEQ ID NO: 183506 - RNA, 32 nt, Human
gcuuuuugcauguaucuucuaagaauuuuauc

SEQ ID NO: 183507 - RNA, 22 nt, Human
gcuuuuuggucuguuuguuuga

SEQ ID NO: 183508 - RNA, 32 nt, Human
gcuuuuuguuaaaacaugucuauagaguuggc

SEQ ID NO: 183509 - RNA, 32 nt, Human
gcuuuuuguucuguuuugcaacauuuuguagu

SEQ ID NO: 183510 - RNA, 32 nt, Human
gcuuuuuguuugcaucauuuaacugaacugug

SEQ ID NO: 183511 - RNA, 20 nt, Human
ggaaaaaaucaaugaucuca

SEQ ID NO: 183512 - RNA, 18 nt, Human
ggaaaaaauugcuuuuga

SEQ ID NO: 183513 - RNA, 32 nt, Human
ggaaaaacaaaaagauauugcugagaugaccu

SEQ ID NO: 183514 - RNA, 32 nt, Human
ggaaaaacaaacaugaauccugugauauuggg

SEQ ID NO: 183515 - RNA, 32 nt, Human
ggaaaaacaaaugaucuguuaacaaaggacug

SEQ ID NO: 183516 - RNA, 32 nt, Human
ggaaaaacaaauuugcacaauggccugggaag

SEQ ID NO: 183517 - RNA, 32 nt, Human
ggaaaaacaauggaaaugcacaguacugaaua

SEQ ID NO: 183518 - RNA, 19 nt, Human
ggaaaaacagacuuuggga

SEQ ID NO: 183519 - RNA, 22 nt, Human
ggaaaaacagggccacuuacca

SEQ ID NO: 183520 - RNA, 20 nt, Human
ggaaaaacagugccuggaga

SEQ ID NO: 183521 - RNA, 17 nt, Human
ggaaaaacaucucuggg

SEQ ID NO: 183522 - RNA, 18 nt, Human
ggaaaaacccucugaaga

SEQ ID NO: 183523 - RNA, 32 nt, Human
ggaaaaacuacaaauuucuaauuuagcugaag

SEQ ID NO: 183524 - RNA, 32 nt, Human
ggaaaaacuaccaucuccccugcccaccaugg

SEQ ID NO: 183525 - RNA, 32 nt, Human
ggaaaaacucuugcuuucugcacuuucgcccc

SEQ ID NO: 183526 - RNA, 32 nt, Human
ggaaaaagaaaauucuugggcucacaaaacug

SEQ ID NO: 183527 - RNA, 19 nt, Human
ggaaaaagagccaauguca

SEQ ID NO: 183528 - RNA, 32 nt, Human
ggaaaaagagccagggccggaaggagggugca

SEQ ID NO: 183529 - RNA, 32 nt, Human
ggaaaaagaggagaagaaaaagaaguaccacu

SEQ ID NO: 183530 - RNA, 32 nt, Human
ggaaaaagaguguugcaauuuaucaucaauuu

SEQ ID NO: 183531 - RNA, 32 nt, Human
ggaaaaagaucauucgggaaauggcgguggcu

SEQ ID NO: 183532 - RNA, 32 nt, Human
ggaaaaagcauacacccccaaacagaaaggag

SEQ ID NO: 183533 - RNA, 32 nt, Human
ggaaaaagccuuggaagagaaaaguagaauuc

SEQ ID NO: 183534 - RNA, 32 nt, Human
ggaaaaagcugaugguccuguccaaaggcuau

SEQ ID NO: 183535 - RNA, 32 nt, Human
ggaaaaaggagaaaggagaggagaguucucug

SEQ ID NO: 183536 - RNA, 32 nt, Human
ggaaaaaggagagacucuagacauucagaguc

SEQ ID NO: 183537 - RNA, 32 nt, Human
  misc_feature (22)..(22): n is a, c, g or u
ggaaaaaggagaggaggaaacnagugaggcag

SEQ ID NO: 183538 - RNA, 32 nt, Human
ggaaaaaggcccagagcuguggccggacagag

SEQ ID NO: 183539 - RNA, 32 nt, Human
ggaaaaaggccuucccaggcgcgagaagauga

SEQ ID NO: 183540 - RNA, 21 nt, Human
ggaaaaaguaggagaggcaga

SEQ ID NO: 183541 - RNA, 19 nt, Human
ggaaaaauagacugcagaa

SEQ ID NO: 183542 - RNA, 32 nt, Human
ggaaaaaucacccuucagacuuugcuuuucuu

SEQ ID NO: 183543 - RNA, 32 nt, Human
ggaaaaaucacuuuccagucuguuuugcaagg

SEQ ID NO: 183544 - RNA, 18 nt, Human
ggaaaaaucauucuggga

SEQ ID NO: 183545 - RNA, 32 nt, Human
ggaaaaauccacugcaccuccacuuggugacu

SEQ ID NO: 183546 - RNA, 32 nt, Human
ggaaaaaucgagccucucccacccucagucgc

SEQ ID NO: 183547 - RNA, 32 nt, Human
ggaaaaaucuccuuucugcuucccagagaggg

SEQ ID NO: 183548 - RNA, 32 nt, Human
ggaaaaaugagguauguggacaaguagaaggu

SEQ ID NO: 183549 - RNA, 32 nt, Human
ggaaaaaugaugguuugggcauauugguauaa

SEQ ID NO: 183550 - RNA, 32 nt, Human
ggaaaaaugcugcuucuccucccagcgugugu

SEQ ID NO: 183551 - RNA, 32 nt, Human
ggaaaaauggaugauuccaaagcaagggcaag

SEQ ID NO: 183552 - RNA, 32 nt, Human
ggaaaaauggcugaccccauggacaccuccuc

SEQ ID NO: 183553 - RNA, 32 nt, Human
ggaaaaauuaggagaaagugaggugcuauaua

SEQ ID NO: 183554 - RNA, 32 nt, Human
ggaaaaauuauaaucacuaaucuugguucuuu

SEQ ID NO: 183555 - RNA, 32 nt, Human
ggaaaaauucuuugaugguuuuuccuugaaaa

SEQ ID NO: 183556 - RNA, 32 nt, Human
ggaaaacaaacaguagcagcuaauauucucaa

SEQ ID NO: 183557 - RNA, 32 nt, Human
ggaaaacaacagcaacaaaaucuguuuuuaaa

SEQ ID NO: 183558 - RNA, 21 nt, Human
ggaaaacaaccacuucuggga

SEQ ID NO: 183559 - RNA, 22 nt, Human
ggaaaacaaggggcuaccuacc

SEQ ID NO: 183560 - RNA, 19 nt, Human
ggaaaacaauugcuuuuga

SEQ ID NO: 183561 - RNA, 21 nt, Human
ggaaaacacaccccggucuca

SEQ ID NO: 183562 - RNA, 32 nt, Human
ggaaaacacagcaaacuagaaaguccaguugg

SEQ ID NO: 183563 - RNA, 32 nt, Human
ggaaaacaccucuuccuuuuaauugcucugag

SEQ ID NO: 183564 - RNA, 17 nt, Human
ggaaaacaccuuuggga

SEQ ID NO: 183565 - RNA, 32 nt, Human
ggaaaacacuggccuaucggcuguaauaggaa

SEQ ID NO: 183566 - RNA, 32 nt, Human
ggaaaacagaaaccacacuaaguauuucaaga

SEQ ID NO: 183567 - RNA, 32 nt, Human
ggaaaacagaagccacacuguauuccagauga

SEQ ID NO: 183568 - RNA, 21 nt, Human
ggaaaacagcccugcuucuga

SEQ ID NO: 183569 - RNA, 32 nt, Human
ggaaaacaggccuccccucccucucucggcac

SEQ ID NO: 183570 - RNA, 32 nt, Human
ggaaaacaggucacagcuauguuuccaguguc

SEQ ID NO: 183571 - RNA, 32 nt, Human
ggaaaacauacccuuuuucuucaacaggcuuu

SEQ ID NO: 183572 - RNA, 24 nt, Human
ggaaaacauggaggaggaggcuga

SEQ ID NO: 183573 - RNA, 32 nt, Human
ggaaaacauggcuguuucaaaagagaaaaaua

SEQ ID NO: 183574 - RNA, 23 nt, Human
ggaaaaccaaaccuagugauacu

SEQ ID NO: 183575 - RNA, 19 nt, Human
ggaaaaccacugcagugug

SEQ ID NO: 183576 - RNA, 32 nt, Human
ggaaaaccagaagaacagagcaguggcacugg

SEQ ID NO: 183577 - RNA, 19 nt, Human
ggaaaacccauucucuggg

SEQ ID NO: 183578 - RNA, 32 nt, Human
ggaaaaccccuaaaaauccccaaaacagaaac

SEQ ID NO: 183579 - RNA, 21 nt, Human
ggaaaacccgucccugggccg

SEQ ID NO: 183580 - RNA, 32 nt, Human
ggaaaaccggagaggcgcaucuugccggcuac

SEQ ID NO: 183581 - RNA, 23 nt, Human
ggaaaacgcagcuacaccuggag

SEQ ID NO: 183582 - RNA, 32 nt, Human
ggaaaacggaaaggaaagaucagcagaaauag

SEQ ID NO: 183583 - RNA, 17 nt, Human
ggaaaacuacuuuggga

SEQ ID NO: 183584 - RNA, 32 nt, Human
ggaaaacucggggcuuugugccagucucuaag

SEQ ID NO: 183585 - RNA, 32 nt, Human
ggaaaacugaaaacuguucaacucccuugacu

SEQ ID NO: 183586 - RNA, 32 nt, Human
ggaaaacugcaagccgcucuguuccugggccu

SEQ ID NO: 183587 - RNA, 32 nt, Human
ggaaaacugcacugugaggcggggcgaugggg

SEQ ID NO: 183588 - RNA, 32 nt, Human
ggaaaacuggaaaaucuggauggcagagaaau

SEQ ID NO: 183589 - RNA, 32 nt, Human
ggaaaacuggacuguggccagggcuggccccc

SEQ ID NO: 183590 - RNA, 32 nt, Human
ggaaaacuguaaagacuuccaggucccaucca

SEQ ID NO: 183591 - RNA, 32 nt, Human
ggaaaacuugcaguuauucuggaagcaccggc

SEQ ID NO: 183592 - RNA, 32 nt, Human
ggaaaagaaaaaggagaaaaacaaagagauuu

SEQ ID NO: 183593 - RNA, 32 nt, Human
ggaaaagaaacuuggauuaaaugagugugcug

SEQ ID NO: 183594 - RNA, 32 nt, Human
ggaaaagaaagagagaucagacuguuacugug

SEQ ID NO: 183595 - RNA, 31 nt, Human
ggaaaagaacaaugccacucucuuuuaugua

SEQ ID NO: 183596 - RNA, 32 nt, Human
ggaaaagaauacuuuguuuccagcccccuucc

SEQ ID NO: 183597 - RNA, 32 nt, Human
ggaaaagacacaagaccuuccccacauccugu

SEQ ID NO: 183598 - RNA, 32 nt, Human
ggaaaagacagagucagacagggagccugggg

SEQ ID NO: 183599 - RNA, 32 nt, Human
ggaaaagacuccuucucccaaagaagaagaug

SEQ ID NO: 183600 - RNA, 32 nt, Human
ggaaaagagaaaacugcaucacagucccauuc

SEQ ID NO: 183601 - RNA, 32 nt, Human
ggaaaagagaaaagggaaagaaauccagagaa

SEQ ID NO: 183602 - RNA, 31 nt, Human
ggaaaagagaggagagaaaagcaacugaguu

SEQ ID NO: 183603 - RNA, 18 nt, Human
ggaaaagagcucuggaga

SEQ ID NO: 183604 - RNA, 32 nt, Human
ggaaaagaggagaagagcaaacaggcacuuug

SEQ ID NO: 183605 - RNA, 32 nt, Human
ggaaaagaggucaccuuccagcagugaaauga

SEQ ID NO: 183606 - RNA, 17 nt, Human
ggaaaagagguuuuuga

SEQ ID NO: 183607 - RNA, 32 nt, Human
ggaaaagaguccaaacaccuacccacaccugc

SEQ ID NO: 183608 - RNA, 32 nt, Human
ggaaaagauaccaaaugccugcugcuaccacc

SEQ ID NO: 183609 - RNA, 32 nt, Human
ggaaaagcaagaaacgcuugaaagaagugaaa

SEQ ID NO: 183610 - RNA, 32 nt, Human
ggaaaagcagccugggcuucacuggcaggaag

SEQ ID NO: 183611 - RNA, 28 nt, Human
ggaaaagcagcugcugccucucuccugg

SEQ ID NO: 183612 - RNA, 32 nt, Human
ggaaaagcaggagguaguugugccucaauuau

SEQ ID NO: 183613 - RNA, 32 nt, Human
ggaaaagcaggauggcauacaccccacugaag

SEQ ID NO: 183614 - RNA, 32 nt, Human
ggaaaagcagggccaaggaugaggcuuucuuc

SEQ ID NO: 183615 - RNA, 32 nt, Human
ggaaaagcaguuugcucgaggaaagguauucg

SEQ ID NO: 183616 - RNA, 32 nt, Human
ggaaaagcaucugccacaaaaauguucacuuc

SEQ ID NO: 183617 - RNA, 32 nt, Human
ggaaaagcaucuugucaggaagcguccuuucu

SEQ ID NO: 183618 - RNA, 32 nt, Human
ggaaaagcccagggucuggggcagcagagcca

SEQ ID NO: 183619 - RNA, 32 nt, Human
ggaaaagcccggugggcucugagucuucuggg

SEQ ID NO: 183620 - RNA, 32 nt, Human
ggaaaagccuguccgcaguccugggccgccuc

SEQ ID NO: 183621 - RNA, 32 nt, Human
ggaaaagcgugccuccagccguggggacaggc

SEQ ID NO: 183622 - RNA, 32 nt, Human
ggaaaagcucuaaacaggcuuaaugauucuuc

SEQ ID NO: 183623 - RNA, 32 nt, Human
ggaaaagcuguucccaugucuaacaggacuug

SEQ ID NO: 183624 - RNA, 19 nt, Human
ggaaaagcuuuugaucuua

SEQ ID NO: 183625 - RNA, 32 nt, Human
ggaaaaggaagcaccagguggaaagggagguu

SEQ ID NO: 183626 - RNA, 32 nt, Human
ggaaaaggaagugcccuuauccacgaccaagc

SEQ ID NO: 183627 - RNA, 32 nt, Human
ggaaaaggaauuguuuucaaaguaauuucaua

SEQ ID NO: 183628 - RNA, 32 nt, Human
ggaaaaggagaaaauguccuuuuggaagaaua

SEQ ID NO: 183629 - RNA, 21 nt, Human
ggaaaaggaggaggaggaaga

SEQ ID NO: 183630 - RNA, 32 nt, Human
ggaaaaggaggaggugucuggggugagggagu

SEQ ID NO: 183631 - RNA, 32 nt, Human
ggaaaaggagucaggagccacugugaggugag

SEQ ID NO: 183632 - RNA, 32 nt, Human
ggaaaaggagucgggcuggcaggacagaggga

SEQ ID NO: 183633 - RNA, 18 nt, Human
ggaaaaggauuguucugg

SEQ ID NO: 183634 - RNA, 32 nt, Human
ggaaaaggcaaaggagcacauucugucuagag

SEQ ID NO: 183635 - RNA, 32 nt, Human
ggaaaaggccucugccuuccucaggagggaca

SEQ ID NO: 183636 - RNA, 32 nt, Human
ggaaaaggccugccaccaaagcaggaagcugc

SEQ ID NO: 183637 - RNA, 32 nt, Human
ggaaaaggcugaugcuucagggaacagauguu

SEQ ID NO: 183638 - RNA, 32 nt, Human
ggaaaagggaaaggcagacgaauggcauggcu

SEQ ID NO: 183639 - RNA, 32 nt, Human
ggaaaagggaacgugguacucacuggaugcac

SEQ ID NO: 183640 - RNA, 32 nt, Human
ggaaaagggaauggguagcauaaggaaaggaa

SEQ ID NO: 183641 - RNA, 32 nt, Human
ggaaaagggaauucauuaaacauaucauccuu

SEQ ID NO: 183642 - RNA, 32 nt, Human
ggaaaagggagaaagggaggcucccgggagca

SEQ ID NO: 183643 - RNA, 32 nt, Human
ggaaaagggcaaucagcaaucaacugagguuu

SEQ ID NO: 183644 - RNA, 32 nt, Human
ggaaaagggcuggcucggagucuagacucuuc

SEQ ID NO: 183645 - RNA, 17 nt, Human
ggaaaagggucuuggga

SEQ ID NO: 183646 - RNA, 17 nt, Human
ggaaaagguguuuuuga

SEQ ID NO: 183647 - RNA, 32 nt, Human
ggaaaagguuauggaacuggagggggugagcu

SEQ ID NO: 183648 - RNA, 24 nt, Human
ggaaaagguugauauaauaaugca

SEQ ID NO: 183649 - RNA, 32 nt, Human
ggaaaaguauugaaguucaaauccagauagua

SEQ ID NO: 183650 - RNA, 21 nt, Human
ggaaaaguccuggcugggaga

SEQ ID NO: 183651 - RNA, 32 nt, Human
ggaaaagugaagagcagugugcugucacacac

SEQ ID NO: 183652 - RNA, 32 nt, Human
ggaaaauacacaccuggggaguacauuugaca

SEQ ID NO: 183653 - RNA, 32 nt, Human
ggaaaauagaggcauuguagaauagcaguuca

SEQ ID NO: 183654 - RNA, 32 nt, Human
ggaaaauagaucuaggcagagugccuuaguca

SEQ ID NO: 183655 - RNA, 32 nt, Human
ggaaaaucaucccauuccuaucuucuuccuca

SEQ ID NO: 183656 - RNA, 32 nt, Human
ggaaaaucaucucccauuucuccacagggcag

SEQ ID NO: 183657 - RNA, 32 nt, Human
ggaaaaucauuucuuguccuuuaaggcaggga

SEQ ID NO: 183658 - RNA, 32 nt, Human
ggaaaauccagcagguggagguugcagugagc

SEQ ID NO: 183659 - RNA, 32 nt, Human
ggaaaauccagccugggagccccuggaguggc

SEQ ID NO: 183660 - RNA, 32 nt, Human
ggaaaaucuacccccuuccuccagcacauugc

SEQ ID NO: 183661 - RNA, 32 nt, Human
ggaaaaucuaguuucacagcuauuugaauuuu

SEQ ID NO: 183662 - RNA, 32 nt, Human
ggaaaaucuccaagagcccugaccucaucuuc

SEQ ID NO: 183663 - RNA, 19 nt, Human
ggaaaaugaagagagccag

SEQ ID NO: 183664 - RNA, 32 nt, Human
ggaaaaugaauccacagcucuacuccagguuc

SEQ ID NO: 183665 - RNA, 32 nt, Human
ggaaaaugacaucacccaggagugauuucucu

SEQ ID NO: 183666 - RNA, 19 nt, Human
ggaaaaugcaaugauuuca

SEQ ID NO: 183667 - RNA, 32 nt, Human
ggaaaaugccuuguugacauuuucuuucagca

SEQ ID NO: 183668 - RNA, 20 nt, Human
ggaaaauggacuguuucuga

SEQ ID NO: 183669 - RNA, 32 nt, Human
ggaaaauggagauguccucuccacuuuauccc

SEQ ID NO: 183670 - RNA, 30 nt, Human
ggaaaauggcggcugccaggcccagccugg

SEQ ID NO: 183671 - RNA, 30 nt, Human
ggaaaaugggggaaaguuuggaacuuccua

SEQ ID NO: 183672 - RNA, 21 nt, Human
ggaaaaugggugguugggaga

SEQ ID NO: 183673 - RNA, 20 nt, Human
ggaaaauggguuucucuggg

SEQ ID NO: 183674 - RNA, 32 nt, Human
ggaaaaugguuucuucauguuuucccaacucu

SEQ ID NO: 183675 - RNA, 32 nt, Human
ggaaaaugugggaaaauuuggaagagauuucc

SEQ ID NO: 183676 - RNA, 32 nt, Human
ggaaaauguggugaaauccugucucuauuuaa

SEQ ID NO: 183677 - RNA, 32 nt, Human
ggaaaauuaauggcucaacaagcacaauaccu

SEQ ID NO: 183678 - RNA, 32 nt, Human
ggaaaauucuuuuugugcauuugagggcaaaa

SEQ ID NO: 183679 - RNA, 18 nt, Human
ggaaaauugacugcagaa

SEQ ID NO: 183680 - RNA, 16 nt, Human
ggaaaauugcuuuuga

SEQ ID NO: 183681 - RNA, 32 nt, Human
ggaaaauuucaaauuuccuuauaguaaaaaua

SEQ ID NO: 183682 - RNA, 20 nt, Human
ggaaaauuuuggaagucaag

SEQ ID NO: 183683 - RNA, 32 nt, Human
ggaaacaaaccagcucgucucagaggccagca

SEQ ID NO: 183684 - RNA, 32 nt, Human
ggaaacaaagaaguaaucauuccccagccccc

SEQ ID NO: 183685 - RNA, 32 nt, Human
ggaaacaaagcauauagaauacaugcuagaag

SEQ ID NO: 183686 - RNA, 32 nt, Human
ggaaacaaaggggaagaggacagugaaugaac

SEQ ID NO: 183687 - RNA, 32 nt, Human
ggaaacaaaugcuguaauucaaaagcauuuga

SEQ ID NO: 183688 - RNA, 32 nt, Human
ggaaacaacacacacuggggccuaugagaggg

SEQ ID NO: 183689 - RNA, 21 nt, Human
ggaaacaacggaggagcucug

SEQ ID NO: 183690 - RNA, 32 nt, Human
ggaaacaagacgggguuucuuggcaggcccug

SEQ ID NO: 183691 - RNA, 32 nt, Human
ggaaacaagccccugucccacgccgucugcac

SEQ ID NO: 183692 - RNA, 32 nt, Human
ggaaacaagguagagaaaaggacgaagaagug

SEQ ID NO: 183693 - RNA, 32 nt, Human
ggaaacaauccuuccuucugguggcagagcca

SEQ ID NO: 183694 - RNA, 32 nt, Human
ggaaacacaauuugagagucaugugaaacgug

SEQ ID NO: 183695 - RNA, 24 nt, Human
ggaaacacacacagcuccugcuga

SEQ ID NO: 183696 - RNA, 32 nt, Human
ggaaacacagggcuucuuggccccagauggca

SEQ ID NO: 183697 - RNA, 32 nt, Human
ggaaacacaugccuucccagacuggccuguug

SEQ ID NO: 183698 - RNA, 32 nt, Human
ggaaacaccuguaggcagaggcugccgagaca

SEQ ID NO: 183699 - RNA, 18 nt, Human
ggaaacacgacucuggga

SEQ ID NO: 183700 - RNA, 21 nt, Human
ggaaacacugacuucugggaa

SEQ ID NO: 183701 - RNA, 32 nt, Human
ggaaacacugcaacuuuccuuaacagccuguu

SEQ ID NO: 183702 - RNA, 22 nt, Human
ggaaacacuggguuccugggaa

SEQ ID NO: 183703 - RNA, 32 nt, Human
ggaaacacugucuaugauaggauuuccaaaag

SEQ ID NO: 183704 - RNA, 32 nt, Human
ggaaacagaacugacugucccggggugcccac

SEQ ID NO: 183705 - RNA, 32 nt, Human
ggaaacagaaugggccagggagguugagugac

SEQ ID NO: 183706 - RNA, 32 nt, Human
ggaaacagacgcgugaaaacugagccccagaa

SEQ ID NO: 183707 - RNA, 32 nt, Human
ggaaacagagggcuggagccagguucugaucc

SEQ ID NO: 183708 - RNA, 32 nt, Human
ggaaacagauggaaaaagugagggaccgguga

SEQ ID NO: 183709 - RNA, 32 nt, Human
ggaaacagcagauggaaauggaaauagccaag

SEQ ID NO: 183710 - RNA, 19 nt, Human
ggaaacagccgcacaguga

SEQ ID NO: 183711 - RNA, 19 nt, Human
ggaaacagcucuccaggga

SEQ ID NO: 183712 - RNA, 17 nt, Human
ggaaacagcuucagaga

SEQ ID NO: 183713 - RNA, 32 nt, Human
ggaaacaggaauaauaaaggcaucacugacca

SEQ ID NO: 183714 - RNA, 21 nt, Human
ggaaacaggagccgaccuccc

SEQ ID NO: 183715 - RNA, 32 nt, Human
ggaaacaggagugaagcccaccagccugccug

SEQ ID NO: 183716 - RNA, 20 nt, Human
ggaaacaggccagcccagug

SEQ ID NO: 183717 - RNA, 32 nt, Human
ggaaacaggcuggagacugcgggugcugcgug

SEQ ID NO: 183718 - RNA, 32 nt, Human
ggaaacagggagaccugggguccuguggauaa

SEQ ID NO: 183719 - RNA, 31 nt, Human
ggaaacagugaaagagaaaaaucugauauug

SEQ ID NO: 183720 - RNA, 32 nt, Human
ggaaacaguggaggcagcggggcaggucgccu

SEQ ID NO: 183721 - RNA, 32 nt, Human
ggaaacaguucaccuccucccuucaucacguc

SEQ ID NO: 183722 - RNA, 32 nt, Human
ggaaacaguuugaaaauguugagacagcacag

SEQ ID NO: 183723 - RNA, 32 nt, Human
ggaaacauacccaggaaguacaguugauaaau

SEQ ID NO: 183724 - RNA, 32 nt, Human
ggaaacaucagaaugucugcucuccuuggucu

SEQ ID NO: 183725 - RNA, 32 nt, Human
ggaaacaugaauaaauccacauggacaggaug

SEQ ID NO: 183726 - RNA, 32 nt, Human
ggaaacauggcaaaauccucucucuauuuuca

SEQ ID NO: 183727 - RNA, 32 nt, Human
ggaaacauggguggcugccugccugccugccu

SEQ ID NO: 183728 - RNA, 32 nt, Human
ggaaacauuuugcugauuuugugaauugccag

SEQ ID NO: 183729 - RNA, 32 nt, Human
ggaaaccaaaguaaccuuuugcaccugcucuc

SEQ ID NO: 183730 - RNA, 32 nt, Human
ggaaaccaacaggugaccucagggagguuugu

SEQ ID NO: 183731 - RNA, 32 nt, Human
ggaaaccaaccgggaugcuaacuacaacaugg

SEQ ID NO: 183732 - RNA, 32 nt, Human
ggaaaccaagaagugagaagcauuucagggga

SEQ ID NO: 183733 - RNA, 32 nt, Human
ggaaaccaagacaggaggauggcuugaagcca

SEQ ID NO: 183734 - RNA, 32 nt, Human
ggaaaccaagccccacacucccgggaagccuc

SEQ ID NO: 183735 - RNA, 32 nt, Human
ggaaaccaaggaagaggaaugggagccacgcg

SEQ ID NO: 183736 - RNA, 32 nt, Human
ggaaaccaauuaaaaugugccuuuggugggcg

SEQ ID NO: 183737 - RNA, 32 nt, Human
ggaaaccacagcagcccaugcacacagaaugg

SEQ ID NO: 183738 - RNA, 32 nt, Human
ggaaaccacaguuugcauuuaggauugugcua

SEQ ID NO: 183739 - RNA, 32 nt, Human
ggaaaccaccugcugggagacaaugggggugg

SEQ ID NO: 183740 - RNA, 32 nt, Human
ggaaaccagaagcuggggauuccagggacccc

SEQ ID NO: 183741 - RNA, 32 nt, Human
ggaaaccagaaggccaaguggaucugcuggca

SEQ ID NO: 183742 - RNA, 31 nt, Human
ggaaaccagagagucggagggaguccaucug

SEQ ID NO: 183743 - RNA, 32 nt, Human
ggaaaccaggcagaggaggcacagggugcucu

SEQ ID NO: 183744 - RNA, 23 nt, Human
ggaaaccaggcuccccucucuca

SEQ ID NO: 183745 - RNA, 32 nt, Human
ggaaaccauacuccuauaaugagcaaaguaac

SEQ ID NO: 183746 - RNA, 32 nt, Human
ggaaaccauggaggccagaaggaagugagaca

SEQ ID NO: 183747 - RNA, 22 nt, Human
ggaaaccauggcagcauggaga

SEQ ID NO: 183748 - RNA, 32 nt, Human
ggaaacccaagaggcugagaauucuuuugucu

SEQ ID NO: 183749 - RNA, 32 nt, Human
ggaaacccaaguguccaucuccaucggaacag

SEQ ID NO: 183750 - RNA, 32 nt, Human
ggaaacccaauccacauuggaacaaggcuucu

SEQ ID NO: 183751 - RNA, 32 nt, Human
ggaaacccaccucucuggaaggccccuucccu

SEQ ID NO: 183752 - RNA, 32 nt, Human
ggaaacccacugucugaagaccacagaggggu

SEQ ID NO: 183753 - RNA, 32 nt, Human
ggaaacccagaagggagagucacugcauguga

SEQ ID NO: 183754 - RNA, 32 nt, Human
ggaaacccagagagacagagacccaaagggag

SEQ ID NO: 183755 - RNA, 19 nt, Human
ggaaacccgacaaacaggg

SEQ ID NO: 183756 - RNA, 32 nt, Human
ggaaacccuauucaauaaauggugcugggaua

SEQ ID NO: 183757 - RNA, 32 nt, Human
ggaaacccuccaggaaaaaguggccccggacg

SEQ ID NO: 183758 - RNA, 32 nt, Human
ggaaacccucuucaauaagaccugugugauga

SEQ ID NO: 183759 - RNA, 32 nt, Human
ggaaacccugguguaccucucaguggcagaau

SEQ ID NO: 183760 - RNA, 20 nt, Human
ggaaacccuuucacuucucu

SEQ ID NO: 183761 - RNA, 32 nt, Human
ggaaaccgacaagauuaaaaauaacuuggcag

SEQ ID NO: 183762 - RNA, 22 nt, Human
ggaaaccgagaugcuucccgca

SEQ ID NO: 183763 - RNA, 32 nt, Human
ggaaaccgcggagcaugacuccuccgaagcug

SEQ ID NO: 183764 - RNA, 32 nt, Human
ggaaaccgcugccuuuaucuugaagucagcca

SEQ ID NO: 183765 - RNA, 32 nt, Human
ggaaaccgggccagcguggggcucccugccuu

SEQ ID NO: 183766 - RNA, 32 nt, Human
ggaaaccuaaacugaggucagcacuugggccc

SEQ ID NO: 183767 - RNA, 32 nt, Human
ggaaaccuacagacaaggaggaguuccaccau

SEQ ID NO: 183768 - RNA, 32 nt, Human
ggaaaccuaccuagaaccuccacccucugaca

SEQ ID NO: 183769 - RNA, 32 nt, Human
ggaaaccucccuuuacagcaccaccuugcgau

SEQ ID NO: 183770 - RNA, 32 nt, Human
ggaaaccugcccugggcgcucccuucauuagc

SEQ ID NO: 183771 - RNA, 28 nt, Human
ggaaaccugcccuguccaccccuucuca

SEQ ID NO: 183772 - RNA, 32 nt, Human
ggaaaccugccuggccccuaaccacaggaggc

SEQ ID NO: 183773 - RNA, 18 nt, Human
ggaaaccugcgaccccuu

SEQ ID NO: 183774 - RNA, 32 nt, Human
ggaaaccugcguucuccuaccucuuccaaccc

SEQ ID NO: 183775 - RNA, 32 nt, Human
ggaaaccuggacugcgugggcucgggcgccug

SEQ ID NO: 183776 - RNA, 18 nt, Human
ggaaaccuggcucaggga

SEQ ID NO: 183777 - RNA, 32 nt, Human
ggaaaccuggugguauggaagcauguacucaa

SEQ ID NO: 183778 - RNA, 32 nt, Human
ggaaaccuuacaggccaggagagagugcuaug

SEQ ID NO: 183779 - RNA, 22 nt, Human
ggaaaccuuuauacccuuguga

SEQ ID NO: 183780 - RNA, 32 nt, Human
ggaaacgagaugguuguagcaccaccagaggu

SEQ ID NO: 183781 - RNA, 32 nt, Human
ggaaacgaggguuuauuccguugcccacuccg

SEQ ID NO: 183782 - RNA, 32 nt, Human
ggaaacgagugcugcacacagaguaggcaucu

SEQ ID NO: 183783 - RNA, 32 nt, Human
ggaaacgccuccgucucuauauaaggaauuuu

SEQ ID NO: 183784 - RNA, 32 nt, Human
ggaaacgccucguccugcucucaggccagaac

SEQ ID NO: 183785 - RNA, 32 nt, Human
ggaaacgcuaccucucugucccuugcuguaug

SEQ ID NO: 183786 - RNA, 32 nt, Human
ggaaacgcugccucugcuugcgugacucugcu

SEQ ID NO: 183787 - RNA, 32 nt, Human
ggaaacgcuggguucagaaaaguguuacaaga

SEQ ID NO: 183788 - RNA, 32 nt, Human
ggaaacggcagauguagauaauucagcauugg

SEQ ID NO: 183789 - RNA, 17 nt, Human
ggaaacguugcuucuga

SEQ ID NO: 183790 - RNA, 32 nt, Human
ggaaacuaagacauuggacugaaggaacuggc

SEQ ID NO: 183791 - RNA, 32 nt, Human
ggaaacuacagaugaaauuuaacuuacucaaa

SEQ ID NO: 183792 - RNA, 32 nt, Human
ggaaacuacuaaucuugccaucuugcuuuaag

SEQ ID NO: 183793 - RNA, 32 nt, Human
ggaaacuagggagggagggagagggagagagg

SEQ ID NO: 183794 - RNA, 32 nt, Human
ggaaacucaagaaugacagcuucuauauuuug

SEQ ID NO: 183795 - RNA, 32 nt, Human
ggaaacucaagccuuaaauguuuaaguaaacu

SEQ ID NO: 183796 - RNA, 32 nt, Human
ggaaacucaaugccccugcuggcuccauuucc

SEQ ID NO: 183797 - RNA, 32 nt, Human
ggaaacucaguaauucucccaccuucacauug

SEQ ID NO: 183798 - RNA, 32 nt, Human
ggaaacucagugcugccuucagaugucauuga

SEQ ID NO: 183799 - RNA, 32 nt, Human
ggaaacuccacaucugccuuaaaaccaaagag

SEQ ID NO: 183800 - RNA, 32 nt, Human
ggaaacucuaaacuccccuuauggucuaccag

SEQ ID NO: 183801 - RNA, 32 nt, Human
ggaaacucugcagcuuugucaucuaacucuuc

SEQ ID NO: 183802 - RNA, 32 nt, Human
ggaaacucugcuuuuaaaaucaucauuuacug

SEQ ID NO: 183803 - RNA, 23 nt, Human
ggaaacugaacuugggcugggag

SEQ ID NO: 183804 - RNA, 32 nt, Human
ggaaacugaagaaaaagacauguggguuacaa

SEQ ID NO: 183805 - RNA, 32 nt, Human
ggaaacugaccuuuuaaaggccacuggcagua

SEQ ID NO: 183806 - RNA, 32 nt, Human
ggaaacugagagaagaggggcuggagugcggc

SEQ ID NO: 183807 - RNA, 22 nt, Human
ggaaacugaggcacggagcggg

SEQ ID NO: 183808 - RNA, 32 nt, Human
ggaaacugaggccuggaauggcccagagucac

SEQ ID NO: 183809 - RNA, 32 nt, Human
ggaaacugaggcgcagagacuugcuuagacac

SEQ ID NO: 183810 - RNA, 32 nt, Human
ggaaacugaggcucaaagagucccacguggac

SEQ ID NO: 183811 - RNA, 18 nt, Human
ggaaacugaggcugagaa

SEQ ID NO: 183812 - RNA, 18 nt, Human
ggaaacugaggcugagag

SEQ ID NO: 183813 - RNA, 22 nt, Human
ggaaacugaggcugagcgggaa

SEQ ID NO: 183814 - RNA, 24 nt, Human
ggaaacugaggcuuggugaaguua

SEQ ID NO: 183815 - RNA, 20 nt, Human
ggaaacugaggcuuugggag

SEQ ID NO: 183816 - RNA, 32 nt, Human
ggaaacugaggugggagaaucgcuugagccug

SEQ ID NO: 183817 - RNA, 32 nt, Human
ggaaacugagucucagaagggcuuugacacuu

SEQ ID NO: 183818 - RNA, 18 nt, Human
ggaaacugaucucuggga

SEQ ID NO: 183819 - RNA, 32 nt, Human
ggaaacugcacacccuccacucaccucuagca

SEQ ID NO: 183820 - RNA, 32 nt, Human
ggaaacugcacacccuccacucaccucuagcu

SEQ ID NO: 183821 - RNA, 32 nt, Human
ggaaacugccaaggccaggugcaguggcuuac

SEQ ID NO: 183822 - RNA, 32 nt, Human
ggaaacugccuuccccaugcagguuugucuua

SEQ ID NO: 183823 - RNA, 23 nt, Human
ggaaacugcgauauuaaaugcca

SEQ ID NO: 183824 - RNA, 19 nt, Human
ggaaacugcgccucagaga

SEQ ID NO: 183825 - RNA, 32 nt, Human
ggaaacugcuagacagccugguccgaaagcau

SEQ ID NO: 183826 - RNA, 32 nt, Human
ggaaacugcugcuguguaccgacugagccagg

SEQ ID NO: 183827 - RNA, 32 nt, Human
ggaaacuggaagagaagcaggcuugcaagaau

SEQ ID NO: 183828 - RNA, 32 nt, Human
ggaaacuggaagcuaaaaauacagagggugac

SEQ ID NO: 183829 - RNA, 32 nt, Human
ggaaacuggauggagagauuuggggaagcaug

SEQ ID NO: 183830 - RNA, 21 nt, Human
ggaaacuggcagaaauaguua

SEQ ID NO: 183831 - RNA, 32 nt, Human
ggaaacuggcuuuucaaaaugggcuaugggag

SEQ ID NO: 183832 - RNA, 32 nt, Human
ggaaacugggagagagaagcuguggucuccug

SEQ ID NO: 183833 - RNA, 31 nt, Human
ggaaacuggguggacggcauggguuggucuc

SEQ ID NO: 183834 - RNA, 32 nt, Human
ggaaacuguggcagaugagugggagacugguu

SEQ ID NO: 183835 - RNA, 32 nt, Human
ggaaacuguguguauguauacauacauuuucc

SEQ ID NO: 183836 - RNA, 32 nt, Human
ggaaacuucuccccucccaccuucaccuuuag

SEQ ID NO: 183837 - RNA, 32 nt, Human
ggaaacuucuucuuccguggcuuuuggggccc

SEQ ID NO: 183838 - RNA, 32 nt, Human
ggaaacuugguauagcagcuaaaagaguuuag

SEQ ID NO: 183839 - RNA, 21 nt, Human
ggaaacuuuuacucuucagga

SEQ ID NO: 183840 - RNA, 25 nt, Human
ggaaacuuuucugggcuccuggaga

SEQ ID NO: 183841 - RNA, 32 nt, Human
ggaaagaaaauuaguauuuaaggagaguauaa

SEQ ID NO: 183842 - RNA, 19 nt, Human
ggaaagaaaccuuagccag

SEQ ID NO: 183843 - RNA, 32 nt, Human
ggaaagaaaccuuucaaauguaaagaaugugg

SEQ ID NO: 183844 - RNA, 32 nt, Human
ggaaagaaagagaucgcagcaggggugaaggg

SEQ ID NO: 183845 - RNA, 32 nt, Human
ggaaagaaauaacaaaugacaugugggaauug

SEQ ID NO: 183846 - RNA, 32 nt, Human
ggaaagaaauacaaggaggaggaggguuagca

SEQ ID NO: 183847 - RNA, 23 nt, Human
ggaaagaacagaaggagaccaga

SEQ ID NO: 183848 - RNA, 32 nt, Human
ggaaagaagcugaaaauguaaaaccacaccag

SEQ ID NO: 183849 - RNA, 23 nt, Human
ggaaagaaggaacaauuauuagg

SEQ ID NO: 183850 - RNA, 32 nt, Human
ggaaagaaggaggcagaaguggaacugaacuu

SEQ ID NO: 183851 - RNA, 32 nt, Human
ggaaagaagucacuguugcaauaaaagcaccc

SEQ ID NO: 183852 - RNA, 32 nt, Human
ggaaagaauggacuggcagagugugggccuuc

SEQ ID NO: 183853 - RNA, 19 nt, Human
ggaaagaauggagaaucua

SEQ ID NO: 183854 - RNA, 32 nt, Human
ggaaagacagaggaaggaaggagggagaaggg

SEQ ID NO: 183855 - RNA, 32 nt, Human
ggaaagacagaggcgggaggauugagugaggc

SEQ ID NO: 183856 - RNA, 32 nt, Human
ggaaagacagcggcucagaugaggcuucaggc

SEQ ID NO: 183857 - RNA, 32 nt, Human
ggaaagacaggaguucgaaaccagccugggca

SEQ ID NO: 183858 - RNA, 32 nt, Human
ggaaagaccagccucacuccugggaacugucu

SEQ ID NO: 183859 - RNA, 32 nt, Human
ggaaagacccaggcugcgggacgcggugcagg

SEQ ID NO: 183860 - RNA, 32 nt, Human
ggaaagaccgcccaccaugcccacggagaccc

SEQ ID NO: 183861 - RNA, 32 nt, Human
ggaaagaccucaguugggcauucuuuaauagg

SEQ ID NO: 183862 - RNA, 24 nt, Human
ggaaagacgugucccuucugaacu

SEQ ID NO: 183863 - RNA, 32 nt, Human
ggaaagacucacuugagauacccucuccuugc

SEQ ID NO: 183864 - RNA, 32 nt, Human
ggaaagacucuucucauuuauuccucauugaa

SEQ ID NO: 183865 - RNA, 32 nt, Human
ggaaagacugaggcuucugccuacugagcaag

SEQ ID NO: 183866 - RNA, 32 nt, Human
ggaaagacuuuauaaucaggagcuugaccugu

SEQ ID NO: 183867 - RNA, 32 nt, Human
ggaaagacuuuucuuuuccuuccggaacaugu

SEQ ID NO: 183868 - RNA, 32 nt, Human
ggaaagagaaaaagaccacggagugcugagcu

SEQ ID NO: 183869 - RNA, 21 nt, Human
ggaaagagaacucucccaggg

SEQ ID NO: 183870 - RNA, 32 nt, Human
ggaaagagacaggcagagaaggagagaggcag

SEQ ID NO: 183871 - RNA, 32 nt, Human
ggaaagagacccggggaggccaggaguagcug

SEQ ID NO: 183872 - RNA, 32 nt, Human
ggaaagagaccuguaucuugguguuuuucugg

SEQ ID NO: 183873 - RNA, 31 nt, Human
ggaaagagacuucucccauagcaaagaggcu

SEQ ID NO: 183874 - RNA, 20 nt, Human
ggaaagagagauucccugga

SEQ ID NO: 183875 - RNA, 21 nt, Human
ggaaagagagguggggggaga

SEQ ID NO: 183876 - RNA, 32 nt, Human
ggaaagagagugagagccugugcaggcugcug

SEQ ID NO: 183877 - RNA, 32 nt, Human
ggaaagagaucuucuacucacaauguguucaa

SEQ ID NO: 183878 - RNA, 20 nt, Human
ggaaagagauuuacucucug

SEQ ID NO: 183879 - RNA, 32 nt, Human
ggaaagagcaggcuuccaggagagaggccccc

SEQ ID NO: 183880 - RNA, 32 nt, Human
ggaaagagccaaaaugucacaguuccuaucug

SEQ ID NO: 183881 - RNA, 32 nt, Human
ggaaagagccucugaccucccuuguuuaguuu

SEQ ID NO: 183882 - RNA, 32 nt, Human
ggaaagagccuggguguuugggucagauaaau

SEQ ID NO: 183883 - RNA, 32 nt, Human
ggaaagagcggagcagccauuguugagggaaa

SEQ ID NO: 183884 - RNA, 26 nt, Human
ggaaagagcugcgggaaaagccgggg

SEQ ID NO: 183885 - RNA, 18 nt, Human
ggaaagaggacugggaga

SEQ ID NO: 183886 - RNA, 32 nt, Human
ggaaagaggagaaggacaugaauugaaagagg

SEQ ID NO: 183887 - RNA, 32 nt, Human
ggaaagaggagaaggagagggaguacaaagac

SEQ ID NO: 183888 - RNA, 32 nt, Human
ggaaagaggcaggcagggggagaggggcagag

SEQ ID NO: 183889 - RNA, 21 nt, Human
ggaaagaggggagggacucua

SEQ ID NO: 183890 - RNA, 32 nt, Human
ggaaagaggggcuuggagagggagacagggcc

SEQ ID NO: 183891 - RNA, 20 nt, Human
ggaaagagggugcugggaga

SEQ ID NO: 183892 - RNA, 19 nt, Human
ggaaagagucuugcucugu

SEQ ID NO: 183893 - RNA, 32 nt, Human
ggaaagauacacagagugaauaucaaauuuua

SEQ ID NO: 183894 - RNA, 21 nt, Human
ggaaagauaggcaggaguccc

SEQ ID NO: 183895 - RNA, 32 nt, Human
ggaaagaucccuuaugccaggaggccugccau

SEQ ID NO: 183896 - RNA, 32 nt, Human
ggaaagauggagagaagacugcagugagcgga

SEQ ID NO: 183897 - RNA, 22 nt, Human
ggaaagauggagagaucaaacg

SEQ ID NO: 183898 - RNA, 19 nt, Human
ggaaagauggggagcucug

SEQ ID NO: 183899 - RNA, 32 nt, Human
ggaaagcaaaugguaucgaauaccuuucuugc

SEQ ID NO: 183900 - RNA, 32 nt, Human
ggaaagcaacacaggacagaauucagcuagug

SEQ ID NO: 183901 - RNA, 32 nt, Human
ggaaagcaaguuugaaccagcugcugguguaa

SEQ ID NO: 183902 - RNA, 20 nt, Human
ggaaagcacacagacuucua

SEQ ID NO: 183903 - RNA, 20 nt, Human
ggaaagcacgccgggagcuc

SEQ ID NO: 183904 - RNA, 32 nt, Human
ggaaagcacggggccuuucccacccacccuca

SEQ ID NO: 183905 - RNA, 18 nt, Human
ggaaagcacugugcucug

SEQ ID NO: 183906 - RNA, 32 nt, Human
ggaaagcagaaaugaaugaacugugaaagcuc

SEQ ID NO: 183907 - RNA, 22 nt, Human
ggaaagcagagguugcagugag

SEQ ID NO: 183908 - RNA, 32 nt, Human
ggaaagcagaugucaggcuuuggugugccugu

SEQ ID NO: 183909 - RNA, 32 nt, Human
ggaaagcagcaagaaaagguagagaggaacca

SEQ ID NO: 183910 - RNA, 32 nt, Human
ggaaagcagcccauuccugggcucagagacuc

SEQ ID NO: 183911 - RNA, 32 nt, Human
ggaaagcagccccuccucacacauacaugugc

SEQ ID NO: 183912 - RNA, 19 nt, Human
ggaaagcagccuccaggga

SEQ ID NO: 183913 - RNA, 32 nt, Human
ggaaagcagcuguggacucucaaggacaggca

SEQ ID NO: 183914 - RNA, 32 nt, Human
ggaaagcagcuuguugagccccugcagcugga

SEQ ID NO: 183915 - RNA, 32 nt, Human
ggaaagcaggagagagacugaguggcacaucc

SEQ ID NO: 183916 - RNA, 19 nt, Human
ggaaagcaggccucugagg

SEQ ID NO: 183917 - RNA, 21 nt, Human
ggaaagcaguuagaaugucug

SEQ ID NO: 183918 - RNA, 32 nt, Human
ggaaagcauauguauauaacaugugucauguc

SEQ ID NO: 183919 - RNA, 32 nt, Human
ggaaagcauccucaaaacugugggucagugag

SEQ ID NO: 183920 - RNA, 20 nt, Human
ggaaagcauucaucauucua

SEQ ID NO: 183921 - RNA, 21 nt, Human
ggaaagcauuugugaaacuuu

SEQ ID NO: 183922 - RNA, 32 nt, Human
ggaaagccaaaagaacacacagagccaaaaag

SEQ ID NO: 183923 - RNA, 32 nt, Human
ggaaagccaagggggaggguugcccacuagga

SEQ ID NO: 183924 - RNA, 32 nt, Human
ggaaagccaccugagaccacuucauagcaagg

SEQ ID NO: 183925 - RNA, 32 nt, Human
ggaaagccaccuugacagcccaggucccucca

SEQ ID NO: 183926 - RNA, 20 nt, Human
ggaaagccagaagacugcag

SEQ ID NO: 183927 - RNA, 32 nt, Human
ggaaagccagccugggagcaugugaaaggauc

SEQ ID NO: 183928 - RNA, 21 nt, Human
ggaaagccaggcccaccugcc

SEQ ID NO: 183929 - RNA, 21 nt, Human
ggaaagccaguugcccugaac

SEQ ID NO: 183930 - RNA, 32 nt, Human
ggaaagccauggagagcgcucuccccgccgcc

SEQ ID NO: 183931 - RNA, 32 nt, Human
ggaaagccauuaaguggggugcagccccuggc

SEQ ID NO: 183932 - RNA, 32 nt, Human
ggaaagcccaggagaugaugccagccuugagc

SEQ ID NO: 183933 - RNA, 23 nt, Human
ggaaagcccaucccauauucuga

SEQ ID NO: 183934 - RNA, 32 nt, Human
ggaaagccccugccccuccucucccucaucaa

SEQ ID NO: 183935 - RNA, 32 nt, Human
ggaaagcccgagggaggaagagagggagggag

SEQ ID NO: 183936 - RNA, 18 nt, Human
ggaaagccucucauggga

SEQ ID NO: 183937 - RNA, 32 nt, Human
ggaaagccuuuuccuguuugauccugagacac

SEQ ID NO: 183938 - RNA, 32 nt, Human
ggaaagcgcagugcaugcugggugcaugaagg

SEQ ID NO: 183939 - RNA, 25 nt, Human
ggaaagcgccacgaucccaccuacu

SEQ ID NO: 183940 - RNA, 32 nt, Human
ggaaagcggaggaggaaagcgagggggugggg

SEQ ID NO: 183941 - RNA, 22 nt, Human
ggaaagcgggcgacccaccucc

SEQ ID NO: 183942 - RNA, 32 nt, Human
ggaaagcgggugagcuguugugcugcugggcc

SEQ ID NO: 183943 - RNA, 32 nt, Human
ggaaagcggugaggacgcagagugcaggcugu

SEQ ID NO: 183944 - RNA, 32 nt, Human
ggaaagcuaagacaaacaaaacuacaauggaa

SEQ ID NO: 183945 - RNA, 32 nt, Human
ggaaagcuagaaggggacagaggugucccuga

SEQ ID NO: 183946 - RNA, 32 nt, Human
ggaaagcucucauuuguuccaguucacuuuaa

SEQ ID NO: 183947 - RNA, 32 nt, Human
ggaaagcugacuguaagucccaccucccacuc

SEQ ID NO: 183948 - RNA, 23 nt, Human
ggaaagcugaggcagguggauca

SEQ ID NO: 183949 - RNA, 32 nt, Human
ggaaagcugcagcuagaaaauggucuuaaugg

SEQ ID NO: 183950 - RNA, 20 nt, Human
ggaaagcuggaaggacucug

SEQ ID NO: 183951 - RNA, 32 nt, Human
ggaaagcuuacaauuaacuuaccagguuuuuc

SEQ ID NO: 183952 - RNA, 32 nt, Human
ggaaagcuucaaucaaagaacaacccuuauuc

SEQ ID NO: 183953 - RNA, 32 nt, Human
ggaaagcuuccagcccuccucccuucacccug

SEQ ID NO: 183954 - RNA, 16 nt, Human
ggaaagcuuccuggga

SEQ ID NO: 183955 - RNA, 17 nt, Human
ggaaagcuucucugggg

SEQ ID NO: 183956 - RNA, 21 nt, Human
ggaaagcuuuggcaguguuuu

SEQ ID NO: 183957 - RNA, 32 nt, Human
ggaaaggaaagagacggggcucugaggccgag

SEQ ID NO: 183958 - RNA, 32 nt, Human
ggaaaggaaagcagcugagauccagaggagug

SEQ ID NO: 183959 - RNA, 32 nt, Human
ggaaaggaagaaggaaaaccgaguaaaggagg

SEQ ID NO: 183960 - RNA, 32 nt, Human
ggaaaggaagauugagcaacauaggaaaaggg

SEQ ID NO: 183961 - RNA, 32 nt, Human
ggaaaggaaggaaggaaggaaaaggaggggag

SEQ ID NO: 183962 - RNA, 32 nt, Human
ggaaaggaaggagagaaagaaaagcuggaaac

SEQ ID NO: 183963 - RNA, 24 nt, Human
ggaaaggaagggcuuggcuugcca

SEQ ID NO: 183964 - RNA, 32 nt, Human
ggaaaggaaucuuuagaaaugcagcccgcuga

SEQ ID NO: 183965 - RNA, 32 nt, Human
ggaaaggaccacgccuggcagcaaagaucucu

SEQ ID NO: 183966 - RNA, 32 nt, Human
ggaaaggacucuguccccuuggggcucaucac

SEQ ID NO: 183967 - RNA, 31 nt, Human
ggaaaggagaaaagagaaaacaggcugggcc

SEQ ID NO: 183968 - RNA, 32 nt, Human
ggaaaggagaaaggagaaagaaggugaagucu

SEQ ID NO: 183969 - RNA, 32 nt, Human
ggaaaggagaggagggacacuggagagcaggg

SEQ ID NO: 183970 - RNA, 32 nt, Human
ggaaaggagagggcggaaaaggaccagcggga

SEQ ID NO: 183971 - RNA, 24 nt, Human
ggaaaggagagggcucacuuauca

SEQ ID NO: 183972 - RNA, 32 nt, Human
ggaaaggagcauucgaggucucaguccucgcu

SEQ ID NO: 183973 - RNA, 32 nt, Human
ggaaaggaggcugagguuguagcucacacaua

SEQ ID NO: 183974 - RNA, 32 nt, Human
ggaaaggaggugggggcggggaguauugaaug

SEQ ID NO: 183975 - RNA, 19 nt, Human
ggaaaggaugucucugggg

SEQ ID NO: 183976 - RNA, 32 nt, Human
ggaaaggcagaagcugggagccucccuucccu

SEQ ID NO: 183977 - RNA, 32 nt, Human
ggaaaggcagcccccucagucucccuccuccu

SEQ ID NO: 183978 - RNA, 32 nt, Human
ggaaaggcaucagcagggugcuuucaaccaca

SEQ ID NO: 183979 - RNA, 26 nt, Human
ggaaaggcauccgcagcccucaccaa

SEQ ID NO: 183980 - RNA, 32 nt, Human
ggaaaggccagcagccuuccaguggcuucucc

SEQ ID NO: 183981 - RNA, 32 nt, Human
ggaaaggccauaaacaaagacagacuuguagu

SEQ ID NO: 183982 - RNA, 32 nt, Human
ggaaaggcccucuccaaucauuuuggaagagc

SEQ ID NO: 183983 - RNA, 32 nt, Human
ggaaaggcucaagugauccuccuguaucaccc

SEQ ID NO: 183984 - RNA, 32 nt, Human
ggaaaggcugggcuggaccugcucugagaggc

SEQ ID NO: 183985 - RNA, 32 nt, Human
ggaaaggcugguuccuuagccuccugguuugu

SEQ ID NO: 183986 - RNA, 32 nt, Human
ggaaaggcuguaagccugagauuguggggaau

SEQ ID NO: 183987 - RNA, 32 nt, Human
ggaaaggcuuuuauucucccacgucauuucaa

SEQ ID NO: 183988 - RNA, 32 nt, Human
ggaaagggaaauugcugucucucugaacaaaa

SEQ ID NO: 183989 - RNA, 32 nt, Human
ggaaagggaagcaggguaggaguccuucugag

SEQ ID NO: 183990 - RNA, 32 nt, Human
ggaaagggaaggguugggggauggauuuaggc

SEQ ID NO: 183991 - RNA, 32 nt, Human
ggaaagggagaagggugguaaauauuuucaaa

SEQ ID NO: 183992 - RNA, 32 nt, Human
ggaaagggagacaaagacuggcuucuggacuu

SEQ ID NO: 183993 - RNA, 32 nt, Human
ggaaagggagagaagagaugucugaggaaggu

SEQ ID NO: 183994 - RNA, 32 nt, Human
ggaaagggaggcacugccauuuggagacauuc

SEQ ID NO: 183995 - RNA, 32 nt, Human
ggaaagggagugagaggaggcucaggccaggg

SEQ ID NO: 183996 - RNA, 32 nt, Human
ggaaagggaugggucauagccauggagacaug

SEQ ID NO: 183997 - RNA, 32 nt, Human
ggaaagggcagggcaugcaaauucgaaaugaa

SEQ ID NO: 183998 - RNA, 32 nt, Human
ggaaagggccaccacaccacacccaagcccau

SEQ ID NO: 183999 - RNA, 32 nt, Human
ggaaagggccuccagccucuacagcuucaagg

SEQ ID NO: 184000 - RNA, 32 nt, Human
ggaaagggcuacaccuccugcaggaaggggug

SEQ ID NO: 184001 - RNA, 32 nt, Human
ggaaaggggaaaucucacagggcagaagaaau

SEQ ID NO: 184002 - RNA, 32 nt, Human
ggaaaggggacaaggaaggaaaagaaagaaga

SEQ ID NO: 184003 - RNA, 32 nt, Human
ggaaaggggacugugcccuggaggcucacuuc

SEQ ID NO: 184004 - RNA, 32 nt, Human
ggaaaggggagagagaagcaguagauacacuc

SEQ ID NO: 184005 - RNA, 32 nt, Human
ggaaaggggaggaggaaggaaaugauauggua

SEQ ID NO: 184006 - RNA, 32 nt, Human
ggaaaggggauaccuucccacucagcacugcu

SEQ ID NO: 184007 - RNA, 32 nt, Human
ggaaaggggccugggcucuucauuuaaaggua

SEQ ID NO: 184008 - RNA, 32 nt, Human
ggaaaggggcugucccagcccaagaaggcagu

SEQ ID NO: 184009 - RNA, 32 nt, Human
ggaaagggggcgggcccuuuucacaacaggcu

SEQ ID NO: 184010 - RNA, 32 nt, Human
ggaaagggggugggacagggacucggggcugg

SEQ ID NO: 184011 - RNA, 32 nt, Human
ggaaaggguaaucuuuucaaugaaugaugugg

SEQ ID NO: 184012 - RNA, 32 nt, Human
ggaaaggguuauaaugucugugguguacaagu

SEQ ID NO: 184013 - RNA, 32 nt, Human
ggaaagguagcauaggauagaugaagaugaag

SEQ ID NO: 184014 - RNA, 32 nt, Human
ggaaagguauccaccuuucugaaucagacaca

SEQ ID NO: 184015 - RNA, 32 nt, Human
ggaaaggugcuccugcccacacccagcaugga

SEQ ID NO: 184016 - RNA, 32 nt, Human
ggaaagguugaaaugacuccguuuccuuauaa

SEQ ID NO: 184017 - RNA, 32 nt, Human
ggaaagguugaauuaauuccugggcauggacu

SEQ ID NO: 184018 - RNA, 32 nt, Human
ggaaagguugcauugguugaaaccacugagga

SEQ ID NO: 184019 - RNA, 32 nt, Human
ggaaaguaaggaguuaggcauuaccuucuggg

SEQ ID NO: 184020 - RNA, 22 nt, Human
ggaaaguaauuugagaacuuua

SEQ ID NO: 184021 - RNA, 32 nt, Human
ggaaaguaguuaagaaaucaagaaaagugucu

SEQ ID NO: 184022 - RNA, 32 nt, Human
ggaaaguaucagugagcuugaagacuggcuau

SEQ ID NO: 184023 - RNA, 32 nt, Human
ggaaaguauucucuuuucaagaaguucuuuga

SEQ ID NO: 184024 - RNA, 32 nt, Human
ggaaagucacccauaaggauggcaaugccagu

SEQ ID NO: 184025 - RNA, 32 nt, Human
ggaaagucagccacugugucuuaugaggaauu

SEQ ID NO: 184026 - RNA, 32 nt, Human
ggaaagucagcuuucagagccagugaaggagc

SEQ ID NO: 184027 - RNA, 32 nt, Human
ggaaagucauagugccuugggucagagaagcu

SEQ ID NO: 184028 - RNA, 32 nt, Human
ggaaagucaucuaugaauucaucaugaaagac

SEQ ID NO: 184029 - RNA, 32 nt, Human
ggaaaguccucagaaagggaaugguauaucaa

SEQ ID NO: 184030 - RNA, 32 nt, Human
ggaaaguccuccuccagcuccaccucccuccc

SEQ ID NO: 184031 - RNA, 32 nt, Human
ggaaaguccugaacuccuggcuuuccaggaga

SEQ ID NO: 184032 - RNA, 32 nt, Human
ggaaagucguacuguucacacacacaguuuga

SEQ ID NO: 184033 - RNA, 32 nt, Human
ggaaagucucucuccuuccucauaagacaugc

SEQ ID NO: 184034 - RNA, 32 nt, Human
ggaaagucuuagauuccaguagauggaauugc

SEQ ID NO: 184035 - RNA, 21 nt, Human
ggaaagugagaaaaaccucca

SEQ ID NO: 184036 - RNA, 32 nt, Human
ggaaagugagagcuggauggaggcagacaaga

SEQ ID NO: 184037 - RNA, 25 nt, Human
ggaaagugagaggcguccauuucca

SEQ ID NO: 184038 - RNA, 22 nt, Human
ggaaagugaggauucccugcca

SEQ ID NO: 184039 - RNA, 32 nt, Human
ggaaagugcaagacacuaagucaggacaucug

SEQ ID NO: 184040 - RNA, 32 nt, Human
ggaaaguggccugcucuggcaggugugugcag

SEQ ID NO: 184041 - RNA, 32 nt, Human
ggaaagugggccugggcugggcuggggcuagg

SEQ ID NO: 184042 - RNA, 32 nt, Human
ggaaaguguaugauauaaaggacuuccagaca

SEQ ID NO: 184043 - RNA, 32 nt, Human
ggaaagugucugcaguaggggacccagagucc

SEQ ID NO: 184044 - RNA, 32 nt, Human
ggaaaguuccaagugaggacauggaagaggcc

SEQ ID NO: 184045 - RNA, 32 nt, Human
ggaaaguuccagcaguuucaugagaugcagua

SEQ ID NO: 184046 - RNA, 32 nt, Human
ggaaaguucccaagcccuggcucaugaacuca

SEQ ID NO: 184047 - RNA, 32 nt, Human
ggaaaguucccugauggcugucaacaaagugc

SEQ ID NO: 184048 - RNA, 32 nt, Human
ggaaaguugauuuuuaugauaauauggaaaac

SEQ ID NO: 184049 - RNA, 32 nt, Human
ggaaaguugcccaaggaagggaaguugaguuc

SEQ ID NO: 184050 - RNA, 32 nt, Human
ggaaaguugcccacuuuucucuuucagguuaa

SEQ ID NO: 184051 - RNA, 32 nt, Human
ggaaaguuuuagaggaccuucugcaagguuaa

SEQ ID NO: 184052 - RNA, 32 nt, Human
ggaaauaaaacuuuuaagacacuacuauaagu

SEQ ID NO: 184053 - RNA, 32 nt, Human
ggaaauaaacaaggaaacuaagugcuuggacc

SEQ ID NO: 184054 - RNA, 32 nt, Human
ggaaauaaacacaggcaccaaaccacuauccu

SEQ ID NO: 184055 - RNA, 32 nt, Human
ggaaauaaagagaacugagauggaauucaaga

SEQ ID NO: 184056 - RNA, 32 nt, Human
ggaaauaaaggagaaccuggagaucugggaga

SEQ ID NO: 184057 - RNA, 32 nt, Human
ggaaauaaauccugacagaugugcacagcaua

SEQ ID NO: 184058 - RNA, 32 nt, Human
ggaaauaaauuguuauggaggggcuguuuuug

SEQ ID NO: 184059 - RNA, 32 nt, Human
ggaaauaacagacaacaugagcaauggaggac

SEQ ID NO: 184060 - RNA, 32 nt, Human
ggaaauaagcagcuggucuggaagaaaaggac

SEQ ID NO: 184061 - RNA, 32 nt, Human
ggaaauaaguccuuauugauuggaccgagcca

SEQ ID NO: 184062 - RNA, 32 nt, Human
ggaaauacaagugcucuguaaucacaggcagu

SEQ ID NO: 184063 - RNA, 32 nt, Human
ggaaauagaacagcugggcaaaccccaaacgc

SEQ ID NO: 184064 - RNA, 32 nt, Human
ggaaauagaagagcagaagcaaaagcaauugg

SEQ ID NO: 184065 - RNA, 32 nt, Human
ggaaauagcgcaggacaucacaaggaccaaaa

SEQ ID NO: 184066 - RNA, 32 nt, Human
ggaaauaggaagaggauugccauggccuggcc

SEQ ID NO: 184067 - RNA, 32 nt, Human
ggaaauagggcaccaugguccggugguuugua

SEQ ID NO: 184068 - RNA, 32 nt, Human
ggaaauagugauuuccacagugacuccacucu

SEQ ID NO: 184069 - RNA, 32 nt, Human
ggaaauauagaugucaccuaagugauaguuaa

SEQ ID NO: 184070 - RNA, 32 nt, Human
ggaaauauagccacugccuauaggcucuucag

SEQ ID NO: 184071 - RNA, 32 nt, Human
ggaaauaucugugggcuugugcacggacucaa

SEQ ID NO: 184072 - RNA, 32 nt, Human
ggaaaucaagccugucuuccaguggggcacgg

SEQ ID NO: 184073 - RNA, 32 nt, Human
ggaaaucaaucagcacugggacuggcuggaac

SEQ ID NO: 184074 - RNA, 20 nt, Human
ggaaaucacuggggacagga

SEQ ID NO: 184075 - RNA, 23 nt, Human
ggaaaucagcacuuacauuaaga

SEQ ID NO: 184076 - RNA, 32 nt, Human
ggaaaucaguagaaagcuaaagugauccuaaa

SEQ ID NO: 184077 - RNA, 24 nt, Human
ggaaauccaaacucaccaccauga

SEQ ID NO: 184078 - RNA, 32 nt, Human
ggaaauccagcagggggugggaugugugauuu

SEQ ID NO: 184079 - RNA, 32 nt, Human
ggaaauccgagagugagagagacauccaggcu

SEQ ID NO: 184080 - RNA, 32 nt, Human
ggaaauccuccaccaagcuuccagaacuacag

SEQ ID NO: 184081 - RNA, 32 nt, Human
ggaaauccugggguccuugagacagaggcagg

SEQ ID NO: 184082 - RNA, 32 nt, Human
ggaaauccuggugugcugcagggaucaggcug

SEQ ID NO: 184083 - RNA, 32 nt, Human
ggaaaucuaggacuuccagcuucccucauguc

SEQ ID NO: 184084 - RNA, 32 nt, Human
ggaaaucucaccucugccacccaucuacuugc

SEQ ID NO: 184085 - RNA, 32 nt, Human
ggaaaucucauuuuggaugccugccuuaugaa

SEQ ID NO: 184086 - RNA, 32 nt, Human
ggaaaucuccuugggccuugugcagcauuugg

SEQ ID NO: 184087 - RNA, 32 nt, Human
ggaaaucucucaucuuguuuuuguuucaugua

SEQ ID NO: 184088 - RNA, 32 nt, Human
ggaaaucucuguuauuaagucauuucaagaug

SEQ ID NO: 184089 - RNA, 32 nt, Human
ggaaaucucuuaccuuucauuaggguuucuuu

SEQ ID NO: 184090 - RNA, 32 nt, Human
ggaaaucugagagcaagaugccagcagauuca

SEQ ID NO: 184091 - RNA, 23 nt, Human
ggaaaucugggggcucccaggaa

SEQ ID NO: 184092 - RNA, 32 nt, Human
ggaaaucuguaacgcagcuucuguaagcaugu

SEQ ID NO: 184093 - RNA, 32 nt, Human
ggaaaugaaacagagacagagggaagccugag

SEQ ID NO: 184094 - RNA, 32 nt, Human
ggaaaugaaaggaagccugaagacugacuacc

SEQ ID NO: 184095 - RNA, 32 nt, Human
ggaaaugaaagugccaagaaagguguuccauu

SEQ ID NO: 184096 - RNA, 32 nt, Human
ggaaaugaagacagaaggacuugagaaagcau

SEQ ID NO: 184097 - RNA, 21 nt, Human
ggaaaugaagcuccagccaga

SEQ ID NO: 184098 - RNA, 32 nt, Human
ggaaaugaauauaaaaugcaucuaaacaugac

SEQ ID NO: 184099 - RNA, 32 nt, Human
ggaaaugacauggcuugauuguucuguuuaaa

SEQ ID NO: 184100 - RNA, 32 nt, Human
ggaaaugagaaggccagcagaaguagauuaaa

SEQ ID NO: 184101 - RNA, 32 nt, Human
ggaaaugagaugguuuggccaugcaccaccuc

SEQ ID NO: 184102 - RNA, 20 nt, Human
ggaaaugaggcuccugagga

SEQ ID NO: 184103 - RNA, 20 nt, Human
ggaaaugaguccccugggaa

SEQ ID NO: 184104 - RNA, 32 nt, Human
ggaaaugaucacuaggcaauuucagccuugca

SEQ ID NO: 184105 - RNA, 26 nt, Human
ggaaaugauguucuggacagaguuuu

SEQ ID NO: 184106 - RNA, 32 nt, Human
ggaaaugcacaagccucuugaugcauaaaaac

SEQ ID NO: 184107 - RNA, 32 nt, Human
ggaaaugcagacgcuuuccuccuucacaauuu

SEQ ID NO: 184108 - RNA, 32 nt, Human
ggaaaugcagagcucagagagacagcaaguca

SEQ ID NO: 184109 - RNA, 32 nt, Human
ggaaaugccugccucuggccuuggcuguaggc

SEQ ID NO: 184110 - RNA, 32 nt, Human
ggaaaugccugcugcccccagugacucuuggu

SEQ ID NO: 184111 - RNA, 32 nt, Human
ggaaaugcgauuuguuuugugccugaacgguc

SEQ ID NO: 184112 - RNA, 32 nt, Human
ggaaaugcgucuauaauacuccugccugagaa

SEQ ID NO: 184113 - RNA, 32 nt, Human
ggaaaugcuaucuuugcucuucuccuacucug

SEQ ID NO: 184114 - RNA, 19 nt, Human
ggaaaugcucuugagcuca

SEQ ID NO: 184115 - RNA, 32 nt, Human
ggaaaugcucuuuaugaaaaugcagcauuucu

SEQ ID NO: 184116 - RNA, 32 nt, Human
ggaaaugcugaccuuuuacauaaaaucaagga

SEQ ID NO: 184117 - RNA, 32 nt, Human
ggaaaugcuggggaggugggggcagaucacau

SEQ ID NO: 184118 - RNA, 27 nt, Human
ggaaauggaacccgcaaagccugcagg

SEQ ID NO: 184119 - RNA, 32 nt, Human
ggaaauggaauagaauugguauaaauucauaa

SEQ ID NO: 184120 - RNA, 32 nt, Human
ggaaauggacugccucucuugagcacuucccu

SEQ ID NO: 184121 - RNA, 32 nt, Human
ggaaauggagggggaagagaggaggggagagg

SEQ ID NO: 184122 - RNA, 32 nt, Human
ggaaauggccaccacagcguccuccuccuccc

SEQ ID NO: 184123 - RNA, 22 nt, Human
ggaaauggcucuggacaugcuc

SEQ ID NO: 184124 - RNA, 32 nt, Human
ggaaauggcugaaguggagagaucgccugagc

SEQ ID NO: 184125 - RNA, 29 nt, Human
ggaaauggcugcuucaucaucauccuccu

SEQ ID NO: 184126 - RNA, 21 nt, Human
ggaaauggcuggacucagaga

SEQ ID NO: 184127 - RNA, 32 nt, Human
ggaaaugggagcauaugcugggaaaugggagc

SEQ ID NO: 184128 - RNA, 32 nt, Human
ggaaaugggagguggaggguuguacugugacc

SEQ ID NO: 184129 - RNA, 24 nt, Human
ggaaauggggaagggggccuggag

SEQ ID NO: 184130 - RNA, 32 nt, Human
ggaaauggggaagggggccuggagaggggagg

SEQ ID NO: 184131 - RNA, 29 nt, Human
ggaaaugguaaagagaaagaggaccggag

SEQ ID NO: 184132 - RNA, 32 nt, Human
ggaaaugguacucauucaucugcacagaauga

SEQ ID NO: 184133 - RNA, 24 nt, Human
ggaaaugguggagaugggccugca

SEQ ID NO: 184134 - RNA, 32 nt, Human
ggaaauguccccgcaguggaugcagcucacau

SEQ ID NO: 184135 - RNA, 32 nt, Human
ggaaaugucugcuuuaugaaacuaugcacaua

SEQ ID NO: 184136 - RNA, 32 nt, Human
ggaaaugugagccccaggcugcagaaggaaga

SEQ ID NO: 184137 - RNA, 32 nt, Human
ggaaauguggcugccccucuccucacuacuuc

SEQ ID NO: 184138 - RNA, 32 nt, Human
ggaaaugugggguagauuugguggugguuaga

SEQ ID NO: 184139 - RNA, 32 nt, Human
ggaaaugugugugggggugugucuguggccag

SEQ ID NO: 184140 - RNA, 32 nt, Human
ggaaauguguuucggcuuggucagggguccac

SEQ ID NO: 184141 - RNA, 32 nt, Human
ggaaauguucucaaggucucaggcuauuuggg

SEQ ID NO: 184142 - RNA, 32 nt, Human
ggaaauguucuuuagaugguggcacauuccuu

SEQ ID NO: 184143 - RNA, 29 nt, Human
ggaaauguugcaggaggagucggaccucu

SEQ ID NO: 184144 - RNA, 32 nt, Human
ggaaauguugcuuucuguacucccucuucccu

SEQ ID NO: 184145 - RNA, 32 nt, Human
ggaaauguuugauaucucagcaauuuugcauu

SEQ ID NO: 184146 - RNA, 21 nt, Human
ggaaauuaaguuucuugcgga

SEQ ID NO: 184147 - RNA, 32 nt, Human
ggaaauuagaauaugaagaacuccuucaaguc

SEQ ID NO: 184148 - RNA, 32 nt, Human
ggaaauuagcuuucaauuuaguauacggaaag

SEQ ID NO: 184149 - RNA, 32 nt, Human
ggaaauucagugugugagucucagcaggaguu

SEQ ID NO: 184150 - RNA, 32 nt, Human
ggaaauuccaccaacauccagaccaaaaagaa

SEQ ID NO: 184151 - RNA, 32 nt, Human
ggaaauuccucuuuuagccucuccuuagaggu

SEQ ID NO: 184152 - RNA, 32 nt, Human
ggaaauuccuucaggugcucucaagcccugcu

SEQ ID NO: 184153 - RNA, 32 nt, Human
ggaaauucuauuuggccacccuuccgcacugg

SEQ ID NO: 184154 - RNA, 32 nt, Human
ggaaauucucuugcccaggcuuuuugcuccuu

SEQ ID NO: 184155 - RNA, 32 nt, Human
ggaaauucugacuggucucagagucuacuuga

SEQ ID NO: 184156 - RNA, 32 nt, Human
ggaaauucuggacuaagacuuaagucucguua

SEQ ID NO: 184157 - RNA, 32 nt, Human
ggaaauucuuccuaguaucuaaccuuggccug

SEQ ID NO: 184158 - RNA, 32 nt, Human
ggaaauugaaaaggaagaaacugauuuagaaa

SEQ ID NO: 184159 - RNA, 21 nt, Human
ggaaauugccuggacaagaga

SEQ ID NO: 184160 - RNA, 32 nt, Human
ggaaauugggcuaugucauugagccacuggag

SEQ ID NO: 184161 - RNA, 23 nt, Human
ggaaauuguagggaagaucgaug

SEQ ID NO: 184162 - RNA, 32 nt, Human
ggaaauuguccaccacuucccaaugauaaugc

SEQ ID NO: 184163 - RNA, 32 nt, Human
ggaaauugucuucuccucagcccguucgcugg

SEQ ID NO: 184164 - RNA, 32 nt, Human
ggaaauugugcuuccgaugggguggggacuga

SEQ ID NO: 184165 - RNA, 32 nt, Human
ggaaauuguggucuccggccugggugagacaa

SEQ ID NO: 184166 - RNA, 32 nt, Human
ggaaauuguguuuuccccauuuauggugcucu

SEQ ID NO: 184167 - RNA, 32 nt, Human
ggaaauuguuugacauaacacaggguucaggg

SEQ ID NO: 184168 - RNA, 32 nt, Human
ggaaauuuauagcaccgaguacccacaucaaa

SEQ ID NO: 184169 - RNA, 32 nt, Human
ggaaauuucaugggauaauuagcaggcugguc

SEQ ID NO: 184170 - RNA, 32 nt, Human
ggaaauuuccucaucauuuucaccauaaaguc

SEQ ID NO: 184171 - RNA, 32 nt, Human
ggaaauuugcagaggggcaggugugugguaaa

SEQ ID NO: 184172 - RNA, 32 nt, Human
ggaaauuugcugagcccccaccagggaaccgg

SEQ ID NO: 184173 - RNA, 32 nt, Human
ggaaauuuggaaacgggacauacacaaaaguu

SEQ ID NO: 184174 - RNA, 23 nt, Human
ggaacaaaaaccaacacauaguu

SEQ ID NO: 184175 - RNA, 32 nt, Human
ggaacaaaaccagcuggauccauccaucaccg

SEQ ID NO: 184176 - RNA, 32 nt, Human
ggaacaaagggagggggaaggggcggcgcggg

SEQ ID NO: 184177 - RNA, 32 nt, Human
ggaacaaccagaggaggaggaggacagaggga

SEQ ID NO: 184178 - RNA, 32 nt, Human
ggaacaacccuugagccucugcagucggaaga

SEQ ID NO: 184179 - RNA, 32 nt, Human
ggaacaacugccuguuuccuccaccuccaccc

SEQ ID NO: 184180 - RNA, 32 nt, Human
ggaacaagaacauaaugggaugguggugcaga

SEQ ID NO: 184181 - RNA, 32 nt, Human
ggaacaagaacccaggcugaucccagacaugc

SEQ ID NO: 184182 - RNA, 32 nt, Human
ggaacaagcaacaaaacuaauccuuagcuauc

SEQ ID NO: 184183 - RNA, 32 nt, Human
ggaacaagcaagaaaaugagccuaaugguggc

SEQ ID NO: 184184 - RNA, 32 nt, Human
ggaacaagcauuggaagagaugaagaccaaac

SEQ ID NO: 184185 - RNA, 32 nt, Human
ggaacaaggaggugggggcaguguggccccuu

SEQ ID NO: 184186 - RNA, 23 nt, Human
ggaacaaggcagaauauaaaaua

SEQ ID NO: 184187 - RNA, 32 nt, Human
ggaacaaggcaggccgccuguggaggaccuca

SEQ ID NO: 184188 - RNA, 32 nt, Human
ggaacaagggagugagccuuauaagaggacgu

SEQ ID NO: 184189 - RNA, 19 nt, Human
ggaacaagggucucagaga

SEQ ID NO: 184190 - RNA, 32 nt, Human
ggaacaaggugaggaaaaagagacugacccca

SEQ ID NO: 184191 - RNA, 32 nt, Human
ggaacaaguggggcugggaagcugacuucgug

SEQ ID NO: 184192 - RNA, 32 nt, Human
ggaacaaugauagucacauuagagaacaagaa

SEQ ID NO: 184193 - RNA, 32 nt, Human
ggaacacaaagaagcuuagaagaggguccaga

SEQ ID NO: 184194 - RNA, 31 nt, Human
ggaacacaagugucuucucauaagauuuaua

SEQ ID NO: 184195 - RNA, 32 nt, Human
ggaacacacagaaccaaaccagguguguucua

SEQ ID NO: 184196 - RNA, 32 nt, Human
ggaacacagaagcuuuauuuuauaguggaguc

SEQ ID NO: 184197 - RNA, 23 nt, Human
ggaacacagaugaagcagucuua

SEQ ID NO: 184198 - RNA, 32 nt, Human
ggaacacagauggagggcaagagggacagaug

SEQ ID NO: 184199 - RNA, 32 nt, Human
ggaacacagcagaagaggaggugguggaggag

SEQ ID NO: 184200 - RNA, 32 nt, Human
ggaacacagucugggagcccagagcucuggga

SEQ ID NO: 184201 - RNA, 32 nt, Human
ggaacaccaccuggucccuggcuugucccuca

SEQ ID NO: 184202 - RNA, 32 nt, Human
ggaacaccacugcuuuucagcauuguacugga

SEQ ID NO: 184203 - RNA, 32 nt, Human
ggaacaccagugcuaagguagagcuccccagc

SEQ ID NO: 184204 - RNA, 32 nt, Human
ggaacacccuggaagccgagaaauggacccag

SEQ ID NO: 184205 - RNA, 32 nt, Human
ggaacacuagaauccccaccucagcgugagga

SEQ ID NO: 184206 - RNA, 32 nt, Human
ggaacacucagagaaaggggagaucugggccu

SEQ ID NO: 184207 - RNA, 32 nt, Human
ggaacacugagaaagaggcagggaccuaaagg

SEQ ID NO: 184208 - RNA, 19 nt, Human
ggaacacuggaacauucca

SEQ ID NO: 184209 - RNA, 32 nt, Human
ggaacacuggcugccauuucaucacagucaac

SEQ ID NO: 184210 - RNA, 32 nt, Human
ggaacacugggcugagcacaugacagggagcc

SEQ ID NO: 184211 - RNA, 32 nt, Human
ggaacacugucaauggacugcaccuugugaag

SEQ ID NO: 184212 - RNA, 32 nt, Human
ggaacacuuagugacuaucacagccgaggccg

SEQ ID NO: 184213 - RNA, 32 nt, Human
ggaacacuucugaaccugcauuuuuaucugga

SEQ ID NO: 184214 - RNA, 32 nt, Human
ggaacacuugugagcacacagagcagcaucug

SEQ ID NO: 184215 - RNA, 32 nt, Human
ggaacagaacagaucugcagggccagugagug

SEQ ID NO: 184216 - RNA, 32 nt, Human
ggaacagaacagcuccaggguauaaggagggu

SEQ ID NO: 184217 - RNA, 32 nt, Human
ggaacagaacauggguuugaggucagguggcu

SEQ ID NO: 184218 - RNA, 26 nt, Human
ggaacagaagaaggccauggagcagg

SEQ ID NO: 184219 - RNA, 32 nt, Human
ggaacagaagugaggaugagacccagccccuu

SEQ ID NO: 184220 - RNA, 32 nt, Human
ggaacagacccaaaucugaaccucuuuugagu

SEQ ID NO: 184221 - RNA, 20 nt, Human
ggaacagagaagagagcaga

SEQ ID NO: 184222 - RNA, 18 nt, Human
ggaacagagaagccuggg

SEQ ID NO: 184223 - RNA, 32 nt, Human
ggaacagagaaguguggggaagagauaggaac

SEQ ID NO: 184224 - RNA, 32 nt, Human
ggaacagagaugccaguugaggggagggcauu

SEQ ID NO: 184225 - RNA, 19 nt, Human
ggaacagaggagcuugggg

SEQ ID NO: 184226 - RNA, 32 nt, Human
ggaacagauccaggugugagagcucuugaguc

SEQ ID NO: 184227 - RNA, 32 nt, Human
ggaacagcaacgcgggcuccagccaggcucuc

SEQ ID NO: 184228 - RNA, 32 nt, Human
ggaacagcacagcaugcugggcucuggauuua

SEQ ID NO: 184229 - RNA, 32 nt, Human
ggaacagcagagacacagagggcagucaugag

SEQ ID NO: 184230 - RNA, 32 nt, Human
ggaacagcagaggcggcggcacuggcuggacc

SEQ ID NO: 184231 - RNA, 32 nt, Human
ggaacagcagagguggaggcaagcagugacuc

SEQ ID NO: 184232 - RNA, 18 nt, Human
ggaacagcagcucuggga

SEQ ID NO: 184233 - RNA, 32 nt, Human
ggaacagcaggccgugcuuaacaggaaaggac

SEQ ID NO: 184234 - RNA, 32 nt, Human
ggaacagcaggugggaggggugggacagaggu

SEQ ID NO: 184235 - RNA, 32 nt, Human
ggaacagcauugugaucaaagacucaacuuua

SEQ ID NO: 184236 - RNA, 32 nt, Human
ggaacagccaauuuggaaaauccuucuaaggc

SEQ ID NO: 184237 - RNA, 32 nt, Human
ggaacagccacuccccuccacucucuaccaga

SEQ ID NO: 184238 - RNA, 32 nt, Human
ggaacagcucacuaagucaguccuuccuuagc

SEQ ID NO: 184239 - RNA, 32 nt, Human
ggaacagcucuccagccccaggacuucugcug

SEQ ID NO: 184240 - RNA, 32 nt, Human
ggaacaggaacagcuggaguggaguugaggac

SEQ ID NO: 184241 - RNA, 32 nt, Human
ggaacaggagaaaggagaagggagugauagua

SEQ ID NO: 184242 - RNA, 32 nt, Human
ggaacaggaucaucugucucagcggugggcag

SEQ ID NO: 184243 - RNA, 32 nt, Human
ggaacaggauucauccuguguaggggaucagg

SEQ ID NO: 184244 - RNA, 32 nt, Human
ggaacaggauuccaggaccccuuucuuguugu

SEQ ID NO: 184245 - RNA, 32 nt, Human
ggaacaggcccaugggaagaaggggguuuuaa

SEQ ID NO: 184246 - RNA, 17 nt, Human
ggaacaggcguuucuga

SEQ ID NO: 184247 - RNA, 32 nt, Human
ggaacaggcuccagggcaggaaccugggccca

SEQ ID NO: 184248 - RNA, 32 nt, Human
ggaacagggagcggccaggaugcugaaucugc

SEQ ID NO: 184249 - RNA, 32 nt, Human
ggaacagggcauggcacaggcacacaggaccc

SEQ ID NO: 184250 - RNA, 17 nt, Human
ggaacagggcucagagg

SEQ ID NO: 184251 - RNA, 32 nt, Human
ggaacaggggaggaagagggauggggcugcaa

SEQ ID NO: 184252 - RNA, 32 nt, Human
ggaacagguaguaucuauuuuucuccauuauu

SEQ ID NO: 184253 - RNA, 32 nt, Human
ggaacagguguggcagcaccugcccuucaccu

SEQ ID NO: 184254 - RNA, 32 nt, Human
ggaacaguagagaccuagucugccuucuuuca

SEQ ID NO: 184255 - RNA, 31 nt, Human
ggaacaguagagagagacaggccugaugcca

SEQ ID NO: 184256 - RNA, 32 nt, Human
ggaacaguaggagcuggagugggaucuccaag

SEQ ID NO: 184257 - RNA, 32 nt, Human
ggaacaguggauagcucauacuuuaugguggu

SEQ ID NO: 184258 - RNA, 22 nt, Human
ggaacaguggauguccacccca

SEQ ID NO: 184259 - RNA, 32 nt, Human
ggaacaguggcugugcuggaccccagaggcag

SEQ ID NO: 184260 - RNA, 31 nt, Human
ggaacaguggggaacugucagaugcucgaac

SEQ ID NO: 184261 - RNA, 32 nt, Human
ggaacaguggggacaggaggaggcaggucuca

SEQ ID NO: 184262 - RNA, 32 nt, Human
ggaacagugguggccagcuuggaggauggaca

SEQ ID NO: 184263 - RNA, 32 nt, Human
ggaacagugugguuugggaaagauggauaaac

SEQ ID NO: 184264 - RNA, 32 nt, Human
ggaacaguguguccucugcccccugggccagg

SEQ ID NO: 184265 - RNA, 32 nt, Human
ggaacaguuauugucugugccaugaccuucau

SEQ ID NO: 184266 - RNA, 32 nt, Human
ggaacaguucaccuaaaugacacugaguuggg

SEQ ID NO: 184267 - RNA, 18 nt, Human
ggaacauaaaggguuuca

SEQ ID NO: 184268 - RNA, 32 nt, Human
ggaacauaccacugccucuagacuaaggccag

SEQ ID NO: 184269 - RNA, 32 nt, Human
ggaacauagaaaacacaaaaacucaccuuaaa

SEQ ID NO: 184270 - RNA, 32 nt, Human
ggaacaucacacuccggggacuguuguggggu

SEQ ID NO: 184271 - RNA, 32 nt, Human
ggaacaucacacucuggggacuguuguggggg

SEQ ID NO: 184272 - RNA, 32 nt, Human
ggaacaucacacucuggggacuguuguggggu

SEQ ID NO: 184273 - RNA, 32 nt, Human
ggaacaucacacucuggggccuguuguggggu

SEQ ID NO: 184274 - RNA, 32 nt, Human
ggaacaucagagccacagggccuggacgcugc

SEQ ID NO: 184275 - RNA, 32 nt, Human
ggaacaucccagagagagcugggcccauccuc

SEQ ID NO: 184276 - RNA, 32 nt, Human
ggaacaucccgagggucacagggacagugcag

SEQ ID NO: 184277 - RNA, 32 nt, Human
ggaacaucggccgccuccagcucccggcgcgg

SEQ ID NO: 184278 - RNA, 32 nt, Human
ggaacaucugcaggaggcccaacuagugaaag

SEQ ID NO: 184279 - RNA, 32 nt, Human
ggaacaugagccuggagacccauggcagucca

SEQ ID NO: 184280 - RNA, 32 nt, Human
ggaacaugcccugucugugcugucccuccugu

SEQ ID NO: 184281 - RNA, 30 nt, Human
ggaacaugccgcgcuccuuccuggugaaaa

SEQ ID NO: 184282 - RNA, 32 nt, Human
ggaacaugccuguggucccagcuucuugggag

SEQ ID NO: 184283 - RNA, 32 nt, Human
ggaacauggaugcucccugcucugaacaucca

SEQ ID NO: 184284 - RNA, 32 nt, Human
ggaacauggugacgaguacaagagaccaaagc

SEQ ID NO: 184285 - RNA, 32 nt, Human
ggaacaugucaggugcuuacugggugagaccc

SEQ ID NO: 184286 - RNA, 32 nt, Human
ggaacauguggcugagcagacuuuuguauaau

SEQ ID NO: 184287 - RNA, 32 nt, Human
ggaacauguucuucaccaccuuuuggagauuu

SEQ ID NO: 184288 - RNA, 32 nt, Human
ggaacauuccuuggaccagguguuguauugca

SEQ ID NO: 184289 - RNA, 32 nt, Human
ggaacauuucaggccuggcacgaaaugcaguu

SEQ ID NO: 184290 - RNA, 32 nt, Human
ggaacauuugacuuccuugggacucuuaagug

SEQ ID NO: 184291 - RNA, 32 nt, Human
ggaacauuuguuuucuccaauuuccuuucaga

SEQ ID NO: 184292 - RNA, 32 nt, Human
ggaaccaaagagaacugucucaagagaagauu

SEQ ID NO: 184293 - RNA, 32 nt, Human
ggaaccaaagucacaaaagcccuucagaaaaa

SEQ ID NO: 184294 - RNA, 32 nt, Human
ggaaccaacccugaucuaaccagcacacuaaa

SEQ ID NO: 184295 - RNA, 32 nt, Human
ggaaccaagcuauuccuuucccuuccucuucg

SEQ ID NO: 184296 - RNA, 22 nt, Human
ggaaccaauauuucagcauucu

SEQ ID NO: 184297 - RNA, 32 nt, Human
ggaaccaaugugcccugguccacugggccgug

SEQ ID NO: 184298 - RNA, 32 nt, Human
ggaaccacacacugcuaugacauauccacccc

SEQ ID NO: 184299 - RNA, 32 nt, Human
ggaaccacagaacaucagcacuggaauggcca

SEQ ID NO: 184300 - RNA, 32 nt, Human
ggaaccacagcccagaugugcaggaggacggu

SEQ ID NO: 184301 - RNA, 18 nt, Human
ggaaccacagcucuggga

SEQ ID NO: 184302 - RNA, 32 nt, Human
ggaaccacaggcuggggcacuccggagucagg

SEQ ID NO: 184303 - RNA, 32 nt, Human
ggaaccacaggugcuucccguccuggucacaa

SEQ ID NO: 184304 - RNA, 23 nt, Human
ggaaccacaugaaucccuuggca

SEQ ID NO: 184305 - RNA, 32 nt, Human
ggaaccacauuuucaauccuccuucacugucu

SEQ ID NO: 184306 - RNA, 32 nt, Human
ggaaccaccuucucuacucucacugacacccc

SEQ ID NO: 184307 - RNA, 32 nt, Human
ggaaccacuccugguucagagaggcagcuccc

SEQ ID NO: 184308 - RNA, 32 nt, Human
ggaaccagacacagccugccucucaauccuca

SEQ ID NO: 184309 - RNA, 32 nt, Human
ggaaccagaccaggcagaucgggagcggugcc

SEQ ID NO: 184310 - RNA, 32 nt, Human
ggaaccagaccgcaggcugugccaccauuaaa

SEQ ID NO: 184311 - RNA, 32 nt, Human
ggaaccagaccucaucagcccaacaucaaaga

SEQ ID NO: 184312 - RNA, 32 nt, Human
ggaaccagagggcagaaggcgggaccuaagga

SEQ ID NO: 184313 - RNA, 32 nt, Human
ggaaccagaggguggagguugguguggaagag

SEQ ID NO: 184314 - RNA, 32 nt, Human
ggaaccagcccagcuuaauuuguacuccucca

SEQ ID NO: 184315 - RNA, 32 nt, Human
ggaaccagccgaguggcugagagcagauaaau

SEQ ID NO: 184316 - RNA, 32 nt, Human
ggaaccagccugcacgcgcuggcuccggguga

SEQ ID NO: 184317 - RNA, 32 nt, Human
ggaaccaggagaaaggggugaggccucccgcu

SEQ ID NO: 184318 - RNA, 23 nt, Human
ggaaccaggaggaaguugccgcc

SEQ ID NO: 184319 - RNA, 32 nt, Human
ggaaccaggaggcuugggaacagggaaagagg

SEQ ID NO: 184320 - RNA, 32 nt, Human
ggaaccaggaguugaagaccugggucugaggc

SEQ ID NO: 184321 - RNA, 32 nt, Human
ggaaccaggcuacagagcaggaguugccaaaa

SEQ ID NO: 184322 - RNA, 31 nt, Human
ggaaccagggagagagaggaagaagggacuc

SEQ ID NO: 184323 - RNA, 32 nt, Human
ggaaccagggagguagagguugcagugagcug

SEQ ID NO: 184324 - RNA, 32 nt, Human
ggaaccagugcuuugcuggaucacagcagaau

SEQ ID NO: 184325 - RNA, 32 nt, Human
ggaaccagugggagacuuaagagcaaggaaca

SEQ ID NO: 184326 - RNA, 32 nt, Human
ggaaccauaccccagcccauggucccaugacu

SEQ ID NO: 184327 - RNA, 32 nt, Human
ggaaccauaucuuuacaauagacucuccaccc

SEQ ID NO: 184328 - RNA, 32 nt, Human
ggaaccaucaaauuguucacuuacaaugggua

SEQ ID NO: 184329 - RNA, 32 nt, Human
ggaaccaucuggugguauuccagcacauuguu

SEQ ID NO: 184330 - RNA, 21 nt, Human
ggaaccauggaaucaaacaca

SEQ ID NO: 184331 - RNA, 31 nt, Human
ggaaccauggugcaaaagaagaaguucuguc

SEQ ID NO: 184332 - RNA, 19 nt, Human
ggaaccauuccccuucuua

SEQ ID NO: 184333 - RNA, 32 nt, Human
ggaacccaaguuugaacccaacuugugaugga

SEQ ID NO: 184334 - RNA, 19 nt, Human
ggaacccacagcgcaaucc

SEQ ID NO: 184335 - RNA, 32 nt, Human
ggaacccaccaggacagcagucucagugcugu

SEQ ID NO: 184336 - RNA, 32 nt, Human
ggaacccagaagguggagguugcagugagccg

SEQ ID NO: 184337 - RNA, 32 nt, Human
ggaacccagccuugccaacggagcuggcggag

SEQ ID NO: 184338 - RNA, 32 nt, Human
ggaacccagcucccaucugcugcccauggaug

SEQ ID NO: 184339 - RNA, 32 nt, Human
ggaacccaggagacugcugugugaccucagac

SEQ ID NO: 184340 - RNA, 32 nt, Human
ggaacccaggaggcaaagguugcagugagcca

SEQ ID NO: 184341 - RNA, 32 nt, Human
ggaacccaggaggcagaggucgcagugagucg

SEQ ID NO: 184342 - RNA, 32 nt, Human
ggaacccaggaggcagagguugcagugagcug

SEQ ID NO: 184343 - RNA, 32 nt, Human
ggaacccaggagguggagguugcagugagcug

SEQ ID NO: 184344 - RNA, 32 nt, Human
ggaacccaggcggagacccgaggcucucgcug

SEQ ID NO: 184345 - RNA, 32 nt, Human
ggaacccagggacuucagaagggcugguuugu

SEQ ID NO: 184346 - RNA, 32 nt, Human
ggaccggaaguggcucgcggaggcucagaagc

SEQ ID NO: 184347 - RNA, 32 nt, Human
ggaccggacgcaggcggcagauuugcagcccg

SEQ ID NO: 184348 - RNA, 32 nt, Human
ggaccggacgccugugcacccccagcccugcc

SEQ ID NO: 184349 - RNA, 32 nt, Human
ggaccggagcugcucccggaacuggcaggacu

SEQ ID NO: 184350 - RNA, 32 nt, Human
ggaccggcaccacuggaaaggagucugguugg

SEQ ID NO: 184351 - RNA, 32 nt, Human
ggaccggcagagggaggaagaggaagacaaga

SEQ ID NO: 184352 - RNA, 22 nt, Human
ggaccggccaacugcccuggag

SEQ ID NO: 184353 - RNA, 32 nt, Human
ggaccggccaaggacacuccuggcauugguua

SEQ ID NO: 184354 - RNA, 21 nt, Human
ggaccggcccccuuccugggg

SEQ ID NO: 184355 - RNA, 32 nt, Human
ggaccggccccugccccagccuccgcagccgc

SEQ ID NO: 184356 - RNA, 20 nt, Human
ggaccggcgcggcggggcgg

SEQ ID NO: 184357 - RNA, 32 nt, Human
ggaccggcuucugggcggcugaaggggcaagg

SEQ ID NO: 184358 - RNA, 32 nt, Human
ggaccgggacagaaagacuuacaugguccuca

SEQ ID NO: 184359 - RNA, 32 nt, Human
ggaccgggagagagggggcgcggaaggaagga

SEQ ID NO: 184360 - RNA, 32 nt, Human
ggaccgggaggcaguggcuuggagaggcagcu

SEQ ID NO: 184361 - RNA, 24 nt, Human
ggaccgggauuuucuacccagaga

SEQ ID NO: 184362 - RNA, 20 nt, Human
ggaccgggcagccccucucc

SEQ ID NO: 184363 - RNA, 24 nt, Human
ggaccgggcgaugcgcuuuagaga

SEQ ID NO: 184364 - RNA, 32 nt, Human
ggaccgggcggagaaaggcaagagaugggggu

SEQ ID NO: 184365 - RNA, 23 nt, Human
ggaccgggcggcugaccgagggg

SEQ ID NO: 184366 - RNA, 32 nt, Human
ggaccggggaucgggaccugaccuggggcugg

SEQ ID NO: 184367 - RNA, 20 nt, Human
ggaccggggcagccccugcc

SEQ ID NO: 184368 - RNA, 32 nt, Human
ggaccgggggaccccagagggaggccuaggag

SEQ ID NO: 184369 - RNA, 32 nt, Human
ggaccggucacuguccagccuggagggaggca

SEQ ID NO: 184370 - RNA, 23 nt, Human
ggaccggugaacaccugauucca

SEQ ID NO: 184371 - RNA, 16 nt, Human
ggaccgguggugggaa

SEQ ID NO: 184372 - RNA, 32 nt, Human
ggaccguauuuauacagaacugaagggaauau

SEQ ID NO: 184373 - RNA, 32 nt, Human
ggaccgucaucagcacauucccuagugagccu

SEQ ID NO: 184374 - RNA, 32 nt, Human
ggaccguccucuuccuugucuuggccacccaa

SEQ ID NO: 184375 - RNA, 32 nt, Human
ggaccgugaagaaaucaagccugugauggcac

SEQ ID NO: 184376 - RNA, 32 nt, Human
ggaccgugcagcuacgggguucuuggagaguc

SEQ ID NO: 184377 - RNA, 31 nt, Human
ggaccgugcgcucucccuuccugagcaccca

SEQ ID NO: 184378 - RNA, 32 nt, Human
ggaccguguuucccugcaccagcuccacgcug

SEQ ID NO: 184379 - RNA, 32 nt, Human
ggaccuaagaaagaaggggaguuuucugacaa

SEQ ID NO: 184380 - RNA, 21 nt, Human
ggaccuacccaggucuccacc

SEQ ID NO: 184381 - RNA, 32 nt, Human
ggaccuaggagguggagguugcagugagcuga

SEQ ID NO: 184382 - RNA, 32 nt, Human
ggaccuaggccuggcccuccgccugccuggag

SEQ ID NO: 184383 - RNA, 32 nt, Human
ggaccuaguaaacuagucaguguuggaaacgg

SEQ ID NO: 184384 - RNA, 32 nt, Human
ggaccuauacugaccucuuccccagccauuua

SEQ ID NO: 184385 - RNA, 32 nt, Human
ggaccuaugcacuuuauuucugaccccguggc

SEQ ID NO: 184386 - RNA, 32 nt, Human
ggaccucaaaauacaaaauuagcagggccuca

SEQ ID NO: 184387 - RNA, 32 nt, Human
ggaccucaacgggcaaaguugugcacacuaaa

SEQ ID NO: 184388 - RNA, 32 nt, Human
ggaccucaagcagacuuccuagagacuuguuu

SEQ ID NO: 184389 - RNA, 32 nt, Human
ggaccucacccaggauggacugauggaccugg

SEQ ID NO: 184390 - RNA, 32 nt, Human
ggaccucagagcccacucuccuuggcacccug

SEQ ID NO: 184391 - RNA, 32 nt, Human
ggaccucagauguccagagacugaucuugaau

SEQ ID NO: 184392 - RNA, 32 nt, Human
ggaccucagcaacaaggcugugccugagccca

SEQ ID NO: 184393 - RNA, 32 nt, Human
ggaccucagcaacuauggccuccugcccagac

SEQ ID NO: 184394 - RNA, 32 nt, Human
ggaccucagcgcugaagcagaaguccccggag

SEQ ID NO: 184395 - RNA, 32 nt, Human
ggaccucaggaauccggaaaagacugagaagc

SEQ ID NO: 184396 - RNA, 32 nt, Human
ggaccucaggagagaugcuacucuccauaaag

SEQ ID NO: 184397 - RNA, 32 nt, Human
ggaccuccaaaaacauagaggcaucaccugac

SEQ ID NO: 184398 - RNA, 20 nt, Human
ggaccuccaaccugcuggug

SEQ ID NO: 184399 - RNA, 21 nt, Human
ggaccuccaaggaggcugcac

SEQ ID NO: 184400 - RNA, 32 nt, Human
ggaccuccaggaugaggcagaggcaugaugcu

SEQ ID NO: 184401 - RNA, 26 nt, Human
ggaccucccaccuucaggucugcauc

SEQ ID NO: 184402 - RNA, 21 nt, Human
ggaccucccccacccuucuca

SEQ ID NO: 184403 - RNA, 22 nt, Human
ggaccuccuaggacugggccuu

SEQ ID NO: 184404 - RNA, 32 nt, Human
ggaccuccucagcauggcccaagccuugcaug

SEQ ID NO: 184405 - RNA, 32 nt, Human
ggaccuccuccaggacccugcggggcugggua

SEQ ID NO: 184406 - RNA, 32 nt, Human
ggaccuccuccaggauacagcacuggaguugg

SEQ ID NO: 184407 - RNA, 32 nt, Human
ggaccuccuggugucugccucucggagucugu

SEQ ID NO: 184408 - RNA, 32 nt, Human
ggaccucgaacaggggcggcugccucacuccc

SEQ ID NO: 184409 - RNA, 32 nt, Human
ggaccucgaggccgcugcuggggaggacgcug

SEQ ID NO: 184410 - RNA, 32 nt, Human
ggaccucgcuguguuucacugccuccugccca

SEQ ID NO: 184411 - RNA, 21 nt, Human
ggaccucggaccagagccaug

SEQ ID NO: 184412 - RNA, 32 nt, Human
ggaccucggacugcagggagccagucuucuag

SEQ ID NO: 184413 - RNA, 20 nt, Human
ggaccucggaggggggccgc

SEQ ID NO: 184414 - RNA, 32 nt, Human
ggaccucuccacugccuccuccaccccuguau

SEQ ID NO: 184415 - RNA, 32 nt, Human
ggaccucugacccugagggccgaugaggccag

SEQ ID NO: 184416 - RNA, 32 nt, Human
ggaccucugagcauccacgcaggauggcucuc

SEQ ID NO: 184417 - RNA, 32 nt, Human
ggaccucugccauccagcgccacaaagagaca

SEQ ID NO: 184418 - RNA, 32 nt, Human
ggaccucuuccaucauggaaaggaaagagguu

SEQ ID NO: 184419 - RNA, 32 nt, Human
ggaccucuucuaaaggaugguauaaaaugacu

SEQ ID NO: 184420 - RNA, 32 nt, Human
ggaccugaccucaagccucagcuccaguggga

SEQ ID NO: 184421 - RNA, 32 nt, Human
ggaccugaccucagaggugcaccagugccgcc

SEQ ID NO: 184422 - RNA, 32 nt, Human
ggaccugacuggggaggaagaagaagagaaac

SEQ ID NO: 184423 - RNA, 31 nt, Human
ggaccugagagaccucuucaaucagguggag

SEQ ID NO: 184424 - RNA, 32 nt, Human
ggaccugagccccgcgccugggaugccgggga

SEQ ID NO: 184425 - RNA, 32 nt, Human
ggaccugagccgucuuccccagucuccauaug

SEQ ID NO: 184426 - RNA, 32 nt, Human
ggaccugaggaaccugggcucugcuuccuccg

SEQ ID NO: 184427 - RNA, 32 nt, Human
ggaccugaguagcugggaccacaggcaugcgc

SEQ ID NO: 184428 - RNA, 32 nt, Human
ggaccugaguuuacuuuuuacuuuuggcaggu

SEQ ID NO: 184429 - RNA, 19 nt, Human
ggaccugcagagggggcug

SEQ ID NO: 184430 - RNA, 32 nt, Human
ggaccugcagggaaggugagaccccucaaauc

SEQ ID NO: 184431 - RNA, 32 nt, Human
ggaccugcagggcugaaguucacucaucgacc

SEQ ID NO: 184432 - RNA, 17 nt, Human
ggaccugcagguggcug

SEQ ID NO: 184433 - RNA, 32 nt, Human
ggaccugcauguuaacaaaccccacaucugug

SEQ ID NO: 184434 - RNA, 32 nt, Human
ggaccugccacaggcugggcucuugugcuaga

SEQ ID NO: 184435 - RNA, 32 nt, Human
ggaccugccacccagagccccaugaagcugau

SEQ ID NO: 184436 - RNA, 32 nt, Human
ggaccugccccucuuucuuucccuucacacca

SEQ ID NO: 184437 - RNA, 32 nt, Human
ggaccugccucgagccucaggcugcugaaauc

SEQ ID NO: 184438 - RNA, 23 nt, Human
ggaccugccucugccacccaggg

SEQ ID NO: 184439 - RNA, 32 nt, Human
ggaccugccugggagcuuucucuugcauaccc

SEQ ID NO: 184440 - RNA, 32 nt, Human
ggaccugcgcuccaggguggucucggucccag

SEQ ID NO: 184441 - RNA, 32 nt, Human
ggaccugcuaucuucaucuacaugcaccccuu

SEQ ID NO: 184442 - RNA, 32 nt, Human
ggaccugcucccacaggggccauguccucucu

SEQ ID NO: 184443 - RNA, 32 nt, Human
ggaccugcucuggggcuaccucagggccccac

SEQ ID NO: 184444 - RNA, 32 nt, Human
ggaccugcugaccaacaauagccagacacccc

SEQ ID NO: 184445 - RNA, 21 nt, Human
ggaccugcuggcucuggggua

SEQ ID NO: 184446 - RNA, 32 nt, Human
ggaccugcugucauccccaucuguggccuggg

SEQ ID NO: 184447 - RNA, 32 nt, Human
ggaccugcuugaacuaccagggccacaggagg

SEQ ID NO: 184448 - RNA, 32 nt, Human
ggaccuggacacagugcucccuucuuuaaaaa

SEQ ID NO: 184449 - RNA, 32 nt, Human
ggaccuggacguugccuccagagcaggcacca

SEQ ID NO: 184450 - RNA, 32 nt, Human
ggaccuggacucaguagugguggaauuugacg

SEQ ID NO: 184451 - RNA, 32 nt, Human
ggaccuggaguuggccagucaccaccaccauc

SEQ ID NO: 184452 - RNA, 32 nt, Human
ggaccuggauugaggaggugugcaguucgcug

SEQ ID NO: 184453 - RNA, 32 nt, Human
ggaccuggcaaccacaagacccuccccauaag

SEQ ID NO: 184454 - RNA, 19 nt, Human
ggaccuggccuucugcacg

SEQ ID NO: 184455 - RNA, 32 nt, Human
ggaccuggcggggagagcugccuccacggccg

SEQ ID NO: 184456 - RNA, 32 nt, Human
ggaccuggcuccgaaaugugaugugucuuucc

SEQ ID NO: 184457 - RNA, 32 nt, Human
ggaccugggaaugcacaggacccccugaagca

SEQ ID NO: 184458 - RNA, 32 nt, Human
ggaccugggaggcagagguuucagugagccca

SEQ ID NO: 184459 - RNA, 32 nt, Human
ggaccugggaggcggagcuugcagugagcuga

SEQ ID NO: 184460 - RNA, 32 nt, Human
ggaccugggagguggagguugcagugagcuga

SEQ ID NO: 184461 - RNA, 32 nt, Human
ggaccugggagguggagguugcggugagcuga

SEQ ID NO: 184462 - RNA, 32 nt, Human
ggaccugggcauucagccuccugcucuuaacu

SEQ ID NO: 184463 - RNA, 32 nt, Human
ggaccuggggaaaggagauggagcagcucuug

SEQ ID NO: 184464 - RNA, 32 nt, Human
ggaccuggggagugguuaggcagcaagcuuug

SEQ ID NO: 184465 - RNA, 32 nt, Human
ggaccuggucucaaggcagccccacucgaguc

SEQ ID NO: 184466 - RNA, 32 nt, Human
ggaccuggugcaggaagcuucaucugaagaug

SEQ ID NO: 184467 - RNA, 32 nt, Human
ggaccugguggaggacgccgggccggcccuag

SEQ ID NO: 184468 - RNA, 22 nt, Human
ggaccugguggcccaccggagg

SEQ ID NO: 184469 - RNA, 32 nt, Human
ggaccuguaccgcagccgccugugcugguacg

SEQ ID NO: 184470 - RNA, 32 nt, Human
ggaccuguagccaccugcaccaggagcuggac

SEQ ID NO: 184471 - RNA, 32 nt, Human
ggaccuguauguggggguggucucugguuucg

SEQ ID NO: 184472 - RNA, 32 nt, Human
ggaccuguauuuccaugucaaauguuuucaaa

SEQ ID NO: 184473 - RNA, 32 nt, Human
ggaccugugcaaaugacccuggaguugguuuc

SEQ ID NO: 184474 - RNA, 32 nt, Human
ggaccugugcagacuucuucugggcuuaccca

SEQ ID NO: 184475 - RNA, 32 nt, Human
ggaccugugcaggaucacuggacacaggcugu

SEQ ID NO: 184476 - RNA, 32 nt, Human
ggaccugugcgggcaguggccccggugaccuu

SEQ ID NO: 184477 - RNA, 32 nt, Human
ggaccuguggaggcacugccugccucaccugc

SEQ ID NO: 184478 - RNA, 32 nt, Human
ggaccuguggcagcucacaggcaugaggggug

SEQ ID NO: 184479 - RNA, 32 nt, Human
ggaccugugugugugcaaguuucuaucuucca

SEQ ID NO: 184480 - RNA, 32 nt, Human
ggaccuguuaaacaaucucuggcuauuaaaaa

SEQ ID NO: 184481 - RNA, 32 nt, Human
ggaccuguuccagugggcacuguacuuggauc

SEQ ID NO: 184482 - RNA, 19 nt, Human
ggaccuguuggaaguggga

SEQ ID NO: 184483 - RNA, 32 nt, Human
ggaccuguuuauaaauugaggaauggaugagg

SEQ ID NO: 184484 - RNA, 32 nt, Human
ggaccuguuugccgcccugccccagguugugg

SEQ ID NO: 184485 - RNA, 18 nt, Human
ggaccuguuuugguggga

SEQ ID NO: 184486 - RNA, 32 nt, Human
ggaccuguuuuuaucuaccugugugacuugaa

SEQ ID NO: 184487 - RNA, 32 nt, Human
ggaccuguuuuuccuguuucccgcagaguucc

SEQ ID NO: 184488 - RNA, 31 nt, Human
ggaccuucaauaaacacuuguccagugaaaa

SEQ ID NO: 184489 - RNA, 32 nt, Human
ggaccuucaucacuaccucuggccgcaauucc

SEQ ID NO: 184490 - RNA, 32 nt, Human
ggaccuuccagggcccaugcagggugagggaa

SEQ ID NO: 184491 - RNA, 32 nt, Human
ggaccuucuagacugcucacagggccuuaacu

SEQ ID NO: 184492 - RNA, 32 nt, Human
ggaccuucugacucagaggacaugagauggcc

SEQ ID NO: 184493 - RNA, 32 nt, Human
ggaccuucugcaguggaagugccacauccagu

SEQ ID NO: 184494 - RNA, 32 nt, Human
ggaccuucugcuccgagaaaugcagcugcuca

SEQ ID NO: 184495 - RNA, 32 nt, Human
ggaccuucuggaccaaccgacccugcucccgg

SEQ ID NO: 184496 - RNA, 32 nt, Human
ggaccuucuuucucugucaggcccuugaccug

SEQ ID NO: 184497 - RNA, 25 nt, Human
ggaccuucuuucuguucucuuuacu

SEQ ID NO: 184498 - RNA, 32 nt, Human
ggaccuugaccuucuggugccugccccucccc

SEQ ID NO: 184499 - RNA, 32 nt, Human
ggaccuugaguguggcccucccuuucugggcc

SEQ ID NO: 184500 - RNA, 32 nt, Human
ggaccuugaugugagaggagcagguucaggua

SEQ ID NO: 184501 - RNA, 32 nt, Human
ggaccuugccgccacaccagcccuguccuggg

SEQ ID NO: 184502 - RNA, 31 nt, Human
ggaccuugccucucuggaaucugucaaccca

SEQ ID NO: 184503 - RNA, 32 nt, Human
ggaccuugcuuggacaaaaugccuucaccgcu

SEQ ID NO: 184504 - RNA, 32 nt, Human
ggaccuuggaggagauugccugcugcaccccu

SEQ ID NO: 184505 - RNA, 32 nt, Human
ggaccuuggccuguucauuugcagagaagaua

SEQ ID NO: 184506 - RNA, 32 nt, Human
ggaccuuggcugcuggaggcugcaccuacuga

SEQ ID NO: 184507 - RNA, 32 nt, Human
ggaccuuggcuucugacuuggagaguguacag

SEQ ID NO: 184508 - RNA, 32 nt, Human
ggaccuuggggccacuggcacugucagauagu

SEQ ID NO: 184509 - RNA, 32 nt, Human
ggaccuugucccaggcugggcagaggucagga

SEQ ID NO: 184510 - RNA, 32 nt, Human
ggaccuuuccaucucagacuggcuggccaggg

SEQ ID NO: 184511 - RNA, 32 nt, Human
ggaccuuucucaggaucuguguucacacagcc

SEQ ID NO: 184512 - RNA, 32 nt, Human
ggaccuuucucuuccuccuccuccaauucccc

SEQ ID NO: 184513 - RNA, 23 nt, Human
ggaccuuugagaggaggcugugu

SEQ ID NO: 184514 - RNA, 32 nt, Human
ggaccuuuggcaaaugaagguuuacauuucug

SEQ ID NO: 184515 - RNA, 32 nt, Human
ggaccuuugugcugggaacugaaagagugggg

SEQ ID NO: 184516 - RNA, 32 nt, Human
ggaccuuuuccugcccuucuccuuccucugcu

SEQ ID NO: 184517 - RNA, 32 nt, Human
ggaccuuuucuuucuucuugucccacgguugc

SEQ ID NO: 184518 - RNA, 32 nt, Human
ggacgaaaccaacacauauacaaucaucuccc

SEQ ID NO: 184519 - RNA, 32 nt, Human
ggacgaacccaaggacgggggcagugugggga

SEQ ID NO: 184520 - RNA, 32 nt, Human
ggacgaacuucucuuccucacaugagguuacu

SEQ ID NO: 184521 - RNA, 32 nt, Human
ggacgaagaggaggaggaugaggaggacacag

SEQ ID NO: 184522 - RNA, 32 nt, Human
ggacgaagccuccagugaccuggaccuggagc

SEQ ID NO: 184523 - RNA, 32 nt, Human
ggacgaaugcugcuucaugcgacuccauguca

SEQ ID NO: 184524 - RNA, 18 nt, Human
ggacgaauuugcacagug

SEQ ID NO: 184525 - RNA, 24 nt, Human
ggacgacagagcaagacucugucu

SEQ ID NO: 184526 - RNA, 24 nt, Human
ggacgacagagugagacuccaucu

SEQ ID NO: 184527 - RNA, 24 nt, Human
ggacgacagagugagauucugucu

SEQ ID NO: 184528 - RNA, 32 nt, Human
ggacgacagagugagauucugucucaaaauaa

SEQ ID NO: 184529 - RNA, 32 nt, Human
ggacgaccccaggucuccagacaucuagggac

SEQ ID NO: 184530 - RNA, 32 nt, Human
ggacgacccugccuccgucucgugacacaaug

SEQ ID NO: 184531 - RNA, 32 nt, Human
ggacgacccuugcucugaccggaagagaaguc

SEQ ID NO: 184532 - RNA, 32 nt, Human
ggacgaccugcucucuacauugcugggcaccu

SEQ ID NO: 184533 - RNA, 32 nt, Human
ggacgaccugggaaggucacccccaucgccua

SEQ ID NO: 184534 - RNA, 22 nt, Human
ggacgaccuucccugcuccaug

SEQ ID NO: 184535 - RNA, 17 nt, Human
ggacgacggcucuggga

SEQ ID NO: 184536 - RNA, 32 nt, Human
ggacgacucacugcggcugcgccacugggacc

SEQ ID NO: 184537 - RNA, 24 nt, Human
ggacgacugagugagacccugucu

SEQ ID NO: 184538 - RNA, 32 nt, Human
ggacgagacccccauccagccuccagggcauu

SEQ ID NO: 184539 - RNA, 26 nt, Human
ggacgagagcaaggagaggcuaggga

SEQ ID NO: 184540 - RNA, 32 nt, Human
ggacgagcuggcugaccccacugagcgguuca

SEQ ID NO: 184541 - RNA, 18 nt, Human
ggacgaggagcacuguga

SEQ ID NO: 184542 - RNA, 32 nt, Human
ggacgaggaggaggaggaggaagaggggaugg

SEQ ID NO: 184543 - RNA, 32 nt, Human
ggacgaggaggcagcaggagcagugacgguga

SEQ ID NO: 184544 - RNA, 32 nt, Human
ggacgaggcaggcggaucaugaggucaggaga

SEQ ID NO: 184545 - RNA, 32 nt, Human
ggacgaggccuccugcggacaccagcuccucu

SEQ ID NO: 184546 - RNA, 32 nt, Human
ggacgagggcgggaugucugccuccaguucca

SEQ ID NO: 184547 - RNA, 32 nt, Human
ggacgaggggcaggacgugugggcaggagccu

SEQ ID NO: 184548 - RNA, 32 nt, Human
ggacgaguagggccacccagggccaggagaac

SEQ ID NO: 184549 - RNA, 32 nt, Human
ggacgaguucauguccaucacgggcagccugg

SEQ ID NO: 184550 - RNA, 30 nt, Human
ggacgaugacugcaguguauaugaauggag

SEQ ID NO: 184551 - RNA, 32 nt, Human
ggacgaugcaagauuucaucacacuacucaga

SEQ ID NO: 184552 - RNA, 32 nt, Human
ggacgauggaaauccuguaugaauguggaagc

SEQ ID NO: 184553 - RNA, 32 nt, Human
ggacgauggugaucaguaucacucccucugac

SEQ ID NO: 184554 - RNA, 32 nt, Human
ggacgauuagauagguguuuuaaggccugaaa

SEQ ID NO: 184555 - RNA, 32 nt, Human
ggacgcacagcccaggccacagccagggcucc

SEQ ID NO: 184556 - RNA, 32 nt, Human
ggacgcacccuccacagugggaggugguggug

SEQ ID NO: 184557 - RNA, 32 nt, Human
ggacgcaccggccuggcugcagcugggcagca

SEQ ID NO: 184558 - RNA, 32 nt, Human
ggacgcacucgucccugaggccuggguguccc

SEQ ID NO: 184559 - RNA, 32 nt, Human
ggacgcagagggcagaggcccaguggagccuc

SEQ ID NO: 184560 - RNA, 32 nt, Human
ggacgcagaggguccucagagcaggagugaca

SEQ ID NO: 184561 - RNA, 32 nt, Human
ggacgcagccgugguggagguggagaaguuga

SEQ ID NO: 184562 - RNA, 32 nt, Human
ggacgcagcgcagauguuggugaccuucaagg

SEQ ID NO: 184563 - RNA, 32 nt, Human
ggacgcagggcccaagacugggcacaggagug

SEQ ID NO: 184564 - RNA, 32 nt, Human
ggacgcauaagacaccaaaaucccagacacuc

SEQ ID NO: 184565 - RNA, 32 nt, Human
ggacgcauccccgccggcccugaggccagaga

SEQ ID NO: 184566 - RNA, 32 nt, Human
ggacgcaucuggagacaagugagaaacaguag

SEQ ID NO: 184567 - RNA, 32 nt, Human
ggacgcauggaggagaaaaauuugaacgaggc

SEQ ID NO: 184568 - RNA, 32 nt, Human
ggacgccaaagcugaggcaggggagggagcca

SEQ ID NO: 184569 - RNA, 32 nt, Human
ggacgccaagcagacacaccugcccuccccag

SEQ ID NO: 184570 - RNA, 32 nt, Human
ggacgccaagcuccgggaggcugcaguggcgg

SEQ ID NO: 184571 - RNA, 17 nt, Human
ggacgccauccccuccu

SEQ ID NO: 184572 - RNA, 32 nt, Human
ggacgcccaagaucaagaggccagcagauucg

SEQ ID NO: 184573 - RNA, 32 nt, Human
ggacgcccagcacccuggauaggacccaacag

SEQ ID NO: 184574 - RNA, 32 nt, Human
ggacgcccaggccuucucacaugggcaccaug

SEQ ID NO: 184575 - RNA, 16 nt, Human
ggacgccccagcuggc

SEQ ID NO: 184576 - RNA, 20 nt, Human
ggacgccccaggcucugcug

SEQ ID NO: 184577 - RNA, 20 nt, Human
ggacgccccgaggaaggggc

SEQ ID NO: 184578 - RNA, 32 nt, Human
ggacgccccugccucccucugcgggcuccaga

SEQ ID NO: 184579 - RNA, 20 nt, Human
ggacgccccugggugaacug

SEQ ID NO: 184580 - RNA, 19 nt, Human
ggacgcccgcuuccugcug

SEQ ID NO: 184581 - RNA, 32 nt, Human
ggacgcccucacugcaggcuccccuccucggc

SEQ ID NO: 184582 - RNA, 32 nt, Human
ggacgcccuccccucaccgcgcccccgcagac

SEQ ID NO: 184583 - RNA, 32 nt, Human
ggacgcccuccugguuugggaagcugcugcuc

SEQ ID NO: 184584 - RNA, 22 nt, Human
ggacgcccucgcaccccuggac

SEQ ID NO: 184585 - RNA, 32 nt, Human
ggacgcccugcaacccugccaggcugggaagg

SEQ ID NO: 184586 - RNA, 19 nt, Human
ggacgcccugcccucacug

SEQ ID NO: 184587 - RNA, 32 nt, Human
ggacgcccuggaccugcccggcuguuuccgca

SEQ ID NO: 184588 - RNA, 32 nt, Human
ggacgccgaggccuggagugggugguagcccc

SEQ ID NO: 184589 - RNA, 32 nt, Human
ggacgccgccagcgaguccagcagggagucca

SEQ ID NO: 184590 - RNA, 32 nt, Human
ggacgccgccgccguugcugcccggcccggag

SEQ ID NO: 184591 - RNA, 32 nt, Human
ggacgccggccccaggguaacaggaggcgccu

SEQ ID NO: 184592 - RNA, 32 nt, Human
ggacgccggcgccccugugcgagugaccgcca

SEQ ID NO: 184593 - RNA, 19 nt, Human
ggacgccggcggcgcccug

SEQ ID NO: 184594 - RNA, 18 nt, Human
ggacgccggcuccuggag

SEQ ID NO: 184595 - RNA, 32 nt, Human
ggacgccgugagccgccgccgcagucgucucg

SEQ ID NO: 184596 - RNA, 32 nt, Human
ggacgccuccacccugccccacaaggcuccgu

SEQ ID NO: 184597 - RNA, 19 nt, Human
ggacgccugggaagccugg

SEQ ID NO: 184598 - RNA, 32 nt, Human
ggacgccugguguggacgaugagggaagaacg

SEQ ID NO: 184599 - RNA, 32 nt, Human
ggacgccuguaaucccagcuacuuggaaggcu

SEQ ID NO: 184600 - RNA, 32 nt, Human
ggacgccuguaaucccagcuacuugggaggcu

SEQ ID NO: 184601 - RNA, 17 nt, Human
ggacgccuguaguccca

SEQ ID NO: 184602 - RNA, 32 nt, Human
ggacgccuguagucccagcuacuuggaggcug

SEQ ID NO: 184603 - RNA, 32 nt, Human
ggacgccuguauucacagcuacucgggagguu

SEQ ID NO: 184604 - RNA, 32 nt, Human
ggacgcgaaagaaaugggcauaaguagaauga

SEQ ID NO: 184605 - RNA, 32 nt, Human
ggacgcgaggagccaugaggcgccagccugcg

SEQ ID NO: 184606 - RNA, 32 nt, Human
ggacgcgaugcuauucgacaaggugaaagcgu

SEQ ID NO: 184607 - RNA, 32 nt, Human
ggacgcgccgggcuggagugggcgguuauagg

SEQ ID NO: 184608 - RNA, 32 nt, Human
ggacgcggaacugcggaagauccacagggcgg

SEQ ID NO: 184609 - RNA, 32 nt, Human
ggacgcggaaggcccugggggugcaguggagc

SEQ ID NO: 184610 - RNA, 32 nt, Human
ggacgcggcagagucacgguggcagcauugag

SEQ ID NO: 184611 - RNA, 16 nt, Human
ggacgcggcggcuggc

SEQ ID NO: 184612 - RNA, 32 nt, Human
ggacgcggcgucuggggagcacccaggcagca

SEQ ID NO: 184613 - RNA, 32 nt, Human
ggacgcgggaaagaccgaaaggaagaggaaga

SEQ ID NO: 184614 - RNA, 32 nt, Human
ggacgcgggaggacauggagguaggcgggaac

SEQ ID NO: 184615 - RNA, 32 nt, Human
ggacgcgggagugagagagggugagucagcca

SEQ ID NO: 184616 - RNA, 23 nt, Human
ggacgcgguggcucaugccugua

SEQ ID NO: 184617 - RNA, 32 nt, Human
ggacgcgguggguguggagcagcaucccuggc

SEQ ID NO: 184618 - RNA, 32 nt, Human
ggacgcgucugggcuccccuaggcaaaggucc

SEQ ID NO: 184619 - RNA, 32 nt, Human
ggacgcgucugggcugcuggaggcagcccgag

SEQ ID NO: 184620 - RNA, 32 nt, Human
ggacgcgugggguuccguguccccagcaguga

SEQ ID NO: 184621 - RNA, 32 nt, Human
ggacgcguucugccugggcauguaggggaggu

SEQ ID NO: 184622 - RNA, 23 nt, Human
ggacgcucccagggccccagagg

SEQ ID NO: 184623 - RNA, 18 nt, Human
ggacgcucccugcuccac

SEQ ID NO: 184624 - RNA, 32 nt, Human
ggacgcuccuuucugcugacagcccagccagu

SEQ ID NO: 184625 - RNA, 23 nt, Human
ggacgcucuuggcagguccccuc

SEQ ID NO: 184626 - RNA, 19 nt, Human
ggacgcugagaccaagaag

SEQ ID NO: 184627 - RNA, 32 nt, Human
ggacgcugaggcaggagaaucgcuugaaccca

SEQ ID NO: 184628 - RNA, 32 nt, Human
ggacgcugaggcaggaggaucauuugagccug

SEQ ID NO: 184629 - RNA, 32 nt, Human
ggacgcugaggugggaggauugcuugagccca

SEQ ID NO: 184630 - RNA, 32 nt, Human
ggacgcugcugguguccuccaggccugggugg

SEQ ID NO: 184631 - RNA, 32 nt, Human
ggacgcuggaaaugccuuaaggauagaggcug

SEQ ID NO: 184632 - RNA, 32 nt, Human
ggacgcugggagguggaugcugcagugagcag

SEQ ID NO: 184633 - RNA, 32 nt, Human
ggacgcugggccggucuacaccgccgccuggg

SEQ ID NO: 184634 - RNA, 25 nt, Human
ggacgcugucuacaagacccuggag

SEQ ID NO: 184635 - RNA, 32 nt, Human
ggacgcuucugcucaugguccaaggcuguguu

SEQ ID NO: 184636 - RNA, 32 nt, Human
ggacggaaggcugaauguagggucauuuugua

SEQ ID NO: 184637 - RNA, 32 nt, Human
ggacggacacacucauuacacacucacacgcc

SEQ ID NO: 184638 - RNA, 32 nt, Human
ggacggaccgacgcggagaggaagggaagccg

SEQ ID NO: 184639 - RNA, 32 nt, Human
ggacggacucacuucucuuuuuaguugaggcc

SEQ ID NO: 184640 - RNA, 32 nt, Human
ggacggacuguacuacagggagcagauccccc

SEQ ID NO: 184641 - RNA, 32 nt, Human
ggacggagaggaacaaggauggggagguagga

SEQ ID NO: 184642 - RNA, 32 nt, Human
ggacggagcagcgaggaggggagcagccggga

SEQ ID NO: 184643 - RNA, 32 nt, Human
ggacggagccugggagcggggcggggccgccg

SEQ ID NO: 184644 - RNA, 22 nt, Human
ggacggagcucggcgcugggaa

SEQ ID NO: 184645 - RNA, 32 nt, Human
ggacggaggaagagaugaaggcucugcagccc

SEQ ID NO: 184646 - RNA, 32 nt, Human
ggacggagugucccucuuguugcccaggcugg

SEQ ID NO: 184647 - RNA, 32 nt, Human
ggacggaucugagcagcugggcagcaggugcc

SEQ ID NO: 184648 - RNA, 22 nt, Human
ggacggaugaggacgacuugga

SEQ ID NO: 184649 - RNA, 23 nt, Human
ggacggauugacgaacugaugga

SEQ ID NO: 184650 - RNA, 32 nt, Human
ggacggauugugaauucagagcugaauaagga

SEQ ID NO: 184651 - RNA, 17 nt, Human
ggacggcagcucuggga

SEQ ID NO: 184652 - RNA, 24 nt, Human
ggacggcaggagccagccccggac

SEQ ID NO: 184653 - RNA, 32 nt, Human
ggacggccucaaacucagcucagaggagucgc

SEQ ID NO: 184654 - RNA, 20 nt, Human
ggacggcggagccccagcgg

SEQ ID NO: 184655 - RNA, 32 nt, Human
ggacggcggcgugcccuuccuuuccucccucc

SEQ ID NO: 184656 - RNA, 17 nt, Human
ggacggcgggcgcccgg

SEQ ID NO: 184657 - RNA, 32 nt, Human
ggacggcuggaggaccgcucagucucuccucu

SEQ ID NO: 184658 - RNA, 32 nt, Human
ggacgggaagggacagcggccuucgaccgccc

SEQ ID NO: 184659 - RNA, 32 nt, Human
ggacgggacucauguaaggacucaauuugggg

SEQ ID NO: 184660 - RNA, 32 nt, Human
ggacgggagaggccguguagcgucgccguuac

SEQ ID NO: 184661 - RNA, 32 nt, Human
ggacgggagagggcagugcaaugggaaguaaa

SEQ ID NO: 184662 - RNA, 32 nt, Human
ggacgggagccagcaggucgcguucgaugacu

SEQ ID NO: 184663 - RNA, 32 nt, Human
ggacgggaggagggagggcgggcaggcgccag

SEQ ID NO: 184664 - RNA, 32 nt, Human
ggacgggaggcagagccggcucagagcagguc

SEQ ID NO: 184665 - RNA, 32 nt, Human
ggacgggaggcuggaagcugggaggucaggug

SEQ ID NO: 184666 - RNA, 32 nt, Human
ggacgggagguggcggagguggcggcggaggc

SEQ ID NO: 184667 - RNA, 20 nt, Human
ggacgggagucaccaggugg

SEQ ID NO: 184668 - RNA, 18 nt, Human
ggacgggagucucagaga

SEQ ID NO: 184669 - RNA, 32 nt, Human
ggacgggcaggacgggcagggcuuccaggaga

SEQ ID NO: 184670 - RNA, 32 nt, Human
ggacgggcagggcuuccaggagagcucaagca

SEQ ID NO: 184671 - RNA, 32 nt, Human
ggacgggcccagugcuggguguuuucaccacc

SEQ ID NO: 184672 - RNA, 32 nt, Human
ggacgggcccuccuucccuccugugccccagc

SEQ ID NO: 184673 - RNA, 32 nt, Human
ggacgggcguuuucacagggcucugaguggga

SEQ ID NO: 184674 - RNA, 32 nt, Human
ggacggggaagggagagugagcgcaugcugaa

SEQ ID NO: 184675 - RNA, 20 nt, Human
ggacggggacgcaaggcaga

SEQ ID NO: 184676 - RNA, 32 nt, Human
ggacggggagcugagacccagaagaaaggagg

SEQ ID NO: 184677 - RNA, 32 nt, Human
ggacggggaguguuaccggggagcagcugcuc

SEQ ID NO: 184678 - RNA, 32 nt, Human
ggacggggcccaggaggucaggagagcagccc

SEQ ID NO: 184679 - RNA, 32 nt, Human
ggacggggcccgcaguccgcagccucucccgu

SEQ ID NO: 184680 - RNA, 22 nt, Human
ggacggggcgcccgcgcagcug

SEQ ID NO: 184681 - RNA, 32 nt, Human
ggacggggcugcacuccaaccgucugcaccug

SEQ ID NO: 184682 - RNA, 32 nt, Human
ggacgggggaggaggaaggggacagagggagc

SEQ ID NO: 184683 - RNA, 32 nt, Human
ggacgggggcagagaagugaugaagggaaaug

SEQ ID NO: 184684 - RNA, 32 nt, Human
ggacgggggcagcgcagcugugcucaagacug

SEQ ID NO: 184685 - RNA, 32 nt, Human
ggacgggguacagaggauagugugggucagag

SEQ ID NO: 184686 - RNA, 32 nt, Human
ggacggggugcagacggcagggccaguauggg

SEQ ID NO: 184687 - RNA, 18 nt, Human
ggacgggugacaguguga

SEQ ID NO: 184688 - RNA, 16 nt, Human
ggacgggugcuucugg

SEQ ID NO: 184689 - RNA, 32 nt, Human
ggacgggugggccugaggugcccagcucaggg

SEQ ID NO: 184690 - RNA, 16 nt, Human
ggacggguggugggaa

SEQ ID NO: 184691 - RNA, 32 nt, Human
ggacggucaucugcuccggaaggaaagagaac

SEQ ID NO: 184692 - RNA, 32 nt, Human
ggacggucuuuucuaaacuuuacaugagacuu

SEQ ID NO: 184693 - RNA, 32 nt, Human
ggacggugauaaccucuccccgaucggguugc

SEQ ID NO: 184694 - RNA, 32 nt, Human
ggacggugccacuuccagacaagacccacaaa

SEQ ID NO: 184695 - RNA, 32 nt, Human
ggacgguggaccggugaccccuuuguauucug

SEQ ID NO: 184696 - RNA, 20 nt, Human
ggacgguggccccugcaucu

SEQ ID NO: 184697 - RNA, 32 nt, Human
ggacgguggcccugccuucaugcccaggacac

SEQ ID NO: 184698 - RNA, 32 nt, Human
ggacggugucucuggccagcacuggcagcuuc

SEQ ID NO: 184699 - RNA, 32 nt, Human
ggacgguguugugguuuaccgucuccagcuuc

SEQ ID NO: 184700 - RNA, 32 nt, Human
ggacguaagggugugaaaggagccaaaggcuu

SEQ ID NO: 184701 - RNA, 31 nt, Human
ggacguaccgggcuuccuacagcagagccag

SEQ ID NO: 184702 - RNA, 32 nt, Human
ggacguaggagguggagguuguggaauucgcc

SEQ ID NO: 184703 - RNA, 32 nt, Human
ggacguccacgaucucuuucgccggcucggcg

SEQ ID NO: 184704 - RNA, 32 nt, Human
ggacguccuccagggacagccagcuccuccuc

SEQ ID NO: 184705 - RNA, 21 nt, Human
ggacgucgcgugguggggcag

SEQ ID NO: 184706 - RNA, 32 nt, Human
ggacgucggcuucuccccgcgggagcccccag

SEQ ID NO: 184707 - RNA, 32 nt, Human
ggacgucugcccccgcaugcaggagggggugu

SEQ ID NO: 184708 - RNA, 32 nt, Human
ggacgucuguaaucccagcuacuugggagacu

SEQ ID NO: 184709 - RNA, 32 nt, Human
ggacgugaagugaggaggggguugggagggga

SEQ ID NO: 184710 - RNA, 32 nt, Human
ggacgugaggccaagaccccagcagagaugcc

SEQ ID NO: 184711 - RNA, 32 nt, Human
ggacgugauaggagcaaagucucuccauucuc

SEQ ID NO: 184712 - RNA, 32 nt, Human
ggacgugcaccucgagcugaaggaccugacuc

SEQ ID NO: 184713 - RNA, 19 nt, Human
ggacgugcagagggugcag

SEQ ID NO: 184714 - RNA, 32 nt, Human
ggacgugcugcagaugcugaagauccaccgca

SEQ ID NO: 184715 - RNA, 32 nt, Human
ggacgugcuggguggcuggguggggcgggugc

SEQ ID NO: 184716 - RNA, 32 nt, Human
ggacguggccagaucuucucgcaggucacaag

SEQ ID NO: 184717 - RNA, 32 nt, Human
ggacguggcgcugucgguguuuggaggcugcu

SEQ ID NO: 184718 - RNA, 20 nt, Human
ggacgugggcugggcccaca

SEQ ID NO: 184719 - RNA, 23 nt, Human
ggacgugguggcacaugccugua

SEQ ID NO: 184720 - RNA, 23 nt, Human
ggacgugguggcaggugccugua

SEQ ID NO: 184721 - RNA, 23 nt, Human
ggacgugguggcgcaugccugua

SEQ ID NO: 184722 - RNA, 23 nt, Human
ggacgugguggcucacgccugua

SEQ ID NO: 184723 - RNA, 32 nt, Human
ggacguggugggcaccuguaaucccagcuacu

SEQ ID NO: 184724 - RNA, 32 nt, Human
ggacguguucagaguuucuucuuucugguggg

SEQ ID NO: 184725 - RNA, 32 nt, Human
ggacguucagcugucuguacgucugucugcug

SEQ ID NO: 184726 - RNA, 32 nt, Human
ggacguucaucuccuguacuccaggcugucau

SEQ ID NO: 184727 - RNA, 32 nt, Human
ggacguugaaaugggagaauugcuugagucca

SEQ ID NO: 184728 - RNA, 32 nt, Human
ggacguugauaggaagcggaaggggaaucgcg

SEQ ID NO: 184729 - RNA, 22 nt, Human
ggacguugucacggguuugggg

SEQ ID NO: 184730 - RNA, 32 nt, Human
ggacguugucugcaggcacucagaauggucca

SEQ ID NO: 184731 - RNA, 32 nt, Human
ggacguuuaaaguauugcuguguguuucaagu

SEQ ID NO: 184732 - RNA, 32 nt, Human
ggacguuuccaucagguuccaucccgaaaauc

SEQ ID NO: 184733 - RNA, 32 nt, Human
ggacguuucugcccuguuccccgaucagagcu

SEQ ID NO: 184734 - RNA, 19 nt, Human
ggacguuucuguuuacuca

SEQ ID NO: 184735 - RNA, 32 nt, Human
ggacguuucuguuuacucagagcugcuagaga

SEQ ID NO: 184736 - RNA, 32 nt, Human
ggacuaaaaaucuuguaaaaacuucggaggca

SEQ ID NO: 184737 - RNA, 32 nt, Human
ggacuaaacaacaaaaaggaggcaugagauuc

SEQ ID NO: 184738 - RNA, 32 nt, Human
ggacuaaacacguguuccgguggcagauugaa

SEQ ID NO: 184739 - RNA, 32 nt, Human
ggacuaaacucauuagaguucuuaaggcaguu

SEQ ID NO: 184740 - RNA, 32 nt, Human
ggacuaaagcagaauguaggagagggauucuu

SEQ ID NO: 184741 - RNA, 32 nt, Human
ggacuaaagcccagagagcaagacaguugggc

SEQ ID NO: 184742 - RNA, 32 nt, Human
ggacuaacccaagggggaaagcuaguguugau

SEQ ID NO: 184743 - RNA, 32 nt, Human
ggacuaagaaguuuugugagcaccaauggcaa

SEQ ID NO: 184744 - RNA, 32 nt, Human
ggacuaagacacacauugucaaaaucuucaug

SEQ ID NO: 184745 - RNA, 32 nt, Human
ggacuaagcuuggaauugccugucccacagca

SEQ ID NO: 184746 - RNA, 32 nt, Human
ggacuaaugagacugaggaagcagcuuuuccu

SEQ ID NO: 184747 - RNA, 32 nt, Human
ggacuacaagcaugcaccaccacgcccagcua

SEQ ID NO: 184748 - RNA, 32 nt, Human
ggacuacaagcgcacaccaccacgccugacua

SEQ ID NO: 184749 - RNA, 32 nt, Human
ggacuacaagcgcgcaccaccacucccagcua

SEQ ID NO: 184750 - RNA, 32 nt, Human
ggacuacaagugugcaccaccauggcuggcua

SEQ ID NO: 184751 - RNA, 32 nt, Human
ggacuacaaguuaaagucacucagcuggaucc

SEQ ID NO: 184752 - RNA, 32 nt, Human
ggacuacaauugugagccaccaugccaggcuc

SEQ ID NO: 184753 - RNA, 24 nt, Human
ggacuacagagugagacuccaucu

SEQ ID NO: 184754 - RNA, 32 nt, Human
ggacuacagaugcauuccaccaugcccagcua

SEQ ID NO: 184755 - RNA, 32 nt, Human
ggacuacagaugugggccaccaugucuggcua

SEQ ID NO: 184756 - RNA, 32 nt, Human
ggacuacagauguuugccaccaugcccgccuc

SEQ ID NO: 184757 - RNA, 32 nt, Human
ggacuacagcaaggggaagugccugaagacau

SEQ ID NO: 184758 - RNA, 32 nt, Human
ggacuacaggaguaugccaccaugcccagcua

SEQ ID NO: 184759 - RNA, 32 nt, Human
ggacuacaggcaaccaccaccacuccuaccuu

SEQ ID NO: 184760 - RNA, 32 nt, Human
ggacuacaggcacacaccacaacaccuggcua

SEQ ID NO: 184761 - RNA, 32 nt, Human
ggacuacaggcacacaccaccacgcccagcua

SEQ ID NO: 184762 - RNA, 32 nt, Human
ggacuacaggcacacaccaccaugcccagcua

SEQ ID NO: 184763 - RNA, 32 nt, Human
ggacuacaggcacaugccaccaugcccggcua

SEQ ID NO: 184764 - RNA, 32 nt, Human
ggacuacaggcacccgccaccaugcccagcua

SEQ ID NO: 184765 - RNA, 32 nt, Human
ggacuacaggcacccgccaccaugcccggcua

SEQ ID NO: 184766 - RNA, 32 nt, Human
ggacuacaggcaccugccaccaugcccagcua

SEQ ID NO: 184767 - RNA, 32 nt, Human
ggacuacaggcacgagccaccaugcccagcua

SEQ ID NO: 184768 - RNA, 32 nt, Human
ggacuacaggcacgcaccaccacaccuggcua

SEQ ID NO: 184769 - RNA, 32 nt, Human
ggacuacaggcacgcaccaccaugccaggcua

SEQ ID NO: 184770 - RNA, 32 nt, Human
ggacuacaggcacgcaccaccaugccuagcua

SEQ ID NO: 184771 - RNA, 32 nt, Human
ggacuacaggcacgcgccaccaugcccggcua

SEQ ID NO: 184772 - RNA, 32 nt, Human
ggacuacaggcacucaccaccaugcccagcuc

SEQ ID NO: 184773 - RNA, 32 nt, Human
ggacuacaggcacucgccaccaugcccggcug

SEQ ID NO: 184774 - RNA, 32 nt, Human
ggacuacaggcaugcaccaccacacccggcua

SEQ ID NO: 184775 - RNA, 32 nt, Human
ggacuacaggcaugcaccaccacacccugcua

SEQ ID NO: 184776 - RNA, 32 nt, Human
ggacuacaggcaugcaccaccacauccggcua

SEQ ID NO: 184777 - RNA, 32 nt, Human
ggacuacaggcaugcaccaccacgccaggcua

SEQ ID NO: 184778 - RNA, 32 nt, Human
ggacuacaggcaugcaccaccacgcccagcua

SEQ ID NO: 184779 - RNA, 32 nt, Human
ggacuacaggcaugcaccaccaugcccagcua

SEQ ID NO: 184780 - RNA, 32 nt, Human
ggacuacaggcaugcaccaccaugcccaguua

SEQ ID NO: 184781 - RNA, 32 nt, Human
ggacuacaggcaugcaccaccaugccuagcua

SEQ ID NO: 184782 - RNA, 32 nt, Human
ggacuacaggcaugcaccaccaugccuggcua

SEQ ID NO: 184783 - RNA, 32 nt, Human
ggacuacaggcaugugccaccaugcccggcua

SEQ ID NO: 184784 - RNA, 32 nt, Human
ggacuacaggcaugugccaccauguccagcua

SEQ ID NO: 184785 - RNA, 32 nt, Human
ggacuacaggcauguggcaccaugcccgcuaa

SEQ ID NO: 184786 - RNA, 32 nt, Human
ggacuacaggcgcacaccaccacacuggcuaa

SEQ ID NO: 184787 - RNA, 32 nt, Human
ggacuacaggcgcacaccaccacgccaggcua

SEQ ID NO: 184788 - RNA, 32 nt, Human
ggacuacaggcgcacaccaccaugcccagcua

SEQ ID NO: 184789 - RNA, 32 nt, Human
ggacuacaggcgcacgccgcaccaccacgucu

SEQ ID NO: 184790 - RNA, 32 nt, Human
ggacuacaggcgcaugccaccacacccggcua

SEQ ID NO: 184791 - RNA, 32 nt, Human
ggacuacaggcgcaugccaccaugcccagcua

SEQ ID NO: 184792 - RNA, 32 nt, Human
ggacuacaggcgcaugucaccaagcccggcua

SEQ ID NO: 184793 - RNA, 32 nt, Human
ggacuacaggcgccaccaccuugcccaacuaa

SEQ ID NO: 184794 - RNA, 32 nt, Human
ggacuacaggcgccagccaccaugccuggcua

SEQ ID NO: 184795 - RNA, 32 nt, Human
ggacuacaggcgcccaccaccacacaugcuaa

SEQ ID NO: 184796 - RNA, 32 nt, Human
ggacuacaggcgcccaccaccacaccaggcua

SEQ ID NO: 184797 - RNA, 32 nt, Human
ggacuacaggcgcccaccaccacaguuggcua

SEQ ID NO: 184798 - RNA, 32 nt, Human
ggacuacaggcgcccaccaccacgcccagcua

SEQ ID NO: 184799 - RNA, 32 nt, Human
ggacuacaggcgcccaccaccacgcccggcua

SEQ ID NO: 184800 - RNA, 32 nt, Human
ggacuacaggcgcccaccaccacgcccggcuu

SEQ ID NO: 184801 - RNA, 32 nt, Human
ggacuacaggcgcccaccaccaugcccggcua

SEQ ID NO: 184802 - RNA, 32 nt, Human
ggacuacaggcgcccaccacgacgccuggcuc

SEQ ID NO: 184803 - RNA, 32 nt, Human
ggacuacaggcgcccacgaccacgcccggcug

SEQ ID NO: 184804 - RNA, 32 nt, Human
ggacuacaggcgcccgcaaccacgcccggcua

SEQ ID NO: 184805 - RNA, 32 nt, Human
ggacuacaggcgcccgccaccacacccggcua

SEQ ID NO: 184806 - RNA, 32 nt, Human
ggacuacaggcgcccgccaccacaccuggcua

SEQ ID NO: 184807 - RNA, 32 nt, Human
ggacuacaggcgcccgccaccacaucuggcua

SEQ ID NO: 184808 - RNA, 32 nt, Human
ggacuacaggcgcccgccaccacgcccagcua

SEQ ID NO: 184809 - RNA, 32 nt, Human
ggacuacaggcgcccgccaccacgcccggcca

SEQ ID NO: 184810 - RNA, 32 nt, Human
ggacuacaggcgcccgccaccacgcccggcua

SEQ ID NO: 184811 - RNA, 32 nt, Human
ggacuacaggcgcccgccaccacgcccggcuc

SEQ ID NO: 184812 - RNA, 32 nt, Human
ggacuacaggcgcccgccaccacggccggcua

SEQ ID NO: 184813 - RNA, 32 nt, Human
ggacuacaggcgcccgccaccaugcccagcua

SEQ ID NO: 184814 - RNA, 32 nt, Human
ggacuacaggcgcccgccaccaugccccggcu

SEQ ID NO: 184815 - RNA, 32 nt, Human
ggacuacaggcgcccgccaccaugccuggcua

SEQ ID NO: 184816 - RNA, 32 nt, Human
ggacuacaggcgcccgccaccgcucccggcua

SEQ ID NO: 184817 - RNA, 32 nt, Human
ggacuacaggcgcccgccaccucgcccggcua

SEQ ID NO: 184818 - RNA, 32 nt, Human
ggacuacaggcgcccgccacugcgcccggcua

SEQ ID NO: 184819 - RNA, 32 nt, Human
ggacuacaggcgcccgccaucacgcccggcua

SEQ ID NO: 184820 - RNA, 32 nt, Human
ggacuacaggcgcccgccgccacgcccgucaa

SEQ ID NO: 184821 - RNA, 32 nt, Human
ggacuacaggcgcccgcuaccguacccggcua

SEQ ID NO: 184822 - RNA, 32 nt, Human
ggacuacaggcgccuaccaccaugcccagcua

SEQ ID NO: 184823 - RNA, 32 nt, Human
ggacuacaggcgccuaucaccaugccuggcua

SEQ ID NO: 184824 - RNA, 32 nt, Human
ggacuacaggcgccugccaccacauccgguua

SEQ ID NO: 184825 - RNA, 32 nt, Human
ggacuacaggcgccugccaccacuccuggcua

SEQ ID NO: 184826 - RNA, 32 nt, Human
ggacuacaggcgccugccaccaugcccgccua

SEQ ID NO: 184827 - RNA, 32 nt, Human
ggacuacaggcgcgcaccaccacgcccagcua

SEQ ID NO: 184828 - RNA, 32 nt, Human
ggacuacaggcgcgugccaccacaaccagcua

SEQ ID NO: 184829 - RNA, 32 nt, Human
ggacuacaggcgcgugccaccacgccaggcua

SEQ ID NO: 184830 - RNA, 32 nt, Human
ggacuacaggcgcgugccaccacgcccggcua

SEQ ID NO: 184831 - RNA, 32 nt, Human
ggacuacaggcgcgugccaccaugccuggcuu

SEQ ID NO: 184832 - RNA, 32 nt, Human
ggacuacaggcgcgugccaugacacccagcua

SEQ ID NO: 184833 - RNA, 32 nt, Human
ggacuacaggcggccgccaccaugcccgggua

SEQ ID NO: 184834 - RNA, 32 nt, Human
ggacuacaggcguccaccaccacgcccggcua

SEQ ID NO: 184835 - RNA, 32 nt, Human
ggacuacaggcgugagccaccaugcccggcua

SEQ ID NO: 184836 - RNA, 32 nt, Human
ggacuacaggcgugcaccaccacacccagcua

SEQ ID NO: 184837 - RNA, 32 nt, Human
ggacuacaggcgugcaccaccacaccuggcua

SEQ ID NO: 184838 - RNA, 32 nt, Human
ggacuacaggcgugcaccaccacgccugguua

SEQ ID NO: 184839 - RNA, 32 nt, Human
ggacuacaggcgugcgccaccaugcccggcua

SEQ ID NO: 184840 - RNA, 32 nt, Human
ggacuacaggcgugcgccaccaugccuggcua

SEQ ID NO: 184841 - RNA, 32 nt, Human
ggacuacaggcgugugccaccaugcccagcua

SEQ ID NO: 184842 - RNA, 32 nt, Human
ggacuacaggcucaugccaucaugcccagcua

SEQ ID NO: 184843 - RNA, 32 nt, Human
ggacuacaggcuugcaccaccacacccggcua

SEQ ID NO: 184844 - RNA, 32 nt, Human
ggacuacaggggugcaccaccaugcccagcua

SEQ ID NO: 184845 - RNA, 32 nt, Human
ggacuacagguacccaccaccacgcccagcua

SEQ ID NO: 184846 - RNA, 32 nt, Human
ggacuacaggucuacaccaccacucccggcua

SEQ ID NO: 184847 - RNA, 32 nt, Human
ggacuacaggugcacaccaccacaccuggcua

SEQ ID NO: 184848 - RNA, 32 nt, Human
ggacuacaggugcaugccaccaugccaggcua

SEQ ID NO: 184849 - RNA, 32 nt, Human
ggacuacaggugcccaccaccacacccggcua

SEQ ID NO: 184850 - RNA, 32 nt, Human
ggacuacaggugcccaccaccacgcuuggcuu

SEQ ID NO: 184851 - RNA, 32 nt, Human
ggacuacaggugcccaccaccaugcccagcua

SEQ ID NO: 184852 - RNA, 32 nt, Human
ggacuacaggugcccgccaccaugcccggcug

SEQ ID NO: 184853 - RNA, 32 nt, Human
ggacuacaggugcgcaccaccaugcccggcuu

SEQ ID NO: 184854 - RNA, 32 nt, Human
ggacuacaggugcgugccaccaugcccgggua

SEQ ID NO: 184855 - RNA, 32 nt, Human
ggacuacaggugcgugccaccaugccuggcua

SEQ ID NO: 184856 - RNA, 32 nt, Human
ggacuacaggugcucaccaccacacccggcua

SEQ ID NO: 184857 - RNA, 32 nt, Human
ggacuacagguguccaccaccaugccuggcua

SEQ ID NO: 184858 - RNA, 31 nt, Human
ggacuacaggugugagucaccaaagcccagu

SEQ ID NO: 184859 - RNA, 32 nt, Human
ggacuacaggugugcaccaccacaccaggcua

SEQ ID NO: 184860 - RNA, 32 nt, Human
ggacuacaggugugcaccaccacaccuggcua

SEQ ID NO: 184861 - RNA, 32 nt, Human
ggacuacaggugugcaccaccacagcuggcua

SEQ ID NO: 184862 - RNA, 32 nt, Human
ggacuacaggugugcaccaccaugcccagcua

SEQ ID NO: 184863 - RNA, 32 nt, Human
ggacuacaggugugcaccaccaugcccaggua

SEQ ID NO: 184864 - RNA, 32 nt, Human
ggacuacaggugugcgccaccaugcccgacua

SEQ ID NO: 184865 - RNA, 32 nt, Human
ggacuacaggugugugccaccaugcccagacg

SEQ ID NO: 184866 - RNA, 32 nt, Human
ggacuacaugaucaccaucacccggcugcugc

SEQ ID NO: 184867 - RNA, 32 nt, Human
ggacuacaugcgcacaccaccacguccggcua

SEQ ID NO: 184868 - RNA, 32 nt, Human
ggacuacauggugaaacuccaucucuacuaaa

SEQ ID NO: 184869 - RNA, 32 nt, Human
ggacuaccggcgugcaccaccaugccaggcua

SEQ ID NO: 184870 - RNA, 32 nt, Human
ggacuacgggcacacaccaccaugccuggcua

SEQ ID NO: 184871 - RNA, 32 nt, Human
ggacuacuaugggcgugcgccgccgugcuggu

SEQ ID NO: 184872 - RNA, 32 nt, Human
ggacuacucuggagggcucuucugccuggcau

SEQ ID NO: 184873 - RNA, 32 nt, Human
ggacuacugugcuuccggaggcucccuguguc

SEQ ID NO: 184874 - RNA, 32 nt, Human
ggacuagaagcaugcaccaccaugcccaucua

SEQ ID NO: 184875 - RNA, 32 nt, Human
ggacuagaggcauguaucaccaugcccagcua

SEQ ID NO: 184876 - RNA, 32 nt, Human
ggacuagauaccuugguacuguugaccuucuc

SEQ ID NO: 184877 - RNA, 32 nt, Human
ggacuagcacagacacacggaugagugggguc

SEQ ID NO: 184878 - RNA, 32 nt, Human
ggacuagcugcaggguuugagcuaggcugaag

SEQ ID NO: 184879 - RNA, 32 nt, Human
ggacuagcuggguugguaggaaaagagcagga

SEQ ID NO: 184880 - RNA, 32 nt, Human
ggacuaggacuugcccaagaccacagccaggu

SEQ ID NO: 184881 - RNA, 32 nt, Human
ggacuaggcccuggggcuacagcugcugcugc

SEQ ID NO: 184882 - RNA, 32 nt, Human
ggacuagggcaggcagcugggggcacuugguu

SEQ ID NO: 184883 - RNA, 32 nt, Human
ggacuagggcccaggaggcuaaggcugggaga

SEQ ID NO: 184884 - RNA, 32 nt, Human
ggacuaggggcaggacucuugccugaaccccc

SEQ ID NO: 184885 - RNA, 32 nt, Human
ggacuaggggcaguguuaauuuugaaaaggug

SEQ ID NO: 184886 - RNA, 32 nt, Human
ggacuaggggcugaggcccgcccagguaaggg

SEQ ID NO: 184887 - RNA, 21 nt, Human
ggacuagggugagagggagug

SEQ ID NO: 184888 - RNA, 32 nt, Human
ggacuagguaagcaucuuacaaccauuugugg

SEQ ID NO: 184889 - RNA, 32 nt, Human
ggacuaguacauuccuguuauuuucuggguuu

SEQ ID NO: 184890 - RNA, 16 nt, Human
ggacuaguguggggug

SEQ ID NO: 184891 - RNA, 32 nt, Human
ggacuauagaucauaggcaaugcaugaaccac

SEQ ID NO: 184892 - RNA, 32 nt, Human
ggacuauagcaaccucccccagagagaggcua

SEQ ID NO: 184893 - RNA, 32 nt, Human
ggacuauaggcacgcaccaccaugccuggcua

SEQ ID NO: 184894 - RNA, 32 nt, Human
ggacuauaggcaugcaccaccacgcccagcuu

SEQ ID NO: 184895 - RNA, 32 nt, Human
ggacuauaggcauguaccaccaugcccagcua

SEQ ID NO: 184896 - RNA, 32 nt, Human
ggacuauaggcgugugccaccaugcccagcua

SEQ ID NO: 184897 - RNA, 32 nt, Human
ggacuauaggugcaugccaccaugcccagcua

SEQ ID NO: 184898 - RNA, 32 nt, Human
ggacuauaggugcgugccaccaugcccagcua

SEQ ID NO: 184899 - RNA, 32 nt, Human
ggacuauaggugugcgccaccaugcccagcua

SEQ ID NO: 184900 - RNA, 32 nt, Human
ggacuauagguucgcaccaccacucccagcua

SEQ ID NO: 184901 - RNA, 32 nt, Human
ggacuaugguaccaagcagguaggacuguuca

SEQ ID NO: 184902 - RNA, 32 nt, Human
ggacuauuaaaacccuugcacuguaaggaaaa

SEQ ID NO: 184903 - RNA, 32 nt, Human
ggacuauuagcaauggcuuccagaaugugcuu

SEQ ID NO: 184904 - RNA, 32 nt, Human
ggacucaaaugccugcauuugagccuggcauu

SEQ ID NO: 184905 - RNA, 32 nt, Human
ggacucaaccugagcacccacacccaccuccu

SEQ ID NO: 184906 - RNA, 23 nt, Human
ggacucaagcaauccuccugccu

SEQ ID NO: 184907 - RNA, 32 nt, Human
ggacucaagccagccacccccuucuuuccccc

SEQ ID NO: 184908 - RNA, 23 nt, Human
ggacucaagcgaucuuccugccu

SEQ ID NO: 184909 - RNA, 23 nt, Human
ggacucaagcgauuuuccugccu

SEQ ID NO: 184910 - RNA, 32 nt, Human
ggacucaaggaggaggagagagauuccgcgag

SEQ ID NO: 184911 - RNA, 32 nt, Human
ggacucaaggauggcuuccuggaggaaauaca

SEQ ID NO: 184912 - RNA, 32 nt, Human
ggacucaagggacagagcacuuccagucgacc

SEQ ID NO: 184913 - RNA, 32 nt, Human
ggacucaagggugggucuuuggagcugauuag

SEQ ID NO: 184914 - RNA, 19 nt, Human
ggacucacaacccuggaua

SEQ ID NO: 184915 - RNA, 32 nt, Human
ggacucacacagauauuuacacugccauauuc

SEQ ID NO: 184916 - RNA, 32 nt, Human
ggacucacaggugggagacaggaguuccaacc

SEQ ID NO: 184917 - RNA, 32 nt, Human
ggacucacagugccacugcaaucaagcuccca

SEQ ID NO: 184918 - RNA, 32 nt, Human
ggacucacccaguuggaauucugggugggcuc

SEQ ID NO: 184919 - RNA, 32 nt, Human
ggacucaccuugaaagggggagcugcugggcc

SEQ ID NO: 184920 - RNA, 32 nt, Human
ggacucacgggccuggggcccacccagcacag

SEQ ID NO: 184921 - RNA, 32 nt, Human
ggacucacguggcuucaacagcuuuggaaaug

SEQ ID NO: 184922 - RNA, 32 nt, Human
ggacucacuccaccagcuuccuauaacuugga

SEQ ID NO: 184923 - RNA, 32 nt, Human
ggacucagaacaaaccaaaaagcagcuccaag

SEQ ID NO: 184924 - RNA, 32 nt, Human
ggacucagaacccagguuugcaggugggcaua

SEQ ID NO: 184925 - RNA, 32 nt, Human
ggacucagaagcacuuggaggaaggccuauuc

SEQ ID NO: 184926 - RNA, 24 nt, Human
ggacucagaauuguagggauaaua

SEQ ID NO: 184927 - RNA, 32 nt, Human
ggacucagacaggcacugugugggcacgaggu

SEQ ID NO: 184928 - RNA, 32 nt, Human
ggacucagaccccugaggagugggugcugccc

SEQ ID NO: 184929 - RNA, 32 nt, Human
ggacucagagcaauuuacaagagcuguucaug

SEQ ID NO: 184930 - RNA, 32 nt, Human
ggacucagagccagacagggcagccucagacc

SEQ ID NO: 184931 - RNA, 32 nt, Human
ggacucagagccuuccuugagcuaaacucggc

SEQ ID NO: 184932 - RNA, 32 nt, Human
ggacucagaggaugaggucaauuuccugaugc

SEQ ID NO: 184933 - RNA, 32 nt, Human
ggacucagaggccgugcuccugaccgauccag

SEQ ID NO: 184934 - RNA, 32 nt, Human
ggacucagagggccugaccccucaccuccccu

SEQ ID NO: 184935 - RNA, 32 nt, Human
ggacucagauacaaugcaaaaaguucaaguuu

SEQ ID NO: 184936 - RNA, 32 nt, Human
ggacucagaucagggcuggcaguagaugguag

SEQ ID NO: 184937 - RNA, 32 nt, Human
ggacucagcaguggccuggacaacagccucag

SEQ ID NO: 184938 - RNA, 32 nt, Human
ggacucagccuccuguguuuuggagaaggggc

SEQ ID NO: 184939 - RNA, 32 nt, Human
ggacucagcgaccugucuuccagccuggaagg

SEQ ID NO: 184940 - RNA, 32 nt, Human
ggacucagcgguagcaaccucgccccuugcaa

SEQ ID NO: 184941 - RNA, 32 nt, Human
ggacucagcucuggcucucugugugaccuugg

SEQ ID NO: 184942 - RNA, 32 nt, Human
ggacucaggaggcggaguuugcagugagcuga

SEQ ID NO: 184943 - RNA, 32 nt, Human
ggacucaggaguggagauggcaguuggggaca

SEQ ID NO: 184944 - RNA, 32 nt, Human
ggacucaggcagcagaggcaucugggaagucu

SEQ ID NO: 184945 - RNA, 30 nt, Human
ggacucaggccuguuuaguaaugcagggaa

SEQ ID NO: 184946 - RNA, 19 nt, Human
ggacucaggcugcugccag

SEQ ID NO: 184947 - RNA, 32 nt, Human
ggacucaggcuggggucugcagugcagcauua

SEQ ID NO: 184948 - RNA, 32 nt, Human
ggacucaggcuucucauccccuccucccgcaa

SEQ ID NO: 184949 - RNA, 32 nt, Human
ggacucaggucuaggucccuucccagaagccc

SEQ ID NO: 184950 - RNA, 32 nt, Human
ggacucaggugccucccugauuccugugggaa

SEQ ID NO: 184951 - RNA, 32 nt, Human
ggacucagugcuggcagauggcaguggaagcu

SEQ ID NO: 184952 - RNA, 22 nt, Human
ggacucauaaucugaagacuca

SEQ ID NO: 184953 - RNA, 22 nt, Human
ggacucauagccugaaagcuca

SEQ ID NO: 184954 - RNA, 32 nt, Human
ggacucaugccuuuaauuccaguguuuuggga

SEQ ID NO: 184955 - RNA, 32 nt, Human
ggacuccaaccgcuuguuuuguacaugaacaa

SEQ ID NO: 184956 - RNA, 32 nt, Human
ggacuccacacagcguuugccaccagaaacca

SEQ ID NO: 184957 - RNA, 22 nt, Human
ggacuccacagcacccagagga

SEQ ID NO: 184958 - RNA, 19 nt, Human
ggacuccacccccagcggg

SEQ ID NO: 184959 - RNA, 32 nt, Human
ggacuccaccugccuccuccccaaucccacac

SEQ ID NO: 184960 - RNA, 32 nt, Human
ggacuccagagggagagaggaagcgcugcagg

SEQ ID NO: 184961 - RNA, 20 nt, Human
ggacuccagcaccucugguc

SEQ ID NO: 184962 - RNA, 32 nt, Human
ggacuccagccuggacaacagagcaagacucc

SEQ ID NO: 184963 - RNA, 32 nt, Human
ggacuccagccuggccgccggcgcccgcagcc

SEQ ID NO: 184964 - RNA, 32 nt, Human
ggacuccagccugggcaacagagcaagacccu

SEQ ID NO: 184965 - RNA, 32 nt, Human
ggacuccaggagagagguuuuugcagcaugua

SEQ ID NO: 184966 - RNA, 32 nt, Human
ggacuccaggaggagggaccagcugaaggcac

SEQ ID NO: 184967 - RNA, 32 nt, Human
ggacuccaggcacccaccaccacucccggcua

SEQ ID NO: 184968 - RNA, 32 nt, Human
ggacuccaggcaugcaccaccaugccuggcua

SEQ ID NO: 184969 - RNA, 32 nt, Human
ggacuccaggugagcacuauguucucagagga

SEQ ID NO: 184970 - RNA, 22 nt, Human
ggacuccaguccugaaggcugg

SEQ ID NO: 184971 - RNA, 32 nt, Human
ggacuccagucuaacuccuauaucauguuguc

SEQ ID NO: 184972 - RNA, 32 nt, Human
ggacuccagugcccuccucucccaagagacaa

SEQ ID NO: 184973 - RNA, 32 nt, Human
ggacuccaucuucauucucucccuucucuccg

SEQ ID NO: 184974 - RNA, 32 nt, Human
ggacucccaaagugcugggauuacagacguga

SEQ ID NO: 184975 - RNA, 32 nt, Human
ggacucccaaagugcugggauuacaggcguga

SEQ ID NO: 184976 - RNA, 32 nt, Human
ggacucccaaagugcugggauuacaggcuuga

SEQ ID NO: 184977 - RNA, 32 nt, Human
ggacucccaccagggucugggagaggacggag

SEQ ID NO: 184978 - RNA, 21 nt, Human
ggacucccauccucacccuga

SEQ ID NO: 184979 - RNA, 32 nt, Human
ggacuccccacugucagcagcagccccgggac

SEQ ID NO: 184980 - RNA, 32 nt, Human
ggacuccccaggagcacccaggcaugggcagc

SEQ ID NO: 184981 - RNA, 32 nt, Human
ggacuccccaggagcacccaggcuugggcagc

SEQ ID NO: 184982 - RNA, 24 nt, Human
ggacucccccugugucagugcucu

SEQ ID NO: 184983 - RNA, 32 nt, Human
ggacuccccuggcaccugacaucucccacgcu

SEQ ID NO: 184984 - RNA, 32 nt, Human
ggacucccgugagcuggaaggaacagauuuaa

SEQ ID NO: 184985 - RNA, 32 nt, Human
ggacucccuccaggugcccgagacaagguuga

SEQ ID NO: 184986 - RNA, 32 nt, Human
ggacucccuccccucugcuucuacuccuccug

SEQ ID NO: 184987 - RNA, 32 nt, Human
ggacucccuggcagacagagcagugaguacaa

SEQ ID NO: 184988 - RNA, 32 nt, Human
ggacucccuuuucuuuggcaagauggcggagu

SEQ ID NO: 184989 - RNA, 32 nt, Human
ggacuccgauggaaaucagacucuccauuggc

SEQ ID NO: 184990 - RNA, 32 nt, Human
ggacuccgugagccucaugucugggaccuugg

SEQ ID NO: 184991 - RNA, 32 nt, Human
ggacuccguucugcaggcuggacgccuucuca

SEQ ID NO: 184992 - RNA, 32 nt, Human
ggacuccuaaacuaagcacagaagaguuggcg

SEQ ID NO: 184993 - RNA, 32 nt, Human
ggacuccuauuuccucuucuacccuggccucu

SEQ ID NO: 184994 - RNA, 32 nt, Human
ggacuccucuuccucucucuucuccuacucug

SEQ ID NO: 184995 - RNA, 22 nt, Human
ggacuccucuuuuccacuguga

SEQ ID NO: 184996 - RNA, 32 nt, Human
ggacuccuggggauccaggaaguaauucagaa

SEQ ID NO: 184997 - RNA, 32 nt, Human
ggacuccuggguggcacagcagcaggaccuug

SEQ ID NO: 184998 - RNA, 32 nt, Human
ggacuccuucaaggaagcugcagcucggucag

SEQ ID NO: 184999 - RNA, 32 nt, Human
ggacuccuucucacgggcggagcugcugcgcg

SEQ ID NO: 185000 - RNA, 32 nt, Human
ggacuccuuuccuccacuucuccaguaacaua

SEQ ID NO: 185001 - RNA, 18 nt, Human
ggacucgagcgcuggcug

SEQ ID NO: 185002 - RNA, 32 nt, Human
ggacucgagcuucccaucuccucgccuccccc

SEQ ID NO: 185003 - RNA, 32 nt, Human
ggacucgcaagugcccucaucacagccacccc

SEQ ID NO: 185004 - RNA, 32 nt, Human
ggacucgcacuggggcaagggugacagacacg

SEQ ID NO: 185005 - RNA, 32 nt, Human
ggacucgcugcugccaggugagucaccgccug

SEQ ID NO: 185006 - RNA, 32 nt, Human
ggacucgcuugccaccacgcaggaagcagccc

SEQ ID NO: 185007 - RNA, 32 nt, Human
ggacucgggaagagagaaccuaacagaacaau

SEQ ID NO: 185008 - RNA, 32 nt, Human
ggacucgggaggugccagaggcggcggcugcu

SEQ ID NO: 185009 - RNA, 20 nt, Human
ggacucggggugccgggcca

SEQ ID NO: 185010 - RNA, 32 nt, Human
ggacucggugcuguggcaggacaugaaggaga

SEQ ID NO: 185011 - RNA, 32 nt, Human
ggacucuacaggccagccucugccucacagug

SEQ ID NO: 185012 - RNA, 32 nt, Human
ggacucuacaggucagccucugccucacagug

SEQ ID NO: 185013 - RNA, 32 nt, Human
ggacucuacccaggcagguggaugaaaaugcu

SEQ ID NO: 185014 - RNA, 32 nt, Human
ggacucuacuaaaaguacaaaaauuagcuggc

SEQ ID NO: 185015 - RNA, 25 nt, Human
ggacucuagugaucugcccaccuca

SEQ ID NO: 185016 - RNA, 32 nt, Human
ggacucucacuccugcacugccagccccuucu

SEQ ID NO: 185017 - RNA, 32 nt, Human
ggacucucagccuucuuuucccuucccugagg

SEQ ID NO: 185018 - RNA, 32 nt, Human
ggacucuccaaacccccaaagcagagagaggg

SEQ ID NO: 185019 - RNA, 32 nt, Human
ggacucucucacacaggaaacuucccuauacu

SEQ ID NO: 185020 - RNA, 32 nt, Human
ggacucucucccaccacauacagcacagcacu

SEQ ID NO: 185021 - RNA, 32 nt, Human
ggacucucucugcugccacuucaccuuccuga

SEQ ID NO: 185022 - RNA, 32 nt, Human
ggacucucugccugcuuccuggaccggggccu

SEQ ID NO: 185023 - RNA, 32 nt, Human
ggacucucuggaggaugggaugacagaugcag

SEQ ID NO: 185024 - RNA, 32 nt, Human
ggacucugaaaccacaggccgacagauagagg

SEQ ID NO: 185025 - RNA, 32 nt, Human
ggacucugaauuucuaacaaugcccagugacu

SEQ ID NO: 185026 - RNA, 18 nt, Human
ggacucugacaacuucau

SEQ ID NO: 185027 - RNA, 32 nt, Human
ggacucugaggcucuuucugggccaaguuccu

SEQ ID NO: 185028 - RNA, 32 nt, Human
ggacucugagggaggagcuggggacggcgacc

SEQ ID NO: 185029 - RNA, 32 nt, Human
ggacucugaucccagccauggccuuccucucc

SEQ ID NO: 185030 - RNA, 32 nt, Human
ggacucugauccggcucagcuuuccaaucagc

SEQ ID NO: 185031 - RNA, 32 nt, Human
ggacucugaucuucccccucuucaggugucag

SEQ ID NO: 185032 - RNA, 32 nt, Human
ggacucugccacccucccucaggaugccugag

SEQ ID NO: 185033 - RNA, 32 nt, Human
ggacucugcccaggccagcguguucugaaaau

SEQ ID NO: 185034 - RNA, 32 nt, Human
ggacucugcccuuccaaauaaaccuugcuaag

SEQ ID NO: 185035 - RNA, 32 nt, Human
ggacucugcucacuaccugggugacaggauca

SEQ ID NO: 185036 - RNA, 32 nt, Human
ggacucugcucacuaccuuggugacaggauca

SEQ ID NO: 185037 - RNA, 32 nt, Human
ggacucuggagaggagauugaaauauaauugc

SEQ ID NO: 185038 - RNA, 32 nt, Human
ggacucugggaccugcagcucugccuuugcug

SEQ ID NO: 185039 - RNA, 32 nt, Human
ggacucugggaggcgaggagagcuggcugggc

SEQ ID NO: 185040 - RNA, 32 nt, Human
ggacucugggauggacauuguucuccaacagg

SEQ ID NO: 185041 - RNA, 32 nt, Human
ggacucugggcagagucagggacagucacacc

SEQ ID NO: 185042 - RNA, 32 nt, Human
ggacucugggcuccugcugccugggccccgau

SEQ ID NO: 185043 - RNA, 21 nt, Human
ggacucuggggccacagggug

SEQ ID NO: 185044 - RNA, 32 nt, Human
ggacucuggggucaugucuugcucugagaguu

SEQ ID NO: 185045 - RNA, 32 nt, Human
ggacucuggugucucacccauccaccaggcgg

SEQ ID NO: 185046 - RNA, 32 nt, Human
ggacucuguuaccaaaucccaggcugggcacu

SEQ ID NO: 185047 - RNA, 32 nt, Human
ggacucuucagccugucaagcugccagcuuau

SEQ ID NO: 185048 - RNA, 32 nt, Human
ggacucuuccagagucaucuaccugaguccca

SEQ ID NO: 185049 - RNA, 32 nt, Human
ggacucuugcccacccucagccauggcuccga

SEQ ID NO: 185050 - RNA, 32 nt, Human
ggacucuugccugaacccccagccugggcuua

SEQ ID NO: 185051 - RNA, 32 nt, Human
ggacucuuggugcaacagacucaauuggaacu

SEQ ID NO: 185052 - RNA, 32 nt, Human
ggacucuuugccaggauggcuuuuccugcugu

SEQ ID NO: 185053 - RNA, 32 nt, Human
ggacugaacuacaccauuggcuuuccugggcu

SEQ ID NO: 185054 - RNA, 32 nt, Human
ggacugaacugaaccccuccccaugaacacaa

SEQ ID NO: 185055 - RNA, 32 nt, Human
ggacugaagauaauuuacagugccccaucuaa

SEQ ID NO: 185056 - RNA, 32 nt, Human
ggacugaagcugaagaggaauacuaaguccau

SEQ ID NO: 185057 - RNA, 21 nt, Human
ggacugaagggcaguccccuc

SEQ ID NO: 185058 - RNA, 32 nt, Human
ggacugaagugcagguugcucacagcauccua

SEQ ID NO: 185059 - RNA, 32 nt, Human
ggacugaaucgccacuacagccugggugcaaa

SEQ ID NO: 185060 - RNA, 32 nt, Human
ggacugaaucucaucaccccacaaacauacca

SEQ ID NO: 185061 - RNA, 32 nt, Human
ggacugaaucucaucaccccacaaacauacua

SEQ ID NO: 185062 - RNA, 24 nt, Human
ggacugaaugccuguguccccugg

SEQ ID NO: 185063 - RNA, 20 nt, Human
ggacugacaccacagaugac

SEQ ID NO: 185064 - RNA, 32 nt, Human
ggacugacaggcugacauagaaaauaaacuuu

SEQ ID NO: 185065 - RNA, 21 nt, Human
ggacugaccacagccuggcug

SEQ ID NO: 185066 - RNA, 32 nt, Human
ggacugacccuuuccccacaaggaccugccau

SEQ ID NO: 185067 - RNA, 31 nt, Human
ggacugacgccuucuucaccuguguccucug

SEQ ID NO: 185068 - RNA, 32 nt, Human
ggacugacucaccucucucuuucucaguccca

SEQ ID NO: 185069 - RNA, 32 nt, Human
ggacugacugcgccguggaggcugcugcagug

SEQ ID NO: 185070 - RNA, 32 nt, Human
ggacugacuggguauagaaggaagacagacuc

SEQ ID NO: 185071 - RNA, 32 nt, Human
ggacugagaacagcuguugagcaguuuaccug

SEQ ID NO: 185072 - RNA, 32 nt, Human
ggacugagagcagggagcagcaggcauggggc

SEQ ID NO: 185073 - RNA, 32 nt, Human
ggacugagaggauggaggcagguccaacucga

SEQ ID NO: 185074 - RNA, 19 nt, Human
ggacugagauugccucuga

SEQ ID NO: 185075 - RNA, 32 nt, Human
ggacugagccaaggaagagucugccugagaga

SEQ ID NO: 185076 - RNA, 32 nt, Human
ggacugagcccuuuauucccucucacaccacc

SEQ ID NO: 185077 - RNA, 23 nt, Human
ggacugagccgugcacccggagg

SEQ ID NO: 185078 - RNA, 32 nt, Human
ggacugagccuggggacgcccacccacaccca

SEQ ID NO: 185079 - RNA, 21 nt, Human
ggacugagcgucccccggaga

SEQ ID NO: 185080 - RNA, 32 nt, Human
ggacugagcuccaggggacugcagcccucuga

SEQ ID NO: 185081 - RNA, 32 nt, Human
ggacugaggauggaguuaaaucacucagcccc

SEQ ID NO: 185082 - RNA, 32 nt, Human
ggacugaggcaugcaagccucugccuuuccuu

SEQ ID NO: 185083 - RNA, 32 nt, Human
ggacugaggggaggggagcaugggaagugacg

SEQ ID NO: 185084 - RNA, 32 nt, Human
ggacugaggggguggagagaggggaccucuuc

SEQ ID NO: 185085 - RNA, 32 nt, Human
ggacugagggugcuugaguaggaugugagacu

SEQ ID NO: 185086 - RNA, 32 nt, Human
ggacugaguccauauggaagaagaacuuccuc

SEQ ID NO: 185087 - RNA, 23 nt, Human
ggacugagugggaacccugcagc

SEQ ID NO: 185088 - RNA, 32 nt, Human
ggacugaucaacucuugccagucucaaaccau

SEQ ID NO: 185089 - RNA, 19 nt, Human
ggacugaugcgaggucccc

SEQ ID NO: 185090 - RNA, 19 nt, Human
ggacugaugcuguggggug

SEQ ID NO: 185091 - RNA, 19 nt, Human
ggacugauggccucagaga

SEQ ID NO: 185092 - RNA, 21 nt, Human
ggacugauucagggcccccuc

SEQ ID NO: 185093 - RNA, 32 nt, Human
ggacugauucugucguguucaccagagaaagc

SEQ ID NO: 185094 - RNA, 32 nt, Human
ggacugcaacaucacggauggugacuacuacg

SEQ ID NO: 185095 - RNA, 32 nt, Human
ggacugcaagauggaggaaggcgggaaccuag

SEQ ID NO: 185096 - RNA, 32 nt, Human
ggacugcaagcagggcucugccccagaggccu

SEQ ID NO: 185097 - RNA, 32 nt, Human
ggacugcacacagcacccacaaccagccccau

SEQ ID NO: 185098 - RNA, 32 nt, Human
ggacugcacgagcuggugaggcugaggagcag

SEQ ID NO: 185099 - RNA, 32 nt, Human
ggacugcacguacucucucaucaugaaaacag

SEQ ID NO: 185100 - RNA, 32 nt, Human
ggacugcacguuucuuucucucuugauucuug

SEQ ID NO: 185101 - RNA, 32 nt, Human
ggacugcacuguagggccuggagaccuguucc

SEQ ID NO: 185102 - RNA, 32 nt, Human
ggacugcagauuuuucuacucugugaucgauu

SEQ ID NO: 185103 - RNA, 32 nt, Human
ggacugcagccugcugugcugagcccugcugc

SEQ ID NO: 185104 - RNA, 32 nt, Human
ggacugcagcgcagugggugggccaguggcag

SEQ ID NO: 185105 - RNA, 32 nt, Human
ggacugcagcuagcauccaugcucugaugggc

SEQ ID NO: 185106 - RNA, 32 nt, Human
ggacugcagcuaugugccaucaugccuggcug

SEQ ID NO: 185107 - RNA, 32 nt, Human
ggacugcaggcaugcgccaccaugccaggcug

SEQ ID NO: 185108 - RNA, 32 nt, Human
ggacugcaggccuuagaggccaugccauuugg

SEQ ID NO: 185109 - RNA, 32 nt, Human
ggacugcagguaaaaugcaauuaggacaacua

SEQ ID NO: 185110 - RNA, 32 nt, Human
ggacugcaggugcacaccaccacgcccagcua

SEQ ID NO: 185111 - RNA, 32 nt, Human
ggacugcaggugugcaccaccaugcccagcua

SEQ ID NO: 185112 - RNA, 32 nt, Human
ggacugcaucacagcaagggacgccauucacu

SEQ ID NO: 185113 - RNA, 32 nt, Human
ggacugcaucaucugcugaagcuccagucccu

SEQ ID NO: 185114 - RNA, 32 nt, Human
ggacugcauuuuaagcccugcaggcuucugcc

SEQ ID NO: 185115 - RNA, 32 nt, Human
ggacugccaaauuuucucaugaucucaccuau

SEQ ID NO: 185116 - RNA, 32 nt, Human
ggacugccagccccuguccucccuucaccccc

SEQ ID NO: 185117 - RNA, 20 nt, Human
ggacugccaggacucaggca

SEQ ID NO: 185118 - RNA, 32 nt, Human
ggacugccaggaggaggagaggaggaggggag

SEQ ID NO: 185119 - RNA, 32 nt, Human
ggacugcccaccccaccucugcucauuccaca

SEQ ID NO: 185120 - RNA, 32 nt, Human
ggacugccggcuguuucguacaacauucuugc

SEQ ID NO: 185121 - RNA, 21 nt, Human
ggacugccugacucccagagg

SEQ ID NO: 185122 - RNA, 32 nt, Human
ggacugccugacuccccuccccagacuggcuu

SEQ ID NO: 185123 - RNA, 32 nt, Human
ggacugccuuucccucuccucagcccguccuc

SEQ ID NO: 185124 - RNA, 32 nt, Human
ggacugcgaccuccuucccuccugggagagcc

SEQ ID NO: 185125 - RNA, 17 nt, Human
ggacugcgcggcuggcu

SEQ ID NO: 185126 - RNA, 32 nt, Human
ggacugcgggagagaguaugggggcacccucc

SEQ ID NO: 185127 - RNA, 32 nt, Human
ggacugcgggauaggaagcuggggauauggac

SEQ ID NO: 185128 - RNA, 32 nt, Human
ggacugcggggcucuugaggccagcugcagag

SEQ ID NO: 185129 - RNA, 32 nt, Human
ggacugcgggugcggcccugcccgccaccaga

SEQ ID NO: 185130 - RNA, 32 nt, Human
ggacugcggguguucgccaccaugcccagcua

SEQ ID NO: 185131 - RNA, 32 nt, Human
ggacugcgguggacaccagaggaagcuguuuc

SEQ ID NO: 185132 - RNA, 18 nt, Human
ggacugcuaccuuucaaa

SEQ ID NO: 185133 - RNA, 32 nt, Human
ggacugcuccauugcugacugccugcaguucc

SEQ ID NO: 185134 - RNA, 32 nt, Human
ggacugcucugaccuuuuacggcgacaaacaa

SEQ ID NO: 185135 - RNA, 32 nt, Human
ggacugcucuggacugacauugcucagguucg

SEQ ID NO: 185136 - RNA, 18 nt, Human
ggacugcugcccuugucc

SEQ ID NO: 185137 - RNA, 32 nt, Human
ggacugcugguccccucuccuucccuccuucc

SEQ ID NO: 185138 - RNA, 32 nt, Human
ggacugcuucuaggugcagugacagggcagcg

SEQ ID NO: 185139 - RNA, 32 nt, Human
ggacugcuucugcccucugccugccagugccc

SEQ ID NO: 185140 - RNA, 32 nt, Human
ggacugcuugagcucaggagguugaggcugca

SEQ ID NO: 185141 - RNA, 32 nt, Human
ggacugcuugagcucaggaguucgagaccagc

SEQ ID NO: 185142 - RNA, 32 nt, Human
ggacugcuugcuggucgcuuacaucacuuuac

SEQ ID NO: 185143 - RNA, 32 nt, Human
ggacugcuuuggagaccuagccccagaaagcc

SEQ ID NO: 185144 - RNA, 32 nt, Human
ggacugcuuuuccuccuucauccucgugagcc

SEQ ID NO: 185145 - RNA, 32 nt, Human
ggacuggaaauggcagaccauaugauggcaau

SEQ ID NO: 185146 - RNA, 22 nt, Human
ggacuggaagagaggacgcggu

SEQ ID NO: 185147 - RNA, 32 nt, Human
ggacuggaagcucuaguggauguggcccgucu

SEQ ID NO: 185148 - RNA, 32 nt, Human
ggacuggaaggguggagaguaggcggaaccag

SEQ ID NO: 185149 - RNA, 19 nt, Human
ggacuggaagguggcggug

SEQ ID NO: 185150 - RNA, 32 nt, Human
ggacuggacaccuucacuccagcuggacaaag

SEQ ID NO: 185151 - RNA, 32 nt, Human
ggacuggacgguucccgcuggacuauacuaga

SEQ ID NO: 185152 - RNA, 32 nt, Human
ggacuggacucacuuuucugcuccagggacuc

SEQ ID NO: 185153 - RNA, 32 nt, Human
ggacuggacuguucccucuggacuauacuaga

SEQ ID NO: 185154 - RNA, 21 nt, Human
ggacuggagaagacgcgggug

SEQ ID NO: 185155 - RNA, 32 nt, Human
ggacuggagagugaggaggaggaggagccuug

SEQ ID NO: 185156 - RNA, 32 nt, Human
ggacuggagaucuccuggauggaguuggauua

SEQ ID NO: 185157 - RNA, 31 nt, Human
ggacuggagcagacgacgaggagggaagagu

SEQ ID NO: 185158 - RNA, 32 nt, Human
ggacuggaggcgugugccaccaugcccagcua

SEQ ID NO: 185159 - RNA, 32 nt, Human
ggacuggaggggccagguggcuaaccacucuc

SEQ ID NO: 185160 - RNA, 32 nt, Human
ggacuggaguccaggcagccuggcuccugaau

SEQ ID NO: 185161 - RNA, 32 nt, Human
ggacuggauggcucccgcuggacuauacugga

SEQ ID NO: 185162 - RNA, 32 nt, Human
ggacuggaugugccaauggcccuucagggccu

SEQ ID NO: 185163 - RNA, 32 nt, Human
ggacuggauuucuucuggagggaagcaccaug

SEQ ID NO: 185164 - RNA, 32 nt, Human
ggacuggcaagauguccaggagcccacugccu

SEQ ID NO: 185165 - RNA, 32 nt, Human
ggacuggcaagcacggcuggcccagugcagca

SEQ ID NO: 185166 - RNA, 32 nt, Human
ggacuggcacacacagacacacgagaccgagg

SEQ ID NO: 185167 - RNA, 32 nt, Human
ggacuggcaccgagaguucugaagggaucuua

SEQ ID NO: 185168 - RNA, 32 nt, Human
ggacuggcagagccaggggucagccaccugcc

SEQ ID NO: 185169 - RNA, 32 nt, Human
ggacuggcaggggauaugagggccaguguaga

SEQ ID NO: 185170 - RNA, 32 nt, Human
ggacuggcccaggcacacaggucccggggcau

SEQ ID NO: 185171 - RNA, 32 nt, Human
ggacuggcccccagugucaggcaggaggugac

SEQ ID NO: 185172 - RNA, 32 nt, Human
ggacuggccgggaggugaugggcggggaaggu

SEQ ID NO: 185173 - RNA, 32 nt, Human
ggacuggccuccaggaugaggauggggguggc

SEQ ID NO: 185174 - RNA, 32 nt, Human
ggacuggcggcaggauguucagcuggaugggg

SEQ ID NO: 185175 - RNA, 32 nt, Human
ggacuggcuggcacagggaggauggaaaccuu

SEQ ID NO: 185176 - RNA, 32 nt, Human
ggacuggcugugccccugaugcagccuguggc

SEQ ID NO: 185177 - RNA, 16 nt, Human
ggacugggacuggggu

SEQ ID NO: 185178 - RNA, 32 nt, Human
ggacugggagaggcacacccacccucaaucug

SEQ ID NO: 185179 - RNA, 32 nt, Human
ggacugggaggcagagccgccgccaagggggc

SEQ ID NO: 185180 - RNA, 32 nt, Human
ggacugggaggggagagaagagaaggagggaa

SEQ ID NO: 185181 - RNA, 21 nt, Human
ggacugggagguggaggcaga

SEQ ID NO: 185182 - RNA, 32 nt, Human
ggacugggaguggggagccagagggagcagcu

SEQ ID NO: 185183 - RNA, 32 nt, Human
ggacugggaugagagaaagugggaccuggugg

SEQ ID NO: 185184 - RNA, 32 nt, Human
ggacugggcaaagauugcuuguguaauaucca

SEQ ID NO: 185185 - RNA, 23 nt, Human
ggacugggccccggggcggggug

SEQ ID NO: 185186 - RNA, 32 nt, Human
ggacugggcuccucucgaaccccucuuuggcu

SEQ ID NO: 185187 - RNA, 32 nt, Human
ggacugggcucuuuggagcucauccuuggacc

SEQ ID NO: 185188 - RNA, 32 nt, Human
ggacugggcuggggcgaggagugaagagcggu

SEQ ID NO: 185189 - RNA, 32 nt, Human
ggacuggggaagggaggggagacuauguguga

SEQ ID NO: 185190 - RNA, 32 nt, Human
ggacuggggaaugcgauagggaggggugggga

SEQ ID NO: 185191 - RNA, 32 nt, Human
ggacuggggagggauaugauggagagccagcc

SEQ ID NO: 185192 - RNA, 32 nt, Human
ggacuggggccaugaggccuucccuggucccc

SEQ ID NO: 185193 - RNA, 32 nt, Human
ggacugggggcccucagcuagcuuaaaagagg

SEQ ID NO: 185194 - RNA, 32 nt, Human
ggacugggguggguugguggcaccaauggcag

SEQ ID NO: 185195 - RNA, 18 nt, Human
ggacugggguuggaggug

SEQ ID NO: 185196 - RNA, 32 nt, Human
ggacugggugcgucccaucuccccagcuugcu

SEQ ID NO: 185197 - RNA, 32 nt, Human
ggacugggugggggcaggauggaguuagaccc

SEQ ID NO: 185198 - RNA, 32 nt, Human
ggacuggguuggcagugacacgggggaccagu

SEQ ID NO: 185199 - RNA, 31 nt, Human
ggacuggucuuccuggagccugugucagcug

SEQ ID NO: 185200 - RNA, 22 nt, Human
ggacuggugaugguggagggug

SEQ ID NO: 185201 - RNA, 32 nt, Human
ggacugguggcaucauguaacugcuaaccuua

SEQ ID NO: 185202 - RNA, 32 nt, Human
ggacugguggcccagagagggcugugccuuac

SEQ ID NO: 185203 - RNA, 32 nt, Human
ggacuggugggcuccccucugggccagcacag

SEQ ID NO: 185204 - RNA, 19 nt, Human
ggacuggugggggccgggg

SEQ ID NO: 185205 - RNA, 16 nt, Human
ggacuggugguggagu

SEQ ID NO: 185206 - RNA, 32 nt, Human
ggacugguuccagugagagaaaccaaccacag

SEQ ID NO: 185207 - RNA, 21 nt, Human
ggacugguugguggaggugca

SEQ ID NO: 185208 - RNA, 32 nt, Human
ggacuguaccaggcagcugggccccgcaggac

SEQ ID NO: 185209 - RNA, 32 nt, Human
ggacuguagggagggcggcaggggccuggaga

SEQ ID NO: 185210 - RNA, 32 nt, Human
ggacugucaagugcuuuaucuuaucuaagccu

SEQ ID NO: 185211 - RNA, 20 nt, Human
ggacugucaguucucuggga

SEQ ID NO: 185212 - RNA, 32 nt, Human
ggacuguccagcucugcccccugcugcugcca

SEQ ID NO: 185213 - RNA, 20 nt, Human
ggacugucccuccuugagac

SEQ ID NO: 185214 - RNA, 17 nt, Human
ggacuguccuaggugac

SEQ ID NO: 185215 - RNA, 32 nt, Human
ggacugucggagguguggacucugccugccua

SEQ ID NO: 185216 - RNA, 32 nt, Human
ggacugucuaccucccuuccuccucugcucac

SEQ ID NO: 185217 - RNA, 32 nt, Human
ggacugucugcucaggcugguggugacaggau

SEQ ID NO: 185218 - RNA, 32 nt, Human
ggacugucuucucucccuucacaaaaaucuga

SEQ ID NO: 185219 - RNA, 32 nt, Human
ggacugugacacugcacuccagccugggcaac

SEQ ID NO: 185220 - RNA, 32 nt, Human
ggacugugacucuguguuaccuuccaacuucc

SEQ ID NO: 185221 - RNA, 32 nt, Human
ggacugugaucucccugggauuuaaaguggga

SEQ ID NO: 185222 - RNA, 21 nt, Human
ggacugugauucuaagugggg

SEQ ID NO: 185223 - RNA, 32 nt, Human
ggacugugccauuuuugcuauuuaaaggaauc

SEQ ID NO: 185224 - RNA, 32 nt, Human
ggacugugcucacuaccugggugacaggauca

SEQ ID NO: 185225 - RNA, 32 nt, Human
ggacuguggagaauaggcaaucccagggggua

SEQ ID NO: 185226 - RNA, 32 nt, Human
ggacuguggccgggcaaguggaucacaggccu

SEQ ID NO: 185227 - RNA, 32 nt, Human
ggacugugggagcagaggcauugccaggacuu

SEQ ID NO: 185228 - RNA, 32 nt, Human
ggacugugggccagugccagagccaggcuugu

SEQ ID NO: 185229 - RNA, 32 nt, Human
ggacugugguugggggaggugggagcuguuuu

SEQ ID NO: 185230 - RNA, 32 nt, Human
ggacuguguccucagcuccuuccagaugacca

SEQ ID NO: 185231 - RNA, 32 nt, Human
ggacugugugaaccaacaaggggccaguuuuc

SEQ ID NO: 185232 - RNA, 32 nt, Human
ggacugugugcucaggagcacugugguagagc

SEQ ID NO: 185233 - RNA, 32 nt, Human
ggacugugugugucuggcuguagcagacgcga

SEQ ID NO: 185234 - RNA, 22 nt, Human
ggacuguguucaggacacaggg

SEQ ID NO: 185235 - RNA, 32 nt, Human
ggacuguguugacugacgagccgagggguggc

SEQ ID NO: 185236 - RNA, 32 nt, Human
ggacuguuccagcacgggccagauggccagcu

SEQ ID NO: 185237 - RNA, 32 nt, Human
ggacuguugcugguaugaagcagcccuucgug

SEQ ID NO: 185238 - RNA, 19 nt, Human
ggacuguugugaggggcug

SEQ ID NO: 185239 - RNA, 24 nt, Human
ggacuguuuucucucggaggccgg

SEQ ID NO: 185240 - RNA, 32 nt, Human
ggacuuaaaaagauaaggaggccagguguggu

SEQ ID NO: 185241 - RNA, 32 nt, Human
ggacuuaaucuagaccugaaacuacaaaaauu

SEQ ID NO: 185242 - RNA, 32 nt, Human
ggacuuaccauccacaaugcaccacggaagag

SEQ ID NO: 185243 - RNA, 31 nt, Human
ggacuuagccucccugggccucaguuucuuu

SEQ ID NO: 185244 - RNA, 32 nt, Human
ggacuuagccucccugggccucaguuucuuua

SEQ ID NO: 185245 - RNA, 32 nt, Human
ggacuuagggacaggguauagcuuagauggug

SEQ ID NO: 185246 - RNA, 32 nt, Human
ggacuuagggccagcccuugagguccuuaucc

SEQ ID NO: 185247 - RNA, 32 nt, Human
ggacuuagucuugccauuucugcuucuuugaa

SEQ ID NO: 185248 - RNA, 32 nt, Human
ggacuuaugggugggaggggagcauuuuuagu

SEQ ID NO: 185249 - RNA, 32 nt, Human
ggacuucaacauaggaacuugagggggacaaa

SEQ ID NO: 185250 - RNA, 32 nt, Human
ggacuucaagcaggaggaggugggugggguga

SEQ ID NO: 185251 - RNA, 32 nt, Human
ggacuucacaggcugcuugggagaagacaauc

SEQ ID NO: 185252 - RNA, 32 nt, Human
ggacuucaccaauggauuacaugccaucuggg

SEQ ID NO: 185253 - RNA, 32 nt, Human
ggacuucacccaggaggaguggggucaacuag

SEQ ID NO: 185254 - RNA, 19 nt, Human
ggacuucagggucaccaag

SEQ ID NO: 185255 - RNA, 32 nt, Human
ggacuucagguaugcuaauuuggccauuaauu

SEQ ID NO: 185256 - RNA, 23 nt, Human
ggacuucaguaaucaguggcagg

SEQ ID NO: 185257 - RNA, 32 nt, Human
ggacuucagugcccugaggaaaaggcuuuggg

SEQ ID NO: 185258 - RNA, 23 nt, Human
ggacuucaguuaauaauaaugua

SEQ ID NO: 185259 - RNA, 32 nt, Human
ggacuucaguucagguuguauggcaguaggcc

SEQ ID NO: 185260 - RNA, 32 nt, Human
ggacuucauagcagaagaauuggaguuggaag

SEQ ID NO: 185261 - RNA, 32 nt, Human
ggacuuccaaagugcugggauuacagguguga

SEQ ID NO: 185262 - RNA, 32 nt, Human
ggacuuccagccaccagaacugugaagaagaa

SEQ ID NO: 185263 - RNA, 32 nt, Human
ggacuuccagccucaagaacugugagaaaaua

SEQ ID NO: 185264 - RNA, 32 nt, Human
ggacuuccagccuccagaacugugagaaauuu

SEQ ID NO: 185265 - RNA, 32 nt, Human
ggacuuccagcuuccagaacugugagagaaua

SEQ ID NO: 185266 - RNA, 32 nt, Human
ggacuucccgcccuccuucuccaccuucuagu

SEQ ID NO: 185267 - RNA, 32 nt, Human
ggacuuccgaaagcuaccagcacugcacugug

SEQ ID NO: 185268 - RNA, 32 nt, Human
ggacuuccucaagguuuuccugugugcagugg

SEQ ID NO: 185269 - RNA, 32 nt, Human
ggacuuccucacccucuucuauacucuucgcu

SEQ ID NO: 185270 - RNA, 32 nt, Human
ggacuuccugggaggcuguggaucaauuacca

SEQ ID NO: 185271 - RNA, 19 nt, Human
ggacuuccugugggacaag

SEQ ID NO: 185272 - RNA, 32 nt, Human
ggacuucguguccccucuauguucuccuugga

SEQ ID NO: 185273 - RNA, 19 nt, Human
ggacuucucagcgcuccgc

SEQ ID NO: 185274 - RNA, 32 nt, Human
ggacuucugagaugcuugugaaguauagaugu

SEQ ID NO: 185275 - RNA, 32 nt, Human
ggacuucugcaacagauucuguuucuuuuucc

SEQ ID NO: 185276 - RNA, 32 nt, Human
ggacuucugcaggauccgcaacagggcagagg

SEQ ID NO: 185277 - RNA, 31 nt, Human
ggacuucugcauuucugacauagaacacugg

SEQ ID NO: 185278 - RNA, 32 nt, Human
ggacuucugcugcugccaccugcgccagcccu

SEQ ID NO: 185279 - RNA, 32 nt, Human
ggacuucuggccugcagaacugugagacaaua

SEQ ID NO: 185280 - RNA, 18 nt, Human
ggacuucuggcuaugcaa

SEQ ID NO: 185281 - RNA, 32 nt, Human
ggacuucugguuuuggcuuuuucuuuuuaagc

SEQ ID NO: 185282 - RNA, 22 nt, Human
ggacuucuguuccaaaggcugg

SEQ ID NO: 185283 - RNA, 32 nt, Human
ggacuucuuauucaaagcaucaauaauuaaaa

SEQ ID NO: 185284 - RNA, 32 nt, Human
ggacuucuuccagcaauaaguugaaagaauaa

SEQ ID NO: 185285 - RNA, 32 nt, Human
ggacuucuugcagcuccuggaggcagacgcug

SEQ ID NO: 185286 - RNA, 32 nt, Human
ggacuucuugcuggucuagucacgcaugcagu

SEQ ID NO: 185287 - RNA, 32 nt, Human
ggacuucuugugguaagagcaagugcagguau

SEQ ID NO: 185288 - RNA, 32 nt, Human
ggacuugaaagagaacugaggggccacaaaau

SEQ ID NO: 185289 - RNA, 32 nt, Human
ggacuugaagaaagagaaggaagacaugaaga

SEQ ID NO: 185290 - RNA, 32 nt, Human
ggacuugaagaauggccauuccuguacuccac

SEQ ID NO: 185291 - RNA, 32 nt, Human
ggacuugacuuagcauuauccaagcaccaguc

SEQ ID NO: 185292 - RNA, 32 nt, Human
ggacuugagaucugggucuucugaaucuagag

SEQ ID NO: 185293 - RNA, 32 nt, Human
ggacuugagcgagccaguugccggauuauucu

SEQ ID NO: 185294 - RNA, 32 nt, Human
ggacuugaggcagagccugcagcagcugugug

SEQ ID NO: 185295 - RNA, 32 nt, Human
ggacuugaucucaaguggucacaaaguuuucu

SEQ ID NO: 185296 - RNA, 32 nt, Human
ggacuugauuauacacauuucuaaaacccaug

SEQ ID NO: 185297 - RNA, 32 nt, Human
ggacuugcaagggcugccagagguucugauau

SEQ ID NO: 185298 - RNA, 32 nt, Human
ggacuugcagagcccuacgugaagguccagcu

SEQ ID NO: 185299 - RNA, 32 nt, Human
ggacuugccaugagguguugaagccuuguuuc

SEQ ID NO: 185300 - RNA, 32 nt, Human
ggacuugccauugcccccuccacccaccccca

SEQ ID NO: 185301 - RNA, 32 nt, Human
ggacuugccccagggcagcuaccuaugggucu

SEQ ID NO: 185302 - RNA, 32 nt, Human
ggacuugcccucucccuuccuggcacucucau

SEQ ID NO: 185303 - RNA, 32 nt, Human
ggacuugccuguucaaccuuguggccaucauc

SEQ ID NO: 185304 - RNA, 32 nt, Human
ggacuugcggggcagaggagggcgugggcgug

SEQ ID NO: 185305 - RNA, 32 nt, Human
ggacuugcugguaaaggggcagaugcuuuuua

SEQ ID NO: 185306 - RNA, 32 nt, Human
ggacuugcuuccaagcccuucccucuguugga

SEQ ID NO: 185307 - RNA, 19 nt, Human
ggacuuggaacucaggaug

SEQ ID NO: 185308 - RNA, 32 nt, Human
ggacuuggagguagcuuugagguggaagaggg

SEQ ID NO: 185309 - RNA, 32 nt, Human
ggacuuggcuuccgcagggcaggggguggggc

SEQ ID NO: 185310 - RNA, 32 nt, Human
ggacuugggaggcgguuguugcagugagcugu

SEQ ID NO: 185311 - RNA, 18 nt, Human
ggacuuggggguggggug

SEQ ID NO: 185312 - RNA, 32 nt, Human
ggacuuggguggguacuugggugaggaucccu

SEQ ID NO: 185313 - RNA, 32 nt, Human
ggacuugguaaucauagcugaagaggguucau

SEQ ID NO: 185314 - RNA, 32 nt, Human
ggacuuggucuggagcagggacuacuuggaau

SEQ ID NO: 185315 - RNA, 32 nt, Human
ggacuugguggaggaucgugaggaggauuucg

SEQ ID NO: 185316 - RNA, 25 nt, Human
ggacuuggugguucguccugucuca

SEQ ID NO: 185317 - RNA, 32 nt, Human
ggacuugguguugguuucuuucuuucuuuucu

SEQ ID NO: 185318 - RNA, 23 nt, Human
ggacuuguaaaugaaacaaugca

SEQ ID NO: 185319 - RNA, 32 nt, Human
ggacuugucagacuagccacagaggcacuuug

SEQ ID NO: 185320 - RNA, 32 nt, Human
ggacuugucugggggcugcaguggagucagcu

SEQ ID NO: 185321 - RNA, 32 nt, Human
ggacuugugccagcagaacaugugggaggaag

SEQ ID NO: 185322 - RNA, 32 nt, Human
ggacuugugucacaucucucuggaguuuucua

SEQ ID NO: 185323 - RNA, 32 nt, Human
ggacuuguguuccaaugagugacuaggaaaaa

SEQ ID NO: 185324 - RNA, 32 nt, Human
ggacuuguuagacacuuccuuccuucccucau

SEQ ID NO: 185325 - RNA, 16 nt, Human
ggacuuguuccagccc

SEQ ID NO: 185326 - RNA, 32 nt, Human
ggacuuuaaaaagaauaaguauuugagaaaau

SEQ ID NO: 185327 - RNA, 32 nt, Human
ggacuuuaacauccuaugaauuugaaacaucc

SEQ ID NO: 185328 - RNA, 32 nt, Human
ggacuuuaguagccaugaagguccucauccuu

SEQ ID NO: 185329 - RNA, 22 nt, Human
ggacuuuaucgaucucuuuauu

SEQ ID NO: 185330 - RNA, 32 nt, Human
ggacuuuaugccuguuuaccacugagcucugg

SEQ ID NO: 185331 - RNA, 32 nt, Human
ggacuuucacaaucagagauggcagcgguaaa

SEQ ID NO: 185332 - RNA, 32 nt, Human
ggacuuuccuucccucuccugcuuccucuuuu

SEQ ID NO: 185333 - RNA, 32 nt, Human
ggacuuuccuuccucccucccuuuccuccccu

SEQ ID NO: 185334 - RNA, 22 nt, Human
ggacuuucugucuuuuuucauu

SEQ ID NO: 185335 - RNA, 32 nt, Human
ggacuuugaaagucauggggguuuuuauuuug

SEQ ID NO: 185336 - RNA, 32 nt, Human
ggacuuugcaagagauggagacagguuaggug

SEQ ID NO: 185337 - RNA, 32 nt, Human
ggacuuugcaaggacugauggauagcuaccuc

SEQ ID NO: 185338 - RNA, 32 nt, Human
ggacuuugccaccggcuugccuggugguuugc

SEQ ID NO: 185339 - RNA, 32 nt, Human
ggacuuuggagguggggcucugcagcugugag

SEQ ID NO: 185340 - RNA, 32 nt, Human
ggacuuuggggacucaggaagggaggcuugga

SEQ ID NO: 185341 - RNA, 32 nt, Human
ggacuuuguccccagagacccacugugugccc

SEQ ID NO: 185342 - RNA, 32 nt, Human
ggacuuugugcaacugccugugcccgucaucc

SEQ ID NO: 185343 - RNA, 32 nt, Human
ggacuuugugucgagccgagccuggacuuccc

SEQ ID NO: 185344 - RNA, 24 nt, Human
ggacuuuguucucacucacaggga

SEQ ID NO: 185345 - RNA, 32 nt, Human
ggacuuuuauuuucucucuguuuggugcucua

SEQ ID NO: 185346 - RNA, 32 nt, Human
ggacuuuuccagcauguggccucugguggggc

SEQ ID NO: 185347 - RNA, 32 nt, Human
ggacuuuuccuguuguuguacacacacaacag

SEQ ID NO: 185348 - RNA, 32 nt, Human
ggacuuuuguggcugugucugugucugcaaga

SEQ ID NO: 185349 - RNA, 22 nt, Human
ggacuuuuucauuuuucucauu

SEQ ID NO: 185350 - RNA, 21 nt, Human
ggacuuuuuucaucuuuuccu

SEQ ID NO: 185351 - RNA, 24 nt, Human
ggacuuuuuucauguuuucuucac

SEQ ID NO: 185352 - RNA, 32 nt, Human
ggagaaaaacccagacgccaggaaaagaagaa

SEQ ID NO: 185353 - RNA, 32 nt, Human
ggagaaaaagaggggagagagcagagggaggg

SEQ ID NO: 185354 - RNA, 32 nt, Human
ggagaaaaccaaacaaaugcuuuuuggaaagg

SEQ ID NO: 185355 - RNA, 32 nt, Human
ggagaaaacccuaggguuuccucugcccccuc

SEQ ID NO: 185356 - RNA, 32 nt, Human
ggagaaaacuggagauaauugggagaaaauug

SEQ ID NO: 185357 - RNA, 32 nt, Human
ggagaaaacuucuacaagugugaaugaacagu

SEQ ID NO: 185358 - RNA, 32 nt, Human
ggagaaaagcagccugauucggaggaacgggu

SEQ ID NO: 185359 - RNA, 32 nt, Human
ggagaaaagcagggcuagaauuggaacccaaa

SEQ ID NO: 185360 - RNA, 32 nt, Human
ggagaaaagccuuuugagugcaaagaaugugg

SEQ ID NO: 185361 - RNA, 22 nt, Human
ggagaaaagggugcggaggcag

SEQ ID NO: 185362 - RNA, 19 nt, Human
ggagaaaaguggagguaga

SEQ ID NO: 185363 - RNA, 32 nt, Human
ggagaaaauagagacccauccccaaauaccau

SEQ ID NO: 185364 - RNA, 32 nt, Human
ggagaaaaucacccuuucccuuuuucuuugua

SEQ ID NO: 185365 - RNA, 32 nt, Human
ggagaaacaaaauaaaaauuagcuuccaggca

SEQ ID NO: 185366 - RNA, 19 nt, Human
ggagaaacaaagcucaggg

SEQ ID NO: 185367 - RNA, 22 nt, Human
ggagaaacaaggaggaggcagg

SEQ ID NO: 185368 - RNA, 18 nt, Human
ggagaaacaaggaggcag

SEQ ID NO: 185369 - RNA, 22 nt, Human
ggagaaacaaugcauuuugggg

SEQ ID NO: 185370 - RNA, 32 nt, Human
ggagaaacacccuguuaguucccagggagaga

SEQ ID NO: 185371 - RNA, 17 nt, Human
ggagaaacagaccuggg

SEQ ID NO: 185372 - RNA, 16 nt, Human
ggagaaacagccuggg

SEQ ID NO: 185373 - RNA, 32 nt, Human
ggagaaacagccugggcuggggcuacaggucu

SEQ ID NO: 185374 - RNA, 19 nt, Human
ggagaaacagcugcugagg

SEQ ID NO: 185375 - RNA, 18 nt, Human
ggagaaacaggacuuggg

SEQ ID NO: 185376 - RNA, 19 nt, Human
ggagaaacaggcucugaga

SEQ ID NO: 185377 - RNA, 32 nt, Human
ggagaaacaguacauaucuuucugucuuuagu

SEQ ID NO: 185378 - RNA, 19 nt, Human
ggagaaacaguggagggga

SEQ ID NO: 185379 - RNA, 16 nt, Human
ggagaaacauccggga

SEQ ID NO: 185380 - RNA, 21 nt, Human
ggagaaacaucgagaggcaga

SEQ ID NO: 185381 - RNA, 32 nt, Human
ggagaaaccaacauguugaaaagacaaagaau

SEQ ID NO: 185382 - RNA, 32 nt, Human
ggagaaaccagagaugccaacuuccugcuucc

SEQ ID NO: 185383 - RNA, 17 nt, Human
ggagaaaccaggucgga

SEQ ID NO: 185384 - RNA, 32 nt, Human
ggagaaaccaugcacauaaauacggcacaguc

SEQ ID NO: 185385 - RNA, 21 nt, Human
ggagaaaccccaucucuacua

SEQ ID NO: 185386 - RNA, 21 nt, Human
ggagaaacccuaucucuacua

SEQ ID NO: 185387 - RNA, 32 nt, Human
ggagaaacccuugaguugacuugucuagucac

SEQ ID NO: 185388 - RNA, 32 nt, Human
ggagaaaccguuggguaacuuguucaagauau

SEQ ID NO: 185389 - RNA, 18 nt, Human
ggagaaaccucccuggga

SEQ ID NO: 185390 - RNA, 32 nt, Human
ggagaaacuagaaauaugcaacucccuugauu

SEQ ID NO: 185391 - RNA, 18 nt, Human
ggagaaacucuacuaggg

SEQ ID NO: 185392 - RNA, 16 nt, Human
ggagaaacucucuagg

SEQ ID NO: 185393 - RNA, 21 nt, Human
ggagaaacucuggcucugggg

SEQ ID NO: 185394 - RNA, 16 nt, Human
ggagaaacucugguga

SEQ ID NO: 185395 - RNA, 20 nt, Human
ggagaaacuguagucucagg

SEQ ID NO: 185396 - RNA, 18 nt, Human
ggagaaacugugaugggg

SEQ ID NO: 185397 - RNA, 20 nt, Human
ggagaaacuugauucuggga

SEQ ID NO: 185398 - RNA, 32 nt, Human
ggagaaagaaaaugggcacuuuaugucucaga

SEQ ID NO: 185399 - RNA, 32 nt, Human
ggagaaagaacuuccccauacaaauaaggcau

SEQ ID NO: 185400 - RNA, 32 nt, Human
ggagaaagaagagggugaggaggcgacagagg

SEQ ID NO: 185401 - RNA, 32 nt, Human
ggagaaagaagggagaggcagcagucuccucc

SEQ ID NO: 185402 - RNA, 32 nt, Human
ggagaaagacaugcucucaaacugcagacaaa

SEQ ID NO: 185403 - RNA, 25 nt, Human
ggagaaagagagagaaggagagaga

SEQ ID NO: 185404 - RNA, 26 nt, Human
ggagaaagagcugggggaagggcaga

SEQ ID NO: 185405 - RNA, 32 nt, Human
ggagaaagaggaagauggaauccuggaccacu

SEQ ID NO: 185406 - RNA, 19 nt, Human
ggagaaagaggagagacag

SEQ ID NO: 185407 - RNA, 32 nt, Human
ggagaaagagggaggaagagagggagggaggg

SEQ ID NO: 185408 - RNA, 19 nt, Human
ggagaaagagggagggaga

SEQ ID NO: 185409 - RNA, 23 nt, Human
ggagaaagagggagggagagaga

SEQ ID NO: 185410 - RNA, 32 nt, Human
ggagaaagaguccacuccaggacccuuuuccc

SEQ ID NO: 185411 - RNA, 18 nt, Human
ggagaaagaugaggcaga

SEQ ID NO: 185412 - RNA, 32 nt, Human
ggagaaagcaccagggcagcuggcaggaggcg

SEQ ID NO: 185413 - RNA, 32 nt, Human
ggagaaagcagcacuaaagcacucugagucaa

SEQ ID NO: 185414 - RNA, 21 nt, Human
ggagaaagcauaucccaccaa

SEQ ID NO: 185415 - RNA, 32 nt, Human
ggagaaagccuagguucugggcucagguccag

SEQ ID NO: 185416 - RNA, 32 nt, Human
ggagaaagccuuccucuucucucauaggauag

SEQ ID NO: 185417 - RNA, 20 nt, Human
ggagaaagcucuggaggccu

SEQ ID NO: 185418 - RNA, 32 nt, Human
ggagaaagcugauggagccaggacagagaucu

SEQ ID NO: 185419 - RNA, 21 nt, Human
ggagaaaggaaagaaggcaga

SEQ ID NO: 185420 - RNA, 21 nt, Human
ggagaaaggaaggagaggaga

SEQ ID NO: 185421 - RNA, 32 nt, Human
ggagaaaggaagggaagcauuacuggguuacu

SEQ ID NO: 185422 - RNA, 25 nt, Human
ggagaaaggaagggcugcaugcggg

SEQ ID NO: 185423 - RNA, 18 nt, Human
ggagaaaggagaauugaa

SEQ ID NO: 185424 - RNA, 32 nt, Human
ggagaaaggagagaggauaagaagggaaaguu

SEQ ID NO: 185425 - RNA, 21 nt, Human
ggagaaaggagaggaagcaga

SEQ ID NO: 185426 - RNA, 24 nt, Human
ggagaaaggaggggagaaagcggg

SEQ ID NO: 185427 - RNA, 32 nt, Human
ggagaaaggaggucgaggaggagguggucggu

SEQ ID NO: 185428 - RNA, 25 nt, Human
ggagaaaggaucaggaggagacaga

SEQ ID NO: 185429 - RNA, 18 nt, Human
ggagaaagggaagucagg

SEQ ID NO: 185430 - RNA, 32 nt, Human
ggagaaaggggauggagcaguggugcauagcu

SEQ ID NO: 185431 - RNA, 22 nt, Human
ggagaaaggguggcagccggga

SEQ ID NO: 185432 - RNA, 31 nt, Human
ggagaaagugagaggagaguucucugcaucc

SEQ ID NO: 185433 - RNA, 31 nt, Human
ggagaaagugagauuuaaagagguguuccca

SEQ ID NO: 185434 - RNA, 32 nt, Human
ggagaaagugaucugcagggagguggacaccg

SEQ ID NO: 185435 - RNA, 18 nt, Human
ggagaaagugguuuggga

SEQ ID NO: 185436 - RNA, 32 nt, Human
ggagaaauaaagggaggagagaagcacaguga

SEQ ID NO: 185437 - RNA, 18 nt, Human
ggagaaauacaguuggga

SEQ ID NO: 185438 - RNA, 29 nt, Human
ggagaaauaggaguugcaggcagcagcag

SEQ ID NO: 185439 - RNA, 32 nt, Human
ggagaaauauccaucacaugcagcuaaacaag

SEQ ID NO: 185440 - RNA, 18 nt, Human
ggagaaauaucuuuuaga

SEQ ID NO: 185441 - RNA, 32 nt, Human
ggagaaaucugacagacaccagcucagccagg

SEQ ID NO: 185442 - RNA, 32 nt, Human
ggagaaaucuguagugagcaaaggacagacca

SEQ ID NO: 185443 - RNA, 17 nt, Human
ggagaaaugucaugaga

SEQ ID NO: 185444 - RNA, 19 nt, Human
ggagaaauucccucuagga

SEQ ID NO: 185445 - RNA, 17 nt, Human
ggagaaauuccuaggga

SEQ ID NO: 185446 - RNA, 18 nt, Human
ggagaaauuucugcagga

SEQ ID NO: 185447 - RNA, 32 nt, Human
ggagaacacacguguuggcgcuucuuggcagc

SEQ ID NO: 185448 - RNA, 32 nt, Human
ggagaacaccaagaggccagagcccaggacac

SEQ ID NO: 185449 - RNA, 32 nt, Human
ggagaacacuuacuguggacagucccagaugu

SEQ ID NO: 185450 - RNA, 32 nt, Human
ggagaacaggcaggugagcugguaguggagca

SEQ ID NO: 185451 - RNA, 32 nt, Human
ggagaacaggguggaagaucugggggagcuaa

SEQ ID NO: 185452 - RNA, 32 nt, Human
ggagaacaggugacaauauacacaugugcgcu

SEQ ID NO: 185453 - RNA, 17 nt, Human
ggagaacagucccuggg

SEQ ID NO: 185454 - RNA, 32 nt, Human
ggagaacaugcuuguuaaauaugcagguagau

SEQ ID NO: 185455 - RNA, 32 nt, Human
ggagaacaugggcagagucuccauccagcagc

SEQ ID NO: 185456 - RNA, 32 nt, Human
ggagaaccaaaggccacauacaugacaaaaag

SEQ ID NO: 185457 - RNA, 32 nt, Human
ggagaaccaaauagauaaauagccagguuguu

SEQ ID NO: 185458 - RNA, 18 nt, Human
ggagaaccacuacaugca

SEQ ID NO: 185459 - RNA, 32 nt, Human
ggagaaccagaugggcugggcagaucaagcac

SEQ ID NO: 185460 - RNA, 16 nt, Human
ggagaaccagcuggga

SEQ ID NO: 185461 - RNA, 22 nt, Human
ggagaacccagggauucuggga

SEQ ID NO: 185462 - RNA, 22 nt, Human
ggagaaccccagaucucugggg

SEQ ID NO: 185463 - RNA, 32 nt, Human
ggagaaccccaggacgcccucacugcaggcuc

SEQ ID NO: 185464 - RNA, 32 nt, Human
ggagaacccgggaggcggagcuugcagugagc

SEQ ID NO: 185465 - RNA, 32 nt, Human
ggagaaccucaagcuccuggccugauccagcu

SEQ ID NO: 185466 - RNA, 32 nt, Human
ggagaaccucuuuuucucccucgacucuuccu

SEQ ID NO: 185467 - RNA, 20 nt, Human
ggagaaccugcucucuggga

SEQ ID NO: 185468 - RNA, 32 nt, Human
ggagaaccugcugggcaccccugcugcaggug

SEQ ID NO: 185469 - RNA, 23 nt, Human
ggagaaccuggauguacuuaaga

SEQ ID NO: 185470 - RNA, 31 nt, Human
ggagaacggagaagaaguuguagcagaggga

SEQ ID NO: 185471 - RNA, 32 nt, Human
ggagaacggagaagaaguuguagcagagggaa

SEQ ID NO: 185472 - RNA, 32 nt, Human
ggagaacguguguucguacuccaggcuaaccc

SEQ ID NO: 185473 - RNA, 32 nt, Human
ggagaacuaguuaggaggauggccugaggcca

SEQ ID NO: 185474 - RNA, 22 nt, Human
ggagaacucaggaggccugcag

SEQ ID NO: 185475 - RNA, 32 nt, Human
ggagaacucgccaaccucgcugugcugccaag

SEQ ID NO: 185476 - RNA, 32 nt, Human
ggagaacugaccucucugggacucaaccgugg

SEQ ID NO: 185477 - RNA, 32 nt, Human
ggagaacugcaacgccuacgcccccagucgug

SEQ ID NO: 185478 - RNA, 32 nt, Human
ggagaacugcagcugcugugccugugugggaa

SEQ ID NO: 185479 - RNA, 32 nt, Human
ggagaacugccucauucuggcuuugguagagu

SEQ ID NO: 185480 - RNA, 32 nt, Human
ggagaacuggugacccagaagggguggcgaag

SEQ ID NO: 185481 - RNA, 32 nt, Human
ggagaacuucugaaacagcaguucucaaaaug

SEQ ID NO: 185482 - RNA, 32 nt, Human
ggagaacuuguuuccugcuauuuggaagagau

SEQ ID NO: 185483 - RNA, 17 nt, Human
ggagaacuuuuuuggga

SEQ ID NO: 185484 - RNA, 32 nt, Human
ggagaagaaaaguugcuggagaccauggccaa

SEQ ID NO: 185485 - RNA, 18 nt, Human
ggagaagaaaggaggcag

SEQ ID NO: 185486 - RNA, 32 nt, Human
ggagaagaaccauuuacaugcaccuuauauuu

SEQ ID NO: 185487 - RNA, 32 nt, Human
ggagaagaagaaagcggaaaagaggcagauuc

SEQ ID NO: 185488 - RNA, 32 nt, Human
ggagaagaagaguccagccaccaucuuccuga

SEQ ID NO: 185489 - RNA, 32 nt, Human
ggagaagaauacuuuucuucaacaaauuuugg

SEQ ID NO: 185490 - RNA, 32 nt, Human
ggagaagaaugaauccucugagguccccagcu

SEQ ID NO: 185491 - RNA, 32 nt, Human
ggagaagaccucuugccucauggaugucuggu

SEQ ID NO: 185492 - RNA, 32 nt, Human
ggagaagacuguguggauccaccagaagaugg

SEQ ID NO: 185493 - RNA, 32 nt, Human
ggagaagagaagcagacgggagcagaagggac

SEQ ID NO: 185494 - RNA, 32 nt, Human
ggagaagagacaaacuccuaugucaugagaau

SEQ ID NO: 185495 - RNA, 32 nt, Human
ggagaagagagaagaaacuggagcagccuguu

SEQ ID NO: 185496 - RNA, 32 nt, Human
ggagaagagagggagggguagggagaggagcc

SEQ ID NO: 185497 - RNA, 32 nt, Human
ggagaagagccugcaaauggccaaugaaggag

SEQ ID NO: 185498 - RNA, 32 nt, Human
ggagaagaggagagacaggcaggaaaggccac

SEQ ID NO: 185499 - RNA, 32 nt, Human
ggagaagagggagggagcgagagcgagagaau

SEQ ID NO: 185500 - RNA, 32 nt, Human
ggagaagagugaggagaaaggaaacucaaguc

SEQ ID NO: 185501 - RNA, 32 nt, Human
ggagaagaugcagacacaggagauccugagga

SEQ ID NO: 185502 - RNA, 32 nt, Human
ggagaagaugcugaggaugcggaccgcgggau

SEQ ID NO: 185503 - RNA, 32 nt, Human
ggagaagauuccagaaggucuugagacacucc

SEQ ID NO: 185504 - RNA, 18 nt, Human
ggagaagauucucugggg

SEQ ID NO: 185505 - RNA, 32 nt, Human
ggagaagcaagggucauucuguucucaagugg

SEQ ID NO: 185506 - RNA, 32 nt, Human
ggagaagcacuauccuugcagcccuuguggug

SEQ ID NO: 185507 - RNA, 32 nt, Human
ggagaagcagaagcagucaguguugggguacc

SEQ ID NO: 185508 - RNA, 32 nt, Human
ggagaagcagagccauggguacgccggagaug

SEQ ID NO: 185509 - RNA, 32 nt, Human
ggagaagcagcucuacagcagagauuaucuuc

SEQ ID NO: 185510 - RNA, 32 nt, Human
ggagaagcaggcauagacagauucagauaagu

SEQ ID NO: 185511 - RNA, 17 nt, Human
ggagaagcagucugggg

SEQ ID NO: 185512 - RNA, 32 nt, Human
ggagaagcagugagccgcaucuucuccaucug

SEQ ID NO: 185513 - RNA, 26 nt, Human
ggagaagccaaagaggaggaggcagg

SEQ ID NO: 185514 - RNA, 32 nt, Human
ggagaagcccaggacugggagaaucgcacgug

SEQ ID NO: 185515 - RNA, 17 nt, Human
ggagaagcccucuggga

SEQ ID NO: 185516 - RNA, 16 nt, Human
ggagaagccucaggga

SEQ ID NO: 185517 - RNA, 32 nt, Human
ggagaagccuccacuccauugucuccuggccc

SEQ ID NO: 185518 - RNA, 32 nt, Human
ggagaagccugagacaagccacagaaccccuc

SEQ ID NO: 185519 - RNA, 32 nt, Human
ggagaagccuugcaucaaccucuugggccuca

SEQ ID NO: 185520 - RNA, 32 nt, Human
ggagaagcgaauguguccguccauccagcgga

SEQ ID NO: 185521 - RNA, 32 nt, Human
ggagaagcgcugucccggggccguggugcccg

SEQ ID NO: 185522 - RNA, 32 nt, Human
ggagaagcucaaguggacgucccccuucaccu

SEQ ID NO: 185523 - RNA, 16 nt, Human
ggagaagcucccuggg

SEQ ID NO: 185524 - RNA, 18 nt, Human
ggagaagcucuccgagga

SEQ ID NO: 185525 - RNA, 32 nt, Human
ggagaagcucugcuuucuuucucuccaacuuu

SEQ ID NO: 185526 - RNA, 32 nt, Human
ggagaagcucugggacuggggcagcagcaagg

SEQ ID NO: 185527 - RNA, 32 nt, Human
ggagaagcugcagcugcaggagugcuuguggg

SEQ ID NO: 185528 - RNA, 18 nt, Human
ggagaagcugccagggca

SEQ ID NO: 185529 - RNA, 18 nt, Human
ggagaagcuggccaggga

SEQ ID NO: 185530 - RNA, 17 nt, Human
ggagaagcugucaggga

SEQ ID NO: 185531 - RNA, 19 nt, Human
ggagaagcuguugcugaga

SEQ ID NO: 185532 - RNA, 32 nt, Human
ggagaaggaagcuuccaaguucugagagccca

SEQ ID NO: 185533 - RNA, 19 nt, Human
ggagaaggacuuucuggga

SEQ ID NO: 185534 - RNA, 32 nt, Human
ggagaaggagagaaagagacgggagagaggag

SEQ ID NO: 185535 - RNA, 17 nt, Human
ggagaaggagaggcaga

SEQ ID NO: 185536 - RNA, 32 nt, Human
ggagaaggagcaaugcugaggggugaggccuc

SEQ ID NO: 185537 - RNA, 32 nt, Human
ggagaaggagccccaccucucccaggcgagua

SEQ ID NO: 185538 - RNA, 32 nt, Human
ggagaaggagcccccagcccagccucauccug

SEQ ID NO: 185539 - RNA, 32 nt, Human
ggagaaggaggaagagggggaggaggaagagg

SEQ ID NO: 185540 - RNA, 21 nt, Human
ggagaaggaggaggaggaaga

SEQ ID NO: 185541 - RNA, 32 nt, Human
ggagaaggaggaggaggaagagagugugaaac

SEQ ID NO: 185542 - RNA, 32 nt, Human
ggagaaggaggaggaggaagaggaggagcgca

SEQ ID NO: 185543 - RNA, 32 nt, Human
ggagaaggaggcagcgcaggaggccggagcgg

SEQ ID NO: 185544 - RNA, 32 nt, Human
ggagaaggaggcggagggagcgauuguggccc

SEQ ID NO: 185545 - RNA, 32 nt, Human
ggagaaggauucgcggcggugacagauuaaau

SEQ ID NO: 185546 - RNA, 32 nt, Human
ggagaaggcagcacaucacaaccugucacauu

SEQ ID NO: 185547 - RNA, 32 nt, Human
ggagaaggcaggcagggcccagugagagggga

SEQ ID NO: 185548 - RNA, 32 nt, Human
ggagaaggcccugcggcugcagaaggagcagc

SEQ ID NO: 185549 - RNA, 32 nt, Human
ggagaaggcgagcgcggcagucgcgccggcgc

SEQ ID NO: 185550 - RNA, 32 nt, Human
ggagaaggcgucuugcuuugucacccacgcug

SEQ ID NO: 185551 - RNA, 32 nt, Human
ggagaaggcucccuccccauggggcagcauca

SEQ ID NO: 185552 - RNA, 18 nt, Human
ggagaaggcucuacagga

SEQ ID NO: 185553 - RNA, 32 nt, Human
ggagaaggcucugcaagagcucccuggcaaua

SEQ ID NO: 185554 - RNA, 32 nt, Human
ggagaaggcugaagacugaggaauccucuuuc

SEQ ID NO: 185555 - RNA, 32 nt, Human
ggagaaggcugcaugcagccucaggccugccc

SEQ ID NO: 185556 - RNA, 32 nt, Human
ggagaagggaaacuguacuuuucccugugagg

SEQ ID NO: 185557 - RNA, 32 nt, Human
ggagaagggaccuggcuggaaagcuuugcccc

SEQ ID NO: 185558 - RNA, 31 nt, Human
ggagaagggagaccuggcaguggagggaggc

SEQ ID NO: 185559 - RNA, 32 nt, Human
ggagaagggaggugggaggaggcaaagaaacu

SEQ ID NO: 185560 - RNA, 32 nt, Human
ggagaagggauauguugugagcauauaccuuc

SEQ ID NO: 185561 - RNA, 32 nt, Human
ggagaagggcauuucuggaggcagcaauauga

SEQ ID NO: 185562 - RNA, 32 nt, Human
ggagaaggggaaggaaggggcuuugggaucug

SEQ ID NO: 185563 - RNA, 32 nt, Human
ggagaaggggagacaaaaccacugcagaccua

SEQ ID NO: 185564 - RNA, 32 nt, Human
ggagaaggggaugugcaagcacauauggaggg

SEQ ID NO: 185565 - RNA, 32 nt, Human
ggagaaggggccagggguucugggcagcgcug

SEQ ID NO: 185566 - RNA, 32 nt, Human
ggagaagggugaggaugggcauuuagacccga

SEQ ID NO: 185567 - RNA, 32 nt, Human
ggagaagguaacauuggaguccugguuugauu

SEQ ID NO: 185568 - RNA, 32 nt, Human
ggagaagguauaguggaaugagugugagcauc

SEQ ID NO: 185569 - RNA, 16 nt, Human
ggagaaggucugggga

SEQ ID NO: 185570 - RNA, 32 nt, Human
ggagaaggugugagcaugagccuauuggacac

SEQ ID NO: 185571 - RNA, 32 nt, Human
ggagaagguguuauggggcagguggagggccc

SEQ ID NO: 185572 - RNA, 17 nt, Human
ggagaagguucguggga

SEQ ID NO: 185573 - RNA, 18 nt, Human
ggagaagguugcagugag

SEQ ID NO: 185574 - RNA, 32 nt, Human
ggagaaguauuuuuaugagacucuuuacucag

SEQ ID NO: 185575 - RNA, 32 nt, Human
ggagaagucaucucaugacaacagaagggagg

SEQ ID NO: 185576 - RNA, 16 nt, Human
ggagaagucuauggga

SEQ ID NO: 185577 - RNA, 32 nt, Human
ggagaagugaaaaggccccagccggggugaau

SEQ ID NO: 185578 - RNA, 32 nt, Human
ggagaagugaagauguaacauguuaucugucg

SEQ ID NO: 185579 - RNA, 32 nt, Human
ggagaagugagcaccaguaaagaucuggccuc

SEQ ID NO: 185580 - RNA, 32 nt, Human
ggagaagugcagcugcugcgccugugucggga

SEQ ID NO: 185581 - RNA, 32 nt, Human
ggagaagugcagcugcugugccugauguggga

SEQ ID NO: 185582 - RNA, 32 nt, Human
ggagaagugcagcugcugugccugugugggaa

SEQ ID NO: 185583 - RNA, 32 nt, Human
ggagaagugcagcugcugugccugugugggga

SEQ ID NO: 185584 - RNA, 31 nt, Human
ggagaaguggagagagaccgcuggcaggaug

SEQ ID NO: 185585 - RNA, 32 nt, Human
ggagaagugguaucagcugcuccuccucuccu

SEQ ID NO: 185586 - RNA, 32 nt, Human
ggagaaguucuagauucccacuguccaauaga

SEQ ID NO: 185587 - RNA, 32 nt, Human
ggagaauacucacccuucagaaacagaccaaa

SEQ ID NO: 185588 - RNA, 19 nt, Human
ggagaauagggcucugaga

SEQ ID NO: 185589 - RNA, 32 nt, Human
ggagaauaguaguucuggaauauugccgggug

SEQ ID NO: 185590 - RNA, 32 nt, Human
ggagaauaugcuggacuggccacuauccgagc

SEQ ID NO: 185591 - RNA, 32 nt, Human
ggagaaucacaaggucaggagacugagaccau

SEQ ID NO: 185592 - RNA, 32 nt, Human
ggagaaucaccugaacccccaggcuggaguac

SEQ ID NO: 185593 - RNA, 32 nt, Human
ggagaaucaccugagccugggcaauagaacaa

SEQ ID NO: 185594 - RNA, 32 nt, Human
ggagaaucacuagaagccaggaggcagagguu

SEQ ID NO: 185595 - RNA, 23 nt, Human
ggagaaucacuuaaacccaggug

SEQ ID NO: 185596 - RNA, 22 nt, Human
ggagaaucacuucaacccagga

SEQ ID NO: 185597 - RNA, 21 nt, Human
ggagaaucacuugaacccaga

SEQ ID NO: 185598 - RNA, 21 nt, Human
ggagaaucacuugaacccagg

SEQ ID NO: 185599 - RNA, 22 nt, Human
ggagaaucacuugaacccagga

SEQ ID NO: 185600 - RNA, 21 nt, Human
ggagaaucacuugaacccgga

SEQ ID NO: 185601 - RNA, 21 nt, Human
ggagaaucacuugaacccggg

SEQ ID NO: 185602 - RNA, 32 nt, Human
ggagaaucacuugaaccuggaggcagagguug

SEQ ID NO: 185603 - RNA, 32 nt, Human
ggagaaucacuugaacuaggaggcagagguug

SEQ ID NO: 185604 - RNA, 32 nt, Human
ggagaaucacuugaagccaggaggcggagguu

SEQ ID NO: 185605 - RNA, 32 nt, Human
ggagaaucacuugacccaggagguggaggucg

SEQ ID NO: 185606 - RNA, 23 nt, Human
ggagaaucacuugaccccaggug

SEQ ID NO: 185607 - RNA, 32 nt, Human
ggagaaucacuugaggccaggaauuccagauc

SEQ ID NO: 185608 - RNA, 22 nt, Human
ggagaaucacuugcacuccgga

SEQ ID NO: 185609 - RNA, 21 nt, Human
ggagaaucacuuuaacccggg

SEQ ID NO: 185610 - RNA, 21 nt, Human
ggagaaucagcccugcuggga

SEQ ID NO: 185611 - RNA, 32 nt, Human
ggagaaucauuuccaaccauuauuuacugcag

SEQ ID NO: 185612 - RNA, 32 nt, Human
ggagaaucauuuccuugucauuccaccuucua

SEQ ID NO: 185613 - RNA, 32 nt, Human
ggagaauccaccagcacaagaagaggaggcag

SEQ ID NO: 185614 - RNA, 24 nt, Human
ggagaaucccuuuggacagucuuu

SEQ ID NO: 185615 - RNA, 32 nt, Human
ggagaauccucucugccauucuuccaaucucc

SEQ ID NO: 185616 - RNA, 32 nt, Human
ggagaauccuugaggccaggagguugaggcug

SEQ ID NO: 185617 - RNA, 21 nt, Human
ggagaaucgccugaacccaga

SEQ ID NO: 185618 - RNA, 21 nt, Human
ggagaaucgccugaacccggg

SEQ ID NO: 185619 - RNA, 21 nt, Human
ggagaaucgcucugguggaug

SEQ ID NO: 185620 - RNA, 21 nt, Human
ggagaaucgcuuaaacccagg

SEQ ID NO: 185621 - RNA, 17 nt, Human
ggagaaucgcuuaaccc

SEQ ID NO: 185622 - RNA, 21 nt, Human
ggagaaucgcuucaaccuggg

SEQ ID NO: 185623 - RNA, 18 nt, Human
ggagaaucgcuugaaccc

SEQ ID NO: 185624 - RNA, 21 nt, Human
ggagaaucgcuugaacccaga

SEQ ID NO: 185625 - RNA, 22 nt, Human
ggagaaucgcuugaacccgcga

SEQ ID NO: 185626 - RNA, 32 nt, Human
ggagaaucgcuugacccaggaggcggagguug

SEQ ID NO: 185627 - RNA, 21 nt, Human
ggagaaucgcuugagcccaga

SEQ ID NO: 185628 - RNA, 32 nt, Human
ggagaaucgcuugagccugggcaguugaggcu

SEQ ID NO: 185629 - RNA, 32 nt, Human
ggagaaucgcuugagcuggagugcaguggugc

SEQ ID NO: 185630 - RNA, 32 nt, Human
ggagaaucgcuugaggccagaagugcaagacc

SEQ ID NO: 185631 - RNA, 21 nt, Human
ggagaaucgcuuuaacuggga

SEQ ID NO: 185632 - RNA, 22 nt, Human
ggagaaucgcuuuaaucuagga

SEQ ID NO: 185633 - RNA, 32 nt, Human
ggagaaucucacuuuuccuacucucguauuuu

SEQ ID NO: 185634 - RNA, 32 nt, Human
ggagaaucugaggacucagaauucagcaacua

SEQ ID NO: 185635 - RNA, 32 nt, Human
ggagaaucuguaccaccucuuugccaggggga

SEQ ID NO: 185636 - RNA, 32 nt, Human
ggagaaugaaaaacuagagucagacagcuuua

SEQ ID NO: 185637 - RNA, 32 nt, Human
ggagaaugaaggagguagagguuugacugugg

SEQ ID NO: 185638 - RNA, 32 nt, Human
ggagaaugacuggcccaaagucacucggcugg

SEQ ID NO: 185639 - RNA, 32 nt, Human
ggagaaugagacaugcuuuuccagcuguuugg

SEQ ID NO: 185640 - RNA, 32 nt, Human
ggagaaugaggugggaggauugcuugagcuca

SEQ ID NO: 185641 - RNA, 30 nt, Human
ggagaauggaggagcacacagaggcaggcu

SEQ ID NO: 185642 - RNA, 31 nt, Human
ggagaauggcuucucccuugggaggcgcugg

SEQ ID NO: 185643 - RNA, 32 nt, Human
ggagaauggcuugacccaggaagcggagguug

SEQ ID NO: 185644 - RNA, 32 nt, Human
ggagaauggugcggagcuugcagugagccgag

SEQ ID NO: 185645 - RNA, 32 nt, Human
ggagaauguauucuuuugaugaugugcuggag

SEQ ID NO: 185646 - RNA, 32 nt, Human
ggagaaugucaaggcaaguucuaaauuaguuu

SEQ ID NO: 185647 - RNA, 16 nt, Human
ggagaauguccugggg

SEQ ID NO: 185648 - RNA, 23 nt, Human
ggagaaugugaaggaugguuugg

SEQ ID NO: 185649 - RNA, 32 nt, Human
ggagaauguggaaugcagagugauaauccugc

SEQ ID NO: 185650 - RNA, 32 nt, Human
ggagaauugcuggaacguggaggcagagguug

SEQ ID NO: 185651 - RNA, 32 nt, Human
ggagaauugcuugaacagggaggcagagguug

SEQ ID NO: 185652 - RNA, 32 nt, Human
ggagaauugcuugaacccggaggcagagguug

SEQ ID NO: 185653 - RNA, 32 nt, Human
ggagaauugcuugaaccgggaggcagaaguug

SEQ ID NO: 185654 - RNA, 32 nt, Human
ggagaauugcuugacccaggaggcagagguug

SEQ ID NO: 185655 - RNA, 32 nt, Human
ggagaauugcuugaggccaggaguuugagacc

SEQ ID NO: 185656 - RNA, 32 nt, Human
ggagaauugggggugguugccgggaggaccag

SEQ ID NO: 185657 - RNA, 32 nt, Human
ggagaauuuuuaaaacaaaaucucucauucca

SEQ ID NO: 185658 - RNA, 32 nt, Human
ggagacaagauccaaacugagauggagacugu

SEQ ID NO: 185659 - RNA, 32 nt, Human
ggagacaagcacagcacacagacauuuuagga

SEQ ID NO: 185660 - RNA, 32 nt, Human
ggagacaaggcggccauggauuugcccuugau

SEQ ID NO: 185661 - RNA, 32 nt, Human
ggagacaaggcuuugccauguugcccaggcug

SEQ ID NO: 185662 - RNA, 32 nt, Human
ggagacaaggucucgccauguugccuaggaug

SEQ ID NO: 185663 - RNA, 32 nt, Human
ggagacaaggucucuccauguugccuaggcug

SEQ ID NO: 185664 - RNA, 19 nt, Human
ggagacaauccugguuuca

SEQ ID NO: 185665 - RNA, 32 nt, Human
ggagacaauguguaccaggacagcagaaagac

SEQ ID NO: 185666 - RNA, 20 nt, Human
ggagacacaaaagagacaga

SEQ ID NO: 185667 - RNA, 19 nt, Human
ggagacacagcagcggugu

SEQ ID NO: 185668 - RNA, 32 nt, Human
ggagacacagccgccacucccccagucuacuu

SEQ ID NO: 185669 - RNA, 32 nt, Human
ggagacacauggccacuggccacugaauggcu

SEQ ID NO: 185670 - RNA, 32 nt, Human
ggagacaccagcagguggcugcagugacguua

SEQ ID NO: 185671 - RNA, 32 nt, Human
ggagacacccaggaggaaggccgugcuccugg

SEQ ID NO: 185672 - RNA, 16 nt, Human
ggagacaccucugggg

SEQ ID NO: 185673 - RNA, 32 nt, Human
ggagacacuacccuuccaugccccagaccucu

SEQ ID NO: 185674 - RNA, 32 nt, Human
ggagacacuccaggaagaccugcaggugggag

SEQ ID NO: 185675 - RNA, 32 nt, Human
ggagacacugacuccagccaagaaaccugagc

SEQ ID NO: 185676 - RNA, 32 nt, Human
ggagacagaacaacagagucucagggaaagag

SEQ ID NO: 185677 - RNA, 22 nt, Human
ggagacagaaggcagcaaacaa

SEQ ID NO: 185678 - RNA, 32 nt, Human
ggagacagaaucucacuccagccugggcaaca

SEQ ID NO: 185679 - RNA, 32 nt, Human
ggagacagacagagaaggcagcaggcggccuu

SEQ ID NO: 185680 - RNA, 22 nt, Human
ggagacagacggcagcaaacaa

SEQ ID NO: 185681 - RNA, 32 nt, Human
ggagacagacuggacauuucccuguuucgagc

SEQ ID NO: 185682 - RNA, 32 nt, Human
ggagacagagucucacucugucacccaggcug

SEQ ID NO: 185683 - RNA, 32 nt, Human
ggagacagagucuggcucugucacccaggcug

SEQ ID NO: 185684 - RNA, 32 nt, Human
ggagacagagucuugcucugucacccaggcug

SEQ ID NO: 185685 - RNA, 32 nt, Human
ggagacagagucuugcucugucucaaaagaau

SEQ ID NO: 185686 - RNA, 32 nt, Human
ggagacagagucuugcuuuguugcccaggcug

SEQ ID NO: 185687 - RNA, 32 nt, Human
ggagacagcaugggaugccauugccuagaguu

SEQ ID NO: 185688 - RNA, 21 nt, Human
ggagacagccacccacaguga

SEQ ID NO: 185689 - RNA, 32 nt, Human
ggagacagccagggugugucaccugacaggcu

SEQ ID NO: 185690 - RNA, 32 nt, Human
ggagacagccgccaccccacaggccgggcuac

SEQ ID NO: 185691 - RNA, 16 nt, Human
ggagacagccucagag

SEQ ID NO: 185692 - RNA, 32 nt, Human
ggagacagcuguuccacuugcacacacgcaca

SEQ ID NO: 185693 - RNA, 32 nt, Human
ggagacaggaaguggagguaaagcaaaggaag

SEQ ID NO: 185694 - RNA, 32 nt, Human
ggagacaggaugcuuaugagggccagugcaag

SEQ ID NO: 185695 - RNA, 32 nt, Human
ggagacaggauuuuaccauguuggccaggcug

SEQ ID NO: 185696 - RNA, 32 nt, Human
ggagacaggcagacauuuggucucagcagcca

SEQ ID NO: 185697 - RNA, 32 nt, Human
ggagacaggcagggagggcuuggggcugcacc

SEQ ID NO: 185698 - RNA, 32 nt, Human
ggagacaggcauauucaugggucaucaaaauc

SEQ ID NO: 185699 - RNA, 32 nt, Human
ggagacaggccguccugcugucuugcuucucc

SEQ ID NO: 185700 - RNA, 17 nt, Human
ggagacaggcucagaga

SEQ ID NO: 185701 - RNA, 32 nt, Human
ggagacaggcuucuauccacucugccugcggu

SEQ ID NO: 185702 - RNA, 32 nt, Human
ggagacagggacgcaggagggugcaaggaagu

SEQ ID NO: 185703 - RNA, 21 nt, Human
ggagacagggcagggguucag

SEQ ID NO: 185704 - RNA, 32 nt, Human
ggagacagggcuuuuucucucccucuggcgag

SEQ ID NO: 185705 - RNA, 32 nt, Human
ggagacagggucucaccauguuggcuaggcug

SEQ ID NO: 185706 - RNA, 32 nt, Human
ggagacagggucucacucugucacacaggcug

SEQ ID NO: 185707 - RNA, 32 nt, Human
ggagacagggucucacuguguugcccaggcug

SEQ ID NO: 185708 - RNA, 32 nt, Human
ggagacagggucucgcucuguugcccaggcug

SEQ ID NO: 185709 - RNA, 32 nt, Human
ggagacagggucuugcacuaucacccaggcug

SEQ ID NO: 185710 - RNA, 32 nt, Human
ggagacagggucuugcucugucacccagacug

SEQ ID NO: 185711 - RNA, 32 nt, Human
ggagacagggucuugcucugucgcccagacug

SEQ ID NO: 185712 - RNA, 32 nt, Human
ggagacaggguuucaacauguuggccaggcug

SEQ ID NO: 185713 - RNA, 32 nt, Human
ggagacaggguuucaccauguuggccaggcug

SEQ ID NO: 185714 - RNA, 32 nt, Human
ggagacaggguuuugccauguugcccagguug

SEQ ID NO: 185715 - RNA, 32 nt, Human
ggagacaguggauucuugccucggugagguca

SEQ ID NO: 185716 - RNA, 32 nt, Human
ggagacaguggccgccggcggcccaacccguc

SEQ ID NO: 185717 - RNA, 32 nt, Human
ggagacaguuguguggugugugcauugugugu

SEQ ID NO: 185718 - RNA, 32 nt, Human
ggagacaguuuuggucgucacagcagaggggc

SEQ ID NO: 185719 - RNA, 32 nt, Human
ggagacaucacugacccaggacaccuagcaca

SEQ ID NO: 185720 - RNA, 32 nt, Human
ggagacaucgcccaugugcuucugcuacuggu

SEQ ID NO: 185721 - RNA, 32 nt, Human
ggagacaucugucuggcgaucagcaucaccaa

SEQ ID NO: 185722 - RNA, 32 nt, Human
ggagacaugaagaugaccagacugggcaaauu

SEQ ID NO: 185723 - RNA, 31 nt, Human
ggagacauggaggcagcuguggcgguguuag

SEQ ID NO: 185724 - RNA, 32 nt, Human
ggagacaugucauuuguaaaagcagaaaaagg

SEQ ID NO: 185725 - RNA, 21 nt, Human
ggagacauuaaaggauggaug

SEQ ID NO: 185726 - RNA, 32 nt, Human
ggagacauuauggggcguccaccaccaccccu

SEQ ID NO: 185727 - RNA, 32 nt, Human
ggagacauuccaucuccagacacccagagacg

SEQ ID NO: 185728 - RNA, 32 nt, Human
ggagacauugucaugaacucuuugccaagguc

SEQ ID NO: 185729 - RNA, 25 nt, Human
ggagaccaaaugagaaggauugcuu

SEQ ID NO: 185730 - RNA, 17 nt, Human
ggagaccaacucugggg

SEQ ID NO: 185731 - RNA, 32 nt, Human
ggagaccaagcagcagaugcagguguggaccc

SEQ ID NO: 185732 - RNA, 25 nt, Human
ggagaccaaggcaagaggauugcuu

SEQ ID NO: 185733 - RNA, 32 nt, Human
ggagaccaaggcaagaggauugcuugagucca

SEQ ID NO: 185734 - RNA, 20 nt, Human
ggagaccaaggcagguggau

SEQ ID NO: 185735 - RNA, 32 nt, Human
ggagaccaagguggguggaucgcuugagcuca

SEQ ID NO: 185736 - RNA, 21 nt, Human
ggagaccaaugguaugacaga

SEQ ID NO: 185737 - RNA, 32 nt, Human
ggagaccaauuccuaaaggguaaagaaggguu

SEQ ID NO: 185738 - RNA, 19 nt, Human
ggagaccacgcuccuggag

SEQ ID NO: 185739 - RNA, 32 nt, Human
ggagaccacggugaaaccccgucucuacuaaa

SEQ ID NO: 185740 - RNA, 19 nt, Human
ggagaccagacauacucua

SEQ ID NO: 185741 - RNA, 32 nt, Human
ggagaccagccuccuuaaucccuucccccgcc

SEQ ID NO: 185742 - RNA, 32 nt, Human
ggagaccagccuggccaagauggugaaacccu

SEQ ID NO: 185743 - RNA, 16 nt, Human
ggagaccaggaagcca

SEQ ID NO: 185744 - RNA, 22 nt, Human
ggagaccaggaauggaguucca

SEQ ID NO: 185745 - RNA, 22 nt, Human
ggagaccaggacaaggaacaga

SEQ ID NO: 185746 - RNA, 32 nt, Human
ggagaccagggacaggagagccagcagggugg

SEQ ID NO: 185747 - RNA, 24 nt, Human
ggagaccagggcaggauagacaga

SEQ ID NO: 185748 - RNA, 32 nt, Human
ggagaccagggccaggaggguggaggccucuc

SEQ ID NO: 185749 - RNA, 32 nt, Human
ggagaccagguguugucugacaucccacacac

SEQ ID NO: 185750 - RNA, 32 nt, Human
ggagaccaucuuggcaaucucugccucugcaa

SEQ ID NO: 185751 - RNA, 32 nt, Human
ggagacccaagugggcccggcgccaacggcuc

SEQ ID NO: 185752 - RNA, 32 nt, Human
ggagacccagcagcccccagacuacuucuauc

SEQ ID NO: 185753 - RNA, 32 nt, Human
ggagacccagcagccuguagguggagggugag

SEQ ID NO: 185754 - RNA, 19 nt, Human
ggagacccagcccgggcug

SEQ ID NO: 185755 - RNA, 17 nt, Human
ggagaccccagaccccu

SEQ ID NO: 185756 - RNA, 32 nt, Human
ggagaccccagggccucucaggagacagugag

SEQ ID NO: 185757 - RNA, 21 nt, Human
ggagaccccaucucuacaaaa

SEQ ID NO: 185758 - RNA, 23 nt, Human
ggagaccccgaagggaggcugcu

SEQ ID NO: 185759 - RNA, 19 nt, Human
ggagaccccucccgagccg

SEQ ID NO: 185760 - RNA, 23 nt, Human
ggagaccccugccuggccccggg

SEQ ID NO: 185761 - RNA, 32 nt, Human
ggagaccccuggcugcuacagcugcgucacag

SEQ ID NO: 185762 - RNA, 32 nt, Human
ggagacccucauuugccacccagaccaaugug

SEQ ID NO: 185763 - RNA, 21 nt, Human
ggagacccuggcaucacaaaa

SEQ ID NO: 185764 - RNA, 19 nt, Human
ggagaccgacgggcagaac

SEQ ID NO: 185765 - RNA, 32 nt, Human
ggagaccgaggcaugagagucacuugaaccuc

SEQ ID NO: 185766 - RNA, 32 nt, Human
ggagaccgcguuuagaggaucaguggcggcgg

SEQ ID NO: 185767 - RNA, 23 nt, Human
ggagaccgcuggggacagacagg

SEQ ID NO: 185768 - RNA, 32 nt, Human
ggagaccggggaagaaggaggagcagccaagg

SEQ ID NO: 185769 - RNA, 32 nt, Human
ggagaccuagaggugggggccugccuuggcca

SEQ ID NO: 185770 - RNA, 32 nt, Human
ggagaccucuacucaugcuaucaucaccaaag

SEQ ID NO: 185771 - RNA, 32 nt, Human
ggagaccugagcuguaggcaguggagauggca

SEQ ID NO: 185772 - RNA, 32 nt, Human
ggagaccuggaaggcccucgcagcgccugcuc

SEQ ID NO: 185773 - RNA, 32 nt, Human
ggagaccuggccuccuggucagcuuuggaggg

SEQ ID NO: 185774 - RNA, 32 nt, Human
ggagaccuggcuuagaaucagaucauaugaaa

SEQ ID NO: 185775 - RNA, 32 nt, Human
ggagaccugggugacggaagaacgcccaaggc

SEQ ID NO: 185776 - RNA, 32 nt, Human
ggagaccuugcuuucuguuucacugggaaaca

SEQ ID NO: 185777 - RNA, 32 nt, Human
ggagaccuuguccuuggccuagaguccuccca

SEQ ID NO: 185778 - RNA, 32 nt, Human
ggagaccuuugguggggacuucucccugaacu

SEQ ID NO: 185779 - RNA, 32 nt, Human
ggagacgaacagagugcucucagugagaagug

SEQ ID NO: 185780 - RNA, 32 nt, Human
ggagacgaaggagagagagcugaggguggagg

SEQ ID NO: 185781 - RNA, 32 nt, Human
ggagacgacaggcgagagaggagccagacaga

SEQ ID NO: 185782 - RNA, 21 nt, Human
ggagacgacgcguguguguug

SEQ ID NO: 185783 - RNA, 32 nt, Human
ggagacgaggggcuggcucucaguccccgcuu

SEQ ID NO: 185784 - RNA, 32 nt, Human
ggagacgcaaggacaggacugguagacggguc

SEQ ID NO: 185785 - RNA, 32 nt, Human
ggagacgcagccgccggacccugcccagggca

SEQ ID NO: 185786 - RNA, 32 nt, Human
ggagacgcagccuuucaacaccuggcagggca

SEQ ID NO: 185787 - RNA, 32 nt, Human
ggagacgcauuguauauaauauaugucaaagg

SEQ ID NO: 185788 - RNA, 32 nt, Human
ggagacgcgaggaggagggaggaggaagagag

SEQ ID NO: 185789 - RNA, 32 nt, Human
ggagacgcucaggaggugggaaaggcggaggu

SEQ ID NO: 185790 - RNA, 32 nt, Human
ggagacgcucgcccgacagcauaguacuugcc

SEQ ID NO: 185791 - RNA, 32 nt, Human
ggagacgcugcuccauucugccuggaucauuu

SEQ ID NO: 185792 - RNA, 32 nt, Human
ggagacggacucuugcuauguugcccaggcug

SEQ ID NO: 185793 - RNA, 32 nt, Human
ggagacggagcugagcaugcaaggaagggcaa

SEQ ID NO: 185794 - RNA, 20 nt, Human
ggagacggagguuacaguga

SEQ ID NO: 185795 - RNA, 21 nt, Human
ggagacggagguuacagugag

SEQ ID NO: 185796 - RNA, 20 nt, Human
ggagacggagguugcuguga

SEQ ID NO: 185797 - RNA, 21 nt, Human
ggagacggagguugcugugag

SEQ ID NO: 185798 - RNA, 32 nt, Human
ggagacggagucucacucugucacccauucug

SEQ ID NO: 185799 - RNA, 32 nt, Human
ggagacggagucuugcucugcgcccaggaugg

SEQ ID NO: 185800 - RNA, 19 nt, Human
ggagacggaguguggggga

SEQ ID NO: 185801 - RNA, 32 nt, Human
ggagacggaugggaauucugcagccacaccca

SEQ ID NO: 185802 - RNA, 32 nt, Human
ggagacggcaggcuuaggucucacugacagca

SEQ ID NO: 185803 - RNA, 32 nt, Human
ggagacggccggaagccaguaaaagaagagaa

SEQ ID NO: 185804 - RNA, 32 nt, Human
ggagacggccugggugcuggcgaagcggaggc

SEQ ID NO: 185805 - RNA, 32 nt, Human
ggagacgggagguuguggugagcugagaucgu

SEQ ID NO: 185806 - RNA, 32 nt, Human
ggagacgggauuucaccauguuggccaugcug

SEQ ID NO: 185807 - RNA, 32 nt, Human
ggagacggggccucacuauguugccuaggcug

SEQ ID NO: 185808 - RNA, 32 nt, Human
ggagacggggucuugcccugucacccaggcug

SEQ ID NO: 185809 - RNA, 32 nt, Human
ggagacgggguuucaccaugcuggccagacug

SEQ ID NO: 185810 - RNA, 32 nt, Human
ggagacgggguuucaccauguuggccaggcug

SEQ ID NO: 185811 - RNA, 32 nt, Human
ggagacgggguuucaccauguuggcuaagcug

SEQ ID NO: 185812 - RNA, 32 nt, Human
ggagacgggguuucaccauguuggucaggaug

SEQ ID NO: 185813 - RNA, 32 nt, Human
ggagacgggguuucaccauguuggucaggcug

SEQ ID NO: 185814 - RNA, 32 nt, Human
ggagacgggguuucaccauguuguccaggaug

SEQ ID NO: 185815 - RNA, 32 nt, Human
ggagacgggguuucaccguguuagccaggaua

SEQ ID NO: 185816 - RNA, 32 nt, Human
ggagacgggguuucaccguguuggccgggcug

SEQ ID NO: 185817 - RNA, 32 nt, Human
ggagacgggguuucacuguguuagccacgaug

SEQ ID NO: 185818 - RNA, 32 nt, Human
ggagacgggguuucacuguguuagccaggaug

SEQ ID NO: 185819 - RNA, 32 nt, Human
ggagacgggguuucgccauguuugccaggcug

SEQ ID NO: 185820 - RNA, 32 nt, Human
ggagacgggguuucgcuguguuggccgggcug

SEQ ID NO: 185821 - RNA, 32 nt, Human
ggagacgggguuucuccauguuggucaggcug

SEQ ID NO: 185822 - RNA, 32 nt, Human
ggagacgggguuuugccauguugaccuggcug

SEQ ID NO: 185823 - RNA, 32 nt, Human
ggagacguccuccauaaguggagcacagggua

SEQ ID NO: 185824 - RNA, 32 nt, Human
ggagacgucugccucagccacugccuccgaga

SEQ ID NO: 185825 - RNA, 32 nt, Human
ggagacguggaaccucugucucauccuccugg

SEQ ID NO: 185826 - RNA, 32 nt, Human
ggagacguggagaagaggaaugcugagugaug

SEQ ID NO: 185827 - RNA, 32 nt, Human
ggagacguucccagaugcaggccaucugucuc

SEQ ID NO: 185828 - RNA, 21 nt, Human
ggagacguuucaacccugcag

SEQ ID NO: 185829 - RNA, 32 nt, Human
ggagacuaaggcaggaggaaggauagcuugag

SEQ ID NO: 185830 - RNA, 32 nt, Human
ggagacuacauuuuguccccuccuggggucuu

SEQ ID NO: 185831 - RNA, 32 nt, Human
ggagacuaccauugcggcugcaucgccuucuc

SEQ ID NO: 185832 - RNA, 32 nt, Human
ggagacuagaaaacauucuaccccuucagguc

SEQ ID NO: 185833 - RNA, 32 nt, Human
ggagacuauggaacgucaggugcugcugagcg

SEQ ID NO: 185834 - RNA, 32 nt, Human
ggagacucacccacccucucccucucccuuca

SEQ ID NO: 185835 - RNA, 32 nt, Human
ggagacucacugcaaguuccugcccaggaggc

SEQ ID NO: 185836 - RNA, 32 nt, Human
ggagacucaggcaguggccuggagaggcuuug

SEQ ID NO: 185837 - RNA, 32 nt, Human
ggagacucccauccucucuucccccucaccaa

SEQ ID NO: 185838 - RNA, 32 nt, Human
ggagacuccgcucacuccccacggccagcgug

SEQ ID NO: 185839 - RNA, 32 nt, Human
ggagacucgcagcagcugcuacccacagccua

SEQ ID NO: 185840 - RNA, 19 nt, Human
ggagacucggaaagaugga

SEQ ID NO: 185841 - RNA, 32 nt, Human
ggagacucugcaggcuccaucccuccuuauuc

SEQ ID NO: 185842 - RNA, 32 nt, Human
ggagacucugcuccugcauggaaagggagccu

SEQ ID NO: 185843 - RNA, 32 nt, Human
ggagacucuggagagaggaccucugccagugg

SEQ ID NO: 185844 - RNA, 32 nt, Human
ggagacucuguggggccuugguucccuugugu

SEQ ID NO: 185845 - RNA, 32 nt, Human
ggagacucuuucucccuugcuggcuuugggcc

SEQ ID NO: 185846 - RNA, 32 nt, Human
ggagacugaagagcaacugggaacucggaucu

SEQ ID NO: 185847 - RNA, 32 nt, Human
ggagacugaagcaggagaaucgcucgagcccg

SEQ ID NO: 185848 - RNA, 32 nt, Human
ggagacugacacugaagaagcuuaaaaucacu

SEQ ID NO: 185849 - RNA, 32 nt, Human
ggagacugagacaggagaaucgcuugagcugg

SEQ ID NO: 185850 - RNA, 32 nt, Human
ggagacugagacaugagaaucgcuugagccug

SEQ ID NO: 185851 - RNA, 25 nt, Human
ggagacugagaugggaggaucgcuu

SEQ ID NO: 185852 - RNA, 32 nt, Human
ggagacugagaugggaggaucgcuugagacca

SEQ ID NO: 185853 - RNA, 32 nt, Human
ggagacugaggcagaagaaucgcuugaaccca

SEQ ID NO: 185854 - RNA, 32 nt, Human
ggagacugaggcagaaggaucgcuugaaccug

SEQ ID NO: 185855 - RNA, 32 nt, Human
ggagacugaggcaggaaaauugcuugaaccca

SEQ ID NO: 185856 - RNA, 32 nt, Human
ggagacugaggcaggagaaucgcaugaacccg

SEQ ID NO: 185857 - RNA, 32 nt, Human
ggagacugaggcaggagaaucgcuugaacccg

SEQ ID NO: 185858 - RNA, 32 nt, Human
ggagacugaggcaggagaaucgcuugaaccug

SEQ ID NO: 185859 - RNA, 32 nt, Human
ggagacugaggcaggagaaucgcuugaacuca

SEQ ID NO: 185860 - RNA, 32 nt, Human
ggagacugaggcaggagaauggggagaacccg

SEQ ID NO: 185861 - RNA, 32 nt, Human
ggagacugaggcaggagaauugcuugaaacug

SEQ ID NO: 185862 - RNA, 32 nt, Human
ggagacugaggcaggagaauugcuugaaccca

SEQ ID NO: 185863 - RNA, 32 nt, Human
ggagacugaggcaggagaauugcuugaaccug

SEQ ID NO: 185864 - RNA, 32 nt, Human
ggagacugaggcgggaggauuacuugagccca

SEQ ID NO: 185865 - RNA, 25 nt, Human
ggagacugaggugggagaaucgcuu

SEQ ID NO: 185866 - RNA, 32 nt, Human
ggagacugaggugggagaaucgcuugagacug

SEQ ID NO: 185867 - RNA, 25 nt, Human
ggagacugaggugggaggaucgcuu

SEQ ID NO: 185868 - RNA, 32 nt, Human
ggagacugaggugggaggaucgcuugagccca

SEQ ID NO: 185869 - RNA, 32 nt, Human
ggagacugaggugggaggaucgcuugagccuc

SEQ ID NO: 185870 - RNA, 32 nt, Human
ggagacugaggugggaggauugcuagaagcca

SEQ ID NO: 185871 - RNA, 32 nt, Human
ggagacugagguuggaggaucgcuugagccug

SEQ ID NO: 185872 - RNA, 32 nt, Human
ggagacugaucuguuccauccguuagcgcgag

SEQ ID NO: 185873 - RNA, 32 nt, Human
ggagacugauuugggcccagccccagggcgca

SEQ ID NO: 185874 - RNA, 32 nt, Human
ggagacugcaccacugcacuucagccugggug

SEQ ID NO: 185875 - RNA, 32 nt, Human
ggagacugccccugcugccuucugcccagugg

SEQ ID NO: 185876 - RNA, 32 nt, Human
ggagacuggaagaaggggccagaaauucagac

SEQ ID NO: 185877 - RNA, 18 nt, Human
ggagacuggacuacaaca

SEQ ID NO: 185878 - RNA, 29 nt, Human
ggagacuggcugcuggggccuccuugcuu

SEQ ID NO: 185879 - RNA, 32 nt, Human
ggagacugggggcagcccucacccaacucaca

SEQ ID NO: 185880 - RNA, 32 nt, Human
ggagacugggucuugcucuguuacccaggcug

SEQ ID NO: 185881 - RNA, 32 nt, Human
ggagacuggguggaggcucaguguguaauaau

SEQ ID NO: 185882 - RNA, 32 nt, Human
ggagacuguagucccagcuacucgggagguug

SEQ ID NO: 185883 - RNA, 32 nt, Human
ggagacugucugcagcuuagggcagaaauggg

SEQ ID NO: 185884 - RNA, 32 nt, Human
ggagacugucuggaaggcuuggaaugguuuau

SEQ ID NO: 185885 - RNA, 32 nt, Human
ggagacuguggcucagacccaggugugcgggc

SEQ ID NO: 185886 - RNA, 32 nt, Human
ggagacugugucugcuuucugccuccucuucc

SEQ ID NO: 185887 - RNA, 32 nt, Human
ggagacuucagggagaccagagcccagcuugc

SEQ ID NO: 185888 - RNA, 32 nt, Human
ggagacuugagcaagcccuaaaguccccugcu

SEQ ID NO: 185889 - RNA, 24 nt, Human
ggagacuuguaugaaagauggcug

SEQ ID NO: 185890 - RNA, 32 nt, Human
ggagacuuugcggggaggaggcagcagacacu

SEQ ID NO: 185891 - RNA, 32 nt, Human
ggagagaaaaccucugcgaggaaagggaagga

SEQ ID NO: 185892 - RNA, 32 nt, Human
ggagagaaaggagggaaaagccagucucuccg

SEQ ID NO: 185893 - RNA, 20 nt, Human
ggagagaaaggcagcucccu

SEQ ID NO: 185894 - RNA, 32 nt, Human
ggagagaaagugguaugagagcagugugguuu

SEQ ID NO: 185895 - RNA, 32 nt, Human
ggagagaaaugguuugugucucccuuauuccc

SEQ ID NO: 185896 - RNA, 22 nt, Human
ggagagaacagagaagaaaaga

SEQ ID NO: 185897 - RNA, 32 nt, Human
ggagagaaccaaggaagacuuccuggaggaaa

SEQ ID NO: 185898 - RNA, 32 nt, Human
ggagagaacccugaugauggagaagaacugug

SEQ ID NO: 185899 - RNA, 32 nt, Human
ggagagaaccucuacugaucagagcaucuaaa

SEQ ID NO: 185900 - RNA, 32 nt, Human
ggagagaagagggagaggcaggagccggccca

SEQ ID NO: 185901 - RNA, 32 nt, Human
ggagagaagauggggaagugugugagacaaaa

SEQ ID NO: 185902 - RNA, 21 nt, Human
ggagagaagcaggagucggga

SEQ ID NO: 185903 - RNA, 32 nt, Human
ggagagaaggaaggaaggaacuuccguaguac

SEQ ID NO: 185904 - RNA, 32 nt, Human
ggagagaaggagguggggauccgagugcagug

SEQ ID NO: 185905 - RNA, 32 nt, Human
ggagagaauacaauaacuacuacaguaaaguc

SEQ ID NO: 185906 - RNA, 32 nt, Human
ggagagaauccccuacccuacucugauguaua

SEQ ID NO: 185907 - RNA, 32 nt, Human
ggagagaaucuugcagaccccaugucuauuaa

SEQ ID NO: 185908 - RNA, 32 nt, Human
ggagagaaugaagagcgcugugccaguaaaua

SEQ ID NO: 185909 - RNA, 32 nt, Human
ggagagaaugugcuaccauggaaacuggagga

SEQ ID NO: 185910 - RNA, 32 nt, Human
ggagagacacccggggccuggccacgcucugg

SEQ ID NO: 185911 - RNA, 32 nt, Human
ggagagacacugguggggauaggccagccgcg

SEQ ID NO: 185912 - RNA, 19 nt, Human
ggagagacagagaacucug

SEQ ID NO: 185913 - RNA, 32 nt, Human
ggagagacagcgcagagcagggggcggcuugc

SEQ ID NO: 185914 - RNA, 32 nt, Human
ggagagacagcucugcaguuucccacacuguc

SEQ ID NO: 185915 - RNA, 32 nt, Human
ggagagaccagagggggccugaggcuucacug

SEQ ID NO: 185916 - RNA, 32 nt, Human
ggagagaccagccuggccagcauagugaaacc

SEQ ID NO: 185917 - RNA, 32 nt, Human
ggagagaccagcucuccagccuggcaggaaag

SEQ ID NO: 185918 - RNA, 19 nt, Human
ggagagacccagaaaagaa

SEQ ID NO: 185919 - RNA, 32 nt, Human
ggagagaccccuccccucccacccacagccau

SEQ ID NO: 185920 - RNA, 17 nt, Human
ggagagacccucagaga

SEQ ID NO: 185921 - RNA, 32 nt, Human
ggagagaccgagugaaccuaccuucauuucag

SEQ ID NO: 185922 - RNA, 32 nt, Human
ggagagaccuggcugcugugucccgcggcuug

SEQ ID NO: 185923 - RNA, 32 nt, Human
ggagagacggagcggaccucagcgcugaagca

SEQ ID NO: 185924 - RNA, 32 nt, Human
ggagagacgggcccugcucacagacuagacag

SEQ ID NO: 185925 - RNA, 32 nt, Human
ggagagacuggauuccagccugcaaaagcugu

SEQ ID NO: 185926 - RNA, 32 nt, Human
ggagagacugggacucaaagaggaacuugauu

SEQ ID NO: 185927 - RNA, 32 nt, Human
ggagagagaaaggcuuccccaccacacuuucc

SEQ ID NO: 185928 - RNA, 32 nt, Human
ggagagagaaaggggcauugacugggacccac

SEQ ID NO: 185929 - RNA, 32 nt, Human
ggagagagaacccauccucucccuucuuacac

SEQ ID NO: 185930 - RNA, 19 nt, Human
ggagagagaagcaggcaga

SEQ ID NO: 185931 - RNA, 32 nt, Human
ggagagagacagaaagagagauggauagaugg

SEQ ID NO: 185932 - RNA, 18 nt, Human
ggagagagagcaccgaga

SEQ ID NO: 185933 - RNA, 22 nt, Human
ggagagagagcgggagccgcgg

SEQ ID NO: 185934 - RNA, 32 nt, Human
ggagagagagcugaggguggaggcagagcacg

SEQ ID NO: 185935 - RNA, 32 nt, Human
ggagagagaggagagagaaggaaauaugugua

SEQ ID NO: 185936 - RNA, 32 nt, Human
ggagagagaggagagaggagagagggagggaa

SEQ ID NO: 185937 - RNA, 32 nt, Human
ggagagagagggagggagagggagugaagagc

SEQ ID NO: 185938 - RNA, 32 nt, Human
ggagagagagggagggagcgagagggagagca

SEQ ID NO: 185939 - RNA, 32 nt, Human
ggagagagagugaacagggagcggggcuuuug

SEQ ID NO: 185940 - RNA, 22 nt, Human
ggagagagcagcaaagccggga

SEQ ID NO: 185941 - RNA, 32 nt, Human
ggagagagccagagagaggagugaggguggcu

SEQ ID NO: 185942 - RNA, 32 nt, Human
ggagagagccuaccuagacagugcaguccugc

SEQ ID NO: 185943 - RNA, 16 nt, Human
ggagagagccugucca

SEQ ID NO: 185944 - RNA, 32 nt, Human
ggagagagcugaggauuuccaggacuuuguaa

SEQ ID NO: 185945 - RNA, 32 nt, Human
ggagagagcugaugacugcaguucucaaaggu

SEQ ID NO: 185946 - RNA, 32 nt, Human
ggagagaggaagacaagaaggagaagcagaaa

SEQ ID NO: 185947 - RNA, 21 nt, Human
ggagagaggaagaggagcaga

SEQ ID NO: 185948 - RNA, 32 nt, Human
ggagagaggagagagggagggaagagagugac

SEQ ID NO: 185949 - RNA, 22 nt, Human
ggagagaggagccagccaggga

SEQ ID NO: 185950 - RNA, 32 nt, Human
ggagagaggaggaggaggaggcugagagaggg

SEQ ID NO: 185951 - RNA, 32 nt, Human
ggagagaggagugaguuuguuuaggugggaag

SEQ ID NO: 185952 - RNA, 32 nt, Human
ggagagaggcagagagacagagagggagagag

SEQ ID NO: 185953 - RNA, 32 nt, Human
ggagagaggcgcgggccagggcucuagcaggg

SEQ ID NO: 185954 - RNA, 22 nt, Human
ggagagaggcggcaggggccag

SEQ ID NO: 185955 - RNA, 32 nt, Human
ggagagaggcugccuuucugguuccaucuccu

SEQ ID NO: 185956 - RNA, 32 nt, Human
ggagagagggacaacaguaggagcaggcagau

SEQ ID NO: 185957 - RNA, 32 nt, Human
ggagagagggagggaggaaggaaggaagggag

SEQ ID NO: 185958 - RNA, 32 nt, Human
ggagagagggagucugcuuagaguuugagguu

SEQ ID NO: 185959 - RNA, 32 nt, Human
ggagagagguguggugggcacacagauugccu

SEQ ID NO: 185960 - RNA, 32 nt, Human
ggagagaguucuugugguugcuuuuguugcuu

SEQ ID NO: 185961 - RNA, 32 nt, Human
ggagagaguuuggacaucucacucaaaaguac

SEQ ID NO: 185962 - RNA, 32 nt, Human
ggagagaugaaaaaggaggaugaggagaagaa

SEQ ID NO: 185963 - RNA, 24 nt, Human
ggagagaugcuacccggaguucca

SEQ ID NO: 185964 - RNA, 20 nt, Human
ggagagaugcugaggagucc

SEQ ID NO: 185965 - RNA, 19 nt, Human
ggagagauggauucugggg

SEQ ID NO: 185966 - RNA, 31 nt, Human
ggagagauggcaucuguuucaaccuggauga

SEQ ID NO: 185967 - RNA, 32 nt, Human
ggagagaugguauacagcagguaacugugaau

SEQ ID NO: 185968 - RNA, 32 nt, Human
ggagagauggucagaaauauccuguacauauu

SEQ ID NO: 185969 - RNA, 32 nt, Human
ggagagauugcuugcuucacuuguacaagaau

SEQ ID NO: 185970 - RNA, 32 nt, Human
ggagagcaaagcacaagcuugccugaagaaug

SEQ ID NO: 185971 - RNA, 32 nt, Human
ggagagcaaaggagucaggaauggcuuuuacu

SEQ ID NO: 185972 - RNA, 32 nt, Human
ggagagcaacacaggauggucucugccaugaa

SEQ ID NO: 185973 - RNA, 32 nt, Human
ggagagcaaggucaugaaggaggggaccucuc

SEQ ID NO: 185974 - RNA, 23 nt, Human
ggagagcaagguggcagccggga

SEQ ID NO: 185975 - RNA, 22 nt, Human
ggagagcaagucuguuuuggga

SEQ ID NO: 185976 - RNA, 31 nt, Human
ggagagcaaguuucugggccuguucccauaa

SEQ ID NO: 185977 - RNA, 32 nt, Human
ggagagcacagcccagcguuggggccgggacc

SEQ ID NO: 185978 - RNA, 22 nt, Human
ggagagcacucgguugucuuua

SEQ ID NO: 185979 - RNA, 20 nt, Human
ggagagcagaaagcuuuggg

SEQ ID NO: 185980 - RNA, 23 nt, Human
ggagagcagaaaguugucugggg

SEQ ID NO: 185981 - RNA, 32 nt, Human
ggagagcagaaccuugcgcgggcacagggccc

SEQ ID NO: 185982 - RNA, 32 nt, Human
ggagagcagagcugugugguccuaaucauggu

SEQ ID NO: 185983 - RNA, 24 nt, Human
ggagagcagaggaguggguuggga

SEQ ID NO: 185984 - RNA, 22 nt, Human
ggagagcagaggcaggauucug

SEQ ID NO: 185985 - RNA, 32 nt, Human
ggagagcagcaaccuaaacgaagaggacacug

SEQ ID NO: 185986 - RNA, 21 nt, Human
ggagagcagcagcuggccgga

SEQ ID NO: 185987 - RNA, 32 nt, Human
ggagagcaggacguugagauauccugacccuc

SEQ ID NO: 185988 - RNA, 32 nt, Human
ggagagcaggcagggugggagugagcguggcu

SEQ ID NO: 185989 - RNA, 20 nt, Human
ggagagcaggcugaguuugg

SEQ ID NO: 185990 - RNA, 32 nt, Human
ggagagcaggcuggcagcucuccagucaggag

SEQ ID NO: 185991 - RNA, 21 nt, Human
ggagagcagggccuggugugg

SEQ ID NO: 185992 - RNA, 32 nt, Human
ggagagcaggggugaggagagcaggagaguag

SEQ ID NO: 185993 - RNA, 32 nt, Human
ggagagcagggugucagcaagaaaaccuguga

SEQ ID NO: 185994 - RNA, 32 nt, Human
ggagagcagugcagugacacagaugagaagcu

SEQ ID NO: 185995 - RNA, 32 nt, Human
ggagagcaguuaguacaaagaggcagaacagu

SEQ ID NO: 185996 - RNA, 32 nt, Human
ggagagcaucauucucugccuaggcaaggccc

SEQ ID NO: 185997 - RNA, 32 nt, Human
ggagagcauccaucuucugacauacaacugag

SEQ ID NO: 185998 - RNA, 32 nt, Human
ggagagcaugggcaauggagacccaccaauga

SEQ ID NO: 185999 - RNA, 20 nt, Human
ggagagcauugaaaacucug

SEQ ID NO: 186000 - RNA, 32 nt, Human
ggagagccagaguucagguucagaucugggcu

SEQ ID NO: 186001 - RNA, 32 nt, Human
ggagagccagccaccagccagccacugcucca

SEQ ID NO: 186002 - RNA, 32 nt, Human
ggagagccagcugugggguccagacuuguugg

SEQ ID NO: 186003 - RNA, 32 nt, Human
ggagagccaggagaacuggggacuuagaaaau

SEQ ID NO: 186004 - RNA, 32 nt, Human
ggagagccaguguguaccugaaugacagcuug

SEQ ID NO: 186005 - RNA, 32 nt, Human
ggagagcccaaagcucccccagaucuuuagga

SEQ ID NO: 186006 - RNA, 32 nt, Human
ggagagcccacugucccacucccacaugucug

SEQ ID NO: 186007 - RNA, 25 nt, Human
ggagagcccagaaggacauugcaga

SEQ ID NO: 186008 - RNA, 22 nt, Human
ggagagcccagaggcugccaga

SEQ ID NO: 186009 - RNA, 32 nt, Human
ggagagcccaggauucaacacgggccuugaga

SEQ ID NO: 186010 - RNA, 21 nt, Human
ggagagccccauagacuaaga

SEQ ID NO: 186011 - RNA, 22 nt, Human
ggagagcccccacucucugcca

SEQ ID NO: 186012 - RNA, 32 nt, Human
ggagagccccuggggcgaggaggcgagggcag

SEQ ID NO: 186013 - RNA, 20 nt, Human
ggagagcccggacggagcag

SEQ ID NO: 186014 - RNA, 26 nt, Human
ggagagccgcgaagggccugccuuca

SEQ ID NO: 186015 - RNA, 32 nt, Human
ggagagccuagaccaggcuccgggcugccaau

SEQ ID NO: 186016 - RNA, 32 nt, Human
ggagagccuaggggcuuagaccagccauauuu

SEQ ID NO: 186017 - RNA, 20 nt, Human
ggagagccucaugcccugga

SEQ ID NO: 186018 - RNA, 25 nt, Human
ggagagccucgcgggggagccggga

SEQ ID NO: 186019 - RNA, 18 nt, Human
ggagagccucucugugca

SEQ ID NO: 186020 - RNA, 25 nt, Human
ggagagccugcccucagacugcagg

SEQ ID NO: 186021 - RNA, 32 nt, Human
ggagagccugcggguaaaguaccaccugcuac

SEQ ID NO: 186022 - RNA, 24 nt, Human
ggagagccuggauaagacugcaga

SEQ ID NO: 186023 - RNA, 32 nt, Human
ggagagccuggcccuguccuuugcuacccagg

SEQ ID NO: 186024 - RNA, 21 nt, Human
ggagagccuggccugccacca

SEQ ID NO: 186025 - RNA, 32 nt, Human
ggagagccugggaacuuucaucccccacugaa

SEQ ID NO: 186026 - RNA, 24 nt, Human
ggagagccugggcaagacuggaga

SEQ ID NO: 186027 - RNA, 22 nt, Human
ggagagccugugaggaccgaga

SEQ ID NO: 186028 - RNA, 32 nt, Human
ggagagccugugaguuugaggcugcaaugagc

SEQ ID NO: 186029 - RNA, 32 nt, Human
ggagagccuuggcccaagucuggaccaaugac

SEQ ID NO: 186030 - RNA, 32 nt, Human
ggagagcgacucaggaacaagugugggagagg

SEQ ID NO: 186031 - RNA, 23 nt, Human
ggagagcgagggggcccccagcu

SEQ ID NO: 186032 - RNA, 32 nt, Human
ggagagcgcacacccaggcagcccucugcgga

SEQ ID NO: 186033 - RNA, 23 nt, Human
ggagagcgccagggccugagcug

SEQ ID NO: 186034 - RNA, 23 nt, Human
ggagagcgcucgggucaugucug

SEQ ID NO: 186035 - RNA, 32 nt, Human
ggagagcgcuggggcuaccaggugggcuccca

SEQ ID NO: 186036 - RNA, 32 nt, Human
ggagagcggccugcuugugcagugggucgccg

SEQ ID NO: 186037 - RNA, 32 nt, Human
ggagagcgugugcgcuccagcccagcccgcug

SEQ ID NO: 186038 - RNA, 32 nt, Human
ggagagcuaaaauguucaugaguaucaagcag

SEQ ID NO: 186039 - RNA, 32 nt, Human
ggagagcuauccacucaggccccagugccucu

SEQ ID NO: 186040 - RNA, 32 nt, Human
ggagagcuaugagaauaaagaggccuaucaga

SEQ ID NO: 186041 - RNA, 32 nt, Human
ggagagcucagauguggagcuggaccuccaga

SEQ ID NO: 186042 - RNA, 23 nt, Human
ggagagcucagcugagaauucug

SEQ ID NO: 186043 - RNA, 16 nt, Human
ggagagcucccugggg

SEQ ID NO: 186044 - RNA, 32 nt, Human
ggagagcucugccuagucugguuuggcgaggg

SEQ ID NO: 186045 - RNA, 32 nt, Human
ggagagcugagagagccuccuguccauggaga

SEQ ID NO: 186046 - RNA, 32 nt, Human
ggagagcugcggcaucacaucgcuugggccca

SEQ ID NO: 186047 - RNA, 32 nt, Human
ggagagcugcucggacaggcccccucccggcc

SEQ ID NO: 186048 - RNA, 32 nt, Human
ggagagcugcuuccaguggauaguugaugaga

SEQ ID NO: 186049 - RNA, 32 nt, Human
ggagagcuggcaggacccuguggcugggcugg

SEQ ID NO: 186050 - RNA, 17 nt, Human
ggagagcuggccaggga

SEQ ID NO: 186051 - RNA, 32 nt, Human
ggagagcuggcucugcagugggggagggaugc

SEQ ID NO: 186052 - RNA, 32 nt, Human
ggagagcuggcugcgcgggcugugagugagac

SEQ ID NO: 186053 - RNA, 32 nt, Human
ggagagcugguccuccagcccuggcaggcccu

SEQ ID NO: 186054 - RNA, 32 nt, Human
ggagagcuugacacuucgccucccugauggcc

SEQ ID NO: 186055 - RNA, 32 nt, Human
ggagagcuuugagggccccugcuuugggacuc

SEQ ID NO: 186056 - RNA, 32 nt, Human
ggagaggaagagaaagaaaaagagacagagau

SEQ ID NO: 186057 - RNA, 20 nt, Human
ggagaggaagaggaggaaga

SEQ ID NO: 186058 - RNA, 32 nt, Human
ggagaggaagcauauguggaaggagcauuucc

SEQ ID NO: 186059 - RNA, 32 nt, Human
ggagaggaaggaggugggggagagggcugggg

SEQ ID NO: 186060 - RNA, 32 nt, Human
ggagaggaagggaaggaaggagagggaggggg

SEQ ID NO: 186061 - RNA, 32 nt, Human
ggagaggaagggacauagcaguauuucaggug

SEQ ID NO: 186062 - RNA, 32 nt, Human
ggagaggaagggcugaaagccccaagccccau

SEQ ID NO: 186063 - RNA, 32 nt, Human
ggagaggaagguuggcuccaggccaggugucc

SEQ ID NO: 186064 - RNA, 32 nt, Human
ggagaggaagugaaagcgucaaguacaucccg

SEQ ID NO: 186065 - RNA, 20 nt, Human
ggagaggacaaagagacaga

SEQ ID NO: 186066 - RNA, 32 nt, Human
ggagaggacacagagacacagagaaggaagca

SEQ ID NO: 186067 - RNA, 20 nt, Human
ggagaggacacagagacaga

SEQ ID NO: 186068 - RNA, 32 nt, Human
ggagaggacacaugaaggcaccacagucccag

SEQ ID NO: 186069 - RNA, 32 nt, Human
ggagaggaccccagccagcugugugacagcug

SEQ ID NO: 186070 - RNA, 32 nt, Human
ggagaggacccggacccaggacccucugagcu

SEQ ID NO: 186071 - RNA, 32 nt, Human
ggagaggacugauucagggcccccucagcugu

SEQ ID NO: 186072 - RNA, 32 nt, Human
ggagaggagagaagcuggacuccaggcaugac

SEQ ID NO: 186073 - RNA, 32 nt, Human
ggagaggagagccagagaaaugacagggaauc

SEQ ID NO: 186074 - RNA, 32 nt, Human
ggagaggagagggcaaaggcgaggcgggggag

SEQ ID NO: 186075 - RNA, 32 nt, Human
ggagaggagagggcggcggcggcggugggagg

SEQ ID NO: 186076 - RNA, 32 nt, Human
ggagaggagcaguggaggggcccaggcucuga

SEQ ID NO: 186077 - RNA, 32 nt, Human
ggagaggagccggaauggagggcagaggugaa

SEQ ID NO: 186078 - RNA, 32 nt, Human
ggagaggagcuggcccggaaggcgugguugug

SEQ ID NO: 186079 - RNA, 32 nt, Human
ggagaggagcuguacccugcaaagucacaggg

SEQ ID NO: 186080 - RNA, 32 nt, Human
ggagaggaggaugagcagaacuccuaugcagc

SEQ ID NO: 186081 - RNA, 32 nt, Human
ggagaggaggcagcggcaguuugagccccugu

SEQ ID NO: 186082 - RNA, 32 nt, Human
ggagaggaggcaggggcugggcugggggcgca

SEQ ID NO: 186083 - RNA, 32 nt, Human
ggagaggaggcuguugguaggaaaguggcagg

SEQ ID NO: 186084 - RNA, 32 nt, Human
ggagaggaggcuucagucucaguggcucagcc

SEQ ID NO: 186085 - RNA, 32 nt, Human
ggagaggaggcuucagucucagugguucagcu

SEQ ID NO: 186086 - RNA, 32 nt, Human
ggagaggaggggcagaggagcugccaggggaa

SEQ ID NO: 186087 - RNA, 32 nt, Human
ggagaggaggggccuggaguugccgaggaagu

SEQ ID NO: 186088 - RNA, 32 nt, Human
ggagaggagguguggaguggaggggucagcag

SEQ ID NO: 186089 - RNA, 32 nt, Human
ggagaggauugugcugagcucaugggauuaca

SEQ ID NO: 186090 - RNA, 32 nt, Human
ggagaggcaagaaaauuaugcuguccauagaa

SEQ ID NO: 186091 - RNA, 32 nt, Human
ggagaggcacacauccacuagcaauauccagg

SEQ ID NO: 186092 - RNA, 32 nt, Human
ggagaggcacagaauggcuuccucuguugauc

SEQ ID NO: 186093 - RNA, 32 nt, Human
ggagaggcaccaugggcguggaggggcuuccc

SEQ ID NO: 186094 - RNA, 32 nt, Human
ggagaggcagcuuuccagccuugguggggaag

SEQ ID NO: 186095 - RNA, 32 nt, Human
ggagaggcaggcagagggcagugguucuccca

SEQ ID NO: 186096 - RNA, 32 nt, Human
ggagaggcaguagagucaggcugcaguggaau

SEQ ID NO: 186097 - RNA, 32 nt, Human
ggagaggcagucggaugcaggcugagaccauc

SEQ ID NO: 186098 - RNA, 32 nt, Human
ggagaggccaguugucacgugccugaaacaug

SEQ ID NO: 186099 - RNA, 32 nt, Human
ggagaggccauuggcucccagagggaacagug

SEQ ID NO: 186100 - RNA, 32 nt, Human
ggagaggcccauagggcugaguggggucgggu

SEQ ID NO: 186101 - RNA, 18 nt, Human
ggagaggcccggggccag

SEQ ID NO: 186102 - RNA, 17 nt, Human
ggagaggcccucaggga

SEQ ID NO: 186103 - RNA, 32 nt, Human
ggagaggccuccaggaauguggggacuuccag

SEQ ID NO: 186104 - RNA, 32 nt, Human
ggagaggccucgggaugucucuggcagaugag

SEQ ID NO: 186105 - RNA, 16 nt, Human
ggagaggccucgggga

SEQ ID NO: 186106 - RNA, 32 nt, Human
ggagaggccuugguacccccucuccccugggg

SEQ ID NO: 186107 - RNA, 19 nt, Human
ggagaggcggucccggugu

SEQ ID NO: 186108 - RNA, 32 nt, Human
ggagaggcucagccuggcucccuucccuggag

SEQ ID NO: 186109 - RNA, 32 nt, Human
ggagaggcucugucuccuuccugcugccagga

SEQ ID NO: 186110 - RNA, 32 nt, Human
ggagaggcugcugaauccagggccaggagggc

SEQ ID NO: 186111 - RNA, 32 nt, Human
ggagaggcugcuggaagagguggagaagcugu

SEQ ID NO: 186112 - RNA, 32 nt, Human
ggagaggcuggaccaggccuugcugggagcca

SEQ ID NO: 186113 - RNA, 32 nt, Human
ggagaggcugugaaaggagggcgaggacauuu

SEQ ID NO: 186114 - RNA, 32 nt, Human
ggagaggcuuccugaugcucuaccccuucagc

SEQ ID NO: 186115 - RNA, 32 nt, Human
ggagaggcuuccuuuguuacagcugggaaaga

SEQ ID NO: 186116 - RNA, 32 nt, Human
ggagagggaaccagauaugcagaucagagaua

SEQ ID NO: 186117 - RNA, 32 nt, Human
ggagagggaagaggagagaaaagacagggacu

SEQ ID NO: 186118 - RNA, 32 nt, Human
ggagagggaaggcagggguggaccgccaugag

SEQ ID NO: 186119 - RNA, 32 nt, Human
ggagagggaagggaagucaggcuugggcacgg

SEQ ID NO: 186120 - RNA, 32 nt, Human
ggagagggacuuccagacuucagcucgacgca

SEQ ID NO: 186121 - RNA, 32 nt, Human
ggagagggagaaaaggaggagaacaggagacg

SEQ ID NO: 186122 - RNA, 32 nt, Human
ggagagggagagagcgaacacccacgcugguu

SEQ ID NO: 186123 - RNA, 32 nt, Human
ggagagggagagaggagcggaagcugagggug

SEQ ID NO: 186124 - RNA, 32 nt, Human
ggagagggagagagggggagagaaggagagcg

SEQ ID NO: 186125 - RNA, 32 nt, Human
ggagagggagggaggaaggaagggagggaggg

SEQ ID NO: 186126 - RNA, 18 nt, Human
ggagagggagggccggga

SEQ ID NO: 186127 - RNA, 32 nt, Human
ggagagggaguggagggucaggugagaucuca

SEQ ID NO: 186128 - RNA, 32 nt, Human
ggagagggauagaggagggagagccagcccag

SEQ ID NO: 186129 - RNA, 32 nt, Human
ggagagggaucucuaguuuuugugguuuaauu

SEQ ID NO: 186130 - RNA, 32 nt, Human
ggagagggaugcaggccagccagggauccagc

SEQ ID NO: 186131 - RNA, 32 nt, Human
ggagagggcaauagagggaagacugaggcuga

SEQ ID NO: 186132 - RNA, 32 nt, Human
ggagagggccaccacgcucccuuccccucgcc

SEQ ID NO: 186133 - RNA, 20 nt, Human
ggagagggcgcgggggccgg

SEQ ID NO: 186134 - RNA, 32 nt, Human
ggagagggcucagccugccauaacuccaagug

SEQ ID NO: 186135 - RNA, 32 nt, Human
ggagagggcuggggcaggggagagggaaagga

SEQ ID NO: 186136 - RNA, 32 nt, Human
ggagaggggaaugguggugguggggaaugcag

SEQ ID NO: 186137 - RNA, 32 nt, Human
ggagaggggaccccaccaugcccaaagucuuc

SEQ ID NO: 186138 - RNA, 19 nt, Human
ggagaggggacuuaguaaa

SEQ ID NO: 186139 - RNA, 32 nt, Human
ggagaggggagaagaaggaagggaagggcaga

SEQ ID NO: 186140 - RNA, 32 nt, Human
ggagaggggagaagaagggaaaacccaggaaa

SEQ ID NO: 186141 - RNA, 32 nt, Human
ggagaggggagaggagagaguuugggaaaggg

SEQ ID NO: 186142 - RNA, 32 nt, Human
ggagaggggaggacuccucucccuacgccagc

SEQ ID NO: 186143 - RNA, 23 nt, Human
ggagaggggagggaugccuggga

SEQ ID NO: 186144 - RNA, 32 nt, Human
ggagaggggagugcagggcaccaccugggcga

SEQ ID NO: 186145 - RNA, 19 nt, Human
ggagaggggcaaccuggga

SEQ ID NO: 186146 - RNA, 32 nt, Human
ggagaggggcaccagaaucugcauuuguagug

SEQ ID NO: 186147 - RNA, 24 nt, Human
ggagaggggccagggaaguggaug

SEQ ID NO: 186148 - RNA, 32 nt, Human
ggagaggggcuguccauggcagcuggucuuua

SEQ ID NO: 186149 - RNA, 32 nt, Human
ggagagggggccagggccagaggggacagagg

SEQ ID NO: 186150 - RNA, 18 nt, Human
ggagagggggcuccggga

SEQ ID NO: 186151 - RNA, 32 nt, Human
ggagaggggguuucaccauguuggccagucug

SEQ ID NO: 186152 - RNA, 32 nt, Human
ggagaggggucccucaacagucagccucaccu

SEQ ID NO: 186153 - RNA, 32 nt, Human
ggagaggggugugauggggcagaggaacuuac

SEQ ID NO: 186154 - RNA, 32 nt, Human
ggagaggguggaaggggaauaagaagacauuc

SEQ ID NO: 186155 - RNA, 32 nt, Human
ggagagggugguaaguggggaggacuuuggua

SEQ ID NO: 186156 - RNA, 32 nt, Human
ggagagguaggguggagcggggcagagaaaau

SEQ ID NO: 186157 - RNA, 32 nt, Human
ggagaggucaaaacauccaccuaccuucaaaa

SEQ ID NO: 186158 - RNA, 19 nt, Human
ggagaggucacuccggaga

SEQ ID NO: 186159 - RNA, 32 nt, Human
ggagaggucauugucacccaagcagaggccac

SEQ ID NO: 186160 - RNA, 17 nt, Human
ggagaggucccugcggg

SEQ ID NO: 186161 - RNA, 32 nt, Human
ggagaggucugagggaagggaggcaggcagcu

SEQ ID NO: 186162 - RNA, 32 nt, Human
ggagaggucuuaaccucuguucucagacucug

SEQ ID NO: 186163 - RNA, 32 nt, Human
ggagaggugacaccucacuaaggggccgaccc

SEQ ID NO: 186164 - RNA, 32 nt, Human
ggagaggugcagcugcagcaguguucuaccgg

SEQ ID NO: 186165 - RNA, 32 nt, Human
ggagaggugcagcugggccguccagcaucaaa

SEQ ID NO: 186166 - RNA, 32 nt, Human
ggagaggugccuggcuucuaccugggugcuca

SEQ ID NO: 186167 - RNA, 32 nt, Human
ggagaggugcugucugcuggagccucuagucc

SEQ ID NO: 186168 - RNA, 18 nt, Human
ggagagguggcucugaga

SEQ ID NO: 186169 - RNA, 32 nt, Human
ggagagguuacccgagaagcacuugagcauga

SEQ ID NO: 186170 - RNA, 32 nt, Human
ggagagguucaggcacauggcauagcugcuau

SEQ ID NO: 186171 - RNA, 32 nt, Human
ggagagguugcaaaccaaaucaagaguauuua

SEQ ID NO: 186172 - RNA, 32 nt, Human
ggagagguugggcagugagugagggaccccua

SEQ ID NO: 186173 - RNA, 32 nt, Human
ggagagguuuugcucacagggacucuccauau

SEQ ID NO: 186174 - RNA, 32 nt, Human
ggagaguaccugcugcaggaccuggaggucag

SEQ ID NO: 186175 - RNA, 21 nt, Human
ggagaguacuguggagagcuc

SEQ ID NO: 186176 - RNA, 32 nt, Human
ggagaguagcgccauugugcucuucgccuucc

SEQ ID NO: 186177 - RNA, 32 nt, Human
ggagaguaggagagaccgaaaaggcugggggu

SEQ ID NO: 186178 - RNA, 32 nt, Human
ggagaguaguaagacgugaaaggaauacacuu

SEQ ID NO: 186179 - RNA, 32 nt, Human
ggagaguagucagaggcccaccuuccugugac

SEQ ID NO: 186180 - RNA, 20 nt, Human
ggagaguaugcgagaaccua

SEQ ID NO: 186181 - RNA, 32 nt, Human
ggagagucaaagggaucaaggagaguugggga

SEQ ID NO: 186182 - RNA, 26 nt, Human
ggagagucaacaucuggaggauuuua

SEQ ID NO: 186183 - RNA, 31 nt, Human
ggagagucacucaauggacaggcgagaaagc

SEQ ID NO: 186184 - RNA, 32 nt, Human
ggagagucagccuguggacccugugcacagcu

SEQ ID NO: 186185 - RNA, 32 nt, Human
ggagagucaugagcugucuggauguuauguac

SEQ ID NO: 186186 - RNA, 32 nt, Human
ggagagucauuuuccccagacacuacauuugg

SEQ ID NO: 186187 - RNA, 32 nt, Human
ggagaguccaaacagaacacucuuuugaguag

SEQ ID NO: 186188 - RNA, 32 nt, Human
ggagagucccuuguaaguuuggcuccuccaug

SEQ ID NO: 186189 - RNA, 32 nt, Human
ggagaguccucagcaaccucuggaacacagga

SEQ ID NO: 186190 - RNA, 32 nt, Human
ggagaguccugcugcccuccagccgggcuccu

SEQ ID NO: 186191 - RNA, 32 nt, Human
ggagaguccuggggccuuguuuugaaaaagac

SEQ ID NO: 186192 - RNA, 32 nt, Human
ggagagucugccuuaugucccuuccuugugga

SEQ ID NO: 186193 - RNA, 32 nt, Human
ggagagucugggguccugagaggcagagaccu

SEQ ID NO: 186194 - RNA, 32 nt, Human
ggagagugaagccaagccccagagccacggac

SEQ ID NO: 186195 - RNA, 32 nt, Human
ggagagugaaggagggauaugugguagagcac

SEQ ID NO: 186196 - RNA, 32 nt, Human
ggagagugagaaagaggaugagagggaugguc

SEQ ID NO: 186197 - RNA, 24 nt, Human
ggagagugaggaugaccaucucca

SEQ ID NO: 186198 - RNA, 25 nt, Human
ggagagugaggcuaggcaucuauca

SEQ ID NO: 186199 - RNA, 24 nt, Human
ggagagugaggggccccgccagcc

SEQ ID NO: 186200 - RNA, 32 nt, Human
ggagagugauaaggaaagaacucaccuuucug

SEQ ID NO: 186201 - RNA, 32 nt, Human
ggagagugaugauucugugaauauugcugaga

SEQ ID NO: 186202 - RNA, 32 nt, Human
ggagagugccucuccccucugccauccacguc

SEQ ID NO: 186203 - RNA, 32 nt, Human
ggagagugcuugaacccaggaggcggagguug

SEQ ID NO: 186204 - RNA, 32 nt, Human
ggagaguggaaggacuguggcugcagguggga

SEQ ID NO: 186205 - RNA, 32 nt, Human
ggagaguggccgggccggcagagcagggggcc

SEQ ID NO: 186206 - RNA, 32 nt, Human
ggagaguggccuccaugauggaagaugauagg

SEQ ID NO: 186207 - RNA, 32 nt, Human
ggagaguggggagcaggguggggaagagggga

SEQ ID NO: 186208 - RNA, 32 nt, Human
ggagaguggggagcccgucuucugcugagugc

SEQ ID NO: 186209 - RNA, 22 nt, Human
ggagaguggggggcucauucca

SEQ ID NO: 186210 - RNA, 32 nt, Human
ggagaguggggugggucuggaaacccccgagg

SEQ ID NO: 186211 - RNA, 32 nt, Human
ggagagugguacuggcaguuuauggcugaaau

SEQ ID NO: 186212 - RNA, 32 nt, Human
ggagagugucugcagggcggcggagggcagag

SEQ ID NO: 186213 - RNA, 32 nt, Human
ggagagugugacauguggggagaggaccagcu

SEQ ID NO: 186214 - RNA, 32 nt, Human
ggagaguguggaguccagagugcugccaggac

SEQ ID NO: 186215 - RNA, 32 nt, Human
ggagagugugggcagcuggagccagguccucc

SEQ ID NO: 186216 - RNA, 32 nt, Human
ggagagugugucuuuccuucugugucuggugu

SEQ ID NO: 186217 - RNA, 32 nt, Human
ggagagugugugugggcagcuguguguaagcc

SEQ ID NO: 186218 - RNA, 20 nt, Human
ggagaguuccaugcagugug

SEQ ID NO: 186219 - RNA, 32 nt, Human
ggagaguugagauuuccuccucccucuggcug

SEQ ID NO: 186220 - RNA, 32 nt, Human
ggagaguuguucaggucacugcacaaauauau

SEQ ID NO: 186221 - RNA, 32 nt, Human
ggagauaaaaggaugaauuucugugacugcca

SEQ ID NO: 186222 - RNA, 32 nt, Human
ggagauaaacagccaaauagcaaauaggucac

SEQ ID NO: 186223 - RNA, 32 nt, Human
ggagauaagacuggggagagacaccccaaccu

SEQ ID NO: 186224 - RNA, 32 nt, Human
ggagauacaaagcaaggagcuggugagcccag

SEQ ID NO: 186225 - RNA, 32 nt, Human
ggagauacaaaguagacccaggaaugaggcua

SEQ ID NO: 186226 - RNA, 19 nt, Human
ggagauacaggugugugug

SEQ ID NO: 186227 - RNA, 16 nt, Human
ggagauacaucuggga

SEQ ID NO: 186228 - RNA, 32 nt, Human
ggagauagagccuugcucugccacccaggcug

SEQ ID NO: 186229 - RNA, 32 nt, Human
ggagauagagucucgcucugucgcccagggug

SEQ ID NO: 186230 - RNA, 32 nt, Human
ggagauagccaaggaacaggauuuccccuagc

SEQ ID NO: 186231 - RNA, 32 nt, Human
ggagauaggcuccugaguauuuugaaaaacaa

SEQ ID NO: 186232 - RNA, 23 nt, Human
ggagauaggggagaaccugcagg

SEQ ID NO: 186233 - RNA, 32 nt, Human
ggagauaggguuucacaauguuggccaugcug

SEQ ID NO: 186234 - RNA, 32 nt, Human
ggagauaucugagggaggaggccaccucucca

SEQ ID NO: 186235 - RNA, 31 nt, Human
ggagauauuugauacucucauuuaaacuggu

SEQ ID NO: 186236 - RNA, 32 nt, Human
ggagaucaaauauguaaaaucauuucaaauau

SEQ ID NO: 186237 - RNA, 32 nt, Human
ggagaucaagcaagggcugccuuucaggaguc

SEQ ID NO: 186238 - RNA, 32 nt, Human
ggagaucaagccuuuuuccuaugcucaugagc

SEQ ID NO: 186239 - RNA, 32 nt, Human
ggagaucacgccacugcaacuccagcuugggu

SEQ ID NO: 186240 - RNA, 32 nt, Human
ggagaucacgccacugcgcuccagccugggcg

SEQ ID NO: 186241 - RNA, 21 nt, Human
ggagaucagccgaaagagcaa

SEQ ID NO: 186242 - RNA, 23 nt, Human
ggagaucagcguccagcaaauaa

SEQ ID NO: 186243 - RNA, 32 nt, Human
ggagaucaugaaggaguucaaaagccagagca

SEQ ID NO: 186244 - RNA, 32 nt, Human
ggagaucaugaucuuuauacugugaauagcag

SEQ ID NO: 186245 - RNA, 32 nt, Human
ggagaucaugccacugcaccccagccugggca

SEQ ID NO: 186246 - RNA, 32 nt, Human
ggagaucaugccacugcauucuagccugggca

SEQ ID NO: 186247 - RNA, 32 nt, Human
ggagaucaugccagugcacuccagccugggca

SEQ ID NO: 186248 - RNA, 32 nt, Human
ggagaucauggagcuaagaagcagagccaagu

SEQ ID NO: 186249 - RNA, 32 nt, Human
ggagaucauuuccuuuuuaacuuuguucaggu

SEQ ID NO: 186250 - RNA, 22 nt, Human
ggagauccagaccauccuggcc

SEQ ID NO: 186251 - RNA, 24 nt, Human
ggagauccauaggcagccugcagg

SEQ ID NO: 186252 - RNA, 32 nt, Human
ggagaucccagccugggcagccugcgcugcug

SEQ ID NO: 186253 - RNA, 18 nt, Human
ggagaucccucccuucuc

SEQ ID NO: 186254 - RNA, 32 nt, Human
ggagaucccugggggcuccucuugccuggcag

SEQ ID NO: 186255 - RNA, 32 nt, Human
ggagaucccuuucaauuauuucugggaugcag

SEQ ID NO: 186256 - RNA, 25 nt, Human
ggagauccuggggccuuaccuacua

SEQ ID NO: 186257 - RNA, 32 nt, Human
ggagaucgagaccauggugaaaccccgucucu

SEQ ID NO: 186258 - RNA, 32 nt, Human
ggagaucgcaccacugcccuccagccuaggug

SEQ ID NO: 186259 - RNA, 32 nt, Human
ggagaucgcaucauugcacucuagccugggcc

SEQ ID NO: 186260 - RNA, 32 nt, Human
ggagaucgccccacuacacuccagccugguca

SEQ ID NO: 186261 - RNA, 32 nt, Human
ggagaucgcgccacugcacuccagccugggcg

SEQ ID NO: 186262 - RNA, 32 nt, Human
ggagaucgcgccauugcacuccagccugggcg

SEQ ID NO: 186263 - RNA, 32 nt, Human
ggagaucgcggaggggagggggcgggaggggg

SEQ ID NO: 186264 - RNA, 32 nt, Human
ggagaucgcuggaacucaggaggcagagguug

SEQ ID NO: 186265 - RNA, 32 nt, Human
ggagaucggucaccaggagagcagccacaaag

SEQ ID NO: 186266 - RNA, 32 nt, Human
ggagaucgugccauugcacuccagccugggcg

SEQ ID NO: 186267 - RNA, 32 nt, Human
ggagaucuacagccaccugcucucugugggcu

SEQ ID NO: 186268 - RNA, 32 nt, Human
ggagaucuccauccuuuguccagagcagaaca

SEQ ID NO: 186269 - RNA, 32 nt, Human
ggagaucucuccucagcuggaaugaggaaugu

SEQ ID NO: 186270 - RNA, 32 nt, Human
ggagaucugcagcugggccaugcucacuuccu

SEQ ID NO: 186271 - RNA, 32 nt, Human
ggagaucugggaggggucaggagccacuaagu

SEQ ID NO: 186272 - RNA, 32 nt, Human
ggagaucuugccacugcacuccagccugggca

SEQ ID NO: 186273 - RNA, 32 nt, Human
ggagaugaaggccacauacaucaaccucaagc

SEQ ID NO: 186274 - RNA, 32 nt, Human
ggagaugaagucacugucauuugcucggagau

SEQ ID NO: 186275 - RNA, 19 nt, Human
ggagaugaauccugggccg

SEQ ID NO: 186276 - RNA, 32 nt, Human
ggagaugaccaacagggggcaggaccugggga

SEQ ID NO: 186277 - RNA, 32 nt, Human
ggagaugaccaugauuuucaggaacagcagcc

SEQ ID NO: 186278 - RNA, 32 nt, Human
ggagaugacgacacaucaugcauggaagaagu

SEQ ID NO: 186279 - RNA, 32 nt, Human
ggagaugacgccauugcacuccagccugggug

SEQ ID NO: 186280 - RNA, 32 nt, Human
ggagaugagauagggaaggagcagggaugaga

SEQ ID NO: 186281 - RNA, 29 nt, Human
ggagaugagcacgaagaaagaagacagua

SEQ ID NO: 186282 - RNA, 23 nt, Human
ggagaugagggccaccuugcagg

SEQ ID NO: 186283 - RNA, 23 nt, Human
ggagaugagggccguggccugca

SEQ ID NO: 186284 - RNA, 32 nt, Human
ggagaugauaagggccaaaggagcagucaggg

SEQ ID NO: 186285 - RNA, 32 nt, Human
ggagaugauaguggcuugcaugauggugguag

SEQ ID NO: 186286 - RNA, 32 nt, Human
ggagaugaugccacuguacugcaaccugggac

SEQ ID NO: 186287 - RNA, 24 nt, Human
ggagaugauggauaaggcaaacaa

SEQ ID NO: 186288 - RNA, 32 nt, Human
ggagaugaugucagaggcaucuguuuccuuua

SEQ ID NO: 186289 - RNA, 32 nt, Human
ggagaugauuccuagacuucacaaacacucgg

SEQ ID NO: 186290 - RNA, 31 nt, Human
ggagaugcagagaugcccaugccgagaccca

SEQ ID NO: 186291 - RNA, 32 nt, Human
ggagaugcaggaaggaguaaagagcacuggaa

SEQ ID NO: 186292 - RNA, 32 nt, Human
ggagaugcauuuuccgucuggcucacaggggg

SEQ ID NO: 186293 - RNA, 32 nt, Human
ggagaugccaugagccgcccaaggccuucccc

SEQ ID NO: 186294 - RNA, 32 nt, Human
ggagaugccuggguccuguucuuccuacauaa

SEQ ID NO: 186295 - RNA, 32 nt, Human
ggagaugccuucucccccaccucccaggaccu

SEQ ID NO: 186296 - RNA, 24 nt, Human
ggagaugcgaggaccuaucuauua

SEQ ID NO: 186297 - RNA, 32 nt, Human
ggagaugcgccacugcacuccagccugggcga

SEQ ID NO: 186298 - RNA, 32 nt, Human
ggagaugcgcuugggaggaaauugcagaggcc

SEQ ID NO: 186299 - RNA, 32 nt, Human
ggagaugcggggagcagggugggcaggaauac

SEQ ID NO: 186300 - RNA, 32 nt, Human
ggagaugcgguuucaccauguuggccgggcca

SEQ ID NO: 186301 - RNA, 32 nt, Human
ggagaugcgguuucaccauguuggcugggcca

SEQ ID NO: 186302 - RNA, 32 nt, Human
ggagaugcucacugagcugcugcuuuuaugug

SEQ ID NO: 186303 - RNA, 32 nt, Human
ggagaugcugaucuugaguuguaaugagaaaa

SEQ ID NO: 186304 - RNA, 32 nt, Human
ggagaugcuggccugcgccugcaccugcgccu

SEQ ID NO: 186305 - RNA, 32 nt, Human
ggagaugcugggacccucggggcaggaagucc

SEQ ID NO: 186306 - RNA, 32 nt, Human
ggagaugcugggacugagagugucauggugga

SEQ ID NO: 186307 - RNA, 32 nt, Human
ggagaugcugggauagccauuuccauggcucu

SEQ ID NO: 186308 - RNA, 32 nt, Human
ggagaugcugugccccuggccuugggauccag

SEQ ID NO: 186309 - RNA, 32 nt, Human
ggagaugcugugcugccuacagccuggacagg

SEQ ID NO: 186310 - RNA, 29 nt, Human
ggagauggaagacuucgcccgaggggcgg

SEQ ID NO: 186311 - RNA, 22 nt, Human
ggagauggacggugaugagcuc

SEQ ID NO: 186312 - RNA, 32 nt, Human
ggagauggagaggaaggacuacagaggacaag

SEQ ID NO: 186313 - RNA, 23 nt, Human
ggagauggagaggcgggccugca

SEQ ID NO: 186314 - RNA, 32 nt, Human
ggagauggagaggcgggccugcaagugcgaac

SEQ ID NO: 186315 - RNA, 32 nt, Human
ggagauggaggcagcagacgugcagugccaua

SEQ ID NO: 186316 - RNA, 32 nt, Human
ggagauggaguaauuuugcuguggaaagacuu

SEQ ID NO: 186317 - RNA, 32 nt, Human
ggagauggagucucacucuguugcccaggcug

SEQ ID NO: 186318 - RNA, 32 nt, Human
ggagauggagucucgcucugucgcccaagcug

SEQ ID NO: 186319 - RNA, 32 nt, Human
ggagauggagucuugcucuguugcccaggcug

SEQ ID NO: 186320 - RNA, 32 nt, Human
ggagauggaguuaaacuguuccccuaccuugg

SEQ ID NO: 186321 - RNA, 32 nt, Human
ggagauggauuccguccucgggggcucugggu

SEQ ID NO: 186322 - RNA, 32 nt, Human
ggagauggcaggacacagcaaacaggacacau

SEQ ID NO: 186323 - RNA, 32 nt, Human
ggagauggcgccacugcacucccgucuggggg

SEQ ID NO: 186324 - RNA, 32 nt, Human
ggagauggcguuuuaccauguuggucaggcug

SEQ ID NO: 186325 - RNA, 32 nt, Human
ggagauggcuuccccacuaugggaugacgagg

SEQ ID NO: 186326 - RNA, 32 nt, Human
ggagaugggaagagcaucuccaggcaaugagu

SEQ ID NO: 186327 - RNA, 32 nt, Human
ggagaugggaagggaugggauuucuggguccc

SEQ ID NO: 186328 - RNA, 32 nt, Human
ggagaugggaggaagccgcgggguggagcagg

SEQ ID NO: 186329 - RNA, 32 nt, Human
ggagaugggagguggggaaugaauggaagcug

SEQ ID NO: 186330 - RNA, 31 nt, Human
ggagaugggaugguugcuaugccaagccuug

SEQ ID NO: 186331 - RNA, 32 nt, Human
ggagaugggcaggauuuaguaggacaacucgg

SEQ ID NO: 186332 - RNA, 29 nt, Human
ggagaugggcaucuaccagauguacuugu

SEQ ID NO: 186333 - RNA, 32 nt, Human
ggagauggggaggaagccccaucucugcuguu

SEQ ID NO: 186334 - RNA, 32 nt, Human
ggagauggggccggugcugauggggaacagcu

SEQ ID NO: 186335 - RNA, 18 nt, Human
ggagauggggcucuggga

SEQ ID NO: 186336 - RNA, 32 nt, Human
ggagauggggcucugggagacggccaaggccu

SEQ ID NO: 186337 - RNA, 32 nt, Human
ggagauggggcugaggacagcucaaaaaggag

SEQ ID NO: 186338 - RNA, 32 nt, Human
ggagaugggggcggagggagcuggagcuguca

SEQ ID NO: 186339 - RNA, 32 nt, Human
ggagauggggucuugcuuuguugcccaggcug

SEQ ID NO: 186340 - RNA, 20 nt, Human
ggagaugggguggccugcag

SEQ ID NO: 186341 - RNA, 32 nt, Human
ggagauggggugucaccauguuggccaggcug

SEQ ID NO: 186342 - RNA, 32 nt, Human
ggagaugggguuucacaauguuggccaggcug

SEQ ID NO: 186343 - RNA, 32 nt, Human
ggagaugggguuucaccauguuagccaggaug

SEQ ID NO: 186344 - RNA, 32 nt, Human
ggagaugggguuucaccauguugccaaggcca

SEQ ID NO: 186345 - RNA, 32 nt, Human
ggagaugggguuucaccauguuggccaggcua

SEQ ID NO: 186346 - RNA, 32 nt, Human
ggagaugggguuucaccauguuggccaggcug

SEQ ID NO: 186347 - RNA, 32 nt, Human
ggagaugggguuucaccauguuggccaggcuu

SEQ ID NO: 186348 - RNA, 32 nt, Human
ggagaugggguuucacuauguugccuaagcug

SEQ ID NO: 186349 - RNA, 32 nt, Human
ggagaugggguuucacuguguuggccaggcug

SEQ ID NO: 186350 - RNA, 32 nt, Human
ggagaugggguuucaucauguuggccaggcua

SEQ ID NO: 186351 - RNA, 32 nt, Human
ggagaugggguuucgccauauugaucaggcug

SEQ ID NO: 186352 - RNA, 32 nt, Human
ggagaugggguuucuccauauuggucaggcug

SEQ ID NO: 186353 - RNA, 32 nt, Human
ggagaugggguuuuaccauguuggccagagug

SEQ ID NO: 186354 - RNA, 32 nt, Human
ggagaugggguuuuaccauguuggccaggcug

SEQ ID NO: 186355 - RNA, 32 nt, Human
ggagaugggguuuugccauguugcgcaacuaa

SEQ ID NO: 186356 - RNA, 32 nt, Human
ggagaugggguuuugcuauguugcccaggcug

SEQ ID NO: 186357 - RNA, 32 nt, Human
ggagaugggguuuugucauguuggccagucug

SEQ ID NO: 186358 - RNA, 32 nt, Human
ggagauggguuuucaccauguuggccaggcug

SEQ ID NO: 186359 - RNA, 32 nt, Human
ggagauggucagguugguaggagaagcuauaa

SEQ ID NO: 186360 - RNA, 32 nt, Human
ggagaugguggagucacaggaugaacacaggc

SEQ ID NO: 186361 - RNA, 32 nt, Human
ggagaugguguuucaccauguuggccagacug

SEQ ID NO: 186362 - RNA, 32 nt, Human
ggagaugucaucaagcuccacccuccuggccu

SEQ ID NO: 186363 - RNA, 32 nt, Human
ggagaugugaugacaauugucuuuuggcacaa

SEQ ID NO: 186364 - RNA, 32 nt, Human
ggagauguggcuguaggccauugaggaagacg

SEQ ID NO: 186365 - RNA, 29 nt, Human
ggagauguucccggcgcuggaguccgacu

SEQ ID NO: 186366 - RNA, 32 nt, Human
ggagauuaaaggacagggcauugauggaaggu

SEQ ID NO: 186367 - RNA, 32 nt, Human
ggagauuaaggcaggaggaucacuugagccca

SEQ ID NO: 186368 - RNA, 31 nt, Human
ggagauuaggaaagagaaaagguugagaaga

SEQ ID NO: 186369 - RNA, 32 nt, Human
ggagauuagucauuauagcucagaccuaagcu

SEQ ID NO: 186370 - RNA, 32 nt, Human
ggagauucaagucaugccccagaagcaaggug

SEQ ID NO: 186371 - RNA, 32 nt, Human
ggagauucacuggguucugcauuuucaggauu

SEQ ID NO: 186372 - RNA, 32 nt, Human
ggagauucaggcagacugguggcaguggagua

SEQ ID NO: 186373 - RNA, 32 nt, Human
ggagauuccauuccauuuucaaguguacagcc

SEQ ID NO: 186374 - RNA, 32 nt, Human
ggagauucccucgcagcugagcagaaaacagu

SEQ ID NO: 186375 - RNA, 22 nt, Human
ggagauucccugggccugcagg

SEQ ID NO: 186376 - RNA, 32 nt, Human
ggagauucgggcuguggaaggcucccuagcgu

SEQ ID NO: 186377 - RNA, 32 nt, Human
ggagauucuaggcagaggcuggaaugcaauga

SEQ ID NO: 186378 - RNA, 32 nt, Human
ggagauugaccuggauggggcaggccaccugg

SEQ ID NO: 186379 - RNA, 32 nt, Human
ggagauugagagaaaagguugaaaaugguugc

SEQ ID NO: 186380 - RNA, 32 nt, Human
ggagauugagcugggaggauugcuugagacca

SEQ ID NO: 186381 - RNA, 32 nt, Human
ggagauugaggugggagagagaagcagagcga

SEQ ID NO: 186382 - RNA, 32 nt, Human
ggagauugauucauaauucacaugucaauuuu

SEQ ID NO: 186383 - RNA, 32 nt, Human
ggagauugcaccacugcacuccagccugggug

SEQ ID NO: 186384 - RNA, 23 nt, Human
ggagauugcagaaaaggcuuccc

SEQ ID NO: 186385 - RNA, 32 nt, Human
ggagauugcaguaagccaggaucaugccacug

SEQ ID NO: 186386 - RNA, 32 nt, Human
ggagauugcccaggaucaagggugcgguguug

SEQ ID NO: 186387 - RNA, 32 nt, Human
ggagauugcgccgcugcacuccagccugggcg

SEQ ID NO: 186388 - RNA, 32 nt, Human
ggagauugcucugggcagcagugagucucggc

SEQ ID NO: 186389 - RNA, 32 nt, Human
ggagauuggaauggggacucccagggagaccu

SEQ ID NO: 186390 - RNA, 32 nt, Human
ggagauuggaugccuggcuuucuuugaggaca

SEQ ID NO: 186391 - RNA, 32 nt, Human
ggagauuguaccacugcacuccagccugguca

SEQ ID NO: 186392 - RNA, 32 nt, Human
ggagauuguaccauggcacuccagccuggaca

SEQ ID NO: 186393 - RNA, 32 nt, Human
ggagauuucaguucagcgguugaggagaauug

SEQ ID NO: 186394 - RNA, 32 nt, Human
ggagauuuccagauggaagcuguacuuggguc

SEQ ID NO: 186395 - RNA, 32 nt, Human
ggagauuugcucaauaccuggccucauuuaaa

SEQ ID NO: 186396 - RNA, 32 nt, Human
ggagauuuucaucagagguggguggguguuca

SEQ ID NO: 186397 - RNA, 32 nt, Human
ggagcaaaaacauuaaccagcugcccaggguu

SEQ ID NO: 186398 - RNA, 32 nt, Human
ggagcaaaacagacuuugucuccugauuagua

SEQ ID NO: 186399 - RNA, 22 nt, Human
ggagcaaaaccuaugacuucca

SEQ ID NO: 186400 - RNA, 32 nt, Human
ggagcaaaaccugaagugucuucaugugcauu

SEQ ID NO: 186401 - RNA, 32 nt, Human
ggagcaaaauggcugcuugagcuacucugugu

SEQ ID NO: 186402 - RNA, 22 nt, Human
ggagcaaaauugugaucuuucc

SEQ ID NO: 186403 - RNA, 32 nt, Human
ggagcaaaccugaaagccagagccuccugaau

SEQ ID NO: 186404 - RNA, 17 nt, Human
ggagcaaacuucagaga

SEQ ID NO: 186405 - RNA, 19 nt, Human
ggagcaaagaggggggcag

SEQ ID NO: 186406 - RNA, 32 nt, Human
ggagcaaagcaggaggucuugggcuaaaaauc

SEQ ID NO: 186407 - RNA, 32 nt, Human
ggagcaaagcucccucccuccagcagaaggcu

SEQ ID NO: 186408 - RNA, 32 nt, Human
ggagcaaaucacuucugucacaguuauuaugg

SEQ ID NO: 186409 - RNA, 32 nt, Human
ggagcaacacucaucaucaccaagucaaacuu

SEQ ID NO: 186410 - RNA, 32 nt, Human
ggagcaacagccaggcccccaggaggacagcc

SEQ ID NO: 186411 - RNA, 24 nt, Human
ggagcaaccauuagaaaaugcagg

SEQ ID NO: 186412 - RNA, 23 nt, Human
ggagcaacccccaggucuuuacu

SEQ ID NO: 186413 - RNA, 32 nt, Human
ggagcaaccuagguguccaacaacagaugaau

SEQ ID NO: 186414 - RNA, 32 nt, Human
ggagcaacuagaaaauugucauuucccucaac

SEQ ID NO: 186415 - RNA, 19 nt, Human
ggagcaacugucucaggga

SEQ ID NO: 186416 - RNA, 32 nt, Human
ggagcaagaacagaaacagggagccaguuaca

SEQ ID NO: 186417 - RNA, 32 nt, Human
ggagcaagagaagaaagccaaggaggcagcag

SEQ ID NO: 186418 - RNA, 32 nt, Human
ggagcaagagcugccuguuucaaggugauguc

SEQ ID NO: 186419 - RNA, 32 nt, Human
ggagcaagaggagagguugcuggagcaagagg

SEQ ID NO: 186420 - RNA, 32 nt, Human
ggagcaagaggagagguugcuggagcugcagg

SEQ ID NO: 186421 - RNA, 32 nt, Human
ggagcaagcaagguuagcaacugugaacagag

SEQ ID NO: 186422 - RNA, 32 nt, Human
ggagcaaggagagagggaagaaggaccccguc

SEQ ID NO: 186423 - RNA, 32 nt, Human
ggagcaaggggcugccuugcaggccugccuuc

SEQ ID NO: 186424 - RNA, 32 nt, Human
ggagcaaggguagccaauggcagaggggguug

SEQ ID NO: 186425 - RNA, 32 nt, Human
ggagcaaguagcccuguccugacauugacccu

SEQ ID NO: 186426 - RNA, 32 nt, Human
ggagcaagugaagaacucugugaaggauggaa

SEQ ID NO: 186427 - RNA, 32 nt, Human
ggagcaaguggagugguugcaggcagaugaga

SEQ ID NO: 186428 - RNA, 32 nt, Human
ggagcaaguucugcuugaccuagccgacgguu

SEQ ID NO: 186429 - RNA, 32 nt, Human
ggagcaaguuucugccucuggaaagggggcgg

SEQ ID NO: 186430 - RNA, 32 nt, Human
ggagcaaucuaagcuguguuacuccaaaggac

SEQ ID NO: 186431 - RNA, 32 nt, Human
ggagcaaugaccauugugcacaugcguguggg

SEQ ID NO: 186432 - RNA, 32 nt, Human
ggagcaauggccagaccaguuucaguaucucu

SEQ ID NO: 186433 - RNA, 32 nt, Human
ggagcacaaagcccaugagggaaagugaguuu

SEQ ID NO: 186434 - RNA, 32 nt, Human
ggagcacacagacagaagacugugucaugggu

SEQ ID NO: 186435 - RNA, 32 nt, Human
ggagcacacaucuggcacugauaagcacacug

SEQ ID NO: 186436 - RNA, 32 nt, Human
ggagcacaccucagugcagcaggaaggacccc

SEQ ID NO: 186437 - RNA, 32 nt, Human
ggagcacacgcuccacgcacacacaccccagc

SEQ ID NO: 186438 - RNA, 32 nt, Human
ggagcacacuccuucaguucagcaagacauaa

SEQ ID NO: 186439 - RNA, 32 nt, Human
ggagcacagaacaccaugaagccucaagaugu

SEQ ID NO: 186440 - RNA, 32 nt, Human
ggagcacagagggagcggaggaggggcgaagg

SEQ ID NO: 186441 - RNA, 32 nt, Human
ggagcacagaggggaggaggaggacuaaauga

SEQ ID NO: 186442 - RNA, 32 nt, Human
ggagcacagaugggggaaaccggcagggcugg

SEQ ID NO: 186443 - RNA, 32 nt, Human
ggagcacaggcagggguguugguguuggggca

SEQ ID NO: 186444 - RNA, 32 nt, Human
ggagcacaggcagguggcugcggggucccagc

SEQ ID NO: 186445 - RNA, 32 nt, Human
ggagcacaggcauaacacagguacccagugug

SEQ ID NO: 186446 - RNA, 32 nt, Human
ggagcacagugcugggaaaugggagcacaaag

SEQ ID NO: 186447 - RNA, 32 nt, Human
ggagcacaguggugaaagaugcaguccuggcu

SEQ ID NO: 186448 - RNA, 32 nt, Human
ggagcacauagagauagaggaggaggccgaag

SEQ ID NO: 186449 - RNA, 32 nt, Human
ggagcacauucuggggagcacacaccugcggu

SEQ ID NO: 186450 - RNA, 32 nt, Human
ggagcacauucuuugccugccuucccuucauc

SEQ ID NO: 186451 - RNA, 32 nt, Human
ggagcaccaggagcccuggagccccuuccacc

SEQ ID NO: 186452 - RNA, 32 nt, Human
ggagcacccaauucuucuugagaacaccaacc

SEQ ID NO: 186453 - RNA, 32 nt, Human
ggagcacccaggcuugggcagcaaucucugca

SEQ ID NO: 186454 - RNA, 22 nt, Human
ggagcaccccacccccagcgag

SEQ ID NO: 186455 - RNA, 24 nt, Human
ggagcaccccaccugcccccgaga

SEQ ID NO: 186456 - RNA, 19 nt, Human
ggagcacccugucuucucu

SEQ ID NO: 186457 - RNA, 32 nt, Human
ggagcacccugucuucuuaauucuccaagcgg

SEQ ID NO: 186458 - RNA, 32 nt, Human
ggagcaccgccuccacccaggucucacaggau

SEQ ID NO: 186459 - RNA, 32 nt, Human
ggagcaccgcggggccacagccccagacgcca

SEQ ID NO: 186460 - RNA, 21 nt, Human
ggagcaccucagucucuguga

SEQ ID NO: 186461 - RNA, 32 nt, Human
ggagcaccugcauccaagagcaugcuuacauu

SEQ ID NO: 186462 - RNA, 32 nt, Human
ggagcaccugcucagguaccucaagaaccccu

SEQ ID NO: 186463 - RNA, 32 nt, Human
ggagcaccugggaagcucugggugcaggauag

SEQ ID NO: 186464 - RNA, 23 nt, Human
ggagcacgaccuguuugcugggc

SEQ ID NO: 186465 - RNA, 32 nt, Human
ggagcacgcgggaccucgguggagaucuccag

SEQ ID NO: 186466 - RNA, 17 nt, Human
ggagcacgguucuggga

SEQ ID NO: 186467 - RNA, 32 nt, Human
ggagcacguccaggaacuccucagcagcgccu

SEQ ID NO: 186468 - RNA, 18 nt, Human
ggagcacucacucuuccu

SEQ ID NO: 186469 - RNA, 32 nt, Human
ggagcacugagugccagcaucuuccagcacca

SEQ ID NO: 186470 - RNA, 32 nt, Human
ggagcacugcacuccuaggaagcaggaaaugg

SEQ ID NO: 186471 - RNA, 32 nt, Human
ggagcacugccucagccuuugcacaugguaau

SEQ ID NO: 186472 - RNA, 32 nt, Human
ggagcacugccuggccaaggccucauccuggg

SEQ ID NO: 186473 - RNA, 32 nt, Human
ggagcacugcugggcuccuggacugagaauag

SEQ ID NO: 186474 - RNA, 32 nt, Human
ggagcacuggcaguugguggcagugagaccag

SEQ ID NO: 186475 - RNA, 32 nt, Human
ggagcacugguaccugcugggcccgccggcug

SEQ ID NO: 186476 - RNA, 32 nt, Human
ggagcacuggugugaacucacccugggagcca

SEQ ID NO: 186477 - RNA, 32 nt, Human
ggagcacugguucugggcaggcaguggcaggg

SEQ ID NO: 186478 - RNA, 32 nt, Human
ggagcacuguaaucgcgcuugcugaguuagca

SEQ ID NO: 186479 - RNA, 32 nt, Human
ggagcacuucgaggaggaggaggaggccgggg

SEQ ID NO: 186480 - RNA, 32 nt, Human
ggagcacuuuggggacugggguugcagaacac

SEQ ID NO: 186481 - RNA, 17 nt, Human
ggagcagaaaaugcaga

SEQ ID NO: 186482 - RNA, 32 nt, Human
ggagcagaaagaguuauggcagagguuccacu

SEQ ID NO: 186483 - RNA, 32 nt, Human
ggagcagaagagaguggggccugcccucugcc

SEQ ID NO: 186484 - RNA, 20 nt, Human
ggagcagaaggcuucagaga

SEQ ID NO: 186485 - RNA, 32 nt, Human
ggagcagaccaugcccucccaacccuggaguu

SEQ ID NO: 186486 - RNA, 32 nt, Human
ggagcagacccugagaucugggcauaggcacc

SEQ ID NO: 186487 - RNA, 32 nt, Human
ggagcagaccucugugggcacugugaggcgga

SEQ ID NO: 186488 - RNA, 18 nt, Human
ggagcagacuccugggga

SEQ ID NO: 186489 - RNA, 32 nt, Human
ggagcagagaaaacuacuagaugugaacuuga

SEQ ID NO: 186490 - RNA, 32 nt, Human
ggagcagagacacuaacgacuucagggcaggg

SEQ ID NO: 186491 - RNA, 32 nt, Human
ggagcagagagcacccagcccgggagguggau

SEQ ID NO: 186492 - RNA, 32 nt, Human
ggagcagagagggacagcuccggggcccaagc

SEQ ID NO: 186493 - RNA, 32 nt, Human
ggagcagagaugagagcaaaauucagacuugc

SEQ ID NO: 186494 - RNA, 32 nt, Human
ggagcagagcccugcacccugccuaguggcuu

SEQ ID NO: 186495 - RNA, 32 nt, Human
ggagcagagccuuugucucaggagcaaaccag

SEQ ID NO: 186496 - RNA, 26 nt, Human
ggagcagagcgggcugcgagggucuu

SEQ ID NO: 186497 - RNA, 23 nt, Human
ggagcagaggccacuaauggaga

SEQ ID NO: 186498 - RNA, 32 nt, Human
ggagcagaggcccucaggguauagagaaggaa

SEQ ID NO: 186499 - RNA, 32 nt, Human
ggagcagagggaagagcugcugaggggguggg

SEQ ID NO: 186500 - RNA, 32 nt, Human
ggagcagaggggcgggggcgagagggaagugg

SEQ ID NO: 186501 - RNA, 32 nt, Human
ggagcagaggugagcugagugcagugagccaa

SEQ ID NO: 186502 - RNA, 32 nt, Human
ggagcagaguagcccugucccuucccugccug

SEQ ID NO: 186503 - RNA, 32 nt, Human
ggagcagauggccaagcagauagguuaugucu

SEQ ID NO: 186504 - RNA, 19 nt, Human
ggagcagcaaagggccuca

SEQ ID NO: 186505 - RNA, 32 nt, Human
ggagcagcaaguaaaggagcugcaggagaagc

SEQ ID NO: 186506 - RNA, 32 nt, Human
ggagcagcacucgcaggagcugcuggcugagc

SEQ ID NO: 186507 - RNA, 32 nt, Human
ggagcagcagagccaugaagaagaaguuagug

SEQ ID NO: 186508 - RNA, 32 nt, Human
ggagcagcagaggcggucuucaacauccugcc

SEQ ID NO: 186509 - RNA, 19 nt, Human
ggagcagcagcagaggcag

SEQ ID NO: 186510 - RNA, 32 nt, Human
ggagcagcagcucugggccgcuggcagggccg

SEQ ID NO: 186511 - RNA, 32 nt, Human
ggagcagcagggaggcgagcagagggccccca

SEQ ID NO: 186512 - RNA, 32 nt, Human
ggagcagcagucccucacuuugaaaccuucgc

SEQ ID NO: 186513 - RNA, 32 nt, Human
ggagcagcagugaugaagaaggaugauaucau

SEQ ID NO: 186514 - RNA, 32 nt, Human
ggagcagcaucccuggcuuccacccacgaaag

SEQ ID NO: 186515 - RNA, 32 nt, Human
ggagcagcauggagcggcggagcgagagcccg

SEQ ID NO: 186516 - RNA, 32 nt, Human
ggagcagcauuuguuucuccccaaaucuagaa

SEQ ID NO: 186517 - RNA, 32 nt, Human
ggagcagccacagccccaagacgaggcaggga

SEQ ID NO: 186518 - RNA, 18 nt, Human
ggagcagccagggggagg

SEQ ID NO: 186519 - RNA, 20 nt, Human
ggagcagcccacccagcaga

SEQ ID NO: 186520 - RNA, 24 nt, Human
ggagcagcccagauuaucuuuacu

SEQ ID NO: 186521 - RNA, 22 nt, Human
ggagcagcccagcaccuccacu

SEQ ID NO: 186522 - RNA, 24 nt, Human
ggagcagcccaguugugucucucu

SEQ ID NO: 186523 - RNA, 18 nt, Human
ggagcagcccccgggccg

SEQ ID NO: 186524 - RNA, 32 nt, Human
ggagcagccccugggcucccugggcaggggag

SEQ ID NO: 186525 - RNA, 18 nt, Human
ggagcagccggcuggcug

SEQ ID NO: 186526 - RNA, 32 nt, Human
ggagcagccgggaggagggggccgcagucggg

SEQ ID NO: 186527 - RNA, 32 nt, Human
ggagcagccuccagaggugaaggcagggcauc

SEQ ID NO: 186528 - RNA, 18 nt, Human
ggagcagccucuagaacg

SEQ ID NO: 186529 - RNA, 32 nt, Human
ggagcagccugaggccccagagucugagacga

SEQ ID NO: 186530 - RNA, 32 nt, Human
ggagcagcgagcgggcuucagcgagccgcagg

SEQ ID NO: 186531 - RNA, 21 nt, Human
ggagcagcgcgggagagccgg

SEQ ID NO: 186532 - RNA, 32 nt, Human
ggagcagcggggagcuugcagugaccaagagg

SEQ ID NO: 186533 - RNA, 32 nt, Human
ggagcagcggggucucacaaagaggauaccug

SEQ ID NO: 186534 - RNA, 32 nt, Human
ggagcagcgguggggagcagggccaagguccc

SEQ ID NO: 186535 - RNA, 32 nt, Human
ggagcagcucaauccugggccuggugacauca

SEQ ID NO: 186536 - RNA, 32 nt, Human
ggagcagcuccaggggcugguggaggagcggc

SEQ ID NO: 186537 - RNA, 18 nt, Human
ggagcagcuccuccagga

SEQ ID NO: 186538 - RNA, 32 nt, Human
ggagcagcuccuccaggauucccacaggccuc

SEQ ID NO: 186539 - RNA, 32 nt, Human
ggagcagcuccucuuccaucuccagggucuca

SEQ ID NO: 186540 - RNA, 32 nt, Human
ggagcagcucuccugccacagcuccucacccc

SEQ ID NO: 186541 - RNA, 18 nt, Human
ggagcagcugacagacga

SEQ ID NO: 186542 - RNA, 32 nt, Human
ggagcagcugaggaggaggcaggagagaggga

SEQ ID NO: 186543 - RNA, 20 nt, Human
ggagcagcugaugcccagag

SEQ ID NO: 186544 - RNA, 32 nt, Human
ggagcagcugcaauugcaccugagggacaggc

SEQ ID NO: 186545 - RNA, 32 nt, Human
ggagcagcugccgccucccgacaccuucagaa

SEQ ID NO: 186546 - RNA, 32 nt, Human
ggagcagcugccucucuggggagaugcuggag

SEQ ID NO: 186547 - RNA, 21 nt, Human
ggagcagcuggaggcacgaga

SEQ ID NO: 186548 - RNA, 19 nt, Human
ggagcagcugggacccaga

SEQ ID NO: 186549 - RNA, 32 nt, Human
ggagcagcuggggguuccaccucagggugggg

SEQ ID NO: 186550 - RNA, 32 nt, Human
ggagcagcuguuuuccaucccuucccagacaa

SEQ ID NO: 186551 - RNA, 32 nt, Human
ggagcagcuuuucuucuaguuugaugucauuu

SEQ ID NO: 186552 - RNA, 17 nt, Human
ggagcaggacucaggga

SEQ ID NO: 186553 - RNA, 32 nt, Human
ggagcaggagagaaaggaggguggguggucuc

SEQ ID NO: 186554 - RNA, 32 nt, Human
ggagcaggagagagaggguaggcuaggggugg

SEQ ID NO: 186555 - RNA, 32 nt, Human
ggagcaggagaggcugcuggagagggagaggc

SEQ ID NO: 186556 - RNA, 32 nt, Human
ggagcaggagcugcgggagacugagcacuugc

SEQ ID NO: 186557 - RNA, 32 nt, Human
ggagcaggaggaacuccaguccgucccggcau

SEQ ID NO: 186558 - RNA, 32 nt, Human
ggagcaggaggaagagggggaggagaaggagg

SEQ ID NO: 186559 - RNA, 32 nt, Human
ggagcaggaggcagaggagcagauggagcagc

SEQ ID NO: 186560 - RNA, 32 nt, Human
ggagcaggaggcugaugguccuccucaggguc

SEQ ID NO: 186561 - RNA, 32 nt, Human
ggagcaggagugauuucaguccccagcaagug

SEQ ID NO: 186562 - RNA, 32 nt, Human
ggagcaggaguggagaaagggaaaggcagguc

SEQ ID NO: 186563 - RNA, 21 nt, Human
ggagcaggaucaugccagaaa

SEQ ID NO: 186564 - RNA, 32 nt, Human
ggagcaggauggggaggagcugagccggaccc

SEQ ID NO: 186565 - RNA, 32 nt, Human
ggagcaggauuucaaggacggaauuaguauug

SEQ ID NO: 186566 - RNA, 32 nt, Human
ggagcaggcaccagcuauggagagggauacag

SEQ ID NO: 186567 - RNA, 32 nt, Human
ggagcaggcacggcacauggcaacagcaggag

SEQ ID NO: 186568 - RNA, 32 nt, Human
ggagcaggcagcccuggcaucccacagccgcc

SEQ ID NO: 186569 - RNA, 32 nt, Human
ggagcaggcaggcaucccccggaguugucucu

SEQ ID NO: 186570 - RNA, 32 nt, Human
ggagcaggcaggcauccccgggaguugucucu

SEQ ID NO: 186571 - RNA, 21 nt, Human
ggagcaggcaggggccucagg

SEQ ID NO: 186572 - RNA, 32 nt, Human
ggagcaggccagagccucuuuugcuuccuuuu

SEQ ID NO: 186573 - RNA, 32 nt, Human
ggagcaggcgcgcauggcgggccccgcgcggg

SEQ ID NO: 186574 - RNA, 32 nt, Human
ggagcaggcugccaccccuucuaccucaccac

SEQ ID NO: 186575 - RNA, 32 nt, Human
ggagcagggaaggccugacuucugcuggcauc

SEQ ID NO: 186576 - RNA, 23 nt, Human
ggagcagggagacaggaggcaga

SEQ ID NO: 186577 - RNA, 32 nt, Human
ggagcagggagggagacggcuagggcagcaag

SEQ ID NO: 186578 - RNA, 32 nt, Human
ggagcagggaguauguggucuccuucauugug

SEQ ID NO: 186579 - RNA, 31 nt, Human
ggagcagggcaacagcaccugccccacccug

SEQ ID NO: 186580 - RNA, 19 nt, Human
ggagcagggcagcuggcug

SEQ ID NO: 186581 - RNA, 32 nt, Human
ggagcagggcaggcuggcugcuggcucuacca

SEQ ID NO: 186582 - RNA, 23 nt, Human
ggagcagggcagggaagccggga

SEQ ID NO: 186583 - RNA, 32 nt, Human
ggagcagggccuggaaaccugcauuuuaguua

SEQ ID NO: 186584 - RNA, 32 nt, Human
ggagcagggcugggacgcugcaccccgcagga

SEQ ID NO: 186585 - RNA, 32 nt, Human
ggagcagggcugggacgcugcacccggcagga

SEQ ID NO: 186586 - RNA, 32 nt, Human
ggagcaggggcagagauuauuuggaauaacgu

SEQ ID NO: 186587 - RNA, 32 nt, Human
ggagcaggggcaggggcaggggcagggagagc

SEQ ID NO: 186588 - RNA, 32 nt, Human
ggagcaggggcccugguguugcauuuagcccu

SEQ ID NO: 186589 - RNA, 32 nt, Human
ggagcaggggccugccuucaucuccaaggccc

SEQ ID NO: 186590 - RNA, 32 nt, Human
ggagcaggggcuuggaguggggcuggugcccg

SEQ ID NO: 186591 - RNA, 32 nt, Human
ggagcagggguuuugcauucacggaggaccug

SEQ ID NO: 186592 - RNA, 32 nt, Human
ggagcagggugguggcuggggcgaugguggac

SEQ ID NO: 186593 - RNA, 18 nt, Human
ggagcaggguuuaacuca

SEQ ID NO: 186594 - RNA, 19 nt, Human
ggagcagguagaggggcag

SEQ ID NO: 186595 - RNA, 32 nt, Human
ggagcagguccagggaugaugcagcccccuuc

SEQ ID NO: 186596 - RNA, 32 nt, Human
ggagcaggugcuuguggacaaggcuccacaag

SEQ ID NO: 186597 - RNA, 32 nt, Human
ggagcagguggcuggagagaggcgggguaggu

SEQ ID NO: 186598 - RNA, 32 nt, Human
ggagcagguggggguagagcagcucugcucgc

SEQ ID NO: 186599 - RNA, 21 nt, Human
ggagcaggugggucucuggga

SEQ ID NO: 186600 - RNA, 32 nt, Human
ggagcaggugugagcuucaaaugcuuagggcc

SEQ ID NO: 186601 - RNA, 32 nt, Human
ggagcagguuggggugggggagagggaaagga

SEQ ID NO: 186602 - RNA, 31 nt, Human
ggagcaguagagagagaaaaagagggggugc

SEQ ID NO: 186603 - RNA, 32 nt, Human
ggagcaguagcagggacagcagagccaaaggc

SEQ ID NO: 186604 - RNA, 32 nt, Human
ggagcagucaauauaggaucucaggccaggcc

SEQ ID NO: 186605 - RNA, 17 nt, Human
ggagcagucagcauucu

SEQ ID NO: 186606 - RNA, 32 nt, Human
ggagcagucaucuacaaugcuuuccucuauug

SEQ ID NO: 186607 - RNA, 32 nt, Human
ggagcagucccucuuugaccucaccccuugga

SEQ ID NO: 186608 - RNA, 32 nt, Human
ggagcagucucccagcccugggucugcucccc

SEQ ID NO: 186609 - RNA, 32 nt, Human
ggagcagucucuuccauggaguaagaaggaag

SEQ ID NO: 186610 - RNA, 32 nt, Human
ggagcagucuucguucuuccuccccucagugg

SEQ ID NO: 186611 - RNA, 32 nt, Human
ggagcaguggagguaagggcuccaccccaucu

SEQ ID NO: 186612 - RNA, 32 nt, Human
ggagcaguucaugcagcaccucuacccacaga

SEQ ID NO: 186613 - RNA, 32 nt, Human
ggagcaguugcaggccacagugaaguguguug

SEQ ID NO: 186614 - RNA, 23 nt, Human
ggagcaguuguuagcagaggcag

SEQ ID NO: 186615 - RNA, 32 nt, Human
ggagcaguuguuuuucccucccugggccucac

SEQ ID NO: 186616 - RNA, 32 nt, Human
ggagcauacauacauugucauuggucuucuau

SEQ ID NO: 186617 - RNA, 21 nt, Human
ggagcauaccaccaugccuga

SEQ ID NO: 186618 - RNA, 32 nt, Human
ggagcaucaccagcuccucagagccacuccgc

SEQ ID NO: 186619 - RNA, 32 nt, Human
ggagcaucacugucuacucagaagacugagaa

SEQ ID NO: 186620 - RNA, 24 nt, Human
ggagcaucaggguuggcuugggag

SEQ ID NO: 186621 - RNA, 22 nt, Human
ggagcaucaguggaggaggcag

SEQ ID NO: 186622 - RNA, 32 nt, Human
ggagcauccccagcugcuggaugcugggaccc

SEQ ID NO: 186623 - RNA, 32 nt, Human
ggagcauccuggggcucccuggcuccuggccg

SEQ ID NO: 186624 - RNA, 32 nt, Human
ggagcaucucaagagguggaaggggccgggcg

SEQ ID NO: 186625 - RNA, 32 nt, Human
ggagcaucucagaauaagauggugguacaauu

SEQ ID NO: 186626 - RNA, 32 nt, Human
ggagcaucucuugaggccaggaguuugagacc

SEQ ID NO: 186627 - RNA, 32 nt, Human
ggagcaucugcccuccuccuucucaggaauca

SEQ ID NO: 186628 - RNA, 32 nt, Human
ggagcaucugccuugugccuggcacucugccg

SEQ ID NO: 186629 - RNA, 26 nt, Human
ggagcaucuggcaggcaggggggcag

SEQ ID NO: 186630 - RNA, 32 nt, Human
ggagcaucuuaaggagcucagcucaguaaaca

SEQ ID NO: 186631 - RNA, 32 nt, Human
ggagcaucuucuuggcagccaggcugggccau

SEQ ID NO: 186632 - RNA, 32 nt, Human
ggagcaugaaccagucauauccuguugaaagc

SEQ ID NO: 186633 - RNA, 30 nt, Human
ggagcaugaacgccccuccagccuucgagu

SEQ ID NO: 186634 - RNA, 32 nt, Human
ggagcaugaagaggaugguucagagacagagg

SEQ ID NO: 186635 - RNA, 32 nt, Human
ggagcaugcccguaaucccagcuacucaggag

SEQ ID NO: 186636 - RNA, 32 nt, Human
ggagcaugccuguagucucagcuacucaggag

SEQ ID NO: 186637 - RNA, 32 nt, Human
ggagcaugccugucaucccagcuacuugggag

SEQ ID NO: 186638 - RNA, 32 nt, Human
ggagcaugccugugaucccagcuacucaggag

SEQ ID NO: 186639 - RNA, 32 nt, Human
ggagcauggaguuuggacuuugcugagcaacu

SEQ ID NO: 186640 - RNA, 32 nt, Human
ggagcaugggaagagggugagcugagggcugg

SEQ ID NO: 186641 - RNA, 32 nt, Human
ggagcaugggcagaggagacaggaacaagcgu

SEQ ID NO: 186642 - RNA, 32 nt, Human
ggagcaugggccagggcagacagucucugagg

SEQ ID NO: 186643 - RNA, 19 nt, Human
ggagcaugggcucagcuca

SEQ ID NO: 186644 - RNA, 32 nt, Human
ggagcauguaugucugcaggugucugacacgc

SEQ ID NO: 186645 - RNA, 19 nt, Human
ggagcaugucacuccagca

SEQ ID NO: 186646 - RNA, 30 nt, Human
ggagcaugucugggagucagagcgaggugg

SEQ ID NO: 186647 - RNA, 32 nt, Human
ggagcaugucuguaaucccagcuacucgggag

SEQ ID NO: 186648 - RNA, 32 nt, Human
ggagcauucucccagacccuucuuuagaagag

SEQ ID NO: 186649 - RNA, 32 nt, Human
ggagcauucugaaaacagauauucuggcccag

SEQ ID NO: 186650 - RNA, 32 nt, Human
ggagcauugaaggagaagaucugccugugggu

SEQ ID NO: 186651 - RNA, 32 nt, Human
ggagcauugauguuggguggcuuuuguucuuu

SEQ ID NO: 186652 - RNA, 32 nt, Human
ggagcauuggacaacacaggaagucccucugg

SEQ ID NO: 186653 - RNA, 32 nt, Human
ggagcauuucuuuggagagguggaaucagaag

SEQ ID NO: 186654 - RNA, 32 nt, Human
ggagcauuugagauggaagcuuacuuuggaau

SEQ ID NO: 186655 - RNA, 18 nt, Human
ggagcauuuguagccuua

SEQ ID NO: 186656 - RNA, 32 nt, Human
ggagccaaaguuucuguuccugguggucggga

SEQ ID NO: 186657 - RNA, 20 nt, Human
ggagccaacagagggagcag

SEQ ID NO: 186658 - RNA, 32 nt, Human
ggagccaacucucagccuuucccaccagggcg

SEQ ID NO: 186659 - RNA, 32 nt, Human
ggagccaagaaugcaccacugcaguccagccu

SEQ ID NO: 186660 - RNA, 20 nt, Human
ggagccaagaggaacaggaa

SEQ ID NO: 186661 - RNA, 32 nt, Human
ggagccaagaucccuccagacagcaccagcuc

SEQ ID NO: 186662 - RNA, 32 nt, Human
ggagccaagcuuucccccacagccuagccucc

SEQ ID NO: 186663 - RNA, 32 nt, Human
ggagccaaggcuuuauacgucuaaagaaaaua

SEQ ID NO: 186664 - RNA, 32 nt, Human
ggagccaauccacccacccauagaaugacuug

SEQ ID NO: 186665 - RNA, 21 nt, Human
ggagccacaacacccgaccau

SEQ ID NO: 186666 - RNA, 32 nt, Human
ggagccacaagccgcccugccuucugcaccuc

SEQ ID NO: 186667 - RNA, 23 nt, Human
ggagccacacacucccuuccuca

SEQ ID NO: 186668 - RNA, 23 nt, Human
ggagccacaccaccugugacucc

SEQ ID NO: 186669 - RNA, 32 nt, Human
ggagccacagaagauagacagauggaaggugg

SEQ ID NO: 186670 - RNA, 32 nt, Human
ggagccacagcccaggggcagaugaaggggcu

SEQ ID NO: 186671 - RNA, 32 nt, Human
ggagccacagccgcagccccagccccggccac

SEQ ID NO: 186672 - RNA, 32 nt, Human
ggagccacagccgcgcucagccuggagggaag

SEQ ID NO: 186673 - RNA, 32 nt, Human
ggagccacagccgcggcucacgccccaccgca

SEQ ID NO: 186674 - RNA, 32 nt, Human
ggagccacaggcagggucugcugguuucggug

SEQ ID NO: 186675 - RNA, 32 nt, Human
ggagccacagucccuaaugacacccacuccua

SEQ ID NO: 186676 - RNA, 32 nt, Human
ggagccacauccugaccccagcagccucagaa

SEQ ID NO: 186677 - RNA, 32 nt, Human
ggagccacauggacccacaggucccacuguca

SEQ ID NO: 186678 - RNA, 32 nt, Human
ggagccaccaacaccacugaaauucaccgugg

SEQ ID NO: 186679 - RNA, 32 nt, Human
ggagccaccacuuccaguucugaucuucucau

SEQ ID NO: 186680 - RNA, 32 nt, Human
ggagccaccaguaccaaacccaauacuuacuc

SEQ ID NO: 186681 - RNA, 32 nt, Human
ggagccaccuaccucuggccucaggcuguggg

SEQ ID NO: 186682 - RNA, 27 nt, Human
ggagccaccucacuuagacagcuucgg

SEQ ID NO: 186683 - RNA, 32 nt, Human
ggagccaccuccucagcuucccugagggcugc

SEQ ID NO: 186684 - RNA, 32 nt, Human
ggagccaccugccucuggcuucaugugagcug

SEQ ID NO: 186685 - RNA, 17 nt, Human
ggagccacgggugcaag

SEQ ID NO: 186686 - RNA, 32 nt, Human
ggagccacuacccucucuuuugaucugccaag

SEQ ID NO: 186687 - RNA, 32 nt, Human
ggagccacuagcaccaucccagagcugucagc

SEQ ID NO: 186688 - RNA, 32 nt, Human
ggagccacugcacccggccugaaugaugacuc

SEQ ID NO: 186689 - RNA, 32 nt, Human
ggagccacugcacuccagcccaggugacagag

SEQ ID NO: 186690 - RNA, 32 nt, Human
ggagccacugcacuccagccugggcgacagag

SEQ ID NO: 186691 - RNA, 32 nt, Human
ggagccacugcacuccagccugggggaaagag

SEQ ID NO: 186692 - RNA, 32 nt, Human
ggagccacugcacuccagccugggugacagag

SEQ ID NO: 186693 - RNA, 32 nt, Human
ggagccacugcacugcuggcugcagacacagg

SEQ ID NO: 186694 - RNA, 32 nt, Human
ggagccacugccacuccaguccugccaccacc

SEQ ID NO: 186695 - RNA, 32 nt, Human
ggagccacugcucucccccuugcccuccgguc

SEQ ID NO: 186696 - RNA, 32 nt, Human
ggagccacuggguggaggggcagggaggcaaa

SEQ ID NO: 186697 - RNA, 32 nt, Human
ggagccacuguggccccaugguucggagccac

SEQ ID NO: 186698 - RNA, 32 nt, Human
ggagccacuugcaggacugaggguuuuugcaa

SEQ ID NO: 186699 - RNA, 32 nt, Human
ggagccagaagagggaggaaaggagaugagau

SEQ ID NO: 186700 - RNA, 32 nt, Human
ggagccagaccaggaaccugagccagagcugg

SEQ ID NO: 186701 - RNA, 23 nt, Human
ggagccagaggaaaagaagagga

SEQ ID NO: 186702 - RNA, 32 nt, Human
ggagccagaggacccguagcugcuaaagggca

SEQ ID NO: 186703 - RNA, 32 nt, Human
ggagccagaggugccuuuguggaggacagcag

SEQ ID NO: 186704 - RNA, 32 nt, Human
ggagccagagugagaccagcagacucucacac

SEQ ID NO: 186705 - RNA, 19 nt, Human
ggagccagagugggggcag

SEQ ID NO: 186706 - RNA, 25 nt, Human
ggagccagaucugccccucagugca

SEQ ID NO: 186707 - RNA, 32 nt, Human
ggagccagcagauugcagcccagcugaccacc

SEQ ID NO: 186708 - RNA, 32 nt, Human
ggagccagcagugcccccagcacuguccccac

SEQ ID NO: 186709 - RNA, 32 nt, Human
ggagccagccacugcaaauccuuugugucuuc

SEQ ID NO: 186710 - RNA, 32 nt, Human
ggagccagccugacaccaaggacagcacuugu

SEQ ID NO: 186711 - RNA, 32 nt, Human
ggagccagccugggugacgcuccagagaacua

SEQ ID NO: 186712 - RNA, 32 nt, Human
ggagccagcgagcauaugcugcaugaggaccu

SEQ ID NO: 186713 - RNA, 16 nt, Human
ggagccagcucagaga

SEQ ID NO: 186714 - RNA, 32 nt, Human
ggagccagcucucaggacuguggcuggaggcu

SEQ ID NO: 186715 - RNA, 32 nt, Human
ggagccaggaagagagcugugaccagcagcgu

SEQ ID NO: 186716 - RNA, 32 nt, Human
ggagccaggaaggaagaagagggagggccagu

SEQ ID NO: 186717 - RNA, 32 nt, Human
ggagccaggagcuccgcagcugugucagaagc

SEQ ID NO: 186718 - RNA, 32 nt, Human
ggagccaggaggggaugugugugugcagagcu

SEQ ID NO: 186719 - RNA, 32 nt, Human
ggagccaggaguuugagaccagccugggcaac

SEQ ID NO: 186720 - RNA, 32 nt, Human
ggagccaggcagcuguguacagugagaaggga

SEQ ID NO: 186721 - RNA, 32 nt, Human
ggagccaggcccguaaguucgcaggcaggggu

SEQ ID NO: 186722 - RNA, 32 nt, Human
ggagccaggcgcuguggacagggucuguccac

SEQ ID NO: 186723 - RNA, 16 nt, Human
ggagccaggcuggcug

SEQ ID NO: 186724 - RNA, 32 nt, Human
ggagccagggcaccgugagccuggugguuggc

SEQ ID NO: 186725 - RNA, 32 nt, Human
ggagccagggcuggccauggguccccuacccu

SEQ ID NO: 186726 - RNA, 32 nt, Human
ggagccaggggaggggcaggagucccagcacc

SEQ ID NO: 186727 - RNA, 32 nt, Human
ggagccaggguuuugccauguuggccaggcug

SEQ ID NO: 186728 - RNA, 32 nt, Human
ggagccaggugaggaggagccaggaaggcagu

SEQ ID NO: 186729 - RNA, 18 nt, Human
ggagccagucaugccgga

SEQ ID NO: 186730 - RNA, 32 nt, Human
ggagccagucuccuggaacuucucccucccua

SEQ ID NO: 186731 - RNA, 32 nt, Human
ggagccagugagacaggaaaaaccuaguaacg

SEQ ID NO: 186732 - RNA, 32 nt, Human
ggagccagugccugugguuguuucuccagagu

SEQ ID NO: 186733 - RNA, 32 nt, Human
ggagccagugcugccuguccguccccaugggc

SEQ ID NO: 186734 - RNA, 32 nt, Human
ggagccaguuguguucagacacacacaucaca

SEQ ID NO: 186735 - RNA, 32 nt, Human
ggagccauaagccucugccucgaugccguuuu

SEQ ID NO: 186736 - RNA, 32 nt, Human
ggagccauaguggagcuuuccucucuaagcuc

SEQ ID NO: 186737 - RNA, 32 nt, Human
ggagccaucccccaagacccuguccaaggccc

SEQ ID NO: 186738 - RNA, 32 nt, Human
ggagccauccuggcggagcccugcugcagggg

SEQ ID NO: 186739 - RNA, 32 nt, Human
ggagccaucuauccaagaagccuucacucacc

SEQ ID NO: 186740 - RNA, 32 nt, Human
ggagccaugagugcucagucccuuggcacacu

SEQ ID NO: 186741 - RNA, 32 nt, Human
ggagccaugauggacacagaggggcaguagag

SEQ ID NO: 186742 - RNA, 32 nt, Human
ggagccaugccuggguuucagagcagagcucc

SEQ ID NO: 186743 - RNA, 31 nt, Human
ggagccauggccuauaggguccugggccgcg

SEQ ID NO: 186744 - RNA, 31 nt, Human
ggagccaugguccacgccuuccucauucaca

SEQ ID NO: 186745 - RNA, 32 nt, Human
ggagccaugucugugcucaggaagagggaagg

SEQ ID NO: 186746 - RNA, 32 nt, Human
ggagccauuagucccugccucguagugggaaa

SEQ ID NO: 186747 - RNA, 32 nt, Human
ggagcccaacuuccugugggcccucccggggc

SEQ ID NO: 186748 - RNA, 32 nt, Human
ggagcccaagagguggggugucguggcucugc

SEQ ID NO: 186749 - RNA, 32 nt, Human
ggagcccaaggcaggaagauugcuugaggcua

SEQ ID NO: 186750 - RNA, 32 nt, Human
ggagcccaauuauucauucucccuuuauugau

SEQ ID NO: 186751 - RNA, 31 nt, Human
ggagcccacagcuagggaggacagaggcugg

SEQ ID NO: 186752 - RNA, 32 nt, Human
ggagcccacuguccuggcuggcggcgggaucg

SEQ ID NO: 186753 - RNA, 32 nt, Human
ggagcccagaaaaggcagcagauggaccaugc

SEQ ID NO: 186754 - RNA, 32 nt, Human
ggagcccagaagggacacaccagcacagucug

SEQ ID NO: 186755 - RNA, 23 nt, Human
ggagcccagagaauagcgcucag

SEQ ID NO: 186756 - RNA, 20 nt, Human
ggagcccagagccgguucgg

SEQ ID NO: 186757 - RNA, 19 nt, Human
ggagcccagaggagggcag

SEQ ID NO: 186758 - RNA, 32 nt, Human
ggagcccagaggagggcagcagaagggggugg

SEQ ID NO: 186759 - RNA, 32 nt, Human
ggagcccagcacuccugggucucggggucggg

SEQ ID NO: 186760 - RNA, 32 nt, Human
ggagcccagccuaugccucccacuagccgcgu

SEQ ID NO: 186761 - RNA, 32 nt, Human
ggagcccagcugcugcagcccagggcucucug

SEQ ID NO: 186762 - RNA, 32 nt, Human
ggagcccaggaauucaagaccagucugagcaa

SEQ ID NO: 186763 - RNA, 32 nt, Human
ggagcccaggagcagaggaaguagagagagag

SEQ ID NO: 186764 - RNA, 32 nt, Human
ggagcccaggaggcacaggcugcagugagcag

SEQ ID NO: 186765 - RNA, 32 nt, Human
ggagcccaggaggucaaggcugcagugagcug

SEQ ID NO: 186766 - RNA, 32 nt, Human
ggagcccaggcagaggaggcaccgagagugag

SEQ ID NO: 186767 - RNA, 32 nt, Human
ggagcccaggcagaggaggcgccgagagcgag

SEQ ID NO: 186768 - RNA, 32 nt, Human
ggagcccaggcagagggggcgccgagagcgag

SEQ ID NO: 186769 - RNA, 32 nt, Human
ggagcccaggccaggacucugcagccucagag

SEQ ID NO: 186770 - RNA, 32 nt, Human
ggagcccaggcccucccuccaggguagagaug

SEQ ID NO: 186771 - RNA, 21 nt, Human
ggagcccaggggccuugcagg

SEQ ID NO: 186772 - RNA, 32 nt, Human
ggagcccagguggugcccgcgcaccucucaca

SEQ ID NO: 186773 - RNA, 18 nt, Human
ggagcccagucccgggcc

SEQ ID NO: 186774 - RNA, 32 nt, Human
ggagcccagugggggcugcagguccagcccac

SEQ ID NO: 186775 - RNA, 32 nt, Human
ggagcccaugaggagaaaaaggaagacuggaa

SEQ ID NO: 186776 - RNA, 32 nt, Human
ggagccccaagucuuggggaccacagaagaug

SEQ ID NO: 186777 - RNA, 32 nt, Human
ggagccccacacagaugcugggcugggacaug

SEQ ID NO: 186778 - RNA, 32 nt, Human
ggagccccaccaaccccaaaccaugcggagaa

SEQ ID NO: 186779 - RNA, 19 nt, Human
ggagccccacccccaugca

SEQ ID NO: 186780 - RNA, 32 nt, Human
ggagccccacuaaacccagcggagcggagccu

SEQ ID NO: 186781 - RNA, 32 nt, Human
ggagccccacugcuuccagccucuggugccaa

SEQ ID NO: 186782 - RNA, 32 nt, Human
ggagccccagcagacuuugagaggcgugugcg

SEQ ID NO: 186783 - RNA, 32 nt, Human
ggagccccagcuuaguggaggcugggccugaa

SEQ ID NO: 186784 - RNA, 21 nt, Human
ggagccccagggcagaaugca

SEQ ID NO: 186785 - RNA, 32 nt, Human
ggagccccaucccggugcugacagugcccacc

SEQ ID NO: 186786 - RNA, 22 nt, Human
ggagccccaugggccccaggca

SEQ ID NO: 186787 - RNA, 28 nt, Human
ggagcccccagcccagccucauccugga

SEQ ID NO: 186788 - RNA, 32 nt, Human
ggagcccccaggagcugggagaggcaggaagg

SEQ ID NO: 186789 - RNA, 22 nt, Human
ggagccccccaaauggccuggc

SEQ ID NO: 186790 - RNA, 22 nt, Human
ggagccccccacccccucagca

SEQ ID NO: 186791 - RNA, 32 nt, Human
ggagcccccugaccccuucuuucaaacagauc

SEQ ID NO: 186792 - RNA, 32 nt, Human
ggagccccgagagacgccccgggguucuagaa

SEQ ID NO: 186793 - RNA, 32 nt, Human
ggagccccgcgcuuucgugagcccccucgagg

SEQ ID NO: 186794 - RNA, 32 nt, Human
ggagccccggacacacuguggggaggaggagg

SEQ ID NO: 186795 - RNA, 32 nt, Human
ggagccccucaucuuccccagaaggacuucuc

SEQ ID NO: 186796 - RNA, 21 nt, Human
ggagccccucugagaagagga

SEQ ID NO: 186797 - RNA, 32 nt, Human
ggagccccugcuccuucacuuugcagccuccu

SEQ ID NO: 186798 - RNA, 32 nt, Human
ggagccccugggugggugguggggaggggcgc

SEQ ID NO: 186799 - RNA, 32 nt, Human
ggagcccgagagguggagguugcagugagccg

SEQ ID NO: 186800 - RNA, 32 nt, Human
ggagcccgaggagaggagagagcugacuggac

SEQ ID NO: 186801 - RNA, 32 nt, Human
ggagcccgcacucgggcgcggagggagcggcg

SEQ ID NO: 186802 - RNA, 32 nt, Human
ggagcccgcagaggcaggguaaggggagcggg

SEQ ID NO: 186803 - RNA, 32 nt, Human
ggagcccgcccuagggacgcugggcaggucag

SEQ ID NO: 186804 - RNA, 19 nt, Human
ggagcccgcgcaggccgag

SEQ ID NO: 186805 - RNA, 32 nt, Human
ggagcccgcgggaggagauccuguaccaccug

SEQ ID NO: 186806 - RNA, 32 nt, Human
ggagcccgcucaggauggccugggcaggggag

SEQ ID NO: 186807 - RNA, 32 nt, Human
ggagcccggagcucuacucaucauccccauca

SEQ ID NO: 186808 - RNA, 20 nt, Human
ggagcccggcggcucuggga

SEQ ID NO: 186809 - RNA, 21 nt, Human
ggagcccggggggcaaggggu

SEQ ID NO: 186810 - RNA, 32 nt, Human
ggagcccguaaugaaggcccagguuccaguca

SEQ ID NO: 186811 - RNA, 32 nt, Human
ggagcccguagcaacaguguagugagaacagc

SEQ ID NO: 186812 - RNA, 32 nt, Human
ggagcccuaucuuuacaaaaguuuccuacugu

SEQ ID NO: 186813 - RNA, 32 nt, Human
ggagcccucagccauggccucgggcgacaccc

SEQ ID NO: 186814 - RNA, 22 nt, Human
ggagcccuccuggccucacuga

SEQ ID NO: 186815 - RNA, 32 nt, Human
ggagcccuccuuggagcuggagagcaccucag

SEQ ID NO: 186816 - RNA, 24 nt, Human
ggagcccucgacccgcccagcuga

SEQ ID NO: 186817 - RNA, 32 nt, Human
ggagcccucgccgcugccguucuucagccggc

SEQ ID NO: 186818 - RNA, 32 nt, Human
ggagcccucgcggccccuccccggcugcuggc

SEQ ID NO: 186819 - RNA, 24 nt, Human
ggagcccucuggaaagaaaaggac

SEQ ID NO: 186820 - RNA, 28 nt, Human
ggagcccugagggcugccucucugccag

SEQ ID NO: 186821 - RNA, 32 nt, Human
ggagcccugaguggcugagcucaggccuucgc

SEQ ID NO: 186822 - RNA, 18 nt, Human
ggagcccugauccggggg

SEQ ID NO: 186823 - RNA, 20 nt, Human
ggagcccugcacccccggga

SEQ ID NO: 186824 - RNA, 24 nt, Human
ggagcccugcauaaagagaaggac

SEQ ID NO: 186825 - RNA, 32 nt, Human
ggagcccugccugccccugcuccccagcuccu

SEQ ID NO: 186826 - RNA, 32 nt, Human
ggagcccugcgcuuccagcuacuugcagccag

SEQ ID NO: 186827 - RNA, 22 nt, Human
ggagcccugcugcccacaugca

SEQ ID NO: 186828 - RNA, 22 nt, Human
ggagcccuggaaaggagaagga

SEQ ID NO: 186829 - RNA, 32 nt, Human
ggagcccuggaguucuggcgggagggaagcug

SEQ ID NO: 186830 - RNA, 32 nt, Human
ggagcccuggcugaagcaagcagucaguacuu

SEQ ID NO: 186831 - RNA, 32 nt, Human
ggagcccugggaggcuggagccccaggugcag

SEQ ID NO: 186832 - RNA, 32 nt, Human
ggagcccugggcuggggcaggagccgcaaugu

SEQ ID NO: 186833 - RNA, 21 nt, Human
ggagcccuggucacacacaca

SEQ ID NO: 186834 - RNA, 32 nt, Human
ggagcccugguugccaucagccauggcuccca

SEQ ID NO: 186835 - RNA, 32 nt, Human
ggagcccugguuucagcccccucagucugaug

SEQ ID NO: 186836 - RNA, 21 nt, Human
ggagcccuuaagccccagcug

SEQ ID NO: 186837 - RNA, 21 nt, Human
ggagcccuuacucuguucagu

SEQ ID NO: 186838 - RNA, 32 nt, Human
ggagccgaaguuaagguggccugggagccacg

SEQ ID NO: 186839 - RNA, 32 nt, Human
ggagccgagaggaggcggaggagauggcgucc

SEQ ID NO: 186840 - RNA, 32 nt, Human
ggagccgagauggagccacacaugaguuugcu

SEQ ID NO: 186841 - RNA, 32 nt, Human
ggagccgagggugcuuuagagaggugguuuuc

SEQ ID NO: 186842 - RNA, 32 nt, Human
ggagccgauggcugcguauuucauggcaguca

SEQ ID NO: 186843 - RNA, 32 nt, Human
ggagccgauucugcaacccucacuuccuaagc

SEQ ID NO: 186844 - RNA, 31 nt, Human
ggagccgcaaggagccacacagcaggaggug

SEQ ID NO: 186845 - RNA, 32 nt, Human
ggagccgcacacagccacaucuuccuagaccu

SEQ ID NO: 186846 - RNA, 32 nt, Human
ggagccgcagagaggggaagaggcagaaaccg

SEQ ID NO: 186847 - RNA, 32 nt, Human
ggagccgcagaggcccgaggcaccggacgcug

SEQ ID NO: 186848 - RNA, 32 nt, Human
ggagccgcagccgccgccccagcaucacgucc

SEQ ID NO: 186849 - RNA, 32 nt, Human
ggagccgcagcugcaggaguccugcccgccca

SEQ ID NO: 186850 - RNA, 32 nt, Human
ggagccgcaggaggaaggagguugugcagggu

SEQ ID NO: 186851 - RNA, 19 nt, Human
ggagccgcauccacugugg

SEQ ID NO: 186852 - RNA, 32 nt, Human
ggagccgcccuccugagcuugaaaauggaaga

SEQ ID NO: 186853 - RNA, 32 nt, Human
ggagccgccggcagaggucucuccccagccuc

SEQ ID NO: 186854 - RNA, 32 nt, Human
ggagccgcgagccaggauggaggcagagggca

SEQ ID NO: 186855 - RNA, 20 nt, Human
ggagccgcgggaggccggga

SEQ ID NO: 186856 - RNA, 32 nt, Human
ggagccgcucaagccacagcucccaggccccu

SEQ ID NO: 186857 - RNA, 32 nt, Human
ggagccgcucaagucugggagggcaugggagc

SEQ ID NO: 186858 - RNA, 25 nt, Human
ggagccgcugcccccagcgaagucc

SEQ ID NO: 186859 - RNA, 32 nt, Human
ggagccgcugcucuccggcugagggaaucaga

SEQ ID NO: 186860 - RNA, 32 nt, Human
ggagccggaagagagcagugcuucacaauaaa

SEQ ID NO: 186861 - RNA, 32 nt, Human
ggagccggagccgccugggauguucagucaug

SEQ ID NO: 186862 - RNA, 32 nt, Human
ggagccggaggaggaggaggaggaggaggcaa

SEQ ID NO: 186863 - RNA, 32 nt, Human
ggagccggcgcgcaccagccuagcgaucggcc

SEQ ID NO: 186864 - RNA, 32 nt, Human
ggagccggcucacugcacuacccccgcccccu

SEQ ID NO: 186865 - RNA, 19 nt, Human
ggagccgggaggccugcgg

SEQ ID NO: 186866 - RNA, 20 nt, Human
ggagccgggcauucaacuca

SEQ ID NO: 186867 - RNA, 19 nt, Human
ggagccgggccccugggag

SEQ ID NO: 186868 - RNA, 18 nt, Human
ggagccgggcgccugcgg

SEQ ID NO: 186869 - RNA, 32 nt, Human
ggagccgggcuggagaguggggagcacggaga

SEQ ID NO: 186870 - RNA, 32 nt, Human
ggagccgggcuggggguggggaagggaggccg

SEQ ID NO: 186871 - RNA, 32 nt, Human
ggagccgggcuucucuuuuggcccccagcgug

SEQ ID NO: 186872 - RNA, 32 nt, Human
ggagccgggggacugugcuggucugagcccca

SEQ ID NO: 186873 - RNA, 17 nt, Human
ggagccgguggacagcg

SEQ ID NO: 186874 - RNA, 32 nt, Human
ggagccgguugcaggccgagaugcugcagaug

SEQ ID NO: 186875 - RNA, 32 nt, Human
ggagccguacucccagcggccccacaccacga

SEQ ID NO: 186876 - RNA, 21 nt, Human
ggagccgucgugggugccgag

SEQ ID NO: 186877 - RNA, 19 nt, Human
ggagccgugcgccagggca

SEQ ID NO: 186878 - RNA, 32 nt, Human
ggagccguggaggaugcaaagacggcccggcu

SEQ ID NO: 186879 - RNA, 32 nt, Human
ggagccguggggccuggauguggacugugcag

SEQ ID NO: 186880 - RNA, 32 nt, Human
ggaggugcucuugugcacacagcaggucaaag

SEQ ID NO: 186881 - RNA, 32 nt, Human
ggaggugcugaggaguuggugguagcagcaga

SEQ ID NO: 186882 - RNA, 32 nt, Human
ggaggugcugguagcugaggggacgggcaagu

SEQ ID NO: 186883 - RNA, 32 nt, Human
ggaggugcuuccugcaccucaggaugggcgag

SEQ ID NO: 186884 - RNA, 32 nt, Human
ggagguggacgucugggcugggcgccggacaa

SEQ ID NO: 186885 - RNA, 32 nt, Human
ggagguggacguugcagugaucccagauugug

SEQ ID NO: 186886 - RNA, 24 nt, Human
ggagguggagcagaagaucgcggg

SEQ ID NO: 186887 - RNA, 24 nt, Human
ggagguggagcccagagcccaagg

SEQ ID NO: 186888 - RNA, 32 nt, Human
ggagguggagcccagagcccaaggaagagcug

SEQ ID NO: 186889 - RNA, 32 nt, Human
ggagguggagcuugcagugagcggagaucgcg

SEQ ID NO: 186890 - RNA, 32 nt, Human
ggagguggagcuuguagugaggcgagauggcg

SEQ ID NO: 186891 - RNA, 21 nt, Human
ggagguggaggaggaggaaga

SEQ ID NO: 186892 - RNA, 32 nt, Human
ggagguggaggaggaggaagaggagaaggaaa

SEQ ID NO: 186893 - RNA, 32 nt, Human
ggagguggaggaggaggaggaggaggaggagg

SEQ ID NO: 186894 - RNA, 32 nt, Human
ggagguggaggcagagauuacugugggccaag

SEQ ID NO: 186895 - RNA, 32 nt, Human
ggagguggaggcagugagcugagaucgugcca

SEQ ID NO: 186896 - RNA, 32 nt, Human
ggagguggagggaggaaggugggaauuauuau

SEQ ID NO: 186897 - RNA, 32 nt, Human
ggagguggaggggaggcugcagugagcugaga

SEQ ID NO: 186898 - RNA, 32 nt, Human
ggagguggagggugccuguaaucccagcuccu

SEQ ID NO: 186899 - RNA, 32 nt, Human
ggagguggagguaggaagauugcuugaggcca

SEQ ID NO: 186900 - RNA, 32 nt, Human
ggagguggagguggagguugcagugagccgag

SEQ ID NO: 186901 - RNA, 20 nt, Human
ggagguggagguugcaguga

SEQ ID NO: 186902 - RNA, 21 nt, Human
ggagguggagguugcagugag

SEQ ID NO: 186903 - RNA, 32 nt, Human
ggagguggagguugcagugaggugagaucgug

SEQ ID NO: 186904 - RNA, 23 nt, Human
ggagguggaguggcaccugcugg

SEQ ID NO: 186905 - RNA, 24 nt, Human
ggagguggaguucuuccaugcagg

SEQ ID NO: 186906 - RNA, 32 nt, Human
ggagguggauagacggggcagcugcaggcucc

SEQ ID NO: 186907 - RNA, 32 nt, Human
ggagguggauggaucacuugaggccaggaguu

SEQ ID NO: 186908 - RNA, 32 nt, Human
ggagguggcagccucuaccuuccuggacaggg

SEQ ID NO: 186909 - RNA, 19 nt, Human
ggagguggccagcccgcag

SEQ ID NO: 186910 - RNA, 19 nt, Human
ggagguggccagcuccagg

SEQ ID NO: 186911 - RNA, 18 nt, Human
ggagguggccaggccugc

SEQ ID NO: 186912 - RNA, 32 nt, Human
ggagguggcccagccacuucugcagaguuccu

SEQ ID NO: 186913 - RNA, 32 nt, Human
ggagguggcccagguggucaaguucacagaag

SEQ ID NO: 186914 - RNA, 20 nt, Human
ggagguggcggccucugggg

SEQ ID NO: 186915 - RNA, 22 nt, Human
ggagguggcggcggcugggaga

SEQ ID NO: 186916 - RNA, 21 nt, Human
ggagguggcgggaggacggcu

SEQ ID NO: 186917 - RNA, 32 nt, Human
ggagguggcgguugcagugagcacagaucaug

SEQ ID NO: 186918 - RNA, 18 nt, Human
ggagguggcucuggcuca

SEQ ID NO: 186919 - RNA, 32 nt, Human
ggagguggcugcagagagccacuugucccacg

SEQ ID NO: 186920 - RNA, 24 nt, Human
ggaggugggacaacacuugcaugg

SEQ ID NO: 186921 - RNA, 23 nt, Human
ggaggugggacaggggcaagagg

SEQ ID NO: 186922 - RNA, 32 nt, Human
ggaggugggagaaucacuugagcccaggaguu

SEQ ID NO: 186923 - RNA, 32 nt, Human
ggaggugggagaugcagccaggaggaacagcu

SEQ ID NO: 186924 - RNA, 32 nt, Human
ggaggugggaggagggagugacgagucaagga

SEQ ID NO: 186925 - RNA, 32 nt, Human
ggaggugggaggauugcccgaguccaggaauu

SEQ ID NO: 186926 - RNA, 32 nt, Human
ggaggugggaggggguugagggcugaguaugc

SEQ ID NO: 186927 - RNA, 32 nt, Human
ggaggugggaggugggagaggaagguggagua

SEQ ID NO: 186928 - RNA, 21 nt, Human
ggaggugggaguggcugcagg

SEQ ID NO: 186929 - RNA, 32 nt, Human
ggaggugggagugggcuggaggccucuggaga

SEQ ID NO: 186930 - RNA, 32 nt, Human
ggaggugggauuuugccauguuggccaggcug

SEQ ID NO: 186931 - RNA, 32 nt, Human
ggaggugggcagcucagacuccacaugcuggu

SEQ ID NO: 186932 - RNA, 32 nt, Human
ggaggugggcagggaaggggagggcugugcgu

SEQ ID NO: 186933 - RNA, 32 nt, Human
ggaggugggcagggcugcuccaggcaggucag

SEQ ID NO: 186934 - RNA, 32 nt, Human
ggaggugggcagguagcugauaggggcagcca

SEQ ID NO: 186935 - RNA, 24 nt, Human
ggaggugggcccagaaaggggcuu

SEQ ID NO: 186936 - RNA, 27 nt, Human
ggaggugggcccagaaaggggcuuccc

SEQ ID NO: 186937 - RNA, 18 nt, Human
ggaggugggccugcccca

SEQ ID NO: 186938 - RNA, 32 nt, Human
ggaggugggcggaucacuugagcccaggaauu

SEQ ID NO: 186939 - RNA, 25 nt, Human
ggaggugggcuggcgcggagggagg

SEQ ID NO: 186940 - RNA, 32 nt, Human
ggaggugggcugggcccucgcuccugacuguu

SEQ ID NO: 186941 - RNA, 32 nt, Human
ggaggugggcugggcccucucuucucaccuuu

SEQ ID NO: 186942 - RNA, 32 nt, Human
ggagguggggauccgagugcagugagagccuc

SEQ ID NO: 186943 - RNA, 21 nt, Human
ggagguggggcaggaggaugu

SEQ ID NO: 186944 - RNA, 18 nt, Human
ggagguggggcaggggga

SEQ ID NO: 186945 - RNA, 22 nt, Human
ggagguggggcauggcacagca

SEQ ID NO: 186946 - RNA, 32 nt, Human
ggagguggggcguuugggggugugcggugggg

SEQ ID NO: 186947 - RNA, 32 nt, Human
ggagguggggcucugcagcugugagauggccc

SEQ ID NO: 186948 - RNA, 32 nt, Human
ggaggugggggaaugugguaacauugaauaca

SEQ ID NO: 186949 - RNA, 20 nt, Human
ggaggugggggaccgcugca

SEQ ID NO: 186950 - RNA, 32 nt, Human
ggagguggggguagggggcacagaacaccaga

SEQ ID NO: 186951 - RNA, 31 nt, Human
ggaggugggguggaaauagggugggcuccuu

SEQ ID NO: 186952 - RNA, 32 nt, Human
ggaggugggguuuugccauguugcccaggugg

SEQ ID NO: 186953 - RNA, 32 nt, Human
ggagguggguauugugugugugggaagguggg

SEQ ID NO: 186954 - RNA, 17 nt, Human
ggagguggguccuggga

SEQ ID NO: 186955 - RNA, 32 nt, Human
ggaggugggugagacagaggguggggaggaua

SEQ ID NO: 186956 - RNA, 23 nt, Human
ggagguggguggaggcaugcagg

SEQ ID NO: 186957 - RNA, 32 nt, Human
ggagguggucuuaggcaguguggacccuccau

SEQ ID NO: 186958 - RNA, 32 nt, Human
ggagguggugacauuggaacagugcauacagc

SEQ ID NO: 186959 - RNA, 27 nt, Human
ggagguggugaggaagaggaagggagg

SEQ ID NO: 186960 - RNA, 32 nt, Human
ggagguggugaguuggcuacaagagaaaggga

SEQ ID NO: 186961 - RNA, 32 nt, Human
ggagguggugcucucagccauuguagaagaug

SEQ ID NO: 186962 - RNA, 32 nt, Human
ggagguggugcugcuggacugagccaguggag

SEQ ID NO: 186963 - RNA, 32 nt, Human
ggaggugguggaggaggaggaggaggaggaag

SEQ ID NO: 186964 - RNA, 32 nt, Human
ggaggugguggaggaggaguuggugggggaag

SEQ ID NO: 186965 - RNA, 19 nt, Human
ggaggugguggcggcggga

SEQ ID NO: 186966 - RNA, 22 nt, Human
ggaggugguggcugggcugcag

SEQ ID NO: 186967 - RNA, 26 nt, Human
ggagguggugggagggagaaggaagg

SEQ ID NO: 186968 - RNA, 32 nt, Human
ggaggugguggggaaaauggucaguaggacag

SEQ ID NO: 186969 - RNA, 20 nt, Human
ggagguggugguauugggau

SEQ ID NO: 186970 - RNA, 21 nt, Human
ggaggugguguuggcugcagg

SEQ ID NO: 186971 - RNA, 32 nt, Human
ggaggugguuucgguugcggcagucgcguccc

SEQ ID NO: 186972 - RNA, 18 nt, Human
ggaggugucucuggcuca

SEQ ID NO: 186973 - RNA, 16 nt, Human
ggaggugucucugggg

SEQ ID NO: 186974 - RNA, 32 nt, Human
ggaggugugcaggggguggggagcagcccagc

SEQ ID NO: 186975 - RNA, 32 nt, Human
ggaggugugcuaaggcugcccuccacacccgc

SEQ ID NO: 186976 - RNA, 32 nt, Human
ggagguguggcaaggaucuuaucagaaggcuu

SEQ ID NO: 186977 - RNA, 21 nt, Human
ggaggugugggguaagggagg

SEQ ID NO: 186978 - RNA, 32 nt, Human
ggagguguugagugagcaacacgcagaagcuc

SEQ ID NO: 186979 - RNA, 32 nt, Human
ggagguguugcggcagagguuugagugaaccc

SEQ ID NO: 186980 - RNA, 32 nt, Human
ggagguguugggggacacuccuccccuccccc

SEQ ID NO: 186981 - RNA, 32 nt, Human
ggagguuaaauacugaccuaaguucacuuagc

SEQ ID NO: 186982 - RNA, 32 nt, Human
ggagguuaaggugggaggauugcuugggcccu

SEQ ID NO: 186983 - RNA, 32 nt, Human
ggagguuaagucuacauuuccaccacugagca

SEQ ID NO: 186984 - RNA, 32 nt, Human
ggagguucacuuaaggucaggaauucuagacc

SEQ ID NO: 186985 - RNA, 32 nt, Human
ggagguucagccccuucucugggaugugguuc

SEQ ID NO: 186986 - RNA, 32 nt, Human
ggagguuccaacaaucuccagaaccuuuggcc

SEQ ID NO: 186987 - RNA, 32 nt, Human
ggagguucuacaacaggaaaucaggccuacag

SEQ ID NO: 186988 - RNA, 32 nt, Human
ggagguucucugcccaccucaggcacuggaaa

SEQ ID NO: 186989 - RNA, 32 nt, Human
ggagguugaaaacuaagcauggggaagagcug

SEQ ID NO: 186990 - RNA, 32 nt, Human
ggagguugacuugccucucgggccccguaggu

SEQ ID NO: 186991 - RNA, 24 nt, Human
ggagguugagcaggaggauugcuu

SEQ ID NO: 186992 - RNA, 32 nt, Human
ggagguugaggcagaagaaucgcuugaaccca

SEQ ID NO: 186993 - RNA, 32 nt, Human
ggagguugaggcagaaggauugcuggagccca

SEQ ID NO: 186994 - RNA, 25 nt, Human
ggagguugaggcagaaggauugcuu

SEQ ID NO: 186995 - RNA, 32 nt, Human
ggagguugaggcagcagaauugcuugaaccca

SEQ ID NO: 186996 - RNA, 32 nt, Human
ggagguugaggcagcaggauugcuggagccca

SEQ ID NO: 186997 - RNA, 22 nt, Human
ggagguugaggcaggagaauca

SEQ ID NO: 186998 - RNA, 32 nt, Human
ggagguugaggcaggagaaucgcuugaacccg

SEQ ID NO: 186999 - RNA, 32 nt, Human
ggagguugaggcaggagaaucgcuugaaccug

SEQ ID NO: 187000 - RNA, 32 nt, Human
ggagguugaggcaggagaauggggugaacccg

SEQ ID NO: 187001 - RNA, 32 nt, Human
ggagguugaggcaggagaauugcuugaaccca

SEQ ID NO: 187002 - RNA, 32 nt, Human
ggagguugaggcaggaggaucgcuugagccca

SEQ ID NO: 187003 - RNA, 32 nt, Human
ggagguugaggcaggaggauugcuugaggcca

SEQ ID NO: 187004 - RNA, 24 nt, Human
ggagguugaggcgggagaacugcu

SEQ ID NO: 187005 - RNA, 32 nt, Human
ggagguugagguaggagaauugcuugaaccug

SEQ ID NO: 187006 - RNA, 32 nt, Human
ggagguugagguaggaggaucgcuugaaccca

SEQ ID NO: 187007 - RNA, 32 nt, Human
ggagguugagguagguagauugcuugagccca

SEQ ID NO: 187008 - RNA, 25 nt, Human
ggagguugaggugggaagauugcuu

SEQ ID NO: 187009 - RNA, 32 nt, Human
ggagguugaggugggaagauugcuugagccca

SEQ ID NO: 187010 - RNA, 25 nt, Human
ggagguugaggugggaggaucacuu

SEQ ID NO: 187011 - RNA, 25 nt, Human
ggagguugaggugggaggaucgcuu

SEQ ID NO: 187012 - RNA, 32 nt, Human
ggagguugaggugggaggaucgcuugagccca

SEQ ID NO: 187013 - RNA, 32 nt, Human
ggagguugaggugggaggauuugcuugaaccc

SEQ ID NO: 187014 - RNA, 32 nt, Human
ggagguugagguggguggaucaugaggucagg

SEQ ID NO: 187015 - RNA, 32 nt, Human
ggagguugagucacgagaauugcuugaaccug

SEQ ID NO: 187016 - RNA, 32 nt, Human
ggagguugcaaccacaaaauucagagagguga

SEQ ID NO: 187017 - RNA, 32 nt, Human
ggagguugcacugagcugagaccauggaauug

SEQ ID NO: 187018 - RNA, 32 nt, Human
ggagguugcaguaagccaagaucgugccauug

SEQ ID NO: 187019 - RNA, 32 nt, Human
ggagguugcagugagccgagaucaugucacug

SEQ ID NO: 187020 - RNA, 32 nt, Human
ggagguugcauucaacugagaucauaccacuu

SEQ ID NO: 187021 - RNA, 32 nt, Human
ggagguugcggugacccuccagcuugggcaac

SEQ ID NO: 187022 - RNA, 30 nt, Human
ggagguugcuugaaaucagaaaauacagac

SEQ ID NO: 187023 - RNA, 32 nt, Human
ggagguuggaaaugcuccaguggagaugggaa

SEQ ID NO: 187024 - RNA, 32 nt, Human
ggagguuggaaguccgagaucaaggugccgac

SEQ ID NO: 187025 - RNA, 32 nt, Human
ggagguuggagagagaaagggugaaagcagag

SEQ ID NO: 187026 - RNA, 25 nt, Human
ggagguuggcccagagcccugcagg

SEQ ID NO: 187027 - RNA, 32 nt, Human
ggagguugggugggccggcuucaugccagcua

SEQ ID NO: 187028 - RNA, 32 nt, Human
ggagguuguaccacugcacuccagccuggcug

SEQ ID NO: 187029 - RNA, 32 nt, Human
ggagguugucugggacagacugcuccugacag

SEQ ID NO: 187030 - RNA, 32 nt, Human
ggagguuguggcggagguuguggugagcugag

SEQ ID NO: 187031 - RNA, 32 nt, Human
ggagguugugggcauugauggggaaggaggcu

SEQ ID NO: 187032 - RNA, 32 nt, Human
ggagguuuaggcaggagaaucgcuugaacccu

SEQ ID NO: 187033 - RNA, 32 nt, Human
ggagguuuccacaccccuccccugggccgcug

SEQ ID NO: 187034 - RNA, 21 nt, Human
ggagguuuccgggaggcugcu

SEQ ID NO: 187035 - RNA, 32 nt, Human
ggagguuucuauaaugccacauagaaagaggc

SEQ ID NO: 187036 - RNA, 32 nt, Human
ggagguuucugaggcugacagaaacaagcauu

SEQ ID NO: 187037 - RNA, 32 nt, Human
ggagguuuggggaguucagaccuccaaaccuu

SEQ ID NO: 187038 - RNA, 32 nt, Human
ggagguuuguaggaguccucggacgugggaua

SEQ ID NO: 187039 - RNA, 21 nt, Human
ggagguuuucuuuguuccaua

SEQ ID NO: 187040 - RNA, 32 nt, Human
ggagguuuuuaacagaacguguauuuauuaau

SEQ ID NO: 187041 - RNA, 32 nt, Human
ggaguaaagcucaggaggugagugagucucuu

SEQ ID NO: 187042 - RNA, 32 nt, Human
ggaguaaauagaauugagacugcaaaggaaga

SEQ ID NO: 187043 - RNA, 32 nt, Human
ggaguaacacuaaagcuacaagaaauauguaa

SEQ ID NO: 187044 - RNA, 19 nt, Human
ggaguaacaggcucagaga

SEQ ID NO: 187045 - RNA, 32 nt, Human
ggaguaacaggugucuggaggcugaagggugg

SEQ ID NO: 187046 - RNA, 32 nt, Human
ggaguaaccaaagagaguauggaccagaguga

SEQ ID NO: 187047 - RNA, 32 nt, Human
ggaguaagaaaagaugguuagugauauuugga

SEQ ID NO: 187048 - RNA, 32 nt, Human
ggaguaagaagaggauuaaaaaggaaaggcaa

SEQ ID NO: 187049 - RNA, 32 nt, Human
ggaguaagagugagaaagaguaagauuaauag

SEQ ID NO: 187050 - RNA, 21 nt, Human
ggaguaagcguuguugcugaa

SEQ ID NO: 187051 - RNA, 32 nt, Human
ggaguaaggcuggacuccaauggcccauuccc

SEQ ID NO: 187052 - RNA, 32 nt, Human
ggaguaagugaaaaccugccuuuugccacucu

SEQ ID NO: 187053 - RNA, 32 nt, Human
ggaguaaugagcuccugguuccucgggagucc

SEQ ID NO: 187054 - RNA, 32 nt, Human
ggaguaauucagcauuaaaauaaauguaauua

SEQ ID NO: 187055 - RNA, 32 nt, Human
ggaguacaaauccugcucuggucucuggcccc

SEQ ID NO: 187056 - RNA, 32 nt, Human
ggaguacaauggugcgaucuuugcucacugca

SEQ ID NO: 187057 - RNA, 32 nt, Human
ggaguacacagcaguguccuucugcuaaugac

SEQ ID NO: 187058 - RNA, 32 nt, Human
ggaguacaccaggcucagcuguggaccccuca

SEQ ID NO: 187059 - RNA, 32 nt, Human
ggaguacaccuugagcgcuugugugcaguuau

SEQ ID NO: 187060 - RNA, 32 nt, Human
ggaguacacugagguucuagaggcaacagggu

SEQ ID NO: 187061 - RNA, 32 nt, Human
ggaguacagaugcacaccaccacacccagccu

SEQ ID NO: 187062 - RNA, 32 nt, Human
ggaguacaggugcacaccaccaugccuggcua

SEQ ID NO: 187063 - RNA, 32 nt, Human
ggaguacaguagugcaaucacagcugacugca

SEQ ID NO: 187064 - RNA, 32 nt, Human
ggaguaccucaagggccccggccuggguggcg

SEQ ID NO: 187065 - RNA, 32 nt, Human
ggaguaccugcucuguuuuuggcugugagacu

SEQ ID NO: 187066 - RNA, 32 nt, Human
ggaguacggacgggagucagaggcagagcgag

SEQ ID NO: 187067 - RNA, 23 nt, Human
ggaguacggagcagguggaccau

SEQ ID NO: 187068 - RNA, 32 nt, Human
ggaguagaauaccaaaugauagaaacagacug

SEQ ID NO: 187069 - RNA, 32 nt, Human
ggaguagaauuugaugcaaagcagaaagaaau

SEQ ID NO: 187070 - RNA, 32 nt, Human
ggaguagaccauggccuccagcccauggggcu

SEQ ID NO: 187071 - RNA, 32 nt, Human
ggaguagagaaagaaagagcaagagcaggcag

SEQ ID NO: 187072 - RNA, 32 nt, Human
ggaguagagagaucugaccucuugccaggaau

SEQ ID NO: 187073 - RNA, 23 nt, Human
ggaguagcccagcgaaggcacuu

SEQ ID NO: 187074 - RNA, 32 nt, Human
ggaguagcuguggacagaggaaccaacaucug

SEQ ID NO: 187075 - RNA, 32 nt, Human
ggaguaggaagaucaggagcuagagggagacu

SEQ ID NO: 187076 - RNA, 32 nt, Human
ggaguaggaauagaagugcaagcuggaaaggc

SEQ ID NO: 187077 - RNA, 32 nt, Human
ggaguaggagaaauccaccugcugggggcuga

SEQ ID NO: 187078 - RNA, 18 nt, Human
ggaguaggaggaggcagg

SEQ ID NO: 187079 - RNA, 18 nt, Human
ggaguaggcagguggauc

SEQ ID NO: 187080 - RNA, 22 nt, Human
ggaguaggcggcagugaguuuc

SEQ ID NO: 187081 - RNA, 32 nt, Human
ggaguaggcggcagugaguuucccugggaggg

SEQ ID NO: 187082 - RNA, 32 nt, Human
ggaguaggcugugggagccgggagccaacagc

SEQ ID NO: 187083 - RNA, 21 nt, Human
ggaguagggcggagcgggcgg

SEQ ID NO: 187084 - RNA, 32 nt, Human
ggaguagggcgggaaggggcagugaggagccg

SEQ ID NO: 187085 - RNA, 32 nt, Human
ggaguagggcuggggacccuagggccgcucca

SEQ ID NO: 187086 - RNA, 32 nt, Human
ggaguagggggaagaaaggagucagggacaga

SEQ ID NO: 187087 - RNA, 32 nt, Human
ggaguagggguggagucaccaaaaccagugcu

SEQ ID NO: 187088 - RNA, 32 nt, Human
ggaguagguccucugaaaaggcagcagguucc

SEQ ID NO: 187089 - RNA, 21 nt, Human
ggaguagugaccugcagugug

SEQ ID NO: 187090 - RNA, 22 nt, Human
ggaguaguggcucacaccugua

SEQ ID NO: 187091 - RNA, 32 nt, Human
ggaguauaagggggagcuagccuccuaugaua

SEQ ID NO: 187092 - RNA, 32 nt, Human
ggaguauacagaugguaagaaauuccacuuug

SEQ ID NO: 187093 - RNA, 32 nt, Human
ggaguauacuuccugaagauggagccucagga

SEQ ID NO: 187094 - RNA, 32 nt, Human
ggaguaucaguucugagccacagaugaggaaa

SEQ ID NO: 187095 - RNA, 32 nt, Human
ggaguaucauuugagccaggagguugagguug

SEQ ID NO: 187096 - RNA, 32 nt, Human
ggaguaugacaccuucggcuccaaguuccacc

SEQ ID NO: 187097 - RNA, 32 nt, Human
ggaguaugcuggaggcagagggcaagggaggg

SEQ ID NO: 187098 - RNA, 32 nt, Human
ggaguaugguaccaagcagguaggacuguuca

SEQ ID NO: 187099 - RNA, 30 nt, Human
ggaguauggucuggcgggugcccccuuucu

SEQ ID NO: 187100 - RNA, 32 nt, Human
ggaguauguauucacacacauacauauacccc

SEQ ID NO: 187101 - RNA, 32 nt, Human
ggaguauuuccacaacccaaguuuagaguugg

SEQ ID NO: 187102 - RNA, 32 nt, Human
ggaguauuuccccucauucuaccucucuaagg

SEQ ID NO: 187103 - RNA, 32 nt, Human
ggagucaaagaaacugagccuggggcaaacga

SEQ ID NO: 187104 - RNA, 32 nt, Human
ggagucaaagagaggccugcuuuucuaccaga

SEQ ID NO: 187105 - RNA, 25 nt, Human
ggagucaagcgauucuccugccuca

SEQ ID NO: 187106 - RNA, 32 nt, Human
ggagucacagccgcagccagagccgcagccaa

SEQ ID NO: 187107 - RNA, 32 nt, Human
ggagucacaggccccacccaggaagggcauuc

SEQ ID NO: 187108 - RNA, 32 nt, Human
ggagucacaguaaacagaaacccaaaaaucuc

SEQ ID NO: 187109 - RNA, 32 nt, Human
ggagucacugaugcugccucugccuucugaug

SEQ ID NO: 187110 - RNA, 32 nt, Human
ggagucacugcaaggcccccagggugggaugg

SEQ ID NO: 187111 - RNA, 32 nt, Human
ggagucacuuugggcuuccugucccaacuugu

SEQ ID NO: 187112 - RNA, 32 nt, Human
ggagucacuuuuguauucuuuuuaaccagauu

SEQ ID NO: 187113 - RNA, 32 nt, Human
ggagucagaggugacuggcggcuuccaggcug

SEQ ID NO: 187114 - RNA, 32 nt, Human
ggagucagaggugccuccaggagcagcaggag

SEQ ID NO: 187115 - RNA, 32 nt, Human
ggagucagccugaagacacaggguggauuauu

SEQ ID NO: 187116 - RNA, 32 nt, Human
ggagucagcuggaacauaccacugccucuaga

SEQ ID NO: 187117 - RNA, 32 nt, Human
ggagucaggaccuccggggagagcagaggguu

SEQ ID NO: 187118 - RNA, 32 nt, Human
ggagucaggagaaucacuugagcucaggaguu

SEQ ID NO: 187119 - RNA, 32 nt, Human
ggagucaggaggugggaggccgugggcuuugg

SEQ ID NO: 187120 - RNA, 32 nt, Human
ggagucaggcgcagccucacaccagcugccuc

SEQ ID NO: 187121 - RNA, 32 nt, Human
ggagucagguccaaacagucccuaucgccacu

SEQ ID NO: 187122 - RNA, 32 nt, Human
ggagucagugaugcagagaaccucaggagaug

SEQ ID NO: 187123 - RNA, 32 nt, Human
ggagucaguuugcaguaugcuccacgugguaa

SEQ ID NO: 187124 - RNA, 32 nt, Human
ggagucaucagcagguuuaauuuuggaggaac

SEQ ID NO: 187125 - RNA, 32 nt, Human
ggagucaucaggagaggagaaugaggaugagg

SEQ ID NO: 187126 - RNA, 22 nt, Human
ggagucaugccacuccccacug

SEQ ID NO: 187127 - RNA, 32 nt, Human
ggagucauggucaggggugagaccugaaggac

SEQ ID NO: 187128 - RNA, 32 nt, Human
ggagucaugucccucacauccuuuguacaaau

SEQ ID NO: 187129 - RNA, 32 nt, Human
ggagucauguccuaugucugccugaacgcguc

SEQ ID NO: 187130 - RNA, 32 nt, Human
ggagucaugugacccacacaauggcugagugg

SEQ ID NO: 187131 - RNA, 32 nt, Human
ggagucauuccaagacuccuguccucacucag

SEQ ID NO: 187132 - RNA, 32 nt, Human
ggagucauugcugccaucauuaucauccccuc

SEQ ID NO: 187133 - RNA, 32 nt, Human
ggaguccaagcccccaggcuacagagaggagc

SEQ ID NO: 187134 - RNA, 32 nt, Human
ggaguccaaggcaggaggauugcuugagccca

SEQ ID NO: 187135 - RNA, 32 nt, Human
ggaguccaccaaccuagccacagggaccccag

SEQ ID NO: 187136 - RNA, 32 nt, Human
ggaguccaccugcugagcaggaccggguguga

SEQ ID NO: 187137 - RNA, 32 nt, Human
ggaguccacugagguucuugcauccugaagca

SEQ ID NO: 187138 - RNA, 31 nt, Human
ggaguccagagaggcaggaggauggagcucg

SEQ ID NO: 187139 - RNA, 32 nt, Human
ggaguccaggcuucucugaaaccagggcugag

SEQ ID NO: 187140 - RNA, 32 nt, Human
ggaguccagggagggagcugaggagcccuuac

SEQ ID NO: 187141 - RNA, 32 nt, Human
ggaguccagggugggaguauugcuugagguaa

SEQ ID NO: 187142 - RNA, 32 nt, Human
ggaguccauuauuugaguuugacauuuaauaa

SEQ ID NO: 187143 - RNA, 31 nt, Human
ggagucccacaauagaauacccaacaaagug

SEQ ID NO: 187144 - RNA, 32 nt, Human
ggagucccagaagagggcgagaucaaagcgcu

SEQ ID NO: 187145 - RNA, 32 nt, Human
ggaguccccaggagcugggagaggcaggaagg

SEQ ID NO: 187146 - RNA, 20 nt, Human
ggaguccccgggggacugcu

SEQ ID NO: 187147 - RNA, 32 nt, Human
ggaguccccugaguccuuugacuuaguacuga

SEQ ID NO: 187148 - RNA, 32 nt, Human
ggaguccccugccucuaugguguuuaaggcuc

SEQ ID NO: 187149 - RNA, 32 nt, Human
ggaguccccugggcucccucaggcucugguau

SEQ ID NO: 187150 - RNA, 32 nt, Human
ggagucccuguucaaaacccgggagaaggagu

SEQ ID NO: 187151 - RNA, 32 nt, Human
ggagucccuuaaauacaguugcuucucaagaa

SEQ ID NO: 187152 - RNA, 32 nt, Human
ggagucccuuuugaugggaagugcagucagca

SEQ ID NO: 187153 - RNA, 32 nt, Human
ggaguccgaggcagguggauugcuugaggcca

SEQ ID NO: 187154 - RNA, 32 nt, Human
ggaguccgaggugggaggauugcuugagacca

SEQ ID NO: 187155 - RNA, 32 nt, Human
ggaguccgcagugagauucugggucucaguac

SEQ ID NO: 187156 - RNA, 32 nt, Human
ggaguccuacagccugcagccccuaccagaga

SEQ ID NO: 187157 - RNA, 32 nt, Human
ggaguccuccuguguugcccaggcugguauuc

SEQ ID NO: 187158 - RNA, 32 nt, Human
ggaguccugaacaucuggggacagcgggaaaa

SEQ ID NO: 187159 - RNA, 32 nt, Human
ggaguccugaaggagggccugaugucuucauc

SEQ ID NO: 187160 - RNA, 32 nt, Human
ggaguccugagaugcagucaugggaacccgca

SEQ ID NO: 187161 - RNA, 32 nt, Human
ggaguccuggccccugaaucaccagagccacc

SEQ ID NO: 187162 - RNA, 32 nt, Human
ggaguccuguucucugagcuccacagaagaca

SEQ ID NO: 187163 - RNA, 32 nt, Human
ggaguccuguugggugaaugaggcagauggga

SEQ ID NO: 187164 - RNA, 32 nt, Human
ggaguccuugcccaggcuggagugcaguggcg

SEQ ID NO: 187165 - RNA, 32 nt, Human
ggagucgagccgcggccgggagccgggcgggc

SEQ ID NO: 187166 - RNA, 32 nt, Human
ggagucgcgugucagggcuggagggagaucuu

SEQ ID NO: 187167 - RNA, 32 nt, Human
ggagucgcuccaggaggggcuggagugguagc

SEQ ID NO: 187168 - RNA, 32 nt, Human
ggagucggaggaagaggagggaggagggaggc

SEQ ID NO: 187169 - RNA, 32 nt, Human
ggagucggagggaggaagugaggaagggucaa

SEQ ID NO: 187170 - RNA, 32 nt, Human
ggagucggaucuagccauggcuggcagagguu

SEQ ID NO: 187171 - RNA, 32 nt, Human
ggagucggauucccuccugccugcacgccuuc

SEQ ID NO: 187172 - RNA, 32 nt, Human
ggagucggcugcagcagagggcaggagcccca

SEQ ID NO: 187173 - RNA, 23 nt, Human
ggagucgggcagggaccugcagg

SEQ ID NO: 187174 - RNA, 32 nt, Human
ggagucgggccgcugagcccacggcagcggcc

SEQ ID NO: 187175 - RNA, 32 nt, Human
ggagucgggcggagcggcuggggaugagcgcg

SEQ ID NO: 187176 - RNA, 18 nt, Human
ggagucggggagccggga

SEQ ID NO: 187177 - RNA, 32 nt, Human
ggagucggggaucucccuccccuagccaaggg

SEQ ID NO: 187178 - RNA, 32 nt, Human
ggagucgggugaggaaaaugacccugcuggag

SEQ ID NO: 187179 - RNA, 32 nt, Human
ggagucguguaugguaggguaagugagagagg

SEQ ID NO: 187180 - RNA, 19 nt, Human
ggagucgugucgugccuga

SEQ ID NO: 187181 - RNA, 32 nt, Human
ggagucuaaagaagagaaagaaaaucaagaug

SEQ ID NO: 187182 - RNA, 19 nt, Human
ggagucuauagucuuggga

SEQ ID NO: 187183 - RNA, 32 nt, Human
ggagucuaucagacgugggcugaauuuugcug

SEQ ID NO: 187184 - RNA, 32 nt, Human
ggagucuauuuaugaagucuccagaccuuggg

SEQ ID NO: 187185 - RNA, 32 nt, Human
ggagucucaaagcuggagaguuuaccaacaaa

SEQ ID NO: 187186 - RNA, 32 nt, Human
ggagucucacuccauugcccaggcuggaguac

SEQ ID NO: 187187 - RNA, 32 nt, Human
ggagucucacucuggugcccaggcuggagugg

SEQ ID NO: 187188 - RNA, 32 nt, Human
ggagucucacucuguaacccaggcuggagugc

SEQ ID NO: 187189 - RNA, 32 nt, Human
ggagucucacucugucaccagacuggagugca

SEQ ID NO: 187190 - RNA, 32 nt, Human
ggagucucacucuguuacccaggcuggaaugc

SEQ ID NO: 187191 - RNA, 32 nt, Human
ggagucucacucuugucaccuaggcaagagug

SEQ ID NO: 187192 - RNA, 32 nt, Human
ggagucucacugggcgacagagccagauucug

SEQ ID NO: 187193 - RNA, 32 nt, Human
ggagucucacuuuguaacccaggcuggaaugc

SEQ ID NO: 187194 - RNA, 32 nt, Human
ggagucucagcuucacccugaggugagcauca

SEQ ID NO: 187195 - RNA, 32 nt, Human
ggagucucaggcaggagaauugcuugaaucca

SEQ ID NO: 187196 - RNA, 32 nt, Human
ggagucucaguggauguuugacuuuugcuuuc

SEQ ID NO: 187197 - RNA, 32 nt, Human
ggagucucccuauguugcccaggcuggucucc

SEQ ID NO: 187198 - RNA, 32 nt, Human
ggagucucccucugucguccaggcuggagugc

SEQ ID NO: 187199 - RNA, 32 nt, Human
ggagucucccucuguugcccaggcuggagugc

SEQ ID NO: 187200 - RNA, 32 nt, Human
ggagucucccuuggaauucauccugcuccuuc

SEQ ID NO: 187201 - RNA, 32 nt, Human
ggagucuccuucugucgcccaggcuggagugc

SEQ ID NO: 187202 - RNA, 32 nt, Human
ggagucucgagguugaaccacagaucuggacg

SEQ ID NO: 187203 - RNA, 32 nt, Human
ggagucucgauuucaagggagcuccuggaguu

SEQ ID NO: 187204 - RNA, 32 nt, Human
ggagucucgcucagcugcccaggcuggagugu

SEQ ID NO: 187205 - RNA, 32 nt, Human
ggagucucgcuccgucacccaggcuggagugc

SEQ ID NO: 187206 - RNA, 32 nt, Human
ggagucucgcucucuggagugcaauggcgcaa

SEQ ID NO: 187207 - RNA, 32 nt, Human
ggagucucgcuguguuguccaggcuggagugc

SEQ ID NO: 187208 - RNA, 32 nt, Human
ggagucucuagcaugcagcccaggccuucucc

SEQ ID NO: 187209 - RNA, 32 nt, Human
ggagucucucugcacuccagccugggugacag

SEQ ID NO: 187210 - RNA, 32 nt, Human
ggagucucuuccuauguggucuucucuacccc

SEQ ID NO: 187211 - RNA, 32 nt, Human
ggagucucuuugugguucugauuugcaucucu

SEQ ID NO: 187212 - RNA, 32 nt, Human
ggagucugagccggugguugcagcggaggcgg

SEQ ID NO: 187213 - RNA, 32 nt, Human
ggagucugagccugaagagccccaaagcagga

SEQ ID NO: 187214 - RNA, 32 nt, Human
ggagucugagcucugcugcaucugucacagca

SEQ ID NO: 187215 - RNA, 32 nt, Human
ggagucugaggcaggagaaucgcuugaaccca

SEQ ID NO: 187216 - RNA, 32 nt, Human
ggagucugaggcaggagaauugcuugaaccug

SEQ ID NO: 187217 - RNA, 32 nt, Human
ggagucugaggcaggagaauugcuugagccca

SEQ ID NO: 187218 - RNA, 32 nt, Human
ggagucugaggcagguggaucgcuugaggcca

SEQ ID NO: 187219 - RNA, 32 nt, Human
ggagucugagucugaguccugucucugccugc

SEQ ID NO: 187220 - RNA, 32 nt, Human
ggagucugaugcuuuugcaguacucugaucgc

SEQ ID NO: 187221 - RNA, 32 nt, Human
ggagucugcacagaagugcacacaccucauug

SEQ ID NO: 187222 - RNA, 32 nt, Human
ggagucugcaccugcagagccuuugcccuagg

SEQ ID NO: 187223 - RNA, 32 nt, Human
ggagucugcacuccaggcuucuucccggccgg

SEQ ID NO: 187224 - RNA, 32 nt, Human
ggagucugcuucauuucuaucauuccauuuuu

SEQ ID NO: 187225 - RNA, 32 nt, Human
ggagucuggcgacugccccacgcccagccgug

SEQ ID NO: 187226 - RNA, 31 nt, Human
ggagucuggcucucuggcuccugugcauucu

SEQ ID NO: 187227 - RNA, 32 nt, Human
ggagucugggcccaggcugugaguuccagguc

SEQ ID NO: 187228 - RNA, 32 nt, Human
ggagucugggcugaguagaggcaccagauuug

SEQ ID NO: 187229 - RNA, 32 nt, Human
ggagucugggguccaugcguggagagggagug

SEQ ID NO: 187230 - RNA, 32 nt, Human
ggagucuguaccaagcugcuucuggaugacca

SEQ ID NO: 187231 - RNA, 32 nt, Human
ggagucuguagucucagcuauucgggaggaug

SEQ ID NO: 187232 - RNA, 32 nt, Human
ggagucuguccaccccaacuccugacagcauc

SEQ ID NO: 187233 - RNA, 32 nt, Human
ggagucugucuuuccuuagccgucugagugag

SEQ ID NO: 187234 - RNA, 25 nt, Human
ggagucuguggcaggaggauugcuu

SEQ ID NO: 187235 - RNA, 32 nt, Human
ggagucuguggcaggaggauugcuugaggcca

SEQ ID NO: 187236 - RNA, 32 nt, Human
ggagucuguggcuggggaggggcuggcagaac

SEQ ID NO: 187237 - RNA, 32 nt, Human
ggagucuuccccuguugcccaggcuggagugc

SEQ ID NO: 187238 - RNA, 32 nt, Human
ggagucuuccucugucgcccaggcuggagugc

SEQ ID NO: 187239 - RNA, 32 nt, Human
ggagucuucuguccuccuccccaacccccgag

SEQ ID NO: 187240 - RNA, 32 nt, Human
ggagucuugagaccagccugggcaacaggcua

SEQ ID NO: 187241 - RNA, 32 nt, Human
ggagucuugcgcuguugcccaggcucuagugc

SEQ ID NO: 187242 - RNA, 32 nt, Human
ggagucuugcucuauuacucaggcuggaguaa

SEQ ID NO: 187243 - RNA, 32 nt, Human
ggagucuugcucugucgccuaggcugcagugc

SEQ ID NO: 187244 - RNA, 32 nt, Human
ggagucuugcugcugcauguuccaggcuccac

SEQ ID NO: 187245 - RNA, 32 nt, Human
ggagucuugcuguguuguccaggcuggagugc

SEQ ID NO: 187246 - RNA, 32 nt, Human
ggagucuuucucugucacccaggcuggaaugc

SEQ ID NO: 187247 - RNA, 32 nt, Human
ggagucuuucucugucugugcauucauugaac

SEQ ID NO: 187248 - RNA, 32 nt, Human
ggagucuuugaucaggaugacaugugccauuu

SEQ ID NO: 187249 - RNA, 32 nt, Human
ggagugaaacagcaaaccccaaaucuucaaag

SEQ ID NO: 187250 - RNA, 32 nt, Human
ggagugaacagucccugacugccuguaggcug

SEQ ID NO: 187251 - RNA, 32 nt, Human
ggagugaaccaccaugcccagccuaaagacau

SEQ ID NO: 187252 - RNA, 32 nt, Human
ggagugaagaagcaaaaagaggaggaggaaga

SEQ ID NO: 187253 - RNA, 17 nt, Human
ggagugaagaggggcag

SEQ ID NO: 187254 - RNA, 32 nt, Human
ggagugaagagguggcucuugagggaaauggu

SEQ ID NO: 187255 - RNA, 32 nt, Human
ggagugaagcagggcuuggagcagaugguaaa

SEQ ID NO: 187256 - RNA, 32 nt, Human
ggagugaaggcagagccuggugcagauggacg

SEQ ID NO: 187257 - RNA, 32 nt, Human
ggagugaagggaagauugcaccagagaugaag

SEQ ID NO: 187258 - RNA, 32 nt, Human
ggagugaagggcccugaggucagcucccaggu

SEQ ID NO: 187259 - RNA, 32 nt, Human
ggagugacagccgcagacacacgacagccggc

SEQ ID NO: 187260 - RNA, 32 nt, Human
ggagugacaggucucaagacugcauuaaauga

SEQ ID NO: 187261 - RNA, 32 nt, Human
ggagugaccauagccacugcugaaaagucacg

SEQ ID NO: 187262 - RNA, 21 nt, Human
ggagugacccagcguuauucc

SEQ ID NO: 187263 - RNA, 19 nt, Human
ggagugacccagugcuucc

SEQ ID NO: 187264 - RNA, 32 nt, Human
ggagugaccccgggggcacacaggcuccacac

SEQ ID NO: 187265 - RNA, 17 nt, Human
ggagugacgcaucucca

SEQ ID NO: 187266 - RNA, 32 nt, Human
ggagugacugcauaaugucagcauuuugugcu

SEQ ID NO: 187267 - RNA, 32 nt, Human
ggagugacuggcuucuccuuguccucauuuau

SEQ ID NO: 187268 - RNA, 32 nt, Human
ggagugagaagagccgcucccgcuagaggaaa

SEQ ID NO: 187269 - RNA, 32 nt, Human
ggagugagaagaugccuggcgagguuuuggcc

SEQ ID NO: 187270 - RNA, 32 nt, Human
ggagugagaauagaaagaccaguuucaggcuu

SEQ ID NO: 187271 - RNA, 32 nt, Human
ggagugagaccagcuucuggcaacugccccag

SEQ ID NO: 187272 - RNA, 32 nt, Human
ggagugagaccccagcccuaggcugggguucu

SEQ ID NO: 187273 - RNA, 32 nt, Human
ggagugagagagaggcaggucuccagcugugc

SEQ ID NO: 187274 - RNA, 32 nt, Human
ggagugagagauggcaccucagccuggcccau

SEQ ID NO: 187275 - RNA, 31 nt, Human
ggagugagcaaaggaagcauuuaccccgaug

SEQ ID NO: 187276 - RNA, 32 nt, Human
ggagugagcagucagagagggagacagccuug

SEQ ID NO: 187277 - RNA, 32 nt, Human
ggagugagccucccugguccuuccugccugaa

SEQ ID NO: 187278 - RNA, 32 nt, Human
ggagugagcuaaauugaucccaauuaaguuuu

SEQ ID NO: 187279 - RNA, 32 nt, Human
ggagugagcuagccaugcuggggcagggagcc

SEQ ID NO: 187280 - RNA, 32 nt, Human
ggagugagggagaaacagggagcugaauccuc

SEQ ID NO: 187281 - RNA, 32 nt, Human
ggagugagggagcaggaucugggagggacaag

SEQ ID NO: 187282 - RNA, 32 nt, Human
ggagugagggccugaacugugcccccacccuc

SEQ ID NO: 187283 - RNA, 32 nt, Human
ggagugagguccagaagcaccugagccuguua

SEQ ID NO: 187284 - RNA, 32 nt, Human
ggagugagugugugucgcgcguguccgcacug

SEQ ID NO: 187285 - RNA, 32 nt, Human
ggagugauaagaaacaucugcuccacgccaac

SEQ ID NO: 187286 - RNA, 32 nt, Human
ggagugaucccccaggcaucgugugccauguu

SEQ ID NO: 187287 - RNA, 21 nt, Human
ggagugaucuagaaguguuaa

SEQ ID NO: 187288 - RNA, 32 nt, Human
ggagugaugaacgggcuggagcagucugagga

SEQ ID NO: 187289 - RNA, 19 nt, Human
ggagugaugagcccgccca

SEQ ID NO: 187290 - RNA, 32 nt, Human
ggagugaugaugguaacugaugaacagagaac

SEQ ID NO: 187291 - RNA, 16 nt, Human
ggagugauggaagcca

SEQ ID NO: 187292 - RNA, 32 nt, Human
ggagugcaacccaggagcaacgcucaaggugg

SEQ ID NO: 187293 - RNA, 32 nt, Human
ggagugcaaguggcaugaucuuggcucacaac

SEQ ID NO: 187294 - RNA, 20 nt, Human
ggagugcacagcuccugcug

SEQ ID NO: 187295 - RNA, 32 nt, Human
ggagugcaccacugcacuccagccugggcaac

SEQ ID NO: 187296 - RNA, 18 nt, Human
ggagugcagaccucuggg

SEQ ID NO: 187297 - RNA, 32 nt, Human
ggagugcagagaggagaacugaaaauaaaacu

SEQ ID NO: 187298 - RNA, 32 nt, Human
ggagugcagccugaaugucaccugccucgaug

SEQ ID NO: 187299 - RNA, 32 nt, Human
ggagugcaggaguucaagaccagccugggcaa

SEQ ID NO: 187300 - RNA, 32 nt, Human
ggagugcaggcagagggguccauggcuucccc

SEQ ID NO: 187301 - RNA, 32 nt, Human
ggagugcagugagccgagaucacgccacugca

SEQ ID NO: 187302 - RNA, 32 nt, Human
ggagugcaguggcauaaucauaccucauugca

SEQ ID NO: 187303 - RNA, 32 nt, Human
ggagugcaguggugcaaucauagcucauugaa

SEQ ID NO: 187304 - RNA, 32 nt, Human
ggagugcccaggauggagugcaguggcuauuc

SEQ ID NO: 187305 - RNA, 17 nt, Human
ggagugccucucuggga

SEQ ID NO: 187306 - RNA, 32 nt, Human
ggagugcggcaccuucccgucugaugcuggcg

SEQ ID NO: 187307 - RNA, 32 nt, Human
ggagugcggcuggucugcgcuccugugcauug

SEQ ID NO: 187308 - RNA, 32 nt, Human
ggagugcgggaaagccuucaguucuuccaguu

SEQ ID NO: 187309 - RNA, 32 nt, Human
ggagugcgggggagggaaagaaaacaaacagu

SEQ ID NO: 187310 - RNA, 20 nt, Human
ggagugcgguccucuaggga

SEQ ID NO: 187311 - RNA, 32 nt, Human
ggagugcgugagccacuuuagccaggauauac

SEQ ID NO: 187312 - RNA, 32 nt, Human
ggagugcguucugugucgguguuugugacgcc

SEQ ID NO: 187313 - RNA, 24 nt, Human
ggagugcuaaagggugcacacucc

SEQ ID NO: 187314 - RNA, 32 nt, Human
ggagugcucgagaacagauggggccaggcacc

SEQ ID NO: 187315 - RNA, 32 nt, Human
ggagugcugagggcuggagugggugggcccuc

SEQ ID NO: 187316 - RNA, 32 nt, Human
ggagugcugaugagaggcagaggcucuucugg

SEQ ID NO: 187317 - RNA, 19 nt, Human
ggagugcugggcucccaga

SEQ ID NO: 187318 - RNA, 32 nt, Human
ggaguggaacucaucaggcuugccaagagguu

SEQ ID NO: 187319 - RNA, 32 nt, Human
ggaguggacagaaugaugcauccaccccguuc

SEQ ID NO: 187320 - RNA, 31 nt, Human
ggaguggaccaaaacuggugaucuguuugcc

SEQ ID NO: 187321 - RNA, 32 nt, Human
ggaguggacccccauaacugggccucuccugg

SEQ ID NO: 187322 - RNA, 16 nt, Human
ggaguggaccucuggg

SEQ ID NO: 187323 - RNA, 32 nt, Human
ggaguggagaggcauggagaggccccaugggg

SEQ ID NO: 187324 - RNA, 32 nt, Human
ggaguggagauggagggauuauugagcagaaa

SEQ ID NO: 187325 - RNA, 32 nt, Human
ggaguggagcugcugguucucccagguggauu

SEQ ID NO: 187326 - RNA, 32 nt, Human
ggaguggagcugggcuggcugggcaggcaggg

SEQ ID NO: 187327 - RNA, 16 nt, Human
ggaguggaggaaucca

SEQ ID NO: 187328 - RNA, 32 nt, Human
ggaguggaggcagaggccugagagcuccccgg

SEQ ID NO: 187329 - RNA, 32 nt, Human
ggaguggagggaggcucagagauacugauaug

SEQ ID NO: 187330 - RNA, 32 nt, Human
ggaguggaggguggaggaacguguggaguuuc

SEQ ID NO: 187331 - RNA, 32 nt, Human
ggaguggagggugucucauccacuguggagau

SEQ ID NO: 187332 - RNA, 32 nt, Human
ggaguggaguauaaagaguguagggggugguu

SEQ ID NO: 187333 - RNA, 32 nt, Human
ggaguggaguccaguagucugcauuuaacgag

SEQ ID NO: 187334 - RNA, 32 nt, Human
ggaguggaguuucuuaggcugcuuccucugcu

SEQ ID NO: 187335 - RNA, 32 nt, Human
ggaguggaugcugaugaacaucgaacauaucu

SEQ ID NO: 187336 - RNA, 32 nt, Human
ggaguggauggcagaggugggcuguagagcca

SEQ ID NO: 187337 - RNA, 32 nt, Human
ggaguggcagcaccuggaucaugcucagaaga

SEQ ID NO: 187338 - RNA, 20 nt, Human
ggaguggcagcuccucggcc

SEQ ID NO: 187339 - RNA, 32 nt, Human
ggaguggcagcucugcuagcagcuggguucac

SEQ ID NO: 187340 - RNA, 32 nt, Human
ggaguggcaguggcaugaucucagcuuaaugc

SEQ ID NO: 187341 - RNA, 32 nt, Human
ggaguggccaaagagaagcagugcagggaugg

SEQ ID NO: 187342 - RNA, 32 nt, Human
ggaguggccaggaagaggcugcaggcucaagg

SEQ ID NO: 187343 - RNA, 17 nt, Human
ggaguggcccuggucca

SEQ ID NO: 187344 - RNA, 32 nt, Human
ggaguggcccuuuaacucuauuuggcuaucug

SEQ ID NO: 187345 - RNA, 25 nt, Human
ggaguggccucaaggccacccagug

SEQ ID NO: 187346 - RNA, 32 nt, Human
ggaguggccugaaagagagcaagaacaugugg

SEQ ID NO: 187347 - RNA, 32 nt, Human
ggaguggccuuuuaugagaggggacccgucaa

SEQ ID NO: 187348 - RNA, 32 nt, Human
ggaguggcgggcacgccagggucagggugccg

SEQ ID NO: 187349 - RNA, 32 nt, Human
ggaguggcguuuccgcacaggauuuccuaaga

SEQ ID NO: 187350 - RNA, 32 nt, Human
ggaguggcucaggagccccugaaaguguccag

SEQ ID NO: 187351 - RNA, 32 nt, Human
ggaguggcuggauguggagcaccgcaccgugg

SEQ ID NO: 187352 - RNA, 32 nt, Human
ggaguggcuuacauuuccacauacuuaucaga

SEQ ID NO: 187353 - RNA, 32 nt, Human
ggaguggcuuuccugggaacaaaagccggucu

SEQ ID NO: 187354 - RNA, 32 nt, Human
ggaguggcuuuuccagcucucaugccccgcag

SEQ ID NO: 187355 - RNA, 32 nt, Human
ggagugggaaacuuugcccaagcaauggcacg

SEQ ID NO: 187356 - RNA, 32 nt, Human
ggagugggaagagguggcaggaaggggaucug

SEQ ID NO: 187357 - RNA, 32 nt, Human
ggagugggaagugagagacacugauuuuuaaa

SEQ ID NO: 187358 - RNA, 32 nt, Human
ggagugggaaugagccacucccaguucuggag

SEQ ID NO: 187359 - RNA, 20 nt, Human
ggagugggagaaggaggaga

SEQ ID NO: 187360 - RNA, 32 nt, Human
ggagugggagagaccuuccagcaggggucaac

SEQ ID NO: 187361 - RNA, 32 nt, Human
ggagugggaggaagagccugggacaguggcca

SEQ ID NO: 187362 - RNA, 32 nt, Human
ggagugggaggaggagagaugggugaagacaa

SEQ ID NO: 187363 - RNA, 20 nt, Human
ggagugggagggagacgcag

SEQ ID NO: 187364 - RNA, 21 nt, Human
ggagugggagggguggagcag

SEQ ID NO: 187365 - RNA, 32 nt, Human
ggagugggagguugguggugccuccagcccau

SEQ ID NO: 187366 - RNA, 31 nt, Human
ggagugggauagucucccauuuaagcagcua

SEQ ID NO: 187367 - RNA, 32 nt, Human
ggagugggcaaagauuucuuguguaauaccug

SEQ ID NO: 187368 - RNA, 32 nt, Human
ggagugggcacuagaugaagcaaaugggauug

SEQ ID NO: 187369 - RNA, 32 nt, Human
ggagugggcaggccugagugagggucacugac

SEQ ID NO: 187370 - RNA, 32 nt, Human
ggagugggcccaggaaugugcauuuuaaauca

SEQ ID NO: 187371 - RNA, 18 nt, Human
ggagugggcgcugggaga

SEQ ID NO: 187372 - RNA, 32 nt, Human
ggagugggcuacuguagugugugugauucaaa

SEQ ID NO: 187373 - RNA, 32 nt, Human
ggagugggcucuggaagcagagagaugccagg

SEQ ID NO: 187374 - RNA, 32 nt, Human
ggagugggcugggaugggagaaucgcuugagc

SEQ ID NO: 187375 - RNA, 32 nt, Human
ggaguggggagggagagggcaggaaggaggca

SEQ ID NO: 187376 - RNA, 32 nt, Human
ggaguggggauggcagaaucagcugcuguaug

SEQ ID NO: 187377 - RNA, 18 nt, Human
ggaguggggcgcggcagc

SEQ ID NO: 187378 - RNA, 32 nt, Human
ggagugggggcugggcgggucucuccaccgcu

SEQ ID NO: 187379 - RNA, 32 nt, Human
ggagugggggcuucugagagucagccugaggu

SEQ ID NO: 187380 - RNA, 32 nt, Human
ggagugggucuggauuucugguguguggacuu

SEQ ID NO: 187381 - RNA, 32 nt, Human
ggagugggugggcagggguagaggagggggcc

SEQ ID NO: 187382 - RNA, 23 nt, Human
ggaguggguuuuggugguguuuu

SEQ ID NO: 187383 - RNA, 32 nt, Human
ggagugguauuauauaggucucagccaagaca

SEQ ID NO: 187384 - RNA, 32 nt, Human
ggaguggugaugacucucaacgagcaugcugc

SEQ ID NO: 187385 - RNA, 32 nt, Human
ggaguggugcagccccuggcaucucagacaug

SEQ ID NO: 187386 - RNA, 32 nt, Human
ggaguggugcccagagaaguuaagcaguuugc

SEQ ID NO: 187387 - RNA, 32 nt, Human
ggagugguggugguugaaagggcgauggaauu

SEQ ID NO: 187388 - RNA, 32 nt, Human
ggagugguuaccucuaggaagaaaggaggugg

SEQ ID NO: 187389 - RNA, 32 nt, Human
ggaguguaagugacaugaucauagcucacucc

SEQ ID NO: 187390 - RNA, 32 nt, Human
ggaguguagaccugugugugggaccugcucca

SEQ ID NO: 187391 - RNA, 32 nt, Human
ggaguguagggaggggccgagcaggaggagga

SEQ ID NO: 187392 - RNA, 32 nt, Human
ggaguguauggcagcuggcacaauuauccuug

SEQ ID NO: 187393 - RNA, 32 nt, Human
ggagugucagcuuuuagaaggaucauggucau

SEQ ID NO: 187394 - RNA, 18 nt, Human
ggagugucaggggcccuc

SEQ ID NO: 187395 - RNA, 17 nt, Human
ggagugucccugcucca

SEQ ID NO: 187396 - RNA, 32 nt, Human
ggagugucucugaggugaggccggggguaugg

SEQ ID NO: 187397 - RNA, 32 nt, Human
ggagugucugucugcugagcggcgcugugacc

SEQ ID NO: 187398 - RNA, 32 nt, Human
ggagugugagugugcauggcauguguguggca

SEQ ID NO: 187399 - RNA, 32 nt, Human
ggagugugaugauucccaaccgaaagcagcug

SEQ ID NO: 187400 - RNA, 32 nt, Human
ggagugugcacugugcuugcucagagaggcca

SEQ ID NO: 187401 - RNA, 32 nt, Human
ggagugugccaugcucaugaagccacaggucc

SEQ ID NO: 187402 - RNA, 32 nt, Human
ggagugugcccaggucacugcuauggccuucg

SEQ ID NO: 187403 - RNA, 32 nt, Human
ggagugugcgggaggggguagaguuggcaggu

SEQ ID NO: 187404 - RNA, 32 nt, Human
ggaguguggcugaggcccugaguguccagcca

SEQ ID NO: 187405 - RNA, 32 nt, Human
ggagugugggaacaacagucucuccuguccac

SEQ ID NO: 187406 - RNA, 32 nt, Human
ggagugugggaaugaaggaauucuggagcuuu

SEQ ID NO: 187407 - RNA, 32 nt, Human
ggagugugggugcucauaaguugcccagccca

SEQ ID NO: 187408 - RNA, 31 nt, Human
ggagugugggugguugggcgugaggggccga

SEQ ID NO: 187409 - RNA, 32 nt, Human
ggagugugugaaugccuuccaggagguggcuu

SEQ ID NO: 187410 - RNA, 19 nt, Human
ggagugugugacgaugcug

SEQ ID NO: 187411 - RNA, 32 nt, Human
ggaguguguggaggagcgaugggcagaaccag

SEQ ID NO: 187412 - RNA, 32 nt, Human
ggagugugugggggucugggaggcaggucccg

SEQ ID NO: 187413 - RNA, 32 nt, Human
ggaguguguuccugaagagcagccaggaggcc

SEQ ID NO: 187414 - RNA, 19 nt, Human
ggaguguuacacacugcuu

SEQ ID NO: 187415 - RNA, 22 nt, Human
ggaguguuacaguagggagcag

SEQ ID NO: 187416 - RNA, 32 nt, Human
ggaguguuccauaguuuauuguuuuccuauua

SEQ ID NO: 187417 - RNA, 24 nt, Human
ggaguguuccugggaccucagaga

SEQ ID NO: 187418 - RNA, 32 nt, Human
ggaguguuccugggaccucagagaccaggcuc

SEQ ID NO: 187419 - RNA, 32 nt, Human
ggaguguugagugaagggaccagguggagaug

SEQ ID NO: 187420 - RNA, 20 nt, Human
ggaguguugggagccucaga

SEQ ID NO: 187421 - RNA, 31 nt, Human
ggaguguugguggaaaggaaacugaagguaa

SEQ ID NO: 187422 - RNA, 32 nt, Human
ggaguguuuuccaugggauaaaggacacccua

SEQ ID NO: 187423 - RNA, 32 nt, Human
ggaguguuuuuaaugagggaaggaagguagcu

SEQ ID NO: 187424 - RNA, 32 nt, Human
ggaguuaaaaagagcuuuuguugagauuuggc

SEQ ID NO: 187425 - RNA, 32 nt, Human
ggaguuaaaacaaugcuguaauaaauaaagug

SEQ ID NO: 187426 - RNA, 32 nt, Human
ggaguuaaaaccccagccagagccuagguuuu

SEQ ID NO: 187427 - RNA, 32 nt, Human
ggaguuaaaagcuucuucuucaauagaggaau

SEQ ID NO: 187428 - RNA, 32 nt, Human
ggaguuaacacauguaaaagacacagaacagu

SEQ ID NO: 187429 - RNA, 32 nt, Human
ggaguuaaggcggugccuuuccacucuggcug

SEQ ID NO: 187430 - RNA, 32 nt, Human
ggaguuaaucucauuuucaaagcuguuucuca

SEQ ID NO: 187431 - RNA, 22 nt, Human
ggaguuacaagacagcucuaga

SEQ ID NO: 187432 - RNA, 32 nt, Human
ggaguuaccaauauugccaaguagacucacuc

SEQ ID NO: 187433 - RNA, 32 nt, Human
ggaguuaccauggugaccgcagccccuuggac

SEQ ID NO: 187434 - RNA, 32 nt, Human
ggaguuacuuuccuccugaccuguaaauuugu

SEQ ID NO: 187435 - RNA, 32 nt, Human
ggaguuagaagcgucuguaucucuggagcagc

SEQ ID NO: 187436 - RNA, 32 nt, Human
ggaguuagagcacggacucucuccaccugcac

SEQ ID NO: 187437 - RNA, 32 nt, Human
ggaguuagaggaggaggaggaggaggaagagg

SEQ ID NO: 187438 - RNA, 24 nt, Human
ggaguuagccgcggugugcgugaa

SEQ ID NO: 187439 - RNA, 32 nt, Human
ggaguuagggagagagaagcaggcagauaagu

SEQ ID NO: 187440 - RNA, 32 nt, Human
ggaguuauuacggaaaggacaccaagaauauc

SEQ ID NO: 187441 - RNA, 32 nt, Human
ggaguucaagacgagccugggcaacauggcaa

SEQ ID NO: 187442 - RNA, 32 nt, Human
ggaguucaccuugcccgcuaccuagacagagc

SEQ ID NO: 187443 - RNA, 32 nt, Human
ggaguucacugcacugagcugugaucacacca

SEQ ID NO: 187444 - RNA, 32 nt, Human
ggaguucagaaacgggguaccaugaccuggaa

SEQ ID NO: 187445 - RNA, 32 nt, Human
ggaguucaggaguucaagaccagccuggccaa

SEQ ID NO: 187446 - RNA, 32 nt, Human
ggaguucaggaucagaaugguuucagaagcuc

SEQ ID NO: 187447 - RNA, 32 nt, Human
ggaguucaguauuuggaaacuaauuuguucua

SEQ ID NO: 187448 - RNA, 32 nt, Human
ggaguucaguggagagguuagagccagccaca

SEQ ID NO: 187449 - RNA, 23 nt, Human
ggaguuccagaccagccuggcca

SEQ ID NO: 187450 - RNA, 32 nt, Human
ggaguuccauuuucuuaauuuuucauucuaaa

SEQ ID NO: 187451 - RNA, 32 nt, Human
ggaguucccgagaagcauggcugagggaagcu

SEQ ID NO: 187452 - RNA, 32 nt, Human
ggaguucccuuaccugggguccagucuguaaa

SEQ ID NO: 187453 - RNA, 32 nt, Human
ggaguuccugaacagauuuuucacucccauga

SEQ ID NO: 187454 - RNA, 20 nt, Human
ggaguucgaggcugcaguga

SEQ ID NO: 187455 - RNA, 23 nt, Human
ggaguucgaguccagccuggcca

SEQ ID NO: 187456 - RNA, 32 nt, Human
ggaguucucuuugaggcuggaaugcaguagcg

SEQ ID NO: 187457 - RNA, 32 nt, Human
ggaguucugagaccagccuggcuuacauggug

SEQ ID NO: 187458 - RNA, 32 nt, Human
ggaguucugaggcuccugcucucccauccacc

SEQ ID NO: 187459 - RNA, 32 nt, Human
ggaguucugagugcugagcugcagggugaggc

SEQ ID NO: 187460 - RNA, 32 nt, Human
ggaguucuucagcugcuugaugaccacgaaga

SEQ ID NO: 187461 - RNA, 32 nt, Human
ggaguucuugaauuccaggguggcggauauuc

SEQ ID NO: 187462 - RNA, 32 nt, Human
ggaguucuuggcuuuaaucauucauuacaaag

SEQ ID NO: 187463 - RNA, 32 nt, Human
ggaguugagagcuggggcaggagccccagccg

SEQ ID NO: 187464 - RNA, 32 nt, Human
ggaguugaggcagaagccagucaggauggugg

SEQ ID NO: 187465 - RNA, 20 nt, Human
ggaguugagggaaggagcug

SEQ ID NO: 187466 - RNA, 32 nt, Human
ggaguugauggccaggaaagaagccagcacag

SEQ ID NO: 187467 - RNA, 32 nt, Human
ggaguugcaccaggaggugccucugccucucg

SEQ ID NO: 187468 - RNA, 32 nt, Human
ggaguugcauaccaguauuccccagcuuguga

SEQ ID NO: 187469 - RNA, 32 nt, Human
ggaguugcggugagccgagaucgcgccauugc

SEQ ID NO: 187470 - RNA, 32 nt, Human
ggaguugcuacauuaggcagaguaaauauuuu

SEQ ID NO: 187471 - RNA, 32 nt, Human
ggaguugcuagcaaacaaauggcuuacuuaca

SEQ ID NO: 187472 - RNA, 32 nt, Human
ggaguugcucagaggcucacaugggcaccccc

SEQ ID NO: 187473 - RNA, 32 nt, Human
ggaguugcugggguccacuccugggccugccc

SEQ ID NO: 187474 - RNA, 32 nt, Human
ggaguuggaagaggagggauuagaaacaggag

SEQ ID NO: 187475 - RNA, 32 nt, Human
ggaguuggagagaaaggguggcaagagagaag

SEQ ID NO: 187476 - RNA, 32 nt, Human
ggaguuggaggaggaggaggaggaggcgaggg

SEQ ID NO: 187477 - RNA, 32 nt, Human
ggaguugggaaagaguggguguguguccgcau

SEQ ID NO: 187478 - RNA, 32 nt, Human
ggaguugggaucugccuuuuucauccagagcu

SEQ ID NO: 187479 - RNA, 21 nt, Human
ggaguuggggaagcucuuuca

SEQ ID NO: 187480 - RNA, 32 nt, Human
ggaguuggggacagugcugucccccaccccug

SEQ ID NO: 187481 - RNA, 32 nt, Human
ggaguuggggauguccuacaaacccaucgccc

SEQ ID NO: 187482 - RNA, 32 nt, Human
ggaguugggggcccagggagaagggacaaggc

SEQ ID NO: 187483 - RNA, 32 nt, Human
ggaguuggucauggaaugggcugggcuccugg

SEQ ID NO: 187484 - RNA, 32 nt, Human
ggaguuggugccccucauuccagaaucuccua

SEQ ID NO: 187485 - RNA, 23 nt, Human
ggaguuggugcuggucuuccucu

SEQ ID NO: 187486 - RNA, 32 nt, Human
ggaguuggugggcagcaggggagacaauagcg

SEQ ID NO: 187487 - RNA, 32 nt, Human
ggaguugguguuaggacagaagauccaagacg

SEQ ID NO: 187488 - RNA, 32 nt, Human
ggaguuguagggcuccgucauggccauggaga

SEQ ID NO: 187489 - RNA, 32 nt, Human
ggaguugugcagggacucuggcccaggcaggg

SEQ ID NO: 187490 - RNA, 32 nt, Human
ggaguugugcaggguuuggggaaaggaaggcu

SEQ ID NO: 187491 - RNA, 32 nt, Human
ggaguugugccgagugccugcugcagucucau

SEQ ID NO: 187492 - RNA, 32 nt, Human
ggaguuguggcuuugugucugcuggcaccaag

SEQ ID NO: 187493 - RNA, 32 nt, Human
ggaguuguggugaaacuaaucacgucugugag

SEQ ID NO: 187494 - RNA, 32 nt, Human
ggaguuguuccaucuucagccaguuuacuagu

SEQ ID NO: 187495 - RNA, 32 nt, Human
ggaguuguugauuugugaggacagauugaaag

SEQ ID NO: 187496 - RNA, 32 nt, Human
ggaguuuaauaguuacacauucaugcuaauau

SEQ ID NO: 187497 - RNA, 32 nt, Human
ggaguuuauauaagagagacagugaugagcaa

SEQ ID NO: 187498 - RNA, 32 nt, Human
ggaguuucaaaaccaggucugaagcaauccag

SEQ ID NO: 187499 - RNA, 32 nt, Human
ggaguuucaaaucaucuucuucauuucuguga

SEQ ID NO: 187500 - RNA, 32 nt, Human
ggaguuucaccaugguggucaggcuggucuug

SEQ ID NO: 187501 - RNA, 32 nt, Human
ggaguuucaguggaaccaaauuuuugccauua

SEQ ID NO: 187502 - RNA, 32 nt, Human
ggaguuuccccgaggcaucacagggcuucccg

SEQ ID NO: 187503 - RNA, 22 nt, Human
ggaguuucuccuccaccucuca

SEQ ID NO: 187504 - RNA, 32 nt, Human
ggaguuucuccucugggugccugaagcuauag

SEQ ID NO: 187505 - RNA, 32 nt, Human
ggaguuucuguggagccagccacccucaccag

SEQ ID NO: 187506 - RNA, 32 nt, Human
ggaguuucuguuagugguagugguguuuugga

SEQ ID NO: 187507 - RNA, 32 nt, Human
ggaguuucuguugacagagauggagucaguca

SEQ ID NO: 187508 - RNA, 32 nt, Human
ggaguuugagaccaagccugaccaauauggag

SEQ ID NO: 187509 - RNA, 32 nt, Human
ggaguuugagaccagccugacauggugaaacc

SEQ ID NO: 187510 - RNA, 32 nt, Human
ggaguuugagccugaccaacaugcuaaaaucc

SEQ ID NO: 187511 - RNA, 32 nt, Human
ggaguuugaggcaggaggauggcuugaaccca

SEQ ID NO: 187512 - RNA, 32 nt, Human
ggaguuugcaucauccacguggcuccguugcc

SEQ ID NO: 187513 - RNA, 19 nt, Human
ggaguuuggagguuggaga

SEQ ID NO: 187514 - RNA, 32 nt, Human
ggaguuuggccacaagauguuguugacggaac

SEQ ID NO: 187515 - RNA, 26 nt, Human
ggaguuugugaaaaaugcacaucucu

SEQ ID NO: 187516 - RNA, 32 nt, Human
ggaguuugugcccaagcuucucccucuucucu

SEQ ID NO: 187517 - RNA, 32 nt, Human
ggaguuugugugaccccuggccccugagccca

SEQ ID NO: 187518 - RNA, 32 nt, Human
ggaguuuuaagaccagccugaccaacauggug

SEQ ID NO: 187519 - RNA, 32 nt, Human
ggaguuuuagagagcuaugcucuguagcauga

SEQ ID NO: 187520 - RNA, 32 nt, Human
ggaguuuuaggaagucaguugucagagacagg

SEQ ID NO: 187521 - RNA, 32 nt, Human
ggaguuuucaugacagaauauacacauuuugu

SEQ ID NO: 187522 - RNA, 32 nt, Human
ggaguuuuccucaguuuuucuuccucagaaua

SEQ ID NO: 187523 - RNA, 32 nt, Human
ggaguuuugagaccagccuggccaacauggua

SEQ ID NO: 187524 - RNA, 32 nt, Human
ggaguuuugagaccagccuggccaacauggug

SEQ ID NO: 187525 - RNA, 32 nt, Human
ggaguuuugagaccagccuggccaacguggca

SEQ ID NO: 187526 - RNA, 32 nt, Human
ggaguuuugagaccagccugggaaacaucugc

SEQ ID NO: 187527 - RNA, 32 nt, Human
ggaguuuugagaccagccugggcaacaucagg

SEQ ID NO: 187528 - RNA, 32 nt, Human
ggaguuuugaguccagccugaacaacauaaca

SEQ ID NO: 187529 - RNA, 32 nt, Human
ggaguuuugcccuucuugcccaggcuggagug

SEQ ID NO: 187530 - RNA, 32 nt, Human
ggaguuuugcuugaggccagagguucaagacc

SEQ ID NO: 187531 - RNA, 32 nt, Human
ggaguuuuguugaaguugcaaaguccuggagc

SEQ ID NO: 187532 - RNA, 32 nt, Human
ggaguuuuuaggguaaaacgugcagcucuuca

SEQ ID NO: 187533 - RNA, 32 nt, Human
ggaguuuuuccagacaacuuuguacucccacc

SEQ ID NO: 187534 - RNA, 22 nt, Human
ggaguuuuuuaaaaagacauuu

SEQ ID NO: 187535 - RNA, 32 nt, Human
ggauaaaaggaccaaagaaaaagcuuuacuua

SEQ ID NO: 187536 - RNA, 32 nt, Human
ggauaaaagugagggcagaaguagcuguggga

SEQ ID NO: 187537 - RNA, 32 nt, Human
ggauaaaauuuccuuuggaaagaacccaugga

SEQ ID NO: 187538 - RNA, 32 nt, Human
ggauaaacauggcgacgucucugcaugaggga

SEQ ID NO: 187539 - RNA, 32 nt, Human
ggauaaacgcucuccccucggcucccggacgc

SEQ ID NO: 187540 - RNA, 32 nt, Human
ggauaaacugccucgucugaucuuguggcccc

SEQ ID NO: 187541 - RNA, 32 nt, Human
ggauaaacuuggccuuucuaagugguaagaau

SEQ ID NO: 187542 - RNA, 32 nt, Human
ggauaaagaaaaggaauuuuagaagugaccag

SEQ ID NO: 187543 - RNA, 32 nt, Human
ggauaaagaagagauggcaucgcuuacgccac

SEQ ID NO: 187544 - RNA, 32 nt, Human
ggauaaagcagcuucacucaacucuggggaau

SEQ ID NO: 187545 - RNA, 32 nt, Human
ggauaaaggcaguuagcuaacacagauggccg

SEQ ID NO: 187546 - RNA, 32 nt, Human
ggauaaagggacaaucaaacucaaggugccca

SEQ ID NO: 187547 - RNA, 32 nt, Human
ggauaaagggaggaggaggagcuagcagacac

SEQ ID NO: 187548 - RNA, 32 nt, Human
ggauaaaugcauuuuuauuuccuauuucuuua

SEQ ID NO: 187549 - RNA, 32 nt, Human
ggauaaauguggagaaaaugaugagaauuagc

SEQ ID NO: 187550 - RNA, 32 nt, Human
ggauaaauuccaucucugggaauugugugggu

SEQ ID NO: 187551 - RNA, 32 nt, Human
ggauaacaacugcacuccagccuggaugacag

SEQ ID NO: 187552 - RNA, 32 nt, Human
ggauaacacagugaaaccccgucucuacuaaa

SEQ ID NO: 187553 - RNA, 32 nt, Human
ggauaacacggagaaaccccgucucuacuaaa

SEQ ID NO: 187554 - RNA, 32 nt, Human
ggauaacaggcgcccaccaccgcacccugcua

SEQ ID NO: 187555 - RNA, 32 nt, Human
ggauaacaggugccagccaccaugcccagcua

SEQ ID NO: 187556 - RNA, 32 nt, Human
ggauaacagugauguucacggaacaagagaga

SEQ ID NO: 187557 - RNA, 32 nt, Human
ggauaacauggugaaaccacaucccuacuaca

SEQ ID NO: 187558 - RNA, 32 nt, Human
ggauaacgacugcacuccagccuggaugacag

SEQ ID NO: 187559 - RNA, 32 nt, Human
ggauaagaaggaccagcggaaaagagguagau

SEQ ID NO: 187560 - RNA, 32 nt, Human
ggauaagaauaggucauuuucuauucaccauc

SEQ ID NO: 187561 - RNA, 32 nt, Human
ggauaagacagagaaaaucacuuauuucucua

SEQ ID NO: 187562 - RNA, 32 nt, Human
ggauaagagagaagaaaagaagaauggagaga

SEQ ID NO: 187563 - RNA, 32 nt, Human
ggauaagagugugagagagacugauggggucg

SEQ ID NO: 187564 - RNA, 32 nt, Human
ggauaagcagcucagucacaggcagaagaagg

SEQ ID NO: 187565 - RNA, 32 nt, Human
ggauaagccuggggcuacuguugcugggaacu

SEQ ID NO: 187566 - RNA, 32 nt, Human
ggauaagcucaaugcucagaaaaugcugcuga

SEQ ID NO: 187567 - RNA, 32 nt, Human
ggauaagcucuuuaaaggcaaagcuuuauuuu

SEQ ID NO: 187568 - RNA, 25 nt, Human
ggauaaggagacugaggcuuagaga

SEQ ID NO: 187569 - RNA, 20 nt, Human
ggauaaggcagcccuccucc

SEQ ID NO: 187570 - RNA, 32 nt, Human
ggauaaggccuucuguacuuugcuuauuugaa

SEQ ID NO: 187571 - RNA, 32 nt, Human
ggauaagggaugcuuccugugacaacuugaau

SEQ ID NO: 187572 - RNA, 32 nt, Human
ggauaaggggccgggugcaguggcucacaccu

SEQ ID NO: 187573 - RNA, 32 nt, Human
ggauaagugcuaccuuaaaggguauacuaagu

SEQ ID NO: 187574 - RNA, 32 nt, Human
ggauaaguucuuuaguggugaguucugagauu

SEQ ID NO: 187575 - RNA, 32 nt, Human
ggauaauauaacuguuuuaaaacucuuucugg

SEQ ID NO: 187576 - RNA, 32 nt, Human
ggauaauauaugaaauuagcuuuccuuauuuu

SEQ ID NO: 187577 - RNA, 32 nt, Human
ggauaaucagugagcacuguucugcucagagc

SEQ ID NO: 187578 - RNA, 32 nt, Human
ggauaauccacugucucccaucccaggaggug

SEQ ID NO: 187579 - RNA, 32 nt, Human
ggauaaucuuaacuaaucagaguuggagacuu

SEQ ID NO: 187580 - RNA, 32 nt, Human
ggauaauggaggagguaaagguugaauuauau

SEQ ID NO: 187581 - RNA, 32 nt, Human
ggauaauggggaggcuaugcaggugugugggc

SEQ ID NO: 187582 - RNA, 32 nt, Human
ggauaauuacuggcaccugccucccaggccau

SEQ ID NO: 187583 - RNA, 32 nt, Human
ggauaauucucacugauggaucucaagcuaaa

SEQ ID NO: 187584 - RNA, 32 nt, Human
ggauaauuggaauaaagggaggugcuugaaga

SEQ ID NO: 187585 - RNA, 32 nt, Human
ggauacaaagagaacuuagagguggagcaguu

SEQ ID NO: 187586 - RNA, 32 nt, Human
ggauacaaucacagcaacccuggccucggccc

SEQ ID NO: 187587 - RNA, 20 nt, Human
ggauacaaugcauuuccuca

SEQ ID NO: 187588 - RNA, 32 nt, Human
ggauacacacuuuccccucuguagauucaaaa

SEQ ID NO: 187589 - RNA, 17 nt, Human
ggauacacagcaguguc

SEQ ID NO: 187590 - RNA, 19 nt, Human
ggauacaccgugggccuga

SEQ ID NO: 187591 - RNA, 32 nt, Human
ggauacagacuugcccaaaggagagccaggau

SEQ ID NO: 187592 - RNA, 32 nt, Human
ggauacagagaguggauuuucuccccaagucc

SEQ ID NO: 187593 - RNA, 32 nt, Human
ggauacagaguguugcuguccucagggagguc

SEQ ID NO: 187594 - RNA, 32 nt, Human
ggauacagcuggaccugaauuccugaugccca

SEQ ID NO: 187595 - RNA, 32 nt, Human
ggauacaggcuggaaaguaagggaagcagaag

SEQ ID NO: 187596 - RNA, 32 nt, Human
ggauacaguaaugaauuggccaggcaauuccu

SEQ ID NO: 187597 - RNA, 32 nt, Human
ggauacaugugcagaacgugcagcguuguuac

SEQ ID NO: 187598 - RNA, 32 nt, Human
ggauacauguuacuuuugauccagcaucaaaa

SEQ ID NO: 187599 - RNA, 32 nt, Human
ggauaccacagcugugccuuauguguuucaag

SEQ ID NO: 187600 - RNA, 32 nt, Human
ggauaccagcaccccacuccagccucgaggaa

SEQ ID NO: 187601 - RNA, 32 nt, Human
ggauacccagaacccucacuacuguaacauac

SEQ ID NO: 187602 - RNA, 32 nt, Human
ggauacccagaacuagcagccuagggaaaagg

SEQ ID NO: 187603 - RNA, 32 nt, Human
ggauacccgcacuccuccuccugggccggacc

SEQ ID NO: 187604 - RNA, 32 nt, Human
ggauaccgcucaaagcauuuuguggcugaaga

SEQ ID NO: 187605 - RNA, 32 nt, Human
ggauaccuacuucuuuucaugggaaggugagg

SEQ ID NO: 187606 - RNA, 32 nt, Human
ggauaccuccagccaggccucuguggccucug

SEQ ID NO: 187607 - RNA, 32 nt, Human
ggauaccuguaaucccagcuacgugggaggcu

SEQ ID NO: 187608 - RNA, 32 nt, Human
ggauaccuuggcugcccuauggcugucgcuug

SEQ ID NO: 187609 - RNA, 20 nt, Human
ggauacgggucaggcccauc

SEQ ID NO: 187610 - RNA, 32 nt, Human
ggauacgguccuuauagcuggagggaggcggu

SEQ ID NO: 187611 - RNA, 27 nt, Human
ggauacguaugguggcucacgccugua

SEQ ID NO: 187612 - RNA, 32 nt, Human
ggauacuaaauaaacuuucccuaacaaguguc

SEQ ID NO: 187613 - RNA, 20 nt, Human
ggauacuaaggaugugccaa

SEQ ID NO: 187614 - RNA, 23 nt, Human
ggauacuagagggaggcugcacc

SEQ ID NO: 187615 - RNA, 32 nt, Human
ggauacuauucaacccauagcacauccccuca

SEQ ID NO: 187616 - RNA, 32 nt, Human
ggauacuccagccggagaguccagagccccag

SEQ ID NO: 187617 - RNA, 32 nt, Human
ggauacuccugccucagccuccuggguagcug

SEQ ID NO: 187618 - RNA, 25 nt, Human
ggauacugaugggugacauugaaaa

SEQ ID NO: 187619 - RNA, 32 nt, Human
ggauacugcuggcuuuacucuaccucauauua

SEQ ID NO: 187620 - RNA, 31 nt, Human
ggauacuggacuuucugacgcagaugaacaa

SEQ ID NO: 187621 - RNA, 20 nt, Human
ggauacuggucuucucgucg

SEQ ID NO: 187622 - RNA, 32 nt, Human
ggauacuucgccccaucucugccuucaccugu

SEQ ID NO: 187623 - RNA, 21 nt, Human
ggauacuuucaaggacauuca

SEQ ID NO: 187624 - RNA, 32 nt, Human
ggauacuuucccucagcugacugguguucuac

SEQ ID NO: 187625 - RNA, 32 nt, Human
ggauacuuugcagcuuccuauguuugagugac

SEQ ID NO: 187626 - RNA, 32 nt, Human
ggauagaacaucacaacacugcucuaguuucu

SEQ ID NO: 187627 - RNA, 32 nt, Human
ggauagaagaaggagggaaggaaguagggagg

SEQ ID NO: 187628 - RNA, 21 nt, Human
ggauagaaggacaaggacaga

SEQ ID NO: 187629 - RNA, 32 nt, Human
ggauagacaugugcacuccuuccaggaguggg

SEQ ID NO: 187630 - RNA, 32 nt, Human
ggauagaccugcguuccggacacugagcgccu

SEQ ID NO: 187631 - RNA, 32 nt, Human
ggauagagaagcaggaagagcacuggacuugg

SEQ ID NO: 187632 - RNA, 32 nt, Human
ggauagagggcuggugccacgccccaggcuca

SEQ ID NO: 187633 - RNA, 32 nt, Human
ggauagaucaaauuggcagucaggcccaugau

SEQ ID NO: 187634 - RNA, 32 nt, Human
ggauagauggguuuucuggccauguugggaau

SEQ ID NO: 187635 - RNA, 32 nt, Human
ggauagauguuaggaggagacacaccucuugu

SEQ ID NO: 187636 - RNA, 32 nt, Human
ggauagcaacaucaguuaugggagcugugagg

SEQ ID NO: 187637 - RNA, 32 nt, Human
ggauagcacaggacucagcccaaaggagggcc

SEQ ID NO: 187638 - RNA, 32 nt, Human
ggauagcagaguaugugguugcaggaggcggu

SEQ ID NO: 187639 - RNA, 32 nt, Human
ggauagcagcagccucagccucugccugucca

SEQ ID NO: 187640 - RNA, 32 nt, Human
ggauagcaggugugugccaccaugcccagcua

SEQ ID NO: 187641 - RNA, 32 nt, Human
ggauagcaguaagccacacaccugccacuuag

SEQ ID NO: 187642 - RNA, 32 nt, Human
ggauagccucagccacaaaacucugucaggca

SEQ ID NO: 187643 - RNA, 32 nt, Human
ggauagcuagucacucaggcugcagagagaga

SEQ ID NO: 187644 - RNA, 32 nt, Human
ggauagcuuaguuuuaaaagacugauuaaaaa

SEQ ID NO: 187645 - RNA, 30 nt, Human
ggauagcuucagaaaucagaaaaacauuug

SEQ ID NO: 187646 - RNA, 31 nt, Human
ggauaggaagcaagucccaugcuuagaggca

SEQ ID NO: 187647 - RNA, 32 nt, Human
ggauaggagaagaggcauccugccuggguggg

SEQ ID NO: 187648 - RNA, 32 nt, Human
ggauaggaguuugagguugcagucagcuauga

SEQ ID NO: 187649 - RNA, 32 nt, Human
ggauaggccuucagccugcucuccuccucugu

SEQ ID NO: 187650 - RNA, 32 nt, Human
ggauagggaguuguaacagagcagugccagag

SEQ ID NO: 187651 - RNA, 32 nt, Human
ggauaggggaccagagagagcuuggaauguca

SEQ ID NO: 187652 - RNA, 32 nt, Human
ggauagguggugacccacugagccugaucaua

SEQ ID NO: 187653 - RNA, 32 nt, Human
ggauaguagauggggagggagaacagaaaaau

SEQ ID NO: 187654 - RNA, 32 nt, Human
ggauaguaugagcccuaaaaauccagacucuu

SEQ ID NO: 187655 - RNA, 32 nt, Human
ggauagucaagggcaggaaaccagguuucgcc

SEQ ID NO: 187656 - RNA, 32 nt, Human
ggauagugaacucagggacaucaggguaggga

SEQ ID NO: 187657 - RNA, 32 nt, Human
ggauaguggagugcagggaugaguggccuggc

SEQ ID NO: 187658 - RNA, 32 nt, Human
ggauagugggugugacaauggaagguccacag

SEQ ID NO: 187659 - RNA, 31 nt, Human
ggauagugugagagaauuaggcuguagaaca

SEQ ID NO: 187660 - RNA, 32 nt, Human
ggauaguucccuuuugagauacuuuccugucu

SEQ ID NO: 187661 - RNA, 32 nt, Human
ggauauaagcaguugaggaagaacgguccaug

SEQ ID NO: 187662 - RNA, 32 nt, Human
ggauauacugcagcuuuacugccuuccuccuu

SEQ ID NO: 187663 - RNA, 23 nt, Human
ggauauaucggguuggggucuuc

SEQ ID NO: 187664 - RNA, 32 nt, Human
ggauauaucuaguaccuuuauuuggaaugugu

SEQ ID NO: 187665 - RNA, 32 nt, Human
ggauauaugcuaccaauaaccccagccccaac

SEQ ID NO: 187666 - RNA, 32 nt, Human
ggauauaugggccagccuggauauacaacaga

SEQ ID NO: 187667 - RNA, 32 nt, Human
ggauaucaacagcucaucugugaccaacaggg

SEQ ID NO: 187668 - RNA, 32 nt, Human
ggauaucacaugaagaaguagacugaaauauc

SEQ ID NO: 187669 - RNA, 32 nt, Human
ggauaucacaugaagaaguagacugaauauca

SEQ ID NO: 187670 - RNA, 32 nt, Human
ggauaucaguguauuuugguucuugaaauagc

SEQ ID NO: 187671 - RNA, 32 nt, Human
ggauauccagugccaucuccaaggacuuucag

SEQ ID NO: 187672 - RNA, 32 nt, Human
ggauaucccaagaaucagagguuauauaaaaa

SEQ ID NO: 187673 - RNA, 32 nt, Human
ggauaucccuggaauguggggcuugaacauug

SEQ ID NO: 187674 - RNA, 32 nt, Human
ggauaucuacaccgccuuucugaccccacccu

SEQ ID NO: 187675 - RNA, 32 nt, Human
ggauaucugacuggaaccacagauacagaauc

SEQ ID NO: 187676 - RNA, 31 nt, Human
ggauaucugcucucugggauggcaucaguug

SEQ ID NO: 187677 - RNA, 32 nt, Human
ggauaucuggauugagauggccuaggaaaagu

SEQ ID NO: 187678 - RNA, 20 nt, Human
ggauaucuuuuggccgugua

SEQ ID NO: 187679 - RNA, 32 nt, Human
ggauaugagaaagcaaacuagauggaauaaau

SEQ ID NO: 187680 - RNA, 32 nt, Human
ggauaugaggcaggagggcuuggggacaacug

SEQ ID NO: 187681 - RNA, 32 nt, Human
ggauaugauuacugcaggaacuucuggaggaa

SEQ ID NO: 187682 - RNA, 32 nt, Human
ggauaugcacguuuguucuggaaaagauagaa

SEQ ID NO: 187683 - RNA, 32 nt, Human
ggauaugccuccgcaacucacacaccugccug

SEQ ID NO: 187684 - RNA, 31 nt, Human
ggauaugcucacuuaaauuguugaaaaccau

SEQ ID NO: 187685 - RNA, 32 nt, Human
ggauaugcuccccauaaauaccaccuugccac

SEQ ID NO: 187686 - RNA, 32 nt, Human
ggauaugcuccuggguggggacugggcugugc

SEQ ID NO: 187687 - RNA, 32 nt, Human
ggauauggagccaauucacuguggccgaucac

SEQ ID NO: 187688 - RNA, 32 nt, Human
ggauauggagcuuuggagguucagagaagaga

SEQ ID NO: 187689 - RNA, 32 nt, Human
ggauaugguauuccuuggaaucuggggaaaga

SEQ ID NO: 187690 - RNA, 32 nt, Human
ggauauggucuugagccaguaaucuuuguacu

SEQ ID NO: 187691 - RNA, 32 nt, Human
ggauauguaacaaaccuuacaaauauaaggaa

SEQ ID NO: 187692 - RNA, 32 nt, Human
ggauauguguuuuggauguaugauaugcuugg

SEQ ID NO: 187693 - RNA, 20 nt, Human
ggauauuaaacagaaacucu

SEQ ID NO: 187694 - RNA, 32 nt, Human
ggauauuaaaguuaggggaaagaaaagaucau

SEQ ID NO: 187695 - RNA, 23 nt, Human
ggauauuaacagucugucaguua

SEQ ID NO: 187696 - RNA, 32 nt, Human
ggauauuauuggagacgggguuucacuguguu

SEQ ID NO: 187697 - RNA, 32 nt, Human
ggauauucacugcuguggcaaggccuguagag

SEQ ID NO: 187698 - RNA, 32 nt, Human
ggauauuccucuuccucuaucaaggccuucuc

SEQ ID NO: 187699 - RNA, 32 nt, Human
ggauauucucuuccugauggugcagaacccag

SEQ ID NO: 187700 - RNA, 32 nt, Human
ggauauucugcagcgcuucugucuuuuucuug

SEQ ID NO: 187701 - RNA, 32 nt, Human
ggauauugaggcaggagaaucgcuugaaccca

SEQ ID NO: 187702 - RNA, 32 nt, Human
ggauauugagggcuucagcugcugcuauuaug

SEQ ID NO: 187703 - RNA, 31 nt, Human
ggauauuggagaccuguuuuagaaggagccu

SEQ ID NO: 187704 - RNA, 32 nt, Human
ggauauuucagcccucuccauccuagucaaca

SEQ ID NO: 187705 - RNA, 32 nt, Human
ggauauuucuaauauuuguauuucauggugga

SEQ ID NO: 187706 - RNA, 32 nt, Human
ggauauuugcuaugcagcaccaugaagaagag

SEQ ID NO: 187707 - RNA, 32 nt, Human
ggauauuuuacaaccaaauacagguuuucugg

SEQ ID NO: 187708 - RNA, 32 nt, Human
ggauauuuuguacaaaaagaaaacccacggga

SEQ ID NO: 187709 - RNA, 32 nt, Human
ggaucaaaagagacuugccuuuuaaggaucga

SEQ ID NO: 187710 - RNA, 32 nt, Human
ggaucaaagcaaaccuaaauguguacaucucc

SEQ ID NO: 187711 - RNA, 32 nt, Human
ggaucaacacaaaguguuccugguugguugag

SEQ ID NO: 187712 - RNA, 32 nt, Human
ggaucaacagugaaaagacagaagaggcaaua

SEQ ID NO: 187713 - RNA, 32 nt, Human
ggaucaaccugacagggaucugggagaggcua

SEQ ID NO: 187714 - RNA, 32 nt, Human
ggaucaacuguacgccuuugguaucugaccau

SEQ ID NO: 187715 - RNA, 32 nt, Human
ggaucaacuuacagcuacuauaagauguacua

SEQ ID NO: 187716 - RNA, 32 nt, Human
ggaucaagcaaucccacuucagccucuugaau

SEQ ID NO: 187717 - RNA, 32 nt, Human
ggaucaagcaggcacuucaagccucaauagga

SEQ ID NO: 187718 - RNA, 32 nt, Human
ggaucaagcaggcauuuggagcacaggugucu

SEQ ID NO: 187719 - RNA, 31 nt, Human
ggaucaagcucauggccucagaugcuccauc

SEQ ID NO: 187720 - RNA, 32 nt, Human
ggaucaaggaagcagagauggacggugaggca

SEQ ID NO: 187721 - RNA, 32 nt, Human
ggaucaaggaaggcugccccuguacccugugg

SEQ ID NO: 187722 - RNA, 32 nt, Human
ggaucaaggcucaugggcucugagccaaagaa

SEQ ID NO: 187723 - RNA, 24 nt, Human
ggaucaagggauucuccugccuca

SEQ ID NO: 187724 - RNA, 32 nt, Human
ggaucaagggcaacauaguacuucuccuucac

SEQ ID NO: 187725 - RNA, 24 nt, Human
ggaucaagugauccuccugccuca

SEQ ID NO: 187726 - RNA, 21 nt, Human
ggaucaagugauucuccugcc

SEQ ID NO: 187727 - RNA, 24 nt, Human
ggaucaagugauucuccugccuca

SEQ ID NO: 187728 - RNA, 24 nt, Human
ggaucaagugauucuccugccuua

SEQ ID NO: 187729 - RNA, 32 nt, Human
ggaucaaguucagccaccgaauugcuuuuauc

SEQ ID NO: 187730 - RNA, 32 nt, Human
ggaucaaugaccccuguaaggggccagagccu

SEQ ID NO: 187731 - RNA, 19 nt, Human
ggaucaaugcaguggcuga

SEQ ID NO: 187732 - RNA, 32 nt, Human
ggaucaauuuuauuuuguaucuucauuuuaug

SEQ ID NO: 187733 - RNA, 32 nt, Human
ggaucacaagagcccaggagguugagaaugca

SEQ ID NO: 187734 - RNA, 32 nt, Human
ggaucacaagggcaggagaucgagaccauccu

SEQ ID NO: 187735 - RNA, 32 nt, Human
ggaucacaaggucaggaguuugagacuagccu

SEQ ID NO: 187736 - RNA, 32 nt, Human
ggaucacaccacugcacuccagccuggacaac

SEQ ID NO: 187737 - RNA, 32 nt, Human
ggaucacaccacugcacuccagccugggugac

SEQ ID NO: 187738 - RNA, 32 nt, Human
ggaucacaccacugcacuucagccugggcaac

SEQ ID NO: 187739 - RNA, 32 nt, Human
ggaucacaccauugcuguccagccugggugac

SEQ ID NO: 187740 - RNA, 32 nt, Human
ggaucacaccugcaaucccagcacuuugggag

SEQ ID NO: 187741 - RNA, 32 nt, Human
ggaucacaccuguaaucccagcacuuugggag

SEQ ID NO: 187742 - RNA, 32 nt, Human
ggaucacacgccccacauucugggucaagcau

SEQ ID NO: 187743 - RNA, 32 nt, Human
ggaucacaggaaguggaggagccagaggugcc

SEQ ID NO: 187744 - RNA, 32 nt, Human
ggaucacaggcacacaccaccaugcccggcua

SEQ ID NO: 187745 - RNA, 32 nt, Human
ggaucacaggcaugcaccaccaugccuggcua

SEQ ID NO: 187746 - RNA, 32 nt, Human
ggaucacaggccuggccagccuaggaguugcc

SEQ ID NO: 187747 - RNA, 32 nt, Human
ggaucacaggcgccagccacugcgcccggccc

SEQ ID NO: 187748 - RNA, 32 nt, Human
ggaucacaggugugcaccaccaugcccagcua

SEQ ID NO: 187749 - RNA, 32 nt, Human
ggaucacagugcugggaaaugggagcacagua

SEQ ID NO: 187750 - RNA, 32 nt, Human
ggaucacaugcuuuugucuccacagcaaccag

SEQ ID NO: 187751 - RNA, 32 nt, Human
ggaucacauuucaacaugugauuugacaggau

SEQ ID NO: 187752 - RNA, 32 nt, Human
ggaucaccacaaccuccgucucccagguucaa

SEQ ID NO: 187753 - RNA, 32 nt, Human
ggaucaccagccccaaggucccgaagggcagg

SEQ ID NO: 187754 - RNA, 32 nt, Human
ggaucaccggcgugccccaccaugucagacgc

SEQ ID NO: 187755 - RNA, 18 nt, Human
ggaucaccugaggucagg

SEQ ID NO: 187756 - RNA, 22 nt, Human
ggaucaccugccccaccuguca

SEQ ID NO: 187757 - RNA, 32 nt, Human
ggaucacgagggcagauuucucccuugcuguu

SEQ ID NO: 187758 - RNA, 18 nt, Human
ggaucacgagguggugaa

SEQ ID NO: 187759 - RNA, 32 nt, Human
ggaucacgccacugaacuccagccugggugac

SEQ ID NO: 187760 - RNA, 32 nt, Human
ggaucacgccacugcacuccagcuugggugac

SEQ ID NO: 187761 - RNA, 32 nt, Human
ggaucacgccuguaaucccagcacuuagggag

SEQ ID NO: 187762 - RNA, 32 nt, Human
ggaucacgccuguaaucccagcgcuuugggag

SEQ ID NO: 187763 - RNA, 32 nt, Human
ggaucacggcagggccagaggguggugugguc

SEQ ID NO: 187764 - RNA, 32 nt, Human
ggaucacgucacugcauuccagccuggauaau

SEQ ID NO: 187765 - RNA, 32 nt, Human
ggaucacuacaaccuccaccucccggguucaa

SEQ ID NO: 187766 - RNA, 32 nt, Human
ggaucacuaguggccagcauccccagaguucc

SEQ ID NO: 187767 - RNA, 32 nt, Human
ggaucacucaggcuccagcccagcccuacccc

SEQ ID NO: 187768 - RNA, 32 nt, Human
ggaucacucuacagccugccuccuggguuuuc

SEQ ID NO: 187769 - RNA, 32 nt, Human
ggaucacugagaccagccugggcaacauagag

SEQ ID NO: 187770 - RNA, 32 nt, Human
ggaucacugcaaccuccaccuccuagguucaa

SEQ ID NO: 187771 - RNA, 32 nt, Human
ggaucacugcaaccucugccuccuggguucaa

SEQ ID NO: 187772 - RNA, 32 nt, Human
ggaucacuucagccuaggacguugaggcugca

SEQ ID NO: 187773 - RNA, 32 nt, Human
ggaucacuugaacccaggagguugaggcugca

SEQ ID NO: 187774 - RNA, 21 nt, Human
ggaucacuugaaccccagagg

SEQ ID NO: 187775 - RNA, 21 nt, Human
ggaucacuugagccccagagg

SEQ ID NO: 187776 - RNA, 32 nt, Human
ggaucacuugagcucaggagcuugagaccagc

SEQ ID NO: 187777 - RNA, 32 nt, Human
ggaucacuugagcucaggaguuugagaccagc

SEQ ID NO: 187778 - RNA, 31 nt, Human
ggaucacuugaggucggaguuggagaucagc

SEQ ID NO: 187779 - RNA, 32 nt, Human
ggaucacuugaguucaauaccagccugagcaa

SEQ ID NO: 187780 - RNA, 32 nt, Human
ggaucacuuuugucuguuccagccugcuugca

SEQ ID NO: 187781 - RNA, 32 nt, Human
ggaucagaacccaugggaaacaggagguacua

SEQ ID NO: 187782 - RNA, 32 nt, Human
ggaucagaagggaccagcuggagaccacggag

SEQ ID NO: 187783 - RNA, 21 nt, Human
ggaucagaccaccaccccuca

SEQ ID NO: 187784 - RNA, 22 nt, Human
ggaucagacucagaaagacacu

SEQ ID NO: 187785 - RNA, 32 nt, Human
ggaucagagaaagggagggcagagggagaaug

SEQ ID NO: 187786 - RNA, 21 nt, Human
ggaucagagaccagcagcagg

SEQ ID NO: 187787 - RNA, 32 nt, Human
ggaucagagagaaaggagaaccauccaggaga

SEQ ID NO: 187788 - RNA, 19 nt, Human
ggaucagauagauguuaua

SEQ ID NO: 187789 - RNA, 32 nt, Human
ggaucagauagcaggaggaacuuucaaaaguc

SEQ ID NO: 187790 - RNA, 32 nt, Human
ggaucagaugauaaaccacuacgcccgggcug

SEQ ID NO: 187791 - RNA, 18 nt, Human
ggaucagcaggccaggca

SEQ ID NO: 187792 - RNA, 32 nt, Human
ggaucagcaguaucacuaucacuugggcuagu

SEQ ID NO: 187793 - RNA, 32 nt, Human
ggaucagcaucauuaacaccuuccccaccccc

SEQ ID NO: 187794 - RNA, 32 nt, Human
ggaucagccacaucaacucaguuguccaccac

SEQ ID NO: 187795 - RNA, 32 nt, Human
ggaucagccacgggauuccagccuuggucuuc

SEQ ID NO: 187796 - RNA, 32 nt, Human
ggaucagccagccaugccuccaguucagguac

SEQ ID NO: 187797 - RNA, 32 nt, Human
ggaucagcuggcugggaggauuagugagcacc

SEQ ID NO: 187798 - RNA, 32 nt, Human
ggaucaggaaucaggagagaugcugaacacaa

SEQ ID NO: 187799 - RNA, 20 nt, Human
ggaucaggacagcugcaggu

SEQ ID NO: 187800 - RNA, 32 nt, Human
ggaucaggaugccguguuuggcccagagacuc

SEQ ID NO: 187801 - RNA, 23 nt, Human
ggaucaggcagcggcucaggcga

SEQ ID NO: 187802 - RNA, 19 nt, Human
ggaucaggcaggguggcuc

SEQ ID NO: 187803 - RNA, 32 nt, Human
ggaucaggccaaccccaaagaagaagugacca

SEQ ID NO: 187804 - RNA, 32 nt, Human
ggaucaggccacugcacuccagccuggguaac

SEQ ID NO: 187805 - RNA, 32 nt, Human
ggaucaggcugcuggaaacacagucacuuggg

SEQ ID NO: 187806 - RNA, 32 nt, Human
ggaucagggagguggagggacagugugaauaa

SEQ ID NO: 187807 - RNA, 22 nt, Human
ggaucaggggaucacccugaga

SEQ ID NO: 187808 - RNA, 32 nt, Human
ggaucagggguaggaauggaaggauggagcau

SEQ ID NO: 187809 - RNA, 32 nt, Human
ggaucagguucucugggcucucgcuccacuug

SEQ ID NO: 187810 - RNA, 32 nt, Human
ggaucagguuuggccaggagaacacucagagc

SEQ ID NO: 187811 - RNA, 32 nt, Human
ggaucaguaauauuucauuuuauuucaguuuu

SEQ ID NO: 187812 - RNA, 32 nt, Human
ggaucagucugcugcaucuucuaccuccugau

SEQ ID NO: 187813 - RNA, 32 nt, Human
ggaucagugacauucagggauguggccauuga

SEQ ID NO: 187814 - RNA, 32 nt, Human
ggaucaguggggccccaaagcccagcccggcu

SEQ ID NO: 187815 - RNA, 22 nt, Human
ggaucagugucccacccagagg

SEQ ID NO: 187816 - RNA, 32 nt, Human
ggaucauacuaacuacaaccagucuuccauca

SEQ ID NO: 187817 - RNA, 32 nt, Human
ggaucauaucuagcuaaaagcaagaacaccca

SEQ ID NO: 187818 - RNA, 32 nt, Human
ggaucaucuuguagcaugaaugcagacuggag

SEQ ID NO: 187819 - RNA, 32 nt, Human
ggaucaucuuugucuuuugggaccuaauacuu

SEQ ID NO: 187820 - RNA, 32 nt, Human
ggaucaugaagacgaguuuaaugaggaggaug

SEQ ID NO: 187821 - RNA, 32 nt, Human
ggaucaugagaucaggaguuugagacuagccu

SEQ ID NO: 187822 - RNA, 32 nt, Human
ggaucaugccacugcacuccaaccugggcagc

SEQ ID NO: 187823 - RNA, 32 nt, Human
ggaucaugccacugcacuccagcuugggcgac

SEQ ID NO: 187824 - RNA, 32 nt, Human
ggaucaugccuguaaucccagcacuuugggaa

SEQ ID NO: 187825 - RNA, 32 nt, Human
ggaucaugccuguaaucccaguacuuugggag

SEQ ID NO: 187826 - RNA, 32 nt, Human
ggaucauggagacgaacuaaaccaucauggag

SEQ ID NO: 187827 - RNA, 32 nt, Human
ggaucauggggacagaucccucaugaauggcu

SEQ ID NO: 187828 - RNA, 32 nt, Human
ggaucauggugaggacuagggguaaggucagg

SEQ ID NO: 187829 - RNA, 32 nt, Human
ggaucauguacaacagcaugccuagugagacu

SEQ ID NO: 187830 - RNA, 32 nt, Human
ggaucaugucuguaauccuagcacugugggag

SEQ ID NO: 187831 - RNA, 32 nt, Human
ggaucaugugccagcuucaucuguucucaagu

SEQ ID NO: 187832 - RNA, 32 nt, Human
ggaucaugugccagcuucgucuguucucaauu

SEQ ID NO: 187833 - RNA, 32 nt, Human
ggaucaugugccagcuucgucuguucuuaauu

SEQ ID NO: 187834 - RNA, 32 nt, Human
ggaucauugcagacucugccucucaggcucag

SEQ ID NO: 187835 - RNA, 32 nt, Human
ggaucauuucagcccaggagguuguggauaca

SEQ ID NO: 187836 - RNA, 32 nt, Human
ggaucauuuccauaagucugcuuuucagggau

SEQ ID NO: 187837 - RNA, 32 nt, Human
ggaucauuucuacuugcugugcauuuuaacca

SEQ ID NO: 187838 - RNA, 32 nt, Human
ggaucauuugagcucaugagggcccaggaggu

SEQ ID NO: 187839 - RNA, 32 nt, Human
ggaucauuuucuucggaaaaaguuuuccaaag

SEQ ID NO: 187840 - RNA, 32 nt, Human
ggauccaaaguggcaggaggucuguguuguca

SEQ ID NO: 187841 - RNA, 32 nt, Human
ggauccaagaaccacagcucaucugccaacaa

SEQ ID NO: 187842 - RNA, 25 nt, Human
ggauccaaguuuccuuauuugugaa

SEQ ID NO: 187843 - RNA, 32 nt, Human
ggauccacgacgcuuaaauacagcuuuuggau

SEQ ID NO: 187844 - RNA, 19 nt, Human
ggauccacgucccacgggc

SEQ ID NO: 187845 - RNA, 32 nt, Human
ggauccagaagcauugaaggggaccagccgcu

SEQ ID NO: 187846 - RNA, 32 nt, Human
ggauccagacagggcacauugggggcauggaa

SEQ ID NO: 187847 - RNA, 32 nt, Human
ggauccagagccacagaaagaaauguaggugu

SEQ ID NO: 187848 - RNA, 32 nt, Human
ggauccagcugugcuccagucuguccccuccu

SEQ ID NO: 187849 - RNA, 32 nt, Human
ggauccaggaauaugacacaaagguggaauaa

SEQ ID NO: 187850 - RNA, 32 nt, Human
ggauccaggagaaggagacgacuccugaguga

SEQ ID NO: 187851 - RNA, 32 nt, Human
ggauccaggaggagcaggggccagcagugggc

SEQ ID NO: 187852 - RNA, 32 nt, Human
ggauccaggguaagggguuaaggaggugaugc

SEQ ID NO: 187853 - RNA, 32 nt, Human
ggauccaggucugcaaggccagcccgacccug

SEQ ID NO: 187854 - RNA, 32 nt, Human
ggauccaguaccuccaaaacaccagaauccac

SEQ ID NO: 187855 - RNA, 31 nt, Human
ggauccagugagaggaaagauucugggugcu

SEQ ID NO: 187856 - RNA, 32 nt, Human
ggauccagugaucucuacuggcccagggcuuc

SEQ ID NO: 187857 - RNA, 20 nt, Human
ggauccaguguccacacuua

SEQ ID NO: 187858 - RNA, 32 nt, Human
ggauccagugugcagaagagccagcagggaac

SEQ ID NO: 187859 - RNA, 32 nt, Human
ggauccaguucccucaucucuggcaggaaaga

SEQ ID NO: 187860 - RNA, 32 nt, Human
ggauccaucuggguuggucuguggauuuuuaa

SEQ ID NO: 187861 - RNA, 32 nt, Human
ggauccauuaguucucauaccaugaagaaauu

SEQ ID NO: 187862 - RNA, 32 nt, Human
ggaucccaaaaacuucagaaagaggauagcaa

SEQ ID NO: 187863 - RNA, 32 nt, Human
ggaucccaaaaagguacaggcagcaguugcac

SEQ ID NO: 187864 - RNA, 32 nt, Human
ggaucccaaggcaggagagccaaagcuggagu

SEQ ID NO: 187865 - RNA, 32 nt, Human
ggaucccaagggacccucaaggaccucgaggu

SEQ ID NO: 187866 - RNA, 19 nt, Human
ggaucccagaaccuggaca

SEQ ID NO: 187867 - RNA, 32 nt, Human
ggaucccagcaacccuaaugcuggaaaggugc

SEQ ID NO: 187868 - RNA, 32 nt, Human
ggaucccagcacuuugggaggccgaggcaggc

SEQ ID NO: 187869 - RNA, 32 nt, Human
ggaucccagccuaaaagacaccagagaccuca

SEQ ID NO: 187870 - RNA, 32 nt, Human
ggaucccagcugguagagcagccuccaccugg

SEQ ID NO: 187871 - RNA, 32 nt, Human
ggaucccaggacuccggcuuucgccgagccgc

SEQ ID NO: 187872 - RNA, 32 nt, Human
ggaucccaggaguucaaauccugccugggcaa

SEQ ID NO: 187873 - RNA, 32 nt, Human
ggaucccaggggacccgcaggaugugucaggc

SEQ ID NO: 187874 - RNA, 32 nt, Human
ggaucccaguguugccuuaacagggugucugu

SEQ ID NO: 187875 - RNA, 32 nt, Human
ggaucccauccaguugguuuccaagggugauc

SEQ ID NO: 187876 - RNA, 32 nt, Human
ggauccccaagaagagggaaggcaggaggggc

SEQ ID NO: 187877 - RNA, 19 nt, Human
ggauccccaccugcgccca

SEQ ID NO: 187878 - RNA, 22 nt, Human
ggauccccagccuacugccucu

SEQ ID NO: 187879 - RNA, 32 nt, Human
ggauccccgucagcucauccaggcuggacaaa

SEQ ID NO: 187880 - RNA, 32 nt, Human
ggauccccguuuuacagaggaggaaacugagg

SEQ ID NO: 187881 - RNA, 21 nt, Human
ggauccccuggcccauccucu

SEQ ID NO: 187882 - RNA, 32 nt, Human
ggauccccugggagaacuuggcgggccgagag

SEQ ID NO: 187883 - RNA, 18 nt, Human
ggauccccuuccuuuaca

SEQ ID NO: 187884 - RNA, 32 nt, Human
ggaucccggaagacggaacacugugugcaacg

SEQ ID NO: 187885 - RNA, 32 nt, Human
ggaucccggaggugaaagaaacuucccccuga

SEQ ID NO: 187886 - RNA, 32 nt, Human
ggaucccggccaaggcggaggcugcggcuccg

SEQ ID NO: 187887 - RNA, 32 nt, Human
ggaucccgugcgccuggagacaggguccagau

SEQ ID NO: 187888 - RNA, 32 nt, Human
ggaucccgugggccucacaugccaggucacca

SEQ ID NO: 187889 - RNA, 32 nt, Human
ggaucccuaaaauuaggagcaacaaccacuug

SEQ ID NO: 187890 - RNA, 32 nt, Human
ggaucccuaaccuggaggaaauugccagggac

SEQ ID NO: 187891 - RNA, 32 nt, Human
ggaucccucccagauccucugcugacuccaua

SEQ ID NO: 187892 - RNA, 32 nt, Human
ggaucccuccccugcuaaucugaacugugucc

SEQ ID NO: 187893 - RNA, 32 nt, Human
ggaucccucccgcuugucaggaggcggccagc

SEQ ID NO: 187894 - RNA, 32 nt, Human
ggaucccugacgauugcuuagcauuaaggccc

SEQ ID NO: 187895 - RNA, 32 nt, Human
ggaucccugcuuucccccucuuccuggcucau

SEQ ID NO: 187896 - RNA, 32 nt, Human
ggaucccugggccacagagcaagucuccaaau

SEQ ID NO: 187897 - RNA, 32 nt, Human
ggaucccuggggagaguggagagaggggcaga

SEQ ID NO: 187898 - RNA, 32 nt, Human
ggaucccuuaguuucaucacucaucuggacug

SEQ ID NO: 187899 - RNA, 32 nt, Human
ggaucccuucaagacuuugucacagccucuau

SEQ ID NO: 187900 - RNA, 32 nt, Human
ggaucccuugagccuaggagguugaggcugca

SEQ ID NO: 187901 - RNA, 32 nt, Human
ggaucccuugagcucaggaguuugaggccagg

SEQ ID NO: 187902 - RNA, 32 nt, Human
ggaucccuugaguccaggagguugaggcugca

SEQ ID NO: 187903 - RNA, 21 nt, Human
ggauccgacgggccccagagg

SEQ ID NO: 187904 - RNA, 22 nt, Human
ggauccgcaagcugcgcgccca

SEQ ID NO: 187905 - RNA, 32 nt, Human
ggauccggaccagccaaggaaggguccaggug

SEQ ID NO: 187906 - RNA, 32 nt, Human
ggauccggaguauagugcuugauucuauugag

SEQ ID NO: 187907 - RNA, 32 nt, Human
ggauccggcugccagcccugaggccaagcacg

SEQ ID NO: 187908 - RNA, 32 nt, Human
ggauccggggcugagggcaggggucggguggg

SEQ ID NO: 187909 - RNA, 32 nt, Human
ggauccguacuuggcagaugaggaaauugauu

SEQ ID NO: 187910 - RNA, 32 nt, Human
ggauccuacaauauuuuauucuaggguuucuu

SEQ ID NO: 187911 - RNA, 32 nt, Human
ggauccuacaguguaucaacaaaaggagccaa

SEQ ID NO: 187912 - RNA, 32 nt, Human
ggauccuaguagcuguugcucucuguauuguu

SEQ ID NO: 187913 - RNA, 32 nt, Human
ggauccuaguguuuuaauuaccugugugcagc

SEQ ID NO: 187914 - RNA, 32 nt, Human
ggauccucagccaggccugacuggaaggagcu

SEQ ID NO: 187915 - RNA, 32 nt, Human
ggauccucauaggucagggagugggggagggg

SEQ ID NO: 187916 - RNA, 32 nt, Human
ggauccuccugccucagucucccaacuaagug

SEQ ID NO: 187917 - RNA, 21 nt, Human
ggauccucucagucccagagc

SEQ ID NO: 187918 - RNA, 32 nt, Human
ggauccucucucucuugagcaaaguauagcaa

SEQ ID NO: 187919 - RNA, 32 nt, Human
ggauccucuggaagcuguauuucuugaauuag

SEQ ID NO: 187920 - RNA, 32 nt, Human
ggauccugauuggggugccaagagaaacagca

SEQ ID NO: 187921 - RNA, 32 nt, Human
ggauccugcaggaagccugcgggcggggacug

SEQ ID NO: 187922 - RNA, 32 nt, Human
ggauccugccaacuuucuggggcuucuggaug

SEQ ID NO: 187923 - RNA, 32 nt, Human
ggauccugccgcguacacagcaggugcagaau

SEQ ID NO: 187924 - RNA, 32 nt, Human
ggauccuggaaggugaguguguaugaauugcg

SEQ ID NO: 187925 - RNA, 32 nt, Human
ggauccuggagcugugcuguggcuugaggaga

SEQ ID NO: 187926 - RNA, 32 nt, Human
ggauccuggccauuaaggaaaccuugccuucg

SEQ ID NO: 187927 - RNA, 32 nt, Human
ggauccugugcugcugucugguugagagccug

SEQ ID NO: 187928 - RNA, 32 nt, Human
ggauccuguggcuggaagcgaggaggcuccac

SEQ ID NO: 187929 - RNA, 32 nt, Human
ggauccuguucccagacaggucccugaguacu

SEQ ID NO: 187930 - RNA, 32 nt, Human
ggauccuuccauucuuucauccuucgcauuca

SEQ ID NO: 187931 - RNA, 32 nt, Human
ggauccuucucaggaagcuucaugucuaaugg

SEQ ID NO: 187932 - RNA, 32 nt, Human
ggauccuugccuggaacaaguuauggaaagaa

SEQ ID NO: 187933 - RNA, 32 nt, Human
ggauccuuggcaggaaagcagggauuguguuc

SEQ ID NO: 187934 - RNA, 32 nt, Human
ggauccuuucuugauugguucuuccaaacaaa

SEQ ID NO: 187935 - RNA, 32 nt, Human
ggaucgauugagccucggaggucgagaucagc

SEQ ID NO: 187936 - RNA, 32 nt, Human
ggaucgcaccacugcacuccagccugggcuac

SEQ ID NO: 187937 - RNA, 32 nt, Human
ggaucgcaccacugcacuccagccuggguuac

SEQ ID NO: 187938 - RNA, 32 nt, Human
ggaucgcaccgcugcacuccagccugggugac

SEQ ID NO: 187939 - RNA, 32 nt, Human
ggaucgccugggaggugaggugugugugaccc

SEQ ID NO: 187940 - RNA, 32 nt, Human
ggaucgccuugauccaggggccgccgggccgc

SEQ ID NO: 187941 - RNA, 32 nt, Human
ggaucgcgcagggcccgcagggcacaggcgcc

SEQ ID NO: 187942 - RNA, 32 nt, Human
ggaucgcgccacugcauuccagccuggacgac

SEQ ID NO: 187943 - RNA, 32 nt, Human
ggaucgcgccacuguacuccagccugggugac

SEQ ID NO: 187944 - RNA, 32 nt, Human
ggaucgcgccauugcacuccagccuggcugac

SEQ ID NO: 187945 - RNA, 32 nt, Human
ggaucgcgccauugcacuccagccugggcaac

SEQ ID NO: 187946 - RNA, 32 nt, Human
ggaucgcuugaauccaggaguuagaccagccu

SEQ ID NO: 187947 - RNA, 32 nt, Human
ggaucgcuugagcucaggaguucgagagcagc

SEQ ID NO: 187948 - RNA, 32 nt, Human
ggaucgcuugagcucaggaguuugagaccagc

SEQ ID NO: 187949 - RNA, 32 nt, Human
ggaucgcuugggccugggaggcggagguugca

SEQ ID NO: 187950 - RNA, 32 nt, Human
ggaucggaggcugaaggaagauuauagagacu

SEQ ID NO: 187951 - RNA, 32 nt, Human
ggaucggaggcuugucagagcugggagggguu

SEQ ID NO: 187952 - RNA, 32 nt, Human
ggaucggauccagcacauccaggcuucuccuc

SEQ ID NO: 187953 - RNA, 32 nt, Human
ggaucggcaggauguuagggcagcagcagcag

SEQ ID NO: 187954 - RNA, 32 nt, Human
ggaucggccacugcacuccgggcugggcgaca

SEQ ID NO: 187955 - RNA, 32 nt, Human
ggaucgggcacugguuccuccuuguccccgcu

SEQ ID NO: 187956 - RNA, 32 nt, Human
ggaucggucucuucccgccgggucucuuaccg

SEQ ID NO: 187957 - RNA, 32 nt, Human
ggaucgguugagcccaggagguuguggcugca

SEQ ID NO: 187958 - RNA, 32 nt, Human
ggaucguaccacugcacuccagccugggcuac

SEQ ID NO: 187959 - RNA, 32 nt, Human
ggaucguacuacugcacuccagcauggaagac

SEQ ID NO: 187960 - RNA, 32 nt, Human
ggaucgucuauuggaugugaaaccagagaugc

SEQ ID NO: 187961 - RNA, 32 nt, Human
ggaucgugccacugcacuccaaccugggugag

SEQ ID NO: 187962 - RNA, 32 nt, Human
ggaucgugccacugcacucuagccggggcgac

SEQ ID NO: 187963 - RNA, 32 nt, Human
ggaucuaaaugccuugugcacugcaaaauggg

SEQ ID NO: 187964 - RNA, 32 nt, Human
ggaucuaacccuaggaucuggcuagggcucug

SEQ ID NO: 187965 - RNA, 32 nt, Human
ggaucuaagggaagaucacuguaguuuaguuc

SEQ ID NO: 187966 - RNA, 32 nt, Human
ggaucuacacccugccuuggcugcuacagcuu

SEQ ID NO: 187967 - RNA, 32 nt, Human
ggaucuaccuuugaaggccaggccuuccgagg

SEQ ID NO: 187968 - RNA, 32 nt, Human
ggaucuacuuuaauuccacacucucauuaaua

SEQ ID NO: 187969 - RNA, 32 nt, Human
ggaucuagagaugcucucugcuugacaacaaa

SEQ ID NO: 187970 - RNA, 18 nt, Human
ggaucuagcuucuccucg

SEQ ID NO: 187971 - RNA, 32 nt, Human
ggaucuagcuuuuggaaaauggugguuaaauu

SEQ ID NO: 187972 - RNA, 32 nt, Human
ggaucuaguguccucccaggagucagaucaua

SEQ ID NO: 187973 - RNA, 32 nt, Human
ggaucuaugccuggaauccuggcagggauucc

SEQ ID NO: 187974 - RNA, 32 nt, Human
ggaucucaagccuucagcucuccccugaacuc

SEQ ID NO: 187975 - RNA, 32 nt, Human
ggaucucaaugcuuuccacauuucuuucucca

SEQ ID NO: 187976 - RNA, 31 nt, Human
ggaucucacagcugcagucuaauaguaacac

SEQ ID NO: 187977 - RNA, 32 nt, Human
ggaucucacgugagauuccugaggcaugauua

SEQ ID NO: 187978 - RNA, 32 nt, Human
ggaucucagggaagcccagggaagagagggac

SEQ ID NO: 187979 - RNA, 32 nt, Human
ggaucuccagauacuggauagccagcauccuc

SEQ ID NO: 187980 - RNA, 22 nt, Human
ggaucuccaggaguccccugca

SEQ ID NO: 187981 - RNA, 32 nt, Human
ggaucuccagugccugggccaggaaagcccuc

SEQ ID NO: 187982 - RNA, 32 nt, Human
ggaucucccacacucaccuggcaccacccucc

SEQ ID NO: 187983 - RNA, 32 nt, Human
ggaucucccauagcuucuccuuugcuuccagg

SEQ ID NO: 187984 - RNA, 32 nt, Human
ggaucuccugcaggguccuggggacaaacccu

SEQ ID NO: 187985 - RNA, 32 nt, Human
ggaucucgaggagguggugaaaaagagggauu

SEQ ID NO: 187986 - RNA, 32 nt, Human
ggaucucggcugccuuuuccucuaucuugagc

SEQ ID NO: 187987 - RNA, 32 nt, Human
ggaucucgguggacucagucacaaaacaaagg

SEQ ID NO: 187988 - RNA, 32 nt, Human
ggaucucucgggccagggagguugaggcugca

SEQ ID NO: 187989 - RNA, 32 nt, Human
ggaucucucuaggagcugacacucgaaccuuc

SEQ ID NO: 187990 - RNA, 32 nt, Human
ggaucucugaacacugacaauuugucauuuug

SEQ ID NO: 187991 - RNA, 32 nt, Human
ggaucucugaagaacccacagaccaggugaau

SEQ ID NO: 187992 - RNA, 32 nt, Human
ggaucugaaacagaguuuaugaccucagagac

SEQ ID NO: 187993 - RNA, 32 nt, Human
ggaucugaaaguacagaacaugaacauugaug

SEQ ID NO: 187994 - RNA, 23 nt, Human
ggaucugaauccuccacuuccca

SEQ ID NO: 187995 - RNA, 32 nt, Human
ggaucugagaaggagaaggaaaugugggguag

SEQ ID NO: 187996 - RNA, 32 nt, Human
ggaucugagaugguuuuugcaucuuuccagga

SEQ ID NO: 187997 - RNA, 32 nt, Human
ggaucugagcacuugucugugcuuggggagca

SEQ ID NO: 187998 - RNA, 32 nt, Human
ggaucugagcucccaccucccuucccaccuac

SEQ ID NO: 187999 - RNA, 32 nt, Human
ggaucugauggcaaaguauucuagccuggaag

SEQ ID NO: 188000 - RNA, 32 nt, Human
ggaucugcacaaggucuuguauacaaauguuc

SEQ ID NO: 188001 - RNA, 32 nt, Human
ggaucugccaggacugggaagggaggcaggag

SEQ ID NO: 188002 - RNA, 32 nt, Human
ggaucugccauccauucugcagucuccagcag

SEQ ID NO: 188003 - RNA, 32 nt, Human
ggaucugcgcaggaagggugacuuuaagggau

SEQ ID NO: 188004 - RNA, 32 nt, Human
ggaucugcucccucucgcucucucacuccacu

SEQ ID NO: 188005 - RNA, 32 nt, Human
ggaucuggagguuguucucugcagagaaccag

SEQ ID NO: 188006 - RNA, 32 nt, Human
ggaucuggagucugcauucacgcacgcuggug

SEQ ID NO: 188007 - RNA, 32 nt, Human
ggaucuggccugccuuucuuuggucagucccu

SEQ ID NO: 188008 - RNA, 32 nt, Human
ggaucuggcucaggucacuccuccagcuacga

SEQ ID NO: 188009 - RNA, 32 nt, Human
ggaucugggaaaggggacaagaggcuuuucgu

SEQ ID NO: 188010 - RNA, 18 nt, Human
ggaucugggaauggggug

SEQ ID NO: 188011 - RNA, 32 nt, Human
ggaucugggaaugggguggagaggacauccuc

SEQ ID NO: 188012 - RNA, 32 nt, Human
ggaucugggcaaaugaaaauguuucaggaagu

SEQ ID NO: 188013 - RNA, 20 nt, Human
ggaucugggcguucgcaccc

SEQ ID NO: 188014 - RNA, 22 nt, Human
ggaucuggggaggaggggcaga

SEQ ID NO: 188015 - RNA, 23 nt, Human
ggaucuggucgcugccccagggg

SEQ ID NO: 188016 - RNA, 32 nt, Human
ggaucugugcagggagucauagguguguguga

SEQ ID NO: 188017 - RNA, 32 nt, Human
ggaucugugccuggacaguggcagaaccuuuc

SEQ ID NO: 188018 - RNA, 32 nt, Human
ggaucugugggaggggguuaggagggagcaga

SEQ ID NO: 188019 - RNA, 32 nt, Human
ggaucuguggucccuguccucccugcuguccc

SEQ ID NO: 188020 - RNA, 32 nt, Human
ggaucuguugagcgcuucaggaaaggcggaca

SEQ ID NO: 188021 - RNA, 32 nt, Human
ggaucuucaucugguucauuguauuuauaugu

SEQ ID NO: 188022 - RNA, 32 nt, Human
ggaucuucucuccauuccccuuucuagcuuua

SEQ ID NO: 188023 - RNA, 24 nt, Human
ggaucuugauuccacuggcaugaa

SEQ ID NO: 188024 - RNA, 25 nt, Human
ggaucuuucgccaggaagauuaucc

SEQ ID NO: 188025 - RNA, 32 nt, Human
ggaucuuucucccuuucuccucuccuuuuucu

SEQ ID NO: 188026 - RNA, 32 nt, Human
ggaucuuugaagcacaaaugcagcaaauccuu

SEQ ID NO: 188027 - RNA, 32 nt, Human
ggaucuuuuaacauaggugguucugugauaac

SEQ ID NO: 188028 - RNA, 32 nt, Human
ggaugaaaaagcucccgaagaagagccagaau

SEQ ID NO: 188029 - RNA, 32 nt, Human
ggaugaaaagccucagaaagcaacucaaagga

SEQ ID NO: 188030 - RNA, 32 nt, Human
ggaugaaaauguuuucaaugcacagaacagga

SEQ ID NO: 188031 - RNA, 32 nt, Human
ggaugaaacugaagccuagaaagaagugacug

SEQ ID NO: 188032 - RNA, 21 nt, Human
ggaugaaaggagaaggcuaga

SEQ ID NO: 188033 - RNA, 32 nt, Human
ggaugaaaucucagcauauguugcaggacacc

SEQ ID NO: 188034 - RNA, 32 nt, Human
ggaugaacaaauucuggaaauggauagcgaug

SEQ ID NO: 188035 - RNA, 32 nt, Human
ggaugaacgagaugugccugaguaccagccac

SEQ ID NO: 188036 - RNA, 32 nt, Human
ggaugaagagucagauguuacagaagaagaca

SEQ ID NO: 188037 - RNA, 32 nt, Human
ggaugaagccaagaguggugguaaggguagga

SEQ ID NO: 188038 - RNA, 32 nt, Human
ggaugaagcccagccacauuucagccgagguc

SEQ ID NO: 188039 - RNA, 32 nt, Human
ggaugaagccccaugccacuccacacugcugg

SEQ ID NO: 188040 - RNA, 32 nt, Human
ggaugaagcuuuuccaaaaucacaugccuuca

SEQ ID NO: 188041 - RNA, 32 nt, Human
ggaugaaggagagcgaguguucauggagcucu

SEQ ID NO: 188042 - RNA, 32 nt, Human
ggaugaaggagagcgaguguucguggagcucu

SEQ ID NO: 188043 - RNA, 24 nt, Human
ggaugaaggauagaggcugagaga

SEQ ID NO: 188044 - RNA, 27 nt, Human
ggaugaaggauuccugcaucacuguga

SEQ ID NO: 188045 - RNA, 32 nt, Human
ggaugaaggccugaccagggagggagaagcag

SEQ ID NO: 188046 - RNA, 32 nt, Human
ggaugaaggcugccaggacacagggucuggcc

SEQ ID NO: 188047 - RNA, 32 nt, Human
ggaugaagucuaccauuaccagcugggucacc

SEQ ID NO: 188048 - RNA, 21 nt, Human
ggaugaagugagugaggcuga

SEQ ID NO: 188049 - RNA, 32 nt, Human
ggaugaaucagaauuuucuuaauaugguacaa

SEQ ID NO: 188050 - RNA, 32 nt, Human
ggaugaaucucccaucaucccaucccuuaacc

SEQ ID NO: 188051 - RNA, 32 nt, Human
ggaugaaugagaggacagcaaugcauguguga

SEQ ID NO: 188052 - RNA, 17 nt, Human
ggaugaauggcuggcug

SEQ ID NO: 188053 - RNA, 32 nt, Human
ggaugacaaggcagaggagaaugacccugugg

SEQ ID NO: 188054 - RNA, 24 nt, Human
ggaugacagagagagacccugucu

SEQ ID NO: 188055 - RNA, 24 nt, Human
ggaugacagagcgaaacccugucu

SEQ ID NO: 188056 - RNA, 24 nt, Human
ggaugacagagcgagacccugccu

SEQ ID NO: 188057 - RNA, 24 nt, Human
ggaugacagagcgagacucuaucu

SEQ ID NO: 188058 - RNA, 23 nt, Human
ggaugacagagugaaacccuguc

SEQ ID NO: 188059 - RNA, 22 nt, Human
ggaugacagagugagacccugu

SEQ ID NO: 188060 - RNA, 24 nt, Human
ggaugacagagugagacccugucu

SEQ ID NO: 188061 - RNA, 24 nt, Human
ggaugacagagugagaccuugucu

SEQ ID NO: 188062 - RNA, 24 nt, Human
ggaugacagagugagacuccaucu

SEQ ID NO: 188063 - RNA, 24 nt, Human
ggaugacagagugagacuccgucu

SEQ ID NO: 188064 - RNA, 24 nt, Human
ggaugacagagugagacuucaucu

SEQ ID NO: 188065 - RNA, 21 nt, Human
ggaugacagagugagaucucc

SEQ ID NO: 188066 - RNA, 20 nt, Human
ggaugacagcaagacuucug

SEQ ID NO: 188067 - RNA, 32 nt, Human
ggaugacagcaccccugagcugggcaaaggua

SEQ ID NO: 188068 - RNA, 32 nt, Human
ggaugacagcucccggguccccaaaccuguuc

SEQ ID NO: 188069 - RNA, 32 nt, Human
ggaugacaggcagagcagcgaggccaccacau

SEQ ID NO: 188070 - RNA, 32 nt, Human
ggaugacaggcgcacaccaccacgcccagcaa

SEQ ID NO: 188071 - RNA, 32 nt, Human
ggaugacaggcgccugccaccacgcccggcua

SEQ ID NO: 188072 - RNA, 32 nt, Human
ggaugacagggaaugugucuucugcuggcugu

SEQ ID NO: 188073 - RNA, 32 nt, Human
ggaugaccaagcuuggugaaauuccucccugu

SEQ ID NO: 188074 - RNA, 32 nt, Human
ggaugaccagcaccuaggacagugcccagcac

SEQ ID NO: 188075 - RNA, 18 nt, Human
ggaugaccaggucccugg

SEQ ID NO: 188076 - RNA, 21 nt, Human
ggaugaccaggucccugggaa

SEQ ID NO: 188077 - RNA, 32 nt, Human
ggaugaccauuggguggaugaggaaucaauag

SEQ ID NO: 188078 - RNA, 32 nt, Human
ggaugacccacuguccgcgguggacucucaug

SEQ ID NO: 188079 - RNA, 32 nt, Human
ggaugacccugacaggugcccucaggggucug

SEQ ID NO: 188080 - RNA, 20 nt, Human
ggaugacccugcgaaggggc

SEQ ID NO: 188081 - RNA, 32 nt, Human
ggaugaccugaagagcgcuccucugccuugga

SEQ ID NO: 188082 - RNA, 21 nt, Human
ggaugaccugccugcagagag

SEQ ID NO: 188083 - RNA, 15 nt, Human
ggaugaccugcucca

SEQ ID NO: 188084 - RNA, 24 nt, Human
ggaugacgggaugagacucugucu

SEQ ID NO: 188085 - RNA, 32 nt, Human
ggaugacucagcccugggaccugcacagggac

SEQ ID NO: 188086 - RNA, 32 nt, Human
ggaugacuccacccuccccuacuaugcccagg

SEQ ID NO: 188087 - RNA, 32 nt, Human
ggaugacuugagcucaggaguuugagaccagc

SEQ ID NO: 188088 - RNA, 32 nt, Human
ggaugacuuuucaguacauaaaagcaagcagu

SEQ ID NO: 188089 - RNA, 32 nt, Human
ggaugagaauccagccccucacaagcuguggg

SEQ ID NO: 188090 - RNA, 32 nt, Human
ggaugagaauuaggaaagacacuauugaauuu

SEQ ID NO: 188091 - RNA, 32 nt, Human
ggaugagacagcaacacaaacacucgagcuuc

SEQ ID NO: 188092 - RNA, 32 nt, Human
ggaugagagccaguggaugaaauucacuaaua

SEQ ID NO: 188093 - RNA, 32 nt, Human
ggaugagagcccagagguaacagaacagcuuc

SEQ ID NO: 188094 - RNA, 32 nt, Human
ggaugagaggaagggaaaccuuacauuaugcu

SEQ ID NO: 188095 - RNA, 32 nt, Human
ggaugagagggagggagaggagagagagugcg

SEQ ID NO: 188096 - RNA, 32 nt, Human
ggaugagaguccugggugugaggaacaccucc

SEQ ID NO: 188097 - RNA, 22 nt, Human
ggaugagaugaggaacccaggg

SEQ ID NO: 188098 - RNA, 32 nt, Human
ggaugagaugcucagcagggguccccauccua

SEQ ID NO: 188099 - RNA, 32 nt, Human
ggaugagauucugcuguuucuuugucuagggu

SEQ ID NO: 188100 - RNA, 32 nt, Human
ggaugagcaaacugaggcagagugcuggagug

SEQ ID NO: 188101 - RNA, 31 nt, Human
ggaugagcagcacuggagccugguaaaugca

SEQ ID NO: 188102 - RNA, 32 nt, Human
ggaugagccgugaguccucugagaacugcuuc

SEQ ID NO: 188103 - RNA, 22 nt, Human
ggaugagcgcccaugcagcaag

SEQ ID NO: 188104 - RNA, 32 nt, Human
ggaugagcguccaggaugggagaaggggagau

SEQ ID NO: 188105 - RNA, 32 nt, Human
ggaugagcugaugguugcuggaggaggccagu

SEQ ID NO: 188106 - RNA, 32 nt, Human
ggaugagcuggagcacagccugggggagagug

SEQ ID NO: 188107 - RNA, 32 nt, Human
ggaugagcuuaccacuaaucucuuuuaaagca

SEQ ID NO: 188108 - RNA, 25 nt, Human
ggaugaggaaacucaggcucagaga

SEQ ID NO: 188109 - RNA, 32 nt, Human
ggaugaggaaacugaggccuggagagguuaaa

SEQ ID NO: 188110 - RNA, 32 nt, Human
ggaugaggaacauggagcuguacuugaauccc

SEQ ID NO: 188111 - RNA, 32 nt, Human
ggaugaggaagcacacaaaaggcuccaccagu

SEQ ID NO: 188112 - RNA, 32 nt, Human
ggaugaggacagggcaucccagaucuggacua

SEQ ID NO: 188113 - RNA, 32 nt, Human
ggaugaggacaucagaccucccuaccuuucca

SEQ ID NO: 188114 - RNA, 32 nt, Human
ggaugaggaggcaccuuaucagcagagcacuu

SEQ ID NO: 188115 - RNA, 32 nt, Human
ggaugaggagguggagugcaggggauguuagg

SEQ ID NO: 188116 - RNA, 32 nt, Human
ggaugaggcaccuccuuucccugcugaaggac

SEQ ID NO: 188117 - RNA, 32 nt, Human
ggaugaggccuggagucaggagucaaaagccc

SEQ ID NO: 188118 - RNA, 32 nt, Human
ggaugaggcugcaguccaugcagcuguucuug

SEQ ID NO: 188119 - RNA, 32 nt, Human
ggaugaggcugcugaagagccugagcucacuu

SEQ ID NO: 188120 - RNA, 20 nt, Human
ggaugaggcuucagccccca

SEQ ID NO: 188121 - RNA, 32 nt, Human
ggaugaggcuucuuccuggauggggcagagcu

SEQ ID NO: 188122 - RNA, 18 nt, Human
ggaugaggcuuuaccuca

SEQ ID NO: 188123 - RNA, 32 nt, Human
ggaugagggagaagaauaagcagcugccugga

SEQ ID NO: 188124 - RNA, 32 nt, Human
ggaugagggagacagaccacuuuucuauauug

SEQ ID NO: 188125 - RNA, 32 nt, Human
ggaugagggagagaggagagaggagaggaaag

SEQ ID NO: 188126 - RNA, 32 nt, Human
ggaugagggaggucggggcugcagugagccaa

SEQ ID NO: 188127 - RNA, 32 nt, Human
ggaugaggggcccugacccugugucuccaacu

SEQ ID NO: 188128 - RNA, 32 nt, Human
ggaugagggugagggcaaaggcugacgaagag

SEQ ID NO: 188129 - RNA, 32 nt, Human
ggaugaggucaccaggggaggagccugugcgu

SEQ ID NO: 188130 - RNA, 32 nt, Human
ggaugaggucugggcuggagcaguagaagcca

SEQ ID NO: 188131 - RNA, 32 nt, Human
ggaugagguggguggguauggagccagcuuaa

SEQ ID NO: 188132 - RNA, 32 nt, Human
ggaugaguaaugagccucaucuugaugcagag

SEQ ID NO: 188133 - RNA, 32 nt, Human
ggaugagucaccgacagcaaggcauggacucc

SEQ ID NO: 188134 - RNA, 32 nt, Human
ggaugagucccaagaagguucuuuggaaggag

SEQ ID NO: 188135 - RNA, 24 nt, Human
ggaugagugaggcccugcagagag

SEQ ID NO: 188136 - RNA, 32 nt, Human
ggaugaguucuuuaguggugacuucugaguuu

SEQ ID NO: 188137 - RNA, 32 nt, Human
ggaugaguugaggugauauuuuuaugugcagc

SEQ ID NO: 188138 - RNA, 24 nt, Human
ggaugauagagcaagacccugucu

SEQ ID NO: 188139 - RNA, 32 nt, Human
ggaugaucacaaugguaaggcacauaaauuau

SEQ ID NO: 188140 - RNA, 32 nt, Human
ggaugaucacuugaggccaggaguucgagacc

SEQ ID NO: 188141 - RNA, 32 nt, Human
ggaugaucaugaauauaacaacuucgaggaaa

SEQ ID NO: 188142 - RNA, 32 nt, Human
ggaugaucaugaggaacaacugccuguuuccu

SEQ ID NO: 188143 - RNA, 32 nt, Human
ggaugaucccccaacaggaagaugcaacccca

SEQ ID NO: 188144 - RNA, 32 nt, Human
ggaugaugauagcauggaugugccugaaaugc

SEQ ID NO: 188145 - RNA, 25 nt, Human
ggaugaugcagggccacacagagag

SEQ ID NO: 188146 - RNA, 23 nt, Human
ggaugaugccagccccggauccg

SEQ ID NO: 188147 - RNA, 20 nt, Human
ggaugauggccaguuuugcc

SEQ ID NO: 188148 - RNA, 21 nt, Human
ggaugauggcuugagcccagg

SEQ ID NO: 188149 - RNA, 32 nt, Human
ggaugauggucuucagccucuuucugucccuu

SEQ ID NO: 188150 - RNA, 32 nt, Human
ggaugauuagacuuggcaaucuguaagcagga

SEQ ID NO: 188151 - RNA, 32 nt, Human
ggaugauuauccucagaacaauggagcaauaa

SEQ ID NO: 188152 - RNA, 32 nt, Human
ggaugauucagaguuaaaagauaaaaagacgc

SEQ ID NO: 188153 - RNA, 25 nt, Human
ggaugauucugccaaaaagguacuu

SEQ ID NO: 188154 - RNA, 21 nt, Human
ggaugauugcuuaagcccagg

SEQ ID NO: 188155 - RNA, 32 nt, Human
ggaugauugcuucucuaggcuccuggauguug

SEQ ID NO: 188156 - RNA, 32 nt, Human
ggaugcaacuucuauccucaguccaguucaua

SEQ ID NO: 188157 - RNA, 32 nt, Human
ggaugcaaggucugcgguccagaagcuugcgg

SEQ ID NO: 188158 - RNA, 32 nt, Human
ggaugcacaagagcagaaucuccaugggacgc

SEQ ID NO: 188159 - RNA, 32 nt, Human
ggaugcacacacaacccugccucccacaguuc

SEQ ID NO: 188160 - RNA, 32 nt, Human
ggaugcacagaggaacgagcugagcuggcaga

SEQ ID NO: 188161 - RNA, 19 nt, Human
ggaugcaccccucagggag

SEQ ID NO: 188162 - RNA, 17 nt, Human
ggaugcaccucucggcg

SEQ ID NO: 188163 - RNA, 19 nt, Human
ggaugcaccuguaauccca

SEQ ID NO: 188164 - RNA, 19 nt, Human
ggaugcagaauaaugcaga

SEQ ID NO: 188165 - RNA, 32 nt, Human
ggaugcagagguggagguugaggccgugacuc

SEQ ID NO: 188166 - RNA, 32 nt, Human
ggaugcagccugaucagggucuggagcaagga

SEQ ID NO: 188167 - RNA, 20 nt, Human
ggaugcagcgagcccacgga

SEQ ID NO: 188168 - RNA, 32 nt, Human
ggaugcagcugccccuucucagccucugagga

SEQ ID NO: 188169 - RNA, 32 nt, Human
ggaugcaggaacagcucuagucuacuaagcug

SEQ ID NO: 188170 - RNA, 21 nt, Human
ggaugcaggaggcugaaggga

SEQ ID NO: 188171 - RNA, 32 nt, Human
ggaugcagucucuuugugguuccugguccugu

SEQ ID NO: 188172 - RNA, 32 nt, Human
ggaugcaguggaaaggagggggcccuccugag

SEQ ID NO: 188173 - RNA, 32 nt, Human
ggaugcaguuccagggcaggcaguagaggccc

SEQ ID NO: 188174 - RNA, 17 nt, Human
ggaugcaguucuaggca

SEQ ID NO: 188175 - RNA, 32 nt, Human
ggaugcaucugaaccagcagagcuguguuaua

SEQ ID NO: 188176 - RNA, 32 nt, Human
ggaugcaugucugucuguucuaucuagagauc

SEQ ID NO: 188177 - RNA, 32 nt, Human
ggaugcauuuuuacccuccacacaaaccuaaa

SEQ ID NO: 188178 - RNA, 32 nt, Human
ggaugccaaagugggaggauugcuugagcuca

SEQ ID NO: 188179 - RNA, 32 nt, Human
ggaugccaccuggagccccacccaggagcugg

SEQ ID NO: 188180 - RNA, 32 nt, Human
ggaugccagaacuguagguuauaaggcaguca

SEQ ID NO: 188181 - RNA, 22 nt, Human
ggaugccagagggacuggggag

SEQ ID NO: 188182 - RNA, 28 nt, Human
ggaugccagagggcugccucuccagcgg

SEQ ID NO: 188183 - RNA, 20 nt, Human
ggaugccagcaacgcgggag

SEQ ID NO: 188184 - RNA, 22 nt, Human
ggaugccagcaccugccaggug

SEQ ID NO: 188185 - RNA, 20 nt, Human
ggaugccagcaguggccgag

SEQ ID NO: 188186 - RNA, 32 nt, Human
ggaugccagcucuccccuuugugcuucccugc

SEQ ID NO: 188187 - RNA, 32 nt, Human
ggaugccagcuuuaaucuuucugucauuuaaa

SEQ ID NO: 188188 - RNA, 32 nt, Human
ggaugccagggaacagagagugagacaccuac

SEQ ID NO: 188189 - RNA, 32 nt, Human
ggaugccagggagggaggagaaagccgaagcg

SEQ ID NO: 188190 - RNA, 32 nt, Human
ggaugccauacaacaggacuaugugaugauuu

SEQ ID NO: 188191 - RNA, 32 nt, Human
ggaugccauacaacaggacuaugugaugguuu

SEQ ID NO: 188192 - RNA, 32 nt, Human
ggaugccaugccacgcagcagccagcacucgg

SEQ ID NO: 188193 - RNA, 32 nt, Human
ggaugccauucaaccacgggccccacugucac

SEQ ID NO: 188194 - RNA, 32 nt, Human
ggaugccauucaagugucaaucauccagcccu

SEQ ID NO: 188195 - RNA, 32 nt, Human
ggaugccauucaaucagagccugggccugggg

SEQ ID NO: 188196 - RNA, 32 nt, Human
ggaugcccaggccgcagaggaagcugggcacu

SEQ ID NO: 188197 - RNA, 32 nt, Human
ggaugcccauuuuacagaggaggagacugagg

SEQ ID NO: 188198 - RNA, 32 nt, Human
ggaugccccaggaaggcuccuaggaagagggg

SEQ ID NO: 188199 - RNA, 32 nt, Human
ggaugcccccuaauccccuucuccccugcacu

SEQ ID NO: 188200 - RNA, 32 nt, Human
ggaugcccucucuccccuuugcccagcaagag

SEQ ID NO: 188201 - RNA, 32 nt, Human
ggaugcccugaacaugcaauucuuucuuccaa

SEQ ID NO: 188202 - RNA, 32 nt, Human
ggaugcccugagcuccacaggucuucaugggc

SEQ ID NO: 188203 - RNA, 32 nt, Human
ggaugcccugcaccggguccggcagaaagcca

SEQ ID NO: 188204 - RNA, 20 nt, Human
ggaugccgccgcggcugcug

SEQ ID NO: 188205 - RNA, 27 nt, Human
ggaugccgggggaggaagaggagcggg

SEQ ID NO: 188206 - RNA, 32 nt, Human
ggaugccuacgagcagguacaaaaaggacuuc

SEQ ID NO: 188207 - RNA, 32 nt, Human
ggaugccuccacucucuaugacuaaauccaaa

SEQ ID NO: 188208 - RNA, 18 nt, Human
ggaugccucgcuggggag

SEQ ID NO: 188209 - RNA, 32 nt, Human
ggaugccugacgagguguagccuuuuaucuug

SEQ ID NO: 188210 - RNA, 32 nt, Human
ggaugccugcauucugggcaggauccccacca

SEQ ID NO: 188211 - RNA, 32 nt, Human
ggaugccugccugcccugcccugugcugugga

SEQ ID NO: 188212 - RNA, 32 nt, Human
ggaugccugccuggaaauguccuugcauucgu

SEQ ID NO: 188213 - RNA, 32 nt, Human
ggaugccugccuggacccuguugguggcugaa

SEQ ID NO: 188214 - RNA, 32 nt, Human
ggaugccuggacugcagagcccuugcuccgug

SEQ ID NO: 188215 - RNA, 32 nt, Human
ggaugccuggaguccccaggagcugggagagg

SEQ ID NO: 188216 - RNA, 32 nt, Human
ggaugccugggugccaggcaagacaagccccu

SEQ ID NO: 188217 - RNA, 17 nt, Human
ggaugccuguaauccca

SEQ ID NO: 188218 - RNA, 32 nt, Human
ggaugccuguaaucccagcuacuugggaggcu

SEQ ID NO: 188219 - RNA, 32 nt, Human
ggaugccuguaauccuagcuccucgggaggcu

SEQ ID NO: 188220 - RNA, 32 nt, Human
ggaugccuguccugugggaaccgucagugcgg

SEQ ID NO: 188221 - RNA, 32 nt, Human
ggaugccuucuacaacgcggaugugguggugc

SEQ ID NO: 188222 - RNA, 32 nt, Human
ggaugccuugagacccaggaggugugcggaug

SEQ ID NO: 188223 - RNA, 32 nt, Human
ggaugcgcagaguucggcuggaaaagaggaca

SEQ ID NO: 188224 - RNA, 32 nt, Human
ggaugcgcugggcggagggugcaggggagggc

SEQ ID NO: 188225 - RNA, 32 nt, Human
ggaugcggaaggcaguuuugcuugggaaacaa

SEQ ID NO: 188226 - RNA, 32 nt, Human
ggaugcggagagguuggcagagccagggguag

SEQ ID NO: 188227 - RNA, 32 nt, Human
ggaugcgggaaccuggucccagcuugaguucc

SEQ ID NO: 188228 - RNA, 32 nt, Human
ggaugcgggagcgggagcgggagcagcgcugg

SEQ ID NO: 188229 - RNA, 32 nt, Human
ggaugcgggugagagacauggaggacugguca

SEQ ID NO: 188230 - RNA, 32 nt, Human
ggaugcggucgcgucugugguccuggcagccg

SEQ ID NO: 188231 - RNA, 23 nt, Human
ggaugcgguggcucacaccugua

SEQ ID NO: 188232 - RNA, 23 nt, Human
ggaugcgguggcucacgccugua

SEQ ID NO: 188233 - RNA, 23 nt, Human
ggaugcgguggcucaugccugua

SEQ ID NO: 188234 - RNA, 32 nt, Human
ggaugcuaaaagcaaggaauaaaaguugaaaa

SEQ ID NO: 188235 - RNA, 32 nt, Human
ggaugcuaccucucccuuucccacuugaggac

SEQ ID NO: 188236 - RNA, 27 nt, Human
ggaugcuagcagcaaggaccccaaaga

SEQ ID NO: 188237 - RNA, 32 nt, Human
ggaugcucagcccucaugugucaguccccuca

SEQ ID NO: 188238 - RNA, 32 nt, Human
ggaugcucagcggccaggcacugaccugccau

SEQ ID NO: 188239 - RNA, 32 nt, Human
ggaugcucaucuuuaacagucucccucaugua

SEQ ID NO: 188240 - RNA, 32 nt, Human
ggaugcucauugccugggcaaggccuguuuag

SEQ ID NO: 188241 - RNA, 32 nt, Human
ggaugcucgauuuccucugccucucucuuugc

SEQ ID NO: 188242 - RNA, 32 nt, Human
ggaugcucucgaacuccugaccucgugaucua

SEQ ID NO: 188243 - RNA, 32 nt, Human
ggaugcucucucgguuugcuuuugccacuuuc

SEQ ID NO: 188244 - RNA, 32 nt, Human
ggaugcucucucuguuugcuuuugccacuuuc

SEQ ID NO: 188245 - RNA, 32 nt, Human
ggaugcucuucauccagcugaagacggucccu

SEQ ID NO: 188246 - RNA, 32 nt, Human
ggaugcugaaguaggaggaucgcuugagccca

SEQ ID NO: 188247 - RNA, 32 nt, Human
ggaugcugaggcaggagaaucgcuugaauaug

SEQ ID NO: 188248 - RNA, 32 nt, Human
ggaugcugaggugggaggauugcuugagccca

SEQ ID NO: 188249 - RNA, 32 nt, Human
ggaugcugccacccucuucugacccugcugcu

SEQ ID NO: 188250 - RNA, 32 nt, Human
ggaugcugccuaacccaguucaucucuauguc

SEQ ID NO: 188251 - RNA, 32 nt, Human
ggaugcugcuccauuagcguggauccugggau

SEQ ID NO: 188252 - RNA, 32 nt, Human
ggaugcugcugaggcagcuggaggagugggag

SEQ ID NO: 188253 - RNA, 32 nt, Human
ggaugcugcugcccucuccucaaccucucacg

SEQ ID NO: 188254 - RNA, 32 nt, Human
ggaugcuggacauccaccgccuccaggcaguu

SEQ ID NO: 188255 - RNA, 32 nt, Human
ggaugcuggcacagggcacuguucacagacug

SEQ ID NO: 188256 - RNA, 32 nt, Human
ggaugcuggcgggugacuugcagugggcgccu

SEQ ID NO: 188257 - RNA, 32 nt, Human
ggaugcuggggacuugccacccauggaagcug

SEQ ID NO: 188258 - RNA, 32 nt, Human
ggaugcuggggguccgcugccugcugcggucc

SEQ ID NO: 188259 - RNA, 32 nt, Human
ggaugcuguggggcaccaccuccuugaggacc

SEQ ID NO: 188260 - RNA, 32 nt, Human
ggaugcuguugucauggagcugugggaguugg

SEQ ID NO: 188261 - RNA, 32 nt, Human
ggaugcuucaaaaauauuuggcuaaaggauga

SEQ ID NO: 188262 - RNA, 32 nt, Human
ggaugcuucgggcuucugacugcuccauaggu

SEQ ID NO: 188263 - RNA, 32 nt, Human
ggaugcuucuaauucagccacugugaaccauu

SEQ ID NO: 188264 - RNA, 32 nt, Human
ggaugcuucucuggaaccucaaggcaggcagc

SEQ ID NO: 188265 - RNA, 24 nt, Human
ggaugcuugcccagaaaggugcuu

SEQ ID NO: 188266 - RNA, 32 nt, Human
ggaugcuuggcuggagucacccccaggacuua

SEQ ID NO: 188267 - RNA, 32 nt, Human
ggaugcuugggccugggucucuccgccagcag

SEQ ID NO: 188268 - RNA, 27 nt, Human
ggaugcuuguucucuuucuccugggca

SEQ ID NO: 188269 - RNA, 32 nt, Human
ggaugcuuucaaggagcucacuuggccugcuu

SEQ ID NO: 188270 - RNA, 32 nt, Human
ggaugcuuugggccuuugacugcuccauaggu

SEQ ID NO: 188271 - RNA, 32 nt, Human
ggaugcuuuugcccacucccauggccccugga

SEQ ID NO: 188272 - RNA, 32 nt, Human
ggaugcuuuuuaccuuuugcugucugcugugg

SEQ ID NO: 188273 - RNA, 20 nt, Human
ggauggaaacugaccaccua

SEQ ID NO: 188274 - RNA, 23 nt, Human
ggauggaaagcccagggucucca

SEQ ID NO: 188275 - RNA, 32 nt, Human
ggauggaaaggcuguuggcaucaauaggggac

SEQ ID NO: 188276 - RNA, 32 nt, Human
ggauggaaaugagaagcauucuaaauuugagu

SEQ ID NO: 188277 - RNA, 32 nt, Human
ggauggaagaccaggcuugugugucuuguguu

SEQ ID NO: 188278 - RNA, 32 nt, Human
ggauggaagagagggcuggcugcccaagggaa

SEQ ID NO: 188279 - RNA, 31 nt, Human
ggauggaaggauggagaaaaacagacugugg

SEQ ID NO: 188280 - RNA, 32 nt, Human
ggauggaaggcagaggguggguguggggccug

SEQ ID NO: 188281 - RNA, 32 nt, Human
ggauggaaugugcugggccacuguugggugga

SEQ ID NO: 188282 - RNA, 32 nt, Human
ggauggaauucugguauuuacaggcauuggug

SEQ ID NO: 188283 - RNA, 32 nt, Human
ggauggacagcuuggcucucccagagagguga

SEQ ID NO: 188284 - RNA, 32 nt, Human
ggauggacauuuuucuucuaagauggaacuua

SEQ ID NO: 188285 - RNA, 32 nt, Human
ggauggacccugggcauggcuucugggcugcu

SEQ ID NO: 188286 - RNA, 27 nt, Human
ggauggacgaggacgugcuaaccaccc

SEQ ID NO: 188287 - RNA, 32 nt, Human
ggauggacgccucucccccggagcagcacuuu

SEQ ID NO: 188288 - RNA, 32 nt, Human
ggauggacugcaaccuuaauuuacuugccgga

SEQ ID NO: 188289 - RNA, 32 nt, Human
ggauggacuuacugcaaccuagcaggcaccua

SEQ ID NO: 188290 - RNA, 32 nt, Human
ggauggagagaaggauggaaagccuggacuua

SEQ ID NO: 188291 - RNA, 32 nt, Human
ggauggagagcaaaggagaccccucccgagcc

SEQ ID NO: 188292 - RNA, 32 nt, Human
ggauggagagggagagacugaauuguuaguag

SEQ ID NO: 188293 - RNA, 31 nt, Human
ggauggagagugaggggauccaggccauuca

SEQ ID NO: 188294 - RNA, 32 nt, Human
ggauggagcacuuaaacuuucagcuaaggauc

SEQ ID NO: 188295 - RNA, 32 nt, Human
ggauggagcagguggaggugcagaggggauuu

SEQ ID NO: 188296 - RNA, 32 nt, Human
ggauggagcaucccaugagagccgggccaugg

SEQ ID NO: 188297 - RNA, 32 nt, Human
ggauggagcccagcgccugaggcccuuaucau

SEQ ID NO: 188298 - RNA, 32 nt, Human
ggauggagcccaggcgggagcgguggcccugu

SEQ ID NO: 188299 - RNA, 32 nt, Human
ggauggagccugggaagcagcgaggaaaucac

SEQ ID NO: 188300 - RNA, 32 nt, Human
ggauggaggaagaaggcauuaguaaaagguua

SEQ ID NO: 188301 - RNA, 32 nt, Human
ggauggaggcgcuggggagcuucuaggcuucc

SEQ ID NO: 188302 - RNA, 32 nt, Human
ggauggagggaggcaggcuggggagaagagaa

SEQ ID NO: 188303 - RNA, 32 nt, Human
ggauggagugaagaccuggagaggaggggcuc

SEQ ID NO: 188304 - RNA, 27 nt, Human
ggauggagugugaaacagaugaacaaa

SEQ ID NO: 188305 - RNA, 32 nt, Human
ggauggaguucugggcuuagucuggagagaau

SEQ ID NO: 188306 - RNA, 32 nt, Human
ggauggauaauaguuggagaucccagacagga

SEQ ID NO: 188307 - RNA, 32 nt, Human
ggauggauagggacaccaggaagaggacaaac

SEQ ID NO: 188308 - RNA, 22 nt, Human
ggauggaucacuugagcccagg

SEQ ID NO: 188309 - RNA, 32 nt, Human
ggauggauguggggagaguggaagaggcaggg

SEQ ID NO: 188310 - RNA, 22 nt, Human
ggauggauucacccuacaggga

SEQ ID NO: 188311 - RNA, 32 nt, Human
ggauggauuccuccuccucuuccuccgcggcg

SEQ ID NO: 188312 - RNA, 32 nt, Human
ggauggcaagaaggaaguaaaagggagagagg

SEQ ID NO: 188313 - RNA, 32 nt, Human
ggauggcaagcacgggacaggaggggcccaca

SEQ ID NO: 188314 - RNA, 32 nt, Human
ggauggcaaugccaguggaaccaugcugcuug

SEQ ID NO: 188315 - RNA, 32 nt, Human
ggauggcacaguggucaagagcacagacucua

SEQ ID NO: 188316 - RNA, 32 nt, Human
ggauggcaccucaggcugagggccccaaugua

SEQ ID NO: 188317 - RNA, 32 nt, Human
ggauggcagaggaggugaggagggaggaagcg

SEQ ID NO: 188318 - RNA, 18 nt, Human
ggauggcagccucugggg

SEQ ID NO: 188319 - RNA, 20 nt, Human
ggauggccacccuccugcug

SEQ ID NO: 188320 - RNA, 19 nt, Human
ggauggccagggaaggaga

SEQ ID NO: 188321 - RNA, 32 nt, Human
ggauggccagggagccaugagaagacucuucc

SEQ ID NO: 188322 - RNA, 32 nt, Human
ggauggcccagccuguaagauacuguauaugc

SEQ ID NO: 188323 - RNA, 32 nt, Human
ggauggcccagcugcccuagugugugcuugcc

SEQ ID NO: 188324 - RNA, 32 nt, Human
ggauggcccaggaggugcuggagcuaggucuc

SEQ ID NO: 188325 - RNA, 22 nt, Human
ggauggccccuagcuuaggaag

SEQ ID NO: 188326 - RNA, 32 nt, Human
ggauggcccugaccagcagggagcuggggugg

SEQ ID NO: 188327 - RNA, 32 nt, Human
ggauggcccuuccuccuccaccaccgcccguc

SEQ ID NO: 188328 - RNA, 32 nt, Human
ggauggccuagacuuggggaacagagccgggu

SEQ ID NO: 188329 - RNA, 32 nt, Human
ggauggccuggugcccccaccugcugcagcag

SEQ ID NO: 188330 - RNA, 32 nt, Human
ggauggccuugaacuccugggcucaagugauc

SEQ ID NO: 188331 - RNA, 32 nt, Human
ggauggccuuggacccugucaggcccagcaug

SEQ ID NO: 188332 - RNA, 32 nt, Human
ggauggcgaggccucucucaggagcaggggca

SEQ ID NO: 188333 - RNA, 32 nt, Human
ggauggcgagguaggauggccacccagcgcga

SEQ ID NO: 188334 - RNA, 27 nt, Human
ggauggcgcggagcugccucuccggga

SEQ ID NO: 188335 - RNA, 32 nt, Human
ggauggcgcugguacugcugcuugcuggugga

SEQ ID NO: 188336 - RNA, 32 nt, Human
ggauggcggcagcggcgcuggggagggcgagg

SEQ ID NO: 188337 - RNA, 32 nt, Human
ggauggcggcgggagguugauggcgaguggug

SEQ ID NO: 188338 - RNA, 32 nt, Human
ggauggcucaaaggagucaggacuuggaagug

SEQ ID NO: 188339 - RNA, 32 nt, Human
ggauggcucaaaggagucaggacuuggaauug

SEQ ID NO: 188340 - RNA, 32 nt, Human
ggauggcucuauggacaaaaagacucgggccc

SEQ ID NO: 188341 - RNA, 32 nt, Human
ggauggcucuccagagaagaggugcccgggcg

SEQ ID NO: 188342 - RNA, 32 nt, Human
ggauggcugcaaucucagugccugagggaaga

SEQ ID NO: 188343 - RNA, 32 nt, Human
ggauggcugcagugccagccuggggcagcagg

SEQ ID NO: 188344 - RNA, 32 nt, Human
ggauggcugcugcuugccaggugggcccaaau

SEQ ID NO: 188345 - RNA, 32 nt, Human
ggauggcuggcggaaagauauaugagaaagaa

SEQ ID NO: 188346 - RNA, 32 nt, Human
ggauggcuuaugauuguaaagcauuuuaucac

SEQ ID NO: 188347 - RNA, 32 nt, Human
ggauggcuugagcccaggagguugaggucaca

SEQ ID NO: 188348 - RNA, 32 nt, Human
ggauggcuugccagggccuugggguuugguag

SEQ ID NO: 188349 - RNA, 32 nt, Human
ggauggcuuuuagguuuguuugaauaagagau

SEQ ID NO: 188350 - RNA, 27 nt, Human
ggaugggaaccggauugguugcagugu

SEQ ID NO: 188351 - RNA, 32 nt, Human
ggaugggaaugaggaaggagugaggggaagaa

SEQ ID NO: 188352 - RNA, 32 nt, Human
ggaugggaauggcaauggccuagcuuuuauuu

SEQ ID NO: 188353 - RNA, 32 nt, Human
ggaugggacgggcaggccagaggucagccagc

SEQ ID NO: 188354 - RNA, 32 nt, Human
ggaugggacucuacacauccugagcuaagaca

SEQ ID NO: 188355 - RNA, 32 nt, Human
ggaugggacugucuaccucccuuccuccucug

SEQ ID NO: 188356 - RNA, 32 nt, Human
ggaugggagaagaaggaaggggguggcccguc

SEQ ID NO: 188357 - RNA, 32 nt, Human
ggaugggagagaaggugagggagccggcgagc

SEQ ID NO: 188358 - RNA, 32 nt, Human
ggaugggagagggguaggauguacagggguag

SEQ ID NO: 188359 - RNA, 32 nt, Human
ggaugggagagggguggggagcgagucacugc

SEQ ID NO: 188360 - RNA, 32 nt, Human
ggaugggagcgaugcuuaucucucacagugug

SEQ ID NO: 188361 - RNA, 32 nt, Human
ggaugggaggagagaaacacagcgaucacaaa

SEQ ID NO: 188362 - RNA, 32 nt, Human
ggaugggaggaggcgggaucugcucugaggcc

SEQ ID NO: 188363 - RNA, 32 nt, Human
ggaugggaggcaggucuaacuucuacugauuc

SEQ ID NO: 188364 - RNA, 32 nt, Human
ggaugggagguaccuuagagggaguauuuucu

SEQ ID NO: 188365 - RNA, 32 nt, Human
ggaugggagugggaggaggagagaugggugaa

SEQ ID NO: 188366 - RNA, 32 nt, Human
ggaugggaugguggcaaagcccaggaucuggc

SEQ ID NO: 188367 - RNA, 32 nt, Human
ggaugggcaaacugcaggccugggaaggcagc

SEQ ID NO: 188368 - RNA, 32 nt, Human
ggaugggcaaagcaucuuucgagagcuugccu

SEQ ID NO: 188369 - RNA, 32 nt, Human
ggaugggcaaaggagaguccugccuggcccua

SEQ ID NO: 188370 - RNA, 32 nt, Human
ggaugggcagaggcucucucccugcccacucu

SEQ ID NO: 188371 - RNA, 32 nt, Human
ggaugggcaggcaguggcggucccgccugccg

SEQ ID NO: 188372 - RNA, 32 nt, Human
ggaugggccauggagguccgugagcuggaacu

SEQ ID NO: 188373 - RNA, 32 nt, Human
ggaugggcccaggauggagccugccaagugug

SEQ ID NO: 188374 - RNA, 32 nt, Human
ggaugggccugauccaauucaguugaaggccu

SEQ ID NO: 188375 - RNA, 32 nt, Human
ggaugggccuggcugcacagcauccuccucug

SEQ ID NO: 188376 - RNA, 32 nt, Human
ggaugggcuggguggguggguggggaagaaau

SEQ ID NO: 188377 - RNA, 32 nt, Human
ggaugggcuguggugggaggguugcagcgccg

SEQ ID NO: 188378 - RNA, 32 nt, Human
ggauggggaagggagagcuggccuuggucagc

SEQ ID NO: 188379 - RNA, 32 nt, Human
ggauggggacauuugaacauguuuaaugggua

SEQ ID NO: 188380 - RNA, 32 nt, Human
ggauggggaggaagaggaggaagaggaagggg

SEQ ID NO: 188381 - RNA, 32 nt, Human
ggauggggagugaagcaaggugggcccagaag

SEQ ID NO: 188382 - RNA, 32 nt, Human
ggauggggcccaaaugaugggauuagugcccu

SEQ ID NO: 188383 - RNA, 32 nt, Human
ggauggggcggccugcagacccugccaggggg

SEQ ID NO: 188384 - RNA, 32 nt, Human
ggaugggggagaagaagcuaaggggagaaguc

SEQ ID NO: 188385 - RNA, 32 nt, Human
ggaugggggcggagcugggguuuggugcaguu

SEQ ID NO: 188386 - RNA, 32 nt, Human
ggaugggggcuggagucauucuuagcuguuuc

SEQ ID NO: 188387 - RNA, 32 nt, Human
ggaugggggugcaggccagggaaacaacgggu

SEQ ID NO: 188388 - RNA, 32 nt, Human
ggauggggguugugggagagaggcagcuggga

SEQ ID NO: 188389 - RNA, 23 nt, Human
ggaugggguagcacucacaggga

SEQ ID NO: 188390 - RNA, 32 nt, Human
ggauggggucaagggacagugggcagguccuc

SEQ ID NO: 188391 - RNA, 31 nt, Human
ggauggguaccauggaauaccaaagugaagg

SEQ ID NO: 188392 - RNA, 27 nt, Human
ggaugggucaucuggaacccacuuaca

SEQ ID NO: 188393 - RNA, 32 nt, Human
ggaugggugacuagacccauggagaggaacuc

SEQ ID NO: 188394 - RNA, 32 nt, Human
ggaugggugggaacaaggaggaguagauggca

SEQ ID NO: 188395 - RNA, 32 nt, Human
ggaugggugggugguaaaaagggaaggaugag

SEQ ID NO: 188396 - RNA, 32 nt, Human
ggauggguucaggccaggucuuuugauggcca

SEQ ID NO: 188397 - RNA, 24 nt, Human
ggaugguaaacugaggcacagaga

SEQ ID NO: 188398 - RNA, 32 nt, Human
ggaugguacagcuguguggugcuucuguggug

SEQ ID NO: 188399 - RNA, 32 nt, Human
ggaugguaggcacgcaccaccaugccagcuaa

SEQ ID NO: 188400 - RNA, 32 nt, Human
ggaugguagucaggggaaggagcgagauucca

SEQ ID NO: 188401 - RNA, 32 nt, Human
ggauggucagcaugucaggaaugcuggaggag

SEQ ID NO: 188402 - RNA, 32 nt, Human
ggauggucagggggaaggaggaaugcgcucaa

SEQ ID NO: 188403 - RNA, 32 nt, Human
ggauggucaugugaaccaacagagccagucac

SEQ ID NO: 188404 - RNA, 32 nt, Human
ggaugguccuguacccaguccccagccucagg

SEQ ID NO: 188405 - RNA, 21 nt, Human
ggauggucgccaagcaagcac

SEQ ID NO: 188406 - RNA, 32 nt, Human
ggauggucggaggcagagguguuuccagugau

SEQ ID NO: 188407 - RNA, 32 nt, Human
ggauggucucaaacuccugaccucgugaucca

SEQ ID NO: 188408 - RNA, 32 nt, Human
ggauggucucaggguucugucuugccuucaug

SEQ ID NO: 188409 - RNA, 32 nt, Human
ggauggucuccaacuccugacuucaugaucca

SEQ ID NO: 188410 - RNA, 32 nt, Human
ggauggucucgaacuccugaccucaggugauc

SEQ ID NO: 188411 - RNA, 32 nt, Human
ggauggucucgaacuccugacuucaugaucca

SEQ ID NO: 188412 - RNA, 32 nt, Human
ggauggucucgagucuccugaccucgugaucc

SEQ ID NO: 188413 - RNA, 32 nt, Human
ggauggucucugcugcucuugccucuaguuca

SEQ ID NO: 188414 - RNA, 32 nt, Human
ggauggucucuuaacuccugcccucaagugau

SEQ ID NO: 188415 - RNA, 32 nt, Human
ggauggucuggcccaccuccagccucagcuag

SEQ ID NO: 188416 - RNA, 22 nt, Human
ggauggugagccccugaugccg

SEQ ID NO: 188417 - RNA, 32 nt, Human
ggauggugaggguacuuagucuuagguuuugg

SEQ ID NO: 188418 - RNA, 32 nt, Human
ggauggugaugucggcugggugcaguggcuca

SEQ ID NO: 188419 - RNA, 32 nt, Human
ggauggugcaggauggcuuugcggaaaggaga

SEQ ID NO: 188420 - RNA, 19 nt, Human
ggauggugccauccaggga

SEQ ID NO: 188421 - RNA, 32 nt, Human
ggaugguggaaccauucccucccaacuccccc

SEQ ID NO: 188422 - RNA, 31 nt, Human
ggaugguggaguggacacugggugaaccacg

SEQ ID NO: 188423 - RNA, 32 nt, Human
ggauggugggcagaucacuugaggucaggagu

SEQ ID NO: 188424 - RNA, 27 nt, Human
ggauggugggcugugggguggcaguuu

SEQ ID NO: 188425 - RNA, 32 nt, Human
ggaugguggguguucagccugaaugcccagga

SEQ ID NO: 188426 - RNA, 32 nt, Human
ggaugguggucuucuccccuugccaggccuug

SEQ ID NO: 188427 - RNA, 32 nt, Human
ggauggugucuuccucuccucagccgagaaug

SEQ ID NO: 188428 - RNA, 32 nt, Human
ggauggugugcuggcccugcgcugccuggagg

SEQ ID NO: 188429 - RNA, 17 nt, Human
ggauggugugggcccuc

SEQ ID NO: 188430 - RNA, 23 nt, Human
ggaugguucccggcgcugggguc

SEQ ID NO: 188431 - RNA, 32 nt, Human
ggaugguucugggaggugagggcucaggaaca

SEQ ID NO: 188432 - RNA, 32 nt, Human
ggaugguugccaccccuccugcuguaggaugg

SEQ ID NO: 188433 - RNA, 32 nt, Human
ggaugguuugagcucaggcauuugaggcuguc

SEQ ID NO: 188434 - RNA, 20 nt, Human
ggaugguuugguugguccca

SEQ ID NO: 188435 - RNA, 22 nt, Human
ggauguaaauaaagaggcauuu

SEQ ID NO: 188436 - RNA, 29 nt, Human
ggauguaacaaauauauucaguaccauuu

SEQ ID NO: 188437 - RNA, 32 nt, Human
ggauguaacaaauauauucaguaccauuucuu

SEQ ID NO: 188438 - RNA, 32 nt, Human
ggauguaacuccuuuuagcuccaucuuuuccu

SEQ ID NO: 188439 - RNA, 32 nt, Human
ggauguaagagaauccagcagagauggacugg

SEQ ID NO: 188440 - RNA, 32 nt, Human
ggauguaagugagagaccuugggaccagcaaa

SEQ ID NO: 188441 - RNA, 32 nt, Human
ggauguagacugagaauggcuuugaguggcau

SEQ ID NO: 188442 - RNA, 32 nt, Human
ggauguagcugcagaaagcaugcacaacuuug

SEQ ID NO: 188443 - RNA, 32 nt, Human
ggauguauaauauuucugucugcucagaauau

SEQ ID NO: 188444 - RNA, 32 nt, Human
ggauguauggggagcuggcagagcagguggca

SEQ ID NO: 188445 - RNA, 32 nt, Human
ggauguauguauuggaauuaugaggcauaagu

SEQ ID NO: 188446 - RNA, 21 nt, Human
ggaugucaaagaacggcacuu

SEQ ID NO: 188447 - RNA, 32 nt, Human
ggaugucaagaucagacuggccaacagaauga

SEQ ID NO: 188448 - RNA, 32 nt, Human
ggaugucacagcuugaggcuguggugugaaag

SEQ ID NO: 188449 - RNA, 32 nt, Human
ggaugucagugaggcugggagcagggagccac

SEQ ID NO: 188450 - RNA, 32 nt, Human
ggaugucaucaggcuggcccagaaggaggagg

SEQ ID NO: 188451 - RNA, 32 nt, Human
ggaugucccaggaggcagcucuccccacacag

SEQ ID NO: 188452 - RNA, 32 nt, Human
ggaugucccucaagaaugagacaggaagugca

SEQ ID NO: 188453 - RNA, 32 nt, Human
ggauguccuccaggugacagaggguggcaagg

SEQ ID NO: 188454 - RNA, 26 nt, Human
ggauguccucgagcugcugggcugcu

SEQ ID NO: 188455 - RNA, 21 nt, Human
ggaugucgucaagugaugcuu

SEQ ID NO: 188456 - RNA, 32 nt, Human
ggaugucuauaacuucauccucaguauguucc

SEQ ID NO: 188457 - RNA, 32 nt, Human
ggaugucucccaggacaagccagucugccucu

SEQ ID NO: 188458 - RNA, 21 nt, Human
ggaugucugaaugggacgcuu

SEQ ID NO: 188459 - RNA, 32 nt, Human
ggaugucugcaggcaguggcaugugggcaggg

SEQ ID NO: 188460 - RNA, 32 nt, Human
ggaugucugccuggucccuucucacugugagg

SEQ ID NO: 188461 - RNA, 32 nt, Human
ggaugugaauuuugagacaugaaggaggguaa

SEQ ID NO: 188462 - RNA, 32 nt, Human
ggaugugacugaggccagcucuggggucucag

SEQ ID NO: 188463 - RNA, 32 nt, Human
ggaugugaucauaccacuguacugcagucugg

SEQ ID NO: 188464 - RNA, 32 nt, Human
ggaugugauggaccagcucagcuguccccaga

SEQ ID NO: 188465 - RNA, 23 nt, Human
ggaugugauggcacaugccugua

SEQ ID NO: 188466 - RNA, 23 nt, Human
ggaugugauggcucaugccugua

SEQ ID NO: 188467 - RNA, 31 nt, Human
ggaugugcagggcugccucagaagcuggcug

SEQ ID NO: 188468 - RNA, 32 nt, Human
ggaugugcauuuucaccugagguuucccugca

SEQ ID NO: 188469 - RNA, 32 nt, Human
ggaugugcugaggccuaaauguuagcaggugg

SEQ ID NO: 188470 - RNA, 32 nt, Human
ggaugugcugcacucggcaguccuaguguaau

SEQ ID NO: 188471 - RNA, 32 nt, Human
ggaugugcugugugugcaccugcucacaggau

SEQ ID NO: 188472 - RNA, 32 nt, Human
ggaugugcuuccagcagugccuucccuuuaug

SEQ ID NO: 188473 - RNA, 32 nt, Human
ggauguggaagagauaggaaaggccucaccac

SEQ ID NO: 188474 - RNA, 32 nt, Human
ggauguggagggcucagccacucugggacggg

SEQ ID NO: 188475 - RNA, 32 nt, Human
ggauguggaggggaaaaagaugacagagaagu

SEQ ID NO: 188476 - RNA, 32 nt, Human
ggauguggagucaggagcaaccagagaccccc

SEQ ID NO: 188477 - RNA, 32 nt, Human
ggauguggccccucccccuccuucucacccuu

SEQ ID NO: 188478 - RNA, 32 nt, Human
ggauguggccuuucaggcagagcccagaaaaa

SEQ ID NO: 188479 - RNA, 32 nt, Human
ggaugugggaaugaauuggcauugcaggaaag

SEQ ID NO: 188480 - RNA, 32 nt, Human
ggaugugggaaugacuggggugaggcaggguc

SEQ ID NO: 188481 - RNA, 32 nt, Human
ggaugugggaggaggggcuggcagggccgccu

SEQ ID NO: 188482 - RNA, 32 nt, Human
ggaugugggcaucccuggguucuuggaagcag

SEQ ID NO: 188483 - RNA, 32 nt, Human
ggaugugggcaugcaggugacaagggcccugc

SEQ ID NO: 188484 - RNA, 32 nt, Human
ggaugugggccaagcccuacagcuucccuagg

SEQ ID NO: 188485 - RNA, 31 nt, Human
ggauguggggcacugccucacagcucugcag

SEQ ID NO: 188486 - RNA, 32 nt, Human
ggaugugggggcugugcagggugcagcgcuca

SEQ ID NO: 188487 - RNA, 32 nt, Human
ggaugugggugucccuggcucugugagucuuc

SEQ ID NO: 188488 - RNA, 23 nt, Human
ggauguggugccgcaugccugua

SEQ ID NO: 188489 - RNA, 32 nt, Human
ggaugugguggagcugggcugggaccuccggg

SEQ ID NO: 188490 - RNA, 32 nt, Human
ggaugugguggcacacauaccuguaaucccag

SEQ ID NO: 188491 - RNA, 23 nt, Human
ggaugugguggcucacgccugua

SEQ ID NO: 188492 - RNA, 23 nt, Human
ggaugugguggcucaugccugua

SEQ ID NO: 188493 - RNA, 32 nt, Human
ggaugugguggggaacaggcaagucuugugca

SEQ ID NO: 188494 - RNA, 32 nt, Human
ggauguggugucugugcucagcgucaccuccu

SEQ ID NO: 188495 - RNA, 23 nt, Human
ggauguguaggaucacuacugca

SEQ ID NO: 188496 - RNA, 32 nt, Human
ggaugugucaacuagccaagaucgaggaccug

SEQ ID NO: 188497 - RNA, 32 nt, Human
ggauguguccccaggauccgucacaguguucc

SEQ ID NO: 188498 - RNA, 32 nt, Human
ggauguguccgccaccuucauccuccagacgg

SEQ ID NO: 188499 - RNA, 32 nt, Human
ggaugugucugccccaggcucagagugcugag

SEQ ID NO: 188500 - RNA, 32 nt, Human
ggaugugucugggcuuucuuuuugccaggcuu

SEQ ID NO: 188501 - RNA, 32 nt, Human
ggaugugugguuauaucugauuucugagcucu

SEQ ID NO: 188502 - RNA, 32 nt, Human
ggauguguguaccauugagaugagaaugggua

SEQ ID NO: 188503 - RNA, 32 nt, Human
ggauguguguacuguguucacaucgaguuggc

SEQ ID NO: 188504 - RNA, 32 nt, Human
ggaugugugugggggccaguugcaguguuucu

SEQ ID NO: 188505 - RNA, 32 nt, Human
ggauguguguuuugggguacggggagaggcga

SEQ ID NO: 188506 - RNA, 32 nt, Human
ggauguguucucuaggccuucaggacucuaga

SEQ ID NO: 188507 - RNA, 32 nt, Human
ggauguguuugugguuuguaaccauuacgguu

SEQ ID NO: 188508 - RNA, 22 nt, Human
ggauguuaaagccaacaagcac

SEQ ID NO: 188509 - RNA, 32 nt, Human
ggauguuaaagugcuugguggagacugguccc

SEQ ID NO: 188510 - RNA, 32 nt, Human
ggauguuagacacaauaucacaaaaaggugua

SEQ ID NO: 188511 - RNA, 19 nt, Human
ggauguuagacuccuggga

SEQ ID NO: 188512 - RNA, 32 nt, Human
ggauguuauaaauauacauauacauuuuugcc

SEQ ID NO: 188513 - RNA, 32 nt, Human
ggauguucuccaacuccugacuucaugaucca

SEQ ID NO: 188514 - RNA, 32 nt, Human
ggauguucucucuuccccaaaauccagcacca

SEQ ID NO: 188515 - RNA, 21 nt, Human
ggauguucucuguggcuguga

SEQ ID NO: 188516 - RNA, 32 nt, Human
ggauguucugcucucacuuguccacuguggcc

SEQ ID NO: 188517 - RNA, 32 nt, Human
ggauguucuggcacagcagacuggagacugag

SEQ ID NO: 188518 - RNA, 32 nt, Human
ggauguucuggcuuuacauuuuauuuauuagc

SEQ ID NO: 188519 - RNA, 22 nt, Human
ggauguugaacaaaaggcaguu

SEQ ID NO: 188520 - RNA, 32 nt, Human
ggauguugagcugaggccggaggagaaguagc

SEQ ID NO: 188521 - RNA, 32 nt, Human
ggauguugcaccagaagagagugcaguguugg

SEQ ID NO: 188522 - RNA, 32 nt, Human
ggauguugcuugcacuccagccugggugacag

SEQ ID NO: 188523 - RNA, 21 nt, Human
ggauguuggcaguggacacuu

SEQ ID NO: 188524 - RNA, 22 nt, Human
ggauguuggccaaaagcugcuu

SEQ ID NO: 188525 - RNA, 21 nt, Human
ggauguuguggagcuggggug

SEQ ID NO: 188526 - RNA, 32 nt, Human
ggauguuguguguguauacaugcauacacacg

SEQ ID NO: 188527 - RNA, 23 nt, Human
ggauguuguuggggaaggcacuu

SEQ ID NO: 188528 - RNA, 21 nt, Human
ggauguuuaccuaggucccuc

SEQ ID NO: 188529 - RNA, 32 nt, Human
ggauguuucggggagaauaggagccagaaccu

SEQ ID NO: 188530 - RNA, 32 nt, Human
ggauguuugggacuucacucgaccugcacggg

SEQ ID NO: 188531 - RNA, 31 nt, Human
ggauguuugggauccccuugcccaagggaca

SEQ ID NO: 188532 - RNA, 32 nt, Human
ggauguuuucuuucuccucuuugcuuccauuc

SEQ ID NO: 188533 - RNA, 21 nt, Human
ggauguuuuguccccuccuua

SEQ ID NO: 188534 - RNA, 32 nt, Human
ggauguuuuuccucccccuuaccgcccaugcc

SEQ ID NO: 188535 - RNA, 25 nt, Human
ggauguuuuucuuaccgacaagcac

SEQ ID NO: 188536 - RNA, 32 nt, Human
ggauuaaaaguuuccauuuaauuucccuuaaa

SEQ ID NO: 188537 - RNA, 32 nt, Human
ggauuaaaggcgugagccaccaugcccagccu

SEQ ID NO: 188538 - RNA, 32 nt, Human
ggauuaaaggugcgugccaccaugcccggcua

SEQ ID NO: 188539 - RNA, 32 nt, Human
ggauuaacaaaacaggaaaaauaaccaauccu

SEQ ID NO: 188540 - RNA, 32 nt, Human
ggauuaacuuugacaaaucaugcugcuguuau

SEQ ID NO: 188541 - RNA, 24 nt, Human
ggauuaagccuaggccacuugagg

SEQ ID NO: 188542 - RNA, 32 nt, Human
ggauuaaggaggggagguuacccaagaaacaa

SEQ ID NO: 188543 - RNA, 32 nt, Human
ggauuaaggcaauugaaaacacugccucagug

SEQ ID NO: 188544 - RNA, 32 nt, Human
ggauuaagugagccagucaugcaugggccgag

SEQ ID NO: 188545 - RNA, 21 nt, Human
ggauuaaugcugccacagggg

SEQ ID NO: 188546 - RNA, 32 nt, Human
ggauuaauguggguuuuucuguucauuuuauu

SEQ ID NO: 188547 - RNA, 32 nt, Human
ggauuaauugcaaacucugaacuuuuuacaaa

SEQ ID NO: 188548 - RNA, 32 nt, Human
ggauuacaagcacccaaccacgcccagcuaau

SEQ ID NO: 188549 - RNA, 32 nt, Human
ggauuacaagcaugcaccaccaugcccagcua

SEQ ID NO: 188550 - RNA, 32 nt, Human
ggauuacaagcaugcgccaccaugcccagcuu

SEQ ID NO: 188551 - RNA, 32 nt, Human
ggauuacaagcaugcgucaccacagcaggccc

SEQ ID NO: 188552 - RNA, 32 nt, Human
ggauuacaagcgugagccacugugcugggccc

SEQ ID NO: 188553 - RNA, 32 nt, Human
ggauuacaagugcccaccaccaugcccagcua

SEQ ID NO: 188554 - RNA, 32 nt, Human
ggauuacaccauugcauuccagccugggcaac

SEQ ID NO: 188555 - RNA, 32 nt, Human
ggauuacacgugcccaccaccaugcccagcua

SEQ ID NO: 188556 - RNA, 19 nt, Human
ggauuacagacaugagcca

SEQ ID NO: 188557 - RNA, 32 nt, Human
ggauuacagacgcacgccaccaugcccggcua

SEQ ID NO: 188558 - RNA, 32 nt, Human
ggauuacagacuccagcauaaccuucuccagg

SEQ ID NO: 188559 - RNA, 32 nt, Human
ggauuacagaugccugccaccaugucuugcua

SEQ ID NO: 188560 - RNA, 32 nt, Human
ggauuacagaugugagccaccaugcccagcuu

SEQ ID NO: 188561 - RNA, 32 nt, Human
ggauuacagaugugagccaccgugccuagcca

SEQ ID NO: 188562 - RNA, 17 nt, Human
ggauuacagcucuggga

SEQ ID NO: 188563 - RNA, 32 nt, Human
ggauuacaggaacccaccaccaugcuggcuaa

SEQ ID NO: 188564 - RNA, 32 nt, Human
ggauuacaggagugaaccaccaugcccagccu

SEQ ID NO: 188565 - RNA, 32 nt, Human
ggauuacaggagugagccaccaugcccggcug

SEQ ID NO: 188566 - RNA, 32 nt, Human
ggauuacaggcaacugccaccaugcccggcua

SEQ ID NO: 188567 - RNA, 32 nt, Human
ggauuacaggcaagcaccaccaugccugcuaa

SEQ ID NO: 188568 - RNA, 32 nt, Human
ggauuacaggcacacaccacaaugccuggcaa

SEQ ID NO: 188569 - RNA, 32 nt, Human
ggauuacaggcacacaccaccacgcccagcua

SEQ ID NO: 188570 - RNA, 32 nt, Human
ggauuacaggcacacaccaccacgcuugguua

SEQ ID NO: 188571 - RNA, 32 nt, Human
ggauuacaggcacacaccaccagccagcuaau

SEQ ID NO: 188572 - RNA, 32 nt, Human
ggauuacaggcacacaccaccauaccuggcua

SEQ ID NO: 188573 - RNA, 32 nt, Human
ggauuacaggcacacaccaccaugcccagcua

SEQ ID NO: 188574 - RNA, 32 nt, Human
ggauuacaggcacacgccaccaugcccggcua

SEQ ID NO: 188575 - RNA, 32 nt, Human
ggauuacaggcacaugccaccaugcccagcua

SEQ ID NO: 188576 - RNA, 32 nt, Human
ggauuacaggcacaugccaccaugcccguaua

SEQ ID NO: 188577 - RNA, 32 nt, Human
ggauuacaggcacaugccaccaugcucagcua

SEQ ID NO: 188578 - RNA, 32 nt, Human
ggauuacaggcacccaccaccacgcccagcua

SEQ ID NO: 188579 - RNA, 32 nt, Human
ggauuacaggcacccaccaccacgcucggcua

SEQ ID NO: 188580 - RNA, 32 nt, Human
ggauuacaggcacccaccaccauaucuggcua

SEQ ID NO: 188581 - RNA, 32 nt, Human
ggauuacaggcacccaccaccaugcccaacua

SEQ ID NO: 188582 - RNA, 32 nt, Human
ggauuacaggcacccaccaccaugcccagcua

SEQ ID NO: 188583 - RNA, 32 nt, Human
ggauuacaggcacccgccaccaugccaggcua

SEQ ID NO: 188584 - RNA, 32 nt, Human
ggauuacaggcaccugccaccaugcccggcua

SEQ ID NO: 188585 - RNA, 32 nt, Human
ggauuacaggcacgcaccaccacaccuggcua

SEQ ID NO: 188586 - RNA, 32 nt, Human
ggauuacaggcacgcaccaccaugccuggcua

SEQ ID NO: 188587 - RNA, 32 nt, Human
ggauuacaggcacgcaccacuacugccuggcu

SEQ ID NO: 188588 - RNA, 32 nt, Human
ggauuacaggcaucagccaccaugcccggaug

SEQ ID NO: 188589 - RNA, 32 nt, Human
ggauuacaggcauccgccaccaugcccggcua

SEQ ID NO: 188590 - RNA, 19 nt, Human
ggauuacaggcaugaacca

SEQ ID NO: 188591 - RNA, 19 nt, Human
ggauuacaggcaugagcca

SEQ ID NO: 188592 - RNA, 32 nt, Human
ggauuacaggcaugagccaccaugccagacuu

SEQ ID NO: 188593 - RNA, 32 nt, Human
ggauuacaggcaugagccaccaugcccaaccc

SEQ ID NO: 188594 - RNA, 32 nt, Human
ggauuacaggcaugagccaccaugcccagcca

SEQ ID NO: 188595 - RNA, 32 nt, Human
ggauuacaggcaugagccaccaugcccagccc

SEQ ID NO: 188596 - RNA, 32 nt, Human
ggauuacaggcaugagccaccaugcccagccu

SEQ ID NO: 188597 - RNA, 32 nt, Human
ggauuacaggcaugagccaccaugcccagcug

SEQ ID NO: 188598 - RNA, 32 nt, Human
ggauuacaggcaugagccaccaugcccagucg

SEQ ID NO: 188599 - RNA, 32 nt, Human
ggauuacaggcaugagccaccaugcccggccc

SEQ ID NO: 188600 - RNA, 32 nt, Human
ggauuacaggcaugagccaccaugcccggccu

SEQ ID NO: 188601 - RNA, 32 nt, Human
ggauuacaggcaugagccaccaugcccggcug

SEQ ID NO: 188602 - RNA, 32 nt, Human
ggauuacaggcaugagccaccaugucuugcca

SEQ ID NO: 188603 - RNA, 32 nt, Human
ggauuacaggcaugcaccaccacacacagcua

SEQ ID NO: 188604 - RNA, 32 nt, Human
ggauuacaggcaugcaccaccacaccaggcua

SEQ ID NO: 188605 - RNA, 32 nt, Human
ggauuacaggcaugcaccaccacacccagcua

SEQ ID NO: 188606 - RNA, 32 nt, Human
ggauuacaggcaugcaccaccacaccuggcua

SEQ ID NO: 188607 - RNA, 32 nt, Human
ggauuacaggcaugcaccaccacagcccagcu

SEQ ID NO: 188608 - RNA, 32 nt, Human
ggauuacaggcaugcaccaccacgcccagcua

SEQ ID NO: 188609 - RNA, 32 nt, Human
ggauuacaggcaugcaccaccacgcccagcuu

SEQ ID NO: 188610 - RNA, 32 nt, Human
ggauuacaggcaugcaccaccacgcccggcua

SEQ ID NO: 188611 - RNA, 32 nt, Human
ggauuacaggcaugcaccaccacgcucgacua

SEQ ID NO: 188612 - RNA, 32 nt, Human
ggauuacaggcaugcaccaccacgcuggcuaa

SEQ ID NO: 188613 - RNA, 32 nt, Human
ggauuacaggcaugcaccaccacuccuggcua

SEQ ID NO: 188614 - RNA, 32 nt, Human
ggauuacaggcaugcaccaccaugcccagaua

SEQ ID NO: 188615 - RNA, 32 nt, Human
ggauuacaggcaugcaccaccaugcccagcua

SEQ ID NO: 188616 - RNA, 32 nt, Human
ggauuacaggcaugcaccaccaugcccggaua

SEQ ID NO: 188617 - RNA, 32 nt, Human
ggauuacaggcaugcaccaccaugcccggcua

SEQ ID NO: 188618 - RNA, 32 nt, Human
ggauuacaggcaugcaccaccaugccuggcua

SEQ ID NO: 188619 - RNA, 32 nt, Human
ggauuacaggcaugcaccaccugacugauuuu

SEQ ID NO: 188620 - RNA, 32 nt, Human
ggauuacaggcaugcgccaccaugaccggcua

SEQ ID NO: 188621 - RNA, 32 nt, Human
ggauuacaggcaugcgccaccaugccaggcua

SEQ ID NO: 188622 - RNA, 32 nt, Human
ggauuacaggcaugcgccaccaugcccagcua

SEQ ID NO: 188623 - RNA, 32 nt, Human
ggauuacaggcaugcgccaccaugcccagcug

SEQ ID NO: 188624 - RNA, 32 nt, Human
ggauuacaggcaugcgccaccaugcccggcua

SEQ ID NO: 188625 - RNA, 32 nt, Human
ggauuacaggcaugcuccaccaugcccagcua

SEQ ID NO: 188626 - RNA, 32 nt, Human
ggauuacaggcaugggccaccaugcccggcua

SEQ ID NO: 188627 - RNA, 19 nt, Human
ggauuacaggcaugugcca

SEQ ID NO: 188628 - RNA, 32 nt, Human
ggauuacaggcaugugccaccaugcccagcua

SEQ ID NO: 188629 - RNA, 32 nt, Human
ggauuacaggcaugugucaccaugcccagcua

SEQ ID NO: 188630 - RNA, 32 nt, Human
ggauuacaggccugagccaccaugcccagcug

SEQ ID NO: 188631 - RNA, 32 nt, Human
ggauuacaggcgcaaaccaccaugcguggcua

SEQ ID NO: 188632 - RNA, 32 nt, Human
ggauuacaggcgcaagccacccagcccagcuu

SEQ ID NO: 188633 - RNA, 32 nt, Human
ggauuacaggcgcacaccaccacacacagcua

SEQ ID NO: 188634 - RNA, 32 nt, Human
ggauuacaggcgcacaccaccacauccagcuu

SEQ ID NO: 188635 - RNA, 32 nt, Human
ggauuacaggcgcacaucaccaugcccaaccu

SEQ ID NO: 188636 - RNA, 32 nt, Human
ggauuacaggcgcacgccaccaugcccagcua

SEQ ID NO: 188637 - RNA, 32 nt, Human
ggauuacaggcgcacgccaccgugccuggcua

SEQ ID NO: 188638 - RNA, 32 nt, Human
ggauuacaggcgcacgccacuaugcuggcuaa

SEQ ID NO: 188639 - RNA, 32 nt, Human
ggauuacaggcgcaugccaccacaccuggcua

SEQ ID NO: 188640 - RNA, 32 nt, Human
ggauuacaggcgcaugccaccaugccaggcua

SEQ ID NO: 188641 - RNA, 32 nt, Human
ggauuacaggcgcccaccaccacaccuggcua

SEQ ID NO: 188642 - RNA, 32 nt, Human
ggauuacaggcgcccaccaccacagccugcua

SEQ ID NO: 188643 - RNA, 32 nt, Human
ggauuacaggcgcccaccaccacgcccagcua

SEQ ID NO: 188644 - RNA, 32 nt, Human
ggauuacaggcgcccaccaccaugcccagcua

SEQ ID NO: 188645 - RNA, 32 nt, Human
ggauuacaggcgcccaccaccaugcccggcua

SEQ ID NO: 188646 - RNA, 32 nt, Human
ggauuacaggcgcccaccacuaugcccagcua

SEQ ID NO: 188647 - RNA, 32 nt, Human
ggauuacaggcgcccaccgccaugcccggcua

SEQ ID NO: 188648 - RNA, 32 nt, Human
ggauuacaggcgcccgccaccacacccggcuc

SEQ ID NO: 188649 - RNA, 32 nt, Human
ggauuacaggcgcccgccaccacaccuggcua

SEQ ID NO: 188650 - RNA, 32 nt, Human
ggauuacaggcgcccgccaccacgcccagcua

SEQ ID NO: 188651 - RNA, 32 nt, Human
ggauuacaggcgcccgccaccacgcccggcua

SEQ ID NO: 188652 - RNA, 32 nt, Human
ggauuacaggcgcccgccaccaugcccggcua

SEQ ID NO: 188653 - RNA, 32 nt, Human
ggauuacaggcgcccgccacuacgcccagcua

SEQ ID NO: 188654 - RNA, 32 nt, Human
ggauuacaggcgcccgccaucacgcccgggua

SEQ ID NO: 188655 - RNA, 32 nt, Human
ggauuacaggcgcccgccaucgugcccagcua

SEQ ID NO: 188656 - RNA, 32 nt, Human
ggauuacaggcgccgaucaccaagcccggcua

SEQ ID NO: 188657 - RNA, 32 nt, Human
ggauuacaggcgccugccaccacgcccagcua

SEQ ID NO: 188658 - RNA, 32 nt, Human
ggauuacaggcgccugccaccaugccuagcaa

SEQ ID NO: 188659 - RNA, 32 nt, Human
ggauuacaggcgccugccaccaugccuggcua

SEQ ID NO: 188660 - RNA, 32 nt, Human
ggauuacaggcgccugccaccaugccuggcug

SEQ ID NO: 188661 - RNA, 32 nt, Human
ggauuacaggcgccugccaccaugcugggcua

SEQ ID NO: 188662 - RNA, 32 nt, Human
ggauuacaggcgccugcuaccacauccagcua

SEQ ID NO: 188663 - RNA, 32 nt, Human
ggauuacaggcgccugcuaccucgcccggcuu

SEQ ID NO: 188664 - RNA, 32 nt, Human
ggauuacaggcgcgagccaccaugcccggcca

SEQ ID NO: 188665 - RNA, 32 nt, Human
ggauuacaggcgcgagccaccgcgcccagccu

SEQ ID NO: 188666 - RNA, 32 nt, Human
ggauuacaggcgcgagccaccgcgcccgacag

SEQ ID NO: 188667 - RNA, 32 nt, Human
ggauuacaggcgcgcaucaccaugcccagcua

SEQ ID NO: 188668 - RNA, 32 nt, Human
ggauuacaggcgcguaucaccauacccagcua

SEQ ID NO: 188669 - RNA, 32 nt, Human
ggauuacaggcgcgugccaccacacccagcua

SEQ ID NO: 188670 - RNA, 32 nt, Human
ggauuacaggcgcgugccaccauaccgagcua

SEQ ID NO: 188671 - RNA, 32 nt, Human
ggauuacaggcguacaccaccaugccuggcua

SEQ ID NO: 188672 - RNA, 32 nt, Human
ggauuacaggcguacgccaccaugcccaguua

SEQ ID NO: 188673 - RNA, 32 nt, Human
ggauuacaggcgucagccaccaugcccagccu

SEQ ID NO: 188674 - RNA, 32 nt, Human
ggauuacaggcguccgccaccaugcccagcca

SEQ ID NO: 188675 - RNA, 19 nt, Human
ggauuacaggcgugagcca

SEQ ID NO: 188676 - RNA, 32 nt, Human
ggauuacaggcgugagccaccaugaccagccc

SEQ ID NO: 188677 - RNA, 32 nt, Human
ggauuacaggcgugagccaccaugcccagaug

SEQ ID NO: 188678 - RNA, 32 nt, Human
ggauuacaggcgugagccaccaugcccagccu

SEQ ID NO: 188679 - RNA, 32 nt, Human
ggauuacaggcgugagccaccaugccccgccc

SEQ ID NO: 188680 - RNA, 32 nt, Human
ggauuacaggcgugagccaccaugcccggcca

SEQ ID NO: 188681 - RNA, 32 nt, Human
ggauuacaggcgugagccaccaugcccggccc

SEQ ID NO: 188682 - RNA, 32 nt, Human
ggauuacaggcgugagccaccaugcccggccu

SEQ ID NO: 188683 - RNA, 32 nt, Human
ggauuacaggcgugagccaccaugccugccca

SEQ ID NO: 188684 - RNA, 32 nt, Human
ggauuacaggcgugagccaccaugccuggcca

SEQ ID NO: 188685 - RNA, 32 nt, Human
ggauuacaggcgugagccaccaugccuggccu

SEQ ID NO: 188686 - RNA, 32 nt, Human
ggauuacaggcgugagccaccaugcucggccu

SEQ ID NO: 188687 - RNA, 32 nt, Human
ggauuacaggcgugagccaccauguccagcca

SEQ ID NO: 188688 - RNA, 32 nt, Human
ggauuacaggcgugagccaccauguccggcuu

SEQ ID NO: 188689 - RNA, 32 nt, Human
ggauuacaggcgugcaccaccacgcccaguug

SEQ ID NO: 188690 - RNA, 32 nt, Human
ggauuacaggcgugcaccaccacgcccggcug

SEQ ID NO: 188691 - RNA, 32 nt, Human
ggauuacaggcgugcaccaccaugccuggcua

SEQ ID NO: 188692 - RNA, 32 nt, Human
ggauuacaggcgugcgccaccauguccagcua

SEQ ID NO: 188693 - RNA, 32 nt, Human
ggauuacaggcguguaccaccauacccagcua

SEQ ID NO: 188694 - RNA, 32 nt, Human
ggauuacaggcgugugccaccaugcccaaccu

SEQ ID NO: 188695 - RNA, 32 nt, Human
ggauuacaggcgugugccaccaugcccagcua

SEQ ID NO: 188696 - RNA, 32 nt, Human
ggauuacaggcgugugccaccaugccuggcua

SEQ ID NO: 188697 - RNA, 32 nt, Human
ggauuacaggcucaugccaccaugcccagcua

SEQ ID NO: 188698 - RNA, 19 nt, Human
ggauuacagggaugagcca

SEQ ID NO: 188699 - RNA, 32 nt, Human
ggauuacagguaccugccaccaugcccggcua

SEQ ID NO: 188700 - RNA, 32 nt, Human
ggauuacagguacgcaccaccacgcccagcuc

SEQ ID NO: 188701 - RNA, 19 nt, Human
ggauuacagguaugagcca

SEQ ID NO: 188702 - RNA, 32 nt, Human
ggauuacagguaugagccaccaugcccggcug

SEQ ID NO: 188703 - RNA, 32 nt, Human
ggauuacagguaugcaccaccacgcccggcua

SEQ ID NO: 188704 - RNA, 32 nt, Human
ggauuacaggugcacaccaccacaccuggcua

SEQ ID NO: 188705 - RNA, 32 nt, Human
ggauuacaggugcacaccaccacgcuuggcua

SEQ ID NO: 188706 - RNA, 32 nt, Human
ggauuacaggugcacaccaccaugcccggcaa

SEQ ID NO: 188707 - RNA, 32 nt, Human
ggauuacaggugcacaccaccaugccugucua

SEQ ID NO: 188708 - RNA, 32 nt, Human
ggauuacaggugcacgccaccaugcuuggcuc

SEQ ID NO: 188709 - RNA, 32 nt, Human
ggauuacaggugcaggccaccaugcccggcua

SEQ ID NO: 188710 - RNA, 32 nt, Human
ggauuacaggugcaugccaccauggcuggcua

SEQ ID NO: 188711 - RNA, 32 nt, Human
ggauuacaggugcccaccaccacaccaggcua

SEQ ID NO: 188712 - RNA, 32 nt, Human
ggauuacaggugcccaccaccacauccagcua

SEQ ID NO: 188713 - RNA, 32 nt, Human
ggauuacaggugcccaccaccaccccuggcua

SEQ ID NO: 188714 - RNA, 32 nt, Human
ggauuacaggugcccaccaccaugccaggcua

SEQ ID NO: 188715 - RNA, 32 nt, Human
ggauuacaggugcccaccaccaugcccggcaa

SEQ ID NO: 188716 - RNA, 32 nt, Human
ggauuacaggugcccaccaccaugcccggcua

SEQ ID NO: 188717 - RNA, 32 nt, Human
ggauuacaggugcccaccaccaugccuggaua

SEQ ID NO: 188718 - RNA, 32 nt, Human
ggauuacaggugcccaccaccaugccuggcua

SEQ ID NO: 188719 - RNA, 32 nt, Human
ggauuacaggugcccaccaccaugccuggcug

SEQ ID NO: 188720 - RNA, 32 nt, Human
ggauuacaggugcccaccaccaugucaagaua

SEQ ID NO: 188721 - RNA, 32 nt, Human
ggauuacaggugcccgccaccaugcucagcua

SEQ ID NO: 188722 - RNA, 32 nt, Human
ggauuacaggugccugccaccaugcccagcua

SEQ ID NO: 188723 - RNA, 32 nt, Human
ggauuacaggugcgcaccaccaugcccggcua

SEQ ID NO: 188724 - RNA, 32 nt, Human
ggauuacaggugcgcaccauuacauccagcua

SEQ ID NO: 188725 - RNA, 32 nt, Human
ggauuacaggugcgccccaccaugcccagcua

SEQ ID NO: 188726 - RNA, 32 nt, Human
ggauuacaggugcucaccaccacguccagcua

SEQ ID NO: 188727 - RNA, 32 nt, Human
ggauuacagguguaagccaccaugcccagccu

SEQ ID NO: 188728 - RNA, 24 nt, Human
ggauuacaggugugagacagugca

SEQ ID NO: 188729 - RNA, 32 nt, Human
ggauuacaggugugagccaccaugccaggccc

SEQ ID NO: 188730 - RNA, 32 nt, Human
ggauuacaggugugagccaccaugcccaacac

SEQ ID NO: 188731 - RNA, 32 nt, Human
ggauuacaggugugagccaccaugcccagccc

SEQ ID NO: 188732 - RNA, 32 nt, Human
ggauuacaggugugagccaccaugcccagccu

SEQ ID NO: 188733 - RNA, 32 nt, Human
ggauuacaggugugagccaccaugcccggccu

SEQ ID NO: 188734 - RNA, 32 nt, Human
ggauuacaggugugagccaccaugcucugcca

SEQ ID NO: 188735 - RNA, 32 nt, Human
ggauuacaggugugcaccaccacacccggcua

SEQ ID NO: 188736 - RNA, 32 nt, Human
ggauuacaggugugcaccaccauuccuggcua

SEQ ID NO: 188737 - RNA, 32 nt, Human
ggauuacaggugugcgccaccaugcccggccu

SEQ ID NO: 188738 - RNA, 32 nt, Human
ggauuacaggugugcgccaccaugcccggcua

SEQ ID NO: 188739 - RNA, 32 nt, Human
ggauuacaggugugcgccaccauguccggcua

SEQ ID NO: 188740 - RNA, 32 nt, Human
ggauuacaggugugugccaccaugcccgucuc

SEQ ID NO: 188741 - RNA, 32 nt, Human
ggauuacaggugugugccaccaugcuuggcua

SEQ ID NO: 188742 - RNA, 32 nt, Human
ggauuacaggugugugccaucaugccugacua

SEQ ID NO: 188743 - RNA, 32 nt, Human
ggauuacagguguguggcaccaugcccagcua

SEQ ID NO: 188744 - RNA, 32 nt, Human
ggauuacagguuugcaccaccaugcccggcua

SEQ ID NO: 188745 - RNA, 32 nt, Human
ggauuacaguguuauaguuuugccgcuggacu

SEQ ID NO: 188746 - RNA, 32 nt, Human
ggauuacaugcaugagccacugugcugggcuu

SEQ ID NO: 188747 - RNA, 32 nt, Human
ggauuacauuuuuauggggcagggguaagcgg

SEQ ID NO: 188748 - RNA, 32 nt, Human
ggauuaccggcgugagccaccaugcccagccu

SEQ ID NO: 188749 - RNA, 32 nt, Human
ggauuacgccuguaaucccagcacuuugggag

SEQ ID NO: 188750 - RNA, 32 nt, Human
ggauuacgcugaggcccagccugggggagaau

SEQ ID NO: 188751 - RNA, 32 nt, Human
ggauuacgggcgcccaccaccaugcccagcua

SEQ ID NO: 188752 - RNA, 32 nt, Human
ggauuacgggcgcccgccaccaugcccagcua

SEQ ID NO: 188753 - RNA, 32 nt, Human
ggauuacgucacugcaggaacugcuucugaaa

SEQ ID NO: 188754 - RNA, 24 nt, Human
ggauuacgugauccacccgccuca

SEQ ID NO: 188755 - RNA, 32 nt, Human
ggauuacuccugcauaacaagaucccauuucu

SEQ ID NO: 188756 - RNA, 32 nt, Human
ggauuacugcugucuaucuucuugcuccacuc

SEQ ID NO: 188757 - RNA, 32 nt, Human
ggauuacuggugcacaccaccacacucagcua

SEQ ID NO: 188758 - RNA, 32 nt, Human
ggauuacuggugcccaccaccaugcccagcua

SEQ ID NO: 188759 - RNA, 32 nt, Human
ggauuacuucaaccugggagguugaggcugca

SEQ ID NO: 188760 - RNA, 31 nt, Human
ggauuagaaaaaugccuauuuuucuuguauc

SEQ ID NO: 188761 - RNA, 32 nt, Human
ggauuagaacaugcuuauaccuauuaacaaga

SEQ ID NO: 188762 - RNA, 32 nt, Human
ggauuagaauaaauccuaaucucuaaucuaag

SEQ ID NO: 188763 - RNA, 23 nt, Human
ggauuagacgccgggaagcacuu

SEQ ID NO: 188764 - RNA, 32 nt, Human
ggauuaggcaggcagaggcaguuaugggcuuc

SEQ ID NO: 188765 - RNA, 32 nt, Human
ggauuagggaaggacauaauguauuuaagaau

SEQ ID NO: 188766 - RNA, 32 nt, Human
ggauuagggaccuaccaaaauauuucauuaau

SEQ ID NO: 188767 - RNA, 32 nt, Human
ggauuagggguggaggcagcaggaugagcaga

SEQ ID NO: 188768 - RNA, 32 nt, Human
ggauuaggugguccucacagggguggggccau

SEQ ID NO: 188769 - RNA, 32 nt, Human
ggauuaggugugagccaccgcaccuggccgau

SEQ ID NO: 188770 - RNA, 32 nt, Human
ggauuaguagucaguugcuguaaacuauuuug

SEQ ID NO: 188771 - RNA, 32 nt, Human
ggauuauacuugaaaugcauugugcugauguu

SEQ ID NO: 188772 - RNA, 32 nt, Human
ggauuauaggcacacaccaccauguccagcua

SEQ ID NO: 188773 - RNA, 32 nt, Human
ggauuauaggcacgagccaccaugccaagccu

SEQ ID NO: 188774 - RNA, 19 nt, Human
ggauuauaggcaugagcca

SEQ ID NO: 188775 - RNA, 32 nt, Human
ggauuauaggcaugagccaccaugcccagcca

SEQ ID NO: 188776 - RNA, 32 nt, Human
ggauuauaggcaugcaccaccacgcccagcua

SEQ ID NO: 188777 - RNA, 32 nt, Human
ggauuauaggcaugcaccaccaugcccagcua

SEQ ID NO: 188778 - RNA, 32 nt, Human
ggauuauaggcaugcgccaccaugcccggccg

SEQ ID NO: 188779 - RNA, 32 nt, Human
ggauuauaggcgagugccaucaugcccggcua

SEQ ID NO: 188780 - RNA, 32 nt, Human
ggauuauaggcgugagccaccaugcccagccu

SEQ ID NO: 188781 - RNA, 32 nt, Human
ggauuauaggcgugagccaccaugcucagcca

SEQ ID NO: 188782 - RNA, 32 nt, Human
ggauuauaggcgugcaccaccaugcccagcua

SEQ ID NO: 188783 - RNA, 32 nt, Human
ggauuauaggcgugugccaccaugcccagcaa

SEQ ID NO: 188784 - RNA, 32 nt, Human
ggauuauaggugcaugccaccaugcccagcua

SEQ ID NO: 188785 - RNA, 32 nt, Human
ggauuauaggugcccaccaccaagcccagcua

SEQ ID NO: 188786 - RNA, 32 nt, Human
ggauuauaggugccugccaccaugcccggcua

SEQ ID NO: 188787 - RNA, 32 nt, Human
ggauuauaggugcgcaccaccacacccggcua

SEQ ID NO: 188788 - RNA, 32 nt, Human
ggauuauaggugugaaccaccauacccaggcu

SEQ ID NO: 188789 - RNA, 32 nt, Human
ggauuauaggugugagccaccaugcccagccc

SEQ ID NO: 188790 - RNA, 32 nt, Human
ggauuauauuaauugcuaaauauuuuauucac

SEQ ID NO: 188791 - RNA, 32 nt, Human
ggauuaucauuaccuuuacaauacuguauaau

SEQ ID NO: 188792 - RNA, 32 nt, Human
ggauuaucgcacagacugggagguuuaguggu

SEQ ID NO: 188793 - RNA, 32 nt, Human
ggauuaucgccaccaucaccucuuucaauugc

SEQ ID NO: 188794 - RNA, 32 nt, Human
ggauuaucuuugcuaccuguguuaaagaauau

SEQ ID NO: 188795 - RNA, 32 nt, Human
ggauuaugaagggguggccugccccuccacau

SEQ ID NO: 188796 - RNA, 32 nt, Human
ggauuaugagcuucuuucaagggcuaaggcug

SEQ ID NO: 188797 - RNA, 32 nt, Human
ggauuaugcccagccacuuggggagggcaguc

SEQ ID NO: 188798 - RNA, 32 nt, Human
ggauuaugccuaguuugucauaucacagaaaa

SEQ ID NO: 188799 - RNA, 32 nt, Human
ggauuaugggcgcccaccaccaugcccagcua

SEQ ID NO: 188800 - RNA, 32 nt, Human
ggauuaugggcgcccaccaccaugccuggcua

SEQ ID NO: 188801 - RNA, 32 nt, Human
ggauuaugucuuauauuuucucugucagaguu

SEQ ID NO: 188802 - RNA, 17 nt, Human
ggauuauguggagugaa

SEQ ID NO: 188803 - RNA, 32 nt, Human
ggauuauguguguacacuccaucucugaagaa

SEQ ID NO: 188804 - RNA, 32 nt, Human
ggauuauuaccugaagugguggaagguugauc

SEQ ID NO: 188805 - RNA, 32 nt, Human
ggauuauuagguuggugcaaaaguaauugugg

SEQ ID NO: 188806 - RNA, 32 nt, Human
ggauuauuuaauaacauuaccuuacuguggag

SEQ ID NO: 188807 - RNA, 18 nt, Human
ggauuauuuccacuguga

SEQ ID NO: 188808 - RNA, 32 nt, Human
ggauuauuucuuucuccucuuacagaaugaag

SEQ ID NO: 188809 - RNA, 32 nt, Human
ggauucaaaaacacagggaggggcuccauuuu

SEQ ID NO: 188810 - RNA, 23 nt, Human
ggauucaaacaauucuccugccu

SEQ ID NO: 188811 - RNA, 32 nt, Human
ggauucaaaggaaaaaucuuugggugauuccc

SEQ ID NO: 188812 - RNA, 32 nt, Human
ggauucaacagcuuuauugucuggaagcagug

SEQ ID NO: 188813 - RNA, 22 nt, Human
ggauucaagcaauucuccugcc

SEQ ID NO: 188814 - RNA, 23 nt, Human
ggauucaagcaauucuccugccu

SEQ ID NO: 188815 - RNA, 23 nt, Human
ggauucaagcaauucuucugccu

SEQ ID NO: 188816 - RNA, 23 nt, Human
ggauucaagcgauuccccugccu

SEQ ID NO: 188817 - RNA, 23 nt, Human
ggauucaagcgauucuccugccu

SEQ ID NO: 188818 - RNA, 25 nt, Human
ggauucaagcgauucuccugccuca

SEQ ID NO: 188819 - RNA, 22 nt, Human
ggauucaagcgauucuccuguc

SEQ ID NO: 188820 - RNA, 25 nt, Human
ggauucaagcgguuuuccugccuca

SEQ ID NO: 188821 - RNA, 25 nt, Human
ggauucaagugauuccccugucuca

SEQ ID NO: 188822 - RNA, 25 nt, Human
ggauucaagugauucuacugccuca

SEQ ID NO: 188823 - RNA, 25 nt, Human
ggauucaagugauucuccagccuca

SEQ ID NO: 188824 - RNA, 25 nt, Human
ggauucaagugauucuccugccuca

SEQ ID NO: 188825 - RNA, 32 nt, Human
ggauucacaccagccacaagccuggaaagaug

SEQ ID NO: 188826 - RNA, 32 nt, Human
ggauucacuaaauuuguuuguuguuguuguug

SEQ ID NO: 188827 - RNA, 32 nt, Human
ggauucacugcuucucauaccuccagugaaga

SEQ ID NO: 188828 - RNA, 32 nt, Human
ggauucacuucuuuaaggguaaggaggcuagu

SEQ ID NO: 188829 - RNA, 32 nt, Human
ggauucagacacuguaucccagaacugcucua

SEQ ID NO: 188830 - RNA, 32 nt, Human
ggauucagaccauccauaaugaacacgcauca

SEQ ID NO: 188831 - RNA, 32 nt, Human
ggauucagagagucugggggacaggaauccug

SEQ ID NO: 188832 - RNA, 32 nt, Human
ggauucagagguaggcucuggagccagucuac

SEQ ID NO: 188833 - RNA, 32 nt, Human
ggauucagagugacuugccuaagauuacacag

SEQ ID NO: 188834 - RNA, 32 nt, Human
ggauucagccuccugcuggguccuucugcugg

SEQ ID NO: 188835 - RNA, 22 nt, Human
ggauucagcucggagagcucug

SEQ ID NO: 188836 - RNA, 32 nt, Human
ggauucaggagaaggcaaaagcuagaaacacu

SEQ ID NO: 188837 - RNA, 32 nt, Human
ggauucaguugcagagcaggaagccuggaucc

SEQ ID NO: 188838 - RNA, 32 nt, Human
ggauucauaaacuucuucccuaccugcaucau

SEQ ID NO: 188839 - RNA, 22 nt, Human
ggauucaucuguuuucuucacu

SEQ ID NO: 188840 - RNA, 32 nt, Human
ggauucaugcucccugccccuaccccacccug

SEQ ID NO: 188841 - RNA, 32 nt, Human
ggauuccacagaguugaccucucugauuuucu

SEQ ID NO: 188842 - RNA, 32 nt, Human
ggauuccacccaggucugucugcagcgaguug

SEQ ID NO: 188843 - RNA, 32 nt, Human
ggauuccacuggcauccagccucccacagggc

SEQ ID NO: 188844 - RNA, 32 nt, Human
ggauuccagaagcucaggugguggugacuaaa

SEQ ID NO: 188845 - RNA, 23 nt, Human
ggauuccagcaauucuccugccu

SEQ ID NO: 188846 - RNA, 32 nt, Human
ggauuccagccuguuggccccugucuucgacc

SEQ ID NO: 188847 - RNA, 32 nt, Human
ggauuccagcuuuguguccuccuuggcaagcu

SEQ ID NO: 188848 - RNA, 32 nt, Human
ggauuccaggucuggaguuuuccaauguuaau

SEQ ID NO: 188849 - RNA, 32 nt, Human
ggauuccauauuuuuguuucucuccaauucag

SEQ ID NO: 188850 - RNA, 32 nt, Human
ggauuccauccagcucagaagggcaggaguaa

SEQ ID NO: 188851 - RNA, 32 nt, Human
ggauuccaucuaugagacuuugucuacauaac

SEQ ID NO: 188852 - RNA, 32 nt, Human
ggauuccaugguagcugggauguuagggcuca

SEQ ID NO: 188853 - RNA, 32 nt, Human
ggauuccauucaagcaugcacauaacuagcag

SEQ ID NO: 188854 - RNA, 32 nt, Human
ggauucccacaucuucuaguuggacaauauug

SEQ ID NO: 188855 - RNA, 32 nt, Human
ggauucccagaagcauagcuuagaugggacca

SEQ ID NO: 188856 - RNA, 23 nt, Human
ggauucccagccucacucccucu

SEQ ID NO: 188857 - RNA, 32 nt, Human
ggauucccagucuacaaaaccccacagcuccu

SEQ ID NO: 188858 - RNA, 22 nt, Human
ggauucccccggcucgccugcc

SEQ ID NO: 188859 - RNA, 32 nt, Human
ggauuccccugccccgcccccggcacgaggcc

SEQ ID NO: 188860 - RNA, 32 nt, Human
ggauucccgcaggccgguguguuuucaaaaca

SEQ ID NO: 188861 - RNA, 32 nt, Human
ggauucccugacuuugacacacauggccaccu

SEQ ID NO: 188862 - RNA, 32 nt, Human
ggauucccuggagaaaguggaccuaaggguga

SEQ ID NO: 188863 - RNA, 32 nt, Human
ggauuccgaggcagaaggguguaauuaaggau

SEQ ID NO: 188864 - RNA, 32 nt, Human
ggauuccuacuuccugcucuaagguuugacac

SEQ ID NO: 188865 - RNA, 32 nt, Human
ggauuccuagagccugcuaacagaauaauccc

SEQ ID NO: 188866 - RNA, 32 nt, Human
ggauuccucaugggggaggcagagcccacccg

SEQ ID NO: 188867 - RNA, 20 nt, Human
ggauuccugccagguccccg

SEQ ID NO: 188868 - RNA, 32 nt, Human
ggauuccugcuggcauucggcuguggcccuag

SEQ ID NO: 188869 - RNA, 32 nt, Human
ggauuccugcuugugcaggagccuguguacac

SEQ ID NO: 188870 - RNA, 32 nt, Human
ggauuccuuccaagucaguuacaggugguuuu

SEQ ID NO: 188871 - RNA, 17 nt, Human
ggauuccuugccaggga

SEQ ID NO: 188872 - RNA, 32 nt, Human
ggauuccuuuuucgccaggcaccaaggcacag

SEQ ID NO: 188873 - RNA, 32 nt, Human
ggauucgaaggcauaagcagaagaggaaaggg

SEQ ID NO: 188874 - RNA, 32 nt, Human
ggauucgacagcagugacagaucagugcauuu

SEQ ID NO: 188875 - RNA, 32 nt, Human
ggauucgaggagaagggaaggaugcagcuuug

SEQ ID NO: 188876 - RNA, 25 nt, Human
ggauucgagugauucuccugccuca

SEQ ID NO: 188877 - RNA, 32 nt, Human
ggauucgcgcuccacuggucagcuggggucgc

SEQ ID NO: 188878 - RNA, 32 nt, Human
ggauucggaccacuuggggaucccagaaccuc

SEQ ID NO: 188879 - RNA, 32 nt, Human
ggauucggcugccauggcgccugcugcugagc

SEQ ID NO: 188880 - RNA, 32 nt, Human
ggauucgggaaguggcugaagagcacuggaaa

SEQ ID NO: 188881 - RNA, 32 nt, Human
ggauucuaggagaaagagaaggucuaugucaa

SEQ ID NO: 188882 - RNA, 32 nt, Human
ggauucuauccagcaagauccuguccaagagu

SEQ ID NO: 188883 - RNA, 32 nt, Human
ggauucucauaagaagcacgcaaccuagaucc

SEQ ID NO: 188884 - RNA, 32 nt, Human
ggauucuccauggcuaggcccagaaacacagg

SEQ ID NO: 188885 - RNA, 32 nt, Human
ggauucucccaggagccuccagaaggaaccuu

SEQ ID NO: 188886 - RNA, 32 nt, Human
ggauucuccccaaggucauuuguauucagagu

SEQ ID NO: 188887 - RNA, 32 nt, Human
ggauucuccugccucagccuccaacuagcugg

SEQ ID NO: 188888 - RNA, 32 nt, Human
ggauucuccugccucagccuccugaguagcug

SEQ ID NO: 188889 - RNA, 32 nt, Human
ggauucuccugccucaggcuccugaguagcua

SEQ ID NO: 188890 - RNA, 32 nt, Human
ggauucugaugggaagaggccugggaugcugc

SEQ ID NO: 188891 - RNA, 32 nt, Human
ggauucugcacuuuagccagccugggucggca

SEQ ID NO: 188892 - RNA, 31 nt, Human
ggauucugccucuuuaguccucacuguuaaa

SEQ ID NO: 188893 - RNA, 32 nt, Human
ggauucugggaggugacgucgcgggucucggu

SEQ ID NO: 188894 - RNA, 32 nt, Human
ggauucuggucagcuauaaaggaggacuuucc

SEQ ID NO: 188895 - RNA, 20 nt, Human
ggauucuggugggguguguu

SEQ ID NO: 188896 - RNA, 32 nt, Human
ggauucugguuccagccaggguugaggaaaag

SEQ ID NO: 188897 - RNA, 32 nt, Human
ggauucugguuccagccaggguugaggaaagg

SEQ ID NO: 188898 - RNA, 32 nt, Human
ggauucugguugucacuuuucuuaguuaugag

SEQ ID NO: 188899 - RNA, 32 nt, Human
ggauucuguaauguuccuccauacaguuaaaa

SEQ ID NO: 188900 - RNA, 32 nt, Human
ggauucuguaguaaggugacauagcuaugaca

SEQ ID NO: 188901 - RNA, 23 nt, Human
ggauucuucaacacagccaauga

SEQ ID NO: 188902 - RNA, 23 nt, Human
ggauucuucccgaacaggcgcuu

SEQ ID NO: 188903 - RNA, 32 nt, Human
ggauucuuguucuuccucuuaucuuccuuuug

SEQ ID NO: 188904 - RNA, 32 nt, Human
ggauucuuucucucuucucccaacaauccaaa

SEQ ID NO: 188905 - RNA, 32 nt, Human
ggauucuuuguucaccccgcagauaguuaaug

SEQ ID NO: 188906 - RNA, 32 nt, Human
ggauugaaaaacagaaacacaaaacuuugacu

SEQ ID NO: 188907 - RNA, 32 nt, Human
ggauugaaaaagcaaaccacagcagaaccauc

SEQ ID NO: 188908 - RNA, 32 nt, Human
ggauugaaagaaugugugugaagggguagaau

SEQ ID NO: 188909 - RNA, 32 nt, Human
ggauugaaggauuggguuuucucuuucccaug

SEQ ID NO: 188910 - RNA, 32 nt, Human
ggauugagaacagcuggucuacaccaguuccu

SEQ ID NO: 188911 - RNA, 32 nt, Human
ggauugagacugacacagguaaggcgucuucu

SEQ ID NO: 188912 - RNA, 32 nt, Human
ggauugagcacccuguacucuccagccaccuu

SEQ ID NO: 188913 - RNA, 32 nt, Human
ggauugagccaagaggugagggugcacgucuu

SEQ ID NO: 188914 - RNA, 32 nt, Human
ggauugaggagacugaagaaugcugaagacag

SEQ ID NO: 188915 - RNA, 20 nt, Human
ggauugaggcacagaguguu

SEQ ID NO: 188916 - RNA, 32 nt, Human
ggauugaggggcccuggcaggacccugaccuc

SEQ ID NO: 188917 - RNA, 32 nt, Human
ggauugaucggagagggcagauccucagguuc

SEQ ID NO: 188918 - RNA, 32 nt, Human
ggauugaucuucagggcuguuuuuguuccugc

SEQ ID NO: 188919 - RNA, 32 nt, Human
ggauugcaccacugcacuccagccugggcuac

SEQ ID NO: 188920 - RNA, 32 nt, Human
ggauugcacccuggcgagcuuaccaagggccu

SEQ ID NO: 188921 - RNA, 32 nt, Human
ggauugcagacgugcaccaccacgccaggcua

SEQ ID NO: 188922 - RNA, 32 nt, Human
ggauugcaggcacucaccaccaugcccggcua

SEQ ID NO: 188923 - RNA, 19 nt, Human
ggauugcaggcaugagcca

SEQ ID NO: 188924 - RNA, 32 nt, Human
ggauugcaggcgugagccaccaugcccggcuc

SEQ ID NO: 188925 - RNA, 32 nt, Human
ggauugcaggugcacaccaccacgcccagcua

SEQ ID NO: 188926 - RNA, 32 nt, Human
ggauugcaggugcccaccaccacgcccagcua

SEQ ID NO: 188927 - RNA, 32 nt, Human
ggauugcaggugcccaccaucaugcccagcua

SEQ ID NO: 188928 - RNA, 32 nt, Human
ggauugcagugaucauuaaucaaaaauauuug

SEQ ID NO: 188929 - RNA, 32 nt, Human
ggauugcaucacugcacuccagccugggugac

SEQ ID NO: 188930 - RNA, 32 nt, Human
ggauugccugagaccaggagguugaggcugca

SEQ ID NO: 188931 - RNA, 32 nt, Human
ggauugccuggguuccaugagacaggccagcg

SEQ ID NO: 188932 - RNA, 32 nt, Human
ggauugcgagggaagccaggggaggaucgcga

SEQ ID NO: 188933 - RNA, 32 nt, Human
ggauugcgccaccacacuccagccugggcaac

SEQ ID NO: 188934 - RNA, 32 nt, Human
ggauugcgccacugcaccccagcccgggugac

SEQ ID NO: 188935 - RNA, 32 nt, Human
ggauugcgccacugcacuccagccugggcaac

SEQ ID NO: 188936 - RNA, 32 nt, Human
ggauugcgccacugcacuccagccugggugac

SEQ ID NO: 188937 - RNA, 32 nt, Human
ggauugcgccagugcacuccagcugggcgaca

SEQ ID NO: 188938 - RNA, 32 nt, Human
ggauugcgcuacugcacuccagccugggugac

SEQ ID NO: 188939 - RNA, 32 nt, Human
ggauugcuacuguaucagaaauauuguuucaa

SEQ ID NO: 188940 - RNA, 32 nt, Human
ggauugcucaugcagaacaccacccagugccc

SEQ ID NO: 188941 - RNA, 32 nt, Human
ggauugcugcauaucagcaguuggauguucuu

SEQ ID NO: 188942 - RNA, 32 nt, Human
ggauugcuggauggaaacccuggaauaggcua

SEQ ID NO: 188943 - RNA, 32 nt, Human
ggauugcuguuuacgauagugccuucauuagu

SEQ ID NO: 188944 - RNA, 32 nt, Human
ggauugcuuaagucugggagguugaggcugca

SEQ ID NO: 188945 - RNA, 22 nt, Human
ggauugcuuacggagaacucug

SEQ ID NO: 188946 - RNA, 32 nt, Human
ggauugcuucaacccaggcauucgagacuagc

SEQ ID NO: 188947 - RNA, 18 nt, Human
ggauugcuugagcccagg

SEQ ID NO: 188948 - RNA, 32 nt, Human
ggauugcuugagccugggagguugaggcugca

SEQ ID NO: 188949 - RNA, 32 nt, Human
ggauugcuugagcguagccauucgagagcagc

SEQ ID NO: 188950 - RNA, 32 nt, Human
ggauugcuugagcucaggaguucgagaccagu

SEQ ID NO: 188951 - RNA, 32 nt, Human
ggauugcuugagcucaggaguuugagaccaac

SEQ ID NO: 188952 - RNA, 32 nt, Human
ggauugcuugagcucaggaguuugagaccagc

SEQ ID NO: 188953 - RNA, 32 nt, Human
ggauugcuugagcucggaagauggaggcugca

SEQ ID NO: 188954 - RNA, 32 nt, Human
ggauugcuugagcucgggaguuugagaccagc

SEQ ID NO: 188955 - RNA, 18 nt, Human
ggauugcuugaguccagg

SEQ ID NO: 188956 - RNA, 32 nt, Human
ggauugcuugaguccaggagguugaggcugca

SEQ ID NO: 188957 - RNA, 32 nt, Human
ggauugcuugggccugggaggucgaggcugca

SEQ ID NO: 188958 - RNA, 32 nt, Human
ggauuggaaagaauguugggaaaggacaucuu

SEQ ID NO: 188959 - RNA, 32 nt, Human
ggauuggaccuggaagaagugagucuccucuc

SEQ ID NO: 188960 - RNA, 32 nt, Human
ggauuggacuggaaggacuggcugucuuuccu

SEQ ID NO: 188961 - RNA, 32 nt, Human
ggauuggagaagguaccuggauccuuguggac

SEQ ID NO: 188962 - RNA, 32 nt, Human
ggauuggagcagugugcucuggcgggaagggc

SEQ ID NO: 188963 - RNA, 32 nt, Human
ggauuggaggcaaaccaucaagguggucccuc

SEQ ID NO: 188964 - RNA, 32 nt, Human
ggauuggagguggggguuucagaguguugcca

SEQ ID NO: 188965 - RNA, 32 nt, Human
ggauuggccagagaaguagggagcagcagugg

SEQ ID NO: 188966 - RNA, 32 nt, Human
ggauuggccuccagggcgcaggggagggugcg

SEQ ID NO: 188967 - RNA, 32 nt, Human
ggauuggcuaccucuaggugaaaugagcggug

SEQ ID NO: 188968 - RNA, 32 nt, Human
ggauuggcugugagccaauucaccucagucuc

SEQ ID NO: 188969 - RNA, 32 nt, Human
ggauugggcuaguuagcacagagcagggacgg

SEQ ID NO: 188970 - RNA, 32 nt, Human
ggauuggggaaaggggagagagaagcaguaga

SEQ ID NO: 188971 - RNA, 21 nt, Human
ggauuggggaccauggucugg

SEQ ID NO: 188972 - RNA, 32 nt, Human
ggauuggggcuccaccuggcuuggagauggcc

SEQ ID NO: 188973 - RNA, 32 nt, Human
ggauugggggcuggugccagccuuccucugca

SEQ ID NO: 188974 - RNA, 32 nt, Human
ggauuggggguaaccuuucauuugucaaccuu

SEQ ID NO: 188975 - RNA, 32 nt, Human
ggauugggguguugaguccaggcugaguaggg

SEQ ID NO: 188976 - RNA, 32 nt, Human
ggauuggucaucucaguauccggaguuacucg

SEQ ID NO: 188977 - RNA, 32 nt, Human
ggauuggugaugacucuuaaugagcaugcugc

SEQ ID NO: 188978 - RNA, 32 nt, Human
ggauuggugguuuuguuuugcuuuguuuaaag

SEQ ID NO: 188979 - RNA, 32 nt, Human
ggauugguugagcuuaggagguugaggcugca

SEQ ID NO: 188980 - RNA, 32 nt, Human
ggauuguagggaggggaaccgagggacaucau

SEQ ID NO: 188981 - RNA, 32 nt, Human
ggauuguagggagucagaaagacaaggggagc

SEQ ID NO: 188982 - RNA, 32 nt, Human
ggauuguauugugaauauguaucuuauuuguu

SEQ ID NO: 188983 - RNA, 32 nt, Human
ggauugucagcugaggccccaggaggaaaccu

SEQ ID NO: 188984 - RNA, 32 nt, Human
ggauugucucaaggaguccgcagugagauucu

SEQ ID NO: 188985 - RNA, 32 nt, Human
ggauugugacauauugcugggcccagcaccac

SEQ ID NO: 188986 - RNA, 32 nt, Human
ggauugugagaaucaagucacucucaugggaa

SEQ ID NO: 188987 - RNA, 32 nt, Human
ggauugugaggaucaagucacucucaugggaa

SEQ ID NO: 188988 - RNA, 32 nt, Human
ggauugugaggguucccucacagccagcacga

SEQ ID NO: 188989 - RNA, 32 nt, Human
ggauugugaggugagggguuaauaaguuacuc

SEQ ID NO: 188990 - RNA, 32 nt, Human
ggauugugccacuacacuccagccuggccgac

SEQ ID NO: 188991 - RNA, 32 nt, Human
ggauugugccacugcacucaagccugggugac

SEQ ID NO: 188992 - RNA, 32 nt, Human
ggauugugccacuguacuccagccugggcgac

SEQ ID NO: 188993 - RNA, 32 nt, Human
ggauugugccauugcacuccagccugggcaac

SEQ ID NO: 188994 - RNA, 32 nt, Human
ggauugugcugacuuugggauuaacaugagcu

SEQ ID NO: 188995 - RNA, 32 nt, Human
ggauugugcugcucucguuucagcuuugauuu

SEQ ID NO: 188996 - RNA, 32 nt, Human
ggauuguguuucuauucagcaagggaaaccgg

SEQ ID NO: 188997 - RNA, 32 nt, Human
ggauuguuacugguugaagugggggcagaugc

SEQ ID NO: 188998 - RNA, 32 nt, Human
ggauuguuccauccauggcgugcaugugccaa

SEQ ID NO: 188999 - RNA, 32 nt, Human
ggauuguuccaucuuguguugguauaccaauu

SEQ ID NO: 189000 - RNA, 32 nt, Human
ggauuguucccacuucuugggcuguuaggaau

SEQ ID NO: 189001 - RNA, 32 nt, Human
ggauuguuccuagugaggaaggucuuguccca

SEQ ID NO: 189002 - RNA, 24 nt, Human
ggauuguugcggggccacccagug

SEQ ID NO: 189003 - RNA, 32 nt, Human
ggauuguuggcaggccagccugcagugacagu

SEQ ID NO: 189004 - RNA, 32 nt, Human
ggauuguuggugcuguggggagaagcuggugu

SEQ ID NO: 189005 - RNA, 32 nt, Human
ggauuguuugagcccaggagguugaggcugca

SEQ ID NO: 189006 - RNA, 32 nt, Human
ggauuguuugagcccuggagguugaggcugca

SEQ ID NO: 189007 - RNA, 32 nt, Human
ggauuguuugugugcuguuauuuggaauuuug

SEQ ID NO: 189008 - RNA, 32 nt, Human
ggauuuaaagcagucacuucagacaggagcca

SEQ ID NO: 189009 - RNA, 24 nt, Human
ggauuuaaaugcagaguguaugaa

SEQ ID NO: 189010 - RNA, 32 nt, Human
ggauuuaaccauuguucauugucaggcuauau

SEQ ID NO: 189011 - RNA, 32 nt, Human
ggauuuaagacguucuuguuacacuccaccaa

SEQ ID NO: 189012 - RNA, 25 nt, Human
ggauuuaagcgauucuccugcuuca

SEQ ID NO: 189013 - RNA, 25 nt, Human
ggauuuaagcgauucuucugccuca

SEQ ID NO: 189014 - RNA, 32 nt, Human
ggauuuaauagaauugagggucaagcaacuac

SEQ ID NO: 189015 - RNA, 32 nt, Human
ggauuuacauuuuaagguaaacuuuuuauuga

SEQ ID NO: 189016 - RNA, 32 nt, Human
ggauuuagaccagcccggcuguauccacggca

SEQ ID NO: 189017 - RNA, 32 nt, Human
ggauuuaggaagcagacagggauucgggaagu

SEQ ID NO: 189018 - RNA, 32 nt, Human
ggauuuaggaucgcccucccauccucucaccc

SEQ ID NO: 189019 - RNA, 23 nt, Human
ggauuuaggugauucuccugccu

SEQ ID NO: 189020 - RNA, 25 nt, Human
ggauuuauaaccuuucagucaucac

SEQ ID NO: 189021 - RNA, 32 nt, Human
ggauuuauacagggaccaaagacugaaugcuc

SEQ ID NO: 189022 - RNA, 32 nt, Human
ggauuuaucuucuguggcagauaaaugaagua

SEQ ID NO: 189023 - RNA, 32 nt, Human
ggauuuauugguaggacauuuaugugccagag

SEQ ID NO: 189024 - RNA, 32 nt, Human
ggauuuauuuugcuaaacaguuuacuaacaca

SEQ ID NO: 189025 - RNA, 32 nt, Human
ggauuucaacauaugaauuuuggaaggacaua

SEQ ID NO: 189026 - RNA, 32 nt, Human
ggauuucaagagcaaccaaguaaagucaugaa

SEQ ID NO: 189027 - RNA, 32 nt, Human
ggauuucaagaugacaagaacagagcauuaaa

SEQ ID NO: 189028 - RNA, 32 nt, Human
ggauuucacccaggaggaguggcagcaacugg

SEQ ID NO: 189029 - RNA, 32 nt, Human
ggauuucacccaggaggagugguggcaacugg

SEQ ID NO: 189030 - RNA, 32 nt, Human
ggauuucacuguguuggcugggauggucuuga

SEQ ID NO: 189031 - RNA, 32 nt, Human
ggauuucagggccuucccucccugccugggug

SEQ ID NO: 189032 - RNA, 31 nt, Human
ggauuucaguuucagcaaguuggcaucauuu

SEQ ID NO: 189033 - RNA, 32 nt, Human
ggauuucauauugugaaacagaacaaguccac

SEQ ID NO: 189034 - RNA, 32 nt, Human
ggauuucauccaguggccaagagcuuugugug

SEQ ID NO: 189035 - RNA, 32 nt, Human
ggauuucaugccacuaaucauguccauagccu

SEQ ID NO: 189036 - RNA, 32 nt, Human
ggauuucauguaaccaagaguauuccauuuuu

SEQ ID NO: 189037 - RNA, 18 nt, Human
ggauuucauuaccaggug

SEQ ID NO: 189038 - RNA, 32 nt, Human
ggauuuccagaaggugauaaaaagagcacucu

SEQ ID NO: 189039 - RNA, 32 nt, Human
ggauuuccagccagggcugcuagacggaggcc

SEQ ID NO: 189040 - RNA, 32 nt, Human
ggauuuccaguuccuugaugaagagaaguuac

SEQ ID NO: 189041 - RNA, 32 nt, Human
ggauuucccaggaugcgugagcacuugauuaa

SEQ ID NO: 189042 - RNA, 32 nt, Human
ggauuucccauaggaagagaucugccagacgc

SEQ ID NO: 189043 - RNA, 32 nt, Human
ggauuucccugacccaauucagagauucuuua

SEQ ID NO: 189044 - RNA, 32 nt, Human
ggauuuccuccaccuguaccuccagggacccc

SEQ ID NO: 189045 - RNA, 32 nt, Human
ggauuuccuccccucagcagccuuccccaucu

SEQ ID NO: 189046 - RNA, 32 nt, Human
ggauuuccugacuuugacacacauggccaccu

SEQ ID NO: 189047 - RNA, 20 nt, Human
ggauuuccugcuuugggaag

SEQ ID NO: 189048 - RNA, 32 nt, Human
ggauuuccuuuuccuccaaggcugucuuauuu

SEQ ID NO: 189049 - RNA, 32 nt, Human
ggauuucggggaugaaggcggcagcagcaaga

SEQ ID NO: 189050 - RNA, 32 nt, Human
ggauuucuacagccuggguacccauagccaca

SEQ ID NO: 189051 - RNA, 32 nt, Human
ggauuucuauuccagugggaaggaaaccucuc

SEQ ID NO: 189052 - RNA, 32 nt, Human
ggauuucucaacauuuguucagcuuccuaaug

SEQ ID NO: 189053 - RNA, 32 nt, Human
ggauuucucacuucaauuauagaucauaauag

SEQ ID NO: 189054 - RNA, 32 nt, Human
ggauuucucugcucacagaaggguguggcauu

SEQ ID NO: 189055 - RNA, 32 nt, Human
ggauuucucuucuguggcuuauuguggcacuc

SEQ ID NO: 189056 - RNA, 32 nt, Human
ggauuucucuuuuacuccugauuugcagaaug

SEQ ID NO: 189057 - RNA, 19 nt, Human
ggauuucugcauugcuaug

SEQ ID NO: 189058 - RNA, 32 nt, Human
ggauuucugccuggagcccuuugcccuguccc

SEQ ID NO: 189059 - RNA, 32 nt, Human
ggauuugaacaacaugguuauaauuuucaaau

SEQ ID NO: 189060 - RNA, 32 nt, Human
ggauuugaacccaggucuaccuguugcagagu

SEQ ID NO: 189061 - RNA, 32 nt, Human
ggauuugaagagucagugaacuuuuaguguca

SEQ ID NO: 189062 - RNA, 32 nt, Human
ggauuugaauagugguuuuucucuagcuuuuu

SEQ ID NO: 189063 - RNA, 32 nt, Human
ggauuugaaucucuuucucucccuucagaauc

SEQ ID NO: 189064 - RNA, 32 nt, Human
ggauuugaauucaggcuugcccaacucacauu

SEQ ID NO: 189065 - RNA, 24 nt, Human
ggauuugacacugguuuucucacu

SEQ ID NO: 189066 - RNA, 32 nt, Human
ggauuugacucugaaagaagcuuugccaauuu

SEQ ID NO: 189067 - RNA, 32 nt, Human
ggauuugagaagaaaaucagagagggaagauc

SEQ ID NO: 189068 - RNA, 32 nt, Human
ggauuugagcuuccguccuuccuuccucccuc

SEQ ID NO: 189069 - RNA, 32 nt, Human
ggauuugaggagcagcuucaguuguuuucccg

SEQ ID NO: 189070 - RNA, 32 nt, Human
ggauuugaggguagaggcaggggaagaucugu

SEQ ID NO: 189071 - RNA, 32 nt, Human
ggauuugauaaauaaaaguucuuuaaacacua

SEQ ID NO: 189072 - RNA, 32 nt, Human
ggauuugaucauaccaaaucccaguccuccug

SEQ ID NO: 189073 - RNA, 32 nt, Human
ggauuugcacacaaaugcagcagagucuggcu

SEQ ID NO: 189074 - RNA, 32 nt, Human
ggauuugcacagagaagggcggcggaagggug

SEQ ID NO: 189075 - RNA, 32 nt, Human
ggauuugcacccacugcauuugcagccuugag

SEQ ID NO: 189076 - RNA, 32 nt, Human
ggauuugccaauguauguucagucucucaaga

SEQ ID NO: 189077 - RNA, 32 nt, Human
ggauuugccacacagccccacccuugggcuga

SEQ ID NO: 189078 - RNA, 32 nt, Human
ggauuugccagcaucccucuucugcuucucag

SEQ ID NO: 189079 - RNA, 32 nt, Human
ggauuugcccuucacaauucuacuccccagau

SEQ ID NO: 189080 - RNA, 32 nt, Human
ggauuugcuaugcagacagggaagggaauuuc

SEQ ID NO: 189081 - RNA, 32 nt, Human
ggauuugcucgcacggcauuggcuccaucccc

SEQ ID NO: 189082 - RNA, 32 nt, Human
ggauuugcuuagaaggauggcgcucccaguga

SEQ ID NO: 189083 - RNA, 32 nt, Human
ggauuugcuucuuagaagcucaugugguuguu

SEQ ID NO: 189084 - RNA, 32 nt, Human
ggauuugcuuucccaaggagcuuuccaaaagc

SEQ ID NO: 189085 - RNA, 32 nt, Human
ggauuuggaaggaggcggcugggcagggcggc

SEQ ID NO: 189086 - RNA, 32 nt, Human
ggauuuggacgagagacacaggaugaguaccg

SEQ ID NO: 189087 - RNA, 32 nt, Human
ggauuuggacuggcagugagaauaagagacaa

SEQ ID NO: 189088 - RNA, 32 nt, Human
ggauuuggccuuucaaacucuaggcacuaacg

SEQ ID NO: 189089 - RNA, 32 nt, Human
ggauuugggcuccuaugauaaucuaaugccac

SEQ ID NO: 189090 - RNA, 32 nt, Human
ggauuuggguugugacccagggugcauuaacu

SEQ ID NO: 189091 - RNA, 32 nt, Human
ggauuugguaagaggugagcaagacaaaucuu

SEQ ID NO: 189092 - RNA, 31 nt, Human
ggauuugucaggugcaucacagaggucaaag

SEQ ID NO: 189093 - RNA, 32 nt, Human
ggauuuguccuggagaaaaucaagcagccgaa

SEQ ID NO: 189094 - RNA, 32 nt, Human
ggauuugucugagacauuuccaagcagacugu

SEQ ID NO: 189095 - RNA, 32 nt, Human
ggauuugugcuccuaugagaaucuaacaugcu

SEQ ID NO: 189096 - RNA, 32 nt, Human
ggauuugugcugcugcuguuauucaaagauca

SEQ ID NO: 189097 - RNA, 32 nt, Human
ggauuuguugggggcaaaggggguggcgggac

SEQ ID NO: 189098 - RNA, 32 nt, Human
ggauuuguuuccuaacgccauuggaggccuuc

SEQ ID NO: 189099 - RNA, 32 nt, Human
ggauuuuagaggaacaaaggaagaauauucua

SEQ ID NO: 189100 - RNA, 32 nt, Human
ggauuuuaggugugcaccaccaugccuggcua

SEQ ID NO: 189101 - RNA, 32 nt, Human
ggauuuuauuuuuagggaguggguaauuucuu

SEQ ID NO: 189102 - RNA, 32 nt, Human
ggauuuucaagcgauuugucuguuauaggaaa

SEQ ID NO: 189103 - RNA, 32 nt, Human
ggauuuucacacaccauauuucuuucaccuuu

SEQ ID NO: 189104 - RNA, 32 nt, Human
ggauuuucagcaggaacuuuauuccaaugcua

SEQ ID NO: 189105 - RNA, 32 nt, Human
ggauuuucagcccucagaaucgcuccaccuug

SEQ ID NO: 189106 - RNA, 24 nt, Human
ggauuuucaucaggggccugcagg

SEQ ID NO: 189107 - RNA, 32 nt, Human
ggauuuucauuucuucgcacuucugagacggc

SEQ ID NO: 189108 - RNA, 32 nt, Human
ggauuuucccacccugcucuucuuggcaggag

SEQ ID NO: 189109 - RNA, 32 nt, Human
ggauuuuccuccucucuccaucccugacaguu

SEQ ID NO: 189110 - RNA, 32 nt, Human
ggauuuuccuggaagaucuggauuugguggaa

SEQ ID NO: 189111 - RNA, 31 nt, Human
ggauuuucuagaauuaguuguaggcgacagu

SEQ ID NO: 189112 - RNA, 32 nt, Human
ggauuuucucagcccccauccccagcacugug

SEQ ID NO: 189113 - RNA, 32 nt, Human
ggauuuucucauuagcacaggguuccaagccc

SEQ ID NO: 189114 - RNA, 32 nt, Human
ggauuuucucuacaaaaauuauugagcaaccc

SEQ ID NO: 189115 - RNA, 32 nt, Human
ggauuuucugaccuuccccugaaguagaucau

SEQ ID NO: 189116 - RNA, 32 nt, Human
ggauuuucuucccagggaccuccuaucacccu

SEQ ID NO: 189117 - RNA, 32 nt, Human
ggauuuugagcagggcagggaugggacagaag

SEQ ID NO: 189118 - RNA, 32 nt, Human
ggauuuugccagcuccauacauguuggggccu

SEQ ID NO: 189119 - RNA, 19 nt, Human
ggauuuugcccucuccuua

SEQ ID NO: 189120 - RNA, 32 nt, Human
ggauuuuggcgaccugugugguggccuugagc

SEQ ID NO: 189121 - RNA, 32 nt, Human
ggauuuuguagguccuguuuuucccaucugug

SEQ ID NO: 189122 - RNA, 32 nt, Human
ggauuuuguuacuguguagaguggauugagaa

SEQ ID NO: 189123 - RNA, 32 nt, Human
ggauuuuuaaagauucuucccaccuuaauuuu

SEQ ID NO: 189124 - RNA, 32 nt, Human
ggauuuuuccaugguuuccucagugauggugu

SEQ ID NO: 189125 - RNA, 23 nt, Human
ggcaaaaacaaaacaaccaacac

SEQ ID NO: 189126 - RNA, 24 nt, Human
ggcaaaaacaaagccucacacacc

SEQ ID NO: 189127 - RNA, 32 nt, Human
ggcaaaaauguuguauuggcuaugauggugac

SEQ ID NO: 189128 - RNA, 32 nt, Human
ggcaaaacaagaaaguccuauuuuuccaagcu

SEQ ID NO: 189129 - RNA, 21 nt, Human
ggcaaaaccccaucucuacua

SEQ ID NO: 189130 - RNA, 21 nt, Human
ggcaaaaccccaucucugcua

SEQ ID NO: 189131 - RNA, 21 nt, Human
ggcaaaaccccaucuuuacua

SEQ ID NO: 189132 - RNA, 21 nt, Human
ggcaaaaccccgucucuacua

SEQ ID NO: 189133 - RNA, 32 nt, Human
ggcaaaaccuccaaacuggggucuccagccac

SEQ ID NO: 189134 - RNA, 32 nt, Human
ggcaaaacucaacagccccuggagcugcgcuu

SEQ ID NO: 189135 - RNA, 32 nt, Human
ggcaaaacuggaaugaaacaaggaaccaccug

SEQ ID NO: 189136 - RNA, 32 nt, Human
ggcaaaacuggcugaggccucuguugaugcuc

SEQ ID NO: 189137 - RNA, 32 nt, Human
ggcaaaagaagagauaagaggcccauugccag

SEQ ID NO: 189138 - RNA, 32 nt, Human
ggcaaaagaagaggaaggaauuuaauccuaau

SEQ ID NO: 189139 - RNA, 32 nt, Human
ggcaaaagagaauccccugccuucccuugucg

SEQ ID NO: 189140 - RNA, 25 nt, Human
ggcaaaagaguccccacaagaugaa

SEQ ID NO: 189141 - RNA, 20 nt, Human
ggcaaaagcacuugcucucc

SEQ ID NO: 189142 - RNA, 24 nt, Human
ggcaaaaggaaacacucgauugca

SEQ ID NO: 189143 - RNA, 32 nt, Human
ggcaaaagggaagggaaggaaacuuagcagag

SEQ ID NO: 189144 - RNA, 23 nt, Human
ggcaaaaguccacauagcucucc

SEQ ID NO: 189145 - RNA, 32 nt, Human
ggcaaaaugcagguguuuucucaguaucacag

SEQ ID NO: 189146 - RNA, 32 nt, Human
ggcaaaauucuuucuggugucuccuaacuuca

SEQ ID NO: 189147 - RNA, 20 nt, Human
ggcaaacaaaggaacacuag

SEQ ID NO: 189148 - RNA, 32 nt, Human
ggcaaacaauguacaaaagggaagugcuggac

SEQ ID NO: 189149 - RNA, 32 nt, Human
ggcaaacacggugaaacccugucucuacuaaa

SEQ ID NO: 189150 - RNA, 24 nt, Human
ggcaaacacuggccauggccgugg

SEQ ID NO: 189151 - RNA, 22 nt, Human
ggcaaacagcaaugaucuucca

SEQ ID NO: 189152 - RNA, 32 nt, Human
ggcaaacagugcagugaauauguaggagccug

SEQ ID NO: 189153 - RNA, 32 nt, Human
ggcaaacaugaugaaacccugucucuacuaaa

SEQ ID NO: 189154 - RNA, 32 nt, Human
ggcaaacauggcgaaaccccaucuuaacuaaa

SEQ ID NO: 189155 - RNA, 32 nt, Human
ggcaaacauggugaaaccccaucucuaguaaa

SEQ ID NO: 189156 - RNA, 32 nt, Human
ggcaaacauggugaaaccccgucuguacuaau

SEQ ID NO: 189157 - RNA, 32 nt, Human
ggcaaacauggugaaacgccgucucuacugaa

SEQ ID NO: 189158 - RNA, 32 nt, Human
ggcaaacauggugaaacgcugucucuacuaaa

SEQ ID NO: 189159 - RNA, 32 nt, Human
ggcaaacauggugaaucuaucucuccggagau

SEQ ID NO: 189160 - RNA, 32 nt, Human
ggcaaaccaacucuauccugugccgcaguuuu

SEQ ID NO: 189161 - RNA, 32 nt, Human
ggcaaaccauggugggccccagcuguggugcg

SEQ ID NO: 189162 - RNA, 32 nt, Human
ggcaaacccaaguaacaaaucagcacgguucc

SEQ ID NO: 189163 - RNA, 32 nt, Human
ggcaaacccugccucugcccaguccagcgccc

SEQ ID NO: 189164 - RNA, 32 nt, Human
ggcaaacccuggcaaauccugccacuuguuuc

SEQ ID NO: 189165 - RNA, 32 nt, Human
ggcaaaccuuucuauaauuuuacaagggagua

SEQ ID NO: 189166 - RNA, 32 nt, Human
ggcaaacgcagaacguuucagagccaugagga

SEQ ID NO: 189167 - RNA, 32 nt, Human
ggcaaacuauguuacaugaaugcuucugccuc

SEQ ID NO: 189168 - RNA, 32 nt, Human
ggcaaacuauugauauuucauuaauuuuaaau

SEQ ID NO: 189169 - RNA, 32 nt, Human
ggcaaacuccaccccuucucacucuguccugg

SEQ ID NO: 189170 - RNA, 32 nt, Human
ggcaaacugggcugauguaaauguuuuacuuu

SEQ ID NO: 189171 - RNA, 32 nt, Human
ggcaaacuucauuuuauucuugguuuucauuu

SEQ ID NO: 189172 - RNA, 32 nt, Human
ggcaaagaaaaauuccacuguuccacguguac

SEQ ID NO: 189173 - RNA, 32 nt, Human
ggcaaagaaagaaaacacgaauguaggucagg

SEQ ID NO: 189174 - RNA, 32 nt, Human
ggcaaagaaaugcagaaugcuuaaggcugaau

SEQ ID NO: 189175 - RNA, 32 nt, Human
ggcaaagaacuaagccaggaagacaugggcca

SEQ ID NO: 189176 - RNA, 21 nt, Human
ggcaaagaaggaaggcagcuu

SEQ ID NO: 189177 - RNA, 18 nt, Human
ggcaaagacucugagguu

SEQ ID NO: 189178 - RNA, 32 nt, Human
ggcaaagagaaaaggacccaagauagagguuu

SEQ ID NO: 189179 - RNA, 32 nt, Human
ggcaaagagccaaguggccugcgcuacaacaa

SEQ ID NO: 189180 - RNA, 32 nt, Human
ggcaaagaggagggcaggucugagggaccccg

SEQ ID NO: 189181 - RNA, 32 nt, Human
ggcaaagaguguggggcgucucuguguuccag

SEQ ID NO: 189182 - RNA, 32 nt, Human
ggcaaagauagagaaugcccucagcucuuagc

SEQ ID NO: 189183 - RNA, 31 nt, Human
ggcaaagaugagagagguggagagagaaaga

SEQ ID NO: 189184 - RNA, 32 nt, Human
ggcaaagauuagcugcuuccagaaggcugauu

SEQ ID NO: 189185 - RNA, 32 nt, Human
ggcaaagcacagccugggaagaauugguuugc

SEQ ID NO: 189186 - RNA, 32 nt, Human
ggcaaagcagcucacacacugcagccacacuc

SEQ ID NO: 189187 - RNA, 32 nt, Human
ggcaaagcaucuuucgagagcuugccugccaa

SEQ ID NO: 189188 - RNA, 32 nt, Human
ggcaaagcuauauuucuguuucuccacaucca

SEQ ID NO: 189189 - RNA, 32 nt, Human
ggcaaagcucacugucucucuacuggcugcaa

SEQ ID NO: 189190 - RNA, 22 nt, Human
ggcaaagcugaacaaagaugaa

SEQ ID NO: 189191 - RNA, 32 nt, Human
ggcaaagcuguauugaaaguucugagcuucuc

SEQ ID NO: 189192 - RNA, 32 nt, Human
ggcaaaggacagcacuguucucugccugccug

SEQ ID NO: 189193 - RNA, 32 nt, Human
ggcaaaggagaaacgggacuuacuucacagga

SEQ ID NO: 189194 - RNA, 32 nt, Human
ggcaaaggagccaagugugacugagcagugug

SEQ ID NO: 189195 - RNA, 32 nt, Human
ggcaaaggagugugaguuuuggggaagcucaa

SEQ ID NO: 189196 - RNA, 32 nt, Human
ggcaaaggccuucaguuucccggcuggcuguc

SEQ ID NO: 189197 - RNA, 32 nt, Human
ggcaaaggcgaggcgggggagcagcgugugag

SEQ ID NO: 189198 - RNA, 32 nt, Human
ggcaaagggcaagugggcugacguccggccca

SEQ ID NO: 189199 - RNA, 32 nt, Human
ggcaaagggcugcuuuagcacuuuucuuuuag

SEQ ID NO: 189200 - RNA, 32 nt, Human
ggcaaagggggaaagagacugagguuguaaac

SEQ ID NO: 189201 - RNA, 17 nt, Human
ggcaaaggucagauucu

SEQ ID NO: 189202 - RNA, 31 nt, Human
ggcaaaguaaaauaaauaguucagaugacua

SEQ ID NO: 189203 - RNA, 32 nt, Human
ggcaaaguacuugucauagacuccuuugcuaa

SEQ ID NO: 189204 - RNA, 32 nt, Human
ggcaaagucaccugcaugguagcacauaguga

SEQ ID NO: 189205 - RNA, 32 nt, Human
ggcaaagugacucuugagcaugggugggggaa

SEQ ID NO: 189206 - RNA, 32 nt, Human
ggcaaagugcacaucuuacucaacaucaaaga

SEQ ID NO: 189207 - RNA, 32 nt, Human
ggcaaaguggcacagucugccuuucccagucu

SEQ ID NO: 189208 - RNA, 32 nt, Human
ggcaaaguuuuuaacuaauacaccuuauugca

SEQ ID NO: 189209 - RNA, 32 nt, Human
ggcaaauaaaguaucaguauacauggugaugu

SEQ ID NO: 189210 - RNA, 20 nt, Human
ggcaaauaacuaauguauga

SEQ ID NO: 189211 - RNA, 18 nt, Human
ggcaaaucaccugagguc

SEQ ID NO: 189212 - RNA, 18 nt, Human
ggcaaaucacuugagcuc

SEQ ID NO: 189213 - RNA, 18 nt, Human
ggcaaaucacuugagguc

SEQ ID NO: 189214 - RNA, 32 nt, Human
ggcaaauccaggcugguguucugucugggcuc

SEQ ID NO: 189215 - RNA, 32 nt, Human
ggcaaauccauagacacagaaugcagauccgu

SEQ ID NO: 189216 - RNA, 32 nt, Human
ggcaaaucgcaauggcagcaugugaguggacc

SEQ ID NO: 189217 - RNA, 32 nt, Human
ggcaaaucgcuuaaucuuugagucuaguuuuc

SEQ ID NO: 189218 - RNA, 32 nt, Human
ggcaaaucugcagccgcucgcuuucuccucug

SEQ ID NO: 189219 - RNA, 32 nt, Human
ggcaaaucuuuaucagccacugccuucugcug

SEQ ID NO: 189220 - RNA, 32 nt, Human
ggcaaaugagggcuggacucucuucccuccag

SEQ ID NO: 189221 - RNA, 18 nt, Human
ggcaaaugagugcucuuc

SEQ ID NO: 189222 - RNA, 32 nt, Human
ggcaaaugagugugugugagguauaggaaaug

SEQ ID NO: 189223 - RNA, 32 nt, Human
ggcaaaugcagcccugggucuuugggccaguu

SEQ ID NO: 189224 - RNA, 18 nt, Human
ggcaaaugcaggacuccc

SEQ ID NO: 189225 - RNA, 18 nt, Human
ggcaaaugcccaaccucc

SEQ ID NO: 189226 - RNA, 32 nt, Human
ggcaaaugccuauaaucccagcuacucgggag

SEQ ID NO: 189227 - RNA, 19 nt, Human
ggcaaaugccugaaugguc

SEQ ID NO: 189228 - RNA, 32 nt, Human
ggcaaaugccugaauggucugucugaaggaag

SEQ ID NO: 189229 - RNA, 32 nt, Human
ggcaaaugccuguaauaccagcuacucaggag

SEQ ID NO: 189230 - RNA, 32 nt, Human
ggcaaaugccuguaaucccagcacuuugggag

SEQ ID NO: 189231 - RNA, 21 nt, Human
ggcaaaugcugaauauucucc

SEQ ID NO: 189232 - RNA, 20 nt, Human
ggcaaaugcugcaaacuucc

SEQ ID NO: 189233 - RNA, 32 nt, Human
ggcaaauggaaaucuuuccccaaagggcacac

SEQ ID NO: 189234 - RNA, 32 nt, Human
ggcaaauggaagggaauggguucuggaaggcc

SEQ ID NO: 189235 - RNA, 32 nt, Human
ggcaaauggaucugucaacaggcuccauugcc

SEQ ID NO: 189236 - RNA, 21 nt, Human
ggcaaauggcccagcucugcc

SEQ ID NO: 189237 - RNA, 32 nt, Human
ggcaaauggcuggcguggaagcacaacccgcu

SEQ ID NO: 189238 - RNA, 18 nt, Human
ggcaaaugggauuguccc

SEQ ID NO: 189239 - RNA, 32 nt, Human
ggcaaauggggaguagagagaaaacaggcgag

SEQ ID NO: 189240 - RNA, 32 nt, Human
ggcaaauggguugggugcaauggcucacgccu

SEQ ID NO: 189241 - RNA, 18 nt, Human
ggcaaaugucuugccucc

SEQ ID NO: 189242 - RNA, 20 nt, Human
ggcaaaugugacccgccucc

SEQ ID NO: 189243 - RNA, 20 nt, Human
ggcaaaugugaugugcuccc

SEQ ID NO: 189244 - RNA, 32 nt, Human
ggcaaauguuucucagucauaguuggacuguu

SEQ ID NO: 189245 - RNA, 32 nt, Human
ggcaaauucaaguguuuuccugggugaagacu

SEQ ID NO: 189246 - RNA, 32 nt, Human
ggcaaauucuccuuggugaguuuucuaaaagu

SEQ ID NO: 189247 - RNA, 32 nt, Human
ggcaacaaaggccaucucaccaaaggauuauu

SEQ ID NO: 189248 - RNA, 32 nt, Human
ggcaacaaagugagacccccaucucuacaaaa

SEQ ID NO: 189249 - RNA, 30 nt, Human
ggcaacaaagugagacccccaucucuauag

SEQ ID NO: 189250 - RNA, 32 nt, Human
ggcaacaaauagacuauugucauuuuauuagu

SEQ ID NO: 189251 - RNA, 24 nt, Human
ggcaacaagagcuagacucugucu

SEQ ID NO: 189252 - RNA, 32 nt, Human
ggcaacaagaggagcugguagagaugcuaaca

SEQ ID NO: 189253 - RNA, 24 nt, Human
ggcaacaagagugaaacucugucu

SEQ ID NO: 189254 - RNA, 19 nt, Human
ggcaacaaggguccugcug

SEQ ID NO: 189255 - RNA, 32 nt, Human
ggcaacaaugggcuagaagccaugaagcaaua

SEQ ID NO: 189256 - RNA, 32 nt, Human
ggcaacacaagaaucuguccuccauuaaaaau

SEQ ID NO: 189257 - RNA, 32 nt, Human
ggcaacacagggcgacccccaucucuacaaaa

SEQ ID NO: 189258 - RNA, 21 nt, Human
ggcaacacagugaaacccugu

SEQ ID NO: 189259 - RNA, 32 nt, Human
ggcaacacagugagugagacccugucucuauu

SEQ ID NO: 189260 - RNA, 17 nt, Human
ggcaacaccaagagggu

SEQ ID NO: 189261 - RNA, 32 nt, Human
ggcaacacccuucucgcagccugggccucucg

SEQ ID NO: 189262 - RNA, 32 nt, Human
ggcaacacggagcacaggucucugcugcugau

SEQ ID NO: 189263 - RNA, 32 nt, Human
ggcaacacugaggauacgcagggaugaggugc

SEQ ID NO: 189264 - RNA, 32 nt, Human
ggcaacacugcgcuccagccuggcagacagag

SEQ ID NO: 189265 - RNA, 32 nt, Human
ggcaacacugggguugcagagcucaggagcca

SEQ ID NO: 189266 - RNA, 32 nt, Human
ggcaacagacacagccauugccuccaccucca

SEQ ID NO: 189267 - RNA, 21 nt, Human
ggcaacagagaagagagcaga

SEQ ID NO: 189268 - RNA, 32 nt, Human
ggcaacagagagaggaucuggagccaggauua

SEQ ID NO: 189269 - RNA, 23 nt, Human
ggcaacagagcaagacucugucu

SEQ ID NO: 189270 - RNA, 23 nt, Human
ggcaacagagcgagacucugucu

SEQ ID NO: 189271 - RNA, 32 nt, Human
ggcaacagaggccacggccauggccaugggca

SEQ ID NO: 189272 - RNA, 23 nt, Human
ggcaacagagggagacucugucu

SEQ ID NO: 189273 - RNA, 23 nt, Human
ggcaacagagugagacccugucu

SEQ ID NO: 189274 - RNA, 23 nt, Human
ggcaacagagugagacuccaucu

SEQ ID NO: 189275 - RNA, 23 nt, Human
ggcaacagagugagacuccgucu

SEQ ID NO: 189276 - RNA, 32 nt, Human
ggcaacagagugagacucugucaaaaucaaaa

SEQ ID NO: 189277 - RNA, 23 nt, Human
ggcaacagagugagacucugucu

SEQ ID NO: 189278 - RNA, 23 nt, Human
ggcaacagagugagacuuugucu

SEQ ID NO: 189279 - RNA, 21 nt, Human
ggcaacagagugccugaccca

SEQ ID NO: 189280 - RNA, 32 nt, Human
ggcaacagaucuggaaccucagccuggccaga

SEQ ID NO: 189281 - RNA, 32 nt, Human
ggcaacagaugaucuggucaggcaacccaccc

SEQ ID NO: 189282 - RNA, 32 nt, Human
ggcaacagcucugugcaggcaggaugaagcac

SEQ ID NO: 189283 - RNA, 32 nt, Human
ggcaacagcuuugccacuugacuuuccaacau

SEQ ID NO: 189284 - RNA, 32 nt, Human
ggcaacaggagaaaggaaucaaaccacagaaa

SEQ ID NO: 189285 - RNA, 24 nt, Human
ggcaacagguaucucgugcaugaa

SEQ ID NO: 189286 - RNA, 32 nt, Human
ggcaacagucacagcccagggauugauuggaa

SEQ ID NO: 189287 - RNA, 32 nt, Human
ggcaacagugggacaauugcccccgacggcgg

SEQ ID NO: 189288 - RNA, 32 nt, Human
ggcaacagugguuacccaggaggaaacaggua

SEQ ID NO: 189289 - RNA, 32 nt, Human
ggcaacauaacaagacccccaucucuacaaaa

SEQ ID NO: 189290 - RNA, 32 nt, Human
ggcaacauagcaagacccccaucucugcaaaa

SEQ ID NO: 189291 - RNA, 32 nt, Human
ggcaacauagggagacccccaucucuacaaaa

SEQ ID NO: 189292 - RNA, 32 nt, Human
ggcaacauagggagacccccaucuuuacgaag

SEQ ID NO: 189293 - RNA, 32 nt, Human
ggcaacauaguaagacccccaucucuacaaaa

SEQ ID NO: 189294 - RNA, 32 nt, Human
ggcaacauagugagacccccaucucuacaaaa

SEQ ID NO: 189295 - RNA, 32 nt, Human
ggcaacauagugagacccccaucucuacaauu

SEQ ID NO: 189296 - RNA, 32 nt, Human
ggcaacauagugagacccccaucucuacagaa

SEQ ID NO: 189297 - RNA, 32 nt, Human
ggcaacauagugagaccuccaucucuacaaaa

SEQ ID NO: 189298 - RNA, 32 nt, Human
ggcaacaucacuggggcccagagagagcuguc

SEQ ID NO: 189299 - RNA, 32 nt, Human
ggcaacaucacuucugggauuugguuuacugg

SEQ ID NO: 189300 - RNA, 32 nt, Human
ggcaacaucccgccugaugaccagcuuagcaa

SEQ ID NO: 189301 - RNA, 32 nt, Human
ggcaacaucccugguacuccagcuuugagguc

SEQ ID NO: 189302 - RNA, 32 nt, Human
ggcaacaugaugugaaaacccaucucuacaaa

SEQ ID NO: 189303 - RNA, 21 nt, Human
ggcaacauggagaaaccccgu

SEQ ID NO: 189304 - RNA, 21 nt, Human
ggcaacauggcgaaacccugu

SEQ ID NO: 189305 - RNA, 21 nt, Human
ggcaacauggugaaacccagu

SEQ ID NO: 189306 - RNA, 19 nt, Human
ggcaacauggugaaacccc

SEQ ID NO: 189307 - RNA, 21 nt, Human
ggcaacauggugaaacccugu

SEQ ID NO: 189308 - RNA, 18 nt, Human
ggcaacauggugaaaccu

SEQ ID NO: 189309 - RNA, 19 nt, Human
ggcaacauggugaaaccuc

SEQ ID NO: 189310 - RNA, 32 nt, Human
ggcaacauuacacucuagccugagcaacaaga

SEQ ID NO: 189311 - RNA, 32 nt, Human
ggcaaccaccaccaccugucuuccaggacaca

SEQ ID NO: 189312 - RNA, 32 nt, Human
ggcaaccacugcagauuccuccccuggccagc

SEQ ID NO: 189313 - RNA, 32 nt, Human
ggcaaccagaacuagggagcugguggagaagg

SEQ ID NO: 189314 - RNA, 32 nt, Human
ggcaaccagcugacacaggagccagagugaga

SEQ ID NO: 189315 - RNA, 16 nt, Human
ggcaaccagcuuugcu

SEQ ID NO: 189316 - RNA, 32 nt, Human
ggcaaccaggggugccccaggcuagcucuucu

SEQ ID NO: 189317 - RNA, 32 nt, Human
ggcaaccauggcauggccaggagcccucaugc

SEQ ID NO: 189318 - RNA, 18 nt, Human
ggcaaccauuauucuguu

SEQ ID NO: 189319 - RNA, 32 nt, Human
ggcaaccauuuuuagaaggaaaaaggauuagg

SEQ ID NO: 189320 - RNA, 32 nt, Human
ggcaacccacacaggcaggcuggagaggagug

SEQ ID NO: 189321 - RNA, 32 nt, Human
ggcaacccagaacugauagugcaucagccgac

SEQ ID NO: 189322 - RNA, 32 nt, Human
ggcaacccagaacugauagugcaucagcugac

SEQ ID NO: 189323 - RNA, 32 nt, Human
ggcaacccagcaccggggaagccgucagcugc

SEQ ID NO: 189324 - RNA, 32 nt, Human
ggcaacccaggcccggaguccuuggggagcgg

SEQ ID NO: 189325 - RNA, 32 nt, Human
ggcaacccauggaggcagaaagaaggacgcca

SEQ ID NO: 189326 - RNA, 23 nt, Human
ggcaaccccugugccccuccccu

SEQ ID NO: 189327 - RNA, 32 nt, Human
ggcaacccuccuggacuaggcugcucuuguua

SEQ ID NO: 189328 - RNA, 18 nt, Human
ggcaaccguccaugccca

SEQ ID NO: 189329 - RNA, 32 nt, Human
ggcaaccguugcuguucacacgcucagccugu

SEQ ID NO: 189330 - RNA, 21 nt, Human
ggcaaccucccaucccacccc

SEQ ID NO: 189331 - RNA, 32 nt, Human
ggcaaccucuacugcccaucuccccugcucaa

SEQ ID NO: 189332 - RNA, 32 nt, Human
ggcaaccucugccuucuucccucuuccacucg

SEQ ID NO: 189333 - RNA, 32 nt, Human
ggcaaccugcaaggagcuggccagccagccug

SEQ ID NO: 189334 - RNA, 20 nt, Human
ggcaaccugcuuccauggcc

SEQ ID NO: 189335 - RNA, 32 nt, Human
ggcaacggauugcuuuucuguuucauguuagu

SEQ ID NO: 189336 - RNA, 32 nt, Human
ggcaacggcagugccacucaccccagaauggg

SEQ ID NO: 189337 - RNA, 32 nt, Human
ggcaacggcuuaguggcaucucccaggugcca

SEQ ID NO: 189338 - RNA, 32 nt, Human
ggcaacgggcggcagguugcaguggaggggcc

SEQ ID NO: 189339 - RNA, 32 nt, Human
ggcaacgguggaggaggagagacgggagggga

SEQ ID NO: 189340 - RNA, 32 nt, Human
ggcaacgucacaccuccugaggacagccagga

SEQ ID NO: 189341 - RNA, 32 nt, Human
ggcaacuaagcagucccugagaccauuuaaca

SEQ ID NO: 189342 - RNA, 32 nt, Human
ggcaacuaucuacuuucugucucuguggauuu

SEQ ID NO: 189343 - RNA, 32 nt, Human
ggcaacuauuggugcgcuccagccgggcaggu

SEQ ID NO: 189344 - RNA, 32 nt, Human
ggcaacuccagcccaacauucccucgcucugg

SEQ ID NO: 189345 - RNA, 32 nt, Human
ggcaacuccagccgaggccugggcuucugccu

SEQ ID NO: 189346 - RNA, 21 nt, Human
ggcaacuccccaaguacaaug

SEQ ID NO: 189347 - RNA, 32 nt, Human
ggcaacuccucugugaauuugccuuccaggcc

SEQ ID NO: 189348 - RNA, 32 nt, Human
ggcaacucuacauuggaacacugaggcuuaca

SEQ ID NO: 189349 - RNA, 32 nt, Human
ggcaacugaaucuagcaaggacucuuucgugu

SEQ ID NO: 189350 - RNA, 32 nt, Human
ggcaacugagaacggagagggaugcaggccag

SEQ ID NO: 189351 - RNA, 32 nt, Human
ggcaacugcauguaccuccucccuuucucauu

SEQ ID NO: 189352 - RNA, 32 nt, Human
ggcaacugcccaggaaggacugugcuuccguc

SEQ ID NO: 189353 - RNA, 32 nt, Human
ggcaacugcggcagcaggcuugugugugugag

SEQ ID NO: 189354 - RNA, 32 nt, Human
ggcaacugcucacacaguuguuucucugugaa

SEQ ID NO: 189355 - RNA, 32 nt, Human
ggcaacugcugaugcucaugguccccauggca

SEQ ID NO: 189356 - RNA, 32 nt, Human
ggcaacugcuuaccagccuggcuggccgugcu

SEQ ID NO: 189357 - RNA, 32 nt, Human
ggcaacuggaaagagggaguuggccugauuuu

SEQ ID NO: 189358 - RNA, 24 nt, Human
ggcaacuguguacagcuuaccccu

SEQ ID NO: 189359 - RNA, 32 nt, Human
ggcaacuuccaaugcuucucuaggcccugcac

SEQ ID NO: 189360 - RNA, 32 nt, Human
ggcaagaaacaacuccccacacacaacccacc

SEQ ID NO: 189361 - RNA, 32 nt, Human
ggcaagaaacaugaggaugaaaagccaauaug

SEQ ID NO: 189362 - RNA, 32 nt, Human
ggcaagaaaccagggcuucaaacugcuaguuc

SEQ ID NO: 189363 - RNA, 32 nt, Human
ggcaagaaagaauagugugaaagggaacuguu

SEQ ID NO: 189364 - RNA, 19 nt, Human
ggcaagaacagggcagcuu

SEQ ID NO: 189365 - RNA, 32 nt, Human
ggcaagaaccaccacaccuggccuugggagcu

SEQ ID NO: 189366 - RNA, 24 nt, Human
ggcaagaaccagaggcccaggcug

SEQ ID NO: 189367 - RNA, 32 nt, Human
ggcaagaacuggaaaaugcaagcgcccugaac

SEQ ID NO: 189368 - RNA, 32 nt, Human
ggcaagaagaaagagaugacagagucaauaua

SEQ ID NO: 189369 - RNA, 32 nt, Human
ggcaagaagaagagaagagagaaggagacaag

SEQ ID NO: 189370 - RNA, 32 nt, Human
ggcaagaagaagagaagagagaaggagagaag

SEQ ID NO: 189371 - RNA, 32 nt, Human
ggcaagaagaggagaugaaggccaaggaggag

SEQ ID NO: 189372 - RNA, 32 nt, Human
ggcaagaagaggaggaaggaauagcacagguc

SEQ ID NO: 189373 - RNA, 32 nt, Human
ggcaagaagaugacauguaugagaaccaaaaa

SEQ ID NO: 189374 - RNA, 32 nt, Human
ggcaagaaggagaaaguugaaggacucagcua

SEQ ID NO: 189375 - RNA, 32 nt, Human
ggcaagacacuggcuuugaaauuaggcucaug

SEQ ID NO: 189376 - RNA, 32 nt, Human
ggcaagaccaaaguguggcggggaguggggug

SEQ ID NO: 189377 - RNA, 32 nt, Human
ggcaagaccucuucccucugggccuguucucu

SEQ ID NO: 189378 - RNA, 17 nt, Human
ggcaagacgccacaccu

SEQ ID NO: 189379 - RNA, 32 nt, Human
ggcaagagaaaaauacuuuucuucucaauuuu

SEQ ID NO: 189380 - RNA, 32 nt, Human
ggcaagagaagcuggaaccacauucagagagu

SEQ ID NO: 189381 - RNA, 32 nt, Human
ggcaagagaugggggucucacuguguugcucu

SEQ ID NO: 189382 - RNA, 32 nt, Human
ggcaagagcacucuggguuccacagcacagca

SEQ ID NO: 189383 - RNA, 32 nt, Human
ggcaagagcccaggagacugugugguuugucc

SEQ ID NO: 189384 - RNA, 32 nt, Human
ggcaagagccuguaaucucagcuacucaggag

SEQ ID NO: 189385 - RNA, 32 nt, Human
ggcaagaggagggagaaggcagggccgugacu

SEQ ID NO: 189386 - RNA, 32 nt, Human
ggcauguacgagggaagagggaggcaggccuc

SEQ ID NO: 189387 - RNA, 32 nt, Human
ggcauguauuagacacaagcauauuugcugcc

SEQ ID NO: 189388 - RNA, 32 nt, Human
ggcauguccauaaggucugacaacagcuugcc

SEQ ID NO: 189389 - RNA, 32 nt, Human
ggcauguccgcggcgggcgccgucuagaggaa

SEQ ID NO: 189390 - RNA, 32 nt, Human
ggcauguccuaggcucugggugcaguagugag

SEQ ID NO: 189391 - RNA, 32 nt, Human
ggcaugucuggcaguagucucucauucacucc

SEQ ID NO: 189392 - RNA, 32 nt, Human
ggcaugugagaagccauggaagguugugguug

SEQ ID NO: 189393 - RNA, 18 nt, Human
ggcaugugcagggagcug

SEQ ID NO: 189394 - RNA, 32 nt, Human
ggcaugugccaggaguuugaggcugcagugca

SEQ ID NO: 189395 - RNA, 32 nt, Human
ggcaugugcccaggugagcuccuguguguguc

SEQ ID NO: 189396 - RNA, 32 nt, Human
ggcaugugccugcaaucccagcuacucaggag

SEQ ID NO: 189397 - RNA, 32 nt, Human
ggcaugugccuguaaccccagcuacucaggag

SEQ ID NO: 189398 - RNA, 32 nt, Human
ggcaugugccuguaaucccagcuacucaggag

SEQ ID NO: 189399 - RNA, 32 nt, Human
ggcaugugccuguaaucccagcuauuuggcag

SEQ ID NO: 189400 - RNA, 32 nt, Human
ggcaugugccuguaaucccagcuucuggaggc

SEQ ID NO: 189401 - RNA, 32 nt, Human
ggcaugugccuguaaucccaguuacuggggag

SEQ ID NO: 189402 - RNA, 32 nt, Human
ggcaugugccuguaaucccugcuacucaggag

SEQ ID NO: 189403 - RNA, 20 nt, Human
ggcaugugccuguaguccca

SEQ ID NO: 189404 - RNA, 32 nt, Human
ggcaugugccuguagucccaacuacucaggag

SEQ ID NO: 189405 - RNA, 23 nt, Human
ggcaugugccuguagucccagcu

SEQ ID NO: 189406 - RNA, 32 nt, Human
ggcaugugccuguagucccagcuacucaggag

SEQ ID NO: 189407 - RNA, 32 nt, Human
ggcaugugccuguagucccagcuacucuggag

SEQ ID NO: 189408 - RNA, 32 nt, Human
ggcaugugccuguagucccagcuacuugggag

SEQ ID NO: 189409 - RNA, 32 nt, Human
ggcaugugccuguaguuccagcuacucaggag

SEQ ID NO: 189410 - RNA, 32 nt, Human
ggcaugugccuguauucccagcuacucaugag

SEQ ID NO: 189411 - RNA, 32 nt, Human
ggcaugugcucuagcauauuaaccucaaacca

SEQ ID NO: 189412 - RNA, 16 nt, Human
ggcaugugcugagguu

SEQ ID NO: 189413 - RNA, 32 nt, Human
ggcaugugcuuccuucccucugaggcccauag

SEQ ID NO: 189414 - RNA, 21 nt, Human
ggcaugugcuuggccacugcc

SEQ ID NO: 189415 - RNA, 32 nt, Human
ggcaugugcuuguaaucccagcuacucuggag

SEQ ID NO: 189416 - RNA, 20 nt, Human
ggcauguggccuuuaucuca

SEQ ID NO: 189417 - RNA, 32 nt, Human
ggcauguggcgugcucuggguagcacaugacu

SEQ ID NO: 189418 - RNA, 32 nt, Human
ggcauguggcucagagguaucacagugacaaa

SEQ ID NO: 189419 - RNA, 17 nt, Human
ggcaugugggccuggau

SEQ ID NO: 189420 - RNA, 31 nt, Human
ggcauguggguggacagugguggagagucac

SEQ ID NO: 189421 - RNA, 32 nt, Human
ggcauguggguggacagugguggagagucacu

SEQ ID NO: 189422 - RNA, 31 nt, Human
ggcaugugguaucuggagcauuguguauaga

SEQ ID NO: 189423 - RNA, 32 nt, Human
ggcaugugguuccagagaaagagaggauaccu

SEQ ID NO: 189424 - RNA, 32 nt, Human
ggcaugugucccagggacaagcaguggcugga

SEQ ID NO: 189425 - RNA, 32 nt, Human
ggcauguucaaagacacuacacugccucucca

SEQ ID NO: 189426 - RNA, 32 nt, Human
ggcauguuccuguuucuucaucguugagcuuu

SEQ ID NO: 189427 - RNA, 20 nt, Human
ggcauguucuacacacagac

SEQ ID NO: 189428 - RNA, 32 nt, Human
ggcauguugaaugagccaggaggucuagaacu

SEQ ID NO: 189429 - RNA, 32 nt, Human
ggcauguuggacucugagcucauuuggggacc

SEQ ID NO: 189430 - RNA, 32 nt, Human
ggcauguugguuuugucucucuuucuuuucuc

SEQ ID NO: 189431 - RNA, 32 nt, Human
ggcauguugguuuugucuuucuuuucuccuuu

SEQ ID NO: 189432 - RNA, 32 nt, Human
ggcauguuucuggagguuucaaaggaaauaaa

SEQ ID NO: 189433 - RNA, 32 nt, Human
ggcauguuuuucuagagcagcugugcuaugcc

SEQ ID NO: 189434 - RNA, 32 nt, Human
ggcauuaagaugagagacgggccaggcgcagu

SEQ ID NO: 189435 - RNA, 32 nt, Human
ggcauuacauuccauccagccugggcgacaag

SEQ ID NO: 189436 - RNA, 32 nt, Human
ggcauuacuuguucguuauagacauggacguu

SEQ ID NO: 189437 - RNA, 21 nt, Human
ggcauuagacacuaggccaua

SEQ ID NO: 189438 - RNA, 20 nt, Human
ggcauuagauucucauagca

SEQ ID NO: 189439 - RNA, 32 nt, Human
ggcauuagcauaguaagcagauauuucuacuu

SEQ ID NO: 189440 - RNA, 32 nt, Human
ggcauuaugcauuuguccaaacccaccgaacg

SEQ ID NO: 189441 - RNA, 32 nt, Human
ggcauucacgucccuucuugcagggcauuuua

SEQ ID NO: 189442 - RNA, 32 nt, Human
ggcauucacgugcauccccuggaggggagggu

SEQ ID NO: 189443 - RNA, 21 nt, Human
ggcauucaguaccugacugca

SEQ ID NO: 189444 - RNA, 17 nt, Human
ggcauucaugccuggac

SEQ ID NO: 189445 - RNA, 32 nt, Human
ggcauucauggcugaaguggaggaucaggcag

SEQ ID NO: 189446 - RNA, 32 nt, Human
ggcauuccaacaugucagugauacuggguaga

SEQ ID NO: 189447 - RNA, 32 nt, Human
ggcauuccaaguuugacagcauggaacauugc

SEQ ID NO: 189448 - RNA, 32 nt, Human
ggcauuccagaaagacugggaauucauuucug

SEQ ID NO: 189449 - RNA, 17 nt, Human
ggcauuccagccugggc

SEQ ID NO: 189450 - RNA, 32 nt, Human
ggcauuccagccugggcaacagagugaggcug

SEQ ID NO: 189451 - RNA, 32 nt, Human
ggcauucccaguaggaaugugaagccagaggu

SEQ ID NO: 189452 - RNA, 32 nt, Human
ggcauucccaucaagagcaccauggacaaccc

SEQ ID NO: 189453 - RNA, 32 nt, Human
ggcauucccaugaacauccggggccugguguu

SEQ ID NO: 189454 - RNA, 32 nt, Human
ggcauucccuggccucucuggcugccacuugg

SEQ ID NO: 189455 - RNA, 32 nt, Human
ggcauuccuaggcuuagccaaagcuuaauauu

SEQ ID NO: 189456 - RNA, 32 nt, Human
ggcauuccuuucuccuccucucauccuacaca

SEQ ID NO: 189457 - RNA, 22 nt, Human
ggcauucgagacuagccuggac

SEQ ID NO: 189458 - RNA, 17 nt, Human
ggcauucggacuuggac

SEQ ID NO: 189459 - RNA, 32 nt, Human
ggcauucgucuguaaucccagcuacuugaugc

SEQ ID NO: 189460 - RNA, 18 nt, Human
ggcauucuacaccuggac

SEQ ID NO: 189461 - RNA, 32 nt, Human
ggcauucuaggaugaggucagaccccuuggcc

SEQ ID NO: 189462 - RNA, 32 nt, Human
ggcauucuauacuuaacuuggcaauuugagga

SEQ ID NO: 189463 - RNA, 18 nt, Human
ggcauucucagcuuagac

SEQ ID NO: 189464 - RNA, 17 nt, Human
ggcauucuccacuggac

SEQ ID NO: 189465 - RNA, 32 nt, Human
ggcauucucuucaguuccauguuuucaaguua

SEQ ID NO: 189466 - RNA, 32 nt, Human
ggcauucucuuuccuuuuccuucucuccugag

SEQ ID NO: 189467 - RNA, 32 nt, Human
ggcauucugaaaugaaagaaacuccuuuauau

SEQ ID NO: 189468 - RNA, 16 nt, Human
ggcauucugacuggau

SEQ ID NO: 189469 - RNA, 32 nt, Human
ggcauucugccucuacauuucuuuuuguuugu

SEQ ID NO: 189470 - RNA, 25 nt, Human
ggcauucugcuaaacaucugaccca

SEQ ID NO: 189471 - RNA, 17 nt, Human
ggcauucugcucaggac

SEQ ID NO: 189472 - RNA, 32 nt, Human
ggcauucugcucaggaccccuaucccagcuca

SEQ ID NO: 189473 - RNA, 17 nt, Human
ggcauucuuaccacgac

SEQ ID NO: 189474 - RNA, 18 nt, Human
ggcauucuuagcugagac

SEQ ID NO: 189475 - RNA, 32 nt, Human
ggcauucuuagucauaggagguuggcaggacg

SEQ ID NO: 189476 - RNA, 18 nt, Human
ggcauucuuuucugguac

SEQ ID NO: 189477 - RNA, 32 nt, Human
ggcauugacaacacaaaaacuguguagugguc

SEQ ID NO: 189478 - RNA, 17 nt, Human
ggcauugacccugagac

SEQ ID NO: 189479 - RNA, 32 nt, Human
ggcauugagaaaaaggaaguggguccuguucu

SEQ ID NO: 189480 - RNA, 32 nt, Human
ggcauugauuguaauucugccuuuuuggaaau

SEQ ID NO: 189481 - RNA, 32 nt, Human
ggcauugcaaccagagaggugcccaucccugu

SEQ ID NO: 189482 - RNA, 17 nt, Human
ggcauugcacucugcac

SEQ ID NO: 189483 - RNA, 21 nt, Human
ggcauugccacgccuaccaca

SEQ ID NO: 189484 - RNA, 32 nt, Human
ggcauugcucgcccaagcagcugguaauucca

SEQ ID NO: 189485 - RNA, 24 nt, Human
ggcauugcugauuuugucugccca

SEQ ID NO: 189486 - RNA, 20 nt, Human
ggcauuggaagcucucucca

SEQ ID NO: 189487 - RNA, 32 nt, Human
ggcauuggaaguuuagccuuuacuugaaugua

SEQ ID NO: 189488 - RNA, 32 nt, Human
ggcauuggaugcagaaccuagagccaguuuuc

SEQ ID NO: 189489 - RNA, 32 nt, Human
ggcauuggauuccgucucccugcuccaugccu

SEQ ID NO: 189490 - RNA, 19 nt, Human
ggcauuggccacgggacau

SEQ ID NO: 189491 - RNA, 27 nt, Human
ggcauuggccacgggacaucggccaca

SEQ ID NO: 189492 - RNA, 32 nt, Human
ggcauugguggaagcuggggucagaaaagaga

SEQ ID NO: 189493 - RNA, 19 nt, Human
ggcauugguguccauggcc

SEQ ID NO: 189494 - RNA, 21 nt, Human
ggcauuggugugggguagcuu

SEQ ID NO: 189495 - RNA, 32 nt, Human
ggcauuguaacucugugcuuugagugcaguuu

SEQ ID NO: 189496 - RNA, 32 nt, Human
ggcauuguaguuaaugaugguugauggguucu

SEQ ID NO: 189497 - RNA, 32 nt, Human
ggcauugugauguacagggcugcucugugaga

SEQ ID NO: 189498 - RNA, 32 nt, Human
ggcauugugcacccuuugccacccuggucccu

SEQ ID NO: 189499 - RNA, 32 nt, Human
ggcauuguguacaaauugcuucucaccauccc

SEQ ID NO: 189500 - RNA, 22 nt, Human
ggcauuguucgccgccgccgcc

SEQ ID NO: 189501 - RNA, 32 nt, Human
ggcauuguucuuggcauauuauuguacuaucc

SEQ ID NO: 189502 - RNA, 32 nt, Human
ggcauuuaaggagcauuuaaaaauauguauau

SEQ ID NO: 189503 - RNA, 32 nt, Human
ggcauuuacuacaucggucacuucuccaggcu

SEQ ID NO: 189504 - RNA, 32 nt, Human
ggcauuuaggauuccaucuggcccagccccug

SEQ ID NO: 189505 - RNA, 21 nt, Human
ggcauuuaggccucucugcca

SEQ ID NO: 189506 - RNA, 17 nt, Human
ggcauuuaggucuggau

SEQ ID NO: 189507 - RNA, 32 nt, Human
ggcauuuaguacauccagaaaguuguguaggc

SEQ ID NO: 189508 - RNA, 32 nt, Human
ggcauuucaccccagcuccaucagggcuggca

SEQ ID NO: 189509 - RNA, 31 nt, Human
ggcauuucacucaaguggacaggggaaaaag

SEQ ID NO: 189510 - RNA, 32 nt, Human
ggcauuucagagccaucagcugaagacaucug

SEQ ID NO: 189511 - RNA, 32 nt, Human
ggcauuucaguuccuccuaccaccucaacagg

SEQ ID NO: 189512 - RNA, 32 nt, Human
ggcauuuccagacuugaaauucucaucagucc

SEQ ID NO: 189513 - RNA, 32 nt, Human
ggcauuucugcucucuaugcuugagaccggga

SEQ ID NO: 189514 - RNA, 32 nt, Human
ggcauuucuggaugaaaaugcaaauggaaaaa

SEQ ID NO: 189515 - RNA, 20 nt, Human
ggcauuugaacaugcuccuc

SEQ ID NO: 189516 - RNA, 32 nt, Human
ggcauuugaacauguaaucaccagagauucug

SEQ ID NO: 189517 - RNA, 32 nt, Human
ggcauuugaucagaccaaacagugcuguuucc

SEQ ID NO: 189518 - RNA, 32 nt, Human
ggcauuugcaaugcaguucucacagcugguug

SEQ ID NO: 189519 - RNA, 21 nt, Human
ggcauuugccaaaccaagcca

SEQ ID NO: 189520 - RNA, 32 nt, Human
ggcauuugcccaguuagagcugagaaaauggu

SEQ ID NO: 189521 - RNA, 32 nt, Human
ggcauuugccuuugaguauguucuuguaggag

SEQ ID NO: 189522 - RNA, 32 nt, Human
ggcauuugcuuccaauuguagcuagcgcacag

SEQ ID NO: 189523 - RNA, 32 nt, Human
ggcauuuguauucauguauucaguuagccacu

SEQ ID NO: 189524 - RNA, 18 nt, Human
ggcauuuguccccgcgac

SEQ ID NO: 189525 - RNA, 32 nt, Human
ggcauuugugcguagguggcuguggggugaga

SEQ ID NO: 189526 - RNA, 18 nt, Human
ggcauuuuagaaccagac

SEQ ID NO: 189527 - RNA, 19 nt, Human
ggcauuuuauagccugggc

SEQ ID NO: 189528 - RNA, 32 nt, Human
ggcauuuuauucagcuaccagauggcuuaaaa

SEQ ID NO: 189529 - RNA, 24 nt, Human
ggcauuuuauuccuaaaucuucca

SEQ ID NO: 189530 - RNA, 32 nt, Human
ggcauuuuccaugcaaccuccuucugccagca

SEQ ID NO: 189531 - RNA, 32 nt, Human
ggcauuuucccccugccaagggcugaaauggc

SEQ ID NO: 189532 - RNA, 32 nt, Human
ggcauuuugcuaccaagccucuucccaacgcc

SEQ ID NO: 189533 - RNA, 17 nt, Human
ggcauuuugggcuggau

SEQ ID NO: 189534 - RNA, 32 nt, Human
ggcauuuugucagaaaaagaccuguguuucca

SEQ ID NO: 189535 - RNA, 19 nt, Human
ggcauuuuguugccuggac

SEQ ID NO: 189536 - RNA, 32 nt, Human
ggccaaaaacauccuuuugcucugucucguuc

SEQ ID NO: 189537 - RNA, 32 nt, Human
ggccaaaacaccaggaaacacauuucuguggc

SEQ ID NO: 189538 - RNA, 32 nt, Human
ggccaaaacagcuuuaauuucccugcgaggaa

SEQ ID NO: 189539 - RNA, 32 nt, Human
ggccaaaacagugaaaccccgucucuacuaaa

SEQ ID NO: 189540 - RNA, 32 nt, Human
ggccaaaagaagcgggccuguuggaggcuggg

SEQ ID NO: 189541 - RNA, 32 nt, Human
ggccaaaaggaaacugauggagaauauucugc

SEQ ID NO: 189542 - RNA, 32 nt, Human
ggccaaaagggagggcccuuuggaggagcgug

SEQ ID NO: 189543 - RNA, 24 nt, Human
ggccaaaagggccccuccuugcca

SEQ ID NO: 189544 - RNA, 32 nt, Human
ggccaaaauggugaaaccucgucucugcuaac

SEQ ID NO: 189545 - RNA, 32 nt, Human
ggccaaaauggugaaacuccaucucuacuaaa

SEQ ID NO: 189546 - RNA, 32 nt, Human
ggccaaaauucauuauuguauuuccaauacag

SEQ ID NO: 189547 - RNA, 32 nt, Human
ggccaaaauuguuuuaaaaucuugcaaggaaa

SEQ ID NO: 189548 - RNA, 32 nt, Human
ggccaaacaugggaguuaagugcugcuugucu

SEQ ID NO: 189549 - RNA, 32 nt, Human
ggccaaaccacaguuuguaccaaaaaccuugu

SEQ ID NO: 189550 - RNA, 32 nt, Human
ggccaaacccuggaaugugccugcuggcugca

SEQ ID NO: 189551 - RNA, 32 nt, Human
ggccaaaccuuggcuguuccagaaacugaacc

SEQ ID NO: 189552 - RNA, 32 nt, Human
ggccaaacggugccugcggugccugagcugag

SEQ ID NO: 189553 - RNA, 32 nt, Human
ggccaaacucccagugcugggggucccugugc

SEQ ID NO: 189554 - RNA, 32 nt, Human
ggccaaacugcaggcaaccaccucgggccgcu

SEQ ID NO: 189555 - RNA, 24 nt, Human
ggccaaagaccaaauuccuuggca

SEQ ID NO: 189556 - RNA, 32 nt, Human
ggccaaagagaccucagaugaaccugaaagac

SEQ ID NO: 189557 - RNA, 32 nt, Human
ggccaaagccugggagccugcgaggggaggag

SEQ ID NO: 189558 - RNA, 32 nt, Human
ggccaaagcuguucacgucugugcucaaccau

SEQ ID NO: 189559 - RNA, 18 nt, Human
ggccaaagcuuccggcgu

SEQ ID NO: 189560 - RNA, 32 nt, Human
ggccaaaggcuaagccagcagauuguucuguu

SEQ ID NO: 189561 - RNA, 32 nt, Human
ggccaaaggugagugggcuauuggccuucucc

SEQ ID NO: 189562 - RNA, 26 nt, Human
ggccaaaguggguggaucaccugagg

SEQ ID NO: 189563 - RNA, 32 nt, Human
ggccaaaguggugaaacccugucucuacuaaa

SEQ ID NO: 189564 - RNA, 32 nt, Human
ggccaaauggaaaaggagaggcuacuucaagu

SEQ ID NO: 189565 - RNA, 21 nt, Human
ggccaaaugucacagcaccaa

SEQ ID NO: 189566 - RNA, 21 nt, Human
ggccaaauuccaucugcugcc

SEQ ID NO: 189567 - RNA, 32 nt, Human
ggccaaauugcccuuuaacugcaccugaaucc

SEQ ID NO: 189568 - RNA, 32 nt, Human
ggccaacaaggugaaaccccaucucuacuaaa

SEQ ID NO: 189569 - RNA, 32 nt, Human
ggccaacaaggugaaaccccgucucuacuaaa

SEQ ID NO: 189570 - RNA, 32 nt, Human
ggccaacaaucagaaaggaacugaggcuugcc

SEQ ID NO: 189571 - RNA, 32 nt, Human
ggccaacaauggcaaaaccccgucucuaccaa

SEQ ID NO: 189572 - RNA, 32 nt, Human
ggccaacacagcgagacccccaucucuaaaaa

SEQ ID NO: 189573 - RNA, 32 nt, Human
ggccaacacagugaaaccccaucucuacuaau

SEQ ID NO: 189574 - RNA, 32 nt, Human
ggccaacacagugaaaccccaucuguacuaaa

SEQ ID NO: 189575 - RNA, 32 nt, Human
ggccaacacagugaaaccccaugucuacuaaa

SEQ ID NO: 189576 - RNA, 29 nt, Human
ggccaacacagugaaaccucgucucuagu

SEQ ID NO: 189577 - RNA, 32 nt, Human
ggccaacacgaugaaaccccgucucuacuaaa

SEQ ID NO: 189578 - RNA, 21 nt, Human
ggccaacacgcccuggcagca

SEQ ID NO: 189579 - RNA, 32 nt, Human
ggccaacacggugaaaccccaucucuacuaaa

SEQ ID NO: 189580 - RNA, 32 nt, Human
ggccaacacggugaaaccccaucucucuaaaa

SEQ ID NO: 189581 - RNA, 32 nt, Human
ggccaacacggugaaacccccgucuccacuaa

SEQ ID NO: 189582 - RNA, 32 nt, Human
ggccaacacggugaaaccccgacucuacuaaa

SEQ ID NO: 189583 - RNA, 32 nt, Human
ggccaacacggugaaaccccgccucuacuaaa

SEQ ID NO: 189584 - RNA, 32 nt, Human
ggccaacacggugaaaccccgucacugaaaaa

SEQ ID NO: 189585 - RNA, 32 nt, Human
ggccaacacggugaaaccccgucucuacuaaa

SEQ ID NO: 189586 - RNA, 32 nt, Human
ggccaacacggugaaaccccgucucuccuaaa

SEQ ID NO: 189587 - RNA, 32 nt, Human
ggccaacacggugaaacccggucucuacuaaa

SEQ ID NO: 189588 - RNA, 32 nt, Human
ggccaacacggugaaacccuguaucuacuaaa

SEQ ID NO: 189589 - RNA, 29 nt, Human
ggccaacacggugaaacccugucucuacu

SEQ ID NO: 189590 - RNA, 32 nt, Human
ggccaacacggugaaacccugucucuacuaaa

SEQ ID NO: 189591 - RNA, 32 nt, Human
ggccaacacggugaaacgcugucucuacuaaa

SEQ ID NO: 189592 - RNA, 32 nt, Human
ggccaacagaaugaaacccugucucuacaaaa

SEQ ID NO: 189593 - RNA, 32 nt, Human
ggccaacagagaaccaggaggccaggccugag

SEQ ID NO: 189594 - RNA, 32 nt, Human
ggccaacagaugugagccacuuuucucagccu

SEQ ID NO: 189595 - RNA, 32 nt, Human
ggccaacagcccagagcucaggacacuuggcu

SEQ ID NO: 189596 - RNA, 32 nt, Human
ggccaacagggugaaaccccgucucuacaaaa

SEQ ID NO: 189597 - RNA, 32 nt, Human
ggccaacaguagccaaaccccuagagacagug

SEQ ID NO: 189598 - RNA, 32 nt, Human
ggccaacauaaugaaaccccaucucuacuaaa

SEQ ID NO: 189599 - RNA, 32 nt, Human
ggccaacauacugaaaccccgucucuacuaaa

SEQ ID NO: 189600 - RNA, 32 nt, Human
ggccaacauagcaaaaccccaucucuauuaaa

SEQ ID NO: 189601 - RNA, 32 nt, Human
ggccaacauagcgaaaccccgucucuacuaaa

SEQ ID NO: 189602 - RNA, 32 nt, Human
ggccaacauaguaaaaccucaucucuacuaaa

SEQ ID NO: 189603 - RNA, 32 nt, Human
ggccaacauagugaaaccccaucucuaccaaa

SEQ ID NO: 189604 - RNA, 32 nt, Human
ggccaacauagugaaaccccaucucuacuaaa

SEQ ID NO: 189605 - RNA, 32 nt, Human
ggccaacauagugaaaccccaucucuacugaa

SEQ ID NO: 189606 - RNA, 32 nt, Human
ggccaacauagugaaacccccucucuacuaaa

SEQ ID NO: 189607 - RNA, 32 nt, Human
ggccaacauagugaaaccccgccucuacuaaa

SEQ ID NO: 189608 - RNA, 32 nt, Human
ggccaacauagugaaaccccgucucuacuaaa

SEQ ID NO: 189609 - RNA, 32 nt, Human
ggccaacauagugaaaccccgucucuaguaaa

SEQ ID NO: 189610 - RNA, 32 nt, Human
ggccaacauagugaaaccccgucucuauuaaa

SEQ ID NO: 189611 - RNA, 32 nt, Human
ggccaacauagugaaaccccgucucuucuaaa

SEQ ID NO: 189612 - RNA, 32 nt, Human
ggccaacauagugaaaccccgugucuacuaaa

SEQ ID NO: 189613 - RNA, 32 nt, Human
ggccaacauagugaaaccccuucucuacuaaa

SEQ ID NO: 189614 - RNA, 32 nt, Human
ggccaacauagugaaacccuaucucuacuaaa

SEQ ID NO: 189615 - RNA, 22 nt, Human
ggccaacauagugaaacccugu

SEQ ID NO: 189616 - RNA, 32 nt, Human
ggccaacauagugaaacccugucccuacuaua

SEQ ID NO: 189617 - RNA, 32 nt, Human
ggccaacauagugaaacccugucucuaauaaa

SEQ ID NO: 189618 - RNA, 32 nt, Human
ggccaacauagugaaacccugucucuaccaaa

SEQ ID NO: 189619 - RNA, 32 nt, Human
ggccaacauagugaaacccugucucuacuaaa

SEQ ID NO: 189620 - RNA, 32 nt, Human
ggccaacauagugaaaucccaucucuacuaaa

SEQ ID NO: 189621 - RNA, 32 nt, Human
ggccaacauauagugaaacccagucucuacua

SEQ ID NO: 189622 - RNA, 32 nt, Human
ggccaacauauagugaaacccugucucuacua

SEQ ID NO: 189623 - RNA, 32 nt, Human
ggccaacauaugcagacauuuguacuccucaa

SEQ ID NO: 189624 - RNA, 32 nt, Human
ggccaacaucaugaaaccccgucucuacuaaa

SEQ ID NO: 189625 - RNA, 32 nt, Human
ggccaacaucaugaaacccugucuguacuaaa

SEQ ID NO: 189626 - RNA, 32 nt, Human
ggccaacaucgugaaaccccaucucuacuaaa

SEQ ID NO: 189627 - RNA, 32 nt, Human
ggccaacaucgugaaacccugucucuacuaaa

SEQ ID NO: 189628 - RNA, 32 nt, Human
ggccaacaugacgaaaccccaucucuacuaaa

SEQ ID NO: 189629 - RNA, 32 nt, Human
ggccaacaugacgaaaccccgucucuacuaaa

SEQ ID NO: 189630 - RNA, 32 nt, Human
ggccaacaugauaaaaccccaacucuacuaaa

SEQ ID NO: 189631 - RNA, 32 nt, Human
ggccaacaugaugaaaccccaucuccacuaaa

SEQ ID NO: 189632 - RNA, 32 nt, Human
ggccaacaugaugaaaccccaucucuacuaaa

SEQ ID NO: 189633 - RNA, 32 nt, Human
ggccaacaugaugaaaccccgucucuaccaaa

SEQ ID NO: 189634 - RNA, 32 nt, Human
ggccaacaugaugaaaccccgucucuacuaaa

SEQ ID NO: 189635 - RNA, 32 nt, Human
ggccaacaugaugaaaccccgucucuacuaca

SEQ ID NO: 189636 - RNA, 32 nt, Human
ggccaacaugaugaaaccccguuucuacuaaa

SEQ ID NO: 189637 - RNA, 32 nt, Human
ggccaacaugaugaaacccuaucucuacuaaa

SEQ ID NO: 189638 - RNA, 32 nt, Human
ggccaacaugaugaaacccugucucuaccaaa

SEQ ID NO: 189639 - RNA, 32 nt, Human
ggccaacaugaugaaacccugucucuacuaaa

SEQ ID NO: 189640 - RNA, 32 nt, Human
ggccaacaugaugaaacccugucucuacugaa

SEQ ID NO: 189641 - RNA, 32 nt, Human
ggccaacaugaugaaacccugucucuauuaaa

SEQ ID NO: 189642 - RNA, 32 nt, Human
ggccaacaugaugaaacccuguucucuacuaa

SEQ ID NO: 189643 - RNA, 32 nt, Human
ggccaacaugaugaaacccuugucucuauuaa

SEQ ID NO: 189644 - RNA, 32 nt, Human
ggccaacaugaugagaccuccgucucuacuaa

SEQ ID NO: 189645 - RNA, 32 nt, Human
ggccaacaugcugaaacccugucuguacuaaa

SEQ ID NO: 189646 - RNA, 32 nt, Human
ggccaacauggagaaaccccaucucuaccaaa

SEQ ID NO: 189647 - RNA, 32 nt, Human
ggccaacauggagaaaccccaucucuacuaaa

SEQ ID NO: 189648 - RNA, 32 nt, Human
ggccaacauggagaaaccccaucuuuacuaaa

SEQ ID NO: 189649 - RNA, 32 nt, Human
ggccaacauggagaaaccccgucucuacuaaa

SEQ ID NO: 189650 - RNA, 32 nt, Human
ggccaacauggagaaaccccgugacuacuaaa

SEQ ID NO: 189651 - RNA, 32 nt, Human
ggccaacauggagcuuaguugggaggauaaag

SEQ ID NO: 189652 - RNA, 32 nt, Human
ggccaacauggcaaaaccacaucucuacuaaa

SEQ ID NO: 189653 - RNA, 32 nt, Human
ggccaacauggcaaaaccccaucacuaaaaau

SEQ ID NO: 189654 - RNA, 32 nt, Human
ggccaacauggcaaaaccccaucuccacaaaa

SEQ ID NO: 189655 - RNA, 32 nt, Human
ggccaacauggcaaaaccccaucucuaccaaa

SEQ ID NO: 189656 - RNA, 32 nt, Human
ggccaacauggcaaaaccccaucucuacuaaa

SEQ ID NO: 189657 - RNA, 32 nt, Human
ggccaacauggcaaaaccccaucucuacugaa

SEQ ID NO: 189658 - RNA, 32 nt, Human
ggccaacauggcaaaaccccaucuguacuaaa

SEQ ID NO: 189659 - RNA, 32 nt, Human
ggccaacauggcaaaaccccaucuuuacuaaa

SEQ ID NO: 189660 - RNA, 32 nt, Human
ggccaacauggcaaaaccccaugucuacuaaa

SEQ ID NO: 189661 - RNA, 32 nt, Human
ggccaacauggcaaaacccccaucucgacuaa

SEQ ID NO: 189662 - RNA, 32 nt, Human
ggccaacauggcaaaacccccgucucuacuaa

SEQ ID NO: 189663 - RNA, 32 nt, Human
ggccaacauggcaaaaccucaucucuacuaaa

SEQ ID NO: 189664 - RNA, 32 nt, Human
ggccaacauggcaaaaucccaucucuacuaaa

SEQ ID NO: 189665 - RNA, 32 nt, Human
ggccaacauggcaagaccccaucucuacuaaa

SEQ ID NO: 189666 - RNA, 32 nt, Human
ggccaacauggcagaaaccccaucucuacuaa

SEQ ID NO: 189667 - RNA, 32 nt, Human
ggccaacauggcgaaaacccaucucuacuaaa

SEQ ID NO: 189668 - RNA, 32 nt, Human
ggccaacauggcgaaaccccaucgcuacuaaa

SEQ ID NO: 189669 - RNA, 32 nt, Human
ggccaacauggcgaaaccccaucucuaccgaa

SEQ ID NO: 189670 - RNA, 29 nt, Human
ggccaacauggcgaaaccccaucucuacu

SEQ ID NO: 189671 - RNA, 32 nt, Human
ggccaacauggcgaaaccccaucucuacuaaa

SEQ ID NO: 189672 - RNA, 32 nt, Human
ggccaacauggcgaaaccccaucucuacuuaa

SEQ ID NO: 189673 - RNA, 32 nt, Human
ggccaacauggcgaaaccccaucucugcuaaa

SEQ ID NO: 189674 - RNA, 32 nt, Human
ggccaacauggcgaaaccccauuucuacuaaa

SEQ ID NO: 189675 - RNA, 29 nt, Human
ggccaacauggcgaaaccccgucucuacu

SEQ ID NO: 189676 - RNA, 32 nt, Human
ggccaacauggcgaaaccccgucucuacuaaa

SEQ ID NO: 189677 - RNA, 32 nt, Human
ggccaacauggcgaaaccccgucucuacuaua

SEQ ID NO: 189678 - RNA, 32 nt, Human
ggccaacauggcgaaaccccgucucuauuaaa

SEQ ID NO: 189679 - RNA, 32 nt, Human
ggccaacauggcgaaaccccgucuuuacuaaa

SEQ ID NO: 189680 - RNA, 32 nt, Human
ggccaacauggcgaaaccccucucuacuaaaa

SEQ ID NO: 189681 - RNA, 32 nt, Human
ggccaacauggcgaaaccccuucucuacuaaa

SEQ ID NO: 189682 - RNA, 32 nt, Human
ggccaacauggcgaaaccucaucucuacuaaa

SEQ ID NO: 189683 - RNA, 32 nt, Human
ggccaacauggcgaaauuccaucucuaguaaa

SEQ ID NO: 189684 - RNA, 32 nt, Human
ggccaacauggcgagaccccaucucuacuaaa

SEQ ID NO: 189685 - RNA, 32 nt, Human
ggccaacauggcggaaccccaucuccacuaaa

SEQ ID NO: 189686 - RNA, 32 nt, Human
ggccaacauggggaaaccccaucucuacuaaa

SEQ ID NO: 189687 - RNA, 32 nt, Human
ggccaacauggggaaaccccgucucuacuaaa

SEQ ID NO: 189688 - RNA, 32 nt, Human
ggccaacauggggaaaucccaucucuacuaaa

SEQ ID NO: 189689 - RNA, 32 nt, Human
ggccaacaugguaaaaccccaucucuacuaaa

SEQ ID NO: 189690 - RNA, 32 nt, Human
ggccaacaugguaaaaccccauuucuacuaaa

SEQ ID NO: 189691 - RNA, 32 nt, Human
ggccaacauggugaaaacccaucucuauuaaa

SEQ ID NO: 189692 - RNA, 32 nt, Human
ggccaacauggugaaaacccaucucugcugaa

SEQ ID NO: 189693 - RNA, 32 nt, Human
ggccaacauggugaaaaccugucucuacuaaa

SEQ ID NO: 189694 - RNA, 32 nt, Human
ggccaacauggugaaaacuccucucuacuaaa

SEQ ID NO: 189695 - RNA, 32 nt, Human
ggccaacauggugaaacaccgucuccacuaaa

SEQ ID NO: 189696 - RNA, 32 nt, Human
ggccaacauggugaaacacuaucucuacuaaa

SEQ ID NO: 189697 - RNA, 32 nt, Human
ggccaacauggugaaacacugucucuacuaaa

SEQ ID NO: 189698 - RNA, 32 nt, Human
ggccaacauggugaaacacugucuguacuaaa

SEQ ID NO: 189699 - RNA, 32 nt, Human
ggccaacauggugaaaccacauuucuacaaaa

SEQ ID NO: 189700 - RNA, 32 nt, Human
ggccaacauggugaaaccacguuccugcuaaa

SEQ ID NO: 189701 - RNA, 19 nt, Human
ggccaacauggugaaaccc

SEQ ID NO: 189702 - RNA, 32 nt, Human
ggccaacauggugaaacccagucucuacuaaa

SEQ ID NO: 189703 - RNA, 32 nt, Human
ggccaacauggugaaacccagucuuuacuaaa

SEQ ID NO: 189704 - RNA, 20 nt, Human
ggccaacauggugaaacccc

SEQ ID NO: 189705 - RNA, 32 nt, Human
ggccaacauggugaaaccccaccucuacaaaa

SEQ ID NO: 189706 - RNA, 32 nt, Human
ggccaacauggugaaaccccaccucuacuaaa

SEQ ID NO: 189707 - RNA, 32 nt, Human
ggccaacauggugaaaccccacgucuacuaaa

SEQ ID NO: 189708 - RNA, 32 nt, Human
ggccaacauggugaaaccccauauccauuaaa

SEQ ID NO: 189709 - RNA, 32 nt, Human
ggccaacauggugaaaccccauaucuacuaaa

SEQ ID NO: 189710 - RNA, 32 nt, Human
ggccaacauggugaaaccccauccuuacuaaa

SEQ ID NO: 189711 - RNA, 32 nt, Human
ggccaacauggugaaaccccaucgcuacuaaa

SEQ ID NO: 189712 - RNA, 32 nt, Human
ggccaacauggugaaaccccaucuccacaaaa

SEQ ID NO: 189713 - RNA, 32 nt, Human
ggccaacauggugaaaccccaucuccacuaaa

SEQ ID NO: 189714 - RNA, 32 nt, Human
ggccaacauggugaaaccccaucucuacaaaa

SEQ ID NO: 189715 - RNA, 32 nt, Human
ggccaacauggugaaaccccaucucuacaguu

SEQ ID NO: 189716 - RNA, 32 nt, Human
ggccaacauggugaaaccccaucucuaccaaa

SEQ ID NO: 189717 - RNA, 29 nt, Human
ggccaacauggugaaaccccaucucuacu

SEQ ID NO: 189718 - RNA, 32 nt, Human
ggccaacauggugaaaccccaucucuacuaaa

SEQ ID NO: 189719 - RNA, 32 nt, Human
ggccaacauggugaaaccccaucucuacuaau

SEQ ID NO: 189720 - RNA, 32 nt, Human
ggccaacauggugaaaccccaucucuacuaga

SEQ ID NO: 189721 - RNA, 32 nt, Human
ggccaacauggugaaaccccaucucuacugaa

SEQ ID NO: 189722 - RNA, 32 nt, Human
ggccaacauggugaaaccccaucucuaucaga

SEQ ID NO: 189723 - RNA, 32 nt, Human
ggccaacauggugaaaccccaucucuauuaaa

SEQ ID NO: 189724 - RNA, 32 nt, Human
ggccaacauggugaaaccccaucucuauuaua

SEQ ID NO: 189725 - RNA, 32 nt, Human
ggccaacauggugaaaccccaucucugcuaaa

SEQ ID NO: 189726 - RNA, 32 nt, Human
ggccaacauggugaaaccccaucuguacuaaa

SEQ ID NO: 189727 - RNA, 32 nt, Human
ggccaacauggugaaaccccaucuguauuaau

SEQ ID NO: 189728 - RNA, 32 nt, Human
ggccaacauggugaaaccccaucuuuacuaaa

SEQ ID NO: 189729 - RNA, 32 nt, Human
ggccaacauggugaaaccccaugucuacuaaa

SEQ ID NO: 189730 - RNA, 32 nt, Human
ggccaacauggugaaaccccauuucuacuaaa

SEQ ID NO: 189731 - RNA, 32 nt, Human
ggccaacauggugaaacccccaucucuacuaa

SEQ ID NO: 189732 - RNA, 32 nt, Human
ggccaacauggugaaacccccaucucuccugg

SEQ ID NO: 189733 - RNA, 32 nt, Human
ggccaacauggugaaacccccucucuacuaaa

SEQ ID NO: 189734 - RNA, 22 nt, Human
ggccaacauggugaaaccccgu

SEQ ID NO: 189735 - RNA, 32 nt, Human
ggccaacauggugaaaccccgucacuaauaaa

SEQ ID NO: 189736 - RNA, 32 nt, Human
ggccaacauggugaaaccccgucacuacuaaa

SEQ ID NO: 189737 - RNA, 32 nt, Human
ggccaacauggugaaaccccgucuauacuaaa

SEQ ID NO: 189738 - RNA, 32 nt, Human
ggccaacauggugaaaccccgucuccacuaaa

SEQ ID NO: 189739 - RNA, 32 nt, Human
ggccaacauggugaaaccccgucucuacaaaa

SEQ ID NO: 189740 - RNA, 32 nt, Human
ggccaacauggugaaaccccgucucuaccaaa

SEQ ID NO: 189741 - RNA, 32 nt, Human
ggccaacauggugaaaccccgucucuacuaaa

SEQ ID NO: 189742 - RNA, 32 nt, Human
ggccaacauggugaaaccccgucucuacuuaa

SEQ ID NO: 189743 - RNA, 32 nt, Human
ggccaacauggugaaaccccgucucuaguaaa

SEQ ID NO: 189744 - RNA, 32 nt, Human
ggccaacauggugaaaccccgucucuauuaaa

SEQ ID NO: 189745 - RNA, 32 nt, Human
ggccaacauggugaaaccccgucucuauuaca

SEQ ID NO: 189746 - RNA, 32 nt, Human
ggccaacauggugaaaccccgucuguacuaaa

SEQ ID NO: 189747 - RNA, 32 nt, Human
ggccaacauggugaaaccccgucuguauuaaa

SEQ ID NO: 189748 - RNA, 32 nt, Human
ggccaacauggugaaaccccguuucuaccaaa

SEQ ID NO: 189749 - RNA, 32 nt, Human
ggccaacauggugaaaccccuucucuacuaaa

SEQ ID NO: 189750 - RNA, 32 nt, Human
ggccaacauggugaaaccccuucucuacugaa

SEQ ID NO: 189751 - RNA, 32 nt, Human
ggccaacauggugaaaccccuucucuaguaaa

SEQ ID NO: 189752 - RNA, 32 nt, Human
ggccaacauggugaaacccgcugucuacuaaa

SEQ ID NO: 189753 - RNA, 32 nt, Human
ggccaacauggugaaacccggucucuaccaaa

SEQ ID NO: 189754 - RNA, 32 nt, Human
ggccaacauggugaaacccggucucuacuaaa

SEQ ID NO: 189755 - RNA, 22 nt, Human
ggccaacauggugaaacccguc

SEQ ID NO: 189756 - RNA, 32 nt, Human
ggccaacauggugaaacccgucucuacuaaaa

SEQ ID NO: 189757 - RNA, 32 nt, Human
ggccaacauggugaaacccuaucuccacuaaa

SEQ ID NO: 189758 - RNA, 32 nt, Human
ggccaacauggugaaacccuaucucuacuaaa

SEQ ID NO: 189759 - RNA, 32 nt, Human
ggccaacauggugaaacccuaucucuacugca

SEQ ID NO: 189760 - RNA, 32 nt, Human
ggccaacauggugaaacccucaucucaacuaa

SEQ ID NO: 189761 - RNA, 32 nt, Human
ggccaacauggugaaacccuggcucuacuaca

SEQ ID NO: 189762 - RNA, 22 nt, Human
ggccaacauggugaaacccugu

SEQ ID NO: 189763 - RNA, 32 nt, Human
ggccaacauggugaaacccuguaucuacuaaa

SEQ ID NO: 189764 - RNA, 32 nt, Human
ggccaacauggugaaacccugucgacuaaaaa

SEQ ID NO: 189765 - RNA, 32 nt, Human
ggccaacauggugaaacccugucuacuaaaaa

SEQ ID NO: 189766 - RNA, 32 nt, Human
ggccaacauggugaaacccugucucuacaaaa

SEQ ID NO: 189767 - RNA, 29 nt, Human
ggccaacauggugaaacccugucucuacu

SEQ ID NO: 189768 - RNA, 32 nt, Human
ggccaacauggugaaacccugucucuacuaaa

SEQ ID NO: 189769 - RNA, 32 nt, Human
ggccaacauggugaaacccugucucuacuaca

SEQ ID NO: 189770 - RNA, 32 nt, Human
ggccaacauggugaaacccugucucuacuaga

SEQ ID NO: 189771 - RNA, 32 nt, Human
ggccaacauggugaaacccugucucuacugaa

SEQ ID NO: 189772 - RNA, 32 nt, Human
ggccaacauggugaaacccugucucuaguaaa

SEQ ID NO: 189773 - RNA, 32 nt, Human
ggccaacauggugaaacccugucucuauuaaa

SEQ ID NO: 189774 - RNA, 32 nt, Human
ggccaacauggugaaacccugucucuccuaaa

SEQ ID NO: 189775 - RNA, 32 nt, Human
ggccaacauggugaaacccugucugcauuaaa

SEQ ID NO: 189776 - RNA, 32 nt, Human
ggccaacauggugaaacccugucuguaccaaa

SEQ ID NO: 189777 - RNA, 32 nt, Human
ggccaacauggugaaacccugucuguacuaaa

SEQ ID NO: 189778 - RNA, 32 nt, Human
ggccaacauggugaaacccugucuguaguaaa

SEQ ID NO: 189779 - RNA, 32 nt, Human
ggccaacauggugaaacccugucuuuacuaaa

SEQ ID NO: 189780 - RNA, 32 nt, Human
ggccaacauggugaaacccugugccuacuaaa

SEQ ID NO: 189781 - RNA, 32 nt, Human
ggccaacauggugaaacccugugucugcuaaa

SEQ ID NO: 189782 - RNA, 32 nt, Human
ggccaacauggugaaacccuguugcuacuaaa

SEQ ID NO: 189783 - RNA, 32 nt, Human
ggccaacauggugaaacccuguuucuacuaaa

SEQ ID NO: 189784 - RNA, 32 nt, Human
ggccaacauggugaaacccuguuucuacugaa

SEQ ID NO: 189785 - RNA, 32 nt, Human
ggccaacauggugaaacccuguuucugccaaa

SEQ ID NO: 189786 - RNA, 32 nt, Human
ggccaacauggugaaacccuucucuacugaaa

SEQ ID NO: 189787 - RNA, 32 nt, Human
ggccaacauggugaaacccuuucucuacugaa

SEQ ID NO: 189788 - RNA, 32 nt, Human
ggccaacauggugaaaccgcaucucugcugaa

SEQ ID NO: 189789 - RNA, 32 nt, Human
ggccaacauggugaaaccgugucucuacuaaa

SEQ ID NO: 189790 - RNA, 32 nt, Human
ggccaacauggugaaaccucaucucuacuaaa

SEQ ID NO: 189791 - RNA, 32 nt, Human
ggccaacauggugaaaccucauuucuacuaaa

SEQ ID NO: 189792 - RNA, 32 nt, Human
ggccaacauggugaaaccuccgucucuauuaa

SEQ ID NO: 189793 - RNA, 32 nt, Human
ggccaacauggugaaaccucgucucuacuaaa

SEQ ID NO: 189794 - RNA, 32 nt, Human
ggccaacauggugaaaccucgucucuacuaca

SEQ ID NO: 189795 - RNA, 32 nt, Human
ggccaacauggugaaaccucgucucuacugaa

SEQ ID NO: 189796 - RNA, 32 nt, Human
ggccaacauggugaaaccucgucuguacuaaa

SEQ ID NO: 189797 - RNA, 32 nt, Human
ggccaacauggugaaaccucgucuuuacuaaa

SEQ ID NO: 189798 - RNA, 32 nt, Human
ggccaacauggugaaaccuggccucuaccuaa

SEQ ID NO: 189799 - RNA, 32 nt, Human
ggccaacauggugaaaccugucucuacuaaaa

SEQ ID NO: 189800 - RNA, 32 nt, Human
ggccaacauggugaaaccuugucuacuaaaaa

SEQ ID NO: 189801 - RNA, 32 nt, Human
ggccaacauggugaaaccuugucucuacuaaa

SEQ ID NO: 189802 - RNA, 32 nt, Human
ggccaacauggugaaaccuugucucuacugaa

SEQ ID NO: 189803 - RNA, 32 nt, Human
ggccaacauggugaaacgccaucucuaccaaa

SEQ ID NO: 189804 - RNA, 32 nt, Human
ggccaacauggugaaacgccaucucuacuaaa

SEQ ID NO: 189805 - RNA, 29 nt, Human
ggccaacauggugaaacgcugucucuacu

SEQ ID NO: 189806 - RNA, 32 nt, Human
ggccaacauggugaaacgucgucucugcuaaa

SEQ ID NO: 189807 - RNA, 32 nt, Human
ggccaacauggugaaacuccaucucuacuaaa

SEQ ID NO: 189808 - RNA, 32 nt, Human
ggccaacauggugaaacuccaucucuccuaaa

SEQ ID NO: 189809 - RNA, 32 nt, Human
ggccaacauggugaaacuccgucucuacuaaa

SEQ ID NO: 189810 - RNA, 32 nt, Human
ggccaacauggugaaacuccgucucugcuaaa

SEQ ID NO: 189811 - RNA, 32 nt, Human
ggccaacauggugaaacucugucucuacuaaa

SEQ ID NO: 189812 - RNA, 29 nt, Human
ggccaacauggugaaacugcaucucuacu

SEQ ID NO: 189813 - RNA, 32 nt, Human
ggccaacauggugaaacuucaucucuacuaaa

SEQ ID NO: 189814 - RNA, 32 nt, Human
ggccaacauggugaaaucccaucuauuaaaaa

SEQ ID NO: 189815 - RNA, 32 nt, Human
ggccaacauggugaaaucccaucucuacugaa

SEQ ID NO: 189816 - RNA, 32 nt, Human
ggccaacauggugaaauccccucucuacuaaa

SEQ ID NO: 189817 - RNA, 32 nt, Human
ggccaacauggugaaaucccgucucuacuaaa

SEQ ID NO: 189818 - RNA, 32 nt, Human
ggccaacauggugaaaucccgucucuacugca

SEQ ID NO: 189819 - RNA, 32 nt, Human
ggccaacauggugaaauccugucucugcuaaa

SEQ ID NO: 189820 - RNA, 32 nt, Human
ggccaacauggugaaauccugucuguacuaaa

SEQ ID NO: 189821 - RNA, 32 nt, Human
ggccaacauggugaaaucgugucucugcuaaa

SEQ ID NO: 189822 - RNA, 32 nt, Human
ggccaacauggugaaaucucaucuguacuaaa

SEQ ID NO: 189823 - RNA, 32 nt, Human
ggccaacauggugaaaugccgucucuacuaaa

SEQ ID NO: 189824 - RNA, 32 nt, Human
ggccaacauggugaaauucugucucuacuaaa

SEQ ID NO: 189825 - RNA, 32 nt, Human
ggccaacauggugaaccccaucucuacuaaaa

SEQ ID NO: 189826 - RNA, 32 nt, Human
ggccaacauggugaacccucagcucuacuaag

SEQ ID NO: 189827 - RNA, 29 nt, Human
ggccaacauggugaagccccaucucuacu

SEQ ID NO: 189828 - RNA, 32 nt, Human
ggccaacauggugaagcccugucucuacuaaa

SEQ ID NO: 189829 - RNA, 32 nt, Human
ggccaacauggugaagcuccgucucuacuaaa

SEQ ID NO: 189830 - RNA, 32 nt, Human
ggccaacauggugaagcucugucucuacuaaa

SEQ ID NO: 189831 - RNA, 32 nt, Human
ggccaacauggugaagucccgucucuacuaaa

SEQ ID NO: 189832 - RNA, 32 nt, Human
ggccaacauggugaauccccgucucuauuaaa

SEQ ID NO: 189833 - RNA, 32 nt, Human
ggccaacauggugaauuaucucuacuaaaaau

SEQ ID NO: 189834 - RNA, 32 nt, Human
ggccaacauggugacaccccgucucuacuaaa

SEQ ID NO: 189835 - RNA, 32 nt, Human
ggccaacauggugacacccugucucuacuaag

SEQ ID NO: 189836 - RNA, 32 nt, Human
ggccaacauggugagacacccgucucuacaaa

SEQ ID NO: 189837 - RNA, 32 nt, Human
ggccaacauggugagacaccgucucuacuaaa

SEQ ID NO: 189838 - RNA, 32 nt, Human
ggccaacauggugagaccccaucucuacaaaa

SEQ ID NO: 189839 - RNA, 32 nt, Human
ggccaacauggugagaccccaucucugcuaaa

SEQ ID NO: 189840 - RNA, 32 nt, Human
ggccaacauggugagacccugucucugcuaaa

SEQ ID NO: 189841 - RNA, 32 nt, Human
ggccaacauggugagcccccgucucuacuaaa

SEQ ID NO: 189842 - RNA, 32 nt, Human
ggccaacauggugauacccgucucuacuaaaa

SEQ ID NO: 189843 - RNA, 32 nt, Human
ggccaacauggugauaucucgucucuacugaa

SEQ ID NO: 189844 - RNA, 23 nt, Human
ggccaacauggugcaaccucguc

SEQ ID NO: 189845 - RNA, 32 nt, Human
ggccaacauggugcaaccucgucuuuacuaaa

SEQ ID NO: 189846 - RNA, 32 nt, Human
ggccaacaugguggaacccaaucucuacuaaa

SEQ ID NO: 189847 - RNA, 32 nt, Human
ggccaacaugguggaacccagucucuacuaaa

SEQ ID NO: 189848 - RNA, 32 nt, Human
ggccaacaugguggaacccuaucucuacuaaa

SEQ ID NO: 189849 - RNA, 32 nt, Human
ggccaacaugguguaaccucaucucuacuaaa

SEQ ID NO: 189850 - RNA, 32 nt, Human
ggccaacaugguguaacgcugucucuacuaaa

SEQ ID NO: 189851 - RNA, 32 nt, Human
ggccaacauggugugagaccccgucucuacua

SEQ ID NO: 189852 - RNA, 32 nt, Human
ggccaacaugguuaaaccccaucucuacgaaa

SEQ ID NO: 189853 - RNA, 32 nt, Human
ggccaacaugucgaaacuucaucucuacuaaa

SEQ ID NO: 189854 - RNA, 32 nt, Human
ggccaacaugucgaagugccaucucuacuaaa

SEQ ID NO: 189855 - RNA, 32 nt, Human
ggccaacauguuguaaaccccgucucuacuaa

SEQ ID NO: 189856 - RNA, 32 nt, Human
ggccaacauuguaaaaccccaucucuacuaaa

SEQ ID NO: 189857 - RNA, 32 nt, Human
ggccaacauugugaaaccccaucucuacaaaa

SEQ ID NO: 189858 - RNA, 32 nt, Human
ggccaacauugugaaaccccaucucugccaaa

SEQ ID NO: 189859 - RNA, 32 nt, Human
ggccaacauugugaaacccugucucuacuaaa

SEQ ID NO: 189860 - RNA, 17 nt, Human
ggccaaccacagcuucc

SEQ ID NO: 189861 - RNA, 32 nt, Human
ggccaaccagaggcgagguugagagcccggcg

SEQ ID NO: 189862 - RNA, 32 nt, Human
ggccaaccaugcacuccacaaaggggagcauu

SEQ ID NO: 189863 - RNA, 23 nt, Human
ggccaacccagcaguccuucccu

SEQ ID NO: 189864 - RNA, 32 nt, Human
ggccaacccagccuggucaacauggugaaacc

SEQ ID NO: 189865 - RNA, 32 nt, Human
ggccaaccucaaggauuugggggugaacgggc

SEQ ID NO: 189866 - RNA, 32 nt, Human
ggccaaccucaaggcagugcucucugguuugc

SEQ ID NO: 189867 - RNA, 32 nt, Human
ggccaaccucccucccccuucucccaccaggc

SEQ ID NO: 189868 - RNA, 32 nt, Human
ggccaaccuggugaaaccccaucucugcuaaa

SEQ ID NO: 189869 - RNA, 32 nt, Human
ggccaaccuggugaaaccccgucucuauuaaa

SEQ ID NO: 189870 - RNA, 32 nt, Human
ggccaaccuggugaaacccugucucuacuaaa

SEQ ID NO: 189871 - RNA, 32 nt, Human
ggccaacgcuccucucaauccugggcuggugg

SEQ ID NO: 189872 - RNA, 32 nt, Human
ggccaacggggugaaacccugucucuacuaaa

SEQ ID NO: 189873 - RNA, 32 nt, Human
ggccaacguagugaaaccccgucucuacaaaa

SEQ ID NO: 189874 - RNA, 32 nt, Human
ggccaacgugaugaaaccccaucuguacugaa

SEQ ID NO: 189875 - RNA, 32 nt, Human
ggccaacgugaugaaacuccaucucuacaaaa

SEQ ID NO: 189876 - RNA, 32 nt, Human
ggccaacguggcaaaaccccaucucuacuaaa

SEQ ID NO: 189877 - RNA, 32 nt, Human
ggccaacguggcaaaacuccaucucuauuaaa

SEQ ID NO: 189878 - RNA, 32 nt, Human
ggccaacguggcaaauacccaucucuacuaaa

SEQ ID NO: 189879 - RNA, 32 nt, Human
ggccaacguggggaaaccccaucucuacgaaa

SEQ ID NO: 189880 - RNA, 32 nt, Human
ggccaacguggugaaacaccgucucuacuaaa

SEQ ID NO: 189881 - RNA, 32 nt, Human
ggccaacguggugaaacacugucucuacuaaa

SEQ ID NO: 189882 - RNA, 32 nt, Human
ggccaacguggugaaaccccaucucuacuaaa

SEQ ID NO: 189883 - RNA, 32 nt, Human
ggccaacguggugaaaccccaucuucacuaaa

SEQ ID NO: 189884 - RNA, 32 nt, Human
ggccaacguggugaaacccccucucuacuaaa

SEQ ID NO: 189885 - RNA, 32 nt, Human
ggccaacguggugaaaccccgucacuacuaaa

SEQ ID NO: 189886 - RNA, 32 nt, Human
ggccaacguggugaaaccccgucuccaguaaa

SEQ ID NO: 189887 - RNA, 32 nt, Human
ggccaacguggugaaaccccgucucuacuaaa

SEQ ID NO: 189888 - RNA, 32 nt, Human
ggccaacguggugaaaccccgucucuacugaa

SEQ ID NO: 189889 - RNA, 32 nt, Human
ggccaacguggugaaaccccguguacuaaaau

SEQ ID NO: 189890 - RNA, 32 nt, Human
ggccaacguggugaaacccuaucucuacuaaa

SEQ ID NO: 189891 - RNA, 32 nt, Human
ggccaacguggugaaacccugucucuacuaaa

SEQ ID NO: 189892 - RNA, 32 nt, Human
ggccaacguggugaaacccugucucuacuuaa

SEQ ID NO: 189893 - RNA, 32 nt, Human
ggccaacguggugaaaccucgucuguacuaaa

SEQ ID NO: 189894 - RNA, 32 nt, Human
ggccaacguggugaaacgcugucucuacuaaa

SEQ ID NO: 189895 - RNA, 32 nt, Human
ggccaacguggugaaagccuguaucuauuaaa

SEQ ID NO: 189896 - RNA, 21 nt, Human
ggccaacuccuggcucaggga

SEQ ID NO: 189897 - RNA, 32 nt, Human
ggccaacugcacucuggaggcggcggcagcca

SEQ ID NO: 189898 - RNA, 32 nt, Human
ggccaacugcauauuauuuucuauggcagugg

SEQ ID NO: 189899 - RNA, 32 nt, Human
ggccaacugcuugugggggcaccugggagguc

SEQ ID NO: 189900 - RNA, 32 nt, Human
ggccaacuucaauacauauccugcugaccuug

SEQ ID NO: 189901 - RNA, 32 nt, Human
ggccaacuugaugaaaccccaucucuacccgu

SEQ ID NO: 189902 - RNA, 32 nt, Human
ggccaacuuggagaaaccccagcucuacaaaa

SEQ ID NO: 189903 - RNA, 32 nt, Human
ggccaacuuggcaaaaccccaucucuacuaaa

SEQ ID NO: 189904 - RNA, 32 nt, Human
ggccaacuuggugaaaccccaucucuacaaaa

SEQ ID NO: 189905 - RNA, 32 nt, Human
ggccaacuuggugaaaccccgucuuuacuaaa

SEQ ID NO: 189906 - RNA, 32 nt, Human
ggccaacuuggugaaacccugucucuacuaaa

SEQ ID NO: 189907 - RNA, 32 nt, Human
ggccaacuuggugaaaccuugucucuacuaga

SEQ ID NO: 189908 - RNA, 32 nt, Human
ggccaagaagcauaugaaaauauguucaaucu

SEQ ID NO: 189909 - RNA, 32 nt, Human
ggccaagaaggcaguguggcuggagaaggagg

SEQ ID NO: 189910 - RNA, 32 nt, Human
ggccaagaaggugaguuuauguaaagauaugg

SEQ ID NO: 189911 - RNA, 21 nt, Human
ggccaagacccucccauugca

SEQ ID NO: 189912 - RNA, 32 nt, Human
ggccaagaccucccacuccgcccucugaggau

SEQ ID NO: 189913 - RNA, 32 nt, Human
ggccaagacgggcggaucaugaggucaagaga

SEQ ID NO: 189914 - RNA, 32 nt, Human
ggccaagacucaccuccccuucccagggccua

SEQ ID NO: 189915 - RNA, 32 nt, Human
ggccaagagaagcuggagcagagagcuggcau

SEQ ID NO: 189916 - RNA, 32 nt, Human
ggccaagagacaccaugcggagccuagucugu

SEQ ID NO: 189917 - RNA, 32 nt, Human
ggccaagagcauacuccagggaccaggauaca

SEQ ID NO: 189918 - RNA, 32 nt, Human
ggccaagagccccucaagaccauccuggaugc

SEQ ID NO: 189919 - RNA, 32 nt, Human
ggccaagaggagccuguccugcccuacacguu

SEQ ID NO: 189920 - RNA, 32 nt, Human
ggccaagagguuaaggcuacagugagcuauga

SEQ ID NO: 189921 - RNA, 32 nt, Human
ggccaagaguuggagagcagacugggcaacau

SEQ ID NO: 189922 - RNA, 32 nt, Human
ggccaagaugaugaagccccaucuguacuaaa

SEQ ID NO: 189923 - RNA, 32 nt, Human
ggccaagauggcggugcagguggugcaggcgg

SEQ ID NO: 189924 - RNA, 26 nt, Human
ggccaagaugggcggaucaccugagg

SEQ ID NO: 189925 - RNA, 32 nt, Human
ggccaagauggugaaaccccaucucuacuaaa

SEQ ID NO: 189926 - RNA, 32 nt, Human
ggccaagauggugaaaccccaucucugcaaaa

SEQ ID NO: 189927 - RNA, 32 nt, Human
ggccaagauggugaaaccccgucucuacuaaa

SEQ ID NO: 189928 - RNA, 32 nt, Human
ggccaagauggugaaaccccgucucuacugaa

SEQ ID NO: 189929 - RNA, 32 nt, Human
ggccaagauggugaaacccugucucuacuaaa

SEQ ID NO: 189930 - RNA, 32 nt, Human
ggccaagauggugaaacccuguuucuacuaaa

SEQ ID NO: 189931 - RNA, 32 nt, Human
ggccaagauggugaaaucccaucucuacaaaa

SEQ ID NO: 189932 - RNA, 32 nt, Human
ggccaagauggugaaaucccgucucuacuaaa

SEQ ID NO: 189933 - RNA, 32 nt, Human
ggccaagauggugaaauccugucucuaauaaa

SEQ ID NO: 189934 - RNA, 32 nt, Human
ggccaagaugguggaacccugccucuacuaaa

SEQ ID NO: 189935 - RNA, 32 nt, Human
ggccaagauuauuccuuuggcacagcaguaag

SEQ ID NO: 189936 - RNA, 32 nt, Human
ggccaagauuguaccacuguauuccagcccgg

SEQ ID NO: 189937 - RNA, 32 nt, Human
ggccaagcaaaaagaaagccccgcuauuagac

SEQ ID NO: 189938 - RNA, 19 nt, Human
ggccaagcaacacaaugca

SEQ ID NO: 189939 - RNA, 32 nt, Human
ggccaagcacacacaggcugcgcccaguuccg

SEQ ID NO: 189940 - RNA, 32 nt, Human
ggccaagcagaggcuccccucaugaaggaagc

SEQ ID NO: 189941 - RNA, 32 nt, Human
ggccaagcagccgccaccacgcugucggucgc

SEQ ID NO: 189942 - RNA, 32 nt, Human
ggccaagccagccugggccacccuggucccag

SEQ ID NO: 189943 - RNA, 16 nt, Human
ggccaagcccaugcca

SEQ ID NO: 189944 - RNA, 18 nt, Human
ggccaagcccccacccca

SEQ ID NO: 189945 - RNA, 32 nt, Human
ggccaagccccuggcuucuuacugcggcuuca

SEQ ID NO: 189946 - RNA, 32 nt, Human
ggccaagcccgcagcagaguccugggcaaaga

SEQ ID NO: 189947 - RNA, 32 nt, Human
ggccaagccuccucaacuaugaccucaaccgg

SEQ ID NO: 189948 - RNA, 32 nt, Human
ggccaagccugugacucaacuccaggggcaag

SEQ ID NO: 189949 - RNA, 32 nt, Human
ggccaagcucagaagcggggagaagagcgaga

SEQ ID NO: 189950 - RNA, 32 nt, Human
ggccaagcugacgucccuccauuuucucaacu

SEQ ID NO: 189951 - RNA, 15 nt, Human
ggccaagcugccccu

SEQ ID NO: 189952 - RNA, 32 nt, Human
ggccaagcugcucaaguaccuccgccggccug

SEQ ID NO: 189953 - RNA, 17 nt, Human
ggccaagcugggucuag

SEQ ID NO: 189954 - RNA, 32 nt, Human
ggccaaggaacauugggaccagaagaggcgag

SEQ ID NO: 189955 - RNA, 32 nt, Human
ggccaaggaagugaugucagugugacagaagg

SEQ ID NO: 189956 - RNA, 24 nt, Human
ggccaaggaguagcauggaggagg

SEQ ID NO: 189957 - RNA, 32 nt, Human
ggccaaggagugagauagccagcgcugauggu

SEQ ID NO: 189958 - RNA, 32 nt, Human
ggccaaggaucacgaggucaggagaucgagac

SEQ ID NO: 189959 - RNA, 31 nt, Human
ggccaaggcaaaggggaagcauucacagacc

SEQ ID NO: 189960 - RNA, 26 nt, Human
ggccaaggcacccauucuucuugcua

SEQ ID NO: 189961 - RNA, 19 nt, Human
ggccaaggcaggacauggc

SEQ ID NO: 189962 - RNA, 32 nt, Human
ggccaaggcaggcagaccacgaggucaggagu

SEQ ID NO: 189963 - RNA, 32 nt, Human
ggccaaggcaggcagauaacaaagucaggaga

SEQ ID NO: 189964 - RNA, 32 nt, Human
ggccaaggcaggcagaucacgaggucaggaga

SEQ ID NO: 189965 - RNA, 32 nt, Human
ggccaaggcaggcagaucacgaggucaggagu

SEQ ID NO: 189966 - RNA, 32 nt, Human
ggccaaggcaggcagaucacgagguuaggagu

SEQ ID NO: 189967 - RNA, 26 nt, Human
ggccaaggcaggcagaucacuugagg

SEQ ID NO: 189968 - RNA, 32 nt, Human
ggccaaggcaggcagaucacuugaggucgggc

SEQ ID NO: 189969 - RNA, 32 nt, Human
ggccaaggcaggcagcaguggggcugugacag

SEQ ID NO: 189970 - RNA, 26 nt, Human
ggccaaggcaggcggaucacuugagg

SEQ ID NO: 189971 - RNA, 32 nt, Human
ggccaaggcccuuugcacugcaucacccuggu

SEQ ID NO: 189972 - RNA, 21 nt, Human
ggccaaggccugaaggccccg

SEQ ID NO: 189973 - RNA, 32 nt, Human
ggccaaggccugguuggguccuuggggcgggc

SEQ ID NO: 189974 - RNA, 32 nt, Human
ggccaaggcgagcggaucaugaggucagaaga

SEQ ID NO: 189975 - RNA, 26 nt, Human
ggccaaggcggacggaucacuugagg

SEQ ID NO: 189976 - RNA, 26 nt, Human
ggccaaggcgggcaaaucaccugagg

SEQ ID NO: 189977 - RNA, 32 nt, Human
ggccaaggcgggcagaccaugaggucaggaga

SEQ ID NO: 189978 - RNA, 26 nt, Human
ggccaaggcgggcagaucacuugagg

SEQ ID NO: 189979 - RNA, 32 nt, Human
ggccaaggcgggcggaucaugaggucaggaga

SEQ ID NO: 189980 - RNA, 26 nt, Human
ggccaaggcggguggaucacuugagg

SEQ ID NO: 189981 - RNA, 32 nt, Human
ggccaaggcugcagacaagggacgcagacaau

SEQ ID NO: 189982 - RNA, 32 nt, Human
ggccaaggcugccugcacugagugucccaggc

SEQ ID NO: 189983 - RNA, 32 nt, Human
ggccaagggacaagagaucacauggagcacaa

SEQ ID NO: 189984 - RNA, 32 nt, Human
ggccaagggcgaggaggagggcugggaguaug

SEQ ID NO: 189985 - RNA, 24 nt, Human
ggccaagggcgaugggccccugag

SEQ ID NO: 189986 - RNA, 21 nt, Human
ggccaagggcggccccuggga

SEQ ID NO: 189987 - RNA, 22 nt, Human
ggccaaggggaugggcagaggu

SEQ ID NO: 189988 - RNA, 32 nt, Human
ggccaagggugagguggccaaaaccagaacca

SEQ ID NO: 189989 - RNA, 32 nt, Human
ggccaagguauucaggccaggagaccucgucc

SEQ ID NO: 189990 - RNA, 32 nt, Human
ggccaagguccccacuuucuugcugacuguaa

SEQ ID NO: 189991 - RNA, 32 nt, Human
ggccaaggugaacugugcauccugagaccuug

SEQ ID NO: 189992 - RNA, 26 nt, Human
ggccaaggugaguggaucaccugagg

SEQ ID NO: 189993 - RNA, 32 nt, Human
ggccaaggugcugccagcaauccuuuccauac

SEQ ID NO: 189994 - RNA, 25 nt, Human
ggccaagguggacagaucacuugag

SEQ ID NO: 189995 - RNA, 26 nt, Human
ggccaagguggauagaucacuugagg

SEQ ID NO: 189996 - RNA, 26 nt, Human
ggccaaggugggcagaucaccugagg

SEQ ID NO: 189997 - RNA, 24 nt, Human
ggccaaggugggcagaucacuuga

SEQ ID NO: 189998 - RNA, 25 nt, Human
ggccaaggugggcagaucacuugag

SEQ ID NO: 189999 - RNA, 32 nt, Human
ggccaaggugggcagaucaugaggucaggaga

SEQ ID NO: 190000 - RNA, 32 nt, Human
ggccaaggugggcagaucaugaggucaggagu

SEQ ID NO: 190001 - RNA, 32 nt, Human
ggccaaggugggcggaucaugaggucaggaga

SEQ ID NO: 190002 - RNA, 26 nt, Human
ggccaagguggguaaaucacuugagg

SEQ ID NO: 190003 - RNA, 26 nt, Human
ggccaagguggguggaucaccugagg

SEQ ID NO: 190004 - RNA, 32 nt, Human
ggccaaggugguccggaagcugcaggggaagc

SEQ ID NO: 190005 - RNA, 32 nt, Human
ggccaaguaaagcccuuccgggucgcucuccu

SEQ ID NO: 190006 - RNA, 32 nt, Human
ggccaagucugagcuaaaauguuaacacuccu

SEQ ID NO: 190007 - RNA, 21 nt, Human
ggccaagugagagagcccagg

SEQ ID NO: 190008 - RNA, 32 nt, Human
ggccaaguucauccccagccaggccaagccaa

SEQ ID NO: 190009 - RNA, 32 nt, Human
ggccaaguucuccgugcgccccugcacccuuc

SEQ ID NO: 190010 - RNA, 32 nt, Human
ggccaauaaauggacugggagcguuuuagcug

SEQ ID NO: 190011 - RNA, 32 nt, Human
ggccaauaaggugaaacccugucucuacuaaa

SEQ ID NO: 190012 - RNA, 32 nt, Human
ggccaauaaggugaaacuccaucucuacuaaa

SEQ ID NO: 190013 - RNA, 32 nt, Human
ggccaauacauaccuucuguaacuccucccua

SEQ ID NO: 190014 - RNA, 32 nt, Human
ggccaauagaagagacaggagacaggaagccu

SEQ ID NO: 190015 - RNA, 30 nt, Human
ggccaauagggugaaacuccgucucuacug

SEQ ID NO: 190016 - RNA, 32 nt, Human
ggccaauauagugggacccccaucucuacaaa

SEQ ID NO: 190017 - RNA, 32 nt, Human
ggccaauaugaugaaaccccaucucuacuaaa

SEQ ID NO: 190018 - RNA, 32 nt, Human
ggccaauaugcugaaacccugucucuacuaaa

SEQ ID NO: 190019 - RNA, 32 nt, Human
ggccaauauggcaaaaccccaucucuacuaaa

SEQ ID NO: 190020 - RNA, 32 nt, Human
ggccaauauggcgaaaccccaucucuacuaaa

SEQ ID NO: 190021 - RNA, 32 nt, Human
ggccaauauggugaaaccacgucucuauuaaa

SEQ ID NO: 190022 - RNA, 32 nt, Human
ggccaauauggugaaacccagcucuacuuaag

SEQ ID NO: 190023 - RNA, 32 nt, Human
ggccaauauggugaaacccagucucuacuaaa

SEQ ID NO: 190024 - RNA, 32 nt, Human
ggccaauauggugaaaccccaucucuacaaaa

SEQ ID NO: 190025 - RNA, 32 nt, Human
ggccaauauggugaaaccccaucucuacuaaa

SEQ ID NO: 190026 - RNA, 32 nt, Human
ggccaauauggugaaaccccaucucuacuaag

SEQ ID NO: 190027 - RNA, 32 nt, Human
ggccaauauggugaaaccccaugucuacuaaa

SEQ ID NO: 190028 - RNA, 32 nt, Human
ggccaauauggugaaaccccgacucuacuaaa

SEQ ID NO: 190029 - RNA, 32 nt, Human
ggccaauauggugaaaccccgucucuacuaaa

SEQ ID NO: 190030 - RNA, 32 nt, Human
ggccaauauggugaaacccgucucuauuaaaa

SEQ ID NO: 190031 - RNA, 32 nt, Human
ggccaauauggugaaacccugucucuacuaaa

SEQ ID NO: 190032 - RNA, 32 nt, Human
ggccaauauggugaaacccugucuguacuaaa

SEQ ID NO: 190033 - RNA, 32 nt, Human
ggccaauauggugaaaccucgucucuaccaaa

SEQ ID NO: 190034 - RNA, 32 nt, Human
ggccaauauggugaaacuucgucucuacuaaa

SEQ ID NO: 190035 - RNA, 32 nt, Human
ggccaauauggugagaccccaucucuacuaaa

SEQ ID NO: 190036 - RNA, 20 nt, Human
ggccaaucaccuugggccca

SEQ ID NO: 190037 - RNA, 32 nt, Human
ggccaauccaggugggagagacacucccaggg

SEQ ID NO: 190038 - RNA, 22 nt, Human
ggccaaucccaggcuugccccc

SEQ ID NO: 190039 - RNA, 32 nt, Human
ggccaaucccaguucccaggcugcaguugagg

SEQ ID NO: 190040 - RNA, 23 nt, Human
ggccaaucccucccuccccuccc

SEQ ID NO: 190041 - RNA, 32 nt, Human
ggccaaucgguguggcuucagcuucugaggau

SEQ ID NO: 190042 - RNA, 32 nt, Human
ggccaaugacaccuaccucacugggucaccau

SEQ ID NO: 190043 - RNA, 21 nt, Human
ggccaaugauucuuuuacuua

SEQ ID NO: 190044 - RNA, 17 nt, Human
ggccaaugccaccaggg

SEQ ID NO: 190045 - RNA, 32 nt, Human
ggccaaugccacuucacucagcacuuuaagag

SEQ ID NO: 190046 - RNA, 32 nt, Human
ggccaauggaaaggagacugaggggagucccg

SEQ ID NO: 190047 - RNA, 32 nt, Human
ggccaauggagacagaggcuuagugcagagca

SEQ ID NO: 190048 - RNA, 22 nt, Human
ggccaauggggagccccaggug

SEQ ID NO: 190049 - RNA, 32 nt, Human
ggccaauguagugaaaccccgucucuacuaaa

SEQ ID NO: 190050 - RNA, 32 nt, Human
ggccaaugugaugaaaccccgucucuacuaaa

SEQ ID NO: 190051 - RNA, 32 nt, Human
ggccaauguggguggaucaugaggucaggagu

SEQ ID NO: 190052 - RNA, 32 nt, Human
ggccaaugugguaaaaccucaucucuacuaaa

SEQ ID NO: 190053 - RNA, 32 nt, Human
ggccaauguggugaaaccccaccucuacuaaa

SEQ ID NO: 190054 - RNA, 32 nt, Human
ggccaauguggugaaaccccaucucuacuaaa

SEQ ID NO: 190055 - RNA, 32 nt, Human
ggccaauguggugaaaccccaucucuacuaag

SEQ ID NO: 190056 - RNA, 32 nt, Human
ggccaauguggugaaacccugucucuacuaaa

SEQ ID NO: 190057 - RNA, 32 nt, Human
ggccaauguggugaaacuccaucucuucuaaa

SEQ ID NO: 190058 - RNA, 32 nt, Human
ggccaauucucccaggaguccuggccacuuug

SEQ ID NO: 190059 - RNA, 32 nt, Human
ggccaauuggaggguggagagugaagagccgg

SEQ ID NO: 190060 - RNA, 32 nt, Human
ggccacaagacuuccccaacgauugugugggu

SEQ ID NO: 190061 - RNA, 16 nt, Human
ggccacaaggacagug

SEQ ID NO: 190062 - RNA, 32 nt, Human
ggccacaagggcauagugcaguucacuuacgu

SEQ ID NO: 190063 - RNA, 32 nt, Human
ggccacaagggggaggcuucaggcuagcugca

SEQ ID NO: 190064 - RNA, 32 nt, Human
ggccacaaguuuccuccacuucucagguuugg

SEQ ID NO: 190065 - RNA, 32 nt, Human
ggccacaauagccucaucaacauggcugcuug

SEQ ID NO: 190066 - RNA, 21 nt, Human
ggccacaaucaucagcuccua

SEQ ID NO: 190067 - RNA, 22 nt, Human
ggccacacacaacacgcaagca

SEQ ID NO: 190068 - RNA, 22 nt, Human
ggccacacacaacaugcaagca

SEQ ID NO: 190069 - RNA, 18 nt, Human
ggccacacacagcuucga

SEQ ID NO: 190070 - RNA, 20 nt, Human
ggccacacagcaggguccag

SEQ ID NO: 190071 - RNA, 32 nt, Human
ggccacacagccagggagaggagguggcucgu

SEQ ID NO: 190072 - RNA, 32 nt, Human
ggccacacagcccaaagauuagcuucaugucc

SEQ ID NO: 190073 - RNA, 32 nt, Human
ggccacacagcuaucuggaggcuuugcaggga

SEQ ID NO: 190074 - RNA, 19 nt, Human
ggccacacagcuggggcgg

SEQ ID NO: 190075 - RNA, 32 nt, Human
ggccacacagucaggcccaggcacugggcucc

SEQ ID NO: 190076 - RNA, 32 nt, Human
ggccacacagugggugcugggccucgccccga

SEQ ID NO: 190077 - RNA, 32 nt, Human
ggccacaccagcuguuucccaccugcugugca

SEQ ID NO: 190078 - RNA, 17 nt, Human
ggccacaccauccaggg

SEQ ID NO: 190079 - RNA, 19 nt, Human
ggccacaccccucugcugc

SEQ ID NO: 190080 - RNA, 32 nt, Human
ggccacaccucucuccccagggcccggcagug

SEQ ID NO: 190081 - RNA, 22 nt, Human
ggccacacgcaacacgcaagca

SEQ ID NO: 190082 - RNA, 21 nt, Human
ggccacacgcgguggcaugca

SEQ ID NO: 190083 - RNA, 32 nt, Human
ggccacacggaacacccccaucccauguuccc

SEQ ID NO: 190084 - RNA, 32 nt, Human
ggccacacugguugcauagccauggagcuggc

SEQ ID NO: 190085 - RNA, 25 nt, Human
ggccacacuuccacccgccaggguc

SEQ ID NO: 190086 - RNA, 18 nt, Human
ggccacacuuucagcaaa

SEQ ID NO: 190087 - RNA, 32 nt, Human
ggccacacuuuccuugccuguguuguugcuau

SEQ ID NO: 190088 - RNA, 32 nt, Human
ggccacagaaaaccagacaccccacaugucug

SEQ ID NO: 190089 - RNA, 32 nt, Human
ggccacagacuggggaggagaaucaguggccc

SEQ ID NO: 190090 - RNA, 17 nt, Human
ggccacagagcuauggg

SEQ ID NO: 190091 - RNA, 32 nt, Human
ggccacagaggacucacuugcccacaccgagg

SEQ ID NO: 190092 - RNA, 32 nt, Human
ggccacagagggcagcaucgcccgccccuucc

SEQ ID NO: 190093 - RNA, 23 nt, Human
ggccacagcaaguguggaccaga

SEQ ID NO: 190094 - RNA, 17 nt, Human
ggccacagcagcccccu

SEQ ID NO: 190095 - RNA, 23 nt, Human
ggccacagccccccacccgccag

SEQ ID NO: 190096 - RNA, 22 nt, Human
ggccacagccccucaccuugcc

SEQ ID NO: 190097 - RNA, 32 nt, Human
ggccacagcccuucuccuccaugggaggcccu

SEQ ID NO: 190098 - RNA, 23 nt, Human
ggccacagccgccaccaccacca

SEQ ID NO: 190099 - RNA, 32 nt, Human
ggccacagccuggguggaaggcagaccugaau

SEQ ID NO: 190100 - RNA, 32 nt, Human
ggccacagccugucccugucuccuagcgccca

SEQ ID NO: 190101 - RNA, 19 nt, Human
ggccacagccuugccauuu

SEQ ID NO: 190102 - RNA, 32 nt, Human
ggccacagcucagccgccuccucugccaccag

SEQ ID NO: 190103 - RNA, 32 nt, Human
ggccacagcucaggcugggcuguggugccagc

SEQ ID NO: 190104 - RNA, 26 nt, Human
ggccacagcugcugcuggagugcaau

SEQ ID NO: 190105 - RNA, 32 nt, Human
ggccacagcuggggcucugguuggcugugacc

SEQ ID NO: 190106 - RNA, 32 nt, Human
ggccacagcugguuucuauugcaucaaggcuc

SEQ ID NO: 190107 - RNA, 23 nt, Human
ggccacagcuuuggcgggcacuu

SEQ ID NO: 190108 - RNA, 32 nt, Human
ggccacaggagaggaggggacaggcucucagg

SEQ ID NO: 190109 - RNA, 32 nt, Human
ggccacaggccucagagcucagcugggcccca

SEQ ID NO: 190110 - RNA, 32 nt, Human
ggccacaggccuggaacccuggaagggaggga

SEQ ID NO: 190111 - RNA, 17 nt, Human
ggccacaggcugaggcg

SEQ ID NO: 190112 - RNA, 32 nt, Human
ggccacaggcugguuucuugggugcaaugaau

SEQ ID NO: 190113 - RNA, 19 nt, Human
ggccacagggccccugccu

SEQ ID NO: 190114 - RNA, 32 nt, Human
ggccacagggcugagugcagggacaaaggggu

SEQ ID NO: 190115 - RNA, 32 nt, Human
ggccacaguccaaucccucugccuucagauag

SEQ ID NO: 190116 - RNA, 20 nt, Human
ggccacaguccuuccugggg

SEQ ID NO: 190117 - RNA, 32 nt, Human
ggccacaguccuuccuggggcauuccaggcag

SEQ ID NO: 190118 - RNA, 32 nt, Human
ggccacagugaacuccggcguggcugaggaag

SEQ ID NO: 190119 - RNA, 19 nt, Human
ggccacagugccggccaca

SEQ ID NO: 190120 - RNA, 32 nt, Human
ggccacaguggcuucccauccuggugacuaca

SEQ ID NO: 190121 - RNA, 32 nt, Human
ggccacaguggucucucagagcucuggagaac

SEQ ID NO: 190122 - RNA, 32 nt, Human
ggccacaguuccaugaaucuuugcucccuucc

SEQ ID NO: 190123 - RNA, 32 nt, Human
ggccacaguugcugcaaaguccuggaucugcc

SEQ ID NO: 190124 - RNA, 32 nt, Human
ggccacauacaugacaaaaagacugaaccguu

SEQ ID NO: 190125 - RNA, 32 nt, Human
ggccacauccaaguaaaacucuaagaggcagg

SEQ ID NO: 190126 - RNA, 32 nt, Human
ggccacauccaccacuuucccugcucuguuac

SEQ ID NO: 190127 - RNA, 32 nt, Human
ggccacauccaccauucacuugcacuugagug

SEQ ID NO: 190128 - RNA, 32 nt, Human
ggccacauccucauggcccaucaggggcagga

SEQ ID NO: 190129 - RNA, 22 nt, Human
ggccacauccugccccacccca

SEQ ID NO: 190130 - RNA, 19 nt, Human
ggccacaugcaaaaaagca

SEQ ID NO: 190131 - RNA, 21 nt, Human
ggccacaugcaagugugagca

SEQ ID NO: 190132 - RNA, 19 nt, Human
ggccacaugcacacacagc

SEQ ID NO: 190133 - RNA, 20 nt, Human
ggccacaugcacccacucgc

SEQ ID NO: 190134 - RNA, 19 nt, Human
ggccacaugcagggaugca

SEQ ID NO: 190135 - RNA, 20 nt, Human
ggccacaugccagccaagca

SEQ ID NO: 190136 - RNA, 32 nt, Human
ggccacauggacuggggugcaaugggacagcu

SEQ ID NO: 190137 - RNA, 21 nt, Human
ggccacauggcuggccaagca

SEQ ID NO: 190138 - RNA, 32 nt, Human
ggccacaugggguucccuguuuucucucugcc

SEQ ID NO: 190139 - RNA, 32 nt, Human
ggccacauuccauugaccagagcucagccacg

SEQ ID NO: 190140 - RNA, 32 nt, Human
ggccacauugaugacuacagugcccuaagaca

SEQ ID NO: 190141 - RNA, 32 nt, Human
ggccaccaaaaccagaguggggccaggacagu

SEQ ID NO: 190142 - RNA, 32 nt, Human
ggccaccaaauggcugcucuuucccaggccgg

SEQ ID NO: 190143 - RNA, 32 nt, Human
ggccaccaacacagaggcccugcagagcggca

SEQ ID NO: 190144 - RNA, 32 nt, Human
ggccaccaacacagaggcccugcagaguggcu

SEQ ID NO: 190145 - RNA, 20 nt, Human
ggccaccaagaacaaaugca

SEQ ID NO: 190146 - RNA, 32 nt, Human
ggccaccaagcccucugcaagugugacugcca

SEQ ID NO: 190147 - RNA, 32 nt, Human
ggccaccaaggaagaagagagaggagaagagg

SEQ ID NO: 190148 - RNA, 32 nt, Human
ggccaccacacgagcaauucacaaagcugcag

SEQ ID NO: 190149 - RNA, 20 nt, Human
ggccaccacagccagacuga

SEQ ID NO: 190150 - RNA, 22 nt, Human
ggccaccacagcccucgcccca

SEQ ID NO: 190151 - RNA, 32 nt, Human
ggccaccacuacgccuucacuugucacccaag

SEQ ID NO: 190152 - RNA, 32 nt, Human
ggccaccagacuugcauuucagccucugucau

SEQ ID NO: 190153 - RNA, 32 nt, Human
ggccaccagagacugcagcccacaacccuugg

SEQ ID NO: 190154 - RNA, 32 nt, Human
ggccaccagcacugcugccacuucuuccagcc

SEQ ID NO: 190155 - RNA, 32 nt, Human
ggccaccagcuccgugacccaggcuggaaugc

SEQ ID NO: 190156 - RNA, 32 nt, Human
ggccaccagcucuggcucgucuugccccagug

SEQ ID NO: 190157 - RNA, 32 nt, Human
ggccaccaggaguucaagaccagcccgggcaa

SEQ ID NO: 190158 - RNA, 32 nt, Human
ggccaccaggcugaggacucgcccaggacaug

SEQ ID NO: 190159 - RNA, 23 nt, Human
ggccaccagggggcgccagagaa

SEQ ID NO: 190160 - RNA, 32 nt, Human
ggccaccauccuggguauccagggccccuccu

SEQ ID NO: 190161 - RNA, 32 nt, Human
ggccaccauggugagaccccgucucuacuaaa

SEQ ID NO: 190162 - RNA, 32 nt, Human
ggccaccauggugugaggagaccaucaccucg

SEQ ID NO: 190163 - RNA, 32 nt, Human
ggccacccaaagugcuaggauuacagguauga

SEQ ID NO: 190164 - RNA, 32 nt, Human
ggccacccaaagugcugggauuacaggcguga

SEQ ID NO: 190165 - RNA, 32 nt, Human
ggccacccaaaguguugggauuauaggcauga

SEQ ID NO: 190166 - RNA, 19 nt, Human
ggccacccaccuccaaguc

SEQ ID NO: 190167 - RNA, 32 nt, Human
ggccacccacgagggccucccggccuagggcc

SEQ ID NO: 190168 - RNA, 19 nt, Human
ggccacccacucagcccag

SEQ ID NO: 190169 - RNA, 23 nt, Human
ggccacccagauccccuaggguc

SEQ ID NO: 190170 - RNA, 18 nt, Human
ggccacccagcuaaucag

SEQ ID NO: 190171 - RNA, 18 nt, Human
ggccacccagcugaccgg

SEQ ID NO: 190172 - RNA, 17 nt, Human
ggccacccaggaccagg

SEQ ID NO: 190173 - RNA, 32 nt, Human
ggccacccaggcagcagccacagcggggagug

SEQ ID NO: 190174 - RNA, 18 nt, Human
ggccacccaggccccagg

SEQ ID NO: 190175 - RNA, 21 nt, Human
ggccacccagggacaaagggu

SEQ ID NO: 190176 - RNA, 32 nt, Human
ggccacccaguacucccuccagccucagcugg

SEQ ID NO: 190177 - RNA, 20 nt, Human
ggccaccccaccgcacaggg

SEQ ID NO: 190178 - RNA, 32 nt, Human
ggccaccccacucuaccuccuuagcuuucccu

SEQ ID NO: 190179 - RNA, 32 nt, Human
ggccaccccagggccauuaacaaccaguacuc

SEQ ID NO: 190180 - RNA, 22 nt, Human
ggccaccccauguccagcacuu

SEQ ID NO: 190181 - RNA, 23 nt, Human
ggccacccccagcucuggauccc

SEQ ID NO: 190182 - RNA, 32 nt, Human
ggccacccccagggagggugaugcuuccaagc

SEQ ID NO: 190183 - RNA, 21 nt, Human
ggccaccccccacagccucca

SEQ ID NO: 190184 - RNA, 18 nt, Human
ggccaccccgagcccagg

SEQ ID NO: 190185 - RNA, 19 nt, Human
ggccaccccgaguccgccu

SEQ ID NO: 190186 - RNA, 19 nt, Human
ggccaccccucccacccca

SEQ ID NO: 190187 - RNA, 22 nt, Human
ggccacccgcgaguccagcguc

SEQ ID NO: 190188 - RNA, 32 nt, Human
ggccacccucaggaaaugcacucggcaucugc

SEQ ID NO: 190189 - RNA, 16 nt, Human
ggccacccugcccagg

SEQ ID NO: 190190 - RNA, 32 nt, Human
ggccacccugcuccccaccuuguccagccuga

SEQ ID NO: 190191 - RNA, 20 nt, Human
ggccacccuugcccaguguc

SEQ ID NO: 190192 - RNA, 32 nt, Human
ggccaccgagaggcuggggcuggggcugacca

SEQ ID NO: 190193 - RNA, 32 nt, Human
ggccaccgaucuguaucuguugaaugccucuu

SEQ ID NO: 190194 - RNA, 32 nt, Human
ggccaccgcagagcccaggaggcagcaucucc

SEQ ID NO: 190195 - RNA, 32 nt, Human
ggccaccgcgccuggccgaggcugcuggaauc

SEQ ID NO: 190196 - RNA, 23 nt, Human
ggccaccgcugccucagccucug

SEQ ID NO: 190197 - RNA, 32 nt, Human
ggccaccgcugccucagccucugccucccagc

SEQ ID NO: 190198 - RNA, 22 nt, Human
ggccaccgggcgccggagccag

SEQ ID NO: 190199 - RNA, 18 nt, Human
ggccaccguuggccccag

SEQ ID NO: 190200 - RNA, 32 nt, Human
ggccaccuaagcucugucuucucccucugccc

SEQ ID NO: 190201 - RNA, 32 nt, Human
ggccaccucaguccugccuggguccuggugcc

SEQ ID NO: 190202 - RNA, 17 nt, Human
ggccaccucauccaggg

SEQ ID NO: 190203 - RNA, 19 nt, Human
ggccaccucauccguaagg

SEQ ID NO: 190204 - RNA, 25 nt, Human
ggccaccucauugggauccacuuca

SEQ ID NO: 190205 - RNA, 18 nt, Human
ggccaccuccaggaacag

SEQ ID NO: 190206 - RNA, 32 nt, Human
ggccaccuccaggcuggcuucagucucccauc

SEQ ID NO: 190207 - RNA, 22 nt, Human
ggccaccucccacagcccucca

SEQ ID NO: 190208 - RNA, 32 nt, Human
ggccaccuccccucaucuuccccgcccugucc

SEQ ID NO: 190209 - RNA, 32 nt, Human
ggccaccucuaacuccuccuccuccucucuuc

SEQ ID NO: 190210 - RNA, 20 nt, Human
ggccaccucuccaagggcuu

SEQ ID NO: 190211 - RNA, 28 nt, Human
ggccaccugaaugcugccuuaucacaag

SEQ ID NO: 190212 - RNA, 32 nt, Human
ggccaccugaggcacauccucucugaaacggc

SEQ ID NO: 190213 - RNA, 32 nt, Human
ggccaccugagugcaggugacaaggaccugac

SEQ ID NO: 190214 - RNA, 32 nt, Human
ggccaccugccucauugccugcccugccagag

SEQ ID NO: 190215 - RNA, 32 nt, Human
ggccaccugccuggcuccugccccaagugccu

SEQ ID NO: 190216 - RNA, 32 nt, Human
ggccaccugcuguucccugggauucauguccu

SEQ ID NO: 190217 - RNA, 32 nt, Human
ggccaccuggaauuuucagucaucucaugaua

SEQ ID NO: 190218 - RNA, 32 nt, Human
ggccaccuucagaagguggaugugguggccga

SEQ ID NO: 190219 - RNA, 22 nt, Human
ggccaccuucuccaacaagcuc

SEQ ID NO: 190220 - RNA, 32 nt, Human
ggccaccuucucccuuuccuggaccccagagu

SEQ ID NO: 190221 - RNA, 24 nt, Human
ggccaccuucuccuuggcaggcuc

SEQ ID NO: 190222 - RNA, 32 nt, Human
ggccaccuugcaggacgcugugguguggaggc

SEQ ID NO: 190223 - RNA, 20 nt, Human
ggccaccuuggcacaaaagc

SEQ ID NO: 190224 - RNA, 21 nt, Human
ggccaccuuucccagccugcc

SEQ ID NO: 190225 - RNA, 32 nt, Human
ggccaccuuuccccagugucugaggcccaggu

SEQ ID NO: 190226 - RNA, 32 nt, Human
ggccaccuuuucucagcuucugaggcugcgau

SEQ ID NO: 190227 - RNA, 32 nt, Human
ggccacgaaucugccugccucccaggcagcug

SEQ ID NO: 190228 - RNA, 32 nt, Human
ggccacgaaucugccugccucccaggcaggug

SEQ ID NO: 190229 - RNA, 32 nt, Human
ggccacgacagggcucugagaggcucaucccu

SEQ ID NO: 190230 - RNA, 32 nt, Human
ggccacgacccuccugaucacucugaggacaa

SEQ ID NO: 190231 - RNA, 32 nt, Human
ggccacgauguaggcuccacuuugccaacuuc

SEQ ID NO: 190232 - RNA, 23 nt, Human
ggccacgcaccccuaccuugcca

SEQ ID NO: 190233 - RNA, 19 nt, Human
ggccacgcagagccgggag

SEQ ID NO: 190234 - RNA, 32 nt, Human
ggccacgcagccgccugcccgggagaacccug

SEQ ID NO: 190235 - RNA, 32 nt, Human
ggccacgcccaacuaauuuuuguauuuuuagu

SEQ ID NO: 190236 - RNA, 21 nt, Human
ggccacgcccaucgccuccag

SEQ ID NO: 190237 - RNA, 18 nt, Human
ggccacgccccgcucccg

SEQ ID NO: 190238 - RNA, 20 nt, Human
ggccacgcccucccucuccc

SEQ ID NO: 190239 - RNA, 27 nt, Human
ggccacgcgaguccggcagcccugugg

SEQ ID NO: 190240 - RNA, 32 nt, Human
ggccacgcugagacggacaggcagcaggggag

SEQ ID NO: 190241 - RNA, 32 nt, Human
ggccacggaaggcauucagugaaggcuuguuu

SEQ ID NO: 190242 - RNA, 32 nt, Human
ggccacggaguucuucagcugcuugaugacca

SEQ ID NO: 190243 - RNA, 32 nt, Human
ggccacggcacuccagccugggugacagagug

SEQ ID NO: 190244 - RNA, 21 nt, Human
ggccacggcaggccaccagcc

SEQ ID NO: 190245 - RNA, 32 nt, Human
ggccacggccuaugcccucccugggccccugu

SEQ ID NO: 190246 - RNA, 32 nt, Human
ggccacggccuccuggcuguguuccugagccc

SEQ ID NO: 190247 - RNA, 32 nt, Human
ggccacggcggcuccagcagggucugguuaag

SEQ ID NO: 190248 - RNA, 32 nt, Human
ggccacggcucugccaugcagcuccugcuggc

SEQ ID NO: 190249 - RNA, 32 nt, Human
ggccacgggacaccucaggugccacccaccuu

SEQ ID NO: 190250 - RNA, 32 nt, Human
ggccacgggaggcggggcugcauggcuggggg

SEQ ID NO: 190251 - RNA, 20 nt, Human
ggccacggguccagcccagc

SEQ ID NO: 190252 - RNA, 32 nt, Human
ggccacggugccagagguucagggagaacagc

SEQ ID NO: 190253 - RNA, 32 nt, Human
ggccacgguggcgccucacuccggggccugcg

SEQ ID NO: 190254 - RNA, 32 nt, Human
ggccacgucacaaccucugaucucagaccgug

SEQ ID NO: 190255 - RNA, 32 nt, Human
ggccacgucauugugcuccugcccugcaggcu

SEQ ID NO: 190256 - RNA, 32 nt, Human
ggccacgugaggacacagugagaagguggccg

SEQ ID NO: 190257 - RNA, 32 nt, Human
ggccacguggagguggugaagcugcugguggg

SEQ ID NO: 190258 - RNA, 32 nt, Human
ggccacguggcaggccacagugcccuaugggc

SEQ ID NO: 190259 - RNA, 32 nt, Human
ggccacgugucacccacgucugcgcuugguca

SEQ ID NO: 190260 - RNA, 32 nt, Human
ggccacgugucccagcccagcguccaguggug

SEQ ID NO: 190261 - RNA, 32 nt, Human
ggccacguugugcggagcuccccugcugguug

SEQ ID NO: 190262 - RNA, 32 nt, Human
ggccacuacacuccagccugggugacagagag

SEQ ID NO: 190263 - RNA, 32 nt, Human
ggccacuauaggaacaaaacaaaaagaaugga

SEQ ID NO: 190264 - RNA, 32 nt, Human
ggccacucaccacucacaccuuccuuggcuuu

SEQ ID NO: 190265 - RNA, 32 nt, Human
ggccacucaggucaucaggugaacuugugacg

SEQ ID NO: 190266 - RNA, 20 nt, Human
ggccacucccucccacccca

SEQ ID NO: 190267 - RNA, 32 nt, Human
ggccacucccugcccccagccuggcuggacag

SEQ ID NO: 190268 - RNA, 32 nt, Human
ggccacucccugcccccagccuggcuugagaa

SEQ ID NO: 190269 - RNA, 32 nt, Human
ggccacuccgccucuucccucccuucgucccu

SEQ ID NO: 190270 - RNA, 32 nt, Human
ggccacuccgugugcaaccgcuccuucuuccc

SEQ ID NO: 190271 - RNA, 32 nt, Human
ggccacuccuaugcagaggucuccgcuugugu

SEQ ID NO: 190272 - RNA, 21 nt, Human
ggccacuccucugcuuccucu

SEQ ID NO: 190273 - RNA, 19 nt, Human
ggccacuccugcugcugcc

SEQ ID NO: 190274 - RNA, 32 nt, Human
ggccacucgccccucccugcccgggguugcca

SEQ ID NO: 190275 - RNA, 32 nt, Human
ggccacucgucuagggcaguggagucugcgug

SEQ ID NO: 190276 - RNA, 32 nt, Human
ggccacucuccccucccucuuccuucccccau

SEQ ID NO: 190277 - RNA, 32 nt, Human
ggccacucugcugagcaucuucucccaggagu

SEQ ID NO: 190278 - RNA, 23 nt, Human
ggccacucuguuucuccacccca

SEQ ID NO: 190279 - RNA, 19 nt, Human
ggccacucuuccugcugcc

SEQ ID NO: 190280 - RNA, 32 nt, Human
ggccacucuuucuucuucacuuucuccagcug

SEQ ID NO: 190281 - RNA, 32 nt, Human
ggccacugaaccauuucaccucuuggaaaaac

SEQ ID NO: 190282 - RNA, 32 nt, Human
ggccacugaaggagggcaggagcaguccuccc

SEQ ID NO: 190283 - RNA, 22 nt, Human
ggccacugacaguccacacuua

SEQ ID NO: 190284 - RNA, 32 nt, Human
ggccacugacaucacgggcuucgggauuuugg

SEQ ID NO: 190285 - RNA, 32 nt, Human
ggccacugagccggggugcaguggcagcggga

SEQ ID NO: 190286 - RNA, 32 nt, Human
ggccacugcaaagauuccagccuggguccagg

SEQ ID NO: 190287 - RNA, 32 nt, Human
ggccacugcaagcuccaccucccagguucaca

SEQ ID NO: 190288 - RNA, 32 nt, Human
ggccacugcaauccagccugggcgauagagug

SEQ ID NO: 190289 - RNA, 32 nt, Human
ggccacugcacuccacccugggcgacagagug

SEQ ID NO: 190290 - RNA, 32 nt, Human
ggccacugcacuccagccugagugacagaaug

SEQ ID NO: 190291 - RNA, 32 nt, Human
ggccacugcacuccagccuggaugacagagug

SEQ ID NO: 190292 - RNA, 32 nt, Human
ggccacugcacuccagcuugggugacagagca

SEQ ID NO: 190293 - RNA, 32 nt, Human
ggccacugcacuccgggcugggcgacagagcg

SEQ ID NO: 190294 - RNA, 32 nt, Human
ggccacugcacucuagccuggcaacagagcaa

SEQ ID NO: 190295 - RNA, 32 nt, Human
ggccacugcacugcaaggugcauuucugucau

SEQ ID NO: 190296 - RNA, 32 nt, Human
ggccacugcacugcagccugugugacaaaggg

SEQ ID NO: 190297 - RNA, 32 nt, Human
ggccacugcaggagaugagaccagccuucugu

SEQ ID NO: 190298 - RNA, 21 nt, Human
ggccacugccauccugcugcc

SEQ ID NO: 190299 - RNA, 32 nt, Human
ggccacugcugaccuggcuggaugcaucgggc

SEQ ID NO: 190300 - RNA, 32 nt, Human
ggccacugcugguuauuuuaagccacaucaca

SEQ ID NO: 190301 - RNA, 32 nt, Human
ggccacuggcaggccuuccugaguuagauuug

SEQ ID NO: 190302 - RNA, 18 nt, Human
ggccacuggcccucugca

SEQ ID NO: 190303 - RNA, 32 nt, Human
ggccacugggcuuucccccucccaggccuccu

SEQ ID NO: 190304 - RNA, 32 nt, Human
ggccacugggcuuuccccuucccaggccuccu

SEQ ID NO: 190305 - RNA, 32 nt, Human
ggccacuggggccaccacccugaccaccacug

SEQ ID NO: 190306 - RNA, 21 nt, Human
ggccacugucuucucuuccuc

SEQ ID NO: 190307 - RNA, 32 nt, Human
ggccacugugccagaugccccugaccagcguu

SEQ ID NO: 190308 - RNA, 32 nt, Human
ggccacugugccaggcucagguggccuccugg

SEQ ID NO: 190309 - RNA, 32 nt, Human
ggccacuuagggaaagauguagaaagaugcua

SEQ ID NO: 190310 - RNA, 32 nt, Human
ggccacuuaugcuaaauacacaauaagauaca

SEQ ID NO: 190311 - RNA, 24 nt, Human
ggccacuucccucuuucugacccc

SEQ ID NO: 190312 - RNA, 25 nt, Human
ggccacuucuccagcucugacccca

SEQ ID NO: 190313 - RNA, 32 nt, Human
ggccacuugcauugcgucuuccaggcugcgug

SEQ ID NO: 190314 - RNA, 32 nt, Human
ggccacuugggaggcugagauaggagaaucgc

SEQ ID NO: 190315 - RNA, 32 nt, Human
ggccacuugugagagcugcuucagccaggacu

SEQ ID NO: 190316 - RNA, 32 nt, Human
ggccacuuuaacuccaaggccuugcucugucu

SEQ ID NO: 190317 - RNA, 22 nt, Human
ggccacuuuccucuccacccca

SEQ ID NO: 190318 - RNA, 32 nt, Human
ggccacuuuucuuuccccuuccuuccuuccuu

SEQ ID NO: 190319 - RNA, 32 nt, Human
ggccagaacagacagccugggcccugccgcag

SEQ ID NO: 190320 - RNA, 32 nt, Human
ggccagaaggagagaagacgugcagggacccc

SEQ ID NO: 190321 - RNA, 32 nt, Human
ggccagaaguaccaggugccccaugaagugcu

SEQ ID NO: 190322 - RNA, 32 nt, Human
ggccagaaguagcuuugcacuuuucuaaacua

SEQ ID NO: 190323 - RNA, 32 nt, Human
ggccagaauggaacgacuucaaagagaacuug

SEQ ID NO: 190324 - RNA, 32 nt, Human
ggccagacacauauguauaaacuuuucagcag

SEQ ID NO: 190325 - RNA, 24 nt, Human
ggccagacaccaccccccacccca

SEQ ID NO: 190326 - RNA, 32 nt, Human
ggccagacaugacuccugcuuccccuuaggaa

SEQ ID NO: 190327 - RNA, 16 nt, Human
ggccagacccggcgag

SEQ ID NO: 190328 - RNA, 32 nt, Human
ggccagacccugcugcucacucagcugcccug

SEQ ID NO: 190329 - RNA, 32 nt, Human
ggccagacccuugcuccaucagagagggcagu

SEQ ID NO: 190330 - RNA, 32 nt, Human
ggccagaccuagaguguccacagcaggccugu

SEQ ID NO: 190331 - RNA, 32 nt, Human
ggccagaccuuggcugugccuccugcucucuu

SEQ ID NO: 190332 - RNA, 32 nt, Human
ggccagacuggucucaaacuccugggcugaaa

SEQ ID NO: 190333 - RNA, 32 nt, Human
ggccagacuucuagccaggcugggcugccagu

SEQ ID NO: 190334 - RNA, 32 nt, Human
ggccagacuucucuccccugcggcucccaccu

SEQ ID NO: 190335 - RNA, 32 nt, Human
ggccagagaacagcagugaaggcagcuggaga

SEQ ID NO: 190336 - RNA, 32 nt, Human
ggccagagacacaccuggcccucagggggcug

SEQ ID NO: 190337 - RNA, 32 nt, Human
ggccagagagaggacuccacugagggagaugg

SEQ ID NO: 190338 - RNA, 16 nt, Human
ggccagagagaggcag

SEQ ID NO: 190339 - RNA, 32 nt, Human
ggccagagaggaggagaaggagggugagagga

SEQ ID NO: 190340 - RNA, 32 nt, Human
ggccagagaggcaccuucucaagcgcaggauu

SEQ ID NO: 190341 - RNA, 32 nt, Human
ggccagagagggaaaaggcaggugcuuuuggc

SEQ ID NO: 190342 - RNA, 32 nt, Human
ggccagagccuggggccuccagccugggacug

SEQ ID NO: 190343 - RNA, 32 nt, Human
ggccagagcugaggccaguccauauuacagug

SEQ ID NO: 190344 - RNA, 32 nt, Human
ggccagagcugguucugcuccugcugcaggga

SEQ ID NO: 190345 - RNA, 32 nt, Human
ggccagagcugucucagaucauggacaggcca

SEQ ID NO: 190346 - RNA, 32 nt, Human
ggccagaggagcuugucuuccuuguccucugu

SEQ ID NO: 190347 - RNA, 32 nt, Human
ggccagaggagggaggggcacagugaagaagg

SEQ ID NO: 190348 - RNA, 32 nt, Human
ggccagaggauaacacuugucucuuaaaaacu

SEQ ID NO: 190349 - RNA, 32 nt, Human
ggccagaggccuaggaaugucaccugggcaca

SEQ ID NO: 190350 - RNA, 31 nt, Human
ggccagaggcucuucuuuauccauccuaugg

SEQ ID NO: 190351 - RNA, 20 nt, Human
ggccagagggaagucugcug

SEQ ID NO: 190352 - RNA, 18 nt, Human
ggccagaggggaaccgcc

SEQ ID NO: 190353 - RNA, 32 nt, Human
ggccagaggugucagccagggugaggaccucu

SEQ ID NO: 190354 - RNA, 32 nt, Human
ggccagaguccccagccccagaucacagauac

SEQ ID NO: 190355 - RNA, 32 nt, Human
ggccagagugcuaggggcagggugaaggcuuc

SEQ ID NO: 190356 - RNA, 32 nt, Human
ggccagaguguuagacucuggaacauaagaag

SEQ ID NO: 190357 - RNA, 32 nt, Human
ggccagauaagcuaggaugagagcagagacuc

SEQ ID NO: 190358 - RNA, 32 nt, Human
ggccagaucccuuccccacggugucuuggagu

SEQ ID NO: 190359 - RNA, 32 nt, Human
ggccagaucggugagguggagcuguccuccua

SEQ ID NO: 190360 - RNA, 32 nt, Human
ggccagaucucaggccagccguuugugcuccu

SEQ ID NO: 190361 - RNA, 32 nt, Human
ggccagaugcagauggcuggagaugggugcag

SEQ ID NO: 190362 - RNA, 31 nt, Human
ggccagaugcugagcauccaggaugaugccu

SEQ ID NO: 190363 - RNA, 32 nt, Human
ggccagaugcugggcaggaaaccccagcggca

SEQ ID NO: 190364 - RNA, 32 nt, Human
ggccagaugcuguucuucacaccagaacguca

SEQ ID NO: 190365 - RNA, 32 nt, Human
ggccagauguacaggacauuguugucugcagu

SEQ ID NO: 190366 - RNA, 32 nt, Human
ggccagauuuuaugcuaaaaaugguaguuugu

SEQ ID NO: 190367 - RNA, 32 nt, Human
ggccagcaaagaggagggguccagagaacagc

SEQ ID NO: 190368 - RNA, 18 nt, Human
ggccagcaagcugaugug

SEQ ID NO: 190369 - RNA, 32 nt, Human
ggccagcaaggugaaaccccaucucuacuaaa

SEQ ID NO: 190370 - RNA, 17 nt, Human
ggccagcaaggugcagg

SEQ ID NO: 190371 - RNA, 20 nt, Human
ggccagcaagguggagugga

SEQ ID NO: 190372 - RNA, 32 nt, Human
ggccagcaaguggcgcugggccacacuggcuu

SEQ ID NO: 190373 - RNA, 32 nt, Human
ggccagcaccccuggcuggaguggguuaaagg

SEQ ID NO: 190374 - RNA, 25 nt, Human
ggccagcaccugggugaaguugcgu

SEQ ID NO: 190375 - RNA, 32 nt, Human
ggccagcaccuguaaucccagcuacucaggag

SEQ ID NO: 190376 - RNA, 32 nt, Human
ggccagcacggugaaaccccgucucugcugaa

SEQ ID NO: 190377 - RNA, 19 nt, Human
ggccagcacugcugcugcc

SEQ ID NO: 190378 - RNA, 22 nt, Human
ggccagcagaaaagugacugga

SEQ ID NO: 190379 - RNA, 23 nt, Human
ggccagcagaccucuuccugagg

SEQ ID NO: 190380 - RNA, 20 nt, Human
ggccagcagaucuccugugg

SEQ ID NO: 190381 - RNA, 32 nt, Human
ggccagcagaugugucgggccuggugagaggg

SEQ ID NO: 190382 - RNA, 32 nt, Human
ggccagcagcagagggcggcggaggaaggguu

SEQ ID NO: 190383 - RNA, 32 nt, Human
ggccagcagccccugcgccaacaccaccuucu

SEQ ID NO: 190384 - RNA, 21 nt, Human
ggccagcagcguggccaugga

SEQ ID NO: 190385 - RNA, 19 nt, Human
ggccagcagggagcucagg

SEQ ID NO: 190386 - RNA, 32 nt, Human
ggccagcagggcagacaccaggaaaagagggc

SEQ ID NO: 190387 - RNA, 32 nt, Human
ggccagcagggcucagaacaacagagacggau

SEQ ID NO: 190388 - RNA, 32 nt, Human
ggccagcaggggcgucguuuuguugccauuuu

SEQ ID NO: 190389 - RNA, 32 nt, Human
ggccagcaguccuucagggaagaugggaggcg

SEQ ID NO: 190390 - RNA, 18 nt, Human
ggccagcagugggggcug

SEQ ID NO: 190391 - RNA, 32 nt, Human
ggccagcagugugggagcaggaggggaaggau

SEQ ID NO: 190392 - RNA, 32 nt, Human
ggccagcauagugaaaccccaucucuacuaaa

SEQ ID NO: 190393 - RNA, 32 nt, Human
ggccagcauggcgaaaccccaucucuacuaaa

SEQ ID NO: 190394 - RNA, 32 nt, Human
ggccagcauggugaaaaccuaucucuacuaaa

SEQ ID NO: 190395 - RNA, 32 nt, Human
ggccagcauggugaaaccccaucucuaccaaa

SEQ ID NO: 190396 - RNA, 32 nt, Human
ggccagcauggugaaaccccaucucuacuaaa

SEQ ID NO: 190397 - RNA, 32 nt, Human
ggccagcauggugaaaccccaucucuacuaua

SEQ ID NO: 190398 - RNA, 32 nt, Human
ggccagcauggugaaaccccgucucuacuaaa

SEQ ID NO: 190399 - RNA, 32 nt, Human
ggccagcauggugaaaccccgucuguacuaaa

SEQ ID NO: 190400 - RNA, 32 nt, Human
ggccagcauggugaaacccugucucuacuaaa

SEQ ID NO: 190401 - RNA, 32 nt, Human
ggccagcauggugaaacccugucuuuacuaaa

SEQ ID NO: 190402 - RNA, 32 nt, Human
ggccagcauggugaaaccucaucccucuaaca

SEQ ID NO: 190403 - RNA, 32 nt, Human
ggccagcauggugaaacucugucucuacuaaa

SEQ ID NO: 190404 - RNA, 32 nt, Human
ggccagcauggugagaccccgucucuauuaaa

SEQ ID NO: 190405 - RNA, 32 nt, Human
ggccagccaccaaaccguaccaugccuuaguu

SEQ ID NO: 190406 - RNA, 32 nt, Human
ggccagccagaccaugaacccacugggaggaa

SEQ ID NO: 190407 - RNA, 32 nt, Human
ggccagccagcaccucugccuucucagggaca

SEQ ID NO: 190408 - RNA, 32 nt, Human
ggccagccaugccaccgcccuggccacccugc

SEQ ID NO: 190409 - RNA, 32 nt, Human
ggccagccauuuuucaguagcaggaccugcca

SEQ ID NO: 190410 - RNA, 32 nt, Human
ggccagcccacagccugguguggaggggaguc

SEQ ID NO: 190411 - RNA, 20 nt, Human
ggccagcccacccccagaag

SEQ ID NO: 190412 - RNA, 32 nt, Human
ggccagcccacuccccagccagagagggcuug

SEQ ID NO: 190413 - RNA, 32 nt, Human
ggccagcccagccucugacugcgcaugcccaa

SEQ ID NO: 190414 - RNA, 32 nt, Human
ggccagcccagccuggcucuguucucuguccu

SEQ ID NO: 190415 - RNA, 32 nt, Human
ggccagccccagccaaacacacaaaagcccau

SEQ ID NO: 190416 - RNA, 32 nt, Human
ggccagcccgucuuauggacucugccuugcuu

SEQ ID NO: 190417 - RNA, 17 nt, Human
ggccagcccucccagca

SEQ ID NO: 190418 - RNA, 32 nt, Human
ggccagcccuccuccuccucggaauccugggu

SEQ ID NO: 190419 - RNA, 22 nt, Human
ggccagcccugaccuggcuucu

SEQ ID NO: 190420 - RNA, 32 nt, Human
ggccagcccuggacgaaagaagagggccccuc

SEQ ID NO: 190421 - RNA, 32 nt, Human
ggccagcccuggagguaggcugggaccaagcu

SEQ ID NO: 190422 - RNA, 32 nt, Human
ggccagccuagccugcagcccucccuugcagg

SEQ ID NO: 190423 - RNA, 32 nt, Human
ggccagccuaggaguugccacaugugaggggc

SEQ ID NO: 190424 - RNA, 32 nt, Human
ggccagccuaucugccccaguacugccccagg

SEQ ID NO: 190425 - RNA, 32 nt, Human
ggccagccugggacagcucaucccagccgacu

SEQ ID NO: 190426 - RNA, 32 nt, Human
ggccagccuggggagcucuggccacugcuucc

SEQ ID NO: 190427 - RNA, 32 nt, Human
ggccagccuuuccucucugcgagguucucuca

SEQ ID NO: 190428 - RNA, 23 nt, Human
ggccagcgacagggccccugaga

SEQ ID NO: 190429 - RNA, 18 nt, Human
ggccagcgauuuuugagg

SEQ ID NO: 190430 - RNA, 24 nt, Human
ggccagcgcuggugccagccuucu

SEQ ID NO: 190431 - RNA, 32 nt, Human
ggccagcggaccucagggcggaggcuucccac

SEQ ID NO: 190432 - RNA, 32 nt, Human
ggccagcggagcccugggcuggggcaggagcc

SEQ ID NO: 190433 - RNA, 18 nt, Human
ggccagcggcauccuggg

SEQ ID NO: 190434 - RNA, 20 nt, Human
ggccagcggcuuccgcugag

SEQ ID NO: 190435 - RNA, 32 nt, Human
ggccagcggggagaagagaggcggaacugcug

SEQ ID NO: 190436 - RNA, 32 nt, Human
ggccagcgguguccacccuugcccucagcaag

SEQ ID NO: 190437 - RNA, 18 nt, Human
ggccagcuagaaccaaga

SEQ ID NO: 190438 - RNA, 22 nt, Human
ggccagcucacgccugcuuccu

SEQ ID NO: 190439 - RNA, 32 nt, Human
ggccagcucagggcuuccugcgggugacuguc

SEQ ID NO: 190440 - RNA, 32 nt, Human
ggccagcuccacaucugacuggguucuuacuu

SEQ ID NO: 190441 - RNA, 32 nt, Human
ggccagcuccagggaccccaguugcaggggcc

SEQ ID NO: 190442 - RNA, 32 nt, Human
ggccagcuccauaacauaaaagugcgagguga

SEQ ID NO: 190443 - RNA, 32 nt, Human
ggccagcucccaggacgucucaggugcaggcu

SEQ ID NO: 190444 - RNA, 32 nt, Human
ggccagcucccaggcccuuggaucaccgcggg

SEQ ID NO: 190445 - RNA, 21 nt, Human
ggccagcuccuuuucugugaa

SEQ ID NO: 190446 - RNA, 32 nt, Human
ggccagcucucuggcaucaggcugcuuggaca

SEQ ID NO: 190447 - RNA, 19 nt, Human
ggccagcucugccccaggg

SEQ ID NO: 190448 - RNA, 32 nt, Human
ggccagcugcguucugagccugggcgcagcug

SEQ ID NO: 190449 - RNA, 22 nt, Human
ggccagcugcucaggcucggca

SEQ ID NO: 190450 - RNA, 21 nt, Human
ggccagcugcugccccagagu

SEQ ID NO: 190451 - RNA, 32 nt, Human
ggccagcugcuuccuguccuucagaacacuuc

SEQ ID NO: 190452 - RNA, 32 nt, Human
ggccagcuguguaaaucccaugaaucagagag

SEQ ID NO: 190453 - RNA, 18 nt, Human
ggccagcuugcugcugcc

SEQ ID NO: 190454 - RNA, 32 nt, Human
ggccagcuugggcaagccaagaucagaugucu

SEQ ID NO: 190455 - RNA, 32 nt, Human
ggccaggaagcaugcagggggagugaggaccg

SEQ ID NO: 190456 - RNA, 32 nt, Human
ggccaggaagguaggggagaucaaagagggcu

SEQ ID NO: 190457 - RNA, 19 nt, Human
ggccaggaaguggccggua

SEQ ID NO: 190458 - RNA, 32 nt, Human
ggccaggaaucugccauuacucugcgguggug

SEQ ID NO: 190459 - RNA, 32 nt, Human
ggccaggacaaggggaaggaaaaugaggucaa

SEQ ID NO: 190460 - RNA, 32 nt, Human
ggccaggacacagcccucucucucacagcagu

SEQ ID NO: 190461 - RNA, 17 nt, Human
ggccaggacggccaggu

SEQ ID NO: 190462 - RNA, 32 nt, Human
ggccaggacgugcucccugacucucggcaggg

SEQ ID NO: 190463 - RNA, 32 nt, Human
ggccaggacucugagaucagagcuggggugga

SEQ ID NO: 190464 - RNA, 32 nt, Human
ggccaggacugaaccccuucuccacaccugaa

SEQ ID NO: 190465 - RNA, 32 nt, Human
ggccaggagagccacagccaugauacagggcu

SEQ ID NO: 190466 - RNA, 32 nt, Human
ggccaggagaggggccaagagcgcggcugacc

SEQ ID NO: 190467 - RNA, 32 nt, Human
ggccaggagaggggccgagagcgcggcugacc

SEQ ID NO: 190468 - RNA, 32 nt, Human
ggccaggagaucaagaccauccuggcuaacac

SEQ ID NO: 190469 - RNA, 32 nt, Human
ggccaggagaugagagagaaggucgaguaggu

SEQ ID NO: 190470 - RNA, 32 nt, Human
ggccaggagcagcaggucaugugcacaugccg

SEQ ID NO: 190471 - RNA, 32 nt, Human
ggccaggagccaggaguggggaagggagggau

SEQ ID NO: 190472 - RNA, 18 nt, Human
ggccaggagcuugugccu

SEQ ID NO: 190473 - RNA, 32 nt, Human
ggccaggaggaggaagagucugcagcauuugu

SEQ ID NO: 190474 - RNA, 22 nt, Human
ggccaggaggaugaaaggcccc

SEQ ID NO: 190475 - RNA, 32 nt, Human
ggccaggaggcggagcuugcagugagccgaga

SEQ ID NO: 190476 - RNA, 32 nt, Human
ggccaggaggcugcagcaccagggaaucugug

SEQ ID NO: 190477 - RNA, 32 nt, Human
ggccaggagguugaggcugcagugagcuguga

SEQ ID NO: 190478 - RNA, 32 nt, Human
ggccaggaguaguggcugagcucugugaucgc

SEQ ID NO: 190479 - RNA, 32 nt, Human
ggccaggaguaguggcugaugccugucauccc

SEQ ID NO: 190480 - RNA, 32 nt, Human
ggccaggagugacauuuaagcuagucaguuua

SEQ ID NO: 190481 - RNA, 32 nt, Human
ggccaggaguuagagacugcagugagcuauga

SEQ ID NO: 190482 - RNA, 32 nt, Human
ggccaggaguucgagaccagccuggacaacau

SEQ ID NO: 190483 - RNA, 32 nt, Human
ggccaggaguugcagaccagccuggguaacau

SEQ ID NO: 190484 - RNA, 32 nt, Human
ggccaggaguuggacacgagccuggucaaugu

SEQ ID NO: 190485 - RNA, 32 nt, Human
ggccaggaguuugagaccugccugggcaacau

SEQ ID NO: 190486 - RNA, 32 nt, Human
ggccaggaguuugaggcugcagugagcuauga

SEQ ID NO: 190487 - RNA, 32 nt, Human
ggccaggaguuugaggcugcagugaguuauga

SEQ ID NO: 190488 - RNA, 20 nt, Human
ggccaggauacccucugcca

SEQ ID NO: 190489 - RNA, 32 nt, Human
ggccaggaucagcagguuugaguggauaauug

SEQ ID NO: 190490 - RNA, 32 nt, Human
ggccaggauggacggccaggggccaggcacac

SEQ ID NO: 190491 - RNA, 32 nt, Human
ggccaggauggaggaggccggagcagcggugg

SEQ ID NO: 190492 - RNA, 32 nt, Human
ggccaggaugugggguuggaugggccauuuuc

SEQ ID NO: 190493 - RNA, 32 nt, Human
ggccaggcaagagaaccaggaggcagagcggg

SEQ ID NO: 190494 - RNA, 18 nt, Human
ggccaggcacagcugccc

SEQ ID NO: 190495 - RNA, 19 nt, Human
ggccaggcacggaggcucg

SEQ ID NO: 190496 - RNA, 32 nt, Human
ggccaggcacuugccuuaggacggggccagga

SEQ ID NO: 190497 - RNA, 32 nt, Human
ggccaggcagagaagaccaugggaguucccga

SEQ ID NO: 190498 - RNA, 32 nt, Human
ggccaggcagagcauuuggcuguagggaggcc

SEQ ID NO: 190499 - RNA, 32 nt, Human
ggccaggcagaggcaccccucaccucccggau

SEQ ID NO: 190500 - RNA, 32 nt, Human
ggccaggcagaggcgccccucaccucccggac

SEQ ID NO: 190501 - RNA, 32 nt, Human
ggccaggcagaggugcuccucacuucccagaa

SEQ ID NO: 190502 - RNA, 32 nt, Human
ggccaggcagaugaccucguacucaggagccc

SEQ ID NO: 190503 - RNA, 19 nt, Human
ggccaggcagcggguccag

SEQ ID NO: 190504 - RNA, 32 nt, Human
ggccaggcagcugagggccaggaaagauguga

SEQ ID NO: 190505 - RNA, 32 nt, Human
ggccaggcagcugugggcaaugcuggaggcug

SEQ ID NO: 190506 - RNA, 32 nt, Human
ggccaggcaggcaaaaggagucauggcuucug

SEQ ID NO: 190507 - RNA, 32 nt, Human
ggccaggcaggcagggaucccgcagcgagggg

SEQ ID NO: 190508 - RNA, 32 nt, Human
ggccaggcaggcgccgccugcggagagcaccg

SEQ ID NO: 190509 - RNA, 32 nt, Human
ggccaggcagugcuggagugcguuugcuggca

SEQ ID NO: 190510 - RNA, 32 nt, Human
ggccaggcauaguggugcaugccaguaauccc

SEQ ID NO: 190511 - RNA, 32 nt, Human
ggccaggccaagcugcaaaaggguggagucau

SEQ ID NO: 190512 - RNA, 32 nt, Human
ggccaggcccagacaugucuguccuugugaga

SEQ ID NO: 190513 - RNA, 18 nt, Human
ggccaggcccccagcggg

SEQ ID NO: 190514 - RNA, 20 nt, Human
ggccaggcccccagcgggca

SEQ ID NO: 190515 - RNA, 23 nt, Human
ggccaggcccccucccccacgca

SEQ ID NO: 190516 - RNA, 20 nt, Human
ggccaggcccgacaccuaca

SEQ ID NO: 190517 - RNA, 19 nt, Human
ggccaggcccugcuccuca

SEQ ID NO: 190518 - RNA, 22 nt, Human
ggccaggcccuuuuccugcaug

SEQ ID NO: 190519 - RNA, 32 nt, Human
ggccaggccgagagaccaagcagggaccaugc

SEQ ID NO: 190520 - RNA, 32 nt, Human
ggccaggccggcccuccagccugcugcugcau

SEQ ID NO: 190521 - RNA, 32 nt, Human
ggccaggccggucucgaacuccuggccuuaag

SEQ ID NO: 190522 - RNA, 16 nt, Human
ggccaggccucacaga

SEQ ID NO: 190523 - RNA, 32 nt, Human
ggccaggccucauucuccucuggccucuaaua

SEQ ID NO: 190524 - RNA, 32 nt, Human
ggccaggccugcagacccagacuccagccaga

SEQ ID NO: 190525 - RNA, 32 nt, Human
ggccaggccuggggcuuggugucugacugucg

SEQ ID NO: 190526 - RNA, 18 nt, Human
ggccaggccugggucuag

SEQ ID NO: 190527 - RNA, 19 nt, Human
ggccaggccuguagucuca

SEQ ID NO: 190528 - RNA, 32 nt, Human
ggccaggcgaugucuaaucagguuccggucag

SEQ ID NO: 190529 - RNA, 18 nt, Human
ggccaggcggggugcuca

SEQ ID NO: 190530 - RNA, 32 nt, Human
ggccaggcgggugcccuuggacagcuuggaag

SEQ ID NO: 190531 - RNA, 32 nt, Human
ggccaggcgguggcaguggagcugcuucugac

SEQ ID NO: 190532 - RNA, 32 nt, Human
ggccaggcuaaggggaaugcagaggagacaca

SEQ ID NO: 190533 - RNA, 19 nt, Human
ggccaggcuagagugcagu

SEQ ID NO: 190534 - RNA, 32 nt, Human
ggccaggcucagagcugagauguggccugaac

SEQ ID NO: 190535 - RNA, 32 nt, Human
ggccaggcucaggggcagaggcugggacacaa

SEQ ID NO: 190536 - RNA, 32 nt, Human
ggccaggcuccuggcaaccucucuugcuagag

SEQ ID NO: 190537 - RNA, 32 nt, Human
ggccaggcucgaagcagucucuguuuccagca

SEQ ID NO: 190538 - RNA, 32 nt, Human
ggccaggcucugagccacugagcaccagcugg

SEQ ID NO: 190539 - RNA, 32 nt, Human
ggccaggcuggaggcagggauggggacagggu

SEQ ID NO: 190540 - RNA, 19 nt, Human
ggccaggcuggagugcagu

SEQ ID NO: 190541 - RNA, 20 nt, Human
ggccaggcuggagugcagug

SEQ ID NO: 190542 - RNA, 32 nt, Human
ggccaggcuggcuacccuguguacaaguauag

SEQ ID NO: 190543 - RNA, 17 nt, Human
ggccaggcuggguccag

SEQ ID NO: 190544 - RNA, 32 nt, Human
ggccaggcuggucucaaacuccugggcucaag

SEQ ID NO: 190545 - RNA, 32 nt, Human
ggccaggcuggucucaaccucuggaccucagg

SEQ ID NO: 190546 - RNA, 23 nt, Human
ggccaggcuggucucgaauucca

SEQ ID NO: 190547 - RNA, 32 nt, Human
ggccaggcuggucuugaacucccaggcauaag

SEQ ID NO: 190548 - RNA, 32 nt, Human
ggccaggcuguguauuucuuucccaggaaauu

SEQ ID NO: 190549 - RNA, 18 nt, Human
ggccaggcuuccguggcc

SEQ ID NO: 190550 - RNA, 19 nt, Human
ggccaggcuuccugucaga

SEQ ID NO: 190551 - RNA, 32 nt, Human
ggccaggcuugggaaggaaggagggaucaaca

SEQ ID NO: 190552 - RNA, 31 nt, Human
ggccaggcuuggguggagccugugucccaga

SEQ ID NO: 190553 - RNA, 32 nt, Human
ggccaggcuuguuaugaacugaccucaaguga

SEQ ID NO: 190554 - RNA, 32 nt, Human
ggccaggcuuuguagcuccugcagcagcucug

SEQ ID NO: 190555 - RNA, 32 nt, Human
ggccagggaacauuuuuaacagcuucugccgg

SEQ ID NO: 190556 - RNA, 32 nt, Human
ggccagggaagaggaggaagaagaggaggagg

SEQ ID NO: 190557 - RNA, 20 nt, Human
ggccagggacgucaugccca

SEQ ID NO: 190558 - RNA, 32 nt, Human
ggccagggacuggccaggcagccauggcugac

SEQ ID NO: 190559 - RNA, 32 nt, Human
ggccagggagaagcuccucuccccagcccaga

SEQ ID NO: 190560 - RNA, 19 nt, Human
ggccagggagaggcgcagg

SEQ ID NO: 190561 - RNA, 32 nt, Human
ggccagggagcagagcuuccacaagacauuuc

SEQ ID NO: 190562 - RNA, 32 nt, Human
ggccagggagcugcaagagugaggcucagcuc

SEQ ID NO: 190563 - RNA, 19 nt, Human
ggccagggagcugcugcca

SEQ ID NO: 190564 - RNA, 20 nt, Human
ggccagggaggaagaggcag

SEQ ID NO: 190565 - RNA, 32 nt, Human
ggccagggaggcaggggaggcaggagaggcug

SEQ ID NO: 190566 - RNA, 32 nt, Human
ggccagggaggcaguggaggcaggagaggcug

SEQ ID NO: 190567 - RNA, 32 nt, Human
ggccagggaggcauugcugcaggugagccugg

SEQ ID NO: 190568 - RNA, 32 nt, Human
ggccagggaggggaacucagcaguucaggagc

SEQ ID NO: 190569 - RNA, 32 nt, Human
ggccagggaggggagugguggagccagucgcu

SEQ ID NO: 190570 - RNA, 32 nt, Human
ggccagggagguugaggcugcagugagcuaug

SEQ ID NO: 190571 - RNA, 22 nt, Human
ggccagggaugcugcccugcca

SEQ ID NO: 190572 - RNA, 32 nt, Human
ggccagggauggucucuguuccccagcccacc

SEQ ID NO: 190573 - RNA, 23 nt, Human
ggccagggcacacggugcgcccg

SEQ ID NO: 190574 - RNA, 22 nt, Human
ggccagggcacugagggccccg

SEQ ID NO: 190575 - RNA, 19 nt, Human
ggccagggccagaggcccc

SEQ ID NO: 190576 - RNA, 21 nt, Human
ggccagggcccaagacccccg

SEQ ID NO: 190577 - RNA, 22 nt, Human
ggccagggccccucacccugcc

SEQ ID NO: 190578 - RNA, 18 nt, Human
ggccagggccugggccuc

SEQ ID NO: 190579 - RNA, 32 nt, Human
ggccagggccuuuugaacaguaguguccccau

SEQ ID NO: 190580 - RNA, 21 nt, Human
ggccagggcgccccgcccacc

SEQ ID NO: 190581 - RNA, 22 nt, Human
ggccagggcgcgggggccgcca

SEQ ID NO: 190582 - RNA, 21 nt, Human
ggccagggcggagggaggaag

SEQ ID NO: 190583 - RNA, 19 nt, Human
ggccagggcggcagcacca

SEQ ID NO: 190584 - RNA, 32 nt, Human
ggccagggcgggcggagggaggcuguggagag

SEQ ID NO: 190585 - RNA, 21 nt, Human
ggccagggcuaccccaggccc

SEQ ID NO: 190586 - RNA, 32 nt, Human
ggccagggcugcugccugccagccuggggucc

SEQ ID NO: 190587 - RNA, 32 nt, Human
ggccagggcuggucucuggagcuguucugcca

SEQ ID NO: 190588 - RNA, 32 nt, Human
ggccagggcuggucucuguuccccagcccacc

SEQ ID NO: 190589 - RNA, 32 nt, Human
ggccagggcugugcucccugaaguggcuuuga

SEQ ID NO: 190590 - RNA, 21 nt, Human
ggccagggcuguucacgccca

SEQ ID NO: 190591 - RNA, 32 nt, Human
ggccagggcuuauccuggguuggccacuggau

SEQ ID NO: 190592 - RNA, 32 nt, Human
ggccagggcuuccucaaauacaugcacaguca

SEQ ID NO: 190593 - RNA, 22 nt, Human
ggccagggcuuggccuuagcca

SEQ ID NO: 190594 - RNA, 32 nt, Human
ggccaggggaagcagaagggagacucuaggag

SEQ ID NO: 190595 - RNA, 31 nt, Human
ggccaggggaauaugccucagugaugcauuu

SEQ ID NO: 190596 - RNA, 32 nt, Human
ggccaggggagagagaagaggaucagcagugc

SEQ ID NO: 190597 - RNA, 17 nt, Human
ggccaggggaucugaug

SEQ ID NO: 190598 - RNA, 32 nt, Human
ggccaggggaucugcacgucguguuagacaug

SEQ ID NO: 190599 - RNA, 17 nt, Human
ggccaggggcacuguga

SEQ ID NO: 190600 - RNA, 32 nt, Human
ggccaggggccaggcuguuugcgagaccagcc

SEQ ID NO: 190601 - RNA, 32 nt, Human
ggccaggggccugacccucagcacuuucagcc

SEQ ID NO: 190602 - RNA, 32 nt, Human
ggccaggggcuaauggugucacuguguaaagu

SEQ ID NO: 190603 - RNA, 32 nt, Human
ggccaggggcucugcugggaucaaaggacuug

SEQ ID NO: 190604 - RNA, 18 nt, Human
ggccaggggguugugaug

SEQ ID NO: 190605 - RNA, 15 nt, Human
ggccaggggugcagg

SEQ ID NO: 190606 - RNA, 32 nt, Human
ggccaggggugguggagggugggaagagucau

SEQ ID NO: 190607 - RNA, 22 nt, Human
ggccaggguauaaaaagggccc

SEQ ID NO: 190608 - RNA, 32 nt, Human
ggccagggugcugacugucaagcauccccugu

SEQ ID NO: 190609 - RNA, 20 nt, Human
ggccaggguggccagccccg

SEQ ID NO: 190610 - RNA, 23 nt, Human
ggccaggguggccagccccgcca

SEQ ID NO: 190611 - RNA, 32 nt, Human
ggccagggugggaggcaggcagcugccugcuc

SEQ ID NO: 190612 - RNA, 32 nt, Human
ggccagggugggcagaucaugaggucagaagu

SEQ ID NO: 190613 - RNA, 21 nt, Human
ggccaggguguguggagcaag

SEQ ID NO: 190614 - RNA, 24 nt, Human
ggccaggguugccucagaggccaa

SEQ ID NO: 190615 - RNA, 32 nt, Human
ggccagguaagggggugcagcagugaggggua

SEQ ID NO: 190616 - RNA, 32 nt, Human
ggccagguacaacaccuuuuucauacaaggcc

SEQ ID NO: 190617 - RNA, 31 nt, Human
ggccagguacgguucuucacagcagauauag

SEQ ID NO: 190618 - RNA, 22 nt, Human
ggccaggucacugucuacccca

SEQ ID NO: 190619 - RNA, 32 nt, Human
ggccaggucugucuggcuccgguacaggaagg

SEQ ID NO: 190620 - RNA, 28 nt, Human
ggccaggucuguguggacguggaggaag

SEQ ID NO: 190621 - RNA, 32 nt, Human
ggccaggugagguuggggccugugggccgcca

SEQ ID NO: 190622 - RNA, 32 nt, Human
ggccagguggacuguggcagaucaauaaagaa

SEQ ID NO: 190623 - RNA, 32 nt, Human
ggccaggugggaaaugcuuucacuggaccaac

SEQ ID NO: 190624 - RNA, 26 nt, Human
ggccaggugggaacggcugaugugga

SEQ ID NO: 190625 - RNA, 32 nt, Human
ggccaggugguggagacagagacaggcccuga

SEQ ID NO: 190626 - RNA, 32 nt, Human
ggccaggugguggcucaugccuguaaucccag

SEQ ID NO: 190627 - RNA, 16 nt, Human
ggccagguggugguga

SEQ ID NO: 190628 - RNA, 32 nt, Human
ggccagguguggugauucaugccugaaauccc

SEQ ID NO: 190629 - RNA, 32 nt, Human
ggccagguguucuccuggggcgggggcaggca

SEQ ID NO: 190630 - RNA, 30 nt, Human
ggccagguucuccguuagcuccuguggccc

SEQ ID NO: 190631 - RNA, 32 nt, Human
ggccagguuggucucaagcuccugaccucaga

SEQ ID NO: 190632 - RNA, 32 nt, Human
ggccaguaacauugccaauacuaccuaccggc

SEQ ID NO: 190633 - RNA, 20 nt, Human
ggccaguagccuucugcucc

SEQ ID NO: 190634 - RNA, 32 nt, Human
ggccaguaggagacacgacagcacacacagug

SEQ ID NO: 190635 - RNA, 21 nt, Human
ggccaguagugcagcccgugg

SEQ ID NO: 190636 - RNA, 32 nt, Human
ggccaguaucauuuuacccccaccucccaagc

SEQ ID NO: 190637 - RNA, 32 nt, Human
ggccaguauggugaaacccugucucuacuaaa

SEQ ID NO: 190638 - RNA, 32 nt, Human
ggccaguauggugaaacccugucucuccuaaa

SEQ ID NO: 190639 - RNA, 32 nt, Human
ggccagucagauguuucucauccuucuugcuc

SEQ ID NO: 190640 - RNA, 32 nt, Human
ggccagucccccagagcuugggagacuucgau

SEQ ID NO: 190641 - RNA, 32 nt, Human
ggccaguccccugccugugcuccugcugggga

SEQ ID NO: 190642 - RNA, 32 nt, Human
ggccagucccuggugcccuccuggcccugcug

SEQ ID NO: 190643 - RNA, 32 nt, Human
ggccagucucaaacuccugaccucaggugauc

SEQ ID NO: 190644 - RNA, 32 nt, Human
ggccagucucaaacuccugaccucgugauccg

SEQ ID NO: 190645 - RNA, 32 nt, Human
ggccagucucaaacuccuggacucaagcaauc

SEQ ID NO: 190646 - RNA, 32 nt, Human
ggccagucucaaacuccuggccucaugugauc

SEQ ID NO: 190647 - RNA, 21 nt, Human
ggccagucucuccugaccuca

SEQ ID NO: 190648 - RNA, 32 nt, Human
ggccagucugccagcugaguccugguuuugga

SEQ ID NO: 190649 - RNA, 32 nt, Human
ggccagugacagaccccaaggacucuaggcua

SEQ ID NO: 190650 - RNA, 32 nt, Human
ggccagugacagagaaggcagaggggagugug

SEQ ID NO: 190651 - RNA, 32 nt, Human
ggccagugcaggaauccagguaguggaggaug

SEQ ID NO: 190652 - RNA, 32 nt, Human
ggccagugcccagguuagugagcagugcccgg

SEQ ID NO: 190653 - RNA, 19 nt, Human
ggccagugcccgccugguu

SEQ ID NO: 190654 - RNA, 18 nt, Human
ggccagugcucaccaggg

SEQ ID NO: 190655 - RNA, 32 nt, Human
ggccagugcucuucugggugauccugguguug

SEQ ID NO: 190656 - RNA, 32 nt, Human
ggccagugcugggugggcauugaggggucaca

SEQ ID NO: 190657 - RNA, 32 nt, Human
ggccagugcuuccccagccccugggccugguc

SEQ ID NO: 190658 - RNA, 32 nt, Human
ggccagugcuuggcaggugcucagggaaugua

SEQ ID NO: 190659 - RNA, 32 nt, Human
ggccagugggaggggguuugggccagugcacc

SEQ ID NO: 190660 - RNA, 32 nt, Human
ggccaguguaaggucgaucccagaggcugauc

SEQ ID NO: 190661 - RNA, 32 nt, Human
ggccagugucaggccagcaggugcagggacag

SEQ ID NO: 190662 - RNA, 32 nt, Human
ggccagugugccaggcacaugucccugucaca

SEQ ID NO: 190663 - RNA, 32 nt, Human
ggccaguguugucugucaugugccagaagcuu

SEQ ID NO: 190664 - RNA, 32 nt, Human
ggccaguguuuuuaacccuccucaaauuccau

SEQ ID NO: 190665 - RNA, 32 nt, Human
ggccaguucuauaaccauccccaaacuagcug

SEQ ID NO: 190666 - RNA, 32 nt, Human
ggccaguucucuuccuccugcgcaccugcccc

SEQ ID NO: 190667 - RNA, 32 nt, Human
ggccaguuguuugagcgguggggaagauuuug

SEQ ID NO: 190668 - RNA, 32 nt, Human
ggccaguuucucccucuucaccccugcgccuc

SEQ ID NO: 190669 - RNA, 32 nt, Human
ggccaguuugaagccugugccucccagcuuaa

SEQ ID NO: 190670 - RNA, 32 nt, Human
ggccaguuuggaggcaggcguugagcugugca

SEQ ID NO: 190671 - RNA, 32 nt, Human
ggccauacuuuggcccacacuauucuuuccac

SEQ ID NO: 190672 - RNA, 32 nt, Human
ggccauagaacagcugagcuguggagcuggac

SEQ ID NO: 190673 - RNA, 32 nt, Human
ggccauagcugaagcuguggggccaguugaua

SEQ ID NO: 190674 - RNA, 32 nt, Human
ggccauagggagggagauucgcuacggaucca

SEQ ID NO: 190675 - RNA, 32 nt, Human
ggccauaguugagaauuuugacuugggauacu

SEQ ID NO: 190676 - RNA, 24 nt, Human
ggccauaguuugagccacagagaa

SEQ ID NO: 190677 - RNA, 32 nt, Human
ggccauauaaagucaccugaggcccucuccac

SEQ ID NO: 190678 - RNA, 32 nt, Human
ggccauauaagggaaggagcucagggaggccu

SEQ ID NO: 190679 - RNA, 32 nt, Human
ggccauauccacccauugacucugccuucauc

SEQ ID NO: 190680 - RNA, 21 nt, Human
ggccauaugacacuccucccg

SEQ ID NO: 190681 - RNA, 32 nt, Human
ggccauauggccugggcgcugggucguggagg

SEQ ID NO: 190682 - RNA, 19 nt, Human
ggccauauucuuccugggg

SEQ ID NO: 190683 - RNA, 32 nt, Human
ggccaucaacaucgcagaugagcugccccgcu

SEQ ID NO: 190684 - RNA, 17 nt, Human
ggccaucacaccuggau

SEQ ID NO: 190685 - RNA, 31 nt, Human
ggccaucacagcugcgugccugggggccgug

SEQ ID NO: 190686 - RNA, 32 nt, Human
ggccaucacaucaacagaaaaccccucccagu

SEQ ID NO: 190687 - RNA, 19 nt, Human
ggccaucagaggcucaggc

SEQ ID NO: 190688 - RNA, 32 nt, Human
ggccaucagcgugcacuguucguauuuggagu

SEQ ID NO: 190689 - RNA, 32 nt, Human
ggccaucauggugaaaccccaucucuacuaaa

SEQ ID NO: 190690 - RNA, 32 nt, Human
ggccaucauggugaaacccugucucuacugaa

SEQ ID NO: 190691 - RNA, 32 nt, Human
ggccaucauggugaaauccugucucuagugaa

SEQ ID NO: 190692 - RNA, 32 nt, Human
ggccaucauuugguacagucucauuuccaagu

SEQ ID NO: 190693 - RNA, 32 nt, Human
ggccauccacacccucuccuugucacagaauc

SEQ ID NO: 190694 - RNA, 32 nt, Human
ggccauccccacccccuccaucugccccuguc

SEQ ID NO: 190695 - RNA, 32 nt, Human
ggccauccccgcccccgacuccugcggccggu

SEQ ID NO: 190696 - RNA, 18 nt, Human
ggccaucccucuguugcc

SEQ ID NO: 190697 - RNA, 32 nt, Human
ggccauccuccaaggcucacugugcuucucca

SEQ ID NO: 190698 - RNA, 32 nt, Human
ggccauccucuuucugcugugugucuguguag

SEQ ID NO: 190699 - RNA, 32 nt, Human
ggccauccugugagacacagaguuaaagaagu

SEQ ID NO: 190700 - RNA, 32 nt, Human
ggccaucgagagcggggacacugaccuggugu

SEQ ID NO: 190701 - RNA, 32 nt, Human
ggccaucgccacccuccgcagccauguccacc

SEQ ID NO: 190702 - RNA, 19 nt, Human
ggccaucucugugauccca

SEQ ID NO: 190703 - RNA, 32 nt, Human
ggccaucugacccugagcauugccugcaagug

SEQ ID NO: 190704 - RNA, 32 nt, Human
ggccaucugcugucauugucauugucauaguu

SEQ ID NO: 190705 - RNA, 32 nt, Human
ggccaucuggaaacuuguggacagagaagaag

SEQ ID NO: 190706 - RNA, 32 nt, Human
ggccaucuggggcuccuucuccaccccagccc

SEQ ID NO: 190707 - RNA, 32 nt, Human
ggccaucuucuuucuuccacccacaaacucca

SEQ ID NO: 190708 - RNA, 21 nt, Human
ggccaugaaagccacagagga

SEQ ID NO: 190709 - RNA, 32 nt, Human
ggccaugaaagccacagaggaugggcugagga

SEQ ID NO: 190710 - RNA, 32 nt, Human
ggccaugagacagaaagaaagacugaaaaaga

SEQ ID NO: 190711 - RNA, 32 nt, Human
ggccaugaggcugcaggcuggugcuaugacag

SEQ ID NO: 190712 - RNA, 32 nt, Human
ggccaugagggugggagccggccugggcagcu

SEQ ID NO: 190713 - RNA, 29 nt, Human
ggccaugaguaagaggcagacagcagagg

SEQ ID NO: 190714 - RNA, 32 nt, Human
ggccaugaguuacucgggaggcugaggcagga

SEQ ID NO: 190715 - RNA, 32 nt, Human
ggccaugauagccacuggcagcuuugaagaac

SEQ ID NO: 190716 - RNA, 29 nt, Human
ggccaugcaccuccagcccgccugggcac

SEQ ID NO: 190717 - RNA, 32 nt, Human
ggccaugcagccaugccugcaggaugaucaga

SEQ ID NO: 190718 - RNA, 32 nt, Human
ggccaugcagcugcacuccccucccaggaaag

SEQ ID NO: 190719 - RNA, 19 nt, Human
ggccaugcauccugcugcc

SEQ ID NO: 190720 - RNA, 21 nt, Human
ggccaugcauccugcugccaa

SEQ ID NO: 190721 - RNA, 22 nt, Human
ggccaugccaaacagcacccag

SEQ ID NO: 190722 - RNA, 22 nt, Human
ggccaugccaagcaucccccca

SEQ ID NO: 190723 - RNA, 23 nt, Human
ggccaugccgaagcccaccucua

SEQ ID NO: 190724 - RNA, 21 nt, Human
ggccaugccgucucacccaca

SEQ ID NO: 190725 - RNA, 22 nt, Human
ggccaugccgucucacccacag

SEQ ID NO: 190726 - RNA, 32 nt, Human
ggccaugccgugccaccgucaccagagccagc

SEQ ID NO: 190727 - RNA, 31 nt, Human
ggccaugccuugguggggccugugucgggcg

SEQ ID NO: 190728 - RNA, 32 nt, Human
ggccaugcuccuugaacuuggaaaugucaacc

SEQ ID NO: 190729 - RNA, 32 nt, Human
ggccaugcucuuagcccugcccugugcuacgc

SEQ ID NO: 190730 - RNA, 32 nt, Human
ggccaugcuggggccagaaccccagcccugug

SEQ ID NO: 190731 - RNA, 32 nt, Human
ggccaugcuggucaucggcuugcccaggcucc

SEQ ID NO: 190732 - RNA, 32 nt, Human
ggccauggaaagucaccuucccuuucgguucu

SEQ ID NO: 190733 - RNA, 32 nt, Human
ggccauggagaaagcugacuuggcuggugugg

SEQ ID NO: 190734 - RNA, 32 nt, Human
ggccauggagaagcugguggggaccagaccca

SEQ ID NO: 190735 - RNA, 29 nt, Human
ggccauggagcugagcagcaagaagaagc

SEQ ID NO: 190736 - RNA, 21 nt, Human
ggccauggaguguccacaccu

SEQ ID NO: 190737 - RNA, 18 nt, Human
ggccauggcagcuguagu

SEQ ID NO: 190738 - RNA, 32 nt, Human
ggccauggcaggaaguggagccucccaccgaa

SEQ ID NO: 190739 - RNA, 29 nt, Human
ggccauggccagccuggggcugcugcucc

SEQ ID NO: 190740 - RNA, 29 nt, Human
ggccauggcccaggccggcgucgucggug

SEQ ID NO: 190741 - RNA, 29 nt, Human
ggccauggcgugcggagccacucugaaaa

SEQ ID NO: 190742 - RNA, 32 nt, Human
ggccauggcuaugcuucccuggcuccaagggc

SEQ ID NO: 190743 - RNA, 32 nt, Human
ggccaugggaauuauuuagaaugugaucugcc

SEQ ID NO: 190744 - RNA, 32 nt, Human
ggccaugggagauacaauuccaaguucucgcu

SEQ ID NO: 190745 - RNA, 23 nt, Human
ggccaugggaggagcucuaggga

SEQ ID NO: 190746 - RNA, 31 nt, Human
ggccaugggccgaggccuggcauucacguuc

SEQ ID NO: 190747 - RNA, 20 nt, Human
ggccaugggccucugccaga

SEQ ID NO: 190748 - RNA, 21 nt, Human
ggccauggggaacuucaggga

SEQ ID NO: 190749 - RNA, 29 nt, Human
ggccauggggacccaaccagagccuggcc

SEQ ID NO: 190750 - RNA, 29 nt, Human
ggccauggggcucugggcgcuguugccug

SEQ ID NO: 190751 - RNA, 32 nt, Human
ggccaugggggcuacaaaguccagccgaguca

SEQ ID NO: 190752 - RNA, 21 nt, Human
ggccaugggucgcucccgccg

SEQ ID NO: 190753 - RNA, 22 nt, Human
ggccaugguggcucauaccugu

SEQ ID NO: 190754 - RNA, 19 nt, Human
ggccauguagcaagugggg

SEQ ID NO: 190755 - RNA, 32 nt, Human
ggccaugucaguuuucugccaccuacaggaua

SEQ ID NO: 190756 - RNA, 32 nt, Human
ggccaugucauggagauagaccauguagacau

SEQ ID NO: 190757 - RNA, 29 nt, Human
ggccaugucauugucccacuuauaccggg

SEQ ID NO: 190758 - RNA, 32 nt, Human
ggccauguccaguuuauauaguuuacaaaaua

SEQ ID NO: 190759 - RNA, 32 nt, Human
ggccauguccccaggcuuggggauucucugac

SEQ ID NO: 190760 - RNA, 23 nt, Human
ggccauguccccuucuugcugcc

SEQ ID NO: 190761 - RNA, 32 nt, Human
ggccaugugagcacacugugagaagaugccau

SEQ ID NO: 190762 - RNA, 20 nt, Human
ggccaugugcacacagcucc

SEQ ID NO: 190763 - RNA, 23 nt, Human
ggccaugugccgcgccugcuccc

SEQ ID NO: 190764 - RNA, 32 nt, Human
ggccaugugguuuucuccuuccuggccuuggc

SEQ ID NO: 190765 - RNA, 32 nt, Human
ggccauguugcccaggcuggucucgaacuccu

SEQ ID NO: 190766 - RNA, 32 nt, Human
ggccauguuggccaggcugguuucaaacuccu

SEQ ID NO: 190767 - RNA, 32 nt, Human
ggccauuaggcagggcuucaguuccucgccau

SEQ ID NO: 190768 - RNA, 32 nt, Human
ggccauuaugccacuaacuuuaaccuauccca

SEQ ID NO: 190769 - RNA, 32 nt, Human
ggccauuauggugaaaccccgucucuacuaaa

SEQ ID NO: 190770 - RNA, 32 nt, Human
ggccauuauuuucauuuucauuuuuggcucuu

SEQ ID NO: 190771 - RNA, 32 nt, Human
ggccauucaggccuccagccccucucuugucu

SEQ ID NO: 190772 - RNA, 18 nt, Human
ggccauucccagcuccuu

SEQ ID NO: 190773 - RNA, 32 nt, Human
ggccauucgggcagacaccgagcuagcuguag

SEQ ID NO: 190774 - RNA, 32 nt, Human
ggccauucuccccucacccuccucaccuuccu

SEQ ID NO: 190775 - RNA, 18 nt, Human
ggccauugacacauggac

SEQ ID NO: 190776 - RNA, 23 nt, Human
ggccauugcacuccagccucagc

SEQ ID NO: 190777 - RNA, 32 nt, Human
ggccauugcacuccagccugggcaauagggca

SEQ ID NO: 190778 - RNA, 32 nt, Human
ggccauugcacuccagccugggugacagagug

SEQ ID NO: 190779 - RNA, 32 nt, Human
ggccauugcacuccagcgugggcaacagagug

SEQ ID NO: 190780 - RNA, 32 nt, Human
ggccauugcacuucagccugggugacagagug

SEQ ID NO: 190781 - RNA, 32 nt, Human
ggccauugcccagccagauguggucaccucag

SEQ ID NO: 190782 - RNA, 32 nt, Human
ggccauuuccagcagacccucuacccaggcuu

SEQ ID NO: 190783 - RNA, 32 nt, Human
ggccauuuccagccagcucccacccaucuuuu

SEQ ID NO: 190784 - RNA, 32 nt, Human
ggccauuuccauuaugguggcagcccuccauu

SEQ ID NO: 190785 - RNA, 32 nt, Human
ggccauuucccuuucgcaguucuuucaauagg

SEQ ID NO: 190786 - RNA, 32 nt, Human
ggccauuucucaucuaccgucauugccacauc

SEQ ID NO: 190787 - RNA, 32 nt, Human
ggccauuucucccaccuuuacucacacccuuc

SEQ ID NO: 190788 - RNA, 23 nt, Human
ggccauuucuccugguuacccua

SEQ ID NO: 190789 - RNA, 32 nt, Human
ggccauuucuguaguuagugaacagagcagau

SEQ ID NO: 190790 - RNA, 32 nt, Human
ggccauuucuguguuucccuuuaaaccagauc

SEQ ID NO: 190791 - RNA, 32 nt, Human
ggccauuucuucccaucuccaaaaauccagag

SEQ ID NO: 190792 - RNA, 32 nt, Human
ggccauuugccuggcuaguugcugucuacaag

SEQ ID NO: 190793 - RNA, 32 nt, Human
ggccauuuuaucuucagcugaccaauaugccu

SEQ ID NO: 190794 - RNA, 32 nt, Human
ggccauuuucccugcucuuccucaguuguccg

SEQ ID NO: 190795 - RNA, 32 nt, Human
ggccauuuuucuuccugguguuugaaugacuc

SEQ ID NO: 190796 - RNA, 32 nt, Human
ggcccaaaaccucacaauaugggcucccaacc

SEQ ID NO: 190797 - RNA, 20 nt, Human
ggcccaaacccaguuuccuu

SEQ ID NO: 190798 - RNA, 32 nt, Human
ggcccaaagaagcaaggaaccaaauuuaagac

SEQ ID NO: 190799 - RNA, 32 nt, Human
ggcccaaaggcaggagcagcagacaagagugc

SEQ ID NO: 190800 - RNA, 32 nt, Human
ggcccaaauggugaaacccugucucuacuaaa

SEQ ID NO: 190801 - RNA, 32 nt, Human
ggcccaacaagaagguuucuguccuaaucaua

SEQ ID NO: 190802 - RNA, 32 nt, Human
ggcccaacacugcauagcacugugcauaggcc

SEQ ID NO: 190803 - RNA, 32 nt, Human
ggcccaacauaaacaagcuuuggagacaaaca

SEQ ID NO: 190804 - RNA, 18 nt, Human
ggcccaacccccacccca

SEQ ID NO: 190805 - RNA, 32 nt, Human
ggcccaacggggacacaaggaggcagaggagc

SEQ ID NO: 190806 - RNA, 32 nt, Human
ggcccaacucacagucucaaagccuguccucc

SEQ ID NO: 190807 - RNA, 32 nt, Human
ggcccaacuccaggacgccccagcuggcccag

SEQ ID NO: 190808 - RNA, 32 nt, Human
ggcccaacugcggcgucaucccggcuauaagc

SEQ ID NO: 190809 - RNA, 32 nt, Human
ggcccaacuggccggcagccuggugagcccuc

SEQ ID NO: 190810 - RNA, 24 nt, Human
ggcccaacuuccccuggagcucag

SEQ ID NO: 190811 - RNA, 32 nt, Human
ggcccaacuucugauaacuacuugucuuccau

SEQ ID NO: 190812 - RNA, 17 nt, Human
ggcccaacuuuucugcc

SEQ ID NO: 190813 - RNA, 32 nt, Human
ggcccaagacugggcuguaguuacauuaaugc

SEQ ID NO: 190814 - RNA, 25 nt, Human
ggcccaagagcagagucugggccuc

SEQ ID NO: 190815 - RNA, 32 nt, Human
ggcccaagagcagagucugggccucugacucu

SEQ ID NO: 190816 - RNA, 23 nt, Human
ggcccaagagcccgugccacccc

SEQ ID NO: 190817 - RNA, 20 nt, Human
ggcccaagagcugcacucac

SEQ ID NO: 190818 - RNA, 24 nt, Human
ggcccaagcaauccuccugcuuca

SEQ ID NO: 190819 - RNA, 19 nt, Human
ggcccaagcaauccugccu

SEQ ID NO: 190820 - RNA, 24 nt, Human
ggcccaagcaauucucccaccuca

SEQ ID NO: 190821 - RNA, 21 nt, Human
ggcccaagcaggagcugcagc

SEQ ID NO: 190822 - RNA, 20 nt, Human
ggcccaagcaugccccaccc

SEQ ID NO: 190823 - RNA, 24 nt, Human
ggcccaagcgauccuccugccuca

SEQ ID NO: 190824 - RNA, 16 nt, Human
ggcccaagcugccccu

SEQ ID NO: 190825 - RNA, 26 nt, Human
ggcccaagcugccccugacagcacag

SEQ ID NO: 190826 - RNA, 32 nt, Human
ggcccaaggagaggacccaggagaggagucug

SEQ ID NO: 190827 - RNA, 22 nt, Human
ggcccaaggaucuggaugaccu

SEQ ID NO: 190828 - RNA, 32 nt, Human
ggcccaaggaugugaccuugagugucaaggcu

SEQ ID NO: 190829 - RNA, 24 nt, Human
ggcccaagggacaagcugggccuc

SEQ ID NO: 190830 - RNA, 26 nt, Human
ggcccaagggacaagcugggccuccc

SEQ ID NO: 190831 - RNA, 32 nt, Human
ggcccaagggagcagagggaggagaggugagg

SEQ ID NO: 190832 - RNA, 23 nt, Human
ggcccaagggcagaacugcaccc

SEQ ID NO: 190833 - RNA, 23 nt, Human
ggcccaagggccuguccccaucc

SEQ ID NO: 190834 - RNA, 22 nt, Human
ggcccaaggucccagcugcucg

SEQ ID NO: 190835 - RNA, 17 nt, Human
ggcccaagucguucuca

SEQ ID NO: 190836 - RNA, 32 nt, Human
ggcccaagucugucuuugacucugccuauccc

SEQ ID NO: 190837 - RNA, 23 nt, Human
ggcccaagugaaggccagaguga

SEQ ID NO: 190838 - RNA, 22 nt, Human
ggcccaagugauccuccaauca

SEQ ID NO: 190839 - RNA, 24 nt, Human
ggcccaagugauccucccgucuca

SEQ ID NO: 190840 - RNA, 24 nt, Human
ggcccaagugauccuuccaccuca

SEQ ID NO: 190841 - RNA, 16 nt, Human
ggcccaauccaugcca

SEQ ID NO: 190842 - RNA, 19 nt, Human
ggcccacaacccccacccc

SEQ ID NO: 190843 - RNA, 18 nt, Human
ggcccacaacugggucca

SEQ ID NO: 190844 - RNA, 32 nt, Human
ggcccacaaguuggaggucuaagugcgagggg

SEQ ID NO: 190845 - RNA, 24 nt, Human
ggcccacacacggccccgcccugg

SEQ ID NO: 190846 - RNA, 26 nt, Human
ggcccacacaggcacccuggaucccc

SEQ ID NO: 190847 - RNA, 21 nt, Human
ggcccacaccuacaguuccag

SEQ ID NO: 190848 - RNA, 32 nt, Human
ggcccacaccuguaaucccagcacuuugggag

SEQ ID NO: 190849 - RNA, 26 nt, Human
ggcccacacgggcacccuggaucccc

SEQ ID NO: 190850 - RNA, 22 nt, Human
ggcccacacucccuggguccag

SEQ ID NO: 190851 - RNA, 21 nt, Human
ggcccacacucuccugcugcc

SEQ ID NO: 190852 - RNA, 32 nt, Human
ggcccacacuuguaaucccagcacuuugggag

SEQ ID NO: 190853 - RNA, 32 nt, Human
ggcccacagcacucugaacaggcacagcccuc

SEQ ID NO: 190854 - RNA, 19 nt, Human
ggcccacagcacugcugcc

SEQ ID NO: 190855 - RNA, 32 nt, Human
ggcccacagccccagagagccugucugugcau

SEQ ID NO: 190856 - RNA, 32 nt, Human
ggcccacaggcagggcaagucucgguggcccu

SEQ ID NO: 190857 - RNA, 32 nt, Human
ggcccacaggccaggcuucggugcuaccucag

SEQ ID NO: 190858 - RNA, 20 nt, Human
ggcccacaggcgguccugcc

SEQ ID NO: 190859 - RNA, 20 nt, Human
ggcccacauaucccaucacu

SEQ ID NO: 190860 - RNA, 32 nt, Human
ggcccacaucuguaaucccagcacuuugggag

SEQ ID NO: 190861 - RNA, 32 nt, Human
ggcccacauggugaaacccaugucuacuaaaa

SEQ ID NO: 190862 - RNA, 32 nt, Human
ggcccacauggugaaaccccaucuuuacuaaa

SEQ ID NO: 190863 - RNA, 32 nt, Human
ggcccacauggugaaacccugucucuacuaaa

SEQ ID NO: 190864 - RNA, 19 nt, Human
ggcccacauuuaaguggga

SEQ ID NO: 190865 - RNA, 21 nt, Human
ggcccaccaaguguguaccau

SEQ ID NO: 190866 - RNA, 32 nt, Human
ggcccaccaaguuugaggaggguggugcuuuc

SEQ ID NO: 190867 - RNA, 23 nt, Human
ggcccaccacaaccugcugggcc

SEQ ID NO: 190868 - RNA, 19 nt, Human
ggcccaccagaguccugcu

SEQ ID NO: 190869 - RNA, 32 nt, Human
ggcccaccagccgccacacacagcuugggccu

SEQ ID NO: 190870 - RNA, 32 nt, Human
ggcccaccauggcucucgggccugugccccuc

SEQ ID NO: 190871 - RNA, 32 nt, Human
ggcccacccaaccuugaagagagucaagucua

SEQ ID NO: 190872 - RNA, 32 nt, Human
ggcccacccaggccuggagcugggaugcaaug

SEQ ID NO: 190873 - RNA, 32 nt, Human
ggcccacccaguggccgagccugcugcugcuc

SEQ ID NO: 190874 - RNA, 32 nt, Human
ggcccacccaucucccuagcauaaggucugcu

SEQ ID NO: 190875 - RNA, 22 nt, Human
ggcccaccccagagccaagaga

SEQ ID NO: 190876 - RNA, 15 nt, Human
ggcccaccccuccca

SEQ ID NO: 190877 - RNA, 19 nt, Human
ggcccaccccuggcuccac

SEQ ID NO: 190878 - RNA, 32 nt, Human
ggcccacccgggcucgcgucuccguuucuccg

SEQ ID NO: 190879 - RNA, 32 nt, Human
ggcccacccugccuacuucccuacugacaagu

SEQ ID NO: 190880 - RNA, 32 nt, Human
ggcccacccugccugcaccuccgcgggcugac

SEQ ID NO: 190881 - RNA, 32 nt, Human
ggcccaccgagcccugguguggcagcggcuca

SEQ ID NO: 190882 - RNA, 22 nt, Human
ggcccaccgcccauccugcaca

SEQ ID NO: 190883 - RNA, 21 nt, Human
ggcccaccgccucccaccaca

SEQ ID NO: 190884 - RNA, 32 nt, Human
ggcccaccuagaggcuuucuuggucagugccu

SEQ ID NO: 190885 - RNA, 32 nt, Human
ggcccaccuccuggcccucuuggaggucugug

SEQ ID NO: 190886 - RNA, 32 nt, Human
ggcccaccucuucuccaagcuggccuucuguu

SEQ ID NO: 190887 - RNA, 18 nt, Human
ggcccaccuucugcuucc

SEQ ID NO: 190888 - RNA, 32 nt, Human
ggcccacgaaaucugcuacuccguauuauguc

SEQ ID NO: 190889 - RNA, 32 nt, Human
ggcccacgacaguugcucaagagccauuucgg

SEQ ID NO: 190890 - RNA, 20 nt, Human
ggcccacgccuguaauccca

SEQ ID NO: 190891 - RNA, 32 nt, Human
ggcccacgccuguaaucccagcacuuugggag

SEQ ID NO: 190892 - RNA, 32 nt, Human
ggcccacgccuguaaucccagcuacucgggag

SEQ ID NO: 190893 - RNA, 32 nt, Human
ggcccacgccuguaaucccagcuacuuggaag

SEQ ID NO: 190894 - RNA, 31 nt, Human
ggcccacgcugccccuggccuguguuaggca

SEQ ID NO: 190895 - RNA, 32 nt, Human
ggcccacggagcccaccaugccgcgcccggcc

SEQ ID NO: 190896 - RNA, 21 nt, Human
ggcccacgggcagcagaguga

SEQ ID NO: 190897 - RNA, 32 nt, Human
ggcccacgggguaggcggggaggcggaagcgg

SEQ ID NO: 190898 - RNA, 24 nt, Human
ggcccacgguggaggccucaggca

SEQ ID NO: 190899 - RNA, 18 nt, Human
ggcccacgugccccgagc

SEQ ID NO: 190900 - RNA, 32 nt, Human
ggcccacguggaggcugggcaggaagggccug

SEQ ID NO: 190901 - RNA, 23 nt, Human
ggcccacuacagccccagccucc

SEQ ID NO: 190902 - RNA, 32 nt, Human
ggcccacucacgccuucacuccugggcccggg

SEQ ID NO: 190903 - RNA, 21 nt, Human
ggcccacucccaccugcugcc

SEQ ID NO: 190904 - RNA, 21 nt, Human
ggcccacucuacccuacccca

SEQ ID NO: 190905 - RNA, 23 nt, Human
ggcccacucuccucucuccuucu

SEQ ID NO: 190906 - RNA, 19 nt, Human
ggcccacucugccccaggg

SEQ ID NO: 190907 - RNA, 32 nt, Human
ggcccacugaaaccuccaccucccggguucaa

SEQ ID NO: 190908 - RNA, 32 nt, Human
ggcccacugcaaccucugccucccggguucaa

SEQ ID NO: 190909 - RNA, 32 nt, Human
ggcccacugcaaccucugccuccuggguucaa

SEQ ID NO: 190910 - RNA, 24 nt, Human
ggcccacugcaaccucugcuuccu

SEQ ID NO: 190911 - RNA, 32 nt, Human
ggcccacugcaaccucugcuuccuagguucaa

SEQ ID NO: 190912 - RNA, 19 nt, Human
ggcccacugcaagcuccgc

SEQ ID NO: 190913 - RNA, 23 nt, Human
ggcccacugcaagcuccgccucc

SEQ ID NO: 190914 - RNA, 32 nt, Human
ggcccacugcaagcuccgccucccagguucac

SEQ ID NO: 190915 - RNA, 20 nt, Human
ggcccacugcaggacaggug

SEQ ID NO: 190916 - RNA, 32 nt, Human
ggcccacugcucagcccagcuguauguagaag

SEQ ID NO: 190917 - RNA, 32 nt, Human
ggcccacuggaagcauccagaacagcaccacc

SEQ ID NO: 190918 - RNA, 20 nt, Human
ggcccacugugccucagaga

SEQ ID NO: 190919 - RNA, 32 nt, Human
ggcccacugugccucagagaccagggcuccag

SEQ ID NO: 190920 - RNA, 32 nt, Human
ggcccacuuuaugguuugcagauggcuaccuu

SEQ ID NO: 190921 - RNA, 32 nt, Human
ggcccagaaaccagagccauuugucucagacc

SEQ ID NO: 190922 - RNA, 32 nt, Human
ggcccagaaagacuagccagaggccugauggu

SEQ ID NO: 190923 - RNA, 22 nt, Human
ggcccagaacacccagccuccu

SEQ ID NO: 190924 - RNA, 32 nt, Human
ggcccagaacacucauggcacauuuguuuaau

SEQ ID NO: 190925 - RNA, 32 nt, Human
ggcccagaacgguccucacacauccgggugau

SEQ ID NO: 190926 - RNA, 32 nt, Human
ggcccagaacuuucuccagucagccuccacag

SEQ ID NO: 190927 - RNA, 32 nt, Human
ggcccagaacuuucuccagucagccucuacag

SEQ ID NO: 190928 - RNA, 32 nt, Human
ggcccagaagccaucagaauuaucaguggaga

SEQ ID NO: 190929 - RNA, 32 nt, Human
ggcccagaaggaggaggagaugaaggugaagc

SEQ ID NO: 190930 - RNA, 32 nt, Human
ggcccagaagguugcgaugaagaaaagcgggc

SEQ ID NO: 190931 - RNA, 24 nt, Human
ggcccagaauggccuguugccaua

SEQ ID NO: 190932 - RNA, 21 nt, Human
ggcccagacaacucuacccca

SEQ ID NO: 190933 - RNA, 32 nt, Human
ggcccagacaacucuaccccacugccuagaag

SEQ ID NO: 190934 - RNA, 20 nt, Human
ggcccagacacacggucccu

SEQ ID NO: 190935 - RNA, 22 nt, Human
ggcccagacagaaggaucgcuu

SEQ ID NO: 190936 - RNA, 22 nt, Human
ggcccagacagccaggcugugg

SEQ ID NO: 190937 - RNA, 23 nt, Human
ggcccagaccacugucuccaccc

SEQ ID NO: 190938 - RNA, 24 nt, Human
ggcccagaccagccagggcuccuu

SEQ ID NO: 190939 - RNA, 23 nt, Human
ggcccagaccaugcaggcccccu

SEQ ID NO: 190940 - RNA, 23 nt, Human
ggcccagacccaaccuggccccu

SEQ ID NO: 190941 - RNA, 21 nt, Human
ggcccagacccagcccagccu

SEQ ID NO: 190942 - RNA, 20 nt, Human
ggcccagaccccagccuccc

SEQ ID NO: 190943 - RNA, 32 nt, Human
ggcccagaccccaucaccaagacuggccaccc

SEQ ID NO: 190944 - RNA, 20 nt, Human
ggcccagaccccuagucccu

SEQ ID NO: 190945 - RNA, 26 nt, Human
ggcccagaccuacacuuggagcccag

SEQ ID NO: 190946 - RNA, 18 nt, Human
ggcccagaccucgggccc

SEQ ID NO: 190947 - RNA, 32 nt, Human
ggcccagaccuucagaggcucagucuguugag

SEQ ID NO: 190948 - RNA, 20 nt, Human
ggcccagacgccaaagcccu

SEQ ID NO: 190949 - RNA, 21 nt, Human
ggcccagacuauccagaguga

SEQ ID NO: 190950 - RNA, 22 nt, Human
ggcccagacuggcggaucaccu

SEQ ID NO: 190951 - RNA, 32 nt, Human
ggcccagagaagcagaacagcccagagcccca

SEQ ID NO: 190952 - RNA, 20 nt, Human
ggcccagagagccagagugg

SEQ ID NO: 190953 - RNA, 32 nt, Human
ggcccagagagggaggcccaggugcagggagc

SEQ ID NO: 190954 - RNA, 32 nt, Human
ggcccagagaugaccguccuauuugcccaccg

SEQ ID NO: 190955 - RNA, 23 nt, Human
ggcccagagauuuggauucccuu

SEQ ID NO: 190956 - RNA, 32 nt, Human
ggcccagagcagaccugcauaucugagcaaaa

SEQ ID NO: 190957 - RNA, 20 nt, Human
ggcccagagcaguccucccu

SEQ ID NO: 190958 - RNA, 21 nt, Human
ggcccagagccaggccgcccu

SEQ ID NO: 190959 - RNA, 32 nt, Human
ggcccagagcccagagcaaccagcacaauagc

SEQ ID NO: 190960 - RNA, 18 nt, Human
ggcccagagccgggaccc

SEQ ID NO: 190961 - RNA, 20 nt, Human
ggcccagaggaagcccaggg

SEQ ID NO: 190962 - RNA, 21 nt, Human
ggcccagaggcccucucccca

SEQ ID NO: 190963 - RNA, 32 nt, Human
ggcccagaggcugcccucugagguccccacuc

SEQ ID NO: 190964 - RNA, 20 nt, Human
ggcccagaggucuggguccc

SEQ ID NO: 190965 - RNA, 32 nt, Human
ggcccagaguccagccguccagcugcuccuuu

SEQ ID NO: 190966 - RNA, 23 nt, Human
ggcccagaguuuucagggcacag

SEQ ID NO: 190967 - RNA, 19 nt, Human
ggcccagaucacagauccc

SEQ ID NO: 190968 - RNA, 32 nt, Human
ggcccagauccaaggccgcggcccagacccac

SEQ ID NO: 190969 - RNA, 21 nt, Human
ggcccagaucccccugcccca

SEQ ID NO: 190970 - RNA, 21 nt, Human
ggcccagauccuccacuccca

SEQ ID NO: 190971 - RNA, 22 nt, Human
ggcccagauccucuggacuccu

SEQ ID NO: 190972 - RNA, 20 nt, Human
ggcccagaucucugaccaca

SEQ ID NO: 190973 - RNA, 32 nt, Human
ggcccagaucuucucaccuaggacuuuuuaaa

SEQ ID NO: 190974 - RNA, 22 nt, Human
ggcccagaugagccggcagcau

SEQ ID NO: 190975 - RNA, 20 nt, Human
ggcccagaugauggagcaua

SEQ ID NO: 190976 - RNA, 32 nt, Human
ggcccagaugcaggccaucaaggguguggugg

SEQ ID NO: 190977 - RNA, 32 nt, Human
ggcccagauuuguuuguaaagcacuuugacuc

SEQ ID NO: 190978 - RNA, 31 nt, Human
ggcccagcaaacuugguuacauuccucagca

SEQ ID NO: 190979 - RNA, 32 nt, Human
ggcccagcaacagaccuugaagacugaaaucu

SEQ ID NO: 190980 - RNA, 21 nt, Human
ggcccagcacaagcccugcuu

SEQ ID NO: 190981 - RNA, 32 nt, Human
ggcccagcacuagaggaagacaaggaucccgc

SEQ ID NO: 190982 - RNA, 32 nt, Human
ggcccagcacugcccaucccaccccaugaggc

SEQ ID NO: 190983 - RNA, 32 nt, Human
ggcccagcacuuccucagacacaacuucuucc

SEQ ID NO: 190984 - RNA, 21 nt, Human
ggcccagcagacccugcuguc

SEQ ID NO: 190985 - RNA, 32 nt, Human
ggcccagcagaggcgcuccucacaucccggac

SEQ ID NO: 190986 - RNA, 19 nt, Human
ggcccagcagagggaguag

SEQ ID NO: 190987 - RNA, 17 nt, Human
ggcccagcagagggcag

SEQ ID NO: 190988 - RNA, 32 nt, Human
ggcccagcagagggcagcacccccaucauuuu

SEQ ID NO: 190989 - RNA, 32 nt, Human
ggcccagcagcaggagcuccaggcuggcugga

SEQ ID NO: 190990 - RNA, 24 nt, Human
ggcccagcagcaucucagccuccu

SEQ ID NO: 190991 - RNA, 23 nt, Human
ggcccagcagcccagccaucacu

SEQ ID NO: 190992 - RNA, 18 nt, Human
ggcccagcagcucacaga

SEQ ID NO: 190993 - RNA, 32 nt, Human
ggcccagcagcuccuguggccacagcagcuuu

SEQ ID NO: 190994 - RNA, 20 nt, Human
ggcccagcagcugccccugg

SEQ ID NO: 190995 - RNA, 32 nt, Human
ggcccagcaggcggggguuugagcccuggacc

SEQ ID NO: 190996 - RNA, 32 nt, Human
ggcccagcaguccaggagguggagcucucggg

SEQ ID NO: 190997 - RNA, 32 nt, Human
ggcccagcauucuccacccuuaacccugugcu

SEQ ID NO: 190998 - RNA, 32 nt, Human
ggcccagccaacuccuggaaugagccgggagg

SEQ ID NO: 190999 - RNA, 21 nt, Human
ggcccagccacagccacagcc

SEQ ID NO: 191000 - RNA, 18 nt, Human
ggcccagccacagcuccc

SEQ ID NO: 191001 - RNA, 23 nt, Human
ggcccagccaccaggacagcagg

SEQ ID NO: 191002 - RNA, 20 nt, Human
ggcccagccacccccagggg

SEQ ID NO: 191003 - RNA, 32 nt, Human
ggcccagccacguguuugcagcgaccagaguc

SEQ ID NO: 191004 - RNA, 32 nt, Human
ggcccagccacugcacuucaccggaugccguc

SEQ ID NO: 191005 - RNA, 20 nt, Human
ggcccagccagcccucugca

SEQ ID NO: 191006 - RNA, 32 nt, Human
ggcccagccccgagccugccucccucuuggcc

SEQ ID NO: 191007 - RNA, 32 nt, Human
ggcccagccccuccagcuccagcgaccccacc

SEQ ID NO: 191008 - RNA, 19 nt, Human
ggcccagccccucucaguc

SEQ ID NO: 191009 - RNA, 32 nt, Human
ggcccagccccucuccccucugucuugauccc

SEQ ID NO: 191010 - RNA, 32 nt, Human
ggcccagccgccgcccugcuccaggcucuagg

SEQ ID NO: 191011 - RNA, 26 nt, Human
ggcccagccgugcccagcuccaagca

SEQ ID NO: 191012 - RNA, 32 nt, Human
ggcccagccuccaucuucgucucucaggacgg

SEQ ID NO: 191013 - RNA, 18 nt, Human
ggcccagccucuauggcc

SEQ ID NO: 191014 - RNA, 23 nt, Human
ggcccagccucugccucacagca

SEQ ID NO: 191015 - RNA, 18 nt, Human
ggcccagccucugcuguc

SEQ ID NO: 191016 - RNA, 32 nt, Human
ggcccagccugccugccgcaccccuguggccu

SEQ ID NO: 191017 - RNA, 21 nt, Human
ggcccagccuggcccccaagc

SEQ ID NO: 191018 - RNA, 22 nt, Human
ggcccagccuguggccucagca

SEQ ID NO: 191019 - RNA, 32 nt, Human
ggcccagccuucacagcgcuccagaagaagcu

SEQ ID NO: 191020 - RNA, 18 nt, Human
ggcccagccuuccugcug

SEQ ID NO: 191021 - RNA, 20 nt, Human
ggcccagccuuccugcugcc

SEQ ID NO: 191022 - RNA, 32 nt, Human
ggcccagccuucuccccuguuacccauaauuc

SEQ ID NO: 191023 - RNA, 32 nt, Human
ggcccagcggacaaccugggaacacauccugg

SEQ ID NO: 191024 - RNA, 32 nt, Human
ggcccagcguuacuuuucuugauaagaauuua

SEQ ID NO: 191025 - RNA, 32 nt, Human
ggcccagcucaggccucacgguggccucucca

SEQ ID NO: 191026 - RNA, 32 nt, Human
ggcccagcucaggccucgcgguggccucucca

SEQ ID NO: 191027 - RNA, 32 nt, Human
ggcccagcucaugcuucuuugcagccucucca

SEQ ID NO: 191028 - RNA, 18 nt, Human
ggcccagcucccauggcc

SEQ ID NO: 191029 - RNA, 19 nt, Human
ggcccagcuccuccugccu

SEQ ID NO: 191030 - RNA, 20 nt, Human
ggcccagcuccugucccagg

SEQ ID NO: 191031 - RNA, 32 nt, Human
ggcccagcucggaaggugcguggagaaggcuc

SEQ ID NO: 191032 - RNA, 32 nt, Human
ggcccagcucugcccuucaucccuucagcacc

SEQ ID NO: 191033 - RNA, 32 nt, Human
ggcccagcucuggagugcaugugugugugcuc

SEQ ID NO: 191034 - RNA, 32 nt, Human
ggcccagcucuguccuccagagccuagcgucu

SEQ ID NO: 191035 - RNA, 32 nt, Human
ggcccagcugaacccagguuaggggcagauca

SEQ ID NO: 191036 - RNA, 24 nt, Human
ggcccagcugccaaugaaucagua

SEQ ID NO: 191037 - RNA, 21 nt, Human
ggcccagcugccagaccucag

SEQ ID NO: 191038 - RNA, 27 nt, Human
ggcccagcugccagggaagacagagca

SEQ ID NO: 191039 - RNA, 22 nt, Human
ggcccagcuggcuuuugcugcc

SEQ ID NO: 191040 - RNA, 22 nt, Human
ggcccagcugggccuggagcca

SEQ ID NO: 191041 - RNA, 22 nt, Human
ggcccaggaacuggagccacag

SEQ ID NO: 191042 - RNA, 32 nt, Human
ggcccaggaacuguuguuuucucaggauucuu

SEQ ID NO: 191043 - RNA, 22 nt, Human
ggcccaggaagcccacacuaug

SEQ ID NO: 191044 - RNA, 32 nt, Human
ggcccaggaaggugccuggcccagaauaagga

SEQ ID NO: 191045 - RNA, 19 nt, Human
ggcccaggacuugggccuc

SEQ ID NO: 191046 - RNA, 32 nt, Human
ggcccaggagaauaacuuuucccagcugacag

SEQ ID NO: 191047 - RNA, 32 nt, Human
ggcccaggagaccccaccucuggcagagccac

SEQ ID NO: 191048 - RNA, 32 nt, Human
ggcccaggagauccuacucucccccgagcacc

SEQ ID NO: 191049 - RNA, 32 nt, Human
ggcccaggagauggagguugcggugagugggg

SEQ ID NO: 191050 - RNA, 21 nt, Human
ggcccaggagcucugcgccag

SEQ ID NO: 191051 - RNA, 26 nt, Human
ggcccaggaggcagagguugcaguga

SEQ ID NO: 191052 - RNA, 32 nt, Human
ggcccaggaggcagagguugcagugagcugag

SEQ ID NO: 191053 - RNA, 32 nt, Human
ggcccaggaggcagcuggguugcauggagagg

SEQ ID NO: 191054 - RNA, 21 nt, Human
ggcccaggaggcugaagacag

SEQ ID NO: 191055 - RNA, 21 nt, Human
ggcccaggagguccucaagca

SEQ ID NO: 191056 - RNA, 26 nt, Human
ggcccaggagguggagguugcaguga

SEQ ID NO: 191057 - RNA, 32 nt, Human
ggcccaggagguggagguugcagugagccgag

SEQ ID NO: 191058 - RNA, 32 nt, Human
ggcccaggagguuucuucucccugggagggcu

SEQ ID NO: 191059 - RNA, 32 nt, Human
ggcccaggaguucaaggcugcagugagcuaug

SEQ ID NO: 191060 - RNA, 32 nt, Human
ggcccaggaguuugaggcugcagugagccauc

SEQ ID NO: 191061 - RNA, 32 nt, Human
ggcccaggaugguggaggcugaggaacuggca

SEQ ID NO: 191062 - RNA, 32 nt, Human
ggcccaggcaaaugccagugugcaccaggcug

SEQ ID NO: 191063 - RNA, 32 nt, Human
ggcccaggcacuaccugcuggcucccaccuau

SEQ ID NO: 191064 - RNA, 19 nt, Human
ggcccaggcagcuggacag

SEQ ID NO: 191065 - RNA, 32 nt, Human
ggcccaggcaggcgggucaugaggucaggaga

SEQ ID NO: 191066 - RNA, 20 nt, Human
ggcccaggccaaccgugcac

SEQ ID NO: 191067 - RNA, 32 nt, Human
ggcccaggccaagauggagaaggcagccaaug

SEQ ID NO: 191068 - RNA, 23 nt, Human
ggcccaggccagcugaguccguu

SEQ ID NO: 191069 - RNA, 21 nt, Human
ggcccaggccagggcagccag

SEQ ID NO: 191070 - RNA, 21 nt, Human
ggcccaggccccaggagccag

SEQ ID NO: 191071 - RNA, 19 nt, Human
ggcccaggcccgagccccu

SEQ ID NO: 191072 - RNA, 18 nt, Human
ggcccaggcccgcgcccg

SEQ ID NO: 191073 - RNA, 32 nt, Human
ggcccaggcccuccaaccauaaacaguccagg

SEQ ID NO: 191074 - RNA, 23 nt, Human
ggcccaggccgaggaccugccag

SEQ ID NO: 191075 - RNA, 21 nt, Human
ggcccaggccgcagggggccc

SEQ ID NO: 191076 - RNA, 32 nt, Human
ggcccaggccuguaaucccaucacuuugggag

SEQ ID NO: 191077 - RNA, 19 nt, Human
ggcccaggccuguugaucc

SEQ ID NO: 191078 - RNA, 15 nt, Human
ggcccaggcgggcac

SEQ ID NO: 191079 - RNA, 32 nt, Human
ggcccaggcucuccccugacccauccucgcuc

SEQ ID NO: 191080 - RNA, 23 nt, Human
ggcccaggcucuuuggaagacag

SEQ ID NO: 191081 - RNA, 32 nt, Human
ggcccaggcugaagcucagggcccugucugcu

SEQ ID NO: 191082 - RNA, 24 nt, Human
ggcccaggcugccugcagaaccag

SEQ ID NO: 191083 - RNA, 32 nt, Human
ggcccaggcugggagagggagcagggcggcgg

SEQ ID NO: 191084 - RNA, 20 nt, Human
ggcccagggagaggccauga

SEQ ID NO: 191085 - RNA, 32 nt, Human
ggcccagggaggauugcugcucggaugaagga

SEQ ID NO: 191086 - RNA, 32 nt, Human
ggcccagggaggcuaagaguccugccaggauc

SEQ ID NO: 191087 - RNA, 32 nt, Human
ggcccagggcaaaggccucuccccagaggaug

SEQ ID NO: 191088 - RNA, 21 nt, Human
ggcccagggcagcugauuccc

SEQ ID NO: 191089 - RNA, 21 nt, Human
ggcccagggcccagagcccag

SEQ ID NO: 191090 - RNA, 20 nt, Human
ggcccagggcgggggcagcu

SEQ ID NO: 191091 - RNA, 32 nt, Human
ggcccagggcucaggcuaccagcuggacuucu

SEQ ID NO: 191092 - RNA, 32 nt, Human
ggcccagggcugcguuugcuccuggccccuua

SEQ ID NO: 191093 - RNA, 32 nt, Human
ggcccaggggcaagugacaccugcugagagag

SEQ ID NO: 191094 - RNA, 32 nt, Human
ggcccagggggcagcuggaguggugcucuggg

SEQ ID NO: 191095 - RNA, 32 nt, Human
ggcccaggguccagggcccaggagagagaagc

SEQ ID NO: 191096 - RNA, 22 nt, Human
ggcccagggugcgcuggagcac

SEQ ID NO: 191097 - RNA, 32 nt, Human
ggcccaggguggccuugguggcuuccacgugc

SEQ ID NO: 191098 - RNA, 32 nt, Human
ggcccaggguucccagagcagugauggaggag

SEQ ID NO: 191099 - RNA, 32 nt, Human
ggcccaggucaggccucacgguggccucucca

SEQ ID NO: 191100 - RNA, 32 nt, Human
ggcccaggucauggugcuuagaggaggagccu

SEQ ID NO: 191101 - RNA, 21 nt, Human
ggcccaggucccaaaucucuu

SEQ ID NO: 191102 - RNA, 32 nt, Human
ggcccaggucuccucagccucugccccaguuc

SEQ ID NO: 191103 - RNA, 19 nt, Human
ggcccaggucugggccccu

SEQ ID NO: 191104 - RNA, 21 nt, Human
ggcccaggugagcugaagaca

SEQ ID NO: 191105 - RNA, 32 nt, Human
ggcccaggugcaacccccagcccaggaggaga

SEQ ID NO: 191106 - RNA, 21 nt, Human
ggcccagguggggccaggcug

SEQ ID NO: 191107 - RNA, 22 nt, Human
ggcccagguggucccauugcca

SEQ ID NO: 191108 - RNA, 32 nt, Human
ggcccagguggugagcgguuugcaguguccgu

SEQ ID NO: 191109 - RNA, 22 nt, Human
ggcccaggugugcugggccccu

SEQ ID NO: 191110 - RNA, 21 nt, Human
ggcccagguuugcucucccca

SEQ ID NO: 191111 - RNA, 22 nt, Human
ggcccaguagccccacugaagc

SEQ ID NO: 191112 - RNA, 32 nt, Human
ggcccagucacugggaaggagccccagagagc

SEQ ID NO: 191113 - RNA, 32 nt, Human
ggcccagucccauccagagcauggagcccgac

SEQ ID NO: 191114 - RNA, 32 nt, Human
ggcccagucuccaggaucaacacagucaguuu

SEQ ID NO: 191115 - RNA, 32 nt, Human
ggcccagucugcccacaauccuggcccugagc

SEQ ID NO: 191116 - RNA, 32 nt, Human
ggcccagucuuguccuccucugucaccgacuu

SEQ ID NO: 191117 - RNA, 22 nt, Human
ggcccagugagccgggucccuu

SEQ ID NO: 191118 - RNA, 32 nt, Human
ggcccagugauggaagcagcuagugaacgauu

SEQ ID NO: 191119 - RNA, 32 nt, Human
ggcccagugccaggcugggcccaagugucgau

SEQ ID NO: 191120 - RNA, 32 nt, Human
ggcccagugggauugagggggcuggguccccc

SEQ ID NO: 191121 - RNA, 32 nt, Human
ggcccaguggggaggagcaggagccugagccu

SEQ ID NO: 191122 - RNA, 21 nt, Human
ggcccagugggggccagagga

SEQ ID NO: 191123 - RNA, 32 nt, Human
ggcccaguggguggguggggugggguggggca

SEQ ID NO: 191124 - RNA, 21 nt, Human
ggcccaguguccccuucugcc

SEQ ID NO: 191125 - RNA, 20 nt, Human
ggcccaguucucaugcugcc

SEQ ID NO: 191126 - RNA, 23 nt, Human
ggcccauccaagggccacuccac

SEQ ID NO: 191127 - RNA, 32 nt, Human
ggcccaucccagauguuugugauguccugaaa

SEQ ID NO: 191128 - RNA, 32 nt, Human
ggcccauccccaggcaccucacaggccccagg

SEQ ID NO: 191129 - RNA, 32 nt, Human
ggcccauccuagaccagaggagcccaggcccu

SEQ ID NO: 191130 - RNA, 32 nt, Human
ggcccauccucccacaucuugccauuaccagu

SEQ ID NO: 191131 - RNA, 21 nt, Human
ggcccaucgagccggguccag

SEQ ID NO: 191132 - RNA, 32 nt, Human
ggcccaucucagaauuaacgcuuugauggcau

SEQ ID NO: 191133 - RNA, 32 nt, Human
ggcccaucucagaauugcaaaucugucagguu

SEQ ID NO: 191134 - RNA, 19 nt, Human
ggcccaucucuucugugcc

SEQ ID NO: 191135 - RNA, 19 nt, Human
ggcccaucugccugcugcc

SEQ ID NO: 191136 - RNA, 32 nt, Human
ggcccaucugcuucugucggugccucagugcc

SEQ ID NO: 191137 - RNA, 32 nt, Human
ggcccaucugucuccccuuggggccaccucuc

SEQ ID NO: 191138 - RNA, 32 nt, Human
ggcccaucuucugugggccccuucccagacac

SEQ ID NO: 191139 - RNA, 32 nt, Human
ggcccaugaaagucuuacugggcccuggggaa

SEQ ID NO: 191140 - RNA, 21 nt, Human
ggcccaugaggccauccaggu

SEQ ID NO: 191141 - RNA, 32 nt, Human
ggcccaugauccucaucggugggugcccauca

SEQ ID NO: 191142 - RNA, 32 nt, Human
ggcccaugcacuuggagaccagccugguuccc

SEQ ID NO: 191143 - RNA, 32 nt, Human
ggcccaugcagggugagggaaaggguagaggu

SEQ ID NO: 191144 - RNA, 23 nt, Human
ggcccaugccagcaucccaguga

SEQ ID NO: 191145 - RNA, 32 nt, Human
ggcccaugcccaggaugagggacaggugcagc

SEQ ID NO: 191146 - RNA, 20 nt, Human
ggcccaugccuauaauccca

SEQ ID NO: 191147 - RNA, 32 nt, Human
ggcccaugccuauaaucccagcacuuugggag

SEQ ID NO: 191148 - RNA, 20 nt, Human
ggcccaugccuguaauccca

SEQ ID NO: 191149 - RNA, 32 nt, Human
ggcccaugccuguaaucccagcacuuugggag

SEQ ID NO: 191150 - RNA, 32 nt, Human
ggcccaugccuguaaucccagcacuuuggggg

SEQ ID NO: 191151 - RNA, 32 nt, Human
ggcccaugccuguaaucucagcacucugggag

SEQ ID NO: 191152 - RNA, 22 nt, Human
ggcccaugccuguagccccagc

SEQ ID NO: 191153 - RNA, 22 nt, Human
ggcccaugccuguagucccagc

SEQ ID NO: 191154 - RNA, 32 nt, Human
ggcccaugccuguagucccagcuacucaggag

SEQ ID NO: 191155 - RNA, 32 nt, Human
ggcccaugccuguagugccagcauuuugggag

SEQ ID NO: 191156 - RNA, 32 nt, Human
ggcccaugccuguuaucccagcacuuggggag

SEQ ID NO: 191157 - RNA, 32 nt, Human
ggcccaugcucuggcagagagacucggaguaa

SEQ ID NO: 191158 - RNA, 31 nt, Human
ggcccauggacaaucuccaccucacgcuucu

SEQ ID NO: 191159 - RNA, 32 nt, Human
ggcccauggauuugaaagaagcugcugcaccc

SEQ ID NO: 191160 - RNA, 21 nt, Human
ggcccauggcugauuuuacca

SEQ ID NO: 191161 - RNA, 32 nt, Human
ggcccauggcuucacacugggcucaggcugcg

SEQ ID NO: 191162 - RNA, 21 nt, Human
ggcccauggggcugggccccu

SEQ ID NO: 191163 - RNA, 32 nt, Human
ggcccauguaggcugagcucagcugguccauc

SEQ ID NO: 191164 - RNA, 32 nt, Human
ggcccauguauaccuauguaacaaaccugcac

SEQ ID NO: 191165 - RNA, 32 nt, Human
ggcccaugucacaaacccuaucucaggaauuu

SEQ ID NO: 191166 - RNA, 17 nt, Human
ggcccaugugagcauca

SEQ ID NO: 191167 - RNA, 25 nt, Human
ggcccauuaggucccucacuccaca

SEQ ID NO: 191168 - RNA, 32 nt, Human
ggcccauugccaccugaggaaaugccuuggag

SEQ ID NO: 191169 - RNA, 22 nt, Human
ggcccauugcccacccacccau

SEQ ID NO: 191170 - RNA, 32 nt, Human
ggcccauugcccacccacccaucucacuaugc

SEQ ID NO: 191171 - RNA, 32 nt, Human
ggcccauugcuuguaguuaguugauccauguc

SEQ ID NO: 191172 - RNA, 17 nt, Human
ggcccauuuaugucccu

SEQ ID NO: 191173 - RNA, 32 nt, Human
ggcccauuucaucucuggcagugccuuggcgg

SEQ ID NO: 191174 - RNA, 32 nt, Human
ggcccauuucccuccugucucccgggggcucu

SEQ ID NO: 191175 - RNA, 18 nt, Human
ggccccaacuccccaggg

SEQ ID NO: 191176 - RNA, 32 nt, Human
ggccccaagacccaguuccuuuacagaaucaa

SEQ ID NO: 191177 - RNA, 32 nt, Human
ggccccaagaggagaggagaagugcugagguu

SEQ ID NO: 191178 - RNA, 15 nt, Human
ggccccaagccccug

SEQ ID NO: 191179 - RNA, 21 nt, Human
ggccccacacccaccaggguc

SEQ ID NO: 191180 - RNA, 22 nt, Human
ggccccacacccagcccugccu

SEQ ID NO: 191181 - RNA, 19 nt, Human
ggccccacaccgccagcug

SEQ ID NO: 191182 - RNA, 20 nt, Human
ggccccacacuuucugcgcc

SEQ ID NO: 191183 - RNA, 32 nt, Human
ggccccacagcagugugggccgauccuguuua

SEQ ID NO: 191184 - RNA, 32 nt, Human
ggccccacagccgagacgacguguccagugac

SEQ ID NO: 191185 - RNA, 32 nt, Human
ggccccacaguaugucagcuguauaggcaaua

SEQ ID NO: 191186 - RNA, 20 nt, Human
ggccccaccaaaguccugcc

SEQ ID NO: 191187 - RNA, 32 nt, Human
ggccccacccacccucugguccuucugacccc

SEQ ID NO: 191188 - RNA, 32 nt, Human
ggccccacccagcagacugaggggcagaggca

SEQ ID NO: 191189 - RNA, 32 nt, Human
ggccccacccccaggaagcauggauggggaug

SEQ ID NO: 191190 - RNA, 32 nt, Human
ggccccacccccgggcggucacggugacccau

SEQ ID NO: 191191 - RNA, 24 nt, Human
ggccccacccgggccuuccaguga

SEQ ID NO: 191192 - RNA, 32 nt, Human
ggccccacccucaccagccugggcagcagcaa

SEQ ID NO: 191193 - RNA, 23 nt, Human
ggccccacccuggagucuugccu

SEQ ID NO: 191194 - RNA, 18 nt, Human
ggccccaccucuucugcc

SEQ ID NO: 191195 - RNA, 21 nt, Human
ggccccaccugcuccucaggg

SEQ ID NO: 191196 - RNA, 22 nt, Human
ggccccaccuuccaacacuguu

SEQ ID NO: 191197 - RNA, 22 nt, Human
ggccccacgaagcccccagugg

SEQ ID NO: 191198 - RNA, 32 nt, Human
ggccccacguuucaagucaaaucaagcugcug

SEQ ID NO: 191199 - RNA, 32 nt, Human
ggccccacugccucucacugcccgugaguccc

SEQ ID NO: 191200 - RNA, 18 nt, Human
ggccccacugggguccag

SEQ ID NO: 191201 - RNA, 32 nt, Human
ggccccacugugcugcucuucagguccccaca

SEQ ID NO: 191202 - RNA, 32 nt, Human
ggccccacuucuuauccacccuucccucuacc

SEQ ID NO: 191203 - RNA, 32 nt, Human
ggccccacuuucaagucacccuugccacugag

SEQ ID NO: 191204 - RNA, 32 nt, Human
ggccccagaagggugaggggccagcaggaccc

SEQ ID NO: 191205 - RNA, 21 nt, Human
ggccccagaccaagccaagcc

SEQ ID NO: 191206 - RNA, 17 nt, Human
ggccccagacugggccc

SEQ ID NO: 191207 - RNA, 17 nt, Human
ggccccagagccccgca

SEQ ID NO: 191208 - RNA, 32 nt, Human
ggccccagauccuucucucuggaggaagaggg

SEQ ID NO: 191209 - RNA, 19 nt, Human
ggccccagcaagccccagc

SEQ ID NO: 191210 - RNA, 32 nt, Human
ggccccagcaaggcuggagagcagggacgugg

SEQ ID NO: 191211 - RNA, 21 nt, Human
ggccccagccagccccgacgg

SEQ ID NO: 191212 - RNA, 32 nt, Human
ggccccagcccaaacacaucuuguuuucacua

SEQ ID NO: 191213 - RNA, 32 nt, Human
ggccccagcccacuccacccugccagcagcuu

SEQ ID NO: 191214 - RNA, 18 nt, Human
ggccccagcccccagucc

SEQ ID NO: 191215 - RNA, 19 nt, Human
ggccccagccuaccugcac

SEQ ID NO: 191216 - RNA, 32 nt, Human
ggccccagccuccaugcugggucuggagggcc

SEQ ID NO: 191217 - RNA, 32 nt, Human
ggccccagccuccugccugccucuccaaggac

SEQ ID NO: 191218 - RNA, 32 nt, Human
ggccccagccuccugcucaucccuccuucuuu

SEQ ID NO: 191219 - RNA, 32 nt, Human
ggccccagccuuccucuucuuccugcucugug

SEQ ID NO: 191220 - RNA, 17 nt, Human
ggccccagcgcccgcac

SEQ ID NO: 191221 - RNA, 20 nt, Human
ggccccagcuccagccccgc

SEQ ID NO: 191222 - RNA, 21 nt, Human
ggccccagcucugcugcugcc

SEQ ID NO: 191223 - RNA, 21 nt, Human
ggccccagcugcuggcggggg

SEQ ID NO: 191224 - RNA, 23 nt, Human
ggccccagcuggcuuagaguagg

SEQ ID NO: 191225 - RNA, 32 nt, Human
ggccccagcuggggccuguugucugggacccu

SEQ ID NO: 191226 - RNA, 21 nt, Human
ggccccagcugggggcagugg

SEQ ID NO: 191227 - RNA, 21 nt, Human
ggccccagcuucccucugcac

SEQ ID NO: 191228 - RNA, 32 nt, Human
ggccccaggaacauuuauuucaucucagcauc

SEQ ID NO: 191229 - RNA, 32 nt, Human
ggccccaggaaggggccauagguaggucugaa

SEQ ID NO: 191230 - RNA, 19 nt, Human
ggccccaggaccucagcac

SEQ ID NO: 191231 - RNA, 32 nt, Human
ggccccaggacuucugaucucaguccucuggg

SEQ ID NO: 191232 - RNA, 22 nt, Human
ggccccaggagagccgcagggg

SEQ ID NO: 191233 - RNA, 25 nt, Human
ggccccaggauggcaggccaccuga

SEQ ID NO: 191234 - RNA, 21 nt, Human
ggccccaggccagccaggccc

SEQ ID NO: 191235 - RNA, 32 nt, Human
ggccccaggccuguuuggaggaugggcugggu

SEQ ID NO: 191236 - RNA, 32 nt, Human
ggccccaggcggugcuucuccccaccaccgcc

SEQ ID NO: 191237 - RNA, 18 nt, Human
ggccccaggcuggugagg

SEQ ID NO: 191238 - RNA, 21 nt, Human
ggccccaggcuuccugccagg

SEQ ID NO: 191239 - RNA, 32 nt, Human
ggccccaggcuuuccccugccucgcggccggg

SEQ ID NO: 191240 - RNA, 32 nt, Human
ggccccagggagagaauggaggacugggagga

SEQ ID NO: 191241 - RNA, 32 nt, Human
ggccccaggggagaaagaggaguagcaugaac

SEQ ID NO: 191242 - RNA, 19 nt, Human
ggccccaggggucuccacc

SEQ ID NO: 191243 - RNA, 32 nt, Human
ggccccaggucaagggcucuugggagacagcu

SEQ ID NO: 191244 - RNA, 21 nt, Human
ggccccaggucgcuugcugcc

SEQ ID NO: 191245 - RNA, 32 nt, Human
ggccccaggugaaaacuccaggcuccaaguag

SEQ ID NO: 191246 - RNA, 23 nt, Human
ggccccaggugcaggccaccacc

SEQ ID NO: 191247 - RNA, 32 nt, Human
ggccccagguggccaccuuccuucccucaagg

SEQ ID NO: 191248 - RNA, 32 nt, Human
ggccccagugccaucuugcccagcuuggcagc

SEQ ID NO: 191249 - RNA, 20 nt, Human
ggccccaguucuucucugcc

SEQ ID NO: 191250 - RNA, 32 nt, Human
ggccccaguucuucucugcccucucucccaag

SEQ ID NO: 191251 - RNA, 32 nt, Human
ggccccauccaccucccucccuugacucccag

SEQ ID NO: 191252 - RNA, 32 nt, Human
ggccccauccauuagcuuccacugccucgugu

SEQ ID NO: 191253 - RNA, 32 nt, Human
ggccccauccauuaguuuccacugccucgugu

SEQ ID NO: 191254 - RNA, 32 nt, Human
ggccccaucccccaccaccauuccuuuccucc

SEQ ID NO: 191255 - RNA, 32 nt, Human
ggccccaucccccauggucaagauccagcugc

SEQ ID NO: 191256 - RNA, 21 nt, Human
ggccccauccucacuuccucu

SEQ ID NO: 191257 - RNA, 22 nt, Human
ggccccaucucuaguuuuucca

SEQ ID NO: 191258 - RNA, 19 nt, Human
ggccccaucugcaaugcca

SEQ ID NO: 191259 - RNA, 32 nt, Human
ggccccaucuguccuuccucacagcacccuca

SEQ ID NO: 191260 - RNA, 31 nt, Human
ggccccauggagguggcggugcccgugaagc

SEQ ID NO: 191261 - RNA, 22 nt, Human
ggccccauggccuugccaguga

SEQ ID NO: 191262 - RNA, 24 nt, Human
ggccccauggucagcccuagggug

SEQ ID NO: 191263 - RNA, 22 nt, Human
ggccccauguccucucugugga

SEQ ID NO: 191264 - RNA, 32 nt, Human
ggccccauguccucuuggaggauuuuucugcc

SEQ ID NO: 191265 - RNA, 18 nt, Human
ggccccauuacugcugcc

SEQ ID NO: 191266 - RNA, 32 nt, Human
ggccccauucaagccuccuccuccaggaagcc

SEQ ID NO: 191267 - RNA, 32 nt, Human
ggccccauuccaccgccuccccaacuugagcc

SEQ ID NO: 191268 - RNA, 22 nt, Human
ggccccauugcccagagcacag

SEQ ID NO: 191269 - RNA, 20 nt, Human
ggccccauugcuuccaugcc

SEQ ID NO: 191270 - RNA, 18 nt, Human
ggcccccaaagagcaagc

SEQ ID NO: 191271 - RNA, 32 nt, Human
ggcccccaaauacucagcauuucagagugagu

SEQ ID NO: 191272 - RNA, 22 nt, Human
ggcccccaaccccuccucccuc

SEQ ID NO: 191273 - RNA, 21 nt, Human
ggcccccaacucaccagcauc

SEQ ID NO: 191274 - RNA, 24 nt, Human
ggcccccaacuccauuuccugucu

SEQ ID NO: 191275 - RNA, 20 nt, Human
ggcccccaagcagaggaggc

SEQ ID NO: 191276 - RNA, 32 nt, Human
ggcccccaagcagaggaggcugcaccucccuc

SEQ ID NO: 191277 - RNA, 20 nt, Human
ggcccccaagccggcggggc

SEQ ID NO: 191278 - RNA, 18 nt, Human
ggcccccaagccuuggua

SEQ ID NO: 191279 - RNA, 32 nt, Human
ggcccccaaggcucucuggccucuguuuccuu

SEQ ID NO: 191280 - RNA, 20 nt, Human
ggcccccaaucaucagaagg

SEQ ID NO: 191281 - RNA, 32 nt, Human
ggcccccaaugccugcccaucccaccccagca

SEQ ID NO: 191282 - RNA, 19 nt, Human
ggcccccacacccccuccu

SEQ ID NO: 191283 - RNA, 32 nt, Human
ggcccccaccacugcuuguuccgagcuccccc

SEQ ID NO: 191284 - RNA, 19 nt, Human
ggcccccacccaguccugc

SEQ ID NO: 191285 - RNA, 16 nt, Human
ggcccccaccccggga

SEQ ID NO: 191286 - RNA, 21 nt, Human
ggcccccacccucuugcugcu

SEQ ID NO: 191287 - RNA, 21 nt, Human
ggcccccacccugcugcugcc

SEQ ID NO: 191288 - RNA, 32 nt, Human
ggcccccaccuccaucgcccagccuuuuauua

SEQ ID NO: 191289 - RNA, 32 nt, Human
ggcccccacgacaagucuucuacucuagaaga

SEQ ID NO: 191290 - RNA, 20 nt, Human
ggcccccacugcaccagcaa

SEQ ID NO: 191291 - RNA, 32 nt, Human
ggcccccacugccugucgguugcuuggauucc

SEQ ID NO: 191292 - RNA, 32 nt, Human
ggcccccagaaccuggcuccagccagggggcc

SEQ ID NO: 191293 - RNA, 24 nt, Human
ggcccccagagaacaccugucccc

SEQ ID NO: 191294 - RNA, 32 nt, Human
ggcccccagaggcuuccagucucacugacaca

SEQ ID NO: 191295 - RNA, 32 nt, Human
ggcccccagagggaggucaccugggggcagcu

SEQ ID NO: 191296 - RNA, 32 nt, Human
ggcccccagcaagcucaccgccuccuuggagg

SEQ ID NO: 191297 - RNA, 22 nt, Human
ggcccccagcacacccccgggg

SEQ ID NO: 191298 - RNA, 19 nt, Human
ggcccccagcacugcucca

SEQ ID NO: 191299 - RNA, 32 nt, Human
ggcccccagccacucccuccagcagccugguu

SEQ ID NO: 191300 - RNA, 23 nt, Human
ggcccccagccccuccccuggcu

SEQ ID NO: 191301 - RNA, 20 nt, Human
ggcccccagccccucugccu

SEQ ID NO: 191302 - RNA, 18 nt, Human
ggcccccagccucccccu

SEQ ID NO: 191303 - RNA, 17 nt, Human
ggcccccagccuccccu

SEQ ID NO: 191304 - RNA, 18 nt, Human
ggcccccagccuggucca

SEQ ID NO: 191305 - RNA, 32 nt, Human
ggcccccagcucccaggagggcccacugaccc

SEQ ID NO: 191306 - RNA, 20 nt, Human
ggcccccagcuccccgcggg

SEQ ID NO: 191307 - RNA, 32 nt, Human
ggcccccagcuggcuugaggauuugaucauac

SEQ ID NO: 191308 - RNA, 22 nt, Human
ggcccccagcugguguccugcc

SEQ ID NO: 191309 - RNA, 20 nt, Human
ggcccccaggagcacugccu

SEQ ID NO: 191310 - RNA, 23 nt, Human
ggcccccaggcaaggccaccacc

SEQ ID NO: 191311 - RNA, 32 nt, Human
ggcccccaggcugaggugcacccagaggcccg

SEQ ID NO: 191312 - RNA, 18 nt, Human
ggcccccagggcuggcuu

SEQ ID NO: 191313 - RNA, 32 nt, Human
ggcccccaggggccaccaugccagcugggggc

SEQ ID NO: 191314 - RNA, 32 nt, Human
ggcccccaggugggaaaggcugggcucuuagu

SEQ ID NO: 191315 - RNA, 19 nt, Human
ggcccccagguuccugucu

SEQ ID NO: 191316 - RNA, 24 nt, Human
ggcccccaguccucuucugcugcu

SEQ ID NO: 191317 - RNA, 23 nt, Human
ggcccccagucuacaacccugca

SEQ ID NO: 191318 - RNA, 32 nt, Human
ggcccccaguggggacagggagggggaccugu

SEQ ID NO: 191319 - RNA, 25 nt, Human
ggcccccaugcucccuucucugcca

SEQ ID NO: 191320 - RNA, 32 nt, Human
ggcccccaugggccagggacagugccaaguga

SEQ ID NO: 191321 - RNA, 18 nt, Human
ggcccccaugucugcacc

SEQ ID NO: 191322 - RNA, 26 nt, Human
ggccccccaccaaccagcccccagcc

SEQ ID NO: 191323 - RNA, 16 nt, Human
ggccccccaccagcug

SEQ ID NO: 191324 - RNA, 21 nt, Human
ggccccccaccgccggguccc

SEQ ID NO: 191325 - RNA, 21 nt, Human
ggccccccgcagccccccagc

SEQ ID NO: 191326 - RNA, 25 nt, Human
ggccccccgccccucccucccagcc

SEQ ID NO: 191327 - RNA, 21 nt, Human
ggccccccgcgcccccgcgcg

SEQ ID NO: 191328 - RNA, 21 nt, Human
ggccccccucagccccugccu

SEQ ID NO: 191329 - RNA, 19 nt, Human
ggccccccucucugcugcc

SEQ ID NO: 191330 - RNA, 21 nt, Human
ggccccccuggccccgccugc

SEQ ID NO: 191331 - RNA, 20 nt, Human
ggccccccugugcccaggga

SEQ ID NO: 191332 - RNA, 22 nt, Human
ggccccccuguguccccaguga

SEQ ID NO: 191333 - RNA, 32 nt, Human
ggcccccgagccccaaggccaacagagagaag

SEQ ID NO: 191334 - RNA, 32 nt, Human
ggcccccgaggaggaggaggaggacgcgggcc

SEQ ID NO: 191335 - RNA, 32 nt, Human
ggcccccgaggaggaggaggaggaggaggacg

SEQ ID NO: 191336 - RNA, 20 nt, Human
ggcccccgauccccggcggg

SEQ ID NO: 191337 - RNA, 32 nt, Human
ggcccccgcccccaccgucccacucggugacc

SEQ ID NO: 191338 - RNA, 23 nt, Human
ggcccccgccccccagcccccca

SEQ ID NO: 191339 - RNA, 23 nt, Human
ggcccccgcccccgccccccggg

SEQ ID NO: 191340 - RNA, 17 nt, Human
ggcccccgccccuggga

SEQ ID NO: 191341 - RNA, 19 nt, Human
ggcccccgcccucacccca

SEQ ID NO: 191342 - RNA, 19 nt, Human
ggcccccgcgagcgcaggg

SEQ ID NO: 191343 - RNA, 19 nt, Human
ggcccccgcuccugcugcu

SEQ ID NO: 191344 - RNA, 32 nt, Human
ggcccccgcugucccugguguaaagaagucgc

SEQ ID NO: 191345 - RNA, 32 nt, Human
ggcccccgcuucagucaagaccugccuagaaa

SEQ ID NO: 191346 - RNA, 16 nt, Human
ggcccccggccccggg

SEQ ID NO: 191347 - RNA, 32 nt, Human
ggcccccggcgccgccgcgggaggccgcgccc

SEQ ID NO: 191348 - RNA, 32 nt, Human
ggcccccggcggcuggagcgcggcggcagcgg

SEQ ID NO: 191349 - RNA, 32 nt, Human
ggcccccgggauugguggaucauuggucagug

SEQ ID NO: 191350 - RNA, 19 nt, Human
ggcccccgggcccgucaca

SEQ ID NO: 191351 - RNA, 32 nt, Human
ggcccccggucaagggagagaacucacgucag

SEQ ID NO: 191352 - RNA, 32 nt, Human
ggcccccgucugcugcuggacacagagccaug

SEQ ID NO: 191353 - RNA, 32 nt, Human
ggcccccguucccacccccgccccaggcugga

SEQ ID NO: 191354 - RNA, 32 nt, Human
ggcccccuacagccucagguucugccugagcc

SEQ ID NO: 191355 - RNA, 25 nt, Human
ggcccccuaguucccaaagggagca

SEQ ID NO: 191356 - RNA, 32 nt, Human
ggcccccucaggagaagguggaagagaaaggg

SEQ ID NO: 191357 - RNA, 32 nt, Human
ggcccccucaguuagccuuuuugaggcaaugc

SEQ ID NO: 191358 - RNA, 32 nt, Human
ggcccccuccccaggcuggagaucagacauug

SEQ ID NO: 191359 - RNA, 19 nt, Human
ggcccccuccccuccccca

SEQ ID NO: 191360 - RNA, 19 nt, Human
ggcccccuccccugcugcu

SEQ ID NO: 191361 - RNA, 26 nt, Human
ggcccccucccucccucagcccccca

SEQ ID NO: 191362 - RNA, 20 nt, Human
ggcccccucccucuacugcc

SEQ ID NO: 191363 - RNA, 32 nt, Human
ggcccccuccuccuucucucaggauuucucuu

SEQ ID NO: 191364 - RNA, 19 nt, Human
ggcccccucggcaccgccu

SEQ ID NO: 191365 - RNA, 23 nt, Human
ggcccccucggcaccgccugcuc

SEQ ID NO: 191366 - RNA, 32 nt, Human
ggcccccucuccccacugcccuuuuugagcca

SEQ ID NO: 191367 - RNA, 32 nt, Human
ggcccccucugggcauaccugccuguggagcg

SEQ ID NO: 191368 - RNA, 23 nt, Human
ggcccccugcaaccuccgccucc

SEQ ID NO: 191369 - RNA, 32 nt, Human
ggcccccugcaaccuccgccucccggguucga

SEQ ID NO: 191370 - RNA, 32 nt, Human
ggcccccugcacugccugguccagaaggggug

SEQ ID NO: 191371 - RNA, 32 nt, Human
ggcccccugccugguucucccgccucugcaag

SEQ ID NO: 191372 - RNA, 21 nt, Human
ggcccccuggcgccugcugcu

SEQ ID NO: 191373 - RNA, 32 nt, Human
ggcccccugggaacugggggugcgggaguucu

SEQ ID NO: 191374 - RNA, 22 nt, Human
ggcccccugggugguccaccug

SEQ ID NO: 191375 - RNA, 22 nt, Human
ggcccccugucugucuuccucu

SEQ ID NO: 191376 - RNA, 21 nt, Human
ggcccccuuaccccugcugcu

SEQ ID NO: 191377 - RNA, 21 nt, Human
ggcccccuucccaaggccuua

SEQ ID NO: 191378 - RNA, 20 nt, Human
ggcccccuucugcucccugc

SEQ ID NO: 191379 - RNA, 32 nt, Human
ggcccccuuguuccaggggugccugagccccu

SEQ ID NO: 191380 - RNA, 22 nt, Human
ggcccccuuuccguccuccucu

SEQ ID NO: 191381 - RNA, 21 nt, Human
ggccccgaagccagagccgga

SEQ ID NO: 191382 - RNA, 18 nt, Human
ggccccgaccggguccag

SEQ ID NO: 191383 - RNA, 32 nt, Human
ggccccgagcgaaggaaggaagggaggcgcgc

SEQ ID NO: 191384 - RNA, 32 nt, Human
ggccccgagcucagggcagcugugcuggguga

SEQ ID NO: 191385 - RNA, 32 nt, Human
ggccccgagugccuccccucccucccucugug

SEQ ID NO: 191386 - RNA, 32 nt, Human
ggccccgcaaguccccgggaggcgacggugcc

SEQ ID NO: 191387 - RNA, 23 nt, Human
ggccccgcauagcucucgcugcc

SEQ ID NO: 191388 - RNA, 24 nt, Human
ggccccgcauagcucucgcugcca

SEQ ID NO: 191389 - RNA, 23 nt, Human
ggccccgccaccugcccagcgug

SEQ ID NO: 191390 - RNA, 32 nt, Human
ggccccgccagcccgggucuccgcgcucggag

SEQ ID NO: 191391 - RNA, 21 nt, Human
ggccccgcccacagcaccaag

SEQ ID NO: 191392 - RNA, 21 nt, Human
ggccccgccccagccagggug

SEQ ID NO: 191393 - RNA, 32 nt, Human
ggccccgcccccaggauccuacggauugaggu

SEQ ID NO: 191394 - RNA, 17 nt, Human
ggccccgccccuuccca

SEQ ID NO: 191395 - RNA, 20 nt, Human
ggccccgccccuuuccugcc

SEQ ID NO: 191396 - RNA, 32 nt, Human
ggccccgcccucucacagaggaugggugagga

SEQ ID NO: 191397 - RNA, 25 nt, Human
ggccccgccgagccacagcccccca

SEQ ID NO: 191398 - RNA, 22 nt, Human
ggccccgccgcagcgcccgccg

SEQ ID NO: 191399 - RNA, 22 nt, Human
ggccccgccgcgcucccgcucg

SEQ ID NO: 191400 - RNA, 32 nt, Human
ggccccgccgucucccugccgcaggccccgca

SEQ ID NO: 191401 - RNA, 32 nt, Human
ggccccgccucaccccggcuccugggccccag

SEQ ID NO: 191402 - RNA, 23 nt, Human
ggccccgccucgcgaguccuccu

SEQ ID NO: 191403 - RNA, 32 nt, Human
ggccccgcggagagcgagagacccugcgcacc

SEQ ID NO: 191404 - RNA, 32 nt, Human
ggccccgcggugagccaugauucgccucgggg

SEQ ID NO: 191405 - RNA, 32 nt, Human
ggccccgcgucccagcccugcccagcccgcgc

SEQ ID NO: 191406 - RNA, 32 nt, Human
ggccccgcuccucugaaggaucaccugcccca

SEQ ID NO: 191407 - RNA, 20 nt, Human
ggccccgcugaaccccaggg

SEQ ID NO: 191408 - RNA, 32 nt, Human
ggccccgcuguugggagugugcauuuaacugu

SEQ ID NO: 191409 - RNA, 21 nt, Human
ggccccgcuucagucccaggg

SEQ ID NO: 191410 - RNA, 32 nt, Human
ggccccgcuugccucggcuccugcugcaccaa

SEQ ID NO: 191411 - RNA, 32 nt, Human
ggccccggagccaagagaagaagcagguccca

SEQ ID NO: 191412 - RNA, 21 nt, Human
ggccccggagcggccgcagcg

SEQ ID NO: 191413 - RNA, 32 nt, Human
ggccccggaggacucggcuuccccgcuaaccc

SEQ ID NO: 191414 - RNA, 32 nt, Human
ggccccggagguagagguugcagugagcugag

SEQ ID NO: 191415 - RNA, 18 nt, Human
ggccccggccccccggga

SEQ ID NO: 191416 - RNA, 19 nt, Human
ggccccggcccccgcggga

SEQ ID NO: 191417 - RNA, 32 nt, Human
ggccccggccccuccuggaaucgccugcucgc

SEQ ID NO: 191418 - RNA, 32 nt, Human
ggccccggcucccuccugagcugcgccgugcc

SEQ ID NO: 191419 - RNA, 22 nt, Human
ggccccggcucucgcugcagcg

SEQ ID NO: 191420 - RNA, 24 nt, Human
ggccccgggaaccccagccugcca

SEQ ID NO: 191421 - RNA, 32 nt, Human
ggccccgggaccccgccuccccgccagccccg

SEQ ID NO: 191422 - RNA, 22 nt, Human
ggccccgggccccagcccccca

SEQ ID NO: 191423 - RNA, 32 nt, Human
ggccccgggccuggcccggccgagcgccgcgc

SEQ ID NO: 191424 - RNA, 32 nt, Human
ggccccgggccuggcccuggcacccgcuggcc

SEQ ID NO: 191425 - RNA, 24 nt, Human
ggccccgggcugcgcccucccccg

SEQ ID NO: 191426 - RNA, 32 nt, Human
ggccccgggcugggcagagccuccuccugccg

SEQ ID NO: 191427 - RNA, 32 nt, Human
ggccccgggcuuguuucuccucuuguuuuccu

SEQ ID NO: 191428 - RNA, 32 nt, Human
ggccccggggcaggcucucucuccccagcagu

SEQ ID NO: 191429 - RNA, 23 nt, Human
ggccccgggggaccugccugcuc

SEQ ID NO: 191430 - RNA, 32 nt, Human
ggccccgggggcccagggaugggcaggggcag

SEQ ID NO: 191431 - RNA, 32 nt, Human
ggccccgggggugaagucgcagcuucacuuac

SEQ ID NO: 191432 - RNA, 21 nt, Human
ggccccgguccgcgcccgccg

SEQ ID NO: 191433 - RNA, 20 nt, Human
ggccccggugaccccgggug

SEQ ID NO: 191434 - RNA, 31 nt, Human
ggccccggugcugccugcaugccaagcgcuu

SEQ ID NO: 191435 - RNA, 32 nt, Human
ggccccgguggaggcccggccugggcggcgcc

SEQ ID NO: 191436 - RNA, 32 nt, Human
ggccccgguggccauggggaauaaaccagcau

SEQ ID NO: 191437 - RNA, 25 nt, Human
ggccccgguggcuccaccgcagcgu

SEQ ID NO: 191438 - RNA, 32 nt, Human
ggccccguacugcuuccaucagcuccagcccc

SEQ ID NO: 191439 - RNA, 32 nt, Human
ggccccuaagccacccccagaggucccaucug

SEQ ID NO: 191440 - RNA, 19 nt, Human
ggccccuacacuguggcag

SEQ ID NO: 191441 - RNA, 22 nt, Human
ggccccuacagcgcccggcagc

SEQ ID NO: 191442 - RNA, 32 nt, Human
ggccccuacaggcuggcccugcaauggggccc

SEQ ID NO: 191443 - RNA, 22 nt, Human
ggccccuacccuaagccagcca

SEQ ID NO: 191444 - RNA, 32 nt, Human
ggccccuaccugcuguaagauuauggguccau

SEQ ID NO: 191445 - RNA, 32 nt, Human
ggccccuagcagugcagaacuacaagucccag

SEQ ID NO: 191446 - RNA, 32 nt, Human
ggccccuaugagucaacucacagcuugcgggg

SEQ ID NO: 191447 - RNA, 17 nt, Human
ggccccucaaagccuga

SEQ ID NO: 191448 - RNA, 32 nt, Human
ggccccucagaagauggccagguccaucccgc

SEQ ID NO: 191449 - RNA, 18 nt, Human
ggccccucagcagccuga

SEQ ID NO: 191450 - RNA, 32 nt, Human
ggccccucagccacccuuggucucaugccccg

SEQ ID NO: 191451 - RNA, 20 nt, Human
ggccccucagcccugcugcc

SEQ ID NO: 191452 - RNA, 22 nt, Human
ggccccucagccuggccugcuc

SEQ ID NO: 191453 - RNA, 32 nt, Human
ggccccucagcgucuuucugugccucugaauu

SEQ ID NO: 191454 - RNA, 32 nt, Human
ggccccucagcuucuuucugugccucugaauu

SEQ ID NO: 191455 - RNA, 28 nt, Human
ggccccucagguacgcccucucuucccu

SEQ ID NO: 191456 - RNA, 32 nt, Human
ggccccucaucgugcaguucugugccaaugac

SEQ ID NO: 191457 - RNA, 21 nt, Human
ggccccucaugccccaggcug

SEQ ID NO: 191458 - RNA, 32 nt, Human
ggccccuccaacccucucugcugcuguuucca

SEQ ID NO: 191459 - RNA, 23 nt, Human
ggccccuccaauccuccccgcuc

SEQ ID NO: 191460 - RNA, 32 nt, Human
ggccccuccagccaguacuccaggucucccug

SEQ ID NO: 191461 - RNA, 26 nt, Human
ggccccuccaguuucccucuguccuc

SEQ ID NO: 191462 - RNA, 19 nt, Human
ggccccucccaccgcccgc

SEQ ID NO: 191463 - RNA, 21 nt, Human
ggccccucccagcaccagcuc

SEQ ID NO: 191464 - RNA, 23 nt, Human
ggccccucccagggccgccgcuc

SEQ ID NO: 191465 - RNA, 23 nt, Human
ggccccucccaguaaagccccuc

SEQ ID NO: 191466 - RNA, 24 nt, Human
ggccccuccccaacuccuuccucu

SEQ ID NO: 191467 - RNA, 24 nt, Human
ggccccuccccauccccucccucu

SEQ ID NO: 191468 - RNA, 20 nt, Human
ggccccuccccggccugcuc

SEQ ID NO: 191469 - RNA, 19 nt, Human
ggccccuccccuccccugc

SEQ ID NO: 191470 - RNA, 24 nt, Human
ggccccuccccucucccucccucu

SEQ ID NO: 191471 - RNA, 23 nt, Human
ggccccuccccuggacccgccgc

SEQ ID NO: 191472 - RNA, 32 nt, Human
ggccccucccgcagcaguuccccaccacggcu

SEQ ID NO: 191473 - RNA, 19 nt, Human
ggccccucccggccccugc

SEQ ID NO: 191474 - RNA, 23 nt, Human
ggccccucccggccgcccagcuc

SEQ ID NO: 191475 - RNA, 21 nt, Human
ggccccucccggcgccugccc

SEQ ID NO: 191476 - RNA, 32 nt, Human
ggccccucccucccccuccuccccucuuuuac

SEQ ID NO: 191477 - RNA, 20 nt, Human
ggccccucccucccggcugc

SEQ ID NO: 191478 - RNA, 24 nt, Human
ggccccuccucagcagcgcagggg

SEQ ID NO: 191479 - RNA, 32 nt, Human
ggccccuccuccauuccagcauuucaucugcc

SEQ ID NO: 191480 - RNA, 24 nt, Human
ggccccuccucccucuuuuccucu

SEQ ID NO: 191481 - RNA, 20 nt, Human
ggccccuccucccugcugcc

SEQ ID NO: 191482 - RNA, 21 nt, Human
ggccccuccugcccccacccc

SEQ ID NO: 191483 - RNA, 24 nt, Human
ggccccuccugccuggcccugcuc

SEQ ID NO: 191484 - RNA, 24 nt, Human
ggccccuccuggaaucgccugcuc

SEQ ID NO: 191485 - RNA, 16 nt, Human
ggccccuccuggagcc

SEQ ID NO: 191486 - RNA, 32 nt, Human
ggccccuccuggccaggcaggguuuccccgcg

SEQ ID NO: 191487 - RNA, 23 nt, Human
ggccccuccuguccuccugcucu

SEQ ID NO: 191488 - RNA, 19 nt, Human
ggccccuccuuccugcaga

SEQ ID NO: 191489 - RNA, 32 nt, Human
ggccccucgcagggcccugccgcgccgccuuc

SEQ ID NO: 191490 - RNA, 32 nt, Human
ggccccucggacagcccaucugccuguucuga

SEQ ID NO: 191491 - RNA, 21 nt, Human
ggccccucgggccucugcaca

SEQ ID NO: 191492 - RNA, 19 nt, Human
ggccccucgggcuuccaca

SEQ ID NO: 191493 - RNA, 32 nt, Human
ggccccucgugagcucggcgcccagccuguca

SEQ ID NO: 191494 - RNA, 20 nt, Human
ggccccucuaccaccugcuc

SEQ ID NO: 191495 - RNA, 32 nt, Human
ggccccucuccugcagccccugccccucaccu

SEQ ID NO: 191496 - RNA, 32 nt, Human
ggccccucuccugcaggggccccacacaggca

SEQ ID NO: 191497 - RNA, 32 nt, Human
ggccccucucucuagcagaaaaauagacuaaa

SEQ ID NO: 191498 - RNA, 22 nt, Human
ggccccucucuguccugccucu

SEQ ID NO: 191499 - RNA, 20 nt, Human
ggccccucugcccggcagcg

SEQ ID NO: 191500 - RNA, 32 nt, Human
ggccccucugccugcacuccucaggcuugccc

SEQ ID NO: 191501 - RNA, 27 nt, Human
ggccccucugcguauucccuucucucu

SEQ ID NO: 191502 - RNA, 22 nt, Human
ggccccucugggcuccucccuc

SEQ ID NO: 191503 - RNA, 23 nt, Human
ggccccucuguccccuuggcucu

SEQ ID NO: 191504 - RNA, 32 nt, Human
ggccccucuguggagcgcccgccgucugcucc

SEQ ID NO: 191505 - RNA, 32 nt, Human
ggccccucuucacucugcucacagcagagcug

SEQ ID NO: 191506 - RNA, 32 nt, Human
ggccccugaacuguucuuuguuuacaggacuc

SEQ ID NO: 191507 - RNA, 22 nt, Human
ggccccugaaucaccagagcca

SEQ ID NO: 191508 - RNA, 24 nt, Human
ggccccugacucuaagcugaacca

SEQ ID NO: 191509 - RNA, 32 nt, Human
ggccccugagauugcauuugauaccauuuuau

SEQ ID NO: 191510 - RNA, 22 nt, Human
ggccccugagccagccccaggg

SEQ ID NO: 191511 - RNA, 27 nt, Human
ggccccugagcccgcggcgcugagcca

SEQ ID NO: 191512 - RNA, 24 nt, Human
ggccccugagccuuggaccagcca

SEQ ID NO: 191513 - RNA, 23 nt, Human
ggccccugaggcagaccaggcca

SEQ ID NO: 191514 - RNA, 32 nt, Human
ggccccugaggcuguguguaacaaaaugacag

SEQ ID NO: 191515 - RNA, 25 nt, Human
ggccccugaguggcagggcugacuc

SEQ ID NO: 191516 - RNA, 32 nt, Human
ggccccugaugaggaagacuucagaauuggga

SEQ ID NO: 191517 - RNA, 18 nt, Human
ggccccugcacaccaggg

SEQ ID NO: 191518 - RNA, 32 nt, Human
ggccccugcaggaaaacugaggcccuugggca

SEQ ID NO: 191519 - RNA, 32 nt, Human
ggccccugcaggagucaggccuggucucacgc

SEQ ID NO: 191520 - RNA, 32 nt, Human
ggccccugcccagcucuccaaagucuuucaga

SEQ ID NO: 191521 - RNA, 32 nt, Human
ggccccugcccagggcuugggucuggugagcu

SEQ ID NO: 191522 - RNA, 22 nt, Human
ggccccugcccccagccccugc

SEQ ID NO: 191523 - RNA, 18 nt, Human
ggccccugccccgcgccc

SEQ ID NO: 191524 - RNA, 18 nt, Human
ggccccugcccucuuccu

SEQ ID NO: 191525 - RNA, 18 nt, Human
ggccccugcccugcugcc

SEQ ID NO: 191526 - RNA, 31 nt, Human
ggccccugccucuucugucauuguucaaagg

SEQ ID NO: 191527 - RNA, 24 nt, Human
ggccccugcgcuccucgccagccg

SEQ ID NO: 191528 - RNA, 31 nt, Human
ggccccugcgucucugggcgcuggagcgcgg

SEQ ID NO: 191529 - RNA, 32 nt, Human
ggccccugcucacugaugggcccucccaggcc

SEQ ID NO: 191530 - RNA, 32 nt, Human
ggccccuggaggaggaggcggaggaggaggag

SEQ ID NO: 191531 - RNA, 32 nt, Human
ggccccuggagucccagcuacucgggaggcug

SEQ ID NO: 191532 - RNA, 32 nt, Human
ggccccuggagugguggggccauggcaagaga

SEQ ID NO: 191533 - RNA, 32 nt, Human
ggccccuggcaccugggugcucuggcuggaga

SEQ ID NO: 191534 - RNA, 22 nt, Human
ggccccuggccccagcacccug

SEQ ID NO: 191535 - RNA, 32 nt, Human
ggccccuggccccaucuugccugcugcggccu

SEQ ID NO: 191536 - RNA, 32 nt, Human
ggccccuggcgagaaccgcacacaccccuccc

SEQ ID NO: 191537 - RNA, 24 nt, Human
ggccccuggcuucccccuuccucu

SEQ ID NO: 191538 - RNA, 32 nt, Human
ggccccugggcauggauucagcucccccaggu

SEQ ID NO: 191539 - RNA, 18 nt, Human
ggccccugggccucuaug

SEQ ID NO: 191540 - RNA, 21 nt, Human
ggccccugggucuucgcugcc

SEQ ID NO: 191541 - RNA, 32 nt, Human
ggccccugguaaaauuccaggccaggccucug

SEQ ID NO: 191542 - RNA, 32 nt, Human
ggccccuggucccagagcagagcugacaaagg

SEQ ID NO: 191543 - RNA, 32 nt, Human
ggccccuggucugcccugggcucaucagccuu

SEQ ID NO: 191544 - RNA, 16 nt, Human
ggccccuguaauccca

SEQ ID NO: 191545 - RNA, 32 nt, Human
ggccccuguaaucccagcuaauugggaggcug

SEQ ID NO: 191546 - RNA, 32 nt, Human
ggccccuguaaucccagcuacucgggaggcug

SEQ ID NO: 191547 - RNA, 32 nt, Human
ggccccuguaaucccagcuacucgggagguug

SEQ ID NO: 191548 - RNA, 32 nt, Human
ggccccuguaaucccagcuacuugggaggcug

SEQ ID NO: 191549 - RNA, 32 nt, Human
ggccccuguagucccagcuacucaggaggcua

SEQ ID NO: 191550 - RNA, 32 nt, Human
ggccccuguagucccagcuacucgggaggcug

SEQ ID NO: 191551 - RNA, 32 nt, Human
ggccccuguccuccagccugaccagcccuggc

SEQ ID NO: 191552 - RNA, 19 nt, Human
ggccccugugacugcugcc

SEQ ID NO: 191553 - RNA, 19 nt, Human
ggccccugugagcugggag

SEQ ID NO: 191554 - RNA, 31 nt, Human
ggccccugugugcucuguccugugucugcag

SEQ ID NO: 191555 - RNA, 32 nt, Human
ggccccuguucaccccagugcacuggcccuga

SEQ ID NO: 191556 - RNA, 32 nt, Human
ggccccuuagcuggaagcguuucuccaggacc

SEQ ID NO: 191557 - RNA, 32 nt, Human
ggccccuucaaaccucauagcaaccagaggaa

SEQ ID NO: 191558 - RNA, 32 nt, Human
ggccccuucccaaucuccauuucucugccaag

SEQ ID NO: 191559 - RNA, 32 nt, Human
ggccccuucccccugccagcagcugcuccuuc

SEQ ID NO: 191560 - RNA, 31 nt, Human
ggccccuuccucucugccuuguuccccguuc

SEQ ID NO: 191561 - RNA, 19 nt, Human
ggccccuuccucugcugcu

SEQ ID NO: 191562 - RNA, 25 nt, Human
ggccccuucgggccccacacgcauu

SEQ ID NO: 191563 - RNA, 32 nt, Human
ggccccuucguaccugcaauaugucaggagcc

SEQ ID NO: 191564 - RNA, 22 nt, Human
ggccccuucucucccugccaga

SEQ ID NO: 191565 - RNA, 18 nt, Human
ggccccuucucugcugcc

SEQ ID NO: 191566 - RNA, 32 nt, Human
ggccccuucucuuccucauuuuggaaacuuuu

SEQ ID NO: 191567 - RNA, 21 nt, Human
ggccccuucuggaccuuucca

SEQ ID NO: 191568 - RNA, 32 nt, Human
ggccccuucuggcccccugccuggagcaucug

SEQ ID NO: 191569 - RNA, 32 nt, Human
ggccccuugacagucagcugggcugaguguau

SEQ ID NO: 191570 - RNA, 21 nt, Human
ggccccuugccccauuuuaag

SEQ ID NO: 191571 - RNA, 23 nt, Human
ggccccuuggugacccgcugcuc

SEQ ID NO: 191572 - RNA, 32 nt, Human
ggccccuuuacaugcccucucccuuuuauaaa

SEQ ID NO: 191573 - RNA, 22 nt, Human
ggccccuuuaccucuaugccau

SEQ ID NO: 191574 - RNA, 32 nt, Human
ggccccuuuccaagcaaucucacguuuacugg

SEQ ID NO: 191575 - RNA, 32 nt, Human
ggccccuuuccgccucccuugcagcucagguu

SEQ ID NO: 191576 - RNA, 32 nt, Human
ggccccuuugaccucagggccaugaagcugcc

SEQ ID NO: 191577 - RNA, 23 nt, Human
ggccccuuuguucucgcgcgcuc

SEQ ID NO: 191578 - RNA, 21 nt, Human
ggcccgacauggcucggccuc

SEQ ID NO: 191579 - RNA, 32 nt, Human
ggcccgacauggucugggacacagaguuggag

SEQ ID NO: 191580 - RNA, 32 nt, Human
ggcccgaccuguacccagccuggcaggaagac

SEQ ID NO: 191581 - RNA, 22 nt, Human
ggcccgacgagacccagaguga

SEQ ID NO: 191582 - RNA, 32 nt, Human
ggcccgacuagcucuaggugccauggaagagg

SEQ ID NO: 191583 - RNA, 20 nt, Human
ggcccgacuggcugggcuuc

SEQ ID NO: 191584 - RNA, 32 nt, Human
ggcccgagaagagaucagagauugguucuggg

SEQ ID NO: 191585 - RNA, 32 nt, Human
ggcccgagaagcuuccucucagugaccacaau

SEQ ID NO: 191586 - RNA, 23 nt, Human
ggcccgagagcugcuccagagug

SEQ ID NO: 191587 - RNA, 19 nt, Human
ggcccgagcagcugagcag

SEQ ID NO: 191588 - RNA, 17 nt, Human
ggcccgagccacugcag

SEQ ID NO: 191589 - RNA, 21 nt, Human
ggcccgagcgccagccccagc

SEQ ID NO: 191590 - RNA, 32 nt, Human
ggcccgaggaagccucucuggggccaggggua

SEQ ID NO: 191591 - RNA, 32 nt, Human
ggcccgaggacccacugugagcacuccaccca

SEQ ID NO: 191592 - RNA, 22 nt, Human
ggcccgagggacccacacagug

SEQ ID NO: 191593 - RNA, 32 nt, Human
ggcccgaggggagacgccgugacaacuuucgu

SEQ ID NO: 191594 - RNA, 32 nt, Human
ggcccgagguccaagccuccgcuaagcugcuu

SEQ ID NO: 191595 - RNA, 19 nt, Human
ggcccgagguggcucacca

SEQ ID NO: 191596 - RNA, 24 nt, Human
ggcccgauaccaugauuuugcugc

SEQ ID NO: 191597 - RNA, 23 nt, Human
ggcccgcaacccccagcgcugcg

SEQ ID NO: 191598 - RNA, 19 nt, Human
ggcccgcaagccgcugcca

SEQ ID NO: 191599 - RNA, 20 nt, Human
ggcccgcacacucgcuccag

SEQ ID NO: 191600 - RNA, 32 nt, Human
ggcccgcacagagcuggggcugagggauggac

SEQ ID NO: 191601 - RNA, 22 nt, Human
ggcccgcaccaagacccgcucg

SEQ ID NO: 191602 - RNA, 32 nt, Human
ggcccgcaccugccuuggauguuuucagcaau

SEQ ID NO: 191603 - RNA, 21 nt, Human
ggcccgcagaugcuaagaggg

SEQ ID NO: 191604 - RNA, 21 nt, Human
ggcccgcagccgggcgcccug

SEQ ID NO: 191605 - RNA, 32 nt, Human
ggcccgcagccucacccggcucccucuccuca

SEQ ID NO: 191606 - RNA, 32 nt, Human
ggcccgcaggcaaggucucccacugcagggcu

SEQ ID NO: 191607 - RNA, 21 nt, Human
ggcccgcaggcagcgcgaggg

SEQ ID NO: 191608 - RNA, 32 nt, Human
ggcccgcagggacauggccggggacacccagu

SEQ ID NO: 191609 - RNA, 32 nt, Human
ggcccgcagggugucgggcgaggcaaagugca

SEQ ID NO: 191610 - RNA, 20 nt, Human
ggcccgcauccaggccgcca

SEQ ID NO: 191611 - RNA, 32 nt, Human
ggcccgcaugaggcagccucguuguggccuag

SEQ ID NO: 191612 - RNA, 22 nt, Human
ggcccgccccgcccuccccucc

SEQ ID NO: 191613 - RNA, 32 nt, Human
ggcccgccccuucacguacucggagcucggau

SEQ ID NO: 191614 - RNA, 19 nt, Human
ggcccgcccgagccccagc

SEQ ID NO: 191615 - RNA, 23 nt, Human
ggcccgcccgagccccagcagca

SEQ ID NO: 191616 - RNA, 32 nt, Human
ggcccgcccgggaauuggcggcggcgcugcag

SEQ ID NO: 191617 - RNA, 20 nt, Human
ggcccgcccugcaggcaaca

SEQ ID NO: 191618 - RNA, 22 nt, Human
ggcccgccgcacgcccggcagc

SEQ ID NO: 191619 - RNA, 19 nt, Human
ggcccgccgccccccgggg

SEQ ID NO: 191620 - RNA, 21 nt, Human
ggcccgccgccucccccggga

SEQ ID NO: 191621 - RNA, 22 nt, Human
ggcccgccguucuucugcugcc

SEQ ID NO: 191622 - RNA, 32 nt, Human
ggcccgccucuggcuccugggccugggcuuua

SEQ ID NO: 191623 - RNA, 18 nt, Human
ggcccgccugccacgccc

SEQ ID NO: 191624 - RNA, 22 nt, Human
ggcccgccuuugccccacccua

SEQ ID NO: 191625 - RNA, 32 nt, Human
ggcccgcgcaggcggcgaguccuccgagcccc

SEQ ID NO: 191626 - RNA, 25 nt, Human
ggcccgcgccccgcgccccccacgg

SEQ ID NO: 191627 - RNA, 22 nt, Human
ggcccgcgcccggccuccgcgg

SEQ ID NO: 191628 - RNA, 24 nt, Human
ggcccgcgccuccuccccccagcg

SEQ ID NO: 191629 - RNA, 21 nt, Human
ggcccgcgcgcucccaggguc

SEQ ID NO: 191630 - RNA, 19 nt, Human
ggcccgcggccggguccag

SEQ ID NO: 191631 - RNA, 32 nt, Human
ggcccgcucccuuuuucuucugccucacuuga

SEQ ID NO: 191632 - RNA, 32 nt, Human
ggcccgcucuccccacccuguucugagccaaa

SEQ ID NO: 191633 - RNA, 32 nt, Human
ggcccgcucuucucccccuccugcugcggccg

SEQ ID NO: 191634 - RNA, 32 nt, Human
ggcccgcugcagccucugccucuuggguucaa

SEQ ID NO: 191635 - RNA, 32 nt, Human
ggcccgcugcuggccgcucucuucucugccuc

SEQ ID NO: 191636 - RNA, 32 nt, Human
ggcccgcuugccucagcuucuugcugccgcca

SEQ ID NO: 191637 - RNA, 32 nt, Human
ggcccgcuuggcuguccaaucacacuccagug

SEQ ID NO: 191638 - RNA, 19 nt, Human
ggcccgcuuugggguccag

SEQ ID NO: 191639 - RNA, 32 nt, Human
ggcccggaacugcuucaaccugggagguagag

SEQ ID NO: 191640 - RNA, 22 nt, Human
ggcccggacaggacugauggcc

SEQ ID NO: 191641 - RNA, 32 nt, Human
ggcccggagccagccaggcaguuuuauugaaa

SEQ ID NO: 191642 - RNA, 17 nt, Human
ggcccggagccggagga

SEQ ID NO: 191643 - RNA, 32 nt, Human
ggcccggagcggaggaaggagucgccgaggag

SEQ ID NO: 191644 - RNA, 32 nt, Human
ggcccggagcggggguugggggaguagagaaa

SEQ ID NO: 191645 - RNA, 22 nt, Human
ggcccggaggcggcggcgcagg

SEQ ID NO: 191646 - RNA, 32 nt, Human
ggcccggaggcugagacuaaggcuuucgaccc

SEQ ID NO: 191647 - RNA, 32 nt, Human
ggcccggaggggaacuguuuucuccggaagug

SEQ ID NO: 191648 - RNA, 19 nt, Human
ggcccggaggggcaggccu

SEQ ID NO: 191649 - RNA, 32 nt, Human
ggcccggcacccggucccaccuggugacacug

SEQ ID NO: 191650 - RNA, 32 nt, Human
ggcccggcagagccgcaggcgcuaggccgccc

SEQ ID NO: 191651 - RNA, 32 nt, Human
ggcccggcagccagcucugcagagccauuugu

SEQ ID NO: 191652 - RNA, 32 nt, Human
ggcccggcagccugagcggcaggccuguauuc

SEQ ID NO: 191653 - RNA, 32 nt, Human
ggcccggcagggaggcagggaggcugcagagu

SEQ ID NO: 191654 - RNA, 32 nt, Human
ggcccggcaguuggaggaaggccagaggaaca

SEQ ID NO: 191655 - RNA, 32 nt, Human
ggcccggcaugaagcggcguugaggagcugcu

SEQ ID NO: 191656 - RNA, 32 nt, Human
ggcccggccaccucucugucauggcucuggcg

SEQ ID NO: 191657 - RNA, 32 nt, Human
ggcccggccacugcaggaugcccaccugggcc

SEQ ID NO: 191658 - RNA, 32 nt, Human
ggcccggccacuggcccugcagcugcuuuuug

SEQ ID NO: 191659 - RNA, 32 nt, Human
ggcccggccauggcggacaacgagaaacugga

SEQ ID NO: 191660 - RNA, 32 nt, Human
ggcccggcccaauccaggccccggccccgccg

SEQ ID NO: 191661 - RNA, 32 nt, Human
ggcccggcccagccuaggcccgggguggccac

SEQ ID NO: 191662 - RNA, 32 nt, Human
ggcccggcccccgcgugccucccaggcuccgc

SEQ ID NO: 191663 - RNA, 22 nt, Human
ggcccggccccgucgcugcccg

SEQ ID NO: 191664 - RNA, 20 nt, Human
ggcccggcccgugcagcccg

SEQ ID NO: 191665 - RNA, 32 nt, Human
ggcccggcccugcucuguucugcccggaggag

SEQ ID NO: 191666 - RNA, 20 nt, Human
ggcccggccgcagcgcaggg

SEQ ID NO: 191667 - RNA, 23 nt, Human
ggcccggccuccacagcacccca

SEQ ID NO: 191668 - RNA, 32 nt, Human
ggcccggccuuuccuuuuuccucuccucuccu

SEQ ID NO: 191669 - RNA, 23 nt, Human
ggcccggcgaggcagcgcagagg

SEQ ID NO: 191670 - RNA, 32 nt, Human
ggcccggcgcgagaggaggcagagggggcguc

SEQ ID NO: 191671 - RNA, 18 nt, Human
ggcccggcgcgccuggua

SEQ ID NO: 191672 - RNA, 32 nt, Human
ggcccggcgugggcacacagacagcccgcuuu

SEQ ID NO: 191673 - RNA, 21 nt, Human
ggcccggcucccccgccccgg

SEQ ID NO: 191674 - RNA, 32 nt, Human
ggcccgggaagugcagcaggcagcuuuucuuu

SEQ ID NO: 191675 - RNA, 32 nt, Human
ggcccgggaaucugagggccucaccccacuuc

SEQ ID NO: 191676 - RNA, 32 nt, Human
ggcccgggaccccuguuuucugcucccuggac

SEQ ID NO: 191677 - RNA, 32 nt, Human
ggcccgggacgacagccugggcucagagucag

SEQ ID NO: 191678 - RNA, 18 nt, Human
ggcccgggacgaggccuc

SEQ ID NO: 191679 - RNA, 18 nt, Human
ggcccgggagccgggagg

SEQ ID NO: 191680 - RNA, 32 nt, Human
ggcccgggaggcagaccugccccaagggugau

SEQ ID NO: 191681 - RNA, 32 nt, Human
ggcccgggaggcagaccugcccuaagggugau

SEQ ID NO: 191682 - RNA, 32 nt, Human
ggcccgggaggcagagguugcagugagccgag

SEQ ID NO: 191683 - RNA, 17 nt, Human
ggcccgggaggcgcagg

SEQ ID NO: 191684 - RNA, 32 nt, Human
ggcccgggaggcggaggcgcgggggaggaggc

SEQ ID NO: 191685 - RNA, 32 nt, Human
ggcccgggagggcugggggcucuucccuggag

SEQ ID NO: 191686 - RNA, 32 nt, Human
ggcccgggaggucaagguugcagugagcuguc

SEQ ID NO: 191687 - RNA, 32 nt, Human
ggcccgggagguggagguugcagugagcugag

SEQ ID NO: 191688 - RNA, 32 nt, Human
ggcccgggagguggagguugcagugagucaag

SEQ ID NO: 191689 - RNA, 18 nt, Human
ggcccgggagugggucuc

SEQ ID NO: 191690 - RNA, 32 nt, Human
ggcccgggaguuugaaguugcagugagcuaug

SEQ ID NO: 191691 - RNA, 32 nt, Human
ggcccgggcaccugagggcuucucccucugga

SEQ ID NO: 191692 - RNA, 19 nt, Human
ggcccgggcagacaaggcc

SEQ ID NO: 191693 - RNA, 32 nt, Human
ggcccgggcaugggcugcaagggagacgcgag

SEQ ID NO: 191694 - RNA, 32 nt, Human
ggcccgggccagggagaugcaggaugaggaga

SEQ ID NO: 191695 - RNA, 32 nt, Human
ggcccgggcccaccuuggacucccucuggaga

SEQ ID NO: 191696 - RNA, 22 nt, Human
ggcccgggccccacgguaccuc

SEQ ID NO: 191697 - RNA, 18 nt, Human
ggcccgggccccucggga

SEQ ID NO: 191698 - RNA, 32 nt, Human
ggcccgggccggggcccugccugaggccaucg

SEQ ID NO: 191699 - RNA, 19 nt, Human
ggcccgggccucgggcccc

SEQ ID NO: 191700 - RNA, 32 nt, Human
ggcccgggccugggaacugcuggcucuaagaa

SEQ ID NO: 191701 - RNA, 20 nt, Human
ggcccgggcggagccccggg

SEQ ID NO: 191702 - RNA, 19 nt, Human
ggcccgggcgggcgggagc

SEQ ID NO: 191703 - RNA, 18 nt, Human
ggcccgggcucccagagg

SEQ ID NO: 191704 - RNA, 32 nt, Human
ggcccgggcucccagccgcagucccacacugg

SEQ ID NO: 191705 - RNA, 20 nt, Human
ggcccgggcucggggaccuu

SEQ ID NO: 191706 - RNA, 32 nt, Human
ggcccgggcuggagaggaaggggcaccaccca

SEQ ID NO: 191707 - RNA, 18 nt, Human
ggcccgggcuggggccuc

SEQ ID NO: 191708 - RNA, 18 nt, Human
ggcccgggcugggggccc

SEQ ID NO: 191709 - RNA, 32 nt, Human
ggcccgggcugugauuuaccugggugagacag

SEQ ID NO: 191710 - RNA, 32 nt, Human
ggcccggggacacaucuccugagggaucccag

SEQ ID NO: 191711 - RNA, 19 nt, Human
ggcccggggaccugugcca

SEQ ID NO: 191712 - RNA, 32 nt, Human
ggcccggggagacaguuguguggugugugcau

SEQ ID NO: 191713 - RNA, 21 nt, Human
ggcccggggauccucccgccg

SEQ ID NO: 191714 - RNA, 32 nt, Human
ggcccggggccaugcaguaccuggaguguccu

SEQ ID NO: 191715 - RNA, 32 nt, Human
ggcccggggccugaccccaacaccugcaugcu

SEQ ID NO: 191716 - RNA, 32 nt, Human
ggcccggggccuggggcgucagcugggauaua

SEQ ID NO: 191717 - RNA, 32 nt, Human
ggcccggggcucgagcccggaggcaggagcag

SEQ ID NO: 191718 - RNA, 32 nt, Human
ggcccggggcuggagcgcagcgggaagcggga

SEQ ID NO: 191719 - RNA, 32 nt, Human
ggcccgggggccugagccugggaccccacccc

SEQ ID NO: 191720 - RNA, 32 nt, Human
ggcccggggguggagcccucaccagggaccug

SEQ ID NO: 191721 - RNA, 32 nt, Human
ggcccgggguugagacaggcggcaggugccug

SEQ ID NO: 191722 - RNA, 16 nt, Human
ggcccgggucgggccu

SEQ ID NO: 191723 - RNA, 32 nt, Human
ggcccgguauccugccuguccgcugccaccaa

SEQ ID NO: 191724 - RNA, 32 nt, Human
ggcccggucagugcugcaugcacugcauauga

SEQ ID NO: 191725 - RNA, 19 nt, Human
ggcccggugaggugcugcc

SEQ ID NO: 191726 - RNA, 22 nt, Human
ggcccggugcuucccgcagcug

SEQ ID NO: 191727 - RNA, 32 nt, Human
ggcccguacacaggcggggccagcacaguagu

SEQ ID NO: 191728 - RNA, 32 nt, Human
ggcccguacuccuggggguuucccuuugccau

SEQ ID NO: 191729 - RNA, 23 nt, Human
ggcccguccagagccccagcagg

SEQ ID NO: 191730 - RNA, 32 nt, Human
ggcccgucucccaggcugggcgugggccgggc

SEQ ID NO: 191731 - RNA, 32 nt, Human
ggcccgucuccucuucccuacaacaggcugcu

SEQ ID NO: 191732 - RNA, 32 nt, Human
ggcccgucugcccgccuuccuccaucuaaccu

SEQ ID NO: 191733 - RNA, 32 nt, Human
ggcccgucuggguuugggaugcacugaguugg

SEQ ID NO: 191734 - RNA, 32 nt, Human
ggcccgugaaaggcaacugagcagggauccau

SEQ ID NO: 191735 - RNA, 32 nt, Human
ggcccgugcagcagugucugagcuguagugaa

SEQ ID NO: 191736 - RNA, 32 nt, Human
ggcccgugcccagcccuaaaguuuuaaacucu

SEQ ID NO: 191737 - RNA, 19 nt, Human
ggcccgugcccgggaccgc

SEQ ID NO: 191738 - RNA, 23 nt, Human
ggcccguggacuccgcacaggga

SEQ ID NO: 191739 - RNA, 19 nt, Human
ggcccguggccaacccagc

SEQ ID NO: 191740 - RNA, 21 nt, Human
ggcccguggcucaugccugua

SEQ ID NO: 191741 - RNA, 32 nt, Human
ggcccguggggcagguggagggagcagucuuc

SEQ ID NO: 191742 - RNA, 21 nt, Human
ggcccguguccccuuccucca

SEQ ID NO: 191743 - RNA, 32 nt, Human
ggcccguguccuggaagccacccggaccugga

SEQ ID NO: 191744 - RNA, 32 nt, Human
ggcccguguguugggagguuguggucugcgug

SEQ ID NO: 191745 - RNA, 22 nt, Human
ggcccguugccaccgacuccca

SEQ ID NO: 191746 - RNA, 32 nt, Human
ggcccguugccaccgacucccaccuccagcac

SEQ ID NO: 191747 - RNA, 32 nt, Human
ggcccguuggguagcuggggccaggcuucucu

SEQ ID NO: 191748 - RNA, 32 nt, Human
ggcccuaacaggcacagagagcaggggcaacu

SEQ ID NO: 191749 - RNA, 19 nt, Human
ggcccuacaagugcggcga

SEQ ID NO: 191750 - RNA, 22 nt, Human
ggcccuacaccugccccgagug

SEQ ID NO: 191751 - RNA, 32 nt, Human
ggcccuacaucaucugcuacccugaaagaucu

SEQ ID NO: 191752 - RNA, 32 nt, Human
ggcccuacaucaucugcuacccugaaggaucu

SEQ ID NO: 191753 - RNA, 21 nt, Human
ggcccuaccagcgcccgcugg

SEQ ID NO: 191754 - RNA, 32 nt, Human
ggcccuacuacccauuguucccuuccucuucc

SEQ ID NO: 191755 - RNA, 24 nt, Human
ggcccuacugcuccccucugcugc

SEQ ID NO: 191756 - RNA, 32 nt, Human
ggcccuagagagaaguauauacuaggguacuu

SEQ ID NO: 191757 - RNA, 32 nt, Human
ggcccuagaggaguuuguaucaauuugugagu

SEQ ID NO: 191758 - RNA, 20 nt, Human
ggcccuaggacacugccaga

SEQ ID NO: 191759 - RNA, 32 nt, Human
ggcccuaggaggcuucugccaccagcucacug

SEQ ID NO: 191760 - RNA, 32 nt, Human
ggcccuaggauuguccacucaucccaguauca

SEQ ID NO: 191761 - RNA, 21 nt, Human
ggcccuaggccccucagcagg

SEQ ID NO: 191762 - RNA, 18 nt, Human
ggcccuaggccugcuguc

SEQ ID NO: 191763 - RNA, 32 nt, Human
ggcccuagggagcaccgugauggagaggacag

SEQ ID NO: 191764 - RNA, 32 nt, Human
ggcccuauaccuggccgagguggagaagcagg

SEQ ID NO: 191765 - RNA, 32 nt, Human
ggcccuauagcagaagucugauucuaagagca

SEQ ID NO: 191766 - RNA, 32 nt, Human
ggcccuaucagccugugaacuucacuuaggcc

SEQ ID NO: 191767 - RNA, 30 nt, Human
ggcccuauccucuccauuagcuccuuccgg

SEQ ID NO: 191768 - RNA, 32 nt, Human
ggcccuaucuccugcaaccucagugccucagc

SEQ ID NO: 191769 - RNA, 22 nt, Human
ggcccuaugcuacacagucccu

SEQ ID NO: 191770 - RNA, 20 nt, Human
ggcccuauuuuccugcugcu

SEQ ID NO: 191771 - RNA, 32 nt, Human
ggcccuauuuuccugcugcuucccagcucaga

SEQ ID NO: 191772 - RNA, 21 nt, Human
ggcccucaaaccacuucugcc

SEQ ID NO: 191773 - RNA, 21 nt, Human
ggcccucaaacccaguuuggc

SEQ ID NO: 191774 - RNA, 22 nt, Human
ggcccucaaacccucucccucu

SEQ ID NO: 191775 - RNA, 20 nt, Human
ggcccucaaacuauauugca

SEQ ID NO: 191776 - RNA, 19 nt, Human
ggcccucaacuuccauccu

SEQ ID NO: 191777 - RNA, 32 nt, Human
ggcccucaagagccauccccacugccuggcca

SEQ ID NO: 191778 - RNA, 32 nt, Human
ggcccucaagaggcaugcuagaacguuagguc

SEQ ID NO: 191779 - RNA, 20 nt, Human
ggcccucaagcuuuccugcu

SEQ ID NO: 191780 - RNA, 23 nt, Human
ggcccucaagcuuuccugcuguc

SEQ ID NO: 191781 - RNA, 32 nt, Human
ggcccucaagggacagacauggcucagcggau

SEQ ID NO: 191782 - RNA, 20 nt, Human
ggcccucacaccauccaccu

SEQ ID NO: 191783 - RNA, 24 nt, Human
ggcccucacagaaccgagucugcc

SEQ ID NO: 191784 - RNA, 32 nt, Human
ggcccucacagcccugggcagcuacaaccgcu

SEQ ID NO: 191785 - RNA, 20 nt, Human
ggcccucacagcgcccugcc

SEQ ID NO: 191786 - RNA, 21 nt, Human
ggcccucaccacagcccaccu

SEQ ID NO: 191787 - RNA, 21 nt, Human
ggcccucaccaggguccuucc

SEQ ID NO: 191788 - RNA, 21 nt, Human
ggcccucaccccaucacgccu

SEQ ID NO: 191789 - RNA, 16 nt, Human
ggcccucaccccugcc

SEQ ID NO: 191790 - RNA, 21 nt, Human
ggcccucacccgaagggcugc

SEQ ID NO: 191791 - RNA, 32 nt, Human
ggcccucacccuccucuguggucaagauggag

SEQ ID NO: 191792 - RNA, 19 nt, Human
ggcccucaccugcaccgcc

SEQ ID NO: 191793 - RNA, 20 nt, Human
ggcccucaccugccggcgcc

SEQ ID NO: 191794 - RNA, 17 nt, Human
ggcccucaccugcuguc

SEQ ID NO: 191795 - RNA, 21 nt, Human
ggcccucaccuuaucacuggc

SEQ ID NO: 191796 - RNA, 19 nt, Human
ggcccucaccuuccucccu

SEQ ID NO: 191797 - RNA, 24 nt, Human
ggcccucacgcgcgcccucucccg

SEQ ID NO: 191798 - RNA, 20 nt, Human
ggcccucacgguguccgccu

SEQ ID NO: 191799 - RNA, 18 nt, Human
ggcccucacguuccugcc

SEQ ID NO: 191800 - RNA, 18 nt, Human
ggcccucacucuccggcc

SEQ ID NO: 191801 - RNA, 19 nt, Human
ggcccucacucucucgccu

SEQ ID NO: 191802 - RNA, 19 nt, Human
ggcccucacucucugugcc

SEQ ID NO: 191803 - RNA, 22 nt, Human
ggcccucacucuugaaguccag

SEQ ID NO: 191804 - RNA, 32 nt, Human
ggcccucacugaggagauucagccugggcucc

SEQ ID NO: 191805 - RNA, 19 nt, Human
ggcccucagaacaccugcc

SEQ ID NO: 191806 - RNA, 20 nt, Human
ggcccucagaacgcccugcu

SEQ ID NO: 191807 - RNA, 32 nt, Human
ggcccucagaagcagcucuuggaggagaugag

SEQ ID NO: 191808 - RNA, 18 nt, Human
ggcccucagacccugccu

SEQ ID NO: 191809 - RNA, 32 nt, Human
ggcccucagagcagcgccugugggugucagua

SEQ ID NO: 191810 - RNA, 19 nt, Human
ggcccucagaggacagugc

SEQ ID NO: 191811 - RNA, 32 nt, Human
ggcccucagaggaccaggggaucaugucucca

SEQ ID NO: 191812 - RNA, 21 nt, Human
ggcccucagaggcuccucccu

SEQ ID NO: 191813 - RNA, 32 nt, Human
ggcccucagagugcucuguagagcuguagacu

SEQ ID NO: 191814 - RNA, 32 nt, Human
ggcccucagcaaccagcucuguagggagcucu

SEQ ID NO: 191815 - RNA, 21 nt, Human
ggcccucagcaagcccuggcc

SEQ ID NO: 191816 - RNA, 32 nt, Human
ggcccucagcacuguccacuguuucggugcca

SEQ ID NO: 191817 - RNA, 31 nt, Human
ggcccucagcacuuugggccuggucacauac

SEQ ID NO: 191818 - RNA, 17 nt, Human
ggcccucagcagcugcu

SEQ ID NO: 191819 - RNA, 19 nt, Human
ggcccucagcagcugcucc

SEQ ID NO: 191820 - RNA, 19 nt, Human
ggcccucagccacagugcc

SEQ ID NO: 191821 - RNA, 19 nt, Human
ggcccucagccagcuggcu

SEQ ID NO: 191822 - RNA, 32 nt, Human
ggcccucagccaugcguggacucagugggcca

SEQ ID NO: 191823 - RNA, 20 nt, Human
ggcccucagccccuccugcc

SEQ ID NO: 191824 - RNA, 19 nt, Human
ggcccucagcccuccaccu

SEQ ID NO: 191825 - RNA, 19 nt, Human
ggcccucagcccucugucu

SEQ ID NO: 191826 - RNA, 18 nt, Human
ggcccucagcccugccgc

SEQ ID NO: 191827 - RNA, 19 nt, Human
ggcccucagccgacaggcc

SEQ ID NO: 191828 - RNA, 20 nt, Human
ggcccucagccuucccugcu

SEQ ID NO: 191829 - RNA, 23 nt, Human
ggcccucagccuucccugcugcc

SEQ ID NO: 191830 - RNA, 22 nt, Human
ggcccucagcgccgccccggcc

SEQ ID NO: 191831 - RNA, 32 nt, Human
ggcccucagcgucuccccaugcugggcucacu

SEQ ID NO: 191832 - RNA, 21 nt, Human
ggcccucagcucccccucccu

SEQ ID NO: 191833 - RNA, 19 nt, Human
ggcccucagcugcccuccu

SEQ ID NO: 191834 - RNA, 32 nt, Human
ggcccucaggagagaccaggaggacugacagc

SEQ ID NO: 191835 - RNA, 21 nt, Human
ggcccucaggccaggccuacc

SEQ ID NO: 191836 - RNA, 22 nt, Human
ggcccucaggcccacccuggcu

SEQ ID NO: 191837 - RNA, 18 nt, Human
ggcccucaggcugcugcu

SEQ ID NO: 191838 - RNA, 20 nt, Human
ggcccucagggggccugccu

SEQ ID NO: 191839 - RNA, 21 nt, Human
ggcccucaggucgcccuggcc

SEQ ID NO: 191840 - RNA, 32 nt, Human
ggcccucaguaaauaccuggaggaaugugacc

SEQ ID NO: 191841 - RNA, 19 nt, Human
ggcccucaguagucccugc

SEQ ID NO: 191842 - RNA, 19 nt, Human
ggcccucagucaccccgcc

SEQ ID NO: 191843 - RNA, 19 nt, Human
ggcccucaguccacccccu

SEQ ID NO: 191844 - RNA, 19 nt, Human
ggcccucagucuuccugcc

SEQ ID NO: 191845 - RNA, 19 nt, Human
ggcccucaguggacugccu

SEQ ID NO: 191846 - RNA, 23 nt, Human
ggcccucaguggacugccugcuc

SEQ ID NO: 191847 - RNA, 21 nt, Human
ggcccucaguggaugcuggcc

SEQ ID NO: 191848 - RNA, 20 nt, Human
ggcccucaguuucccuaucu

SEQ ID NO: 191849 - RNA, 18 nt, Human
ggcccucauaaugaugcc

SEQ ID NO: 191850 - RNA, 18 nt, Human
ggcccucauagcccugcu

SEQ ID NO: 191851 - RNA, 20 nt, Human
ggcccucauagcccugcucc

SEQ ID NO: 191852 - RNA, 19 nt, Human
ggcccucauauuugcugcu

SEQ ID NO: 191853 - RNA, 21 nt, Human
ggcccucaucacuucgccgcc

SEQ ID NO: 191854 - RNA, 17 nt, Human
ggcccucauccccugcc

SEQ ID NO: 191855 - RNA, 20 nt, Human
ggcccucauccccugccgcu

SEQ ID NO: 191856 - RNA, 21 nt, Human
ggcccucauccuucugcugcc

SEQ ID NO: 191857 - RNA, 21 nt, Human
ggcccucaugaagccaugccu

SEQ ID NO: 191858 - RNA, 19 nt, Human
ggcccucaugagcuacgcc

SEQ ID NO: 191859 - RNA, 26 nt, Human
ggcccucaugguggccugucaccaug

SEQ ID NO: 191860 - RNA, 20 nt, Human
ggcccucauucgcuccugcc

SEQ ID NO: 191861 - RNA, 21 nt, Human
ggcccucauucgcuccugccu

SEQ ID NO: 191862 - RNA, 32 nt, Human
ggcccucauuucucagcuucugcauuuccuuc

SEQ ID NO: 191863 - RNA, 32 nt, Human
ggcccuccagccuggccuaacacuuggggagc

SEQ ID NO: 191864 - RNA, 19 nt, Human
ggcccuccaggcugcugcu

SEQ ID NO: 191865 - RNA, 32 nt, Human
ggcccuccagggaaguggagccuccagccccu

SEQ ID NO: 191866 - RNA, 23 nt, Human
ggcccuccaucaccuucugcucc

SEQ ID NO: 191867 - RNA, 32 nt, Human
ggcccuccccagggguacccagugccagcggg

SEQ ID NO: 191868 - RNA, 23 nt, Human
ggcccuccccccggcccucccgg

SEQ ID NO: 191869 - RNA, 32 nt, Human
ggcccucccuccgcccccuccgcccucgcgcg

SEQ ID NO: 191870 - RNA, 32 nt, Human
ggcccucccugcacuccccucuugcugcgugu

SEQ ID NO: 191871 - RNA, 32 nt, Human
ggcccuccgaguagcugggaccacagguguac

SEQ ID NO: 191872 - RNA, 32 nt, Human
ggcccuccgcacccucugcccucugccuggca

SEQ ID NO: 191873 - RNA, 22 nt, Human
ggcccuccgccccagccccagc

SEQ ID NO: 191874 - RNA, 32 nt, Human
ggcccuccgcccugacccuccugcugccuucc

SEQ ID NO: 191875 - RNA, 32 nt, Human
ggcccuccgccuccuccccuccuccuucucgu

SEQ ID NO: 191876 - RNA, 32 nt, Human
ggcccuccgcucuccccuccgcuccccucccc

SEQ ID NO: 191877 - RNA, 24 nt, Human
ggcccuccgcugggaagcacuuga

SEQ ID NO: 191878 - RNA, 32 nt, Human
ggcccuccgucugccccuucuccgcagggccc

SEQ ID NO: 191879 - RNA, 32 nt, Human
ggcccuccucaaggucagccuucagauuuggg

SEQ ID NO: 191880 - RNA, 32 nt, Human
ggcccuccucaggccuccaguggccccaugcc

SEQ ID NO: 191881 - RNA, 22 nt, Human
ggcccuccuccacuucuuggua

SEQ ID NO: 191882 - RNA, 32 nt, Human
ggcccuccuccagggcccucugggguuggggu

SEQ ID NO: 191883 - RNA, 32 nt, Human
ggcccuccucccccucuccccacucccucaua

SEQ ID NO: 191884 - RNA, 32 nt, Human
ggcccuccuccccuucccuccccuccgccccc

SEQ ID NO: 191885 - RNA, 32 nt, Human
ggcccuccuccuccuccugguccuugcuaacg

SEQ ID NO: 191886 - RNA, 19 nt, Human
ggcccuccucucugcugcc

SEQ ID NO: 191887 - RNA, 19 nt, Human
ggcccuccucuggguccag

SEQ ID NO: 191888 - RNA, 32 nt, Human
ggcccuccugcagguccuagaucugagggacc

SEQ ID NO: 191889 - RNA, 32 nt, Human
ggcccuccugcucugaggguugaggaaggcuc

SEQ ID NO: 191890 - RNA, 32 nt, Human
ggcccuccugggaaggagggagcugcucagaa

SEQ ID NO: 191891 - RNA, 24 nt, Human
ggcccuccugugcuuauuuuucca

SEQ ID NO: 191892 - RNA, 32 nt, Human
ggcccuccuuucuccaggccugggcuacaggg

SEQ ID NO: 191893 - RNA, 18 nt, Human
ggcccuccuuucuugggu

SEQ ID NO: 191894 - RNA, 32 nt, Human
ggcccucgagccaccaucgcccgagccggagc

SEQ ID NO: 191895 - RNA, 18 nt, Human
ggcccucgccauccuccc

SEQ ID NO: 191896 - RNA, 20 nt, Human
ggcccucggaccccucugcc

SEQ ID NO: 191897 - RNA, 18 nt, Human
ggcccucggccgccccgc

SEQ ID NO: 191898 - RNA, 21 nt, Human
ggcccucggcgcgcgcagggg

SEQ ID NO: 191899 - RNA, 32 nt, Human
ggcccucggcuuccaccccucgucuucccucc

SEQ ID NO: 191900 - RNA, 20 nt, Human
ggcccucgggcgucugcgcc

SEQ ID NO: 191901 - RNA, 18 nt, Human
ggcccucgguccccugcc

SEQ ID NO: 191902 - RNA, 19 nt, Human
ggcccucgguccgcccucc

SEQ ID NO: 191903 - RNA, 18 nt, Human
ggcccucgucauccugcc

SEQ ID NO: 191904 - RNA, 32 nt, Human
ggcccucguggcccacgcuccaugccaguggc

SEQ ID NO: 191905 - RNA, 21 nt, Human
ggcccucgugggacugccgcc

SEQ ID NO: 191906 - RNA, 20 nt, Human
ggcccucuaguugccaugac

SEQ ID NO: 191907 - RNA, 32 nt, Human
ggcccucucagaggugcagcuuccaugucagu

SEQ ID NO: 191908 - RNA, 32 nt, Human
ggcccucuccucugcugacucugccguuucuc

SEQ ID NO: 191909 - RNA, 19 nt, Human
ggcccucuccuguccugcc

SEQ ID NO: 191910 - RNA, 32 nt, Human
ggcccucugaggcugcugagggccaaguacgc

SEQ ID NO: 191911 - RNA, 24 nt, Human
ggcccucugcaagaagcucaagga

SEQ ID NO: 191912 - RNA, 32 nt, Human
ggcccucugccgcaagaaacagugugagcuac

SEQ ID NO: 191913 - RNA, 32 nt, Human
ggcccucugcugcaagauguccguggaguaug

SEQ ID NO: 191914 - RNA, 32 nt, Human
ggcccucuggcccacagccauugguagcggug

SEQ ID NO: 191915 - RNA, 32 nt, Human
ggcccucugggagcuguuaucaucucagaucu

SEQ ID NO: 191916 - RNA, 20 nt, Human
ggcccucugguggccaggug

SEQ ID NO: 191917 - RNA, 32 nt, Human
ggcccucugucugggcgaacagcccccuccuc

SEQ ID NO: 191918 - RNA, 20 nt, Human
ggcccucugugaucaugccu

SEQ ID NO: 191919 - RNA, 21 nt, Human
ggcccucuuagcccucugccg

SEQ ID NO: 191920 - RNA, 23 nt, Human
ggcccucuucagcgcauccugcc

SEQ ID NO: 191921 - RNA, 22 nt, Human
ggcccucuugccuuggagccag

SEQ ID NO: 191922 - RNA, 18 nt, Human
ggcccucuugcugcugcc

SEQ ID NO: 191923 - RNA, 19 nt, Human
ggcccucuuucucuguggg

SEQ ID NO: 191924 - RNA, 32 nt, Human
ggcccugaagacacagaugacucaaccuaagc

SEQ ID NO: 191925 - RNA, 32 nt, Human
ggcccugaaggaggggcaggaggcaggggugg

SEQ ID NO: 191926 - RNA, 32 nt, Human
ggcccugaaggcugggggccaggcugucagug

SEQ ID NO: 191927 - RNA, 32 nt, Human
ggcccugaauccuccucugcuccagggcuggc

SEQ ID NO: 191928 - RNA, 17 nt, Human
ggcccugacccugccag

SEQ ID NO: 191929 - RNA, 18 nt, Human
ggcccugacccugcugcc

SEQ ID NO: 191930 - RNA, 18 nt, Human
ggcccugaccucugcugc

SEQ ID NO: 191931 - RNA, 32 nt, Human
ggcccugacuccccugcccuccagaggcccca

SEQ ID NO: 191932 - RNA, 32 nt, Human
ggcccugacuguaaacuagugaagagugaaug

SEQ ID NO: 191933 - RNA, 32 nt, Human
ggcccugacuguaaauuagugaagagugaaug

SEQ ID NO: 191934 - RNA, 32 nt, Human
ggcccugagaaaagccauuguggagccaacuc

SEQ ID NO: 191935 - RNA, 19 nt, Human
ggcccugagaaccccaggg

SEQ ID NO: 191936 - RNA, 20 nt, Human
ggcccugagaggcccccaga

SEQ ID NO: 191937 - RNA, 32 nt, Human
ggcccugagauggugggcccuugacaggccuu

SEQ ID NO: 191938 - RNA, 32 nt, Human
ggcccugagcaggggcuuggggcagcccagcc

SEQ ID NO: 191939 - RNA, 32 nt, Human
ggcccugagccccagcccccagccuccucccu

SEQ ID NO: 191940 - RNA, 32 nt, Human
ggcccugagccucccuuucucucccauguuuc

SEQ ID NO: 191941 - RNA, 32 nt, Human
ggcccugagcuggggagguggggaagauucgg

SEQ ID NO: 191942 - RNA, 20 nt, Human
ggcccugagcuucugcugcc

SEQ ID NO: 191943 - RNA, 25 nt, Human
ggcccugaggaacacccggcaguau

SEQ ID NO: 191944 - RNA, 24 nt, Human
ggcccugaggaacagccgcagcgu

SEQ ID NO: 191945 - RNA, 21 nt, Human
ggcccugaggacaguccugcc

SEQ ID NO: 191946 - RNA, 32 nt, Human
ggcccugaggcaggaccgcccuccugaccccu

SEQ ID NO: 191947 - RNA, 32 nt, Human
ggcccugagggacugcugcuuccuuccuuccu

SEQ ID NO: 191948 - RNA, 32 nt, Human
ggcccugaggggcagggagaugccaccaugcu

SEQ ID NO: 191949 - RNA, 32 nt, Human
ggcccugaggucaggauggggagcugcugccu

SEQ ID NO: 191950 - RNA, 32 nt, Human
ggcccugaguaccucuugccuuguuugcugcc

SEQ ID NO: 191951 - RNA, 32 nt, Human
ggcccugaguccugguuuccuggcagccugcu

SEQ ID NO: 191952 - RNA, 32 nt, Human
ggcccugaugauuuuuguauuuuuaguagaga

SEQ ID NO: 191953 - RNA, 32 nt, Human
ggcccugauguggaguagacagugcgcaccuc

SEQ ID NO: 191954 - RNA, 32 nt, Human
ggcccugauuucccugguuugagacucacuuc

SEQ ID NO: 191955 - RNA, 32 nt, Human
ggcccugcaagacacaggcucagcaugcagaa

SEQ ID NO: 191956 - RNA, 18 nt, Human
ggcccugcagccccuggg

SEQ ID NO: 191957 - RNA, 32 nt, Human
ggcccugcagccgucgccgcugccucgggcua

SEQ ID NO: 191958 - RNA, 32 nt, Human
ggcccugcagcuccagggcuggugcucuagca

SEQ ID NO: 191959 - RNA, 23 nt, Human
ggcccugcagcucucaugcugcc

SEQ ID NO: 191960 - RNA, 32 nt, Human
ggcccugcagggaccauggaauccagagcuga

SEQ ID NO: 191961 - RNA, 32 nt, Human
ggcccugcagggggccagccugggggaaccuc

SEQ ID NO: 191962 - RNA, 32 nt, Human
ggcccugcagugaggacacgcccugcccaguc

SEQ ID NO: 191963 - RNA, 32 nt, Human
ggcccugcaguguggagagacacauaagccuu

SEQ ID NO: 191964 - RNA, 19 nt, Human
ggcccugcauccugccagg

SEQ ID NO: 191965 - RNA, 32 nt, Human
ggcccugcauuuucacgcugugcuaagcagcc

SEQ ID NO: 191966 - RNA, 21 nt, Human
ggcccugccacagcccucccu

SEQ ID NO: 191967 - RNA, 17 nt, Human
ggcccugccacccaggg

SEQ ID NO: 191968 - RNA, 32 nt, Human
ggcccugccacucuccccaagagggccuccau

SEQ ID NO: 191969 - RNA, 19 nt, Human
ggcccugccacugcccagg

SEQ ID NO: 191970 - RNA, 32 nt, Human
ggcccugccagguuguuuugcauaugugcauu

SEQ ID NO: 191971 - RNA, 32 nt, Human
ggcccugccccagccuguguagcucuuccugc

SEQ ID NO: 191972 - RNA, 32 nt, Human
ggcccugcccccgggcgauggugcaggcuggu

SEQ ID NO: 191973 - RNA, 32 nt, Human
ggcccugccccucuccccacauguaucccucg

SEQ ID NO: 191974 - RNA, 18 nt, Human
ggcccugcccuugccaga

SEQ ID NO: 191975 - RNA, 27 nt, Human
ggcccugcccuuggcaccaccagggug

SEQ ID NO: 191976 - RNA, 23 nt, Human
ggcccugccgggaacccaggcug

SEQ ID NO: 191977 - RNA, 21 nt, Human
ggcccugccggguggugcagg

SEQ ID NO: 191978 - RNA, 23 nt, Human
ggcccugccuaagccucagcaga

SEQ ID NO: 191979 - RNA, 32 nt, Human
ggcccugccuauacucugguggccugguccug

SEQ ID NO: 191980 - RNA, 18 nt, Human
ggcccugccucugcugcc

SEQ ID NO: 191981 - RNA, 18 nt, Human
ggcccugccugagccagg

SEQ ID NO: 191982 - RNA, 20 nt, Human
ggcccugccugcagccaggg

SEQ ID NO: 191983 - RNA, 21 nt, Human
ggcccugccugccacccuagg

SEQ ID NO: 191984 - RNA, 19 nt, Human
ggcccugccugcucccagg

SEQ ID NO: 191985 - RNA, 20 nt, Human
ggcccugccuggacccaggg

SEQ ID NO: 191986 - RNA, 21 nt, Human
ggcccugccuucccaccacca

SEQ ID NO: 191987 - RNA, 18 nt, Human
ggcccugccuucugccgc

SEQ ID NO: 191988 - RNA, 30 nt, Human
ggcccugccuugucccugcuccugugcuuu

SEQ ID NO: 191989 - RNA, 32 nt, Human
ggcccugccuugugcauguccauagugaggcu

SEQ ID NO: 191990 - RNA, 32 nt, Human
ggcccugcgagcagcagugccgagaugaaccc

SEQ ID NO: 191991 - RNA, 32 nt, Human
ggcccugcgcccugugcagggaaagggauggu

SEQ ID NO: 191992 - RNA, 32 nt, Human
ggcccugcgccugcccagccucgggugagccg

SEQ ID NO: 191993 - RNA, 32 nt, Human
ggcccugcggggcccagcccugccucagcugg

SEQ ID NO: 191994 - RNA, 25 nt, Human
ggcccugcuaagauucccucuacca

SEQ ID NO: 191995 - RNA, 18 nt, Human
ggcccugcuacuugaggg

SEQ ID NO: 191996 - RNA, 32 nt, Human
ggcccugcucacgucucggggcauuuuggcag

SEQ ID NO: 191997 - RNA, 32 nt, Human
ggcccugcuccucugcuggggucggccccgca

SEQ ID NO: 191998 - RNA, 32 nt, Human
ggcccugcuccuuccuccucuagguccaggcc

SEQ ID NO: 191999 - RNA, 32 nt, Human
ggcccugcucugugaccgccaggaugacugug

SEQ ID NO: 192000 - RNA, 32 nt, Human
ggcccugcucuuccucagcugugugggucaua

SEQ ID NO: 192001 - RNA, 22 nt, Human
ggcccugcugccucucucccuc

SEQ ID NO: 192002 - RNA, 32 nt, Human
ggcccugcugcucucucaggaccauccgauca

SEQ ID NO: 192003 - RNA, 32 nt, Human
ggcccugcugcuggugcuccucgccucuuggg

SEQ ID NO: 192004 - RNA, 20 nt, Human
ggcccugcuggaccagugug

SEQ ID NO: 192005 - RNA, 21 nt, Human
ggcccugcuggaccccaaggg

SEQ ID NO: 192006 - RNA, 32 nt, Human
ggcccugcuggagcaucucccccaagcccacu

SEQ ID NO: 192007 - RNA, 32 nt, Human
ggcccugcuggcagggacuugcaguggauucu

SEQ ID NO: 192008 - RNA, 22 nt, Human
ggcccugcuggccacgcagggg

SEQ ID NO: 192009 - RNA, 32 nt, Human
ggcccugcugucaaccucuccuccaggcccug

SEQ ID NO: 192010 - RNA, 22 nt, Human
ggcccugcugucgggccccagg

SEQ ID NO: 192011 - RNA, 23 nt, Human
ggcccugcuucacccacgccaga

SEQ ID NO: 192012 - RNA, 32 nt, Human
ggcgcgugcuuguaaucccagcuacucaggag

SEQ ID NO: 192013 - RNA, 32 nt, Human
ggcgcguggaggaggaggaaaaggagggaaag

SEQ ID NO: 192014 - RNA, 24 nt, Human
ggcgcguggcggcgcucggccucg

SEQ ID NO: 192015 - RNA, 22 nt, Human
ggcgcguggggugcagcgggag

SEQ ID NO: 192016 - RNA, 32 nt, Human
ggcgcguguguguagagccucagggcugagug

SEQ ID NO: 192017 - RNA, 32 nt, Human
ggcgcuacugaggccgcggagccggacugcgg

SEQ ID NO: 192018 - RNA, 32 nt, Human
ggcgcuagaggcaagaggaagggggucugcga

SEQ ID NO: 192019 - RNA, 21 nt, Human
ggcgcuagcaaacuucugcca

SEQ ID NO: 192020 - RNA, 22 nt, Human
ggcgcuagcccagcccgaccca

SEQ ID NO: 192021 - RNA, 32 nt, Human
ggcgcuagugggagacagggggcaggccagag

SEQ ID NO: 192022 - RNA, 22 nt, Human
ggcgcuaucucggcucgcugca

SEQ ID NO: 192023 - RNA, 32 nt, Human
ggcgcuauugcacuccagucuggguaacaggg

SEQ ID NO: 192024 - RNA, 32 nt, Human
ggcgcucaccuguaaucccaccauuuugggag

SEQ ID NO: 192025 - RNA, 32 nt, Human
ggcgcucaccuguaaucccggcuacucgggag

SEQ ID NO: 192026 - RNA, 32 nt, Human
ggcgcucagccuuggcuggaguagaauuaagu

SEQ ID NO: 192027 - RNA, 32 nt, Human
ggcgcucaucacagccacacuguacaagcuug

SEQ ID NO: 192028 - RNA, 32 nt, Human
ggcgcucauggacggaagaccccuggcucuau

SEQ ID NO: 192029 - RNA, 32 nt, Human
ggcgcuccaggccgcgcccccuuggcgccggg

SEQ ID NO: 192030 - RNA, 32 nt, Human
ggcgcuccgauccccuccucccucucuccgaa

SEQ ID NO: 192031 - RNA, 32 nt, Human
ggcgcuccgggacguggcaccuccucggcugg

SEQ ID NO: 192032 - RNA, 32 nt, Human
ggcgcuccuaaccucccgaacggggcggcugg

SEQ ID NO: 192033 - RNA, 32 nt, Human
ggcgcuccucaagauggcugccgacagugagc

SEQ ID NO: 192034 - RNA, 32 nt, Human
ggcgcuccugcugccgucucugcuccaggaag

SEQ ID NO: 192035 - RNA, 32 nt, Human
ggcgcuccuggugugugacuggguguccuggc

SEQ ID NO: 192036 - RNA, 32 nt, Human
ggcgcucgcucgggaccuuccaccucuccaac

SEQ ID NO: 192037 - RNA, 32 nt, Human
ggcgcucggggcccggccccucccucucccug

SEQ ID NO: 192038 - RNA, 20 nt, Human
ggcgcucgucccgucccaag

SEQ ID NO: 192039 - RNA, 31 nt, Human
ggcgcucucgcaaaugaagcugcaggccaag

SEQ ID NO: 192040 - RNA, 32 nt, Human
ggcgcucucuggguuuuauuguuauguggguu

SEQ ID NO: 192041 - RNA, 32 nt, Human
ggcgcucugcccuggagacuccggacacugac

SEQ ID NO: 192042 - RNA, 32 nt, Human
ggcgcucuggaaaagacagggagccaggcccu

SEQ ID NO: 192043 - RNA, 32 nt, Human
ggcgcucugggaacucugcuagaaucacucau

SEQ ID NO: 192044 - RNA, 19 nt, Human
ggcgcucuggguccacagg

SEQ ID NO: 192045 - RNA, 32 nt, Human
ggcgcucuggguggaggagaccagcucuaggc

SEQ ID NO: 192046 - RNA, 32 nt, Human
ggcgcucugucugccucugccugccagcucau

SEQ ID NO: 192047 - RNA, 32 nt, Human
ggcgcucuucagguucugccucugggaggcug

SEQ ID NO: 192048 - RNA, 26 nt, Human
ggcgcucuuggagguggugucggaga

SEQ ID NO: 192049 - RNA, 19 nt, Human
ggcgcugagauccccacag

SEQ ID NO: 192050 - RNA, 32 nt, Human
ggcgcugaggugucuggccugaggucaauggu

SEQ ID NO: 192051 - RNA, 32 nt, Human
ggcgcugauggccauggagggcuaccggcgcu

SEQ ID NO: 192052 - RNA, 32 nt, Human
ggcgcugcacucuagccugggugacagaguca

SEQ ID NO: 192053 - RNA, 19 nt, Human
ggcgcugcagccaccaggg

SEQ ID NO: 192054 - RNA, 31 nt, Human
ggcgcugccacgucugggccgcgguucccaa

SEQ ID NO: 192055 - RNA, 32 nt, Human
ggcgcugccagccucacgcucugggcacagcu

SEQ ID NO: 192056 - RNA, 32 nt, Human
ggcgcugccagccuccuccugcgcacagaucg

SEQ ID NO: 192057 - RNA, 32 nt, Human
ggcgcugccagccuggcugcuacugcccacca

SEQ ID NO: 192058 - RNA, 32 nt, Human
ggcgcugccccagagccacaaccagcccgccu

SEQ ID NO: 192059 - RNA, 32 nt, Human
ggcgcugccgccugccaggccauccggccccc

SEQ ID NO: 192060 - RNA, 21 nt, Human
ggcgcugcggcaguccagauc

SEQ ID NO: 192061 - RNA, 32 nt, Human
ggcgcugcggccugggagccucggggagaugc

SEQ ID NO: 192062 - RNA, 18 nt, Human
ggcgcugcgggcggggca

SEQ ID NO: 192063 - RNA, 32 nt, Human
ggcgcugcucacuguuuuccugcuucaguuuu

SEQ ID NO: 192064 - RNA, 32 nt, Human
ggcgcugcugagacgguggccagaucccagcg

SEQ ID NO: 192065 - RNA, 32 nt, Human
ggcgcugcugcacucaagcuuggaugacagag

SEQ ID NO: 192066 - RNA, 32 nt, Human
ggcgcugcugccaucuuuccucccagguggaa

SEQ ID NO: 192067 - RNA, 22 nt, Human
ggcgcuggaauuacaugaacau

SEQ ID NO: 192068 - RNA, 18 nt, Human
ggcgcuggacagaggggc

SEQ ID NO: 192069 - RNA, 19 nt, Human
ggcgcuggaccucagcaug

SEQ ID NO: 192070 - RNA, 20 nt, Human
ggcgcuggagccaggaccug

SEQ ID NO: 192071 - RNA, 32 nt, Human
ggcgcuggagccaggaccuggcguugggcggu

SEQ ID NO: 192072 - RNA, 19 nt, Human
ggcgcuggauuuugggaca

SEQ ID NO: 192073 - RNA, 17 nt, Human
ggcgcuggcagaggaca

SEQ ID NO: 192074 - RNA, 32 nt, Human
ggcgcuggcggcgcgcccugccccacggaccc

SEQ ID NO: 192075 - RNA, 32 nt, Human
ggcgcuggcuccgucugccagggaugacggcg

SEQ ID NO: 192076 - RNA, 21 nt, Human
ggcgcuggcuucaggaauaug

SEQ ID NO: 192077 - RNA, 32 nt, Human
ggcgcugggaauggccauguggaacaggccau

SEQ ID NO: 192078 - RNA, 32 nt, Human
ggcgcugggagagggcggagggggaggcggcg

SEQ ID NO: 192079 - RNA, 32 nt, Human
ggcgcugggaggacgcggcggcgcugggaacg

SEQ ID NO: 192080 - RNA, 32 nt, Human
ggcgcugggagggagaccagggcgcaguuccg

SEQ ID NO: 192081 - RNA, 32 nt, Human
ggcgcugggagguggagucguugcuguugcug

SEQ ID NO: 192082 - RNA, 32 nt, Human
ggcgcugggcuggagagcagguucgggcagcc

SEQ ID NO: 192083 - RNA, 32 nt, Human
ggcgcugguacugcugcuugcugguggagucc

SEQ ID NO: 192084 - RNA, 32 nt, Human
ggcgcuggugcuagguuccagugugggaggag

SEQ ID NO: 192085 - RNA, 18 nt, Human
ggcgcuguagucucaaag

SEQ ID NO: 192086 - RNA, 32 nt, Human
ggcgcugucuuccucccuuccccugggggucc

SEQ ID NO: 192087 - RNA, 32 nt, Human
ggcgcugugcagccucaccccgggcaggggcg

SEQ ID NO: 192088 - RNA, 19 nt, Human
ggcgcuguggagcgcaggg

SEQ ID NO: 192089 - RNA, 32 nt, Human
ggcgcuguggaggaggcagagaucagauuugu

SEQ ID NO: 192090 - RNA, 19 nt, Human
ggcgcuguuccacagugac

SEQ ID NO: 192091 - RNA, 32 nt, Human
ggcgcuuacccugcuuugggccugcguugcug

SEQ ID NO: 192092 - RNA, 32 nt, Human
ggcgcuucaauuaucccuccccacaaagauag

SEQ ID NO: 192093 - RNA, 32 nt, Human
ggcgcuucacacaccuuuucacuucuuggcac

SEQ ID NO: 192094 - RNA, 32 nt, Human
ggcgcuuccccuucuccucuggcuccgggguu

SEQ ID NO: 192095 - RNA, 32 nt, Human
ggcgcuuccugccucauccucggcugcauggg

SEQ ID NO: 192096 - RNA, 32 nt, Human
ggcgcuucuagaaggagguuaaaauggaaaau

SEQ ID NO: 192097 - RNA, 18 nt, Human
ggcgcuugagcccgcaag

SEQ ID NO: 192098 - RNA, 32 nt, Human
ggcgcuugccuguagucuagcuacuuggggug

SEQ ID NO: 192099 - RNA, 16 nt, Human
ggcgcuuguaauccca

SEQ ID NO: 192100 - RNA, 19 nt, Human
ggcgcuuguaaucccagcu

SEQ ID NO: 192101 - RNA, 32 nt, Human
ggcgcuuguaaucccagcuacuugggaggcug

SEQ ID NO: 192102 - RNA, 32 nt, Human
ggcgcuugucccauccuggacuuuuccucuca

SEQ ID NO: 192103 - RNA, 32 nt, Human
ggcgcuuguccccagugaguggcuguguccuc

SEQ ID NO: 192104 - RNA, 32 nt, Human
ggcgcuuuagggacuggacuugcaguguaaac

SEQ ID NO: 192105 - RNA, 32 nt, Human
ggcgcuuucauuuugcacucuaacuuaagagu

SEQ ID NO: 192106 - RNA, 19 nt, Human
ggcggaaagaaggcaccag

SEQ ID NO: 192107 - RNA, 19 nt, Human
ggcggaaaugcucucccca

SEQ ID NO: 192108 - RNA, 18 nt, Human
ggcggaacagccagagga

SEQ ID NO: 192109 - RNA, 32 nt, Human
ggcggaaccagccccggcugggcagcagcggg

SEQ ID NO: 192110 - RNA, 32 nt, Human
ggcggaaccgcgcugccgcagccugggauucc

SEQ ID NO: 192111 - RNA, 32 nt, Human
ggcggaacgcacuucgaccaccucucaggcgc

SEQ ID NO: 192112 - RNA, 32 nt, Human
ggcggaagaggaggaggaggaggaggaagggg

SEQ ID NO: 192113 - RNA, 32 nt, Human
ggcggaagaucaagcaaaggcagagagggagg

SEQ ID NO: 192114 - RNA, 20 nt, Human
ggcggaagcggcgagggcgg

SEQ ID NO: 192115 - RNA, 32 nt, Human
ggcggaaggcggacgaaaacagaacggaagac

SEQ ID NO: 192116 - RNA, 32 nt, Human
ggcggaaggcggggcgugggggucuguggcug

SEQ ID NO: 192117 - RNA, 20 nt, Human
ggcggaaucccuucugcucu

SEQ ID NO: 192118 - RNA, 20 nt, Human
ggcggacacuugagcccagg

SEQ ID NO: 192119 - RNA, 24 nt, Human
ggcggacagagugagacccuaucu

SEQ ID NO: 192120 - RNA, 32 nt, Human
ggcggacagcagggcggacagcagggaggaca

SEQ ID NO: 192121 - RNA, 32 nt, Human
ggcggacaucuguaaucccagcuacucaggag

SEQ ID NO: 192122 - RNA, 32 nt, Human
ggcggacccagaggggacauggagaggaacgc

SEQ ID NO: 192123 - RNA, 32 nt, Human
ggcggaccucacccuucucuucccaggucuau

SEQ ID NO: 192124 - RNA, 32 nt, Human
ggcggaccugggaagccuggauggcaaguggg

SEQ ID NO: 192125 - RNA, 32 nt, Human
ggcggacgcaggcagagaagcugcaggagcug

SEQ ID NO: 192126 - RNA, 32 nt, Human
ggcggacgccuguaaucccagcuacuuggaag

SEQ ID NO: 192127 - RNA, 32 nt, Human
ggcggacucaggcuggggucugcagugcagca

SEQ ID NO: 192128 - RNA, 32 nt, Human
ggcggacugugaggcagccaggagccagcugc

SEQ ID NO: 192129 - RNA, 32 nt, Human
ggcggagaagucgggaggggacaggaagggag

SEQ ID NO: 192130 - RNA, 32 nt, Human
ggcggagagagaaggaaggaggugguugugca

SEQ ID NO: 192131 - RNA, 32 nt, Human
ggcggagaggggagaagaaggaagggaagggc

SEQ ID NO: 192132 - RNA, 32 nt, Human
ggcggagcaggcggcggugcaggaggcccgug

SEQ ID NO: 192133 - RNA, 32 nt, Human
ggcggagcagggcugagcccgcugcccgcccg

SEQ ID NO: 192134 - RNA, 32 nt, Human
ggcggagccagagagauguaacuucacccugg

SEQ ID NO: 192135 - RNA, 22 nt, Human
ggcggagcgcgucccgcagccg

SEQ ID NO: 192136 - RNA, 32 nt, Human
ggcggagcugcugcggaucaggacccgagccg

SEQ ID NO: 192137 - RNA, 20 nt, Human
ggcggagcuggagccccggg

SEQ ID NO: 192138 - RNA, 24 nt, Human
ggcggaggaggaggaggagcggga

SEQ ID NO: 192139 - RNA, 32 nt, Human
ggcggaggaggaggaggagcgggaggagcgcg

SEQ ID NO: 192140 - RNA, 32 nt, Human
ggcggaggaggagggaaggaagauggcggccg

SEQ ID NO: 192141 - RNA, 32 nt, Human
ggcggaggaggcggcggcggcgauggagguga

SEQ ID NO: 192142 - RNA, 32 nt, Human
ggcggaggcaccaagcccuguuuucuuggugu

SEQ ID NO: 192143 - RNA, 32 nt, Human
ggcggaggcagaggaagagggagcgggagcuc

SEQ ID NO: 192144 - RNA, 32 nt, Human
ggcggaggcgggaggaucaugaggucaggaga

SEQ ID NO: 192145 - RNA, 18 nt, Human
ggcggaggcggggcggcu

SEQ ID NO: 192146 - RNA, 32 nt, Human
ggcggaggcgggguuucaguggcuucuggugc

SEQ ID NO: 192147 - RNA, 19 nt, Human
ggcggaggcucccguggcc

SEQ ID NO: 192148 - RNA, 32 nt, Human
ggcggaggcuucccacggggaggcaggaagaa

SEQ ID NO: 192149 - RNA, 32 nt, Human
ggcggagggagagcaggagccacugagaugag

SEQ ID NO: 192150 - RNA, 32 nt, Human
ggcggagggaggcggcggcggcggcggcggga

SEQ ID NO: 192151 - RNA, 32 nt, Human
ggcggagggggagagcgcgggccgcgcgggcg

SEQ ID NO: 192152 - RNA, 32 nt, Human
ggcggaggugggcaccacugaguugcacucag

SEQ ID NO: 192153 - RNA, 32 nt, Human
ggcggagguugcagugaguugcagucacaccc

SEQ ID NO: 192154 - RNA, 32 nt, Human
ggcggaguaaagggacuugagcgagccaguug

SEQ ID NO: 192155 - RNA, 20 nt, Human
ggcggagucggcgccgagaa

SEQ ID NO: 192156 - RNA, 32 nt, Human
ggcggagucggggauggagggagcuggccaca

SEQ ID NO: 192157 - RNA, 32 nt, Human
ggcggagucugaggcccgagccaagauggcgg

SEQ ID NO: 192158 - RNA, 32 nt, Human
ggcggagugagggugaggagccugguccaggg

SEQ ID NO: 192159 - RNA, 32 nt, Human
ggcggaguucugagaggaacugggaagcaggc

SEQ ID NO: 192160 - RNA, 18 nt, Human
ggcggauaaccugagguc

SEQ ID NO: 192161 - RNA, 32 nt, Human
ggcggaucacaaggucaggagaucgagaccau

SEQ ID NO: 192162 - RNA, 32 nt, Human
ggcggaucacaugaggccaggaauucgagacc

SEQ ID NO: 192163 - RNA, 32 nt, Human
ggcggaucaccugaggccaggaguucaagacc

SEQ ID NO: 192164 - RNA, 16 nt, Human
ggcggaucacgagguc

SEQ ID NO: 192165 - RNA, 19 nt, Human
ggcggaucacgaggucagg

SEQ ID NO: 192166 - RNA, 32 nt, Human
ggcggaucacgaggucaggaaaucgagaccau

SEQ ID NO: 192167 - RNA, 32 nt, Human
ggcggaucacgaggucaggagaccgagaucau

SEQ ID NO: 192168 - RNA, 32 nt, Human
ggcggaucacuugaggccagcaguuugagacc

SEQ ID NO: 192169 - RNA, 32 nt, Human
ggcggaucacuugaggccaggaguucaagacc

SEQ ID NO: 192170 - RNA, 32 nt, Human
ggcggaucacuugaggccaggaguucgagacc

SEQ ID NO: 192171 - RNA, 32 nt, Human
ggcggaucacuugaggccaggaguuugagacc

SEQ ID NO: 192172 - RNA, 32 nt, Human
ggcggaucacuugaggccagggguuugagacc

SEQ ID NO: 192173 - RNA, 19 nt, Human
ggcggaucacuugagguca

SEQ ID NO: 192174 - RNA, 32 nt, Human
ggcggaucaucugaggccaggaguucgagacc

SEQ ID NO: 192175 - RNA, 32 nt, Human
ggcggaucccuuacacucaggaguucaagacc

SEQ ID NO: 192176 - RNA, 32 nt, Human
ggcggaucgcuugagcccaggagaccagguug

SEQ ID NO: 192177 - RNA, 21 nt, Human
ggcggaucgcuugagcucagg

SEQ ID NO: 192178 - RNA, 32 nt, Human
ggcggaucgcuugaggagaguucgugaucagc

SEQ ID NO: 192179 - RNA, 32 nt, Human
ggcggaucugcaagcaccucggagcacccacc

SEQ ID NO: 192180 - RNA, 23 nt, Human
ggcggaugccuguaaucccagcu

SEQ ID NO: 192181 - RNA, 32 nt, Human
ggcggaugccuguaaucccagcuacuugggag

SEQ ID NO: 192182 - RNA, 32 nt, Human
ggcggauggaggccugacgucccuggaguuga

SEQ ID NO: 192183 - RNA, 32 nt, Human
ggcggauggaucaccugaggucgggaauucga

SEQ ID NO: 192184 - RNA, 32 nt, Human
ggcggauggaucacuugaggucaggggaucac

SEQ ID NO: 192185 - RNA, 32 nt, Human
ggcggauguugcuugcacuccagccuggguga

SEQ ID NO: 192186 - RNA, 21 nt, Human
ggcggauugccugagcucagg

SEQ ID NO: 192187 - RNA, 32 nt, Human
ggcggauuggguaggaggauuacuugaggcca

SEQ ID NO: 192188 - RNA, 21 nt, Human
ggcggcaagggcgggagggag

SEQ ID NO: 192189 - RNA, 32 nt, Human
ggcggcacaguggccaagucgauuggccgugg

SEQ ID NO: 192190 - RNA, 32 nt, Human
ggcggcaccacugccgucauuucagcuucugg

SEQ ID NO: 192191 - RNA, 32 nt, Human
ggcggcagagacagaagagcggggucggggcc

SEQ ID NO: 192192 - RNA, 19 nt, Human
ggcggcagaggaacaggag

SEQ ID NO: 192193 - RNA, 32 nt, Human
ggcggcagcagguugguuuccacagcccggcc

SEQ ID NO: 192194 - RNA, 20 nt, Human
ggcggcagccagcgagggag

SEQ ID NO: 192195 - RNA, 18 nt, Human
ggcggcagcgacgaagga

SEQ ID NO: 192196 - RNA, 32 nt, Human
ggcggcagcgcccugccgacgccggggaggga

SEQ ID NO: 192197 - RNA, 32 nt, Human
ggcggcagcggugggagaugccggggcggccg

SEQ ID NO: 192198 - RNA, 32 nt, Human
ggcggcagcgguuggagguuguaggaccggcg

SEQ ID NO: 192199 - RNA, 32 nt, Human
ggcggcaggaccagcaugcaccaccgaaacga

SEQ ID NO: 192200 - RNA, 32 nt, Human
ggcggcaggcagcaggcuguggaggaggcccc

SEQ ID NO: 192201 - RNA, 32 nt, Human
ggcggcaggcccgggucaggugccucgagauc

SEQ ID NO: 192202 - RNA, 22 nt, Human
ggcggcaggcggcaggcagcag

SEQ ID NO: 192203 - RNA, 32 nt, Human
ggcggcagggcccgggcggagccccggggagu

SEQ ID NO: 192204 - RNA, 22 nt, Human
ggcggcaggguggcggacggag

SEQ ID NO: 192205 - RNA, 22 nt, Human
ggcggcagggugggggagggag

SEQ ID NO: 192206 - RNA, 32 nt, Human
ggcggcaguggaggggacaguggaggcuggag

SEQ ID NO: 192207 - RNA, 32 nt, Human
ggcggcaucacugagaugcucaguccugaauu

SEQ ID NO: 192208 - RNA, 32 nt, Human
ggcggcaucugcaaauuaaggggacagagcaa

SEQ ID NO: 192209 - RNA, 32 nt, Human
ggcggcauuuugccccuguccuagagauuugu

SEQ ID NO: 192210 - RNA, 32 nt, Human
ggcggccacacuucccucccucccucccuucc

SEQ ID NO: 192211 - RNA, 32 nt, Human
ggcggccacccccgccuccaccacuuuccacc

SEQ ID NO: 192212 - RNA, 32 nt, Human
ggcggccacuggcucuguguccuuggggaagc

SEQ ID NO: 192213 - RNA, 20 nt, Human
ggcggccagaggccugggca

SEQ ID NO: 192214 - RNA, 32 nt, Human
ggcggccaggaggugagauggcagcugggcaa

SEQ ID NO: 192215 - RNA, 32 nt, Human
ggcggccagugaccacggccaagcagggccug

SEQ ID NO: 192216 - RNA, 19 nt, Human
ggcggccauccagaagcug

SEQ ID NO: 192217 - RNA, 32 nt, Human
ggcggccauggaguugggcgagcugcucuaca

SEQ ID NO: 192218 - RNA, 28 nt, Human
ggcggcccaaguggagcucaccucuccc

SEQ ID NO: 192219 - RNA, 32 nt, Human
ggcggcccagcacuuccucagacacaacuucu

SEQ ID NO: 192220 - RNA, 21 nt, Human
ggcggcccaggcccccagcac

SEQ ID NO: 192221 - RNA, 32 nt, Human
ggcggccccacuggcccucucaggcugcggag

SEQ ID NO: 192222 - RNA, 18 nt, Human
ggcggcccccauggcguc

SEQ ID NO: 192223 - RNA, 32 nt, Human
ggcggccccugcccagccccagcuaugugcac

SEQ ID NO: 192224 - RNA, 32 nt, Human
ggcggcccuccagcuucugcagguggugcugg

SEQ ID NO: 192225 - RNA, 32 nt, Human
ggcggcccugggagcagagguggagcgacccc

SEQ ID NO: 192226 - RNA, 32 nt, Human
ggcggcccuguugcccuggagacgcuuucccu

SEQ ID NO: 192227 - RNA, 32 nt, Human
ggcggccgagacuggcggggguggacgcccgg

SEQ ID NO: 192228 - RNA, 32 nt, Human
ggcggccgagaggggcggcggcggcggcggcg

SEQ ID NO: 192229 - RNA, 32 nt, Human
ggcggccgaggaggaggagggggaagcggcgg

SEQ ID NO: 192230 - RNA, 22 nt, Human
ggcggccgaggcgcccggcgca

SEQ ID NO: 192231 - RNA, 32 nt, Human
ggcggccgcagcccuggcugacugcacggcuu

SEQ ID NO: 192232 - RNA, 22 nt, Human
ggcggccgcagccucggcuaca

SEQ ID NO: 192233 - RNA, 32 nt, Human
ggcggccgccccagugcugauggagaugccac

SEQ ID NO: 192234 - RNA, 32 nt, Human
ggcggccgcugcaaaguuuccccggcggcggc

SEQ ID NO: 192235 - RNA, 32 nt, Human
ggcggccggaggaucgccgagcucaggguccc

SEQ ID NO: 192236 - RNA, 32 nt, Human
ggcggccggcgcaauucugccucucagagaga

SEQ ID NO: 192237 - RNA, 32 nt, Human
ggcggccggcgugggagccgggggaccaccau

SEQ ID NO: 192238 - RNA, 32 nt, Human
ggcggccgggagggaguugucggcgccgcggc

SEQ ID NO: 192239 - RNA, 21 nt, Human
ggcggccgggucucgaccaca

SEQ ID NO: 192240 - RNA, 32 nt, Human
ggcggccggguggcgggggugaguggggccag

SEQ ID NO: 192241 - RNA, 32 nt, Human
ggcggccgugaacucagacaccagagaugaag

SEQ ID NO: 192242 - RNA, 32 nt, Human
ggcggccuaccuccacaccacaaccaccuuca

SEQ ID NO: 192243 - RNA, 32 nt, Human
ggcggccuccaggaagcggaaaagcaaggggc

SEQ ID NO: 192244 - RNA, 32 nt, Human
ggcggccucuaugugcucaggugcagaccuuc

SEQ ID NO: 192245 - RNA, 32 nt, Human
ggcggccucuuugcgagcaucagucuauugag

SEQ ID NO: 192246 - RNA, 32 nt, Human
ggcggccugagcgugaugcuccggguucucgg

SEQ ID NO: 192247 - RNA, 19 nt, Human
ggcggccuggagccccggg

SEQ ID NO: 192248 - RNA, 32 nt, Human
ggcggccugugcagcgcggcccccggcggggg

SEQ ID NO: 192249 - RNA, 22 nt, Human
ggcggccuuccccugcaguccu

SEQ ID NO: 192250 - RNA, 32 nt, Human
ggcggcgacggcagcccugaaaugcauuuucc

SEQ ID NO: 192251 - RNA, 18 nt, Human
ggcggcgacggccgggcg

SEQ ID NO: 192252 - RNA, 32 nt, Human
ggcggcgacggcgacauggagagcggggccua

SEQ ID NO: 192253 - RNA, 32 nt, Human
ggcggcgacugccugccugccuggguugcgga

SEQ ID NO: 192254 - RNA, 32 nt, Human
ggcggcgagaucagccuccugucucaucugga

SEQ ID NO: 192255 - RNA, 32 nt, Human
ggcggcgagaucugggcucggguugaggaguu

SEQ ID NO: 192256 - RNA, 32 nt, Human
ggcggcgagccgcggcccagaccccggcagag

SEQ ID NO: 192257 - RNA, 32 nt, Human
ggcggcgaggagcagagggagcggaggagggg

SEQ ID NO: 192258 - RNA, 32 nt, Human
ggcggcgcagagaagagcacggcgccggcgca

SEQ ID NO: 192259 - RNA, 32 nt, Human
ggcggcgcaggcggagagaacauugaaaguau

SEQ ID NO: 192260 - RNA, 32 nt, Human
ggcggcgccagccuggcucucggcucgggcga

SEQ ID NO: 192261 - RNA, 32 nt, Human
ggcggcgccggaggacgcggaggacucccugg

SEQ ID NO: 192262 - RNA, 29 nt, Human
ggcggcgccuguaaucccagcuacuuggg

SEQ ID NO: 192263 - RNA, 17 nt, Human
ggcggcgcgcggaggag

SEQ ID NO: 192264 - RNA, 32 nt, Human
ggcggcgcugggagguggagucguugcuguug

SEQ ID NO: 192265 - RNA, 32 nt, Human
ggcggcgcuuggcagccaggagcucugcauug

SEQ ID NO: 192266 - RNA, 32 nt, Human
ggcggcggaggaggagaaaggaaagaggaagg

SEQ ID NO: 192267 - RNA, 32 nt, Human
ggcggcggaggaggaggaggagcgggaggagc

SEQ ID NO: 192268 - RNA, 32 nt, Human
ggcggcggagggcagagcaggcccugcggaga

SEQ ID NO: 192269 - RNA, 32 nt, Human
ggcggcggcaaaggaaaaugcuuggacagaag

SEQ ID NO: 192270 - RNA, 32 nt, Human
ggcggcggcaacaaugcacggagccgccagag

SEQ ID NO: 192271 - RNA, 20 nt, Human
ggcggcggcagcagaggcgg

SEQ ID NO: 192272 - RNA, 32 nt, Human
ggcggcggcagccucuccucuggccgauggac

SEQ ID NO: 192273 - RNA, 32 nt, Human
ggcggcggcccgggcucagaggggccuuccag

SEQ ID NO: 192274 - RNA, 32 nt, Human
ggcggcggccgaggcggcgucguuauuuccgu

SEQ ID NO: 192275 - RNA, 20 nt, Human
ggcggcggcgacgggugcgg

SEQ ID NO: 192276 - RNA, 18 nt, Human
ggcggcggcgcagaggag

SEQ ID NO: 192277 - RNA, 32 nt, Human
ggcggcggcgcagaggaggaggcaggcggcgg

SEQ ID NO: 192278 - RNA, 18 nt, Human
ggcggcggcgcggaggag

SEQ ID NO: 192279 - RNA, 20 nt, Human
ggcggcggcgcuuggccaua

SEQ ID NO: 192280 - RNA, 32 nt, Human
ggcggcggcggcagaggcggcgggaggaugac

SEQ ID NO: 192281 - RNA, 32 nt, Human
ggcggcggcggcagcagcaggagcagccccgg

SEQ ID NO: 192282 - RNA, 32 nt, Human
ggcggcggcggcagcagcgcggcucggucucu

SEQ ID NO: 192283 - RNA, 32 nt, Human
ggcggcggcggcagcggcgcucgagcgguucc

SEQ ID NO: 192284 - RNA, 18 nt, Human
ggcggcggcggcgcggcg

SEQ ID NO: 192285 - RNA, 32 nt, Human
ggcggcggcggcggaggcaggagcagccuggg

SEQ ID NO: 192286 - RNA, 32 nt, Human
ggcggcggcggcggaggcgucgguggaggagg

SEQ ID NO: 192287 - RNA, 32 nt, Human
ggcggcggcggcggaggcugccauggacgacg

SEQ ID NO: 192288 - RNA, 32 nt, Human
ggcggcggcggcggccccagacucccuccgga

SEQ ID NO: 192289 - RNA, 26 nt, Human
ggcggcggcggcggccgaggaggagg

SEQ ID NO: 192290 - RNA, 32 nt, Human
ggcggcggcggcggcggcagcugcuugggcgc

SEQ ID NO: 192291 - RNA, 32 nt, Human
ggcggcggcggcggcggcgggagcagcagcgg

SEQ ID NO: 192292 - RNA, 18 nt, Human
ggcggcggcggcgggcgg

SEQ ID NO: 192293 - RNA, 32 nt, Human
ggcggcggcugcagcagcagcaacaagucggg

SEQ ID NO: 192294 - RNA, 32 nt, Human
ggcggcggcugcagcgcuagcggcgcgggggc

SEQ ID NO: 192295 - RNA, 32 nt, Human
ggcggcggcugcaggcacgggcacgggcacgg

SEQ ID NO: 192296 - RNA, 32 nt, Human
ggcggcggcugcagggcagguccaggggccac

SEQ ID NO: 192297 - RNA, 32 nt, Human
ggcggcggcugcugugcugggugcagugagga

SEQ ID NO: 192298 - RNA, 19 nt, Human
ggcggcggcuggggggcug

SEQ ID NO: 192299 - RNA, 32 nt, Human
ggcggcgggaacaggugccggcgccuccgccc

SEQ ID NO: 192300 - RNA, 32 nt, Human
ggcggcgggacccggagcaggagcggcggcag

SEQ ID NO: 192301 - RNA, 32 nt, Human
ggcggcgggaggcggaggaggcggcggcggcg

SEQ ID NO: 192302 - RNA, 32 nt, Human
ggcggcgggauggcaacagccuccggggccuc

SEQ ID NO: 192303 - RNA, 32 nt, Human
ggcggcgggcaggaggcugcugagggauggag

SEQ ID NO: 192304 - RNA, 32 nt, Human
ggcggcgggcaggccggggacccggacgccag

SEQ ID NO: 192305 - RNA, 32 nt, Human
ggcggcgggcaggcgggugggggcacaccccu

SEQ ID NO: 192306 - RNA, 32 nt, Human
ggcggcgggcaggcgugcggaggacacuccug

SEQ ID NO: 192307 - RNA, 32 nt, Human
ggcggcggugagaagagcgaggcggaggaggg

SEQ ID NO: 192308 - RNA, 32 nt, Human
ggcggcgguggaggcugaggcggcggccgagg

SEQ ID NO: 192309 - RNA, 32 nt, Human
ggcggcgguggcggcagcugcuugggcgcggu

SEQ ID NO: 192310 - RNA, 32 nt, Human
ggcggcgguggcgguggaggaggcggggcggc

SEQ ID NO: 192311 - RNA, 32 nt, Human
ggcggcgguggcuguagguugugcggcugcag

SEQ ID NO: 192312 - RNA, 32 nt, Human
ggcggcgguggucugaggaaguucuaucuugg

SEQ ID NO: 192313 - RNA, 17 nt, Human
ggcggcgguugauccca

SEQ ID NO: 192314 - RNA, 32 nt, Human
ggcggcgguugcgagagagaugagccgcggcg

SEQ ID NO: 192315 - RNA, 32 nt, Human
ggcggcguaggggcggaggucgcgccugagug

SEQ ID NO: 192316 - RNA, 32 nt, Human
ggcggcgucacugcacccuccgccaggcuccg

SEQ ID NO: 192317 - RNA, 32 nt, Human
ggcggcgucugugguuugaauuccagcggcgc

SEQ ID NO: 192318 - RNA, 32 nt, Human
ggcggcguggagccugcugccaugaagucagc

SEQ ID NO: 192319 - RNA, 32 nt, Human
ggcggcguggucucccugcucuguccccacac

SEQ ID NO: 192320 - RNA, 32 nt, Human
ggcggcuacagcucaccguggggaagaucaac

SEQ ID NO: 192321 - RNA, 32 nt, Human
ggcggcuauuuuugccaccugccuugggugcc

SEQ ID NO: 192322 - RNA, 22 nt, Human
ggcggcucaacaccgcgaggag

SEQ ID NO: 192323 - RNA, 23 nt, Human
ggcggcucacaccuguaauccca

SEQ ID NO: 192324 - RNA, 23 nt, Human
ggcggcucacgccuguaauccca

SEQ ID NO: 192325 - RNA, 32 nt, Human
ggcggcucaguucugcggugccagggagugga

SEQ ID NO: 192326 - RNA, 23 nt, Human
ggcggcucaugccuauaauccca

SEQ ID NO: 192327 - RNA, 20 nt, Human
ggcggcucaugccuguaauc

SEQ ID NO: 192328 - RNA, 23 nt, Human
ggcggcucaugccuguaauccca

SEQ ID NO: 192329 - RNA, 32 nt, Human
ggcggcuccaagagccccagagcugccugcau

SEQ ID NO: 192330 - RNA, 32 nt, Human
ggcggcuccagccccagacaacagcccaggca

SEQ ID NO: 192331 - RNA, 32 nt, Human
ggcggcucccgccugugaucccggcacuuugg

SEQ ID NO: 192332 - RNA, 32 nt, Human
ggcggcuccgacgcagguggagcugcugaccu

SEQ ID NO: 192333 - RNA, 32 nt, Human
ggcggcuccuccucccacucugcuccuccucu

SEQ ID NO: 192334 - RNA, 32 nt, Human
ggcggcucugcaggaccagccagcagccucug

SEQ ID NO: 192335 - RNA, 23 nt, Human
ggcggcugaaucacuugagguua

SEQ ID NO: 192336 - RNA, 32 nt, Human
ggcggcugagccaggggcccuccuguguuuga

SEQ ID NO: 192337 - RNA, 32 nt, Human
ggcggcugagccugagcggggauguagaggcg

SEQ ID NO: 192338 - RNA, 32 nt, Human
ggcggcugagcuccagccaccccgcagucacu

SEQ ID NO: 192339 - RNA, 16 nt, Human
ggcggcugcaaggggc

SEQ ID NO: 192340 - RNA, 19 nt, Human
ggcggcugcuccagcucca

SEQ ID NO: 192341 - RNA, 32 nt, Human
ggcggcugcucgcggaggcacuucuccgagcg

SEQ ID NO: 192342 - RNA, 32 nt, Human
ggcggcugcucuggaccucgguguucacugac

SEQ ID NO: 192343 - RNA, 32 nt, Human
ggcggcuggaaagaggagaaggagagggagua

SEQ ID NO: 192344 - RNA, 32 nt, Human
ggcggcuggacggggcuggagcugucgggagg

SEQ ID NO: 192345 - RNA, 32 nt, Human
ggcggcugggacucacccugauuuaaagcucc

SEQ ID NO: 192346 - RNA, 22 nt, Human
ggcggcugucccugugcauccu

SEQ ID NO: 192347 - RNA, 25 nt, Human
ggcggcugugcuggcacccuuggca

SEQ ID NO: 192348 - RNA, 32 nt, Human
ggcggcuuaccagcugggucagucccaucucg

SEQ ID NO: 192349 - RNA, 32 nt, Human
ggcggcuucuaggagcuagucgaaggagcgag

SEQ ID NO: 192350 - RNA, 32 nt, Human
ggcggcuuguguccacgggacgcgggcggauc

SEQ ID NO: 192351 - RNA, 32 nt, Human
ggcgggaaaagggaucaaagacucagagagac

SEQ ID NO: 192352 - RNA, 32 nt, Human
ggcgggaagaaagagggaguucuggccaccug

SEQ ID NO: 192353 - RNA, 32 nt, Human
ggcgggaagaggaggcgcgagaauggaggugg

SEQ ID NO: 192354 - RNA, 32 nt, Human
ggcgggaaggggcagaggccgugagcucucag

SEQ ID NO: 192355 - RNA, 32 nt, Human
ggcgggaaugggaccugcgcuccagggugguc

SEQ ID NO: 192356 - RNA, 32 nt, Human
ggcgggacaacucaaagguggggagagggaug

SEQ ID NO: 192357 - RNA, 19 nt, Human
ggcgggacaguccuucccu

SEQ ID NO: 192358 - RNA, 32 nt, Human
ggcgggaccaaggaggugcggggcaagaagga

SEQ ID NO: 192359 - RNA, 19 nt, Human
ggcgggacccgccagcuuc

SEQ ID NO: 192360 - RNA, 21 nt, Human
ggcgggacuaucaggagucca

SEQ ID NO: 192361 - RNA, 32 nt, Human
ggcgggacuaucaggaguccacugccuccaug

SEQ ID NO: 192362 - RNA, 32 nt, Human
ggcgggacuccagacugggaacggaagucagc

SEQ ID NO: 192363 - RNA, 32 nt, Human
ggcgggacugggucaaguggguggagcuccuc

SEQ ID NO: 192364 - RNA, 32 nt, Human
ggcgggacugggugaagagugggauugggaga

SEQ ID NO: 192365 - RNA, 32 nt, Human
ggcgggacuuccucuuccucggggacaacugu

SEQ ID NO: 192366 - RNA, 32 nt, Human
ggcgggagaagggagaggagugacauccguuu

SEQ ID NO: 192367 - RNA, 32 nt, Human
ggcgggagagaggaagagaggggagcgcggug

SEQ ID NO: 192368 - RNA, 21 nt, Human
ggcgggagaucagccgaaaga

SEQ ID NO: 192369 - RNA, 32 nt, Human
ggcgggagcaaugagauugccacuccaucccc

SEQ ID NO: 192370 - RNA, 20 nt, Human
ggcgggagccaagccgagga

SEQ ID NO: 192371 - RNA, 18 nt, Human
ggcgggagcggcgcggug

SEQ ID NO: 192372 - RNA, 23 nt, Human
ggcgggaggacggcuccgcgcug

SEQ ID NO: 192373 - RNA, 32 nt, Human
ggcgggaggagagaagggacagcucugggagg

SEQ ID NO: 192374 - RNA, 32 nt, Human
ggcgggaggagggaguggagagacugacuggc

SEQ ID NO: 192375 - RNA, 26 nt, Human
ggcgggaggcggaggcgggagggcgg

SEQ ID NO: 192376 - RNA, 32 nt, Human
ggcgggaggcuggaguagagggaagccugcaa

SEQ ID NO: 192377 - RNA, 20 nt, Human
ggcgggagggagccgagaga

SEQ ID NO: 192378 - RNA, 15 nt, Human
ggcgggagggggcag

SEQ ID NO: 192379 - RNA, 16 nt, Human
ggcgggaggggggcag

SEQ ID NO: 192380 - RNA, 31 nt, Human
ggcgggagugagaggagaagggagagagcug

SEQ ID NO: 192381 - RNA, 21 nt, Human
ggcgggaucacucaggcucca

SEQ ID NO: 192382 - RNA, 32 nt, Human
ggcgggauugcuugaguccagccugggcagua

SEQ ID NO: 192383 - RNA, 32 nt, Human
ggcgggcaaacaguggcgcccacccagaccgg

SEQ ID NO: 192384 - RNA, 32 nt, Human
ggcgggcaccuguaaucccagccacuugggag

SEQ ID NO: 192385 - RNA, 32 nt, Human
ggcgggcaccuguaaucccagcuacucaggag

SEQ ID NO: 192386 - RNA, 32 nt, Human
ggcgggcaccuguaaucccagcuacucgggag

SEQ ID NO: 192387 - RNA, 32 nt, Human
ggcgggcaccuguaaucccagcuacuugggag

SEQ ID NO: 192388 - RNA, 32 nt, Human
ggcgggcacuuguaaucccagcuacucccaag

SEQ ID NO: 192389 - RNA, 32 nt, Human
ggcgggcaggcagggguuagugaaaggacacu

SEQ ID NO: 192390 - RNA, 32 nt, Human
ggcgggcagggugggccauggguaauuuagga

SEQ ID NO: 192391 - RNA, 32 nt, Human
ggcgggcagugaacgaguguggggaaggauug

SEQ ID NO: 192392 - RNA, 32 nt, Human
ggcgggcagugcauccagaagcguuuauauuc

SEQ ID NO: 192393 - RNA, 32 nt, Human
ggcgggccacagucuccagccugaagcggaag

SEQ ID NO: 192394 - RNA, 20 nt, Human
ggcgggcccacucagccccg

SEQ ID NO: 192395 - RNA, 24 nt, Human
ggcgggcccagaccggcuucucgg

SEQ ID NO: 192396 - RNA, 23 nt, Human
ggcgggcccagcaccccggccgg

SEQ ID NO: 192397 - RNA, 20 nt, Human
ggcgggcccagcacuuuccg

SEQ ID NO: 192398 - RNA, 32 nt, Human
ggcgggcccaggagccucagccagccacgugg

SEQ ID NO: 192399 - RNA, 21 nt, Human
ggcgggccccccagcacccgg

SEQ ID NO: 192400 - RNA, 24 nt, Human
ggcgggcccggccgccgcuuccgg

SEQ ID NO: 192401 - RNA, 32 nt, Human
ggcgggcccggcggcgggcaagugacugcccg

SEQ ID NO: 192402 - RNA, 32 nt, Human
ggcgggcccugagccggcaccuccccuuucgg

SEQ ID NO: 192403 - RNA, 32 nt, Human
ggcgggcccugggagagcugggacgggcggcg

SEQ ID NO: 192404 - RNA, 21 nt, Human
ggcgggccuggcggcucccgg

SEQ ID NO: 192405 - RNA, 32 nt, Human
ggcgggcgcccguaaucccagcuacucgggag

SEQ ID NO: 192406 - RNA, 32 nt, Human
ggcgggcgcccuguugggcuuccugugacggg

SEQ ID NO: 192407 - RNA, 32 nt, Human
ggcgggcgccgcacccccucccuggccgccug

SEQ ID NO: 192408 - RNA, 32 nt, Human
ggcgggcgccgggacgccugggugccgcagac

SEQ ID NO: 192409 - RNA, 32 nt, Human
ggcgggcgccuguaaucacagcuacucaggag

SEQ ID NO: 192410 - RNA, 32 nt, Human
ggcgggcgccuguaaucccaacuacucaggag

SEQ ID NO: 192411 - RNA, 32 nt, Human
ggcgggcgccuguaaucccagcuacucaagag

SEQ ID NO: 192412 - RNA, 32 nt, Human
ggcgggcgccuguaaucccagcuacucaggag

SEQ ID NO: 192413 - RNA, 32 nt, Human
ggcgggcgccuguaaucccagcuacucgggaa

SEQ ID NO: 192414 - RNA, 32 nt, Human
ggcgggcgccuguaaucccagcuacucgggag

SEQ ID NO: 192415 - RNA, 32 nt, Human
ggcgggcgccuguaaucccagcuacugagggg

SEQ ID NO: 192416 - RNA, 32 nt, Human
ggcgggcgccuguaaucccagcuacuugggaa

SEQ ID NO: 192417 - RNA, 32 nt, Human
ggcgggcgccuguaaucccagcuacuugggag

SEQ ID NO: 192418 - RNA, 32 nt, Human
ggcgggcgccuguaaucccagcuacuugggug

SEQ ID NO: 192419 - RNA, 32 nt, Human
ggcgggcgccuguaaucccagguacucaggag

SEQ ID NO: 192420 - RNA, 32 nt, Human
ggcgggcgccuguaauccuagcugcuugggag

SEQ ID NO: 192421 - RNA, 32 nt, Human
ggcgggcgccuguuaucccagcuacuugggag

SEQ ID NO: 192422 - RNA, 32 nt, Human
ggcgggcgcugguaaucccagcuacucaggug

SEQ ID NO: 192423 - RNA, 32 nt, Human
ggcgggcggaggcggcgggagcgguggugccc

SEQ ID NO: 192424 - RNA, 32 nt, Human
ggcgggcggcaggugagcaaggagaacguguc

SEQ ID NO: 192425 - RNA, 32 nt, Human
ggcgggcggccgcggcgccgcgcuggugggug

SEQ ID NO: 192426 - RNA, 32 nt, Human
ggcgggcggcgcgugucugcagcugcuccggg

SEQ ID NO: 192427 - RNA, 22 nt, Human
ggcgggcgggaggcggacgcgg

SEQ ID NO: 192428 - RNA, 32 nt, Human
ggcgggcggguggcaggggcugucugugaaau

SEQ ID NO: 192429 - RNA, 32 nt, Human
ggcgggcgguggcgguggcugggcagggcugg

SEQ ID NO: 192430 - RNA, 32 nt, Human
ggcgggcgucuucuccacuccucugccgcguc

SEQ ID NO: 192431 - RNA, 32 nt, Human
ggcgggcuacaccccauucacacucaugaauc

SEQ ID NO: 192432 - RNA, 32 nt, Human
ggcgggcucgggcuggagaagggccgcgggac

SEQ ID NO: 192433 - RNA, 32 nt, Human
ggcgggcugagggugacagucacguccguuuc

SEQ ID NO: 192434 - RNA, 18 nt, Human
ggcgggcugaguccugcc

SEQ ID NO: 192435 - RNA, 32 nt, Human
ggcgggcugcuggcucccccggcuccggcagc

SEQ ID NO: 192436 - RNA, 18 nt, Human
ggcgggcuggcgggcugg

SEQ ID NO: 192437 - RNA, 21 nt, Human
ggcgggcugguuaggauucca

SEQ ID NO: 192438 - RNA, 32 nt, Human
ggcggggaaggaggaggagggggagagucgcu

SEQ ID NO: 192439 - RNA, 32 nt, Human
ggcggggaagugaaccccgacggucagcgcuu

SEQ ID NO: 192440 - RNA, 32 nt, Human
ggcggggaccaagcuggaaggagcagcgacuc

SEQ ID NO: 192441 - RNA, 32 nt, Human
ggcggggacgaggcucgggcugugcugggcgg

SEQ ID NO: 192442 - RNA, 32 nt, Human
ggcggggagagccacagaggagcaggaggggg

SEQ ID NO: 192443 - RNA, 32 nt, Human
ggcggggagagcgccagagggaggccggucgg

SEQ ID NO: 192444 - RNA, 32 nt, Human
ggcggggagagggaaggaccgcacggagcacc

SEQ ID NO: 192445 - RNA, 32 nt, Human
ggcggggagagggcaagcgggaccgguagggg

SEQ ID NO: 192446 - RNA, 32 nt, Human
ggcggggagccaagcccggcuugagagcagag

SEQ ID NO: 192447 - RNA, 32 nt, Human
ggcggggagcuaggaggagggagcucgagagu

SEQ ID NO: 192448 - RNA, 32 nt, Human
ggcggggaggaggaggaggacaaggacuccug

SEQ ID NO: 192449 - RNA, 32 nt, Human
ggcggggaggcagcaggcgcgggagcgggcgc

SEQ ID NO: 192450 - RNA, 32 nt, Human
ggcggggaggcagggaugucgagggccccuca

SEQ ID NO: 192451 - RNA, 32 nt, Human
ggcggggaggcuggaggaggguccaugagguu

SEQ ID NO: 192452 - RNA, 32 nt, Human
ggcggggagggagggaaggggaggggcgcggc

SEQ ID NO: 192453 - RNA, 32 nt, Human
ggcggggcacagauuggagagggcucugugcu

SEQ ID NO: 192454 - RNA, 32 nt, Human
ggcggggcagaggcgccccucaccucccggac

SEQ ID NO: 192455 - RNA, 32 nt, Human
ggcggggcagaggcgcuccccacaucucagac

SEQ ID NO: 192456 - RNA, 32 nt, Human
ggcggggcaggccuccuuuguucuccacaauc

SEQ ID NO: 192457 - RNA, 32 nt, Human
ggcggggcauguugggagagggggagggaggg

SEQ ID NO: 192458 - RNA, 32 nt, Human
ggcggggccacugccccgcuugggggaagccg

SEQ ID NO: 192459 - RNA, 32 nt, Human
ggcggggccacugcggucgccggggcggggcc

SEQ ID NO: 192460 - RNA, 32 nt, Human
ggcggggcccggaagagcaggauggcggcgcg

SEQ ID NO: 192461 - RNA, 32 nt, Human
ggcggggcccuuugaugucuucaucuguaugg

SEQ ID NO: 192462 - RNA, 32 nt, Human
ggcggggccggcucucugacccucucuucccc

SEQ ID NO: 192463 - RNA, 19 nt, Human
ggcggggccuuucuuguca

SEQ ID NO: 192464 - RNA, 32 nt, Human
ggcggggcgagggagaggggcggccgcgcgga

SEQ ID NO: 192465 - RNA, 18 nt, Human
ggcggggcgagggcagcu

SEQ ID NO: 192466 - RNA, 32 nt, Human
ggcggggcggccuccggcucaggcuggcugag

SEQ ID NO: 192467 - RNA, 20 nt, Human
ggcggggcggggcgggucgg

SEQ ID NO: 192468 - RNA, 32 nt, Human
ggcggggcucgcgcaaccucccucgccucccc

SEQ ID NO: 192469 - RNA, 18 nt, Human
ggcgggggacaguaguug

SEQ ID NO: 192470 - RNA, 32 nt, Human
ggcgggggacggaggggcaggagcccugggcu

SEQ ID NO: 192471 - RNA, 32 nt, Human
ggcgggggagcgcgggacaggaggcuucgggg

SEQ ID NO: 192472 - RNA, 32 nt, Human
ggcgggggaggcagcgugagcagccggaggag

SEQ ID NO: 192473 - RNA, 32 nt, Human
ggcgggggcagcugugucaucuuucuggggcc

SEQ ID NO: 192474 - RNA, 32 nt, Human
ggcgggggccgcgggccaggggaggcgcucag

SEQ ID NO: 192475 - RNA, 32 nt, Human
ggcgggggccgggggccagggagcgggcuggg

SEQ ID NO: 192476 - RNA, 32 nt, Human
ggcgggggccuguaaucccagcuacucaggag

SEQ ID NO: 192477 - RNA, 32 nt, Human
ggcgggggccuguaauccuagcuacuuggggu

SEQ ID NO: 192478 - RNA, 32 nt, Human
ggcgggggcgagagggaagugggcgggagccg

SEQ ID NO: 192479 - RNA, 32 nt, Human
ggcgggggcgagggccacccaccuccaagucu

SEQ ID NO: 192480 - RNA, 32 nt, Human
ggcgggggcgcucaccccacagcccaggcccc

SEQ ID NO: 192481 - RNA, 17 nt, Human
ggcgggggcgggugagg

SEQ ID NO: 192482 - RNA, 17 nt, Human
ggcgggggcuaggggga

SEQ ID NO: 192483 - RNA, 32 nt, Human
ggcgggggcucugcauagccaggaugacgccu

SEQ ID NO: 192484 - RNA, 32 nt, Human
ggcgggggucaccaaaggcggcgggcccgucg

SEQ ID NO: 192485 - RNA, 23 nt, Human
ggcggggguguuguggguacagg

SEQ ID NO: 192486 - RNA, 32 nt, Human
ggcggggguuggggcggagggagcagcggccc

SEQ ID NO: 192487 - RNA, 32 nt, Human
ggcgggguagugcggagguggggcagggggag

SEQ ID NO: 192488 - RNA, 32 nt, Human
ggcggggucacagcucgcgcacccucaucugg

SEQ ID NO: 192489 - RNA, 32 nt, Human
ggcgggguccuggguagaguccuagccccaga

SEQ ID NO: 192490 - RNA, 23 nt, Human
ggcgggguggagcggagcugcug

SEQ ID NO: 192491 - RNA, 32 nt, Human
ggcggggugggcaguggcugccguaggggagg

SEQ ID NO: 192492 - RNA, 32 nt, Human
ggcgggguggggccuccagagcuuugcaggga

SEQ ID NO: 192493 - RNA, 17 nt, Human
ggcggggugggggcagc

SEQ ID NO: 192494 - RNA, 32 nt, Human
ggcgggguuucaucauguuggccaggcugguc

SEQ ID NO: 192495 - RNA, 32 nt, Human
ggcgggguuuccucaucuccccagccugaacu

SEQ ID NO: 192496 - RNA, 32 nt, Human
ggcggguacacggcccaggcccagggaacccc

SEQ ID NO: 192497 - RNA, 32 nt, Human
ggcggguaccuguaaucccagcuacucaggag

SEQ ID NO: 192498 - RNA, 32 nt, Human
ggcggguacggcuaugggcgaggcggaggcgc

SEQ ID NO: 192499 - RNA, 32 nt, Human
ggcggguagcuggcaggcgccgacuuccgaag

SEQ ID NO: 192500 - RNA, 32 nt, Human
ggcgggucagucuccgugcaggaugugagcag

SEQ ID NO: 192501 - RNA, 32 nt, Human
ggcggguccuuuccuuguucucuugcucccug

SEQ ID NO: 192502 - RNA, 32 nt, Human
ggcgggucucagccucaccccaccucucgcug

SEQ ID NO: 192503 - RNA, 20 nt, Human
ggcgggucuccgggauucca

SEQ ID NO: 192504 - RNA, 32 nt, Human
ggcgggucucgaacuccugaccucgugaucca

SEQ ID NO: 192505 - RNA, 32 nt, Human
ggcgggugagaagcaggaaggaggcugaugau

SEQ ID NO: 192506 - RNA, 32 nt, Human
ggcgggugaguggagagcagagccaggagcuc

SEQ ID NO: 192507 - RNA, 32 nt, Human
ggcgggugccuguaaccccagcuacuugggag

SEQ ID NO: 192508 - RNA, 32 nt, Human
ggcgggugccuguaaucagcuacucgggaggc

SEQ ID NO: 192509 - RNA, 32 nt, Human
ggcgggugccuguaaucccagcuacucaggag

SEQ ID NO: 192510 - RNA, 32 nt, Human
ggcgggugccuguaaucccagcuacucgggag

SEQ ID NO: 192511 - RNA, 32 nt, Human
ggcgggugccuguaaucccagcuacuggggag

SEQ ID NO: 192512 - RNA, 32 nt, Human
ggcgggugccuguaaucccagcuacuugggag

SEQ ID NO: 192513 - RNA, 32 nt, Human
ggcgggugccuguaaucccggcuacucaggag

SEQ ID NO: 192514 - RNA, 32 nt, Human
ggcgggugccuguaaucucagcuacucaggag

SEQ ID NO: 192515 - RNA, 32 nt, Human
ggcgggugccuguaaucucagcuacuugagag

SEQ ID NO: 192516 - RNA, 17 nt, Human
ggcgggugccuguaguc

SEQ ID NO: 192517 - RNA, 32 nt, Human
ggcgggugccuguagucccaacuacucggggg

SEQ ID NO: 192518 - RNA, 32 nt, Human
ggcgggugccuguagucccagccacuugggag

SEQ ID NO: 192519 - RNA, 32 nt, Human
ggcgggugccuguagucccagcuacucaggag

SEQ ID NO: 192520 - RNA, 32 nt, Human
ggcgggugccuguagucccagcuacucgggag

SEQ ID NO: 192521 - RNA, 32 nt, Human
ggcgggugccuguagucccagcuacugguagg

SEQ ID NO: 192522 - RNA, 32 nt, Human
ggcgggugccuguagucccagcuauuugggag

SEQ ID NO: 192523 - RNA, 32 nt, Human
ggcgggugccuguagucccagcugcucgggag

SEQ ID NO: 192524 - RNA, 32 nt, Human
ggcgggugccuguagucccaguacucaggagg

SEQ ID NO: 192525 - RNA, 32 nt, Human
ggcggguggaucaccugacaucaggaguucga

SEQ ID NO: 192526 - RNA, 32 nt, Human
ggcggguggaucaccugaggucgggaguuuga

SEQ ID NO: 192527 - RNA, 31 nt, Human
ggcgggugggggagagaaacccuggcucuuc

SEQ ID NO: 192528 - RNA, 31 nt, Human
ggcggguggguggaggaugcggugcgcggga

SEQ ID NO: 192529 - RNA, 32 nt, Human
ggcgggugggugguggaggcugcgagggugca

SEQ ID NO: 192530 - RNA, 32 nt, Human
ggcgggugugagccauugcgcccagccuugaa

SEQ ID NO: 192531 - RNA, 32 nt, Human
ggcggguguguuucggccuggccugggcaggc

SEQ ID NO: 192532 - RNA, 23 nt, Human
ggcggguucggcugcccccagca

SEQ ID NO: 192533 - RNA, 32 nt, Human
ggcggguugggaggggcaggagguggggugga

SEQ ID NO: 192534 - RNA, 22 nt, Human
ggcggguuucgccgccgcugcc

SEQ ID NO: 192535 - RNA, 32 nt, Human
ggcgguaaacagacaggcucuggcagugcaga

SEQ ID NO: 192536 - RNA, 32 nt, Human
ggcgguacugccccaaggccccagggacagag

SEQ ID NO: 192537 - RNA, 32 nt, Human
ggcgguagaggggagguugggguuggagcagc

SEQ ID NO: 192538 - RNA, 32 nt, Human
ggcgguagcucauaccuguaaauccuaggacu

SEQ ID NO: 192539 - RNA, 32 nt, Human
ggcgguaggaagggagagggggagcuguuugu

SEQ ID NO: 192540 - RNA, 32 nt, Human
ggcgguaggcagcagcaggcugaagggaucau

SEQ ID NO: 192541 - RNA, 32 nt, Human
ggcgguaucuagcccuuucucuguaaaauauc

SEQ ID NO: 192542 - RNA, 32 nt, Human
ggcgguauggaaggcaggcuguacugguugag

SEQ ID NO: 192543 - RNA, 24 nt, Human
ggcggucagcagcugcccuuggca

SEQ ID NO: 192544 - RNA, 18 nt, Human
ggcggucagccggaguga

SEQ ID NO: 192545 - RNA, 32 nt, Human
ggcgguccaugccaacugugcugugucacaua

SEQ ID NO: 192546 - RNA, 32 nt, Human
ggcgguccaugcugccccucugccucguggcc

SEQ ID NO: 192547 - RNA, 32 nt, Human
ggcgguccccagcugccagggugcuuggggag

SEQ ID NO: 192548 - RNA, 32 nt, Human
ggcgguccgcggcggagguucaugugggggug

SEQ ID NO: 192549 - RNA, 32 nt, Human
ggcgguccuacuaaucagauuugcagaagaaa

SEQ ID NO: 192550 - RNA, 32 nt, Human
ggcggucgggcccgggacacccccucccgguc

SEQ ID NO: 192551 - RNA, 22 nt, Human
ggcggugaaaaaccuacguccu

SEQ ID NO: 192552 - RNA, 32 nt, Human
ggcggugaagagacaggagagggggaucggug

SEQ ID NO: 192553 - RNA, 21 nt, Human
ggcggugacccagacaugccu

SEQ ID NO: 192554 - RNA, 32 nt, Human
ggcggugaccccggccuggaacugccccggua

SEQ ID NO: 192555 - RNA, 32 nt, Human
ggcggugagcucaguggauugcaguggugugc

SEQ ID NO: 192556 - RNA, 32 nt, Human
ggcggugcaauggcggaaagaaaaggaacagc

SEQ ID NO: 192557 - RNA, 32 nt, Human
ggcggugcaggagagcgccccgagucccggcg

SEQ ID NO: 192558 - RNA, 32 nt, Human
ggcggugcugaggagggggcaggguuggagaa

SEQ ID NO: 192559 - RNA, 32 nt, Human
ggcggugcuggcaagauggcugcacuugagaa

SEQ ID NO: 192560 - RNA, 32 nt, Human
ggcggugcugggagggguaggugagggucgcg

SEQ ID NO: 192561 - RNA, 20 nt, Human
ggcgguggaaggaagaagac

SEQ ID NO: 192562 - RNA, 32 nt, Human
ggcgguggagccaccacacagccgacucucuc

SEQ ID NO: 192563 - RNA, 32 nt, Human
ggcgguggaggcucuguacccuggcccugcug

SEQ ID NO: 192564 - RNA, 32 nt, Human
ggcgguggcacagugcuguauccugccugggc

SEQ ID NO: 192565 - RNA, 32 nt, Human
ggcgguggcacggugcuguauccugccugggc

SEQ ID NO: 192566 - RNA, 32 nt, Human
ggcgguggcagcagagguggcaggggcggggc

SEQ ID NO: 192567 - RNA, 32 nt, Human
ggcgguggcggccauggcggcagauggagagc

SEQ ID NO: 192568 - RNA, 19 nt, Human
ggcgguggcggcgggucgg

SEQ ID NO: 192569 - RNA, 24 nt, Human
ggcgguggcgggcgcgcugaccgc

SEQ ID NO: 192570 - RNA, 32 nt, Human
ggcgguggcucacaccuguaaucccagcacuu

SEQ ID NO: 192571 - RNA, 32 nt, Human
ggcgguggcucaccccuguaaucccagcacuu

SEQ ID NO: 192572 - RNA, 32 nt, Human
ggcgguggcucacgccuguaaucccaacacuu

SEQ ID NO: 192573 - RNA, 32 nt, Human
ggcgguggcucacgccuguaaucccagcacgc

SEQ ID NO: 192574 - RNA, 32 nt, Human
ggcgguggcucacgccuguaaucccagcacuu

SEQ ID NO: 192575 - RNA, 32 nt, Human
ggcgguggcucaugccuguaaucccagcacuu

SEQ ID NO: 192576 - RNA, 32 nt, Human
ggcgguggcugggcagggcugggcagggccgc

SEQ ID NO: 192577 - RNA, 32 nt, Human
ggcggugggaggaggauggccgggggugcugg

SEQ ID NO: 192578 - RNA, 32 nt, Human
ggcggugggaggcggcggcggcggcggcgcuc

SEQ ID NO: 192579 - RNA, 32 nt, Human
ggcggugggcagggugcagcagugagcaaaac

SEQ ID NO: 192580 - RNA, 32 nt, Human
ggcggugggccccagccccacagaccagccca

SEQ ID NO: 192581 - RNA, 32 nt, Human
ggcgguggggauguucucauaacaaucaccgu

SEQ ID NO: 192582 - RNA, 32 nt, Human
ggcgguggggcaguggagguugaggagaaugu

SEQ ID NO: 192583 - RNA, 32 nt, Human
ggcggugguggaggugggaucagcggccaggg

SEQ ID NO: 192584 - RNA, 32 nt, Human
ggcgguggugggggugucucacucucugucuu

SEQ ID NO: 192585 - RNA, 32 nt, Human
ggcgguguccaggagggaaggaacgggaaagg

SEQ ID NO: 192586 - RNA, 32 nt, Human
ggcgguguccgaguaggggccucugccccacc

SEQ ID NO: 192587 - RNA, 32 nt, Human
ggcggugugcuauguaccuauguguccaugac

SEQ ID NO: 192588 - RNA, 32 nt, Human
ggcgguguggguggagugcagagcagggcacu

SEQ ID NO: 192589 - RNA, 32 nt, Human
ggcggugugguuguagguggggugggggugga

SEQ ID NO: 192590 - RNA, 32 nt, Human
ggcgguguuuugcugaucuguuaaauucuuag

SEQ ID NO: 192591 - RNA, 21 nt, Human
ggcgguuagcaggcuccagca

SEQ ID NO: 192592 - RNA, 32 nt, Human
ggcgguuagggugggaagggggacagagaggg

SEQ ID NO: 192593 - RNA, 32 nt, Human
ggcgguucagccaagacagauguagacggagu

SEQ ID NO: 192594 - RNA, 32 nt, Human
ggcgguuccggcuccucccucuccuugugccu

SEQ ID NO: 192595 - RNA, 32 nt, Human
ggcgguugcuggucaguaacagccaagaugcu

SEQ ID NO: 192596 - RNA, 32 nt, Human
ggcgguuugugagcucauaguuagggcagagu

SEQ ID NO: 192597 - RNA, 32 nt, Human
ggcgguuuuguucugcucaguuucuggagagg

SEQ ID NO: 192598 - RNA, 32 nt, Human
ggcguaagccaccacacccagccagaaagugg

SEQ ID NO: 192599 - RNA, 32 nt, Human
ggcguacacaugcacgcuugcacacaugcaca

SEQ ID NO: 192600 - RNA, 19 nt, Human
ggcguacggaggguggcag

SEQ ID NO: 192601 - RNA, 32 nt, Human
ggcguacuuugggcuucaucauggaggacuac

SEQ ID NO: 192602 - RNA, 32 nt, Human
ggcguagaaagccacgagcaggaauccgcguu

SEQ ID NO: 192603 - RNA, 32 nt, Human
ggcguagggcuggagggcaggggcgggcccug

SEQ ID NO: 192604 - RNA, 22 nt, Human
ggcguaguggcucaugccugua

SEQ ID NO: 192605 - RNA, 22 nt, Human
ggcguaguggcuuaugccugua

SEQ ID NO: 192606 - RNA, 32 nt, Human
ggcguauaguacaugauaauuucucuagucua

SEQ ID NO: 192607 - RNA, 18 nt, Human
ggcguaucaccugagguc

SEQ ID NO: 192608 - RNA, 18 nt, Human
ggcguaucaccugagguu

SEQ ID NO: 192609 - RNA, 32 nt, Human
ggcguaugccuguaaucccagcuacuuaggag

SEQ ID NO: 192610 - RNA, 32 nt, Human
ggcgucacagagcuuucagacgcccagaagaa

SEQ ID NO: 192611 - RNA, 32 nt, Human
ggcgucacagccgaggaagcggcccggccggg

SEQ ID NO: 192612 - RNA, 32 nt, Human
ggcgucaccucucugcuacucuggugcugcgc

SEQ ID NO: 192613 - RNA, 32 nt, Human
ggcgucacgccuguaaucccagcacuuuggga

SEQ ID NO: 192614 - RNA, 32 nt, Human
ggcgucacguguguucagagcuugucuccacc

SEQ ID NO: 192615 - RNA, 32 nt, Human
ggcgucacuacugcuacccucauuucaccugc

SEQ ID NO: 192616 - RNA, 32 nt, Human
ggcgucagaaaaauggcuacaaacuuccuagc

SEQ ID NO: 192617 - RNA, 23 nt, Human
ggcgucagaaguaggaagggcag

SEQ ID NO: 192618 - RNA, 23 nt, Human
ggcgucagcgcgguggccagcgc

SEQ ID NO: 192619 - RNA, 32 nt, Human
ggcgucaggcuaagcacuuugauaaacugguu

SEQ ID NO: 192620 - RNA, 32 nt, Human
ggcgucaguguucuccagccugggcaacagag

SEQ ID NO: 192621 - RNA, 32 nt, Human
ggcgucaucaugcacaguuguaucgcgcccgc

SEQ ID NO: 192622 - RNA, 32 nt, Human
ggcgucauuccucugcugaauuuuuaaauguu

SEQ ID NO: 192623 - RNA, 22 nt, Human
ggcguccagcgugccgaccaca

SEQ ID NO: 192624 - RNA, 32 nt, Human
ggcguccagcuccacuagggccuggaucccca

SEQ ID NO: 192625 - RNA, 32 nt, Human
ggcgucccaaagugcuaggauuacaggcauga

SEQ ID NO: 192626 - RNA, 32 nt, Human
ggcgucccaagaccucaucugccugcagcguc

SEQ ID NO: 192627 - RNA, 24 nt, Human
ggcgucccaagacggagcuggcug

SEQ ID NO: 192628 - RNA, 24 nt, Human
ggcgucccaagauguggcuggcug

SEQ ID NO: 192629 - RNA, 24 nt, Human
ggcgucccagaacgcggcuggcug

SEQ ID NO: 192630 - RNA, 25 nt, Human
ggcgucccagaaugcuggcuggcug

SEQ ID NO: 192631 - RNA, 22 nt, Human
ggcgucccaucccccgcccuga

SEQ ID NO: 192632 - RNA, 21 nt, Human
ggcgucccccagagccugaga

SEQ ID NO: 192633 - RNA, 19 nt, Human
ggcguccccugccauggcc

SEQ ID NO: 192634 - RNA, 32 nt, Human
ggcguccccugccuccagaacgcgggcuggac

SEQ ID NO: 192635 - RNA, 24 nt, Human
ggcgucccgaaacggagcugguug

SEQ ID NO: 192636 - RNA, 24 nt, Human
ggcgucccgagacgcggcugccug

SEQ ID NO: 192637 - RNA, 24 nt, Human
ggcgucccgagauguggcuggcug

SEQ ID NO: 192638 - RNA, 22 nt, Human
ggcgucccgagcagcgcagggg

SEQ ID NO: 192639 - RNA, 32 nt, Human
ggcgucccgggacagcucaguguuggagggcc

SEQ ID NO: 192640 - RNA, 21 nt, Human
ggcgucccgggcgcggcuggc

SEQ ID NO: 192641 - RNA, 32 nt, Human
ggcgucccuccaggccuugccuccugcgggag

SEQ ID NO: 192642 - RNA, 32 nt, Human
ggcguccgccuccucccuccccuugaggcugg

SEQ ID NO: 192643 - RNA, 19 nt, Human
ggcguccgcucuccacacc

SEQ ID NO: 192644 - RNA, 32 nt, Human
ggcguccgcugcgccgccccugggcaggcuca

SEQ ID NO: 192645 - RNA, 21 nt, Human
ggcguccggggcgagcgggag

SEQ ID NO: 192646 - RNA, 32 nt, Human
ggcguccuaaccccagauaccugugaauguga

SEQ ID NO: 192647 - RNA, 32 nt, Human
ggcguccuagggcaccuggcgcaggggcggac

SEQ ID NO: 192648 - RNA, 32 nt, Human
ggcguccuccacccacgcccacuagccugcca

SEQ ID NO: 192649 - RNA, 32 nt, Human
ggcguccucuuuccggcuguugcugcucuucu

SEQ ID NO: 192650 - RNA, 32 nt, Human
ggcguccuucacagggagggugcagcugaccu

SEQ ID NO: 192651 - RNA, 32 nt, Human
ggcguccuuggaggcagcuugggagggugacu

SEQ ID NO: 192652 - RNA, 16 nt, Human
ggcgucgagggggcag

SEQ ID NO: 192653 - RNA, 32 nt, Human
ggcgucgcagcugagggaguaaggaggcuccc

SEQ ID NO: 192654 - RNA, 32 nt, Human
ggcgucgccugagaucagggcccgggaagccc

SEQ ID NO: 192655 - RNA, 21 nt, Human
ggcgucgcuaggcagcuucga

SEQ ID NO: 192656 - RNA, 32 nt, Human
ggcgucggcagcgcagaccucuuggccuucuc

SEQ ID NO: 192657 - RNA, 17 nt, Human
ggcgucggcggcggcag

SEQ ID NO: 192658 - RNA, 32 nt, Human
ggcgucgggagagagcgcggagguagcgggcg

SEQ ID NO: 192659 - RNA, 21 nt, Human
ggcgucggggccagcuuccgg

SEQ ID NO: 192660 - RNA, 17 nt, Human
ggcgucuacaccugcac

SEQ ID NO: 192661 - RNA, 32 nt, Human
ggcgucucaaagugcugggauuacaagcguga

SEQ ID NO: 192662 - RNA, 32 nt, Human
ggcgucuccagccucgguaccauggccgggau

SEQ ID NO: 192663 - RNA, 32 nt, Human
ggcgucuccuuuccuuccuucuuccucucuua

SEQ ID NO: 192664 - RNA, 32 nt, Human
ggcgucucgcucgcgcucacacacgcucugcc

SEQ ID NO: 192665 - RNA, 21 nt, Human
ggcgucucucaggagcucagg

SEQ ID NO: 192666 - RNA, 32 nt, Human
ggcgucucuccaccagccagaucccccaaucc

SEQ ID NO: 192667 - RNA, 18 nt, Human
ggcgucugcagggggcag

SEQ ID NO: 192668 - RNA, 32 nt, Human
ggcgucugcggccgcagcagcacuuuuugcac

SEQ ID NO: 192669 - RNA, 16 nt, Human
ggcgucuggcuggcug

SEQ ID NO: 192670 - RNA, 32 nt, Human
ggcgucugggcugagccggagggaggcgggag

SEQ ID NO: 192671 - RNA, 16 nt, Human
ggcgucuguaauccca

SEQ ID NO: 192672 - RNA, 32 nt, Human
ggcgucuguaaucccagcugcuugggaggcug

SEQ ID NO: 192673 - RNA, 32 nt, Human
ggcgucuucaucucccugccaucccccucuca

SEQ ID NO: 192674 - RNA, 32 nt, Human
ggcgucuucauucaguucaugcagggcaaagg

SEQ ID NO: 192675 - RNA, 32 nt, Human
ggcgucuucccaggaccuccugccagcuccca

SEQ ID NO: 192676 - RNA, 32 nt, Human
ggcgucuuucuuucuccccucaacucugacag

SEQ ID NO: 192677 - RNA, 32 nt, Human
ggcgugaaccaccacgcccagcugguuccuga

SEQ ID NO: 192678 - RNA, 32 nt, Human
ggcgugaaccacugcacccagccugcugaucc

SEQ ID NO: 192679 - RNA, 32 nt, Human
ggcgugaaccacugcacccggcgaggcauuuu

SEQ ID NO: 192680 - RNA, 32 nt, Human
ggcgugaauacacacaugcacacacauauaca

SEQ ID NO: 192681 - RNA, 32 nt, Human
ggcgugacugagguaauagaugaaaaguguuc

SEQ ID NO: 192682 - RNA, 32 nt, Human
ggcgugagccaccacacccagccaaauuuuug

SEQ ID NO: 192683 - RNA, 32 nt, Human
ggcgugagccaccacacccagccagugaacuc

SEQ ID NO: 192684 - RNA, 32 nt, Human
ggcgugagccaccacacccagccaguuuuccu

SEQ ID NO: 192685 - RNA, 32 nt, Human
ggcgugagccaccacacccagcccuuucacua

SEQ ID NO: 192686 - RNA, 32 nt, Human
ggcgugagccaccacauccagccuaauuuaag

SEQ ID NO: 192687 - RNA, 32 nt, Human
ggcgugagccaccaugccugcccagcaauacc

SEQ ID NO: 192688 - RNA, 32 nt, Human
ggcgugagccaccgcacguagcauuuacauua

SEQ ID NO: 192689 - RNA, 32 nt, Human
ggcgugagccacugcacccagccucauguuga

SEQ ID NO: 192690 - RNA, 32 nt, Human
ggcgugagccacugcacccagccugggagagg

SEQ ID NO: 192691 - RNA, 32 nt, Human
ggcgugagccacugcaccuggccuuauaaaua

SEQ ID NO: 192692 - RNA, 32 nt, Human
ggcgugagccacugcgcccagccugaauuuuu

SEQ ID NO: 192693 - RNA, 32 nt, Human
ggcgugagccacugcgcccagccuguuccuua

SEQ ID NO: 192694 - RNA, 19 nt, Human
ggcgugagcccccacgcug

SEQ ID NO: 192695 - RNA, 32 nt, Human
ggcgugagucacugcacccaagccuccuuucu

SEQ ID NO: 192696 - RNA, 22 nt, Human
ggcgugaucucagcucacugca

SEQ ID NO: 192697 - RNA, 32 nt, Human
ggcgugaucucggcuuuacugcagccuccgcu

SEQ ID NO: 192698 - RNA, 22 nt, Human
ggcgugauggcucaugccugug

SEQ ID NO: 192699 - RNA, 32 nt, Human
ggcgugcaaggggcucagcaaggugugaauga

SEQ ID NO: 192700 - RNA, 32 nt, Human
ggcgugcacaggacacagcgugggcggccugg

SEQ ID NO: 192701 - RNA, 32 nt, Human
ggcgugcaccacugaguccagccuauauucuu

SEQ ID NO: 192702 - RNA, 32 nt, Human
ggcgugcaccuguaaucccagcuacucaggag

SEQ ID NO: 192703 - RNA, 32 nt, Human
ggcgugcaccuguaaucccagcuacuugggag

SEQ ID NO: 192704 - RNA, 32 nt, Human
ggcgugcaccuguaaucucagcuacucgggag

SEQ ID NO: 192705 - RNA, 32 nt, Human
ggcgugcagggcccugaucacagcugccagua

SEQ ID NO: 192706 - RNA, 32 nt, Human
ggcgugcaggggcgguccagaggaggugcccg

SEQ ID NO: 192707 - RNA, 32 nt, Human
ggcgugcaggguggacgcgugggguuccgugu

SEQ ID NO: 192708 - RNA, 32 nt, Human
ggcgugcauauguaaagcacaucagauccgug

SEQ ID NO: 192709 - RNA, 22 nt, Human
ggcgugcaugugccaagaaaug

SEQ ID NO: 192710 - RNA, 32 nt, Human
ggcgugccucucugcccuccagccuucuucac

SEQ ID NO: 192711 - RNA, 32 nt, Human
ggcgugccugcggaugggcccgcuaaaggagu

SEQ ID NO: 192712 - RNA, 32 nt, Human
ggcgugcgaaguccaaacgcacuggcaacuuc

SEQ ID NO: 192713 - RNA, 21 nt, Human
ggcgugcgcaacgccaccacc

SEQ ID NO: 192714 - RNA, 32 nt, Human
ggcgugcgccuguaaucccagcuacucaagag

SEQ ID NO: 192715 - RNA, 32 nt, Human
ggcgugcgccuguaaucccagcuacucaggag

SEQ ID NO: 192716 - RNA, 32 nt, Human
ggcgugcgccuguaaucccagcuacucgggag

SEQ ID NO: 192717 - RNA, 32 nt, Human
ggcgugcgccuguaaucccagcuacuugggag

SEQ ID NO: 192718 - RNA, 32 nt, Human
ggcgugcgccuguaaucucagcuacuugggag

SEQ ID NO: 192719 - RNA, 23 nt, Human
ggcgugcggaucaucugagauca

SEQ ID NO: 192720 - RNA, 32 nt, Human
ggcgugcggccccagccccgccaccuuccugg

SEQ ID NO: 192721 - RNA, 32 nt, Human
ggcgugcggugacucggugcuucuguuuugga

SEQ ID NO: 192722 - RNA, 16 nt, Human
ggcgugcgucagguca

SEQ ID NO: 192723 - RNA, 32 nt, Human
ggcgugcgugagcgcacagcauguccgagccc

SEQ ID NO: 192724 - RNA, 32 nt, Human
ggcgugcugggcuauuugcugugguacuuuag

SEQ ID NO: 192725 - RNA, 20 nt, Human
ggcgugcugguggugcucac

SEQ ID NO: 192726 - RNA, 32 nt, Human
ggcguggaccuccagccuuggaagcuuucuuu

SEQ ID NO: 192727 - RNA, 32 nt, Human
ggcguggagggcacgggugccacccacaaacc

SEQ ID NO: 192728 - RNA, 32 nt, Human
ggcguggcacuuccuuccuuccugggcccgca

SEQ ID NO: 192729 - RNA, 32 nt, Human
ggcguggcaggcagugcugggagaggaaggcc

SEQ ID NO: 192730 - RNA, 18 nt, Human
ggcguggcagggaggcag

SEQ ID NO: 192731 - RNA, 32 nt, Human
ggcguggcagggccaaggcccacccacugcca

SEQ ID NO: 192732 - RNA, 20 nt, Human
ggcguggccuggcgcuggga

SEQ ID NO: 192733 - RNA, 32 nt, Human
ggcgugggaggaagauggacucgguggagaag

SEQ ID NO: 192734 - RNA, 32 nt, Human
ggcgugggaggcugggccgcagugaguggggg

SEQ ID NO: 192735 - RNA, 32 nt, Human
ggcgugggauccagagagaagcaccccaccac

SEQ ID NO: 192736 - RNA, 32 nt, Human
ggcgugggcagcgggggcaugggcaggaccac

SEQ ID NO: 192737 - RNA, 32 nt, Human
ggcgugggcaggcagugagaacacagauggua

SEQ ID NO: 192738 - RNA, 32 nt, Human
ggcgugggccaaccugugcugugucaucaguu

SEQ ID NO: 192739 - RNA, 32 nt, Human
ggcgugggccugccggggguugcgugacaggc

SEQ ID NO: 192740 - RNA, 32 nt, Human
ggcgugggcggcugaggggcugaggggcugag

SEQ ID NO: 192741 - RNA, 32 nt, Human
ggcguggggagcugcacugcaccagccagggc

SEQ ID NO: 192742 - RNA, 32 nt, Human
ggcguggggcuggggcagagcaggguuccugg

SEQ ID NO: 192743 - RNA, 32 nt, Human
ggcgugggggaggcacggcccgcaacucggcg

SEQ ID NO: 192744 - RNA, 32 nt, Human
ggcguggggugagacccagcguuggauaacgu

SEQ ID NO: 192745 - RNA, 22 nt, Human
ggcgugggugugagccaggcug

SEQ ID NO: 192746 - RNA, 32 nt, Human
ggcgugggugugagccaggcugcaggaggaac

SEQ ID NO: 192747 - RNA, 32 nt, Human
ggcgugguccuagcuacucgggagacugaagu

SEQ ID NO: 192748 - RNA, 22 nt, Human
ggcgugguggcacacaccugua

SEQ ID NO: 192749 - RNA, 22 nt, Human
ggcgugguggcacaugccugua

SEQ ID NO: 192750 - RNA, 32 nt, Human
ggcgugguggcacgucuguaaucccagcuacu

SEQ ID NO: 192751 - RNA, 22 nt, Human
ggcgugguggcacgugccugua

SEQ ID NO: 192752 - RNA, 22 nt, Human
ggcgugguggcacuugccugua

SEQ ID NO: 192753 - RNA, 22 nt, Human
ggcgugguggcagguaccugua

SEQ ID NO: 192754 - RNA, 22 nt, Human
ggcgugguggcaggugccugua

SEQ ID NO: 192755 - RNA, 22 nt, Human
ggcgugguggcgcacaccugua

SEQ ID NO: 192756 - RNA, 22 nt, Human
ggcgugguggcgcauaccugua

SEQ ID NO: 192757 - RNA, 22 nt, Human
ggcgugguggcgcaugccugua

SEQ ID NO: 192758 - RNA, 22 nt, Human
ggcgugguggcgcgcaccugua

SEQ ID NO: 192759 - RNA, 22 nt, Human
ggcgugguggcgggugccugua

SEQ ID NO: 192760 - RNA, 22 nt, Human
ggcgugguggcggucaccugua

SEQ ID NO: 192761 - RNA, 24 nt, Human
ggcgugguggcucaaaugccugua

SEQ ID NO: 192762 - RNA, 22 nt, Human
ggcgugguggcucacaccugua

SEQ ID NO: 192763 - RNA, 22 nt, Human
ggcgugguggcucacgccugua

SEQ ID NO: 192764 - RNA, 22 nt, Human
ggcgugguggcucacuccugua

SEQ ID NO: 192765 - RNA, 22 nt, Human
ggcgugguggcucaugccugua

SEQ ID NO: 192766 - RNA, 22 nt, Human
ggcgugguggcucaugcuugua

SEQ ID NO: 192767 - RNA, 22 nt, Human
ggcgugguggcucaugcuugug

SEQ ID NO: 192768 - RNA, 22 nt, Human
ggcgugguggcucauguaugua

SEQ ID NO: 192769 - RNA, 22 nt, Human
ggcgugguggcuggcaccugua

SEQ ID NO: 192770 - RNA, 22 nt, Human
ggcguggugguacaugccugua

SEQ ID NO: 192771 - RNA, 32 nt, Human
ggcguggugguccucagaggacaacucccagc

SEQ ID NO: 192772 - RNA, 22 nt, Human
ggcgugguggugcacaccugua

SEQ ID NO: 192773 - RNA, 22 nt, Human
ggcgugguggugcaugccugua

SEQ ID NO: 192774 - RNA, 32 nt, Human
ggcgugguggugggcaccuguacuggggaggu

SEQ ID NO: 192775 - RNA, 22 nt, Human
ggcguggugguucacaccugua

SEQ ID NO: 192776 - RNA, 22 nt, Human
ggcguggugguucaugccugua

SEQ ID NO: 192777 - RNA, 32 nt, Human
ggcgugguucgagagcgcgcagaguccagacu

SEQ ID NO: 192778 - RNA, 32 nt, Human
ggcguguaccaccacacccgucuaaguuuugu

SEQ ID NO: 192779 - RNA, 32 nt, Human
ggcguguaucugguauauguaaguguucagaa

SEQ ID NO: 192780 - RNA, 32 nt, Human
ggcgugucuuuggggagucagauggcugauug

SEQ ID NO: 192781 - RNA, 32 nt, Human
ggcgugugagccaccacgcccggccaugaaau

SEQ ID NO: 192782 - RNA, 32 nt, Human
ggcgugugccuguaaucccagcuacuugggag

SEQ ID NO: 192783 - RNA, 32 nt, Human
ggcgugugccuguaaucccagcuauuugggag

SEQ ID NO: 192784 - RNA, 32 nt, Human
ggcgugugccuguaaucucagcuacucaggag

SEQ ID NO: 192785 - RNA, 32 nt, Human
ggcgugugccuguaaugccagcuacucgggag

SEQ ID NO: 192786 - RNA, 20 nt, Human
ggcgugugccuguaguccca

SEQ ID NO: 192787 - RNA, 23 nt, Human
ggcgugugccuguagucccagcu

SEQ ID NO: 192788 - RNA, 32 nt, Human
ggcgugugccuguagucccagcuacucaggag

SEQ ID NO: 192789 - RNA, 32 nt, Human
ggcgugugccuguagucccagcuacuugggag

SEQ ID NO: 192790 - RNA, 32 nt, Human
ggcgugugccuguagucccagcugcuugggag

SEQ ID NO: 192791 - RNA, 32 nt, Human
ggcgugugccuguagugcuagcuacucagaag

SEQ ID NO: 192792 - RNA, 32 nt, Human
ggcgugugcgguugugggggagcucgccgugg

SEQ ID NO: 192793 - RNA, 32 nt, Human
ggcgugugcuaaggccagagcuaccagauggg

SEQ ID NO: 192794 - RNA, 23 nt, Human
ggcguguggaucaccugagguca

SEQ ID NO: 192795 - RNA, 32 nt, Human
ggcguguggcagccacacacaggcggccaggg

SEQ ID NO: 192796 - RNA, 21 nt, Human
ggcguguggcucacgccugua

SEQ ID NO: 192797 - RNA, 32 nt, Human
ggcguguggggcucuuucagggaccacagagg

SEQ ID NO: 192798 - RNA, 18 nt, Human
ggcgugugguggggcagu

SEQ ID NO: 192799 - RNA, 32 nt, Human
ggcguguguaacaucccaugugccucaccuaa

SEQ ID NO: 192800 - RNA, 20 nt, Human
ggcgugugucuguaauccca

SEQ ID NO: 192801 - RNA, 23 nt, Human
ggcgugugucuguaaucccagcu

SEQ ID NO: 192802 - RNA, 32 nt, Human
ggcgugugucuguaaucccagcuacucgggag

SEQ ID NO: 192803 - RNA, 32 nt, Human
ggcguuacacagaaggcuggcugacaugccca

SEQ ID NO: 192804 - RNA, 15 nt, Human
ggcguuagugggcag

SEQ ID NO: 192805 - RNA, 32 nt, Human
ggcguucaggcaggugaucgguguggcggcgg

SEQ ID NO: 192806 - RNA, 32 nt, Human
ggcguuccagcccagauccggccacgaagaca

SEQ ID NO: 192807 - RNA, 32 nt, Human
ggcguuccaugagaugcaagcacacaagaaug

SEQ ID NO: 192808 - RNA, 32 nt, Human
ggcguugcgcccuucgccucucccagaggagc

SEQ ID NO: 192809 - RNA, 19 nt, Human
ggcguugcgggaggccucg

SEQ ID NO: 192810 - RNA, 32 nt, Human
ggcguugcugggacuguuuugcacuggagcca

SEQ ID NO: 192811 - RNA, 32 nt, Human
ggcguuggagggaagagagaccagagaguuua

SEQ ID NO: 192812 - RNA, 19 nt, Human
ggcguugguaagggggcag

SEQ ID NO: 192813 - RNA, 32 nt, Human
ggcguugguuccaagccgguucccgucccugg

SEQ ID NO: 192814 - RNA, 32 nt, Human
ggcguugucaccacccacccuaccugcagagu

SEQ ID NO: 192815 - RNA, 32 nt, Human
ggcguuuacugaugcuuccugguccgguggcc

SEQ ID NO: 192816 - RNA, 32 nt, Human
ggcguuuccagggggaggacugcccacccuuc

SEQ ID NO: 192817 - RNA, 18 nt, Human
ggcguuuccuucauggcc

SEQ ID NO: 192818 - RNA, 32 nt, Human
ggcguuuguggugccagagaaaaguagccaga

SEQ ID NO: 192819 - RNA, 32 nt, Human
ggcguuuucuuugugcauugauuugcauuuuu

SEQ ID NO: 192820 - RNA, 32 nt, Human
ggcuaaaacggugaaaccccgucucuacuaaa

SEQ ID NO: 192821 - RNA, 20 nt, Human
ggcuaaaacuuuuuucacuu

SEQ ID NO: 192822 - RNA, 32 nt, Human
ggcuaaaaugaacugguuaucuuaggaucaug

SEQ ID NO: 192823 - RNA, 32 nt, Human
ggcuaaacagaauuuugagggcauggcccaaa

SEQ ID NO: 192824 - RNA, 32 nt, Human
ggcuaaaccgauacaggaaagcucucuuagaa

SEQ ID NO: 192825 - RNA, 21 nt, Human
ggcuaaagaauccccuugaua

SEQ ID NO: 192826 - RNA, 32 nt, Human
ggcuaaagacacugggcucugccaggggccuu

SEQ ID NO: 192827 - RNA, 32 nt, Human
ggcuaaagaggaaggaggggaggaggucgcua

SEQ ID NO: 192828 - RNA, 32 nt, Human
ggcuaaagaugaagcuacaagaaauaaguugg

SEQ ID NO: 192829 - RNA, 32 nt, Human
ggcuaaagcagaggugucacagcugcucaaga

SEQ ID NO: 192830 - RNA, 32 nt, Human
ggcuaaagccccgugaggccaggggcucuugu

SEQ ID NO: 192831 - RNA, 32 nt, Human
ggcuaaagccuguaaucccagcacuuugggag

SEQ ID NO: 192832 - RNA, 32 nt, Human
ggcuaaagcggaggaggggaccagccucaucc

SEQ ID NO: 192833 - RNA, 24 nt, Human
ggcuaaagcugguggaggaggaag

SEQ ID NO: 192834 - RNA, 32 nt, Human
ggcuaaagcuguuuuugacacagcacaugugu

SEQ ID NO: 192835 - RNA, 32 nt, Human
ggcuaaaggcggccagguuugcagugcgggaa

SEQ ID NO: 192836 - RNA, 32 nt, Human
ggcuaacaaggugaaaccccgucucuacuaaa

SEQ ID NO: 192837 - RNA, 32 nt, Human
ggcuaacaaggugaaaccucgucucuacuaaa

SEQ ID NO: 192838 - RNA, 32 nt, Human
ggcuaacacagugaaaccccaucucuaauaaa

SEQ ID NO: 192839 - RNA, 32 nt, Human
ggcuaacacagugaaaccccaucucuacuaaa

SEQ ID NO: 192840 - RNA, 32 nt, Human
ggcuaacacagugaaacccccucugauaaaaa

SEQ ID NO: 192841 - RNA, 32 nt, Human
ggcuaacacagugaaaccccgucucuaccaaa

SEQ ID NO: 192842 - RNA, 29 nt, Human
ggcuaacacagugaaaccccgucucuacu

SEQ ID NO: 192843 - RNA, 32 nt, Human
ggcuaacacagugaaaccccgucucuacuaaa

SEQ ID NO: 192844 - RNA, 32 nt, Human
ggcuaacacagugaaaccccgucucuucuaaa

SEQ ID NO: 192845 - RNA, 32 nt, Human
ggcuaacacagugaaaccccuccucuacuaaa

SEQ ID NO: 192846 - RNA, 32 nt, Human
ggcuaacacagugaaacccugucucuacuaaa

SEQ ID NO: 192847 - RNA, 32 nt, Human
ggcuaacacagugaaacccugucucuacuuaa

SEQ ID NO: 192848 - RNA, 32 nt, Human
ggcuaacacagugaaacccugucucuccuaaa

SEQ ID NO: 192849 - RNA, 32 nt, Human
ggcuaacacagugaaaccucaucucuacuaaa

SEQ ID NO: 192850 - RNA, 32 nt, Human
ggcuaacaccgugaaaccccaucucuacuaaa

SEQ ID NO: 192851 - RNA, 32 nt, Human
ggcuaacaccuguaaucccagcacuuugggag

SEQ ID NO: 192852 - RNA, 32 nt, Human
ggcuaacacgaugaaaccccgucucuacuaaa

SEQ ID NO: 192853 - RNA, 32 nt, Human
ggcuaacacggcgaaaccccgucucuacuaaa

SEQ ID NO: 192854 - RNA, 32 nt, Human
ggcuaacacggcgaaacgccaucucuacugaa

SEQ ID NO: 192855 - RNA, 32 nt, Human
ggcuaacacgggugaaaccccgucucuauuaa

SEQ ID NO: 192856 - RNA, 32 nt, Human
ggcuaacacgguaaaaccccaucucuacuaaa

SEQ ID NO: 192857 - RNA, 32 nt, Human
ggcuaacacggugaaacccaaucucuacuaaa

SEQ ID NO: 192858 - RNA, 32 nt, Human
ggcuaacacggugaaacccagccucuacuaaa

SEQ ID NO: 192859 - RNA, 32 nt, Human
ggcuaacacggugaaacccagucucuacuaaa

SEQ ID NO: 192860 - RNA, 32 nt, Human
ggcuaacacggugaaaccccaccucuacuaaa

SEQ ID NO: 192861 - RNA, 32 nt, Human
ggcuaacacggugaaaccccaucuccacuaaa

SEQ ID NO: 192862 - RNA, 32 nt, Human
ggcuaacacggugaaaccccaucucuacaaaa

SEQ ID NO: 192863 - RNA, 32 nt, Human
ggcuaacacggugaaaccccaucucuacuaaa

SEQ ID NO: 192864 - RNA, 32 nt, Human
ggcuaacacggugaaaccccaucucuacugaa

SEQ ID NO: 192865 - RNA, 32 nt, Human
ggcuaacacggugaaaccccauuuccacuaaa

SEQ ID NO: 192866 - RNA, 32 nt, Human
ggcuaacacggugaaaccccggcucuacuaaa

SEQ ID NO: 192867 - RNA, 32 nt, Human
ggcuaacacggugaaaccccgucucuaauaaa

SEQ ID NO: 192868 - RNA, 32 nt, Human
ggcuaacacggugaaaccccgucucuacauaa

SEQ ID NO: 192869 - RNA, 32 nt, Human
ggcuaacacggugaaaccccgucucuacuaaa

SEQ ID NO: 192870 - RNA, 32 nt, Human
ggcuaacacggugaaaccccgucucuacuaca

SEQ ID NO: 192871 - RNA, 32 nt, Human
ggcuaacacggugaaaccccgucucuacuacg

SEQ ID NO: 192872 - RNA, 32 nt, Human
ggcuaacacggugaaaccccgucucuacugaa

SEQ ID NO: 192873 - RNA, 32 nt, Human
ggcuaacacggugaaaccccgucucuaguaaa

SEQ ID NO: 192874 - RNA, 32 nt, Human
ggcuaacacggugaaaccccgucuuuacuaaa

SEQ ID NO: 192875 - RNA, 32 nt, Human
ggcuaacacggugaaaccccgucuuuacuaac

SEQ ID NO: 192876 - RNA, 32 nt, Human
ggcuaacacggugaaaccccuuaucuaugcgc

SEQ ID NO: 192877 - RNA, 32 nt, Human
ggcuaacacggugaaacccgaucccuacuaaa

SEQ ID NO: 192878 - RNA, 32 nt, Human
ggcuaacacggugaaacccgucucuacuaaaa

SEQ ID NO: 192879 - RNA, 32 nt, Human
ggcuaacacggugaaacccuaucucuacuaaa

SEQ ID NO: 192880 - RNA, 32 nt, Human
ggcuaacacggugaaacccugccucuacuaaa

SEQ ID NO: 192881 - RNA, 32 nt, Human
ggcuaacacggugaaacccugucucuacuaaa

SEQ ID NO: 192882 - RNA, 32 nt, Human
ggcuaacacggugaaacccugucuuuacuaaa

SEQ ID NO: 192883 - RNA, 32 nt, Human
ggcuaacacggugaaaccgucucuacuaaaac

SEQ ID NO: 192884 - RNA, 32 nt, Human
ggcuaacacggugaaaccucgucucuacuaaa

SEQ ID NO: 192885 - RNA, 32 nt, Human
ggcuaacacggugaaaccugucucuacuaaaa

SEQ ID NO: 192886 - RNA, 32 nt, Human
ggcuaacacggugaaacuccaucucuacuaaa

SEQ ID NO: 192887 - RNA, 32 nt, Human
ggcuaacacggugaaacuccgucucuacuaaa

SEQ ID NO: 192888 - RNA, 32 nt, Human
ggcuaacacggugagaccccaucucuacuaaa

SEQ ID NO: 192889 - RNA, 32 nt, Human
ggcuaacagggugaaaccacgucucuacuaaa

SEQ ID NO: 192890 - RNA, 32 nt, Human
ggcuaacagggugaaaccccaucgcuacuaaa

SEQ ID NO: 192891 - RNA, 32 nt, Human
ggcuaacagggugaaaccccgucucuacuaaa

SEQ ID NO: 192892 - RNA, 29 nt, Human
ggcuaacagggugaaacccugucucuacu

SEQ ID NO: 192893 - RNA, 32 nt, Human
ggcuaacauagugaaacccugucucuacuaaa

SEQ ID NO: 192894 - RNA, 32 nt, Human
ggcuaacauggcaaaaccccaucucuacuaaa

SEQ ID NO: 192895 - RNA, 32 nt, Human
ggcuaacauggcaaaaccucaucucuacuaaa

SEQ ID NO: 192896 - RNA, 32 nt, Human
ggcuaacauggcgaaaccccgucucuacuaaa

SEQ ID NO: 192897 - RNA, 32 nt, Human
ggcuaacauggugaaaccccaucuccacuaaa

SEQ ID NO: 192898 - RNA, 29 nt, Human
ggcuaacauggugaaaccccaucucuacu

SEQ ID NO: 192899 - RNA, 32 nt, Human
ggcuaacauggugaaaccccaucucuacuaaa

SEQ ID NO: 192900 - RNA, 32 nt, Human
ggcuaacauggugaaaccccaucucuacugaa

SEQ ID NO: 192901 - RNA, 32 nt, Human
ggcuaacauggugaaaccccaucucuaguaaa

SEQ ID NO: 192902 - RNA, 32 nt, Human
ggcuaacauggugaaaccccaugucuacuaaa

SEQ ID NO: 192903 - RNA, 32 nt, Human
ggcuaacauggugaaacccccgucucuacuaa

SEQ ID NO: 192904 - RNA, 32 nt, Human
ggcuaacauggugaaacccccguuucuacuaa

SEQ ID NO: 192905 - RNA, 32 nt, Human
ggcuaacauggugaaaccccgccucuacuaaa

SEQ ID NO: 192906 - RNA, 32 nt, Human
ggcuaacauggugaaaccccgucucuaccaaa

SEQ ID NO: 192907 - RNA, 32 nt, Human
ggcuaacauggugaaaccccgucucuacuaaa

SEQ ID NO: 192908 - RNA, 32 nt, Human
ggcuaacauggugaaaccccgucucuacugaa

SEQ ID NO: 192909 - RNA, 32 nt, Human
ggcuaacauggugaaaccccgucucuacuuaa

SEQ ID NO: 192910 - RNA, 32 nt, Human
ggcuaacauggugaaaccccgucucugcuaaa

SEQ ID NO: 192911 - RNA, 32 nt, Human
ggcuaacauggugaaaccccgucuguacuaaa

SEQ ID NO: 192912 - RNA, 32 nt, Human
ggcuaacauggugaaacccgcgucucuggugg

SEQ ID NO: 192913 - RNA, 32 nt, Human
ggcuaacauggugaaacccuaucucuacuaaa

SEQ ID NO: 192914 - RNA, 32 nt, Human
ggcuaacauggugaaacccugccucuacuaaa

SEQ ID NO: 192915 - RNA, 32 nt, Human
ggcuaacauggugaaacccuggcucuacuaaa

SEQ ID NO: 192916 - RNA, 32 nt, Human
ggcuaacauggugaaacccugucucuacuaaa

SEQ ID NO: 192917 - RNA, 32 nt, Human
ggcuaacauggugaaacccugucucuacugaa

SEQ ID NO: 192918 - RNA, 32 nt, Human
ggcuaacauggugaaacccugucucuauuaaa

SEQ ID NO: 192919 - RNA, 32 nt, Human
ggcuaacauggugaaacccugucuuuacuaaa

SEQ ID NO: 192920 - RNA, 32 nt, Human
ggcuaacauggugaaacccuguuucugcuaga

SEQ ID NO: 192921 - RNA, 32 nt, Human
ggcuaacauggugaaacccuuccccgucucua

SEQ ID NO: 192922 - RNA, 32 nt, Human
ggcuaacauggugaaaccucaucuccacuuaa

SEQ ID NO: 192923 - RNA, 32 nt, Human
ggcuaacauggugaaagccccucucuacuaaa

SEQ ID NO: 192924 - RNA, 32 nt, Human
ggcuaacauggugaaaucccgucucuacugaa

SEQ ID NO: 192925 - RNA, 32 nt, Human
ggcuaacauggugaaauccuaucucuaccaaa

SEQ ID NO: 192926 - RNA, 32 nt, Human
ggcuaacauggugaaccccgucucuacuaaaa

SEQ ID NO: 192927 - RNA, 32 nt, Human
ggcuaacauggugguaccccgucucuacugaa

SEQ ID NO: 192928 - RNA, 32 nt, Human
ggcuaacccggugaaaccccgucucuacuaaa

SEQ ID NO: 192929 - RNA, 32 nt, Human
ggcuaaccugggaggucaggggcugugguaua

SEQ ID NO: 192930 - RNA, 32 nt, Human
ggcuaacgauguagguuucauuucucagacuu

SEQ ID NO: 192931 - RNA, 32 nt, Human
ggcuaacgccuguaaucccagaacuuugggaa

SEQ ID NO: 192932 - RNA, 32 nt, Human
ggcuaacgccuguaaucccagcacuugggagg

SEQ ID NO: 192933 - RNA, 32 nt, Human
ggcuaacgccuguaaucccagcacuuugagau

SEQ ID NO: 192934 - RNA, 32 nt, Human
ggcuaacgcuuguaaucccagcgcuuugggag

SEQ ID NO: 192935 - RNA, 23 nt, Human
ggcuaacgugggcagcgcagggg

SEQ ID NO: 192936 - RNA, 32 nt, Human
ggcuaacguggugaaaccccaucucuacuaaa

SEQ ID NO: 192937 - RNA, 32 nt, Human
ggcuaacguggugaaaccccgucccuacuaaa

SEQ ID NO: 192938 - RNA, 32 nt, Human
ggcuaacugcaaccuccagcuccuggguucag

SEQ ID NO: 192939 - RNA, 32 nt, Human
ggcuaacugcaaccuccgccucccagguucaa

SEQ ID NO: 192940 - RNA, 32 nt, Human
ggcuaacugcaacuuccaccuccuggguucaa

SEQ ID NO: 192941 - RNA, 32 nt, Human
ggcuaacugccuggcccuccuggcucgcagcc

SEQ ID NO: 192942 - RNA, 32 nt, Human
ggcuaacuuggugaaaccccgucucuaauaaa

SEQ ID NO: 192943 - RNA, 32 nt, Human
ggcuaacuuggugaaacccugucucuacuaaa

SEQ ID NO: 192944 - RNA, 32 nt, Human
ggcuaagaaaugucagccacggaaacaacucu

SEQ ID NO: 192945 - RNA, 32 nt, Human
ggcuaagaaccucagcccuggggacuucaccu

SEQ ID NO: 192946 - RNA, 32 nt, Human
ggcuaagaaggaaauggcgaagagugaacaua

SEQ ID NO: 192947 - RNA, 32 nt, Human
ggcuaagaagucagagguagccaauguuuccu

SEQ ID NO: 192948 - RNA, 32 nt, Human
ggcuaagaagugagauggugcugccagagugc

SEQ ID NO: 192949 - RNA, 32 nt, Human
ggcuaagacgacucuuccacacacaggucgca

SEQ ID NO: 192950 - RNA, 32 nt, Human
ggcuaagaguguccuaggaguauccucauuug

SEQ ID NO: 192951 - RNA, 32 nt, Human
ggcuaagauggagaaacagguacuggacuuuu

SEQ ID NO: 192952 - RNA, 32 nt, Human
ggcuaagauggccacagaggaguuaggagccu

SEQ ID NO: 192953 - RNA, 32 nt, Human
ggcuaagauuccauggauggagcaauaaaggu

SEQ ID NO: 192954 - RNA, 32 nt, Human
ggcuaagccuggacacagucagggcggggcug

SEQ ID NO: 192955 - RNA, 32 nt, Human
ggcuaaggagaggaaagagcaggcacccaaac

SEQ ID NO: 192956 - RNA, 32 nt, Human
ggcuaaggcaggcacacaguggcggagaagau

SEQ ID NO: 192957 - RNA, 32 nt, Human
ggcuaaggggacagcggugugguuuggcuuua

SEQ ID NO: 192958 - RNA, 32 nt, Human
ggcuaaggggacgccggccggggaagaggcgc

SEQ ID NO: 192959 - RNA, 32 nt, Human
ggcuaagguaggaucacuugaucccaggaggc

SEQ ID NO: 192960 - RNA, 32 nt, Human
ggcuaagucccagcaauacaaaggacauaaga

SEQ ID NO: 192961 - RNA, 23 nt, Human
ggcuaagugauccucccaccuca

SEQ ID NO: 192962 - RNA, 32 nt, Human
ggcuaauacagugaaaccccaucucuacuaaa

SEQ ID NO: 192963 - RNA, 32 nt, Human
ggcuaauacggugaaaccccgucucuacuaaa

SEQ ID NO: 192964 - RNA, 32 nt, Human
ggcuaauauggugaaaccccaucucuacuaaa

SEQ ID NO: 192965 - RNA, 32 nt, Human
ggcuaauauggugaaaccccgucucuacuaaa

SEQ ID NO: 192966 - RNA, 32 nt, Human
ggcuaauauggugaaacccugucucuacuaaa

SEQ ID NO: 192967 - RNA, 32 nt, Human
ggcuaauauggugaaaccucgucucuacuaaa

SEQ ID NO: 192968 - RNA, 32 nt, Human
ggcuaaugaaggagggagaaaaacuguugauu

SEQ ID NO: 192969 - RNA, 32 nt, Human
ggcuaauggaguguuugaaaacugacaucaga

SEQ ID NO: 192970 - RNA, 32 nt, Human
ggcuaauguaaagccuuuccugccuugcauua

SEQ ID NO: 192971 - RNA, 32 nt, Human
ggcuaaugugcugauagccaggucugaaacuu

SEQ ID NO: 192972 - RNA, 32 nt, Human
ggcuaauguggugaaaccccgucucuacuaaa

SEQ ID NO: 192973 - RNA, 32 nt, Human
ggcuaauguugacuggagugucaagaagagug

SEQ ID NO: 192974 - RNA, 32 nt, Human
ggcuaauugccaccaauuucagccugccacga

SEQ ID NO: 192975 - RNA, 32 nt, Human
ggcuaauuugucucucauuugggguccuucau

SEQ ID NO: 192976 - RNA, 32 nt, Human
ggcuacaaaggcuccgcucacaaaagaaagcc

SEQ ID NO: 192977 - RNA, 32 nt, Human
ggcuacaaccccgacacaguagcauuugugcc

SEQ ID NO: 192978 - RNA, 32 nt, Human
ggcuacaacccugacacaguagcauuugugcc

SEQ ID NO: 192979 - RNA, 21 nt, Human
ggcuacaacgccgaugucauc

SEQ ID NO: 192980 - RNA, 21 nt, Human
ggcuacaacuaagcagccuca

SEQ ID NO: 192981 - RNA, 21 nt, Human
ggcuacaacuauuuuuucuca

SEQ ID NO: 192982 - RNA, 32 nt, Human
ggcuacaacucauaaauaugcaacauauaugu

SEQ ID NO: 192983 - RNA, 21 nt, Human
ggcuacaagcaggcuuaggca

SEQ ID NO: 192984 - RNA, 23 nt, Human
ggcuacaaggccugcccacggcc

SEQ ID NO: 192985 - RNA, 32 nt, Human
ggcuacaccacucucccagccugugaccaccg

SEQ ID NO: 192986 - RNA, 21 nt, Human
ggcuacacccccacaggugac

SEQ ID NO: 192987 - RNA, 32 nt, Human
ggcuacaccuucagugcuguguguuuccacag

SEQ ID NO: 192988 - RNA, 32 nt, Human
ggcuacacuagauauuuugugauuggcaagac

SEQ ID NO: 192989 - RNA, 32 nt, Human
ggcuacacuccucugcugaggaugucuacauu

SEQ ID NO: 192990 - RNA, 32 nt, Human
ggcuacacucuuuaagcaccuuccugagccac

SEQ ID NO: 192991 - RNA, 32 nt, Human
ggcuacacugcaacuuccguccagugcuguga

SEQ ID NO: 192992 - RNA, 22 nt, Human
ggcuacagaaugagacucugcc

SEQ ID NO: 192993 - RNA, 32 nt, Human
ggcuacagacuggcuuccaggguacucaagca

SEQ ID NO: 192994 - RNA, 21 nt, Human
ggcuacagagcugccgcggcu

SEQ ID NO: 192995 - RNA, 32 nt, Human
ggcuacagcacuccagccugggcaacaagagc

SEQ ID NO: 192996 - RNA, 32 nt, Human
ggcuacagcaggugucggauugcagugcgcuc

SEQ ID NO: 192997 - RNA, 21 nt, Human
ggcuacagcaugugcuaggcc

SEQ ID NO: 192998 - RNA, 21 nt, Human
ggcuacagccccgcuacagcc

SEQ ID NO: 192999 - RNA, 22 nt, Human
ggcuacagcccuucauguggcu

SEQ ID NO: 193000 - RNA, 22 nt, Human
ggcuacagccuuugugcuuuua

SEQ ID NO: 193001 - RNA, 25 nt, Human
ggcuacagcuaugcgccaccaugcc

SEQ ID NO: 193002 - RNA, 21 nt, Human
ggcuacagcugagcaauggcu

SEQ ID NO: 193003 - RNA, 32 nt, Human
ggcuacagcugcgccggaucugggcgaccacg

SEQ ID NO: 193004 - RNA, 32 nt, Human
ggcuacagcugcugcugccucuucuaauaaag

SEQ ID NO: 193005 - RNA, 23 nt, Human
ggcuacagcuucuaucacaugcc

SEQ ID NO: 193006 - RNA, 32 nt, Human
ggcuacagcuucugccuccucaccuggccguc

SEQ ID NO: 193007 - RNA, 32 nt, Human
ggcuacaggacccccaacaaccccaauccacg

SEQ ID NO: 193008 - RNA, 25 nt, Human
ggcuacaggagcauaccaccaugcc

SEQ ID NO: 193009 - RNA, 25 nt, Human
ggcuacaggcacgcaucaccaugcc

SEQ ID NO: 193010 - RNA, 25 nt, Human
ggcuacaggcauauaccaccaugcc

SEQ ID NO: 193011 - RNA, 20 nt, Human
ggcuacagggcaggcagagg

SEQ ID NO: 193012 - RNA, 32 nt, Human
ggcuacagggcuguaagagucgcuugaccuuc

SEQ ID NO: 193013 - RNA, 25 nt, Human
ggcuacaggugugagccaccaugcc

SEQ ID NO: 193014 - RNA, 25 nt, Human
ggcuacagugagccaucaucgugcc

SEQ ID NO: 193015 - RNA, 20 nt, Human
ggcuacaguuuagcauggcc

SEQ ID NO: 193016 - RNA, 32 nt, Human
ggcuacaucaucccuggcuguggauagugcuu

SEQ ID NO: 193017 - RNA, 32 nt, Human
ggcuacauuggugggugguggaguacugcccg

SEQ ID NO: 193018 - RNA, 32 nt, Human
ggcuacauuucccauggguuguuuccauaaga

SEQ ID NO: 193019 - RNA, 20 nt, Human
ggcuaccagucccaccaggg

SEQ ID NO: 193020 - RNA, 32 nt, Human
ggcuaccauggacugaagggcaguccccuccc

SEQ ID NO: 193021 - RNA, 32 nt, Human
ggcuacccaccagggaauggcacuagcagggg

SEQ ID NO: 193022 - RNA, 32 nt, Human
ggcuacccggaugaagagguuggaggugggca

SEQ ID NO: 193023 - RNA, 32 nt, Human
ggcuacccuaaagggagaaggaagggcagaga

SEQ ID NO: 193024 - RNA, 32 nt, Human
ggcuacccuccccaccccacuucuaucucaau

SEQ ID NO: 193025 - RNA, 23 nt, Human
ggcuaccgcggcccgccguggcc

SEQ ID NO: 193026 - RNA, 20 nt, Human
ggcuaccgcggcggcgcagg

SEQ ID NO: 193027 - RNA, 22 nt, Human
ggcuaccgcuaccgccacugcu

SEQ ID NO: 193028 - RNA, 32 nt, Human
ggcuaccggaucggucggaaauggcagaggug

SEQ ID NO: 193029 - RNA, 32 nt, Human
ggcuaccuacuucuuaaauuccguuuguggac

SEQ ID NO: 193030 - RNA, 27 nt, Human
ggcuaccuaggccuggccugcaugggc

SEQ ID NO: 193031 - RNA, 32 nt, Human
ggcuaccucccaggaaaccgugauagccauuu

SEQ ID NO: 193032 - RNA, 32 nt, Human
ggcuaccucuucguucugauuggccgcuagug

SEQ ID NO: 193033 - RNA, 32 nt, Human
ggcuaccugacuuggugggagcuccaggcagu

SEQ ID NO: 193034 - RNA, 32 nt, Human
ggcuaccugaggcugcacaggccagggcucgg

SEQ ID NO: 193035 - RNA, 22 nt, Human
ggcuaccuggcacccuauggcu

SEQ ID NO: 193036 - RNA, 32 nt, Human
ggcuaccugggcaggcagaaaaguuccugagg

SEQ ID NO: 193037 - RNA, 22 nt, Human
ggcuaccugucucccacagaug

SEQ ID NO: 193038 - RNA, 32 nt, Human
ggcuacgaccgggaccacguggugcuauggga

SEQ ID NO: 193039 - RNA, 32 nt, Human
ggcuacgccuguaaucccagcacuuugggagg

SEQ ID NO: 193040 - RNA, 32 nt, Human
ggcuacggaugggcgggacggagcagcccacc

SEQ ID NO: 193041 - RNA, 26 nt, Human
ggcuacggggaggccaccaccaggcc

SEQ ID NO: 193042 - RNA, 21 nt, Human
ggcuacggugacggccuggcc

SEQ ID NO: 193043 - RNA, 21 nt, Human
ggcuacggugagccgaagcca

SEQ ID NO: 193044 - RNA, 32 nt, Human
ggcuacuagagaacaagagggaaaguagggca

SEQ ID NO: 193045 - RNA, 32 nt, Human
ggcuacucaccccucugggauggcuaugggag

SEQ ID NO: 193046 - RNA, 32 nt, Human
ggcuacuccagccgcuucagacugccgggcag

SEQ ID NO: 193047 - RNA, 32 nt, Human
ggcuacuccugcucagcauggcugcuuuaggg

SEQ ID NO: 193048 - RNA, 32 nt, Human
ggcuacucucaaacuccugaccucaggugauc

SEQ ID NO: 193049 - RNA, 32 nt, Human
ggcuacucuggccuggcuucagcuuggaaccc

SEQ ID NO: 193050 - RNA, 32 nt, Human
ggcuacuggaggucacguucccuaacugaucc

SEQ ID NO: 193051 - RNA, 23 nt, Human
ggcuacugucucucugcacucug

SEQ ID NO: 193052 - RNA, 32 nt, Human
ggcuacuguucuguucuguauuuuggcaucug

SEQ ID NO: 193053 - RNA, 32 nt, Human
ggcuacuucuccccuccucuugccucccuccu

SEQ ID NO: 193054 - RNA, 32 nt, Human
ggcuacuucucccuucccucgguuccagucuu

SEQ ID NO: 193055 - RNA, 32 nt, Human
ggcuacuugggaggcagaggcaggagaauugc

SEQ ID NO: 193056 - RNA, 32 nt, Human
ggcuagaaaaggggcuuugccuuuguaacuuu

SEQ ID NO: 193057 - RNA, 32 nt, Human
ggcuagaaccuguagagcuagaacauggagag

SEQ ID NO: 193058 - RNA, 32 nt, Human
ggcuagaacuacaggcgugcaccacugugccc

SEQ ID NO: 193059 - RNA, 32 nt, Human
ggcuagaacuacccccucccagucuucaggcu

SEQ ID NO: 193060 - RNA, 32 nt, Human
ggcuagacgagggcccugggcaccagugauua

SEQ ID NO: 193061 - RNA, 32 nt, Human
ggcuagagaacagcaggucugugcagugucug

SEQ ID NO: 193062 - RNA, 32 nt, Human
ggcuagagaggcaccuuccugcgugaauccug

SEQ ID NO: 193063 - RNA, 32 nt, Human
ggcuagagccagcugcacuauccuuuucagag

SEQ ID NO: 193064 - RNA, 32 nt, Human
ggcuagagcgcaguggcaagauccucaggcuu

SEQ ID NO: 193065 - RNA, 22 nt, Human
ggcuagaggcaugggccaggua

SEQ ID NO: 193066 - RNA, 22 nt, Human
ggcuagaggcgccgccgccgcc

SEQ ID NO: 193067 - RNA, 20 nt, Human
ggcuagaggcggccgaggca

SEQ ID NO: 193068 - RNA, 32 nt, Human
ggcuagaguacagugggaacagucauggcuca

SEQ ID NO: 193069 - RNA, 32 nt, Human
ggcuagagugaacuugggccacugugaagaga

SEQ ID NO: 193070 - RNA, 21 nt, Human
ggcuagaucaguguuuuucca

SEQ ID NO: 193071 - RNA, 32 nt, Human
ggcuagauuuaucuugggugauggaggaaaug

SEQ ID NO: 193072 - RNA, 20 nt, Human
ggcuagcacagggcuaggca

SEQ ID NO: 193073 - RNA, 32 nt, Human
ggcuagcaccgugucugugucugucucccccu

SEQ ID NO: 193074 - RNA, 18 nt, Human
ggcuagcagcaugcggua

SEQ ID NO: 193075 - RNA, 32 nt, Human
ggcuagcauaguaaaaccccaucucuacugaa

SEQ ID NO: 193076 - RNA, 32 nt, Human
ggcuagcauccccagcccuuaauccacgucgg

SEQ ID NO: 193077 - RNA, 19 nt, Human
ggcuagcaugcucauggca

SEQ ID NO: 193078 - RNA, 32 nt, Human
ggcuagcauggugaaaccccgucucuacuaaa

SEQ ID NO: 193079 - RNA, 32 nt, Human
ggcuagcauggugagaccgucucuacuaaaaa

SEQ ID NO: 193080 - RNA, 32 nt, Human
ggcuagccacugugcuccagccugggcaacac

SEQ ID NO: 193081 - RNA, 32 nt, Human
ggcuagccagcuuuccaccaccauuuauuaaa

SEQ ID NO: 193082 - RNA, 32 nt, Human
ggcuagccccaaacuccugggcucaagugaug

SEQ ID NO: 193083 - RNA, 32 nt, Human
ggcuagccccuaccucugccauccuggagggc

SEQ ID NO: 193084 - RNA, 32 nt, Human
ggcuagccucaaacuccugggcucaagcgauc

SEQ ID NO: 193085 - RNA, 32 nt, Human
ggcuagccucaaacuccugggcuccagugacc

SEQ ID NO: 193086 - RNA, 32 nt, Human
ggcuagccucgaacuccugaacucaggugauc

SEQ ID NO: 193087 - RNA, 20 nt, Human
ggcuagccuggagcucacca

SEQ ID NO: 193088 - RNA, 32 nt, Human
ggcuagcgaggaaccugccccuccaguggccc

SEQ ID NO: 193089 - RNA, 32 nt, Human
ggcuagcgugagcgcugauucucaaccuacca

SEQ ID NO: 193090 - RNA, 32 nt, Human
ggcuagcucucaucauuuuggcacuuccgacu

SEQ ID NO: 193091 - RNA, 32 nt, Human
ggcuagcucugccuuccacaugcuucucagga

SEQ ID NO: 193092 - RNA, 32 nt, Human
ggcuagcucuugcccuuauaugacuuuaaugu

SEQ ID NO: 193093 - RNA, 20 nt, Human
ggcuaggaaagggcccaggg

SEQ ID NO: 193094 - RNA, 32 nt, Human
ggcuaggaagugaaaggaucaagauauuuacu

SEQ ID NO: 193095 - RNA, 31 nt, Human
ggcuaggacagcuagagugcagggaagccgg

SEQ ID NO: 193096 - RNA, 32 nt, Human
ggcuaggacagggaacagggaagcacuuacaa

SEQ ID NO: 193097 - RNA, 24 nt, Human
ggcuaggacuuuuacuaccauggu

SEQ ID NO: 193098 - RNA, 20 nt, Human
ggcuaggagaagagcccagg

SEQ ID NO: 193099 - RNA, 32 nt, Human
ggcuaggaggcaggggcugcaggcucagccug

SEQ ID NO: 193100 - RNA, 32 nt, Human
ggcuaggaguuagaggaagagagugacucaaa

SEQ ID NO: 193101 - RNA, 32 nt, Human
ggcuaggaguucgagaccauccuggccaacau

SEQ ID NO: 193102 - RNA, 32 nt, Human
ggcuaggcagcuggaagagaaagaccgagugc

SEQ ID NO: 193103 - RNA, 32 nt, Human
ggcuaggccaaggacagcaacaaguguucaaa

SEQ ID NO: 193104 - RNA, 32 nt, Human
ggcuaggccgcccuccccacuguuaccaacau

SEQ ID NO: 193105 - RNA, 32 nt, Human
ggcuaggcugcagccugccuccuggggacuca

SEQ ID NO: 193106 - RNA, 20 nt, Human
ggcuaggcuuuuuuauuuca

SEQ ID NO: 193107 - RNA, 32 nt, Human
ggcuagggacucggcugcaccugcucuuggac

SEQ ID NO: 193108 - RNA, 32 nt, Human
ggcuagggagggcaugaacacaaacauaagaa

SEQ ID NO: 193109 - RNA, 32 nt, Human
ggcuagggccuccugcaggguuguggggugga

SEQ ID NO: 193110 - RNA, 32 nt, Human
ggcuagggccugauucgggaagaugccuuugc

SEQ ID NO: 193111 - RNA, 32 nt, Human
ggcuagggcuugggccuggcauggaaggccuu

SEQ ID NO: 193112 - RNA, 32 nt, Human
ggcuaggggcucuguuucccccggcucuggca

SEQ ID NO: 193113 - RNA, 32 nt, Human
ggcuaggggcugggagcugcagauucugaccc

SEQ ID NO: 193114 - RNA, 20 nt, Human
ggcuaggggcuggggaagga

SEQ ID NO: 193115 - RNA, 32 nt, Human
ggcuagggguggaggccaggguuccaaggaaa

SEQ ID NO: 193116 - RNA, 32 nt, Human
ggcuaggguacuuggcuugcuuugcuaugugu

SEQ ID NO: 193117 - RNA, 32 nt, Human
ggcuagggugaaaugacaucaucuugcauuua

SEQ ID NO: 193118 - RNA, 23 nt, Human
ggcuagguagggucaccuaggga

SEQ ID NO: 193119 - RNA, 32 nt, Human
ggcuaggucccucuguccaucugggccuuugu

SEQ ID NO: 193120 - RNA, 18 nt, Human
ggcuaggucuggguccag

SEQ ID NO: 193121 - RNA, 32 nt, Human
ggcuagguuagaaagggagugagggaagggac

SEQ ID NO: 193122 - RNA, 32 nt, Human
ggcuagucacgaacuccugaccucgugauccg

SEQ ID NO: 193123 - RNA, 32 nt, Human
ggcuagucucaaacucccgaccuuaggugaug

SEQ ID NO: 193124 - RNA, 32 nt, Human
ggcuagucucaaacuccugaccucaggugauc

SEQ ID NO: 193125 - RNA, 32 nt, Human
ggcuagucucaaacuccugaccucaggugcuc

SEQ ID NO: 193126 - RNA, 32 nt, Human
ggcuagucucaaacuccugaccuccagugauc

SEQ ID NO: 193127 - RNA, 32 nt, Human
ggcuagucucaaacuccugacgucgugauccg

SEQ ID NO: 193128 - RNA, 32 nt, Human
ggcuagucucaaacuccugggcucaagcaauc

SEQ ID NO: 193129 - RNA, 32 nt, Human
ggcuagucucaaacuccugggcucaagugauc

SEQ ID NO: 193130 - RNA, 32 nt, Human
ggcuagucuccaacuccugggcucagaugagc

SEQ ID NO: 193131 - RNA, 32 nt, Human
ggcuagucucgaacuccugaccucaggugauc

SEQ ID NO: 193132 - RNA, 32 nt, Human
ggcuagucucgaauuccugggcucaagugauu

SEQ ID NO: 193133 - RNA, 32 nt, Human
ggcuagucuugaacuccugaccucaggugauc

SEQ ID NO: 193134 - RNA, 32 nt, Human
ggcuagucuuggaacuacugaccucaggugau

SEQ ID NO: 193135 - RNA, 32 nt, Human
ggcuagugagccacagacccauuugaggccaa

SEQ ID NO: 193136 - RNA, 20 nt, Human
ggcuaguuacucuucagaug

SEQ ID NO: 193137 - RNA, 32 nt, Human
ggcuaguuaggaagaaaggaggugggauaagg

SEQ ID NO: 193138 - RNA, 32 nt, Human
ggcuaguucuuuucagccuuguggagccuguc

SEQ ID NO: 193139 - RNA, 32 nt, Human
ggcuaguuucaaacuccugaccuuaggugauc

SEQ ID NO: 193140 - RNA, 32 nt, Human
ggcuaguuugcaggagagaacccagaauaaac

SEQ ID NO: 193141 - RNA, 32 nt, Human
ggcuauaaaauaaaggcuucaaauucuucaaa

SEQ ID NO: 193142 - RNA, 32 nt, Human
ggcuauaacauacaugucaauaucacuguuuu

SEQ ID NO: 193143 - RNA, 32 nt, Human
ggcuauaauacacacuaccucccuucacuaca

SEQ ID NO: 193144 - RNA, 22 nt, Human
ggcuauaauaguucuguucuua

SEQ ID NO: 193145 - RNA, 22 nt, Human
ggcuauagcagauggccauggc

SEQ ID NO: 193146 - RNA, 32 nt, Human
ggcuauaggacagguagcccucauuuccaugc

SEQ ID NO: 193147 - RNA, 20 nt, Human
ggcuauagucugagcuacuc

SEQ ID NO: 193148 - RNA, 32 nt, Human
ggcuauaucugcacuucaagaggccaccuucu

SEQ ID NO: 193149 - RNA, 32 nt, Human
ggcuauauuuugcuaaacugcccucucaaaug

SEQ ID NO: 193150 - RNA, 32 nt, Human
ggcuaucaaggugacacaccgugagacaggug

SEQ ID NO: 193151 - RNA, 32 nt, Human
ggcuaucagagucaacguccugccugugcagc

SEQ ID NO: 193152 - RNA, 32 nt, Human
ggcuaucagcagagaaagacaggugggcagca

SEQ ID NO: 193153 - RNA, 32 nt, Human
ggcuaucaggggcauuuaucaugugugagauu

SEQ ID NO: 193154 - RNA, 32 nt, Human
ggcuauccagagauucccaguaggagacacgg

SEQ ID NO: 193155 - RNA, 32 nt, Human
ggcuauccauccacccaccaagacccuguucc

SEQ ID NO: 193156 - RNA, 19 nt, Human
ggcuauccuacaccugggc

SEQ ID NO: 193157 - RNA, 32 nt, Human
ggcuauccucaccaugacccagcucuacaagg

SEQ ID NO: 193158 - RNA, 31 nt, Human
ggcuaucugagggugugaugggugaagcugu

SEQ ID NO: 193159 - RNA, 32 nt, Human
ggcuaucuugcccaggcuugcaauuuauagag

SEQ ID NO: 193160 - RNA, 32 nt, Human
ggcuaugaaagaacuaaauaugaguacauaaa

SEQ ID NO: 193161 - RNA, 32 nt, Human
ggcuaugcaacagcucucaccuacgcgagucu

SEQ ID NO: 193162 - RNA, 32 nt, Human
ggcuaugcuucugugauauggaaagggcaccc

SEQ ID NO: 193163 - RNA, 22 nt, Human
ggcuauggcuugacucaugggc

SEQ ID NO: 193164 - RNA, 23 nt, Human
ggcuaugggacgcggcuacggcc

SEQ ID NO: 193165 - RNA, 32 nt, Human
ggcuaugggaggauuauuuuaacagaucaaga

SEQ ID NO: 193166 - RNA, 32 nt, Human
ggcuaugggagugucuagaugccugaaagggc

SEQ ID NO: 193167 - RNA, 24 nt, Human
ggcuaugguccugccaggugcagg

SEQ ID NO: 193168 - RNA, 32 nt, Human
ggcuaugguggggguagguaggucacuugucc

SEQ ID NO: 193169 - RNA, 32 nt, Human
ggcuauguugcccaggcuggucucgaacucug

SEQ ID NO: 193170 - RNA, 32 nt, Human
ggcuauucucgaacuccugaccucgugaucca

SEQ ID NO: 193171 - RNA, 32 nt, Human
ggcuauucugugccuucuaccucuuucuucuc

SEQ ID NO: 193172 - RNA, 32 nt, Human
ggcuauucuugaaggccagguuuuaauaacca

SEQ ID NO: 193173 - RNA, 32 nt, Human
ggcuauugagauuauuguggcuuuuguauuuc

SEQ ID NO: 193174 - RNA, 29 nt, Human
ggcuauuggcugcucccaauccuugcccc

SEQ ID NO: 193175 - RNA, 32 nt, Human
ggcuauuuccacugcucuauuucugacucuca

SEQ ID NO: 193176 - RNA, 32 nt, Human
ggcuauuuugaacccaggaauccuugggggug

SEQ ID NO: 193177 - RNA, 32 nt, Human
ggcuauuuugaugaagaaaacuuuguucauuu

SEQ ID NO: 193178 - RNA, 24 nt, Human
ggcucaaacaauucuccugccuca

SEQ ID NO: 193179 - RNA, 32 nt, Human
ggcucaaaccaauaggacaauuugcugagguc

SEQ ID NO: 193180 - RNA, 32 nt, Human
ggcucaaaccuguaaucccagcacuuugggag

SEQ ID NO: 193181 - RNA, 32 nt, Human
ggcucaaagacuguucgcgcagccacacaggu

SEQ ID NO: 193182 - RNA, 32 nt, Human
ggcucaaagcaaguggaagugggcagagauuc

SEQ ID NO: 193183 - RNA, 32 nt, Human
ggcucaaagcagcaggacugugggaaagagcc

SEQ ID NO: 193184 - RNA, 32 nt, Human
ggcucaaaggcugggagggagggaaggagaga

SEQ ID NO: 193185 - RNA, 24 nt, Human
ggcucaaaucauccuccugccuca

SEQ ID NO: 193186 - RNA, 19 nt, Human
ggcucaaaugauccuccca

SEQ ID NO: 193187 - RNA, 24 nt, Human
ggcucaaaugauccucccaccuca

SEQ ID NO: 193188 - RNA, 23 nt, Human
ggcucaaaugauccucccaucuc

SEQ ID NO: 193189 - RNA, 24 nt, Human
ggcucaaaugauccuuccaccuca

SEQ ID NO: 193190 - RNA, 19 nt, Human
ggcucaaaugcucucccca

SEQ ID NO: 193191 - RNA, 32 nt, Human
ggcucaacauucacgugccucuugcuuucuuu

SEQ ID NO: 193192 - RNA, 32 nt, Human
ggcucaacgcaaccuccgccucccagguucaa

SEQ ID NO: 193193 - RNA, 24 nt, Human
ggcucaacggauccuuccaccuca

SEQ ID NO: 193194 - RNA, 32 nt, Human
ggcucaacuucccugcuucugccugugcccuc

SEQ ID NO: 193195 - RNA, 21 nt, Human
ggcucaacuucugggcuccca

SEQ ID NO: 193196 - RNA, 24 nt, Human
ggcucaagaaauccucccaccuca

SEQ ID NO: 193197 - RNA, 20 nt, Human
ggcucaagaacagcuccaag

SEQ ID NO: 193198 - RNA, 24 nt, Human
ggcucaagagauccucccacuuca

SEQ ID NO: 193199 - RNA, 32 nt, Human
ggcucaagaugaaacucuuuccccagcaguuu

SEQ ID NO: 193200 - RNA, 24 nt, Human
ggcucaagcaaaccucucaccuca

SEQ ID NO: 193201 - RNA, 24 nt, Human
ggcucaagcaacccugccaccuca

SEQ ID NO: 193202 - RNA, 24 nt, Human
ggcucaagcaacucuuccaccuca

SEQ ID NO: 193203 - RNA, 24 nt, Human
ggcucaagcaauccuaccauguca

SEQ ID NO: 193204 - RNA, 24 nt, Human
ggcucaagcaauccucccaccuca

SEQ ID NO: 193205 - RNA, 24 nt, Human
ggcucaagcaauccucccacuuca

SEQ ID NO: 193206 - RNA, 24 nt, Human
ggcucaagcaauccucccaucuua

SEQ ID NO: 193207 - RNA, 24 nt, Human
ggcucaagcaauccucccgccuca

SEQ ID NO: 193208 - RNA, 24 nt, Human
ggcucaagcaauccucccgcuuca

SEQ ID NO: 193209 - RNA, 24 nt, Human
ggcucaagcaauccucccuccuca

SEQ ID NO: 193210 - RNA, 24 nt, Human
ggcucaagcaauccuccugccuca

SEQ ID NO: 193211 - RNA, 32 nt, Human
ggcucaagcaauccuccugccucggccuccca

SEQ ID NO: 193212 - RNA, 32 nt, Human
ggcucaagcaauccuccugccucggcuuccua

SEQ ID NO: 193213 - RNA, 24 nt, Human
ggcucaagcaauccucucaccgca

SEQ ID NO: 193214 - RNA, 24 nt, Human
ggcucaagcaauccucucaccuca

SEQ ID NO: 193215 - RNA, 23 nt, Human
ggcucaagcaauccucucaucuc

SEQ ID NO: 193216 - RNA, 24 nt, Human
ggcucaagcaauccuuccuacuca

SEQ ID NO: 193217 - RNA, 24 nt, Human
ggcucaagcaaucuucccaccuca

SEQ ID NO: 193218 - RNA, 24 nt, Human
ggcucaagcaaugcucccaucuca

SEQ ID NO: 193219 - RNA, 24 nt, Human
ggcucaagcaauucucccaccuca

SEQ ID NO: 193220 - RNA, 24 nt, Human
ggcucaagcaauucuccuaccuca

SEQ ID NO: 193221 - RNA, 22 nt, Human
ggcucaagcaauucuccugccu

SEQ ID NO: 193222 - RNA, 24 nt, Human
ggcucaagcaauucuccugccuca

SEQ ID NO: 193223 - RNA, 24 nt, Human
ggcucaagcacuccucccuccuca

SEQ ID NO: 193224 - RNA, 24 nt, Human
ggcucaagcacucugcccaccuca

SEQ ID NO: 193225 - RNA, 24 nt, Human
ggcucaagcaguccucccaccuca

SEQ ID NO: 193226 - RNA, 24 nt, Human
ggcucaagcaguccuccccacuca

SEQ ID NO: 193227 - RNA, 32 nt, Human
ggcucaagcaguccuccugccuuggccuccua

SEQ ID NO: 193228 - RNA, 19 nt, Human
ggcucaagcaguccuuccc

SEQ ID NO: 193229 - RNA, 24 nt, Human
ggcucaagcagucuacccaccuca

SEQ ID NO: 193230 - RNA, 24 nt, Human
ggcucaagcagucuuccugccuca

SEQ ID NO: 193231 - RNA, 24 nt, Human
ggcucaagcaguucucccaccuca

SEQ ID NO: 193232 - RNA, 22 nt, Human
ggcucaagcaguucuccugccu

SEQ ID NO: 193233 - RNA, 24 nt, Human
ggcucaagcaguucuccugccuca

SEQ ID NO: 193234 - RNA, 28 nt, Human
ggcucaagccauccauccuccuaccuca

SEQ ID NO: 193235 - RNA, 24 nt, Human
ggcucaagccauccucccuccuca

SEQ ID NO: 193236 - RNA, 24 nt, Human
ggcucaagccauccuuccgccuca

SEQ ID NO: 193237 - RNA, 24 nt, Human
ggcucaagccaucuuuccaccuca

SEQ ID NO: 193238 - RNA, 24 nt, Human
ggcucaagccauuuucccaccuca

SEQ ID NO: 193239 - RNA, 32 nt, Human
ggcucaagcccauaaucccagcacuuugggag

SEQ ID NO: 193240 - RNA, 32 nt, Human
ggcucaagccuguaaucccagcacuuuaggug

SEQ ID NO: 193241 - RNA, 32 nt, Human
ggcucaagccuguaaucccagcacuuugggag

SEQ ID NO: 193242 - RNA, 32 nt, Human
ggcucaagccuguaaucccagcacuuugggug

SEQ ID NO: 193243 - RNA, 32 nt, Human
ggcucaagccuguaaucccagcauuuugggag

SEQ ID NO: 193244 - RNA, 32 nt, Human
ggcucaagccuguaaugucagcacuuuaaaag

SEQ ID NO: 193245 - RNA, 32 nt, Human
ggcucaagccuguacucccagcacuuuuggag

SEQ ID NO: 193246 - RNA, 32 nt, Human
ggcucaagccuguauuccagcacuuugggagg

SEQ ID NO: 193247 - RNA, 24 nt, Human
ggcucaagcgacccucccaccuca

SEQ ID NO: 193248 - RNA, 24 nt, Human
ggcucaagcgacccuccugccuca

SEQ ID NO: 193249 - RNA, 24 nt, Human
ggcucaagcgauacucccaccuca

SEQ ID NO: 193250 - RNA, 23 nt, Human
ggcucaagcgaucccuccccuca

SEQ ID NO: 193251 - RNA, 24 nt, Human
ggcucaagcgauccuaucaccuca

SEQ ID NO: 193252 - RNA, 24 nt, Human
ggcucaagcgauccucacaccuca

SEQ ID NO: 193253 - RNA, 24 nt, Human
ggcucaagcgauccuccacccuca

SEQ ID NO: 193254 - RNA, 19 nt, Human
ggcucaagcgauccuccca

SEQ ID NO: 193255 - RNA, 24 nt, Human
ggcucaagcgauccucccaccuca

SEQ ID NO: 193256 - RNA, 23 nt, Human
ggcucaagcgauccucccacuuu

SEQ ID NO: 193257 - RNA, 24 nt, Human
ggcucaagcgauccucccagcuca

SEQ ID NO: 193258 - RNA, 24 nt, Human
ggcucaagcgauccucccgcuuca

SEQ ID NO: 193259 - RNA, 22 nt, Human
ggcucaagcgauccuccugccu

SEQ ID NO: 193260 - RNA, 24 nt, Human
ggcucaagcgauccuccugccuca

SEQ ID NO: 193261 - RNA, 24 nt, Human
ggcucaagcgauccuccuggcuca

SEQ ID NO: 193262 - RNA, 24 nt, Human
ggcucaagcgauccuucugccuca

SEQ ID NO: 193263 - RNA, 24 nt, Human
ggcucaagcgauucuccagccuca

SEQ ID NO: 193264 - RNA, 24 nt, Human
ggcucaagcgauucucccaccuca

SEQ ID NO: 193265 - RNA, 24 nt, Human
ggcucaagcgauucucucaccuca

SEQ ID NO: 193266 - RNA, 24 nt, Human
ggcucaagcgauucucucacuuca

SEQ ID NO: 193267 - RNA, 24 nt, Human
ggcucaagcgauucucuugccuca

SEQ ID NO: 193268 - RNA, 24 nt, Human
ggcucaagcgguccuucuaccuca

SEQ ID NO: 193269 - RNA, 24 nt, Human
ggcucaagcuauccucccaccuca

SEQ ID NO: 193270 - RNA, 24 nt, Human
ggcucaagcuauccuccugccuca

SEQ ID NO: 193271 - RNA, 24 nt, Human
ggcucaagcuguccucccaccuca

SEQ ID NO: 193272 - RNA, 32 nt, Human
ggcucaagcuuguauuaccagcacuuuaggag

SEQ ID NO: 193273 - RNA, 32 nt, Human
ggcucaaggauguggauacaggaagccuacua

SEQ ID NO: 193274 - RNA, 32 nt, Human
ggcucaaggcagcucuggacaagggagcaggc

SEQ ID NO: 193275 - RNA, 24 nt, Human
ggcucaaggcauccucccaccuca

SEQ ID NO: 193276 - RNA, 24 nt, Human
ggcucaagggauccucucaccuca

SEQ ID NO: 193277 - RNA, 24 nt, Human
ggcucaagggauccugccaccuca

SEQ ID NO: 193278 - RNA, 24 nt, Human
ggcucaagggauccugccaucuca

SEQ ID NO: 193279 - RNA, 32 nt, Human
ggcucaagggccagggcagccgagggaagcuc

SEQ ID NO: 193280 - RNA, 24 nt, Human
ggcucaaguaauccuaccgccuca

SEQ ID NO: 193281 - RNA, 19 nt, Human
ggcucaaguaauccuccca

SEQ ID NO: 193282 - RNA, 24 nt, Human
ggcucaaguaaucuuccugccuca

SEQ ID NO: 193283 - RNA, 32 nt, Human
ggcucaaguaaucuuccugccucaaccuccca

SEQ ID NO: 193284 - RNA, 32 nt, Human
ggcucaagucuguaaucccagcgcuuugggag

SEQ ID NO: 193285 - RNA, 24 nt, Human
ggcucaagugacccucccaccuca

SEQ ID NO: 193286 - RNA, 24 nt, Human
ggcucaagugacccuccugcauca

SEQ ID NO: 193287 - RNA, 24 nt, Human
ggcucaagugacccuccugccuca

SEQ ID NO: 193288 - RNA, 24 nt, Human
ggcucaagugaucaucccaccuca

SEQ ID NO: 193289 - RNA, 24 nt, Human
ggcucaagugaucauuccaccuca

SEQ ID NO: 193290 - RNA, 18 nt, Human
ggcucaagugauccuccc

SEQ ID NO: 193291 - RNA, 19 nt, Human
ggcucaagugauccuccca

SEQ ID NO: 193292 - RNA, 23 nt, Human
ggcucaagugauccucccaccuc

SEQ ID NO: 193293 - RNA, 24 nt, Human
ggcucaagugauccucccaccuca

SEQ ID NO: 193294 - RNA, 32 nt, Human
ggcucaagugauccucccacuucaccuuccug

SEQ ID NO: 193295 - RNA, 24 nt, Human
ggcucaagugauccucccagcuca

SEQ ID NO: 193296 - RNA, 23 nt, Human
ggcucaagugauccucccaucuu

SEQ ID NO: 193297 - RNA, 24 nt, Human
ggcucaagugauccuccccacuca

SEQ ID NO: 193298 - RNA, 19 nt, Human
ggcucaagugauccucccg

SEQ ID NO: 193299 - RNA, 24 nt, Human
ggcucaagugauccucccgccuca

SEQ ID NO: 193300 - RNA, 24 nt, Human
ggcucaagugauccucccgcuuca

SEQ ID NO: 193301 - RNA, 18 nt, Human
ggcucaagugauccuccu

SEQ ID NO: 193302 - RNA, 19 nt, Human
ggcucaagugauccuccua

SEQ ID NO: 193303 - RNA, 24 nt, Human
ggcucaagugauccuccuaccuca

SEQ ID NO: 193304 - RNA, 24 nt, Human
ggcucaagugauccuccuauuuca

SEQ ID NO: 193305 - RNA, 23 nt, Human
ggcucaagugauccuccugccuc

SEQ ID NO: 193306 - RNA, 24 nt, Human
ggcucaagugauccuccugccuca

SEQ ID NO: 193307 - RNA, 32 nt, Human
ggcucaagugauccuccugccugggccugcca

SEQ ID NO: 193308 - RNA, 24 nt, Human
ggcucaagugauccuccugccuua

SEQ ID NO: 193309 - RNA, 24 nt, Human
ggcucaagugauccuccugcuuca

SEQ ID NO: 193310 - RNA, 23 nt, Human
ggcucaagugauccuccugucuc

SEQ ID NO: 193311 - RNA, 18 nt, Human
ggcucaagugauccucuc

SEQ ID NO: 193312 - RNA, 24 nt, Human
ggcucaagugauccucucaccuca

SEQ ID NO: 193313 - RNA, 32 nt, Human
ggcucaagugauccucucacuucagcuccuca

SEQ ID NO: 193314 - RNA, 19 nt, Human
ggcucaagugauccucuua

SEQ ID NO: 193315 - RNA, 23 nt, Human
ggcucaagugauccucuugccuu

SEQ ID NO: 193316 - RNA, 24 nt, Human
ggcucaagugauccuuccaucuca

SEQ ID NO: 193317 - RNA, 24 nt, Human
ggcucaagugauccuucugccuca

SEQ ID NO: 193318 - RNA, 23 nt, Human
ggcucaagugaucucccacuuca

SEQ ID NO: 193319 - RNA, 24 nt, Human
ggcucaagugaucugcccuccuca

SEQ ID NO: 193320 - RNA, 24 nt, Human
ggcucaagugaucuuccugcuuca

SEQ ID NO: 193321 - RNA, 23 nt, Human
ggcucaagugauucaccugccuu

SEQ ID NO: 193322 - RNA, 19 nt, Human
ggcucaagugauucuccca

SEQ ID NO: 193323 - RNA, 24 nt, Human
ggcucaagugauucucccaccuca

SEQ ID NO: 193324 - RNA, 24 nt, Human
ggcucaagugauucuccucccuca

SEQ ID NO: 193325 - RNA, 32 nt, Human
ggcucaagugauucuccucccucagccuccca

SEQ ID NO: 193326 - RNA, 22 nt, Human
ggcucaagugauucuccugccu

SEQ ID NO: 193327 - RNA, 23 nt, Human
ggcucaagugauucuccugcuuc

SEQ ID NO: 193328 - RNA, 19 nt, Human
ggcucaagugauucuucca

SEQ ID NO: 193329 - RNA, 24 nt, Human
ggcucaagugauucuucugccuca

SEQ ID NO: 193330 - RNA, 24 nt, Human
ggcucaagugguccuccugccuca

SEQ ID NO: 193331 - RNA, 24 nt, Human
ggcucaaguguuccuccugccuca

SEQ ID NO: 193332 - RNA, 29 nt, Human
ggcucaauaaagcaagucaaagcacaaaa

SEQ ID NO: 193333 - RNA, 32 nt, Human
ggcucaaugacaccgcuaccucccagggauuc

SEQ ID NO: 193334 - RNA, 21 nt, Human
ggcucaaugagcagccaggua

SEQ ID NO: 193335 - RNA, 23 nt, Human
ggcucaaugauucuccugucuca

SEQ ID NO: 193336 - RNA, 32 nt, Human
ggcucaaugcaaccuccaccucccagguucaa

SEQ ID NO: 193337 - RNA, 23 nt, Human
ggcucaaugcaaccucugccccc

SEQ ID NO: 193338 - RNA, 32 nt, Human
ggcucacaaagggagaggagagaacagggcaa

SEQ ID NO: 193339 - RNA, 20 nt, Human
ggcucacaaaugaggaccag

SEQ ID NO: 193340 - RNA, 22 nt, Human
ggcucacaagcagaaccccacc

SEQ ID NO: 193341 - RNA, 32 nt, Human
ggcucacacaaaacagcugacacugacuaagg

SEQ ID NO: 193342 - RNA, 32 nt, Human
ggcucacacacucucauucacacacacaaauc

SEQ ID NO: 193343 - RNA, 18 nt, Human
ggcucacacaugcaucag

SEQ ID NO: 193344 - RNA, 19 nt, Human
ggcucacacaugcaucagc

SEQ ID NO: 193345 - RNA, 32 nt, Human
ggcucacacaugcaucagcacugcacacugga

SEQ ID NO: 193346 - RNA, 19 nt, Human
ggcucacacauguaauccc

SEQ ID NO: 193347 - RNA, 32 nt, Human
ggcucacacauguuaauuccagcacuuuggga

SEQ ID NO: 193348 - RNA, 32 nt, Human
ggcucacaccaauccaggauucaggcccaccc

SEQ ID NO: 193349 - RNA, 32 nt, Human
ggcucacacccauaaucccagcacuuugggag

SEQ ID NO: 193350 - RNA, 17 nt, Human
ggcucacaccccuccag

SEQ ID NO: 193351 - RNA, 32 nt, Human
ggcucacacccguaaucccagcacuuugcggg

SEQ ID NO: 193352 - RNA, 32 nt, Human
ggcucacacccguaaucccagcacuuugggag

SEQ ID NO: 193353 - RNA, 21 nt, Human
ggcucacaccgguaaucccag

SEQ ID NO: 193354 - RNA, 32 nt, Human
ggcucacaccgguaaucccagcacuuugggag

SEQ ID NO: 193355 - RNA, 19 nt, Human
ggcucacaccuaaucccag

SEQ ID NO: 193356 - RNA, 32 nt, Human
ggcucacaccuaaucccagcacuuugggaggc

SEQ ID NO: 193357 - RNA, 32 nt, Human
ggcucacaccuauaaccccagcacuuugggag

SEQ ID NO: 193358 - RNA, 20 nt, Human
ggcucacaccuauaauccca

SEQ ID NO: 193359 - RNA, 21 nt, Human
ggcucacaccuauaaucccag

SEQ ID NO: 193360 - RNA, 32 nt, Human
ggcucacaccuauaaucccagcacuuuaggag

SEQ ID NO: 193361 - RNA, 28 nt, Human
ggcucacaccuauaaucccagcacuuug

SEQ ID NO: 193362 - RNA, 32 nt, Human
ggcucacaccuauaaucccagcacuuugggaa

SEQ ID NO: 193363 - RNA, 32 nt, Human
ggcucacaccuauaaucccagcacuuugggag

SEQ ID NO: 193364 - RNA, 32 nt, Human
ggcucacaccuauaaucccagcgcuuuggagg

SEQ ID NO: 193365 - RNA, 20 nt, Human
ggcucacaccuauaaucgag

SEQ ID NO: 193366 - RNA, 32 nt, Human
ggcucacaccuauaaucgagcacuuugggagg

SEQ ID NO: 193367 - RNA, 32 nt, Human
ggcucacaccuauaaucucagcacuuugggag

SEQ ID NO: 193368 - RNA, 21 nt, Human
ggcucacaccuauaauuccag

SEQ ID NO: 193369 - RNA, 18 nt, Human
ggcucacaccuauagucc

SEQ ID NO: 193370 - RNA, 20 nt, Human
ggcucacaccuauaguccca

SEQ ID NO: 193371 - RNA, 21 nt, Human
ggcucacaccuaugaucucag

SEQ ID NO: 193372 - RNA, 19 nt, Human
ggcucacaccucauaccag

SEQ ID NO: 193373 - RNA, 18 nt, Human
ggcucacaccuccagucc

SEQ ID NO: 193374 - RNA, 21 nt, Human
ggcucacaccucuaaucccag

SEQ ID NO: 193375 - RNA, 32 nt, Human
ggcucacaccucuaaucccagcacuuugggag

SEQ ID NO: 193376 - RNA, 21 nt, Human
ggcucacaccugaaaucccag

SEQ ID NO: 193377 - RNA, 32 nt, Human
ggcucacaccugaaaucccagcacuuugggag

SEQ ID NO: 193378 - RNA, 21 nt, Human
ggcucacaccugcaaucccag

SEQ ID NO: 193379 - RNA, 32 nt, Human
ggcucacaccugcaaucccagcacuuuggaag

SEQ ID NO: 193380 - RNA, 32 nt, Human
ggcucacaccugcaaucccagcacuuugggag

SEQ ID NO: 193381 - RNA, 32 nt, Human
ggcucacaccugcaaucccaguacuuugagag

SEQ ID NO: 193382 - RNA, 21 nt, Human
ggcucacaccuggaaucccag

SEQ ID NO: 193383 - RNA, 17 nt, Human
ggcucacaccuggccca

SEQ ID NO: 193384 - RNA, 17 nt, Human
ggcucacaccugggccc

SEQ ID NO: 193385 - RNA, 20 nt, Human
ggcucacaccuguaacccca

SEQ ID NO: 193386 - RNA, 21 nt, Human
ggcucacaccuguaaccccag

SEQ ID NO: 193387 - RNA, 32 nt, Human
ggcucacaccuguaaccccagcacuuugggac

SEQ ID NO: 193388 - RNA, 32 nt, Human
ggcucacaccuguaaccccagcacuuugggag

SEQ ID NO: 193389 - RNA, 21 nt, Human
ggcucacaccuguaacccuag

SEQ ID NO: 193390 - RNA, 32 nt, Human
ggcucacaccuguaacccuagcacuuugggag

SEQ ID NO: 193391 - RNA, 32 nt, Human
ggcucacaccuguaauaaucccagcacuuugg

SEQ ID NO: 193392 - RNA, 32 nt, Human
ggcucacaccuguaauaccagcacuuugggaa

SEQ ID NO: 193393 - RNA, 32 nt, Human
ggcucacaccuguaauaccagcaguuugagaa

SEQ ID NO: 193394 - RNA, 32 nt, Human
ggcucacaccuguaaucacagcacuuugggag

SEQ ID NO: 193395 - RNA, 32 nt, Human
ggcucacaccuguaauccaagcacuuugggag

SEQ ID NO: 193396 - RNA, 20 nt, Human
ggcucacaccuguaauccca

SEQ ID NO: 193397 - RNA, 32 nt, Human
ggcucacaccuguaaucccaacacuuugagag

SEQ ID NO: 193398 - RNA, 32 nt, Human
ggcucacaccuguaaucccaacacuuugagcg

SEQ ID NO: 193399 - RNA, 32 nt, Human
ggcucacaccuguaaucccaacacuuuggaag

SEQ ID NO: 193400 - RNA, 32 nt, Human
ggcucacaccuguaaucccaacacuuugggaa

SEQ ID NO: 193401 - RNA, 32 nt, Human
ggcucacaccuguaaucccaacacuuugggac

SEQ ID NO: 193402 - RNA, 32 nt, Human
ggcucacaccuguaaucccaacacuuugggag

SEQ ID NO: 193403 - RNA, 32 nt, Human
ggcucacaccuguaaucccaacacuuugggau

SEQ ID NO: 193404 - RNA, 32 nt, Human
ggcucacaccuguaaucccaacaguuuggaag

SEQ ID NO: 193405 - RNA, 32 nt, Human
ggcucacaccuguaaucccaacauuuugggaa

SEQ ID NO: 193406 - RNA, 32 nt, Human
ggcucacaccuguaaucccaacauuuugggag

SEQ ID NO: 193407 - RNA, 32 nt, Human
ggcucacaccuguaaucccaauacuuugggug

SEQ ID NO: 193408 - RNA, 21 nt, Human
ggcucacaccuguaaucccag

SEQ ID NO: 193409 - RNA, 32 nt, Human
ggcucacaccuguaaucccagaacuuugggag

SEQ ID NO: 193410 - RNA, 22 nt, Human
ggcucacaccuguaaucccagc

SEQ ID NO: 193411 - RNA, 26 nt, Human
ggcucacaccuguaaucccagcacuu

SEQ ID NO: 193412 - RNA, 32 nt, Human
ggcucacaccuguaaucccagcacuuagagag

SEQ ID NO: 193413 - RNA, 32 nt, Human
ggcucacaccuguaaucccagcacuuagggaa

SEQ ID NO: 193414 - RNA, 32 nt, Human
ggcucacaccuguaaucccagcacuuagggag

SEQ ID NO: 193415 - RNA, 32 nt, Human
ggcucacaccuguaaucccagcacuucgggaa

SEQ ID NO: 193416 - RNA, 32 nt, Human
ggcucacaccuguaaucccagcacuugggaag

SEQ ID NO: 193417 - RNA, 32 nt, Human
ggcucacaccuguaaucccagcacuuggggaa

SEQ ID NO: 193418 - RNA, 32 nt, Human
ggcucacaccuguaaucccagcacuuggggag

SEQ ID NO: 193419 - RNA, 32 nt, Human
ggcucacaccuguaaucccagcacuuugagag

SEQ ID NO: 193420 - RNA, 32 nt, Human
ggcucacaccuguaaucccagcacuuugcggg

SEQ ID NO: 193421 - RNA, 32 nt, Human
ggcucacaccuguaaucccagcacuuuggcag

SEQ ID NO: 193422 - RNA, 32 nt, Human
ggcucacaccuguaaucccagcacuuugggaa

SEQ ID NO: 193423 - RNA, 32 nt, Human
ggcucacaccuguaaucccagcacuuugggac

SEQ ID NO: 193424 - RNA, 32 nt, Human
ggcucacaccuguaaucccagcacuuugggag

SEQ ID NO: 193425 - RNA, 32 nt, Human
ggcucacaccuguaaucccagcacuuugggau

SEQ ID NO: 193426 - RNA, 32 nt, Human
ggcucacaccuguaaucccagcacuuugggga

SEQ ID NO: 193427 - RNA, 32 nt, Human
ggcucacaccuguaaucccagcacuuugguag

SEQ ID NO: 193428 - RNA, 32 nt, Human
ggcucacaccuguaaucccagcacuuuuggag

SEQ ID NO: 193429 - RNA, 32 nt, Human
ggcucacaccuguaaucccagcaguuuggaag

SEQ ID NO: 193430 - RNA, 32 nt, Human
ggcucacaccuguaaucccagcaguuugggag

SEQ ID NO: 193431 - RNA, 32 nt, Human
ggcucacaccuguaaucccagcauuuugggaa

SEQ ID NO: 193432 - RNA, 32 nt, Human
ggcucacaccuguaaucccagcauuuugggag

SEQ ID NO: 193433 - RNA, 32 nt, Human
ggcucacaccuguaaucccagcccuuugggag

SEQ ID NO: 193434 - RNA, 32 nt, Human
ggcucacaccuguaaucccagcgcuuugggag

SEQ ID NO: 193435 - RNA, 32 nt, Human
ggcucacaccuguaaucccagcuacucagcag

SEQ ID NO: 193436 - RNA, 32 nt, Human
ggcucacaccuguaaucccagcuacucaggaa

SEQ ID NO: 193437 - RNA, 32 nt, Human
ggcucacaccuguaaucccagcuacuugggag

SEQ ID NO: 193438 - RNA, 32 nt, Human
ggcucacaccuguaaucccagcucuuuggagg

SEQ ID NO: 193439 - RNA, 32 nt, Human
ggcucacaccuguaaucccagcucuuugggag

SEQ ID NO: 193440 - RNA, 32 nt, Human
ggcucacaccuguaaucccaggacuuugggag

SEQ ID NO: 193441 - RNA, 32 nt, Human
ggcucacaccuguaaucccaguacuuugagac

SEQ ID NO: 193442 - RNA, 32 nt, Human
ggcucacaccuguaaucccaguacuuugggag

SEQ ID NO: 193443 - RNA, 32 nt, Human
ggcucacaccuguaaucccagugcuuugggag

SEQ ID NO: 193444 - RNA, 22 nt, Human
ggcucacaccuguaauccccag

SEQ ID NO: 193445 - RNA, 32 nt, Human
ggcucacaccuguaauccccagcacuuuggga

SEQ ID NO: 193446 - RNA, 21 nt, Human
ggcucacaccuguaaucccgg

SEQ ID NO: 193447 - RNA, 32 nt, Human
ggcucacaccuguaaucccugcacuuugggag

SEQ ID NO: 193448 - RNA, 20 nt, Human
ggcucacaccuguaauccua

SEQ ID NO: 193449 - RNA, 32 nt, Human
ggcucacaccuguaauccuaacacuuugggag

SEQ ID NO: 193450 - RNA, 32 nt, Human
ggcucacaccuguaauccuagcacuuugggag

SEQ ID NO: 193451 - RNA, 32 nt, Human
ggcucacaccuguaauccuagcgcuuugggag

SEQ ID NO: 193452 - RNA, 32 nt, Human
ggcucacaccuguaauccugcacuuugggagu

SEQ ID NO: 193453 - RNA, 32 nt, Human
ggcucacaccuguaauccuugcauuuuggaag

SEQ ID NO: 193454 - RNA, 20 nt, Human
ggcucacaccuguaaucuca

SEQ ID NO: 193455 - RNA, 32 nt, Human
ggcucacaccuguaaucucaacacuuugggag

SEQ ID NO: 193456 - RNA, 32 nt, Human
ggcucacaccuguaaucucaacgcuuugggag

SEQ ID NO: 193457 - RNA, 21 nt, Human
ggcucacaccuguaaucucag

SEQ ID NO: 193458 - RNA, 32 nt, Human
ggcucacaccuguaaucucagcacuuugggaa

SEQ ID NO: 193459 - RNA, 32 nt, Human
ggcucacaccuguaaucucagcacuuugggag

SEQ ID NO: 193460 - RNA, 32 nt, Human
ggcucacaccuguaaucucagcauuuugggag

SEQ ID NO: 193461 - RNA, 26 nt, Human
ggcucacaccuguaaucucagccucc

SEQ ID NO: 193462 - RNA, 32 nt, Human
ggcucacaccuguaaucucagccucccagacg

SEQ ID NO: 193463 - RNA, 32 nt, Human
ggcucacaccuguaaucucggcacuuuggggg

SEQ ID NO: 193464 - RNA, 32 nt, Human
ggcucacaccuguaaugccagcacuuugggca

SEQ ID NO: 193465 - RNA, 32 nt, Human
ggcucacaccuguaaugccagcccuuugggag

SEQ ID NO: 193466 - RNA, 20 nt, Human
ggcucacaccuguaauucca

SEQ ID NO: 193467 - RNA, 32 nt, Human
ggcucacaccuguaauuccaacacuuugggag

SEQ ID NO: 193468 - RNA, 21 nt, Human
ggcucacaccuguaauuccag

SEQ ID NO: 193469 - RNA, 32 nt, Human
ggcucacaccuguaauuccagcacuuugggag

SEQ ID NO: 193470 - RNA, 32 nt, Human
ggcucacaccuguaauuccagcacuuugugag

SEQ ID NO: 193471 - RNA, 32 nt, Human
ggcucacaccuguaauucuagcacuuugggag

SEQ ID NO: 193472 - RNA, 21 nt, Human
ggcucacaccuguaauuucag

SEQ ID NO: 193473 - RNA, 21 nt, Human
ggcucacaccuguacucccag

SEQ ID NO: 193474 - RNA, 18 nt, Human
ggcucacaccuguagucc

SEQ ID NO: 193475 - RNA, 20 nt, Human
ggcucacaccuguaguccca

SEQ ID NO: 193476 - RNA, 32 nt, Human
ggcucacaccuguagucccagcacuuuaggag

SEQ ID NO: 193477 - RNA, 32 nt, Human
ggcucacaccuguaucccagcacuuugggagg

SEQ ID NO: 193478 - RNA, 21 nt, Human
ggcucacaccuguauucccag

SEQ ID NO: 193479 - RNA, 32 nt, Human
ggcucacaccuguauucccagcacuuugggag

SEQ ID NO: 193480 - RNA, 19 nt, Human
ggcucacaccugucauccc

SEQ ID NO: 193481 - RNA, 21 nt, Human
ggcucacaccugucaucccag

SEQ ID NO: 193482 - RNA, 32 nt, Human
ggcucacaccugucaucccagcacuuugggag

SEQ ID NO: 193483 - RNA, 32 nt, Human
ggcucacaccugucaucccagcaguuugggag

SEQ ID NO: 193484 - RNA, 32 nt, Human
ggcucacaccugucauuccagcacuuugagag

SEQ ID NO: 193485 - RNA, 21 nt, Human
ggcucacaccugugaucccag

SEQ ID NO: 193486 - RNA, 32 nt, Human
ggcucacaccugugaucccagcacuuugggag

SEQ ID NO: 193487 - RNA, 21 nt, Human
ggcucacaccugugaucucag

SEQ ID NO: 193488 - RNA, 32 nt, Human
ggcucacaccugugcucccagcacuuugggag

SEQ ID NO: 193489 - RNA, 17 nt, Human
ggcucacaccuguguuc

SEQ ID NO: 193490 - RNA, 21 nt, Human
ggcucacaccuguuaucccag

SEQ ID NO: 193491 - RNA, 20 nt, Human
ggcucacaccuuaaucccag

SEQ ID NO: 193492 - RNA, 32 nt, Human
ggcucacaccuuaaucccagcacuuugggagg

SEQ ID NO: 193493 - RNA, 20 nt, Human
ggcucacaccuuaaucucag

SEQ ID NO: 193494 - RNA, 22 nt, Human
ggcucacaccuuguaaucccag

SEQ ID NO: 193495 - RNA, 18 nt, Human
ggcucacaccuuuaaucc

SEQ ID NO: 193496 - RNA, 21 nt, Human
ggcucacaccuuuaaucccag

SEQ ID NO: 193497 - RNA, 32 nt, Human
ggcucacaccuuuaaucccagcacuuugggaa

SEQ ID NO: 193498 - RNA, 32 nt, Human
ggcucacaccuuuaaucccagcacuuugggag

SEQ ID NO: 193499 - RNA, 32 nt, Human
ggcucacacggggagccaccaggcuggacugg

SEQ ID NO: 193500 - RNA, 18 nt, Human
ggcucacacgguggugca

SEQ ID NO: 193501 - RNA, 19 nt, Human
ggcucacacgugccauccc

SEQ ID NO: 193502 - RNA, 32 nt, Human
ggcucacacguguaaucccaacacuuugggag

SEQ ID NO: 193503 - RNA, 32 nt, Human
ggcucacacucaggcugggcugggcgcugaug

SEQ ID NO: 193504 - RNA, 18 nt, Human
ggcucacacucuugccca

SEQ ID NO: 193505 - RNA, 32 nt, Human
ggcucacacuguaaucccagcacuuugggagg

SEQ ID NO: 193506 - RNA, 32 nt, Human
ggcucacacuguaaugccagcacuuugggagg

SEQ ID NO: 193507 - RNA, 18 nt, Human
ggcucacacugugcucag

SEQ ID NO: 193508 - RNA, 21 nt, Human
ggcucacacuuauaaucccag

SEQ ID NO: 193509 - RNA, 32 nt, Human
ggcucacacuuauaaucccagcacuuugggag

SEQ ID NO: 193510 - RNA, 21 nt, Human
ggcucacacuuaucaucucag

SEQ ID NO: 193511 - RNA, 32 nt, Human
ggcucacacuuguaaucauagcacuuugggag

SEQ ID NO: 193512 - RNA, 32 nt, Human
ggcucacacuuguaaucccaacacuuuggaag

SEQ ID NO: 193513 - RNA, 21 nt, Human
ggcucacacuuguaaucccag

SEQ ID NO: 193514 - RNA, 32 nt, Human
ggcucacacuuguaaucccagcacuuugaggu

SEQ ID NO: 193515 - RNA, 32 nt, Human
ggcucacacuuguaaucccagcacuuugggaa

SEQ ID NO: 193516 - RNA, 32 nt, Human
ggcucacacuuguaaucccagcacuuugggag

SEQ ID NO: 193517 - RNA, 32 nt, Human
ggcucacacuuguaaucccagcacuuugggau

SEQ ID NO: 193518 - RNA, 32 nt, Human
ggcucacacuuguaaucccagcauuuugggag

SEQ ID NO: 193519 - RNA, 32 nt, Human
ggcucacacuuguaauccuaguacuuugggag

SEQ ID NO: 193520 - RNA, 32 nt, Human
ggcucacagaaaccuccgccucccagguucaa

SEQ ID NO: 193521 - RNA, 32 nt, Human
ggcucacagaaguucugacaauaaaagauacu

SEQ ID NO: 193522 - RNA, 20 nt, Human
ggcucacagaccaccccacc

SEQ ID NO: 193523 - RNA, 24 nt, Human
ggcucacagcaaccucuaccuccu

SEQ ID NO: 193524 - RNA, 32 nt, Human
ggcucacagcaaccucuaccuccuggguucaa

SEQ ID NO: 193525 - RNA, 32 nt, Human
ggcucacagcaaccucucugccuccagaaaug

SEQ ID NO: 193526 - RNA, 23 nt, Human
ggcucacagcaaccucugccucc

SEQ ID NO: 193527 - RNA, 32 nt, Human
ggcucacagcaaccucugccucccggauuuaa

SEQ ID NO: 193528 - RNA, 32 nt, Human
ggcucacagcaccccucuauuucuuucugggc

SEQ ID NO: 193529 - RNA, 32 nt, Human
ggcucacagcagccucugccucccggguucaa

SEQ ID NO: 193530 - RNA, 21 nt, Human
ggcucacagcuauaaucucag

SEQ ID NO: 193531 - RNA, 32 nt, Human
ggcucacagcuauaaucucagcacuuugggag

SEQ ID NO: 193532 - RNA, 32 nt, Human
ggcucacaggaaccuccgccucccagguucaa

SEQ ID NO: 193533 - RNA, 19 nt, Human
ggcucacaggaggauccag

SEQ ID NO: 193534 - RNA, 19 nt, Human
ggcucacagguggggucca

SEQ ID NO: 193535 - RNA, 22 nt, Human
ggcucacaguccagccaccagc

SEQ ID NO: 193536 - RNA, 32 nt, Human
ggcucacagugcaaccucugcuucccagguuc

SEQ ID NO: 193537 - RNA, 19 nt, Human
ggcucacagugggaaccag

SEQ ID NO: 193538 - RNA, 18 nt, Human
ggcucacaguggggccag

SEQ ID NO: 193539 - RNA, 32 nt, Human
ggcucacagugugggagcagcuggacaccagg

SEQ ID NO: 193540 - RNA, 32 nt, Human
ggcucacaguucuggaaccugggaaauccaaa

SEQ ID NO: 193541 - RNA, 20 nt, Human
ggcucacauagccaguguga

SEQ ID NO: 193542 - RNA, 16 nt, Human
ggcucacaucauccag

SEQ ID NO: 193543 - RNA, 21 nt, Human
ggcucacaucuguaaccccag

SEQ ID NO: 193544 - RNA, 32 nt, Human
ggcucacaucuguaaccccagcacuuugggag

SEQ ID NO: 193545 - RNA, 21 nt, Human
ggcucacaucuguaaucccag

SEQ ID NO: 193546 - RNA, 32 nt, Human
ggcucacaucuguaaucccagcacuuuggaag

SEQ ID NO: 193547 - RNA, 32 nt, Human
ggcucacaucuguaaucccagcacuuugggag

SEQ ID NO: 193548 - RNA, 32 nt, Human
ggcucacaucuguaaucccagcacuuuuggag

SEQ ID NO: 193549 - RNA, 32 nt, Human
ggcucacaucuguaaucucaacacuuugggag

SEQ ID NO: 193550 - RNA, 21 nt, Human
ggcucacaucuguaaucucag

SEQ ID NO: 193551 - RNA, 32 nt, Human
ggcucacaucuguaaucucagcauuuugggag

SEQ ID NO: 193552 - RNA, 21 nt, Human
ggcucacaucuguaaugccag

SEQ ID NO: 193553 - RNA, 32 nt, Human
ggcucacaucuguaaugccagcacuuugggag

SEQ ID NO: 193554 - RNA, 17 nt, Human
ggcucacaugggcccag

SEQ ID NO: 193555 - RNA, 18 nt, Human
ggcucacauuugccccag

SEQ ID NO: 193556 - RNA, 32 nt, Human
ggcucaccacaacauccgccuccuggguucaa

SEQ ID NO: 193557 - RNA, 32 nt, Human
ggcucaccacaaccuccaccucccagguucaa

SEQ ID NO: 193558 - RNA, 32 nt, Human
ggcucaccacaaccuccgccucccggauucaa

SEQ ID NO: 193559 - RNA, 32 nt, Human
ggcucaccacaaccuccgccuccuggguucau

SEQ ID NO: 193560 - RNA, 32 nt, Human
ggcucaccacaaccuccuccucuuggguucaa

SEQ ID NO: 193561 - RNA, 32 nt, Human
ggcucaccacaaccucuaccuccaggguucaa

SEQ ID NO: 193562 - RNA, 32 nt, Human
ggcucaccacaaccucugccuacuggguucca

SEQ ID NO: 193563 - RNA, 32 nt, Human
ggcucaccacaaccucugccucccggguucaa

SEQ ID NO: 193564 - RNA, 32 nt, Human
ggcucaccacaaccucugccuccuggguucaa

SEQ ID NO: 193565 - RNA, 32 nt, Human
ggcucaccacucccaggccucugacaugaggg

SEQ ID NO: 193566 - RNA, 32 nt, Human
ggcucaccagcccugccaucuuugucacagcc

SEQ ID NO: 193567 - RNA, 32 nt, Human
ggcucaccauaaccuccgccucccagguucaa

SEQ ID NO: 193568 - RNA, 32 nt, Human
ggcucacccagagcagcugggucuccaggcug

SEQ ID NO: 193569 - RNA, 32 nt, Human
ggcucacccaggcucugcucaggcugggaggc

SEQ ID NO: 193570 - RNA, 32 nt, Human
ggcucacccaggcuggggucugagugucacug

SEQ ID NO: 193571 - RNA, 18 nt, Human
ggcucacccaguccugcc

SEQ ID NO: 193572 - RNA, 32 nt, Human
ggcucaccccaaccuccgccuccuggguucag

SEQ ID NO: 193573 - RNA, 32 nt, Human
ggcucaccccucucccccgcccaaggcugcag

SEQ ID NO: 193574 - RNA, 21 nt, Human
ggcucaccccuguaauuccag

SEQ ID NO: 193575 - RNA, 32 nt, Human
ggcucacccuccaccugcauccccaccccacu

SEQ ID NO: 193576 - RNA, 19 nt, Human
ggcucacccucugccugcc

SEQ ID NO: 193577 - RNA, 32 nt, Human
ggcucacccugagagcagaggccgugcagggg

SEQ ID NO: 193578 - RNA, 32 nt, Human
ggcucaccgaaagcucacagauugcagaaauu

SEQ ID NO: 193579 - RNA, 28 nt, Human
ggcucaccgagaccagccucaucucggg

SEQ ID NO: 193580 - RNA, 32 nt, Human
ggcucaccgcaaaguccgccucccaggcgauu

SEQ ID NO: 193581 - RNA, 24 nt, Human
ggcucaccgcaaccuccaccuccu

SEQ ID NO: 193582 - RNA, 32 nt, Human
ggcucaccgcaaccuccaccuccugaguucca

SEQ ID NO: 193583 - RNA, 23 nt, Human
ggcucaccgcaaccuccaccuuc

SEQ ID NO: 193584 - RNA, 32 nt, Human
ggcucaccgcaaccuccaccuuccugguucaa

SEQ ID NO: 193585 - RNA, 24 nt, Human
ggcucaccgcaaccuccgcccccu

SEQ ID NO: 193586 - RNA, 32 nt, Human
ggcucaccgcaaccuccgcccccuggguucaa

SEQ ID NO: 193587 - RNA, 23 nt, Human
ggcucaccgcaaccuccgccucc

SEQ ID NO: 193588 - RNA, 32 nt, Human
ggcucaccgcaaccuccgccucccagguucaa

SEQ ID NO: 193589 - RNA, 32 nt, Human
ggcucaccgcaaccuccgccucccggauucaa

SEQ ID NO: 193590 - RNA, 32 nt, Human
ggcucaccgcaaccuccgccucccggguucaa

SEQ ID NO: 193591 - RNA, 24 nt, Human
ggcucaccgcaaccuccgccuccu

SEQ ID NO: 193592 - RNA, 32 nt, Human
ggcucaccgcaaccuccgccuccuagguccag

SEQ ID NO: 193593 - RNA, 32 nt, Human
ggcucaccgcaaccuccgccuccuggguucaa

SEQ ID NO: 193594 - RNA, 23 nt, Human
ggcucaccgcaaccuccuccucc

SEQ ID NO: 193595 - RNA, 23 nt, Human
ggcucaccgcaaccuccucuucu

SEQ ID NO: 193596 - RNA, 32 nt, Human
ggcucaccgcaaccuccucuucuggguuaaag

SEQ ID NO: 193597 - RNA, 24 nt, Human
ggcucaccgcaaccucugccuacc

SEQ ID NO: 193598 - RNA, 32 nt, Human
ggcucaccgcaaccucugccuaccggguucaa

SEQ ID NO: 193599 - RNA, 23 nt, Human
ggcucaccgcaaccucugccucc

SEQ ID NO: 193600 - RNA, 32 nt, Human
ggcucaccgcaaccucugccucccaggugcaa

SEQ ID NO: 193601 - RNA, 32 nt, Human
ggcucaccgcaaccucugccucccggguucaa

SEQ ID NO: 193602 - RNA, 32 nt, Human
ggcucaccgcaaccucugccucccugguucaa

SEQ ID NO: 193603 - RNA, 24 nt, Human
ggcucaccgcaaccucugccuccu

SEQ ID NO: 193604 - RNA, 32 nt, Human
ggcucaccgcaaccucugccuccuggguucaa

SEQ ID NO: 193605 - RNA, 24 nt, Human
ggcucaccgcaaccucugcuuccu

SEQ ID NO: 193606 - RNA, 32 nt, Human
ggcucaccgcaaccucugcuuccuggcuuaaa

SEQ ID NO: 193607 - RNA, 23 nt, Human
ggcucaccgcaaccuuccucucc

SEQ ID NO: 193608 - RNA, 32 nt, Human
ggcucaccgcaagcuccgccucccggguucac

SEQ ID NO: 193609 - RNA, 32 nt, Human
ggcucaccgcaagcuccgccucccggguucag

SEQ ID NO: 193610 - RNA, 32 nt, Human
ggcucaccgcaagcuccgcuucccaggcuggg

SEQ ID NO: 193611 - RNA, 32 nt, Human
ggcucaccgcagccuccaccuccaggguucaa

SEQ ID NO: 193612 - RNA, 24 nt, Human
ggcucaccgcagccuccgccuccu

SEQ ID NO: 193613 - RNA, 32 nt, Human
ggcucaccgcagccuccgccuccuggggucag

SEQ ID NO: 193614 - RNA, 21 nt, Human
ggcucaccgcauugaccuccu

SEQ ID NO: 193615 - RNA, 32 nt, Human
ggcucaccgggacccguucugcuaggaagaag

SEQ ID NO: 193616 - RNA, 23 nt, Human
ggcucaccguaaucuccgccucc

SEQ ID NO: 193617 - RNA, 32 nt, Human
ggcucaccguaaucuccgccucccaggcucaa

SEQ ID NO: 193618 - RNA, 32 nt, Human
ggcucaccucaaccucugccucccagguucag

SEQ ID NO: 193619 - RNA, 32 nt, Human
ggcucaccucuguaaucccagcacuuugggag

SEQ ID NO: 193620 - RNA, 32 nt, Human
ggcucaccugaagucugagauuuugggagcuu

SEQ ID NO: 193621 - RNA, 32 nt, Human
ggcucaccuguaaucccaacacuuugggaggc

SEQ ID NO: 193622 - RNA, 32 nt, Human
ggcucaccuguaaucccagcacuuugggaggc

SEQ ID NO: 193623 - RNA, 23 nt, Human
ggcucaccuguuacucggccucc

SEQ ID NO: 193624 - RNA, 32 nt, Human
ggcucaccuguuacucggccucccagaaagau

SEQ ID NO: 193625 - RNA, 32 nt, Human
ggcucacgacaaccucugccucucggauucaa

SEQ ID NO: 193626 - RNA, 32 nt, Human
ggcucacgaggagaucaagaccauccuggcua

SEQ ID NO: 193627 - RNA, 19 nt, Human
ggcucacgaguuaguccag

SEQ ID NO: 193628 - RNA, 23 nt, Human
ggcucacgcagacgccggccaca

SEQ ID NO: 193629 - RNA, 32 nt, Human
ggcucacgcauguaaucccagcacuuugggag

SEQ ID NO: 193630 - RNA, 32 nt, Human
ggcucacgcauguaaucccugcacuuugggag

SEQ ID NO: 193631 - RNA, 32 nt, Human
ggcucacgcauguaauccuaacacuuugggag

SEQ ID NO: 193632 - RNA, 32 nt, Human
ggcucacgccaggaaucccagcacuuugggag

SEQ ID NO: 193633 - RNA, 32 nt, Human
ggcucacgccaguaaucccagcacuuuggagg

SEQ ID NO: 193634 - RNA, 32 nt, Human
ggcucacgccaguaaucccagcacuuugggag

SEQ ID NO: 193635 - RNA, 24 nt, Human
ggcucacgccauucuccugccuca

SEQ ID NO: 193636 - RNA, 20 nt, Human
ggcucacgcccauaauccag

SEQ ID NO: 193637 - RNA, 32 nt, Human
ggcucacgcccauaauccagcacuuugggaag

SEQ ID NO: 193638 - RNA, 32 nt, Human
ggcucacgcccauaaucccagcacuuugggag

SEQ ID NO: 193639 - RNA, 32 nt, Human
ggcucacgcccguaaucccagggcuuugggag

SEQ ID NO: 193640 - RNA, 21 nt, Human
ggcucacgccgguaaucccag

SEQ ID NO: 193641 - RNA, 32 nt, Human
ggcucacgccgguaaucccagcacuuugggag

SEQ ID NO: 193642 - RNA, 32 nt, Human
ggcucacgccuauaauccaagcacuuugggag

SEQ ID NO: 193643 - RNA, 20 nt, Human
ggcucacgccuauaauccca

SEQ ID NO: 193644 - RNA, 32 nt, Human
ggcucacgccuauaaucccaacacuuugagag

SEQ ID NO: 193645 - RNA, 21 nt, Human
ggcucacgccuauaaucccag

SEQ ID NO: 193646 - RNA, 32 nt, Human
ggcucacgccuauaaucccagcacuuagggag

SEQ ID NO: 193647 - RNA, 32 nt, Human
ggcucacgccuauaaucccagcacuuccagag

SEQ ID NO: 193648 - RNA, 32 nt, Human
ggcucacgccuauaaucccagcacuuuaggag

SEQ ID NO: 193649 - RNA, 32 nt, Human
ggcucacgccuauaaucccagcacuuugcgag

SEQ ID NO: 193650 - RNA, 32 nt, Human
ggcucacgccuauaaucccagcacuuugggag

SEQ ID NO: 193651 - RNA, 32 nt, Human
ggcucacgccuauaaucccagcaguuugggag

SEQ ID NO: 193652 - RNA, 20 nt, Human
ggcucacgccuauaaucuca

SEQ ID NO: 193653 - RNA, 21 nt, Human
ggcucacgccuauaauuccag

SEQ ID NO: 193654 - RNA, 21 nt, Human
ggcucacgccuauacacccag

SEQ ID NO: 193655 - RNA, 32 nt, Human
ggcucacgccuauacacccagcacuuuggaag

SEQ ID NO: 193656 - RNA, 32 nt, Human
ggcucacgccuauaucccagcacuuugggagg

SEQ ID NO: 193657 - RNA, 20 nt, Human
ggcucacgccuaugauccca

SEQ ID NO: 193658 - RNA, 21 nt, Human
ggcucacgccuaugaucccag

SEQ ID NO: 193659 - RNA, 32 nt, Human
ggcucacgccuaugaucccagcacuuugggag

SEQ ID NO: 193660 - RNA, 32 nt, Human
ggcucacgccuauuaucuuagcacuuugggag

SEQ ID NO: 193661 - RNA, 32 nt, Human
ggcucacgccuccccuucagcuucucuucacg

SEQ ID NO: 193662 - RNA, 21 nt, Human
ggcucacgccucuaaucccag

SEQ ID NO: 193663 - RNA, 32 nt, Human
ggcucacgccucuaaucccagcacuuugggag

SEQ ID NO: 193664 - RNA, 32 nt, Human
ggcucacgccucuaaucccaggacuuugggag

SEQ ID NO: 193665 - RNA, 32 nt, Human
ggcucacgccucuaaucgcagcacuuugggag

SEQ ID NO: 193666 - RNA, 32 nt, Human
ggcucacgccucuaaucucagcacuuugggag

SEQ ID NO: 193667 - RNA, 32 nt, Human
ggcucacgccugaaaucccagcacuuugggag

SEQ ID NO: 193668 - RNA, 21 nt, Human
ggcucacgccugcaaucccag

SEQ ID NO: 193669 - RNA, 32 nt, Human
ggcucacgccugcaaucccagagcuuugggaa

SEQ ID NO: 193670 - RNA, 32 nt, Human
ggcucacgccugcaaucccagcacuuugggag

SEQ ID NO: 193671 - RNA, 32 nt, Human
ggcucacgccugcaaucccagcgcuuugggag

SEQ ID NO: 193672 - RNA, 32 nt, Human
ggcucacgccugcaaugccagcacuuugagag

SEQ ID NO: 193673 - RNA, 18 nt, Human
ggcucacgccugcagucc

SEQ ID NO: 193674 - RNA, 32 nt, Human
ggcucacgccugcagucccagcacuuugggag

SEQ ID NO: 193675 - RNA, 32 nt, Human
ggcucacgccuggaaucccagcacuugaggcc

SEQ ID NO: 193676 - RNA, 32 nt, Human
ggcucacgccuggaaucccagcacuuugggaa

SEQ ID NO: 193677 - RNA, 32 nt, Human
ggcucacgccuggaaucccagcacuuugggag

SEQ ID NO: 193678 - RNA, 32 nt, Human
ggcucacgccuguaaacccagcacuuuaggag

SEQ ID NO: 193679 - RNA, 32 nt, Human
ggcucacgccuguaaccccaacacuuugggag

SEQ ID NO: 193680 - RNA, 21 nt, Human
ggcucacgccuguaaccccag

SEQ ID NO: 193681 - RNA, 32 nt, Human
ggcucacgccuguaaccccagcacuuugggag

SEQ ID NO: 193682 - RNA, 32 nt, Human
ggcucacgccuguaaccccaucacuuugggag

SEQ ID NO: 193683 - RNA, 32 nt, Human
ggcucacgccuguaacccuagcacuuugggag

SEQ ID NO: 193684 - RNA, 32 nt, Human
ggcucacgccuguaaccucagcacuuugggag

SEQ ID NO: 193685 - RNA, 32 nt, Human
ggcucacgccuguaacuccagcacuuugggag

SEQ ID NO: 193686 - RNA, 32 nt, Human
ggcucacgccuguaauaucaacacuuugggac

SEQ ID NO: 193687 - RNA, 32 nt, Human
ggcucacgccuguaaucacaacacuuugggag

SEQ ID NO: 193688 - RNA, 32 nt, Human
ggcucacgccuguaaucacacuuucggaggcc

SEQ ID NO: 193689 - RNA, 32 nt, Human
ggcucacgccuguaaucacagcacuuugggag

SEQ ID NO: 193690 - RNA, 19 nt, Human
ggcucacgccuguaaucca

SEQ ID NO: 193691 - RNA, 32 nt, Human
ggcucacgccuguaauccaacacuuugagagg

SEQ ID NO: 193692 - RNA, 32 nt, Human
ggcucacgccuguaauccaagcacuuggggag

SEQ ID NO: 193693 - RNA, 20 nt, Human
ggcucacgccuguaauccag

SEQ ID NO: 193694 - RNA, 32 nt, Human
ggcucacgccuguaauccagcacuuugggaga

SEQ ID NO: 193695 - RNA, 32 nt, Human
ggcucacgccuguaauccagcacuuugggagg

SEQ ID NO: 193696 - RNA, 20 nt, Human
ggcucacgccuguaauccca

SEQ ID NO: 193697 - RNA, 32 nt, Human
ggcucacgccuguaaucccaacaacacuuugg

SEQ ID NO: 193698 - RNA, 32 nt, Human
ggcucacgccuguaaucccaacacuuuaggag

SEQ ID NO: 193699 - RNA, 32 nt, Human
ggcucacgccuguaaucccaacacuuugggag

SEQ ID NO: 193700 - RNA, 32 nt, Human
ggcucacgccuguaaucccaacacuuuucgag

SEQ ID NO: 193701 - RNA, 32 nt, Human
ggcucacgccuguaaucccaacauuuugggag

SEQ ID NO: 193702 - RNA, 32 nt, Human
ggcucacgccuguaaucccaccacuuuggaaa

SEQ ID NO: 193703 - RNA, 32 nt, Human
ggcucacgccuguaaucccaccacuuugggag

SEQ ID NO: 193704 - RNA, 21 nt, Human
ggcucacgccuguaaucccag

SEQ ID NO: 193705 - RNA, 32 nt, Human
ggcucacgccuguaaucccagaacuuugagag

SEQ ID NO: 193706 - RNA, 32 nt, Human
ggcucacgccuguaaucccagaacuuugggaa

SEQ ID NO: 193707 - RNA, 32 nt, Human
ggcucacgccuguaaucccagaacuuugggag

SEQ ID NO: 193708 - RNA, 32 nt, Human
ggcucacgccuguaaucccagacuuugggagg

SEQ ID NO: 193709 - RNA, 22 nt, Human
ggcucacgccuguaaucccagc

SEQ ID NO: 193710 - RNA, 32 nt, Human
ggcucacgccuguaaucccagcaaguugggag

SEQ ID NO: 193711 - RNA, 32 nt, Human
ggcucacgccuguaaucccagcacuaggaggc

SEQ ID NO: 193712 - RNA, 32 nt, Human
ggcucacgccuguaaucccagcacucugggag

SEQ ID NO: 193713 - RNA, 32 nt, Human
ggcucacgccuguaaucccagcacugagaggc

SEQ ID NO: 193714 - RNA, 32 nt, Human
ggcucacgccuguaaucccagcacuggaaggc

SEQ ID NO: 193715 - RNA, 32 nt, Human
ggcucacgccuguaaucccagcacugggaggc

SEQ ID NO: 193716 - RNA, 32 nt, Human
ggcucacgccuguaaucccagcacugugagag

SEQ ID NO: 193717 - RNA, 32 nt, Human
ggcucacgccuguaaucccagcacugugggag

SEQ ID NO: 193718 - RNA, 32 nt, Human
ggcucacgccuguaaucccagcacuuagggug

SEQ ID NO: 193719 - RNA, 32 nt, Human
ggcucacgccuguaaucccagcacuucggggg

SEQ ID NO: 193720 - RNA, 32 nt, Human
ggcucacgccuguaaucccagcacuugggagg

SEQ ID NO: 193721 - RNA, 32 nt, Human
ggcucacgccuguaaucccagcacuuggggag

SEQ ID NO: 193722 - RNA, 32 nt, Human
ggcucacgccuguaaucccagcacuuuaagag

SEQ ID NO: 193723 - RNA, 32 nt, Human
ggcucacgccuguaaucccagcacuuuaggag

SEQ ID NO: 193724 - RNA, 32 nt, Human
ggcucacgccuguaaucccagcacuuucggag

SEQ ID NO: 193725 - RNA, 32 nt, Human
ggcucacgccuguaaucccagcacuuugagaa

SEQ ID NO: 193726 - RNA, 32 nt, Human
ggcucacgccuguaaucccagcacuuugagag

SEQ ID NO: 193727 - RNA, 32 nt, Human
ggcucacgccuguaaucccagcacuuugagau

SEQ ID NO: 193728 - RNA, 32 nt, Human
ggcucacgccuguaaucccagcacuuugcgau

SEQ ID NO: 193729 - RNA, 32 nt, Human
ggcucacgccuguaaucccagcacuuugcggg

SEQ ID NO: 193730 - RNA, 32 nt, Human
ggcucacgccuguaaucccagcacuuuggaag

SEQ ID NO: 193731 - RNA, 32 nt, Human
ggcucacgccuguaaucccagcacuuuggagg

SEQ ID NO: 193732 - RNA, 32 nt, Human
ggcucacgccuguaaucccagcacuuuggcag

SEQ ID NO: 193733 - RNA, 32 nt, Human
ggcucacgccuguaaucccagcacuuugggaa

SEQ ID NO: 193734 - RNA, 32 nt, Human
ggcucacgccuguaaucccagcacuuugggac

SEQ ID NO: 193735 - RNA, 32 nt, Human
ggcucacgccuguaaucccagcacuuugggag

SEQ ID NO: 193736 - RNA, 32 nt, Human
ggcucacgccuguaaucccagcacuuuggggg

SEQ ID NO: 193737 - RNA, 32 nt, Human
ggcucacgccuguaaucccagcacuuugguag

SEQ ID NO: 193738 - RNA, 32 nt, Human
ggcucacgccuguaaucccagcacuuugguug

SEQ ID NO: 193739 - RNA, 32 nt, Human
ggcucacgccuguaaucccagcacuuuguggg

SEQ ID NO: 193740 - RNA, 32 nt, Human
ggcucacgccuguaaucccagcacuuuuggag

SEQ ID NO: 193741 - RNA, 32 nt, Human
ggcucacgccuguaaucccagcacuuuuggga

SEQ ID NO: 193742 - RNA, 32 nt, Human
ggcucacgccuguaaucccagcaguuugggaa

SEQ ID NO: 193743 - RNA, 32 nt, Human
ggcucacgccuguaaucccagcaguuugggag

SEQ ID NO: 193744 - RNA, 32 nt, Human
ggcucacgccuguaaucccagcauuugggagg

SEQ ID NO: 193745 - RNA, 32 nt, Human
ggcucacgccuguaaucccagcauuuugggag

SEQ ID NO: 193746 - RNA, 32 nt, Human
ggcucacgccuguaaucccagcccuuugggag

SEQ ID NO: 193747 - RNA, 32 nt, Human
ggcucacgccuguaaucccagcgcuuugggag

SEQ ID NO: 193748 - RNA, 32 nt, Human
ggcucacgccuguaaucccagcuacucaggag

SEQ ID NO: 193749 - RNA, 32 nt, Human
ggcucacgccuguaaucccagcucuuugggag

SEQ ID NO: 193750 - RNA, 32 nt, Human
ggcucacgccuguaaucccagcucuuuguggg

SEQ ID NO: 193751 - RNA, 32 nt, Human
ggcucacgccuguaaucccaggacuuuaggag

SEQ ID NO: 193752 - RNA, 32 nt, Human
ggcucacgccuguaaucccaggacuuugggag

SEQ ID NO: 193753 - RNA, 32 nt, Human
ggcucacgccuguaaucccaguacuugggagg

SEQ ID NO: 193754 - RNA, 32 nt, Human
ggcucacgccuguaaucccaguacuuugggag

SEQ ID NO: 193755 - RNA, 32 nt, Human
ggcucacgccuguaaucccaguaguuugggag

SEQ ID NO: 193756 - RNA, 32 nt, Human
ggcucacgccuguaaucccaguauuuugggag

SEQ ID NO: 193757 - RNA, 32 nt, Human
ggcucacgccuguaauccccgcacuuugggag

SEQ ID NO: 193758 - RNA, 32 nt, Human
ggcucacgccuguaaucccggcacuuugggag

SEQ ID NO: 193759 - RNA, 32 nt, Human
ggcucacgccuguaaucccggcaguuugggag

SEQ ID NO: 193760 - RNA, 32 nt, Human
ggcucacgccuguaaucccgguauuuugggag

SEQ ID NO: 193761 - RNA, 32 nt, Human
ggcucacgccuguaaucccuacacuuugggag

SEQ ID NO: 193762 - RNA, 32 nt, Human
ggcucacgccuguaaucccugcauuuuggggg

SEQ ID NO: 193763 - RNA, 32 nt, Human
ggcucacgccuguaaucccuuagcuacucagg

SEQ ID NO: 193764 - RNA, 32 nt, Human
ggcucacgccuguaauccuaacacuuugggag

SEQ ID NO: 193765 - RNA, 32 nt, Human
ggcucacgccuguaauccuagcacuugggagg

SEQ ID NO: 193766 - RNA, 32 nt, Human
ggcucacgccuguaauccuagcacuuuggaag

SEQ ID NO: 193767 - RNA, 32 nt, Human
ggcucacgccuguaauccuagcacuuugggag

SEQ ID NO: 193768 - RNA, 32 nt, Human
ggcucacgccuguaauccuagcacuuuguaag

SEQ ID NO: 193769 - RNA, 32 nt, Human
ggcucacgccuguaauccuagcaguuugggag

SEQ ID NO: 193770 - RNA, 32 nt, Human
ggcucacgccuguaauccuagcauuuugggag

SEQ ID NO: 193771 - RNA, 32 nt, Human
ggcucacgccuguaauccuagcauuuugggug

SEQ ID NO: 193772 - RNA, 32 nt, Human
ggcucacgccuguaauccuagcauuuuuggag

SEQ ID NO: 193773 - RNA, 32 nt, Human
ggcucacgccuguaauccuagcccuuuggaag

SEQ ID NO: 193774 - RNA, 32 nt, Human
ggcucacgccuguaauccuagcgguuuggggg

SEQ ID NO: 193775 - RNA, 32 nt, Human
ggcucacgccuguaauccugacacuuugggag

SEQ ID NO: 193776 - RNA, 32 nt, Human
ggcucacgccuguaauccuggcacuuugggag

SEQ ID NO: 193777 - RNA, 32 nt, Human
ggcucacgccuguaaucgcagcacuuugggag

SEQ ID NO: 193778 - RNA, 32 nt, Human
ggcucacgccuguaaucgcggcacuuugggag

SEQ ID NO: 193779 - RNA, 32 nt, Human
ggcucacgccuguaaucucaacacuuugggag

SEQ ID NO: 193780 - RNA, 32 nt, Human
ggcucacgccuguaaucucagcacuuuaagag

SEQ ID NO: 193781 - RNA, 32 nt, Human
ggcucacgccuguaaucucagcacuuugggag

SEQ ID NO: 193782 - RNA, 32 nt, Human
ggcucacgccuguaaucucagcacuuugggug

SEQ ID NO: 193783 - RNA, 32 nt, Human
ggcucacgccuguaaucucagcauuuugggag

SEQ ID NO: 193784 - RNA, 32 nt, Human
ggcucacgccuguaaucucggcacuuugggag

SEQ ID NO: 193785 - RNA, 32 nt, Human
ggcucacgccuguaaugccagcacuuugggag

SEQ ID NO: 193786 - RNA, 21 nt, Human
ggcucacgccuguaauuccag

SEQ ID NO: 193787 - RNA, 32 nt, Human
ggcucacgccuguaauuccagcacuuugggag

SEQ ID NO: 193788 - RNA, 32 nt, Human
ggcucacgccuguaauuccagugcuuugggag

SEQ ID NO: 193789 - RNA, 32 nt, Human
ggcucacgccuguaauuccaucauuuugggag

SEQ ID NO: 193790 - RNA, 32 nt, Human
ggcucacgccuguaauucuagcacuuugggag

SEQ ID NO: 193791 - RNA, 32 nt, Human
ggcucacgccuguacucccagcauuuugugag

SEQ ID NO: 193792 - RNA, 18 nt, Human
ggcucacgccuguagucc

SEQ ID NO: 193793 - RNA, 32 nt, Human
ggcucacgccuguagucccagcacuuugagag

SEQ ID NO: 193794 - RNA, 32 nt, Human
ggcucacgccuguagucccagcacuuugggag

SEQ ID NO: 193795 - RNA, 32 nt, Human
ggcucacgccuguagucccagcauuuugggag

SEQ ID NO: 193796 - RNA, 32 nt, Human
ggcucacgccuguaucccagcacuuuggaagg

SEQ ID NO: 193797 - RNA, 32 nt, Human
ggcucacgccuguaucccagcacuuugggagg

SEQ ID NO: 193798 - RNA, 32 nt, Human
ggcucacgccuguauuccagcacuuugggagg

SEQ ID NO: 193799 - RNA, 32 nt, Human
ggcucacgccugucaucccagcacuuugggag

SEQ ID NO: 193800 - RNA, 32 nt, Human
ggcucacgccugucaucucagcacuuugggag

SEQ ID NO: 193801 - RNA, 32 nt, Human
ggcucacgccugugauaccagcacuuuuggga

SEQ ID NO: 193802 - RNA, 21 nt, Human
ggcucacgccugugaucccag

SEQ ID NO: 193803 - RNA, 32 nt, Human
ggcucacgccugugaucccagcacuuugggag

SEQ ID NO: 193804 - RNA, 32 nt, Human
ggcucacgccugugaucccagcauuuugggag

SEQ ID NO: 193805 - RNA, 32 nt, Human
ggcucacgccugugauccuagcacuuugggag

SEQ ID NO: 193806 - RNA, 32 nt, Human
ggcucacgccugugaucucagcacuuugaggg

SEQ ID NO: 193807 - RNA, 21 nt, Human
ggcucacgccuguggucccag

SEQ ID NO: 193808 - RNA, 32 nt, Human
ggcucacgccuguggucccagcacuuuggcag

SEQ ID NO: 193809 - RNA, 32 nt, Human
ggcucacgccuguggucccagcacuuugggag

SEQ ID NO: 193810 - RNA, 32 nt, Human
ggcucacgccuguggucccagcacuuuggggg

SEQ ID NO: 193811 - RNA, 32 nt, Human
ggcucacgccuguggucucagcacuuugggag

SEQ ID NO: 193812 - RNA, 20 nt, Human
ggcucacgccuguuauccca

SEQ ID NO: 193813 - RNA, 32 nt, Human
ggcucacgccuguuaucccagcacuuugggag

SEQ ID NO: 193814 - RNA, 22 nt, Human
ggcucacgcguccgcccgcccg

SEQ ID NO: 193815 - RNA, 19 nt, Human
ggcucacgcuuaacuccag

SEQ ID NO: 193816 - RNA, 32 nt, Human
ggcucacgcuuacagucccagcacuuuaagag

SEQ ID NO: 193817 - RNA, 20 nt, Human
ggcucacgcuuauaauccca

SEQ ID NO: 193818 - RNA, 21 nt, Human
ggcucacgcuuauaaucccag

SEQ ID NO: 193819 - RNA, 32 nt, Human
ggcucacgcuuauaaucccagcacuuugggag

SEQ ID NO: 193820 - RNA, 21 nt, Human
ggcucacgcuugcaaucccag

SEQ ID NO: 193821 - RNA, 32 nt, Human
ggcucacgcuugcaaucccagugcuuugggag

SEQ ID NO: 193822 - RNA, 32 nt, Human
ggcucacgcuuguaaucccaacacuuugggag

SEQ ID NO: 193823 - RNA, 21 nt, Human
ggcucacgcuuguaaucccag

SEQ ID NO: 193824 - RNA, 32 nt, Human
ggcucacgcuuguaaucccagcacuuugggaa

SEQ ID NO: 193825 - RNA, 32 nt, Human
ggcucacgcuuguaaucccagcacuuugggag

SEQ ID NO: 193826 - RNA, 32 nt, Human
ggcucacgcuuguaaucccaguacuuugggag

SEQ ID NO: 193827 - RNA, 32 nt, Human
ggcucacgcuuguaaucccggcacuuuaggag

SEQ ID NO: 193828 - RNA, 32 nt, Human
ggcucacgcuuguaaucgcagcacuuugggag

SEQ ID NO: 193829 - RNA, 32 nt, Human
ggcucacgcuuguaaucucagcacuuugggag

SEQ ID NO: 193830 - RNA, 21 nt, Human
ggcucacgcuuguaauuccag

SEQ ID NO: 193831 - RNA, 32 nt, Human
ggcucacgcuuguaauuccagcacuuugggag

SEQ ID NO: 193832 - RNA, 20 nt, Human
ggcucacggcaaccuccacc

SEQ ID NO: 193833 - RNA, 23 nt, Human
ggcucacggcaaccuccaccucc

SEQ ID NO: 193834 - RNA, 32 nt, Human
ggcucacggcaaccuccaccucccggguucaa

SEQ ID NO: 193835 - RNA, 23 nt, Human
ggcucacggcaaccucugccucc

SEQ ID NO: 193836 - RNA, 32 nt, Human
ggcucacggcacgcuccgccucccggguucac

SEQ ID NO: 193837 - RNA, 23 nt, Human
ggcucacggcagccucagccacc

SEQ ID NO: 193838 - RNA, 32 nt, Human
ggcucacggcuguaaucccagcacuuugggag

SEQ ID NO: 193839 - RNA, 23 nt, Human
ggcucacgguaaccucugccucc

SEQ ID NO: 193840 - RNA, 32 nt, Human
ggcucacgguaaccucugccucccagguucaa

SEQ ID NO: 193841 - RNA, 19 nt, Human
ggcucacggugcaggguga

SEQ ID NO: 193842 - RNA, 32 nt, Human
ggcucacguauguaaucccagcacuuugggaa

SEQ ID NO: 193843 - RNA, 32 nt, Human
ggcucacgucuguaaucccagcacuuuggaag

SEQ ID NO: 193844 - RNA, 32 nt, Human
ggcucacgucuguaaucccagcacuuugggag

SEQ ID NO: 193845 - RNA, 32 nt, Human
ggcucacgucuguaaucccagcaguuugggag

SEQ ID NO: 193846 - RNA, 32 nt, Human
ggcucacgucuguaaucccagcgcuuugggag

SEQ ID NO: 193847 - RNA, 32 nt, Human
ggcucacgucuguaaucccaggacuuugggag

SEQ ID NO: 193848 - RNA, 32 nt, Human
ggcucacgucuguaaucucagcacuuagggag

SEQ ID NO: 193849 - RNA, 32 nt, Human
ggcucacgucuguaaucuuugggagcacuuug

SEQ ID NO: 193850 - RNA, 16 nt, Human
ggcucacguggcccag

SEQ ID NO: 193851 - RNA, 32 nt, Human
ggcucacguuuguaaucccagcacuuugggag

SEQ ID NO: 193852 - RNA, 32 nt, Human
ggcucacguuuuuaaucccagcacuuugggag

SEQ ID NO: 193853 - RNA, 24 nt, Human
ggcucacuacaaccaccaccuccu

SEQ ID NO: 193854 - RNA, 32 nt, Human
ggcucacuacaaccaccaccuccuggguccaa

SEQ ID NO: 193855 - RNA, 32 nt, Human
ggcucacuacaaccuccaccucccagguucaa

SEQ ID NO: 193856 - RNA, 32 nt, Human
ggcucacuacaaccuccaccucccggguucag

SEQ ID NO: 193857 - RNA, 24 nt, Human
ggcucacuacaaccuccaccuccu

SEQ ID NO: 193858 - RNA, 32 nt, Human
ggcucacuacaaccuccaccuccuggguucca

SEQ ID NO: 193859 - RNA, 32 nt, Human
ggcucacuacaaccuccaccuuccaggcuuaa

SEQ ID NO: 193860 - RNA, 32 nt, Human
ggcucacuacaaccuccgccucccagguucaa

SEQ ID NO: 193861 - RNA, 32 nt, Human
ggcucacuacaaccuccgccuccuggguucaa

SEQ ID NO: 193862 - RNA, 24 nt, Human
ggcucacuacaaccucgaccuccu

SEQ ID NO: 193863 - RNA, 32 nt, Human
ggcucacuacaaccucgaccuccuggguucaa

SEQ ID NO: 193864 - RNA, 22 nt, Human
ggcucacuacaaccucugccuc

SEQ ID NO: 193865 - RNA, 23 nt, Human
ggcucacuacaaccucugccucc

SEQ ID NO: 193866 - RNA, 32 nt, Human
ggcucacuacaaccucugccucccagguucaa

SEQ ID NO: 193867 - RNA, 32 nt, Human
ggcucacuacaaccucugccucccggguucaa

SEQ ID NO: 193868 - RNA, 32 nt, Human
ggcucacuacaaccucugccucgcagguucag

SEQ ID NO: 193869 - RNA, 23 nt, Human
ggcucacuacaacuuccgccucc

SEQ ID NO: 193870 - RNA, 32 nt, Human
ggcucacuacaagcucugccucccggguucac

SEQ ID NO: 193871 - RNA, 32 nt, Human
ggcucacuacagccucaaacucccagacucaa

SEQ ID NO: 193872 - RNA, 32 nt, Human
ggcucacuacagccuccgccuccuggguucaa

SEQ ID NO: 193873 - RNA, 32 nt, Human
ggcucacuacagccucgaacuccuggucucuu

SEQ ID NO: 193874 - RNA, 32 nt, Human
ggcucacuacagccucgcucucccgggcucca

SEQ ID NO: 193875 - RNA, 23 nt, Human
ggcucacuacagccucugccccc

SEQ ID NO: 193876 - RNA, 27 nt, Human
ggcucacuacagugagccucagccucc

SEQ ID NO: 193877 - RNA, 21 nt, Human
ggcucacuacucuaauuccag

SEQ ID NO: 193878 - RNA, 32 nt, Human
ggcucacuacugcugugcccucaggcugggcg

SEQ ID NO: 193879 - RNA, 32 nt, Human
ggcucacuacuguaauuccagcacuuugggag

SEQ ID NO: 193880 - RNA, 32 nt, Human
ggcucacuauaaccuccaccucccagguucaa

SEQ ID NO: 193881 - RNA, 32 nt, Human
ggcucacuauaaccucuuccuccaggguucaa

SEQ ID NO: 193882 - RNA, 22 nt, Human
ggcucacucagaagcucaggca

SEQ ID NO: 193883 - RNA, 32 nt, Human
ggcucacucaggagcaggucucaggcacaguc

SEQ ID NO: 193884 - RNA, 32 nt, Human
ggcucacuccaaccuccaccuacuagguucaa

SEQ ID NO: 193885 - RNA, 32 nt, Human
ggcucacuccaaccuccaccuuccagguucaa

SEQ ID NO: 193886 - RNA, 24 nt, Human
ggcucacuccaaccuccgccuccu

SEQ ID NO: 193887 - RNA, 32 nt, Human
ggcucacuccaaccuccgccuccuggguucaa

SEQ ID NO: 193888 - RNA, 32 nt, Human
ggcucacuccaaccuccuccuggguuccagcg

SEQ ID NO: 193889 - RNA, 32 nt, Human
ggcucacuccaaucuccaccucccggauucaa

SEQ ID NO: 193890 - RNA, 32 nt, Human
ggcucacucccugugccucugccaucagcaca

SEQ ID NO: 193891 - RNA, 32 nt, Human
ggcucacucccuugccucucccccuccaccac

SEQ ID NO: 193892 - RNA, 32 nt, Human
ggcucacuccguaauuccggcacuuugggagg

SEQ ID NO: 193893 - RNA, 20 nt, Human
ggcucacuccuguaauccca

SEQ ID NO: 193894 - RNA, 32 nt, Human
ggcucacuccuguaaucccaacacuuugagag

SEQ ID NO: 193895 - RNA, 32 nt, Human
ggcucacuccuguaaucccaccacuuugggag

SEQ ID NO: 193896 - RNA, 22 nt, Human
ggcucacuccuguaaucccagc

SEQ ID NO: 193897 - RNA, 32 nt, Human
ggcucacuccuguaaucccagcacuuuggagg

SEQ ID NO: 193898 - RNA, 32 nt, Human
ggcucacuccuguaaucccagcacuuugggaa

SEQ ID NO: 193899 - RNA, 32 nt, Human
ggcucacuccuguaaucccagcacuuugggag

SEQ ID NO: 193900 - RNA, 32 nt, Human
ggcucacuccuguaaucccagcauuuugagag

SEQ ID NO: 193901 - RNA, 32 nt, Human
ggcucacuccuguaaucccagcauuuugggag

SEQ ID NO: 193902 - RNA, 32 nt, Human
ggcucacuccuguaaucccggcacuuuggaau

SEQ ID NO: 193903 - RNA, 32 nt, Human
ggcucacuccuguaauccuagcaguuuggaag

SEQ ID NO: 193904 - RNA, 32 nt, Human
ggcucacuccuguaaucucagaacuuugggag

SEQ ID NO: 193905 - RNA, 32 nt, Human
ggcucacuccuguaauuccagcacuuugggag

SEQ ID NO: 193906 - RNA, 32 nt, Human
ggcucacuccuguagucccagcacuuugggag

SEQ ID NO: 193907 - RNA, 32 nt, Human
ggcucacucuagggagaaugguucacuccacc

SEQ ID NO: 193908 - RNA, 32 nt, Human
ggcucacucugucauugggagcugucagcugc

SEQ ID NO: 193909 - RNA, 23 nt, Human
ggcucacugaaaccucugccucc

SEQ ID NO: 193910 - RNA, 32 nt, Human
ggcucacugaaaccucugccucccggguucaa

SEQ ID NO: 193911 - RNA, 32 nt, Human
ggcucacugaaaccucugccucccgguucaag

SEQ ID NO: 193912 - RNA, 32 nt, Human
ggcucacugaaaccucugccuuccagguucaa

SEQ ID NO: 193913 - RNA, 32 nt, Human
ggcucacugaaaccugugccuccccgguucga

SEQ ID NO: 193914 - RNA, 32 nt, Human
ggcucacugaaacuucugccucccggguacaa

SEQ ID NO: 193915 - RNA, 22 nt, Human
ggcucacugcaaacccgccucc

SEQ ID NO: 193916 - RNA, 21 nt, Human
ggcucacugcaaaccgccucc

SEQ ID NO: 193917 - RNA, 32 nt, Human
ggcucacugcaaacuccacuucccuaguucaa

SEQ ID NO: 193918 - RNA, 21 nt, Human
ggcucacugcaaacuccgccu

SEQ ID NO: 193919 - RNA, 23 nt, Human
ggcucacugcaaacuccgccucc

SEQ ID NO: 193920 - RNA, 32 nt, Human
ggcucacugcaaacuccgccucccagguucaa

SEQ ID NO: 193921 - RNA, 32 nt, Human
ggcucacugcaaacuccgccucccggguucac

SEQ ID NO: 193922 - RNA, 32 nt, Human
ggcucacugcaaacuccgccuuccagguucac

SEQ ID NO: 193923 - RNA, 32 nt, Human
ggcucacugcaaacuccgccuuccagguucau

SEQ ID NO: 193924 - RNA, 32 nt, Human
ggcucacugcaaacucugccuaccagguucaa

SEQ ID NO: 193925 - RNA, 32 nt, Human
ggcucacugcaaacucugccucccagguucaa

SEQ ID NO: 193926 - RNA, 32 nt, Human
ggcucacugcaaacucugccucccggguucaa

SEQ ID NO: 193927 - RNA, 24 nt, Human
ggcucacugcaaacucugccuccu

SEQ ID NO: 193928 - RNA, 32 nt, Human
ggcucacugcaaacucugccuccuggauucaa

SEQ ID NO: 193929 - RNA, 32 nt, Human
ggcucacugcaaacucugccuuuuggguucaa

SEQ ID NO: 193930 - RNA, 22 nt, Human
ggcucacugcaaaucuccgccu

SEQ ID NO: 193931 - RNA, 32 nt, Human
ggcucacugcaaaucuccgccucccagguuca

SEQ ID NO: 193932 - RNA, 32 nt, Human
ggcucacugcaacauccaccuccuggguucaa

SEQ ID NO: 193933 - RNA, 32 nt, Human
ggcucacugcaacauccagcuccuggguuuca

SEQ ID NO: 193934 - RNA, 23 nt, Human
ggcucacugcaacauccgccucc

SEQ ID NO: 193935 - RNA, 32 nt, Human
ggcucacugcaacauccgccucccggguucag

SEQ ID NO: 193936 - RNA, 24 nt, Human
ggcucacugcaacaucugacuccu

SEQ ID NO: 193937 - RNA, 32 nt, Human
ggcucacugcaacaucugacuccuggguucaa

SEQ ID NO: 193938 - RNA, 23 nt, Human
ggcucacugcaacaucugccucc

SEQ ID NO: 193939 - RNA, 23 nt, Human
ggcucacugcaaccaccaucucc

SEQ ID NO: 193940 - RNA, 32 nt, Human
ggcucacugcaaccaccaucucccaggagagg

SEQ ID NO: 193941 - RNA, 32 nt, Human
ggcucacugcaaccacugccucccagguucaa

SEQ ID NO: 193942 - RNA, 24 nt, Human
ggcucacugcaaccacugcuuccu

SEQ ID NO: 193943 - RNA, 32 nt, Human
ggcucacugcaaccacugcuuccuggguucaa

SEQ ID NO: 193944 - RNA, 32 nt, Human
ggcucacugcaaccacugucucccggguucaa

SEQ ID NO: 193945 - RNA, 23 nt, Human
ggcucacugcaacccccacaucc

SEQ ID NO: 193946 - RNA, 32 nt, Human
ggcucacugcaacccccacaucccggguucaa

SEQ ID NO: 193947 - RNA, 32 nt, Human
ggcucacugcaacccccaccucccggguucaa

SEQ ID NO: 193948 - RNA, 23 nt, Human
ggcucacugcaacccccaucucc

SEQ ID NO: 193949 - RNA, 32 nt, Human
ggcucacugcaacccccaucucccagguucaa

SEQ ID NO: 193950 - RNA, 24 nt, Human
ggcucacugcaacccccgccaccu

SEQ ID NO: 193951 - RNA, 32 nt, Human
ggcucacugcaacccccgccaccuagguucaa

SEQ ID NO: 193952 - RNA, 23 nt, Human
ggcucacugcaacccccgccccc

SEQ ID NO: 193953 - RNA, 23 nt, Human
ggcucacugcaacccccgccucc

SEQ ID NO: 193954 - RNA, 32 nt, Human
ggcucacugcaacccccgccuccaggguucaa

SEQ ID NO: 193955 - RNA, 23 nt, Human
ggcucacugcaacccccgucucc

SEQ ID NO: 193956 - RNA, 32 nt, Human
ggcucacugcaacccccgucucccggguucaa

SEQ ID NO: 193957 - RNA, 22 nt, Human
ggcucacugcaaccccgccucc

SEQ ID NO: 193958 - RNA, 32 nt, Human
ggcucacugcaaccccgccucccagguucaag

SEQ ID NO: 193959 - RNA, 22 nt, Human
ggcucacugcaacccucccucc

SEQ ID NO: 193960 - RNA, 32 nt, Human
ggcucacugcaacccucccucccggguuccag

SEQ ID NO: 193961 - RNA, 24 nt, Human
ggcucacugcaaccucaaauuccu

SEQ ID NO: 193962 - RNA, 32 nt, Human
ggcucacugcaaccucaaccagcccagguuca

SEQ ID NO: 193963 - RNA, 24 nt, Human
ggcucacugcaaccucaaccuucu

SEQ ID NO: 193964 - RNA, 32 nt, Human
ggcucacugcaaccucaaccuucugguuucaa

SEQ ID NO: 193965 - RNA, 22 nt, Human
ggcucacugcaaccucaccucc

SEQ ID NO: 193966 - RNA, 32 nt, Human
ggcucacugcaaccucaccucccggguucaag

SEQ ID NO: 193967 - RNA, 23 nt, Human
ggcucacugcaaccucagccucc

SEQ ID NO: 193968 - RNA, 32 nt, Human
ggcucacugcaaccucagccucccagguucaa

SEQ ID NO: 193969 - RNA, 24 nt, Human
ggcucacugcaaccucagccuccu

SEQ ID NO: 193970 - RNA, 32 nt, Human
ggcucacugcaaccucagccuccugggcucaa

SEQ ID NO: 193971 - RNA, 23 nt, Human
ggcucacugcaaccuccaacucc

SEQ ID NO: 193972 - RNA, 32 nt, Human
ggcucacugcaaccuccaacucccagguucaa

SEQ ID NO: 193973 - RNA, 32 nt, Human
ggcucacugcaaccuccaacucccugguucaa

SEQ ID NO: 193974 - RNA, 32 nt, Human
ggcucacugcaaccuccaacucccugguuuaa

SEQ ID NO: 193975 - RNA, 23 nt, Human
ggcucacugcaaccuccacaucc

SEQ ID NO: 193976 - RNA, 32 nt, Human
ggcucacugcaaccuccacaucccauguugaa

SEQ ID NO: 193977 - RNA, 23 nt, Human
ggcucacugcaaccuccaccccc

SEQ ID NO: 193978 - RNA, 32 nt, Human
ggcucacugcaaccuccacccccggggaucaa

SEQ ID NO: 193979 - RNA, 24 nt, Human
ggcucacugcaaccuccacccgcc

SEQ ID NO: 193980 - RNA, 32 nt, Human
ggcucacugcaaccuccacccgccggguucaa

SEQ ID NO: 193981 - RNA, 21 nt, Human
ggcucacugcaaccuccaccu

SEQ ID NO: 193982 - RNA, 22 nt, Human
ggcucacugcaaccuccaccuc

SEQ ID NO: 193983 - RNA, 32 nt, Human
ggcucacugcaaccuccaccucacagguucaa

SEQ ID NO: 193984 - RNA, 23 nt, Human
ggcucacugcaaccuccaccucc

SEQ ID NO: 193985 - RNA, 32 nt, Human
ggcucacugcaaccuccaccuccagguucaag

SEQ ID NO: 193986 - RNA, 32 nt, Human
ggcucacugcaaccuccaccucccagaaggaa

SEQ ID NO: 193987 - RNA, 32 nt, Human
ggcucacugcaaccuccaccucccagauucaa

SEQ ID NO: 193988 - RNA, 32 nt, Human
ggcucacugcaaccuccaccucccaggucagc

SEQ ID NO: 193989 - RNA, 32 nt, Human
ggcucacugcaaccuccaccucccagguccaa

SEQ ID NO: 193990 - RNA, 32 nt, Human
ggcucacugcaaccuccaccucccagguucaa

SEQ ID NO: 193991 - RNA, 32 nt, Human
ggcucacugcaaccuccaccucccagguucac

SEQ ID NO: 193992 - RNA, 32 nt, Human
ggcucacugcaaccuccaccucccaguucaag

SEQ ID NO: 193993 - RNA, 32 nt, Human
ggcucacugcaaccuccaccuccccaguucac

SEQ ID NO: 193994 - RNA, 32 nt, Human
ggcucacugcaaccuccaccuccccggguuca

SEQ ID NO: 193995 - RNA, 32 nt, Human
ggcucacugcaaccuccaccucccgaguucaa

SEQ ID NO: 193996 - RNA, 32 nt, Human
ggcucacugcaaccuccaccucccggauucaa

SEQ ID NO: 193997 - RNA, 32 nt, Human
ggcucacugcaaccuccaccucccgggcucaa

SEQ ID NO: 193998 - RNA, 32 nt, Human
ggcucacugcaaccuccaccucccggguucaa

SEQ ID NO: 193999 - RNA, 32 nt, Human
ggcucacugcaaccuccaccucccggguucac

SEQ ID NO: 194000 - RNA, 32 nt, Human
ggcucacugcaaccuccaccucccggguucag

SEQ ID NO: 194001 - RNA, 32 nt, Human
ggcucacugcaaccuccaccucccggguucca

SEQ ID NO: 194002 - RNA, 24 nt, Human
ggcucacugcaaccuccaccuccu

SEQ ID NO: 194003 - RNA, 32 nt, Human
ggcucacugcaaccuccaccuccuagguucaa

SEQ ID NO: 194004 - RNA, 32 nt, Human
ggcucacugcaaccuccaccuccugaguucaa

SEQ ID NO: 194005 - RNA, 32 nt, Human
ggcucacugcaaccuccaccuccuggauucaa

SEQ ID NO: 194006 - RNA, 32 nt, Human
ggcucacugcaaccuccaccuccuggcuucaa

SEQ ID NO: 194007 - RNA, 32 nt, Human
ggcucacugcaaccuccaccuccugggcucaa

SEQ ID NO: 194008 - RNA, 32 nt, Human
ggcucacugcaaccuccaccuccugggucaag

SEQ ID NO: 194009 - RNA, 32 nt, Human
ggcucacugcaaccuccaccuccuggguucaa

SEQ ID NO: 194010 - RNA, 32 nt, Human
ggcucacugcaaccuccaccuccuggguucag

SEQ ID NO: 194011 - RNA, 32 nt, Human
ggcucacugcaaccuccaccuccuggguuuaa

SEQ ID NO: 194012 - RNA, 32 nt, Human
ggcucacugcaaccuccaccuccugguucaag

SEQ ID NO: 194013 - RNA, 23 nt, Human
ggcucacugcaaccuccaccucu

SEQ ID NO: 194014 - RNA, 32 nt, Human
ggcucacugcaaccuccaccucucggcuucaa

SEQ ID NO: 194015 - RNA, 32 nt, Human
ggcucacugcaaccuccaccucugggauucaa

SEQ ID NO: 194016 - RNA, 23 nt, Human
ggcucacugcaaccuccaccuuc

SEQ ID NO: 194017 - RNA, 32 nt, Human
ggcucacugcaaccuccaccuucaggguguca

SEQ ID NO: 194018 - RNA, 32 nt, Human
ggcucacugcaaccuccaccuuccugguucaa

SEQ ID NO: 194019 - RNA, 23 nt, Human
ggcucacugcaaccuccacuucc

SEQ ID NO: 194020 - RNA, 32 nt, Human
ggcucacugcaaccuccacuucccagguucua

SEQ ID NO: 194021 - RNA, 32 nt, Human
ggcucacugcaaccuccacuucccggguucaa

SEQ ID NO: 194022 - RNA, 24 nt, Human
ggcucacugcaaccuccacuuccu

SEQ ID NO: 194023 - RNA, 32 nt, Human
ggcucacugcaaccuccacuuccuggguucaa

SEQ ID NO: 194024 - RNA, 23 nt, Human
ggcucacugcaaccuccacuucu

SEQ ID NO: 194025 - RNA, 32 nt, Human
ggcucacugcaaccuccacuucucagguucaa

SEQ ID NO: 194026 - RNA, 24 nt, Human
ggcucacugcaaccuccacuucuu

SEQ ID NO: 194027 - RNA, 32 nt, Human
ggcucacugcaaccuccacuucuuggguucaa

SEQ ID NO: 194028 - RNA, 32 nt, Human
ggcucacugcaaccuccagcucccagguugaa

SEQ ID NO: 194029 - RNA, 22 nt, Human
ggcucacugcaaccuccaggcc

SEQ ID NO: 194030 - RNA, 32 nt, Human
ggcucacugcaaccuccaggccagccucagcc

SEQ ID NO: 194031 - RNA, 24 nt, Human
ggcucacugcaaccuccagguccc

SEQ ID NO: 194032 - RNA, 23 nt, Human
ggcucacugcaaccuccaucucc

SEQ ID NO: 194033 - RNA, 32 nt, Human
ggcucacugcaaccuccaucuccggggcucaa

SEQ ID NO: 194034 - RNA, 23 nt, Human
ggcucacugcaaccucccucucc

SEQ ID NO: 194035 - RNA, 23 nt, Human
ggcucacugcaaccucccugccu

SEQ ID NO: 194036 - RNA, 32 nt, Human
ggcucacugcaaccucccugccugauucuccu

SEQ ID NO: 194037 - RNA, 32 nt, Human
ggcucacugcaaccucccugccugauucucuu

SEQ ID NO: 194038 - RNA, 23 nt, Human
ggcucacugcaaccuccgacucc

SEQ ID NO: 194039 - RNA, 32 nt, Human
ggcucacugcaaccuccgacucccagguucaa

SEQ ID NO: 194040 - RNA, 32 nt, Human
ggcucacugcaaccuccgacucccugguucaa

SEQ ID NO: 194041 - RNA, 24 nt, Human
ggcucacugcaaccuccgacuccu

SEQ ID NO: 194042 - RNA, 32 nt, Human
ggcucacugcaaccuccgacuccuggguucaa

SEQ ID NO: 194043 - RNA, 19 nt, Human
ggcucacugcaaccuccgc

SEQ ID NO: 194044 - RNA, 23 nt, Human
ggcucacugcaaccuccgcaucc

SEQ ID NO: 194045 - RNA, 32 nt, Human
ggcucacugcaaccuccgcaucccggguucaa

SEQ ID NO: 194046 - RNA, 24 nt, Human
ggcucacugcaaccuccgcauccu

SEQ ID NO: 194047 - RNA, 23 nt, Human
ggcucacugcaaccuccgccacc

SEQ ID NO: 194048 - RNA, 24 nt, Human
ggcucacugcaaccuccgccaccu

SEQ ID NO: 194049 - RNA, 24 nt, Human
ggcucacugcaaccuccgcccccu

SEQ ID NO: 194050 - RNA, 32 nt, Human
ggcucacugcaaccuccgcccccuggguuuaa

SEQ ID NO: 194051 - RNA, 24 nt, Human
ggcucacugcaaccuccgccuacc

SEQ ID NO: 194052 - RNA, 32 nt, Human
ggcucacugcaaccuccgccuaccggguucaa

SEQ ID NO: 194053 - RNA, 23 nt, Human
ggcucacugcaaccuccgccucc

SEQ ID NO: 194054 - RNA, 32 nt, Human
ggcucacugcaaccuccgccuccagggcgcag

SEQ ID NO: 194055 - RNA, 32 nt, Human
ggcucacugcaaccuccgccuccaggguucgg

SEQ ID NO: 194056 - RNA, 32 nt, Human
ggcucacugcaaccuccgccucccaaguucaa

SEQ ID NO: 194057 - RNA, 32 nt, Human
ggcucacugcaaccuccgccucccaaguucag

SEQ ID NO: 194058 - RNA, 32 nt, Human
ggcucacugcaaccuccgccucccagguucaa

SEQ ID NO: 194059 - RNA, 32 nt, Human
ggcucacugcaaccuccgccucccagguucac

SEQ ID NO: 194060 - RNA, 32 nt, Human
ggcucacugcaaccuccgccucccagguucag

SEQ ID NO: 194061 - RNA, 32 nt, Human
ggcucacugcaaccuccgccucccagguucca

SEQ ID NO: 194062 - RNA, 32 nt, Human
ggcucacugcaaccuccgccucccagguugac

SEQ ID NO: 194063 - RNA, 32 nt, Human
ggcucacugcaaccuccgccucccagguuuaa

SEQ ID NO: 194064 - RNA, 32 nt, Human
ggcucacugcaaccuccgccucccaguuucaa

SEQ ID NO: 194065 - RNA, 32 nt, Human
ggcucacugcaaccuccgccucccgaguucaa

SEQ ID NO: 194066 - RNA, 32 nt, Human
ggcucacugcaaccuccgccucccggcuucaa

SEQ ID NO: 194067 - RNA, 32 nt, Human
ggcucacugcaaccuccgccucccgggcugaa

SEQ ID NO: 194068 - RNA, 32 nt, Human
ggcucacugcaaccuccgccucccggguuaaa

SEQ ID NO: 194069 - RNA, 32 nt, Human
ggcucacugcaaccuccgccucccggguucaa

SEQ ID NO: 194070 - RNA, 32 nt, Human
ggcucacugcaaccuccgccucccggguucag

SEQ ID NO: 194071 - RNA, 32 nt, Human
ggcucacugcaaccuccgccucccggguucca

SEQ ID NO: 194072 - RNA, 32 nt, Human
ggcucacugcaaccuccgccucccggguucgg

SEQ ID NO: 194073 - RNA, 32 nt, Human
ggcucacugcaaccuccgccucccgguucaag

SEQ ID NO: 194074 - RNA, 32 nt, Human
ggcucacugcaaccuccgccucccugguucaa

SEQ ID NO: 194075 - RNA, 32 nt, Human
ggcucacugcaaccuccgccuccgggguucaa

SEQ ID NO: 194076 - RNA, 24 nt, Human
ggcucacugcaaccuccgccuccu

SEQ ID NO: 194077 - RNA, 32 nt, Human
ggcucacugcaaccuccgccuccugaguucac

SEQ ID NO: 194078 - RNA, 32 nt, Human
ggcucacugcaaccuccgccuccugggcucaa

SEQ ID NO: 194079 - RNA, 32 nt, Human
ggcucacugcaaccuccgccuccuggguuaaa

SEQ ID NO: 194080 - RNA, 32 nt, Human
ggcucacugcaaccuccgccuccuggguucaa

SEQ ID NO: 194081 - RNA, 32 nt, Human
ggcucacugcaaccuccgccuccuggguucag

SEQ ID NO: 194082 - RNA, 32 nt, Human
ggcucacugcaaccuccgccuccuggguucca

SEQ ID NO: 194083 - RNA, 32 nt, Human
ggcucacugcaaccuccgccuccuggguucgg

SEQ ID NO: 194084 - RNA, 32 nt, Human
ggcucacugcaaccuccgccuccuugguucca

SEQ ID NO: 194085 - RNA, 23 nt, Human
ggcucacugcaaccuccgccucu

SEQ ID NO: 194086 - RNA, 32 nt, Human
ggcucacugcaaccuccgccucucagguucaa

SEQ ID NO: 194087 - RNA, 32 nt, Human
ggcucacugcaaccuccgccucucggguucaa

SEQ ID NO: 194088 - RNA, 24 nt, Human
ggcucacugcaaccuccgccucuu

SEQ ID NO: 194089 - RNA, 32 nt, Human
ggcucacugcaaccuccgccucuuggguucaa

SEQ ID NO: 194090 - RNA, 22 nt, Human
ggcucacugcaaccuccgccuu

SEQ ID NO: 194091 - RNA, 32 nt, Human
ggcucacugcaaccuccgccuuccugaguuca

SEQ ID NO: 194092 - RNA, 32 nt, Human
ggcucacugcaaccuccgccuuccugguucaa

SEQ ID NO: 194093 - RNA, 32 nt, Human
ggcucacugcaaccuccgccuucuggguucaa

SEQ ID NO: 194094 - RNA, 32 nt, Human
ggcucacugcaaccuccgccuugcugguugag

SEQ ID NO: 194095 - RNA, 32 nt, Human
ggcucacugcaaccuccgccuuuccaccuucc

SEQ ID NO: 194096 - RNA, 32 nt, Human
ggcucacugcaaccuccgcucccuggguucaa

SEQ ID NO: 194097 - RNA, 23 nt, Human
ggcucacugcaaccuccgucucc

SEQ ID NO: 194098 - RNA, 32 nt, Human
ggcucacugcaaccuccgucucccagguucaa

SEQ ID NO: 194099 - RNA, 24 nt, Human
ggcucacugcaaccuccgucuccu

SEQ ID NO: 194100 - RNA, 32 nt, Human
ggcucacugcaaccuccgucuccuggguucaa

SEQ ID NO: 194101 - RNA, 23 nt, Human
ggcucacugcaaccuccgucuuc

SEQ ID NO: 194102 - RNA, 32 nt, Human
ggcucacugcaaccuccgucuuccggguucaa

SEQ ID NO: 194103 - RNA, 23 nt, Human
ggcucacugcaaccuccuccucc

SEQ ID NO: 194104 - RNA, 32 nt, Human
ggcucacugcaaccuccuccucccagagguac

SEQ ID NO: 194105 - RNA, 32 nt, Human
ggcucacugcaaccuccuccucccggguucaa

SEQ ID NO: 194106 - RNA, 24 nt, Human
ggcucacugcaaccuccuccuccu

SEQ ID NO: 194107 - RNA, 32 nt, Human
ggcucacugcaaccuccuccuccuggauucaa

SEQ ID NO: 194108 - RNA, 32 nt, Human
ggcucacugcaaccuccugcuuccuggguuca

SEQ ID NO: 194109 - RNA, 23 nt, Human
ggcucacugcaaccuccuucucc

SEQ ID NO: 194110 - RNA, 32 nt, Human
ggcucacugcaaccuccuucucccagguucaa

SEQ ID NO: 194111 - RNA, 22 nt, Human
ggcucacugcaaccucgccucc

SEQ ID NO: 194112 - RNA, 32 nt, Human
ggcucacugcaaccucgccucccugguucaag

SEQ ID NO: 194113 - RNA, 23 nt, Human
ggcucacugcaaccucuaccucc

SEQ ID NO: 194114 - RNA, 32 nt, Human
ggcucacugcaaccucuaccucccagguucaa

SEQ ID NO: 194115 - RNA, 24 nt, Human
ggcucacugcaaccucuaccuccu

SEQ ID NO: 194116 - RNA, 32 nt, Human
ggcucacugcaaccucuaccuccuggauucaa

SEQ ID NO: 194117 - RNA, 32 nt, Human
ggcucacugcaaccucuaccuccuggguucaa

SEQ ID NO: 194118 - RNA, 19 nt, Human
ggcucacugcaaccucugc

SEQ ID NO: 194119 - RNA, 20 nt, Human
ggcucacugcaaccucugcc

SEQ ID NO: 194120 - RNA, 32 nt, Human
ggcucacugcaaccucugccacacggguucag

SEQ ID NO: 194121 - RNA, 32 nt, Human
ggcucacugcaaccucugccaccuggguucaa

SEQ ID NO: 194122 - RNA, 32 nt, Human
ggcucacugcaaccucugccaucaggauuaaa

SEQ ID NO: 194123 - RNA, 24 nt, Human
ggcucacugcaaccucugcccccu

SEQ ID NO: 194124 - RNA, 32 nt, Human
ggcucacugcaaccucugcccccuggguucaa

SEQ ID NO: 194125 - RNA, 24 nt, Human
ggcucacugcaaccucugccgucu

SEQ ID NO: 194126 - RNA, 24 nt, Human
ggcucacugcaaccucugccuacc

SEQ ID NO: 194127 - RNA, 32 nt, Human
ggcucacugcaaccucugccuaccggauucaa

SEQ ID NO: 194128 - RNA, 22 nt, Human
ggcucacugcaaccucugccuc

SEQ ID NO: 194129 - RNA, 23 nt, Human
ggcucacugcaaccucugccuca

SEQ ID NO: 194130 - RNA, 32 nt, Human
ggcucacugcaaccucugccucacaggcucaa

SEQ ID NO: 194131 - RNA, 32 nt, Human
ggcucacugcaaccucugccucacagguucaa

SEQ ID NO: 194132 - RNA, 32 nt, Human
ggcucacugcaaccucugccucacggguucaa

SEQ ID NO: 194133 - RNA, 23 nt, Human
ggcucacugcaaccucugccucc

SEQ ID NO: 194134 - RNA, 32 nt, Human
ggcucacugcaaccucugccucccaaguucaa

SEQ ID NO: 194135 - RNA, 32 nt, Human
ggcucacugcaaccucugccucccagguucaa

SEQ ID NO: 194136 - RNA, 32 nt, Human
ggcucacugcaaccucugccucccagguucac

SEQ ID NO: 194137 - RNA, 32 nt, Human
ggcucacugcaaccucugccucccagguucag

SEQ ID NO: 194138 - RNA, 32 nt, Human
ggcucacugcaaccucugccucccagguucau

SEQ ID NO: 194139 - RNA, 32 nt, Human
ggcucacugcaaccucugccucccagguucca

SEQ ID NO: 194140 - RNA, 32 nt, Human
ggcucacugcaaccucugccucccgaguucaa

SEQ ID NO: 194141 - RNA, 32 nt, Human
ggcucacugcaaccucugccucccgcauucaa

SEQ ID NO: 194142 - RNA, 32 nt, Human
ggcucacugcaaccucugccucccggauucaa

SEQ ID NO: 194143 - RNA, 32 nt, Human
ggcucacugcaaccucugccucccgggcucaa

SEQ ID NO: 194144 - RNA, 32 nt, Human
ggcucacugcaaccucugccucccggguucaa

SEQ ID NO: 194145 - RNA, 32 nt, Human
ggcucacugcaaccucugccucccggguucca

SEQ ID NO: 194146 - RNA, 32 nt, Human
ggcucacugcaaccucugccucccggguucgg

SEQ ID NO: 194147 - RNA, 32 nt, Human
ggcucacugcaaccucugccucccgguuucaa

SEQ ID NO: 194148 - RNA, 32 nt, Human
ggcucacugcaaccucugccucccguguucaa

SEQ ID NO: 194149 - RNA, 32 nt, Human
ggcucacugcaaccucugccucccugguucaa

SEQ ID NO: 194150 - RNA, 24 nt, Human
ggcucacugcaaccucugccuccu

SEQ ID NO: 194151 - RNA, 32 nt, Human
ggcucacugcaaccucugccuccuagguugaa

SEQ ID NO: 194152 - RNA, 25 nt, Human
ggcucacugcaaccucugccuccug

SEQ ID NO: 194153 - RNA, 32 nt, Human
ggcucacugcaaccucugccuccugaauucca

SEQ ID NO: 194154 - RNA, 32 nt, Human
ggcucacugcaaccucugccuccugagcucaa

SEQ ID NO: 194155 - RNA, 32 nt, Human
ggcucacugcaaccucugccuccugaguucac

SEQ ID NO: 194156 - RNA, 32 nt, Human
ggcucacugcaaccucugccuccuggauucaa

SEQ ID NO: 194157 - RNA, 32 nt, Human
ggcucacugcaaccucugccuccugggcucaa

SEQ ID NO: 194158 - RNA, 32 nt, Human
ggcucacugcaaccucugccuccugggguuca

SEQ ID NO: 194159 - RNA, 32 nt, Human
ggcucacugcaaccucugccuccugggugcaa

SEQ ID NO: 194160 - RNA, 32 nt, Human
ggcucacugcaaccucugccuccuggguucaa

SEQ ID NO: 194161 - RNA, 32 nt, Human
ggcucacugcaaccucugccuccuggguucag

SEQ ID NO: 194162 - RNA, 32 nt, Human
ggcucacugcaaccucugccuccuggguuuaa

SEQ ID NO: 194163 - RNA, 32 nt, Human
ggcucacugcaaccucugccuccuucguucaa

SEQ ID NO: 194164 - RNA, 32 nt, Human
ggcucacugcaaccucugccuccuugguucaa

SEQ ID NO: 194165 - RNA, 32 nt, Human
ggcucacugcaaccucugccucuuggguucaa

SEQ ID NO: 194166 - RNA, 32 nt, Human
ggcucacugcaaccucugccugccggguucaa

SEQ ID NO: 194167 - RNA, 32 nt, Human
ggcucacugcaaccucugccuuccagguucaa

SEQ ID NO: 194168 - RNA, 24 nt, Human
ggcucacugcaaccucugccuucu

SEQ ID NO: 194169 - RNA, 32 nt, Human
ggcucacugcaaccucugccuucuggguucaa

SEQ ID NO: 194170 - RNA, 32 nt, Human
ggcucacugcaaccucugccuucuggguucag

SEQ ID NO: 194171 - RNA, 32 nt, Human
ggcucacugcaaccucugcgggcucacgcaau

SEQ ID NO: 194172 - RNA, 23 nt, Human
ggcucacugcaaccucugcuucc

SEQ ID NO: 194173 - RNA, 32 nt, Human
ggcucacugcaaccucugcuucccagguuuaa

SEQ ID NO: 194174 - RNA, 32 nt, Human
ggcucacugcaaccucugcuucccgaguucaa

SEQ ID NO: 194175 - RNA, 32 nt, Human
ggcucacugcaaccucugcuucccggguucaa

SEQ ID NO: 194176 - RNA, 23 nt, Human
ggcucacugcaaccucugucucc

SEQ ID NO: 194177 - RNA, 32 nt, Human
ggcucacugcaaccucugucuccaggguugaa

SEQ ID NO: 194178 - RNA, 32 nt, Human
ggcucacugcaaccucugucucccagguucag

SEQ ID NO: 194179 - RNA, 24 nt, Human
ggcucacugcaaccucugucuccu

SEQ ID NO: 194180 - RNA, 32 nt, Human
ggcucacugcaaccucugucuccugaguucaa

SEQ ID NO: 194181 - RNA, 32 nt, Human
ggcucacugcaaccucugucuccugggcucaa

SEQ ID NO: 194182 - RNA, 32 nt, Human
ggcucacugcaaccucugucuccuggguucaa

SEQ ID NO: 194183 - RNA, 32 nt, Human
ggcucacugcaaccucugucuccuggguuuaa

SEQ ID NO: 194184 - RNA, 32 nt, Human
ggcucacugcaaccucugucuuccagguucaa

SEQ ID NO: 194185 - RNA, 32 nt, Human
ggcucacugcaaccucugucuucuggguucaa

SEQ ID NO: 194186 - RNA, 24 nt, Human
ggcucacugcaaccucuguguccu

SEQ ID NO: 194187 - RNA, 32 nt, Human
ggcucacugcaaccucuguguccugggcucaa

SEQ ID NO: 194188 - RNA, 24 nt, Human
ggcucacugcaaccucuuccuccu

SEQ ID NO: 194189 - RNA, 32 nt, Human
ggcucacugcaaccucuuccuccugguucaag

SEQ ID NO: 194190 - RNA, 24 nt, Human
ggcucacugcaaccucuugccucc

SEQ ID NO: 194191 - RNA, 32 nt, Human
ggcucacugcaaccucuugccucccagguuca

SEQ ID NO: 194192 - RNA, 24 nt, Human
ggcucacugcaaccugcgccuccu

SEQ ID NO: 194193 - RNA, 32 nt, Human
ggcucacugcaaccugcgccuccuggguucaa

SEQ ID NO: 194194 - RNA, 24 nt, Human
ggcucacugcaaccuggaacuccu

SEQ ID NO: 194195 - RNA, 32 nt, Human
ggcucacugcaaccuggaacuccugggcucaa

SEQ ID NO: 194196 - RNA, 32 nt, Human
ggcucacugcaaccugucucucagguugaagu

SEQ ID NO: 194197 - RNA, 32 nt, Human
ggcucacugcaaccuucaccgcccagguucaa

SEQ ID NO: 194198 - RNA, 23 nt, Human
ggcucacugcaaccuucaccucc

SEQ ID NO: 194199 - RNA, 32 nt, Human
ggcucacugcaaccuucaccuccagguucaag

SEQ ID NO: 194200 - RNA, 24 nt, Human
ggcucacugcaaccuucgccuccu

SEQ ID NO: 194201 - RNA, 23 nt, Human
ggcucacugcaaccuucgccucu

SEQ ID NO: 194202 - RNA, 32 nt, Human
ggcucacugcaaccuucgccucuggguucaag

SEQ ID NO: 194203 - RNA, 23 nt, Human
ggcucacugcaaccuugaccucc

SEQ ID NO: 194204 - RNA, 32 nt, Human
ggcucacugcaaccuugaccucccaggcucag

SEQ ID NO: 194205 - RNA, 24 nt, Human
ggcucacugcaaccuugacguccc

SEQ ID NO: 194206 - RNA, 32 nt, Human
ggcucacugcaaccuugacgucccagguucaa

SEQ ID NO: 194207 - RNA, 24 nt, Human
ggcucacugcaaccuuugccuccu

SEQ ID NO: 194208 - RNA, 32 nt, Human
ggcucacugcaaccuuugccuccuagguucaa

SEQ ID NO: 194209 - RNA, 23 nt, Human
ggcucacugcaacguccgccucc

SEQ ID NO: 194210 - RNA, 32 nt, Human
ggcucacugcaacguccgccucccagguucaa

SEQ ID NO: 194211 - RNA, 32 nt, Human
ggcucacugcaacguccgccucccggguugac

SEQ ID NO: 194212 - RNA, 24 nt, Human
ggcucacugcaacguccgccuccu

SEQ ID NO: 194213 - RNA, 32 nt, Human
ggcucacugcaacguccgccuccuggguucaa

SEQ ID NO: 194214 - RNA, 24 nt, Human
ggcucacugcaacgucugccuccu

SEQ ID NO: 194215 - RNA, 32 nt, Human
ggcucacugcaacgucugccuccuggguucaa

SEQ ID NO: 194216 - RNA, 24 nt, Human
ggcucacugcaacuaccaccuccu

SEQ ID NO: 194217 - RNA, 32 nt, Human
ggcucacugcaacuaccaccuccuggguucaa

SEQ ID NO: 194218 - RNA, 22 nt, Human
ggcucacugcaacuccaccucc

SEQ ID NO: 194219 - RNA, 32 nt, Human
ggcucacugcaacuccaccucccggguucacg

SEQ ID NO: 194220 - RNA, 32 nt, Human
ggcucacugcaacucugccucccggguucaag

SEQ ID NO: 194221 - RNA, 32 nt, Human
ggcucacugcaacucugcuucccagguucaag

SEQ ID NO: 194222 - RNA, 32 nt, Human
ggcucacugcaacugcagccucccggguucag

SEQ ID NO: 194223 - RNA, 23 nt, Human
ggcucacugcaacuuccaccucc

SEQ ID NO: 194224 - RNA, 32 nt, Human
ggcucacugcaacuuccaccucccggguucaa

SEQ ID NO: 194225 - RNA, 24 nt, Human
ggcucacugcaacuuccaccuccu

SEQ ID NO: 194226 - RNA, 23 nt, Human
ggcucacugcaacuuccaccucu

SEQ ID NO: 194227 - RNA, 32 nt, Human
ggcucacugcaacuuccaccucugggaucaag

SEQ ID NO: 194228 - RNA, 23 nt, Human
ggcucacugcaacuuccacuucc

SEQ ID NO: 194229 - RNA, 32 nt, Human
ggcucacugcaacuuccacuucccggguucaa

SEQ ID NO: 194230 - RNA, 32 nt, Human
ggcucacugcaacuuccgccucccggguucaa

SEQ ID NO: 194231 - RNA, 32 nt, Human
ggcucacugcaacuuccgccucccgguuucaa

SEQ ID NO: 194232 - RNA, 24 nt, Human
ggcucacugcaacuuccgccuccu

SEQ ID NO: 194233 - RNA, 32 nt, Human
ggcucacugcaacuuccgccuccugggaucaa

SEQ ID NO: 194234 - RNA, 32 nt, Human
ggcucacugcaacuuccgccuccuguguucaa

SEQ ID NO: 194235 - RNA, 32 nt, Human
ggcucacugcaacuuccgucucccggguucaa

SEQ ID NO: 194236 - RNA, 24 nt, Human
ggcucacugcaacuucuaccaccu

SEQ ID NO: 194237 - RNA, 32 nt, Human
ggcucacugcaacuucuaccaccuagguucaa

SEQ ID NO: 194238 - RNA, 23 nt, Human
ggcucacugcaacuucuaccucc

SEQ ID NO: 194239 - RNA, 32 nt, Human
ggcucacugcaacuucuaccuccgagguucaa

SEQ ID NO: 194240 - RNA, 24 nt, Human
ggcucacugcaacuucugccaccu

SEQ ID NO: 194241 - RNA, 32 nt, Human
ggcucacugcaacuucugccaccuggguucaa

SEQ ID NO: 194242 - RNA, 23 nt, Human
ggcucacugcaacuucugccucc

SEQ ID NO: 194243 - RNA, 32 nt, Human
ggcucacugcaacuucugccucccaugcuuac

SEQ ID NO: 194244 - RNA, 32 nt, Human
ggcucacugcaacuucugccucccggguucaa

SEQ ID NO: 194245 - RNA, 24 nt, Human
ggcucacugcaacuucugccuccu

SEQ ID NO: 194246 - RNA, 32 nt, Human
ggcucacugcaacuucugccuccuagguucaa

SEQ ID NO: 194247 - RNA, 24 nt, Human
ggcucacugcaacuucugccucuu

SEQ ID NO: 194248 - RNA, 32 nt, Human
ggcucacugcaacuucugccucuuggguucaa

SEQ ID NO: 194249 - RNA, 32 nt, Human
ggcucacugcaacuucugccuuccagguucaa

SEQ ID NO: 194250 - RNA, 32 nt, Human
ggcucacugcaacuugggccucccagguucaa

SEQ ID NO: 194251 - RNA, 23 nt, Human
ggcucacugcaagauccgccucc

SEQ ID NO: 194252 - RNA, 32 nt, Human
ggcucacugcaagauccgccucccggguucau

SEQ ID NO: 194253 - RNA, 32 nt, Human
ggcucacugcaagccccaccucccaaguucac

SEQ ID NO: 194254 - RNA, 24 nt, Human
ggcucacugcaagcccugccuccu

SEQ ID NO: 194255 - RNA, 32 nt, Human
ggcucacugcaagcccugccuccuggguucau

SEQ ID NO: 194256 - RNA, 23 nt, Human
ggcucacugcaagcucagccucc

SEQ ID NO: 194257 - RNA, 23 nt, Human
ggcucacugcaagcuccaccucc

SEQ ID NO: 194258 - RNA, 32 nt, Human
ggcucacugcaagcuccaccucccagguucac

SEQ ID NO: 194259 - RNA, 32 nt, Human
ggcucacugcaagcuccaccucccggguucac

SEQ ID NO: 194260 - RNA, 24 nt, Human
ggcucacugcaagcuccaccuccu

SEQ ID NO: 194261 - RNA, 32 nt, Human
ggcucacugcaagcuccaccuccuggguucaa

SEQ ID NO: 194262 - RNA, 32 nt, Human
ggcucacugcaagcuccaccuccuggguucac

SEQ ID NO: 194263 - RNA, 32 nt, Human
ggcucacugcaagcuccaccuccuggguucau

SEQ ID NO: 194264 - RNA, 32 nt, Human
ggcucacugcaagcuccaucucccagguucac

SEQ ID NO: 194265 - RNA, 19 nt, Human
ggcucacugcaagcuccgc

SEQ ID NO: 194266 - RNA, 21 nt, Human
ggcucacugcaagcuccgccu

SEQ ID NO: 194267 - RNA, 23 nt, Human
ggcucacugcaagcuccgccucc

SEQ ID NO: 194268 - RNA, 32 nt, Human
ggcucacugcaagcuccgccucccagauucac

SEQ ID NO: 194269 - RNA, 32 nt, Human
ggcucacugcaagcuccgccucccaggaucaa

SEQ ID NO: 194270 - RNA, 32 nt, Human
ggcucacugcaagcuccgccucccagguucac

SEQ ID NO: 194271 - RNA, 32 nt, Human
ggcucacugcaagcuccgccucccagguucau

SEQ ID NO: 194272 - RNA, 32 nt, Human
ggcucacugcaagcuccgccucccagguuccc

SEQ ID NO: 194273 - RNA, 32 nt, Human
ggcucacugcaagcuccgccucccgaguucaa

SEQ ID NO: 194274 - RNA, 32 nt, Human
ggcucacugcaagcuccgccucccggauucaa

SEQ ID NO: 194275 - RNA, 32 nt, Human
ggcucacugcaagcuccgccucccggcuucau

SEQ ID NO: 194276 - RNA, 32 nt, Human
ggcucacugcaagcuccgccucccggguucac

SEQ ID NO: 194277 - RNA, 32 nt, Human
ggcucacugcaagcuccgccucccggguucau

SEQ ID NO: 194278 - RNA, 32 nt, Human
ggcucacugcaagcuccgccucccggguucuc

SEQ ID NO: 194279 - RNA, 24 nt, Human
ggcucacugcaagcuccgccuccu

SEQ ID NO: 194280 - RNA, 32 nt, Human
ggcucacugcaagcuccgccuccuggguucaa

SEQ ID NO: 194281 - RNA, 32 nt, Human
ggcucacugcaagcuccgccuccuggguucac

SEQ ID NO: 194282 - RNA, 32 nt, Human
ggcucacugcaagcuccgccuccuggguucau

SEQ ID NO: 194283 - RNA, 32 nt, Human
ggcucacugcaagcuccgccuccuggguugac

SEQ ID NO: 194284 - RNA, 32 nt, Human
ggcucacugcaagcuccgccucucggguucac

SEQ ID NO: 194285 - RNA, 32 nt, Human
ggcucacugcaagcuccgccucucggguuugc

SEQ ID NO: 194286 - RNA, 32 nt, Human
ggcucacugcaagcuccggcucccagguucac

SEQ ID NO: 194287 - RNA, 32 nt, Human
ggcucacugcaagcuccggcucccggguucac

SEQ ID NO: 194288 - RNA, 32 nt, Human
ggcucacugcaagcuccgucugccggguucac

SEQ ID NO: 194289 - RNA, 24 nt, Human
ggcucacugcaagcucggccuccu

SEQ ID NO: 194290 - RNA, 32 nt, Human
ggcucacugcaagcucggccuccuggguucaa

SEQ ID NO: 194291 - RNA, 32 nt, Human
ggcucacugcaagcucugcccuccccggguuc

SEQ ID NO: 194292 - RNA, 23 nt, Human
ggcucacugcaagcucugccucc

SEQ ID NO: 194293 - RNA, 32 nt, Human
ggcucacugcaagcucugccucccagguucac

SEQ ID NO: 194294 - RNA, 32 nt, Human
ggcucacugcaagcucugccucccgggcucac

SEQ ID NO: 194295 - RNA, 32 nt, Human
ggcucacugcaagcucugccucccggguucaa

SEQ ID NO: 194296 - RNA, 32 nt, Human
ggcucacugcaagcucugccucccggguucac

SEQ ID NO: 194297 - RNA, 32 nt, Human
ggcucacugcaagcucugccucccggguucca

SEQ ID NO: 194298 - RNA, 32 nt, Human
ggcucacugcaagcucugccucccgguugcug

SEQ ID NO: 194299 - RNA, 24 nt, Human
ggcucacugcaagcucugccuccu

SEQ ID NO: 194300 - RNA, 32 nt, Human
ggcucacugcaagcucugccuccuggguucaa

SEQ ID NO: 194301 - RNA, 32 nt, Human
ggcucacugcaagcucugccuccuggguucac

SEQ ID NO: 194302 - RNA, 32 nt, Human
ggcucacugcaagcucugccucucggguucac

SEQ ID NO: 194303 - RNA, 32 nt, Human
ggcucacugcaagcucugcguccuggguugac

SEQ ID NO: 194304 - RNA, 32 nt, Human
ggcucacugcaagcucugcuucccagguucac

SEQ ID NO: 194305 - RNA, 32 nt, Human
ggcucacugcaagcuuccccuuccggguucau

SEQ ID NO: 194306 - RNA, 23 nt, Human
ggcucacugcaagcuucgccucc

SEQ ID NO: 194307 - RNA, 32 nt, Human
ggcucacugcaagcuucgccucccggguucac

SEQ ID NO: 194308 - RNA, 23 nt, Human
ggcucacugcaaguuccgccucc

SEQ ID NO: 194309 - RNA, 32 nt, Human
ggcucacugcaaguuccgccucccggguucac

SEQ ID NO: 194310 - RNA, 32 nt, Human
ggcucacugcaaucuccaucucccggguucaa

SEQ ID NO: 194311 - RNA, 23 nt, Human
ggcucacugcaaucuccgccucc

SEQ ID NO: 194312 - RNA, 32 nt, Human
ggcucacugcaaucuccgccucccagguucaa

SEQ ID NO: 194313 - RNA, 32 nt, Human
ggcucacugcaaucuccgccuccccaguucaa

SEQ ID NO: 194314 - RNA, 32 nt, Human
ggcucacugcaaucucuauccccuggguucaa

SEQ ID NO: 194315 - RNA, 23 nt, Human
ggcucacugcaaucucugccucc

SEQ ID NO: 194316 - RNA, 32 nt, Human
ggcucacugcaaucucugccucccaagcaauc

SEQ ID NO: 194317 - RNA, 32 nt, Human
ggcucacugcaaucucugccucccagguucaa

SEQ ID NO: 194318 - RNA, 32 nt, Human
ggcucacugcaaucucugccucccggauucaa

SEQ ID NO: 194319 - RNA, 32 nt, Human
ggcucacugcaaucucugccucccggguucaa

SEQ ID NO: 194320 - RNA, 32 nt, Human
ggcucacugcaaucucugccuccuggguucaa

SEQ ID NO: 194321 - RNA, 32 nt, Human
ggcucacugcaaucucugccucucggguucaa

SEQ ID NO: 194322 - RNA, 32 nt, Human
ggcucacugcaaucucugccuuccggguucaa

SEQ ID NO: 194323 - RNA, 23 nt, Human
ggcucacugcaauuugcgucucc

SEQ ID NO: 194324 - RNA, 32 nt, Human
ggcucacugcacccuccgccuccugggcucaa

SEQ ID NO: 194325 - RNA, 32 nt, Human
ggcucacugcacccucugccucuuggguucaa

SEQ ID NO: 194326 - RNA, 22 nt, Human
ggcucacugcaccuccgccucc

SEQ ID NO: 194327 - RNA, 23 nt, Human
ggcucacugcaccucugccuccu

SEQ ID NO: 194328 - RNA, 24 nt, Human
ggcucacugcagacuucaccuccu

SEQ ID NO: 194329 - RNA, 32 nt, Human
ggcucacugcagacuucaccuccugaguucaa

SEQ ID NO: 194330 - RNA, 32 nt, Human
ggcucacugcagccccaaccuucagggcucag

SEQ ID NO: 194331 - RNA, 32 nt, Human
ggcucacugcagccccgaacuacugggcucaa

SEQ ID NO: 194332 - RNA, 32 nt, Human
ggcucacugcagccccugccucccaggcucaa

SEQ ID NO: 194333 - RNA, 32 nt, Human
ggcucacugcagccuagaccucccagcuggag

SEQ ID NO: 194334 - RNA, 32 nt, Human
ggcucacugcagccucaaacuccugaguccaa

SEQ ID NO: 194335 - RNA, 23 nt, Human
ggcucacugcagccucaaccucc

SEQ ID NO: 194336 - RNA, 32 nt, Human
ggcucacugcagccucaaccucccaggcucaa

SEQ ID NO: 194337 - RNA, 32 nt, Human
ggcucacugcagccucaaccucccagguucaa

SEQ ID NO: 194338 - RNA, 24 nt, Human
ggcucacugcagccucaaccuccu

SEQ ID NO: 194339 - RNA, 32 nt, Human
ggcucacugcagccucaaccuccugagcucaa

SEQ ID NO: 194340 - RNA, 32 nt, Human
ggcucacugcagccucaaccuccuggacucag

SEQ ID NO: 194341 - RNA, 32 nt, Human
ggcucacugcagccucaaccuccugggcuaag

SEQ ID NO: 194342 - RNA, 32 nt, Human
ggcucacugcagccucaaccuccugggcucaa

SEQ ID NO: 194343 - RNA, 24 nt, Human
ggcucacugcagccucaaccugcu

SEQ ID NO: 194344 - RNA, 24 nt, Human
ggcucacugcagccucaaccuucu

SEQ ID NO: 194345 - RNA, 23 nt, Human
ggcucacugcagccucaacuucc

SEQ ID NO: 194346 - RNA, 24 nt, Human
ggcucacugcagccucagcguccu

SEQ ID NO: 194347 - RNA, 23 nt, Human
ggcucacugcagccuccaccucc

SEQ ID NO: 194348 - RNA, 32 nt, Human
ggcucacugcagccuccaccucccaggcucaa

SEQ ID NO: 194349 - RNA, 32 nt, Human
ggcucacugcagccuccaccucccagguucaa

SEQ ID NO: 194350 - RNA, 32 nt, Human
ggcucacugcagccuccaccuccccgguucca

SEQ ID NO: 194351 - RNA, 32 nt, Human
ggcucacugcagccuccaccucccggguucaa

SEQ ID NO: 194352 - RNA, 24 nt, Human
ggcucacugcagccuccaccuccu

SEQ ID NO: 194353 - RNA, 32 nt, Human
ggcucacugcagccuccaccuccugggcucaa

SEQ ID NO: 194354 - RNA, 32 nt, Human
ggcucacugcagccuccaccuccugggcucuc

SEQ ID NO: 194355 - RNA, 32 nt, Human
ggcucacugcagccuccaccuccuugacucgc

SEQ ID NO: 194356 - RNA, 32 nt, Human
ggcucacugcagccuccaucucccggggcuca

SEQ ID NO: 194357 - RNA, 23 nt, Human
ggcucacugcagccuccgccucc

SEQ ID NO: 194358 - RNA, 32 nt, Human
ggcucacugcagccuccgccucccagguucaa

SEQ ID NO: 194359 - RNA, 32 nt, Human
ggcucacugcagccuccgccucccggguucaa

SEQ ID NO: 194360 - RNA, 32 nt, Human
ggcucacugcagccuccgccucccguauucaa

SEQ ID NO: 194361 - RNA, 32 nt, Human
ggcucacugcagccuccgccucccugguucaa

SEQ ID NO: 194362 - RNA, 32 nt, Human
ggcucacugcagccuccgccugccgggucaag

SEQ ID NO: 194363 - RNA, 32 nt, Human
ggcucacugcagccuccgccuucuggguucaa

SEQ ID NO: 194364 - RNA, 32 nt, Human
ggcucacugcagccuccuucuccuggguccaa

SEQ ID NO: 194365 - RNA, 32 nt, Human
ggcucacugcagccucgaacuccugggcucaa

SEQ ID NO: 194366 - RNA, 23 nt, Human
ggcucacugcagccucgaccucc

SEQ ID NO: 194367 - RNA, 32 nt, Human
ggcucacugcagccucgaccucccaggcucaa

SEQ ID NO: 194368 - RNA, 24 nt, Human
ggcucacugcagccucgaccuccu

SEQ ID NO: 194369 - RNA, 32 nt, Human
ggcucacugcagccucgaccuccugggcucaa

SEQ ID NO: 194370 - RNA, 32 nt, Human
ggcucacugcagccucgagcuccugagcucaa

SEQ ID NO: 194371 - RNA, 23 nt, Human
ggcucacugcagccucuaccucc

SEQ ID NO: 194372 - RNA, 23 nt, Human
ggcucacugcagccucugccucc

SEQ ID NO: 194373 - RNA, 32 nt, Human
ggcucacugcagccucugccucccaggcucaa

SEQ ID NO: 194374 - RNA, 32 nt, Human
ggcucacugcagccucugccucccagguucaa

SEQ ID NO: 194375 - RNA, 32 nt, Human
ggcucacugcagccucugccucccggguucaa

SEQ ID NO: 194376 - RNA, 24 nt, Human
ggcucacugcagccucugccuccu

SEQ ID NO: 194377 - RNA, 32 nt, Human
ggcucacugcagccucugccuccugaguagcu

SEQ ID NO: 194378 - RNA, 32 nt, Human
ggcucacugcagccucugccuccuggguucaa

SEQ ID NO: 194379 - RNA, 32 nt, Human
ggcucacugcagccucugccuccuggguucca

SEQ ID NO: 194380 - RNA, 23 nt, Human
ggcucacugcagccugcgccucc

SEQ ID NO: 194381 - RNA, 32 nt, Human
ggcucacugcagccugcgccucccagcgucca

SEQ ID NO: 194382 - RNA, 32 nt, Human
ggcucacugcagccuggaccuccugguucaag

SEQ ID NO: 194383 - RNA, 32 nt, Human
ggcucacugcagccuggagcuccugggcacaa

SEQ ID NO: 194384 - RNA, 23 nt, Human
ggcucacugcagccuucaccucc

SEQ ID NO: 194385 - RNA, 32 nt, Human
ggcucacugcagccuucaccucccggguucaa

SEQ ID NO: 194386 - RNA, 23 nt, Human
ggcucacugcagccuucgccucc

SEQ ID NO: 194387 - RNA, 32 nt, Human
ggcucacugcagccuucgccucccggguucaa

SEQ ID NO: 194388 - RNA, 32 nt, Human
ggcucacugcagccuugaacucccagacucaa

SEQ ID NO: 194389 - RNA, 32 nt, Human
ggcucacugcagccuugaacuccugagcucaa

SEQ ID NO: 194390 - RNA, 32 nt, Human
ggcucacugcagccuugaccucccaggcucaa

SEQ ID NO: 194391 - RNA, 32 nt, Human
ggcucacugcagccuugacuucccaggcucag

SEQ ID NO: 194392 - RNA, 32 nt, Human
ggcucacugcagccuuugccucccggguucaa

SEQ ID NO: 194393 - RNA, 21 nt, Human
ggcucacugcagcgcgcuccu

SEQ ID NO: 194394 - RNA, 32 nt, Human
ggcucacugcagcuuaagcucacugccugggc

SEQ ID NO: 194395 - RNA, 32 nt, Human
ggcucacugcagcuucaaacuccugggcucaa

SEQ ID NO: 194396 - RNA, 32 nt, Human
ggcucacugcagcuuugacuucccaggcucaa

SEQ ID NO: 194397 - RNA, 23 nt, Human
ggcucacugcaggcucugccucc

SEQ ID NO: 194398 - RNA, 32 nt, Human
ggcucacugcaggcucugccucccgguuucaa

SEQ ID NO: 194399 - RNA, 24 nt, Human
ggcucacugcaggcucugccuccu

SEQ ID NO: 194400 - RNA, 32 nt, Human
ggcucacugcaggcucugccuccuggguucac

SEQ ID NO: 194401 - RNA, 24 nt, Human
ggcucacugcagucuccaccuccu

SEQ ID NO: 194402 - RNA, 23 nt, Human
ggcucacugcagucucgaccucc

SEQ ID NO: 194403 - RNA, 32 nt, Human
ggcucacugcagucucugccucccagauggaa

SEQ ID NO: 194404 - RNA, 32 nt, Human
ggcucacugcagucucugccucccaggcucaa

SEQ ID NO: 194405 - RNA, 23 nt, Human
ggcucacugcagucuucaccucc

SEQ ID NO: 194406 - RNA, 23 nt, Human
ggcucacugcaguuucaaccucc

SEQ ID NO: 194407 - RNA, 32 nt, Human
ggcucacugcaguuucaaccucccagauucca

SEQ ID NO: 194408 - RNA, 23 nt, Human
ggcucacugcaguuuugaccucc

SEQ ID NO: 194409 - RNA, 32 nt, Human
ggcucacugcaguuuugaccucccaggcucaa

SEQ ID NO: 194410 - RNA, 24 nt, Human
ggcucacugcauccucaaccuccu

SEQ ID NO: 194411 - RNA, 32 nt, Human
ggcucacugcauccucaaccuccuggguucag

SEQ ID NO: 194412 - RNA, 24 nt, Human
ggcucacugcauccuccaccuccu

SEQ ID NO: 194413 - RNA, 32 nt, Human
ggcucacugcauccuccaccuccuggguucaa

SEQ ID NO: 194414 - RNA, 23 nt, Human
ggcucacugcauccuccgccucc

SEQ ID NO: 194415 - RNA, 32 nt, Human
ggcucacugcauccuccgccucccggguucaa

SEQ ID NO: 194416 - RNA, 32 nt, Human
ggcucacugcauccuccgccuuccagguuuaa

SEQ ID NO: 194417 - RNA, 23 nt, Human
ggcucacugcauccucugccucc

SEQ ID NO: 194418 - RNA, 32 nt, Human
ggcucacugcauccucugccucccggguucaa

SEQ ID NO: 194419 - RNA, 24 nt, Human
ggcucacugcauccucugccuccu

SEQ ID NO: 194420 - RNA, 32 nt, Human
ggcucacugcauccucugccuccuggguucaa

SEQ ID NO: 194421 - RNA, 32 nt, Human
ggcucacugcaucuccggcuccuggacucaag

SEQ ID NO: 194422 - RNA, 23 nt, Human
ggcucacugcaucuuccgccucc

SEQ ID NO: 194423 - RNA, 32 nt, Human
ggcucacugcaucuuccgccucccggguucaa

SEQ ID NO: 194424 - RNA, 21 nt, Human
ggcucacugcaugcagccccu

SEQ ID NO: 194425 - RNA, 23 nt, Human
ggcucacugcaugcagccccugg

SEQ ID NO: 194426 - RNA, 32 nt, Human
ggcucacugcaugcucugccacuuggguucaa

SEQ ID NO: 194427 - RNA, 32 nt, Human
ggcucacugccaccccucuuugguccagcugu

SEQ ID NO: 194428 - RNA, 23 nt, Human
ggcucacugccaccuccaccucc

SEQ ID NO: 194429 - RNA, 32 nt, Human
ggcucacugccaccucugccucccagguucaa

SEQ ID NO: 194430 - RNA, 32 nt, Human
ggcucacugccaggccagccuccgagagggag

SEQ ID NO: 194431 - RNA, 23 nt, Human
ggcucacugccgccucaaccucu

SEQ ID NO: 194432 - RNA, 32 nt, Human
ggcucacugccuccuguuccagcuccugcugc

SEQ ID NO: 194433 - RNA, 32 nt, Human
ggcucacugcgaccuccgucucccgggcucac

SEQ ID NO: 194434 - RNA, 24 nt, Human
ggcucacugcgaccucggccuccu

SEQ ID NO: 194435 - RNA, 32 nt, Human
ggcucacugcgaccucggccuccuggauucaa

SEQ ID NO: 194436 - RNA, 32 nt, Human
ggcucacugcgaccucugccucccagguucaa

SEQ ID NO: 194437 - RNA, 32 nt, Human
ggcucacugcgaccucugcuuccuggguucaa

SEQ ID NO: 194438 - RNA, 32 nt, Human
ggcucacugcgagcuccaccucucggguucac

SEQ ID NO: 194439 - RNA, 32 nt, Human
ggcucacugcgagcucugccuccuggguucaa

SEQ ID NO: 194440 - RNA, 32 nt, Human
ggcucacugcggccucugccucccggcuucaa

SEQ ID NO: 194441 - RNA, 32 nt, Human
ggcucacugcuaccuccgccucccagguucag

SEQ ID NO: 194442 - RNA, 20 nt, Human
ggcucacugcugcaaccucc

SEQ ID NO: 194443 - RNA, 32 nt, Human
ggcucacuggaacucaggcucaagcaauccuc

SEQ ID NO: 194444 - RNA, 24 nt, Human
ggcucacuguaaacucaagcuccu

SEQ ID NO: 194445 - RNA, 23 nt, Human
ggcucacuguaaccuccaccucc

SEQ ID NO: 194446 - RNA, 32 nt, Human
ggcucacuguaaccuccaccucccaggcucaa

SEQ ID NO: 194447 - RNA, 32 nt, Human
ggcucacuguaaccuccaccuccuggguucac

SEQ ID NO: 194448 - RNA, 32 nt, Human
ggcucacuguaaccuccgacuccuggguucaa

SEQ ID NO: 194449 - RNA, 23 nt, Human
ggcucacuguaaccuccgccucc

SEQ ID NO: 194450 - RNA, 32 nt, Human
ggcucacuguaaccuccgccucccagguucaa

SEQ ID NO: 194451 - RNA, 32 nt, Human
ggcucacuguaaccuccgccucccggguucaa

SEQ ID NO: 194452 - RNA, 24 nt, Human
ggcucacuguaaccuccgccuccu

SEQ ID NO: 194453 - RNA, 32 nt, Human
ggcucacuguaaccuccgccuccugaauucaa

SEQ ID NO: 194454 - RNA, 32 nt, Human
ggcucacuguaaccuccgccuccuggguucaa

SEQ ID NO: 194455 - RNA, 23 nt, Human
ggcucacuguaaccucugccucc

SEQ ID NO: 194456 - RNA, 32 nt, Human
ggcucacuguaaccucugccuccaggauucaa

SEQ ID NO: 194457 - RNA, 32 nt, Human
ggcucacuguaaccucugccucccaggcucga

SEQ ID NO: 194458 - RNA, 32 nt, Human
ggcucacuguaaccucugccucccaguucaag

SEQ ID NO: 194459 - RNA, 32 nt, Human
ggcucacuguaaccucugccuccugccucccg

SEQ ID NO: 194460 - RNA, 32 nt, Human
ggcucacuguaaccuucaccuacuggguucaa

SEQ ID NO: 194461 - RNA, 32 nt, Human
ggcucacuguaacuuccacuugccaggcucaa

SEQ ID NO: 194462 - RNA, 23 nt, Human
ggcucacuguaagcuccgccucc

SEQ ID NO: 194463 - RNA, 32 nt, Human
ggcucacuguaagcuccgccucccggguucac

SEQ ID NO: 194464 - RNA, 24 nt, Human
ggcucacuguaaucuccgccuccu

SEQ ID NO: 194465 - RNA, 32 nt, Human
ggcucacuguaaucuccgccuccuggguucaa

SEQ ID NO: 194466 - RNA, 32 nt, Human
ggcucacuguagccacaaccucucaggcucaa

SEQ ID NO: 194467 - RNA, 24 nt, Human
ggcucacuguagccucaaccugcc

SEQ ID NO: 194468 - RNA, 23 nt, Human
ggcucacuguagccuccaccucc

SEQ ID NO: 194469 - RNA, 32 nt, Human
ggcucacuguagccucgaccuccugggcucaa

SEQ ID NO: 194470 - RNA, 23 nt, Human
ggcucacuguagccucugccucc

SEQ ID NO: 194471 - RNA, 24 nt, Human
ggcucacuguagucucaaccuccu

SEQ ID NO: 194472 - RNA, 32 nt, Human
ggcucacuguagucucaaccuccugggcucaa

SEQ ID NO: 194473 - RNA, 23 nt, Human
ggcucacuguagucucgaccucc

SEQ ID NO: 194474 - RNA, 32 nt, Human
ggcucacuguagucucgaccucccaggcucaa

SEQ ID NO: 194475 - RNA, 24 nt, Human
ggcucacugugaccuccgccuccu

SEQ ID NO: 194476 - RNA, 32 nt, Human
ggcucacugugaccuccgccucucggguucaa

SEQ ID NO: 194477 - RNA, 32 nt, Human
ggcucacugugaccucugccuccuggguuuaa

SEQ ID NO: 194478 - RNA, 32 nt, Human
ggcucacuguucgcaggggagcauuuuggaac

SEQ ID NO: 194479 - RNA, 32 nt, Human
ggcucacuucaaacuccgccucccggguucaa

SEQ ID NO: 194480 - RNA, 32 nt, Human
ggcucacuucaaccuccgcccccaagguucaa

SEQ ID NO: 194481 - RNA, 32 nt, Human
ggcucacuucuuuggugauacacuguagccac

SEQ ID NO: 194482 - RNA, 32 nt, Human
ggcucacuuuaaccuccacuucccugguucaa

SEQ ID NO: 194483 - RNA, 31 nt, Human
ggcucagaaauaauugcucuguugaaaauaa

SEQ ID NO: 194484 - RNA, 21 nt, Human
ggcucagaacacggccaggua

SEQ ID NO: 194485 - RNA, 32 nt, Human
ggcucagaagacacaggagcugcccugggugu

SEQ ID NO: 194486 - RNA, 32 nt, Human
ggcucagaagcacagcagcgccaucuuuccgu

SEQ ID NO: 194487 - RNA, 32 nt, Human
ggcucagaagcaggggccacagcuggaguaaa

SEQ ID NO: 194488 - RNA, 32 nt, Human
ggcucagaagccagcuacccagcuucgacugu

SEQ ID NO: 194489 - RNA, 21 nt, Human
ggcucagaaggcagcaucacc

SEQ ID NO: 194490 - RNA, 21 nt, Human
ggcucagacacugggcuccca

SEQ ID NO: 194491 - RNA, 32 nt, Human
ggcucagaccuauaaucccagcacuuugggag

SEQ ID NO: 194492 - RNA, 22 nt, Human
ggcucagaccucauuucaggca

SEQ ID NO: 194493 - RNA, 32 nt, Human
ggcucagaccuguaaucccagaacuuugggag

SEQ ID NO: 194494 - RNA, 32 nt, Human
ggcucagagaauaaagguagcuaaucucauca

SEQ ID NO: 194495 - RNA, 32 nt, Human
ggcucagagacaagcagaaucucucuauggag

SEQ ID NO: 194496 - RNA, 31 nt, Human
ggcucagagagaccugguguugacucuggaa

SEQ ID NO: 194497 - RNA, 32 nt, Human
ggcucagagcaaccuccagccuucuccagcag

SEQ ID NO: 194498 - RNA, 32 nt, Human
ggcucagagccaccccugcacccccggcacac

SEQ ID NO: 194499 - RNA, 21 nt, Human
ggcucagagcccucugccuca

SEQ ID NO: 194500 - RNA, 32 nt, Human
ggcucagaggcaggcgaggucccugauucacu

SEQ ID NO: 194501 - RNA, 32 nt, Human
ggcucagagggaccucaccccugagcagguca

SEQ ID NO: 194502 - RNA, 18 nt, Human
ggcucagagggcuacaga

SEQ ID NO: 194503 - RNA, 16 nt, Human
ggcucagaggggguag

SEQ ID NO: 194504 - RNA, 32 nt, Human
ggcucagaguccaauguaccauguugcccaga

SEQ ID NO: 194505 - RNA, 32 nt, Human
ggcucagagugcaggccguggggcgcgagggu

SEQ ID NO: 194506 - RNA, 20 nt, Human
ggcucagaucuggccaggug

SEQ ID NO: 194507 - RNA, 24 nt, Human
ggcucagaugguccuccugccuca

SEQ ID NO: 194508 - RNA, 32 nt, Human
ggcucagcaaacagcccucccucccaguauuu

SEQ ID NO: 194509 - RNA, 32 nt, Human
ggcucagcaaauucaaucccacccuuaccaau

SEQ ID NO: 194510 - RNA, 31 nt, Human
ggcucagcaaugucuucgaccacguggugag

SEQ ID NO: 194511 - RNA, 32 nt, Human
ggcucagcacagaaagaggaaggacagcacag

SEQ ID NO: 194512 - RNA, 32 nt, Human
ggcucagcacgaccacacaggacacccagcca

SEQ ID NO: 194513 - RNA, 32 nt, Human
ggcucagcagaggugggaucccacgcccccuc

SEQ ID NO: 194514 - RNA, 18 nt, Human
ggcucagcagccagagga

SEQ ID NO: 194515 - RNA, 32 nt, Human
ggcucagcagcgcaacugcgaggacaugaucc

SEQ ID NO: 194516 - RNA, 32 nt, Human
ggcucagcagcuccugaguuccuaaugcucag

SEQ ID NO: 194517 - RNA, 18 nt, Human
ggcucagcaggggggcag

SEQ ID NO: 194518 - RNA, 19 nt, Human
ggcucagcauggccaggug

SEQ ID NO: 194519 - RNA, 20 nt, Human
ggcucagcaugggcucagca

SEQ ID NO: 194520 - RNA, 32 nt, Human
ggcucagccaaugcugcccagccugagggucc

SEQ ID NO: 194521 - RNA, 32 nt, Human
ggcucagccagaaccucuugguguacccgaua

SEQ ID NO: 194522 - RNA, 32 nt, Human
ggcucagccauguccccuccccagguccuuca

SEQ ID NO: 194523 - RNA, 32 nt, Human
ggcucagcccaccccuccaccucucucucgau

SEQ ID NO: 194524 - RNA, 22 nt, Human
ggcucagcccaggccaccaacu

SEQ ID NO: 194525 - RNA, 19 nt, Human
ggcucagccccggcggcag

SEQ ID NO: 194526 - RNA, 32 nt, Human
ggcucagccuccagauuaacugggucucacuc

SEQ ID NO: 194527 - RNA, 20 nt, Human
ggcucagccucuggguccag

SEQ ID NO: 194528 - RNA, 21 nt, Human
ggcucagccuuguaaucccag

SEQ ID NO: 194529 - RNA, 32 nt, Human
ggcucagcggggcugcaccaaggggccaagag

SEQ ID NO: 194530 - RNA, 32 nt, Human
ggcucagcucagcucuccuccucuagcucaau

SEQ ID NO: 194531 - RNA, 32 nt, Human
ggcucagcugaccgagcggaaagccagagggg

SEQ ID NO: 194532 - RNA, 32 nt, Human
ggcucagcugcuucagggaaugugucccuccc

SEQ ID NO: 194533 - RNA, 32 nt, Human
ggcucagcuucuaaucccagcacuuugguagg

SEQ ID NO: 194534 - RNA, 18 nt, Human
ggcucagcuuggauuugu

SEQ ID NO: 194535 - RNA, 32 nt, Human
ggcucaggaaaacgggaccggccaggccaccu

SEQ ID NO: 194536 - RNA, 32 nt, Human
ggcucaggaaccacacugagcuugagauacug

SEQ ID NO: 194537 - RNA, 32 nt, Human
ggcucaggacagccacucacccucucugugcu

SEQ ID NO: 194538 - RNA, 20 nt, Human
ggcucaggacguuuuaccca

SEQ ID NO: 194539 - RNA, 17 nt, Human
ggcucaggacuagagga

SEQ ID NO: 194540 - RNA, 32 nt, Human
ggcucaggagagaagggagcagcuggcaugug

SEQ ID NO: 194541 - RNA, 21 nt, Human
ggcucaggagcccuaccuccc

SEQ ID NO: 194542 - RNA, 18 nt, Human
ggcucaggagcucauaga

SEQ ID NO: 194543 - RNA, 21 nt, Human
ggcucaggauguccacaucca

SEQ ID NO: 194544 - RNA, 32 nt, Human
ggcucaggauuccgcuggaagaaucucagcca

SEQ ID NO: 194545 - RNA, 24 nt, Human
ggcucaggcaauccuccugccuca

SEQ ID NO: 194546 - RNA, 32 nt, Human
ggcucaggcacucgggaacacacacaugaaau

SEQ ID NO: 194547 - RNA, 21 nt, Human
ggcucaggcagacucaccuca

SEQ ID NO: 194548 - RNA, 32 nt, Human
ggcucaggcagguccugugcugugcugcaggc

SEQ ID NO: 194549 - RNA, 32 nt, Human
ggcucaggccagcauccuagggagcuugaguc

SEQ ID NO: 194550 - RNA, 32 nt, Human
ggcucaggccccguaccgugugcaaugggcgg

SEQ ID NO: 194551 - RNA, 32 nt, Human
ggcucaggccuauaaucccaguacuuugggag

SEQ ID NO: 194552 - RNA, 18 nt, Human
ggcucaggccugggucua

SEQ ID NO: 194553 - RNA, 32 nt, Human
ggcucaggccuggucauugccuccucagcacu

SEQ ID NO: 194554 - RNA, 32 nt, Human
ggcucaggccuguaaccccaguacuuugggag

SEQ ID NO: 194555 - RNA, 32 nt, Human
ggcucaggccuguaaccucagcacuuugguga

SEQ ID NO: 194556 - RNA, 32 nt, Human
ggcucaggccuguaaucccaacacuuugggag

SEQ ID NO: 194557 - RNA, 32 nt, Human
ggcucaggccuguaaucccaacccuuuggaag

SEQ ID NO: 194558 - RNA, 32 nt, Human
ggcucaggccuguaaucccagcacucugggag

SEQ ID NO: 194559 - RNA, 32 nt, Human
ggcucaggccuguaaucccagcacugugggag

SEQ ID NO: 194560 - RNA, 32 nt, Human
ggcucaggccuguaaucccagcacuucaggaa

SEQ ID NO: 194561 - RNA, 32 nt, Human
ggcucaggccuguaaucccagcacuuuccaag

SEQ ID NO: 194562 - RNA, 32 nt, Human
ggcucaggccuguaaucccagcacuuugggaa

SEQ ID NO: 194563 - RNA, 32 nt, Human
ggcucaggccuguaaucccagcacuuugggag

SEQ ID NO: 194564 - RNA, 32 nt, Human
ggcucaggccuguaaucccagcauuuucagag

SEQ ID NO: 194565 - RNA, 32 nt, Human
ggcucaggccuguaaucccagcauuuugggag

SEQ ID NO: 194566 - RNA, 32 nt, Human
ggcucaggccuguaaucccagcuacuagggag

SEQ ID NO: 194567 - RNA, 32 nt, Human
ggcucaggccuguaauccuaacacuuugggag

SEQ ID NO: 194568 - RNA, 32 nt, Human
ggcucaggccuguaauccuggcacuuugggag

SEQ ID NO: 194569 - RNA, 32 nt, Human
ggcucaggccugugaucccagcacuuugggag

SEQ ID NO: 194570 - RNA, 17 nt, Human
ggcucaggcgcugccca

SEQ ID NO: 194571 - RNA, 18 nt, Human
ggcucaggcggccccacc

SEQ ID NO: 194572 - RNA, 20 nt, Human
ggcucaggcggggcauccua

SEQ ID NO: 194573 - RNA, 22 nt, Human
ggcucaggcucagagccucuca

SEQ ID NO: 194574 - RNA, 32 nt, Human
ggcucaggcugcagaacagcguagaccaggga

SEQ ID NO: 194575 - RNA, 23 nt, Human
ggcucaggcuggcccccacauca

SEQ ID NO: 194576 - RNA, 20 nt, Human
ggcucaggcugucagaguga

SEQ ID NO: 194577 - RNA, 32 nt, Human
ggcucagggaacaguugauaucaacagucucu

SEQ ID NO: 194578 - RNA, 21 nt, Human
ggcucagggagcaggaggcug

SEQ ID NO: 194579 - RNA, 32 nt, Human
ggcucagggaugaccuugcccauagccuuggc

SEQ ID NO: 194580 - RNA, 32 nt, Human
ggcucagggccaggcuguugaccugagaacac

SEQ ID NO: 194581 - RNA, 32 nt, Human
ggcucagggccccugacugcauggugcaugag

SEQ ID NO: 194582 - RNA, 32 nt, Human
ggcucagggccuuccccacagaucuaaggacu

SEQ ID NO: 194583 - RNA, 32 nt, Human
ggcucagggcuggaacugcugccugauuccug

SEQ ID NO: 194584 - RNA, 23 nt, Human
ggcucaggggacuguccaccuca

SEQ ID NO: 194585 - RNA, 24 nt, Human
ggcucagguaaucuucccacuuca

SEQ ID NO: 194586 - RNA, 32 nt, Human
ggcucaggucugucccgcugcccugggcacga

SEQ ID NO: 194587 - RNA, 32 nt, Human
ggcuuaugccuguaauccuagaacuuugggag

SEQ ID NO: 194588 - RNA, 32 nt, Human
ggcuuaugccuguaauccuagcgcuuugggag

SEQ ID NO: 194589 - RNA, 32 nt, Human
ggcuuaugccuguaauugcagcacuuuuagag

SEQ ID NO: 194590 - RNA, 32 nt, Human
ggcuuaugccuguagucgcagcuacucagaag

SEQ ID NO: 194591 - RNA, 32 nt, Human
ggcuuaugcuuguaaucccaacacuuagggag

SEQ ID NO: 194592 - RNA, 32 nt, Human
ggcuuaugcuuguaaucccagaacuuugggaa

SEQ ID NO: 194593 - RNA, 32 nt, Human
ggcuuaugcuuguaaucccagcacuuugggag

SEQ ID NO: 194594 - RNA, 23 nt, Human
ggcuuauggcaaccuccgccucc

SEQ ID NO: 194595 - RNA, 32 nt, Human
ggcuuauggcaaccuccgccucccggguucaa

SEQ ID NO: 194596 - RNA, 32 nt, Human
ggcuuauggguggagguugggaagaggaugaa

SEQ ID NO: 194597 - RNA, 32 nt, Human
ggcuuauugaagccucugccuccuggguucaa

SEQ ID NO: 194598 - RNA, 32 nt, Human
ggcuuauugcaaccuccgcuuccuggguucaa

SEQ ID NO: 194599 - RNA, 22 nt, Human
ggcuuauuggaugaaacagugu

SEQ ID NO: 194600 - RNA, 32 nt, Human
ggcuuauuucaggcugacagcuggacccucug

SEQ ID NO: 194601 - RNA, 32 nt, Human
ggcuuauuuuacaaggauguuggcaaacgaac

SEQ ID NO: 194602 - RNA, 32 nt, Human
ggcuucaaaccaccuggaaugcacagcucagg

SEQ ID NO: 194603 - RNA, 31 nt, Human
ggcuucaagaacacaaccuuaggaccuuggg

SEQ ID NO: 194604 - RNA, 25 nt, Human
ggcuucaagcaguccuccugccuca

SEQ ID NO: 194605 - RNA, 32 nt, Human
ggcuucaaggugguaacagagagagcugcaga

SEQ ID NO: 194606 - RNA, 24 nt, Human
ggcuucaagugauccucuugcuuu

SEQ ID NO: 194607 - RNA, 32 nt, Human
ggcuucaaugccuaucgguagcaagccaugga

SEQ ID NO: 194608 - RNA, 32 nt, Human
ggcuucaauuugaaggaggaggaaugauggga

SEQ ID NO: 194609 - RNA, 32 nt, Human
ggcuucacaacguguccugccggggcaacgag

SEQ ID NO: 194610 - RNA, 32 nt, Human
ggcuucacaagucacgagauggcaguuuugga

SEQ ID NO: 194611 - RNA, 32 nt, Human
ggcuucacaccaauacccuguguauacaagaa

SEQ ID NO: 194612 - RNA, 32 nt, Human
ggcuucacagccgcccucaccgcccggccuuc

SEQ ID NO: 194613 - RNA, 32 nt, Human
ggcuucacauggcauuugucugucucuguguc

SEQ ID NO: 194614 - RNA, 32 nt, Human
ggcuucaccgagauaaggaggugccacuguag

SEQ ID NO: 194615 - RNA, 32 nt, Human
ggcuucaccugacauuauggaccucagaccug

SEQ ID NO: 194616 - RNA, 32 nt, Human
ggcuucacgccuguaauucuagcacuuuggga

SEQ ID NO: 194617 - RNA, 32 nt, Human
ggcuucacucccaaaagugcagccaggcccug

SEQ ID NO: 194618 - RNA, 32 nt, Human
ggcuucacugcagcggccuccacccaccuauu

SEQ ID NO: 194619 - RNA, 32 nt, Human
ggcuucagagagggagaagcacugugaggccu

SEQ ID NO: 194620 - RNA, 32 nt, Human
ggcuucagagcaccuuccuagccauggacacg

SEQ ID NO: 194621 - RNA, 32 nt, Human
ggcuucagagguggaagauaaacagugacggg

SEQ ID NO: 194622 - RNA, 32 nt, Human
ggcuucagcacaacagacaccagccugugguc

SEQ ID NO: 194623 - RNA, 22 nt, Human
ggcuucagcaccgcgcccaugg

SEQ ID NO: 194624 - RNA, 17 nt, Human
ggcuucagcacugcagc

SEQ ID NO: 194625 - RNA, 32 nt, Human
ggcuucagcaggaagcccagggacagcagagc

SEQ ID NO: 194626 - RNA, 32 nt, Human
ggcuucagccaccacacccagccucauucaua

SEQ ID NO: 194627 - RNA, 32 nt, Human
ggcuucagccuccccaccuucuucagccaccu

SEQ ID NO: 194628 - RNA, 25 nt, Human
ggcuucagccugcuugcuuguggug

SEQ ID NO: 194629 - RNA, 19 nt, Human
ggcuucagcgagccgcagg

SEQ ID NO: 194630 - RNA, 19 nt, Human
ggcuucagcugccauggcc

SEQ ID NO: 194631 - RNA, 32 nt, Human
ggcuucagcugcguggucaccaaccgauucga

SEQ ID NO: 194632 - RNA, 19 nt, Human
ggcuucaggacgcgggagg

SEQ ID NO: 194633 - RNA, 32 nt, Human
ggcuucaggauuccaaagagagugagaguaga

SEQ ID NO: 194634 - RNA, 32 nt, Human
ggcuucaggcauggccaugagcaagaccagca

SEQ ID NO: 194635 - RNA, 21 nt, Human
ggcuucaggcugagguggcag

SEQ ID NO: 194636 - RNA, 23 nt, Human
ggcuucagggagggaaacugugu

SEQ ID NO: 194637 - RNA, 32 nt, Human
ggcuucaggugggacugcucagaaagugggcc

SEQ ID NO: 194638 - RNA, 23 nt, Human
ggcuucagugucuguucucugga

SEQ ID NO: 194639 - RNA, 32 nt, Human
ggcuucaguucauucccccaucuugcugccaa

SEQ ID NO: 194640 - RNA, 32 nt, Human
ggcuucaguuuggaauccaaaggcgacaacug

SEQ ID NO: 194641 - RNA, 21 nt, Human
ggcuucaguuuucucaucugu

SEQ ID NO: 194642 - RNA, 32 nt, Human
ggcuucauccuuuccauauucuuacucuuuac

SEQ ID NO: 194643 - RNA, 32 nt, Human
ggcuucaugaacuaggaugaaaggaggccccu

SEQ ID NO: 194644 - RNA, 32 nt, Human
ggcuucaugccucccuucucccagcucaggug

SEQ ID NO: 194645 - RNA, 31 nt, Human
ggcuucaugcugaggaagauucuugaagacu

SEQ ID NO: 194646 - RNA, 32 nt, Human
ggcuuccaaacuuuuccuggugauugaauucu

SEQ ID NO: 194647 - RNA, 32 nt, Human
ggcuuccaaguuccugggggcugcagugaaca

SEQ ID NO: 194648 - RNA, 32 nt, Human
ggcuuccacagcccuccucucccaagaaaucc

SEQ ID NO: 194649 - RNA, 21 nt, Human
ggcuuccacauccugggcuca

SEQ ID NO: 194650 - RNA, 32 nt, Human
ggcuuccacaucugcacaucugggagacaaau

SEQ ID NO: 194651 - RNA, 32 nt, Human
ggcuuccacccacgcaguguucuaagugaagg

SEQ ID NO: 194652 - RNA, 32 nt, Human
ggcuuccaccuggcacgugccugcugcuuccu

SEQ ID NO: 194653 - RNA, 32 nt, Human
ggcuuccaccuuuaacccuuccaccugggagc

SEQ ID NO: 194654 - RNA, 32 nt, Human
ggcuuccacugcauccuggccaggggacggag

SEQ ID NO: 194655 - RNA, 24 nt, Human
ggcuuccacuguuuggcuauccca

SEQ ID NO: 194656 - RNA, 32 nt, Human
ggcuuccagaaacaggauugccaaauuguccc

SEQ ID NO: 194657 - RNA, 32 nt, Human
ggcuuccagaagacaugcugcuauggucacug

SEQ ID NO: 194658 - RNA, 32 nt, Human
ggcuuccagagcuguggguagaggacaucgcc

SEQ ID NO: 194659 - RNA, 32 nt, Human
ggcuuccagcagggagcuuccccucuggcguc

SEQ ID NO: 194660 - RNA, 23 nt, Human
ggcuuccagcgggcccucugccg

SEQ ID NO: 194661 - RNA, 32 nt, Human
ggcuuccagcuggugugugaugggcagccuga

SEQ ID NO: 194662 - RNA, 32 nt, Human
ggcuuccaggagagcucaagcacuccgggggc

SEQ ID NO: 194663 - RNA, 32 nt, Human
ggcuuccaggcccugaggacauguggucaggu

SEQ ID NO: 194664 - RNA, 32 nt, Human
ggcuuccagggccaacucaaggaugugcaggu

SEQ ID NO: 194665 - RNA, 32 nt, Human
ggcuuccagguggaggugcggcuucagugcgc

SEQ ID NO: 194666 - RNA, 21 nt, Human
ggcuuccaucucagcacucug

SEQ ID NO: 194667 - RNA, 32 nt, Human
ggcuucccaaaccaagugccuugagcugccug

SEQ ID NO: 194668 - RNA, 21 nt, Human
ggcuucccaaaccacccagcc

SEQ ID NO: 194669 - RNA, 32 nt, Human
ggcuucccaaaguacugggauuauaggcuuga

SEQ ID NO: 194670 - RNA, 32 nt, Human
ggcuucccaaaguccugggauuacagguguga

SEQ ID NO: 194671 - RNA, 32 nt, Human
ggcuucccaaagugcucggauuacagguguga

SEQ ID NO: 194672 - RNA, 32 nt, Human
ggcuucccaaagugcugagauuacaggcaugg

SEQ ID NO: 194673 - RNA, 32 nt, Human
ggcuucccaaagugcugagauuacagguguga

SEQ ID NO: 194674 - RNA, 32 nt, Human
ggcuucccaaagugcuggaauuacaggccuga

SEQ ID NO: 194675 - RNA, 32 nt, Human
ggcuucccaaagugcugggauuacaggaauga

SEQ ID NO: 194676 - RNA, 32 nt, Human
ggcuucccaaagugcugggauuacaggcauga

SEQ ID NO: 194677 - RNA, 32 nt, Human
ggcuucccaaagugcugggauuacaggcguga

SEQ ID NO: 194678 - RNA, 32 nt, Human
ggcuucccaaagugcugggauuacaggcgugc

SEQ ID NO: 194679 - RNA, 32 nt, Human
ggcuucccaaagugcugggauuacaggcuuga

SEQ ID NO: 194680 - RNA, 32 nt, Human
ggcuucccaaagugcugggauuacgggcguga

SEQ ID NO: 194681 - RNA, 32 nt, Human
ggcuucccaaagugcugggauuauaggcagca

SEQ ID NO: 194682 - RNA, 32 nt, Human
ggcuucccaaagugcugggauuauaggcaugu

SEQ ID NO: 194683 - RNA, 32 nt, Human
ggcuucccaaagugcugggauugcaggcguga

SEQ ID NO: 194684 - RNA, 32 nt, Human
ggcuucccaaaguucugggauuacaggcauga

SEQ ID NO: 194685 - RNA, 32 nt, Human
ggcuucccaaggugcuggaauuacaggcguga

SEQ ID NO: 194686 - RNA, 32 nt, Human
ggcuucccaaguagcugggauuacaggcacgu

SEQ ID NO: 194687 - RNA, 23 nt, Human
ggcuucccaggaguuugagguug

SEQ ID NO: 194688 - RNA, 32 nt, Human
ggcuucccaggcccagagaagggagaaaguaa

SEQ ID NO: 194689 - RNA, 32 nt, Human
ggcuucccaggguuggggaggcugugggacca

SEQ ID NO: 194690 - RNA, 32 nt, Human
ggcuucccaucuuccacagagacaucucccug

SEQ ID NO: 194691 - RNA, 32 nt, Human
ggcuuccccaaaaugggcaacuucagcuuaag

SEQ ID NO: 194692 - RNA, 17 nt, Human
ggcuucccccaagacca

SEQ ID NO: 194693 - RNA, 32 nt, Human
ggcuucccccuggagcugggagagaggccggg

SEQ ID NO: 194694 - RNA, 32 nt, Human
ggcuuccccggccccugcuguggugcuagguc

SEQ ID NO: 194695 - RNA, 25 nt, Human
ggcuuccccuacaccccagccuccu

SEQ ID NO: 194696 - RNA, 17 nt, Human
ggcuuccccugcaccac

SEQ ID NO: 194697 - RNA, 32 nt, Human
ggcuuccccugcccucacuccccucuggcugg

SEQ ID NO: 194698 - RNA, 32 nt, Human
ggcuuccccugccuauccucuccgaucaccaa

SEQ ID NO: 194699 - RNA, 24 nt, Human
ggcuuccccuucgccgccgccgcc

SEQ ID NO: 194700 - RNA, 32 nt, Human
ggcuucccgaagugcugggauuauaggcguaa

SEQ ID NO: 194701 - RNA, 32 nt, Human
ggcuucccggcccccacugccugcggcauggc

SEQ ID NO: 194702 - RNA, 32 nt, Human
ggcuucccuaacuccuccccuugccccuacca

SEQ ID NO: 194703 - RNA, 32 nt, Human
ggcuucccuaacuuaguccaggaacacagccu

SEQ ID NO: 194704 - RNA, 32 nt, Human
ggcuucccucagcuccaacucuucucuuccgc

SEQ ID NO: 194705 - RNA, 32 nt, Human
ggcuucccuccaccaauccuggagcuaaaaga

SEQ ID NO: 194706 - RNA, 32 nt, Human
ggcuucccuccuccuccccugcagccugguua

SEQ ID NO: 194707 - RNA, 18 nt, Human
ggcuucccuccugcugcu

SEQ ID NO: 194708 - RNA, 25 nt, Human
ggcuucccugagccagcgaauugug

SEQ ID NO: 194709 - RNA, 21 nt, Human
ggcuucccugagugccugagu

SEQ ID NO: 194710 - RNA, 32 nt, Human
ggcuucccugcaggagccccaucuugucgcua

SEQ ID NO: 194711 - RNA, 32 nt, Human
ggcuucccugcucuuuccuuuuucccggcuuc

SEQ ID NO: 194712 - RNA, 22 nt, Human
ggcuucccuggacaaagaagac

SEQ ID NO: 194713 - RNA, 32 nt, Human
ggcuucccuuugacccucuuccuuccuuuccc

SEQ ID NO: 194714 - RNA, 23 nt, Human
ggcuuccgagcacgugcuggacc

SEQ ID NO: 194715 - RNA, 32 nt, Human
ggcuuccgcaagugcugggauuacaggcguga

SEQ ID NO: 194716 - RNA, 21 nt, Human
ggcuuccgcagccccccucca

SEQ ID NO: 194717 - RNA, 20 nt, Human
ggcuuccgcagcccccucca

SEQ ID NO: 194718 - RNA, 19 nt, Human
ggcuuccggaagcgcaggg

SEQ ID NO: 194719 - RNA, 32 nt, Human
ggcuuccggagcuguauuugcaguuuuguguu

SEQ ID NO: 194720 - RNA, 20 nt, Human
ggcuuccgguguggccggua

SEQ ID NO: 194721 - RNA, 32 nt, Human
ggcuuccgugaaagaccaugccuggucugcuc

SEQ ID NO: 194722 - RNA, 24 nt, Human
ggcuuccguggccagcagcccuag

SEQ ID NO: 194723 - RNA, 32 nt, Human
ggcuuccguucccagcgugcccagugagccgg

SEQ ID NO: 194724 - RNA, 32 nt, Human
ggcuuccuaaagugcugggauugcaggcguga

SEQ ID NO: 194725 - RNA, 32 nt, Human
ggcuuccuaaaguguugggauuacaggcuuga

SEQ ID NO: 194726 - RNA, 21 nt, Human
ggcuuccuacuggcccagggu

SEQ ID NO: 194727 - RNA, 32 nt, Human
ggcuuccucaaauacaugcacagucauacaag

SEQ ID NO: 194728 - RNA, 32 nt, Human
ggcuuccucacugcccugugacuuccaccugc

SEQ ID NO: 194729 - RNA, 21 nt, Human
ggcuuccucagccgcugucuc

SEQ ID NO: 194730 - RNA, 32 nt, Human
ggcuuccucauaggaagcacugaggguguguc

SEQ ID NO: 194731 - RNA, 32 nt, Human
ggcuuccucaugggagggcaugaggcuccacu

SEQ ID NO: 194732 - RNA, 32 nt, Human
ggcuuccuccacugcugaagacccugcuguag

SEQ ID NO: 194733 - RNA, 25 nt, Human
ggcuuccucccauccucccaucuca

SEQ ID NO: 194734 - RNA, 32 nt, Human
ggcuuccuccgucugcaaugucccuugcacag

SEQ ID NO: 194735 - RNA, 32 nt, Human
ggcuuccuccucccucucccgcccggccagcc

SEQ ID NO: 194736 - RNA, 32 nt, Human
ggcuuccuccuggaugugauggggauugccag

SEQ ID NO: 194737 - RNA, 32 nt, Human
ggcuuccucgcaagccucuccaucagcgcccu

SEQ ID NO: 194738 - RNA, 32 nt, Human
ggcuuccucucucucccuuccucucucucccu

SEQ ID NO: 194739 - RNA, 32 nt, Human
ggcuuccucucuguuaguccccaaauccuuac

SEQ ID NO: 194740 - RNA, 32 nt, Human
ggcuuccugaaggaugugggaugguggacucc

SEQ ID NO: 194741 - RNA, 32 nt, Human
ggcuuccugacggaggaguccggggacguguu

SEQ ID NO: 194742 - RNA, 32 nt, Human
ggcuuccugcagcugagaucuaugcaggccau

SEQ ID NO: 194743 - RNA, 23 nt, Human
ggcuuccugccgugccuggaacc

SEQ ID NO: 194744 - RNA, 32 nt, Human
ggcuuccugccucugcacgccaccccgugcac

SEQ ID NO: 194745 - RNA, 32 nt, Human
ggcuuccugccugguuuuucucuucucacauu

SEQ ID NO: 194746 - RNA, 32 nt, Human
ggcuuccuggaugacaguugggugauaugugu

SEQ ID NO: 194747 - RNA, 32 nt, Human
ggcuuccuggccagggcauuuucucugcggcc

SEQ ID NO: 194748 - RNA, 32 nt, Human
ggcuucgcagcccaaaaacaaaugguuaggcu

SEQ ID NO: 194749 - RNA, 24 nt, Human
ggcuucgcaggcacaucgacuaca

SEQ ID NO: 194750 - RNA, 25 nt, Human
ggcuucgcaguuccucuucugugaa

SEQ ID NO: 194751 - RNA, 32 nt, Human
ggcuucgccacaggaccuggaguuaucagggg

SEQ ID NO: 194752 - RNA, 32 nt, Human
ggcuucgcugcaggaauccggugucucaaugu

SEQ ID NO: 194753 - RNA, 32 nt, Human
ggcuucggagcugaggagcagcuguucugaug

SEQ ID NO: 194754 - RNA, 32 nt, Human
ggcuucgggcaggaccugucagcugggaggcc

SEQ ID NO: 194755 - RNA, 32 nt, Human
ggcuucgggccugcagccaccaugcuccacuc

SEQ ID NO: 194756 - RNA, 32 nt, Human
ggcuucggggaaauguggguuugcuggucucu

SEQ ID NO: 194757 - RNA, 32 nt, Human
ggcuucgucacugagaccucaggccucugcca

SEQ ID NO: 194758 - RNA, 18 nt, Human
ggcuucgugcaggagggc

SEQ ID NO: 194759 - RNA, 32 nt, Human
ggcuucgugcgccguucgcaccuggccaacca

SEQ ID NO: 194760 - RNA, 32 nt, Human
ggcuucguggccugcucucaggaaguggguca

SEQ ID NO: 194761 - RNA, 32 nt, Human
ggcuucuaaaggacagguguuugggagccucu

SEQ ID NO: 194762 - RNA, 24 nt, Human
ggcuucuaagcacccagcuaucuc

SEQ ID NO: 194763 - RNA, 32 nt, Human
ggcuucuaccaaagagaauggagaauugguug

SEQ ID NO: 194764 - RNA, 19 nt, Human
ggcuucuaccaggguccag

SEQ ID NO: 194765 - RNA, 32 nt, Human
ggcuucuagggaggccucaggaagcuuacagu

SEQ ID NO: 194766 - RNA, 16 nt, Human
ggcuucuauggccagg

SEQ ID NO: 194767 - RNA, 32 nt, Human
ggcuucucaacugcucggccucuugggccagg

SEQ ID NO: 194768 - RNA, 21 nt, Human
ggcuucucaggagcugucuca

SEQ ID NO: 194769 - RNA, 32 nt, Human
ggcuucuccaaagccaaagagcucucccggag

SEQ ID NO: 194770 - RNA, 32 nt, Human
ggcuucuccaccccaagucuggcuccauuccu

SEQ ID NO: 194771 - RNA, 32 nt, Human
ggcuucuccacuccugccccagaguguggagg

SEQ ID NO: 194772 - RNA, 32 nt, Human
ggcuucuccaucuuccucgucuggacgguggu

SEQ ID NO: 194773 - RNA, 32 nt, Human
ggcuucucccacgcagccccagaagaggacac

SEQ ID NO: 194774 - RNA, 32 nt, Human
ggcuucucccccucagcucucccucacaccuc

SEQ ID NO: 194775 - RNA, 32 nt, Human
ggcuucucccuuaagaagagagagauacuugu

SEQ ID NO: 194776 - RNA, 24 nt, Human
ggcuucuccggaucaguacaugca

SEQ ID NO: 194777 - RNA, 25 nt, Human
ggcuucuccugcaugggaguugugu

SEQ ID NO: 194778 - RNA, 32 nt, Human
ggcuucuccugccucagccucacgaguagcug

SEQ ID NO: 194779 - RNA, 32 nt, Human
ggcuucuccugccuccaucacaucacagaagu

SEQ ID NO: 194780 - RNA, 32 nt, Human
ggcuucuccuucagcccauccacucuccucua

SEQ ID NO: 194781 - RNA, 32 nt, Human
ggcuucucucaccuccauuagcucuuuaccuu

SEQ ID NO: 194782 - RNA, 32 nt, Human
ggcuucucucauuccauuuuguggcuaaccuu

SEQ ID NO: 194783 - RNA, 32 nt, Human
ggcuucucuccuccugcuggagugccaguccc

SEQ ID NO: 194784 - RNA, 32 nt, Human
ggcuucucuccucuguuuucaaugaacugcua

SEQ ID NO: 194785 - RNA, 22 nt, Human
ggcuucucugagguccacauca

SEQ ID NO: 194786 - RNA, 24 nt, Human
ggcuucucugaguugggguugugu

SEQ ID NO: 194787 - RNA, 32 nt, Human
ggcuucucugcagagcucugcuuccugcagcc

SEQ ID NO: 194788 - RNA, 32 nt, Human
ggcuucucugggucccacucucuggcugccuu

SEQ ID NO: 194789 - RNA, 32 nt, Human
ggcuucugaagaagaggaagggcgaguagggg

SEQ ID NO: 194790 - RNA, 32 nt, Human
ggcuucugaagaccccuccucaauuucuuggc

SEQ ID NO: 194791 - RNA, 32 nt, Human
ggcuucugacccuucaggcagggacaguucua

SEQ ID NO: 194792 - RNA, 21 nt, Human
ggcuucugaucccagccgcca

SEQ ID NO: 194793 - RNA, 32 nt, Human
ggcuucugauggucagcaucuuccccaacacu

SEQ ID NO: 194794 - RNA, 32 nt, Human
ggcuucugcagcagcagaguccugggugacca

SEQ ID NO: 194795 - RNA, 32 nt, Human
ggcuucugcauuaagcuuuccuggugaagacc

SEQ ID NO: 194796 - RNA, 32 nt, Human
ggcuucugccuaagccucucccuccagccaau

SEQ ID NO: 194797 - RNA, 32 nt, Human
ggcuucugccugaaaucccaguacucuggaag

SEQ ID NO: 194798 - RNA, 24 nt, Human
ggcuucugcuccgguaccuuguga

SEQ ID NO: 194799 - RNA, 32 nt, Human
ggcuucugcucugacuuuacugcagcuaguca

SEQ ID NO: 194800 - RNA, 17 nt, Human
ggcuucugcuggccagg

SEQ ID NO: 194801 - RNA, 22 nt, Human
ggcuucugcuguggcuauccca

SEQ ID NO: 194802 - RNA, 32 nt, Human
ggcuucuggaaccugaggcuuggccccgguug

SEQ ID NO: 194803 - RNA, 32 nt, Human
ggcuucuggccacugccuccucccucuucuaa

SEQ ID NO: 194804 - RNA, 29 nt, Human
ggcuucuggcugcccccuucccucccgcc

SEQ ID NO: 194805 - RNA, 32 nt, Human
ggcuucuggggcugggucccacaugcccuuga

SEQ ID NO: 194806 - RNA, 22 nt, Human
ggcuucuguaaaccgccaggua

SEQ ID NO: 194807 - RNA, 32 nt, Human
ggcuucuguaaucccagcuacuugggaggcug

SEQ ID NO: 194808 - RNA, 32 nt, Human
ggcuucuguccucugcuguucucugcugugug

SEQ ID NO: 194809 - RNA, 21 nt, Human
ggcuucugugguugucugaga

SEQ ID NO: 194810 - RNA, 32 nt, Human
ggcuucuguucucugcugagggccaauacccu

SEQ ID NO: 194811 - RNA, 32 nt, Human
ggcuucuucacgaagcuuagaguuuggccuuu

SEQ ID NO: 194812 - RNA, 32 nt, Human
ggcuucuucccaagacuuauuuuucccaucag

SEQ ID NO: 194813 - RNA, 32 nt, Human
ggcuucuugacuugccccuugugacuugaaac

SEQ ID NO: 194814 - RNA, 32 nt, Human
ggcuucuugagugagguggccuuugaacugaa

SEQ ID NO: 194815 - RNA, 32 nt, Human
ggcuucuugcccagguuucaaagcugaaguac

SEQ ID NO: 194816 - RNA, 31 nt, Human
ggcuucuuucacucugggcuguguuuaugag

SEQ ID NO: 194817 - RNA, 32 nt, Human
ggcuucuuucuccucggcccucggugaaccca

SEQ ID NO: 194818 - RNA, 32 nt, Human
ggcuugaaauguuacaucaccagagccaaguc

SEQ ID NO: 194819 - RNA, 19 nt, Human
ggcuugaacaagucacuua

SEQ ID NO: 194820 - RNA, 19 nt, Human
ggcuugaaccuaaucaggu

SEQ ID NO: 194821 - RNA, 17 nt, Human
ggcuugaaccugggagg

SEQ ID NO: 194822 - RNA, 19 nt, Human
ggcuugaaccugggaggug

SEQ ID NO: 194823 - RNA, 16 nt, Human
ggcuugaacuugccag

SEQ ID NO: 194824 - RNA, 20 nt, Human
ggcuugaauccgggcggcag

SEQ ID NO: 194825 - RNA, 32 nt, Human
ggcuugaccagguacaaggcccauggggaagg

SEQ ID NO: 194826 - RNA, 18 nt, Human
ggcuugacgcgccggaaa

SEQ ID NO: 194827 - RNA, 32 nt, Human
ggcuugagaacgaccuuucuuucuuuauuucu

SEQ ID NO: 194828 - RNA, 32 nt, Human
ggcuugagagacaccugcaucuauaauccccg

SEQ ID NO: 194829 - RNA, 32 nt, Human
ggcuugagagagccucagagacacgaaaugca

SEQ ID NO: 194830 - RNA, 32 nt, Human
ggcuugagaggagagcgcuggccaugccagga

SEQ ID NO: 194831 - RNA, 32 nt, Human
ggcuugagccaccacaccugaccuauucuugu

SEQ ID NO: 194832 - RNA, 32 nt, Human
ggcuugagccacugcaccuggccucaugucuc

SEQ ID NO: 194833 - RNA, 32 nt, Human
ggcuugagcucaggauguaaggcugcagagag

SEQ ID NO: 194834 - RNA, 32 nt, Human
ggcuugaggaagaagaaaaacgcuucggcauu

SEQ ID NO: 194835 - RNA, 32 nt, Human
ggcuugaggagaagaaaggaagaaaagauauc

SEQ ID NO: 194836 - RNA, 32 nt, Human
ggcuugaggcaggccguccuggagggggcucc

SEQ ID NO: 194837 - RNA, 32 nt, Human
ggcuugaggggaggggauggggagucgguguu

SEQ ID NO: 194838 - RNA, 24 nt, Human
ggcuugagguuccacaucugugaa

SEQ ID NO: 194839 - RNA, 32 nt, Human
ggcuugauagaguucccugaaaacuccuugua

SEQ ID NO: 194840 - RNA, 32 nt, Human
ggcuugauagaguucccugaaaacuccuuuua

SEQ ID NO: 194841 - RNA, 19 nt, Human
ggcuugaucacagcucccu

SEQ ID NO: 194842 - RNA, 32 nt, Human
ggcuugaugccuuucugaaggcgagagggaag

SEQ ID NO: 194843 - RNA, 18 nt, Human
ggcuugaugguggccagg

SEQ ID NO: 194844 - RNA, 32 nt, Human
ggcuugauugggagggcggugggagccaguaa

SEQ ID NO: 194845 - RNA, 29 nt, Human
ggcuugauugugagugugccugggaggau

SEQ ID NO: 194846 - RNA, 32 nt, Human
ggcuugcaaccagcagcugacugcuaagcuag

SEQ ID NO: 194847 - RNA, 32 nt, Human
ggcuugcaacccagagagagcagcuucccuug

SEQ ID NO: 194848 - RNA, 32 nt, Human
ggcuugcacacagcaggugcucagcaaaugcc

SEQ ID NO: 194849 - RNA, 32 nt, Human
ggcuugcaccaccacacacauaccuggucuca

SEQ ID NO: 194850 - RNA, 32 nt, Human
ggcuugcaccuguaaucccagcacuuugggag

SEQ ID NO: 194851 - RNA, 32 nt, Human
ggcuugcacugagggccuggcugcccagacag

SEQ ID NO: 194852 - RNA, 17 nt, Human
ggcuugcacuugggcca

SEQ ID NO: 194853 - RNA, 32 nt, Human
ggcuugcagagacuccuugcucccaggagaua

SEQ ID NO: 194854 - RNA, 23 nt, Human
ggcuugcaggcacuuuccucuug

SEQ ID NO: 194855 - RNA, 32 nt, Human
ggcuugcagggcaaugauggcaguccagguua

SEQ ID NO: 194856 - RNA, 32 nt, Human
ggcuugcaggggacaggagugggagcagggag

SEQ ID NO: 194857 - RNA, 32 nt, Human
ggcuugcagugagccaugaucaugccacugua

SEQ ID NO: 194858 - RNA, 19 nt, Human
ggcuugcaguguggccagg

SEQ ID NO: 194859 - RNA, 32 nt, Human
ggcuugcaucacgucacuccagugguucccuc

SEQ ID NO: 194860 - RNA, 32 nt, Human
ggcuugcauggauguagggcuuggggugggaa

SEQ ID NO: 194861 - RNA, 32 nt, Human
ggcuugccaaaacccacccagcuaauaagugc

SEQ ID NO: 194862 - RNA, 32 nt, Human
ggcuugccaagagguuggaagggaaauggcuc

SEQ ID NO: 194863 - RNA, 27 nt, Human
ggcuugccacacaguccccgccugcca

SEQ ID NO: 194864 - RNA, 19 nt, Human
ggcuugccaccaucuugga

SEQ ID NO: 194865 - RNA, 32 nt, Human
ggcuugccaccugaagcagccacugcccaggg

SEQ ID NO: 194866 - RNA, 32 nt, Human
ggcuugcccaaaaggcuggagagggcagggag

SEQ ID NO: 194867 - RNA, 32 nt, Human
ggcuugcccagauagacuaacaacccuuuagu

SEQ ID NO: 194868 - RNA, 32 nt, Human
ggcuugcccagcugggaggccccacacgaaag

SEQ ID NO: 194869 - RNA, 32 nt, Human
ggcuugcccaggaaaggggcugugcugucguc

SEQ ID NO: 194870 - RNA, 32 nt, Human
ggcuugcccaggcuggagugcgguggcuaguc

SEQ ID NO: 194871 - RNA, 19 nt, Human
ggcuugcccucugccugcc

SEQ ID NO: 194872 - RNA, 32 nt, Human
ggcuugccgcacucccccugaggugcccgccg

SEQ ID NO: 194873 - RNA, 32 nt, Human
ggcuugccucccuccuuccuccccucucaacc

SEQ ID NO: 194874 - RNA, 32 nt, Human
ggcuugccuccuccugcguccugcuagcuauu

SEQ ID NO: 194875 - RNA, 32 nt, Human
ggcuugccuccugccucuggauuuuagguguu

SEQ ID NO: 194876 - RNA, 32 nt, Human
ggcuugccugaacuuugggcauggaagaaaga

SEQ ID NO: 194877 - RNA, 32 nt, Human
ggcuugccugcaggcaugagucagucugauga

SEQ ID NO: 194878 - RNA, 18 nt, Human
ggcuugccuguaauccca

SEQ ID NO: 194879 - RNA, 20 nt, Human
ggcuugccuguaaucccagc

SEQ ID NO: 194880 - RNA, 32 nt, Human
ggcuugccuguaaucccagcacuuugggaggc

SEQ ID NO: 194881 - RNA, 32 nt, Human
ggcuugccuguggcccauaccccagcccuccu

SEQ ID NO: 194882 - RNA, 17 nt, Human
ggcuugcgcugggccag

SEQ ID NO: 194883 - RNA, 23 nt, Human
ggcuugcgggcaggggcugcagg

SEQ ID NO: 194884 - RNA, 32 nt, Human
ggcuugcgggcugucagcacucacugugggug

SEQ ID NO: 194885 - RNA, 32 nt, Human
ggcuugcuccaaugccacugagcccugcuccc

SEQ ID NO: 194886 - RNA, 32 nt, Human
ggcuugcuccucuauucuaccucucuuucucc

SEQ ID NO: 194887 - RNA, 32 nt, Human
ggcuugcucuucuccccggcccucagaggccu

SEQ ID NO: 194888 - RNA, 32 nt, Human
ggcuugcugaagaagggagaaaaagaacagca

SEQ ID NO: 194889 - RNA, 20 nt, Human
ggcuugcugaggcucacaga

SEQ ID NO: 194890 - RNA, 32 nt, Human
ggcuugcugcagccucaaccuccugggcucac

SEQ ID NO: 194891 - RNA, 32 nt, Human
ggcuugcuuggcaggcugggccucugugucac

SEQ ID NO: 194892 - RNA, 32 nt, Human
ggcuugcuuucaaauugugagcucuuuuuggu

SEQ ID NO: 194893 - RNA, 32 nt, Human
ggcuugcuuuccugcaucucugugaagccucu

SEQ ID NO: 194894 - RNA, 20 nt, Human
ggcuuggaaaagucaaguga

SEQ ID NO: 194895 - RNA, 32 nt, Human
ggcuuggaaauuugcauuucuaacacaaguuc

SEQ ID NO: 194896 - RNA, 32 nt, Human
ggcuuggaacauuugggagacugagcuugauu

SEQ ID NO: 194897 - RNA, 32 nt, Human
ggcuuggaaccagcucauauguuuggaggggu

SEQ ID NO: 194898 - RNA, 32 nt, Human
ggcuuggaacccaccccaccucccucauuggg

SEQ ID NO: 194899 - RNA, 18 nt, Human
ggcuuggaagaagaguga

SEQ ID NO: 194900 - RNA, 17 nt, Human
ggcuuggaagaggauga

SEQ ID NO: 194901 - RNA, 32 nt, Human
ggcuuggaaugaauucucucuaaaaauaaaau

SEQ ID NO: 194902 - RNA, 15 nt, Human
ggcuuggacagagug

SEQ ID NO: 194903 - RNA, 20 nt, Human
ggcuuggacagccccaguga

SEQ ID NO: 194904 - RNA, 17 nt, Human
ggcuuggacagcuguga

SEQ ID NO: 194905 - RNA, 19 nt, Human
ggcuuggacagugugugug

SEQ ID NO: 194906 - RNA, 20 nt, Human
ggcuuggacccauuugagga

SEQ ID NO: 194907 - RNA, 18 nt, Human
ggcuuggacuagagagga

SEQ ID NO: 194908 - RNA, 19 nt, Human
ggcuuggacugaggagcgg

SEQ ID NO: 194909 - RNA, 32 nt, Human
ggcuuggagagggagacagggccagacauguu

SEQ ID NO: 194910 - RNA, 17 nt, Human
ggcuuggagagugagug

SEQ ID NO: 194911 - RNA, 18 nt, Human
ggcuuggagcaagagaga

SEQ ID NO: 194912 - RNA, 32 nt, Human
ggcuuggagcacauaguugguucuuucuacug

SEQ ID NO: 194913 - RNA, 32 nt, Human
ggcuuggaggagcugggcucuaucccacaccc

SEQ ID NO: 194914 - RNA, 32 nt, Human
ggcuuggaggcugagguaggaggaucgccuga

SEQ ID NO: 194915 - RNA, 32 nt, Human
ggcuuggaggcugccuagagggacaggugggu

SEQ ID NO: 194916 - RNA, 20 nt, Human
ggcuuggaggcuggggguga

SEQ ID NO: 194917 - RNA, 32 nt, Human
ggcuuggaggcugggggugagucucaagauau

SEQ ID NO: 194918 - RNA, 32 nt, Human
ggcuuggagggaacuucccacucccauugccu

SEQ ID NO: 194919 - RNA, 32 nt, Human
ggcuuggaggggcacggaggagccgauugggg

SEQ ID NO: 194920 - RNA, 20 nt, Human
ggcuuggagggugaagagga

SEQ ID NO: 194921 - RNA, 18 nt, Human
ggcuuggagguggccagg

SEQ ID NO: 194922 - RNA, 19 nt, Human
ggcuuggaguuagagauga

SEQ ID NO: 194923 - RNA, 17 nt, Human
ggcuuggauaggcguga

SEQ ID NO: 194924 - RNA, 32 nt, Human
ggcuuggauuccugggccuggcccagguggcu

SEQ ID NO: 194925 - RNA, 32 nt, Human
ggcuuggcacacugccagugucuuagcagggu

SEQ ID NO: 194926 - RNA, 32 nt, Human
ggcuuggcaccggaguucauguucaauaaaua

SEQ ID NO: 194927 - RNA, 32 nt, Human
ggcuuggcacugccuuuuccuuucucaggcca

SEQ ID NO: 194928 - RNA, 32 nt, Human
ggcuuggcaucugcacuccagcccaggacugu

SEQ ID NO: 194929 - RNA, 32 nt, Human
ggcuuggccagcagaacacagaguagauuuug

SEQ ID NO: 194930 - RNA, 32 nt, Human
ggcuuggccugcaguaguagggagacaaguuc

SEQ ID NO: 194931 - RNA, 16 nt, Human
ggcuuggccugggguc

SEQ ID NO: 194932 - RNA, 32 nt, Human
ggcuuggcgagugccacaucuggcagguuugg

SEQ ID NO: 194933 - RNA, 19 nt, Human
ggcuuggcggaacugcggg

SEQ ID NO: 194934 - RNA, 20 nt, Human
ggcuuggcguccagcaauga

SEQ ID NO: 194935 - RNA, 32 nt, Human
ggcuuggcucaccgcaaccuccgccucccggg

SEQ ID NO: 194936 - RNA, 32 nt, Human
ggcuuggcucacugccaccccucuuuggucca

SEQ ID NO: 194937 - RNA, 32 nt, Human
ggcuuggcucacugcuaccuccgccucccagg

SEQ ID NO: 194938 - RNA, 32 nt, Human
ggcuuggcuccaccacuuuccucccccagccu

SEQ ID NO: 194939 - RNA, 32 nt, Human
ggcuuggcucggcgcccccaccccuggcuacc

SEQ ID NO: 194940 - RNA, 19 nt, Human
ggcuuggcugcagaguaga

SEQ ID NO: 194941 - RNA, 32 nt, Human
ggcuuggcugugguccugagaagcuucugugu

SEQ ID NO: 194942 - RNA, 22 nt, Human
ggcuuggcuuauuucacuuaca

SEQ ID NO: 194943 - RNA, 32 nt, Human
ggcuugggagagaccuguggcaccagguugga

SEQ ID NO: 194944 - RNA, 17 nt, Human
ggcuugggagcagaaug

SEQ ID NO: 194945 - RNA, 32 nt, Human
ggcuugggagcaucgccaugcccugccaccug

SEQ ID NO: 194946 - RNA, 19 nt, Human
ggcuugggagccaggauga

SEQ ID NO: 194947 - RNA, 32 nt, Human
ggcuugggccuaggcugcauugaaaagagcug

SEQ ID NO: 194948 - RNA, 17 nt, Human
ggcuugggcgagaguga

SEQ ID NO: 194949 - RNA, 18 nt, Human
ggcuugggcuccagagga

SEQ ID NO: 194950 - RNA, 32 nt, Human
ggcuugggcuccaggagggaggcugggaggca

SEQ ID NO: 194951 - RNA, 32 nt, Human
ggcuugggcuuccccagcgccccaccaccacc

SEQ ID NO: 194952 - RNA, 32 nt, Human
ggcuugggcuucccuuugacccucuuccuucc

SEQ ID NO: 194953 - RNA, 19 nt, Human
ggcuuggggaacagagaga

SEQ ID NO: 194954 - RNA, 17 nt, Human
ggcuuggggagcagagu

SEQ ID NO: 194955 - RNA, 20 nt, Human
ggcuuggggagccagaggga

SEQ ID NO: 194956 - RNA, 20 nt, Human
ggcuuggggcaacagauuga

SEQ ID NO: 194957 - RNA, 32 nt, Human
ggcuugggggcugaggcccagcggcccgagac

SEQ ID NO: 194958 - RNA, 32 nt, Human
ggcuugggggugugcaggcacagcagauggcc

SEQ ID NO: 194959 - RNA, 16 nt, Human
ggcuuggguaggggga

SEQ ID NO: 194960 - RNA, 21 nt, Human
ggcuugggucccccugcugcu

SEQ ID NO: 194961 - RNA, 32 nt, Human
ggcuugggugccugggcuggguguggggcagg

SEQ ID NO: 194962 - RNA, 32 nt, Human
ggcuugggugugagacagcagcgguggcagac

SEQ ID NO: 194963 - RNA, 32 nt, Human
ggcuuggguuuggagcugggaacagcacccac

SEQ ID NO: 194964 - RNA, 32 nt, Human
ggcuugguagcucugggauuugccuuccuuca

SEQ ID NO: 194965 - RNA, 18 nt, Human
ggcuuggucauaggguga

SEQ ID NO: 194966 - RNA, 17 nt, Human
ggcuugguccagaguga

SEQ ID NO: 194967 - RNA, 32 nt, Human
ggcuuggugacuggagcaaagcugcugugaga

SEQ ID NO: 194968 - RNA, 32 nt, Human
ggcuugguggccugagacaggggugacuugcc

SEQ ID NO: 194969 - RNA, 22 nt, Human
ggcuugguggcucacgccugua

SEQ ID NO: 194970 - RNA, 22 nt, Human
ggcuugguggcucaugccugua

SEQ ID NO: 194971 - RNA, 32 nt, Human
ggcuugguggugguagcauuugggucugagau

SEQ ID NO: 194972 - RNA, 32 nt, Human
ggcuugguucugccuggacgcacagcaugccu

SEQ ID NO: 194973 - RNA, 32 nt, Human
ggcuuguaaauacccgccccgccaaaccgcau

SEQ ID NO: 194974 - RNA, 32 nt, Human
ggcuuguaccaauuuacugacacugucuuaaa

SEQ ID NO: 194975 - RNA, 32 nt, Human
ggcuuguacccguaaucccagcacuuugggag

SEQ ID NO: 194976 - RNA, 22 nt, Human
ggcuuguagcuuuuuuacguca

SEQ ID NO: 194977 - RNA, 32 nt, Human
ggcuuguaugagugugacuggguguguuucuu

SEQ ID NO: 194978 - RNA, 32 nt, Human
ggcuuguauucaugggauacaggacagggaug

SEQ ID NO: 194979 - RNA, 22 nt, Human
ggcuugucauuuguguauuuag

SEQ ID NO: 194980 - RNA, 18 nt, Human
ggcuuguccaucccuuga

SEQ ID NO: 194981 - RNA, 32 nt, Human
ggcuuguccccuccucuuuccccuccccaggc

SEQ ID NO: 194982 - RNA, 20 nt, Human
ggcuugucuuccuaaugcua

SEQ ID NO: 194983 - RNA, 32 nt, Human
ggcuugucuugaacuccugaccuugagauauc

SEQ ID NO: 194984 - RNA, 32 nt, Human
ggcuugucuugagacguggcaaauucuccuug

SEQ ID NO: 194985 - RNA, 32 nt, Human
ggcuugugacccuggcuucccauguccuucug

SEQ ID NO: 194986 - RNA, 32 nt, Human
ggcuugugccuguaaucccagaacuuuggaag

SEQ ID NO: 194987 - RNA, 32 nt, Human
ggcuugugccuguagucccagcuacuugggag

SEQ ID NO: 194988 - RNA, 32 nt, Human
ggcuugugcucugcaaagacucugcugcuggg

SEQ ID NO: 194989 - RNA, 32 nt, Human
ggcuugugggaggcugggagguggcugucucc

SEQ ID NO: 194990 - RNA, 32 nt, Human
ggcuugugggguggcaggaugcaggagagagu

SEQ ID NO: 194991 - RNA, 32 nt, Human
ggcuuguggggugggagccagaguggaggucg

SEQ ID NO: 194992 - RNA, 32 nt, Human
ggcuuguguauccaugcaccuaccucagaaaa

SEQ ID NO: 194993 - RNA, 32 nt, Human
ggcuugugucugccaguacgacaaaggacgcu

SEQ ID NO: 194994 - RNA, 32 nt, Human
ggcuuguguguguauauaguguguuuggggga

SEQ ID NO: 194995 - RNA, 32 nt, Human
ggcuuguguucuguuccuuucacaaaagcucu

SEQ ID NO: 194996 - RNA, 21 nt, Human
ggcuuguuaaugucagaguga

SEQ ID NO: 194997 - RNA, 23 nt, Human
ggcuuguuacauuugucauuuaa

SEQ ID NO: 194998 - RNA, 29 nt, Human
ggcuuguuaugugcugugccuggacuugg

SEQ ID NO: 194999 - RNA, 32 nt, Human
ggcuuguucacuacuucugcuuuacaggcuuu

SEQ ID NO: 195000 - RNA, 32 nt, Human
ggcuuguuccuauagucccagcacuuugggag

SEQ ID NO: 195001 - RNA, 18 nt, Human
ggcuuguugagccaggua

SEQ ID NO: 195002 - RNA, 21 nt, Human
ggcuuguugcuuggcuuuuaa

SEQ ID NO: 195003 - RNA, 32 nt, Human
ggcuuguuuaaugcaguaccauuggagaguua

SEQ ID NO: 195004 - RNA, 32 nt, Human
ggcuuguuuccuggcccugcucaguugccucu

SEQ ID NO: 195005 - RNA, 19 nt, Human
ggcuuguuucucuccauug

SEQ ID NO: 195006 - RNA, 32 nt, Human
ggcuuguuugcagacugggugagguggagccc

SEQ ID NO: 195007 - RNA, 32 nt, Human
ggcuuguuuguuguuuucaccagagugagcuc

SEQ ID NO: 195008 - RNA, 32 nt, Human
ggcuuuaaaaaugcaugaaaccaccuuuaauu

SEQ ID NO: 195009 - RNA, 20 nt, Human
ggcuuuaaaacaugcucucu

SEQ ID NO: 195010 - RNA, 19 nt, Human
ggcuuuaaagagggggcag

SEQ ID NO: 195011 - RNA, 32 nt, Human
ggcuuuaacuaucuucucuauauuuuuauuuc

SEQ ID NO: 195012 - RNA, 32 nt, Human
ggcuuuaaucaccaacccaucaacaucaagcc

SEQ ID NO: 195013 - RNA, 18 nt, Human
ggcuuuaauuggguucag

SEQ ID NO: 195014 - RNA, 32 nt, Human
ggcuuuacagaugacucacuccauuccuaggu

SEQ ID NO: 195015 - RNA, 32 nt, Human
ggcuuuacaguguaaacugucuugccccuuca

SEQ ID NO: 195016 - RNA, 21 nt, Human
ggcuuuacuguauuucacuca

SEQ ID NO: 195017 - RNA, 32 nt, Human
ggcuuuagagcuggcuucugcccacacuuucu

SEQ ID NO: 195018 - RNA, 32 nt, Human
ggcuuuagaggcagaugaaguggucuuugacc

SEQ ID NO: 195019 - RNA, 32 nt, Human
ggcuuuagcgagccuggagggaagggaaggcu

SEQ ID NO: 195020 - RNA, 32 nt, Human
ggcuuuagcuaccucacuaugcugcuucacaa

SEQ ID NO: 195021 - RNA, 31 nt, Human
ggcuuuauauccucugggccuggguuuccug

SEQ ID NO: 195022 - RNA, 32 nt, Human
ggcuuuaucucccuuuuccagaaaguucuuug

SEQ ID NO: 195023 - RNA, 19 nt, Human
ggcuuuauuucuuucauca

SEQ ID NO: 195024 - RNA, 32 nt, Human
ggcuuucaaagauaauucgcagugaugugaaa

SEQ ID NO: 195025 - RNA, 32 nt, Human
ggcuuucacagcaaggguaccuauuucauggc

SEQ ID NO: 195026 - RNA, 32 nt, Human
ggcuuucaccuugcccuggugucuuuuuccag

SEQ ID NO: 195027 - RNA, 32 nt, Human
ggcuuucagaguacaauaaacagggaaugaga

SEQ ID NO: 195028 - RNA, 32 nt, Human
ggcuuucaggaggugccagcagcucuguuggc

SEQ ID NO: 195029 - RNA, 32 nt, Human
ggcuuucauacaaauagacuguucauaauuua

SEQ ID NO: 195030 - RNA, 32 nt, Human
ggcuuucauuucucuuggggugcaguggggau

SEQ ID NO: 195031 - RNA, 32 nt, Human
ggcuuuccaaagugcugggauuacagauguga

SEQ ID NO: 195032 - RNA, 32 nt, Human
ggcuuuccaggccaaaaugaagaggguggagg

SEQ ID NO: 195033 - RNA, 32 nt, Human
ggcuuuccagggcagcucagaccucaucggac

SEQ ID NO: 195034 - RNA, 32 nt, Human
ggcuuuccaguggagcagccuguuugacccca

SEQ ID NO: 195035 - RNA, 22 nt, Human
ggcuuucccaacagcugccucu

SEQ ID NO: 195036 - RNA, 32 nt, Human
ggcuuucccacauucuuuacauuuguaggauu

SEQ ID NO: 195037 - RNA, 32 nt, Human
ggcuuucccacauucuuuacauuuguaggguu

SEQ ID NO: 195038 - RNA, 32 nt, Human
ggcuuucccaggccuggugauucugcucucca

SEQ ID NO: 195039 - RNA, 20 nt, Human
ggcuuuccccgccagaguga

SEQ ID NO: 195040 - RNA, 21 nt, Human
ggcuuuccccgccuccucccg

SEQ ID NO: 195041 - RNA, 32 nt, Human
ggcuuucccucgggcagguggcagcggccauc

SEQ ID NO: 195042 - RNA, 32 nt, Human
ggcuuucccucucugggccucagucuguucau

SEQ ID NO: 195043 - RNA, 32 nt, Human
ggcuuucccugacucugcgacagggucaaacc

SEQ ID NO: 195044 - RNA, 32 nt, Human
ggcuuucccuguaacccaaaacaaggagagag

SEQ ID NO: 195045 - RNA, 32 nt, Human
ggcuuuccuaacccugccuuuuuagucccggu

SEQ ID NO: 195046 - RNA, 32 nt, Human
ggcuuuccucaaggaucccucaaguuuccaac

SEQ ID NO: 195047 - RNA, 32 nt, Human
ggcuuuccucaagggguccccgagcagcgucg

SEQ ID NO: 195048 - RNA, 32 nt, Human
ggcuuuccuccacucuaccuuggccacagucu

SEQ ID NO: 195049 - RNA, 30 nt, Human
ggcuuuccucucugccugcuccugucucuc

SEQ ID NO: 195050 - RNA, 25 nt, Human
ggcuuuccugagacuugagguugug

SEQ ID NO: 195051 - RNA, 26 nt, Human
ggcuuuccugauuucugagucugugu

SEQ ID NO: 195052 - RNA, 32 nt, Human
ggcuuuccugcucugcuuuugggucgucaauu

SEQ ID NO: 195053 - RNA, 32 nt, Human
ggcuuuccuggcacccuggccugggugucugg

SEQ ID NO: 195054 - RNA, 32 nt, Human
ggcuuuccugggcuccagcuugcacauagcag

SEQ ID NO: 195055 - RNA, 26 nt, Human
ggcuuucgcaguuuuucguccgugaa

SEQ ID NO: 195056 - RNA, 20 nt, Human
ggcuuucgcccgcugcugcc

SEQ ID NO: 195057 - RNA, 32 nt, Human
ggcuuucgcucugugcugaugugugacaguca

SEQ ID NO: 195058 - RNA, 32 nt, Human
ggcuuucgguugcugguugggggugggauaua

SEQ ID NO: 195059 - RNA, 32 nt, Human
ggcuuucuaugcugccugcuucccuuucaaac

SEQ ID NO: 195060 - RNA, 19 nt, Human
ggcuuucucacagcucccu

SEQ ID NO: 195061 - RNA, 32 nt, Human
ggcuuucucaccccagcucuggcuaugcccag

SEQ ID NO: 195062 - RNA, 32 nt, Human
ggcuuucucaggaaguggcucugccaggcagg

SEQ ID NO: 195063 - RNA, 32 nt, Human
ggcuuucucggcacccagaagaaguggggagc

SEQ ID NO: 195064 - RNA, 21 nt, Human
ggcuuucucuaaauccugccu

SEQ ID NO: 195065 - RNA, 32 nt, Human
ggcuuucucuggggaccccauuccugucagua

SEQ ID NO: 195066 - RNA, 32 nt, Human
ggcuuucugacaguuccaugcugauguaucag

SEQ ID NO: 195067 - RNA, 32 nt, Human
ggcuuucugagguuuagcuggguggggacugc

SEQ ID NO: 195068 - RNA, 23 nt, Human
ggcuuucugcaaccucugccucc

SEQ ID NO: 195069 - RNA, 32 nt, Human
ggcuuucugcaaccucugccucccagguucaa

SEQ ID NO: 195070 - RNA, 32 nt, Human
ggcuuucugcagaaugacacagccucagaagc

SEQ ID NO: 195071 - RNA, 32 nt, Human
ggcuuucuggcugcugugcugccuccugggcu

SEQ ID NO: 195072 - RNA, 32 nt, Human
ggcuuucuguaucccagguucuugccuaggua

SEQ ID NO: 195073 - RNA, 32 nt, Human
ggcuuucugucucucguuguuugcuuucuuuu

SEQ ID NO: 195074 - RNA, 32 nt, Human
ggcuuucugucugccccagggugcuccaugga

SEQ ID NO: 195075 - RNA, 32 nt, Human
ggcuuucuucucuccugcucaggaccucaucu

SEQ ID NO: 195076 - RNA, 32 nt, Human
ggcuuucuugacauguagguugcuugguaaua

SEQ ID NO: 195077 - RNA, 32 nt, Human
ggcuuugaaacuuacauuuuaaaagaggguua

SEQ ID NO: 195078 - RNA, 32 nt, Human
ggcuuugaaagccagacaaagcagcugccccu

SEQ ID NO: 195079 - RNA, 32 nt, Human
ggcuuugaaaucuccccuugcacugagauuag

SEQ ID NO: 195080 - RNA, 32 nt, Human
ggcuuugaacaaccuccuccagggacuuuggg

SEQ ID NO: 195081 - RNA, 32 nt, Human
ggcuuugaacacugcccaucagcuacagucau

SEQ ID NO: 195082 - RNA, 32 nt, Human
ggcuuugaagaaugcagccggggaaagcauua

SEQ ID NO: 195083 - RNA, 32 nt, Human
ggcuuugaagaccucuggacaugagaacauau

SEQ ID NO: 195084 - RNA, 32 nt, Human
ggcuuugaccauacacauuucugcacagcccu

SEQ ID NO: 195085 - RNA, 21 nt, Human
ggcuuugaccaugaaacugug

SEQ ID NO: 195086 - RNA, 31 nt, Human
ggcuuugagcucucuggguacagugucugag

SEQ ID NO: 195087 - RNA, 32 nt, Human
ggcuuugaggagaauccucucugccauucuuc

SEQ ID NO: 195088 - RNA, 32 nt, Human
ggcuuugaggguggaaggaugggauggguucc

SEQ ID NO: 195089 - RNA, 19 nt, Human
ggcuuugaugucuuucaaa

SEQ ID NO: 195090 - RNA, 32 nt, Human
ggcuuugcaaaaacaacagguuaaucuagucg

SEQ ID NO: 195091 - RNA, 21 nt, Human
ggcuuugcaaacccagccucc

SEQ ID NO: 195092 - RNA, 32 nt, Human
ggcuuugcaaaguggcacgccuggagagaacu

SEQ ID NO: 195093 - RNA, 32 nt, Human
ggcuuugcaccugguggcuauuacaaagcagu

SEQ ID NO: 195094 - RNA, 31 nt, Human
ggcuuugcacuuugguuacacagaacauugg

SEQ ID NO: 195095 - RNA, 32 nt, Human
ggcuuugcagggcggccagugcagugaugccu

SEQ ID NO: 195096 - RNA, 32 nt, Human
ggcuuugcagguggugggccugccugggcauc

SEQ ID NO: 195097 - RNA, 32 nt, Human
ggcuuugccagccuggccagcagcucagagug

SEQ ID NO: 195098 - RNA, 32 nt, Human
ggcuuugccauggagaaggacaugaagaacgu

SEQ ID NO: 195099 - RNA, 23 nt, Human
ggcuuugcccugcaggggaucug

SEQ ID NO: 195100 - RNA, 32 nt, Human
ggcuuugccgucugcgcuccagccuucgccug

SEQ ID NO: 195101 - RNA, 32 nt, Human
ggcuuugcgugagaaaggggaggagagugguu

SEQ ID NO: 195102 - RNA, 21 nt, Human
ggcuuugcguguugcugugaa

SEQ ID NO: 195103 - RNA, 32 nt, Human
ggcuuugcuaaacagaaaagauauaaaacaaa

SEQ ID NO: 195104 - RNA, 32 nt, Human
ggcuuugcucuccaccgcccugggcaaacccc

SEQ ID NO: 195105 - RNA, 31 nt, Human
ggcuuugcuggguccaucacagaagagucuc

SEQ ID NO: 195106 - RNA, 19 nt, Human
ggcuuugcuguucuucacu

SEQ ID NO: 195107 - RNA, 32 nt, Human
ggcuuugcuuucccugcuggggccacagcugu

SEQ ID NO: 195108 - RNA, 32 nt, Human
ggcuuuggaagcaguuugauuuugaaaugcuu

SEQ ID NO: 195109 - RNA, 19 nt, Human
ggcuuuggaagggcagcuu

SEQ ID NO: 195110 - RNA, 32 nt, Human
ggcuuuggagacccccucaucugugacaacca

SEQ ID NO: 195111 - RNA, 32 nt, Human
ggcuuuggagagaagagcaguucugcagcugg

SEQ ID NO: 195112 - RNA, 32 nt, Human
ggcuuuggagugugacacuggccuagaaucca

SEQ ID NO: 195113 - RNA, 19 nt, Human
ggcuuuggccucugcugcc

SEQ ID NO: 195114 - RNA, 32 nt, Human
ggcuuuggccucugcugccucucagucaccaa

SEQ ID NO: 195115 - RNA, 32 nt, Human
ggcuuuggcuccccuggguccccugguugugc

SEQ ID NO: 195116 - RNA, 32 nt, Human
ggcuuugggaagcacccccagcccagggugaa

SEQ ID NO: 195117 - RNA, 32 nt, Human
ggcuuugggaggcugaggugggaggauugcuu

SEQ ID NO: 195118 - RNA, 32 nt, Human
ggcuuugggagggagaaagagggaccuagcgc

SEQ ID NO: 195119 - RNA, 32 nt, Human
ggcuuugggcaguucaggaggaggacuccauc

SEQ ID NO: 195120 - RNA, 32 nt, Human
ggcuuugggguuucgcccuaucccacucccuc

SEQ ID NO: 195121 - RNA, 32 nt, Human
ggcuuuggucaccacgagucuagcucagggca

SEQ ID NO: 195122 - RNA, 32 nt, Human
ggcuuugguccccagcauugcaguauggugug

SEQ ID NO: 195123 - RNA, 32 nt, Human
ggcuuugguuuucauuccuuuuuguuuggcuu

SEQ ID NO: 195124 - RNA, 22 nt, Human
ggcuuuguaaaccggcuggacc

SEQ ID NO: 195125 - RNA, 32 nt, Human
ggcuuugucauuccuuucucuuccuguacauc

SEQ ID NO: 195126 - RNA, 32 nt, Human
ggcuuuguccauaacaaugcucugggauuuca

SEQ ID NO: 195127 - RNA, 32 nt, Human
ggcuuugucccccaggcuggagugcgauggca

SEQ ID NO: 195128 - RNA, 32 nt, Human
ggcuuugugauccucaguguccagugucaccc

SEQ ID NO: 195129 - RNA, 32 nt, Human
ggcuuugugccacccucucccuugccaaagaa

SEQ ID NO: 195130 - RNA, 23 nt, Human
ggcuuuguguucuucacugugaa

SEQ ID NO: 195131 - RNA, 32 nt, Human
ggcuuuguuaccugggcaauaagggacuagca

SEQ ID NO: 195132 - RNA, 32 nt, Human
ggcuuuguucucucaagucaggucugagggaa

SEQ ID NO: 195133 - RNA, 32 nt, Human
ggcuuuuacaucuugccuaccauugcaugaaa

SEQ ID NO: 195134 - RNA, 32 nt, Human
ggcuuuuagaaaaugguuguaaaucugacuuc

SEQ ID NO: 195135 - RNA, 32 nt, Human
ggcuuuuagaggcacacacacaaaaagagguc

SEQ ID NO: 195136 - RNA, 32 nt, Human
ggcuuuuaggauguuuauauuccuucaucccu

SEQ ID NO: 195137 - RNA, 32 nt, Human
ggcuuuuaguaaucauguuggcuggucugguc

SEQ ID NO: 195138 - RNA, 32 nt, Human
ggcuuuuaucugugucuuuuggaaaaggagcu

SEQ ID NO: 195139 - RNA, 22 nt, Human
ggcuuuuaucuuauuucacuua

SEQ ID NO: 195140 - RNA, 19 nt, Human
ggcuuuuaucuucuucauu

SEQ ID NO: 195141 - RNA, 32 nt, Human
ggcuuuuauguuuguccgauggagauuuguuu

SEQ ID NO: 195142 - RNA, 32 nt, Human
ggcuuuucauucuucaauucaugacgagugcc

SEQ ID NO: 195143 - RNA, 32 nt, Human
ggcuuuuccacauucuucacauguguaggguu

SEQ ID NO: 195144 - RNA, 32 nt, Human
ggcuuuuccagguugugauagcccuuaaagca

SEQ ID NO: 195145 - RNA, 23 nt, Human
ggcuuuucccccaaaguaucaug

SEQ ID NO: 195146 - RNA, 32 nt, Human
ggcuuuuccucugguagccacacaccugagca

SEQ ID NO: 195147 - RNA, 32 nt, Human
ggcuuuuccuucaugauuguucucucccuugu

SEQ ID NO: 195148 - RNA, 32 nt, Human
ggcuuuuccuucuccaaacuuugaggcgugau

SEQ ID NO: 195149 - RNA, 32 nt, Human
ggcuuuuccuuuccuuucuucuccauucccug

SEQ ID NO: 195150 - RNA, 32 nt, Human
ggcuuuucgagugugggacaaggucugauguc

SEQ ID NO: 195151 - RNA, 32 nt, Human
ggcuuuucgugcacaugagaaaauguuggcca

SEQ ID NO: 195152 - RNA, 32 nt, Human
ggcuuuucuguuuaaagugugugugcacauga

SEQ ID NO: 195153 - RNA, 32 nt, Human
ggcuuuugaacccaggaggcagagguugcagc

SEQ ID NO: 195154 - RNA, 32 nt, Human
ggcuuuugaauggucucccucuccccagccca

SEQ ID NO: 195155 - RNA, 32 nt, Human
ggcuuuugaauuaacugaauccauccaucaaa

SEQ ID NO: 195156 - RNA, 32 nt, Human
ggcuuuugaccuaagaacccuagcaggagaau

SEQ ID NO: 195157 - RNA, 32 nt, Human
ggcuuuugagacugaaguuaagugggcacagg

SEQ ID NO: 195158 - RNA, 22 nt, Human
ggcuuuugcaggagggcagcuu

SEQ ID NO: 195159 - RNA, 32 nt, Human
ggcuuuugcauugucucuugacaucagaaguu

SEQ ID NO: 195160 - RNA, 23 nt, Human
ggcuuuugcccuuugaaacugug

SEQ ID NO: 195161 - RNA, 32 nt, Human
ggcuuuugccuguaaucccaacacuuugggag

SEQ ID NO: 195162 - RNA, 32 nt, Human
ggcuuuuggaaaggagaaacuugcagucagaa

SEQ ID NO: 195163 - RNA, 32 nt, Human
ggcuuuuggagacauauuacacagguaugagu

SEQ ID NO: 195164 - RNA, 32 nt, Human
ggcuuuuggggugcucugcagcagggcaggca

SEQ ID NO: 195165 - RNA, 32 nt, Human
ggcuuuuggucucccugggaguggguggaggc

SEQ ID NO: 195166 - RNA, 24 nt, Human
ggcuuuuguagauggcgacugugu

SEQ ID NO: 195167 - RNA, 22 nt, Human
ggcuuuuguaucucuucauuua

SEQ ID NO: 195168 - RNA, 32 nt, Human
ggcuuuuguccaggguggcucugguguguggg

SEQ ID NO: 195169 - RNA, 21 nt, Human
ggcuuuuguuaucuuucacuu

SEQ ID NO: 195170 - RNA, 21 nt, Human
ggcuuuuguuuagcagaguga

SEQ ID NO: 195171 - RNA, 32 nt, Human
ggcuuuuuauacaccacauacuagcuucuuuc

SEQ ID NO: 195172 - RNA, 32 nt, Human
ggcuuuuuccucagucccuguucauaccaucu

SEQ ID NO: 195173 - RNA, 32 nt, Human
ggcuuuuucuaagaaagggauucugggagcag

SEQ ID NO: 195174 - RNA, 32 nt, Human
ggcuuuuucucccuccccaugucuguucuggg

SEQ ID NO: 195175 - RNA, 20 nt, Human
ggcuuuuucuuucugcugcc

SEQ ID NO: 195176 - RNA, 32 nt, Human
ggcuuuuugguuguggcuucaagggagggaag

SEQ ID NO: 195177 - RNA, 17 nt, Human
gggaaaaaaggcuccag

SEQ ID NO: 195178 - RNA, 31 nt, Human
gggaaaaagagacucuuuuaggaucagaucu

SEQ ID NO: 195179 - RNA, 32 nt, Human
gggaaaaaggaaaugggcugggaauggugguu

SEQ ID NO: 195180 - RNA, 32 nt, Human
gggaaaaaggccauuggcuaauugcacgugug

SEQ ID NO: 195181 - RNA, 32 nt, Human
gggaaaaauuuuaguuaugauagccacaaacc

SEQ ID NO: 195182 - RNA, 20 nt, Human
gggaaaacggaggugggaga

SEQ ID NO: 195183 - RNA, 32 nt, Human
gggaaaacucuucuugaauaaccaggcgauac

SEQ ID NO: 195184 - RNA, 32 nt, Human
gggaaaacuuccagcccucuguuaauugugug

SEQ ID NO: 195185 - RNA, 32 nt, Human
gggaaaagaaaccucgucggagagcagaggca

SEQ ID NO: 195186 - RNA, 32 nt, Human
gggaaaagaagaggaggcuuaggauggucaag

SEQ ID NO: 195187 - RNA, 32 nt, Human
gggaaaagaccacgagcaccccugacugcacc

SEQ ID NO: 195188 - RNA, 32 nt, Human
gggaaaagagagaaggcagggagaguagggag

SEQ ID NO: 195189 - RNA, 32 nt, Human
gggaaaagagguuuuucuccugcaggguacug

SEQ ID NO: 195190 - RNA, 32 nt, Human
gggaaaagcauccgguggccucagggagcccu

SEQ ID NO: 195191 - RNA, 32 nt, Human
gggaaaagccagagcuuccagauggaggugau

SEQ ID NO: 195192 - RNA, 32 nt, Human
gggaaaagccuccuuagcuuuugaagcuccuc

SEQ ID NO: 195193 - RNA, 32 nt, Human
gggaaaagcgggugagcaggaggcaugaggua

SEQ ID NO: 195194 - RNA, 32 nt, Human
gggaaaagcuuuuuccucuguauucuuuuggg

SEQ ID NO: 195195 - RNA, 32 nt, Human
gggaaaagcuuuuugcuuauuugucuuuugaa

SEQ ID NO: 195196 - RNA, 32 nt, Human
gggaaaaggaaaggaucagacauuucggggac

SEQ ID NO: 195197 - RNA, 32 nt, Human
gggaaaaggaagcacaaaaaggagaagcagca

SEQ ID NO: 195198 - RNA, 32 nt, Human
gggaaaaggaggugggagugcagaugaaacaa

SEQ ID NO: 195199 - RNA, 32 nt, Human
gggaaaaggcagaccgugugagggggccugug

SEQ ID NO: 195200 - RNA, 32 nt, Human
gggaaaaggcaugucaucagguuguuggugug

SEQ ID NO: 195201 - RNA, 32 nt, Human
gggaaaaggccuuccaaaagagcagcaccggc

SEQ ID NO: 195202 - RNA, 32 nt, Human
gggaaaaggcuuccguuuauuuagcauaauga

SEQ ID NO: 195203 - RNA, 32 nt, Human
gggaaaagggaaggcgugcuguggaaauaaaa

SEQ ID NO: 195204 - RNA, 21 nt, Human
gggaaaagggaggugcagaga

SEQ ID NO: 195205 - RNA, 20 nt, Human
gggaaaaggggaggggaaga

SEQ ID NO: 195206 - RNA, 18 nt, Human
gggaaaaggggggcccug

SEQ ID NO: 195207 - RNA, 25 nt, Human
gggaaaaggucaagaaagaggcaga

SEQ ID NO: 195208 - RNA, 32 nt, Human
gggaaaaguguggacguggccagagcgagaga

SEQ ID NO: 195209 - RNA, 32 nt, Human
gggaaaauacccuuuaaauuaugacagacauc

SEQ ID NO: 195210 - RNA, 32 nt, Human
gggaaaaucauauauccuaucuucucaaagga

SEQ ID NO: 195211 - RNA, 22 nt, Human
gggaaaaucugagaacacugaa

SEQ ID NO: 195212 - RNA, 31 nt, Human
gggaaaaugaacaucaguguugauuuggaaa

SEQ ID NO: 195213 - RNA, 32 nt, Human
gggaaaaugcaaagcacccaaaccacuaacac

SEQ ID NO: 195214 - RNA, 32 nt, Human
gggaaaaugccggucuccuacucuucauggcc

SEQ ID NO: 195215 - RNA, 19 nt, Human
gggaaaaugcugggaccaa

SEQ ID NO: 195216 - RNA, 32 nt, Human
gggaaaaugcuuccucauuugcuucucccagc

SEQ ID NO: 195217 - RNA, 24 nt, Human
gggaaaauucauguugcugcagaa

SEQ ID NO: 195218 - RNA, 21 nt, Human
gggaaaauucuguugcaagaa

SEQ ID NO: 195219 - RNA, 21 nt, Human
gggaaaauuguaccugcagaa

SEQ ID NO: 195220 - RNA, 32 nt, Human
gggaaaauuugaaagaaauuacuuccugaaaa

SEQ ID NO: 195221 - RNA, 24 nt, Human
gggaaaauuugcaucuguaaagaa

SEQ ID NO: 195222 - RNA, 32 nt, Human
gggaaacaaaugcccuccuaagccacaaggcg

SEQ ID NO: 195223 - RNA, 32 nt, Human
gggaaacaacacacacuggggccuaugagagg

SEQ ID NO: 195224 - RNA, 32 nt, Human
gggaaacaacuucuccccaggggccccuggga

SEQ ID NO: 195225 - RNA, 32 nt, Human
gggaaacacagcagcaucucuccacugaaaga

SEQ ID NO: 195226 - RNA, 32 nt, Human
gggaaacacagcccugcuggccucggacugca

SEQ ID NO: 195227 - RNA, 18 nt, Human
gggaaacagaagagacag

SEQ ID NO: 195228 - RNA, 32 nt, Human
gggaaacagcacagccugucacaguaauugca

SEQ ID NO: 195229 - RNA, 20 nt, Human
gggaaacagccuuccuggag

SEQ ID NO: 195230 - RNA, 32 nt, Human
gggaaacaggcagagguuggaacaguuuggag

SEQ ID NO: 195231 - RNA, 32 nt, Human
gggaaacagucauuugcgcacaacuuaaaaag

SEQ ID NO: 195232 - RNA, 32 nt, Human
gggaaacauagcgaaacccccucucuacaaaa

SEQ ID NO: 195233 - RNA, 32 nt, Human
gggaaacauggcaaaaccccaucucuauaaaa

SEQ ID NO: 195234 - RNA, 32 nt, Human
gggaaacauggcaaaaucccaucucuacaaca

SEQ ID NO: 195235 - RNA, 32 nt, Human
gggaaaccaaaccguugacacccccuagaaac

SEQ ID NO: 195236 - RNA, 32 nt, Human
gggaaaccaccagcaucggcagaggugauagc

SEQ ID NO: 195237 - RNA, 32 nt, Human
gggaaaccacuaacuauccaaccagcuuauac

SEQ ID NO: 195238 - RNA, 23 nt, Human
gggaaaccccagagacucuucug

SEQ ID NO: 195239 - RNA, 32 nt, Human
gggaaacgggagcagaggaagcacagagcugg

SEQ ID NO: 195240 - RNA, 32 nt, Human
gggaaacguccucgugagaugagagccugagc

SEQ ID NO: 195241 - RNA, 32 nt, Human
gggaaacguggcgaaaccccaucucuacuaaa

SEQ ID NO: 195242 - RNA, 32 nt, Human
gggaaacguggugagaccucaucucuacaaaa

SEQ ID NO: 195243 - RNA, 27 nt, Human
gggaaacucaauaaacacauuuuggau

SEQ ID NO: 195244 - RNA, 32 nt, Human
gggaaacucacagaugagcugaucuguaaguc

SEQ ID NO: 195245 - RNA, 32 nt, Human
gggaaacucauuuuccccugcagcucccccaa

SEQ ID NO: 195246 - RNA, 32 nt, Human
gggaaacugagcuucuuucuucugcacugggg

SEQ ID NO: 195247 - RNA, 32 nt, Human
gggaaacugcagcuuucauuacagauuccuug

SEQ ID NO: 195248 - RNA, 25 nt, Human
gggaaacuggaaaugaauuugacau

SEQ ID NO: 195249 - RNA, 32 nt, Human
gggaaagaaaccaggcaucuggucaaaccagc

SEQ ID NO: 195250 - RNA, 32 nt, Human
gggaaagaaaccuggaaaguacccuuggcugu

SEQ ID NO: 195251 - RNA, 32 nt, Human
gggaaagaaagagagaucagacuguuacugug

SEQ ID NO: 195252 - RNA, 32 nt, Human
gggaaagaaaggaagaaagagaaaaagagaaa

SEQ ID NO: 195253 - RNA, 32 nt, Human
gggaaagaaauagagaccuucugggauuauuu

SEQ ID NO: 195254 - RNA, 32 nt, Human
gggaaagaagcaccagcacucgccuuagaacu

SEQ ID NO: 195255 - RNA, 32 nt, Human
gggaaagaaggaaagucgagaggcucaugaau

SEQ ID NO: 195256 - RNA, 22 nt, Human
gggaaagaaugguagagacaga

SEQ ID NO: 195257 - RNA, 32 nt, Human
gggaaagacauucagacccacagaaaggaggc

SEQ ID NO: 195258 - RNA, 32 nt, Human
gggaaagacccaggcugcgggacgcggugcag

SEQ ID NO: 195259 - RNA, 32 nt, Human
gggaaagacccuucugucucaguuuugcuaug

SEQ ID NO: 195260 - RNA, 32 nt, Human
gggaaagagaaagagacagagacuggcauuuu

SEQ ID NO: 195261 - RNA, 32 nt, Human
gggaaagagaaggagaugggagagggcguagc

SEQ ID NO: 195262 - RNA, 32 nt, Human
gggaaagagaggagagaaagaaaaagagagug

SEQ ID NO: 195263 - RNA, 32 nt, Human
gggaaagagaggcagagagggggaaggccccc

SEQ ID NO: 195264 - RNA, 32 nt, Human
gggaaagagcccaggugggacgugggacaggc

SEQ ID NO: 195265 - RNA, 32 nt, Human
gggaaagagccuggggaggagcuuaaaacuca

SEQ ID NO: 195266 - RNA, 32 nt, Human
gggaaagaggcagagaaggaaagagacaggca

SEQ ID NO: 195267 - RNA, 32 nt, Human
gggaaagagggagggggacuccaggaaaagcc

SEQ ID NO: 195268 - RNA, 32 nt, Human
gggaaagauaaauagacauaaauauauaacaa

SEQ ID NO: 195269 - RNA, 24 nt, Human
gggaaagauaccagcugcaugaca

SEQ ID NO: 195270 - RNA, 32 nt, Human
gggaaagaucugucagaggagccuuucgauau

SEQ ID NO: 195271 - RNA, 32 nt, Human
gggaaagcaagccgaguguacgggaagggccg

SEQ ID NO: 195272 - RNA, 32 nt, Human
gggaaagcagaacugaagccacuuggcccaga

SEQ ID NO: 195273 - RNA, 32 nt, Human
gggaaagcagaagaagucugcuggucacacgg

SEQ ID NO: 195274 - RNA, 32 nt, Human
gggaaagcagccugccccaugcuuccagccug

SEQ ID NO: 195275 - RNA, 32 nt, Human
gggaaagcagggcagccgggaccugcggcugu

SEQ ID NO: 195276 - RNA, 32 nt, Human
gggaaagccagccugggagcaugugaaaggau

SEQ ID NO: 195277 - RNA, 32 nt, Human
gggaaagcccauaugcuaccaccagcuguguc

SEQ ID NO: 195278 - RNA, 32 nt, Human
gggaaagcucuggugacccugggcuucgcagg

SEQ ID NO: 195279 - RNA, 32 nt, Human
gggaaagcugauaaaacuuucacuggacugga

SEQ ID NO: 195280 - RNA, 32 nt, Human
gggaaagcuuucagccauaccccagccuucau

SEQ ID NO: 195281 - RNA, 32 nt, Human
gggaaaggaccccagagaaguggcugugaccc

SEQ ID NO: 195282 - RNA, 32 nt, Human
gggaaaggacgcugagaugacaucaccacaga

SEQ ID NO: 195283 - RNA, 32 nt, Human
gggaaaggagcccagacggagaaggggccaug

SEQ ID NO: 195284 - RNA, 32 nt, Human
gggaaaggaggaacaucccucccaggacucac

SEQ ID NO: 195285 - RNA, 32 nt, Human
gggaaaggcaaaggagcacauucugucuagag

SEQ ID NO: 195286 - RNA, 32 nt, Human
gggaaaggcgcacggcagccucggugccuccc

SEQ ID NO: 195287 - RNA, 32 nt, Human
gggaaaggcugcugccuccugcucuguccuca

SEQ ID NO: 195288 - RNA, 32 nt, Human
gggaaagggaaaggaaaucagcaacucuucaa

SEQ ID NO: 195289 - RNA, 21 nt, Human
gggaaagggaaaggaagcagg

SEQ ID NO: 195290 - RNA, 32 nt, Human
gggaaagggaaaggaagcagggcagugguggg

SEQ ID NO: 195291 - RNA, 32 nt, Human
gggaaagggaagguuaguagcagaacagguuu

SEQ ID NO: 195292 - RNA, 20 nt, Human
gggaaagggagaggggcaga

SEQ ID NO: 195293 - RNA, 32 nt, Human
gggaaagggccaccacaccacacccaagccca

SEQ ID NO: 195294 - RNA, 32 nt, Human
gggaaagggcugggccucaccgcucccagcaa

SEQ ID NO: 195295 - RNA, 32 nt, Human
gggaaaggggagacagagggugaaguggugcu

SEQ ID NO: 195296 - RNA, 32 nt, Human
gggaaaggggagccggccugcccacacccccg

SEQ ID NO: 195297 - RNA, 20 nt, Human
gggaaaggggaggaggaagg

SEQ ID NO: 195298 - RNA, 32 nt, Human
gggaaaggggaugauaaagcagugaguugucu

SEQ ID NO: 195299 - RNA, 32 nt, Human
gggaaagggugagggagacuggggccuggucu

SEQ ID NO: 195300 - RNA, 32 nt, Human
gggaaaggguuuuuccuuagcacacgaaaaag

SEQ ID NO: 195301 - RNA, 32 nt, Human
gggaaaggugaagcugugacuggaggggcagg

SEQ ID NO: 195302 - RNA, 32 nt, Human
gggaaagguggugagaggggcaaaggaggaug

SEQ ID NO: 195303 - RNA, 32 nt, Human
gggaaaguaaaggguuuaaaggaaugugcauc

SEQ ID NO: 195304 - RNA, 32 nt, Human
gggaaaguaagccuguaucagucauauuucca

SEQ ID NO: 195305 - RNA, 32 nt, Human
gggaaaguagcagcaacuagauuaagacuggg

SEQ ID NO: 195306 - RNA, 32 nt, Human
gggaaaguaguuaagaaaucaagaaaaguguc

SEQ ID NO: 195307 - RNA, 32 nt, Human
gggaaagucagggcaguggaaguggaugcacu

SEQ ID NO: 195308 - RNA, 32 nt, Human
gggaaagucaucuguuuaauuuacacacuugc

SEQ ID NO: 195309 - RNA, 32 nt, Human
gggaaagugcucagcaaggaggcucuccuucc

SEQ ID NO: 195310 - RNA, 32 nt, Human
gggaaagugcugaaaucugcagugagugaaag

SEQ ID NO: 195311 - RNA, 32 nt, Human
gggaaaguggaagaccccaugaugacaucaug

SEQ ID NO: 195312 - RNA, 32 nt, Human
gggaaagugggucgccccacagcuucaaaggc

SEQ ID NO: 195313 - RNA, 32 nt, Human
gggaaagugguaagggagagugcugguccaaa

SEQ ID NO: 195314 - RNA, 32 nt, Human
gggaaagugugugguuuuaguacguucaaaag

SEQ ID NO: 195315 - RNA, 22 nt, Human
gggaaaguucuuccuugcuccg

SEQ ID NO: 195316 - RNA, 32 nt, Human
gggaaauaaaaggugguaaaauucaguuuuca

SEQ ID NO: 195317 - RNA, 32 nt, Human
gggaaauaaaggcagaaggcagugagagggag

SEQ ID NO: 195318 - RNA, 32 nt, Human
gggaaauaagaccgaucuccugaccccauugg

SEQ ID NO: 195319 - RNA, 32 nt, Human
gggaaauaggucuccuaggugccugaagcgcu

SEQ ID NO: 195320 - RNA, 32 nt, Human
gggaaauaguaacagugaucugcuuagagugg

SEQ ID NO: 195321 - RNA, 32 nt, Human
gggaaauaucuagcuauuuuaauagauagaua

SEQ ID NO: 195322 - RNA, 32 nt, Human
gggaaauauuccaggcuuuggccaaggccagu

SEQ ID NO: 195323 - RNA, 32 nt, Human
gggaaauauuuuaauuuagcuuuuggauuucc

SEQ ID NO: 195324 - RNA, 32 nt, Human
gggaaaucacaauaauauagcaguaguuauac

SEQ ID NO: 195325 - RNA, 32 nt, Human
gggaaaucaguaucugucuucccagugguugc

SEQ ID NO: 195326 - RNA, 32 nt, Human
gggaaaucauagacaauuucuuuuguagggcg

SEQ ID NO: 195327 - RNA, 32 nt, Human
gggaaaucauagccaaggggaaaucuaucagu

SEQ ID NO: 195328 - RNA, 32 nt, Human
gggaaaucccaguggugggcagccuggcacgc

SEQ ID NO: 195329 - RNA, 24 nt, Human
gggaaauccugcucuaugaauuca

SEQ ID NO: 195330 - RNA, 32 nt, Human
gggaaaucgcacuggugaagcugccguggggu

SEQ ID NO: 195331 - RNA, 21 nt, Human
gggaaaugaaaggaagccuga

SEQ ID NO: 195332 - RNA, 21 nt, Human
gggaaaugaagagaccucaga

SEQ ID NO: 195333 - RNA, 23 nt, Human
gggaaaugacuucuccaggcaga

SEQ ID NO: 195334 - RNA, 32 nt, Human
gggaaaugagggcugaaaauauccuccccaca

SEQ ID NO: 195335 - RNA, 32 nt, Human
gggaaaugcaggaaggccggguugugaggggu

SEQ ID NO: 195336 - RNA, 32 nt, Human
gggaaaugccaaggaugcuucugguggacuuc

SEQ ID NO: 195337 - RNA, 32 nt, Human
gggaaaugccaaggcagauucuagaggaagaa

SEQ ID NO: 195338 - RNA, 32 nt, Human
gggaaaugccuuuguacuuuagggaaguacuu

SEQ ID NO: 195339 - RNA, 30 nt, Human
gggaaauggacucugugcugaggcccuuca

SEQ ID NO: 195340 - RNA, 32 nt, Human
gggaaauggagacaaauucuggguacuagagu

SEQ ID NO: 195341 - RNA, 32 nt, Human
gggaaauggagaccccaacagccagcagcagu

SEQ ID NO: 195342 - RNA, 32 nt, Human
gggaaauggggccaugugaaugcagcugcucu

SEQ ID NO: 195343 - RNA, 32 nt, Human
gggaaauguuuucugccuuccugcuucuagaa

SEQ ID NO: 195344 - RNA, 32 nt, Human
gggaaauuauuugucaagcaaauguuuaaaau

SEQ ID NO: 195345 - RNA, 32 nt, Human
gggaaauugcucuccccucuguggcuuggacu

SEQ ID NO: 195346 - RNA, 32 nt, Human
gggaaauuguggucuccggccugggugagaca

SEQ ID NO: 195347 - RNA, 22 nt, Human
gggaacaaaggaggcucagaga

SEQ ID NO: 195348 - RNA, 32 nt, Human
gggaacaaagggagguugggcggggcggugcu

SEQ ID NO: 195349 - RNA, 32 nt, Human
gggaacaaaucucaaacugauccaucagucau

SEQ ID NO: 195350 - RNA, 32 nt, Human
gggaacaacaacagcaagccgcccccauccug

SEQ ID NO: 195351 - RNA, 32 nt, Human
gggaacaagccccucccuccacugccucagag

SEQ ID NO: 195352 - RNA, 32 nt, Human
gggaacaaguugagcuaugacuuaacauagcc

SEQ ID NO: 195353 - RNA, 32 nt, Human
gggaacacaagugucuucucauaagauuuaua

SEQ ID NO: 195354 - RNA, 32 nt, Human
gggaacaccugccucucccagaugcacagcug

SEQ ID NO: 195355 - RNA, 32 nt, Human
gggaacacgugcagugccgugguguggggauc

SEQ ID NO: 195356 - RNA, 22 nt, Human
gggaacacuagcuguccaggga

SEQ ID NO: 195357 - RNA, 32 nt, Human
gggaacacucucccaaggugauuuucuuuuuc

SEQ ID NO: 195358 - RNA, 32 nt, Human
gggaacagaagggcuuuuguuuuggaggguuu

SEQ ID NO: 195359 - RNA, 32 nt, Human
gggaacagaauuacaggaaguuuagggcaagg

SEQ ID NO: 195360 - RNA, 32 nt, Human
gggaacagacuccauucagacaucuuuauacu

SEQ ID NO: 195361 - RNA, 22 nt, Human
gggaacagagcaacagucuuuc

SEQ ID NO: 195362 - RNA, 31 nt, Human
gggaacagaugggacaauaaagacuggagac

SEQ ID NO: 195363 - RNA, 32 nt, Human
gggaacagaugggacaauaaagacuggagacu

SEQ ID NO: 195364 - RNA, 32 nt, Human
gggaacagcaggcagggcucugggugacgcau

SEQ ID NO: 195365 - RNA, 32 nt, Human
gggaacagccuggaugugagagccggugggag

SEQ ID NO: 195366 - RNA, 20 nt, Human
gggaacagcugggcccaggg

SEQ ID NO: 195367 - RNA, 24 nt, Human
gggaacagcugggcggccccagag

SEQ ID NO: 195368 - RNA, 32 nt, Human
gggaacagcuuccaauggcaugggaguucugu

SEQ ID NO: 195369 - RNA, 32 nt, Human
gggaacaggagagaggcaaugaugagugauca

SEQ ID NO: 195370 - RNA, 32 nt, Human
gggaacaggaggaggaagagggucagggugga

SEQ ID NO: 195371 - RNA, 32 nt, Human
gggaacaggccugucuggcccugagggagucc

SEQ ID NO: 195372 - RNA, 32 nt, Human
gggaacagggaacaaggcuggggagggaggag

SEQ ID NO: 195373 - RNA, 32 nt, Human
gggaacagggagcggugugcagaggagguggc

SEQ ID NO: 195374 - RNA, 32 nt, Human
gggaacagggccagggcaggcggggcagggcu

SEQ ID NO: 195375 - RNA, 32 nt, Human
gggaacaggggaggggaggagcuagggaaaga

SEQ ID NO: 195376 - RNA, 32 nt, Human
gggaacagggggcugaaggggcacuugucgua

SEQ ID NO: 195377 - RNA, 32 nt, Human
gggaacaggguagggaaaucuccauaccuucu

SEQ ID NO: 195378 - RNA, 32 nt, Human
gggaacagucauggcucacugcagcuuaagcu

SEQ ID NO: 195379 - RNA, 32 nt, Human
gggaacagugcaggagggaugggcuggugggg

SEQ ID NO: 195380 - RNA, 32 nt, Human
gggaacaguggggaacugucagaugcucgaac

SEQ ID NO: 195381 - RNA, 32 nt, Human
gggaacagugguggccagcuuggaggauggac

SEQ ID NO: 195382 - RNA, 32 nt, Human
gggaacagugguuggccaggcugcaguauaac

SEQ ID NO: 195383 - RNA, 32 nt, Human
gggaacauauauugcuguuuacuccaguguaa

SEQ ID NO: 195384 - RNA, 32 nt, Human
gggaacaucacacaccagggccugucaugggg

SEQ ID NO: 195385 - RNA, 32 nt, Human
gggaacaucacacuccggggacuguugugggg

SEQ ID NO: 195386 - RNA, 32 nt, Human
gggaacaucacacucuggggacuguugugggg

SEQ ID NO: 195387 - RNA, 32 nt, Human
gggaacaucacacucuggggccuguugugggg

SEQ ID NO: 195388 - RNA, 32 nt, Human
gggaacaucccucgucuuguccucucuucugc

SEQ ID NO: 195389 - RNA, 32 nt, Human
gggaacaucucaaaaugccaauguaaaauuua

SEQ ID NO: 195390 - RNA, 32 nt, Human
gggaacaugaccuggaaccacauggcaauacu

SEQ ID NO: 195391 - RNA, 32 nt, Human
gggaacaugccagggcuucagagcaccuuccu

SEQ ID NO: 195392 - RNA, 21 nt, Human
gggaacauguaggguggggag

SEQ ID NO: 195393 - RNA, 20 nt, Human
gggaaccacagagccaggag

SEQ ID NO: 195394 - RNA, 32 nt, Human
gggaaccaccucucugcucuccaucgcuacca

SEQ ID NO: 195395 - RNA, 32 nt, Human
gggaaccacugcaucaugucccgguauagcua

SEQ ID NO: 195396 - RNA, 32 nt, Human
gggaaccagagcugguuaagggccuagugaag

SEQ ID NO: 195397 - RNA, 23 nt, Human
gggaaccaggauuccucccuccu

SEQ ID NO: 195398 - RNA, 32 nt, Human
gggaaccauggcugccccgagagacaauguca

SEQ ID NO: 195399 - RNA, 32 nt, Human
gggaacccacggcuggagagaaauagggagau

SEQ ID NO: 195400 - RNA, 32 nt, Human
gggaacccaggaggcagagguugcagugagcu

SEQ ID NO: 195401 - RNA, 32 nt, Human
gggaacccaggagggcccuucuggggcagugg

SEQ ID NO: 195402 - RNA, 26 nt, Human
gggaacccaggcuggcaaccugccuc

SEQ ID NO: 195403 - RNA, 32 nt, Human
gggaaccccagccugccacgcugccuuccgcu

SEQ ID NO: 195404 - RNA, 32 nt, Human
gggaaccccaggaauugacccugaguuuuaaa

SEQ ID NO: 195405 - RNA, 32 nt, Human
gggaaccccugacccaggaggcuggaaguguc

SEQ ID NO: 195406 - RNA, 32 nt, Human
gggaaccccuggcagcugcugccaguccugga

SEQ ID NO: 195407 - RNA, 29 nt, Human
gggaacccgagccugcggcgccuuccccu

SEQ ID NO: 195408 - RNA, 26 nt, Human
gggaacccgggcugugcaccugccuc

SEQ ID NO: 195409 - RNA, 29 nt, Human
gggaacccgguuccuggcugccugccucu

SEQ ID NO: 195410 - RNA, 32 nt, Human
gggaacccgugcagcccuuggcugagugguuc

SEQ ID NO: 195411 - RNA, 32 nt, Human
gggaacccuccuaucagccacagggaagcugg

SEQ ID NO: 195412 - RNA, 32 nt, Human
gggaacccugcguuucuacugugugauucugc

SEQ ID NO: 195413 - RNA, 32 nt, Human
gggaacccuuacuuaugggcagucuccgaugu

SEQ ID NO: 195414 - RNA, 32 nt, Human
gggaacccuuucucauucuccaagccugguca

SEQ ID NO: 195415 - RNA, 32 nt, Human
gggaaccgagcagcaggucagagcaggcgagc

SEQ ID NO: 195416 - RNA, 32 nt, Human
gggaaccgcagucuucaucacagagguaccgu

SEQ ID NO: 195417 - RNA, 32 nt, Human
gggaaccguauguccuggaauauuagaugccu

SEQ ID NO: 195418 - RNA, 32 nt, Human
gggaaccguucccgggccguugaucuucggcc

SEQ ID NO: 195419 - RNA, 21 nt, Human
gggaaccucccuccccuccca

SEQ ID NO: 195420 - RNA, 32 nt, Human
gggaaccucccuggcccggcccggugcuuguc

SEQ ID NO: 195421 - RNA, 32 nt, Human
gggaaccucuccugccggaagccggacggcag

SEQ ID NO: 195422 - RNA, 32 nt, Human
gggaaccucugaacuccuccuuccucugggcu

SEQ ID NO: 195423 - RNA, 32 nt, Human
gggaaccucugccuaguuuucagaggauguau

SEQ ID NO: 195424 - RNA, 32 nt, Human
gggaaccugaacuaggaguccugggagagcug

SEQ ID NO: 195425 - RNA, 32 nt, Human
gggaaccuguguuuguuugugugcacauguaa

SEQ ID NO: 195426 - RNA, 32 nt, Human
gggaaccuguuccugcucacucuuugccuucu

SEQ ID NO: 195427 - RNA, 32 nt, Human
gggaacgauggccauggaguccacagccacug

SEQ ID NO: 195428 - RNA, 23 nt, Human
gggaacgcagagcaggaaugcgu

SEQ ID NO: 195429 - RNA, 32 nt, Human
gggaacgcuggcuggggacgaucacaaagccu

SEQ ID NO: 195430 - RNA, 24 nt, Human
gggaacggcccuagccuugggaag

SEQ ID NO: 195431 - RNA, 24 nt, Human
gggaacggcccuagcuuugggaag

SEQ ID NO: 195432 - RNA, 20 nt, Human
gggaacggccgcccuggaag

SEQ ID NO: 195433 - RNA, 22 nt, Human
gggaacgggcaagccuggaaag

SEQ ID NO: 195434 - RNA, 22 nt, Human
gggaacgggcggggcgggccgg

SEQ ID NO: 195435 - RNA, 32 nt, Human
gggaacuagugaucacuagcucaagaacugca

SEQ ID NO: 195436 - RNA, 32 nt, Human
gggaacucagccacuggugacguucagguugu

SEQ ID NO: 195437 - RNA, 28 nt, Human
gggaacucauuugcugccucuuggucau

SEQ ID NO: 195438 - RNA, 32 nt, Human
gggaacuccaggggaagugaggggagaagguu

SEQ ID NO: 195439 - RNA, 32 nt, Human
gggaacuccccuccucaacgccaggauguaga

SEQ ID NO: 195440 - RNA, 32 nt, Human
gggaacuccuuccucagccucucgucagcgcc

SEQ ID NO: 195441 - RNA, 20 nt, Human
gggaacucgcgugggcugag

SEQ ID NO: 195442 - RNA, 32 nt, Human
gggaacucuggccucgcugcacucauggcuuc

SEQ ID NO: 195443 - RNA, 32 nt, Human
gggaacucugugaggagaugcugguaaauuau

SEQ ID NO: 195444 - RNA, 32 nt, Human
gggaacugaaucaggaaacucaaaucgaauag

SEQ ID NO: 195445 - RNA, 19 nt, Human
gggaacugagcuucagaga

SEQ ID NO: 195446 - RNA, 32 nt, Human
gggaacugcaccagcuuccugcucuggauaca

SEQ ID NO: 195447 - RNA, 32 nt, Human
gggaacugccacuccugguugccauggaaaua

SEQ ID NO: 195448 - RNA, 31 nt, Human
gggaacugccucuuuccuguuguuguuaaug

SEQ ID NO: 195449 - RNA, 32 nt, Human
gggaacugcucacugacagcuucucuguaacc

SEQ ID NO: 195450 - RNA, 32 nt, Human
gggaacuggaaagaaaguuacagaaaggauag

SEQ ID NO: 195451 - RNA, 32 nt, Human
gggaacuggaaugccacacaaggcaaggccug

SEQ ID NO: 195452 - RNA, 22 nt, Human
gggaacuggcaggauucugggg

SEQ ID NO: 195453 - RNA, 32 nt, Human
gggaacuggcuuugagaugacaggguccagga

SEQ ID NO: 195454 - RNA, 32 nt, Human
gggaacugggagaagagcuggagcaacagccu

SEQ ID NO: 195455 - RNA, 32 nt, Human
gggaacugggcugucuagccggguauagguaa

SEQ ID NO: 195456 - RNA, 32 nt, Human
gggaacugugacaaacagccucgggcagauga

SEQ ID NO: 195457 - RNA, 32 nt, Human
gggaacugugguuacaggaaauggagcacucu

SEQ ID NO: 195458 - RNA, 32 nt, Human
gggaacuucagcacuacugugaaagagacaau

SEQ ID NO: 195459 - RNA, 32 nt, Human
gggaacuucucccucaccuccacacugccucu

SEQ ID NO: 195460 - RNA, 32 nt, Human
gggaacuucugccuagaugucagaggaaguau

SEQ ID NO: 195461 - RNA, 32 nt, Human
gggaacuugaaagacauuuaugccauauuauu

SEQ ID NO: 195462 - RNA, 32 nt, Human
gggaacuugagguuuaaagcagggggaggagg

SEQ ID NO: 195463 - RNA, 32 nt, Human
gggaacuugccucucccucuuguuuugcuccu

SEQ ID NO: 195464 - RNA, 32 nt, Human
gggaacuuggaguucagggggcuuccaccauu

SEQ ID NO: 195465 - RNA, 32 nt, Human
gggaacuuggauuagguggagaggcaguuggg

SEQ ID NO: 195466 - RNA, 21 nt, Human
gggaacuuugaggcucagaga

SEQ ID NO: 195467 - RNA, 32 nt, Human
gggaagaaaguggucacuggauggacuuaccc

SEQ ID NO: 195468 - RNA, 32 nt, Human
gggaagaaauccuaguaugccaaaaauauaug

SEQ ID NO: 195469 - RNA, 19 nt, Human
gggaagaacaaucagcaga

SEQ ID NO: 195470 - RNA, 32 nt, Human
gggaagaagaaagcagucagugcugggccuua

SEQ ID NO: 195471 - RNA, 31 nt, Human
gggaagaagagaccugggcuuggaaggaacc

SEQ ID NO: 195472 - RNA, 32 nt, Human
gggaagaagaggacgagguggcgcagagaccg

SEQ ID NO: 195473 - RNA, 22 nt, Human
gggaagaauggccauugggaga

SEQ ID NO: 195474 - RNA, 19 nt, Human
gggaagaauugcagaccag

SEQ ID NO: 195475 - RNA, 21 nt, Human
gggaagacacagaaggacaga

SEQ ID NO: 195476 - RNA, 32 nt, Human
gggaagacacuggcguccauagucagacccac

SEQ ID NO: 195477 - RNA, 32 nt, Human
gggaagacagccggccagagugcggugugcug

SEQ ID NO: 195478 - RNA, 32 nt, Human
gggaagacaggacguaaaggaaaaugagagaa

SEQ ID NO: 195479 - RNA, 32 nt, Human
gggaagacaugcugguucucugaugagcuggg

SEQ ID NO: 195480 - RNA, 18 nt, Human
gggaagacccagagcaag

SEQ ID NO: 195481 - RNA, 23 nt, Human
gggaagacccaggagcugggagg

SEQ ID NO: 195482 - RNA, 32 nt, Human
gggaagacccaggagcugggaggcacgggagu

SEQ ID NO: 195483 - RNA, 19 nt, Human
gggaagaccuuggaugcag

SEQ ID NO: 195484 - RNA, 21 nt, Human
gggaagacgagaagagacagg

SEQ ID NO: 195485 - RNA, 32 nt, Human
gggaagacggagcccugaagccugcgugugga

SEQ ID NO: 195486 - RNA, 32 nt, Human
gggaagacuuggggcucuuucugugacugagg

SEQ ID NO: 195487 - RNA, 32 nt, Human
gggaagagaaaaucgacucuucuuuuuacugu

SEQ ID NO: 195488 - RNA, 18 nt, Human
gggaagagaaagcugccu

SEQ ID NO: 195489 - RNA, 18 nt, Human
gggaagagaagaaacaga

SEQ ID NO: 195490 - RNA, 32 nt, Human
gggaagagaagcccaggucaccugccaagacc

SEQ ID NO: 195491 - RNA, 32 nt, Human
gggaagagagaagggaggagguuccaaguagu

SEQ ID NO: 195492 - RNA, 32 nt, Human
gggaagagagagggacagggacaagggcaaga

SEQ ID NO: 195493 - RNA, 32 nt, Human
gggaagagagaguuggggaaagagaaaugaga

SEQ ID NO: 195494 - RNA, 32 nt, Human
gggaagagaggaggaguggcagaagaaagaua

SEQ ID NO: 195495 - RNA, 32 nt, Human
gggaagagaggaggggagaggagaagggaaau

SEQ ID NO: 195496 - RNA, 32 nt, Human
gggaagagaguagaguagcuuucuccaagucc

SEQ ID NO: 195497 - RNA, 32 nt, Human
gggaagagagugacccagaugguaggaaaagg

SEQ ID NO: 195498 - RNA, 32 nt, Human
gggaagagagugacggagaaggagagaaagag

SEQ ID NO: 195499 - RNA, 32 nt, Human
gggaagagaguuucaagggaggcagcuggauu

SEQ ID NO: 195500 - RNA, 32 nt, Human
gggaagagauggggucuuacuauguuguccag

SEQ ID NO: 195501 - RNA, 32 nt, Human
gggaagagcauguggcaaggcacagaggagau

SEQ ID NO: 195502 - RNA, 32 nt, Human
gggaagagcucaucagugacccuucagugccu

SEQ ID NO: 195503 - RNA, 32 nt, Human
gggaagagcucccaccuucucuggaugugccu

SEQ ID NO: 195504 - RNA, 32 nt, Human
gggaagagcucccugcugugugccugcaccac

SEQ ID NO: 195505 - RNA, 32 nt, Human
gggaagagcuggggcccagagggaccuugagu

SEQ ID NO: 195506 - RNA, 32 nt, Human
gggaagaggaaaacgaggcaagaugcugagaa

SEQ ID NO: 195507 - RNA, 32 nt, Human
gggaagaggaaaaugaggcaagaugcugagaa

SEQ ID NO: 195508 - RNA, 32 nt, Human
gggaagaggaacaggccacagguucuccaagc

SEQ ID NO: 195509 - RNA, 32 nt, Human
gggaagaggacacggaugugaggugggaugag

SEQ ID NO: 195510 - RNA, 32 nt, Human
gggaagaggagagaaaagacagggacuuugaa

SEQ ID NO: 195511 - RNA, 32 nt, Human
gggaagaggaggaggaaggaaagaaagaaagc

SEQ ID NO: 195512 - RNA, 32 nt, Human
gggaagaggaggaggagguuguugaugacaca

SEQ ID NO: 195513 - RNA, 32 nt, Human
gggaagaggaugagcagagggaggaagauggc

SEQ ID NO: 195514 - RNA, 32 nt, Human
gggaagaggccugggaugcugcuaaacauccu

SEQ ID NO: 195515 - RNA, 32 nt, Human
gggaagaggcugggauggucucugcugcucuu

SEQ ID NO: 195516 - RNA, 32 nt, Human
gggaagaggcuuccugggcccccuggucuucg

SEQ ID NO: 195517 - RNA, 19 nt, Human
gggaagagggagugggagg

SEQ ID NO: 195518 - RNA, 32 nt, Human
gggaagagggccaggacaucuucugagccagg

SEQ ID NO: 195519 - RNA, 21 nt, Human
gggaagagguggaggaggagg

SEQ ID NO: 195520 - RNA, 32 nt, Human
gggaagagguggaggaggaggggccagggcag

SEQ ID NO: 195521 - RNA, 20 nt, Human
gggaagagguggcucuggag

SEQ ID NO: 195522 - RNA, 19 nt, Human
gggaagaggugguggcaga

SEQ ID NO: 195523 - RNA, 19 nt, Human
gggaagagugugggggagg

SEQ ID NO: 195524 - RNA, 19 nt, Human
gggaagauaagcugggagg

SEQ ID NO: 195525 - RNA, 32 nt, Human
gggaagauaccagcuuuuucucucaggguucu

SEQ ID NO: 195526 - RNA, 22 nt, Human
gggaagaucacuugagcccagg

SEQ ID NO: 195527 - RNA, 31 nt, Human
gggaagaucaucuaugagguuggagaugaaa

SEQ ID NO: 195528 - RNA, 32 nt, Human
gggaagaucccuugagcccaggaguucgagac

SEQ ID NO: 195529 - RNA, 32 nt, Human
gggaagauggaggccaccucagcuggagaaca

SEQ ID NO: 195530 - RNA, 31 nt, Human
gggaagauggcggagcuggggaagaaguacu

SEQ ID NO: 195531 - RNA, 22 nt, Human
gggaagauggcgguccuggggu

SEQ ID NO: 195532 - RNA, 31 nt, Human
gggaagauggcugcacggagcuggcaggacg

SEQ ID NO: 195533 - RNA, 16 nt, Human
gggaagauggcuggga

SEQ ID NO: 195534 - RNA, 32 nt, Human
gggaagaugggcagagaaaaaggggacaccua

SEQ ID NO: 195535 - RNA, 21 nt, Human
gggaagaugggugcugggaga

SEQ ID NO: 195536 - RNA, 26 nt, Human
gggaagauggugggguuuguuugcca

SEQ ID NO: 195537 - RNA, 21 nt, Human
gggaagcaaaccgugcccugg

SEQ ID NO: 195538 - RNA, 32 nt, Human
gggaagcaaaggcagaggcccuggggugggag

SEQ ID NO: 195539 - RNA, 32 nt, Human
gggaagcaagggggcuuagaauuuguggggua

SEQ ID NO: 195540 - RNA, 32 nt, Human
gggaagcacaugcuugcucuaggaauaucucc

SEQ ID NO: 195541 - RNA, 32 nt, Human
gggaagcacgccgccucccuacgcaccagcau

SEQ ID NO: 195542 - RNA, 32 nt, Human
gggaagcacuggccguucgcucccgggccggc

SEQ ID NO: 195543 - RNA, 20 nt, Human
gggaagcagaccgccuugga

SEQ ID NO: 195544 - RNA, 32 nt, Human
gggaagcagaggaggccagggaggcaggggag

SEQ ID NO: 195545 - RNA, 32 nt, Human
gggaagcagaguguccacccaccagggcagga

SEQ ID NO: 195546 - RNA, 32 nt, Human
gggaagcagccccagcaguggggucaugccug

SEQ ID NO: 195547 - RNA, 19 nt, Human
gggaagcagcugauggaga

SEQ ID NO: 195548 - RNA, 24 nt, Human
gggaagcagcuggaaagagacaga

SEQ ID NO: 195549 - RNA, 32 nt, Human
gggaagcaggagcaucuucuuggcagccaggc

SEQ ID NO: 195550 - RNA, 32 nt, Human
gggaagcaggcagagcggggaggugccugagc

SEQ ID NO: 195551 - RNA, 32 nt, Human
gggaagcaggcagcggucccagagccacccug

SEQ ID NO: 195552 - RNA, 32 nt, Human
gggaagcaggggaggggagggagcagcugggc

SEQ ID NO: 195553 - RNA, 32 nt, Human
gggaagcaggggcagagcgcucaggccagggc

SEQ ID NO: 195554 - RNA, 32 nt, Human
gggaagcauaguuuauuugcaaguguucaccu

SEQ ID NO: 195555 - RNA, 32 nt, Human
gggaagcaucagcaaccaagguagucucugcc

SEQ ID NO: 195556 - RNA, 32 nt, Human
gggaagcaucaucugcacagucccuguccuag

SEQ ID NO: 195557 - RNA, 20 nt, Human
gggaagccaaaugccucuca

SEQ ID NO: 195558 - RNA, 22 nt, Human
gggaagccaagacagguggauc

SEQ ID NO: 195559 - RNA, 24 nt, Human
gggaagccaaggcagguagauugu

SEQ ID NO: 195560 - RNA, 23 nt, Human
gggaagccaaggcagguggaucg

SEQ ID NO: 195561 - RNA, 22 nt, Human
gggaagccaaggcagguggauu

SEQ ID NO: 195562 - RNA, 23 nt, Human
gggaagccaaggcggguggauua

SEQ ID NO: 195563 - RNA, 32 nt, Human
gggaagccacugucccucccacuccaguaggg

SEQ ID NO: 195564 - RNA, 22 nt, Human
gggaagccagagccgccugcca

SEQ ID NO: 195565 - RNA, 32 nt, Human
gggaagccagcagagaccagggaaguggcagc

SEQ ID NO: 195566 - RNA, 32 nt, Human
gggaagccaguggagcugagcgggcugcaaga

SEQ ID NO: 195567 - RNA, 23 nt, Human
gggaagccauauguuuccaggga

SEQ ID NO: 195568 - RNA, 32 nt, Human
gggaagccaucacuuaccuugcacugagaaag

SEQ ID NO: 195569 - RNA, 32 nt, Human
gggaagccauuuuucugcaauggaauuaaaug

SEQ ID NO: 195570 - RNA, 32 nt, Human
gggaagcccacacacaccugcuuccuucaugg

SEQ ID NO: 195571 - RNA, 32 nt, Human
gggaagcccacgggacccucaggcgggcagga

SEQ ID NO: 195572 - RNA, 22 nt, Human
gggaagcccaucucaguuccug

SEQ ID NO: 195573 - RNA, 23 nt, Human
gggaagccccagagcuuuccuga

SEQ ID NO: 195574 - RNA, 21 nt, Human
gggaagccccaggcucuccga

SEQ ID NO: 195575 - RNA, 32 nt, Human
gggaagccccagggacugcaaguggccauuac

SEQ ID NO: 195576 - RNA, 32 nt, Human
gggaagccccuccaggagggaacacggucauc

SEQ ID NO: 195577 - RNA, 32 nt, Human
gggaagcccguggcagggcacaggguuguccc

SEQ ID NO: 195578 - RNA, 32 nt, Human
gggaagcccugaggcgccuuguuccgcuggcc

SEQ ID NO: 195579 - RNA, 32 nt, Human
gggaagcccuucuccccgggucugcccugugg

SEQ ID NO: 195580 - RNA, 23 nt, Human
gggaagccgaggcgggcagauca

SEQ ID NO: 195581 - RNA, 23 nt, Human
gggaagccgaggcggguggaaca

SEQ ID NO: 195582 - RNA, 23 nt, Human
gggaagccgaggcggguggauca

SEQ ID NO: 195583 - RNA, 23 nt, Human
gggaagccgaggugggcagauca

SEQ ID NO: 195584 - RNA, 24 nt, Human
gggaagccgaggugggcagaucau

SEQ ID NO: 195585 - RNA, 23 nt, Human
gggaagccgaggugggcggauca

SEQ ID NO: 195586 - RNA, 32 nt, Human
gggaagccgugcucgccccagcaggugcugac

SEQ ID NO: 195587 - RNA, 32 nt, Human
gggaagccucacccuucugcccuucacaggcu

SEQ ID NO: 195588 - RNA, 32 nt, Human
gggaagccuguaaucccagcuacuugggaggc

SEQ ID NO: 195589 - RNA, 32 nt, Human
gggaagccugugucuccugcccccagggcgca

SEQ ID NO: 195590 - RNA, 32 nt, Human
gggaagccuuucugccgcccaggcccacaggu

SEQ ID NO: 195591 - RNA, 17 nt, Human
gggaagcgcaaaggggc

SEQ ID NO: 195592 - RNA, 22 nt, Human
gggaagcgcccgcguccgggga

SEQ ID NO: 195593 - RNA, 32 nt, Human
gggaagcgcuguuugggcaggcugcaggagcu

SEQ ID NO: 195594 - RNA, 32 nt, Human
gggaagcgcuucacuccagguugguagcuucu

SEQ ID NO: 195595 - RNA, 19 nt, Human
gggaagcggaggugggaga

SEQ ID NO: 195596 - RNA, 21 nt, Human
gggaagcggagguugcaguga

SEQ ID NO: 195597 - RNA, 22 nt, Human
gggaagcggagguugcagugag

SEQ ID NO: 195598 - RNA, 32 nt, Human
gggaagcggcagcagaggcagggaccacucgg

SEQ ID NO: 195599 - RNA, 32 nt, Human
gggaagcuacuuccuuuccuuuuggagaugau

SEQ ID NO: 195600 - RNA, 32 nt, Human
gggaagcuagcaccagccugggccgcacacac

SEQ ID NO: 195601 - RNA, 32 nt, Human
gggaagcuaucggagaaaauacuccagcaaaa

SEQ ID NO: 195602 - RNA, 32 nt, Human
gggaagcucaguccucacagggccgacccuuc

SEQ ID NO: 195603 - RNA, 32 nt, Human
gggaagcuccuccucagcuuugagcuguggcu

SEQ ID NO: 195604 - RNA, 32 nt, Human
gggaagcucugccucuuuccccagugggcgag

SEQ ID NO: 195605 - RNA, 32 nt, Human
gggaagcucuuuagcaauaucagcuaaaagga

SEQ ID NO: 195606 - RNA, 23 nt, Human
gggaagcugaggcaggagaauca

SEQ ID NO: 195607 - RNA, 23 nt, Human
gggaagcugaggcaggaggauca

SEQ ID NO: 195608 - RNA, 32 nt, Human
gggaagcugaggcaggugaauuguuugaaccu

SEQ ID NO: 195609 - RNA, 23 nt, Human
gggaagcugaggcgggcggauca

SEQ ID NO: 195610 - RNA, 32 nt, Human
gggaagcugcaccagcccugaggugucagcug

SEQ ID NO: 195611 - RNA, 21 nt, Human
gggaagcugcagcuugggaga

SEQ ID NO: 195612 - RNA, 20 nt, Human
gggaagcugcccugcccugg

SEQ ID NO: 195613 - RNA, 32 nt, Human
gggaagcugcuggccuggcccuccuggucucu

SEQ ID NO: 195614 - RNA, 32 nt, Human
gggaagcugcuuggacccagucucaaacuuaa

SEQ ID NO: 195615 - RNA, 32 nt, Human
gggaagcuggaggaggugggggagacagagcu

SEQ ID NO: 195616 - RNA, 32 nt, Human
gggaagcuggggacuugggaagugaugggugu

SEQ ID NO: 195617 - RNA, 32 nt, Human
gggaagcuggggcuccccugcccacaggagag

SEQ ID NO: 195618 - RNA, 21 nt, Human
gggaagcugggguccaccgcu

SEQ ID NO: 195619 - RNA, 32 nt, Human
gggaagcugggucugaggggagacugaccucg

SEQ ID NO: 195620 - RNA, 26 nt, Human
gggaagcuggugucugaguccucuga

SEQ ID NO: 195621 - RNA, 32 nt, Human
gggaagcuuagcaauguaucuucaaauuuauu

SEQ ID NO: 195622 - RNA, 32 nt, Human
gggaagcuuucuuuuggugguuuuguuuauua

SEQ ID NO: 195623 - RNA, 32 nt, Human
gggaaggaaaaccaguagcaucagcagcagca

SEQ ID NO: 195624 - RNA, 32 nt, Human
gggaaggaaacuuagcagagugcuauugacua

SEQ ID NO: 195625 - RNA, 32 nt, Human
gggaaggaaagccagacacaaugcugcaauga

SEQ ID NO: 195626 - RNA, 32 nt, Human
gggaaggaaaggagguuuguucugcuccccgc

SEQ ID NO: 195627 - RNA, 32 nt, Human
gggaaggaacaggcacuuggaguccagacauu

SEQ ID NO: 195628 - RNA, 20 nt, Human
gggaaggaaccaagcugaca

SEQ ID NO: 195629 - RNA, 32 nt, Human
gggaaggaagaaaggaaggagggagaagggaa

SEQ ID NO: 195630 - RNA, 32 nt, Human
gggaaggaagagggcgagaucuuggcauccug

SEQ ID NO: 195631 - RNA, 20 nt, Human
gggaaggaagcagauucgga

SEQ ID NO: 195632 - RNA, 21 nt, Human
gggaaggaaggaacuacaaga

SEQ ID NO: 195633 - RNA, 32 nt, Human
gggaaggaaggaagagagggaggcgggcaagc

SEQ ID NO: 195634 - RNA, 32 nt, Human
gggaaggaaggaugaggccagauacaguccug

SEQ ID NO: 195635 - RNA, 32 nt, Human
gggaaggaaggggguuucaaccauguccccuu

SEQ ID NO: 195636 - RNA, 32 nt, Human
gggaaggaaugagagagagugaaaaggagagg

SEQ ID NO: 195637 - RNA, 26 nt, Human
gggaaggacagcaggggcccuggggu

SEQ ID NO: 195638 - RNA, 26 nt, Human
gggaaggacagcaggggucccggggu

SEQ ID NO: 195639 - RNA, 26 nt, Human
gggaaggacagcagggguccuggggu

SEQ ID NO: 195640 - RNA, 19 nt, Human
gggaaggacaucuccaggg

SEQ ID NO: 195641 - RNA, 32 nt, Human
gggaaggaccaagccucacucccaugcagaga

SEQ ID NO: 195642 - RNA, 32 nt, Human
gggaaggagaaaggguacuauaaggaauugcu

SEQ ID NO: 195643 - RNA, 32 nt, Human
gggaaggagaauuuucagaaguugcuggaguu

SEQ ID NO: 195644 - RNA, 32 nt, Human
gggaaggagagagguuuagugccauguucagu

SEQ ID NO: 195645 - RNA, 32 nt, Human
gggaaggagagggaagaagggaggagcggugc

SEQ ID NO: 195646 - RNA, 32 nt, Human
gggaaggagagggaggggaccgucaggaagcc

SEQ ID NO: 195647 - RNA, 32 nt, Human
gggaaggagaggggagagcagcgacaggccuc

SEQ ID NO: 195648 - RNA, 32 nt, Human
gggaaggagaggggagggcaggggauagguag

SEQ ID NO: 195649 - RNA, 32 nt, Human
gggaaggagaugccucuuccuucccuucaaua

SEQ ID NO: 195650 - RNA, 32 nt, Human
gggaaggagcacggggcugaucaagccaucca

SEQ ID NO: 195651 - RNA, 32 nt, Human
gggaaggagcagaaagcugggaaaggggaugg

SEQ ID NO: 195652 - RNA, 32 nt, Human
gggaaggagcagucacugggagagguuacccg

SEQ ID NO: 195653 - RNA, 31 nt, Human
gggaaggagcagucucccagcccugggucug

SEQ ID NO: 195654 - RNA, 32 nt, Human
gggaaggagccccagagagccggcugucugac

SEQ ID NO: 195655 - RNA, 32 nt, Human
gggaaggagccccaggagggagagggacccgg

SEQ ID NO: 195656 - RNA, 32 nt, Human
gggaaggagccgcgcccccaccuggagcugaa

SEQ ID NO: 195657 - RNA, 32 nt, Human
gggaaggagcugggagaaggagccccaccucu

SEQ ID NO: 195658 - RNA, 32 nt, Human
gggaaggaggaggaggaggagcaaagguguug

SEQ ID NO: 195659 - RNA, 32 nt, Human
gggaaggaggcaggggugcugagaaggcggcu

SEQ ID NO: 195660 - RNA, 32 nt, Human
gggaaggagggagggagguaagaggggcuugg

SEQ ID NO: 195661 - RNA, 32 nt, Human
gggaaggagggccuguggcugcaguccaggca

SEQ ID NO: 195662 - RNA, 32 nt, Human
gggaaggaggggcaaggucuuucaggaaccag

SEQ ID NO: 195663 - RNA, 32 nt, Human
gggaaggagugaaggaaggagugaaaaagggg

SEQ ID NO: 195664 - RNA, 32 nt, Human
gggaaggaucccucuccucucugccauuucuu

SEQ ID NO: 195665 - RNA, 22 nt, Human
gggaaggaugaguccucggggu

SEQ ID NO: 195666 - RNA, 32 nt, Human
gggaaggauggaagaaugggcagaagcagcag

SEQ ID NO: 195667 - RNA, 32 nt, Human
gggaaggauggcagagucgugagaaagguguu

SEQ ID NO: 195668 - RNA, 32 nt, Human
gggaaggcaaacccucuuuauugaacauuagc

SEQ ID NO: 195669 - RNA, 32 nt, Human
gggaaggcaacuugauucugugggaagggcug

SEQ ID NO: 195670 - RNA, 32 nt, Human
gggaaggcacugaaacgucaccagagagacag

SEQ ID NO: 195671 - RNA, 32 nt, Human
gggaaggcacuuccgcuuaggcucccaacaaa

SEQ ID NO: 195672 - RNA, 32 nt, Human
gggaaggcagaagucccagggauccuggggga

SEQ ID NO: 195673 - RNA, 32 nt, Human
gggaaggcagacuucugugcuuucuuuccugu

SEQ ID NO: 195674 - RNA, 18 nt, Human
gggaaggcagcuggggga

SEQ ID NO: 195675 - RNA, 32 nt, Human
gggaaggcagggaaauuugacaucauccccac

SEQ ID NO: 195676 - RNA, 32 nt, Human
gggaaggcauacaggccucauccaccaggcaa

SEQ ID NO: 195677 - RNA, 32 nt, Human
gggaaggcauccaggaugcggugcggggcggc

SEQ ID NO: 195678 - RNA, 32 nt, Human
gggaaggccaagaagcagguguucuauggcga

SEQ ID NO: 195679 - RNA, 32 nt, Human
gggaaggccauggggaccugaaacauugcccc

SEQ ID NO: 195680 - RNA, 19 nt, Human
gggaaggcccugagcguca

SEQ ID NO: 195681 - RNA, 32 nt, Human
gggaaggccgcugggagcaugaacuucugagc

SEQ ID NO: 195682 - RNA, 22 nt, Human
gggaaggcgcgggagccagggg

SEQ ID NO: 195683 - RNA, 32 nt, Human
gggaaggcggacggcgccucacugcaggaaag

SEQ ID NO: 195684 - RNA, 19 nt, Human
gggaaggcuauuugggaca

SEQ ID NO: 195685 - RNA, 32 nt, Human
gggaaggcucagaagggcagaguugaagaagg

SEQ ID NO: 195686 - RNA, 32 nt, Human
gggaaggcugagcaaagggggagcagcuacag

SEQ ID NO: 195687 - RNA, 32 nt, Human
gggaaggcugagguaggagaaucuuuugaauc

SEQ ID NO: 195688 - RNA, 32 nt, Human
gggaaggcuuuccccucuugggccacaccugc

SEQ ID NO: 195689 - RNA, 22 nt, Human
gggaagggaagccgucaggugg

SEQ ID NO: 195690 - RNA, 32 nt, Human
gggaagggaaggaggagaaagcaggcgaagcg

SEQ ID NO: 195691 - RNA, 32 nt, Human
gggaagggaagggagaggcaagcuggcuguga

SEQ ID NO: 195692 - RNA, 32 nt, Human
gggaagggaagugccacacaaccagaucuugu

SEQ ID NO: 195693 - RNA, 32 nt, Human
gggaagggacaacauggaagaaacagcgauuu

SEQ ID NO: 195694 - RNA, 32 nt, Human
gggaagggagacuggcccugcccagccggucu

SEQ ID NO: 195695 - RNA, 32 nt, Human
gggaagggagagagugagacugggagaaagag

SEQ ID NO: 195696 - RNA, 32 nt, Human
gggaagggagagugagcgcaugcugaaauuua

SEQ ID NO: 195697 - RNA, 32 nt, Human
gggaagggagaugugacggaugaaaaggagac

SEQ ID NO: 195698 - RNA, 32 nt, Human
gggaagggaggagggagagggaggacagggag

SEQ ID NO: 195699 - RNA, 32 nt, Human
gggaagggaggauuggaagggagccauccucu

SEQ ID NO: 195700 - RNA, 32 nt, Human
gggaagggaggcaggaggcuucucuggguaua

SEQ ID NO: 195701 - RNA, 32 nt, Human
gggaagggaggcgggaggugggcuggggcagc

SEQ ID NO: 195702 - RNA, 32 nt, Human
gggaagggauccuauauguccuguuggcucuu

SEQ ID NO: 195703 - RNA, 32 nt, Human
gggaagggcagaaggaaggagggaagaaaaga

SEQ ID NO: 195704 - RNA, 32 nt, Human
gggaagggcccagccacuuccagcuuuugauc

SEQ ID NO: 195705 - RNA, 32 nt, Human
gggaagggcgaguggcggggacuggggaaggg

SEQ ID NO: 195706 - RNA, 32 nt, Human
gggaaggggaaagagggaggaaggggaggggc

SEQ ID NO: 195707 - RNA, 32 nt, Human
gggaaggggaacacagaccaggaagcucggug

SEQ ID NO: 195708 - RNA, 32 nt, Human
gggaaggggaagaggaagaagagugaacaaag

SEQ ID NO: 195709 - RNA, 32 nt, Human
gggaaggggagagagaaggaauggggagugaa

SEQ ID NO: 195710 - RNA, 32 nt, Human
gggaaggggcugaaagcggcagaggagugccc

SEQ ID NO: 195711 - RNA, 32 nt, Human
gggaaggggcugaggacgagacccccauccag

SEQ ID NO: 195712 - RNA, 32 nt, Human
gggaaggggcugggaucggaacuuccugcucu

SEQ ID NO: 195713 - RNA, 32 nt, Human
gggaagggggaaagguguaggcugggggauug

SEQ ID NO: 195714 - RNA, 32 nt, Human
gggaagggggcugaggcguggaggaaacgcuu

SEQ ID NO: 195715 - RNA, 20 nt, Human
gggaaggggucacugugcug

SEQ ID NO: 195716 - RNA, 32 nt, Human
gggaaggguggggaggggaugggcuggagcuc

SEQ ID NO: 195717 - RNA, 32 nt, Human
gggaagguaggugggaaaugacaagaugagug

SEQ ID NO: 195718 - RNA, 32 nt, Human
gggaaggucaccagaguucaguucaccugugg

SEQ ID NO: 195719 - RNA, 32 nt, Human
gggaaggucagaggagaaggcaggcagggccc

SEQ ID NO: 195720 - RNA, 20 nt, Human
gggaaggucuaugauacuca

SEQ ID NO: 195721 - RNA, 16 nt, Human
gggaaggucucccaca

SEQ ID NO: 195722 - RNA, 32 nt, Human
gggaaggucugcagcuucacuccugagccagc

SEQ ID NO: 195723 - RNA, 32 nt, Human
gggaaggucuugggaccaguucucucucacuc

SEQ ID NO: 195724 - RNA, 32 nt, Human
gggaaggugagccagacacaggccgggacaaa

SEQ ID NO: 195725 - RNA, 32 nt, Human
gggaaggugccucuggaugcugugaagagucu

SEQ ID NO: 195726 - RNA, 32 nt, Human
gggaagguggacaggcuaaccucuccagcugu

SEQ ID NO: 195727 - RNA, 32 nt, Human
gggaagguggggcuauggcagcugcuagggac

SEQ ID NO: 195728 - RNA, 32 nt, Human
gggaagguuagaaguacgaaggcaguuuggag

SEQ ID NO: 195729 - RNA, 25 nt, Human
gggaaguagaaugagaggucuguug

SEQ ID NO: 195730 - RNA, 19 nt, Human
gggaaguagaggcugggag

SEQ ID NO: 195731 - RNA, 32 nt, Human
gggaaguaggcccuuacuucuggcagggugcu

SEQ ID NO: 195732 - RNA, 32 nt, Human
gggaaguaguugaaucauggaggcagguauuu

SEQ ID NO: 195733 - RNA, 32 nt, Human
gggaaguauccaugggccccaggggaagcugc

SEQ ID NO: 195734 - RNA, 22 nt, Human
gggaagucaaggcagguggauc

SEQ ID NO: 195735 - RNA, 32 nt, Human
gggaagucacuguugaaguugcaguggcuugu

SEQ ID NO: 195736 - RNA, 32 nt, Human
gggaaguccaggagaacuauaaguugucucug

SEQ ID NO: 195737 - RNA, 32 nt, Human
gggaaguccuggcgcagaugggccacggggcc

SEQ ID NO: 195738 - RNA, 32 nt, Human
gggaagugagagaaaaggggaugagugcaggg

SEQ ID NO: 195739 - RNA, 32 nt, Human
gggaagugagcuugugcuuaguauuuacauug

SEQ ID NO: 195740 - RNA, 32 nt, Human
gggaagugccuguguggucuguuuacagugca

SEQ ID NO: 195741 - RNA, 32 nt, Human
gggaagugcuaccucagcuaagccgcucaggu

SEQ ID NO: 195742 - RNA, 32 nt, Human
gggaaguggaggaaaugcuggacaagaaggca

SEQ ID NO: 195743 - RNA, 32 nt, Human
gggaagugggaaucguuagguucguucuggac

SEQ ID NO: 195744 - RNA, 32 nt, Human
gggaagugggacuccuggcuccccagggccug

SEQ ID NO: 195745 - RNA, 32 nt, Human
gggaagugggagagacagagggagagugugca

SEQ ID NO: 195746 - RNA, 32 nt, Human
gggaaguggguggcagggagaaaagaacauca

SEQ ID NO: 195747 - RNA, 32 nt, Human
gggaaguggguuggagggaggccaggccggca

SEQ ID NO: 195748 - RNA, 22 nt, Human
gggaagugucugcccaccugcc

SEQ ID NO: 195749 - RNA, 32 nt, Human
gggaaguuaguggccacagaagagagaugaaa

SEQ ID NO: 195750 - RNA, 21 nt, Human
gggaaguucgcgacuuucuga

SEQ ID NO: 195751 - RNA, 23 nt, Human
gggaaguugagguaggcagauca

SEQ ID NO: 195752 - RNA, 32 nt, Human
gggaaguugcuggcugacugggcuugcgagga

SEQ ID NO: 195753 - RNA, 18 nt, Human
gggaaguuggcuggagga

SEQ ID NO: 195754 - RNA, 32 nt, Human
gggaaguugggcccaggcaguguugcugcggu

SEQ ID NO: 195755 - RNA, 32 nt, Human
gggaaguuguucacagaugcaaagauucaguu

SEQ ID NO: 195756 - RNA, 32 nt, Human
gggaaguuuacugggccaucacagacuuuugu

SEQ ID NO: 195757 - RNA, 22 nt, Human
gggaaguuuccugacuuucuga

SEQ ID NO: 195758 - RNA, 32 nt, Human
gggaaguuugucucuccuuucuugcccaacca

SEQ ID NO: 195759 - RNA, 25 nt, Human
gggaauaaagaguauguugucaagc

SEQ ID NO: 195760 - RNA, 32 nt, Human
gggaauaagggucuugacuguugcccaagcug

SEQ ID NO: 195761 - RNA, 32 nt, Human
gggaauaaugaacuagaaaccagcaagugaaa

SEQ ID NO: 195762 - RNA, 32 nt, Human
gggaauacagugccaugaucauagcucacugc

SEQ ID NO: 195763 - RNA, 32 nt, Human
gggaauaccugucucugcucuagcagaggcua

SEQ ID NO: 195764 - RNA, 32 nt, Human
gggaauagaaaggggcagggaggggacaucug

SEQ ID NO: 195765 - RNA, 32 nt, Human
gggaauaggauuuuauuuuaaauguggaacca

SEQ ID NO: 195766 - RNA, 32 nt, Human
gggaauauauuucagggaaccccacccccaca

SEQ ID NO: 195767 - RNA, 32 nt, Human
gggaaucaaauuacaagcuauuuaaguuuaua

SEQ ID NO: 195768 - RNA, 32 nt, Human
gggaaucaauaugcccuuucacaugccuuaga

SEQ ID NO: 195769 - RNA, 32 nt, Human
gggaaucacagcuggggcagaccucauccugg

SEQ ID NO: 195770 - RNA, 32 nt, Human
gggaaucacuugaaccugggaggcagagguug

SEQ ID NO: 195771 - RNA, 32 nt, Human
gggaaucacuugaaccugggaggcagaguuug

SEQ ID NO: 195772 - RNA, 19 nt, Human
gggaauccaacaucaguga

SEQ ID NO: 195773 - RNA, 32 nt, Human
gggaauccacagagaagcggguagggagagag

SEQ ID NO: 195774 - RNA, 32 nt, Human
gggaauccagaauguugagauagagacggccu

SEQ ID NO: 195775 - RNA, 24 nt, Human
gggaauccuaaaagaaaaccccga

SEQ ID NO: 195776 - RNA, 25 nt, Human
gggaauccuaagagauaaaccccga

SEQ ID NO: 195777 - RNA, 25 nt, Human
gggaauccuagaaagagaacccuga

SEQ ID NO: 195778 - RNA, 25 nt, Human
gggaauccuagaaucagaacccuga

SEQ ID NO: 195779 - RNA, 32 nt, Human
gggaauccugcccucugguugugucugucauc

SEQ ID NO: 195780 - RNA, 32 nt, Human
gggaauccuggugaauauagugcugcuauguu

SEQ ID NO: 195781 - RNA, 32 nt, Human
gggaauccuggugcucaaauuacccuccaaaa

SEQ ID NO: 195782 - RNA, 32 nt, Human
gggaaucucaacaaccagggaucaggaggguc

SEQ ID NO: 195783 - RNA, 32 nt, Human
gggaaucucaguagcugggaauuauggaaaaa

SEQ ID NO: 195784 - RNA, 32 nt, Human
gggaaucuccccaggaugacugaagaugacuu

SEQ ID NO: 195785 - RNA, 32 nt, Human
gggaaucucccccgucaggugccugcagauua

SEQ ID NO: 195786 - RNA, 32 nt, Human
gggaaucugaggcagaggagggugaggccugu

SEQ ID NO: 195787 - RNA, 32 nt, Human
gggaaucugcaagaaccucccuuucccccucc

SEQ ID NO: 195788 - RNA, 32 nt, Human
gggaaucugcaagcugugcauugggcuuaccu

SEQ ID NO: 195789 - RNA, 32 nt, Human
gggaaucugcauuuuaguagcuucucagguga

SEQ ID NO: 195790 - RNA, 26 nt, Human
gggaaucugcuacagagaaggacaga

SEQ ID NO: 195791 - RNA, 32 nt, Human
gggaaucuggggacccaacacaacauccugaa

SEQ ID NO: 195792 - RNA, 32 nt, Human
gggaaucuucuuuccuccccucccauggacac

SEQ ID NO: 195793 - RNA, 22 nt, Human
gggaaugaaugggccucugaug

SEQ ID NO: 195794 - RNA, 23 nt, Human
gggaaugaauggggaggccgcug

SEQ ID NO: 195795 - RNA, 32 nt, Human
gggaaugacagugucugcaagccauugauauu

SEQ ID NO: 195796 - RNA, 32 nt, Human
gggaaugagaacaagccagacuuggugguuuc

SEQ ID NO: 195797 - RNA, 32 nt, Human
gggaaugaggaaggagugaggggaagaacaga

SEQ ID NO: 195798 - RNA, 32 nt, Human
gggaaugaggggaagccauuuuccagugacuu

SEQ ID NO: 195799 - RNA, 32 nt, Human
gggaaugcacacacgugcacuggagcagcugc

SEQ ID NO: 195800 - RNA, 32 nt, Human
gggaaugcagaggagacacagagccggcgggc

SEQ ID NO: 195801 - RNA, 32 nt, Human
gggaaugcauuccguuuuccuggguggaagcu

SEQ ID NO: 195802 - RNA, 32 nt, Human
gggaaugcgugagaggagagcagcucugagcc

SEQ ID NO: 195803 - RNA, 32 nt, Human
gggaaugcuauuuauuuuuauauuguguauau

SEQ ID NO: 195804 - RNA, 32 nt, Human
gggaauggaaagucugaguaacaagacaucuc

SEQ ID NO: 195805 - RNA, 32 nt, Human
gggaauggacuguacauugcucauuucacacu

SEQ ID NO: 195806 - RNA, 32 nt, Human
gggaauggaggaggcaggcggggcuggagacg

SEQ ID NO: 195807 - RNA, 32 nt, Human
gggaauggagucucagucuguugcccaggcug

SEQ ID NO: 195808 - RNA, 32 nt, Human
gggaauggaugcuucacuugaucuccggaccu

SEQ ID NO: 195809 - RNA, 32 nt, Human
gggaauggcgcuggcaucuggcugccacucug

SEQ ID NO: 195810 - RNA, 32 nt, Human
gggaauggcgugaacccaggaggcagagcuug

SEQ ID NO: 195811 - RNA, 32 nt, Human
gggaauggcuugaacccaggaggcagagguug

SEQ ID NO: 195812 - RNA, 29 nt, Human
gggaaugggaaagacagaagagaagggaa

SEQ ID NO: 195813 - RNA, 32 nt, Human
gggaaugggaaagacagaagagaagggaaaug

SEQ ID NO: 195814 - RNA, 32 nt, Human
gggaaugggagaagaugggagcuaagaaugua

SEQ ID NO: 195815 - RNA, 31 nt, Human
gggaauggggagagagaggaagcgacugagc

SEQ ID NO: 195816 - RNA, 32 nt, Human
gggaauggggucccggccgggaggcuuggccu

SEQ ID NO: 195817 - RNA, 31 nt, Human
gggaaugggguggaagggugauggggagcua

SEQ ID NO: 195818 - RNA, 32 nt, Human
gggaaugggguuucaaccacguuggccaggcu

SEQ ID NO: 195819 - RNA, 32 nt, Human
gggaaugguuaaauacauuauggccagcuuaa

SEQ ID NO: 195820 - RNA, 32 nt, Human
gggaauguaaagcuuucauccuuuguaugcaa

SEQ ID NO: 195821 - RNA, 32 nt, Human
gggaauguaaaggcuucauccuuuguauguaa

SEQ ID NO: 195822 - RNA, 32 nt, Human
gggaauguacugaaaggagccugcucuaccgc

SEQ ID NO: 195823 - RNA, 32 nt, Human
gggaauguagagcuagccaacauaucacauuc

SEQ ID NO: 195824 - RNA, 24 nt, Human
gggaauguagguuuuggcuuuuua

SEQ ID NO: 195825 - RNA, 29 nt, Human
gggaaugugcugccccacauguccaggcu

SEQ ID NO: 195826 - RNA, 32 nt, Human
gggaauguggggaucagggagguggagggaca

SEQ ID NO: 195827 - RNA, 32 nt, Human
gggaauguuauggguaacagacaugcaggcau

SEQ ID NO: 195828 - RNA, 22 nt, Human
gggaauguugucauccaggugg

SEQ ID NO: 195829 - RNA, 32 nt, Human
gggaauguuguuuucugacuaggcugaucauu

SEQ ID NO: 195830 - RNA, 32 nt, Human
gggaauguuugccucugccucugacacacagc

SEQ ID NO: 195831 - RNA, 24 nt, Human
gggaauuaaaaaagaacucugcag

SEQ ID NO: 195832 - RNA, 32 nt, Human
gggaauuagggugggggugggggaugaaggga

SEQ ID NO: 195833 - RNA, 32 nt, Human
gggaauuaguuugagggugaggguacauaugu

SEQ ID NO: 195834 - RNA, 32 nt, Human
gggaauuccaauucuuuuucucuccuuagauc

SEQ ID NO: 195835 - RNA, 32 nt, Human
gggaauucgagaccagccugaccaacauggag

SEQ ID NO: 195836 - RNA, 32 nt, Human
gggaauucgagaucagcgggaccaacauggug

SEQ ID NO: 195837 - RNA, 32 nt, Human
gggaauucucaaauaacaaaagaauggguucc

SEQ ID NO: 195838 - RNA, 32 nt, Human
gggaauugaacugggaccugcacugaacuuaa

SEQ ID NO: 195839 - RNA, 32 nt, Human
gggaauugagggcucaggggaggcaggaagau

SEQ ID NO: 195840 - RNA, 32 nt, Human
gggaauugcuugaacccgggaggcagagguua

SEQ ID NO: 195841 - RNA, 32 nt, Human
gggaauuggacagaggaaaggaaggggaaccc

SEQ ID NO: 195842 - RNA, 32 nt, Human
gggaauuggccugccuugcaugugagcuugau

SEQ ID NO: 195843 - RNA, 32 nt, Human
gggaauuggggaggggucguggcaggcagggu

SEQ ID NO: 195844 - RNA, 25 nt, Human
gggaauuggucccagguacaacaga

SEQ ID NO: 195845 - RNA, 32 nt, Human
gggaauuguugccuccugcucuuuuguuacug

SEQ ID NO: 195846 - RNA, 32 nt, Human
gggaauuuaucaccaacauccauuguaggggg

SEQ ID NO: 195847 - RNA, 20 nt, Human
gggaauuuccaccucugccu

SEQ ID NO: 195848 - RNA, 32 nt, Human
gggaauuucuggaaucucguauuugggggcuu

SEQ ID NO: 195849 - RNA, 32 nt, Human
gggaauuugggggauucgacagcagugacaga

SEQ ID NO: 195850 - RNA, 32 nt, Human
gggaauuuugcugcucccuauugcuucuguuu

SEQ ID NO: 195851 - RNA, 20 nt, Human
gggacaaaagaaucugaaca

SEQ ID NO: 195852 - RNA, 31 nt, Human
gggacaaagagacuguugguaacuguggauu

SEQ ID NO: 195853 - RNA, 22 nt, Human
gggacaaaggugcgucccuuca

SEQ ID NO: 195854 - RNA, 32 nt, Human
gggacaaagugugggugauccuggagacgcca

SEQ ID NO: 195855 - RNA, 32 nt, Human
gggacaacauguuucacagacaaaucauccaa

SEQ ID NO: 195856 - RNA, 32 nt, Human
gggacaaccaaaacaggucugcagagcaaagg

SEQ ID NO: 195857 - RNA, 32 nt, Human
gggacaaccagcuccccgacaacuccuaggug

SEQ ID NO: 195858 - RNA, 32 nt, Human
gggacaaccagcuuucagaguagccucaucag

SEQ ID NO: 195859 - RNA, 19 nt, Human
gggacaacccccuuccuua

SEQ ID NO: 195860 - RNA, 32 nt, Human
gggacaacugauuugcauuaugcucagcuggg

SEQ ID NO: 195861 - RNA, 32 nt, Human
gggacaagacuccgacuccagcucugacuuuu

SEQ ID NO: 195862 - RNA, 32 nt, Human
gggacaagagggcggaggaagaaguggggagc

SEQ ID NO: 195863 - RNA, 32 nt, Human
gggacaagauacauaugaggacaagguauaca

SEQ ID NO: 195864 - RNA, 32 nt, Human
gggacaagccauccaaaaaccccaggcccaca

SEQ ID NO: 195865 - RNA, 19 nt, Human
gggacaagcccuggagaaa

SEQ ID NO: 195866 - RNA, 23 nt, Human
gggacaagcuguggagcuggcug

SEQ ID NO: 195867 - RNA, 32 nt, Human
gggacaaggacaccuccagacagguugccagg

SEQ ID NO: 195868 - RNA, 32 nt, Human
gggacaagguaggggagagggaaaaacaguuu

SEQ ID NO: 195869 - RNA, 32 nt, Human
gggacaagguguuagaugaauuugaacaaaac

SEQ ID NO: 195870 - RNA, 32 nt, Human
gggacaaguacacgauccgcuggcauccagga

SEQ ID NO: 195871 - RNA, 32 nt, Human
gggacaagugcuugugugaguccuccgacaau

SEQ ID NO: 195872 - RNA, 32 nt, Human
gggacaaugccggcagccugagcccaggcacc

SEQ ID NO: 195873 - RNA, 32 nt, Human
gggacacaaagagggauggaagaaaagaacaa

SEQ ID NO: 195874 - RNA, 32 nt, Human
gggacacacacagucuucacugugcugcagcc

SEQ ID NO: 195875 - RNA, 31 nt, Human
gggacacacagccaggcaaggagggagcuca

SEQ ID NO: 195876 - RNA, 32 nt, Human
gggacacacgccuucagguuugcucagggguu

SEQ ID NO: 195877 - RNA, 32 nt, Human
gggacacacgugaagaggggaggcaggaagau

SEQ ID NO: 195878 - RNA, 32 nt, Human
gggacacagcacaaacgguguuuacgccacug

SEQ ID NO: 195879 - RNA, 32 nt, Human
gggacacagcagcguccggcgagaugaaggcg

SEQ ID NO: 195880 - RNA, 32 nt, Human
gggacacagcuauaacuguccagcucugugca

SEQ ID NO: 195881 - RNA, 18 nt, Human
gggacacagcucuucucu

SEQ ID NO: 195882 - RNA, 24 nt, Human
gggacacagcucuucucuccuucu

SEQ ID NO: 195883 - RNA, 32 nt, Human
gggacacaggcagcuggcaugggagggacuuu

SEQ ID NO: 195884 - RNA, 32 nt, Human
gggacacaggcuuggggcccacccucagaccu

SEQ ID NO: 195885 - RNA, 32 nt, Human
gggacacaugagacgcuacugcagcuuuugcc

SEQ ID NO: 195886 - RNA, 32 nt, Human
gggacaccagagagucguguggcugagguuuc

SEQ ID NO: 195887 - RNA, 32 nt, Human
gggacaccaggaugaggucagagagugcacug

SEQ ID NO: 195888 - RNA, 21 nt, Human
gggacacccacucgcuggcug

SEQ ID NO: 195889 - RNA, 32 nt, Human
gggacacccuggaagccaggaaauggacucag

SEQ ID NO: 195890 - RNA, 32 nt, Human
gggacacccuugcuguggaaaggacauccuua

SEQ ID NO: 195891 - RNA, 23 nt, Human
gggacaccgaggcaggagaauca

SEQ ID NO: 195892 - RNA, 32 nt, Human
gggacaccucucccccucaucccccgauguac

SEQ ID NO: 195893 - RNA, 32 nt, Human
gggacaccuggaagccaggaauugauuguacg

SEQ ID NO: 195894 - RNA, 22 nt, Human
gggacacgaauugccuggcuga

SEQ ID NO: 195895 - RNA, 22 nt, Human
gggacacggcccugcuggguga

SEQ ID NO: 195896 - RNA, 20 nt, Human
gggacacgggcagcucaggu

SEQ ID NO: 195897 - RNA, 23 nt, Human
gggacacgggggaccaccaggug

SEQ ID NO: 195898 - RNA, 32 nt, Human
gggacacgguguccaccauccccagcuggugg

SEQ ID NO: 195899 - RNA, 32 nt, Human
gggacacguagaggagagaaaagcgaccaaga

SEQ ID NO: 195900 - RNA, 22 nt, Human
gggacacguggggaguggggug

SEQ ID NO: 195901 - RNA, 20 nt, Human
gggacacuaaccauccaggu

SEQ ID NO: 195902 - RNA, 32 nt, Human
gggacacuaucaugaccacagacucagcauca

SEQ ID NO: 195903 - RNA, 32 nt, Human
gggacacucccaggccagcccaggggucaggg

SEQ ID NO: 195904 - RNA, 32 nt, Human
gggacacucugggccggccuucugccugcaug

SEQ ID NO: 195905 - RNA, 32 nt, Human
gggacacugccuggcagaggcugcgagcaugg

SEQ ID NO: 195906 - RNA, 32 nt, Human
gggacacugggucauggccuggaguugcugau

SEQ ID NO: 195907 - RNA, 32 nt, Human
gggacacugggucccggguucgugcuccuggu

SEQ ID NO: 195908 - RNA, 32 nt, Human
gggacacuuucagcuucuacuuuugccuucua

SEQ ID NO: 195909 - RNA, 32 nt, Human
gggacacuuuucuucccuccagccaggguuuc

SEQ ID NO: 195910 - RNA, 22 nt, Human
gggacagaaaagagaagacaga

SEQ ID NO: 195911 - RNA, 32 nt, Human
gggacagaaagagggucaguggacuuuugugg

SEQ ID NO: 195912 - RNA, 22 nt, Human
gggacagaaagguggacugggg

SEQ ID NO: 195913 - RNA, 32 nt, Human
gggacagaaauguggcuccaguugcucugucu

SEQ ID NO: 195914 - RNA, 21 nt, Human
gggacagaagaaauaaugggg

SEQ ID NO: 195915 - RNA, 32 nt, Human
gggacagaagaagaggaugaggaugagaugga

SEQ ID NO: 195916 - RNA, 26 nt, Human
gggacagaagaagccuccaaaucugg

SEQ ID NO: 195917 - RNA, 32 nt, Human
gggacagacagagagagggcccauggccugcu

SEQ ID NO: 195918 - RNA, 32 nt, Human
gggacagacauggguguuucagguugggaucu

SEQ ID NO: 195919 - RNA, 32 nt, Human
gggacagacuggccguugcuguggagacgccu

SEQ ID NO: 195920 - RNA, 32 nt, Human
gggacagagaaagaagggacagaggaaagggg

SEQ ID NO: 195921 - RNA, 20 nt, Human
gggacagagacagacagagg

SEQ ID NO: 195922 - RNA, 32 nt, Human
gggacagagagaggagaggaggaagauugagc

SEQ ID NO: 195923 - RNA, 21 nt, Human
gggacagagagcagggggcag

SEQ ID NO: 195924 - RNA, 22 nt, Human
gggacagagauggcaccugggg

SEQ ID NO: 195925 - RNA, 32 nt, Human
gggacagagcagaggaaggcaggggauuuagg

SEQ ID NO: 195926 - RNA, 21 nt, Human
gggacagagcagaggggccag

SEQ ID NO: 195927 - RNA, 32 nt, Human
gggacagagcugggaguccugaaggagaaagc

SEQ ID NO: 195928 - RNA, 32 nt, Human
gggacagaggaaaaggagagagagggggcucu

SEQ ID NO: 195929 - RNA, 24 nt, Human
gggacagaggaagcaauauggugg

SEQ ID NO: 195930 - RNA, 24 nt, Human
gggacagaggaaggccuccugagg

SEQ ID NO: 195931 - RNA, 22 nt, Human
gggacagaggaggcucgugggg

SEQ ID NO: 195932 - RNA, 20 nt, Human
gggacagaggagguaacaga

SEQ ID NO: 195933 - RNA, 18 nt, Human
gggacagaggcagagaga

SEQ ID NO: 195934 - RNA, 21 nt, Human
gggacagaggccaaggacuga

SEQ ID NO: 195935 - RNA, 20 nt, Human
gggacagaggcucaccuggg

SEQ ID NO: 195936 - RNA, 32 nt, Human
gggacagaggcugaugcuggaguggccaguag

SEQ ID NO: 195937 - RNA, 21 nt, Human
gggacagaggucagccuaagg

SEQ ID NO: 195938 - RNA, 32 nt, Human
gggacagagguggagacaggugcagugaccca

SEQ ID NO: 195939 - RNA, 22 nt, Human
gggacagagugagacccugucu

SEQ ID NO: 195940 - RNA, 22 nt, Human
gggacagagugagacuccaucu

SEQ ID NO: 195941 - RNA, 22 nt, Human
gggacagagugagacucugucu

SEQ ID NO: 195942 - RNA, 32 nt, Human
gggacagaguuucacucuuguugcccaggcgg

SEQ ID NO: 195943 - RNA, 32 nt, Human
gggacagauacuggaaucgggggugggacuug

SEQ ID NO: 195944 - RNA, 32 nt, Human
gggacagauccagaaacugagaagcuuauccg

SEQ ID NO: 195945 - RNA, 32 nt, Human
gggacagauccagcaggccccagucucgcauc

SEQ ID NO: 195946 - RNA, 32 nt, Human
gggacagcacagacccucuggcuggggcagcg

SEQ ID NO: 195947 - RNA, 20 nt, Human
gggacagcagaacgccaggg

SEQ ID NO: 195948 - RNA, 32 nt, Human
gggacagcagagaagaaacuagccagcuguga

SEQ ID NO: 195949 - RNA, 18 nt, Human
gggacagcagcugggaga

SEQ ID NO: 195950 - RNA, 32 nt, Human
gggacagccaaguugcugggcccagcugaacc

SEQ ID NO: 195951 - RNA, 16 nt, Human
gggacagcccagguca

SEQ ID NO: 195952 - RNA, 23 nt, Human
gggacagccggccaccugcccag

SEQ ID NO: 195953 - RNA, 32 nt, Human
gggacagccuggggcugcccagagacuguggg

SEQ ID NO: 195954 - RNA, 32 nt, Human
gggacagcgauucugagggugacugaggcuac

SEQ ID NO: 195955 - RNA, 20 nt, Human
gggacagcggcgggcggcug

SEQ ID NO: 195956 - RNA, 32 nt, Human
gggacagcgucagccccuccagccuggcucuu

SEQ ID NO: 195957 - RNA, 32 nt, Human
gggacagcuaaggacgacaagaggaggccgaa

SEQ ID NO: 195958 - RNA, 32 nt, Human
gggacagcucuggccagggcucugggacugca

SEQ ID NO: 195959 - RNA, 32 nt, Human
gggacagcuggacggcugccucccaggggcau

SEQ ID NO: 195960 - RNA, 32 nt, Human
gggacaggaaaagcaugaccagaugcucccuc

SEQ ID NO: 195961 - RNA, 32 nt, Human
gggacaggagaaaugaaauaccuggaacgaga

SEQ ID NO: 195962 - RNA, 32 nt, Human
gggacaggagugaauagaaagggaggagagcu

SEQ ID NO: 195963 - RNA, 21 nt, Human
gggacaggcaacaucuaucca

SEQ ID NO: 195964 - RNA, 32 nt, Human
gggacaggccaugugggagaccccaguugugc

SEQ ID NO: 195965 - RNA, 32 nt, Human
gggacaggcccaggcccgaccucaggucaucc

SEQ ID NO: 195966 - RNA, 24 nt, Human
gggacaggccgggcagugucccca

SEQ ID NO: 195967 - RNA, 32 nt, Human
gggacaggccucaccucuacccaaacccuagg

SEQ ID NO: 195968 - RNA, 21 nt, Human
gggacaggcucagccuccuca

SEQ ID NO: 195969 - RNA, 32 nt, Human
gggacaggcugcagccggugcaguuacacguu

SEQ ID NO: 195970 - RNA, 32 nt, Human
gggacagggaauuggcccugggagaaaacgcg

SEQ ID NO: 195971 - RNA, 32 nt, Human
gggacagggaggugacaguggaacaggcuacc

SEQ ID NO: 195972 - RNA, 32 nt, Human
gggacagggaggugugaggcaggagagacagu

SEQ ID NO: 195973 - RNA, 20 nt, Human
gggacagggccucacucugu

SEQ ID NO: 195974 - RNA, 32 nt, Human
gggacagggcuaauuaauuugcuuuauacauu

SEQ ID NO: 195975 - RNA, 32 nt, Human
gggacagggcugaggaugaggagaacccuggg

SEQ ID NO: 195976 - RNA, 32 nt, Human
gggacaggggcaggaggaagggguaggauuac

SEQ ID NO: 195977 - RNA, 32 nt, Human
gggacaggggcaggggcaggggcggagccccu

SEQ ID NO: 195978 - RNA, 32 nt, Human
gggacagggggaggggaggagcuagggaaaga

SEQ ID NO: 195979 - RNA, 32 nt, Human
gggacagggugaggguauacccaaagcugaug

SEQ ID NO: 195980 - RNA, 32 nt, Human
gggacaggguggcugagaaccaggacagggcc

SEQ ID NO: 195981 - RNA, 32 nt, Human
gggacagggugggcgggggugaggcugugaca

SEQ ID NO: 195982 - RNA, 23 nt, Human
gggacagggugugagcugggguc

SEQ ID NO: 195983 - RNA, 32 nt, Human
gggacaggguuucaccauguuaaccagucugg

SEQ ID NO: 195984 - RNA, 32 nt, Human
gggacagguagaggaugcuuuucguuucacug

SEQ ID NO: 195985 - RNA, 32 nt, Human
gggacagguccaggcuggcugaagacagucca

SEQ ID NO: 195986 - RNA, 32 nt, Human
gggacagguuccugccuuaucauuuucucccu

SEQ ID NO: 195987 - RNA, 32 nt, Human
gggacaguaagccagggguuaagguucuuucc

SEQ ID NO: 195988 - RNA, 32 nt, Human
gggacaguaagguuuggaggaagggggaucgu

SEQ ID NO: 195989 - RNA, 32 nt, Human
gggacagucaccgcugggguccuggcugcucu

SEQ ID NO: 195990 - RNA, 32 nt, Human
gggacagucagucaggaugacacuucggcauc

SEQ ID NO: 195991 - RNA, 25 nt, Human
gggacagucaugggaauguggggga

SEQ ID NO: 195992 - RNA, 22 nt, Human
gggacagucccucuccgugcgg

SEQ ID NO: 195993 - RNA, 32 nt, Human
gggacagugaaaggcagguuugagcugcugaa

SEQ ID NO: 195994 - RNA, 22 nt, Human
gggacagugcagagcaccgggg

SEQ ID NO: 195995 - RNA, 23 nt, Human
gggacagugccaagaguggggug

SEQ ID NO: 195996 - RNA, 32 nt, Human
gggacagugcugucccccaccccugcacacag

SEQ ID NO: 195997 - RNA, 32 nt, Human
gggacaguggccagggacuucggugcagauua

SEQ ID NO: 195998 - RNA, 32 nt, Human
gggacagugugggccuggccucuccuuuccuu

SEQ ID NO: 195999 - RNA, 21 nt, Human
gggacauaaacggggcggcug

SEQ ID NO: 196000 - RNA, 32 nt, Human
gggacauaugcagauccaaagaccuaaacaau

SEQ ID NO: 196001 - RNA, 26 nt, Human
gggacaucaaaaacagcagaacuucu

SEQ ID NO: 196002 - RNA, 32 nt, Human
gggacaucagcccuucauguagccccuugcug

SEQ ID NO: 196003 - RNA, 32 nt, Human
gggacauccuggacuugagccuagagauuuag

SEQ ID NO: 196004 - RNA, 32 nt, Human
gggacaucgcuguuccccagaaacccacucua

SEQ ID NO: 196005 - RNA, 32 nt, Human
gggacaucgggggcaaguuugcaguggggccg

SEQ ID NO: 196006 - RNA, 32 nt, Human
gggacaucucacuccacuccuaccucccuuac

SEQ ID NO: 196007 - RNA, 32 nt, Human
gggacaugaaggaggcggauacggcuggaccu

SEQ ID NO: 196008 - RNA, 18 nt, Human
gggacaugacaaaggugg

SEQ ID NO: 196009 - RNA, 32 nt, Human
gggacaugagccauucacaacagaggagaguu

SEQ ID NO: 196010 - RNA, 32 nt, Human
gggacaugaggccucaguggguggugagaggg

SEQ ID NO: 196011 - RNA, 20 nt, Human
gggacaugauccucuccuua

SEQ ID NO: 196012 - RNA, 19 nt, Human
gggacaugcaagggccaga

SEQ ID NO: 196013 - RNA, 32 nt, Human
gggacaugcacauaucagggguuguuugcagg

SEQ ID NO: 196014 - RNA, 21 nt, Human
gggacauggaggcauggguga

SEQ ID NO: 196015 - RNA, 23 nt, Human
gggacauggaugaagcuagguga

SEQ ID NO: 196016 - RNA, 23 nt, Human
gggacauggcccaggacacgggg

SEQ ID NO: 196017 - RNA, 32 nt, Human
gggacauggcccaucuggaauauucacaaaca

SEQ ID NO: 196018 - RNA, 32 nt, Human
gggacauggcuacccuucacuuuuggagggag

SEQ ID NO: 196019 - RNA, 17 nt, Human
gggacaugggggcccuc

SEQ ID NO: 196020 - RNA, 31 nt, Human
gggacauggguggaaugauggcagaauccag

SEQ ID NO: 196021 - RNA, 32 nt, Human
gggacauguuaaggaaaacaaauauguucauc

SEQ ID NO: 196022 - RNA, 20 nt, Human
gggacauuaaaccugaccuc

SEQ ID NO: 196023 - RNA, 32 nt, Human
gggacauugcagccgccuaccugcuccaggga

SEQ ID NO: 196024 - RNA, 18 nt, Human
gggacauuggggaguggg

SEQ ID NO: 196025 - RNA, 32 nt, Human
gggacauuugccagacccugugcuucucugcu

SEQ ID NO: 196026 - RNA, 18 nt, Human
gggacauuugcccccucc

SEQ ID NO: 196027 - RNA, 32 nt, Human
gggacauuuuggugaagaugcaauauuuuuau

SEQ ID NO: 196028 - RNA, 32 nt, Human
gggaccaaaaggauuaaugauaauuaauaaag

SEQ ID NO: 196029 - RNA, 32 nt, Human
gggaccaaauagugcuccugggugcauuguca

SEQ ID NO: 196030 - RNA, 32 nt, Human
gggaccaacaucaccacugacauucuguggcu

SEQ ID NO: 196031 - RNA, 32 nt, Human
gggaccaacauggugaaaccccgucucuacua

SEQ ID NO: 196032 - RNA, 32 nt, Human
gggaccaaccaaagugugucaacccuguuucc

SEQ ID NO: 196033 - RNA, 18 nt, Human
gggaccaaggcugggccc

SEQ ID NO: 196034 - RNA, 32 nt, Human
gggaccaagguggcacggugguacugggggug

SEQ ID NO: 196035 - RNA, 24 nt, Human
gggaccaaguacccucuggucuuu

SEQ ID NO: 196036 - RNA, 32 nt, Human
gggaccaagucacuugcuuccuuacuuagcaa

SEQ ID NO: 196037 - RNA, 32 nt, Human
gggaccacagagcaccagccugcauggaacuu

SEQ ID NO: 196038 - RNA, 32 nt, Human
gggaccacaggcgcccccaccauguccggcua

SEQ ID NO: 196039 - RNA, 32 nt, Human
gggaccacauggucaguaggcacacugccccu

SEQ ID NO: 196040 - RNA, 32 nt, Human
gggaccaccgaggacucugucacugcagaccc

SEQ ID NO: 196041 - RNA, 32 nt, Human
gggaccaccgagggcucugucacugcagaccc

SEQ ID NO: 196042 - RNA, 32 nt, Human
gggaccacugaaucuguuucuccagucuuggc

SEQ ID NO: 196043 - RNA, 32 nt, Human
gggaccacugggaaaugccccuugucccuuug

SEQ ID NO: 196044 - RNA, 32 nt, Human
gggaccacuucugccuuccuacguggcagugg

SEQ ID NO: 196045 - RNA, 32 nt, Human
gggaccagaacuuccccucccuuccccuuuuc

SEQ ID NO: 196046 - RNA, 32 nt, Human
gggaccagagggagccaggcagcuguguacag

SEQ ID NO: 196047 - RNA, 32 nt, Human
gggaccagagggugggacggccagguaucacu

SEQ ID NO: 196048 - RNA, 21 nt, Human
gggaccagcacaccugggcug

SEQ ID NO: 196049 - RNA, 22 nt, Human
gggaccagcagccagcaugcug

SEQ ID NO: 196050 - RNA, 32 nt, Human
gggaccagcagucuuucugauaacugggagag

SEQ ID NO: 196051 - RNA, 20 nt, Human
gggaccagccagggaggcag

SEQ ID NO: 196052 - RNA, 32 nt, Human
gggaccagcccuggugggcaugggguggggag

SEQ ID NO: 196053 - RNA, 21 nt, Human
gggaccagccggccugggaga

SEQ ID NO: 196054 - RNA, 32 nt, Human
gggaccagccugagguguaagggcagacaaac

SEQ ID NO: 196055 - RNA, 32 nt, Human
gggaccagccugggcaacauagggggauccca

SEQ ID NO: 196056 - RNA, 32 nt, Human
gggaccagccugggcuauauagcaagacccca

SEQ ID NO: 196057 - RNA, 26 nt, Human
gggaccagccuugccaacugcugcug

SEQ ID NO: 196058 - RNA, 32 nt, Human
gggaccagcgcuagccugaggagcucagagcc

SEQ ID NO: 196059 - RNA, 32 nt, Human
gggaccagcugggcagaugagaggcugagccu

SEQ ID NO: 196060 - RNA, 32 nt, Human
gggaccaggaaaccucuugcuugagugcugga

SEQ ID NO: 196061 - RNA, 32 nt, Human
gggaccaggaagacucauuccaaaaaggagcc

SEQ ID NO: 196062 - RNA, 32 nt, Human
gggaccaggaggaggaggaggaggaggaggag

SEQ ID NO: 196063 - RNA, 32 nt, Human
gggaccaggaguagcugucauuugauauguau

SEQ ID NO: 196064 - RNA, 24 nt, Human
gggaccaggaguuugagacuagcu

SEQ ID NO: 196065 - RNA, 21 nt, Human
gggaccaggcccuugaucaca

SEQ ID NO: 196066 - RNA, 32 nt, Human
gggaccaggccuguugucuuuugggugaggac

SEQ ID NO: 196067 - RNA, 32 nt, Human
gggaccaggcucccagugggcagcccuggccu

SEQ ID NO: 196068 - RNA, 32 nt, Human
gggaccaggcugggaggacagagccagcagcu

SEQ ID NO: 196069 - RNA, 32 nt, Human
gggaccaggcugggaggggaguguggcaggga

SEQ ID NO: 196070 - RNA, 32 nt, Human
gggaccaggcuggggucgcugcguugcugugc

SEQ ID NO: 196071 - RNA, 32 nt, Human
gggaccagggaggggaacaggagccagacaug

SEQ ID NO: 196072 - RNA, 32 nt, Human
gggaccaggucuguggaaaguggugcaugguc

SEQ ID NO: 196073 - RNA, 20 nt, Human
gggaccagguggggcgggug

SEQ ID NO: 196074 - RNA, 26 nt, Human
gggaccagucaguguuggcgcuggag

SEQ ID NO: 196075 - RNA, 32 nt, Human
gggaccagugaccaccuggacaugcaggaggg

SEQ ID NO: 196076 - RNA, 32 nt, Human
gggaccagugcagccgccgccucccaggaucg

SEQ ID NO: 196077 - RNA, 32 nt, Human
gggaccagugggaugggcucuaccucucuuuc

SEQ ID NO: 196078 - RNA, 32 nt, Human
gggaccaucacugagagucaggaguuuuacug

SEQ ID NO: 196079 - RNA, 17 nt, Human
gggaccaucccccuucu

SEQ ID NO: 196080 - RNA, 32 nt, Human
gggaccauccuggcuaacacgcgguaaaacau

SEQ ID NO: 196081 - RNA, 32 nt, Human
gggaccaugagaccucccacuccuggggccag

SEQ ID NO: 196082 - RNA, 32 nt, Human
gggaccaugaggguuggugugggaucuggugg

SEQ ID NO: 196083 - RNA, 32 nt, Human
gggaccaugccagcaacuaccaaaaaucucuu

SEQ ID NO: 196084 - RNA, 32 nt, Human
gggaccauggcagagaaaagcaggagaggagc

SEQ ID NO: 196085 - RNA, 32 nt, Human
gggaccauggggcuccugaccauucugaagaa

SEQ ID NO: 196086 - RNA, 32 nt, Human
gggaccauuauuaugcucauuucccagaggag

SEQ ID NO: 196087 - RNA, 32 nt, Human
gggacccaaaacacaggaagucagucacguuu

SEQ ID NO: 196088 - RNA, 32 nt, Human
gggacccaaacaggcccagcuaccagccuggc

SEQ ID NO: 196089 - RNA, 32 nt, Human
gggacccaacugcccugccugccucuagcucc

SEQ ID NO: 196090 - RNA, 32 nt, Human
gggacccaaggcaggagguacaccagcuggac

SEQ ID NO: 196091 - RNA, 21 nt, Human
gggacccaaggccacaaagga

SEQ ID NO: 196092 - RNA, 22 nt, Human
gggacccaagucugaacgugga

SEQ ID NO: 196093 - RNA, 20 nt, Human
gggacccaccagcucucucc

SEQ ID NO: 196094 - RNA, 19 nt, Human
gggacccaccucccccucc

SEQ ID NO: 196095 - RNA, 19 nt, Human
gggacccacgcaccucccu

SEQ ID NO: 196096 - RNA, 21 nt, Human
gggacccacggagcccucccu

SEQ ID NO: 196097 - RNA, 32 nt, Human
gggacccacggcucgccuccagccuccugcgc

SEQ ID NO: 196098 - RNA, 32 nt, Human
gggacccacucuacuacugcaggaugaccuca

SEQ ID NO: 196099 - RNA, 21 nt, Human
gggacccacuggacacaugga

SEQ ID NO: 196100 - RNA, 18 nt, Human
gggacccacuucucuccu

SEQ ID NO: 196101 - RNA, 20 nt, Human
gggacccagacccaccccca

SEQ ID NO: 196102 - RNA, 20 nt, Human
gggacccagaccucugggcc

SEQ ID NO: 196103 - RNA, 32 nt, Human
gggacccagagcaacaggaucugucacccacc

SEQ ID NO: 196104 - RNA, 32 nt, Human
gggacccagaguagaugcugaccugggcacuc

SEQ ID NO: 196105 - RNA, 32 nt, Human
gggacccagaucuugcuguggagacuguaagu

SEQ ID NO: 196106 - RNA, 32 nt, Human
gggacccagcagagcugggggagggaucagcc

SEQ ID NO: 196107 - RNA, 19 nt, Human
gggacccagcagguggaca

SEQ ID NO: 196108 - RNA, 32 nt, Human
gggacccagccuucagucacaugcuagcagcu

SEQ ID NO: 196109 - RNA, 32 nt, Human
gggacccagccuugcccuccacccgaggcucu

SEQ ID NO: 196110 - RNA, 32 nt, Human
gggacccagcgggccagguggggacggcgcgg

SEQ ID NO: 196111 - RNA, 32 nt, Human
gggacccaggcaggguuggguguugugacuca

SEQ ID NO: 196112 - RNA, 20 nt, Human
gggacccaggcuccgccuua

SEQ ID NO: 196113 - RNA, 19 nt, Human
gggacccaggcuucuccuc

SEQ ID NO: 196114 - RNA, 21 nt, Human
gggacccaggggccccucccu

SEQ ID NO: 196115 - RNA, 21 nt, Human
gggacccagguaacccccucu

SEQ ID NO: 196116 - RNA, 32 nt, Human
gggacccagguguggaguggagacuugauggg

SEQ ID NO: 196117 - RNA, 19 nt, Human
gggacccagguguguucag

SEQ ID NO: 196118 - RNA, 32 nt, Human
gggacccagugacucagagccugcucuuccug

SEQ ID NO: 196119 - RNA, 22 nt, Human
gggacccauaccaacugccuug

SEQ ID NO: 196120 - RNA, 17 nt, Human
gggacccauccaucucc

SEQ ID NO: 196121 - RNA, 19 nt, Human
gggacccaucugcuccucc

SEQ ID NO: 196122 - RNA, 32 nt, Human
gggacccaucuuccaccucaccucuuuguucu

SEQ ID NO: 196123 - RNA, 24 nt, Human
gggacccaugcagcacccagguca

SEQ ID NO: 196124 - RNA, 20 nt, Human
gggacccauggccucucucc

SEQ ID NO: 196125 - RNA, 18 nt, Human
gggacccauguaauccuu

SEQ ID NO: 196126 - RNA, 19 nt, Human
gggacccauuguucucuuc

SEQ ID NO: 196127 - RNA, 32 nt, Human
gggaccccacacacuccaggugggaucagaug

SEQ ID NO: 196128 - RNA, 17 nt, Human
gggaccccacccucucc

SEQ ID NO: 196129 - RNA, 32 nt, Human
gggaccccagacugucagcacagggaagaugg

SEQ ID NO: 196130 - RNA, 19 nt, Human
gggacccccagcccccucc

SEQ ID NO: 196131 - RNA, 32 nt, Human
gggacccccagccucauccucuuaguuggguc

SEQ ID NO: 196132 - RNA, 18 nt, Human
gggacccccgccuccuug

SEQ ID NO: 196133 - RNA, 32 nt, Human
gggaccccgagugccacuccagccucaccccc

SEQ ID NO: 196134 - RNA, 19 nt, Human
gggaccccgggcccccuuc

SEQ ID NO: 196135 - RNA, 32 nt, Human
gggaccccucaaggagggagacgcuccauauc

SEQ ID NO: 196136 - RNA, 32 nt, Human
gggaccccuccacccccaguacccuggacccc

SEQ ID NO: 196137 - RNA, 32 nt, Human
gggaccccuccccagggccuuuuccuccucug

SEQ ID NO: 196138 - RNA, 32 nt, Human
gggaccccuccugggauccccagcacauucuc

SEQ ID NO: 196139 - RNA, 32 nt, Human
gggaccccugccacuguccccugcugcagcac

SEQ ID NO: 196140 - RNA, 19 nt, Human
gggaccccugcgccccucc

SEQ ID NO: 196141 - RNA, 32 nt, Human
gggaccccugcucccagccugcugagagcccc

SEQ ID NO: 196142 - RNA, 32 nt, Human
gggaccccugcugccaccucuccugggccugu

SEQ ID NO: 196143 - RNA, 32 nt, Human
gggaccccuguuggccacuuguugaccucuca

SEQ ID NO: 196144 - RNA, 32 nt, Human
gggaccccuucccuugcugcuucucuuggcac

SEQ ID NO: 196145 - RNA, 32 nt, Human
gggacccgccagcuucagccuccagggccugg

SEQ ID NO: 196146 - RNA, 32 nt, Human
gggacccgccuuucuguguuguguucugcccu

SEQ ID NO: 196147 - RNA, 18 nt, Human
gggacccgcuccucccuu

SEQ ID NO: 196148 - RNA, 32 nt, Human
gggacccggagccgcgguacaggugugguugc

SEQ ID NO: 196149 - RNA, 17 nt, Human
gggacccggcccccacc

SEQ ID NO: 196150 - RNA, 32 nt, Human
gggacccggcgccgaugaaaccgaccaaacug

SEQ ID NO: 196151 - RNA, 32 nt, Human
gggacccguuggcagagguggcggcggcggca

SEQ ID NO: 196152 - RNA, 18 nt, Human
gggacccuaccacccucc

SEQ ID NO: 196153 - RNA, 20 nt, Human
gggacccuaccaggacacgg

SEQ ID NO: 196154 - RNA, 32 nt, Human
gggacccuauugcauuaaaguacaaauacuau

SEQ ID NO: 196155 - RNA, 19 nt, Human
gggacccuccagagagggu

SEQ ID NO: 196156 - RNA, 17 nt, Human
gggacccuccccuuccu

SEQ ID NO: 196157 - RNA, 32 nt, Human
gggacccuccugggaaggcaaguggccagugc

SEQ ID NO: 196158 - RNA, 17 nt, Human
gggacccugaacccucc

SEQ ID NO: 196159 - RNA, 32 nt, Human
gggacccugaagaaagggggccagcagcaggu

SEQ ID NO: 196160 - RNA, 32 nt, Human
gggacccugagcugcucucaggacgguggacc

SEQ ID NO: 196161 - RNA, 32 nt, Human
gggacccugcacucgacccugggggcuccuuc

SEQ ID NO: 196162 - RNA, 20 nt, Human
gggacccugcagcuccaggu

SEQ ID NO: 196163 - RNA, 32 nt, Human
gggacccuggccccagcguccccugccagcau

SEQ ID NO: 196164 - RNA, 18 nt, Human
gggacccuggugggggug

SEQ ID NO: 196165 - RNA, 20 nt, Human
gggacccugugccccuccuu

SEQ ID NO: 196166 - RNA, 32 nt, Human
gggacccugugggagcagcaggcuuccgagca

SEQ ID NO: 196167 - RNA, 32 nt, Human
gggacccuguuuggaccaggccaagccacacg

SEQ ID NO: 196168 - RNA, 21 nt, Human
gggacccuuugcaguggggug

SEQ ID NO: 196169 - RNA, 32 nt, Human
gggaccgaacuagcuuaacccgagucggccgu

SEQ ID NO: 196170 - RNA, 32 nt, Human
gggaccgacugaggccuaggcgccggagccgg

SEQ ID NO: 196171 - RNA, 22 nt, Human
gggaccgacugccugcguccag

SEQ ID NO: 196172 - RNA, 23 nt, Human
gggaccgagaagauuucgaaggu

SEQ ID NO: 196173 - RNA, 23 nt, Human
gggaccgaucucugcccccuccu

SEQ ID NO: 196174 - RNA, 32 nt, Human
gggaccgcaauccugaagacauugaauggcug

SEQ ID NO: 196175 - RNA, 15 nt, Human
gggaccgcacugaca

SEQ ID NO: 196176 - RNA, 32 nt, Human
gggaccgccagccgugggcacuggugggcccu

SEQ ID NO: 196177 - RNA, 32 nt, Human
gggaccgccucggggugugcagccggcucgcg

SEQ ID NO: 196178 - RNA, 19 nt, Human
gggaccgcguggccccccu

SEQ ID NO: 196179 - RNA, 32 nt, Human
gggaccgcuccucccuuuuuccuugucccaca

SEQ ID NO: 196180 - RNA, 32 nt, Human
gggaccgcugucuucccucccauacgccuuuc

SEQ ID NO: 196181 - RNA, 32 nt, Human
gggaccggauaacaccagaaagagggaugcua

SEQ ID NO: 196182 - RNA, 32 nt, Human
gggaccggcggcggcggcaaugcuggagaccc

SEQ ID NO: 196183 - RNA, 32 nt, Human
gggaccgggcucuggguaaccagcagaaggua

SEQ ID NO: 196184 - RNA, 32 nt, Human
gggaccggggcggucuuccagcagggaaaaug

SEQ ID NO: 196185 - RNA, 19 nt, Human
gggaccgggggguggggug

SEQ ID NO: 196186 - RNA, 32 nt, Human
gggaccggucacuguccagccuggagggaggc

SEQ ID NO: 196187 - RNA, 32 nt, Human
gggaccggugcuggggccucuccuugcugugu

SEQ ID NO: 196188 - RNA, 32 nt, Human
gggaccgucugaggacuggaguuugauccaug

SEQ ID NO: 196189 - RNA, 32 nt, Human
gggaccguucucugaucaucaggauuuucuug

SEQ ID NO: 196190 - RNA, 32 nt, Human
gggaccguucugugaucaucaggauuuucuug

SEQ ID NO: 196191 - RNA, 32 nt, Human
gggaccuacuccucccccuccuccaugcuguc

SEQ ID NO: 196192 - RNA, 32 nt, Human
gggaccuaugcuacccuucaggcaucagaaca

SEQ ID NO: 196193 - RNA, 22 nt, Human
gggaccucaaggacgacuuuca

SEQ ID NO: 196194 - RNA, 32 nt, Human
gggaccucaagggccuucugucagccuugccc

SEQ ID NO: 196195 - RNA, 19 nt, Human
gggaccucagugggggcag

SEQ ID NO: 196196 - RNA, 32 nt, Human
gggaccucauugaggucuggggcugcacccca

SEQ ID NO: 196197 - RNA, 21 nt, Human
gggaccuccaguugggccagg

SEQ ID NO: 196198 - RNA, 17 nt, Human
gggaccucgcccccucc

SEQ ID NO: 196199 - RNA, 32 nt, Human
gggaccucgggggagcucaagccucgacuguc

SEQ ID NO: 196200 - RNA, 32 nt, Human
gggaccucucacuccgugaagacuccaucacc

SEQ ID NO: 196201 - RNA, 32 nt, Human
gggaccucuguggcacucagggcugcagccac

SEQ ID NO: 196202 - RNA, 32 nt, Human
gggaccucuuucuccuggacauugaagauaug

SEQ ID NO: 196203 - RNA, 20 nt, Human
gggaccugaaggggccgcug

SEQ ID NO: 196204 - RNA, 32 nt, Human
gggaccugacagcacaccacugucuuccccag

SEQ ID NO: 196205 - RNA, 32 nt, Human
gggaccugacuuccaccucucugcccagauuu

SEQ ID NO: 196206 - RNA, 19 nt, Human
gggaccugagaacguuuca

SEQ ID NO: 196207 - RNA, 32 nt, Human
gggaccugagcuacaugcagguugugagcugg

SEQ ID NO: 196208 - RNA, 32 nt, Human
gggaccugagcuuugcuacccaaccagauucc

SEQ ID NO: 196209 - RNA, 32 nt, Human
gggaccugcacugcccuuuccagccugacauc

SEQ ID NO: 196210 - RNA, 32 nt, Human
gggaccugcccaggauggagaugagagagggu

SEQ ID NO: 196211 - RNA, 17 nt, Human
gggaccugcccccuccu

SEQ ID NO: 196212 - RNA, 32 nt, Human
gggaccugcccggagaccucaggcggccuucu

SEQ ID NO: 196213 - RNA, 32 nt, Human
gggaccugcccucccuuggucccaggucacug

SEQ ID NO: 196214 - RNA, 19 nt, Human
gggaccugccgggccucug

SEQ ID NO: 196215 - RNA, 32 nt, Human
gggaccugccugagggcucccugcugcaguuc

SEQ ID NO: 196216 - RNA, 32 nt, Human
gggaccugcgguaccugcuguagucacgaggg

SEQ ID NO: 196217 - RNA, 32 nt, Human
gggaccugcucagcaggugugaccaggguucu

SEQ ID NO: 196218 - RNA, 22 nt, Human
gggaccugcugggaauggggug

SEQ ID NO: 196219 - RNA, 32 nt, Human
gggaccuggaaccugggcguacuagagugccg

SEQ ID NO: 196220 - RNA, 32 nt, Human
gggaccuggagugcugggcuugugcacaggaa

SEQ ID NO: 196221 - RNA, 32 nt, Human
gggaccuggaguguguuuggacugcaguuugc

SEQ ID NO: 196222 - RNA, 32 nt, Human
gggaccuggcagcgugauuggaguauggaugu

SEQ ID NO: 196223 - RNA, 32 nt, Human
gggaccuggccaagggcuccacacaccaagac

SEQ ID NO: 196224 - RNA, 21 nt, Human
gggaccuggccagccgugcag

SEQ ID NO: 196225 - RNA, 32 nt, Human
gggaccuggccaggguggagcauugucugggu

SEQ ID NO: 196226 - RNA, 32 nt, Human
gggaccugggagaauggggcugagaggaggcu

SEQ ID NO: 196227 - RNA, 32 nt, Human
gggaccugggccugacgggcccuucucagccc

SEQ ID NO: 196228 - RNA, 32 nt, Human
gggaccuggugggagagaggggacuuccaggg

SEQ ID NO: 196229 - RNA, 22 nt, Human
gggaccugguguggguggagug

SEQ ID NO: 196230 - RNA, 32 nt, Human
gggaccuguaaucccagcuacuugggaggcug

SEQ ID NO: 196231 - RNA, 32 nt, Human
gggaccugucugcauauacacacggggaaugc

SEQ ID NO: 196232 - RNA, 32 nt, Human
gggaccugucuuggacugugggagacucaccc

SEQ ID NO: 196233 - RNA, 32 nt, Human
gggaccugugguuugcuggcggaaacaaauga

SEQ ID NO: 196234 - RNA, 32 nt, Human
gggaccuguguccuuccgccuccagagcugcc

SEQ ID NO: 196235 - RNA, 17 nt, Human
gggaccuguguggggug

SEQ ID NO: 196236 - RNA, 32 nt, Human
gggaccuuaauuugucuugcauggacauuugu

SEQ ID NO: 196237 - RNA, 31 nt, Human
gggaccuucaauaaacacuuguccagugaaa

SEQ ID NO: 196238 - RNA, 32 nt, Human
gggaccuucucccucacuccccucccuccuag

SEQ ID NO: 196239 - RNA, 17 nt, Human
gggaccuucucccuccu

SEQ ID NO: 196240 - RNA, 32 nt, Human
gggaccuucucgcgcuccuccuggccucugag

SEQ ID NO: 196241 - RNA, 20 nt, Human
gggaccuugauggagugggg

SEQ ID NO: 196242 - RNA, 32 nt, Human
gggaccuuggcauguggcuggccacaccaagc

SEQ ID NO: 196243 - RNA, 32 nt, Human
gggaccuugggcaggucucuccaccucucugg

SEQ ID NO: 196244 - RNA, 32 nt, Human
gggacgaacaaggacugggcuggguccagcug

SEQ ID NO: 196245 - RNA, 20 nt, Human
gggacgaacgcugcuggcug

SEQ ID NO: 196246 - RNA, 32 nt, Human
gggacgaaguuucacucuuguugcccaggcug

SEQ ID NO: 196247 - RNA, 32 nt, Human
gggacgacagccugggcucagagucaggcuug

SEQ ID NO: 196248 - RNA, 32 nt, Human
gggacgagcuucccaggauuccccgaccuucc

SEQ ID NO: 196249 - RNA, 32 nt, Human
gggacgaggaagagcuggagcccgcagaagcc

SEQ ID NO: 196250 - RNA, 20 nt, Human
gggacgaggagcagcggcug

SEQ ID NO: 196251 - RNA, 32 nt, Human
gggacgaggaggaggaggaggaagaggggaug

SEQ ID NO: 196252 - RNA, 32 nt, Human
gggacgaggauggggaaagaggcagcaugucu

SEQ ID NO: 196253 - RNA, 20 nt, Human
gggacgaggcggaccggcug

SEQ ID NO: 196254 - RNA, 32 nt, Human
gggacgcagaaagguuaaggcacuuuuaaaaa

SEQ ID NO: 196255 - RNA, 32 nt, Human
gggacgcagagcugcgagagaaucuuguucag

SEQ ID NO: 196256 - RNA, 21 nt, Human
gggacgcagccccaguggcug

SEQ ID NO: 196257 - RNA, 32 nt, Human
gggacgccaaagagagguugcagucagaaccg

SEQ ID NO: 196258 - RNA, 19 nt, Human
gggacgccagcgccugcag

SEQ ID NO: 196259 - RNA, 18 nt, Human
gggacgccagcgccuggc

SEQ ID NO: 196260 - RNA, 32 nt, Human
gggacgccauguccauggaggaccccuucuuu

SEQ ID NO: 196261 - RNA, 23 nt, Human
gggacgcccaaggccacccacug

SEQ ID NO: 196262 - RNA, 20 nt, Human
gggacgcccagauccugcug

SEQ ID NO: 196263 - RNA, 20 nt, Human
gggacgcccccgcccaccug

SEQ ID NO: 196264 - RNA, 19 nt, Human
gggacgccccgcgccgagc

SEQ ID NO: 196265 - RNA, 19 nt, Human
gggacgccccgcugccgcu

SEQ ID NO: 196266 - RNA, 17 nt, Human
gggacgccccggccgcu

SEQ ID NO: 196267 - RNA, 19 nt, Human
gggacgccccguccggggc

SEQ ID NO: 196268 - RNA, 18 nt, Human
gggacgccccugccuagc

SEQ ID NO: 196269 - RNA, 22 nt, Human
gggacgccgaggcggcgggcgg

SEQ ID NO: 196270 - RNA, 32 nt, Human
gggacgccggcagacacgggugaccucucgcc

SEQ ID NO: 196271 - RNA, 32 nt, Human
gggacgccucggcucgcgccucccgggcgggc

SEQ ID NO: 196272 - RNA, 24 nt, Human
gggacgccugcccugcccaggugg

SEQ ID NO: 196273 - RNA, 20 nt, Human
gggacgccuggagccugcug

SEQ ID NO: 196274 - RNA, 20 nt, Human
gggacgccuggccacugcug

SEQ ID NO: 196275 - RNA, 16 nt, Human
gggacgccugugcugg

SEQ ID NO: 196276 - RNA, 21 nt, Human
gggacgccuguggcuuggcug

SEQ ID NO: 196277 - RNA, 32 nt, Human
gggacgccuuucugucucugcugagcuguggc

SEQ ID NO: 196278 - RNA, 20 nt, Human
gggacgcgaguggcuggcug

SEQ ID NO: 196279 - RNA, 22 nt, Human
gggacgcggaaguggcagguga

SEQ ID NO: 196280 - RNA, 32 nt, Human
gggacgcgggagggguggaggcugcggggagc

SEQ ID NO: 196281 - RNA, 21 nt, Human
gggacgcgugcggcgggacgg

SEQ ID NO: 196282 - RNA, 20 nt, Human
gggacgcuccagcuggucug

SEQ ID NO: 196283 - RNA, 20 nt, Human
gggacgcugcucagcugcug

SEQ ID NO: 196284 - RNA, 17 nt, Human
gggacgcugcugcuggc

SEQ ID NO: 196285 - RNA, 32 nt, Human
gggacgcuggcacugguggggagcuguugggg

SEQ ID NO: 196286 - RNA, 32 nt, Human
gggacgcuggugucucuggaggcccuuccuga

SEQ ID NO: 196287 - RNA, 32 nt, Human
gggacggaaaggacaggucccaagggaugggg

SEQ ID NO: 196288 - RNA, 20 nt, Human
gggacggacagggcuggcug

SEQ ID NO: 196289 - RNA, 21 nt, Human
gggacggaccccagcuggggu

SEQ ID NO: 196290 - RNA, 20 nt, Human
gggacggagcgagcaaggag

SEQ ID NO: 196291 - RNA, 32 nt, Human
gggacggaugaaauucaccaaagucucuacca

SEQ ID NO: 196292 - RNA, 31 nt, Human
gggacggcaacuuucugacaucccacagcag

SEQ ID NO: 196293 - RNA, 32 nt, Human
gggacggcccacucugccccagggagucccuu

SEQ ID NO: 196294 - RNA, 18 nt, Human
gggacggccgccccuccu

SEQ ID NO: 196295 - RNA, 32 nt, Human
gggacggccucuggacugccaggcuggguugg

SEQ ID NO: 196296 - RNA, 32 nt, Human
gggacggcuccucugaguguucccuggcccca

SEQ ID NO: 196297 - RNA, 16 nt, Human
gggacggcuggcuggc

SEQ ID NO: 196298 - RNA, 32 nt, Human
gggacggcugugagccaagagccgcggagcac

SEQ ID NO: 196299 - RNA, 32 nt, Human
gggacggcugugguaggcauuggcuugcagcu

SEQ ID NO: 196300 - RNA, 19 nt, Human
gggacggcuugaugggaga

SEQ ID NO: 196301 - RNA, 32 nt, Human
gggacgggaggaggagaaagguggaggagaag

SEQ ID NO: 196302 - RNA, 32 nt, Human
gggacgggagugagagcgggagugagagcagg

SEQ ID NO: 196303 - RNA, 32 nt, Human
gggacggggaagagaagcaaagcggcgcgcau

SEQ ID NO: 196304 - RNA, 32 nt, Human
gggacggggcaggcaggagucugggaggcggg

SEQ ID NO: 196305 - RNA, 17 nt, Human
gggacgggggcggggug

SEQ ID NO: 196306 - RNA, 32 nt, Human
gggacgggguggggaaacggaggcaggggaca

SEQ ID NO: 196307 - RNA, 20 nt, Human
gggacggugcaggcugguug

SEQ ID NO: 196308 - RNA, 32 nt, Human
gggacggugcagggaaaggagcccugccaggc

SEQ ID NO: 196309 - RNA, 32 nt, Human
gggacggugccacuuccagacaagacccacaa

SEQ ID NO: 196310 - RNA, 32 nt, Human
gggacggugcugcuguccacgguuacagccca

SEQ ID NO: 196311 - RNA, 32 nt, Human
gggacgguuggcaccuuccucgggggcgggcc

SEQ ID NO: 196312 - RNA, 32 nt, Human
gggacgucacccaaggcugguggucaguguga

SEQ ID NO: 196313 - RNA, 20 nt, Human
gggacgucagcggacggggc

SEQ ID NO: 196314 - RNA, 16 nt, Human
gggacguccagcuggc

SEQ ID NO: 196315 - RNA, 20 nt, Human
gggacgucggcgagcggcug

SEQ ID NO: 196316 - RNA, 32 nt, Human
gggacgucuguaaucccagcuacuugggagac

SEQ ID NO: 196317 - RNA, 32 nt, Human
gggacgugagccgcugcgcccaccgggcuaga

SEQ ID NO: 196318 - RNA, 32 nt, Human
gggacguggagagacggcgccgcccggguccu

SEQ ID NO: 196319 - RNA, 32 nt, Human
gggacguggggaggggaccugcaggggccagc

SEQ ID NO: 196320 - RNA, 22 nt, Human
gggacgugggggcagccaggga

SEQ ID NO: 196321 - RNA, 21 nt, Human
gggacgugggggccccgggug

SEQ ID NO: 196322 - RNA, 32 nt, Human
gggacguguuggguuuuucuuccuuacacuau

SEQ ID NO: 196323 - RNA, 21 nt, Human
gggacguugcugagcuggcug

SEQ ID NO: 196324 - RNA, 20 nt, Human
gggacguugguggcuggcug

SEQ ID NO: 196325 - RNA, 19 nt, Human
gggacguuuggagcugcug

SEQ ID NO: 196326 - RNA, 32 nt, Human
gggacguuugugaaugacaugcgcaucccgga

SEQ ID NO: 196327 - RNA, 32 nt, Human
gggacuaagaaagagaaauugaucagaaucua

SEQ ID NO: 196328 - RNA, 32 nt, Human
gggacuaagccaagggauucagguguggugcc

SEQ ID NO: 196329 - RNA, 32 nt, Human
gggacuacaagaagaggagcugccugaguggu

SEQ ID NO: 196330 - RNA, 23 nt, Human
gggacuacagacacccgccacca

SEQ ID NO: 196331 - RNA, 20 nt, Human
gggacuacaggcaugcgcca

SEQ ID NO: 196332 - RNA, 23 nt, Human
gggacuacaggggcccgccacca

SEQ ID NO: 196333 - RNA, 32 nt, Human
gggacuacauuaaacccaaaacuccugcacaa

SEQ ID NO: 196334 - RNA, 32 nt, Human
gggacuaccagccagaggguucauggagguag

SEQ ID NO: 196335 - RNA, 23 nt, Human
gggacuacccaugagaguggggu

SEQ ID NO: 196336 - RNA, 32 nt, Human
gggacuagaauacaaugucacuuuaagauuua

SEQ ID NO: 196337 - RNA, 32 nt, Human
gggacuagaauguauaugagaaacccccacuc

SEQ ID NO: 196338 - RNA, 18 nt, Human
gggacuagaggcggggug

SEQ ID NO: 196339 - RNA, 32 nt, Human
gggacuaggacagugucacuucugcuaaguuc

SEQ ID NO: 196340 - RNA, 32 nt, Human
gggacuaggcaaggaagaaggaaggagagggc

SEQ ID NO: 196341 - RNA, 18 nt, Human
gggacuaggcuggugggg

SEQ ID NO: 196342 - RNA, 32 nt, Human
gggacuaucagguaauaaaagcuuugacuccc

SEQ ID NO: 196343 - RNA, 32 nt, Human
gggacuaucugaagcgcuuccauccuaaagcc

SEQ ID NO: 196344 - RNA, 32 nt, Human
gggacuaugaccuuuuucuccaguaugcuacc

SEQ ID NO: 196345 - RNA, 32 nt, Human
gggacuaugaucuccugguggucggcggggga

SEQ ID NO: 196346 - RNA, 32 nt, Human
gggacuauguugugagccugcgaaagaaguuu

SEQ ID NO: 196347 - RNA, 32 nt, Human
gggacucacaugcacauaggcccacacacaca

SEQ ID NO: 196348 - RNA, 32 nt, Human
gggacucacguggcuucaacagcuuuggaaau

SEQ ID NO: 196349 - RNA, 25 nt, Human
gggacucacugguucgcacaucuaa

SEQ ID NO: 196350 - RNA, 32 nt, Human
gggacucagaccccugaggagugggugcugcc

SEQ ID NO: 196351 - RNA, 32 nt, Human
gggacucagcccagacugcccuggggcagcuu

SEQ ID NO: 196352 - RNA, 32 nt, Human
gggacucagcgggcguggaggucgcggcggac

SEQ ID NO: 196353 - RNA, 32 nt, Human
gggacucagggugggucagguaacuggaaagc

SEQ ID NO: 196354 - RNA, 32 nt, Human
gggacucauccccucaucuuccucuuaccuca

SEQ ID NO: 196355 - RNA, 19 nt, Human
gggacucaugacuguaauc

SEQ ID NO: 196356 - RNA, 32 nt, Human
gggacuccacagccucuccaaguucagaguga

SEQ ID NO: 196357 - RNA, 21 nt, Human
gggacuccaccugccuccucc

SEQ ID NO: 196358 - RNA, 32 nt, Human
gggacuccaggggcagcugccauucguuccag

SEQ ID NO: 196359 - RNA, 32 nt, Human
gggacuccauggucuucagagucguucacaga

SEQ ID NO: 196360 - RNA, 32 nt, Human
gggacuccauguccuagagugccccgcgggcg

SEQ ID NO: 196361 - RNA, 32 nt, Human
gggacucccaggcuggagagcacugccaggac

SEQ ID NO: 196362 - RNA, 32 nt, Human
gggacucccaugcugcuguuggcuccaucucu

SEQ ID NO: 196363 - RNA, 32 nt, Human
gggacucccuagggcacaugcaucagcacaua

SEQ ID NO: 196364 - RNA, 32 nt, Human
gggacucccuccaagcuaggguuuggcaaguc

SEQ ID NO: 196365 - RNA, 32 nt, Human
gggacucccuccugggaagccgaauucuaucu

SEQ ID NO: 196366 - RNA, 32 nt, Human
gggacuccgaguugugaaaauuagcuggggac

SEQ ID NO: 196367 - RNA, 32 nt, Human
gggacuccggcauagcagacccugccccagca

SEQ ID NO: 196368 - RNA, 32 nt, Human
gggacuccgggcggcccugccuggugccauug

SEQ ID NO: 196369 - RNA, 32 nt, Human
gggacuccucacaacccccagccucagcuucc

SEQ ID NO: 196370 - RNA, 32 nt, Human
gggacucgcaggggccgggucuccgugacugg

SEQ ID NO: 196371 - RNA, 22 nt, Human
gggacucgcgguguccggguga

SEQ ID NO: 196372 - RNA, 32 nt, Human
gggacucgggggauauacaguggcugcaccaa

SEQ ID NO: 196373 - RNA, 20 nt, Human
gggacucgucaugagugggg

SEQ ID NO: 196374 - RNA, 24 nt, Human
gggacucgugggggccaccugcca

SEQ ID NO: 196375 - RNA, 32 nt, Human
gggacucucuccacucuuuccugggcucgggg

SEQ ID NO: 196376 - RNA, 32 nt, Human
gggacucucuugacaauaaugugaauugcuga

SEQ ID NO: 196377 - RNA, 32 nt, Human
gggacucugcaccuaccucacaggguuguugu

SEQ ID NO: 196378 - RNA, 18 nt, Human
gggacucugcaguggggu

SEQ ID NO: 196379 - RNA, 32 nt, Human
gggacucugcccuucgcuccuccuggucucug

SEQ ID NO: 196380 - RNA, 32 nt, Human
gggacucugccugccuuccuguccccagugcu

SEQ ID NO: 196381 - RNA, 19 nt, Human
gggacucugggcucagaga

SEQ ID NO: 196382 - RNA, 32 nt, Human
gggacucugguucccucgccaaguguggcagc

SEQ ID NO: 196383 - RNA, 32 nt, Human
gggacucuuccaggauggguuggagaggagua

SEQ ID NO: 196384 - RNA, 32 nt, Human
gggacucuuggaauuggcuuuuggugucugua

SEQ ID NO: 196385 - RNA, 22 nt, Human
gggacugaaccagcugguggug

SEQ ID NO: 196386 - RNA, 18 nt, Human
gggacugaagaauguuaa

SEQ ID NO: 196387 - RNA, 19 nt, Human
gggacugacacuccaggca

SEQ ID NO: 196388 - RNA, 32 nt, Human
gggacugaccagccccuuccucuuggagccug

SEQ ID NO: 196389 - RNA, 32 nt, Human
gggacugacccaggggaaggaaguggggaagg

SEQ ID NO: 196390 - RNA, 32 nt, Human
gggacugaccugcugacagucacccucccucu

SEQ ID NO: 196391 - RNA, 19 nt, Human
gggacugacgccagguucc

SEQ ID NO: 196392 - RNA, 32 nt, Human
gggacugacuccagcccuuggacucaggacau

SEQ ID NO: 196393 - RNA, 32 nt, Human
gggacugacuccagccucugcuccgggaggcc

SEQ ID NO: 196394 - RNA, 32 nt, Human
gggacugagagggagucagcaggcaugcugcg

SEQ ID NO: 196395 - RNA, 32 nt, Human
gggacugagcagcugggagcaggcgaccgagc

SEQ ID NO: 196396 - RNA, 32 nt, Human
gggacugagcugccuccugucucuccacucug

SEQ ID NO: 196397 - RNA, 32 nt, Human
gggacugagcuggucuuugaggcugcagagcu

SEQ ID NO: 196398 - RNA, 32 nt, Human
gggacugaggcaguagagggaggcgagagccc

SEQ ID NO: 196399 - RNA, 32 nt, Human
gggacugagggagggauggggaaguguagcca

SEQ ID NO: 196400 - RNA, 16 nt, Human
gggacugagggugggg

SEQ ID NO: 196401 - RNA, 22 nt, Human
gggacugaugcuguccaggaga

SEQ ID NO: 196402 - RNA, 32 nt, Human
gggacugauucugucguguucaccagagaaag

SEQ ID NO: 196403 - RNA, 32 nt, Human
gggacugcacuccagccugggugacagagcca

SEQ ID NO: 196404 - RNA, 32 nt, Human
gggacugcagcccucugagugcuugucauccu

SEQ ID NO: 196405 - RNA, 32 nt, Human
gggacugccauccaccauggugaagcugggcu

SEQ ID NO: 196406 - RNA, 32 nt, Human
gggacugccaugcacucugccuggugucacau

SEQ ID NO: 196407 - RNA, 32 nt, Human
gggacugccgggcacucccuggaguugggugg

SEQ ID NO: 196408 - RNA, 32 nt, Human
gggacugccguggagccgcauccacuguggau

SEQ ID NO: 196409 - RNA, 32 nt, Human
gggacugccuguaauagcacugggauuuugcc

SEQ ID NO: 196410 - RNA, 17 nt, Human
gggacugcugguggggu

SEQ ID NO: 196411 - RNA, 32 nt, Human
gggacugcuguugcgguaccgugugucugaca

SEQ ID NO: 196412 - RNA, 32 nt, Human
gggacuggacgagcaguagauccagcagccug

SEQ ID NO: 196413 - RNA, 17 nt, Human
gggacuggagagaggug

SEQ ID NO: 196414 - RNA, 32 nt, Human
gggacuggagaggagugaguggcgggcugggc

SEQ ID NO: 196415 - RNA, 32 nt, Human
gggacuggagccagggucuggggagagcaaca

SEQ ID NO: 196416 - RNA, 21 nt, Human
gggacuggaggaggagccaga

SEQ ID NO: 196417 - RNA, 22 nt, Human
gggacuggaggccagcgguguc

SEQ ID NO: 196418 - RNA, 18 nt, Human
gggacuggagggcagggg

SEQ ID NO: 196419 - RNA, 18 nt, Human
gggacuggaguuagggug

SEQ ID NO: 196420 - RNA, 32 nt, Human
gggacuggauccuaggaggugaagccauuucc

SEQ ID NO: 196421 - RNA, 32 nt, Human
gggacuggaucuccuaaaugcugaagaaggug

SEQ ID NO: 196422 - RNA, 32 nt, Human
gggacuggcccuguaggguugagccacagaca

SEQ ID NO: 196423 - RNA, 31 nt, Human
gggacuggccucucugcacggcuguguacac

SEQ ID NO: 196424 - RNA, 32 nt, Human
gggacuggccucugcugauccucccaggcuuc

SEQ ID NO: 196425 - RNA, 20 nt, Human
gggacuggcggcucggaggu

SEQ ID NO: 196426 - RNA, 20 nt, Human
gggacuggcggggggagggg

SEQ ID NO: 196427 - RNA, 17 nt, Human
gggacuggcggugaggu

SEQ ID NO: 196428 - RNA, 19 nt, Human
gggacuggcguggcuccag

SEQ ID NO: 196429 - RNA, 23 nt, Human
gggacuggcguggcuccagggug

SEQ ID NO: 196430 - RNA, 19 nt, Human
gggacuggcuggaggaagg

SEQ ID NO: 196431 - RNA, 18 nt, Human
gggacuggcuggagggug

SEQ ID NO: 196432 - RNA, 32 nt, Human
gggacugggaaaguccugcuucacuucugggg

SEQ ID NO: 196433 - RNA, 32 nt, Human
gggacugggaagaagagggggaaaguggggca

SEQ ID NO: 196434 - RNA, 32 nt, Human
gggacugggacccucccuacccugccccagcu

SEQ ID NO: 196435 - RNA, 19 nt, Human
gggacugggacuggcggug

SEQ ID NO: 196436 - RNA, 32 nt, Human
gggacugggacuucugggucuccagggagggu

SEQ ID NO: 196437 - RNA, 32 nt, Human
gggacugggagaggcaauggagagggagggua

SEQ ID NO: 196438 - RNA, 20 nt, Human
gggacugggaggugggggug

SEQ ID NO: 196439 - RNA, 19 nt, Human
gggacugggagugugagug

SEQ ID NO: 196440 - RNA, 31 nt, Human
gggacugggaugagagaaagugggaccuggu

SEQ ID NO: 196441 - RNA, 17 nt, Human
gggacugggauuggggu

SEQ ID NO: 196442 - RNA, 20 nt, Human
gggacugggccagggaagcu

SEQ ID NO: 196443 - RNA, 24 nt, Human
gggacugggccccggggcggggug

SEQ ID NO: 196444 - RNA, 32 nt, Human
gggacugggcggcuugucccaggcugcugggc

SEQ ID NO: 196445 - RNA, 19 nt, Human
gggacugggcggggcgggg

SEQ ID NO: 196446 - RNA, 20 nt, Human
gggacugggcugagagggug

SEQ ID NO: 196447 - RNA, 32 nt, Human
gggacugggcugagaggguggacgaguucagg

SEQ ID NO: 196448 - RNA, 31 nt, Human
gggacuggggaacugccuccggcuucacgau

SEQ ID NO: 196449 - RNA, 16 nt, Human
gggacuggggaagggg

SEQ ID NO: 196450 - RNA, 32 nt, Human
gggacuggggagcugggcucuaccaucccucc

SEQ ID NO: 196451 - RNA, 18 nt, Human
gggacuggggaucagggu

SEQ ID NO: 196452 - RNA, 32 nt, Human
gggacuggggaugugggagggagcagacagga

SEQ ID NO: 196453 - RNA, 32 nt, Human
gggacuggggccugugcucaggaucagcagag

SEQ ID NO: 196454 - RNA, 32 nt, Human
gggacugggggaaggaaacuuauuggaaaacu

SEQ ID NO: 196455 - RNA, 17 nt, Human
gggacugggggaggggu

SEQ ID NO: 196456 - RNA, 21 nt, Human
gggacugggggccggggggug

SEQ ID NO: 196457 - RNA, 16 nt, Human
gggacugggggcgggg

SEQ ID NO: 196458 - RNA, 20 nt, Human
gggacugggguuucuggggu

SEQ ID NO: 196459 - RNA, 19 nt, Human
gggacuggguggggggcgg

SEQ ID NO: 196460 - RNA, 18 nt, Human
gggacuggucaguggagu

SEQ ID NO: 196461 - RNA, 32 nt, Human
gggacuggucuagacccucccuuuccugucac

SEQ ID NO: 196462 - RNA, 19 nt, Human
gggacuggugagaaugggg

SEQ ID NO: 196463 - RNA, 20 nt, Human
gggacugguggagcuggcug

SEQ ID NO: 196464 - RNA, 32 nt, Human
gggacugguggagguggauggcagguccgacu

SEQ ID NO: 196465 - RNA, 19 nt, Human
gggacugguggcugggagg

SEQ ID NO: 196466 - RNA, 20 nt, Human
gggacugguggggaagaggg

SEQ ID NO: 196467 - RNA, 18 nt, Human
gggacugguggggacagg

SEQ ID NO: 196468 - RNA, 18 nt, Human
gggacugguggucggggg

SEQ ID NO: 196469 - RNA, 20 nt, Human
gggacugguguccugaagug

SEQ ID NO: 196470 - RNA, 18 nt, Human
gggacuggugucugcgug

SEQ ID NO: 196471 - RNA, 19 nt, Human
gggacuggugugugguggu

SEQ ID NO: 196472 - RNA, 22 nt, Human
gggacugguugagggagugggg

SEQ ID NO: 196473 - RNA, 18 nt, Human
gggacugguuuggguggg

SEQ ID NO: 196474 - RNA, 20 nt, Human
gggacugucccgagcuggua

SEQ ID NO: 196475 - RNA, 32 nt, Human
gggacugucuucaacccugcccugcaccuugg

SEQ ID NO: 196476 - RNA, 32 nt, Human
gggacugugagcagcuucagggccaagacagu

SEQ ID NO: 196477 - RNA, 32 nt, Human
gggacugugagcuuccuggcuccugggcagug

SEQ ID NO: 196478 - RNA, 32 nt, Human
gggacugugcaggccagagaagguggcauggg

SEQ ID NO: 196479 - RNA, 32 nt, Human
gggacugugcaggccggagcuaggcagggaca

SEQ ID NO: 196480 - RNA, 32 nt, Human
gggacuguggaugcuggaguaaguggaauugu

SEQ ID NO: 196481 - RNA, 32 nt, Human
gggacuguggccugggcugaucuugagccuua

SEQ ID NO: 196482 - RNA, 32 nt, Human
gggacugugguguuuggugaaaaccuuccuga

SEQ ID NO: 196483 - RNA, 32 nt, Human
gggacuguguuucuuuaaggaugcugaccugg

SEQ ID NO: 196484 - RNA, 17 nt, Human
gggacuguuguggggug

SEQ ID NO: 196485 - RNA, 32 nt, Human
gggacuucaggccacauuggcuugaaggcauu

SEQ ID NO: 196486 - RNA, 17 nt, Human
gggacuucaguggggug

SEQ ID NO: 196487 - RNA, 32 nt, Human
gggacuucaucucuaaaacaaaacaaaacaaa

SEQ ID NO: 196488 - RNA, 32 nt, Human
gggacuuccccaggcaggaagcacuugaugga

SEQ ID NO: 196489 - RNA, 32 nt, Human
gggacuuccgccccuucucgugcccgggcggu

SEQ ID NO: 196490 - RNA, 32 nt, Human
gggacuucgccuuugugauuguucagccaauu

SEQ ID NO: 196491 - RNA, 32 nt, Human
gggacuucucauaggaagagucaagaccuccu

SEQ ID NO: 196492 - RNA, 32 nt, Human
gggacuucucucuucgggagaugauaucuugu

SEQ ID NO: 196493 - RNA, 23 nt, Human
gggacuucuucccuuccuccuca

SEQ ID NO: 196494 - RNA, 32 nt, Human
gggacuugaauccaccuuucucaaauauaaaa

SEQ ID NO: 196495 - RNA, 32 nt, Human
gggacuugacagaaugaggugcgcgagggagg

SEQ ID NO: 196496 - RNA, 23 nt, Human
gggacuugauggggagguggggu

SEQ ID NO: 196497 - RNA, 20 nt, Human
gggacuugccguuggcgcuu

SEQ ID NO: 196498 - RNA, 32 nt, Human
gggacuuggaaggugagaaagauacugcauuu

SEQ ID NO: 196499 - RNA, 32 nt, Human
gggacuuggacaggagucagugucuggcuuuu

SEQ ID NO: 196500 - RNA, 32 nt, Human
gggacuugggggccccuggagcucagggguca

SEQ ID NO: 196501 - RNA, 32 nt, Human
gggacuuggugcccugcaucccagccacuccc

SEQ ID NO: 196502 - RNA, 32 nt, Human
gggacuuguauuuuucucuggccaguggccuu

SEQ ID NO: 196503 - RNA, 32 nt, Human
gggacuuugcuacuuguaaaaauaacauaaua

SEQ ID NO: 196504 - RNA, 32 nt, Human
gggacuuuggagguggggcucugcagcuguga

SEQ ID NO: 196505 - RNA, 32 nt, Human
gggacuuuugggaccccacacacuccaggugg

SEQ ID NO: 196506 - RNA, 26 nt, Human
gggagaaaaagaggggagagagcaga

SEQ ID NO: 196507 - RNA, 32 nt, Human
gggagaaaaaggcuuuucgagugugggacaag

SEQ ID NO: 196508 - RNA, 21 nt, Human
gggagaaaaaggggaauccuc

SEQ ID NO: 196509 - RNA, 24 nt, Human
gggagaaaaaguaggggaagcgga

SEQ ID NO: 196510 - RNA, 32 nt, Human
gggagaaaacacaagagggugcggucaggguu

SEQ ID NO: 196511 - RNA, 18 nt, Human
gggagaaaaggagcaggc

SEQ ID NO: 196512 - RNA, 32 nt, Human
gggagaaaaggaggagaacaggagacgagaag

SEQ ID NO: 196513 - RNA, 24 nt, Human
gggagaaaaggugggggaaagaga

SEQ ID NO: 196514 - RNA, 24 nt, Human
gggagaaaauguagaagaggcaga

SEQ ID NO: 196515 - RNA, 32 nt, Human
gggagaaaccuacagaauacuagccagagcuc

SEQ ID NO: 196516 - RNA, 32 nt, Human
gggagaaacgucgacuccuccuuuuccacugc

SEQ ID NO: 196517 - RNA, 18 nt, Human
gggagaaagaaaugggga

SEQ ID NO: 196518 - RNA, 32 nt, Human
gggagaaagaagccagaagccagggggugggg

SEQ ID NO: 196519 - RNA, 22 nt, Human
gggagaaagaagggagaggcag

SEQ ID NO: 196520 - RNA, 20 nt, Human
gggagaaagagaagcacaga

SEQ ID NO: 196521 - RNA, 24 nt, Human
gggagaaagagaaugagagaaaga

SEQ ID NO: 196522 - RNA, 26 nt, Human
gggagaaagagagggagaaagggaga

SEQ ID NO: 196523 - RNA, 32 nt, Human
gggagaaagaggagggccguggaagaaaaggg

SEQ ID NO: 196524 - RNA, 32 nt, Human
gggagaaagauggaggccagauucagccaguc

SEQ ID NO: 196525 - RNA, 32 nt, Human
gggagaaagcucaagaaaauaaugcacagauc

SEQ ID NO: 196526 - RNA, 20 nt, Human
gggagaaagcuggagggagg

SEQ ID NO: 196527 - RNA, 21 nt, Human
gggagaaaggaaaagaacaga

SEQ ID NO: 196528 - RNA, 23 nt, Human
gggagaaaggaaaaggagagaca

SEQ ID NO: 196529 - RNA, 24 nt, Human
gggagaaaggaguuggagacaaga

SEQ ID NO: 196530 - RNA, 23 nt, Human
gggagaaaggcagugggaaaaga

SEQ ID NO: 196531 - RNA, 21 nt, Human
gggagaaagggaaaaagcggg

SEQ ID NO: 196532 - RNA, 21 nt, Human
gggagaaagggaagucccagg

SEQ ID NO: 196533 - RNA, 23 nt, Human
gggagaaagggagcgaggucaga

SEQ ID NO: 196534 - RNA, 32 nt, Human
gggagaaauauucucuccacuuugggggagag

SEQ ID NO: 196535 - RNA, 32 nt, Human
gggagaaauggcgaaugucauacacaugagau

SEQ ID NO: 196536 - RNA, 22 nt, Human
gggagaaaugggaagcaacaga

SEQ ID NO: 196537 - RNA, 21 nt, Human
gggagaacacaagaggacaga

SEQ ID NO: 196538 - RNA, 20 nt, Human
gggagaacacagaaagaaga

SEQ ID NO: 196539 - RNA, 21 nt, Human
gggagaacagcaugcugugug

SEQ ID NO: 196540 - RNA, 32 nt, Human
gggagaacagccaggugaggugggagguugga

SEQ ID NO: 196541 - RNA, 20 nt, Human
gggagaacccaaagagacag

SEQ ID NO: 196542 - RNA, 32 nt, Human
gggagaaccccagcccccaggaggccccugcu

SEQ ID NO: 196543 - RNA, 20 nt, Human
gggagaacgagccugggaga

SEQ ID NO: 196544 - RNA, 27 nt, Human
gggagaacggcuccguccugcggcgug

SEQ ID NO: 196545 - RNA, 21 nt, Human
gggagaacucugaggggcaga

SEQ ID NO: 196546 - RNA, 32 nt, Human
gggagaacugagggguagguggggaggggcca

SEQ ID NO: 196547 - RNA, 32 nt, Human
gggagaacugccucauucuggcuuugguagag

SEQ ID NO: 196548 - RNA, 22 nt, Human
gggagaacugcuugagcccagg

SEQ ID NO: 196549 - RNA, 32 nt, Human
gggagaagaagaggaagaccacaguauuucuc

SEQ ID NO: 196550 - RNA, 32 nt, Human
gggagaagaaggaaagaggcaaguaaggccca

SEQ ID NO: 196551 - RNA, 32 nt, Human
gggagaagacggcgagcaggaggacccgcaga

SEQ ID NO: 196552 - RNA, 32 nt, Human
gggagaagacugaaggagcaguugccgccguu

SEQ ID NO: 196553 - RNA, 32 nt, Human
gggagaagagaaggcuaaaggagcucauagaa

SEQ ID NO: 196554 - RNA, 32 nt, Human
gggagaagagggcuggaguucuaggcaaccuu

SEQ ID NO: 196555 - RNA, 32 nt, Human
gggagaagcacugggucaggugaggucugagg

SEQ ID NO: 196556 - RNA, 20 nt, Human
gggagaagcagucuggggga

SEQ ID NO: 196557 - RNA, 23 nt, Human
gggagaagcccaggacugggaga

SEQ ID NO: 196558 - RNA, 32 nt, Human
gggagaagccugggauugacagaagcuucugc

SEQ ID NO: 196559 - RNA, 22 nt, Human
gggagaagcgugaggggacaga

SEQ ID NO: 196560 - RNA, 32 nt, Human
gggagaagcugcagcuggagcugaaggcucga

SEQ ID NO: 196561 - RNA, 32 nt, Human
gggagaagcugcaggugccuucuuaccagcuc

SEQ ID NO: 196562 - RNA, 32 nt, Human
gggagaaggagaggcaaggaaagagggaggga

SEQ ID NO: 196563 - RNA, 31 nt, Human
gggagaaggaggagagaaaagcugguccucu

SEQ ID NO: 196564 - RNA, 32 nt, Human
gggagaaggaggaggcggcgaaucacuuauaa

SEQ ID NO: 196565 - RNA, 32 nt, Human
gggagaaggcagugauuagcacuugggugacg

SEQ ID NO: 196566 - RNA, 32 nt, Human
gggagaaggcucugcaagagcucccuggcaau

SEQ ID NO: 196567 - RNA, 32 nt, Human
gggagaagggaaggaaggaaagaagagaggaa

SEQ ID NO: 196568 - RNA, 20 nt, Human
gggagaagggaggugggagg

SEQ ID NO: 196569 - RNA, 21 nt, Human
gggagaaggugaagcagcaga

SEQ ID NO: 196570 - RNA, 20 nt, Human
gggagaagguucgugggagg

SEQ ID NO: 196571 - RNA, 32 nt, Human
gggagaaguaugaaugcgugugucuaaauuaa

SEQ ID NO: 196572 - RNA, 31 nt, Human
gggagaagugagagggacaauuggguucauu

SEQ ID NO: 196573 - RNA, 32 nt, Human
gggagaauccacccucccaucaucugcuuccc

SEQ ID NO: 196574 - RNA, 32 nt, Human
gggagaaucccuugaacccgggaaguggaggc

SEQ ID NO: 196575 - RNA, 32 nt, Human
gggagaaucccuugaaccugggaggcggaggu

SEQ ID NO: 196576 - RNA, 22 nt, Human
gggagaaucgcuugagcccagg

SEQ ID NO: 196577 - RNA, 32 nt, Human
gggagaaucuagccuucagccuguccaguguu

SEQ ID NO: 196578 - RNA, 32 nt, Human
gggagaaugagaaagagagggacagagagaua

SEQ ID NO: 196579 - RNA, 32 nt, Human
gggagaaugaggcaguuccaaaaugaauuaua

SEQ ID NO: 196580 - RNA, 32 nt, Human
gggagaauggcagaaauauaggaugagcaaga

SEQ ID NO: 196581 - RNA, 18 nt, Human
gggagaauggggcuggga

SEQ ID NO: 196582 - RNA, 32 nt, Human
gggagaauguggcauuugaggacucucuuaga

SEQ ID NO: 196583 - RNA, 22 nt, Human
gggagaauugcuugaacccagg

SEQ ID NO: 196584 - RNA, 20 nt, Human
gggagaauugcuugaagcca

SEQ ID NO: 196585 - RNA, 32 nt, Human
gggagaauugcuugaguccaggaguuugagau

SEQ ID NO: 196586 - RNA, 32 nt, Human
gggagaauuggaagaaugugaugaugguagga

SEQ ID NO: 196587 - RNA, 32 nt, Human
gggagacaacagaaaaagacaaacagcgaugg

SEQ ID NO: 196588 - RNA, 32 nt, Human
gggagacaagaguugggccagguugauaacua

SEQ ID NO: 196589 - RNA, 32 nt, Human
gggagacacucaggaggagcuggaggaccugg

SEQ ID NO: 196590 - RNA, 32 nt, Human
gggagacagaaaacauguuucccuacaccucu

SEQ ID NO: 196591 - RNA, 32 nt, Human
gggagacagaacuuaaauccagguggagaguc

SEQ ID NO: 196592 - RNA, 32 nt, Human
gggagacagacagagguugcagugagccgaga

SEQ ID NO: 196593 - RNA, 22 nt, Human
gggagacagagacagaaacaga

SEQ ID NO: 196594 - RNA, 32 nt, Human
gggagacagagcagcgucggagccgcgcaggg

SEQ ID NO: 196595 - RNA, 32 nt, Human
gggagacagcacaugucuaaggcccacaagcc

SEQ ID NO: 196596 - RNA, 22 nt, Human
gggagacagcagaagagauaga

SEQ ID NO: 196597 - RNA, 32 nt, Human
gggagacagcagaagagauagaaucagggcug

SEQ ID NO: 196598 - RNA, 32 nt, Human
gggagacagcagcguggucagagugguaggag

SEQ ID NO: 196599 - RNA, 32 nt, Human
gggagacaggcagggagggcuuggggcugcac

SEQ ID NO: 196600 - RNA, 32 nt, Human
gggagacagugacagaucaucaggcauuagau

SEQ ID NO: 196601 - RNA, 32 nt, Human
gggagacaguguggaggccacaggguacucgc

SEQ ID NO: 196602 - RNA, 32 nt, Human
gggagacauauucuuggagaacuuuccaucug

SEQ ID NO: 196603 - RNA, 32 nt, Human
gggagacauugcaccuggccacugcagcccag

SEQ ID NO: 196604 - RNA, 23 nt, Human
gggagaccaaggcagguggauca

SEQ ID NO: 196605 - RNA, 22 nt, Human
gggagaccaaggcggguagauc

SEQ ID NO: 196606 - RNA, 23 nt, Human
gggagaccaaggcggguggauca

SEQ ID NO: 196607 - RNA, 27 nt, Human
gggagacccacagcuaagacaccggga

SEQ ID NO: 196608 - RNA, 22 nt, Human
gggagacccaggagcaccugga

SEQ ID NO: 196609 - RNA, 22 nt, Human
gggagacccaggccccgggcug

SEQ ID NO: 196610 - RNA, 22 nt, Human
gggagacccggaggaggucaga

SEQ ID NO: 196611 - RNA, 24 nt, Human
gggagacccuaaagauguggggga

SEQ ID NO: 196612 - RNA, 23 nt, Human
gggagaccgagacagguggauca

SEQ ID NO: 196613 - RNA, 24 nt, Human
gggagaccgaggcaggcggaucau

SEQ ID NO: 196614 - RNA, 23 nt, Human
gggagaccgaggcagguggauca

SEQ ID NO: 196615 - RNA, 23 nt, Human
gggagaccgaggcuggcagauca

SEQ ID NO: 196616 - RNA, 23 nt, Human
gggagaccgaggugggcagauca

SEQ ID NO: 196617 - RNA, 32 nt, Human
gggagaccugcacugucccugcgaaauacuaa

SEQ ID NO: 196618 - RNA, 23 nt, Human
gggagacgaggagacgcggagaa

SEQ ID NO: 196619 - RNA, 32 nt, Human
gggagacgcaggcaauggggccucgcaggcca

SEQ ID NO: 196620 - RNA, 25 nt, Human
gggagacgcaguagacagagacaga

SEQ ID NO: 196621 - RNA, 32 nt, Human
gggagacguccuccauaaguggagcacagggu

SEQ ID NO: 196622 - RNA, 32 nt, Human
gggagacguguaugugagucucaguggacuaa

SEQ ID NO: 196623 - RNA, 32 nt, Human
gggagacguuucugccacccugggugaugagc

SEQ ID NO: 196624 - RNA, 20 nt, Human
gggagacuaggccucagaga

SEQ ID NO: 196625 - RNA, 23 nt, Human
gggagacucagcgguccaggggu

SEQ ID NO: 196626 - RNA, 32 nt, Human
gggagacucccaguaccugaaugcaggauggg

SEQ ID NO: 196627 - RNA, 23 nt, Human
gggagacugaagcggguggauca

SEQ ID NO: 196628 - RNA, 32 nt, Human
gggagacugagccugugggcguggcuugcucc

SEQ ID NO: 196629 - RNA, 21 nt, Human
gggagacugaggaagggcaga

SEQ ID NO: 196630 - RNA, 32 nt, Human
gggagacugaggaagggcagagccagaagcaa

SEQ ID NO: 196631 - RNA, 23 nt, Human
gggagacugaggcaggagaauca

SEQ ID NO: 196632 - RNA, 23 nt, Human
gggagacugaggcaggaggauca

SEQ ID NO: 196633 - RNA, 23 nt, Human
gggagacugaggcaggcggauca

SEQ ID NO: 196634 - RNA, 19 nt, Human
gggagacugaggcggauca

SEQ ID NO: 196635 - RNA, 24 nt, Human
gggagacugaggcgggcggaucau

SEQ ID NO: 196636 - RNA, 32 nt, Human
gggagacugcaacaaucugugucccuggaaug

SEQ ID NO: 196637 - RNA, 22 nt, Human
gggagacugcucagacaggaac

SEQ ID NO: 196638 - RNA, 32 nt, Human
gggagacugcuugguguucccugaggacaaga

SEQ ID NO: 196639 - RNA, 19 nt, Human
gggagacugggcggaggug

SEQ ID NO: 196640 - RNA, 32 nt, Human
gggagacugggugaaaggcgagcuugguuacg

SEQ ID NO: 196641 - RNA, 32 nt, Human
gggagacuuccucgucuuccagggaaggaagg

SEQ ID NO: 196642 - RNA, 32 nt, Human
gggagagaaagcccagaucagacagauggggg

SEQ ID NO: 196643 - RNA, 32 nt, Human
gggagagaaaggaggggaguucagggugaggg

SEQ ID NO: 196644 - RNA, 32 nt, Human
gggagagaaagggagagagggagggagaggau

SEQ ID NO: 196645 - RNA, 32 nt, Human
gggagagaaaugcaaagcccucucagccugcu

SEQ ID NO: 196646 - RNA, 28 nt, Human
gggagagaacaaaggggaagaagagaga

SEQ ID NO: 196647 - RNA, 32 nt, Human
gggagagaacagggauggccugagggaaaggg

SEQ ID NO: 196648 - RNA, 23 nt, Human
gggagagaacugagccccggggu

SEQ ID NO: 196649 - RNA, 23 nt, Human
gggagagaagagccguccaggga

SEQ ID NO: 196650 - RNA, 32 nt, Human
gggagagaagcagaaaggcacuucgccacugu

SEQ ID NO: 196651 - RNA, 32 nt, Human
gggagagaaggcccuuggucagagugggcagu

SEQ ID NO: 196652 - RNA, 18 nt, Human
gggagagacagagacaga

SEQ ID NO: 196653 - RNA, 32 nt, Human
gggagagacagagacagagaugacagagacag

SEQ ID NO: 196654 - RNA, 32 nt, Human
gggagagaccuguggcaccagguuggagggag

SEQ ID NO: 196655 - RNA, 32 nt, Human
gggagagacggagguagagggaggacacagag

SEQ ID NO: 196656 - RNA, 21 nt, Human
gggagagacggguccuggagu

SEQ ID NO: 196657 - RNA, 32 nt, Human
gggagagacuccugagccugaggucccuggaa

SEQ ID NO: 196658 - RNA, 32 nt, Human
gggagagacuggauuccagccugcaaaagcug

SEQ ID NO: 196659 - RNA, 32 nt, Human
gggagagagaaagacgaagggagagagaaagc

SEQ ID NO: 196660 - RNA, 32 nt, Human
gggagagagaagaggaucagcagugcagcccc

SEQ ID NO: 196661 - RNA, 32 nt, Human
gggagagagaagcagagcgagagagaggaggc

SEQ ID NO: 196662 - RNA, 32 nt, Human
gggagagagaagcaggagagggggaggaaaag

SEQ ID NO: 196663 - RNA, 32 nt, Human
gggagagagaagcaggcagauaaguuggagca

SEQ ID NO: 196664 - RNA, 32 nt, Human
gggagagagaggagaaaggcgaaggagaagga

SEQ ID NO: 196665 - RNA, 19 nt, Human
gggagagagaggagacaga

SEQ ID NO: 196666 - RNA, 32 nt, Human
gggagagagagggagagaaagggagagaggga

SEQ ID NO: 196667 - RNA, 32 nt, Human
gggagagagagggaggaguaaaacugggcaag

SEQ ID NO: 196668 - RNA, 32 nt, Human
gggagagagagugagagagacugacucuuacc

SEQ ID NO: 196669 - RNA, 32 nt, Human
gggagagagcaggaaagcgagcacaggcgagu

SEQ ID NO: 196670 - RNA, 32 nt, Human
gggagagagcagugaaaacaugcagggcugug

SEQ ID NO: 196671 - RNA, 20 nt, Human
gggagagagccggucccggg

SEQ ID NO: 196672 - RNA, 32 nt, Human
gggagagaggcagaggcagcuggagcgccguu

SEQ ID NO: 196673 - RNA, 32 nt, Human
gggagagagggagggggagggcgggcgaagcg

SEQ ID NO: 196674 - RNA, 32 nt, Human
gggagagaucuccaacucucucuguguccgug

SEQ ID NO: 196675 - RNA, 32 nt, Human
gggagagauggagcaaagugagggccgaguga

SEQ ID NO: 196676 - RNA, 32 nt, Human
gggagagauggcaucuguuucaaccuggauga

SEQ ID NO: 196677 - RNA, 25 nt, Human
gggagagauguaguggauucuguga

SEQ ID NO: 196678 - RNA, 32 nt, Human
gggagagcaagaagaccagcugugggugaggg

SEQ ID NO: 196679 - RNA, 32 nt, Human
gggagagcagcugaggccguguggaaaauuag

SEQ ID NO: 196680 - RNA, 32 nt, Human
gggagagcaggagccacugagaugaggaggcg

SEQ ID NO: 196681 - RNA, 32 nt, Human
gggagagcaucgguuuuguuguacuugggacu

SEQ ID NO: 196682 - RNA, 22 nt, Human
gggagagcauggauccuggggu

SEQ ID NO: 196683 - RNA, 32 nt, Human
gggagagccgcagaggcugggcucagagacgu

SEQ ID NO: 196684 - RNA, 32 nt, Human
gggagagccgggagucgcugggugcguggggc

SEQ ID NO: 196685 - RNA, 32 nt, Human
gggagagccugaggcucugcucagggcccauu

SEQ ID NO: 196686 - RNA, 32 nt, Human
gggagagccugggaacuuucaucccccacuga

SEQ ID NO: 196687 - RNA, 32 nt, Human
gggagagcggcagcggggcugcgcaggaguag

SEQ ID NO: 196688 - RNA, 32 nt, Human
gggagagcugaacuccaggggugugaccuggg

SEQ ID NO: 196689 - RNA, 32 nt, Human
gggagagcuggauaguccugggacacagaguu

SEQ ID NO: 196690 - RNA, 32 nt, Human
gggagagcuggauuugaacccaggcagggcag

SEQ ID NO: 196691 - RNA, 32 nt, Human
gggagagcugggagcuguugaagguuuggggg

SEQ ID NO: 196692 - RNA, 32 nt, Human
gggagagcugggcagacaggugggagauggag

SEQ ID NO: 196693 - RNA, 19 nt, Human
gggagagcuuccuggggga

SEQ ID NO: 196694 - RNA, 32 nt, Human
gggagagcuuguaaagcaucuccuaaaugcga

SEQ ID NO: 196695 - RNA, 32 nt, Human
gggagaggaacccguucuauccccagccauga

SEQ ID NO: 196696 - RNA, 32 nt, Human
gggagaggaagaggagucggaagggaggcggg

SEQ ID NO: 196697 - RNA, 32 nt, Human
gggagaggaaugaggggagcagcuggacaugg

SEQ ID NO: 196698 - RNA, 32 nt, Human
gggagaggacaggaggaggagccuuccccagg

SEQ ID NO: 196699 - RNA, 32 nt, Human
gggagaggacucagauuuccuggaggcaaagu

SEQ ID NO: 196700 - RNA, 32 nt, Human
gggagaggagagaaagggcucccaccugcagu

SEQ ID NO: 196701 - RNA, 32 nt, Human
gggagaggagagaacagggcaagacguuuggu

SEQ ID NO: 196702 - RNA, 32 nt, Human
gggagaggagagaagaccccaguuccgccucc

SEQ ID NO: 196703 - RNA, 32 nt, Human
gggagaggagagaagcuggacuccaggcauga

SEQ ID NO: 196704 - RNA, 32 nt, Human
gggagaggagcaucuauuuucuuaaagaaaua

SEQ ID NO: 196705 - RNA, 32 nt, Human
gggagaggaggaagaggaaggggagggaagcu

SEQ ID NO: 196706 - RNA, 21 nt, Human
gggagaggaggaucucagcag

SEQ ID NO: 196707 - RNA, 21 nt, Human
gggagaggaggccccggcaga

SEQ ID NO: 196708 - RNA, 32 nt, Human
gggagaggaggggccuccagggccaggagucc

SEQ ID NO: 196709 - RNA, 32 nt, Human
gggagaggauggaaugcuugccuccaaugaac

SEQ ID NO: 196710 - RNA, 32 nt, Human
gggagaggaugggggaggggacaaauuagaau

SEQ ID NO: 196711 - RNA, 18 nt, Human
gggagaggcaagcuggcu

SEQ ID NO: 196712 - RNA, 20 nt, Human
gggagaggcaccugccccca

SEQ ID NO: 196713 - RNA, 32 nt, Human
gggagaggcacuaucugagaccugcaaucacu

SEQ ID NO: 196714 - RNA, 19 nt, Human
gggagaggcagagcugccu

SEQ ID NO: 196715 - RNA, 32 nt, Human
gggagaggcaggugagguucucagccgaugug

SEQ ID NO: 196716 - RNA, 32 nt, Human
gggagaggccagcagagggcgccagagagcca

SEQ ID NO: 196717 - RNA, 32 nt, Human
gggagaggcccagcgggagucgcggaacagca

SEQ ID NO: 196718 - RNA, 32 nt, Human
gggagaggcccagggacuggggcuggauucca

SEQ ID NO: 196719 - RNA, 27 nt, Human
gggagaggccccgcggucgcucagggg

SEQ ID NO: 196720 - RNA, 32 nt, Human
gggagaggcuguagaguggcugugucgggcau

SEQ ID NO: 196721 - RNA, 32 nt, Human
gggagagggaaagacgaggccgagagggaccc

SEQ ID NO: 196722 - RNA, 32 nt, Human
gggagagggaacggggacaggagcagaggacg

SEQ ID NO: 196723 - RNA, 32 nt, Human
gggagagggaagggagggaaacaguuuugugg

SEQ ID NO: 196724 - RNA, 32 nt, Human
gggagagggaaguaggaaagaaaauggaggaa

SEQ ID NO: 196725 - RNA, 20 nt, Human
gggagagggacagagacaga

SEQ ID NO: 196726 - RNA, 32 nt, Human
gggagagggacccaccacacacccacacaugc

SEQ ID NO: 196727 - RNA, 19 nt, Human
gggagagggagaaggcagg

SEQ ID NO: 196728 - RNA, 32 nt, Human
gggagagggagagagcgaacacccacgcuggu

SEQ ID NO: 196729 - RNA, 32 nt, Human
gggagagggagagagggagaaaacgaagggga

SEQ ID NO: 196730 - RNA, 32 nt, Human
gggagagggagagccugcagggcaggaaaaag

SEQ ID NO: 196731 - RNA, 32 nt, Human
gggagagggagaggggacccgaggcugaggca

SEQ ID NO: 196732 - RNA, 19 nt, Human
gggagagggaggagucaga

SEQ ID NO: 196733 - RNA, 32 nt, Human
gggagagggagguggucgggagagugcacgcc

SEQ ID NO: 196734 - RNA, 32 nt, Human
gggagagggauucucuucccacccucaccauu

SEQ ID NO: 196735 - RNA, 32 nt, Human
gggagaggggacaggagggaagggugggccaa

SEQ ID NO: 196736 - RNA, 32 nt, Human
gggagaggggaggcggggacggugugcccaag

SEQ ID NO: 196737 - RNA, 32 nt, Human
gggagaggggcagcuugggcuggagaagcaca

SEQ ID NO: 196738 - RNA, 32 nt, Human
gggagaggggcgcagcuaagacugggggcagg

SEQ ID NO: 196739 - RNA, 32 nt, Human
gggagaggggcugagggggagccaagggugac

SEQ ID NO: 196740 - RNA, 32 nt, Human
gggagagggggaggggaggaguccagggagag

SEQ ID NO: 196741 - RNA, 32 nt, Human
gggagaggguccugacaccaaaaguucauuuc

SEQ ID NO: 196742 - RNA, 32 nt, Human
gggagagggucuggagaagcagugagccgcau

SEQ ID NO: 196743 - RNA, 32 nt, Human
gggagagggugaagcagguaucagagucacuc

SEQ ID NO: 196744 - RNA, 32 nt, Human
gggagagggugaggaaaucagcugaaugguug

SEQ ID NO: 196745 - RNA, 32 nt, Human
gggagaggguuaagugaccuugcucaaacguu

SEQ ID NO: 196746 - RNA, 32 nt, Human
gggagaggguuuaaaugaggguuauggggcga

SEQ ID NO: 196747 - RNA, 32 nt, Human
gggagaggucagauggcacaacagaagucacc

SEQ ID NO: 196748 - RNA, 32 nt, Human
gggagagguugcugagaaguacaugggguugu

SEQ ID NO: 196749 - RNA, 32 nt, Human
gggagagugagaagcugagauacugggcacag

SEQ ID NO: 196750 - RNA, 32 nt, Human
gggagagugaggauggcagagaccagugccuu

SEQ ID NO: 196751 - RNA, 24 nt, Human
gggagagugagggagagagacaga

SEQ ID NO: 196752 - RNA, 32 nt, Human
gggagagugagucccccagaagaggcugggug

SEQ ID NO: 196753 - RNA, 32 nt, Human
gggagagugaucugcugcccucuccuggcaau

SEQ ID NO: 196754 - RNA, 32 nt, Human
gggagagugcagugaugggagcacagaccagg

SEQ ID NO: 196755 - RNA, 32 nt, Human
gggagaguggagagaggggcagagcucaagau

SEQ ID NO: 196756 - RNA, 32 nt, Human
gggagaguggcugugauauuucaaccaauugu

SEQ ID NO: 196757 - RNA, 32 nt, Human
gggagaguuugcggccacacacaacacgcaag

SEQ ID NO: 196758 - RNA, 32 nt, Human
gggagauagagggagagaugcaguuugacccc

SEQ ID NO: 196759 - RNA, 32 nt, Human
gggagauauaucugccuucuaagaaggcagac

SEQ ID NO: 196760 - RNA, 32 nt, Human
gggagaucacaaggucaggagaucgagaccag

SEQ ID NO: 196761 - RNA, 32 nt, Human
gggagaucagccacggagccuggagggaugcc

SEQ ID NO: 196762 - RNA, 32 nt, Human
gggagaucauguuuucuuaaucaugcuggaau

SEQ ID NO: 196763 - RNA, 27 nt, Human
gggagauccacagcuaagacaccggga

SEQ ID NO: 196764 - RNA, 32 nt, Human
gggagaucccucccuucucugagccuagagca

SEQ ID NO: 196765 - RNA, 32 nt, Human
gggagauccuggaaaagaucccuucaguuugg

SEQ ID NO: 196766 - RNA, 32 nt, Human
gggagauccuuguguuuaucagaaagggcaga

SEQ ID NO: 196767 - RNA, 20 nt, Human
gggagaucuuucccaggccg

SEQ ID NO: 196768 - RNA, 32 nt, Human
gggagaugaagagaacacuucaaggagacuuc

SEQ ID NO: 196769 - RNA, 26 nt, Human
gggagaugagagaggagauaggcaga

SEQ ID NO: 196770 - RNA, 30 nt, Human
gggagaugaugagaaaccacagaauugcua

SEQ ID NO: 196771 - RNA, 32 nt, Human
gggagaugcacccagagccugccagggagggc

SEQ ID NO: 196772 - RNA, 32 nt, Human
gggagaugcaggcucuguucagaugcugucuc

SEQ ID NO: 196773 - RNA, 32 nt, Human
gggagaugcaguguccagggaagcagaggcag

SEQ ID NO: 196774 - RNA, 32 nt, Human
gggagaugcaugcguguccaggcugagaugcc

SEQ ID NO: 196775 - RNA, 32 nt, Human
gggagaugcauugguagcaacuccccagcuua

SEQ ID NO: 196776 - RNA, 32 nt, Human
gggagaugcuggacccagccuugcugucuggc

SEQ ID NO: 196777 - RNA, 32 nt, Human
gggagaugcuuucagguugcagccagaagggg

SEQ ID NO: 196778 - RNA, 32 nt, Human
gggagaugcuuuccaguugcagccagaagggg

SEQ ID NO: 196779 - RNA, 32 nt, Human
gggagauggaaaggggauaucagauugguuuc

SEQ ID NO: 196780 - RNA, 32 nt, Human
gggagauggaagccucccaggcgcgcgaggcu

SEQ ID NO: 196781 - RNA, 32 nt, Human
gggagauggagguugcagagagccaagaucau

SEQ ID NO: 196782 - RNA, 24 nt, Human
gggagauggagucuugcucuguug

SEQ ID NO: 196783 - RNA, 32 nt, Human
gggagaugggagagagauuuaagacaaagggu

SEQ ID NO: 196784 - RNA, 32 nt, Human
gggagauggggugggaaggaggugagccccug

SEQ ID NO: 196785 - RNA, 32 nt, Human
gggagauggguuucuuauucugccuuuacguu

SEQ ID NO: 196786 - RNA, 32 nt, Human
gggagauguacccagugucuuggcaaacccaa

SEQ ID NO: 196787 - RNA, 29 nt, Human
gggagauguuggacugugccuggauccuu

SEQ ID NO: 196788 - RNA, 32 nt, Human
gggagauugagacuagccugaccgacauggag

SEQ ID NO: 196789 - RNA, 19 nt, Human
gggagauugcagaagcacc

SEQ ID NO: 196790 - RNA, 32 nt, Human
gggagauuggacaugguacauccuuugucacu

SEQ ID NO: 196791 - RNA, 32 nt, Human
gggagauuggcacccaggcugggagcuugcca

SEQ ID NO: 196792 - RNA, 32 nt, Human
gggagauuugggcuggaaacuccaugagauuc

SEQ ID NO: 196793 - RNA, 32 nt, Human
gggagcaaaccagcuuguucugggcucaggga

SEQ ID NO: 196794 - RNA, 20 nt, Human
gggagcaacauggccaccca

SEQ ID NO: 196795 - RNA, 32 nt, Human
gggagcaagaagguaggguugcaaggaagggc

SEQ ID NO: 196796 - RNA, 32 nt, Human
gggagcaagaggagauccugaggcucugccua

SEQ ID NO: 196797 - RNA, 18 nt, Human
gggagcaagucuaaggga

SEQ ID NO: 196798 - RNA, 32 nt, Human
gggagcaaugcagacucguagggcccuuagua

SEQ ID NO: 196799 - RNA, 32 nt, Human
gggagcacaccguuuccuguugcucagggacu

SEQ ID NO: 196800 - RNA, 32 nt, Human
gggagcacagccgcuccccaaacccagcaaac

SEQ ID NO: 196801 - RNA, 32 nt, Human
gggagcacagggaggcagaggcuuggguaaac

SEQ ID NO: 196802 - RNA, 16 nt, Human
gggagcacauuccugg

SEQ ID NO: 196803 - RNA, 32 nt, Human
gggagcaccaggaccugcugucugcugucagc

SEQ ID NO: 196804 - RNA, 32 nt, Human
gggagcacccccaggaggaggggaggguggga

SEQ ID NO: 196805 - RNA, 32 nt, Human
gggagcaccgccugggcaaccacuacaagugc

SEQ ID NO: 196806 - RNA, 32 nt, Human
gggagcacggccgaggggagcagugaggggca

SEQ ID NO: 196807 - RNA, 21 nt, Human
gggagcacugcugcccuccug

SEQ ID NO: 196808 - RNA, 23 nt, Human
gggagcacuggaggccacccagu

SEQ ID NO: 196809 - RNA, 32 nt, Human
gggagcacuggagugcagggaggagaggggaa

SEQ ID NO: 196810 - RNA, 32 nt, Human
gggagcacuuccucccagcaaagccauggagc

SEQ ID NO: 196811 - RNA, 19 nt, Human
gggagcagaaccuuaaaga

SEQ ID NO: 196812 - RNA, 32 nt, Human
gggagcagaagagggaugagggggagcaggag

SEQ ID NO: 196813 - RNA, 32 nt, Human
gggagcagagagacccaacugggagccagaga

SEQ ID NO: 196814 - RNA, 32 nt, Human
gggagcagagagagccagacagccccaagcuu

SEQ ID NO: 196815 - RNA, 17 nt, Human
gggagcagagcccagag

SEQ ID NO: 196816 - RNA, 32 nt, Human
gggagcagaggccagcugggggccaguggggg

SEQ ID NO: 196817 - RNA, 32 nt, Human
gggagcagagggcagcacuuccuccagcucca

SEQ ID NO: 196818 - RNA, 32 nt, Human
gggagcagaggugagcugagugcagugagcca

SEQ ID NO: 196819 - RNA, 32 nt, Human
gggagcagaguccagugggugugaggcugacu

SEQ ID NO: 196820 - RNA, 17 nt, Human
gggagcagauccucaga

SEQ ID NO: 196821 - RNA, 32 nt, Human
gggagcagaugagggcccugcccccgccccac

SEQ ID NO: 196822 - RNA, 32 nt, Human
gggagcagcagucuagggcuggcaggacuuau

SEQ ID NO: 196823 - RNA, 24 nt, Human
gggagcagccacagcuuucaggga

SEQ ID NO: 196824 - RNA, 19 nt, Human
gggagcagccagccaagag

SEQ ID NO: 196825 - RNA, 22 nt, Human
gggagcagccagccggcaaagg

SEQ ID NO: 196826 - RNA, 21 nt, Human
gggagcagccauugggaggga

SEQ ID NO: 196827 - RNA, 21 nt, Human
gggagcagcccagacucaagg

SEQ ID NO: 196828 - RNA, 22 nt, Human
gggagcagccccaggccagaga

SEQ ID NO: 196829 - RNA, 21 nt, Human
gggagcagccgccagcaggga

SEQ ID NO: 196830 - RNA, 22 nt, Human
gggagcagccggcagacagagg

SEQ ID NO: 196831 - RNA, 32 nt, Human
gggagcagccggcagcagcccaggcccgggga

SEQ ID NO: 196832 - RNA, 19 nt, Human
gggagcagccgggaggagg

SEQ ID NO: 196833 - RNA, 23 nt, Human
gggagcagccucacacaagcaga

SEQ ID NO: 196834 - RNA, 32 nt, Human
gggagcagccuccuugggccucaggaaaccac

SEQ ID NO: 196835 - RNA, 19 nt, Human
gggagcagcgagaccggga

SEQ ID NO: 196836 - RNA, 21 nt, Human
gggagcagcggcagguggauc

SEQ ID NO: 196837 - RNA, 18 nt, Human
gggagcagcggcugggag

SEQ ID NO: 196838 - RNA, 32 nt, Human
gggagcagcggggagcuugcagugaccaagag

SEQ ID NO: 196839 - RNA, 22 nt, Human
gggagcagcuaaagaugagagg

SEQ ID NO: 196840 - RNA, 32 nt, Human
gggagcagcuacugggcugggcugcggaagcu

SEQ ID NO: 196841 - RNA, 32 nt, Human
gggagcagcuaggaagagagaggcaagcuuuc

SEQ ID NO: 196842 - RNA, 17 nt, Human
gggagcagcuccaggca

SEQ ID NO: 196843 - RNA, 21 nt, Human
gggagcagcugagaaaggagg

SEQ ID NO: 196844 - RNA, 19 nt, Human
gggagcagcugagcugcag

SEQ ID NO: 196845 - RNA, 32 nt, Human
gggagcagcugaugccucacuacuaaugcagu

SEQ ID NO: 196846 - RNA, 19 nt, Human
gggagcagcugggcaagga

SEQ ID NO: 196847 - RNA, 18 nt, Human
gggagcagcugggcacgg

SEQ ID NO: 196848 - RNA, 20 nt, Human
gggagcagcugggcacuggg

SEQ ID NO: 196849 - RNA, 32 nt, Human
gggagcagcuugguccaugugccuucaggggg

SEQ ID NO: 196850 - RNA, 32 nt, Human
gggagcaggagaagaagauacgggagcaggag

SEQ ID NO: 196851 - RNA, 32 nt, Human
gggagcaggagagagaggguaggcuaggggug

SEQ ID NO: 196852 - RNA, 32 nt, Human
gggagcaggagguugcagugagccgaggucgu

SEQ ID NO: 196853 - RNA, 32 nt, Human
gggagcaggauggagagcaggaugaagucagc

SEQ ID NO: 196854 - RNA, 24 nt, Human
gggagcaggccgcagggcgcggag

SEQ ID NO: 196855 - RNA, 18 nt, Human
gggagcagggccaggagg

SEQ ID NO: 196856 - RNA, 32 nt, Human
gggagcagggccugagacugcccaccugagug

SEQ ID NO: 196857 - RNA, 20 nt, Human
gggagcagggcgcggggcgg

SEQ ID NO: 196858 - RNA, 32 nt, Human
gggagcagggcugaggggcgaagaggacaugu

SEQ ID NO: 196859 - RNA, 32 nt, Human
gggagcagggcugaggguaggggcugaaugug

SEQ ID NO: 196860 - RNA, 19 nt, Human
gggagcaggggaccguaga

SEQ ID NO: 196861 - RNA, 32 nt, Human
gggagcaggggaggggucaguagcagaagcag

SEQ ID NO: 196862 - RNA, 32 nt, Human
gggagcaggggcaccucuggaggcaggagagg

SEQ ID NO: 196863 - RNA, 22 nt, Human
gggagcaggguucuccucaaag

SEQ ID NO: 196864 - RNA, 19 nt, Human
gggagcagguggcuggaga

SEQ ID NO: 196865 - RNA, 32 nt, Human
gggagcagguuagagggacaaagagcuuugca

SEQ ID NO: 196866 - RNA, 32 nt, Human
gggagcagguuucugccccaacgccugcccug

SEQ ID NO: 196867 - RNA, 32 nt, Human
gggagcaguagagagagaaaaagagggggugc

SEQ ID NO: 196868 - RNA, 32 nt, Human
gggagcagugacugaauaaacacgagcugugg

SEQ ID NO: 196869 - RNA, 32 nt, Human
gggagcaguggcugaguagcucugccuuugcu

SEQ ID NO: 196870 - RNA, 32 nt, Human
gggagcaguuucugccccuccugccccgucag

SEQ ID NO: 196871 - RNA, 32 nt, Human
gggagcauaugcugggaaaugggagcacagua

SEQ ID NO: 196872 - RNA, 32 nt, Human
gggagcaucaccaacuccagacuggcuccugu

SEQ ID NO: 196873 - RNA, 31 nt, Human
gggagcaucaggcuccucaugccaagagauc

SEQ ID NO: 196874 - RNA, 19 nt, Human
gggagcaucuccagugcuc

SEQ ID NO: 196875 - RNA, 21 nt, Human
gggagcaucucuggaucgggg

SEQ ID NO: 196876 - RNA, 32 nt, Human
gggagcaugauaggauuuggggcagagggaca

SEQ ID NO: 196877 - RNA, 19 nt, Human
gggagcaugcccucagcga

SEQ ID NO: 196878 - RNA, 32 nt, Human
gggagcauggcucagcaccagagcagaggccc

SEQ ID NO: 196879 - RNA, 31 nt, Human
gggagcaugggcaggaggaugcggggcgccg

SEQ ID NO: 196880 - RNA, 32 nt, Human
gggagccaagcccggcuugagagcagagccgg

SEQ ID NO: 196881 - RNA, 32 nt, Human
gggagccaaggugacacuucacugugaagccc

SEQ ID NO: 196882 - RNA, 22 nt, Human
gggagccaaguggucuugcuca

SEQ ID NO: 196883 - RNA, 32 nt, Human
gggagccacaggugccugcuucucccaucccc

SEQ ID NO: 196884 - RNA, 32 nt, Human
gggagccacugcacccggccugaaugaugacu

SEQ ID NO: 196885 - RNA, 32 nt, Human
gggagccacugcaccuggcucuugcacuuguu

SEQ ID NO: 196886 - RNA, 32 nt, Human
gggagccacugcacuggccuucauugucuuuu

SEQ ID NO: 196887 - RNA, 32 nt, Human
gggagccacugcauccagcacauggggugccu

SEQ ID NO: 196888 - RNA, 20 nt, Human
gggagccagaaaccacccag

SEQ ID NO: 196889 - RNA, 32 nt, Human
gggagccagacuauaaggaauaaaaggaaaaa

SEQ ID NO: 196890 - RNA, 32 nt, Human
gggagccagaguggaggucggugaaauaaagu

SEQ ID NO: 196891 - RNA, 32 nt, Human
gggagccagaucucaugaguaaaaauccauuu

SEQ ID NO: 196892 - RNA, 32 nt, Human
gggagccagccugccaagagccgccugggccu

SEQ ID NO: 196893 - RNA, 32 nt, Human
gggagccagccugucccaugccugccugggga

SEQ ID NO: 196894 - RNA, 32 nt, Human
gggagccagcgcucaaggcagcucccuagggc

SEQ ID NO: 196895 - RNA, 21 nt, Human
gggagccagcuugcugggaga

SEQ ID NO: 196896 - RNA, 21 nt, Human
gggagccaggagagagacaga

SEQ ID NO: 196897 - RNA, 31 nt, Human
gggagccaggagagagacagaaaggggcuga

SEQ ID NO: 196898 - RNA, 32 nt, Human
gggagccaggagagagacagaaaggggcugag

SEQ ID NO: 196899 - RNA, 32 nt, Human
gggagccaggcagggccagggcagcugggugg

SEQ ID NO: 196900 - RNA, 32 nt, Human
gggagccagggaagacuggaaaugcugccgcc

SEQ ID NO: 196901 - RNA, 32 nt, Human
gggagccaggggcugggggagguggaaggggc

SEQ ID NO: 196902 - RNA, 32 nt, Human
gggagccagguucucccugccaaaaagggggc

SEQ ID NO: 196903 - RNA, 32 nt, Human
gggagccaucuuggaagcagauccuccagccu

SEQ ID NO: 196904 - RNA, 32 nt, Human
gggagccauggccgaagggggagaaggaggcg

SEQ ID NO: 196905 - RNA, 28 nt, Human
gggagcccaagugcagugccuggugcug

SEQ ID NO: 196906 - RNA, 20 nt, Human
gggagcccacaggccugcag

SEQ ID NO: 196907 - RNA, 23 nt, Human
gggagcccagagcaggaggcaga

SEQ ID NO: 196908 - RNA, 32 nt, Human
gggagcccaggcagaggaggcaccgagaguga

SEQ ID NO: 196909 - RNA, 32 nt, Human
gggagcccaggccaggcagggagcagaugcag

SEQ ID NO: 196910 - RNA, 32 nt, Human
gggagcccagggguuaggaagggaagauaaac

SEQ ID NO: 196911 - RNA, 32 nt, Human
gggagcccagugccagccagagguugugcagg

SEQ ID NO: 196912 - RNA, 32 nt, Human
gggagcccaucuuacagcggugccaagcagag

SEQ ID NO: 196913 - RNA, 32 nt, Human
gggagccccaaaaccuaccacucgcguguucc

SEQ ID NO: 196914 - RNA, 32 nt, Human
gggagccccaaagcauaaccaguguccagagg

SEQ ID NO: 196915 - RNA, 32 nt, Human
gggagccccaccccuucuaaauugguaggcag

SEQ ID NO: 196916 - RNA, 32 nt, Human
gggagccccaggcuggagcagcaugaggccca

SEQ ID NO: 196917 - RNA, 32 nt, Human
gggagccccugcccucuguggcacaucggagu

SEQ ID NO: 196918 - RNA, 23 nt, Human
gggagcccgcccgcugcgcugag

SEQ ID NO: 196919 - RNA, 21 nt, Human
gggagcccgcgucgcgcggag

SEQ ID NO: 196920 - RNA, 21 nt, Human
gggagcccggcgagggcgccg

SEQ ID NO: 196921 - RNA, 17 nt, Human
gggagcccggggccugc

SEQ ID NO: 196922 - RNA, 32 nt, Human
gggagcccucaccucugccucaagccucccgu

SEQ ID NO: 196923 - RNA, 32 nt, Human
gggagcccucauugccuuccugggcaacccgg

SEQ ID NO: 196924 - RNA, 32 nt, Human
gggagcccucccccgcugcagcccucucagaa

SEQ ID NO: 196925 - RNA, 32 nt, Human
gggagcccugacucccagaggcugccaccggg

SEQ ID NO: 196926 - RNA, 21 nt, Human
gggagcccugcacccccggga

SEQ ID NO: 196927 - RNA, 32 nt, Human
gggagcccugcucggcccugaaucaccuucgu

SEQ ID NO: 196928 - RNA, 32 nt, Human
gggagcccuggacgagggugacggggaaagcg

SEQ ID NO: 196929 - RNA, 32 nt, Human
gggagcccuguaucacacggggcaggcggguu

SEQ ID NO: 196930 - RNA, 32 nt, Human
gggagccgaaagcaucuugaccacgcagccgc

SEQ ID NO: 196931 - RNA, 32 nt, Human
gggagccgaagucggagcaggagccaugggcg

SEQ ID NO: 196932 - RNA, 32 nt, Human
gggagccgacuggaagaagggcucuagggagg

SEQ ID NO: 196933 - RNA, 32 nt, Human
gggagccgagagaagggacuuugcugucaggu

SEQ ID NO: 196934 - RNA, 25 nt, Human
gggagccgagcccgcugggcugcgg

SEQ ID NO: 196935 - RNA, 32 nt, Human
gggagccgaggccgcaccacugcacuccagcc

SEQ ID NO: 196936 - RNA, 32 nt, Human
gggagccgaguuaacccugcgugucuguguca

SEQ ID NO: 196937 - RNA, 32 nt, Human
gggagccgcacuccagacuggcccgguaguca

SEQ ID NO: 196938 - RNA, 32 nt, Human
gggagccgccgugaugagcacagccaacccag

SEQ ID NO: 196939 - RNA, 21 nt, Human
gggagccgccuccccuacuca

SEQ ID NO: 196940 - RNA, 20 nt, Human
gggagccggccggccugcgg
